United States Patent 9,624,556 (VIRAL AND VIRAL ASSOCIATED MIRNAS AND USES THEREOF) - sequence listing, part 12

SEQ ID NO: 335045 - RNA, 64 nt, Human
aucuagaggcaagaguucagugagggccaagggggacccccagaaaaagguauggagcuaacuc

SEQ ID NO: 335046 - RNA, 64 nt, Human
aaggaguuugagaccagcuuagccaacauaguaagacccccaucucuuuaaaaaaaaaaaaaaa

SEQ ID NO: 335047 - RNA, 64 nt, Human
ucagacccaggaccucagacuucuggcucacacagacccccacgcucuccauccccggaaucua

SEQ ID NO: 335048 - RNA, 64 nt, Human
agaugggcaaggcgcugagggaggaugcuuaggggacccccagaaacaggagucaggaaaauga

SEQ ID NO: 335049 - RNA, 64 nt, Human
uuaugugcaucauagugauuuaucugagcuuagugacccccaucuuguaaccuguugcaagagu

SEQ ID NO: 335050 - RNA, 64 nt, Human
uuccccuggauuuagugaaaugccguaugcaguggacccccaaaaguacaagggcauauuuaac

SEQ ID NO: 335051 - RNA, 64 nt, Human
guguucuuaaucagauggaaccacacccaaaauggacccccacuaccuucccagaccauauauc

SEQ ID NO: 335052 - RNA, 64 nt, Human
cccacuaguccaacuucauggcugcacguggauggacccccaugucugagaggggugaaagagg

SEQ ID NO: 335053 - RNA, 64 nt, Human
ggccugccugcaccccggggaggcgcccaccccggacccccaccccuccgcacugugaaagacu

SEQ ID NO: 335054 - RNA, 64 nt, Human
ggcuccccucaccaggacagucacccccaaacuugacccccaacauuucaaugcacagaaggga

SEQ ID NO: 335055 - RNA, 62 nt, Human; identical to SEQ ID NO: 278625

SEQ ID NO: 335056 - RNA, 62 nt, Human; identical to SEQ ID NO: 278626

SEQ ID NO: 335057 - RNA, 62 nt, Human; identical to SEQ ID NO: 278662

SEQ ID NO: 335058 - RNA, 62 nt, Human; identical to SEQ ID NO: 278663

SEQ ID NO: 335059 - RNA, 64 nt, Human
uuuuucuuuuaaaauugaauucauucugaugcuugacccccauacucccaaccuuguccagugg

SEQ ID NO: 335060 - RNA, 64 nt, Human
ggagaggacccugagaggagacgggcugggcggcgacccccacagggcucucgagaacagauuc

SEQ ID NO: 335061 - RNA, 64 nt, Human
cgguguccuuuucacuacaccauguuugagcucagacccccacucucauuccccagguggcuga

SEQ ID NO: 335062 - RNA, 64 nt, Human
guguggaccaaggagcuuccaucuagugacaagugacccccagcuaucgccucuugccuucccc

SEQ ID NO: 335063 - RNA, 64 nt, Human
gguuccagagagaagcuagaagucccccuugaaugacccccagagccccucugagaagggcugg

SEQ ID NO: 335064 - RNA, 64 nt, Human
cagcugcuccucggcugggcgccgagggggggccgacccccaucuccaccccgcgggcucucca

SEQ ID NO: 335065 - RNA, 64 nt, Human
aaccagggucaucugcacuugaugacugcuccccgacccccagcccggacaccucauuccccuc

SEQ ID NO: 335066 - RNA, 64 nt, Human
caaacacgcacggcacugaccccaccuccgcccggacccccacagaccucgggaaggcgcuggg

SEQ ID NO: 335067 - RNA, 64 nt, Human
caggaguucaagaccagccugggcaacauagggagacccccaucuuuacaaagaaaaaaaaaag

SEQ ID NO: 335068 - RNA, 64 nt, Human
ggcucucagaggguccgugcauuccugcucuccggacccccaaagggcccagcauuggugggug

SEQ ID NO: 335069 - RNA, 64 nt, Human
cccgccugccuggccgcaggugguucucccugaagacccccacaugugccauaucccugugggc

SEQ ID NO: 335070 - RNA, 64 nt, Human
ggcaccaggcucccuggcacggccuaacucugcggacccccauccugcugggggccuagaaccc

SEQ ID NO: 335071 - RNA, 64 nt, Human
cuucagccuguuuccccagccacaggccugcuacgacccccacgaugugccgcaagcacugucu

SEQ ID NO: 335072 - RNA, 64 nt, Human
ugcaacuggcagggccugaucagaggcagaaaaugacccccacaguggucuuuucccugcuaga

SEQ ID NO: 335073 - RNA, 64 nt, Human
uaguccccacuuaucugagggggauacauucaaagacccccagcagaugccugaaacgguggac

SEQ ID NO: 335074 - RNA, 64 nt, Human
cugugaggcgaugcuguuccaucugcacaugaaggacccccauacagccugucucccaccccug

SEQ ID NO: 335075 - RNA, 62 nt, Human; identical to SEQ ID NO: 278656

SEQ ID NO: 335076 - RNA, 62 nt, Human; identical to SEQ ID NO: 278657

SEQ ID NO: 335077 - RNA, 64 nt, Human
uugaacuggucccacacgcaccccaggccccacuccucggcaguuucagguguagcuguggggc

SEQ ID NO: 335078 - RNA, 64 nt, Human
gcguuggaucuacuggaaugagcagcagccgcuuccucggcagccuugggaagcacgggcgacu

SEQ ID NO: 335079 - RNA, 64 nt, Human
ccacuuucucauccgaagaugguggccacagacugacccccaucugagcuggggggauguucug

SEQ ID NO: 335080 - RNA, 64 nt, Human
aggggguggccuugaggcagagccgugccucacugacccccaggggccucauccuccccaugga

SEQ ID NO: 335081 - RNA, 64 nt, Human
aucccaaguuacaagaacuucagugagacuaagggacccccauccuagggaucuugucaggguu

SEQ ID NO: 335082 - RNA, 64 nt, Human
guggccauagucagucaccaugugugggcucagggacccccaggaccaggaugugucucagccu

SEQ ID NO: 335083 - RNA, 64 nt, Human
uaaaucccuuaaacccagacaucuucugggaccugacccccaauaauugguuaccaguguguca

SEQ ID NO: 335084 - RNA, 64 nt, Human
cacagcugggggugcagagcccaccuggguaccugacccccaggggaugaaaaugcaaggauga

SEQ ID NO: 335085 - RNA, 64 nt, Human
ggucuucccucucagauucaccuggaggcccucagacccccagggugcacgucuccccaggucc

SEQ ID NO: 335086 - RNA, 64 nt, Human
aauuguuuuuaauccucugacaaguugacucuucgacccccacccccacccaagacauuuuaau

SEQ ID NO: 335087 - RNA, 64 nt, Human
cagaugaccccacacccuacucaauuaagacauggacccccaaugcauucauauuugccaagcc

SEQ ID NO: 335088 - RNA, 64 nt, Human
uaguccccccuuaucuucaggauauauguuccaagacccccaguggaugcuggaaaccagggau

SEQ ID NO: 335089 - RNA, 64 nt, Human
cuggcgagcaggcuucuuggauggacagugcugagacccccauaucccagaguccccagccucc

SEQ ID NO: 335090 - RNA, 64 nt, Human
augguggacagugggauucuggaaacuuguuugggacccccaaggguuaaagccacccagcauu

SEQ ID NO: 335091 - RNA, 64 nt, Human
cugcccuggaggaaguuguggggagauccacugggacccccaacauucugcccucaccucugug

SEQ ID NO: 335092 - RNA, 64 nt, Human
ccccuccucagagcccacccugagaggcagcagugacccccauggcacacaccugccaacagca

SEQ ID NO: 335093 - RNA, 64 nt, Human
uaguggacuggccaguucauagcagcacugugaggacccccaaguuggacgugcucggagggaa

SEQ ID NO: 335094 - RNA, 63 nt, Human
ugaccgagaaguaccgcugagcgccgccuccgggacccccaggacaggcugcggccccucccc

SEQ ID NO: 335095 - RNA, 64 nt, Human
cgcgccuguaaucccagcuacucaggaggcugaggcagaugaauugcuugaauccaggaggcag

SEQ ID NO: 335096 - RNA, 64 nt, Human
ggugcaggugguggggagacagauggagaagcuggcagaugaagggugggggcugcggauccca

SEQ ID NO: 335097 - RNA, 64 nt, Human
ccuguaaucucagcacuuuggguggccaaggcgggcagaugacuugaggucaggaguucgagac

SEQ ID NO: 335098 - RNA, 64 nt, Human
gugucuccccuaccucccucaguuguugcacagggacccccaagcauccccagcaccccccgug

SEQ ID NO: 335099 - RNA, 64 nt, Human
cucccagggcucccuggcccaguacagcugugcggacccccaguggcauguccuccgaguggca

SEQ ID NO: 335100 - RNA, 64 nt, Human
cuuaugcugccaugcacugcccuggcuccugccggacccccagggugggccguggcagguggcu

SEQ ID NO: 335101 - RNA, 64 nt, Human
gccccgagggguggccuugcccugcucccccggggacccccaggcugaggguucugccgcgggc

SEQ ID NO: 335102 - RNA, 64 nt, Human
ugcucucuggaccccacgugaucuggccacuggggacccccacccgaccccacucccaaugaug

SEQ ID NO: 335103 - RNA, 64 nt, Human
uuuugcucauccaccuucacaccacuugugagcugacccccaggaacagcuuggcuguuccacc

SEQ ID NO: 335104 - RNA, 64 nt, Human
caagaguuugagaucagccuggagaacaaagugagacccccaucuauuaaaaaaagaaaaaaaa

SEQ ID NO: 335105 - RNA, 64 nt, Human
ggcagacucccggccugggcccccaggauucuaggacccccaggcagccccuuggacugguccc

SEQ ID NO: 335106 - RNA, 64 nt, Human
cuguuccucccucaucuccucugccugugucugcgacccccauccaugugccaaagugucccuu

SEQ ID NO: 335107 - RNA, 64 nt, Human
uggcccgggccuauggugucccaguaaagccaaugacccccaagguggucacucucugguaagu

SEQ ID NO: 335108 - RNA, 51 nt, Human
augaacaagccgugcagugaggacccccaagaggcccauuucccccaauaa

SEQ ID NO: 335109 - RNA, 64 nt, Human
cauaauacacaaaggccagggagccuuuggcuuggacccccagggagcuauugaaacuuuuaaa

SEQ ID NO: 335110 - RNA, 64 nt, Human
cguccugcccucagcccggcccuggccccuucccgacccccacccgccauucagaccccauuaa

SEQ ID NO: 335111 - RNA, 64 nt, Human
cugagcugucgcugccuccauggcagcagccagggacccccagaacaagaagaccccgcaggau

SEQ ID NO: 335112 - RNA, 64 nt, Human
agcagcacugccacugccuuuggccaccugaggugacccccaggccuccccggccuuguacagu

SEQ ID NO: 335113 - RNA, 64 nt, Human
ggcccccagugaucucgacuccccccuggccacagacccccagggcauuguguucacuguacuc

SEQ ID NO: 335114 - RNA, 64 nt, Human
gagaguugguuuggaccaauucccugguuuuccagcagaugaaacaggcccaaagagguuaaau

SEQ ID NO: 335115 - RNA, 64 nt, Human
acgucaacugccugcucugcaaggccauccaugagcagaugaacugcaaggaguaucaggagga

SEQ ID NO: 335116 - RNA, 64 nt, Human
gacuugcucucaagccucauccagagaaggagcugcagaugagggagcccguacacucccugcc

SEQ ID NO: 335117 - RNA, 64 nt, Human
gccugcccuucacccaggccccguccccgaggccgacccccagcucaagcgcuggggccugcug

SEQ ID NO: 335118 - RNA, 64 nt, Human
cucagccuuggugcucaguggucccgaggcccuagacccccaccccccgccaguugcuuugucu

SEQ ID NO: 335119 - RNA, 64 nt, Human
accaucccccacuccuuggguauccccaaccccagacccccaucacuugaugggccacacaagu

SEQ ID NO: 335120 - RNA, 64 nt, Human
cucagggcccugugccaggccaaagauccccccagacccccauucugacauccacaugcucugc

SEQ ID NO: 335121 - RNA, 64 nt, Human
accaccuguccagcuucuuccuggucagggcugggacccccaggaauauuauguugccgugugu

SEQ ID NO: 335122 - RNA, 64 nt, Human
ugcugcuuaccccuagccuugaugccugcccagggacccccagcccccucccguugcccugcag

SEQ ID NO: 335123 - RNA, 64 nt, Human
ccggaguuggagaccagccagagcaacacagugagacccccaucucuacaaaaauaaagaaaau

SEQ ID NO: 335124 - RNA, 64 nt, Human
uucagaucuguuaccauugggaugauaaccugaggacccccacuggaaaucucccaucuuuuga

SEQ ID NO: 335125 - RNA, 64 nt, Human
cugcaugaaucucguggggggucccugcccuugcgacccccagauaccuccacuugcuaccgag

SEQ ID NO: 335126 - RNA, 64 nt, Human
agccaagucagcuuugccuuccacgcugucuccagacccccaccccuuccccacugccugccca

SEQ ID NO: 335127 - RNA, 64 nt, Human
cuuuuggcccccgagcugggggccaugagcuccagacccccagcaacccuccuaucaccucccc

SEQ ID NO: 335128 - RNA, 64 nt, Human
acggauccagcaauuccugagccaagaggaacuugacccccagaguguggaaagaaagaccauc

SEQ ID NO: 335129 - RNA, 64 nt, Human
gcccaguggguagacagcuacuacacaagccuuugacccccaugcugcuuccugagagucuuuu

SEQ ID NO: 335130 - RNA, 64 nt, Human
agggaggaaaaaaaaagaaggaaaaggaauuauagacccccagggucagccaguuaagagcucu

SEQ ID NO: 335131 - RNA, 64 nt, Human
gucccccugcccagaauggagcagcagcaggacagacccccacgaggccccccagagaggagga

SEQ ID NO: 335132 - RNA, 64 nt, Human
agcugccuauguaaggccuucuaguuuguucugagacccccaccccacgaaccaaauccaaaua

SEQ ID NO: 335133 - RNA, 64 nt, Human
cugaauagcuccuucggccccaucuccauccucagcagaugacacugauuggccucacggggac

SEQ ID NO: 335134 - RNA, 64 nt, Human
cagugacccugcgaggcaaggguuugcccaguuugcagaugagaaacccaaagcugagagaggu

SEQ ID NO: 335135 - RNA, 64 nt, Human
uccauugcucuuggcuucaugguguuccuggaaggcagaugagcuggucauuucgccugggacu

SEQ ID NO: 335136 - RNA, 64 nt, Human
uguggcccuccuggggcaaggguggacagacucagacccccagcaugguuagcgcugaccuuca

SEQ ID NO: 335137 - RNA, 64 nt, Human
cguggcauuugcugaccgaaugcucauagagguugacccccacagggucacgcaggacucggac

SEQ ID NO: 335138 - RNA, 64 nt, Human
aggcacaguccacccagauccaccuuuccagcaagacccccaguggcugcccagccugggagca

SEQ ID NO: 335139 - RNA, 64 nt, Human
ccaguccagggcagggaaauauuggcccuaucuugacccccaaauccagugagcuccagauucu

SEQ ID NO: 335140 - RNA, 64 nt, Human
aaacugccccagcuucucccaccauagggggccggacccccaucaccagccuaggauccagggg

SEQ ID NO: 335141 - RNA, 64 nt, Human
aauaggggagauguuuuguuggugucucugaggggacccccaugaggcugcuuuugugaguguu

SEQ ID NO: 335142 - RNA, 64 nt, Human
caccuggcgccacagaggaagcugccugccggaggacccccaccugagagauggaugagcugcu

SEQ ID NO: 335143 - RNA, 64 nt, Human
gauggaggagaugagacggcccgaaguucucucugacccccaccucgacucggccucugccagc

SEQ ID NO: 335144 - RNA, 64 nt, Human
aaaaaaaaaaacuuaagauggacacagcugacuggacccccauccugccucacccaugggugcu

SEQ ID NO: 335145 - RNA, 64 nt, Human
gucugucccucuucagccaagcccaagucuccuagacccccagggagccagugaacugucaccu

SEQ ID NO: 335146 - RNA, 64 nt, Human
uggccccugacuucacugcugucccgggaacauggacccccaggcuuggcguagguguuugcuu

SEQ ID NO: 335147 - RNA, 64 nt, Human
ggaggggacuuguaggaaucugccuuccagcccagacccccaguguauuuuguccaaguucaca

SEQ ID NO: 335148 - RNA, 64 nt, Human
uuauacacucagccuucccucucccaggcaggaggacccccagacccuguuccccugcagaccu

SEQ ID NO: 335149 - RNA, 64 nt, Human
cagcggcaaccccaaagcaccuguuaagacuccugacccccaaguggcaugcagcccccaugcc

SEQ ID NO: 335150 - RNA, 64 nt, Human
ucacagugcccuccccacagcacuaccucaccccgacccccacccucacuccuaccccaccccg

SEQ ID NO: 335151 - RNA, 64 nt, Human
cuuggauuugcauauuuauugcauugcugguagagacccccaggccuguccacccugccaagac

SEQ ID NO: 335152 - RNA, 64 nt, Human
ugggcagugucaggcaggacucacucaccgcugagcagaugagggaaguuuuagucuuggcggg

SEQ ID NO: 335153 - RNA, 64 nt, Human
gugcuggagaaucugguaaaagcaccauugugaagcagaugaggauccugcauguuaauggguu

SEQ ID NO: 335154 - RNA, 64 nt, Human
cucagcugcugacacgcagccugcucuggagccugcagaugagauccgggagacugacacgaag

SEQ ID NO: 335155 - RNA, 64 nt, Human
ccagcacagcugacaagucccagaagcagucccugacccccagcuuucagagcccagccaccag

SEQ ID NO: 335156 - RNA, 64 nt, Human
gugcaagugucugagagauacugcaucagcccuagacccccagagccagucccgcccuuuacag

SEQ ID NO: 335157 - RNA, 64 nt, Human
agagaggaaccaccacacccagcagcuccugacagacccccaccccuaaagauguguccugaug

SEQ ID NO: 335158 - RNA, 64 nt, Human
gcggaggggccgcuccaggccccacagagcaggagacccccagagaaagccggggcuggcagga

SEQ ID NO: 335159 - RNA, 64 nt, Human
gcuccuaaacuuggccauucccaggaggcuuggagacccccagauaaccauaacagggaagcag

SEQ ID NO: 335160 - RNA, 64 nt, Human
caagagguuguagcauggagggcccggcaucgcugacccccacgccgagggcuugccguuuucc

SEQ ID NO: 335161 - RNA, 64 nt, Human
uccagaaucauguggaggggccagaggccugccagacccccagcugggcccugcucaccccuug

SEQ ID NO: 335162 - RNA, 64 nt, Human
aggaggggugguagccguucccaccucgcagcaggacccccagugcagaggcucacagguggca

SEQ ID NO: 335163 - RNA, 64 nt, Human
acucagccccgagaccacccaaccucacccuccugacccccauguaaauauuguucugcugucu

SEQ ID NO: 335164 - RNA, 64 nt, Human
cacagggacucgugggagcaagcgaggcucccaggacccccacccucugggacaggcccucccc

SEQ ID NO: 335165 - RNA, 64 nt, Human
ccagauccggccucaggacuuacaccuccugccugacccccaggcuucucucuccuuucuccca

SEQ ID NO: 335166 - RNA, 64 nt, Human
ggaguugguagacagcaagggaagggucccuggagacccccagccaaacgggucagugucucau

SEQ ID NO: 335167 - RNA, 64 nt, Human
accucauacaucaagccaauaccguguggcccaagacccccaccauaaaucacaucauuagcau

SEQ ID NO: 335168 - RNA, 64 nt, Human
acuagcuacuccacgaagcccccgagccucgccagacccccagggggccucugacgcucgugac

SEQ ID NO: 335169 - RNA, 64 nt, Human
cccccacucaagcaauagggccccgccauaggaagacccccagagagagggucagcaggggggc

SEQ ID NO: 335170 - RNA, 64 nt, Human
ucccuuccuggccacgaauggcagcguccuccccgacccccagucugggcgcuucugggagggc

SEQ ID NO: 335171 - RNA, 64 nt, Human
aagcugccuuucccuuugcccuaagcagacagcugcagaugagagggucagcaucuccacuagu

SEQ ID NO: 335172 - RNA, 64 nt, Human
cugagcaugaaucuccagacccgcugcucccagugcagaugaggccacaccuguacacucccug

SEQ ID NO: 335173 - RNA, 64 nt, Human; identical to SEQ ID NO: 335172

SEQ ID NO: 335174 - RNA, 64 nt, Human
cuaagggacagacugccuccucaagugggucccugacccccaugccuccugacggggagacacc

SEQ ID NO: 335175 - RNA, 64 nt, Human
agaugcugcuucaggcgccgccacugggccccgggacccccacggcgcugcccgaugacaugaa

SEQ ID NO: 335176 - RNA, 64 nt, Human
ccccuuuccuagccccuagaggcggacacacagcgacccccaucccugcaggacaaacgccccu

SEQ ID NO: 335177 - RNA, 64 nt, Human
cagggcgcccccccacccccgcccgguccaccuagacccccacguuuggagauucaaaacuucu

SEQ ID NO: 335178 - RNA, 64 nt, Human
ugccgccuuccuucacggcacuuacaaccggcgggacccccagggaccaccccucagggcgccc

SEQ ID NO: 335179 - RNA, 64 nt, Human
cucugccccucccgggcggaccuccugaggccuggacccccagugggcagggcaggagguggca

SEQ ID NO: 335180 - RNA, 64 nt, Human
cgcugagagcgcagacacccuucuucacacccgggacccccagguuuuugcgaaccccagaaga

SEQ ID NO: 335181 - RNA, 64 nt, Human
auggauacagccaggcccagagcaagacccugaagacccccaaccacggccuaaaagccucuuu

SEQ ID NO: 335182 - RNA, 64 nt, Human
uaauaaaauggcgaguuguuuuucaguugucguggacccccagguugcaaguuacauacccugg

SEQ ID NO: 335183 - RNA, 64 nt, Human
aaagaaucauauuaaguacuuuggacugaacaaugacccccaaaauucguaugaugaugaagcu

SEQ ID NO: 335184 - RNA, 64 nt, Human
cuggcccccagguucucugcagagaucucuccuggacccccagcggucuccuuggcgcccacga

SEQ ID NO: 335185 - RNA, 64 nt, Human
ggcaaggucucggggguccggaagggugaucaucgacccccaagggacccgcagacccuuaaaa

SEQ ID NO: 335186 - RNA, 64 nt, Human
uucccggagaccacgcuucuccuccgugccgugcgacccccaccccaugacuauugugcgauuc

SEQ ID NO: 335187 - RNA, 64 nt, Human
agucugugacgcugacuuuccagcacgugaagaugacccccaguaccaaaaaggucuucugugu

SEQ ID NO: 335188 - RNA, 64 nt, Human
caggaguuugagaccagccugggcaacauagcaagacccccaccaucucugaaaaaaaaaauua

SEQ ID NO: 335189 - RNA, 64 nt, Human
cagcucccucagcuccuagagggggaagaggagagacccccaacaaggggacaggacggucacu

SEQ ID NO: 335190 - RNA, 64 nt, Human
guccuguagguccuagaggagccacagcccaggggcagaugaaggggcugcggaagacgggggc

SEQ ID NO: 335191 - RNA, 64 nt, Human
acccagugccccucacggcugccgcaagucugcugcagaugaccucaugaacuggaagggguca

SEQ ID NO: 335192 - RNA, 64 nt, Human
aacgcacgagggaugaguuggagaggaggcugcugcagaugaaagaagaagcaacaauggccaa

SEQ ID NO: 335193 - RNA, 64 nt, Human
ucccccggucauguggcgccuguuucgacgccgggacccccaggagaccaggucuggcucgcgg

SEQ ID NO: 335194 - RNA, 64 nt, Human
ucuccauucucacccaguuccucucuccuucccugacccccacccacauuucccuccuuagaga

SEQ ID NO: 335195 - RNA, 64 nt, Human
gcuguacagucucgcccuuggaagacugagcugggacccccacagccauccgcuggcuuggcca

SEQ ID NO: 335196 - RNA, 64 nt, Human
ggagguuuccugccuccuucccgaggcuacagcagacccccaugagagaaggaggggagcaggc

SEQ ID NO: 335197 - RNA, 64 nt, Human
aaccagaccccaucccccuaagucccuuugucuugacccccaagucuucaaccagauauccucg

SEQ ID NO: 335198 - RNA, 64 nt, Human
agccccuagaagaccccaaugccguaacuccuaggacccccaaaucauggaaucccaaaucccc

SEQ ID NO: 335199 - RNA, 64 nt, Human
uaguccccuauuuucugcaagagauggacucuaagacccccaguggauaccuaaaacccagaua

SEQ ID NO: 335200 - RNA, 64 nt, Human
cucagccucacgggcccucagcacuuuguguuuugacccccagcaccgugucuugugaacuccc

SEQ ID NO: 335201 - RNA, 64 nt, Human
aucugcagcacugugacauguuugugauggccaugacccccacccugaagguuguggguuuacu

SEQ ID NO: 335202 - RNA, 64 nt, Human
ccagaguucaagaccagccugggcaauguaguaagacccccaucgcuacaaaaaauacaaaagu

SEQ ID NO: 335203 - RNA, 64 nt, Human
cccuugguucacacuccauuucccaguuucuguugacccccaccuuccaguguuggacaggaug

SEQ ID NO: 335204 - RNA, 64 nt, Human
cauuccucgguauuuauugucuguccccaccuaggacccccacccccgacccucgcgaauaaaa

SEQ ID NO: 335205 - RNA, 64 nt, Human
ugaccucguccuccgacucgcugacaggcuacaggacccccaacaaccccaauccacguuuugg

SEQ ID NO: 335206 - RNA, 64 nt, Human
uccuccccucuccacagacccagccuccggcugugacccccagccucacaccugccucugguuc

SEQ ID NO: 335207 - RNA, 64 nt, Human
aucugccccaccuccugccauggccaugaaccgcgacccccacuaaauuucuagauuggggaua

SEQ ID NO: 335208 - RNA, 64 nt, Human
caguuaacucuggggacugggaacccaugaaauugacccccaaauacauccugcggaaggaauu

SEQ ID NO: 335209 - RNA, 62 nt, Human; identical to SEQ ID NO: 278668

SEQ ID NO: 335210 - RNA, 62 nt, Human; identical to SEQ ID NO: 278669

SEQ ID NO: 335211 - RNA, 62 nt, Human; identical to SEQ ID NO: 278670

SEQ ID NO: 335212 - RNA, 62 nt, Human; identical to SEQ ID NO: 278671

SEQ ID NO: 335213 - RNA, 64 nt, Human
ucaucacccugacacccccacauucucuccucuggacccccaggaggcuggugccagggagaca

SEQ ID NO: 335214 - RNA, 64 nt, Human
cuugcccccucgucccucuccccaguguuuccaggacccccaauaaaccuuguccugucagucg

SEQ ID NO: 335215 - RNA, 64 nt, Human
uccucuccugugggaaggagaguugacucuugaggacccccacccuccugcauccucucucugg

SEQ ID NO: 335216 - RNA, 64 nt, Human
ggagacaaccccaggggccaacagccccagcugugacccccaggcuuccacaugaacucacaaa

SEQ ID NO: 335217 - RNA, 64 nt, Human
gggccuggcucugcacacccaggaaaagucugcagacccccagcccuccgcaauaauucaccag

SEQ ID NO: 335218 - RNA, 64 nt, Human
aaggcgcggaaaggagaggagcuggggccuuggggacccccagguaguccaugcggcccauucc

SEQ ID NO: 335219 - RNA, 64 nt, Human
aaaaugccgaacgagaaaacuguccauuuucugagacccccagaaaggaaacugacccucagca

SEQ ID NO: 335220 - RNA, 64 nt, Human
aucugggcaccccaggaaccgccauugcccauaagacccccaggaagcuaggcacuuucuuucc

SEQ ID NO: 335221 - RNA, 64 nt, Human
agcuaguuuucuagaauuuaucacacuucugugagacccccacaccucaguucccuuggccuca

SEQ ID NO: 335222 - RNA, 64 nt, Human
gccuauggggaagaacugggagcuccccaacuuggacccccaccuuguggcucugcacaccaag

SEQ ID NO: 335223 - RNA, 64 nt, Human
cagucagucccagaguggggaggaagauaugggugacccccaccccccaucugugagccaagcc

SEQ ID NO: 335224 - RNA, 64 nt, Human
auauccccagggaaacccaucuucacgccugggugacccccacugccgccuccuucuuaacucu

SEQ ID NO: 335225 - RNA, 64 nt, Human
auucaaaaauauuuuuaacauugugagccagcuagacccccagugcaccaccccauauugaaaa

SEQ ID NO: 335226 - RNA, 64 nt, Human
ggacuccagcugggcucggucccccacagucagggacccccauaaaggacacccccuucucucu

SEQ ID NO: 335227 - RNA, 64 nt, Human
gacccaaagccugcacaacccaaccucgcuuagggacccccagagaugcuggaaucgcuaggag

SEQ ID NO: 335228 - RNA, 64 nt, Human
gugugcauuccucacuagaacucauccgacccccgacccccaccuccgggaaaagauucuaaaa

SEQ ID NO: 335229 - RNA, 64 nt, Human
cccggucacucagcgagaaacucaacuccuggcagcagaugacgggcacucugguuaaaugacu

SEQ ID NO: 335230 - RNA, 64 nt, Human
uggaaugugugucuaacuugcucucugacauuuagcagaugaaauaaaauauauaucuguuuag

SEQ ID NO: 335231 - RNA, 64 nt, Human
ucuaggagcacaagagaggagccuguggccccaugcagaugaaaaggacgggcagggucuccug

SEQ ID NO: 335232 - RNA, 64 nt, Human
uagccacugcacuccaucuugggcaacacagugagacccccaucuauaaaaagagagcacugcc

SEQ ID NO: 335233 - RNA, 64 nt, Human
acaccuguaucccuccgugaauaagcaucugguggacccccagauugcacacauagggcagaug

SEQ ID NO: 335234 - RNA, 64 nt, Human
cugaagcagguucccaagcucagaggcgcacugugacccccagcuccggccuguccuccaacac

SEQ ID NO: 335235 - RNA, 64 nt, Human
gugguuaguaggaaucucucauuguucaccaugugacccccaggagguauucgaccugcacugg

SEQ ID NO: 335236 - RNA, 64 nt, Human
ggcuucagccccuugagcagcccauggcuuagcagacccccagauguaggucaguggccuuacc

SEQ ID NO: 335237 - RNA, 64 nt, Human
ggcaguaauccagucccucauagcacuggugaaugacccccagccugagcacccgcuucgggcu

SEQ ID NO: 335238 - RNA, 64 nt, Human
aggagaggccccagaaccccaaagcagacagcgagacccccagcggcagaggccucccucggca

SEQ ID NO: 335239 - RNA, 64 nt, Human
ccaaugcccgggcccuugaggcuguugcuagcgugacccccacuggaccagccccugacccagc

SEQ ID NO: 335240 - RNA, 64 nt, Human
uggggcuucacauuuaugacccugagaacagacugacccccaagaucuccuucccguggaauga

SEQ ID NO: 335241 - RNA, 64 nt, Human
aggcccaagaucacuuggcaagcugggcacccaggacccccaggugcuugacagagucacccca

SEQ ID NO: 335242 - RNA, 50 nt, Human
agccuggggagguguguugagacccccaggccuagacaggcaaggggaug

SEQ ID NO: 335243 - RNA, 64 nt, Human
ucccuggcccucccagcugucugggacuucaguggacccccagccccugcccccacucaccaag

SEQ ID NO: 335244 - RNA, 64 nt, Human
ugcgcugauacguuucuuacacugggccauuuuagacccccagggaaacagccuuccuggagcg

SEQ ID NO: 335245 - RNA, 64 nt, Human
cuacccguguugggacacgugaggauacagccuugacccccaggggcugacauucuagggggag

SEQ ID NO: 335246 - RNA, 64 nt, Human
cucgaaugugugggcccaaggcccccaccucugugacccccauguccuuggaccuagaggauug

SEQ ID NO: 335247 - RNA, 64 nt, Human
cagccaggaccccaucugccacccccgcagcagugacccccacccagggccaggccuaagaggc

SEQ ID NO: 335248 - RNA, 62 nt, Human; identical to SEQ ID NO: 278652

SEQ ID NO: 335249 - RNA, 62 nt, Human; identical to SEQ ID NO: 278653

SEQ ID NO: 335250 - RNA, 62 nt, Human; identical to SEQ ID NO: 278672

SEQ ID NO: 335251 - RNA, 62 nt, Human; identical to SEQ ID NO: 278673

SEQ ID NO: 335252 - RNA, 64 nt, Human
agagaauuccucuauuuguucagaucucauagaugacccccagguauugucuuuugacauccag

SEQ ID NO: 335253 - RNA, 64 nt, Human
gggaggggucagugacucugggggucuccucagugacccccauaccucaucaugaacccuuggg

SEQ ID NO: 335254 - RNA, 64 nt, Human
gaguccaguggggcugagccccuugcccccgacugacccccacguggucacuuuucucaucagu

SEQ ID NO: 335255 - RNA, 64 nt, Human
cuucaccccuuuauuccagcugccugccaccccagacccccaccucccacccugacccccgacc

SEQ ID NO: 335256 - RNA, 64 nt, Human
gagccggcaggagguggccccugcccucccucuggacccccagccaggggcuuggaaaucaaau

SEQ ID NO: 335257 - RNA, 64 nt, Human
aagacuuggagaaaaggaaagcuccaucaaagaggacccccagccagcccgguucucggacgug

SEQ ID NO: 335258 - RNA, 64 nt, Human
ccccgugcuuccccgggccuucgccuuccccguggacccccagguccagucugccgcugaugag

SEQ ID NO: 335259 - RNA, 64 nt, Human
caggaguucgagaccagccuggacaacauagugagacccccaucucuaaauaaaaauagaccaa

SEQ ID NO: 335260 - RNA, 64 nt, Human
gcccucucucuacuccuugacccccuccauccuugacccccaacaccucaacacacacacacac

SEQ ID NO: 335261 - RNA, 64 nt, Human
agggcuucaggcccgaaggucucucuggcucuaggacccccagugcucacacaaucagaccaag

SEQ ID NO: 335262 - RNA, 64 nt, Human
cccccagugcucacacaaucagaccaaggaacaagacccccaggaaggaaacagauuuaagcaa

SEQ ID NO: 335263 - RNA, 64 nt, Human
gagccaaaggccaaagugcccaacucuuugggaugacccccaagccuccaacauccugucuuuc

SEQ ID NO: 335264 - RNA, 64 nt, Human
uugugcaggcaaggagaccaaagauugaugagaagacccccagcagggguacuggguacccggc

SEQ ID NO: 335265 - RNA, 64 nt, Human
guugaacccagggaagaaccugcugaaaaccgaugacccccagcauugaaauggacucugagau

SEQ ID NO: 335266 - RNA, 64 nt, Human
ugguuuauagaggugucuuauuucuaaugcaacagacccccaacuuuaacagauuugauaugga

SEQ ID NO: 335267 - RNA, 64 nt, Human
ucccucucaggcagaugccgaggccaaguggacugacccccagauuuccuucccuuggaugcuu

SEQ ID NO: 335268 - RNA, 64 nt, Human
cagguacugcuugugcagguggauuugagguuaggcagaugaugcuguccaucccguacaccag

SEQ ID NO: 335269 - RNA, 64 nt, Human
ugaggagaaggaaagccgauucuuuggaaguucagcagaugaaagcccaggccagggaggagaa

SEQ ID NO: 335270 - RNA, 64 nt, Human
ucaccugggcgcuggagguggcuuuggcccuguagcagaugauggcuauggaguuuccuacaug

SEQ ID NO: 335271 - RNA, 64 nt, Human
agccaaagacuucauccggcaccuucuggagcgagacccccagaagagguucaccugccaacag

SEQ ID NO: 335272 - RNA, 64 nt, Human
augaauuuuacauccaaagggggauaggcacuuggacccccauucuccaaggcccgggggggcg

SEQ ID NO: 335273 - RNA, 64 nt, Human
ccucacucuuccucauccugcuucucuuuuccucgcagaugauaaaaggaaucuggcauucuac

SEQ ID NO: 335274 - RNA, 64 nt, Human
gcuggguagcaggacuccagggcgugcacggugagcagaugaggccccaagcucaucacaccag

SEQ ID NO: 335275 - RNA, 64 nt, Human
aaacguucccaaacucccccagcccuggaccccagcagaugaggaaacggccccauuuacugac

SEQ ID NO: 335276 - RNA, 64 nt, Human
agaacagguggcugagcuguggggccggggugaccggaucgaaucucucagcgaccaggugcug

SEQ ID NO: 335277 - RNA, 64 nt, Human
cagauaguuagaauuguaacaucuaaaccugccacggaucgaaugguacuuacagguaccucuc

SEQ ID NO: 335278 - RNA, 64 nt, Human
uguagggagagagcugaguaggaggccuccacuccggaucgaggccuguauagggcucguuucc

SEQ ID NO: 335279 - RNA, 64 nt, Human
ccuccagcggggagcacgggugcugccuuccgugcggaucgagcuuuccuggacucggucauug

SEQ ID NO: 335280 - RNA, 64 nt, Human
acgacggcuucaggcccggcuaacucuggcaccccggaucgaggacaagugagagagcaagugg

SEQ ID NO: 335281 - RNA, 64 nt, Human
cauagccugggcugggugggagccagucacccugcggaucgagagaggggguagagucuucuuc

SEQ ID NO: 335282 - RNA, 64 nt, Human
aauagaggggcauucacaaggcacaccagugcaagcagaugacaaaaaggugcagaaggcaauc

SEQ ID NO: 335283 - RNA, 64 nt, Human
ggccucuuaaauagaccacuauuuuuugugucuggcagaugaguaugucaaggauugagaugaa

SEQ ID NO: 335284 - RNA, 64 nt, Human
gcauggagaaugggacgaggacauuugugggcaagcagaugacagagguuugaaggagaauggc

SEQ ID NO: 335285 - RNA, 60 nt, Human
ccuuucucccaucaaagcaaaauauggccucaccaccagccccaaaucagugcucagacc

SEQ ID NO: 335286 - RNA, 60 nt, Human
gaagaaggucguugcuuccccuucaccuuccaccaccaugauuguaaguuccuuuuuucu

SEQ ID NO: 335287 - RNA, 60 nt, Human
gccucuggaguagcugagacuacaggcgcccaccaccaugcccggcuaauuuuguuugua

SEQ ID NO: 335288 - RNA, 60 nt, Human
acuucucagcuucugcgaucagauuaucaucaccaccacccuccagagaauuuuuacgca

SEQ ID NO: 335289 - RNA, 60 nt, Human
aagucucccuuccagcuguuccauucucuccaccaccagcguaacuggcaaguuaccaag

SEQ ID NO: 335290 - RNA, 60 nt, Human
gccucccaaguagcugggaugacaggcgcacaccaccacgcccagcaaauuuuuuguauu

SEQ ID NO: 335291 - RNA, 60 nt, Human
cagccucucaaguagcugggacuacaggugcaccaccacaccuggcuaauuuuuguauuu

SEQ ID NO: 335292 - RNA, 60 nt, Human
uuuaaaaucacaaacauuaacggcaguaggcaccaccauguaaaagugagcucagacguc

SEQ ID NO: 335293 - RNA, 60 nt, Human
cugccuccagggaggggaggggaugggaagcaccaccagccagcggaagagcagcccucu

SEQ ID NO: 335294 - RNA, 60 nt, Human
gcuuaccuguggguuucaguccugagaggccaccaccaguucccaucagcacugucucca

SEQ ID NO: 335295 - RNA, 60 nt, Human
gccucccuaguagcugggauuacaggcgcacaccaccacacacagcuaauuuuuuuuuuu

SEQ ID NO: 335296 - RNA, 60 nt, Human
gggcccagcacauggccauagaggcccaggcaccaccaggagcagcagccagcaccaccu

SEQ ID NO: 335297 - RNA, 60 nt, Human
ugggaauaaaauguugccuuccccacuucucaccaccaccgccaucaugacgcucauacu

SEQ ID NO: 335298 - RNA, 60 nt, Human
cuguuuguuuguuuucauguugaaugcccacaccaccauccucucaucccagccaguaag

SEQ ID NO: 335299 - RNA, 60 nt, Human
aaauauaaguagucauuagaaguuugcaaccaccaccaagucugagagaacucugggaua

SEQ ID NO: 335300 - RNA, 60 nt, Human
ucuccgugggaggagacauuauggggcguccaccaccaccccucccuggccauccuccug

SEQ ID NO: 335301 - RNA, 60 nt, Human
gcccugaauuugcuuccucugacaaguuaccucaccuaauuuuugcuucucaggaaugag

SEQ ID NO: 335302 - RNA, 60 nt, Human
gccccagggaggagcacauuuuucuugacccucaccuaccuggugcuaguuggucaaccc

SEQ ID NO: 335303 - RNA, 62 nt, Human; identical to SEQ ID NO: 278598

SEQ ID NO: 335304 - RNA, 62 nt, Human; identical to SEQ ID NO: 278599

SEQ ID NO: 335305 - RNA, 60 nt, Human
cccuccugaguagcugggacuacaggugugcaccaccacaccuggcuaauucuucuuaaa

SEQ ID NO: 335306 - RNA, 60 nt, Human
gccucccaaguagcugggauuacaggcauacaccaccacgccccacuaauuuuuuguauu

SEQ ID NO: 335307 - RNA, 60 nt, Human
gccuccugaguagcugggauuacaggcacacaccaccacgcuugguuaauuuuuguauuu

SEQ ID NO: 335308 - RNA, 60 nt, Human
uuuucuaauacucuacccucuuagaaaaaccaccaccaucaccagacaggugcgaaagga

SEQ ID NO: 335309 - RNA, 60 nt, Human
cugguaacugcuuugcuucuugaguagagccaccaccaccauagcccagccagaugagug

SEQ ID NO: 335310 - RNA, 60 nt, Human
guaacugcuuugcuucuugaguagagccaccaccaccauagcccagccagaugagugcuc

SEQ ID NO: 335311 - RNA, 60 nt, Human
gucaggugugauaaaauguugaacccuccccaccaccacuuuuuuuuuuuuaaaccaggg

SEQ ID NO: 335312 - RNA, 60 nt, Human
accugguugaaauacaacacuauacauacacaccaccauauauacuagcuguuaauccua

SEQ ID NO: 335313 - RNA, 60 nt, Human
gagacccuuagguuuuaacacgaauccugacaccaccaucuauagggucccaacuugguu

SEQ ID NO: 335314 - RNA, 60 nt, Human
uaacaaauguuccuccucccucugggauaccaccaccacuuguuucuguguguguuuauu

SEQ ID NO: 335315 - RNA, 60 nt, Human
uaagcuugaagcuacagauuauaucacuaucaccaccaccccucacccuaugcaaucaau

SEQ ID NO: 335316 - RNA, 60 nt, Human
uugguugggacacuccucuggcagccccagcaccaccacaaccccuugcagugugcccca

SEQ ID NO: 335317 - RNA, 60 nt, Human
gacaaaaccacugcagaccuaccacgaagccaccaccaccuucaguaacaaggguacgau

SEQ ID NO: 335318 - RNA, 60 nt, Human
cuguuugccaccucaaaacuuuaugaacuucaccaccacuagugucuguccauggaguua

SEQ ID NO: 335319 - RNA, 60 nt, Human
gaccucugggagcuaauacuccucuuugcucaccaccaugugaucauugaucagaugugg

SEQ ID NO: 335320 - RNA, 60 nt, Human
ccuuacccucccucccuuacucuccccccccaccaccacccuccacccccaacucaugaa

SEQ ID NO: 335321 - RNA, 64 nt, Human
caacaguguuccuuuucuugguuuuaauuucugagcagaugauugugcugugggaacagcacac

SEQ ID NO: 335322 - RNA, 64 nt, Human
uuuuccugagaugacugaguauggagauuaccaggcagaugauaccgaaaugcuuaaaggggcu

SEQ ID NO: 335323 - RNA, 64 nt, Human
cuaaaaucucagguuaucuccugaacacuuuugggcagaugaaguuuuauaccaaaaaauaguu

SEQ ID NO: 335324 - RNA, 60 nt, Human
acgggaggcaggguggggggcaggcuggaccaccaccaucugcccuggcagccuggcugc

SEQ ID NO: 335325 - RNA, 60 nt, Human
cacucugucacccaggcuggagugcaguggcaccaccauggcucucugcagccuugaccu

SEQ ID NO: 335326 - RNA, 60 nt, Human
aguauuuggacaaaaaccuaauagaagagucaccaccaaaugaagaauaaaacucccagg

SEQ ID NO: 335327 - RNA, 60 nt, Human
gccuccagaguagcugggacuauagacaugcaccaccacgcccggcuaauuuuguauuuu

SEQ ID NO: 335328 - RNA, 60 nt, Human
ggucaggucacugcggacaucaagggcggacaccaccaaggggcccucuggaacuugaga

SEQ ID NO: 335329 - RNA, 60 nt, Human
gccucccgaguagcugggguuacaggcaugcaccaccaugccuggcuaauuuucuguauu

SEQ ID NO: 335330 - RNA, 60 nt, Human
ccuuuggugaguaugguguucaggaugcaccaccaccaccucuagauaccuucaggcaac

SEQ ID NO: 335331 - RNA, 60 nt, Human
aucccuuuggugaguaugguguucaggaugcaccaccaccaccucuagauaccuucaggc

SEQ ID NO: 335332 - RNA, 60 nt, Human
ccucccaaagcagcugggacuacaggcaugcaccaccauacccagcccuagaaagcucuu

SEQ ID NO: 335333 - RNA, 60 nt, Human
gccuccugaguagcugggauuauaggcgugcaccaccaugcccagcuaauuuuuguauuu

SEQ ID NO: 335334 - RNA, 60 nt, Human
aauaauaaaugcccucuucucgugccuccccaccaccacuuaccacucgugcaucccuga

SEQ ID NO: 335335 - RNA, 60 nt, Human
gccucccgaguaccugggacuauaugugcgcaccaccacgccuggcuaauuuuuuguauu

SEQ ID NO: 335336 - RNA, 60 nt, Human
cguacccuccugugagacagugugugcaggcaccaccaccuuaauccugcuguugccuga

SEQ ID NO: 335337 - RNA, 60 nt, Human
ccacaaucccagggaucuacagaacuauuucaccaccagauaugaccuaguuuuauauuu

SEQ ID NO: 335338 - RNA, 60 nt, Human
ugcaauaguugacuuuuaaccaaccaccaccaccaccaaaaccaguuuaugcaguuggac

SEQ ID NO: 335339 - RNA, 60 nt, Human
aagugcaauaguugacuuuuaaccaaccaccaccaccaccaaaaccaguuuaugcaguug

SEQ ID NO: 335340 - RNA, 64 nt, Human
aaaauaagaccccuaucuagugagggagacaggugcagaugaggugaagaucacugucaucuaa

SEQ ID NO: 335341 - RNA, 64 nt, Human
cucaauuuaaaucauuacucuguaaaauaaauaagcagaugauucuuauaaugacucacuguuu

SEQ ID NO: 335342 - RNA, 64 nt, Human
cagagacugagaguuggugcuggugguugugguggcagaugauauuaccugaagaagggacgaa

SEQ ID NO: 335343 - RNA, 60 nt, Human
uguaagugcaauaguugacuuuuaaccaaccaccaccaccaccaaaaccaguuuaugcag

SEQ ID NO: 335344 - RNA, 60 nt, Human
gccucccgaguagcuggaauuauaggcgugcaccaccacgcccagcuaauuuuuguauuu

SEQ ID NO: 335345 - RNA, 60 nt, Human
aucaccaucccucuucuuggccccaucccccaccaccauuccuuuccucccuucccccug

SEQ ID NO: 335346 - RNA, 60 nt, Human
cagcgguaucugaccucagaggcagaggaacaccaccagcucuucgaucugauugaaagc

SEQ ID NO: 335347 - RNA, 60 nt, Human
cuuguugguuucugguucagagugcucucccaccaccagagacaaguggguaaaaagguc

SEQ ID NO: 335348 - RNA, 60 nt, Human
ugcugcucccuggccagccuuuggccacagcaccaccagcugcuguugcugagagagcuu

SEQ ID NO: 335349 - RNA, 60 nt, Human
aacacaaaauuuugaggcuagacccaugaucaccaccaacuauaauugcacaaggucuug

SEQ ID NO: 335350 - RNA, 60 nt, Human
uggaaggauagacugcccccuaccucccaccaccaccaugaaguuuggugacuugaggcu

SEQ ID NO: 335351 - RNA, 60 nt, Human
gguuggaaggauagacugcccccuaccucccaccaccaccaugaaguuuggugacuugag

SEQ ID NO: 335352 - RNA, 60 nt, Human
gauuagaccaauuacugcacucuuaaacagcaccaccauuuaauuucauguauaucuaac

SEQ ID NO: 335353 - RNA, 60 nt, Human
gccucccgaguagcugggauuacaggcacacaccaccacgcccggcuaauuuuuuguguc

SEQ ID NO: 335354 - RNA, 60 nt, Human
gucagagacagauaccuccaacccugccgucaccaccaccccuaccacauauguccacau

SEQ ID NO: 335355 - RNA, 60 nt, Human
gccucccaaguagcugggauuacaggcaugcaccaccaugcccagcuaauuuuuguauuu

SEQ ID NO: 335356 - RNA, 60 nt, Human
uccugucacuggaucugggcuaaaguccuccaccaccacucuggaccuaagaccuggggu

SEQ ID NO: 335357 - RNA, 60 nt, Human
gccucccauguagcaggaaccacaggcaggcaccaccauacccagcuaauuuuuguauuu

SEQ ID NO: 335358 - RNA, 60 nt, Human
cacgucccugcacucucagcccccgcccgucaccaccaccggccaccugaguguccguga

SEQ ID NO: 335359 - RNA, 64 nt, Human
uagcaagagccaccaagaacuuugggugaagcaagcagaugacaaugaagaggaguaauguucc

SEQ ID NO: 335360 - RNA, 64 nt, Human
ggcuccuuccucaaacaucggacggcggaauguggcagaugaaaugugcuggaggaaaaaaaug

SEQ ID NO: 335361 - RNA, 64 nt, Human
auucacaccugacucugaaaucugaagaccucgagcagaugaugccaaccucuggagcaauguu

SEQ ID NO: 335362 - RNA, 60 nt, Human
gccucccgaguagcugggacuacaggcgcccaccaccacgcccggcuaauuuuuuguauu

SEQ ID NO: 335363 - RNA, 60 nt, Human
gccucccgaguagcugggauuaugggcgcccaccaccaugcccagcuaauuuuuguauuu

SEQ ID NO: 335364 - RNA, 60 nt, Human
cugguaggaucccugagccccuugcgauaucaccaccaagagccugauaacugagcaggg

SEQ ID NO: 335365 - RNA, 60 nt, Human
uaaacucaauaauuuugugaaaaaaaaaaccaccaccaaacuuuugguuguaaaagagaa

SEQ ID NO: 335366 - RNA, 60 nt, Human
gccucuugaauagcugggacuagaagcaugcaccaccaugcccaucuaauauuuguauuu

SEQ ID NO: 335367 - RNA, 60 nt, Human
auuuaaagagucgacuauacaaaaaucaaucaccaccacgaggacaagagggcaaaagca

SEQ ID NO: 335368 - RNA, 60 nt, Human
cuggauuguacuacuuuaccucuacuuuaccaccaccacccuuuuccucccuccuuucca

SEQ ID NO: 335369 - RNA, 60 nt, Human
uaaaaugcugcacugcagcaaaaacaaaaccaccaccaccccagagaaaaccauguacua

SEQ ID NO: 335370 - RNA, 60 nt, Human
gccucccuaguagcugggacuacagguaugcaccaccaugccuggcuaauuuuuuguauu

SEQ ID NO: 335371 - RNA, 60 nt, Human
gccucuaaggccaaggccucaggagagcaucaccaccacaccccugccggccuuggccuu

SEQ ID NO: 335372 - RNA, 60 nt, Human
gacuuugcccggccucaucugccuggcacgcaccaccagucacaaccuaugcagcgcccc

SEQ ID NO: 335373 - RNA, 60 nt, Human
uuauuuagucaccuuucuccuguccaacuucaccaccaccugauaauggguauauaacag

SEQ ID NO: 335374 - RNA, 60 nt, Human
gccuccugaguagcugagacuacaggugcacaccaccaagccuggcuuuauguauuuauu

SEQ ID NO: 335375 - RNA, 60 nt, Human
aucaauauuuagacuauggcagauagcuaccaccaccacagggugcuaaaagaaacagug

SEQ ID NO: 335376 - RNA, 60 nt, Human
ccaccugaagugaugauggaugagaaaaaacaccaccaaaugacaagucacacccucccc

SEQ ID NO: 335377 - RNA, 60 nt, Human
gugcuuuaucaucuccaucuuuagccuuuacaccaccaaucaaaacucuagguacaccaa

SEQ ID NO: 335378 - RNA, 64 nt, Human
ucccacuucuauuccugaggugcagcggggaggagcagaugagcugggcagggcaggggugggu

SEQ ID NO: 335379 - RNA, 64 nt, Human
acaaugagaaacggcagcgccgacaggagcggcggcagaugaagcgguuauagccauugacauu

SEQ ID NO: 335380 - RNA, 64 nt, Human
uuuauguguuuuuuagggaaugaugauugaugaagcagaugaguuuguagcagggccacaaaac

SEQ ID NO: 335381 - RNA, 60 nt, Human
aauuuacuguugcccauugcacuuacauaccaccaccaagaaagccuucaagaugucaaa

SEQ ID NO: 335382 - RNA, 60 nt, Human
gccuccugaguagcugggauuacaggcacgcaccaccauaccuggcuaauuuuuguauuu

SEQ ID NO: 335383 - RNA, 60 nt, Human
cccagcccacuccccgcauggggaggccgccaccaccaacaccucaucauccuucucauc

SEQ ID NO: 335384 - RNA, 60 nt, Human
ccaacaccucaucauccuucucaucgcuaacaccaccaccuccaucggcacccaagcggg

SEQ ID NO: 335385 - RNA, 60 nt, Human
gucucaguguccucaucuguaaaauggagacaccaccacccuugccauggagguuaagca

SEQ ID NO: 335386 - RNA, 60 nt, Human
gccucccuaguagcugggauuacaggcacacaccaccauaccuggcuaauuuuuguauuu

SEQ ID NO: 335387 - RNA, 60 nt, Human
gccucccgagcagcugggauuauaggcguccaccaccacgcccagcuaauuuuuguauuu

SEQ ID NO: 335388 - RNA, 60 nt, Human
agaggugggccagucuguggaucagagaugcaccaccaagccaagggaaccuguguccgg

SEQ ID NO: 335389 - RNA, 60 nt, Human
cuguuccucuuccaaaagaccucucuuuaccaccaccacccucaucacucagaaacccua

SEQ ID NO: 335390 - RNA, 60 nt, Human
uuggaauuacuccugcagaagguugccugccaccaccagcuggaccugagcuugggcaac

SEQ ID NO: 335391 - RNA, 60 nt, Human
ucagggcuugugggggguaggcugagaccccaccaccaaagguuaagugagguccccuug

SEQ ID NO: 335392 - RNA, 60 nt, Human
uagacgcuauaccguggacucucccugguccaccaccauguugaagcccuuggcagccug

SEQ ID NO: 335393 - RNA, 60 nt, Human
aaugggcacugccagagccauuucugaucacaccaccauccuggaccaugugacuggaag

SEQ ID NO: 335394 - RNA, 60 nt, Human
uaaaguaagccaagacacaucgacaaugagcaccaccaucaaugaccaccgccauucaca

SEQ ID NO: 335395 - RNA, 60 nt, Human
uucuguuaaaaucaggauuuuagugcuugccaccaccagaugagaaguuaagcagccuuu

SEQ ID NO: 335396 - RNA, 60 nt, Human
ucaugccccuucucucccaccccaucuccccaccaccaccucuguggccuccaugguacc

SEQ ID NO: 335397 - RNA, 64 nt, Human
gaaguguugguaauggauaaauaacauaucccgggcagaugagcucaaccuaguagguaagagu

SEQ ID NO: 335398 - RNA, 64 nt, Human
cgaggcccuuggcgggcacgggugucacggccaggcagaugaccucguacucaggagcccgaug

SEQ ID NO: 335399 - RNA, 64 nt, Human
ucagugccucaccucccccugccucccagccuccgcagaugagguuccugccccuuccuccucg

SEQ ID NO: 335400 - RNA, 60 nt, Human
gccucccaaguagcugggacuaugggugcacaccaccacgccuggcuaauuuuuguauuu

SEQ ID NO: 335401 - RNA, 60 nt, Human
uggccugggagaggcagugagccuucucuccaccaccauagacagguguuaaugcaucua

SEQ ID NO: 335402 - RNA, 60 nt, Human
guggggcaaagccagcaugcaagcagaccccaccaccacagcccaccuccguccucacau

SEQ ID NO: 335403 - RNA, 60 nt, Human
ucaucacugcacacaagugccaugcuuugccaccaccaccaagcacaucugugauccuga

SEQ ID NO: 335404 - RNA, 60 nt, Human
ucacugcacacaagugccaugcuuugccaccaccaccaagcacaucugugauccugaagg

SEQ ID NO: 335405 - RNA, 60 nt, Human
agcccccaaguagcuaggacuacaggagcacaccaccacaccuggcuaauuuuuguauuu

SEQ ID NO: 335406 - RNA, 60 nt, Human
aagcuauccuuucucagcuaugugguuuggcaccaccaccaucuucaugaguggacccug

SEQ ID NO: 335407 - RNA, 60 nt, Human
cuauccuuucucagcuaugugguuuggcaccaccaccaucuucaugaguggacccuguuu

SEQ ID NO: 335408 - RNA, 60 nt, Human
gaucagagcagcagugaaaacaagugcuggcaccaccaggcaccucacagaaaugagauc

SEQ ID NO: 335409 - RNA, 60 nt, Human
ucuuggcucacucccuugccucucccccuccaccaccaccuugugacugaugguuugguu

SEQ ID NO: 335410 - RNA, 60 nt, Human
gagcucccuuugcccuucuccuguaucccacaccaccacauccaaccuccuugccugccu

SEQ ID NO: 335411 - RNA, 60 nt, Human
ggccaaagccagagacucgaacagccuccccaccaccaccagcauaugucaaggagcacu

SEQ ID NO: 335412 - RNA, 60 nt, Human
caaagccagagacucgaacagccuccccaccaccaccagcauaugucaaggagcacuugc

SEQ ID NO: 335413 - RNA, 60 nt, Human
guucauuuggguggggaucaaaguccuguccaccaccaaaacuaaguucuuagauuuugg

SEQ ID NO: 335414 - RNA, 60 nt, Human
uaaggaagcuguuucuuuuaaaacacaaaccaccaccaaaaauuuaaauguacauauugc

SEQ ID NO: 335415 - RNA, 60 nt, Human
gccucccgaguagcugggacuacaggcgcccaccaccaugcccggcuaauuuuuguuuuu

SEQ ID NO: 335416 - RNA, 64 nt, Human
caacaauauuguaucuuaaucaaggcugucugaugcagaugauugcauuuuuuggcaaauuuua

SEQ ID NO: 335417 - RNA, 64 nt, Human
aggaucucauggagccucacgucuacucccuucugcagaugaggaaaccgagagaaguggccca

SEQ ID NO: 335418 - RNA, 64 nt, Human
ucccagaucccgcagccucuggagagagcugacggcagaugaaaucaccagggcggggcacccg

SEQ ID NO: 335419 - RNA, 60 nt, Human
gccucucaaguggcugggaccacagaagugcaccaccaugccuggcuuuuuuuuuuuuuu

SEQ ID NO: 335420 - RNA, 60 nt, Human
gcuuccagauuagcuggugcuauaggcaugcaccaccacguccaucuaaauuucuuuauu

SEQ ID NO: 335421 - RNA, 60 nt, Human
cccuucugagguaacuagacugcagcuaaccaccaccaacagccauucaucaucugaucu

SEQ ID NO: 335422 - RNA, 60 nt, Human
uacuaaggacguauccaggaguaccacaaccaccaccagugcuaccaccguugccacuga

SEQ ID NO: 335423 - RNA, 60 nt, Human
aauauuguuacaaaaaauguacaguacugacaccaccacaaaucaugguuaauaaaagag

SEQ ID NO: 335424 - RNA, 60 nt, Human
ccuggcaaaaggcauggccucccugaugaucaccaccaaggguagccccagaggggagcu

SEQ ID NO: 335425 - RNA, 60 nt, Human
ggaggggacuccaggaauggggaaaugugacaccaccauccugaagccagcuugcaccuc

SEQ ID NO: 335426 - RNA, 60 nt, Human
uccuugguguguguaaguaccgaugcacgccaccaccaugccuguguuacagcagcucca

SEQ ID NO: 335427 - RNA, 60 nt, Human
gccuccugaguagcugauacuacaggcacccaccaccacgcccagcuaauuuuuuuguau

SEQ ID NO: 335428 - RNA, 60 nt, Human
ggcuucugaguagcugggauuauaggugcgcaccaccacacccggcuaguuucuguauuu

SEQ ID NO: 335429 - RNA, 60 nt, Human
aaacccaccacacaccagcagccacaaccucaccaccaacaaagaggacuuuuguggggc

SEQ ID NO: 335430 - RNA, 60 nt, Human
agccuggaagaugcagggaaccuccacgcccaccaccaugagcuggaguggggaugacaa

SEQ ID NO: 335431 - RNA, 60 nt, Human
agccuggcuuacagugccauuucugcugggcaccaccaccugccugagggccuagcucac

SEQ ID NO: 335432 - RNA, 60 nt, Human
cacuuaggaggcagcaugagaacaguggcacaccaccagugaggcacauguugccuuuuu

SEQ ID NO: 335433 - RNA, 60 nt, Human
cucucacuggcugaaaagcaaaggggcccacaccaccauggcagaugcccucuggcgccu

SEQ ID NO: 335434 - RNA, 60 nt, Human
auguauugcagugcggcucacaucacuguccaccaccaccuggagcggcucaucagaacu

SEQ ID NO: 335435 - RNA, 64 nt, Human
ggucagaggagacccagcuguccugcacccccuugcagaugaguaucaccccaucuuuucuuuc

SEQ ID NO: 335436 - RNA, 64 nt, Human
ggcaugagaugaaccgcagugcccauugggcugggcagaugagauccuacuuucuccccaggac

SEQ ID NO: 335437 - RNA, 64 nt, Human
uacggugugcuccugaaugaagguuucuauguaagcagaugaugauuuuaccugucaauaccag

SEQ ID NO: 335438 - RNA, 60 nt, Human
accucccgaauggcugggacuacaggcacccaccaccacgccuggcuaacuaacuaacua

SEQ ID NO: 335439 - RNA, 60 nt, Human
gccucccaaguagcugggauuacaggcgugcaccaccacgcccaguugauuuuuguauuu

SEQ ID NO: 335440 - RNA, 60 nt, Human
agccaccugacuagcugggauugcagccugcaccaccacaccuggcuaaauuuuuguugu

SEQ ID NO: 335441 - RNA, 60 nt, Human
auuuauuauuuuauaaauugagaacaaccacaccaccaaaugucacaccuucuuauaaag

SEQ ID NO: 335442 - RNA, 60 nt, Human
gccuccugaguagcugggauuauaggcaugcaccaccacacccagcuauuuuuuguauuu

SEQ ID NO: 335443 - RNA, 60 nt, Human
ggcgcuggccacccggcccugccuucccaccaccaccaccgugcauggggcagcaaacac

SEQ ID NO: 335444 - RNA, 60 nt, Human
guaggcgcuggccacccggcccugccuucccaccaccaccaccgugcauggggcagcaaa

SEQ ID NO: 335445 - RNA, 60 nt, Human
agccacccaagcauacuuaccaguacugcccaccaccacccacugcccaccucuaagaag

SEQ ID NO: 335446 - RNA, 60 nt, Human
cuugagcccuauaaaugcccacgggacccccaccaccagccucuugaaguggcuccacag

SEQ ID NO: 335447 - RNA, 60 nt, Human
gaggaacugaauuuggcuccucagccccagcaccaccagcugugggcagucaguagcaga

SEQ ID NO: 335448 - RNA, 60 nt, Human
gcuccacaagacaccugugcuuuggaaauccaccaccaaucccgaucggcucuuauuagc

SEQ ID NO: 335449 - RNA, 60 nt, Human
gcucacaauccagagcaauggauccuccaacaccaccagguggauguggagcaggagagc

SEQ ID NO: 335450 - RNA, 60 nt, Human
gccuccugaguagcugggacuacaggcgcccaccaccacacauggcuaauuuuuguauuu

SEQ ID NO: 335451 - RNA, 60 nt, Human
cuauccuuaccuuuuaguuucagcaguccucaccaccaccauauccccagugcugggaug

SEQ ID NO: 335452 - RNA, 60 nt, Human
uccuuaccuuuuaguuucagcaguccucaccaccaccauauccccagugcugggauggca

SEQ ID NO: 335453 - RNA, 60 nt, Human
accccaaauaugaacaacugcagcaggugccaccaccaccacaaaagacaccacuacccu

SEQ ID NO: 335454 - RNA, 50 nt, Human
auaacuauuuucccaacugagcagaugacaugaugaaaggaacagaaaca

SEQ ID NO: 335455 - RNA, 64 nt, Human
ccugcugauggucucagcuuccagcagcacaaaagcagaugauguacuggaaaaugcucagaag

SEQ ID NO: 335456 - RNA, 64 nt, Human
uccaggacacaauguaggaagucuuuuccacauggcagaugauuugggcagagcgauggagucc

SEQ ID NO: 335457 - RNA, 60 nt, Human
ccaaauaugaacaacugcagcaggugccaccaccaccacaaaagacaccacuacccuugu

SEQ ID NO: 335458 - RNA, 60 nt, Human
cacuaucauuaaucuuucaaucuaauuauucaccaccacaagaccuauuaacaagacaaa

SEQ ID NO: 335459 - RNA, 60 nt, Human
uauuuaugagucuuugagacuaaauucaaucaccaccagguaucaaaucaacuuuuaugc

SEQ ID NO: 335460 - RNA, 60 nt, Human
acauagucaugugcgaggucaaaacugagucaccaccacaaccaaguuccagcuggcaag

SEQ ID NO: 335461 - RNA, 60 nt, Human
gccucccucagagcugggacuacaggcgugcaccaccacgccugguuaauuguuuuuuuu

SEQ ID NO: 335462 - RNA, 60 nt, Human
gccuccugaguagcugggauuauaggcaugcaccaccaugcccagcuaauuuuguauuuu

SEQ ID NO: 335463 - RNA, 60 nt, Human
ccacgccuggccagaguuuuuuauuuuuaucaccaccauagauguuacaguuggcugugg

SEQ ID NO: 335464 - RNA, 60 nt, Human
gcuucccaaguagcugcaacaacaggcacacaccaccaugcucaacuaauuuuauuucua

SEQ ID NO: 335465 - RNA, 60 nt, Human
gccuccugaguagcugggauuacaggcaugcaccaccacaccaggcuaauuuuguauuuu

SEQ ID NO: 335466 - RNA, 60 nt, Human
auuuagccuaucaaaacuuccaaaagcccacaccaccaguuccugacucaaauuugaagg

SEQ ID NO: 335467 - RNA, 60 nt, Human
caaccaccaugugucuucuaggugcuggcccaccaccacacaucacaggcugauuuccac

SEQ ID NO: 335468 - RNA, 60 nt, Human
ugaagugggauuuacccauuaccauauauucaccaccaggucacugacgagagacuccag

SEQ ID NO: 335469 - RNA, 56 nt, Human
gagggagcacaggaggauagccgcaucaccaccagcagcucuugcccagagcugug

SEQ ID NO: 335470 - RNA, 60 nt, Human
caggugaguacucauaauuggccagcaucucaccaccagcaaguaguagggccaggucaa

SEQ ID NO: 335471 - RNA, 60 nt, Human
gccucaugaauagcugggauuacaggugcccaccaccaugccuggcuaguuuuuguauuu

SEQ ID NO: 335472 - RNA, 60 nt, Human
gccucucgaguagcugggauuacaggcaugcaccaccacacccagcuaauuuuguauuuu

SEQ ID NO: 335473 - RNA, 64 nt, Human
uuccuuugaguuuauuucuuccuaacauuggucagcagaugacacuggugacuugacccuuccu

SEQ ID NO: 335474 - RNA, 64 nt, Human
cugccuauuuaauguagcuaauaaaguuauagaagcagaugaucuguuaauuuccuaucuaaua

SEQ ID NO: 335475 - RNA, 64 nt, Human
aauuuaacauaaaacagggaugucacuuugaggggcagaugaaagucuagagaacuguuccuua

SEQ ID NO: 335476 - RNA, 60 nt, Human
gccuccugaguagcugggacuacaggcacgcaccaccaugccaggcuaauuuuuuuguau

SEQ ID NO: 335477 - RNA, 60 nt, Human
gccuccugaguagcuggaauuacaggcacccaccaccacacccagcucauuuuuguauuu

SEQ ID NO: 335478 - RNA, 60 nt, Human
gccucccaaguagcugggauuacaggcacccaccaccaugcccagcuaauuuuuuguauu

SEQ ID NO: 335479 - RNA, 60 nt, Human
gccucaugaauagcugggauuacaggugcccaccaccaugccuggcugguuuuuguauuu

SEQ ID NO: 335480 - RNA, 60 nt, Human
uaaagugcccucacacugcugugcagccaucaccaccauucaucuccagaauuuguucuc

SEQ ID NO: 335481 - RNA, 60 nt, Human
gccucccaaguagcugggauuacaggcaugcaccaccacgcccagcuaauuuuuauauuc

SEQ ID NO: 335482 - RNA, 60 nt, Human
cccugauuccggacccuguagauugggcgccaccaccagaucccccucccaggccuuccu

SEQ ID NO: 335483 - RNA, 60 nt, Human
gauugucuuguugauuaaauuguucaugcucaccaccaccaauaagguauuuuucucuga

SEQ ID NO: 335484 - RNA, 60 nt, Human
ugucuuguugauuaaauuguucaugcucaccaccaccaauaagguauuuuucucugauug

SEQ ID NO: 335485 - RNA, 60 nt, Human
gccucccgaguagcuggcauuacaggcgcccaccaccacgcucggcuaaauuuuuuuuuu

SEQ ID NO: 335486 - RNA, 60 nt, Human
cuaccaaguagccaggaccacaggcaagugcaccaccaugacuggcuaguuuuguuuuuu

SEQ ID NO: 335487 - RNA, 60 nt, Human
auggcacagauuacaaaaguaaagaacaaccaccaccaacaucgguaacucccuguauuc

SEQ ID NO: 335488 - RNA, 60 nt, Human
gccaaaaacaacaacaaaaugaaacgcaaccaccaccaaccacugcgaccacaagaagga

SEQ ID NO: 335489 - RNA, 60 nt, Human
ggagguagaggcuucagugagcugagaucgcaccaccacacuccagccugggugacagag

SEQ ID NO: 335490 - RNA, 59 nt, Human
agcagcaacaguuuguguagccagucuaccaccaccacagcaccccagacagcuaggcu

SEQ ID NO: 335491 - RNA, 60 nt, Human
ccaucuccucauccuaacccaggucuucggcaccaccacaauuaauucccuucccaacac

SEQ ID NO: 335492 - RNA, 64 nt, Human
cugauccuugggacccaacgccgcauugccucuugcagaugagguuuugccuugggcugcuuug

SEQ ID NO: 335493 - RNA, 64 nt, Human
agacagcagggcucucuguaucagucuuucuugagcagaugauuccccuaguugaguagccaga

SEQ ID NO: 335494 - RNA, 64 nt, Human
uuaauauugugucaggucguccuauuaaccaggagcagaugacaguaaaauuucagugaauagc

SEQ ID NO: 335495 - RNA, 60 nt, Human
gccuucugaguagcugggacuacagaugcacaccaccacaccuggcuaauuuuuguguuu

SEQ ID NO: 335496 - RNA, 60 nt, Human
agcucccaaguagcugggauuacgggcgcccaccaccacgcccagcuaauuuuuuuuuuu

SEQ ID NO: 335497 - RNA, 60 nt, Human
aaaacaaaacaaaacacaguccugcauacucaccaccaagcucaagaaauaaaucaucac

SEQ ID NO: 335498 - RNA, 60 nt, Human
gccucccaaguaacuaagacuacaggcaugcaccaccauacccaacuaauuuuauuuuuu

SEQ ID NO: 335499 - RNA, 60 nt, Human
ccaggucagccucccaaguagcugggauuacaccaccaugcccagcuacuaaaaauacuu

SEQ ID NO: 335500 - RNA, 60 nt, Human
agccucccaaguagcuggauuacaggcauacaccaccacgccuggcuauguuuuguauuu

SEQ ID NO: 335501 - RNA, 60 nt, Human
uguucucaccacgaagaucauguucauuaccaccaccacccccccuuauuuuuuuuaucc

SEQ ID NO: 335502 - RNA, 60 nt, Human
gccucccaaguagcugggguuacaggcgcccaccaccacacucggcuaauuuuguguuuu

SEQ ID NO: 335503 - RNA, 60 nt, Human
gucccagauacacuaaaguuacaaacagaccaccaccaggacugugccugaacaauuuug

SEQ ID NO: 335504 - RNA, 60 nt, Human
uuuuguuuuuugaugggguuuuauccucuucaccaccacuacccacuccauuuuuuuucu

SEQ ID NO: 335505 - RNA, 60 nt, Human
gccccgcaccaguuggagcagaugccuccccaccaccaauugccaaagguccaauaaaau

SEQ ID NO: 335506 - RNA, 60 nt, Human
ccccuggggcuccaggaccuucccuaccuccaccaccaaaccaagggauuuauagcaaag

SEQ ID NO: 335507 - RNA, 60 nt, Human
ccuacccccagcuucggaaaauacagagaccaccaccacguacccuguauuccccaaggu

SEQ ID NO: 335508 - RNA, 60 nt, Human
ggugcaaaaauuuuaaugcuagucaguaugcaccaccacaggaaaguuagaucccauuag

SEQ ID NO: 335509 - RNA, 60 nt, Human
ugauggauauucuggcucuggggcccucuccaccaccacucacaguagccuugcugaagc

SEQ ID NO: 335510 - RNA, 60 nt, Human
gugauggagggcaacaaggacuccgaggagcaccaccaggccucgggccccagagguccc

SEQ ID NO: 335511 - RNA, 64 nt, Human
uuucuuuaacugccuuccuggcuuagcucagauggcagaugagaguguagucaagggccugggc

SEQ ID NO: 335512 - RNA, 64 nt, Human
cuuccuuagaaccuuccaugguugucuuuucccagcagaugaagcauagccuccuuggaauggc

SEQ ID NO: 335513 - RNA, 60 nt, Human
gccuccugaguggcugggauuacaggcaugcaccaccaugcccagcuaauuuguuguauu

SEQ ID NO: 335514 - RNA, 60 nt, Human
uuguugagcaaguuuuagcccugcaguuuucaccaccagcaccuacccagcauucugguu

SEQ ID NO: 335515 - RNA, 60 nt, Human
acccaccuuauccucccaccccacucccuccaccaccacagcacaccggugcuggccaca

SEQ ID NO: 335516 - RNA, 60 nt, Human
uccuccugagcagcugggacuacaggcacacaccaccacaccuggcuaaguuuuguauuu

SEQ ID NO: 335517 - RNA, 60 nt, Human
gacucccgaauagcugggauuacagacaggcaccaccacacccagcuaauuuuuguauuu

SEQ ID NO: 335518 - RNA, 60 nt, Human
gccgccacccccaucuuccaccugugcccucaccaccacacuacacagcacaccagccgc

SEQ ID NO: 335519 - RNA, 60 nt, Human
ccuccucuuggccacuuggccugggccugccaccaccacguccugcagaacgagcccugc

SEQ ID NO: 335520 - RNA, 60 nt, Human
ggccagcccugcugccaucauuggcugaagcaccaccaggauucacggcacccaacugcu

SEQ ID NO: 335521 - RNA, 60 nt, Human
gccucccaaguagcugggauuacaggcgugcaccaccacgccgggcuaaauuuuuuugua

SEQ ID NO: 335522 - RNA, 60 nt, Human
gccugcugaguaguugggauuacaggcgcccaccaccaugcccagcuaauuuuuguguuu

SEQ ID NO: 335523 - RNA, 60 nt, Human
gccucccgaguagcugggauuauaggcacccaccaccacgcccagcuaauuuuuguauua

SEQ ID NO: 335524 - RNA, 60 nt, Human
uuuaucagauugcuuuugugcauuggauaacaccaccauucacaaguuaagauucuuggu

SEQ ID NO: 335525 - RNA, 60 nt, Human
cccccaccccauggcuuccaucuuuugcaucaccaccacuccugaacccccauuucugau

SEQ ID NO: 335526 - RNA, 60 nt, Human
gauauuugguuucagaguaaggacuaggugcaccaccaugacugacuaucaaucaaaaug

SEQ ID NO: 335527 - RNA, 60 nt, Human
gcugggagucuuuucccuaacuuguggggacaccaccaguugucaagcuacuaggcagua

SEQ ID NO: 335528 - RNA, 60 nt, Human
ugaggaaaggggaugcagagcccugcccagcaccaccaccuccuaugcuccuggaucccu

SEQ ID NO: 335529 - RNA, 64 nt, Human
cuuuaaucccacuugccccuguuaccuaauuagagcagaugaccccuccccuaaugccugcgga

SEQ ID NO: 335530 - RNA, 64 nt, Human
uggccaugauugaugacgugacugcuuccauuuugcagaugaggaaacuaaggcucagagaggc

SEQ ID NO: 335531 - RNA, 64 nt, Human
ugcugcagaauucacugcauagcaggagauguaagcagaugaguuauuuuuuaagagaaucuaa

SEQ ID NO: 335532 - RNA, 60 nt, Human
aaaaggacagugaguuuucgccuucccuuacaccaccaacuuuacuuuccaacauuuguu

SEQ ID NO: 335533 - RNA, 60 nt, Human
uuuugaguuacuucauggaacuuggacauacaccaccagguccuuuauguguuguucucc

SEQ ID NO: 335534 - RNA, 60 nt, Human
gccucccgaguagcugggacuacgggcacgcaccaccacgucuggcuaauuuuuguauuu

SEQ ID NO: 335535 - RNA, 60 nt, Human
aacauuuccgaguuaauuucccauaggcuucaccaccaagaaaguaagaauugcaucuuu

SEQ ID NO: 335536 - RNA, 60 nt, Human
gccucccgaguagcugggauuacaggugcucaccaccacacccagcuaauuuuuguauuu

SEQ ID NO: 335537 - RNA, 60 nt, Human
cucuauauaagcagucuugcaauaacuaaucaccaccauagaagaaagaaacagacugca

SEQ ID NO: 335538 - RNA, 60 nt, Human
guccacacaagacagcagagccaucugcgacaccaccaacaggcguucucagccuccgga

SEQ ID NO: 335539 - RNA, 60 nt, Human
gccuccugaauagcugggguuacaggugcgcaccaccacgcccggcuaauuuuuguauuu

SEQ ID NO: 335540 - RNA, 60 nt, Human
gacaucugcaugagugacaaacuuucugaacaccaccaccaccaauaauacuuaucagca

SEQ ID NO: 335541 - RNA, 60 nt, Human
aucugcaugagugacaaacuuucugaacaccaccaccaccaauaauacuuaucagcauca

SEQ ID NO: 335542 - RNA, 60 nt, Human
ugcaugagugacaaacuuucugaacaccaccaccaccaauaauacuuaucagcaucauaa

SEQ ID NO: 335543 - RNA, 60 nt, Human
gccuccugaguagcugggacuacaggugugcaccaccacgcccggcuaauuuuuguauuu

SEQ ID NO: 335544 - RNA, 60 nt, Human
gaguguuuccaguuccacccuuuccuggggcaccaccacccuuuuuauauugcugaauuc

SEQ ID NO: 335545 - RNA, 60 nt, Human
gccuccugaguagcugggacuacaagugugcaccaccaugccuggcuaauuuuuugaauu

SEQ ID NO: 335546 - RNA, 60 nt, Human
gccucccaaguagcugggauuacaggcaugcaccaccacaccuggcuaguuuuuguauuu

SEQ ID NO: 335547 - RNA, 60 nt, Human
agcagcacauucugaggggggaacaauucacaccaccaauaauaaccugguaagauuuca

SEQ ID NO: 335548 - RNA, 64 nt, Human
ugacuccuucucauccgauccugagucuggagaggcagaugagguuccugccuacugugugcca

SEQ ID NO: 335549 - RNA, 64 nt, Human
agccgcgggccaggaggcugccacacggaagcaagcagaugaacuaauuucauuucaaggcagu

SEQ ID NO: 335550 - RNA, 64 nt, Human
cugugaguacccuuugugagggaaccaucagcuagcagaugagcaccguauauucauuccaccc

SEQ ID NO: 335551 - RNA, 60 nt, Human
aaaguauagauaauuuaauuaacuuagugacaccaccaaguguuuugauauaacuaaauu

SEQ ID NO: 335552 - RNA, 60 nt, Human
gccucccgaauagcugggacuacaggcgcacaccaccauccccggcuaauuuuuguauuu

SEQ ID NO: 335553 - RNA, 60 nt, Human
ccaaaacugaacucaucaccccucuucccccaccaccaaaacugcuccuccuccuguauu

SEQ ID NO: 335554 - RNA, 60 nt, Human
cagauauauuucuccaagaaagccaacaaccaccaccacaaugacagaaaugacaacaag

SEQ ID NO: 335555 - RNA, 60 nt, Human
aaauaauaauaauaaaaugaaagaaacaaucaccaccaccauuauuaaacuguaacuugu

SEQ ID NO: 335556 - RNA, 60 nt, Human
uaauaauaauaaaaugaaagaaacaaucaccaccaccauuauuaaacuguaacuugucua

SEQ ID NO: 335557 - RNA, 60 nt, Human
cuccuuuccccucucucuagaaucaucucgcaccaccaguuacacuugaauuaagaucug

SEQ ID NO: 335558 - RNA, 60 nt, Human
gcuuccugacuagcugggacuacuggugugcaccaccacacccagcuaauuuucaauuuu

SEQ ID NO: 335559 - RNA, 60 nt, Human
uccugcaaggguggcggguggcugaggucacaccaccacuggaguggaugggcagugccc

SEQ ID NO: 335560 - RNA, 60 nt, Human
gccuccugaguagcuaggacuacaggugugcaccaccacgccccgcuaauuuuuguauuu

SEQ ID NO: 335561 - RNA, 60 nt, Human
ccccaccaccaccaccaccaccaacaccaccaccaccaccgcgagcuggagcgcgcacca

SEQ ID NO: 335562 - RNA, 60 nt, Human
agaccccaccaccaccaccaccaccaacaccaccaccaccaccgcgagcuggagcgcgca

SEQ ID NO: 335563 - RNA, 60 nt, Human
gggagaccccaccaccaccaccaccaccaacaccaccaccaccaccgcgagcuggagcgc

SEQ ID NO: 335564 - RNA, 60 nt, Human
acagacgcagggagaccccaccaccaccaccaccaccaacaccaccaccaccaccgcgag

SEQ ID NO: 335565 - RNA, 60 nt, Human
gggacagacgcagggagaccccaccaccaccaccaccaccaacaccaccaccaccaccgc

SEQ ID NO: 335566 - RNA, 60 nt, Human
uaagggacagacgcagggagaccccaccaccaccaccaccaccaacaccaccaccaccac

SEQ ID NO: 335567 - RNA, 64 nt, Human
aguaaagccacaugacaagcauauaaaaaaaaaugcagaugauacaaauaugaaagaggccuuc

SEQ ID NO: 335568 - RNA, 64 nt, Human
auuccagugcccuguaacaaucacugguccuccugcagaugacccuugguagagucuuuauuug

SEQ ID NO: 335569 - RNA, 64 nt, Human
guugaguuugucugaagaccugggauuuuaucaugcagaugaaacauccagguagcaagcuuca

SEQ ID NO: 335570 - RNA, 60 nt, Human
gucuaagggacagacgcagggagaccccaccaccaccaccaccaccaacaccaccaccac

SEQ ID NO: 335571 - RNA, 60 nt, Human
uacgucuaagggacagacgcagggagaccccaccaccaccaccaccaccaacaccaccac

SEQ ID NO: 335572 - RNA, 60 nt, Human
uuugguccuucuuuccucuuaacguaaauccaccaccaaaauuauuaauccucuugagag

SEQ ID NO: 335573 - RNA, 60 nt, Human
ucaaaagaaauuuuaaaaaaauccuacuaacaccaccacaaauaugcaaucagcaauauc

SEQ ID NO: 335574 - RNA, 60 nt, Human
uugggguuuguagucccaacuugcugcugucaccaccaaacucaaucauuuuuuucccuu

SEQ ID NO: 335575 - RNA, 60 nt, Human
gccuccuaaguagcugggaguacaggcgcgcaccaccacgccuagcugauuuuuguauuu

SEQ ID NO: 335576 - RNA, 60 nt, Human
ggguaccugugggguucuucucuucauuuucaccaccacaaagcuggucuaagcugccau

SEQ ID NO: 335577 - RNA, 60 nt, Human
gggugggucucaagugggaggauaaggcuucaccaccaggagauuccccucugcccgaug

SEQ ID NO: 335578 - RNA, 60 nt, Human
gccucccagguagcugggauuacaggcacccaccaccacgccuggcuaauuuuuguauuu

SEQ ID NO: 335579 - RNA, 60 nt, Human
cagucccaauuggcuaggacugcaggcacacaccaccagacccagcuaauguaauuucua

SEQ ID NO: 335580 - RNA, 60 nt, Human
ugugggaccuuugagccgaugugcacuggccaccaccaggguugggggcgccacagcugc

SEQ ID NO: 335581 - RNA, 60 nt, Human
gccucccagguagcugggacuacaggcgugcaccaccacacccagcuaauuuuuaaguuu

SEQ ID NO: 335582 - RNA, 60 nt, Human
gccuccugaguagcugggauuacaggcacacaccaccacgcccagcuaauuuuuguauuu

SEQ ID NO: 335583 - RNA, 60 nt, Human
auuuucagcuacuauuugaauauucuugaacaccaccacugaagaguuucauauacacca

SEQ ID NO: 335584 - RNA, 60 nt, Human
uuaaaccaauuuuuaaaacaaaacugcggacaccaccauaaaaauggaaucaaaagaaag

SEQ ID NO: 335585 - RNA, 60 nt, Human
uuacuccagccucccaagcagcugggacuacaccaccacagguaugcaccaccauaccug

SEQ ID NO: 335586 - RNA, 64 nt, Human
aagguuuguuguaguugucuuaugugcugaauuugcagaugaucagaugcugugcagaauucug

SEQ ID NO: 335587 - RNA, 64 nt, Human
ggggcauagucaggguggggaguguuugaaguuugcagaugagaagguuugacaaaaagacaga

SEQ ID NO: 335588 - RNA, 64 nt, Human
uuaauuuaauucauguauuaugauuaaaucugaggcagaugagcuuacaaguauugaaauaauu

SEQ ID NO: 335589 - RNA, 60 nt, Human
agcagcugggacuacaccaccacagguaugcaccaccauaccuggcugauuuuuaaaauu

SEQ ID NO: 335590 - RNA, 60 nt, Human
gaguuuuggcaaaugcagucaagucacuaccaccaccacaauuaacagcuauaucacccu

SEQ ID NO: 335591 - RNA, 60 nt, Human
cuugggacaaagguuccucaggaccuuggacaccaccaccugcugagcuucccgucccag

SEQ ID NO: 335592 - RNA, 60 nt, Human
gguuuugaaaaaucuauacaccuguguaaccaccaccaccuguguaaccaccaccgccag

SEQ ID NO: 335593 - RNA, 60 nt, Human
cguugcaaauuccuuuacuguuaucccccccaccaccaggaccauguagggugcagucuu

SEQ ID NO: 335594 - RNA, 60 nt, Human
ccgccaccaccaccaacaccgccacaccaacaccaccacuacaaaaaaaaaagaauuaau

SEQ ID NO: 335595 - RNA, 60 nt, Human
ccuucccccaauacacagaaccaccgccaccaccaccaacaccgccacaccaacaccacc

SEQ ID NO: 335596 - RNA, 60 nt, Human
cucccuucccccaauacacagaaccaccgccaccaccaccaacaccgccacaccaacacc

SEQ ID NO: 335597 - RNA, 60 nt, Human
aggugaucacugaagcaacgcaaccgcuuccaccaccaugguguuuguuucuagaacuuu

SEQ ID NO: 335598 - RNA, 60 nt, Human
aaaucaauuguguggcagcuguauuuucugcaccaccauuuccagcagcaaucggcucuc

SEQ ID NO: 335599 - RNA, 60 nt, Human
gccauccaaauagcugggaccacaggugugcaccaccacgcccggcuaauuuuuuguauu

SEQ ID NO: 335600 - RNA, 60 nt, Human
cugauaaccaaauuuuaacacaucagcauucaccaccagguuuacuuuuauuuucagauu

SEQ ID NO: 335601 - RNA, 60 nt, Human
gccucccgaguagcugggauuacaggcacccaccaccacgcccagcuaauuuuuguauuu

SEQ ID NO: 335602 - RNA, 60 nt, Human
gccucccaaguaccugggacuacaggcacgcaccaccaugccuagcuauucuuuuguauu

SEQ ID NO: 335603 - RNA, 60 nt, Human
gccucccgaauagcuggaauuacaggcacgcaccaccaugccugacuaauuuuguauuuu

SEQ ID NO: 335604 - RNA, 60 nt, Human
agcuaccugccuucaaaauaguuuagggaccaccaccauauuuuauuuuguuuuuauuuu

SEQ ID NO: 335605 - RNA, 64 nt, Human
agucggucaagaggaggauuuuguuuuguaguuugcagaugagcauuucuaaagcauuuucccu

SEQ ID NO: 335606 - RNA, 64 nt, Human
gugugcccagcacccucccuaccugggccuggaagcagaugaggggaauacuucaugcaaagaa

SEQ ID NO: 335607 - RNA, 64 nt, Human
cccauaagaacugaaacucagucuagguccagcugcagaugaggaguccucucuuuaauugcua

SEQ ID NO: 335608 - RNA, 60 nt, Human
gcuuccuaaguagcuggguuuacaggcacccaccaccaugcccagcuaauuuuuguauuu

SEQ ID NO: 335609 - RNA, 60 nt, Human
ccggagaucacccaggagaaauaauacaaacaccaccacuguccagagagaguaaagaag

SEQ ID NO: 335610 - RNA, 60 nt, Human
cagggguccuggaauaccccguagcucuggcaccaccacacuggccucugauggcaagac

SEQ ID NO: 335611 - RNA, 60 nt, Human
accgcccacuucuagccccguggaugccgucaccaccagcacacggaacuaccucccacc

SEQ ID NO: 335612 - RNA, 60 nt, Human
cacuuggugcugcgcccagggaggaagccgcaccaccagccagcgcaggcccugguggag

SEQ ID NO: 335613 - RNA, 60 nt, Human
uucuaccuuuaaauagcaaaguaccacuaccaccaccaccucuugcccccuucccucuuu

SEQ ID NO: 335614 - RNA, 60 nt, Human
ggaggcggagguugcagugagcugagaugccaccaccacaccagccugggugacagagug

SEQ ID NO: 335615 - RNA, 60 nt, Human
uccgugagcugagucucccacugcccugcacaccaccacauuggaccugugcuguccugg

SEQ ID NO: 335616 - RNA, 60 nt, Human
agccucccuaguagcugggacuacagcacccaccaccacacccagcuaauuuuuguauuu

SEQ ID NO: 335617 - RNA, 60 nt, Human
aggaggacgguugacggcccugcuuggauccaccaccaggacgcugugcucggccauggc

SEQ ID NO: 335618 - RNA, 60 nt, Human
gggccaggcagaggugcuccucauccaugacaccaccagucugaaugguccugggggcug

SEQ ID NO: 335619 - RNA, 60 nt, Human
uccugggggcuggggcuggagaggccgcugcaccaccacccgagccugggagccagcguc

SEQ ID NO: 335620 - RNA, 60 nt, Human
uuuaccuggauauaaauuaauugugccugccaccaccauccaacagaccuggugcucuaa

SEQ ID NO: 335621 - RNA, 60 nt, Human
gccucccgaguagcugggaguacaggugcacaccaccaugccuggcuaauuucuguauuu

SEQ ID NO: 335622 - RNA, 60 nt, Human
gcccaccagcagccccacucacagcugcugcaccaccaccuuccgcaggaugcacaggug

SEQ ID NO: 335623 - RNA, 60 nt, Human
ccguccuuggcucaggauuuggagagcuugcaccaccaaaaauggcaaacaucaccagcu

SEQ ID NO: 335624 - RNA, 64 nt, Human
aaagaauucuguccacuuguauuagcuuaauccagcagaugauauugugcaguuacuguuugug

SEQ ID NO: 335625 - RNA, 64 nt, Human
gacaucuuuagggcaggauucuuauccccauuuugcagaugaaaacccugagucacagauuucu

SEQ ID NO: 335626 - RNA, 62 nt, Human; identical to SEQ ID NO: 278600

SEQ ID NO: 335627 - RNA, 60 nt, Human
ggaccccagagccagcccucccacuaccaccaccaccaccccggggcuccuuggcucacc

SEQ ID NO: 335628 - RNA, 60 nt, Human
ucuggaccccagagccagcccucccacuaccaccaccaccaccccggggcuccuuggcuc

SEQ ID NO: 335629 - RNA, 60 nt, Human
cauucucguuuuggaggaaacaaucucugccaccaccaagucauugacuuugcucgaggc

SEQ ID NO: 335630 - RNA, 60 nt, Human
ucccauuugcauaucacccuucccugcucccaccaccagugagacaagcugaagauuagg

SEQ ID NO: 335631 - RNA, 60 nt, Human
gcguccuauuguccuuaagagggcguuucacaccaccaacaguaagccacccacucugga

SEQ ID NO: 335632 - RNA, 60 nt, Human
aaagagggaguuccugacugcuagaggugccaccaccacaaacacuuuuuauucaggaga

SEQ ID NO: 335633 - RNA, 60 nt, Human
guuccugagauggaaagcacaaauuuaauacaccaccacaauggaaaacaaguucaaaga

SEQ ID NO: 335634 - RNA, 60 nt, Human
auuacauauguucauaaguuguacaaccaucaccaccauccaucuucagaauuauuuuca

SEQ ID NO: 335635 - RNA, 60 nt, Human
ucuaggcaugcagacaaccccacacggccacaccaccacaugcccaaguguacacacaca

SEQ ID NO: 335636 - RNA, 60 nt, Human
uccgcauccacccccguccgccauccugcccaccaccaggucgguucccgaggccuggcc

SEQ ID NO: 335637 - RNA, 60 nt, Human
cugcuuguccugggccugccccuguguauucaccaccaauaaaucagaccaugaaaccag

SEQ ID NO: 335638 - RNA, 60 nt, Human
caggucucuugugcccuguucucuuguccccaccaccaaccuauagcaggcaccaaagca

SEQ ID NO: 335639 - RNA, 60 nt, Human
gccuccugaguagcuggcauuauaggugcccaccaccaugccuggcugauuuuuguauuu

SEQ ID NO: 335640 - RNA, 60 nt, Human
gccucccaaauagcugugauuacaggcgugcaccaccacgcccggcuaauguuuguauuu

SEQ ID NO: 335641 - RNA, 60 nt, Human
gcagggcugggaugaggcuuguacaacccccaccaccaauuucccagggacuccaggguc

SEQ ID NO: 335642 - RNA, 60 nt, Human
gccucccgaguagcugggauuaccggcacccaccaccacgccuggcuaauuuuucaauuu

SEQ ID NO: 335643 - RNA, 64 nt, Human
ggcccucuugagccuugggcagggugggugaggugcagaugaccaggagugugugaaugccuuc

SEQ ID NO: 335644 - RNA, 64 nt, Human
ccagauucagagaaugcgauuuagggaaacgguggcagaugagugggagacugguugcaaggug

SEQ ID NO: 335645 - RNA, 64 nt, Human
ccagauucagagaaucugauuuagggaaacuguggcagaugagugggagacugguugcaaggug

SEQ ID NO: 335646 - RNA, 60 nt, Human
ggcaguugguggcagugagaccagcccacccaccaccacccaccacagaaaagcacaaac

SEQ ID NO: 335647 - RNA, 60 nt, Human
gccucccaaguagcugggacuacaggcacacaccaccacgcccagcuaauuuuuguauuu

SEQ ID NO: 335648 - RNA, 60 nt, Human
uccucccaaguagcuggaacuacaggugugcaccaccaugccugguucauuuuuguguuu

SEQ ID NO: 335649 - RNA, 60 nt, Human
ggugggagggcgugggggccccuggguggacaccaccagccaccagucccuggcaugccc

SEQ ID NO: 335650 - RNA, 60 nt, Human
gccuucugaguagcugggaccacaggcgugcaccaccaugcccaccuaauuuuuuauuuc

SEQ ID NO: 335651 - RNA, 60 nt, Human
ccgccuggugggcauuugccgccgccuccccaccaccagucacugccucgcagagcccua

SEQ ID NO: 335652 - RNA, 60 nt, Human
cagugcacuuguccuuacgucaguuccuuacaccaccaaagcacuucaccuuucuggaaa

SEQ ID NO: 335653 - RNA, 60 nt, Human
ccuccugccaucuacaggcuugucacaucucaccaccagaaacaggcuuccucaggcuuc

SEQ ID NO: 335654 - RNA, 60 nt, Human
acccagcugccuuuccucccucacaggagccaccaccagccaccucucaggagaagccag

SEQ ID NO: 335655 - RNA, 60 nt, Human
gucccaggaguagcugggacuacaggugcccaccaccacacccagcuaauuuuuuuguau

SEQ ID NO: 335656 - RNA, 60 nt, Human
cuccugaguagccggggagcuacaagcaugcaccaccacacccagcuaauuuuuuuuuuu

SEQ ID NO: 335657 - RNA, 60 nt, Human
gccucccuaguagcugggauuacaggugcacaccaccacaccuggcuaauuuuuguauuu

SEQ ID NO: 335658 - RNA, 60 nt, Human
agugaccacugggacuucaggcaagaagcucaccaccaggcacacagcaaagggacugaa

SEQ ID NO: 335659 - RNA, 60 nt, Human
ucucucuuuuucuuugaggagaaugauggucaccaccacaauuaauuguaauuaagggaa

SEQ ID NO: 335660 - RNA, 60 nt, Human
uucuucuuguuauuccuccagcaacucccucaccaccacgccucccugccuaccaucccc

SEQ ID NO: 335661 - RNA, 60 nt, Human
uuuguagcuccucuccggcugccuugcagacaccaccacaugggcucugcucuaugggaa

SEQ ID NO: 335662 - RNA, 64 nt, Human
gucacagggcaaguagaucauggaccacagaacagcagaugagaaaagacuuggguuggaguga

SEQ ID NO: 335663 - RNA, 64 nt, Human
auuuugcuugguggaugaaaugucaguggaagaagcagaugagaaacucuugagaucuuggucc

SEQ ID NO: 335664 - RNA, 64 nt, Human
aacugauaauauacugaaacauauaauggaagaugcagaugauaaaacuaauuuugaacuuuuu

SEQ ID NO: 335665 - RNA, 60 nt, Human
cagcgccccugcugucuuccccaccgcagucaccaccacccgaaaugccacguggucacu

SEQ ID NO: 335666 - RNA, 60 nt, Human
ggagauggccgcacccacagcugccuuucccaccaccagccucggugcucugccccaugc

SEQ ID NO: 335667 - RNA, 60 nt, Human
cacccagagccugccagggagggcuggccucaccaccaccgucaauaaaggauuugaauc

SEQ ID NO: 335668 - RNA, 60 nt, Human
gcaucccaaguagcugggauuacaggcacccaccaccaugcccaacuaauuuuuguauuu

SEQ ID NO: 335669 - RNA, 60 nt, Human
uagguaguccauaggaaccacccccaugaccaccaccaacaucaacuaaagguucuugga

SEQ ID NO: 335670 - RNA, 60 nt, Human
gccucccgaauagcugggauuacacgugcccaccaccaugcccagcuaauuuuuguauuu

SEQ ID NO: 335671 - RNA, 60 nt, Human
gucuccugaguagcugggaucacaggugcacaccaccacgccuggcuaauuuuuuuauuu

SEQ ID NO: 335672 - RNA, 60 nt, Human
gccucuugaguagcugggauuacaggcgcccaccaccacagccugcuaauuuuuguauuu

SEQ ID NO: 335673 - RNA, 60 nt, Human
cuggacuuggagagaugggaggcagacccccaccaccauacaugcugucuguggccccuc

SEQ ID NO: 335674 - RNA, 60 nt, Human
agcaauuuguuuaaugagugguucagccaucaccaccaguggccaccuguucaauaaaau

SEQ ID NO: 335675 - RNA, 60 nt, Human
ccugcccaccuaccuggcucugaccguucccaccaccaucugcauguccccacugggccu

SEQ ID NO: 335676 - RNA, 60 nt, Human
agccucucaaguagcgggauuacaggcgcccaccaccaaaaauuagcccagcuaauuuuu

SEQ ID NO: 335677 - RNA, 60 nt, Human
gccacuuccccacccgggaaaggcugccgccaccaccaccaccaacacaacagcaauggc

SEQ ID NO: 335678 - RNA, 60 nt, Human
acuuccccacccgggaaaggcugccgccaccaccaccaccaacacaacagcaauggcaac

SEQ ID NO: 335679 - RNA, 60 nt, Human
uccccacccgggaaaggcugccgccaccaccaccaccaacacaacagcaauggcaacacc

SEQ ID NO: 335680 - RNA, 60 nt, Human
uccagaggccaccaggagcugagacagugccaccaccagcaccucccacaagcccaccgc

SEQ ID NO: 335681 - RNA, 64 nt, Human
acacauucaagaccucgaagucauucuuggccaagcagaugacaacacaucuccuggacuggag

SEQ ID NO: 335682 - RNA, 64 nt, Human
ucuguaugccuuugucuugucauuugcuuuuagggcagaugacacuuuuucccacccuuuuaaa

SEQ ID NO: 335683 - RNA, 64 nt, Human
uaacuaagcgugaaugaggaacagaagaagcagagcagaugauucgagcagcauuuguuucucc

SEQ ID NO: 335684 - RNA, 60 nt, Human
cuuccggauggagggagagguugugcugaccaccaccacacuggcacaggcgggagccuu

SEQ ID NO: 335685 - RNA, 60 nt, Human
gccucccaaguagcugggauuacaggugcccaccaccaccccuggcuaaauuuguauuuu

SEQ ID NO: 335686 - RNA, 60 nt, Human
gccucggacuaugacuggcuacggggaggccaccaccaggccccagcucuccacccugaa

SEQ ID NO: 335687 - RNA, 60 nt, Human
caacauggccuguacccagcagagugguggcaccaccaugguuacagcggaugccccgag

SEQ ID NO: 335688 - RNA, 60 nt, Human
gaccaggcuugggcuuccccagcgccccaccaccaccacgugcagguggagcucugggau

SEQ ID NO: 335689 - RNA, 60 nt, Human
agcgaccaggcuugggcuuccccagcgccccaccaccaccacgugcagguggagcucugg

SEQ ID NO: 335690 - RNA, 60 nt, Human
gaccccccucucuuccccacuggguucugccaccaccaggaggauuucaagaaagcacca

SEQ ID NO: 335691 - RNA, 60 nt, Human
gcauccuaauuaguugggauuacaggcgcccaccaccaugcccggcuaauuuuuguguuu

SEQ ID NO: 335692 - RNA, 60 nt, Human
cugagagcuuggugaaggugucuccaucaccaccaccagagccuccugcccagcccuggc

SEQ ID NO: 335693 - RNA, 60 nt, Human
cuucugagagcuuggugaaggugucuccaucaccaccaccagagccuccugcccagcccu

SEQ ID NO: 335694 - RNA, 60 nt, Human
acugaugccucccacugugacaggcccugucaccaccaauaucuuauuucaaccucacag

SEQ ID NO: 335695 - RNA, 60 nt, Human
gaaaagagggugcagggcacggcugcuccccaccaccaggucugcauuuguucaucauca

SEQ ID NO: 335696 - RNA, 60 nt, Human
ggcacaucuggagggcagggguugaggggccaccaccacacaugccuuucuggggugaag

SEQ ID NO: 335697 - RNA, 60 nt, Human
gugugcagugcccuugccugccuucacccccaccaccacuucuccaauaaagccgccugg

SEQ ID NO: 335698 - RNA, 60 nt, Human
ugacuaucccauaucacagauaugauuuaccaccaccacccugcccccgcucccgugaag

SEQ ID NO: 335699 - RNA, 60 nt, Human
gauuguuuucaauuucuucuuuuauguucacaccaccacauucccauucacuuugauuuu

SEQ ID NO: 335700 - RNA, 64 nt, Human
ccaugggcauagguaagcugugccuucagcuguugcagaugaaauguucuguucacccugcauu

SEQ ID NO: 335701 - RNA, 64 nt, Human
auuuucagauauuuuccagggugaaaucuguaaugcagaugauauaaugcccacuugugcucuu

SEQ ID NO: 335702 - RNA, 64 nt, Human
agcuuggacaugguuugcagcuuucauacaccaagcagaugauugauaaaaccugggaguaagg

SEQ ID NO: 335703 - RNA, 60 nt, Human
cuagccccaugugaugugaaaacuaaaaggcaccaccaacuagacauguguucauaaauu

SEQ ID NO: 335704 - RNA, 60 nt, Human
gccuccugaguagcugggacuacaggcaugcaccaccacgcccagcuaauuuuuguguuu

SEQ ID NO: 335705 - RNA, 60 nt, Human
gccucccgaauagcuggaauuacgggcaugcaccaccacaccuggcuaauuuuuguauuu

SEQ ID NO: 335706 - RNA, 60 nt, Human
uccaacucuuaugcccccaaccugcccuaccaccaccacgcgcucagccugauguguuua

SEQ ID NO: 335707 - RNA, 60 nt, Human
cucaccugccugccugucucccuccucugucaccaccagccucuccaagcucaaguacaa

SEQ ID NO: 335708 - RNA, 60 nt, Human
guucgagccccacuucugguugcauguucccaccaccacgcucugcugguuuuagucggc

SEQ ID NO: 335709 - RNA, 60 nt, Human
ccugcaaggcccgcuuuucagggaccaguccaccaccaucuccuccacguugagugaagc

SEQ ID NO: 335710 - RNA, 60 nt, Human
gcuggugccugaagaccccagaugugagggcaccaccaagaauuuguggccuaccuugug

SEQ ID NO: 335711 - RNA, 60 nt, Human
agcccccagguaacugggacuacaggcaugcaccaccaugccuggcuaauuuuuguauuu

SEQ ID NO: 335712 - RNA, 60 nt, Human
gccucuccaguagcugggauuacaggugugcaccaccacgccuggcuaaauuuuguauuu

SEQ ID NO: 335713 - RNA, 60 nt, Human
cacugcuuucuccucugugccauccacucccaccaccagguuguuuuggccugaggagca

SEQ ID NO: 335714 - RNA, 60 nt, Human
cagcacagccccaucaguccaggaacuucccaccaccagcccuugacugucccauuaacu

SEQ ID NO: 335715 - RNA, 60 nt, Human
acagccaugcccagaagccucacaccucgucaccaccaccaccccccaccccauccugag

SEQ ID NO: 335716 - RNA, 60 nt, Human
gccaugcccagaagccucacaccucgucaccaccaccaccccccaccccauccugaggca

SEQ ID NO: 335717 - RNA, 60 nt, Human
cuucuucuuccaaaugcaguucauugcagacaccaccauauugcuaucuaauggggaaau

SEQ ID NO: 335718 - RNA, 60 nt, Human
caacgguuucucuugggggcuuugaaauaacaccaccaguggacuuaagguugaagugug

SEQ ID NO: 335719 - RNA, 64 nt, Human
cuggagcugcugcccagcacagaggagagucgccgcagaugaccuagcugcggugugagagagc

SEQ ID NO: 335720 - RNA, 64 nt, Human
aauuaacaacuugcaaaugaggugcaaauaaaaugcagaugauugcgcggcuuugaauccaauu

SEQ ID NO: 335721 - RNA, 64 nt, Human; identical to SEQ ID NO: 335720

SEQ ID NO: 335722 - RNA, 60 nt, Human
cagccccaaguaggugggacuccaggcaugcaccaccaugccuggcuaauuuuugcauuu

SEQ ID NO: 335723 - RNA, 60 nt, Human
ggguagggaaacaaccaacuaauugacuaacaccaccaacaacaaaaaacaaacccaauc

SEQ ID NO: 335724 - RNA, 60 nt, Human
ggucgggacagacgacgcuaccugcccagacaccaccaaguucucugccugcaaaaccug

SEQ ID NO: 335725 - RNA, 60 nt, Human
cagauucauccauaaucccuuucugcuguucaccaccacccaugauccaucuguguaguu

SEQ ID NO: 335726 - RNA, 60 nt, Human
ugccccacuacagaacagggcuaaauuagccaccaccacugaaaacucagccgaauuuuu

SEQ ID NO: 335727 - RNA, 60 nt, Human
gucucccaaguagcugggauuacaggugugcaccaccacgccugacuaauuuuguauuuu

SEQ ID NO: 335728 - RNA, 60 nt, Human
uuaaagaaacuggggaaggauuuaugaauacaccaccaccagaguggauaaugcuuagaa

SEQ ID NO: 335729 - RNA, 60 nt, Human
aagaaacuggggaaggauuuaugaauacaccaccaccagaguggauaaugcuuagaauuc

SEQ ID NO: 335730 - RNA, 60 nt, Human
gccuccuagauaacugggauuacaggugcccaccaccaugcccggcuaauuuuuguauuu

SEQ ID NO: 335731 - RNA, 60 nt, Human
gcauccuucuuccugagccaacugcuugggcaccaccacagcgucuucuauagcucggug

SEQ ID NO: 335732 - RNA, 60 nt, Human
acccucucccaccucaugcuccugcaccugcaccaccaagguugaugccggauucgaagc

SEQ ID NO: 335733 - RNA, 60 nt, Human
aaaucuggaacaaaugaaacaucuuuuagccaccaccacccuguugcaauuaagacaacc

SEQ ID NO: 335734 - RNA, 60 nt, Human
uuacuuggggugcucuucugugacacuugccaccaccaccuuccaguagcaagcugguag

SEQ ID NO: 335735 - RNA, 60 nt, Human
aacccauggggcuagagacugccaugcaaccaccaccacgacagcccuuccuccaucaga

SEQ ID NO: 335736 - RNA, 60 nt, Human
ugggggcggaugguggcccaggagacagcacaccaccaggcuccacacgugcaugcuuuc

SEQ ID NO: 335737 - RNA, 60 nt, Human
gccgcccaaguaucugggaccacaggcgugcaccaccaugcauagcuaauuuauuuuuug

SEQ ID NO: 335738 - RNA, 64 nt, Human
caaguaaauuugaauuuucgguuuaauguugaaagcagaugaacuuuucuugaguuauuuuguc

SEQ ID NO: 335739 - RNA, 64 nt, Human
uaccaugggcauuuguucucuguuggagcuguaagcagaugaacccaaguagagaagauagauc

SEQ ID NO: 335740 - RNA, 64 nt, Human
aggguccagaggccgacuggagcaagguuugcuggcagaugaggccucaguggaagugacggcu

SEQ ID NO: 335741 - RNA, 60 nt, Human
aauuuucuggcacuuccucucuauugcccccaccaccaccacccccaucacugcuuucuc

SEQ ID NO: 335742 - RNA, 60 nt, Human
uuucuggcacuuccucucuauugcccccaccaccaccacccccaucacugcuuucuccca

SEQ ID NO: 335743 - RNA, 60 nt, Human
agagacuagcagcggggccaccuccacaaccaccaccacaagguaggugcagcguccacc

SEQ ID NO: 335744 - RNA, 60 nt, Human
cuggagcagcuccuuccccuuugcugauaacaccaccacugggacgugccauguugggac

SEQ ID NO: 335745 - RNA, 60 nt, Human
gacuaucaggccaugugcaaacccucgagucaccaccacagugcagcccagccccugguc

SEQ ID NO: 335746 - RNA, 60 nt, Human
auaccaccccaaacacaacucaacuucccacaccaccaugucucucaccacaccuucugg

SEQ ID NO: 335747 - RNA, 60 nt, Human
ccggaagaucuggcgaagcucaggcaaaaacaccaccaaucacguggaaguuaauuuuau

SEQ ID NO: 335748 - RNA, 60 nt, Human
auucguuuauggguaguaccgggaugaacccaccaccacaaagcaaauuagacaacuuaa

SEQ ID NO: 335749 - RNA, 60 nt, Human
gccucccaaguagcugggauuacagucaggcaccaccacacccggcuaauuuuguauuuu

SEQ ID NO: 335750 - RNA, 60 nt, Human
ucuggaugauaggacagaugauggauucuucaccaccauuuuccuuguacucuucucucc

SEQ ID NO: 335751 - RNA, 60 nt, Human
cccuucugccugccagacgugccacugccccaccaccagcugaaaacagcagcacaucgc

SEQ ID NO: 335752 - RNA, 60 nt, Human
auuaacuccuuggcuguggucccccagcuacaccaccagcccagguccuggcugccagcu

SEQ ID NO: 335753 - RNA, 60 nt, Human
gaccuucucuuuuagauaaagaugagcccccaccaccaccgacucucccaacccagacuc

SEQ ID NO: 335754 - RNA, 60 nt, Human
gccuccugaguagcugggauuacaggcacacaccaccacaccuggcccagcuaauucuuu

SEQ ID NO: 335755 - RNA, 60 nt, Human
gccuccccaguagcugggauuacagaucugcaccaccaugcccagcuaauuuuguauuuu

SEQ ID NO: 335756 - RNA, 60 nt, Human
gccuccugaguagcugggauuauaggcacgcaccaccacgcccagcuaauuuuuuguauu

SEQ ID NO: 335757 - RNA, 64 nt, Human
ugcagcaacucuggaaaccuggccugacagacaagcagaugaccucacaggagugauaagaaac

SEQ ID NO: 335758 - RNA, 64 nt, Human
aguagaagugagccagacaaaaaaagcagaaaaugcagaugauggaaaggacaugugccaugca

SEQ ID NO: 335759 - RNA, 64 nt, Human
ucaccugggccauuugcagaugagacuguaguuugcagaugagacuguaguuugcagauggcgu

SEQ ID NO: 335760 - RNA, 60 nt, Human
ucucuuucauccacacuucuguuaacuucccaccaccaucaaucaucugauuuccugaaa

SEQ ID NO: 335761 - RNA, 60 nt, Human
cuuaauaaaauagcauuaggucuaucuagccaccaccaccuuucaacuuuuuaucacuca

SEQ ID NO: 335762 - RNA, 60 nt, Human
cagccuggcauccaggcagggacacccucacaccaccagccccagggagcuucccugcua

SEQ ID NO: 335763 - RNA, 60 nt, Human
gaccgggacagccgcuccagcuucugcacucaccaccaugugggcuggggggcggggcgg

SEQ ID NO: 335764 - RNA, 60 nt, Human
gccuccugaguagcugggacuacaugcgcacaccaccacguccggcuaauuuuuguauuu

SEQ ID NO: 335765 - RNA, 60 nt, Human
gccuccugaguagcugggacuacaggcaugcaccaccacacccggcuaauuuuuguauuu

SEQ ID NO: 335766 - RNA, 60 nt, Human
ccuccagaguagcugggacuacgggcgccccaccaccacgcccggcuaauuuuuuguauu

SEQ ID NO: 335767 - RNA, 60 nt, Human
aggggaccucaucucccgccugaccucggacaccaccauggucagcgaccuggucuccca

SEQ ID NO: 335768 - RNA, 60 nt, Human
gccucacgaguagcugggacuacaggcaugcaccaccacgcccagcuaauuuuuguauuu

SEQ ID NO: 335769 - RNA, 60 nt, Human
gcuucccgaguagcugggauuauaggcacccaccaccacaccuggcuaauuuuuguauuu

SEQ ID NO: 335770 - RNA, 60 nt, Human
aguuucugcugcuucucccauaacugcugccaccaccaucagaauucauaaucaaaccua

SEQ ID NO: 335771 - RNA, 60 nt, Human
cagcacauugacccauagcacacacauacacaccaccaccaacaacgcuugugaauguau

SEQ ID NO: 335772 - RNA, 60 nt, Human
cacauugacccauagcacacacauacacaccaccaccaacaacgcuugugaauguauuuu

SEQ ID NO: 335773 - RNA, 60 nt, Human
uugguuuguuaauuuauacaaagagauuaccaccaccacccccuccuucagacggcggag

SEQ ID NO: 335774 - RNA, 60 nt, Human
agacgcugaaacugcugccuuucaggaaagcaccaccaacgcuggaggaggagccggccc

SEQ ID NO: 335775 - RNA, 60 nt, Human
gccucccaaguagcugggauuacaggugcgcaccaccaugccuggcuguguuuucacuuu

SEQ ID NO: 335776 - RNA, 64 nt, Human
aaaauauagcauucugaccuaaaaaaguuauuuugcagaugaauguguuuucaacucaggaccu

SEQ ID NO: 335777 - RNA, 64 nt, Human
ucaagcagagaaacugaccugacuaaaguuaaucgcagaugaacuagaagucacagguuaauua

SEQ ID NO: 335778 - RNA, 64 nt, Human
gaagcuuuacuuuagaaacuuaacccaaggucaagcagaugaguagugaacacaggugaucgag

SEQ ID NO: 335779 - RNA, 60 nt, Human
ugcagcaucuuucccacauucaauaugaagcaccaccagauggcuaccaaaugauaagaa

SEQ ID NO: 335780 - RNA, 60 nt, Human
ucauuuucccccauagaagagaaaaaagagcaccaccauuauuaccaccuccccaacccu

SEQ ID NO: 335781 - RNA, 60 nt, Human
gccucccaaguagcugggauuacaggugcccaccaccaugccuggcuuaauuuuuuguau

SEQ ID NO: 335782 - RNA, 60 nt, Human
gccucccgaguggcugggauuagcggcaugcaccaccacgcccagcuauuuuuguauuuu

SEQ ID NO: 335783 - RNA, 60 nt, Human
cguggccauggccagacaccccagucccuucaccaccaccugcuccccacgccaccacca

SEQ ID NO: 335784 - RNA, 60 nt, Human
agucccuucaccaccaccugcuccccacgccaccaccauuuggguggcuguuuuuaaaaa

SEQ ID NO: 335785 - RNA, 60 nt, Human
ugauacccaggcccguuucucaccugagcgcaccaccaccuggcguguagaaucuccagg

SEQ ID NO: 335786 - RNA, 60 nt, Human
uccccugucccccucucgccgcccgcccgccaccaccacucucacuccacccagaguaga

SEQ ID NO: 335787 - RNA, 60 nt, Human
aaucaaacccauccucaaaggaugaagacucaccaccauccaggacauucagaagaguuc

SEQ ID NO: 335788 - RNA, 60 nt, Human
gcauaucuuaaucgacauucccaguccuuucaccaccagaaccaacuccucuuucaaaca

SEQ ID NO: 335789 - RNA, 60 nt, Human
gcaucucgaguagcugggauuacaggcaugcaccaccacgcccagcuaauuuuguauuuu

SEQ ID NO: 335790 - RNA, 60 nt, Human
uugcaugagccugcgacaggaccucacccccaccaccaggcuucuauuugggauucacau

SEQ ID NO: 335791 - RNA, 60 nt, Human
aagacucaagugggaacgacugggcacugccaccaccagaaagcuguucgacgagacggu

SEQ ID NO: 335792 - RNA, 60 nt, Human
ugcccagaggaucacagugcugagaccccccaccaccagccgguaccugggaagggggag

SEQ ID NO: 335793 - RNA, 60 nt, Human
uccuggacuggcccuugcccaacucccagccaccaccacugucccuaccacugagcccuu

SEQ ID NO: 335794 - RNA, 60 nt, Human
ucaaaagcauucuagccaugugcaaccaaacaccaccaaaaauaaaaucaaacaaaacua

SEQ ID NO: 335795 - RNA, 64 nt, Human
auguuugcauuaaaaguguuuauauaacuuagaagcagaugaauauuucuaauaaaugauugcu

SEQ ID NO: 335796 - RNA, 64 nt, Human
gggcagcaggaagcccaagugaaauuaauauuaugcagaugaugaaagggaccucugaacagga

SEQ ID NO: 335797 - RNA, 64 nt, Human
guuccagggagcuugcccgggucuccucgggggagcagaugagggcccugcccccgccccacug

SEQ ID NO: 335798 - RNA, 60 nt, Human
aacaccacgcuguagucuccaacagaaaaacaccaccaaaacagauacccauguugaggg

SEQ ID NO: 335799 - RNA, 60 nt, Human
gccuccugaguagcugggauuauaggcacacaccaccacacccagcuaaucuuuuuguau

SEQ ID NO: 335800 - RNA, 60 nt, Human
cugacuccagagcccccuccuaagaaccaucaccaccacucagccaaucuguucugggcc

SEQ ID NO: 335801 - RNA, 60 nt, Human
cauugccuccaugcccuugcuuggcucaagcaccaccaaucgcuuuaaugcuucagccac

SEQ ID NO: 335802 - RNA, 60 nt, Human
cccucagcuccucccugccagcaucccagucaccaccagguggcgcuucugacacggucc

SEQ ID NO: 335803 - RNA, 60 nt, Human
gccuccugaguagcugggaauauaggugcacaccaccaugccuggcuaauuuuuguauuu

SEQ ID NO: 335804 - RNA, 60 nt, Human
caaaaccucucccacccuuguguuucacuccaccaccaaccccagguaaaaaagucuccc

SEQ ID NO: 335805 - RNA, 60 nt, Human
cuucucuaccaucacuccuguggcggucaccaccaccaccucucccgcccuuaccagcag

SEQ ID NO: 335806 - RNA, 60 nt, Human
uuccuucucuaccaucacuccuguggcggucaccaccaccaccucucccgcccuuaccag

SEQ ID NO: 335807 - RNA, 60 nt, Human
gccuccugaguagcugggacuacaggugugcaccaccacacccagccaaaacagccaucc

SEQ ID NO: 335808 - RNA, 60 nt, Human
gccucccaaguagcugggauuacaggugugcaccaccaugcccggcuaauuuuuuguauu

SEQ ID NO: 335809 - RNA, 60 nt, Human
gccucccaaguagcugggauuacaggcacccaccaccaugcccagcuaauuuuuguauuu

SEQ ID NO: 335810 - RNA, 60 nt, Human
uccucccaagaagcugagauuacagaugaccaccaccacuccuggcuaauuuuuuguauu

SEQ ID NO: 335811 - RNA, 60 nt, Human
uagauccuucagguccccacccucagcugucaccaccacccuccccaggggacuccaucu

SEQ ID NO: 335812 - RNA, 60 nt, Human
aauuuggaaaggagcuaguagcuuuaaggccaccaccauauuuuacuuuuuuaggauuuu

SEQ ID NO: 335813 - RNA, 60 nt, Human
gucgaggaagcccuggaauguucagcagaacaccaccacugugacauggggcuguggcag

SEQ ID NO: 335814 - RNA, 64 nt, Human
acugcagcccugggucuucccuuagggaggaagggcagaugaacccagcaggcuuaggaggugg

SEQ ID NO: 335815 - RNA, 64 nt, Human
ccucucccuuccuccucaggacauggagaucugugcagaugagcucaagaagguccuuaacaca

SEQ ID NO: 335816 - RNA, 64 nt, Human
uccuuuuauuuuacaugagugcugauguguuuuggcagaugagcuuucagcugaggccugaugg

SEQ ID NO: 335817 - RNA, 60 nt, Human
uggcagugccacauuugaccaugagcaccacaccaccauuguggccacccgucacuaucg

SEQ ID NO: 335818 - RNA, 56 nt, Human
ugcgcuucuccaucaacugaagaagacaccaccauucugaggccagggagcgagug

SEQ ID NO: 335819 - RNA, 60 nt, Human
gccucccaaguagcugagacuacaggcacacaccaccacgccuggcuaauuuuuguauuu

SEQ ID NO: 335820 - RNA, 60 nt, Human
cccaugacccaccccugugcuccgugccuccaccaccacuggccaccaggcuggcgcagc

SEQ ID NO: 335821 - RNA, 60 nt, Human
augggguacuaacaccacccccaccgcccccaccaccacccccagcuccugaggugcugg

SEQ ID NO: 335822 - RNA, 51 nt, Human
ugccgagaagaaggagauaaacaccaccaucaucaaagagcugcucaagaa

SEQ ID NO: 335823 - RNA, 60 nt, Human
ggagcaccuggccuuaggaauccuggcugccaccaccacaaggcuccccauuuggacauu

SEQ ID NO: 335824 - RNA, 60 nt, Human
uuuagaguuaggugccugccuaaagccaggcaccaccacaccuggcuuuagaguucacac

SEQ ID NO: 335825 - RNA, 60 nt, Human
auuucagugacuccagaagaaaugagccuccaccaccaagaaaugaacuuagagaaucag

SEQ ID NO: 335826 - RNA, 60 nt, Human
acuugggggaaaaauuagugaugaaacagccaccaccauauugccauuaguggaaaaaaa

SEQ ID NO: 335827 - RNA, 60 nt, Human
auuuuaaauaggggcauugaaauuuacucccaccaccagggcuuuuuugggggaugccug

SEQ ID NO: 335828 - RNA, 60 nt, Human
aggacugcagcaggacagggacuggcuucucaccaccagccuuuccgucugauggacagc

SEQ ID NO: 335829 - RNA, 60 nt, Human
augagccaccagugccccggcacccuuuaacaccaccagauggguguuuucccccaucca

SEQ ID NO: 335830 - RNA, 60 nt, Human
acuggggaaggggaggguguucagaggcagcaccaccacacagucaccccucccucccuc

SEQ ID NO: 335831 - RNA, 60 nt, Human
gccuccccaguagcugggauuacaggcacccaccaccaugcccagcuaauuguuguaugu

SEQ ID NO: 335832 - RNA, 60 nt, Human
gccucccgaguagcugggauuacaggcacacaccaccacgcccagcuaguuuuuuuguau

SEQ ID NO: 335833 - RNA, 56 nt, Human
uaggacccuuuaaauggugaaaaugggcagaugaauagcaauaaguggaccuuugu

SEQ ID NO: 335834 - RNA, 64 nt, Human
uuuuauuuaaaugcuuuuuaucgcuaaaugacuugcagaugaaaaaaacuaaggugacucgagu

SEQ ID NO: 335835 - RNA, 64 nt, Human
cggcuguguuaggaaaaacauguuacacuguaaggcagaugaucguccccguaugaugauuguc

SEQ ID NO: 335836 - RNA, 60 nt, Human
caggacugagggaacugcuggcucgccuggcaccaccacacggccacagccagccaucug

SEQ ID NO: 335837 - RNA, 60 nt, Human
ucaugccgcccccgugcccugcacaaaaaccaccaccagcagcucacauuucacgucucg

SEQ ID NO: 335838 - RNA, 60 nt, Human
ucguggaacagccuagaaaccaagggacuccaccaccaagucacuuccccugcucgugca

SEQ ID NO: 335839 - RNA, 60 nt, Human
ccgcguuucagggccucgguccauagagaacaccaccaccauggccagguggaaggguuu

SEQ ID NO: 335840 - RNA, 60 nt, Human
cguuucagggccucgguccauagagaacaccaccaccauggccagguggaaggguuuauu

SEQ ID NO: 335841 - RNA, 60 nt, Human
gccuuccaaguagcugggacuacaggugugcaccaccacagcuggcuaauucuauuuuuu

SEQ ID NO: 335842 - RNA, 60 nt, Human
gccucccaaguagcugggauuacuggugcacaccaccacacucagcuaauuuuugcauuu

SEQ ID NO: 335843 - RNA, 60 nt, Human
aggagcagucagcauucuuccaauuugccccaccaccaccuccucgggcuucauuuucuc

SEQ ID NO: 335844 - RNA, 60 nt, Human
agccccagaguagcuggaauuacaggcacacaccaccacgccuggcuaauuuuuguauuu

SEQ ID NO: 335845 - RNA, 60 nt, Human
cuuggagaugucccuucaccccuccccuuucaccaccauccucuuuuccucauggaaaug

SEQ ID NO: 335846 - RNA, 60 nt, Human
gcuucccgaguaacugagauuacaggcacccaccaccaugcccagcugcuuuuuuguauu

SEQ ID NO: 335847 - RNA, 60 nt, Human
uaaccguggugagggcuggaaauccaaacucaccaccaugaucugugaaauaaagcccuu

SEQ ID NO: 335848 - RNA, 53 nt, Human
gaacagcggaacuccccuagggacaccaccacccaugccccucugucccgugg

SEQ ID NO: 335849 - RNA, 60 nt, Human
cucuaacagugcuuacugcagccuuguguccaccaccaacuucucagcauguuucucucc

SEQ ID NO: 335850 - RNA, 60 nt, Human
cuugccagagacuguguguuuuguuucccccaccaccaucacugccaccuggcuucugcc

SEQ ID NO: 335851 - RNA, 60 nt, Human
gucucuuccccugccccaacuggcccucuccaccaccaacuucucuacuuuggguuuguu

SEQ ID NO: 335852 - RNA, 64 nt, Human
uguuuaggguggagaaagagguacuggaaaacaugcagaugaggauaucuuuuaugugcaacag

SEQ ID NO: 335853 - RNA, 64 nt, Human
accuaauuguauuuacuguaauaucuuauaacaugcagaugaaugcuuuauaaguuaaauauga

SEQ ID NO: 335854 - RNA, 61 nt, Human
cccagaccucacaguucuagggccccuggcugcagaugacuggaaacaaggaaggacauuu

SEQ ID NO: 335855 - RNA, 60 nt, Human
caaggaggugaggagcagagcaggcaauuucaccaccaaaugccaagaaaagggcugaca

SEQ ID NO: 335856 - RNA, 60 nt, Human
ggcagaagacacugcucuuuguaacccagccaccaccaaaaagcaaacagaaagaaggaa

SEQ ID NO: 335857 - RNA, 60 nt, Human
caacagagacccugucucaaccaccaccaccaccaccaccccuacuaccccuguauucaa

SEQ ID NO: 335858 - RNA, 60 nt, Human
gggcaacagagacccugucucaaccaccaccaccaccaccaccccuacuaccccuguauu

SEQ ID NO: 335859 - RNA, 60 nt, Human
ccugggcaacagagacccugucucaaccaccaccaccaccaccaccccuacuaccccugu

SEQ ID NO: 335860 - RNA, 60 nt, Human
cagccugggcaacagagacccugucucaaccaccaccaccaccaccaccccuacuacccc

SEQ ID NO: 335861 - RNA, 59 nt, Human
cugccgaguuuuucgguugaagugaugcacaccaccaacauucuuggcauuacgcaggc

SEQ ID NO: 335862 - RNA, 60 nt, Human
gccaagaucagacgucgcugaggggcuguucaccaccauccucguucuccagggucaagg

SEQ ID NO: 335863 - RNA, 60 nt, Human
ggagguucccugcacucccagugagccagccaccaccacaaccugucucccaguccugcu

SEQ ID NO: 335864 - RNA, 60 nt, Human
gucggggcccacuggaagcauccagaacagcaccaccaucuagcggccgcucgagggaag

SEQ ID NO: 335865 - RNA, 60 nt, Human
cugggacaaccagacucuguaacucacccccaccaccauacacacacacaaaaacagaaa

SEQ ID NO: 335866 - RNA, 60 nt, Human
gccucccgaguagcugggaguacaggcacacaccaccacacccagcuaauuuuuguauuu

SEQ ID NO: 335867 - RNA, 60 nt, Human
uccggcuccggcggacgcgcgaccguugugcaccaccagggaccgccgcgccuacucugc

SEQ ID NO: 335868 - RNA, 60 nt, Human
uuucuuugacucgugugaguucaaaguaaacaccaccaccguggacaacucuugaauuaa

SEQ ID NO: 335869 - RNA, 60 nt, Human
acugccugaguagcugggacuacaggcaugcaccaccacgcccagcuaauuuuucuuauu

SEQ ID NO: 335870 - RNA, 60 nt, Human
acagguauuuuuaauuuuaaaauuucauuccaccaccaucagaugcaguucccuauuuug

SEQ ID NO: 335871 - RNA, 64 nt, Human
caucuuuuaagggaacugugacaaacagccucgggcagaugaacacggaggcucucuguugucu

SEQ ID NO: 335872 - RNA, 64 nt, Human
auugcguggcugcugguguguggggucaguuccagcagaugaaugugucauguggcacaccuug

SEQ ID NO: 335873 - RNA, 64 nt, Human
gcggaucucaggcacccccgccuuggcccgugucgcagaugaggacacugagggcggcgucccu

SEQ ID NO: 335874 - RNA, 60 nt, Human
ccuccacguagcgaggggcucccugcuggucaccaccaaggguaugagcucucugccuca

SEQ ID NO: 335875 - RNA, 57 nt, Human
aguccugcaccaucauaugaguguucucaccaccacuuaugccccuagaagggaagg

SEQ ID NO: 335876 - RNA, 60 nt, Human
ggggggauuggagggaaaugaccugcccuccaccaccacccaaagugugggauuaaagua

SEQ ID NO: 335877 - RNA, 60 nt, Human
gccuccucaguagcuaggacuaccggcgugcaccaccaugccaggcuaauuuuuauauuu

SEQ ID NO: 335878 - RNA, 60 nt, Human
gccucccgaguagcugggauuacaggcacgcaccaccacaccuggcuaauuuuuguacuu

SEQ ID NO: 335879 - RNA, 60 nt, Human
uuugggugggggcuguggcccugcccuuggcaccaccaggguggaccaggccuggagggc

SEQ ID NO: 335880 - RNA, 60 nt, Human
augugugccaaugcacacgagugugccacucaccaccauuccuuggccagccuuuugccu

SEQ ID NO: 335881 - RNA, 60 nt, Human
ucugugacaucuuggagggggagcuagugccaccaccaugcgcggugcuuaggaaaugaa

SEQ ID NO: 335882 - RNA, 60 nt, Human
guggggcugggaagcugacuucgugcucuucaccaccacaaaggaugugugugcauccug

SEQ ID NO: 335883 - RNA, 60 nt, Human
ccuggucaccagaccuccaaauauggcugccaccaccaggaccuuuccaguuacuccuua

SEQ ID NO: 335884 - RNA, 60 nt, Human
gaguggcagugaggagggggccaggucaggcaccaccaucaagagagcuguguguucucu

SEQ ID NO: 335885 - RNA, 60 nt, Human
gucugcagcccccagaauguucuggacaugcaccaccagccgguggucccaauguccacc

SEQ ID NO: 335886 - RNA, 60 nt, Human
ggcuggcacucucaauccuacaucaggugccaccaccaccagacucaggcccugguguaa

SEQ ID NO: 335887 - RNA, 60 nt, Human
uggcacucucaauccuacaucaggugccaccaccaccagacucaggcccugguguaagaa

SEQ ID NO: 335888 - RNA, 54 nt, Human
agcaguccaugcuguccuagcagccaccaccaucugcgacuccugccugccgcc

SEQ ID NO: 335889 - RNA, 60 nt, Human
cacacagugccagagccagagaaggggccccaccaccaaggccaagcuugaccaggucag

SEQ ID NO: 335890 - RNA, 64 nt, Human
acguggucuuucuuacaaggaagguggugggggugcagaugagguugcuagagaauguuagagg

SEQ ID NO: 335891 - RNA, 64 nt, Human
cuacaaaguacgcaauaacuguuugguauuugaugcagaugagagagcacgagcuaaaguaaaa

SEQ ID NO: 335892 - RNA, 64 nt, Human
cuacugagagugacuucucuuuuaaaauugaguagcagaugaaaaauuaaaauuugaacuugau

SEQ ID NO: 335893 - RNA, 60 nt, Human
uccuccugaguagcugggacuacaggugcucaccaccacacccggcuaauuuuuuguauu

SEQ ID NO: 335894 - RNA, 50 nt, Human
gcaaucauguaaacuucugacaccaccaggagcugacucacaccugaacu

SEQ ID NO: 335895 - RNA, 60 nt, Human
ccugaagccucugggaacuccuccuguggccaccaccaaaggaugaggaaucugaguugc

SEQ ID NO: 335896 - RNA, 60 nt, Human
acaccccaaaaugacccaacgauguccacacaccaccaaaacccagccaaugggccaccu

SEQ ID NO: 335897 - RNA, 60 nt, Human
cuuucccauucaccuggcucaauccuccuccaccaccaggggccucaaaaggcacaucau

SEQ ID NO: 335898 - RNA, 60 nt, Human
guagaauacccugccuucuugaagcaguuccaccaccaauaugauggggaagggcaggaa

SEQ ID NO: 335899 - RNA, 60 nt, Human
guguauuaauuuuuuuucuuguccauaucacaccaccaaaggcuuuuggaccauuuagca

SEQ ID NO: 335900 - RNA, 60 nt, Human
cccccaccccucugcugcaggaggcguggccaccaccagaugcucccugucuggggcagg

SEQ ID NO: 335901 - RNA, 60 nt, Human
gccuucugaguagcugggacuacaggugugcaccaccaugcccagcuaguuuuuguauuu

SEQ ID NO: 335902 - RNA, 60 nt, Human
cccucucucccugccucacuccuccgugagcaccaccagggcuccaggagccucauccag

SEQ ID NO: 335903 - RNA, 60 nt, Human
uccggccauagcaaccaugaguggcauggccaccaccacgguggucacuggaacucagug

SEQ ID NO: 335904 - RNA, 60 nt, Human
gguagcagccuugaacccacccagcugggacaccaccagaagguccagggcucuccccau

SEQ ID NO: 335905 - RNA, 60 nt, Human
gccucccugugucccagacccuccugcugccaccaccacccagguccucccuaguccucc

SEQ ID NO: 335906 - RNA, 60 nt, Human
gccucccuaguagcugggauuacaggcaugcaccaccauacccagcuaauuucuguauuu

SEQ ID NO: 335907 - RNA, 60 nt, Human
caugugaccagagcaugugcccagccccuccaccaccaggggcacugccgucauggcagg

SEQ ID NO: 335908 - RNA, 60 nt, Human
ugcugcgucagagcucaaggaaucugugcccaccaccagcuccugguccguaggagguga

SEQ ID NO: 335909 - RNA, 64 nt, Human
agcauagaccccugucuaacggggguagacaggugcagaugaggugaagaucacugucaucuaa

SEQ ID NO: 335910 - RNA, 64 nt, Human
gccucuccucggccaggaggcugaggccugcacugcagaugauccugcggaccacgucaagguc

SEQ ID NO: 335911 - RNA, 64 nt, Human
gcuguuuccuuuccauuucuacaaugagucaauugcagaugaugcuauaacacuuccaguguuu

SEQ ID NO: 335912 - RNA, 60 nt, Human
gauuuuagaaaacccugggaaaacccaccacaccaccacaaaauggccuuuaguguauga

SEQ ID NO: 335913 - RNA, 60 nt, Human
guacuuaugugaacuguuguccuugcuuuacaccaccauuuggaaaacuuaccaguuuuu

SEQ ID NO: 335914 - RNA, 60 nt, Human
ccagcaguacucugaggcccugauggcucucaccaccauggcgucacuccgcgaccacag

SEQ ID NO: 335915 - RNA, 60 nt, Human
uagcaauggcaacaagugaacgaggacaaccaccaccauguucuaacauguggacccuuu

SEQ ID NO: 335916 - RNA, 60 nt, Human
ccagcccucuuccauccgcccggcucugcccaccaccacugccaggcugaacaggggacu

SEQ ID NO: 335917 - RNA, 60 nt, Human
gccucccgaguagcugggacuacaggugcccaccaccacgccuggcuaguuuuuuguauu

SEQ ID NO: 335918 - RNA, 60 nt, Human
gccuccugaguagcugggacuacaggcgcccaccaccacgcccggcuaauuuuuuguauu

SEQ ID NO: 335919 - RNA, 60 nt, Human
gccuccugaguagcugggauuacaggcacccaccaccacaccuggcuaauuuuuuguauu

SEQ ID NO: 335920 - RNA, 60 nt, Human
ugauaggaagaggggaagcagaaauccaagcaccaccaaacacaguguaugaaggggggc

SEQ ID NO: 335921 - RNA, 60 nt, Human
ggggagggucguccgguaucccccagugcccaccaccaccaaccagaaucacuucucaga

SEQ ID NO: 335922 - RNA, 60 nt, Human
gagggucguccgguaucccccagugcccaccaccaccaaccagaaucacuucucagacug

SEQ ID NO: 335923 - RNA, 50 nt, Human
cuggcacggaggaguccugacaccaccagaauaaacuugccgaguuuacc

SEQ ID NO: 335924 - RNA, 60 nt, Human
gccucccagguagcuaguacuauaggugugcaccaccacgcccagcaaauuuuuaaauuu

SEQ ID NO: 335925 - RNA, 60 nt, Human
acuucccuuaacaguuuccggaucagugaccaccaccacguucagguuucugaaugcaga

SEQ ID NO: 335926 - RNA, 60 nt, Human
uccuggcagggaaacauacaccccuugucucaccaccaaccuugcuuguguagucagcag

SEQ ID NO: 335927 - RNA, 60 nt, Human
gccuccugaguagcugggacuacaggcaugcaccaccacgccaggcuaauuuuuuguauu

SEQ ID NO: 335928 - RNA, 64 nt, Human
auguuuuuaguucccuuuuuuuguuguauuauaggcagaugaacaaauuaaauuuggccucaaa

SEQ ID NO: 335929 - RNA, 64 nt, Human
cagacaugucagccgcuaccugcuggccuuccuggcagaugaccuaggggggcucugacagacc

SEQ ID NO: 335930 - RNA, 64 nt, Human
ccuuucuuaaagacaggcugaaaccccuucaaaggcagaugaggagguacagacacgugaccuu

SEQ ID NO: 335931 - RNA, 60 nt, Human
gccucccaaguagcugggauuacaggcacccaccaccacauccagcuaauuguuguauuu

SEQ ID NO: 335932 - RNA, 60 nt, Human
gccucuugaguagcugggacuacaggcgcacaccaccacgccaggcuaauuuuuguauuu

SEQ ID NO: 335933 - RNA, 60 nt, Human
uacagacaagcaaaugcugagagauuuugucaccaccaggccugcccuaaaagagcuccu

SEQ ID NO: 335934 - RNA, 57 nt, Human
gcgagggcacccggcagugacgcccgccaccaccacgcagccgccgccgcccacgcc

SEQ ID NO: 335935 - RNA, 60 nt, Human
ugggccaugcgaggggccagcagagggcgccaccaccaccugacggcuggggacccaccc

SEQ ID NO: 335936 - RNA, 60 nt, Human
gcgugugguucauucacaaagcuguacaaccaccaccaucuaguuccaaacauuuucuuu

SEQ ID NO: 335937 - RNA, 60 nt, Human
ucugacaguguuuuucuuccucuuucauaccaccaccaccacaaucaucaacauaaagga

SEQ ID NO: 335938 - RNA, 60 nt, Human
gacaguguuuuucuuccucuuucauaccaccaccaccacaaucaucaacauaaaggaagu

SEQ ID NO: 335939 - RNA, 60 nt, Human
gccuccccaguagcugggauuacagacaugcaccaccacaccuggcuaauuuuuguauuu

SEQ ID NO: 335940 - RNA, 60 nt, Human
cguccucggccccccacccugaagugccagcaccaccagcaccagauccuccgccgccac

SEQ ID NO: 335941 - RNA, 60 nt, Human
gccuccugaguaccugagauuacaggcacccaccaccaugcccagcuaauuuuuguauuu

SEQ ID NO: 335942 - RNA, 55 nt, Human
cugaguagcugggauuaugaguacacaccaccacgcccagcuaauuuuuguguuu

SEQ ID NO: 335943 - RNA, 60 nt, Human
gccucccgaguagcagggauuaccggugugcaccaccaugccuggauaacuuuuuuuuuu

SEQ ID NO: 335944 - RNA, 60 nt, Human
ggaggccugugucacucuggcacaagcugccaccaccagccacccacacccaccccagca

SEQ ID NO: 335945 - RNA, 60 nt, Human
acucagagcauggacagguggauaguaaaucaccaccacggggacagccgugcccagacu

SEQ ID NO: 335946 - RNA, 60 nt, Human
gccuuccaaguagcugggauuacaagugcccaccaccaugcccagcuaauuuuuauauuu

SEQ ID NO: 335947 - RNA, 64 nt, Human
aaagucgcuuugggacggaagccaagccauuauggcagaugaaccugcuggauuuguaaauaau

SEQ ID NO: 335948 - RNA, 64 nt, Human
uaaaaauaaaaucuuuaccugucgaauuguugcugcagaugauuguuguggaaaaucuggauca

SEQ ID NO: 335949 - RNA, 64 nt, Human
agaccccacgcagugucucauacaguggaauguggcagaugagacgggcuuucaggaaggaagu

SEQ ID NO: 335950 - RNA, 60 nt, Human
gugcgagccgcccgccaaggcugcagggagcaccaccaggagcccagugucugacggccu

SEQ ID NO: 335951 - RNA, 60 nt, Human
ggccacuguccccucccugauccaggguuccaccaccaggagggcagacccagccacaua

SEQ ID NO: 335952 - RNA, 60 nt, Human
gccucccgaguagcugggauuacaggugugcaccaccacacccggcuaauuuuuuuuauu

SEQ ID NO: 335953 - RNA, 60 nt, Human
gccucuggaguagcugggacuacagacaugcaccaccacaccugguuaauuuuuuauuuu

SEQ ID NO: 335954 - RNA, 60 nt, Human
ccagggcaucaagaacccagugaacaagggcaccaccacaguggacggcgcuggcuucgg

SEQ ID NO: 335955 - RNA, 60 nt, Human
gccuacugaguagcugagauuacaggugcacaccaccacguccggcugacuuuuguauuu

SEQ ID NO: 335956 - RNA, 60 nt, Human
gccuccuaaguagcugggauuacaggcacccaccaccaugcccagcuaauuuuuguauuu

SEQ ID NO: 335957 - RNA, 60 nt, Human
ggcaggaaagaaugcaacaaaaaaguuaaccaccaccaucucucuccucuucaaagcuaa

SEQ ID NO: 335958 - RNA, 60 nt, Human
acuuccugacguaaugcaauaggaaguccacaccaccaucuacaaagccuuauugcugga

SEQ ID NO: 335959 - RNA, 60 nt, Human
cuuaacuccugucccugcaaguguuacugccaccaccagccacgccaucgccgccugcca

SEQ ID NO: 335960 - RNA, 60 nt, Human
ggagguugaggcugcagugagccgugauuucaccaccacuccagccugggugagaaagca

SEQ ID NO: 335961 - RNA, 60 nt, Human
cacagccaggauuugaacaaacuugguauucaccaccacauucuuugccucuauuccaaa

SEQ ID NO: 335962 - RNA, 60 nt, Human
guggggacugagccgcccgccucugccgcccaccaccaucucaggaaaggcuguugugcu

SEQ ID NO: 335963 - RNA, 60 nt, Human
gccuccagaguagcugggauuacaggcaugcaccaccacagcccagcuaauuuuuuguau

SEQ ID NO: 335964 - RNA, 60 nt, Human
uguguccuggggugacgucccuugugacaacaccaccaagccuggugucuauaccaaagu

SEQ ID NO: 335965 - RNA, 60 nt, Human
ccuuccccuggagagggacugcucagccaacaccaccagcugccacauccugggcugggg

SEQ ID NO: 335966 - RNA, 64 nt, Human
uuacauugauuaaugaauuaucacccagacaugugcagaugaaaugucaauauaagaaaaauca

SEQ ID NO: 335967 - RNA, 64 nt, Human
uguuuagcaaauggcucugacaggguggccaugagcagaugagaccagcucuugcuugguugga

SEQ ID NO: 335968 - RNA, 64 nt, Human
acucagaaacaagaacagcgacagcccuucucgagcagaugacacgagcuaguccacguugaca

SEQ ID NO: 335969 - RNA, 60 nt, Human
gccucccaaguaccugggacuacaggugugcaccaccacaccaggcuaauuuuuugugua

SEQ ID NO: 335970 - RNA, 60 nt, Human
agaaaucuuaacacauauauugauucaugucaccaccaccguaaucgagauucagaaugu

SEQ ID NO: 335971 - RNA, 60 nt, Human
gccucccgaguagcugggauuacaggcaugcaccaccacgcccagcuuauuuuguauuuu

SEQ ID NO: 335972 - RNA, 60 nt, Human
gccucccgauuagcugggaucacaggugugcaccaccaugcccagcuaauuauuuauuuc

SEQ ID NO: 335973 - RNA, 60 nt, Human
uuuccuccauuuuccugcuaugaaauauaucaccaccagcuugauucaaccuuaaaaaua

SEQ ID NO: 335974 - RNA, 60 nt, Human
gccucccgaguagcugggauuacaggcgcccaccaccaugcccggcuaguuuuuuuguau

SEQ ID NO: 335975 - RNA, 60 nt, Human
gccucccuaauagcugggacuacaggcaaccaccaccacuccuaccuuuuuuguauuuuu

SEQ ID NO: 335976 - RNA, 60 nt, Human
gccuccugaguagcugggcugacaggcacccaccaccacacccagcuaauuuuuauguuu

SEQ ID NO: 335977 - RNA, 60 nt, Human
ugucucuuucaccaucagcuccuccccuuucaccaccagcuccucuccacuucccaaggg

SEQ ID NO: 335978 - RNA, 60 nt, Human
aaucccaccuccccugaccuccaccaccuccaccaccaccaccaccaccaccaccaccac

SEQ ID NO: 335979 - RNA, 60 nt, Human
cccaccuccccugaccuccaccaccuccaccaccaccaccaccaccaccaccaccacuac

SEQ ID NO: 335980 - RNA, 60 nt, Human
accuccccugaccuccaccaccuccaccaccaccaccaccaccaccaccaccacuaccac

SEQ ID NO: 335981 - RNA, 60 nt, Human
uccccugaccuccaccaccuccaccaccaccaccaccaccaccaccaccacuaccaccac

SEQ ID NO: 335982 - RNA, 60 nt, Human
ccugaccuccaccaccuccaccaccaccaccaccaccaccaccaccacuaccaccaccac

SEQ ID NO: 335983 - RNA, 60 nt, Human
gaccuccaccaccuccaccaccaccaccaccaccaccaccaccacuaccaccaccaccca

SEQ ID NO: 335984 - RNA, 60 nt, Human
cuccaccaccuccaccaccaccaccaccaccaccaccaccacuaccaccaccacccaacu

SEQ ID NO: 335985 - RNA, 62 nt, Human
ugucuauuugccauaucuauuuuuuuuaaauuuccauacacuuguaaaaguaguuaguugcu

SEQ ID NO: 335986 - RNA, 62 nt, Human
ucaggggauaugaaacaaucuguagauugguuuccauacagggaaguucucuguccuaugca

SEQ ID NO: 335987 - RNA, 64 nt, Human
uugguggccagggaggcagccuagccuaugucuggcagaugagggcuggcugccguuuucuggg

SEQ ID NO: 335988 - RNA, 60 nt, Human
caccaccuccaccaccaccaccaccaccaccaccaccacuaccaccaccacccaacuggg

SEQ ID NO: 335989 - RNA, 60 nt, Human
caccaccaccaccaccaccaccaccacuaccaccaccacccaacuggggcuagagugggg

SEQ ID NO: 335990 - RNA, 60 nt, Human
ugccagcagcucucuggugcaucgucucaacaccaccaaguuuguaggaccugcccaagu

SEQ ID NO: 335991 - RNA, 60 nt, Human
cugagggcuguagccagguccgcaucuccccaccaccaccagggcacucacucgcagcua

SEQ ID NO: 335992 - RNA, 60 nt, Human
agggcuguagccagguccgcaucuccccaccaccaccagggcacucacucgcagcuauag

SEQ ID NO: 335993 - RNA, 60 nt, Human
uccucccaaguaggugggauuacaggugcccaccaccaagcccugcaaauuuuuuuguau

SEQ ID NO: 335994 - RNA, 60 nt, Human
uagacaugaugaggaucugguggguguuuccaccaccacagcuguugggaaagugauuug

SEQ ID NO: 335995 - RNA, 60 nt, Human
aauggcugcuugcugccauaugugacaaaucaccaccaccaguguuaagugcuucuggau

SEQ ID NO: 335996 - RNA, 60 nt, Human
ggcugcuugcugccauaugugacaaaucaccaccaccaguguuaagugcuucuggauuca

SEQ ID NO: 335997 - RNA, 60 nt, Human
ccucccagguagcugccacuacaggugcugcaccaccacgcccggcuaauuuuuguauuu

SEQ ID NO: 335998 - RNA, 60 nt, Human
cugugucacucccaauuucugagguccagccaccaccaggcugagcagugaggagagaaa

SEQ ID NO: 335999 - RNA, 60 nt, Human
gugguaauucaugaaaaauauccccacuaccaccaccaaggggaagaaaggacucagaag

SEQ ID NO: 336000 - RNA, 60 nt, Human
gaguaagugaauccugauuauuuccagacccaccaccagaguggaucuuauuuucaaagc

SEQ ID NO: 336001 - RNA, 60 nt, Human
cucuguggcuccccugcaucagcaccgucccaccaccaaguucaccagguucaccagaca

SEQ ID NO: 336002 - RNA, 60 nt, Human
uuaagaaaagggaauucucuuuaaagaaaccaccaccaacaacaaaacaaccaaaaacca

SEQ ID NO: 336003 - RNA, 60 nt, Human
acuucuguuuggcuaguuugcuuagcugaucaccaccaacaucauaggucuauaaaucac

SEQ ID NO: 336004 - RNA, 64 nt, Human
cuucgucugugccguuugucuucguggccauccugcagaugagcaccguguccagugccacagc

SEQ ID NO: 336005 - RNA, 64 nt, Human
ggauaguuagcagaaauauugucuguaaagcuaggcagaugagcccagaagaauggucccagag

SEQ ID NO: 336006 - RNA, 50 nt, Human
gcagggaccuucaagccugagcagaugaaugacuccaggaagaagguaac

SEQ ID NO: 336007 - RNA, 60 nt, Human
auuacccuguaaacucucuguuagggcaaccaccaccaccugucuuccaggacacauuuu

SEQ ID NO: 336008 - RNA, 60 nt, Human
gccuccagaauagcugggauuacaggcguacaccaccaugccuggcuaauuuuuuuguau

SEQ ID NO: 336009 - RNA, 60 nt, Human
uuucagaaaaucuacaagucucguugagaccaccaccauaccucagaagguaggacugug

SEQ ID NO: 336010 - RNA, 60 nt, Human
cccagagccugccgcuacccucggccugcccaccaccaagcaagcagcaagcaagauggg

SEQ ID NO: 336011 - RNA, 60 nt, Human
uuccuuuacccaggaaaucuccggagccaacaccaccacccccagggggucuccccaccc

SEQ ID NO: 336012 - RNA, 60 nt, Human
gcuucccaaguagcugagauuacaggcgcacaccaccacgcccaacugauuuuuguauuu

SEQ ID NO: 336013 - RNA, 60 nt, Human
gccucccgaguagcugggacuacaggugcacaccaccacaccuggcuaauuuuuuguauu

SEQ ID NO: 336014 - RNA, 60 nt, Human
ccugcggcggaggccaacgcagggcaccaccaccaccaacuugaauuccgucaucaaugc

SEQ ID NO: 336015 - RNA, 60 nt, Human
cccccugcggcggaggccaacgcagggcaccaccaccaccaacuugaauuccgucaucaa

SEQ ID NO: 336016 - RNA, 60 nt, Human
uggcccccugcggcggaggccaacgcagggcaccaccaccaccaacuugaauuccgucau

SEQ ID NO: 336017 - RNA, 60 nt, Human
gccuccagaguagcugggauaacaggugcccaccaccacaccccacuaauuuuuguauuu

SEQ ID NO: 336018 - RNA, 60 nt, Human
agcacacaacaggcuguguguggaaauggccaccaccauucuccuuccccaccccaccac

SEQ ID NO: 336019 - RNA, 60 nt, Human
caucaccaugguaacaguucccaucaccaucaccaccaccaccaccaucaccaccaccau

SEQ ID NO: 336020 - RNA, 60 nt, Human
caccaugguaacaguucccaucaccaucaccaccaccaccaccaucaccaccaccaugga

SEQ ID NO: 336021 - RNA, 60 nt, Human
caugguaacaguucccaucaccaucaccaccaccaccaccaucaccaccaccauggacaa

SEQ ID NO: 336022 - RNA, 60 nt, Human
gguaacaguucccaucaccaucaccaccaccaccaccaucaccaccaccauggacaacaa

SEQ ID NO: 336023 - RNA, 64 nt, Human
uaguuugaucaguugaaggcuagaagugugaagugcagaugaguguguguucuuccccaagguc

SEQ ID NO: 336024 - RNA, 64 nt, Human
uuaaagacuuuuucaaauugucaaaugauuuaaugcagaugaacauauuucuauuuuaaguaac

SEQ ID NO: 336025 - RNA, 64 nt, Human
ucauuucugcccuuuagaauggcuugucccaucagcagaugaauguguuaagcacaaagcaucu

SEQ ID NO: 336026 - RNA, 60 nt, Human
ucccaucaccaucaccaccaccaccaccaucaccaccaccauggacaacaagccuugggu

SEQ ID NO: 336027 - RNA, 60 nt, Human
caucaccaucaccaccaccaccaccaucaccaccaccauggacaacaagccuuggguaac

SEQ ID NO: 336028 - RNA, 60 nt, Human
acgggggcaguccugggggugcugcggcuacaccaccacccgcgcggcccccgcagccua

SEQ ID NO: 336029 - RNA, 60 nt, Human
gccucccaaguaggugggauuacagguacucaccaccagguccagcuaacuuuuguauuu

SEQ ID NO: 336030 - RNA, 60 nt, Human
uguuucagacgcucggccgggaacgaaucccaccaccaggaggaaugccaaggcugggcc

SEQ ID NO: 336031 - RNA, 60 nt, Human
gccuccugaguagcugggacuacaggcaugcaccaccaagcuuggcuaauuuaaaaaaaa

SEQ ID NO: 336032 - RNA, 60 nt, Human
uuuacagaaaucauuuuuaggucuuugugccaccaccacgaggggcaucugcaaagaggg

SEQ ID NO: 336033 - RNA, 60 nt, Human
aggcugccugccgugcaccaccaccaccaccaccaccaugcuguguggccaccuggggcu

SEQ ID NO: 336034 - RNA, 60 nt, Human
ccaaggcugccugccgugcaccaccaccaccaccaccaccaugcuguguggccaccuggg

SEQ ID NO: 336035 - RNA, 60 nt, Human
aggccaaggcugccugccgugcaccaccaccaccaccaccaccaugcuguguggccaccu

SEQ ID NO: 336036 - RNA, 60 nt, Human
gccaggccaaggcugccugccgugcaccaccaccaccaccaccaccaugcuguguggcca

SEQ ID NO: 336037 - RNA, 60 nt, Human
gcugccaggccaaggcugccugccgugcaccaccaccaccaccaccaccaugcugugugg

SEQ ID NO: 336038 - RNA, 60 nt, Human
cgagcugccaggccaaggcugccugccgugcaccaccaccaccaccaccaccaugcugug

SEQ ID NO: 336039 - RNA, 60 nt, Human
ucucuucagcccuuuucgcuaguggucacccaccaccaugguuacuugccagcaacaucu

SEQ ID NO: 336040 - RNA, 60 nt, Human
ggagccucgcugugucuugcuguucccaggcaccaccacagcaggugcugccauacucuu

SEQ ID NO: 336041 - RNA, 60 nt, Human
gccucccaaguagcugggauuacaggcaugcaccaccaugccuggcuaauuuuguauuuu

SEQ ID NO: 336042 - RNA, 62 nt, Human
ggacaggauacuugucacauauuugaagaaauuccauacagugaaggaaauuugagucugua

SEQ ID NO: 336043 - RNA, 62 nt, Human
cuaauaucaacugcauggauuaaaguagucccuccauacauggggaaguguuuggagcaaag

SEQ ID NO: 336044 - RNA, 62 nt, Human
caaccaauggcauccagagagggcauggaggcuccauacaaccucuuccacccccacaucuu

SEQ ID NO: 336045 - RNA, 60 nt, Human
ggacggaagcagagggugcuguuucaacgccaccaccaggagagaggcagaggggcugug

SEQ ID NO: 336046 - RNA, 60 nt, Human
ggaggucgaggcugcagugagcuaugaucacaccaccacacuccagccugagcagcagag

SEQ ID NO: 336047 - RNA, 60 nt, Human
gccucccaaguagcugggacuacaggcaugcaccaccacacuuggccaauguucuguauu

SEQ ID NO: 336048 - RNA, 60 nt, Human
uaauuuucuccuuuuuucucucuugaugcucaccaccaccuuuugcccccuucuguucug

SEQ ID NO: 336049 - RNA, 60 nt, Human
ucuucuuccaagaaaugcaaacagaccguucaccaccaucuccagcugcucacagacgcc

SEQ ID NO: 336050 - RNA, 60 nt, Human
ucuucuuccaagaaaugcaaacagaccguucaccaccaucuccagcugcucacagacacc

SEQ ID NO: 336051 - RNA, 60 nt, Human
ucuucuuccaagaaaugcaaacaggcuguucaccaccaucuccagcugaucacagacacc

SEQ ID NO: 336052 - RNA, 60 nt, Human
gugguggacgggcccagugcuggguguuuucaccaccauccccccaucccccaucuaaga

SEQ ID NO: 336053 - RNA, 60 nt, Human
ggcccggguguagagaaaccaagcggcagccaccaccaguguuguuuugaauaaaagccc

SEQ ID NO: 336054 - RNA, 60 nt, Human
uagcuggaagccagcccagcguuucucuaccaccaccaccaugccuccaccugacuuugg

SEQ ID NO: 336055 - RNA, 60 nt, Human
cuggaagccagcccagcguuucucuaccaccaccaccaugccuccaccugacuuuggcuu

SEQ ID NO: 336056 - RNA, 60 nt, Human
acccacuucacacacacacaucccaaauaccaccaccaaccaccuucuuccucucaacuc

SEQ ID NO: 336057 - RNA, 60 nt, Human
agcccuuuuuagugcugugcucguccagcucaccaccacagccccucucagcccucagua

SEQ ID NO: 336058 - RNA, 60 nt, Human
gguggggcuccacaggcagcacaggcgccccaccaccacccaguuuggggacccaguggg

SEQ ID NO: 336059 - RNA, 60 nt, Human
gccuccugaguagcugggauuacaggcaugcaccaccaugcccggauaauuuuuguauuu

SEQ ID NO: 336060 - RNA, 60 nt, Human
aggagagcuggacucgcucaucuguucuugcaccaccauccagaaugcccccuuugcaag

SEQ ID NO: 336061 - RNA, 62 nt, Human
accagaugaaaggauaaacaaaauaugguccauccauacaauggaguauuacacagccauaa

SEQ ID NO: 336062 - RNA, 62 nt, Human
uguuauaaacauuuaaaaucacauuuuccauuuccauacauaucuuuuuguucaucaguaau

SEQ ID NO: 336063 - RNA, 62 nt, Human
ucuuugugacuucgaaaucuuuucaugugccuuccauacaggccauucacuguggucccugg

SEQ ID NO: 336064 - RNA, 60 nt, Human
ccauguguccccccuguggucugugugugacaccaccacugugucccagugucuggccca

SEQ ID NO: 336065 - RNA, 60 nt, Human
uaugccccugugcccagugguugaugauaccaccaccaccugccuacccaugggcccaag

SEQ ID NO: 336066 - RNA, 60 nt, Human
acguggggugauucacagcacaaaagaccucaccaccacaccugcacucaccccaccuug

SEQ ID NO: 336067 - RNA, 60 nt, Human
caggauggggacaggaucaccugcccgggacaccaccauuaucauucuccucuagugacg

SEQ ID NO: 336068 - RNA, 60 nt, Human
cccggaaauaugagggaaaucucugcauugcaccaccagaggggcauaaauuugaaaguu

SEQ ID NO: 336069 - RNA, 60 nt, Human
agccuccagagaguugggaccauaggugcacaccaccacaccuagcuaauuuuuugggga

SEQ ID NO: 336070 - RNA, 60 nt, Human
gccuccugaguagcugggauuacaggcacacaccaccaugcccagcuaacuuuuguauuu

SEQ ID NO: 336071 - RNA, 60 nt, Human
gacucugugacauuucuagcauauccaaggcaccaccagugauuucuccuguuucuuggu

SEQ ID NO: 336072 - RNA, 60 nt, Human
ccuugaugucugcugugacaucagaggugccaccaccaaagcacucuucccacccuaguc

SEQ ID NO: 336073 - RNA, 60 nt, Human
ggaguuugaggcugcggugagcugugaucacaccaccacacuccaaccuguguaacagag

SEQ ID NO: 336074 - RNA, 60 nt, Human
gccucccgaguagcugggauuacaggcaugcaccaccacaccuggcuaauuuuuguguuu

SEQ ID NO: 336075 - RNA, 60 nt, Human
gccucccgaguagcugagauuauaggcgugcaccaccacaccuggcuaauuuuuguauuu

SEQ ID NO: 336076 - RNA, 60 nt, Human
ucaauuugaucauauuuuaaaauauguuuucaccaccauauaagauuuugguucuacuug

SEQ ID NO: 336077 - RNA, 60 nt, Human
aauucuccugccucagcgauuacaggaaugcaccaccacgcccagcuaauuuuguagaga

SEQ ID NO: 336078 - RNA, 60 nt, Human
uagaaccaauagucucaaaguaaaaacaaccaccaccauccaacaaaaggauuacgucug

SEQ ID NO: 336079 - RNA, 60 nt, Human
ggccccagaagccaugacuacuaccaccaccaccaccaccccuucuggggucacuccauc

SEQ ID NO: 336080 - RNA, 62 nt, Human
uuaucugugugugccugggaguccauacaauguccauacaugggugaacucuugaaucgcuc

SEQ ID NO: 336081 - RNA, 62 nt, Human
acacacacccauuaucugugugugccugggaguccauacaauguccauacaugggugaacuc

SEQ ID NO: 336082 - RNA, 62 nt, Human
accagaugaaaggauaaacaaaaugugguccauccauacaauggaguauuacacagccauaa

SEQ ID NO: 336083 - RNA, 60 nt, Human
cagggccccagaagccaugacuacuaccaccaccaccaccaccccuucuggggucacucc

SEQ ID NO: 336084 - RNA, 57 nt, Human
cagggccccagaagccaugacuacuaccaccaccaccaccaccccuucuggggucac

SEQ ID NO: 336085 - RNA, 60 nt, Human
gggaaggaauggaagauggacaccaccggacaccaccagacacuaggaugggauggaugg

SEQ ID NO: 336086 - RNA, 60 nt, Human
aacauggagaaaccaaauuggacaaauccucaccaccaacggugaugauuacaauaaaau

SEQ ID NO: 336087 - RNA, 60 nt, Human
ucugcuucuuccacgcaccaccaccaccaccaccaccaucauggccauagccacgguggc

SEQ ID NO: 336088 - RNA, 60 nt, Human
ucaucugcuucuuccacgcaccaccaccaccaccaccaccaucauggccauagccacggu

SEQ ID NO: 336089 - RNA, 60 nt, Human
ucuucaucugcuucuuccacgcaccaccaccaccaccaccaccaucauggccauagccac

SEQ ID NO: 336090 - RNA, 60 nt, Human
uccucuucaucugcuucuuccacgcaccaccaccaccaccaccaccaucauggccauagc

SEQ ID NO: 336091 - RNA, 60 nt, Human
gccuccucuucaucugcuucuuccacgcaccaccaccaccaccaccaccaucauggccau

SEQ ID NO: 336092 - RNA, 60 nt, Human
ucugccuccucuucaucugcuucuuccacgcaccaccaccaccaccaccaccaucauggc

SEQ ID NO: 336093 - RNA, 60 nt, Human
cucgcucccgggacucacuggcagccccagcaccaccaggucucccgggaagccacccuc

SEQ ID NO: 336094 - RNA, 60 nt, Human
gccuccugaguagcugggacuacaguugugcaccaccacaccaaacaagaauugauuaua

SEQ ID NO: 336095 - RNA, 60 nt, Human
ccaaccacgaccaccaccaccaccaccacucaccaccaucaucaccuccggaaaguguag

SEQ ID NO: 336096 - RNA, 60 nt, Human
gccaccaccaccaaccacgaccaccaccaccaccaccacucaccaccaucaucaccuccg

SEQ ID NO: 336097 - RNA, 60 nt, Human
acugccaccaccaccaaccacgaccaccaccaccaccaccacucaccaccaucaucaccu

SEQ ID NO: 336098 - RNA, 60 nt, Human
accacugccaccaccaccaaccacgaccaccaccaccaccaccacucaccaccaucauca

SEQ ID NO: 336099 - RNA, 62 nt, Human
cgccccucccaagcguuccuggccuucugaacuccauacagccucuacagccgucccgcguu

SEQ ID NO: 336100 - RNA, 62 nt, Human
aaauaaaaaugaaaaaagagcaggcauccauuuccauacaggaacaaaauaggaggcagcac

SEQ ID NO: 336101 - RNA, 64 nt, Human
uucuaagcaugaauugaggaacagaagaagcagagcagaugaucggagcagcauuuguuucucc

SEQ ID NO: 336102 - RNA, 60 nt, Human
gacaccacugccaccaccaccaaccacgaccaccaccaccaccaccacucaccaccauca

SEQ ID NO: 336103 - RNA, 60 nt, Human
guccccaacccuuacagacaccacugccaccaccaccaaccacgaccaccaccaccacca

SEQ ID NO: 336104 - RNA, 60 nt, Human
uaaguccccaacccuuacagacaccacugccaccaccaccaaccacgaccaccaccacca

SEQ ID NO: 336105 - RNA, 60 nt, Human
cuuaaaaauuaaaaacaucaguacuaccaccaccaccaacaacaucaacacagaucuuca

SEQ ID NO: 336106 - RNA, 60 nt, Human
ucacuuaaaaauuaaaaacaucaguacuaccaccaccaccaacaacaucaacacagaucu

SEQ ID NO: 336107 - RNA, 60 nt, Human
cuuuuuuuuuuguaaagauuaacuccaccucaccaccacaaugagguauuuuucucagca

SEQ ID NO: 336108 - RNA, 62 nt, Human
gaaaguagauauuuccaucaaagccaaagcaauccauacaccaagaacuuguuaccaagaau

SEQ ID NO: 336109 - RNA, 62 nt, Human
auaaaaaucaagaagaacacuuuucucccuuuuccauacaaauuaaaacuuaacagcaucaa

SEQ ID NO: 336110 - RNA, 62 nt, Human
ucaaagaccuaagucuguaagcuggugccauguccauacaccaugucacuuuacucuucauu

SEQ ID NO: 336111 - RNA, 62 nt, Human
uugacuauuguuuuuccuuucuggcgcaugaauccauacaucauuccuggaagugaggcaag

SEQ ID NO: 336112 - RNA, 64 nt, Human
cugcagccgaccgcccugcuccggccccaguguggugggcgaggguggcgcaugggaggccgag

SEQ ID NO: 336113 - RNA, 64 nt, Human
ccuuggcaccggccucuauuugucauaaggcggcgugggcgaggccugacacaggccagccuug

SEQ ID NO: 336114 - RNA, 64 nt, Human
gaaagccaagaagccgugagaggccccacggggugugggcgacgcuguuauguaaauagagcug

SEQ ID NO: 336115 - RNA, 64 nt, Human
ucagugagccaagauagcgccauugcacuccagcgugggcgacagcaagagacuucauuucgau

SEQ ID NO: 336116 - RNA, 62 nt, Human
ggggugaagcugucaaugccaccaguuggaccuccauacauucugagcuaacccagaaucuu

SEQ ID NO: 336117 - RNA, 62 nt, Human
cacagccagcgggcuggccucccaccccagcauccauacacguaggccuguugcugagggaa

SEQ ID NO: 336118 - RNA, 62 nt, Human
uuagaggacaagaaacaaucuguagauugguuuccauacagggaaguucuccguccuaugca

SEQ ID NO: 336119 - RNA, 62 nt, Human
cugugccugcauaaugcugacaccugcuuguuuccauacaaauugauaucaaaauaaaauuu

SEQ ID NO: 336120 - RNA, 64 nt, Human
gucgugggaccuggguccccaccgugaggaccccgugggcgacagcagguguggccaggguggg

SEQ ID NO: 336121 - RNA, 64 nt, Human
gcgacagcgggcgagccagggcccgggcgggcgagugggcgagcggguaggcccaaggcuauug

SEQ ID NO: 336122 - RNA, 64 nt, Human
cccucugccugcagcaggccgaaucagacccggcgugggcgaauucagaagugcccagggagag

SEQ ID NO: 336123 - RNA, 64 nt, Human
cacgccuguaaucccagcacuuugggaggcucaggugggcgaauugcuugagcccaggaguucg

SEQ ID NO: 336124 - RNA, 64 nt, Human
cacagggcugcugcuucaugcgagagggagaugugugggcgagagccaauuugugugagugguu

SEQ ID NO: 336125 - RNA, 64 nt, Human
gacccuggaaaaccaggaacaauugacucccggggugggcgagagacaggagggcucccugauc

SEQ ID NO: 336126 - RNA, 64 nt, Human
caugccuguaaucccagcacuuuggggggcugaggugggcgaaucaugagaucaggaguucgag

SEQ ID NO: 336127 - RNA, 64 nt, Human
cccucagccggcgccgggcacccuggacagugcggugggcgauggcccagguggguggccgcga

SEQ ID NO: 336128 - RNA, 64 nt, Human
gagaggcaaugggugagacaggaauccccucacagugggcgacagaucugaagugaagacagga

SEQ ID NO: 336129 - RNA, 64 nt, Human
guagugggccgagauugugccacugcgcuccagcgugggcgacagagugagacuccaucucaaa

SEQ ID NO: 336130 - RNA, 64 nt, Human
uguuuuccuuaugcccaacacugggucaggcagagugggcgacaauaaacgcugcuaggagaau

SEQ ID NO: 336131 - RNA, 64 nt, Human
aaagcaaauugcgccauagcugggggcagcgggggugggcgaggccugagcugcgggcugcccu

SEQ ID NO: 336132 - RNA, 64 nt, Human
cauggaggacacaguaccagaguuuacagagagggugggcgaagccaccggucucuuccuaauc

SEQ ID NO: 336133 - RNA, 64 nt, Human
uugggagcugcugugcccaggacguggguucagcgugggcgaggaaagccuggcgagcguggcc

SEQ ID NO: 336134 - RNA, 64 nt, Human
augcacuuuccuuugaugcugaggagaaauggaagugggcgaaaaaucucaaggcugcuucaug

SEQ ID NO: 336135 - RNA, 64 nt, Human
ccgggcggcagaucuagcgggagcucaaagggaugugggcgaaaucuugagucuucugagaaaa

SEQ ID NO: 336136 - RNA, 62 nt, Human
auucuaugaauguaguaauuaaucuauuuugcuccauacaugcaacugcguuggcauuagag

SEQ ID NO: 336137 - RNA, 62 nt, Human
acacccuagguuuuucuuagcuuccagcucuuuccauacagucuucacugaaguguuuggua

SEQ ID NO: 336138 - RNA, 62 nt, Human
cccagcccaccccauggccggcuuucaggagcuccauacacacgcugccuucgguacccacc

SEQ ID NO: 336139 - RNA, 64 nt, Human
acuggaaagagcuuuaggacagcuuagaugccgagugggcgaaugccagaccaaugauacccag

SEQ ID NO: 336140 - RNA, 64 nt, Human
caguucuacugggguuccugcccaccgucccaaggugggcgaggccuaggaagagggucauucu

SEQ ID NO: 336141 - RNA, 64 nt, Human
ccaggugaagcugcuggagcugguguugcagcuugugggcgacugcaacaaguggcauggcaga

SEQ ID NO: 336142 - RNA, 64 nt, Human
uugcccuaucuuuggcagauaugaggauggucaggugggcgaugccaacauuaauacucaggac

SEQ ID NO: 336143 - RNA, 64 nt, Human
caacuccauuaugaggcccuucuaccaggguccggugggcgacccugacaaguaccgccugucu

SEQ ID NO: 336144 - RNA, 64 nt, Human
guaccacacaccaaagaagggggucggcccaggggugggcgacacaggcagcuucuucggcagc

SEQ ID NO: 336145 - RNA, 64 nt, Human
agcuugcagagcuggccagcccccuccuuagggggugggcgaggagccucugggcagacccaag

SEQ ID NO: 336146 - RNA, 64 nt, Human
gacggcacgcacuugccuguuggcugcugcggcugugggcgagcaugggggcugccagcgucug

SEQ ID NO: 336147 - RNA, 64 nt, Human
ucuguggagaccccucgguggccucccuaucucugugggcgaugccugaggguuagggaugucu

SEQ ID NO: 336148 - RNA, 64 nt, Human
aggggagagcagcuuccagccugggucagaaggggugggcgagccccucggccccucacccucc

SEQ ID NO: 336149 - RNA, 64 nt, Human
auuuagccaggaaaggggugagagugauuguguugugggcgaggaggcguuuccacccccuggu

SEQ ID NO: 336150 - RNA, 64 nt, Human
cucuccccagcucugucccuguagucaccugccggugggcgaggauccucucccugggauaagc

SEQ ID NO: 336151 - RNA, 64 nt, Human
cgagcuuagcugagcugggaggagcagggugagggugggcgacccaggauucccccuccccuuc

SEQ ID NO: 336152 - RNA, 64 nt, Human
ggaaguuaucgguuguggugcugugcagcgcucugugggcgacuaagugccacucacgcagcau

SEQ ID NO: 336153 - RNA, 64 nt, Human
guugguccagugaggggugacugcagccggucaggugggcgaggagaaggggggcugccccuuu

SEQ ID NO: 336154 - RNA, 64 nt, Human
uaaaugucugauuaggcaucacuuggaugaggaggugggcgauuuggcucugacagcuggagau

SEQ ID NO: 336155 - RNA, 64 nt, Human
ccuguccaggcacuagaggcucccuugacguuuggcagaugaaaaacaacuaagccuuuuugag

SEQ ID NO: 336156 - RNA, 64 nt, Human
gcucacuguuuuuccuugaguucuccuacaggaagcagaugagaacugcccagucuucagguuu

SEQ ID NO: 336157 - RNA, 64 nt, Human
cagaccucuccucuuccaguguccccggggaagggcagaugacacucccuucccccuaagccaa

SEQ ID NO: 336158 - RNA, 64 nt, Human
gcggcccagguacgaagcugcaacucugcgcgcagugggcgagaucucaucagccccaggcugc

SEQ ID NO: 336159 - RNA, 64 nt, Human
agugcgguggaggugagggggugagccuggaccugugggcgagucccauuggcugggcucuggc

SEQ ID NO: 336160 - RNA, 64 nt, Human
aaaagagacuguuuugggggaauggggcaaaggggugggcgauuucuuuuguaaguguaaaaua

SEQ ID NO: 336161 - RNA, 64 nt, Human
caccuggugcgaguucagggccagguuggccaccgugggcgaccuggaggagauccagcgugcg

SEQ ID NO: 336162 - RNA, 64 nt, Human
accgccuacccgacucgguuucuggauauccuccgugggcgaacugcgagccccauucccagcu

SEQ ID NO: 336163 - RNA, 64 nt, Human; identical to SEQ ID NO: 298845

SEQ ID NO: 336164 - RNA, 64 nt, Human; identical to SEQ ID NO: 298846

SEQ ID NO: 336165 - RNA, 64 nt, Human; identical to SEQ ID NO: 298847

SEQ ID NO: 336166 - RNA, 64 nt, Human
cugcuuucuccuguccuaacaccaagccuggguggcagaugaacagugcuuccuuggguugcca

SEQ ID NO: 336167 - RNA, 64 nt, Human
agcugaauuaagagcuuuaaaguuucuggcauuagcagaugauuucuguucaccugguaagaaa

SEQ ID NO: 336168 - RNA, 64 nt, Human
aaguugaguaccugugaucuaaaauguccuggaggcagaugacaucuaaaauaugugcuuucca

SEQ ID NO: 336169 - RNA, 64 nt, Human; identical to SEQ ID NO: 298848

SEQ ID NO: 336170 - RNA, 64 nt, Human; identical to SEQ ID NO: 298852

SEQ ID NO: 336171 - RNA, 64 nt, Human; identical to SEQ ID NO: 298853

SEQ ID NO: 336172 - RNA, 64 nt, Human; identical to SEQ ID NO: 298854

SEQ ID NO: 336173 - RNA, 64 nt, Human; identical to SEQ ID NO: 298855

SEQ ID NO: 336174 - RNA, 64 nt, Human; identical to SEQ ID NO: 298856

SEQ ID NO: 336175 - RNA, 64 nt, Human; identical to SEQ ID NO: 298857

SEQ ID NO: 336176 - RNA, 64 nt, Human; identical to SEQ ID NO: 298858

SEQ ID NO: 336177 - RNA, 64 nt, Human; identical to SEQ ID NO: 298859

SEQ ID NO: 336178 - RNA, 64 nt, Human; identical to SEQ ID NO: 298860

SEQ ID NO: 336179 - RNA, 64 nt, Human; identical to SEQ ID NO: 298861

SEQ ID NO: 336180 - RNA, 64 nt, Human; identical to SEQ ID NO: 298862

SEQ ID NO: 336181 - RNA, 64 nt, Human; identical to SEQ ID NO: 298863

SEQ ID NO: 336182 - RNA, 64 nt, Human; identical to SEQ ID NO: 298864

SEQ ID NO: 336183 - RNA, 64 nt, Human; identical to SEQ ID NO: 298865

SEQ ID NO: 336184 - RNA, 64 nt, Human; identical to SEQ ID NO: 298866

SEQ ID NO: 336185 - RNA, 62 nt, Human
acucuuuugcaauaacaacuuugauuacugaauccauacacucaaacuauagugauauauca

SEQ ID NO: 336186 - RNA, 64 nt, Human
gagacggugguacccugaaggcagaggccagcugccgcaagacagcaaugacaguccaccugcc

SEQ ID NO: 336187 - RNA, 64 nt, Human
uaauuaguggcgucuuuaucuuuccaagagaaaugcagaugagaaaaguuagcacugaugucuc

SEQ ID NO: 336188 - RNA, 54 nt, Human
acggucagcacccaaccugaacucgcagaugaauccugccacacaugcucaucc

SEQ ID NO: 336189 - RNA, 64 nt, Human; identical to SEQ ID NO: 298871

SEQ ID NO: 336190 - RNA, 64 nt, Human; identical to SEQ ID NO: 298872

SEQ ID NO: 336191 - RNA, 64 nt, Human; identical to SEQ ID NO: 298873

SEQ ID NO: 336192 - RNA, 64 nt, Human; identical to SEQ ID NO: 298874

SEQ ID NO: 336193 - RNA, 64 nt, Human; identical to SEQ ID NO: 298875

SEQ ID NO: 336194 - RNA, 64 nt, Human; identical to SEQ ID NO: 298876

SEQ ID NO: 336195 - RNA, 64 nt, Human; identical to SEQ ID NO: 298877

SEQ ID NO: 336196 - RNA, 53 nt, Human; identical to SEQ ID NO: 298878

SEQ ID NO: 336197 - RNA, 64 nt, Human; identical to SEQ ID NO: 298879

SEQ ID NO: 336198 - RNA, 64 nt, Human; identical to SEQ ID NO: 298880

SEQ ID NO: 336199 - RNA, 64 nt, Human; identical to SEQ ID NO: 298881

SEQ ID NO: 336200 - RNA, 64 nt, Human; identical to SEQ ID NO: 298882

SEQ ID NO: 336201 - RNA, 64 nt, Human; identical to SEQ ID NO: 298883

SEQ ID NO: 336202 - RNA, 64 nt, Human; identical to SEQ ID NO: 298884

SEQ ID NO: 336203 - RNA, 64 nt, Human; identical to SEQ ID NO: 298885

SEQ ID NO: 336204 - RNA, 64 nt, Human; identical to SEQ ID NO: 298890

SEQ ID NO: 336205 - RNA, 64 nt, Human
gagacaagcauggaaaaucagugacaucugauuggcagaugagcuuauuucaaaaggaagggug

SEQ ID NO: 336206 - RNA, 64 nt, Human
ucuugugaggcccuuauauaauuacucccauuuugcagaugaaguaacugaggcuuagaaaggu

SEQ ID NO: 336207 - RNA, 64 nt, Human
aaaggggguuuguuucauuaucugguuuuauuaagcagaugaaugcagccagcuauaugaagca

SEQ ID NO: 336208 - RNA, 64 nt, Human; identical to SEQ ID NO: 298891

SEQ ID NO: 336209 - RNA, 64 nt, Human; identical to SEQ ID NO: 298892

SEQ ID NO: 336210 - RNA, 64 nt, Human; identical to SEQ ID NO: 298893

SEQ ID NO: 336211 - RNA, 64 nt, Human; identical to SEQ ID NO: 298894

SEQ ID NO: 336212 - RNA, 64 nt, Human; identical to SEQ ID NO: 298895

SEQ ID NO: 336213 - RNA, 64 nt, Human; identical to SEQ ID NO: 298896

SEQ ID NO: 336214 - RNA, 64 nt, Human; identical to SEQ ID NO: 298897

SEQ ID NO: 336215 - RNA, 64 nt, Human; identical to SEQ ID NO: 298898

SEQ ID NO: 336216 - RNA, 64 nt, Human; identical to SEQ ID NO: 298899

SEQ ID NO: 336217 - RNA, 64 nt, Human; identical to SEQ ID NO: 298900

SEQ ID NO: 336218 - RNA, 64 nt, Human; identical to SEQ ID NO: 298901

SEQ ID NO: 336219 - RNA, 64 nt, Human; identical to SEQ ID NO: 298902

SEQ ID NO: 336220 - RNA, 64 nt, Human; identical to SEQ ID NO: 298903

SEQ ID NO: 336221 - RNA, 64 nt, Human; identical to SEQ ID NO: 298904

SEQ ID NO: 336222 - RNA, 64 nt, Human; identical to SEQ ID NO: 298909

SEQ ID NO: 336223 - RNA, 64 nt, Human; identical to SEQ ID NO: 298910

SEQ ID NO: 336224 - RNA, 62 nt, Human
cuccaacucccccugaguguagcagcacacuuuccauacaccagguucuuucuacaauccug

SEQ ID NO: 336225 - RNA, 62 nt, Human
aaauuuguaggaguuacuagguuagcaauuaguccauacauccauaagccugaugaguugaa

SEQ ID NO: 336226 - RNA, 64 nt, Human
cacccuucucuccuuuccucauccuaagugccuggcagaugaaggaguuuucaggagcuuuuga

SEQ ID NO: 336227 - RNA, 64 nt, Human
uacacuccccaucuguaauuugauuuguucuauugcagaugauguacugggcagaggugagugu

SEQ ID NO: 336228 - RNA, 64 nt, Human; identical to SEQ ID NO: 298911

SEQ ID NO: 336229 - RNA, 64 nt, Human; identical to SEQ ID NO: 298912

SEQ ID NO: 336230 - RNA, 64 nt, Human; identical to SEQ ID NO: 298913

SEQ ID NO: 336231 - RNA, 64 nt, Human; identical to SEQ ID NO: 298914

SEQ ID NO: 336232 - RNA, 64 nt, Human; identical to SEQ ID NO: 298915

SEQ ID NO: 336233 - RNA, 64 nt, Human; identical to SEQ ID NO: 298916

SEQ ID NO: 336234 - RNA, 64 nt, Human; identical to SEQ ID NO: 298917

SEQ ID NO: 336235 - RNA, 64 nt, Human; identical to SEQ ID NO: 298918

SEQ ID NO: 336236 - RNA, 64 nt, Human; identical to SEQ ID NO: 298919

SEQ ID NO: 336237 - RNA, 64 nt, Human; identical to SEQ ID NO: 298920

SEQ ID NO: 336238 - RNA, 64 nt, Human; identical to SEQ ID NO: 298921

SEQ ID NO: 336239 - RNA, 64 nt, Human; identical to SEQ ID NO: 298922

SEQ ID NO: 336240 - RNA, 64 nt, Human; identical to SEQ ID NO: 298923

SEQ ID NO: 336241 - RNA, 64 nt, Human; identical to SEQ ID NO: 298928

SEQ ID NO: 336242 - RNA, 64 nt, Human; identical to SEQ ID NO: 298929

SEQ ID NO: 336243 - RNA, 64 nt, Human; identical to SEQ ID NO: 298930

SEQ ID NO: 336244 - RNA, 64 nt, Human
aaaacgaucacggacagguaugcacugguaacaugcagaugauuucauccagcuaagcugguug

SEQ ID NO: 336245 - RNA, 64 nt, Human
gagcuucaaucaggaagcuauuugccuggcuccagcagaugaugagauaaugagguaguggguu

SEQ ID NO: 336246 - RNA, 64 nt, Human
guguuuguuauuugagaaagcauguuuaaaaauugcagaugagaaauauugucguuaauaauua

SEQ ID NO: 336247 - RNA, 64 nt, Human; identical to SEQ ID NO: 298931

SEQ ID NO: 336248 - RNA, 64 nt, Human; identical to SEQ ID NO: 298932

SEQ ID NO: 336249 - RNA, 64 nt, Human; identical to SEQ ID NO: 298933

SEQ ID NO: 336250 - RNA, 64 nt, Human; identical to SEQ ID NO: 298934

SEQ ID NO: 336251 - RNA, 64 nt, Human; identical to SEQ ID NO: 298935

SEQ ID NO: 336252 - RNA, 64 nt, Human; identical to SEQ ID NO: 298936

SEQ ID NO: 336253 - RNA, 64 nt, Human; identical to SEQ ID NO: 298937

SEQ ID NO: 336254 - RNA, 64 nt, Human; identical to SEQ ID NO: 298938

SEQ ID NO: 336255 - RNA, 64 nt, Human; identical to SEQ ID NO: 298939

SEQ ID NO: 336256 - RNA, 64 nt, Human; identical to SEQ ID NO: 298940

SEQ ID NO: 336257 - RNA, 64 nt, Human; identical to SEQ ID NO: 298941

SEQ ID NO: 336258 - RNA, 64 nt, Human; identical to SEQ ID NO: 298942

SEQ ID NO: 336259 - RNA, 64 nt, Human; identical to SEQ ID NO: 298947

SEQ ID NO: 336260 - RNA, 64 nt, Human; identical to SEQ ID NO: 298948

SEQ ID NO: 336261 - RNA, 64 nt, Human; identical to SEQ ID NO: 298949

SEQ ID NO: 336262 - RNA, 64 nt, Human; identical to SEQ ID NO: 298950

SEQ ID NO: 336263 - RNA, 62 nt, Human
gaggcucuugaugaucccaggucuccucgaccuccauacaccacacaggcauuuguaagcac

SEQ ID NO: 336264 - RNA, 62 nt, Human
uggaaaaauacucagcaaacaaaguuaccaauuccauacagagaugaucugguaucuucuuu

SEQ ID NO: 336265 - RNA, 62 nt, Human
aacuuggauagagccaguucaaccucccccaauccauacacauacauaccuaggucauccua

SEQ ID NO: 336266 - RNA, 62 nt, Human
ccgguguuguacuaaaccucgugcuugugaacuccauacagaaaacggugccaucccugaac

SEQ ID NO: 336267 - RNA, 64 nt, Human; identical to SEQ ID NO: 298951

SEQ ID NO: 336268 - RNA, 64 nt, Human; identical to SEQ ID NO: 298952

SEQ ID NO: 336269 - RNA, 64 nt, Human; identical to SEQ ID NO: 298953

SEQ ID NO: 336270 - RNA, 64 nt, Human; identical to SEQ ID NO: 298954

SEQ ID NO: 336271 - RNA, 64 nt, Human; identical to SEQ ID NO: 298955

SEQ ID NO: 336272 - RNA, 64 nt, Human; identical to SEQ ID NO: 298956

SEQ ID NO: 336273 - RNA, 64 nt, Human; identical to SEQ ID NO: 298957

SEQ ID NO: 336274 - RNA, 64 nt, Human; identical to SEQ ID NO: 298958

SEQ ID NO: 336275 - RNA, 64 nt, Human; identical to SEQ ID NO: 298959

SEQ ID NO: 336276 - RNA, 64 nt, Human; identical to SEQ ID NO: 298960

SEQ ID NO: 336277 - RNA, 64 nt, Human; identical to SEQ ID NO: 298961

SEQ ID NO: 336278 - RNA, 64 nt, Human; identical to SEQ ID NO: 298966

SEQ ID NO: 336279 - RNA, 64 nt, Human; identical to SEQ ID NO: 298967

SEQ ID NO: 336280 - RNA, 64 nt, Human; identical to SEQ ID NO: 298968

SEQ ID NO: 336281 - RNA, 64 nt, Human; identical to SEQ ID NO: 298969

SEQ ID NO: 336282 - RNA, 64 nt, Human; identical to SEQ ID NO: 298970

SEQ ID NO: 336283 - RNA, 62 nt, Human
cucucuauauauaucuguauaucuuauacauguccauacacagaaacauaauaaacaaucuu

SEQ ID NO: 336284 - RNA, 62 nt, Human
uauuucuuuuuuuuaauaaggaaaaaauaauauccauacagucaagauacauaguaaauggu

SEQ ID NO: 336285 - RNA, 62 nt, Human
uuaucuugaaccugugcuauuaaauggaaauuuccauacaucuuccccauacuauuuuuuau

SEQ ID NO: 336286 - RNA, 62 nt, Human
aggaacuggccuuguucuccuuagcccgucacuccauacaguauuaggugaggauggaugcg

SEQ ID NO: 336287 - RNA, 64 nt, Human; identical to SEQ ID NO: 298971

SEQ ID NO: 336288 - RNA, 64 nt, Human; identical to SEQ ID NO: 298972

SEQ ID NO: 336289 - RNA, 64 nt, Human; identical to SEQ ID NO: 298973

SEQ ID NO: 336290 - RNA, 64 nt, Human; identical to SEQ ID NO: 298974

SEQ ID NO: 336291 - RNA, 64 nt, Human; identical to SEQ ID NO: 298975

SEQ ID NO: 336292 - RNA, 64 nt, Human; identical to SEQ ID NO: 298976

SEQ ID NO: 336293 - RNA, 64 nt, Human; identical to SEQ ID NO: 298977

SEQ ID NO: 336294 - RNA, 64 nt, Human; identical to SEQ ID NO: 298978

SEQ ID NO: 336295 - RNA, 64 nt, Human; identical to SEQ ID NO: 298979

SEQ ID NO: 336296 - RNA, 64 nt, Human; identical to SEQ ID NO: 298980

SEQ ID NO: 336297 - RNA, 64 nt, Human; identical to SEQ ID NO: 298985

SEQ ID NO: 336298 - RNA, 64 nt, Human; identical to SEQ ID NO: 298986

SEQ ID NO: 336299 - RNA, 64 nt, Human; identical to SEQ ID NO: 298987

SEQ ID NO: 336300 - RNA, 64 nt, Human; identical to SEQ ID NO: 298988

SEQ ID NO: 336301 - RNA, 64 nt, Human; identical to SEQ ID NO: 298989

SEQ ID NO: 336302 - RNA, 64 nt, Human; identical to SEQ ID NO: 298990

SEQ ID NO: 336303 - RNA, 62 nt, Human
ccuugggacaggaaugggcaccugcuucugaguccauacaggagaagaaagaucuguuuccu

SEQ ID NO: 336304 - RNA, 62 nt, Human
uucaugcauccauuguucuguucauucauucauccauacauccaccugccucugagcuuuca

SEQ ID NO: 336305 - RNA, 64 nt, Human
aucccaugucccuccagggggaccccacagccuggcagaugagcagauaccccuggccacccau

SEQ ID NO: 336306 - RNA, 64 nt, Human
gucauuacuacauaugcuagccaaaucaauccaugcagaugauauauuaaaaucuguauaaagg

SEQ ID NO: 336307 - RNA, 64 nt, Human; identical to SEQ ID NO: 298991

SEQ ID NO: 336308 - RNA, 64 nt, Human; identical to SEQ ID NO: 298992

SEQ ID NO: 336309 - RNA, 64 nt, Human; identical to SEQ ID NO: 298993

SEQ ID NO: 336310 - RNA, 64 nt, Human; identical to SEQ ID NO: 298994

SEQ ID NO: 336311 - RNA, 64 nt, Human; identical to SEQ ID NO: 298995

SEQ ID NO: 336312 - RNA, 64 nt, Human; identical to SEQ ID NO: 298996

SEQ ID NO: 336313 - RNA, 64 nt, Human; identical to SEQ ID NO: 298997

SEQ ID NO: 336314 - RNA, 64 nt, Human; identical to SEQ ID NO: 298998

SEQ ID NO: 336315 - RNA, 64 nt, Human; identical to SEQ ID NO: 298999

SEQ ID NO: 336316 - RNA, 64 nt, Human; identical to SEQ ID NO: 299004

SEQ ID NO: 336317 - RNA, 64 nt, Human; identical to SEQ ID NO: 299005

SEQ ID NO: 336318 - RNA, 64 nt, Human; identical to SEQ ID NO: 299006

SEQ ID NO: 336319 - RNA, 64 nt, Human; identical to SEQ ID NO: 299007

SEQ ID NO: 336320 - RNA, 64 nt, Human; identical to SEQ ID NO: 299008

SEQ ID NO: 336321 - RNA, 64 nt, Human; identical to SEQ ID NO: 299009

SEQ ID NO: 336322 - RNA, 64 nt, Human; identical to SEQ ID NO: 299010

SEQ ID NO: 336323 - RNA, 62 nt, Human
cuucucuuuucuaaacccuuuuccuguucagauccauacaggauuugcaaggguaggaucau

SEQ ID NO: 336324 - RNA, 62 nt, Human
uacauauuugugguuaagguuagacuauaugauccauacaaauuaaagugagagacaugguu

SEQ ID NO: 336325 - RNA, 62 nt, Human
uggcaugccgugaucagaagucaugcaugagauccauacaccacaggacacuacuaaucuag

SEQ ID NO: 336326 - RNA, 62 nt, Human
gcuagauugauuacggauguaauugcuguccauccauacagagcauacucuacaguguauuc

SEQ ID NO: 336327 - RNA, 64 nt, Human; identical to SEQ ID NO: 299011

SEQ ID NO: 336328 - RNA, 64 nt, Human; identical to SEQ ID NO: 299012

SEQ ID NO: 336329 - RNA, 64 nt, Human; identical to SEQ ID NO: 299013

SEQ ID NO: 336330 - RNA, 64 nt, Human; identical to SEQ ID NO: 299014

SEQ ID NO: 336331 - RNA, 64 nt, Human; identical to SEQ ID NO: 299015

SEQ ID NO: 336332 - RNA, 64 nt, Human; identical to SEQ ID NO: 299016

SEQ ID NO: 336333 - RNA, 64 nt, Human; identical to SEQ ID NO: 299017

SEQ ID NO: 336334 - RNA, 64 nt, Human; identical to SEQ ID NO: 299018

SEQ ID NO: 336335 - RNA, 64 nt, Human; identical to SEQ ID NO: 299023

SEQ ID NO: 336336 - RNA, 64 nt, Human; identical to SEQ ID NO: 299024

SEQ ID NO: 336337 - RNA, 64 nt, Human; identical to SEQ ID NO: 299025

SEQ ID NO: 336338 - RNA, 64 nt, Human; identical to SEQ ID NO: 299026

SEQ ID NO: 336339 - RNA, 64 nt, Human; identical to SEQ ID NO: 299027

SEQ ID NO: 336340 - RNA, 64 nt, Human; identical to SEQ ID NO: 299028

SEQ ID NO: 336341 - RNA, 64 nt, Human; identical to SEQ ID NO: 299029

SEQ ID NO: 336342 - RNA, 64 nt, Human; identical to SEQ ID NO: 299030

SEQ ID NO: 336343 - RNA, 62 nt, Human
gaggguguuuauguaagagcaccuuccucacuuccauacagcucuacguggcaaauuaacuu

SEQ ID NO: 336344 - RNA, 62 nt, Human
gugguuugagcacuggguucuuuuagccaaauuccauacaaaaagaauuuggauguuuucca

SEQ ID NO: 336345 - RNA, 62 nt, Human
guacauacacucaggaagguaguacaagauacuccauacaacacaaccaugugcuauuuauc

SEQ ID NO: 336346 - RNA, 62 nt, Human
cuucaucuuugagaugcuuggccauaacaggguccauacacaucuucugguuuacuauauac

SEQ ID NO: 336347 - RNA, 64 nt, Human; identical to SEQ ID NO: 299031

SEQ ID NO: 336348 - RNA, 64 nt, Human; identical to SEQ ID NO: 299032

SEQ ID NO: 336349 - RNA, 64 nt, Human; identical to SEQ ID NO: 299033

SEQ ID NO: 336350 - RNA, 64 nt, Human; identical to SEQ ID NO: 299034

SEQ ID NO: 336351 - RNA, 64 nt, Human; identical to SEQ ID NO: 299035

SEQ ID NO: 336352 - RNA, 64 nt, Human; identical to SEQ ID NO: 299036

SEQ ID NO: 336353 - RNA, 64 nt, Human; identical to SEQ ID NO: 299037

SEQ ID NO: 336354 - RNA, 64 nt, Human; identical to SEQ ID NO: 299042

SEQ ID NO: 336355 - RNA, 64 nt, Human; identical to SEQ ID NO: 299043

SEQ ID NO: 336356 - RNA, 64 nt, Human; identical to SEQ ID NO: 299044

SEQ ID NO: 336357 - RNA, 64 nt, Human; identical to SEQ ID NO: 299045

SEQ ID NO: 336358 - RNA, 64 nt, Human; identical to SEQ ID NO: 299046

SEQ ID NO: 336359 - RNA, 64 nt, Human; identical to SEQ ID NO: 299047

SEQ ID NO: 336360 - RNA, 64 nt, Human; identical to SEQ ID NO: 299048

SEQ ID NO: 336361 - RNA, 64 nt, Human; identical to SEQ ID NO: 299049

SEQ ID NO: 336362 - RNA, 64 nt, Human; identical to SEQ ID NO: 299050

SEQ ID NO: 336363 - RNA, 62 nt, Human
aguauauaucgggaccggcagaaauggaaguauccauacauuuuuaaaaagcaacaaguuug

SEQ ID NO: 336364 - RNA, 62 nt, Human
ccuaugauugauuuuuuaaaaucaugcucuuuuccauacaucaacauaaacagucuuuggau

SEQ ID NO: 336365 - RNA, 62 nt, Human
ucugcugcuccucccccacccccaccuuccacuccauacaaucugggccugguggagucuuc

SEQ ID NO: 336366 - RNA, 62 nt, Human
gcucuuuggauuuauaacucuguuuagacuauuccauacauuuuagguauauuuugugccuu

SEQ ID NO: 336367 - RNA, 64 nt, Human; identical to SEQ ID NO: 299051

SEQ ID NO: 336368 - RNA, 64 nt, Human; identical to SEQ ID NO: 299052

SEQ ID NO: 336369 - RNA, 64 nt, Human; identical to SEQ ID NO: 299053

SEQ ID NO: 336370 - RNA, 64 nt, Human; identical to SEQ ID NO: 299054

SEQ ID NO: 336371 - RNA, 64 nt, Human; identical to SEQ ID NO: 299055

SEQ ID NO: 336372 - RNA, 64 nt, Human; identical to SEQ ID NO: 299056

SEQ ID NO: 336373 - RNA, 64 nt, Human; identical to SEQ ID NO: 299061

SEQ ID NO: 336374 - RNA, 64 nt, Human; identical to SEQ ID NO: 299062

SEQ ID NO: 336375 - RNA, 64 nt, Human; identical to SEQ ID NO: 299063

SEQ ID NO: 336376 - RNA, 64 nt, Human; identical to SEQ ID NO: 299064

SEQ ID NO: 336377 - RNA, 64 nt, Human; identical to SEQ ID NO: 299065

SEQ ID NO: 336378 - RNA, 64 nt, Human; identical to SEQ ID NO: 299066

SEQ ID NO: 336379 - RNA, 64 nt, Human; identical to SEQ ID NO: 299067

SEQ ID NO: 336380 - RNA, 64 nt, Human; identical to SEQ ID NO: 299068

SEQ ID NO: 336381 - RNA, 64 nt, Human; identical to SEQ ID NO: 299069

SEQ ID NO: 336382 - RNA, 64 nt, Human; identical to SEQ ID NO: 299070

SEQ ID NO: 336383 - RNA, 62 nt, Human
cacaggaaggaggagccgaccgggaauaaccuuccauacauuuuuuucuuugucuuaucugg

SEQ ID NO: 336384 - RNA, 62 nt, Human
gucugccacaugccaaacaauguuagguacuuuccauacaacgaaucuauuauucccaucuu

SEQ ID NO: 336385 - RNA, 62 nt, Human
uuguucauauaguauccuuuaaccucuaguuuuccauacauccuuuguuuguuucucauuuu

SEQ ID NO: 336386 - RNA, 62 nt, Human
uauuugcucagguaucaugcugucuguacaguuccauacaacaaggaggugaaaucagagau

SEQ ID NO: 336387 - RNA, 64 nt, Human; identical to SEQ ID NO: 299071

SEQ ID NO: 336388 - RNA, 64 nt, Human; identical to SEQ ID NO: 299072

SEQ ID NO: 336389 - RNA, 64 nt, Human; identical to SEQ ID NO: 299073

SEQ ID NO: 336390 - RNA, 64 nt, Human; identical to SEQ ID NO: 299074

SEQ ID NO: 336391 - RNA, 64 nt, Human; identical to SEQ ID NO: 299075

SEQ ID NO: 336392 - RNA, 64 nt, Human; identical to SEQ ID NO: 299080

SEQ ID NO: 336393 - RNA, 64 nt, Human; identical to SEQ ID NO: 299081

SEQ ID NO: 336394 - RNA, 64 nt, Human; identical to SEQ ID NO: 299082

SEQ ID NO: 336395 - RNA, 64 nt, Human; identical to SEQ ID NO: 299083

SEQ ID NO: 336396 - RNA, 64 nt, Human; identical to SEQ ID NO: 299084

SEQ ID NO: 336397 - RNA, 64 nt, Human; identical to SEQ ID NO: 299085

SEQ ID NO: 336398 - RNA, 64 nt, Human; identical to SEQ ID NO: 299086

SEQ ID NO: 336399 - RNA, 64 nt, Human; identical to SEQ ID NO: 299087

SEQ ID NO: 336400 - RNA, 64 nt, Human; identical to SEQ ID NO: 299088

SEQ ID NO: 336401 - RNA, 64 nt, Human; identical to SEQ ID NO: 299089

SEQ ID NO: 336402 - RNA, 64 nt, Human; identical to SEQ ID NO: 299090

SEQ ID NO: 336403 - RNA, 62 nt, Human
aacauaggucuaauuuauuugccgugucauuuuccauacaaaucaguugauuuaaaaaaguu

SEQ ID NO: 336404 - RNA, 62 nt, Human
caacaaaacacaaacccugaaggaaaaccuuuuccauacacccaggcuaugcauugaagagu

SEQ ID NO: 336405 - RNA, 62 nt, Human
auuuuuccaguuuccuauuacugaggaaaaccuccauacacugaggcagaaacuugugucag

SEQ ID NO: 336406 - RNA, 62 nt, Human
aaugacuuguuauagcucagugugcccuugaauccauacaguuucuuaaaagacaauaaaau

SEQ ID NO: 336407 - RNA, 64 nt, Human; identical to SEQ ID NO: 299091

SEQ ID NO: 336408 - RNA, 64 nt, Human; identical to SEQ ID NO: 299092

SEQ ID NO: 336409 - RNA, 64 nt, Human; identical to SEQ ID NO: 299093

SEQ ID NO: 336410 - RNA, 64 nt, Human; identical to SEQ ID NO: 299094

SEQ ID NO: 336411 - RNA, 64 nt, Human; identical to SEQ ID NO: 299099

SEQ ID NO: 336412 - RNA, 64 nt, Human; identical to SEQ ID NO: 299100

SEQ ID NO: 336413 - RNA, 64 nt, Human; identical to SEQ ID NO: 299101

SEQ ID NO: 336414 - RNA, 64 nt, Human; identical to SEQ ID NO: 299102

SEQ ID NO: 336415 - RNA, 64 nt, Human; identical to SEQ ID NO: 299103

SEQ ID NO: 336416 - RNA, 64 nt, Human; identical to SEQ ID NO: 299104

SEQ ID NO: 336417 - RNA, 64 nt, Human; identical to SEQ ID NO: 299105

SEQ ID NO: 336418 - RNA, 64 nt, Human; identical to SEQ ID NO: 299106

SEQ ID NO: 336419 - RNA, 64 nt, Human; identical to SEQ ID NO: 299107

SEQ ID NO: 336420 - RNA, 64 nt, Human; identical to SEQ ID NO: 299108

SEQ ID NO: 336421 - RNA, 64 nt, Human; identical to SEQ ID NO: 299109

SEQ ID NO: 336422 - RNA, 64 nt, Human; identical to SEQ ID NO: 299110

SEQ ID NO: 336423 - RNA, 64 nt, Human
ucaagaaaagcauuucuguuguguuauuugcagugcagaugaugucuguguaacaacauaaugg

SEQ ID NO: 336424 - RNA, 64 nt, Human
aaaaauuuauggugaaugaauauggcuuuaggcggcagaugauauacauaucugacuucccaaa

SEQ ID NO: 336425 - RNA, 64 nt, Human
uggugauccacccaguuacaggggcauuuagggagcagaugacugagaacauuaaaaaagaacu

SEQ ID NO: 336426 - RNA, 64 nt, Human; identical to SEQ ID NO: 299111

SEQ ID NO: 336427 - RNA, 64 nt, Human; identical to SEQ ID NO: 299112

SEQ ID NO: 336428 - RNA, 64 nt, Human; identical to SEQ ID NO: 299113

SEQ ID NO: 336429 - RNA, 64 nt, Human; identical to SEQ ID NO: 299118

SEQ ID NO: 336430 - RNA, 64 nt, Human; identical to SEQ ID NO: 299119

SEQ ID NO: 336431 - RNA, 64 nt, Human; identical to SEQ ID NO: 299120

SEQ ID NO: 336432 - RNA, 64 nt, Human; identical to SEQ ID NO: 299121

SEQ ID NO: 336433 - RNA, 64 nt, Human; identical to SEQ ID NO: 299122

SEQ ID NO: 336434 - RNA, 64 nt, Human; identical to SEQ ID NO: 299123

SEQ ID NO: 336435 - RNA, 64 nt, Human; identical to SEQ ID NO: 299124

SEQ ID NO: 336436 - RNA, 64 nt, Human; identical to SEQ ID NO: 299125

SEQ ID NO: 336437 - RNA, 64 nt, Human; identical to SEQ ID NO: 299126

SEQ ID NO: 336438 - RNA, 64 nt, Human; identical to SEQ ID NO: 299127

SEQ ID NO: 336439 - RNA, 64 nt, Human; identical to SEQ ID NO: 299128

SEQ ID NO: 336440 - RNA, 64 nt, Human; identical to SEQ ID NO: 299129

SEQ ID NO: 336441 - RNA, 64 nt, Human; identical to SEQ ID NO: 299130

SEQ ID NO: 336442 - RNA, 62 nt, Human
gccaaggaaauauuuugugaugguguucuggguccauacaccagcaaugaaggagauagauu

SEQ ID NO: 336443 - RNA, 62 nt, Human
gucagcaccauguaccaggaauagcuuuacuuuccauacauagaaauauaaauuuaguggua

SEQ ID NO: 336444 - RNA, 62 nt, Human
cuguuauuaagcccaaugagacaucuagggaguccauacacaucagugagcagauguaguuu

SEQ ID NO: 336445 - RNA, 62 nt, Human
aagcagugauacucccuggcucgguuauuuucuccauacaaugcacacaugguacaaugaua

SEQ ID NO: 336446 - RNA, 64 nt, Human; identical to SEQ ID NO: 299131

SEQ ID NO: 336447 - RNA, 64 nt, Human; identical to SEQ ID NO: 299132

SEQ ID NO: 336448 - RNA, 64 nt, Human; identical to SEQ ID NO: 299137

SEQ ID NO: 336449 - RNA, 64 nt, Human; identical to SEQ ID NO: 299138

SEQ ID NO: 336450 - RNA, 64 nt, Human; identical to SEQ ID NO: 299139

SEQ ID NO: 336451 - RNA, 64 nt, Human; identical to SEQ ID NO: 299140

SEQ ID NO: 336452 - RNA, 64 nt, Human; identical to SEQ ID NO: 299141

SEQ ID NO: 336453 - RNA, 64 nt, Human; identical to SEQ ID NO: 299142

SEQ ID NO: 336454 - RNA, 64 nt, Human; identical to SEQ ID NO: 299143

SEQ ID NO: 336455 - RNA, 64 nt, Human; identical to SEQ ID NO: 299144

SEQ ID NO: 336456 - RNA, 64 nt, Human; identical to SEQ ID NO: 299145

SEQ ID NO: 336457 - RNA, 64 nt, Human; identical to SEQ ID NO: 299146

SEQ ID NO: 336458 - RNA, 64 nt, Human; identical to SEQ ID NO: 299147

SEQ ID NO: 336459 - RNA, 64 nt, Human; identical to SEQ ID NO: 299148

SEQ ID NO: 336460 - RNA, 64 nt, Human; identical to SEQ ID NO: 299149

SEQ ID NO: 336461 - RNA, 64 nt, Human; identical to SEQ ID NO: 299150

SEQ ID NO: 336462 - RNA, 62 nt, Human
ugaaaagacuuuguacucccacuuccuccaaauccauacagugaggaaucagaguguuuaua

SEQ ID NO: 336463 - RNA, 62 nt, Human
ugagguuauuacuggccguaaggcagaguuaauccauacagaaaccaguguguccaugugcu

SEQ ID NO: 336464 - RNA, 62 nt, Human
aguguauuuguguaaaguuugucauuucauacuccauacacuacaguugcugucacugaucc

SEQ ID NO: 336465 - RNA, 62 nt, Human
uauuugcuauaugcacuggguauaauccguaauccauacacugccagauaaugccauuucaa

SEQ ID NO: 336466 - RNA, 64 nt, Human; identical to SEQ ID NO: 299151

SEQ ID NO: 336467 - RNA, 64 nt, Human; identical to SEQ ID NO: 299156

SEQ ID NO: 336468 - RNA, 64 nt, Human; identical to SEQ ID NO: 299157

SEQ ID NO: 336469 - RNA, 64 nt, Human; identical to SEQ ID NO: 299158

SEQ ID NO: 336470 - RNA, 64 nt, Human; identical to SEQ ID NO: 299159

SEQ ID NO: 336471 - RNA, 64 nt, Human; identical to SEQ ID NO: 299160

SEQ ID NO: 336472 - RNA, 64 nt, Human; identical to SEQ ID NO: 299161

SEQ ID NO: 336473 - RNA, 64 nt, Human; identical to SEQ ID NO: 299162

SEQ ID NO: 336474 - RNA, 64 nt, Human; identical to SEQ ID NO: 299163

SEQ ID NO: 336475 - RNA, 64 nt, Human; identical to SEQ ID NO: 299164

SEQ ID NO: 336476 - RNA, 64 nt, Human; identical to SEQ ID NO: 299165

SEQ ID NO: 336477 - RNA, 64 nt, Human; identical to SEQ ID NO: 299166

SEQ ID NO: 336478 - RNA, 64 nt, Human; identical to SEQ ID NO: 299167

SEQ ID NO: 336479 - RNA, 64 nt, Human; identical to SEQ ID NO: 299168

SEQ ID NO: 336480 - RNA, 64 nt, Human; identical to SEQ ID NO: 299169

SEQ ID NO: 336481 - RNA, 64 nt, Human; identical to SEQ ID NO: 299170

SEQ ID NO: 336482 - RNA, 62 nt, Human
acuggaguuaauuagucuuagaaaugugugcauccauacaaaugcacaacauaaagugaaca

SEQ ID NO: 336483 - RNA, 62 nt, Human
aggaucuuccucccuuuucugcuuugaggguuuccauacauugcuguuuucagguucuacaa

SEQ ID NO: 336484 - RNA, 62 nt, Human
uguuuacaacauuuuugcaaaucuaaaguugcuccauacaaugacuagucaccugggggggu

SEQ ID NO: 336485 - RNA, 62 nt, Human
gugugcggucucgauucgcugaauugcccguuuccauacagggucucuuccuucggucuuuu

SEQ ID NO: 336486 - RNA, 64 nt, Human; identical to SEQ ID NO: 299175

SEQ ID NO: 336487 - RNA, 64 nt, Human; identical to SEQ ID NO: 299176

SEQ ID NO: 336488 - RNA, 64 nt, Human; identical to SEQ ID NO: 299177

SEQ ID NO: 336489 - RNA, 64 nt, Human; identical to SEQ ID NO: 299178

SEQ ID NO: 336490 - RNA, 64 nt, Human; identical to SEQ ID NO: 299179

SEQ ID NO: 336491 - RNA, 64 nt, Human; identical to SEQ ID NO: 299180

SEQ ID NO: 336492 - RNA, 64 nt, Human; identical to SEQ ID NO: 299181

SEQ ID NO: 336493 - RNA, 64 nt, Human; identical to SEQ ID NO: 299182

SEQ ID NO: 336494 - RNA, 64 nt, Human; identical to SEQ ID NO: 299183

SEQ ID NO: 336495 - RNA, 64 nt, Human; identical to SEQ ID NO: 299184

SEQ ID NO: 336496 - RNA, 64 nt, Human; identical to SEQ ID NO: 299185

SEQ ID NO: 336497 - RNA, 64 nt, Human; identical to SEQ ID NO: 299186

SEQ ID NO: 336498 - RNA, 64 nt, Human; identical to SEQ ID NO: 299187

SEQ ID NO: 336499 - RNA, 64 nt, Human; identical to SEQ ID NO: 299188

SEQ ID NO: 336500 - RNA, 64 nt, Human; identical to SEQ ID NO: 299189

SEQ ID NO: 336501 - RNA, 64 nt, Human; identical to SEQ ID NO: 299194

SEQ ID NO: 336502 - RNA, 62 nt, Human
acuccgaaaauuucaucaucuaagaaaaugauuccauacaaauaacucagcacacaagugac

SEQ ID NO: 336503 - RNA, 62 nt, Human
gggugagagucacaccacauuacacaugugcuuccauacagugguuucugaagcuuuugcag

SEQ ID NO: 336504 - RNA, 62 nt, Human
ggguauucugagaaucaugcucuaauggcuuuuccauacacuaaagcucugaaaguagugag

SEQ ID NO: 336505 - RNA, 62 nt, Human
gaguucagucccuagaaguaucuucacaaugauccauacagccuugcuaugcuuuagaacuu

SEQ ID NO: 336506 - RNA, 62 nt, Human; identical to SEQ ID NO: 299195

SEQ ID NO: 336507 - RNA, 64 nt, Human; identical to SEQ ID NO: 299196

SEQ ID NO: 336508 - RNA, 64 nt, Human; identical to SEQ ID NO: 299197

SEQ ID NO: 336509 - RNA, 64 nt, Human; identical to SEQ ID NO: 299198

SEQ ID NO: 336510 - RNA, 64 nt, Human; identical to SEQ ID NO: 299199

SEQ ID NO: 336511 - RNA, 64 nt, Human; identical to SEQ ID NO: 299200

SEQ ID NO: 336512 - RNA, 64 nt, Human; identical to SEQ ID NO: 299201

SEQ ID NO: 336513 - RNA, 64 nt, Human; identical to SEQ ID NO: 299202

SEQ ID NO: 336514 - RNA, 64 nt, Human; identical to SEQ ID NO: 299203

SEQ ID NO: 336515 - RNA, 64 nt, Human; identical to SEQ ID NO: 299204

SEQ ID NO: 336516 - RNA, 64 nt, Human; identical to SEQ ID NO: 299205

SEQ ID NO: 336517 - RNA, 64 nt, Human; identical to SEQ ID NO: 299206

SEQ ID NO: 336518 - RNA, 64 nt, Human; identical to SEQ ID NO: 299207

SEQ ID NO: 336519 - RNA, 64 nt, Human; identical to SEQ ID NO: 299208

SEQ ID NO: 336520 - RNA, 64 nt, Human; identical to SEQ ID NO: 299213

SEQ ID NO: 336521 - RNA, 64 nt, Human; identical to SEQ ID NO: 299214

SEQ ID NO: 336522 - RNA, 62 nt, Human
auucuuggagaacuuuccaucugcuuguauuuuccauacacauccccagccagaaguuagug

SEQ ID NO: 336523 - RNA, 62 nt, Human
cagguagaccaaauuccgcuuucaguaauucauccauacagaauuuggaugacuauguauaa

SEQ ID NO: 336524 - RNA, 62 nt, Human
uuguauguuugacuuaccuuagauuuuuauuuuccauacauacugcaaaugauugacuuguu

SEQ ID NO: 336525 - RNA, 62 nt, Human
ggaagcagggauugcugacauguauuuuugaauccauacauuaaugcuaaaacgaauauagu

SEQ ID NO: 336526 - RNA, 64 nt, Human; identical to SEQ ID NO: 299215

SEQ ID NO: 336527 - RNA, 64 nt, Human; identical to SEQ ID NO: 299216

SEQ ID NO: 336528 - RNA, 64 nt, Human; identical to SEQ ID NO: 299217

SEQ ID NO: 336529 - RNA, 64 nt, Human; identical to SEQ ID NO: 299218

SEQ ID NO: 336530 - RNA, 64 nt, Human; identical to SEQ ID NO: 299219

SEQ ID NO: 336531 - RNA, 64 nt, Human; identical to SEQ ID NO: 299220

SEQ ID NO: 336532 - RNA, 64 nt, Human; identical to SEQ ID NO: 299221

SEQ ID NO: 336533 - RNA, 64 nt, Human; identical to SEQ ID NO: 299222

SEQ ID NO: 336534 - RNA, 64 nt, Human; identical to SEQ ID NO: 299223

SEQ ID NO: 336535 - RNA, 64 nt, Human; identical to SEQ ID NO: 299224

SEQ ID NO: 336536 - RNA, 64 nt, Human; identical to SEQ ID NO: 299225

SEQ ID NO: 336537 - RNA, 64 nt, Human; identical to SEQ ID NO: 299226

SEQ ID NO: 336538 - RNA, 64 nt, Human; identical to SEQ ID NO: 299227

SEQ ID NO: 336539 - RNA, 64 nt, Human; identical to SEQ ID NO: 299232

SEQ ID NO: 336540 - RNA, 54 nt, Human; identical to SEQ ID NO: 299233

SEQ ID NO: 336541 - RNA, 64 nt, Human; identical to SEQ ID NO: 299234

SEQ ID NO: 336542 - RNA, 62 nt, Human
gcuuacaauuuguagaaacacaaaaugcguuuuccauacagcagugccuauauagugacuga

SEQ ID NO: 336543 - RNA, 62 nt, Human
gcuuaaaguugcucuuuugguuuuuaacuuccuccauacauaagcuucaaggacaauaagau

SEQ ID NO: 336544 - RNA, 62 nt, Human
cccuuucuucuaguggacagaacaugcuguguuccauacagccuuggacuagcaauuuaugc

SEQ ID NO: 336545 - RNA, 62 nt, Human
uaugauauaaaaugauggcuaucaaaugauuuuccauacauuguacugaucaaguuauacac

SEQ ID NO: 336546 - RNA, 64 nt, Human; identical to SEQ ID NO: 299235

SEQ ID NO: 336547 - RNA, 64 nt, Human; identical to SEQ ID NO: 299236

SEQ ID NO: 336548 - RNA, 64 nt, Human; identical to SEQ ID NO: 299237

SEQ ID NO: 336549 - RNA, 64 nt, Human; identical to SEQ ID NO: 299238

SEQ ID NO: 336550 - RNA, 64 nt, Human; identical to SEQ ID NO: 299239

SEQ ID NO: 336551 - RNA, 60 nt, Human; identical to SEQ ID NO: 299240

SEQ ID NO: 336552 - RNA, 64 nt, Human; identical to SEQ ID NO: 299241

SEQ ID NO: 336553 - RNA, 64 nt, Human; identical to SEQ ID NO: 299242

SEQ ID NO: 336554 - RNA, 64 nt, Human; identical to SEQ ID NO: 299243

SEQ ID NO: 336555 - RNA, 64 nt, Human; identical to SEQ ID NO: 299244

SEQ ID NO: 336556 - RNA, 64 nt, Human; identical to SEQ ID NO: 299245

SEQ ID NO: 336557 - RNA, 64 nt, Human; identical to SEQ ID NO: 299246

SEQ ID NO: 336558 - RNA, 64 nt, Human; identical to SEQ ID NO: 299251

SEQ ID NO: 336559 - RNA, 64 nt, Human; identical to SEQ ID NO: 299252

SEQ ID NO: 336560 - RNA, 64 nt, Human; identical to SEQ ID NO: 299253

SEQ ID NO: 336561 - RNA, 64 nt, Human; identical to SEQ ID NO: 299254

SEQ ID NO: 336562 - RNA, 62 nt, Human
ugugcucccuaaaaguuguacuucauuucuuuuccauacacugugugcuauuuguguuaaca

SEQ ID NO: 336563 - RNA, 62 nt, Human
cucccccugccgcccacacugcagcagccacauccauacacacacgcucgcacaguguucug

SEQ ID NO: 336564 - RNA, 62 nt, Human
uguuuccucucuccucuaccauucaucucucuuccauacagucauuugggcuuuuuacucaa

SEQ ID NO: 336565 - RNA, 62 nt, Human
acagugcccacucuggaccuaagucuaguguauccauacaauuggugcagagaaauaaggug

SEQ ID NO: 336566 - RNA, 64 nt, Human; identical to SEQ ID NO: 299255

SEQ ID NO: 336567 - RNA, 64 nt, Human; identical to SEQ ID NO: 299256

SEQ ID NO: 336568 - RNA, 64 nt, Human; identical to SEQ ID NO: 299257

SEQ ID NO: 336569 - RNA, 64 nt, Human; identical to SEQ ID NO: 299258

SEQ ID NO: 336570 - RNA, 64 nt, Human; identical to SEQ ID NO: 299259

SEQ ID NO: 336571 - RNA, 64 nt, Human; identical to SEQ ID NO: 299260

SEQ ID NO: 336572 - RNA, 64 nt, Human; identical to SEQ ID NO: 299261

SEQ ID NO: 336573 - RNA, 64 nt, Human; identical to SEQ ID NO: 299262

SEQ ID NO: 336574 - RNA, 64 nt, Human; identical to SEQ ID NO: 299263

SEQ ID NO: 336575 - RNA, 64 nt, Human; identical to SEQ ID NO: 299264

SEQ ID NO: 336576 - RNA, 61 nt, Human; identical to SEQ ID NO: 299265

SEQ ID NO: 336577 - RNA, 64 nt, Human; identical to SEQ ID NO: 299270

SEQ ID NO: 336578 - RNA, 64 nt, Human; identical to SEQ ID NO: 299271

SEQ ID NO: 336579 - RNA, 64 nt, Human; identical to SEQ ID NO: 299272

SEQ ID NO: 336580 - RNA, 64 nt, Human; identical to SEQ ID NO: 299273

SEQ ID NO: 336581 - RNA, 64 nt, Human; identical to SEQ ID NO: 299274

SEQ ID NO: 336582 - RNA, 62 nt, Human
caguaucugaacuauaagcccauuuauacuguuccauacaaaagcuauuuuucaaaaauuaa

SEQ ID NO: 336583 - RNA, 62 nt, Human
caccugcuucccuaccacuccucacugcauuuuccauacaaauguuucuauuuuauuguucc

SEQ ID NO: 336584 - RNA, 62 nt, Human
aaggcccaagcaccaccgucaacacagcccaguccauacagaaauggguuucaugccugaaa

SEQ ID NO: 336585 - RNA, 62 nt, Human
aacuaaugaauagauaaaccaaaucugguauauccauacaauggacuauauuauucagccau

SEQ ID NO: 336586 - RNA, 64 nt, Human; identical to SEQ ID NO: 299275

SEQ ID NO: 336587 - RNA, 64 nt, Human; identical to SEQ ID NO: 299276

SEQ ID NO: 336588 - RNA, 64 nt, Human; identical to SEQ ID NO: 299277

SEQ ID NO: 336589 - RNA, 64 nt, Human; identical to SEQ ID NO: 299278

SEQ ID NO: 336590 - RNA, 64 nt, Human; identical to SEQ ID NO: 299279

SEQ ID NO: 336591 - RNA, 64 nt, Human; identical to SEQ ID NO: 299280

SEQ ID NO: 336592 - RNA, 64 nt, Human; identical to SEQ ID NO: 299281

SEQ ID NO: 336593 - RNA, 64 nt, Human; identical to SEQ ID NO: 299282

SEQ ID NO: 336594 - RNA, 64 nt, Human; identical to SEQ ID NO: 299283

SEQ ID NO: 336595 - RNA, 64 nt, Human; identical to SEQ ID NO: 299284

SEQ ID NO: 336596 - RNA, 64 nt, Human; identical to SEQ ID NO: 299289

SEQ ID NO: 336597 - RNA, 64 nt, Human; identical to SEQ ID NO: 299290

SEQ ID NO: 336598 - RNA, 64 nt, Human; identical to SEQ ID NO: 299291

SEQ ID NO: 336599 - RNA, 64 nt, Human; identical to SEQ ID NO: 299292

SEQ ID NO: 336600 - RNA, 64 nt, Human; identical to SEQ ID NO: 299293

SEQ ID NO: 336601 - RNA, 64 nt, Human; identical to SEQ ID NO: 299294

SEQ ID NO: 336602 - RNA, 62 nt, Human
gcuaacucccugcaucugggcaucaggacugcuccauacauuugcugaaaacuucuuguauu

SEQ ID NO: 336603 - RNA, 62 nt, Human
auuaaggcacaguugauuuuguagaguauugguccauacagagaaacugugguccuuuauaa

SEQ ID NO: 336604 - RNA, 62 nt, Human
aauuuacauuuuauauuaaagaaauugagcuauccauacaaccuguauuuacuuuaauuuca

SEQ ID NO: 336605 - RNA, 62 nt, Human
ugauguugugguuuuauuaucuuaaacucuguuccauacacuuguauaaauacauggauauu

SEQ ID NO: 336606 - RNA, 64 nt, Human; identical to SEQ ID NO: 299295

SEQ ID NO: 336607 - RNA, 64 nt, Human; identical to SEQ ID NO: 299296

SEQ ID NO: 336608 - RNA, 64 nt, Human; identical to SEQ ID NO: 299297

SEQ ID NO: 336609 - RNA, 64 nt, Human; identical to SEQ ID NO: 299298

SEQ ID NO: 336610 - RNA, 64 nt, Human; identical to SEQ ID NO: 299299

SEQ ID NO: 336611 - RNA, 64 nt, Human; identical to SEQ ID NO: 299300

SEQ ID NO: 336612 - RNA, 64 nt, Human; identical to SEQ ID NO: 299301

SEQ ID NO: 336613 - RNA, 64 nt, Human; identical to SEQ ID NO: 299302

SEQ ID NO: 336614 - RNA, 64 nt, Human; identical to SEQ ID NO: 299303

SEQ ID NO: 336615 - RNA, 64 nt, Human; identical to SEQ ID NO: 299308

SEQ ID NO: 336616 - RNA, 64 nt, Human; identical to SEQ ID NO: 299309

SEQ ID NO: 336617 - RNA, 64 nt, Human; identical to SEQ ID NO: 299310

SEQ ID NO: 336618 - RNA, 64 nt, Human; identical to SEQ ID NO: 299311

SEQ ID NO: 336619 - RNA, 64 nt, Human; identical to SEQ ID NO: 299312

SEQ ID NO: 336620 - RNA, 64 nt, Human; identical to SEQ ID NO: 299313

SEQ ID NO: 336621 - RNA, 64 nt, Human; identical to SEQ ID NO: 299314

SEQ ID NO: 336622 - RNA, 62 nt, Human
caaauuacagaaggaagcuacuuguuuaaaauuccauacacguuugcaguuucuuguacaca

SEQ ID NO: 336623 - RNA, 62 nt, Human
gaaaaacuggaaauaauucguuuccauaucuuuccauacauccauuucugaaguauucagga

SEQ ID NO: 336624 - RNA, 62 nt, Human
uacacaauagcagagaauauaaacugaaaaaauccauacaaauauuaaaaauguggcaaauu

SEQ ID NO: 336625 - RNA, 62 nt, Human
aagagugaccugcacaaacuuggaauuuuuuuuccauacaacccugacccauuuacuguauu

SEQ ID NO: 336626 - RNA, 64 nt, Human; identical to SEQ ID NO: 299315

SEQ ID NO: 336627 - RNA, 64 nt, Human; identical to SEQ ID NO: 299316

SEQ ID NO: 336628 - RNA, 64 nt, Human; identical to SEQ ID NO: 299317

SEQ ID NO: 336629 - RNA, 64 nt, Human; identical to SEQ ID NO: 299318

SEQ ID NO: 336630 - RNA, 64 nt, Human; identical to SEQ ID NO: 299319

SEQ ID NO: 336631 - RNA, 64 nt, Human; identical to SEQ ID NO: 299320

SEQ ID NO: 336632 - RNA, 64 nt, Human; identical to SEQ ID NO: 299321

SEQ ID NO: 336633 - RNA, 64 nt, Human; identical to SEQ ID NO: 299322

SEQ ID NO: 336634 - RNA, 64 nt, Human; identical to SEQ ID NO: 299327

SEQ ID NO: 336635 - RNA, 64 nt, Human; identical to SEQ ID NO: 299328

SEQ ID NO: 336636 - RNA, 64 nt, Human; identical to SEQ ID NO: 299329

SEQ ID NO: 336637 - RNA, 64 nt, Human; identical to SEQ ID NO: 299330

SEQ ID NO: 336638 - RNA, 64 nt, Human; identical to SEQ ID NO: 299331

SEQ ID NO: 336639 - RNA, 64 nt, Human; identical to SEQ ID NO: 299332

SEQ ID NO: 336640 - RNA, 64 nt, Human; identical to SEQ ID NO: 299333

SEQ ID NO: 336641 - RNA, 64 nt, Human; identical to SEQ ID NO: 299334

SEQ ID NO: 336642 - RNA, 62 nt, Human
aaaaugcagacagaccucaacauucaacaacauccauacagcacugcuggaggaagaggaag

SEQ ID NO: 336643 - RNA, 62 nt, Human
ggggcuggcacaaaucugaucagagacacauauccauacacaggugaaacacauacagacuc

SEQ ID NO: 336644 - RNA, 62 nt, Human
agaugaaacggaagaugcacgaggauaugaucuccauacagaacuuucucaucuacguggcc

SEQ ID NO: 336645 - RNA, 62 nt, Human
cugaagugcuuaugaaggggcguccauucuccuccauacauccccaucccucuacuuucccc

SEQ ID NO: 336646 - RNA, 64 nt, Human; identical to SEQ ID NO: 299335

SEQ ID NO: 336647 - RNA, 64 nt, Human; identical to SEQ ID NO: 299336

SEQ ID NO: 336648 - RNA, 64 nt, Human; identical to SEQ ID NO: 299337

SEQ ID NO: 336649 - RNA, 64 nt, Human; identical to SEQ ID NO: 299338

SEQ ID NO: 336650 - RNA, 64 nt, Human; identical to SEQ ID NO: 299339

SEQ ID NO: 336651 - RNA, 64 nt, Human; identical to SEQ ID NO: 299340

SEQ ID NO: 336652 - RNA, 64 nt, Human; identical to SEQ ID NO: 299341

SEQ ID NO: 336653 - RNA, 64 nt, Human; identical to SEQ ID NO: 299346

SEQ ID NO: 336654 - RNA, 64 nt, Human; identical to SEQ ID NO: 299347

SEQ ID NO: 336655 - RNA, 64 nt, Human; identical to SEQ ID NO: 299348

SEQ ID NO: 336656 - RNA, 64 nt, Human; identical to SEQ ID NO: 299349

SEQ ID NO: 336657 - RNA, 64 nt, Human; identical to SEQ ID NO: 299350

SEQ ID NO: 336658 - RNA, 64 nt, Human; identical to SEQ ID NO: 299351

SEQ ID NO: 336659 - RNA, 64 nt, Human; identical to SEQ ID NO: 299352

SEQ ID NO: 336660 - RNA, 64 nt, Human; identical to SEQ ID NO: 299353

SEQ ID NO: 336661 - RNA, 64 nt, Human; identical to SEQ ID NO: 299354

SEQ ID NO: 336662 - RNA, 51 nt, Human
cagaaggggcugaaaacuaaauccauacagggugucauccuucuuuccuuc

SEQ ID NO: 336663 - RNA, 62 nt, Human
uucaaccauguuuuuugaucuagcucucugauuccauacauuccagacuucucaguggauuu

SEQ ID NO: 336664 - RNA, 62 nt, Human
aguccucccauauuuuaaaagguguccaaaauuccauacacaagggaaagugaucuagccuu

SEQ ID NO: 336665 - RNA, 62 nt, Human
agcaccucccaucccauggauacaguggagauuccauacaggccuuacuuagcuccuugcga

SEQ ID NO: 336666 - RNA, 64 nt, Human; identical to SEQ ID NO: 299355

SEQ ID NO: 336667 - RNA, 64 nt, Human; identical to SEQ ID NO: 299356

SEQ ID NO: 336668 - RNA, 64 nt, Human; identical to SEQ ID NO: 299357

SEQ ID NO: 336669 - RNA, 64 nt, Human; identical to SEQ ID NO: 299358

SEQ ID NO: 336670 - RNA, 64 nt, Human; identical to SEQ ID NO: 299359

SEQ ID NO: 336671 - RNA, 64 nt, Human; identical to SEQ ID NO: 299360

SEQ ID NO: 336672 - RNA, 64 nt, Human; identical to SEQ ID NO: 299365

SEQ ID NO: 336673 - RNA, 64 nt, Human; identical to SEQ ID NO: 299366

SEQ ID NO: 336674 - RNA, 64 nt, Human; identical to SEQ ID NO: 299367

SEQ ID NO: 336675 - RNA, 64 nt, Human; identical to SEQ ID NO: 299368

SEQ ID NO: 336676 - RNA, 64 nt, Human; identical to SEQ ID NO: 299369

SEQ ID NO: 336677 - RNA, 64 nt, Human; identical to SEQ ID NO: 299370

SEQ ID NO: 336678 - RNA, 64 nt, Human; identical to SEQ ID NO: 299371

SEQ ID NO: 336679 - RNA, 64 nt, Human; identical to SEQ ID NO: 299372

SEQ ID NO: 336680 - RNA, 64 nt, Human; identical to SEQ ID NO: 299373

SEQ ID NO: 336681 - RNA, 64 nt, Human; identical to SEQ ID NO: 299374

SEQ ID NO: 336682 - RNA, 62 nt, Human
ugaacuuaucuaccugguuaugauacuguggguccauacacaaguaaaauaagauuagacag

SEQ ID NO: 336683 - RNA, 62 nt, Human
auguauauauauauaguaacuacuuuuuauacuccauacauaacuugauauagaaagcuguu

SEQ ID NO: 336684 - RNA, 62 nt, Human
gagcaaguggaguagcagaaccaggagccucuuccauacaugaggugaggguugggggacau

SEQ ID NO: 336685 - RNA, 62 nt, Human
cuuuuuaccaagucuguguucuguuuaaucuguccauacaaguuauuacugagaaaguguuu

SEQ ID NO: 336686 - RNA, 64 nt, Human; identical to SEQ ID NO: 299355

SEQ ID NO: 336687 - RNA, 64 nt, Human; identical to SEQ ID NO: 299376

SEQ ID NO: 336688 - RNA, 64 nt, Human; identical to SEQ ID NO: 299377

SEQ ID NO: 336689 - RNA, 64 nt, Human; identical to SEQ ID NO: 299378

SEQ ID NO: 336690 - RNA, 64 nt, Human; identical to SEQ ID NO: 299379

SEQ ID NO: 336691 - RNA, 64 nt, Human; identical to SEQ ID NO: 299384

SEQ ID NO: 336692 - RNA, 64 nt, Human; identical to SEQ ID NO: 299385

SEQ ID NO: 336693 - RNA, 64 nt, Human; identical to SEQ ID NO: 299386

SEQ ID NO: 336694 - RNA, 64 nt, Human; identical to SEQ ID NO: 299387

SEQ ID NO: 336695 - RNA, 64 nt, Human; identical to SEQ ID NO: 299388

SEQ ID NO: 336696 - RNA, 64 nt, Human; identical to SEQ ID NO: 299389

SEQ ID NO: 336697 - RNA, 64 nt, Human; identical to SEQ ID NO: 299390

SEQ ID NO: 336698 - RNA, 64 nt, Human; identical to SEQ ID NO: 299391

SEQ ID NO: 336699 - RNA, 64 nt, Human; identical to SEQ ID NO: 299392

SEQ ID NO: 336700 - RNA, 64 nt, Human; identical to SEQ ID NO: 299393

SEQ ID NO: 336701 - RNA, 64 nt, Human; identical to SEQ ID NO: 299394

SEQ ID NO: 336702 - RNA, 62 nt, Human
acaagugguuuaacaugcauuaucuuacucaauccauacaaaagucuuauggagguguuagc

SEQ ID NO: 336703 - RNA, 62 nt, Human
ucccaauauacaguaaguacgugagccagucauccauacacuaaggccuaguugagaaaaac

SEQ ID NO: 336704 - RNA, 62 nt, Human
guguuuugccuccuguucuaauuaauuuugucuccauacauaucugaaccccaaguguguac

SEQ ID NO: 336705 - RNA, 62 nt, Human
ggucaguguccauccaguuuacgcugagucaguccauacagcaagacaccuggcacuuggca

SEQ ID NO: 336706 - RNA, 64 nt, Human; identical to SEQ ID NO: 299395

SEQ ID NO: 336707 - RNA, 64 nt, Human; identical to SEQ ID NO: 299396

SEQ ID NO: 336708 - RNA, 64 nt, Human; identical to SEQ ID NO: 299397

SEQ ID NO: 336709 - RNA, 64 nt, Human; identical to SEQ ID NO: 299398

SEQ ID NO: 336710 - RNA, 64 nt, Human; identical to SEQ ID NO: 299403

SEQ ID NO: 336711 - RNA, 64 nt, Human; identical to SEQ ID NO: 299404

SEQ ID NO: 336712 - RNA, 64 nt, Human; identical to SEQ ID NO: 299405

SEQ ID NO: 336713 - RNA, 64 nt, Human; identical to SEQ ID NO: 299406

SEQ ID NO: 336714 - RNA, 64 nt, Human; identical to SEQ ID NO: 299407

SEQ ID NO: 336715 - RNA, 64 nt, Human; identical to SEQ ID NO: 299408

SEQ ID NO: 336716 - RNA, 56 nt, Human; identical to SEQ ID NO: 299409

SEQ ID NO: 336717 - RNA, 64 nt, Human; identical to SEQ ID NO: 299410

SEQ ID NO: 336718 - RNA, 64 nt, Human; identical to SEQ ID NO: 299411

SEQ ID NO: 336719 - RNA, 64 nt, Human; identical to SEQ ID NO: 299412

SEQ ID NO: 336720 - RNA, 64 nt, Human; identical to SEQ ID NO: 299413

SEQ ID NO: 336721 - RNA, 64 nt, Human; identical to SEQ ID NO: 299414

SEQ ID NO: 336722 - RNA, 62 nt, Human
uaaacaguaaguccuaagcuuugauggaaggguccauacauuuuuuuuuuuuuuuugcugau

SEQ ID NO: 336723 - RNA, 62 nt, Human
uugaggccaaugcugcuuucugguguauauucuccauacaagauuauuauuaacugcucuuu

SEQ ID NO: 336724 - RNA, 62 nt, Human
ugacaagaacuauacuugcaacucuuuuugaauccauacaggucgucuggccaaugauucuu

SEQ ID NO: 336725 - RNA, 62 nt, Human
uggggguucccacacucgugcauacacacacauccauacacucugacaaucuccacgcuagu

SEQ ID NO: 336726 - RNA, 64 nt, Human; identical to SEQ ID NO: 299415

SEQ ID NO: 336727 - RNA, 64 nt, Human; identical to SEQ ID NO: 299416

SEQ ID NO: 336728 - RNA, 64 nt, Human; identical to SEQ ID NO: 299417

SEQ ID NO: 336729 - RNA, 64 nt, Human; identical to SEQ ID NO: 299422

SEQ ID NO: 336730 - RNA, 64 nt, Human; identical to SEQ ID NO: 299423

SEQ ID NO: 336731 - RNA, 64 nt, Human; identical to SEQ ID NO: 299424

SEQ ID NO: 336732 - RNA, 64 nt, Human; identical to SEQ ID NO: 299425

SEQ ID NO: 336733 - RNA, 64 nt, Human; identical to SEQ ID NO: 299426

SEQ ID NO: 336734 - RNA, 64 nt, Human; identical to SEQ ID NO: 299427

SEQ ID NO: 336735 - RNA, 64 nt, Human; identical to SEQ ID NO: 299428

SEQ ID NO: 336736 - RNA, 64 nt, Human; identical to SEQ ID NO: 299429

SEQ ID NO: 336737 - RNA, 64 nt, Human; identical to SEQ ID NO: 299430

SEQ ID NO: 336738 - RNA, 64 nt, Human; identical to SEQ ID NO: 299431

SEQ ID NO: 336739 - RNA, 64 nt, Human; identical to SEQ ID NO: 299432

SEQ ID NO: 336740 - RNA, 64 nt, Human; identical to SEQ ID NO: 299433

SEQ ID NO: 336741 - RNA, 64 nt, Human; identical to SEQ ID NO: 299434

SEQ ID NO: 336742 - RNA, 62 nt, Human
uucagaagagcaagcacaaaguaauuuagcuuuccauacauuuuuagagucagagauaacuu

SEQ ID NO: 336743 - RNA, 62 nt, Human
uugacacugaaaguuuuguaaaagaaaucauguccauacacuuuguugcaagaugugaauua

SEQ ID NO: 336744 - RNA, 62 nt, Human
aaucggggaugcagacaaguggcuacaaacuuuccauacaacaggugaagauaacgagacuu

SEQ ID NO: 336745 - RNA, 62 nt, Human
aggcugugcuccgccauggugucccgguaccuuccauacacagaggagugcagccuucucca

SEQ ID NO: 336746 - RNA, 64 nt, Human; identical to SEQ ID NO: 299435

SEQ ID NO: 336747 - RNA, 64 nt, Human; identical to SEQ ID NO: 299436

SEQ ID NO: 336748 - RNA, 64 nt, Human; identical to SEQ ID NO: 299441

SEQ ID NO: 336749 - RNA, 64 nt, Human; identical to SEQ ID NO: 299442

SEQ ID NO: 336750 - RNA, 64 nt, Human; identical to SEQ ID NO: 299443

SEQ ID NO: 336751 - RNA, 64 nt, Human; identical to SEQ ID NO: 299444

SEQ ID NO: 336752 - RNA, 64 nt, Human; identical to SEQ ID NO: 299445

SEQ ID NO: 336753 - RNA, 64 nt, Human; identical to SEQ ID NO: 299446

SEQ ID NO: 336754 - RNA, 64 nt, Human; identical to SEQ ID NO: 299447

SEQ ID NO: 336755 - RNA, 64 nt, Human; identical to SEQ ID NO: 299448

SEQ ID NO: 336756 - RNA, 64 nt, Human; identical to SEQ ID NO: 299449

SEQ ID NO: 336757 - RNA, 64 nt, Human; identical to SEQ ID NO: 299450

SEQ ID NO: 336758 - RNA, 64 nt, Human; identical to SEQ ID NO: 299451

SEQ ID NO: 336759 - RNA, 64 nt, Human; identical to SEQ ID NO: 299452

SEQ ID NO: 336760 - RNA, 64 nt, Human; identical to SEQ ID NO: 299453

SEQ ID NO: 336761 - RNA, 64 nt, Human; identical to SEQ ID NO: 299454

SEQ ID NO: 336762 - RNA, 62 nt, Human
agguguuugccaugugguaccuacauagaaucuccauacaacacacagguaacagguuauac

SEQ ID NO: 336763 - RNA, 62 nt, Human
ucagaagacagcucaggccaaguuuugaucguuccauacaguaccuuguuuaucugcuucuu

SEQ ID NO: 336764 - RNA, 62 nt, Human
cuuucccaaauccuguuugguuaauuguagccuccauacaguggggucuucucuguggcugg

SEQ ID NO: 336765 - RNA, 62 nt, Human
aaaucuuccucgucaguggucaaggugugucauccauacagcuccaugccuuugucuuuuuu

SEQ ID NO: 336766 - RNA, 64 nt, Human; identical to SEQ ID NO: 299455

SEQ ID NO: 336767 - RNA, 64 nt, Human; identical to SEQ ID NO: 299460

SEQ ID NO: 336768 - RNA, 64 nt, Human; identical to SEQ ID NO: 299461

SEQ ID NO: 336769 - RNA, 64 nt, Human; identical to SEQ ID NO: 299462

SEQ ID NO: 336770 - RNA, 64 nt, Human; identical to SEQ ID NO: 299463

SEQ ID NO: 336771 - RNA, 64 nt, Human; identical to SEQ ID NO: 299464

SEQ ID NO: 336772 - RNA, 64 nt, Human; identical to SEQ ID NO: 299465

SEQ ID NO: 336773 - RNA, 64 nt, Human; identical to SEQ ID NO: 299466

SEQ ID NO: 336774 - RNA, 64 nt, Human; identical to SEQ ID NO: 299467

SEQ ID NO: 336775 - RNA, 64 nt, Human; identical to SEQ ID NO: 299468

SEQ ID NO: 336776 - RNA, 64 nt, Human; identical to SEQ ID NO: 299469

SEQ ID NO: 336777 - RNA, 64 nt, Human; identical to SEQ ID NO: 299470

SEQ ID NO: 336778 - RNA, 64 nt, Human; identical to SEQ ID NO: 299471

SEQ ID NO: 336779 - RNA, 64 nt, Human; identical to SEQ ID NO: 299472

SEQ ID NO: 336780 - RNA, 64 nt, Human; identical to SEQ ID NO: 299473

SEQ ID NO: 336781 - RNA, 54 nt, Human; identical to SEQ ID NO: 299474

SEQ ID NO: 336782 - RNA, 62 nt, Human
uuacuguaagaaaauaucacuugucaauaaaauccauacauuugugugaaacuuuguuguuu

SEQ ID NO: 336783 - RNA, 62 nt, Human
acagaaagucugccuguuuaguaaguggcaauuccauacauauuuuagaguuuuuucuaucu

SEQ ID NO: 336784 - RNA, 62 nt, Human
uacagaauaauagagcagauaauauauagaguuccauacacccacugcaccccauacccuca

SEQ ID NO: 336785 - RNA, 62 nt, Human
cgcuuccauuugaugcauuugaugugagugaauccauacauuugaaugucauuguccuugag

SEQ ID NO: 336786 - RNA, 64 nt, Human; identical to SEQ ID NO: 299479

SEQ ID NO: 336787 - RNA, 64 nt, Human; identical to SEQ ID NO: 299480

SEQ ID NO: 336788 - RNA, 64 nt, Human; identical to SEQ ID NO: 299481

SEQ ID NO: 336789 - RNA, 64 nt, Human; identical to SEQ ID NO: 299482

SEQ ID NO: 336790 - RNA, 64 nt, Human; identical to SEQ ID NO: 299483

SEQ ID NO: 336791 - RNA, 64 nt, Human; identical to SEQ ID NO: 299484

SEQ ID NO: 336792 - RNA, 64 nt, Human; identical to SEQ ID NO: 299485

SEQ ID NO: 336793 - RNA, 64 nt, Human; identical to SEQ ID NO: 299486

SEQ ID NO: 336794 - RNA, 64 nt, Human; identical to SEQ ID NO: 299487

SEQ ID NO: 336795 - RNA, 64 nt, Human; identical to SEQ ID NO: 299488

SEQ ID NO: 336796 - RNA, 64 nt, Human; identical to SEQ ID NO: 299489

SEQ ID NO: 336797 - RNA, 64 nt, Human; identical to SEQ ID NO: 299490

SEQ ID NO: 336798 - RNA, 64 nt, Human; identical to SEQ ID NO: 299491

SEQ ID NO: 336799 - RNA, 64 nt, Human; identical to SEQ ID NO: 299492

SEQ ID NO: 336800 - RNA, 64 nt, Human; identical to SEQ ID NO: 299493

SEQ ID NO: 336801 - RNA, 64 nt, Human; identical to SEQ ID NO: 299498

SEQ ID NO: 336802 - RNA, 62 nt, Human
cacagaugaauuaagacaugaaguguguucuguccauacaauggaauauuauuuggccauaa

SEQ ID NO: 336803 - RNA, 62 nt, Human
caaaugaaggacaagcauacuacauaauauaauccauacaauucucuucaguuaguguaaac

SEQ ID NO: 336804 - RNA, 62 nt, Human
ggcagggcuuggacccccgucuccauggcagguccauacagcauggguggcaggguuuggac

SEQ ID NO: 336805 - RNA, 62 nt, Human
ugguaaauauaaaacuccagagguuguucuacuccauacaguucacacugauugugacacau

SEQ ID NO: 336806 - RNA, 64 nt, Human; identical to SEQ ID NO: 299499

SEQ ID NO: 336807 - RNA, 64 nt, Human; identical to SEQ ID NO: 299500

SEQ ID NO: 336808 - RNA, 64 nt, Human; identical to SEQ ID NO: 299501

SEQ ID NO: 336809 - RNA, 64 nt, Human; identical to SEQ ID NO: 299502

SEQ ID NO: 336810 - RNA, 64 nt, Human; identical to SEQ ID NO: 299503

SEQ ID NO: 336811 - RNA, 64 nt, Human; identical to SEQ ID NO: 299504

SEQ ID NO: 336812 - RNA, 64 nt, Human; identical to SEQ ID NO: 299505

SEQ ID NO: 336813 - RNA, 51 nt, Human; identical to SEQ ID NO: 299506

SEQ ID NO: 336814 - RNA, 64 nt, Human; identical to SEQ ID NO: 299507

SEQ ID NO: 336815 - RNA, 64 nt, Human; identical to SEQ ID NO: 299508

SEQ ID NO: 336816 - RNA, 64 nt, Human; identical to SEQ ID NO: 299509

SEQ ID NO: 336817 - RNA, 64 nt, Human; identical to SEQ ID NO: 299510

SEQ ID NO: 336818 - RNA, 64 nt, Human; identical to SEQ ID NO: 299511

SEQ ID NO: 336819 - RNA, 64 nt, Human; identical to SEQ ID NO: 299512

SEQ ID NO: 336820 - RNA, 64 nt, Human; identical to SEQ ID NO: 299517

SEQ ID NO: 336821 - RNA, 62 nt, Human
acccccaagccacuauccacuuugaauccugcuccauacauuggguguauauuuauucugaa

SEQ ID NO: 336822 - RNA, 62 nt, Human
ggaccaaaggcugaggcuuggccaucuagcauuccauacaaaauuguuuccuauaagcauuc

SEQ ID NO: 336823 - RNA, 62 nt, Human
uugaaaaucaagaugagauauauagauauauauccauacauuuuauugucagaauuuagacu

SEQ ID NO: 336824 - RNA, 62 nt, Human
uuguccuuucagaaaacaugcaaauaccaagauccauacaaaacaauaauuuauuccacuga

SEQ ID NO: 336825 - RNA, 62 nt, Human
guccauaagccauccagaucaacacccuuucuuccauacagaaaagggcuaaccauaccaca

SEQ ID NO: 336826 - RNA, 64 nt, Human
gaauauuuggcuuuaagaaugauucuuauacucugaaggugagaauauuuugugggcagguauc

SEQ ID NO: 336827 - RNA, 64 nt, Human
gagacaaaagcaguuucucuccaacucccucugggaaggugaccuggccagagccaagaaacac

SEQ ID NO: 336828 - RNA, 64 nt, Human
caaaagaaaaaaauauacuaccucagauuuucaagaaggugaacuaaauauucggucugcccgu

SEQ ID NO: 336829 - RNA, 64 nt, Human
gggucaaaauggggagauguacuggguaugaguggaaggugauggagagccugauccugaagcc

SEQ ID NO: 336830 - RNA, 64 nt, Human
gcugcccuuggcuucagcaugagccuugguagcagaaggugaggaaccuccucugcccuggucc

SEQ ID NO: 336831 - RNA, 64 nt, Human
gaguuggugcaaauucuuguguguguuugcauaggaaggugagaugaccaucuacuaaagagga

SEQ ID NO: 336832 - RNA, 64 nt, Human
ccauggcagucaguggcagcagaaagaggcagcagaaggugaagagguuauagguggucucuug

SEQ ID NO: 336833 - RNA, 64 nt, Human
ucucuuucuccuucaaacuugcucugcagcuaaggaaggugagucuacuuucccugaggcuuug

SEQ ID NO: 336834 - RNA, 64 nt, Human
uuaaccauacagaaugauauaacuccugugcaaugaaggugauaacaguaaaagaaggcagggg

SEQ ID NO: 336835 - RNA, 64 nt, Human
aucauuaucaugauuuaaaggaaauaguacuagagaaggugaauuauuaucauuuuccugugaa

SEQ ID NO: 336836 - RNA, 64 nt, Human
caguggacagggagaccucacagagaaaggccuggaaggugauuucccgugugacucauggaua

SEQ ID NO: 336837 - RNA, 64 nt, Human
aggaggcacugcugaauggcuauggccuggcuaagaaggugauuagucaguagggugugaaaau

SEQ ID NO: 336838 - RNA, 64 nt, Human
gucucagauuaaugagcacuuggacuggugccuugaaggugacagcaucaaagucaaaagcgaa

SEQ ID NO: 336839 - RNA, 64 nt, Human
ugucugcagggcuguuagccgggccacccccucugaaggugaaacugagcagguuagacccagc

SEQ ID NO: 336840 - RNA, 64 nt, Human
aauagaguauauagguuuuguaccuuuuuuacaggaaggugacuuucuguaacaaugcgaugua

SEQ ID NO: 336841 - RNA, 64 nt, Human
uuucagacccuauccugagaaugggguuugaaaggaaggugagggcuguggccccuggacgggu

SEQ ID NO: 336842 - RNA, 64 nt, Human
uggacaaacccccauuguggcuccugccacccuggcagaugacucacuguggggggguggcugu

SEQ ID NO: 336843 - RNA, 64 nt, Human
ugcuuugugagagccgcuacaaugagagcgacaagcagaugaagaaauucaaaggauugaagag

SEQ ID NO: 336844 - RNA, 64 nt, Human
ucugacucucucugugugaacaggaaacuuuagggcagaugaggagaaugaauugguuaucaga

SEQ ID NO: 336845 - RNA, 64 nt, Human
cuagaaggagcagagagcauuugaggagguagaagaaggugacaugauggacagguucaccuuc

SEQ ID NO: 336846 - RNA, 64 nt, Human
guucaggauaugaacacagguacagucauucuuugaaggugacacuguucuguauauucccuau

SEQ ID NO: 336847 - RNA, 64 nt, Human
guagaauuccagauuacaaucgccauaauauaaggaaggugagcuccucaacaauaacuuugca

SEQ ID NO: 336848 - RNA, 64 nt, Human
aagcugaaggcauuugaggaaauugcagaagcaggaaggugacucugaccuucugccugcuguu

SEQ ID NO: 336849 - RNA, 64 nt, Human
aguuuggugugucccaauuuuugguauuguggcagaaggugaaggcucugaaagcaaagaugca

SEQ ID NO: 336850 - RNA, 64 nt, Human
cugaagcagcaaucgaaucccuuucucacuuuuggaaggugacuuuucaccuuaaugcauauuc

SEQ ID NO: 336851 - RNA, 64 nt, Human
ccuuuccugugccaaccugaugccccuuccccaagaaggugagugcuugucauggaaaaugucc

SEQ ID NO: 336852 - RNA, 64 nt, Human
cccagucucucuguugagccugcuugugucaggugaaggugagggaucgggagugauggagaug

SEQ ID NO: 336853 - RNA, 64 nt, Human
ggacuccaucaauccaagaaagaguugcuuuguggaaggugaaggaagacccacagagugcuca

SEQ ID NO: 336854 - RNA, 64 nt, Human
ucuuuuuauauuagcuccucacugcuacagccuagaaggugagaagcagauuuuaaccccaucu

SEQ ID NO: 336855 - RNA, 64 nt, Human
uuccauauacuagccuccuuggaagaagugaucagaaggugauaagaaggacagaaaggacuau

SEQ ID NO: 336856 - RNA, 64 nt, Human
agaggaggacuguagggugagagggaaagaaaaugaaggugacuuucauggaaguuucauuucu

SEQ ID NO: 336857 - RNA, 64 nt, Human
uguugugccauugaguucccauguggaucauucugaaggugaucuccacaagagggugugugug

SEQ ID NO: 336858 - RNA, 64 nt, Human
uaaaaugagaaauacauaagaugauaaauaaaaugaaggugaagguauuccagaucuaccgaaa

SEQ ID NO: 336859 - RNA, 64 nt, Human
uccauguggcuggggaggccucacaaucaugguggaaggugaaaggcacgucuuacauggcggu

SEQ ID NO: 336860 - RNA, 64 nt, Human
ccuuuaacauagccagaaacaagcccugugguuugaaggugagcugugaggaugggacuaauug

SEQ ID NO: 336861 - RNA, 53 nt, Human
uugcaggauuccugagcugaaaugcagaugaccacauucaaggaagaacuuuc

SEQ ID NO: 336862 - RNA, 64 nt, Human
auguucugggauaacauuuggaggaaggugggaagcagaugacugaggaagggauggacuaagc

SEQ ID NO: 336863 - RNA, 64 nt, Human
ucauuccuaaaacacccuucagcaaugauaaugagcagaugagaguuucuggauuagcuuuucc

SEQ ID NO: 336864 - RNA, 64 nt, Human
aauuuccccauaaauaaaugaauggaguuugcaggaaggugagggugagcagagaugugugugg

SEQ ID NO: 336865 - RNA, 64 nt, Human
gucucauggagaccaguaagaaaaucauuuaucugaaggugaaaugcagaguuggauaagaaau

SEQ ID NO: 336866 - RNA, 64 nt, Human
gcuuuaauuuaauggcccuacugauauucacaucgaaggugacuaacaaugacaaaggccuuau

SEQ ID NO: 336867 - RNA, 55 nt, Human
cacccauucaggaaaccugaacagggaaggugaaccccuguccugaccaaaauug

SEQ ID NO: 336868 - RNA, 64 nt, Human
aaucuaauuuuguauaaauaaaaacaggcuccuggaaggugaaaaguagucauuuguucuaaau

SEQ ID NO: 336869 - RNA, 64 nt, Human
aguucuuaauuauaggacauauuuucucaaagcugaaggugacaccuagaaccaggggcuugac

SEQ ID NO: 336870 - RNA, 64 nt, Human
acggaaagugcugucuuaaacuaaaugugcaauagaaggugauguugccauccuaccgucuuuu

SEQ ID NO: 336871 - RNA, 64 nt, Human
uuacaacucuggugacuucugaugucuuagaaaggaaggugaauauagucaaagcguggcauug

SEQ ID NO: 336872 - RNA, 64 nt, Human
auuuguagggccggagggaugguagugauggggagaaggugaggaagggucacccucugucacc

SEQ ID NO: 336873 - RNA, 64 nt, Human
cgguuguuggaccucuuucacucccugcguguaagaaggugaaucacgugggaaaaaguggcuu

SEQ ID NO: 336874 - RNA, 64 nt, Human
acaugaguccucaggggcccugcacauucaaucugaaggugacccuggccuggcugaagcugga

SEQ ID NO: 336875 - RNA, 64 nt, Human
ugguuuggcccuucuccuuuugaaaagguaaggugaaggugaaucuagcuuauuuugaggcuuu

SEQ ID NO: 336876 - RNA, 64 nt, Human
agagacaaguaauuucaguguaaagugugugauugaaggugauaagggaaaagauaaagaccag

SEQ ID NO: 336877 - RNA, 64 nt, Human
gcauauuggaaucccaucuacccauaguuccucugaaggugauuuuguaauuugcaaaagggua

SEQ ID NO: 336878 - RNA, 64 nt, Human
gccuauuucauucagcacaagacauacgauuuuagaaggugaggggaggggaggcuuuuucuac

SEQ ID NO: 336879 - RNA, 64 nt, Human
uccgcguggcuggggaggcuucacaaucauggcggaaggugaaaggcaugucuuacguggaggg

SEQ ID NO: 336880 - RNA, 64 nt, Human
gugaggauggaccucaaaaguuugauccccucgugcagaugaagaagcugaagcccagaguggg

SEQ ID NO: 336881 - RNA, 64 nt, Human
cugcuggcucccuuacuuuaccucucugucaugugcagaugaaggcucagggugcuagaggauu

SEQ ID NO: 336882 - RNA, 64 nt, Human
uggaggugaugagaaagguggugggagaaagucagcagaugagagacacaaagagaagugguaa

SEQ ID NO: 336883 - RNA, 64 nt, Human
gugguggcacgcaucuguaguuccagcuauacaggaaggugaggcagaagcauugcuugagcuu

SEQ ID NO: 336884 - RNA, 64 nt, Human
uagaaaugagcuuaauccaggccgcagagccagggaaggugaguaacuuuaggagggugcuaga

SEQ ID NO: 336885 - RNA, 64 nt, Human
ggaaagaauaaccaacacccugagguuguguguggaaggugaucuggcucuggacaggcacuau

SEQ ID NO: 336886 - RNA, 64 nt, Human
uuuccuucugcuaacccagggaggguccuaagaggaaggugacuucucucuguuugucuuaagu

SEQ ID NO: 336887 - RNA, 64 nt, Human
gcugauaccaacuuuugguaggaaggaaaacagggaaggugauugcugcuauucuggaaugugu

SEQ ID NO: 336888 - RNA, 64 nt, Human
gaacacauacauauauguucacuuauuuguggcagaaggugaucagauaagcuccagcccaaau

SEQ ID NO: 336889 - RNA, 64 nt, Human
ucccaacccagagugucccugugggaggcaggcagaaggugacaauugacacgauuuccugcac

SEQ ID NO: 336890 - RNA, 64 nt, Human
ugggaugcuccccuacagccuuacagguagaauagaaggugaguucuggaagugcaaagaagca

SEQ ID NO: 336891 - RNA, 64 nt, Human
uaaaaaugacucccauccauccucugacaaggaagaaggugaggccacauccgauucugaauca

SEQ ID NO: 336892 - RNA, 64 nt, Human
agugugccucuguaguguggccuggugcuggggugaaggugagcugggcaaaggagaaauauga

SEQ ID NO: 336893 - RNA, 64 nt, Human
guggccguggguuccugaugucggugcaggagcugaaggugaguggagugcugccaagaauaug

SEQ ID NO: 336894 - RNA, 64 nt, Human
ugaauacuuuuacguuggaauccuccuucuagcugaaggugauugaaaaggaaaagagugagug

SEQ ID NO: 336895 - RNA, 64 nt, Human
cuggggaggccuccggaagcuuauagucaugacagaaggugaagggggagcaggcacaucacau

SEQ ID NO: 336896 - RNA, 64 nt, Human
aaacuaucacaggaagaaauaaaaacagauuuuugaaggugagaugauaaacuugcaaaacuca

SEQ ID NO: 336897 - RNA, 64 nt, Human
cuucguuaacuucaaaaggaacugguagaguucagaaggugagcuguuguuuuucuaaaccucu

SEQ ID NO: 336898 - RNA, 64 nt, Human
ccagauuuccagcgugaagcaggcccaagcuagggaaggugagaagcuuuaaccuuaaauuuuc

SEQ ID NO: 336899 - RNA, 64 nt, Human
gagauaguagcagacaggcugcccaagguaugaagcagaugagggaccagcacucagucuaaca

SEQ ID NO: 336900 - RNA, 64 nt, Human
aguaugucauauuacugaggcuacaaguuagucagcagaugagugccaguccagccuuuucugg

SEQ ID NO: 336901 - RNA, 64 nt, Human
aggcaaauuguaaguugaaauucuagauaagcaugcagaugacuuacaauauaaaugaagaaua

SEQ ID NO: 336902 - RNA, 64 nt, Human
cgucuccagcagagaaagugaacagcauuuguuggaaggugauggcucucccuccucccucccc

SEQ ID NO: 336903 - RNA, 64 nt, Human
acacaagcuggcagauacauuugacucuacagaugaaggugaacaauguuagaauaaaauugcu

SEQ ID NO: 336904 - RNA, 64 nt, Human
uuugaagcuuuugugauugaaaagacccuaucaagaaggugaaaagauaaccugcagaauggga

SEQ ID NO: 336905 - RNA, 64 nt, Human
aagauauucucacuuagucaacuccugucaaaaugaaggugaacuggcauggcccgaucacugu

SEQ ID NO: 336906 - RNA, 64 nt, Human
uuuagauagucuggucagggagggccucaacugagaaggugaaaugugagcaaagacgugaagg

SEQ ID NO: 336907 - RNA, 64 nt, Human
aaauguaugaucccaaucucaucuuucgcaugcagaaggugaguagcuccccgaggcacccucc

SEQ ID NO: 336908 - RNA, 64 nt, Human
aggugccuguagugacugacaagcagaguuaguggaaggugacucccagucuccugguggcucu

SEQ ID NO: 336909 - RNA, 64 nt, Human
ccccugcuugaauugauuccgaaggguagggugggaaggugagcaaagggagcagaaacaaggg

SEQ ID NO: 336910 - RNA, 64 nt, Human
aagcccaaacuugguuucugugagaauaguggaggaaggugagauggccaguuugaagccugug

SEQ ID NO: 336911 - RNA, 64 nt, Human
ucugucauauaguugugggaucucuaccaagugugaaggugaaugagguaagggagaucagaac

SEQ ID NO: 336912 - RNA, 64 nt, Human
cuuaucuaaauaugaauguggccacaaagcuguggaaggugacaaagcuuaaacaccuuugccc

SEQ ID NO: 336913 - RNA, 64 nt, Human
cugcacagcagagcucauuguggaaacgauggaggaaggugaaggggaaggggaagaggaagaa

SEQ ID NO: 336914 - RNA, 64 nt, Human
aaggaaugccaggucucgcacagcuuggccucgagaaggugagaggaaggcaaaggccagggag

SEQ ID NO: 336915 - RNA, 64 nt, Human
caggcuuuaaaugucaccugcuaccuuagagugugaaggugaugguaacugccacagcaaaggc

SEQ ID NO: 336916 - RNA, 64 nt, Human
ggaaaaaaaauaagauaucaacugccagccuggagaaggugacaguccaagugugcaacagcug

SEQ ID NO: 336917 - RNA, 64 nt, Human
uaaggcgccauugcuuuugggagacuggaaaagggaaggugacugaaggcugucaggauucuuc

SEQ ID NO: 336918 - RNA, 64 nt, Human
aucauaauguaaauaauaauuuguauauuguguugcagaugaaaguauuccaggaacagugaau

SEQ ID NO: 336919 - RNA, 64 nt, Human
cuugugccaaccagauuuacagauuggaaauacugcagaugaugugaaguuaucaguuggagga

SEQ ID NO: 336920 - RNA, 64 nt, Human
uauuuuggauuauucaaguguaugugguaaaaaugcagaugauugcugcuuuaccccaggguuu

SEQ ID NO: 336921 - RNA, 64 nt, Human
auuucucaaaggaagcaggggauucagugagugugaaggugaacaggauggccuggcagcaggg

SEQ ID NO: 336922 - RNA, 64 nt, Human
uggagauagauggauaagggaauaauaggccacagaaggugaacuuugugcuucaaggacauug

SEQ ID NO: 336923 - RNA, 64 nt, Human
ucauauuucuuuauuauuguaaaugggggcuguggaaggugagaaaacacaugcuuucuuaaaa

SEQ ID NO: 336924 - RNA, 64 nt, Human
cuuuaguuaauucaaccuuauagaucauacuuaugaaggugauaacugacacguguucacugaa

SEQ ID NO: 336925 - RNA, 64 nt, Human
uugaucucuuuuuaaggagaggcacuuuccaacugaaggugauugauguagggaaauguuugua

SEQ ID NO: 336926 - RNA, 64 nt, Human
uccuccaugaaacuuacgcaguaaucacuaccuggaaggugaguuuugaucucuuuuuaaggag

SEQ ID NO: 336927 - RNA, 64 nt, Human
uaaucaaaacuauauauuuguuaaaaauuugggagaaggugaugguaauuucauuagucccaaa

SEQ ID NO: 336928 - RNA, 64 nt, Human
auuacuucucaguauuaccaaaccuaaacugguugaaggugaaagugugcuauggccuuuucaa

SEQ ID NO: 336929 - RNA, 64 nt, Human
caggcccauaucuuaucuaggauguugguggcaagaaggugaagauuacuaccucuuuugauau

SEQ ID NO: 336930 - RNA, 64 nt, Human
accucgguuucagugcaccauguguuugcuuugugaaggugaagaauauguugguuuagagaaa

SEQ ID NO: 336931 - RNA, 64 nt, Human
ccccaggauagcuaaguguuauguaauaugccuagaaggugaugugaaugcgauucagaagcau

SEQ ID NO: 336932 - RNA, 64 nt, Human
gaccacugucagaaaugggauauuagucuagagagaaggugaucuauucccacaugucauuucu

SEQ ID NO: 336933 - RNA, 64 nt, Human
auaccuggcuuuuacuuuauuaauaugaguuacugaaggugauggagguauuugaaaauuuuac

SEQ ID NO: 336934 - RNA, 64 nt, Human
auaauucuuaaaagggaaauuaggaaugggauaagaaggugauuuuuuuauuauuuuuauacug

SEQ ID NO: 336935 - RNA, 64 nt, Human
uugggucaaagacagaugcuucagacuugggugggaaggugaaagauggcuauuuagaaagcug

SEQ ID NO: 336936 - RNA, 64 nt, Human
auauacacagacauccauaugcagcguuuccuuugaaggugaccaguuguuuguagcuauucuu

SEQ ID NO: 336937 - RNA, 64 nt, Human
cucccacagaccugcagugaggggcccuccaugcgcagaugaggggccacugacccaccugcgc

SEQ ID NO: 336938 - RNA, 64 nt, Human
uggauuaaagcuuugugguucaugcaaacaaugugcagaugauagcaccuccauauuacuaaua

SEQ ID NO: 336939 - RNA, 64 nt, Human
uugccacagugagacuuaaggaaauguuugguuggcagaugagcaccaaugacugcagcgugga

SEQ ID NO: 336940 - RNA, 64 nt, Human
gaccugaaucacaacgggccagcucuaguaauacgaaggugaggucugggaugcugcgugcggc

SEQ ID NO: 336941 - RNA, 64 nt, Human
aaucuguugauaaauccaucacuauaauaaaaccgaaggugaaaaaaauucugaaaaaauucua

SEQ ID NO: 336942 - RNA, 64 nt, Human
gacaugggugagcucaccccagcacugcuguugggaaggugacugcaggaaaccaauucuuaca

SEQ ID NO: 336943 - RNA, 64 nt, Human
cacccaguccucugccuccauuuaauuuuuaagagaaggugaagguaacuauuagaauauaaua

SEQ ID NO: 336944 - RNA, 64 nt, Human
uuugcuucuaguuuggggauugcgcuagcccaaugaaggugaugaagcuuuuggauuuggaggg

SEQ ID NO: 336945 - RNA, 64 nt, Human
uguguugguaaugugcaucaugacaauuuccagugaaggugagcuggagcugguuggacuaaug

SEQ ID NO: 336946 - RNA, 64 nt, Human
aagagcacccggagcugaagcugucccugaugaugaaggugaaacgucagcccuggccauggcu

SEQ ID NO: 336947 - RNA, 64 nt, Human
aaaagccaaguguccugcuugguuuagcugugcagaaggugaaauggaggaaaccacaaauuca

SEQ ID NO: 336948 - RNA, 64 nt, Human
cuaaccucccaaccugauuuccccgaaucugagggaaggugagggagugggaagggggauggag

SEQ ID NO: 336949 - RNA, 64 nt, Human
uuccuugaauuuucucuagaaaugcagaaauuaggaaggugaugggucuguaucccccugcccc

SEQ ID NO: 336950 - RNA, 64 nt, Human
ucacucaacagcucggcccagcucugaaacuugggaaggugagggauucaggggaggucagagg

SEQ ID NO: 336951 - RNA, 64 nt, Human
gggaguguggacaaaccccgcaaaucagaguggggaaggugagugguagagagggggucucuga

SEQ ID NO: 336952 - RNA, 64 nt, Human
ucucaguucauuuccugagguggauuuacugagagaaggugaaauaaagccauauuuaguauac

SEQ ID NO: 336953 - RNA, 64 nt, Human
uucaugccuauugagggccugcuuucugauuauagaaggugacuucuugcugugcccacacaug

SEQ ID NO: 336954 - RNA, 64 nt, Human
uccugggcaacucuacagucccucccuccuuucggaaggugaaggauacuggguuuuuagaugc

SEQ ID NO: 336955 - RNA, 64 nt, Human
gcccugcaacgucccaucuauacgagguguuggagaaggugaagaacccucccauucacgcccg

SEQ ID NO: 336956 - RNA, 64 nt, Human
uccgaguucuuucugagccugcuggacaugaagagcagaugaccaccaugcucugugucagcca

SEQ ID NO: 336957 - RNA, 64 nt, Human
uuaaaauaugcaaggaccauaaguuuuuccucuugcagaugaggaaaguaaaaaauaauacgaa

SEQ ID NO: 336958 - RNA, 64 nt, Human
gggaggaaugcaucaucucacuuuuuuuuuuuaagcagaugaugggauaacauggacugcucag

SEQ ID NO: 336959 - RNA, 64 nt, Human
agaugaauguguagugucagcaaaugcauguuaagaaggugaagcccaaaagcucuuaaggaga

SEQ ID NO: 336960 - RNA, 64 nt, Human
ugaucuauuuuuuuuaccuguuuaucacauuugugaaggugaaauuauucauggagugaauaag

SEQ ID NO: 336961 - RNA, 64 nt, Human
ggacaggggaaagggucugugcgugggcaaagcugaaggugaugaggaagaagagacgaacauu

SEQ ID NO: 336962 - RNA, 64 nt, Human
cagugauggucauucagcaugacugguucugggagaaggugagagacaaaaauggaaagauccu

SEQ ID NO: 336963 - RNA, 64 nt, Human
gggggcaggggaguuuggggcaacugguuggagggaaggugaaguucaaugaugcucuugauuu

SEQ ID NO: 336964 - RNA, 64 nt, Human
aagaaaaaagguuagggaagugucaacucuggaugaaggugauguguuugccucucagucuuuc

SEQ ID NO: 336965 - RNA, 64 nt, Human
cacccaguggauugggucacccggcagaccuagggaaggugaggcgagguggggaguuggcaga

SEQ ID NO: 336966 - RNA, 64 nt, Human
cguagaaaucuaucuccauaaauugagagaagaagaaggugauaaguguugaaaauuaaaugug

SEQ ID NO: 336967 - RNA, 64 nt, Human
guuaugcuuuggggcuccugaaacaccucguuuugaaggugaaucuuugguuuucucccagaag

SEQ ID NO: 336968 - RNA, 64 nt, Human
uauaaaccuuauguacaagucaguaagccuuagggaaggugaguguggguccuuccuaaucccu

SEQ ID NO: 336969 - RNA, 64 nt, Human
ugaggcagccugucacccauccuaaucugggagagaaggugacacagcugggcccagacccugg

SEQ ID NO: 336970 - RNA, 64 nt, Human
cagcagaccaaugagugagaaacugccccauuuugaaggugaggaaauugagguucuggguaua

SEQ ID NO: 336971 - RNA, 64 nt, Human
aaaaucuacuguauuuauuauaauuuacacccuugaaggugaucucuuguuuuguguuguaaau

SEQ ID NO: 336972 - RNA, 64 nt, Human
uagacaugcgccaccuccacgugagaacaagggugaaggugagggaagccccucaccuuggguc

SEQ ID NO: 336973 - RNA, 64 nt, Human
auuuauauauaguuggucuaucucugcaguccuugaaggugaaguuguguguuacuaggcugug

SEQ ID NO: 336974 - RNA, 64 nt, Human
guucacugagucagcugguucccaagcucgcacagaaggugauaaguuacuaucaaaugccagu

SEQ ID NO: 336975 - RNA, 64 nt, Human
ggcagucuuggugugagaagcuguuuccaagggugcagaugagccuuagguuccagccgccugc

SEQ ID NO: 336976 - RNA, 64 nt, Human
ggaucauuccaauugaaguugcuaugaagagguagcagaugaaucucauugaauuaguccugua

SEQ ID NO: 336977 - RNA, 64 nt, Human
cagucaugggacugcaucuuccgacuuguccacagcagaugaggacagugagaauuaaguuaga

SEQ ID NO: 336978 - RNA, 64 nt, Human
uuuggguguacucuaggggccagguugggagggggaaggugagggcuucggguggugcuauaau

SEQ ID NO: 336979 - RNA, 64 nt, Human
uuggcuugacucaggauuuaaaaacuggaacggugaaggugacagcagucgguuggagcgagca

SEQ ID NO: 336980 - RNA, 64 nt, Human
ccacuuauuaaagagcuuccacagugaagauggagaaggugaacuugcuuugaauauuccagau

SEQ ID NO: 336981 - RNA, 64 nt, Human
acaagccauagugguagguuugcccuuugguacagaaggugaguuaaagcugguggaaaaggcu

SEQ ID NO: 336982 - RNA, 64 nt, Human
ccuaggcugacuaagaaucccuaagccuagcugggaaggugaccacauccaccuuuaaacacgg

SEQ ID NO: 336983 - RNA, 64 nt, Human
aagguggucaguaaauaacaggcauuuguucacugaaggugauucaccaaaauagucuucucaa

SEQ ID NO: 336984 - RNA, 64 nt, Human
uguauccagccuuuccuugcaucaucuuccucuugaaggugaggaagugaaaacuacagaccuc

SEQ ID NO: 336985 - RNA, 64 nt, Human
caggggcccuccacauucuggccgguaacugggggaaggugauggggcgggggucccccucaac

SEQ ID NO: 336986 - RNA, 64 nt, Human
uguccaucagcacuuggucucuuaucuucagugagaaggugacccgccuucuucccaugguggc

SEQ ID NO: 336987 - RNA, 64 nt, Human
caucguacuggaguagagggccgacucuucccaugaaggugagcacagcugugagugagugagc

SEQ ID NO: 336988 - RNA, 64 nt, Human
uucgccaggguuuugggagcuccaggguucauaagaaggugaaccauuagaacagaucccuucu

SEQ ID NO: 336989 - RNA, 64 nt, Human
agcaguagggaggucagugcuucgugccucgauugaaggugaccucugccccagauagguggug

SEQ ID NO: 336990 - RNA, 64 nt, Human
guguaagccuucaaagaaaaaacauaaaaagugggaaggugaugcuguucuuauuguaaaagga

SEQ ID NO: 336991 - RNA, 64 nt, Human
aauuugccaaaauucagacaugcacuucuaaggggaaggugauuuuccaguucaaaaaaauggg

SEQ ID NO: 336992 - RNA, 64 nt, Human
uaaauaauacauuauauuucuauuuuauuaugaagaaggugaauagccauauuuguaaaaugac

SEQ ID NO: 336993 - RNA, 64 nt, Human
auugaauuagagaacaaggcauuauucuuuuagggaaggugagagcuuauuuguaucagagcuu

SEQ ID NO: 336994 - RNA, 64 nt, Human
acacauuucugcucuccuuucuccuaaguuucaugcagaugaauauaagguaauauacuauuau

SEQ ID NO: 336995 - RNA, 64 nt, Human
aucucuguagaaggaguagcugcccuuucucagggcagaugaugcuuugagaacauacuuuggc

SEQ ID NO: 336996 - RNA, 64 nt, Human
gagguagggcugccaccaaggugaagaugggaacgcagaugauccaugaguuugcccugguuuc

SEQ ID NO: 336997 - RNA, 64 nt, Human
gcugagagcagcuuugcucaaggaaauuauucacgaaggugaccacugucuuucugaccuggca

SEQ ID NO: 336998 - RNA, 64 nt, Human
agcuacuagcucuagaaaagucccaaaagcagcagaaggugaagcaggaagcacuugguuuucu

SEQ ID NO: 336999 - RNA, 63 nt, Human
aguaauaaauaaaaauguguacaugugauuaaaagaaggugaauugauauguguggugauaau

SEQ ID NO: 337000 - RNA, 64 nt, Human
ucucccuguuaggcugccacaggcccugcuucuggaaggugaacagcuccuggcugcugccgag

SEQ ID NO: 337001 - RNA, 64 nt, Human
gacuauugccaagaaggggcaagggaugagucaagaaggugagacccuucccggugggcacgug

SEQ ID NO: 337002 - RNA, 64 nt, Human
gacaugguuggggaaacaguccaaacuguucugagaaggugaacuguuacgacccaggacaauu

SEQ ID NO: 337003 - RNA, 64 nt, Human
uugaaaguuuuaguguugucugaaaugcaagagggaaggugauugguagugaguuaaaagaaaa

SEQ ID NO: 337004 - RNA, 64 nt, Human
augugcugugugaguuagaagucauucuugcugagaaggugaauagguagggauuugccuuguu

SEQ ID NO: 337005 - RNA, 64 nt, Human
cccuaacuuagggccugggcaggggaaagagaaagaaggugagagauuauacuucaugagucuu

SEQ ID NO: 337006 - RNA, 64 nt, Human
uucagaguccaaaauagcaaggaaguggugggaagaaggugagagaaaagggugggagggugag

SEQ ID NO: 337007 - RNA, 64 nt, Human
uguaauauauaaaaaucaugauauaagaauguuugaaggugaugcauguuugauuuuaguagua

SEQ ID NO: 337008 - RNA, 64 nt, Human
gaagaguguguccuggcaggaagccaccauuggagaaggugaggccaguaaccaucucauggga

SEQ ID NO: 337009 - RNA, 64 nt, Human
ugccacagggcccuuccuaccuuuggaucugugagaaggugaauacaaagcagcaggcagagua

SEQ ID NO: 337010 - RNA, 64 nt, Human
uagcucgagaaauaccacaugccagucuucccaggaaggugaccugccugaccaugaagcaaca

SEQ ID NO: 337011 - RNA, 64 nt, Human
cugaacccuagaaaaagagccaguuugcuacgaugaaggugacauuucucuggucauuuauuug

SEQ ID NO: 337012 - RNA, 64 nt, Human
auauuuuucuccuauagcaguaaguacagcauuagaaggugauuagagagucuguugaugaaac

SEQ ID NO: 337013 - RNA, 64 nt, Human
ugaauucagucccuaaauacaugaggcugggugagcagaugaaaccgguagccacugugcugau

SEQ ID NO: 337014 - RNA, 64 nt, Human
ugaacccuccuuucccacaguucuggaaggaucugcagaugauggagaacuaccuaggcuucau

SEQ ID NO: 337015 - RNA, 64 nt, Human
uccuucccuaggccugcuggcucugguuuucuaugcagaugauucauuggauugggggugagug

SEQ ID NO: 337016 - RNA, 64 nt, Human
ugaagaguguggcugugaagcuggggaagacgcagaaggugaaggugcucacgggcacggguga

SEQ ID NO: 337017 - RNA, 64 nt, Human
aaggacccuaguuccuagaggcaucuggcagcaagaaggugaggcaucagggaacgggaaucag

SEQ ID NO: 337018 - RNA, 64 nt, Human
gauggugcugagggagguggguggggccuucugggaaggugaguggagaggggcaccugccccc

SEQ ID NO: 337019 - RNA, 64 nt, Human
accagugccuuuggcauuuuccucccacaauggggaaggugacuuuggcauucuuacaaacucg

SEQ ID NO: 337020 - RNA, 64 nt, Human
caaaaggacagagaacuaaaaaauugcugcuggagaaggugaaagucgcuuugggacggaagcc

SEQ ID NO: 337021 - RNA, 64 nt, Human
guugucaguguacacaacucacauccuucauauugaaggugacucauuuuucugcacacuuuuu

SEQ ID NO: 337022 - RNA, 64 nt, Human
ugccggcauuauuaagggugggcuagguuggauggaaggugaaagggaugaacugccuuuugcu

SEQ ID NO: 337023 - RNA, 64 nt, Human
cuuugucccccauggcucugcaggaccugauggagaaggugaugguucuuaacaggagcuugga

SEQ ID NO: 337024 - RNA, 64 nt, Human
auacggugggguuuucuuuagauuuuacuugagagaaggugaguacaaagcaauuugcaguugu

SEQ ID NO: 337025 - RNA, 64 nt, Human
cuuccugggcccauaggugaagccuucuggaggagaaggugacguggcccagcguccaagggac

SEQ ID NO: 337026 - RNA, 64 nt, Human
aggggaacaaaacuugaaaaagcccuguucuucagaaggugaguggguugagggaggcaguaau

SEQ ID NO: 337027 - RNA, 64 nt, Human
ggggcucugaugaucagcccagccaguggccccggaaggugaauggccugcucucccuggcccu

SEQ ID NO: 337028 - RNA, 64 nt, Human
uaaacuuuauaaacugcuuuggguaaacugagcagaaggugauacacagaagggaaaaugugca

SEQ ID NO: 337029 - RNA, 64 nt, Human
agggagaggccaggcgcagcucacugcggccuaagaaggugaagcaacaugggaacacauccua

SEQ ID NO: 337030 - RNA, 64 nt, Human
aucacuuccucccuccucaggugccggaagcugcgaaggugacacauggcuuuucagacucagc

SEQ ID NO: 337031 - RNA, 64 nt, Human
uuuuucuuuuuuaaaaaagcugcuguuggaucuagaaggugaagaauuuuuuuauguauauaua

SEQ ID NO: 337032 - RNA, 64 nt, Human
uggagaguuagucauggaauaaagcacuguccuugcagaugaaaaaagucuccagagcagacuu

SEQ ID NO: 337033 - RNA, 64 nt, Human
aguaaugggaagaaccucccacaucucccuggcagcagaugagguggcuucacaugcacuuccc

SEQ ID NO: 337034 - RNA, 64 nt, Human
uacaagacauggagaagaaaccuuuggacacagagcagaugacaccuccuucuguuuuguagug

SEQ ID NO: 337035 - RNA, 64 nt, Human
auuuaagaaugagagucaugauguuuugauuuaugaaggugaauuuaaugcaaaaguggguaac

SEQ ID NO: 337036 - RNA, 64 nt, Human
ucacucugauccuggccccauaauguccucaguggaaggugaugggggccggugcuguggggag

SEQ ID NO: 337037 - RNA, 64 nt, Human
cuucagugcuccacgcccuccauagaccuucagagaaggugaaaccagguuaucugggaaucuu

SEQ ID NO: 337038 - RNA, 64 nt, Human
ucccuucuccaaugagggagccacagaauccugagaaggugaaugugcccuaaccugcuccucu

SEQ ID NO: 337039 - RNA, 64 nt, Human
gccaguuucaggucuggaaggggaggaagcaggggaaggugaccugaggaggcucggcuuugua

SEQ ID NO: 337040 - RNA, 64 nt, Human
uuuuuuguuuuguuuccuuuuuguuauuguugccgaaggugaguaguuuugcauuucugaugac

SEQ ID NO: 337041 - RNA, 64 nt, Human
uggggcgggcuucauagagacuugggaaugagcugaaggugaaacauuuucucccuggauuuuu

SEQ ID NO: 337042 - RNA, 64 nt, Human
cuuggcucugggccugaugggacagggguagagggaaggugagcauagcacauuuuccuagagc

SEQ ID NO: 337043 - RNA, 64 nt, Human
acccuuuggggucuccaggauccucauggaaggggaaggugagacaucugagugagcagagugu

SEQ ID NO: 337044 - RNA, 64 nt, Human
gguuccacaagcaguguuuggguguugccuuccugaaggugaccaagcuuccaaagcucguccc

SEQ ID NO: 337045 - RNA, 64 nt, Human
ucugcugugaauuuguauucccuuucaccuccuggaaggugaaguaccccuucaucccuuuguu

SEQ ID NO: 337046 - RNA, 64 nt, Human
ggaauaucucauguaauuuauugaauacuguacugaaggugaaaaccagaaugguuguauggau

SEQ ID NO: 337047 - RNA, 64 nt, Human
gaacauucuucagaaaugcaacuucuucuauuuagaaggugaccuccugacagcguucacucuc

SEQ ID NO: 337048 - RNA, 64 nt, Human
ggugggcaguccaggccgagaggccggcggcccugaaggugagugaggcccucggcagcugcag

SEQ ID NO: 337049 - RNA, 64 nt, Human
gaggggaaagaugcuuuauggaauguaagaagaugaaggugacugggauucagcgagagagagg

SEQ ID NO: 337050 - RNA, 64 nt, Human
uucugggcacuggcauuuugugaaacucucaagggaaggugaugcaggggagaaaaugugaauu

SEQ ID NO: 337051 - RNA, 64 nt, Human
uauccuggaaaaagaagaaaagagcuucuucuuugcagaugaaaauaaagguguuuuugguuaa

SEQ ID NO: 337052 - RNA, 64 nt, Human
cuuuagcagcaauggcaaauaccuggcuaccugugcagaugaucgcaccauccgcaucuggagc

SEQ ID NO: 337053 - RNA, 64 nt, Human
aaucugcaaaauggggauggggaagguucaaucagcagaugacccccaggccuuggcagcugug

SEQ ID NO: 337054 - RNA, 64 nt, Human
ggggaaagaggguggcucccaccgcaaggagacagaaggugaagacaucuagaaacauuacacc

SEQ ID NO: 337055 - RNA, 64 nt, Human
aauuuaggauuuucauauaaaaauagcuguuuaggaaggugaaauacauucacugucucuguug

SEQ ID NO: 337056 - RNA, 64 nt, Human
cuucuuuuacuggacugucugaucaggguggagggaaggugagagguuugcauccacuucagga

SEQ ID NO: 337057 - RNA, 64 nt, Human
aaaugaagguggggcggggcagugaggggugggagaaggugaaugauucauuauuccaccccga

SEQ ID NO: 337058 - RNA, 64 nt, Human
ggcugaauugagugacuccccagaaugaagaugagaaggugaauauaaucaaugccaauguaau

SEQ ID NO: 337059 - RNA, 64 nt, Human
gcucuugcucuccuggucacugcagaaugacagagaaggugaagcuccaugcaugugugcgcgg

SEQ ID NO: 337060 - RNA, 64 nt, Human
ccuuucuacuccagcagcaggaagauagccuggagaaggugauuaaagauacggagucccuguu

SEQ ID NO: 337061 - RNA, 64 nt, Human
cugucaaaacaaagggggguggggcuuuaagagugaaggugaggaggagaucacacaccguaug

SEQ ID NO: 337062 - RNA, 64 nt, Human
gcauggugaggugaaaguaucacuggacuaggaagaaggugacuuagguucuagauaggugucu

SEQ ID NO: 337063 - RNA, 64 nt, Human
gguuuuccaucuucauucucuuuuguuauuaggagaaggugaggcaugggccaaucccauuccu

SEQ ID NO: 337064 - RNA, 64 nt, Human
ugucuacccccuuccuucuuugucuugccccuaggaaggugaaucugcccuagccugguuuacg

SEQ ID NO: 337065 - RNA, 64 nt, Human
uauuggucaagaaaagcaugaaaacugagaugcugaaggugagaggaaauguugacuggccaaa

SEQ ID NO: 337066 - RNA, 64 nt, Human
uuguauucauuuagauuuugauuuuccauguuaagaaggugagguccauguuggugcccuucag

SEQ ID NO: 337067 - RNA, 64 nt, Human
agcuugugauaaaggccaauuccagguagcucuugaaggugauagccaucuacuuuccaguggc

SEQ ID NO: 337068 - RNA, 64 nt, Human
cuuguugaaaaagcugggggugaaagggaacaaggaaggugaugugugagucuggcaggcagga

SEQ ID NO: 337069 - RNA, 64 nt, Human
gauggagaugcugaugagaacaacacuaccacuugaaggugaacauucccugucugguuggacu

SEQ ID NO: 337070 - RNA, 64 nt, Human
gccucucccaccuccagucuuuccccugugaugagcagaugaccaccgcccuccagggucagcg

SEQ ID NO: 337071 - RNA, 64 nt, Human
gggggccauagggugcgguggaacugcaggcccugcagaugacggcagccagcugcuuccagga

SEQ ID NO: 337072 - RNA, 64 nt, Human
agggaggcaagccgccucuucucggccaucgacugcagaugaugaaagagcgggauucaacuuu

SEQ ID NO: 337073 - RNA, 64 nt, Human
caaagaugaaugagauaaggccucaggccucauggaaggugagacaguaaagacauuacuccca

SEQ ID NO: 337074 - RNA, 64 nt, Human
acaugacagaaggacuggaaugccaugaacuggagaaggugagcgcugaagaaccaggauggga

SEQ ID NO: 337075 - RNA, 64 nt, Human
auuaaaagacaguaguuuauuugaacugguuauggaaggugacuuugggauguaagaguguuca

SEQ ID NO: 337076 - RNA, 64 nt, Human
auccgugaaaaguugauaaugaaagaaauuugaugaaggugaauauuuuauaaauuagaaucuc

SEQ ID NO: 337077 - RNA, 64 nt, Human
uuugucuuggacucuaguccuuggcuggacuguagaaggugagaggcgagucacccuccucaca

SEQ ID NO: 337078 - RNA, 64 nt, Human
gaaauuguuuuuuuuuuuuuuucuuuuuggaugugaaggugaacauuccugauuuuugucugau

SEQ ID NO: 337079 - RNA, 64 nt, Human
caaguaucagaagaaauaaacccacagcuccagagaaggugaccauucucagaacuccagcuau

SEQ ID NO: 337080 - RNA, 64 nt, Human
auuguuccggcucaaacagaagcuuuucuuuggggaaggugauuugugggagacuaguguauuu

SEQ ID NO: 337081 - RNA, 64 nt, Human
gcuaugaaguacuguggcagagcugcuguuuucugaaggugagaagccauuuuuagcucagagc

SEQ ID NO: 337082 - RNA, 64 nt, Human
guuagguccacacagugaagggaaaagagucugugaaggugaucaguguagcaguaagacaucu

SEQ ID NO: 337083 - RNA, 64 nt, Human
uaggucuaguugcauuuucacuggggggaggggggaaggugaauuaugguaacuuuuaaugauc

SEQ ID NO: 337084 - RNA, 64 nt, Human
uagagcuccuaacagguguacaggcccaagaguugaaggugauugguuuucuuuacagacuccu

SEQ ID NO: 337085 - RNA, 64 nt, Human
guccuagcuugauaagcacuuggagggggacuuggaaggugagaaagauacugcauuuucucau

SEQ ID NO: 337086 - RNA, 64 nt, Human
ccauggcauguguggcccugucugcuuauccuuggaaggugacagcgauucccuguguagcucu

SEQ ID NO: 337087 - RNA, 64 nt, Human
aguccuucagcucacggaagggaugcuaguccgugaaggugaccucacaguacugguuaauuaa

SEQ ID NO: 337088 - RNA, 64 nt, Human
cuacauacuguuccagacuuuuaaaggggacaaugaaggugacuguggggaggagcaugucagg

SEQ ID NO: 337089 - RNA, 64 nt, Human
gcccuguggacaacuucucuaugcaucugugugagcagaugaucauuguauuaccuuuuaucgg

SEQ ID NO: 337090 - RNA, 64 nt, Human
auaaacugaaauuugcuauauaauuaauauuuuggcagaugauaggggaacuccucaacacuca

SEQ ID NO: 337091 - RNA, 64 nt, Human
gggaucgcggugauuugcagcguggaaaagaaaugcagaugaucaugucuaccugaugcgccgu

SEQ ID NO: 337092 - RNA, 64 nt, Human
auuucaagaaaauuuugcuaccauuuaaguaagagaaggugagaaggaugacagagguuguauu

SEQ ID NO: 337093 - RNA, 64 nt, Human
ccuuaaauguaugcauuugugcaacaauuuuugagaaggugaguggcaauuuauaauuuaguug

SEQ ID NO: 337094 - RNA, 64 nt, Human
gagcuggccggccgcggcugugcagcgugggggugaaggugaaggcuggggcuccucgcgcacc

SEQ ID NO: 337095 - RNA, 64 nt, Human
aauccuuccuuugcuaaaucucaccuuuaaaaacgaaggugacucacuuugcuuuuucagucca

SEQ ID NO: 337096 - RNA, 64 nt, Human
ugccacaguuccagaguuaucaguaggcuagauagaaggugaccucuccucauaaggacuugga

SEQ ID NO: 337097 - RNA, 64 nt, Human
agguaguuauaaaaaaagcccaguuugucuuucagaaggugacuuucaugugcuugaaaaguuu

SEQ ID NO: 337098 - RNA, 64 nt, Human
augucaucaggcuggcccagaaggaggaggagaugaaggugaagcugcuggagcugcaagaguu

SEQ ID NO: 337099 - RNA, 64 nt, Human
cauauuugaaagguaaguaaaaaacuaccaucuugaaggugaagggaguuaagaaaaguaauca

SEQ ID NO: 337100 - RNA, 64 nt, Human
ccuacacaagaacacuccagcccaaaaccgugaggaaggugauauaucucugcauuuucccuug

SEQ ID NO: 337101 - RNA, 64 nt, Human
aaaucucaaaaguauuaauagcucuucuacccuugaaggugacugguccugggacaguuagaau

SEQ ID NO: 337102 - RNA, 64 nt, Human
cuuggaacaacgcauaggaaaagaaucuccuuuggaaggugacacugcucccugaauuaaggua

SEQ ID NO: 337103 - RNA, 64 nt, Human
ggguggugggggcuucagccagugauuucggaccgaaggugacagccgucccaacccugcccag

SEQ ID NO: 337104 - RNA, 64 nt, Human
agugcuggccugggcuggaaacagcucugugugugaaggugaggacucuuggaagcaggccauc

SEQ ID NO: 337105 - RNA, 64 nt, Human
acauaagcaggcuggcucaggacaaggaggagaugaaggugaagcugcuggagcugguguugca

SEQ ID NO: 337106 - RNA, 64 nt, Human
cuuaaaaaaaaaaaaaaagaggagagagauagaggaaggugaauuagacuccaaaagaugaccc

SEQ ID NO: 337107 - RNA, 64 nt, Human
ucaagccugagcuuuuuggucuuguucugauuuggaaggugaauugagcaggucugcugcuguu

SEQ ID NO: 337108 - RNA, 64 nt, Human
accuuaauucagugcacauaauacuaauguaacagcagaugaaaauugauaaaacccaaaagag

SEQ ID NO: 337109 - RNA, 64 nt, Human
uauccagauaggaaaagaagaaguaaaacuauuugcagaugacacaguuuuguauauagaaaau

SEQ ID NO: 337110 - RNA, 64 nt, Human
aaauuguuaaaggagugaaaauguaguuugccuggcagaugaauaauuuucacucauuuauugu

SEQ ID NO: 337111 - RNA, 64 nt, Human
gaaaguggaguuuaagguauaucaaaucguuguggaaggugauuaaaaaucaaaauucuuuuaa

SEQ ID NO: 337112 - RNA, 64 nt, Human
auaggacuccuuuaagauugagcuuucugaacaagaaggugaucaguguuugccuuugaacaca

SEQ ID NO: 337113 - RNA, 64 nt, Human
ccccuccacugcuucucuccccauccacaauggagaaggugaaaagaggagggaaaggccuuug

SEQ ID NO: 337114 - RNA, 64 nt, Human
uccccaaucaggugugggacauccagaaccugcagaaggugaacaccauccgggcccaugacaa

SEQ ID NO: 337115 - RNA, 64 nt, Human
gcagauuuccaaaagacuugaagaaccaugguaugaaggugauuggccccacugacguuggccu

SEQ ID NO: 337116 - RNA, 64 nt, Human
acaacuagaaagugucaccuaugacaagagcagugaaggugagguacuugcugccacagcagaa

SEQ ID NO: 337117 - RNA, 64 nt, Human
ccaggcagucuuugcucaguggaucacacacauggaaggugaugggggcauggguggagggucc

SEQ ID NO: 337118 - RNA, 64 nt, Human
uguugccccuguucugccuuucugggaugggagagaaggugagggagccggcgagcagguucua

SEQ ID NO: 337119 - RNA, 64 nt, Human
cgaagugagguaggugcgguauuaaagugaaagggaaggugaugcauuuauucuggguuaugcu

SEQ ID NO: 337120 - RNA, 64 nt, Human
agugcuaaaccuagaggccaauacugaugaccuggaaggugauccauaugauugucaccacaaa

SEQ ID NO: 337121 - RNA, 64 nt, Human
ugaaguacccuuuuguaaauagcauuuuuuugcagaaggugaaaauuccacucucuaccaccgg

SEQ ID NO: 337122 - RNA, 64 nt, Human
ccugcccccucuuccuccaguagcccucagugucgaaggugagcuuguaggugccugccuucau

SEQ ID NO: 337123 - RNA, 64 nt, Human
agacuccuccugggggcuggcucccaggguggaggaaggugacugugugugugugugugugcgc

SEQ ID NO: 337124 - RNA, 64 nt, Human
ucaacugcgaucacguccugguuauggaaaaugggaaggugauugaguuugacaagccugaagu

SEQ ID NO: 337125 - RNA, 64 nt, Human
ugagccaucuuuuuccuuugcguuuuucuugacugaaggugagauguuauuuguggcaugugaa

SEQ ID NO: 337126 - RNA, 64 nt, Human
uggacagcaggacguucacaaacgucuauuggaugaaggugaaugacuaaagcuuugcuacugg

SEQ ID NO: 337127 - RNA, 64 nt, Human
aaccuauguggcagccaugagggccaucaacaucgcagaugagcugccccgcucccgugcccga

SEQ ID NO: 337128 - RNA, 64 nt, Human
gcgggccggagcugaucgcucucacuggccugcugcagaugagccagggggagccuaggcccag

SEQ ID NO: 337129 - RNA, 64 nt, Human
auuuuuauuguggcuugagcucagucaaucuggugcagaugaggcuggacaacuacuaaccaau

SEQ ID NO: 337130 - RNA, 64 nt, Human
acccuggacacguccugcuggugagggaccucgggaaggugacagucugugugccuuggugugg

SEQ ID NO: 337131 - RNA, 64 nt, Human
aaauagcaguaaaggcucaaaggaacguauucuugaaggugacggaaauaccuaaaaacuccua

SEQ ID NO: 337132 - RNA, 64 nt, Human
uccacaagugugauuaaaagugaccagaaacacagaaggugagaucacagcucugcuggcagag

SEQ ID NO: 337133 - RNA, 64 nt, Human
guugacuguacuaaaaauguauacuuguugccaggaaggugaccucaaaaauuaaaaguauaau

SEQ ID NO: 337134 - RNA, 64 nt, Human
gaagcugaaggccagcuucacauuucugcugagagaaggugacuuaacgccuuuuccggcccua

SEQ ID NO: 337135 - RNA, 64 nt, Human
gcugggaggggaguguggcagggaggaggaagaggaaggugagaaugaguagaacaguuuugua

SEQ ID NO: 337136 - RNA, 64 nt, Human
aacacagaggagaguaggaacagggcggauaccugaaggugacuccgaguccagcccccuggag

SEQ ID NO: 337137 - RNA, 64 nt, Human
uccaugacugccccaacccccuugggguggggcagaaggugaagcaucccaacugacuagagac

SEQ ID NO: 337138 - RNA, 64 nt, Human
uuucuagagaacuauguucuucccugacuuuagggaaggugaauguguucccguccucccgcag

SEQ ID NO: 337139 - RNA, 64 nt, Human
uuuuaagggaaggggaaggauagggugauguuccgaaggugaggagcuugaaacccguggcgcu

SEQ ID NO: 337140 - RNA, 64 nt, Human
caagcacugcccugggcccaugggauagagcggggaaggugauggcucuuccagaggauucccu

SEQ ID NO: 337141 - RNA, 64 nt, Human
accacaucugccuuuuccacaagcuuuucacaaagaaggugagagagaaggaaaccuugggagg

SEQ ID NO: 337142 - RNA, 64 nt, Human
aauagcagcaagaaauaucucuuucuguguucaagaaggugaaauuuugggauugcuaggaccc

SEQ ID NO: 337143 - RNA, 64 nt, Human
cagugugagugugaugggccaccggggcaagagggaaggugaccgcccagcucucccacauccc

SEQ ID NO: 337144 - RNA, 64 nt, Human
gccaggguagagcaaaggagacaaagcaggaguggaaggugaggcguucuccugcuuguacuaa

SEQ ID NO: 337145 - RNA, 64 nt, Human
aaaagacaaaugcccucauaguagugggaagugugaaggugaccgugaacauccuuccucaucg

SEQ ID NO: 337146 - RNA, 64 nt, Human
ucugcaugggauuugcuaucauaauauuuacuaugcagaugaauucagugugagguccuguguc

SEQ ID NO: 337147 - RNA, 64 nt, Human
uauuugaugguuuguaaguagacaguaaggcaaggcagaugauuauuacccucagaaagguugc

SEQ ID NO: 337148 - RNA, 56 nt, Human
aauuugaaauggacaucuaauccagugcagaugaccuggcauguggaguuacagag

SEQ ID NO: 337149 - RNA, 64 nt, Human
acuuguaacuuaauaaauacaggaaauccucagagaaggugauauuuucaggaaaaagacaaau

SEQ ID NO: 337150 - RNA, 64 nt, Human
cgcguguguguguuugugucugucugugggucucgaaggugauccgucggugcgguggcucugu

SEQ ID NO: 337151 - RNA, 64 nt, Human
uccuccacagcgccauauuaauggaggaggggaggaaggugaaaucuacugcaugggauucagg

SEQ ID NO: 337152 - RNA, 64 nt, Human
auuuuuaucucuugauucuucaaaagcauucugagaaggugagauaagcccugagucucagcua

SEQ ID NO: 337153 - RNA, 64 nt, Human
cguugcgcugaaaccccaugggcccguucugauugaaggugaagcccaccagauuauuuuucaa

SEQ ID NO: 337154 - RNA, 64 nt, Human
uuguccuauuaagaaguagaccacugagaagggagaaggugacauuuuagcuuucccagguaaa

SEQ ID NO: 337155 - RNA, 64 nt, Human
ccaucaugaugcagggguuuuggggaccuggaaggaaggugaugaggcagugagucagaaaaac

SEQ ID NO: 337156 - RNA, 64 nt, Human
ccucugcccucccaacuuggguuguacuuucuaagaaggugauucccccugcccuugcccccuu

SEQ ID NO: 337157 - RNA, 64 nt, Human
uaaagaaagcugaaggugcccaccugggccaccagaaggugacacccccagaaucccuccccag

SEQ ID NO: 337158 - RNA, 64 nt, Human
gcugugccuggcccuguaggcccaggguuggcuggaaggugacaucuguguuucguuuuagcug

SEQ ID NO: 337159 - RNA, 64 nt, Human
gagaacaaaauagacaaauacaucugcccucauggaaggugacguucccaggagagggcaccua

SEQ ID NO: 337160 - RNA, 64 nt, Human
aggacuucagaagcaacauuucuggccugaccuggaaggugaaggugaaggugagacccuguag

SEQ ID NO: 337161 - RNA, 64 nt, Human
ucagaagcaacauuucuggccugaccuggaaggugaaggugaaggugagacccuguagggcaca

SEQ ID NO: 337162 - RNA, 64 nt, Human
gcaacauuucuggccugaccuggaaggugaaggugaaggugagacccuguagggcacagggcua

SEQ ID NO: 337163 - RNA, 64 nt, Human
uguccaaugacaugugugcuagagcuuacucugagaaggugacagaguucauguugugugcugg

SEQ ID NO: 337164 - RNA, 64 nt, Human
ccuuuggaugguuaaaagcauugcaggcacccgggaaggugagcagaggguaggugggugggcu

SEQ ID NO: 337165 - RNA, 64 nt, Human
aaaauccaugaguucuguguacccuagaccuuuggaaggugagagcagggcccugagaaaaggc

SEQ ID NO: 337166 - RNA, 64 nt, Human
cggggcucggagcauggcagcuaaguuagugagggaaggugagauggagguuuuggucuuauug

SEQ ID NO: 337167 - RNA, 64 nt, Human
gguggugcuggguggguuccgccaccuucuccuggaaggugagccuuuuccuggccaagggcag

SEQ ID NO: 337168 - RNA, 64 nt, Human
gucuuguggccuccaugggagguugaaaaccagagaaggugaaggggggcugcacugagccaca

SEQ ID NO: 337169 - RNA, 64 nt, Human
gauggugagaagagguuaaugguguucagugagugaaggugaguuagaauaauauauuggagca

SEQ ID NO: 337170 - RNA, 64 nt, Human
uuaggacagagugagagaagucagcugucacggggaaggugagagagaggaugcuaagcuuccu

SEQ ID NO: 337171 - RNA, 64 nt, Human
acgauguggcugcccggcagacgacagagaugcugaaggugaugcugcagcagggcgaggccau

SEQ ID NO: 337172 - RNA, 64 nt, Human
acuugccugcaccgugccugacucauccaguggggaaggugacucaagaaguuguuuaagccua

SEQ ID NO: 337173 - RNA, 64 nt, Human
gcugagcuaucuccuaacuuuggaccuauuaucagaaggugacaaguacuggcucuuuauucau

SEQ ID NO: 337174 - RNA, 64 nt, Human
gaauaucugagaaacuacucuguuuuagaccuuugaaggugauuuagaguuuuguguacaucua

SEQ ID NO: 337175 - RNA, 64 nt, Human
gggaagucagagcuccaugcacacagugucuucagaaggugaaaauaaauauuucccugugcuc

SEQ ID NO: 337176 - RNA, 64 nt, Human
ugggcucugggcacugacucauggcaccucccuagaaggugagaaacacuccaaaucuaaacac

SEQ ID NO: 337177 - RNA, 64 nt, Human
cacaaggucacauucucugugaucacaugagagggaaggugaugacuuaaauggcagggggugg

SEQ ID NO: 337178 - RNA, 64 nt, Human
aauacggaugccaugggaguggccaggccagauugaaggugaauauggagcaguagcagaagcc

SEQ ID NO: 337179 - RNA, 64 nt, Human
aucuccauuccucugcccucuugagccagcacaggaaggugaggcccugggauagcgcgccugc

SEQ ID NO: 337180 - RNA, 64 nt, Human
cacacuuguuccagcucuuugaaauagucugugugaaggugaaagugcaguucaguaauaaacu

SEQ ID NO: 337181 - RNA, 64 nt, Human
gugugagcaugugugugugcauguaccggggaaugaaggugaacauacaccucugugugugcac

SEQ ID NO: 337182 - RNA, 64 nt, Human
ucucuucgcagccaucaggacuagguuugugcaggaaggugaugcccacuggaacucuccucac

SEQ ID NO: 337183 - RNA, 64 nt, Human
cuuugcaaguuugacuguaugcagguuuauaucagaaggugagauugaauaaugcuugaugcag

SEQ ID NO: 337184 - RNA, 64 nt, Human
agcugagcuuugaaaaaguuugucuuaguuuugugaaggugauuuauucuuaaaaaaaaaaaag

SEQ ID NO: 337185 - RNA, 64 nt, Human
aaacgcacacuguuucaucuugacccuuucuugggaaggugacagagagguaggagggcaaaca

SEQ ID NO: 337186 - RNA, 64 nt, Human
cugcaagggagggggagagaagcagagggagagagaaggugacacggauggaagagugggaagg

SEQ ID NO: 337187 - RNA, 64 nt, Human
acccacaggcacuggcacccuuggguuggcaauagaaggugacauggaauggagaaaaccaaga

SEQ ID NO: 337188 - RNA, 64 nt, Human
ucgagugcggagagagugggagugcucagggaaagaaggugauuuguauuugucuccccgcuga

SEQ ID NO: 337189 - RNA, 64 nt, Human
ccugcagcggugguugucacacccugacuucagggaaggugaaacagggcuugucccuccaacu

SEQ ID NO: 337190 - RNA, 64 nt, Human
gucaaaaagaaccacuugugguucuaaaaggugugaaggugauuuaagggcccaggucagccac

SEQ ID NO: 337191 - RNA, 64 nt, Human
gcaauucugcaucccuaauucugucaaaaccuaugaaggugacuaaauugucuaacaugaagug

SEQ ID NO: 337192 - RNA, 64 nt, Human
cacagggagauaggcaaugcuguggguguuggaggaaggugagagccuguugcuaacaauuucc

SEQ ID NO: 337193 - RNA, 64 nt, Human
uacccaaugaccccagagcagugcagccaccagggaaggugagccagacacaggccgggacaaa

SEQ ID NO: 337194 - RNA, 64 nt, Human
agaguaauggcauuaauccccauaauaauccugugaaggugauauucucaucccaucuuagaca

SEQ ID NO: 337195 - RNA, 64 nt, Human
gugugugugugugugugugugugugugucuuggugaaggugaggggcuguauuuucaccaagcc

SEQ ID NO: 337196 - RNA, 64 nt, Human
uccacaugacugaggaggccucacaauugugguggaaggugaaaggcaugucucacauggcagc

SEQ ID NO: 337197 - RNA, 64 nt, Human
agcacucugugaaaccuugaaaugagaaguaaaggcagaugaaaagaaagaaaaagccuuuuua

SEQ ID NO: 337198 - RNA, 64 nt, Human
uacagaaacugagacacguggagacuggaugagggcagaugaggacaggaagagaguguuagaa

SEQ ID NO: 337199 - RNA, 64 nt, Human
cugacgucauggugagugacugccgaaguaaggagcagaugagugauuguucaaauacccgaac

SEQ ID NO: 337200 - RNA, 64 nt, Human
gugugcguauguaacaagcuucacuguuuuuauagaaggugaaccauuaguauaaaugguaaua

SEQ ID NO: 337201 - RNA, 64 nt, Human
agaguccugccuucuuccuugaggggcaguuugggaaggugauggguauuagugggggacugag

SEQ ID NO: 337202 - RNA, 64 nt, Human
ccaacauucuuguucugcagguugcuuuuauaaagaaggugaacuauuuucauguaauguuaag

SEQ ID NO: 337203 - RNA, 64 nt, Human
gcucuauugauuggugagugaccagagcaaguaugaaggugaugcugccaaagcacaagccagu

SEQ ID NO: 337204 - RNA, 64 nt, Human
cagcuacugagagcucuggaaagaaggaugucaagaaggugaaauccuaaagccuagaaauaaa

SEQ ID NO: 337205 - RNA, 64 nt, Human
cgggggacccaagggucucaagccugcaaguccagaaggugacaaacccaggagcacugggagu

SEQ ID NO: 337206 - RNA, 64 nt, Human
cuuguacagcaaauccugacucgugucuuuuuacccccaagauaucugucuucaguagcgacug

SEQ ID NO: 337207 - RNA, 64 nt, Human
agagucuuccaaggccagaaggagggggacaaccccccaagaccaucccugaagacgagcaucc

SEQ ID NO: 337208 - RNA, 64 nt, Human
uauuccaaaagggacuuuacauuaaaggagaagcccccaagauguggccacccuuaaccauuuu

SEQ ID NO: 337209 - RNA, 64 nt, Human
cugaccuggcuagguagggagggggugguuaucgccccaagaugggguccaggcuccauccuuc

SEQ ID NO: 337210 - RNA, 64 nt, Human
uacgguauuucuugacucugggaacagcugcuacccccaagacuugccacguuguucugcccuc

SEQ ID NO: 337211 - RNA, 64 nt, Human
cucguuccuuucuccuguuuauucccaucuuuacccccaagacuuuauugggccucuucacuuc

SEQ ID NO: 337212 - RNA, 64 nt, Human
gaggaaaaguacuaggauucuuaagauggcgagaccccaagagggaucucauagcacugcugca

SEQ ID NO: 337213 - RNA, 64 nt, Human
agcuccauccaugucuagaccuucaggccagucugcagaugagguucccuaccuuuuucuucuc

SEQ ID NO: 337214 - RNA, 64 nt, Human
cuggccuaaccauggagauauugguuaucaguuugcagaugaauacacaguucuauccaacaga

SEQ ID NO: 337215 - RNA, 64 nt, Human
ugguuccuaucucagggauacuggacuuucugacgcagaugaacaauuaaggggaaaagcuucc

SEQ ID NO: 337216 - RNA, 64 nt, Human
gucugcccucagggguccaaaucacuucaggacaccccaagagauguccuuuagucucugccug

SEQ ID NO: 337217 - RNA, 64 nt, Human
ggcgccucccaccuucacccucucggggaugccuccccaagaggguaguuagggguggggaagc

SEQ ID NO: 337218 - RNA, 64 nt, Human
ccuuucccacacccacuucucuccuaucaccuucccccaagauuaccugaacaggguccauggc

SEQ ID NO: 337219 - RNA, 64 nt, Human
uacaguacagugagugaccccagccuccugccuaccccaagaugccccuccccacccugaccgu

SEQ ID NO: 337220 - RNA, 64 nt, Human
cauuuuggccugcaaaccuucaacucccaucuuuccccaagaagucagagaugcuguuacuuga

SEQ ID NO: 337221 - RNA, 64 nt, Human
uguuuuuauuccuaaugugugcaacaucacaucuccccaagaagcaacagcaugggguccagca

SEQ ID NO: 337222 - RNA, 64 nt, Human
cucuuguuugacaugguguguggauggggacuugccccaagacugagcaggucugcccuuucau

SEQ ID NO: 337223 - RNA, 64 nt, Human
guacugccugccagcugggucucccaagcaacuaccccaagacauaccaacagugaagccagga

SEQ ID NO: 337224 - RNA, 64 nt, Human
gcugacuugaagcucccugucccccucacucuugccccaagaaaagaggccaaagcaagagcag

SEQ ID NO: 337225 - RNA, 64 nt, Human
cuggggaaagccugaagggccucccagcccccaaccccaagaccaagcuuaguccugggagagg

SEQ ID NO: 337226 - RNA, 64 nt, Human
aaggugcggggagaagaagcggccaggcggggcgccccaagagcccaaaagagggcacaccgcc

SEQ ID NO: 337227 - RNA, 64 nt, Human
ggcagcacuucccaaagugcacugaggaagguggccccaagagaagcucucuaaacaaaggagu

SEQ ID NO: 337228 - RNA, 64 nt, Human
cccacccuguagggaggucugagcagagggaggcccccaagagugccauugaccaagagacagc

SEQ ID NO: 337229 - RNA, 64 nt, Human
aaggccgauaauuuaaacagucucccaccaccuaccccaagagauacugguuguauuuuuuguu

SEQ ID NO: 337230 - RNA, 64 nt, Human
gccaucagugauuuacaaacaauauuuugauauugcagaugacuugcuuacuguauuugcauug

SEQ ID NO: 337231 - RNA, 64 nt, Human
uuuaaaaauucuucuucauugcugacugaaacuggcagaugauugaccaguauccuuugaccau

SEQ ID NO: 337232 - RNA, 64 nt, Human
aucuuaaaaauaccaaauaacagaagaucgcauugcagaugauaucaggaugugguuuccagcu

SEQ ID NO: 337233 - RNA, 64 nt, Human
uuaacauuucaaaaguuuuucguauuuuuuuauggcagaugauuugucauuuauuuauauuagg

SEQ ID NO: 337234 - RNA, 64 nt, Human
uguuugacucccauuccuugggcucuggagcuuuccccaagaauuacaucagagaaaaggaaga

SEQ ID NO: 337235 - RNA, 64 nt, Human
uuaucuuccacaggguccaagaguucaucaggacccccaagagugagugagggggcaaggcucu

SEQ ID NO: 337236 - RNA, 64 nt, Human
caccuccagccugacucccugucugcccuuucacccccaagauuuugcacagguuaaggccagu

SEQ ID NO: 337237 - RNA, 64 nt, Human
ggagauacuuauuggucuuuuuguuuaauaccuuccccaagaggggacagucuggccaacuugc

SEQ ID NO: 337238 - RNA, 64 nt, Human
cagcaccccgauguaaccuucucuguggcuccaaccccaagacucccaggcacaugggauggau

SEQ ID NO: 337239 - RNA, 64 nt, Human
ccaaggagcaaaauuugccuguccagcucccucuccccaagaaacaacaugaaugagcaacuuc

SEQ ID NO: 337240 - RNA, 64 nt, Human
acuuugaagucaugagaugcaccaucgaggcuacccccaagaagaagcagaagagaaguuggua

SEQ ID NO: 337241 - RNA, 64 nt, Human
cuuuggcaaaacuuaggcaugcacagcuguaguaccccaagaagaaaauguuacuucucucauc

SEQ ID NO: 337242 - RNA, 64 nt, Human
acugugggaggaucugagcuuggugauauuuuauccccaagauaugacaccaagguagacagga

SEQ ID NO: 337243 - RNA, 64 nt, Human
cacaggcucucacaagaucagaacccccacucacccccaagaucuuaucuagcaagccuguagu

SEQ ID NO: 337244 - RNA, 64 nt, Human
ccugggccuuuccugugccaaccugaugccccuuccccaagaaggugagugcuugucauggaaa

SEQ ID NO: 337245 - RNA, 64 nt, Human
gaugauugacaacacccauuuuuccuuuugccgaccccaagaguuuugggaguuguaguuaauc

SEQ ID NO: 337246 - RNA, 64 nt, Human
auccuuauauuuucuaaauugccuagccgucacaccccaagauugccuugagccuacuaggcac

SEQ ID NO: 337247 - RNA, 64 nt, Human
uuauaucccaccaacacucucccagcucccauguccccaagaccucuggaguuuccucuugaau

SEQ ID NO: 337248 - RNA, 64 nt, Human
aaaggaaauaaaaaccaucucaauaauuaaguuggcagaugacuugaucuccgacauuuucacc

SEQ ID NO: 337249 - RNA, 64 nt, Human
aggugugaucugaauuuaauccacauuugguguugcagaugaguuguaaagccaacugaaagag

SEQ ID NO: 337250 - RNA, 64 nt, Human
cggucagucugccuccguguguccucugaaauaagcagaugaagaugaaagggcaacuuuguuu

SEQ ID NO: 337251 - RNA, 64 nt, Human
ccaugaacgaguacaacgcgcugaacgaggccaagcagaugaucgccgucgccgacgagaacca

SEQ ID NO: 337252 - RNA, 64 nt, Human
cuuucugugacccuccuuuuuuggccuccucuuuccccaagacuuucuuccuccuguuucucgu

SEQ ID NO: 337253 - RNA, 64 nt, Human
gucagagcuagugauuucaaaagguuucacaauuccccaagacaaaagugauuuucguucauua

SEQ ID NO: 337254 - RNA, 64 nt, Human
aucaaaaucuggcagagucagcugcugacccucuccccaagaagaugaaagauucaguggugag

SEQ ID NO: 337255 - RNA, 64 nt, Human
ggccgcccaugcagacuuuuggccuggcgcgaucccccaagaaccccuccagggccggccugcg

SEQ ID NO: 337256 - RNA, 64 nt, Human
agaaggguuuuuuuagaaauacauuuaguaaaguccccaagacauuagucuuacauuuaaacuu

SEQ ID NO: 337257 - RNA, 64 nt, Human
guccaaaggagugcauggccacagccaccuccacccccaagaaaccuccauccugccaggagca

SEQ ID NO: 337258 - RNA, 64 nt, Human
uccacucagggcuggcccggggaguccccgugugccccaagaggcuagccccagggugagcagg

SEQ ID NO: 337259 - RNA, 64 nt, Human
aauccaaauacucuuacuuuaaaaaauuuccuuuccccaagaaucuccuugggacuuugacuua

SEQ ID NO: 337260 - RNA, 64 nt, Human
acgacgaaagcgacggaccaaaagaaauuuccugccccaagaagcaugggauccaggaaggggc

SEQ ID NO: 337261 - RNA, 64 nt, Human
cuccauugcugagugccccauccuggaggauuggccccaagaucuccuagaacaggauaauugc

SEQ ID NO: 337262 - RNA, 64 nt, Human
ucagacuuggaagaauuuccaaaacugaaguuagccccaagacuucccuaggguugauguacuu

SEQ ID NO: 337263 - RNA, 64 nt, Human
cauuugauguuuuuacuuaugaaauauucuccucccccaagaaaauuuaaacuuuuucucucua

SEQ ID NO: 337264 - RNA, 64 nt, Human
cagugugacccuugaagacagugccccucagagaccccaagaccuuagggauugacaccugggc

SEQ ID NO: 337265 - RNA, 64 nt, Human
uccucaaaagaaauuugaucaucaugaaucccauccccaagaaucucaucaaccagggaagagg

SEQ ID NO: 337266 - RNA, 62 nt, Human
agacagaaccuggaccucaccagggacugcugggcagcgauuccuggcaguggccugguguu

SEQ ID NO: 337267 - RNA, 62 nt, Human
gacucacacaaauuaaaauacagcugcacugaggcagcgaccucaaguguccugaaagcuua

SEQ ID NO: 337268 - RNA, 62 nt, Human
uauuuucuuuuccugcuuuggagcuguguaauggcagcgaaacauguagcugucuuuguucu

SEQ ID NO: 337269 - RNA, 62 nt, Human
agcagcccaaggcaccuguccucugacccaccggcagcgagugcgcaggugugaguguaagu

SEQ ID NO: 337270 - RNA, 64 nt, Human
gagagcacugugcaccugggaaugaggaaucaggccccaagacagaaguacuuggaggagccag

SEQ ID NO: 337271 - RNA, 64 nt, Human
caggcuacuagguggcauaguguuaauuaggacuccccaagauauggggaguucuacucucaau

SEQ ID NO: 337272 - RNA, 64 nt, Human
cagcuuugggggccccagggaauuggaacucuucccccaagacagagcaggggugaacuguagc

SEQ ID NO: 337273 - RNA, 64 nt, Human
auaagucuuuugucaucaaggaggcaaauugucuccccaagacagcucaaaauauccacaccuc

SEQ ID NO: 337274 - RNA, 60 nt, Human
uccucuuugcuccguacuaacgucugcaaaccccaagacguuugaggccaguaggaaguu

SEQ ID NO: 337275 - RNA, 64 nt, Human
aacauacauguugggcaugauucuacccuuauugccccaagagaccuagcuaaggucuauaaac

SEQ ID NO: 337276 - RNA, 64 nt, Human
accuguguagcauuguaauuauguacuaucaaacccccaagaugcugaugauaggccuucucug

SEQ ID NO: 337277 - RNA, 64 nt, Human
uucguuacuuugcugcuucauguguacuuuccuaccccaagaggaaguuuucugaaauaagauu

SEQ ID NO: 337278 - RNA, 64 nt, Human
cccagcuucugcccaaccuucagcagugacaaguccccaagagacucgccugagcagcuugggc

SEQ ID NO: 337279 - RNA, 64 nt, Human
cuccuggauauucauuuacgaccuuccucuauggccccaagaguaguccuaggaagcccacuga

SEQ ID NO: 337280 - RNA, 64 nt, Human
uugucuuagguuucuuuuccugucccucuuccauccccaagaugugaccccauaaaaauuuuuc

SEQ ID NO: 337281 - RNA, 64 nt, Human
cagguucugcugaggguggggcugguguagggacccccaagagaccccuguccugucccuucac

SEQ ID NO: 337282 - RNA, 64 nt, Human
ggaugagcccccuccccccaaugcacaagccagcccccaagacccuggggguggacaccacuca

SEQ ID NO: 337283 - RNA, 64 nt, Human
gaauaaaacauucucaacuccucuugaaucuaucccccaagaaaccaucuuaucccuguaauaa

SEQ ID NO: 337284 - RNA, 57 nt, Human
gcaaauccaucaaaaguuaacuucugggcagaugaaaagcuaccaucacuuccucau

SEQ ID NO: 337285 - RNA, 64 nt, Human
aaugcuuagugugugucacaauucugagguuuucgcagaugaaccaaaaacuccaguaacaugu

SEQ ID NO: 337286 - RNA, 64 nt, Human
ucaauggguagaugccuuccaggcugcagucagugcagaugauaugccaauuucagguggaaaa

SEQ ID NO: 337287 - RNA, 64 nt, Human
agaagcgcuuugaggaaggcaaagggcgguaccugcagaugaaggcgaagcgacagggccacgc

SEQ ID NO: 337288 - RNA, 64 nt, Human
aauaaacccauugaugaucuauuucccagcuuauccccaagaaaacuuuugaaaggaaagagua

SEQ ID NO: 337289 - RNA, 64 nt, Human
cuuuauuaccuuucaaauauuuacuguugcuuggccccaagaauggccuuguacaacuuaucca

SEQ ID NO: 337290 - RNA, 64 nt, Human
caguaucacaggugagaaaaggugguuauuuuuuccccaagacaacagcacuaguaaucccacu

SEQ ID NO: 337291 - RNA, 64 nt, Human
cccggaggaugggucucagccgagccucgugcacccccaagauggaacaucccugcugcauuca

SEQ ID NO: 337292 - RNA, 64 nt, Human
gugccggugugaggaccaggaugucuuuucccagccccaagagaccuguugcugcuuucuugua

SEQ ID NO: 337293 - RNA, 64 nt, Human
auugcaucucucaccuguucucaccccucugcagccccaagaccccacuggccaccccucccuc

SEQ ID NO: 337294 - RNA, 64 nt, Human
cucaggaaguaaaaccgaagaagauggcccagcuccccaagaaagccucagccauucacugccc

SEQ ID NO: 337295 - RNA, 64 nt, Human
ugguuuuugguuuuuagaaauauuuuuuauuuuuccccaagaauugcaaccggaaccauuuuuu

SEQ ID NO: 337296 - RNA, 64 nt, Human
uugccaaccaguuugaagaccgccccccgccucuccccaagaggaacugaaucagcaugaaaau

SEQ ID NO: 337297 - RNA, 64 nt, Human
ggggcagagacagcauggggaaggagguccccuuccccaagaguccucucuauccuggaugagc

SEQ ID NO: 337298 - RNA, 64 nt, Human
guaguaggauagggauuuuuuuuuuuuuuuuuugccccaagaaaacguucacccagugaucuug

SEQ ID NO: 337299 - RNA, 64 nt, Human
cuccagguaguuuucuuccucuaccuccacauccccccaagacugaaaagagucacuaacucuc

SEQ ID NO: 337300 - RNA, 64 nt, Human
gagggacacgcgagaggcaggccaggcugcaccaccccaagagccacgccccucgcuggcgccc

SEQ ID NO: 337301 - RNA, 64 nt, Human
agaaggaguaggcacaucaagauauucaggggugccccaagagucugggacuuucaaaaaaaaa

SEQ ID NO: 337302 - RNA, 64 nt, Human
gaagggacccaggccaccucccuuccgcaggucugcagaugaaggguuuuuugaaugaaaugcc

SEQ ID NO: 337303 - RNA, 64 nt, Human
ccccucaucacuguggggaucauucucucugagggcagaugaggcgcaggaaaauagucuugga

SEQ ID NO: 337304 - RNA, 64 nt, Human
acaugucagugcaucacauauaucaugaucuaaugcagaugacuaggcuuuuuccaaaaggaag

SEQ ID NO: 337305 - RNA, 64 nt, Human
guggauaucuuuuaaguuuauuacagaaaaaaaugcagaugaucucuuaaaauaaaacuaaaga

SEQ ID NO: 337306 - RNA, 51 nt, Human
augagugcaagaucuucuaaaccccaagagacuucacacaacacuuaugua

SEQ ID NO: 337307 - RNA, 64 nt, Human
uuuuuucucuuuucuucuuucuuuuccucuuuuuccccaagaggaagaauugcuuuucucuuac

SEQ ID NO: 337308 - RNA, 64 nt, Human
cucauucaugaggaaucugaugcuccuuugcugcccccaagaguauacuccaccgagaaccacc

SEQ ID NO: 337309 - RNA, 64 nt, Human
ccaccagccacaccauuauaccagaaggcggaucccccaagaccacagugagagcuuuuucccu

SEQ ID NO: 337310 - RNA, 64 nt, Human
ugacauucuauaccaaugguucccaaaauuuuuuccccaagacuuaauuaagugucugacuguc

SEQ ID NO: 337311 - RNA, 64 nt, Human
ccauaucaaaauuauaaaugaggaggacagcaggccccaagaaaguagggacuaaguaugucuu

SEQ ID NO: 337312 - RNA, 64 nt, Human
cccauuccuucauucuagagcuagagugaaugagccccaagaaaaugacccaaggaguugacuc

SEQ ID NO: 337313 - RNA, 64 nt, Human
auggauacagauuuucuuuuguccuuguccauuaccccaagacuuucuucuagauauaucucuc

SEQ ID NO: 337314 - RNA, 64 nt, Human
auaggaacugagcacaggcuuuuucaggugcuuuccccaagauagaucuagauauuagcuagug

SEQ ID NO: 337315 - RNA, 64 nt, Human
gugaguuugccaaaaccaaagggggugaauacuuccccaagauucuuccugggaggauggaaac

SEQ ID NO: 337316 - RNA, 60 nt, Human
aauuguuugguaaccccuaaucaagagaggccccaagauccacaacucgagugguuaaag

SEQ ID NO: 337317 - RNA, 64 nt, Human
uccauuucaacaucuccccccaggcgauguucucccccaagacgaccagaaaauuguuuauugg

SEQ ID NO: 337318 - RNA, 64 nt, Human
gucucucuaguaguuaaaacagcuauuuuaguaaccccaagaguuucuucucauauccauaaaa

SEQ ID NO: 337319 - RNA, 64 nt, Human
uuuugucuuucuucucagguguauuucuugguacccccaagauaucaggccagaaagagaugag

SEQ ID NO: 337320 - RNA, 62 nt, Human
ggcaggacuggagaggcugcgugcccggcacuggcagcgaggcucgugugucccccaggcag

SEQ ID NO: 337321 - RNA, 62 nt, Human
ccccgcugagccucgcggugacagccgccuuuggcagcgagcgcucggggcacuucuauccc

SEQ ID NO: 337322 - RNA, 62 nt, Human
accaagcuugagcugugucguuucguggagggggcagcgaggaugggcuugagcuguugaga

SEQ ID NO: 337323 - RNA, 62 nt, Human
gaagaguaagugggaucacagggaaggauguuggcagcgacaccaucccauacaggcucuua

SEQ ID NO: 337324 - RNA, 64 nt, Human
guggugcuuacugugcugacuguguacuuaucuuccccaagagaaaaugcuucuuuugagcaca

SEQ ID NO: 337325 - RNA, 64 nt, Human
agauccguguucuaaaccugggguccacagacacccccaagaagagcggauugaaugcaagaga

SEQ ID NO: 337326 - RNA, 64 nt, Human
acaacuggggaaagaaguguucuucacccccuacccccaagacauugucucugucggccaggcu

SEQ ID NO: 337327 - RNA, 64 nt, Human
cacuggucaauauauagauuuugggugucugaggccccaagauuagaugccacuaaucuccaaa

SEQ ID NO: 337328 - RNA, 64 nt, Human
aauaugguauguaugcuaaauuauaugaaccuuuccccaagaagggcccuagaaauugaugugg

SEQ ID NO: 337329 - RNA, 64 nt, Human
aagcugcucuuucugguccuccccaccaccccacccccaagacuuguguuuguuaauagaaaua

SEQ ID NO: 337330 - RNA, 64 nt, Human
cccccuauuccagggugugcacccucuccccaacccccaagaaccccacuacugcuuucccugu

SEQ ID NO: 337331 - RNA, 64 nt, Human
uggccuucuucccugaaugcuuuuuuuuuuuggcccccaagaaagucccuuuuauagcacuuua

SEQ ID NO: 337332 - RNA, 64 nt, Human
ugucuuguaaaagacaagaagcuucagauggguaccccaagaaggaugugagaggugggcgcuu

SEQ ID NO: 337333 - RNA, 64 nt, Human
ugaacagacaucagcacaucagacgucuuuuagaccccaagacaauuuuucuguuucaguuuca

SEQ ID NO: 337334 - RNA, 64 nt, Human
ugccuuccacuucccaacagcccccaucaagggaccccaagaggccaccaugcucuuaucucgc

SEQ ID NO: 337335 - RNA, 64 nt, Human
cgacagucuucccuucucuccaagaggccucaguccccaagacugccaccagucuacacauaca

SEQ ID NO: 337336 - RNA, 64 nt, Human
ugcugcuuuuuuucauauugaaaagaugacaucgccccaagagccaaaaauaaaugggaauuga

SEQ ID NO: 337337 - RNA, 64 nt, Human
ccucauugccuccuguucugcccacgauccccucccccaagauacucuuuguggggaagagggg

SEQ ID NO: 337338 - RNA, 62 nt, Human
ccaggacuggccucccugaucucucuccucauggcagcgacccaccuccaguccccuggaca

SEQ ID NO: 337339 - RNA, 62 nt, Human
ugcacaccugcuggccuggggagcuccagccaggcagcgaguccugccccgcccgcagcucc

SEQ ID NO: 337340 - RNA, 62 nt, Human
ugucucuccuacccccacugccccgagugucgggcagcgauguacauauggagguggggugg

SEQ ID NO: 337341 - RNA, 62 nt, Human
uuccucagcugacuccauauuuuccuacuuguggcagcgacugcauccgacauaaaggaaca

SEQ ID NO: 337342 - RNA, 64 nt, Human
gggcaggaggccccaggcugagagccagaugccuccccaagacugucauugccccuccgaugcu

SEQ ID NO: 337343 - RNA, 64 nt, Human
cagcugcagagaguuuggcuauaugcaucugcagccccaagagcucccacugcaagacaagugu

SEQ ID NO: 337344 - RNA, 64 nt, Human
aguccuuugauuucuucccucucccuggugucucccccaagaccccaaauaaagcaauacacug

SEQ ID NO: 337345 - RNA, 64 nt, Human
gacaccaggcuuauuggggcgugcacagccaagaccccaagaagugacuccuuguaaaauguau

SEQ ID NO: 337346 - RNA, 64 nt, Human
uuaaaacucccuugcuaccgaucuggaacucaagccccaagacauccccuuagaugaucugaau

SEQ ID NO: 337347 - RNA, 64 nt, Human
uaaucuguacuauccagugagguaauuucuucccccccaagauagagucaagcucugucaccca

SEQ ID NO: 337348 - RNA, 64 nt, Human
agccagacuccaggguugccugggaacagucucuccccaagaucaccuguagggaaaugagugu

SEQ ID NO: 337349 - RNA, 64 nt, Human
agauagcccccgaguccaagaacuuaggcaggggccccaagacaauaaaguuggucucuacuau

SEQ ID NO: 337350 - RNA, 64 nt, Human
ggagagaacuuaacccaccugggggaaaauagcuccccaagagcuggcaccaguaccacugaug

SEQ ID NO: 337351 - RNA, 64 nt, Human
agugugugauaaggucugcugauaaaauauuuaaccccaagaaagugaaaacuaauauaaaauu

SEQ ID NO: 337352 - RNA, 64 nt, Human
agagacagcucugcaguuucccacacugucagcuccccaagagacaguccugaugggcacaggc

SEQ ID NO: 337353 - RNA, 64 nt, Human
uguagacacucugacaagcuggccaaagucacuuccccaagaucugccagaccugcauggucaa

SEQ ID NO: 337354 - RNA, 64 nt, Human
uuaauuacaaccucuucaaagaaauaggagcaacccccaagaggcuuaauuuaccaauuuaaau

SEQ ID NO: 337355 - RNA, 64 nt, Human
uuugaaguagugccaggguccccugggaagaugcccccaagacaccugccccaaguggguggau

SEQ ID NO: 337356 - RNA, 64 nt, Human
cagaauggaggguguucugacaccccacccugagccgcaagagcaguccuggggcccuggaccc

SEQ ID NO: 337357 - RNA, 64 nt, Human
agcucuccaaggaggacgacgaguaugaggcguuccgcaagaggaugaugcuggccuaccgcuu

SEQ ID NO: 337358 - RNA, 62 nt, Human
ugaauuccaccuucccuccugcagugcugagaggcagcgaggacggagaggacagcggcauc

SEQ ID NO: 337359 - RNA, 62 nt, Human
ccgcaggcacccagugaacccgcuugggcugaggcagcgagugauucccgcgcuccggcucc

SEQ ID NO: 337360 - RNA, 64 nt, Human
aggcuugacagagucugcccccucccccacugcaccccaagagagagagccccagccagcggaa

SEQ ID NO: 337361 - RNA, 64 nt, Human
caagauguucuacucccagguugacuuuuucaagccccaagauguugagucagccauucuccaa

SEQ ID NO: 337362 - RNA, 64 nt, Human
gaauguggccacagggagcagagguuuguacuuuccccaagagguccucauccugagacggucu

SEQ ID NO: 337363 - RNA, 64 nt, Human
cguucccgggugccgagcacugccuccgggcuucccccaagaccacgcuuagcgguggcuucuu

SEQ ID NO: 337364 - RNA, 64 nt, Human
uuuuugcaccccaaguuggcuggagcaucggccaccccaagauucaucugugaccuccaggcag

SEQ ID NO: 337365 - RNA, 64 nt, Human
ggguaucuccucuucccccaacccaucuugggauccccaagaagagggaaggcaggaggggccu

SEQ ID NO: 337366 - RNA, 64 nt, Human
aucuagugauuucuuuaguagacaguuuaauuucccccaagauuaggagacacuucugugcagg

SEQ ID NO: 337367 - RNA, 64 nt, Human
cagucuggucaggaaccuugguuucuugagaggcccccaagaugccgcagcuccagggcucuuc

SEQ ID NO: 337368 - RNA, 64 nt, Human
uaaaagaagcuuuauugucuaguuguuuuuuuucccccaagacaaaggcaaguuucccuaaguu

SEQ ID NO: 337369 - RNA, 64 nt, Human
uugaugugcuugggaaagcucccucccccuccuuccccaagagaggaaauaaaagccaccuucg

SEQ ID NO: 337370 - RNA, 64 nt, Human
ccucacugagucaucaguacccuccuauucagcuccccaagaugauguguuuuugcuuacccua

SEQ ID NO: 337371 - RNA, 64 nt, Human
uuccaaauauguuaguaccuacccuuuacuuuuuccccaagaccaucucaggguggagcauucu

SEQ ID NO: 337372 - RNA, 64 nt, Human
ucaugagggcucuccccuugugauucuguccccuccccaagaccccaccucauaucaucuuaug

SEQ ID NO: 337373 - RNA, 64 nt, Human
uucuguggaaacugcacaauggggaccuguguagccccaagagaucccccacauccuccgccau

SEQ ID NO: 337374 - RNA, 62 nt, Human
aaacgaagcucauucccaacgugcaaagccaaggcagcgaccccaggaccucuucuggagau

SEQ ID NO: 337375 - RNA, 62 nt, Human
cuguauaggaacagaggugccuccgggaaggaggcagcgagguagguagcuaugauaggcac

SEQ ID NO: 337376 - RNA, 64 nt, Human
cauuagcugcagaaaaaccccccgacagagcccuggcggagaggcaggcgcuggggcuccuacg

SEQ ID NO: 337377 - RNA, 64 nt, Human
gguggcucacgccuguaaccccagcacuuugggaggcggagacgggcagauaaccugaggucag

SEQ ID NO: 337378 - RNA, 64 nt, Human
aagaaaagaaaccauaaauaucgugucauauuuuccccaagauuaaccaaaaauaaucugcuua

SEQ ID NO: 337379 - RNA, 64 nt, Human
cucccuaccaaugacuugguguccuuauuuucuaccccaagagcagggauauuagcugugucca

SEQ ID NO: 337380 - RNA, 64 nt, Human
uuuugcaccuacgggggcaucugaguccagcuccccccaagaugagcugcagccccccagagag

SEQ ID NO: 337381 - RNA, 64 nt, Human
uccuuguaaggggcagagacaggguccaccaacuccccaagaugaagaagccccuucaggccag

SEQ ID NO: 337382 - RNA, 64 nt, Human
uuucgguuccuaugagcccggggcaugaucugauccccaagacauguggaggggcagccugugc

SEQ ID NO: 337383 - RNA, 64 nt, Human
cacuccucacacacacacaccucuugaaacccuuccccaagaauguuucuuuauagacggacuu

SEQ ID NO: 337384 - RNA, 64 nt, Human
uucuuuuguuugauauuuuuucucuccaauuuaaccccaagauuucagauauucugcucuauua

SEQ ID NO: 337385 - RNA, 64 nt, Human
cguaggggugauggauggcaccggaugcuggauuccccaagaacaaguuacccucuggggugag

SEQ ID NO: 337386 - RNA, 64 nt, Human
cuguuacccgcagauccugucccaugggcucuggccccaagauguuggggggccccacggagag

SEQ ID NO: 337387 - RNA, 64 nt, Human
cggaggcagugggugcccugguuagggcugaggaccccaagauaggcugaaguccuaacuugaa

SEQ ID NO: 337388 - RNA, 64 nt, Human
uucucuuggcugguucucucauugaauuaucagaccccaagaggagauauuggaacaggcuccc

SEQ ID NO: 337389 - RNA, 64 nt, Human
gauaucaaggaauugggaaauccuggccaaaccaccccaagaugauuacacugaaauguaguau

SEQ ID NO: 337390 - RNA, 64 nt, Human
acccaagaccaaacgcaucuaaaggauccccagcccccaagaccuagccuuugucugcgauuuu

SEQ ID NO: 337391 - RNA, 64 nt, Human
uugcuuuuaucccuaaacugcauccacagagaagccccaagaaggagguuggggccagcucaua

SEQ ID NO: 337392 - RNA, 62 nt, Human
cccagucaaaaagaaagugagagaagcuguugggcagcgaaccuacuguuuaaaaucaggau

SEQ ID NO: 337393 - RNA, 62 nt, Human
caucucucagagaugugaagccagauccucauggcagcgaggcccucugcaagaagcucaag

SEQ ID NO: 337394 - RNA, 62 nt, Human
ucucacugaucacaaauggaaucaccucccugggcagcgagacgcaguugcucugggaagau

SEQ ID NO: 337395 - RNA, 62 nt, Human
cagcuccccagccaaucuguacaucccucagaggcagcgaucugaugaauugguuuuugaau

SEQ ID NO: 337396 - RNA, 64 nt, Human
uuccucagaguauggggaccugacaucuuuggguccccaagaguuggcucuuggauguggaggc

SEQ ID NO: 337397 - RNA, 64 nt, Human
gauggccaguaucauuuuacccccaccucccaagccccaagagguguaccuuuucagaugccau

SEQ ID NO: 337398 - RNA, 64 nt, Human
acccccacccugcccuguuuuuuguuuuuuuuuuccccaagaucauuagauguccucaccccuc

SEQ ID NO: 337399 - RNA, 64 nt, Human
ggccaagcugcccucccugggaaucacucagaugccccaagauguccguugggaagcucccagg

SEQ ID NO: 337400 - RNA, 64 nt, Human
auggucgguuuaggcugcugaguuuucugugcuuccccaagaaccagugggaucaaugccggcg

SEQ ID NO: 337401 - RNA, 64 nt, Human
ggugaagccaccucuagaagggacuuuggccuccccccaagaacuucccaugguagaauggggu

SEQ ID NO: 337402 - RNA, 64 nt, Human
uaagacgugaaugaaacaucauccuaacuuacuuccccaagauauugagaggucauaucuguuu

SEQ ID NO: 337403 - RNA, 64 nt, Human
auucuuuuuuagccuucccuggagaaaaacaaguccccaagaaaaaauucacucuauguagaga

SEQ ID NO: 337404 - RNA, 64 nt, Human
acuccaucuauauuucacaaaagagacuuccuuuccccaagaauuaucauggaaugucagaugu

SEQ ID NO: 337405 - RNA, 64 nt, Human
gaaaaauaacugcgccuuugccugaauaccacguccccaagaaucagaggggccacagcccuuc

SEQ ID NO: 337406 - RNA, 64 nt, Human
ugcagaagaauaaggcagcugagaaucuuguuucccccaagagaguuuuacaggcugaguguug

SEQ ID NO: 337407 - RNA, 64 nt, Human
aaccaaaaguaucccuuucccuccuuauuccucaccccaagaacauucuagaucacaugggugc

SEQ ID NO: 337408 - RNA, 64 nt, Human
auauuuccauugugaccagcagcaggcuuuuuucccccaagaagaugaucaaaacaaaggauga

SEQ ID NO: 337409 - RNA, 64 nt, Human
uccugcuaaaacugggauggaggaaucggcccagccccaagagcaacugugauuuuuguuuuua

SEQ ID NO: 337410 - RNA, 64 nt, Human
cugggccccuuccaaaugucccuccaacacagauccgcaagaguaaaggaaauaagagcaguca

SEQ ID NO: 337411 - RNA, 64 nt, Human
agaggcagcucgugugccuggcccgagcccugcuccgcaagagccgcauccugguuuuagacga

SEQ ID NO: 337412 - RNA, 62 nt, Human
cggccacgucccccugccgcaucuuugaccugggcagcgacaacgaggaggugguggcuggc

SEQ ID NO: 337413 - RNA, 62 nt, Human
ugggcgccggggaggacgauggccccgacccuggcagcgagaggagaccaggaggcuaggac

SEQ ID NO: 337414 - RNA, 64 nt, Human
agacaaaugggccugccaaacuguacaguuucuuccccaagagcuguuagguaucaaaauguug

SEQ ID NO: 337415 - RNA, 64 nt, Human
ucacccucccuuuccuuuuccccucuucuacccuccccaagaaaaagggccuucaaggcaggaa

SEQ ID NO: 337416 - RNA, 64 nt, Human
agaagauucaccggcccauggcucccaaggaggcccccaagaagcugauccgauacaucgacaa

SEQ ID NO: 337417 - RNA, 64 nt, Human
uguugccauuuugguuugggaggcuggaaaagcaccccaagagcuauuacagagacuggaguca

SEQ ID NO: 337418 - RNA, 64 nt, Human
gugggguccucaaacaucaccuuuaccugagaggccccaagaagcugagcuggcagagagcucc

SEQ ID NO: 337419 - RNA, 64 nt, Human
ucucuccuucccucccuuccuucaagauaacuggccccaagaguggggcaugggaagggcuggu

SEQ ID NO: 337420 - RNA, 64 nt, Human
gguccauccccuucccccaucccuaccacuguggccccaagaggggcgggcucagagcuuuguc

SEQ ID NO: 337421 - RNA, 64 nt, Human
uugagcuaaugacugucuccagaaaauaacugugccccaagaagugcuccagauuugcaaggaa

SEQ ID NO: 337422 - RNA, 64 nt, Human
gccccaagaagugcuccagauuugcaaggaauagccccaagagaauaccaagacaagcaggcug

SEQ ID NO: 337423 - RNA, 64 nt, Human
uucaaguucucuugauuucuuuguucccacugucccccaagaaacuaguaucucuggccuccug

SEQ ID NO: 337424 - RNA, 64 nt, Human
aauuuucuuuucuaucaguuuguauauuacuaagccccaagagacauuuccugugcuagagucc

SEQ ID NO: 337425 - RNA, 64 nt, Human
uccccaacuccccagcuccaagaguggaagaaauccccaagaucaucugggucucccucuccac

SEQ ID NO: 337426 - RNA, 64 nt, Human
ugcugcccucugcugcugacaaggugaauaacagccccaagaccagccagaggggcucugauga

SEQ ID NO: 337427 - RNA, 64 nt, Human
gaacaaagaggagccugguaaaaaacagccaagcccccaagaccucagcccaggcagaagcugc

SEQ ID NO: 337428 - RNA, 62 nt, Human
gugcacauaccucugcuagaaacuccugucaaggcagcgagagcugaugcacucggacagag

SEQ ID NO: 337429 - RNA, 62 nt, Human
ggcuggggagcggcccccagccgggacgggagggcagcgaccccgaggccucguggacgugg

SEQ ID NO: 337430 - RNA, 62 nt, Human
ggccgugggagaauggcugggcagagcagaggggcagcgauagacucuggggauggagcagg

SEQ ID NO: 337431 - RNA, 62 nt, Human
cuaacugcucccucucuccacacggagcuccuggcagcgagaacuacgcacagcugccgcgu

SEQ ID NO: 337432 - RNA, 64 nt, Human
ugaguggcucgagcccugggggugcuccuggaagccccaagagcauccaggauugccucccagc

SEQ ID NO: 337433 - RNA, 64 nt, Human
gacugugauacagagcccuagccugcccagccagccccaagaucucaggagcuuuagggagaag

SEQ ID NO: 337434 - RNA, 64 nt, Human
gaaggcacagcccauaagacuauacuugauuuugccccaagauucugacuucuggcuacauuuc

SEQ ID NO: 337435 - RNA, 64 nt, Human
gcugacaguaucagguggaucccgcuucccccucccccaagaagucagccaacacgcagcugag

SEQ ID NO: 337436 - RNA, 64 nt, Human
aauguuagaguacuugucaucuugaauauagccuccccaagagagaacagggugguauucuaag

SEQ ID NO: 337437 - RNA, 64 nt, Human
ucaaaacagcaucaaauguuucuucucuuccuuuccccaagacagaguccugaaccuguuaaau

SEQ ID NO: 337438 - RNA, 50 nt, Human
ccuuccucuuugaucuuuaaccccaagaagcaacagccagcuaaugcuuu

SEQ ID NO: 337439 - RNA, 64 nt, Human
ccaaauaaauucauaucuagauuuucaaacaaagccccaagaugaagucuaauucugaaaauau

SEQ ID NO: 337440 - RNA, 64 nt, Human
ccuacaucuccgugccacucccgccccagccuagccccaagacuuuggauccggggcgagauga

SEQ ID NO: 337441 - RNA, 64 nt, Human
cuagaaacagaaaacccaugcagggccucggacuccccaagaaggccaugaggaagccagaaau

SEQ ID NO: 337442 - RNA, 64 nt, Human
cuaaccucugcccucgcugcucuuggaauugcgcccccaagaugcucucucccuucuccaauga

SEQ ID NO: 337443 - RNA, 64 nt, Human
cucaugagcucauccaagccaagguuggaccccuccccaagaggccaacccagugcccccuccc

SEQ ID NO: 337444 - RNA, 64 nt, Human
guuguuuggagucuggggaaccagguuagugggcccccaagaagagcuuuuuauuuccuauuca

SEQ ID NO: 337445 - RNA, 64 nt, Human
augugggaacucaaauuuucauuuuuaauguaauccccaagauuuucuccaagaaauaaauugu

SEQ ID NO: 337446 - RNA, 62 nt, Human
uccucaugccuuccuggagguagaaggccaguggcagcgacugagcuggcaugaaugaauaa

SEQ ID NO: 337447 - RNA, 62 nt, Human
ucuucccaccaguccucagccaccuucuccacggcagcgaccuccgucucaaguuccgcauc

SEQ ID NO: 337448 - RNA, 59 nt, Human
agaacgacugguccgacugagcaaaggccggcggagaggccgcgugugggagcguguug

SEQ ID NO: 337449 - RNA, 64 nt, Human
cugggccgcccggguuggaagggagggcagugugggcggagaucugcuccuucggugggggccu

SEQ ID NO: 337450 - RNA, 64 nt, Human
gggacaaacauucaaaccauagcagggucauaggccccaagaaggcuuccagacagaacccggc

SEQ ID NO: 337451 - RNA, 64 nt, Human
agcuuucccgcuguuucccugccugcaaaagcagccccaagagcugcgcauuggcuucccucag

SEQ ID NO: 337452 - RNA, 64 nt, Human
uuggaagugucuguggggucuccuccucccagauccccaagaucugugucacuggucgauuuug

SEQ ID NO: 337453 - RNA, 64 nt, Human
ccugggaccacaaugggguaccugccgaggggguccccaagagauccaggcugucaugugauuu

SEQ ID NO: 337454 - RNA, 64 nt, Human
ucagccagcuucauguugcaaaucagaaagcugaccccaagacugcaaaucaaugaagguauug

SEQ ID NO: 337455 - RNA, 64 nt, Human
auaaaugaauuuuguguuuagacuuuguguccauccccaagaucucucauuuuauauauauaua

SEQ ID NO: 337456 - RNA, 64 nt, Human
cucccaccacggaccaaugccuuucccccauaggccccaagaagagcggcugucacacucauug

SEQ ID NO: 337457 - RNA, 64 nt, Human
ugggggauagaggaugccucccccacagacccuaccccaagaccccuagcccugcccccauccc

SEQ ID NO: 337458 - RNA, 64 nt, Human
uuuguccuccuuuuucucccccacucugagguuuccccaagagaaccagauuggcagggagaag

SEQ ID NO: 337459 - RNA, 64 nt, Human
uucacuccuuauccgagggcaaauucacaaggauccccaagauccacuuuuagaagccauucuc

SEQ ID NO: 337460 - RNA, 64 nt, Human
uuaagcauuuucagauguggugguuguauuuuugccccaagaaguguuuggauaaccacacaaa

SEQ ID NO: 337461 - RNA, 64 nt, Human
caauaaaaugaccuaucagaaaguagaauuucauccccaagaguauuucaguuuauccaauauu

SEQ ID NO: 337462 - RNA, 64 nt, Human
cacaccauacaggccaaauuauagaaucccccaaccccaagacacugcacccuaugggcuauac

SEQ ID NO: 337463 - RNA, 64 nt, Human
cagcacaccaccaggcuccacacgugcaugcuuuccccaagagggaauggacuguacauugcuc

SEQ ID NO: 337464 - RNA, 62 nt, Human
ugcucaucucacugcccagugaagggggcaagggcagcgaggggcaggaccccugcugcuca

SEQ ID NO: 337465 - RNA, 62 nt, Human
agaggguguuuauguaaaacuaaaugagugcaggcagcgagcuacacuuuuuuuuuuccuaa

SEQ ID NO: 337466 - RNA, 62 nt, Human
cugcccagcuuugcccaacuguugcuucuuggggcagcgaacugagcccuggggcugcugcu

SEQ ID NO: 337467 - RNA, 62 nt, Human
gaagagagaguuuauuuagucaacuggcccaaggcagcgaggcuucuacagucccacacccc

SEQ ID NO: 337468 - RNA, 64 nt, Human
uaaagguggccacaaauucuuugacacucaagucccccaagaccuaaggguuuuaucuccuccc

SEQ ID NO: 337469 - RNA, 64 nt, Human
ucccaaggccccgcagcuuccucccccgaccaaaccccaagaccuggaucccaggagacaacag

SEQ ID NO: 337470 - RNA, 64 nt, Human
agucacacccuagccacugcugggaccuuguguuccccaagaguaucugauuccucugcugucc

SEQ ID NO: 337471 - RNA, 64 nt, Human
cucguuccaaagggaaaaacucggaugaagaagcccccaagacugcccagaagaaguuaaagcu

SEQ ID NO: 337472 - RNA, 61 nt, Human
aaaacacaucggaaucaugacagcaagauaaccccaagacagucuuuuaucaaguuuugac

SEQ ID NO: 337473 - RNA, 64 nt, Human
gcuuccugauccaauggugccaaacccuucaucuccccaagaagcgcagcauaccccugggacc

SEQ ID NO: 337474 - RNA, 64 nt, Human
cauauuggcaacacccccagcgccaccccaugcuccccaagaacgcggcucugcgcuggaaggc

SEQ ID NO: 337475 - RNA, 64 nt, Human
ggcgcuacauuaauuucaagaugucuccuggcuuccccaagaagcugaauaggguagaaccuaa

SEQ ID NO: 337476 - RNA, 64 nt, Human
gaaaggcaauauuuaugaagggcagaagaggcagccccaagaaccuaaagacugcaggcugcua

SEQ ID NO: 337477 - RNA, 64 nt, Human
aacaggaugguguuuacuuuguucaccuggauguccccaagacucuagcuucuucuaucagugg

SEQ ID NO: 337478 - RNA, 64 nt, Human
accgcucuguuuauagugacccacccuagaucuuccccaagagggacugggguuucuggggucc

SEQ ID NO: 337479 - RNA, 64 nt, Human
aagaaaauaauuuuccuuguaaaaucgggccaaaccccaagacagcuacauuuucaacaaaaaa

SEQ ID NO: 337480 - RNA, 64 nt, Human
uccuuugucuacagagagaaaaauugccuucaucccccaagaggaugcggugaaguuuaaacuc

SEQ ID NO: 337481 - RNA, 64 nt, Human
ucaucuuuuuguugcuguuuucccagaugcuuauccccaagaaacagcaagcucaggucugugg

SEQ ID NO: 337482 - RNA, 64 nt, Human
gaucagaaaugagguguaauuccccaaccccugcccgcaagagcuaaguaggaucuuacuguaa

SEQ ID NO: 337483 - RNA, 64 nt, Human
ccacccggcccacaggcauguuucugccgccacuccgcaagauggacagggagccagcaggcag

SEQ ID NO: 337484 - RNA, 62 nt, Human
ggggaccuucccugggggacggggagggaggaggcagcgacuccuuggacagaggccugggc

SEQ ID NO: 337485 - RNA, 62 nt, Human
uagguggccauggugaaggugucaguggcggcggcagcgauggcaagcaggcggcguugcug

SEQ ID NO: 337486 - RNA, 64 nt, Human
accauggccucugcaagccucuccuccaccuucaccccaagacuaggggcaggaaugauaagaa

SEQ ID NO: 337487 - RNA, 64 nt, Human
uauuuacaaauuccuugcaacuagagcgcuccuuccccaagauaugguagugagaguaauuuuu

SEQ ID NO: 337488 - RNA, 64 nt, Human
auggcuuaggucaaggcgcgcucagaugccggagccccaagacucugcucuccucgggcccugu

SEQ ID NO: 337489 - RNA, 64 nt, Human
ggcggggguggcaggugucccccccugguccccgccccaagagccugcugucuguauggaggag

SEQ ID NO: 337490 - RNA, 64 nt, Human
caguauggaagucccgguggucuccccaagaaguccccaagacaaucucgccaaaggcaccucc

SEQ ID NO: 337491 - RNA, 64 nt, Human
uggcaucuccccaguauggaagucccgguggucuccccaagaaguccccaagacaaucucgcca

SEQ ID NO: 337492 - RNA, 64 nt, Human
caaugggacuggagucagaugagcaaggacauugccccaagauaggggcacacuacagagcagc

SEQ ID NO: 337493 - RNA, 64 nt, Human
cuaaagcugagucaauggggcuauugucugaggaccccaagagcagugauucagagaacagugu

SEQ ID NO: 337494 - RNA, 64 nt, Human
guccugccugcccagucccuucacugcuuuccugccccaagauggcuugcuuuucacaaauaaa

SEQ ID NO: 337495 - RNA, 64 nt, Human
gccuguuuggccucucuauccucucuuccucuucccccaagauugagcucucugcccuugauca

SEQ ID NO: 337496 - RNA, 64 nt, Human
gcuacaaaugaaguccuucuccaaaugcauugagccccaagaaaaaucgcugauucugaggaac

SEQ ID NO: 337497 - RNA, 64 nt, Human
aaagccuucauuuuaacagauggggaaagugagcccccaagaugggaaagaaccacacagcuaa

SEQ ID NO: 337498 - RNA, 64 nt, Human
aggcuguucugugucugaacccaguugggcuaguccccaagaggagcugagagccauguacucu

SEQ ID NO: 337499 - RNA, 64 nt, Human
cuggccauccacuucuuuuucacuucauguucuaccccaagagacucccgaugucggcugugga

SEQ ID NO: 337500 - RNA, 64 nt, Human
agaaaaugacuuauuucugcucuggaauaaaguugcagaugauucaaaccgaucuuggcuuuca

SEQ ID NO: 337501 - RNA, 64 nt, Human
uuagccgggccacccccucugaaggugaaacugagcagaugaggccacagaagcacaaggggaa

SEQ ID NO: 337502 - RNA, 64 nt, Human
ucucuccaccuccagaggcuuggaagggaacagggcagaugaggcccuucacccaccaucuacg

SEQ ID NO: 337503 - RNA, 64 nt, Human
gggcagggguuuguccuugcaggacagggugcaggcagaugaccuggugaagaugcucuucagc

SEQ ID NO: 337504 - RNA, 64 nt, Human
guucucagauuguaguuugcaauccccugggguuccccaagacccuuucagagguuugaggguc

SEQ ID NO: 337505 - RNA, 64 nt, Human
gucaggugggcgaugccaacauuaauacucaggaccccaagauacagaaggaaaucaugcgugu

SEQ ID NO: 337506 - RNA, 64 nt, Human
guaccauguggccacaacugcuguggcccccuguccccaagacacuuccccuugucucccuggu

SEQ ID NO: 337507 - RNA, 64 nt, Human
uggccugcccugauccucugcuuccuccucacaaccccaagagcccccagcccgguccauccac

SEQ ID NO: 337508 - RNA, 64 nt, Human
uggccaggagcaggcacgggugguccccguuccaccccaagagaacucgcgcucaguaaacggg

SEQ ID NO: 337509 - RNA, 64 nt, Human
ucaccuacuacuuggacuggauccaccacuauguccccaagaagcccugagccaggccuggggu

SEQ ID NO: 337510 - RNA, 64 nt, Human
acaaagcgggggcaggggaaagacaccacccucgccccaagacuggggauccuggccacuguuc

SEQ ID NO: 337511 - RNA, 64 nt, Human
ggccugguagagaagauggcacaggauggaggcgccccaagacggacaguguacauaagaguuu

SEQ ID NO: 337512 - RNA, 64 nt, Human
gaacugccuuccauucaauggggaacccuucuauccccaagaaccccuucccugcuugcacccu

SEQ ID NO: 337513 - RNA, 64 nt, Human
ccguuucuucugcauagccuggaucuccucaaguccccaagauucacaccugacucugaaaucu

SEQ ID NO: 337514 - RNA, 64 nt, Human
ugggcguggggggggcuguccuggcucugcugucccccaagagggugcuucgagggugaggacu

SEQ ID NO: 337515 - RNA, 64 nt, Human
uuccauguacauauuuaucaccccuuucacauagccccaagaccuuuuguacauuuuuacaggg

SEQ ID NO: 337516 - RNA, 64 nt, Human
cuuucaugcuuuuccagugggaucaagcccuuuuccccaagagucccaucucuucugccaugca

SEQ ID NO: 337517 - RNA, 64 nt, Human
auuuuuggaaggggacacgugacagccguuuguuccccaagacauucuagguuugcaagaaaaa

SEQ ID NO: 337518 - RNA, 62 nt, Human
gcagcggaaacgccgugcaucucuugucuguuggcagcgagcacaucgugcuggagacacga

SEQ ID NO: 337519 - RNA, 62 nt, Human
uggacuuuguggaggaggcaccaagugucucaggcagcgaggaaauuggaggccauuuuuca

SEQ ID NO: 337520 - RNA, 62 nt, Human
acucccagagcuaccucuugggggagcgugguggcagcgaugauggggagacgccuggaagc

SEQ ID NO: 337521 - RNA, 62 nt, Human
auccuccaaagggccugggcccgccccgagggggcagcgagaggagcuuccccauccccggu

SEQ ID NO: 337522 - RNA, 64 nt, Human
agggaggagugagacuuaucagaugggacgcuugccccaagacugugggauaaaccaccauugc

SEQ ID NO: 337523 - RNA, 64 nt, Human
aggccguguccaugugugacagcagaaccacaugccccaagaccccagggcuucccccaaaauu

SEQ ID NO: 337524 - RNA, 64 nt, Human
ggcuccuccgugcuucucuccuaaguucucugcgccccaagaacucgagguugugccuugcucu

SEQ ID NO: 337525 - RNA, 64 nt, Human
guguccugguuugacagcauguucaacgagggaaccccaagacggacccacacagguccaccca

SEQ ID NO: 337526 - RNA, 54 nt, Human
augaacaagccgugcagugaggacccccaagaggcccauuucccccaauaaaag

SEQ ID NO: 337527 - RNA, 64 nt, Human
cuugcugugcuggcuuugcaacaagacagacuguccccaagaguuccugcugcugcugggggcu

SEQ ID NO: 337528 - RNA, 64 nt, Human
gaggggugggagcaugggaagggaggcaucccacccccaagaagaacugaauaaagauugcuga

SEQ ID NO: 337529 - RNA, 64 nt, Human
uguugagcccagaucucaugugcuacgaaggaaaccccaagacccagagaggaagggucaaccu

SEQ ID NO: 337530 - RNA, 64 nt, Human
uuuuggccaccuggggccgcccccaaccuccccaccccaagaggggucugagugggaccucaaa

SEQ ID NO: 337531 - RNA, 64 nt, Human
uucuuguuaugccuuccaucacagcccaggcucaccccaagaacuccaggcuccccuaaagaau

SEQ ID NO: 337532 - RNA, 51 nt, Human
aguaugaaguuuccaucugaaccccaagacuacagcugcaggacccaggac

SEQ ID NO: 337533 - RNA, 64 nt, Human
uuccuucuccccuggaaaaccugcucacuucugaccccaagacagcccccuccccuucccucug

SEQ ID NO: 337534 - RNA, 64 nt, Human
ggccaacagcuugugguccccgaucugccuccagccccaagaugccuacagcccccaggccccu

SEQ ID NO: 337535 - RNA, 64 nt, Human
cagaguuugcaaguugcuuuaucucccacgggcuccccaagaaccuccaaccccgaggcuuauc

SEQ ID NO: 337536 - RNA, 62 nt, Human
aaacacuccguggcugagaggcagcggauccaggcagcgaugcugagccaccuccuccgagc

SEQ ID NO: 337537 - RNA, 62 nt, Human
gcuguggggcaggcugggcagggggcugagcuggcagcgauucagagcccuggggcuggggg

SEQ ID NO: 337538 - RNA, 62 nt, Human
acaguccaauggaggaggcagauguguccucaggcagcgacugggcagggcugguauagggg

SEQ ID NO: 337539 - RNA, 62 nt, Human
ccuccauucagguggaggucccgagugggcggggcagcgacugggagaugggucggucaccc

SEQ ID NO: 337540 - RNA, 64 nt, Human
uucaaccaaucccuucacacucucucccccauccccccaagauacacacuggacccucucuugc

SEQ ID NO: 337541 - RNA, 64 nt, Human
uaaaaguagcaguagccacuugguucuuagggggccccaagaggagaggagaagugcugagguu

SEQ ID NO: 337542 - RNA, 64 nt, Human
aucccaguauaaucucuguuaaucaacaggacuaccccaagaacccaugugcucucccgaguaa

SEQ ID NO: 337543 - RNA, 64 nt, Human
gacacuaagaggaggcaggaggagcaacucaaauccccaagaacacaagaagacccauccugaa

SEQ ID NO: 337544 - RNA, 64 nt, Human
agguccacccauuucccucauggggaucccgaggccccaagaggggcagauuccccucacagcu

SEQ ID NO: 337545 - RNA, 64 nt, Human
cgggguacacaagaggggaugaguugugugaauaccccaagacucccaugagggagaugccaug

SEQ ID NO: 337546 - RNA, 64 nt, Human
ccuccugagugaucccauuucuuaaucaguguagccccaagaaggcuggggcuauuuaccaggg

SEQ ID NO: 337547 - RNA, 64 nt, Human
caguguuuggaaaucuuucuacaggcaauuaccuccccaagagaagccuuccuuauuuuggagu

SEQ ID NO: 337548 - RNA, 64 nt, Human
ugugugucuccacgcgcugaugguggaaugggagccccaagacgugugggcuuagaaaucaacu

SEQ ID NO: 337549 - RNA, 64 nt, Human
uuccuggcccgcacccccauccccagucccuguuccccaagaggauacagagcacggugcuggc

SEQ ID NO: 337550 - RNA, 64 nt, Human
ucuguuugcaggcaaaugcuucagcucacaugucccccaagacucaauagucuugguugggacu

SEQ ID NO: 337551 - RNA, 64 nt, Human
agaggcagaugagguuccugccuacugugugccaccccaagaagguagccccccaacagcccac

SEQ ID NO: 337552 - RNA, 64 nt, Human
gcaaauguuuuagccaggggucccugcagccauuccccaagaacguacaaaaguuaagcuccau

SEQ ID NO: 337553 - RNA, 64 nt, Human
ggggacagccccucguguccagaaccuuccauacccccaagacagugucuugucuuucugugau

SEQ ID NO: 337554 - RNA, 64 nt, Human
uacgguuuuggaccuauauuguucacguuuugauggcggagaggggugguccuggaggcccaau

SEQ ID NO: 337555 - RNA, 64 nt, Human
acaugccuguaaucccagcuacucaggaggcugaggcggagaauugcuugaacccggaaggugg

SEQ ID NO: 337556 - RNA, 64 nt, Human
uuuaagacaaauucauauucuuuuauuuguuauggcagaugacaagaugguacaaccuuuauuc

SEQ ID NO: 337557 - RNA, 64 nt, Human
caugccuguaaucccagcacucugggaggccaaggcagaugaucaccugaggucaggaguucua

SEQ ID NO: 337558 - RNA, 64 nt, Human
cccuacugcaguaaacugaagacaagaucucuucccccaagaaaaaguguacagacagcuggca

SEQ ID NO: 337559 - RNA, 64 nt, Human
accuugcccagccgugguggcccccaggccugguccccaagagcuuuggaggcuuggauuccug

SEQ ID NO: 337560 - RNA, 64 nt, Human
ucugaggcuuuggggccccuuaguugucccgaaaccccaagaaaaaucagaaugaggagaguca

SEQ ID NO: 337561 - RNA, 64 nt, Human
uccccucuaaggccgaagaaggguccuucccucuccccaagacuugguguccuuucccuccacu

SEQ ID NO: 337562 - RNA, 64 nt, Human
cccaugggugguggggugugagaagccugcaauaccccaagaccccagagggcaguccuuagga

SEQ ID NO: 337563 - RNA, 64 nt, Human
aaaauacagcaggcagaacucuccuuggauaauuccccaagaggucccaaggauugggagcaug

SEQ ID NO: 337564 - RNA, 64 nt, Human
uugggcucacacucucacugagccuugcugguggccccaagacacgcaaugucaggccauggcu

SEQ ID NO: 337565 - RNA, 64 nt, Human
cugucucagcgggcagugcccagagcccacgcccccccaagagcccucgauggacagccucacc

SEQ ID NO: 337566 - RNA, 64 nt, Human
ggcucugugcuguaacuggagagacuguuccaaaccccaagaguugucugauccuagucuguuc

SEQ ID NO: 337567 - RNA, 64 nt, Human
ggaauuauagaccucuaguagcugaaaugcaagaccccaagaggaaguucagaucuuaauauaa

SEQ ID NO: 337568 - RNA, 64 nt, Human
cacucccucacucaccgaucaaaaccugcuaccuccccaagacuuuacuagugccgauaaacuu

SEQ ID NO: 337569 - RNA, 64 nt, Human
ccaccugcccuggcuagcaugcugcugggccacaccccaagaucaggggcccuggggacggcaa

SEQ ID NO: 337570 - RNA, 64 nt, Human
uuuuuuuuuuaacagguaacuuucgaccgacuuuccccaagagaaaauuccuagaaauugaaca

SEQ ID NO: 337571 - RNA, 64 nt, Human
gcugagcgcuggccucuggguugccucuugauuaccccaagacagacacaaagggcagaaggug

SEQ ID NO: 337572 - RNA, 62 nt, Human
gucggagcacauguguggcacccgcucccucuggcagcgaauguaggaagucgccaaauuua

SEQ ID NO: 337573 - RNA, 62 nt, Human
ggcugcgcggaggccguggcacaccugcgggaggcagcgacggcccccacgcagacgccggg

SEQ ID NO: 337574 - RNA, 62 nt, Human
caccugcccaggggcuguucagagcuggcaauggcagcgacagcagcaacagcagcagaucc

SEQ ID NO: 337575 - RNA, 62 nt, Human
auuuuaacugacagcuuuccuuuggggugccaggcagcgaggccccccaccccuauccugcc

SEQ ID NO: 337576 - RNA, 64 nt, Human
ccagcaaguccucuggcaagccggaggacgcagcccccaagaccagcggacagcgccagaagga

SEQ ID NO: 337577 - RNA, 64 nt, Human
ucccaguugggcgucccggagcucagggacugagccccaagacgccucuguaaccucgcugcag

SEQ ID NO: 337578 - RNA, 64 nt, Human
gcuggauuaguuccuuugauauuuguaaaaauucccccaagagccgcauaugaaucugcccuuu

SEQ ID NO: 337579 - RNA, 64 nt, Human
ggggaggguggcagguauaagacuucugggggcaccccaagaccccagacacccaaguggcauc

SEQ ID NO: 337580 - RNA, 64 nt, Human
ugggguccucauuaggagcccccaucccuguguuccccaagaauucagagaacagcacuggggc

SEQ ID NO: 337581 - RNA, 64 nt, Human
cacccuccgcuggcucgggaagacaccgugcccgccccaagagcaagcaccggccaugcugcag

SEQ ID NO: 337582 - RNA, 64 nt, Human
acaucuguccccaagccagcuccacugcccaggcccccaagagggcagcuccagaagcugccca

SEQ ID NO: 337583 - RNA, 64 nt, Human
cuacagcccuuccuagcagaguuuauccauucguccccaagagcagcuagaagagauuugaggu

SEQ ID NO: 337584 - RNA, 64 nt, Human
ggugggcaccggaaaggaggggacuucuccugcaccccaagaagugguggggagauugcugccc

SEQ ID NO: 337585 - RNA, 64 nt, Human
gagccaagcccccagccccgaucugcagauccugccccaagaagcugggguggugggggcagua

SEQ ID NO: 337586 - RNA, 64 nt, Human
ggcuaacgucugucccccugaaccccuaaccauaccccaagagcucccaaagccugagaccagg

SEQ ID NO: 337587 - RNA, 64 nt, Human
aaggcaggcucuggccccuuuccaugccaaagucccccaagaucuggauaucuggggacaagau

SEQ ID NO: 337588 - RNA, 64 nt, Human
ugucuuacccacuaugccccucucuagucaugguccccaagaggggcuuggagacccacuuagc

SEQ ID NO: 337589 - RNA, 64 nt, Human
gaaaaaauuaauaaauuccuugaaagauauaaccccccaagauugaaccaagaagaaauugcau

SEQ ID NO: 337590 - RNA, 64 nt, Human
augggagaagaaggaaggggguggcccgucacccccgcaagacuugcauccagguagccuaagg

SEQ ID NO: 337591 - RNA, 64 nt, Human
uuauuuucacacauuuaauuccuauuaaguacagccgcaagaaagaaaaaaugaugaaguugca

SEQ ID NO: 337592 - RNA, 64 nt, Human
aagccgggagggucgagccgaagucuccggcgggccgcaagaggagaagggggcguggcugcgu

SEQ ID NO: 337593 - RNA, 64 nt, Human
cacaguggugacggcaggauggcccugcucagcaccgcaagagccauggcugucccuguuggcc

SEQ ID NO: 337594 - RNA, 64 nt, Human
caaccaccgagcccuuugaccuucuccauuguacccccaagaucuuuuugccccaucuccuaga

SEQ ID NO: 337595 - RNA, 64 nt, Human
ucugcugcuuuaggauuggcacagcuagagaaguccccaagaugcagcaaggagguaaauacau

SEQ ID NO: 337596 - RNA, 64 nt, Human
gagugcugaaagaaccucccccaggucauccuauccccaagagugaugcccggcagcauuccca

SEQ ID NO: 337597 - RNA, 64 nt, Human
ggcuccucucugacacgccuuuaggcgaaacaugccccaagacacagggaccguuucuccccua

SEQ ID NO: 337598 - RNA, 64 nt, Human
gcuucagggaccccagaagugccuuccaagcuucccccaagauccacaucacccacgacccugc

SEQ ID NO: 337599 - RNA, 64 nt, Human
accccccccccaccgaggccuaggccccugccacccccaagacugggaggggacuucuuuuucu

SEQ ID NO: 337600 - RNA, 64 nt, Human
agccacagcacccaaccuuuuuuuccccgccgcaccccaagauggugucucacucuguugcccc

SEQ ID NO: 337601 - RNA, 64 nt, Human
gacaucguugcugccgccgugacugguuuucuguccccaagaacgugacguucgugauguccug

SEQ ID NO: 337602 - RNA, 64 nt, Human
gcggagaggaccccauucugggacugcucaggcuccccaagacuugacgcagccccccacgcuu

SEQ ID NO: 337603 - RNA, 64 nt, Human
ccccaccaagcacccuuccacuuccaucugggagccccaagaggggcugggaaggggggccaua

SEQ ID NO: 337604 - RNA, 64 nt, Human
agguuagcaauugggaauggcugggaggggguguccccaagacacugggcuucaaaucuccccc

SEQ ID NO: 337605 - RNA, 64 nt, Human
agccccgccugacauggaacagaacggagccaucccccaagacccuguccaaggcccagauguu

SEQ ID NO: 337606 - RNA, 64 nt, Human
agccccgauucaccaucucuccuccauuuuuccuccccaagaauagcuggcaucucuucucccu

SEQ ID NO: 337607 - RNA, 64 nt, Human
gaggucccuggaaugaguguggguagccguaaguccccaagacauggggacuuugcagugagca

SEQ ID NO: 337608 - RNA, 64 nt, Human
uaguccaaguagaggguggggcacccuuuucucgccgcaagaagcccauuccuauggaagucua

SEQ ID NO: 337609 - RNA, 64 nt, Human
uucugcccagcccucuguggccaggagcccuggcccgcaagagggacagagcccgggagagacu

SEQ ID NO: 337610 - RNA, 64 nt, Human
uuucagauacucugaccaaaaagccugcuuuaaaccgcaagauggggccugggcaugcgcagga

SEQ ID NO: 337611 - RNA, 64 nt, Human
cccaggcgcgguugaccugccccugcuguaacacccgcaagaaggaugcaguccuuaccaagug

SEQ ID NO: 337612 - RNA, 64 nt, Human
acagcgaagacuugaguuccuccaagucccagaaccccaagaaugggcaagaaggaucagguca

SEQ ID NO: 337613 - RNA, 64 nt, Human
ggggcuccaguggggcccgccuaauuuuuuuuccccccaagacagggccuugcucugucuccca

SEQ ID NO: 337614 - RNA, 64 nt, Human
aacagcugaacucugagcuugugcccagaaauuaccccaagaccacaggaacccuucaagaagc

SEQ ID NO: 337615 - RNA, 64 nt, Human
ucggccaggugaggucagcagccugggagagugcccccaagagaugagggcaccccguguuccu

SEQ ID NO: 337616 - RNA, 64 nt, Human
ucccuggggaucugcauuucuaacaggcuccugcccccaagacugcucugguggaaaauccagc

SEQ ID NO: 337617 - RNA, 64 nt, Human
uauaucucucucuuuuucacucucuuccucccacccccaagacugaguuuuggggggcaaggug

SEQ ID NO: 337618 - RNA, 64 nt, Human
gcugcuucucuuggggcccucucagagucuaucuccccaagacaggaagggaaaagcaaauuuc

SEQ ID NO: 337619 - RNA, 64 nt, Human
ggagaagaaauccauaacacccccaccccaacacccccaagacagcagucuucuucacccgcug

SEQ ID NO: 337620 - RNA, 64 nt, Human
gucuugucugugaucuuuguucuugaccucuagaccccaagaugugaacagugcacguguuaau

SEQ ID NO: 337621 - RNA, 64 nt, Human
agggcuacagagaaccugaauucaacccauguguccccaagagauucagagaaaagaggucaau

SEQ ID NO: 337622 - RNA, 64 nt, Human
uacagagcuguucuaaaugguaaauccucaauuuccccaagaccgguugcucugagaguagcug

SEQ ID NO: 337623 - RNA, 64 nt, Human
gagaacgaucuuagugcuggaauggggaggggcuccccaagauggccuggagaccacccagccc

SEQ ID NO: 337624 - RNA, 64 nt, Human
auagggagaugcaggaagugggggcccauggggcccccaagaagcggacucuccaagggguacc

SEQ ID NO: 337625 - RNA, 64 nt, Human
gccuaugucugugaggaaggggcccugccacucuccccaagagggccuccauguuucgaggugc

SEQ ID NO: 337626 - RNA, 64 nt, Human
cagcucuuggucacugagugauugaguuagggcuccgcaagagacuuuggggagugaaguggau

SEQ ID NO: 337627 - RNA, 64 nt, Human
ccaggaaggggccauagguaggucugaacaacugccgcaagaccacuacaugacuuagggaacu

SEQ ID NO: 337628 - RNA, 64 nt, Human
guggagggaacccaggauccugaaauucuccuggccgcaagaacuccccacagaggcagaagag

SEQ ID NO: 337629 - RNA, 64 nt, Human
cucggcccucccagucccucgcugcacaaauacuccgcaagagaggccagaaugacagcugaca

SEQ ID NO: 337630 - RNA, 64 nt, Human
ugcuguggauaucaaggaaauaauaaagcagaaaccccaagaaauuugcaacuuaacaguuuga

SEQ ID NO: 337631 - RNA, 64 nt, Human
ccuuggaaacaguuggcacuguaaggugcuugcuccccaagacacauccuaaaagguguuguaa

SEQ ID NO: 337632 - RNA, 64 nt, Human
gguggccauuuagggaucguggggacgggguccaccccaagaagaaagaaaggcccguccacag

SEQ ID NO: 337633 - RNA, 64 nt, Human
ggauucaugaggaaagagaaauccugggguuggaccccaagacgacguacaacagguucugcgg

SEQ ID NO: 337634 - RNA, 64 nt, Human
ggaccaggccauccuuggcuccagagcucgaagaccccaagacagcccucugcucucagcggcg

SEQ ID NO: 337635 - RNA, 64 nt, Human
ggcuucacauuuaugacccugagaacagacugacccccaagaucuccuucccguggaaugaaau

SEQ ID NO: 337636 - RNA, 64 nt, Human
aacccuuugcugcuggggaggcuggaagcauauuccccaagagcacugcccugggcaucaucuc

SEQ ID NO: 337637 - RNA, 64 nt, Human
ggccucacccuagccagccuggguggcucccuagccccaagaggccaggaagggcuggaaggca

SEQ ID NO: 337638 - RNA, 64 nt, Human
cugucuugcaugugacaauugacaaucuggacuaccccaagauggcacccaaguguuuggcuuc

SEQ ID NO: 337639 - RNA, 64 nt, Human
ugacugucuaggaggaucccuugccuuguaggugccccaagaccgcaggguagaaaucagccgg

SEQ ID NO: 337640 - RNA, 64 nt, Human
acuuccccaugcugugggaaggggugcaguucguccccaagaacgacacugccugucagguggu

SEQ ID NO: 337641 - RNA, 64 nt, Human
ccuccaggaauaaccccucccugagacauaguguccccaagaccacagugugccuuggacauca

SEQ ID NO: 337642 - RNA, 64 nt, Human
ucaccccaagcaccugcuggcugcuggaagcauaccccaagaccccaagccuugacuccagcug

SEQ ID NO: 337643 - RNA, 64 nt, Human
gccguccuugucauuaguggucauaugaaaauggccccaagaaggagaugauucuuucaaggga

SEQ ID NO: 337644 - RNA, 62 nt, Human
uuccagcugucaggcaucacugcggcuaguccggcagcgaccuagaugggguccacccccau

SEQ ID NO: 337645 - RNA, 64 nt, Human
uggcuuccugguccccuugagucaucaccagcuuccccaagagagugucagaaucuuaagagcu

SEQ ID NO: 337646 - RNA, 64 nt, Human
gugggcugggaaugggggagagaagggaaaagauccccaagacccccuggggugggaucugagc

SEQ ID NO: 337647 - RNA, 64 nt, Human
cccccaguucacgauucuggcgcggacuucgcucccccaagacaacacucggaagccagggccc

SEQ ID NO: 337648 - RNA, 64 nt, Human
ccacugcaucccauccugaauauccuuugcaacuccccaagagugcuuauuuaaguguuaauac

SEQ ID NO: 337649 - RNA, 64 nt, Human
uccagcccagaaggaaaggggggcagcucaguggccccaagagggagcugauaucaugaggaua

SEQ ID NO: 337650 - RNA, 64 nt, Human
uccggcgcguguggccgcugggcacuuggcaccuccccaagagcuuccacuugguuuggucccc

SEQ ID NO: 337651 - RNA, 64 nt, Human
cuugcuuagcuccccucacccugcacugaacauaccccaagagccccugcuggcccauugccua

SEQ ID NO: 337652 - RNA, 64 nt, Human
acugcuacagcugcuccccucccgccaaacaaaaccccaagagagcaaugccccuaccacccaa

SEQ ID NO: 337653 - RNA, 64 nt, Human
gucugucacguccagucccgagacggcugagugaccccaagaaaggcuuccccgacacccagac

SEQ ID NO: 337654 - RNA, 64 nt, Human
ggcauggcugccuugauguaacauaauucucuguccccaagauuuagaaaauuccucuucguuc

SEQ ID NO: 337655 - RNA, 64 nt, Human
acgugcccccuagccuuacugggaaccuucugucccccaagauccccugugcuaucaggaaagc

SEQ ID NO: 337656 - RNA, 64 nt, Human
gguuaggacaucucccccaccuccccacuuuuuuccccaagacaagacaaucgaggucuggcuu

SEQ ID NO: 337657 - RNA, 64 nt, Human
aggccuccagcucagcagugacuguggccaugguccccaagaccucuauauuugcucuuuuauu

SEQ ID NO: 337658 - RNA, 64 nt, Human
caugaaugauaagcuguuucugagggaugccagcccccaagagacucagagugccuucuccauc

SEQ ID NO: 337659 - RNA, 62 nt, Human
ugccuuuggcuuugaucucaagucaggcugaaggcagcgaagccucggggcccaagccccuc

SEQ ID NO: 337660 - RNA, 62 nt, Human
agccucccucugaccugcaggccaagagcagaggcagcgaguuguggaaagccucugcugcc

SEQ ID NO: 337661 - RNA, 62 nt, Human
aaaugcagcugugauuuguugcugggagcggcggcagcgagucccugcaacagcaauaaacu

SEQ ID NO: 337662 - RNA, 64 nt, Human
gauguggaggcccagggaauagacccucaagagcccccaagagacaggagagacuccgaacucc

SEQ ID NO: 337663 - RNA, 64 nt, Human
agcucaauuucugggccugaggugcucagacugcccccaagaucaaaucucuccuggcuguagu

SEQ ID NO: 337664 - RNA, 64 nt, Human
ugagguuccauaugauaauucuuuacaccuccccccccaagagaaaguacacagggcuauucug

SEQ ID NO: 337665 - RNA, 64 nt, Human
accccacucagcuccaggcaguguucugccgagaccccaagaacucggggugucagagggcaaa

SEQ ID NO: 337666 - RNA, 64 nt, Human
uucaggcuucucagguguuucuagacccccgacuccgcaagagugaggaugaugggagcugguc

SEQ ID NO: 337667 - RNA, 64 nt, Human
cuggugccccugcugauguggccugcucugugcgccgcaagaagccaggcccggcccuggccuu

SEQ ID NO: 337668 - RNA, 64 nt, Human
ucauuuauucguucauuuagcaaauaugcagccuccgcaagaugagcucuccugcagacaagca

SEQ ID NO: 337669 - RNA, 64 nt, Human
uucauuuugaagaaaagccacagaagauacacuuccgcaagauaucuucauuuuaaaguaaagu

SEQ ID NO: 337670 - RNA, 64 nt, Human
ucuuucgaaaccuacuuuuuggugcacaaacaugccgcaagacugagcuacuuuggcguggagu

SEQ ID NO: 337671 - RNA, 64 nt, Human
ggugggaaaguuaauuauuauuauucuggaaauaccgcaagauuauguuuucuguuuccagggu

SEQ ID NO: 337672 - RNA, 64 nt, Human
aaaaaagcacauaacuuuuaacacuagaaucagcccgcaagaugcuugccccgcuaguggcaga

SEQ ID NO: 337673 - RNA, 64 nt, Human
acaauccuagacugagacgcagucaggcgcacgcccgcaagaggcggcgaggugacaaguuugg

SEQ ID NO: 337674 - RNA, 64 nt, Human
cccugcggccccugcugccgcugcgcugucccggccgcaagagcggggccgccccgccgagguu

SEQ ID NO: 337675 - RNA, 64 nt, Human
ccuuccugaaaguuuuaaagaaagcaggagcuggccgcaagacucuaggccuccuucauagccu

SEQ ID NO: 337676 - RNA, 64 nt, Human
gaagaacucccuuuggcuacuuuugaaaaucaagaugagauauauagauauauauccauacauu

SEQ ID NO: 337677 - RNA, 64 nt, Human
aucauauuugaaaaccauauuuuauuguauuuugaugagauauuaaauucucaaaguuuuauua

SEQ ID NO: 337678 - RNA, 64 nt, Human
aauuaauauaaaugaccaaaaguaacuuaaaagcaugagauauuugcuauuucauucauugggc

SEQ ID NO: 337679 - RNA, 64 nt, Human
uucugugacaucuuuuuaaaccacuggaggaaaaaugagauauucucuaauuuauucuucuaua

SEQ ID NO: 337680 - RNA, 64 nt, Human
guuguaaggaaacguguuucaaucaaaacugaccaugagauaaaggaaagagauguggcuuuug

SEQ ID NO: 337681 - RNA, 64 nt, Human
cuucauggaugucauacccaugaagugcauuuggaugagauagaagaaauuguuuuuuaaaaag

SEQ ID NO: 337682 - RNA, 64 nt, Human
ggugguuuuauuauaugcaaaaucucugucuauuaugagauacuggcauugaugagcuuugccu

SEQ ID NO: 337683 - RNA, 64 nt, Human
caccugcuacuuacacauuuccucuuuuggaaaaaugagauacuuagaauaacaagaaaauuaa

SEQ ID NO: 337684 - RNA, 64 nt, Human
uaccagguagcucauuaaacguaauucuucagauaugagauagugggcuuagaccuaagccaua

SEQ ID NO: 337685 - RNA, 64 nt, Human
cugcugaaguaaagcagaaaguacugcauaguauaugagauauagccagcuagcuaaaguucag

SEQ ID NO: 337686 - RNA, 64 nt, Human
aguacuuuuaaaugggugccaaaggucaacuguaaugagauaauuaucccugccuguguccaug

SEQ ID NO: 337687 - RNA, 64 nt, Human
auuuaguaucuuuuuaacagaauuacuuggaauaaugagauacaauaaucauaucucuuuugac

SEQ ID NO: 337688 - RNA, 64 nt, Human
guuucucuggcaaauuuguaucaguaauuugaaaaugagauauuaggaaaaaccaauucuucuu

SEQ ID NO: 337689 - RNA, 64 nt, Human
ugccuuuaauuuucuuguuuguuugagcuuagggaugagauacuuaugcaagauauuuuugaag

SEQ ID NO: 337690 - RNA, 64 nt, Human
ggguacauaguaggaguguauuuuuauggguuacaugagauauucugauacaaacaugcaaugu

SEQ ID NO: 337691 - RNA, 64 nt, Human
uuggucccucaagagggagacuuucuuccucaguggcggagagaagaaagugcauuuauugucu

SEQ ID NO: 337692 - RNA, 64 nt, Human
gcgcagaggucaguccuagucggagcuuaggaggggcggagacgcucacaucgucugacuugag

SEQ ID NO: 337693 - RNA, 64 nt, Human
acugggaucgcaccuuuuauaccagagaccugaggcagaugaaauuuauuuccaucuaggacua

SEQ ID NO: 337694 - RNA, 64 nt, Human
ucuugaagcuaaauguauauaugaguaguuugccaugagauaacacaguguaaacaguagacac

SEQ ID NO: 337695 - RNA, 64 nt, Human
cagcugugugguagggagguccaaguaugugcauaugagauaagccugcaaccucuugaccuuc

SEQ ID NO: 337696 - RNA, 64 nt, Human
agagagauauuguguaacuaggaugcauuuuccaaugagauaucuugcaguuucuguucugggu

SEQ ID NO: 337697 - RNA, 64 nt, Human
gaaauacuggaagaagauauuuuuccugucauugaugagauauaucagaguaacuggaguagcu

SEQ ID NO: 337698 - RNA, 64 nt, Human
cacaucggguguuuguuaucagaaaagagaugagaugagauaagacuuguuuauugacuagcca

SEQ ID NO: 337699 - RNA, 64 nt, Human
augggauuuugaguucuccagcuauagaaugugaaugagauaaaaagugaacuaucuauuauau

SEQ ID NO: 337700 - RNA, 64 nt, Human
auuauauaagauggaggaaggguaauuaauagacaugagauauagaaauacuuuguuagcccug

SEQ ID NO: 337701 - RNA, 64 nt, Human
caagauuauucacacauaccauguauuauuuuauaugagauaauuuauuuuuuuccccuuugga

SEQ ID NO: 337702 - RNA, 64 nt, Human
aacugaaaaccugagauggagauauguucaaagaaugagauacaauuuuuuaguuuucaguuua

SEQ ID NO: 337703 - RNA, 64 nt, Human
ugacucugaguagucacauauauaagcacugcacaugagauauagauccguagaauugucagga

SEQ ID NO: 337704 - RNA, 64 nt, Human
gcaguugccagguuuuagcugccaccgcuucaguaugagauauagcugucccaucuucccccau

SEQ ID NO: 337705 - RNA, 64 nt, Human
uugaucuuuuaguuuuucccucagugaaggcuaaaugagauacacugauucuagguacauuuuu

SEQ ID NO: 337706 - RNA, 64 nt, Human
uuuuucccacuaagcaaggggcccugaccucgggaugagauaacaaauuguaauaaaguaacuu

SEQ ID NO: 337707 - RNA, 64 nt, Human
uuguagacacaauauucuaacauugcacaaguugaugagauaucaaguuuugaauauuauucag

SEQ ID NO: 337708 - RNA, 64 nt, Human
gcuauuuauuaaaaaacauuaaauuucauuccaaaugagauaagugauauuacuauaacaucua

SEQ ID NO: 337709 - RNA, 64 nt, Human
gcagggcugaggacccaaagucauuucccaggcuggcggagaauaaacugccagggagaagaau

SEQ ID NO: 337710 - RNA, 64 nt, Human
cagaagggugaggcagaauugccugaacccgcgaggcggagacugcagugagccgagaucgcac

SEQ ID NO: 337711 - RNA, 64 nt, Human
cuggaggguucuuguugucccucccauuagccagggcggagacugucugagcugugcaggagga

SEQ ID NO: 337712 - RNA, 64 nt, Human
cacauaccuuaaugauuugggaaguuaggcaaauaugagauauguagacauaucuaugcugauu

SEQ ID NO: 337713 - RNA, 64 nt, Human
uagcaaauaggaauuauuaacuugagcauaagauaugagauacaugaaccugaacuauuaaaau

SEQ ID NO: 337714 - RNA, 64 nt, Human
cuguuaaccaaauaaaacauaauagaauuuccuaaugagauauaucuuuauacuuaaacagcuu

SEQ ID NO: 337715 - RNA, 64 nt, Human
ccucuuguuuacaguuuauauauauaugauagauaugagauauauauauaaaagguacuguuaa

SEQ ID NO: 337716 - RNA, 64 nt, Human
accugucuucaguuacuuuguaauuuauuguggcaugagauaagauggggaaaauuuuguuuua

SEQ ID NO: 337717 - RNA, 64 nt, Human
auuguuuuucuaaaaacaaaugcuguuuauacauaugagauagcuauuuugauaggauuugcuc

SEQ ID NO: 337718 - RNA, 64 nt, Human
ugguuuuggucugcaguuuuuccaaagggcuuuuaugagauacauuucccacaaaguccauuuu

SEQ ID NO: 337719 - RNA, 64 nt, Human
aacacaaauaauaauauccuucguuauaaccacaaugagauaaguauuggcauuaguguucagu

SEQ ID NO: 337720 - RNA, 64 nt, Human
aguuugucaaaaguaucucauacuuauaaacaguaugagauaggaggauuaaaauauuauuuua

SEQ ID NO: 337721 - RNA, 64 nt, Human
uagauacucauuaaguagccuuaugacaaacaguaugagauacuuaugacaaacucgcucuguc

SEQ ID NO: 337722 - RNA, 64 nt, Human
auugaaagaugauagcaaugauauuaugagggauaugagauaggugacugaccacaaagaagaa

SEQ ID NO: 337723 - RNA, 64 nt, Human
aaauauuucaaccuguaaucaacauaaaauuuuaaugagauauuuuauauuauuuuuugguacu

SEQ ID NO: 337724 - RNA, 64 nt, Human
uuuguaaucuuuuuuuggauuauuuuucaaaaagaugagauacuacacucauuuaaauauuuuu

SEQ ID NO: 337725 - RNA, 64 nt, Human
aaacaaugauuugcuuuucagugagaauauauauaugagauauauauagauauauauucuaggu

SEQ ID NO: 337726 - RNA, 64 nt, Human
acagucacaugucacgacaaaccaaucaaucuuuaugagauauuccuguauccauaccccagcu

SEQ ID NO: 337727 - RNA, 64 nt, Human
cccggaccgcauggccggugagaguagagucggaggcggagagccuggacgcccagaggccggg

SEQ ID NO: 337728 - RNA, 64 nt, Human
gggcucuaggcugacaucgcuggcugccccuuugggcggagaggggaccucaccaguuuuuuua

SEQ ID NO: 337729 - RNA, 64 nt, Human
gaggcugaggcaggaggauugcuugaacccuggaggcggagauugaagugagcugaguucgugc

SEQ ID NO: 337730 - RNA, 64 nt, Human
gccacagaguaugaaggaagagugauagauccagaugagauacagcucagagugccacgccccc

SEQ ID NO: 337731 - RNA, 64 nt, Human
uccaggucuuaagagaccucauugccuuuguuuuaugagauaucauucugggauugggaauaug

SEQ ID NO: 337732 - RNA, 64 nt, Human
aaaaaaaaaaaauccauauccauucauuaaaaaaaugagauauaaagcaacaacugggcugacc

SEQ ID NO: 337733 - RNA, 64 nt, Human
auuaucuugagagcaaauaacuuggaaaauuuaaaugagauaaugcaguugcaacugugugucc

SEQ ID NO: 337734 - RNA, 64 nt, Human
aaaagacuauauugcauaacuugcaaugaaauuaaugagauauauauugaaauaaagaauuaug

SEQ ID NO: 337735 - RNA, 64 nt, Human
cauuuugauuuauuuuaaaucuuuacauucagaaaugagauacuguauuaucagaccaggaggc

SEQ ID NO: 337736 - RNA, 64 nt, Human
gcaaaguguuacucuuacguguuuauuuugagucaugagauaaucaauuuuaacccaaagucau

SEQ ID NO: 337737 - RNA, 64 nt, Human
uuuaacacuuuguacugcaaagagugaacuauauaugagauagagagacaauaauuucuugcaa

SEQ ID NO: 337738 - RNA, 64 nt, Human
cauguagauuauacauauauauacacacguguauaugagauauauaucuuauaucuccacaaac

SEQ ID NO: 337739 - RNA, 64 nt, Human
ggaaucuucuucuuggcagcugcagucugucaggaugagauaucagauuagguuggauaggugg

SEQ ID NO: 337740 - RNA, 64 nt, Human
cuguuuguggauguguguuuguaugugcauacguaugagauaggcacaugcaucuucuguaugg

SEQ ID NO: 337741 - RNA, 64 nt, Human
uggcauugaagaauuccuuccagagauaaacucuaugagauaugugggaaggccuuuugcaagu

SEQ ID NO: 337742 - RNA, 64 nt, Human
auucaguuucguuugcuugauaaaucugaggacuaugagauaucagaguuacuaguaggguagg

SEQ ID NO: 337743 - RNA, 64 nt, Human
uuaaauuuugagauucauacacuacauuuacaaaaugagauaguugaaaaagcacaucuagaau

SEQ ID NO: 337744 - RNA, 64 nt, Human
ucacaacuuucuaaggcagcuauuuuguuuugcaaugagauauuugcagugguuucacuaaagc

SEQ ID NO: 337745 - RNA, 64 nt, Human
gaggcugaggcuggagaguugcucaaacccgggaggcggagauugcagugagccaagaucgcac

SEQ ID NO: 337746 - RNA, 64 nt, Human
uugcuaaguacagaucauucaagguggccgacgaggcggagaaguacaaucugguccugggggc

SEQ ID NO: 337747 - RNA, 64 nt, Human
cacuacccucagagagagccaaaaauacagaagaggcggagagcgccccuccaaccaggcuguu

SEQ ID NO: 337748 - RNA, 64 nt, Human
uuuauagugguugucuaauuuuuacuuuuauuauaugagauagagcugugcagaucuucacuca

SEQ ID NO: 337749 - RNA, 64 nt, Human
aacauauacaaaguaagcuuaaaacacuauaaacaugagauaagggaaaaugaauccagaguuc

SEQ ID NO: 337750 - RNA, 64 nt, Human
uguuuccuaauuaaaauaagaauugaaugucaauaugagauauuaaaauaagcacagaaaauca

SEQ ID NO: 337751 - RNA, 64 nt, Human
guuugacaagggcagugguccguacuucggcugcaugagauaaucacuugggagcuuuggagaa

SEQ ID NO: 337752 - RNA, 64 nt, Human
uuagaagaauguggccauuauuuugauuuuuugaaugagauauauaaucaaaguacugcugaac

SEQ ID NO: 337753 - RNA, 64 nt, Human
guuaccuuuaugguuucuccagguccucuacuuaaugagauaguagcauacauuuauaauguuu

SEQ ID NO: 337754 - RNA, 64 nt, Human
gggccugggauuauuuuuuuaauuuuaaguuugcaugagauagccuaauaaauggagguggggc

SEQ ID NO: 337755 - RNA, 64 nt, Human
gggacuuccaugcuggaauugcucccugauuaaaaugagauauggcuauuuggaagacacugca

SEQ ID NO: 337756 - RNA, 64 nt, Human
ccugagacuuuucagguguuggagccucuaaaauaugagauauaaacagaaacuaauacaaguu

SEQ ID NO: 337757 - RNA, 64 nt, Human
agagaggaaaacaauuaucuucucuacuuggauuaugagauaaccuuuucuuggaggaaagaaa

SEQ ID NO: 337758 - RNA, 64 nt, Human
gcacacuuguuaaauaguguuaagagauguggagaugagauauaccccuuugauguagaauuau

SEQ ID NO: 337759 - RNA, 64 nt, Human
uuuuucaaacuagaauaaggaggcaaauagaagaaugagauacugauguccacaguucauuggc

SEQ ID NO: 337760 - RNA, 64 nt, Human
guauuuuggggugauaaaauaguucaccauggguaugagauauuuauucuuuaaaucaaaguaa

SEQ ID NO: 337761 - RNA, 64 nt, Human
aauagcugucauuaugcaguguguauauucaaauaugagauaagacuauguacacauccacuuu

SEQ ID NO: 337762 - RNA, 64 nt, Human
aacuauucauacagaaaugcaaaucaaaaccacaaugagauaucaucucauccuaauuaaggug

SEQ ID NO: 337763 - RNA, 64 nt, Human
cugggccugugugagcucucugugagcucuggcuggcggagaagggcagguguccggagcuguc

SEQ ID NO: 337764 - RNA, 64 nt, Human
aggcugaggcacgagacuugcuuaauaccugggaggcggagauugcagugagccgagaucacgc

SEQ ID NO: 337765 - RNA, 64 nt, Human
aauauauuauuuccuuuauuccuuucagcaauccaugagauagcuauuauaauccucauuuccu

SEQ ID NO: 337766 - RNA, 64 nt, Human
uaauucauaguaauuucacucucugcauugacuuaugagauaauuaaugauuaaacuauuaaug

SEQ ID NO: 337767 - RNA, 64 nt, Human
uaaccuuugccaaguuagagaaaagauggauuuaaugagauaaaugaaaagauauuuaaccuaa

SEQ ID NO: 337768 - RNA, 64 nt, Human
guuacaucaguguuguuuuguuuaaaaagccuucaugagauacaauucacauaccauauaauca

SEQ ID NO: 337769 - RNA, 64 nt, Human
ucccuaaaaacuugaggaaggaagaugauagaacaugagauacucuuuguuuuguacauacuag

SEQ ID NO: 337770 - RNA, 64 nt, Human
ggaaagcugaaagggcugcacuggaacaacacagaugagauauucuacacauuaaucuacuuau

SEQ ID NO: 337771 - RNA, 64 nt, Human
aaagacuauccaacuuaacaugaaacuugucaccaugagauagcauuagcugcccaggaugcug

SEQ ID NO: 337772 - RNA, 64 nt, Human
gguaccgaccucuuaggcuuggugugaggaugaaaugagauagggaauauaaagcaagcagaua

SEQ ID NO: 337773 - RNA, 64 nt, Human
caaaucaagauucaaacagcuuuaaacacuuccaaugagauaaaauauuuacuauuaugcuuau

SEQ ID NO: 337774 - RNA, 64 nt, Human
ugcuggcccugaguacugaacuuucugaguaacaaugagauacguuacagaaccuauguucagg

SEQ ID NO: 337775 - RNA, 64 nt, Human
gaacuuaggaaaauagcuggaaucaugaaugacaaugagauaacauacagaugucaguggagac

SEQ ID NO: 337776 - RNA, 64 nt, Human
cuuuuccuucuauuucagcucacuccaucacucgaugagauaauaugagauuucuacuucggag

SEQ ID NO: 337777 - RNA, 64 nt, Human
uuuuccuucucuuuuucgacaaugguagacaugaaugagauauuuaaaguucauuggaaaucuu

SEQ ID NO: 337778 - RNA, 64 nt, Human
uaauccugaaauccaaaauugcacuguguuugacaugagauaguuuaaguuccacaaaauccaa

SEQ ID NO: 337779 - RNA, 64 nt, Human
uuguaauuaauuuucuuagaauugugcaggcuggaugagauaaugacauacucuuuuacacugu

SEQ ID NO: 337780 - RNA, 64 nt, Human
aguggccugggcucuguuggugugcguguuccguggcggagagaagaaaaugggaaagacaucu

SEQ ID NO: 337781 - RNA, 64 nt, Human
gagcuuuaaaacuaucuaucuugcauuugugucuggcggagaacuagccaucagccuccugaag

SEQ ID NO: 337782 - RNA, 64 nt, Human
auccccaaacacuagagaagcucuccuaacccaaggcggagaaugaaggugguggcggcagagg

SEQ ID NO: 337783 - RNA, 64 nt, Human
cucucccaaggccugacaaugguaccuauuagggaugagauacagacaaggauagcuaucuggg

SEQ ID NO: 337784 - RNA, 64 nt, Human
gcuuuuggccucuguguggccguguuuugccagcaugagauacuguccccucuggaggauuuua

SEQ ID NO: 337785 - RNA, 64 nt, Human
uuaguuaaucuuuugcaggcccgcuucucaaugaaugagauacaccaggauaugcacgugcauc

SEQ ID NO: 337786 - RNA, 64 nt, Human
gauaggcacuacaaugaaauggcaggaugccaauaugagauauuucaggaauaauaagaaauac

SEQ ID NO: 337787 - RNA, 64 nt, Human
augcauuacugcaugcacuucuuacaauaauucuaugagauagguacuauuauccccauuucuu

SEQ ID NO: 337788 - RNA, 64 nt, Human
uuuuucaucacuugcacacuugauaaauauuuugaugagauaucauccaaguauugaggauaag

SEQ ID NO: 337789 - RNA, 64 nt, Human
uguuaaugccucugaguguccuaccuccuuggagaugagauagggaaggagcagggaugagacu

SEQ ID NO: 337790 - RNA, 64 nt, Human
aaucaggaagcuauuugccuggcuccagcagaugaugagauaaugagguaguggguuuuuuauu

SEQ ID NO: 337791 - RNA, 64 nt, Human
uugaugccugugaugcaauuuuuuauugccuacaaugagauacacuuaguacaaaaaaugaaaa

SEQ ID NO: 337792 - RNA, 64 nt, Human
cugagcaaaaaaccacacaaaaguuguguaagagaugagauaacaaaggagcgagagaaaucuc

SEQ ID NO: 337793 - RNA, 64 nt, Human
ucuggaaugcauuacuguaaacaugaucuuucccaugagauaccauguucuaugccuucccauu

SEQ ID NO: 337794 - RNA, 64 nt, Human
aaugugauacagaagaacaucucaucccauaugcaugagauacuaauuaaugaugaaauugaac

SEQ ID NO: 337795 - RNA, 64 nt, Human
uacaauaaugguggguaauggccccaccucuguuaugagauaauguucuaaucaaugucucugc

SEQ ID NO: 337796 - RNA, 64 nt, Human
uccaaguaauagaaguaucuuacugaaauuccauaugagauaaucuuuauuuuugccuauuuuu

SEQ ID NO: 337797 - RNA, 64 nt, Human
uccugaucaguugauuaccaucugaggucaagaaaugagauagugggagcaaaugggucacaaa

SEQ ID NO: 337798 - RNA, 64 nt, Human
gaggcugaggcaagagaguugcuugaacccaggaggcggagauugcagugagcugagauugcac

SEQ ID NO: 337799 - RNA, 64 nt, Human
guaaaacaauguuucuaaauugucuuauuuuguuggcggagaagauuacaauggcuauuagugc

SEQ ID NO: 337800 - RNA, 64 nt, Human
gccugcagguggccacucauguggucagcaggucggcggagagacugggauggcugggcuucuc

SEQ ID NO: 337801 - RNA, 64 nt, Human
aaauaggaccauauguaaacuugacuuugacugcaugagauaucccuaucuggucucacucagu

SEQ ID NO: 337802 - RNA, 64 nt, Human
cuuacgguucacgcucuaaggcaggauguggcuuaugagauacuuugcauugucugucugcaca

SEQ ID NO: 337803 - RNA, 64 nt, Human
cucaugacauuuuauuugaccaacauagcacaugaugagauaucaagguaauuaaaauagcaug

SEQ ID NO: 337804 - RNA, 64 nt, Human
uuuaaauuuagacuucuuauuuccacacuggauuaugagauacuuaacaauuuuuccaccuuau

SEQ ID NO: 337805 - RNA, 64 nt, Human
uguuuaaauuuugaagauggugaacuuuuguagaaugagauagucgaagcuaaaacuggaguau

SEQ ID NO: 337806 - RNA, 64 nt, Human
ucaugcuugggaagaauggggaucacaauggccuaugagauagucugccuggucaaugcugagc

SEQ ID NO: 337807 - RNA, 64 nt, Human
auauuuagacuauuuuacugagcagacuuuauaaaugagauaucuacaaggcacuuaaaguguu

SEQ ID NO: 337808 - RNA, 64 nt, Human
gaacacucuuuuuuaucuucccugaaccauauugaugagauaaauagggcugggggcugggccc

SEQ ID NO: 337809 - RNA, 64 nt, Human
guuguguggaucuguuccuaguauaggcaacauaaugagauacugugcuucccaccuccccuuc

SEQ ID NO: 337810 - RNA, 64 nt, Human
uuucuuaaaauaacaguuuuguugacuuaaaaauaugagauacauaggaugugaaaaaaaaugu

SEQ ID NO: 337811 - RNA, 64 nt, Human
cucccugucucuccagccaguauauuuaaagguaaugagauaaugaugaguguuuugaaaaaug

SEQ ID NO: 337812 - RNA, 64 nt, Human
uuaaugcacaggugugaguggauugcuuauggcuaugagauagguugaucucgcccuuaccccg

SEQ ID NO: 337813 - RNA, 64 nt, Human
acauuuuagcaaaacuuuacuaaauguaaugucuaugagauauguuucugaucuuggaugacca

SEQ ID NO: 337814 - RNA, 64 nt, Human
uguauauuugaaaucagagguguuuaaaauaccuaugagauaccaauguagccuuaacauaugu

SEQ ID NO: 337815 - RNA, 64 nt, Human
cagcggcuggaauuggguggggggcuucauacacaugagauaauaugcagauuuugcccuugac

SEQ ID NO: 337816 - RNA, 64 nt, Human
gccccguccugggcgugugcuggguuugaauccuggcggagaccuggggggaaauugagggagg

SEQ ID NO: 337817 - RNA, 64 nt, Human
aggagcacugcagcccgagacuuccaaccugaguggcggagaagcugggacccugggcuggacu

SEQ ID NO: 337818 - RNA, 55 nt, Human
aaagggagacguacuacuaaacucagcagaugaagagcuucaugugacacagggg

SEQ ID NO: 337819 - RNA, 64 nt, Human; identical to SEQ ID NO: 337808

SEQ ID NO: 337820 - RNA, 64 nt, Human
guugaaauuuccuucaugccaagcuucuuguuauaugagauaauuacgcccuuauuguauaaga

SEQ ID NO: 337821 - RNA, 64 nt, Human
gagagauguguaguuaauuuaguaauucuguuucaugagauaugaucuguuaugcuagugguuu

SEQ ID NO: 337822 - RNA, 64 nt, Human
uuaagauguauauuuuguuaagcauauucucuaaaugagauauuguguggcuuuuuaguaacaa

SEQ ID NO: 337823 - RNA, 64 nt, Human
ggcuccuuagcauggccacuuacaauuuuuuaacaugagauaacacaucaggugucagaacuug

SEQ ID NO: 337824 - RNA, 64 nt, Human
cugauaaauggaaauguagguucacugccacuucaugagauaucucugcucacgcuuccaaguu

SEQ ID NO: 337825 - RNA, 64 nt, Human
uauuuccuugccaggccuguuuccccaccaggaaaugagauaggaggacuggaugaggaugucc

SEQ ID NO: 337826 - RNA, 64 nt, Human
aagcguauacuuaguugccguuagaugugacagaaugagauaauuuauguaaagcaguagagua

SEQ ID NO: 337827 - RNA, 64 nt, Human
cuuugcagauauguucaaauuggacuggacuuugaugagauauaaucucauuauuugaaugggu

SEQ ID NO: 337828 - RNA, 64 nt, Human
ccacugagucagugagggccacagauugguauuaaugagauacgaggguuguugcuggguguuu

SEQ ID NO: 337829 - RNA, 64 nt, Human
aaaugaugaaguugaagugauguuugaaagauuaaugagauacaauuuauauuauuugguaagg

SEQ ID NO: 337830 - RNA, 64 nt, Human
caggcugagcagauacuacuugguuuugcuugguaugagauacuacuguuugcuuaguaugaga

SEQ ID NO: 337831 - RNA, 64 nt, Human
uauugugcacaagucuuuccagaggaguuucuuaaugagauauuuguauuuauuuccagaccaa

SEQ ID NO: 337832 - RNA, 64 nt, Human
cuccuugagccuugguuuuuguuguagggauuaaaugagauaauaugaguggcagcucuucaug

SEQ ID NO: 337833 - RNA, 64 nt, Human
uuuuguauguuucuacuguuaaugccauauuacuaugagauaauuuguugcauaguguccuuau

SEQ ID NO: 337834 - RNA, 64 nt, Human
ugaggggggagugcagcaguuggccugcuugucuggcggagaaagccagcucccugcacccucg

SEQ ID NO: 337835 - RNA, 64 nt, Human
uggagaaggggcugccggacccagugcucuaccuggcggagaaguucacaccgaguagcccuug

SEQ ID NO: 337836 - RNA, 64 nt, Human
agagaggaagggacagcaggagugaggugaagagggcggagagagggggcaggcucggcaccgg

SEQ ID NO: 337837 - RNA, 64 nt, Human
gguacuggcuucuuguuucaagagaugaaccuaaaugagauaggaagccugucccauagcagcc

SEQ ID NO: 337838 - RNA, 64 nt, Human
aguccaauaggaaagugagacccagacaaugacaaugagauaaauguuaggaagggggagguau

SEQ ID NO: 337839 - RNA, 64 nt, Human
auugcaaaauaaaauaaaauagccagcguacacaaugagauauucuaaacuuccauucuguuuu

SEQ ID NO: 337840 - RNA, 64 nt, Human
augaggaagaugccagugguaccgcauuuuauagaugagauagcugaggcuaggggagaaggau

SEQ ID NO: 337841 - RNA, 64 nt, Human
ggaugagcaggggaugagagcugcagggaaauaaaugagauauucguccuuauuucauuuccuu

SEQ ID NO: 337842 - RNA, 64 nt, Human
aaaccacacacacucguacaugcagacaccuccaaugagauauaguuaagagauggcauucaaa

SEQ ID NO: 337843 - RNA, 64 nt, Human
guccugauucuuuagagaagcugggguacaguuuaugagauagcuagagcuucuuuguuaucuc

SEQ ID NO: 337844 - RNA, 64 nt, Human
uuuaagaaacuguuugauuuuagagucuauuucuaugagauaguuuaccaaauaaauguuccuu

SEQ ID NO: 337845 - RNA, 64 nt, Human
aagacagcuccuauaguuuuguauuuuggcagcuaugagauauuuucaugguaaugucaacaug

SEQ ID NO: 337846 - RNA, 64 nt, Human
uucauuccuuuuuauggggcuccaggucauaaggaugagauauauuugggguacuggcagagga

SEQ ID NO: 337847 - RNA, 64 nt, Human
ugccaguagucugugauaaauuuauguagguauaaugagauacugauaugguuugggcauuugu

SEQ ID NO: 337848 - RNA, 64 nt, Human
acacacaguuaugccgcuagauacaugcuuuuuaaugagauaaugugauauuauacauaacaca

SEQ ID NO: 337849 - RNA, 64 nt, Human
uguaacuuucucuaugaacucuguuuucuuucuaaugagauauuaaaccauguaaagaacauaa

SEQ ID NO: 337850 - RNA, 64 nt, Human
gggcuguaaauccuaauuaaaaauagaggucgacaugagauaccuggcauuuugggaagugacc

SEQ ID NO: 337851 - RNA, 64 nt, Human
aagucauugucaguuguaguagcucugauguugaaugagauaucauguuuuagcauuccauuuu

SEQ ID NO: 337852 - RNA, 64 nt, Human
ucuggugugagccguggcagccgcagcgcagacuggcggagaaggagaggaacgggcagccugg

SEQ ID NO: 337853 - RNA, 64 nt, Human
gaggcugaggcaggggaaucgcuuaaacccaggaggcggagauugcagugagccaagguuccac

SEQ ID NO: 337854 - RNA, 64 nt, Human
ggaggaagaagcuacagcaucugaaaggaaugaugcagaugagaagcacccagaacaugcugag

SEQ ID NO: 337855 - RNA, 64 nt, Human
acuuuuagauaaaaugcugcugagugacugcaugaugagauacaacuucugaaugcugcacauu

SEQ ID NO: 337856 - RNA, 64 nt, Human
ccacucucaauaccuagagagugaaacccguacaaugagauaaagacuaaaaagagaaaucccu

SEQ ID NO: 337857 - RNA, 64 nt, Human
aaagauaaaaguucaguucuuaaaaugaguuuuuaugagauaacagucagugaucuugguguua

SEQ ID NO: 337858 - RNA, 64 nt, Human
aaaaaaaaaaaaaaaaaaaaaaaagccugaagagaugagauaggaggaaagaccucacagccag

SEQ ID NO: 337859 - RNA, 64 nt, Human
acccuaaaagaagaucugacaggaaagcuguauaaugagauagaaaaacgucagguauggaagg

SEQ ID NO: 337860 - RNA, 64 nt, Human
cugcugacagcuauagggagccccagguaauggcaugagauagcugguguuagggcuaucucag

SEQ ID NO: 337861 - RNA, 64 nt, Human
gaagccaagucucaagaacugucagcaacagaaaaugagauaugaugcuagagagcauuugucc

SEQ ID NO: 337862 - RNA, 64 nt, Human
caaauguggcauuugugaucaugagauugaugcaaugagauagaagauguuugcuaccugaaca

SEQ ID NO: 337863 - RNA, 64 nt, Human
ucagccuugaccucacuuagcagggauuacagaaaugagauacauuuugaaggagaguugucug

SEQ ID NO: 337864 - RNA, 64 nt, Human
cacacccugcucugggcacugggaaugcugggaaaugagauacauucccgcccucaagaaucuc

SEQ ID NO: 337865 - RNA, 64 nt, Human
agcuccccuaaacuucccaggugccucauccauaaugagauaaugcauguaggggaaaaguuuc

SEQ ID NO: 337866 - RNA, 64 nt, Human
uaguugucaaguacuuagucaucccuauuaugauaugagauaguacagcuuuucaggaagcuua

SEQ ID NO: 337867 - RNA, 64 nt, Human
ugccacccaaucaugcccagcuucugucauaugaaugagauauacauuuaugucugaccuuccc

SEQ ID NO: 337868 - RNA, 64 nt, Human
agugccugcauucccaggaaaauacgaaaaucccaugagauaaauaaaaauauaggugaugggc

SEQ ID NO: 337869 - RNA, 64 nt, Human
acugaucagcagggaaaugcaaaucaaagccacaaugagauaccaccucacaccuguuagguua

SEQ ID NO: 337870 - RNA, 64 nt, Human
gaggcugaggcaggagaaucgcuugaaucugggaggcggagauugcagugagccgagaucccgc

SEQ ID NO: 337871 - RNA, 64 nt, Human
ggaaacuccguuccuacaaaacccucuuugaugcggcggagacgauggucagccuucagcuggg

SEQ ID NO: 337872 - RNA, 64 nt, Human
auggcauucacggcuccaucccgcagggugccugggcggagaugucuuuuaggggcccaagaaa

SEQ ID NO: 337873 - RNA, 64 nt, Human
uuuuuucucuguaaauauguacagugcacgggcuaugagauagcaacaaaaaaugcauaguuaa

SEQ ID NO: 337874 - RNA, 64 nt, Human
cuguuuugcuagugugauaaugaauagguaagauaugagauaauugcaacauugucuaguucua

SEQ ID NO: 337875 - RNA, 64 nt, Human
gaugugugauaaucucauaauguugagaacccugaugagauacauugucuuccucucccuacaa

SEQ ID NO: 337876 - RNA, 64 nt, Human
uuuauacauuucauuuuuuauuugauauuaaaguaugagauagaguugagagacaauuaauuau

SEQ ID NO: 337877 - RNA, 64 nt, Human
gaggaggaagaacaaauaauagaagaaaauaaaaaugagauagaagaaaaguaagaaccaagau

SEQ ID NO: 337878 - RNA, 64 nt, Human
acgccaggucagucauuuuugcacuuaauuguauaugagauaacuagauguccuguuuucgugc

SEQ ID NO: 337879 - RNA, 64 nt, Human
uccaccagucucugaaauuagaacaguaggcgguaugagauaaucaggccuaaucauguuguga

SEQ ID NO: 337880 - RNA, 64 nt, Human
uguucagaagccgcuuccucuccacugaagagcuaugagauacgcacaauacuugcuguucacg

SEQ ID NO: 337881 - RNA, 64 nt, Human
aauacaucuggaugaccugccuagcaguuuccccaugagauagaggaaugucuacguauuucau

SEQ ID NO: 337882 - RNA, 64 nt, Human
ggacuccgaucgcgaugucucaucugacagcuccaugagauagagaccugccucccccuugcac

SEQ ID NO: 337883 - RNA, 64 nt, Human
gcuuugugccuggugcucuguaaugaaccaggcaaugagauaguuuucucaguuugguuucagc

SEQ ID NO: 337884 - RNA, 64 nt, Human
cucuguuucccuccuucuuggaagaguaauagggaugagauauuaaauggccuuuuuagaauua

SEQ ID NO: 337885 - RNA, 64 nt, Human
uuuuacuuuuuuuuuuguucuggccgaaauuuuuaugagauaucucucacuugucuuccacuuu

SEQ ID NO: 337886 - RNA, 64 nt, Human
ugauguuuucuugucaucuugaaggcuccauggaaugagauaaagcauugacccaccacaggac

SEQ ID NO: 337887 - RNA, 64 nt, Human
uaaagccacaaugauuugaggucuuugcuuaaguaugagauacuugaugggggcuuuaucaugc

SEQ ID NO: 337888 - RNA, 64 nt, Human
uucuccucacaaagggguuuuauggacuuccucaggcggagagcuucugagaacacaggcagga

SEQ ID NO: 337889 - RNA, 64 nt, Human
ccccaaagugcagauuccggagcagacacauccgggcggagagacucagcagacaagugcugca

SEQ ID NO: 337890 - RNA, 64 nt, Human
uuacuugauaacagcguuccaucuuuguguuguagcagaugaaauggacaguaaugugaguuca

SEQ ID NO: 337891 - RNA, 64 nt, Human
gacgcuguguuagacacuagggaugcaaagaugaaugagauaaggccucaggccucauggaagg

SEQ ID NO: 337892 - RNA, 64 nt, Human
acucuuuaucucaauagagaccuuaaaagaaaacaugagauacguuaaauaauaaaauaagaua

SEQ ID NO: 337893 - RNA, 64 nt, Human
ugauacuuacauuucauggacagcauuaacaagaaugagauaaauuuguacuuuuuagaucaaa

SEQ ID NO: 337894 - RNA, 64 nt, Human
ugcuuguuagaacucagcuaauggagcucaaaguaugagauacagaacuuggugacccauguau

SEQ ID NO: 337895 - RNA, 64 nt, Human
auuuuuuugaauuuuggaauauuugcauagcauaaugagauaucuugggaaugggacccaaauc

SEQ ID NO: 337896 - RNA, 64 nt, Human
uccugucuuuugugcaugggcgacccauuacaguaugagauaagauugaguucugaugcguuaa

SEQ ID NO: 337897 - RNA, 64 nt, Human
acaugaucucugaaagacuagacugucuuauauuaugagauacuugaaugcugcauguaaagcc

SEQ ID NO: 337898 - RNA, 64 nt, Human
aaaagaaaaaacgaaaaaaaaucucaaauaaaacaugagauaacauuuuaagacuuccaaauca

SEQ ID NO: 337899 - RNA, 64 nt, Human
uuaauuuuaaagcaacuuauguguucgaucauguaugagauagaaaaauuuuuauuacucaaag

SEQ ID NO: 337900 - RNA, 64 nt, Human
aaggagccagaaaguauucauacugcuacuccuuaugagauagccaagaagcaucaugucagua

SEQ ID NO: 337901 - RNA, 64 nt, Human
guagaaggaccccuggagccagaggguuuucuaaaugagauaacugggggcaaagguugggaua

SEQ ID NO: 337902 - RNA, 64 nt, Human
ugaacaguuggcuguaugacugaaguaauaacugaugagauacauuugaucuuguaaaaauagc

SEQ ID NO: 337903 - RNA, 64 nt, Human
acaggcccagcauugcugguucuauuuaauggacaugagauaauguuagagguuuuaaagugau

SEQ ID NO: 337904 - RNA, 64 nt, Human
uuuagcuaauaaagaaagagaauagaaaacacgcaugagauauucagaaaauacuagccuagaa

SEQ ID NO: 337905 - RNA, 64 nt, Human
cccaggcccugugcggagcaucgggaauacaaagaugagauaaaacauugucccugcccccggg

SEQ ID NO: 337906 - RNA, 64 nt, Human
caggcugaggcaguagaaucgcuugaaccugggaggcggagauugcagugaaccaagaucgggc

SEQ ID NO: 337907 - RNA, 64 nt, Human
acaugcagucugcacgccacucuugggcucugcuggcggagauccccuuccuucugggugcaga

SEQ ID NO: 337908 - RNA, 64 nt, Human
uccccagcuccaauauguagcagucucucuggauggcggagagugaaggagacggagaaacgcg

SEQ ID NO: 337909 - RNA, 64 nt, Human
caagcugcugccuauggaaggcaaagucauaguaaugagauagcaccucugaacugugcaguca

SEQ ID NO: 337910 - RNA, 64 nt, Human
auagcaguugacaaaacagcuauccccacaagugaugagauagucccuuuacuguccucaaaug

SEQ ID NO: 337911 - RNA, 64 nt, Human
caguauugcacuuuuguuuaacuagaauacaccuaugagauagccaaaguuucaaacacaguua

SEQ ID NO: 337912 - RNA, 64 nt, Human
cagccguggggagaucaccuucagagacuaucagaugagauacagagacaacaccccccuuguu

SEQ ID NO: 337913 - RNA, 64 nt, Human
uuccaagagaguuauuugaaaaguuaacagaacaaugagauaacagugacaguuuaacaaagau

SEQ ID NO: 337914 - RNA, 64 nt, Human
ggcgacagagccagacugucucaaauaaauaaauaugagauaaugcagucgggagaagggaggg

SEQ ID NO: 337915 - RNA, 64 nt, Human
ucugaguacaaugaaauuucuuaaguuuuagaacaugagauaaaguuguauacucuacuuucau

SEQ ID NO: 337916 - RNA, 64 nt, Human
ucucacccccucaaccaggaacuggggauuugggaugagauauggucagacuuguagauaaccc

SEQ ID NO: 337917 - RNA, 64 nt, Human
ugucacucuuccuccuuuucuacuuucaguagauaugagauagagcauaauuaucuguuuuauc

SEQ ID NO: 337918 - RNA, 64 nt, Human
uaacuuucuguauguauaggccuguccaaaggcuaugagauaccagggacaguggaaucuugau

SEQ ID NO: 337919 - RNA, 64 nt, Human
acauuugcuucacugggugauaaccuuugaugaaaugagauauguccaaguaacguuaacugug

SEQ ID NO: 337920 - RNA, 64 nt, Human
auuauuuuuccuuaugaaaaaugaucuguuuuaaaugagauaaaauaggagaaguuccuggcuu

SEQ ID NO: 337921 - RNA, 64 nt, Human
uauuuucagauuuuggaauguuugcauauacauaaugagauauuuugggaauaggacccgagcc

SEQ ID NO: 337922 - RNA, 64 nt, Human
aauauguauuuucuucuugaauuucacuggccuaaugagauaauacucuuaucuuuggcucuac

SEQ ID NO: 337923 - RNA, 64 nt, Human
uagcuagcgcacagagcuuuggaagccugucauuaugagauacagucgguuuaccucaggaguc

SEQ ID NO: 337924 - RNA, 64 nt, Human
ggcccagggggugcuggugccuccccggggucugggcggagagaacaggaggaauggcugggaa

SEQ ID NO: 337925 - RNA, 60 nt, Human
ugaacuaccaguacagauaagcccccgcggggcggagauuucuaccuucugcacuuacuc

SEQ ID NO: 337926 - RNA, 64 nt, Human
uuccccauccaucucauugucuaaauauuuagaaggcggagaaguucccagaggcuucuguaca

SEQ ID NO: 337927 - RNA, 64 nt, Human
cuuaucuuuuaaaaaaaaaaaugaaaaaacacucaugagauaacugcauuucacccaacaaaag

SEQ ID NO: 337928 - RNA, 64 nt, Human
caugaggaauucaggagcagaaggucaggauagcaugagauagucucaauguggccaaccaaaa

SEQ ID NO: 337929 - RNA, 64 nt, Human
ugcagcgggaaccuuacuuuccuuuuaguuauaaaugagauaaacuggaaaauuucaguuguaa

SEQ ID NO: 337930 - RNA, 64 nt, Human
ccgggcaaaccccgucaauaccucccaccaaggaaugagauauguggaccucacugcuccccca

SEQ ID NO: 337931 - RNA, 64 nt, Human
aggcauacucuauauaauaaucacauuagaggaaaugagauauccauuaccucuagcauuuauu

SEQ ID NO: 337932 - RNA, 64 nt, Human
aaacccuuugaacaaagugugugcauaaccagucaugagauaaaacaacacaaugcauguugcc

SEQ ID NO: 337933 - RNA, 64 nt, Human
cagauacuggcagacaauucagaacuuucaccacaugagauaauugacacugaagggaaacagc

SEQ ID NO: 337934 - RNA, 64 nt, Human
aagagaaagaccaguggggauuuguaagacuuagaugagauagcgcauaauaaggggaagacuu

SEQ ID NO: 337935 - RNA, 64 nt, Human
gaagagacaaaguggggauauuuguaaggcuuagaugagauaguguuuuuuuagaaaaaaacuu

SEQ ID NO: 337936 - RNA, 64 nt, Human
cgcuaaucauuaaggaaaugcaaucaaagccacaaugagauaccaucucagaccugucugaaug

SEQ ID NO: 337937 - RNA, 64 nt, Human
cagcaauucuaugcugacauaacagaaaauguagaugagauagaugaaauacgaaaaauuacag

SEQ ID NO: 337938 - RNA, 64 nt, Human
agauuccuaagaucauagcauuaacaaguuguguaugagauaaaucaugcagauugaccccagc

SEQ ID NO: 337939 - RNA, 64 nt, Human
cagugugauuauaaaaaauaaaagaucguaugauaugagauacauacuaugaaaugaagauaga

SEQ ID NO: 337940 - RNA, 64 nt, Human
gagccccuggcccaaauuucugacccacaaaaacaugagauauaauaaaaugguuguuguuuua

SEQ ID NO: 337941 - RNA, 64 nt, Human
ggaggaaaugaaguacugugaauuuuuaaaacagaugagauaauuggugucgggaguguugcag

SEQ ID NO: 337942 - RNA, 64 nt, Human
acugcuuggaguccaggaugcccagaugugaggggcagaugaagggaauguugcuggaaaggug

SEQ ID NO: 337943 - RNA, 64 nt, Human
uguggguagcgcacauccccacagaucaaucucugcagaugacagggaggugcugugagaagug

SEQ ID NO: 337944 - RNA, 64 nt, Human
uaaaauuugaaaaaugauuguaggaucaaaaaaggcagaugaaauuacuuaauacucaguguuu

SEQ ID NO: 337945 - RNA, 64 nt, Human
uacauauuugauguaguaguuuauccauucaccuaugagauauauuugcacuguuuuccugguu

SEQ ID NO: 337946 - RNA, 64 nt, Human
cuugcuucucaaccuagucuaauaaacuaaggugaugagauauacaucuucuuccuuuugguuu

SEQ ID NO: 337947 - RNA, 64 nt, Human
uagcaacuaguuuuguagcacuacauuuaauguaaugagauaccuuuguucauuuuuuuaaauu

SEQ ID NO: 337948 - RNA, 64 nt, Human
guguucagagggagccaggaaucuacauggguagaugagauagacacagaccugcuccccgcag

SEQ ID NO: 337949 - RNA, 64 nt, Human
cguuuugcacaaagucuugcuucgcucagaugagaugagauaugauuuccuagagauguaaaaa

SEQ ID NO: 337950 - RNA, 64 nt, Human
agugucuuacagcggccaaaccaugacgugaagaaugagauaggagacaggagaucaccauaag

SEQ ID NO: 337951 - RNA, 64 nt, Human
aaauguaaaaaaaaaaaacuggcugaauggcugaaugagauaaaauuuaauuuuaaaaaauggu

SEQ ID NO: 337952 - RNA, 64 nt, Human
gaacaugcugucuccugucuuggccuccccuuucaugagauacuggggagaagagaacauuccu

SEQ ID NO: 337953 - RNA, 64 nt, Human
aggcuguuagacuguuagauuuaaauguauauugaugagauaaaaagcaaaacugugccuaaaa

SEQ ID NO: 337954 - RNA, 64 nt, Human
ccuggcuccaaaucuguguucuuuccacugacaaaugagauaugggauauggugcaucuuuaca

SEQ ID NO: 337955 - RNA, 64 nt, Human
agaaauugguuaugaauaaaagugacaauaaaacaugagauauaaaucaagcuuaaaaaaaaaa

SEQ ID NO: 337956 - RNA, 64 nt, Human
agcuauuuaugauucuauaagcuauuucagcagaaugagauauuaaacccaaugcuuugauugu

SEQ ID NO: 337957 - RNA, 64 nt, Human
uuagauauaaagaugaaaaacucagauaacucaaaugagauaucuauaucccuacaaccuaauu

SEQ ID NO: 337958 - RNA, 64 nt, Human
auuuugaagauggugaaagugacugauuuuaauaaugagauaggucacuuaaaauaacagugcc

SEQ ID NO: 337959 - RNA, 64 nt, Human
gaacucuuuauuugccuaauuuauauauauauauaugagauauauaaauauauauaaaauagcu

SEQ ID NO: 337960 - RNA, 64 nt, Human
cugaguuagguuccagcauguaaagagcugggagggcggagaauucuuagcauacauucagacg

SEQ ID NO: 337961 - RNA, 64 nt, Human
cgccuucucugaaaacaaugcugagaaugagagcggcggagacaagccccccaucgaucccagu

SEQ ID NO: 337962 - RNA, 64 nt, Human
ccuucagugcccugccuguacucgagcggcuccgggcggagaacaagucggcugugaguuuccu

SEQ ID NO: 337963 - RNA, 64 nt, Human
ggaaccgauuuuuuuuauccaaugugaauuauaaaugagauaauccacaguuauucauugugga

SEQ ID NO: 337964 - RNA, 64 nt, Human
uaaaaucuuaggagauaaacacauucaaaaaggaaugagauaaaaagaauaaggcaauaaaugu

SEQ ID NO: 337965 - RNA, 64 nt, Human
gaaaguagagagaucugcccuguguuauccaguuaugagauaaaaaaugaauauaagagugcuu

SEQ ID NO: 337966 - RNA, 64 nt, Human
auggcucaucauaggggaaaccugcugcuacaucaugagauagcccuguggaaagguccacaug

SEQ ID NO: 337967 - RNA, 64 nt, Human
ggaaucucugauuacaguggccuugagcuucaaaaugagauaugcaauaaauauuauuugauga

SEQ ID NO: 337968 - RNA, 64 nt, Human
uuuagaaaugugaaacaacauagcaguaaaauacaugagauaaagacauaaagaaauuaaacaa

SEQ ID NO: 337969 - RNA, 64 nt, Human
gcuuaaaauugugagcgaauuagcaauaacauacaugagauaacucaagaaaucaaaagauagu

SEQ ID NO: 337970 - RNA, 64 nt, Human
uuuaaaaaaaaaaucacuucacuuauauuaagcaaugagauauacuaaacaaugagauucuaua

SEQ ID NO: 337971 - RNA, 64 nt, Human
aacuauucucacaguaaaagagggggugagaauaaugagauaucugaaaccagguagaaggaag

SEQ ID NO: 337972 - RNA, 64 nt, Human
guugggaguguuaguaaucaagguuuagaacaccaugagauaguuaccccugaucuccaguccc

SEQ ID NO: 337973 - RNA, 64 nt, Human
uuggagagagagcuccucauuucucgaaugaaagaugagauauauucauccucauguaccacau

SEQ ID NO: 337974 - RNA, 64 nt, Human
uaaauuaaacacagacucuucuauaaauauuuucaugagauacuguguuacacaaaguccuugu

SEQ ID NO: 337975 - RNA, 64 nt, Human
gcuuagaauugugaaagaauuagcaguaaaauacaugagauaaagaccucaagaaguuaaaaga

SEQ ID NO: 337976 - RNA, 64 nt, Human; identical to SEQ ID NO: 337969

SEQ ID NO: 337977 - RNA, 64 nt, Human
uacuuagaaaugugaaaaaugagcaguaaaauagaugagauaaagaacuaaagaaauuaagaga

SEQ ID NO: 337978 - RNA, 64 nt, Human
ggcugcuccccccaacaucuggaccagcugcccuggcggagagacagcaaggggccggcaggug

SEQ ID NO: 337979 - RNA, 64 nt, Human
ugugggggaagagccggucaccggagagugagcaggcggagacuccaagcugggcugagccaga

SEQ ID NO: 337980 - RNA, 64 nt, Human
gaggcugagacaggagaaucgcuuaaaccugggaggcggagaguacagugagccaagaucgcgc

SEQ ID NO: 337981 - RNA, 64 nt, Human
ucauguagccucuggaaaaguccucuguauccucaugagauaacgagagggggaaaaaaagcua

SEQ ID NO: 337982 - RNA, 64 nt, Human
acacucuccuugcaguucuugaguugcggcagaacaucgcgaugggaaccgauggugggugggg

SEQ ID NO: 337983 - RNA, 64 nt, Human
ccgucugcccguggaccuggcugaggagcugggccaucgcgaugucgcacgguaccugcgcgcg

SEQ ID NO: 337984 - RNA, 64 nt, Human
caagagaugagccaggguccaggagacagaugcccaucgcgaguacagacuuuguccuauuggc

SEQ ID NO: 337985 - RNA, 64 nt, Human
uuuccguuaucacccaggccugauucacuggccuggcggagaugcuucuaaggcauggucgggg

SEQ ID NO: 337986 - RNA, 64 nt, Human
agagcaucccguguggauaugaggcugguguagaggcggagaggagccaagaaacuaaagguga

SEQ ID NO: 337987 - RNA, 64 nt, Human
aucgagaucugagcagcccuggcaccggguacugggcggagagcccccguggcauuuggcuuga

SEQ ID NO: 337988 - RNA, 64 nt, Human
gcugcaucuucgcgugugcucagaggugguuguuggcggagaacgccgccgcaguguuugaccu

SEQ ID NO: 337989 - RNA, 64 nt, Human
ggggcugucagugaaagagccccagcugguguggggcggagacgcuaaccgcccuucugcguuc

SEQ ID NO: 337990 - RNA, 64 nt, Human; identical to SEQ ID NO: 337728

SEQ ID NO: 337991 - RNA, 64 nt, Human
gaggcugaagcaggauaaucgcuugaacccgggcggcggagauugcagugagccgaggucaugc

SEQ ID NO: 337992 - RNA, 64 nt, Human
gcccagcccuggcaggggucuggccccccagguaggcggagagcagucccucccucaggaacug

SEQ ID NO: 337993 - RNA, 64 nt, Human
caccccaacacuuccagcauuuagcuggccacauggcggagaguuuuaauuuuuaacuuauuga

SEQ ID NO: 337994 - RNA, 64 nt, Human
aggagccugguggcugccucagggcagggugccuggcggagaaggccugggcccucccacuggu

SEQ ID NO: 337995 - RNA, 64 nt, Human
cgcccccuucaguacugcgcguucuaagacuuuuggcggagacuuucuuggcaaaacccauucc

SEQ ID NO: 337996 - RNA, 64 nt, Human; identical to SEQ ID NO: 133027

SEQ ID NO: 337997 - RNA, 64 nt, Human; identical to SEQ ID NO: 133028

SEQ ID NO: 337998 - RNA, 64 nt, Human; identical to SEQ ID NO: 133029

SEQ ID NO: 337999 - RNA, 64 nt, Human; identical to SEQ ID NO: 133030

SEQ ID NO: 338000 - RNA, 64 nt, Human; identical to SEQ ID NO: 133031

SEQ ID NO: 338001 - RNA, 64 nt, Human; identical to SEQ ID NO: 133032

SEQ ID NO: 338002 - RNA, 64 nt, Human; identical to SEQ ID NO: 133033

SEQ ID NO: 338003 - RNA, 64 nt, Human; identical to SEQ ID NO: 133034

SEQ ID NO: 338004 - RNA, 64 nt, Human; identical to SEQ ID NO: 133035

SEQ ID NO: 338005 - RNA, 64 nt, Human; identical to SEQ ID NO: 133036

SEQ ID NO: 338006 - RNA, 64 nt, Human; identical to SEQ ID NO: 133037

SEQ ID NO: 338007 - RNA, 64 nt, Human; identical to SEQ ID NO: 133038

SEQ ID NO: 338008 - RNA, 64 nt, Human; identical to SEQ ID NO: 133039

SEQ ID NO: 338009 - RNA, 64 nt, Human; identical to SEQ ID NO: 133040

SEQ ID NO: 338010 - RNA, 64 nt, Human; identical to SEQ ID NO: 133041

SEQ ID NO: 338011 - RNA, 62 nt, Human; identical to SEQ ID NO: 278605

SEQ ID NO: 338012 - RNA, 62 nt, Human; identical to SEQ ID NO: 278606

SEQ ID NO: 338013 - RNA, 62 nt, Human; identical to SEQ ID NO: 278607

SEQ ID NO: 338014 - RNA, 64 nt, Human; identical to SEQ ID NO: 133042

SEQ ID NO: 338015 - RNA, 64 nt, Human; identical to SEQ ID NO: 133043

SEQ ID NO: 338016 - RNA, 64 nt, Human; identical to SEQ ID NO: 133044

SEQ ID NO: 338017 - RNA, 64 nt, Human; identical to SEQ ID NO: 133045

SEQ ID NO: 338018 - RNA, 64 nt, Human; identical to SEQ ID NO: 133046

SEQ ID NO: 338019 - RNA, 64 nt, Human; identical to SEQ ID NO: 133047

SEQ ID NO: 338020 - RNA, 64 nt, Human; identical to SEQ ID NO: 133048

SEQ ID NO: 338021 - RNA, 55 nt, Human; identical to SEQ ID NO: 133049

SEQ ID NO: 338022 - RNA, 64 nt, Human; identical to SEQ ID NO: 133050

SEQ ID NO: 338023 - RNA, 64 nt, Human; identical to SEQ ID NO: 133051

SEQ ID NO: 338024 - RNA, 64 nt, Human; identical to SEQ ID NO: 133052

SEQ ID NO: 338025 - RNA, 64 nt, Human; identical to SEQ ID NO: 133053

SEQ ID NO: 338026 - RNA, 64 nt, Human; identical to SEQ ID NO: 133054

SEQ ID NO: 338027 - RNA, 64 nt, Human; identical to SEQ ID NO: 133055

SEQ ID NO: 338028 - RNA, 64 nt, Human; identical to SEQ ID NO: 133056

SEQ ID NO: 338029 - RNA, 62 nt, Human; identical to SEQ ID NO: 278608

SEQ ID NO: 338030 - RNA, 62 nt, Human; identical to SEQ ID NO: 278609

SEQ ID NO: 338031 - RNA, 62 nt, Human; identical to SEQ ID NO: 278611

SEQ ID NO: 338032 - RNA, 64 nt, Human; identical to SEQ ID NO: 133057

SEQ ID NO: 338033 - RNA, 64 nt, Human; identical to SEQ ID NO: 133058

SEQ ID NO: 338034 - RNA, 64 nt, Human; identical to SEQ ID NO: 133059

SEQ ID NO: 338035 - RNA, 64 nt, Human; identical to SEQ ID NO: 133060

SEQ ID NO: 338036 - RNA, 64 nt, Human; identical to SEQ ID NO: 133061

SEQ ID NO: 338037 - RNA, 64 nt, Human; identical to SEQ ID NO: 133062

SEQ ID NO: 338038 - RNA, 64 nt, Human; identical to SEQ ID NO: 133063

SEQ ID NO: 338039 - RNA, 64 nt, Human; identical to SEQ ID NO: 133064

SEQ ID NO: 338040 - RNA, 64 nt, Human; identical to SEQ ID NO: 133065

SEQ ID NO: 338041 - RNA, 64 nt, Human; identical to SEQ ID NO: 133066

SEQ ID NO: 338042 - RNA, 64 nt, Human; identical to SEQ ID NO: 133067

SEQ ID NO: 338043 - RNA, 62 nt, Human; identical to SEQ ID NO: 278674

SEQ ID NO: 338044 - RNA, 62 nt, Human; identical to SEQ ID NO: 278675

SEQ ID NO: 338045 - RNA, 62 nt, Human; identical to SEQ ID NO: 278676

SEQ ID NO: 338046 - RNA, 64 nt, Human
ggaggaaggagagcaauuucuaaguuucaauccugcgcuguacaguugaagaagaguguggagg

SEQ ID NO: 338047 - RNA, 64 nt, Human
cugagcagcuaccauguucaagguaauaugccaggcgcuguaugucuccacugccaaguagaag

SEQ ID NO: 338048 - RNA, 64 nt, Human
caaaauggcauggagaucagcugccugagcaccugcgcuguagcuuaucugacaacgcugaggc

SEQ ID NO: 338049 - RNA, 64 nt, Human
aacuuuagccccaacucugugcucacagaaacaugcgcuguaaugaaucaaaguuuaauggauu

SEQ ID NO: 338050 - RNA, 52 nt, Human
agaugaccauguggggauagaggcgcuguaggagccuggucaucucuaccag

SEQ ID NO: 338051 - RNA, 64 nt, Human
uguugcagacuacagaacauuguucucccuucaagcgcuguaaagcaccaacccggaaguggca

SEQ ID NO: 338052 - RNA, 64 nt, Human
ugagaagagcaaaagcuuuauaaauauaccugaugcgcuguagaaugaaaauguaaaagauaac

SEQ ID NO: 338053 - RNA, 64 nt, Human
gcuguaaacuacaauguaaaaccucaauaaaagugcgcuguacuucuuaauguuuauuaaaaga

SEQ ID NO: 338054 - RNA, 64 nt, Human
cauuucccagagcuaugacgaugagaggaagacugcgcuguauuuuggcguuucuaauaaugac

SEQ ID NO: 338055 - RNA, 64 nt, Human
auggcucaguaccaugucauguugccuccucugggcgcuguaaguuaagcucuacauagauuaa

SEQ ID NO: 338056 - RNA, 64 nt, Human
gcuuaugccuuucguuuauccuugggguuugagagcgcuguauuugggagagaguuuaaaaaua

SEQ ID NO: 338057 - RNA, 64 nt, Human
auuugggauggaagcaggacagacaccguggacagcgcuguauuuacagacacacccagugcgu

SEQ ID NO: 338058 - RNA, 64 nt, Human
guaaauaaauuuauuuuuuuaugaauaauaaaacgcgcuguaaaaaccgugugccccuuggagg

SEQ ID NO: 338059 - RNA, 64 nt, Human
cggcccacuccggggagggggugugcugugcugagcgcuguaucccugaauauaguuuauuuuu

SEQ ID NO: 338060 - RNA, 62 nt, Human; identical to SEQ ID NO: 278615

SEQ ID NO: 338061 - RNA, 62 nt, Human; identical to SEQ ID NO: 278616

SEQ ID NO: 338062 - RNA, 62 nt, Human; identical to SEQ ID NO: 278620

SEQ ID NO: 338063 - RNA, 64 nt, Human
auuaauuuaugcagaauguugauuacagugcagugcgcuguaguaggcauuuuuaccaucacug

SEQ ID NO: 338064 - RNA, 64 nt, Human
caaauacgacuucauuuggcuucgaguuccccaggcgcuguagacacaacaugaaucgggcucu

SEQ ID NO: 338065 - RNA, 64 nt, Human
cugaugugggcuaguaagacuccaguucuuagaggcgcuguaguauuuuuuuuuuuuugucuca

SEQ ID NO: 338066 - RNA, 64 nt, Human
aauuuguuugaaauugaggaagcaguuaaauugugcgcuguauuuugcagauuauggggauuca

SEQ ID NO: 338067 - RNA, 64 nt, Human
aaaccaucucuccaaagcauuaauauccaaucaugcgcuguauguuuuaaucagcagaagcaug

SEQ ID NO: 338068 - RNA, 64 nt, Human
uaugcauaaauauuuauauuuuaucuaaauaacugcgcuguaacaaacuuuguguuagacaguu

SEQ ID NO: 338069 - RNA, 64 nt, Human
caugcguggcacucacccgcagucuccuggacaggcgcuguauuuuauucugucgcagagcuaa

SEQ ID NO: 338070 - RNA, 64 nt, Human
gaguguguuucauuuguucuggugccaagaaugagcgcuguacuaugguaguucccuuaggauu

SEQ ID NO: 338071 - RNA, 64 nt, Human
gggccgccccagccaccuccgagggccagagcaagcgcuguaaacccugacggugggccuggca

SEQ ID NO: 338072 - RNA, 64 nt, Human
gggaaucaugucuuauccucacaacaaaaguauugcgcuguaaugucacagagcugguuucagc

SEQ ID NO: 338073 - RNA, 64 nt, Human
auuucucauccgagaaauuacuuaacccuuccuggcgcuguacagucaucuuuuauucuauuuc

SEQ ID NO: 338074 - RNA, 64 nt, Human
guuucagaugugaacaucacguguuauaacuguagcgcuguaaauuuuuuugugggaggguggg

SEQ ID NO: 338075 - RNA, 64 nt, Human
gcccugcggcgcggucuggcugccccaugggccugcgcuguagacgucccccauaggucgcccc

SEQ ID NO: 338076 - RNA, 64 nt, Human
ccccgggaccauagccaagggggucaucggccccgcgcuguacagccuccguauacauauguac

SEQ ID NO: 338077 - RNA, 64 nt, Human
gcagugaggcaggacagauggacagguuccuccugcgcuguaauucccugcucccuggagacug

SEQ ID NO: 338078 - RNA, 64 nt, Human
caccccugucugcacaugaguuguucugacaacagcgcuguauacgcuucaguuuuuccacauu

SEQ ID NO: 338079 - RNA, 62 nt, Human; identical to SEQ ID NO: 278612

SEQ ID NO: 338080 - RNA, 62 nt, Human; identical to SEQ ID NO: 278613

SEQ ID NO: 338081 - RNA, 62 nt, Human; identical to SEQ ID NO: 278624

SEQ ID NO: 338082 - RNA, 64 nt, Human
uugaacuggcucccggggaacauucagagcaugauugguagacagaagggugcagaggcgccca

SEQ ID NO: 338083 - RNA, 64 nt, Human
uuacggucccgggccaguaacagcaccugggagcuugguagaaaugcagaaucuuagccuaggc

SEQ ID NO: 338084 - RNA, 64 nt, Human
cuuagguuggagaguauugauuucaaauaggaaguugguagacuaggugugaggaugaaauaau

SEQ ID NO: 338085 - RNA, 64 nt, Human
acuuucuuggaauucacuauucuggcaauaaauuuugguagacuaauacaguacagcuagaccc

SEQ ID NO: 338086 - RNA, 64 nt, Human
guacauccuccugcuaacuaucacuucaguugguuugguagagacuucaaacccuugcacauau

SEQ ID NO: 338087 - RNA, 64 nt, Human
cucacccucaccaucugaggggcucccugagaucuugguagaggaggccccuccugcccagacc

SEQ ID NO: 338088 - RNA, 64 nt, Human
aaaugcagccaccuuggcagguuccagguggaaguugguagaaggccccugccaggucacagca

SEQ ID NO: 338089 - RNA, 64 nt, Human
uguugucuuugaaugauuugcugucacagacuauuugguagaagaaauauuuuucaccugagag

SEQ ID NO: 338090 - RNA, 64 nt, Human
gucacugauggucacuccgauucugagugccacauugguagacuccuaaaauacaguugacaac

SEQ ID NO: 338091 - RNA, 64 nt, Human
ccccaccuucucggcuucugguuuuucuuucuuuuugguagaacacaacaucuaccauucaguu

SEQ ID NO: 338092 - RNA, 64 nt, Human
aagugugccaaggaagcucuguggcguuguguuauugguagacacccucagccucaucauuuga

SEQ ID NO: 338093 - RNA, 64 nt, Human
uugucucauuaaaaauaaacuuucauauucauauuugguagaacuguuaaccuagaaauguagc

SEQ ID NO: 338094 - RNA, 64 nt, Human
uuuauguucacacacugaaaacuuaguuuuuuuguugguagauccaugugcaugcuagaauuug

SEQ ID NO: 338095 - RNA, 64 nt, Human
guuuuuuuguuguuguuguuguuguuuuguauuuuugguagagacgggguuucaucauguugcc

SEQ ID NO: 338096 - RNA, 64 nt, Human
uaagacccucugauucugugaguuuuccauguauuugguagauaaaugacuaacgaggcugggc

SEQ ID NO: 338097 - RNA, 62 nt, Human; identical to SEQ ID NO: 278628

SEQ ID NO: 338098 - RNA, 62 nt, Human; identical to SEQ ID NO: 278629

SEQ ID NO: 338099 - RNA, 62 nt, Human; identical to SEQ ID NO: 278630

SEQ ID NO: 338100 - RNA, 64 nt, Human
accacaccuggcuaauuuuuacuuuuuuuuuuuuuugguagagauggagucuugcuauauugcc

SEQ ID NO: 338101 - RNA, 64 nt, Human
aauaaaguuaaaaacaguuaaaauaaggaguauuuugguagaguauauacauaccucacugcca

SEQ ID NO: 338102 - RNA, 64 nt, Human
agaaguuaaaacccuuuguaucaaaagaucuuuauugguagagcacugguuaucuucuggauac

SEQ ID NO: 338103 - RNA, 64 nt, Human
caguuucucccaaugauuaugacugggacauucuuugguagauaccauuugcuacuaguuuauu

SEQ ID NO: 338104 - RNA, 64 nt, Human
gugccuucugagcugucuaaaaguuacauugugcuugguagauuuaguguuaagugugcaguau

SEQ ID NO: 338105 - RNA, 64 nt, Human
cugugccuaugauucuuaaggagaaagugaaucauugguagauauccugcacaagcagcuggac

SEQ ID NO: 338106 - RNA, 64 nt, Human
gggagguggggagggguacgaguccacuguugcuuugguagagaugagaggccgcauuuugcug

SEQ ID NO: 338107 - RNA, 64 nt, Human
ccccucugcugccucuccccaccccuuaaagcaguugguagaaggaaugguauuuguauggggg

SEQ ID NO: 338108 - RNA, 64 nt, Human
aguauguguucuuuauuccuagaagccacugugcuugguagagugcaucacucaccacagcugc

SEQ ID NO: 338109 - RNA, 64 nt, Human
gacggaaacuuuggcuggaugcaagagcuuuaaauugguagaaaagucacaagaugagcuugug

SEQ ID NO: 338110 - RNA, 64 nt, Human
caugcggcaccauucccggcuaauuuuuguauuuuugguagagauggguuuucaccauguuggc

SEQ ID NO: 338111 - RNA, 64 nt, Human
ggagugccaaguuugcaaaccugcaguuuuuaauuugguagaugacaaauauucugaaucacca

SEQ ID NO: 338112 - RNA, 64 nt, Human
guuauuucacaguuguagcuacacaguaaguagcuugguagauaguuauugaauguauuuaugu

SEQ ID NO: 338113 - RNA, 64 nt, Human
aagcuuugccuuuguuuugaacuuccuuucccacuugguagaaagagcccagaagcagcccugg

SEQ ID NO: 338114 - RNA, 64 nt, Human
cacuaagcuguggcuggaauugauuaggaagcauuugguagaaggacugaacaacuguugggau

SEQ ID NO: 338115 - RNA, 62 nt, Human; identical to SEQ ID NO: 278637

SEQ ID NO: 338116 - RNA, 62 nt, Human; identical to SEQ ID NO: 278638

SEQ ID NO: 338117 - RNA, 62 nt, Human; identical to SEQ ID NO: 278639

SEQ ID NO: 338118 - RNA, 64 nt, Human
aucccauuucuugaaaagccuuggagaacucgguuugguagacuuggacaucucucuggcuucu

SEQ ID NO: 338119 - RNA, 64 nt, Human
cuagagaauguguuaaggagggaauguauaugucuugguagaccaggaggccuuugccagcaau

SEQ ID NO: 338120 - RNA, 64 nt, Human
augaaauuuugugguggugccaugcaauccccuuuugguagaauugccacaaacaaggcucaaa

SEQ ID NO: 338121 - RNA, 64 nt, Human
uuugcccugagcugaacuggguuguguuaacacauugguagagcuaugauuccuucccaguucu

SEQ ID NO: 338122 - RNA, 64 nt, Human
uccaucuuugugugcacagagccuagcacagggcuugguagaggguauaucuagugaauggaga

SEQ ID NO: 338123 - RNA, 64 nt, Human
ugcugaaguguugaauaaggcccacgugaagaguuugguagaaauagccuugucaagagaacua

SEQ ID NO: 338124 - RNA, 64 nt, Human
guauucccccuccucuuugcauuaaucaagguauuugguagagguggaaucuaaguguuuguau

SEQ ID NO: 338125 - RNA, 64 nt, Human
gugccaccaugcccagcaaauuuuguauuuuuuuuugguagagacaggguucaaccauguuggu

SEQ ID NO: 338126 - RNA, 64 nt, Human
ugaaggaagccaaauuuaucaaagcauagauguuuugguagauuaaauauagauuagaaaaauu

SEQ ID NO: 338127 - RNA, 64 nt, Human
cacacaccaccauaccuggcuaauuuuuguauuuuugguagacaugggguuucaccaaguuggc

SEQ ID NO: 338128 - RNA, 50 nt, Human
ccagcuuuuccuuucaguaguugguagagcugaggaagaguuagggccuc

SEQ ID NO: 338129 - RNA, 64 nt, Human
ggagguuugaggagagagaacugcucggaagacauugguagauggaccauaaaaacagaguuag

SEQ ID NO: 338130 - RNA, 64 nt, Human
caguuuuuaaaaaucagagcgcucuagccacuacuugguagaaaguagcauuuuuuuuuucagu

SEQ ID NO: 338131 - RNA, 64 nt, Human
aucugucaccacacccagcuaacuuuuuguauuuuugguagagacgggguuucgccauauugac

SEQ ID NO: 338132 - RNA, 64 nt, Human
aauuugacuauagagauuauuucuguaaaugaaauugguagagaaccaugaaauuacauagaug

SEQ ID NO: 338133 - RNA, 62 nt, Human; identical to SEQ ID NO: 278577

SEQ ID NO: 338134 - RNA, 62 nt, Human; identical to SEQ ID NO: 278578

SEQ ID NO: 338135 - RNA, 62 nt, Human; identical to SEQ ID NO: 278631

SEQ ID NO: 338136 - RNA, 62 nt, Human; identical to SEQ ID NO: 278632

SEQ ID NO: 338137 - RNA, 64 nt, Human
ugacaguguuguucaaagacagccuaguaaguaauugguagaaaugcccuuauaaaaaccauuc

SEQ ID NO: 338138 - RNA, 64 nt, Human
aaguguugcccugcacuauggcuggaggacacauuugguagaggucacacugcagcucccagug

SEQ ID NO: 338139 - RNA, 60 nt, Human
agagagaaucagaagcauaagcuuauacuuuugguagauauucccccuuggaauuugaca

SEQ ID NO: 338140 - RNA, 64 nt, Human
caaaguauauuagcaaaaguauuugcuggaauuauugguagauggcagucccacuccuacaccu

SEQ ID NO: 338141 - RNA, 64 nt, Human
uccaacucuguuuaguguauuaauuaccaguggauugguagaacugcuuuuuauugacuaguaa

SEQ ID NO: 338142 - RNA, 64 nt, Human
uucuuuccagacagcauccuccccgccuuccaccuugguagaugcaaggucuaucucucccauc

SEQ ID NO: 338143 - RNA, 64 nt, Human
gugagcugauuuauucugauucauuauauuccuuuugguagauuuuauaccccuuggggaaaua

SEQ ID NO: 338144 - RNA, 64 nt, Human
uagaaaugcauguaauauccauauuaguuuuuucuugguagacaacuggaagguuuucuuuuuu

SEQ ID NO: 338145 - RNA, 64 nt, Human
ugccuuguuaacaauauguuugcaggcuguaugcuugguagaagucaucgccauucuccauucu

SEQ ID NO: 338146 - RNA, 64 nt, Human
cagaaucucucuucuuuucaaguugggugauauguugguagauucuaauggcuuuauugcagcg

SEQ ID NO: 338147 - RNA, 64 nt, Human
cuucuguccuuccauguguggggaaaggguguuuuugguagagcuugguuuccaaagcgccugg

SEQ ID NO: 338148 - RNA, 64 nt, Human
gggaaaggauuuggauaaaauuuuuguuuaaauuuugguagauuuuuaucuauacaaauuuaaa

SEQ ID NO: 338149 - RNA, 64 nt, Human
cugcauuuaacuacaaaaaaaguuuauguuuaguuugguagagguguuauguauaaugcuuugu

SEQ ID NO: 338150 - RNA, 64 nt, Human
aaguagugucagauuuuuguugcuugggcggcuguugguagagugggcagugcccgcgccaugg

SEQ ID NO: 338151 - RNA, 64 nt, Human
ucuaagugugaauauggcaugcuaauuagcuaauuugguagaagcuaauuugcuucuaaaaauc

SEQ ID NO: 338152 - RNA, 62 nt, Human; identical to SEQ ID NO: 278565

SEQ ID NO: 338153 - RNA, 62 nt, Human; identical to SEQ ID NO: 278566

SEQ ID NO: 338154 - RNA, 62 nt, Human; identical to SEQ ID NO: 278640

SEQ ID NO: 338155 - RNA, 64 nt, Human
cacaauuuuuuuacugcuuuaauucuacuuaauuuugguagauauugaauggcuuggaaaagag

SEQ ID NO: 338156 - RNA, 64 nt, Human
gguacaggcaagcuugugugggcccaacaggcccuugguagagcuggugccagaugugggcuca

SEQ ID NO: 338157 - RNA, 64 nt, Human
ucauacucuaacccuuagugagggcaaaguguaguugguagaagaaauugcuaaauaccuaucu

SEQ ID NO: 338158 - RNA, 64 nt, Human
uauguaccuggucccuaauuaagcugcguuaaauuugguagaagcauuuaaauggucuaucuuc

SEQ ID NO: 338159 - RNA, 64 nt, Human
cacuuauuagugaaaccucauuuuagaucugacauugguagauagauggauuuaggcaaauaug

SEQ ID NO: 338160 - RNA, 64 nt, Human
auaaaguguaaaaugcagauguucuucaccccuuuugguagaacaaaagcaggaugauaaccau

SEQ ID NO: 338161 - RNA, 64 nt, Human
ugccuuuauaggccucagauacugaagauuauuuuugguagaagcaccguguaggcuuuuucug

SEQ ID NO: 338162 - RNA, 64 nt, Human
ggccaacccaucucaccugacacugaauacugccuugguagaaagugaggaccuguaauccagc

SEQ ID NO: 338163 - RNA, 64 nt, Human
ucauuaguucuaaauaaaagccuguuggcaaguguugguagauuacaacucuuuuuauuugaag

SEQ ID NO: 338164 - RNA, 64 nt, Human
uaagagcauuggaaguaguuacaacucaaggauuuugguagaaagguaugaguuuggucgaaaa

SEQ ID NO: 338165 - RNA, 64 nt, Human
agauaaguuauuuugcacuuucuuauguauaaaguugguagaaacuuauuuuugcuuuguauca

SEQ ID NO: 338166 - RNA, 64 nt, Human
uuguaacacuacuucugcuguucaaucaagagucuugguagauaagaaaaaaaucagucaauau

SEQ ID NO: 338167 - RNA, 64 nt, Human
cuggagcuucucuuuaacucaggacuccagcccauugguagacguguguuucuagagccugcug

SEQ ID NO: 338168 - RNA, 64 nt, Human
ucauuucucccuauucaaaugagaauauuuucccuugguagaauccauauacaauauggauuga

SEQ ID NO: 338169 - RNA, 64 nt, Human
cucugauucccugauuuaauaugcaaagucuagguugguagaguuuagcccugaacauuucaug

SEQ ID NO: 338170 - RNA, 62 nt, Human; identical to SEQ ID NO: 278621

SEQ ID NO: 338171 - RNA, 62 nt, Human; identical to SEQ ID NO: 278622

SEQ ID NO: 338172 - RNA, 62 nt, Human; identical to SEQ ID NO: 278677

SEQ ID NO: 338173 - RNA, 64 nt, Human
cucaucuuuaucaccuaaugguaguuuguuuucuuugguagaguauauggcagucccacaucga

SEQ ID NO: 338174 - RNA, 64 nt, Human
acuaccacaccaggccaauuuuuguuuuuuuuuuuugguagaaacgggucuguuuugcccaggc

SEQ ID NO: 338175 - RNA, 64 nt, Human
gccaccaugcuugacuaauuuuugugauuuuuuuuugguagagaccagggguuucacuauguug

SEQ ID NO: 338176 - RNA, 64 nt, Human
guuagcuccauaagcugccaguguugcuuuucuguugguagagcucucccauuuggugacaugg

SEQ ID NO: 338177 - RNA, 64 nt, Human
uuguaaaugaaaaaaauauagaaacuauuuaguuuugguagauuuuuuuucugacaaugugacc

SEQ ID NO: 338178 - RNA, 64 nt, Human
ugggugguuuauacccugagccaaccuuuaaaaauugguagauuucacauaaaaguccagaucc

SEQ ID NO: 338179 - RNA, 64 nt, Human
ucuucacgaacagcguuuuuaacaagauuucagcuugguagagcugacaaagcagauaaaaucu

SEQ ID NO: 338180 - RNA, 64 nt, Human
guuucugaacaauggggacuuuguugguagccauuugguagauguucuuuucuauuuauaagug

SEQ ID NO: 338181 - RNA, 64 nt, Human
uacuuuucucucauuguuuccugaauuauucgcauugguagaaauauauuagggaaagaaagua

SEQ ID NO: 338182 - RNA, 64 nt, Human
uuguuucuguaagauuuuccauuguauccucuuuuugguagaugcugggcucaucuucuagaau

SEQ ID NO: 338183 - RNA, 64 nt, Human
cgcuggucacacagcucccggaugaagauaacaguugguagaccaaaaggugaccucgcuuagu

SEQ ID NO: 338184 - RNA, 64 nt, Human
aacuguucucugucccccaaccaucuccugauauuugguagaguaacaccuuuauacgugugcu

SEQ ID NO: 338185 - RNA, 64 nt, Human
gcccucccuguugcucuaggaggcuccugcuggcuugguagaagacagaauucgaucugccugu

SEQ ID NO: 338186 - RNA, 64 nt, Human
aacaaaaguaagccauccucaaauaaggaaccccuugguagauauuaaccuuaaaaaggguuuu

SEQ ID NO: 338187 - RNA, 64 nt, Human
cacgcaauauauaauuuuaaagaaaauauucuauuugguagaauacaaaugugguguguguugu

SEQ ID NO: 338188 - RNA, 62 nt, Human; identical to SEQ ID NO: 278642

SEQ ID NO: 338189 - RNA, 62 nt, Human; identical to SEQ ID NO: 278643

SEQ ID NO: 338190 - RNA, 62 nt, Human; identical to SEQ ID NO: 278644

SEQ ID NO: 338191 - RNA, 64 nt, Human
auuguaaccuaacagaccaucacagauuggaaacuugguagauagcagagcaugguauuaguga

SEQ ID NO: 338192 - RNA, 64 nt, Human
auaaacuaaagggggauuuucuuucuucuuuuguuugguagaaaauuauccuuuucuaaaaacu

SEQ ID NO: 338193 - RNA, 64 nt, Human
uagcaguaggcacuuaagcauuuagucaaugauauugguagaaauaguaaaauacauccuuuaa

SEQ ID NO: 338194 - RNA, 64 nt, Human
auaugcaauuaauaguaguuaagaauuuauucauuugguagauauguuuauuugguuuuugguu

SEQ ID NO: 338195 - RNA, 64 nt, Human
gguuucugauucuucaaagaggcacagagccaaauugguagaggaaggaugcaaaguauaaauu

SEQ ID NO: 338196 - RNA, 64 nt, Human
ggcauguaaacggucaguugcacugccuagugguuugguagaucugacuuguaagcaguucaua

SEQ ID NO: 338197 - RNA, 64 nt, Human
aaaacccauacuuaccuugagucugagaaaaccuuugguagaagcuccugucuuaucaggcccc

SEQ ID NO: 338198 - RNA, 64 nt, Human
caaugaaaaagaagaauuaugcacacaucuaacauugguagauuucuaaagacaacucauaaau

SEQ ID NO: 338199 - RNA, 64 nt, Human
aacaguuauuacaaauauuuuauacauaaaucucuugguagauuuucagaauaauagagauuua

SEQ ID NO: 338200 - RNA, 64 nt, Human
uaccaucuguuuuguuuuuguuuuuaucuauaucuugguagauguauuucaucccuagagcagg

SEQ ID NO: 338201 - RNA, 64 nt, Human
uacagagcucuuuuuuccccucauaaccuuguuuuugguagaaaauaagcuagagaaauuaagc

SEQ ID NO: 338202 - RNA, 64 nt, Human
agugcugaguacagaaaguuauccaaaacaaaaguugguagauaacuaauagugaacaaguuuu

SEQ ID NO: 338203 - RNA, 64 nt, Human
acaaagagaagugguaauaggaaacggaagagacuugguagacgagauaaggaggacaagagaa

SEQ ID NO: 338204 - RNA, 64 nt, Human
ucaggcacucguaacuaaggaccaccauuggccauugguagauguuugauugacuuaacaagag

SEQ ID NO: 338205 - RNA, 64 nt, Human
ccaaaggcuuauucuguugccugcgugugaauguuugguagagcuauaucauugucuguuaaug

SEQ ID NO: 338206 - RNA, 62 nt, Human; identical to SEQ ID NO: 278535

SEQ ID NO: 338207 - RNA, 62 nt, Human; identical to SEQ ID NO: 278536

SEQ ID NO: 338208 - RNA, 62 nt, Human; identical to SEQ ID NO: 278537

SEQ ID NO: 338209 - RNA, 64 nt, Human
uuucauuucuagugcuucgcuguaaguggcuagguugguagaaucaaaaacaagggccagaugu

SEQ ID NO: 338210 - RNA, 64 nt, Human
gcauuuuaaauuuaguguaucaugcgaguuuuuuuugguagaugcugaagaaugugguugcuaa

SEQ ID NO: 338211 - RNA, 64 nt, Human
ugugcaccaccacgccccgcuaauuuuuguauuuuugguagagacgggguuucaccguguuggc

SEQ ID NO: 338212 - RNA, 64 nt, Human
uuccguucuuacugccuuuucuagaggacugccauugguagagcuggggugcucucaguuuccg

SEQ ID NO: 338213 - RNA, 64 nt, Human
agugaagauagcagggaugcuguguucacccuucuugguagaagcuaaggugugagcugggagg

SEQ ID NO: 338214 - RNA, 64 nt, Human
guugguuuauuguugaauuccuagaaaaguuuuauugguagaugaguaaauaaaauauuguaaa

SEQ ID NO: 338215 - RNA, 64 nt, Human
acgcaccaccaugccuagcuauucuuuuguauuuuugguagagacaggguuuugcuguguugcu

SEQ ID NO: 338216 - RNA, 64 nt, Human
gguaagauaaauaaauacauacacauauguuuuuuugguagauaagugcuaauuacauauaugu

SEQ ID NO: 338217 - RNA, 64 nt, Human
aaguagggcugccagaaaugucccacuagggaauuugguagagacgaagacaugcucaccggac

SEQ ID NO: 338218 - RNA, 64 nt, Human
ggagcaaacuguggacuugccuggcacuuaaaccuugguagaucuggguuuauaaucggccauu

SEQ ID NO: 338219 - RNA, 64 nt, Human
cccaagauguuggggggccccacggagaguugacuugguagaguuccuuucugggaagaaagua

SEQ ID NO: 338220 - RNA, 64 nt, Human
acggaugaugagugaucaguauggaccuuuuuccuugguagaacugaauuccuuccuccccugu

SEQ ID NO: 338221 - RNA, 64 nt, Human
aacuaaugacaaguauuuucuacuaaaccagaaauugguagaaggauuuaaauaaguaaaagcu

SEQ ID NO: 338222 - RNA, 64 nt, Human
gaaggacaaacauuucugagagugucagccauucuugguagacaccucuccacuccucauccca

SEQ ID NO: 338223 - RNA, 64 nt, Human
auuuuaugugaucuucaugcgucguaaucuacuuuugguagauaauuaagauuauuaaacccuc

SEQ ID NO: 338224 - RNA, 62 nt, Human; identical to SEQ ID NO: 278532

SEQ ID NO: 338225 - RNA, 62 nt, Human; identical to SEQ ID NO: 278533

SEQ ID NO: 338226 - RNA, 62 nt, Human; identical to SEQ ID NO: 278541

SEQ ID NO: 338227 - RNA, 62 nt, Human; identical to SEQ ID NO: 278542

SEQ ID NO: 338228 - RNA, 64 nt, Human
cguggccaggugcucacgccguaaugccaacacuuugguagaccgaagugggcagaucaccuga

SEQ ID NO: 338229 - RNA, 64 nt, Human
gccugguauugggcauggaaauuugaauugcugauugguagauggugugucuggacuuaacuca

SEQ ID NO: 338230 - RNA, 64 nt, Human
caaauucugcagucguacuauaauucaggccuguuugguagacaaaaucaaaaggcauuuaaca

SEQ ID NO: 338231 - RNA, 64 nt, Human; identical to SEQ ID NO: 338197

SEQ ID NO: 338232 - RNA, 64 nt, Human
agaugcuaugcuaagagaagugaauaaucuuucuuugguagaaaauaggcugagauauaaggug

SEQ ID NO: 338233 - RNA, 64 nt, Human
ggaacgggggacacgggcagcucaggucagccuguugguagaugcugggacagcauuagaagag

SEQ ID NO: 338234 - RNA, 64 nt, Human
auaacauugauauuuugauuuguaauauuucuaauugguagauuuaauugaaaaguaaaauuaa

SEQ ID NO: 338235 - RNA, 64 nt, Human
guggguauucuuaacugugacuauauuuugacaauugguagaaggugcacauuuuaagcaaaaa

SEQ ID NO: 338236 - RNA, 64 nt, Human
uaaguguuuuaaauaaaauguaaacaguuuuuauuugguagagaugacucauggaaaaauugug

SEQ ID NO: 338237 - RNA, 64 nt, Human
aggguuguaagaguuuuuguuuuuaaucacgcauuugguagagucuaaauggauaaaaugcaag

SEQ ID NO: 338238 - RNA, 64 nt, Human
cggugcucugcccccacgccccgaccaucuggucuugguagaugucccuagacgggcugagcca

SEQ ID NO: 338239 - RNA, 64 nt, Human
agaaauaauuuaaaaauaguguuuguucugaauguugguagacccuucauagcuuuguuacaau

SEQ ID NO: 338240 - RNA, 55 nt, Human
gacaggcugacaagguuugaagggcuugguagagaaugcuggagggaaggggcug

SEQ ID NO: 338241 - RNA, 64 nt, Human
ggaacaaacagcuguugagugagcugcuaugacuuugguagagaggugcaauauguuuuuugaa

SEQ ID NO: 338242 - RNA, 64 nt, Human
aaaccaaauguuaaacuauagccuuaagaaaugcuugguagaaguguccuaaugagacaaauuu

SEQ ID NO: 338243 - RNA, 62 nt, Human; identical to SEQ ID NO: 278544

SEQ ID NO: 338244 - RNA, 62 nt, Human; identical to SEQ ID NO: 278545

SEQ ID NO: 338245 - RNA, 62 nt, Human; identical to SEQ ID NO: 278546

SEQ ID NO: 338246 - RNA, 64 nt, Human
gaagacauuuauuuggacaguaauacuagcaaaguugguagauauuugauucuucauuuuuugu

SEQ ID NO: 338247 - RNA, 64 nt, Human
aauauggguaaaaguuuauucaagaaaagaguacuugguagaagauucuuuaacaaauugagga

SEQ ID NO: 338248 - RNA, 64 nt, Human
ggcuguagaaaggggagaaugucaaggaagacuuuugguagagaaggagcagaaagauguguuu

SEQ ID NO: 338249 - RNA, 64 nt, Human
guauuguuuaaaacggaucaaaaauguaagucuauugguagagauuaaguaaaguauuuauugc

SEQ ID NO: 338250 - RNA, 64 nt, Human
auguucuuuauugugugugaugguauugguuuguuugguagauaagugggaggaaaaguacugu

SEQ ID NO: 338251 - RNA, 64 nt, Human
gaccuuccggcccaagcguggcgcugcgggcacuuugguagacugugccaccacggcguguguu

SEQ ID NO: 338252 - RNA, 64 nt, Human
gcuuagcaugcaaguucccuccaucauugccaccuugguagagagggauggcuccccacccuca

SEQ ID NO: 338253 - RNA, 64 nt, Human
cuagcagaucuauguggugaaaaugcacaggagcuugguagacugcgggggaaagagagagcuc

SEQ ID NO: 338254 - RNA, 64 nt, Human
uagcaccaucgucacuauuaagcagacauuucaguugguagaauccauguagaagucauggacu

SEQ ID NO: 338255 - RNA, 64 nt, Human
uaaaaauaagaaauuaagacuuuaaauuaaacauuugguagagucaucauaaaacaccagacca

SEQ ID NO: 338256 - RNA, 64 nt, Human
guguccagguuucuccugagcucaucuacauagauugguagacccuuccuuuggauuaggaaag

SEQ ID NO: 338257 - RNA, 64 nt, Human
cuguaacaaucacugguccuccugcagaugacccuugguagagucuuuauuugcauagccucaa

SEQ ID NO: 338258 - RNA, 64 nt, Human
gacaaauuuauagcaaggcacugaauuuuaucuuuugguagaaauguguuuauuuaacacacac

SEQ ID NO: 338259 - RNA, 60 nt, Human
ccaauaaagcagaaacaugacugaauugaauugguagaugaaaaaaaccugguucaaguu

SEQ ID NO: 338260 - RNA, 64 nt, Human
accaggcuucauucacccaguggaccugaacuguuugguagagccacccggcccuuccuuccuc

SEQ ID NO: 338261 - RNA, 62 nt, Human; identical to SEQ ID NO: 278547

SEQ ID NO: 338262 - RNA, 62 nt, Human; identical to SEQ ID NO: 278548

SEQ ID NO: 338263 - RNA, 62 nt, Human; identical to SEQ ID NO: 278590

SEQ ID NO: 338264 - RNA, 64 nt, Human
auucugugauggcaaaugaaaaaaauguuaacauuugguagacaugugcuuugacauagcguga

SEQ ID NO: 338265 - RNA, 64 nt, Human
gccugcuuuuauaugcauuuuuguagggaucagcuugguagacaguauuagcggagaaacaccu

SEQ ID NO: 338266 - RNA, 64 nt, Human
auucucuauaggacucuuuaauuuuuuuuuuuuuuugguagagauggggucuugcuguguugcc

SEQ ID NO: 338267 - RNA, 64 nt, Human
ugcccaccaccaugcccggcuaauuuuuguauuuuugguagagacagaguuucaccagguuggu

SEQ ID NO: 338268 - RNA, 64 nt, Human
gaaacacaugauggaauuauaauucagaaucaucuugguagauaggggcacugugcuuaaacaa

SEQ ID NO: 338269 - RNA, 64 nt, Human
gccauccaaauaagaaaccuaaaauaauugguucuugguagagauucauuauuuuuccacuuug

SEQ ID NO: 338270 - RNA, 64 nt, Human
cugggaaugugacuugagcccagagugaacacucuugguagaagcccuucuaccuuccugcaac

SEQ ID NO: 338271 - RNA, 64 nt, Human
guuaauugcagaaauaaaucuuuuuuuuuuuuuuuugguagaaaacaaagaggcauacucugau

SEQ ID NO: 338272 - RNA, 64 nt, Human
ccccugggcuaccauugucccuuuccucacccaguugguagaggagucaggaggugggaggccg

SEQ ID NO: 338273 - RNA, 64 nt, Human
uuauuuacuuacagccuuauguuuuuguauuuucuugguagacuagguaauuuuuuuuuaaagg

SEQ ID NO: 338274 - RNA, 64 nt, Human
aaccauauuuauaugauuccuaacauaauaucauuugguagaaagaaaaccaacuguggucauc

SEQ ID NO: 338275 - RNA, 64 nt, Human
agauucucaaugauacugaaagcuuugcaccucuuugguagaaaccaggucuauuuagaaaaug

SEQ ID NO: 338276 - RNA, 64 nt, Human
auguauaugcuuaaaaacaguuuuaggaaaauauuugguagacaaagaguuucaacuuuaaaug

SEQ ID NO: 338277 - RNA, 64 nt, Human
gagugauuugcaccuugcaaaaaugguccuggaguugguagauugcuguugaucuuuuaucaau

SEQ ID NO: 338278 - RNA, 64 nt, Human
uuuaugaugcagcagauguugacuaaaggcuugguugguagauauucaggaaauguucacugaa

SEQ ID NO: 338279 - RNA, 62 nt, Human; identical to SEQ ID NO: 278518

SEQ ID NO: 338280 - RNA, 62 nt, Human; identical to SEQ ID NO: 278519

SEQ ID NO: 338281 - RNA, 62 nt, Human; identical to SEQ ID NO: 278550

SEQ ID NO: 338282 - RNA, 64 nt, Human
ccuuaacuacccuaacuugacaaaacagaauucuuugguagacgcggugggggcgggguggggg

SEQ ID NO: 338283 - RNA, 64 nt, Human
uugccucuuuagauuacauagaagcauuguagucuugguagaaccaguauuuuuguuguuuauu

SEQ ID NO: 338284 - RNA, 64 nt, Human
aguuaaaaggggccaaguaaauguugcuuguuauuugguagagauuaggcucacaaaauauuuc

SEQ ID NO: 338285 - RNA, 64 nt, Human
uuuccuaucaguugacauuuguuuuuaguuuuuguugguagaaacaguacacucaaaacauccu

SEQ ID NO: 338286 - RNA, 64 nt, Human
caggugacaaaaaauacccagguaaacacuggcuuugguagaauugugcagucauuaaaaguca

SEQ ID NO: 338287 - RNA, 64 nt, Human
uagugguccuugaaaaacugugaauguuugggaauugguagaaaggcaaaaaguaggauauuuu

SEQ ID NO: 338288 - RNA, 64 nt, Human
cagcaacuagaaagucuaugcacauccucagauauugguagaguauucagugcuuccaaagugg

SEQ ID NO: 338289 - RNA, 64 nt, Human
cggcaacuagaaagucuaugcacauccucagguauugguagaguauucagugcuuucuaaguag

SEQ ID NO: 338290 - RNA, 64 nt, Human
ggaauuauauaccacgaaaagaaaaaaaggucauuugguagaaacuagggaaaucugaauacag

SEQ ID NO: 338291 - RNA, 64 nt, Human
augugcuucugcuacugguccuugggcugggugguugguagaggagauguugacacuaugagcu

SEQ ID NO: 338292 - RNA, 64 nt, Human
cacaugccacugcaccuggcuaauuuuuauauuuuugguagagacaggguuucaccauguuggc

SEQ ID NO: 338293 - RNA, 64 nt, Human
acugcucucuauguuuuaagcaaagagcauggaauugguagaagucuugggaucuugccauggg

SEQ ID NO: 338294 - RNA, 64 nt, Human
uggaaagucauuauaauaguuuugguucuuugaauugguagacaauuaguagaguauaauuggu

SEQ ID NO: 338295 - RNA, 64 nt, Human
augguaccugcugccacucaucacagagcccuucuugguagaaaugaugucagcauucuuauuu

SEQ ID NO: 338296 - RNA, 64 nt, Human
ucugucuccaucgucucauccuccuuucaguucguugguagagcccucagaaccauuuaagaga

SEQ ID NO: 338297 - RNA, 62 nt, Human; identical to SEQ ID NO: 278556

SEQ ID NO: 338298 - RNA, 62 nt, Human; identical to SEQ ID NO: 278557

SEQ ID NO: 338299 - RNA, 62 nt, Human; identical to SEQ ID NO: 278558

SEQ ID NO: 338300 - RNA, 64 nt, Human
gcccuuagccuugcuguagagacuuccgucacccuugguagaguuuauuuuuuugauggcuaag

SEQ ID NO: 338301 - RNA, 64 nt, Human
augucuuuaauaugaaaugcuacauuauuuauaauugguagaguuauuguaucuuuuuauaguu

SEQ ID NO: 338302 - RNA, 64 nt, Human
aauaaaaauacuuguauuuugugguggcaaauguuugguagaacuguaauuagaaaaauacaag

SEQ ID NO: 338303 - RNA, 64 nt, Human
cucuacuuucaccuuuuuuuuucuuuuaauccuuuugguagaaaucagguuacaaagcaaaacc

SEQ ID NO: 338304 - RNA, 64 nt, Human
acccaccaccaugcccagcugcuuuuuuguauuuuugguagagaugggguuucaccauguuggc

SEQ ID NO: 338305 - RNA, 64 nt, Human
ugcacgccaccacgcccggcuaauuuuuauauuuuugguagagaugggguuucaccaugcuggc

SEQ ID NO: 338306 - RNA, 64 nt, Human
ggccagaguuuauccuagauuauuuuauuuuaaauugguagaauucuuugcgaacugucacaga

SEQ ID NO: 338307 - RNA, 64 nt, Human
uuuuuuguuguuguguuuuuuuguuuuuuuuuuuuugguagaugcaugacuugugugugaugag

SEQ ID NO: 338308 - RNA, 64 nt, Human
gagggacagcugagcccccugccuuggcuccagguugguagaagcagccgaagggcuccugaca

SEQ ID NO: 338309 - RNA, 64 nt, Human
uuccuucaggaugaucuagagcagcauggagcuguugguagaauauuaguuuuuaaccauacau

SEQ ID NO: 338310 - RNA, 64 nt, Human
gagcgggcccuguacccaccugcugaccugcuguuugguagagaaauaaagguugugugacugg

SEQ ID NO: 338311 - RNA, 64 nt, Human
cuugcgccaccacaccuggcuaauuuuuguauuuuugguagagacgggauucuaccauguugcc

SEQ ID NO: 338312 - RNA, 64 nt, Human
cucugacaauuuuuuuuuuaaugugccuuuuggguugguagaaacggaaguagaaguaggcugg

SEQ ID NO: 338313 - RNA, 64 nt, Human
guuaucuuuuaaaauucacacagaaaaauuccguuugguagacuccuuccaaugaaaucucagg

SEQ ID NO: 338314 - RNA, 64 nt, Human
guagaaacaaaggguuuucuuuuuuaaauguuucuugguagauuauucauaaugugagaugguu

SEQ ID NO: 338315 - RNA, 62 nt, Human; identical to SEQ ID NO: 278562

SEQ ID NO: 338316 - RNA, 62 nt, Human; identical to SEQ ID NO: 278563

SEQ ID NO: 338317 - RNA, 62 nt, Human; identical to SEQ ID NO: 278564

SEQ ID NO: 338318 - RNA, 64 nt, Human
gcugauuuucaugccacguuucauagccccacuuuugguagacuaccaccacgcuucuucgcgu

SEQ ID NO: 338319 - RNA, 64 nt, Human
uucauucucccuuuauugauucaucgaggagaacuugguagauggggagaaaacacaguugguu

SEQ ID NO: 338320 - RNA, 64 nt, Human
ccccaacuaaacugggaguaagacuuagucaguguugguagacaaagucauaccacccagggca

SEQ ID NO: 338321 - RNA, 64 nt, Human
cagagugcuaaguauagaaaaucugaaacuaaaguugguagaaaaguuauuuguauagaacuuu

SEQ ID NO: 338322 - RNA, 64 nt, Human
augagaguucugaguauagaaaauaaaacuaaaguugguagaaaaauuauuuguauauaauguu

SEQ ID NO: 338323 - RNA, 64 nt, Human
uguguuggaaaauucaaaauccauuugagaggaguugguagacagcaagggaagggucccugga

SEQ ID NO: 338324 - RNA, 64 nt, Human
gagguucuguguuuugaagggaagaauaucagaauugguagacauuucaaacugucacauuagg

SEQ ID NO: 338325 - RNA, 64 nt, Human
cgugcaccacugcgcccagcuaauucuuguauuuuugguagagacgggguuucaacauguugac

SEQ ID NO: 338326 - RNA, 64 nt, Human
gcaugcgccaccacacccagcuaauuuuuuguauuugguagagauggaguuucaccaugguggu

SEQ ID NO: 338327 - RNA, 64 nt, Human
ucuucaccucuucugugaugacuugguauguuguuugguagagagaucuugauuuucggaggau

SEQ ID NO: 338328 - RNA, 64 nt, Human
cuggaugguggcucaucccugcaaucacaacacuuugguagacugaugugaguggaucaccuaa

SEQ ID NO: 338329 - RNA, 64 nt, Human
uacacauuucaguaacucauagcugcugugcaaauugguagaccuuauaagaaggcacuuguuu

SEQ ID NO: 338330 - RNA, 64 nt, Human
aucucuucugaucucuugccccaguggggccugguugguagaauguuggcauucgguugauauc

SEQ ID NO: 338331 - RNA, 64 nt, Human
guucuccagguucaccauuuggguuguuuauauguugguagaaauucucccuguaugccuagaa

SEQ ID NO: 338332 - RNA, 64 nt, Human
aaacugaggaauuuucuuuguguagcuuugcucuuugguagaaaaggcuagguacacagcucua

SEQ ID NO: 338333 - RNA, 62 nt, Human; identical to SEQ ID NO: 278551

SEQ ID NO: 338334 - RNA, 62 nt, Human; identical to SEQ ID NO: 278552

SEQ ID NO: 338335 - RNA, 62 nt, Human; identical to SEQ ID NO: 278568

SEQ ID NO: 338336 - RNA, 64 nt, Human
uuuggacagagggaggagagaguuagaaaaauuuuugguagagagaaucaggugaaagagaugc

SEQ ID NO: 338337 - RNA, 64 nt, Human
agccugggugcaguuauaagccccuuuggcuuacuugguagaagauggcuacuuggauguaccu

SEQ ID NO: 338338 - RNA, 64 nt, Human
caaaaguccuaaauaccuucucuagguaagacacuugguagaugagagacggaaggcauuguca

SEQ ID NO: 338339 - RNA, 64 nt, Human
gcacccccaccucagaguguaaucgcauuucugcuugguagaggccgagcccagcaaagguggc

SEQ ID NO: 338340 - RNA, 64 nt, Human
gaaagagcaaugacuagauugcuuugugaagcucuugguagagacacgcuccagaagggauaac

SEQ ID NO: 338341 - RNA, 64 nt, Human
cugccucccaccagacuuccuccuggaaaacgcuuugguagauuuggccaggagcuuucuuuua

SEQ ID NO: 338342 - RNA, 64 nt, Human
cacaccacuacucacccucucugcugcuggcauguugguagagucaucccuguaaucaagaaau

SEQ ID NO: 338343 - RNA, 64 nt, Human
uauuucucugugggcuuuuguuuuuguuuuuguuuugguagaucuucaauuuggauauuuggag

SEQ ID NO: 338344 - RNA, 64 nt, Human
gagcuagaaaaaaaaaccucaaaaaaguuaaucauugguagaugccccacaauuaacguguugc

SEQ ID NO: 338345 - RNA, 64 nt, Human
guaacaacccaaaaauaaaugucauagucaagauuugguagauaaauuuaaaauuaaaauauuc

SEQ ID NO: 338346 - RNA, 64 nt, Human
cacaaagggguccaacagcucuuugaguaggcauuugguagagcuugggggugugugugugggg

SEQ ID NO: 338347 - RNA, 64 nt, Human
aaucccuucuguuuacccaugugcuacuaaugucuugguagaauauucuugccaaaaaaauacc

SEQ ID NO: 338348 - RNA, 64 nt, Human
gccuuucucaguguguuucuaaauggccuuacacuugguagaagaaauugaaggguuacucaaa

SEQ ID NO: 338349 - RNA, 64 nt, Human
acacauauuacacacaugugcgcauuacacacacacaauacacauacaugcauauagacgcauc

SEQ ID NO: 338350 - RNA, 64 nt, Human
gggaagggguucccucccuccugaagaugaacacacaauacacggaagagcgccagccucugcu

SEQ ID NO: 338351 - RNA, 62 nt, Human; identical to SEQ ID NO: 278645

SEQ ID NO: 338352 - RNA, 62 nt, Human; identical to SEQ ID NO: 278646

SEQ ID NO: 338353 - RNA, 62 nt, Human; identical to SEQ ID NO: 278648

SEQ ID NO: 338354 - RNA, 64 nt, Human
acuuaaaggaaugguuuuuauguuaggagaaaauacaauacaccacuuuuuucucacaaaaauu

SEQ ID NO: 338355 - RNA, 64 nt, Human
aucaaaacuguauuaaaaugcauugaguuuuuguacaauacagauaagauuuuuacaugguaga

SEQ ID NO: 338356 - RNA, 64 nt, Human
uagcuuuuaauugugguauauauaaucuucaguaacaauacauacugaauacgcugugguucau

SEQ ID NO: 338357 - RNA, 64 nt, Human
gaaaaugaucugauuuucccuuauacuucauuuuacaauacauauucccuuuuaacuuaaaaaa

SEQ ID NO: 338358 - RNA, 64 nt, Human
auaaacuguguuuuguagaagaaaaagaaucauaacaauacaaacacacauucauucucucuuu

SEQ ID NO: 338359 - RNA, 64 nt, Human
ccuccuucuucauccauaaguggacugugccaguacaauacaugccucagcccccaagccuaga

SEQ ID NO: 338360 - RNA, 64 nt, Human
auaauauugcaagcuuaaguuugcaauuucccaaacaauacaaaaagcaaauuacacacccuca

SEQ ID NO: 338361 - RNA, 64 nt, Human
ggagccagcuagaaagaagcuuuugauuagauguacaauacauugggggcagaagaucugggau

SEQ ID NO: 338362 - RNA, 64 nt, Human
caguacucaguaaggcagugcaguacucaguaacacaauacaguacucaggcagugcaguacuc

SEQ ID NO: 338363 - RNA, 64 nt, Human
caguauucaguaaggcagugaaguacucaguaauacaauacaguacucaguuaggcagugcagu

SEQ ID NO: 338364 - RNA, 64 nt, Human
ucuaaugacuugauuuucuauuuucucccuacccacaauacaguuaucuuuuuuauuguguugu

SEQ ID NO: 338365 - RNA, 64 nt, Human
uaguagaggugcaugccuuucauugcuuuucaaaacaauacagcuguguuuauuugugaaguua

SEQ ID NO: 338366 - RNA, 60 nt, Human
cuucugcacagggccaauaauaagaaguggacaauacaguauuugcuucauugugugggg

SEQ ID NO: 338367 - RNA, 64 nt, Human
uuuucugucccaaccguucccucacagcaaagcaacaauacaggcuagggaugguaauccuuua

SEQ ID NO: 338368 - RNA, 64 nt, Human
aagcuaaauagagaacaauuuagaaaguuaacuaacaauacagugcauucuacccguagggcca

SEQ ID NO: 338369 - RNA, 62 nt, Human; identical to SEQ ID NO: 278514

SEQ ID NO: 338370 - RNA, 62 nt, Human; identical to SEQ ID NO: 278515

SEQ ID NO: 338371 - RNA, 62 nt, Human; identical to SEQ ID NO: 278575

SEQ ID NO: 338372 - RNA, 62 nt, Human; identical to SEQ ID NO: 278576

SEQ ID NO: 338373 - RNA, 64 nt, Human
cuuuuguacuuuacuauuuauuucagaaauguugacaauacaacauagcauaugucuucaucuc

SEQ ID NO: 338374 - RNA, 64 nt, Human
aaauuuuucucaguuccagugauagaaaacccacacaauacauccucugccagucuuaauagaa

SEQ ID NO: 338375 - RNA, 64 nt, Human
ucucucccuucuccaguucugggaauuuacaggcacaauacacuuccuuuuccuggagaggucg

SEQ ID NO: 338376 - RNA, 64 nt, Human
aacuuuuugacaaggcugaagguucuauuuauuuacaauacauaggguuacucaccaaacuuuu

SEQ ID NO: 338377 - RNA, 64 nt, Human
uauuuucauaucaagauaaagucgcacauuuuccacaauacauugcuaaaauaaagaggagaaa

SEQ ID NO: 338378 - RNA, 64 nt, Human
uguggcaaauggaggcuuuucacugccuguagagacaauacaguaagcauaguuaagggguggg

SEQ ID NO: 338379 - RNA, 64 nt, Human
aacagaugcaaaaugcaaaauaaaauauuggcaaacaauacagcaacaaauaauuuacuaucac

SEQ ID NO: 338380 - RNA, 64 nt, Human
acuaacaaugacaaaggccuuaugaacuguacagacaauacagaagauuauucuuauccucauu

SEQ ID NO: 338381 - RNA, 64 nt, Human
agcacucagucuagugaagauguugucauuauguacaauacauaacuaguuuaauuaacuaugu

SEQ ID NO: 338382 - RNA, 64 nt, Human
acucugaacauacuaccuucacacucgguaaucaacaauacagugugguucaaauaagaauaaa

SEQ ID NO: 338383 - RNA, 64 nt, Human
gaaaaagcugaguagaacaaaggcaguggagcauacaauacaauucuauuuauuugagguuaau

SEQ ID NO: 338384 - RNA, 64 nt, Human
auacauagagauacgcaacuuuguuuuugcagcuacaauacacuuucucaaucucauauguuuu

SEQ ID NO: 338385 - RNA, 64 nt, Human
uacuuuacacauacguguauguacacacacacacacaauacaagacauuuuuccuguuuuagaa

SEQ ID NO: 338386 - RNA, 64 nt, Human
aaucaccaaggagacuuugcauuaaguucagaguacaauacaaacugggccuagcucuguauuu

SEQ ID NO: 338387 - RNA, 64 nt, Human
uggcuauauuacaaaaugggaugcuggcaaugaaacaauacauuuaacacuauuguauuuuuau

SEQ ID NO: 338388 - RNA, 62 nt, Human; identical to SEQ ID NO: 278572

SEQ ID NO: 338389 - RNA, 62 nt, Human; identical to SEQ ID NO: 278573

SEQ ID NO: 338390 - RNA, 62 nt, Human; identical to SEQ ID NO: 278580

SEQ ID NO: 338391 - RNA, 64 nt, Human
ccugccccacccuaacugaucaauugaccuugugacaauacaccuuccccacccuugagaaggu

SEQ ID NO: 338392 - RNA, 64 nt, Human
ccggggcauccuggauuuagaacauggacuacacacaauacagugguauaaacuuuuuauucuc

SEQ ID NO: 338393 - RNA, 64 nt, Human
guuagcuguauuguuaguuuuaaauuauuuucagacaauacacuauugcccacacaugggaugg

SEQ ID NO: 338394 - RNA, 64 nt, Human
uuggcuaccugaaaaaucuuaggaggaauagcucacaauacaauaaaucuguagauucugcuua

SEQ ID NO: 338395 - RNA, 64 nt, Human
ucacaguggcuggacuaccgagagcuuggacuacacaauacaguauuauagacaaaagaauaag

SEQ ID NO: 338396 - RNA, 64 nt, Human
auuuaggaugugcugacagauaagcucuuugccuacaauacauggauaauuagugcuauaauuc

SEQ ID NO: 338397 - RNA, 64 nt, Human
aaacuuuuaaacuacagguaguuaagggccaccuacaauacaucugagguccugugaucuuauu

SEQ ID NO: 338398 - RNA, 64 nt, Human
auuuauugaaugccuauucuauuuucugcaguuuacaauacaauaacucuuugaguaaguugaa

SEQ ID NO: 338399 - RNA, 64 nt, Human
ucaugccuaugccuacauaagaauggcugagcuaacaauacacauucuggaaacauaacacucu

SEQ ID NO: 338400 - RNA, 64 nt, Human
uuuuauaaaacugugcaauacgaauuaugcaaucacaauacauuuguagcucccgaguguccua

SEQ ID NO: 338401 - RNA, 64 nt, Human
ggguagagaugauguaaaagcagccaaucuggaaacaauacauuguaaauaguuuuucauugua

SEQ ID NO: 338402 - RNA, 64 nt, Human
cuuugccucuaauucaguauuccauuuaauaaaaacaauacaguggcuggaaaggagcaucaga

SEQ ID NO: 338403 - RNA, 64 nt, Human
acuuuuuguucugguccuuuuuggucgaggaguaacaauacaaauggauuuugggagugacuca

SEQ ID NO: 338404 - RNA, 64 nt, Human
cagccagcuauugauauaaauaaaacauuuucacacaauacaauaaguuaacuauuuuauuuuc

SEQ ID NO: 338405 - RNA, 64 nt, Human
guuguuuuuaaacaauaaagcaauaagaacaaauacaauacauaggaaguuaaaagcacaaagg

SEQ ID NO: 338406 - RNA, 62 nt, Human; identical to SEQ ID NO: 278584

SEQ ID NO: 338407 - RNA, 62 nt, Human; identical to SEQ ID NO: 278588

SEQ ID NO: 338408 - RNA, 62 nt, Human; identical to SEQ ID NO: 278589

SEQ ID NO: 338409 - RNA, 64 nt, Human
acgaacagguaguuugguggagcugagcuaguguacaauacacuaguuguaaaaaaaaaaaaaa

SEQ ID NO: 338410 - RNA, 64 nt, Human
ugacuugagggugauuaacagagagggcaccaucacaauacagauaacauuagguuguccuaga

SEQ ID NO: 338411 - RNA, 64 nt, Human
guuguuguuacuguuuuuguuuuuuuuaauguagacaauacagcuuuggaaggggaagucucau

SEQ ID NO: 338412 - RNA, 64 nt, Human
auuuauauaaaaucugauaccuugauguaauuucacaauacaguuccaauuuuuauggcuuuua

SEQ ID NO: 338413 - RNA, 64 nt, Human
acuauaagaaagcugauuauuuaaaucacuauauacaauacacccuuaauuuguucauuccaga

SEQ ID NO: 338414 - RNA, 64 nt, Human
gucacugcauugcuuucaccauugcucuuaggguacaauacaaauuuaucuucaucuuuaaggu

SEQ ID NO: 338415 - RNA, 64 nt, Human
cugacaacuugauaaaaagaaaagcuacacccaaacaauacaacaccaaaaugaauuuuggcac

SEQ ID NO: 338416 - RNA, 64 nt, Human
acaugcacauaucuuugucaaggcaccagugggaacaauacacugcauuacuguucuauacaua

SEQ ID NO: 338417 - RNA, 64 nt, Human
gcuauugguaaagagaauaaauacacuuaauuucacaauacauuguuauauguaccccaguugu

SEQ ID NO: 338418 - RNA, 64 nt, Human
uauuuaauuuguuuugaauguuuuggauugcuacacaauacaauauucuaaauuuaggcaugag

SEQ ID NO: 338419 - RNA, 64 nt, Human
ggauaaugguauuucaacuaguuaucagcaagugacaauacauuccaccacaaauacacucuug

SEQ ID NO: 338420 - RNA, 64 nt, Human
gggaagagaucaaaauggagucuccuuaccauggacaauacaugcaaagcaauaucuuguucag

SEQ ID NO: 338421 - RNA, 64 nt, Human
uguauuaguuaauggaaaaaaaaauacaacacuaacaauacauagcugcaauguguacaauggc

SEQ ID NO: 338422 - RNA, 64 nt, Human
uguagguacauguuaugaaauaaacacauuucuaacaauacaagggaguaggggcagaccugug

SEQ ID NO: 338423 - RNA, 64 nt, Human
uacacucucuguacaaaaacaaaacaaaacaacaacaauacaacaagaacaacaacaacaauaa

SEQ ID NO: 338424 - RNA, 62 nt, Human; identical to SEQ ID NO: 278559

SEQ ID NO: 338425 - RNA, 62 nt, Human; identical to SEQ ID NO: 278560

SEQ ID NO: 338426 - RNA, 62 nt, Human; identical to SEQ ID NO: 278655

SEQ ID NO: 338427 - RNA, 64 nt, Human
guuucccaacaauggaccuuggcacacuggaguaacaauacauaacagaguugccaagauauuu

SEQ ID NO: 338428 - RNA, 64 nt, Human
ugucucugaugcaaaaagguagaguaacacaauuacaauacaugauuaaaugcaauaguccagg

SEQ ID NO: 338429 - RNA, 51 nt, Human
guaccauucugauguuuugagacaauacagauguuuucccuuguggcaguc

SEQ ID NO: 338430 - RNA, 51 nt, Human
guaccguccugacguuuugaaacaauacagaugccuucccuuguagcaguu

SEQ ID NO: 338431 - RNA, 64 nt, Human
auguaucuuuuccacuuauuauaguuauauuccuacaauacaauuuuaaaauugucuuuuuaua

SEQ ID NO: 338432 - RNA, 64 nt, Human
auaguaguacauuaugaaucacauauaaaaucuuacaauacagaacaacuguuaagauggaaaa

SEQ ID NO: 338433 - RNA, 64 nt, Human
guacugauagggguucaugcuuaauaaacaugucacaauacaguaaguaaagugguuuuguuug

SEQ ID NO: 338434 - RNA, 64 nt, Human
aacccuacgauacaauuauugaaugaagcguuuuacaauacauugcacuuaauccauuguuuaa

SEQ ID NO: 338435 - RNA, 64 nt, Human
uauauugcaggauauggagauuucaucacguacuacaauacaguguauuuuguuauauuugacg

SEQ ID NO: 338436 - RNA, 64 nt, Human
aauguagauuuugauguauuaggucacccugaaaacaauacaagaaaagggauccccagguaau

SEQ ID NO: 338437 - RNA, 64 nt, Human
gcuuucaaggguaaccagauuuaagaaucuucaaacaauacacuguuaccuuuugacuguaccu

SEQ ID NO: 338438 - RNA, 64 nt, Human
cucuugagauugcuuuaaauuuuguauugaaacaacaauacauuuugcacuguaguaaugggag

SEQ ID NO: 338439 - RNA, 64 nt, Human
aaaaauugagacccagacacuggucaacaggaaaacaauacagacucccagaauuagaaagugu

SEQ ID NO: 338440 - RNA, 64 nt, Human
aauucuucggagcuugucuuauuugcuauagaaaacaauacagagcuuuugggaauggacucac

SEQ ID NO: 338441 - RNA, 64 nt, Human
gguucauucuuuucaaaucuauuuuuguuuaaaaacaauacaaguuuuagaaaacaaagcauua

SEQ ID NO: 338442 - RNA, 62 nt, Human; identical to SEQ ID NO: 278592

SEQ ID NO: 338443 - RNA, 62 nt, Human; identical to SEQ ID NO: 278593

SEQ ID NO: 338444 - RNA, 62 nt, Human; identical to SEQ ID NO: 278594

SEQ ID NO: 338445 - RNA, 62 nt, Human; identical to SEQ ID NO: 278595

SEQ ID NO: 338446 - RNA, 64 nt, Human
gcacauaggacagacugaaagacuguaauuuuacacaauacacauggcuuaauuauuuuauugg

SEQ ID NO: 338447 - RNA, 64 nt, Human
aaaacgagcaugaaaauucgguuugagccggcugacaauacaaugaaaaggcuuaaaaagcaga

SEQ ID NO: 338448 - RNA, 64 nt, Human
caccuuugggcuuuguuuugguguuucuacagggacaauacagacccuggagugugugugugug

SEQ ID NO: 338449 - RNA, 64 nt, Human
acuaacaaugacaaaggccuuaugaacuguacggacaauacagaagacuauucuuauccucauu

SEQ ID NO: 338450 - RNA, 64 nt, Human
ugucuaguuuaagaaagugguuuucaguauugugacaauacaacguuuuuacaagguuguuuuc

SEQ ID NO: 338451 - RNA, 64 nt, Human
aggaugggguuuuggauuuuguauaauaauaaaaacaauacagcauauggcuagggaaggacau

SEQ ID NO: 338452 - RNA, 64 nt, Human
gauucaauuagucuucaaaccuaagagcauuuacacaauacacaagguguaaaaaugauaaaau

SEQ ID NO: 338453 - RNA, 64 nt, Human
ucuugguuucuugauucauuuauuugagaaaaaaacaauacaaagaaaugcauucauaucaaaa

SEQ ID NO: 338454 - RNA, 64 nt, Human
aguucuauaugaaguauuugauguuuuguuugaaacaauacagcauuaaagaaccaauguuauu

SEQ ID NO: 338455 - RNA, 64 nt, Human
uuaugcaaagacuggcucuagguauuugaggagcacaauacagagauuuuaaaaagugauuuug

SEQ ID NO: 338456 - RNA, 64 nt, Human
augggaaauuucacacagcauuuugaaacuggcuacaauacauagaaguagugaggaaagugug

SEQ ID NO: 338457 - RNA, 64 nt, Human
cuuuguuuguuugcucuuuuuguuuuuuaccuaaacaauacauuuugauucucuuguggguuga

SEQ ID NO: 338458 - RNA, 64 nt, Human
uuaacauguaaauguacauaauaaaauuccaggcacaauacauaugaacgcuuuuagagaacuu

SEQ ID NO: 338459 - RNA, 64 nt, Human
ggaaguuaaaguccauauaaugacugauaagaguacaauacaggugccaugggaacacgugaca

SEQ ID NO: 338460 - RNA, 64 nt, Human
auaaauacaauaugcuacucccuguugugauugaacaauacaaauaacaaacaagaaagacaau

SEQ ID NO: 338461 - RNA, 62 nt, Human; identical to SEQ ID NO: 278472

SEQ ID NO: 338462 - RNA, 62 nt, Human; identical to SEQ ID NO: 278473

SEQ ID NO: 338463 - RNA, 62 nt, Human; identical to SEQ ID NO: 278477

SEQ ID NO: 338464 - RNA, 64 nt, Human
aauaugaugcaaacugugcuucucuaugauaauuacaauacaaagguuccauucagugcagcau

SEQ ID NO: 338465 - RNA, 64 nt, Human
ggucacaaggccugggguuguucacaccacaggcacaauacagagcuguccacucuugaacugg

SEQ ID NO: 338466 - RNA, 64 nt, Human
caaaacaaaaaaagaguauucauugugaggacaaacaauacaaauacgaagaggguuguaguac

SEQ ID NO: 338467 - RNA, 64 nt, Human
ccaaaguuagguuuauauaaauaucagagaauucacaauacagauaucuaagauacugacacuu

SEQ ID NO: 338468 - RNA, 64 nt, Human
aggucuaccaaaaaucucaauauuucagauaaucacaauacaucccuuaccugggaaagggcug

SEQ ID NO: 338469 - RNA, 64 nt, Human
ccuacccaguuuagcaaaacaccuguuuuaugcaacaauacaucacaacaggccacccccaaga

SEQ ID NO: 338470 - RNA, 64 nt, Human
aacaguuccaagccagauagucucgugaacagugacaauacagaaauaagguguuauuucuguu

SEQ ID NO: 338471 - RNA, 64 nt, Human
uuauuguucguguaaaugacacccuuggaucugaacaauacacaccaggacaauugugugcaac

SEQ ID NO: 338472 - RNA, 51 nt, Human
augauauagaaguaauuuaagacaauacaucaccuguaguucaaauacguu

SEQ ID NO: 338473 - RNA, 64 nt, Human
auuaucauuguuuguccuuuauguauucucuucuacaauacaacacauugaaacuguauuuacu

SEQ ID NO: 338474 - RNA, 64 nt, Human
uuuaguuagcacuuuguaucguuauauacaguuuacaauacauguauaacuuguagcuauaaac

SEQ ID NO: 338475 - RNA, 64 nt, Human
guggucacugcaugucaggauugcacaguauguuacaauacaauuucaaagagaacccacauuu

SEQ ID NO: 338476 - RNA, 64 nt, Human
auuacuugguuuugauuaccagugaaaagaaaacacaauacaaucaggaguuuucaaauuuuug

SEQ ID NO: 338477 - RNA, 64 nt, Human
aaacuguuuugugcuuuuauggaugucauacuugacaauacauguguaaguuacuaauauauga

SEQ ID NO: 338478 - RNA, 64 nt, Human
gaauucccuuuaaaaaugauauuucaaagguaaaacaauacaauauaaagaaaaaaauaaauau

SEQ ID NO: 338479 - RNA, 62 nt, Human; identical to SEQ ID NO: 278478

SEQ ID NO: 338480 - RNA, 62 nt, Human; identical to SEQ ID NO: 278479

SEQ ID NO: 338481 - RNA, 62 nt, Human; identical to SEQ ID NO: 278481

SEQ ID NO: 338482 - RNA, 62 nt, Human; identical to SEQ ID NO: 278482

SEQ ID NO: 338483 - RNA, 64 nt, Human
aucuguucugguuauaaaccuugcuaaugaaaauacaauacauauaaaaauguauagccauguu

SEQ ID NO: 338484 - RNA, 64 nt, Human
uugcacuguauaguagcuuuuaaagaaaauagucacaauacagaaaagcauuuuagaaauagcu

SEQ ID NO: 338485 - RNA, 64 nt, Human
caguucugcuaguauagcgugaaagcagcuauacacaauacagaaaugaaugagugugguuaug

SEQ ID NO: 338486 - RNA, 64 nt, Human
aguaaauaacuggaaaacagaacacuuauguuauacaauacagaucaucuuggaacugcauucu

SEQ ID NO: 338487 - RNA, 64 nt, Human
auacaugguuuuuaacaaaacagaacaaaacaaaacaauacagaaucucucccugaguuuuccu

SEQ ID NO: 338488 - RNA, 64 nt, Human
uuuucuccccacgaugauaucuauauauguaucuacaauacauauaucuacacauacagaaaga

SEQ ID NO: 338489 - RNA, 64 nt, Human
cuguguguuuggcuucuaaagacaagaaugacuuacaauacagccuaauuauguaauuaacauc

SEQ ID NO: 338490 - RNA, 64 nt, Human
uuauauggguuuauuuucauucugccaaaguaaaacaauacaucaacaagaagaaacucagauu

SEQ ID NO: 338491 - RNA, 64 nt, Human
ugcccauucucucuuucuggaguuuuuccagcauacaauacaugcacgugcacacacauacaca

SEQ ID NO: 338492 - RNA, 64 nt, Human
caaaccauaaaacccuauacaaguuguucuaguaacaauacaugagaaagaugucuauguagcu

SEQ ID NO: 338493 - RNA, 64 nt, Human
agaguaauauugccguucugcugauuuuaaauauacaauacaucauacauacuuuacaagcaag

SEQ ID NO: 338494 - RNA, 64 nt, Human
ggccaacauuaacaagcccucuaacaaaaacuuuacaauacauuuauguugaauggaacuccaa

SEQ ID NO: 338495 - RNA, 64 nt, Human
aagcgaagcagacaaaaagaaccuuaccucccccacaauacaacauugggcugcugaacccaca

SEQ ID NO: 338496 - RNA, 64 nt, Human
uuuauguuagcuaccaggugccaagugugcagacacaauacagagccuucaggcucucgacagg

SEQ ID NO: 338497 - RNA, 64 nt, Human
cccauccccagacccaccagacaccacacagcagacaauacacacccacucgcacaagcuucca

SEQ ID NO: 338498 - RNA, 62 nt, Human; identical to SEQ ID NO: 278486

SEQ ID NO: 338499 - RNA, 62 nt, Human; identical to SEQ ID NO: 278487

SEQ ID NO: 338500 - RNA, 62 nt, Human; identical to SEQ ID NO: 278488

SEQ ID NO: 338501 - RNA, 64 nt, Human
guaaauauguauaaaauuugaaggaaucgaacuaacaauacauucuguguauauuauuuuaaug

SEQ ID NO: 338502 - RNA, 64 nt, Human
uuagcaaaugacagaagcuaauuccuauugaacaacaauacaguacaacacagaauguuagaga

SEQ ID NO: 338503 - RNA, 64 nt, Human
acuucaggaucuguucuguuucaccauguaacacacaauacaugcaugcauuguauuaguguua

SEQ ID NO: 338504 - RNA, 64 nt, Human
agcagauuagaaaaccuuaaugacucagagagcaacaauacaagagguuaaaggaagcugauua

SEQ ID NO: 338505 - RNA, 64 nt, Human
aauguagcaaguaaagaaugagaauggauucuguacaauacacuagaaaccaacauaauguauu

SEQ ID NO: 338506 - RNA, 64 nt, Human
guauauaucaacauuauuuuauugugcaauuaaaacaauacaaauucaugguuuuuuaaaguua

SEQ ID NO: 338507 - RNA, 64 nt, Human
auaagaacaugcugcauacuugccuaguagcaaaacaauacagggaagagucaaaagggcuucu

SEQ ID NO: 338508 - RNA, 64 nt, Human
gcagccguggcgcucgacugcacaggagcccgagacaauacaccuccgagcugaauaugaaaag

SEQ ID NO: 338509 - RNA, 64 nt, Human
auuucuaaacuugccugaguuugaaaauuuguuaacaauacauuaaaaucuuaaagcaucaaau

SEQ ID NO: 338510 - RNA, 64 nt, Human
uauauauucuauaugauuguaaauauuuuauacaacaauacaaauaaaauauuuuucuauuaua

SEQ ID NO: 338511 - RNA, 64 nt, Human
uuuuuccuuggauauaccuagauuccauacagugacaauacaaauacaaaggaagaacaucugg

SEQ ID NO: 338512 - RNA, 64 nt, Human
acccaaaucacugcugguuuucaauuuuuuuuuaacaauacauuuuuguggucaguuccaacag

SEQ ID NO: 338513 - RNA, 64 nt, Human
uccuauuaagaaauauuugucuuaaauauauaggacaauacauuauauuaaaauggucucucuc

SEQ ID NO: 338514 - RNA, 64 nt, Human
uuuuaaggaugauaaaaaaaaauaacaacuagggacaauacagaacccauuccauuuaucuuuc

SEQ ID NO: 338515 - RNA, 64 nt, Human
uggccauacugaauuaugagacuaacagaugucuacaauacaauaccuguauucaaaauaacaa

SEQ ID NO: 338516 - RNA, 62 nt, Human; identical to SEQ ID NO: 278483

SEQ ID NO: 338517 - RNA, 62 nt, Human; identical to SEQ ID NO: 278484

SEQ ID NO: 338518 - RNA, 62 nt, Human; identical to SEQ ID NO: 278495

SEQ ID NO: 338519 - RNA, 64 nt, Human
auugucagaguucugcucuagacaguguagggcaacaauacaugcugcuaauucaaagcucuau

SEQ ID NO: 338520 - RNA, 64 nt, Human
uuccaucuauaaauagccuucucagauucagaaaacaauacagagaacaucagaaauuuucuaa

SEQ ID NO: 338521 - RNA, 64 nt, Human
uuccaaaucuaucugaguuguauacccaucaaagacaauacaguuauuaacauagaugaaggua

SEQ ID NO: 338522 - RNA, 64 nt, Human
guagcugcaucaccaggcuugcuuggcguagauaacaauacacugaaauacuccugaagauggu

SEQ ID NO: 338523 - RNA, 64 nt, Human
auugacagccaccagucucuacuaaaagacagaaacaauacacugccaaaauguuaaguugacc

SEQ ID NO: 338524 - RNA, 64 nt, Human
guuguucuggaaccuuugcuuuuuauugauuuauacaauacaauuggugggaggguggacuugg

SEQ ID NO: 338525 - RNA, 64 nt, Human
ugauuugagguauuagaaaauauuuuugugccgaacaauacauuccacaaagccauuuucuuuu

SEQ ID NO: 338526 - RNA, 64 nt, Human
aacacagaaaaauucuaguacauuuaaauucuaaacaauacaguggaugacccuuuugaauaua

SEQ ID NO: 338527 - RNA, 64 nt, Human
cacauaccacagacacgcgugugcaugcuccuacacaauacauaugcacauaucaugaacagcg

SEQ ID NO: 338528 - RNA, 64 nt, Human
uuauucugggcaccacacauuugccccauagauaacaauacacgugaugaugucacuaguacua

SEQ ID NO: 338529 - RNA, 64 nt, Human
uagcagagccagaauggacuucagaaucccaacuacaauacaaauguuuauuuaaauaaagaag

SEQ ID NO: 338530 - RNA, 64 nt, Human
acauccaccuuugaggcuggucauaccuccaggaacaauacagagccagucaacuuccuggaau

SEQ ID NO: 338531 - RNA, 64 nt, Human
cuacagaucuguuauaacuauauuguguugguuuacaauacagcaagccugaugguuugucuua

SEQ ID NO: 338532 - RNA, 64 nt, Human
uuggaccauuugaaauaagaaagacaaacacuaaacaauacaaccaugaaauugaucaccggga

SEQ ID NO: 338533 - RNA, 64 nt, Human
ugugaagauguaugaaugguaucuuuuauaauccacaauacauuucugguaagauggaaucacu

SEQ ID NO: 338534 - RNA, 62 nt, Human; identical to SEQ ID NO: 278581

SEQ ID NO: 338535 - RNA, 62 nt, Human; identical to SEQ ID NO: 278582

SEQ ID NO: 338536 - RNA, 62 nt, Human; identical to SEQ ID NO: 278596

SEQ ID NO: 338537 - RNA, 64 nt, Human
ugaagcaaugcuuacaauagaugucucacacagaacaauacaaauauguaaaaaaucuuucacc

SEQ ID NO: 338538 - RNA, 64 nt, Human
ucuucucgaaggaggguugacucagaacccagagacaauacaaaaccccucacuuccucugaga

SEQ ID NO: 338539 - RNA, 64 nt, Human
acccuacacuuucaggggaccgagucugacaaacacaauacauuuaucugugaccuauaucaag

SEQ ID NO: 338540 - RNA, 64 nt, Human
ggaaaaccuuuucuagcuuagagcauuuauaucuacaauacauuuuaaagucagaguucauguu

SEQ ID NO: 338541 - RNA, 64 nt, Human
gaaaaaccuuuccuagcuuagagcauuuguaucuacaauacauuuuaaagucagaguucguguu

SEQ ID NO: 338542 - RNA, 64 nt, Human
cacgggucugaaagugauguccaggcaaaaauugacaauacauuucuugcccgaaauaagaacc

SEQ ID NO: 338543 - RNA, 64 nt, Human
auguacagacuuuuuucuugucauuauucucugaacaauacaagaacucuuuauguagcauuua

SEQ ID NO: 338544 - RNA, 64 nt, Human
cgagccauggaaggguggauugauguuuaaagaaacaauacaaagaauauauuuuuuuguuaaa

SEQ ID NO: 338545 - RNA, 64 nt, Human
auauucagccagcuuaaacccauacaauguauguacaauacaauguacaauuaugucucuugag

SEQ ID NO: 338546 - RNA, 63 nt, Human
cggacaccuucagauuguaagcuuugaagaugaacaauacaaacaaaugaauuuaaauacaaa

SEQ ID NO: 338547 - RNA, 64 nt, Human
gccuggacacugcccucacaggacagcgccaauaacaauacagugucugaguaucuccagggga

SEQ ID NO: 338548 - RNA, 64 nt, Human
aaaggacugguuaaaucaauucugauacagccuuacaauacaauaguaugcagcuaaaaaauaa

SEQ ID NO: 338549 - RNA, 64 nt, Human
uaacuugggugagacguucacuaaaguaccaagcacaauacaaaugcaucuucgaguucuuugg

SEQ ID NO: 338550 - RNA, 64 nt, Human
ggaggagguuaagucuacauuuccaccacugagcacaauacaaauguucuuuacuucuggggaa

SEQ ID NO: 338551 - RNA, 64 nt, Human
ugggggagggagccuggggacacaaaccuuuuauacaauacaaagcuuugcuuuuuuuuuuuuu

SEQ ID NO: 338552 - RNA, 62 nt, Human; identical to SEQ ID NO: 278498

SEQ ID NO: 338553 - RNA, 62 nt, Human; identical to SEQ ID NO: 278499

SEQ ID NO: 338554 - RNA, 62 nt, Human; identical to SEQ ID NO: 278500

SEQ ID NO: 338555 - RNA, 64 nt, Human
guuaacuuuauauuacaaaauccguucuaccauaacaauacagaggaacuagcuguguuacugc

SEQ ID NO: 338556 - RNA, 64 nt, Human
ccuuggcucauccaagaacucuucuguaucuaaaacaauacaucucaaucuuggccaagggaaa

SEQ ID NO: 338557 - RNA, 64 nt, Human
aacuuuaaaaaugugaaguguccuuuuccuuuucacaauacaaaaaaaauuucaacagauugug

SEQ ID NO: 338558 - RNA, 64 nt, Human
uucaguuguugguuaacguauuaacugaacacagacaauacagucugauuuagaagucaucuuu

SEQ ID NO: 338559 - RNA, 64 nt, Human
aaacuacuguucccuuuauuuuaacauuguacagacaauacagaaauguaccuguuggcggccg

SEQ ID NO: 338560 - RNA, 64 nt, Human
agguaccuaauguagcugcuagcaugcaugcacaacaauacaauuuauaugguaaauggaacca

SEQ ID NO: 338561 - RNA, 64 nt, Human
uguuuucugaaacagacguuucuuuuaguaagucacaauacaugcuaauuuucauuucuagaau

SEQ ID NO: 338562 - RNA, 64 nt, Human
uucccuuacucaaggauguagguaaaagaugguaacaauacacuauuugguaagauaauguacu

SEQ ID NO: 338563 - RNA, 64 nt, Human
auuggaagaagaaaaauugucuugugccacacauacaauacacuaacauuaacaauagcugaug

SEQ ID NO: 338564 - RNA, 64 nt, Human
ucuucuugaauguugauaaaaaugaaugacuacuacaauacauuuuguguugcuuguuggauga

SEQ ID NO: 338565 - RNA, 64 nt, Human
cuagucaaugcucugaaaaugugucacauuauaaacaauacagaaggagagauagaugagagau

SEQ ID NO: 338566 - RNA, 64 nt, Human
ggcucugggacgacuuugucucuagcccauuaauacaauacauccuaugcuuucugugcagacu

SEQ ID NO: 338567 - RNA, 64 nt, Human
uacaguuagcacaaaagaaaaauucagcugccugacaauacaggaaauguucucagaugcugau

SEQ ID NO: 338568 - RNA, 64 nt, Human
ugacuauauugaggauaaaauuucuagagaagaaacaauacaugcuugcuauuaauauuucaau

SEQ ID NO: 338569 - RNA, 64 nt, Human
uuuauggacuagaaggaaucacgagggcuacugcacaauacauggccuaaguucccucuguucc

SEQ ID NO: 338570 - RNA, 62 nt, Human; identical to SEQ ID NO: 278489

SEQ ID NO: 338571 - RNA, 62 nt, Human; identical to SEQ ID NO: 278493

SEQ ID NO: 338572 - RNA, 62 nt, Human; identical to SEQ ID NO: 278501

SEQ ID NO: 338573 - RNA, 64 nt, Human
uggaaagucacuggaauaacuuuaaaaaagaauuacaauacauggcuuuuuagaauuucguuac

SEQ ID NO: 338574 - RNA, 64 nt, Human
ugcaucuggcaagaagauccacgugguguuaggaacaauacaggaccuuaaggaugggggaauc

SEQ ID NO: 338575 - RNA, 64 nt, Human
uuaacuuggguccaugaccguuugcauucgaaacacaauacacugccucguucucucaguuagc

SEQ ID NO: 338576 - RNA, 64 nt, Human
auuucaacaguuauugggcuuaaaaagcaucauuacaauacaguauuucuuuguuauacauuua

SEQ ID NO: 338577 - RNA, 64 nt, Human
aggauuguuuuucucaucaggauacauuaaaaauacaauacagcacgucaaaccacagaauauu

SEQ ID NO: 338578 - RNA, 64 nt, Human
ugaaaguuaauuauaugggaucuguugucaggauacaauacacacugauauauacauguugaag

SEQ ID NO: 338579 - RNA, 64 nt, Human
auaaugagacaauaucaaaaguaaacauguaaugacaauacauacuaacauucuuguaggagug

SEQ ID NO: 338580 - RNA, 64 nt, Human
cuuaucuuucauuuuauaagaagguugguuuuaaacaauacacuaagaaugacuccuauaaaga

SEQ ID NO: 338581 - RNA, 64 nt, Human
ccagagcacccccaccaucaggccagucaacugcacaauacacaacuguauuucccaauacacu

SEQ ID NO: 338582 - RNA, 64 nt, Human
auccugcggaacuguuuuaauuacaauuauacuaacaauacacaugagaauagauauuagaaac

SEQ ID NO: 338583 - RNA, 64 nt, Human
gaugucaaagggaggcagccugcuugaacaggaaacaauacacaaaagguugccaacucgcaug

SEQ ID NO: 338584 - RNA, 64 nt, Human
cagcuuuugugcccauuguuuuaacuugugugaaacaauacaaagcccagaaauucuuuucggg

SEQ ID NO: 338585 - RNA, 64 nt, Human
cuuucaggaauaaaguucagugugcugaucauucacaauacaguggauagcuugauaucuucug

SEQ ID NO: 338586 - RNA, 64 nt, Human
acagaagggcgucgggggaaccugccgcaaggagcagagacagcacagccccccgggcccagcc

SEQ ID NO: 338587 - RNA, 64 nt, Human
uugcuuuucagacuguuuucauuucuguuuuuagcagagacaugcaacaacaacacacacgcac

SEQ ID NO: 338588 - RNA, 62 nt, Human; identical to SEQ ID NO: 278503

SEQ ID NO: 338589 - RNA, 62 nt, Human; identical to SEQ ID NO: 278504

SEQ ID NO: 338590 - RNA, 62 nt, Human; identical to SEQ ID NO: 278505

SEQ ID NO: 338591 - RNA, 62 nt, Human; identical to SEQ ID NO: 278509

SEQ ID NO: 338592 - RNA, 64 nt, Human
ccccuggggcgggcauuggcccaggugguggagacagagacaggccccugaacgauaagcacca

SEQ ID NO: 338593 - RNA, 64 nt, Human
ucacugugauacccugcccuccagagggugcgcucagagacacgggcaagcaugccucuucccu

SEQ ID NO: 338594 - RNA, 64 nt, Human
aauacaccuggaucugucuagucaaucaacauagcagagacagucuuaaaccuaccauugaccu

SEQ ID NO: 338595 - RNA, 64 nt, Human
gcaccacaccccuuccccuagaugacugccugugcagagacacaguuugcaccauuagccuuac

SEQ ID NO: 338596 - RNA, 64 nt, Human
ccucaggguauugcuugccacuaagccaugaaaccagagacaaaaucucuauacugcccugagu

SEQ ID NO: 338597 - RNA, 64 nt, Human
aguguuagacacuaugugucccaccaccccauuacagagacauaugacaauguucagcagguca

SEQ ID NO: 338598 - RNA, 64 nt, Human
ggauggagagcagcagcaggggaagaggugcucucagagacagcagggcuggugcucuucuccc

SEQ ID NO: 338599 - RNA, 64 nt, Human
gauagauagaaaugcccacucaaagaaaaauaaacagagacaaauguuaaaauugccauacaga

SEQ ID NO: 338600 - RNA, 64 nt, Human
auucggucugcccgucuucgaauaccagguauugcagagacaggcacuuggacuuacagcguuc

SEQ ID NO: 338601 - RNA, 64 nt, Human
aagaaaaaaaaaaaucuuuuauuugugauauuuucagagacauuugcucuaguaugguguauuu

SEQ ID NO: 338602 - RNA, 64 nt, Human
gaagaaauggccuucaauuauuugaaaagagacacagagacaccucuggcuaccuagaguucuu

SEQ ID NO: 338603 - RNA, 64 nt, Human
cgccaccacgcccggcuaauuuuuguguuuuuagcagagacaggguuucaccacguuggccagg

SEQ ID NO: 338604 - RNA, 64 nt, Human
caaggacaaggggggacaguuuugccuacagcuccagagacacagagaacaaaggggugaccuu

SEQ ID NO: 338605 - RNA, 64 nt, Human
uuugugggaucccuuagaaagcaucacuucagggcagagacacucaauauugccagccagcuug

SEQ ID NO: 338606 - RNA, 64 nt, Human
guugggggccuguaugccuugcuucuaccaugagcagagacaauuaaaaucuuuauuccaguga

SEQ ID NO: 338607 - RNA, 64 nt, Human
uggugggggcggagggaaggagggcggcggggcacagagacagagagcaaggcugugaaacuga

SEQ ID NO: 338608 - RNA, 62 nt, Human; identical to SEQ ID NO: 278510

SEQ ID NO: 338609 - RNA, 62 nt, Human; identical to SEQ ID NO: 278511

SEQ ID NO: 338610 - RNA, 62 nt, Human; identical to SEQ ID NO: 278513

SEQ ID NO: 338611 - RNA, 64 nt, Human
agguaucagaaaagucuaggaccuaucauuucaucagagacaugaucagaaaagaaacugcuuc

SEQ ID NO: 338612 - RNA, 64 nt, Human
acauuugguaaaaggaaguauacuggucuguuagcagagacaaacuuuuuuuagaauugaaguc

SEQ ID NO: 338613 - RNA, 64 nt, Human
ucccaaguucugagaauuguucacacuuucuaaccagagacagaauucagagcucuuuuugaaa

SEQ ID NO: 338614 - RNA, 64 nt, Human
accaaaguugucccaacagaggaggccagugaggcagagacagagcucucccacucucagaccc

SEQ ID NO: 338615 - RNA, 64 nt, Human
uauuauaccaugagaaaaucaaaaagguguucuucagagacauuuuaucuauaaaauuuuccua

SEQ ID NO: 338616 - RNA, 64 nt, Human
cuaaugcauuuuugaaaccaaagguaccuagccucagagacagagaaggagagggggagaucuu

SEQ ID NO: 338617 - RNA, 64 nt, Human
ccccacgguacugugaacgucgugugacucagugcagagacagauaauauauuuaauucaugua

SEQ ID NO: 338618 - RNA, 64 nt, Human
agccagcugcaguccguaccguucuuagguuagccagagacagguuuucauuaucaggucacug

SEQ ID NO: 338619 - RNA, 64 nt, Human
uuagucaaaaaauuccaacaaguagccaggacugcagagacacuccagugcagagggagaagga

SEQ ID NO: 338620 - RNA, 64 nt, Human
ggagaccagcggagugggagggagacgcaguagacagagacagaccgagagaggaauggagaga

SEQ ID NO: 338621 - RNA, 64 nt, Human
ucuuaucuaugaagacaucuucccagaguguccccagagacaugcaagucaugggucacaccug

SEQ ID NO: 338622 - RNA, 64 nt, Human
ugguaaaaugugaaguaauagugaaccuaacagucagagacaggcagcaugcucuuaacuagug

SEQ ID NO: 338623 - RNA, 64 nt, Human
acucccggagucuucucgagcuacgagaccuucacagagacacguggcagccacacucacccag

SEQ ID NO: 338624 - RNA, 64 nt, Human
uuaccucuccccuugagauguaaaaaugguccagcagagacaagcucccguggaaaacagacag

SEQ ID NO: 338625 - RNA, 64 nt, Human
cacccaaccugucacaacggccagaaccauacaccagagacacacuggcagguuaggcaguccu

SEQ ID NO: 338626 - RNA, 64 nt, Human
cagcaaagucuccuuauguauaaugaaacaaggucagagacagauuugauauuaaaaaauuaaa

SEQ ID NO: 338627 - RNA, 62 nt, Human; identical to SEQ ID NO: 278452

SEQ ID NO: 338628 - RNA, 62 nt, Human; identical to SEQ ID NO: 278453

SEQ ID NO: 338629 - RNA, 62 nt, Human; identical to SEQ ID NO: 278517

SEQ ID NO: 338630 - RNA, 64 nt, Human
aaacauacugcuuaaaacaguguugcugugacuucagagacaagccuggaaggggcaccuuagg

SEQ ID NO: 338631 - RNA, 64 nt, Human
gaccuucagcuccuaugcaggcuucucuugagcccagagacaaggcagcuuggucuaguggaga

SEQ ID NO: 338632 - RNA, 64 nt, Human
agagcccaggccuccuacagcuugaccgugaggccagagacacaagccuucggcgccuuaagga

SEQ ID NO: 338633 - RNA, 64 nt, Human
cacacuugguuuccagagcucccaguggacaugucagagacaacacuucccagcaucugagacc

SEQ ID NO: 338634 - RNA, 64 nt, Human
uccucuggucaggcgagguucacugugcauauggcagagacaggaguggcccugcagugauguu

SEQ ID NO: 338635 - RNA, 64 nt, Human
cuugguuacacugcaguuucaggauugggugagacagagacaaaugaaccccccucuaaaguca

SEQ ID NO: 338636 - RNA, 64 nt, Human
guuuuuaaucaacucagaacacuggcaguuccuacagagacacugaggugucuugauuauggag

SEQ ID NO: 338637 - RNA, 64 nt, Human
caacugcuaugugccuuucguuguuccagauaugcagagacaaugauaaauaaaacauauaauc

SEQ ID NO: 338638 - RNA, 64 nt, Human
gacuugaaaaguguuccaaguucccagucagucacagagacagacugccucucgguggcagucu

SEQ ID NO: 338639 - RNA, 64 nt, Human
uaaauucagccuaaacuuuuugacgggaacacugcagagacaaugcugugaguuuccaaccuca

SEQ ID NO: 338640 - RNA, 64 nt, Human
uuauuuuugaaggaaaaauugcuuauacuaaguccagagacaugcaggugagcccuuuugucag

SEQ ID NO: 338641 - RNA, 64 nt, Human
aacacauacagacucaacagcaaucaugcaguuccagagacacaugaaccugacacaaucucuc

SEQ ID NO: 338642 - RNA, 64 nt, Human
aaagauagacuuuaggggcuggcacaaaucugaucagagacacauauccauacacaggugaaac

SEQ ID NO: 338643 - RNA, 64 nt, Human
uguugguuucugguucagagugcucucccaccaccagagacaaguggguaaaaaggucagucca

SEQ ID NO: 338644 - RNA, 64 nt, Human
caucuggggaacuagagggauacacugaaguuaacagagacagauaacucuccucgggucucug

SEQ ID NO: 338645 - RNA, 64 nt, Human
cugggcuugucauuuuuucccuuguagcuuuaagcagagacauaagugccuugcauuacacaua

SEQ ID NO: 338646 - RNA, 62 nt, Human; identical to SEQ ID NO: 278444

SEQ ID NO: 338647 - RNA, 55 nt, Human; identical to SEQ ID NO: 278445

SEQ ID NO: 338648 - RNA, 62 nt, Human; identical to SEQ ID NO: 278496

SEQ ID NO: 338649 - RNA, 64 nt, Human
uccccuccucagcaaggcaucuaccggccccucacagagacaguacuuugaaacucauguugag

SEQ ID NO: 338650 - RNA, 64 nt, Human
aggauguggccuguugguccuucuguugccaucacagagacacaggcauuuaaauauuuaacuu

SEQ ID NO: 338651 - RNA, 64 nt, Human
aaucauguuaacucuuccuuaucagccuguggcccagagacacaaugggguccuucuguaggca

SEQ ID NO: 338652 - RNA, 64 nt, Human
ggagccagcugagaggucuauuuaaaaaaaaagucagagacagauaccuccaacccugccguca

SEQ ID NO: 338653 - RNA, 64 nt, Human
acaauagucacaauacuuuuugugaaucuacaaccagagacaggcaaaaacuuguaaaguaagg

SEQ ID NO: 338654 - RNA, 64 nt, Human
ggaaguaacauugcacuaauauggaaaucacugccagagacagucuauuuucuuuuaauuuguu

SEQ ID NO: 338655 - RNA, 64 nt, Human
cguuuuauaugugcaguaugacaaagaggaguuucagagacaacuuugaauccuugucagccug

SEQ ID NO: 338656 - RNA, 64 nt, Human
ugugagaaugccuucauuuauccuauaacucacucagagacacaugguaacacauacuccagau

SEQ ID NO: 338657 - RNA, 64 nt, Human
uugcuuucaguugguuuucaauuugcucacuggccagagacauugauggcaguucuuaucugca

SEQ ID NO: 338658 - RNA, 64 nt, Human
aaggacuuggaauacugcuugacauaucgugaggcagagacacaaagauauggaagaacauugg

SEQ ID NO: 338659 - RNA, 64 nt, Human
uuauagccagccaucuaucaccucuagaagguuccagagacagugaaacugcaagaugcucuca

SEQ ID NO: 338660 - RNA, 64 nt, Human
cuguuuuaaauuauaagaugucauccccuugugucagagacagaccccuuggcuuuugcuuggc

SEQ ID NO: 338661 - RNA, 64 nt, Human
guccagcugcagaaauucguugccaaagauuggacagagacaccgaaggaaaugggguggugaa

SEQ ID NO: 338662 - RNA, 64 nt, Human
ggagcagccgguaagugaagagcacagcuggaagcagagacaccuuaugacucaaacugggcaa

SEQ ID NO: 338663 - RNA, 64 nt, Human
augacugguuuccuuguaugaaaaggagaggacacagagacagaggagaugcggggaagacuau

SEQ ID NO: 338664 - RNA, 64 nt, Human
ggaaccgcaaucagcugugaagccagcaccaccucagagacacuguucccugcuccaggguaga

SEQ ID NO: 338665 - RNA, 62 nt, Human; identical to SEQ ID NO: 278659

SEQ ID NO: 338666 - RNA, 62 nt, Human; identical to SEQ ID NO: 278660

SEQ ID NO: 338667 - RNA, 62 nt, Human; identical to SEQ ID NO: 278661

SEQ ID NO: 338668 - RNA, 64 nt, Human
gcagcuuacggagaugucacuggagcagcacgcucagagacagugaacuagcauuugaauacac

SEQ ID NO: 338669 - RNA, 64 nt, Human
uucugauucuucuagcauuacucguugguggcuucagagacagugcugccuccuccugagggag

SEQ ID NO: 338670 - RNA, 64 nt, Human
gauaauugaaucucucaguugugggaauaauuaucagagacaugcaacugaaaaugucucaccu

SEQ ID NO: 338671 - RNA, 64 nt, Human
ucagaacuuugccauuugucuacagaagacgaaccagagacaaaauuacuaaguauaaauuagu

SEQ ID NO: 338672 - RNA, 64 nt, Human
caccuacaugagguacugagagugaacaaauuuacagagacagaaagcagaacagugauuacca

SEQ ID NO: 338673 - RNA, 64 nt, Human
ggcacagcuaaugcccgaacccagccccugucggcagagacagagccccacauuauuaugugaa

SEQ ID NO: 338674 - RNA, 64 nt, Human
cuuauuugcaaaauuguauaauuaggaauuauuucagagacaauguuuucuuuuucaggugagu

SEQ ID NO: 338675 - RNA, 64 nt, Human
uuucucaaucucauauguuuuugucuuguagagacagagacaaguucagcauguugcagauugg

SEQ ID NO: 338676 - RNA, 64 nt, Human
ucacagaaauaaacaaguagguuucaguugucuucagagacaaauguuacuuaaucaggaauac

SEQ ID NO: 338677 - RNA, 64 nt, Human
uuaaacaaaguuucagaguauauuguugaagagacagagacaaguaauuucaguguaaagugug

SEQ ID NO: 338678 - RNA, 64 nt, Human
cuggcacacgccccacgccuuccucuauaacccccagagacaggcuggggcagcgccaaggcgg

SEQ ID NO: 338679 - RNA, 64 nt, Human
uccugaauuaagauguuuucaccacauuguauuacagagacagccaauaaaucuacuauuugau

SEQ ID NO: 338680 - RNA, 64 nt, Human
ccccgcccguuuuacaaagggggaggcuaaagcccagagacagcuugaucaaaggcacacagca

SEQ ID NO: 338681 - RNA, 64 nt, Human
gguagaugccacaauguaugugcacggccuuucucagagacauuaguucugaggcccuuugugg

SEQ ID NO: 338682 - RNA, 64 nt, Human
aacacacacacacauacacacacacacacacacacagagacacaucuuaaggggacccacaagu

SEQ ID NO: 338683 - RNA, 64 nt, Human
cuuacagugauuguacauauuguacaucuuuguacagagacaucuuggcaccucaucccaacaa

SEQ ID NO: 338684 - RNA, 62 nt, Human; identical to SEQ ID NO: 278521

SEQ ID NO: 338685 - RNA, 62 nt, Human; identical to SEQ ID NO: 278525

SEQ ID NO: 338686 - RNA, 62 nt, Human; identical to SEQ ID NO: 278526

SEQ ID NO: 338687 - RNA, 64 nt, Human
cccugugggugaggcugggugaugaccugaggaccagagacacgcgaccauguuggggcucuug

SEQ ID NO: 338688 - RNA, 64 nt, Human
ccuuacuauuuaagauacucugaucgcacaacugcagagacaggguucccucacugcuagucag

SEQ ID NO: 338689 - RNA, 64 nt, Human
ccaggcuucugucauacagguagaucccgaagcacagagacauaaaaaaggucucccagaaaac

SEQ ID NO: 338690 - RNA, 64 nt, Human
ugagaccugucaggccauacugacaagcagaggucagagacacugguggggagcuggcaaugaa

SEQ ID NO: 338691 - RNA, 64 nt, Human
guagaggaggccaucugaucccaugggaagccaucagagacacugcuggugggagcaggaagga

SEQ ID NO: 338692 - RNA, 64 nt, Human
cucaugccuccaagucagaguuucccuggugccccagagacaggagcacaagugggaucugacc

SEQ ID NO: 338693 - RNA, 64 nt, Human
cacugggaguuguggcugggcuucccaucuuccacagagacaucucccugugggaugggcagau

SEQ ID NO: 338694 - RNA, 52 nt, Human
uuggcagaaagaguccuugaagcagagacaagccucaccuccacuucuguca

SEQ ID NO: 338695 - RNA, 64 nt, Human
uuuuugcucaaggcaaccagaggaaacuugcauacagagacagauauacugggagaaaugacuu

SEQ ID NO: 338696 - RNA, 64 nt, Human
gccgcaugacaugggaggcgauggggacgauggacagagacagagcgugcacacguagaguggc

SEQ ID NO: 338697 - RNA, 64 nt, Human
gauagaaauaucgaaugcaaagcuacuggcuucacagagacaaccauuuaugauuugcuguucu

SEQ ID NO: 338698 - RNA, 64 nt, Human
guuuucuguguggucuccagcuccucuccagacacagagacaugggaguggggagcggagcuug

SEQ ID NO: 338699 - RNA, 64 nt, Human
cucugcucagaacacuaccauucaccccaucucccagagacacucucccuccuccucuuucacc

SEQ ID NO: 338700 - RNA, 64 nt, Human
aaaaaaagaaaaaggcugcuugauguauguuaugcagagacacucugccucugguggcugcaga

SEQ ID NO: 338701 - RNA, 64 nt, Human
cugggucaaggcaccauguguuacuuggucaggacagagacaaaaaugaggaaaacuaggggac

SEQ ID NO: 338702 - RNA, 64 nt, Human
cgcaagggccaggcccuggaggaggaugaagacacagagacaaggugacuggcgcaggucuccu

SEQ ID NO: 338703 - RNA, 62 nt, Human; identical to SEQ ID NO: 278416

SEQ ID NO: 338704 - RNA, 62 nt, Human; identical to SEQ ID NO: 278417

SEQ ID NO: 338705 - RNA, 62 nt, Human; identical to SEQ ID NO: 278418

SEQ ID NO: 338706 - RNA, 64 nt, Human
ugcaucuacuuggcaaggucauagacaauuccuccagagacacugagccagucuuugaacugca

SEQ ID NO: 338707 - RNA, 64 nt, Human
ccucaguauuaccaugucucccucucagggguagcagagacaggguugcuuauaggaagcuggc

SEQ ID NO: 338708 - RNA, 64 nt, Human
ucugccugggcagcagaauauauauuuuaccuaucagagacaucuauuuuucugggcuccaacc

SEQ ID NO: 338709 - RNA, 64 nt, Human
gagcagaauaagucuaaaggcagagccccagccucagagacaaauaggcuucaucauggaaacu

SEQ ID NO: 338710 - RNA, 64 nt, Human
caguuaagucuacacagccucucaacugcuuugacagagacaaccuccucugaaauauuaaagu

SEQ ID NO: 338711 - RNA, 64 nt, Human
cagauguuuuuauugcaggucaauauaauacugccagagacagaaaauacccccuuaucagucc

SEQ ID NO: 338712 - RNA, 64 nt, Human
gacuucccucuccugcuucauuaagggcuuggggcagagacagcauggggaaggagguccccuu

SEQ ID NO: 338713 - RNA, 64 nt, Human
cacagccucauuuuacagacagcccccugaggcccagagacaugcagcucucuguccacaacca

SEQ ID NO: 338714 - RNA, 64 nt, Human
uagaugcaugaauuuauuuauaugaaggcucucacagagacacacacagcacuucaguagcauu

SEQ ID NO: 338715 - RNA, 64 nt, Human
uggugccugcuuugacgggccaggcccuggagggcagagacaaucacgggcgguccugcacaga

SEQ ID NO: 338716 - RNA, 64 nt, Human
guaguuugcuuuuaguauuguuguugcacuugagcagagacaaaccuuuauucauagugucuac

SEQ ID NO: 338717 - RNA, 64 nt, Human
aucagcagggggaaagccaagcugagaauaaacccagagacaaagaacccucggacucaggcag

SEQ ID NO: 338718 - RNA, 64 nt, Human
cccuuuucacucccuccaucaagaauggggaucacagagacauuccuccgagccggggaguuuc

SEQ ID NO: 338719 - RNA, 64 nt, Human
gguuccagagaauuugcacaaaguucccucuguacagagacaaaacggccuccggcucucagag

SEQ ID NO: 338720 - RNA, 64 nt, Human
acaccagcaaugcugaggaugccaacuucacgcucagagacagcugcaccgacuuggagcucuu

SEQ ID NO: 338721 - RNA, 64 nt, Human
acacagauaagcugcccaaaugcacgcacacgcacagagacaugccagaacauacaaggacaug

SEQ ID NO: 338722 - RNA, 62 nt, Human; identical to SEQ ID NO: 278413

SEQ ID NO: 338723 - RNA, 62 nt, Human; identical to SEQ ID NO: 278414

SEQ ID NO: 338724 - RNA, 62 nt, Human; identical to SEQ ID NO: 278419

SEQ ID NO: 338725 - RNA, 64 nt, Human
gcccucccuggcugugagcagccuccacuguguccagagacaugggccucccacuccuguuccu

SEQ ID NO: 338726 - RNA, 64 nt, Human
augugaaauguccagaauaggcaaaucuguguaucagagacaaagcacauuggugguugccagg

SEQ ID NO: 338727 - RNA, 64 nt, Human
uuagaaauacaguauccagacugcuaguccuugccagagacauucuuaccucugcccugugaua

SEQ ID NO: 338728 - RNA, 64 nt, Human
uggcccggcaaagcacugaaaaccccucuggucucagagacaguaggggcagugccacuuucua

SEQ ID NO: 338729 - RNA, 64 nt, Human
aacaguuggauucagaaccaagaccuaacuccugcagagacagacucugaaugcaugaccuuug

SEQ ID NO: 338730 - RNA, 64 nt, Human
ggcucagccauucggcuuggggcaccaggcuccccagagacaaugcucaguauucauucauaca

SEQ ID NO: 338731 - RNA, 64 nt, Human
aguacuuuaaagaaaggucuguuaggaccagaagcagagacaccacuuuucaaaggacuucuug

SEQ ID NO: 338732 - RNA, 64 nt, Human
gcauuucuaaagcaccgacuggagaggaaggcaacagagacaaggagagaagccgagagacaug

SEQ ID NO: 338733 - RNA, 64 nt, Human
ccuguaacuugagaguagaugguuugagccugagcagagacaugacucagccuguuccaugaag

SEQ ID NO: 338734 - RNA, 64 nt, Human
uggcaugcaucaggcacaucuguccuacagcuggcagagacagaugccucgguucuuugucauu

SEQ ID NO: 338735 - RNA, 64 nt, Human
agcugugucccuuuacuaugcaagcacaugaccccagagacagcugguucacuggcagaucccc

SEQ ID NO: 338736 - RNA, 64 nt, Human
gugugcaaggcaauaguuagccuugauuuuagcccagagacagauggcagagcuaucucucuca

SEQ ID NO: 338737 - RNA, 64 nt, Human
gcaauguguuuuaaaauaagcuugcaaaugacagcagagacauuuacuucugcaguuaguuaac

SEQ ID NO: 338738 - RNA, 64 nt, Human
uguuuguauaauuuugaacacuauaauagcaauucagagacagacauuguuaaagguuugaugu

SEQ ID NO: 338739 - RNA, 64 nt, Human
aguucaacugaaacuucgaaagcaucauuauuugcagagacaggaccugacuauugaaguugca

SEQ ID NO: 338740 - RNA, 64 nt, Human
ccugcagagcacacagguacagcaacaggaaucucagagacagguggccuagcaggcacaggac

SEQ ID NO: 338741 - RNA, 62 nt, Human; identical to SEQ ID NO: 278403

SEQ ID NO: 338742 - RNA, 62 nt, Human; identical to SEQ ID NO: 278404

SEQ ID NO: 338743 - RNA, 62 nt, Human; identical to SEQ ID NO: 278421

SEQ ID NO: 338744 - RNA, 64 nt, Human
guggcccaccagcagccuuuccaaaggggaacuccagagacauuucauaaugcaaacagcacug

SEQ ID NO: 338745 - RNA, 64 nt, Human
ucauguaacuggugacacucagccauucagcucucagagacauuguacuaaacaaccaccuuaa

SEQ ID NO: 338746 - RNA, 64 nt, Human
ugauggguuguagaagcguguguuugagagaauucagagacauuugaaggcugcugugugcaug

SEQ ID NO: 338747 - RNA, 64 nt, Human
agguuuuccauuuuaguggguucugcuuuuauuucagagacagacaugugucuucucuguccgu

SEQ ID NO: 338748 - RNA, 64 nt, Human
gauggucauucucaaaaacccugggguccugggccagagacaggcagggcccaguccaggggcc

SEQ ID NO: 338749 - RNA, 64 nt, Human
ccacuuuuguuccuuccugcugggcugccucgugcagagacacaguguaggggccaugcagcug

SEQ ID NO: 338750 - RNA, 64 nt, Human
aaacuccuuauuagagagucuacagauaaaucuacagagacaauuccucaaguggacuuggcca

SEQ ID NO: 338751 - RNA, 64 nt, Human
ucuugaauggcaaauaacccaauagccugcguaccagagacaucugugauuguucuauuacuug

SEQ ID NO: 338752 - RNA, 64 nt, Human
gccggcugacaauacaaugaaaaggcuuaaaaagcagagacaaggagugggcuucaugcauuau

SEQ ID NO: 338753 - RNA, 64 nt, Human
gacaguucccaguaagguaaugagaugccauuuucagagacauucuaagaagauauuuugauuc

SEQ ID NO: 338754 - RNA, 64 nt, Human
ucucuuguuaaaccagacccugggcuugucugggcagagacagaagcugauuuaacagcauaga

SEQ ID NO: 338755 - RNA, 64 nt, Human
gggccagucgagagccacugagggacccagcacucagagacacaacacacauguguagcugcuu

SEQ ID NO: 338756 - RNA, 64 nt, Human
caucuagaggcuuccuucauuuccuccgucaccucagagacauacaccuaugucauuucauuuc

SEQ ID NO: 338757 - RNA, 64 nt, Human
ccgacugucuccucugccuuuuguuuuucagcuucagagacagauccaauauagucccagggac

SEQ ID NO: 338758 - RNA, 64 nt, Human
agaggggaauaauagaagaacauccaaggagaaacagagacaggcccaagagaugaagagugag

SEQ ID NO: 338759 - RNA, 64 nt, Human
uuuuaaaagucaaaacagaacaaaacaaaguaugcagagacagagcauuugcagggccaccugg

SEQ ID NO: 338760 - RNA, 62 nt, Human; identical to SEQ ID NO: 278422

SEQ ID NO: 338761 - RNA, 62 nt, Human; identical to SEQ ID NO: 278423

SEQ ID NO: 338762 - RNA, 62 nt, Human; identical to SEQ ID NO: 278527

SEQ ID NO: 338763 - RNA, 64 nt, Human
ucggguuugagcagggagcaggcagagcugcagucagagacauuagaaaaccagucugaauugg

SEQ ID NO: 338764 - RNA, 64 nt, Human
caccuggggaugggcugacucagggucccgaggccagagacaaagcugugggagccaagaauaa

SEQ ID NO: 338765 - RNA, 64 nt, Human
ggacuuggcugcgcguaacugccuggucagugcccagagacaagugaaggugucugcccugggc

SEQ ID NO: 338766 - RNA, 64 nt, Human
cucaggcaucgucucccgcaaugggcagagagagcagagacagguggaccaacagacagcuggc

SEQ ID NO: 338767 - RNA, 64 nt, Human
ugaauuauuuagugugacuucaccugaggcaucacagagacaaaagaaugugaagcuacuuaac

SEQ ID NO: 338768 - RNA, 64 nt, Human
ucauaaccuuuucauaacaugauaguuuccauaacagagacagccuaacaaugaugaguuguau

SEQ ID NO: 338769 - RNA, 64 nt, Human
gaggagggggaaagggucuuaauucuauguacagcagagacauuaaacuugcuguguccgggcu

SEQ ID NO: 338770 - RNA, 64 nt, Human
cagcuauaugauuaauucugcccaauaggguauacagagacauguccugggugacaugggaugu

SEQ ID NO: 338771 - RNA, 64 nt, Human
ucuagcccagcagcggcuggggucuggcuccuuucagagacacuacacuucccgugcagacuca

SEQ ID NO: 338772 - RNA, 64 nt, Human
gccuauaucuuuguucucucauguugauccaagccagagacaucaguaacaaauagcaccugug

SEQ ID NO: 338773 - RNA, 64 nt, Human
uguauucugaaguuccagauuguucaucuagaggcagagacaucucuuuuaaaaaagugccaga

SEQ ID NO: 338774 - RNA, 64 nt, Human
uacaauuucauguuaaucugguuugucuguccaccagagacagaucuucugugacagccuccuu

SEQ ID NO: 338775 - RNA, 64 nt, Human
agucuaguauggcuuuaacugaauauuugauccucagagacaguaucaugagacugcauuauaa

SEQ ID NO: 338776 - RNA, 64 nt, Human
ggcugcagggagacaacggguggcugcauccagccagagacaggcgcagguggguguccucagc

SEQ ID NO: 338777 - RNA, 64 nt, Human
acuggugcagggaggcaaggcccacauucuccuucagagacaggcacuggcgccagaggcuucc

SEQ ID NO: 338778 - RNA, 64 nt, Human
ugggccagcucuccugccugugucuagaggaagccagagacagaaauaggcuaagccugcagua

SEQ ID NO: 338779 - RNA, 62 nt, Human; identical to SEQ ID NO: 278428

SEQ ID NO: 338780 - RNA, 62 nt, Human; identical to SEQ ID NO: 278429

SEQ ID NO: 338781 - RNA, 62 nt, Human; identical to SEQ ID NO: 278430

SEQ ID NO: 338782 - RNA, 64 nt, Human
uacgagaaugugcucauuugcaagcagaaaaccacagagacaggugcccagcaggagggcauag

SEQ ID NO: 338783 - RNA, 64 nt, Human
ggcggcguuugcugugaaccacgcucaggccacacagagacacauacuugguuucugggacuga

SEQ ID NO: 338784 - RNA, 64 nt, Human
aacuucuuaaucauugauccaggaauauuucaaccagagacacaacuuucuggcagacagacaa

SEQ ID NO: 338785 - RNA, 64 nt, Human
cauuacucaguggacggagaaaucuguuuuguuacagagacaugccucucagaaggucaggagg

SEQ ID NO: 338786 - RNA, 64 nt, Human
uccaacagagaugaugcuguucguauguuaaucucagagacaguauuucaagagaguggcaggu

SEQ ID NO: 338787 - RNA, 64 nt, Human
uuuuaccucgggguuuugaggccaacagggacgacagagacaguuucuaguuagagccuuggcu

SEQ ID NO: 338788 - RNA, 64 nt, Human
agggaaaaccuacaggacuuucacuaaagcuagccagagacagccaugaaaauggacguuucac

SEQ ID NO: 338789 - RNA, 64 nt, Human
guuacuuggccauuucuucccaucuccaaaaauccagagacauuacgagagcuauucauucaua

SEQ ID NO: 338790 - RNA, 64 nt, Human
guuagucccaacucuggccaaagauacuuuuuuccagagacagaggccaggaggcagugagggg

SEQ ID NO: 338791 - RNA, 64 nt, Human
agggcaucuguacuccugugcaaaaugcccaguccagagacaaaaccucagacuuugugcaccu

SEQ ID NO: 338792 - RNA, 64 nt, Human
caguuucuugucuuuuuuauacauuuugucaucccagagacaaucaguaugugcuuaccugugu

SEQ ID NO: 338793 - RNA, 64 nt, Human
ucaguauugagaaacgcagccugccagggaaucacagagacaucggggugcccgcgauggcccu

SEQ ID NO: 338794 - RNA, 64 nt, Human
ucuaaccaaucaaauaguuucuuugucuugcucccagagacaccuuguaaguguccccucuggu

SEQ ID NO: 338795 - RNA, 64 nt, Human
uacuguggcacuuucucaguuauucgcagacacacagagacaaaaaauuugaagugccuggcug

SEQ ID NO: 338796 - RNA, 64 nt, Human
gccuucccggggccccccaucagcgaugugucuucagagacaauccauuaaagcagccaggaag

SEQ ID NO: 338797 - RNA, 64 nt, Human
guaggugguggugacgugagggcugugaaggauccagagacaagacuuagauguuucguucauu

SEQ ID NO: 338798 - RNA, 62 nt, Human; identical to SEQ ID NO: 278396

SEQ ID NO: 338799 - RNA, 62 nt, Human; identical to SEQ ID NO: 278397

SEQ ID NO: 338800 - RNA, 62 nt, Human; identical to SEQ ID NO: 278434

SEQ ID NO: 338801 - RNA, 64 nt, Human
uuuuccuagccuggagaugggaaaauaugcuuggcagagacaggaaugcugugugcuuguucca

SEQ ID NO: 338802 - RNA, 64 nt, Human
ugccuucaccauuguuaaaugucagccuguacggcagagacaugguggucugcacaagccugga

SEQ ID NO: 338803 - RNA, 64 nt, Human
gcagcaacgcaagucaggcugaacauucagucuccagagacagcuguguggagcaaaucagagu

SEQ ID NO: 338804 - RNA, 64 nt, Human
uaauguaacccaacaagagcacauuuuaucauagcagagacaucuguaugcauuccugucauua

SEQ ID NO: 338805 - RNA, 64 nt, Human
aaacaaagcagaggcaagaacugaggagaaguaucagagacaaacgggacuuuuagccuugaca

SEQ ID NO: 338806 - RNA, 64 nt, Human
auuugauuuuaugaaguauauacccuuuacccaccagagacaguacagaaucccugcccuaaaa

SEQ ID NO: 338807 - RNA, 64 nt, Human
aagauugaacacugcguaggagagggagaugauccagagacauguggcagcaggcauggcuucc

SEQ ID NO: 338808 - RNA, 64 nt, Human
uccuguugaugggaaaagcccccaguuaauacuccagagacagggaaaggucagcccguuucag

SEQ ID NO: 338809 - RNA, 64 nt, Human
uauuuuuucagcugaaggguaaaaucuuucuuugcagagacaguauuuugcugaauacuuuuua

SEQ ID NO: 338810 - RNA, 64 nt, Human
ucucagauucuucacuggugagacaaugaaacaacagagacagugaaaguuuuaauaccuaagu

SEQ ID NO: 338811 - RNA, 64 nt, Human
cucugguuuccucagcaacacuccuuguaaggggcagagacaggguccaccaacuccccaagau

SEQ ID NO: 338812 - RNA, 64 nt, Human
uuucuucuuuuuuaaaauauucccacucagcacucagagacacaaaaauacuguaagucucaau

SEQ ID NO: 338813 - RNA, 64 nt, Human
ugguccccugaaauuuugacuuaguauauaggugcagagacacccacuuagaaaguuaacuguu

SEQ ID NO: 338814 - RNA, 64 nt, Human
guccaaucuuaucauuaguagauuuuauaagccacagagacaaaccagaaacggaauaauguua

SEQ ID NO: 338815 - RNA, 64 nt, Human
accaguggccgguugccacucuccuccccucccucagagacaccaaacugccaaaaacaagacg

SEQ ID NO: 338816 - RNA, 64 nt, Human
uuaaaugucgguccaggcccugugcaccuuaccccagagacagacucuuuuuguaagauuuugu

SEQ ID NO: 338817 - RNA, 62 nt, Human; identical to SEQ ID NO: 278438

SEQ ID NO: 338818 - RNA, 62 nt, Human; identical to SEQ ID NO: 278439

SEQ ID NO: 338819 - RNA, 62 nt, Human; identical to SEQ ID NO: 278440

SEQ ID NO: 338820 - RNA, 64 nt, Human
cugcucauaugcuuauuuaagcuuggacaguuuucagagacaaaccccauuaagaauuacucuu

SEQ ID NO: 338821 - RNA, 64 nt, Human
uugugaauuacauguuucaugaauccauuuggcacagagacacaaggaagaaaacacuaguaac

SEQ ID NO: 338822 - RNA, 64 nt, Human
ggauggaaggggcccuccacacuuccugggaggucagagacaaacuguuucagagagucagaug

SEQ ID NO: 338823 - RNA, 64 nt, Human
acccauucccugguugguccuacucccguguggccagagacauccuagcaaauccuuccuccua

SEQ ID NO: 338824 - RNA, 64 nt, Human
aacuuguugguaguuaggcacccaugaaugucuccagagacauccugagaggcaagauuccucu

SEQ ID NO: 338825 - RNA, 64 nt, Human
cuuggggagagaauaagugacagcugauuaaaggcagagacacaggacugcuuucaggcuccug

SEQ ID NO: 338826 - RNA, 64 nt, Human
acguguugucuaccaguacacaggcugcagaagacagagacagaagaaagagaucaagggcaga

SEQ ID NO: 338827 - RNA, 64 nt, Human
ucuaaauccguuuagaaucaucuauuuaacuccucagagacaugcacaaacuauucuagagagg

SEQ ID NO: 338828 - RNA, 64 nt, Human
acguuguaguaaacggcagcuuaagauaaguaagcagagacaguguuaaggacgaguugguguc

SEQ ID NO: 338829 - RNA, 64 nt, Human
aaccuucugacugguugugaucgaaacagguggacagagacaccugcacuuggaacuggacucc

SEQ ID NO: 338830 - RNA, 64 nt, Human
ccagucggaagggauucuggcuauugggggagcccagagacaggggaaggcagccuguccaucu

SEQ ID NO: 338831 - RNA, 64 nt, Human
gggaacuugauucaaaaauuugggauucauguagcagagacagagcuagacuguaaaggucaca

SEQ ID NO: 338832 - RNA, 64 nt, Human
gguaguacuucuugcugcaacaaacuucaacacacagagacagauucccauguaacaguccagu

SEQ ID NO: 338833 - RNA, 64 nt, Human
ugagugcuugcagucaagcagaauguaccuccugcagagacaaaucuucugcaugagauuacug

SEQ ID NO: 338834 - RNA, 64 nt, Human
ucuagguuacaugaggcaggaauaagaagucagacagagacagcaagacaguuaacaauguagg

SEQ ID NO: 338835 - RNA, 64 nt, Human
cagacacacaaucacacgcagccccuccccgccacagagacacaccauuacauacacagacaca

SEQ ID NO: 338836 - RNA, 62 nt, Human; identical to SEQ ID NO: 278431

SEQ ID NO: 338837 - RNA, 62 nt, Human; identical to SEQ ID NO: 278432

SEQ ID NO: 338838 - RNA, 62 nt, Human; identical to SEQ ID NO: 278447

SEQ ID NO: 338839 - RNA, 64 nt, Human
cagacacaaaaucacacacacacccuccccgccacagagacacaccauuacauacacagacacg

SEQ ID NO: 338840 - RNA, 64 nt, Human
cagacacaaaaucacacacacacccuccccgccacagagacaccauuacauacacagacacaca

SEQ ID NO: 338841 - RNA, 64 nt, Human
cccaccucaaaucacacacacccccuccccaccacagagacaccauuacauacacagacacaca

SEQ ID NO: 338842 - RNA, 64 nt, Human
gguaaaggcacagauguuuugagaacuuuauuugcagagacaccugagaaucgauggcucaguc

SEQ ID NO: 338843 - RNA, 64 nt, Human
cacgagagagauuggcuuuuuauuccagucuaggcagagacagaagaauguugaauaagagcac

SEQ ID NO: 338844 - RNA, 64 nt, Human
ugugguuacagcgccccucaguguucaucuccagcagagacaacggaggaggcucccaccagga

SEQ ID NO: 338845 - RNA, 64 nt, Human
uacucacagcccccgggcucuacccugggcacagcagagacagacuggugguugaaccuggagg

SEQ ID NO: 338846 - RNA, 64 nt, Human
uccuuuuugcccuucuccaaaaaauaaccuuccacagagacaaacuguccuucuauccacuuuu

SEQ ID NO: 338847 - RNA, 64 nt, Human
cacucuugguuuuagaguccaagaguaaguugugcagagacaugguucuaauuuggaguucaaa

SEQ ID NO: 338848 - RNA, 64 nt, Human
agcuuagccaaugugggagcagcgguuuggggagcagagacacuaacgacuucagggcagggcu

SEQ ID NO: 338849 - RNA, 64 nt, Human
ccaaacuugugacugcaucccucuggagucuacccagagacagagaaugugucuuuauguggga

SEQ ID NO: 338850 - RNA, 64 nt, Human
cagaaaucgcuugagugaggaaaaguccacauggcagagacagguaugguccaguuccucuuuu

SEQ ID NO: 338851 - RNA, 64 nt, Human
ucuuuuccaggaagcaugcuuaagcaucuuguuacagagacauacauccauuauggcuuggcaa

SEQ ID NO: 338852 - RNA, 64 nt, Human
guugaaaugaaauuuguagcaucugauacaaagccagagacauucuagcaagugcagcagcccc

SEQ ID NO: 338853 - RNA, 64 nt, Human
ccuuggcaaaauucuuucuggugucuccuaacuucagagacagggacucuuuuuggaucucuau

SEQ ID NO: 338854 - RNA, 64 nt, Human
uuguguuuacaucugcauuucuacauguuuuagacagagacaauuuaaggccugcacucuuauu

SEQ ID NO: 338855 - RNA, 62 nt, Human; identical to SEQ ID NO: 278529

SEQ ID NO: 338856 - RNA, 62 nt, Human; identical to SEQ ID NO: 278530

SEQ ID NO: 338857 - RNA, 62 nt, Human; identical to SEQ ID NO: 278531

SEQ ID NO: 338858 - RNA, 64 nt, Human
aggggaccacacaguagacuaucccuacucuaagcagagacaacugccacccagccugggccuu

SEQ ID NO: 338859 - RNA, 64 nt, Human
ugccuccacagcucgccacacacucacgcuucgccagagacaggaagugcgcugccuccacggc

SEQ ID NO: 338860 - RNA, 62 nt, Human
uggagcggcugauauccugaaucuugccccuccagagacaggaaagaauuugccuucucccu

SEQ ID NO: 338861 - RNA, 64 nt, Human
acagaaaaggcugccagcuguuuuaccagggauccagagacauagaggaaguagggggugguau

SEQ ID NO: 338862 - RNA, 64 nt, Human
ugaucaccaugaaagaagaauaguuuuuuguccccagagacauucauuuaguugauauaauccu

SEQ ID NO: 338863 - RNA, 64 nt, Human
cuuagcaucucagcagaaaccuugcucugaagaccagagacagaagggacagaaacaggagugc

SEQ ID NO: 338864 - RNA, 64 nt, Human
gaccccaccugaucugcaucuuuguuugcaucuccagagacaccugaggccccagagcuugagg

SEQ ID NO: 338865 - RNA, 64 nt, Human
gccuggccccagcccucagcugcugaccuugaggcagagacaacuucuaagaauuuggcugcca

SEQ ID NO: 338866 - RNA, 64 nt, Human
ccagcagcuuuagaaucccagcccccugaccacucagagacaugcagagauuggguuuuuggac

SEQ ID NO: 338867 - RNA, 64 nt, Human
gcuucagaaucugaacuuuggaaggguccacuaccagagacagaugaaaaaucacaguaagugc

SEQ ID NO: 338868 - RNA, 64 nt, Human
gcccccaggggaaaccuccagaggaacaagcugccagagacauuuaugcccccagcaccaauua

SEQ ID NO: 338869 - RNA, 64 nt, Human
gugaaaagaugcuguggcaguuccugaagcccgccagagacagcucaggugcaaggagaugaga

SEQ ID NO: 338870 - RNA, 64 nt, Human
uaaauguucugauuugcucucagcugcagagacacagagacacugcagaugucacacgcuuuca

SEQ ID NO: 338871 - RNA, 64 nt, Human
ggccucuguaaauguucugauuugcucucagcugcagagacacagagacacugcagaugucaca

SEQ ID NO: 338872 - RNA, 51 nt, Human
acuacuacacagcguucugagcagagacacgcagaccagcugaggaggaca

SEQ ID NO: 338873 - RNA, 64 nt, Human
gauuccugagaggccagagaggaaguuuguucaccagagacaggcuucagauggcuuugauuuc

SEQ ID NO: 338874 - RNA, 62 nt, Human; identical to SEQ ID NO: 278386

SEQ ID NO: 338875 - RNA, 62 nt, Human; identical to SEQ ID NO: 278387

SEQ ID NO: 338876 - RNA, 62 nt, Human; identical to SEQ ID NO: 278451

SEQ ID NO: 338877 - RNA, 64 nt, Human
cagccgaacccaagagcugguggcucugagcagacagagacaucuuggccugucccugccuggg

SEQ ID NO: 338878 - RNA, 64 nt, Human
aaaauuuuaaaaaacugguauuuuguaaaugugucagagacacaugggacagaacccuacuuuu

SEQ ID NO: 338879 - RNA, 64 nt, Human
gggcucuggcgcuccucucuggcugagguggaaacagagacacccugcggcaccagagccuucc

SEQ ID NO: 338880 - RNA, 64 nt, Human
ugcagugugguucgcccaguagucuuguggaugccagagacauccuuucugaauacuucuugau

SEQ ID NO: 338881 - RNA, 64 nt, Human
ucugaaaccaaacagcauccugccaugagcuucccagagacagaagagacuggagcaaagucgg

SEQ ID NO: 338882 - RNA, 64 nt, Human
agcaaugucauuucuagauggguuucuaauucugcagagacacccguuucagccacaucuaaaa

SEQ ID NO: 338883 - RNA, 64 nt, Human
ucccacacccuggaucucacucuccucuuaguaacagagacacuccugagguuggacuuccuug

SEQ ID NO: 338884 - RNA, 64 nt, Human
agaaagauuagauaaagagaaaauaaguauccaucagagacaguaucucuaggcuugggcaaga

SEQ ID NO: 338885 - RNA, 64 nt, Human
accaaggagcuggggcccaaggccaguccugccccagagacacuccaaguccgccaggggcaca

SEQ ID NO: 338886 - RNA, 64 nt, Human
gccaaggcugccuucaauuagaagcagccgcccacagagacaggcacugugugccuggcagcag

SEQ ID NO: 338887 - RNA, 64 nt, Human
ggagggagucugcuccugccgcccucugcccugccagagacagacccaugcgcugccugcccac

SEQ ID NO: 338888 - RNA, 64 nt, Human
gauuggggguggcccaggggaugcugcugaugugcagagacaucccuuuuuccggcacaugaau

SEQ ID NO: 338889 - RNA, 64 nt, Human
agaccauggcgugguauuuauugugcagcagauccagagacagaggcagccugucuuuucaguu

SEQ ID NO: 338890 - RNA, 64 nt, Human
uggguccugcccgccaauaaucacccccacgggucagagacaggcuccuugccggggucugggc

SEQ ID NO: 338891 - RNA, 64 nt, Human
uccuauacucacaucagacaugugaucauagucccagagacagaguugaggucucgaagaaaag

SEQ ID NO: 338892 - RNA, 64 nt, Human
aggacccucgacucacccccauguuucagugucacagagacauucuuugauaaggaaauggcac

SEQ ID NO: 338893 - RNA, 62 nt, Human; identical to SEQ ID NO: 278448

SEQ ID NO: 338894 - RNA, 62 nt, Human; identical to SEQ ID NO: 278449

SEQ ID NO: 338895 - RNA, 62 nt, Human; identical to SEQ ID NO: 278455

SEQ ID NO: 338896 - RNA, 64 nt, Human
guccuucacacucacacuacucuguuccucuucccagagacaucgauucacuucaaagagcugu

SEQ ID NO: 338897 - RNA, 64 nt, Human
ccugccuuuuuauuuucuuggguuauuuacaugucagagacauuuauaaaaagugaaaggauaa

SEQ ID NO: 338898 - RNA, 64 nt, Human
ucagaaaugacacugaaucccuguguugagucuacagagacaucuagacuuaaaauagaucauu

SEQ ID NO: 338899 - RNA, 64 nt, Human
ucuaguugucucccuaccacccuauacacacugacagagacagcaauaccccaccccccauauu

SEQ ID NO: 338900 - RNA, 64 nt, Human
uauugcugacuuuaaauauuuaucccacggcagacagagacauuuggugucuuuuuauaauucg

SEQ ID NO: 338901 - RNA, 64 nt, Human
cgaaugaucaaggggacccauaggaaaucuuguccagagacaagacuucgggaaggugucugga

SEQ ID NO: 338902 - RNA, 64 nt, Human
ugagcuggccucucuagcacaauuugcacuaaaucagagacaaaauauuucccauuugugccag

SEQ ID NO: 338903 - RNA, 51 nt, Human
uuugcuguauucacuucugaccagagacaaaucagaaauguguucacaugc

SEQ ID NO: 338904 - RNA, 64 nt, Human
uaugaucggccaucaagggaagaacuauugugcucagagacacuguugauaaaaacucaggcaa

SEQ ID NO: 338905 - RNA, 64 nt, Human
cuaggugguuuugacaaagaccaaaaucccaacucagagacacugcaugcgauuuuacuguucc

SEQ ID NO: 338906 - RNA, 64 nt, Human
ugaauuguuuucuuuaaagauguaaugucccuuucagagacagcugauacuucauuuaaaaaaa

SEQ ID NO: 338907 - RNA, 64 nt, Human
gaaaaagacaaacagaaauagacacacacaccagcagagacagaaacagcaauagccaggacuc

SEQ ID NO: 338908 - RNA, 64 nt, Human
uggaggucuacccuggacacuaagccaagugugucagagacagaagggagcuggggauuggcga

SEQ ID NO: 338909 - RNA, 64 nt, Human
guggcaauggcuucugagaucaggcacccggggccagagacauaugggccauaccccuuaaccc

SEQ ID NO: 338910 - RNA, 64 nt, Human
aaggcaaagagagaggcagaagagacagacgaggcagagacaaaacacugagaaagagacugaa

SEQ ID NO: 338911 - RNA, 64 nt, Human
uguguguguguaugagagagagagagagagacaacagagacagagagaggcagagaggcauaga

SEQ ID NO: 338912 - RNA, 62 nt, Human; identical to SEQ ID NO: 278462

SEQ ID NO: 338913 - RNA, 62 nt, Human; identical to SEQ ID NO: 278463

SEQ ID NO: 338914 - RNA, 62 nt, Human; identical to SEQ ID NO: 278464

SEQ ID NO: 338915 - RNA, 64 nt, Human
auuuccacaaacagaucaggaagcacuagguuggcagagacacuuugucuaguguauucucuuc

SEQ ID NO: 338916 - RNA, 64 nt, Human
gcaguucagccugcagcagaggagggcacggcagcagagacacgcacaugcacguaagcauguu

SEQ ID NO: 338917 - RNA, 64 nt, Human
ugggaucgucaccugguucgggacgggggaagggcagagacaagggauuucuuugauggacaag

SEQ ID NO: 338918 - RNA, 64 nt, Human
caugcaucagaaccaugauuuagauguaguuuugcagagacaaaaauccaugagugaauagcua

SEQ ID NO: 338919 - RNA, 64 nt, Human
caguggccuagcugguaccacaucuauucccauccagagacauucucuggcaaguguucucagc

SEQ ID NO: 338920 - RNA, 64 nt, Human
auacuuaaaauggaauaacuuuuugguugcaaaacagagacaugguucuauaaugcuucauguc

SEQ ID NO: 338921 - RNA, 64 nt, Human
gugccccaaaaugcaagauuuuccacaagauucccagagacaggaaaauccucuggcuggcuaa

SEQ ID NO: 338922 - RNA, 64 nt, Human
aacagacaggagaaaugcauccauuccucagggacagagacaccugcaccuccccccacugcag

SEQ ID NO: 338923 - RNA, 64 nt, Human
ugcuggucuaaauuaauccaucgcagugauccuccagagacagcgcucugcucauguccguagc

SEQ ID NO: 338924 - RNA, 64 nt, Human
caaaaguaucuauagacacagacacuugccuauacagagacauaaccacacacacucagaggau

SEQ ID NO: 338925 - RNA, 64 nt, Human
gcugacggccagggagaagcuccucuccccagcccagagacauacuugaagggccagagccagg

SEQ ID NO: 338926 - RNA, 64 nt, Human
uuaaguggguuugccccaucacuuaguucucaggcagagacaucuuugggccugucccugccca

SEQ ID NO: 338927 - RNA, 64 nt, Human
guguagagaaaugagagucuguaugauucuggaacagagacaucagaaggaaagacuggugaaa

SEQ ID NO: 338928 - RNA, 64 nt, Human
gccacagaagggcagcagcugcgucagccuaagacagagacauuugaacagggccuugaagggu

SEQ ID NO: 338929 - RNA, 64 nt, Human
ggcuucaucauggaacuccaggacggcuacagcacagagacaggggagaagggcgcccagcugu

SEQ ID NO: 338930 - RNA, 64 nt, Human
gcacuggaggugaagagagcguguuuuuaaaauacagagacaagcacgucaagguguuuucaca

SEQ ID NO: 338931 - RNA, 62 nt, Human; identical to SEQ ID NO: 278435

SEQ ID NO: 338932 - RNA, 62 nt, Human; identical to SEQ ID NO: 278436

SEQ ID NO: 338933 - RNA, 62 nt, Human; identical to SEQ ID NO: 278465

SEQ ID NO: 338934 - RNA, 64 nt, Human
gcuuuauuaugguccuuuacacuggagacagacacagagacacuguucagaagaugaacuaaac

SEQ ID NO: 338935 - RNA, 64 nt, Human
ugugaccagguuuguguuuucuuaaaauaaaaugcagagacauguuuuaagcugauaguugagg

SEQ ID NO: 338936 - RNA, 64 nt, Human
caccaccacgcccagcuaauuuuuguauuuuuagcagagacagggaggaaguuuuuauuuuuau

SEQ ID NO: 338937 - RNA, 64 nt, Human
aauaaauuaucaauuuguaauucagcauguuggucagagacacggucacugauucacacccagu

SEQ ID NO: 338938 - RNA, 64 nt, Human
gggcaugggagggagggagagguggggagggagacagagacagaaacagagagagacagagaca

SEQ ID NO: 338939 - RNA, 64 nt, Human
uggggagggagacagagacagaaacagagagagacagagacagagagagacugagggagagacu

SEQ ID NO: 338940 - RNA, 64 nt, Human
cgcgggaaggguaggaaaauggacuguuucugaccagagacacuuaccuaaauauccuggggac

SEQ ID NO: 338941 - RNA, 64 nt, Human
uuuaguuuugggauaaaauuuugguccuugggcacagagacauucacuauuaaugaaguaaccc

SEQ ID NO: 338942 - RNA, 64 nt, Human
gauggcuuugucccaucauagggggguguccccccagagacaaagcugcagagcacauuccaug

SEQ ID NO: 338943 - RNA, 64 nt, Human
gggcccgcgcggcccccgacacgccccuggggcgcagagacaccggguuggcuuggggcgcgcg

SEQ ID NO: 338944 - RNA, 64 nt, Human
aucagggcauuuagaaagagcuauguuucugucacagagacagcccuuuucucagaacuaccca

SEQ ID NO: 338945 - RNA, 64 nt, Human
auacauuuuuuauuuuuuaauuaguagcugcuaucagagacauuauagcacagugguuaugagc

SEQ ID NO: 338946 - RNA, 64 nt, Human
uugggggacucacucacuggugccaguucuaagucagagacaaaauuccacugucuguuccuuu

SEQ ID NO: 338947 - RNA, 64 nt, Human
ggacccaacccagccacugaagagagagucucugcagagacagggcuaccugggugguugaggg

SEQ ID NO: 338948 - RNA, 64 nt, Human
ugccguggacuucagcacccagacaagccaaaaacagagacagggaagaacucauuguugauca

SEQ ID NO: 338949 - RNA, 63 nt, Human
aagaccuuuuaaagcaauagaugauucucaagccagagacaaucuagcacuuuaaagaaacca

SEQ ID NO: 338950 - RNA, 62 nt, Human; identical to SEQ ID NO: 278347

SEQ ID NO: 338951 - RNA, 62 nt, Human; identical to SEQ ID NO: 278348

SEQ ID NO: 338952 - RNA, 62 nt, Human; identical to SEQ ID NO: 278349

SEQ ID NO: 338953 - RNA, 64 nt, Human
ucccacccggcugcauacccgggcagggcucccacagagacaaggagggcacaggugucugccc

SEQ ID NO: 338954 - RNA, 64 nt, Human
ucugagcuucuccuguacugugcaucgugagggccagagacaggaauguaaggauuggcaacug

SEQ ID NO: 338955 - RNA, 64 nt, Human
ccgccaccugccggccucgagaggggccgaugcccagagacacagcccccacggacaaaacccc

SEQ ID NO: 338956 - RNA, 64 nt, Human
gugagucuucucgaaggaggguugacucagaacccagagacaauacaaaaccccucacuuccuc

SEQ ID NO: 338957 - RNA, 64 nt, Human
acucaucccuuaacuucucccuuaccagugaccccagagacagagccaggacaggagugggggc

SEQ ID NO: 338958 - RNA, 64 nt, Human
cagcccucguucugccagcuggagccaagaagcacagagacacagaggcgccugccccucagcu

SEQ ID NO: 338959 - RNA, 64 nt, Human
cgucccagccagccccgucgcucucguccauccucagagacaaagaagagggcagggaguuugg

SEQ ID NO: 338960 - RNA, 64 nt, Human
ggugcuguaacaaagacccaugugaugcugggggcagagacagaggagaagcuguuugaugccc

SEQ ID NO: 338961 - RNA, 64 nt, Human
ugaagaagaaaaggugcuuacccuggagaugcuacagagacacaguggaauagaccuugacacu

SEQ ID NO: 338962 - RNA, 64 nt, Human
auuuuuuuuuuuuuuuuguaaguuaaaaaaacuacagagacacuaaaggugaaaauggaugaga

SEQ ID NO: 338963 - RNA, 64 nt, Human
aguagaaauguauggguagucuaaccacuuuuaucagagacagagcagggcuguggucucacuc

SEQ ID NO: 338964 - RNA, 64 nt, Human
uucuucugcccccuaagugauagguuuaaacacacagagacacacacacacguuuccaaagugc

SEQ ID NO: 338965 - RNA, 64 nt, Human
ugccccuacccuggacuugccucugcacacccuccagagacaacagguaaaacagggccacaua

SEQ ID NO: 338966 - RNA, 64 nt, Human
aacauccccucaggcugaagccccccacccccaccagagacacacugggaaccgucagagucag

SEQ ID NO: 338967 - RNA, 64 nt, Human
gcggacaugcccucgcauugcuucccgcagagugcagagacaggaagcuggagaugucuuuaua

SEQ ID NO: 338968 - RNA, 64 nt, Human
gaccagaugcuggugugguccgaagccacuuucucagagacacuuuaaucauugaguauuugua

SEQ ID NO: 338969 - RNA, 62 nt, Human; identical to SEQ ID NO: 278352

SEQ ID NO: 338970 - RNA, 62 nt, Human; identical to SEQ ID NO: 278353

SEQ ID NO: 338971 - RNA, 62 nt, Human; identical to SEQ ID NO: 278354

SEQ ID NO: 338972 - RNA, 64 nt, Human
agccugaagacagaggauaaauaguugucaaugucagagacagugcuauuaauguauaugugag

SEQ ID NO: 338973 - RNA, 64 nt, Human
uguccagagcuggccaggccacugggcccugagccagagacaaggucaccugggcugugaugug

SEQ ID NO: 338974 - RNA, 64 nt, Human
ucacuugaacccgggagguggaggcugcagugaacagagacagugccacugcacaucagccuga

SEQ ID NO: 338975 - RNA, 64 nt, Human
ggcaggaggacgcaucccaaucgggagggagagacagagacagagccgauggggccagagcagg

SEQ ID NO: 338976 - RNA, 64 nt, Human
ugccagggagccagaaggaagggccuugcagccacagagacacuccacugcccuggggcacaca

SEQ ID NO: 338977 - RNA, 64 nt, Human
cugucccccgacauugaagagaucucauucaggccagagacacagagaccacauagcccaguga

SEQ ID NO: 338978 - RNA, 64 nt, Human
ugugaacauuuuaugcuucgacuuuuuuuuucuucagagacagggugucguucugucgcccagg

SEQ ID NO: 338979 - RNA, 64 nt, Human
caccgcaucaguccccaucaucacuacuccuccccagagacauacagauugcccuccccggcau

SEQ ID NO: 338980 - RNA, 64 nt, Human
cagaacaggugacacagagcaggggcuucagccacagagacacacucaggaggccagaagccga

SEQ ID NO: 338981 - RNA, 64 nt, Human
gggagaucaccuucagagacuaucagaugagauacagagacaacaccccccuuguucucgacag

SEQ ID NO: 338982 - RNA, 64 nt, Human
gccgcugguagacuuuuguuaaaagagagagagacagagacagagaaauaagcauuagagaccu

SEQ ID NO: 338983 - RNA, 64 nt, Human
caggucaccaaguaaugucccuggugcgaggaaacagagacaaccuuucugucuucagccucug

SEQ ID NO: 338984 - RNA, 64 nt, Human
gcagacaaagcccuguccuucagucuucuagaaacagagacaagaaaggcagacacaccgcggc

SEQ ID NO: 338985 - RNA, 64 nt, Human
ucugucggggaagaauccggucacagccuccccucagagacaggccucaguucgagggcagccc

SEQ ID NO: 338986 - RNA, 64 nt, Human
ggagcucagcagugacuggggagcuggucugccucagagacagaguagggggugggagcagagc

SEQ ID NO: 338987 - RNA, 64 nt, Human
uuaaccugacuuuauagggacugaaguccaccuccagagacaaguccaaguucuugauccaccc

SEQ ID NO: 338988 - RNA, 62 nt, Human; identical to SEQ ID NO: 278355

SEQ ID NO: 338989 - RNA, 62 nt, Human; identical to SEQ ID NO: 278356

SEQ ID NO: 338990 - RNA, 62 nt, Human; identical to SEQ ID NO: 278362

SEQ ID NO: 338991 - RNA, 64 nt, Human
gucucagaugaccacggguuuaaccuucuuaucccagagacacccaauucuagagcuuuaugga

SEQ ID NO: 338992 - RNA, 64 nt, Human
cagugccucgcaugauaccagaggaggcgagggacagagacagcaaggcagacaguggcuggca

SEQ ID NO: 338993 - RNA, 64 nt, Human
cucucauguauguuaucuacagagaggaucauuacagagacagacucucccgagacaugggcca

SEQ ID NO: 338994 - RNA, 64 nt, Human
gagaacgaaucgauguaagauuccuccuuuagggcagagacagaccacugacaaauacacagau

SEQ ID NO: 338995 - RNA, 64 nt, Human
ggcuuccagggagaccuccccgcccagcagcccccagagacacaacaaccuaccuuccagccuu

SEQ ID NO: 338996 - RNA, 56 nt, Human
augaccuggaacugaacugagcugcucagagacaggaagucuucagggaaggucac

SEQ ID NO: 338997 - RNA, 56 nt, Human; identical to SEQ ID NO: 338996

SEQ ID NO: 338998 - RNA, 64 nt, Human
gccugagcccccugaguucccaaagggaggguggcagagacagugggcacuaaggguggagagu

SEQ ID NO: 338999 - RNA, 64 nt, Human
uucggcauugguucccuuugcuccaccccacucacagagacacagggcauccaacugagaaaac

SEQ ID NO: 339000 - RNA, 64 nt, Human
uggucuggggcauuuuccucuccuuaucuugccccagagacaauucaagauuucuauauggggu

SEQ ID NO: 339001 - RNA, 64 nt, Human
guccuugggcccaguugggagcucauaucuaacacagagacacauugcaucaacuucaagaaag

SEQ ID NO: 339002 - RNA, 64 nt, Human
ggguuagggaugucuccacccugauggggugucccagagacauuuucccauggcaguccuccuc

SEQ ID NO: 339003 - RNA, 64 nt, Human
guggcuguggagagggucaaggaguacuccaagacagagacagagguggguacuggcaugagcc

SEQ ID NO: 339004 - RNA, 64 nt, Human
uugguauuaaguccaucuuguguugguacauuggcagagacauaugcuuuaaaaacuuaaauau

SEQ ID NO: 339005 - RNA, 64 nt, Human
ugucuuacgauggacagugauaaaggugaacacacagagacagacuauucucuaagaaugugag

SEQ ID NO: 339006 - RNA, 64 nt, Human
caugaguguccugcuuacauguagcuucagacugcagagacaggacgugugcuuuucauuucaa

SEQ ID NO: 339007 - RNA, 62 nt, Human; identical to SEQ ID NO: 278467

SEQ ID NO: 339008 - RNA, 62 nt, Human; identical to SEQ ID NO: 278468

SEQ ID NO: 339009 - RNA, 62 nt, Human; identical to SEQ ID NO: 278469

SEQ ID NO: 339010 - RNA, 64 nt, Human
augaaacgccacugggagugaggaagccagacuccagagacacggagaagaucaaacuggagcu

SEQ ID NO: 339011 - RNA, 64 nt, Human
uggguggauggaacccugccuggucacauuuggccagagacacaccuggcccucagggggcuga

SEQ ID NO: 339012 - RNA, 64 nt, Human
accugggaugagaaacgacagguggaagguuguccagagacaccuacagcguggaugcuguucc

SEQ ID NO: 339013 - RNA, 64 nt, Human
uauaaaacaagaaaucagcaagccugcuuaccuccagagacacaccguuccacuuacaguaucu

SEQ ID NO: 339014 - RNA, 64 nt, Human
uccuuaccaagaaugaguuccugaaacccagggccagagacaaggacaacuuaggggaagacgg

SEQ ID NO: 339015 - RNA, 64 nt, Human
caaggguugaaggaagggagccauccuuacuguucagagacagcaacucccucccguaacucag

SEQ ID NO: 339016 - RNA, 64 nt, Human
uuccucuaauccagcaaagugauucccugcacaccagagacaagcagaguaacaggaucagugg

SEQ ID NO: 339017 - RNA, 64 nt, Human
ccucuaggucugggcagccaugaccugcagggcccagagacacuguccuuccccucauccaccc

SEQ ID NO: 339018 - RNA, 64 nt, Human
cuccugccaaauuaugcauuaguaacuuuuuccucagagacaccccuaaaggcucccauuaggu

SEQ ID NO: 339019 - RNA, 64 nt, Human
ugagugacccagaagggguggcgaaggcacagcucagagacauaaagagaagaugccaaggccc

SEQ ID NO: 339020 - RNA, 64 nt, Human
gggcagaucuccaagcgccuggagugcuuuuuagcagagacaccucguuaagcuccgggaugac

SEQ ID NO: 339021 - RNA, 64 nt, Human
ucggaaaguaaaugcuucaaaaggaaggaaaugacagagacacacgcccuugcccaccuuccuc

SEQ ID NO: 339022 - RNA, 64 nt, Human
gcuuuaugaauuaacagucuguucuuccagaguccagagacauuguuaauaaagacaaugaauc

SEQ ID NO: 339023 - RNA, 64 nt, Human
ggcuggaggagcccaggccaggacucugcagccucagagacaucagcccuuggggguccuccuc

SEQ ID NO: 339024 - RNA, 64 nt, Human
ccuagucuguccugcguccucuguccccggguuucagagacaacuucccaaagcacaaagcagu

SEQ ID NO: 339025 - RNA, 64 nt, Human
caucauuuuuauaggguaggacaguucuuuguuacagagacauaacgauacuguacucuccaca

SEQ ID NO: 339026 - RNA, 62 nt, Human; identical to SEQ ID NO: 278366

SEQ ID NO: 339027 - RNA, 62 nt, Human; identical to SEQ ID NO: 278367

SEQ ID NO: 339028 - RNA, 62 nt, Human; identical to SEQ ID NO: 278368

SEQ ID NO: 339029 - RNA, 64 nt, Human
gaaggggacggccggcgggggcucuccuagugcccagagacaggcccagagguuuacaaguuuu

SEQ ID NO: 339030 - RNA, 64 nt, Human
gcagccagacagcgucgccaggcaaugaggaaagcagagacaggagaggaaggccucacucacc

SEQ ID NO: 339031 - RNA, 64 nt, Human
ucauguuaaugagcuuuucuuugcucgagguguucagagacaaguccugugucuaccugcguca

SEQ ID NO: 339032 - RNA, 64 nt, Human
aggaccggcucauggcguuggucacuggcaggcucagagacauucugcugugggcgcagggagc

SEQ ID NO: 339033 - RNA, 64 nt, Human
auguaccugauuuuucaugagccuuacagacacacagagacacauacacauugaucuuaaaauu

SEQ ID NO: 339034 - RNA, 64 nt, Human
guuuucaccucauaugcuauguuagaaguccaggcagagacaauaaaacauuccugugaaaggc

SEQ ID NO: 339035 - RNA, 64 nt, Human
uacugcaauuugacaccauuugaaauaaucaauucagagacacuaaagauuucacaauauucau

SEQ ID NO: 339036 - RNA, 64 nt, Human
gacagcugaggaaaggcaauuaggcccagagaggcagagacacucgcuuaagaucacaggcuua

SEQ ID NO: 339037 - RNA, 64 nt, Human
gccacgcccagcuuccuccccccgacuccccccccagagacacggucccaccauguuacccagc

SEQ ID NO: 339038 - RNA, 64 nt, Human
cuaucuuuuguaggaaauaguggggcacacuacucagagacauuauuuagcaguaaagaaagac

SEQ ID NO: 339039 - RNA, 64 nt, Human
ugauuucagccauuuuccuagugcuugucggaugcagagacaauguugaaauccccuaaacaca

SEQ ID NO: 339040 - RNA, 64 nt, Human
auaguucuuuuaacaauuugaccucucuccaaaacagagacacauauaaguagugcucauccau

SEQ ID NO: 339041 - RNA, 64 nt, Human
cuaagaugaguaauauuuuuuccaguagguuccacagagacaccuugggggcuggcuuagggga

SEQ ID NO: 339042 - RNA, 64 nt, Human
uuugguuugaauuauuaguacuauccuguagacccagagacauaguuuauauaagaauugcuaa

SEQ ID NO: 339043 - RNA, 64 nt, Human
uuuugcuggucacugccauggaggcacacagcugcagagacagagaggacgugggcggcagaga

SEQ ID NO: 339044 - RNA, 64 nt, Human
uggcccauguggagcuggcaugggggacacagcccagagacagagaagcuuaugaggaagugag

SEQ ID NO: 339045 - RNA, 62 nt, Human; identical to SEQ ID NO: 278344

SEQ ID NO: 339046 - RNA, 62 nt, Human; identical to SEQ ID NO: 278345

SEQ ID NO: 339047 - RNA, 62 nt, Human; identical to SEQ ID NO: 278350

SEQ ID NO: 339048 - RNA, 64 nt, Human
cucccuccaacugucccuggagccagaacacucacagagacaccccugagaggguggccacagc

SEQ ID NO: 339049 - RNA, 64 nt, Human
aucugggagccagcagcuggaugcuguggcuggccagagacaccuccaggcuguggccuggggg

SEQ ID NO: 339050 - RNA, 64 nt, Human
gccagggcgccgggccccacuucugagcacagagcagagacagacgcaggcggggacaaaggca

SEQ ID NO: 339051 - RNA, 64 nt, Human
ucugucuccaaaaaaaagagaagaggagaggacacagagacacacagagaagaaagccaugugg

SEQ ID NO: 339052 - RNA, 64 nt, Human
cagggugcuguauucaggaaacccaucucacgugcagagacacacauaggcucaaaauaaaagg

SEQ ID NO: 339053 - RNA, 64 nt, Human
augaggccagcaucuuccuguuaccaaagcugggcagagacaaaaccaaaaaagagaauuuuag

SEQ ID NO: 339054 - RNA, 64 nt, Human
ugccacaauccucgggguguggucaaggggcacucagagacaccugcacuagaaauugcauuga

SEQ ID NO: 339055 - RNA, 64 nt, Human
agaaaguucccauugcucaauaaauguggaucaucagagacauuuaugaacaaugacagaagaa

SEQ ID NO: 339056 - RNA, 64 nt, Human
aguuuauuuuuuaaaaauacuuauauaauacaugcagagacaagauacacaaugauuauaagua

SEQ ID NO: 339057 - RNA, 64 nt, Human
uuaucauuguaaucaaugugggaaagcuuucagucagagacaaaaucuucuugagcaugaaaaa

SEQ ID NO: 339058 - RNA, 62 nt, Human
ggcgggcaguuuaugugugaccuggacacagacagagacagagccaggcccggcccucccgc

SEQ ID NO: 339059 - RNA, 64 nt, Human
caugccuacuccaugccaggcccagugcuggacacagagacaugaagcucugucugugggagac

SEQ ID NO: 339060 - RNA, 64 nt, Human
aucauuuuuagagggaggaaucaguguuggauugcagagacauuuucuggagugauccaugaag

SEQ ID NO: 339061 - RNA, 64 nt, Human
ucugcuacucacacacacccucaugugugaagggcagagacacugucacaaacaggcaugcccc

SEQ ID NO: 339062 - RNA, 64 nt, Human
uggggggugcuccuggccuggaguggguggaggccagagacacugcucagcagcacccugcagu

SEQ ID NO: 339063 - RNA, 64 nt, Human
gccuggaacagagccugcgggaaacggggcuugccagagacacucacaguuuccuucauggccu

SEQ ID NO: 339064 - RNA, 62 nt, Human; identical to SEQ ID NO: 278363

SEQ ID NO: 339065 - RNA, 62 nt, Human; identical to SEQ ID NO: 278364

SEQ ID NO: 339066 - RNA, 62 nt, Human; identical to SEQ ID NO: 278371

SEQ ID NO: 339067 - RNA, 64 nt, Human
ggcgggcgggccgccagagcagcuuuuuacaauccagagacagaaaacaaaaucuagaugcaac

SEQ ID NO: 339068 - RNA, 64 nt, Human
cuucaacauucauaauggccaggagaccacacaacagagacauuuaaugagagggguuucacga

SEQ ID NO: 339069 - RNA, 64 nt, Human
ccaugaucaugccauuguacuccagcaugggugacagagacagauaguguaucgaaaaaugaau

SEQ ID NO: 339070 - RNA, 64 nt, Human
gcaauuucuagagggaggaauggguguuugagugcagagacacuggucuggggugauccaugga

SEQ ID NO: 339071 - RNA, 64 nt, Human
agccacacuguuaagucugcucauuggggaacuccagagacaacuuaggaugagggcagaaaag

SEQ ID NO: 339072 - RNA, 64 nt, Human
gcaacuuaaaggagggccugcaagcagccagggucagagacagggcuugguucugcuuccuggu

SEQ ID NO: 339073 - RNA, 64 nt, Human
uggcuuguaaaccuucgucucccucucuuuuacccagagacagcacauacgugugcacacgcau

SEQ ID NO: 339074 - RNA, 64 nt, Human
agaauucuuuggcgggaaggguaugauggguucccagagacaagaagcccaaccuucuggccug

SEQ ID NO: 339075 - RNA, 64 nt, Human
gaggauccauucagccugcccagcucuggcuggucagagacaaggcagaacuuuuggaaaaaca

SEQ ID NO: 339076 - RNA, 64 nt, Human
ucuuggauggaacccuuucccguauuaaacaaaccagagacagaaucagugcugacucaggauc

SEQ ID NO: 339077 - RNA, 64 nt, Human
uuggaaggguucuuugaaauagcagcaguugaaacagagacacuuugccacaguguggagcaga

SEQ ID NO: 339078 - RNA, 64 nt, Human
cucacacacacacacacacacacacacacacacacagagacacggcaccauucugccuggggca

SEQ ID NO: 339079 - RNA, 64 nt, Human
gguccucugccuagaaacacaaggcaagcaacaucagagacagaaucuugcuauguugugcggc

SEQ ID NO: 339080 - RNA, 64 nt, Human
ugggggcaaaacccugaauccagccagucgugcacagagacacacccacacuagcccaguggca

SEQ ID NO: 339081 - RNA, 64 nt, Human
cugucuaggguuuuaccauugaaggguggaagaacagagacaaagaggagcucuuuuucuguga

SEQ ID NO: 339082 - RNA, 64 nt, Human
augaaccaggauuuaaaccgguuuuuucucacuacagagacaauauuuuuccaccauuguaucu

SEQ ID NO: 339083 - RNA, 62 nt, Human; identical to SEQ ID NO: 278334

SEQ ID NO: 339084 - RNA, 62 nt, Human; identical to SEQ ID NO: 278335

SEQ ID NO: 339085 - RNA, 62 nt, Human; identical to SEQ ID NO: 278372

SEQ ID NO: 339086 - RNA, 64 nt, Human
gggcaggcaguggccuugucacuguaucuugcaucagagacaaaggaggacccgcuuuagcccu

SEQ ID NO: 339087 - RNA, 64 nt, Human
aggugggcgggggcuagggggagccugggugcagcagagacagaggaagcagagccaggugccg

SEQ ID NO: 339088 - RNA, 64 nt, Human
ccuccccgcguggguaaccaaauuuuuaaguagucagagacauaucgagguaguuacauaaaau

SEQ ID NO: 339089 - RNA, 64 nt, Human
guaaagcugagaaaggaccagauugaccaagcgccagagacaaaauguggcacaacgagaaccc

SEQ ID NO: 339090 - RNA, 64 nt, Human
uuagcaauuuucauuuuauuucucauaauuugaacagagacaguucucauacaugaucagaugc

SEQ ID NO: 339091 - RNA, 64 nt, Human
cccggcaaaugcgcacgaccuacauuaauuuaugcagagacagcuguuugaauuggaccccgcc

SEQ ID NO: 339092 - RNA, 64 nt, Human
uccacuccuucaguccucauuugcucaucaaccucagagacacugcuuuccaacuuaccucgag

SEQ ID NO: 339093 - RNA, 64 nt, Human
ccuuucuccuguuuauggguuucuuccagcagaacagagacauugccaaccauauuggaucugc

SEQ ID NO: 339094 - RNA, 64 nt, Human
acccguguccucagagcaccacacacugagcacccagagacagcgggccuggcagcgggccggg

SEQ ID NO: 339095 - RNA, 57 nt, Human
gucuuccaaugccaaucugaggaccuucagagacagucuacgccuuaacaagcacau

SEQ ID NO: 339096 - RNA, 56 nt, Human
ucagccggaagagaaaaugaagaccccagagacauuuauuggggaguaggaugugg

SEQ ID NO: 339097 - RNA, 64 nt, Human
gugucauccuaaguaccuugaaaugagaccacgucagagacauguacugccccucacauuuucu

SEQ ID NO: 339098 - RNA, 64 nt, Human
acagagcugccuggcacaggucccagccccucugcagagacacaauaaaagccagcagacccuu

SEQ ID NO: 339099 - RNA, 64 nt, Human
ggggucgcuugugcgggcgggagggcaaugguggcagagacaugcugguggccccggcggagcg

SEQ ID NO: 339100 - RNA, 64 nt, Human
cccuggcccaugcacacccgucuuuccaugauggcagagacauccagucaggaccugacccguc

SEQ ID NO: 339101 - RNA, 64 nt, Human
ggcugcugaugucuagaugaguccccuguagggucagagacaaugucaaacuguguaagugaag

SEQ ID NO: 339102 - RNA, 62 nt, Human; identical to SEQ ID NO: 278378

SEQ ID NO: 339103 - RNA, 62 nt, Human; identical to SEQ ID NO: 278379

SEQ ID NO: 339104 - RNA, 62 nt, Human; identical to SEQ ID NO: 278380

SEQ ID NO: 339105 - RNA, 64 nt, Human
ggaggugacgaggcaggggcuccaggaaaggaaucagagacaauucacagagccucccucccug

SEQ ID NO: 339106 - RNA, 64 nt, Human
cccgucucaucagggagagaaaggaggacagccacagagacacaugucuuacuuucagaauuuc

SEQ ID NO: 339107 - RNA, 64 nt, Human
agggugucucagaggcugcaauguagguguucaccagagacauaggcaucacuggggucacacu

SEQ ID NO: 339108 - RNA, 64 nt, Human
aagagaagacuuuaagagaugagggagagagagccagagacaguguugcaacugggccuggcau

SEQ ID NO: 339109 - RNA, 64 nt, Human
uauuuugugcaaugaagcccugcucccagccuuucagagacagggacacagccccuauuuggaa

SEQ ID NO: 339110 - RNA, 64 nt, Human
uucuuaaaauauauaugaauuuguguaacacacacagagacacacacacauacuacuuuaaggg

SEQ ID NO: 339111 - RNA, 64 nt, Human
uucccuaacuguggaguuuuaggaagucaguugucagagacagguggggaggguggggguaggg

SEQ ID NO: 339112 - RNA, 64 nt, Human
ccucugcauuuacacacacacacacacacacacacagagacacacacacacaccaaguaccagu

SEQ ID NO: 339113 - RNA, 64 nt, Human
cagagcauccauggccaauuucaaauugugaacccagagacacucccauccacccuucuccaug

SEQ ID NO: 339114 - RNA, 64 nt, Human
cagggggguggcuggggcugggccaucaccauuccagagacaaggccaguguauaugcaaacug

SEQ ID NO: 339115 - RNA, 64 nt, Human
uugaguuguucauggggccuugauguuggggaaacagagacaaauucaguugugaaaaguauua

SEQ ID NO: 339116 - RNA, 64 nt, Human
aaccaaagacgcuuggcagaacccuguuccuuuccagagacagagcuguguaccuugucuaaaa

SEQ ID NO: 339117 - RNA, 64 nt, Human
aaaccaucuccuccuugccggcucccccuccagccagagacagaggauguggccugguucaaag

SEQ ID NO: 339118 - RNA, 64 nt, Human
cugcagcagcuccagcuuccaguugccuuagggacagagacaaaggaaaugaagagaccucaga

SEQ ID NO: 339119 - RNA, 64 nt, Human
guacuauuuugaacuuuccagaacccucucacaccagagacaguucuucucuguucaguuucca

SEQ ID NO: 339120 - RNA, 64 nt, Human
caaauaggucagcuccaccuggagugcgaauugccagagacaccuugguagugcccaucggcaa

SEQ ID NO: 339121 - RNA, 62 nt, Human; identical to SEQ ID NO: 278381

SEQ ID NO: 339122 - RNA, 62 nt, Human; identical to SEQ ID NO: 278382

SEQ ID NO: 339123 - RNA, 62 nt, Human; identical to SEQ ID NO: 278456

SEQ ID NO: 339124 - RNA, 64 nt, Human
uggugcccuugacuuuauaguggcacaaacgcuucagagacacacaauuauaagagacuuaucu

SEQ ID NO: 339125 - RNA, 61 nt, Human
ggcccagcugccuuuggcuuugaucucaagucaggcugaaggcagcgaagccucggggccc

SEQ ID NO: 339126 - RNA, 61 nt, Human
guggugcacaccuguagucccagcuauucuccaggcugaggugggaggaucgcuugagccc

SEQ ID NO: 339127 - RNA, 57 nt, Human
agccccuccuccccagcugaccagaaccaggcugagcgcaggaggacaggcaccacc

SEQ ID NO: 339128 - RNA, 61 nt, Human
uuuaguaaagaugggguuucaccauguuggccaggcugaucucaaacuccugaccucaagu

SEQ ID NO: 339129 - RNA, 61 nt, Human
uuuaguagagaugggguuucaccauauuggucaggcugaucuggaacuucugaccucaggu

SEQ ID NO: 339130 - RNA, 61 nt, Human
aggugaggcuuccagcugggaccugcccagacaggcugagccugggcgugguggguggggu

SEQ ID NO: 339131 - RNA, 62 nt, Human; identical to SEQ ID NO: 278327

SEQ ID NO: 339132 - RNA, 62 nt, Human; identical to SEQ ID NO: 278328

SEQ ID NO: 339133 - RNA, 62 nt, Human; identical to SEQ ID NO: 278384

SEQ ID NO: 339134 - RNA, 62 nt, Human; identical to SEQ ID NO: 278385

SEQ ID NO: 339135 - RNA, 61 nt, Human
gccaaccugcccccuccccacaccaaucagccaggcugagcccccaccccugccccagcuc

SEQ ID NO: 339136 - RNA, 61 nt, Human
cacagcuaccugccuucacugaaauauaccucaggcugaaauuuggggugggauagcaggu

SEQ ID NO: 339137 - RNA, 61 nt, Human
ugaacaggugaaugaagaaggaagaggauuccaggcugagagcacuggacguggcaacugu

SEQ ID NO: 339138 - RNA, 61 nt, Human
guuagacucuguaugugugauuuguaaaaagcaggcugaaacuauggacaugauuucugaa

SEQ ID NO: 339139 - RNA, 61 nt, Human
cagcuuugcccacacauacccagcagcuccccaggcugaaagcagcccuggcccagggucu

SEQ ID NO: 339140 - RNA, 61 nt, Human
cugccaagacgcccucucguccaacuaugcccaggcugaaguccucacccucucuuaaagc

SEQ ID NO: 339141 - RNA, 61 nt, Human
caguucucucagugcaggcaguucuuccucucaggcugaagaucaaggagaugcuuuguac

SEQ ID NO: 339142 - RNA, 61 nt, Human
ggggacuggcauggggggaucucagagcuuacaggcugagccaagcccacggccaugcaca

SEQ ID NO: 339143 - RNA, 61 nt, Human
uaugaucaaauccucaagccagcugggggcccaggcugaagaccuggggacaggucgauug

SEQ ID NO: 339144 - RNA, 61 nt, Human
gguguaugccacaccuggccuuaaagagggacaggcugaagagagggacaggcacuccaaa

SEQ ID NO: 339145 - RNA, 61 nt, Human
agccccuucuccaucccuguccugugccccccaggcugauugggagggagggcaccuggaa

SEQ ID NO: 339146 - RNA, 61 nt, Human
gguuuuaugugugggaaagggacccgaagcccaggcugaagaguuuaacuuugggcccaga

SEQ ID NO: 339147 - RNA, 61 nt, Human
ggcaggaacugcaguauggccaugggcugagcaggcugagcaccucagccuuuagggcuua

SEQ ID NO: 339148 - RNA, 61 nt, Human
ggggcgacagggucugucuuguucugucucccaggcugaagugcagugcagugguaugauc

SEQ ID NO: 339149 - RNA, 61 nt, Human
cagauaugcagagucacccugacacuggugccaggcugaccucagcucccgaaggcucgca

SEQ ID NO: 339150 - RNA, 61 nt, Human
ucguguagcuucagaaguucccucucugacccaggcugaguccauacugccccugauccca

SEQ ID NO: 339151 - RNA, 62 nt, Human; identical to SEQ ID NO: 278303

SEQ ID NO: 339152 - RNA, 62 nt, Human; identical to SEQ ID NO: 278304

SEQ ID NO: 339153 - RNA, 62 nt, Human; identical to SEQ ID NO: 278369

SEQ ID NO: 339154 - RNA, 61 nt, Human
agauucuuaagcaagagaagaguuggacuuccaggcugaaggggagaaagugacucuguuc

SEQ ID NO: 339155 - RNA, 61 nt, Human
agcugggacuccuauugagacagcugcaaaacaggcugauuucaauuaggcagcacuuccc

SEQ ID NO: 339156 - RNA, 61 nt, Human
uugccuuguagauuccucuggugcuggucuccaggcugacaaggauucaaaguugucucug

SEQ ID NO: 339157 - RNA, 61 nt, Human
caugaaaagauucuauggacugaaaaagccccaggcugaaaggacuggacugccuugauug

SEQ ID NO: 339158 - RNA, 61 nt, Human
uuccaggcugcagccguaacgcacuuucucccaggcugagggcggguguucuggggugucu

SEQ ID NO: 339159 - RNA, 61 nt, Human
gggucaaagggcuacuuucuggaagucuccccaggcugacuccuucucccugacugcaagg

SEQ ID NO: 339160 - RNA, 61 nt, Human
cagccugcccccgacucuaccuccucacagacaggcugacagccccucugccugcacaggg

SEQ ID NO: 339161 - RNA, 61 nt, Human
uggggguggggggugccuggcagccaugaagcaggcugaaaggcagaggggcuccaggucc

SEQ ID NO: 339162 - RNA, 61 nt, Human
cgaggagacuaacuugcuuucucccugcaugcaggcugagauuguuucuggaaggggcugg

SEQ ID NO: 339163 - RNA, 61 nt, Human
ggucuggggcgaggccaggggccaucaaaaacaggcugaucaccaaagucagugucacccu

SEQ ID NO: 339164 - RNA, 61 nt, Human
cugcugcuuugcucuuucaaaacagaaccuccaggcugacgaggcaagacaaagccuccca

SEQ ID NO: 339165 - RNA, 61 nt, Human
uuuaguagagaugggguuucgcuauguuggccaggcugaucucaaacuucugaccucaggu

SEQ ID NO: 339166 - RNA, 61 nt, Human
gacaggguacaaacuuagcuggaagucugcccaggcugaaugaucucuucccuagaguuga

SEQ ID NO: 339167 - RNA, 61 nt, Human
guguguguguguguaaccucaugguugugcucaggcugacagggagggcaaagagugaaaa

SEQ ID NO: 339168 - RNA, 61 nt, Human
ugccuucccauauacccucuucugacuuucacaggcugagcuggagguuuuccuguggggg

SEQ ID NO: 339169 - RNA, 61 nt, Human
ugaguucccagauacccucuucuggcuuucacaggcugagcuagggguuuuccuguggaag

SEQ ID NO: 339170 - RNA, 62 nt, Human; identical to SEQ ID NO: 278271

SEQ ID NO: 339171 - RNA, 62 nt, Human; identical to SEQ ID NO: 278276

SEQ ID NO: 339172 - RNA, 62 nt, Human; identical to SEQ ID NO: 278277

SEQ ID NO: 339173 - RNA, 61 nt, Human
gagggucugagaggggagaugcaugcguguccaggcugaagaugccccuauauucugucaa

SEQ ID NO: 339174 - RNA, 61 nt, Human
uuccacugugucucugccagaauguuuguaucaggcugaugcuggcuucauagaaugaguu

SEQ ID NO: 339175 - RNA, 61 nt, Human
cucuaggugcugagcccucaccucccuguuccaggcugagaacucaaaugguuacccugcu

SEQ ID NO: 339176 - RNA, 61 nt, Human
agaaggagaugcucagggcuccuggggggagcaggcugaagggagagccagccagccaggg

SEQ ID NO: 339177 - RNA, 61 nt, Human
uuucuaaauaguggccauuguagaccugacucaggcugaagcuaaauagagaacaauuuag

SEQ ID NO: 339178 - RNA, 61 nt, Human
cucccugggacaguaguguggagucccagcccaggcugaccucacaccggagcuuccuagc

SEQ ID NO: 339179 - RNA, 61 nt, Human
guauuuguauaaauuuucuguauaauuagcccaggcugauguaacuauaaaaauuaguuga

SEQ ID NO: 339180 - RNA, 61 nt, Human
caagcugcuugaugggaaccuacuagauggacaggcugagguguuuggcagugaugaugac

SEQ ID NO: 339181 - RNA, 61 nt, Human
cgggagccugaucaccugcccugcugagucccaggcugagccucagucucccucccuuggg

SEQ ID NO: 339182 - RNA, 61 nt, Human
uuuugacaacauacaggcauucuuuuaaaaccaggcugaaacauuuuauuuccgagacuua

SEQ ID NO: 339183 - RNA, 61 nt, Human
ggauauuuggggauguuauuuaaauacucagcaggcugagugcagguauacguguguauag

SEQ ID NO: 339184 - RNA, 61 nt, Human
uugcacacggugugaagggucuacaccugcacaggcugaguuccugggcucgaccagccca

SEQ ID NO: 339185 - RNA, 61 nt, Human
uaggggguuaggcugaaaaguguucaauuagcaggcugauuucuuuuuccucuuccgcuag

SEQ ID NO: 339186 - RNA, 61 nt, Human
cggagcugcauggacgccuggcuccaggcuccaggcugacugggggccucugccuccagga

SEQ ID NO: 339187 - RNA, 61 nt, Human
gacagaacucacagcucuguguguguguguucaggcugauaggaaauucaaagagucuccu

SEQ ID NO: 339188 - RNA, 61 nt, Human
uuuguuuuguucugaugcagcuuccaugaggcaggcugaaccugcagauaugcgcccagag

SEQ ID NO: 339189 - RNA, 62 nt, Human; identical to SEQ ID NO: 278268

SEQ ID NO: 339190 - RNA, 62 nt, Human; identical to SEQ ID NO: 278269

SEQ ID NO: 339191 - RNA, 62 nt, Human; identical to SEQ ID NO: 278278

SEQ ID NO: 339192 - RNA, 61 nt, Human
uaugccaaacuuuaaucugcuuuuauguuuucaggcugaaggugugaaaauccuaagagga

SEQ ID NO: 339193 - RNA, 61 nt, Human
uagccugcuuuguaaacuaguuuacaauuugcaggcugaucuuaagauuuuuuuauaucua

SEQ ID NO: 339194 - RNA, 61 nt, Human
aacucaaaguggguugcaaucauuccuaacacaggcugaaacuaaacaaucuugcuccuag

SEQ ID NO: 339195 - RNA, 61 nt, Human
ggggacccugggcccaucucucccugcgcaccaggcugagccgaagcugcgggggcaggcc

SEQ ID NO: 339196 - RNA, 61 nt, Human
uuuguagagacaggagucuugccauguugcccaggcugaucucaaacuccuaggcuuaagu

SEQ ID NO: 339197 - RNA, 61 nt, Human
ggaauuggaagagcauuuuauguuuuaagaacaggcugacacgcagcagcuacaacaacag

SEQ ID NO: 339198 - RNA, 61 nt, Human
uucaucacagagugucaugaagacagacagucaggcugaaauggacaguucuuuguggacu

SEQ ID NO: 339199 - RNA, 61 nt, Human
ccugcggccccaccagguacugaaagacccgcaggcugagcggguagaacagccggguagg

SEQ ID NO: 339200 - RNA, 61 nt, Human
gaauucagguaaccuggugucugugcucacccaggcugagggugccuuuguggcuucgcug

SEQ ID NO: 339201 - RNA, 61 nt, Human
aggcuaaggauagggaaaggguggaugcucucaggcugagggaggcagaaagggaaaguau

SEQ ID NO: 339202 - RNA, 61 nt, Human
cccuguuuggaacccuccccaaagaggcagucaggcugaugcucagugcuuugugcucccu

SEQ ID NO: 339203 - RNA, 61 nt, Human
accaacaccaacucaacaacaaagugcaauacaggcugaaccuggcccaacagaaaaaccc

SEQ ID NO: 339204 - RNA, 61 nt, Human
gcggcacacaucuguaauccuagcuacuuggcaggcugaggugagaagaucauuggaguuu

SEQ ID NO: 339205 - RNA, 61 nt, Human
caccaaaaaugaucaggagaaagcauauuaccaggcugaacugucacuuuaaauucaugac

SEQ ID NO: 339206 - RNA, 61 nt, Human
agcgcugugagccagacccuccuugggcagacaggcugacuggcagcaccagcuuuggggg

SEQ ID NO: 339207 - RNA, 61 nt, Human
uacagccugaguaggccugaguggccguggccaggcugagaccugucaggccauacugaca

SEQ ID NO: 339208 - RNA, 62 nt, Human; identical to SEQ ID NO: 278389

SEQ ID NO: 339209 - RNA, 62 nt, Human; identical to SEQ ID NO: 278390

SEQ ID NO: 339210 - RNA, 62 nt, Human; identical to SEQ ID NO: 278395

SEQ ID NO: 339211 - RNA, 61 nt, Human
uuuuuuugagacaggaucucacucugucauccaggcugaaguccaaucccacaaucauggc

SEQ ID NO: 339212 - RNA, 61 nt, Human
cagggugugcaucaucauugguucuuuuucacaggcugagccuccugaaaacccaugaacg

SEQ ID NO: 339213 - RNA, 61 nt, Human
agaugcaggccaagauucugaguuuuacuaccaggcugaaugcuggagaaaacuggcuauc

SEQ ID NO: 339214 - RNA, 61 nt, Human
aauaauaacagacaaggucaaaaaauagaugcaggcugaaaagaaaaggaagugggcuaag

SEQ ID NO: 339215 - RNA, 61 nt, Human
uuuaguggagaugggguuucgccuuguugcccaggcugaauuuggguuuuuuuaaaaugag

SEQ ID NO: 339216 - RNA, 61 nt, Human
gagggacacacuuaucucugaaguuuuucuccaggcugaacauuucuauuaucaguggccc

SEQ ID NO: 339217 - RNA, 61 nt, Human
ugccccauuacaggcucacacccagucugaucaggcugaguuuuguauguaucuaucuguu

SEQ ID NO: 339218 - RNA, 61 nt, Human
aaggggauuggugaauacucauaaggaucuucaggcugaacagacuaugucuggggaaaga

SEQ ID NO: 339219 - RNA, 61 nt, Human
acuagcugcagagggaugagugaccaccauccaggcugagacugaaaggagcagaggcugg

SEQ ID NO: 339220 - RNA, 56 nt, Human
gccgcgaaggcuuccucuagggccaccaggcugaggacucgcccaggacauggacu

SEQ ID NO: 339221 - RNA, 61 nt, Human
gggggcccacccccagcugggggaccccaugcaggcugaugggccccggggcugccguuuu

SEQ ID NO: 339222 - RNA, 61 nt, Human
cuuggugcugucauaaaagggcaggcaggggcaggcugaggaguugcccuuugccccccag

SEQ ID NO: 339223 - RNA, 61 nt, Human
agcugcggugugggaugcuggaguuuggcugcaggcugacaucauuuauuuuugcaucccu

SEQ ID NO: 339224 - RNA, 61 nt, Human
guaucagaaggugguuugacagcaucauaaacaggcugacuggcaggaaugaaaacaagaa

SEQ ID NO: 339225 - RNA, 61 nt, Human
auguuuacuucauagagauuuauguuuuaugcaggcugaauguuuaucucaaaaguuaaaa

SEQ ID NO: 339226 - RNA, 61 nt, Human
uugucccuaggcuacaaugcuacacuuggcucaggcugaucaccaugcuagucacaggagg

SEQ ID NO: 339227 - RNA, 62 nt, Human; identical to SEQ ID NO: 278280

SEQ ID NO: 339228 - RNA, 62 nt, Human; identical to SEQ ID NO: 278281

SEQ ID NO: 339229 - RNA, 62 nt, Human; identical to SEQ ID NO: 278282

SEQ ID NO: 339230 - RNA, 61 nt, Human
gcaugacugauugaggugaagcucacggggccaggcugaccgucuugaccguuccacuuga

SEQ ID NO: 339231 - RNA, 61 nt, Human
uggcauugaccaugggggaaagggcugguuucaggcugacauauggccgcagguccaguuc

SEQ ID NO: 339232 - RNA, 61 nt, Human
augagaacauauauauauauauauuaagccccaggcugaauacucagggacagcaauucac

SEQ ID NO: 339233 - RNA, 61 nt, Human
cagccacacuucccaccccagggggugcccccaggcugaucucauuucugauguugagggc

SEQ ID NO: 339234 - RNA, 61 nt, Human
caagagucugggacuuucaaaaaaaaaagaucaggcugaaacugcagucagauuuaugaca

SEQ ID NO: 339235 - RNA, 61 nt, Human
auuggaggguguuugaucauuuaguuuuuaacaggcugaggcaacauggaucagugugugu

SEQ ID NO: 339236 - RNA, 61 nt, Human
augcuggaguugugugugucugucuucaucccaggcugagcuccuugaggugaggauguug

SEQ ID NO: 339237 - RNA, 61 nt, Human
uuuuguagagaugggaucucacuauguugcucaggcugaucucgagcuccugggcucaagu

SEQ ID NO: 339238 - RNA, 61 nt, Human
gaagaccuaggccauagagcacaguggaacgcaggcugagaacgcagggaaggagaaauaa

SEQ ID NO: 339239 - RNA, 61 nt, Human
gcugcgagugugucugauuucauaacgaagccaggcugagggcaagaggcccgacaggcag

SEQ ID NO: 339240 - RNA, 61 nt, Human
aguggaaucagccugugcaggcuggggaucucaggcugaucaguaggggccagcuuuggag

SEQ ID NO: 339241 - RNA, 61 nt, Human
cagaaaccuugugaugucuugacuguugcaccaggcugagaaagcagcaauauugauauua

SEQ ID NO: 339242 - RNA, 61 nt, Human
agcugcucuugaagaagaaaaacgaagacaacaggcugaacuagaagcuuuugaaaacaga

SEQ ID NO: 339243 - RNA, 61 nt, Human
ggaaaugaugcagcucuggcuccuugucucccaggcugauccuuuauucagaauaccacaa

SEQ ID NO: 339244 - RNA, 61 nt, Human
uguacuguagucaauaaaugaagacuuguuucaggcugaagauuaccuaagaguauuuauu

SEQ ID NO: 339245 - RNA, 61 nt, Human
uuggaagccaugugauuccaucuugcccgcucaggcugaccacuuuauuucuuuuuguucc

SEQ ID NO: 339246 - RNA, 62 nt, Human; identical to SEQ ID NO: 278283

SEQ ID NO: 339247 - RNA, 62 nt, Human; identical to SEQ ID NO: 278284

SEQ ID NO: 339248 - RNA, 62 nt, Human; identical to SEQ ID NO: 278286

SEQ ID NO: 339249 - RNA, 61 nt, Human
gauaggaacauucuggccagagguuaaagagcaggcugacauggcuggccauuaagcuuua

SEQ ID NO: 339250 - RNA, 61 nt, Human
aggaaaggcuguagaaggaaauauaccuuaacaggcugauuuggagugagccagaaaaaaa

SEQ ID NO: 339251 - RNA, 61 nt, Human
uguguuucacauucauagcaacugcagcuaacaggcugauuuucuggccuuuggagaagug

SEQ ID NO: 339252 - RNA, 61 nt, Human
cuucuaggugcuggcccaccaccacacaucacaggcugauuuccacaggcuucuuccuagg

SEQ ID NO: 339253 - RNA, 61 nt, Human
ggaaaccaagaaaaagaagccaagcaaaaaucaggcugagaaaaagcaaaagaaaagcaaa

SEQ ID NO: 339254 - RNA, 61 nt, Human
aauugcaaaggcucugcugucacaaggagagcaggcugaguuuggagcaggguccauccgg

SEQ ID NO: 339255 - RNA, 61 nt, Human
aguuucucuucucacaaaagauguacuuaagcaggcugaucgcuguuccuugagcaaggcg

SEQ ID NO: 339256 - RNA, 61 nt, Human
cccccuuuacucagagauaacauagauuauccaggcugagauggaaaacaagcccuuuauu

SEQ ID NO: 339257 - RNA, 61 nt, Human
cggggauccugucuugaugacacuugcagggcaggcugaaaaguuuugagauugagcagcu

SEQ ID NO: 339258 - RNA, 61 nt, Human
uuuugcagcgaugagauuuugccaaguugcccaggcugaucuugaacuccugggcucaagc

SEQ ID NO: 339259 - RNA, 61 nt, Human
uuuaguaaagaugggguuuugccauguuugccaggcugaucucgaacuccugaccucaagu

SEQ ID NO: 339260 - RNA, 61 nt, Human
uggcaauuuuuuuuuuuuuuccuguguugcccaggcugaccuccaacuccugggcccaagc

SEQ ID NO: 339261 - RNA, 61 nt, Human
gcccaaagguugggaguaggagacaguaucccaggcugacaagggcuugcccuuuaccuug

SEQ ID NO: 339262 - RNA, 61 nt, Human
aacauuaauauuauugagaguaucugcuuuccaggcugaagugauucauucauuauucuag

SEQ ID NO: 339263 - RNA, 61 nt, Human
uuugauauuuuuugagaugacacucaagcaucaggcugagauuugcacacaugggauguaa

SEQ ID NO: 339264 - RNA, 61 nt, Human
ggagucaggggaagccugucccgggaaggcccaggcugagaggcccuggcucuggccaggc

SEQ ID NO: 339265 - RNA, 62 nt, Human; identical to SEQ ID NO: 278294

SEQ ID NO: 339266 - RNA, 62 nt, Human; identical to SEQ ID NO: 278295

SEQ ID NO: 339267 - RNA, 62 nt, Human; identical to SEQ ID NO: 278296

SEQ ID NO: 339268 - RNA, 61 nt, Human
gcugugcugggcccuugugagugugggggcacaggcugaauuagaugagcuccugccgcag

SEQ ID NO: 339269 - RNA, 61 nt, Human
uucccucucucgugagaugggggauccugugcaggcugaugaggcacccaugagaaaagcc

SEQ ID NO: 339270 - RNA, 61 nt, Human
cacacugaggaacggagaccugugaccacagcaggcugacagauggacagaaucucccgua

SEQ ID NO: 339271 - RNA, 61 nt, Human
uuuaguagagaugggguuucaccauguugaccaggcugauuuugaacuccugaccucaggu

SEQ ID NO: 339272 - RNA, 61 nt, Human
guguauagauucacauacacauauguauauacaggcugacuugaucuagaacauuaaaucc

SEQ ID NO: 339273 - RNA, 61 nt, Human
caccuuuguauguuccuuuguauguuccuaucaggcugauuuuuggagaaaugaauguuug

SEQ ID NO: 339274 - RNA, 61 nt, Human
uuuugcacuaacaguuggcucuuguagccugcaggcugaggaagucucuucucugugcauc

SEQ ID NO: 339275 - RNA, 61 nt, Human
cauagagcacagcgcccuacuuccccacagacaggcugaauuagaagccccuauuacaaau

SEQ ID NO: 339276 - RNA, 61 nt, Human
ggucuggguuuggaucuccaauugccucuugcaggcugagucccuccaugcaaaagugggg

SEQ ID NO: 339277 - RNA, 61 nt, Human
gugccagagaaguggaggcagaucgcuaccccaggcugagauggcccccacugugaaggcc

SEQ ID NO: 339278 - RNA, 61 nt, Human
uuggccuuggcuuuucuagccuauuuaccugcaggcugagccacucucuucccuuucccca

SEQ ID NO: 339279 - RNA, 61 nt, Human
aaagccauccuagacuauauccaaccccagucaggcugacacagaccauaagaauuguaca

SEQ ID NO: 339280 - RNA, 61 nt, Human
acuucaaaguuaaugggauggucggaucucacaggcugagaacucguucaccuccaagcau

SEQ ID NO: 339281 - RNA, 61 nt, Human
uugucuccaggggaggggcuguuugcuggcucaggcugaggauggcccaaaguccaggguc

SEQ ID NO: 339282 - RNA, 59 nt, Human
cgcaguugacucgugucugaggaaaccuccaggcugaggaggucuccgccgcagccuug

SEQ ID NO: 339283 - RNA, 61 nt, Human
guggcaugugccuguaaucccagcuauuuggcaggcugaggcaugagaaucgcuugaaccc

SEQ ID NO: 339284 - RNA, 62 nt, Human; identical to SEQ ID NO: 278399

SEQ ID NO: 339285 - RNA, 62 nt, Human; identical to SEQ ID NO: 278400

SEQ ID NO: 339286 - RNA, 62 nt, Human; identical to SEQ ID NO: 278401

SEQ ID NO: 339287 - RNA, 62 nt, Human; identical to SEQ ID NO: 278402

SEQ ID NO: 339288 - RNA, 61 nt, Human
cccgggcuuagcuaacgaaaguggggagccucaggcugaaguaacuuuucucugcuucucc

SEQ ID NO: 339289 - RNA, 61 nt, Human
aaauucaaaaugugcugugaaaggacaaucucaggcugaaaucccauaaaggaacuuggag

SEQ ID NO: 339290 - RNA, 61 nt, Human
ccugcugcaaaggacagugggcaggaggccccaggcugagagccagaugccuccccaagac

SEQ ID NO: 339291 - RNA, 61 nt, Human
cugccuuggauggccucaggccagguaaccccaggcugaaggggcccugcuccccaucccc

SEQ ID NO: 339292 - RNA, 61 nt, Human
gaggccucuaaagguccucucccaaacugaccaggcugaugucaaccuaacccccucaggg

SEQ ID NO: 339293 - RNA, 61 nt, Human
cuccagacccgcccccaaccugagacagaaccaggcugagccaggccuccacccccacccc

SEQ ID NO: 339294 - RNA, 61 nt, Human
uuuaguagagacgggguuucucuauguuggucaggcugaucucgaacucccgaccucaggu

SEQ ID NO: 339295 - RNA, 61 nt, Human
aaaagguguucaugccucccuguggcuaguacaggcugagcacuaagaugcuuagugcuca

SEQ ID NO: 339296 - RNA, 61 nt, Human
gccgugccauucugccucuuaccuggaagaucaggcugaacgaucaaaagcugaaacauaa

SEQ ID NO: 339297 - RNA, 61 nt, Human
gagaaggguggggaccguugcugucacuacucaggcugacuggggccuggucagauuacgu

SEQ ID NO: 339298 - RNA, 61 nt, Human
uuuaguagagacaggguuucaccauguuggucaggcugaucucgagcuccugaccucaggu

SEQ ID NO: 339299 - RNA, 61 nt, Human
cucuuguugugcucuuugugcccaagaugcgcaggcugaucacccgaggggaauggcaguc

SEQ ID NO: 339300 - RNA, 61 nt, Human
agggagccuaaaaaaauucaaagaccaacuccaggcugauaggaaaaaagaugaaaacaga

SEQ ID NO: 339301 - RNA, 61 nt, Human
gcgccuuucccaacucuagcugggggugggccaggcugaugggacagaauuggauacauac

SEQ ID NO: 339302 - RNA, 61 nt, Human
agguaggggaugguucugggugagaggggagcaggcugagccggcgggggaucugcugucc

SEQ ID NO: 339303 - RNA, 61 nt, Human
ucaucauuugaaaguaacagaagaaagcugucaggcugaggaaaguuucaacaggcacuug

SEQ ID NO: 339304 - RNA, 62 nt, Human; identical to SEQ ID NO: 278300

SEQ ID NO: 339305 - RNA, 62 nt, Human; identical to SEQ ID NO: 278301

SEQ ID NO: 339306 - RNA, 62 nt, Human; identical to SEQ ID NO: 278302

SEQ ID NO: 339307 - RNA, 61 nt, Human
gcauccuggcaucugcgauccaucccugacacaggcugacacauucuuucuccuuuccuuc

SEQ ID NO: 339308 - RNA, 61 nt, Human
guuugcaaaggggaggcaucaguguccuuggcaggcugauuucuagguaggaaauguggua

SEQ ID NO: 339309 - RNA, 61 nt, Human
uggaguguagaccugugugugggaccugcuccaggcugaucccuguccgcacaggugggug

SEQ ID NO: 339310 - RNA, 61 nt, Human
ugugccuuggggagaagaaacauggugaaaacaggcugagguugucagggcagagagcuga

SEQ ID NO: 339311 - RNA, 61 nt, Human
augggggucuccccuaaugcgggggcuggaccaggcugaguccccacaggguccuagugga

SEQ ID NO: 339312 - RNA, 59 nt, Human
gcacaccgccuugcacauagcagaggcuccaggcugacuccuuccuggugggaaaggaa

SEQ ID NO: 339313 - RNA, 61 nt, Human
cacaggaucccagcacuuugggaggccgaggcaggcugaucacgaggucagaagaucaaga

SEQ ID NO: 339314 - RNA, 61 nt, Human
uuugagggaagcagucuccugcgguucaguucaggcugagauuuucuccuucaguggacug

SEQ ID NO: 339315 - RNA, 61 nt, Human
caucccgaaguggaagggggucuaaacagaacaggcugagagaggcgggacugggucaagu

SEQ ID NO: 339316 - RNA, 61 nt, Human
uaagcuuuguuucuuugugaaacuaauucagcaggcugaaggaaaugguucaugugauaau

SEQ ID NO: 339317 - RNA, 61 nt, Human
aaugugacccagauccucacaaccaccuaaucaggcugaggugucuuaagccuuuugcuca

SEQ ID NO: 339318 - RNA, 61 nt, Human
uuuugaaaaucugcugagcggccaccauaugcaggcugagagcugggcacaggcgaagcca

SEQ ID NO: 339319 - RNA, 61 nt, Human
cuaacuuucucauccucggucucuggaaagucaggcugagaaauccuuucccaggccaggc

SEQ ID NO: 339320 - RNA, 61 nt, Human
uuuucugagacggaguuucgcccuuuucgcccaggcugaguacaguggugcaaucucacug

SEQ ID NO: 339321 - RNA, 61 nt, Human
ugggcugcccgguucccagcugcugcggaggcaggcugagggcgcaggggcugccgagugc

SEQ ID NO: 339322 - RNA, 61 nt, Human
cucauuugaugacaccugggaauaacauuagcaggcugauguccugcaccauuauguuuac

SEQ ID NO: 339323 - RNA, 62 nt, Human; identical to SEQ ID NO: 278287

SEQ ID NO: 339324 - RNA, 62 nt, Human; identical to SEQ ID NO: 278288

SEQ ID NO: 339325 - RNA, 62 nt, Human; identical to SEQ ID NO: 278310

SEQ ID NO: 339326 - RNA, 61 nt, Human
agacaaggaaacgcugcaggggccacaggcacaggcugauauuuaaagaucuuugcuugca

SEQ ID NO: 339327 - RNA, 61 nt, Human
uccuuuggaaaauucacuguuccacaaacagcaggcugaauggccucgccucuagauugac

SEQ ID NO: 339328 - RNA, 61 nt, Human
ucccccggggcucccgguccucugcaugucucaggcugagcucccucccccgcggugccuu

SEQ ID NO: 339329 - RNA, 61 nt, Human
guggcacaugccuguaaucccagcuacuuggcaggcugaggugggagaaucgcuugagcuc

SEQ ID NO: 339330 - RNA, 61 nt, Human
ccuguccuuuguugcucaugcuguuuaagugcaggcugagacccagccucuuuguaaguac

SEQ ID NO: 339331 - RNA, 61 nt, Human
gguaagaaaccagccccaguaaucaguaagucaggcugaacugcagugacuuuuauuuaag

SEQ ID NO: 339332 - RNA, 61 nt, Human
uaaauccagggcugcaggcagcaacgcaagucaggcugaacauucagucuccagagacagc

SEQ ID NO: 339333 - RNA, 61 nt, Human
auguaagagugucauggaagcacucagcaagcaggcugauugcaauagacucagacaugcg

SEQ ID NO: 339334 - RNA, 61 nt, Human
uuuaguagagccgggguuucaccaucuuggccaggcugaucuugaacuccugagcucauga

SEQ ID NO: 339335 - RNA, 61 nt, Human
uggcuucucagaagcagcucauugccaaggccaggcugagaggggaccugcuugcuguggu

SEQ ID NO: 339336 - RNA, 61 nt, Human
aaacccuagggugcuuaaagccaaguuagugcaggcugagccccuugguucacagucaagc

SEQ ID NO: 339337 - RNA, 61 nt, Human
aucugaccacagucauggugggauaagacaacaggcugacaaaccaagcuggccauuuggu

SEQ ID NO: 339338 - RNA, 61 nt, Human
aacaguguaugaagcauucguccagcagcaccaggcugaaaaaacagaacgagagaaucgg

SEQ ID NO: 339339 - RNA, 61 nt, Human
gagaccuuaguguucuccaggcucuguggcccaggcugagagcagcaggguagaaaagacc

SEQ ID NO: 339340 - RNA, 61 nt, Human
guuaauucaaagcucaugcuccccuacgguacaggcugagguacacgguuagcaaaaccau

SEQ ID NO: 339341 - RNA, 61 nt, Human
ggcuauuccagaaagaaaagugagccacaugcaggcugaugaaugccgacacuuccagaau

SEQ ID NO: 339342 - RNA, 62 nt, Human; identical to SEQ ID NO: 278313

SEQ ID NO: 339343 - RNA, 62 nt, Human; identical to SEQ ID NO: 278314

SEQ ID NO: 339344 - RNA, 62 nt, Human; identical to SEQ ID NO: 278315

SEQ ID NO: 339345 - RNA, 61 nt, Human
cacaguuggugauugugagaucuguuagcggcaggcugagcagauacuacuugguuuugcu

SEQ ID NO: 339346 - RNA, 61 nt, Human
gccagagccgcacccuggcuggaaugggggccaggcugagccgaucuggucucguguucgc

SEQ ID NO: 339347 - RNA, 61 nt, Human
uccccagccgcaacgggggugccaggagccccaggcugagggcuuccccgaaagucuggga

SEQ ID NO: 339348 - RNA, 61 nt, Human
guaagcucccuccccugccugguucccagggcaggcugacucaguugacugcuugguccaa

SEQ ID NO: 339349 - RNA, 61 nt, Human
uuuaguagagaugagguuucaccauuuuggccaggcugaucuugaacuccugaccucaggu

SEQ ID NO: 339350 - RNA, 61 nt, Human
ccugacuuaagaguuuucaagaugucaacuucaggcugaucagcagaugggaugugaaaaa

SEQ ID NO: 339351 - RNA, 61 nt, Human
aggcuggugcccaugcuccacacugggaggccaggcugaccccaccagccagucagcuaca

SEQ ID NO: 339352 - RNA, 61 nt, Human
gccucagaguggucgagugacacaccucacgcaggcugaguccagagcuugugcuccucuu

SEQ ID NO: 339353 - RNA, 61 nt, Human
gucuucugggcugggcaggcccucugguucccaggcugagacugacggguuuucucaggau

SEQ ID NO: 339354 - RNA, 61 nt, Human
uccugacccucacuuuucucaucuguaaaaccaggcugaugccgugcgggcuaaugagcca

SEQ ID NO: 339355 - RNA, 61 nt, Human
gugacacacauucuccugucucuggcuucuucaggcugaaaugacauagcucacccuuacu

SEQ ID NO: 339356 - RNA, 61 nt, Human
gaguggggcaggguaaggugggccuuacagacaggcugagguuuggguggugugaucuguc

SEQ ID NO: 339357 - RNA, 61 nt, Human
auggccaagggugggugguagaaaguguguucaggcugacacuggcaaugaguacagauaa

SEQ ID NO: 339358 - RNA, 61 nt, Human
agcaggcaggccgagggcugcggcacuggagcaggcugacuuacaugcuccacaugggacc

SEQ ID NO: 339359 - RNA, 61 nt, Human
cguauguacuagauggcagggcacugggggucaggcugaaggcugagcaacaccucucugc

SEQ ID NO: 339360 - RNA, 61 nt, Human
auuguuuacaagacuaaggcccacuucccugcaggcugaccugaaccucaggggguagcug

SEQ ID NO: 339361 - RNA, 62 nt, Human; identical to SEQ ID NO: 278316

SEQ ID NO: 339362 - RNA, 62 nt, Human; identical to SEQ ID NO: 278317

SEQ ID NO: 339363 - RNA, 62 nt, Human; identical to SEQ ID NO: 278470

SEQ ID NO: 339364 - RNA, 61 nt, Human
agauggcuacagaccagagauuccacgcucucaggcugacuagaguccgcaucucaucucc

SEQ ID NO: 339365 - RNA, 61 nt, Human
augugaaggucaaagcccugccucugcccgacaggcugaagugguaccuccuuagcgagca

SEQ ID NO: 339366 - RNA, 61 nt, Human
cccgcugcugggauugacgccugccauuggucaggcugaccuggccucccguggaccacuc

SEQ ID NO: 339367 - RNA, 61 nt, Human
guuucugcagucagggaggagggaggguggccaggcugacagcuuuuugcaagaggagggg

SEQ ID NO: 339368 - RNA, 61 nt, Human
gagucaucuccggugauccuuaaaugaacugcaggcugagaaaagaaggaaaaaggucaca

SEQ ID NO: 339369 - RNA, 61 nt, Human
ugagaaucuuguuucccccaagagaguuuuacaggcugaguguugcaaauguguucuuugu

SEQ ID NO: 339370 - RNA, 61 nt, Human
ggggcccaagagucuggggaccagcuuggcucaggcugagcugaaagaggccaaacaggcc

SEQ ID NO: 339371 - RNA, 61 nt, Human
aauuuuugagacugaguaguauucuuggauacaggcugauguguacuuaaccacuuccaga

SEQ ID NO: 339372 - RNA, 61 nt, Human
ccaugacccuacauaaggcuggauggcaccucaggcugagggccccaauguauguguggcu

SEQ ID NO: 339373 - RNA, 61 nt, Human
cguagggccuaaaggaaaccuuucuuaaagacaggcugaaaccccuucaaaggcagaugag

SEQ ID NO: 339374 - RNA, 61 nt, Human
gagagguggauccuguaggcuaaaaggcuuccaggcugagagccggccguggaaggaggga

SEQ ID NO: 339375 - RNA, 59 nt, Human
cucggacccggacaccuugagaugagacucaggcugauacaccagcucccaaagguccc

SEQ ID NO: 339376 - RNA, 61 nt, Human
uuucucuuucccuggucccuuguauccccugcaggcugagugcauuuggagggagugagug

SEQ ID NO: 339377 - RNA, 61 nt, Human
cuugcuugcccucuggccccgccccaacuuccaggcugacccggcccuacuggaggguguu

SEQ ID NO: 339378 - RNA, 61 nt, Human
aggguagaccaaaucaaaugcucacuggggucaggcugauggagacaguaacacuggcgag

SEQ ID NO: 339379 - RNA, 61 nt, Human
agucuguauuagaagaaaauaaggguaaaaucaggcugaacugcauguauauggcuccacu

SEQ ID NO: 339380 - RNA, 62 nt, Human; identical to SEQ ID NO: 278319

SEQ ID NO: 339381 - RNA, 62 nt, Human; identical to SEQ ID NO: 278320

SEQ ID NO: 339382 - RNA, 62 nt, Human; identical to SEQ ID NO: 278321

SEQ ID NO: 339383 - RNA, 62 nt, Human; identical to SEQ ID NO: 278322

SEQ ID NO: 339384 - RNA, 61 nt, Human
cacgaugcagguggcacucaggggcuaacuucaggcugaugagugugugggguauggggca

SEQ ID NO: 339385 - RNA, 61 nt, Human
accccagggugagcuggagcuccaggcuggccaggcugaaccucgcacacacgcagaguuc

SEQ ID NO: 339386 - RNA, 61 nt, Human
ggccuggcccauguauggccaggaaguagcacaggcugagugcaggcccacccugcuuggc

SEQ ID NO: 339387 - RNA, 61 nt, Human
uuuuauagagauaggguuucaccguguuggccaggcugaucucgaacuccugaccgcaagu

SEQ ID NO: 339388 - RNA, 61 nt, Human
uggcuggaucuuuugguggagucaggaaagacaggcugagcuuucuagccuaaguguggag

SEQ ID NO: 339389 - RNA, 61 nt, Human
gacauccuuucugaauacuucuugauggguacaggcugaguggggcgcccucaccuccagc

SEQ ID NO: 339390 - RNA, 61 nt, Human
ugccccaacccccaccgaagagcccugagcucaggcugagcccagccaccucccaaggacu

SEQ ID NO: 339391 - RNA, 61 nt, Human
agcccagcacugugaagacccagcaggaagccaggcugagugagccacagaccaccugcuu

SEQ ID NO: 339392 - RNA, 61 nt, Human
gcagguggccggcgggcacuguguacaggagcaggcugagccccgccccuggcccugcugc

SEQ ID NO: 339393 - RNA, 61 nt, Human
gagcauuuagaguugucuuucagcauucaaucaggcugagcugaauguagugauguuuaca

SEQ ID NO: 339394 - RNA, 61 nt, Human
ugggacaagcagcccaucaacgccauggguucaggcugauccaggagaugcucacaggcca

SEQ ID NO: 339395 - RNA, 61 nt, Human
agccagguguggugguaugugccuguagucccaggcugaggcaagagaauuacuugagccc

SEQ ID NO: 339396 - RNA, 61 nt, Human
uucucuguccugagcuggagaagggaaugagcaggcugacacguugcacagccccaggugg

SEQ ID NO: 339397 - RNA, 61 nt, Human
auggggcuuucuggaguuguggugaggccaccaggcugaagucagcucagacccagaccuc

SEQ ID NO: 339398 - RNA, 61 nt, Human
guccugucaauccagaacugccucugagcuccaggcugaccacagaucagccacagccuga

SEQ ID NO: 339399 - RNA, 61 nt, Human
gaacuccaccgucauccccgagacgcaacugcaggcugaggaccgcgacaaggacgacauu

SEQ ID NO: 339400 - RNA, 62 nt, Human; identical to SEQ ID NO: 278330

SEQ ID NO: 339401 - RNA, 53 nt, Human; identical to SEQ ID NO: 278331

SEQ ID NO: 339402 - RNA, 62 nt, Human; identical to SEQ ID NO: 278332

SEQ ID NO: 339403 - RNA, 62 nt, Human; identical to SEQ ID NO: 278333

SEQ ID NO: 339404 - RNA, 61 nt, Human
ucuuugagguucccuccuucuggguguucuucaggcugagcagagaggcuccuguacccuc

SEQ ID NO: 339405 - RNA, 61 nt, Human
uuccucugucugauccuuuggucuuugcuaccaggcugaagucugucaugaaaccacuuau

SEQ ID NO: 339406 - RNA, 61 nt, Human
cccuuaaccuucaaguccaagcaguuccaaucaggcugacuuaggaucaugcuggaaggaa

SEQ ID NO: 339407 - RNA, 61 nt, Human
gaaucaaguggugaggcacugaaucgcuguacaggcugaagaccuccuuauuagaguugaa

SEQ ID NO: 339408 - RNA, 61 nt, Human
aacuaaaauaaggaauagaaaagcuguuuuucaggcugacaguccaauuaaggguagccaa

SEQ ID NO: 339409 - RNA, 61 nt, Human
aaacuggcuuccccuuggagacggcagauuucaggcugaucccugcuuaagcccucucauc

SEQ ID NO: 339410 - RNA, 61 nt, Human
ccugcugggugacaagaauaaaggcucugcccaggcugaaaguuccuacccuuuuuuuuuu

SEQ ID NO: 339411 - RNA, 61 nt, Human
uuuaauagagaugggguuucaccauauuggccaggcugaucucuaacuccuggccucaagu

SEQ ID NO: 339412 - RNA, 61 nt, Human
augucaccagucggacugugcuguggcuaaccaggcugacaacugagaugaggauucacug

SEQ ID NO: 339413 - RNA, 61 nt, Human
gccucuggagugggacacuggcccugggaaccaggcugagcugaguggccucaaacccccc

SEQ ID NO: 339414 - RNA, 61 nt, Human
cuuuaccucacagucucuaggauuccugacucaggcugaccucucucucuggucccagacu

SEQ ID NO: 339415 - RNA, 61 nt, Human
uauguagagacaggggucuugccaugucgcccaggcugaucuugaacuccugggcucaagc

SEQ ID NO: 339416 - RNA, 61 nt, Human
agucaucauaaaacaccagaccacuuagacucaggcugaaccauacucuuucuauucuuau

SEQ ID NO: 339417 - RNA, 61 nt, Human
gaaugaaaccaggaauggacuuggaguucaacaggcugagaggaugccuccaauggaccag

SEQ ID NO: 339418 - RNA, 61 nt, Human
gcagccauccugcagugggggugagcgggcacaggcugagaacugcucuugggugguggaa

SEQ ID NO: 339419 - RNA, 61 nt, Human
ccuucuccacuaacccaggacuaaaaauggacaggcugaccucaguguuuacaaauucaga

SEQ ID NO: 339420 - RNA, 62 nt, Human; identical to SEQ ID NO: 278297

SEQ ID NO: 339421 - RNA, 62 nt, Human; identical to SEQ ID NO: 278298

SEQ ID NO: 339422 - RNA, 62 nt, Human; identical to SEQ ID NO: 278311

SEQ ID NO: 339423 - RNA, 61 nt, Human
agaugggugggggaaaacaaucagguuucuucaggcugaggaggacuugcucaggccgauu

SEQ ID NO: 339424 - RNA, 61 nt, Human
ccagcagcagaauggaaaaauccuugaagcccaggcugaugcuugaaguaacuguggaggg

SEQ ID NO: 339425 - RNA, 61 nt, Human
ggcaaaauagcaugaucugagcagcagcauccaggcugaccucaaggaagcauagccacaa

SEQ ID NO: 339426 - RNA, 61 nt, Human
uucccaaguagguaguaguaaguaugugccacaggcugauuaucuggguaaucuuuuacgg

SEQ ID NO: 339427 - RNA, 61 nt, Human
ucauccccucgcagcacuuguucguaaggcacaggcugacaguuccacucccaccccacac

SEQ ID NO: 339428 - RNA, 61 nt, Human
gaagggaagaccugcagugcacgguuucuuccaggcugagguaccuggaucuuggguucuu

SEQ ID NO: 339429 - RNA, 61 nt, Human
ugagggccccgggcccucagccucucuuguacaggcugagaggcugagaaaucauccccug

SEQ ID NO: 339430 - RNA, 61 nt, Human
gacccagagaagcuaaaagccacuggcagcacaggcugacaaaauggaagcaaagcaagag

SEQ ID NO: 339431 - RNA, 61 nt, Human
gagguuaggagacugauagcaugugauggcucaggcugaagaaccggggugcuguuuaagu

SEQ ID NO: 339432 - RNA, 61 nt, Human
uuaccaggacuccuacacacucucugaaacucaggcugaggcagcagcugaggcccugucc

SEQ ID NO: 339433 - RNA, 61 nt, Human
uuuaguagagacgggguuucaccauguuggccaggcugauuaacuccugaccucaggugau

SEQ ID NO: 339434 - RNA, 61 nt, Human
agggcccagauuucaccagauacacaauccucaggcugacauaaaguuuacgaggacugcu

SEQ ID NO: 339435 - RNA, 61 nt, Human
cccucacagggucccucagauuauaggugcccaggcugaggugaagaggccugggggcccu

SEQ ID NO: 339436 - RNA, 61 nt, Human
ugaggccaggaaaagaagcacuggaaagcagcaggcugaacaauuccuggaacucaugcag

SEQ ID NO: 339437 - RNA, 61 nt, Human
gguauuggcuuaguuguaagggcuuuaggaucaggcugaauaugaggacaaagugggccac

SEQ ID NO: 339438 - RNA, 61 nt, Human
ugcucagaaugggaaaauauccauagccuugcaggcugauuggauagaaccugccugcccu

SEQ ID NO: 339439 - RNA, 62 nt, Human; identical to SEQ ID NO: 278226

SEQ ID NO: 339440 - RNA, 62 nt, Human; identical to SEQ ID NO: 278227

SEQ ID NO: 339441 - RNA, 62 nt, Human; identical to SEQ ID NO: 278228

SEQ ID NO: 339442 - RNA, 61 nt, Human
gcugugcaccuaaaugucugucugggaggagcaggcugagaagucuugcagucugcaggac

SEQ ID NO: 339443 - RNA, 61 nt, Human
uaacuaacgccuguuugugaaauuagcuuaucaggcugaaauuaaagccaugcaaaagaag

SEQ ID NO: 339444 - RNA, 61 nt, Human
ccuuucuaguucagugaauugaccccauccacaggcugauucaucuuuguguuaaggggca

SEQ ID NO: 339445 - RNA, 61 nt, Human
ccugagagacagugggcacggggacagugaucaggcugacagugaccaagacacuaacaaa

SEQ ID NO: 339446 - RNA, 61 nt, Human
gugcuggaugccacaguucccugcagccaaucaggcugaaaaugcagauuaccgcacaaau

SEQ ID NO: 339447 - RNA, 61 nt, Human
cccaccggguucugcagcggcagagcaauuccaggcugagccaugaggagcguggacucug

SEQ ID NO: 339448 - RNA, 61 nt, Human
aauaaguuuagccuuuauaaaaaugaaguugcaggcugacauuacauucuguacuaagugu

SEQ ID NO: 339449 - RNA, 61 nt, Human
agugacaaaaaccagcaaauucaauucuuugcaggcugaguucccacaaagcauggguaac

SEQ ID NO: 339450 - RNA, 61 nt, Human
cuacccuauuuuucccuguucccuggugccacaggcugacaacugcagucuccaguuuaga

SEQ ID NO: 339451 - RNA, 61 nt, Human
uaguuugaaaagcaugauuauacaggccucucaggcugagugcuacuuugguaaaguuccc

SEQ ID NO: 339452 - RNA, 61 nt, Human
ggcccgaaguccgcuagagcacagucccauccaggcugaugccaagcaccccuuuuauccc

SEQ ID NO: 339453 - RNA, 61 nt, Human
uccaucucccaccugcccuugagcgcgcucucaggcugagaacacggucucaucaggcgcc

SEQ ID NO: 339454 - RNA, 61 nt, Human
acaugcuguuuuuccuauuugguuugagaaacaggcugacacuauucucuuugauuagaaa

SEQ ID NO: 339455 - RNA, 61 nt, Human
uggcggcacgcugaaggaaacgugcgaagcacaggcugaagagggguuucuaaccugggaa

SEQ ID NO: 339456 - RNA, 61 nt, Human
gucagccugcgggcccaggcagcucggacaccaggcugagcccggcgcagcaccugggcag

SEQ ID NO: 339457 - RNA, 61 nt, Human
gcagagccuccugggaacacaucuggcugcacaggcugaaauauccacccagcaggcagag

SEQ ID NO: 339458 - RNA, 62 nt, Human; identical to SEQ ID NO: 278232

SEQ ID NO: 339459 - RNA, 62 nt, Human; identical to SEQ ID NO: 278233

SEQ ID NO: 339460 - RNA, 62 nt, Human; identical to SEQ ID NO: 278234

SEQ ID NO: 339461 - RNA, 61 nt, Human
uuuaaccuuguauaaauuauucaguaacugucaggcugaaaacaauggaguauucucggau

SEQ ID NO: 339462 - RNA, 61 nt, Human
ugcagaagcuugaaaggccaauaccagaacacaggcugaugcuucugagaaagucuuuucc

SEQ ID NO: 339463 - RNA, 61 nt, Human
ccucgggcucagguggcacggucccaggguccaggcugagggcugggagcucccuugcgcc

SEQ ID NO: 339464 - RNA, 61 nt, Human
uuguguguaugcugaugaucaaaaccugugccaggcugaauuacagugaaauuuuggugaa

SEQ ID NO: 339465 - RNA, 61 nt, Human
ugcucggcccagggucugggagcugggcuaacaggcugacacuucggcagggucaccagga

SEQ ID NO: 339466 - RNA, 61 nt, Human
cgcacccaggacgcugagcccaggagccugccaggcugacgugcaucccacccagacggug

SEQ ID NO: 339467 - RNA, 61 nt, Human
gcucaaggaaagggggucccagugggaggggcaggcugacaucuguguuucaaguggggcu

SEQ ID NO: 339468 - RNA, 61 nt, Human
agaggugcacaggcuggaguuucaggcacugcaggcugaugacacacagggagaguggccc

SEQ ID NO: 339469 - RNA, 61 nt, Human
auugggacagcuggucaccuuacgcaagagccaggcugaaacauccccuccauacucagcu

SEQ ID NO: 339470 - RNA, 61 nt, Human
ugaccucccagaaccauggaagccaggacgucaggcugaccaacaccucagaccuucugaa

SEQ ID NO: 339471 - RNA, 61 nt, Human
ggugaaggucagacuaaggcagccuucuucacaggcugaggggguucagaaccagccuggc

SEQ ID NO: 339472 - RNA, 61 nt, Human
acaggucacacauugucaaacuaccucucagcaggcugaaguucaugcacaccucacacca

SEQ ID NO: 339473 - RNA, 61 nt, Human
auaggcuggcuggugaaagguucacguggcccaggcugaacuucauugccuagcuuuggau

SEQ ID NO: 339474 - RNA, 61 nt, Human
gugagccaucuggagcagaggggcacuaacccaggcugacgccaagaaugaaguggcccac

SEQ ID NO: 339475 - RNA, 61 nt, Human
gugcccagcuaauuuuuguauuuuuguuggccaggcugauuucgaacuccugaccucaaau

SEQ ID NO: 339476 - RNA, 61 nt, Human
uagugucacuuucugaguacccgccgcuucacaggcugaguccaggccugugugcuuugua

SEQ ID NO: 339477 - RNA, 62 nt, Human; identical to SEQ ID NO: 278235

SEQ ID NO: 339478 - RNA, 62 nt, Human; identical to SEQ ID NO: 278236

SEQ ID NO: 339479 - RNA, 62 nt, Human; identical to SEQ ID NO: 278238

SEQ ID NO: 339480 - RNA, 61 nt, Human
cccugcagugugaaugugugaaacauccccucaggcugaagccccccacccccaccagaga

SEQ ID NO: 339481 - RNA, 61 nt, Human
gguggccuugcccugcucccccggggacccccaggcugaggguucugccgcgggcuaccgg

SEQ ID NO: 339482 - RNA, 61 nt, Human
gggcucagguugggucuaggguguccucaaacaggcugaggagguuccgaggcucaaagga

SEQ ID NO: 339483 - RNA, 61 nt, Human
gggugcccuccuuccuagaggcccugggggccaggcugacuuggggggcagacuugacacu

SEQ ID NO: 339484 - RNA, 61 nt, Human
auagcuuucuucacaguccuuucagaauucccaggcugaaaucagccauagcaguugacaa

SEQ ID NO: 339485 - RNA, 61 nt, Human
uggaaacccagguguugugacuggcacugcccaggcugagacucuucaagucccgcugacg

SEQ ID NO: 339486 - RNA, 61 nt, Human
cggguacuacgcagcaacacucacaacuguccaggcugagauaaaucccgggaccugaacu

SEQ ID NO: 339487 - RNA, 61 nt, Human
cuucaucguggggcucucaguuccgauuucccaggcugaauugggagugagaugccugcau

SEQ ID NO: 339488 - RNA, 61 nt, Human
aggggagaggcuacugcagaaccugacgguucaggcugagucgcccuuugggguuggggcc

SEQ ID NO: 339489 - RNA, 61 nt, Human
ccuguccuuggcucuuccucccaaugcccgucaggcugaacucgccucccccgugacucug

SEQ ID NO: 339490 - RNA, 61 nt, Human
aggccuuccuccuccagggcccucugcagaccaggcugagauggaggaaccugcuaaaauc

SEQ ID NO: 339491 - RNA, 61 nt, Human
aucaguggugucugugaagggugccgcgagccaggcugaccaggcgcccgggauccagcuc

SEQ ID NO: 339492 - RNA, 61 nt, Human
uccgccccaaaacccggccuuggucccuggccaggcugagagaauugggcagggagagggc

SEQ ID NO: 339493 - RNA, 61 nt, Human
aguggggauggucugugaccugcugggaaggcaggcugauggggcacacccuuggccucuc

SEQ ID NO: 339494 - RNA, 61 nt, Human
gauccggcaggugcgccuagagcggauccgccaggcugagacccuggagcaagugcgcagc

SEQ ID NO: 339495 - RNA, 61 nt, Human
ggcuaagaggcacugagcccucaacccaagccaggcugaccucaucugcuuugcuuuggca

SEQ ID NO: 339496 - RNA, 62 nt, Human; identical to SEQ ID NO: 278337

SEQ ID NO: 339497 - RNA, 62 nt, Human; identical to SEQ ID NO: 278338

SEQ ID NO: 339498 - RNA, 62 nt, Human; identical to SEQ ID NO: 278339

SEQ ID NO: 339499 - RNA, 61 nt, Human
ucagaggaaacccaggaaaugcccuuacugccaggcugagucuccacccaugcugguuggu

SEQ ID NO: 339500 - RNA, 61 nt, Human
aaccgaauggcagauaaaccccaugaggggucaggcugaugugcccuccagcaguaucuga

SEQ ID NO: 339501 - RNA, 61 nt, Human
uaguguggccaagagaucagcacaaccuuugcaggcugacuugcuaagucugacagugaca

SEQ ID NO: 339502 - RNA, 61 nt, Human
aaaagucuugcaaaauggggcaguggacugacaggcugacauagaaaauaaacuuugccca

SEQ ID NO: 339503 - RNA, 61 nt, Human
uuuugcagaaacgaggccucacuauauuguccaggcugaguggcucuuuuauuaaccaguc

SEQ ID NO: 339504 - RNA, 52 nt, Human
ccaaugcccccccacccuaaugcaggcugaggagggggcacauguugggaga

SEQ ID NO: 339505 - RNA, 61 nt, Human
uuuuauacagacaaggucuugcuauguugcccaggcugaucuugaauucccgggcucaagu

SEQ ID NO: 339506 - RNA, 61 nt, Human
ccacccaguuccuuggccuaggucuccccuccaggcugagggccucucuacuuccccagau

SEQ ID NO: 339507 - RNA, 61 nt, Human
gguggauucugcagggguguggggccguggacaggcugaggcucaaggaaggugguccuca

SEQ ID NO: 339508 - RNA, 61 nt, Human
uguuguuuuggggcccuucaaggcaaaagaccaggcugacuggaagauggaaagccacagg

SEQ ID NO: 339509 - RNA, 61 nt, Human
uucuuucuagaagauugagaagugcauaugacaggcugagagcaccuccccaaacacacaa

SEQ ID NO: 339510 - RNA, 59 nt, Human
gccccugggagagccuguaaggaaagaggcaggcugagcugggggcucuggaccaggaa

SEQ ID NO: 339511 - RNA, 61 nt, Human
uuuuuuugaaauggagucucguucugucgcccaggcugaggugcaguagugcaaucuccgc

SEQ ID NO: 339512 - RNA, 61 nt, Human
guuugaauugcagccauccccugcccccucccaggcugaagaucuguucuuuuuaaguuga

SEQ ID NO: 339513 - RNA, 61 nt, Human
cucagccucguccaagcaccgggaagaccuccaggcugaccccuugagcagcagucagcac

SEQ ID NO: 339514 - RNA, 61 nt, Human
uuucuuccugcaugaucccugggcccucccgcaggcugagcaagucuguaaacugauucug

SEQ ID NO: 339515 - RNA, 62 nt, Human; identical to SEQ ID NO: 278245

SEQ ID NO: 339516 - RNA, 62 nt, Human; identical to SEQ ID NO: 278246

SEQ ID NO: 339517 - RNA, 62 nt, Human; identical to SEQ ID NO: 278247

SEQ ID NO: 339518 - RNA, 61 nt, Human
aggaggcggucaggcugcugaggaaacaccacaggcugaacgggggaggaaugcacaugcc

SEQ ID NO: 339519 - RNA, 61 nt, Human
cuguggcuccccagaacaggauccccagaagcaggcugaagaggaaaggcaggaggaaccu

SEQ ID NO: 339520 - RNA, 61 nt, Human
cccugccacugggcucuggaccucaggagggcaggcugagguggggaaggagggacuuggc

SEQ ID NO: 339521 - RNA, 61 nt, Human
uguucagagacagcaacucccucccguaacucaggcugagaaggaaccagccagcucuuac

SEQ ID NO: 339522 - RNA, 61 nt, Human
guggugcacaccuguagucccaacuauucggcaggcugaggcaguagaaucgcuugaaccu

SEQ ID NO: 339523 - RNA, 61 nt, Human
gucuuuacaugcaagagggauccaauuaugacaggcugacccagcugguuucauguuuggg

SEQ ID NO: 339524 - RNA, 61 nt, Human
gugaggugggacuuggaaaggcuuugaacgccaggcugaugguugagggauggugggcagg

SEQ ID NO: 339525 - RNA, 61 nt, Human
aucccaggaggaccagcuggcccccugcuggcaggcugaacacccugcggagcgggugaga

SEQ ID NO: 339526 - RNA, 61 nt, Human
aaugcaacuggacaaccccagcaagguucagcaggcugaacuucacacagguagucugcca

SEQ ID NO: 339527 - RNA, 61 nt, Human
cuggcuggacagacugauagcagaaaaaguacaggcugagcgaccugacaccauguugggg

SEQ ID NO: 339528 - RNA, 61 nt, Human
gagccugccaccgugugucgggagugugggccaggcugagugcauaggugacagggccgug

SEQ ID NO: 339529 - RNA, 61 nt, Human
uugcugggaagccucacccuucugcccuucacaggcugaaggguuaagaucuaaucucccu

SEQ ID NO: 339530 - RNA, 61 nt, Human
uuuuuuuuugagacagagucucacugucacccaggcugaacugcaguggugugaucuaggc

SEQ ID NO: 339531 - RNA, 61 nt, Human
cccauaaccauaguuucaauguacauaaacccaggcugaaaauauuuuuuaacuccucaaa

SEQ ID NO: 339532 - RNA, 61 nt, Human
acaacuagggcugcgaaucuagaggagggggcaggcugagggucgugggaaaggggaguag

SEQ ID NO: 339533 - RNA, 61 nt, Human
uuuuuuggagacagggucucucucuguggcccaggcugaagugcaguggugugauuacagc

SEQ ID NO: 339534 - RNA, 62 nt, Human; identical to SEQ ID NO: 278250

SEQ ID NO: 339535 - RNA, 62 nt, Human; identical to SEQ ID NO: 278251

SEQ ID NO: 339536 - RNA, 62 nt, Human; identical to SEQ ID NO: 278252

SEQ ID NO: 339537 - RNA, 53 nt, Human
gggcuccuccuggaagauagagccaggcugacccgaagcccugcagagcccca

SEQ ID NO: 339538 - RNA, 61 nt, Human
guggcauacacuuguagucccagcuacuuggcaggcugaggcagaagaaucaccugaaccc

SEQ ID NO: 339539 - RNA, 61 nt, Human
cugccacccuagggacgggccaagggcuggucaggcugaagugccccuccuagcagggccc

SEQ ID NO: 339540 - RNA, 61 nt, Human
gugggauuugagacccagguuaggcacgacccaggcugagaagggacguuuccaucauuca

SEQ ID NO: 339541 - RNA, 61 nt, Human
ccugucgccagaucaacugagcacggcaggccaggcugagcccgcccgcccucgcccccug

SEQ ID NO: 339542 - RNA, 61 nt, Human
cuggagagcgggcgccacggcugguauucugcaggcugaaugcagucuccagacuggaaac

SEQ ID NO: 339543 - RNA, 61 nt, Human
ggccgucucugauucucccuuuaugaagcugcaggcugacgagagauggucccuucccauu

SEQ ID NO: 339544 - RNA, 61 nt, Human
acagagcagcccuuagccuggggccaugggucaggcugaccuucaacaauuauuucuagau

SEQ ID NO: 339545 - RNA, 61 nt, Human
gguucaucccugguuaaaaagcaaacaaacacaggcugaaaacccaugcugcuguuauaca

SEQ ID NO: 339546 - RNA, 61 nt, Human
agagaacucaccugacaaaugucucugagcacaggcugacaccaaaguggcacaacugcac

SEQ ID NO: 339547 - RNA, 61 nt, Human
uauccagauagauccaaagcucaugucucuucaggcugagacuggcgcugucaccuccacc

SEQ ID NO: 339548 - RNA, 61 nt, Human
gguuuuuuuguacaaauuuagcuaauagcuacaggcugagagaauuguaacauagcaugac

SEQ ID NO: 339549 - RNA, 61 nt, Human
uaagagguuuguauauaaaucuguuauagaacaggcugaaauuucuuguucauaagauuau

SEQ ID NO: 339550 - RNA, 61 nt, Human
ccauccgcccggcucugcccaccaccacugccaggcugaacaggggacuagugcccaggug

SEQ ID NO: 339551 - RNA, 61 nt, Human
uuuuuuugagacagagucucucucugucccccaggcugaagugcagcggcaugaucucagc

SEQ ID NO: 339552 - RNA, 61 nt, Human
auaucauucagaaugugcaaagcaguauguacaggcugagacacagcccagagacugaacg

SEQ ID NO: 339553 - RNA, 62 nt, Human; identical to SEQ ID NO: 278242

SEQ ID NO: 339554 - RNA, 62 nt, Human; identical to SEQ ID NO: 278243

SEQ ID NO: 339555 - RNA, 62 nt, Human; identical to SEQ ID NO: 278253

SEQ ID NO: 339556 - RNA, 61 nt, Human
caccgcaggcgcuggagccuccaggcccaaacaggcugaagcuccuaaacuuggccauucc

SEQ ID NO: 339557 - RNA, 61 nt, Human
ugcccagaagguaccauuaggugccaugauccaggcugaaccaauauacaguggggcugaa

SEQ ID NO: 339558 - RNA, 61 nt, Human
agcaggcgcugccuucacccacggaucugcccaggcugaaggcacacgcucaaugccccac

SEQ ID NO: 339559 - RNA, 61 nt, Human
auggauggcugagcagagagcggggaaaaugcaggcugaguggggcgaccuccugccugcc

SEQ ID NO: 339560 - RNA, 61 nt, Human
caggcuguggccugggggcuggggggagccccaggcugaaaaggguccaauuaaaacaaau

SEQ ID NO: 339561 - RNA, 61 nt, Human
gaaggcagggcgguguuggggggcuggggggcaggcugaauguguguguguggguguguau

SEQ ID NO: 339562 - RNA, 61 nt, Human
uggggacccucgccuucccuccucucaccugcaggcugauccuucuuuucacuuucuguca

SEQ ID NO: 339563 - RNA, 61 nt, Human
ccucuuggaguucaagaagccaacgcugagucaggcugaguggacugaggccugccccgcc

SEQ ID NO: 339564 - RNA, 61 nt, Human
gcaaagcucauuggucuggucucuuguuugccaggcugauugaagcaggccuugaugaggg

SEQ ID NO: 339565 - RNA, 61 nt, Human
ugaucaucauaauacaacuucaaaaggauuucaggcugagugugguggcucacgccuauac

SEQ ID NO: 339566 - RNA, 61 nt, Human
ugcucacucccguaauaaaaaaauaaaagaacaggcugagccgggcaugguugcucacucc

SEQ ID NO: 339567 - RNA, 61 nt, Human
gaagaaaggccuuuucuagcccagaagggugcaggcugagggcugggcccugggcccuggu

SEQ ID NO: 339568 - RNA, 61 nt, Human
aggucaggagcucacgccagggccuugaggacaggcugacccuccuccccgggguggcgug

SEQ ID NO: 339569 - RNA, 61 nt, Human
uuuaguagagacaguguuucaccauguugaccaggcugaucuuaaacucuugaccucaaau

SEQ ID NO: 339570 - RNA, 61 nt, Human
uuuaauagagaugagguuucaccaugauggccaggcugaucucgaacuccuaaccucaagu

SEQ ID NO: 339571 - RNA, 61 nt, Human
uugugaagaggggccagaugacacccuaaagcaggcugaucgggcaaugggagguggccag

SEQ ID NO: 339572 - RNA, 62 nt, Human; identical to SEQ ID NO: 278259

SEQ ID NO: 339573 - RNA, 62 nt, Human; identical to SEQ ID NO: 278260

SEQ ID NO: 339574 - RNA, 62 nt, Human; identical to SEQ ID NO: 278261

SEQ ID NO: 339575 - RNA, 61 nt, Human
aguaauuuagguuucaugguacuguagaggccaggcugaaaugucauaucugaaggaagaa

SEQ ID NO: 339576 - RNA, 61 nt, Human
agccaggcaugguggcacacaccuguagucccaggcugaggugggaggaucacuugaaccc

SEQ ID NO: 339577 - RNA, 61 nt, Human
gagggggugggaggggcugguguccucccuccaggcugaaccccacuuccucggcaggacc

SEQ ID NO: 339578 - RNA, 61 nt, Human
cacgccacuggacugucuaugaacuugcaaacaggcugauaccuuugugaaguugcccacc

SEQ ID NO: 339579 - RNA, 61 nt, Human
cuggacuaagaacuuucaaaauuuuaaugaacaggcugauacuucaugaaauucaagacaa

SEQ ID NO: 339580 - RNA, 61 nt, Human
uuugucuaagaacuucgaaaacuuuaacaaacaggcugauaucuucauaauauucccagcc

SEQ ID NO: 339581 - RNA, 61 nt, Human
cuggacuaagaacuuucaaaauuuugaugaacaggcugauaccuucaugaaauucaagaca

SEQ ID NO: 339582 - RNA, 61 nt, Human
cuggacuaagaacuuucaaaauuuuaaugaacaggcugauaccuucaugaaauucaagaca

SEQ ID NO: 339583 - RNA, 61 nt, Human
cuggacuaagaacuuucaaaauuuuaaugaacaggcugauaccuucaugaaauucuagaca

SEQ ID NO: 339584 - RNA, 61 nt, Human
acugcaacaacugagacacugagaaaaagaacaggcugauaccuucaugaaauucaagaca

SEQ ID NO: 339585 - RNA, 61 nt, Human
uuuuguagaaauggagucucacuauguuucccaggcugaucuugaacuccugggcucaaga

SEQ ID NO: 339586 - RNA, 61 nt, Human
gggggaucacagaccauuucuuucuuucggccaggcugaggcccugacguggaugggcaaa

SEQ ID NO: 339587 - RNA, 61 nt, Human
cuuugggauugggcacugguccgcugacugccaggcugaagggacccgccaaggacugaac

SEQ ID NO: 339588 - RNA, 61 nt, Human
auuguaaucccaguacuuugggaggccaaggcaggcugauugcuugaggucaggaguuuga

SEQ ID NO: 339589 - RNA, 61 nt, Human
uucuuucugccccguugaagaggugcagccucaggcugagaaacacugauagaccaagagg

SEQ ID NO: 339590 - RNA, 61 nt, Human
gugcuugcucagagaggccaaacccugcucccaggcugaagccuggagucugcccccacuu

SEQ ID NO: 339591 - RNA, 62 nt, Human; identical to SEQ ID NO: 278219

SEQ ID NO: 339592 - RNA, 62 nt, Human; identical to SEQ ID NO: 278220

SEQ ID NO: 339593 - RNA, 62 nt, Human; identical to SEQ ID NO: 278262

SEQ ID NO: 339594 - RNA, 61 nt, Human
cugauuaccugcuugugccagggacuauucucaggcugaagaaggugggaggggagggcgg

SEQ ID NO: 339595 - RNA, 61 nt, Human
ggccugcuggagagcauagggucuggaacaccaggcugagguccugaucagcuucaaggag

SEQ ID NO: 339596 - RNA, 61 nt, Human
auaauuuucuuccuccagcuccagccaccaccaggcugagcagugaggagagaaaguuucu

SEQ ID NO: 339597 - RNA, 61 nt, Human
cagcuuccuggacaagaucgacgugaucaagcaggcugacuaugugccgagcgaucaggug

SEQ ID NO: 339598 - RNA, 61 nt, Human
gcgcauuccgugugcuuugcuuguggcugugcaggcugaggucuggagccaggcccagagc

SEQ ID NO: 339599 - RNA, 55 nt, Human
uggagagcccagugaacugacccuucaggcugagugugaagcgucucagaggcau

SEQ ID NO: 339600 - RNA, 61 nt, Human
uaccuuuguaugguggcacaaguggccgaaucaggcugaggaaucuacggcuugguuccag

SEQ ID NO: 339601 - RNA, 61 nt, Human
gagggugggaggucccggaguaacuucucuccaggcugaagggcggcgaggcauagucccg

SEQ ID NO: 339602 - RNA, 61 nt, Human
gacaccagugcacuaggcagcuggggcggcccaggcugaagccaucuccgggugucugaga

SEQ ID NO: 339603 - RNA, 61 nt, Human
cuugugugugugcauggugucagcccaaagccaggcugagacaguccucauauccucuuga

SEQ ID NO: 339604 - RNA, 61 nt, Human
uuaggcaaucacuuaaaacuccaaagaacuccaggcugaggaguucuuuuggugcugaaca

SEQ ID NO: 339605 - RNA, 61 nt, Human
ugagaccuggccuuggacucacaaggaagaccaggcugaggccccuccaggccaggguccu

SEQ ID NO: 339606 - RNA, 61 nt, Human
uuuuguagaaaugggguuucgccauguugcucaggcugaucucaaacuccugggcuccaac

SEQ ID NO: 339607 - RNA, 56 nt, Human
accagguguucuacgaauaggaggcgcaggcugacaggaaggugggugcggagugg

SEQ ID NO: 339608 - RNA, 61 nt, Human
cuuguggaagcuccccucauccguggugcagcaggcugagcacugcgcguuugccacgugc

SEQ ID NO: 339609 - RNA, 61 nt, Human
acuuccaggaccagaaugacguggagcugaacaggcugaacucuguaugugccuggccucc

SEQ ID NO: 339610 - RNA, 62 nt, Human; identical to SEQ ID NO: 278215

SEQ ID NO: 339611 - RNA, 62 nt, Human; identical to SEQ ID NO: 278216

SEQ ID NO: 339612 - RNA, 62 nt, Human; identical to SEQ ID NO: 278229

SEQ ID NO: 339613 - RNA, 62 nt, Human; identical to SEQ ID NO: 278230

SEQ ID NO: 339614 - RNA, 61 nt, Human
cucagcucugggccauucuccacagcaaccccaggcugaagcagguucccaagcucagagg

SEQ ID NO: 339615 - RNA, 61 nt, Human
uguggagggacaaguggacucagggcagcgccaggcugaccacagcacagccaacacgcac

SEQ ID NO: 339616 - RNA, 61 nt, Human
ucacucaacaacaucuuuguguugcuuucaccaggcugagacccuacccuaugggguauau

SEQ ID NO: 339617 - RNA, 61 nt, Human
aaaggaaaaucgugguugaguuucacugcagcaggcugacguugccugaugugagagcaag

SEQ ID NO: 339618 - RNA, 61 nt, Human
agagagagacaguuuuccaaacugugucacgcaggcugagugcacuggcaggaucacagcu

SEQ ID NO: 339619 - RNA, 61 nt, Human
ccacaaagaauagaaccuguacccaguucuucaggcugauuucccugaccucuugggcauu

SEQ ID NO: 339620 - RNA, 61 nt, Human
aaacagugccuuuuucaucaguugcauuuuccaggcugagagcuguauaaaacauuuugga

SEQ ID NO: 339621 - RNA, 61 nt, Human
gcaggagugcgauccgggcugggccgcugggcaggcugacccccugcccuccugcggccau

SEQ ID NO: 339622 - RNA, 61 nt, Human
uggggagagacuuuaggcagaagcugugaugcaggcugacugccagccgaggggcugggua

SEQ ID NO: 339623 - RNA, 61 nt, Human
gagcacagagauccugccuucuuccuacuaucaggcugaccuaaugggguugggcugcucg

SEQ ID NO: 339624 - RNA, 61 nt, Human
gcuggagauggcagccguuguuugcggagcccaggcugacuccggauucaacguugcuggg

SEQ ID NO: 339625 - RNA, 61 nt, Human
guggcucacgccuguaaucccagcacuuuggcaggcugaggcgggcagaucaccugagauc

SEQ ID NO: 339626 - RNA, 61 nt, Human
guuggagggguggagggauguuccccugagccaggcugagacuagaaccccaucuucccug

SEQ ID NO: 339627 - RNA, 61 nt, Human
ggcugagacuagaaccccaucuucccugagccaggcugagacuagaaccccaucuucccca

SEQ ID NO: 339628 - RNA, 61 nt, Human
guggcacacaucaguagucccagcuacucugcaggcugaggugggaggauugcuugaaccc

SEQ ID NO: 339629 - RNA, 61 nt, Human
ggugaagccagaauggagacacccgugaccucaggcugaaagucacucgacauuggucucu

SEQ ID NO: 339630 - RNA, 62 nt, Human; identical to SEQ ID NO: 278406

SEQ ID NO: 339631 - RNA, 62 nt, Human; identical to SEQ ID NO: 278407

SEQ ID NO: 339632 - RNA, 62 nt, Human; identical to SEQ ID NO: 278412

SEQ ID NO: 339633 - RNA, 61 nt, Human
cuccccgcacccggagccucagggaugggcucaggcugauggucagcugggcgcuuggaaa

SEQ ID NO: 339634 - RNA, 61 nt, Human
ucuucucagcucucugggucuggaaggagaacaggcugaggggagcugagaggagcugagg

SEQ ID NO: 339635 - RNA, 61 nt, Human
agccuacagauguuccugccaguggugccuucaggcugaugccaaucuagccucuccuguc

SEQ ID NO: 339636 - RNA, 61 nt, Human
gugcuggccccucugcagauggaaucagcuccaggcugacaccagcagaguccugcauggg

SEQ ID NO: 339637 - RNA, 61 nt, Human
gacuuuccauugauucaggggucugaugacacaggcugacucauggccgggcugacugccc

SEQ ID NO: 339638 - RNA, 61 nt, Human
acacagggcccagcacccagguugcugucggcaggcugaagacacuagaauccugaccugu

SEQ ID NO: 339639 - RNA, 61 nt, Human
cccucagaaaccccuucccccaacuugaccccaggcugaacagaccacugcaucucacugg

SEQ ID NO: 339640 - RNA, 61 nt, Human
ccccuggguggggaaggggcucacaugggcccaggcugagugugagugagcaugucaaguu

SEQ ID NO: 339641 - RNA, 61 nt, Human
uccacggccucccucuggcccguuggaggggcaggcugaggcuguggaggggacaagcacg

SEQ ID NO: 339642 - RNA, 61 nt, Human
uuucuuagagucaaggucuugcucuguugcccaggcugaucuuggacuugcgagccaccau

SEQ ID NO: 339643 - RNA, 61 nt, Human
uucuuuuucaugauucgucuuugaguaccuccaggcugaaagacuguuguaccaguaaaaa

SEQ ID NO: 339644 - RNA, 61 nt, Human
gugcuuucugauugaccugcugcagcccaaucaggcugaauucccacucuucagcgucuuu

SEQ ID NO: 339645 - RNA, 61 nt, Human
gucauuucugccuuuguuugggacaggcagacaggcugaggaagucaccagugauugugga

SEQ ID NO: 339646 - RNA, 61 nt, Human
auggcuguaaaauaggaagagcuuuaguucccaggcugaaccugccacugcuggagccauu

SEQ ID NO: 339647 - RNA, 61 nt, Human
cuccuaacacuagcaucagucccacucaucucaggcugagccacaucucacuuuuucgcuc

SEQ ID NO: 339648 - RNA, 61 nt, Human
ugguuuuuaccagagaggcuuugaauggaagcaggcugagaguagccaaagaggcaagggg

SEQ ID NO: 339649 - RNA, 62 nt, Human; identical to SEQ ID NO: 278211

SEQ ID NO: 339650 - RNA, 62 nt, Human; identical to SEQ ID NO: 278212

SEQ ID NO: 339651 - RNA, 62 nt, Human; identical to SEQ ID NO: 278264

SEQ ID NO: 339652 - RNA, 61 nt, Human
uuacagccuggccacucuagacauaugaauccaggcugacugcuuaagugcccaucucguu

SEQ ID NO: 339653 - RNA, 61 nt, Human
auagggucgaaacuguuguucaguauuuuuucaggcugaggaugugauguuacucuacaca

SEQ ID NO: 339654 - RNA, 61 nt, Human
cuucuguuuucuuuuagcgaccccccaccgccaggcugaucagaagcugaugacucgugga

SEQ ID NO: 339655 - RNA, 61 nt, Human
cauuuugaauccuauugauuauucaaaaauucaggcugauuugucuuuuaucagagguagg

SEQ ID NO: 339656 - RNA, 61 nt, Human
ccucuugggugaccuuccaaaacucugcucucaggcugaaaucuggcaucaucucagguuc

SEQ ID NO: 339657 - RNA, 61 nt, Human
uguaggggcuuccuuaggcugagagugcccccaggcugacaucuguguuggcuuuuguuca

SEQ ID NO: 339658 - RNA, 61 nt, Human
uaauuuagaaauggggucuuguuauguugcccaggcugaauucagacuccugggcuuaagg

SEQ ID NO: 339659 - RNA, 61 nt, Human
ccuugugucaucucauaaugguuggucuuuccaggcugagggaaauguuucuuguuuccag

SEQ ID NO: 339660 - RNA, 61 nt, Human
uauauuguuuuuagaucagugcuucaacauccaggcugacguuuagccauuuuggcugcug

SEQ ID NO: 339661 - RNA, 61 nt, Human
gagggacugagcagugaguggggcugaaggccaggcugagugccugggucagccaaacccc

SEQ ID NO: 339662 - RNA, 61 nt, Human; identical to SEQ ID NO: 339648

SEQ ID NO: 339663 - RNA, 64 nt, Human; identical to SEQ ID NO: 338586

SEQ ID NO: 339664 - RNA, 64 nt, Human; identical to SEQ ID NO: 338587

SEQ ID NO: 339665 - RNA, 64 nt, Human; identical to SEQ ID NO: 338592

SEQ ID NO: 339666 - RNA, 62 nt, Human; identical to SEQ ID NO: 278151

SEQ ID NO: 339667 - RNA, 62 nt, Human; identical to SEQ ID NO: 278152

SEQ ID NO: 339668 - RNA, 62 nt, Human; identical to SEQ ID NO: 278153

SEQ ID NO: 339669 - RNA, 64 nt, Human; identical to SEQ ID NO: 338593

SEQ ID NO: 339670 - RNA, 64 nt, Human; identical to SEQ ID NO: 338594

SEQ ID NO: 339671 - RNA, 64 nt, Human; identical to SEQ ID NO: 338595

SEQ ID NO: 339672 - RNA, 64 nt, Human; identical to SEQ ID NO: 338596

SEQ ID NO: 339673 - RNA, 64 nt, Human; identical to SEQ ID NO: 338597

SEQ ID NO: 339674 - RNA, 64 nt, Human; identical to SEQ ID NO: 338598

SEQ ID NO: 339675 - RNA, 64 nt, Human; identical to SEQ ID NO: 338599

SEQ ID NO: 339676 - RNA, 64 nt, Human; identical to SEQ ID NO: 338600

SEQ ID NO: 339677 - RNA, 64 nt, Human; identical to SEQ ID NO: 338601

SEQ ID NO: 339678 - RNA, 64 nt, Human; identical to SEQ ID NO: 338602

SEQ ID NO: 339679 - RNA, 64 nt, Human; identical to SEQ ID NO: 338603

SEQ ID NO: 339680 - RNA, 64 nt, Human; identical to SEQ ID NO: 338604

SEQ ID NO: 339681 - RNA, 64 nt, Human; identical to SEQ ID NO: 338605

SEQ ID NO: 339682 - RNA, 64 nt, Human; identical to SEQ ID NO: 338606

SEQ ID NO: 339683 - RNA, 64 nt, Human; identical to SEQ ID NO: 338607

SEQ ID NO: 339684 - RNA, 64 nt, Human; identical to SEQ ID NO: 338611

SEQ ID NO: 339685 - RNA, 62 nt, Human; identical to SEQ ID NO: 278154

SEQ ID NO: 339686 - RNA, 62 nt, Human; identical to SEQ ID NO: 278159

SEQ ID NO: 339687 - RNA, 55 nt, Human; identical to SEQ ID NO: 278161

SEQ ID NO: 339688 - RNA, 64 nt, Human; identical to SEQ ID NO: 338612

SEQ ID NO: 339689 - RNA, 64 nt, Human; identical to SEQ ID NO: 338613

SEQ ID NO: 339690 - RNA, 64 nt, Human; identical to SEQ ID NO: 338614

SEQ ID NO: 339691 - RNA, 64 nt, Human; identical to SEQ ID NO: 338615

SEQ ID NO: 339692 - RNA, 64 nt, Human; identical to SEQ ID NO: 338616

SEQ ID NO: 339693 - RNA, 64 nt, Human; identical to SEQ ID NO: 338617

SEQ ID NO: 339694 - RNA, 64 nt, Human; identical to SEQ ID NO: 338618

SEQ ID NO: 339695 - RNA, 64 nt, Human; identical to SEQ ID NO: 338619

SEQ ID NO: 339696 - RNA, 64 nt, Human; identical to SEQ ID NO: 338620

SEQ ID NO: 339697 - RNA, 64 nt, Human; identical to SEQ ID NO: 338621

SEQ ID NO: 339698 - RNA, 64 nt, Human; identical to SEQ ID NO: 338622

SEQ ID NO: 339699 - RNA, 64 nt, Human; identical to SEQ ID NO: 338623

SEQ ID NO: 339700 - RNA, 64 nt, Human; identical to SEQ ID NO: 338624

SEQ ID NO: 339701 - RNA, 64 nt, Human; identical to SEQ ID NO: 338625

SEQ ID NO: 339702 - RNA, 64 nt, Human; identical to SEQ ID NO: 338626

SEQ ID NO: 339703 - RNA, 64 nt, Human; identical to SEQ ID NO: 338630

SEQ ID NO: 339704 - RNA, 62 nt, Human; identical to SEQ ID NO: 278162

SEQ ID NO: 339705 - RNA, 62 nt, Human; identical to SEQ ID NO: 278163

SEQ ID NO: 339706 - RNA, 62 nt, Human; identical to SEQ ID NO: 278265

SEQ ID NO: 339707 - RNA, 64 nt, Human; identical to SEQ ID NO: 338631

SEQ ID NO: 339708 - RNA, 64 nt, Human; identical to SEQ ID NO: 338632

SEQ ID NO: 339709 - RNA, 64 nt, Human; identical to SEQ ID NO: 338633

SEQ ID NO: 339710 - RNA, 64 nt, Human; identical to SEQ ID NO: 338634

SEQ ID NO: 339711 - RNA, 64 nt, Human; identical to SEQ ID NO: 338635

SEQ ID NO: 339712 - RNA, 64 nt, Human; identical to SEQ ID NO: 338636

SEQ ID NO: 339713 - RNA, 64 nt, Human; identical to SEQ ID NO: 338637

SEQ ID NO: 339714 - RNA, 64 nt, Human; identical to SEQ ID NO: 338638

SEQ ID NO: 339715 - RNA, 64 nt, Human; identical to SEQ ID NO: 338639

SEQ ID NO: 339716 - RNA, 64 nt, Human; identical to SEQ ID NO: 338640

SEQ ID NO: 339717 - RNA, 64 nt, Human; identical to SEQ ID NO: 338641

SEQ ID NO: 339718 - RNA, 64 nt, Human; identical to SEQ ID NO: 338642

SEQ ID NO: 339719 - RNA, 64 nt, Human; identical to SEQ ID NO: 338643

SEQ ID NO: 339720 - RNA, 64 nt, Human; identical to SEQ ID NO: 338644

SEQ ID NO: 339721 - RNA, 64 nt, Human; identical to SEQ ID NO: 338645

SEQ ID NO: 339722 - RNA, 64 nt, Human; identical to SEQ ID NO: 338649

SEQ ID NO: 339723 - RNA, 62 nt, Human; identical to SEQ ID NO: 278165

SEQ ID NO: 339724 - RNA, 62 nt, Human; identical to SEQ ID NO: 278166

SEQ ID NO: 339725 - RNA, 62 nt, Human; identical to SEQ ID NO: 278167

SEQ ID NO: 339726 - RNA, 64 nt, Human; identical to SEQ ID NO: 338650

SEQ ID NO: 339727 - RNA, 64 nt, Human; identical to SEQ ID NO: 338651

SEQ ID NO: 339728 - RNA, 64 nt, Human; identical to SEQ ID NO: 338652

SEQ ID NO: 339729 - RNA, 64 nt, Human; identical to SEQ ID NO: 338653

SEQ ID NO: 339730 - RNA, 64 nt, Human; identical to SEQ ID NO: 338654

SEQ ID NO: 339731 - RNA, 64 nt, Human; identical to SEQ ID NO: 338655

SEQ ID NO: 339732 - RNA, 64 nt, Human; identical to SEQ ID NO: 338656

SEQ ID NO: 339733 - RNA, 64 nt, Human; identical to SEQ ID NO: 338657

SEQ ID NO: 339734 - RNA, 64 nt, Human; identical to SEQ ID NO: 338658

SEQ ID NO: 339735 - RNA, 64 nt, Human; identical to SEQ ID NO: 338659

SEQ ID NO: 339736 - RNA, 64 nt, Human; identical to SEQ ID NO: 338660

SEQ ID NO: 339737 - RNA, 64 nt, Human; identical to SEQ ID NO: 338661

SEQ ID NO: 339738 - RNA, 64 nt, Human; identical to SEQ ID NO: 338662

SEQ ID NO: 339739 - RNA, 64 nt, Human; identical to SEQ ID NO: 338663

SEQ ID NO: 339740 - RNA, 64 nt, Human; identical to SEQ ID NO: 338664

SEQ ID NO: 339741 - RNA, 64 nt, Human; identical to SEQ ID NO: 338668

SEQ ID NO: 339742 - RNA, 62 nt, Human; identical to SEQ ID NO: 278171

SEQ ID NO: 339743 - RNA, 62 nt, Human; identical to SEQ ID NO: 278176

SEQ ID NO: 339744 - RNA, 62 nt, Human; identical to SEQ ID NO: 278177

SEQ ID NO: 339745 - RNA, 64 nt, Human; identical to SEQ ID NO: 338669

SEQ ID NO: 339746 - RNA, 64 nt, Human; identical to SEQ ID NO: 338670

SEQ ID NO: 339747 - RNA, 64 nt, Human; identical to SEQ ID NO: 338671

SEQ ID NO: 339748 - RNA, 64 nt, Human; identical to SEQ ID NO: 338672

SEQ ID NO: 339749 - RNA, 64 nt, Human; identical to SEQ ID NO: 338673

SEQ ID NO: 339750 - RNA, 64 nt, Human; identical to SEQ ID NO: 338674

SEQ ID NO: 339751 - RNA, 64 nt, Human; identical to SEQ ID NO: 338675

SEQ ID NO: 339752 - RNA, 64 nt, Human; identical to SEQ ID NO: 338676

SEQ ID NO: 339753 - RNA, 64 nt, Human; identical to SEQ ID NO: 338677

SEQ ID NO: 339754 - RNA, 64 nt, Human; identical to SEQ ID NO: 338678

SEQ ID NO: 339755 - RNA, 64 nt, Human; identical to SEQ ID NO: 338679

SEQ ID NO: 339756 - RNA, 64 nt, Human; identical to SEQ ID NO: 338680

SEQ ID NO: 339757 - RNA, 64 nt, Human; identical to SEQ ID NO: 338681

SEQ ID NO: 339758 - RNA, 64 nt, Human; identical to SEQ ID NO: 338682

SEQ ID NO: 339759 - RNA, 64 nt, Human; identical to SEQ ID NO: 338683

SEQ ID NO: 339760 - RNA, 64 nt, Human; identical to SEQ ID NO: 338687

SEQ ID NO: 339761 - RNA, 62 nt, Human; identical to SEQ ID NO: 278168

SEQ ID NO: 339762 - RNA, 62 nt, Human; identical to SEQ ID NO: 278169

SEQ ID NO: 339763 - RNA, 62 nt, Human; identical to SEQ ID NO: 278180

SEQ ID NO: 339764 - RNA, 64 nt, Human; identical to SEQ ID NO: 338688

SEQ ID NO: 339765 - RNA, 64 nt, Human; identical to SEQ ID NO: 338689

SEQ ID NO: 339766 - RNA, 64 nt, Human; identical to SEQ ID NO: 338690

SEQ ID NO: 339767 - RNA, 64 nt, Human; identical to SEQ ID NO: 338691

SEQ ID NO: 339768 - RNA, 64 nt, Human; identical to SEQ ID NO: 338692

SEQ ID NO: 339769 - RNA, 64 nt, Human; identical to SEQ ID NO: 338693

SEQ ID NO: 339770 - RNA, 52 nt, Human; identical to SEQ ID NO: 338694

SEQ ID NO: 339771 - RNA, 64 nt, Human; identical to SEQ ID NO: 338695

SEQ ID NO: 339772 - RNA, 64 nt, Human; identical to SEQ ID NO: 338696

SEQ ID NO: 339773 - RNA, 64 nt, Human; identical to SEQ ID NO: 338697

SEQ ID NO: 339774 - RNA, 64 nt, Human; identical to SEQ ID NO: 338698

SEQ ID NO: 339775 - RNA, 64 nt, Human; identical to SEQ ID NO: 338699

SEQ ID NO: 339776 - RNA, 64 nt, Human; identical to SEQ ID NO: 338700

SEQ ID NO: 339777 - RNA, 64 nt, Human; identical to SEQ ID NO: 338701

SEQ ID NO: 339778 - RNA, 64 nt, Human; identical to SEQ ID NO: 338702

SEQ ID NO: 339779 - RNA, 64 nt, Human; identical to SEQ ID NO: 338706

SEQ ID NO: 339780 - RNA, 62 nt, Human; identical to SEQ ID NO: 278181

SEQ ID NO: 339781 - RNA, 62 nt, Human; identical to SEQ ID NO: 278182

SEQ ID NO: 339782 - RNA, 62 nt, Human; identical to SEQ ID NO: 278196

SEQ ID NO: 339783 - RNA, 64 nt, Human; identical to SEQ ID NO: 338707

SEQ ID NO: 339784 - RNA, 64 nt, Human; identical to SEQ ID NO: 338708

SEQ ID NO: 339785 - RNA, 64 nt, Human; identical to SEQ ID NO: 338709

SEQ ID NO: 339786 - RNA, 64 nt, Human; identical to SEQ ID NO: 338710

SEQ ID NO: 339787 - RNA, 64 nt, Human; identical to SEQ ID NO: 338711

SEQ ID NO: 339788 - RNA, 64 nt, Human; identical to SEQ ID NO: 338712

SEQ ID NO: 339789 - RNA, 64 nt, Human; identical to SEQ ID NO: 338713

SEQ ID NO: 339790 - RNA, 64 nt, Human; identical to SEQ ID NO: 338714

SEQ ID NO: 339791 - RNA, 64 nt, Human; identical to SEQ ID NO: 338715

SEQ ID NO: 339792 - RNA, 64 nt, Human; identical to SEQ ID NO: 338716

SEQ ID NO: 339793 - RNA, 64 nt, Human; identical to SEQ ID NO: 338717

SEQ ID NO: 339794 - RNA, 64 nt, Human; identical to SEQ ID NO: 338718

SEQ ID NO: 339795 - RNA, 64 nt, Human; identical to SEQ ID NO: 338719

SEQ ID NO: 339796 - RNA, 64 nt, Human; identical to SEQ ID NO: 338720

SEQ ID NO: 339797 - RNA, 64 nt, Human; identical to SEQ ID NO: 338721

SEQ ID NO: 339798 - RNA, 64 nt, Human; identical to SEQ ID NO: 338725

SEQ ID NO: 339799 - RNA, 62 nt, Human; identical to SEQ ID NO: 278184

SEQ ID NO: 339800 - RNA, 62 nt, Human; identical to SEQ ID NO: 278185

SEQ ID NO: 339801 - RNA, 62 nt, Human; identical to SEQ ID NO: 278186

SEQ ID NO: 339802 - RNA, 64 nt, Human; identical to SEQ ID NO: 338726

SEQ ID NO: 339803 - RNA, 64 nt, Human; identical to SEQ ID NO: 338727

SEQ ID NO: 339804 - RNA, 64 nt, Human; identical to SEQ ID NO: 338728

SEQ ID NO: 339805 - RNA, 64 nt, Human; identical to SEQ ID NO: 338729

SEQ ID NO: 339806 - RNA, 64 nt, Human; identical to SEQ ID NO: 338730

SEQ ID NO: 339807 - RNA, 64 nt, Human; identical to SEQ ID NO: 338731

SEQ ID NO: 339808 - RNA, 64 nt, Human; identical to SEQ ID NO: 338732

SEQ ID NO: 339809 - RNA, 64 nt, Human; identical to SEQ ID NO: 338733

SEQ ID NO: 339810 - RNA, 64 nt, Human; identical to SEQ ID NO: 338734

SEQ ID NO: 339811 - RNA, 64 nt, Human; identical to SEQ ID NO: 338735

SEQ ID NO: 339812 - RNA, 64 nt, Human; identical to SEQ ID NO: 338736

SEQ ID NO: 339813 - RNA, 64 nt, Human; identical to SEQ ID NO: 338737

SEQ ID NO: 339814 - RNA, 64 nt, Human; identical to SEQ ID NO: 338738

SEQ ID NO: 339815 - RNA, 64 nt, Human; identical to SEQ ID NO: 338739

SEQ ID NO: 339816 - RNA, 64 nt, Human; identical to SEQ ID NO: 338740

SEQ ID NO: 339817 - RNA, 64 nt, Human; identical to SEQ ID NO: 338744

SEQ ID NO: 339818 - RNA, 62 nt, Human; identical to SEQ ID NO: 278193

SEQ ID NO: 339819 - RNA, 62 nt, Human; identical to SEQ ID NO: 278194

SEQ ID NO: 339820 - RNA, 62 nt, Human; identical to SEQ ID NO: 278195

SEQ ID NO: 339821 - RNA, 64 nt, Human; identical to SEQ ID NO: 338745

SEQ ID NO: 339822 - RNA, 64 nt, Human; identical to SEQ ID NO: 338746

SEQ ID NO: 339823 - RNA, 64 nt, Human; identical to SEQ ID NO: 338747

SEQ ID NO: 339824 - RNA, 64 nt, Human; identical to SEQ ID NO: 338748

SEQ ID NO: 339825 - RNA, 64 nt, Human; identical to SEQ ID NO: 338749

SEQ ID NO: 339826 - RNA, 64 nt, Human; identical to SEQ ID NO: 338750

SEQ ID NO: 339827 - RNA, 64 nt, Human; identical to SEQ ID NO: 338751

SEQ ID NO: 339828 - RNA, 64 nt, Human; identical to SEQ ID NO: 338752

SEQ ID NO: 339829 - RNA, 64 nt, Human; identical to SEQ ID NO: 338753

SEQ ID NO: 339830 - RNA, 64 nt, Human; identical to SEQ ID NO: 338754

SEQ ID NO: 339831 - RNA, 64 nt, Human; identical to SEQ ID NO: 338755

SEQ ID NO: 339832 - RNA, 64 nt, Human; identical to SEQ ID NO: 338756

SEQ ID NO: 339833 - RNA, 64 nt, Human; identical to SEQ ID NO: 338757

SEQ ID NO: 339834 - RNA, 64 nt, Human; identical to SEQ ID NO: 338758

SEQ ID NO: 339835 - RNA, 64 nt, Human; identical to SEQ ID NO: 338759

SEQ ID NO: 339836 - RNA, 64 nt, Human; identical to SEQ ID NO: 338763

SEQ ID NO: 339837 - RNA, 62 nt, Human; identical to SEQ ID NO: 278131

SEQ ID NO: 339838 - RNA, 62 nt, Human; identical to SEQ ID NO: 278132

SEQ ID NO: 339839 - RNA, 62 nt, Human; identical to SEQ ID NO: 278178

SEQ ID NO: 339840 - RNA, 64 nt, Human; identical to SEQ ID NO: 338764

SEQ ID NO: 339841 - RNA, 64 nt, Human; identical to SEQ ID NO: 338765

SEQ ID NO: 339842 - RNA, 64 nt, Human; identical to SEQ ID NO: 338766

SEQ ID NO: 339843 - RNA, 64 nt, Human; identical to SEQ ID NO: 338767

SEQ ID NO: 339844 - RNA, 64 nt, Human; identical to SEQ ID NO: 338768

SEQ ID NO: 339845 - RNA, 64 nt, Human; identical to SEQ ID NO: 338769

SEQ ID NO: 339846 - RNA, 64 nt, Human; identical to SEQ ID NO: 338770

SEQ ID NO: 339847 - RNA, 64 nt, Human; identical to SEQ ID NO: 338771

SEQ ID NO: 339848 - RNA, 64 nt, Human; identical to SEQ ID NO: 338772

SEQ ID NO: 339849 - RNA, 64 nt, Human; identical to SEQ ID NO: 338773

SEQ ID NO: 339850 - RNA, 64 nt, Human; identical to SEQ ID NO: 338774

SEQ ID NO: 339851 - RNA, 64 nt, Human; identical to SEQ ID NO: 338775

SEQ ID NO: 339852 - RNA, 64 nt, Human; identical to SEQ ID NO: 338776

SEQ ID NO: 339853 - RNA, 64 nt, Human; identical to SEQ ID NO: 338777

SEQ ID NO: 339854 - RNA, 64 nt, Human; identical to SEQ ID NO: 338778

SEQ ID NO: 339855 - RNA, 64 nt, Human; identical to SEQ ID NO: 338782

SEQ ID NO: 339856 - RNA, 62 nt, Human; identical to SEQ ID NO: 278119

SEQ ID NO: 339857 - RNA, 62 nt, Human; identical to SEQ ID NO: 278120

SEQ ID NO: 339858 - RNA, 62 nt, Human; identical to SEQ ID NO: 278248

SEQ ID NO: 339859 - RNA, 64 nt, Human; identical to SEQ ID NO: 338783

SEQ ID NO: 339860 - RNA, 64 nt, Human; identical to SEQ ID NO: 338784

SEQ ID NO: 339861 - RNA, 64 nt, Human; identical to SEQ ID NO: 338785

SEQ ID NO: 339862 - RNA, 64 nt, Human; identical to SEQ ID NO: 338786

SEQ ID NO: 339863 - RNA, 64 nt, Human; identical to SEQ ID NO: 338787

SEQ ID NO: 339864 - RNA, 64 nt, Human; identical to SEQ ID NO: 338788

SEQ ID NO: 339865 - RNA, 64 nt, Human; identical to SEQ ID NO: 338789

SEQ ID NO: 339866 - RNA, 64 nt, Human; identical to SEQ ID NO: 338790

SEQ ID NO: 339867 - RNA, 64 nt, Human; identical to SEQ ID NO: 338791

SEQ ID NO: 339868 - RNA, 64 nt, Human; identical to SEQ ID NO: 338792

SEQ ID NO: 339869 - RNA, 64 nt, Human; identical to SEQ ID NO: 338793

SEQ ID NO: 339870 - RNA, 64 nt, Human; identical to SEQ ID NO: 338794

SEQ ID NO: 339871 - RNA, 64 nt, Human; identical to SEQ ID NO: 338795

SEQ ID NO: 339872 - RNA, 64 nt, Human; identical to SEQ ID NO: 338796

SEQ ID NO: 339873 - RNA, 64 nt, Human; identical to SEQ ID NO: 338797

SEQ ID NO: 339874 - RNA, 64 nt, Human; identical to SEQ ID NO: 338801

SEQ ID NO: 339875 - RNA, 62 nt, Human; identical to SEQ ID NO: 278198

SEQ ID NO: 339876 - RNA, 62 nt, Human; identical to SEQ ID NO: 278199

SEQ ID NO: 339877 - RNA, 62 nt, Human; identical to SEQ ID NO: 278200

SEQ ID NO: 339878 - RNA, 64 nt, Human; identical to SEQ ID NO: 338802

SEQ ID NO: 339879 - RNA, 64 nt, Human; identical to SEQ ID NO: 338803

SEQ ID NO: 339880 - RNA, 64 nt, Human; identical to SEQ ID NO: 338804

SEQ ID NO: 339881 - RNA, 64 nt, Human; identical to SEQ ID NO: 338805

SEQ ID NO: 339882 - RNA, 64 nt, Human; identical to SEQ ID NO: 338806

SEQ ID NO: 339883 - RNA, 64 nt, Human; identical to SEQ ID NO: 338807

SEQ ID NO: 339884 - RNA, 64 nt, Human; identical to SEQ ID NO: 338808

SEQ ID NO: 339885 - RNA, 64 nt, Human; identical to SEQ ID NO: 338809

SEQ ID NO: 339886 - RNA, 64 nt, Human; identical to SEQ ID NO: 338810

SEQ ID NO: 339887 - RNA, 64 nt, Human; identical to SEQ ID NO: 338811

SEQ ID NO: 339888 - RNA, 64 nt, Human; identical to SEQ ID NO: 338812

SEQ ID NO: 339889 - RNA, 64 nt, Human; identical to SEQ ID NO: 338813

SEQ ID NO: 339890 - RNA, 64 nt, Human; identical to SEQ ID NO: 338814

SEQ ID NO: 339891 - RNA, 64 nt, Human; identical to SEQ ID NO: 338815

SEQ ID NO: 339892 - RNA, 64 nt, Human; identical to SEQ ID NO: 338816

SEQ ID NO: 339893 - RNA, 64 nt, Human; identical to SEQ ID NO: 338820

SEQ ID NO: 339894 - RNA, 62 nt, Human; identical to SEQ ID NO: 278201

SEQ ID NO: 339895 - RNA, 62 nt, Human; identical to SEQ ID NO: 278202

SEQ ID NO: 339896 - RNA, 62 nt, Human; identical to SEQ ID NO: 278267

SEQ ID NO: 339897 - RNA, 64 nt, Human; identical to SEQ ID NO: 338821

SEQ ID NO: 339898 - RNA, 64 nt, Human; identical to SEQ ID NO: 338822

SEQ ID NO: 339899 - RNA, 64 nt, Human; identical to SEQ ID NO: 338823

SEQ ID NO: 339900 - RNA, 64 nt, Human; identical to SEQ ID NO: 338824

SEQ ID NO: 339901 - RNA, 64 nt, Human; identical to SEQ ID NO: 338825

SEQ ID NO: 339902 - RNA, 64 nt, Human; identical to SEQ ID NO: 338826

SEQ ID NO: 339903 - RNA, 64 nt, Human; identical to SEQ ID NO: 338827

SEQ ID NO: 339904 - RNA, 64 nt, Human; identical to SEQ ID NO: 338828

SEQ ID NO: 339905 - RNA, 64 nt, Human; identical to SEQ ID NO: 338829

SEQ ID NO: 339906 - RNA, 64 nt, Human; identical to SEQ ID NO: 338830

SEQ ID NO: 339907 - RNA, 64 nt, Human; identical to SEQ ID NO: 338831

SEQ ID NO: 339908 - RNA, 64 nt, Human; identical to SEQ ID NO: 338832

SEQ ID NO: 339909 - RNA, 64 nt, Human; identical to SEQ ID NO: 338833

SEQ ID NO: 339910 - RNA, 64 nt, Human; identical to SEQ ID NO: 338834

SEQ ID NO: 339911 - RNA, 64 nt, Human; identical to SEQ ID NO: 338835

SEQ ID NO: 339912 - RNA, 64 nt, Human; identical to SEQ ID NO: 338839

SEQ ID NO: 339913 - RNA, 62 nt, Human; identical to SEQ ID NO: 278092

SEQ ID NO: 339914 - RNA, 62 nt, Human; identical to SEQ ID NO: 278093

SEQ ID NO: 339915 - RNA, 62 nt, Human; identical to SEQ ID NO: 278095

SEQ ID NO: 339916 - RNA, 64 nt, Human; identical to SEQ ID NO: 338840

SEQ ID NO: 339917 - RNA, 64 nt, Human; identical to SEQ ID NO: 338841

SEQ ID NO: 339918 - RNA, 64 nt, Human; identical to SEQ ID NO: 338842

SEQ ID NO: 339919 - RNA, 64 nt, Human; identical to SEQ ID NO: 338843

SEQ ID NO: 339920 - RNA, 64 nt, Human; identical to SEQ ID NO: 338844

SEQ ID NO: 339921 - RNA, 64 nt, Human; identical to SEQ ID NO: 338845

SEQ ID NO: 339922 - RNA, 64 nt, Human; identical to SEQ ID NO: 338846

SEQ ID NO: 339923 - RNA, 64 nt, Human; identical to SEQ ID NO: 338847

SEQ ID NO: 339924 - RNA, 64 nt, Human; identical to SEQ ID NO: 338848

SEQ ID NO: 339925 - RNA, 64 nt, Human; identical to SEQ ID NO: 338849

SEQ ID NO: 339926 - RNA, 64 nt, Human; identical to SEQ ID NO: 338850

SEQ ID NO: 339927 - RNA, 64 nt, Human; identical to SEQ ID NO: 338851

SEQ ID NO: 339928 - RNA, 64 nt, Human; identical to SEQ ID NO: 338852

SEQ ID NO: 339929 - RNA, 64 nt, Human; identical to SEQ ID NO: 338853

SEQ ID NO: 339930 - RNA, 64 nt, Human; identical to SEQ ID NO: 338854

SEQ ID NO: 339931 - RNA, 64 nt, Human; identical to SEQ ID NO: 338858

SEQ ID NO: 339932 - RNA, 62 nt, Human; identical to SEQ ID NO: 278096

SEQ ID NO: 339933 - RNA, 62 nt, Human; identical to SEQ ID NO: 278097

SEQ ID NO: 339934 - RNA, 62 nt, Human; identical to SEQ ID NO: 278099

SEQ ID NO: 339935 - RNA, 64 nt, Human; identical to SEQ ID NO: 338859

SEQ ID NO: 339936 - RNA, 62 nt, Human; identical to SEQ ID NO: 338860

SEQ ID NO: 339937 - RNA, 64 nt, Human; identical to SEQ ID NO: 338861

SEQ ID NO: 339938 - RNA, 64 nt, Human; identical to SEQ ID NO: 338862

SEQ ID NO: 339939 - RNA, 64 nt, Human; identical to SEQ ID NO: 338863

SEQ ID NO: 339940 - RNA, 64 nt, Human; identical to SEQ ID NO: 338864

SEQ ID NO: 339941 - RNA, 64 nt, Human; identical to SEQ ID NO: 338865

SEQ ID NO: 339942 - RNA, 64 nt, Human; identical to SEQ ID NO: 338866

SEQ ID NO: 339943 - RNA, 64 nt, Human; identical to SEQ ID NO: 338867

SEQ ID NO: 339944 - RNA, 64 nt, Human; identical to SEQ ID NO: 338868

SEQ ID NO: 339945 - RNA, 64 nt, Human; identical to SEQ ID NO: 338869

SEQ ID NO: 339946 - RNA, 64 nt, Human; identical to SEQ ID NO: 338870

SEQ ID NO: 339947 - RNA, 64 nt, Human; identical to SEQ ID NO: 338871

SEQ ID NO: 339948 - RNA, 51 nt, Human; identical to SEQ ID NO: 338872

SEQ ID NO: 339949 - RNA, 64 nt, Human; identical to SEQ ID NO: 338873

SEQ ID NO: 339950 - RNA, 64 nt, Human; identical to SEQ ID NO: 338877

SEQ ID NO: 339951 - RNA, 62 nt, Human; identical to SEQ ID NO: 278103

SEQ ID NO: 339952 - RNA, 62 nt, Human; identical to SEQ ID NO: 278104

SEQ ID NO: 339953 - RNA, 62 nt, Human; identical to SEQ ID NO: 278108

SEQ ID NO: 339954 - RNA, 64 nt, Human; identical to SEQ ID NO: 338878

SEQ ID NO: 339955 - RNA, 64 nt, Human; identical to SEQ ID NO: 338879

SEQ ID NO: 339956 - RNA, 64 nt, Human; identical to SEQ ID NO: 338880

SEQ ID NO: 339957 - RNA, 64 nt, Human; identical to SEQ ID NO: 338881

SEQ ID NO: 339958 - RNA, 64 nt, Human; identical to SEQ ID NO: 338882

SEQ ID NO: 339959 - RNA, 64 nt, Human; identical to SEQ ID NO: 338883

SEQ ID NO: 339960 - RNA, 64 nt, Human; identical to SEQ ID NO: 338884

SEQ ID NO: 339961 - RNA, 64 nt, Human; identical to SEQ ID NO: 338885

SEQ ID NO: 339962 - RNA, 64 nt, Human; identical to SEQ ID NO: 338886

SEQ ID NO: 339963 - RNA, 64 nt, Human; identical to SEQ ID NO: 338887

SEQ ID NO: 339964 - RNA, 64 nt, Human; identical to SEQ ID NO: 338888

SEQ ID NO: 339965 - RNA, 64 nt, Human; identical to SEQ ID NO: 338889

SEQ ID NO: 339966 - RNA, 64 nt, Human; identical to SEQ ID NO: 338890

SEQ ID NO: 339967 - RNA, 64 nt, Human; identical to SEQ ID NO: 338891

SEQ ID NO: 339968 - RNA, 64 nt, Human; identical to SEQ ID NO: 338892

SEQ ID NO: 339969 - RNA, 64 nt, Human; identical to SEQ ID NO: 338896

SEQ ID NO: 339970 - RNA, 62 nt, Human; identical to SEQ ID NO: 278100

SEQ ID NO: 339971 - RNA, 62 nt, Human; identical to SEQ ID NO: 278101

SEQ ID NO: 339972 - RNA, 62 nt, Human; identical to SEQ ID NO: 278145

SEQ ID NO: 339973 - RNA, 64 nt, Human; identical to SEQ ID NO: 338897

SEQ ID NO: 339974 - RNA, 64 nt, Human; identical to SEQ ID NO: 338898

SEQ ID NO: 339975 - RNA, 64 nt, Human; identical to SEQ ID NO: 338899

SEQ ID NO: 339976 - RNA, 64 nt, Human; identical to SEQ ID NO: 338900

SEQ ID NO: 339977 - RNA, 64 nt, Human; identical to SEQ ID NO: 338901

SEQ ID NO: 339978 - RNA, 64 nt, Human; identical to SEQ ID NO: 338902

SEQ ID NO: 339979 - RNA, 51 nt, Human; identical to SEQ ID NO: 338903

SEQ ID NO: 339980 - RNA, 64 nt, Human; identical to SEQ ID NO: 338904

SEQ ID NO: 339981 - RNA, 64 nt, Human; identical to SEQ ID NO: 338905

SEQ ID NO: 339982 - RNA, 64 nt, Human; identical to SEQ ID NO: 338906

SEQ ID NO: 339983 - RNA, 64 nt, Human; identical to SEQ ID NO: 338907

SEQ ID NO: 339984 - RNA, 64 nt, Human; identical to SEQ ID NO: 338908

SEQ ID NO: 339985 - RNA, 64 nt, Human; identical to SEQ ID NO: 338909

SEQ ID NO: 339986 - RNA, 64 nt, Human; identical to SEQ ID NO: 338910

SEQ ID NO: 339987 - RNA, 64 nt, Human; identical to SEQ ID NO: 338911

SEQ ID NO: 339988 - RNA, 64 nt, Human; identical to SEQ ID NO: 338915

SEQ ID NO: 339989 - RNA, 62 nt, Human; identical to SEQ ID NO: 278079

SEQ ID NO: 339990 - RNA, 62 nt, Human; identical to SEQ ID NO: 278080

SEQ ID NO: 339991 - RNA, 62 nt, Human; identical to SEQ ID NO: 278112

SEQ ID NO: 339992 - RNA, 64 nt, Human; identical to SEQ ID NO: 338916

SEQ ID NO: 339993 - RNA, 64 nt, Human; identical to SEQ ID NO: 338917

SEQ ID NO: 339994 - RNA, 64 nt, Human; identical to SEQ ID NO: 338918

SEQ ID NO: 339995 - RNA, 64 nt, Human; identical to SEQ ID NO: 338919

SEQ ID NO: 339996 - RNA, 64 nt, Human; identical to SEQ ID NO: 338920

SEQ ID NO: 339997 - RNA, 64 nt, Human; identical to SEQ ID NO: 338921

SEQ ID NO: 339998 - RNA, 64 nt, Human; identical to SEQ ID NO: 338922

SEQ ID NO: 339999 - RNA, 64 nt, Human; identical to SEQ ID NO: 338923

SEQ ID NO: 340000 - RNA, 64 nt, Human; identical to SEQ ID NO: 338924

SEQ ID NO: 340001 - RNA, 64 nt, Human; identical to SEQ ID NO: 338925

SEQ ID NO: 340002 - RNA, 64 nt, Human; identical to SEQ ID NO: 338926

SEQ ID NO: 340003 - RNA, 64 nt, Human; identical to SEQ ID NO: 338927

SEQ ID NO: 340004 - RNA, 64 nt, Human; identical to SEQ ID NO: 338928

SEQ ID NO: 340005 - RNA, 64 nt, Human; identical to SEQ ID NO: 338929

SEQ ID NO: 340006 - RNA, 64 nt, Human; identical to SEQ ID NO: 338930

SEQ ID NO: 340007 - RNA, 64 nt, Human; identical to SEQ ID NO: 338934

SEQ ID NO: 340008 - RNA, 62 nt, Human; identical to SEQ ID NO: 278116

SEQ ID NO: 340009 - RNA, 62 nt, Human; identical to SEQ ID NO: 278117

SEQ ID NO: 340010 - RNA, 62 nt, Human; identical to SEQ ID NO: 278118

SEQ ID NO: 340011 - RNA, 64 nt, Human; identical to SEQ ID NO: 338935

SEQ ID NO: 340012 - RNA, 64 nt, Human; identical to SEQ ID NO: 338936

SEQ ID NO: 340013 - RNA, 64 nt, Human; identical to SEQ ID NO: 338937

SEQ ID NO: 340014 - RNA, 64 nt, Human; identical to SEQ ID NO: 338938

SEQ ID NO: 340015 - RNA, 64 nt, Human; identical to SEQ ID NO: 338939

SEQ ID NO: 340016 - RNA, 64 nt, Human; identical to SEQ ID NO: 338940

SEQ ID NO: 340017 - RNA, 64 nt, Human; identical to SEQ ID NO: 338941

SEQ ID NO: 340018 - RNA, 64 nt, Human; identical to SEQ ID NO: 338942

SEQ ID NO: 340019 - RNA, 64 nt, Human; identical to SEQ ID NO: 338943

SEQ ID NO: 340020 - RNA, 64 nt, Human; identical to SEQ ID NO: 338944

SEQ ID NO: 340021 - RNA, 64 nt, Human; identical to SEQ ID NO: 338945

SEQ ID NO: 340022 - RNA, 64 nt, Human; identical to SEQ ID NO: 338946

SEQ ID NO: 340023 - RNA, 64 nt, Human; identical to SEQ ID NO: 338947

SEQ ID NO: 340024 - RNA, 64 nt, Human; identical to SEQ ID NO: 338948

SEQ ID NO: 340025 - RNA, 63 nt, Human; identical to SEQ ID NO: 338949

SEQ ID NO: 340026 - RNA, 64 nt, Human; identical to SEQ ID NO: 338953

SEQ ID NO: 340027 - RNA, 62 nt, Human; identical to SEQ ID NO: 278109

SEQ ID NO: 340028 - RNA, 62 nt, Human; identical to SEQ ID NO: 278110

SEQ ID NO: 340029 - RNA, 62 nt, Human; identical to SEQ ID NO: 278126

SEQ ID NO: 340030 - RNA, 64 nt, Human; identical to SEQ ID NO: 338954

SEQ ID NO: 340031 - RNA, 64 nt, Human; identical to SEQ ID NO: 338955

SEQ ID NO: 340032 - RNA, 64 nt, Human; identical to SEQ ID NO: 338956

SEQ ID NO: 340033 - RNA, 64 nt, Human; identical to SEQ ID NO: 338957

SEQ ID NO: 340034 - RNA, 64 nt, Human; identical to SEQ ID NO: 338958

SEQ ID NO: 340035 - RNA, 64 nt, Human; identical to SEQ ID NO: 338959

SEQ ID NO: 340036 - RNA, 64 nt, Human; identical to SEQ ID NO: 338960

SEQ ID NO: 340037 - RNA, 64 nt, Human; identical to SEQ ID NO: 338961

SEQ ID NO: 340038 - RNA, 64 nt, Human; identical to SEQ ID NO: 338962

SEQ ID NO: 340039 - RNA, 64 nt, Human; identical to SEQ ID NO: 338963

SEQ ID NO: 340040 - RNA, 64 nt, Human; identical to SEQ ID NO: 338964

SEQ ID NO: 340041 - RNA, 64 nt, Human; identical to SEQ ID NO: 338965

SEQ ID NO: 340042 - RNA, 64 nt, Human; identical to SEQ ID NO: 338966

SEQ ID NO: 340043 - RNA, 64 nt, Human; identical to SEQ ID NO: 338967

SEQ ID NO: 340044 - RNA, 64 nt, Human; identical to SEQ ID NO: 338968

SEQ ID NO: 340045 - RNA, 64 nt, Human; identical to SEQ ID NO: 338972

SEQ ID NO: 340046 - RNA, 62 nt, Human; identical to SEQ ID NO: 278204

SEQ ID NO: 340047 - RNA, 62 nt, Human; identical to SEQ ID NO: 278209

SEQ ID NO: 340048 - RNA, 62 nt, Human; identical to SEQ ID NO: 278210

SEQ ID NO: 340049 - RNA, 64 nt, Human; identical to SEQ ID NO: 338973

SEQ ID NO: 340050 - RNA, 64 nt, Human; identical to SEQ ID NO: 338974

SEQ ID NO: 340051 - RNA, 64 nt, Human; identical to SEQ ID NO: 338975

SEQ ID NO: 340052 - RNA, 64 nt, Human; identical to SEQ ID NO: 338976

SEQ ID NO: 340053 - RNA, 64 nt, Human; identical to SEQ ID NO: 338977

SEQ ID NO: 340054 - RNA, 64 nt, Human; identical to SEQ ID NO: 338978

SEQ ID NO: 340055 - RNA, 64 nt, Human; identical to SEQ ID NO: 338979

SEQ ID NO: 340056 - RNA, 64 nt, Human; identical to SEQ ID NO: 338980

SEQ ID NO: 340057 - RNA, 64 nt, Human; identical to SEQ ID NO: 338981

SEQ ID NO: 340058 - RNA, 64 nt, Human; identical to SEQ ID NO: 338982

SEQ ID NO: 340059 - RNA, 64 nt, Human; identical to SEQ ID NO: 338983

SEQ ID NO: 340060 - RNA, 64 nt, Human; identical to SEQ ID NO: 338984

SEQ ID NO: 340061 - RNA, 64 nt, Human; identical to SEQ ID NO: 338985

SEQ ID NO: 340062 - RNA, 64 nt, Human; identical to SEQ ID NO: 338986

SEQ ID NO: 340063 - RNA, 64 nt, Human; identical to SEQ ID NO: 338987

SEQ ID NO: 340064 - RNA, 64 nt, Human; identical to SEQ ID NO: 338991

SEQ ID NO: 340065 - RNA, 62 nt, Human; identical to SEQ ID NO: 278069

SEQ ID NO: 340066 - RNA, 62 nt, Human; identical to SEQ ID NO: 278070

SEQ ID NO: 340067 - RNA, 62 nt, Human; identical to SEQ ID NO: 278130

SEQ ID NO: 340068 - RNA, 64 nt, Human; identical to SEQ ID NO: 338992

SEQ ID NO: 340069 - RNA, 64 nt, Human; identical to SEQ ID NO: 338993

SEQ ID NO: 340070 - RNA, 64 nt, Human; identical to SEQ ID NO: 338994

SEQ ID NO: 340071 - RNA, 64 nt, Human; identical to SEQ ID NO: 338995

SEQ ID NO: 340072 - RNA, 56 nt, Human; identical to SEQ ID NO: 338996

SEQ ID NO: 340073 - RNA, 56 nt, Human; identical to SEQ ID NO: 338996

SEQ ID NO: 340074 - RNA, 64 nt, Human; identical to SEQ ID NO: 338998

SEQ ID NO: 340075 - RNA, 64 nt, Human; identical to SEQ ID NO: 338999

SEQ ID NO: 340076 - RNA, 64 nt, Human; identical to SEQ ID NO: 339000

SEQ ID NO: 340077 - RNA, 64 nt, Human; identical to SEQ ID NO: 339001

SEQ ID NO: 340078 - RNA, 64 nt, Human; identical to SEQ ID NO: 339002

SEQ ID NO: 340079 - RNA, 64 nt, Human; identical to SEQ ID NO: 339003

SEQ ID NO: 340080 - RNA, 64 nt, Human; identical to SEQ ID NO: 339004

SEQ ID NO: 340081 - RNA, 64 nt, Human; identical to SEQ ID NO: 339005

SEQ ID NO: 340082 - RNA, 64 nt, Human; identical to SEQ ID NO: 339006

SEQ ID NO: 340083 - RNA, 64 nt, Human; identical to SEQ ID NO: 339010

SEQ ID NO: 340084 - RNA, 62 nt, Human; identical to SEQ ID NO: 278127

SEQ ID NO: 340085 - RNA, 62 nt, Human; identical to SEQ ID NO: 278128

SEQ ID NO: 340086 - RNA, 62 nt, Human; identical to SEQ ID NO: 278134

SEQ ID NO: 340087 - RNA, 64 nt, Human; identical to SEQ ID NO: 339011

SEQ ID NO: 340088 - RNA, 64 nt, Human; identical to SEQ ID NO: 339012

SEQ ID NO: 340089 - RNA, 64 nt, Human; identical to SEQ ID NO: 339013

SEQ ID NO: 340090 - RNA, 64 nt, Human; identical to SEQ ID NO: 339014

SEQ ID NO: 340091 - RNA, 64 nt, Human; identical to SEQ ID NO: 339015

SEQ ID NO: 340092 - RNA, 64 nt, Human; identical to SEQ ID NO: 339016

SEQ ID NO: 340093 - RNA, 64 nt, Human; identical to SEQ ID NO: 339017

SEQ ID NO: 340094 - RNA, 64 nt, Human; identical to SEQ ID NO: 339018

SEQ ID NO: 340095 - RNA, 64 nt, Human; identical to SEQ ID NO: 339019

SEQ ID NO: 340096 - RNA, 64 nt, Human; identical to SEQ ID NO: 339020

SEQ ID NO: 340097 - RNA, 64 nt, Human; identical to SEQ ID NO: 339021

SEQ ID NO: 340098 - RNA, 64 nt, Human; identical to SEQ ID NO: 339022

SEQ ID NO: 340099 - RNA, 64 nt, Human; identical to SEQ ID NO: 339023

SEQ ID NO: 340100 - RNA, 64 nt, Human; identical to SEQ ID NO: 339024

SEQ ID NO: 340101 - RNA, 64 nt, Human; identical to SEQ ID NO: 339025

SEQ ID NO: 340102 - RNA, 64 nt, Human; identical to SEQ ID NO: 339029

SEQ ID NO: 340103 - RNA, 62 nt, Human; identical to SEQ ID NO: 278142

SEQ ID NO: 340104 - RNA, 62 nt, Human; identical to SEQ ID NO: 278143

SEQ ID NO: 340105 - RNA, 62 nt, Human; identical to SEQ ID NO: 278144

SEQ ID NO: 340106 - RNA, 64 nt, Human; identical to SEQ ID NO: 339030

SEQ ID NO: 340107 - RNA, 64 nt, Human; identical to SEQ ID NO: 339031

SEQ ID NO: 340108 - RNA, 64 nt, Human; identical to SEQ ID NO: 339032

SEQ ID NO: 340109 - RNA, 64 nt, Human; identical to SEQ ID NO: 339033

SEQ ID NO: 340110 - RNA, 64 nt, Human; identical to SEQ ID NO: 339034

SEQ ID NO: 340111 - RNA, 64 nt, Human; identical to SEQ ID NO: 339035

SEQ ID NO: 340112 - RNA, 64 nt, Human; identical to SEQ ID NO: 339036

SEQ ID NO: 340113 - RNA, 64 nt, Human; identical to SEQ ID NO: 339037

SEQ ID NO: 340114 - RNA, 64 nt, Human; identical to SEQ ID NO: 339038

SEQ ID NO: 340115 - RNA, 64 nt, Human; identical to SEQ ID NO: 339039

SEQ ID NO: 340116 - RNA, 64 nt, Human; identical to SEQ ID NO: 339040

SEQ ID NO: 340117 - RNA, 64 nt, Human; identical to SEQ ID NO: 339041

SEQ ID NO: 340118 - RNA, 64 nt, Human; identical to SEQ ID NO: 339042

SEQ ID NO: 340119 - RNA, 64 nt, Human; identical to SEQ ID NO: 339043

SEQ ID NO: 340120 - RNA, 64 nt, Human; identical to SEQ ID NO: 339044

SEQ ID NO: 340121 - RNA, 64 nt, Human; identical to SEQ ID NO: 339048

SEQ ID NO: 340122 - RNA, 62 nt, Human; identical to SEQ ID NO: 278113

SEQ ID NO: 340123 - RNA, 62 nt, Human; identical to SEQ ID NO: 278114

SEQ ID NO: 340124 - RNA, 62 nt, Human; identical to SEQ ID NO: 278214

SEQ ID NO: 340125 - RNA, 64 nt, Human; identical to SEQ ID NO: 339049

SEQ ID NO: 340126 - RNA, 64 nt, Human; identical to SEQ ID NO: 339050

SEQ ID NO: 340127 - RNA, 64 nt, Human; identical to SEQ ID NO: 339051

SEQ ID NO: 340128 - RNA, 64 nt, Human; identical to SEQ ID NO: 339052

SEQ ID NO: 340129 - RNA, 64 nt, Human; identical to SEQ ID NO: 339053

SEQ ID NO: 340130 - RNA, 64 nt, Human; identical to SEQ ID NO: 339054

SEQ ID NO: 340131 - RNA, 64 nt, Human; identical to SEQ ID NO: 339055

SEQ ID NO: 340132 - RNA, 64 nt, Human; identical to SEQ ID NO: 339056

SEQ ID NO: 340133 - RNA, 64 nt, Human; identical to SEQ ID NO: 339057

SEQ ID NO: 340134 - RNA, 62 nt, Human; identical to SEQ ID NO: 339058

SEQ ID NO: 340135 - RNA, 64 nt, Human; identical to SEQ ID NO: 339059

SEQ ID NO: 340136 - RNA, 64 nt, Human; identical to SEQ ID NO: 339060

SEQ ID NO: 340137 - RNA, 64 nt, Human; identical to SEQ ID NO: 339061

SEQ ID NO: 340138 - RNA, 64 nt, Human; identical to SEQ ID NO: 339062

SEQ ID NO: 340139 - RNA, 64 nt, Human; identical to SEQ ID NO: 339063

SEQ ID NO: 340140 - RNA, 64 nt, Human; identical to SEQ ID NO: 339067

SEQ ID NO: 340141 - RNA, 62 nt, Human; identical to SEQ ID NO: 278187

SEQ ID NO: 340142 - RNA, 62 nt, Human; identical to SEQ ID NO: 278188

SEQ ID NO: 340143 - RNA, 62 nt, Human; identical to SEQ ID NO: 278218

SEQ ID NO: 340144 - RNA, 64 nt, Human; identical to SEQ ID NO: 339068

SEQ ID NO: 340145 - RNA, 64 nt, Human; identical to SEQ ID NO: 339069

SEQ ID NO: 340146 - RNA, 64 nt, Human; identical to SEQ ID NO: 339070

SEQ ID NO: 340147 - RNA, 64 nt, Human; identical to SEQ ID NO: 339071

SEQ ID NO: 340148 - RNA, 64 nt, Human; identical to SEQ ID NO: 339072

SEQ ID NO: 340149 - RNA, 64 nt, Human; identical to SEQ ID NO: 339073

SEQ ID NO: 340150 - RNA, 64 nt, Human; identical to SEQ ID NO: 339074

SEQ ID NO: 340151 - RNA, 64 nt, Human; identical to SEQ ID NO: 339075

SEQ ID NO: 340152 - RNA, 64 nt, Human; identical to SEQ ID NO: 339076

SEQ ID NO: 340153 - RNA, 64 nt, Human; identical to SEQ ID NO: 339077

SEQ ID NO: 340154 - RNA, 64 nt, Human; identical to SEQ ID NO: 339078

SEQ ID NO: 340155 - RNA, 64 nt, Human; identical to SEQ ID NO: 339079

SEQ ID NO: 340156 - RNA, 64 nt, Human; identical to SEQ ID NO: 339080

SEQ ID NO: 340157 - RNA, 64 nt, Human; identical to SEQ ID NO: 339081

SEQ ID NO: 340158 - RNA, 64 nt, Human; identical to SEQ ID NO: 339082

SEQ ID NO: 340159 - RNA, 64 nt, Human; identical to SEQ ID NO: 339086

SEQ ID NO: 340160 - RNA, 62 nt, Human; identical to SEQ ID NO: 278039

SEQ ID NO: 340161 - RNA, 60 nt, Human; identical to SEQ ID NO: 278040

SEQ ID NO: 340162 - RNA, 62 nt, Human; identical to SEQ ID NO: 278044

SEQ ID NO: 340163 - RNA, 64 nt, Human; identical to SEQ ID NO: 339087

SEQ ID NO: 340164 - RNA, 64 nt, Human; identical to SEQ ID NO: 339088

SEQ ID NO: 340165 - RNA, 64 nt, Human; identical to SEQ ID NO: 339089

SEQ ID NO: 340166 - RNA, 64 nt, Human; identical to SEQ ID NO: 339090

SEQ ID NO: 340167 - RNA, 64 nt, Human; identical to SEQ ID NO: 339091

SEQ ID NO: 340168 - RNA, 64 nt, Human; identical to SEQ ID NO: 339092

SEQ ID NO: 340169 - RNA, 64 nt, Human; identical to SEQ ID NO: 339093

SEQ ID NO: 340170 - RNA, 64 nt, Human; identical to SEQ ID NO: 339094

SEQ ID NO: 340171 - RNA, 57 nt, Human; identical to SEQ ID NO: 339095

SEQ ID NO: 340172 - RNA, 56 nt, Human; identical to SEQ ID NO: 339096

SEQ ID NO: 340173 - RNA, 64 nt, Human; identical to SEQ ID NO: 339097

SEQ ID NO: 340174 - RNA, 64 nt, Human; identical to SEQ ID NO: 339098

SEQ ID NO: 340175 - RNA, 64 nt, Human; identical to SEQ ID NO: 339099

SEQ ID NO: 340176 - RNA, 64 nt, Human; identical to SEQ ID NO: 339100

SEQ ID NO: 340177 - RNA, 64 nt, Human; identical to SEQ ID NO: 339101

SEQ ID NO: 340178 - RNA, 64 nt, Human; identical to SEQ ID NO: 339105

SEQ ID NO: 340179 - RNA, 62 nt, Human; identical to SEQ ID NO: 278047

SEQ ID NO: 340180 - RNA, 62 nt, Human; identical to SEQ ID NO: 278048

SEQ ID NO: 340181 - RNA, 62 nt, Human; identical to SEQ ID NO: 278049

SEQ ID NO: 340182 - RNA, 64 nt, Human; identical to SEQ ID NO: 339106

SEQ ID NO: 340183 - RNA, 64 nt, Human; identical to SEQ ID NO: 339107

SEQ ID NO: 340184 - RNA, 64 nt, Human; identical to SEQ ID NO: 339108

SEQ ID NO: 340185 - RNA, 64 nt, Human; identical to SEQ ID NO: 339109

SEQ ID NO: 340186 - RNA, 64 nt, Human; identical to SEQ ID NO: 339110

SEQ ID NO: 340187 - RNA, 64 nt, Human; identical to SEQ ID NO: 339111

SEQ ID NO: 340188 - RNA, 64 nt, Human; identical to SEQ ID NO: 339112

SEQ ID NO: 340189 - RNA, 64 nt, Human; identical to SEQ ID NO: 339113

SEQ ID NO: 340190 - RNA, 64 nt, Human; identical to SEQ ID NO: 339114

SEQ ID NO: 340191 - RNA, 64 nt, Human; identical to SEQ ID NO: 339115

SEQ ID NO: 340192 - RNA, 64 nt, Human; identical to SEQ ID NO: 339116

SEQ ID NO: 340193 - RNA, 64 nt, Human; identical to SEQ ID NO: 339117

SEQ ID NO: 340194 - RNA, 64 nt, Human; identical to SEQ ID NO: 339118

SEQ ID NO: 340195 - RNA, 64 nt, Human; identical to SEQ ID NO: 339119

SEQ ID NO: 340196 - RNA, 64 nt, Human; identical to SEQ ID NO: 339120

SEQ ID NO: 340197 - RNA, 64 nt, Human; identical to SEQ ID NO: 339124

SEQ ID NO: 340198 - RNA, 62 nt, Human; identical to SEQ ID NO: 278050

SEQ ID NO: 340199 - RNA, 62 nt, Human; identical to SEQ ID NO: 278051

SEQ ID NO: 340200 - RNA, 62 nt, Human; identical to SEQ ID NO: 278053

SEQ ID NO: 340201 - RNA, 61 nt, Human; identical to SEQ ID NO: 339125

SEQ ID NO: 340202 - RNA, 61 nt, Human; identical to SEQ ID NO: 339126

SEQ ID NO: 340203 - RNA, 57 nt, Human; identical to SEQ ID NO: 339127

SEQ ID NO: 340204 - RNA, 61 nt, Human; identical to SEQ ID NO: 339128

SEQ ID NO: 340205 - RNA, 61 nt, Human; identical to SEQ ID NO: 339129

SEQ ID NO: 340206 - RNA, 61 nt, Human; identical to SEQ ID NO: 339130

SEQ ID NO: 340207 - RNA, 61 nt, Human; identical to SEQ ID NO: 339135

SEQ ID NO: 340208 - RNA, 62 nt, Human; identical to SEQ ID NO: 278135

SEQ ID NO: 340209 - RNA, 62 nt, Human; identical to SEQ ID NO: 278136

SEQ ID NO: 340210 - RNA, 62 nt, Human; identical to SEQ ID NO: 278147

SEQ ID NO: 340211 - RNA, 62 nt, Human; identical to SEQ ID NO: 278148

SEQ ID NO: 340212 - RNA, 61 nt, Human; identical to SEQ ID NO: 339136

SEQ ID NO: 340213 - RNA, 61 nt, Human; identical to SEQ ID NO: 339137

SEQ ID NO: 340214 - RNA, 61 nt, Human; identical to SEQ ID NO: 339138

SEQ ID NO: 340215 - RNA, 61 nt, Human; identical to SEQ ID NO: 339139

SEQ ID NO: 340216 - RNA, 61 nt, Human; identical to SEQ ID NO: 339140

SEQ ID NO: 340217 - RNA, 61 nt, Human; identical to SEQ ID NO: 339141

SEQ ID NO: 340218 - RNA, 61 nt, Human; identical to SEQ ID NO: 339142

SEQ ID NO: 340219 - RNA, 61 nt, Human; identical to SEQ ID NO: 339143

SEQ ID NO: 340220 - RNA, 61 nt, Human; identical to SEQ ID NO: 339144

SEQ ID NO: 340221 - RNA, 61 nt, Human; identical to SEQ ID NO: 339145

SEQ ID NO: 340222 - RNA, 61 nt, Human; identical to SEQ ID NO: 339146

SEQ ID NO: 340223 - RNA, 61 nt, Human; identical to SEQ ID NO: 339147

SEQ ID NO: 340224 - RNA, 61 nt, Human; identical to SEQ ID NO: 339148

SEQ ID NO: 340225 - RNA, 61 nt, Human; identical to SEQ ID NO: 339149

SEQ ID NO: 340226 - RNA, 61 nt, Human; identical to SEQ ID NO: 339150

SEQ ID NO: 340227 - RNA, 61 nt, Human; identical to SEQ ID NO: 339154

SEQ ID NO: 340228 - RNA, 62 nt, Human; identical to SEQ ID NO: 278036

SEQ ID NO: 340229 - RNA, 62 nt, Human; identical to SEQ ID NO: 278037

SEQ ID NO: 340230 - RNA, 62 nt, Human; identical to SEQ ID NO: 278056

SEQ ID NO: 340231 - RNA, 61 nt, Human; identical to SEQ ID NO: 339155

SEQ ID NO: 340232 - RNA, 61 nt, Human; identical to SEQ ID NO: 339156

SEQ ID NO: 340233 - RNA, 61 nt, Human; identical to SEQ ID NO: 339157

SEQ ID NO: 340234 - RNA, 61 nt, Human; identical to SEQ ID NO: 339158

SEQ ID NO: 340235 - RNA, 61 nt, Human; identical to SEQ ID NO: 339159

SEQ ID NO: 340236 - RNA, 61 nt, Human; identical to SEQ ID NO: 339160

SEQ ID NO: 340237 - RNA, 61 nt, Human; identical to SEQ ID NO: 339161

SEQ ID NO: 340238 - RNA, 61 nt, Human; identical to SEQ ID NO: 339162

SEQ ID NO: 340239 - RNA, 61 nt, Human; identical to SEQ ID NO: 339163

SEQ ID NO: 340240 - RNA, 61 nt, Human; identical to SEQ ID NO: 339164

SEQ ID NO: 340241 - RNA, 61 nt, Human; identical to SEQ ID NO: 339165

SEQ ID NO: 340242 - RNA, 61 nt, Human; identical to SEQ ID NO: 339166

SEQ ID NO: 340243 - RNA, 61 nt, Human; identical to SEQ ID NO: 339167

SEQ ID NO: 340244 - RNA, 61 nt, Human; identical to SEQ ID NO: 339168

SEQ ID NO: 340245 - RNA, 61 nt, Human; identical to SEQ ID NO: 339169

SEQ ID NO: 340246 - RNA, 61 nt, Human; identical to SEQ ID NO: 339173

SEQ ID NO: 340247 - RNA, 64 nt, Human
agccacagagauagagcugaggaguccuguguucccccgcaaggagcaccccgggaucauuuuc

SEQ ID NO: 340248 - RNA, 64 nt, Human
ucuaccauccccuucccuggcugcuggaaauggaccccgcaacccuguccucugcugggccccc

SEQ ID NO: 340249 - RNA, 62 nt, Human; identical to SEQ ID NO: 278045

SEQ ID NO: 340250 - RNA, 61 nt, Human; identical to SEQ ID NO: 339174

SEQ ID NO: 340251 - RNA, 61 nt, Human; identical to SEQ ID NO: 339175

SEQ ID NO: 340252 - RNA, 61 nt, Human; identical to SEQ ID NO: 339176

SEQ ID NO: 340253 - RNA, 61 nt, Human; identical to SEQ ID NO: 339177

SEQ ID NO: 340254 - RNA, 61 nt, Human; identical to SEQ ID NO: 339178

SEQ ID NO: 340255 - RNA, 61 nt, Human; identical to SEQ ID NO: 339179

SEQ ID NO: 340256 - RNA, 61 nt, Human; identical to SEQ ID NO: 339180

SEQ ID NO: 340257 - RNA, 61 nt, Human; identical to SEQ ID NO: 339181

SEQ ID NO: 340258 - RNA, 61 nt, Human; identical to SEQ ID NO: 339182

SEQ ID NO: 340259 - RNA, 61 nt, Human; identical to SEQ ID NO: 339183

SEQ ID NO: 340260 - RNA, 61 nt, Human; identical to SEQ ID NO: 339184

SEQ ID NO: 340261 - RNA, 61 nt, Human; identical to SEQ ID NO: 339185

SEQ ID NO: 340262 - RNA, 61 nt, Human; identical to SEQ ID NO: 339186

SEQ ID NO: 340263 - RNA, 61 nt, Human; identical to SEQ ID NO: 339187

SEQ ID NO: 340264 - RNA, 61 nt, Human; identical to SEQ ID NO: 339188

SEQ ID NO: 340265 - RNA, 61 nt, Human; identical to SEQ ID NO: 339192

SEQ ID NO: 340266 - RNA, 64 nt, Human
agcuguggcuuuauccaucagcucccugggccuuccccgcaacccaccucggggaucugaggau

SEQ ID NO: 340267 - RNA, 64 nt, Human
cccagagcugggugaguggggagacaccucagagccccgcaaaacccacugaccggaggcaaaa

SEQ ID NO: 340268 - RNA, 50 nt, Human; identical to SEQ ID NO: 278060

SEQ ID NO: 340269 - RNA, 61 nt, Human; identical to SEQ ID NO: 339193

SEQ ID NO: 340270 - RNA, 61 nt, Human; identical to SEQ ID NO: 339194

SEQ ID NO: 340271 - RNA, 61 nt, Human; identical to SEQ ID NO: 339195

SEQ ID NO: 340272 - RNA, 61 nt, Human; identical to SEQ ID NO: 339196

SEQ ID NO: 340273 - RNA, 61 nt, Human; identical to SEQ ID NO: 339197

SEQ ID NO: 340274 - RNA, 61 nt, Human; identical to SEQ ID NO: 339198

SEQ ID NO: 340275 - RNA, 61 nt, Human; identical to SEQ ID NO: 339199

SEQ ID NO: 340276 - RNA, 61 nt, Human; identical to SEQ ID NO: 339200

SEQ ID NO: 340277 - RNA, 61 nt, Human; identical to SEQ ID NO: 339201

SEQ ID NO: 340278 - RNA, 61 nt, Human; identical to SEQ ID NO: 339202

SEQ ID NO: 340279 - RNA, 61 nt, Human; identical to SEQ ID NO: 339203

SEQ ID NO: 340280 - RNA, 61 nt, Human; identical to SEQ ID NO: 339204

SEQ ID NO: 340281 - RNA, 61 nt, Human; identical to SEQ ID NO: 339205

SEQ ID NO: 340282 - RNA, 61 nt, Human; identical to SEQ ID NO: 339206

SEQ ID NO: 340283 - RNA, 61 nt, Human; identical to SEQ ID NO: 339207

SEQ ID NO: 340284 - RNA, 61 nt, Human; identical to SEQ ID NO: 339211

SEQ ID NO: 340285 - RNA, 64 nt, Human
uauagcacacucuccgauuugggccauuuaugcaccccgcaaccugggaucucaaggagcuuua

SEQ ID NO: 340286 - RNA, 64 nt, Human
ugugagcagagaccccgugcagugcauucagacaccccgcaaagcaggacucuguggaaauuga

SEQ ID NO: 340287 - RNA, 62 nt, Human; identical to SEQ ID NO: 278054

SEQ ID NO: 340288 - RNA, 61 nt, Human; identical to SEQ ID NO: 339212

SEQ ID NO: 340289 - RNA, 61 nt, Human; identical to SEQ ID NO: 339213

SEQ ID NO: 340290 - RNA, 61 nt, Human; identical to SEQ ID NO: 339214

SEQ ID NO: 340291 - RNA, 61 nt, Human; identical to SEQ ID NO: 339215

SEQ ID NO: 340292 - RNA, 61 nt, Human; identical to SEQ ID NO: 339216

SEQ ID NO: 340293 - RNA, 61 nt, Human; identical to SEQ ID NO: 339217

SEQ ID NO: 340294 - RNA, 61 nt, Human; identical to SEQ ID NO: 339218

SEQ ID NO: 340295 - RNA, 61 nt, Human; identical to SEQ ID NO: 339219

SEQ ID NO: 340296 - RNA, 56 nt, Human; identical to SEQ ID NO: 339220

SEQ ID NO: 340297 - RNA, 61 nt, Human; identical to SEQ ID NO: 339221

SEQ ID NO: 340298 - RNA, 61 nt, Human; identical to SEQ ID NO: 339222

SEQ ID NO: 340299 - RNA, 61 nt, Human; identical to SEQ ID NO: 339223

SEQ ID NO: 340300 - RNA, 61 nt, Human; identical to SEQ ID NO: 339224

SEQ ID NO: 340301 - RNA, 61 nt, Human; identical to SEQ ID NO: 339225

SEQ ID NO: 340302 - RNA, 61 nt, Human; identical to SEQ ID NO: 339226

SEQ ID NO: 340303 - RNA, 61 nt, Human; identical to SEQ ID NO: 339230

SEQ ID NO: 340304 - RNA, 62 nt, Human; identical to SEQ ID NO: 278062

SEQ ID NO: 340305 - RNA, 62 nt, Human; identical to SEQ ID NO: 278063

SEQ ID NO: 340306 - RNA, 62 nt, Human; identical to SEQ ID NO: 278064

SEQ ID NO: 340307 - RNA, 61 nt, Human; identical to SEQ ID NO: 339231

SEQ ID NO: 340308 - RNA, 61 nt, Human; identical to SEQ ID NO: 339232

SEQ ID NO: 340309 - RNA, 61 nt, Human; identical to SEQ ID NO: 339233

SEQ ID NO: 340310 - RNA, 61 nt, Human; identical to SEQ ID NO: 339234

SEQ ID NO: 340311 - RNA, 61 nt, Human; identical to SEQ ID NO: 339235

SEQ ID NO: 340312 - RNA, 61 nt, Human; identical to SEQ ID NO: 339236

SEQ ID NO: 340313 - RNA, 61 nt, Human; identical to SEQ ID NO: 339237

SEQ ID NO: 340314 - RNA, 61 nt, Human; identical to SEQ ID NO: 339238

SEQ ID NO: 340315 - RNA, 61 nt, Human; identical to SEQ ID NO: 339239

SEQ ID NO: 340316 - RNA, 61 nt, Human; identical to SEQ ID NO: 339240

SEQ ID NO: 340317 - RNA, 61 nt, Human; identical to SEQ ID NO: 339241

SEQ ID NO: 340318 - RNA, 61 nt, Human; identical to SEQ ID NO: 339242

SEQ ID NO: 340319 - RNA, 61 nt, Human; identical to SEQ ID NO: 339243

SEQ ID NO: 340320 - RNA, 61 nt, Human; identical to SEQ ID NO: 339244

SEQ ID NO: 340321 - RNA, 61 nt, Human; identical to SEQ ID NO: 339245

SEQ ID NO: 340322 - RNA, 61 nt, Human; identical to SEQ ID NO: 339249

SEQ ID NO: 340323 - RNA, 62 nt, Human; identical to SEQ ID NO: 278065

SEQ ID NO: 340324 - RNA, 62 nt, Human; identical to SEQ ID NO: 278066

SEQ ID NO: 340325 - RNA, 62 nt, Human; identical to SEQ ID NO: 278068

SEQ ID NO: 340326 - RNA, 61 nt, Human; identical to SEQ ID NO: 339250

SEQ ID NO: 340327 - RNA, 61 nt, Human; identical to SEQ ID NO: 339251

SEQ ID NO: 340328 - RNA, 61 nt, Human; identical to SEQ ID NO: 339252

SEQ ID NO: 340329 - RNA, 61 nt, Human; identical to SEQ ID NO: 339253

SEQ ID NO: 340330 - RNA, 61 nt, Human; identical to SEQ ID NO: 339254

SEQ ID NO: 340331 - RNA, 61 nt, Human; identical to SEQ ID NO: 339255

SEQ ID NO: 340332 - RNA, 61 nt, Human; identical to SEQ ID NO: 339256

SEQ ID NO: 340333 - RNA, 61 nt, Human; identical to SEQ ID NO: 339257

SEQ ID NO: 340334 - RNA, 61 nt, Human; identical to SEQ ID NO: 339258

SEQ ID NO: 340335 - RNA, 61 nt, Human; identical to SEQ ID NO: 339259

SEQ ID NO: 340336 - RNA, 61 nt, Human; identical to SEQ ID NO: 339260

SEQ ID NO: 340337 - RNA, 61 nt, Human; identical to SEQ ID NO: 339261

SEQ ID NO: 340338 - RNA, 61 nt, Human; identical to SEQ ID NO: 339262

SEQ ID NO: 340339 - RNA, 61 nt, Human; identical to SEQ ID NO: 339263

SEQ ID NO: 340340 - RNA, 61 nt, Human; identical to SEQ ID NO: 339264

SEQ ID NO: 340341 - RNA, 61 nt, Human; identical to SEQ ID NO: 339268

SEQ ID NO: 340342 - RNA, 64 nt, Human
ucugaagcuccuuuccccuugcucuuggucccugccccgcaagcaaaccugcccccucugccuc

SEQ ID NO: 340343 - RNA, 64 nt, Human
guuaccuccgcauuugacacgagucugcugugaaccccgcaaccuccuccccaccucccaucuc

SEQ ID NO: 340344 - RNA, 62 nt, Human; identical to SEQ ID NO: 278149

SEQ ID NO: 340345 - RNA, 61 nt, Human; identical to SEQ ID NO: 339269

SEQ ID NO: 340346 - RNA, 61 nt, Human; identical to SEQ ID NO: 339270

SEQ ID NO: 340347 - RNA, 61 nt, Human; identical to SEQ ID NO: 339271

SEQ ID NO: 340348 - RNA, 61 nt, Human; identical to SEQ ID NO: 339272

SEQ ID NO: 340349 - RNA, 61 nt, Human; identical to SEQ ID NO: 339273

SEQ ID NO: 340350 - RNA, 61 nt, Human; identical to SEQ ID NO: 339274

SEQ ID NO: 340351 - RNA, 61 nt, Human; identical to SEQ ID NO: 339275

SEQ ID NO: 340352 - RNA, 61 nt, Human; identical to SEQ ID NO: 339276

SEQ ID NO: 340353 - RNA, 61 nt, Human; identical to SEQ ID NO: 339277

SEQ ID NO: 340354 - RNA, 61 nt, Human; identical to SEQ ID NO: 339278

SEQ ID NO: 340355 - RNA, 61 nt, Human; identical to SEQ ID NO: 339279

SEQ ID NO: 340356 - RNA, 61 nt, Human; identical to SEQ ID NO: 339280

SEQ ID NO: 340357 - RNA, 61 nt, Human; identical to SEQ ID NO: 339281

SEQ ID NO: 340358 - RNA, 59 nt, Human; identical to SEQ ID NO: 339282

SEQ ID NO: 340359 - RNA, 61 nt, Human; identical to SEQ ID NO: 339283

SEQ ID NO: 340360 - RNA, 61 nt, Human; identical to SEQ ID NO: 339288

SEQ ID NO: 340361 - RNA, 62 nt, Human; identical to SEQ ID NO: 278072

SEQ ID NO: 340362 - RNA, 62 nt, Human; identical to SEQ ID NO: 278076

SEQ ID NO: 340363 - RNA, 62 nt, Human; identical to SEQ ID NO: 278077

SEQ ID NO: 340364 - RNA, 62 nt, Human; identical to SEQ ID NO: 278078

SEQ ID NO: 340365 - RNA, 61 nt, Human; identical to SEQ ID NO: 339289

SEQ ID NO: 340366 - RNA, 61 nt, Human; identical to SEQ ID NO: 339290

SEQ ID NO: 340367 - RNA, 61 nt, Human; identical to SEQ ID NO: 339291

SEQ ID NO: 340368 - RNA, 61 nt, Human; identical to SEQ ID NO: 339292

SEQ ID NO: 340369 - RNA, 61 nt, Human; identical to SEQ ID NO: 339293

SEQ ID NO: 340370 - RNA, 61 nt, Human; identical to SEQ ID NO: 339294

SEQ ID NO: 340371 - RNA, 61 nt, Human; identical to SEQ ID NO: 339295

SEQ ID NO: 340372 - RNA, 61 nt, Human; identical to SEQ ID NO: 339296

SEQ ID NO: 340373 - RNA, 61 nt, Human; identical to SEQ ID NO: 339297

SEQ ID NO: 340374 - RNA, 61 nt, Human; identical to SEQ ID NO: 339298

SEQ ID NO: 340375 - RNA, 61 nt, Human; identical to SEQ ID NO: 339299

SEQ ID NO: 340376 - RNA, 61 nt, Human; identical to SEQ ID NO: 339300

SEQ ID NO: 340377 - RNA, 61 nt, Human; identical to SEQ ID NO: 339301

SEQ ID NO: 340378 - RNA, 61 nt, Human; identical to SEQ ID NO: 339302

SEQ ID NO: 340379 - RNA, 61 nt, Human; identical to SEQ ID NO: 339303

SEQ ID NO: 340380 - RNA, 61 nt, Human; identical to SEQ ID NO: 339307

SEQ ID NO: 340381 - RNA, 64 nt, Human
ugagccgggagggucgaacgcccagggcacugcgccccgcaacugacgcuccugcaaggaaaag

SEQ ID NO: 340382 - RNA, 64 nt, Human
gguucuagucaauucugaaccaccaccccccgccccccgcaaaaaaguaaaagucaaaccaaac

SEQ ID NO: 340383 - RNA, 64 nt, Human
gaaaacucauagacacaucggcuguucacacguuccccgcaaucugagaacgaacaggaaugga

SEQ ID NO: 340384 - RNA, 61 nt, Human; identical to SEQ ID NO: 339308

SEQ ID NO: 340385 - RNA, 61 nt, Human; identical to SEQ ID NO: 339309

SEQ ID NO: 340386 - RNA, 61 nt, Human; identical to SEQ ID NO: 339310

SEQ ID NO: 340387 - RNA, 61 nt, Human; identical to SEQ ID NO: 339311

SEQ ID NO: 340388 - RNA, 59 nt, Human; identical to SEQ ID NO: 339312

SEQ ID NO: 340389 - RNA, 61 nt, Human; identical to SEQ ID NO: 339313

SEQ ID NO: 340390 - RNA, 61 nt, Human; identical to SEQ ID NO: 339314

SEQ ID NO: 340391 - RNA, 61 nt, Human; identical to SEQ ID NO: 339315

SEQ ID NO: 340392 - RNA, 61 nt, Human; identical to SEQ ID NO: 339316

SEQ ID NO: 340393 - RNA, 61 nt, Human; identical to SEQ ID NO: 339317

SEQ ID NO: 340394 - RNA, 61 nt, Human; identical to SEQ ID NO: 339318

SEQ ID NO: 340395 - RNA, 61 nt, Human; identical to SEQ ID NO: 339319

SEQ ID NO: 340396 - RNA, 61 nt, Human; identical to SEQ ID NO: 339320

SEQ ID NO: 340397 - RNA, 61 nt, Human; identical to SEQ ID NO: 339321

SEQ ID NO: 340398 - RNA, 61 nt, Human; identical to SEQ ID NO: 339322

SEQ ID NO: 340399 - RNA, 61 nt, Human; identical to SEQ ID NO: 339326

SEQ ID NO: 340400 - RNA, 62 nt, Human; identical to SEQ ID NO: 278082

SEQ ID NO: 340401 - RNA, 62 nt, Human; identical to SEQ ID NO: 278083

SEQ ID NO: 340402 - RNA, 62 nt, Human; identical to SEQ ID NO: 278084

SEQ ID NO: 340403 - RNA, 62 nt, Human; identical to SEQ ID NO: 278085

SEQ ID NO: 340404 - RNA, 61 nt, Human; identical to SEQ ID NO: 339327

SEQ ID NO: 340405 - RNA, 61 nt, Human; identical to SEQ ID NO: 339328

SEQ ID NO: 340406 - RNA, 61 nt, Human; identical to SEQ ID NO: 339329

SEQ ID NO: 340407 - RNA, 61 nt, Human; identical to SEQ ID NO: 339330

SEQ ID NO: 340408 - RNA, 61 nt, Human; identical to SEQ ID NO: 339331

SEQ ID NO: 340409 - RNA, 61 nt, Human; identical to SEQ ID NO: 339332

SEQ ID NO: 340410 - RNA, 61 nt, Human; identical to SEQ ID NO: 339333

SEQ ID NO: 340411 - RNA, 61 nt, Human; identical to SEQ ID NO: 339334

SEQ ID NO: 340412 - RNA, 61 nt, Human; identical to SEQ ID NO: 339335

SEQ ID NO: 340413 - RNA, 61 nt, Human; identical to SEQ ID NO: 339336

SEQ ID NO: 340414 - RNA, 61 nt, Human; identical to SEQ ID NO: 339337

SEQ ID NO: 340415 - RNA, 61 nt, Human; identical to SEQ ID NO: 339338

SEQ ID NO: 340416 - RNA, 61 nt, Human; identical to SEQ ID NO: 339339

SEQ ID NO: 340417 - RNA, 61 nt, Human; identical to SEQ ID NO: 339340

SEQ ID NO: 340418 - RNA, 61 nt, Human; identical to SEQ ID NO: 339341

SEQ ID NO: 340419 - RNA, 61 nt, Human; identical to SEQ ID NO: 339345

SEQ ID NO: 340420 - RNA, 64 nt, Human
cggccaccgccccagccucaccccaucccacgacccccgcaacccuucacaucaccccccucga

SEQ ID NO: 340421 - RNA, 64 nt, Human
cuccuggggacauuuccucaaagcaguuuugcgcccccgcaagggaauggucagccuaagggua

SEQ ID NO: 340422 - RNA, 64 nt, Human
uggagcuggcugagucacagccaccuccccaccuccccgcaagcuggucccaucgaccagcaag

SEQ ID NO: 340423 - RNA, 61 nt, Human; identical to SEQ ID NO: 339346

SEQ ID NO: 340424 - RNA, 61 nt, Human; identical to SEQ ID NO: 339347

SEQ ID NO: 340425 - RNA, 61 nt, Human; identical to SEQ ID NO: 339348

SEQ ID NO: 340426 - RNA, 61 nt, Human; identical to SEQ ID NO: 339349

SEQ ID NO: 340427 - RNA, 61 nt, Human; identical to SEQ ID NO: 339350

SEQ ID NO: 340428 - RNA, 61 nt, Human; identical to SEQ ID NO: 339351

SEQ ID NO: 340429 - RNA, 61 nt, Human; identical to SEQ ID NO: 339352

SEQ ID NO: 340430 - RNA, 61 nt, Human; identical to SEQ ID NO: 339353

SEQ ID NO: 340431 - RNA, 61 nt, Human; identical to SEQ ID NO: 339354

SEQ ID NO: 340432 - RNA, 61 nt, Human; identical to SEQ ID NO: 339355

SEQ ID NO: 340433 - RNA, 61 nt, Human; identical to SEQ ID NO: 339356

SEQ ID NO: 340434 - RNA, 61 nt, Human; identical to SEQ ID NO: 339357

SEQ ID NO: 340435 - RNA, 61 nt, Human; identical to SEQ ID NO: 339358

SEQ ID NO: 340436 - RNA, 61 nt, Human; identical to SEQ ID NO: 339359

SEQ ID NO: 340437 - RNA, 61 nt, Human; identical to SEQ ID NO: 339360

SEQ ID NO: 340438 - RNA, 61 nt, Human; identical to SEQ ID NO: 339364

SEQ ID NO: 340439 - RNA, 64 nt, Human
ggaugggagaagaaggaaggggguggcccgucacccccgcaagacuugcauccagguagccuaa

SEQ ID NO: 340440 - RNA, 64 nt, Human
ccaggcccugggacucugagcguccgugucucucccccgcaacccauccucagccggggccguc

SEQ ID NO: 340441 - RNA, 64 nt, Human
gaggccaaacaggcccuccucccucccagcuccaccccgcaagcaccauccccuccggcuaagc

SEQ ID NO: 340442 - RNA, 61 nt, Human; identical to SEQ ID NO: 339365

SEQ ID NO: 340443 - RNA, 61 nt, Human; identical to SEQ ID NO: 339366

SEQ ID NO: 340444 - RNA, 61 nt, Human; identical to SEQ ID NO: 339367

SEQ ID NO: 340445 - RNA, 61 nt, Human; identical to SEQ ID NO: 339368

SEQ ID NO: 340446 - RNA, 61 nt, Human; identical to SEQ ID NO: 339369

SEQ ID NO: 340447 - RNA, 61 nt, Human; identical to SEQ ID NO: 339370

SEQ ID NO: 340448 - RNA, 61 nt, Human; identical to SEQ ID NO: 339371

SEQ ID NO: 340449 - RNA, 61 nt, Human; identical to SEQ ID NO: 339372

SEQ ID NO: 340450 - RNA, 61 nt, Human; identical to SEQ ID NO: 339373

SEQ ID NO: 340451 - RNA, 61 nt, Human; identical to SEQ ID NO: 339374

SEQ ID NO: 340452 - RNA, 59 nt, Human; identical to SEQ ID NO: 339375

SEQ ID NO: 340453 - RNA, 61 nt, Human; identical to SEQ ID NO: 339376

SEQ ID NO: 340454 - RNA, 61 nt, Human; identical to SEQ ID NO: 339377

SEQ ID NO: 340455 - RNA, 61 nt, Human; identical to SEQ ID NO: 339378

SEQ ID NO: 340456 - RNA, 61 nt, Human; identical to SEQ ID NO: 339379

SEQ ID NO: 340457 - RNA, 61 nt, Human; identical to SEQ ID NO: 339384

SEQ ID NO: 340458 - RNA, 64 nt, Human
uccauuaggugauacauagauaagggcuuuuucuccccgcaaacaccccuaagaaugguucugu

SEQ ID NO: 340459 - RNA, 64 nt, Human
guagaaaccagguuauuucucccugcuuauggcuccccgcaaagggacuugcagcguguccugc

SEQ ID NO: 340460 - RNA, 64 nt, Human
caguccagugaauccacgacccgcagaccuguccccccgcaacagcuuauaccauggaaugagg

SEQ ID NO: 340461 - RNA, 61 nt, Human; identical to SEQ ID NO: 339385

SEQ ID NO: 340462 - RNA, 61 nt, Human; identical to SEQ ID NO: 339386

SEQ ID NO: 340463 - RNA, 61 nt, Human; identical to SEQ ID NO: 339387

SEQ ID NO: 340464 - RNA, 61 nt, Human; identical to SEQ ID NO: 339388

SEQ ID NO: 340465 - RNA, 61 nt, Human; identical to SEQ ID NO: 339389

SEQ ID NO: 340466 - RNA, 61 nt, Human; identical to SEQ ID NO: 339390

SEQ ID NO: 340467 - RNA, 61 nt, Human; identical to SEQ ID NO: 339391

SEQ ID NO: 340468 - RNA, 61 nt, Human; identical to SEQ ID NO: 339392

SEQ ID NO: 340469 - RNA, 61 nt, Human; identical to SEQ ID NO: 339393

SEQ ID NO: 340470 - RNA, 61 nt, Human; identical to SEQ ID NO: 339394

SEQ ID NO: 340471 - RNA, 61 nt, Human; identical to SEQ ID NO: 339395

SEQ ID NO: 340472 - RNA, 61 nt, Human; identical to SEQ ID NO: 339396

SEQ ID NO: 340473 - RNA, 61 nt, Human; identical to SEQ ID NO: 339397

SEQ ID NO: 340474 - RNA, 61 nt, Human; identical to SEQ ID NO: 339398

SEQ ID NO: 340475 - RNA, 61 nt, Human; identical to SEQ ID NO: 339399

SEQ ID NO: 340476 - RNA, 61 nt, Human; identical to SEQ ID NO: 339404

SEQ ID NO: 340477 - RNA, 64 nt, Human
uggccagcccccagggcuuguccaccagucuucuccccgcaaggcccucagagcagcgccugug

SEQ ID NO: 340478 - RNA, 64 nt, Human
gccuucaaagucuaccagcacaaagaccccugagccccgcaauugugaucccacaagacaugca

SEQ ID NO: 340479 - RNA, 64 nt, Human
uaccuuccauucccaccacacagacucugggccuccccgcaaaauggcuccagaauuagaguaa

SEQ ID NO: 340480 - RNA, 61 nt, Human; identical to SEQ ID NO: 339405

SEQ ID NO: 340481 - RNA, 61 nt, Human; identical to SEQ ID NO: 339406

SEQ ID NO: 340482 - RNA, 61 nt, Human; identical to SEQ ID NO: 339407

SEQ ID NO: 340483 - RNA, 61 nt, Human; identical to SEQ ID NO: 339408

SEQ ID NO: 340484 - RNA, 61 nt, Human; identical to SEQ ID NO: 339409

SEQ ID NO: 340485 - RNA, 61 nt, Human; identical to SEQ ID NO: 339410

SEQ ID NO: 340486 - RNA, 61 nt, Human; identical to SEQ ID NO: 339411

SEQ ID NO: 340487 - RNA, 61 nt, Human; identical to SEQ ID NO: 339412

SEQ ID NO: 340488 - RNA, 61 nt, Human; identical to SEQ ID NO: 339413

SEQ ID NO: 340489 - RNA, 61 nt, Human; identical to SEQ ID NO: 339414

SEQ ID NO: 340490 - RNA, 61 nt, Human; identical to SEQ ID NO: 339415

SEQ ID NO: 340491 - RNA, 61 nt, Human; identical to SEQ ID NO: 339416

SEQ ID NO: 340492 - RNA, 61 nt, Human; identical to SEQ ID NO: 339417

SEQ ID NO: 340493 - RNA, 61 nt, Human; identical to SEQ ID NO: 339418

SEQ ID NO: 340494 - RNA, 61 nt, Human; identical to SEQ ID NO: 339419

SEQ ID NO: 340495 - RNA, 61 nt, Human; identical to SEQ ID NO: 339423

SEQ ID NO: 340496 - RNA, 64 nt, Human
aaacauguuuagcaaaaaccaauucaguuccauuccccgcaaaaaaccccuaacuuuacucuga

SEQ ID NO: 340497 - RNA, 64 nt, Human
uuauuggaaggcagcucccgcauaccaggauaacccccgcaaaccacauagcagacccccgcca

SEQ ID NO: 340498 - RNA, 64 nt, Human
guuucugcucagucugucccccuucccccucgacccccgcaaugagugggcaccaggggacgcu

SEQ ID NO: 340499 - RNA, 61 nt, Human; identical to SEQ ID NO: 339424

SEQ ID NO: 340500 - RNA, 61 nt, Human; identical to SEQ ID NO: 339425

SEQ ID NO: 340501 - RNA, 61 nt, Human; identical to SEQ ID NO: 339426

SEQ ID NO: 340502 - RNA, 61 nt, Human; identical to SEQ ID NO: 339427

SEQ ID NO: 340503 - RNA, 61 nt, Human; identical to SEQ ID NO: 339428

SEQ ID NO: 340504 - RNA, 61 nt, Human; identical to SEQ ID NO: 339429

SEQ ID NO: 340505 - RNA, 61 nt, Human; identical to SEQ ID NO: 339430

SEQ ID NO: 340506 - RNA, 61 nt, Human; identical to SEQ ID NO: 339431

SEQ ID NO: 340507 - RNA, 61 nt, Human; identical to SEQ ID NO: 339432

SEQ ID NO: 340508 - RNA, 61 nt, Human; identical to SEQ ID NO: 339433

SEQ ID NO: 340509 - RNA, 61 nt, Human; identical to SEQ ID NO: 339434

SEQ ID NO: 340510 - RNA, 61 nt, Human; identical to SEQ ID NO: 339435

SEQ ID NO: 340511 - RNA, 61 nt, Human; identical to SEQ ID NO: 339436

SEQ ID NO: 340512 - RNA, 61 nt, Human; identical to SEQ ID NO: 339437

SEQ ID NO: 340513 - RNA, 61 nt, Human; identical to SEQ ID NO: 339438

SEQ ID NO: 340514 - RNA, 61 nt, Human; identical to SEQ ID NO: 339442

SEQ ID NO: 340515 - RNA, 64 nt, Human
cauuguaacuaaaaucuuccucaggacuauuaacccccgcaaaguuucuauagggaacugccua

SEQ ID NO: 340516 - RNA, 64 nt, Human
uggggagaaaaacucucaucccugacccuuccccccccgcaaauguuagaccagagcuguugau

SEQ ID NO: 340517 - RNA, 64 nt, Human
uguggagaccagacucugcaaguggggagaccacccccgcaagccagugacaagggagcccuga

SEQ ID NO: 340518 - RNA, 61 nt, Human; identical to SEQ ID NO: 339443

SEQ ID NO: 340519 - RNA, 61 nt, Human; identical to SEQ ID NO: 339444

SEQ ID NO: 340520 - RNA, 61 nt, Human; identical to SEQ ID NO: 339445

SEQ ID NO: 340521 - RNA, 61 nt, Human; identical to SEQ ID NO: 339446

SEQ ID NO: 340522 - RNA, 61 nt, Human; identical to SEQ ID NO: 339447

SEQ ID NO: 340523 - RNA, 61 nt, Human; identical to SEQ ID NO: 339448

SEQ ID NO: 340524 - RNA, 61 nt, Human; identical to SEQ ID NO: 339449

SEQ ID NO: 340525 - RNA, 61 nt, Human; identical to SEQ ID NO: 339450

SEQ ID NO: 340526 - RNA, 61 nt, Human; identical to SEQ ID NO: 339451

SEQ ID NO: 340527 - RNA, 61 nt, Human; identical to SEQ ID NO: 339452

SEQ ID NO: 340528 - RNA, 61 nt, Human; identical to SEQ ID NO: 339453

SEQ ID NO: 340529 - RNA, 61 nt, Human; identical to SEQ ID NO: 339454

SEQ ID NO: 340530 - RNA, 61 nt, Human; identical to SEQ ID NO: 339455

SEQ ID NO: 340531 - RNA, 61 nt, Human; identical to SEQ ID NO: 339456

SEQ ID NO: 340532 - RNA, 61 nt, Human; identical to SEQ ID NO: 339457

SEQ ID NO: 340533 - RNA, 61 nt, Human; identical to SEQ ID NO: 339461

SEQ ID NO: 340534 - RNA, 64 nt, Human
acugccccucaaguucaaccccgggaccgcccagccccgcaaagcaaagacccugacuucuccu

SEQ ID NO: 340535 - RNA, 64 nt, Human
agaggaucuuuaggccugaguugugaagcgcaacccccgcaaaacgcauuugccaucacaguug

SEQ ID NO: 340536 - RNA, 62 nt, Human; identical to SEQ ID NO: 278088

SEQ ID NO: 340537 - RNA, 61 nt, Human; identical to SEQ ID NO: 339462

SEQ ID NO: 340538 - RNA, 61 nt, Human; identical to SEQ ID NO: 339463

SEQ ID NO: 340539 - RNA, 61 nt, Human; identical to SEQ ID NO: 339464

SEQ ID NO: 340540 - RNA, 61 nt, Human; identical to SEQ ID NO: 339465

SEQ ID NO: 340541 - RNA, 61 nt, Human; identical to SEQ ID NO: 339466

SEQ ID NO: 340542 - RNA, 61 nt, Human; identical to SEQ ID NO: 339467

SEQ ID NO: 340543 - RNA, 61 nt, Human; identical to SEQ ID NO: 339468

SEQ ID NO: 340544 - RNA, 61 nt, Human; identical to SEQ ID NO: 339469

SEQ ID NO: 340545 - RNA, 61 nt, Human; identical to SEQ ID NO: 339470

SEQ ID NO: 340546 - RNA, 61 nt, Human; identical to SEQ ID NO: 339471

SEQ ID NO: 340547 - RNA, 61 nt, Human; identical to SEQ ID NO: 339472

SEQ ID NO: 340548 - RNA, 61 nt, Human; identical to SEQ ID NO: 339473

SEQ ID NO: 340549 - RNA, 61 nt, Human; identical to SEQ ID NO: 339474

SEQ ID NO: 340550 - RNA, 61 nt, Human; identical to SEQ ID NO: 339475

SEQ ID NO: 340551 - RNA, 61 nt, Human; identical to SEQ ID NO: 339476

SEQ ID NO: 340552 - RNA, 61 nt, Human; identical to SEQ ID NO: 339480

SEQ ID NO: 340553 - RNA, 64 nt, Human
ccuccagaauccugaugguaucaauggauuuaucccccgcaaagacaucaaaccugaguaucag

SEQ ID NO: 340554 - RNA, 64 nt, Human
uaaaguagaucaccuccucgaacccacuccgguuccccgcaacccacagcucagcugcccaucc

SEQ ID NO: 340555 - RNA, 64 nt, Human
ggcuccaggccgugggggcugcugaaggcucuuuccccgcaagggccagguguugacaccuuaa

SEQ ID NO: 340556 - RNA, 61 nt, Human; identical to SEQ ID NO: 339481

SEQ ID NO: 340557 - RNA, 61 nt, Human; identical to SEQ ID NO: 339482

SEQ ID NO: 340558 - RNA, 61 nt, Human; identical to SEQ ID NO: 339483

SEQ ID NO: 340559 - RNA, 61 nt, Human; identical to SEQ ID NO: 339484

SEQ ID NO: 340560 - RNA, 61 nt, Human; identical to SEQ ID NO: 339485

SEQ ID NO: 340561 - RNA, 61 nt, Human; identical to SEQ ID NO: 339486

SEQ ID NO: 340562 - RNA, 61 nt, Human; identical to SEQ ID NO: 339487

SEQ ID NO: 340563 - RNA, 61 nt, Human; identical to SEQ ID NO: 339488

SEQ ID NO: 340564 - RNA, 61 nt, Human; identical to SEQ ID NO: 339489

SEQ ID NO: 340565 - RNA, 61 nt, Human; identical to SEQ ID NO: 339490

SEQ ID NO: 340566 - RNA, 61 nt, Human; identical to SEQ ID NO: 339491

SEQ ID NO: 340567 - RNA, 61 nt, Human; identical to SEQ ID NO: 339492

SEQ ID NO: 340568 - RNA, 61 nt, Human; identical to SEQ ID NO: 339493

SEQ ID NO: 340569 - RNA, 61 nt, Human; identical to SEQ ID NO: 339494

SEQ ID NO: 340570 - RNA, 61 nt, Human; identical to SEQ ID NO: 339495

SEQ ID NO: 340571 - RNA, 61 nt, Human; identical to SEQ ID NO: 339499

SEQ ID NO: 340572 - RNA, 64 nt, Human
acuaacugaggagcuaguguuaauccagagaaccccccgcaaugugcuuccgagauucagacug

SEQ ID NO: 340573 - RNA, 64 nt, Human
gauuaagauagguucuuucuguauaugaaacgcuccccgcaaauucacuggcagcucagaauua

SEQ ID NO: 340574 - RNA, 64 nt, Human
gagccuggccuguaacuuauaaagugcaccucgcccccgcaagccccagccccgaggaccgucc

SEQ ID NO: 340575 - RNA, 61 nt, Human; identical to SEQ ID NO: 339500

SEQ ID NO: 340576 - RNA, 61 nt, Human; identical to SEQ ID NO: 339501

SEQ ID NO: 340577 - RNA, 61 nt, Human; identical to SEQ ID NO: 339502

SEQ ID NO: 340578 - RNA, 61 nt, Human; identical to SEQ ID NO: 339503

SEQ ID NO: 340579 - RNA, 52 nt, Human; identical to SEQ ID NO: 339504

SEQ ID NO: 340580 - RNA, 61 nt, Human; identical to SEQ ID NO: 339505

SEQ ID NO: 340581 - RNA, 61 nt, Human; identical to SEQ ID NO: 339506

SEQ ID NO: 340582 - RNA, 61 nt, Human; identical to SEQ ID NO: 339507

SEQ ID NO: 340583 - RNA, 61 nt, Human; identical to SEQ ID NO: 339508

SEQ ID NO: 340584 - RNA, 61 nt, Human; identical to SEQ ID NO: 339509

SEQ ID NO: 340585 - RNA, 59 nt, Human; identical to SEQ ID NO: 339510

SEQ ID NO: 340586 - RNA, 61 nt, Human; identical to SEQ ID NO: 339511

SEQ ID NO: 340587 - RNA, 61 nt, Human; identical to SEQ ID NO: 339512

SEQ ID NO: 340588 - RNA, 61 nt, Human; identical to SEQ ID NO: 339513

SEQ ID NO: 340589 - RNA, 61 nt, Human; identical to SEQ ID NO: 339514

SEQ ID NO: 340590 - RNA, 61 nt, Human; identical to SEQ ID NO: 339518

SEQ ID NO: 340591 - RNA, 64 nt, Human
ccccaccccacccacccucggggcgccccccuccccccgcaagccagccugggccagccccgcu

SEQ ID NO: 340592 - RNA, 64 nt, Human
aguguccccgccucuguagacaauggcucugacuccccgcaacuuccugccucugagagaccug

SEQ ID NO: 340593 - RNA, 64 nt, Human
uauauaaguuauuuguugcagcauaacaaaugauccccgcaaauuuuguggcuucaaacacgaa

SEQ ID NO: 340594 - RNA, 61 nt, Human; identical to SEQ ID NO: 339519

SEQ ID NO: 340595 - RNA, 61 nt, Human; identical to SEQ ID NO: 339520

SEQ ID NO: 340596 - RNA, 61 nt, Human; identical to SEQ ID NO: 339521

SEQ ID NO: 340597 - RNA, 61 nt, Human; identical to SEQ ID NO: 339522

SEQ ID NO: 340598 - RNA, 61 nt, Human; identical to SEQ ID NO: 339523

SEQ ID NO: 340599 - RNA, 61 nt, Human; identical to SEQ ID NO: 339524

SEQ ID NO: 340600 - RNA, 61 nt, Human; identical to SEQ ID NO: 339525

SEQ ID NO: 340601 - RNA, 61 nt, Human; identical to SEQ ID NO: 339526

SEQ ID NO: 340602 - RNA, 61 nt, Human; identical to SEQ ID NO: 339527

SEQ ID NO: 340603 - RNA, 61 nt, Human; identical to SEQ ID NO: 339528

SEQ ID NO: 340604 - RNA, 61 nt, Human; identical to SEQ ID NO: 339529

SEQ ID NO: 340605 - RNA, 61 nt, Human; identical to SEQ ID NO: 339530

SEQ ID NO: 340606 - RNA, 61 nt, Human; identical to SEQ ID NO: 339531

SEQ ID NO: 340607 - RNA, 61 nt, Human; identical to SEQ ID NO: 339532

SEQ ID NO: 340608 - RNA, 61 nt, Human; identical to SEQ ID NO: 339533

SEQ ID NO: 340609 - RNA, 53 nt, Human; identical to SEQ ID NO: 339537

SEQ ID NO: 340610 - RNA, 64 nt, Human
aagagacagacaugagagacaagcaucuucuuucccccgcaaguccauuuuauuuccuucuugu

SEQ ID NO: 340611 - RNA, 64 nt, Human
acugucccuuucugugugaagaucacguuccuucccccgcaaugugcccccagacgcacguggg

SEQ ID NO: 340612 - RNA, 62 nt, Human; identical to SEQ ID NO: 278086

SEQ ID NO: 340613 - RNA, 61 nt, Human; identical to SEQ ID NO: 339538

SEQ ID NO: 340614 - RNA, 61 nt, Human; identical to SEQ ID NO: 339539

SEQ ID NO: 340615 - RNA, 61 nt, Human; identical to SEQ ID NO: 339540

SEQ ID NO: 340616 - RNA, 61 nt, Human; identical to SEQ ID NO: 339541

SEQ ID NO: 340617 - RNA, 61 nt, Human; identical to SEQ ID NO: 339542

SEQ ID NO: 340618 - RNA, 61 nt, Human; identical to SEQ ID NO: 339543

SEQ ID NO: 340619 - RNA, 61 nt, Human; identical to SEQ ID NO: 339544

SEQ ID NO: 340620 - RNA, 61 nt, Human; identical to SEQ ID NO: 339545

SEQ ID NO: 340621 - RNA, 61 nt, Human; identical to SEQ ID NO: 339546

SEQ ID NO: 340622 - RNA, 61 nt, Human; identical to SEQ ID NO: 339547

SEQ ID NO: 340623 - RNA, 61 nt, Human; identical to SEQ ID NO: 339548

SEQ ID NO: 340624 - RNA, 61 nt, Human; identical to SEQ ID NO: 339549

SEQ ID NO: 340625 - RNA, 61 nt, Human; identical to SEQ ID NO: 339550

SEQ ID NO: 340626 - RNA, 61 nt, Human; identical to SEQ ID NO: 339551

SEQ ID NO: 340627 - RNA, 61 nt, Human; identical to SEQ ID NO: 339552

SEQ ID NO: 340628 - RNA, 61 nt, Human; identical to SEQ ID NO: 339556

SEQ ID NO: 340629 - RNA, 64 nt, Human
gucaaggauuccagucaggugucuaucccaacuggucagggagagaagggcagacccauucuca

SEQ ID NO: 340630 - RNA, 64 nt, Human
aucaccuggcccaugucccuacaaacccaugauugucagggaggugccaguuacagcaggugau

SEQ ID NO: 340631 - RNA, 64 nt, Human
gaacaucaucuuaauagccuuuggcucacccagagucagggagagaugaaaauaauaggucaga

SEQ ID NO: 340632 - RNA, 61 nt, Human; identical to SEQ ID NO: 339557

SEQ ID NO: 340633 - RNA, 61 nt, Human; identical to SEQ ID NO: 339558

SEQ ID NO: 340634 - RNA, 61 nt, Human; identical to SEQ ID NO: 339559

SEQ ID NO: 340635 - RNA, 61 nt, Human; identical to SEQ ID NO: 339560

SEQ ID NO: 340636 - RNA, 61 nt, Human; identical to SEQ ID NO: 339561

SEQ ID NO: 340637 - RNA, 61 nt, Human; identical to SEQ ID NO: 339562

SEQ ID NO: 340638 - RNA, 61 nt, Human; identical to SEQ ID NO: 339563

SEQ ID NO: 340639 - RNA, 61 nt, Human; identical to SEQ ID NO: 339564

SEQ ID NO: 340640 - RNA, 61 nt, Human; identical to SEQ ID NO: 339565

SEQ ID NO: 340641 - RNA, 61 nt, Human; identical to SEQ ID NO: 339566

SEQ ID NO: 340642 - RNA, 61 nt, Human; identical to SEQ ID NO: 339567

SEQ ID NO: 340643 - RNA, 61 nt, Human; identical to SEQ ID NO: 339568

SEQ ID NO: 340644 - RNA, 61 nt, Human; identical to SEQ ID NO: 339569

SEQ ID NO: 340645 - RNA, 61 nt, Human; identical to SEQ ID NO: 339570

SEQ ID NO: 340646 - RNA, 61 nt, Human; identical to SEQ ID NO: 339571

SEQ ID NO: 340647 - RNA, 61 nt, Human; identical to SEQ ID NO: 339575

SEQ ID NO: 340648 - RNA, 64 nt, Human
ggaggaggacuccagcugggcucggucccccacagucagggacccccauaaaggacacccccuu

SEQ ID NO: 340649 - RNA, 64 nt, Human
uucuaguagcuuuuauaaguacacucaagaauuugucagggagaauaauucugauagugcaucc

SEQ ID NO: 340650 - RNA, 64 nt, Human
ggaaaugaccuuuuuacaagagagugaaauuuaggucagggaaaagaccaagggccagcauugc

SEQ ID NO: 340651 - RNA, 61 nt, Human; identical to SEQ ID NO: 339576

SEQ ID NO: 340652 - RNA, 61 nt, Human; identical to SEQ ID NO: 339577

SEQ ID NO: 340653 - RNA, 61 nt, Human; identical to SEQ ID NO: 339578

SEQ ID NO: 340654 - RNA, 61 nt, Human; identical to SEQ ID NO: 339579

SEQ ID NO: 340655 - RNA, 61 nt, Human; identical to SEQ ID NO: 339580

SEQ ID NO: 340656 - RNA, 61 nt, Human; identical to SEQ ID NO: 339581

SEQ ID NO: 340657 - RNA, 61 nt, Human; identical to SEQ ID NO: 339582

SEQ ID NO: 340658 - RNA, 61 nt, Human; identical to SEQ ID NO: 339583

SEQ ID NO: 340659 - RNA, 61 nt, Human; identical to SEQ ID NO: 339584

SEQ ID NO: 340660 - RNA, 61 nt, Human; identical to SEQ ID NO: 339585

SEQ ID NO: 340661 - RNA, 61 nt, Human; identical to SEQ ID NO: 339586

SEQ ID NO: 340662 - RNA, 61 nt, Human; identical to SEQ ID NO: 339587

SEQ ID NO: 340663 - RNA, 61 nt, Human; identical to SEQ ID NO: 339588

SEQ ID NO: 340664 - RNA, 61 nt, Human; identical to SEQ ID NO: 339589

SEQ ID NO: 340665 - RNA, 61 nt, Human; identical to SEQ ID NO: 339590

SEQ ID NO: 340666 - RNA, 61 nt, Human; identical to SEQ ID NO: 339594

SEQ ID NO: 340667 - RNA, 64 nt, Human
agaugagaaaucaauuauucccacaggauuuuaggucagggagcaaaaaucucagaacuugacc

SEQ ID NO: 340668 - RNA, 64 nt, Human
uggaaggugcagcagugccucagggguccucagggucagggagccccccucacccucuuggccc

SEQ ID NO: 340669 - RNA, 64 nt, Human
gggccugcugggaguggcuguuuuuaugccccagccccgcaaguuggggaguguuugugggggu

SEQ ID NO: 340670 - RNA, 61 nt, Human; identical to SEQ ID NO: 339595

SEQ ID NO: 340671 - RNA, 61 nt, Human; identical to SEQ ID NO: 339596

SEQ ID NO: 340672 - RNA, 61 nt, Human; identical to SEQ ID NO: 339597

SEQ ID NO: 340673 - RNA, 61 nt, Human; identical to SEQ ID NO: 339598

SEQ ID NO: 340674 - RNA, 55 nt, Human; identical to SEQ ID NO: 339599

SEQ ID NO: 340675 - RNA, 61 nt, Human; identical to SEQ ID NO: 339600

SEQ ID NO: 340676 - RNA, 61 nt, Human; identical to SEQ ID NO: 339601

SEQ ID NO: 340677 - RNA, 61 nt, Human; identical to SEQ ID NO: 339602

SEQ ID NO: 340678 - RNA, 61 nt, Human; identical to SEQ ID NO: 339603

SEQ ID NO: 340679 - RNA, 61 nt, Human; identical to SEQ ID NO: 339604

SEQ ID NO: 340680 - RNA, 61 nt, Human; identical to SEQ ID NO: 339605

SEQ ID NO: 340681 - RNA, 61 nt, Human; identical to SEQ ID NO: 339606

SEQ ID NO: 340682 - RNA, 56 nt, Human; identical to SEQ ID NO: 339607

SEQ ID NO: 340683 - RNA, 61 nt, Human; identical to SEQ ID NO: 339608

SEQ ID NO: 340684 - RNA, 61 nt, Human; identical to SEQ ID NO: 339609

SEQ ID NO: 340685 - RNA, 61 nt, Human; identical to SEQ ID NO: 339614

SEQ ID NO: 340686 - RNA, 64 nt, Human
gcugagcaccguggggcacccagggagcaggggcgucagggauccugcugccggcaccccugug

SEQ ID NO: 340687 - RNA, 64 nt, Human
gaucccaggccagcacgccugccggcuucucaucgucagggagcccgcccagagcucgugacga

SEQ ID NO: 340688 - RNA, 64 nt, Human
gacaggguggaucauggugaggacuagggguaaggucagggaaugcuuaagcucuggcccugcc

SEQ ID NO: 340689 - RNA, 61 nt, Human; identical to SEQ ID NO: 339615

SEQ ID NO: 340690 - RNA, 61 nt, Human; identical to SEQ ID NO: 339616

SEQ ID NO: 340691 - RNA, 61 nt, Human; identical to SEQ ID NO: 339617

SEQ ID NO: 340692 - RNA, 61 nt, Human; identical to SEQ ID NO: 339618

SEQ ID NO: 340693 - RNA, 61 nt, Human; identical to SEQ ID NO: 339619

SEQ ID NO: 340694 - RNA, 61 nt, Human; identical to SEQ ID NO: 339620

SEQ ID NO: 340695 - RNA, 61 nt, Human; identical to SEQ ID NO: 339621

SEQ ID NO: 340696 - RNA, 61 nt, Human; identical to SEQ ID NO: 339622

SEQ ID NO: 340697 - RNA, 61 nt, Human; identical to SEQ ID NO: 339623

SEQ ID NO: 340698 - RNA, 61 nt, Human; identical to SEQ ID NO: 339624

SEQ ID NO: 340699 - RNA, 61 nt, Human; identical to SEQ ID NO: 339625

SEQ ID NO: 340700 - RNA, 61 nt, Human; identical to SEQ ID NO: 339626

SEQ ID NO: 340701 - RNA, 61 nt, Human; identical to SEQ ID NO: 339627

SEQ ID NO: 340702 - RNA, 61 nt, Human; identical to SEQ ID NO: 339628

SEQ ID NO: 340703 - RNA, 61 nt, Human; identical to SEQ ID NO: 339629

SEQ ID NO: 340704 - RNA, 61 nt, Human; identical to SEQ ID NO: 339633

SEQ ID NO: 340705 - RNA, 64 nt, Human
gaaacuucuagcgucagugcuggagggagaagcugucagggacccagggcgccuggagaaagag

SEQ ID NO: 340706 - RNA, 64 nt, Human
cuccccuccaacucagccaacccaggugugggcagucagggagggagggagugucccaccacgu

SEQ ID NO: 340707 - RNA, 64 nt, Human
ggcacagauuaucuaaaauuagccagcucuuccugucagggaucagggcagcacuaacaggcgc

SEQ ID NO: 340708 - RNA, 61 nt, Human; identical to SEQ ID NO: 339634

SEQ ID NO: 340709 - RNA, 61 nt, Human; identical to SEQ ID NO: 339635

SEQ ID NO: 340710 - RNA, 61 nt, Human; identical to SEQ ID NO: 339636

SEQ ID NO: 340711 - RNA, 61 nt, Human; identical to SEQ ID NO: 339637

SEQ ID NO: 340712 - RNA, 61 nt, Human; identical to SEQ ID NO: 339638

SEQ ID NO: 340713 - RNA, 61 nt, Human; identical to SEQ ID NO: 339639

SEQ ID NO: 340714 - RNA, 61 nt, Human; identical to SEQ ID NO: 339640

SEQ ID NO: 340715 - RNA, 61 nt, Human; identical to SEQ ID NO: 339641

SEQ ID NO: 340716 - RNA, 61 nt, Human; identical to SEQ ID NO: 339642

SEQ ID NO: 340717 - RNA, 61 nt, Human; identical to SEQ ID NO: 339643

SEQ ID NO: 340718 - RNA, 61 nt, Human; identical to SEQ ID NO: 339644

SEQ ID NO: 340719 - RNA, 61 nt, Human; identical to SEQ ID NO: 339645

SEQ ID NO: 340720 - RNA, 61 nt, Human; identical to SEQ ID NO: 339646

SEQ ID NO: 340721 - RNA, 61 nt, Human; identical to SEQ ID NO: 339647

SEQ ID NO: 340722 - RNA, 61 nt, Human; identical to SEQ ID NO: 339648

SEQ ID NO: 340723 - RNA, 61 nt, Human; identical to SEQ ID NO: 339652

SEQ ID NO: 340724 - RNA, 64 nt, Human
ugccauugggagaguauugacuaaaauaucauucgucagggaaauauaguuguaauauuuuuac

SEQ ID NO: 340725 - RNA, 64 nt, Human
ggagcuucuuuuuccaaaagaaaaacuaguugcagucagggagccagcgaaaagacaaaaaaaa

SEQ ID NO: 340726 - RNA, 64 nt, Human
gugaaggauuggaaaaggcuauuuuccaacugaagucagggacauugccagcuccagaaaacau

SEQ ID NO: 340727 - RNA, 61 nt, Human; identical to SEQ ID NO: 339653

SEQ ID NO: 340728 - RNA, 61 nt, Human; identical to SEQ ID NO: 339654

SEQ ID NO: 340729 - RNA, 61 nt, Human; identical to SEQ ID NO: 339655

SEQ ID NO: 340730 - RNA, 61 nt, Human; identical to SEQ ID NO: 339656

SEQ ID NO: 340731 - RNA, 61 nt, Human; identical to SEQ ID NO: 339657

SEQ ID NO: 340732 - RNA, 61 nt, Human; identical to SEQ ID NO: 339658

SEQ ID NO: 340733 - RNA, 61 nt, Human; identical to SEQ ID NO: 339659

SEQ ID NO: 340734 - RNA, 61 nt, Human; identical to SEQ ID NO: 339660

SEQ ID NO: 340735 - RNA, 61 nt, Human; identical to SEQ ID NO: 339661

SEQ ID NO: 340736 - RNA, 61 nt, Human; identical to SEQ ID NO: 339648

SEQ ID NO: 340737 - RNA, 64 nt, Human; identical to SEQ ID NO: 338586

SEQ ID NO: 340738 - RNA, 64 nt, Human; identical to SEQ ID NO: 338587

SEQ ID NO: 340739 - RNA, 64 nt, Human; identical to SEQ ID NO: 338592

SEQ ID NO: 340740 - RNA, 64 nt, Human; identical to SEQ ID NO: 338593

SEQ ID NO: 340741 - RNA, 64 nt, Human
gcuuaacuugaaggccugcugucuccuucugggggucagggacgcagcuccacccucaccacua

SEQ ID NO: 340742 - RNA, 64 nt, Human
aguuuuaugcaaaauuuuaaaaaaugccagucuggucagggaaguaggggguuucaaugcuguu

SEQ ID NO: 340743 - RNA, 64 nt, Human
ucuuuuuggagcacugugcugucuuuccuagucagucagggacuuuuuuaagcuucaaagaaca

SEQ ID NO: 340744 - RNA, 64 nt, Human; identical to SEQ ID NO: 338594

SEQ ID NO: 340745 - RNA, 64 nt, Human; identical to SEQ ID NO: 338595

SEQ ID NO: 340746 - RNA, 64 nt, Human; identical to SEQ ID NO: 338596

SEQ ID NO: 340747 - RNA, 64 nt, Human; identical to SEQ ID NO: 338597

SEQ ID NO: 340748 - RNA, 64 nt, Human; identical to SEQ ID NO: 338598

SEQ ID NO: 340749 - RNA, 64 nt, Human; identical to SEQ ID NO: 338599

SEQ ID NO: 340750 - RNA, 64 nt, Human; identical to SEQ ID NO: 338600

SEQ ID NO: 340751 - RNA, 64 nt, Human; identical to SEQ ID NO: 338601

SEQ ID NO: 340752 - RNA, 64 nt, Human; identical to SEQ ID NO: 338602

SEQ ID NO: 340753 - RNA, 64 nt, Human; identical to SEQ ID NO: 338603

SEQ ID NO: 340754 - RNA, 64 nt, Human; identical to SEQ ID NO: 338604

SEQ ID NO: 340755 - RNA, 64 nt, Human; identical to SEQ ID NO: 338605

SEQ ID NO: 340756 - RNA, 64 nt, Human; identical to SEQ ID NO: 338606

SEQ ID NO: 340757 - RNA, 64 nt, Human; identical to SEQ ID NO: 338607

SEQ ID NO: 340758 - RNA, 64 nt, Human; identical to SEQ ID NO: 338611

SEQ ID NO: 340759 - RNA, 64 nt, Human; identical to SEQ ID NO: 338612

SEQ ID NO: 340760 - RNA, 64 nt, Human
gcggcaggcagcaggcuguggaggaggccccucggucagggagcggccugccucaccccugaau

SEQ ID NO: 340761 - RNA, 64 nt, Human
agaaagaaauguaggugugaaguauuaggcugcugucagggagaggauggcagauggaggcauc

SEQ ID NO: 340762 - RNA, 64 nt, Human
aggagagcaagaggaaccagaagaagucucuuuggucagggaccaugaugcucuacauggacau

SEQ ID NO: 340763 - RNA, 64 nt, Human; identical to SEQ ID NO: 338613

SEQ ID NO: 340764 - RNA, 64 nt, Human; identical to SEQ ID NO: 338614

SEQ ID NO: 340765 - RNA, 64 nt, Human; identical to SEQ ID NO: 338615

SEQ ID NO: 340766 - RNA, 64 nt, Human; identical to SEQ ID NO: 338616

SEQ ID NO: 340767 - RNA, 64 nt, Human; identical to SEQ ID NO: 338617

SEQ ID NO: 340768 - RNA, 64 nt, Human; identical to SEQ ID NO: 338618

SEQ ID NO: 340769 - RNA, 64 nt, Human; identical to SEQ ID NO: 338619

SEQ ID NO: 340770 - RNA, 64 nt, Human; identical to SEQ ID NO: 338620

SEQ ID NO: 340771 - RNA, 64 nt, Human; identical to SEQ ID NO: 338621

SEQ ID NO: 340772 - RNA, 64 nt, Human; identical to SEQ ID NO: 338622

SEQ ID NO: 340773 - RNA, 64 nt, Human; identical to SEQ ID NO: 338623

SEQ ID NO: 340774 - RNA, 64 nt, Human; identical to SEQ ID NO: 338624

SEQ ID NO: 340775 - RNA, 64 nt, Human; identical to SEQ ID NO: 338625

SEQ ID NO: 340776 - RNA, 64 nt, Human; identical to SEQ ID NO: 338626

SEQ ID NO: 340777 - RNA, 64 nt, Human; identical to SEQ ID NO: 338630

SEQ ID NO: 340778 - RNA, 64 nt, Human; identical to SEQ ID NO: 338631

SEQ ID NO: 340779 - RNA, 64 nt, Human
uccccagggccaagcgcuggggggaagacggggagucagggagggggggaaaucucggaagagg

SEQ ID NO: 340780 - RNA, 64 nt, Human
agcccaauuaggugccugcacccgcccgguggacgucagggacucggggggcaggccccuccca

SEQ ID NO: 340781 - RNA, 64 nt, Human
guucucugcugugguugcugcagcuccaggaaguccccgcaaugucucacguugucuuugacca

SEQ ID NO: 340782 - RNA, 64 nt, Human; identical to SEQ ID NO: 338632

SEQ ID NO: 340783 - RNA, 64 nt, Human; identical to SEQ ID NO: 338633

SEQ ID NO: 340784 - RNA, 64 nt, Human; identical to SEQ ID NO: 338634

SEQ ID NO: 340785 - RNA, 64 nt, Human; identical to SEQ ID NO: 338635

SEQ ID NO: 340786 - RNA, 64 nt, Human; identical to SEQ ID NO: 338636

SEQ ID NO: 340787 - RNA, 64 nt, Human; identical to SEQ ID NO: 338637

SEQ ID NO: 340788 - RNA, 64 nt, Human; identical to SEQ ID NO: 338638

SEQ ID NO: 340789 - RNA, 64 nt, Human; identical to SEQ ID NO: 338639

SEQ ID NO: 340790 - RNA, 64 nt, Human; identical to SEQ ID NO: 338640

SEQ ID NO: 340791 - RNA, 64 nt, Human; identical to SEQ ID NO: 338641

SEQ ID NO: 340792 - RNA, 64 nt, Human; identical to SEQ ID NO: 338642

SEQ ID NO: 340793 - RNA, 64 nt, Human; identical to SEQ ID NO: 338643

SEQ ID NO: 340794 - RNA, 64 nt, Human; identical to SEQ ID NO: 338644

SEQ ID NO: 340795 - RNA, 64 nt, Human; identical to SEQ ID NO: 338645

SEQ ID NO: 340796 - RNA, 64 nt, Human; identical to SEQ ID NO: 338649

SEQ ID NO: 340797 - RNA, 64 nt, Human; identical to SEQ ID NO: 338650

SEQ ID NO: 340798 - RNA, 64 nt, Human
acugcgaucaauucugcauggucacaguagagauccccgcaacucgcuuguccuugggucaccc

SEQ ID NO: 340799 - RNA, 64 nt, Human
gucucucucugucacccaaguuggagugcaguggccccgcaaucucggcucacugcaaccucua

SEQ ID NO: 340800 - RNA, 64 nt, Human
cgugccguuuaagcuuugcuugcaagaguggaugccccgcaaucguuccugcucucccgggccc

SEQ ID NO: 340801 - RNA, 64 nt, Human; identical to SEQ ID NO: 338651

SEQ ID NO: 340802 - RNA, 64 nt, Human; identical to SEQ ID NO: 338652

SEQ ID NO: 340803 - RNA, 64 nt, Human; identical to SEQ ID NO: 338653

SEQ ID NO: 340804 - RNA, 64 nt, Human; identical to SEQ ID NO: 338654

SEQ ID NO: 340805 - RNA, 64 nt, Human; identical to SEQ ID NO: 338655

SEQ ID NO: 340806 - RNA, 64 nt, Human; identical to SEQ ID NO: 338656

SEQ ID NO: 340807 - RNA, 64 nt, Human; identical to SEQ ID NO: 338657

SEQ ID NO: 340808 - RNA, 64 nt, Human; identical to SEQ ID NO: 338658

SEQ ID NO: 340809 - RNA, 64 nt, Human; identical to SEQ ID NO: 338659

SEQ ID NO: 340810 - RNA, 64 nt, Human; identical to SEQ ID NO: 338660

SEQ ID NO: 340811 - RNA, 64 nt, Human; identical to SEQ ID NO: 338661

SEQ ID NO: 340812 - RNA, 64 nt, Human; identical to SEQ ID NO: 338662

SEQ ID NO: 340813 - RNA, 64 nt, Human; identical to SEQ ID NO: 338663

SEQ ID NO: 340814 - RNA, 64 nt, Human; identical to SEQ ID NO: 338664

SEQ ID NO: 340815 - RNA, 64 nt, Human; identical to SEQ ID NO: 338668

SEQ ID NO: 340816 - RNA, 64 nt, Human; identical to SEQ ID NO: 338669

SEQ ID NO: 340817 - RNA, 64 nt, Human
cccugcagcccccacucagccggcagccagauggccccgcaaggccuccagggauggccccuag

SEQ ID NO: 340818 - RNA, 64 nt, Human
uauucaaaaaguacaucuucccccccccccccccccccgcaaaauaauucuguggcagggcaag

SEQ ID NO: 340819 - RNA, 64 nt, Human
gcugcacucggucgggccuccacaggcauggaguccccgcaaaaaccuggccccugcaggaguc

SEQ ID NO: 340820 - RNA, 64 nt, Human; identical to SEQ ID NO: 338670

SEQ ID NO: 340821 - RNA, 64 nt, Human; identical to SEQ ID NO: 338671

SEQ ID NO: 340822 - RNA, 64 nt, Human; identical to SEQ ID NO: 338672

SEQ ID NO: 340823 - RNA, 64 nt, Human; identical to SEQ ID NO: 338673

SEQ ID NO: 340824 - RNA, 64 nt, Human; identical to SEQ ID NO: 338674

SEQ ID NO: 340825 - RNA, 64 nt, Human; identical to SEQ ID NO: 338675

SEQ ID NO: 340826 - RNA, 64 nt, Human; identical to SEQ ID NO: 338676

SEQ ID NO: 340827 - RNA, 64 nt, Human; identical to SEQ ID NO: 338677

SEQ ID NO: 340828 - RNA, 64 nt, Human; identical to SEQ ID NO: 338678

SEQ ID NO: 340829 - RNA, 64 nt, Human; identical to SEQ ID NO: 338679

SEQ ID NO: 340830 - RNA, 64 nt, Human; identical to SEQ ID NO: 338680

SEQ ID NO: 340831 - RNA, 64 nt, Human; identical to SEQ ID NO: 338681

SEQ ID NO: 340832 - RNA, 64 nt, Human; identical to SEQ ID NO: 338682

SEQ ID NO: 340833 - RNA, 64 nt, Human; identical to SEQ ID NO: 338683

SEQ ID NO: 340834 - RNA, 64 nt, Human; identical to SEQ ID NO: 338687

SEQ ID NO: 340835 - RNA, 64 nt, Human; identical to SEQ ID NO: 338688

SEQ ID NO: 340836 - RNA, 64 nt, Human
auuucuuuuuuauuuuuugaagagguuauguccugucagggaaccagccccgauauucacauag

SEQ ID NO: 340837 - RNA, 64 nt, Human
auuccagugacaaacgacagagauggugaugguggucagggaagaccucucugcagagguagug

SEQ ID NO: 340838 - RNA, 64 nt, Human
ggcccugcugcgaaaguucuuggugguggaugacccccgcaaguuugcacucuuugagcgcgcu

SEQ ID NO: 340839 - RNA, 64 nt, Human; identical to SEQ ID NO: 338689

SEQ ID NO: 340840 - RNA, 64 nt, Human; identical to SEQ ID NO: 338690

SEQ ID NO: 340841 - RNA, 64 nt, Human; identical to SEQ ID NO: 338691

SEQ ID NO: 340842 - RNA, 64 nt, Human; identical to SEQ ID NO: 338692

SEQ ID NO: 340843 - RNA, 64 nt, Human; identical to SEQ ID NO: 338693

SEQ ID NO: 340844 - RNA, 52 nt, Human; identical to SEQ ID NO: 338694

SEQ ID NO: 340845 - RNA, 64 nt, Human; identical to SEQ ID NO: 338695

SEQ ID NO: 340846 - RNA, 64 nt, Human; identical to SEQ ID NO: 338696

SEQ ID NO: 340847 - RNA, 64 nt, Human; identical to SEQ ID NO: 338697

SEQ ID NO: 340848 - RNA, 64 nt, Human; identical to SEQ ID NO: 338698

SEQ ID NO: 340849 - RNA, 64 nt, Human; identical to SEQ ID NO: 338699

SEQ ID NO: 340850 - RNA, 64 nt, Human; identical to SEQ ID NO: 338700

SEQ ID NO: 340851 - RNA, 64 nt, Human; identical to SEQ ID NO: 338701

SEQ ID NO: 340852 - RNA, 64 nt, Human; identical to SEQ ID NO: 338702

SEQ ID NO: 340853 - RNA, 64 nt, Human; identical to SEQ ID NO: 338706

SEQ ID NO: 340854 - RNA, 64 nt, Human; identical to SEQ ID NO: 338707

SEQ ID NO: 340855 - RNA, 64 nt, Human
ucccggcgauacuccuggcgauacugacuagaaagucagggagcugggggagcuguucacuuua

SEQ ID NO: 340856 - RNA, 64 nt, Human
gaggguggcgggugaccaagugcaggcgcgacgggucagggaccgggccgggccgggggugcgg

SEQ ID NO: 340857 - RNA, 64 nt, Human
uccauuucuggccucaguugucuacaggacaguggucagggaugccuggaggcauauauccagc

SEQ ID NO: 340858 - RNA, 64 nt, Human; identical to SEQ ID NO: 338708

SEQ ID NO: 340859 - RNA, 64 nt, Human; identical to SEQ ID NO: 338709

SEQ ID NO: 340860 - RNA, 64 nt, Human; identical to SEQ ID NO: 338710

SEQ ID NO: 340861 - RNA, 64 nt, Human; identical to SEQ ID NO: 338711

SEQ ID NO: 340862 - RNA, 64 nt, Human; identical to SEQ ID NO: 338712

SEQ ID NO: 340863 - RNA, 64 nt, Human; identical to SEQ ID NO: 338713

SEQ ID NO: 340864 - RNA, 64 nt, Human; identical to SEQ ID NO: 338714

SEQ ID NO: 340865 - RNA, 64 nt, Human; identical to SEQ ID NO: 338715

SEQ ID NO: 340866 - RNA, 64 nt, Human; identical to SEQ ID NO: 338716

SEQ ID NO: 340867 - RNA, 64 nt, Human; identical to SEQ ID NO: 338717

SEQ ID NO: 340868 - RNA, 64 nt, Human; identical to SEQ ID NO: 338718

SEQ ID NO: 340869 - RNA, 64 nt, Human; identical to SEQ ID NO: 338719

SEQ ID NO: 340870 - RNA, 64 nt, Human; identical to SEQ ID NO: 338720

SEQ ID NO: 340871 - RNA, 64 nt, Human; identical to SEQ ID NO: 338721

SEQ ID NO: 340872 - RNA, 64 nt, Human; identical to SEQ ID NO: 338725

SEQ ID NO: 340873 - RNA, 64 nt, Human; identical to SEQ ID NO: 338726

SEQ ID NO: 340874 - RNA, 64 nt, Human
aucucaaagcacaauguggauuuggggaccaaaggucagggacacauccccuuagaggaccuga

SEQ ID NO: 340875 - RNA, 64 nt, Human
auagguccuuucugccaucucuguuccagcugcugucagggauuaacaacagaguguaggggag

SEQ ID NO: 340876 - RNA, 64 nt, Human
ugccuccuuuccccucccucaggccgaaggaggagucagggagagcugaacuauuagagcugcc

SEQ ID NO: 340877 - RNA, 64 nt, Human; identical to SEQ ID NO: 338727

SEQ ID NO: 340878 - RNA, 64 nt, Human; identical to SEQ ID NO: 338728

SEQ ID NO: 340879 - RNA, 64 nt, Human; identical to SEQ ID NO: 338729

SEQ ID NO: 340880 - RNA, 64 nt, Human; identical to SEQ ID NO: 338730

SEQ ID NO: 340881 - RNA, 64 nt, Human; identical to SEQ ID NO: 338731

SEQ ID NO: 340882 - RNA, 64 nt, Human; identical to SEQ ID NO: 338732

SEQ ID NO: 340883 - RNA, 64 nt, Human; identical to SEQ ID NO: 338733

SEQ ID NO: 340884 - RNA, 64 nt, Human; identical to SEQ ID NO: 338734

SEQ ID NO: 340885 - RNA, 64 nt, Human; identical to SEQ ID NO: 338735

SEQ ID NO: 340886 - RNA, 64 nt, Human; identical to SEQ ID NO: 338736

SEQ ID NO: 340887 - RNA, 64 nt, Human; identical to SEQ ID NO: 338737

SEQ ID NO: 340888 - RNA, 64 nt, Human; identical to SEQ ID NO: 338738

SEQ ID NO: 340889 - RNA, 64 nt, Human; identical to SEQ ID NO: 338739

SEQ ID NO: 340890 - RNA, 64 nt, Human; identical to SEQ ID NO: 338740

SEQ ID NO: 340891 - RNA, 64 nt, Human; identical to SEQ ID NO: 338744

SEQ ID NO: 340892 - RNA, 64 nt, Human; identical to SEQ ID NO: 338745

SEQ ID NO: 340893 - RNA, 64 nt, Human
ggagcuaacacuggccccuagaaucagccuaggggucagggaccaaggaccccucaccuugcaa

SEQ ID NO: 340894 - RNA, 64 nt, Human
uggcagcagugagguagaugggaggacauuucuggucagggaacuggcaucccauucagcaucu

SEQ ID NO: 340895 - RNA, 64 nt, Human
cgcuuuugucugucuucgcugucgugucuggaaugucagggaaggggagggcucggguugacgg

SEQ ID NO: 340896 - RNA, 64 nt, Human; identical to SEQ ID NO: 338746

SEQ ID NO: 340897 - RNA, 64 nt, Human; identical to SEQ ID NO: 338747

SEQ ID NO: 340898 - RNA, 64 nt, Human; identical to SEQ ID NO: 338748

SEQ ID NO: 340899 - RNA, 64 nt, Human; identical to SEQ ID NO: 338749

SEQ ID NO: 340900 - RNA, 64 nt, Human; identical to SEQ ID NO: 338750

SEQ ID NO: 340901 - RNA, 64 nt, Human; identical to SEQ ID NO: 338751

SEQ ID NO: 340902 - RNA, 64 nt, Human; identical to SEQ ID NO: 338752

SEQ ID NO: 340903 - RNA, 64 nt, Human; identical to SEQ ID NO: 338753

SEQ ID NO: 340904 - RNA, 64 nt, Human; identical to SEQ ID NO: 338754

SEQ ID NO: 340905 - RNA, 64 nt, Human; identical to SEQ ID NO: 338755

SEQ ID NO: 340906 - RNA, 64 nt, Human; identical to SEQ ID NO: 338756

SEQ ID NO: 340907 - RNA, 64 nt, Human; identical to SEQ ID NO: 338757

SEQ ID NO: 340908 - RNA, 64 nt, Human; identical to SEQ ID NO: 338758

SEQ ID NO: 340909 - RNA, 64 nt, Human; identical to SEQ ID NO: 338759

SEQ ID NO: 340910 - RNA, 64 nt, Human; identical to SEQ ID NO: 338763

SEQ ID NO: 340911 - RNA, 64 nt, Human; identical to SEQ ID NO: 338764

SEQ ID NO: 340912 - RNA, 64 nt, Human
agaucuaaucugaggacacuauaauggcccugucgucagggaagcccgugaucgcucguuuuca

SEQ ID NO: 340913 - RNA, 56 nt, Human
aggggggcccaggugcauaaaugggggucagggagggaaaggaggagggagagaga

SEQ ID NO: 340914 - RNA, 64 nt, Human
aaaaaaaaagaacggaaaaagaaaugcuuacauugucagggauccuguagacaaucauuaacuc

SEQ ID NO: 340915 - RNA, 64 nt, Human; identical to SEQ ID NO: 338765

SEQ ID NO: 340916 - RNA, 64 nt, Human; identical to SEQ ID NO: 338766

SEQ ID NO: 340917 - RNA, 64 nt, Human; identical to SEQ ID NO: 338767

SEQ ID NO: 340918 - RNA, 64 nt, Human; identical to SEQ ID NO: 338768

SEQ ID NO: 340919 - RNA, 64 nt, Human; identical to SEQ ID NO: 338769

SEQ ID NO: 340920 - RNA, 64 nt, Human; identical to SEQ ID NO: 338770

SEQ ID NO: 340921 - RNA, 64 nt, Human; identical to SEQ ID NO: 338771

SEQ ID NO: 340922 - RNA, 64 nt, Human; identical to SEQ ID NO: 338772

SEQ ID NO: 340923 - RNA, 64 nt, Human; identical to SEQ ID NO: 338773

SEQ ID NO: 340924 - RNA, 64 nt, Human; identical to SEQ ID NO: 338774

SEQ ID NO: 340925 - RNA, 64 nt, Human; identical to SEQ ID NO: 338775

SEQ ID NO: 340926 - RNA, 64 nt, Human; identical to SEQ ID NO: 338776

SEQ ID NO: 340927 - RNA, 64 nt, Human; identical to SEQ ID NO: 338777

SEQ ID NO: 340928 - RNA, 64 nt, Human; identical to SEQ ID NO: 338778

SEQ ID NO: 340929 - RNA, 64 nt, Human; identical to SEQ ID NO: 338782

SEQ ID NO: 340930 - RNA, 64 nt, Human; identical to SEQ ID NO: 338783

SEQ ID NO: 340931 - RNA, 64 nt, Human
ucagcuuaucugaauuauuuuccaaaggaaugcugucagggagggacuguucugccagccuaac

SEQ ID NO: 340932 - RNA, 64 nt, Human
uguagguagauggagggggugauuauuuuggguggucagggaagugcucagugagggaagaacu

SEQ ID NO: 340933 - RNA, 62 nt, Human; identical to SEQ ID NO: 278035

SEQ ID NO: 340934 - RNA, 64 nt, Human; identical to SEQ ID NO: 338784

SEQ ID NO: 340935 - RNA, 64 nt, Human; identical to SEQ ID NO: 338785

SEQ ID NO: 340936 - RNA, 64 nt, Human; identical to SEQ ID NO: 338786

SEQ ID NO: 340937 - RNA, 64 nt, Human; identical to SEQ ID NO: 338787

SEQ ID NO: 340938 - RNA, 64 nt, Human; identical to SEQ ID NO: 338788

SEQ ID NO: 340939 - RNA, 64 nt, Human; identical to SEQ ID NO: 338789

SEQ ID NO: 340940 - RNA, 64 nt, Human; identical to SEQ ID NO: 338790

SEQ ID NO: 340941 - RNA, 64 nt, Human; identical to SEQ ID NO: 338791

SEQ ID NO: 340942 - RNA, 64 nt, Human; identical to SEQ ID NO: 338792

SEQ ID NO: 340943 - RNA, 64 nt, Human; identical to SEQ ID NO: 338793

SEQ ID NO: 340944 - RNA, 64 nt, Human; identical to SEQ ID NO: 338794

SEQ ID NO: 340945 - RNA, 64 nt, Human; identical to SEQ ID NO: 338795

SEQ ID NO: 340946 - RNA, 64 nt, Human; identical to SEQ ID NO: 338796

SEQ ID NO: 340947 - RNA, 64 nt, Human; identical to SEQ ID NO: 338797

SEQ ID NO: 340948 - RNA, 64 nt, Human; identical to SEQ ID NO: 338801

SEQ ID NO: 340949 - RNA, 64 nt, Human; identical to SEQ ID NO: 338802

SEQ ID NO: 340950 - RNA, 64 nt, Human
gcaguaucugagaagcugcuaccuucaggggugugucagggaugaggacgggugccugagcuua

SEQ ID NO: 340951 - RNA, 64 nt, Human
ugaagggaagcgcagccacccgccugcgucuggggucagggauguccccgcuccugugucgcac

SEQ ID NO: 340952 - RNA, 64 nt, Human
acaugguacuguaugcuugccagcuagaaggagggucagggauuuuuuacagucugagaaugag

SEQ ID NO: 340953 - RNA, 64 nt, Human; identical to SEQ ID NO: 338803

SEQ ID NO: 340954 - RNA, 64 nt, Human; identical to SEQ ID NO: 338804

SEQ ID NO: 340955 - RNA, 64 nt, Human; identical to SEQ ID NO: 338805

SEQ ID NO: 340956 - RNA, 64 nt, Human; identical to SEQ ID NO: 338806

SEQ ID NO: 340957 - RNA, 64 nt, Human; identical to SEQ ID NO: 338807

SEQ ID NO: 340958 - RNA, 64 nt, Human; identical to SEQ ID NO: 338808

SEQ ID NO: 340959 - RNA, 64 nt, Human; identical to SEQ ID NO: 338809

SEQ ID NO: 340960 - RNA, 64 nt, Human; identical to SEQ ID NO: 338810

SEQ ID NO: 340961 - RNA, 64 nt, Human; identical to SEQ ID NO: 338811

SEQ ID NO: 340962 - RNA, 64 nt, Human; identical to SEQ ID NO: 338812

SEQ ID NO: 340963 - RNA, 64 nt, Human; identical to SEQ ID NO: 338813

SEQ ID NO: 340964 - RNA, 64 nt, Human; identical to SEQ ID NO: 338814

SEQ ID NO: 340965 - RNA, 64 nt, Human; identical to SEQ ID NO: 338815

SEQ ID NO: 340966 - RNA, 64 nt, Human; identical to SEQ ID NO: 338816

SEQ ID NO: 340967 - RNA, 64 nt, Human; identical to SEQ ID NO: 338820

SEQ ID NO: 340968 - RNA, 64 nt, Human; identical to SEQ ID NO: 338821

SEQ ID NO: 340969 - RNA, 64 nt, Human
agaugcucuggggacugagcccacuguuguuggugucagggaggcuuacuggagccacaccugc

SEQ ID NO: 340970 - RNA, 64 nt, Human
agggccagggucugugcuucugcucccggcacuggucagggagucugggaagaguggagaagag

SEQ ID NO: 340971 - RNA, 64 nt, Human
ggacaggauuucuaaaauucugugauucagauuugucagggaagcacagugaagcuugcuuaaa

SEQ ID NO: 340972 - RNA, 64 nt, Human; identical to SEQ ID NO: 338822

SEQ ID NO: 340973 - RNA, 64 nt, Human; identical to SEQ ID NO: 338823

SEQ ID NO: 340974 - RNA, 64 nt, Human; identical to SEQ ID NO: 338824

SEQ ID NO: 340975 - RNA, 64 nt, Human; identical to SEQ ID NO: 338825

SEQ ID NO: 340976 - RNA, 64 nt, Human; identical to SEQ ID NO: 338826

SEQ ID NO: 340977 - RNA, 64 nt, Human; identical to SEQ ID NO: 338827

SEQ ID NO: 340978 - RNA, 64 nt, Human; identical to SEQ ID NO: 338828

SEQ ID NO: 340979 - RNA, 64 nt, Human; identical to SEQ ID NO: 338829

SEQ ID NO: 340980 - RNA, 64 nt, Human; identical to SEQ ID NO: 338830

SEQ ID NO: 340981 - RNA, 64 nt, Human; identical to SEQ ID NO: 338831

SEQ ID NO: 340982 - RNA, 64 nt, Human; identical to SEQ ID NO: 338832

SEQ ID NO: 340983 - RNA, 64 nt, Human; identical to SEQ ID NO: 338833

SEQ ID NO: 340984 - RNA, 64 nt, Human; identical to SEQ ID NO: 338834

SEQ ID NO: 340985 - RNA, 64 nt, Human; identical to SEQ ID NO: 338835

SEQ ID NO: 340986 - RNA, 64 nt, Human; identical to SEQ ID NO: 338839

SEQ ID NO: 340987 - RNA, 64 nt, Human; identical to SEQ ID NO: 338840

SEQ ID NO: 340988 - RNA, 64 nt, Human
ucaucuccuccacuuggaugaugcucuagccucugucagggacuguccccuccaaacuugcuuc

SEQ ID NO: 340989 - RNA, 64 nt, Human
ggaaggaaggcugguuuggugggguaguggggaggucagggaggcggggccaagggugucccac

SEQ ID NO: 340990 - RNA, 64 nt, Human
cacccacagcgcuggccacagggcucccugcagggucagggaccagaccacgcccagaggaggg

SEQ ID NO: 340991 - RNA, 64 nt, Human; identical to SEQ ID NO: 338841

SEQ ID NO: 340992 - RNA, 64 nt, Human; identical to SEQ ID NO: 338842

SEQ ID NO: 340993 - RNA, 64 nt, Human; identical to SEQ ID NO: 338843

SEQ ID NO: 340994 - RNA, 64 nt, Human; identical to SEQ ID NO: 338844

SEQ ID NO: 340995 - RNA, 64 nt, Human; identical to SEQ ID NO: 338845

SEQ ID NO: 340996 - RNA, 64 nt, Human; identical to SEQ ID NO: 338846

SEQ ID NO: 340997 - RNA, 64 nt, Human; identical to SEQ ID NO: 338847

SEQ ID NO: 340998 - RNA, 64 nt, Human; identical to SEQ ID NO: 338848

SEQ ID NO: 340999 - RNA, 64 nt, Human; identical to SEQ ID NO: 338849

SEQ ID NO: 341000 - RNA, 64 nt, Human; identical to SEQ ID NO: 338850

SEQ ID NO: 341001 - RNA, 64 nt, Human; identical to SEQ ID NO: 338851

SEQ ID NO: 341002 - RNA, 64 nt, Human; identical to SEQ ID NO: 338852

SEQ ID NO: 341003 - RNA, 64 nt, Human; identical to SEQ ID NO: 338853

SEQ ID NO: 341004 - RNA, 64 nt, Human; identical to SEQ ID NO: 338854

SEQ ID NO: 341005 - RNA, 64 nt, Human; identical to SEQ ID NO: 338858

SEQ ID NO: 341006 - RNA, 64 nt, Human; identical to SEQ ID NO: 338859

SEQ ID NO: 341007 - RNA, 64 nt, Human
cuaaggaaaccacccuaccgggguggaagggagggucagggaagaaacccacucuugcucuacg

SEQ ID NO: 341008 - RNA, 64 nt, Human
ugcacauggccugagcauccagaccugagcgggagucagggaccugcugcucaguaagaagauu

SEQ ID NO: 341009 - RNA, 64 nt, Human
gagaccaaguaggggccaguuuccaauucacccugucagggagugagccggaucugacguuccu

SEQ ID NO: 341010 - RNA, 62 nt, Human; identical to SEQ ID NO: 338860

SEQ ID NO: 341011 - RNA, 64 nt, Human; identical to SEQ ID NO: 338861

SEQ ID NO: 341012 - RNA, 64 nt, Human; identical to SEQ ID NO: 338862

SEQ ID NO: 341013 - RNA, 64 nt, Human; identical to SEQ ID NO: 338863

SEQ ID NO: 341014 - RNA, 64 nt, Human; identical to SEQ ID NO: 338864

SEQ ID NO: 341015 - RNA, 64 nt, Human; identical to SEQ ID NO: 338865

SEQ ID NO: 341016 - RNA, 64 nt, Human; identical to SEQ ID NO: 338866

SEQ ID NO: 341017 - RNA, 64 nt, Human; identical to SEQ ID NO: 338867

SEQ ID NO: 341018 - RNA, 64 nt, Human; identical to SEQ ID NO: 338868

SEQ ID NO: 341019 - RNA, 64 nt, Human; identical to SEQ ID NO: 338869

SEQ ID NO: 341020 - RNA, 64 nt, Human; identical to SEQ ID NO: 338870

SEQ ID NO: 341021 - RNA, 64 nt, Human; identical to SEQ ID NO: 338871

SEQ ID NO: 341022 - RNA, 51 nt, Human; identical to SEQ ID NO: 338872

SEQ ID NO: 341023 - RNA, 64 nt, Human; identical to SEQ ID NO: 338873

SEQ ID NO: 341024 - RNA, 64 nt, Human; identical to SEQ ID NO: 338877

SEQ ID NO: 341025 - RNA, 64 nt, Human; identical to SEQ ID NO: 338878

SEQ ID NO: 341026 - RNA, 64 nt, Human
agugcaguccuugcucauauuuccuucaucuuaaccccgcaaacaagaauuaagaugaucccaa

SEQ ID NO: 341027 - RNA, 64 nt, Human
ggccagaguagggguuggggggaguguggacaaaccccgcaaaucagaguggggaaggugagug

SEQ ID NO: 341028 - RNA, 64 nt, Human
cucucagcugugguacugcccuguaagaaccugcccccgcaaaacucuggagucccugggacac

SEQ ID NO: 341029 - RNA, 64 nt, Human; identical to SEQ ID NO: 338879

SEQ ID NO: 341030 - RNA, 64 nt, Human; identical to SEQ ID NO: 338880

SEQ ID NO: 341031 - RNA, 64 nt, Human; identical to SEQ ID NO: 338881

SEQ ID NO: 341032 - RNA, 64 nt, Human; identical to SEQ ID NO: 338882

SEQ ID NO: 341033 - RNA, 64 nt, Human; identical to SEQ ID NO: 338883

SEQ ID NO: 341034 - RNA, 64 nt, Human; identical to SEQ ID NO: 338884

SEQ ID NO: 341035 - RNA, 64 nt, Human; identical to SEQ ID NO: 338885

SEQ ID NO: 341036 - RNA, 64 nt, Human; identical to SEQ ID NO: 338886

SEQ ID NO: 341037 - RNA, 64 nt, Human; identical to SEQ ID NO: 338887

SEQ ID NO: 341038 - RNA, 64 nt, Human; identical to SEQ ID NO: 338888

SEQ ID NO: 341039 - RNA, 64 nt, Human; identical to SEQ ID NO: 338889

SEQ ID NO: 341040 - RNA, 64 nt, Human; identical to SEQ ID NO: 338890

SEQ ID NO: 341041 - RNA, 64 nt, Human; identical to SEQ ID NO: 338891

SEQ ID NO: 341042 - RNA, 64 nt, Human; identical to SEQ ID NO: 338892

SEQ ID NO: 341043 - RNA, 64 nt, Human; identical to SEQ ID NO: 338896

SEQ ID NO: 341044 - RNA, 64 nt, Human; identical to SEQ ID NO: 338897

SEQ ID NO: 341045 - RNA, 64 nt, Human
uggccucugguccgaccaccaggcccuagucucggucagggagucugcucugccucccaggcgg

SEQ ID NO: 341046 - RNA, 64 nt, Human
aggcucccgccugacaaacaggcagggagccacagucagggacaauaaaaacuuggugcacucu

SEQ ID NO: 341047 - RNA, 64 nt, Human
agugaccuugggaggaaggggcuacuccgcccacgucagggagagaugugagcaucccggguca

SEQ ID NO: 341048 - RNA, 64 nt, Human; identical to SEQ ID NO: 338898

SEQ ID NO: 341049 - RNA, 64 nt, Human; identical to SEQ ID NO: 338899

SEQ ID NO: 341050 - RNA, 64 nt, Human; identical to SEQ ID NO: 338900

SEQ ID NO: 341051 - RNA, 64 nt, Human; identical to SEQ ID NO: 338901

SEQ ID NO: 341052 - RNA, 64 nt, Human; identical to SEQ ID NO: 338902

SEQ ID NO: 341053 - RNA, 51 nt, Human; identical to SEQ ID NO: 338903

SEQ ID NO: 341054 - RNA, 64 nt, Human; identical to SEQ ID NO: 338904

SEQ ID NO: 341055 - RNA, 64 nt, Human; identical to SEQ ID NO: 338905

SEQ ID NO: 341056 - RNA, 64 nt, Human; identical to SEQ ID NO: 338906

SEQ ID NO: 341057 - RNA, 64 nt, Human; identical to SEQ ID NO: 338907

SEQ ID NO: 341058 - RNA, 64 nt, Human; identical to SEQ ID NO: 338908

SEQ ID NO: 341059 - RNA, 64 nt, Human; identical to SEQ ID NO: 338909

SEQ ID NO: 341060 - RNA, 64 nt, Human; identical to SEQ ID NO: 338910

SEQ ID NO: 341061 - RNA, 64 nt, Human; identical to SEQ ID NO: 338911

SEQ ID NO: 341062 - RNA, 64 nt, Human; identical to SEQ ID NO: 338915

SEQ ID NO: 341063 - RNA, 64 nt, Human; identical to SEQ ID NO: 338916

SEQ ID NO: 341064 - RNA, 64 nt, Human
uuguaaagucaaguaguaagucgaaccauccuaagucagggacugucuguauauaucugcauuu

SEQ ID NO: 341065 - RNA, 64 nt, Human
gauccacagcagagaaaaagucccgugcuugcuagucagggacaagggaggcccuuuggcugug

SEQ ID NO: 341066 - RNA, 64 nt, Human
gagcuggauguguugcccaaggugugcagggcaggucagggaagggcaggguccccuaaggagg

SEQ ID NO: 341067 - RNA, 64 nt, Human; identical to SEQ ID NO: 338917

SEQ ID NO: 341068 - RNA, 64 nt, Human; identical to SEQ ID NO: 338918

SEQ ID NO: 341069 - RNA, 64 nt, Human; identical to SEQ ID NO: 338919

SEQ ID NO: 341070 - RNA, 64 nt, Human; identical to SEQ ID NO: 338920

SEQ ID NO: 341071 - RNA, 64 nt, Human; identical to SEQ ID NO: 338921

SEQ ID NO: 341072 - RNA, 64 nt, Human; identical to SEQ ID NO: 338922

SEQ ID NO: 341073 - RNA, 64 nt, Human; identical to SEQ ID NO: 338923

SEQ ID NO: 341074 - RNA, 64 nt, Human; identical to SEQ ID NO: 338924

SEQ ID NO: 341075 - RNA, 64 nt, Human; identical to SEQ ID NO: 338925

SEQ ID NO: 341076 - RNA, 64 nt, Human; identical to SEQ ID NO: 338926

SEQ ID NO: 341077 - RNA, 64 nt, Human; identical to SEQ ID NO: 338927

SEQ ID NO: 341078 - RNA, 64 nt, Human; identical to SEQ ID NO: 338928

SEQ ID NO: 341079 - RNA, 64 nt, Human; identical to SEQ ID NO: 338929

SEQ ID NO: 341080 - RNA, 64 nt, Human; identical to SEQ ID NO: 338930

SEQ ID NO: 341081 - RNA, 64 nt, Human; identical to SEQ ID NO: 338934

SEQ ID NO: 341082 - RNA, 64 nt, Human; identical to SEQ ID NO: 338935

SEQ ID NO: 341083 - RNA, 64 nt, Human
agggaggggcugauggagggcugggcgccauggggucagggaggccccagggacccaugggcag

SEQ ID NO: 341084 - RNA, 64 nt, Human
gcaaccaccaccgaggccccgaaaagcacuggucgucagggagcuccuccccuuggcccccagc

SEQ ID NO: 341085 - RNA, 64 nt, Human
agagcggguggagggcccugagguggcagcaggggucagggaagugggcuuccgagugcccucu

SEQ ID NO: 341086 - RNA, 64 nt, Human; identical to SEQ ID NO: 338936

SEQ ID NO: 341087 - RNA, 64 nt, Human; identical to SEQ ID NO: 338937

SEQ ID NO: 341088 - RNA, 64 nt, Human; identical to SEQ ID NO: 338938

SEQ ID NO: 341089 - RNA, 64 nt, Human; identical to SEQ ID NO: 338939

SEQ ID NO: 341090 - RNA, 64 nt, Human; identical to SEQ ID NO: 338940

SEQ ID NO: 341091 - RNA, 64 nt, Human; identical to SEQ ID NO: 338941

SEQ ID NO: 341092 - RNA, 64 nt, Human; identical to SEQ ID NO: 338942

SEQ ID NO: 341093 - RNA, 64 nt, Human; identical to SEQ ID NO: 338943

SEQ ID NO: 341094 - RNA, 64 nt, Human; identical to SEQ ID NO: 338944

SEQ ID NO: 341095 - RNA, 64 nt, Human; identical to SEQ ID NO: 338945

SEQ ID NO: 341096 - RNA, 64 nt, Human; identical to SEQ ID NO: 338946

SEQ ID NO: 341097 - RNA, 64 nt, Human; identical to SEQ ID NO: 338947

SEQ ID NO: 341098 - RNA, 64 nt, Human; identical to SEQ ID NO: 338948

SEQ ID NO: 341099 - RNA, 63 nt, Human; identical to SEQ ID NO: 338949

SEQ ID NO: 341100 - RNA, 64 nt, Human; identical to SEQ ID NO: 338953

SEQ ID NO: 341101 - RNA, 64 nt, Human; identical to SEQ ID NO: 338954

SEQ ID NO: 341102 - RNA, 64 nt, Human
ccccagggguguuaaggcucaggagugggcagcagucagggagagacagaacugggggaaaggg

SEQ ID NO: 341103 - RNA, 64 nt, Human
ccuucgcugugcuagaguuguguuguaggaauuagucagggaguuguugugaaaaaaaaaaccc

SEQ ID NO: 341104 - RNA, 64 nt, Human
gcuccucagagagggcagcggugccaggccucaggucagggagaaugucugugacuuagcugca

SEQ ID NO: 341105 - RNA, 64 nt, Human; identical to SEQ ID NO: 338955

SEQ ID NO: 341106 - RNA, 64 nt, Human; identical to SEQ ID NO: 338956

SEQ ID NO: 341107 - RNA, 64 nt, Human; identical to SEQ ID NO: 338957

SEQ ID NO: 341108 - RNA, 64 nt, Human; identical to SEQ ID NO: 338958

SEQ ID NO: 341109 - RNA, 64 nt, Human; identical to SEQ ID NO: 338959

SEQ ID NO: 341110 - RNA, 64 nt, Human; identical to SEQ ID NO: 338960

SEQ ID NO: 341111 - RNA, 64 nt, Human; identical to SEQ ID NO: 338961

SEQ ID NO: 341112 - RNA, 64 nt, Human; identical to SEQ ID NO: 338962

SEQ ID NO: 341113 - RNA, 64 nt, Human; identical to SEQ ID NO: 338963

SEQ ID NO: 341114 - RNA, 64 nt, Human; identical to SEQ ID NO: 338964

SEQ ID NO: 341115 - RNA, 64 nt, Human; identical to SEQ ID NO: 338965

SEQ ID NO: 341116 - RNA, 64 nt, Human; identical to SEQ ID NO: 338966

SEQ ID NO: 341117 - RNA, 64 nt, Human; identical to SEQ ID NO: 338967

SEQ ID NO: 341118 - RNA, 64 nt, Human; identical to SEQ ID NO: 338968

SEQ ID NO: 341119 - RNA, 64 nt, Human; identical to SEQ ID NO: 338972

SEQ ID NO: 341120 - RNA, 64 nt, Human; identical to SEQ ID NO: 338973

SEQ ID NO: 341121 - RNA, 64 nt, Human
cgucucccugucaauggccucgugucccccccuaccccgcaacacccacaucaccuccccacca

SEQ ID NO: 341122 - RNA, 64 nt, Human
ccagaagggaaaggcggcuguuuggcucuuucucccccgcaaggacccgcugacccgcuggaug

SEQ ID NO: 341123 - RNA, 64 nt, Human
ccuccagcugagccugucucugaauuguucccucccccgcaaugugggcacuuaccauguuccu

SEQ ID NO: 341124 - RNA, 64 nt, Human; identical to SEQ ID NO: 338974

SEQ ID NO: 341125 - RNA, 64 nt, Human; identical to SEQ ID NO: 338975

SEQ ID NO: 341126 - RNA, 64 nt, Human; identical to SEQ ID NO: 338976

SEQ ID NO: 341127 - RNA, 64 nt, Human; identical to SEQ ID NO: 338977

SEQ ID NO: 341128 - RNA, 64 nt, Human; identical to SEQ ID NO: 338978

SEQ ID NO: 341129 - RNA, 64 nt, Human; identical to SEQ ID NO: 338979

SEQ ID NO: 341130 - RNA, 64 nt, Human; identical to SEQ ID NO: 338980

SEQ ID NO: 341131 - RNA, 64 nt, Human; identical to SEQ ID NO: 338981

SEQ ID NO: 341132 - RNA, 64 nt, Human; identical to SEQ ID NO: 338982

SEQ ID NO: 341133 - RNA, 64 nt, Human; identical to SEQ ID NO: 338983

SEQ ID NO: 341134 - RNA, 64 nt, Human; identical to SEQ ID NO: 338984

SEQ ID NO: 341135 - RNA, 64 nt, Human; identical to SEQ ID NO: 338985

SEQ ID NO: 341136 - RNA, 64 nt, Human; identical to SEQ ID NO: 338986

SEQ ID NO: 341137 - RNA, 64 nt, Human; identical to SEQ ID NO: 338987

SEQ ID NO: 341138 - RNA, 64 nt, Human; identical to SEQ ID NO: 338991

SEQ ID NO: 341139 - RNA, 64 nt, Human; identical to SEQ ID NO: 338992

SEQ ID NO: 341140 - RNA, 64 nt, Human
uaggaacucccuuuugcaaaaaagaaaccugggugucagggaggugaagugacuugcccuagga

SEQ ID NO: 341141 - RNA, 64 nt, Human
cuccaacauuaccggaucuggauuggggagguuggucagggaagagagggguucuacccacaga

SEQ ID NO: 341142 - RNA, 64 nt, Human
guaucuuagccacaggagcgaugaggcaaggauugucagggaggggucugggcuucugagcuga

SEQ ID NO: 341143 - RNA, 64 nt, Human; identical to SEQ ID NO: 338993

SEQ ID NO: 341144 - RNA, 64 nt, Human; identical to SEQ ID NO: 338994

SEQ ID NO: 341145 - RNA, 64 nt, Human; identical to SEQ ID NO: 338995

SEQ ID NO: 341146 - RNA, 56 nt, Human; identical to SEQ ID NO: 338996

SEQ ID NO: 341147 - RNA, 56 nt, Human; identical to SEQ ID NO: 338996

SEQ ID NO: 341148 - RNA, 64 nt, Human; identical to SEQ ID NO: 338998

SEQ ID NO: 341149 - RNA, 64 nt, Human; identical to SEQ ID NO: 338999

SEQ ID NO: 341150 - RNA, 64 nt, Human; identical to SEQ ID NO: 339000

SEQ ID NO: 341151 - RNA, 64 nt, Human; identical to SEQ ID NO: 339001

SEQ ID NO: 341152 - RNA, 64 nt, Human; identical to SEQ ID NO: 339002

SEQ ID NO: 341153 - RNA, 64 nt, Human; identical to SEQ ID NO: 339003

SEQ ID NO: 341154 - RNA, 64 nt, Human; identical to SEQ ID NO: 339004

SEQ ID NO: 341155 - RNA, 64 nt, Human; identical to SEQ ID NO: 339005

SEQ ID NO: 341156 - RNA, 64 nt, Human; identical to SEQ ID NO: 339006

SEQ ID NO: 341157 - RNA, 64 nt, Human; identical to SEQ ID NO: 339010

SEQ ID NO: 341158 - RNA, 64 nt, Human; identical to SEQ ID NO: 339011

SEQ ID NO: 341159 - RNA, 64 nt, Human
gcaugauuuccugcccuaaguccugugagaagaugucagggacuagggagggagggagggaagg

SEQ ID NO: 341160 - RNA, 64 nt, Human
gggugggguggggguggggugacauuagcuaguggucagggaggccuuuccgcggugggauguu

SEQ ID NO: 341161 - RNA, 64 nt, Human
gcugccacuuuuaauggguccuccacccaacggggucagggagguggugcugccccagugggcc

SEQ ID NO: 341162 - RNA, 64 nt, Human; identical to SEQ ID NO: 339012

SEQ ID NO: 341163 - RNA, 64 nt, Human; identical to SEQ ID NO: 339013

SEQ ID NO: 341164 - RNA, 64 nt, Human; identical to SEQ ID NO: 339014

SEQ ID NO: 341165 - RNA, 64 nt, Human; identical to SEQ ID NO: 339015

SEQ ID NO: 341166 - RNA, 64 nt, Human; identical to SEQ ID NO: 339016

SEQ ID NO: 341167 - RNA, 64 nt, Human; identical to SEQ ID NO: 339017

SEQ ID NO: 341168 - RNA, 64 nt, Human; identical to SEQ ID NO: 339018

SEQ ID NO: 341169 - RNA, 64 nt, Human; identical to SEQ ID NO: 339019

SEQ ID NO: 341170 - RNA, 64 nt, Human; identical to SEQ ID NO: 339020

SEQ ID NO: 341171 - RNA, 64 nt, Human; identical to SEQ ID NO: 339021

SEQ ID NO: 341172 - RNA, 64 nt, Human; identical to SEQ ID NO: 339022

SEQ ID NO: 341173 - RNA, 64 nt, Human; identical to SEQ ID NO: 339023

SEQ ID NO: 341174 - RNA, 64 nt, Human; identical to SEQ ID NO: 339024

SEQ ID NO: 341175 - RNA, 64 nt, Human; identical to SEQ ID NO: 339025

SEQ ID NO: 341176 - RNA, 64 nt, Human; identical to SEQ ID NO: 339029

SEQ ID NO: 341177 - RNA, 64 nt, Human; identical to SEQ ID NO: 339030

SEQ ID NO: 341178 - RNA, 64 nt, Human
agggccuccuuccugcaauucuucccucuccagagucagggagggcugcccagcccuggccuca

SEQ ID NO: 341179 - RNA, 64 nt, Human
uuuugguuuuguauuacauacgguaguccucugcgucagggagcacuuuuuuguuugccucgag

SEQ ID NO: 341180 - RNA, 64 nt, Human
caguugacagggaccacccacaguaagcaccauggucagggagguggcaggaggugcaaagaca

SEQ ID NO: 341181 - RNA, 64 nt, Human; identical to SEQ ID NO: 339031

SEQ ID NO: 341182 - RNA, 64 nt, Human; identical to SEQ ID NO: 339032

SEQ ID NO: 341183 - RNA, 64 nt, Human; identical to SEQ ID NO: 339033

SEQ ID NO: 341184 - RNA, 64 nt, Human; identical to SEQ ID NO: 339034

SEQ ID NO: 341185 - RNA, 64 nt, Human; identical to SEQ ID NO: 339035

SEQ ID NO: 341186 - RNA, 64 nt, Human; identical to SEQ ID NO: 339036

SEQ ID NO: 341187 - RNA, 64 nt, Human; identical to SEQ ID NO: 339037

SEQ ID NO: 341188 - RNA, 64 nt, Human; identical to SEQ ID NO: 339038

SEQ ID NO: 341189 - RNA, 64 nt, Human; identical to SEQ ID NO: 339039

SEQ ID NO: 341190 - RNA, 64 nt, Human; identical to SEQ ID NO: 339040

SEQ ID NO: 341191 - RNA, 64 nt, Human; identical to SEQ ID NO: 339041

SEQ ID NO: 341192 - RNA, 64 nt, Human; identical to SEQ ID NO: 339042

SEQ ID NO: 341193 - RNA, 64 nt, Human; identical to SEQ ID NO: 339043

SEQ ID NO: 341194 - RNA, 64 nt, Human; identical to SEQ ID NO: 339044

SEQ ID NO: 341195 - RNA, 64 nt, Human; identical to SEQ ID NO: 339048

SEQ ID NO: 341196 - RNA, 64 nt, Human; identical to SEQ ID NO: 339049

SEQ ID NO: 341197 - RNA, 64 nt, Human
uuauguuaaaugucuuuccauguaccucuggugugucagggauuuugugccucaaaaaauguuu

SEQ ID NO: 341198 - RNA, 64 nt, Human
cagagccccacgcagguucaccaugaaccucagggucagggaaugagccaggcacgggggcaug

SEQ ID NO: 341199 - RNA, 64 nt, Human
uggccagucguggcaggccggccuucagcguccggucagggaagcgugcagcccaaaugggcac

SEQ ID NO: 341200 - RNA, 64 nt, Human; identical to SEQ ID NO: 339050

SEQ ID NO: 341201 - RNA, 64 nt, Human; identical to SEQ ID NO: 339051

SEQ ID NO: 341202 - RNA, 64 nt, Human; identical to SEQ ID NO: 339052

SEQ ID NO: 341203 - RNA, 64 nt, Human; identical to SEQ ID NO: 339053

SEQ ID NO: 341204 - RNA, 64 nt, Human; identical to SEQ ID NO: 339054

SEQ ID NO: 341205 - RNA, 64 nt, Human; identical to SEQ ID NO: 339055

SEQ ID NO: 341206 - RNA, 64 nt, Human; identical to SEQ ID NO: 339056

SEQ ID NO: 341207 - RNA, 64 nt, Human; identical to SEQ ID NO: 339057

SEQ ID NO: 341208 - RNA, 62 nt, Human; identical to SEQ ID NO: 339058

SEQ ID NO: 341209 - RNA, 64 nt, Human; identical to SEQ ID NO: 339059

SEQ ID NO: 341210 - RNA, 64 nt, Human; identical to SEQ ID NO: 339060

SEQ ID NO: 341211 - RNA, 64 nt, Human; identical to SEQ ID NO: 339061

SEQ ID NO: 341212 - RNA, 64 nt, Human; identical to SEQ ID NO: 339062

SEQ ID NO: 341213 - RNA, 64 nt, Human; identical to SEQ ID NO: 339063

SEQ ID NO: 341214 - RNA, 64 nt, Human; identical to SEQ ID NO: 339067

SEQ ID NO: 341215 - RNA, 64 nt, Human; identical to SEQ ID NO: 339068

SEQ ID NO: 341216 - RNA, 64 nt, Human
cacucagaaccucauaccccagagcaaaccgauggucagggagagggcuagagcucacacccag

SEQ ID NO: 341217 - RNA, 64 nt, Human
uuagccugccccuggcccaggcccaguccuuggugucagggagcccccaggccgcagguggagg

SEQ ID NO: 341218 - RNA, 64 nt, Human
uguaacuucaaaacuuuuaagagcagugaaguuggucagggacauguggccacuuauuauuacc

SEQ ID NO: 341219 - RNA, 64 nt, Human; identical to SEQ ID NO: 339069

SEQ ID NO: 341220 - RNA, 64 nt, Human; identical to SEQ ID NO: 339070

SEQ ID NO: 341221 - RNA, 64 nt, Human; identical to SEQ ID NO: 339071

SEQ ID NO: 341222 - RNA, 64 nt, Human; identical to SEQ ID NO: 339072

SEQ ID NO: 341223 - RNA, 64 nt, Human; identical to SEQ ID NO: 339073

SEQ ID NO: 341224 - RNA, 64 nt, Human; identical to SEQ ID NO: 339074

SEQ ID NO: 341225 - RNA, 64 nt, Human; identical to SEQ ID NO: 339075

SEQ ID NO: 341226 - RNA, 64 nt, Human; identical to SEQ ID NO: 339076

SEQ ID NO: 341227 - RNA, 64 nt, Human; identical to SEQ ID NO: 339077

SEQ ID NO: 341228 - RNA, 64 nt, Human; identical to SEQ ID NO: 339078

SEQ ID NO: 341229 - RNA, 64 nt, Human; identical to SEQ ID NO: 339079

SEQ ID NO: 341230 - RNA, 64 nt, Human; identical to SEQ ID NO: 339080

SEQ ID NO: 341231 - RNA, 64 nt, Human; identical to SEQ ID NO: 339081

SEQ ID NO: 341232 - RNA, 64 nt, Human; identical to SEQ ID NO: 339082

SEQ ID NO: 341233 - RNA, 64 nt, Human; identical to SEQ ID NO: 339086

SEQ ID NO: 341234 - RNA, 64 nt, Human; identical to SEQ ID NO: 339087

SEQ ID NO: 341235 - RNA, 64 nt, Human
aagaaacacggagcugggccaucgucagaacuaagucagggaaggagauggaugagaaggccag

SEQ ID NO: 341236 - RNA, 64 nt, Human
ggggaucugaucccaaagauggggugaccccagggucagggaggcugcccccaggccuguauau

SEQ ID NO: 341237 - RNA, 64 nt, Human
agugaggagaauucuggugaucucuguggagguagucagggacacaaggcuuggcugugagucu

SEQ ID NO: 341238 - RNA, 64 nt, Human; identical to SEQ ID NO: 339088

SEQ ID NO: 341239 - RNA, 64 nt, Human; identical to SEQ ID NO: 339089

SEQ ID NO: 341240 - RNA, 64 nt, Human; identical to SEQ ID NO: 339090

SEQ ID NO: 341241 - RNA, 64 nt, Human; identical to SEQ ID NO: 339091

SEQ ID NO: 341242 - RNA, 64 nt, Human; identical to SEQ ID NO: 339092

SEQ ID NO: 341243 - RNA, 64 nt, Human; identical to SEQ ID NO: 339093

SEQ ID NO: 341244 - RNA, 64 nt, Human; identical to SEQ ID NO: 339094

SEQ ID NO: 341245 - RNA, 57 nt, Human; identical to SEQ ID NO: 339095

SEQ ID NO: 341246 - RNA, 56 nt, Human; identical to SEQ ID NO: 339096

SEQ ID NO: 341247 - RNA, 64 nt, Human; identical to SEQ ID NO: 339097

SEQ ID NO: 341248 - RNA, 64 nt, Human; identical to SEQ ID NO: 339098

SEQ ID NO: 341249 - RNA, 64 nt, Human; identical to SEQ ID NO: 339099

SEQ ID NO: 341250 - RNA, 64 nt, Human; identical to SEQ ID NO: 339100

SEQ ID NO: 341251 - RNA, 64 nt, Human; identical to SEQ ID NO: 339101

SEQ ID NO: 341252 - RNA, 64 nt, Human; identical to SEQ ID NO: 339105

SEQ ID NO: 341253 - RNA, 64 nt, Human; identical to SEQ ID NO: 339106

SEQ ID NO: 341254 - RNA, 64 nt, Human
guccaagaguccauuccccaggugggagccaacugucagggaggucuuucccaccaaacaucuu

SEQ ID NO: 341255 - RNA, 64 nt, Human
agagugaaauacguuuuuguaccucucauuuucagucagggacauacuuugugcaauauuucug

SEQ ID NO: 341256 - RNA, 64 nt, Human
uauauucccauugcucugaaugguugauugaagggucagggaacuagauuuuauggcuuuaguu

SEQ ID NO: 341257 - RNA, 64 nt, Human; identical to SEQ ID NO: 339107

SEQ ID NO: 341258 - RNA, 64 nt, Human; identical to SEQ ID NO: 339108

SEQ ID NO: 341259 - RNA, 64 nt, Human; identical to SEQ ID NO: 339109

SEQ ID NO: 341260 - RNA, 64 nt, Human; identical to SEQ ID NO: 339110

SEQ ID NO: 341261 - RNA, 64 nt, Human; identical to SEQ ID NO: 339111

SEQ ID NO: 341262 - RNA, 64 nt, Human; identical to SEQ ID NO: 339112

SEQ ID NO: 341263 - RNA, 64 nt, Human; identical to SEQ ID NO: 339113

SEQ ID NO: 341264 - RNA, 64 nt, Human; identical to SEQ ID NO: 339114

SEQ ID NO: 341265 - RNA, 64 nt, Human; identical to SEQ ID NO: 339115

SEQ ID NO: 341266 - RNA, 64 nt, Human; identical to SEQ ID NO: 339116

SEQ ID NO: 341267 - RNA, 64 nt, Human; identical to SEQ ID NO: 339117

SEQ ID NO: 341268 - RNA, 64 nt, Human; identical to SEQ ID NO: 339118

SEQ ID NO: 341269 - RNA, 64 nt, Human; identical to SEQ ID NO: 339119

SEQ ID NO: 341270 - RNA, 64 nt, Human; identical to SEQ ID NO: 339120

SEQ ID NO: 341271 - RNA, 64 nt, Human; identical to SEQ ID NO: 339124

SEQ ID NO: 341272 - RNA, 64 nt, Human
ggagagaucuagauugggugagggggacggggaugucagggaggcaaguguguuguguuacugu

SEQ ID NO: 341273 - RNA, 64 nt, Human
cuaccuaggacccuuccuguggggggucuacagagucagggacagaagggaagggacccacagg

SEQ ID NO: 341274 - RNA, 64 nt, Human
gcugagcaggagcucccaagugccggccaccgcugucagggauugcccaccccugggcaucaug

SEQ ID NO: 341275 - RNA, 61 nt, Human; identical to SEQ ID NO: 339125

SEQ ID NO: 341276 - RNA, 61 nt, Human; identical to SEQ ID NO: 339126

SEQ ID NO: 341277 - RNA, 57 nt, Human; identical to SEQ ID NO: 339127

SEQ ID NO: 341278 - RNA, 61 nt, Human; identical to SEQ ID NO: 339128

SEQ ID NO: 341279 - RNA, 61 nt, Human; identical to SEQ ID NO: 339129

SEQ ID NO: 341280 - RNA, 61 nt, Human; identical to SEQ ID NO: 339130

SEQ ID NO: 341281 - RNA, 61 nt, Human; identical to SEQ ID NO: 339135

SEQ ID NO: 341282 - RNA, 61 nt, Human; identical to SEQ ID NO: 339136

SEQ ID NO: 341283 - RNA, 64 nt, Human
cagucuccacuugccuccccucuggauguaucuggucagggaagugggggauguucuuuugaua

SEQ ID NO: 341284 - RNA, 64 nt, Human
uuuuauucagauuggaaauuacacauuuucuacugucagggagauucguuacauaaauauauuu

SEQ ID NO: 341285 - RNA, 64 nt, Human
cccguguuugacgagaccugcugcuuccacgugagucagggauggucggcugggugggccugga

SEQ ID NO: 341286 - RNA, 61 nt, Human; identical to SEQ ID NO: 339137

SEQ ID NO: 341287 - RNA, 61 nt, Human; identical to SEQ ID NO: 339138

SEQ ID NO: 341288 - RNA, 61 nt, Human; identical to SEQ ID NO: 339139

SEQ ID NO: 341289 - RNA, 61 nt, Human; identical to SEQ ID NO: 339140

SEQ ID NO: 341290 - RNA, 61 nt, Human; identical to SEQ ID NO: 339141

SEQ ID NO: 341291 - RNA, 61 nt, Human; identical to SEQ ID NO: 339142

SEQ ID NO: 341292 - RNA, 61 nt, Human; identical to SEQ ID NO: 339143

SEQ ID NO: 341293 - RNA, 61 nt, Human; identical to SEQ ID NO: 339144

SEQ ID NO: 341294 - RNA, 61 nt, Human; identical to SEQ ID NO: 339145

SEQ ID NO: 341295 - RNA, 61 nt, Human; identical to SEQ ID NO: 339146

SEQ ID NO: 341296 - RNA, 61 nt, Human; identical to SEQ ID NO: 339147

SEQ ID NO: 341297 - RNA, 61 nt, Human; identical to SEQ ID NO: 339148

SEQ ID NO: 341298 - RNA, 61 nt, Human; identical to SEQ ID NO: 339149

SEQ ID NO: 341299 - RNA, 61 nt, Human; identical to SEQ ID NO: 339150

SEQ ID NO: 341300 - RNA, 61 nt, Human; identical to SEQ ID NO: 339154

SEQ ID NO: 341301 - RNA, 61 nt, Human; identical to SEQ ID NO: 339155

SEQ ID NO: 341302 - RNA, 64 nt, Human
ggaggagccacagccugucugggggaaaggacaagucagggaccacuugcugaagcacgaagag

SEQ ID NO: 341303 - RNA, 64 nt, Human
cauggcaagcagugauuuaguaaaacaccccagagucagggaagccaaccaccuugaaaccuuu

SEQ ID NO: 341304 - RNA, 64 nt, Human
caucuuuuuacuaaacucagaggcagugacagcagucagggacagacauacauuucucauaccu

SEQ ID NO: 341305 - RNA, 61 nt, Human; identical to SEQ ID NO: 339156

SEQ ID NO: 341306 - RNA, 61 nt, Human; identical to SEQ ID NO: 339157

SEQ ID NO: 341307 - RNA, 61 nt, Human; identical to SEQ ID NO: 339158

SEQ ID NO: 341308 - RNA, 61 nt, Human; identical to SEQ ID NO: 339159

SEQ ID NO: 341309 - RNA, 61 nt, Human; identical to SEQ ID NO: 339160

SEQ ID NO: 341310 - RNA, 61 nt, Human; identical to SEQ ID NO: 339161

SEQ ID NO: 341311 - RNA, 61 nt, Human; identical to SEQ ID NO: 339162

SEQ ID NO: 341312 - RNA, 61 nt, Human; identical to SEQ ID NO: 339163

SEQ ID NO: 341313 - RNA, 61 nt, Human; identical to SEQ ID NO: 339164

SEQ ID NO: 341314 - RNA, 61 nt, Human; identical to SEQ ID NO: 339165

SEQ ID NO: 341315 - RNA, 61 nt, Human; identical to SEQ ID NO: 339166

SEQ ID NO: 341316 - RNA, 61 nt, Human; identical to SEQ ID NO: 339167

SEQ ID NO: 341317 - RNA, 61 nt, Human; identical to SEQ ID NO: 339168

SEQ ID NO: 341318 - RNA, 61 nt, Human; identical to SEQ ID NO: 339169

SEQ ID NO: 341319 - RNA, 61 nt, Human; identical to SEQ ID NO: 339173

SEQ ID NO: 341320 - RNA, 61 nt, Human; identical to SEQ ID NO: 339174

SEQ ID NO: 341321 - RNA, 64 nt, Human
ugggaaacaaccugaaaagcaggcaggccucccggucagggagccucugcugugcuggcuuccc

SEQ ID NO: 341322 - RNA, 64 nt, Human
ccuccgucacuuaauccagaguacaggggcuggggucagggaaggaagaucuaaagaacccacu

SEQ ID NO: 341323 - RNA, 64 nt, Human
aguaggggaaccuaggagggugugaguggcauuugucagggauuuagcccaugacguguuucuu

SEQ ID NO: 341324 - RNA, 61 nt, Human; identical to SEQ ID NO: 339175

SEQ ID NO: 341325 - RNA, 61 nt, Human; identical to SEQ ID NO: 339176

SEQ ID NO: 341326 - RNA, 61 nt, Human; identical to SEQ ID NO: 339177

SEQ ID NO: 341327 - RNA, 61 nt, Human; identical to SEQ ID NO: 339178

SEQ ID NO: 341328 - RNA, 61 nt, Human; identical to SEQ ID NO: 339179

SEQ ID NO: 341329 - RNA, 61 nt, Human; identical to SEQ ID NO: 339180

SEQ ID NO: 341330 - RNA, 61 nt, Human; identical to SEQ ID NO: 339181

SEQ ID NO: 341331 - RNA, 61 nt, Human; identical to SEQ ID NO: 339182

SEQ ID NO: 341332 - RNA, 61 nt, Human; identical to SEQ ID NO: 339183

SEQ ID NO: 341333 - RNA, 61 nt, Human; identical to SEQ ID NO: 339184

SEQ ID NO: 341334 - RNA, 61 nt, Human; identical to SEQ ID NO: 339185

SEQ ID NO: 341335 - RNA, 61 nt, Human; identical to SEQ ID NO: 339186

SEQ ID NO: 341336 - RNA, 61 nt, Human; identical to SEQ ID NO: 339187

SEQ ID NO: 341337 - RNA, 61 nt, Human; identical to SEQ ID NO: 339188

SEQ ID NO: 341338 - RNA, 61 nt, Human; identical to SEQ ID NO: 339192

SEQ ID NO: 341339 - RNA, 61 nt, Human; identical to SEQ ID NO: 339193

SEQ ID NO: 341340 - RNA, 64 nt, Human
uacuuagagguugguuacauucgaauaaaaaguagucagggaaugggggagguggggaguuggg

SEQ ID NO: 341341 - RNA, 64 nt, Human
aauuguuaguaaugauucugcuucaauaacuauggucagggaauuuauaauauuauauuuuuau

SEQ ID NO: 341342 - RNA, 64 nt, Human
ccugcucaggcccccaucucugggguguuugggggucagggagcagggagcacuggccgugguc

SEQ ID NO: 341343 - RNA, 61 nt, Human; identical to SEQ ID NO: 339194

SEQ ID NO: 341344 - RNA, 61 nt, Human; identical to SEQ ID NO: 339195

SEQ ID NO: 341345 - RNA, 61 nt, Human; identical to SEQ ID NO: 339196

SEQ ID NO: 341346 - RNA, 61 nt, Human; identical to SEQ ID NO: 339197

SEQ ID NO: 341347 - RNA, 61 nt, Human; identical to SEQ ID NO: 339198

SEQ ID NO: 341348 - RNA, 61 nt, Human; identical to SEQ ID NO: 339199

SEQ ID NO: 341349 - RNA, 61 nt, Human; identical to SEQ ID NO: 339200

SEQ ID NO: 341350 - RNA, 61 nt, Human; identical to SEQ ID NO: 339201

SEQ ID NO: 341351 - RNA, 61 nt, Human; identical to SEQ ID NO: 339202

SEQ ID NO: 341352 - RNA, 61 nt, Human; identical to SEQ ID NO: 339203

SEQ ID NO: 341353 - RNA, 61 nt, Human; identical to SEQ ID NO: 339204

SEQ ID NO: 341354 - RNA, 61 nt, Human; identical to SEQ ID NO: 339205

SEQ ID NO: 341355 - RNA, 61 nt, Human; identical to SEQ ID NO: 339206

SEQ ID NO: 341356 - RNA, 61 nt, Human; identical to SEQ ID NO: 339207

SEQ ID NO: 341357 - RNA, 61 nt, Human; identical to SEQ ID NO: 339211

SEQ ID NO: 341358 - RNA, 61 nt, Human; identical to SEQ ID NO: 339212

SEQ ID NO: 341359 - RNA, 64 nt, Human
gauaacagacucauuaaacauuuacugagugucugucagggaucauucacauccacaucauccu

SEQ ID NO: 341360 - RNA, 64 nt, Human
cagggugucucuaugaaaagcacaaggggccaaggucagggagcaagaggugugcacaccaaag

SEQ ID NO: 341361 - RNA, 64 nt, Human
aaagggccaucucugcccugcacuugugcagaaagucagggauacggcaagcaugaaugcaaug

SEQ ID NO: 341362 - RNA, 61 nt, Human; identical to SEQ ID NO: 339213

SEQ ID NO: 341363 - RNA, 61 nt, Human; identical to SEQ ID NO: 339214

SEQ ID NO: 341364 - RNA, 61 nt, Human; identical to SEQ ID NO: 339215

SEQ ID NO: 341365 - RNA, 61 nt, Human; identical to SEQ ID NO: 339216

SEQ ID NO: 341366 - RNA, 61 nt, Human; identical to SEQ ID NO: 339217

SEQ ID NO: 341367 - RNA, 61 nt, Human; identical to SEQ ID NO: 339218

SEQ ID NO: 341368 - RNA, 61 nt, Human; identical to SEQ ID NO: 339219

SEQ ID NO: 341369 - RNA, 56 nt, Human; identical to SEQ ID NO: 339220

SEQ ID NO: 341370 - RNA, 61 nt, Human; identical to SEQ ID NO: 339221

SEQ ID NO: 341371 - RNA, 61 nt, Human; identical to SEQ ID NO: 339222

SEQ ID NO: 341372 - RNA, 61 nt, Human; identical to SEQ ID NO: 339223

SEQ ID NO: 341373 - RNA, 61 nt, Human; identical to SEQ ID NO: 339224

SEQ ID NO: 341374 - RNA, 61 nt, Human; identical to SEQ ID NO: 339225

SEQ ID NO: 341375 - RNA, 61 nt, Human; identical to SEQ ID NO: 339226

SEQ ID NO: 341376 - RNA, 61 nt, Human; identical to SEQ ID NO: 339230

SEQ ID NO: 341377 - RNA, 61 nt, Human; identical to SEQ ID NO: 339231

SEQ ID NO: 341378 - RNA, 64 nt, Human
uugcaauguauuucgcucaucuggacccugcagugucagggacccuauggaggcaagccaguaa

SEQ ID NO: 341379 - RNA, 64 nt, Human
gcuuuuucucucaugcauucccuggccuggaggcgucagggaccccacauccucccugcuccuc

SEQ ID NO: 341380 - RNA, 64 nt, Human
aagugucugcuuuuuuuauccuuaaaauucaccugucagggaggcauuaaaaauuuggaaaugu

SEQ ID NO: 341381 - RNA, 61 nt, Human; identical to SEQ ID NO: 339232

SEQ ID NO: 341382 - RNA, 61 nt, Human; identical to SEQ ID NO: 339233

SEQ ID NO: 341383 - RNA, 61 nt, Human; identical to SEQ ID NO: 339234

SEQ ID NO: 341384 - RNA, 61 nt, Human; identical to SEQ ID NO: 339235

SEQ ID NO: 341385 - RNA, 61 nt, Human; identical to SEQ ID NO: 339236

SEQ ID NO: 341386 - RNA, 61 nt, Human; identical to SEQ ID NO: 339237

SEQ ID NO: 341387 - RNA, 61 nt, Human; identical to SEQ ID NO: 339238

SEQ ID NO: 341388 - RNA, 61 nt, Human; identical to SEQ ID NO: 339239

SEQ ID NO: 341389 - RNA, 61 nt, Human; identical to SEQ ID NO: 339240

SEQ ID NO: 341390 - RNA, 61 nt, Human; identical to SEQ ID NO: 339241

SEQ ID NO: 341391 - RNA, 61 nt, Human; identical to SEQ ID NO: 339242

SEQ ID NO: 341392 - RNA, 61 nt, Human; identical to SEQ ID NO: 339243

SEQ ID NO: 341393 - RNA, 61 nt, Human; identical to SEQ ID NO: 339244

SEQ ID NO: 341394 - RNA, 61 nt, Human; identical to SEQ ID NO: 339245

SEQ ID NO: 341395 - RNA, 61 nt, Human; identical to SEQ ID NO: 339249

SEQ ID NO: 341396 - RNA, 61 nt, Human; identical to SEQ ID NO: 339250

SEQ ID NO: 341397 - RNA, 61 nt, Human
ucuguggcucugcaccuaagcuggggaccaacggaaagaguucacgaugggaggccugggg

SEQ ID NO: 341398 - RNA, 61 nt, Human
caaaacaaaacaaaugacaguaacccuuccccggaaagaaauagaacaaucauggagccua

SEQ ID NO: 341399 - RNA, 64 nt, Human
aauuauguuuuugcuuuuguuuucagagcaaugggucagggauuacaagaaaaacuuugcuaaa

SEQ ID NO: 341400 - RNA, 61 nt, Human; identical to SEQ ID NO: 339251

SEQ ID NO: 341401 - RNA, 61 nt, Human; identical to SEQ ID NO: 339252

SEQ ID NO: 341402 - RNA, 61 nt, Human; identical to SEQ ID NO: 339253

SEQ ID NO: 341403 - RNA, 61 nt, Human; identical to SEQ ID NO: 339254

SEQ ID NO: 341404 - RNA, 61 nt, Human; identical to SEQ ID NO: 339255

SEQ ID NO: 341405 - RNA, 61 nt, Human; identical to SEQ ID NO: 339256

SEQ ID NO: 341406 - RNA, 61 nt, Human; identical to SEQ ID NO: 339257

SEQ ID NO: 341407 - RNA, 61 nt, Human; identical to SEQ ID NO: 339258

SEQ ID NO: 341408 - RNA, 61 nt, Human; identical to SEQ ID NO: 339259

SEQ ID NO: 341409 - RNA, 61 nt, Human; identical to SEQ ID NO: 339260

SEQ ID NO: 341410 - RNA, 61 nt, Human; identical to SEQ ID NO: 339261

SEQ ID NO: 341411 - RNA, 61 nt, Human; identical to SEQ ID NO: 339262

SEQ ID NO: 341412 - RNA, 61 nt, Human; identical to SEQ ID NO: 339263

SEQ ID NO: 341413 - RNA, 61 nt, Human; identical to SEQ ID NO: 339264

SEQ ID NO: 341414 - RNA, 61 nt, Human; identical to SEQ ID NO: 339268

SEQ ID NO: 341415 - RNA, 61 nt, Human; identical to SEQ ID NO: 339269

SEQ ID NO: 341416 - RNA, 64 nt, Human
ccccugucagacagaggcugcggccugggccagagucagggaguagcugcugcuucacggcguc

SEQ ID NO: 341417 - RNA, 64 nt, Human
agagaacuuagcucuuuuuagacucuuuuuaggagucagggaucugggauaaagccacacuguc

SEQ ID NO: 341418 - RNA, 64 nt, Human
ggcucccucaucucguaaccagagaccagcacaugucagggaagcacccagugucggcucccca

SEQ ID NO: 341419 - RNA, 61 nt, Human; identical to SEQ ID NO: 339270

SEQ ID NO: 341420 - RNA, 61 nt, Human; identical to SEQ ID NO: 339271

SEQ ID NO: 341421 - RNA, 61 nt, Human; identical to SEQ ID NO: 339272

SEQ ID NO: 341422 - RNA, 61 nt, Human; identical to SEQ ID NO: 339273

SEQ ID NO: 341423 - RNA, 61 nt, Human; identical to SEQ ID NO: 339274

SEQ ID NO: 341424 - RNA, 61 nt, Human; identical to SEQ ID NO: 339275

SEQ ID NO: 341425 - RNA, 61 nt, Human; identical to SEQ ID NO: 339276

SEQ ID NO: 341426 - RNA, 61 nt, Human; identical to SEQ ID NO: 339277

SEQ ID NO: 341427 - RNA, 61 nt, Human; identical to SEQ ID NO: 339278

SEQ ID NO: 341428 - RNA, 61 nt, Human; identical to SEQ ID NO: 339279

SEQ ID NO: 341429 - RNA, 61 nt, Human; identical to SEQ ID NO: 339280

SEQ ID NO: 341430 - RNA, 61 nt, Human; identical to SEQ ID NO: 339281

SEQ ID NO: 341431 - RNA, 59 nt, Human; identical to SEQ ID NO: 339282

SEQ ID NO: 341432 - RNA, 61 nt, Human; identical to SEQ ID NO: 339283

SEQ ID NO: 341433 - RNA, 61 nt, Human; identical to SEQ ID NO: 339288

SEQ ID NO: 341434 - RNA, 61 nt, Human; identical to SEQ ID NO: 339289

SEQ ID NO: 341435 - RNA, 64 nt, Human
ucccgggccugaaagcuuccccgagguuugcagggucagggaggaggaacggugggggugggca

SEQ ID NO: 341436 - RNA, 64 nt, Human
cucuuugcaguguagugacacugggguuucugcagucagggaggagggaggguggccaggcuga

SEQ ID NO: 341437 - RNA, 64 nt, Human
uagcugugaacaugugggagcccgaugcaugugggucagggaucugggggcccccccagcuggc

SEQ ID NO: 341438 - RNA, 61 nt, Human; identical to SEQ ID NO: 339290

SEQ ID NO: 341439 - RNA, 61 nt, Human; identical to SEQ ID NO: 339291

SEQ ID NO: 341440 - RNA, 61 nt, Human; identical to SEQ ID NO: 339292

SEQ ID NO: 341441 - RNA, 61 nt, Human; identical to SEQ ID NO: 339293

SEQ ID NO: 341442 - RNA, 61 nt, Human; identical to SEQ ID NO: 339294

SEQ ID NO: 341443 - RNA, 61 nt, Human; identical to SEQ ID NO: 339295

SEQ ID NO: 341444 - RNA, 61 nt, Human; identical to SEQ ID NO: 339296

SEQ ID NO: 341445 - RNA, 61 nt, Human; identical to SEQ ID NO: 339297

SEQ ID NO: 341446 - RNA, 61 nt, Human; identical to SEQ ID NO: 339298

SEQ ID NO: 341447 - RNA, 61 nt, Human; identical to SEQ ID NO: 339299

SEQ ID NO: 341448 - RNA, 61 nt, Human; identical to SEQ ID NO: 339300

SEQ ID NO: 341449 - RNA, 61 nt, Human; identical to SEQ ID NO: 339301

SEQ ID NO: 341450 - RNA, 61 nt, Human; identical to SEQ ID NO: 339302

SEQ ID NO: 341451 - RNA, 61 nt, Human; identical to SEQ ID NO: 339303

SEQ ID NO: 341452 - RNA, 61 nt, Human; identical to SEQ ID NO: 339307

SEQ ID NO: 341453 - RNA, 61 nt, Human; identical to SEQ ID NO: 339308

SEQ ID NO: 341454 - RNA, 61 nt, Human
aucauaugugaacaugcaaaagcaaugcagccggaaagaacggagauuuuaauuuuuaaca

SEQ ID NO: 341455 - RNA, 61 nt, Human
acaagugcuuuuuaucuugaaauucaaccaacggaaagaauaugcauagaauaaugcauuc

SEQ ID NO: 341456 - RNA, 61 nt, Human
accuccuuuaaccacagugucaacauaguaucggaaagagagccauuucuuaggggaauaa

SEQ ID NO: 341457 - RNA, 61 nt, Human; identical to SEQ ID NO: 339309

SEQ ID NO: 341458 - RNA, 61 nt, Human; identical to SEQ ID NO: 339310

SEQ ID NO: 341459 - RNA, 61 nt, Human; identical to SEQ ID NO: 339311

SEQ ID NO: 341460 - RNA, 59 nt, Human; identical to SEQ ID NO: 339312

SEQ ID NO: 341461 - RNA, 61 nt, Human; identical to SEQ ID NO: 339313

SEQ ID NO: 341462 - RNA, 61 nt, Human; identical to SEQ ID NO: 339314

SEQ ID NO: 341463 - RNA, 61 nt, Human; identical to SEQ ID NO: 339315

SEQ ID NO: 341464 - RNA, 61 nt, Human; identical to SEQ ID NO: 339316

SEQ ID NO: 341465 - RNA, 61 nt, Human; identical to SEQ ID NO: 339317

SEQ ID NO: 341466 - RNA, 61 nt, Human; identical to SEQ ID NO: 339318

SEQ ID NO: 341467 - RNA, 61 nt, Human; identical to SEQ ID NO: 339319

SEQ ID NO: 341468 - RNA, 61 nt, Human; identical to SEQ ID NO: 339320

SEQ ID NO: 341469 - RNA, 61 nt, Human; identical to SEQ ID NO: 339321

SEQ ID NO: 341470 - RNA, 61 nt, Human; identical to SEQ ID NO: 339322

SEQ ID NO: 341471 - RNA, 61 nt, Human; identical to SEQ ID NO: 339326

SEQ ID NO: 341472 - RNA, 61 nt, Human; identical to SEQ ID NO: 339327

SEQ ID NO: 341473 - RNA, 61 nt, Human
ugcaaaucuuagggcgcucgcucccugcacacggaaagaacucuguuuaaaugcucaguuc

SEQ ID NO: 341474 - RNA, 61 nt, Human
uguguccucuuaucaguuaguggaaauagaacggaaagagugcucuuuaaacaaugaggga

SEQ ID NO: 341475 - RNA, 61 nt, Human
cuggcagcauggacuuuguuaaaauaauaggcggaaagaagaggccugggaagggccccca

SEQ ID NO: 341476 - RNA, 61 nt, Human; identical to SEQ ID NO: 339328

SEQ ID NO: 341477 - RNA, 61 nt, Human; identical to SEQ ID NO: 339329

SEQ ID NO: 341478 - RNA, 61 nt, Human; identical to SEQ ID NO: 339330

SEQ ID NO: 341479 - RNA, 61 nt, Human; identical to SEQ ID NO: 339331

SEQ ID NO: 341480 - RNA, 61 nt, Human; identical to SEQ ID NO: 339332

SEQ ID NO: 341481 - RNA, 61 nt, Human; identical to SEQ ID NO: 339333

SEQ ID NO: 341482 - RNA, 61 nt, Human; identical to SEQ ID NO: 339334

SEQ ID NO: 341483 - RNA, 61 nt, Human; identical to SEQ ID NO: 339335

SEQ ID NO: 341484 - RNA, 61 nt, Human; identical to SEQ ID NO: 339336

SEQ ID NO: 341485 - RNA, 61 nt, Human; identical to SEQ ID NO: 339337

SEQ ID NO: 341486 - RNA, 61 nt, Human; identical to SEQ ID NO: 339338

SEQ ID NO: 341487 - RNA, 61 nt, Human; identical to SEQ ID NO: 339339

SEQ ID NO: 341488 - RNA, 61 nt, Human; identical to SEQ ID NO: 339340

SEQ ID NO: 341489 - RNA, 61 nt, Human; identical to SEQ ID NO: 339341

SEQ ID NO: 341490 - RNA, 61 nt, Human; identical to SEQ ID NO: 339345

SEQ ID NO: 341491 - RNA, 61 nt, Human; identical to SEQ ID NO: 339346

SEQ ID NO: 341492 - RNA, 61 nt, Human
cagcccuuuugucucugcaaacugccuucuucggaaagaagaaggugggaggaugugaauu

SEQ ID NO: 341493 - RNA, 61 nt, Human
augucuccgcuuuguaccauaaccgaacccacggaaagacgcugcgcgggugcagaagagu

SEQ ID NO: 341494 - RNA, 61 nt, Human
cggcagcucuuaggacacauucccagaagagcggaaagaucauugacguggaacuacacac

SEQ ID NO: 341495 - RNA, 61 nt, Human; identical to SEQ ID NO: 339347

SEQ ID NO: 341496 - RNA, 61 nt, Human; identical to SEQ ID NO: 339348

SEQ ID NO: 341497 - RNA, 61 nt, Human; identical to SEQ ID NO: 339349

SEQ ID NO: 341498 - RNA, 61 nt, Human; identical to SEQ ID NO: 339350

SEQ ID NO: 341499 - RNA, 61 nt, Human; identical to SEQ ID NO: 339351

SEQ ID NO: 341500 - RNA, 61 nt, Human; identical to SEQ ID NO: 339352

SEQ ID NO: 341501 - RNA, 61 nt, Human; identical to SEQ ID NO: 339353

SEQ ID NO: 341502 - RNA, 61 nt, Human; identical to SEQ ID NO: 339354

SEQ ID NO: 341503 - RNA, 61 nt, Human; identical to SEQ ID NO: 339355

SEQ ID NO: 341504 - RNA, 61 nt, Human; identical to SEQ ID NO: 339356

SEQ ID NO: 341505 - RNA, 61 nt, Human; identical to SEQ ID NO: 339357

SEQ ID NO: 341506 - RNA, 61 nt, Human; identical to SEQ ID NO: 339358

SEQ ID NO: 341507 - RNA, 61 nt, Human; identical to SEQ ID NO: 339359

SEQ ID NO: 341508 - RNA, 61 nt, Human; identical to SEQ ID NO: 339360

SEQ ID NO: 341509 - RNA, 61 nt, Human; identical to SEQ ID NO: 339364

SEQ ID NO: 341510 - RNA, 61 nt, Human; identical to SEQ ID NO: 339365

SEQ ID NO: 341511 - RNA, 64 nt, Human
ggaaaucaacugaccucccugaacauuucacgcagucagggaacaggugaggaaagaaauaaau

SEQ ID NO: 341512 - RNA, 64 nt, Human
uuugcaugacaucuucucagagcuucacaauaaugucagggaccacauuuaaugcuuuuuaauc

SEQ ID NO: 341513 - RNA, 64 nt, Human
auuaagguccugcuugaacugcugccaacuccaugucagggaagucgcuuuuggugccuggcug

SEQ ID NO: 341514 - RNA, 61 nt, Human; identical to SEQ ID NO: 339366

SEQ ID NO: 341515 - RNA, 61 nt, Human; identical to SEQ ID NO: 339367

SEQ ID NO: 341516 - RNA, 61 nt, Human; identical to SEQ ID NO: 339368

SEQ ID NO: 341517 - RNA, 61 nt, Human; identical to SEQ ID NO: 339369

SEQ ID NO: 341518 - RNA, 61 nt, Human; identical to SEQ ID NO: 339370

SEQ ID NO: 341519 - RNA, 61 nt, Human; identical to SEQ ID NO: 339371

SEQ ID NO: 341520 - RNA, 61 nt, Human; identical to SEQ ID NO: 339372

SEQ ID NO: 341521 - RNA, 61 nt, Human; identical to SEQ ID NO: 339373

SEQ ID NO: 341522 - RNA, 61 nt, Human; identical to SEQ ID NO: 339374

SEQ ID NO: 341523 - RNA, 59 nt, Human; identical to SEQ ID NO: 339375

SEQ ID NO: 341524 - RNA, 61 nt, Human; identical to SEQ ID NO: 339376

SEQ ID NO: 341525 - RNA, 61 nt, Human; identical to SEQ ID NO: 339377

SEQ ID NO: 341526 - RNA, 61 nt, Human; identical to SEQ ID NO: 339378

SEQ ID NO: 341527 - RNA, 61 nt, Human; identical to SEQ ID NO: 339379

SEQ ID NO: 341528 - RNA, 61 nt, Human; identical to SEQ ID NO: 339384

SEQ ID NO: 341529 - RNA, 61 nt, Human; identical to SEQ ID NO: 339385

SEQ ID NO: 341530 - RNA, 61 nt, Human
gagucaauuauuucucucgacuucggccuuucggaaagaagcgaccgguuucucccucgcc

SEQ ID NO: 341531 - RNA, 61 nt, Human
ccucccagccccagguggaaggcucaguugucggaaagacaaaagcgauuucuucccacuc

SEQ ID NO: 341532 - RNA, 61 nt, Human
ucaauugugggauuauaacuucuuuacacuucggaaagauuagccuagacuaacuucauuc

SEQ ID NO: 341533 - RNA, 61 nt, Human; identical to SEQ ID NO: 339386

SEQ ID NO: 341534 - RNA, 61 nt, Human; identical to SEQ ID NO: 339387

SEQ ID NO: 341535 - RNA, 61 nt, Human; identical to SEQ ID NO: 339388

SEQ ID NO: 341536 - RNA, 61 nt, Human; identical to SEQ ID NO: 339389

SEQ ID NO: 341537 - RNA, 61 nt, Human; identical to SEQ ID NO: 339390

SEQ ID NO: 341538 - RNA, 61 nt, Human; identical to SEQ ID NO: 339391

SEQ ID NO: 341539 - RNA, 61 nt, Human; identical to SEQ ID NO: 339392

SEQ ID NO: 341540 - RNA, 61 nt, Human; identical to SEQ ID NO: 339393

SEQ ID NO: 341541 - RNA, 61 nt, Human; identical to SEQ ID NO: 339394

SEQ ID NO: 341542 - RNA, 61 nt, Human; identical to SEQ ID NO: 339395

SEQ ID NO: 341543 - RNA, 61 nt, Human; identical to SEQ ID NO: 339396

SEQ ID NO: 341544 - RNA, 61 nt, Human; identical to SEQ ID NO: 339397

SEQ ID NO: 341545 - RNA, 61 nt, Human; identical to SEQ ID NO: 339398

SEQ ID NO: 341546 - RNA, 61 nt, Human; identical to SEQ ID NO: 339399

SEQ ID NO: 341547 - RNA, 61 nt, Human; identical to SEQ ID NO: 339404

SEQ ID NO: 341548 - RNA, 61 nt, Human; identical to SEQ ID NO: 339405

SEQ ID NO: 341549 - RNA, 61 nt, Human
cuucagagcccacaguccccugcucaguguccggaaagaagucagucaucccuguuggcag

SEQ ID NO: 341550 - RNA, 61 nt, Human
cucccuuuuccaugacugugguagccagcaucggaaagaacgcugauuuaaagaggucgcu

SEQ ID NO: 341551 - RNA, 61 nt, Human
agacauaaacuguccagaguuugaagguucucggaaagaccggagggcuucuccccacaga

SEQ ID NO: 341552 - RNA, 61 nt, Human; identical to SEQ ID NO: 339406

SEQ ID NO: 341553 - RNA, 61 nt, Human; identical to SEQ ID NO: 339407

SEQ ID NO: 341554 - RNA, 61 nt, Human; identical to SEQ ID NO: 339408

SEQ ID NO: 341555 - RNA, 61 nt, Human; identical to SEQ ID NO: 339409

SEQ ID NO: 341556 - RNA, 61 nt, Human; identical to SEQ ID NO: 339410

SEQ ID NO: 341557 - RNA, 61 nt, Human; identical to SEQ ID NO: 339411

SEQ ID NO: 341558 - RNA, 61 nt, Human; identical to SEQ ID NO: 339412

SEQ ID NO: 341559 - RNA, 61 nt, Human; identical to SEQ ID NO: 339413

SEQ ID NO: 341560 - RNA, 61 nt, Human; identical to SEQ ID NO: 339414

SEQ ID NO: 341561 - RNA, 61 nt, Human; identical to SEQ ID NO: 339415

SEQ ID NO: 341562 - RNA, 61 nt, Human; identical to SEQ ID NO: 339416

SEQ ID NO: 341563 - RNA, 61 nt, Human; identical to SEQ ID NO: 339417

SEQ ID NO: 341564 - RNA, 61 nt, Human; identical to SEQ ID NO: 339418

SEQ ID NO: 341565 - RNA, 61 nt, Human; identical to SEQ ID NO: 339419

SEQ ID NO: 341566 - RNA, 61 nt, Human; identical to SEQ ID NO: 339423

SEQ ID NO: 341567 - RNA, 61 nt, Human; identical to SEQ ID NO: 339424

SEQ ID NO: 341568 - RNA, 61 nt, Human
ccacggaacauggcagaggggcaccccggcccggaaagacgccagagccagcaggggcugu

SEQ ID NO: 341569 - RNA, 61 nt, Human
uuugccaucaagaaacauucagaccagggaacggaaagaagagagaccgagcuaauuaacu

SEQ ID NO: 341570 - RNA, 61 nt, Human
uuugucauaaaguuuuaggaaagguaggacccggaaagaaguucuaauuaguugucuaaau

SEQ ID NO: 341571 - RNA, 61 nt, Human; identical to SEQ ID NO: 339425

SEQ ID NO: 341572 - RNA, 61 nt, Human; identical to SEQ ID NO: 339426

SEQ ID NO: 341573 - RNA, 61 nt, Human; identical to SEQ ID NO: 339427

SEQ ID NO: 341574 - RNA, 61 nt, Human; identical to SEQ ID NO: 339428

SEQ ID NO: 341575 - RNA, 61 nt, Human; identical to SEQ ID NO: 339429

SEQ ID NO: 341576 - RNA, 61 nt, Human; identical to SEQ ID NO: 339430

SEQ ID NO: 341577 - RNA, 61 nt, Human; identical to SEQ ID NO: 339431

SEQ ID NO: 341578 - RNA, 61 nt, Human; identical to SEQ ID NO: 339432

SEQ ID NO: 341579 - RNA, 61 nt, Human; identical to SEQ ID NO: 339433

SEQ ID NO: 341580 - RNA, 61 nt, Human; identical to SEQ ID NO: 339434

SEQ ID NO: 341581 - RNA, 61 nt, Human; identical to SEQ ID NO: 339435

SEQ ID NO: 341582 - RNA, 61 nt, Human; identical to SEQ ID NO: 339436

SEQ ID NO: 341583 - RNA, 61 nt, Human; identical to SEQ ID NO: 339437

SEQ ID NO: 341584 - RNA, 61 nt, Human; identical to SEQ ID NO: 339438

SEQ ID NO: 341585 - RNA, 61 nt, Human; identical to SEQ ID NO: 339442

SEQ ID NO: 341586 - RNA, 61 nt, Human; identical to SEQ ID NO: 339443

SEQ ID NO: 341587 - RNA, 61 nt, Human
uccuaaacuguauaguaaccugcuaaccagucggaaagagcuaccacccaauggagauacu

SEQ ID NO: 341588 - RNA, 61 nt, Human
aacagcagcagacgugucgggagguuagcugcggaaagaaaucgggaugccgcggagcaca

SEQ ID NO: 341589 - RNA, 61 nt, Human
gcggacacgccaaauugcgaggcgacggaaacggaaagacucuuuucuccucucuccgcca

SEQ ID NO: 341590 - RNA, 61 nt, Human; identical to SEQ ID NO: 339444

SEQ ID NO: 341591 - RNA, 61 nt, Human; identical to SEQ ID NO: 339445

SEQ ID NO: 341592 - RNA, 61 nt, Human; identical to SEQ ID NO: 339446

SEQ ID NO: 341593 - RNA, 61 nt, Human; identical to SEQ ID NO: 339447

SEQ ID NO: 341594 - RNA, 61 nt, Human; identical to SEQ ID NO: 339448

SEQ ID NO: 341595 - RNA, 61 nt, Human; identical to SEQ ID NO: 339449

SEQ ID NO: 341596 - RNA, 61 nt, Human; identical to SEQ ID NO: 339450

SEQ ID NO: 341597 - RNA, 61 nt, Human; identical to SEQ ID NO: 339451

SEQ ID NO: 341598 - RNA, 61 nt, Human; identical to SEQ ID NO: 339452

SEQ ID NO: 341599 - RNA, 61 nt, Human; identical to SEQ ID NO: 339453

SEQ ID NO: 341600 - RNA, 61 nt, Human; identical to SEQ ID NO: 339454

SEQ ID NO: 341601 - RNA, 61 nt, Human; identical to SEQ ID NO: 339455

SEQ ID NO: 341602 - RNA, 61 nt, Human; identical to SEQ ID NO: 339456

SEQ ID NO: 341603 - RNA, 61 nt, Human; identical to SEQ ID NO: 339457

SEQ ID NO: 341604 - RNA, 61 nt, Human; identical to SEQ ID NO: 339461

SEQ ID NO: 341605 - RNA, 61 nt, Human; identical to SEQ ID NO: 339462

SEQ ID NO: 341606 - RNA, 61 nt, Human
ggguggaagcacugaccguauccagaaguugcggaaagaguauuaucaggcucggagggaa

SEQ ID NO: 341607 - RNA, 61 nt, Human
cgggccgcacugucugucuguccgucugucccggaaagaacuauaaagcgcuggaagcgcc

SEQ ID NO: 341608 - RNA, 61 nt, Human
auccgugccaaacuggguagguggauuugagcggaaagacucccaaaaugugccaagaauu

SEQ ID NO: 341609 - RNA, 61 nt, Human; identical to SEQ ID NO: 339463

SEQ ID NO: 341610 - RNA, 61 nt, Human; identical to SEQ ID NO: 339464

SEQ ID NO: 341611 - RNA, 61 nt, Human; identical to SEQ ID NO: 339465

SEQ ID NO: 341612 - RNA, 61 nt, Human; identical to SEQ ID NO: 339466

SEQ ID NO: 341613 - RNA, 61 nt, Human; identical to SEQ ID NO: 339467

SEQ ID NO: 341614 - RNA, 61 nt, Human; identical to SEQ ID NO: 339468

SEQ ID NO: 341615 - RNA, 61 nt, Human; identical to SEQ ID NO: 339469

SEQ ID NO: 341616 - RNA, 61 nt, Human; identical to SEQ ID NO: 339470

SEQ ID NO: 341617 - RNA, 61 nt, Human; identical to SEQ ID NO: 339471

SEQ ID NO: 341618 - RNA, 61 nt, Human; identical to SEQ ID NO: 339472

SEQ ID NO: 341619 - RNA, 61 nt, Human; identical to SEQ ID NO: 339473

SEQ ID NO: 341620 - RNA, 61 nt, Human; identical to SEQ ID NO: 339474

SEQ ID NO: 341621 - RNA, 61 nt, Human; identical to SEQ ID NO: 339475

SEQ ID NO: 341622 - RNA, 61 nt, Human; identical to SEQ ID NO: 339476

SEQ ID NO: 341623 - RNA, 61 nt, Human; identical to SEQ ID NO: 339480

SEQ ID NO: 341624 - RNA, 61 nt, Human; identical to SEQ ID NO: 339481

SEQ ID NO: 341625 - RNA, 64 nt, Human
agacgcaugaauguaagaguaggaaggggugggugucagggaucacuugggaucuuugacacuu

SEQ ID NO: 341626 - RNA, 64 nt, Human
cgucccucugccagccauaggcccugccuccagugucagggaauggaggcugggcugcgagagu

SEQ ID NO: 341627 - RNA, 64 nt, Human
cacuuuuaauacugcaacugcucccuuuugcccagucagggaaagcugacuguaagucccaccu

SEQ ID NO: 341628 - RNA, 61 nt, Human; identical to SEQ ID NO: 339482

SEQ ID NO: 341629 - RNA, 61 nt, Human; identical to SEQ ID NO: 339483

SEQ ID NO: 341630 - RNA, 61 nt, Human; identical to SEQ ID NO: 339484

SEQ ID NO: 341631 - RNA, 61 nt, Human; identical to SEQ ID NO: 339485

SEQ ID NO: 341632 - RNA, 61 nt, Human; identical to SEQ ID NO: 339486

SEQ ID NO: 341633 - RNA, 61 nt, Human; identical to SEQ ID NO: 339487

SEQ ID NO: 341634 - RNA, 61 nt, Human; identical to SEQ ID NO: 339488

SEQ ID NO: 341635 - RNA, 61 nt, Human; identical to SEQ ID NO: 339489

SEQ ID NO: 341636 - RNA, 61 nt, Human; identical to SEQ ID NO: 339490

SEQ ID NO: 341637 - RNA, 61 nt, Human; identical to SEQ ID NO: 339491

SEQ ID NO: 341638 - RNA, 61 nt, Human; identical to SEQ ID NO: 339492

SEQ ID NO: 341639 - RNA, 61 nt, Human; identical to SEQ ID NO: 339493

SEQ ID NO: 341640 - RNA, 61 nt, Human; identical to SEQ ID NO: 339494

SEQ ID NO: 341641 - RNA, 61 nt, Human; identical to SEQ ID NO: 339495

SEQ ID NO: 341642 - RNA, 61 nt, Human; identical to SEQ ID NO: 339499

SEQ ID NO: 341643 - RNA, 61 nt, Human; identical to SEQ ID NO: 339500

SEQ ID NO: 341644 - RNA, 61 nt, Human
caaagucuguuuuccccaccaacuuagcucucggaaagaugugcuggagggacccucuugu

SEQ ID NO: 341645 - RNA, 61 nt, Human
accauggggccaagagcucuggaagccuggccggaaagaccaagguucaugcagcccaaca

SEQ ID NO: 341646 - RNA, 61 nt, Human
acucagagcacauacaaaaccaguuauguuucggaaagagggaaaagaguccccgagcccg

SEQ ID NO: 341647 - RNA, 61 nt, Human; identical to SEQ ID NO: 339501

SEQ ID NO: 341648 - RNA, 61 nt, Human; identical to SEQ ID NO: 339502

SEQ ID NO: 341649 - RNA, 61 nt, Human; identical to SEQ ID NO: 339503

SEQ ID NO: 341650 - RNA, 52 nt, Human; identical to SEQ ID NO: 339504

SEQ ID NO: 341651 - RNA, 61 nt, Human; identical to SEQ ID NO: 339505

SEQ ID NO: 341652 - RNA, 61 nt, Human; identical to SEQ ID NO: 339506

SEQ ID NO: 341653 - RNA, 61 nt, Human; identical to SEQ ID NO: 339507

SEQ ID NO: 341654 - RNA, 61 nt, Human; identical to SEQ ID NO: 339508

SEQ ID NO: 341655 - RNA, 61 nt, Human; identical to SEQ ID NO: 339509

SEQ ID NO: 341656 - RNA, 59 nt, Human; identical to SEQ ID NO: 339510

SEQ ID NO: 341657 - RNA, 61 nt, Human; identical to SEQ ID NO: 339511

SEQ ID NO: 341658 - RNA, 61 nt, Human; identical to SEQ ID NO: 339512

SEQ ID NO: 341659 - RNA, 61 nt, Human; identical to SEQ ID NO: 339513

SEQ ID NO: 341660 - RNA, 61 nt, Human; identical to SEQ ID NO: 339514

SEQ ID NO: 341661 - RNA, 61 nt, Human; identical to SEQ ID NO: 339518

SEQ ID NO: 341662 - RNA, 61 nt, Human; identical to SEQ ID NO: 339519

SEQ ID NO: 341663 - RNA, 61 nt, Human
ccugcaucugcaggcgauggggcaggggccacggaaagagucugagggcugcuugguguag

SEQ ID NO: 341664 - RNA, 61 nt, Human
cggcacaaucgcgucucuugugucucacucacggaaagaaacaaccugaaggccaucccgu

SEQ ID NO: 341665 - RNA, 61 nt, Human
aucccuuucagaccuaacagccacagccacacggaaagagacuuugccucacuuuuacauu

SEQ ID NO: 341666 - RNA, 61 nt, Human; identical to SEQ ID NO: 339520

SEQ ID NO: 341667 - RNA, 61 nt, Human; identical to SEQ ID NO: 339521

SEQ ID NO: 341668 - RNA, 61 nt, Human; identical to SEQ ID NO: 339522

SEQ ID NO: 341669 - RNA, 61 nt, Human; identical to SEQ ID NO: 339523

SEQ ID NO: 341670 - RNA, 61 nt, Human; identical to SEQ ID NO: 339524

SEQ ID NO: 341671 - RNA, 61 nt, Human; identical to SEQ ID NO: 339525

SEQ ID NO: 341672 - RNA, 61 nt, Human; identical to SEQ ID NO: 339526

SEQ ID NO: 341673 - RNA, 61 nt, Human; identical to SEQ ID NO: 339527

SEQ ID NO: 341674 - RNA, 61 nt, Human; identical to SEQ ID NO: 339528

SEQ ID NO: 341675 - RNA, 61 nt, Human; identical to SEQ ID NO: 339529

SEQ ID NO: 341676 - RNA, 61 nt, Human; identical to SEQ ID NO: 339530

SEQ ID NO: 341677 - RNA, 61 nt, Human; identical to SEQ ID NO: 339531

SEQ ID NO: 341678 - RNA, 61 nt, Human; identical to SEQ ID NO: 339532

SEQ ID NO: 341679 - RNA, 61 nt, Human; identical to SEQ ID NO: 339533

SEQ ID NO: 341680 - RNA, 53 nt, Human; identical to SEQ ID NO: 339537

SEQ ID NO: 341681 - RNA, 61 nt, Human; identical to SEQ ID NO: 339538

SEQ ID NO: 341682 - RNA, 64 nt, Human
ggcaccgcucuguaucccccugguggugggggcugucagggagggccuggggugggggccaggg

SEQ ID NO: 341683 - RNA, 61 nt, Human; identical to SEQ ID NO: 339539

SEQ ID NO: 341684 - RNA, 61 nt, Human; identical to SEQ ID NO: 339540

SEQ ID NO: 341685 - RNA, 61 nt, Human; identical to SEQ ID NO: 339541

SEQ ID NO: 341686 - RNA, 61 nt, Human; identical to SEQ ID NO: 339542

SEQ ID NO: 341687 - RNA, 61 nt, Human; identical to SEQ ID NO: 339543

SEQ ID NO: 341688 - RNA, 61 nt, Human; identical to SEQ ID NO: 339544

SEQ ID NO: 341689 - RNA, 61 nt, Human; identical to SEQ ID NO: 339545

SEQ ID NO: 341690 - RNA, 61 nt, Human; identical to SEQ ID NO: 339546

SEQ ID NO: 341691 - RNA, 61 nt, Human; identical to SEQ ID NO: 339547

SEQ ID NO: 341692 - RNA, 61 nt, Human; identical to SEQ ID NO: 339548

SEQ ID NO: 341693 - RNA, 61 nt, Human; identical to SEQ ID NO: 339549

SEQ ID NO: 341694 - RNA, 61 nt, Human; identical to SEQ ID NO: 339550

SEQ ID NO: 341695 - RNA, 61 nt, Human; identical to SEQ ID NO: 339551

SEQ ID NO: 341696 - RNA, 61 nt, Human; identical to SEQ ID NO: 339552

SEQ ID NO: 341697 - RNA, 61 nt, Human; identical to SEQ ID NO: 339556

SEQ ID NO: 341698 - RNA, 61 nt, Human; identical to SEQ ID NO: 339557

SEQ ID NO: 341699 - RNA, 64 nt, Human
cugcuggaggccgagggcuccaggugcuaucuuagguggacacagcccugggggcuccuuccag

SEQ ID NO: 341700 - RNA, 64 nt, Human
ccagggaagccuggagcguggccuggcgggucuggguggacaccguccccacuccggacuccca

SEQ ID NO: 341701 - RNA, 64 nt, Human
ccugcgacucgggggccuccauccgauggcaggugguggacaggcgcaucccacucuaugcgaa

SEQ ID NO: 341702 - RNA, 61 nt, Human; identical to SEQ ID NO: 339558

SEQ ID NO: 341703 - RNA, 61 nt, Human; identical to SEQ ID NO: 339559

SEQ ID NO: 341704 - RNA, 61 nt, Human; identical to SEQ ID NO: 339560

SEQ ID NO: 341705 - RNA, 61 nt, Human; identical to SEQ ID NO: 339561

SEQ ID NO: 341706 - RNA, 61 nt, Human; identical to SEQ ID NO: 339562

SEQ ID NO: 341707 - RNA, 61 nt, Human; identical to SEQ ID NO: 339563

SEQ ID NO: 341708 - RNA, 61 nt, Human; identical to SEQ ID NO: 339564

SEQ ID NO: 341709 - RNA, 61 nt, Human; identical to SEQ ID NO: 339565

SEQ ID NO: 341710 - RNA, 61 nt, Human; identical to SEQ ID NO: 339566

SEQ ID NO: 341711 - RNA, 61 nt, Human; identical to SEQ ID NO: 339567

SEQ ID NO: 341712 - RNA, 61 nt, Human; identical to SEQ ID NO: 339568

SEQ ID NO: 341713 - RNA, 61 nt, Human; identical to SEQ ID NO: 339569

SEQ ID NO: 341714 - RNA, 61 nt, Human; identical to SEQ ID NO: 339570

SEQ ID NO: 341715 - RNA, 61 nt, Human; identical to SEQ ID NO: 339571

SEQ ID NO: 341716 - RNA, 61 nt, Human; identical to SEQ ID NO: 339575

SEQ ID NO: 341717 - RNA, 61 nt, Human; identical to SEQ ID NO: 339576

SEQ ID NO: 341718 - RNA, 64 nt, Human
cuguaucugcaccugccucucuguccuggccagggguggacaacuggggucccccaaaacucag

SEQ ID NO: 341719 - RNA, 64 nt, Human
cuaggaggggucacuaagcccuuaccuagggcuggguggacaacaaggcacagaugagggugug

SEQ ID NO: 341720 - RNA, 64 nt, Human
cgaguccucugccgucgagagcagggagggguaggguggacaggcgaugccguggaaagacguc

SEQ ID NO: 341721 - RNA, 61 nt, Human; identical to SEQ ID NO: 339577

SEQ ID NO: 341722 - RNA, 61 nt, Human; identical to SEQ ID NO: 339578

SEQ ID NO: 341723 - RNA, 61 nt, Human; identical to SEQ ID NO: 339579

SEQ ID NO: 341724 - RNA, 61 nt, Human; identical to SEQ ID NO: 339580

SEQ ID NO: 341725 - RNA, 61 nt, Human; identical to SEQ ID NO: 339581

SEQ ID NO: 341726 - RNA, 61 nt, Human; identical to SEQ ID NO: 339582

SEQ ID NO: 341727 - RNA, 61 nt, Human; identical to SEQ ID NO: 339583

SEQ ID NO: 341728 - RNA, 61 nt, Human; identical to SEQ ID NO: 339584

SEQ ID NO: 341729 - RNA, 61 nt, Human; identical to SEQ ID NO: 339585

SEQ ID NO: 341730 - RNA, 61 nt, Human; identical to SEQ ID NO: 339586

SEQ ID NO: 341731 - RNA, 61 nt, Human; identical to SEQ ID NO: 339587

SEQ ID NO: 341732 - RNA, 61 nt, Human; identical to SEQ ID NO: 339588

SEQ ID NO: 341733 - RNA, 61 nt, Human; identical to SEQ ID NO: 339589

SEQ ID NO: 341734 - RNA, 61 nt, Human; identical to SEQ ID NO: 339590

SEQ ID NO: 341735 - RNA, 61 nt, Human; identical to SEQ ID NO: 339594

SEQ ID NO: 341736 - RNA, 61 nt, Human; identical to SEQ ID NO: 339595

SEQ ID NO: 341737 - RNA, 64 nt, Human
cucugccugugucguguggccuggccagccucccgguggacaccagcccugcguggacguggcc

SEQ ID NO: 341738 - RNA, 64 nt, Human
agucccaggccugccgucuccagcacggccccaagguggacacuagccccugcugcugcaggca

SEQ ID NO: 341739 - RNA, 64 nt, Human
gcagcuguggggcccuuaggagccccccaccgaggguggacacagucccuuuccuuccugcaga

SEQ ID NO: 341740 - RNA, 61 nt, Human; identical to SEQ ID NO: 339596

SEQ ID NO: 341741 - RNA, 61 nt, Human; identical to SEQ ID NO: 339597

SEQ ID NO: 341742 - RNA, 61 nt, Human; identical to SEQ ID NO: 339598

SEQ ID NO: 341743 - RNA, 55 nt, Human; identical to SEQ ID NO: 339599

SEQ ID NO: 341744 - RNA, 61 nt, Human; identical to SEQ ID NO: 339600

SEQ ID NO: 341745 - RNA, 61 nt, Human; identical to SEQ ID NO: 339601

SEQ ID NO: 341746 - RNA, 61 nt, Human; identical to SEQ ID NO: 339602

SEQ ID NO: 341747 - RNA, 61 nt, Human; identical to SEQ ID NO: 339603

SEQ ID NO: 341748 - RNA, 61 nt, Human; identical to SEQ ID NO: 339604

SEQ ID NO: 341749 - RNA, 61 nt, Human; identical to SEQ ID NO: 339605

SEQ ID NO: 341750 - RNA, 61 nt, Human; identical to SEQ ID NO: 339606

SEQ ID NO: 341751 - RNA, 56 nt, Human; identical to SEQ ID NO: 339607

SEQ ID NO: 341752 - RNA, 61 nt, Human; identical to SEQ ID NO: 339608

SEQ ID NO: 341753 - RNA, 61 nt, Human; identical to SEQ ID NO: 339609

SEQ ID NO: 341754 - RNA, 61 nt, Human; identical to SEQ ID NO: 339614

SEQ ID NO: 341755 - RNA, 61 nt, Human; identical to SEQ ID NO: 339615

SEQ ID NO: 341756 - RNA, 64 nt, Human
ccagagaaagcaaaggugcacuccagacucuggggguggacaucugaccccaagggggcugcug

SEQ ID NO: 341757 - RNA, 64 nt, Human
auugagagcccaaucucugcaugaauaacagaaagguggacauaaggaauuguaaaguauuuag

SEQ ID NO: 341758 - RNA, 64 nt, Human
ucagcuguaguccccaacaucagacuuggcacgugguggacacuaacacacaggcacucaauga

SEQ ID NO: 341759 - RNA, 61 nt, Human; identical to SEQ ID NO: 339616

SEQ ID NO: 341760 - RNA, 61 nt, Human; identical to SEQ ID NO: 339617

SEQ ID NO: 341761 - RNA, 61 nt, Human; identical to SEQ ID NO: 339618

SEQ ID NO: 341762 - RNA, 61 nt, Human; identical to SEQ ID NO: 339619

SEQ ID NO: 341763 - RNA, 61 nt, Human; identical to SEQ ID NO: 339620

SEQ ID NO: 341764 - RNA, 61 nt, Human; identical to SEQ ID NO: 339621

SEQ ID NO: 341765 - RNA, 61 nt, Human; identical to SEQ ID NO: 339622

SEQ ID NO: 341766 - RNA, 61 nt, Human; identical to SEQ ID NO: 339623

SEQ ID NO: 341767 - RNA, 61 nt, Human; identical to SEQ ID NO: 339624

SEQ ID NO: 341768 - RNA, 61 nt, Human; identical to SEQ ID NO: 339625

SEQ ID NO: 341769 - RNA, 61 nt, Human; identical to SEQ ID NO: 339626

SEQ ID NO: 341770 - RNA, 61 nt, Human; identical to SEQ ID NO: 339627

SEQ ID NO: 341771 - RNA, 61 nt, Human; identical to SEQ ID NO: 339628

SEQ ID NO: 341772 - RNA, 61 nt, Human; identical to SEQ ID NO: 339629

SEQ ID NO: 341773 - RNA, 61 nt, Human; identical to SEQ ID NO: 339633

SEQ ID NO: 341774 - RNA, 61 nt, Human; identical to SEQ ID NO: 339634

SEQ ID NO: 341775 - RNA, 64 nt, Human
guggcgauccgguugcacacuggccucuguggaggucagggaggugggaaggugggugggccug

SEQ ID NO: 341776 - RNA, 64 nt, Human
uggccaggccccaugguccugcucugggucagcugucagggagaccucccuucagccugagcca

SEQ ID NO: 341777 - RNA, 64 nt, Human
aaauguucacggcagcacuauacacaaucgcaaagucagggaaucaaacuaaauguccaucagu

SEQ ID NO: 341778 - RNA, 61 nt, Human; identical to SEQ ID NO: 339635

SEQ ID NO: 341779 - RNA, 61 nt, Human; identical to SEQ ID NO: 339636

SEQ ID NO: 341780 - RNA, 61 nt, Human; identical to SEQ ID NO: 339637

SEQ ID NO: 341781 - RNA, 61 nt, Human; identical to SEQ ID NO: 339638

SEQ ID NO: 341782 - RNA, 61 nt, Human; identical to SEQ ID NO: 339639

SEQ ID NO: 341783 - RNA, 61 nt, Human; identical to SEQ ID NO: 339640

SEQ ID NO: 341784 - RNA, 61 nt, Human; identical to SEQ ID NO: 339641

SEQ ID NO: 341785 - RNA, 61 nt, Human; identical to SEQ ID NO: 339642

SEQ ID NO: 341786 - RNA, 61 nt, Human; identical to SEQ ID NO: 339643

SEQ ID NO: 341787 - RNA, 61 nt, Human; identical to SEQ ID NO: 339644

SEQ ID NO: 341788 - RNA, 61 nt, Human; identical to SEQ ID NO: 339645

SEQ ID NO: 341789 - RNA, 61 nt, Human; identical to SEQ ID NO: 339646

SEQ ID NO: 341790 - RNA, 61 nt, Human; identical to SEQ ID NO: 339647

SEQ ID NO: 341791 - RNA, 61 nt, Human; identical to SEQ ID NO: 339648

SEQ ID NO: 341792 - RNA, 61 nt, Human; identical to SEQ ID NO: 339652

SEQ ID NO: 341793 - RNA, 61 nt, Human; identical to SEQ ID NO: 339653

SEQ ID NO: 341794 - RNA, 64 nt, Human
aaacagccugucucuggugaaugggacuuucuuugguggacacuuggcaccagcucugagagcc

SEQ ID NO: 341795 - RNA, 64 nt, Human
ugucuuccaggugagacuguggagaugagaaggugguggacacucgugauggaauggaaaucgu

SEQ ID NO: 341796 - RNA, 61 nt, Human; identical to SEQ ID NO: 339654

SEQ ID NO: 341797 - RNA, 61 nt, Human; identical to SEQ ID NO: 339655

SEQ ID NO: 341798 - RNA, 61 nt, Human; identical to SEQ ID NO: 339656

SEQ ID NO: 341799 - RNA, 61 nt, Human; identical to SEQ ID NO: 339657

SEQ ID NO: 341800 - RNA, 61 nt, Human; identical to SEQ ID NO: 339658

SEQ ID NO: 341801 - RNA, 61 nt, Human; identical to SEQ ID NO: 339659

SEQ ID NO: 341802 - RNA, 61 nt, Human; identical to SEQ ID NO: 339660

SEQ ID NO: 341803 - RNA, 61 nt, Human; identical to SEQ ID NO: 339661

SEQ ID NO: 341804 - RNA, 61 nt, Human; identical to SEQ ID NO: 339648

SEQ ID NO: 341805 - RNA, 64 nt, Human; identical to SEQ ID NO: 338586

SEQ ID NO: 341806 - RNA, 64 nt, Human; identical to SEQ ID NO: 338587

SEQ ID NO: 341807 - RNA, 64 nt, Human; identical to SEQ ID NO: 338592

SEQ ID NO: 341808 - RNA, 64 nt, Human; identical to SEQ ID NO: 338593

SEQ ID NO: 341809 - RNA, 64 nt, Human; identical to SEQ ID NO: 338594

SEQ ID NO: 341810 - RNA, 61 nt, Human
agggagggcaccagcccugauccacagaccucggaaagaugccccuguuccuuuguugcgg

SEQ ID NO: 341811 - RNA, 61 nt, Human
ugccuuuuuguuuuuguaaaaaaggaacacccggaaagacugaaagaauacauuuuauauc

SEQ ID NO: 341812 - RNA, 64 nt, Human; identical to SEQ ID NO: 338595

SEQ ID NO: 341813 - RNA, 64 nt, Human; identical to SEQ ID NO: 338596

SEQ ID NO: 341814 - RNA, 64 nt, Human; identical to SEQ ID NO: 338597

SEQ ID NO: 341815 - RNA, 64 nt, Human; identical to SEQ ID NO: 338598

SEQ ID NO: 341816 - RNA, 64 nt, Human; identical to SEQ ID NO: 338599

SEQ ID NO: 341817 - RNA, 64 nt, Human; identical to SEQ ID NO: 338600

SEQ ID NO: 341818 - RNA, 64 nt, Human; identical to SEQ ID NO: 338601

SEQ ID NO: 341819 - RNA, 64 nt, Human; identical to SEQ ID NO: 338602

SEQ ID NO: 341820 - RNA, 64 nt, Human; identical to SEQ ID NO: 338603

SEQ ID NO: 341821 - RNA, 64 nt, Human; identical to SEQ ID NO: 338604

SEQ ID NO: 341822 - RNA, 64 nt, Human; identical to SEQ ID NO: 338605

SEQ ID NO: 341823 - RNA, 64 nt, Human; identical to SEQ ID NO: 338606

SEQ ID NO: 341824 - RNA, 64 nt, Human; identical to SEQ ID NO: 338607

SEQ ID NO: 341825 - RNA, 64 nt, Human; identical to SEQ ID NO: 338611

SEQ ID NO: 341826 - RNA, 64 nt, Human; identical to SEQ ID NO: 338612

SEQ ID NO: 341827 - RNA, 64 nt, Human; identical to SEQ ID NO: 338613

SEQ ID NO: 341828 - RNA, 64 nt, Human
aacagcaccagcacggcuaugacagugaugaggagguggacagcgagcugggcaccugggagca

SEQ ID NO: 341829 - RNA, 64 nt, Human
uuugccaagccugguacugaguucaugauaccaugguggacacagcugagaaaaucccugcccu

SEQ ID NO: 341830 - RNA, 61 nt, Human
uauaaagcacugauguaacuugcuagguaaacggaaagauaaguucuaacugccuacuauc

SEQ ID NO: 341831 - RNA, 64 nt, Human; identical to SEQ ID NO: 338614

SEQ ID NO: 341832 - RNA, 64 nt, Human; identical to SEQ ID NO: 338615

SEQ ID NO: 341833 - RNA, 64 nt, Human; identical to SEQ ID NO: 338616

SEQ ID NO: 341834 - RNA, 64 nt, Human; identical to SEQ ID NO: 338617

SEQ ID NO: 341835 - RNA, 64 nt, Human; identical to SEQ ID NO: 338618

SEQ ID NO: 341836 - RNA, 64 nt, Human; identical to SEQ ID NO: 338619

SEQ ID NO: 341837 - RNA, 64 nt, Human; identical to SEQ ID NO: 338620

SEQ ID NO: 341838 - RNA, 64 nt, Human; identical to SEQ ID NO: 338621

SEQ ID NO: 341839 - RNA, 64 nt, Human; identical to SEQ ID NO: 338622

SEQ ID NO: 341840 - RNA, 64 nt, Human; identical to SEQ ID NO: 338623

SEQ ID NO: 341841 - RNA, 64 nt, Human; identical to SEQ ID NO: 338624

SEQ ID NO: 341842 - RNA, 64 nt, Human; identical to SEQ ID NO: 338625

SEQ ID NO: 341843 - RNA, 64 nt, Human; identical to SEQ ID NO: 338626

SEQ ID NO: 341844 - RNA, 64 nt, Human; identical to SEQ ID NO: 338630

SEQ ID NO: 341845 - RNA, 64 nt, Human; identical to SEQ ID NO: 338631

SEQ ID NO: 341846 - RNA, 64 nt, Human; identical to SEQ ID NO: 338632

SEQ ID NO: 341847 - RNA, 61 nt, Human
gaaucugaaugcuauacuggauacucugcuccggaaagaugagcuuuuuauucuacuacuu

SEQ ID NO: 341848 - RNA, 61 nt, Human
ccaguugggugaucaggaaucaaaccagcaucggaaagacuucccagcaccaagcuugagc

SEQ ID NO: 341849 - RNA, 61 nt, Human
caguguuccccgauaccaugcuguaaggauccggaaagaagagcgagagaucaaagaugaa

SEQ ID NO: 341850 - RNA, 64 nt, Human; identical to SEQ ID NO: 338633

SEQ ID NO: 341851 - RNA, 64 nt, Human; identical to SEQ ID NO: 338634

SEQ ID NO: 341852 - RNA, 64 nt, Human; identical to SEQ ID NO: 338635

SEQ ID NO: 341853 - RNA, 64 nt, Human; identical to SEQ ID NO: 338636

SEQ ID NO: 341854 - RNA, 64 nt, Human; identical to SEQ ID NO: 338637

SEQ ID NO: 341855 - RNA, 64 nt, Human; identical to SEQ ID NO: 338638

SEQ ID NO: 341856 - RNA, 64 nt, Human; identical to SEQ ID NO: 338639

SEQ ID NO: 341857 - RNA, 64 nt, Human; identical to SEQ ID NO: 338640

SEQ ID NO: 341858 - RNA, 64 nt, Human; identical to SEQ ID NO: 338641

SEQ ID NO: 341859 - RNA, 64 nt, Human; identical to SEQ ID NO: 338642

SEQ ID NO: 341860 - RNA, 64 nt, Human; identical to SEQ ID NO: 338643

SEQ ID NO: 341861 - RNA, 64 nt, Human; identical to SEQ ID NO: 338644

SEQ ID NO: 341862 - RNA, 64 nt, Human; identical to SEQ ID NO: 338645

SEQ ID NO: 341863 - RNA, 64 nt, Human; identical to SEQ ID NO: 338649

SEQ ID NO: 341864 - RNA, 64 nt, Human; identical to SEQ ID NO: 338650

SEQ ID NO: 341865 - RNA, 64 nt, Human; identical to SEQ ID NO: 338651

SEQ ID NO: 341866 - RNA, 64 nt, Human
guuuuuuuuuuuuuuuuuuugcauauggaggacagguggacaugguccugagcucuggacggag

SEQ ID NO: 341867 - RNA, 64 nt, Human
ucaccagggauaaggugggacaaugggggguggggguggacagugugugcugggggguucgggu

SEQ ID NO: 341868 - RNA, 64 nt, Human
ugccugaaacucagcaugacuucaccuccauccugguggacaugugguaccagaccgugaacac

SEQ ID NO: 341869 - RNA, 64 nt, Human; identical to SEQ ID NO: 338652

SEQ ID NO: 341870 - RNA, 64 nt, Human; identical to SEQ ID NO: 338653

SEQ ID NO: 341871 - RNA, 64 nt, Human; identical to SEQ ID NO: 338654

SEQ ID NO: 341872 - RNA, 64 nt, Human; identical to SEQ ID NO: 338655

SEQ ID NO: 341873 - RNA, 64 nt, Human; identical to SEQ ID NO: 338656

SEQ ID NO: 341874 - RNA, 64 nt, Human; identical to SEQ ID NO: 338657

SEQ ID NO: 341875 - RNA, 64 nt, Human; identical to SEQ ID NO: 338658

SEQ ID NO: 341876 - RNA, 64 nt, Human; identical to SEQ ID NO: 338659

SEQ ID NO: 341877 - RNA, 64 nt, Human; identical to SEQ ID NO: 338660

SEQ ID NO: 341878 - RNA, 64 nt, Human; identical to SEQ ID NO: 338661

SEQ ID NO: 341879 - RNA, 64 nt, Human; identical to SEQ ID NO: 338662

SEQ ID NO: 341880 - RNA, 64 nt, Human; identical to SEQ ID NO: 338663

SEQ ID NO: 341881 - RNA, 64 nt, Human; identical to SEQ ID NO: 338664

SEQ ID NO: 341882 - RNA, 64 nt, Human; identical to SEQ ID NO: 338668

SEQ ID NO: 341883 - RNA, 64 nt, Human; identical to SEQ ID NO: 338669

SEQ ID NO: 341884 - RNA, 64 nt, Human; identical to SEQ ID NO: 338670

SEQ ID NO: 341885 - RNA, 64 nt, Human
cuuuagcggggagggaagccaggggauuuugaaggguggacauuaggguagggugaggucaacc

SEQ ID NO: 341886 - RNA, 64 nt, Human
acagcccugcauacugaccccgggaggcugggcagguggacagccccagccaccaccuucagcc

SEQ ID NO: 341887 - RNA, 64 nt, Human
gcacagguucugggauugugaggcugugagugaagguggacaagcugucuggauggcaggucua

SEQ ID NO: 341888 - RNA, 64 nt, Human; identical to SEQ ID NO: 338671

SEQ ID NO: 341889 - RNA, 64 nt, Human; identical to SEQ ID NO: 338672

SEQ ID NO: 341890 - RNA, 64 nt, Human; identical to SEQ ID NO: 338673

SEQ ID NO: 341891 - RNA, 64 nt, Human; identical to SEQ ID NO: 338674

SEQ ID NO: 341892 - RNA, 64 nt, Human; identical to SEQ ID NO: 338675

SEQ ID NO: 341893 - RNA, 64 nt, Human; identical to SEQ ID NO: 338676

SEQ ID NO: 341894 - RNA, 64 nt, Human; identical to SEQ ID NO: 338677

SEQ ID NO: 341895 - RNA, 64 nt, Human; identical to SEQ ID NO: 338678

SEQ ID NO: 341896 - RNA, 64 nt, Human; identical to SEQ ID NO: 338679

SEQ ID NO: 341897 - RNA, 64 nt, Human; identical to SEQ ID NO: 338680

SEQ ID NO: 341898 - RNA, 64 nt, Human; identical to SEQ ID NO: 338681

SEQ ID NO: 341899 - RNA, 64 nt, Human; identical to SEQ ID NO: 338682

SEQ ID NO: 341900 - RNA, 64 nt, Human; identical to SEQ ID NO: 338683

SEQ ID NO: 341901 - RNA, 64 nt, Human; identical to SEQ ID NO: 338687

SEQ ID NO: 341902 - RNA, 64 nt, Human; identical to SEQ ID NO: 338688

SEQ ID NO: 341903 - RNA, 64 nt, Human; identical to SEQ ID NO: 338689

SEQ ID NO: 341904 - RNA, 64 nt, Human
uuacauuuucauuuuccuuucagggauuuguggggucagggaggggcagggggcaccuggcagc

SEQ ID NO: 341905 - RNA, 64 nt, Human
uguugaugacuugaagugaugcaagaauggacaagucagggaagucauugggaacauggaugag

SEQ ID NO: 341906 - RNA, 64 nt, Human
gaugauggggggaagggcggucgccucugccacugucagggaccagccggccaacgcccacccg

SEQ ID NO: 341907 - RNA, 64 nt, Human; identical to SEQ ID NO: 338690

SEQ ID NO: 341908 - RNA, 64 nt, Human; identical to SEQ ID NO: 338691

SEQ ID NO: 341909 - RNA, 64 nt, Human; identical to SEQ ID NO: 338692

SEQ ID NO: 341910 - RNA, 64 nt, Human; identical to SEQ ID NO: 338693

SEQ ID NO: 341911 - RNA, 52 nt, Human; identical to SEQ ID NO: 338694

SEQ ID NO: 341912 - RNA, 64 nt, Human; identical to SEQ ID NO: 338695

SEQ ID NO: 341913 - RNA, 64 nt, Human; identical to SEQ ID NO: 338696

SEQ ID NO: 341914 - RNA, 64 nt, Human; identical to SEQ ID NO: 338697

SEQ ID NO: 341915 - RNA, 64 nt, Human; identical to SEQ ID NO: 338698

SEQ ID NO: 341916 - RNA, 64 nt, Human; identical to SEQ ID NO: 338699

SEQ ID NO: 341917 - RNA, 64 nt, Human; identical to SEQ ID NO: 338700

SEQ ID NO: 341918 - RNA, 64 nt, Human; identical to SEQ ID NO: 338701

SEQ ID NO: 341919 - RNA, 64 nt, Human; identical to SEQ ID NO: 338702

SEQ ID NO: 341920 - RNA, 64 nt, Human; identical to SEQ ID NO: 338706

SEQ ID NO: 341921 - RNA, 64 nt, Human; identical to SEQ ID NO: 338707

SEQ ID NO: 341922 - RNA, 64 nt, Human; identical to SEQ ID NO: 338708

SEQ ID NO: 341923 - RNA, 64 nt, Human
uccugacuucuggaaucuuugagaccaaguuccagguggacaaagucaacuuccaguaagccaa

SEQ ID NO: 341924 - RNA, 64 nt, Human
gaacucaugccaacagucuuuaugaugggauuaagguggacaagaucuccuaagaucugugaau

SEQ ID NO: 341925 - RNA, 61 nt, Human
agccugaucagauaggagcacaagcaggggacggaaagagagagacacucaggcggcagca

SEQ ID NO: 341926 - RNA, 64 nt, Human; identical to SEQ ID NO: 338709

SEQ ID NO: 341927 - RNA, 64 nt, Human; identical to SEQ ID NO: 338710

SEQ ID NO: 341928 - RNA, 64 nt, Human; identical to SEQ ID NO: 338711

SEQ ID NO: 341929 - RNA, 64 nt, Human; identical to SEQ ID NO: 338712

SEQ ID NO: 341930 - RNA, 64 nt, Human; identical to SEQ ID NO: 338713

SEQ ID NO: 341931 - RNA, 64 nt, Human; identical to SEQ ID NO: 338714

SEQ ID NO: 341932 - RNA, 64 nt, Human; identical to SEQ ID NO: 338715

SEQ ID NO: 341933 - RNA, 64 nt, Human; identical to SEQ ID NO: 338716

SEQ ID NO: 341934 - RNA, 64 nt, Human; identical to SEQ ID NO: 338717

SEQ ID NO: 341935 - RNA, 64 nt, Human; identical to SEQ ID NO: 338718

SEQ ID NO: 341936 - RNA, 64 nt, Human; identical to SEQ ID NO: 338719

SEQ ID NO: 341937 - RNA, 64 nt, Human; identical to SEQ ID NO: 338720

SEQ ID NO: 341938 - RNA, 64 nt, Human; identical to SEQ ID NO: 338721

SEQ ID NO: 341939 - RNA, 64 nt, Human; identical to SEQ ID NO: 338725

SEQ ID NO: 341940 - RNA, 64 nt, Human; identical to SEQ ID NO: 338726

SEQ ID NO: 341941 - RNA, 64 nt, Human; identical to SEQ ID NO: 338727

SEQ ID NO: 341942 - RNA, 64 nt, Human
aagagguagaaaagauugggucuaggauaugguggguggacaggggccccgggacuuggagggu

SEQ ID NO: 341943 - RNA, 64 nt, Human
uccaagcuauacugugcaggacauggccaggccugguggacacaggaagccuacccaacacgcu

SEQ ID NO: 341944 - RNA, 64 nt, Human
agaggugguuuuugggucuuuaccaccugcggcugguggacagcagccagugugucuggacacc

SEQ ID NO: 341945 - RNA, 64 nt, Human; identical to SEQ ID NO: 338728

SEQ ID NO: 341946 - RNA, 64 nt, Human; identical to SEQ ID NO: 338729

SEQ ID NO: 341947 - RNA, 64 nt, Human; identical to SEQ ID NO: 338730

SEQ ID NO: 341948 - RNA, 64 nt, Human; identical to SEQ ID NO: 338731

SEQ ID NO: 341949 - RNA, 64 nt, Human; identical to SEQ ID NO: 338732

SEQ ID NO: 341950 - RNA, 64 nt, Human; identical to SEQ ID NO: 338733

SEQ ID NO: 341951 - RNA, 64 nt, Human; identical to SEQ ID NO: 338734

SEQ ID NO: 341952 - RNA, 64 nt, Human; identical to SEQ ID NO: 338735

SEQ ID NO: 341953 - RNA, 64 nt, Human; identical to SEQ ID NO: 338736

SEQ ID NO: 341954 - RNA, 64 nt, Human; identical to SEQ ID NO: 338737

SEQ ID NO: 341955 - RNA, 64 nt, Human; identical to SEQ ID NO: 338738

SEQ ID NO: 341956 - RNA, 64 nt, Human; identical to SEQ ID NO: 338739

SEQ ID NO: 341957 - RNA, 64 nt, Human; identical to SEQ ID NO: 338740

SEQ ID NO: 341958 - RNA, 64 nt, Human; identical to SEQ ID NO: 338744

SEQ ID NO: 341959 - RNA, 64 nt, Human; identical to SEQ ID NO: 338745

SEQ ID NO: 341960 - RNA, 64 nt, Human; identical to SEQ ID NO: 338746

SEQ ID NO: 341961 - RNA, 64 nt, Human
ccccugaaaaccacaccuuccuuuucaccuucuugguggacaguuuccuguugacagcauuucc

SEQ ID NO: 341962 - RNA, 64 nt, Human
ucuguccccugagcguugggggucccgggggagagguggacagacaccucccuccaacuggcau

SEQ ID NO: 341963 - RNA, 64 nt, Human
aaccuggccacaguugggggaggcagagccagcagguggacagguguuugcaggggcccaacuu

SEQ ID NO: 341964 - RNA, 64 nt, Human; identical to SEQ ID NO: 338747

SEQ ID NO: 341965 - RNA, 64 nt, Human; identical to SEQ ID NO: 338748

SEQ ID NO: 341966 - RNA, 64 nt, Human; identical to SEQ ID NO: 338749

SEQ ID NO: 341967 - RNA, 64 nt, Human; identical to SEQ ID NO: 338750

SEQ ID NO: 341968 - RNA, 64 nt, Human; identical to SEQ ID NO: 338751

SEQ ID NO: 341969 - RNA, 64 nt, Human; identical to SEQ ID NO: 338752

SEQ ID NO: 341970 - RNA, 64 nt, Human; identical to SEQ ID NO: 338753

SEQ ID NO: 341971 - RNA, 64 nt, Human; identical to SEQ ID NO: 338754

SEQ ID NO: 341972 - RNA, 64 nt, Human; identical to SEQ ID NO: 338755

SEQ ID NO: 341973 - RNA, 64 nt, Human; identical to SEQ ID NO: 338756

SEQ ID NO: 341974 - RNA, 64 nt, Human; identical to SEQ ID NO: 338757

SEQ ID NO: 341975 - RNA, 64 nt, Human; identical to SEQ ID NO: 338758

SEQ ID NO: 341976 - RNA, 64 nt, Human; identical to SEQ ID NO: 338759

SEQ ID NO: 341977 - RNA, 64 nt, Human; identical to SEQ ID NO: 338763

SEQ ID NO: 341978 - RNA, 64 nt, Human; identical to SEQ ID NO: 338764

SEQ ID NO: 341979 - RNA, 64 nt, Human; identical to SEQ ID NO: 338765

SEQ ID NO: 341980 - RNA, 64 nt, Human
gauggaugcuucccuguggcccuccuggggcaaggguggacagacucagacccccagcaugguu

SEQ ID NO: 341981 - RNA, 64 nt, Human
caccuguugaccuaaacucacuggacagacuccagguggacaccaacuccucaacagccccaug

SEQ ID NO: 341982 - RNA, 64 nt, Human
cucuucagcaccuggucuguucgcugcagggcaugguggacaguaaugcugaguucugucucac

SEQ ID NO: 341983 - RNA, 64 nt, Human; identical to SEQ ID NO: 338766

SEQ ID NO: 341984 - RNA, 64 nt, Human; identical to SEQ ID NO: 338767

SEQ ID NO: 341985 - RNA, 64 nt, Human; identical to SEQ ID NO: 338768

SEQ ID NO: 341986 - RNA, 64 nt, Human; identical to SEQ ID NO: 338769

SEQ ID NO: 341987 - RNA, 64 nt, Human; identical to SEQ ID NO: 338770

SEQ ID NO: 341988 - RNA, 64 nt, Human; identical to SEQ ID NO: 338771

SEQ ID NO: 341989 - RNA, 64 nt, Human; identical to SEQ ID NO: 338772

SEQ ID NO: 341990 - RNA, 64 nt, Human; identical to SEQ ID NO: 338773

SEQ ID NO: 341991 - RNA, 64 nt, Human; identical to SEQ ID NO: 338774

SEQ ID NO: 341992 - RNA, 64 nt, Human; identical to SEQ ID NO: 338775

SEQ ID NO: 341993 - RNA, 64 nt, Human; identical to SEQ ID NO: 338776

SEQ ID NO: 341994 - RNA, 64 nt, Human; identical to SEQ ID NO: 338777

SEQ ID NO: 341995 - RNA, 64 nt, Human; identical to SEQ ID NO: 338778

SEQ ID NO: 341996 - RNA, 64 nt, Human; identical to SEQ ID NO: 338782

SEQ ID NO: 341997 - RNA, 64 nt, Human; identical to SEQ ID NO: 338783

SEQ ID NO: 341998 - RNA, 64 nt, Human; identical to SEQ ID NO: 338784

SEQ ID NO: 341999 - RNA, 61 nt, Human
ugggugggugcuggcgguggggaccaagauccggaaagaugaauaaagacaaacaugacaa

SEQ ID NO: 342000 - RNA, 61 nt, Human
acagagcuaaggccaaugggcuagagggugccggaaagagagcuggagucugggcuccucu

SEQ ID NO: 342001 - RNA, 51 nt, Human
uuaagcccugcgucaugugaacggaaagaggccaagcgauggccgcucucu

SEQ ID NO: 342002 - RNA, 64 nt, Human; identical to SEQ ID NO: 338785

SEQ ID NO: 342003 - RNA, 64 nt, Human; identical to SEQ ID NO: 338786

SEQ ID NO: 342004 - RNA, 64 nt, Human; identical to SEQ ID NO: 338787

SEQ ID NO: 342005 - RNA, 64 nt, Human; identical to SEQ ID NO: 338788

SEQ ID NO: 342006 - RNA, 64 nt, Human; identical to SEQ ID NO: 338789

SEQ ID NO: 342007 - RNA, 64 nt, Human; identical to SEQ ID NO: 338790

SEQ ID NO: 342008 - RNA, 64 nt, Human; identical to SEQ ID NO: 338791

SEQ ID NO: 342009 - RNA, 64 nt, Human; identical to SEQ ID NO: 338792

SEQ ID NO: 342010 - RNA, 64 nt, Human; identical to SEQ ID NO: 338793

SEQ ID NO: 342011 - RNA, 64 nt, Human; identical to SEQ ID NO: 338794

SEQ ID NO: 342012 - RNA, 64 nt, Human; identical to SEQ ID NO: 338795

SEQ ID NO: 342013 - RNA, 64 nt, Human; identical to SEQ ID NO: 338796

SEQ ID NO: 342014 - RNA, 64 nt, Human; identical to SEQ ID NO: 338797

SEQ ID NO: 342015 - RNA, 64 nt, Human; identical to SEQ ID NO: 338801

SEQ ID NO: 342016 - RNA, 64 nt, Human; identical to SEQ ID NO: 338802

SEQ ID NO: 342017 - RNA, 64 nt, Human; identical to SEQ ID NO: 338803

SEQ ID NO: 342018 - RNA, 64 nt, Human
augccgaagaccgagggcaggggagggaggcggggguggacagggaggcagcuugugaauuuuu

SEQ ID NO: 342019 - RNA, 64 nt, Human
uccccauauaggcccguccacacaggcuugacuggguggacaagaaugaacccaugacagcacc

SEQ ID NO: 342020 - RNA, 64 nt, Human
ccauccuaaggggaacucccaaauggguguugcugguggacacagaugcuccccccaauggaag

SEQ ID NO: 342021 - RNA, 64 nt, Human; identical to SEQ ID NO: 338804

SEQ ID NO: 342022 - RNA, 64 nt, Human; identical to SEQ ID NO: 338805

SEQ ID NO: 342023 - RNA, 64 nt, Human; identical to SEQ ID NO: 338806

SEQ ID NO: 342024 - RNA, 64 nt, Human; identical to SEQ ID NO: 338807

SEQ ID NO: 342025 - RNA, 64 nt, Human; identical to SEQ ID NO: 338808

SEQ ID NO: 342026 - RNA, 64 nt, Human; identical to SEQ ID NO: 338809

SEQ ID NO: 342027 - RNA, 64 nt, Human; identical to SEQ ID NO: 338810

SEQ ID NO: 342028 - RNA, 64 nt, Human; identical to SEQ ID NO: 338811

SEQ ID NO: 342029 - RNA, 64 nt, Human; identical to SEQ ID NO: 338812

SEQ ID NO: 342030 - RNA, 64 nt, Human; identical to SEQ ID NO: 338813

SEQ ID NO: 342031 - RNA, 64 nt, Human; identical to SEQ ID NO: 338814

SEQ ID NO: 342032 - RNA, 64 nt, Human; identical to SEQ ID NO: 338815

SEQ ID NO: 342033 - RNA, 64 nt, Human; identical to SEQ ID NO: 338816

SEQ ID NO: 342034 - RNA, 64 nt, Human; identical to SEQ ID NO: 338820

SEQ ID NO: 342035 - RNA, 64 nt, Human; identical to SEQ ID NO: 338821

SEQ ID NO: 342036 - RNA, 64 nt, Human; identical to SEQ ID NO: 338822

SEQ ID NO: 342037 - RNA, 64 nt, Human
uagggcugcacuguccuggguguugggcccuucugguggacaaggcugugccaacccuguacag

SEQ ID NO: 342038 - RNA, 64 nt, Human
cguugaccucccucucagcucccugcucagggacgguggacagguugccuacugggacacucua

SEQ ID NO: 342039 - RNA, 64 nt, Human
guacacauugggcggccugcaggaaccugcuccagguggacacacgggccagcagccgcgaacc

SEQ ID NO: 342040 - RNA, 64 nt, Human; identical to SEQ ID NO: 338823

SEQ ID NO: 342041 - RNA, 64 nt, Human; identical to SEQ ID NO: 338824

SEQ ID NO: 342042 - RNA, 64 nt, Human; identical to SEQ ID NO: 338825

SEQ ID NO: 342043 - RNA, 64 nt, Human; identical to SEQ ID NO: 338826

SEQ ID NO: 342044 - RNA, 64 nt, Human; identical to SEQ ID NO: 338827

SEQ ID NO: 342045 - RNA, 64 nt, Human; identical to SEQ ID NO: 338828

SEQ ID NO: 342046 - RNA, 64 nt, Human; identical to SEQ ID NO: 338829

SEQ ID NO: 342047 - RNA, 64 nt, Human; identical to SEQ ID NO: 338830

SEQ ID NO: 342048 - RNA, 64 nt, Human; identical to SEQ ID NO: 338831

SEQ ID NO: 342049 - RNA, 64 nt, Human; identical to SEQ ID NO: 338832

SEQ ID NO: 342050 - RNA, 64 nt, Human; identical to SEQ ID NO: 338833

SEQ ID NO: 342051 - RNA, 64 nt, Human; identical to SEQ ID NO: 338834

SEQ ID NO: 342052 - RNA, 64 nt, Human; identical to SEQ ID NO: 338835

SEQ ID NO: 342053 - RNA, 64 nt, Human; identical to SEQ ID NO: 338839

SEQ ID NO: 342054 - RNA, 64 nt, Human; identical to SEQ ID NO: 338840

SEQ ID NO: 342055 - RNA, 64 nt, Human; identical to SEQ ID NO: 338841

SEQ ID NO: 342056 - RNA, 64 nt, Human
gagaacugcccuuauggagcuugcaguccagugagguggacagaccuguccccagacagugaug

SEQ ID NO: 342057 - RNA, 64 nt, Human
gcacauucaggacuagaagccccucugggcaugggguggacauggcaggucagccuguggaacu

SEQ ID NO: 342058 - RNA, 64 nt, Human
agauucuucugcaggaugugucugucuuugucacgguggacagagggugacaucauaggagcag

SEQ ID NO: 342059 - RNA, 64 nt, Human; identical to SEQ ID NO: 338842

SEQ ID NO: 342060 - RNA, 64 nt, Human; identical to SEQ ID NO: 338843

SEQ ID NO: 342061 - RNA, 64 nt, Human; identical to SEQ ID NO: 338844

SEQ ID NO: 342062 - RNA, 64 nt, Human; identical to SEQ ID NO: 338845

SEQ ID NO: 342063 - RNA, 64 nt, Human; identical to SEQ ID NO: 338846

SEQ ID NO: 342064 - RNA, 64 nt, Human; identical to SEQ ID NO: 338847

SEQ ID NO: 342065 - RNA, 64 nt, Human; identical to SEQ ID NO: 338848

SEQ ID NO: 342066 - RNA, 64 nt, Human; identical to SEQ ID NO: 338849

SEQ ID NO: 342067 - RNA, 64 nt, Human; identical to SEQ ID NO: 338850

SEQ ID NO: 342068 - RNA, 64 nt, Human; identical to SEQ ID NO: 338851

SEQ ID NO: 342069 - RNA, 64 nt, Human; identical to SEQ ID NO: 338852

SEQ ID NO: 342070 - RNA, 64 nt, Human; identical to SEQ ID NO: 338853

SEQ ID NO: 342071 - RNA, 64 nt, Human; identical to SEQ ID NO: 338854

SEQ ID NO: 342072 - RNA, 64 nt, Human; identical to SEQ ID NO: 338858

SEQ ID NO: 342073 - RNA, 64 nt, Human; identical to SEQ ID NO: 338859

SEQ ID NO: 342074 - RNA, 62 nt, Human; identical to SEQ ID NO: 338860

SEQ ID NO: 342075 - RNA, 64 nt, Human
ccagggccugaugggcaccacgugaggggcacuugguggacagggcggggcugacguggccucc

SEQ ID NO: 342076 - RNA, 64 nt, Human
ugagggaaauugcugcugucuacaaaaugccaaggguggacaggcgcuguggcucacgccugua

SEQ ID NO: 342077 - RNA, 64 nt, Human
augaagcuaagaaaaguuuuguguuuuggggguugguggacaaaguucuagcugauuaaauaug

SEQ ID NO: 342078 - RNA, 64 nt, Human; identical to SEQ ID NO: 338861

SEQ ID NO: 342079 - RNA, 64 nt, Human; identical to SEQ ID NO: 338862

SEQ ID NO: 342080 - RNA, 64 nt, Human; identical to SEQ ID NO: 338863

SEQ ID NO: 342081 - RNA, 64 nt, Human; identical to SEQ ID NO: 338864

SEQ ID NO: 342082 - RNA, 64 nt, Human; identical to SEQ ID NO: 338865

SEQ ID NO: 342083 - RNA, 64 nt, Human; identical to SEQ ID NO: 338866

SEQ ID NO: 342084 - RNA, 64 nt, Human; identical to SEQ ID NO: 338867

SEQ ID NO: 342085 - RNA, 64 nt, Human; identical to SEQ ID NO: 338868

SEQ ID NO: 342086 - RNA, 64 nt, Human; identical to SEQ ID NO: 338869

SEQ ID NO: 342087 - RNA, 64 nt, Human; identical to SEQ ID NO: 338870

SEQ ID NO: 342088 - RNA, 64 nt, Human; identical to SEQ ID NO: 338871

SEQ ID NO: 342089 - RNA, 51 nt, Human; identical to SEQ ID NO: 338872

SEQ ID NO: 342090 - RNA, 64 nt, Human; identical to SEQ ID NO: 338873

SEQ ID NO: 342091 - RNA, 64 nt, Human; identical to SEQ ID NO: 338877

SEQ ID NO: 342092 - RNA, 64 nt, Human; identical to SEQ ID NO: 338878

SEQ ID NO: 342093 - RNA, 64 nt, Human; identical to SEQ ID NO: 338879

SEQ ID NO: 342094 - RNA, 64 nt, Human
ggggcccacccuggaagaguggacagugacacaagguggacacucucuacagaucacugaggau

SEQ ID NO: 342095 - RNA, 64 nt, Human
ccaaucugcuccggcccuggucuucccccaucccgguggacagacuuaacgauccuugcugcag

SEQ ID NO: 342096 - RNA, 64 nt, Human
agagcuccucugcuccucgcuugaaugauucagggucagggagguggcucagaguccaccucuc

SEQ ID NO: 342097 - RNA, 64 nt, Human; identical to SEQ ID NO: 338880

SEQ ID NO: 342098 - RNA, 64 nt, Human; identical to SEQ ID NO: 338881

SEQ ID NO: 342099 - RNA, 64 nt, Human; identical to SEQ ID NO: 338882

SEQ ID NO: 342100 - RNA, 64 nt, Human; identical to SEQ ID NO: 338883

SEQ ID NO: 342101 - RNA, 64 nt, Human; identical to SEQ ID NO: 338884

SEQ ID NO: 342102 - RNA, 64 nt, Human; identical to SEQ ID NO: 338885

SEQ ID NO: 342103 - RNA, 64 nt, Human; identical to SEQ ID NO: 338886

SEQ ID NO: 342104 - RNA, 64 nt, Human; identical to SEQ ID NO: 338887

SEQ ID NO: 342105 - RNA, 64 nt, Human; identical to SEQ ID NO: 338888

SEQ ID NO: 342106 - RNA, 64 nt, Human; identical to SEQ ID NO: 338889

SEQ ID NO: 342107 - RNA, 64 nt, Human; identical to SEQ ID NO: 338890

SEQ ID NO: 342108 - RNA, 64 nt, Human; identical to SEQ ID NO: 338891

SEQ ID NO: 342109 - RNA, 64 nt, Human; identical to SEQ ID NO: 338892

SEQ ID NO: 342110 - RNA, 64 nt, Human; identical to SEQ ID NO: 338896

SEQ ID NO: 342111 - RNA, 64 nt, Human; identical to SEQ ID NO: 338897

SEQ ID NO: 342112 - RNA, 64 nt, Human; identical to SEQ ID NO: 338898

SEQ ID NO: 342113 - RNA, 64 nt, Human
gacccacucuguuccagaagcccuauaagcuggagguggacaacucgauguaaauuucauggga

SEQ ID NO: 342114 - RNA, 64 nt, Human
ggaggaaccaggcuacuuuccccaguacugaggugguggacaucgucucugccacuccugaccc

SEQ ID NO: 342115 - RNA, 64 nt, Human
ggucagguccugucaagaggagcuggguguccuggguggacauuugaagaauuauauucauucc

SEQ ID NO: 342116 - RNA, 64 nt, Human; identical to SEQ ID NO: 338899

SEQ ID NO: 342117 - RNA, 64 nt, Human; identical to SEQ ID NO: 338900

SEQ ID NO: 342118 - RNA, 64 nt, Human; identical to SEQ ID NO: 338901

SEQ ID NO: 342119 - RNA, 64 nt, Human; identical to SEQ ID NO: 338902

SEQ ID NO: 342120 - RNA, 51 nt, Human; identical to SEQ ID NO: 338903

SEQ ID NO: 342121 - RNA, 64 nt, Human; identical to SEQ ID NO: 338904

SEQ ID NO: 342122 - RNA, 64 nt, Human; identical to SEQ ID NO: 338905

SEQ ID NO: 342123 - RNA, 64 nt, Human; identical to SEQ ID NO: 338906

SEQ ID NO: 342124 - RNA, 64 nt, Human; identical to SEQ ID NO: 338907

SEQ ID NO: 342125 - RNA, 64 nt, Human; identical to SEQ ID NO: 338908

SEQ ID NO: 342126 - RNA, 64 nt, Human; identical to SEQ ID NO: 338909

SEQ ID NO: 342127 - RNA, 64 nt, Human; identical to SEQ ID NO: 338910

SEQ ID NO: 342128 - RNA, 64 nt, Human; identical to SEQ ID NO: 338911

SEQ ID NO: 342129 - RNA, 64 nt, Human; identical to SEQ ID NO: 338915

SEQ ID NO: 342130 - RNA, 64 nt, Human; identical to SEQ ID NO: 338916

SEQ ID NO: 342131 - RNA, 64 nt, Human; identical to SEQ ID NO: 338917

SEQ ID NO: 342132 - RNA, 64 nt, Human
acuggcauacugcaaaguccccagcccugccucugguggacagcaucguccuggaauggccacg

SEQ ID NO: 342133 - RNA, 64 nt, Human
aaaaauguuguguguggugcucuagucaucuugugguggacaugucgcuauuaccgaauucgca

SEQ ID NO: 342134 - RNA, 64 nt, Human
cugaagauuugagggaggggagauggagaggagagguggacaaaguacuugguuugcuaagaac

SEQ ID NO: 342135 - RNA, 64 nt, Human; identical to SEQ ID NO: 338918

SEQ ID NO: 342136 - RNA, 64 nt, Human; identical to SEQ ID NO: 338919

SEQ ID NO: 342137 - RNA, 64 nt, Human; identical to SEQ ID NO: 338920

SEQ ID NO: 342138 - RNA, 64 nt, Human; identical to SEQ ID NO: 338921

SEQ ID NO: 342139 - RNA, 64 nt, Human; identical to SEQ ID NO: 338922

SEQ ID NO: 342140 - RNA, 64 nt, Human; identical to SEQ ID NO: 338923

SEQ ID NO: 342141 - RNA, 64 nt, Human; identical to SEQ ID NO: 338924

SEQ ID NO: 342142 - RNA, 64 nt, Human; identical to SEQ ID NO: 338925

SEQ ID NO: 342143 - RNA, 64 nt, Human; identical to SEQ ID NO: 338926

SEQ ID NO: 342144 - RNA, 64 nt, Human; identical to SEQ ID NO: 338927

SEQ ID NO: 342145 - RNA, 64 nt, Human; identical to SEQ ID NO: 338928

SEQ ID NO: 342146 - RNA, 64 nt, Human; identical to SEQ ID NO: 338929

SEQ ID NO: 342147 - RNA, 64 nt, Human; identical to SEQ ID NO: 338930

SEQ ID NO: 342148 - RNA, 64 nt, Human; identical to SEQ ID NO: 338934

SEQ ID NO: 342149 - RNA, 64 nt, Human; identical to SEQ ID NO: 338935

SEQ ID NO: 342150 - RNA, 64 nt, Human; identical to SEQ ID NO: 338936

SEQ ID NO: 342151 - RNA, 64 nt, Human
uuucuccguauuuauuuuuuuauucuucggaggagguggacauuucggaagugguggggacuaa

SEQ ID NO: 342152 - RNA, 64 nt, Human
ugaccacagucugagggggggggaaggggacugcgguggacaccagaggaagcuguuuccuguu

SEQ ID NO: 342153 - RNA, 64 nt, Human
ucagccaucaagaacccacacagacggcagggaagguggacacaguaugaacuacugcugaugu

SEQ ID NO: 342154 - RNA, 64 nt, Human; identical to SEQ ID NO: 338937

SEQ ID NO: 342155 - RNA, 64 nt, Human; identical to SEQ ID NO: 338938

SEQ ID NO: 342156 - RNA, 64 nt, Human; identical to SEQ ID NO: 338939

SEQ ID NO: 342157 - RNA, 64 nt, Human; identical to SEQ ID NO: 338940

SEQ ID NO: 342158 - RNA, 64 nt, Human; identical to SEQ ID NO: 338941

SEQ ID NO: 342159 - RNA, 64 nt, Human; identical to SEQ ID NO: 338942

SEQ ID NO: 342160 - RNA, 64 nt, Human; identical to SEQ ID NO: 338943

SEQ ID NO: 342161 - RNA, 64 nt, Human; identical to SEQ ID NO: 338944

SEQ ID NO: 342162 - RNA, 64 nt, Human; identical to SEQ ID NO: 338945

SEQ ID NO: 342163 - RNA, 64 nt, Human; identical to SEQ ID NO: 338946

SEQ ID NO: 342164 - RNA, 64 nt, Human; identical to SEQ ID NO: 338947

SEQ ID NO: 342165 - RNA, 64 nt, Human; identical to SEQ ID NO: 338948

SEQ ID NO: 342166 - RNA, 63 nt, Human; identical to SEQ ID NO: 338949

SEQ ID NO: 342167 - RNA, 64 nt, Human; identical to SEQ ID NO: 338953

SEQ ID NO: 342168 - RNA, 64 nt, Human; identical to SEQ ID NO: 338954

SEQ ID NO: 342169 - RNA, 64 nt, Human; identical to SEQ ID NO: 338955

SEQ ID NO: 342170 - RNA, 64 nt, Human
ugaaucugggcuuugcaagcuccugcuccauauugguggacaugggaaugguugguguggccug

SEQ ID NO: 342171 - RNA, 64 nt, Human
gcugucccuucuggggaggcuuugguggcucugagguggacaaagagcucucgcaagaagagac

SEQ ID NO: 342172 - RNA, 64 nt, Human
uucuuuauccugugaacucaucugagugggaggugguggacacugggguuuccuucccucucuc

SEQ ID NO: 342173 - RNA, 64 nt, Human; identical to SEQ ID NO: 338956

SEQ ID NO: 342174 - RNA, 64 nt, Human; identical to SEQ ID NO: 338957

SEQ ID NO: 342175 - RNA, 64 nt, Human; identical to SEQ ID NO: 338958

SEQ ID NO: 342176 - RNA, 64 nt, Human; identical to SEQ ID NO: 338959

SEQ ID NO: 342177 - RNA, 64 nt, Human; identical to SEQ ID NO: 338960

SEQ ID NO: 342178 - RNA, 64 nt, Human; identical to SEQ ID NO: 338961

SEQ ID NO: 342179 - RNA, 64 nt, Human; identical to SEQ ID NO: 338962

SEQ ID NO: 342180 - RNA, 64 nt, Human; identical to SEQ ID NO: 338963

SEQ ID NO: 342181 - RNA, 64 nt, Human; identical to SEQ ID NO: 338964

SEQ ID NO: 342182 - RNA, 64 nt, Human; identical to SEQ ID NO: 338965

SEQ ID NO: 342183 - RNA, 64 nt, Human; identical to SEQ ID NO: 338966

SEQ ID NO: 342184 - RNA, 64 nt, Human; identical to SEQ ID NO: 338967

SEQ ID NO: 342185 - RNA, 64 nt, Human; identical to SEQ ID NO: 338968

SEQ ID NO: 342186 - RNA, 64 nt, Human; identical to SEQ ID NO: 338972

SEQ ID NO: 342187 - RNA, 64 nt, Human; identical to SEQ ID NO: 338973

SEQ ID NO: 342188 - RNA, 64 nt, Human; identical to SEQ ID NO: 338974

SEQ ID NO: 342189 - RNA, 64 nt, Human
accgacugacuucagggaucugggccaggagugugguggacauuggacaaagaggccauuuugg

SEQ ID NO: 342190 - RNA, 64 nt, Human
aaaguuagccacugaaggccaaaacaccaugugggguggacagaggguuugcugggcuggcuuu

SEQ ID NO: 342191 - RNA, 64 nt, Human
uuccccagcucggccucugucgggaccagugccagguggacagccaguguccuggccagaugaa

SEQ ID NO: 342192 - RNA, 64 nt, Human; identical to SEQ ID NO: 338975

SEQ ID NO: 342193 - RNA, 64 nt, Human; identical to SEQ ID NO: 338976

SEQ ID NO: 342194 - RNA, 64 nt, Human; identical to SEQ ID NO: 338977

SEQ ID NO: 342195 - RNA, 64 nt, Human; identical to SEQ ID NO: 338978

SEQ ID NO: 342196 - RNA, 64 nt, Human; identical to SEQ ID NO: 338979

SEQ ID NO: 342197 - RNA, 64 nt, Human; identical to SEQ ID NO: 338980

SEQ ID NO: 342198 - RNA, 64 nt, Human; identical to SEQ ID NO: 338981

SEQ ID NO: 342199 - RNA, 64 nt, Human; identical to SEQ ID NO: 338982

SEQ ID NO: 342200 - RNA, 64 nt, Human; identical to SEQ ID NO: 338983

SEQ ID NO: 342201 - RNA, 64 nt, Human; identical to SEQ ID NO: 338984

SEQ ID NO: 342202 - RNA, 64 nt, Human; identical to SEQ ID NO: 338985

SEQ ID NO: 342203 - RNA, 64 nt, Human; identical to SEQ ID NO: 338986

SEQ ID NO: 342204 - RNA, 64 nt, Human; identical to SEQ ID NO: 338987

SEQ ID NO: 342205 - RNA, 64 nt, Human; identical to SEQ ID NO: 338991

SEQ ID NO: 342206 - RNA, 64 nt, Human; identical to SEQ ID NO: 338992

SEQ ID NO: 342207 - RNA, 64 nt, Human; identical to SEQ ID NO: 338993

SEQ ID NO: 342208 - RNA, 58 nt, Human
agguggaccaacuaccuuaaugcaaagagguggacaggauaacacagauaagggcuuu

SEQ ID NO: 342209 - RNA, 64 nt, Human
aauuuauauagcagugaagaauuacaugccuucugguggacauuuuauaagugcauuuuauauc

SEQ ID NO: 342210 - RNA, 64 nt, Human
cuccccucucuuccuugcagugcuuuccuaaggggguggacaugauggcugcccuugaucucua

SEQ ID NO: 342211 - RNA, 64 nt, Human; identical to SEQ ID NO: 338994

SEQ ID NO: 342212 - RNA, 64 nt, Human; identical to SEQ ID NO: 338995

SEQ ID NO: 342213 - RNA, 56 nt, Human; identical to SEQ ID NO: 338996

SEQ ID NO: 342214 - RNA, 56 nt, Human; identical to SEQ ID NO: 338996

SEQ ID NO: 342215 - RNA, 64 nt, Human; identical to SEQ ID NO: 338998

SEQ ID NO: 342216 - RNA, 64 nt, Human; identical to SEQ ID NO: 338999

SEQ ID NO: 342217 - RNA, 64 nt, Human; identical to SEQ ID NO: 339000

SEQ ID NO: 342218 - RNA, 64 nt, Human; identical to SEQ ID NO: 339001

SEQ ID NO: 342219 - RNA, 64 nt, Human; identical to SEQ ID NO: 339002

SEQ ID NO: 342220 - RNA, 64 nt, Human; identical to SEQ ID NO: 339003

SEQ ID NO: 342221 - RNA, 64 nt, Human; identical to SEQ ID NO: 339004

SEQ ID NO: 342222 - RNA, 64 nt, Human; identical to SEQ ID NO: 339005

SEQ ID NO: 342223 - RNA, 64 nt, Human; identical to SEQ ID NO: 339006

SEQ ID NO: 342224 - RNA, 64 nt, Human; identical to SEQ ID NO: 339010

SEQ ID NO: 342225 - RNA, 64 nt, Human; identical to SEQ ID NO: 339011

SEQ ID NO: 342226 - RNA, 64 nt, Human; identical to SEQ ID NO: 339012

SEQ ID NO: 342227 - RNA, 64 nt, Human
augaacugugaucccacuacugcauuccagccuggguggacagaacaaggcccugucucuauuu

SEQ ID NO: 342228 - RNA, 64 nt, Human
augucugccuugcucuacagcacaaccucuugaggguggacagggagaaagaugauggugucag

SEQ ID NO: 342229 - RNA, 64 nt, Human
cugggggcucuuccaagucagaagaauggaggaagguggacaagcaacccagcaucccccgacc

SEQ ID NO: 342230 - RNA, 64 nt, Human; identical to SEQ ID NO: 339013

SEQ ID NO: 342231 - RNA, 64 nt, Human; identical to SEQ ID NO: 339014

SEQ ID NO: 342232 - RNA, 64 nt, Human; identical to SEQ ID NO: 339015

SEQ ID NO: 342233 - RNA, 64 nt, Human; identical to SEQ ID NO: 339016

SEQ ID NO: 342234 - RNA, 64 nt, Human; identical to SEQ ID NO: 339017

SEQ ID NO: 342235 - RNA, 64 nt, Human; identical to SEQ ID NO: 339018

SEQ ID NO: 342236 - RNA, 64 nt, Human; identical to SEQ ID NO: 339019

SEQ ID NO: 342237 - RNA, 64 nt, Human; identical to SEQ ID NO: 339020

SEQ ID NO: 342238 - RNA, 64 nt, Human; identical to SEQ ID NO: 339021

SEQ ID NO: 342239 - RNA, 64 nt, Human; identical to SEQ ID NO: 339022

SEQ ID NO: 342240 - RNA, 64 nt, Human; identical to SEQ ID NO: 339023

SEQ ID NO: 342241 - RNA, 64 nt, Human; identical to SEQ ID NO: 339024

SEQ ID NO: 342242 - RNA, 64 nt, Human; identical to SEQ ID NO: 339025

SEQ ID NO: 342243 - RNA, 64 nt, Human; identical to SEQ ID NO: 339029

SEQ ID NO: 342244 - RNA, 64 nt, Human; identical to SEQ ID NO: 339030

SEQ ID NO: 342245 - RNA, 64 nt, Human; identical to SEQ ID NO: 339031

SEQ ID NO: 342246 - RNA, 64 nt, Human
cacggggccugggugaccgccaauacuugaccaccccgucgagccccaucgggccgcugccccc

SEQ ID NO: 342247 - RNA, 64 nt, Human
gagaccccgggagccggggaaggaggccguccaucccgucgacguagaaccucgagguuucuca

SEQ ID NO: 342248 - RNA, 64 nt, Human
aaagaauucugaguuuuucaaacacuagucuagagguggacauugucagggguucuggaauggg

SEQ ID NO: 342249 - RNA, 64 nt, Human; identical to SEQ ID NO: 339032

SEQ ID NO: 342250 - RNA, 64 nt, Human; identical to SEQ ID NO: 339033

SEQ ID NO: 342251 - RNA, 64 nt, Human; identical to SEQ ID NO: 339034

SEQ ID NO: 342252 - RNA, 64 nt, Human; identical to SEQ ID NO: 339035

SEQ ID NO: 342253 - RNA, 64 nt, Human; identical to SEQ ID NO: 339036

SEQ ID NO: 342254 - RNA, 64 nt, Human; identical to SEQ ID NO: 339037

SEQ ID NO: 342255 - RNA, 64 nt, Human; identical to SEQ ID NO: 339038

SEQ ID NO: 342256 - RNA, 64 nt, Human; identical to SEQ ID NO: 339039

SEQ ID NO: 342257 - RNA, 64 nt, Human; identical to SEQ ID NO: 339040

SEQ ID NO: 342258 - RNA, 64 nt, Human; identical to SEQ ID NO: 339041

SEQ ID NO: 342259 - RNA, 64 nt, Human; identical to SEQ ID NO: 339042

SEQ ID NO: 342260 - RNA, 64 nt, Human; identical to SEQ ID NO: 339043

SEQ ID NO: 342261 - RNA, 64 nt, Human; identical to SEQ ID NO: 339044

SEQ ID NO: 342262 - RNA, 64 nt, Human; identical to SEQ ID NO: 339048

SEQ ID NO: 342263 - RNA, 64 nt, Human; identical to SEQ ID NO: 339049

SEQ ID NO: 342264 - RNA, 64 nt, Human; identical to SEQ ID NO: 339050

SEQ ID NO: 342265 - RNA, 60 nt, Human
caauaguagucucugugaggccuuacugaccucaccuaggaagugauuuuugagcccuug

SEQ ID NO: 342266 - RNA, 60 nt, Human
guagagauuuuaggcgucuucggauaucuucucaccuauguucccuggcuaagaagucag

SEQ ID NO: 342267 - RNA, 64 nt, Human
ugcccacaaguaacacaccagguacccagagcaggguggacaggagagaccugaaucacagcag

SEQ ID NO: 342268 - RNA, 64 nt, Human; identical to SEQ ID NO: 339051

SEQ ID NO: 342269 - RNA, 64 nt, Human; identical to SEQ ID NO: 339052

SEQ ID NO: 342270 - RNA, 64 nt, Human; identical to SEQ ID NO: 339053

SEQ ID NO: 342271 - RNA, 64 nt, Human; identical to SEQ ID NO: 339054

SEQ ID NO: 342272 - RNA, 64 nt, Human; identical to SEQ ID NO: 339055

SEQ ID NO: 342273 - RNA, 64 nt, Human; identical to SEQ ID NO: 339056

SEQ ID NO: 342274 - RNA, 64 nt, Human; identical to SEQ ID NO: 339057

SEQ ID NO: 342275 - RNA, 62 nt, Human; identical to SEQ ID NO: 339058

SEQ ID NO: 342276 - RNA, 64 nt, Human; identical to SEQ ID NO: 339059

SEQ ID NO: 342277 - RNA, 64 nt, Human; identical to SEQ ID NO: 339060

SEQ ID NO: 342278 - RNA, 64 nt, Human; identical to SEQ ID NO: 339061

SEQ ID NO: 342279 - RNA, 64 nt, Human; identical to SEQ ID NO: 339062

SEQ ID NO: 342280 - RNA, 64 nt, Human; identical to SEQ ID NO: 339063

SEQ ID NO: 342281 - RNA, 64 nt, Human; identical to SEQ ID NO: 339067

SEQ ID NO: 342282 - RNA, 64 nt, Human; identical to SEQ ID NO: 339068

SEQ ID NO: 342283 - RNA, 64 nt, Human; identical to SEQ ID NO: 339069

SEQ ID NO: 342284 - RNA, 64 nt, Human
aaacaaggaagagaaaugaggaucucaggaccuugguggacacuguguacaccucuggauucau

SEQ ID NO: 342285 - RNA, 64 nt, Human
cggcacuuccccuuuaagguuauuaaagguaagggguggacagacuuucugcauucagauaaug

SEQ ID NO: 342286 - RNA, 64 nt, Human
uuauuuauagcauguuucuuuuugaaaaacuagugguggacacauuuggaucacauuuauacag

SEQ ID NO: 342287 - RNA, 64 nt, Human; identical to SEQ ID NO: 339070

SEQ ID NO: 342288 - RNA, 64 nt, Human; identical to SEQ ID NO: 339071

SEQ ID NO: 342289 - RNA, 64 nt, Human; identical to SEQ ID NO: 339072

SEQ ID NO: 342290 - RNA, 64 nt, Human; identical to SEQ ID NO: 339073

SEQ ID NO: 342291 - RNA, 64 nt, Human; identical to SEQ ID NO: 339074

SEQ ID NO: 342292 - RNA, 64 nt, Human; identical to SEQ ID NO: 339075

SEQ ID NO: 342293 - RNA, 64 nt, Human; identical to SEQ ID NO: 339076

SEQ ID NO: 342294 - RNA, 64 nt, Human; identical to SEQ ID NO: 339077

SEQ ID NO: 342295 - RNA, 64 nt, Human; identical to SEQ ID NO: 339078

SEQ ID NO: 342296 - RNA, 64 nt, Human; identical to SEQ ID NO: 339079

SEQ ID NO: 342297 - RNA, 64 nt, Human; identical to SEQ ID NO: 339080

SEQ ID NO: 342298 - RNA, 64 nt, Human; identical to SEQ ID NO: 339081

SEQ ID NO: 342299 - RNA, 64 nt, Human; identical to SEQ ID NO: 339082

SEQ ID NO: 342300 - RNA, 64 nt, Human; identical to SEQ ID NO: 339086

SEQ ID NO: 342301 - RNA, 64 nt, Human; identical to SEQ ID NO: 339087

SEQ ID NO: 342302 - RNA, 64 nt, Human; identical to SEQ ID NO: 339088

SEQ ID NO: 342303 - RNA, 64 nt, Human
ccugucuggcugcuggaccuggacaccagggcucgguggacacaagaucuauugacgggccuug

SEQ ID NO: 342304 - RNA, 64 nt, Human
gccuacacccggaccugcaguccaaccuccugcagguggacagugaguucacagaggaagagau

SEQ ID NO: 342305 - RNA, 64 nt, Human
gguuaauuuacaacccaaacagcaaaacacaguugguggacaaguucaugcaggaccuacagug

SEQ ID NO: 342306 - RNA, 64 nt, Human; identical to SEQ ID NO: 339089

SEQ ID NO: 342307 - RNA, 64 nt, Human; identical to SEQ ID NO: 339090

SEQ ID NO: 342308 - RNA, 64 nt, Human; identical to SEQ ID NO: 339091

SEQ ID NO: 342309 - RNA, 64 nt, Human; identical to SEQ ID NO: 339092

SEQ ID NO: 342310 - RNA, 64 nt, Human; identical to SEQ ID NO: 339093

SEQ ID NO: 342311 - RNA, 64 nt, Human; identical to SEQ ID NO: 339094

SEQ ID NO: 342312 - RNA, 57 nt, Human; identical to SEQ ID NO: 339095

SEQ ID NO: 342313 - RNA, 56 nt, Human; identical to SEQ ID NO: 339096

SEQ ID NO: 342314 - RNA, 64 nt, Human; identical to SEQ ID NO: 339097

SEQ ID NO: 342315 - RNA, 64 nt, Human; identical to SEQ ID NO: 339098

SEQ ID NO: 342316 - RNA, 64 nt, Human; identical to SEQ ID NO: 339099

SEQ ID NO: 342317 - RNA, 64 nt, Human; identical to SEQ ID NO: 339100

SEQ ID NO: 342318 - RNA, 64 nt, Human; identical to SEQ ID NO: 339101

SEQ ID NO: 342319 - RNA, 64 nt, Human; identical to SEQ ID NO: 339105

SEQ ID NO: 342320 - RNA, 64 nt, Human; identical to SEQ ID NO: 339106

SEQ ID NO: 342321 - RNA, 64 nt, Human; identical to SEQ ID NO: 339107

SEQ ID NO: 342322 - RNA, 60 nt, Human
uccuccaagccuaucucucaccauccagcccucaccuagccauuucccaacccuaguccu

SEQ ID NO: 342323 - RNA, 60 nt, Human
acaaaggggggcuacgcagucacugacuuccucaccuacaacugccucacgguaagcaug

SEQ ID NO: 342324 - RNA, 60 nt, Human
ugggcugccgggaccucacuuucccagggccucaccuaccuagggucucacuagucgggg

SEQ ID NO: 342325 - RNA, 64 nt, Human; identical to SEQ ID NO: 339108

SEQ ID NO: 342326 - RNA, 64 nt, Human; identical to SEQ ID NO: 339109

SEQ ID NO: 342327 - RNA, 64 nt, Human; identical to SEQ ID NO: 339110

SEQ ID NO: 342328 - RNA, 64 nt, Human; identical to SEQ ID NO: 339111

SEQ ID NO: 342329 - RNA, 64 nt, Human; identical to SEQ ID NO: 339112

SEQ ID NO: 342330 - RNA, 64 nt, Human; identical to SEQ ID NO: 339113

SEQ ID NO: 342331 - RNA, 64 nt, Human; identical to SEQ ID NO: 339114

SEQ ID NO: 342332 - RNA, 64 nt, Human; identical to SEQ ID NO: 339115

SEQ ID NO: 342333 - RNA, 64 nt, Human; identical to SEQ ID NO: 339116

SEQ ID NO: 342334 - RNA, 64 nt, Human; identical to SEQ ID NO: 339117

SEQ ID NO: 342335 - RNA, 64 nt, Human; identical to SEQ ID NO: 339118

SEQ ID NO: 342336 - RNA, 64 nt, Human; identical to SEQ ID NO: 339119

SEQ ID NO: 342337 - RNA, 64 nt, Human; identical to SEQ ID NO: 339120

SEQ ID NO: 342338 - RNA, 64 nt, Human; identical to SEQ ID NO: 339124

SEQ ID NO: 342339 - RNA, 60 nt, Human
ucaauccccucccaucuuccccagaccuaccucaccuacuaggaccugaggcagcuccuu

SEQ ID NO: 342340 - RNA, 60 nt, Human
ugcccuuucacacacacuuucuacccaauucucaccuagugucacguucccccgacccug

SEQ ID NO: 342341 - RNA, 60 nt, Human
cacuuggagacgggggagcuggcucagcaccucaccuaccuggaguuccgguccuuccag

SEQ ID NO: 342342 - RNA, 61 nt, Human; identical to SEQ ID NO: 339125

SEQ ID NO: 342343 - RNA, 61 nt, Human; identical to SEQ ID NO: 339126

SEQ ID NO: 342344 - RNA, 57 nt, Human; identical to SEQ ID NO: 339127

SEQ ID NO: 342345 - RNA, 61 nt, Human; identical to SEQ ID NO: 339128

SEQ ID NO: 342346 - RNA, 61 nt, Human; identical to SEQ ID NO: 339129

SEQ ID NO: 342347 - RNA, 61 nt, Human; identical to SEQ ID NO: 339130

SEQ ID NO: 342348 - RNA, 61 nt, Human; identical to SEQ ID NO: 339135

SEQ ID NO: 342349 - RNA, 61 nt, Human; identical to SEQ ID NO: 339136

SEQ ID NO: 342350 - RNA, 61 nt, Human; identical to SEQ ID NO: 339137

SEQ ID NO: 342351 - RNA, 60 nt, Human
cugugagcuucuccaccuggaaauuucccucucaccuacuucucuggcccuggguacccc

SEQ ID NO: 342352 - RNA, 60 nt, Human
accaccccacuggcugguuccagaacgucucucaccuagaccuugccuccccuccucucc

SEQ ID NO: 342353 - RNA, 60 nt, Human
uccuccuuuuuuaaguuauuugauggaagacucaccuaauuugugaccugagacuguuga

SEQ ID NO: 342354 - RNA, 60 nt, Human
cccaccaggcguguguaacaucccaugugccucaccuaauaaaauggcucuucuucugca

SEQ ID NO: 342355 - RNA, 61 nt, Human; identical to SEQ ID NO: 339138

SEQ ID NO: 342356 - RNA, 61 nt, Human; identical to SEQ ID NO: 339139

SEQ ID NO: 342357 - RNA, 61 nt, Human; identical to SEQ ID NO: 339140

SEQ ID NO: 342358 - RNA, 61 nt, Human; identical to SEQ ID NO: 339141

SEQ ID NO: 342359 - RNA, 61 nt, Human; identical to SEQ ID NO: 339142

SEQ ID NO: 342360 - RNA, 61 nt, Human; identical to SEQ ID NO: 339143

SEQ ID NO: 342361 - RNA, 61 nt, Human; identical to SEQ ID NO: 339144

SEQ ID NO: 342362 - RNA, 61 nt, Human; identical to SEQ ID NO: 339145

SEQ ID NO: 342363 - RNA, 61 nt, Human; identical to SEQ ID NO: 339146

SEQ ID NO: 342364 - RNA, 61 nt, Human; identical to SEQ ID NO: 339147

SEQ ID NO: 342365 - RNA, 61 nt, Human; identical to SEQ ID NO: 339148

SEQ ID NO: 342366 - RNA, 61 nt, Human; identical to SEQ ID NO: 339149

SEQ ID NO: 342367 - RNA, 61 nt, Human; identical to SEQ ID NO: 339150

SEQ ID NO: 342368 - RNA, 61 nt, Human; identical to SEQ ID NO: 339154

SEQ ID NO: 342369 - RNA, 61 nt, Human; identical to SEQ ID NO: 339155

SEQ ID NO: 342370 - RNA, 61 nt, Human; identical to SEQ ID NO: 339156

SEQ ID NO: 342371 - RNA, 60 nt, Human
ccugaugcagguguccacucacagguggcgcucaccuaggcugucacaggacccaccucc

SEQ ID NO: 342372 - RNA, 60 nt, Human
agaggauacuauuuccagaauaguguuuagcucaccuagggggauauguuuguauacaca

SEQ ID NO: 342373 - RNA, 60 nt, Human
agaaacucaaaagaaugcaacuguuugugucucaccuaucugugaccuggaagcucccuc

SEQ ID NO: 342374 - RNA, 61 nt, Human; identical to SEQ ID NO: 339157

SEQ ID NO: 342375 - RNA, 61 nt, Human; identical to SEQ ID NO: 339158

SEQ ID NO: 342376 - RNA, 61 nt, Human; identical to SEQ ID NO: 339159

SEQ ID NO: 342377 - RNA, 61 nt, Human; identical to SEQ ID NO: 339160

SEQ ID NO: 342378 - RNA, 61 nt, Human; identical to SEQ ID NO: 339161

SEQ ID NO: 342379 - RNA, 61 nt, Human; identical to SEQ ID NO: 339162

SEQ ID NO: 342380 - RNA, 61 nt, Human; identical to SEQ ID NO: 339163

SEQ ID NO: 342381 - RNA, 61 nt, Human; identical to SEQ ID NO: 339164

SEQ ID NO: 342382 - RNA, 61 nt, Human; identical to SEQ ID NO: 339165

SEQ ID NO: 342383 - RNA, 61 nt, Human; identical to SEQ ID NO: 339166

SEQ ID NO: 342384 - RNA, 61 nt, Human; identical to SEQ ID NO: 339167

SEQ ID NO: 342385 - RNA, 61 nt, Human; identical to SEQ ID NO: 339168

SEQ ID NO: 342386 - RNA, 61 nt, Human; identical to SEQ ID NO: 339169

SEQ ID NO: 342387 - RNA, 61 nt, Human; identical to SEQ ID NO: 339173

SEQ ID NO: 342388 - RNA, 61 nt, Human; identical to SEQ ID NO: 339174

SEQ ID NO: 342389 - RNA, 61 nt, Human; identical to SEQ ID NO: 339175

SEQ ID NO: 342390 - RNA, 60 nt, Human
ggugucagauaccuucccauccugagcucucucaccuaccugcucucucuccuagagcag

SEQ ID NO: 342391 - RNA, 60 nt, Human
uguccccauagcugguuuuucccaccaauccucaccuaacaguuacuuuacaauuaaacu

SEQ ID NO: 342392 - RNA, 64 nt, Human
uccuaggaccuuuucccaauacuagccccccaguggugaacagaaccucccaaauuugaguugc

SEQ ID NO: 342393 - RNA, 61 nt, Human; identical to SEQ ID NO: 339176

SEQ ID NO: 342394 - RNA, 61 nt, Human; identical to SEQ ID NO: 339177

SEQ ID NO: 342395 - RNA, 61 nt, Human; identical to SEQ ID NO: 339178

SEQ ID NO: 342396 - RNA, 61 nt, Human; identical to SEQ ID NO: 339179

SEQ ID NO: 342397 - RNA, 61 nt, Human; identical to SEQ ID NO: 339180

SEQ ID NO: 342398 - RNA, 61 nt, Human; identical to SEQ ID NO: 339181

SEQ ID NO: 342399 - RNA, 61 nt, Human; identical to SEQ ID NO: 339182

SEQ ID NO: 342400 - RNA, 61 nt, Human; identical to SEQ ID NO: 339183

SEQ ID NO: 342401 - RNA, 61 nt, Human; identical to SEQ ID NO: 339184

SEQ ID NO: 342402 - RNA, 61 nt, Human; identical to SEQ ID NO: 339185

SEQ ID NO: 342403 - RNA, 61 nt, Human; identical to SEQ ID NO: 339186

SEQ ID NO: 342404 - RNA, 61 nt, Human; identical to SEQ ID NO: 339187

SEQ ID NO: 342405 - RNA, 61 nt, Human; identical to SEQ ID NO: 339188

SEQ ID NO: 342406 - RNA, 61 nt, Human; identical to SEQ ID NO: 339192

SEQ ID NO: 342407 - RNA, 61 nt, Human; identical to SEQ ID NO: 339193

SEQ ID NO: 342408 - RNA, 61 nt, Human; identical to SEQ ID NO: 339194

SEQ ID NO: 342409 - RNA, 60 nt, Human
aauagcaaaaugaauccccuagccuuuguccucaccuacccuaaggcagguguguaugcu

SEQ ID NO: 342410 - RNA, 60 nt, Human
cugagugcccuguguguaaguccuaauaaacucaccuacucaccaagcuggacuuauucg

SEQ ID NO: 342411 - RNA, 60 nt, Human
aggauugaccuguguguaagucccaauaaacucaccuacucaccaagcuggacuuguucg

SEQ ID NO: 342412 - RNA, 61 nt, Human; identical to SEQ ID NO: 339195

SEQ ID NO: 342413 - RNA, 61 nt, Human; identical to SEQ ID NO: 339196

SEQ ID NO: 342414 - RNA, 61 nt, Human; identical to SEQ ID NO: 339197

SEQ ID NO: 342415 - RNA, 61 nt, Human; identical to SEQ ID NO: 339198

SEQ ID NO: 342416 - RNA, 61 nt, Human; identical to SEQ ID NO: 339199

SEQ ID NO: 342417 - RNA, 61 nt, Human; identical to SEQ ID NO: 339200

SEQ ID NO: 342418 - RNA, 61 nt, Human; identical to SEQ ID NO: 339201

SEQ ID NO: 342419 - RNA, 61 nt, Human; identical to SEQ ID NO: 339202

SEQ ID NO: 342420 - RNA, 61 nt, Human; identical to SEQ ID NO: 339203

SEQ ID NO: 342421 - RNA, 61 nt, Human; identical to SEQ ID NO: 339204

SEQ ID NO: 342422 - RNA, 61 nt, Human; identical to SEQ ID NO: 339205

SEQ ID NO: 342423 - RNA, 61 nt, Human; identical to SEQ ID NO: 339206

SEQ ID NO: 342424 - RNA, 61 nt, Human; identical to SEQ ID NO: 339207

SEQ ID NO: 342425 - RNA, 61 nt, Human; identical to SEQ ID NO: 339211

SEQ ID NO: 342426 - RNA, 61 nt, Human; identical to SEQ ID NO: 339212

SEQ ID NO: 342427 - RNA, 61 nt, Human; identical to SEQ ID NO: 339213

SEQ ID NO: 342428 - RNA, 60 nt, Human
gcuuuuggggggcauauauuggguuccauucucaccuauccacacaacauauccguauau

SEQ ID NO: 342429 - RNA, 60 nt, Human
uuugcacuuccucaaagcuuguguacagugcucaccuaaauccaucugacuacuuguucc

SEQ ID NO: 342430 - RNA, 60 nt, Human
caaaaaucugagaaccccuccccuuuucuccucaccuaaacccaucuccuacuuugggcg

SEQ ID NO: 342431 - RNA, 61 nt, Human; identical to SEQ ID NO: 339214

SEQ ID NO: 342432 - RNA, 61 nt, Human; identical to SEQ ID NO: 339215

SEQ ID NO: 342433 - RNA, 61 nt, Human; identical to SEQ ID NO: 339216

SEQ ID NO: 342434 - RNA, 61 nt, Human; identical to SEQ ID NO: 339217

SEQ ID NO: 342435 - RNA, 61 nt, Human; identical to SEQ ID NO: 339218

SEQ ID NO: 342436 - RNA, 61 nt, Human; identical to SEQ ID NO: 339219

SEQ ID NO: 342437 - RNA, 56 nt, Human; identical to SEQ ID NO: 339220

SEQ ID NO: 342438 - RNA, 61 nt, Human; identical to SEQ ID NO: 339221

SEQ ID NO: 342439 - RNA, 61 nt, Human; identical to SEQ ID NO: 339222

SEQ ID NO: 342440 - RNA, 61 nt, Human; identical to SEQ ID NO: 339223

SEQ ID NO: 342441 - RNA, 61 nt, Human; identical to SEQ ID NO: 339224

SEQ ID NO: 342442 - RNA, 61 nt, Human; identical to SEQ ID NO: 339225

SEQ ID NO: 342443 - RNA, 61 nt, Human; identical to SEQ ID NO: 339226

SEQ ID NO: 342444 - RNA, 61 nt, Human; identical to SEQ ID NO: 339230

SEQ ID NO: 342445 - RNA, 61 nt, Human; identical to SEQ ID NO: 339231

SEQ ID NO: 342446 - RNA, 61 nt, Human; identical to SEQ ID NO: 339232

SEQ ID NO: 342447 - RNA, 60 nt, Human
aggauugaccuguguguaagucccaauaaacucaccuacucaucaagcuggacuuguucg

SEQ ID NO: 342448 - RNA, 60 nt, Human
cagggccccaccuaggugcagagccggccccucaccuaacagcugguuccuaccagaccg

SEQ ID NO: 342449 - RNA, 60 nt, Human
gagagaaggacugccaaauuuucucaugaucucaccuauacuuuggggaugauaauccaa

SEQ ID NO: 342450 - RNA, 61 nt, Human; identical to SEQ ID NO: 339233

SEQ ID NO: 342451 - RNA, 61 nt, Human; identical to SEQ ID NO: 339234

SEQ ID NO: 342452 - RNA, 61 nt, Human; identical to SEQ ID NO: 339235

SEQ ID NO: 342453 - RNA, 61 nt, Human; identical to SEQ ID NO: 339236

SEQ ID NO: 342454 - RNA, 61 nt, Human; identical to SEQ ID NO: 339237

SEQ ID NO: 342455 - RNA, 61 nt, Human; identical to SEQ ID NO: 339238

SEQ ID NO: 342456 - RNA, 61 nt, Human; identical to SEQ ID NO: 339239

SEQ ID NO: 342457 - RNA, 61 nt, Human; identical to SEQ ID NO: 339240

SEQ ID NO: 342458 - RNA, 61 nt, Human; identical to SEQ ID NO: 339241

SEQ ID NO: 342459 - RNA, 61 nt, Human; identical to SEQ ID NO: 339242

SEQ ID NO: 342460 - RNA, 61 nt, Human; identical to SEQ ID NO: 339243

SEQ ID NO: 342461 - RNA, 61 nt, Human; identical to SEQ ID NO: 339244

SEQ ID NO: 342462 - RNA, 61 nt, Human; identical to SEQ ID NO: 339245

SEQ ID NO: 342463 - RNA, 61 nt, Human; identical to SEQ ID NO: 339249

SEQ ID NO: 342464 - RNA, 61 nt, Human; identical to SEQ ID NO: 339250

SEQ ID NO: 342465 - RNA, 61 nt, Human; identical to SEQ ID NO: 339251

SEQ ID NO: 342466 - RNA, 64 nt, Human
acaccuugguggcacugguggacaugggaaagcagguggacaugagcuaacccugagcuugucc

SEQ ID NO: 342467 - RNA, 64 nt, Human
gacccgcuggccagagggacaccuugguggcacugguggacaugggaaagcagguggacaugag

SEQ ID NO: 342468 - RNA, 64 nt, Human
auacauucaaagacccccagcagaugccugaaacgguggacagugcugaaccuuauauauauuu

SEQ ID NO: 342469 - RNA, 61 nt, Human; identical to SEQ ID NO: 339252

SEQ ID NO: 342470 - RNA, 61 nt, Human; identical to SEQ ID NO: 339253

SEQ ID NO: 342471 - RNA, 61 nt, Human; identical to SEQ ID NO: 339254

SEQ ID NO: 342472 - RNA, 61 nt, Human; identical to SEQ ID NO: 339255

SEQ ID NO: 342473 - RNA, 61 nt, Human; identical to SEQ ID NO: 339256

SEQ ID NO: 342474 - RNA, 61 nt, Human; identical to SEQ ID NO: 339257

SEQ ID NO: 342475 - RNA, 61 nt, Human; identical to SEQ ID NO: 339258

SEQ ID NO: 342476 - RNA, 61 nt, Human; identical to SEQ ID NO: 339259

SEQ ID NO: 342477 - RNA, 61 nt, Human; identical to SEQ ID NO: 339260

SEQ ID NO: 342478 - RNA, 61 nt, Human; identical to SEQ ID NO: 339261

SEQ ID NO: 342479 - RNA, 61 nt, Human; identical to SEQ ID NO: 339262

SEQ ID NO: 342480 - RNA, 61 nt, Human; identical to SEQ ID NO: 339263

SEQ ID NO: 342481 - RNA, 61 nt, Human; identical to SEQ ID NO: 339264

SEQ ID NO: 342482 - RNA, 61 nt, Human; identical to SEQ ID NO: 339268

SEQ ID NO: 342483 - RNA, 61 nt, Human; identical to SEQ ID NO: 339269

SEQ ID NO: 342484 - RNA, 61 nt, Human; identical to SEQ ID NO: 339270

SEQ ID NO: 342485 - RNA, 64 nt, Human
cugguucuauaaaaggaucgagguauuuccaauccccgucgaggucaagaucaagauccagguc

SEQ ID NO: 342486 - RNA, 64 nt, Human
guuggcgacugucauguggcuugguuuggucaugcccgucgauguuuuggguauugaauguggu

SEQ ID NO: 342487 - RNA, 64 nt, Human
gcuugugccacacccucccccgccacuccugaaccccgucgaggggcucucagcucagcgccag

SEQ ID NO: 342488 - RNA, 61 nt, Human; identical to SEQ ID NO: 339271

SEQ ID NO: 342489 - RNA, 61 nt, Human; identical to SEQ ID NO: 339272

SEQ ID NO: 342490 - RNA, 61 nt, Human; identical to SEQ ID NO: 339273

SEQ ID NO: 342491 - RNA, 61 nt, Human; identical to SEQ ID NO: 339274

SEQ ID NO: 342492 - RNA, 61 nt, Human; identical to SEQ ID NO: 339275

SEQ ID NO: 342493 - RNA, 61 nt, Human; identical to SEQ ID NO: 339276

SEQ ID NO: 342494 - RNA, 61 nt, Human; identical to SEQ ID NO: 339277

SEQ ID NO: 342495 - RNA, 61 nt, Human; identical to SEQ ID NO: 339278

SEQ ID NO: 342496 - RNA, 61 nt, Human; identical to SEQ ID NO: 339279

SEQ ID NO: 342497 - RNA, 61 nt, Human; identical to SEQ ID NO: 339280

SEQ ID NO: 342498 - RNA, 61 nt, Human; identical to SEQ ID NO: 339281

SEQ ID NO: 342499 - RNA, 59 nt, Human; identical to SEQ ID NO: 339282

SEQ ID NO: 342500 - RNA, 61 nt, Human; identical to SEQ ID NO: 339283

SEQ ID NO: 342501 - RNA, 61 nt, Human; identical to SEQ ID NO: 339288

SEQ ID NO: 342502 - RNA, 61 nt, Human; identical to SEQ ID NO: 339289

SEQ ID NO: 342503 - RNA, 61 nt, Human; identical to SEQ ID NO: 339290

SEQ ID NO: 342504 - RNA, 64 nt, Human
aacccaggagccuaguacaauauagugaugccaucccgucgacucuccauuuaaauuguuucuc

SEQ ID NO: 342505 - RNA, 64 nt, Human
gcacugcgcucggagagccggugggccuggccuccccgucgaccucagugccuuuuuguuuuca

SEQ ID NO: 342506 - RNA, 64 nt, Human
ucagccccgcggccccugaguggcagggcugacucccgucgacacgagcuuagaaaguggauuc

SEQ ID NO: 342507 - RNA, 61 nt, Human; identical to SEQ ID NO: 339291

SEQ ID NO: 342508 - RNA, 61 nt, Human; identical to SEQ ID NO: 339292

SEQ ID NO: 342509 - RNA, 61 nt, Human; identical to SEQ ID NO: 339293

SEQ ID NO: 342510 - RNA, 61 nt, Human; identical to SEQ ID NO: 339294

SEQ ID NO: 342511 - RNA, 61 nt, Human; identical to SEQ ID NO: 339295

SEQ ID NO: 342512 - RNA, 61 nt, Human; identical to SEQ ID NO: 339296

SEQ ID NO: 342513 - RNA, 61 nt, Human; identical to SEQ ID NO: 339297

SEQ ID NO: 342514 - RNA, 61 nt, Human; identical to SEQ ID NO: 339298

SEQ ID NO: 342515 - RNA, 61 nt, Human; identical to SEQ ID NO: 339299

SEQ ID NO: 342516 - RNA, 61 nt, Human; identical to SEQ ID NO: 339300

SEQ ID NO: 342517 - RNA, 61 nt, Human; identical to SEQ ID NO: 339301

SEQ ID NO: 342518 - RNA, 61 nt, Human; identical to SEQ ID NO: 339302

SEQ ID NO: 342519 - RNA, 61 nt, Human; identical to SEQ ID NO: 339303

SEQ ID NO: 342520 - RNA, 61 nt, Human; identical to SEQ ID NO: 339307

SEQ ID NO: 342521 - RNA, 61 nt, Human; identical to SEQ ID NO: 339308

SEQ ID NO: 342522 - RNA, 61 nt, Human; identical to SEQ ID NO: 339309

SEQ ID NO: 342523 - RNA, 60 nt, Human
ucccagucuggccacagcccugccuccgcccucaccuacaugcccucccagccccuccca

SEQ ID NO: 342524 - RNA, 60 nt, Human
cccugggcccaucucaaggcugcccccuuccucaccuacuucggacucuuccagguucac

SEQ ID NO: 342525 - RNA, 60 nt, Human
ugccucuauucuucuauacugcagauuuuucucaccuauuguacaaagaaauugcgaugu

SEQ ID NO: 342526 - RNA, 61 nt, Human; identical to SEQ ID NO: 339310

SEQ ID NO: 342527 - RNA, 61 nt, Human; identical to SEQ ID NO: 339311

SEQ ID NO: 342528 - RNA, 59 nt, Human; identical to SEQ ID NO: 339312

SEQ ID NO: 342529 - RNA, 61 nt, Human; identical to SEQ ID NO: 339313

SEQ ID NO: 342530 - RNA, 61 nt, Human; identical to SEQ ID NO: 339314

SEQ ID NO: 342531 - RNA, 61 nt, Human; identical to SEQ ID NO: 339315

SEQ ID NO: 342532 - RNA, 61 nt, Human; identical to SEQ ID NO: 339316

SEQ ID NO: 342533 - RNA, 61 nt, Human; identical to SEQ ID NO: 339317

SEQ ID NO: 342534 - RNA, 61 nt, Human; identical to SEQ ID NO: 339318

SEQ ID NO: 342535 - RNA, 61 nt, Human; identical to SEQ ID NO: 339319

SEQ ID NO: 342536 - RNA, 61 nt, Human; identical to SEQ ID NO: 339320

SEQ ID NO: 342537 - RNA, 61 nt, Human; identical to SEQ ID NO: 339321

SEQ ID NO: 342538 - RNA, 61 nt, Human; identical to SEQ ID NO: 339322

SEQ ID NO: 342539 - RNA, 61 nt, Human; identical to SEQ ID NO: 339326

SEQ ID NO: 342540 - RNA, 61 nt, Human; identical to SEQ ID NO: 339327

SEQ ID NO: 342541 - RNA, 61 nt, Human; identical to SEQ ID NO: 339328

SEQ ID NO: 342542 - RNA, 64 nt, Human
ugagcccuuccucuacagguggggcagagagggugguggacaccaggcuuaucugccugcuccu

SEQ ID NO: 342543 - RNA, 64 nt, Human
ucccacagcuugcaaggaccaagggaggccagcagguggacagggggccucagccugcccugaa

SEQ ID NO: 342544 - RNA, 64 nt, Human
ccccaaucccugcaguuuuguggcuucaaguguggguggacaguccuaauggggaucuccagcu

SEQ ID NO: 342545 - RNA, 61 nt, Human; identical to SEQ ID NO: 339329

SEQ ID NO: 342546 - RNA, 61 nt, Human; identical to SEQ ID NO: 339330

SEQ ID NO: 342547 - RNA, 61 nt, Human; identical to SEQ ID NO: 339331

SEQ ID NO: 342548 - RNA, 61 nt, Human; identical to SEQ ID NO: 339332

SEQ ID NO: 342549 - RNA, 61 nt, Human; identical to SEQ ID NO: 339333

SEQ ID NO: 342550 - RNA, 61 nt, Human; identical to SEQ ID NO: 339334

SEQ ID NO: 342551 - RNA, 61 nt, Human; identical to SEQ ID NO: 339335

SEQ ID NO: 342552 - RNA, 61 nt, Human; identical to SEQ ID NO: 339336

SEQ ID NO: 342553 - RNA, 61 nt, Human; identical to SEQ ID NO: 339337

SEQ ID NO: 342554 - RNA, 61 nt, Human; identical to SEQ ID NO: 339338

SEQ ID NO: 342555 - RNA, 61 nt, Human; identical to SEQ ID NO: 339339

SEQ ID NO: 342556 - RNA, 61 nt, Human; identical to SEQ ID NO: 339340

SEQ ID NO: 342557 - RNA, 61 nt, Human; identical to SEQ ID NO: 339341

SEQ ID NO: 342558 - RNA, 61 nt, Human; identical to SEQ ID NO: 339345

SEQ ID NO: 342559 - RNA, 61 nt, Human; identical to SEQ ID NO: 339346

SEQ ID NO: 342560 - RNA, 61 nt, Human; identical to SEQ ID NO: 339347

SEQ ID NO: 342561 - RNA, 60 nt, Human
accugaccucacaccugacccugaccccuccucaccuauucucuuccucuauccugaccg

SEQ ID NO: 342562 - RNA, 60 nt, Human
aaaagguacaacagaauaaugcaugaugaacucaccuaauuaugaggugggaggagcgaa

SEQ ID NO: 342563 - RNA, 60 nt, Human
gguacacaaugugauuuuauggugaugucacucaccuagacaaccagaggcuggcauuga

SEQ ID NO: 342564 - RNA, 61 nt, Human; identical to SEQ ID NO: 339348

SEQ ID NO: 342565 - RNA, 61 nt, Human; identical to SEQ ID NO: 339349

SEQ ID NO: 342566 - RNA, 61 nt, Human; identical to SEQ ID NO: 339350

SEQ ID NO: 342567 - RNA, 61 nt, Human; identical to SEQ ID NO: 339351

SEQ ID NO: 342568 - RNA, 61 nt, Human; identical to SEQ ID NO: 339352

SEQ ID NO: 342569 - RNA, 61 nt, Human; identical to SEQ ID NO: 339353

SEQ ID NO: 342570 - RNA, 61 nt, Human; identical to SEQ ID NO: 339354

SEQ ID NO: 342571 - RNA, 61 nt, Human; identical to SEQ ID NO: 339355

SEQ ID NO: 342572 - RNA, 61 nt, Human; identical to SEQ ID NO: 339356

SEQ ID NO: 342573 - RNA, 61 nt, Human; identical to SEQ ID NO: 339357

SEQ ID NO: 342574 - RNA, 61 nt, Human; identical to SEQ ID NO: 339358

SEQ ID NO: 342575 - RNA, 61 nt, Human; identical to SEQ ID NO: 339359

SEQ ID NO: 342576 - RNA, 61 nt, Human; identical to SEQ ID NO: 339360

SEQ ID NO: 342577 - RNA, 61 nt, Human; identical to SEQ ID NO: 339364

SEQ ID NO: 342578 - RNA, 61 nt, Human; identical to SEQ ID NO: 339365

SEQ ID NO: 342579 - RNA, 61 nt, Human; identical to SEQ ID NO: 339366

SEQ ID NO: 342580 - RNA, 60 nt, Human
ccuagaaacccaagcuccuccucggaaccgcucaccuagagccagaccaacguuacucag

SEQ ID NO: 342581 - RNA, 60 nt, Human
guccccaugugaggagaucugcuuucagcccucaccuaagggaggugaggaagaggaaaa

SEQ ID NO: 342582 - RNA, 60 nt, Human
aagacccaaacaaaucuaacuucuugcuuucucaccuauuugaauuuucuccuaccuaau

SEQ ID NO: 342583 - RNA, 61 nt, Human; identical to SEQ ID NO: 339367

SEQ ID NO: 342584 - RNA, 61 nt, Human; identical to SEQ ID NO: 339368

SEQ ID NO: 342585 - RNA, 61 nt, Human; identical to SEQ ID NO: 339369

SEQ ID NO: 342586 - RNA, 61 nt, Human; identical to SEQ ID NO: 339370

SEQ ID NO: 342587 - RNA, 61 nt, Human; identical to SEQ ID NO: 339371

SEQ ID NO: 342588 - RNA, 61 nt, Human; identical to SEQ ID NO: 339372

SEQ ID NO: 342589 - RNA, 61 nt, Human; identical to SEQ ID NO: 339373

SEQ ID NO: 342590 - RNA, 61 nt, Human; identical to SEQ ID NO: 339374

SEQ ID NO: 342591 - RNA, 59 nt, Human; identical to SEQ ID NO: 339375

SEQ ID NO: 342592 - RNA, 61 nt, Human; identical to SEQ ID NO: 339376

SEQ ID NO: 342593 - RNA, 61 nt, Human; identical to SEQ ID NO: 339377

SEQ ID NO: 342594 - RNA, 61 nt, Human; identical to SEQ ID NO: 339378

SEQ ID NO: 342595 - RNA, 61 nt, Human; identical to SEQ ID NO: 339379

SEQ ID NO: 342596 - RNA, 61 nt, Human; identical to SEQ ID NO: 339384

SEQ ID NO: 342597 - RNA, 61 nt, Human; identical to SEQ ID NO: 339385

SEQ ID NO: 342598 - RNA, 61 nt, Human; identical to SEQ ID NO: 339386

SEQ ID NO: 342599 - RNA, 60 nt, Human
guguguagauuucaugcucgacacuuaccacucaccuaucaacagaucauccugcuugac

SEQ ID NO: 342600 - RNA, 60 nt, Human
uuuuccuuguccccacacuccuacaccuaacucaccuaacucauacugugcuggagccac

SEQ ID NO: 342601 - RNA, 64 nt, Human
uuacaacuaggccagggauuagccacugugggaggguggacaggcaaugguucaguggccuggc

SEQ ID NO: 342602 - RNA, 61 nt, Human; identical to SEQ ID NO: 339387

SEQ ID NO: 342603 - RNA, 61 nt, Human; identical to SEQ ID NO: 339388

SEQ ID NO: 342604 - RNA, 61 nt, Human; identical to SEQ ID NO: 339389

SEQ ID NO: 342605 - RNA, 61 nt, Human; identical to SEQ ID NO: 339390

SEQ ID NO: 342606 - RNA, 61 nt, Human; identical to SEQ ID NO: 339391

SEQ ID NO: 342607 - RNA, 61 nt, Human; identical to SEQ ID NO: 339392

SEQ ID NO: 342608 - RNA, 61 nt, Human; identical to SEQ ID NO: 339393

SEQ ID NO: 342609 - RNA, 61 nt, Human; identical to SEQ ID NO: 339394

SEQ ID NO: 342610 - RNA, 61 nt, Human; identical to SEQ ID NO: 339395

SEQ ID NO: 342611 - RNA, 61 nt, Human; identical to SEQ ID NO: 339396

SEQ ID NO: 342612 - RNA, 61 nt, Human; identical to SEQ ID NO: 339397

SEQ ID NO: 342613 - RNA, 61 nt, Human; identical to SEQ ID NO: 339398

SEQ ID NO: 342614 - RNA, 61 nt, Human; identical to SEQ ID NO: 339399

SEQ ID NO: 342615 - RNA, 61 nt, Human; identical to SEQ ID NO: 339404

SEQ ID NO: 342616 - RNA, 61 nt, Human; identical to SEQ ID NO: 339405

SEQ ID NO: 342617 - RNA, 61 nt, Human; identical to SEQ ID NO: 339406

SEQ ID NO: 342618 - RNA, 60 nt, Human
ggagaggugacaucauacauucacaugcuucucaccuaaguccccaggguccaagggaga

SEQ ID NO: 342619 - RNA, 55 nt, Human
cugccugcaguccugugugaagccccucaccuaugccaucuccauaagcacccua

SEQ ID NO: 342620 - RNA, 60 nt, Human
uaaugcagcaguugcgauaaauaaaaacaucucaccuaagucuccuuuucuucauaacau

SEQ ID NO: 342621 - RNA, 61 nt, Human; identical to SEQ ID NO: 339407

SEQ ID NO: 342622 - RNA, 61 nt, Human; identical to SEQ ID NO: 339408

SEQ ID NO: 342623 - RNA, 61 nt, Human; identical to SEQ ID NO: 339409

SEQ ID NO: 342624 - RNA, 61 nt, Human; identical to SEQ ID NO: 339410

SEQ ID NO: 342625 - RNA, 61 nt, Human; identical to SEQ ID NO: 339411

SEQ ID NO: 342626 - RNA, 61 nt, Human; identical to SEQ ID NO: 339412

SEQ ID NO: 342627 - RNA, 61 nt, Human; identical to SEQ ID NO: 339413

SEQ ID NO: 342628 - RNA, 61 nt, Human; identical to SEQ ID NO: 339414

SEQ ID NO: 342629 - RNA, 61 nt, Human; identical to SEQ ID NO: 339415

SEQ ID NO: 342630 - RNA, 61 nt, Human; identical to SEQ ID NO: 339416

SEQ ID NO: 342631 - RNA, 61 nt, Human; identical to SEQ ID NO: 339417

SEQ ID NO: 342632 - RNA, 61 nt, Human; identical to SEQ ID NO: 339418

SEQ ID NO: 342633 - RNA, 61 nt, Human; identical to SEQ ID NO: 339419

SEQ ID NO: 342634 - RNA, 61 nt, Human; identical to SEQ ID NO: 339423

SEQ ID NO: 342635 - RNA, 61 nt, Human; identical to SEQ ID NO: 339424

SEQ ID NO: 342636 - RNA, 61 nt, Human; identical to SEQ ID NO: 339425

SEQ ID NO: 342637 - RNA, 60 nt, Human
uauccauuggccaaccugaaggaaaugaaacucaccuaucuuucuaucacagaugaaugu

SEQ ID NO: 342638 - RNA, 60 nt, Human
auuuuugcccuuaguuaacauuuacuggugcucaccuaggauuggcuauucugagggauu

SEQ ID NO: 342639 - RNA, 60 nt, Human
uggaagaugaacacuugaggacuucagcuucucaccuacuuaguacaguugggaaccaua

SEQ ID NO: 342640 - RNA, 61 nt, Human; identical to SEQ ID NO: 339426

SEQ ID NO: 342641 - RNA, 61 nt, Human; identical to SEQ ID NO: 339427

SEQ ID NO: 342642 - RNA, 61 nt, Human; identical to SEQ ID NO: 339428

SEQ ID NO: 342643 - RNA, 61 nt, Human; identical to SEQ ID NO: 339429

SEQ ID NO: 342644 - RNA, 61 nt, Human; identical to SEQ ID NO: 339430

SEQ ID NO: 342645 - RNA, 61 nt, Human; identical to SEQ ID NO: 339431

SEQ ID NO: 342646 - RNA, 61 nt, Human; identical to SEQ ID NO: 339432

SEQ ID NO: 342647 - RNA, 61 nt, Human; identical to SEQ ID NO: 339433

SEQ ID NO: 342648 - RNA, 61 nt, Human; identical to SEQ ID NO: 339434

SEQ ID NO: 342649 - RNA, 61 nt, Human; identical to SEQ ID NO: 339435

SEQ ID NO: 342650 - RNA, 61 nt, Human; identical to SEQ ID NO: 339436

SEQ ID NO: 342651 - RNA, 61 nt, Human; identical to SEQ ID NO: 339437

SEQ ID NO: 342652 - RNA, 61 nt, Human; identical to SEQ ID NO: 339438

SEQ ID NO: 342653 - RNA, 61 nt, Human; identical to SEQ ID NO: 339442

SEQ ID NO: 342654 - RNA, 61 nt, Human; identical to SEQ ID NO: 339443

SEQ ID NO: 342655 - RNA, 61 nt, Human; identical to SEQ ID NO: 339444

SEQ ID NO: 342656 - RNA, 60 nt, Human
agccugaaaagcaugcagggguuugguccacucaccuacuugaaagccugugggcaacgu

SEQ ID NO: 342657 - RNA, 60 nt, Human
cggcaugcccaaccucaucagcaccgacuucucaccuaagcugcacuucaaguucgacac

SEQ ID NO: 342658 - RNA, 60 nt, Human
uucugggcccuugcugccaaggagcccagccucaccuagcaggaaaggagaugaaggccc

SEQ ID NO: 342659 - RNA, 61 nt, Human; identical to SEQ ID NO: 339445

SEQ ID NO: 342660 - RNA, 61 nt, Human; identical to SEQ ID NO: 339446

SEQ ID NO: 342661 - RNA, 61 nt, Human; identical to SEQ ID NO: 339447

SEQ ID NO: 342662 - RNA, 61 nt, Human; identical to SEQ ID NO: 339448

SEQ ID NO: 342663 - RNA, 61 nt, Human; identical to SEQ ID NO: 339449

SEQ ID NO: 342664 - RNA, 61 nt, Human; identical to SEQ ID NO: 339450

SEQ ID NO: 342665 - RNA, 61 nt, Human; identical to SEQ ID NO: 339451

SEQ ID NO: 342666 - RNA, 61 nt, Human; identical to SEQ ID NO: 339452

SEQ ID NO: 342667 - RNA, 61 nt, Human; identical to SEQ ID NO: 339453

SEQ ID NO: 342668 - RNA, 61 nt, Human; identical to SEQ ID NO: 339454

SEQ ID NO: 342669 - RNA, 61 nt, Human; identical to SEQ ID NO: 339455

SEQ ID NO: 342670 - RNA, 61 nt, Human; identical to SEQ ID NO: 339456

SEQ ID NO: 342671 - RNA, 61 nt, Human; identical to SEQ ID NO: 339457

SEQ ID NO: 342672 - RNA, 61 nt, Human; identical to SEQ ID NO: 339461

SEQ ID NO: 342673 - RNA, 61 nt, Human; identical to SEQ ID NO: 339462

SEQ ID NO: 342674 - RNA, 61 nt, Human; identical to SEQ ID NO: 339463

SEQ ID NO: 342675 - RNA, 60 nt, Human
uggccagugugcucaucugagaggcugccgcucaccuaccugcacaucugccacagcugg

SEQ ID NO: 342676 - RNA, 60 nt, Human
aaaugggggcaagggccugccccccacucccucaccuaccuccuuagcauuccuucaggc

SEQ ID NO: 342677 - RNA, 60 nt, Human
ccuuucuuuugggagcucaaagcaagugagcucaccuaccugccaccgcccaggaccagu

SEQ ID NO: 342678 - RNA, 61 nt, Human; identical to SEQ ID NO: 339464

SEQ ID NO: 342679 - RNA, 61 nt, Human; identical to SEQ ID NO: 339465

SEQ ID NO: 342680 - RNA, 61 nt, Human; identical to SEQ ID NO: 339466

SEQ ID NO: 342681 - RNA, 61 nt, Human; identical to SEQ ID NO: 339467

SEQ ID NO: 342682 - RNA, 61 nt, Human; identical to SEQ ID NO: 339468

SEQ ID NO: 342683 - RNA, 61 nt, Human; identical to SEQ ID NO: 339469

SEQ ID NO: 342684 - RNA, 61 nt, Human; identical to SEQ ID NO: 339470

SEQ ID NO: 342685 - RNA, 61 nt, Human; identical to SEQ ID NO: 339471

SEQ ID NO: 342686 - RNA, 61 nt, Human; identical to SEQ ID NO: 339472

SEQ ID NO: 342687 - RNA, 61 nt, Human; identical to SEQ ID NO: 339473

SEQ ID NO: 342688 - RNA, 61 nt, Human; identical to SEQ ID NO: 339474

SEQ ID NO: 342689 - RNA, 61 nt, Human; identical to SEQ ID NO: 339475

SEQ ID NO: 342690 - RNA, 61 nt, Human; identical to SEQ ID NO: 339476

SEQ ID NO: 342691 - RNA, 61 nt, Human; identical to SEQ ID NO: 339480

SEQ ID NO: 342692 - RNA, 61 nt, Human; identical to SEQ ID NO: 339481

SEQ ID NO: 342693 - RNA, 61 nt, Human; identical to SEQ ID NO: 339482

SEQ ID NO: 342694 - RNA, 64 nt, Human
aaaccagcuuguucugggcucagggagggagggcgguggacaauaaacaucugagcagugccuc

SEQ ID NO: 342695 - RNA, 64 nt, Human
gacagucuugcauucuguuugucucguggggggagguggacaguccugcggaaaugugucuugu

SEQ ID NO: 342696 - RNA, 64 nt, Human
ccaggccagagggucacugucugguuugugauuugguggacaaaacacucgcuguuacaaguac

SEQ ID NO: 342697 - RNA, 61 nt, Human; identical to SEQ ID NO: 339483

SEQ ID NO: 342698 - RNA, 61 nt, Human; identical to SEQ ID NO: 339484

SEQ ID NO: 342699 - RNA, 61 nt, Human; identical to SEQ ID NO: 339485

SEQ ID NO: 342700 - RNA, 61 nt, Human; identical to SEQ ID NO: 339486

SEQ ID NO: 342701 - RNA, 61 nt, Human; identical to SEQ ID NO: 339487

SEQ ID NO: 342702 - RNA, 61 nt, Human; identical to SEQ ID NO: 339488

SEQ ID NO: 342703 - RNA, 61 nt, Human; identical to SEQ ID NO: 339489

SEQ ID NO: 342704 - RNA, 61 nt, Human; identical to SEQ ID NO: 339490

SEQ ID NO: 342705 - RNA, 61 nt, Human; identical to SEQ ID NO: 339491

SEQ ID NO: 342706 - RNA, 61 nt, Human; identical to SEQ ID NO: 339492

SEQ ID NO: 342707 - RNA, 61 nt, Human; identical to SEQ ID NO: 339493

SEQ ID NO: 342708 - RNA, 61 nt, Human; identical to SEQ ID NO: 339494

SEQ ID NO: 342709 - RNA, 61 nt, Human; identical to SEQ ID NO: 339495

SEQ ID NO: 342710 - RNA, 61 nt, Human; identical to SEQ ID NO: 339499

SEQ ID NO: 342711 - RNA, 61 nt, Human; identical to SEQ ID NO: 339500

SEQ ID NO: 342712 - RNA, 61 nt, Human; identical to SEQ ID NO: 339501

SEQ ID NO: 342713 - RNA, 60 nt, Human
ucagagcuucuucccuaagccauaaacugucucaccuaaacaagauagaccucaauaaaa

SEQ ID NO: 342714 - RNA, 60 nt, Human
gagucucccccuuaaauuuccugguacccccucaccuaugccugaaagcauuucacccuc

SEQ ID NO: 342715 - RNA, 60 nt, Human
ccaccccagcgucuguugguacuuaccugucucaccuacccuccaguccccucccagcuc

SEQ ID NO: 342716 - RNA, 61 nt, Human; identical to SEQ ID NO: 339502

SEQ ID NO: 342717 - RNA, 61 nt, Human; identical to SEQ ID NO: 339503

SEQ ID NO: 342718 - RNA, 52 nt, Human; identical to SEQ ID NO: 339504

SEQ ID NO: 342719 - RNA, 61 nt, Human; identical to SEQ ID NO: 339505

SEQ ID NO: 342720 - RNA, 61 nt, Human; identical to SEQ ID NO: 339506

SEQ ID NO: 342721 - RNA, 61 nt, Human; identical to SEQ ID NO: 339507

SEQ ID NO: 342722 - RNA, 61 nt, Human; identical to SEQ ID NO: 339508

SEQ ID NO: 342723 - RNA, 61 nt, Human; identical to SEQ ID NO: 339509

SEQ ID NO: 342724 - RNA, 59 nt, Human; identical to SEQ ID NO: 339510

SEQ ID NO: 342725 - RNA, 61 nt, Human; identical to SEQ ID NO: 339511

SEQ ID NO: 342726 - RNA, 61 nt, Human; identical to SEQ ID NO: 339512

SEQ ID NO: 342727 - RNA, 61 nt, Human; identical to SEQ ID NO: 339513

SEQ ID NO: 342728 - RNA, 61 nt, Human; identical to SEQ ID NO: 339514

SEQ ID NO: 342729 - RNA, 61 nt, Human; identical to SEQ ID NO: 339518

SEQ ID NO: 342730 - RNA, 61 nt, Human; identical to SEQ ID NO: 339519

SEQ ID NO: 342731 - RNA, 61 nt, Human; identical to SEQ ID NO: 339520

SEQ ID NO: 342732 - RNA, 60 nt, Human
gcccuuaaccuuuaucuuucuuccuguccucucaccuagauuguaagcucccugggccag

SEQ ID NO: 342733 - RNA, 60 nt, Human
uggggccacagggcagccgggacucccugucucaccuacauuaacccaugcauacuguau

SEQ ID NO: 342734 - RNA, 60 nt, Human
ccuucuuacggauuuagacgagguucgaggcucaccuaucagggcagcucucaggauugu

SEQ ID NO: 342735 - RNA, 61 nt, Human; identical to SEQ ID NO: 339521

SEQ ID NO: 342736 - RNA, 61 nt, Human; identical to SEQ ID NO: 339522

SEQ ID NO: 342737 - RNA, 61 nt, Human; identical to SEQ ID NO: 339523

SEQ ID NO: 342738 - RNA, 61 nt, Human; identical to SEQ ID NO: 339524

SEQ ID NO: 342739 - RNA, 61 nt, Human; identical to SEQ ID NO: 339525

SEQ ID NO: 342740 - RNA, 61 nt, Human; identical to SEQ ID NO: 339526

SEQ ID NO: 342741 - RNA, 61 nt, Human; identical to SEQ ID NO: 339527

SEQ ID NO: 342742 - RNA, 61 nt, Human; identical to SEQ ID NO: 339528

SEQ ID NO: 342743 - RNA, 61 nt, Human; identical to SEQ ID NO: 339529

SEQ ID NO: 342744 - RNA, 61 nt, Human; identical to SEQ ID NO: 339530

SEQ ID NO: 342745 - RNA, 61 nt, Human; identical to SEQ ID NO: 339531

SEQ ID NO: 342746 - RNA, 61 nt, Human; identical to SEQ ID NO: 339532

SEQ ID NO: 342747 - RNA, 61 nt, Human; identical to SEQ ID NO: 339533

SEQ ID NO: 342748 - RNA, 53 nt, Human; identical to SEQ ID NO: 339537

SEQ ID NO: 342749 - RNA, 61 nt, Human; identical to SEQ ID NO: 339538

SEQ ID NO: 342750 - RNA, 61 nt, Human; identical to SEQ ID NO: 339539

SEQ ID NO: 342751 - RNA, 60 nt, Human
guucuugguguuugacuguaauguaacuaucucaccuaaugguuguacauauccuuuggu

SEQ ID NO: 342752 - RNA, 60 nt, Human
ggugcguuaguggcauuaucuauaaauacacucaccuaaauugaaagcuaagaaggaaau

SEQ ID NO: 342753 - RNA, 60 nt, Human
cugugccccuagguggagacagcccucuuucucaccuacccccugccgcacagcccagca

SEQ ID NO: 342754 - RNA, 61 nt, Human; identical to SEQ ID NO: 339540

SEQ ID NO: 342755 - RNA, 61 nt, Human; identical to SEQ ID NO: 339541

SEQ ID NO: 342756 - RNA, 61 nt, Human; identical to SEQ ID NO: 339542

SEQ ID NO: 342757 - RNA, 61 nt, Human; identical to SEQ ID NO: 339543

SEQ ID NO: 342758 - RNA, 61 nt, Human; identical to SEQ ID NO: 339544

SEQ ID NO: 342759 - RNA, 61 nt, Human; identical to SEQ ID NO: 339545

SEQ ID NO: 342760 - RNA, 61 nt, Human; identical to SEQ ID NO: 339546

SEQ ID NO: 342761 - RNA, 61 nt, Human; identical to SEQ ID NO: 339547

SEQ ID NO: 342762 - RNA, 61 nt, Human; identical to SEQ ID NO: 339548

SEQ ID NO: 342763 - RNA, 61 nt, Human; identical to SEQ ID NO: 339549

SEQ ID NO: 342764 - RNA, 61 nt, Human; identical to SEQ ID NO: 339550

SEQ ID NO: 342765 - RNA, 61 nt, Human; identical to SEQ ID NO: 339551

SEQ ID NO: 342766 - RNA, 61 nt, Human; identical to SEQ ID NO: 339552

SEQ ID NO: 342767 - RNA, 61 nt, Human; identical to SEQ ID NO: 339556

SEQ ID NO: 342768 - RNA, 61 nt, Human; identical to SEQ ID NO: 339557

SEQ ID NO: 342769 - RNA, 61 nt, Human; identical to SEQ ID NO: 339558

SEQ ID NO: 342770 - RNA, 64 nt, Human
ugaccgcccaucugccuuuaucagagggacuguccccgucgacauguucagugccugguggggc

SEQ ID NO: 342771 - RNA, 64 nt, Human
uccagagagagggagcccuguauucuuggcuguacccgucgaauggaguuuugaucucgcugag

SEQ ID NO: 342772 - RNA, 64 nt, Human
cauaggggcugguuuuccguacuccaaaccaucagguggacacaguccuaggaaccauuaugga

SEQ ID NO: 342773 - RNA, 61 nt, Human; identical to SEQ ID NO: 339559

SEQ ID NO: 342774 - RNA, 61 nt, Human; identical to SEQ ID NO: 339560

SEQ ID NO: 342775 - RNA, 61 nt, Human; identical to SEQ ID NO: 339561

SEQ ID NO: 342776 - RNA, 61 nt, Human; identical to SEQ ID NO: 339562

SEQ ID NO: 342777 - RNA, 61 nt, Human; identical to SEQ ID NO: 339563

SEQ ID NO: 342778 - RNA, 61 nt, Human; identical to SEQ ID NO: 339564

SEQ ID NO: 342779 - RNA, 61 nt, Human; identical to SEQ ID NO: 339565

SEQ ID NO: 342780 - RNA, 61 nt, Human; identical to SEQ ID NO: 339566

SEQ ID NO: 342781 - RNA, 61 nt, Human; identical to SEQ ID NO: 339567

SEQ ID NO: 342782 - RNA, 61 nt, Human; identical to SEQ ID NO: 339568

SEQ ID NO: 342783 - RNA, 61 nt, Human; identical to SEQ ID NO: 339569

SEQ ID NO: 342784 - RNA, 61 nt, Human; identical to SEQ ID NO: 339570

SEQ ID NO: 342785 - RNA, 61 nt, Human; identical to SEQ ID NO: 339571

SEQ ID NO: 342786 - RNA, 61 nt, Human; identical to SEQ ID NO: 339575

SEQ ID NO: 342787 - RNA, 61 nt, Human; identical to SEQ ID NO: 339576

SEQ ID NO: 342788 - RNA, 61 nt, Human; identical to SEQ ID NO: 339577

SEQ ID NO: 342789 - RNA, 54 nt, Human
cuaguggcucuugcugcugaugcccucaccuauacucaccugccuuuauuaacc

SEQ ID NO: 342790 - RNA, 60 nt, Human
uuucucaccucuguaaauuuuagucucaaucucaccuaaaugaaucaggucugcccuuua

SEQ ID NO: 342791 - RNA, 60 nt, Human
acagugcagccccauuuccgguccugcuaccucaccuagauguugugaggauucauauuc

SEQ ID NO: 342792 - RNA, 61 nt, Human; identical to SEQ ID NO: 339578

SEQ ID NO: 342793 - RNA, 61 nt, Human; identical to SEQ ID NO: 339579

SEQ ID NO: 342794 - RNA, 61 nt, Human; identical to SEQ ID NO: 339580

SEQ ID NO: 342795 - RNA, 61 nt, Human; identical to SEQ ID NO: 339581

SEQ ID NO: 342796 - RNA, 61 nt, Human; identical to SEQ ID NO: 339582

SEQ ID NO: 342797 - RNA, 61 nt, Human; identical to SEQ ID NO: 339583

SEQ ID NO: 342798 - RNA, 61 nt, Human; identical to SEQ ID NO: 339584

SEQ ID NO: 342799 - RNA, 61 nt, Human; identical to SEQ ID NO: 339585

SEQ ID NO: 342800 - RNA, 61 nt, Human; identical to SEQ ID NO: 339586

SEQ ID NO: 342801 - RNA, 61 nt, Human; identical to SEQ ID NO: 339587

SEQ ID NO: 342802 - RNA, 61 nt, Human; identical to SEQ ID NO: 339588

SEQ ID NO: 342803 - RNA, 61 nt, Human; identical to SEQ ID NO: 339589

SEQ ID NO: 342804 - RNA, 61 nt, Human; identical to SEQ ID NO: 339590

SEQ ID NO: 342805 - RNA, 61 nt, Human; identical to SEQ ID NO: 339594

SEQ ID NO: 342806 - RNA, 61 nt, Human; identical to SEQ ID NO: 339595

SEQ ID NO: 342807 - RNA, 61 nt, Human; identical to SEQ ID NO: 339596

SEQ ID NO: 342808 - RNA, 60 nt, Human
ccagguccuuuccuucucgucuuccucucucucaccuacuuccuccuccuccuccuguuc

SEQ ID NO: 342809 - RNA, 60 nt, Human
uguuugcuucaacaguauauccuaauaagccucaccuauuuaauccaaugaguuuuaaau

SEQ ID NO: 342810 - RNA, 60 nt, Human
aaugcagaguuguauuuacuuguuucuguacucaccuacucccaccccaagggaaaauuu

SEQ ID NO: 342811 - RNA, 61 nt, Human; identical to SEQ ID NO: 339597

SEQ ID NO: 342812 - RNA, 61 nt, Human; identical to SEQ ID NO: 339598

SEQ ID NO: 342813 - RNA, 55 nt, Human; identical to SEQ ID NO: 339599

SEQ ID NO: 342814 - RNA, 61 nt, Human; identical to SEQ ID NO: 339600

SEQ ID NO: 342815 - RNA, 61 nt, Human; identical to SEQ ID NO: 339601

SEQ ID NO: 342816 - RNA, 61 nt, Human; identical to SEQ ID NO: 339602

SEQ ID NO: 342817 - RNA, 61 nt, Human; identical to SEQ ID NO: 339603

SEQ ID NO: 342818 - RNA, 61 nt, Human; identical to SEQ ID NO: 339604

SEQ ID NO: 342819 - RNA, 61 nt, Human; identical to SEQ ID NO: 339605

SEQ ID NO: 342820 - RNA, 61 nt, Human; identical to SEQ ID NO: 339606

SEQ ID NO: 342821 - RNA, 56 nt, Human; identical to SEQ ID NO: 339607

SEQ ID NO: 342822 - RNA, 61 nt, Human; identical to SEQ ID NO: 339608

SEQ ID NO: 342823 - RNA, 61 nt, Human; identical to SEQ ID NO: 339609

SEQ ID NO: 342824 - RNA, 61 nt, Human; identical to SEQ ID NO: 339614

SEQ ID NO: 342825 - RNA, 61 nt, Human; identical to SEQ ID NO: 339615

SEQ ID NO: 342826 - RNA, 61 nt, Human; identical to SEQ ID NO: 339616

SEQ ID NO: 342827 - RNA, 60 nt, Human
uagaggcuaaaauuguguugaugcuguuuacucaccuaauuacauaguuuuaaucauuug

SEQ ID NO: 342828 - RNA, 60 nt, Human
ggcgcuuguuagaaucaaagacucucaggccucaccuagacauccagaaucaaaaucugc

SEQ ID NO: 342829 - RNA, 60 nt, Human
uacauuuuucccacguuuccaacagcacuucucaccuauucaauaacugaaaaagacauu

SEQ ID NO: 342830 - RNA, 61 nt, Human; identical to SEQ ID NO: 339617

SEQ ID NO: 342831 - RNA, 61 nt, Human; identical to SEQ ID NO: 339618

SEQ ID NO: 342832 - RNA, 61 nt, Human; identical to SEQ ID NO: 339619

SEQ ID NO: 342833 - RNA, 61 nt, Human; identical to SEQ ID NO: 339620

SEQ ID NO: 342834 - RNA, 61 nt, Human; identical to SEQ ID NO: 339621

SEQ ID NO: 342835 - RNA, 61 nt, Human; identical to SEQ ID NO: 339622

SEQ ID NO: 342836 - RNA, 61 nt, Human; identical to SEQ ID NO: 339623

SEQ ID NO: 342837 - RNA, 61 nt, Human; identical to SEQ ID NO: 339624

SEQ ID NO: 342838 - RNA, 61 nt, Human; identical to SEQ ID NO: 339625

SEQ ID NO: 342839 - RNA, 61 nt, Human; identical to SEQ ID NO: 339626

SEQ ID NO: 342840 - RNA, 61 nt, Human; identical to SEQ ID NO: 339627

SEQ ID NO: 342841 - RNA, 61 nt, Human; identical to SEQ ID NO: 339628

SEQ ID NO: 342842 - RNA, 61 nt, Human; identical to SEQ ID NO: 339629

SEQ ID NO: 342843 - RNA, 61 nt, Human; identical to SEQ ID NO: 339633

SEQ ID NO: 342844 - RNA, 61 nt, Human; identical to SEQ ID NO: 339634

SEQ ID NO: 342845 - RNA, 61 nt, Human; identical to SEQ ID NO: 339635

SEQ ID NO: 342846 - RNA, 60 nt, Human
uuaugaaauauuucuuuuaaaagccccagucucaccuacgaaauaugaagagcaaaagcu

SEQ ID NO: 342847 - RNA, 60 nt, Human
aacugcuauaagaucgaaguuuguuuuuuucucaccuaauaauagagagguaaucagaug

SEQ ID NO: 342848 - RNA, 60 nt, Human
caagucuuaacuuaccugugcuucaguuuccucaccuauaaaauugugauaauaauaaug

SEQ ID NO: 342849 - RNA, 61 nt, Human; identical to SEQ ID NO: 339636

SEQ ID NO: 342850 - RNA, 61 nt, Human; identical to SEQ ID NO: 339637

SEQ ID NO: 342851 - RNA, 61 nt, Human; identical to SEQ ID NO: 339638

SEQ ID NO: 342852 - RNA, 61 nt, Human; identical to SEQ ID NO: 339639

SEQ ID NO: 342853 - RNA, 61 nt, Human; identical to SEQ ID NO: 339640

SEQ ID NO: 342854 - RNA, 61 nt, Human; identical to SEQ ID NO: 339641

SEQ ID NO: 342855 - RNA, 61 nt, Human; identical to SEQ ID NO: 339642

SEQ ID NO: 342856 - RNA, 61 nt, Human; identical to SEQ ID NO: 339643

SEQ ID NO: 342857 - RNA, 61 nt, Human; identical to SEQ ID NO: 339644

SEQ ID NO: 342858 - RNA, 61 nt, Human; identical to SEQ ID NO: 339645

SEQ ID NO: 342859 - RNA, 61 nt, Human; identical to SEQ ID NO: 339646

SEQ ID NO: 342860 - RNA, 61 nt, Human; identical to SEQ ID NO: 339647

SEQ ID NO: 342861 - RNA, 61 nt, Human; identical to SEQ ID NO: 339648

SEQ ID NO: 342862 - RNA, 61 nt, Human; identical to SEQ ID NO: 339652

SEQ ID NO: 342863 - RNA, 61 nt, Human; identical to SEQ ID NO: 339653

SEQ ID NO: 342864 - RNA, 61 nt, Human; identical to SEQ ID NO: 339654

SEQ ID NO: 342865 - RNA, 60 nt, Human
uugauauugaaaaguguaauaaacuucaugcucaccuauuggagauuugggaagguugaa

SEQ ID NO: 342866 - RNA, 60 nt, Human
cugcucagcccugugucggcuuccugugugcucaccuaaagcugugguuuugcuguguuc

SEQ ID NO: 342867 - RNA, 60 nt, Human
cgugcaccuccaccuccagccuccagucaccucaccuagcucacugcucucucuccugca

SEQ ID NO: 342868 - RNA, 61 nt, Human; identical to SEQ ID NO: 339655

SEQ ID NO: 342869 - RNA, 61 nt, Human; identical to SEQ ID NO: 339656

SEQ ID NO: 342870 - RNA, 61 nt, Human; identical to SEQ ID NO: 339657

SEQ ID NO: 342871 - RNA, 61 nt, Human; identical to SEQ ID NO: 339658

SEQ ID NO: 342872 - RNA, 61 nt, Human; identical to SEQ ID NO: 339659

SEQ ID NO: 342873 - RNA, 61 nt, Human; identical to SEQ ID NO: 339660

SEQ ID NO: 342874 - RNA, 61 nt, Human; identical to SEQ ID NO: 339661

SEQ ID NO: 342875 - RNA, 61 nt, Human; identical to SEQ ID NO: 339648

SEQ ID NO: 342876 - RNA, 64 nt, Human; identical to SEQ ID NO: 57819

SEQ ID NO: 342877 - RNA, 64 nt, Human; identical to SEQ ID NO: 57820

SEQ ID NO: 342878 - RNA, 64 nt, Human; identical to SEQ ID NO: 57821

SEQ ID NO: 342879 - RNA, 64 nt, Human; identical to SEQ ID NO: 57822

SEQ ID NO: 342880 - RNA, 64 nt, Human; identical to SEQ ID NO: 57823

SEQ ID NO: 342881 - RNA, 64 nt, Human; identical to SEQ ID NO: 57824

SEQ ID NO: 342882 - RNA, 60 nt, Human
ucuugauuggcugacacugaaucauaguuucucaccuacauauauccuuagcaccucgua

SEQ ID NO: 342883 - RNA, 60 nt, Human
gugcgcugcaggaaaagcaaucagucacaacucaccuagcgaccugacuuacucuggaau

SEQ ID NO: 342884 - RNA, 60 nt, Human
ccguuugagucaaagucuuacuucccugcucucaccuacucacagacgggaugcuaagca

SEQ ID NO: 342885 - RNA, 64 nt, Human; identical to SEQ ID NO: 57825

SEQ ID NO: 342886 - RNA, 64 nt, Human; identical to SEQ ID NO: 57826

SEQ ID NO: 342887 - RNA, 64 nt, Human; identical to SEQ ID NO: 57827

SEQ ID NO: 342888 - RNA, 64 nt, Human; identical to SEQ ID NO: 57828

SEQ ID NO: 342889 - RNA, 64 nt, Human; identical to SEQ ID NO: 57829

SEQ ID NO: 342890 - RNA, 64 nt, Human; identical to SEQ ID NO: 57830

SEQ ID NO: 342891 - RNA, 64 nt, Human; identical to SEQ ID NO: 57831

SEQ ID NO: 342892 - RNA, 64 nt, Human; identical to SEQ ID NO: 57832

SEQ ID NO: 342893 - RNA, 64 nt, Human; identical to SEQ ID NO: 57833

SEQ ID NO: 342894 - RNA, 64 nt, Human; identical to SEQ ID NO: 57834

SEQ ID NO: 342895 - RNA, 64 nt, Human; identical to SEQ ID NO: 57835

SEQ ID NO: 342896 - RNA, 64 nt, Human; identical to SEQ ID NO: 57836

SEQ ID NO: 342897 - RNA, 64 nt, Human; identical to SEQ ID NO: 57837

SEQ ID NO: 342898 - RNA, 64 nt, Human; identical to SEQ ID NO: 57838

SEQ ID NO: 342899 - RNA, 64 nt, Human; identical to SEQ ID NO: 57839

SEQ ID NO: 342900 - RNA, 64 nt, Human; identical to SEQ ID NO: 57840

SEQ ID NO: 342901 - RNA, 60 nt, Human
uuuccagagcuggaggucacguuucuaaaacucaccuacgaaagauagcauuaaaggaac

SEQ ID NO: 342902 - RNA, 60 nt, Human
ucugaaagcuacccauaaaaucacuuucaucucaccuaccugaugcaaagcaggugaaac

SEQ ID NO: 342903 - RNA, 60 nt, Human
gcacauuuuggaguguccuggcuaccagcucucaccuacacccacgcacccccccacaca

SEQ ID NO: 342904 - RNA, 64 nt, Human; identical to SEQ ID NO: 57841

SEQ ID NO: 342905 - RNA, 64 nt, Human; identical to SEQ ID NO: 57842

SEQ ID NO: 342906 - RNA, 64 nt, Human; identical to SEQ ID NO: 57843

SEQ ID NO: 342907 - RNA, 52 nt, Human; identical to SEQ ID NO: 57844

SEQ ID NO: 342908 - RNA, 64 nt, Human; identical to SEQ ID NO: 57845

SEQ ID NO: 342909 - RNA, 64 nt, Human; identical to SEQ ID NO: 57846

SEQ ID NO: 342910 - RNA, 64 nt, Human; identical to SEQ ID NO: 57847

SEQ ID NO: 342911 - RNA, 64 nt, Human; identical to SEQ ID NO: 57848

SEQ ID NO: 342912 - RNA, 64 nt, Human; identical to SEQ ID NO: 57849

SEQ ID NO: 342913 - RNA, 64 nt, Human; identical to SEQ ID NO: 57850

SEQ ID NO: 342914 - RNA, 64 nt, Human; identical to SEQ ID NO: 57851

SEQ ID NO: 342915 - RNA, 55 nt, Human; identical to SEQ ID NO: 57852

SEQ ID NO: 342916 - RNA, 64 nt, Human; identical to SEQ ID NO: 57853

SEQ ID NO: 342917 - RNA, 64 nt, Human; identical to SEQ ID NO: 57854

SEQ ID NO: 342918 - RNA, 64 nt, Human; identical to SEQ ID NO: 57855

SEQ ID NO: 342919 - RNA, 64 nt, Human; identical to SEQ ID NO: 57856

SEQ ID NO: 342920 - RNA, 60 nt, Human
cgaaucaugcaugcaauuagcucccuccuccucaccuacuccacucccaucuuuaugaca

SEQ ID NO: 342921 - RNA, 60 nt, Human
agaaauacucaggaauugucucauaaaguccucaccuacuggcaaaaacaagauguucua

SEQ ID NO: 342922 - RNA, 60 nt, Human
aauggcacacauauucaugcacaagaagcacucaccuagagcugucugugccucucuggg

SEQ ID NO: 342923 - RNA, 64 nt, Human; identical to SEQ ID NO: 57857

SEQ ID NO: 342924 - RNA, 64 nt, Human; identical to SEQ ID NO: 57858

SEQ ID NO: 342925 - RNA, 64 nt, Human; identical to SEQ ID NO: 57859

SEQ ID NO: 342926 - RNA, 64 nt, Human; identical to SEQ ID NO: 57860

SEQ ID NO: 342927 - RNA, 64 nt, Human; identical to SEQ ID NO: 57861

SEQ ID NO: 342928 - RNA, 64 nt, Human; identical to SEQ ID NO: 57862

SEQ ID NO: 342929 - RNA, 64 nt, Human; identical to SEQ ID NO: 57863

SEQ ID NO: 342930 - RNA, 64 nt, Human; identical to SEQ ID NO: 57864

SEQ ID NO: 342931 - RNA, 64 nt, Human; identical to SEQ ID NO: 57865

SEQ ID NO: 342932 - RNA, 64 nt, Human
ugacugguaaaaugaauccucagucggccuucuuucaaggcaaauugaaaaucacuggcaacau

SEQ ID NO: 342933 - RNA, 64 nt, Human
acuucccucaauugaaucagguaacacuaacggaucaaggcagggccagagggugguguggucu

SEQ ID NO: 342934 - RNA, 64 nt, Human
cucuaagcugggcagacggagcacgagcaccuauucaaggcacugcagcccuuuggaagacauu

SEQ ID NO: 342935 - RNA, 64 nt, Human
aggccccugccaggucacagcaaugcucuccuugucaaggcauggaccagggucauucagacac

SEQ ID NO: 342936 - RNA, 64 nt, Human
cuaaccaauugugagaauuacuguuugaaacuuuucaaggcacauugaaauacuugaaaacuuc

SEQ ID NO: 342937 - RNA, 64 nt, Human
cccucuguuauccuguuggccuccuauguauuggucaaggcaggcaucucuguucucugaacau

SEQ ID NO: 342938 - RNA, 60 nt, Human
accucaauuacgagaggcauagugaccugccucaccuaauccucacccuugcugcuccug

SEQ ID NO: 342939 - RNA, 60 nt, Human
auaaauaugaauaaauguuauauaaggaaacucaccuauuugaaaucauggcuauauugu

SEQ ID NO: 342940 - RNA, 60 nt, Human
ccuagccuggagcccaggaccuaaguccaccucaccuagagccuggaauuaggaucccag

SEQ ID NO: 342941 - RNA, 64 nt, Human
ugcagucucccagccuccacuuucagagugaaauucaaggcagcacggacaugugcccaucagg

SEQ ID NO: 342942 - RNA, 64 nt, Human
acugggaaacaugguauaucaugaaguaaucuugucaaggcaucuggagaguccaggagagaag

SEQ ID NO: 342943 - RNA, 64 nt, Human
uacuuuguggcaaucugugggcuacaugcuggggucaaggcaguagaacuccaggcccuccucu

SEQ ID NO: 342944 - RNA, 64 nt, Human
acccagagaauauauacauucuuuaucuugacauucaaggcauuucuaucacauauuugauagu

SEQ ID NO: 342945 - RNA, 64 nt, Human
uaaauacauucuuccugggguccagaguccccauucaaggcagucaaguuaagacacuaacuug

SEQ ID NO: 342946 - RNA, 64 nt, Human
guauaucuccucuuuugcuauggaggcuccauguucaaggcaauggcuuuuuaaaucuuggcua

SEQ ID NO: 342947 - RNA, 64 nt, Human
cucccucuggccauagccccuccuggagauggggucaaggcagcaggacugaucaagugacuac

SEQ ID NO: 342948 - RNA, 64 nt, Human
uaaucaucucccauuuuccuuagacauuuaaauuucaaggcagguacccucuguguacucagaa

SEQ ID NO: 342949 - RNA, 64 nt, Human
cagugccugguccugccccuuccugguucuuaucucaaggcagagcuucugaauuucaggccuu

SEQ ID NO: 342950 - RNA, 64 nt, Human
ucauuuacauaaguauuuucugugggaccgacucucaaggcacuguguaugcccugcaaguugg

SEQ ID NO: 342951 - RNA, 64 nt, Human
ugaucaccaagcugucucaucaccaaauagguagucaaggcagccucaucuccccaggugaggg

SEQ ID NO: 342952 - RNA, 64 nt, Human
ugaucaccgagcugucacaucagcaaauauguagucaaggcagccaggccaacuagaccacacu

SEQ ID NO: 342953 - RNA, 64 nt, Human
uuccuucaugcuacccaccaccucagugcugaggucaaggcagcuucguuguucccucuggcuu

SEQ ID NO: 342954 - RNA, 64 nt, Human
acgagaaacauaggcuuuucaaaaaaauuuuuauucaaggcaaagcaaggaacaucuugagaua

SEQ ID NO: 342955 - RNA, 64 nt, Human
uuaggauaauugguucuagaauugaauucaaaagucaaggcaucauuuaaaauaaucugauuuc

SEQ ID NO: 342956 - RNA, 64 nt, Human
cuuucuaaaugauuuuacuuucugccuugaauuuucaaggcauagaugucaacuuacagaauaa

SEQ ID NO: 342957 - RNA, 60 nt, Human
gcuugucuagucugcccaaaauuacuuauccucaccuagcuccuaccacucuucuuagag

SEQ ID NO: 342958 - RNA, 60 nt, Human
accuuguuuacuuggauuuauaaaagcagacucaccuaauaaaaucaacauucauuguau

SEQ ID NO: 342959 - RNA, 60 nt, Human
aaggaagcuauaucuagagugcuuaugugacucaccuaaggccacucaacaaguuugugg

SEQ ID NO: 342960 - RNA, 64 nt, Human
ugaaugaaugaacaaaugaaugaauuugcuuacuucaaggcaaaagaaccaugaaacuguauuu

SEQ ID NO: 342961 - RNA, 64 nt, Human
uacacaguugaguugcaagcugaauuggcuguguucaaggcaugcccuuuagaauugaaagaac

SEQ ID NO: 342962 - RNA, 64 nt, Human
ugaagaagaaggcagugggaaaacuggguuuaucucaaggcagcagccugagcccaggagcaga

SEQ ID NO: 342963 - RNA, 64 nt, Human
uacuuuaguggcauuucacugucaaauaugaaguucaaggcaaaauaguauuuucuauuacugu

SEQ ID NO: 342964 - RNA, 64 nt, Human
auuuauuguaacgaauggcuaguuuuuauucucgucaaggcacaaaaccaguucaugcuuaacc

SEQ ID NO: 342965 - RNA, 64 nt, Human
uuagcauucauacuaguugaaauuuuuaauagaaucaaggcacaaaagucuuaaaaccaugugg

SEQ ID NO: 342966 - RNA, 64 nt, Human
ucaccuaugaccuggaauaguuuaaauaugguguucaaggcaauaguacauaauaguggaagaa

SEQ ID NO: 342967 - RNA, 64 nt, Human
uuucuuuuaaccuuccaaauccuaaauguuuccuucaaggcaucuuaauaaacuuauuugcuuc

SEQ ID NO: 342968 - RNA, 64 nt, Human
auuaggaacauuguggaaaauuugcuuuagagaaucaaggcaguaguuugguauuuggugcuua

SEQ ID NO: 342969 - RNA, 64 nt, Human
cugccccccaggagcacaagcaggguccccucagucaaggcagugggaugggcggcugaggaac

SEQ ID NO: 342970 - RNA, 64 nt, Human
uccccuccgaggagucauuuuggucgacaggcucucaaggcaacuccccauuuucaagaggcug

SEQ ID NO: 342971 - RNA, 64 nt, Human
gcacgcauucauaaagcaaaggaguacuacagcaucaaggcacaacacaaaaaccaacacaaaa

SEQ ID NO: 342972 - RNA, 64 nt, Human
uugcacaguuagcaaacuuuguaugucauuuccuucaaggcaucaugcagaguugacaugagau

SEQ ID NO: 342973 - RNA, 64 nt, Human
gggagaugagggaaauaagaugaauucugugcugucaaggcaguaagucugaagaaaggaccau

SEQ ID NO: 342974 - RNA, 64 nt, Human
cacagacacgcgggaccccagccgccaaaacuuuucaaggcagaaguuucaagauguguguuug

SEQ ID NO: 342975 - RNA, 64 nt, Human
caucgugauagcaaugcuuaaccccaggaagauuucaaggcagggagaagaacauuucaaauaa

SEQ ID NO: 342976 - RNA, 60 nt, Human
agaagaucuggccaugcuggggcucacauucucaccuagcaacaacuggcuggagcuggg

SEQ ID NO: 342977 - RNA, 60 nt, Human
cauuauuuccugaggcaagaacuuaagguccucaccuaauuccuccaucacaaccauuaa

SEQ ID NO: 342978 - RNA, 60 nt, Human
aaaaaauugauuauuuuuauuagauaauuucucaccuauagacuuaaacugucaauuugc

SEQ ID NO: 342979 - RNA, 64 nt, Human
ggaacuacagggauaagacaggguccaugccgucucaaggcauuuacgguuuaaaaagaccuuu

SEQ ID NO: 342980 - RNA, 64 nt, Human
ggccaagguaggaggauugcuugaguccgggagcucaaggcaaagcugcacaacauaacaagac

SEQ ID NO: 342981 - RNA, 64 nt, Human
aaguggcuaaguguccauuauuuaccuugaacaaucaaggcaacuaguggagagaacugauugu

SEQ ID NO: 342982 - RNA, 64 nt, Human
uuugguuuaauuuccauuaugcuauuuugcauaaucaaggcacuguaaaucuuauaauuuuaaa

SEQ ID NO: 342983 - RNA, 64 nt, Human
agaaauggaacccccagcccagcagacaucaagcucaaggcaaugggcuacccucauuucacac

SEQ ID NO: 342984 - RNA, 64 nt, Human
uuccagagaugcugcucucugcagggcaccaccuucaaggcacagcccuuguugggagggagaa

SEQ ID NO: 342985 - RNA, 64 nt, Human
uuuugggaaauguagcccuggguuuaaugucaaaucaaggcaaaaggaauuaaauaauguacuu

SEQ ID NO: 342986 - RNA, 64 nt, Human
ggcauaguuuuaucaauaucugucaaauuaaacuucaaggcaaaacuuuuuuauugagauggag

SEQ ID NO: 342987 - RNA, 64 nt, Human
ggcuagcaaauuugaguuggaugauuguuuuugcucaaggcaaccagaggaaacuugcauacag

SEQ ID NO: 342988 - RNA, 64 nt, Human
aaggggcucagguuaauaauagagagcuauggagucaaggcauguuuaagaugggagguagagc

SEQ ID NO: 342989 - RNA, 64 nt, Human
ccagcagccacuaaggcucagauuguuaaagcucucaaggcaaugacucgaaguuugcaguaug

SEQ ID NO: 342990 - RNA, 64 nt, Human
gggaccucaguguccacccuuccugccucaugucucaaggcagcagcuccucucugguaaccug

SEQ ID NO: 342991 - RNA, 64 nt, Human
ucaacacugucuacccuaaauaauuuuuauaugcucaaggcaaagcagggaauagaggcaauua

SEQ ID NO: 342992 - RNA, 64 nt, Human
ucuggcugcgaugcuguuugaacucuuuuucacuucaaggcaaggggcgggaucuccacugggg

SEQ ID NO: 342993 - RNA, 64 nt, Human
aauaagaagugccaaguggacagucuggccacugucaaggcagggaaggggccaugacuuuucu

SEQ ID NO: 342994 - RNA, 64 nt, Human
aaacucagcacugguggugguggcaguggacagaucaaggcacuucaacucauuuggaaaaugu

SEQ ID NO: 342995 - RNA, 60 nt, Human
cugcggcagccgacugcaugaaccaaaguucucaccuaaugguaucaucacgcagugcac

SEQ ID NO: 342996 - RNA, 60 nt, Human
agagcauuuccagcauuuguuguuguuuuacucaccuaacccuuagaaaaugaauguuag

SEQ ID NO: 342997 - RNA, 60 nt, Human
agcacuaaugcuuuaagauuuggucacacucucaccuaggugagcgcauugagccagugg

SEQ ID NO: 342998 - RNA, 64 nt, Human
ucagaccugcagaggaaaacaucagcuggcugggucaaggcaccauguguuacuuggucaggac

SEQ ID NO: 342999 - RNA, 64 nt, Human
gacaucaggaacccacggccaccaccuccuccccucaaggcaugcugagcaugggcacagacag

SEQ ID NO: 343000 - RNA, 64 nt, Human
gguccgcucagggucucauuuccccaggccaaguucaaggcagcagcccuuugugaggcgcucu

SEQ ID NO: 343001 - RNA, 64 nt, Human
agccugcggugcugucugcugggaggucagcuggucaaggcagaggaggagaggaggaaaggau

SEQ ID NO: 343002 - RNA, 64 nt, Human
gaaaugcuuauuaaaaccuuacuauacuauuucuucaaggcaaguaaauugaccaugagaaaag

SEQ ID NO: 343003 - RNA, 64 nt, Human
uguguccccuuacauauacaugcacauaucuuugucaaggcaccagugggaacaauacacugca

SEQ ID NO: 343004 - RNA, 64 nt, Human
gauuuacccuuuauagaacauauuuuccuuuagaucaaggcaaaaauaucaggagcuuuuuuac

SEQ ID NO: 343005 - RNA, 64 nt, Human
auuuagcagauaauuugggaccuaugucuacuuuucaaggcaaagugaagaugacaguccuugc

SEQ ID NO: 343006 - RNA, 64 nt, Human
ggcuacaauauuuguuuaaccucccuaagaacuuucaaggcaucuguccugaaagcuguuaauu

SEQ ID NO: 343007 - RNA, 64 nt, Human
uagaugcaaaacgaaugagcuguaaccccuucacucaaggcauugacagcuuagcugugagggu

SEQ ID NO: 343008 - RNA, 64 nt, Human
uauuuucaguuaauugucaaguuuaagugccuaaucaaggcaaguguuguuucagccuaugcuu

SEQ ID NO: 343009 - RNA, 64 nt, Human
gaugguucuuuuaaagcaguaguauaucuuauuuucaaggcauuuggaaaugaagggcaaacua

SEQ ID NO: 343010 - RNA, 64 nt, Human
cucugcuggcugaguggcaauacuacaacaaacuucaaggcaaguuuggcugaaaacaguugac

SEQ ID NO: 343011 - RNA, 64 nt, Human
aauuucaacagugccacuucugcauucucuguucucaaggcaccuggauggugacccugggccg

SEQ ID NO: 343012 - RNA, 64 nt, Human
gauagauagaaagcuauuuauuugucuucaguguucaaggcaugacuaguauuucuaauuagcc

SEQ ID NO: 343013 - RNA, 64 nt, Human
cuuuguccauuggagaggucuuuuuuggucugguucaaggcaaguagcaagaauagagcaaaau

SEQ ID NO: 343014 - RNA, 60 nt, Human
ggcgcagagcagauccaggccccagaaagccucaccuacagacagcugugguccucugau

SEQ ID NO: 343015 - RNA, 60 nt, Human
uuuaaugcuaaaugcuuugcuacauuguaacucaccuaaaaccuuuuagugacaaaaucc

SEQ ID NO: 343016 - RNA, 60 nt, Human
caaacaucuaugccccacuucuucucuugccucaccuauuccuuagauucuuggucacuu

SEQ ID NO: 343017 - RNA, 64 nt, Human
cugugauuaaaggagccagccagguguaauacagucaaggcagcccccagccuagagacaaucu

SEQ ID NO: 343018 - RNA, 64 nt, Human
acaggccuugggagggcaggcguuugcauuaauaucaaggcaaaaagcauucauagauacaugc

SEQ ID NO: 343019 - RNA, 64 nt, Human
cucuguuccuugacugucuuuguguuucuguaccucaaggcacugaagcuggaggacucugucc

SEQ ID NO: 343020 - RNA, 64 nt, Human
gaggacagaugcacagacgggggggcucugguggucaaggcagcaguccccuuggauacuaaag

SEQ ID NO: 343021 - RNA, 64 nt, Human
augcauccuuauccgucaacucaucagcucuuccucaaggcaaccugaggccagacaccaagaa

SEQ ID NO: 343022 - RNA, 64 nt, Human
agcaucuguuaggacagucugaauacuuucuguuucaaggcacugauaaaaccgcaacaaaaac

SEQ ID NO: 343023 - RNA, 64 nt, Human
aagggagcagaacuuguggcagcaacaggaguugucaaggcagcagaaaggagucacccagcca

SEQ ID NO: 343024 - RNA, 64 nt, Human
cucaggcccucccaccccuucucuaacacuagcuucaaggcagaagccacagcagccucugucc

SEQ ID NO: 343025 - RNA, 64 nt, Human
ccaucucccccaacuccacagccccucccgagccucaaggcaaguccaggacucagaccgggga

SEQ ID NO: 343026 - RNA, 64 nt, Human
caagcaacacuccuagggccuggcuucugucugaucaaggcaccacacaacccagaaaggagcu

SEQ ID NO: 343027 - RNA, 64 nt, Human
uacauucuuacaauaacuaaaccacuuaaaaugaucaaggcacuaauguuuuggucugaaaagc

SEQ ID NO: 343028 - RNA, 64 nt, Human
auucucuuuuuuuucucucccuuuuuuguuugguucaaggcagcucgguaacugacaucagcaa

SEQ ID NO: 343029 - RNA, 64 nt, Human
gcuauauaaauuucuaauauuuuacuuauucuauucaaggcauagggccaaagcauuaaguaua

SEQ ID NO: 343030 - RNA, 64 nt, Human
cuuggccuucugcaagccaagugguucugcaaggucaaggcacuaguaucagauggcaagcuca

SEQ ID NO: 343031 - RNA, 64 nt, Human
cguuucaaauuucagaccaguucuuugggcugggucaaggcaaagcucagucgucccagcagca

SEQ ID NO: 343032 - RNA, 64 nt, Human
gaggcacuuuucacuuugaugucugagaaucaguucaaggcauaugcagaguuggcagagaaac

SEQ ID NO: 343033 - RNA, 64 nt, Human
caauuugccaggaucuaggaaccaccuaaugguagguggacagaaaaggaaaaaaaaaaaaauu

SEQ ID NO: 343034 - RNA, 64 nt, Human
cucauguucugauaguucuucauuauuucacaaagguggacaaccugaaagagaaaaggcugcu

SEQ ID NO: 343035 - RNA, 64 nt, Human
uucaccuuuucugggaccuucuuugggggagaaugguggacagugggauucuggaaacuuguuu

SEQ ID NO: 343036 - RNA, 64 nt, Human
aaacaggauucuuuaaucauggagcaagagaauuucaaggcaggggauuuuaucccccaccaaa

SEQ ID NO: 343037 - RNA, 64 nt, Human
guccauuuccaucuuccccgucucccuuuccacaucaaggcacaucagacuucucagagaccca

SEQ ID NO: 343038 - RNA, 64 nt, Human
uuuagauucaaaaggggggaaaugggucuuuucaucaaggcaacuccccuucuccaagucacuu

SEQ ID NO: 343039 - RNA, 64 nt, Human
gcuguguggcauugcuuguguccauaggaguccaucaaggcagagcggcagagcggcaagcaga

SEQ ID NO: 343040 - RNA, 64 nt, Human
uccggcagugcuaccaugguaauggacagaguuaucaaggcacauucuccaccacugucacagg

SEQ ID NO: 343041 - RNA, 64 nt, Human
aauguauuccauuuuaaaaguaagccagagugagucaaggcauauacacacuuucucacaaaac

SEQ ID NO: 343042 - RNA, 64 nt, Human
ucccuggaugauucaggaagcugacauuguuuccucaaggcagaauuuuccugguucuguuuuc

SEQ ID NO: 343043 - RNA, 64 nt, Human
caggcacuccagccagcgcucaccuggccuuuccucaaggcaugguagucuuuccuugaggcug

SEQ ID NO: 343044 - RNA, 64 nt, Human
acccaguggaaggacacucuuggcucguuugggcucaaggcaccgcagccugucagccaacauu

SEQ ID NO: 343045 - RNA, 64 nt, Human
gccguguauuuauuuuucaccuaucuccuuccugucaaggcaggccgggcuccagggcuccccu

SEQ ID NO: 343046 - RNA, 64 nt, Human
cgagcuucagcuuccaggaugcuucucuggaaccucaaggcaggcagcccaggcccugggccug

SEQ ID NO: 343047 - RNA, 64 nt, Human
gcauccucaaaauccuuugcuaaugaccuggcuuucaaggcaucugucuggccugaugagaaug

SEQ ID NO: 343048 - RNA, 64 nt, Human
cacaaucauggcucaccgcauugaccuccuuggcucaaggcauccucccaccucagcuuccuga

SEQ ID NO: 343049 - RNA, 64 nt, Human
uuuugguuguggaaaguaagugggauacuuggaaucaaggcaucucuguaguacagucuucuuu

SEQ ID NO: 343050 - RNA, 64 nt, Human
auuuucccagaaaucacaccagccuuagaaagcgucaaggcaaguggauggcgugcugggaaua

SEQ ID NO: 343051 - RNA, 64 nt, Human
uucaauacccuuuuaaguuuaaaauguguauuuuucaaggcauuuauugccauauuaaaaucug

SEQ ID NO: 343052 - RNA, 60 nt, Human
gagcugagacagauaagagaauaccuuggucucaccuauccugcccucacaucuuccacc

SEQ ID NO: 343053 - RNA, 60 nt, Human
gugaaguuauacuguggcuaugcaacagcucucaccuacgcgagucuuacuuugaguuag

SEQ ID NO: 343054 - RNA, 60 nt, Human
agauucugagcccauaauggcaacagcccccucaccuaugggaagcugacuucccucagu

SEQ ID NO: 343055 - RNA, 64 nt, Human
ccuucccuccagagaacuucuuuuaaugcuucuuucaaggcaugucuacuggcaacuaauucuc

SEQ ID NO: 343056 - RNA, 64 nt, Human
ucuucuauaaaugaauccuauuuccccagaguguucaaggcauuuuucuaccuaaaugaauacc

SEQ ID NO: 343057 - RNA, 64 nt, Human
gaguaauguuucguugcacuuugaaagaucugcuucaaggcauaacucguguaguugucugguu

SEQ ID NO: 343058 - RNA, 64 nt, Human
gauugcuuuuuuauauugcaucaaacuuggaacaucaaggcauccaaaacacuaagaauucuau

SEQ ID NO: 343059 - RNA, 64 nt, Human
gaagauuuggaagaaauaauauguaagaauggccucaaggcagaccacuuuaaguuuggcuaga

SEQ ID NO: 343060 - RNA, 64 nt, Human
ugcaccucugcuccggugcacaaaugcuuucucuucaaggcauggcgcaaaaaagccacuacuu

SEQ ID NO: 343061 - RNA, 64 nt, Human
uggguucuaaaugccuggcugcaucuguaugaaaucaaggcacacuccaggaagacugccacgu

SEQ ID NO: 343062 - RNA, 64 nt, Human
uaguugaguaugacaggcacugaguaugcagaaaucaaggcauguacuugcuguucgaggcccu

SEQ ID NO: 343063 - RNA, 64 nt, Human
auugaaagcucggauggacaagcacauggcaaucucaaggcagcuuuccacggagcaggcuguu

SEQ ID NO: 343064 - RNA, 64 nt, Human
guagucauuccaggaguuuuuggucuuuucugucucaaggcauuguguguuuuguuccgggacu

SEQ ID NO: 343065 - RNA, 64 nt, Human
uauagucauucuagggguuucagucuuuuccaucucaaggcauuguguguuuuguuccgggacu

SEQ ID NO: 343066 - RNA, 64 nt, Human
augucaaacagcugagcaccguagcaugcagaugucaaggcaguuaggaaguaaauggugucuu

SEQ ID NO: 343067 - RNA, 64 nt, Human
cugcccuccaucuuauuccaguguguucaccucaucaaggcagcagaguggaugaaggaguaag

SEQ ID NO: 343068 - RNA, 64 nt, Human
ccuggacgcccagaggccggggccaggcucugggucaaggcaggaaggagacagacagcuggca

SEQ ID NO: 343069 - RNA, 64 nt, Human
gggaaguguuuucaccauggauugcuuuguacagucaaggcaguucuccauuuuauuagaaaau

SEQ ID NO: 343070 - RNA, 64 nt, Human
ggucauaacagggcacauuucugaccgaacccucucaaggcagaggaggaguuugguggguuuc

SEQ ID NO: 343071 - RNA, 60 nt, Human
agaaauaaagaaaugggugacaggcuuaaccucaccuaugaauguacaguauguggauuu

SEQ ID NO: 343072 - RNA, 60 nt, Human
aacuccauacugaacaaggggcuuuauguccucaccuaugaccuggaauaguuuaaauau

SEQ ID NO: 343073 - RNA, 60 nt, Human
uuuuuauuuaaaugaaggaauuccaaauaacucaccuacagauuuuuagcacaaaaauag

SEQ ID NO: 343074 - RNA, 64 nt, Human
ucaaggaauaauugagauuaaguauggaggccauucaaggcaaaaauguccuaaauuuaauugc

SEQ ID NO: 343075 - RNA, 64 nt, Human
auagcuguaguuuucccugcacugugucaucuuuucaaggcauuugucuuuguaauauuuucca

SEQ ID NO: 343076 - RNA, 64 nt, Human
ggagaggccacggggcccaaaaacgcaacacgucucaaggcaaacccgagggaggaacuugguc

SEQ ID NO: 343077 - RNA, 64 nt, Human
gcgaggguuucuuuauuucacucuuuucugaaugucaaggcagugaggugccucucacugugaa

SEQ ID NO: 343078 - RNA, 64 nt, Human
uccaugaucuaagcaggccacguuuaaaauaacaucaaggcaagcguacgugucacccucugua

SEQ ID NO: 343079 - RNA, 64 nt, Human
cuccuuuggugaaauccggguucgaaugaauaucucaaggcaggagaugcaucuauuuuaagau

SEQ ID NO: 343080 - RNA, 64 nt, Human
ugaacagaucauaaaguucuaucaaggaguucuaucaaggcauccaugucaguggugcuaugcu

SEQ ID NO: 343081 - RNA, 64 nt, Human
uuccuuauaaaguaagaacuuuguuuuccuccuaucaaggcagcuauuuuauuaaauuuuucac

SEQ ID NO: 343082 - RNA, 64 nt, Human
uuuugugauaacuugagaauuauacuuguuugaaucaaggcaacucuucuagaauuuauuguuc

SEQ ID NO: 343083 - RNA, 64 nt, Human
uaacugucuuugacuuggaccuuguuuacucuaaucaaggcaggagaugcagcaguccuacuua

SEQ ID NO: 343084 - RNA, 64 nt, Human
cauuucaucucuggcagugccuuggcggugguauucaaggcaguuuuguagcaccuguaauugg

SEQ ID NO: 343085 - RNA, 64 nt, Human
uccaagcccugagguaggaaugagcaggucagauucaaggcagugaggucaggccgcaugaacc

SEQ ID NO: 343086 - RNA, 64 nt, Human
uccccucuucuacccuccccaagaaaaagggccuucaaggcaggaaugagaaagcaaagccaau

SEQ ID NO: 343087 - RNA, 64 nt, Human
ccaagauaagauccuuuggaguuucucuggauccucaaggcaugacucuuacuccagugucauc

SEQ ID NO: 343088 - RNA, 64 nt, Human
gauuucauucucuugaguaauaaaucuuaucuuuucaaggcaccaacaaacaaaacugugauau

SEQ ID NO: 343089 - RNA, 64 nt, Human
uggggaagcaggaacgggagccucuguaacaaucucaaggcauuugugucaucaccuaagacga

SEQ ID NO: 343090 - RNA, 60 nt, Human
ugugagguuaucugaagcacaaggcccacccucaccuaucugucgaccccauuuccuacc

SEQ ID NO: 343091 - RNA, 60 nt, Human
ggaccauccgaucaagcugcagcugccacccucaccuagaaacaugccuuugugcccacc

SEQ ID NO: 343092 - RNA, 60 nt, Human
aagccagggauuguggcaugcaccuguagucucaccuacuccagaggcugaggugggagg

SEQ ID NO: 343093 - RNA, 64 nt, Human
uucuuaauaccuguuuuguaaucaugauauucagucaaggcauuaugguuuuuaaucuugaaac

SEQ ID NO: 343094 - RNA, 64 nt, Human
uagagugucuccuuccuuuucagagaacaguuaaucaaggcaaaucagcaagcccccaaagugc

SEQ ID NO: 343095 - RNA, 64 nt, Human
gcgcacgugcacauaccucugcuagaaacuccugucaaggcagcgagagcugaugcacucggac

SEQ ID NO: 343096 - RNA, 64 nt, Human
ggugugaucucggcucacuucagccuccgccaccucaaggcaguucaagcaauucuccugccuc

SEQ ID NO: 343097 - RNA, 64 nt, Human
gagguugugaggccaccaucaccugaccugggggucaaggcaggaggacuccgaaggugcuacc

SEQ ID NO: 343098 - RNA, 64 nt, Human
agccuucaggagaggagcugccuuuccacccccuucaaggcaaggagggauggaggucccuuau

SEQ ID NO: 343099 - RNA, 64 nt, Human
cuacuggaucccaugcccagguguccagcagaccucaaggcagaagggucaccuaacccaggag

SEQ ID NO: 343100 - RNA, 64 nt, Human
cccugaacccuuccccugggaggugagggccugaucaaggcaccuccucugcccacucggggcc

SEQ ID NO: 343101 - RNA, 64 nt, Human
gaaacugcugcuaacuuuuaaaguuguuugguuuucaaggcacugauaauggauauguaugaag

SEQ ID NO: 343102 - RNA, 64 nt, Human
agggagguugcaucauuguuuuaagcuugccuguucaaggcagccaggcgaggggugauggcaa

SEQ ID NO: 343103 - RNA, 64 nt, Human
gucuccacuguggugacugggucccuuggccauaucaaggcagcacggcccacccaggccuccc

SEQ ID NO: 343104 - RNA, 64 nt, Human
ccucugguaucaguguccucuuuguuuuuguccaucaaggcacaugagugugaccucugccaug

SEQ ID NO: 343105 - RNA, 64 nt, Human
aaaauacauugaaccaagggauccucccuccccuucaaggcagacguucaguacaaacauuuau

SEQ ID NO: 343106 - RNA, 64 nt, Human
cugaaucucuuuauuuucccugguagagacaucuucaaggcaugaaauagcuuaaagagcagag

SEQ ID NO: 343107 - RNA, 64 nt, Human
ucaucagguguuuuaagaugucucugagaagccaucaaggcaaaagagaacuuuaaguuccuug

SEQ ID NO: 343108 - RNA, 64 nt, Human
aucacuaauguaugagcaaugaucuauaucaauuucaaggcacgugaaaaaaauuuuuuaguau

SEQ ID NO: 343109 - RNA, 60 nt, Human
uacagaacaugcauccuuaaacugugacuucucaccuagugcagaacuuuuaccaggcug

SEQ ID NO: 343110 - RNA, 60 nt, Human
uaauauuauauuguauuuaacccauuauuccucaccuacccucaaaguagguauacaaaa

SEQ ID NO: 343111 - RNA, 60 nt, Human
gcuaaucugaccaaauguugggaaaaaugucucaccuaacccacuauuccuuaauuaugg

SEQ ID NO: 343112 - RNA, 64 nt, Human
aggugcugaguuuaacguggcugugcagcugauuucaaggcaugagcugaacagcguugacaca

SEQ ID NO: 343113 - RNA, 64 nt, Human
cuccaaaacagggguguugcggagaagggagaguucaaggcaaacgcaaggacuggacuuagcu

SEQ ID NO: 343114 - RNA, 64 nt, Human
uauuuauuuauugucuuccuguaagaccuucgggucaaggcagaggcaggaaacuaacuggugu

SEQ ID NO: 343115 - RNA, 64 nt, Human
agcuucccuucacuccccuaucccauucucccucucaaggcaggggucauagauccuaagccau

SEQ ID NO: 343116 - RNA, 64 nt, Human
uuguauugagcuuuuacaguauucauuuuucaacucaaggcaauggcuuucuacaccaacucua

SEQ ID NO: 343117 - RNA, 64 nt, Human
gggguagaauuacacuucuuuuuacagguaaaugucaaggcacaaucaguuuucaggaagugcu

SEQ ID NO: 343118 - RNA, 64 nt, Human
aaguugacaggauugauggaacaugcucuccugcucaaggcacaaccucugggcuggaguagag

SEQ ID NO: 343119 - RNA, 64 nt, Human
acccagggacacccaaggauaugucuucugaagaucaaggcaagaaccucuuuagcauccacca

SEQ ID NO: 343120 - RNA, 64 nt, Human
cccacagccauucugggagcuggggaaccuggucucaaggcaggcccugcaguuccacagaggu

SEQ ID NO: 343121 - RNA, 64 nt, Human
ucuuuguauaauaugagagggccuuguuccaaggucaaggcagccuccuuauuuuacaugcugu

SEQ ID NO: 343122 - RNA, 64 nt, Human
uuaauaagagauggauauauuaaaauuacauucaucaaggcaugauuuuuguuucacuacaaau

SEQ ID NO: 343123 - RNA, 64 nt, Human
aaugguucucucaacaagaaauaauagaaaugucucaaggcaguuaauucucauuaauacucuu

SEQ ID NO: 343124 - RNA, 64 nt, Human
cuaucauguaccgugaaaacccccucugauggccucaaggcagugccugcaggccgaggcccuu

SEQ ID NO: 343125 - RNA, 64 nt, Human
auaaaucuuaacagaaaauucuguucugauuauaucaaggcaaauuuuuccuuucuugcaaauu

SEQ ID NO: 343126 - RNA, 64 nt, Human
uucaggaacauggcuuuaacaagcagaucuuguaucaaggcagaggugaugccaugccauacuu

SEQ ID NO: 343127 - RNA, 64 nt, Human
guuuacauguuauuuaaggauaaagguaaaucauucaaggcaguuaccaaccacuaacuauuug

SEQ ID NO: 343128 - RNA, 60 nt, Human
ugaagcagaagcaaacccugcucuuaggggcucaccuaggugagugcacagccugugacg

SEQ ID NO: 343129 - RNA, 60 nt, Human
uuugcaauauuccuuugggccucugcuucucucaccuaaaaaaagagaauuagauuauau

SEQ ID NO: 343130 - RNA, 60 nt, Human
uuaaaaguauggaugcuucauccaaaucgccucaccuacagcagggaaguugacucaucc

SEQ ID NO: 343131 - RNA, 64 nt, Human
agaagaaaucucuuuguaauugcuguaaaugucaucaaggcaaucauagauuucuuuuccauuu

SEQ ID NO: 343132 - RNA, 64 nt, Human
agacuuuaaagcaaauauuaagauuuuuacucauucaaggcaaguaaaugaauggaauuaucug

SEQ ID NO: 343133 - RNA, 64 nt, Human
uccccggccuucggcggagguggaguaagcuccgucaaggcagguggcuucgucccuuccugug

SEQ ID NO: 343134 - RNA, 64 nt, Human
guugcuauugucagcaucuuaaagguauuuccagucaaggcaaggcuaagugcuuugugauagu

SEQ ID NO: 343135 - RNA, 64 nt, Human
gugccuggccuaaggcauccuaccaacagcaccaucaaggcacguuggagcuuucuugccagaa

SEQ ID NO: 343136 - RNA, 64 nt, Human
acuacugcagguccaacuccuggcaaccgcgggcucaaggcaggucauuggaauccacguuuug

SEQ ID NO: 343137 - RNA, 64 nt, Human
uggcugugaggccaccuuugucccaggcccagccucaaggcaaggagggcgcuucacugaggug

SEQ ID NO: 343138 - RNA, 64 nt, Human
uucagggaccucauagccccucgguggugccuucucaaggcaguguuccuggaggcucccauca

SEQ ID NO: 343139 - RNA, 64 nt, Human
cccucccaaccucaaagcuaggccacacucuauuucaaggcauuuucuuucagcugauaaggug

SEQ ID NO: 343140 - RNA, 64 nt, Human
aagcacuccccgaagaauuaaggggguucuguuuucaaggcaugccaaguacuaaagcaccuug

SEQ ID NO: 343141 - RNA, 64 nt, Human
cagggccucacacgguuugaagccuggaacaucaucaaggcacugccugauggaccugucacga

SEQ ID NO: 343142 - RNA, 64 nt, Human
uaaaauucagcuacucagauaaauucagaaugggucaaggcaccugccuguuuuuguuggugca

SEQ ID NO: 343143 - RNA, 64 nt, Human
aaauaaaugaguacaucuccccuucccacaucacucaaggcauaagcagauuuuacuguuagag

SEQ ID NO: 343144 - RNA, 64 nt, Human
auguguugaaccuuauucuuguacauucauucaaucaaggcaaacuuuuauaauuuuucuuuug

SEQ ID NO: 343145 - RNA, 64 nt, Human
aacuucucaguuuuggagguugggagguccaaggucaaggcaccagcaaauuuggugucuggug

SEQ ID NO: 343146 - RNA, 64 nt, Human
gggacugcuggucacuguuucucacaguugcaaaucaaggcauuugcaaccaagaaaaaaaaaa

SEQ ID NO: 343147 - RNA, 60 nt, Human
agcagcuggggaggagccaaagccucggcgcucaccuaagccgcagggagauacacccaa

SEQ ID NO: 343148 - RNA, 60 nt, Human
ugccuccccauuauguaacacccaaccgcucucaccuacacccugaggucuauucacugc

SEQ ID NO: 343149 - RNA, 60 nt, Human
acggaauaccugcuagguuccaggaaugagcucaccuaacagauagcaaaugugucuggu

SEQ ID NO: 343150 - RNA, 64 nt, Human
uugcgcagacuuauacaugucuaggauccuuuuaucaaggcaguuaugaucaucguuuuccugc

SEQ ID NO: 343151 - RNA, 64 nt, Human
ggcacuaacagugcucaugugccuuccagacgguucaaggcagaggccacugugcucaguguag

SEQ ID NO: 343152 - RNA, 64 nt, Human
ucugaaguguguuguguuucauguucaagcuuaaucaaggcagccauuaauauacgaacugagc

SEQ ID NO: 343153 - RNA, 64 nt, Human
caagccaugguuccuugaugacaaacaaacaacaucaaggcaaauccaauaaucaguauuacca

SEQ ID NO: 343154 - RNA, 64 nt, Human
augcugagccguucuugcucugaaacugcgugagucaaggcaaaugcaaaaagccagguuuugg

SEQ ID NO: 343155 - RNA, 64 nt, Human
agugauggugacagcugcuuucaaauucugcaucucaaggcagggcaagccgggguggugcagg

SEQ ID NO: 343156 - RNA, 60 nt, Human
gcuacaccgaagccuggugaagcucccagcucaaggcaggaagacguuugcaaccgcgac

SEQ ID NO: 343157 - RNA, 64 nt, Human
uuaaucacuuuuuucuaugauggauaugaaaaauucaaggcaguaugcacagaauggacgagug

SEQ ID NO: 343158 - RNA, 64 nt, Human
ggcugcgugagggccacucugagcuggaggcgggucaaggcaaaaggaguaaugcaacgccugu

SEQ ID NO: 343159 - RNA, 64 nt, Human
ccuccuggugccccuggcacugaggcacagaucgucaaggcagguacccccucaacccuucuuc

SEQ ID NO: 343160 - RNA, 64 nt, Human
aagaugauagccagggcuguuguuuuggggcccuucaaggcaaaagaccaggcugacuggaaga

SEQ ID NO: 343161 - RNA, 64 nt, Human
gggucacaaagcaccuauguguagaagcuaggguucaaggcagaucugugauuccagaagcugu

SEQ ID NO: 343162 - RNA, 64 nt, Human
ccacacggaagcaagcagaugaacuaauuucauuucaaggcaguuuuuaaagaagucuuggaaa

SEQ ID NO: 343163 - RNA, 64 nt, Human
ggagggcuuguucuccaacaccuucucugguauuucaaggcaccgagaacaagagccauacucu

SEQ ID NO: 343164 - RNA, 64 nt, Human
cuuggugaaauuauuucagauacauauuuuagugucaaggcagauuaguuauuuagccaccaaa

SEQ ID NO: 343165 - RNA, 64 nt, Human
cucacauuccccaucuauuacccuagguguguuuucaaggcagccagcgguagaauccauguag

SEQ ID NO: 343166 - RNA, 60 nt, Human
gugugcuuggaugggaaagaaaaggcuccacucaccuauaggagauuauuuuuaagugga

SEQ ID NO: 343167 - RNA, 60 nt, Human
gucaccaagggccccagcuggcccguucuacucaccuaagugccgccugacccuuguaca

SEQ ID NO: 343168 - RNA, 60 nt, Human
gaacccuccuggccuccagcucagccuucucucaccuacuaugucuguccaacaggucug

SEQ ID NO: 343169 - RNA, 64 nt, Human
cccaucccaguggaggggaaaggggauaaguguuucaaggcaaccuuuucugcacuuugcugcg

SEQ ID NO: 343170 - RNA, 64 nt, Human
gccccaagacacgcaaugucaggccauggcugggucaaggcagaaggccuuggugcacacccag

SEQ ID NO: 343171 - RNA, 64 nt, Human
cacuggccucucuacagcacggccuguggccuguucaaggcagaaccacgacccuugacucccg

SEQ ID NO: 343172 - RNA, 64 nt, Human
acucccauuuccaguauuaaagagagaaucaucaucaaggcaccguagguaacucaguggcugu

SEQ ID NO: 343173 - RNA, 64 nt, Human
ccggucguggcccacccggcuagagacggcguccucaaggcaucuggagggcuuucguggcugc

SEQ ID NO: 343174 - RNA, 64 nt, Human
cuguugagcagccuggugguacuggccacgccccucaaggcaaggcuccuccccuuagggggcc

SEQ ID NO: 343175 - RNA, 64 nt, Human
ugacgugaggugggcaccggccccaagugcagagucaaggcagggagaggccggcuggagccag

SEQ ID NO: 343176 - RNA, 64 nt, Human
uugaugccgagcgggaguagaguguuuccucugcucaaggcaauuuccagagcccggaugccag

SEQ ID NO: 343177 - RNA, 64 nt, Human
augauuaaauaagauucuaacggucuguucuguuucaaggcacucuagauuccauugguccaag

SEQ ID NO: 343178 - RNA, 64 nt, Human
gacccugcaaguugaguauuagagagcuugucuuucaaggcagguuccuggggcuucagggcua

SEQ ID NO: 343179 - RNA, 64 nt, Human
gaagggucuggcauggcccaaggccccaaguauaucaaggcacuugggcagaacaugccaagga

SEQ ID NO: 343180 - RNA, 64 nt, Human
cacaauagccucaucaacauggcugcuugcuucaucaaggcaugcaagccaaaagggaggacag

SEQ ID NO: 343181 - RNA, 64 nt, Human
acaggaaaauacuguggauggauuuaauagguaaucaaggcaauucaguaucucccucucuuaa

SEQ ID NO: 343182 - RNA, 64 nt, Human
cacauauauguuuuaauaucuuuaugggcucuguucaaggcagugcugagagggagggguuaua

SEQ ID NO: 343183 - RNA, 64 nt, Human
gaaaagcuaacaaaagcuucucagcugaggacacucaaggcauacaugaugacagucuuuuuuu

SEQ ID NO: 343184 - RNA, 64 nt, Human
gauggguaagacaugaguuugaaaagagacucaaucaaggcaauguaaauucugcuaaaacuga

SEQ ID NO: 343185 - RNA, 60 nt, Human
ugcugcagcucccuggcuucuguggggccccucaccuacuuacccaggugggucccggcu

SEQ ID NO: 343186 - RNA, 60 nt, Human
auuuugauucuaaauaugauaaaauaauuucucaccuauuuugugugugugacuugaaau

SEQ ID NO: 343187 - RNA, 60 nt, Human
aauuggacgggagacagagugacgcacugacucaccuagaggcuggaacguggguaggga

SEQ ID NO: 343188 - RNA, 64 nt, Human
ugcucccaaauccuguuuucaguguucauuucccucaaggcaggcgcugggcucccacgacccc

SEQ ID NO: 343189 - RNA, 64 nt, Human
uuucaaaugcuaacuuuuaguuucuugggauugaucaaggcaagagaaguggcuuuaaccaugc

SEQ ID NO: 343190 - RNA, 64 nt, Human
agugcugcagaaacuggacaguuccggacagcggucaaggcaaggaugucaugcuugaaggcca

SEQ ID NO: 343191 - RNA, 64 nt, Human
gguggaaggagcagggcucuggagggauucgcauucaaggcacagaauuggccccuugccuguu

SEQ ID NO: 343192 - RNA, 64 nt, Human
auugaaacagaugaucugaccauuaagcuggugaucaaggcacuccuggaaguaaguuugcauu

SEQ ID NO: 343193 - RNA, 64 nt, Human
gaagacuuuaaaucagucaguaguacuuuaccuuucaaggcauuaguaaauuacuugcaaauag

SEQ ID NO: 343194 - RNA, 64 nt, Human
uaacuucuaaagaaguuuuuucuaagaaaauguuucaaggcaauauuuuuuuugaggcugccga

SEQ ID NO: 343195 - RNA, 64 nt, Human
ccaucuuauuaauaauacucugaaaaaaaugauuucaaggcauggaaguucucugugauacaac

SEQ ID NO: 343196 - RNA, 64 nt, Human
guaacucuggcuagagagacacaugugucuugugucaaggcaggaggauaaccuggaugaccuu

SEQ ID NO: 343197 - RNA, 64 nt, Human
auaaacuuguaaagauuugaauauuaaugucuuuucaaggcaaaugggauuguccccgcacuag

SEQ ID NO: 343198 - RNA, 64 nt, Human
cguccugagcaacuaugcccccgccccaguagguucaaggcaaagcagcucugaccgaauucua

SEQ ID NO: 343199 - RNA, 64 nt, Human
agggucagcagagacucagaguccagggcaagguucaaggcagacuaaccucaugcauggauug

SEQ ID NO: 343200 - RNA, 64 nt, Human
uuugauaauugugcuuuacaacuugaaugcugauucaaggcauuauuuggaugugaguuuaauc

SEQ ID NO: 343201 - RNA, 64 nt, Human
gugaaacagcccaguuguaguaggugccagucagucaaggcaggggcccucucuccgucaauau

SEQ ID NO: 343202 - RNA, 64 nt, Human
uaugaaugaagcuauccuaggcaugcagucuuggucaaggcaacuuuggcuggcagucucugag

SEQ ID NO: 343203 - RNA, 64 nt, Human
gugacuuuuguuuaucaagugucacacaacugcuucaaggcagcugugagauacuagaaagcaa

SEQ ID NO: 343204 - RNA, 60 nt, Human
cguuaccuccaucuauuuuaggauauuuuccucaccuauauauuauagggagaauaauuu

SEQ ID NO: 343205 - RNA, 60 nt, Human
caagaguugauagagcuuuuacaaucaauacucaccuaauucugauaaaaggaauacugc

SEQ ID NO: 343206 - RNA, 60 nt, Human
caccggcacuuucauacccugaccucugaccucaccuacagcugggauguaccuggagag

SEQ ID NO: 343207 - RNA, 64 nt, Human
aaguacauccuuggaaucuuuguccacacagcagucaaggcaguuauggccaaucagcugaggg

SEQ ID NO: 343208 - RNA, 64 nt, Human
gaguugcguuuaucuguuggcaaaaauaucuuuuucaaggcaucagcucugaaccuagcuuuau

SEQ ID NO: 343209 - RNA, 64 nt, Human
aaaugguaaacacugaucaagguauuuuguauugucaaggcaugcauauucuaaagaauuaaau

SEQ ID NO: 343210 - RNA, 64 nt, Human
cuguuucugcccagcuuugcuuauuuuggggauuucaaggcagcagaggguagugaggggagag

SEQ ID NO: 343211 - RNA, 64 nt, Human
aaguaauugaguggaaacuugaugccauucuaaaucaaggcauauccagguggcccgguugaac

SEQ ID NO: 343212 - RNA, 64 nt, Human
ccaauaauuaauugcauuuuaaauuggcccacuuucaaggcaauuuuuuuugugugucuguaac

SEQ ID NO: 343213 - RNA, 64 nt, Human
uuuucuugcugcaagcuuuuuuaaauuucugaacucaaggcaguggcagaagaugucagucacc

SEQ ID NO: 343214 - RNA, 64 nt, Human
uucugcaugccugguaaaguccagccaaggcuggucaaggcaacaucuccacacagaaaaucug

SEQ ID NO: 343215 - RNA, 60 nt, Human
gcaucuuagcuuagcaccaaccaacacagucucaccuagaaaacagauggaagcuucguu

SEQ ID NO: 343216 - RNA, 60 nt, Human
gcuggcaagaaggaagcaguucuccacguucucaccuaagcccagagcaaggaacaggua

SEQ ID NO: 343217 - RNA, 60 nt, Human
acugacagccugaagggucuacacccucggcucaccuaagugcccugugcugguugccag

SEQ ID NO: 343218 - RNA, 60 nt, Human
acaggguucaaaaugucuguagcuccucaacucaccuaauguuuaugagccagacaaaug

SEQ ID NO: 343219 - RNA, 60 nt, Human
aggaauauuauucccaagaaauacccgcuccucaccuacucccucauccuaccaaggugc

SEQ ID NO: 343220 - RNA, 60 nt, Human
ugcugaagaguugucaucaacaauccaaugcucaccuauucaguugcucuguggucagug

SEQ ID NO: 343221 - RNA, 60 nt, Human
uugggcagugaaauuaccuuuugcucaaggcucaccuagauggguacaauaaaaagaaca

SEQ ID NO: 343222 - RNA, 60 nt, Human
agaguggcagacuuucuucuccuuuucccucucaccuaaaugucaacuugucauugaaug

SEQ ID NO: 343223 - RNA, 60 nt, Human
caaagugcugggauuacagacacgagccaccucaccuagccugaugagauuuuuaaaaaa

SEQ ID NO: 343224 - RNA, 60 nt, Human
aauauucuguuugugaauucagacuaugagcucaccuacaaccuagagaagguaagaugg

SEQ ID NO: 343225 - RNA, 60 nt, Human
uucccagauaauuaacuagcuauuacagaucucaccuagaggguugauguuaugaagacu

SEQ ID NO: 343226 - RNA, 60 nt, Human
uggguugagaggucagggcacuuucaaucccucaccuaguccugcugcacagggcaggag

SEQ ID NO: 343227 - RNA, 60 nt, Human
aucagcaccugcguuuuagagaucauaauucucaccuacuucugagcuuauuuuuccauu

SEQ ID NO: 343228 - RNA, 64 nt, Human
uugugugaagggaaaugccaaggaugcuucugguggacuucaggggaccccaggguuuggccgu

SEQ ID NO: 343229 - RNA, 64 nt, Human
uguagacacacauugcagacucuuaacgcaggaaggacuucaaacuucugcugagaccuugggg

SEQ ID NO: 343230 - RNA, 64 nt, Human
ccccccaaguuacuguauuugucugggcuuuguaggacuucacuacguugauugcuagguggcc

SEQ ID NO: 343231 - RNA, 64 nt, Human
gcucagcccagccuccuaucuuuccuucuucuauggacuucagacagccagugucuggggacuc

SEQ ID NO: 343232 - RNA, 64 nt, Human
ggcaagccagggugggcuagggugguaagcuggaggacuucauccuucaguuaggcugcacaag

SEQ ID NO: 343233 - RNA, 64 nt, Human
aaugcauuaaaaacugugcuagucuccuuugcauggacuucaagcugcaugaaaugcaauaaau

SEQ ID NO: 343234 - RNA, 64 nt, Human
uaccugcucccaucaccauccagcccagcacccuggacuucagucgccuggcccaaccccauga

SEQ ID NO: 343235 - RNA, 64 nt, Human
uguugaaacucuauagaccuggggcugcaguuggggacuucaugucagugcaaaugccauuagu

SEQ ID NO: 343236 - RNA, 64 nt, Human
uggucucgggguuucugccugccccgugggcauagguggacaggcucuggcagccgggcagugc

SEQ ID NO: 343237 - RNA, 64 nt, Human
aggggccagcuaacccgugcagaaccagcacuaagguggacagcagacaagagggcaagccucu

SEQ ID NO: 343238 - RNA, 64 nt, Human
caagcagagagugccugggacaggacugugaccugguggacaggggccuagauguagccucugu

SEQ ID NO: 343239 - RNA, 64 nt, Human
agcccaacugcuuggacgccuuuccaaaucugaaggacuucaucucccgcuuugaggugaugcc

SEQ ID NO: 343240 - RNA, 64 nt, Human
cccaagaggaaaaggauguggcucaggcugggagggacuucaguuagcauggugggggagaacc

SEQ ID NO: 343241 - RNA, 64 nt, Human
acguuugaggaacaggagugggcacugauagaaaggacuucaacgccagugacuguguaccucc

SEQ ID NO: 343242 - RNA, 64 nt, Human
gcucacuucuagagagaagaaaaaggcuggguuuggacuucaugccuccucacuggugaaaccc

SEQ ID NO: 343243 - RNA, 64 nt, Human
cuguuauuaaaaucuuccuauuuaacuagcuuggggacuucaguugaaaauuagguucuaaguu

SEQ ID NO: 343244 - RNA, 64 nt, Human
cucucauacgccuucccacucccucugguuuauaggacuucacucccuagccaacaggagagga

SEQ ID NO: 343245 - RNA, 64 nt, Human
uaucugcuuuuaacuaguaguugccuacaucuggggacuucagagaagaauuauauuuuguuag

SEQ ID NO: 343246 - RNA, 64 nt, Human
uaguuuuuacacuaaaacuuuacaagauaaaauuggacuucauuuaguaucuuuuuaacagaau

SEQ ID NO: 343247 - RNA, 64 nt, Human
auauuuuaauaauaaguauaauuagcuuguuccuggacuucauuuucaaugaugaaccaaauuc

SEQ ID NO: 343248 - RNA, 64 nt, Human
agaagggccccacccugggcaguauagagacgucggacuucacgguaaguuuuagagccucucc

SEQ ID NO: 343249 - RNA, 64 nt, Human
uuucauuucugguuuaaccaggcuuuucaggaugggacuucagaccaaggacacaaguugggcu

SEQ ID NO: 343250 - RNA, 64 nt, Human
agggaggcaaagcugacaugaaccuuuugucgugggacuucaggccacauuggcuugaaggcau

SEQ ID NO: 343251 - RNA, 64 nt, Human
aauaugugaauguuuacacuaauuuuaccgagugggacuucaaaauuuuuauuauugacaaugg

SEQ ID NO: 343252 - RNA, 64 nt, Human
gauguaacuagcauguuacaagagugaauaaucuggacuucagagauuaagucaccaauaguga

SEQ ID NO: 343253 - RNA, 64 nt, Human
uagagcacaugaacucaagguuagugacucugcaggacuucacagagagagcugugcccaucau

SEQ ID NO: 343254 - RNA, 64 nt, Human
uaaaugaauuauuuagauuuuugacaaagauuuagguggacacccuaaacugugugugccuuua

SEQ ID NO: 343255 - RNA, 64 nt, Human
gucugccucagccccaggaagggcaaggcaagaugguggacagauagagaauuguugcuguauu

SEQ ID NO: 343256 - RNA, 64 nt, Human
uagggcugucugcauguuuauuuuuacuucccuggguggacagaauuuaauuucucgagcuguu

SEQ ID NO: 343257 - RNA, 64 nt, Human
uuccuauuauaauuacaucucauuguccuguggagguggacaugauaaacauuaucuuuuguuu

SEQ ID NO: 343258 - RNA, 64 nt, Human
ucugaaagacuugaaaagccuccgccugcuguguggacuucaucucaaggggcccagccuccuc

SEQ ID NO: 343259 - RNA, 64 nt, Human
ucccuccuccaccccacacucccaccucuuucuaggacuucacuuugauaccaaauucucauua

SEQ ID NO: 343260 - RNA, 64 nt, Human
guuuucuuuguucuuuuuuugaagucauuacacaggacuucacuccagaguuaccauuaugagu

SEQ ID NO: 343261 - RNA, 64 nt, Human
uguauugcuuauuuuauuaugagcuacaacaaaaggacuucaggaacaaguaauguauuaguau

SEQ ID NO: 343262 - RNA, 64 nt, Human
augcauaguuacagaaauuccugaagauuccccaggacuucaauuucauugguuuuuauuugca

SEQ ID NO: 343263 - RNA, 64 nt, Human
ccauuuguuguguagagauauagcagcugaagcaggacuucauuccagauagcugugugcauuu

SEQ ID NO: 343264 - RNA, 64 nt, Human
acccugcugguacccagacccccaccuucggaggggacuucauguuccguguacguuugcaucu

SEQ ID NO: 343265 - RNA, 64 nt, Human
uaacuggccuccagccacauucucauagcagguaggacuucagccuuccagacacugcccuuag

SEQ ID NO: 343266 - RNA, 64 nt, Human
uuagggguagucauuccaucuuuagauuauccuuggacuucagcuaccagcacagcaugcauua

SEQ ID NO: 343267 - RNA, 63 nt, Human
ccagugacuuccaguuaugagcugcauugauguggacuucauagacacaaaggcuucgaagca

SEQ ID NO: 343268 - RNA, 64 nt, Human
uugccccaggaacagcagaucuaacagcugauguggacuucaguuauuugcgaagaauggcaca

SEQ ID NO: 343269 - RNA, 64 nt, Human
cuuaauucuuuacaagggauaucaaagccauaauggacuucauuaguuuuaggguagggaaggg

SEQ ID NO: 343270 - RNA, 64 nt, Human
uaggcauuaccauucgggacauaggcaugggcaaggacuucaugucuaaaacaccaaaagcaau

SEQ ID NO: 343271 - RNA, 64 nt, Human
ggccuccgcuucgcuggcgccgccuuuuuagcuuggacuucaguccucccucggggacucaccu

SEQ ID NO: 343272 - RNA, 64 nt, Human
cagacuguuuuaagaaaguuuaaaaauuuguguuggacuucaugcgggccacagguuggacaag

SEQ ID NO: 343273 - RNA, 64 nt, Human
agccagggugugacucgggagcugcacacaccuggguggacacaaggcacggccacgucauguc

SEQ ID NO: 343274 - RNA, 64 nt, Human
gugagcagagaucgugccacugcacuccagccuggguggacagagcaagacuccgucucaaaga

SEQ ID NO: 343275 - RNA, 64 nt, Human
agggcugggucccggguccuccacaggugaccccgguggacacacgcguucccauccuggccuc

SEQ ID NO: 343276 - RNA, 64 nt, Human
caggaauaauaaaccaaugaguuagcucagggccgguggacauguucacugguggaccaguugg

SEQ ID NO: 343277 - RNA, 64 nt, Human
acacuuaaacuuuguuaggacuccgaugaguuugggacuucaggaaaaaucaacccagcaccag

SEQ ID NO: 343278 - RNA, 64 nt, Human
cuacugucaaaaaaauaugcauguauaguaauuaggacuucauuccuccauguuuucuucccuu

SEQ ID NO: 343279 - RNA, 64 nt, Human
accaccaaagguuaagugagguccccuugauugaggacuucaccccuugauuaaagcaacuucu

SEQ ID NO: 343280 - RNA, 64 nt, Human
gaaagugagccauuuuguaaugaugaagauguuaggacuucaaaggauuuuucuuuacucgauu

SEQ ID NO: 343281 - RNA, 64 nt, Human
uacagccuaugaagguaaaguauaugugucaacuggacuucaagaggagguccaugccaaacug

SEQ ID NO: 343282 - RNA, 64 nt, Human
acuuucaucaauuaggauggcuggcuaguggcagggacuucauauaaagaaaucuuucccagaa

SEQ ID NO: 343283 - RNA, 64 nt, Human
agugucuaaaggaaacgccaugaggcagggggcuggacuucaggcggggacccauugccucgca

SEQ ID NO: 343284 - RNA, 64 nt, Human
ugggaggcugagacggguggauuaccugaggucaggacuucaagaccagccuggccaacauggu

SEQ ID NO: 343285 - RNA, 64 nt, Human
agugcuuugccccaggauugccucaaaucugaguggacuucauccuuugcggcggcucugagcc

SEQ ID NO: 343286 - RNA, 64 nt, Human
gcuucugcuuuaagccagaggcaccuggaacccuggacuucacugggagggccaacuuggagga

SEQ ID NO: 343287 - RNA, 64 nt, Human
gggauucccuuccuucuguugcugguguacucuaggacuucaaagugugucugggauuuuuuua

SEQ ID NO: 343288 - RNA, 64 nt, Human
gcauuuuauuaucacauucuuaguucucagguugggacuucaauuacugcugcagagcaguagu

SEQ ID NO: 343289 - RNA, 64 nt, Human
ugcauuuauggacucugaccuuuuuaagaacauaggacuucagguaugcuaauuuggccauuaa

SEQ ID NO: 343290 - RNA, 64 nt, Human
ggguugacuaccucagauuugcugcacucauuguggacuucauguggaucacaacuucuggaua

SEQ ID NO: 343291 - RNA, 64 nt, Human
gaaguuccaagaagcccagcauggccaucagugaggacuucaggguagacuuuguccuguagcc

SEQ ID NO: 343292 - RNA, 64 nt, Human
cuuuugaccuuuuagaagauuggucuccaguaaagguggacauuuuugagauuuuuauaauaaa

SEQ ID NO: 343293 - RNA, 64 nt, Human
ccggaaggcugugugcggggacauccgagguggugguggacaggaaggacuugggaaggggagc

SEQ ID NO: 343294 - RNA, 64 nt, Human
ggguaaccacugugggcucucucccaucacagaagguggacagggccuacccagguggagggga

SEQ ID NO: 343295 - RNA, 64 nt, Human
cccagaguccuguccggccugccaaguucauccugguggacagcgggaggccuccgcuaacugu

SEQ ID NO: 343296 - RNA, 64 nt, Human
gauguauuuggggauagaauucuuuaaauguaugggacuucaugcuuccugauuauguaauauu

SEQ ID NO: 343297 - RNA, 64 nt, Human
uuucauaagcaaauaaaucccuaggauguaaucaggacuucaaauguguaauuaaauuuuuuua

SEQ ID NO: 343298 - RNA, 64 nt, Human
uuuacucuaggggccucugucagcaagaccauggggacuucaagagccuguggucaggaaauca

SEQ ID NO: 343299 - RNA, 64 nt, Human
uguaaauagaugauauccaaacuuaauuuggcuaggacuucaauuuuaaaaaucaguguaccua

SEQ ID NO: 343300 - RNA, 57 nt, Human
aguguaaaacacucaugugauauuuuuggacuucauucauucaagcaaaagaauuau

SEQ ID NO: 343301 - RNA, 64 nt, Human
uuguugggugcauauuuaugauaauaacaaugauggacuucaauuguacucacuguucuauugu

SEQ ID NO: 343302 - RNA, 64 nt, Human
uucguauaccuaaguuuguauuuuuugugacuuuggacuucaacaguuuguauauugggacuuc

SEQ ID NO: 343303 - RNA, 64 nt, Human
gcugcuggacccuuccuaaaccugucacucaagaggacuucagcucugcuguugggcuggugug

SEQ ID NO: 343304 - RNA, 64 nt, Human
uaagauuaugaaaguaacaguuauugauacugcuggacuucaaaggcaaaguucauuucuucca

SEQ ID NO: 343305 - RNA, 64 nt, Human
cagaugagguggcuucacaugcacuucccugucuggacuucagcccguauuccgaggaguagag

SEQ ID NO: 343306 - RNA, 64 nt, Human
gaccuggaauuuagaguauaucugaaaagcaguuggacuucaagaaauuuaaaauucucucuuu

SEQ ID NO: 343307 - RNA, 64 nt, Human
cucccccuacuagaauguaagcuccauggggcagggacuucacuguauuuuguucauaguguau

SEQ ID NO: 343308 - RNA, 64 nt, Human
uucuucuccugucuacauuaugcacuacauaauuggacuucauuaugcuuuugaaaugcuuauc

SEQ ID NO: 343309 - RNA, 64 nt, Human
agaucucauggaugauuacuguaugagacagaggggacuucagucuuuccagggccuuggugga

SEQ ID NO: 343310 - RNA, 64 nt, Human
cuaugacacccuggcccugcgcaacgcaagcaucggacuucacacgagggaagucaguaaaaac

SEQ ID NO: 343311 - RNA, 64 nt, Human
aacaggacaucaaguuaaugaaaauggagaaacugguggacaacaacacagcauugguugacaa

SEQ ID NO: 343312 - RNA, 64 nt, Human
gcgggccggcaaggccauaccucggugagggacagguggacaacggucaccuaucuguagccag

SEQ ID NO: 343313 - RNA, 64 nt, Human
gguaguacuacauuuuauuuaucaugcaucgauugguggacauuuggaucguuucuacuucuug

SEQ ID NO: 343314 - RNA, 64 nt, Human
uauugaauuagaaaauuagugaccauuauucacagguggacaaauguugauguuguccuguuaa

SEQ ID NO: 343315 - RNA, 64 nt, Human
ucuauaggauuuuucuuuaggagauuuauuuuuuggacuucaaagcaagcugguauuuucauac

SEQ ID NO: 343316 - RNA, 64 nt, Human
ccagggggaagugcauguauaaugaaaugauaauggacuucaaugaagaaugucaucaauuaug

SEQ ID NO: 343317 - RNA, 64 nt, Human
ugucugcagacagcgccgcuggaugcucccagcuggacuucaaccccacuccucucagucccuc

SEQ ID NO: 343318 - RNA, 64 nt, Human
aaauauuguuaccaugaagauaguuuuccucaauggacuucaaauugcaucuagaauuagugga

SEQ ID NO: 343319 - RNA, 64 nt, Human
gcggcuaguucagagagauuuuuagagcugugguggacuucauagaugaauucaaguguugagg

SEQ ID NO: 343320 - RNA, 64 nt, Human
ugacaugugagaaauaaaauagcagcuccaccauggacuucaggcuguuaguggcaguacugac

SEQ ID NO: 343321 - RNA, 64 nt, Human
uggccauguggcugcauaaaaagcacaauugcuaggacuucaguuuuuacuucagacuaaagcu

SEQ ID NO: 343322 - RNA, 64 nt, Human
agugaaauaccccauuagaagaggauuuuuugggggacuucaauaugaagaaaaccaagaaugu

SEQ ID NO: 343323 - RNA, 64 nt, Human
cuaaaucuguucaguuugcauugguacuuacuguggacuucauagcuuacugacagauaguaau

SEQ ID NO: 343324 - RNA, 64 nt, Human
agaggauucucccugagugucaggggaggcugugggacuucaccacguggacaaacgaaagcac

SEQ ID NO: 343325 - RNA, 64 nt, Human
ccucuagaacugaauuccucuggaauugagugauggacuucacaacaacuagccaggaagggug

SEQ ID NO: 343326 - RNA, 64 nt, Human
guucuuccauugguuggaucugauacuuaucuugggacuucaguuuuuccgucaauaagaugag

SEQ ID NO: 343327 - RNA, 64 nt, Human
ccugaaaggaagccccuuuggggcagggaggugaggacuucaucucaacaucggcuggugguug

SEQ ID NO: 343328 - RNA, 64 nt, Human
gucccagaccccucuauucugcuccaggacagcaggacuucaggucuuccuggggguggauaua

SEQ ID NO: 343329 - RNA, 64 nt, Human
uggcguagguggcaguugggccuggugaggguuaggacuucagaaaccagagcacaagccccac

SEQ ID NO: 343330 - RNA, 55 nt, Human
gggacauaauggagcucugagugcugguggacagugccccucccaccuuccuucu

SEQ ID NO: 343331 - RNA, 64 nt, Human
uguaccaaaaauacaaaaauuaauugggcauggugguggacaccuguaaucccagcuacuaggg

SEQ ID NO: 343332 - RNA, 64 nt, Human
gcugcaugaagaccugcccccugauugacuuggagguggacaauggaccugcgcagauggggac

SEQ ID NO: 343333 - RNA, 64 nt, Human
gagcaccccugcugccccccucucacugaccagggguggacaaugcccaagcagagggagcccc

SEQ ID NO: 343334 - RNA, 64 nt, Human
uuuggauuaaugacauucagggucuuugcaguggggacuucauguugccucucacucauuccuc

SEQ ID NO: 343335 - RNA, 64 nt, Human
uuucaggcacagugggggauguucugcacccaguggacuucaaaagaguuuugaagacuuaauu

SEQ ID NO: 343336 - RNA, 64 nt, Human
acacagaacugaaucauaccacaugcugccuaugggacuucaguuacuguuuccugaguuacug

SEQ ID NO: 343337 - RNA, 64 nt, Human
agggguuaacuuggucagagccacucuaugaguuggacuucagucuugccuaggcgauuuuguc

SEQ ID NO: 343338 - RNA, 64 nt, Human
ggggaugucacacgcaggauucuguggggacuguggacuucaucgagguguguguucgcggaac

SEQ ID NO: 343339 - RNA, 64 nt, Human
caagauauggacacacgggagccgcuggcagaagggacuucacgaaguguugcauggauguuuu

SEQ ID NO: 343340 - RNA, 64 nt, Human
gaaugccauucacaggaacagcccaggaacccagggacuucagaagggcugguuuguccgaaaa

SEQ ID NO: 343341 - RNA, 64 nt, Human
cauccugcagugcacaccucggucucgucaguaaggacuucacuuucuucugaacuggggcuug

SEQ ID NO: 343342 - RNA, 64 nt, Human
aaaggaauugauggacaaaaugagauucucaccaggacuucagguuggauaacaugucaaaaag

SEQ ID NO: 343343 - RNA, 64 nt, Human
gcaggauuccuaauucuuaaaugccauucagucuggacuucaaaucacuugucuucagaaaaua

SEQ ID NO: 343344 - RNA, 64 nt, Human
cuuccaaacaguaucgcuaguaaaauagcaugcuggacuucagaccucagggauccuuuugaug

SEQ ID NO: 343345 - RNA, 64 nt, Human
agacacuguguaucaguuuugccaauaagacuguggacuucaugauuguuguugaacuucuggg

SEQ ID NO: 343346 - RNA, 64 nt, Human
ugggaagguuugccagcauuggaaaaagccacuuggacuucacagagcugucagaagacuuagg

SEQ ID NO: 343347 - RNA, 64 nt, Human
uuguguguuacuuugugaaugagccauuucacauggacuucaugaaauuugccuccugaguuca

SEQ ID NO: 343348 - RNA, 64 nt, Human
cagccugcugagaagcguggugcagcugggucugggacuucacuagagcuuacucuggagcacc

SEQ ID NO: 343349 - RNA, 64 nt, Human
ggugaguggauggauagauggauaggugaauguagguggacaggugacuggguggauguugugg

SEQ ID NO: 343350 - RNA, 64 nt, Human
uuagccaaugccuugggagaagcugccaugcaaagguggacaccauucuccagcuucaggggau

SEQ ID NO: 343351 - RNA, 64 nt, Human
uauuagauuguuagcagcaaaauaugaaagaugagguggacaguccucuaagcccuauuuaggg

SEQ ID NO: 343352 - RNA, 64 nt, Human
uguacaacauaggccagggccaacaaaguggagagguggacacauuuucauguucauuacuaaa

SEQ ID NO: 343353 - RNA, 64 nt, Human
gaauggauguuacugaugccguuagugcuuuuuuggacuucaccugaggacagaugaugcagcu

SEQ ID NO: 343354 - RNA, 64 nt, Human
gugauuugacaagucaagcucuuaagaaauacaaggacuucagauccauuuuuaaauaagaauu

SEQ ID NO: 343355 - RNA, 64 nt, Human
uucugggcccuuggcccauucugugcacagccaaggacuucaguagaccaucugggcagcuuuc

SEQ ID NO: 343356 - RNA, 64 nt, Human
agagccuagaguagcaggaucaaggaugaaagcuggacuucaaauaugccuuguuaguguaaau

SEQ ID NO: 343357 - RNA, 59 nt, Human
aagagacccuugaaacaugaaaaaugaguggacuucagacucaucagagacucuaaaau

SEQ ID NO: 343358 - RNA, 64 nt, Human
acgcuguuuugaagcuuacauggacaaauguuuaggacuucaagaucacacuugugggcaaucu

SEQ ID NO: 343359 - RNA, 64 nt, Human
ggccugggugugugcacaaggaggcccgggccagggacuucaccaggggcugggucacaagggc

SEQ ID NO: 343360 - RNA, 64 nt, Human
cuucccugcuuaaauuucuccaguggauucccagggacuucaggaucaaguccuaguuguucag

SEQ ID NO: 343361 - RNA, 64 nt, Human
ugguuuggagauacugucuguggaugugagguggggacuucauucauuguccuauuucuaucuc

SEQ ID NO: 343362 - RNA, 64 nt, Human
ggcagggaugggugugcccaugugugccuugacgggacuucaucuuauagacuguuaaacuguc

SEQ ID NO: 343363 - RNA, 64 nt, Human
ccucccaccaaguccucuugggcccugucuguccggacuucaacuccagccuuucccuauugca

SEQ ID NO: 343364 - RNA, 64 nt, Human
acgcuggccacuggauccacgcugaccgcccacaggacuucauagcugccauccgaggcuuccu

SEQ ID NO: 343365 - RNA, 64 nt, Human
gcuggaagaaggcccucaccagaacccaacccuuggacuucagccuccagaacugugagaaaua

SEQ ID NO: 343366 - RNA, 64 nt, Human
ccagguuuuuaaauguuuucacaaaacuguuacgggacuucaacuagaaauaaaaugguguaaa

SEQ ID NO: 343367 - RNA, 64 nt, Human
cagacucaaaguuccaccaaaaacaaauacaaggggacuucaaaaguucacgaaaaaauugaau

SEQ ID NO: 343368 - RNA, 64 nt, Human
aguuccagaagacuggguaagucucuugcuagcagguggacauucugguauuuuagacugacug

SEQ ID NO: 343369 - RNA, 64 nt, Human
ugaacccccaguacaaggacauuguuuugaacuagguggacaugccaucccuggucuccuuaga

SEQ ID NO: 343370 - RNA, 64 nt, Human
agaagggaggggacagcuggcuucagccaggcucgguggacacccuggcccucucggggcagag

SEQ ID NO: 343371 - RNA, 64 nt, Human
ggcuggccucucaggaccacucggauggcacucagguggacaggacggggcagggggagacuug

SEQ ID NO: 343372 - RNA, 64 nt, Human
ugcuaccuccuuuccagacagaugagagagggcaggacuucaggcuggauccaccacugggcuc

SEQ ID NO: 343373 - RNA, 64 nt, Human
ugaaacccuuccccaagaauguuucuuuauagacggacuucauugaaaucuuuguuguucuuga

SEQ ID NO: 343374 - RNA, 64 nt, Human
caccccaccccacccuguuccuuuuuuaucaggaggacuucagagccaggccugcagcauuuug

SEQ ID NO: 343375 - RNA, 64 nt, Human
guagucccucuugguaaucuaccaccaagcuuguggacuucaccccaacaaaauuguaagcguu

SEQ ID NO: 343376 - RNA, 64 nt, Human
cugcauuuucuuggguguugagaacuuguaccauggacuucagaccgccuugcagccguaugcu

SEQ ID NO: 343377 - RNA, 64 nt, Human
uuuagcgaugccgccgggcauuuaacacccaccuggacuucagcagagugguccggggcgaacc

SEQ ID NO: 343378 - RNA, 64 nt, Human
cucuuacuucucuggcuaagggcucagcuucuugggacuucaaccaucuucuuucugaaagacc

SEQ ID NO: 343379 - RNA, 64 nt, Human
uuacuaucaugcagccaggggccgcugacaucuaggacuucauuauucuauaauucaggaccac

SEQ ID NO: 343380 - RNA, 64 nt, Human
ggaggugaacaagcaaacccagacggcuccacuaggacuucaaauuggggguuggauuugaaga

SEQ ID NO: 343381 - RNA, 64 nt, Human
caccaauauaugauuuaaaccgagcacugaugcuggacuucaugauuuuuacccucccuuuggc

SEQ ID NO: 343382 - RNA, 64 nt, Human
cucagugaauucccaccaggugcccacagcuccuggacuucaaauucuauauauugagagaguu

SEQ ID NO: 343383 - RNA, 64 nt, Human
agccuugcuucucucagccuagguucccauuuggggacuucaggaccccagagccacuaggacu

SEQ ID NO: 343384 - RNA, 64 nt, Human
cuaucccaauaggcagacuggguuucuagcccauggacuucacauaagcucagaauccaaguga

SEQ ID NO: 343385 - RNA, 64 nt, Human
cccaggucagccaagaaagauacauaaucucaugggacuucagugggaguuacacaggaauguu

SEQ ID NO: 343386 - RNA, 64 nt, Human
acuugggguccaucaccccaggggguccauaguuggacuucagagggucuaugaaaccccuaaa

SEQ ID NO: 343387 - RNA, 64 nt, Human
agcuuuauaagcgcccgggaggaacaaugagcuugguggacacauuucauugcaguguugcucc

SEQ ID NO: 343388 - RNA, 64 nt, Human
uuuguagcuuugcccauugucuuauuggcacauggguggacacggaucugcugggcucugccuu

SEQ ID NO: 343389 - RNA, 64 nt, Human
ccaauggccaagagagugacacagccaggacccugguggacagccagaggggccacuucaggau

SEQ ID NO: 343390 - RNA, 64 nt, Human
ggaagagagccagucuggaaggaagagcuuuccagguggacagggcuucuuggaagacccccaa

SEQ ID NO: 343391 - RNA, 64 nt, Human
gccaugaucagacauacagcugccuaccuaaugaggacuucaagccccaccacauagcaugcuu

SEQ ID NO: 343392 - RNA, 64 nt, Human
ggcagggcaguuggcacuccacuccuauuuggagggacuucauacccuugccucuugugcccca

SEQ ID NO: 343393 - RNA, 64 nt, Human
gaggucaggccgcaugaaccuggaggggaaucggggacuucaugcgaaacuccagccuaggcuu

SEQ ID NO: 343394 - RNA, 64 nt, Human
cgaagaaauugacccauaggcagaggcaugagcuggacuucauguuucccucaaagacucuccc

SEQ ID NO: 343395 - RNA, 64 nt, Human
gaaauuuuggauacuguuaaaauauaacucauguggacuucaaugcagacuucacauuuuucug

SEQ ID NO: 343396 - RNA, 64 nt, Human
cggaaaacacagaguaaacccuagugucaacucuggacuucaguuaauaacaguguaccacuau

SEQ ID NO: 343397 - RNA, 64 nt, Human
uaucuuaccucaacuguuuccucuggagccacuuggacuucaaaaauaguuugauuuuaaugca

SEQ ID NO: 343398 - RNA, 64 nt, Human
cggucggggagcccauacauucugcaacaaccagggacuucacaggagccuuguuuucaauuug

SEQ ID NO: 343399 - RNA, 64 nt, Human
cauugccacugguuuuuccuaagucaugcaccaaggacuucagaaaguucuuccuccgagucag

SEQ ID NO: 343400 - RNA, 64 nt, Human
cagugagaaguaaacagagcagaagugaccacugggacuucaggcaagaagcucaccaccaggc

SEQ ID NO: 343401 - RNA, 64 nt, Human
aaccaugccaucauuaauggcuaacaacacguagggacuucaugucaugucaaagauagcucuu

SEQ ID NO: 343402 - RNA, 64 nt, Human
agccaagaaagcugagauauccugugcaccauagggacuucaccaauggauuacaugccaucug

SEQ ID NO: 343403 - RNA, 64 nt, Human
uguuuaccuuccgcagcacccagcaucaaaggacggacuucaggggacacguuuaguauauuaa

SEQ ID NO: 343404 - RNA, 64 nt, Human
agcauuuguguguguaugugugaaguauauacugggacuucagaagugcaauguauuuuucucc

SEQ ID NO: 343405 - RNA, 64 nt, Human
cuucccuguuuguaaauauucuguggagaaaagaggacuucagggaguaaaaaagccacugaug

SEQ ID NO: 343406 - RNA, 64 nt, Human
gaacaaacuuccucucuggccucucaggaaucaggguggacauggcucacaacagcagggccuu

SEQ ID NO: 343407 - RNA, 64 nt, Human
acccccuguguggccugaguccccucaggaggaagguggacaacagagaaaugagaguuuugau

SEQ ID NO: 343408 - RNA, 64 nt, Human
ugagaagaagggugggagggcgugggggccccuggguggacaccaccagccaccagucccuggc

SEQ ID NO: 343409 - RNA, 64 nt, Human
uuuuuuuugagaacuccaaaguccugaaaauuuugguggacaaugauuuuuaaaaaacuaacuu

SEQ ID NO: 343410 - RNA, 64 nt, Human
uggcaggugcucccaccaggucagacccaguccuggacuucaagagugagggccccugcugggc

SEQ ID NO: 343411 - RNA, 64 nt, Human
uucuuaaagugauuaaaugagaacauggaugaguggacuucauauuaugacuagcuuuacuauu

SEQ ID NO: 343412 - RNA, 64 nt, Human
cugagacugaaauuguuuuaccagcucccaggguggacuucaguguguguauuuguguaaauga

SEQ ID NO: 343413 - RNA, 64 nt, Human
aaaaauccaugcuuuacaccuggacaguagacagggacuucagagauugcacguuugaauacau

SEQ ID NO: 343414 - RNA, 64 nt, Human
agcaccacacguccauccugggacagacgggccuggacuucacggcaagaccccccucucuucc

SEQ ID NO: 343415 - RNA, 64 nt, Human
cugagcuucuacagggcugagagcugcgcuuuggggacuucagccuuccuuccagucugggcug

SEQ ID NO: 343416 - RNA, 64 nt, Human
uguguuguuuucuucuucaccugcuccuaucuauggacuucauuuuagucaccauggaguaaaa

SEQ ID NO: 343417 - RNA, 64 nt, Human
gacuaggagaccagaagugaaugggaaagggugaggacuucacaauguuggccugucagagcuu

SEQ ID NO: 343418 - RNA, 64 nt, Human
uauuuaccuaucacucuaguuuugaagcaaagauggacuucaguggggaggggccaaaaccguu

SEQ ID NO: 343419 - RNA, 64 nt, Human
uggcccagugaccacagagagaucugcaccucccggacuucaggccugccuuuccagcgagaau

SEQ ID NO: 343420 - RNA, 64 nt, Human
gaccaccuggcaugagggagaggggcugagggauggacuucagccccucugcucuguacccuuu

SEQ ID NO: 343421 - RNA, 64 nt, Human
ccuugcuguauuuuuuuguauuauaaauuacauuggacuucauauauauaauuuuuuuuuacau

SEQ ID NO: 343422 - RNA, 64 nt, Human
uaaaggucacucagguuccagguugacaguuggaggacuucaccguaccaacccugaagagauu

SEQ ID NO: 343423 - RNA, 64 nt, Human
aaauaacccucgucccugcccaggaacccagacuggacuucagucucccuccauggagacaaag

SEQ ID NO: 343424 - RNA, 64 nt, Human
augucaagggccaagaagucccaagaccugcgauggacuucacagauuuguccaggcugccccu

SEQ ID NO: 343425 - RNA, 64 nt, Human
auaauugagaaaguguucaucugaggacugcaucgguggacacugguauuuauuuauguuagcu

SEQ ID NO: 343426 - RNA, 64 nt, Human
uuucuugcagcaucauuuccuuacaauacuguccgguggacaaaaugacaauugauauguuuuu

SEQ ID NO: 343427 - RNA, 64 nt, Human
aagggaaaggaaaaaauggggguggggggugggggguggacaacauucaacacugcagaauggg

SEQ ID NO: 343428 - RNA, 64 nt, Human
ggucuuggugggcugcacgugccugcgaagaugugguggacaaggaggcucucgggcugggccu

SEQ ID NO: 343429 - RNA, 64 nt, Human
ugccacccuacucaccgcucuccucccugccccaggacuucaucggagcaggcaggguggagcg

SEQ ID NO: 343430 - RNA, 64 nt, Human
auacaguuaauaguagucuuugacagaucaucuuggacuucaggaaaugcaauuaugauaacgu

SEQ ID NO: 343431 - RNA, 64 nt, Human
guuuauaagaggaugaagugauauggugagcagcggacuucaaaaacugucaaagaaucaaucc

SEQ ID NO: 343432 - RNA, 64 nt, Human
ccccacacgagaaauuugugcgcugaacuucaaaggacuucauaaguauuuguuacucugauau

SEQ ID NO: 343433 - RNA, 64 nt, Human
cacuugccauguuccaguggggggcagauccucaggacuucacggguaugguugccagcugugu

SEQ ID NO: 343434 - RNA, 64 nt, Human
gcuacugggcugaagaguaaggugguugcuauagggacuucagcacacauggacuuguagggcc

SEQ ID NO: 343435 - RNA, 64 nt, Human
caggcugugccgugucucacccacaccccccuggggacuucaguuccauuucagguuaccuggg

SEQ ID NO: 343436 - RNA, 64 nt, Human
auuuacauuccguacuuuguaaacuugagcuauuggacuucacugauguauauauuaauaccuc

SEQ ID NO: 343437 - RNA, 64 nt, Human
auauugugauggacaagcuaguauucuugucuuuggacuucaacagaagacacacuuguacgaa

SEQ ID NO: 343438 - RNA, 64 nt, Human
caggucaccuuuuuuauguauugacuucauuguuggacuucauacucugaugggaaagaaaaug

SEQ ID NO: 343439 - RNA, 64 nt, Human
guauagcauuugugcugauugaugauagacucauggacuucaggagcccuuacuugguuuugau

SEQ ID NO: 343440 - RNA, 64 nt, Human
guaccugucugaagagugacauuaaacuuugaaaggacuucacugcuccuuuacgauauuccaa

SEQ ID NO: 343441 - RNA, 64 nt, Human
agguuuauaaacuaucuuuuaaaauuuuaagccaggacuucaaaaauuguagaguacuuguuug

SEQ ID NO: 343442 - RNA, 64 nt, Human
uggcauccagagggccauuguuucuacuuuugugggacuucagucaugcugauaauagaaucuu

SEQ ID NO: 343443 - RNA, 64 nt, Human
acuauagaauaccaacuugggagaugucgcuaaaggacuucagucaaguaauuuugguguuaau

SEQ ID NO: 343444 - RNA, 64 nt, Human
ccugaauuuggccugcacuaauuugauguuuacagguggacacacaaggugcaaaucaaugcgu

SEQ ID NO: 343445 - RNA, 64 nt, Human
agagaacccacgaacauuccuggacuugucuuuugguggacauggugcacuaauuucacuaccu

SEQ ID NO: 343446 - RNA, 61 nt, Human
ugcuauuuucucacuuuuccuuuugauggugcggaaagagaaaaaggaaaacggggcacag

SEQ ID NO: 343447 - RNA, 61 nt, Human
cacucugaaacugagaaauguucagaauguacggaaagaugaucagcuauuuucaacauaa

SEQ ID NO: 343448 - RNA, 64 nt, Human
gucgaagauucguagaggaacaauuuaguuuuaaggacuucaucccuccaccuaucccuaacag

SEQ ID NO: 343449 - RNA, 64 nt, Human
uuugguugauaaauugcuaucauucuaaagucauggacuucacuuucggcaacaaaacuaaaua

SEQ ID NO: 343450 - RNA, 64 nt, Human
gaaagccuuuauuguaagacucugauuucccuuuggacuucauguauauuguacaguuacagua

SEQ ID NO: 343451 - RNA, 64 nt, Human
aagauuauacacuguuaaguagcagagccagaauggacuucagaaucccaacuacaauacaaau

SEQ ID NO: 343452 - RNA, 58 nt, Human
ugggaaaaguuggaagaugaacacuugaggacuucagcuucucaccuacuuaguacag

SEQ ID NO: 343453 - RNA, 64 nt, Human
aauuuacuuuagauauucauucaucaaauacaugggacuucacaaacaauuuuccauaacuuuu

SEQ ID NO: 343454 - RNA, 64 nt, Human
uuugguagaaacuagggaaaucugaauacaguguggacuucaguuaauauaaaugagaaaaugg

SEQ ID NO: 343455 - RNA, 56 nt, Human
agagcccuggauacagcuagagagcaggacuucacccuccaggagcugacugggug

SEQ ID NO: 343456 - RNA, 64 nt, Human
augacuuggagccggcagaguaggcuguggcuguggacuucagcacaaccaucaacauugcugu

SEQ ID NO: 343457 - RNA, 64 nt, Human
ccucuaaacuuucccuguucagagcaucagaugaggacuucauuggguuuuauagcggcugauu

SEQ ID NO: 343458 - RNA, 64 nt, Human
uaccugucucuaaguaaaggaaaaaacaaaauaaggacuucaauccaaaguuuggacaguagau

SEQ ID NO: 343459 - RNA, 64 nt, Human
cugucucuguucacaagagccaccaaaaguuaggggacuucaguccuagcccccagauggccgc

SEQ ID NO: 343460 - RNA, 64 nt, Human
uaccguaaaugaucauguuauuguguauugccguggacuucagcacccagacaagccaaaaaca

SEQ ID NO: 343461 - RNA, 64 nt, Human
gcagguggacaugagcuaacccugagcuuguccaggacuucauugccucacaggcccugagccu

SEQ ID NO: 343462 - RNA, 64 nt, Human
agaaauaauagugaaaacucaaacccuuauuuugggacuucaguucucgugguccauaggggca

SEQ ID NO: 343463 - RNA, 64 nt, Human
aggugggggcaguguggccccuuccccaacuggggguggacagcugucuccugggguggguugg

SEQ ID NO: 343464 - RNA, 64 nt, Human
gacggaggaaaccaggggcaauguuuacaagacugguggacaaguguaaauauggaauaagaac

SEQ ID NO: 343465 - RNA, 64 nt, Human
ucaauagcuuuauuuuuuuccuacuuggauucuagguggacauuacagaguugaauuccucacu

SEQ ID NO: 343466 - RNA, 64 nt, Human
ucacaauaaggaagaaauaacagauaaguccauugguggacagccuucuucucuuaaucacaag

SEQ ID NO: 343467 - RNA, 64 nt, Human
cucugaaaggugggaacaccacagaggccauggaggacuucacaggagggguggcagaguuuuu

SEQ ID NO: 343468 - RNA, 64 nt, Human
uggcucugcuuuucacccuggacaaagucgcuguggacuucaauuucuucaccucuaaaauggg

SEQ ID NO: 343469 - RNA, 64 nt, Human
ccaccgacaaaaggaaggggaaacucaaucagcaggacuucagaaagggccuuguguuuauagc

SEQ ID NO: 343470 - RNA, 64 nt, Human
acucacaugucuucccucaggcuaucgggcagggggacuucaccaggggguuuauggauaggcu

SEQ ID NO: 343471 - RNA, 64 nt, Human
cuaugcagccuucccucucuuucugggauguuugggacuucacucgaccugcacgggcucugcc

SEQ ID NO: 343472 - RNA, 64 nt, Human
ugggugggugaggcaggcggaucacuugaagccaggacuucaagaccagcuuggccaacauggu

SEQ ID NO: 343473 - RNA, 64 nt, Human
uaagcaauuucuaguuauuauucuagccaguaauggacuucagaaucuuuuauuacacaauaua

SEQ ID NO: 343474 - RNA, 64 nt, Human
gaaaugaccaaacugcccgugacuuuuucugaauggacuucauaaccggaagacuuaaccggug

SEQ ID NO: 343475 - RNA, 64 nt, Human
ccccaugccacuccacacugcugggacauggcagggacuucacaguggggguuuuuagcuggcu

SEQ ID NO: 343476 - RNA, 64 nt, Human
ccacuugaauuacaccacccuagugugaaaucggggacuucaaagugcuugauuccuuccuaaa

SEQ ID NO: 343477 - RNA, 64 nt, Human
acacagaguuggagcuggcacugaagaucuccagggacuucagagaccaauaaaagcccauagg

SEQ ID NO: 343478 - RNA, 64 nt, Human
uucuaagauuucauaaggcugaguuugcacgcuuggacuucaguucugcuagcauguaaagagu

SEQ ID NO: 343479 - RNA, 64 nt, Human
cggcuccucuguccugccuacccugguccuggcgggacuucacuauuugacuugguuuccuuuc

SEQ ID NO: 343480 - RNA, 64 nt, Human
agcgauccuccucccucagccuugugaauaccugggacuucaggcacgcgccacuacacccagc

SEQ ID NO: 343481 - RNA, 64 nt, Human
ggaucugaggcugugucucugccuugucuuuagaggacuucagcguccaagacuggggcccacc

SEQ ID NO: 343482 - RNA, 64 nt, Human
agaguuuguacagacauccugucuucccagagaagguggacacucuugggcucauuguaaagug

SEQ ID NO: 343483 - RNA, 64 nt, Human
aagggaaaccuucugacugguugugaucgaaacagguggacagagacaccugcacuuggaacug

SEQ ID NO: 343484 - RNA, 64 nt, Human
aaaccgguggaaucugaucuugaaaaucugaguagguggacaaauauccucacuuucuaucuau

SEQ ID NO: 343485 - RNA, 64 nt, Human
cuguggguugugcuaauuucuguccagaaaauaggguggacagaagcuugugggguacauggag

SEQ ID NO: 343486 - RNA, 64 nt, Human
uucacucaugaagcaccuugaucuuugguguccuggacuucauccugggugcugcagauacugc

SEQ ID NO: 343487 - RNA, 64 nt, Human
cugcuucccucaccccuugcccaauaaaggacaaggacuucagaggaguacuuucauuaguguu

SEQ ID NO: 343488 - RNA, 64 nt, Human
cuaagaucaaguguagaaauccaugaacacuaaaggacuucauugauuuuuucagagaguagaa

SEQ ID NO: 343489 - RNA, 64 nt, Human
uaaaguuugccuucacagcauuucagaugcuguuggacuucauguccccaaccuagcuugguga

SEQ ID NO: 343490 - RNA, 64 nt, Human
gccaaauuaguggcucccuucgagcgaaugcccaggacuucaacgcaugcacuuuguguugacc

SEQ ID NO: 343491 - RNA, 64 nt, Human
aguagucccugcguucuucauucaaccccuucugggacuucagcucagagagcaccaucccggg

SEQ ID NO: 343492 - RNA, 64 nt, Human
uuuugcaguuaaauggcgaugguggaggugauagggacuucaagaguaaaaugcaccuuguauu

SEQ ID NO: 343493 - RNA, 64 nt, Human
acuuaaccugcuuuugucacucggcuuuggcucgggacuucaaaaucagugaugggaguaagag

SEQ ID NO: 343494 - RNA, 64 nt, Human
guccucucaccuagauuguaagcucccugggccaggacuucagccugccuccgaggguccccug

SEQ ID NO: 343495 - RNA, 64 nt, Human
cucacucagaaugggcaggacagacccacugacuggacuucagagucuggaggguuccaucggu

SEQ ID NO: 343496 - RNA, 64 nt, Human
gccuuguuauugggcauuugaugagguuuggcauggacuucaaggauaaaugaaugaaaacuuu

SEQ ID NO: 343497 - RNA, 64 nt, Human
acugucuagauggaugaauuaugauaaaggcuuaggacuucaaaaggugauuaaauauuuaaug

SEQ ID NO: 343498 - RNA, 64 nt, Human
uguaauucgacgacuccucaaaggggacuuuagaggacuucauacaaagcugggcauuaagaaa

SEQ ID NO: 343499 - RNA, 64 nt, Human
accuggaaauauugguuccaggcuccuguucucuggacuucagauccugggggagccccucccc

SEQ ID NO: 343500 - RNA, 64 nt, Human
ccgccagcacucgggggugcagggcccugugguuggacuucaccucucagcacugaaaacccaa

SEQ ID NO: 343501 - RNA, 64 nt, Human
auggaaacuccaguuaagacaggaucuuaucagagguggacaacgugaagauuuccuuuuccau

SEQ ID NO: 343502 - RNA, 64 nt, Human
uguuuuuguuugucugccuuucaaagugagacaagguggacaccaagaccuuucauuuguacug

SEQ ID NO: 343503 - RNA, 64 nt, Human
guuucuaauaaacagggaucuccagaacacuggugguggacacagcuuuccugucagcacacaa

SEQ ID NO: 343504 - RNA, 64 nt, Human
gaaaagggcaggagccuagaggaggaaaaaggcugguggacagacccaggguggucuucaagcc

SEQ ID NO: 343505 - RNA, 64 nt, Human
auguccgucugcuggaucaacagaaucccgaugaggacuucagcugaguauaguucaacaguuu

SEQ ID NO: 343506 - RNA, 64 nt, Human
agggcugaggcagggaggccgugggccauggggaggacuucacucagcagcaaagagaagagca

SEQ ID NO: 343507 - RNA, 64 nt, Human
uguuuggggauauuucaguguugcugcugcagggggacuucaugaauuugcugauucucaguuu

SEQ ID NO: 343508 - RNA, 64 nt, Human
auauaggucaggaaagaauggagacggcauucuuggacuucacuggggcugcuggauuggaugg

SEQ ID NO: 343509 - RNA, 64 nt, Human
cacauggagugggauugaugucauucagcaggguggacuucauguuuccaaugagcccaucacc

SEQ ID NO: 343510 - RNA, 64 nt, Human
gcaucccagccucgucuaugcagcaagagaccagggacuucaccaaagucacccucgcgggcug

SEQ ID NO: 343511 - RNA, 64 nt, Human
aucaauucccagacugugacucugaugaggaugaggacuucaaauugcaggaccaagcccuaaa

SEQ ID NO: 343512 - RNA, 64 nt, Human
aauuucuguuuguaucaguagaauuaagguaguuggacuucaucuauagaugcacaguucccuu

SEQ ID NO: 343513 - RNA, 64 nt, Human
aaggcauggguuaucaggggauugaggucaccugggacuucagggaggcucagcuugcucccug

SEQ ID NO: 343514 - RNA, 64 nt, Human
gaaacaaucaguucaacuauuguuguacugacugggacuucauauucuaauggauguggcaaaa

SEQ ID NO: 343515 - RNA, 64 nt, Human
guuucgaugaagaccuggccacauggggccacugggacuucaacccagcccaucggugggaagg

SEQ ID NO: 343516 - RNA, 64 nt, Human
ccuuucaccacugugaacagugccgccaguacauggacuucaccucugccucccagguaccauc

SEQ ID NO: 343517 - RNA, 64 nt, Human
caaggaauguacaaacuuuaguuuuugauuauaaggacuucacugcaaguuuuaguuaagaggu

SEQ ID NO: 343518 - RNA, 64 nt, Human
guucaaauucaaaccauuuuuaaaaugugaagauggacuucaugcaaguuggcagugguucugg

SEQ ID NO: 343519 - RNA, 64 nt, Human
agcuuucgggggaggagagaccuuccucuccugcggacuucauugcaggugcaaguugccuaca

SEQ ID NO: 343520 - RNA, 64 nt, Human
cgagugucgggcagcgauguacauauggaggugggguggacagggugcugugccccuucagagg

SEQ ID NO: 343521 - RNA, 64 nt, Human
aucccggcgcaucaguucugacuugccuuaccuggguggacagcagugaaucuccaccugucuu

SEQ ID NO: 343522 - RNA, 64 nt, Human
uaauauauaauguggggugaaaugggaguagggggguggacaggggagaaacgaaaaccacaaa

SEQ ID NO: 343523 - RNA, 64 nt, Human
acuucaugcuuucaguuuuagccuauuaauuuuagguggacaaauuuaacaaguuuucuguuac

SEQ ID NO: 343524 - RNA, 64 nt, Human
agaaauacugcacugaguauaugcccucauuacuggacuucauuuugauacuugucuauccuuc

SEQ ID NO: 343525 - RNA, 64 nt, Human
gguuccacgucuuucuuuaggcagggaccaggcaggacuucagaaaaacccucaugagcacauu

SEQ ID NO: 343526 - RNA, 64 nt, Human
agauugagacuugaugacuauaaaauauuuguuaggacuucaaauuauuaaagagucuauuuau

SEQ ID NO: 343527 - RNA, 64 nt, Human
ccacaaaagucacagucugaggugcuggggguuaggacuucaauauauaaauuuugcgguuaca

SEQ ID NO: 343528 - RNA, 64 nt, Human
ugaaugccggggacagagaggggcagguugaccgggacuucaaagccgugaucgugaauaucga

SEQ ID NO: 343529 - RNA, 64 nt, Human
aauaaauaaauccuccagucuggaucguuugacgggacuucagguucuuucugaaaucgccgug

SEQ ID NO: 343530 - RNA, 64 nt, Human
uuguuuguuuguuuuuaaagaucuccucagggucggacuucauuuuguacugugggcugugcug

SEQ ID NO: 343531 - RNA, 64 nt, Human
uuuuugaacuugacaacagcucucccuuuacccuggacuucagcccaaguuccgucuuuggucu

SEQ ID NO: 343532 - RNA, 64 nt, Human
uaggcaauaccauucaggacauaggcaugggcaaggacuucaugucuaaaacaccaaaagcaau

SEQ ID NO: 343533 - RNA, 64 nt, Human
gagugugggaggugggauggguauugguuaaaggggacuucagcuuuuuauauaaacauccacu

SEQ ID NO: 343534 - RNA, 64 nt, Human
ccagcaccccuggguuaucuggggcuaagggaagggacuucauuuccaggggccacagccaagc

SEQ ID NO: 343535 - RNA, 64 nt, Human
guggacugcuuggcagugcuaggagguggacucaggacuucagaagcaacauuucuggccugac

SEQ ID NO: 343536 - RNA, 61 nt, Human
ucucucuucccccagacugagcccugcuggcggacuucaaggagaagcccccacaggggau

SEQ ID NO: 343537 - RNA, 64 nt, Human
cccaggugacacgcuucugagcaggggccccuggggacuucaacugcccagcaacauggaggau

SEQ ID NO: 343538 - RNA, 64 nt, Human
auauuuuuucaccccccagucuugucuuuuuuagggacuucaauaacaugaguggcagaucuug

SEQ ID NO: 343539 - RNA, 64 nt, Human
cgaguggccagcuucacucucugggggagugcaggguggacaucaccuuggaggcccugcacug

SEQ ID NO: 343540 - RNA, 64 nt, Human
aucagaagcucccagcugaccagacacugccugggguggacauucagcagagugcgaguggaga

SEQ ID NO: 343541 - RNA, 64 nt, Human
ccccaaugcacaagccagcccccaagacccuggggguggacaccacucagggaaaccuggggug

SEQ ID NO: 343542 - RNA, 64 nt, Human
caucagcucugccaagcugagccuggccaagcuagguggacagacccuugcagugauguccguu

SEQ ID NO: 343543 - RNA, 64 nt, Human
cgagggcagcucccggccuugccggcccaauaaaggacuucagaaguguucccugacccgugug

SEQ ID NO: 343544 - RNA, 64 nt, Human
gaggaggagguccccugggcacagggccucuuugggacuucagaggaaaucucccagucccacu

SEQ ID NO: 343545 - RNA, 64 nt, Human
acuugggagugauucacaccuggaacaacauacuggacuucacacuggagagaaaccuuacaag

SEQ ID NO: 343546 - RNA, 64 nt, Human
ggccaagggccucucuuauggcacaaagaugcauggacuucaugacagcucuuuugguggcuca

SEQ ID NO: 343547 - RNA, 52 nt, Human
accagcuucaaacuauguaaaaggacuucaccaaguuagggccuccuggguu

SEQ ID NO: 343548 - RNA, 64 nt, Human
ugggaggccgagguggguggaccaccugagguuaggacuucaagaccagccuggccaacauggu

SEQ ID NO: 343549 - RNA, 64 nt, Human
cagggcugcaggcgggcggagguuccaggagaugggacuucagggagaccuggcuugggcuaaa

SEQ ID NO: 343550 - RNA, 64 nt, Human
ggcccccauagccccauaacccagagagggagcuggacuucagggagccugagugaugcuuucc

SEQ ID NO: 343551 - RNA, 64 nt, Human
cguuugugugagcgugggucagaccgccaaaguaggacuucaucguuuaccuaccuauuaucaa

SEQ ID NO: 343552 - RNA, 64 nt, Human
uacguauuggugaagaacgugcacaaggcuggauggacuucaacuuggaguugaguugaggcaa

SEQ ID NO: 343553 - RNA, 64 nt, Human
uuaaagccauugucagcaaagcuuugaaaauaaaggacuucacaaaaacgguaauguaaaugug

SEQ ID NO: 343554 - RNA, 64 nt, Human
agccuggaugacuguuagcccugaggccuccacgggacuucauuuaagaauacgugcauggcug

SEQ ID NO: 343555 - RNA, 64 nt, Human
ccgaauacugaauggaaaucaacuguaaguauuaggacuucauaugcaacuugaauuuuuggug

SEQ ID NO: 343556 - RNA, 64 nt, Human
gagccccaaccccgugaaaagaucucauaccguaggacuucagguauuauuuacuuuuauuuuu

SEQ ID NO: 343557 - RNA, 64 nt, Human
ugaucacgauccagucugcagacguguuuuguuuggacuucacuuaaaaaaaugccuuaguugu

SEQ ID NO: 343558 - RNA, 64 nt, Human
uuuuaaauauccacuuagcccuguguaguugguagguggacaccacuuucauaagugaacuuga

SEQ ID NO: 343559 - RNA, 64 nt, Human
ucuucuagccacaguucuaagacccaaagugggggguggacacagaagucccuaggagggaagg

SEQ ID NO: 343560 - RNA, 64 nt, Human
uaaauggccauugucuuugucucaguaaaguguagguggacaaucuuccugugauauguaguga

SEQ ID NO: 343561 - RNA, 64 nt, Human
ucuacuaaaaauacaaaaauuagacgagcguggugguggacaccuguagucccagcuacuuggg

SEQ ID NO: 343562 - RNA, 64 nt, Human
aucuaaacauauaucgaaagauaucugcuaaacaggacuucagguaagugaggugaaaugguag

SEQ ID NO: 343563 - RNA, 64 nt, Human
cgacgcuguaccccgggcgcgucauccucucucuggacuucauccuguucugccuccggcucau

SEQ ID NO: 343564 - RNA, 64 nt, Human
auuucaggucaacucugaagaguauuugaaagcaggacuucagaacaguguuugauuuuuauuu

SEQ ID NO: 343565 - RNA, 64 nt, Human
aguuuagcugaaaugcucaugaguaagaauacccggacuucagauacguuaagcaagcaacagc

SEQ ID NO: 343566 - RNA, 64 nt, Human
ucugaccuugggggaucaggagcgaaguugggcgggacuucagagauccgccucccuugcccuu

SEQ ID NO: 343567 - RNA, 64 nt, Human
agucaggcuagggaccuggggggaggagacccauggacuucacccauacucagugagggggcuc

SEQ ID NO: 343568 - RNA, 64 nt, Human
aggaccuuuguaaugguguccaugcaccuuuagaggacuucagaggcccugccaagucuagcau

SEQ ID NO: 343569 - RNA, 64 nt, Human
ugcgucugugucuuugugccuguaucucgcugggggacuucacaggaagcaggauuugggcauu

SEQ ID NO: 343570 - RNA, 64 nt, Human
aacucugaagucacuaguccagcugggugcaggaggacuucaaguguguggacgaaagaaagac

SEQ ID NO: 343571 - RNA, 64 nt, Human
ccccucccuaaucccuggcccucccagcugucugggacuucaguggacccccagccccugcccc

SEQ ID NO: 343572 - RNA, 64 nt, Human
gcccacgucucagccacaguucuccacucgccucggacuucacccguucucugccgcccgccca

SEQ ID NO: 343573 - RNA, 64 nt, Human
agcagugcccacacaggacugggcccuccgcaggggacuucagagcagcaaggccccagcuggc

SEQ ID NO: 343574 - RNA, 64 nt, Human
accugccccucaacccuguagcugcagggggaggggacuucauucauggguugguggucgcacc

SEQ ID NO: 343575 - RNA, 64 nt, Human
auacccaagccccugaugccuaugagaagucccuggacuucaacccuccuguuguuuggccuua

SEQ ID NO: 343576 - RNA, 64 nt, Human
ucugggcagaagaccugcgagacccagaugacuuggacuucagcaaccuggcuuuugaugcccg

SEQ ID NO: 343577 - RNA, 64 nt, Human
uuuuuugccaugaguaggagccccuaguggggcugguggacagcuuuggaagagguguccugcu

SEQ ID NO: 343578 - RNA, 64 nt, Human
auguuaucagcaggccaugcauccugcugccaaggguggacacggcugcagacuucugggggaa

SEQ ID NO: 343579 - RNA, 64 nt, Human
ugugguuucauuagcgaauuuauuuuuugugcuggguggacauuuguauuuuguuagguugcug

SEQ ID NO: 343580 - RNA, 64 nt, Human
uucucaaguggcaguuucauuauuuagaaugcaagguggacaucuuuuggauaucuuuuucuau

SEQ ID NO: 343581 - RNA, 64 nt, Human
uuuaagauguaaagaaaggguuaccgcuugcuaaggacuucagacaccauguccgaaaccuguu

SEQ ID NO: 343582 - RNA, 64 nt, Human
aggccaagccuucucacccuuggccagcuggaagggacuucagcaaccaagaccaccuggcaac

SEQ ID NO: 343583 - RNA, 64 nt, Human
uccuugcaggagauggcgucuaccagaaggggauggacuucauuuuggagaagcucaaccaugg

SEQ ID NO: 343584 - RNA, 64 nt, Human
cuuucccucagguggagaugcggaaagcccugacggacuucauucaagaggaauuccagcaucu

SEQ ID NO: 343585 - RNA, 64 nt, Human
ccuaguuaaguuuccacuaaaucaucgccaaagaggacuucagagcccuggggaggcagcugag

SEQ ID NO: 343586 - RNA, 64 nt, Human
ccuaaaccccaugggagaagacuucaucaugacaggacuucagcuuaccaagcagcagccauag

SEQ ID NO: 343587 - RNA, 64 nt, Human
aaucaauaagcaauugauaauaguuuggaguaagggacuucauauaccugauuccucuagaagg

SEQ ID NO: 343588 - RNA, 64 nt, Human
ugcauugcaauuugcagggggaauugucaagugaggacuucaucacauaugacacgagagaaaa

SEQ ID NO: 343589 - RNA, 64 nt, Human
gccucuucuuuguggagccucucagugugggcagcccucgcaugcuggggucgggccagcucuc

SEQ ID NO: 343590 - RNA, 64 nt, Human
gaaaugaacucacugcauuucugugcucccuccucccucgcaccaaacuccuagcucuacaagu

SEQ ID NO: 343591 - RNA, 64 nt, Human
gucuggagucuccccccggggagaggacacuggccccucgcacuccagaaaagccaugccagcu

SEQ ID NO: 343592 - RNA, 64 nt, Human
guggagaaagcagugacacauucacacagcuguucccucgcauguuauuucaugaacaugaccu

SEQ ID NO: 343593 - RNA, 64 nt, Human
ugauuuugcuuuccaagcuugguuuguggcgucucccucgcagagcccuucucguuucuuuuuu

SEQ ID NO: 343594 - RNA, 64 nt, Human
gggaggcagcgugggcucugccaaugugggcugccccucgcacacagggcucacagggcaggcc

SEQ ID NO: 343595 - RNA, 64 nt, Human
uguugugcuaaccacuuauuugauucuguuuugugguggacauagaugauuacguuugagcuuu

SEQ ID NO: 343596 - RNA, 64 nt, Human
ugugugucugugugcggguaugggugggauuccugguggacaggggugucagaucugucugagg

SEQ ID NO: 343597 - RNA, 64 nt, Human
acaucuuuuucuacucgaguuacagacaaagcgugguggacaugcacagcuaacauggaaguac

SEQ ID NO: 343598 - RNA, 64 nt, Human
ugcuggggcuaugggaaucggggcgggugauggagguggacaagaguggggccacucugcgccu

SEQ ID NO: 343599 - RNA, 64 nt, Human
gaaugggaagggagaacauaucuauccucucagacccucgcagcagcagcaacucauacuuggc

SEQ ID NO: 343600 - RNA, 64 nt, Human
aaacgacccucuguggccgaugggccaugcgggccccucgcagccaacucagccaguguuggga

SEQ ID NO: 343601 - RNA, 64 nt, Human
ugugaauggugccacacagcgcccacagacugggcccucgcacccuugggugcucccggccgcc

SEQ ID NO: 343602 - RNA, 64 nt, Human
cauuauguuccuccguagcaagaaaaauuuuaugcccucgcauugcuacagccaaauagcuuau

SEQ ID NO: 343603 - RNA, 64 nt, Human
cucuccuccgcucaggcccccaaggccgcccuuucccucgcacacaggccccacccccacaguu

SEQ ID NO: 343604 - RNA, 64 nt, Human
cuugcuggauguuccccuguuccugagccuuaaccccucgcacagccauccccccccccguccu

SEQ ID NO: 343605 - RNA, 64 nt, Human
agcccauccguccucgcgugggaccgcaucuucucccucgcagcugcuucuugcuuuucuuucc

SEQ ID NO: 343606 - RNA, 64 nt, Human
agaaaucaucuccuugcccuuuaagguauuuuaacccucgcauuccucugcuuuuccaagaaug

SEQ ID NO: 343607 - RNA, 64 nt, Human
gucaggauggaaauaccuggacuuuucuuugcuucccucgcaaacuggggucuucucuaccgaa

SEQ ID NO: 343608 - RNA, 64 nt, Human
agcacugccgcuuccaccugggccacccaccggacccucgcacgccgugccaggccugccccag

SEQ ID NO: 343609 - RNA, 64 nt, Human
aguucggagagagcugcgaugugaacugccccuccccucgcaucccccaggccaccaacggcag

SEQ ID NO: 343610 - RNA, 64 nt, Human
accaucacugaguggcuugugauucugggauggacccucgcagcaggugcaagagacagagccc

SEQ ID NO: 343611 - RNA, 64 nt, Human
uacaaccugaagcgcaggaaagaaaggcccauuccccucgcacagccgagcuuuuacucccuga

SEQ ID NO: 343612 - RNA, 64 nt, Human
cagaagaagacggucaccauccccucaggcagcacccucgcauuccggguggcccagcugguua

SEQ ID NO: 343613 - RNA, 64 nt, Human
gucgguuuggucuguuuugccuucacccauaagccccucgcacucugguggcaggugccuuguc

SEQ ID NO: 343614 - RNA, 64 nt, Human
gggugagagccuagauuccuccugugucaagggucccucgcauucuuuuacuguaaacaaacaa

SEQ ID NO: 343615 - RNA, 64 nt, Human
guuuucuuuaagauauuuuauuuuuccauuuaaagguggacaaaagcuaccucccuaaaaguaa

SEQ ID NO: 343616 - RNA, 64 nt, Human
aggcguauguggcaaaauguuacagaaucuaacugguggacauggcuguucauuguacuguuuu

SEQ ID NO: 343617 - RNA, 64 nt, Human; identical to SEQ ID NO: 343616

SEQ ID NO: 343618 - RNA, 64 nt, Human
guugcuuugcucuugagaauaguuucucgugucccccucgcaggccucauucuuugaacaucga

SEQ ID NO: 343619 - RNA, 64 nt, Human
cucgugaaaggccugccccgucuuucugccgcagcccucgcagagggcgggugcacagcgccau

SEQ ID NO: 343620 - RNA, 64 nt, Human
cuggccucagacugcacccaggaggggaacacugcccucgcacggccccgaagggcccccacau

SEQ ID NO: 343621 - RNA, 64 nt, Human
gcccgggcucccggccgcccagggucgccgccgccccucgcaccgcuaggucugcgcaccaucu

SEQ ID NO: 343622 - RNA, 64 nt, Human
cagaaagcacacggucaauccacguggaccgucucccucgcaggaacuccgcauccuugucccu

SEQ ID NO: 343623 - RNA, 64 nt, Human
acagacagaaaaccugccauggggcugcuucccucccucgcagggcuggcggaggcuccgcauc

SEQ ID NO: 343624 - RNA, 64 nt, Human
ccagcgcugcuccucaaggguuggggguccuucucccucgcagccaccacaugucucagggcua

SEQ ID NO: 343625 - RNA, 64 nt, Human
ccaacucaccucccuucucuuagcccaagccugucccucgcacagccucgcacaaaccacauug

SEQ ID NO: 343626 - RNA, 64 nt, Human
cagcuuucucgcgcccucccccaugggggugagacccucgcagaccuaagcccugccccgggau

SEQ ID NO: 343627 - RNA, 64 nt, Human
uggagcagcaaagggccucaauuccuauaagagacccucgcagcccagaggcgcccagaggaag

SEQ ID NO: 343628 - RNA, 64 nt, Human
gggaacuguaauggccacugaagcacgugagagacccucgcaaaaugaugugaaaggaccaguu

SEQ ID NO: 343629 - RNA, 64 nt, Human
gugaggcuccaucggccgcccugggagcuggggccccucgcacuccugugaggcuuuugcaggu

SEQ ID NO: 343630 - RNA, 64 nt, Human
uuccauccaguuccuuacucuccucuuuccucuucccucgcaugucucccuccaguccucugua

SEQ ID NO: 343631 - RNA, 64 nt, Human
acugcccccuugaucuuugaaggaguccucaggccccucgcagcauaaggauguuuugcaacuu

SEQ ID NO: 343632 - RNA, 64 nt, Human
uuccagcccuugaagguaguggacccagaucauccccucgcagcacuuguucguaaggcacagg

SEQ ID NO: 343633 - RNA, 64 nt, Human
gagauagagaccugccucccccuugcacccgaggcccucgcagcagggagcucagcgaggcaga

SEQ ID NO: 343634 - RNA, 64 nt, Human
ugguauugcugggcuccuggcuagaugcaagcaagguggacaagagcucaggacuccagcccac

SEQ ID NO: 343635 - RNA, 64 nt, Human
ugguccgagucucagcccugaccuucugggacaugguggacagucaccuauccacccucugcau

SEQ ID NO: 343636 - RNA, 64 nt, Human
aaauuauggcaugacugaaccugcaucuguguuggguggacaugaauacuuagcuaccucagca

SEQ ID NO: 343637 - RNA, 64 nt, Human
accuuuuggcccuuucuuucuuuucuaggcuucucccucgcaggguguuccguaguuucuucuc

SEQ ID NO: 343638 - RNA, 64 nt, Human
uggccuuagccaagcaguuuguuaguuacauauucccucgcaaaccuggagugcagaccacagg

SEQ ID NO: 343639 - RNA, 64 nt, Human
uccuuuucucuccugugugcuugucaguggggaccccucgcaacccugccugucaccugggagg

SEQ ID NO: 343640 - RNA, 64 nt, Human
uaccucaaaaguuuguuuuauuaauuguacucaacccucgcagaacaguaaaacugaagauuau

SEQ ID NO: 343641 - RNA, 64 nt, Human
uauugaagcucgugacaagugccuucacacagaccccucgcaacuguccacgcgugccguggca

SEQ ID NO: 343642 - RNA, 64 nt, Human
guguggaugugaguugugugaauaaucuuucugucccucgcacagaagccaguaauuagcaucu

SEQ ID NO: 343643 - RNA, 64 nt, Human
gcccuugugucccucccagaguccuucagguaggcccucgcagaugcugcuugcucagaaacaa

SEQ ID NO: 343644 - RNA, 64 nt, Human
gacacacugggaaccgucagagucagcuccuucccccucgcaaugcacugaaaggcccggccga

SEQ ID NO: 343645 - RNA, 64 nt, Human
gggacuugcucuaguucucugagccgcggacaugcccucgcauugcuucccgcagagugcagag

SEQ ID NO: 343646 - RNA, 64 nt, Human
ugccgccagaaccgggcucugcccccauacgcugcccucgcagccuggcggccuccgcuguggc

SEQ ID NO: 343647 - RNA, 64 nt, Human
cccgcccggccccugcccccuccaacccuucuggcccucgcaccacugugacucugccaucuuc

SEQ ID NO: 343648 - RNA, 64 nt, Human
aaaaaaaaagaagaaacaagacaugccaccuuuccccucgcacuguugcuuuuccugaugguua

SEQ ID NO: 343649 - RNA, 64 nt, Human
cuccauggucacgaagcagcguugugcugugugucccucgcaagaagcacaggaaagagaaguu

SEQ ID NO: 343650 - RNA, 64 nt, Human
uugucugcugccaaugucgucucgcaugccugcacccucgcaugcacgcugcccgcaugccacg

SEQ ID NO: 343651 - RNA, 64 nt, Human
uccugugccaggacucucuuucuuccacuacccucccucgcauccgccucugagccaggagccu

SEQ ID NO: 343652 - RNA, 64 nt, Human
gcgaugcugacacugccaaccuccaguauccucacccucgcagacgauaucucucucggccucu

SEQ ID NO: 343653 - RNA, 64 nt, Human
aagggcucucuuaggcauguaggacccugcaggggguggacaaacuggagucuggagugggcag

SEQ ID NO: 343654 - RNA, 64 nt, Human
caaggccugugcugcaugcgacagcguccggggugguggacagggcccccggccacgcucccuc

SEQ ID NO: 343655 - RNA, 64 nt, Human
aaccaguuuuuucaccuccaugucauccgagcaagguggacaucuucacgaacagcguuuuuaa

SEQ ID NO: 343656 - RNA, 64 nt, Human
uccugccgucugccaccccgccacguguauuuaacccucgcacuuucuccacuguggagauggc

SEQ ID NO: 343657 - RNA, 64 nt, Human
gguggcuuaggaucuucggaucggccacccucgccccucgcaccccagcccagggcggcgggga

SEQ ID NO: 343658 - RNA, 64 nt, Human
cagcaacuccccgcccagggaccccucccggccucccucgcacacugggaggaggaagccgccg

SEQ ID NO: 343659 - RNA, 64 nt, Human
ggggggccauagcuggcacugcccaccguaaaggcccucgcacauuuucccccuuccuguacac

SEQ ID NO: 343660 - RNA, 64 nt, Human
gucaaggcagggagaggccggcuggagccaggcccccucgcacgcagcccccaaaucauggacg

SEQ ID NO: 343661 - RNA, 64 nt, Human
cugcccauccccccaccacccuccauccugggggcccucgcacaaaucuggggugggaggggcu

SEQ ID NO: 343662 - RNA, 64 nt, Human
gagcccucuuuccaccuuccccuauccaugcacccccucgcaauaaaaccaacucuaaaaucac

SEQ ID NO: 343663 - RNA, 64 nt, Human
uccaacagaagccacaggccggagccccugggagcccucgcaccgcuccccaccccacucagcg

SEQ ID NO: 343664 - RNA, 64 nt, Human
caauaaacgcucuguggccaguguaaaagaaaaucccucgcaguuguggacauuucuguuccug

SEQ ID NO: 343665 - RNA, 64 nt, Human
cugccguguaacacccuuccucugaucgcaccgccccucgcagagaguguaucaucuguuuuau

SEQ ID NO: 343666 - RNA, 64 nt, Human
cucccagguucaagugauucuccugccucagccucccucgcaaguagcugggauuacaggcgcc

SEQ ID NO: 343667 - RNA, 64 nt, Human
aguagacaaagagagcgacaguuacagcgucagccccucgcaagacacagguaggcccugacgc

SEQ ID NO: 343668 - RNA, 64 nt, Human
uacugccagccgggagcugggcggacaggaccgucccucgcagggucccaggcccagaagaggc

SEQ ID NO: 343669 - RNA, 64 nt, Human
gcucgccgcggacacaccguccgucuccgggacgcccucgcaccccuggacaccagaccggacu

SEQ ID NO: 343670 - RNA, 64 nt, Human
cgaguggaccaaucggaagccuaagugacgaugacccucgcauguccuaggucccuggguggac

SEQ ID NO: 343671 - RNA, 64 nt, Human
cacacacacacacacacugcauaucugagcgcgccccucgcacugggucucaccuugcaccuuc

SEQ ID NO: 343672 - RNA, 64 nt, Human
cugagcaccccagacaccuuccucaacccaggcggguggacagggucccccugugguccagcca

SEQ ID NO: 343673 - RNA, 64 nt, Human
aggccauucauacuuaaguugaucacuugcccaugguggacauuuuugugguggugauguccau

SEQ ID NO: 343674 - RNA, 64 nt, Human
cuaguuccaaauaaagucacauucucagguuccagguggacaugaauuccagggggaaaugauu

SEQ ID NO: 343675 - RNA, 64 nt, Human
ggugagaaauuugccuuguucaauaauuacuguacccucgcaugacuguuacagcuuucugugc

SEQ ID NO: 343676 - RNA, 64 nt, Human
cuagcccuccccuccccgggauguagaacggggacccucgcaggguuggggcgggggcugauac

SEQ ID NO: 343677 - RNA, 64 nt, Human
ccccacccgcugcucaguggcucugaccacacuccccucgcagcgucagugguacgacccuucc

SEQ ID NO: 343678 - RNA, 64 nt, Human
uccuccguggcugccuccaugggacaaggaccgauuccaacacaggcuccucuuucccccuucc

SEQ ID NO: 343679 - RNA, 64 nt, Human
ugaucucacucauugcacuuccuggaguuaaauuuuccaacagccauguugaggaauagcacuc

SEQ ID NO: 343680 - RNA, 64 nt, Human
gcaccaaagaagugauaauuuccacaugauuaauuuccaacaagacacuugggaguuauuuacu

SEQ ID NO: 343681 - RNA, 64 nt, Human
uuacuguuaauuuuuuauuuaacaccuaaagcauuuccaacaucacuuugcugcccagguaugu

SEQ ID NO: 343682 - RNA, 64 nt, Human
aucaggaugugguuuccagcuuugccugagggaauuccaacaugagauuaugggcuggcuccau

SEQ ID NO: 343683 - RNA, 64 nt, Human
cuccagaggagauuuuuuuugcucuucucaucuuuuccaacaguguucuccuguuuguggagcu

SEQ ID NO: 343684 - RNA, 64 nt, Human
ccagcucugcaggcccuccuggccuuuucugcaggguggacacagggucugugugugggcagca

SEQ ID NO: 343685 - RNA, 64 nt, Human
uccaggccaguggccaggccuugugccguggcuggguggacaccauuuacaaugcccaggugag

SEQ ID NO: 343686 - RNA, 64 nt, Human
caugguggaaggugaaaggcacgucuuacauggcgguggacaagagagaaugagaacuaaguga

SEQ ID NO: 343687 - RNA, 64 nt, Human
ucaggaauagguuagggaauggucacuucugauuuuccaacaguugcuccuucucugaagagau

SEQ ID NO: 343688 - RNA, 64 nt, Human
ucuugucaucuucuggggauguuugaaggcugaguuccaacagaauucacaaagggaauaaaac

SEQ ID NO: 343689 - RNA, 64 nt, Human
auguuuaagaggaauaccuaaagguuuuucuaaauuccaacauuuaaaaggcaauugugggcua

SEQ ID NO: 343690 - RNA, 64 nt, Human
ucccaguucccauuguggucccuucagagcuccuuuccaacagcaucucucugucgaagaaaga

SEQ ID NO: 343691 - RNA, 64 nt, Human
cauccaucuuuccauccauuaccuccauccauccuuccaacauauauuuauugaguaccuacug

SEQ ID NO: 343692 - RNA, 64 nt, Human
gccaagcagugcuuccaagggauagcgauccagauuccaacauugucuuggagaggguuagucc

SEQ ID NO: 343693 - RNA, 64 nt, Human
ggggcacaugaggcauccugaagcauuagaaugauuccaacacugcucuucugcaccaugagac

SEQ ID NO: 343694 - RNA, 64 nt, Human
uuaggcugaauccuaaaauaaauuagucaaaaaauuccaacaaguagccaggacugcagagaca

SEQ ID NO: 343695 - RNA, 64 nt, Human
uuugcugcugugcagcacugcauugucaugacauuuccaacacugugugaauuaucuaaaugcg

SEQ ID NO: 343696 - RNA, 64 nt, Human
caagcaguuaccaucaaaggcagcauauuuccaauuccaacauuacuguuucuaccaaguccca

SEQ ID NO: 343697 - RNA, 64 nt, Human
ugaucuauggauuuaauaccauuuucaauggaaauuccaacagauuuuauugaaugaaacaagc

SEQ ID NO: 343698 - RNA, 64 nt, Human
cuuugucauacugcacauauaaaacgucuuuuguuuccaacaagaggauuuucuuuuucauucu

SEQ ID NO: 343699 - RNA, 64 nt, Human
cccacucccuuuguauuuccucuuuccaaguugauuccaacacgcuagagcaggguuguccaau

SEQ ID NO: 343700 - RNA, 64 nt, Human
cucuuccacccauucccccauguggcugaagacauuccaacaauggggugggcccauaauaguu

SEQ ID NO: 343701 - RNA, 64 nt, Human
caacgaacuucucuucuccacccagagauggcuuuuccaacacauuuuaauuaaaggaacugag

SEQ ID NO: 343702 - RNA, 64 nt, Human
ucuagccacagccuaaccaaggauuaucaaaggagguggacacucaaggaagggccacgccagg

SEQ ID NO: 343703 - RNA, 64 nt, Human
gcaugcugggcagcaccggugcccaaaucuggcugguggacagaagcaccuggagaguuggaga

SEQ ID NO: 343704 - RNA, 64 nt, Human
uuuuacuagugcagcgaugucaccaggguguugugguggacagggaagccccugcugucauggc

SEQ ID NO: 343705 - RNA, 64 nt, Human
aggaaauagacuuagacgaaagaaaggauuucucuuccaacaguugagauucgcauauuugccu

SEQ ID NO: 343706 - RNA, 64 nt, Human
uuguucuguaucccccuuugcccuugccuugcccuuccaacaaacccuaggcccuugagaagcu

SEQ ID NO: 343707 - RNA, 64 nt, Human
gaacauucuaagcauucuagugaaaguucccauguuccaacagaacuuaaaagcaauguuugcc

SEQ ID NO: 343708 - RNA, 64 nt, Human
uuguuuuugagaaguucuuuuccuuuauauaggcuuccaacaccaaauaaccuaacugcuggaa

SEQ ID NO: 343709 - RNA, 64 nt, Human
ucuacaagguccacuauuucugaguuuaauguguuuccaacacuuaaggagacucuaaugaaag

SEQ ID NO: 343710 - RNA, 64 nt, Human
uuguggccucuucuaguacaaggcgaguggauaauuccaacacaagacuggcaguccaaauuga

SEQ ID NO: 343711 - RNA, 64 nt, Human
aucugagcauuggugugcauuaagguacucaaucuuccaacaauaaauaccauaagugcauguc

SEQ ID NO: 343712 - RNA, 64 nt, Human
accuuucacaacagucacucuguguccuaaaauuuuccaacauagaugugauuuauauaacuuu

SEQ ID NO: 343713 - RNA, 64 nt, Human
uuuucuuuuucuguauauacucaugucccccagauuccaacauuucucacugaaagggggcaug

SEQ ID NO: 343714 - RNA, 64 nt, Human
aguuacaauaaaaugcucucaaguccuuugaauguuccaacaaauucaaaacuucauuuucuga

SEQ ID NO: 343715 - RNA, 64 nt, Human
guucuaccuggacacaaaggcgaggacccugggguuccaacaaagcucagcucccagauucucu

SEQ ID NO: 343716 - RNA, 64 nt, Human
agucaacuuagaaacuccaaggagguuacauguuuuccaacauauccuaaaaacugugauauaa

SEQ ID NO: 343717 - RNA, 64 nt, Human
uuuuggagguuuauuacguaugucugguucucaauuccaacaguuuaaugaagaucuaaauaaa

SEQ ID NO: 343718 - RNA, 64 nt, Human
ugcuugaaggaacagugcuguucuggagcugcuguuccaacagacagggccuagcuuucauuug

SEQ ID NO: 343719 - RNA, 64 nt, Human
ggaacccuggaacccuaggaacaaggagccuuuguuccaacagagcagagaaggagguucucua

SEQ ID NO: 343720 - RNA, 64 nt, Human
ggaaaucacuaccagucagguggggcuggggcuggguggacaggaucaggauucccuugaaagc

SEQ ID NO: 343721 - RNA, 64 nt, Human
cuucucugcagaccagcugaggggaggacuccuggguggacagccuuugacguccaccccacgc

SEQ ID NO: 343722 - RNA, 64 nt, Human
uaauuuauuuuaacauuuuuacaauaaaacaugagguggacaggccagcuuggugugugcugug

SEQ ID NO: 343723 - RNA, 63 nt, Human
uuauuuauaugguuguggcucaaauaaaguuuaauuccaacacaguacagauuauuuggaucc

SEQ ID NO: 343724 - RNA, 64 nt, Human
agucaaugauucuguucgacuaaauagcuguccuuuccaacacauugcuacuuuuuuaaauacu

SEQ ID NO: 343725 - RNA, 64 nt, Human
cccuuuauuuauaauacauuuccuacgggcuguguuccaacaaccauuuuuuuucagcagacua

SEQ ID NO: 343726 - RNA, 64 nt, Human
cauucauuugugcuuuugcauuaaacugugaauguuccaacaccugccuccacuucuccccuca

SEQ ID NO: 343727 - RNA, 64 nt, Human
gagcuggaugccggguuccagaaucgcugcacaguuccaacaggacagcgccuucccccaugcg

SEQ ID NO: 343728 - RNA, 64 nt, Human
gcuuucuuuggccucugacccugcugcccauucuuuccaacaucacagaugaacugccucuccu

SEQ ID NO: 343729 - RNA, 64 nt, Human
ucuuaacagcaaaaugcaauggaaggaagaaaaguuccaacaaagaaugauuuugugaauucug

SEQ ID NO: 343730 - RNA, 64 nt, Human
acucaagggugguuuccuggcugcacggcaccuguuccaacaccuacugugccucucaucaggu

SEQ ID NO: 343731 - RNA, 64 nt, Human
aggaaaugacugccuuccuugggaccaaggaccguuccaacagcauucacugccaguucuaaua

SEQ ID NO: 343732 - RNA, 64 nt, Human
agcaacauguguaucugccgauuguucuccaugguuccaacaaauugcaaauaaaacuguaugg

SEQ ID NO: 343733 - RNA, 64 nt, Human
gccugagcuugauucuuaggucuugagacucaguuuccaacaccuucauuauuaauguuaagaa

SEQ ID NO: 343734 - RNA, 64 nt, Human
cauaauauaacaacuucauauaauaaaaugcugauuccaacaggacugaguuuugccagcauug

SEQ ID NO: 343735 - RNA, 64 nt, Human
cuguccuaauauuuagauguccaaacaagaauacuuccaacauaaaaauuauaauaggaauaau

SEQ ID NO: 343736 - RNA, 64 nt, Human
uaaauggaaguauuuuucucugugaagccacauuuuccaacaugagccucaugaagccaacuaa

SEQ ID NO: 343737 - RNA, 64 nt, Human
uaaauguauaaaauauaaggauuacuuuuguauguuccaacaguauuauacuuguuuuggcauc

SEQ ID NO: 343738 - RNA, 64 nt, Human
uuaaccuaccaucaagagccuguauuuugaguuauuccaacagagaugauggauuccuguagaa

SEQ ID NO: 343739 - RNA, 64 nt, Human
aauauguaccacaguguaugugucuuuugcaagcuuccaacagggauguauccuguaucauuca

SEQ ID NO: 343740 - RNA, 64 nt, Human
ccauugagaucaagccuuuacucccuuugagaguuuccaacaucaguugauugagcuucaggcu

SEQ ID NO: 343741 - RNA, 64 nt, Human
uauuaagcgaucaaggccccugccccacuuuuaguuccaacagaaugccguucacaagaucugg

SEQ ID NO: 343742 - RNA, 64 nt, Human
gggagauuggacuagaggaguccugagaggacacuuccaacaagagacauuuauucucugauuu

SEQ ID NO: 343743 - RNA, 64 nt, Human
aggggaauccaagacagaaaaugaagacacuggcuuccaacagcagcgcuccauguuuaagaua

SEQ ID NO: 343744 - RNA, 64 nt, Human
gaccuguggcuacugguagagaauuggaauaagcuuccaacaauggacuguagagauuaaugga

SEQ ID NO: 343745 - RNA, 64 nt, Human
ugauucuuauggaaguucuaacaauauauggugguuccaacaccugcagugaguuuaaugacug

SEQ ID NO: 343746 - RNA, 64 nt, Human
uaauguggaccccagccgagcgcggcaagcgcuguuccaacaggagauggcccgccuugcccga

SEQ ID NO: 343747 - RNA, 64 nt, Human
uuucauaauaaaaaaguuuuaaaaguccuccaguuuccaacacacucaagagagagccccaacc

SEQ ID NO: 343748 - RNA, 64 nt, Human
gguuguagacaaauguuuccaugaccucucagcuuuccaacaggaaucuuguaagagcuaauaa

SEQ ID NO: 343749 - RNA, 64 nt, Human
ugcagugcaaauaugugaaaugucuuuugguuuauuccaacaauuauuuauuuuagaaaguaag

SEQ ID NO: 343750 - RNA, 64 nt, Human
aucuguuuuucacuuauccugauuuaaugacaguuuccaacauuguuuuguuauuacaaguagg

SEQ ID NO: 343751 - RNA, 64 nt, Human
gggcauaaaauaagaaauguccaugcagccauuuuuccaacagaugcuguacaccguucauuuu

SEQ ID NO: 343752 - RNA, 64 nt, Human
gucuucuagucugggccgcucuaaacauuuauaauuccaacauuguggauuucaucuuauaucu

SEQ ID NO: 343753 - RNA, 64 nt, Human
caggcaccagcaaaacaacggaugaauguagcccuuccaacaccugacagaaugagaccaaacg

SEQ ID NO: 343754 - RNA, 64 nt, Human
gaggagcuacuagaaaagcugaguggagucuccuuuccaacaggaugaugcauuugcucaauuc

SEQ ID NO: 343755 - RNA, 64 nt, Human
gagauauauucaguauuguagauacuacacuaauuuccaacauaagaggcaggaagaguuuuga

SEQ ID NO: 343756 - RNA, 64 nt, Human
uuaugcacuauuuuuauaucucugugagagauuuuuccaacagucagcuauuuuauggcacacu

SEQ ID NO: 343757 - RNA, 64 nt, Human
ucccucacuauauaucuuuaugcagucagaauauuuccaacaguguuuuuugcaaauuagagca

SEQ ID NO: 343758 - RNA, 64 nt, Human
uuaggccucaaugaaauacauuuccccuauauaauuccaacagcaguuucucuaguucuaaauu

SEQ ID NO: 343759 - RNA, 64 nt, Human
gucuagccagcuagccuuaacaucuaagaaauuuuuccaacaagcaaaaaccuuuagaaaugaa

SEQ ID NO: 343760 - RNA, 64 nt, Human
uuguaacuacugcuucuacuacccaaaauaugaauuccaacacugcuuccaagagacauuuaca

SEQ ID NO: 343761 - RNA, 64 nt, Human
gcagggacacucagagcccauaguggauagucucuuccaacagucugcuccucagccugagaug

SEQ ID NO: 343762 - RNA, 64 nt, Human
uuuauuuagaacuuuguguguucuuaaagugugcuuccaacaggaaggucagugauaaauuuuc

SEQ ID NO: 343763 - RNA, 64 nt, Human
auauuccuccuguugauauugcugcuuuuggaaguuccaacaaugacuuuauuuugcaucagca

SEQ ID NO: 343764 - RNA, 64 nt, Human
gacaaagcccaacaaugaucucaggaauuacauuuuccaacagaccaaaaaauguuuucaugua

SEQ ID NO: 343765 - RNA, 64 nt, Human
uaugcagucuuucccagggaacuccgaugaaguguuccaacaaaaugagcgagugaaccaagaa

SEQ ID NO: 343766 - RNA, 50 nt, Human
cugaaauggacauugauugauuccaacacuuguuucuauuaaaacagacu

SEQ ID NO: 343767 - RNA, 64 nt, Human
gcuucuuccgugguuuccuuuuggaaacuccuccuuccaacaagcagugggaucccggggccca

SEQ ID NO: 343768 - RNA, 64 nt, Human
cacaugaggacaugauggagcgcaccugcccccugguggacaguccugggagaaccucaggcuu

SEQ ID NO: 343769 - RNA, 64 nt, Human
cacagccagaauugcauccucugggaucuucugagguggacagcacuuugaauguagcauuuca

SEQ ID NO: 343770 - RNA, 64 nt, Human
gagcucugguuugaaaguagccaaggggacugaugguggacacuccagaugugguuggaagcau

SEQ ID NO: 343771 - RNA, 64 nt, Human
uuggaagagaauguuuauacaaaaaaugaaauucuuccaacagcagagaaacucuaaaaaguuu

SEQ ID NO: 343772 - RNA, 64 nt, Human
ccagggcucucugcuguagauuggcugugccagcuuccaacagguuacuggcaaugccagugag

SEQ ID NO: 343773 - RNA, 64 nt, Human
gaauugguucauuuugcuuuacacaguagaucuguuccaacaguucuguguaaaccaaaugcua

SEQ ID NO: 343774 - RNA, 64 nt, Human
cucuuaauguuuccaaaugggaaggacaguugauuuccaacaugagguuuuuuguuuuuuaucc

SEQ ID NO: 343775 - RNA, 64 nt, Human
uucauggaucuucaugcagccauacaaacccugguuccaacagaauggugaauuuucgacagcc

SEQ ID NO: 343776 - RNA, 64 nt, Human
uauuuguuaugcacuacuuuuguauaucuuguuuuuccaacagugaacauuuuuaggcacacuu

SEQ ID NO: 343777 - RNA, 64 nt, Human; identical to SEQ ID NO: 343765

SEQ ID NO: 343778 - RNA, 64 nt, Human
ccaaucauuuaguauuuuaggaccugugaauaacuuccaacaaaauuaaugaauaccauauuag

SEQ ID NO: 343779 - RNA, 64 nt, Human
cuuaauuagagccuccuuccuuucugugagauuuuuccaacaagcaugugauuuacguggaauu

SEQ ID NO: 343780 - RNA, 64 nt, Human
uaaaaugccugggaguggcuauagggguagcucuuuccaacagcccaaguggggucaacuccua

SEQ ID NO: 343781 - RNA, 64 nt, Human
uauccucugccucccauucugaccacccuucucauuccaacagugagucugucagcgcagguuu

SEQ ID NO: 343782 - RNA, 64 nt, Human
caagacaauuuuucuguuucaguuucaucuggcauuccaacaugucagugauacuggguagagu

SEQ ID NO: 343783 - RNA, 64 nt, Human
agaaauagaggugcaguuagaggacggucacuuuuuccaacaaaacccacuccauagccaugug

SEQ ID NO: 343784 - RNA, 64 nt, Human
agacucugaggugucaggagagcccucugcugcuuuccaacacacaauuaacuccguuuccaaa

SEQ ID NO: 343785 - RNA, 64 nt, Human
aggcucacagauugugugucggcugcagcagugauuccaacaagcagcuauugggggggaaaca

SEQ ID NO: 343786 - RNA, 64 nt, Human
guacagcacugaaaggaaugaagcaccagcaggagguggacagagucucucauggaugccggca

SEQ ID NO: 343787 - RNA, 64 nt, Human
ggucaccuucuucccuaccacacaugggugggaagguggacaggcuaaccucuccagcugugag

SEQ ID NO: 343788 - RNA, 64 nt, Human
cucuaaaaguguccacaagaagggguguuuauucuuccaacacauuucacuuuucuguaaauau

SEQ ID NO: 343789 - RNA, 64 nt, Human
cuauuaaaaugauagauuguggagaaaguaauuauuccaacacccaucugccaugcgauguuaa

SEQ ID NO: 343790 - RNA, 64 nt, Human
gugaaugaagacacccaucacuugucauguugguuuccaacaguccuuucgauuauccuuuauu

SEQ ID NO: 343791 - RNA, 64 nt, Human
uuaucagggccuacaguaacaugccaaaaguugcuuccaacauauuucucugcuuuggaugggg

SEQ ID NO: 343792 - RNA, 64 nt, Human
auuucaggggucgucaccaccucuccuuuggccauuccaacagcucaagucuucccugaucaag

SEQ ID NO: 343793 - RNA, 64 nt, Human
ccaaguuguuucauugauuuaguaaguguucugcuuccaacaucuuucuuuuuaagaaauuccu

SEQ ID NO: 343794 - RNA, 64 nt, Human
cagaucccaucucaaaucauucuguuaaccaccauuccaacaggucgaggagagcuuaaacacc

SEQ ID NO: 343795 - RNA, 64 nt, Human
ggcauauuugugguugacauacucuagauagcuuuuccaacaaaucuuugaaaagcaaucuugg

SEQ ID NO: 343796 - RNA, 64 nt, Human
gaauugaaaguuggauaacugcuuuuuuuaaauuuuccaacagaaguaacaccacaguugcuuu

SEQ ID NO: 343797 - RNA, 64 nt, Human
uggaggacuuuuuuauucuuauggaaauagugaauuccaacaacuaugaugaacuauguucuuu

SEQ ID NO: 343798 - RNA, 64 nt, Human
gucuauauuuuuugccuauacauuuuucccacguuuccaacagcacuucucaccuauucaauaa

SEQ ID NO: 343799 - RNA, 64 nt, Human
agucuggcuagaccagggcuauggagaucaauuuuuccaacaggucauuaggauuugggaggcu

SEQ ID NO: 343800 - RNA, 64 nt, Human
ccauuaccucaaagcagucauuccuuaguaaaguuuccaacaaauagaaauuaaugacacuuug

SEQ ID NO: 343801 - RNA, 64 nt, Human
gaccuaggcccugugcaauggcucacaccuguaauuccaacacuuugggaggcagaggcgggag

SEQ ID NO: 343802 - RNA, 64 nt, Human
aguuuucgccuucccuuacaccaccaacuuuacuuuccaacauuuguugacauguguuuuagug

SEQ ID NO: 343803 - RNA, 64 nt, Human
ugcaaaaaagcccugcuucuucccuugucuagaggguggacauuggcuacaggcucuuccaucu

SEQ ID NO: 343804 - RNA, 64 nt, Human
uuaacuauuuccccuuccuuucauuccacucauggguggacagggaccacaaagacucaugggg

SEQ ID NO: 343805 - RNA, 64 nt, Human
uuaacccuuuccauuuccucucauuccauucauggguggacagcgaccacaaagacucaugggg

SEQ ID NO: 343806 - RNA, 64 nt, Human
aguaauaauguagaaaaacauuauuuuaaaaaaguuccaacacacagccaugaggagccucagu

SEQ ID NO: 343807 - RNA, 64 nt, Human
aaaacuggaaacuuauuucucauuuagaaacagguuccaacauuccucuucuuuugucucugau

SEQ ID NO: 343808 - RNA, 64 nt, Human
aaugcugcuagaagacaagugauguccuggguccuuccaacagugaagagaagauuuaagaagc

SEQ ID NO: 343809 - RNA, 64 nt, Human
uuacaaaauacgcugugucauaaauauguuugaauuccaacagccaaagccauugagagucaua

SEQ ID NO: 343810 - RNA, 64 nt, Human
uuaaauacugaauucauaguuguuguuuuuuaaauuccaacaguaacagcugaaugguuuaauc

SEQ ID NO: 343811 - RNA, 64 nt, Human
gagauucuaacauccuuguuuuagaauucuaaguuuccaacauuccucauucuaggauccuagg

SEQ ID NO: 343812 - RNA, 64 nt, Human
cauugucgcuauugauuuuuacuucaaugggcucuuccaacaaggaagaagcuugcugguagca

SEQ ID NO: 343813 - RNA, 64 nt, Human
uuguaauauguuuuaaaaucagaaacuauaaugcuuccaacauuguuccuuuuuuugaagauug

SEQ ID NO: 343814 - RNA, 64 nt, Human
cugaccugcauguugaguucuguauugcuggggcuuccaacaaaaaccagagucacugacagag

SEQ ID NO: 343815 - RNA, 64 nt, Human
uuuguguagauguauuugguacuuuuuccccuaauuccaacacuaguuuauauauauagcgaau

SEQ ID NO: 343816 - RNA, 64 nt, Human
aaauaagcauguugugauaaugauagauguacaauuccaacaagguuauuauuuuuuaaauaca

SEQ ID NO: 343817 - RNA, 64 nt, Human
cacacacaaaucagcaucauaagggaauguagccuuccaacagagaugaugcuguucguauguu

SEQ ID NO: 343818 - RNA, 64 nt, Human
gagccaagugaccuugggagagguaagaugguguuuccaacaaggugcuucucuacuuccacca

SEQ ID NO: 343819 - RNA, 64 nt, Human
cugugagcaaacagaggaggccagccucaccucauuccaacaccugccauagggaccaacggga

SEQ ID NO: 343820 - RNA, 64 nt, Human
aaacuaaacugcugcaaaaguucucaauguucuuuuccaacacaucuauauauauauggacaca

SEQ ID NO: 343821 - RNA, 64 nt, Human
ucaugccuguaaucccagcacuucaggaggccgagguggacagaucacgaggucaggaguucga

SEQ ID NO: 343822 - RNA, 64 nt, Human
gauagugcgggcaccuguggccaaguggagcagagguggacaugggguuggauuguuuugauua

SEQ ID NO: 343823 - RNA, 64 nt, Human
ccaaacugagacagacugggagcugggagccugggguggacaggaccauacccucuuugagcuu

SEQ ID NO: 343824 - RNA, 64 nt, Human
uacccaugaagaaucaaaaaguuuauuuuuuuucuuccaacaugugauguguugcucuccauuc

SEQ ID NO: 343825 - RNA, 64 nt, Human
aacaugcuagaaaauuaauuuuaaaacuaaguuauuccaacacuaaaagcauacaacagcaugc

SEQ ID NO: 343826 - RNA, 64 nt, Human
ccucacauuguaggggugcaguuuguccaacucuuuccaacagcccauuagacaccacuagcug

SEQ ID NO: 343827 - RNA, 64 nt, Human
gccuucccccugcugccggccuuugcuccuucacuuccaacaucucucaaaauaaaaaucccuc

SEQ ID NO: 343828 - RNA, 64 nt, Human
aaacaugccgcagggagggcuguggugccggugcuuccaacaaggacagcccuccuugacccug

SEQ ID NO: 343829 - RNA, 64 nt, Human
aguuugacuuucauaaugucucuguuuuuuguuuuuccaacaauuacagacucagguucucuua

SEQ ID NO: 343830 - RNA, 64 nt, Human
ccaagucagaagaagacagcaaaaaaagcaacuuuuccaacauacaauuuacuuuuaauaaagu

SEQ ID NO: 343831 - RNA, 64 nt, Human
uuucaucaucugggucccuuugguuuauaucaguuuccaacaugacuuguuuguggggcuugug

SEQ ID NO: 343832 - RNA, 64 nt, Human
agcagccacugcacaggaggaggugacaaaccauuuccaacagcaacacagccacuaaaacaca

SEQ ID NO: 343833 - RNA, 64 nt, Human
cuuuguaauuuuaauuccaugaaagucuuaauguuuccaacaugaaaauucucuuacuuaaaua

SEQ ID NO: 343834 - RNA, 64 nt, Human
augcggucggaggauuguguugcuguggacgugguuccaacauucacuccuaucucauuagaag

SEQ ID NO: 343835 - RNA, 62 nt, Human
acaugcaggacguuagacuguugggacagccauuuuccaacaaccaaggggccaaaauaucu

SEQ ID NO: 343836 - RNA, 64 nt, Human
ugacacauaaaucugucugauucuaugccuguauuuccaacaaacuuacugucagagaauauga

SEQ ID NO: 343837 - RNA, 64 nt, Human
cacaauucccaacaucuuagauaguguauuaugcuuccaacagacagucccucucauauaaagu

SEQ ID NO: 343838 - RNA, 64 nt, Human
ggcacaccuauguguguuaucucucuggcauacuuuccaacaaggauucuuuucuagucuauac

SEQ ID NO: 343839 - RNA, 64 nt, Human
uagaucguuacuuggaaauggagccuaagucugugguggacagauaauaauuauguuuuccugg

SEQ ID NO: 343840 - RNA, 64 nt, Human
ugcuuaagagacucuggaguuucuuaugugcccugguggacacuugcccaccauccugugagua

SEQ ID NO: 343841 - RNA, 64 nt, Human
cgaguuacggcugccagaugccugcaugggaagagguggacaucugcaucuuccauuggugguc

SEQ ID NO: 343842 - RNA, 64 nt, Human
caggacagcagcuccugaggcccaguggucuucuuuccaacaggaaaagaaggcugugaugucg

SEQ ID NO: 343843 - RNA, 64 nt, Human
cgugccugggaaggcgaaauauacccccagccccuuccaacacacacacuccagcgagaggagg

SEQ ID NO: 343844 - RNA, 64 nt, Human
cccugugaccaaaacaccucccauugggccccacuuccaacacuggugaucacauuucaacaug

SEQ ID NO: 343845 - RNA, 64 nt, Human
ugagaugauaauuuaagacacugaaugauuucuuuuccaacaaagcucuauguuaagugcauca

SEQ ID NO: 343846 - RNA, 64 nt, Human
ugccagugcagaaguuucuccagguggccucccuuuccaacaauguacauaauaaaguguaugc

SEQ ID NO: 343847 - RNA, 64 nt, Human
auagaauauauuaguuuucaagggagugggaggcuuccaacauaguauugaaucucaggaaaaa

SEQ ID NO: 343848 - RNA, 64 nt, Human
ucagacuguccuuaauugaaauuuugucuuugguuuccaacaccaugaugaagcucuugcuuuu

SEQ ID NO: 343849 - RNA, 64 nt, Human
ugagggagaaagguagggcugugccuucuaaagauuccaacagagaugugagaagauaauacag

SEQ ID NO: 343850 - RNA, 64 nt, Human
aaauaagcugaauuauuauuucauggugccauuguuccaacaucuuccaaucauugcuagaaaa

SEQ ID NO: 343851 - RNA, 64 nt, Human
uguuuguugaaugaaugcaugucuucuaaaaguuuuccaacacaaauuagcagugguuucuugu

SEQ ID NO: 343852 - RNA, 64 nt, Human
aguuuuccagaaauagauuuuacacuguuuagaauuccaacaccuacaguggaaagacuguuua

SEQ ID NO: 343853 - RNA, 64 nt, Human
uaugggauaaggcccccugggggucuccauuucuuuccaacaguuucauguucacuacuggacu

SEQ ID NO: 343854 - RNA, 64 nt, Human
uguaauccccacaguaagaaaguuguauggcauauuccaacaaguauugguucgucuggugucu

SEQ ID NO: 343855 - RNA, 64 nt, Human
agcagguaauuaaacaagauaaauuauaccugauuuccaacaccagcuacaaagaguugaagau

SEQ ID NO: 343856 - RNA, 64 nt, Human
ggggacagagagaaauggagagcaggaauuacaguuccaacaaacaucaugauagucugguagu

SEQ ID NO: 343857 - RNA, 64 nt, Human
acccugaccggccacugccgcacacccacccagagcacgccacccgccaugggagugugcucag

SEQ ID NO: 343858 - RNA, 64 nt, Human
aggcauagcagaggcccuccagagagacugcccugcacgccaugccuugggccacguuggcagu

SEQ ID NO: 343859 - RNA, 64 nt, Human
ugugaaaagcaucuuugguuaucaguuaaauugagguggacauuauuuccccaauuucacaaca

SEQ ID NO: 343860 - RNA, 64 nt, Human
auuuuuucauugggaauauacauuuuucuuaauguuccaacaucuauacuuuguaaagucaaaa

SEQ ID NO: 343861 - RNA, 64 nt, Human
uuucuuggccuuuucuguuagaauacuuggugcuuuccaacacacuuucacauguguuguaacu

SEQ ID NO: 343862 - RNA, 64 nt, Human
gucaagucuucgagucagcgugacucauucauucuuccaacaguuuggacaccacaaagcagga

SEQ ID NO: 343863 - RNA, 64 nt, Human
cagucuauauucaggcuuauaaacauuucuugguuuccaacagaagucaaauguguuugugggg

SEQ ID NO: 343864 - RNA, 64 nt, Human
gcaccguuuugcuaaaagauacauucucauuguuuuccaacagugauggcuuccacauaagguu

SEQ ID NO: 343865 - RNA, 64 nt, Human
caauuuuuuuuuaacaauacauuuuuguggucaguuccaacagcacuguccguacuuuuaaaac

SEQ ID NO: 343866 - RNA, 64 nt, Human
gaugaggacauagcaucugcccuggaaaucguuauuccaacauaauauuauuuucuagaaugcc

SEQ ID NO: 343867 - RNA, 64 nt, Human
acagccuuuauacaaauguauuuaguucucuuuuuuccaacauaaaauucuuguuuuaagauac

SEQ ID NO: 343868 - RNA, 64 nt, Human
gggaaaccucagguagcuccugaagaucugugcuuuccaacaagugacuacccuugaagcacau

SEQ ID NO: 343869 - RNA, 64 nt, Human
ugauuccugauccaagaaggguccucugggguucuuccaacaaccuauucuaauagacaaaucc

SEQ ID NO: 343870 - RNA, 64 nt, Human
aauaaaaagugacacagcagcuucaccagagcauuuccaacaccacagacacacacacgcacgc

SEQ ID NO: 343871 - RNA, 64 nt, Human
uuuccuuggggcaggcagugaugcuggaugcuccuuccaacaggagcugggauccuaagggcuc

SEQ ID NO: 343872 - RNA, 64 nt, Human
ccucugucccucuccuugcccccagugccucaccuuccaacacuccauuauuccucucacccca

SEQ ID NO: 343873 - RNA, 64 nt, Human
ucauggauaccgacuguuuuuauguuggaauuuguuccaacauaauuagaaucuguuuggugag

SEQ ID NO: 343874 - RNA, 64 nt, Human
gugccauuaacaaauguaucacuagcccuccuuuuuccaacaagaagggacugagagaugcaga

SEQ ID NO: 343875 - RNA, 64 nt, Human
aggcauccuggcgggaaggaccagguccccucuggguggacaugcacccauccccaguccagga

SEQ ID NO: 343876 - RNA, 64 nt, Human
gcaaccuggcaaaucccucagaggacagagcuaagguggacagggauuaccuagauuggauccu

SEQ ID NO: 343877 - RNA, 64 nt, Human
cuaaugucugggcuuugaguauuagcucauuuaggguggacaaaugcauuacuguuuucaaacu

SEQ ID NO: 343878 - RNA, 64 nt, Human
caaaucaugcagccuauccaauaaguaaguuuauuuccaacauuagcucuaauuaguucauuuc

SEQ ID NO: 343879 - RNA, 64 nt, Human
uggagcaaaaaccuugcagugguaaauaaaaaauuuccaacagggucagcugccugguguuuuc

SEQ ID NO: 343880 - RNA, 64 nt, Human
ggaagaccuagaacccuuuccccagcacuugguuuuccaacaugauauuuaugaguaauuuauu

SEQ ID NO: 343881 - RNA, 64 nt, Human
cucaccucauucccauuguuuggaucaugcuucuuuccaacacguguucacaaucuccaaaggg

SEQ ID NO: 343882 - RNA, 64 nt, Human
uucuacauagacucaaccucacccucuccuaguuuuccaacaagacacuccaaagccaacugga

SEQ ID NO: 343883 - RNA, 64 nt, Human
uauuuuugagguguuccuggucuuucacugacaauuccaacauucuuuacuuacaguggaccaa

SEQ ID NO: 343884 - RNA, 64 nt, Human
auuuuaguuucuguucuguggaaaguguaaagcauuccaacaaaggguuuuaauguagauuuuu

SEQ ID NO: 343885 - RNA, 64 nt, Human
cccugcccccaccccaguuccccaacccacucccuuccaacaacaaccagcuccaacugacucu

SEQ ID NO: 343886 - RNA, 64 nt, Human
cccuccucugcucuccucaaagacgcaaaacauuuuccaacaagagcugucacaguggcagcaa

SEQ ID NO: 343887 - RNA, 64 nt, Human
guuaaucugucaccugaaguugccagauaauauuuuccaacagcugaaguagggauaguuuuuu

SEQ ID NO: 343888 - RNA, 64 nt, Human
uuugccuugcagcccugaccccaaugucugcuguuuccaacacuggugauuucuaacuacggcc

SEQ ID NO: 343889 - RNA, 64 nt, Human
aagaacggaagaagaaauagauaagggccuuggauuccaacacaguuucuuccacauccccuga

SEQ ID NO: 343890 - RNA, 64 nt, Human
uguuuguauuuaaacuccauuguuuuuggcauuauuccaacaugcuuuguuuuaagaagccuug

SEQ ID NO: 343891 - RNA, 64 nt, Human
gggaucuuugaaaagcugacauuugcugcuaucauuccaacacuaaauucuuaaguaguugccc

SEQ ID NO: 343892 - RNA, 64 nt, Human
aggcugggccugccuccuugucccugccaggaauuuccaacaaaccccaccacccugugagcac

SEQ ID NO: 343893 - RNA, 64 nt, Human
uuacggcauccagagccacugcugacucccacuugcacgccaccauucagucaccagacugggu

SEQ ID NO: 343894 - RNA, 64 nt, Human
gcaccugcugucuugagacuccauccagccccaggcacgccaccugcuccugagccuccacuau

SEQ ID NO: 343895 - RNA, 64 nt, Human
cggaguggauaaggcugagaugagugcugggagugguggacauuccugcucgugcaaagauggc

SEQ ID NO: 343896 - RNA, 64 nt, Human
aaagcucugaacaucauuaaguaguuaauaauaauuccaacaaggaauucagaguaauguaaaa

SEQ ID NO: 343897 - RNA, 64 nt, Human
aaagaugcacugccauauuaucuuucuuaacuuuuuccaacacauaauccucuccaacuggauu

SEQ ID NO: 343898 - RNA, 64 nt, Human
gggcguuucccccaaugaaauacacaaguaaacauuccaacauugucuuuaggagugauuugca

SEQ ID NO: 343899 - RNA, 64 nt, Human
aacgucgguugcauugagcuacuggggguaggaguuccaacauuuauguccagagcaacuucca

SEQ ID NO: 343900 - RNA, 64 nt, Human
gccauggcuucucauuuacaccaacagguuucaguuccaacagaaaggucgggguagguucgug

SEQ ID NO: 343901 - RNA, 64 nt, Human
aucagggaucauaaauuaugcauaucuaugaauuuuccaacaaauuccuacuuccugauuggau

SEQ ID NO: 343902 - RNA, 64 nt, Human
auuuuaguuucuguucuguggaaaguguaaagcauuccaacaaaguguuuuaauguagauuuuu

SEQ ID NO: 343903 - RNA, 64 nt, Human
cuauggagaagccaguaguuagaaacggugagaauuccaacacuguucauguaacaguaacucc

SEQ ID NO: 343904 - RNA, 64 nt, Human
cgcuuuucagaauguauugucugaauuucuugucuuccaacauucuccuaagccaguuaccuuu

SEQ ID NO: 343905 - RNA, 64 nt, Human
uuaggaaguuuuuaaguucaugguauucucuugauuccaacaaaguuugauuuucucuuguauu

SEQ ID NO: 343906 - RNA, 64 nt, Human
acaaaaacaaaacgaaagaguucauacucugauuuuccaacaucuaggaaacugaguuuuauuu

SEQ ID NO: 343907 - RNA, 64 nt, Human
cuguuuacagcccucucuucuuuguacaguuguauuccaacacuccacucgcuaagaggcccug

SEQ ID NO: 343908 - RNA, 64 nt, Human
gaggcagggagacagggcugcagggccucccaccuuccaacagacaggcucugcuguaucuguu

SEQ ID NO: 343909 - RNA, 64 nt, Human
uuuuuuguuguauuucccccuuuccacugggcccuuccaacacaaugaaugaaggaaauaucau

SEQ ID NO: 343910 - RNA, 64 nt, Human
auauauagaauuguagacugauguuuuagcauuuuuccaacacacacaacguaaaaauaaaagc

SEQ ID NO: 343911 - RNA, 64 nt, Human
auuuguguggaagaggaggaaucaccauuuacaagguggacaaaugcuaauauuuuuaucuaga

SEQ ID NO: 343912 - RNA, 64 nt, Human
uuccaaggcuguuugcugggugucccacaaguuggguggacauaaaugagucaagugacaacag

SEQ ID NO: 343913 - RNA, 64 nt, Human
accaagcacccaaaagaggauuuagaacuagcaggguggacaucaucugguuguuucuacuuuu

SEQ ID NO: 343914 - RNA, 64 nt, Human
uugugauuuuacuuuuuaauagauaugacuuugcuuccaacauggaaugaaauaaaaaauaaau

SEQ ID NO: 343915 - RNA, 64 nt, Human
uuuuauuguuugaacaggaagugaacauagucguuuccaacaaaguuuuacuuuuuguaggauu

SEQ ID NO: 343916 - RNA, 64 nt, Human
aauaccuuuaaaaaauaauuuagauauucauacuuuccaacauuauccugugugauuacagcau

SEQ ID NO: 343917 - RNA, 64 nt, Human
uggauguuuaauuuacaaaauaguuggguaaauguuccaacaaacuuuaaaguaccuugaaguc

SEQ ID NO: 343918 - RNA, 64 nt, Human
uuuuuauauguucuuugcuuccuacuucccugucuuccaacauacuguucacuuacucuggcag

SEQ ID NO: 343919 - RNA, 64 nt, Human
uaauccaauggacagaagccccaggaagggguauuuccaacacuuggcgucucaaugaggauaa

SEQ ID NO: 343920 - RNA, 64 nt, Human
agauccaaacagagacuuccugcaucuucugccuuuccaacagaagcggugaucgucuaaguau

SEQ ID NO: 343921 - RNA, 64 nt, Human
cuucaaaugcgaacacuauaaacuccaggcuugauuccaacaggcgugggaucagauuugguga

SEQ ID NO: 343922 - RNA, 64 nt, Human
cuugucuuacugaacuacagccugguuuguagacuuccaacaucuacacugcugcucuucacca

SEQ ID NO: 343923 - RNA, 64 nt, Human
auucuuuccaugcaguuauuagaacuuaguuuuguuccaacaguuaaacuugcaaugaaaagaa

SEQ ID NO: 343924 - RNA, 64 nt, Human
cagccccuggcuucccagccuuccuccugaccccuuccaacagccuuggaacuccagcugccac

SEQ ID NO: 343925 - RNA, 64 nt, Human
gaaagucucauucuauccucucuccaaacccguuuuccaacauuuguuaauaguuacgucucuc

SEQ ID NO: 343926 - RNA, 64 nt, Human
gccauuuuaagguagcccucucaucgucuuuuaguuccaacaaagaaaggugccaugucuuuac

SEQ ID NO: 343927 - RNA, 64 nt, Human
aacaacuuacagugauucuuccuguuggaagaauuuccaacaaaucagaaucacguuuuuaguu

SEQ ID NO: 343928 - RNA, 64 nt, Human
acauauuuuuagauaaaauuaaaugcucuuauuuuuccaacagcuaaacuacucuuaguugaac

SEQ ID NO: 343929 - RNA, 64 nt, Human
cuccccugugucugcugguggcugcugaggccuugguggacagaggauggggaaaggggucagg

SEQ ID NO: 343930 - RNA, 64 nt, Human
acucuuuuucccuucugccuucaccuuugccguggguggacacagcaagaaggcccucaucaga

SEQ ID NO: 343931 - RNA, 64 nt, Human
cacaggggccugagagcugaagagcaccagguuugguggacaaagcuacugagaugccuguuca

SEQ ID NO: 343932 - RNA, 64 nt, Human
gaguuguguaugucaaguccggcucagucuuuauuuccaacacuagccgugguccugugcaguc

SEQ ID NO: 343933 - RNA, 64 nt, Human
uaugaaaugguacacugacuaauccagaagacauuuccaacaguuugccagugguuccucacua

SEQ ID NO: 343934 - RNA, 64 nt, Human
uguaaauauuuacuauguuuuucuauuagcuaaauuccaacaauuuuguacuuuaauaaaaugu

SEQ ID NO: 343935 - RNA, 64 nt, Human
cagguuuucugccauucuuaaccaaggcugccucuuccaacagggcgggaaucagaccuacucc

SEQ ID NO: 343936 - RNA, 64 nt, Human
gaacuuaucuagugaggaugaagagcuucccugcuuccaacacuuguuauuugguaaaguaaac

SEQ ID NO: 343937 - RNA, 64 nt, Human
gaaauguuuaauuccgcaugauguuucccucuccuuccaacaaaagaaggucaaacuguggguc

SEQ ID NO: 343938 - RNA, 64 nt, Human
gcaaagucuccaaaaaaauugaagucacccacaauuccaacacacagcaaucacugcuguuaau

SEQ ID NO: 343939 - RNA, 64 nt, Human
ccaagaaaaacaacuuuguaaauuuggagauauuuuccaacagcuuuucgucuucagugucuua

SEQ ID NO: 343940 - RNA, 64 nt, Human
guaaguauaccuaacaugcuguggaaucuugaguuuccaacaccgugcugcuugauagaaugac

SEQ ID NO: 343941 - RNA, 64 nt, Human
auaguuaggacuugauuguagaagggacuaaauguuccaacauaaucuuuacccuucuccccaa

SEQ ID NO: 343942 - RNA, 64 nt, Human
cacauaugggggaaacgacacaucccagugggauuuccaacacucccccuccccaugcaacaaa

SEQ ID NO: 343943 - RNA, 64 nt, Human
cuuaacuguauauaagcaaaacagaagagucuuguuccaacagaaacucuggagcuccgugggu

SEQ ID NO: 343944 - RNA, 64 nt, Human
gaauuggacagcucagauggagugagggccuauuuuccaacagcucuucgcagacccaagagcu

SEQ ID NO: 343945 - RNA, 64 nt, Human
uuaauaacauacaaugaccacauagugugagaacuuccaacaagccucaaagucccuugagacu

SEQ ID NO: 343946 - RNA, 64 nt, Human
cuguaaaaugaaacacaccuaaaagugugguuguuuccaacauguauaauacagcaacaacuau

SEQ ID NO: 343947 - RNA, 64 nt, Human
acaggagggccccucaggcagagauggaccaggcgguggacagauggguagauguggcaggcau

SEQ ID NO: 343948 - RNA, 64 nt, Human
ugagagcacuuccugcccuuguuggaagccccaggguggacacucagcacgaaggucucucccu

SEQ ID NO: 343949 - RNA, 64 nt, Human
acagacagccaaagcuucagagauacaguccacagguggacaaagggauccccagccagagaga

SEQ ID NO: 343950 - RNA, 64 nt, Human
acacuuuuucuuccgcaggggcgggagccccuaguuccaacacugaggacgcgugacauggugg

SEQ ID NO: 343951 - RNA, 64 nt, Human
gcaggaaauaacccacaaaagaagcaaaugcaauuuccaacacaagggggaagggaugcagggg

SEQ ID NO: 343952 - RNA, 64 nt, Human
gcaauagacaccagcuggguguccuacaauuaaauuccaacacuaucuaccuggagcuacuguc

SEQ ID NO: 343953 - RNA, 64 nt, Human
ccccaggcagggagagcccgccugccuccacccuuuccaacaagccaucuugguaacugggaac

SEQ ID NO: 343954 - RNA, 64 nt, Human
aucgcccuaguuuucuuucuuuaaaaaaaaaaaauuccaacagaagccacaggccggagccccu

SEQ ID NO: 343955 - RNA, 64 nt, Human
uauauuagagaaagaauauguugauuuaaaagccuuccaacaccauuuaaacaugguuuaucuu

SEQ ID NO: 343956 - RNA, 64 nt, Human
ccaccacuggacugggcuggcccagccccuguuuuuccaacauuccccaguauccccagcuucu

SEQ ID NO: 343957 - RNA, 64 nt, Human
auaaagacaaauagagaagguuagauuuuuuuuuuuccaacaaguggauaaaagucugugacuc

SEQ ID NO: 343958 - RNA, 64 nt, Human
cgcuaacgccacacugaguuaauuaacugugugcuuccaacagaaaaugcacaggagugaggac

SEQ ID NO: 343959 - RNA, 64 nt, Human
uacaguaaccuucugagauauugagauuuaggacuuccaacauaugaauuuuagaagggaacaa

SEQ ID NO: 343960 - RNA, 64 nt, Human
gacaaucagccauccucgucugcucuccucucucuuccaacacagcccaucccugcacugcucc

SEQ ID NO: 343961 - RNA, 64 nt, Human
ugguguuuugccaucuuucuaaguuuggacuagcuuccaacaucuuaucccuugaauuuucaau

SEQ ID NO: 343962 - RNA, 64 nt, Human
aauuccccacuucaauacaaagggugucguucuuuuccaacaaaauagcaaucccuuuuauuuc

SEQ ID NO: 343963 - RNA, 64 nt, Human
agcccaagaaccacuuccaugccauacuguaacauuccaacaucuuuagcugaucagaucucuc

SEQ ID NO: 343964 - RNA, 64 nt, Human
aauacaaagacuuuuaagauuuuaaggcccuuucuuccaacagcuuuuauaguuagcagccauu

SEQ ID NO: 343965 - RNA, 64 nt, Human
cugccucagccucccgaguacugggaauauaggugcacgccaccacacccaacaaauuuuugua

SEQ ID NO: 343966 - RNA, 64 nt, Human
cauguucacagaggauuucagcagcugcaacugcgcacgccagguggggaaggguggggguggg

SEQ ID NO: 343967 - RNA, 64 nt, Human
uccugcagccucccgaguagcugggauuacaggcgcacgccaccacgcacggcugauuuuugca

SEQ ID NO: 343968 - RNA, 64 nt, Human
guccaugcuuucugggcagggacuugguuuuuuguuccaacaguggccuucuccgggcuucaua

SEQ ID NO: 343969 - RNA, 64 nt, Human
ucccacaaggaauaaguuccaacaaaguaauaaauuccaacaaagcaacaaaucaaauaacuua

SEQ ID NO: 343970 - RNA, 51 nt, Human
agaaaucccacaaggaauaaguuccaacaaaguaauaaauuccaacaaagc

SEQ ID NO: 343971 - RNA, 64 nt, Human
ccugcaguacccacaccaucaccacugcuuucucuuccaacagugaucuguauucuuaguuuca

SEQ ID NO: 343972 - RNA, 64 nt, Human
gggcuccuggcagugaccuuuuacaaaaguuauuuuccaacagggcacucccaggcccugucgc

SEQ ID NO: 343973 - RNA, 64 nt, Human
uaggcuauaacucagaccaaauuauaccuaaaaguuccaacaaagucccuuuuucaauaucaca

SEQ ID NO: 343974 - RNA, 64 nt, Human
uuaacuuuccuuccucauuucuugaggcuucugcuuccaacaggcaccucuaaucagaccuuuu

SEQ ID NO: 343975 - RNA, 64 nt, Human
cuugccuucauuuuuacagagguagcacaacugauuccaacacaaaaccccuuccccuuuuuaa

SEQ ID NO: 343976 - RNA, 64 nt, Human
gaagugccuugggggcacccucauuuuguuuccauuccaacaacgagaacagagauguucuggc

SEQ ID NO: 343977 - RNA, 64 nt, Human
uucaucccggcccauguugagccaugaguggaguuuccaacagagggaggaaugugugccuugu

SEQ ID NO: 343978 - RNA, 64 nt, Human
cugucaucucagaccccaggcaggaggcccaguguuccaacacccaagccccgugcuagcagcg

SEQ ID NO: 343979 - RNA, 64 nt, Human
agacugaccuaagaccuauguaaaaggaaagcuguuccaacacacggacuauuuuuguacuaga

SEQ ID NO: 343980 - RNA, 64 nt, Human
gggauuacaggugugagccaccgugccuggccaauuccaacauucuuaaauucucucaucccuc

SEQ ID NO: 343981 - RNA, 64 nt, Human
ccuaagcagguagacauccgcgaggucagaugcuuuccaacaugacaccugaacaucuuccuuu

SEQ ID NO: 343982 - RNA, 64 nt, Human
gaaacagcuaggcccaaaucacaaguacaguccuuuccaacaccccugaaauucauagucagua

SEQ ID NO: 343983 - RNA, 64 nt, Human
gcagcagcgccuccucccggcgcccgagagaccggcacgccacggccccucccccaaggaacag

SEQ ID NO: 343984 - RNA, 64 nt, Human
uccugccucagccucuuuagcugggacuacaggcgcacgccaccacgcccggcuaauuuuugua

SEQ ID NO: 343985 - RNA, 64 nt, Human
auuauugauauggacagauucccaccuguauguagcacgccaugcugggccagcagugucauag

SEQ ID NO: 343986 - RNA, 64 nt, Human
gaguguuucuucucgacaccaaaauuuucauguguuccaacagggugcuuacauauuuguaaau

SEQ ID NO: 343987 - RNA, 64 nt, Human
caccagucauuuuucagaccuuuuaacuccucaauuccaacacugauuuccccuuuugcauucu

SEQ ID NO: 343988 - RNA, 64 nt, Human
uuaaauuggugaccuagggaucagagauuugucuuuccaacagcuugucauuuuuucauuucuc

SEQ ID NO: 343989 - RNA, 64 nt, Human
ccaaauaugcaagaauaacuuuuacacuuuuuccuuccaacacuucuugauuggcuuugcagaa

SEQ ID NO: 343990 - RNA, 64 nt, Human
gguauuuguaauugcugcuuuuuucagggguaauuuccaacacacauacaugcacacaaacaaa

SEQ ID NO: 343991 - RNA, 64 nt, Human
cauuuucccccuuggcucucaaugcuguuuggguuuccaacaauucagcauuagugggaaaaag

SEQ ID NO: 343992 - RNA, 64 nt, Human
uuaaagcuguucuggcacucaaagaaggccguguuuccaacauccucucaucccaggacauuug

SEQ ID NO: 343993 - RNA, 64 nt, Human
caguacuaaaauuaaugcagauuucucuuuagccuuccaacauuucuuguugauagugauguau

SEQ ID NO: 343994 - RNA, 64 nt, Human
gaucucuguuacaaaagaaaaaagcaaguacaaguuccaacaugcaauacuggucaacuuaagg

SEQ ID NO: 343995 - RNA, 64 nt, Human
aaugaaaacuuggcuuuaagacuuuuugacuccuuuccaacaccaucuuuuggaauuuucauac

SEQ ID NO: 343996 - RNA, 64 nt, Human
aaaaccaugccuaaguacaggcggauuagcuaucuuccaacaaugcugaccaccagacaauuac

SEQ ID NO: 343997 - RNA, 64 nt, Human
guuuucucuuuguacugcuuugucuugcauuguguuccaacacaugagacuuacugcucacuga

SEQ ID NO: 343998 - RNA, 64 nt, Human
gacuaggacaucaccauuucaaggaacuguguguuuccaacaucaugguagcagcacacacuuc

SEQ ID NO: 343999 - RNA, 52 nt, Human
cccaggaaaagucuguaugaccuuccaacaagguggauccagagcuuuucuc

SEQ ID NO: 344000 - RNA, 64 nt, Human
ugcuuucagucauucagggaaacagaaagacguuuuccaacauguagaacugcuuuuuaacugg

SEQ ID NO: 344001 - RNA, 64 nt, Human
gagcaaggaaggcucccugcauguccugcuugcugcacgccacauggguguggucugcaucuca

SEQ ID NO: 344002 - RNA, 64 nt, Human
ggcccagaagagccaggcacagagcugcaguugggcacgccaaggauuccaaagguggaaugag

SEQ ID NO: 344003 - RNA, 64 nt, Human
ucugaauguugccugggcugggggaguaccuguagcacgccagugcuguuucccggccuccaga

SEQ ID NO: 344004 - RNA, 64 nt, Human
gcacuccagccugguuacagagcaagacucugucucaaacaaaacaaaacaaaacaaaaacaca

SEQ ID NO: 344005 - RNA, 64 nt, Human
aaauuacauuuuuuuuccaggggagaaaaaaacaucaaacaaaaacaucuaaaucauccuuuuu

SEQ ID NO: 344006 - RNA, 64 nt, Human
guuacuucuauauagaagggugcacccuuacagaucaaacaaugguaagcgcucauuuggacaa

SEQ ID NO: 344007 - RNA, 64 nt, Human
auaucuuuauuacaaacugaaagagagaagauuaucaaacaaaugaaacaaguaaaggaagaaa

SEQ ID NO: 344008 - RNA, 62 nt, Human
aguccaggccaagcaaaugagagcagaagaagucaaacaaagaagaagucccuggggccaug

SEQ ID NO: 344009 - RNA, 64 nt, Human
auaggaacuaucugccuguguccucaaucucccuucaaacaagaugcugauuuguaggguacuu

SEQ ID NO: 344010 - RNA, 64 nt, Human
ccuguaauuuuggaauuucugguccugggaagaaucaaacaaaaucuuaaguucuaugagaacu

SEQ ID NO: 344011 - RNA, 64 nt, Human
guaaaaguuaagcuuuugcaaaguugucaaaaguucaaacaaaagucuaguugggauuuuuuac

SEQ ID NO: 344012 - RNA, 64 nt, Human
ggacuucucugccugguuuuguguguucuguuauucaaacaauaaaaagcugguggaacuuacu

SEQ ID NO: 344013 - RNA, 64 nt, Human
guauccaucuugucaaacacuuguccuuuguguuucaaacaauccaauuauacuguuaguuauu

SEQ ID NO: 344014 - RNA, 64 nt, Human
aauuccagccucaccacucacaagcugugugacuucaaacaaaugaaaucagugcccagaaccu

SEQ ID NO: 344015 - RNA, 64 nt, Human
caggguuccugccuuggacccccagucugggaacgguggacaucaagugccuugcauagagccc

SEQ ID NO: 344016 - RNA, 64 nt, Human
ugauuccagugagggagaaagugaucugcagggagguggacaccgagcccugagugcugugcug

SEQ ID NO: 344017 - RNA, 64 nt, Human
aaaacccacuugucaguucaguaaaauaauuuggucaaacaacagucuauugcauugauuuaua

SEQ ID NO: 344018 - RNA, 64 nt, Human
agggguacacugagggagaaaggaaaaggaaacuucaaacaauauagaauuaaauguaaaagga

SEQ ID NO: 344019 - RNA, 64 nt, Human
ccaagaaacaacaugaaugagcaacuucagagugucaaacaacugccauuaaacuuaacucaaa

SEQ ID NO: 344020 - RNA, 64 nt, Human
ugcauuuuuacaaucuuauauuaaacugguauuuucaaacaauaggaaacuuuuuuuuuuuuuu

SEQ ID NO: 344021 - RNA, 64 nt, Human
gugugcaugcuaaaaaccuguauuuucaugcuuuucaaacaacaugaauagucagcugacuaaa

SEQ ID NO: 344022 - RNA, 64 nt, Human
ccggguguuucuguagcaaguuuucauauucuuuucaaacaaugguuucucugcguuaauuauu

SEQ ID NO: 344023 - RNA, 64 nt, Human
uuuuccucccucuucaucaacauaguaaaauaagucaaacaaaaugagaacaccaaauuuuggg

SEQ ID NO: 344024 - RNA, 64 nt, Human
gagucugggaagugaaguucuacuccucuuggcaucaaacaagguuugggaguguaggaggugc

SEQ ID NO: 344025 - RNA, 64 nt, Human
caguggcaaaaauaaugacauguagcaaagauuuucaaacaaaauauuuuuuccuuuuguaaaa

SEQ ID NO: 344026 - RNA, 64 nt, Human
cacuccaaccugggcaacagaacaagaacccaucucaaacaaacaaacaaacaaaaaaaaaaaa

SEQ ID NO: 344027 - RNA, 64 nt, Human
uugacuguaacacauuuguuucaagucuuuggauucaaacaaccggauuguauuaaaauugaca

SEQ ID NO: 344028 - RNA, 64 nt, Human
ugguauaguagauaaauaaaauccaaggcaauuuucaaacaauuuuuuuaaacuuuggaaugug

SEQ ID NO: 344029 - RNA, 64 nt, Human
aaauuuuaaaguacuuuugguuauuuuucugucaucaaacaaaaacagguaucagugcauuauu

SEQ ID NO: 344030 - RNA, 64 nt, Human
gcuuccuccucgccacuccugcucuuucuccacugcacgccagaggcccauuuacuccuggggc

SEQ ID NO: 344031 - RNA, 64 nt, Human
agauggagaaaauccaaccagcucuucaggagaagcacgccaugaaacaggguaaguuuuuccu

SEQ ID NO: 344032 - RNA, 64 nt, Human
aggacggcuacgagcagcuuaggcagcucucccagcacgccaugaagggggucauccgugugaa

SEQ ID NO: 344033 - RNA, 64 nt, Human
ggagaauuuuuuggacucaagcugucaucuucaagcacgccaacuucaggcaguguuuucuacu

SEQ ID NO: 344034 - RNA, 64 nt, Human
cacuccagccugggcaacagagugagacccugucucaaacaaacaacaacaguaacaacaaaaa

SEQ ID NO: 344035 - RNA, 64 nt, Human
ugguagaaaauuugauaaucugaaucaccagcauucaaacaaauauuucggcaauaaaguuuac

SEQ ID NO: 344036 - RNA, 64 nt, Human
cugugacugcuugcugacuuuaucauaauuuucuucaaacaaaaaaauguauagaaaaaucaug

SEQ ID NO: 344037 - RNA, 64 nt, Human
agcuuuaaaaugugggcuuuugugaagaccacuuucaaacaagggagcacugaaaccugaauug

SEQ ID NO: 344038 - RNA, 64 nt, Human
acuaaucagcuccuggauuuuuuuuuuuuuuuuuucaaacaaugguuugaaacaacuacuggaa

SEQ ID NO: 344039 - RNA, 64 nt, Human
aaauggaacuuuuuaaaaccuacauuauuuucccucaaacaauuuauuuucacaauucauauuu

SEQ ID NO: 344040 - RNA, 64 nt, Human
gacaaagggcuaauaaccagaaucuacaaugaacucaaacaaauuuacaagaaaaaaacaaaca

SEQ ID NO: 344041 - RNA, 64 nt, Human
uuuaggguacuaaauuuaaauuuaaagauauuguucaaacaauaucauaucaucacauugagcu

SEQ ID NO: 344042 - RNA, 64 nt, Human
cucuccagccugggcgacagagugagacuccaucucaaacaacaacaacaacaacaacaacaac

SEQ ID NO: 344043 - RNA, 64 nt, Human
uugaaaacaaaauaugaaaagaaucggcaauguuucaaacaaaaagucauaaaagucacuuuau

SEQ ID NO: 344044 - RNA, 64 nt, Human
aguguacguucuaauugagagcauuccaguaguaucaaacaauaaugucuacuguuuauagucc

SEQ ID NO: 344045 - RNA, 64 nt, Human
aucuacaucucuauacuguacacucacccauaauucaaacaauuacaccaugguauaaaguggg

SEQ ID NO: 344046 - RNA, 64 nt, Human
aacguauguuuacaaaccacuucacuggaagacgucaaacaagcugaaugaaggggcgcuuaga

SEQ ID NO: 344047 - RNA, 64 nt, Human
aaauaaucgcuaguguuaugucaaaguuaagcccgcacgccaggcccaguuaaugcuagucuuu

SEQ ID NO: 344048 - RNA, 64 nt, Human
uaccucagccuccugaauagcugggaauacaggugcacgccacuaugcauggcuaauuuuuguu

SEQ ID NO: 344049 - RNA, 64 nt, Human
gucagagguugcauugggccgagaucgagccacugcacgccagccugggugacagagccagacc

SEQ ID NO: 344050 - RNA, 64 nt, Human
agcugucuggucccagggcaguguggagugacaggcacgccagccaauccaaucggccauuuca

SEQ ID NO: 344051 - RNA, 64 nt, Human
ccaguaucaucagugaagaauuguauuucaagauucaaacaauaaccagcaauuaaacuuuuuu

SEQ ID NO: 344052 - RNA, 64 nt, Human
gaauuuaauugcucacuuauucugaaagcuuuguucaaacaagaugauauuaaauuuguuuuca

SEQ ID NO: 344053 - RNA, 64 nt, Human
uuuuauuuucucugcuuuguguuauuuuuucuuaucaaacaauuagauguuauguuucauauua

SEQ ID NO: 344054 - RNA, 64 nt, Human
uguuaaguuacaaaagacuuuucaucagaaaauuucaaacaaaguaaacauggcguuuuauagu

SEQ ID NO: 344055 - RNA, 64 nt, Human
uccaaccccguuuuuaagcaauggaacucuuucuucaaacaaaagcuuaugcagaacaucucug

SEQ ID NO: 344056 - RNA, 64 nt, Human
cacuccagccugggcgacagagcgagacuucgucucaaacaaacaaaaaaauuagccgggcaug

SEQ ID NO: 344057 - RNA, 64 nt, Human
gagcuagcaaaugaguuuuagcggggacaaaaaaucaaacaaaaaagugaaugcuuagaaccuu

SEQ ID NO: 344058 - RNA, 64 nt, Human
uuacugaaaacuucauucuuggguuaacaguaucucaaacaauugaagucaauuacucuauaau

SEQ ID NO: 344059 - RNA, 64 nt, Human
caauuagacgcaggaaugcuacuaggaauuggaaucaaacaaugccaccccaagcguaauuuua

SEQ ID NO: 344060 - RNA, 64 nt, Human
uuaauuauuacagggagcuauugaucuacuagcaucaaacaaaggcaagcucuaauuccacagg

SEQ ID NO: 344061 - RNA, 64 nt, Human
cuaauaaaaaauccagaaccacacagcccuauggucaaacaauccuacguuugugccucugcuu

SEQ ID NO: 344062 - RNA, 64 nt, Human
ucugcccaauuggaggaaagcaaccgguggauccucaaacaacacuggugugaccugagggcag

SEQ ID NO: 344063 - RNA, 64 nt, Human
ucuuuauuugaggggggaagagugcuguacaaagucaaacaaacaaguuuacaguuguaagugc

SEQ ID NO: 344064 - RNA, 64 nt, Human
gucguguguguccugaguguuucuuugguucuuugcacgccaagucucuugguuguaccaugug

SEQ ID NO: 344065 - RNA, 64 nt, Human
cgacacagcacuguggccugucccuauugcccaggcacgccauuuccaagggcaggaaggggca

SEQ ID NO: 344066 - RNA, 64 nt, Human
acccgagcauccuccccacccccauagcuccagugcacgccacccccgucuugccugggucggg

SEQ ID NO: 344067 - RNA, 61 nt, Human
ggcagccagucaaaaaguaaaaugaagagaggcacgccaaccacuccaaaauuuugagucu

SEQ ID NO: 344068 - RNA, 64 nt, Human
cuugggcagaggagcaagccccucgaacaugauuucaaacaagcagguccucuucucucaucuc

SEQ ID NO: 344069 - RNA, 64 nt, Human
uuuguuaacuaugaggaugugcugguuuguugaaucaaacaaaaggaaauguuguggaauauuu

SEQ ID NO: 344070 - RNA, 64 nt, Human
gaggaucaaauuucaacaugagauuuggaggaggucaaacaaacuaaacuguagcaguguuuca

SEQ ID NO: 344071 - RNA, 64 nt, Human
uuuuuuaaguucaguucucccuuauggcugccuuucaaacaaguaccuuuuaucugaugccugu

SEQ ID NO: 344072 - RNA, 64 nt, Human
ucccuuugcucaugacuccuguagggaaguuucuucaaacaaaacccagcuccugagucuccag

SEQ ID NO: 344073 - RNA, 64 nt, Human
gcaugcugcugaaagcaaaugaauguggaggguuucaaacaagacaaaaggcauuccucccugc

SEQ ID NO: 344074 - RNA, 64 nt, Human
gauuagccugggcaacagugagugagacucggucucaaacaaaaaccaaauugggaaauucuuc

SEQ ID NO: 344075 - RNA, 64 nt, Human
uugcuauucuaccuuaguauuucacauuuguaguucaaacaagcgauuguccaucuguugccua

SEQ ID NO: 344076 - RNA, 64 nt, Human
uaucggcagaacugaugugagguaagugagcaugucaaacaaaauaggagcucacauggauaua

SEQ ID NO: 344077 - RNA, 64 nt, Human
uuuuuguuuuuuuuuuaguucuuauuccggagccucaaacaagcauuauaccuucugugauuau

SEQ ID NO: 344078 - RNA, 64 nt, Human
uauuuuaucugcugcuuauuuguggaaugaaaccucaaacaaacccaaagggggaggguagggc

SEQ ID NO: 344079 - RNA, 64 nt, Human
ucacccacaggugccaugugcacacuccugguuuucaaacaauucucuggauuuauuuauuugu

SEQ ID NO: 344080 - RNA, 64 nt, Human
aagcccuuaggaagaauuuuuauauccacuaaaaucaaacaauucagggagugggcuaagcacg

SEQ ID NO: 344081 - RNA, 64 nt, Human
ucuuacacgaguacugcagugauaccgaacuguggcacgccaaagcaaaggauaaccauccucc

SEQ ID NO: 344082 - RNA, 64 nt, Human
aaaaggucuuggggaauucuguuuggcuaccugggcacgccagucugcaccaugugucccugcg

SEQ ID NO: 344083 - RNA, 64 nt, Human
guagcagagcaguuucuugccgcuugggucuucagcacgccaagccccccaccaacccuccacc

SEQ ID NO: 344084 - RNA, 64 nt, Human
ugccucagccuccugaacagcugggaccacaggugcacgccaccacaccuggcuuuuuuuuguu

SEQ ID NO: 344085 - RNA, 64 nt, Human
uauuucccaagugucuggauggauggagagguacucaaacaaguuacuuucaguuguccugcug

SEQ ID NO: 344086 - RNA, 64 nt, Human
uuaccccaaaucagaccaucugagcccacuacuaucaaacaaacaaacaaaaacuguuaauaua

SEQ ID NO: 344087 - RNA, 64 nt, Human
accuauguuuuuuucagaaagcaaggaaguaaacucaaacaaaagugcguguaauuaaauacua

SEQ ID NO: 344088 - RNA, 64 nt, Human
uucuuuaaagagcuucuuuggcucuagaaaaauuucaaacaauuaaaauaagaaaaaauuuuaa

SEQ ID NO: 344089 - RNA, 64 nt, Human
gcuucaaucuuaucaacgcuacauuuuguauuuuucaaacaaguauaaauucugcaauaaagag

SEQ ID NO: 344090 - RNA, 64 nt, Human
aaaaaguaaccguaaccucacacauuaacuuuauucaaacaaacagcacuuacaggaaauguaa

SEQ ID NO: 344091 - RNA, 64 nt, Human
cauagaaaauaaguaagaacuauuuuuaaaauauucaaacaaaacuaaaacaaaaauccagugu

SEQ ID NO: 344092 - RNA, 64 nt, Human
aaaauauugaagacauuguauuaccacuugugauucaaacaauuuugugguuaaaacuggauuu

SEQ ID NO: 344093 - RNA, 64 nt, Human
gcaguauccuggucuuaaucagguauugcaguguucaaacaagguauggacacaucaacauauu

SEQ ID NO: 344094 - RNA, 64 nt, Human
guguuuuaguuagaugauaaaccaggguuuuaaaucaaacaauguagcauaaagugguauugaa

SEQ ID NO: 344095 - RNA, 64 nt, Human
uuuuaauugaggacagccugguuuucacauacacucaaacaaucaugagucagacauuugguau

SEQ ID NO: 344096 - RNA, 64 nt, Human
caaaauguuugcuaccuuaguuuaaaaaacaaucucaaacaaaagacuugcuucaagguguuuu

SEQ ID NO: 344097 - RNA, 64 nt, Human
gguugccaaauauuuacuucaggagcaaagauuuucaaacaagcauacacgaugcaaaauacca

SEQ ID NO: 344098 - RNA, 64 nt, Human
ucuuucgguucaggggccugcggagcggguuggggcgggggaaacgauaguucugcagucugcg

SEQ ID NO: 344099 - RNA, 64 nt, Human
gcuugaagccagaggucaguggccgugcuguguugcgggggaagcuguguggaaggagaagcug

SEQ ID NO: 344100 - RNA, 64 nt, Human
gggcugcccugagcccuggaaggguggggguggggcgggggaaggcaggcagagcccccucucc

SEQ ID NO: 344101 - RNA, 64 nt, Human
uaaaaucuuagucucuuaugucaaaaagaagggggcgggggaguuugaguauguaccucuaaga

SEQ ID NO: 344102 - RNA, 64 nt, Human
ggauguugggaaauucccucagaguguggguccuucaaacaauguaaaccaccaucuucuauuc

SEQ ID NO: 344103 - RNA, 64 nt, Human
uuucaguagcguccuauggaugucacauuguacaucaaacaaccuugugauuauaaaacgaucc

SEQ ID NO: 344104 - RNA, 64 nt, Human
caaaauugggaaagaaaacucacuugagucuugaucaaacaagugucuuuuacuuaagaagaaa

SEQ ID NO: 344105 - RNA, 64 nt, Human
aaauaaauguguauagcucaguuuggauaauuggucaaacaauuuuuuauccaguaguaaaaua

SEQ ID NO: 344106 - RNA, 64 nt, Human
ucauuuaccuaguauuaugaaagaaugaaggaguucaaacaaauguguuucccaguuaacuagg

SEQ ID NO: 344107 - RNA, 64 nt, Human
cacuccagccuggaugacagagugagaccuugucucaaacaaaacaaaacaaaaaugaaauguu

SEQ ID NO: 344108 - RNA, 64 nt, Human
augcaguacauuauauuauucuguacaaaggcuuucaaacaaaauuuuuaaaauaauaaaguau

SEQ ID NO: 344109 - RNA, 64 nt, Human
agacuucuuauggugcuauuccauaaacuuuuuuucaaacaaguuuuugaccuuugagccaacc

SEQ ID NO: 344110 - RNA, 64 nt, Human
uuuccuuuauuucaaugauucucagaaggccaauucaaacaaacccacauuuaagguucuuuag

SEQ ID NO: 344111 - RNA, 64 nt, Human
uuuucaauaaucucaccuuaaaagugaccccuuuucaaacaaagcauaaacaauuuauuugugg

SEQ ID NO: 344112 - RNA, 64 nt, Human
aagguuaauuuaaacuuaccuaagaagaugagaaucaaacaaaacagauaugcuuacucuaguu

SEQ ID NO: 344113 - RNA, 64 nt, Human
uuuuaaaaugcauugcugagaaacguugcuuucaucaaacaagaauaaauauuuuucagaaguu

SEQ ID NO: 344114 - RNA, 64 nt, Human
ugguacauuugaaauaaaaaccaaauuuuuagauucaaacaaucccuuuauccuuaauuuaauu

SEQ ID NO: 344115 - RNA, 64 nt, Human
ugggcacccccggcccagugcccccugguggaaugcgggggagcaggcaguggggcuggaagca

SEQ ID NO: 344116 - RNA, 64 nt, Human
cauagcaagacucuguuucaaaaaaaaagggggggcgggggacgggugggugcaguggcucaca

SEQ ID NO: 344117 - RNA, 64 nt, Human
acgcgggaccagcucuccccugcgcaggcccuccgcgggggacaggaacacccagccccagcga

SEQ ID NO: 344118 - RNA, 64 nt, Human
auugugaugcagccucgggacagggcugaggccugcgggggaagaccuauaccccacgccuggg

SEQ ID NO: 344119 - RNA, 64 nt, Human
aaugacuuguacucugaaaguuuuggaaacguauucaaacaauuugaauauaaauuuaucauuu

SEQ ID NO: 344120 - RNA, 64 nt, Human
ccuuucacuuaaguauugucaccaggauuacuagucaaacaaaaaagaaaaguagaaaggaggu

SEQ ID NO: 344121 - RNA, 64 nt, Human
uuuggugacacuaauguucuacuauagcuuauuuucaaacaagggguaaaaaaaggaaagaaag

SEQ ID NO: 344122 - RNA, 64 nt, Human
cuuucaggggaggcuguuuacccaggcaauguccucaaacaagccugugccgggguguccugga

SEQ ID NO: 344123 - RNA, 64 nt, Human
uuuuauuaugcaaugccuuagucauaaacugggcucaaacaauucucagccuaaaacacuguug

SEQ ID NO: 344124 - RNA, 64 nt, Human
cuccuaucaaagucccaucucuuaacccuggguaucaaacaaacugugaguuuuccagaaucug

SEQ ID NO: 344125 - RNA, 64 nt, Human
auuuacaacuuaacuuuccaaguuuauauccuagucaaacaaaauuuacuugguugguccaaau

SEQ ID NO: 344126 - RNA, 64 nt, Human
gggagaaauucccugaauuucuuuaguuuuguauucaaacaauuaugccacucgaugcaacaaa

SEQ ID NO: 344127 - RNA, 64 nt, Human
aaucuuagcucacugcaaccucugcuuccuggguucaaacaauucucaugccucagccucccaa

SEQ ID NO: 344128 - RNA, 64 nt, Human
aggaggaagucuggguuuuaugaauagcauagauucaaacaaucuuuuauucaaagauugaaau

SEQ ID NO: 344129 - RNA, 64 nt, Human
cacauuagagaacauccuggcuuuugagcacuuuucaaacaaucaaguugacucacgugggucc

SEQ ID NO: 344130 - RNA, 64 nt, Human
agacagaugaaaugauuugccugaggccguaucaucaaacaagaaauucauauucaccuuucug

SEQ ID NO: 344131 - RNA, 64 nt, Human
auuuguucucagucccaaacugaaacuauaccauucaaacaacagcgcuccccauuucccccuc

SEQ ID NO: 344132 - RNA, 64 nt, Human
aaaccaaaucccacccgugcugggcagagugcgugcacgccauuccuacagcauuccaaagaug

SEQ ID NO: 344133 - RNA, 64 nt, Human
uacgucagccuccugaauagcugggauuacaggugcacgccaccaugcuuggcucauuuuugua

SEQ ID NO: 344134 - RNA, 64 nt, Human
agggggccgggcugaggcugugcacaugcagucugcacgccacucuugggcucugcuggcggag

SEQ ID NO: 344135 - RNA, 64 nt, Human
cgcacacacaccggucaccgagacggcuggaccugcacgccaccgcugccuuuugcugcugcug

SEQ ID NO: 344136 - RNA, 64 nt, Human
ugaaucccacuucagugcaccuguggccucucagucaaacaaguugugccuuucacagcuucuu

SEQ ID NO: 344137 - RNA, 64 nt, Human
gaaugcuuucaaggguaaccagauuuaagaaucuucaaacaauacacuguuaccuuuugacugu

SEQ ID NO: 344138 - RNA, 64 nt, Human
uccuguaauuucacuaacuuuuuauucaugcacuucaaacaaacuuuacuacuacauuauauga

SEQ ID NO: 344139 - RNA, 64 nt, Human
aaaguaaguuugugaauuugucaacuuucgagcaucaaacaaauauuuuacuuaaauuuuauuu

SEQ ID NO: 344140 - RNA, 64 nt, Human
cagacacuucauggaccaagaaugagcugguuugucaaacaacaugugagcauggucacaagca

SEQ ID NO: 344141 - RNA, 64 nt, Human
caaagcaugaaauguauauguguaauguuuuaugucaaacaauuaugcuuaauauacagucuau

SEQ ID NO: 344142 - RNA, 64 nt, Human
caaagcaggaaaugugcauguguaaugguuuaugucaaacaauuaugcuuaauauaaagucuau

SEQ ID NO: 344143 - RNA, 64 nt, Human
uccacugcaugccuugacuucccccaccuccuccucaaacaagagacuccacugcauguuccaa

SEQ ID NO: 344144 - RNA, 64 nt, Human
gacuccagccugggugacagagcgagacuccgucucaaacaaacaaacaaaaaacuguuuucau

SEQ ID NO: 344145 - RNA, 64 nt, Human
auuuaguuuuaucaguagucuuaaaguguugaucucaaacaaguacauuagaaaaaucauguuu

SEQ ID NO: 344146 - RNA, 64 nt, Human
aaccuuuaauauaucagugcuccaguauauaaccucaaacaaauguaaauagaacgaauuauuu

SEQ ID NO: 344147 - RNA, 64 nt, Human
auuuaauacuagugucauagauacuuuuuguacaucaaacaauugaucaugugcuguaaaggaa

SEQ ID NO: 344148 - RNA, 64 nt, Human
cauugguugcaagaaugaauacugacuucagaacucaaacaauggaagaacuugcauuuuuaug

SEQ ID NO: 344149 - RNA, 64 nt, Human
cguccucgguccccagggcgcagcuguuggggcugcgggggaguggagcccccgugccccugcu

SEQ ID NO: 344150 - RNA, 64 nt, Human
cuugagccuccucaugcucucagagcagggaacagcgggggaaaauguuuacacuccaugcaca

SEQ ID NO: 344151 - RNA, 64 nt, Human
cucagaaccuuggggaagguggcuggacugcugggcgggggacaucucgggguuucaggguggg

SEQ ID NO: 344152 - RNA, 64 nt, Human
ugcuggacaaacucuggaagcagcgugugaaacagcgggggaagggaagagcggcgugagcgga

SEQ ID NO: 344153 - RNA, 64 nt, Human
gacaaagacucuuaacguaggauauauguucuguucaaacaagagaaaguaacucuacccaugc

SEQ ID NO: 344154 - RNA, 64 nt, Human
ccuucacucuaccuucuagguuccugaaguauuuucaaacaaaccaccaacaggagauauugag

SEQ ID NO: 344155 - RNA, 64 nt, Human
uucuguggauucuuuaaaccugugugcuaauaauucaaacaauguugcauuaauuguauaaggg

SEQ ID NO: 344156 - RNA, 64 nt, Human
aaaauaauacauaguuucuguuaagggaauucucucaaacaaaaggaaagcgauuuuucucaau

SEQ ID NO: 344157 - RNA, 64 nt, Human
ccucuuuugugaagaaagcggguccaaaugugauucaaacaacuguacggaguggcauauuaga

SEQ ID NO: 344158 - RNA, 64 nt, Human
uuauuacuuaauaaucucacauacugaauacuagucaaacaaguuuuuaaauguuucuuugggu

SEQ ID NO: 344159 - RNA, 64 nt, Human
auaucuacauaucugucaucuaaauaaauggcuuucaaacaaagcaacugggucauuaaaacca

SEQ ID NO: 344160 - RNA, 52 nt, Human
cauccaaguccuggaacugaggucaaacaaguaccaccaaggugauccccag

SEQ ID NO: 344161 - RNA, 64 nt, Human
agagaccgaacccccucaccugaaucccccucuaucaaacaaacaaaaaagcagcaguaaagag

SEQ ID NO: 344162 - RNA, 64 nt, Human
ugguagauauuaaccuuaaaaaggguuuucauucucaaacaagaugcuuuguucuccaacaaga

SEQ ID NO: 344163 - RNA, 64 nt, Human
aaacccaacaaugaauaucaaguauagauuugacucaaacaauuguaauuuuugaaauaaacua

SEQ ID NO: 344164 - RNA, 64 nt, Human
gaucucagcucccugcaaccuccaccuccuggguucaaacaauucuccugccucagccucccga

SEQ ID NO: 344165 - RNA, 64 nt, Human
uauuacuucuagaauuagaccaacaauuuauaaaucaaacaaacccaagagcauugaaauuuug

SEQ ID NO: 344166 - RNA, 64 nt, Human
caacaacuacuaccaggacgccugaggcugcucugcgggggacgugcacaauaaagguguucuc

SEQ ID NO: 344167 - RNA, 64 nt, Human
gaauacuugcaggcuuuguaugugaauaauucuagcgggggaccugggagauaauuccuacggg

SEQ ID NO: 344168 - RNA, 64 nt, Human
gcuccucccaugggagguguaggauaaggugggggcgggggaaaugggggaaugacacaucccc

SEQ ID NO: 344169 - RNA, 64 nt, Human
aucucgugagaagcuacucccuccgcagcaccaagcgggggauggugcucaaccauucaugaga

SEQ ID NO: 344170 - RNA, 64 nt, Human
ucauuguaaauauugguauuuugaauguuaaaugucaaacaaaugugacuuaugcuggugcccu

SEQ ID NO: 344171 - RNA, 64 nt, Human
cuccauguucuuuugcucuuuuggggaugggacaucaaacaaaagucucuucguguauaucuca

SEQ ID NO: 344172 - RNA, 64 nt, Human
cacuccagccugggcaacagagcgagacuccaucucaaacaaaaacaagaacaaaaacaaacau

SEQ ID NO: 344173 - RNA, 64 nt, Human
acggaaugacaugaaugcugcuaaaggacuggacucaaacaaaaacgaggucaaucaugccauu

SEQ ID NO: 344174 - RNA, 64 nt, Human
aacauucuccucucccugacuggugucagauucaucaaacaaaaaauaaaucucgaagaaaaaa

SEQ ID NO: 344175 - RNA, 64 nt, Human
gcacuccagccuggcaacagagcuagaauccgucucaaacaaacaaacaaaaaaucccacagcu

SEQ ID NO: 344176 - RNA, 64 nt, Human
gcacauuugucaguauuuuugccggcuggugaauucaaacaaccugcccaaagauugauuugug

SEQ ID NO: 344177 - RNA, 64 nt, Human
augcaccuaucaagaaucaagagaauagauuguaucaaacaacggcagggaaauccuucagcaa

SEQ ID NO: 344178 - RNA, 64 nt, Human
aaaaguguuauuuguaaguuaauuuuuuuacaagucaaacaauguuggaagugguauuuagguu

SEQ ID NO: 344179 - RNA, 64 nt, Human
uagguguuuuuagacucauauaauuuguuauuuuucaaacaauagugaauaauuaauauuuuug

SEQ ID NO: 344180 - RNA, 64 nt, Human
aagauucccacccaauucaaaacauugugccaugucaaacaaauagucuaucaaccccagacac

SEQ ID NO: 344181 - RNA, 64 nt, Human
gguggguguacucuggccucuugguucauuauuuucaaacaagcacacuuguacaauuauuuuc

SEQ ID NO: 344182 - RNA, 64 nt, Human
uuaaugagaaaaaguuuaaaauucucaauacaaaucaaacaauuuaaauauuuuaagaaaaaag

SEQ ID NO: 344183 - RNA, 64 nt, Human
ccugcuuguuugcuuaaaaauguaauugggggcggcgggggaggagaggggaaagagacauucg

SEQ ID NO: 344184 - RNA, 64 nt, Human
acucugccggcagugggggugggggcccaugcccgcgggggagagaaggagguggcccugcugu

SEQ ID NO: 344185 - RNA, 64 nt, Human
uuggcugagccauucaaagagcaucaucuguucuucaaacaaauguuggucacccacucucucc

SEQ ID NO: 344186 - RNA, 64 nt, Human
uuuagggcucacacauuuagaagaauuagauuuaucaaacaacagucugcaaaacuuugacuau

SEQ ID NO: 344187 - RNA, 64 nt, Human
uauuuguuuugucauuuacgugaccauuugauucucaaacaaaaguuguuccaaacaaaaugau

SEQ ID NO: 344188 - RNA, 64 nt, Human
ccuaauaugugcauuguaaaauaaaugccauauuucaaacaaaacacguaauuuuuuuacagua

SEQ ID NO: 344189 - RNA, 64 nt, Human
caggagugucugagcugcauuaccucuagaaaccucaaacaaguagaaacuugccuagacaaua

SEQ ID NO: 344190 - RNA, 64 nt, Human
uuccaaagugcaacauuuuccgaugcuuuagaaaucaaacaaaccagggacauuguucagaugu

SEQ ID NO: 344191 - RNA, 64 nt, Human
cuuccuggaacuugcucucauuuuccugggugcaucaaacaaaacaaaaaccaaacacccagag

SEQ ID NO: 344192 - RNA, 64 nt, Human
gcaguuuagcaguuaaaaguguauuuuuguuuaaucaaacaauaauaaagagagauuuguggaa

SEQ ID NO: 344193 - RNA, 64 nt, Human
gagcagacuuucaauguuagcaauuaagcuguugucaaacaaucagucaugagcuuuguuaauu

SEQ ID NO: 344194 - RNA, 64 nt, Human
ucuuugcauuaguuaaaaaguuaguauauaggcaucaaacaaccuuggcuguaaccuauagaau

SEQ ID NO: 344195 - RNA, 64 nt, Human
aagaacaacauuaauggagaugcacaaugauuauucaaacaagcuauauauauguacaaaggca

SEQ ID NO: 344196 - RNA, 64 nt, Human
cacuccagccugggugacagggcaagacucugucucaaacaaauaaaaauccccucuccuaaac

SEQ ID NO: 344197 - RNA, 64 nt, Human
ggccuaauccucacucuuuucuuccuaaucuucaucaaacaaaaaaugaaaagucugucuggac

SEQ ID NO: 344198 - RNA, 64 nt, Human
ugccucagccuccugaguagcugggaugacaggugcacgccaccacgcccggcuaauuuuuaua

SEQ ID NO: 344199 - RNA, 64 nt, Human
gaccucaguggcugcagcucugaccgucccgccagcacgccagccccgacucagcuccucgcgg

SEQ ID NO: 344200 - RNA, 64 nt, Human
gcauuuuuuucauuguuuauuuuccuuuucucaugguggacauacaauuuuacuguuucauugc

SEQ ID NO: 344201 - RNA, 64 nt, Human
ccucagcuaccaaauagcgaagcgccccuugucugguggacacgugacucgcgugacuuuaccu

SEQ ID NO: 344202 - RNA, 50 nt, Human
uuuuuaacaucucuuuuugaucaaacaagaaaaggcauuugggaaaugca

SEQ ID NO: 344203 - RNA, 64 nt, Human
aaauggaacuuuuuaaaaccuacguuauuuucccucaaacaauuuauuuucacaauucauauuu

SEQ ID NO: 344204 - RNA, 64 nt, Human
auaaaaguccaaauguuuagcuuaggucugagagucaaacaauguuaaggauugucuuaaaguu

SEQ ID NO: 344205 - RNA, 64 nt, Human
auugaacaauaaauucuagaagaguugccuugauucaaacaaguauaauucucaaguuaucaca

SEQ ID NO: 344206 - RNA, 64 nt, Human
acuaugcuguuuauauugucauuaaauuauacaaucaaacaaaugccaaaugaauugccuaauu

SEQ ID NO: 344207 - RNA, 64 nt, Human
auguuaccccaaagcaaaaccauugugucaggagucaaacaaauguuuagaaagcaaacaugac

SEQ ID NO: 344208 - RNA, 64 nt, Human
gucuugggcuuuguugcuuuuggcaaaagguacuucaaacaagggagggccuggacugaggggg

SEQ ID NO: 344209 - RNA, 64 nt, Human
uaaauuugugguaauacauggucacaaccguggaucaaacaaggucagucuaaaguggcagguc

SEQ ID NO: 344210 - RNA, 64 nt, Human
ccccgguuuuccuccccgcccugucccucucuggucaaacaacauacuaaagaggcgaggcaau

SEQ ID NO: 344211 - RNA, 64 nt, Human
caaaaugaugcaaccaaaagggaaaaaauaaaaaucaaacaaccuucagcuuuauuuuucuuua

SEQ ID NO: 344212 - RNA, 64 nt, Human
guaucguguaacacaaauaaugauauuaaaagcaucaaacaagccagccucagcucccucccug

SEQ ID NO: 344213 - RNA, 64 nt, Human
cuugcgggggacccuccccagcccauuccugcugucaaacaaacaaaaccuugcaaagcgcugg

SEQ ID NO: 344214 - RNA, 64 nt, Human
uuauuuagaacaugguaagccugguauuuuuuaaucaaacaaaauauuuaugaaauggguuuuc

SEQ ID NO: 344215 - RNA, 64 nt, Human
aaacaccgggaaacauuuuggcucauuauaauccggugaacaaugcagucaggccuguuauaac

SEQ ID NO: 344216 - RNA, 64 nt, Human
cugucuacccaagagagucagcccuuaauucucaggugaacaaacagcuaacugcaucagcaaa

SEQ ID NO: 344217 - RNA, 64 nt, Human
uucauuuaagccaucagacgaacacaagagaggcucaaacaagaaauucacuguguacacucuc

SEQ ID NO: 344218 - RNA, 64 nt, Human
cuuauucuugcccuucccccaaccaguuuguuaaucaaacaauaaaaacauguuuuuuuuuuuu

SEQ ID NO: 344219 - RNA, 64 nt, Human
ccaagcucuggaagcccacacuauuuguuggugaucaaacaaagaaacaggugaugaggaugug

SEQ ID NO: 344220 - RNA, 64 nt, Human
uuaaauguaaguagauuguagauacuguuuuauaucaaacaauguuuauaauguguauauagaa

SEQ ID NO: 344221 - RNA, 64 nt, Human
aaaugcacuuuuccccacauauggggcacuggcuucaaacaauucaguucaguaucauuacuuu

SEQ ID NO: 344222 - RNA, 64 nt, Human
cuaguggaggaaagcccauuccagcuguugccugucaaacaaauagaagauggaucucuagcuc

SEQ ID NO: 344223 - RNA, 64 nt, Human
ugaguguguggaggacacccugaaccccccgcuuucaaacaaguuuucaaauuguuugagguca

SEQ ID NO: 344224 - RNA, 64 nt, Human
ccacuggggcauauaaaaaagucaaaaaucaaaaucaaacaacaaguucugaguuacuuaggaa

SEQ ID NO: 344225 - RNA, 64 nt, Human
uauuuuaagauaagagggggaaaaacacauaaagucaaacaaauguuuuaaaaauucauaacag

SEQ ID NO: 344226 - RNA, 64 nt, Human
ccucccccaccguugucucaugccaguaacaggcucaaacaaugacaaagcagauucagaaaug

SEQ ID NO: 344227 - RNA, 64 nt, Human
aaaaucugcccuaaaacaguguacaguauuuuucucaaacaaaaacucagaauccagccuuaga

SEQ ID NO: 344228 - RNA, 64 nt, Human
uugcauugaauaaauuuuugccauggaaagaacaucaaacaagccacucaucucuacagagaua

SEQ ID NO: 344229 - RNA, 64 nt, Human
guguaauaacucacguacucugaagagagcuuggucaaacaauaaaauacauuguuacuaacuu

SEQ ID NO: 344230 - RNA, 64 nt, Human; identical to SEQ ID NO: 135821

SEQ ID NO: 344231 - RNA, 64 nt, Human
cuucccccaucuuguggcugcugaggggcaggaagcgggggagugggcucgucuccuaaauuua

SEQ ID NO: 344232 - RNA, 64 nt, Human
auccucagagcugcucccagccagcgagucaggagcgggggagacagggcuccagggaugaggc

SEQ ID NO: 344233 - RNA, 64 nt, Human
ugaacacccugcucuacaauguugcaucaagaguucaaacaacaaaauaaaaaauauuaagagg

SEQ ID NO: 344234 - RNA, 64 nt, Human
uguauauauguuuaaacuccaaaguuugggacauucaaacaauguacaugaaauuauaugugug

SEQ ID NO: 344235 - RNA, 64 nt, Human
guggugggagaucaggaaaauaacuuggccuagcucaaacaauauuggauaauccccuccuugg

SEQ ID NO: 344236 - RNA, 64 nt, Human
uaacuuacaaaaaaaugaagggcaugcugagcacucaaacaauuuguucuuacuuaaaauaaaa

SEQ ID NO: 344237 - RNA, 64 nt, Human
aaaguuuuauucuugaacuuggacacugaugccaucaaacaauuaacaaauauauuuaaguacu

SEQ ID NO: 344238 - RNA, 64 nt, Human
aucauccccacuuuaaaccccaggagacugaaacucaaacaacccugggcaaguaaugugcaaa

SEQ ID NO: 344239 - RNA, 64 nt, Human
ccuuucgaaugugaagaaguaaauuuagaggaaaucaaacaagcaucacuuuccucaguggaaa

SEQ ID NO: 344240 - RNA, 64 nt, Human
cuaggacacuccguucccugaaaccguuaaaaaaucaaacaaaaggaccccaaauuaagaaucu

SEQ ID NO: 344241 - RNA, 64 nt, Human
cccugccuccccauaggccauuuggacucugccuucaaacaaaggcaguucaguccacaggcau

SEQ ID NO: 344242 - RNA, 64 nt, Human
uccacagcuuccccucucuccuccugcccaccugucaaacaaagccagaagcugagcaccaggg

SEQ ID NO: 344243 - RNA, 64 nt, Human
ucuaguacuuccaaauaaauucauaucuagauuuucaaacaaagccccaagaugaagucuaauu

SEQ ID NO: 344244 - RNA, 64 nt, Human
gauaaaaaagcucaauagcaucuuaacgugaagaucaaacaagaacacaacaagccccuacuga

SEQ ID NO: 344245 - RNA, 64 nt, Human
gucuagagggaaaugauucaaauuuuuucauaauucaaacaaaaguuauuacacuaaaaguauu

SEQ ID NO: 344246 - RNA, 64 nt, Human
cgaccggcaugacuuuauauuguauacagauuuugcacgccaaacucggcagcuuuggggaaga

SEQ ID NO: 344247 - RNA, 64 nt, Human
auuuuuuaaaaguagcacuguucugguucuguuugcacgccaguggggagagaauaaagaggaa

SEQ ID NO: 344248 - RNA, 64 nt, Human
ugccucagccuccugaguagcugggauuacaggcgcacgccaccacgccuggcuaauuuuugua

SEQ ID NO: 344249 - RNA, 64 nt, Human
gcgggcaggggaccuuggcuaaggcgagaguagcgcacgccagcgccgccuccuagacucgagc

SEQ ID NO: 344250 - RNA, 64 nt, Human
guuuguacccauuuuuccuuaaccaacacccaaaucaaacaauuaaaauauacaguguuuuucc

SEQ ID NO: 344251 - RNA, 64 nt, Human
acauuuaggaaguuuaagguggugaucuucucuuucaaacaaagauaaaggaauuuauuuuuua

SEQ ID NO: 344252 - RNA, 64 nt, Human
auauuccuccuggcuuccuuacaaaacaagccuuucaaacaaucauuguccucaggaaaguugu

SEQ ID NO: 344253 - RNA, 64 nt, Human
cauauucacuuugagaaucgguuugacuuugcuuucaaacaaaacaaaaaccucuugcuuuuag

SEQ ID NO: 344254 - RNA, 64 nt, Human
auaaucuuuucuagcuuaauauuuuaauucuaauucaaacaacucugagguuuugguuucauua

SEQ ID NO: 344255 - RNA, 64 nt, Human
ggaucucaguguuuguuaacaaaauacaaagaucucaaacaaaccccuuuuagcuucuccuagc

SEQ ID NO: 344256 - RNA, 64 nt, Human
gaaaaacuguaccuuagagauuuuccucuagugcucaaacaaauacaaaauaagauccccaagg

SEQ ID NO: 344257 - RNA, 64 nt, Human
uacagugggggucuacaacaagaaguguauauuuucaaacaauuuuuuaaugauuuaacaauuu

SEQ ID NO: 344258 - RNA, 64 nt, Human
uuaagugaaaggucacacuaccauuauuuccccuucaaacaaauaauauuuuuacagaagcagg

SEQ ID NO: 344259 - RNA, 64 nt, Human
cuugcaaacugucugaauuugccaugcaagguuuucaaacaauuugcauguuuuucagaugcuu

SEQ ID NO: 344260 - RNA, 64 nt, Human
gaaaauuaaacuuucuuugaucuguacaaguugaucaaacaaauggggucauucuugucauaug

SEQ ID NO: 344261 - RNA, 64 nt, Human
auugaucauuacacccuaacucuccuuccuuggcucaaacaauauuuucccuauaacaaaggca

SEQ ID NO: 344262 - RNA, 64 nt, Human
aguuuauucuuuaauauaaguuacauucugcuccucaaacaaaugcaauuuuuuguguguguuu

SEQ ID NO: 344263 - RNA, 64 nt, Human
agguggcugguucccaugaacgugguugucagaggcgggggacagcagaggcugcagacuggcc

SEQ ID NO: 344264 - RNA, 64 nt, Human
cuguacgaagggccagggccacuggggcuugggggcgggggaggguggcagugggaggggcugu

SEQ ID NO: 344265 - RNA, 63 nt, Human
cucuuugaccgguugcucauuuucuggucugaccggcggaacccccacgaggugaagccagcc

SEQ ID NO: 344266 - RNA, 64 nt, Human
gcugcaagcaaaccauuuuuccccuuucuuuuauucaaacaauaauuuuugaaacaaaaaagag

SEQ ID NO: 344267 - RNA, 64 nt, Human
uaaaaaaguaccaaacauuugcauucucagaacaucaaacaaaaaugcccugguggcaaagcua

SEQ ID NO: 344268 - RNA, 64 nt, Human
caaauuuauaaauauuugcuuacaguuuuccuauucaaacaauuuguuaggccaauauuuugug

SEQ ID NO: 344269 - RNA, 64 nt, Human
uuaccuauuaaauguguauuuauagucccuccuaucaaacaauuacagagcacaaugauuguca

SEQ ID NO: 344270 - RNA, 64 nt, Human
uuuuauuaacuucaguaggaaaguuacaucugcaucaaacaauauggcaacaucuauuuauuaa

SEQ ID NO: 344271 - RNA, 64 nt, Human
augaaauguccuaucaauuuuauuuugucaugcuucaaacaauaaagacauuucugcuuuaaaa

SEQ ID NO: 344272 - RNA, 64 nt, Human
acauucuucuugcuguuguuuaguuuguuuuuuuucaaacaacccucuaaaaauguaaaaacca

SEQ ID NO: 344273 - RNA, 64 nt, Human
acuccagccugggugacacagcaagacucuugucucaaacaaacaggaauuugaguaaauuuua

SEQ ID NO: 344274 - RNA, 64 nt, Human
augcauuuaugccugaaucaaagcugccuucugcucaaacaaaucagauuuauuucacauucuu

SEQ ID NO: 344275 - RNA, 64 nt, Human
aguggcauguaguuaucuaaucaagacaccucauucaaacaaaaccugccuuaggaaaauuuaa

SEQ ID NO: 344276 - RNA, 64 nt, Human
ccgacguccuaguggaccugaugugaaauuccugucaaacaaacaccacuuuucaaugguuugc

SEQ ID NO: 344277 - RNA, 64 nt, Human
ccagcugauccuugagaaauuuacgcuuagucuaucaaacaagaaaugcuggcuuggcccggug

SEQ ID NO: 344278 - RNA, 64 nt, Human
guuacagaauaacucuucuuaacuaaaaaccuagucaaacaaggaagcuguaggugaggagauc

SEQ ID NO: 344279 - RNA, 64 nt, Human
gagaagugaccugguccuaagcugugcagggcgugcgggggaacugcccuguggaugcagccac

SEQ ID NO: 344280 - RNA, 64 nt, Human
uggauucaggagcuaaccaggcucuuccucgggggcgggggagauucugacucuuaaucuguau

SEQ ID NO: 344281 - RNA, 63 nt, Human
cgcgggguccggccugggauccaggcuaagggccggcggaagaggccccaauggggcggugac

SEQ ID NO: 344282 - RNA, 63 nt, Human
uggggugggccaugugccaggacaggagggucccggcggaaagccagccccggacucaucgug

SEQ ID NO: 344283 - RNA, 64 nt, Human
ccuugguuuuccuaagcccuuucuaacgagagucucaaacaagcggaggcgagggccaauucaa

SEQ ID NO: 344284 - RNA, 64 nt, Human
auuacaaguauuuuuaauuaauugggccagcuuuucaaacaaagaugccacauucaaaauaggg

SEQ ID NO: 344285 - RNA, 64 nt, Human
auacaguucaauuaagaccauggaaauuuuuauuucaaacaauuagagauggauauuacaacua

SEQ ID NO: 344286 - RNA, 64 nt, Human
ucauaaaaaacaauaguacugugccucuuucuucucaaacaauggaugacacaaaacuaugaga

SEQ ID NO: 344287 - RNA, 64 nt, Human
uucuguguuaguagucugucuugacacacauuguucaaacaaucucaagcacuuguguuuaaaa

SEQ ID NO: 344288 - RNA, 64 nt, Human
uguggucauaacgggaagcagaauuaugcuuuauucaaacaaaccugcuucugccucauuuucc

SEQ ID NO: 344289 - RNA, 64 nt, Human
uauucaagauauguuuauucuauuauuguaaauuucaaacaauaaauaaauaagaauccaugac

SEQ ID NO: 344290 - RNA, 64 nt, Human
ucaguggagcugugguucucuugguacuuucuugucaaacaaaaccaauggcucuggguuugga

SEQ ID NO: 344291 - RNA, 64 nt, Human
uaacgugcguccgccucagcgcgagauuaggaguucaaacaauggugacuucccagagcccgcu

SEQ ID NO: 344292 - RNA, 64 nt, Human
auucuccugcuaacuuuuuuucuuaagcuuucugucaaacaaugagguuguagggggagguagg

SEQ ID NO: 344293 - RNA, 64 nt, Human
agccaugugcaaccaaacaccaccaaaaauaaaaucaaacaaaacuaaguugugaaggaaggga

SEQ ID NO: 344294 - RNA, 64 nt, Human
uggcaauuaacugaaagggcaaagucuuaaucaaucaaacaauggaggaaucaccgacuuuaca

SEQ ID NO: 344295 - RNA, 64 nt, Human
gcaugccagcuuccugcgucuaccacucugcagcucaaacaagaagcucagagcugccccuucc

SEQ ID NO: 344296 - RNA, 64 nt, Human
uguggacaauguggguuuuugaaauuugcacccuucaaacaaugauuuaucagagaaagggguc

SEQ ID NO: 344297 - RNA, 64 nt, Human
uguucuuugaaaguagacguuucagucauucuuuucaaacaaguguuuguguaccuuuugccaa

SEQ ID NO: 344298 - RNA, 64 nt, Human
cauuccagccagggugacagagugagaccauguuucaaacaagaaacauuucagaggguaagua

SEQ ID NO: 344299 - RNA, 64 nt, Human
uuuucagaaaauggaaacuugggccauguguauuucaaacaaaaauaacuuuagauauaucuuu

SEQ ID NO: 344300 - RNA, 64 nt, Human
uguggcaggugucauuugcuaguagaauuuguaaucaaacaauaggaggggaaucugugaacgc

SEQ ID NO: 344301 - RNA, 64 nt, Human
ggagcaggggugcaggauccuguucugagcugggucaaacaaagcagggccgggccuuccugcc

SEQ ID NO: 344302 - RNA, 64 nt, Human
aaucucggcucacugcaaccuccgccuccuggauucaaacaauucuccugccucagccuccuga

SEQ ID NO: 344303 - RNA, 64 nt, Human
gaucucggcuuauugcaaccuccgcuuccuggguucaaacaauucuccugccucagccuccuga

SEQ ID NO: 344304 - RNA, 64 nt, Human
ugcacuccggccugggcaacagaggaagacugccucaaacaaacaaaaaacaacaaaccaaacc

SEQ ID NO: 344305 - RNA, 64 nt, Human
uucguucuuccagcaaaggcuuccaagguacaacucaaacaagccaugguuccuugaugacaaa

SEQ ID NO: 344306 - RNA, 64 nt, Human
gaacucccauucucacagguuuccagucagcuuuucaaacaagaauuuuguuuccaaauggaaa

SEQ ID NO: 344307 - RNA, 64 nt, Human
gggccaagaaggaucuagucugcccacuacauucucaaacaagaggacuuggaagaaaagagcu

SEQ ID NO: 344308 - RNA, 64 nt, Human
gugucuccucucagagugacagucauaaauacugucaaacaauaaagggagaauggugcuguuu

SEQ ID NO: 344309 - RNA, 64 nt, Human
uguguguuuucccguagccaccaaccgcuaaaaugcacgccaucaucgagcgcacggccagcuu

SEQ ID NO: 344310 - RNA, 64 nt, Human
cauuuagaauuucuuugugagcauguagugcuuugcacgccacagaagccgucugccgugugug

SEQ ID NO: 344311 - RNA, 64 nt, Human
ccuuagccaugugaagguggauuggucgccaucugcacgccaggcggcauccuuuucuaugaag

SEQ ID NO: 344312 - RNA, 64 nt, Human
gugugagugugagcaggcgggcgagugcgugagugcacgccagcgcguggcccauguaugagga

SEQ ID NO: 344313 - RNA, 64 nt, Human
cuauuuuggauugcaaacaggauaaauuaaauguucaaacaaucugauaaaauaaccauuugga

SEQ ID NO: 344314 - RNA, 64 nt, Human
ggaagcagguuucaucucaauauugggagagauuucaaacaaucacaccugccugagaaggagu

SEQ ID NO: 344315 - RNA, 64 nt, Human
guuuuagaucacugaguguacagaagagagaaauucaaacaaaauauugcuguucuucaguuuu

SEQ ID NO: 344316 - RNA, 64 nt, Human
ucagccugaaggcuuuuuuuuggcuggcuuuuaaucaaacaaucuuuugaaacaauuguggucu

SEQ ID NO: 344317 - RNA, 64 nt, Human
gccccccgcuugggguggugacgugacauugacaucaaacaaggauuacagugaaugugaaaaa

SEQ ID NO: 344318 - RNA, 64 nt, Human
uaguauuuaauuaguugauuuauuuaauguaauuucaaacaauuaaauuaugaauaaugcaaug

SEQ ID NO: 344319 - RNA, 64 nt, Human
cuuggcuuggugaggaaaagcggacaucagcuggucaaacaaacucucugaaccccucccucca

SEQ ID NO: 344320 - RNA, 64 nt, Human
gacaggccuggaaaggccacgauggcugcugaauucaaacaaggagucccuccagccugaauaa

SEQ ID NO: 344321 - RNA, 64 nt, Human
aggcagggaaggaccugaaggauuuggaguugauucaaacaagaucucugggagucuccagccu

SEQ ID NO: 344322 - RNA, 64 nt, Human
cauacugucuaauuaauaaauuuuccauuuuuuuucaaacaaguaugaaucuaguugguugaug

SEQ ID NO: 344323 - RNA, 64 nt, Human
acucgauuaucuugcauguuggcuagacuagaaaucaaacaacuuggaaaucgaucacaaccag

SEQ ID NO: 344324 - RNA, 64 nt, Human
augagccugguguauacugagaagcuggcaggggucaaacaagaagugauaaaggaauccaaag

SEQ ID NO: 344325 - RNA, 64 nt, Human
uuaugcaaaaaggaaaacacacacaaccaauaacucaaacaaaaaagggacauuuaugugcagu

SEQ ID NO: 344326 - RNA, 64 nt, Human
ugaggacuucuuccggagagggugggguggagcagcgggggagccuuggccgaagagaaccaug

SEQ ID NO: 344327 - RNA, 64 nt, Human
gaggccgcccgcgcccgccgcggccccgaucggggcgggggaauccccggagaccagccuccuu

SEQ ID NO: 344328 - RNA, 64 nt, Human
aacggggagcaggacgacgggggggcuggggguggcgggggagggugcccacaaaaagaaucag

SEQ ID NO: 344329 - RNA, 64 nt, Human
cccuggcucuucuuugcagcuccagauccuguuugcgggggaagccacacaucgcacguuuuac

SEQ ID NO: 344330 - RNA, 64 nt, Human
gaagauggaagucuggggggcacagacaaccuuaucaaacaauauaaaagccaauauaaauucu

SEQ ID NO: 344331 - RNA, 64 nt, Human
uaauauaaagaaaaaagggagaugaacaaaauugucaaacaagacugauguaccacaaguguug

SEQ ID NO: 344332 - RNA, 64 nt, Human
caauggcuuugcaagaagaugacauuucagaaaaucaaacaaaucuauauuuaauggauggacu

SEQ ID NO: 344333 - RNA, 64 nt, Human
gcguacaaugugaccuucucuaaaugcgguagauucaaacaaagaugcucuguagacaaguaga

SEQ ID NO: 344334 - RNA, 64 nt, Human
aagucacagaauuaaggaagcaccucaauuuaguucaaacaagacgccaacauucucuccacag

SEQ ID NO: 344335 - RNA, 64 nt, Human
uaacaaauauaaugauaauuggcuuuuuaaauuuucaaacaacauagauuuacucaagaugaaa

SEQ ID NO: 344336 - RNA, 64 nt, Human
gacugggaauuaacauguauuuaacacauuuugcucaaacaaucaaacaguaaaagcugaagag

SEQ ID NO: 344337 - RNA, 64 nt, Human
guuugauuauaugugacuaauauguauuuuuuauucaaacaagacuucuguacauguuucuuca

SEQ ID NO: 344338 - RNA, 64 nt, Human
ccagcaucgcggaccgcaaaggccgcccgucccgucaaacaaguuucuucuuaggcuaagaaac

SEQ ID NO: 344339 - RNA, 64 nt, Human
agugugugcgugugugugugcagaaguuuugcuuucaaacaaaugaagauacaagaggcaguag

SEQ ID NO: 344340 - RNA, 64 nt, Human
gacaaagggcuaauauccagaaucuacaaugaacucaaacaaauuuacaggaacaaacaacccc

SEQ ID NO: 344341 - RNA, 64 nt, Human
gucucagccucuccccgccgcccccaacaggcugucaaacaaaaccggagagggggugggggag

SEQ ID NO: 344342 - RNA, 64 nt, Human
gaguuccaaaauuuaaucacuaauuaaaaaucuaucaaacaaaacucuggaccagacagauuua

SEQ ID NO: 344343 - RNA, 64 nt, Human
gacugaaaguagaagucuguccgucuaugaacaugcgggggaaggauccggaaccaggacccag

SEQ ID NO: 344344 - RNA, 64 nt, Human
gacuuuugcccugcgcacaauugcaucugaaugugcgggggagagggcugggggccggagggca

SEQ ID NO: 344345 - RNA, 53 nt, Human; identical to SEQ ID NO: 218966

SEQ ID NO: 344346 - RNA, 63 nt, Human
uguguggugaccauggucaucauagugggcucacggcggaaacgggaucauucaaccuauaca

SEQ ID NO: 344347 - RNA, 64 nt, Human
cugacaaagaucuaauccagaaucuauaaagaacucaaacaaaucaacaaugagaaaaacaacc

SEQ ID NO: 344348 - RNA, 64 nt, Human
gcgagccaccgcgcccggccccuaaguuaauauuucaaacaaucgaagguaaaacaacauauug

SEQ ID NO: 344349 - RNA, 64 nt, Human
cugccuuccaccccccaaccaggccugagacugaucaaacaauaaacacguuucccacucugag

SEQ ID NO: 344350 - RNA, 64 nt, Human
auuaguuuacagugaaauguuaucucagggacauucaaacaaaggaggaggagucauagggaag

SEQ ID NO: 344351 - RNA, 64 nt, Human
ucugucucaggcagggcaucauucaguaauuagcucaaacaaaacaucucaaguccccaaaacc

SEQ ID NO: 344352 - RNA, 64 nt, Human
caaaaaguuuuaaaaaaauuguugagucaaaaagucaaacaauaaagaaauuaagauuucuugg

SEQ ID NO: 344353 - RNA, 64 nt, Human
accgugccuggacuuuccauuauuuuuuguucuuucaaacaaucccauaauauuucccuugcac

SEQ ID NO: 344354 - RNA, 64 nt, Human
auaaccaguauguguauuucuucuuccuuuaugcucaaacaaccuguacacagaaagcauuuuu

SEQ ID NO: 344355 - RNA, 64 nt, Human
cauagagugacuccaagaacaauuguccauggucucaaacaaggggcuguuacauaacaagaaa

SEQ ID NO: 344356 - RNA, 64 nt, Human
caacacaccuggugaagaguaguuuacuagcuuuucaaacaagaaugucccuuuuccuaaguca

SEQ ID NO: 344357 - RNA, 64 nt, Human
uuuugguucugauuuacaaauuaaugaaguaguuucaaacaacgcggucauguuuaccucucca

SEQ ID NO: 344358 - RNA, 64 nt, Human
ucaguguguuugacaagacagcuugauauuucuaucaaacaaaugacuuucauauugcaacaau

SEQ ID NO: 344359 - RNA, 64 nt, Human
gaucucagcucacugcaaccuccaucuccuggauucaaacaauucuccugccucagccuccaga

SEQ ID NO: 344360 - RNA, 64 nt, Human
gaguaguuuuuuuuuuuuuuuuuugguggggggagcgggggacagggucuuacucugucacuca

SEQ ID NO: 344361 - RNA, 64 nt, Human
ucauucuucuucuucuuuuuuuugggggggcggggcgggggagggaucucaaaguuuuagucuu

SEQ ID NO: 344362 - RNA, 64 nt, Human
caccaucuuucuuuuaaggcuguuccugggccuggcgggggaggcaggggugagaggauggaau

SEQ ID NO: 344363 - RNA, 64 nt, Human
ccaagucuugucaauaacuugcuguguggaagcagcgggggaagaccuagaacccuuuccccag

SEQ ID NO: 344364 - RNA, 64 nt, Human
gaacaccucuauuuuuaaaaggacuuuaacgaagucaaacaacuuauaagacuagugauucacu

SEQ ID NO: 344365 - RNA, 64 nt, Human
acagguuaaugugaguugaggaagacagucuuucucaaacaauacuacauaccuuuuauuauau

SEQ ID NO: 344366 - RNA, 64 nt, Human
agguuuuucuagagagcuaagugggauguguagcucaaacaaacuguccuacccuuuuuuauuc

SEQ ID NO: 344367 - RNA, 64 nt, Human
aaaacagugccaagaauuuugcugaaugaaacaaucaaacaaagcauuuuaagguguaaguuau

SEQ ID NO: 344368 - RNA, 64 nt, Human
gauuuuuuucacuggaagggaucccugaaguacaucaaacaaaggcauuggauuuggauccguc

SEQ ID NO: 344369 - RNA, 64 nt, Human
aguauuguuuacauuaaacucccuuucauguuaaucaaacaagugaguagcucacgcagcaacg

SEQ ID NO: 344370 - RNA, 64 nt, Human
gacagcaugacuggacagcgguuguaaauacaauucaaacaauucaaucaaagcuaccuuuuuu

SEQ ID NO: 344371 - RNA, 64 nt, Human
cgcugucaaggaaccguuucuauacauuuuuaccucaaacaacaggaccucgguucaugucccu

SEQ ID NO: 344372 - RNA, 64 nt, Human
cguaucuuuccuaggcagaucacguugcaauggcucaaacaacauuccaccccagcaggacagu

SEQ ID NO: 344373 - RNA, 64 nt, Human
aggggcugccuuuccuuuguguguauuaagcuuuucaaacaauggaggggauggagagcccugg

SEQ ID NO: 344374 - RNA, 64 nt, Human
aagggugguuuggaugaagucugacuacuuuuuuucaaacaaacuauuauauuaaaacugucau

SEQ ID NO: 344375 - RNA, 64 nt, Human
uccuaaaacuggcuuauccuugaguguuuacaacucaaacaacuuuuugaaugcaguaguuuuu

SEQ ID NO: 344376 - RNA, 64 nt, Human
ccaugugauaauuguaaaggugaugaauuuaccaucaaacaaaucauuuugauguauuauuaua

SEQ ID NO: 344377 - RNA, 64 nt, Human
cauuugauuugaaaaauccguauccucugcuucuggugaacauuggcucagggguuagcaucuu

SEQ ID NO: 344378 - RNA, 64 nt, Human
uuuucuacccagauaaggaggguuccugcccccaggugaacauuaacuuuccccagcucggccu

SEQ ID NO: 344379 - RNA, 64 nt, Human
agauaacuggaggauucagcacugaugcagucguggugaacaggaggucuaccuaacgcacaga

SEQ ID NO: 344380 - RNA, 64 nt, Human
ccuuuucucuaccucgcagggcucagcagcacccggugaacagcagcaggaggagccgcuagag

SEQ ID NO: 344381 - RNA, 64 nt, Human
ucccauguggcaagaaaggagacagugaauuuugucaaacaauaaaaaugugucaggaacacaa

SEQ ID NO: 344382 - RNA, 64 nt, Human
aaugcaguucagccccacucccucuccaugcccaucaaacaacugcacaaucacuuguuacuga

SEQ ID NO: 344383 - RNA, 64 nt, Human
uuauucuuuuguuucuuuuaucugacugacucugucaaacaagugucaaaguuguguguuaaaa

SEQ ID NO: 344384 - RNA, 64 nt, Human
ugucucuugcuuaccucaaaggccguugggaagaucaaacaauauuggaugugauugaacuuua

SEQ ID NO: 344385 - RNA, 64 nt, Human
ucuuuuuuugaucacuuacuuucaaagcacacagucaaacaagguuaugccaaauuuccaggcc

SEQ ID NO: 344386 - RNA, 64 nt, Human
augcaaggacuuacacuaaccuccuggcuguaaaucaaacaaggugacugaaaguggcauuuau

SEQ ID NO: 344387 - RNA, 64 nt, Human
uuuguaaaaaauaaaaauguauauagcugugagcucaaacaaaaacugcagacaaacaaaaaag

SEQ ID NO: 344388 - RNA, 64 nt, Human
accuuuuguuugucccauugguggcagaugugagcgacaucaggcgcuuccucagugcauuuca

SEQ ID NO: 344389 - RNA, 64 nt, Human
ccgauuccaacacaggcuccucuuucccccuucccgacaucagcagaaggcagcaucccugcau

SEQ ID NO: 344390 - RNA, 64 nt, Human
cccucacaugggcagaaaaaugguggucauuggccgacaucacaguuuuccuguuucccaccca

SEQ ID NO: 344391 - RNA, 64 nt, Human
uggaaaagccuucagcuauaacucuucacuuagucgacaucaugaaauacacaggaggaacgcc

SEQ ID NO: 344392 - RNA, 64 nt, Human
caucuagccucaagcucuggcugaacuuuguggucgacaucaaucuaaagauacagugucugac

SEQ ID NO: 344393 - RNA, 64 nt, Human
aaugucaaauguuuuuaauacucagaugugggagcgacaucaaugaaaucuguacuguaugaaa

SEQ ID NO: 344394 - RNA, 64 nt, Human
uauguggugaaaaugcacaggagcuugguagacugcgggggaaagagagagcuccuuucgccau

SEQ ID NO: 344395 - RNA, 64 nt, Human
aaaaacaaaaaccccacaaaauaccccaacacaggcgggggagagacgaaaaagaaaaggaaag

SEQ ID NO: 344396 - RNA, 64 nt, Human
gacugcaaggcugucuccuuaaggcacugagugggcgggggaggcugggagccggcggcaggau

SEQ ID NO: 344397 - RNA, 64 nt, Human
cagaaucuaagaccuuucagcuucgagccagggggcgggggaucccgagcaaaagccuuccgug

SEQ ID NO: 344398 - RNA, 64 nt, Human
aagagauauuuugggcaugugggcuucaacuccucgacaucacuguucaugcuggcgagugaau

SEQ ID NO: 344399 - RNA, 64 nt, Human
gcagaacaucagaaaaagcaagaagaagaaaaggcgacaucaagaaggaaaggucucagaugaa

SEQ ID NO: 344400 - RNA, 64 nt, Human
agcaaaugguggcaaagcagacucaaugcacugucgacaucauugccuguuuuuuuuuuuuuuu

SEQ ID NO: 344401 - RNA, 64 nt, Human
ggcaguacaagcgcugcggugucaccucugugcccgacaucagacgcugccagcugacccccaa

SEQ ID NO: 344402 - RNA, 64 nt, Human
gggaggagaugcaggaugcccacgucauccugaacgacaucaccgaggaguguaggcccccauc

SEQ ID NO: 344403 - RNA, 64 nt, Human
ggccuuccuuaggcuggcuacuugucaccaucaccgacaucacuguugccugcaaggacaccac

SEQ ID NO: 344404 - RNA, 64 nt, Human
uuggcagcacuccacucaccuucagcuccugcaccgacaucaggaacccacggccaccaccucc

SEQ ID NO: 344405 - RNA, 64 nt, Human
cugucucaggaaggguaagguucucagacacugccgacaucagcauugucucguguacagcucc

SEQ ID NO: 344406 - RNA, 64 nt, Human
guaacucgagguggaggguagcccuggggccccucgacaucaccgucauugauggagccugaac

SEQ ID NO: 344407 - RNA, 64 nt, Human
agcccuagguccuuccugccccaucacucacuuacgacaucacuuccauugugugcauguuugu

SEQ ID NO: 344408 - RNA, 64 nt, Human
aucuuugguagccguccaugucuggaggacaagucgacaucaccauguguuacuggccuggaaa

SEQ ID NO: 344409 - RNA, 64 nt, Human
uuggagcagggguccaaggaagagaggguggccucgacaucaaacugccuggauuuuucuacca

SEQ ID NO: 344410 - RNA, 64 nt, Human
gcuacuuaauaaucacucuuguugauaucucugccgacaucauagaaauuguucaagugucagu

SEQ ID NO: 344411 - RNA, 64 nt, Human
gacauuggaaccuuggagaaugucuucacagccccgacaucaacuccuucuagcauccagcaag

SEQ ID NO: 344412 - RNA, 64 nt, Human
cccaacaccuugggaggccaaggcaggcagaucacgacaucaggagaucgagaccauccuggcu

SEQ ID NO: 344413 - RNA, 64 nt, Human
aaucucaccacagauaaugguuaacgaaccgggucgacaucacaaaggaggguggagacucuuu

SEQ ID NO: 344414 - RNA, 64 nt, Human
acucucaaggaagcuaauuuucuuucuggggggggcgggggacacagugucacuaugucaccca

SEQ ID NO: 344415 - RNA, 64 nt, Human
ucuggugucucuuuaccaggggcagugccucucugcgggggaggaaaagcucaagguuagcugu

SEQ ID NO: 344416 - RNA, 64 nt, Human
ggggcgauuagcuuagugagcuuaccccgccggagcgggggagcgcuagagguaguuggguaga

SEQ ID NO: 344417 - RNA, 64 nt, Human
agugauauaccuuaauuuagugggcuuuggcagggcgggggagggggaacguucauuaaucucu

SEQ ID NO: 344418 - RNA, 64 nt, Human
aaaacccuaaagcauuaguugcucaaacuuuguucgacaucagggaauuuguauuggagaaaaa

SEQ ID NO: 344419 - RNA, 64 nt, Human
aaaaagggacauguguccugugggucccugcagucgacaucauguuuggcugggcaucgaugcc

SEQ ID NO: 344420 - RNA, 64 nt, Human
uuucagauccgaauucagaggccucagguaaugacgacaucauuuuaaggcauggagcugagaa

SEQ ID NO: 344421 - RNA, 64 nt, Human
guccccaauugagaaugucuugcuugauugaaaacgacaucaucccuugguauacuccagggau

SEQ ID NO: 344422 - RNA, 64 nt, Human
guaauaauaaaacucagcauaguagcaaaaagaacgacaucaguuuaaaggcacaauacuuaau

SEQ ID NO: 344423 - RNA, 64 nt, Human
aauaacucauuuaauaaaauaguacuuugauuuacgacaucacaggauaaaugguuuuagaaau

SEQ ID NO: 344424 - RNA, 64 nt, Human
cgggcugguuggucuugaaggcccuuuuccaugccgacaucaugucacucuaggccugggguuc

SEQ ID NO: 344425 - RNA, 64 nt, Human
auaauuuucacuauaccucuaaaaccaauuguaccgacaucacguagacaaaaacuccagauaa

SEQ ID NO: 344426 - RNA, 64 nt, Human
gacccuaaaguuaguguggugcuccaagcagagucgacaucauggaaugaaccaaaucuggcag

SEQ ID NO: 344427 - RNA, 64 nt, Human
gcccaggggccguggugacucacgggcagggaggcgacaucaggcugguucugccacugagccc

SEQ ID NO: 344428 - RNA, 64 nt, Human
gucucacucugucacccaagguggagugcagugacgacaucacagcucacugcagccucaaccu

SEQ ID NO: 344429 - RNA, 64 nt, Human
agcgcacgcucaucaaggccuauggcauccgcuucgacaucauuguguuugggaagguagcucg

SEQ ID NO: 344430 - RNA, 64 nt, Human
ccaugaagguggauauggacaucugccgccgcaucgacaucaccgccaagcucugcgauguggc

SEQ ID NO: 344431 - RNA, 64 nt, Human
aauacaaugauuaccuagaagugcaagaaaugaccgacaucacguggcucaacucccccaguca

SEQ ID NO: 344432 - RNA, 64 nt, Human
ggauggggguuggaguuucagguuuaugucuucccgacaucacuuuuaucauucaugaaauugu

SEQ ID NO: 344433 - RNA, 64 nt, Human
gggggccgggcaggagccucuggggccuccacuccgacaucaggaccugagaugaccgcugugu

SEQ ID NO: 344434 - RNA, 64 nt, Human
ggagcacccgugucuuacgauggacagugauaaaggugaacacacagagacagacuauucucua

SEQ ID NO: 344435 - RNA, 64 nt, Human
gccuggacuucugugcaagaaagggagaccuaagggugaacaguggccaauaaaaacccuagag

SEQ ID NO: 344436 - RNA, 64 nt, Human
gagccagcccggggacuguccuggguggagggcaggugaacacaagcugcugccggggacuguc

SEQ ID NO: 344437 - RNA, 64 nt, Human
agcugcugccggggacuguccuggguggacggcaggugaacacaagcggcugccgcauguagcc

SEQ ID NO: 344438 - RNA, 64 nt, Human
gaggaaacagaaacucccaacuguccuuacccaccgacaucacagccccuaugaagaaaguagc

SEQ ID NO: 344439 - RNA, 64 nt, Human
gcacaggagacaagugcguucagggcacaggccccgacaucaccccaaggacaacggcacaagu

SEQ ID NO: 344440 - RNA, 64 nt, Human
gcacaggagacaagugcauuuagggcacaggccccgacaucaccccaaggacaacggcagaagu

SEQ ID NO: 344441 - RNA, 64 nt, Human
gaaaauuccgucugugggauuuuuagacauuuuucgacaucaggguauuuguuccaccuuggcc

SEQ ID NO: 344442 - RNA, 64 nt, Human
ggcagcgcugccuccugcccacauuccugccacccgacaucaaagcuggcgugugaccuuucca

SEQ ID NO: 344443 - RNA, 64 nt, Human
ucauuuucugguccucgcgacugagagccaggggcgacaucaugaccuucugucccggccgccu

SEQ ID NO: 344444 - RNA, 64 nt, Human
cacuugaauucaggagguggagguugcagugagccgacaucaugccacugcacuccagccuggg

SEQ ID NO: 344445 - RNA, 64 nt, Human
cucuugcccagggaacucuuccacaggacaaagccgacaucaagacucaacuccucuaaccggu

SEQ ID NO: 344446 - RNA, 64 nt, Human
caguaagucuuuuaaauaucaggaaggagagaagcgacaucaugauacauccuauggguauuaa

SEQ ID NO: 344447 - RNA, 64 nt, Human
cucagcccuccgaguagcugggaccacagguguacgacaucaugacuggcuaauuuuuguauau

SEQ ID NO: 344448 - RNA, 64 nt, Human
caggucuaugacccgcucugcccacggcuguguacgacaucagaccaggcacucucagggccgc

SEQ ID NO: 344449 - RNA, 64 nt, Human
ugcagccucccacaugccuuaaggggaccguggcccccaccagggacguccugcgccauccguu

SEQ ID NO: 344450 - RNA, 64 nt, Human
gaagcagcucacagaguuuaaacuauuuucuuguccccaccaccuuccaagaaccugcgagggu

SEQ ID NO: 344451 - RNA, 64 nt, Human
gagcacagacuucuaguuggcaggagcugaggagggugaacaaaccccgagggaggcccggccc

SEQ ID NO: 344452 - RNA, 64 nt, Human
uuaucuuuaccaaaaaccauguugcguucaaagaggugaacauuaaaauauagagacaggacag

SEQ ID NO: 344453 - RNA, 64 nt, Human
cugccauagacacgggggaagcuugcggagcccaggugaacaagcucagcaaucggacaucucu

SEQ ID NO: 344454 - RNA, 64 nt, Human
auccagugggggugacugggugcacaccugcccaggugaacacagcggcugccagucuccuggu

SEQ ID NO: 344455 - RNA, 64 nt, Human
gaacuacauucuuuaccccuuguuuuaauuugaaccccaccauauggauuuuuuuccuuaagaa

SEQ ID NO: 344456 - RNA, 64 nt, Human
acaaaaaaaacaaaaagaaauguagauucuugggccccaccaccccacgccuacugagccagaa

SEQ ID NO: 344457 - RNA, 64 nt, Human
agggcccaggaucaagucacucaucucagaauguccccaccaauccccgccacagcaggcgccu

SEQ ID NO: 344458 - RNA, 64 nt, Human
aggucugcccugcuugcaaauccacuagcaccgaccccaccaccugguuccggcucugcacgcu

SEQ ID NO: 344459 - RNA, 64 nt, Human
augacccugcgaaggggcccugguccuuccaggcccccaccacuaggacucugaggcucuuucu

SEQ ID NO: 344460 - RNA, 64 nt, Human
aacagugugucuguguguucccaaauccagcuggccccaccagcucagauuccauuuuuuuugu

SEQ ID NO: 344461 - RNA, 64 nt, Human
acuggccagucugcauccuugccuagaccauucuccccaccagauggacuucuccuccagggag

SEQ ID NO: 344462 - RNA, 64 nt, Human
gagaaagugugugauuucucucccaccuccuuccccccaccagaccuuugcugggccuaaaggu

SEQ ID NO: 344463 - RNA, 64 nt, Human
ugaggccuuaucugaugccucugcaguucaugucccccaccaggccucgaggcucaggguggga

SEQ ID NO: 344464 - RNA, 64 nt, Human
caggaggucaggggauucuguuuugguuugucuuccccaccacccuuuuuuuucauuuccccug

SEQ ID NO: 344465 - RNA, 50 nt, Human
accuggcccccaggacguagccccaccaagccucucucucuggaccccca

SEQ ID NO: 344466 - RNA, 64 nt, Human
aagagcagcccucuggugggcgggaaaccaguguccccaccaucagccaccacacaccucugcu

SEQ ID NO: 344467 - RNA, 64 nt, Human
accucaagaagauucugaaaauccuacccccaccccccaccagccgcacagauuguacuaccgc

SEQ ID NO: 344468 - RNA, 64 nt, Human
acaauguuucaaguuaaaccuuuugugucaccgcccccaccaaccaccaccuccuaaauccuga

SEQ ID NO: 344469 - RNA, 64 nt, Human
caccccaccuaaggccaucuagugccaacuccccccccaccauuccccucacugcacuuuggac

SEQ ID NO: 344470 - RNA, 64 nt, Human
gacuguccuaguucauugcugcagugcucccaucccccaccagguggcagcacagccccacugu

SEQ ID NO: 344471 - RNA, 64 nt, Human
ccaaucaggugugggacauccagaaccugcagaaggugaacaccauccgggcccaugacaaccc

SEQ ID NO: 344472 - RNA, 64 nt, Human
gcaaaagcagaaacgugaagccgugauacaaauuggugaacaaaaaaugcccaaggcuucucau

SEQ ID NO: 344473 - RNA, 64 nt, Human
guauuagaaacuguugucuacaccacuuuuaauuggugaacaauuuuucuaaguuauggucaua

SEQ ID NO: 344474 - RNA, 64 nt, Human
cacuucugagaugugacgagacuuuugaaaaaauggugaacacacucuuggagagguaaauagu

SEQ ID NO: 344475 - RNA, 64 nt, Human
aggcauugucacccuagaccccucuuccucucucccccaccauagugugcaauaaagugucugu

SEQ ID NO: 344476 - RNA, 64 nt, Human
agucgccccuggaagcagauucccauugaguuuuccccaccaaggggaccaugcacaugguaga

SEQ ID NO: 344477 - RNA, 64 nt, Human
cgggccuguggugggaagacgggcaacaaguauaccccaccagggccugagugacuagaggaag

SEQ ID NO: 344478 - RNA, 64 nt, Human
uacuuuaaccuggcuuuuaaagcaguaguaacugccccaccaaaggucuuaaaagccauuuuug

SEQ ID NO: 344479 - RNA, 64 nt, Human
uaacggauguuuccaccuccuucuccaaccucuaccccaccauuaguguauuuuacuauaaaaa

SEQ ID NO: 344480 - RNA, 64 nt, Human
uccuugcuaaucugagcuacuuagaguguggucuccccaccaacuccaguuuugugcccuaagc

SEQ ID NO: 344481 - RNA, 64 nt, Human
agagggugaaaaagagaaaugugagcauccgcucccccaccaccccgcccagccccuagcccca

SEQ ID NO: 344482 - RNA, 55 nt, Human
guucugggggaagccagugauccagccccaccaaggggccuccagagaccccagg

SEQ ID NO: 344483 - RNA, 64 nt, Human
uccauaaccccacccuugcccaccccacccccacccccaccaagggcgcaagaguagcggucca

SEQ ID NO: 344484 - RNA, 64 nt, Human
gcuggauuaaugguagcagggaacugccuccucuccccaccagcaccauggcuggcaucgcuca

SEQ ID NO: 344485 - RNA, 64 nt, Human
cuuucuugacuuccccuucagcuucagaccccuuccccaccaggcuaggccccccacaccuggg

SEQ ID NO: 344486 - RNA, 64 nt, Human
gcucucugucaggugugauaaaauguugaacccuccccaccaccacuuuuuuuuuuuuaaacca

SEQ ID NO: 344487 - RNA, 64 nt, Human
ccauggggacauuaauaguccaaggcauucccucccccaccacuauucauaaaguauuaaccaa

SEQ ID NO: 344488 - RNA, 64 nt, Human
uggacuccagcucuacgucccacauuuuagaauaccccaccagcagaacaaacucagaucucau

SEQ ID NO: 344489 - RNA, 64 nt, Human
uaacuacauaaaaauguuuauaggacaagaaaaaccccaccauaacccaaggcaaacaauguau

SEQ ID NO: 344490 - RNA, 64 nt, Human
ccccucccuuacuccucccucugcugccuccuccccccaccaaguuucagggcccuggauuguu

SEQ ID NO: 344491 - RNA, 64 nt, Human
cccucgccuuuuuuucugguuuagucaaauaacgggugaacauagaaaccuguugggaagaaua

SEQ ID NO: 344492 - RNA, 64 nt, Human
guguguuuauacuguguauuuuuuuuaaauucacggugaacagcacuuuuauuauuuccaguuc

SEQ ID NO: 344493 - RNA, 54 nt, Human
ccaggaacuuccugcgcuagcugggcgggggaggggcggccugcccucaucuca

SEQ ID NO: 344494 - RNA, 64 nt, Human
uuguuuuuguuuuuuuuucuccuuuuauuuuuuugcgggggaggguagggaguggguggggggg

SEQ ID NO: 344495 - RNA, 64 nt, Human
gcaggugaaugggugcccuacggggcccuccuucccccaccaggaacagauggaaccugccacc

SEQ ID NO: 344496 - RNA, 64 nt, Human
acacagcugucaggaaaugaaucuuccccccaacccccaccaugcagauggauagacagaaucu

SEQ ID NO: 344497 - RNA, 64 nt, Human
auggggguucagcugugcccgcccccaggcugugccccaccacagauucugccaaggaucagaa

SEQ ID NO: 344498 - RNA, 64 nt, Human
agagaugaucauuggaagcaaucaguuuacucuuccccaccacagugguuaaaaggcguuugua

SEQ ID NO: 344499 - RNA, 64 nt, Human
ucuaggcucagacaggcaucaacaaaccuauucaccccaccaucauccugaucuaaccauuccc

SEQ ID NO: 344500 - RNA, 64 nt, Human
gaaaguaugaccuggaauucaaguuucucgacgaccccaccagguacaucucaccugacugucu

SEQ ID NO: 344501 - RNA, 64 nt, Human
ccuuccuccuuacccucccucccuuacucuccccccccaccaccacccuccacccccaacucau

SEQ ID NO: 344502 - RNA, 64 nt, Human
ggcgucggcgcggggccagagcaccacucugcugccccaccacgcggccugugaggagccacua

SEQ ID NO: 344503 - RNA, 64 nt, Human
cugucagcagaugaagcugggauggaggcucugaccccaccaccgguaagaaccucacugugug

SEQ ID NO: 344504 - RNA, 64 nt, Human
cccucgggggccucucccaggguccagccugagcccccaccaggggucucugcccagcacagga

SEQ ID NO: 344505 - RNA, 64 nt, Human
ucaacauacgccguuccaccaauuuuuuuuuuagccccaccagcuucaggacuucugccaauuu

SEQ ID NO: 344506 - RNA, 64 nt, Human
aaaggcagcucaccccugggcaggcgguccccauccccaccagcucguuuuucagcacccccac

SEQ ID NO: 344507 - RNA, 64 nt, Human
ugagguaaauaauuucugccaggaaacuucccagccccaccagcagccccccuaaaaaaaucac

SEQ ID NO: 344508 - RNA, 64 nt, Human
cagauuugagucagaacuggaaagugucccccacccccaccacccucgagcgggguuccccuca

SEQ ID NO: 344509 - RNA, 64 nt, Human
agcuccuccccugccgccucccgggaagcauccuccccaccagagcugccuccccaauccauuu

SEQ ID NO: 344510 - RNA, 64 nt, Human
ucaacaccacccugcuguccaguccccagccuggccccaccagcccaagccugggacugggccu

SEQ ID NO: 344511 - RNA, 64 nt, Human
uuguaccaggaacuuuucuuagucuuuggguaaaggugaacaagacaacuacaguuccugccuu

SEQ ID NO: 344512 - RNA, 64 nt, Human
augcuucucagccaaguggcgguagcacagauguggugaacaaugacgaauugaggcagggaau

SEQ ID NO: 344513 - RNA, 64 nt, Human
ggaucaccugaggucaggaguucaagaccagccuggugaacauggcgaaaccccgucucuaaua

SEQ ID NO: 344514 - RNA, 64 nt, Human
cuaguuaggccacgcuccucuguucagucgcaaaggugaacacucaugcggcccagccaugggc

SEQ ID NO: 344515 - RNA, 64 nt, Human
ccucggggacccaaguggggcuuucaacccucucccccaccacccagcccacugcacugaaaug

SEQ ID NO: 344516 - RNA, 64 nt, Human
cuuccaauugacccaucuaucugccaccauguugccccaccaggagcucagcucuguggaguuu

SEQ ID NO: 344517 - RNA, 64 nt, Human
aaaugccaauaauaaaugcccucuucucgugccuccccaccaccacuuaccacucgugcauccc

SEQ ID NO: 344518 - RNA, 64 nt, Human
caucugugggaagggagucccuggcuuauacugcccccaccacagcuccuugcccuggccagaa

SEQ ID NO: 344519 - RNA, 64 nt, Human
uauucaauaaaugauaguuucuacagauccuucuccccaccacccuccacaguccuugauccag

SEQ ID NO: 344520 - RNA, 64 nt, Human
guggauucguauuuuuuaaaguucaguugacuuuccccaccaaaugguccauuugaaugcaucc

SEQ ID NO: 344521 - RNA, 64 nt, Human
cccaugaugggguggagucagcccugcuuccccuccccaccagcagggggcgcacuggugucug

SEQ ID NO: 344522 - RNA, 64 nt, Human
agucagugacugguggguuugaaucugcacuuauccccaccaccuggggacccccuuguugugu

SEQ ID NO: 344523 - RNA, 64 nt, Human
gaaaccccugcuggaaaccugagugacccucccuccccaccaagaguccacagaccuuucaucu

SEQ ID NO: 344524 - RNA, 64 nt, Human
cccuuuuccuuucccaugaacccuggagggugguccccaccagcucuuuggaagugagcagaug

SEQ ID NO: 344525 - RNA, 55 nt, Human
guuccgggggcagccagugacccagccccaccaaugggccuccagagaccccagg

SEQ ID NO: 344526 - RNA, 64 nt, Human
gcaccucaucaccaucccucuucuuggccccaucccccaccaccauuccuuuccucccuucccc

SEQ ID NO: 344527 - RNA, 64 nt, Human
ggugguuacuuaaggccccaaucuaccaagucuuccccaccacuucucccuuguuuucccccuc

SEQ ID NO: 344528 - RNA, 64 nt, Human
acucagguucuucagggccaguccuccugggagcccccaccacaaacuucugcuggggauuuga

SEQ ID NO: 344529 - RNA, 64 nt, Human
ccucccuggcagccaggaccagcaccuguagucaccccaccacacgcagacucaugcacgcaca

SEQ ID NO: 344530 - RNA, 64 nt, Human
agcuuucagggacagugggcaagaggacacccccccccaccaccucaguggaacacaccauucu

SEQ ID NO: 344531 - RNA, 64 nt, Human
uauaaaagucccugauaaaaguuuuguuuacuggggugaacaucuuuccaguaaccagguaguc

SEQ ID NO: 344532 - RNA, 64 nt, Human
uuuaaaacaggauucuugcuucuguagucaucaaggugaacagaagcauccuacacaaccacua

SEQ ID NO: 344533 - RNA, 64 nt, Human
cucaucuguggcgccucagagggucagcaucauuggugaacagaugcaggcgcugcuggaccau

SEQ ID NO: 344534 - RNA, 64 nt, Human
cagcgggacucuucucauccuuccucauuugcaaggugaacacuuccuucuagggagcacccuc

SEQ ID NO: 344535 - RNA, 64 nt, Human
agagggggaugcucucauccccucuuucuguaccccccaccauuuucacuggcuggggggcucu

SEQ ID NO: 344536 - RNA, 64 nt, Human
aaacaaagacccuucgguguccaucuacaguaaaccccaccauuaccuucuaguuggcauaaaa

SEQ ID NO: 344537 - RNA, 64 nt, Human
cacaauguggacgugcacugacagccuugcccacccccaccaugcagccccugggcccuugugc

SEQ ID NO: 344538 - RNA, 64 nt, Human
cuacagcuaagccuguuugaaugauacguagguuccccaccaaaagcaggcuuucugcccugag

SEQ ID NO: 344539 - RNA, 64 nt, Human
auauucuuuaaauuucaucucaggccucccucaaccccaccacuucuuuuauaacuaguccuuu

SEQ ID NO: 344540 - RNA, 64 nt, Human
ggcugauaggacccccuuccggggguccccuucaccccaccaggcuugggaggaagugccugca

SEQ ID NO: 344541 - RNA, 64 nt, Human
ccccuacccccaacuuuccccuacccccaacuuuccccaccagcuccacaacccuguuuggagc

SEQ ID NO: 344542 - RNA, 64 nt, Human
ccaaggugugugugucuggaggaaccacugcccaccccaccaccccggggucucuggggaacug

SEQ ID NO: 344543 - RNA, 64 nt, Human
cugaaccccguuugccuguccacacccccucgcuccccaccauuuuuccugaccggccuguguc

SEQ ID NO: 344544 - RNA, 64 nt, Human
cauacugucucuggagugaugguguccuucccugccccaccacgcaugcucagugccuuuuggu

SEQ ID NO: 344545 - RNA, 64 nt, Human
gcacuuuuauuuaacauuauucauauaauucuccccccaccacuuuauuuauagauacugcaaa

SEQ ID NO: 344546 - RNA, 64 nt, Human
cugcaucugcugaagcgagaaccccauucugccaccccaccaggaugcccauucuccaggacuu

SEQ ID NO: 344547 - RNA, 64 nt, Human
aggguaggagagagccuggaucucuggccccaacccccaccagaccucaugcccuggacacugc

SEQ ID NO: 344548 - RNA, 64 nt, Human
cagagaugggagguggugaggcguccucaccuccccccaccacagcuguggcugguaaggcaac

SEQ ID NO: 344549 - RNA, 64 nt, Human
aguaaaaaaugaggugggagggcuggaucuuuucccccaccaaaaggcuagagguaaagcugua

SEQ ID NO: 344550 - RNA, 64 nt, Human
cccaacgcuccaaagucauaauugcauugacuuuccccaccagaugcugaaaauguccuuguga

SEQ ID NO: 344551 - RNA, 64 nt, Human
agguggggaccgcagucagggucaccuggaccauggugaacaugugaccugcagaucuggcauc

SEQ ID NO: 344552 - RNA, 64 nt, Human
guuuuacauuaaaaccccagaauggcugcagaggggugaacaggccccaauauuuggggugcug

SEQ ID NO: 344553 - RNA, 64 nt, Human
ucagguguaugguaguaaguaaauguauuaacauggugaacaguaguaauauucuaucauagag

SEQ ID NO: 344554 - RNA, 64 nt, Human
guggccgggcacuaaacacccgccugccugccagggugaacacacagccagcuuaucccucuua

SEQ ID NO: 344555 - RNA, 64 nt, Human
cuggaaaucacagcaacccauugaaaacugcccuccccaccagaacgugcuacguucuuucuuc

SEQ ID NO: 344556 - RNA, 64 nt, Human
gugcucccugaagcuuuccuaauauugcugugcuccccaccacccccauggcagucccuccgca

SEQ ID NO: 344557 - RNA, 64 nt, Human
cagcaccagcaaacucuggacugguggaagaauuccccaccagaucuccuugaagcagaauuag

SEQ ID NO: 344558 - RNA, 64 nt, Human
uuugugaucccuucuuacuuaauccuccuugccaccccaccaucaccagaccacugaucugcuu

SEQ ID NO: 344559 - RNA, 64 nt, Human
guguuuugucaaagcagguuauucagugauuccuccccaccauucuuaagaacguuaaauaaug

SEQ ID NO: 344560 - RNA, 64 nt, Human
gccacacucagugccauggggaagcgggcgucucccccaccagccccaccaggcgguguagggg

SEQ ID NO: 344561 - RNA, 64 nt, Human
agugccauggggaagcgggcgucucccccaccagccccaccaggcgguguaggggcagcaggcu

SEQ ID NO: 344562 - RNA, 64 nt, Human
ucugugaucgccggacaguccaggccugucugaaccccaccacucacuucugugggcucuagga

SEQ ID NO: 344563 - RNA, 64 nt, Human
ucuuccuucuuaaucccauggcugguggccacgcccccaccaucaucagcugggaggaaaggca

SEQ ID NO: 344564 - RNA, 64 nt, Human
cugcucaccuggguuuacugaugacuccuggcugccccaccauccucucugaucugugagaaac

SEQ ID NO: 344565 - RNA, 64 nt, Human
ucucaggcccuuuuuagucccuuuccaaagcugcccccaccacccugcuccucuggccucagug

SEQ ID NO: 344566 - RNA, 64 nt, Human
agacggcggggggcagcaggaacuuugccucauaccccaccaaccccugcuuccccuucucggu

SEQ ID NO: 344567 - RNA, 64 nt, Human
aauuuuuuggcacuugccauuccaaaauauuaugccccaccaaggcugagacagugaauuuggg

SEQ ID NO: 344568 - RNA, 64 nt, Human
aguggcgguguccaggggcgccccgccccugcggccccaccagguacugaaagacccgcaggcu

SEQ ID NO: 344569 - RNA, 64 nt, Human
aggggccucagggcuugugggggguaggcugagaccccaccaccaaagguuaagugaggucccc

SEQ ID NO: 344570 - RNA, 64 nt, Human
gggugggcgucuuccugccccaugcuccccugccccccaccaccugccugcuugcuucucuggc

SEQ ID NO: 344571 - RNA, 64 nt, Human
aaaaauguauacuggggaaaaguuguaugaagguggugaacaugggagacuuuuagcaaugaug

SEQ ID NO: 344572 - RNA, 64 nt, Human
cagggguggagaaaaggcguuggucgcagugauuggugaacacagcgggggugggugguagcgc

SEQ ID NO: 344573 - RNA, 64 nt, Human
cugugagugcuggggccaguggggcuggggaccggcgggggaccggcagagcccaccugggggc

SEQ ID NO: 344574 - RNA, 64 nt, Human
caccaucgcaccaacacuccaccgcgaucugccugcgggggaucucagcgcagagaaguugaga

SEQ ID NO: 344575 - RNA, 64 nt, Human
accuuuaucuugccugacaugcugggaaucuucaccccaccagggcaaauuuccaaauagcuca

SEQ ID NO: 344576 - RNA, 64 nt, Human
ugucaaucccggagcaacuuucccaacuacccaaccccaccauggccaggacaugugcaaugcc

SEQ ID NO: 344577 - RNA, 64 nt, Human
uuucugaucaugccccuucucucccaccccaucuccccaccaccaccucuguggccuccauggu

SEQ ID NO: 344578 - RNA, 64 nt, Human
aagggggaaaagccaauagaaauuuccuuagcuuccccaccauauguauuuucuaggauuugag

SEQ ID NO: 344579 - RNA, 64 nt, Human
ggucccggaggggauuuguggaccucucuugucuccccaccacuccagugcauuuccgccuggc

SEQ ID NO: 344580 - RNA, 64 nt, Human
ugugugagcaucucuguguacccacuccucacugccccaccagccaccucuugggcaugcucag

SEQ ID NO: 344581 - RNA, 64 nt, Human
uuuaauuggauuuugauaugguuuggaucuguguccccaccaaaucucacguugaaguguaauc

SEQ ID NO: 344582 - RNA, 64 nt, Human
agcacaaguggggcaaagccagcaugcaagcagaccccaccaccacagcccaccuccguccuca

SEQ ID NO: 344583 - RNA, 64 nt, Human
caccuuggaguggucaccagggggacagggagccccccaccaauguaucaaugggugauuuaug

SEQ ID NO: 344584 - RNA, 64 nt, Human
ucccgccgugccgcagcgugcccacgugcccacgccccaccagcaggcggcugucccggaggcc

SEQ ID NO: 344585 - RNA, 64 nt, Human
gagggccuuguuuccuccuccccuuuccccuucuccccaccaaaggaaaauaucccucuuaaug

SEQ ID NO: 344586 - RNA, 64 nt, Human
cacagaagcacaauggcccuucgcucucccccagccccaccaugaugcccccaugccugggcgu

SEQ ID NO: 344587 - RNA, 64 nt, Human
cagcaaugaggccugaccuuuuuugcuauaaccgccccaccacuccccugcccuugccaacauc

SEQ ID NO: 344588 - RNA, 64 nt, Human
gugugcaagcacacaucacuuuagaggggcugcgccccaccagauaggaaggggaggauuuucu

SEQ ID NO: 344589 - RNA, 64 nt, Human
caguuuuguuuguuauacucuuugcaccuuaaacccccaccacuccccgacacuauugccuucc

SEQ ID NO: 344590 - RNA, 64 nt, Human
aaaaggcaggcagugcugguuccucugccuguguccccaccacuccccagcucugucaugcagg

SEQ ID NO: 344591 - RNA, 64 nt, Human
aaguugacuuugaaucccagguacucacagaaauggugaacagacuuaguuguuacccaggcac

SEQ ID NO: 344592 - RNA, 64 nt, Human
cugaagucucucucccuucuagagguuaggacuuggugaacauguuugugggccuuuugacuga

SEQ ID NO: 344593 - RNA, 64 nt, Human
ugagcaugugugugugcauguaccggggaaugaaggugaacauacaccucugugugugcacugc

SEQ ID NO: 344594 - RNA, 64 nt, Human
gaaggcuggguccaggggagggaaaagcuaagagggugaacaaagaaaagacauugaaagcucu

SEQ ID NO: 344595 - RNA, 64 nt, Human
cuccugaggccaaagccagagacucgaacagccuccccaccaccaccagcauaugucaaggagc

SEQ ID NO: 344596 - RNA, 64 nt, Human
gccuuuccuggcugaucagagcuuaccagccccaccccaccaugguagccuuagggugcugagu

SEQ ID NO: 344597 - RNA, 64 nt, Human
aaugcaacuggcuaaaggauaguaccacccucacccccaccauaggcaggcuggaucguggacu

SEQ ID NO: 344598 - RNA, 64 nt, Human
guuuguggucuaaggaugucuugagcccugugugccccaccauucaugaccucuguauucucua

SEQ ID NO: 344599 - RNA, 64 nt, Human
gcaagggggcagaucccagagccccucucaccccccccaccacaggccugcuccuuccuuagcc

SEQ ID NO: 344600 - RNA, 64 nt, Human
ccucuccugcaucaagucugcguggccauccuccccccaccauccaagacuauuagguuuuguc

SEQ ID NO: 344601 - RNA, 64 nt, Human
cacccuccuccacagguccaggugccgcucccucccccaccacacaucagugucuccucccucc

SEQ ID NO: 344602 - RNA, 64 nt, Human
ucugcuuugggggugccccugccuccagcagagcccccaccauucacugugacaucuuuccgug

SEQ ID NO: 344603 - RNA, 64 nt, Human
uccaucucugaccacccccacccuaaccccccacccccaccauccuauuaaacauuuuuaaagc

SEQ ID NO: 344604 - RNA, 64 nt, Human
gacugcaauaggcaccagugcccaacacauacagccccaccaucauccccuucucauuuuauaa

SEQ ID NO: 344605 - RNA, 64 nt, Human
ccaacuucugccuguggagagauuuucugcccugccccaccagggcccugcauguuggagacug

SEQ ID NO: 344606 - RNA, 61 nt, Human
agaccugugacuccgacugaggcaugcccugccccaccacucgcccaucaggccuguccug

SEQ ID NO: 344607 - RNA, 64 nt, Human
agcaagagggcagggccgggguuuguggucccccccccaccacaaacacagcacuucggcuccu

SEQ ID NO: 344608 - RNA, 64 nt, Human
acaugccacugccugcaccuuucggcagaggaacccccaccagacaucacccuuugccuuagca

SEQ ID NO: 344609 - RNA, 64 nt, Human
agggcccguuggguagcuggggccaggcuucucuccccaccaccugcagauuucuugcugcuuc

SEQ ID NO: 344610 - RNA, 64 nt, Human
ggauacagggagcagccaggagacucccuagugcccccaccauggcgggugucacucacgcacu

SEQ ID NO: 344611 - RNA, 64 nt, Human
cuuugaaaguguggauguugguguuuugugauuuggugaacagaacuuaaauugccauucugga

SEQ ID NO: 344612 - RNA, 64 nt, Human
ggacagcuuaccuagucuuguagcauucggccuuggugaacacacacgcucccuggaagcugga

SEQ ID NO: 344613 - RNA, 64 nt, Human
ggggaaccccggggugcccacaggccgcccugcgggugaacaaagcagccacgaggugcaacaa

SEQ ID NO: 344614 - RNA, 64 nt, Human
uugcaccuggcuucugcacacuccugcgaaagucggugaacauucacuccacauugaccccucc

SEQ ID NO: 344615 - RNA, 64 nt, Human
auacagcagccaacaacacccauguuuguagcucccccaccaaagacccagcggcuucuucacu

SEQ ID NO: 344616 - RNA, 64 nt, Human
cagcaugcagccacuucacccuggggggccuccaccccaccaucuuccgccaggugugccuggc

SEQ ID NO: 344617 - RNA, 64 nt, Human
uaucucccaaugcuaucccucccccaucccccgaccccaccacaguccccagagugugauauuc

SEQ ID NO: 344618 - RNA, 64 nt, Human
auggacugaaaugcuccaucaugaagacuugcuuccccaccaaagauguccugggauucugcug

SEQ ID NO: 344619 - RNA, 64 nt, Human
gcacgggugugcaugccugugugggccaguguccccccaccaugggcacacccccaaguggugc

SEQ ID NO: 344620 - RNA, 64 nt, Human
ccucuaucuugagcccuauaaaugcccacgggacccccaccaccagccucuugaaguggcucca

SEQ ID NO: 344621 - RNA, 64 nt, Human
aacgcugagaugggaaggucacuugagcccaggaccccaccacugcacuccagccuggaugaca

SEQ ID NO: 344622 - RNA, 64 nt, Human
uucucuauuucugugacgcgcccccaugcccccaccccaccacaagaggcaggagggcccaguc

SEQ ID NO: 344623 - RNA, 64 nt, Human
uucucucucucuccccuucucauacacaugccucccccaccaaagaauauaauguaaauuaaau

SEQ ID NO: 344624 - RNA, 64 nt, Human
gcugacaauggaagauccaggugccaauccacagccccaccaggccucauuucaccugauuuuc

SEQ ID NO: 344625 - RNA, 64 nt, Human
cucagccuccugaguagcugggauuacaggugugccccaccacgccuggcuaauuuuuguaguu

SEQ ID NO: 344626 - RNA, 64 nt, Human
cuccgagacccccuuuucuuccccuuccucucucccccaccagggggcgcgcuuaaauuuccag

SEQ ID NO: 344627 - RNA, 64 nt, Human
guccugcucacucaugggggcuuccagaccccggccccaccagggcuugugucauagggagccc

SEQ ID NO: 344628 - RNA, 64 nt, Human
acccugcgauauccacugucauuuuccaucccauccccaccaccugagugacagaaaucuaaac

SEQ ID NO: 344629 - RNA, 64 nt, Human
acaguuguuccuaucucucccccgccccccaccgccccaccacacacauauuuuuaaaguuuuu

SEQ ID NO: 344630 - RNA, 64 nt, Human
gcuccccacccgccucuagcccccagcccgaggcccccaccagcaguuggcgguagcagcuacu

SEQ ID NO: 344631 - RNA, 64 nt, Human
uuuuuacaacaaguuuguguaucagagcgggagugcgggggagggaaagaaaacaaacaguuuc

SEQ ID NO: 344632 - RNA, 64 nt, Human
cagcuggcccugcgagccuuggaggaggcggugagcgggggagggugcccggggcacacaaggc

SEQ ID NO: 344633 - RNA, 64 nt, Human
ccgagauacgggguuccaggaaaggggagggguagcgggggaggggggcuucagaaggggggga

SEQ ID NO: 344634 - RNA, 64 nt, Human
ccagagucacuguccagcccccaccccucaacacgcgggggaggccgaaagguagggcggggac

SEQ ID NO: 344635 - RNA, 64 nt, Human
uucaccccucgcccugcccuccuuugccuuccacccccaccauccagguggagacccugagaag

SEQ ID NO: 344636 - RNA, 64 nt, Human
ccucagugacuuuaacuagcucagaaacguacucccccaccaaccccaccucaccgccccccau

SEQ ID NO: 344637 - RNA, 64 nt, Human
uguauucucucugggcagagaugccacuugccucccccaccaugccaucucugaagaauauuac

SEQ ID NO: 344638 - RNA, 64 nt, Human
ugcuguaccauauucagcauuugauuuccaugggccccaccauuuauguguagaauuugaaaug

SEQ ID NO: 344639 - RNA, 64 nt, Human
augugugcaaaaaugauacucuuuucugcauuagccccaccauuguguucaccaaugcuuggaa

SEQ ID NO: 344640 - RNA, 64 nt, Human
uucccugcauuucgaagcugcucuuucugguccuccccaccaccccacccccaagacuuguguu

SEQ ID NO: 344641 - RNA, 64 nt, Human
uacacauugaacuguaucauuuucauauccacuuccccaccacugaaauaucuuauuucacaau

SEQ ID NO: 344642 - RNA, 64 nt, Human
caaggagugggcuucaugcauuauggaucccgacccccaccacugcagacucgcucuaggaaga

SEQ ID NO: 344643 - RNA, 64 nt, Human
caauuucagaugauaggugaauucccugccccucccccaccacugagaagcuagacuuucaugc

SEQ ID NO: 344644 - RNA, 64 nt, Human
cccucaccgccaggggggaccggaaugccuggguccccaccaugcucagugugucugacucucu

SEQ ID NO: 344645 - RNA, 64 nt, Human
cugcagggccccgcaccaguuggagcagaugccuccccaccaccaauugccaaagguccaauaa

SEQ ID NO: 344646 - RNA, 64 nt, Human
cccccagaccccugaccacccccuggguccugucccccaccagagccccagcuccugucugugg

SEQ ID NO: 344647 - RNA, 64 nt, Human
aacuucauuucccccucacuguagcccauuuccaccccaccacaaaguugccacagguuuucuu

SEQ ID NO: 344648 - RNA, 64 nt, Human
agguggauuuugcuggaauucucccaugucaucaccccaccaccgucacuucuguaccugcauc

SEQ ID NO: 344649 - RNA, 64 nt, Human
aguaugagccagaggcguaggggcccaggagagcccccaccagcagcacaauucugucccuguc

SEQ ID NO: 344650 - RNA, 64 nt, Human
accagcacuggguuuacagaaugaggcccuggcuccccaccacagccccagcugccucagagca

SEQ ID NO: 344651 - RNA, 64 nt, Human
aucaagugaucggacugaacaggaauccucggggggugaacagccauuccuucgugaccugugc

SEQ ID NO: 344652 - RNA, 59 nt, Human
uggaagucaguguaacaugacaacgccagggugaacacacgccacuucccagcuaggag

SEQ ID NO: 344653 - RNA, 64 nt, Human
augauacagaucuauuuuaauacacuuaccacugggugaacaagauuuuuauauucuuuuauug

SEQ ID NO: 344654 - RNA, 64 nt, Human
ccaucacggcaccgcuggccgcccacaucuccuuggugaacaaggccgcugucgacuacuucuu

SEQ ID NO: 344655 - RNA, 64 nt, Human
gcuucauguaauuuuaccauuucccauccccauuccccaccacauuaugucaagauucaaguua

SEQ ID NO: 344656 - RNA, 64 nt, Human
gcaaaggacggcgucgugcaacccuaggaccgacccccaccaccccuccccagccuccugaccc

SEQ ID NO: 344657 - RNA, 64 nt, Human
acuggugcuugguucagcuccaccccaaaucuuaccccaccacuggcacuuucagcaccagggg

SEQ ID NO: 344658 - RNA, 64 nt, Human
uaacugccucaaggacccuggacucugcucacccccccaccacucugccuggccuccugcugau

SEQ ID NO: 344659 - RNA, 50 nt, Human
ccaccaaggauccaaagugaccccaccaggggacagccagaggaagggga

SEQ ID NO: 344660 - RNA, 64 nt, Human
gaaugccucccugggaggcacacugauugcccacccccaccacugcaccauuuccaggagggag

SEQ ID NO: 344661 - RNA, 64 nt, Human
ucaggggccuguggcugaagaaaaggugcccagcccccaccacuccucagcugccccccaaccu

SEQ ID NO: 344662 - RNA, 64 nt, Human
uggguaacacccucaagucucuuugccagugaggccccaccacaucggugugaguuagguuucu

SEQ ID NO: 344663 - RNA, 64 nt, Human
ccccccaaccaccagcagcagcagggcccuccucccccaccagcucuccccacagggccccuca

SEQ ID NO: 344664 - RNA, 64 nt, Human
agcuccccuuccuugcccgccucuccccccgccgccccaccaguuaaacggaugaccaaagacc

SEQ ID NO: 344665 - RNA, 64 nt, Human
aggggcuggggagcucagcuuggucucagagucuccccaccagauacuguuuaaaaaaguagca

SEQ ID NO: 344666 - RNA, 64 nt, Human
cuacccccaccuccacaggcugggacagccccguccccaccauccuccucccaagccaauuaaa

SEQ ID NO: 344667 - RNA, 64 nt, Human
uuuuccccaacccggcuucugauggcuggcuuucccccaccaucgcucucucagaguauauuuu

SEQ ID NO: 344668 - RNA, 64 nt, Human
ggacuuuucaagaugucaggauacccuuccaucaccccaccaccgccaccccaacuugacuuuc

SEQ ID NO: 344669 - RNA, 64 nt, Human
gguuagaguccugccaauacagcuguugcauuuuccccaccacuagccccacuuaaacuacuac

SEQ ID NO: 344670 - RNA, 64 nt, Human
ucuugaauuuccucuaggggaggccugcaguuuuccccaccaaccccuuuucacaugcuccaaa

SEQ ID NO: 344671 - RNA, 63 nt, Human
acagccagagaagccucugagaugcagccgggaggugaacagcagagagaagaauguacccuu

SEQ ID NO: 344672 - RNA, 64 nt, Human
caugugcugauguaugugcucugccagugugaagggugaacagcuccaacuuuaugucccccca

SEQ ID NO: 344673 - RNA, 64 nt, Human
aguacaucuaccuucgaggcaggagcccucucauggugaacagcaacuauuaugucaugguaug

SEQ ID NO: 344674 - RNA, 64 nt, Human
caagcugcgagagcugggagcuggagggugaagaggugaacacuugagugguuagagcuguaga

SEQ ID NO: 344675 - RNA, 64 nt, Human
uccagguacuucacccugucaaccaccucugaauccccaccaggcgccuuccuggguggauuca

SEQ ID NO: 344676 - RNA, 64 nt, Human
ugagaauacugucuuuccauauggcuaaguguggccccaccacccucucugcccucccgggaca

SEQ ID NO: 344677 - RNA, 64 nt, Human
gcagcccaugccugggggugcugccaucuucucuccccaccacccuuucacacauuccugacca

SEQ ID NO: 344678 - RNA, 64 nt, Human
ugccuugcagaguuauuuuugauguuccccaauuccccaccagccaauccaagcauuuucuccu

SEQ ID NO: 344679 - RNA, 64 nt, Human
ugucccccccuaccccgcaacacccacaucaccuccccaccacccggccggggugugcucaggg

SEQ ID NO: 344680 - RNA, 64 nt, Human
cugccucagaaacccuauugggcugagcugcccuccccaccagggccacuguguccucugcuuc

SEQ ID NO: 344681 - RNA, 64 nt, Human
ucuguagggacuucccgguccucaccacccucugccccaccaugauccagccucugccucacac

SEQ ID NO: 344682 - RNA, 64 nt, Human
ggagcaagagaauuucaaggcaggggauuuuaucccccaccaaaaacacagugaaaggccugcu

SEQ ID NO: 344683 - RNA, 64 nt, Human
acaagcccuuggccacaacuauacuccugucccaccccaccacgauggccuggucccuccaaca

SEQ ID NO: 344684 - RNA, 64 nt, Human
auuacagagggguauugauuugccuugcccccgcccccaccaucacagugugucccuguccagu

SEQ ID NO: 344685 - RNA, 64 nt, Human
caccgacgguagcgucauaugagaagaaagaaauccccaccaccucaaccucugcugagauugu

SEQ ID NO: 344686 - RNA, 64 nt, Human
ggcaaaugaaucaaagacccauuccuguuccucuccccaccacuacuguuuucuacuguaaucu

SEQ ID NO: 344687 - RNA, 64 nt, Human
uauucaugccagccaggaaggaaacgccuuccuuccccaccauucccagcccuccuucccacug

SEQ ID NO: 344688 - RNA, 64 nt, Human
ggaccuccaguggggguggcgugccaggcgcguaccccaccaggugggcaaagcagaaaccugc

SEQ ID NO: 344689 - RNA, 64 nt, Human
uccuuggggaggggucagcucuggccacaauccuccccaccagucucacccacuaggauaggaa

SEQ ID NO: 344690 - RNA, 64 nt, Human
cagcugccccuguccccaccucuggagaauccacccccaccagauuccuccgcgggagguggcc

SEQ ID NO: 344691 - RNA, 64 nt, Human
gaaaugauuagaacuuaggaagugccaguggguuggugaacaugccaucaguaaaagcccugga

SEQ ID NO: 344692 - RNA, 64 nt, Human
agacucaagugugcacagaccccuguguucugugggugaacaacugcccacuaaccagacugga

SEQ ID NO: 344693 - RNA, 64 nt, Human
aaaaagcaaccagggcuauuuguacaguugaaggggugaacagaaugggcggcugugcugggag

SEQ ID NO: 344694 - RNA, 64 nt, Human
cccaggcacugugcagagugcuguaggacauaguggugaacaagacagacuugguccaagcucu

SEQ ID NO: 344695 - RNA, 64 nt, Human
cccacaggcccccucagggcuccuugccuuucccccccaccagcacaccccguacccugccugg

SEQ ID NO: 344696 - RNA, 64 nt, Human
aacauuuccaaaacugaacucaucaccccucuucccccaccaccaaaacugcuccuccuccugu

SEQ ID NO: 344697 - RNA, 64 nt, Human
ccugcccuuuuccugggccuucucagcucuccacccccaccacucuugacucaggugguguccu

SEQ ID NO: 344698 - RNA, 64 nt, Human
aagaccagccugcacaucacgagacccgcccuccccccaccaaucucuauaaaacauuaaaaaa

SEQ ID NO: 344699 - RNA, 64 nt, Human
ggauugggccccugccagacccccuggagacuaaccccaccacacccucccucuacugggagcc

SEQ ID NO: 344700 - RNA, 64 nt, Human
auagaagcauuucucugcaggauaccaguucaggccccaccauuccugccaaggccauuacauc

SEQ ID NO: 344701 - RNA, 64 nt, Human
cugggaacugggccagcagagcauguuggacaccccccaccauggugggcuugugguggcugcu

SEQ ID NO: 344702 - RNA, 64 nt, Human
gggaagaauuggccacguuggagaccccaugccaccccaccauggugagugcucugugccuccu

SEQ ID NO: 344703 - RNA, 64 nt, Human
gcauggaguuggcacugacaucacagcuucauaaccccaccaccgccagcuuccccugccuccu

SEQ ID NO: 344704 - RNA, 64 nt, Human
caaggacuacgucuaagggacagacgcagggagaccccaccaccaccaccaccaccaacaccac

SEQ ID NO: 344705 - RNA, 64 nt, Human
cccuuccuggaucuggagagagcagcugcugcugccccaccaccugccaggcccggccacugag

SEQ ID NO: 344706 - RNA, 64 nt, Human
acccggccccuucccccaggagucacugugccagccccaccacauccuggaagaggagggggcc

SEQ ID NO: 344707 - RNA, 64 nt, Human
cuggccugccuuucuuuggucagucccuguggucccccaccagcucccccucccauagggcugc

SEQ ID NO: 344708 - RNA, 64 nt, Human
gcuggcaguguuggccacguaggggcucccauccccccaccauugugucacaugggcugccagg

SEQ ID NO: 344709 - RNA, 64 nt, Human
gggauuaagaccagaauaucaguggauuuguuuuccccaccaaguggccucuuagacuagucau

SEQ ID NO: 344710 - RNA, 64 nt, Human
cccucucucucucugucucuccuucucucucuccccccaccacccacccccacacacgucaucu

SEQ ID NO: 344711 - RNA, 64 nt, Human
gcggccccggccgggguggauuggauuugucuuuggugaacauugcaauagaaauccaauugga

SEQ ID NO: 344712 - RNA, 64 nt, Human
agaacuccaaagcuggaaagcaggagggaacaaaggugaacaugaaggcgaggaugcuggggcc

SEQ ID NO: 344713 - RNA, 64 nt, Human
uguuuguaauacgugugcauaaaaauuaaauagaggugaacacaauuauuuuaaggcaguuaaa

SEQ ID NO: 344714 - RNA, 64 nt, Human
gggaagcauuucauggauagggagagcuccucucggugaacaguccaaaacuaaaauagauguu

SEQ ID NO: 344715 - RNA, 64 nt, Human
augcaaguggacuugggcagaggaggucacaccaccccaccaagguagacuuagauuagagaug

SEQ ID NO: 344716 - RNA, 64 nt, Human
cuccuguagcagcagagacgccuuggaguuuaacccccaccaaccagagcgugggcugguaaag

SEQ ID NO: 344717 - RNA, 64 nt, Human
aaagaggccagcucugcagcccccucggggacgcccccaccagcucaaauuccgagugcagaaa

SEQ ID NO: 344718 - RNA, 64 nt, Human
acugucuggcugaagcaagggagggucuggcacgccccaccaauaguaaaucccccugccuaua

SEQ ID NO: 344719 - RNA, 64 nt, Human
auguucccaggccccaggccauccacuugccggcccccaccaguucuuggguuccccgcucuag

SEQ ID NO: 344720 - RNA, 64 nt, Human
gaaguacagagugagacuuaaagaaccccuagauccccaccaguucaacacuccauuaacuggg

SEQ ID NO: 344721 - RNA, 64 nt, Human
auuaaaacguugcaaauuccuuuacuguuaucccccccaccaccaggaccauguagggugcagu

SEQ ID NO: 344722 - RNA, 64 nt, Human
uggagcuuggccugagggcguguugcagcccuggccccaccaguccacagaggcccccaggagc

SEQ ID NO: 344723 - RNA, 64 nt, Human
cauaaaagucugugacuugaaguuuagucagcacccccaccaaacuuuauuuuucuauguguuu

SEQ ID NO: 344724 - RNA, 64 nt, Human
gugauuucggccuauuuccuugccaggccuguuuccccaccaggaaaugagauaggaggacugg

SEQ ID NO: 344725 - RNA, 64 nt, Human
agggagguucuggagguuccuuucugucuccuggccccaccagggauuuccccauuucuguuug

SEQ ID NO: 344726 - RNA, 64 nt, Human
aggcaaaaucuuuaaccacucuggccucuguuucccccaccaacggggagcagugacauuuacc

SEQ ID NO: 344727 - RNA, 64 nt, Human
ggucuuccucccccaagccaggccccuguccccaccccaccaccuuccagggugccaggcaggg

SEQ ID NO: 344728 - RNA, 64 nt, Human
cacaacacacggcuaugaucaugacaaccacgguccccaccacgacacaaucacguucacaacc

SEQ ID NO: 344729 - RNA, 64 nt, Human
ccaagugcaggccgcagugguccacgucauccagccccaccaagugacuuugguugacuugugg

SEQ ID NO: 344730 - RNA, 64 nt, Human
cuucucuggcugcuaccucagggcaugguuguggccccaccaacaccuauuuuccaaauaauua

SEQ ID NO: 344731 - RNA, 64 nt, Human
aauuaguuauccauacucucaugacaauuuuguuggugaacaacaaaaaagagaucuauuucuu

SEQ ID NO: 344732 - RNA, 64 nt, Human
cacccaggcaacacucccagccuuacucaggaguggugaacauuuucugcucuggacauagaau

SEQ ID NO: 344733 - RNA, 64 nt, Human
ccucuuaugagggaccaauucaggucccuuauggggugaacacuguugaagacugguuaauuau

SEQ ID NO: 344734 - RNA, 64 nt, Human
cccagggaucuucuauuuaaguggcuucugagagggugaacaggauuguuacuuuuaagccuac

SEQ ID NO: 344735 - RNA, 64 nt, Human
agggaaagggcuuuggggucagguggcagcuauuccccaccaagagauucagggucacagguuu

SEQ ID NO: 344736 - RNA, 64 nt, Human
ggugcccaugcuccacacugggaggccaggcugaccccaccagccagucagcuacaacuccaca

SEQ ID NO: 344737 - RNA, 64 nt, Human
auuacauguaacuguuuugguuguguucuaucaaccccaccagaguucccuaaacuugcuucag

SEQ ID NO: 344738 - RNA, 64 nt, Human
guuaagugaaaauuagucaacugcacguggaagcccccaccacuuuggggaucucuuuauuucu

SEQ ID NO: 344739 - RNA, 64 nt, Human
cugcccucauggaccugaccacucaacaaacaguccccaccacaccuaucuccuuaggcaagac

SEQ ID NO: 344740 - RNA, 64 nt, Human
ucagcaguucaucuucaugggaaauuugcugagcccccaccagggaaccggaugaugaaacagg

SEQ ID NO: 344741 - RNA, 64 nt, Human
ggacugcacgcuggccccacgguaacccccccucccccaccaacauccugcagggaugggguca

SEQ ID NO: 344742 - RNA, 64 nt, Human
uccagugcugagaagucagugccccgagagacgaccccaccaguggggugcccgcugccugucc

SEQ ID NO: 344743 - RNA, 64 nt, Human
gcucccccuuuguccuccaucccgacuccaucucccccaccaggcuggucaccccaggccagcg

SEQ ID NO: 344744 - RNA, 64 nt, Human
ucuccugucaggcucggagaggucaggagaccgaccccaccacuaacuuuggagaaaauguggg

SEQ ID NO: 344745 - RNA, 64 nt, Human
cccgcggauaccuuggacuacggugccuucccgcccccaccaguggacacuuccggguggcgcu

SEQ ID NO: 344746 - RNA, 64 nt, Human
ccccuggccucgggagcggccccuggcuaugcacccccaccauuccuacacaucuugccagccc

SEQ ID NO: 344747 - RNA, 64 nt, Human
acuacacaggcaugcccagugccuuccaguauggccccaccauguuugugaguauuucagaggg

SEQ ID NO: 344748 - RNA, 64 nt, Human
ggccuuuccauagcuccacagcuucccaccuccuccccaccaaaccgggguucuagaguuaagg

SEQ ID NO: 344749 - RNA, 64 nt, Human
ccauagcccagugagcagccuggagcccuggagaccccaccagccucaccagcgcuugaagccu

SEQ ID NO: 344750 - RNA, 64 nt, Human
ugacagagccugagacuuggaggugccagaggccccccaccaaccagcccagccacuguugcug

SEQ ID NO: 344751 - RNA, 63 nt, Human
ggugacaaaggcugggugagccccugcugggcacggcggaagucacgaccucuccagccaggg

SEQ ID NO: 344752 - RNA, 63 nt, Human
gagugagugccuuucccuccuaaagcugaaucccggcggaaagccucuguccgccuuuacaag

SEQ ID NO: 344753 - RNA, 64 nt, Human
agaucaccgcgucacgacuuuuggggagacucacccccaccaacaccguccagagaggccugag

SEQ ID NO: 344754 - RNA, 64 nt, Human
gcugcugcccucucaucagaccuccgcacccucaccccaccaucacuuacacuacuuuaaucca

SEQ ID NO: 344755 - RNA, 64 nt, Human
ccauagcuuuagacggugguuagauuuuuuuuuuccccaccagggucuuguuuaaaggggugag

SEQ ID NO: 344756 - RNA, 64 nt, Human
ggucuccauugaggaagaacaggaacgccgguucccccaccagcuuuugcugcuccccuuccug

SEQ ID NO: 344757 - RNA, 64 nt, Human
cuuagggcaggucucuugugcccuguucucuuguccccaccaccaaccuauagcaggcaccaaa

SEQ ID NO: 344758 - RNA, 64 nt, Human
gggggcaggaucauucugccccuuguccacgcacccccaccagcccucucgcuucuaacacagg

SEQ ID NO: 344759 - RNA, 64 nt, Human
gcaaagccugaagaaguggggcuggauacccugcccccaccauaucccuaccaucccuucucag

SEQ ID NO: 344760 - RNA, 64 nt, Human
cguggcgccuggaucuugcccagcugccagcuccccccaccaggacugugguuccucaguuucu

SEQ ID NO: 344761 - RNA, 64 nt, Human
ggccuaggcagggcugggaugaggcuuguacaacccccaccaccaauuucccagggacuccagg

SEQ ID NO: 344762 - RNA, 64 nt, Human
gccccguccccaccucaaaucacacacacccccuccccaccacagagacaccauuacauacaca

SEQ ID NO: 344763 - RNA, 64 nt, Human
ggaugccaccaccuugaacaccuaggccagggauccccaccaugucccggguuucuuucuucga

SEQ ID NO: 344764 - RNA, 64 nt, Human
uuccuccacccacccucuaucccccaccgcuccaccccaccacugucuucuccauccuuccacc

SEQ ID NO: 344765 - RNA, 64 nt, Human
ucugaucaggaggcuucuuuaugaauuaaacucgccccaccacccccuccucgguagucuugug

SEQ ID NO: 344766 - RNA, 64 nt, Human
gugaguauaugaauacggggaaauagaacccccuccccaccaccuacacacaugcuguuuuacc

SEQ ID NO: 344767 - RNA, 64 nt, Human
cccuaugaccccccaucuuuccuccgccccugacccccaccacccugcugcucggacuaugcuc

SEQ ID NO: 344768 - RNA, 64 nt, Human
uagaagagcaucagggcugcucucugaggagcugccccaccagccauccuugaagagacaauuc

SEQ ID NO: 344769 - RNA, 64 nt, Human
uacagcauuguguuaugcccauuggggacacagaggugaacaagacaaggaaugccaucaggga

SEQ ID NO: 344770 - RNA, 64 nt, Human
aagcagagaagauuguauaguuggggcuggucuuggugaacacacauuauuaccccacacaucc

SEQ ID NO: 344771 - RNA, 64 nt, Human
uuguuuuuuacuggaaaguuacccaauagcaugaggugaacaggacguaguuaggccuuccugu

SEQ ID NO: 344772 - RNA, 64 nt, Human
ccauggcguugccagccucccugugacagagccuggugaacagugagccuggcucccacgcaag

SEQ ID NO: 344773 - RNA, 64 nt, Human
auacaagccauuuacuuugcaagugagauagcuuccccaccagcuuuauuuuuuaacaugaaag

SEQ ID NO: 344774 - RNA, 64 nt, Human
gacauacagcugccuaccuaaugaggacuucaagccccaccacauagcaugcuuccuuucucuc

SEQ ID NO: 344775 - RNA, 64 nt, Human
gagugccuguguccuguacugcccucgcugucucccccaccacccuacuugacagcgugggcau

SEQ ID NO: 344776 - RNA, 64 nt, Human
aacagcuacaacagccucacuuggucugccaggcccccaccacacaucccagcccaauccaggu

SEQ ID NO: 344777 - RNA, 64 nt, Human
ugaggacuuaccagagggagcccuacuggccuucccccaccacagcagcccugccugugaagcu

SEQ ID NO: 344778 - RNA, 64 nt, Human
acuccuacuggaagacccaugucgguuuccggaaccccaccaguuuacccauaagcaagacuaa

SEQ ID NO: 344779 - RNA, 64 nt, Human
gcuuguuguucugcagcccugucuacuugggcacccccaccaccuguuagcugugguugugcac

SEQ ID NO: 344780 - RNA, 64 nt, Human
ccgagucccgccuggugggcauuugccgccgccuccccaccaccagucacugccucgcagagcc

SEQ ID NO: 344781 - RNA, 64 nt, Human
cauuuaaaagccugagcaaggaccaccacccccuccccaccaaauuauucggucucuuucuggg

SEQ ID NO: 344782 - RNA, 64 nt, Human
agggcugaguccuugcugugggaugugccaguguccccaccaacaccaggaauuuagaccuuuu

SEQ ID NO: 344783 - RNA, 64 nt, Human
guccucccaaaacugggccgauguggugugacauccccaccagccucagaugagacgggccagg

SEQ ID NO: 344784 - RNA, 64 nt, Human
ggcaggcagccaggaucccugacccuuggcccaaccccaccagccuggcccugggaacagcagg

SEQ ID NO: 344785 - RNA, 64 nt, Human
caaggcaaucuggaagcagaaaugcaaacuccagccccaccacacauccaccgaugcauuugug

SEQ ID NO: 344786 - RNA, 64 nt, Human
aauacccaucuuaggaucccaucagcuucccaucccccaccagacagccacaguacccucacuu

SEQ ID NO: 344787 - RNA, 64 nt, Human
acagugcucccgagagccugccuuuccugcccuuccccaccaccugcacugccccccacauucu

SEQ ID NO: 344788 - RNA, 64 nt, Human
agugccuucaaaacccacccccaccccuacccuaccccaccacaccccaucccagaggccuugc

SEQ ID NO: 344789 - RNA, 64 nt, Human
cagcagcagugacggaggaaacagacauggggagggugaacaguccccacagcagacagcuacu

SEQ ID NO: 344790 - RNA, 64 nt, Human
acaugaaaugcuugugaguuguugacauuggacaggugaacaguagggcauuacauuuguguga

SEQ ID NO: 344791 - RNA, 64 nt, Human
gccggaguguaugccgggagcuaaguggucuaugggugaacauaucccaccuugcuuccugagu

SEQ ID NO: 344792 - RNA, 64 nt, Human
acucuccccagccaauaaagcgucuguggcgauuggugaacagcauaaacagcuggaccucagc

SEQ ID NO: 344793 - RNA, 64 nt, Human
ugguguccccaugggcagcaggcagacagcucacccccaccagcaugauggccccagcuggggg

SEQ ID NO: 344794 - RNA, 64 nt, Human
cugcuguuuucccugccuggaacuuucccuccugccccaccaagaucauuucauccaguccuga

SEQ ID NO: 344795 - RNA, 64 nt, Human
gcucgcccacaaacugauuucucacggcgugucaccccaccagggcgcaagccucacuauuacu

SEQ ID NO: 344796 - RNA, 64 nt, Human
uaagauuaguauaaagaguauauagauuguuaauccccaccagcuagacuuugaacuuaaguca

SEQ ID NO: 344797 - RNA, 64 nt, Human
acuacacauauguauuccugaucgccaaccuuucccccaccagcuaaggacauuucccaggguu

SEQ ID NO: 344798 - RNA, 64 nt, Human
ugcgacccugaguucuccccagagccuccuccugccccaccagcucucaaguaccuuuucuccu

SEQ ID NO: 344799 - RNA, 64 nt, Human
uuuccuaugguuuacaaagagggccccagcccagccccaccacagaucccagagauaggggccc

SEQ ID NO: 344800 - RNA, 64 nt, Human
gugggcugcucccagaaucugcucagcuuucugcccccaccaacacccuccaaccaggccuugc

SEQ ID NO: 344801 - RNA, 64 nt, Human
ccucugagggccccaccucaccccuuggugucacccccaccacgccuaggcagcucugggcccu

SEQ ID NO: 344802 - RNA, 64 nt, Human
cccugagagacucagagaccucagcuccagcauaccccaccaccuucuccuuucccgacugugg

SEQ ID NO: 344803 - RNA, 51 nt, Human
gcccccugccccccuccuaauccccaccacugugacccccuucccucauag

SEQ ID NO: 344804 - RNA, 64 nt, Human
agccacgccaaccagagacuggguuccaaucucaccccaccacauacagagcccucaucuguga

SEQ ID NO: 344805 - RNA, 64 nt, Human
ccccugccuuggccaaugcgagguccuuccuuauccccaccaugggguccauggucuauuuauu

SEQ ID NO: 344806 - RNA, 64 nt, Human
cccgacacugauuugaucgauucugugacacaaaccccaccaauuguuaaugcaaguuuuuauu

SEQ ID NO: 344807 - RNA, 64 nt, Human
cuggauugaaccgggacagaaacacggugagggcccccaccacaccucccugguugaaucagga

SEQ ID NO: 344808 - RNA, 64 nt, Human
agcguuucuaggacagaggggccucccagucuccccccaccacccgugcacgacuuccucacca

SEQ ID NO: 344809 - RNA, 64 nt, Human
gaaccaagacuucuguaccuagugcugccugauuggugaacauugacuucaaguagcauagccc

SEQ ID NO: 344810 - RNA, 64 nt, Human
cucacauaagcauccauauggcuucgucaagggaggugaacauuguugcugaguuaaauuccag

SEQ ID NO: 344811 - RNA, 64 nt, Human
ugguuucaguucuguguacauuuuaaaggauaauggugaacauuuuaauggguuucccuugccc

SEQ ID NO: 344812 - RNA, 64 nt, Human
auaaugcauucuucucuguugucguaaagauuugggugaacaaacaaugaaaacucuuugcugc

SEQ ID NO: 344813 - RNA, 64 nt, Human
gcucugccuggacuuggagagaugggaggcagacccccaccaccauacaugcugucuguggccc

SEQ ID NO: 344814 - RNA, 64 nt, Human
auacgcuaugaacucucaccggcuccccagcccuccccaccaagggguacugcaggggaagggc

SEQ ID NO: 344815 - RNA, 64 nt, Human
uucauauuugccauuguguccggggcaccaggagccccaccaaccccaaaccaugcggagaauu

SEQ ID NO: 344816 - RNA, 64 nt, Human
gugauccuuagaugugucuccuguuucagaccagccccaccaugcaacuuccuuugacuuucug

SEQ ID NO: 344817 - RNA, 64 nt, Human
uggcugggguggauguugcuuccuccugguucugccccaccacaaaguuuucuguggcaagugc

SEQ ID NO: 344818 - RNA, 64 nt, Human
cugaggccaagccacucacauccucacuuugcugccccaccaucuugcugacaacuuccagaga

SEQ ID NO: 344819 - RNA, 64 nt, Human
cuuacaacugaccaaaguggcccccucuggggguccccaccacacaaguguuuguaaacugggc

SEQ ID NO: 344820 - RNA, 64 nt, Human
uaggaaaaaaaaguaccuccuagaaggaagccuuccccaccauuuccaggugccaacugcuaag

SEQ ID NO: 344821 - RNA, 64 nt, Human
ucugcccacuuuuuauaaaaacuuacagcgauggccccaccaaggccuagacacggcacuggcc

SEQ ID NO: 344822 - RNA, 64 nt, Human
caaguccugcuuucucaguagccccauugcggggccccaccauucauccugucugaagguccug

SEQ ID NO: 344823 - RNA, 64 nt, Human
cuggcacuuggcuuggaggcugccccugcccuccccccaccaguugugccuuggugccuugucc

SEQ ID NO: 344824 - RNA, 64 nt, Human
ucuucuccccugcacucugcucccugcgcgguaaccccaccacuccugaagccugcccagucuc

SEQ ID NO: 344825 - RNA, 62 nt, Human
cggaccccagcgggcucugaaccuggccccugccccaccagccccuucucugguagcccggg

SEQ ID NO: 344826 - RNA, 64 nt, Human
ccuguggggucccugggugaggagacggcuggagccccaccaugccccaggcugcagccucugu

SEQ ID NO: 344827 - RNA, 64 nt, Human
gguuccuugcugagacccacauugcuucaccuggccccaccauggcugcuugccuggcccaacc

SEQ ID NO: 344828 - RNA, 64 nt, Human
gcacauuagcgaccaggcuugggcuuccccagcgccccaccaccaccacgugcagguggagcuc

SEQ ID NO: 344829 - RNA, 64 nt, Human
ggaggcaggggacaagggaggcaguggcuaguggggugaacagcuggugccaaauagccccaga

SEQ ID NO: 344830 - RNA, 64 nt, Human
aagggcauaauuaugucauaaauacugaacuucaggugaacaaauacuuuauaguuuuaauuau

SEQ ID NO: 344831 - RNA, 64 nt, Human
cuacuaaaaaauacaaaaauuagccagguaugguggugaacaccuguaaucccagcuacuugga

SEQ ID NO: 344832 - RNA, 64 nt, Human
gugucuuaaguuacucugaguuuacacaugaaaaggugaacaucaucaaaaacccuggacacag

SEQ ID NO: 344833 - RNA, 64 nt, Human
acuccucucuuggauccgccucgguuuccuguccccccaccacccgccugccccgcggaagacc

SEQ ID NO: 344834 - RNA, 64 nt, Human
ccauaccgaaauuuucugaaauuaaaucgcacacccccaccauuuccucucccugggaucugga

SEQ ID NO: 344835 - RNA, 64 nt, Human
cccccaccccuugccucuggccacccuguccuccccccaccacccucaggccuaugaaacacac

SEQ ID NO: 344836 - RNA, 64 nt, Human
agcaucuucccagggguccaccucccuuuauaaaccccaccagaaccacaucauuaaaagguuu

SEQ ID NO: 344837 - RNA, 64 nt, Human
agagccccuaagccagcaugggcccuuucccccuccccaccaagaacuuugcauggcucuggca

SEQ ID NO: 344838 - RNA, 64 nt, Human
gacuagggaaaagagggugcagggcacggcugcuccccaccaccaggucugcauuuguucauca

SEQ ID NO: 344839 - RNA, 64 nt, Human
ugcccaagaagaagcugccaagaagugacccuugccccaccaacucccagauuucaaaggaggu

SEQ ID NO: 344840 - RNA, 64 nt, Human
cccaccugugugcagugcccuugccugccuucacccccaccaccacuucuccaauaaagccgcc

SEQ ID NO: 344841 - RNA, 64 nt, Human
cucagccucccuaguagcugggauuauaggcgccccccaccacgcccaaguaacuuuuguauuu

SEQ ID NO: 344842 - RNA, 64 nt, Human
agcagcuugaugguuucuccuugccccauuucugccccaccagaucuuugcuccuuucccuuug

SEQ ID NO: 344843 - RNA, 64 nt, Human
gagccccacccccaugcagccucuuccccaccccccccaccacgugcucaaucaugaguaccuc

SEQ ID NO: 344844 - RNA, 64 nt, Human
cugucuuguagcuggagaagauggcgcacccaucccccaccaggauaaagcagagccugcugcc

SEQ ID NO: 344845 - RNA, 64 nt, Human
uucuugaauugcauuuuuuaaaacaagaaaguuuccccaccagugaaugaaagucuugugacua

SEQ ID NO: 344846 - RNA, 64 nt, Human
accucuguuuuccccauucaucuccacccccuucccccaccacuucuauuuauuuaacaucgag

SEQ ID NO: 344847 - RNA, 64 nt, Human
gaugucagacagcugugacccuggacagggccccccccaccaucuguaaaacggggacaguaug

SEQ ID NO: 344848 - RNA, 53 nt, Human
aagcuggcucucugguaugaugaccccaccacucauuggcuaaaggauuuggg

SEQ ID NO: 344849 - RNA, 64 nt, Human
aaaugcuuauuuuuaccacugugaggcaagcugaggugaacauuuaaaaggcuauuucaagacg

SEQ ID NO: 344850 - RNA, 64 nt, Human
ucuggaauaugaacagguuuauaaaacauuccauggugaacaauucugucggcugcauuauagc

SEQ ID NO: 344851 - RNA, 64 nt, Human
ggagaugcugaugagaacaacacuaccacuugaaggugaacauucccugucugguuggacugag

SEQ ID NO: 344852 - RNA, 64 nt, Human
uaggcucaaagguagacccguuuccaccgcagcaggugaacaugaccguguuuucaacuguguc

SEQ ID NO: 344853 - RNA, 64 nt, Human
uuggccugaggagcagcccugccugcugcucuucccccaccauuuggaucacaggaaguggagg

SEQ ID NO: 344854 - RNA, 64 nt, Human
aacccagucuguucccugcucccucgcuggcaagccccaccacacaggagugaggccaggggcu

SEQ ID NO: 344855 - RNA, 64 nt, Human
ccucacugcuggggagucccugccacacucagucccccaccacacugaaucuccccuccucaca

SEQ ID NO: 344856 - RNA, 64 nt, Human
caggagcagaacagcaagcucucugucccugcacccccaccaucuuggggaccuacaagggccu

SEQ ID NO: 344857 - RNA, 64 nt, Human
gggcauagccagcccacuccuacugucacaggcgccccaccauucaaccuuccgggaggucagg

SEQ ID NO: 344858 - RNA, 64 nt, Human
uuuccuuccacuguagcuauuagcggcuccucgcccccaccaguguagcaucuuccucugcaga

SEQ ID NO: 344859 - RNA, 64 nt, Human
uuuggcucugagucgaggcaaccugcacacaagaccccaccaaggaaugugcaaggacugagau

SEQ ID NO: 344860 - RNA, 64 nt, Human
ucccugccaccccucucucccuuucucccucgcuccccaccaacucuccccuaaucacacacuc

SEQ ID NO: 344861 - RNA, 64 nt, Human
cuccacugcccugacuacaggcauugaucccuguccccaccauuucccaaggaguuuugcuuug

SEQ ID NO: 344862 - RNA, 64 nt, Human
ugagccauugcagggggcagggaaguucacccccccccaccacccccccgcccccccgaagcca

SEQ ID NO: 344863 - RNA, 64 nt, Human
gaaaaggccugggggggaugguauauggcccuuuccccaccaggcgcuaaggggaacacccccu

SEQ ID NO: 344864 - RNA, 64 nt, Human
uacauggacucuuuucugucuccugggucccugcccccaccacucuggguuccauuugugggag

SEQ ID NO: 344865 - RNA, 64 nt, Human
caucaugaucccuccaguuagcucuaauuacagaccccaccaguacagcuugacagcucccggc

SEQ ID NO: 344866 - RNA, 64 nt, Human
aaagguggaaggagcagccagauguuccacaggaccccaccaagaaggucauuuccaaacccau

SEQ ID NO: 344867 - RNA, 64 nt, Human
cccuuggaauuuucuggcacuuccucucuauugcccccaccaccaccacccccaucacugcuuu

SEQ ID NO: 344868 - RNA, 64 nt, Human
gguaggaaugggccggcgauugggaccagcugggccccaccacggccacgccaggcaaagcgcc

SEQ ID NO: 344869 - RNA, 64 nt, Human
ggccaacucuagcuccuuucucaagcuacaaaguggugaacaugguucucaacuccuuaauuua

SEQ ID NO: 344870 - RNA, 64 nt, Human
agcucuuugauagcucugcauuuguuuucccuuaggugaacaauguaggaaauccucaaagugg

SEQ ID NO: 344871 - RNA, 64 nt, Human
cauuggccuggccagaccaggugaccuuagauuuggugaacaacguacuauggaagccacauca

SEQ ID NO: 344872 - RNA, 64 nt, Human
aggacugcgugggcugagaugccacccuuugaagggugaacagcauggcggcaucugggcccca

SEQ ID NO: 344873 - RNA, 64 nt, Human
cugccccccacccacccugcaccccucgcccuccccccaccacagaaucuaagaccuuucagcu

SEQ ID NO: 344874 - RNA, 64 nt, Human
accgugucuaacuccccuggagugacgaccaccgccccaccaccuccugggaccacaccacuac

SEQ ID NO: 344875 - RNA, 64 nt, Human
uaauccuuugcuuacuauuuaugcagcuucucuaccccaccacacaaauuucccauuucccccc

SEQ ID NO: 344876 - RNA, 64 nt, Human
ccccacccuccacacacuaacaucccuuucuuccccccaccagcuguaaaagauccuaugcgaa

SEQ ID NO: 344877 - RNA, 64 nt, Human
ccacucggggagccuucucuguuucuggggccucccccaccauagcucugauucccaccccaca

SEQ ID NO: 344878 - RNA, 64 nt, Human
gaacuccuggaaauaucaguuacucagcccugggccccaccaccuaggccacuccuccaaagga

SEQ ID NO: 344879 - RNA, 64 nt, Human
gacucaccucugccucaaugugaaucagacccuaccccaccacgauguggcccuggccugcugg

SEQ ID NO: 344880 - RNA, 64 nt, Human
aggcaugggccaaucccauuccugccuuccagugccccaccacccuucugaucuuagggguugg

SEQ ID NO: 344881 - RNA, 64 nt, Human
acucuuaucagcuuagaguguucaacugauccuuccccaccaucuucagaucuguuccucugga

SEQ ID NO: 344882 - RNA, 64 nt, Human
ggggagccccuucugccugccagacgugccacugccccaccaccagcugaaaacagcagcacau

SEQ ID NO: 344883 - RNA, 64 nt, Human
cuagguuugugcuucuagccaugcccauucccgcccccaccaugccucuuugcauugcccauuu

SEQ ID NO: 344884 - RNA, 58 nt, Human
ugaccuucucuuuuagauaaagaugagcccccaccaccaccgacucucccaacccaga

SEQ ID NO: 344885 - RNA, 64 nt, Human
agugguccccaaagacccuucaaccuccccagucccccaccagacccacccucucccugaaucu

SEQ ID NO: 344886 - RNA, 64 nt, Human
ccuguggacaucacgguuccaggaacagcccuucccccaccacugggacccuccccagccugga

SEQ ID NO: 344887 - RNA, 64 nt, Human
aggugggagugugguuggagauagaaaggcuccuccccaccauguaauggcuuccucucagaau

SEQ ID NO: 344888 - RNA, 64 nt, Human
agaauacaagccacuaccuucugaccuccccaccccccaccaacccccaucuuuuaauaugcug

SEQ ID NO: 344889 - RNA, 64 nt, Human
auacauuucacagauaaacuguaacaggugaacaggugaacacaaacaugagggaggguuggag

SEQ ID NO: 344890 - RNA, 64 nt, Human
auauaaauauacauuucacagauaaacuguaacaggugaacaggugaacacaaacaugagggag

SEQ ID NO: 344891 - RNA, 64 nt, Human
ucagcauuuagagugaaaacaagggcccuucaugggugaacauuagaaagagccaggguucaaa

SEQ ID NO: 344892 - RNA, 64 nt, Human
ugggguucuuuuugccaacuuuccccacguuaaaggugaacauugguucuuucauuugcuuugg

SEQ ID NO: 344893 - RNA, 64 nt, Human
ugccuccuugucccugccaggaauuuccaacaaaccccaccacccugugagcacucuacuggcu

SEQ ID NO: 344894 - RNA, 64 nt, Human
gagauggguuuucccugaugcucccgacuccccuccccaccaccucccaagguauuucugauga

SEQ ID NO: 344895 - RNA, 64 nt, Human
gccccaggccgcagggggcaaggggccaggugccccccaccagcugagaacaaagugucuaucu

SEQ ID NO: 344896 - RNA, 64 nt, Human
uguuuacacagcugcaucagacaaugccauuucuccccaccacggaaccuuccaucuaagauuu

SEQ ID NO: 344897 - RNA, 64 nt, Human
ugucgggacucgcaagugcccucaucacagccacccccaccacgagugucuccccagugcagac

SEQ ID NO: 344898 - RNA, 64 nt, Human
auugcuguuagaaaacacuagcuagaaauccccuccccaccacccuuuuuaaggccaguuaacu

SEQ ID NO: 344899 - RNA, 64 nt, Human
gccucagccuccagaguagcugggacuacgggcgccccaccaccacgcccggcuaauuuuuugu

SEQ ID NO: 344900 - RNA, 64 nt, Human
aaaucucugugcagaaguguuggcugggugcucuccccaccacuacccuuguaaacuuccagga

SEQ ID NO: 344901 - RNA, 64 nt, Human
aagauuagaaccagacuuacuaaccaauuccaccccccaccaacccccuucuacugccuacuuu

SEQ ID NO: 344902 - RNA, 64 nt, Human
ugaaaaagaaacuuugcacgguaugagcuucauaccccaccaaacaaagucuugaagguauuau

SEQ ID NO: 344903 - RNA, 64 nt, Human
ccagccuguguacguguagaugggggccaggcacccccaccacucgcugccucccaggucaggg

SEQ ID NO: 344904 - RNA, 64 nt, Human
gacgcccccagaggaccgggaggcaccccacccuccccaccagugcaacagaaaccaccugcgu

SEQ ID NO: 344905 - RNA, 64 nt, Human
aagguagaacuugagaacucaaguuuaaauugucccccaccaccuucuucuauaaaugcaaacu

SEQ ID NO: 344906 - RNA, 64 nt, Human
gagcauucuuucagaaaaauuaccauauuuuuguccccaccacaagcuggguuuuuuuccagcu

SEQ ID NO: 344907 - RNA, 64 nt, Human
gagaacgugucccagggcccaaaagucagaagggccccaccagccaggaaaguuguuucaaugc

SEQ ID NO: 344908 - RNA, 64 nt, Human
guaguccauuaaauucuccugucuagaaugacccccccaccaguacuugaccaauuucauguau

SEQ ID NO: 344909 - RNA, 64 nt, Human
cucgagguggaagcuguauagagcccggguccacggugaacagucaguggcagggaguuugcca

SEQ ID NO: 344910 - RNA, 64 nt, Human
uacucucaaaggugucuuuaaaguacagguuaauggugaacauuuucccccaguggcuucaccu

SEQ ID NO: 344911 - RNA, 64 nt, Human
uuuccuuuuucuaguuuggcacaugcagguaguuggugaacagagagaaccaggaggguaacag

SEQ ID NO: 344912 - RNA, 64 nt, Human
gguuaauguugauuuaaauuuucaugaaugugcuggugaacacugugaccaggcuuuuguagau

SEQ ID NO: 344913 - RNA, 64 nt, Human
guaauuugacuuuauagaaaucccucaguuuggcccccaccauucuacagaguuguacucaaga

SEQ ID NO: 344914 - RNA, 64 nt, Human
cagugccgcagcguuucgaggggcgugugcuggaccccaccacuguggguugcaggcccaaugc

SEQ ID NO: 344915 - RNA, 64 nt, Human
gucuuagucauuucacacaaaucagaacuuccuuccccaccagggaggacaacaucuucaugcu

SEQ ID NO: 344916 - RNA, 64 nt, Human
auuguauuguaauacugauacaguuuggcuguguccccaccaaauugaauuguguuaauaguuc

SEQ ID NO: 344917 - RNA, 64 nt, Human
ccugugacacuggcguucuccucuccccuccuucccccaccacaggucucuccugcauaggcag

SEQ ID NO: 344918 - RNA, 64 nt, Human
uucccuguugcaugagccugcgacaggaccucacccccaccaccaggcuucuauuugggauuca

SEQ ID NO: 344919 - RNA, 64 nt, Human
ucggucuugcccagaggaucacagugcugagaccccccaccaccagccgguaccugggaagggg

SEQ ID NO: 344920 - RNA, 64 nt, Human
ucagccacccucugccccauuccuagacccucacccccaccacuguuccugugucuucacgagc

SEQ ID NO: 344921 - RNA, 64 nt, Human
cgagggcagugcaagggagaaccugccagcccagccccaccacagggagagugcgucagcagac

SEQ ID NO: 344922 - RNA, 64 nt, Human
aggcuugugagggccccgucgcugccugcuggguccccaccagggcucccucuaggaaugcgcc

SEQ ID NO: 344923 - RNA, 64 nt, Human
uccagcuccaccuccacuaccacuccaagccuggccccaccagugcuguuuggccuaggaacug

SEQ ID NO: 344924 - RNA, 64 nt, Human
caggccuaggacuucuccuaagagaagggcacuuccccaccagugaucucucccgacugcacug

SEQ ID NO: 344925 - RNA, 64 nt, Human
aaagaacuuaguagcuugcugcucccucaccaccccccaccagguucaagacccuuuuucuggg

SEQ ID NO: 344926 - RNA, 64 nt, Human
uuccauuguaugaauauaccacaauuuguuuccuccccaccaguuucugauacuacaauuaaaa

SEQ ID NO: 344927 - RNA, 64 nt, Human
aucagagcuguaaagaaaacaacuguccuuuucuccccaccaccccuccugccccacuuuggcc

SEQ ID NO: 344928 - RNA, 64 nt, Human
cuggcuugacggcuucucucuuuuuuuaaaucacccccaccacauaaaucucaaauccuauguu

SEQ ID NO: 344929 - RNA, 64 nt, Human
acauuuccuguucuugaauucugcuccugaagagggugaacaaauggggcauucaaguugugag

SEQ ID NO: 344930 - RNA, 64 nt, Human
agcauguggggggugccuuuccuuuaaccagggaggugaacacuaccugccuccugcguguauu

SEQ ID NO: 344931 - RNA, 64 nt, Human
aggagaauggugugaccuaggagucagcauccuuggugaacaagaggaguggccacaaggccag

SEQ ID NO: 344932 - RNA, 64 nt, Human
cuuugaaccaguguacagucgccagauagggaccggugaacaccugauuccaaacauguaggau

SEQ ID NO: 344933 - RNA, 64 nt, Human
cuuucugggccuccccaggugaggccuggcccugccccaccaugaccugggugcucugagccca

SEQ ID NO: 344934 - RNA, 64 nt, Human
auaccccaccccgccccgcccugcccgcccccccccccaccaguccugcccccgcauggagccc

SEQ ID NO: 344935 - RNA, 64 nt, Human
gucuccccuccugcacacagggcaguccuuacucccccaccacucaggccacaguggggcugca

SEQ ID NO: 344936 - RNA, 64 nt, Human
cagcgaguacgucaucgugcccuccaccuacgagccccaccaggagggggaauucauccuccgg

SEQ ID NO: 344937 - RNA, 64 nt, Human
uccccagaaauagcccaaccaagcgaguggauguccccaccacuccuggagucccaaugacuuc

SEQ ID NO: 344938 - RNA, 64 nt, Human
aagguuaaugaacuucaggucccugcaacucagcccccaccacaaacacagcccuggaaacaua

SEQ ID NO: 344939 - RNA, 64 nt, Human
cuuguaaugaucaugucagccuucagaagagaauccccaccaacuucugugccuccucagaugg

SEQ ID NO: 344940 - RNA, 64 nt, Human
gauccccugccaucuugccuuaggaacagccuucccccaccagcagccauggcuggcuggggcu

SEQ ID NO: 344941 - RNA, 64 nt, Human
gugaacauucccagcccagccccgccccgccccgccccaccacuccagcagaccuugccccuug

SEQ ID NO: 344942 - RNA, 64 nt, Human
guggccuugccuggggagccccauguguggcccaccccaccaggccauccccauaccuucuggu

SEQ ID NO: 344943 - RNA, 64 nt, Human
aggaggaagggagacugggcccacugauuuccagccccaccaugugugcuguuuucagauguga

SEQ ID NO: 344944 - RNA, 64 nt, Human
agggaggaaggaggccacggagcgggaggcagcgccccaccacgucgggcuucccuggccuccc

SEQ ID NO: 344945 - RNA, 64 nt, Human
ccccaguugcuguggcuugauucugcuacccugaccccaccaugugccagguggcaucugccuu

SEQ ID NO: 344946 - RNA, 64 nt, Human
aaugccucuggggguuauuuuugcuuuccuuggcccccaccaauuuauacaucuccauuuucug

SEQ ID NO: 344947 - RNA, 64 nt, Human
gcccacccucgcccugcuugcccugccgcaggccccccaccagaagccaucucccccgcugugu

SEQ ID NO: 344948 - RNA, 64 nt, Human
gaguuggcccugagcucuauccaccaagccagcaccccaccaucccuuugcaggggagucaaag

SEQ ID NO: 344949 - RNA, 64 nt, Human
aaaccaaaaaucuaucagcccacguggugugguuggugaacagugcaugccaggaggaagcagu

SEQ ID NO: 344950 - RNA, 64 nt, Human
caaauuuuguguagcuucuuuuguuauggaaaauggugaacaaaaaaagaaacugugauaacug

SEQ ID NO: 344951 - RNA, 64 nt, Human
auuccuggagggccaagcccaucuauuuacaaaaggugaacagcaaaaucaagcacugcuuuau

SEQ ID NO: 344952 - RNA, 64 nt, Human
gaacauuauguucuagacacuguggggacacaguggugaacagacaggcauggucucugcccuu

SEQ ID NO: 344953 - RNA, 64 nt, Human
aucucuucuccuuccccuuucugagaaacgucauccccaccaguuaacguuuccuguacacccu

SEQ ID NO: 344954 - RNA, 64 nt, Human
cuacaagaugggguacuaacaccacccccaccgcccccaccaccacccccagcuccugaggugc

SEQ ID NO: 344955 - RNA, 64 nt, Human
uggacccccaaugcauucauauuugccaagccauccccaccacccagccaugaugaugcacgga

SEQ ID NO: 344956 - RNA, 64 nt, Human
aauuuacaccccucacguuucccucucccuucuuccccaccaacaaaacccaggagguagcugg

SEQ ID NO: 344957 - RNA, 64 nt, Human
cugggccgggcugguucucuccgggccaccuucuccccaccaggcacugcagcagacggagcug

SEQ ID NO: 344958 - RNA, 64 nt, Human
acuucuggcuggcugaguauaguacuagcugccuccccaccagguuccgaguagugucugagac

SEQ ID NO: 344959 - RNA, 64 nt, Human
acgugcauucacauugaccgcaacucacacauucccccaccagcugcagccccuugcucucagc

SEQ ID NO: 344960 - RNA, 64 nt, Human
ccugggugcccccccucucccuucuccuucccggccccaccaacacucugagauccgagaggag

SEQ ID NO: 344961 - RNA, 64 nt, Human
caaggcaguuaugaucaucguuuuccugccuugaccccaccaucaucaaacacucaguuaaaua

SEQ ID NO: 344962 - RNA, 64 nt, Human
gcuaucauagcuuugcucuuaccugaagccuuguccccaccacacaggacagccuuccuccuga

SEQ ID NO: 344963 - RNA, 64 nt, Human
gugugaaacauccccucaggcugaagccccccacccccaccagagacacacugggaaccgucag

SEQ ID NO: 344964 - RNA, 64 nt, Human
cucccugaguccccacacagggccucacucugcaccccaccagggucccgcucacaccaggcag

SEQ ID NO: 344965 - RNA, 64 nt, Human
cuuuccuaacccccuuggaccuacucucccuccuccccaccauuccucuucccccacaugugug

SEQ ID NO: 344966 - RNA, 64 nt, Human
accgagggcugcagccgcugcgcugccggcuucuccccaccacccugccaccuccacugugaug

SEQ ID NO: 344967 - RNA, 64 nt, Human
ccgccucaggccuccauggagggagcugcuauguccccaccagauuggccccgugcggcugcug

SEQ ID NO: 344968 - RNA, 64 nt, Human
cggcuggcaggcacagaccagggcuccaaggccaccccaccaacgcaggccccagggucuccgg

SEQ ID NO: 344969 - RNA, 64 nt, Human
agggccaagucccaagccugcccgggggcccugcggugaacacuggucaagcucucuccggcug

SEQ ID NO: 344970 - RNA, 64 nt, Human
gagacccucggaccccugcagggccuggacuuggggugaacagggcuucagucagcgcaaguau

SEQ ID NO: 344971 - RNA, 64 nt, Human
ucucaaaggaagcaggggauucagugagugugaaggugaacaggauggccuggcagcagggaug

SEQ ID NO: 344972 - RNA, 64 nt, Human
ugucucccauuuuuuauuauuacaauauuacuguggugaacaugcuuaaaaauacauuccuugg

SEQ ID NO: 344973 - RNA, 64 nt, Human
aagcuucagcccauguguguccugguguucccagccccaccagagccccgugccgggagcugac

SEQ ID NO: 344974 - RNA, 64 nt, Human
gcuccugggugcugaagccucgcuccugucugucccccaccaccuggcccucagcuucugagag

SEQ ID NO: 344975 - RNA, 64 nt, Human
agguugucuucacugggagcguggggcccccaggccccaccagcaccguccuccccuaaugagg

SEQ ID NO: 344976 - RNA, 64 nt, Human
gaaaaggaaagcacaggcuaagcaguugaagguuccccaccauucagugagagcagaaccccca

SEQ ID NO: 344977 - RNA, 64 nt, Human
acacacacagcccccugcaccgcccgccccccgcccccaccaaggccccagccucuggccauca

SEQ ID NO: 344978 - RNA, 64 nt, Human
uuucuugccgcuugggucuucagcacgccaagccccccaccaacccuccaccccgagugaaggc

SEQ ID NO: 344979 - RNA, 64 nt, Human
auuuaaucagcaccugaugacuuggcaggacuugccccaccagggucuggcuuugaaggguagu

SEQ ID NO: 344980 - RNA, 64 nt, Human
guggguucuacagccuugucccccucccccucaaccccaccauaugaauuguacagaauauuuc

SEQ ID NO: 344981 - RNA, 64 nt, Human
uggagaaaggagcagucagcauucuuccaauuugccccaccaccaccuccucgggcuucauuuu

SEQ ID NO: 344982 - RNA, 64 nt, Human
uaaaaucaguccguuucgucucuuggaaacagcuccccaccaaccaagauuucuuuuucuaacu

SEQ ID NO: 344983 - RNA, 55 nt, Human
uugguucagcacuguccugacugcuccccaccagcacgcugaccugugaacccca

SEQ ID NO: 344984 - RNA, 64 nt, Human
ugucggggguguggggcugcccuggggcccgugcccccaccaggccagccccugcuggguucag

SEQ ID NO: 344985 - RNA, 64 nt, Human
cacccagaaagucccaccaccugcacauguguagccccaccagcccuccaaggcauugcucgcc

SEQ ID NO: 344986 - RNA, 64 nt, Human
cuuuuggaauagcauuagacccuggcuguccccuccccaccaaauaaacaugauauuucauucu

SEQ ID NO: 344987 - RNA, 64 nt, Human
agcccugcuccaacuccauacuccacuccaagugccccaccacuccccaaccccucuccaggcc

SEQ ID NO: 344988 - RNA, 64 nt, Human
gcucgcagcuucccugagcugcaccucuugcuaaccccaccaucacacugccacccugcccuag

SEQ ID NO: 344989 - RNA, 64 nt, Human
cgcaaaacagccaucaagagccaucugcuuuccaggugaacauuggaaaugagaaucuuugaaa

SEQ ID NO: 344990 - RNA, 64 nt, Human
uuuuuagaaaguguauuuuuauuaguauuuuuccggugaacagaagauuuguuuggauuuaaac

SEQ ID NO: 344991 - RNA, 64 nt, Human
uaggacugccauggcggaugcugaggccacagcuggugaacagcucagcagacaacaugcugga

SEQ ID NO: 344992 - RNA, 64 nt, Human
aaaacuccuguuucacuugguucaguaccacaugggugaacacucaaugguuaacuaauucuug

SEQ ID NO: 344993 - RNA, 64 nt, Human
ccagauaaccagcuaaucccaggaauuugcugccccccaccaguggcuucuagggaaagcaagg

SEQ ID NO: 344994 - RNA, 64 nt, Human
uuuucccagucaaaagggucugaccuuagaaaguccccaccagugaugcugaguguucugcuau

SEQ ID NO: 344995 - RNA, 64 nt, Human
gguggggcuugccagagacuguguguuuuguuucccccaccaccaucacugccaccuggcuucu

SEQ ID NO: 344996 - RNA, 64 nt, Human
uugucaccagugagcccuuggcacggucucugcuccccaccagggcagcacgggacagaaacgu

SEQ ID NO: 344997 - RNA, 64 nt, Human
ccucugccucuaagcgcugagcauugggccccuuccccaccagaccuuuguagcuccuccagcc

SEQ ID NO: 344998 - RNA, 64 nt, Human
ugcccacucacugugggucccauucggcuguuucccccaccagaccccagggaagccggggccc

SEQ ID NO: 344999 - RNA, 64 nt, Human
uuaagcucccuccgaccucccagaagccuccaguccccaccaggccccacucccaguccuccug

SEQ ID NO: 345000 - RNA, 64 nt, Human
ugcagccugugagccggagcucaugccgaccuuuccccaccaccgcaacaagcgggccgcccca

SEQ ID NO: 345001 - RNA, 64 nt, Human
agccaucgcgggcugcaucaucccccagccagguccccaccaggccugucucccagcguuuguc

SEQ ID NO: 345002 - RNA, 64 nt, Human
uucugucuguccgugcaccgaugcacacaccgcaccccaccacuguacucugaaauuggcgagu

SEQ ID NO: 345003 - RNA, 64 nt, Human
cugguccucccagcgcugcuguugcaccugugagccccaccagacucauuuguaaauagcgcuc

SEQ ID NO: 345004 - RNA, 64 nt, Human
aagaaguuuggauuacucaggcagggccauccagccccaccacuagaaaagcucuucagaaucu

SEQ ID NO: 345005 - RNA, 64 nt, Human
uuccaguucuggucaagggccuugggggcuggccccccaccaggccuucuagagcagcaccagu

SEQ ID NO: 345006 - RNA, 64 nt, Human
agggaaaaaaaccaccccaucguucccuacuccuccccaccacuuacccguucccccuuuaccu

SEQ ID NO: 345007 - RNA, 50 nt, Human
ugcggagugugaauuacugaccccaccacacaccggaccaccaagagagc

SEQ ID NO: 345008 - RNA, 64 nt, Human
cucccgcguccugcaggguaguccgcccccuccuccccaccauccucccuaccuccuuaacuuu

SEQ ID NO: 345009 - RNA, 64 nt, Human
cagcuuaccaucuccucacaccccagaguggaaaggugaacaccugcagcugaggcuuggaaac

SEQ ID NO: 345010 - RNA, 64 nt, Human
aagggagcauggcgagacccauuggauggauuggggugaacaguucaggucccaugcuuggagc

SEQ ID NO: 345011 - RNA, 64 nt, Human
gccccacuuuucugcaaguagcuggcuuguaaagggugaacagagccaugggaggaaggucugg

SEQ ID NO: 345012 - RNA, 64 nt, Human
uuccagaacgugguggaucaucugucggguguguggugaacacguucaguucaucagggccuac

SEQ ID NO: 345013 - RNA, 64 nt, Human
ccaaccccauugcuaacaacaugguacauuccggccccaccacucagagccuuccgaagccaac

SEQ ID NO: 345014 - RNA, 64 nt, Human
ccagacccuucccccaccacaucgggagcaauacccccaccaccccuuucacuccauccccugc

SEQ ID NO: 345015 - RNA, 64 nt, Human
ggccccccccacccuucucucucccagacccuucccccaccacaucgggagcaauacccccacc

SEQ ID NO: 345016 - RNA, 64 nt, Human
aucaaugagauccccucacccucaccccauccuuccccaccaauacacacaaauuuuuuaaucc

SEQ ID NO: 345017 - RNA, 64 nt, Human
agauucagaccuuguccacaccuuccugggcaacccccaccaugaaccugucagccucuuuccc

SEQ ID NO: 345018 - RNA, 64 nt, Human
uguuucuaacuuaaaaguaagacugcagauuaucccccaccagccuuaguccagggguguggcu

SEQ ID NO: 345019 - RNA, 64 nt, Human
uguucuuaggccugaaaaggggcugggcacccccccccaccaaggauggacgaagacccccucc

SEQ ID NO: 345020 - RNA, 64 nt, Human
ggaagaucuggcucagucuacuaugggcagggccccccaccaagcugagccgaauggagacagc

SEQ ID NO: 345021 - RNA, 64 nt, Human
ugcagcuccucccuuccauaaaugaagucucuuuccccaccauuugaaucugggcuggcacugu

SEQ ID NO: 345022 - RNA, 64 nt, Human
ucuacaggaaugcaccccccaccgccauuggcauccccaccaagcuccucccccagaacccuga

SEQ ID NO: 345023 - RNA, 64 nt, Human
ggcccccgucagggagaggucaccagcugcugugccccaccacgucuggcucccugccccuuaa

SEQ ID NO: 345024 - RNA, 64 nt, Human
uggagggaaggauaaagccacuucuggcuucagcccccaccaggggaaggaaggagggcacauu

SEQ ID NO: 345025 - RNA, 64 nt, Human
cuauuccaccuccuuccccugagcccagaucugcccccaccauccuuucucuggcuucuuuuag

SEQ ID NO: 345026 - RNA, 64 nt, Human
gccucuccugggacaaccagacucuguaacucacccccaccaccauacacacacacaaaaacag

SEQ ID NO: 345027 - RNA, 64 nt, Human
agaccauuggggcucccagccaggcccuugucggccccaccagugccucucccugcugcuccua

SEQ ID NO: 345028 - RNA, 64 nt, Human
cccucaacccccgaaacaaggcuucucucagccuccccaccagugauggauaacagcuccuauu

SEQ ID NO: 345029 - RNA, 64 nt, Human
guugaggcuuuucuuaggugcauacacagacccaggugaacacgcugacugugaaccugcccug

SEQ ID NO: 345030 - RNA, 64 nt, Human
ugggguggugcaggggccuugggcucccaggacaggugaacagggagggaccuccccacaccua

SEQ ID NO: 345031 - RNA, 64 nt, Human
cccaagauugagaugaugacggugaugacgacugggugaacagccaucacuucaacauugugau

SEQ ID NO: 345032 - RNA, 64 nt, Human
agugucccguggacaacgucaaacugaccgugguggugaacaacaucgcgguggccgagcagau

SEQ ID NO: 345033 - RNA, 64 nt, Human
cccagaauuagccagcuugccuccugcaccccacccccaccaaccaggggagccacuaagcuga

SEQ ID NO: 345034 - RNA, 64 nt, Human
aucccagauaauggagaauguaucagccagccuuccccaccaagucuaaaaagaccuggccuuu

SEQ ID NO: 345035 - RNA, 64 nt, Human
uauuuuguuuuuguucucaccugcugcccccccaccccaccaccccagggauaaauuggauaua

SEQ ID NO: 345036 - RNA, 64 nt, Human
uggagccugggguuggauagggccauggcuggucccccaccauaccuccccuccacaucacuga

SEQ ID NO: 345037 - RNA, 64 nt, Human
ugcaagacaucucacucuucugacauccugcaguccccaccaguccugaccgugggccccucag

SEQ ID NO: 345038 - RNA, 64 nt, Human
gcuucucaacaaccauguuacuccacuuccccacccccaccaggccucccuccuccccuccuac

SEQ ID NO: 345039 - RNA, 64 nt, Human
cuccuccccuccuacucccuuuucucacucucauccccaccacagaucccuggauugcugggaa

SEQ ID NO: 345040 - RNA, 64 nt, Human
aggcagucggccaaaugagugcaaagucuguuuuccccaccaacuuagcucucggaaagaugug

SEQ ID NO: 345041 - RNA, 64 nt, Human
cuucaggaagccugugaaaaacgugauuccugggccccaccaagacccaccaaaaccaucucug

SEQ ID NO: 345042 - RNA, 64 nt, Human
acacuguguuugugauugucugugugucugucucccccaccagacugugagcuccaugagggca

SEQ ID NO: 345043 - RNA, 64 nt, Human
uaaagccacugaaaauucgaaccaggaaauggaaccccaccacuguugguccaauuuucacaca

SEQ ID NO: 345044 - RNA, 64 nt, Human
uuuaaacguggauuguuuaaagaagcucuccaggccccaccaagaggguggaucacaccucagu

SEQ ID NO: 345045 - RNA, 64 nt, Human
gcacaacugaaauuuccccacucuguuggggcuuccccaccacauucaugucccucucccgugu

SEQ ID NO: 345046 - RNA, 64 nt, Human
uaaaucaaggaccucagccuuauauaaucauuguccccaccacuaccauggacuggacaccuuc

SEQ ID NO: 345047 - RNA, 64 nt, Human
agcuggggagcuggggcccugggucagucuggccccccaccagcugccuguccaguuggccuau

SEQ ID NO: 345048 - RNA, 64 nt, Human
cuuuauaggaggauaggccucugcccugccccacccccaccaccuguccccacccaguguccca

SEQ ID NO: 345049 - RNA, 64 nt, Human
aaguuuacacuucauauagcauugauaaucuucaggugaacacuuagugaucauuuaaaaagcu

SEQ ID NO: 345050 - RNA, 64 nt, Human
gccugauaauuucagaugccaccguauagcaaagggugaacauguuuucaacccuuuaacuuuu

SEQ ID NO: 345051 - RNA, 64 nt, Human
acaugcacacaacacauacacacacacgcacagaggugaacagaaacugaaacauuuuguccac

SEQ ID NO: 345052 - RNA, 64 nt, Human
aauuuagaauauguuaaggccaaguagguuaacuggugaacauuucuagaauucaaaaguuucu

SEQ ID NO: 345053 - RNA, 64 nt, Human
aagggccuucucuccaagcugggagcuccugggcccccaccauucacuuuuuguccuugcugcu

SEQ ID NO: 345054 - RNA, 64 nt, Human
acaagcuccuuugugcuuugcacaaaccugaaucccccaccagagaggaugugugugaggagcc

SEQ ID NO: 345055 - RNA, 64 nt, Human
gucccaccacacagugccagagccagagaaggggccccaccaccaaggccaagcuugaccaggu

SEQ ID NO: 345056 - RNA, 64 nt, Human
ccacuccgaucgcaauagauaacauugccaucgcccccaccaguccccucaugccucugggcag

SEQ ID NO: 345057 - RNA, 64 nt, Human
gggacuccgcagcgggccccugccuuccacaugcccccaccauuuuucuuugccgguuugcaug

SEQ ID NO: 345058 - RNA, 64 nt, Human
aaccauucuacucuucuggugggcuuugggguauccccaccaacuuucccuucaaaauagcacc

SEQ ID NO: 345059 - RNA, 64 nt, Human
agcaauauacuuaaccugaaucucuacucacagcccccaccagcucugaaugucuaaccugcuc

SEQ ID NO: 345060 - RNA, 64 nt, Human
ucccccuuucaccagaugccacccucccugaaccccccaccacuaccagcucccuggccucccu

SEQ ID NO: 345061 - RNA, 64 nt, Human
cccaugacuucagcuccaccuggggcacccagcaccccaccacagggcuagaggcccuaagacc

SEQ ID NO: 345062 - RNA, 64 nt, Human
uucuccccugggagacucccuuugccaccaaggcccccaccagggccucugaccaccgcucugg

SEQ ID NO: 345063 - RNA, 64 nt, Human
agaacaaaggcugagauggcagugcacacacccuccccaccaguggggaccugagaaugcgugu

SEQ ID NO: 345064 - RNA, 64 nt, Human
guuccuugaagaaugcagcauugucuuugucuguccccaccacauggaggugggggugggauca

SEQ ID NO: 345065 - RNA, 64 nt, Human
uugggaagcucugucgugccccuaccccacgccgccccaccacuauaggcugcuggaguccugg

SEQ ID NO: 345066 - RNA, 64 nt, Human
agggcuaaggcuuuagcauugugaagcgcugcacccccaccaaccuuacccucaccggggaacc

SEQ ID NO: 345067 - RNA, 64 nt, Human
aaguagaaugccauuggaugucaaauggauuuuuccccaccauucugugacauucuuuacacca

SEQ ID NO: 345068 - RNA, 64 nt, Human
ugucccccacuuuuaaagaugggucucaaccccuccccaccacgucaugauggauggggcaagg

SEQ ID NO: 345069 - RNA, 64 nt, Human
guguagaguacaggaauggggcagacgcgauucaggugaacagcacaagaagaauaugaggugg

SEQ ID NO: 345070 - RNA, 64 nt, Human
gcccucugcucuucugcccucgaugccacauggcggugaacacaucugaagccacuauguuucc

SEQ ID NO: 345071 - RNA, 64 nt, Human
guguaagaugauaucagguuggucuaagacuuuuggugaacacguucauucaacugugaucacu

SEQ ID NO: 345072 - RNA, 64 nt, Human
auugucacugcaaggcagcccugcuugggauucaggugaacaaauguaacgugggugggugagg

SEQ ID NO: 345073 - RNA, 64 nt, Human
uaaaugugugaagugcgauuucugcuuuuguguaccccaccaccccauuaccacagcugccuuu

SEQ ID NO: 345074 - RNA, 64 nt, Human
aaaacagggaguugaaguccaaccuauuuaaaaaccccaccauuuggagaauuacaaggguuuu

SEQ ID NO: 345075 - RNA, 64 nt, Human
cuaguaaaggaacuaugcaaaugcaggccacucuccccaccacgucugugcccugcacuguccc

SEQ ID NO: 345076 - RNA, 55 nt, Human
aggggaaguugaaacccuagggcacccccaccaccucugcucgagagguccgugg

SEQ ID NO: 345077 - RNA, 64 nt, Human
acagggcuggggcuggguuggaacaggugugugcccccaccacagcucuaugacucuguucucc

SEQ ID NO: 345078 - RNA, 64 nt, Human
accacauauacuuucucuccuucuaucuccagggccccaccaaucuguuuacauauuuauuauc

SEQ ID NO: 345079 - RNA, 64 nt, Human
cugugugaggggcgggcccaggcccuagacccucccccaccauuccacauccccaccuuccaag

SEQ ID NO: 345080 - RNA, 64 nt, Human
cgccucugcuggcacauuuccccagaccugagcuccccaccaccccagcugcuccccucccucc

SEQ ID NO: 345081 - RNA, 64 nt, Human
caagccaccucagcuuguggcucuuggcccccagccccaccaacccaccuguucauuuauucaa

SEQ ID NO: 345082 - RNA, 64 nt, Human
ggcuggguccccuugguuuuucgugcuggaacauccccaccagagccucucugccauaacugcc

SEQ ID NO: 345083 - RNA, 64 nt, Human
gaucaucaaaaguucccacucccuacuucugccaccccaccaacgccuuggacuccucucuuug

SEQ ID NO: 345084 - RNA, 64 nt, Human
ccacuuaugccgugguccugcccugagccccuuuccccaccacaacccaccacggccaggcaga

SEQ ID NO: 345085 - RNA, 64 nt, Human
uccagaacugccccccaacacagguccacagacaccccaccaccuaggcaggggcugggccagg

SEQ ID NO: 345086 - RNA, 64 nt, Human
cuuuuggcuggucccgucccugaugucacccccaccccaccagccccuuucaucccuccuuccu

SEQ ID NO: 345087 - RNA, 64 nt, Human
uccugcauugcuucccugugaguccaaggccuucccccaccacugggcagaggcuggacagcac

SEQ ID NO: 345088 - RNA, 64 nt, Human
cuccugcgugcgcccccaccugguccccggaugcccccaccaccuggacagaggccacacugac

SEQ ID NO: 345089 - RNA, 51 nt, Human
cuuacuuucccucgggaugaaggugaacaugggggugagacugaagccuga

SEQ ID NO: 345090 - RNA, 64 nt, Human
cugcuguucuccuacagaaaagugauucugugagggugaacaggaaaugccuuguggaaacagg

SEQ ID NO: 345091 - RNA, 64 nt, Human
augaauaaaugauucguguuucacucuuucaagaggugaacagauacaaccuuaaucuuaaaag

SEQ ID NO: 345092 - RNA, 64 nt, Human
ccaacuguauauuguuuacuuuauuguaaauacuggugaacagugguuaauaaauaguuuuaua

SEQ ID NO: 345093 - RNA, 64 nt, Human
cgucccgccugugguccccccagcaccuucccugccccaccaugccccccacccugccacaccc

SEQ ID NO: 345094 - RNA, 64 nt, Human
ugaguguuugagggacaacgaccaaaggucuuuuccccaccaucuuuaaaucaaaguuguuuaa

SEQ ID NO: 345095 - RNA, 64 nt, Human
uaauacagaagcuugacaagcauguccucacccuccccaccacauaaacacauggacacacacc

SEQ ID NO: 345096 - RNA, 64 nt, Human
ugcuagacucuacauagaaacugaacaucaagaaccccaccaaaauauuacuuuuaaaaacaau

SEQ ID NO: 345097 - RNA, 64 nt, Human
cuuaauaacaauugugaguggcuguuugaguugcccccaccauguccuuagaucuaaucugugc

SEQ ID NO: 345098 - RNA, 64 nt, Human
aaagaauggcuucacuuucauucuguauucuuccccccaccauguggcugggaggacuugggag

SEQ ID NO: 345099 - RNA, 64 nt, Human
augccucccagcaaccagggcccgcggguguggcccccaccagcccaggccuggacucuccuca

SEQ ID NO: 345100 - RNA, 64 nt, Human
ccauaggucgccccagggccucugcccacccgagccccaccacucucagaacccccgcccagcg

SEQ ID NO: 345101 - RNA, 64 nt, Human
gguuggguggauggagcucagaaggaaaccccagccccaccacggaugacaccaucccucccgu

SEQ ID NO: 345102 - RNA, 64 nt, Human
ggccugagaccccgguugcccauucauggcugcaccccaccaugucaaacccaagaccagcccc

SEQ ID NO: 345103 - RNA, 64 nt, Human
aguggggccugagcugagcacugcccccucacccccccaccaccccuucccauuucaucggugg

SEQ ID NO: 345104 - RNA, 64 nt, Human
cgggccuaguucaaaccuuugccucaaagccaucccccaccagacugcuuagcgucugagaucc

SEQ ID NO: 345105 - RNA, 64 nt, Human
ucauuccuacucugaauugucacacuuuucccuuccccaccaguucuuuaauaaaaguauuuga

SEQ ID NO: 345106 - RNA, 64 nt, Human
aaucccugcaccugaguugguccucccucugcacccccaccaccuccugcccgucuggcaacug

SEQ ID NO: 345107 - RNA, 64 nt, Human
ccucccugcccucccgucauuugcccugggucucccccaccagaaugggagccaggagucccag

SEQ ID NO: 345108 - RNA, 64 nt, Human
ccugaugagaggggaaguggugggggagacauagccccaccaugaggacauacaacugggaaau

SEQ ID NO: 345109 - RNA, 64 nt, Human
auauggaacuuaguuacaggacucaauaauggugggugaacauuagucauuuuuaaaagacacc

SEQ ID NO: 345110 - RNA, 64 nt, Human
uuuuuguuuguuuguuuaaaucaagccugaggcuggugaacaguagcuacacacccauauugug

SEQ ID NO: 345111 - RNA, 64 nt, Human
auacaagaacuugguuguaccucagggguauuauggugaacaaaaaaaaaaccagucucaaaug

SEQ ID NO: 345112 - RNA, 64 nt, Human
uaauucguuagaugcuuguuaaaugaaguggguaggugaacaaaguuaacgaaugcccuguuau

SEQ ID NO: 345113 - RNA, 64 nt, Human
agggguggccccgccgaggcuucaggggcccccuccccaccaaaggguucaccucacacuugaa

SEQ ID NO: 345114 - RNA, 64 nt, Human
uugcccucccugggccccccaccuuggugacucgccccaccacccccagcccugucccugccac

SEQ ID NO: 345115 - RNA, 64 nt, Human
ccugagcuaccugcacccgagcccuggggcucagccccaccacaggggcggguggacgugcugg

SEQ ID NO: 345116 - RNA, 64 nt, Human
gagggcaccccauccucagugcccaaugcuguggccccaccaggcccagagccugguuggccau

SEQ ID NO: 345117 - RNA, 64 nt, Human
ccacacugaccacccucaacccauugcgcccaguccccaccacagugaccacacccucacuggc

SEQ ID NO: 345118 - RNA, 64 nt, Human
ccucggucgucugagcugugugcagacaacauccccccaccacccaagagggaggguagcucuu

SEQ ID NO: 345119 - RNA, 64 nt, Human
cagccucagggcugcacguuaccucaggaaugggccccaccaugaaggggcccaucugucagca

SEQ ID NO: 345120 - RNA, 64 nt, Human
aaauaccugcccugacaugcacaccucccccugcccccaccacggccacuggccaucuccaccc

SEQ ID NO: 345121 - RNA, 64 nt, Human
cuucccuacccuggacugaagggucugcccauccccccaccacccuccauccugggggcccucg

SEQ ID NO: 345122 - RNA, 64 nt, Human
cucagccucuggaggagcugguaucacaggcgucccccaccacgccuggcuaaauuuuguauuu

SEQ ID NO: 345123 - RNA, 64 nt, Human
caucuguacauacugugucccuuccucuucccauccccaccaccuuguaaguucuaaauuggau

SEQ ID NO: 345124 - RNA, 64 nt, Human
ucauacaucaagccaauaccguguggcccaagacccccaccauaaaucacaucauuagcaugaa

SEQ ID NO: 345125 - RNA, 64 nt, Human
cucagagucuucuccccuuaggacaaggcagacaccccaccaugcgggccucagguggcagaga

SEQ ID NO: 345126 - RNA, 64 nt, Human
gggcuagcuaaaggguggggagagggaagaugggccccaccacgcucucaagagaacgcaccug

SEQ ID NO: 345127 - RNA, 64 nt, Human
uuuuuccccuuuucuguucauuucaucuggcuccccccaccaccuccccaccccaccccccacc

SEQ ID NO: 345128 - RNA, 64 nt, Human
ugucucuauuaaaaaaaaaaaaucaacccuucuuccccaccaaaccacccaacuccucucuacu

SEQ ID NO: 345129 - RNA, 64 nt, Human
aaauuuccaucuggggauuaacuucugucuuucuggugaacaauauagcaauucacgcauucuu

SEQ ID NO: 345130 - RNA, 64 nt, Human
ccaaggauucaagcaaagggaaguggaaucuuguggugaacaguaccuugucuggauguggugc

SEQ ID NO: 345131 - RNA, 64 nt, Human
ugacuaaguguacgucuuuccguguguguaugcuggugaacagucagauuuauuuauauuuuuu

SEQ ID NO: 345132 - RNA, 64 nt, Human
acauuuuggaagagaguuuuucaucuuagagauuggugaacaagugugagggugugagaaacuc

SEQ ID NO: 345133 - RNA, 64 nt, Human
agccuuuggucaugccacccacucuaccaguuguccccaccaucccccgcccuccucccuguga

SEQ ID NO: 345134 - RNA, 64 nt, Human
agccaagaguaugaggcugcagugagcccaugagccccaccacuacacuccagccuggaagaca

SEQ ID NO: 345135 - RNA, 64 nt, Human
ugaugggccccagaagaugggggacaucccccagccccaccaaccccuggccaccuugggacuc

SEQ ID NO: 345136 - RNA, 64 nt, Human
gcucaggagccagcacaggacaccccccaccccaccccaccauguccccauuacaccagagggc

SEQ ID NO: 345137 - RNA, 64 nt, Human
cgcagccccaggccaucaucugcugcuggggcccccccaccacgcggugccaggcccagugucc

SEQ ID NO: 345138 - RNA, 64 nt, Human
gcaggaccugugagagccaccucacaggcagagcccccaccaggcagggcaaggagacuccgcu

SEQ ID NO: 345139 - RNA, 64 nt, Human
uccacagggccuuggguucccugagcuguccagaccccaccaucucccggaccccagggaggug

SEQ ID NO: 345140 - RNA, 64 nt, Human
ggcugggagccggcaggguuuggggugugggcguccccaccacgcauagcaggaauggcaggaa

SEQ ID NO: 345141 - RNA, 62 nt, Human
agucuuccugcaauaaaaaaguggauccugcauuccccaccagcauggcgcccugucucugu

SEQ ID NO: 345142 - RNA, 64 nt, Human
cgccccggacagaggucugccccacccacuuccuccccaccaccugugccccagagagcagggc

SEQ ID NO: 345143 - RNA, 64 nt, Human
cgcaggggccccggcccucccuggcuccccuuccccccaccaccccaucgcuggguuucggggc

SEQ ID NO: 345144 - RNA, 64 nt, Human
ucuggguccccaggucccugcgcagccaccagggccccaccagaccauggguuccuuauucugg

SEQ ID NO: 345145 - RNA, 64 nt, Human
guagaaggggaaagccuucaucuuggcgaaccggccccaccacccccuccuacccgggccuccg

SEQ ID NO: 345146 - RNA, 64 nt, Human
acacagcugagggagaggcccagcccugagccucccccaccaggacugggccuccccggcagca

SEQ ID NO: 345147 - RNA, 64 nt, Human
gaguuugagaccagccugggcaacauagcaagacccccaccaucucugaaaaaaaaaauuagcc

SEQ ID NO: 345148 - RNA, 64 nt, Human
ccacccuccaugcuccacccccaggcgguuuggaccccaccacuguugccauggugaccaaacu

SEQ ID NO: 345149 - RNA, 64 nt, Human
ggaugaggcugggugacauuucccaggacagcauggugaacauuaccaggcaugcuagcuggcc

SEQ ID NO: 345150 - RNA, 64 nt, Human
aauuauuuuugacaagauguccugguagacuaaaggugaacagauuugcucuugcucaucuucu

SEQ ID NO: 345151 - RNA, 64 nt, Human
uguuugaugagaggaaugagcagagcauugauguggugaacaaggaucuagugagacucuccca

SEQ ID NO: 345152 - RNA, 64 nt, Human
ugauugucauuucgcuuuuuaauaaagugggucuggugaacaagaaauguaauaaacacguggc

SEQ ID NO: 345153 - RNA, 64 nt, Human
gccaccaagauaucugagcaaccaagagucccagccccaccaguaucugcuucuguagcccacg

SEQ ID NO: 345154 - RNA, 64 nt, Human
cagcccagggcccucacccaccucggagaggcguccccaccaucggauccaggcuugcuagggg

SEQ ID NO: 345155 - RNA, 56 nt, Human
agaaggaaaccuacuacugaccucagccccaccacaucgcccaucucuuccccguc

SEQ ID NO: 345156 - RNA, 53 nt, Human
cccucacuaacuccuccugagggccccaccaagcacccuuccacuuccaucug

SEQ ID NO: 345157 - RNA, 64 nt, Human
acauuuaccagagucugggauggugggcuucuccccccaccacuaacaccucagacgcuugggc

SEQ ID NO: 345158 - RNA, 64 nt, Human
uggaaaagcucccugccuucccuugccgcuggucccccaccaggcuugggagcccuggcauccc

SEQ ID NO: 345159 - RNA, 55 nt, Human
ugggcgaggagcguaacuaaguccgccccaccacacuccccgccuguccugccuc

SEQ ID NO: 345160 - RNA, 64 nt, Human
ucgcuccucauggugugccuccaaccccccuguuccccaccaccucaaccaauaaacugguucc

SEQ ID NO: 345161 - RNA, 64 nt, Human
cgugaugagugaggacuuggguccucggucuuacccccaccacuaagagaauacaggaaaaucc

SEQ ID NO: 345162 - RNA, 64 nt, Human
uccuuucccagagcaguugcuucaggcguuuucuccccaccaagcccccacccuugcuguguca

SEQ ID NO: 345163 - RNA, 64 nt, Human
gacaauaagggaauaaaagcuggcgagcgcggcaccccaccagagucugcuuccacgcuguggg

SEQ ID NO: 345164 - RNA, 64 nt, Human
cugaguucaggcucugcacggcauggagugggaaccccaccagcugcugcuacaggaccuggga

SEQ ID NO: 345165 - RNA, 64 nt, Human
cggagggagucccugugcccaaggucucucugcaccccaccauccacauguauuuuuccuucua

SEQ ID NO: 345166 - RNA, 64 nt, Human
auggucggucacuaugggccuggugucuccccucccccaccacccggugcugcccagcucaagc

SEQ ID NO: 345167 - RNA, 64 nt, Human
uugagagcccuaauacuaaaagaugggcacccacccccaccaagggaagacugccccauucccu

SEQ ID NO: 345168 - RNA, 64 nt, Human
gcaaaaauacugaguuguuauguuuauguuaucaccccaccacuaccuccaugguuguucauuu

SEQ ID NO: 345169 - RNA, 64 nt, Human
uccguaaaguggggauagugaagaugacaccccuccccaccaccucucauaagcacuuuaggaa

SEQ ID NO: 345170 - RNA, 64 nt, Human
ggcugaagugucacagccuguuucuggauuugcaggugaacagccuccagacggugugcaccaa

SEQ ID NO: 345171 - RNA, 64 nt, Human
gggaaccaauguuaucuuuaauguugcuuguucuggugaacagagaaucuuaagagcuguuaga

SEQ ID NO: 345172 - RNA, 64 nt, Human
auccccaacuauuaaggauuugucccaggccaauggugaacaugcugcauuuuauguuuggauu

SEQ ID NO: 345173 - RNA, 64 nt, Human
ccucuuccugagggcuguagccagguccgcaucuccccaccaccaccagggcacucacucgcag

SEQ ID NO: 345174 - RNA, 64 nt, Human
aucccuccccucucucccugguccccucccccauccccaccacugauaucauggggaguaauag

SEQ ID NO: 345175 - RNA, 64 nt, Human
aaagcacugaaaacaccacagugacccucccaccccccaccaauauguaauucuauuaauagaa

SEQ ID NO: 345176 - RNA, 64 nt, Human
gcucugaccuauaaugucuuaggugcaacacggaccccaccagagcucuuggauaccccccuag

SEQ ID NO: 345177 - RNA, 64 nt, Human
aucccagccccgaagccagggccaugccagcaggccccaccauggaaaucaaaacaccgcacca

SEQ ID NO: 345178 - RNA, 64 nt, Human
cuucugcgcucucucccuucuccccucaccccgcccccaccagcccagugcgcccugccgccgc

SEQ ID NO: 345179 - RNA, 64 nt, Human
agccucuagucgccuccugccaucugaucucccuccccaccauucccguacucaguuguucuuu

SEQ ID NO: 345180 - RNA, 64 nt, Human
gguagaaagcugcccaucgggggcccuagcucagccccaccaggcccucuguugggccugcaca

SEQ ID NO: 345181 - RNA, 64 nt, Human
aaggagagggacagcacaggccacagagggcugcccccaccacacacacccccgcgucucggga

SEQ ID NO: 345182 - RNA, 64 nt, Human
caacuugugaaaagcaguuuagcugcaucugucuccccaccacccccaccccgggaggggcuua

SEQ ID NO: 345183 - RNA, 64 nt, Human
cuggaugcccugccuguugagccccauucuacauccccaccauuaaccaggccccacccacaag

SEQ ID NO: 345184 - RNA, 64 nt, Human
cugagacuuggaauauggaagaagcaauacccaaccccaccaaagaaaaccugagcuugaaguc

SEQ ID NO: 345185 - RNA, 64 nt, Human
ucccuagggugugggagacuccgcccugccggguccccaccagggaggcgcgaccccuuguggg

SEQ ID NO: 345186 - RNA, 64 nt, Human
cucagcgugacccaacuuuucuagugugccacggccccaccaccuccugcaguacccacaccau

SEQ ID NO: 345187 - RNA, 64 nt, Human
ccccgccagguguggccccgccugcucuuuccucccccaccaguauggccccaccugcucuuuc

SEQ ID NO: 345188 - RNA, 64 nt, Human
gacugggagggaaaguccagggcccccccacccuccccaccacccuccgccaucagccugccug

SEQ ID NO: 345189 - RNA, 64 nt, Human
cccuguuaggcugccacaggcccugcuucuggaaggugaacagcuccuggcugcugccgagagg

SEQ ID NO: 345190 - RNA, 64 nt, Human
guuugaaugcagucuguccaggcucgucauuggaggugaacaagcaaacccagacggcuccacu

SEQ ID NO: 345191 - RNA, 64 nt, Human
auuauuuucugaacuauaauaggguuuuucuucaggugaacaauuugacgugucaucaguuuuu

SEQ ID NO: 345192 - RNA, 64 nt, Human
cagagaagcgcuguugcccgcccuccacccacuaggugaacagcaggaugcccuguugggggcu

SEQ ID NO: 345193 - RNA, 64 nt, Human
gggucagcagggacccacugccccaucucccucuccccaccaagacagccccagaaggagcagc

SEQ ID NO: 345194 - RNA, 64 nt, Human
caagaguuccaaagagccucuggcccaggccccuccccaccagggcuuugcagauguccuugaa

SEQ ID NO: 345195 - RNA, 64 nt, Human
gcuccuuccaggaggggacccucagcccugugccccccaccacuucaggccacaccagguuccc

SEQ ID NO: 345196 - RNA, 64 nt, Human
cuacacggguuagcugcccagugagccaucccguccccaccacccuccuccugccuccugaccc

SEQ ID NO: 345197 - RNA, 64 nt, Human
ggacaacuggccuggccgcucccauccuguaagcccccaccacggggagacccucaucccugcc

SEQ ID NO: 345198 - RNA, 64 nt, Human
guguggaaauggccaccaccauucuccuuccccaccccaccacaaaaagagaagcugugucuuu

SEQ ID NO: 345199 - RNA, 64 nt, Human
cauuuaacccuuguccccugaccucaguucugugccccaccaaaugcccaggggcaagaggcca

SEQ ID NO: 345200 - RNA, 51 nt, Human
agacgaagccuuccccaugaaccccaccacuggcuaaaacuggacacaucc

SEQ ID NO: 345201 - RNA, 64 nt, Human
gcuaugccagccaguggacccucaaccgaccccaccccaccaucucagcacacacccucaccac

SEQ ID NO: 345202 - RNA, 64 nt, Human
aaugauccccaaagugagagguggcucccccggcccccaccacccucagcagccccaccccacu

SEQ ID NO: 345203 - RNA, 64 nt, Human
ccugaggucuggagaaaccccuggagaaggguguccccaccagcccauacagcgugugugugga

SEQ ID NO: 345204 - RNA, 64 nt, Human
uggcaggccccugugugugggguggugagggucuccccaccagugcugcaccccgcagcagcau

SEQ ID NO: 345205 - RNA, 64 nt, Human
ugaagcaagaguccagcguucugccgugucugucccccaccaugcccccuacaggcgguacuga

SEQ ID NO: 345206 - RNA, 64 nt, Human
cacggggaccaggaccccacagcgcacccccccuccccaccaacuucucugccccagggacccg

SEQ ID NO: 345207 - RNA, 64 nt, Human
ggugagaagagguccccccuuuuuaugugcacuaccccaccaucugugauuauaauaaauuuau

SEQ ID NO: 345208 - RNA, 64 nt, Human
uauggaucccuugggcugugggccuucccauccaccccaccacaacugcccagguagcuggagc

SEQ ID NO: 345209 - RNA, 64 nt, Human
uuauuuauacuugguguugcuugucauggacaccggugaacaugccguaacucugugacugcau

SEQ ID NO: 345210 - RNA, 64 nt, Human
gguacaauuguaaaccuagaguuuuaucaacuuuggugaacaguuuuggcauaauagucaauuu

SEQ ID NO: 345211 - RNA, 64 nt, Human
guaagauuuccuucuuuuuuucuugaaaguaccaggugaacaaaguuuaccagaaagcaguuga

SEQ ID NO: 345212 - RNA, 64 nt, Human
guauggaauccaucaguguuacgugaugagaauaggugaacacaccuugucagugaugauguaa

SEQ ID NO: 345213 - RNA, 64 nt, Human
gaagugugcuggguccuucccucugcucccuacuccccaccacggcagagaauaggcuuucuaa

SEQ ID NO: 345214 - RNA, 64 nt, Human
ggacacaaggaggugggaagugggagggucccagccccaccaaguacgcagagacccccuuguc

SEQ ID NO: 345215 - RNA, 56 nt, Human
ccuuccaccccuccaacuagugcccuccccaccaugccuccuucccaggacccagg

SEQ ID NO: 345216 - RNA, 64 nt, Human
gcccaucugcauccuauuuaauuucuucccuucuccccaccaguguugucacagggcuauguug

SEQ ID NO: 345217 - RNA, 64 nt, Human
gguccccaguccuggccucugcccgccccugcugccccaccaccuucugcacacacagcggugg

SEQ ID NO: 345218 - RNA, 64 nt, Human
ccgggauggguccuugcuucucagcuguguccgaccccaccauguaauaaaacccaaaggaaca

SEQ ID NO: 345219 - RNA, 64 nt, Human
uaauagcuguuccuuaggccccacuccaugccacccccaccagcuggaggacccagccucacag

SEQ ID NO: 345220 - RNA, 64 nt, Human
ucccugagccaggcugagacuagaaccccaucuuccccaccacgccaccccuguggcugcuaca

SEQ ID NO: 345221 - RNA, 64 nt, Human
ggcgguccccauccugggcccccacucuagacccccccaccaccugguuaagucucgagugaau

SEQ ID NO: 345222 - RNA, 64 nt, Human
cacaucccagguggugggagcagaggguacccugccccaccaggguccuuagggaugcucuagg

SEQ ID NO: 345223 - RNA, 64 nt, Human
agcccccagcccccugaggcccuguccaucuucuccccaccaccgccccggugugcguacccag

SEQ ID NO: 345224 - RNA, 64 nt, Human
cuuccagcugggugucccacauguuggauuccguccccaccacacuuccagagaccggagaacu

SEQ ID NO: 345225 - RNA, 64 nt, Human
agacaaggguggggcuccacaggcagcacaggcgccccaccaccacccaguuuggggacccagu

SEQ ID NO: 345226 - RNA, 64 nt, Human
agagguaggcagccaaagggcacagaacccugugccccaccaggauuggccugcugcuaggggc

SEQ ID NO: 345227 - RNA, 64 nt, Human
cucacaggugacaggcucaggguucucauccuggccccaccagggccuugggcaaguccugccc

SEQ ID NO: 345228 - RNA, 64 nt, Human
cuaagacacugcucugcccagagcugaagucuggccccaccaugaguccuguguccaggccgga

SEQ ID NO: 345229 - RNA, 64 nt, Human
guuguuacuucuaaaaauuaguauugaguuuaauggugaacacauuuuucuauuuucucuugaa

SEQ ID NO: 345230 - RNA, 64 nt, Human
auuuauuauuuaaauuuuacuagcaaaagucuuaggugaacaaucaacuaguauuuguugagcu

SEQ ID NO: 345231 - RNA, 64 nt, Human
aguucacuugaaccucuuuauagcauugauacuaggugaacagaaauuaccugacuaauaauuu

SEQ ID NO: 345232 - RNA, 64 nt, Human
caagcuggcagauacauuugacucuacagaugaaggugaacaauguuagaauaaaauugcuuug

SEQ ID NO: 345233 - RNA, 64 nt, Human
gcuacaaaaggaauggaaagggaagggaauuuccccccaccaugggcugugggagaguugaccg

SEQ ID NO: 345234 - RNA, 64 nt, Human
cugccagaucuucccaucuuguggcauguggugcccccaccaacaucccaaggggaccaauccc

SEQ ID NO: 345235 - RNA, 64 nt, Human
gugaaacuccuuucaucucuguccuauggccccaccccaccauucccucuaggcccagaccauc

SEQ ID NO: 345236 - RNA, 64 nt, Human
agaauggcauccucaggggcguguacccuggcagccccaccagcuggcuggucgucaucauggc

SEQ ID NO: 345237 - RNA, 64 nt, Human
cagcaccagcaaacucuggacugguggaagaauuccccaccagaucuccuugaagcagaaguag

SEQ ID NO: 345238 - RNA, 64 nt, Human
aaaaagaugagaagaacacuuguucauaggagggccccaccagucagagcccugaaucucuucc

SEQ ID NO: 345239 - RNA, 64 nt, Human
ccugcccacuuguccccugcugccugcccaaacaccccaccauuggccugucaacccacccauu

SEQ ID NO: 345240 - RNA, 64 nt, Human
aaaaucacaccauuuucaugccugucaauccccaccccaccacaaggcaggaaggggguggugc

SEQ ID NO: 345241 - RNA, 64 nt, Human
caucuugaucaggcuuucucaagcccuccaucggccccaccagaucuccauucuuugccaugag

SEQ ID NO: 345242 - RNA, 64 nt, Human
ucuccucuuccaggcccccaaccccccauuucuuccccaccaaccccuccaaugcuguuauccc

SEQ ID NO: 345243 - RNA, 64 nt, Human
guugcagcuaggucggggccccaguuaagcugugccccaccacccuaggcaaugaggggcagga

SEQ ID NO: 345244 - RNA, 64 nt, Human
cuccaccucaaagucauuugacugcccccauccaccccaccacccuaaucuuccaccaccucuc

SEQ ID NO: 345245 - RNA, 64 nt, Human
gaacaaauauuugauaagcuccuauuaauugucaccccaccaagcggacagcuaacaugaauug

SEQ ID NO: 345246 - RNA, 64 nt, Human
gucaaaaauuuaaaaucuuaaauguguaagucacccccaccaaaaacaaaagagaagaaaaaga

SEQ ID NO: 345247 - RNA, 64 nt, Human
auuauuggcuucuguuucauauggacccagagagccccaccaaaccuacgucaagauuaacaau

SEQ ID NO: 345248 - RNA, 64 nt, Human
uguucuccucgagggcuccagcauccucugcuucccccaccacguucccaucacccaccucauu

SEQ ID NO: 345249 - RNA, 64 nt, Human
cauuuguaauagcuucauguacagcaugcugcuuggugaacaaucauuaauucuucgauauuuc

SEQ ID NO: 345250 - RNA, 64 nt, Human
acuuuugguuuuuauauuucucguauuuaauaugggugaacaccaacuuuuauuuggaauaaua

SEQ ID NO: 345251 - RNA, 64 nt, Human
uaccacacacuguuuuuuggcuugcuuauguguaggugaacagucacgccugaaacuuugagga

SEQ ID NO: 345252 - RNA, 64 nt, Human
cuuuguguccaagauucuuuaauccauuuuuguuggugaacaucucagacuauagauaagugga

SEQ ID NO: 345253 - RNA, 64 nt, Human
acuguaguggccuuuggagaugcccccaccucccccccaccaacucucgcguguuggagagaag

SEQ ID NO: 345254 - RNA, 64 nt, Human
ucuguagccaggugcaccucaggcugcacaaauaccccaccagaaugucacaaucauucauugc

SEQ ID NO: 345255 - RNA, 64 nt, Human
guagguucaaccugucccuuucccugccagcaaaccccaccacccuaagagaaauuuuagcuua

SEQ ID NO: 345256 - RNA, 64 nt, Human
gauggggugacuucugcuuugguccuuccaccacccccaccaaguaaaccaccuguggcagcgg

SEQ ID NO: 345257 - RNA, 64 nt, Human
uucuuuaucuugcuuaacuuauccuccuuuccuuccccaccaaaauugggauuguucuaaacaa

SEQ ID NO: 345258 - RNA, 64 nt, Human
agggguagagugagguagacacuggacucccuguccccaccaccccugccccacccagggccaa

SEQ ID NO: 345259 - RNA, 64 nt, Human
uuguagggugaggcgugggauccagagagaagcaccccaccacacacacccuuccccacucccg

SEQ ID NO: 345260 - RNA, 64 nt, Human
ccccccuagcagcauuccaucccagccagagcacccccaccaucaggccagucaacugcacaau

SEQ ID NO: 345261 - RNA, 64 nt, Human
uggaucccggccaccagggggcuccuacucccacccccaccacccccagucaccauugucacca

SEQ ID NO: 345262 - RNA, 64 nt, Human
auuuagugcuugcccccugcucucuccugucgugccccaccaccuccuggcaucacagggcaac

SEQ ID NO: 345263 - RNA, 64 nt, Human
uaucucccagugcuaucccuccccccucccccgaccccaccacaguccccagagugugauauuc

SEQ ID NO: 345264 - RNA, 64 nt, Human
uuuucccgcagagcugagggauguggucagcaguccccaccagcuaucagauaaggcaaacuac

SEQ ID NO: 345265 - RNA, 64 nt, Human
uuaguuuucuaccuacuccgaguguccuccccugccccaccagauugcugcaggggcgcggugu

SEQ ID NO: 345266 - RNA, 64 nt, Human
agcuggucuuuggcauugacgugaaggaagcggaccccaccagcaacaccuacacccuugucac

SEQ ID NO: 345267 - RNA, 64 nt, Human
cagccuggcugggacugggaacagaacucgguguccccaccaucugcugucuuuucuuugccau

SEQ ID NO: 345268 - RNA, 64 nt, Human
uugaggaagcccaagugcguaccuuuauuuuugcccccaccacccucuuucuguacuucaauuu

SEQ ID NO: 345269 - RNA, 64 nt, Human
cggggucuccaccucaggggagacuuaggccagaggugaacauucauguguaggaagaggccgc

SEQ ID NO: 345270 - RNA, 64 nt, Human
gaacacuuaucguuuggcaggacacagagagguaggugaacauuccaggaaagaagcagcuuag

SEQ ID NO: 345271 - RNA, 64 nt, Human
gcagcccugccaucccugcagcagaaugagagagggugaacagggaacucuaugcuagauuuga

SEQ ID NO: 345272 - RNA, 64 nt, Human
uuuugcuguuauuuguuuuaucacuucuauauuuggugaacagccacaguuacugauauuuaug

SEQ ID NO: 345273 - RNA, 64 nt, Human
gagcgugggaggagguggggguggacguccauccggugaacagugaaggcguuugugaggucuu

SEQ ID NO: 345274 - RNA, 64 nt, Human
aaucaacuaggaaaucuaaacuuggauaacacguggugaacaacugccuuuagcugguccagau

SEQ ID NO: 345275 - RNA, 64 nt, Human
acacgugaccaauccccauggcagacagcgggcuggugaacaggaagagcacagaaucucugug

SEQ ID NO: 345276 - RNA, 64 nt, Human
ugggucaggaugcaauuauuuauaaaagucuccaggugaacauggcugaagauuuuucuaguau

SEQ ID NO: 345277 - RNA, 64 nt, Human
aagcgcagaaggaaugugccaguauggcucccugggugaacagcuuggccuuuuuugggugucu

SEQ ID NO: 345278 - RNA, 64 nt, Human
acagggaugcgcagggcgcccccuucuguuccagggugaacauagcacacgcccuccuggcugg

SEQ ID NO: 345279 - RNA, 64 nt, Human
uaagugccuuacuguuguuuaagcauuuuuuuaaggugaacaaaugaacacaauguaucuaccu

SEQ ID NO: 345280 - RNA, 64 nt, Human
guauagcauuuaguccagauuugagaaaguuuggggugaacaagguaagaaagauuuuuuuuuu

SEQ ID NO: 345281 - RNA, 64 nt, Human
uuccuagcaguauuuagcaccuuuuugccaccuuggugaacagaaaauuguauuuuccugucuu

SEQ ID NO: 345282 - RNA, 64 nt, Human
agggucauggcagugccugaacauggcagucuagggugaacaauccccuaacacaaguuuacuu

SEQ ID NO: 345283 - RNA, 64 nt, Human
caguccucuaguguuucauguacauucuguggggggugaacaccuugguucugguuaaacagcu

SEQ ID NO: 345284 - RNA, 64 nt, Human
ugaaugucuccuuuucccccucagagggcaaagaggugaacauaaaggauuuggugaaacauuu

SEQ ID NO: 345285 - RNA, 64 nt, Human
cucaggucuagaaucccaagcaguguucuuuucuggugaacacugugagccgcagaugugacuu

SEQ ID NO: 345286 - RNA, 64 nt, Human; identical to SEQ ID NO: 73703

SEQ ID NO: 345287 - RNA, 64 nt, Human; identical to SEQ ID NO: 73704

SEQ ID NO: 345288 - RNA, 64 nt, Human; identical to SEQ ID NO: 73705

SEQ ID NO: 345289 - RNA, 64 nt, Human; identical to SEQ ID NO: 73706

SEQ ID NO: 345290 - RNA, 64 nt, Human; identical to SEQ ID NO: 73707

SEQ ID NO: 345291 - RNA, 64 nt, Human; identical to SEQ ID NO: 73708

SEQ ID NO: 345292 - RNA, 64 nt, Human; identical to SEQ ID NO: 73709

SEQ ID NO: 345293 - RNA, 64 nt, Human; identical to SEQ ID NO: 73710

SEQ ID NO: 345294 - RNA, 64 nt, Human; identical to SEQ ID NO: 73711

SEQ ID NO: 345295 - RNA, 64 nt, Human; identical to SEQ ID NO: 73712

SEQ ID NO: 345296 - RNA, 64 nt, Human; identical to SEQ ID NO: 73713

SEQ ID NO: 345297 - RNA, 64 nt, Human; identical to SEQ ID NO: 73714

SEQ ID NO: 345298 - RNA, 64 nt, Human; identical to SEQ ID NO: 73715

SEQ ID NO: 345299 - RNA, 64 nt, Human; identical to SEQ ID NO: 73716

SEQ ID NO: 345300 - RNA, 64 nt, Human; identical to SEQ ID NO: 73717

SEQ ID NO: 345301 - RNA, 64 nt, Human
ugggggagggaagaggcagcccggcgaggggcaagcgggggacccagccgggcugggccccugg

SEQ ID NO: 345302 - RNA, 64 nt, Human
aucaccuggaagugucaaggaguggggcgggguggcgggggagaagcagccgugcugccagguc

SEQ ID NO: 345303 - RNA, 64 nt, Human
guucuaguccuggcggaacacacugggggugggggcgggggaagaugcgguaaugaaaccgguu

SEQ ID NO: 345304 - RNA, 64 nt, Human; identical to SEQ ID NO: 73718

SEQ ID NO: 345305 - RNA, 64 nt, Human; identical to SEQ ID NO: 73719

SEQ ID NO: 345306 - RNA, 64 nt, Human; identical to SEQ ID NO: 73720

SEQ ID NO: 345307 - RNA, 64 nt, Human; identical to SEQ ID NO: 73721

SEQ ID NO: 345308 - RNA, 64 nt, Human; identical to SEQ ID NO: 73722

SEQ ID NO: 345309 - RNA, 64 nt, Human; identical to SEQ ID NO: 73723

SEQ ID NO: 345310 - RNA, 64 nt, Human; identical to SEQ ID NO: 73724

SEQ ID NO: 345311 - RNA, 64 nt, Human; identical to SEQ ID NO: 73725

SEQ ID NO: 345312 - RNA, 64 nt, Human; identical to SEQ ID NO: 73726

SEQ ID NO: 345313 - RNA, 64 nt, Human; identical to SEQ ID NO: 73727

SEQ ID NO: 345314 - RNA, 64 nt, Human; identical to SEQ ID NO: 73728

SEQ ID NO: 345315 - RNA, 64 nt, Human; identical to SEQ ID NO: 73729

SEQ ID NO: 345316 - RNA, 64 nt, Human; identical to SEQ ID NO: 73730

SEQ ID NO: 345317 - RNA, 64 nt, Human; identical to SEQ ID NO: 73731

SEQ ID NO: 345318 - RNA, 64 nt, Human; identical to SEQ ID NO: 73732

SEQ ID NO: 345319 - RNA, 64 nt, Human
ccccuggaccccagaaccccagacaagggggcaggcgggggaccagggccucuccugugggauc

SEQ ID NO: 345320 - RNA, 64 nt, Human
acggauccugcugugugagcccuucagcugcagagcgggggaggucugcacccuggggaaccac

SEQ ID NO: 345321 - RNA, 64 nt, Human
ucugaagggaaagaaugagaaagcucccagggaagcgggggauggggcgcugaggcaggguugu

SEQ ID NO: 345322 - RNA, 64 nt, Human; identical to SEQ ID NO: 73733

SEQ ID NO: 345323 - RNA, 64 nt, Human; identical to SEQ ID NO: 73734

SEQ ID NO: 345324 - RNA, 64 nt, Human; identical to SEQ ID NO: 73735

SEQ ID NO: 345325 - RNA, 64 nt, Human; identical to SEQ ID NO: 73736

SEQ ID NO: 345326 - RNA, 64 nt, Human; identical to SEQ ID NO: 73737

SEQ ID NO: 345327 - RNA, 64 nt, Human; identical to SEQ ID NO: 73738

SEQ ID NO: 345328 - RNA, 64 nt, Human; identical to SEQ ID NO: 73739

SEQ ID NO: 345329 - RNA, 64 nt, Human; identical to SEQ ID NO: 73740

SEQ ID NO: 345330 - RNA, 64 nt, Human; identical to SEQ ID NO: 73741

SEQ ID NO: 345331 - RNA, 64 nt, Human; identical to SEQ ID NO: 73742

SEQ ID NO: 345332 - RNA, 64 nt, Human; identical to SEQ ID NO: 73743

SEQ ID NO: 345333 - RNA, 64 nt, Human; identical to SEQ ID NO: 73744

SEQ ID NO: 345334 - RNA, 64 nt, Human; identical to SEQ ID NO: 73745

SEQ ID NO: 345335 - RNA, 64 nt, Human; identical to SEQ ID NO: 73746

SEQ ID NO: 345336 - RNA, 64 nt, Human; identical to SEQ ID NO: 73747

SEQ ID NO: 345337 - RNA, 64 nt, Human
gaggcggagggcggcuccuagcuccguggacuaggcgggggagaaaggaagccuuucugagagc

SEQ ID NO: 345338 - RNA, 64 nt, Human
cuauugcuucucccuugcuucaaagaaucuagcagcgggggauaggauuuugcaacaaaaagcu

SEQ ID NO: 345339 - RNA, 64 nt, Human
gugcccggugagcgcagccagcaggagcugagcagcgggggagaugaaucaccuccugccuugg

SEQ ID NO: 345340 - RNA, 64 nt, Human; identical to SEQ ID NO: 73748

SEQ ID NO: 345341 - RNA, 64 nt, Human; identical to SEQ ID NO: 73749

SEQ ID NO: 345342 - RNA, 64 nt, Human; identical to SEQ ID NO: 73750

SEQ ID NO: 345343 - RNA, 64 nt, Human; identical to SEQ ID NO: 73751

SEQ ID NO: 345344 - RNA, 64 nt, Human; identical to SEQ ID NO: 73752

SEQ ID NO: 345345 - RNA, 64 nt, Human; identical to SEQ ID NO: 73753

SEQ ID NO: 345346 - RNA, 64 nt, Human; identical to SEQ ID NO: 73754

SEQ ID NO: 345347 - RNA, 64 nt, Human; identical to SEQ ID NO: 73755

SEQ ID NO: 345348 - RNA, 64 nt, Human; identical to SEQ ID NO: 73756

SEQ ID NO: 345349 - RNA, 64 nt, Human; identical to SEQ ID NO: 73757

SEQ ID NO: 345350 - RNA, 64 nt, Human; identical to SEQ ID NO: 73758

SEQ ID NO: 345351 - RNA, 64 nt, Human; identical to SEQ ID NO: 73759

SEQ ID NO: 345352 - RNA, 64 nt, Human; identical to SEQ ID NO: 73760

SEQ ID NO: 345353 - RNA, 64 nt, Human; identical to SEQ ID NO: 73761

SEQ ID NO: 345354 - RNA, 64 nt, Human; identical to SEQ ID NO: 73762

SEQ ID NO: 345355 - RNA, 64 nt, Human
gaggccaugugugccccgugcagggaucaggagggcgggggagggaccgagcagcccucuugcc

SEQ ID NO: 345356 - RNA, 64 nt, Human
cuggcagcaccuucccggcucaccagugccaccugcgggggagggacggggcaggcaggagucu

SEQ ID NO: 345357 - RNA, 64 nt, Human
uuugugggagacccgugaucccaucccagagugugcgggggacggagguaagcuggauauccug

SEQ ID NO: 345358 - RNA, 64 nt, Human; identical to SEQ ID NO: 73763

SEQ ID NO: 345359 - RNA, 64 nt, Human; identical to SEQ ID NO: 73764

SEQ ID NO: 345360 - RNA, 53 nt, Human; identical to SEQ ID NO: 73765

SEQ ID NO: 345361 - RNA, 64 nt, Human; identical to SEQ ID NO: 73766

SEQ ID NO: 345362 - RNA, 64 nt, Human; identical to SEQ ID NO: 73767

SEQ ID NO: 345363 - RNA, 64 nt, Human; identical to SEQ ID NO: 73768

SEQ ID NO: 345364 - RNA, 64 nt, Human; identical to SEQ ID NO: 73769

SEQ ID NO: 345365 - RNA, 64 nt, Human; identical to SEQ ID NO: 73770

SEQ ID NO: 345366 - RNA, 64 nt, Human; identical to SEQ ID NO: 73771

SEQ ID NO: 345367 - RNA, 64 nt, Human; identical to SEQ ID NO: 73772

SEQ ID NO: 345368 - RNA, 64 nt, Human; identical to SEQ ID NO: 73773

SEQ ID NO: 345369 - RNA, 64 nt, Human; identical to SEQ ID NO: 73774

SEQ ID NO: 345370 - RNA, 64 nt, Human; identical to SEQ ID NO: 73775

SEQ ID NO: 345371 - RNA, 64 nt, Human; identical to SEQ ID NO: 73776

SEQ ID NO: 345372 - RNA, 64 nt, Human; identical to SEQ ID NO: 73777

SEQ ID NO: 345373 - RNA, 64 nt, Human
cagugugacaccgccagguccagcacccaugggggcgggggagaggcucaccccuacguccccc

SEQ ID NO: 345374 - RNA, 64 nt, Human
gaggauucucauaaggaaagcaaugacuguucuugcgggggauaaaaaagggcuugggagauuc

SEQ ID NO: 345375 - RNA, 64 nt, Human
ggcccugacacgugauggaccaaagccaccugcugcgggggagccaguucuggggcccgccugc

SEQ ID NO: 345376 - RNA, 64 nt, Human; identical to SEQ ID NO: 73778

SEQ ID NO: 345377 - RNA, 64 nt, Human; identical to SEQ ID NO: 73779

SEQ ID NO: 345378 - RNA, 64 nt, Human; identical to SEQ ID NO: 73780

SEQ ID NO: 345379 - RNA, 64 nt, Human; identical to SEQ ID NO: 73781

SEQ ID NO: 345380 - RNA, 64 nt, Human; identical to SEQ ID NO: 73782

SEQ ID NO: 345381 - RNA, 64 nt, Human; identical to SEQ ID NO: 73783

SEQ ID NO: 345382 - RNA, 64 nt, Human; identical to SEQ ID NO: 73784

SEQ ID NO: 345383 - RNA, 64 nt, Human; identical to SEQ ID NO: 73785

SEQ ID NO: 345384 - RNA, 64 nt, Human; identical to SEQ ID NO: 73786

SEQ ID NO: 345385 - RNA, 64 nt, Human; identical to SEQ ID NO: 73787

SEQ ID NO: 345386 - RNA, 64 nt, Human; identical to SEQ ID NO: 73788

SEQ ID NO: 345387 - RNA, 64 nt, Human; identical to SEQ ID NO: 73789

SEQ ID NO: 345388 - RNA, 64 nt, Human; identical to SEQ ID NO: 73790

SEQ ID NO: 345389 - RNA, 64 nt, Human; identical to SEQ ID NO: 73791

SEQ ID NO: 345390 - RNA, 64 nt, Human; identical to SEQ ID NO: 73792

SEQ ID NO: 345391 - RNA, 63 nt, Human
ccaccuaauucgaugaaggcugccaacggggagcggcggaaagccuguaagccugcaagccug

SEQ ID NO: 345392 - RNA, 63 nt, Human
cugggcucuaaccugggagacucgcauccagcccggcggaagcuacagucucuacccugagcu

SEQ ID NO: 345393 - RNA, 63 nt, Human
ugggaugcccgcgccacccgcagcccccucacucggcggaaacccgcgagccggcccuuccgc

SEQ ID NO: 345394 - RNA, 61 nt, Human; identical to SEQ ID NO: 73793

SEQ ID NO: 345395 - RNA, 64 nt, Human; identical to SEQ ID NO: 73794

SEQ ID NO: 345396 - RNA, 64 nt, Human; identical to SEQ ID NO: 73795

SEQ ID NO: 345397 - RNA, 64 nt, Human; identical to SEQ ID NO: 73796

SEQ ID NO: 345398 - RNA, 64 nt, Human; identical to SEQ ID NO: 73797

SEQ ID NO: 345399 - RNA, 64 nt, Human; identical to SEQ ID NO: 73798

SEQ ID NO: 345400 - RNA, 64 nt, Human; identical to SEQ ID NO: 73799

SEQ ID NO: 345401 - RNA, 64 nt, Human; identical to SEQ ID NO: 73800

SEQ ID NO: 345402 - RNA, 64 nt, Human; identical to SEQ ID NO: 73801

SEQ ID NO: 345403 - RNA, 64 nt, Human; identical to SEQ ID NO: 73802

SEQ ID NO: 345404 - RNA, 64 nt, Human; identical to SEQ ID NO: 73803

SEQ ID NO: 345405 - RNA, 64 nt, Human; identical to SEQ ID NO: 73804

SEQ ID NO: 345406 - RNA, 64 nt, Human; identical to SEQ ID NO: 73805

SEQ ID NO: 345407 - RNA, 64 nt, Human; identical to SEQ ID NO: 73806

SEQ ID NO: 345408 - RNA, 64 nt, Human; identical to SEQ ID NO: 73807

SEQ ID NO: 345409 - RNA, 64 nt, Human
aguguaggccaagacuuauggucuacagauuuuggcgggggaggggggaccuuuucaaagacaa

SEQ ID NO: 345410 - RNA, 64 nt, Human
uuuaggaacuaaucuuauuaauuaggcuuauacagcgggggauuugagcuuacaggauuccucc

SEQ ID NO: 345411 - RNA, 64 nt, Human
uuauauuucaguguugugacaaauguguaaacuagcgggggaagacaguauuguaucauaaaug

SEQ ID NO: 345412 - RNA, 64 nt, Human; identical to SEQ ID NO: 73808

SEQ ID NO: 345413 - RNA, 64 nt, Human; identical to SEQ ID NO: 73809

SEQ ID NO: 345414 - RNA, 64 nt, Human; identical to SEQ ID NO: 73810

SEQ ID NO: 345415 - RNA, 64 nt, Human; identical to SEQ ID NO: 73811

SEQ ID NO: 345416 - RNA, 64 nt, Human; identical to SEQ ID NO: 73812

SEQ ID NO: 345417 - RNA, 64 nt, Human; identical to SEQ ID NO: 73813

SEQ ID NO: 345418 - RNA, 64 nt, Human; identical to SEQ ID NO: 73814

SEQ ID NO: 345419 - RNA, 64 nt, Human; identical to SEQ ID NO: 73815

SEQ ID NO: 345420 - RNA, 64 nt, Human; identical to SEQ ID NO: 73816

SEQ ID NO: 345421 - RNA, 64 nt, Human; identical to SEQ ID NO: 73817

SEQ ID NO: 345422 - RNA, 64 nt, Human; identical to SEQ ID NO: 73818

SEQ ID NO: 345423 - RNA, 64 nt, Human; identical to SEQ ID NO: 73819

SEQ ID NO: 345424 - RNA, 64 nt, Human; identical to SEQ ID NO: 73820

SEQ ID NO: 345425 - RNA, 64 nt, Human; identical to SEQ ID NO: 73821

SEQ ID NO: 345426 - RNA, 64 nt, Human; identical to SEQ ID NO: 73822

SEQ ID NO: 345427 - RNA, 64 nt, Human
gggggagccuggagccccugugugggagggcgaggcgggggagccuggagccccugugugggag

SEQ ID NO: 345428 - RNA, 64 nt, Human
gggggagccuggagccccugugugggagggcgaggcgggggauccuggagccccugugucgggg

SEQ ID NO: 345429 - RNA, 64 nt, Human
cucaccggagcaaagcagcaugauaaggacugcagcgggggagcucuggggagcagcuugugua

SEQ ID NO: 345430 - RNA, 64 nt, Human; identical to SEQ ID NO: 73823

SEQ ID NO: 345431 - RNA, 64 nt, Human; identical to SEQ ID NO: 73824

SEQ ID NO: 345432 - RNA, 64 nt, Human; identical to SEQ ID NO: 73825

SEQ ID NO: 345433 - RNA, 64 nt, Human; identical to SEQ ID NO: 73826

SEQ ID NO: 345434 - RNA, 64 nt, Human; identical to SEQ ID NO: 73827

SEQ ID NO: 345435 - RNA, 64 nt, Human; identical to SEQ ID NO: 73828

SEQ ID NO: 345436 - RNA, 64 nt, Human; identical to SEQ ID NO: 73829

SEQ ID NO: 345437 - RNA, 64 nt, Human; identical to SEQ ID NO: 73830

SEQ ID NO: 345438 - RNA, 64 nt, Human; identical to SEQ ID NO: 73831

SEQ ID NO: 345439 - RNA, 64 nt, Human; identical to SEQ ID NO: 73832

SEQ ID NO: 345440 - RNA, 64 nt, Human; identical to SEQ ID NO: 73833

SEQ ID NO: 345441 - RNA, 64 nt, Human; identical to SEQ ID NO: 73834

SEQ ID NO: 345442 - RNA, 64 nt, Human; identical to SEQ ID NO: 73835

SEQ ID NO: 345443 - RNA, 64 nt, Human; identical to SEQ ID NO: 73836

SEQ ID NO: 345444 - RNA, 64 nt, Human; identical to SEQ ID NO: 73837

SEQ ID NO: 345445 - RNA, 64 nt, Human
aauucgugauugcaacaaaggcagagggggcggggcgggggaggggagguaggacccgcuccgg

SEQ ID NO: 345446 - RNA, 64 nt, Human
ugccccgaggggccuggagcaccugggggcgcgggcgggggaccccugcugggaggccaggaga

SEQ ID NO: 345447 - RNA, 64 nt, Human
ccacugggccccauucucccuccauggcaggaaggcgggggauuucaaguuuagggauuggguc

SEQ ID NO: 345448 - RNA, 64 nt, Human; identical to SEQ ID NO: 73838

SEQ ID NO: 345449 - RNA, 64 nt, Human; identical to SEQ ID NO: 73839

SEQ ID NO: 345450 - RNA, 64 nt, Human; identical to SEQ ID NO: 73840

SEQ ID NO: 345451 - RNA, 64 nt, Human; identical to SEQ ID NO: 73841

SEQ ID NO: 345452 - RNA, 64 nt, Human; identical to SEQ ID NO: 73842

SEQ ID NO: 345453 - RNA, 64 nt, Human; identical to SEQ ID NO: 73843

SEQ ID NO: 345454 - RNA, 64 nt, Human; identical to SEQ ID NO: 73844

SEQ ID NO: 345455 - RNA, 64 nt, Human; identical to SEQ ID NO: 73845

SEQ ID NO: 345456 - RNA, 64 nt, Human; identical to SEQ ID NO: 73846

SEQ ID NO: 345457 - RNA, 64 nt, Human; identical to SEQ ID NO: 73847

SEQ ID NO: 345458 - RNA, 64 nt, Human; identical to SEQ ID NO: 73848

SEQ ID NO: 345459 - RNA, 64 nt, Human; identical to SEQ ID NO: 73849

SEQ ID NO: 345460 - RNA, 64 nt, Human; identical to SEQ ID NO: 73850

SEQ ID NO: 345461 - RNA, 64 nt, Human; identical to SEQ ID NO: 73851

SEQ ID NO: 345462 - RNA, 64 nt, Human; identical to SEQ ID NO: 73852

SEQ ID NO: 345463 - RNA, 64 nt, Human
aagggccugaggggcucggcugccucauccccuggcgggggaggcugggagcugggccuccugc

SEQ ID NO: 345464 - RNA, 64 nt, Human
cgcgggcggaggcggcuccagguccggagggguugcgggggagcuggaaauaaaccuggagaug

SEQ ID NO: 345465 - RNA, 64 nt, Human
uccaaaaauaaaauaaaaauaaaaauaaauauuggcgggggaacccucuggaaucaauaaaggc

SEQ ID NO: 345466 - RNA, 64 nt, Human; identical to SEQ ID NO: 73853

SEQ ID NO: 345467 - RNA, 64 nt, Human; identical to SEQ ID NO: 73854

SEQ ID NO: 345468 - RNA, 64 nt, Human; identical to SEQ ID NO: 73855

SEQ ID NO: 345469 - RNA, 64 nt, Human; identical to SEQ ID NO: 73856

SEQ ID NO: 345470 - RNA, 64 nt, Human; identical to SEQ ID NO: 73857

SEQ ID NO: 345471 - RNA, 64 nt, Human; identical to SEQ ID NO: 73858

SEQ ID NO: 345472 - RNA, 64 nt, Human; identical to SEQ ID NO: 73859

SEQ ID NO: 345473 - RNA, 64 nt, Human; identical to SEQ ID NO: 73860

SEQ ID NO: 345474 - RNA, 64 nt, Human; identical to SEQ ID NO: 73861

SEQ ID NO: 345475 - RNA, 64 nt, Human; identical to SEQ ID NO: 73862

SEQ ID NO: 345476 - RNA, 64 nt, Human; identical to SEQ ID NO: 73863

SEQ ID NO: 345477 - RNA, 64 nt, Human; identical to SEQ ID NO: 73864

SEQ ID NO: 345478 - RNA, 64 nt, Human; identical to SEQ ID NO: 73865

SEQ ID NO: 345479 - RNA, 64 nt, Human; identical to SEQ ID NO: 73866

SEQ ID NO: 345480 - RNA, 64 nt, Human; identical to SEQ ID NO: 73867

SEQ ID NO: 345481 - RNA, 64 nt, Human
gggacgcggggugggaccaggcgcgggaccuggggcgggggacgggacuuaaauaaaggcagac

SEQ ID NO: 345482 - RNA, 64 nt, Human
uucugccagccaagggaaaggcccagagcccugugcgggggaauguggcacugucuauccaucc

SEQ ID NO: 345483 - RNA, 64 nt, Human
uuuguacagagaaaaccuggggaggguggggagggcgggggaauggaccuuguauagaucugga

SEQ ID NO: 345484 - RNA, 64 nt, Human; identical to SEQ ID NO: 73868

SEQ ID NO: 345485 - RNA, 64 nt, Human; identical to SEQ ID NO: 73869

SEQ ID NO: 345486 - RNA, 64 nt, Human; identical to SEQ ID NO: 73870

SEQ ID NO: 345487 - RNA, 64 nt, Human; identical to SEQ ID NO: 73871

SEQ ID NO: 345488 - RNA, 64 nt, Human; identical to SEQ ID NO: 73872

SEQ ID NO: 345489 - RNA, 64 nt, Human; identical to SEQ ID NO: 73873

SEQ ID NO: 345490 - RNA, 64 nt, Human; identical to SEQ ID NO: 73874

SEQ ID NO: 345491 - RNA, 64 nt, Human; identical to SEQ ID NO: 73875

SEQ ID NO: 345492 - RNA, 64 nt, Human; identical to SEQ ID NO: 73876

SEQ ID NO: 345493 - RNA, 64 nt, Human; identical to SEQ ID NO: 73877

SEQ ID NO: 345494 - RNA, 64 nt, Human; identical to SEQ ID NO: 73878

SEQ ID NO: 345495 - RNA, 64 nt, Human; identical to SEQ ID NO: 73879

SEQ ID NO: 345496 - RNA, 64 nt, Human; identical to SEQ ID NO: 73880

SEQ ID NO: 345497 - RNA, 64 nt, Human; identical to SEQ ID NO: 73881

SEQ ID NO: 345498 - RNA, 64 nt, Human; identical to SEQ ID NO: 73882

SEQ ID NO: 345499 - RNA, 64 nt, Human
gcucaacgcauccacucucuguucucuuggcagggcgggggaggggggauaggagguccccuuu

SEQ ID NO: 345500 - RNA, 64 nt, Human
gccgugucugcagccacugccugacuucacucgggcgggggagggcggcagucggucggcucgc

SEQ ID NO: 345501 - RNA, 64 nt, Human
uacuuuaugggcuugggguguguagaaugauuuugcgggggaguggggagaaagaugaaagagg

SEQ ID NO: 345502 - RNA, 64 nt, Human; identical to SEQ ID NO: 73883

SEQ ID NO: 345503 - RNA, 64 nt, Human; identical to SEQ ID NO: 73884

SEQ ID NO: 345504 - RNA, 64 nt, Human; identical to SEQ ID NO: 73885

SEQ ID NO: 345505 - RNA, 64 nt, Human; identical to SEQ ID NO: 73886

SEQ ID NO: 345506 - RNA, 64 nt, Human; identical to SEQ ID NO: 73887

SEQ ID NO: 345507 - RNA, 64 nt, Human; identical to SEQ ID NO: 73888

SEQ ID NO: 345508 - RNA, 64 nt, Human; identical to SEQ ID NO: 73889

SEQ ID NO: 345509 - RNA, 64 nt, Human; identical to SEQ ID NO: 73890

SEQ ID NO: 345510 - RNA, 64 nt, Human; identical to SEQ ID NO: 73891

SEQ ID NO: 345511 - RNA, 52 nt, Human; identical to SEQ ID NO: 73892

SEQ ID NO: 345512 - RNA, 64 nt, Human; identical to SEQ ID NO: 73893

SEQ ID NO: 345513 - RNA, 64 nt, Human; identical to SEQ ID NO: 73894

SEQ ID NO: 345514 - RNA, 64 nt, Human; identical to SEQ ID NO: 73895

SEQ ID NO: 345515 - RNA, 64 nt, Human; identical to SEQ ID NO: 73896

SEQ ID NO: 345516 - RNA, 64 nt, Human; identical to SEQ ID NO: 73897

SEQ ID NO: 345517 - RNA, 64 nt, Human
ccccuucaguagagucggggaucccagccccagagcgggggagggcgccucccuauccccuccu

SEQ ID NO: 345518 - RNA, 64 nt, Human
gcauguacgguguggggaaguggaagagaagcuggcgggggagaaggaggcuaaccugcacuga

SEQ ID NO: 345519 - RNA, 64 nt, Human
cccagccgggcgccccggaccccccaggcgggcugcgggggaaccggcgccgagaggggaaggg

SEQ ID NO: 345520 - RNA, 54 nt, Human; identical to SEQ ID NO: 73898

SEQ ID NO: 345521 - RNA, 64 nt, Human; identical to SEQ ID NO: 73899

SEQ ID NO: 345522 - RNA, 64 nt, Human; identical to SEQ ID NO: 73900

SEQ ID NO: 345523 - RNA, 64 nt, Human; identical to SEQ ID NO: 73901

SEQ ID NO: 345524 - RNA, 64 nt, Human; identical to SEQ ID NO: 73902

SEQ ID NO: 345525 - RNA, 64 nt, Human; identical to SEQ ID NO: 73903

SEQ ID NO: 345526 - RNA, 64 nt, Human; identical to SEQ ID NO: 73904

SEQ ID NO: 345527 - RNA, 64 nt, Human; identical to SEQ ID NO: 73905

SEQ ID NO: 345528 - RNA, 64 nt, Human; identical to SEQ ID NO: 73906

SEQ ID NO: 345529 - RNA, 64 nt, Human; identical to SEQ ID NO: 73907

SEQ ID NO: 345530 - RNA, 64 nt, Human; identical to SEQ ID NO: 73908

SEQ ID NO: 345531 - RNA, 64 nt, Human; identical to SEQ ID NO: 73909

SEQ ID NO: 345532 - RNA, 63 nt, Human; identical to SEQ ID NO: 73910

SEQ ID NO: 345533 - RNA, 64 nt, Human; identical to SEQ ID NO: 73911

SEQ ID NO: 345534 - RNA, 64 nt, Human; identical to SEQ ID NO: 73912

SEQ ID NO: 345535 - RNA, 64 nt, Human
ucacauuggggguuaggguuucaacauaugaauugcgggggacacaaacauuccguccauggca

SEQ ID NO: 345536 - RNA, 64 nt, Human
gaggucacaccgcccggcccgagguaucgcaugugcgggggagguccacacuacagcuguccuc

SEQ ID NO: 345537 - RNA, 64 nt, Human
augguucugggugagaggggagcaggcugagccggcgggggaucugcuguccucccuuuugagu

SEQ ID NO: 345538 - RNA, 64 nt, Human; identical to SEQ ID NO: 73913

SEQ ID NO: 345539 - RNA, 64 nt, Human; identical to SEQ ID NO: 73914

SEQ ID NO: 345540 - RNA, 64 nt, Human; identical to SEQ ID NO: 73915

SEQ ID NO: 345541 - RNA, 64 nt, Human; identical to SEQ ID NO: 73916

SEQ ID NO: 345542 - RNA, 64 nt, Human; identical to SEQ ID NO: 73917

SEQ ID NO: 345543 - RNA, 64 nt, Human; identical to SEQ ID NO: 73918

SEQ ID NO: 345544 - RNA, 64 nt, Human; identical to SEQ ID NO: 73919

SEQ ID NO: 345545 - RNA, 64 nt, Human; identical to SEQ ID NO: 73920

SEQ ID NO: 345546 - RNA, 64 nt, Human; identical to SEQ ID NO: 73921

SEQ ID NO: 345547 - RNA, 64 nt, Human; identical to SEQ ID NO: 73922

SEQ ID NO: 345548 - RNA, 64 nt, Human; identical to SEQ ID NO: 73923

SEQ ID NO: 345549 - RNA, 64 nt, Human; identical to SEQ ID NO: 73924

SEQ ID NO: 345550 - RNA, 64 nt, Human; identical to SEQ ID NO: 73925

SEQ ID NO: 345551 - RNA, 64 nt, Human; identical to SEQ ID NO: 73926

SEQ ID NO: 345552 - RNA, 64 nt, Human; identical to SEQ ID NO: 73927

SEQ ID NO: 345553 - RNA, 64 nt, Human; identical to SEQ ID NO: 135844

SEQ ID NO: 345554 - RNA, 64 nt, Human; identical to SEQ ID NO: 135845

SEQ ID NO: 345555 - RNA, 64 nt, Human; identical to SEQ ID NO: 135858

SEQ ID NO: 345556 - RNA, 64 nt, Human; identical to SEQ ID NO: 73928

SEQ ID NO: 345557 - RNA, 64 nt, Human; identical to SEQ ID NO: 73929

SEQ ID NO: 345558 - RNA, 64 nt, Human; identical to SEQ ID NO: 73930

SEQ ID NO: 345559 - RNA, 64 nt, Human; identical to SEQ ID NO: 73931

SEQ ID NO: 345560 - RNA, 64 nt, Human; identical to SEQ ID NO: 73932

SEQ ID NO: 345561 - RNA, 64 nt, Human; identical to SEQ ID NO: 73933

SEQ ID NO: 345562 - RNA, 64 nt, Human; identical to SEQ ID NO: 73934

SEQ ID NO: 345563 - RNA, 64 nt, Human; identical to SEQ ID NO: 73935

SEQ ID NO: 345564 - RNA, 64 nt, Human; identical to SEQ ID NO: 73936

SEQ ID NO: 345565 - RNA, 64 nt, Human; identical to SEQ ID NO: 73937

SEQ ID NO: 345566 - RNA, 64 nt, Human; identical to SEQ ID NO: 73938

SEQ ID NO: 345567 - RNA, 64 nt, Human; identical to SEQ ID NO: 73939

SEQ ID NO: 345568 - RNA, 64 nt, Human; identical to SEQ ID NO: 73940

SEQ ID NO: 345569 - RNA, 64 nt, Human; identical to SEQ ID NO: 73941

SEQ ID NO: 345570 - RNA, 64 nt, Human; identical to SEQ ID NO: 73942

SEQ ID NO: 345571 - RNA, 63 nt, Human
ccggccgugugagugcccgggugcugccagccacggcggaagcucccuuggaggcagcccugc

SEQ ID NO: 345572 - RNA, 63 nt, Human
cucucuccuucucuguacaaugauucagcaucucggcggaagaggaaaauggagcuuuuugag

SEQ ID NO: 345573 - RNA, 64 nt, Human
ucaucccagucugauugcauagccacacugcccggcacgccacauccaccccugucugcacaug

SEQ ID NO: 345574 - RNA, 64 nt, Human; identical to SEQ ID NO: 73943

SEQ ID NO: 345575 - RNA, 64 nt, Human; identical to SEQ ID NO: 73944

SEQ ID NO: 345576 - RNA, 64 nt, Human; identical to SEQ ID NO: 73945

SEQ ID NO: 345577 - RNA, 58 nt, Human; identical to SEQ ID NO: 73946

SEQ ID NO: 345578 - RNA, 64 nt, Human; identical to SEQ ID NO: 73947

SEQ ID NO: 345579 - RNA, 64 nt, Human; identical to SEQ ID NO: 73948

SEQ ID NO: 345580 - RNA, 64 nt, Human; identical to SEQ ID NO: 73949

SEQ ID NO: 345581 - RNA, 64 nt, Human; identical to SEQ ID NO: 73950

SEQ ID NO: 345582 - RNA, 64 nt, Human; identical to SEQ ID NO: 73951

SEQ ID NO: 345583 - RNA, 64 nt, Human; identical to SEQ ID NO: 73952

SEQ ID NO: 345584 - RNA, 64 nt, Human; identical to SEQ ID NO: 73953

SEQ ID NO: 345585 - RNA, 64 nt, Human; identical to SEQ ID NO: 73954

SEQ ID NO: 345586 - RNA, 64 nt, Human; identical to SEQ ID NO: 73955

SEQ ID NO: 345587 - RNA, 64 nt, Human; identical to SEQ ID NO: 73956

SEQ ID NO: 345588 - RNA, 64 nt, Human; identical to SEQ ID NO: 73957

SEQ ID NO: 345589 - RNA, 64 nt, Human
cacguguccucauggagagggugcuccggcccaggcgggggagucagugcccagucagcagcuc

SEQ ID NO: 345590 - RNA, 64 nt, Human
cucagugaccucugccucucccacauuccuccccgcgggggaggaccucgccgcucugaagagc

SEQ ID NO: 345591 - RNA, 64 nt, Human
uggccuccagcugggugugggggggcggagcaaggcgggggacagacgcagcaccuucuuagcg

SEQ ID NO: 345592 - RNA, 64 nt, Human; identical to SEQ ID NO: 73958

SEQ ID NO: 345593 - RNA, 64 nt, Human; identical to SEQ ID NO: 73959

SEQ ID NO: 345594 - RNA, 64 nt, Human; identical to SEQ ID NO: 73960

SEQ ID NO: 345595 - RNA, 64 nt, Human; identical to SEQ ID NO: 73961

SEQ ID NO: 345596 - RNA, 64 nt, Human; identical to SEQ ID NO: 73962

SEQ ID NO: 345597 - RNA, 64 nt, Human; identical to SEQ ID NO: 73963

SEQ ID NO: 345598 - RNA, 64 nt, Human; identical to SEQ ID NO: 73964

SEQ ID NO: 345599 - RNA, 64 nt, Human; identical to SEQ ID NO: 73965

SEQ ID NO: 345600 - RNA, 64 nt, Human; identical to SEQ ID NO: 73966

SEQ ID NO: 345601 - RNA, 64 nt, Human; identical to SEQ ID NO: 73967

SEQ ID NO: 345602 - RNA, 58 nt, Human; identical to SEQ ID NO: 73946

SEQ ID NO: 345603 - RNA, 64 nt, Human; identical to SEQ ID NO: 73969

SEQ ID NO: 345604 - RNA, 64 nt, Human; identical to SEQ ID NO: 73970

SEQ ID NO: 345605 - RNA, 64 nt, Human; identical to SEQ ID NO: 73971

SEQ ID NO: 345606 - RNA, 64 nt, Human; identical to SEQ ID NO: 73972

SEQ ID NO: 345607 - RNA, 64 nt, Human; identical to SEQ ID NO: 135823

SEQ ID NO: 345608 - RNA, 64 nt, Human; identical to SEQ ID NO: 135824

SEQ ID NO: 345609 - RNA, 54 nt, Human; identical to SEQ ID NO: 135825

SEQ ID NO: 345610 - RNA, 64 nt, Human; identical to SEQ ID NO: 73973

SEQ ID NO: 345611 - RNA, 64 nt, Human; identical to SEQ ID NO: 73974

SEQ ID NO: 345612 - RNA, 64 nt, Human; identical to SEQ ID NO: 73975

SEQ ID NO: 345613 - RNA, 64 nt, Human; identical to SEQ ID NO: 73976

SEQ ID NO: 345614 - RNA, 64 nt, Human; identical to SEQ ID NO: 73977

SEQ ID NO: 345615 - RNA, 64 nt, Human; identical to SEQ ID NO: 73978

SEQ ID NO: 345616 - RNA, 64 nt, Human; identical to SEQ ID NO: 73979

SEQ ID NO: 345617 - RNA, 64 nt, Human; identical to SEQ ID NO: 73980

SEQ ID NO: 345618 - RNA, 64 nt, Human; identical to SEQ ID NO: 73981

SEQ ID NO: 345619 - RNA, 64 nt, Human; identical to SEQ ID NO: 73982

SEQ ID NO: 345620 - RNA, 64 nt, Human; identical to SEQ ID NO: 73983

SEQ ID NO: 345621 - RNA, 64 nt, Human; identical to SEQ ID NO: 73984

SEQ ID NO: 345622 - RNA, 64 nt, Human; identical to SEQ ID NO: 73985

SEQ ID NO: 345623 - RNA, 64 nt, Human; identical to SEQ ID NO: 73986

SEQ ID NO: 345624 - RNA, 64 nt, Human; identical to SEQ ID NO: 73987

SEQ ID NO: 345625 - RNA, 64 nt, Human; identical to SEQ ID NO: 135826

SEQ ID NO: 345626 - RNA, 64 nt, Human; identical to SEQ ID NO: 135827

SEQ ID NO: 345627 - RNA, 64 nt, Human
aaccugcguggcuccugauagcguuuggaagaacgcgggggagacugaagagcaacugggaacu

SEQ ID NO: 345628 - RNA, 64 nt, Human; identical to SEQ ID NO: 73988

SEQ ID NO: 345629 - RNA, 64 nt, Human; identical to SEQ ID NO: 73989

SEQ ID NO: 345630 - RNA, 64 nt, Human; identical to SEQ ID NO: 73990

SEQ ID NO: 345631 - RNA, 64 nt, Human; identical to SEQ ID NO: 73991

SEQ ID NO: 345632 - RNA, 64 nt, Human; identical to SEQ ID NO: 73992

SEQ ID NO: 345633 - RNA, 64 nt, Human; identical to SEQ ID NO: 73993

SEQ ID NO: 345634 - RNA, 64 nt, Human; identical to SEQ ID NO: 73994

SEQ ID NO: 345635 - RNA, 64 nt, Human; identical to SEQ ID NO: 73995

SEQ ID NO: 345636 - RNA, 64 nt, Human; identical to SEQ ID NO: 73996

SEQ ID NO: 345637 - RNA, 64 nt, Human; identical to SEQ ID NO: 73997

SEQ ID NO: 345638 - RNA, 64 nt, Human; identical to SEQ ID NO: 73998

SEQ ID NO: 345639 - RNA, 64 nt, Human; identical to SEQ ID NO: 73999

SEQ ID NO: 345640 - RNA, 64 nt, Human; identical to SEQ ID NO: 74000

SEQ ID NO: 345641 - RNA, 64 nt, Human; identical to SEQ ID NO: 74001

SEQ ID NO: 345642 - RNA, 64 nt, Human; identical to SEQ ID NO: 74002

SEQ ID NO: 345643 - RNA, 64 nt, Human; identical to SEQ ID NO: 135829

SEQ ID NO: 345644 - RNA, 64 nt, Human; identical to SEQ ID NO: 135830

SEQ ID NO: 345645 - RNA, 64 nt, Human; identical to SEQ ID NO: 135831

SEQ ID NO: 345646 - RNA, 64 nt, Human; identical to SEQ ID NO: 74003

SEQ ID NO: 345647 - RNA, 64 nt, Human; identical to SEQ ID NO: 74004

SEQ ID NO: 345648 - RNA, 64 nt, Human; identical to SEQ ID NO: 74005

SEQ ID NO: 345649 - RNA, 64 nt, Human; identical to SEQ ID NO: 74006

SEQ ID NO: 345650 - RNA, 64 nt, Human; identical to SEQ ID NO: 74007

SEQ ID NO: 345651 - RNA, 64 nt, Human; identical to SEQ ID NO: 74008

SEQ ID NO: 345652 - RNA, 64 nt, Human; identical to SEQ ID NO: 74009

SEQ ID NO: 345653 - RNA, 64 nt, Human; identical to SEQ ID NO: 74010

SEQ ID NO: 345654 - RNA, 64 nt, Human; identical to SEQ ID NO: 74011

SEQ ID NO: 345655 - RNA, 64 nt, Human; identical to SEQ ID NO: 74012

SEQ ID NO: 345656 - RNA, 64 nt, Human; identical to SEQ ID NO: 74013

SEQ ID NO: 345657 - RNA, 64 nt, Human; identical to SEQ ID NO: 74014

SEQ ID NO: 345658 - RNA, 64 nt, Human; identical to SEQ ID NO: 74015

SEQ ID NO: 345659 - RNA, 64 nt, Human; identical to SEQ ID NO: 74016

SEQ ID NO: 345660 - RNA, 64 nt, Human; identical to SEQ ID NO: 74017

SEQ ID NO: 345661 - RNA, 64 nt, Human; identical to SEQ ID NO: 135835

SEQ ID NO: 345662 - RNA, 64 nt, Human; identical to SEQ ID NO: 135836

SEQ ID NO: 345663 - RNA, 64 nt, Human; identical to SEQ ID NO: 135837

SEQ ID NO: 345664 - RNA, 64 nt, Human; identical to SEQ ID NO: 74018

SEQ ID NO: 345665 - RNA, 64 nt, Human; identical to SEQ ID NO: 74019

SEQ ID NO: 345666 - RNA, 64 nt, Human; identical to SEQ ID NO: 74020

SEQ ID NO: 345667 - RNA, 64 nt, Human; identical to SEQ ID NO: 74021

SEQ ID NO: 345668 - RNA, 64 nt, Human; identical to SEQ ID NO: 74022

SEQ ID NO: 345669 - RNA, 64 nt, Human; identical to SEQ ID NO: 74023

SEQ ID NO: 345670 - RNA, 64 nt, Human; identical to SEQ ID NO: 74024

SEQ ID NO: 345671 - RNA, 64 nt, Human; identical to SEQ ID NO: 74025

SEQ ID NO: 345672 - RNA, 64 nt, Human; identical to SEQ ID NO: 318979

SEQ ID NO: 345673 - RNA, 64 nt, Human; identical to SEQ ID NO: 318980

SEQ ID NO: 345674 - RNA, 64 nt, Human; identical to SEQ ID NO: 318981

SEQ ID NO: 345675 - RNA, 64 nt, Human; identical to SEQ ID NO: 318982

SEQ ID NO: 345676 - RNA, 57 nt, Human; identical to SEQ ID NO: 307757

SEQ ID NO: 345677 - RNA, 59 nt, Human; identical to SEQ ID NO: 135841

SEQ ID NO: 345678 - RNA, 64 nt, Human; identical to SEQ ID NO: 135842

SEQ ID NO: 345679 - RNA, 64 nt, Human; identical to SEQ ID NO: 135843

SEQ ID NO: 345680 - RNA, 64 nt, Human; identical to SEQ ID NO: 318987

SEQ ID NO: 345681 - RNA, 64 nt, Human; identical to SEQ ID NO: 318988

SEQ ID NO: 345682 - RNA, 64 nt, Human; identical to SEQ ID NO: 318989

SEQ ID NO: 345683 - RNA, 64 nt, Human
guggccacgcccagcacccuauugauggcuauaggacagguagcccucauuuccaugccugaua

SEQ ID NO: 345684 - RNA, 64 nt, Human
acacacuaaagccugaguucaagguuucucaguugacagguagguauguaaaucaggguucucu

SEQ ID NO: 345685 - RNA, 64 nt, Human
uuuaauuuuucccauuguaaauaaacauuacauugacagguauugacuacuaacaccucuaaaa

SEQ ID NO: 345686 - RNA, 64 nt, Human
auucaucuagcagguauucccagaccucguguaugacagguagcuagggagcucuuggagaugu

SEQ ID NO: 345687 - RNA, 64 nt, Human; identical to SEQ ID NO: 135832

SEQ ID NO: 345688 - RNA, 64 nt, Human; identical to SEQ ID NO: 135833

SEQ ID NO: 345689 - RNA, 64 nt, Human
aaugcagggggcaggacuugggagguuccagcaggcgggggagccccgaccaguggggacacuc

SEQ ID NO: 345690 - RNA, 64 nt, Human
aaauauuuuuaaaauuauguucagguuauuuauugacagguacuacuuacaccaaagcacuugu

SEQ ID NO: 345691 - RNA, 64 nt, Human
gcaucagcaggucuccuuuuucuugugcugcuuggacagguaccuacugcuggccucuucagug

SEQ ID NO: 345692 - RNA, 64 nt, Human
uagcuagacacuguugaaucaauacagugaaacagacagguaagcaggugguuuuaaugccuca

SEQ ID NO: 345693 - RNA, 64 nt, Human
cuggcgaggguuucacucaucauggaugccaugggacagguaucauugguuuaugagagcuaga

SEQ ID NO: 345694 - RNA, 64 nt, Human
cggggccggaucccggcagcggccuccccaaagcgacagguaacgcagugcgggguuagggauu

SEQ ID NO: 345695 - RNA, 64 nt, Human
caaaaacaaaaaaacaaaauucauguuacuaaaagacagguagccauauacagacaguauaugc

SEQ ID NO: 345696 - RNA, 64 nt, Human
ccuucacuuaucaauaugcauuccuauugcccaugacagguauggaguucacacugugugcugc

SEQ ID NO: 345697 - RNA, 64 nt, Human
uggauuaucuuuaacccccacaccucuuaccuuggacagguaaggcuuggccgaugucugauug

SEQ ID NO: 345698 - RNA, 64 nt, Human
aagugucaauguagcauguaaaaggcuuuguacagacagguaaaaguuccauuucugagugaug

SEQ ID NO: 345699 - RNA, 64 nt, Human
gucgucuugcacaccuuggcagcccccuguaguugacagguaagcuguaggcauguagagcaau

SEQ ID NO: 345700 - RNA, 64 nt, Human
cauacuagaauucaggugcuuugcuagaugcugugacagguaugccaccaacacugcucacagc

SEQ ID NO: 345701 - RNA, 64 nt, Human
ugacauuuaucaccucugauggcugaagaauguagacagguauaaugauacugcuuuucaccaa

SEQ ID NO: 345702 - RNA, 64 nt, Human
gcccuuaugaaaauaaacaaaaugaagggauuaugacagguauuaccaaaaacaccaaaaggaa

SEQ ID NO: 345703 - RNA, 64 nt, Human
gccaguacagaucuuugagaggucuguguacagugacagguauaucuuugcaaagaaucuuuuu

SEQ ID NO: 345704 - RNA, 64 nt, Human
auuucaagggauaguuuuuauucaauguauauaagacagguagugccugauuuacuacuuuaua

SEQ ID NO: 345705 - RNA, 59 nt, Human; identical to SEQ ID NO: 135847

SEQ ID NO: 345706 - RNA, 64 nt, Human; identical to SEQ ID NO: 135848

SEQ ID NO: 345707 - RNA, 64 nt, Human; identical to SEQ ID NO: 135849

SEQ ID NO: 345708 - RNA, 64 nt, Human; identical to SEQ ID NO: 135850

SEQ ID NO: 345709 - RNA, 64 nt, Human
aguuuccuaccccguggaucuagcaagccauggagacagguagcauuuguaagaugcugcacag

SEQ ID NO: 345710 - RNA, 64 nt, Human
cuccuuaaaguugugaagaaauuguuaauugccagacagguaagaaaauguuuauaaucuaucu

SEQ ID NO: 345711 - RNA, 64 nt, Human
gaaaaaauaaagcaagaaauacuaacaucaaaaggacagguaugaugaugcgauaauaauaaac

SEQ ID NO: 345712 - RNA, 64 nt, Human
ggcauuugcaguuaauuagcacaugugaggguuagacagguaggugaaugcaagcucaagguuu

SEQ ID NO: 345713 - RNA, 64 nt, Human
gaaaucacuuaaguguucauagaccaguauuucugacagguaaaaugcuaaaauaagcuaccug

SEQ ID NO: 345714 - RNA, 64 nt, Human
aaugcugguugauuucccucauuguguaaacauugacagguaugugacaaaugggaaaaaaaau

SEQ ID NO: 345715 - RNA, 64 nt, Human
gugggcacaguuaugaaguuuccccacaugugaagacagguacaaaauagcagagccaagcaga

SEQ ID NO: 345716 - RNA, 64 nt, Human
aguugagccugaauuaaauguaauguuuccaagugacagguauccacauuugcaugguuacaag

SEQ ID NO: 345717 - RNA, 64 nt, Human
gaaggcaugagaggaaguaaguagcaaguugaaggacagguaguugagaugaaacacuucaaaa

SEQ ID NO: 345718 - RNA, 64 nt, Human
gauucaguaggguuugagacuuacgugugauacugacagguaagcaacagugcuagcauucuag

SEQ ID NO: 345719 - RNA, 64 nt, Human
gcuggggaagggggccucuggggccugaccaggcgacagguaggggcggaggggagcugagucu

SEQ ID NO: 345720 - RNA, 64 nt, Human
ccauguuuacaaacaaacacaaagagagaaguuagacagguagaucuuuagcagucuuuucuag

SEQ ID NO: 345721 - RNA, 64 nt, Human
auuagguaagauaauuuguugggccauauuuuaggacagguaaaauaacaucagguuccaguug

SEQ ID NO: 345722 - RNA, 64 nt, Human
ggccauuaccugaaauuuccagauuguucuaugagacagguaugucagaggaccgugucucaaa

SEQ ID NO: 345723 - RNA, 64 nt, Human
cuuauuuuauuaauuaauuauuugugcugcuuuugacagguagcagaggguuuuaauacuucac

SEQ ID NO: 345724 - RNA, 64 nt, Human; identical to SEQ ID NO: 135854

SEQ ID NO: 345725 - RNA, 64 nt, Human; identical to SEQ ID NO: 135855

SEQ ID NO: 345726 - RNA, 64 nt, Human; identical to SEQ ID NO: 135856

SEQ ID NO: 345727 - RNA, 64 nt, Human; identical to SEQ ID NO: 135857

SEQ ID NO: 345728 - RNA, 64 nt, Human
gcguaaacgagaggccuuccuuucuaaugacaaugacagguauuggugaaggagcuaauguuua

SEQ ID NO: 345729 - RNA, 64 nt, Human
ucauguguguaaucccagcacucugggaggcugagacagguagaucauuugaggucaggaguuc

SEQ ID NO: 345730 - RNA, 64 nt, Human
ucaagagcagagggguaaacauccucugcuaaucgacagguagcaggugucagaggaggcauaa

SEQ ID NO: 345731 - RNA, 64 nt, Human
uccaggagucaacaugccaaagaaugaggcuggagacagguagcuccgagggaggacuucuggc

SEQ ID NO: 345732 - RNA, 64 nt, Human
gaaaguuaaggaagggggugaggauguggguugggacagguaguaccuaaagaggagcgaaggg

SEQ ID NO: 345733 - RNA, 64 nt, Human
cgccuguccccuguaacuccuaggggugcgccuagacagguacgucuguuuuuuauuuuaaaag

SEQ ID NO: 345734 - RNA, 64 nt, Human
gcaucccuguauucacacgggucacucugacucagacagguacuauucguaggcaguguagaca

SEQ ID NO: 345735 - RNA, 53 nt, Human
acaaggccaagggcaagugauuugacagguaucugagcucccggaaacgcuau

SEQ ID NO: 345736 - RNA, 64 nt, Human
acauacauccugcuuucccuccccaaacccaucagacagguaaaugggcagugccuccugggac

SEQ ID NO: 345737 - RNA, 64 nt, Human
auugccuuuguaaaaaacagagaaaacgaucacggacagguaugcacugguaacaugcagauga

SEQ ID NO: 345738 - RNA, 64 nt, Human
aucugucuccuggaugauuaucucuguuuugggagacagguauuuuuucuucaugccugcucua

SEQ ID NO: 345739 - RNA, 64 nt, Human
ccuucccucccuucuugguuccauuuccauccaugacagguacagcaucccaggagcccggccu

SEQ ID NO: 345740 - RNA, 64 nt, Human
uauuuauucagcuucauuugugucaaugggcaaugacagguaaauuaagacaugcacuaugagg

SEQ ID NO: 345741 - RNA, 64 nt, Human
cuagcagguucugaauuuagaggacaaauaaggugacagguacuaagagaagagugaauuaagu

SEQ ID NO: 345742 - RNA, 64 nt, Human
aaaaugauuucuuaagauaucacugccuaauauagacagguauauuugaaagcuaaauacaggu

SEQ ID NO: 345743 - RNA, 64 nt, Human
uccaauuacccugaugugacaauuacacauuguagacagguagcaaaauaucacauacaccccc

SEQ ID NO: 345744 - RNA, 64 nt, Human
ccugcccggacuguggccucgccggggagagcgggcgggggagcucgcgccgaggacuggacca

SEQ ID NO: 345745 - RNA, 57 nt, Human
ggaaaaccacgccuguguaggggcgcggcgggggagccgaggggcguguccggggcg

SEQ ID NO: 345746 - RNA, 64 nt, Human
ugcccaacugggggugguucuaggggaacagggggcgggggagcuguuucuauuuuauuuauug

SEQ ID NO: 345747 - RNA, 64 nt, Human
gcacacaaaacauuuaacuaugguauuuauggaagacagguaacaacauuaaaucuaguugcuu

SEQ ID NO: 345748 - RNA, 64 nt, Human
cuauauuauuucuuucucgucucaucaaaaugaugacagguaaacuauauuuuuccuuaaacac

SEQ ID NO: 345749 - RNA, 64 nt, Human
aaccaaugaagucuaagagaaauaaaauuuaguggacagguaugaaaaguguaauugcgccuaa

SEQ ID NO: 345750 - RNA, 64 nt, Human
uagagggaugcuaggugucugggaucgggguggggacagguagaccaggugcucagcccaggca

SEQ ID NO: 345751 - RNA, 64 nt, Human
agagagguuccagucuagaugaggagcugaucuagacagguaaaaggcuaacuaacccuuugug

SEQ ID NO: 345752 - RNA, 64 nt, Human
agaaaguggguaguggccgauuugacuucagagugacagguagagaagggaagagcguguagaa

SEQ ID NO: 345753 - RNA, 64 nt, Human
uaaugccuacuugauuuauaucuauaaaaagacugacagguaauuauauuuggaaaacauuuaa

SEQ ID NO: 345754 - RNA, 64 nt, Human
ggcugcaccugagugugccccugccugccagauggacagguacacccaagcacaucucccugcu

SEQ ID NO: 345755 - RNA, 64 nt, Human
uaaaaauggauaauuuauagacagauaauuuauagacagguaaaugugaguuaaauauaacuca

SEQ ID NO: 345756 - RNA, 64 nt, Human
uguaaugaugauacuuaacaugagcagggugaaugacagguacugacgaaguccaacacaaagg

SEQ ID NO: 345757 - RNA, 64 nt, Human
gaaaguagggaggaaggggaccaagccagagagggacagguauauguacagggcugagcugcag

SEQ ID NO: 345758 - RNA, 64 nt, Human
uguuagaguagcacaugaaugugagcucuauaaggacagguacuauauuuccguaagacccaau

SEQ ID NO: 345759 - RNA, 64 nt, Human
cgcuuuuuguuucuaaguugagugcuugggguuugacagguagugacguguaguuugacacugu

SEQ ID NO: 345760 - RNA, 64 nt, Human
gauggggccucagcagcgggugccccuggcucgggacagguagcacugcuguccagccacagcc

SEQ ID NO: 345761 - RNA, 64 nt, Human
cauccauccccuccacaggagggugaggaauugggacagguaauuccagccaauaccuggucca

SEQ ID NO: 345762 - RNA, 64 nt, Human; identical to SEQ ID NO: 135851

SEQ ID NO: 345763 - RNA, 64 nt, Human; identical to SEQ ID NO: 135852

SEQ ID NO: 345764 - RNA, 64 nt, Human; identical to SEQ ID NO: 135860

SEQ ID NO: 345765 - RNA, 64 nt, Human; identical to SEQ ID NO: 135861

SEQ ID NO: 345766 - RNA, 64 nt, Human
aaucgcuugagugaggaaaaguccacauggcagagacagguaugguccaguuccucuuuuauau

SEQ ID NO: 345767 - RNA, 64 nt, Human
guaguuguugauuaaauuuucagacuaaauauaggacagguacaauuuuggauaaauagcacau

SEQ ID NO: 345768 - RNA, 64 nt, Human
gagcccacuccaacugcacagaaguucugggccugacagguagauuccagcuggaaggcaggcc

SEQ ID NO: 345769 - RNA, 64 nt, Human
ggcagagugggacugagaugguacagugugcacagacagguacugagcugacagacugggauuu

SEQ ID NO: 345770 - RNA, 64 nt, Human
ccuuugcuuagggcuggggugggaggcacauggugacagguauaugucgugggacuggggugug

SEQ ID NO: 345771 - RNA, 64 nt, Human
acucaagccugagagaaguugggagggugguggggacagguaaguggcaggacccugucaggau

SEQ ID NO: 345772 - RNA, 64 nt, Human
guaaugugcaggacccuucuccuuucaugggagagacagguaguuaccugaauauagguugaaa

SEQ ID NO: 345773 - RNA, 64 nt, Human
auuuuauguauugaggaugccaagauuaaaaggugacagguagauguuaauuucccuagauugu

SEQ ID NO: 345774 - RNA, 64 nt, Human
guccuuugacaaggacagguggggcagggagcaagacagguaggcuggaagaacaguuauuggc

SEQ ID NO: 345775 - RNA, 64 nt, Human
cuggcccccauggggcuuggaggaccgagccacugacagguauccccugaaacugagcugagcc

SEQ ID NO: 345776 - RNA, 64 nt, Human
aauuguguauagcaugguaaaagaaaaaaaaaaagacagguaaauguuauauaauuguaggguu

SEQ ID NO: 345777 - RNA, 64 nt, Human
auuauuauuauauuaaaagaagcagaguaugagagacagguacaugguccaguaggaagagaag

SEQ ID NO: 345778 - RNA, 64 nt, Human
caacuuuuuuuuuuuuuuuugcacaauuguaauugacagguaaugaagcuauuuguuaaaauau

SEQ ID NO: 345779 - RNA, 64 nt, Human
ggcuuccucaggcaaacuccagcuuaaagcccuagacagguaaaagcacacauuggauggcagc

SEQ ID NO: 345780 - RNA, 64 nt, Human
uugggcagagauucuauuuuugacauuugcacaagacagguagggaaaggggacuugugguagu

SEQ ID NO: 345781 - RNA, 64 nt, Human; identical to SEQ ID NO: 135838

SEQ ID NO: 345782 - RNA, 64 nt, Human; identical to SEQ ID NO: 135839

SEQ ID NO: 345783 - RNA, 64 nt, Human
aauaacauugggcuaauaucugcugugcuucucugacagguagucaugaaaaucaaaugaugca

SEQ ID NO: 345784 - RNA, 64 nt, Human
cacaccaaaccagacagaggcagggcagcauggagacagguagacagaccuccaggucccuaag

SEQ ID NO: 345785 - RNA, 64 nt, Human
cugcccacccuggucccagguaaaugugaauggagacagguaugagaggcuguccucgucuuug

SEQ ID NO: 345786 - RNA, 64 nt, Human
aaaagaaagaugguccccuuuuaucugauucugagacagguaaauucuguuuguuacuacguuu

SEQ ID NO: 345787 - RNA, 64 nt, Human
guauuguaaguaugaagaaccaagcauggugaaagacagguauuucugcaacacaauguaauga

SEQ ID NO: 345788 - RNA, 64 nt, Human
gguauagggguccugggggcaggccagggcaguugacagguacuuggagggcucagggcagugg

SEQ ID NO: 345789 - RNA, 64 nt, Human
ggauuugugaagagcagauuccaugaguaacucugacagguauuuuagaucaugaucucaacaa

SEQ ID NO: 345790 - RNA, 64 nt, Human
gagggaugugggaaugaauuggcauugcaggaaagacagguaaagugauugcugcaaugagaag

SEQ ID NO: 345791 - RNA, 64 nt, Human
cagaauuagggaaugcugguuuugaagagcaaaggacagguagucuagagagggucgucuggcc

SEQ ID NO: 345792 - RNA, 64 nt, Human
aagaaaaacguuuaagucuagccucugcgugguagacagguauggggagggagaaugcuuuucc

SEQ ID NO: 345793 - RNA, 64 nt, Human
agaauucugcaaaauaagagaagaaauaauuugugacagguaauagaauacuaguaggauagaa

SEQ ID NO: 345794 - RNA, 64 nt, Human
aacuccacucauugcaguacuuucacagcacagugacagguagaggacucuggcacaggugcac

SEQ ID NO: 345795 - RNA, 64 nt, Human
ggaugacacaaaacuaugagagugacaaaauggugacagguagcugggaccuaggcuaucuuac

SEQ ID NO: 345796 - RNA, 64 nt, Human
uaccuccuacacauuucccaucaaucagaaaauagacagguacacuaaagggacccugagaacu

SEQ ID NO: 345797 - RNA, 64 nt, Human
gggagaugugccagaguccuuccuccccuccaaggacagguaguaggugccagccuaggggagc

SEQ ID NO: 345798 - RNA, 64 nt, Human
uaccaagcacuuguauuuccguauauuuuguuucgcgggggagugagggggaagaacacggaug

SEQ ID NO: 345799 - RNA, 64 nt, Human
aggccccugucuuguucauguagccgaggggcaggcgggggaccucuacaccucugcugugggc

SEQ ID NO: 345800 - RNA, 64 nt, Human
ugcuuauggcuaacaguucaguucuguauuuguugacagguaaauaaguggaguugagugccau

SEQ ID NO: 345801 - RNA, 64 nt, Human
uuaaaacuaaacugaacauugcaguaauguuaaggacagguauacuuuuugcaaacaaaugcau

SEQ ID NO: 345802 - RNA, 64 nt, Human
guuucacacuauuccuauaccuccagguccggaagacagguaaaaaauucuauaauguaagaau

SEQ ID NO: 345803 - RNA, 64 nt, Human
gcugauggucacuguuuuggcuggcuccagaguggacagguacgcucuguccacagcagcugcu

SEQ ID NO: 345804 - RNA, 64 nt, Human
gggccaaaggagacacuagaaaagugguagaugggacagguaaguggcagaggugaggggauaa

SEQ ID NO: 345805 - RNA, 64 nt, Human
uguuuggagggauauuagucauuauuuuauucaugacagguagacuacaauucgaacuuagggu

SEQ ID NO: 345806 - RNA, 64 nt, Human
gaauuaggcuugugacaauuagaguaauuuacaugacagguaaaacuccuauuaaaaauguuua

SEQ ID NO: 345807 - RNA, 64 nt, Human
cuccggagcccacaaccuggacacagcuccucaagacagguagcauggaccuuaaggcgacaag

SEQ ID NO: 345808 - RNA, 64 nt, Human
gaaacauuuguacuagguuauaagaucuuucugugacagguaacaaauuuggggaagacagcac

SEQ ID NO: 345809 - RNA, 64 nt, Human
auauguuuuaaaguagcaagaacauugauguuuugacagguauauuucauagauacuucauuug

SEQ ID NO: 345810 - RNA, 64 nt, Human
guuuuguuauaucugaacuaguugaacugugacugacagguaauccuaauauauccaaauccaa

SEQ ID NO: 345811 - RNA, 64 nt, Human
gcaaggugguggcgccgagaggcgugucugugaagacagguaccaggauggcaggacccgcacg

SEQ ID NO: 345812 - RNA, 64 nt, Human
cuauuugaaugagaugauucagaaggggaggggagacagguaacgucuguaagcugaaguuuca

SEQ ID NO: 345813 - RNA, 64 nt, Human
cucucucucucucucucucucucucaguauccaugacagguaugaaacauauugucucuuuaua

SEQ ID NO: 345814 - RNA, 64 nt, Human
ucacucagucgcucugcaugcucucugucauacagacagguaaccuaguucuguguucacgugg

SEQ ID NO: 345815 - RNA, 64 nt, Human
uuuaugugugugugugugguuagaugcacauggagacagguauggaagaauauacaccaggcug

SEQ ID NO: 345816 - RNA, 64 nt, Human
uuuuuuccuagaaaaaauauuuaaagcauuguuugacagguagaaacucauguaucuguagucc

SEQ ID NO: 345817 - RNA, 64 nt, Human
uaccuugcaucugagacagacuuccuacaucagggacagguaucugugugucauuauacaaaac

SEQ ID NO: 345818 - RNA, 64 nt, Human
uguauaugcaacauuuauucuauucuaauuauuugacagguaacugcaguguuaaauuguaaau

SEQ ID NO: 345819 - RNA, 64 nt, Human
uaguugauuguacuguucucaugcuauaaaaguggacagguacucuacaacaaaucuguuuucu

SEQ ID NO: 345820 - RNA, 64 nt, Human
gcccguauauauauauuuguaagccuugcaaugugacagguagcaucacuauauaugcaauagu

SEQ ID NO: 345821 - RNA, 64 nt, Human
gagaagggaagagaggauggcacuuggcuuuaaagacagguagcugccaggcuacuguggagag

SEQ ID NO: 345822 - RNA, 64 nt, Human
cuacuggggccagguaagaacaguaauuggcccagacagguaggugugauaaacagaguagaaa

SEQ ID NO: 345823 - RNA, 64 nt, Human
ugaguucauuggggguccucauucccuucuguaugacagguauagguauggauaugacccauuu

SEQ ID NO: 345824 - RNA, 64 nt, Human
gggaggggcucuaggaaggaacuggggggaaggggacagguagguggcuggagggacccuuuuu

SEQ ID NO: 345825 - RNA, 64 nt, Human
ucaugccuguaauuccagcacuuugagaggcaaagacagguaggucacuggagcucacgaguuu

SEQ ID NO: 345826 - RNA, 64 nt, Human
ucacaccuguaaucccagcacuuugagaggccaagacagguaggucacuugaggucaugaauuu

SEQ ID NO: 345827 - RNA, 64 nt, Human
ucucucucucucuacaaacucccacuugucaugugacagguaaacuaucuuggugaauuuuuuu

SEQ ID NO: 345828 - RNA, 64 nt, Human
agcagacacucugacaucacggagcuucacugaugacagguaacgaaacuuccuauguuauguc

SEQ ID NO: 345829 - RNA, 64 nt, Human
auaguuuuucuacaugugcucagcuggggguguggacagguagggguggggaaagaagaggcuc

SEQ ID NO: 345830 - RNA, 64 nt, Human
ccgguuuugugagaugaauuguaucccccaaaaagacagguaccuucaaugugaccuaauuggg

SEQ ID NO: 345831 - RNA, 64 nt, Human
uuaaagcaaauccuguauauguaucuacaugggagacagguagacacuacuuauuuguuacauu

SEQ ID NO: 345832 - RNA, 64 nt, Human
auugguguuucccgcaguggggaugcagcuguuggacagguauugggggcaagguugguaggga

SEQ ID NO: 345833 - RNA, 64 nt, Human
aacuucggggguguggaggaggugcggcucuagggacagguaaugucggcuuccaagugaugcc

SEQ ID NO: 345834 - RNA, 64 nt, Human
auuauuucaaaagaagauuauuuaaaacaugagugacagguagucagaagagaacaaaaggacg

SEQ ID NO: 345835 - RNA, 64 nt, Human
guggaugaaaaauauuucugagugguaguuuuuugacagguagaccaugucuuaucuuguuuca

SEQ ID NO: 345836 - RNA, 64 nt, Human
uaccaugguguaagcugauagcacaaguucuggcgacagguagcacguaucugagagacaccug

SEQ ID NO: 345837 - RNA, 64 nt, Human
uguaaaacaguagccccaucacauuugugauacugacagguaucaacccagaagcccaugaacu

SEQ ID NO: 345838 - RNA, 64 nt, Human
aguuuuuaugccuguuaagcuuuacugugcuuuugacagguaguuuugggucaguuauauucag

SEQ ID NO: 345839 - RNA, 64 nt, Human
augcuuuaaugauaacugcuuuggcaauuccccagacagguauacuucuucauccaaaauugca

SEQ ID NO: 345840 - RNA, 64 nt, Human
agaguaagcaguacaaaguguauauuuuggaaaagacagguaacagguaacagcaucgcuaauc

SEQ ID NO: 345841 - RNA, 64 nt, Human
ugccagcauugcccacaaauccuuuuaggaaugggacagguaccuuccacuuguuguauuuauu

SEQ ID NO: 345842 - RNA, 64 nt, Human; identical to SEQ ID NO: 135816

SEQ ID NO: 345843 - RNA, 64 nt, Human; identical to SEQ ID NO: 135817

SEQ ID NO: 345844 - RNA, 52 nt, Human; identical to SEQ ID NO: 135818

SEQ ID NO: 345845 - RNA, 64 nt, Human; identical to SEQ ID NO: 135819

SEQ ID NO: 345846 - RNA, 64 nt, Human; identical to SEQ ID NO: 135820

SEQ ID NO: 345847 - RNA, 64 nt, Human
ucuugguuaugaaucuuaauuucgaauauaagaugauagguaagcgcagcuuucuuggauaauc

SEQ ID NO: 345848 - RNA, 64 nt, Human
ggagagcgccucuuccucugggcagcgcuaucuagauagguaagugggggcggggaagggugca

SEQ ID NO: 345849 - RNA, 64 nt, Human
uuguacacuuugccuuuuugaguaacauuccagagauagguauuuuuuguaggcuguuucacug

SEQ ID NO: 345850 - RNA, 64 nt, Human
aggauuugggaaaauaaacuguaaauguuuauuugauagguaaauauaguuuuauugucacaug

SEQ ID NO: 345851 - RNA, 64 nt, Human
ggagaaaugcccuuucuggcaauuguuggagcuggauagguaaguuuuauaagggaguacauuu

SEQ ID NO: 345852 - RNA, 64 nt, Human
agccuggccuugcccaccugcacacagucuguuggauagguagggccacgaggaguagccaggu

SEQ ID NO: 345853 - RNA, 64 nt, Human
gaugcacuggggcuaucuaacaguacuggcaucugauagguagaggucagguacgcugcuaaac

SEQ ID NO: 345854 - RNA, 64 nt, Human
acacugcaaaggaaagagagagaaaacaagcaaagauagguaggacagaaaggaagacagccag

SEQ ID NO: 345855 - RNA, 64 nt, Human
cucacccuggggcuaggaaauccagggugguggugauagguauaagugguguguguaugcgugu

SEQ ID NO: 345856 - RNA, 64 nt, Human
accuccuuuagugaccaguucaaauuuuaauagcgauagguagccccugagaaauuuaucacua

SEQ ID NO: 345857 - RNA, 64 nt, Human
gauuacuuucuggauagauaaucugguaauaaaugauagguaaaucaaaaauuacuuuuauuua

SEQ ID NO: 345858 - RNA, 64 nt, Human
cauugcagcacaauguagaaauuggcuugggauggauagguauagggaagggcauucguuggga

SEQ ID NO: 345859 - RNA, 64 nt, Human
guuaauaugcugauaaaacugccaagauauauuugauagguaggggauuaaacucaugguuugu

SEQ ID NO: 345860 - RNA, 64 nt, Human
gugaagacaagggcuuuuuaugcaaguuuugaaagauagguauuuauuuuuucuagagacagga

SEQ ID NO: 345861 - RNA, 64 nt, Human
uguauacacaugucauuuauuauuauuacuuuaagauagguauuauucaugugucaauguuuuu

SEQ ID NO: 345862 - RNA, 64 nt, Human
ucucaugacuauguucuucucccaaacaaggauugauagguaaaugcauugaacaaguauauau

SEQ ID NO: 345863 - RNA, 63 nt, Human
uucaguuccaugcaccacgcuccguagaagccccggcggaagccguagcuuucccugccaccu

SEQ ID NO: 345864 - RNA, 63 nt, Human
ugccugcgggaugagaccuuggcaggcgggcagcggcggaaacucagcucaagguucccggug

SEQ ID NO: 345865 - RNA, 63 nt, Human
uccaggcagugggaagccaauggagggauuaagcggcggaagcuucuuagaagaggcaggggg

SEQ ID NO: 345866 - RNA, 64 nt, Human
uguuuuucucucuuuuaccauuuuugggaagagggauagguaagugcagggaguuugugcugaa

SEQ ID NO: 345867 - RNA, 64 nt, Human
agaagccacuucuuuuggcucucuaggauaauuagauagguauuucagaaaauuggaccuuaaa

SEQ ID NO: 345868 - RNA, 64 nt, Human
auuagcccaguuaauccucacaccuacuguaggagauagguacuguuguuuuuuauuaccgccg

SEQ ID NO: 345869 - RNA, 64 nt, Human
aggaagguuaaaaggggauuaguaaaauuaaugcgauagguaacauguuuguaaccauauagua

SEQ ID NO: 345870 - RNA, 64 nt, Human
uagguaaaagggggcugcuuuucuguuaagcaucgauagguaaguugauggauaaaaguuacua

SEQ ID NO: 345871 - RNA, 64 nt, Human
uauacuccuucccuuaagggguaucauguauggugauagguaucuagagcuuaaugcuacaugu

SEQ ID NO: 345872 - RNA, 64 nt, Human
cguauacuuuuccgagacuguauacguccauauagauagguagauauauauauauauauauaaa

SEQ ID NO: 345873 - RNA, 64 nt, Human
cuuccggguccugagcaccugcuucaugaaggaagauagguagcccagagaagaaguuuuggac

SEQ ID NO: 345874 - RNA, 64 nt, Human
aguaacacuaaagcuacaagaaauauguaauaaugauagguaauaauguguuccaaagcuuuuu

SEQ ID NO: 345875 - RNA, 64 nt, Human
uugaguucuggccaccaacaauuuagucauaucugauagguacaaaagaaaaccaagauuuuga

SEQ ID NO: 345876 - RNA, 64 nt, Human
auuaugauuuuaagaaauuauuaauuuaugaaaugauagguaaggagaagcuggauuaucuccu

SEQ ID NO: 345877 - RNA, 64 nt, Human
uauugauuacuguauuuuuuuucucaagaacagugauagguagaaacuaauugaacauuuggua

SEQ ID NO: 345878 - RNA, 64 nt, Human
acuuguuugggccuuuuguggugucaguggaauggauagguaacuugggugggcaacuugggga

SEQ ID NO: 345879 - RNA, 64 nt, Human
gucaggagcaguaaucugagaaaguuaacuccaggauagguagguuucuauuguuauagcuaga

SEQ ID NO: 345880 - RNA, 64 nt, Human
gccuuauacaucucaaacucuucucuuaauuaaugauagguauuugaguaagaaugaaaaaaau

SEQ ID NO: 345881 - RNA, 64 nt, Human
ccucgacagugaugcaaggacacagagaguaccagauagguagcagagaccaaggcgcagggug

SEQ ID NO: 345882 - RNA, 63 nt, Human
aggaaaggcggggcuccuuccucaaacaucggacggcggaauguggcagaugaaaugugcugg

SEQ ID NO: 345883 - RNA, 63 nt, Human
caaaauuucuuaaggaaggcacugaaagaaacacggcggaaucucuccaggagaagcucggcg

SEQ ID NO: 345884 - RNA, 57 nt, Human; identical to SEQ ID NO: 218986

SEQ ID NO: 345885 - RNA, 64 nt, Human
auucuguuccccucauaucaugaacacaguaacugauagguaaaaagacugcaugauucacuuu

SEQ ID NO: 345886 - RNA, 64 nt, Human
uugugcacccauuggcaaaacaggaaaguuuccagauagguauuguaucauugagaaugcagca

SEQ ID NO: 345887 - RNA, 64 nt, Human
auuacugcaugcacuucuuacaauaauucuaugagauagguacuauuauccccauuucuuuuuu

SEQ ID NO: 345888 - RNA, 64 nt, Human
gggacagagagauaaaagaaauugggugagaggagauagguagcuccauaaggcacacaaauuc

SEQ ID NO: 345889 - RNA, 64 nt, Human
ggcugugugaucucuucagggugggguggucucugauagguagcauuuuccagcacuuugcaag

SEQ ID NO: 345890 - RNA, 64 nt, Human
uaaaaaaccgaguugguuuuauugaauuuaaaaagauagguaacuaaguagcauuuaaaaucaa

SEQ ID NO: 345891 - RNA, 64 nt, Human
uuaauauuuuauauuugccaacagaaacauggcagauagguaucaauauguuuucaaugccuga

SEQ ID NO: 345892 - RNA, 64 nt, Human
gaguauucuaaacagcacuacauuaauaucauuugauagguauaaaguauacuuuuucuugcac

SEQ ID NO: 345893 - RNA, 64 nt, Human
uuucggggccuaguuuugcucgaauaugaauuuagauagguaucaagcuguaacuaagacaaua

SEQ ID NO: 345894 - RNA, 64 nt, Human
gugcuacugaacugucgaaggaaauagccgcucugauagguagaugugaguaaaaagaacagga

SEQ ID NO: 345895 - RNA, 64 nt, Human
caaugcuuuaacucacuuaauccucacaacccgagauagguacuguuaccauccucucugcaga

SEQ ID NO: 345896 - RNA, 64 nt, Human
gucuuuuaauuuauaggaggcaaacuguauaaaugauagguaugaaauagaauaagaaguaaaa

SEQ ID NO: 345897 - RNA, 64 nt, Human
caauauaauauguuuaucuauauccauauggauggauagguagguagaucuucauagauuuuuu

SEQ ID NO: 345898 - RNA, 64 nt, Human
guuugcccauucucuuccuauuacuugcuccagggauagguaaaaaaaaaaaaaaaaaaaaaaa

SEQ ID NO: 345899 - RNA, 64 nt, Human
cuuuugcaucauuugggacugccauuuaaaaaaggauagguaaacaaagaaaugacaaaaauaa

SEQ ID NO: 345900 - RNA, 64 nt, Human
gaauccauacugauauaaugauagauaaucgauagauagguagaugacugacagaugauagaua

SEQ ID NO: 345901 - RNA, 64 nt, Human; identical to SEQ ID NO: 218932

SEQ ID NO: 345902 - RNA, 64 nt, Human; identical to SEQ ID NO: 218933

SEQ ID NO: 345903 - RNA, 64 nt, Human
acuagcaggaaggcccuguguggcccugggccaagcacgccagcucucagcagguuuucugcau

SEQ ID NO: 345904 - RNA, 64 nt, Human
auuccaauaugucaucuuuacucagaauccuagggauagguagaagaauucaucuuuucaagaa

SEQ ID NO: 345905 - RNA, 64 nt, Human
auuuuaucuaauuguaauucucuagggugccagagauagguauuucucauugguuugcuuuccc

SEQ ID NO: 345906 - RNA, 64 nt, Human
aauauauuuguuaauuuaauauuuaaaccugagagauagguauuguuucccagaugaggacaau

SEQ ID NO: 345907 - RNA, 64 nt, Human
caaaaaaaaaaaaaagaauccaauacugcccaaggauagguauuuuauagaugggcaacuggcu

SEQ ID NO: 345908 - RNA, 64 nt, Human
cagaggagauggagcguuaugagcauaguauguggauagguaucuucaccugcccgccccugag

SEQ ID NO: 345909 - RNA, 64 nt, Human
gucuagaacgcaaggaucucuuggaaugacaaaugauagguaccuaaaauguaacaugaaaaua

SEQ ID NO: 345910 - RNA, 64 nt, Human
augucuucaguagccaaacuacuucuugagcauagauagguauaguggguuugcuugagguggu

SEQ ID NO: 345911 - RNA, 64 nt, Human
aauuguugcuucaauaguuuaaaaaauuuauggagauagguaggucauuaugauugcagagcca

SEQ ID NO: 345912 - RNA, 64 nt, Human
cuuuggugauaaguacuuccucuaggaaauguacgauagguagaauugugguucccuaaagaca

SEQ ID NO: 345913 - RNA, 64 nt, Human
aagaggaaauacuccuggagugcccuuggcuuaugauagguaucaaucaggauugagcacugaa

SEQ ID NO: 345914 - RNA, 64 nt, Human
uucauaacaguagaggauuuugagcuuuacaggugauagguaccuaaugucuccuacagaaaca

SEQ ID NO: 345915 - RNA, 64 nt, Human
acucagucugugggagcucagcucgcugcccagggauagguaugaccuaugucugccuuaggcu

SEQ ID NO: 345916 - RNA, 64 nt, Human
aaaccgaccgccuguaggcuccuggaacuauacagauagguaaagaguuccaaguucguccagc

SEQ ID NO: 345917 - RNA, 64 nt, Human
uuccaagcaacaaacuccuuaauuugcucuaauagauagguaugguuuaaucuuuccauugugu

SEQ ID NO: 345918 - RNA, 64 nt, Human
ucuaguaaccuaaaguaaauuuguuaaccaaaaugauagguaaaaagaucuauacaucuuaaug

SEQ ID NO: 345919 - RNA, 63 nt, Human
aggggcagucuccucaguaaucuaggauucaaugauagguaugauuccaguuuauuauccauc

SEQ ID NO: 345920 - RNA, 64 nt, Human
ugucucagcucccugaguaacuggaauuacaggugcacgccaccacgcccggcuaauuuuugug

SEQ ID NO: 345921 - RNA, 64 nt, Human
gccucagccucagcgaguagcugagacuaccggcgcacgccaccacgcccagcuaauuguuuug

SEQ ID NO: 345922 - RNA, 64 nt, Human
uuaguuaacagaauugaaauguuugauauggcaagauagguaugguaauuucaaagugaauugg

SEQ ID NO: 345923 - RNA, 64 nt, Human
cagauucuuuguugggaagacugaaaaaaauaaagauagguauaggauaauuuuuaauauggug

SEQ ID NO: 345924 - RNA, 64 nt, Human
gauaucuaucuguacagauuucuauuuauccauagauagguaucuauacauacacaucucaagu

SEQ ID NO: 345925 - RNA, 64 nt, Human
cccuucuacacaccugagggggagacggcguugggauagguaugacuggcuuaagagaccacag

SEQ ID NO: 345926 - RNA, 64 nt, Human
auauuaaggagacccuuuucuccuugaggauagggauagguaagguaaacuuguaaaaaggaug

SEQ ID NO: 345927 - RNA, 64 nt, Human
gcaaauugacagacagugagaguuuuacaaacaugauagguauucugcucggcaauuuguaagu

SEQ ID NO: 345928 - RNA, 64 nt, Human
aaaugacagaacuauaauuacagagaucagaucagauagguaaacugcaagauagauaggauga

SEQ ID NO: 345929 - RNA, 64 nt, Human
accaauggugguuuguggggagggugacaggguggauagguacaggauugggagacuuuucacu

SEQ ID NO: 345930 - RNA, 64 nt, Human
cagagaccaaauaauuaaaagaaaaacaaauauagauagguagaacuauauuuucccccaauca

SEQ ID NO: 345931 - RNA, 64 nt, Human
augcuggacuguuuugaccugguuuaacccuucugauagguaguuguggaugcuggggaugaga

SEQ ID NO: 345932 - RNA, 64 nt, Human
ggaacggggggaauggucauuuaguuuuacuccugauagguagaugcagcucuuacagauauuu

SEQ ID NO: 345933 - RNA, 64 nt, Human
aaaccaaguuaagucccauucaguggcaacuugugauagguaccugagugacggcaaccugcgg

SEQ ID NO: 345934 - RNA, 64 nt, Human
aagcaucuaguacaguguacagugccuuggaaaugauagguauggaauaaaugguaauuauuuu

SEQ ID NO: 345935 - RNA, 64 nt, Human
guuuuuagaauguugaaaaguaauugaaaaaggugauagguaaauuuuuaggcaaagauaauuu

SEQ ID NO: 345936 - RNA, 64 nt, Human
gcuccuguccucccauccccuggacugggagguagauagguaaauaccaaguauuuauuacuau

SEQ ID NO: 345937 - RNA, 64 nt, Human
accacuuagaagauguuguuaaaaacaugugaaagauagguauggaaaaagcauacacccccaa

SEQ ID NO: 345938 - RNA, 64 nt, Human; identical to SEQ ID NO: 218916

SEQ ID NO: 345939 - RNA, 64 nt, Human; identical to SEQ ID NO: 218917

SEQ ID NO: 345940 - RNA, 64 nt, Human; identical to SEQ ID NO: 218949

SEQ ID NO: 345941 - RNA, 64 nt, Human
gucuugaguaauaauauaaagucaacuccagacugauagguagucauuagccaugagaaauguu

SEQ ID NO: 345942 - RNA, 64 nt, Human
ggcgguaguggucgugccuguguguaucagaagggauagguaucuugccuccuuucucucaggc

SEQ ID NO: 345943 - RNA, 64 nt, Human
acugucagaaugggcucaaggagccaucuuuugugauagguauuggggaacuaagggguaucuc

SEQ ID NO: 345944 - RNA, 64 nt, Human
gauagacguuuuuuaguucuuuuagagugguucugauagguacagauucucuuauuuuuugcuu

SEQ ID NO: 345945 - RNA, 64 nt, Human
uuuaucuagagaauacaaagacccacauguaaaugauagguauuaucuccauguauauauguac

SEQ ID NO: 345946 - RNA, 64 nt, Human
cucuggaagguauaugcaucuucuguaauacucagauagguauaagauuuuucacaaaauccuu

SEQ ID NO: 345947 - RNA, 64 nt, Human
caaaguagucacuguauauacguauagagagguagauagguagguagauuuuaaauugcauucu

SEQ ID NO: 345948 - RNA, 64 nt, Human
ggauuggaauauuuaauaagcccaauucuaaguugauagguaauuuuaaauauucaaaccaaau

SEQ ID NO: 345949 - RNA, 64 nt, Human
acacauuuucuggguccugaagauaauuuuuauugauagguauaugugugucuacaaaugguga

SEQ ID NO: 345950 - RNA, 64 nt, Human
uaaguuaaaguucugauuugcucacucuauccuggauagguauuuagaaccugauagucuuuaa

SEQ ID NO: 345951 - RNA, 64 nt, Human
uggucuuaagaguaagucucauggggugggccaugauagguaccuagugguagguagaaaaaga

SEQ ID NO: 345952 - RNA, 64 nt, Human
uuaguuuuaauugaaaauguuugcuuuuaaaacugauagguauuguuggaaagcaggaugaagc

SEQ ID NO: 345953 - RNA, 64 nt, Human
gauugguagacagaagggugcagaggcgcccaggggaguacauugccccgugcaaagcaggggc

SEQ ID NO: 345954 - RNA, 64 nt, Human
gugacuggccaucacauuaaugaaugacgagauuggaguacacugucaccaagggcaggcaaag

SEQ ID NO: 345955 - RNA, 64 nt, Human
aaugagaagucucuaucugagcuggucaguuacuggaguacauguuacuaaucuggguuuaaag

SEQ ID NO: 345956 - RNA, 64 nt, Human
ucaagccauucugccucagccucccaaguagcugggaguacaggcgucugccaccaugccuaau

SEQ ID NO: 345957 - RNA, 64 nt, Human
acagaacaguguugucuccaccuggccuuagauggcacgccaugauucgggccuggauagacug

SEQ ID NO: 345958 - RNA, 64 nt, Human
cugccucagcucccaaguagcugggacuacaggugcacgccaccacaacuggcuaauuuuugua

SEQ ID NO: 345959 - RNA, 64 nt, Human
aaggugggagcauuuacaccgcagaaaugacaccgcacgccagcgccccgcggccgcgauccgg

SEQ ID NO: 345960 - RNA, 64 nt, Human
aaaauccauguucuaacauauguaauaauugccaggaguacagugcucuuguugaucuuguauu

SEQ ID NO: 345961 - RNA, 64 nt, Human
caauuguuggagcuggauagguaaguuuuauaagggaguacauuuugacugagcacuuagggca

SEQ ID NO: 345962 - RNA, 64 nt, Human
uuuugagauggagucuugcucuguugcccaggcuggaguacauuugccugaugucagcucccug

SEQ ID NO: 345963 - RNA, 64 nt, Human
ugugguaauucgagccaucuggagaaugcucuggggaguacaccaggcucagcuguggaccccu

SEQ ID NO: 345964 - RNA, 64 nt, Human
uuuuuugagacagaguuucauugucacccaggcuggaguacaguggcaugaucucagcucacug

SEQ ID NO: 345965 - RNA, 64 nt, Human
auacaguuugcuuguaauauuuuuaauaaugugaggaguacaguguuuucuaauucauucaagu

SEQ ID NO: 345966 - RNA, 64 nt, Human
cguggccucuguagcuggaggucaagaugcagguggaguacaugucauucagcgcacacgcgga

SEQ ID NO: 345967 - RNA, 64 nt, Human
cgggaggauugcuugagccucggaguuccaggcuggaguacaccaacuacuccagccugagcga

SEQ ID NO: 345968 - RNA, 64 nt, Human
gcuggcccacagcucugcuggaagaacugcauggggaguacauucaucuggaggcugcguccug

SEQ ID NO: 345969 - RNA, 64 nt, Human
gugagagacggugucuuguucugucacucaggcuggaguacaguggugccaucauugcugucug

SEQ ID NO: 345970 - RNA, 64 nt, Human
ccauaccuggacucugagaaaaugagcugaauaaggaguacaguguguaaggagcagccaggga

SEQ ID NO: 345971 - RNA, 64 nt, Human
ucuuuugagacagggucuugcucuugcccaggcaggaguacaguagugcaaucacagcugacug

SEQ ID NO: 345972 - RNA, 64 nt, Human
cacacaagugugauuaggauggucaaggucaucaggaguacagccuauuauauucccacauccu

SEQ ID NO: 345973 - RNA, 64 nt, Human
uuugagacggaguuucgcuuuugucccccaagcuggaguacaaugacaggaucucggcucacug

SEQ ID NO: 345974 - RNA, 64 nt, Human
augcagcauaagaaacugcugcagaguggugcgaggaguacauuuucagagcaggugcaguaca

SEQ ID NO: 345975 - RNA, 64 nt, Human
ccagugagaggauauagccaauuaaguguguuauggaguacacccauuuugacacacuuguaau

SEQ ID NO: 345976 - RNA, 64 nt, Human
ggccguagacucacggcugcaccugcagggagcagcacgccaaccccagcaguccugggccccc

SEQ ID NO: 345977 - RNA, 64 nt, Human
ggcaucguugugccuaaccugggagacggaagaagcacgccaugggaaguguuuacacuugggg

SEQ ID NO: 345978 - RNA, 52 nt, Human
augccauauuucaugauuagaggcacgccaguuucaccauuuccgggaaacg

SEQ ID NO: 345979 - RNA, 64 nt, Human
caucuauuuucucagaaucuauucaguacccuauggaguacauggaagaaguauauuuuuggaa

SEQ ID NO: 345980 - RNA, 64 nt, Human
aaagaaauaguguacaaaauucuuugguuucuauggaguacaccuaccagagacuaccagugua

SEQ ID NO: 345981 - RNA, 64 nt, Human
uuucaagacagggucucgcucuuuugcccaggauggaguacaguggcauggucaaggcucacug

SEQ ID NO: 345982 - RNA, 64 nt, Human
uacuaauucaaaagacaaauauuucagaggaaguggaguacaguauuuaacauuuuguuugcaa

SEQ ID NO: 345983 - RNA, 64 nt, Human
caaaaaaagaugaaagucuuguauccaaagcaauggaguacauguuuggcugguaguagaacac

SEQ ID NO: 345984 - RNA, 64 nt, Human
uuuuucaggugaguaguugccgcguaauaucauuggaguacauucuuuauacuguuugugaaau

SEQ ID NO: 345985 - RNA, 64 nt, Human
uuaagagacagggucugucuuuguuacccaggcuggaguacaguggugucaucaaagcucagug

SEQ ID NO: 345986 - RNA, 64 nt, Human
uuuugagacugagucucucucuguugcccaggcuggaguacaauggcgugaucucggcucacug

SEQ ID NO: 345987 - RNA, 64 nt, Human
agaaggagauggaaugugucugguaaccccaaauggaguacaaguagccuuuguuuuccugcau

SEQ ID NO: 345988 - RNA, 64 nt, Human
uccugcccaggccagcacuuggcugaguuggguuggaguacacaccuggugugcagggugaagc

SEQ ID NO: 345989 - RNA, 64 nt, Human
agagagagaugguguuuacucagaaccugcuccuggaguacaccaaccagaccacucaggcacg

SEQ ID NO: 345990 - RNA, 64 nt, Human
auuuuguaaagauauaaaguacaauagaauuucuggaguacagauuaaacuauuugcacuaaca

SEQ ID NO: 345991 - RNA, 64 nt, Human
ucccgagacagggucuugcucuggcgcccaggcuggaguacaguggcaugaucuuggcucacuu

SEQ ID NO: 345992 - RNA, 64 nt, Human
uuuugagauggagucucacucugucacccaggcuggaguacagugacacgaccucggcucacug

SEQ ID NO: 345993 - RNA, 64 nt, Human
uguuuuagaauguuuugaucucuuuggggaaucuggaguacaggccucuccgccccugaccacc

SEQ ID NO: 345994 - RNA, 64 nt, Human
auuuauucugaccaaugaacacagcugacucaggggaguacaaucuccugccaaguaauagaac

SEQ ID NO: 345995 - RNA, 64 nt, Human; identical to SEQ ID NO: 218913

SEQ ID NO: 345996 - RNA, 64 nt, Human; identical to SEQ ID NO: 218914

SEQ ID NO: 345997 - RNA, 64 nt, Human; identical to SEQ ID NO: 218915

SEQ ID NO: 345998 - RNA, 64 nt, Human
aaauugagggcacggugucgaggguauugggccgggaguacaagcugcccauggacgaccugcu

SEQ ID NO: 345999 - RNA, 64 nt, Human
uggagugcaaugagaaugugaaacacaaaaccaaggaguacauuaagaaguacaugcagaaguu

SEQ ID NO: 346000 - RNA, 64 nt, Human
accuuucucaagcugagauugagcagaagaucaaggaguacaaugcccagaucaacagcaaccu

SEQ ID NO: 346001 - RNA, 64 nt, Human
uuuggagauggagucucgcucugucgcccaagcuggaguacaguggugcaaucucacugcaagc

SEQ ID NO: 346002 - RNA, 64 nt, Human
caguaauggacguuugugugaagaaaugaacuguggaguacaaaaugcuuugagucuuuccgau

SEQ ID NO: 346003 - RNA, 64 nt, Human
gcaucaaguacaugcggcagaucucggagggaguggaguacauccacaagcagggcaucgugca

SEQ ID NO: 346004 - RNA, 64 nt, Human
uuugagacggaguuucacucuugucacccaggcuggaguacaguggcacgaucucggcuuaugg

SEQ ID NO: 346005 - RNA, 64 nt, Human
guugccuaaggcuagaauugggggugaugaauggggaguacaggauucaucuaauggguacagg

SEQ ID NO: 346006 - RNA, 64 nt, Human
cuuuaagauggagucuugcucuguugcccgggcuggaguacaauggcaugaucucagcucacug

SEQ ID NO: 346007 - RNA, 64 nt, Human
auugcaagcugauucacauauaaagaugcaggcuggaguacaauggugcaaucucagcucacca

SEQ ID NO: 346008 - RNA, 64 nt, Human
ucuuuaaauucuguuaagauccucaaguaacuggggaguacaugcuuuaggacacaaacaaaaa

SEQ ID NO: 346009 - RNA, 64 nt, Human
uuuugagacagagucucgcucuguugccuaggcuggaguacaguggccugaucucggcucacug

SEQ ID NO: 346010 - RNA, 64 nt, Human
gaugaugacugaaucuuggauuauggggugaagaggaguacagacuagguuccaguuuucuccu

SEQ ID NO: 346011 - RNA, 64 nt, Human
uuuucuaggauaaaucuaauuacuguuuacugguggaguacauaugcauagaaacggcuucugu

SEQ ID NO: 346012 - RNA, 64 nt, Human
aaauuuaauugauaauuguguauauuauauauauggaguacaaugugauguuuugauauauguu

SEQ ID NO: 346013 - RNA, 64 nt, Human
cacagcuggugaacagcucagcagacaacaugcuggaguacaagucuuggcugaagaacuuggc

SEQ ID NO: 346014 - RNA, 64 nt, Human; identical to SEQ ID NO: 218919

SEQ ID NO: 346015 - RNA, 64 nt, Human; identical to SEQ ID NO: 218920

SEQ ID NO: 346016 - RNA, 64 nt, Human; identical to SEQ ID NO: 218921

SEQ ID NO: 346017 - RNA, 64 nt, Human
uuuuuuugagagagucucacucugucgccaggcuggaguacaguggcaugaucucggcucacug

SEQ ID NO: 346018 - RNA, 64 nt, Human
cugucuucauacgcuucugcacucuggggaagaaggaguacauugaagggagauuggcaccuag

SEQ ID NO: 346019 - RNA, 64 nt, Human
ucuccuuccgcaagucuuuuuaauccucauaucuggaguacaaggguagaccucuggcuuacca

SEQ ID NO: 346020 - RNA, 64 nt, Human
cccuauucuguggauacagucccagaguuuucagggaguacacagguagauuaguuugaagcau

SEQ ID NO: 346021 - RNA, 64 nt, Human
uuugagauggaguuucgcucuuguugcccaggcuggaguacagugguaugaucuuggcucacug

SEQ ID NO: 346022 - RNA, 64 nt, Human
ccccaauuaacugaagcaaauaccaaagcaguugggaguacauaugguagacaauuugccuuag

SEQ ID NO: 346023 - RNA, 64 nt, Human
uuuaaagacagggucucgcuuuaucgcccaggcuggaguacagugaugcaaucucaguccacug

SEQ ID NO: 346024 - RNA, 64 nt, Human
gcugaggcaggagaaucaccugaacccccaggcuggaguacaguggcaggaucucagcuuacug

SEQ ID NO: 346025 - RNA, 64 nt, Human
uuuugagacaaggucucacucugucacccaggcuggaguacaguggguugaucauggcucacug

SEQ ID NO: 346026 - RNA, 64 nt, Human
uucugagacggagucguuuucugccacccaggcuggaguacaguggcaugaucuuggcucacug

SEQ ID NO: 346027 - RNA, 64 nt, Human
ugcucuguuuugauccuucuucuuauuauggaaaggaguacaggaccucuucagucuuccccuu

SEQ ID NO: 346028 - RNA, 64 nt, Human
caaagcucguuuguggauugugggacugagcgaaggaguacaaauauauccacgucgcucagag

SEQ ID NO: 346029 - RNA, 64 nt, Human
guacugagaagugggagcacaguacugagaaaugggaguacacuacugagaaaugggagcacag

SEQ ID NO: 346030 - RNA, 64 nt, Human
ucuuuaugagacgaucucacucugucaccagguuggaguacagugguacaaucacaacucaccg

SEQ ID NO: 346031 - RNA, 64 nt, Human
gaagcuguuggagaaaauacuccagcaaaaugaaggaguacacaaaccagagaaugacaugaau

SEQ ID NO: 346032 - RNA, 64 nt, Human
uuuuuuuuuuuugucucgcucuguugcccaggcuggaguacaguggcgcgaucucagcucacug

SEQ ID NO: 346033 - RNA, 64 nt, Human; identical to SEQ ID NO: 218922

SEQ ID NO: 346034 - RNA, 64 nt, Human; identical to SEQ ID NO: 218923

SEQ ID NO: 346035 - RNA, 64 nt, Human; identical to SEQ ID NO: 218925

SEQ ID NO: 346036 - RNA, 64 nt, Human
aauguuuuaauaggcauuucacuaauagggaucuggaguacaaggaaauacagugcauuuaaga

SEQ ID NO: 346037 - RNA, 64 nt, Human
uuugagacggaguuucugucuuguugcccagacuggaguacaaugaugcgaucucagcucacca

SEQ ID NO: 346038 - RNA, 64 nt, Human
gaaaccuuauacccagaggaaaauacacaccuggggaguacauuugacaaauuucccuuaggau

SEQ ID NO: 346039 - RNA, 64 nt, Human
cuuugagaugaagugcuguucuuuugccuagguuggaguacagcggugaaaucauagcgcacug

SEQ ID NO: 346040 - RNA, 64 nt, Human
uuuugaaacaagaucugacucuguugcccaagcuggaguacaguagugcaaucucagcucacug

SEQ ID NO: 346041 - RNA, 64 nt, Human
agcaauccaccuuccucggccucccaaaguacuaggaguacaggcauagccacuugcucagcca

SEQ ID NO: 346042 - RNA, 64 nt, Human
cuuuccaagcuccucgugauaaugcagacuuccuggaguacaaacacaggauuuguaauuccuu

SEQ ID NO: 346043 - RNA, 64 nt, Human
ggaguggguggagacaaggagggaguaagucguaggaguacaagguuuuuauuuuuuuuaacag

SEQ ID NO: 346044 - RNA, 64 nt, Human
gagaacagacagccaggauaaaguggcaccuucuggaguacacuggagggggcagcccaaguua

SEQ ID NO: 346045 - RNA, 64 nt, Human
ggcauguuugaggacucugcggaucagugcuacaggaguacaucugcccugccacaugacucca

SEQ ID NO: 346046 - RNA, 64 nt, Human
aaacacucauaaauauacaaaacuuuuucaguguggaguacauuuuuccaaucacaggaacuuc

SEQ ID NO: 346047 - RNA, 64 nt, Human
uuuuuugagauagggucuuccugucacccaggcuggaguacaguagcgugaucacagcucacug

SEQ ID NO: 346048 - RNA, 64 nt, Human
gcugcuugaggcugggguaaauuuuggggcuuugggaguacacaggacuacugagggacgggga

SEQ ID NO: 346049 - RNA, 64 nt, Human
agugacucucccaccucagccuccuaaguagcugggaguacaggcgcgcaccaccacgccuagc

SEQ ID NO: 346050 - RNA, 64 nt, Human
augcuucccagagacugguauuguggcugugccaggaguacaugugagacuaugggaggaaagc

SEQ ID NO: 346051 - RNA, 64 nt, Human
uggaaacagauucuugagauucagaaggcauuuuggaguacacuuaucucuuguuuguguugaa

SEQ ID NO: 346052 - RNA, 63 nt, Human
gucuuuuucauugacagaaggaacccagccagccggcggaaugcaagcagcaguaggaagcgg

SEQ ID NO: 346053 - RNA, 63 nt, Human
gucuacaggagccaaggugaaagucucugaugacggcggaacuggcuccauuagaccaugguu

SEQ ID NO: 346054 - RNA, 64 nt, Human
gcuccaugcugucugugagcaggccccaugcccagcacgccagccaccgcaggauaccucaguc

SEQ ID NO: 346055 - RNA, 64 nt, Human
aacaucagaaccagcuaagggaaaagaaauaucuggaguacauuaaaagugugaaagaaaagaa

SEQ ID NO: 346056 - RNA, 64 nt, Human
cgaauaaauguaauugagagucuauucauggugaggaguacaucccagugccuuuaaccuggau

SEQ ID NO: 346057 - RNA, 64 nt, Human
uuuuuggacggagucuuagucugucacugaggcuggaguacaguggcacgaucuuggcucacug

SEQ ID NO: 346058 - RNA, 64 nt, Human
uuuugagguggagucuugcucugucgcccaggcuggaguacaguggugugaucccagcucacug

SEQ ID NO: 346059 - RNA, 64 nt, Human
ccuauaagagucagcauggagagccccugcuaauggaguacagccgccaggagcuacucaggaa

SEQ ID NO: 346060 - RNA, 64 nt, Human
gcccgguggucuggauuggaguauggccagggcaggaguacacagaauagaauuuagacugucc

SEQ ID NO: 346061 - RNA, 64 nt, Human
ucauaagggguuccuuauaaggagcaggcggaggggaguacacuuucaugugauuuaauuuuga

SEQ ID NO: 346062 - RNA, 64 nt, Human
aaacaagucauuugagaguggagacuuauaagaaggaguacauuugaguugaauacacaaaucu

SEQ ID NO: 346063 - RNA, 64 nt, Human
agcaauucuucugacucagccucccgaguagcugggaguacaggugcacaccaccaugccuggc

SEQ ID NO: 346064 - RNA, 64 nt, Human
uuauaaacaaacccaauaugaugcauuuuaagguggaguacaguaagauguguggguuuuucug

SEQ ID NO: 346065 - RNA, 64 nt, Human
cuuugagauggagucucgcucugucacccaggcuggaguacaauagcgugaucucggcucacug

SEQ ID NO: 346066 - RNA, 64 nt, Human
gacuggcuuuacuuaagggauauuugucuuuauaggaguacauaaauuuaucuuaaugauauuu

SEQ ID NO: 346067 - RNA, 64 nt, Human
aaccuuugauaccuagaucaggaauacucuuccaggaguacaaaauuacauuauugauaguuaa

SEQ ID NO: 346068 - RNA, 64 nt, Human
uuguuuuugagauagggucuuuguugcucaggcuggaguacaguggcauaaucacagcucacug

SEQ ID NO: 346069 - RNA, 64 nt, Human
auaaaacaugugaagcaguauugauucuuuauugggaguacauuuuuuuaggucucuuaaacuu

SEQ ID NO: 346070 - RNA, 64 nt, Human
uggcuguggccaccgucacaguccaggaugaagaggaguacaggguccugugagcuguuugacc

SEQ ID NO: 346071 - RNA, 64 nt, Human; identical to SEQ ID NO: 218929

SEQ ID NO: 346072 - RNA, 64 nt, Human; identical to SEQ ID NO: 218930

SEQ ID NO: 346073 - RNA, 64 nt, Human; identical to SEQ ID NO: 218931

SEQ ID NO: 346074 - RNA, 64 nt, Human
gaucaaugaaaugcuuguugaaucaggggcaaacggaguacagacgucucaagacugaaacggc

SEQ ID NO: 346075 - RNA, 64 nt, Human
uuugagacagaguuucacucuuguugcccaggcuggaguacaauggcgugaucucagcucacuc

SEQ ID NO: 346076 - RNA, 64 nt, Human
uuuugagacugagucucacucugucgccugggcuggaguacaguggugcgaucucagcucacug

SEQ ID NO: 346077 - RNA, 64 nt, Human
gccuggccaauauggugaaaccccgucucuauugggaguacaaaaauuagccggccauaguggc

SEQ ID NO: 346078 - RNA, 64 nt, Human
uuuuaaaguaugguuuuugaagauaguaggaaauggaguacagaaaggcauacaguauuauguu

SEQ ID NO: 346079 - RNA, 64 nt, Human
uuuuuagacagagucuugcucuguugcucaggcuggaguacaguggcacgaucucagcucacug

SEQ ID NO: 346080 - RNA, 64 nt, Human
cuggggaucccucuuccugcagccuuguccuuggggaguacagggaaguaccugcagugacccu

SEQ ID NO: 346081 - RNA, 64 nt, Human
cagcuuuacuuuaaaauucaaguuauacaucuugggaguacaauggcccgacauuucuucauag

SEQ ID NO: 346082 - RNA, 64 nt, Human
gguuccccucaccuucugcagaagucuccaauauggaguacaugcacuugggcauuuaauauau

SEQ ID NO: 346083 - RNA, 64 nt, Human
agauguccuaaugaacaugcaccuacauuuaauaggaguacaauaaaacuguugucagcuuuug

SEQ ID NO: 346084 - RNA, 64 nt, Human
accaacuaugcacuaggcaugguaucaaguaccaggaguacaaaaauaaguaaaccuugauuuc

SEQ ID NO: 346085 - RNA, 64 nt, Human
uuuugggacggagucucacuccauugcccaggcuggaguacaauggugcgaucuuggcucacug

SEQ ID NO: 346086 - RNA, 64 nt, Human
caaaugggggcggcuggaaagaggagaaggagagggaguacaaagacagggaauagugggauca

SEQ ID NO: 346087 - RNA, 64 nt, Human
aaggaauugaaauaaggagggacaugauggggaaggaguacaaaacaaucucucaacaugauug

SEQ ID NO: 346088 - RNA, 64 nt, Human
gauugugagaauuauaaauacagacauaaaaagaggaguacaacauacugagaaaagagcucca

SEQ ID NO: 346089 - RNA, 64 nt, Human
cucuuccaauauaggucucagaaauccaauauuuggaguacaauuucuuuuaauccagauuaca

SEQ ID NO: 346090 - RNA, 64 nt, Human; identical to SEQ ID NO: 218935

SEQ ID NO: 346091 - RNA, 64 nt, Human; identical to SEQ ID NO: 218936

SEQ ID NO: 346092 - RNA, 64 nt, Human; identical to SEQ ID NO: 218937

SEQ ID NO: 346093 - RNA, 64 nt, Human
gguggcucccuuuucaggacuagggcuuucucauggaguacaguauguuaauauuuaccuauau

SEQ ID NO: 346094 - RNA, 64 nt, Human
aggagcugguggugcagaaaggcuggcgguugccggaguacacagugacccaggagucugggcc

SEQ ID NO: 346095 - RNA, 64 nt, Human
acgcagacggugcgccugugcagcccucccagguggaguacacggcagacugugaguacucacu

SEQ ID NO: 346096 - RNA, 64 nt, Human
ggagcccggaucugugcgacugaaggugggaagaggaguacacggugcggauccagcugcaaga

SEQ ID NO: 346097 - RNA, 64 nt, Human
aaacaguguccaggagaugggaugguaccuccuaggaguacaagugccugggguguaaugagcu

SEQ ID NO: 346098 - RNA, 64 nt, Human
uuugguucuucuggaauauuuuuauguagcucuuggaguacagcuaugaaaauuaacaacuguu

SEQ ID NO: 346099 - RNA, 64 nt, Human
uggcugagugaccagggugucacccacugcaucuggaguacagcuucuccuaggacaggcggcu

SEQ ID NO: 346100 - RNA, 64 nt, Human
uguuugaggacuacaguucaucucaggguuucuuggaguacaagaccagugugaaguuauucug

SEQ ID NO: 346101 - RNA, 64 nt, Human
auauagcuagguccaauguuaaauacauuuuccuggaguacauuugucacauucagcuuugagc

SEQ ID NO: 346102 - RNA, 64 nt, Human
ucguuuacuacaaaaaaaaagauucagaguggauggaguacaacucugaguauuuuucuagucc

SEQ ID NO: 346103 - RNA, 64 nt, Human
augucccaggcacacagcccaugcccuccaccauggaguacauuuucucccuggcuugcugcug

SEQ ID NO: 346104 - RNA, 64 nt, Human
uuugagacagaguuucgcacuucuugcccaggcuggaguacaauggugcgaucuuggcucacug

SEQ ID NO: 346105 - RNA, 64 nt, Human
uuuugagauggaguuucgcucuuguugcccaggcggaguacaauggugggaucucggcucacug

SEQ ID NO: 346106 - RNA, 64 nt, Human
aaguuaucccaaagccguguguuugugauguuuuggaguacauauauaugaaaauuauuaugac

SEQ ID NO: 346107 - RNA, 64 nt, Human
ucaacugucuccaaaauaaucucuuguuaugcagggaguacaguucuuuucauucauacauaag

SEQ ID NO: 346108 - RNA, 64 nt, Human
uaccauaaagcagacaguguuuguauuuucaacuggaguacauguauuuucuuuguaaaguagc

SEQ ID NO: 346109 - RNA, 64 nt, Human; identical to SEQ ID NO: 218940

SEQ ID NO: 346110 - RNA, 64 nt, Human; identical to SEQ ID NO: 218941

SEQ ID NO: 346111 - RNA, 64 nt, Human; identical to SEQ ID NO: 218942

SEQ ID NO: 346112 - RNA, 64 nt, Human
agcgauucuccugccucagccaccugaguagcugggaguacaggcauguggcaccaugccuggc

SEQ ID NO: 346113 - RNA, 64 nt, Human
accuuuucuccuagaagcaguuacugaacauccaggaguacaacuccuucccaucauucccaug

SEQ ID NO: 346114 - RNA, 64 nt, Human
agauacuuuuugagaguauagaacacagcucuugggaguacaguucucuacguucucuacuaaa

SEQ ID NO: 346115 - RNA, 64 nt, Human
auccuagggaagggugguggagccaguaaacagaggaguacaggugaagcaccaagcucaaagc

SEQ ID NO: 346116 - RNA, 64 nt, Human
accaggaguggagggcuaggucccuuccccauggggaguacacuuggguguucuaggagggaug

SEQ ID NO: 346117 - RNA, 64 nt, Human
ucaugaccuugcugggcacagaaaacacccucguggaguacacuaauuugaacuggacuggucu

SEQ ID NO: 346118 - RNA, 64 nt, Human
uuuugagauggaauauugcucuguugcccaggcuggaguacaguggucacugcaaccuccaucu

SEQ ID NO: 346119 - RNA, 64 nt, Human
uuugcucuuccccugagaacugaaagaggggaaaggaguacauuugagggcacuuaauacaaag

SEQ ID NO: 346120 - RNA, 64 nt, Human
cagaugccgacgaaauccuccaggaggagaucaaggaguacaagguggggcugugggccaaguu

SEQ ID NO: 346121 - RNA, 64 nt, Human
cacaaaagaccccuuaccacugcucugaugaagaggaguacacagaacacauaauucaggaagc

SEQ ID NO: 346122 - RNA, 64 nt, Human
guuacggaaagcagcaguguaccagugucacucuggaguacagcgggagaaacacaaaauagua

SEQ ID NO: 346123 - RNA, 64 nt, Human
agcaacugcagaggcauuucaggaguuggagaacggaguacauuuuuaaaauuuuuuguuccau

SEQ ID NO: 346124 - RNA, 64 nt, Human
cugagcacauccagcugcuccuuacccagcaucuggaguacaggacauagcucucuccugcuac

SEQ ID NO: 346125 - RNA, 64 nt, Human
uuuuuugaggcagucucacucugucacccaggcuggaguacaauggcgugaucucggcccacug

SEQ ID NO: 346126 - RNA, 64 nt, Human
agcaauuuuccugccucagccucccgaguagcugggaguacaggcacacaccaccacacccagc

SEQ ID NO: 346127 - RNA, 64 nt, Human
gaguccccuagagucucagaagacugggcucuuuggaguacaggguccccggccucuccuuuaa

SEQ ID NO: 346128 - RNA, 64 nt, Human; identical to SEQ ID NO: 218926

SEQ ID NO: 346129 - RNA, 64 nt, Human; identical to SEQ ID NO: 218927

SEQ ID NO: 346130 - RNA, 64 nt, Human; identical to SEQ ID NO: 218938

SEQ ID NO: 346131 - RNA, 64 nt, Human
ugucugaacagaaggucugggggaagcgacggguggaguacaauaaagggaaugaggacaaacc

SEQ ID NO: 346132 - RNA, 64 nt, Human
auucuuaugcaguuaaacagaguuucgaccuggaggaguacagccucucacagucuacccugga

SEQ ID NO: 346133 - RNA, 64 nt, Human
uuuuaggagauggucuugcucugucacucaggcuggaguacaguggcacaaucauggcucacug

SEQ ID NO: 346134 - RNA, 64 nt, Human
ccgagcugguccccugccauuccgggaccucucuggaguacacuucggaguccaccaccgagau

SEQ ID NO: 346135 - RNA, 64 nt, Human
auaugcaauuuccuuuuaguguaauuauacugaaggaguacaccugugagagagacaaguaccu

SEQ ID NO: 346136 - RNA, 64 nt, Human
caucucccgcuccucuauggccccugccuucccaggaguacaccccaacagcacccucuccaga

SEQ ID NO: 346137 - RNA, 64 nt, Human
uuuugaggcagggucuugcuuugucacccaugcuggaguacaauggcacaaacacugcucacug

SEQ ID NO: 346138 - RNA, 64 nt, Human
gccgccaccugugguggcgguggggcucugacagggaguacagcugaccgcuucuggagggugu

SEQ ID NO: 346139 - RNA, 64 nt, Human
uuugagacagggucuugcucuccuuguucaggcuggaguacaguggcacaaucacagcucacug

SEQ ID NO: 346140 - RNA, 64 nt, Human
ugggcacagagcugccaucuuugaccaauuccguggaguacagaacauugugguaggggaaggg

SEQ ID NO: 346141 - RNA, 64 nt, Human
cuccaggacaggagaucugggaugccuggcugcuggaguacauguguucacaaggguuacuccu

SEQ ID NO: 346142 - RNA, 64 nt, Human
uuugagacagaguuucgcuccugucacccaggcuggaguacaaugaugcgaucucagcucacug

SEQ ID NO: 346143 - RNA, 64 nt, Human
gcuuaucaggugccaagcccuguucucggugcugggaguacagcagugagcaaaggagacaaua

SEQ ID NO: 346144 - RNA, 64 nt, Human
uuugagauggauuuucgcucuugucgcccaggcuggaguacaauggcacgaucuuggcucacug

SEQ ID NO: 346145 - RNA, 64 nt, Human
augcacauacaugugguauaagcacauguacagaggaguacacauagcauauaaacaugucugu

SEQ ID NO: 346146 - RNA, 64 nt, Human
ggggagggcuggggcuggccggggguccuguggaggaguacauggaggacuccagguacagcgc

SEQ ID NO: 346147 - RNA, 64 nt, Human; identical to SEQ ID NO: 218943

SEQ ID NO: 346148 - RNA, 64 nt, Human; identical to SEQ ID NO: 218944

SEQ ID NO: 346149 - RNA, 64 nt, Human
ugccucagccucccuaguagcugggacuacgggugcacgccaccaugcccagcuaauuuuugua

SEQ ID NO: 346150 - RNA, 64 nt, Human
gaacucuauuccuggccaguucacaggaaguacaggaguacagguuuugacacaagaacaguug

SEQ ID NO: 346151 - RNA, 64 nt, Human
uuuuacuuuaccucacuaacaauggggggagaaaggaguacaaauaggaucuuugaccagcacu

SEQ ID NO: 346152 - RNA, 64 nt, Human
uuggaugucccaguugaaucagaaggggaccucuggaguacacaccucucuccugggcgcucag

SEQ ID NO: 346153 - RNA, 64 nt, Human
gcaguuuuuaaccgcagguucuaaagugucccgcggaguacagauaauauucuggaagguaacu

SEQ ID NO: 346154 - RNA, 64 nt, Human
uucgagauggaguuuugcucuuguugcccaggcuggaguacaauggugcgaucucagcucagug

SEQ ID NO: 346155 - RNA, 64 nt, Human
uguuguuugcaguuucauuaaagcaugcucuuaaggaguacauauggucauuaauugccaacug

SEQ ID NO: 346156 - RNA, 64 nt, Human
gaaucagugguaggagcagugaaguaaauucuauggaguacauuucuaaaauaccacauuucug

SEQ ID NO: 346157 - RNA, 64 nt, Human
uuuagagacagggucuugcucugucacccagacuggaguacaaugacacaaucauagcucacug

SEQ ID NO: 346158 - RNA, 64 nt, Human
ggcaagaaggagaaaguugaaggacucagcuaaaggaguacagcaauuguaguaacugacacau

SEQ ID NO: 346159 - RNA, 64 nt, Human
accugauuucugagcauuuaauauggaugccgugggaguacaaaaguggaguguggccugagua

SEQ ID NO: 346160 - RNA, 64 nt, Human
ggaugccaccuccgcccccacccccgccgccagaggaguacaagagccagaggcccgucuccaa

SEQ ID NO: 346161 - RNA, 64 nt, Human
uuggaaacuaaaacuucaucuuccccaagugcggggaguacaaggcauggcguagagggugcug

SEQ ID NO: 346162 - RNA, 64 nt, Human
aaagcaaagcugauacagaagcauccaggcugcaggaguacaggucgcaagugcugagcguggg

SEQ ID NO: 346163 - RNA, 64 nt, Human
ccccacgauuggccaccuguagccaucugcacacaccuccgagacaguccagugucaccucucu

SEQ ID NO: 346164 - RNA, 64 nt, Human
guuggagugcaguggcccaucagggcucacuguaaccuccgacuccuggguucaagugacccuc

SEQ ID NO: 346165 - RNA, 64 nt, Human; identical to SEQ ID NO: 218946

SEQ ID NO: 346166 - RNA, 64 nt, Human; identical to SEQ ID NO: 218947

SEQ ID NO: 346167 - RNA, 64 nt, Human; identical to SEQ ID NO: 218948

SEQ ID NO: 346168 - RNA, 64 nt, Human
uggaaccccucccucugcgccgcagcuggacgccaccuccgacggacacagccagccccuuccu

SEQ ID NO: 346169 - RNA, 64 nt, Human
caccacccaggaugcucagcucaccagagcccugaccuccgagaaaugaccccguccugccccu

SEQ ID NO: 346170 - RNA, 64 nt, Human
gacaacaacgcggccaccaugcugcagguguuugaccuccgaaggauccucauccgcuacuaca

SEQ ID NO: 346171 - RNA, 64 nt, Human
agucucacucauccgaaggcguauggcugaucugaccuccgagaugaauggaggcuuaaaggcu

SEQ ID NO: 346172 - RNA, 64 nt, Human
gguaaagacugaagggaaaggagcaaagagaaaaaccuccgaggaagagaagaauggcagugaa

SEQ ID NO: 346173 - RNA, 64 nt, Human
cagcuucugcguccucuuaucuucugccaggaucaccuccgagaaggccccccuaucgggagag

SEQ ID NO: 346174 - RNA, 64 nt, Human
gcaugacccucugagaagucacugggcugauuugaccuccgacucauugguugugcaaaugcca

SEQ ID NO: 346175 - RNA, 64 nt, Human
aucacagguagcugagcggcugcccuugggugacaccuccgagaggcagccagacccagagccc

SEQ ID NO: 346176 - RNA, 64 nt, Human
auggccucuagauuaaugccaccgauucaggaacaccuccgacagucuugaaauacccccaugu

SEQ ID NO: 346177 - RNA, 64 nt, Human
cagugugucuuacuugguugcugaacaucuugccaccuccgagugcuuugucuccacucaguac

SEQ ID NO: 346178 - RNA, 50 nt, Human
agggagauggacccguuuaaaccuccgagaugagcugcucagacucuaca

SEQ ID NO: 346179 - RNA, 64 nt, Human
acgccgcagguguuuggcacccaaaucacaucucaccuccgaacuguucaaguguccccagacc

SEQ ID NO: 346180 - RNA, 64 nt, Human
cccggagaugcccacagcaccagcaccugagcucaccuccgaacccgccuccugaacccgccuc

SEQ ID NO: 346181 - RNA, 64 nt, Human
cuguccccccaggcuucauuucaaacaccguggcaccuccgagcaaggcgggccguguguaaaa

SEQ ID NO: 346182 - RNA, 64 nt, Human
ugugugcccauggggagcccagcccccaccccccaccuccgacagcaaacagcaacugacugca

SEQ ID NO: 346183 - RNA, 64 nt, Human
gauguacauaccagggaaagaaaggacagcagucaccuccgacaaugcuccguucuauggaaua

SEQ ID NO: 346184 - RNA, 64 nt, Human; identical to SEQ ID NO: 218960

SEQ ID NO: 346185 - RNA, 64 nt, Human; identical to SEQ ID NO: 218961

SEQ ID NO: 346186 - RNA, 64 nt, Human
cccugccccaugcuucaggguggagugggcgcaggcacgccaggccuucuuuagcucuggaaag

SEQ ID NO: 346187 - RNA, 64 nt, Human
agcccuggccauggcuccgcucagggccccggucaccuccgagucacucuguuccuugacuguc

SEQ ID NO: 346188 - RNA, 64 nt, Human
cuggagugcaguggcgcaaucuuggcucacugcaaccuccgacucccagguucaagcaauucuc

SEQ ID NO: 346189 - RNA, 64 nt, Human
aaucgagggggaggggugguaaccggaaauaaagaccuccgaucuuccgccccacaugcagucu

SEQ ID NO: 346190 - RNA, 64 nt, Human
aacagagcuuuuuguucucauggcuggcccugcuaccuccgaggcacccugcagggcaaugcau

SEQ ID NO: 346191 - RNA, 64 nt, Human
ccugauggcgucggacuauuccgaagaaguggccaccuccgaaaaauuccccuucuagaacaug

SEQ ID NO: 346192 - RNA, 64 nt, Human
acugaaugcuuugaucagcauugaggugaugcucaccuccgaggaccucagaacuggugcagcu

SEQ ID NO: 346193 - RNA, 64 nt, Human
auucugucuaaaaaaacaaaagucccaauuaagaaccuccgaacucuguuuugaggcaaagggg

SEQ ID NO: 346194 - RNA, 64 nt, Human
aggcaggggcucuuggaagacguuccgugcugugaccuccgagcccuccuggugggaagacagc

SEQ ID NO: 346195 - RNA, 64 nt, Human
ugcugggccuccucugccuccccuguaaaaugggaccuccgaaccaacccugccccucagaaau

SEQ ID NO: 346196 - RNA, 64 nt, Human
ugcaguggugcgaucuuggcucacugcaacuucuaccuccgagguucaagagauucuugugccu

SEQ ID NO: 346197 - RNA, 64 nt, Human
uuugucguugcgaaguuucucguuucuuccucugaccuccgagguccccgcugcaccacggggu

SEQ ID NO: 346198 - RNA, 64 nt, Human
gggcaagcaaaguguucucccagaaagugcucucaccuccgacacuggucccuacccccaggug

SEQ ID NO: 346199 - RNA, 64 nt, Human
uggcgcucgacugcacaggagcccgagacaauacaccuccgagcugaauaugaaaagucagaaa

SEQ ID NO: 346200 - RNA, 64 nt, Human
aacucgcauggaacaggagggcagcagggcacuaaccuccgaagccagacucuguuaugugugc

SEQ ID NO: 346201 - RNA, 64 nt, Human
uggggccugggccucaggagccuaggcuaggggcaccuccgagagccccuuuuugugauaaugu

SEQ ID NO: 346202 - RNA, 54 nt, Human
aauuggaagcuggauauugaugauaccuccgaggauucaguaguaguuaaguuc

SEQ ID NO: 346203 - RNA, 64 nt, Human; identical to SEQ ID NO: 218951

SEQ ID NO: 346204 - RNA, 64 nt, Human; identical to SEQ ID NO: 218952

SEQ ID NO: 346205 - RNA, 64 nt, Human; identical to SEQ ID NO: 218953

SEQ ID NO: 346206 - RNA, 64 nt, Human
cuauuucugcugcguccugcacccuccugggcccaccuccgauucacagagguuucagggggac

SEQ ID NO: 346207 - RNA, 64 nt, Human
cucuacgaaggaaaagauugcuauugucguacucaccuccgacguacuccggggucuuuuggga

SEQ ID NO: 346208 - RNA, 64 nt, Human
ccgaaagaagagccugggccacggccacguauaaaccuccgaggggucaugagguccaucaguc

SEQ ID NO: 346209 - RNA, 64 nt, Human
caccaccaccacccccaucacugcuuucucccagaccuccgaauacgaaauggcuucucuggcu

SEQ ID NO: 346210 - RNA, 64 nt, Human
cauuuagcuuguugucugaugccuccaguaggacaccuccgauggagcuuugauuucugagcag

SEQ ID NO: 346211 - RNA, 64 nt, Human
cacaaccccugugacugcccugcauguguucaugaccuccgaaggcccaaauucaugaagcagc

SEQ ID NO: 346212 - RNA, 64 nt, Human
uugcauggucucuguggaucucugacuucuuauuaccuccgauuggaacgcgccacaaaucauc

SEQ ID NO: 346213 - RNA, 64 nt, Human
cucuggccucuucaccagggcacccauccaaggaaccuccgaacagccaggaaaagccaugagu

SEQ ID NO: 346214 - RNA, 64 nt, Human
ccagcccuggcugagcguagcacugcaccguccgaccuccgaggcaggggccggggucacaccu

SEQ ID NO: 346215 - RNA, 64 nt, Human
aaaggcugaaagaguguauccaaguaaggucugaaccuccgaaugccuuuuauuugggggaaca

SEQ ID NO: 346216 - RNA, 64 nt, Human
ugauuuucaugggaugguccuaacagggucagucaccuccgagcaguuugggaacccaguuucu

SEQ ID NO: 346217 - RNA, 64 nt, Human
gggaaaugaggugcaccccaggaaggccccguagaccuccgaagacuccacaagaaacuaaugg

SEQ ID NO: 346218 - RNA, 64 nt, Human
gcagaugcaggcauuaccagcagggagcagacuuaccuccgaagauggagacaggugacugaga

SEQ ID NO: 346219 - RNA, 64 nt, Human
aagagcucagaucucccucccgaucucccuccccaccuccgaagucuccuccguggaccacagg

SEQ ID NO: 346220 - RNA, 64 nt, Human
uccccaccaccgcaacaagcgggccgccccagccaccuccgagggccagagcaagcgcuguaaa

SEQ ID NO: 346221 - RNA, 64 nt, Human
guccagccuguguccaggccuacucccuggucucaccuccgaccacagucggcggcaccuucuc

SEQ ID NO: 346222 - RNA, 64 nt, Human; identical to SEQ ID NO: 218954

SEQ ID NO: 346223 - RNA, 64 nt, Human; identical to SEQ ID NO: 218955

SEQ ID NO: 346224 - RNA, 64 nt, Human; identical to SEQ ID NO: 218959

SEQ ID NO: 346225 - RNA, 64 nt, Human
guggccggagcauggcagcugggcaucaauaaacaccuccgaggaagcuggacucgugugugcu

SEQ ID NO: 346226 - RNA, 58 nt, Human
acgaaggccacggggauugacaucgcccaccuccgacacccagugggcgccuuggcug

SEQ ID NO: 346227 - RNA, 64 nt, Human
ccgucggcgucccccgggccccccacugcaggucaccuccgaccucucgcuguagccgcuauuu

SEQ ID NO: 346228 - RNA, 64 nt, Human
augccccagagggacugugaaaaggcuuccugugaccuccgauggcggccccucauuggccaag

SEQ ID NO: 346229 - RNA, 64 nt, Human
cgcggggccggaggaaauccugaagcugacccucaccuccgagcccccacucccaccccagccg

SEQ ID NO: 346230 - RNA, 64 nt, Human
aaugaggcucaccugaugcucguugccaugggacaccuccgagagaguggagggaaaaugugug

SEQ ID NO: 346231 - RNA, 64 nt, Human
cccguggcguuaggcaaaugcccaaccuccagauaccuccgauguggagaggguguuauuuaga

SEQ ID NO: 346232 - RNA, 64 nt, Human
ccccuaugagggccacguccugggguagcuccugaccuccgaccuuauguccaaauuucacacc

SEQ ID NO: 346233 - RNA, 64 nt, Human
aaaaaaagucugugcauaguuuuagugauacaccaccuccgauaagcaaaaaaguccucacauu

SEQ ID NO: 346234 - RNA, 64 nt, Human
ggugauucuggggguccgcugguauguggagaccaccuccgaggccuugugucaugggguaaca

SEQ ID NO: 346235 - RNA, 64 nt, Human
cauagcaguagggaccaaaagucucagcacacuuaccuccgauuaugccuuaaagaguugauug

SEQ ID NO: 346236 - RNA, 64 nt, Human
cucaacccugaggguccccaggguccugaugaagaccuccgaccccagcgccaggcuccucgga

SEQ ID NO: 346237 - RNA, 64 nt, Human
cucugcguugguaucugcuacaucccaggccaccaccuccgaggaugaaaagauggcugccugc

SEQ ID NO: 346238 - RNA, 64 nt, Human
uugguuuucugggaacacagcaagggguuuggugaccuccgagaagauccaucugcaugauugg

SEQ ID NO: 346239 - RNA, 64 nt, Human; identical to SEQ ID NO: 218908

SEQ ID NO: 346240 - RNA, 64 nt, Human; identical to SEQ ID NO: 218909

SEQ ID NO: 346241 - RNA, 64 nt, Human; identical to SEQ ID NO: 218910

SEQ ID NO: 346242 - RNA, 64 nt, Human; identical to SEQ ID NO: 218911

SEQ ID NO: 346243 - RNA, 64 nt, Human
cagacggagggcagaggugguggaaggggccaggggccugcaggccucccccuggaacugggac

SEQ ID NO: 346244 - RNA, 64 nt, Human
uccuccaccagccucugacccaccuaccaccagaggccugcagccucccacaugccuuaagggg

SEQ ID NO: 346245 - RNA, 64 nt, Human
gaggcgauacagccccuaccuucagagagcaccuggccugcagcucauccaaaccugagucucc

SEQ ID NO: 346246 - RNA, 64 nt, Human
ggucuaguagaugaggcuggacugaggagggguaggccugcauccacagagaggauccaggcca

SEQ ID NO: 346247 - RNA, 64 nt, Human
cuauggcuccagcugugcuguggcccagcagcauggccugcaucuggaaggacacagguugcca

SEQ ID NO: 346248 - RNA, 64 nt, Human
caucacuuugcugcccagguauguaucuauaguuggccugcaagacacuuuuauuaauucuuca

SEQ ID NO: 346249 - RNA, 64 nt, Human
cuaaauuuguaaauauggcugcaccauuuuuguaggccugcauuguauuauauacaagacguag

SEQ ID NO: 346250 - RNA, 64 nt, Human
ggggcccaggagacacggucccaggcacugcacaggccugcaguauuaccaggcggaggggcug

SEQ ID NO: 346251 - RNA, 64 nt, Human
gggccuagaccccuccucccauggcuagaaguggggccugcaccauacaucuguguccgccccc

SEQ ID NO: 346252 - RNA, 64 nt, Human
gaaagugaugagugcgggaguccugaggagauguggccugcagacaacaugcagccaugcaggg

SEQ ID NO: 346253 - RNA, 64 nt, Human
auccaggcauggcaaaguggaaauaauucauuuuggccugcaaaccuucaacucccaucuuucc

SEQ ID NO: 346254 - RNA, 64 nt, Human
acuauacccgggaccaaacucacggaccacucgaggccugcaaaccuuccugggaggacaggca

SEQ ID NO: 346255 - RNA, 64 nt, Human
cggagguagggugcagggucagggcucccgcaggggccugcaucuggccagcaggacacaggga

SEQ ID NO: 346256 - RNA, 64 nt, Human
augcagccaggacugugagucugggcagguccaaggccugcaccuucaagaaguggaauaaaug

SEQ ID NO: 346257 - RNA, 64 nt, Human
ugugguauuuguaauaaacucuaucugcugaaagggccugcaggccauccugggaguaaagggc

SEQ ID NO: 346258 - RNA, 64 nt, Human
gaaucccagcagcagagaaccaucaaggcgggagggccugcagugauucagcaggcccuuccca

SEQ ID NO: 346259 - RNA, 64 nt, Human
ccuagaauccuugugauuuuucuuagcaccuuaugucagggaaaccuaaacugaggucagcacu

SEQ ID NO: 346260 - RNA, 64 nt, Human
ucgggcacagacgacugucguucuccacccaccagucagggacagcagccucccugucacucag

SEQ ID NO: 346261 - RNA, 64 nt, Human
cgaaugcacggccuuguaggggacgccccagauugucagggauggggggaugguccuugaguuu

SEQ ID NO: 346262 - RNA, 64 nt, Human
cccuuccacgggggcuguggcucugggugggcguggccugcauaggcuccuuccuguggguggg

SEQ ID NO: 346263 - RNA, 64 nt, Human
accuccaugccuggcuccuggaugguccuggaggggccugcagugucuccauuccccaagcugc

SEQ ID NO: 346264 - RNA, 64 nt, Human
uccugccagucccaaggcccugugggaggagacuggccugcaucucucuaagacuuagucugac

SEQ ID NO: 346265 - RNA, 64 nt, Human
uccccaagaauuacaucagagaaaaggaagaaggggccugcaggacccauugggaaugaguuua

SEQ ID NO: 346266 - RNA, 64 nt, Human
gccagcaggacggcaggacucuagggagggguguggccugcagcucauucccagccagggcaac

SEQ ID NO: 346267 - RNA, 64 nt, Human
ggggggggggggggaguugggcuguguuggaaugggccugcagcccaacaaacaagggaacuag

SEQ ID NO: 346268 - RNA, 64 nt, Human
caaauuucagguauaguuagauaaacagguacagggccugcauacuauuaaaccauaguuugug

SEQ ID NO: 346269 - RNA, 64 nt, Human
uggugccguccugccccuuccuccuucaugccugggccugcaggcccaccccagccaccacuga

SEQ ID NO: 346270 - RNA, 64 nt, Human
ugucugaauccccaauuauugaggcacacuccuuggccugcagaaaugugauugaaguaaggag

SEQ ID NO: 346271 - RNA, 64 nt, Human
gauuaauuagcaauucucauuccucucagccaaaggccugcacugggcuuuauuugucuuuuuu

SEQ ID NO: 346272 - RNA, 64 nt, Human
ccacaggggcuguuagagaagcaaggccuggaguggccugcaccgaguagcagggucaggguuc

SEQ ID NO: 346273 - RNA, 64 nt, Human
cugcugucugggugcuacuggggaaacuggccauggccugcaaacugggaaccccuuucccacc

SEQ ID NO: 346274 - RNA, 64 nt, Human
gguguguccuugaacugaggcccugugauauggcggccugcaguggugugaaacacacaaugug

SEQ ID NO: 346275 - RNA, 64 nt, Human
accaaagaucugcuccucgcucgcaccugccuccggccugcacucccccaguucccgggcccuc

SEQ ID NO: 346276 - RNA, 64 nt, Human
aaccuuaaauuguuaauuuuauaaaauuugguuuggccugcacuacgaugagggauggagguag

SEQ ID NO: 346277 - RNA, 64 nt, Human
aagaaaauccauaugaauguuuaaaaugugguaaggccugcaguuguuccagugguauuugaug

SEQ ID NO: 346278 - RNA, 64 nt, Human
gcaaaggcagcacguaauguguaaguucuagaucgucagggaggaagggucaguugggugccug

SEQ ID NO: 346279 - RNA, 64 nt, Human
guggaggcagcacggaacauguagguuauagaucgucagggaggaggggucaguugggugcuug

SEQ ID NO: 346280 - RNA, 64 nt, Human
gccuuugguguuugcacuacugcuaucauaaggggucagggacauuccggggagaagugaccac

SEQ ID NO: 346281 - RNA, 64 nt, Human
cucugcgaugugugccccaaagcagaacuuacagggccugcaggaagcuggugucagggagaga

SEQ ID NO: 346282 - RNA, 64 nt, Human
auuuuaacugcucugaacuaaguauaagcucaugggccugcaaagguucagacgguuucuccuu

SEQ ID NO: 346283 - RNA, 64 nt, Human
cagggaaggugaaccccuguccugaccaaaauugggccugcacugcccaaagucuuggaaacuu

SEQ ID NO: 346284 - RNA, 64 nt, Human
ggcuguaccuagaauagugguucucgaagaaugcggccugcagauccugggagucccaagaccc

SEQ ID NO: 346285 - RNA, 64 nt, Human
uucaggcugguugccagcggacgucagcacucacggccugcagggacucagcacagcucuggau

SEQ ID NO: 346286 - RNA, 64 nt, Human
cauuuccucugggcaggacucucuggccuucuguggccugcaaugccaggccaugugccccucu

SEQ ID NO: 346287 - RNA, 64 nt, Human
aauggugccgaaauaacaaugugaaccugagacuggccugcaugaauacagggugugcgugaau

SEQ ID NO: 346288 - RNA, 64 nt, Human
uucgugaggccgguacuuggggccgaaaaacuguggccugcagaagucccaggcgacccccauc

SEQ ID NO: 346289 - RNA, 64 nt, Human
ccccagagcgggugggcggggggugaauaugguuggccugcaucagguggccuucccauuuaag

SEQ ID NO: 346290 - RNA, 64 nt, Human
auggcccuucccuggccuguggcccagccuggcuggccugcaggugucuagggucucagcuuuu

SEQ ID NO: 346291 - RNA, 64 nt, Human
uacuccagggccucugcuccucguggcugccaggggccugcagggucugggugggucucccagg

SEQ ID NO: 346292 - RNA, 64 nt, Human
cccucaaauuaagauuuuuacuucaucuuucuugggccugcaccuccaagauaacaaagaagaa

SEQ ID NO: 346293 - RNA, 64 nt, Human
aaaaauauaaaaauuagccaggcaugguggugugggccugcagucccagcuaccugggaggcug

SEQ ID NO: 346294 - RNA, 64 nt, Human
caaugacccccacccagggggccagcgggagcagggccugcaugagaccccgacagaagguggg

SEQ ID NO: 346295 - RNA, 64 nt, Human
aucugggcgaguagaccgccuggcucagcccacaggccugcagcaucccauagcaccccgcccu

SEQ ID NO: 346296 - RNA, 64 nt, Human
cggagugaggaagcuuccaccuccauccugacuaggccugcauccuaacugggccucccucccu

SEQ ID NO: 346297 - RNA, 64 nt, Human
uaaauuuuucccagcaaaauaaaucauauggcgagucagggaauaaaaagucaaaagaaacaaa

SEQ ID NO: 346298 - RNA, 64 nt, Human
gaugggagcuuuuuagaaggggcuaagugcuggugucagggaaauuccauaaugaaguagaaug

SEQ ID NO: 346299 - RNA, 64 nt, Human
gaguuucccacgggggcugcaguggauucacugugucagggaugagccuggcuuggggguuggu

SEQ ID NO: 346300 - RNA, 64 nt, Human
ccaaaguccugucaggcuggugggcaccaggaaaggccugcacccucuuccugcucucccagga

SEQ ID NO: 346301 - RNA, 64 nt, Human
ggaccccugaaacuggaccugcauagcuacgugaggccugcacagugagucagcuggggugccc

SEQ ID NO: 346302 - RNA, 64 nt, Human
uggagacgacaugguguugucuguggagaccgguggccugcagaccauugcccaccgggagccg

SEQ ID NO: 346303 - RNA, 64 nt, Human
agcucuggucugugcagacucauggccaccaggaggccugcagauccagccuuccugucaacag

SEQ ID NO: 346304 - RNA, 55 nt, Human
cugagaagggcaaggaguaacccauggccugcacccuccugcagugcaguugcug

SEQ ID NO: 346305 - RNA, 64 nt, Human
agacaagccucaccuccacuucugucaagagaggggccugcagugcaaacccucuuccgcugag

SEQ ID NO: 346306 - RNA, 64 nt, Human
ugugggaguccucuagagagaugagaagccaggaggccugcaccaaaugucagaagcuuggcau

SEQ ID NO: 346307 - RNA, 64 nt, Human
gaugacccuggcccaugaccagcauccuggggacggccugcacccucugcccgccuuggggucu

SEQ ID NO: 346308 - RNA, 64 nt, Human
ggagcuuuccccaggcaaauacaaaccgccccguggccugcaggccugcaggggaggcagcaaa

SEQ ID NO: 346309 - RNA, 64 nt, Human
ccccaggcaaauacaaaccgccccguggccugcaggccugcaggggaggcagcaaagggaccug

SEQ ID NO: 346310 - RNA, 64 nt, Human
gcgaagcagaucgcagguuccacgccaucugcauggccugcaggagcuucugcugcugacccca

SEQ ID NO: 346311 - RNA, 64 nt, Human
ugcgcgcgcgcgcgcgugugugugugcacgcacuggccugcacagagagcaugggugagcgugu

SEQ ID NO: 346312 - RNA, 64 nt, Human
ucuaccaguacccuguugccauccccaucccacaggccugcauaggcagcagcgguccaucugu

SEQ ID NO: 346313 - RNA, 64 nt, Human
aagauaauccaagagcaaaacccacuguacuuggggccugcaauggcuguguguacacuacauc

SEQ ID NO: 346314 - RNA, 64 nt, Human
ggacuccaaguucagcgcuccaggucugggacagggccugcaugcagucaggcuggcaguggcg

SEQ ID NO: 346315 - RNA, 64 nt, Human
uagugggccagggcugcccugagaagcugcuccaggccugcagcaggaguggugcagacagaag

SEQ ID NO: 346316 - RNA, 64 nt, Human
gugaggcaggcucccccgugcccugccucccucugucagggaaccugggacccccuccccacug

SEQ ID NO: 346317 - RNA, 64 nt, Human
agcuucacgccacccuuccccgcuguggcuuggugucagggagaggcuguagaguggcuguguc

SEQ ID NO: 346318 - RNA, 64 nt, Human
aaaugugaauucccaaacuuuucuuuuuggcuuugucagggaaaagaaaaauaucuuuauaaag

SEQ ID NO: 346319 - RNA, 64 nt, Human
ugugugggugcgucuaggggguaucccgguagggggccugcagggagccagaggguggaaaugg

SEQ ID NO: 346320 - RNA, 64 nt, Human
uauaaguggagcuggaauaguccuggggcucuggggccugcagguaucagcuugcucucuuugc

SEQ ID NO: 346321 - RNA, 64 nt, Human
acgucugacagaagcaugugcacuucgggaagcaggccugcaucuuaccuguacaguauuugca

SEQ ID NO: 346322 - RNA, 64 nt, Human
gagagcuggucaggcucccccaucugcccagcacggccugcacugugcccacccacuugcucca

SEQ ID NO: 346323 - RNA, 64 nt, Human
auauaauucccuuucuuguggaacagaagacugaggccugcagguuccgaugugucuccauggg

SEQ ID NO: 346324 - RNA, 64 nt, Human
gccucaggucucccccuuacaaggcguggcucauggccugcauuccagagaccaacaugauagc

SEQ ID NO: 346325 - RNA, 64 nt, Human
aaaggcaauaaagcauauaaugacuuagcccagcggccugcaggcaauacauguuaaugaaugu

SEQ ID NO: 346326 - RNA, 64 nt, Human
gguuaaaccgcgcccuguaaaaaguuauguucuaggccugcaucccccauuuuauugcaucaaa

SEQ ID NO: 346327 - RNA, 64 nt, Human
aguuaggauucauguuuaaggugguggcgcuugaggccugcaagggccacguuggauuacugaa

SEQ ID NO: 346328 - RNA, 64 nt, Human
acauuuaugugaaguaaagacaugcgagacugguggccugcaaauagcauccguugaucugugu

SEQ ID NO: 346329 - RNA, 56 nt, Human
ucuuuuuaucacaggcaugaggauguggccugcaugcugccugaucuugccuagaa

SEQ ID NO: 346330 - RNA, 64 nt, Human
aucacaccacugcacucuggccugcaugcacucuggccugcauggcagaacaagacccugucuc

SEQ ID NO: 346331 - RNA, 64 nt, Human
gcugcaguaagcuacgaucacaccacugcacucuggccugcaugcacucuggccugcauggcag

SEQ ID NO: 346332 - RNA, 64 nt, Human
ggacacggacaugcgcugaagccggccggagcggggccugcaugggcgggucugugggggggcu

SEQ ID NO: 346333 - RNA, 64 nt, Human
uucaaacaaucaaguugacucacguggguccugaggccugcagcacgucggaugcuaccccacu

SEQ ID NO: 346334 - RNA, 64 nt, Human
guugacagacaaagccaacaauacucuaaacugaggccugcaagucauuucauuuguauuuuug

SEQ ID NO: 346335 - RNA, 64 nt, Human
cuuguguugggccccagggaacuaaagggugugggucagggaggggucuagaggcuauuccuag

SEQ ID NO: 346336 - RNA, 64 nt, Human
ggaggcaugccaaauguuccauaugugggugucagucagggacaacaagauccuuaaugcagag

SEQ ID NO: 346337 - RNA, 64 nt, Human
auauuucuaguauuugaacaaagcagaagguuaagucagggaagagcagugcuguccaugaugu

SEQ ID NO: 346338 - RNA, 64 nt, Human
uuauaagauauuugcaauuuuuguaaauauuuuuggccugcaacugggaaggggauucagaguc

SEQ ID NO: 346339 - RNA, 64 nt, Human
agcuuuguccagggcagccuguuuuacccagaugggccugcaccuccagcuucuuucugaagca

SEQ ID NO: 346340 - RNA, 64 nt, Human
ggggaaguacuaccuggagauuucaaauucacuuggccugcaaacaacagaguuauccguaucu

SEQ ID NO: 346341 - RNA, 64 nt, Human
uacacagcaguguccccaucaugccucucaauggggccugcaagccugggaacuugggcaucgu

SEQ ID NO: 346342 - RNA, 64 nt, Human
gccaaguugguucaaacuguuggagaacagaguuggccugcaucuggaacacacuuguccucag

SEQ ID NO: 346343 - RNA, 64 nt, Human
gaccaaguagaggccuuggugcugguugggguggggccugcagagucuuaguuacugauuucau

SEQ ID NO: 346344 - RNA, 64 nt, Human
ugggagucugaggccugagugaguguuuggccgaggccugcauguccggcugaaggcugagugu

SEQ ID NO: 346345 - RNA, 64 nt, Human
uaguggaaguacugucuauguuauuagauugaguggccugcauucucuuccugggaggaaaucu

SEQ ID NO: 346346 - RNA, 64 nt, Human
ggguuuucucaaaguccauugccggcaaugggcaggccugcaaauacuggcacagagcauuaau

SEQ ID NO: 346347 - RNA, 64 nt, Human
ccuuccuguaccuuugacuaacgcucagcuuccgggccugcaugcaguagacagaagaggaaga

SEQ ID NO: 346348 - RNA, 64 nt, Human
ucccucacagccauuucuguucccagaggagccaggccugcagcuggcugcucaggagauggcc

SEQ ID NO: 346349 - RNA, 64 nt, Human
agugcccagggggccgagcacggucaugcuggccggccugcaugcaugcgugugccgggcuggg

SEQ ID NO: 346350 - RNA, 64 nt, Human
ugggcccaugcagacacacgccuguguccacccuggccugcaggaacaaggcaggccgccugug

SEQ ID NO: 346351 - RNA, 64 nt, Human
agacccugggugagaccccugugagcaugggaagggccugcagugggcgcgggagugagcugag

SEQ ID NO: 346352 - RNA, 64 nt, Human
ggugcagacccagcugccuuagacagauucccugggccugcaucuccuggcgccggcugcuucu

SEQ ID NO: 346353 - RNA, 64 nt, Human
cuuguugaaggagugaaauugagagaccaggaagggccugcaggcauuguggugagccugccug

SEQ ID NO: 346354 - RNA, 64 nt, Human
cucuagaucauuugagaggcacaguguuuccggagucagggacugcagcugagcgcaacugccc

SEQ ID NO: 346355 - RNA, 64 nt, Human
cugggaagaugagguucugagaccaguguaucaggucagggacuuggacaggagucagugucug

SEQ ID NO: 346356 - RNA, 64 nt, Human
gcaucuuaugacaaggggacagacaagcugggacgucagggaaaugaacaaaagggacgcaggu

SEQ ID NO: 346357 - RNA, 64 nt, Human
guuucauuuaugaucauguagagagccacuaggaggccugcaguuauuuuugaaugugaaaaug

SEQ ID NO: 346358 - RNA, 64 nt, Human
cucuguggucuccccuccucugaagacugccucuggccugcagcugaccuggcaaccauucagg

SEQ ID NO: 346359 - RNA, 64 nt, Human
ccaccacuucgaaaccugggauucaggaauguguggccugcacagugaagugcuggcaaccacu

SEQ ID NO: 346360 - RNA, 64 nt, Human
cccucccugaggcaggugagaacccagagagaggggccugcaggugagcaggcagggcugggcc

SEQ ID NO: 346361 - RNA, 64 nt, Human
ggcaugccaugucugagcggcgcagagcccuccaggccugcaggggcaaggggcuggcuggagu

SEQ ID NO: 346362 - RNA, 61 nt, Human
ucacuuccagcuaccuguaagggcagggcugggccugcauccgcuugcccugccuccaucc

SEQ ID NO: 346363 - RNA, 64 nt, Human
ggucagggaguguguccucagcuugucuggaggaggccugcaucccuccugagcucuuggaggu

SEQ ID NO: 346364 - RNA, 64 nt, Human
uggcucaggggcagcugcagggccagauggaguuggccugcagggagucagccuuaccccauca

SEQ ID NO: 346365 - RNA, 64 nt, Human
gcaggacaggcagucuugaauuuccucuaggggaggccugcaguuuuccccaccaaccccuuuu

SEQ ID NO: 346366 - RNA, 64 nt, Human
gagauaugucuugucagccucucuaguuccccuuggccugcauguacaaacuucuacccuagaa

SEQ ID NO: 346367 - RNA, 64 nt, Human
guacuuccugacuucucccauucaaaccauucuaggccugcaauggggaacaggcccuccccau

SEQ ID NO: 346368 - RNA, 64 nt, Human
uguugcuucucacagaagcugcgacucuagaccaggccugcagccagaacgccgauuccgggag

SEQ ID NO: 346369 - RNA, 64 nt, Human
gugcccaggggcagggccggcccgccagggagggggccugcauuggcugcaaggaugagcagag

SEQ ID NO: 346370 - RNA, 64 nt, Human
gacaggggacagugggacuaacuucaguacccuuggccugcacaguagcaaugcugggagcuag

SEQ ID NO: 346371 - RNA, 64 nt, Human
auccaauuacagaaagaauauaagcaaucucacaggccugcaaucggacacugucucugugugg

SEQ ID NO: 346372 - RNA, 64 nt, Human
aacgaaagagaucuuuuaggaacaguuuggggugggccugcaaauuuagaggcuauugcuaaga

SEQ ID NO: 346373 - RNA, 64 nt, Human
ggcuucacagaaugcucuggaacucuggggucuggucagggaguguguccucagcuugucugga

SEQ ID NO: 346374 - RNA, 64 nt, Human
gcauggcuuacugcuuuauuuauuuuuauuucuugucagggaguauucuccguuuuccuuucuc

SEQ ID NO: 346375 - RNA, 64 nt, Human
uugugugagcguggccuugggaggacaugcgugugucagggaugaguugaggugauauuuuuau

SEQ ID NO: 346376 - RNA, 64 nt, Human
ggaacacuuccugcagcugugccuggaggcagucggccugcagugccagacucugagccaagcc

SEQ ID NO: 346377 - RNA, 64 nt, Human
uccagggcuagggccacucaccggaggagggcggggccugcacuugaagucaggccgcaccugu

SEQ ID NO: 346378 - RNA, 64 nt, Human
ucacccauccauguguucaugaaucaaucaucacggccugcagagcaccuguccuaaggaggga

SEQ ID NO: 346379 - RNA, 64 nt, Human
ucugcaaaguggcagggaccggcagagcucuacaggccugcagccccuaagugcaaacacagca

SEQ ID NO: 346380 - RNA, 64 nt, Human
gaugggagagggugaggaaaucagcugaaugguuggccugcauauucuuuuuuaggccacaggc

SEQ ID NO: 346381 - RNA, 64 nt, Human
agggaggggcuggggguucccaggagccaugcguggccugcagaguccauuccaucaugaugcu

SEQ ID NO: 346382 - RNA, 64 nt, Human
cugacugcaccucaggguugggcucagggcuugcggccugcaggcacuccagccagcgcucacc

SEQ ID NO: 346383 - RNA, 64 nt, Human
gugagguccaccggccccuggcagcacagcccagggccugcaugggggcaccgggcuccaugcc

SEQ ID NO: 346384 - RNA, 64 nt, Human
auauugauaucuaauuaauuauuuaaguggaagaggccugcaucacaauugagguaauguagag

SEQ ID NO: 346385 - RNA, 64 nt, Human
gcaugcccacaguuuauuucuuuguucuucacuaggccugcauaauacaguccuauguagacau

SEQ ID NO: 346386 - RNA, 64 nt, Human
accagaggcuuggucccacaggccacggaccaauggccugcagccgugacaacacuccugucau

SEQ ID NO: 346387 - RNA, 64 nt, Human
gugugcucccugcccucgucacugcccaagcccgggccugcacauacucacuggacuguuccag

SEQ ID NO: 346388 - RNA, 64 nt, Human
acaccuuuagaaauaaaaauacugggaucaaacuggccugcaaaaccauagucaguuaauucuu

SEQ ID NO: 346389 - RNA, 64 nt, Human
acaacccuuuaugugauuccugagagcaguaugaggccugcaagaaagugaucauauaauugua

SEQ ID NO: 346390 - RNA, 64 nt, Human
ugugaguggggcccacaucguggagcugugguggggccugcagucaugaauggcaagugguccc

SEQ ID NO: 346391 - RNA, 64 nt, Human
ugucuugcgcucugggaagucagaugucauuucaggccugcagucucauccugcccuugccauc

SEQ ID NO: 346392 - RNA, 64 nt, Human
gcggcgcgacgacaggagguaugaccuggguggggucagggaaagucuuagcugagaacuaaga

SEQ ID NO: 346393 - RNA, 64 nt, Human
agucaugcgaauggagggugcucuuguguagcuggucagggacuuuuuuuucuuuucuccugaa

SEQ ID NO: 346394 - RNA, 64 nt, Human
gggaugucacuuaacauuuuuuuuuugagcuaaagucagggaaucaagccaugcuuaauauuua

SEQ ID NO: 346395 - RNA, 64 nt, Human
cgccaaggaauguacguugagaaucacugcuccaggccugcauuacuccuucagcucuggggca

SEQ ID NO: 346396 - RNA, 64 nt, Human
ggggguccaaugcaaggaggcagggaagaaagggggccugcaaaggaagcaguagagugacuua

SEQ ID NO: 346397 - RNA, 64 nt, Human
uguaauaauuaugaauucauuacagaguccagguggccugcaguugaagaucaucaaccauuuu

SEQ ID NO: 346398 - RNA, 64 nt, Human
auaaacacagagguuuuaaacagucccuaccauuggccugcaucaugacaaaguuacaaauuca

SEQ ID NO: 346399 - RNA, 64 nt, Human
agaggguuguccacuccucacauuccacgacccaggccugcaccccacccccaacucccagccc

SEQ ID NO: 346400 - RNA, 64 nt, Human
uaaaucaucuauccaguuucuacauuuugcaugaggccugcagguggccuauuuugacucagac

SEQ ID NO: 346401 - RNA, 64 nt, Human
acaggcuacccugugccagggagggggcagaaugggccugcagcuuccugcagaggaagcagga

SEQ ID NO: 346402 - RNA, 64 nt, Human
cuggaccgcagaguuuauuuuuguauuucuacugggccugcacacuccagcccaaagggucugu

SEQ ID NO: 346403 - RNA, 64 nt, Human
cuggcucuggggccugucauugguauuuggccaaggccugcaucgggaauaaaguccagagaau

SEQ ID NO: 346404 - RNA, 64 nt, Human
ggcccccaggaggucuggcagagcugagagccauggccugcaggggcuccauaugucccuacgc

SEQ ID NO: 346405 - RNA, 64 nt, Human
gggcucuucuggaaggggaggaagcgggaggcagggccugcaccugauguggagguacagggca

SEQ ID NO: 346406 - RNA, 64 nt, Human
uaaacucuggaauccacuaugguuuaccuugaguggccugcacgaacaugacagcccugaucug

SEQ ID NO: 346407 - RNA, 64 nt, Human
aaccgucgaguaggcaugauacugguauggagugggccugcaaaaucagacagaaauggcuuga

SEQ ID NO: 346408 - RNA, 64 nt, Human
acaucaaaccacgucugugaggaccccagggaccggccugcaccuaccucagacccucauccuu

SEQ ID NO: 346409 - RNA, 64 nt, Human
cugccaggagcugagggcaccacccagcaaccugggccugcauuccauccgcucugcagcccca

SEQ ID NO: 346410 - RNA, 64 nt, Human
ccugucuguagagggcccugguguuucuagcacuggccugcacggugggccuugcuggggacgg

SEQ ID NO: 346411 - RNA, 64 nt, Human
ccuuuggcuuugcauccuggacggggaguguccugucagggaccagauguguccugccucaucc

SEQ ID NO: 346412 - RNA, 64 nt, Human
uuaaacaaagcugcuuagcaccuggaauucccuggucagggagauggagucaguggggcauugc

SEQ ID NO: 346413 - RNA, 64 nt, Human
ggcccucacaaguaccaaagccagcaccaaaggagucagggaagggguuggcugagucaaggga

SEQ ID NO: 346414 - RNA, 64 nt, Human
ccggcagcaggccggggcggagcaggagcgggcgggccugcagggacgccccugccuagcagcc

SEQ ID NO: 346415 - RNA, 64 nt, Human
cggucucuccuucccuuucuccuguccucguccuggccugcagcucuucccagccccgagagag

SEQ ID NO: 346416 - RNA, 64 nt, Human
aaagaagcuucuggacucugaacaagaauucgguggccugcagagcuugccauuugcacuuuuc

SEQ ID NO: 346417 - RNA, 64 nt, Human
auuucuuauuugugcucugugacugccaagguguggccugcacuggguuguccagggagaccua

SEQ ID NO: 346418 - RNA, 64 nt, Human
cuguuccuuuuuuaucaggaggacuucagagccaggccugcagcauuuuguuugaaaacacaau

SEQ ID NO: 346419 - RNA, 64 nt, Human
gacccaccugcccacgccgacuugggaggaugguggccugcagcggccaagaagccaaaaaaaa

SEQ ID NO: 346420 - RNA, 64 nt, Human
cuccaguuugcuccagguggcaguacaagcuggcggccugcagcgugagcugugggagaggggu

SEQ ID NO: 346421 - RNA, 64 nt, Human
agugccaggggcugccucgcccggaaccccaggaggccugcagccuggagcccugcccaccuag

SEQ ID NO: 346422 - RNA, 64 nt, Human
gcaggggccgcgcuugggcgcuugggagggugucggccugcagccaaguucacugucacggggg

SEQ ID NO: 346423 - RNA, 64 nt, Human
acucgagagggcugagccccuccucuccucguccggccugcagcccagaacgggccuccccggg

SEQ ID NO: 346424 - RNA, 64 nt, Human
cucuguuggcuuagcccugagauggugacaggcuggccugcagucagcaucauugugcauguga

SEQ ID NO: 346425 - RNA, 64 nt, Human
gggucuugagauaaccuuugaagcuuauuguacuggccugcaccagaagaugucugcauuacuc

SEQ ID NO: 346426 - RNA, 64 nt, Human
acccaucaggacagugagcucugcugccagucaaggccugcauaugcagaaugacgaugccugc

SEQ ID NO: 346427 - RNA, 64 nt, Human
uauggagugaauauuucaaaacguugggaauaagggccugcaaaaggcagcgaggaggcaccuc

SEQ ID NO: 346428 - RNA, 64 nt, Human
gacccuacccccucuagauucccugauuuccccaggccugcagcauacaguaagaugggucccu

SEQ ID NO: 346429 - RNA, 64 nt, Human
aggcuccgugugacuuccguccagggagcaugugggccugcaacuuucuccauucccagcuggg

SEQ ID NO: 346430 - RNA, 64 nt, Human
ugagaugcccaggaggaggagcccuagggaagaagucagggacagggaccaggauaccacucug

SEQ ID NO: 346431 - RNA, 64 nt, Human
gggauaaaugugacaacugugcauugaacccugggucagggacguuccaauggccaagagagug

SEQ ID NO: 346432 - RNA, 64 nt, Human
gauugccagaaauugcaagauguaauauaucaaagucagggaugaggagcaggaggacuauuca

SEQ ID NO: 346433 - RNA, 64 nt, Human
ugguaguacagcaagaggcacuggcggggcagcaggccugcaggagcuguuuuuccauugcuag

SEQ ID NO: 346434 - RNA, 64 nt, Human
uugucuccaaaaaucaccaccuuuaauacuccccggccugcacacacccacagucucacugggc

SEQ ID NO: 346435 - RNA, 64 nt, Human
aaaucuacugagccacggaccgcauccuccagggggccugcaggccccagccaagugccuuccg

SEQ ID NO: 346436 - RNA, 64 nt, Human
agguucuccugccucuccucggccaggaggcugaggccugcacugcagaugauccugcggacca

SEQ ID NO: 346437 - RNA, 64 nt, Human
cuuuucucgcugaaagcacuaagaggugggaggaggccugcacaggcuggaggaggguuugggc

SEQ ID NO: 346438 - RNA, 64 nt, Human
acuuggcugcaagucgccugccauggggcgaggaggccugcaccccaguauaagggccucccca

SEQ ID NO: 346439 - RNA, 64 nt, Human
ucuccccugggccgccgggagccccguggagcgcggccugcacgggaguuguguccacaaaggc

SEQ ID NO: 346440 - RNA, 64 nt, Human
ccgcggucggauucuggagggugggaggcaucuuggccugcaguaagcggugcugacggggacu

SEQ ID NO: 346441 - RNA, 64 nt, Human
uccaucccuaacacauuuauuucauuuuauuuggggccugcaauuucugcaugucucauauauu

SEQ ID NO: 346442 - RNA, 64 nt, Human
cgcugcccugggcuggcaacaccauucuggccuuggccugcagaagcuuucagagucuucacug

SEQ ID NO: 346443 - RNA, 64 nt, Human
caucuuagcuaauucuguuuaaaacucugucagaggccugcaggcugugaguuauauuuauaaa

SEQ ID NO: 346444 - RNA, 64 nt, Human
gcauuucuacauguuuuagacagagacaauuuaaggccugcacucuuauuucacuaaagaaaaa

SEQ ID NO: 346445 - RNA, 64 nt, Human
ccagagcguggggcccgcugggcaccuggcaccuggccugcagaugcugcuacgagugaccagu

SEQ ID NO: 346446 - RNA, 64 nt, Human
ucuuugggauugcuaugaaugauacccugaauuuggccugcacuaauuugauguuuacaggugg

SEQ ID NO: 346447 - RNA, 64 nt, Human
uucuucaaucauugagugaaaaaccuuuaacuuuggccugcaauagucauuugauuauuuuuuc

SEQ ID NO: 346448 - RNA, 64 nt, Human
ggcucuggaaugcccaagggaagaggcaagguggggccugcagccuggacucggcacucacagc

SEQ ID NO: 346449 - RNA, 64 nt, Human
cugacaaauggcuguggggauggugggguggauggucagggagggaugcucagggagggauaug

SEQ ID NO: 346450 - RNA, 64 nt, Human
agagcggaugaggauacagaaggcuggaggaaacgucagggaugggcguguuuugggcgugcua

SEQ ID NO: 346451 - RNA, 64 nt, Human
uucugaagccauugucuccuugaguaccaacagggucagggaagacugggccuccugaauuuau

SEQ ID NO: 346452 - RNA, 64 nt, Human
aaggaaagaggguauguuuuucacaauucaugggggccugcauggcaggaguggggacaggaca

SEQ ID NO: 346453 - RNA, 64 nt, Human
aggagcccuccagcccccugcccacagaagggaaggccugcagagggggccaggaucuaccuaa

SEQ ID NO: 346454 - RNA, 64 nt, Human
ggaguauccugaguugcccuugcucuucuggccuggccugcacagggcccagggagagauuugu

SEQ ID NO: 346455 - RNA, 64 nt, Human
uugcaccuuucuguuuuccugcagucagggugguggccugcagggaccugagcuuugcuaccca

SEQ ID NO: 346456 - RNA, 64 nt, Human
caggaggggggagcugaaaggaaucugaugcucaggccugcacaaagcaaccgccaaauuguuu

SEQ ID NO: 346457 - RNA, 64 nt, Human
gaauaaaugaggaagggccugaaagugacacacaggccugcaugucacugugucgguguguuuc

SEQ ID NO: 346458 - RNA, 64 nt, Human
cugagcguccuggagcuuggggaugcagccagcuggccugcacuggguguggagagaacaccua

SEQ ID NO: 346459 - RNA, 64 nt, Human
uggccaacuaaagcaagucuuccuuccacccuguggccugcacuugagccacaaagugugugug

SEQ ID NO: 346460 - RNA, 64 nt, Human
gcuggccggcccccuggggugccccugccgagguggccugcagugcuguacauguuuacagaag

SEQ ID NO: 346461 - RNA, 64 nt, Human
gguggguggggaagaaaugggcccagccccacauggccugcagacagugcucuguaaauaguug

SEQ ID NO: 346462 - RNA, 64 nt, Human
ccagcccuguagcugugugucuugggccaccaguggccugcaggacgaagguacuguuccauca

SEQ ID NO: 346463 - RNA, 64 nt, Human
gccggcagcccuuggggaccacaggccugaccagggccugcacagguuaaccgucagacuuccg

SEQ ID NO: 346464 - RNA, 64 nt, Human
ccuuuuucucugagugccuuuuucuccuuaaggaggccugcagagaaaggggcuuugggcucug

SEQ ID NO: 346465 - RNA, 64 nt, Human
gcacuggccuggacuccuccucugcccuccucgaggccugcacagcuguggccguggagcugac

SEQ ID NO: 346466 - RNA, 64 nt, Human
aagaaagcagggcaagugcugugcugcccauuugggccugcauagugccaugauuggaacccag

SEQ ID NO: 346467 - RNA, 64 nt, Human
agagcagaauugaguaguugugauagagaccuauggccugcaaagccuaauuaauauguagccc

SEQ ID NO: 346468 - RNA, 64 nt, Human
cuucauccuagcugcuggggaagcggggagaggggucagggaggcuaaugguugcuuugcugaa

SEQ ID NO: 346469 - RNA, 64 nt, Human
gggguggcauugguucccccgaagagacacugcagucagggacugaguucuuccugagggcagu

SEQ ID NO: 346470 - RNA, 61 nt, Human
uggccgaggaggacuacugaggggcuggccagucagggagggcuagggggcagguggggag

SEQ ID NO: 346471 - RNA, 64 nt, Human
uccuuugugcuuaguuaggaaggcaguaggauguggccugcauguacuguauauuacagauauu

SEQ ID NO: 346472 - RNA, 64 nt, Human
cugccuccuaggaggacauuuaggggagggcagaggccugcaguuuggcuucacggcuggcuau

SEQ ID NO: 346473 - RNA, 63 nt, Human
gaaugcucacggaggucugacccaugcaggcagggccugcaggaggggagcacugagcuaaca

SEQ ID NO: 346474 - RNA, 64 nt, Human
agugcuaggaugauuggcaugagccaccucgucuggccugcaggucuuuuuaagcauuugcugu

SEQ ID NO: 346475 - RNA, 64 nt, Human
cagaugcugugucaaccagggcccuagggcuaagggccugcaccuugcgugcaugcagcaggca

SEQ ID NO: 346476 - RNA, 64 nt, Human
gccuggaggagcugugcugccggaaaaagccgggggccugcaucaccaccucagagcuguucag

SEQ ID NO: 346477 - RNA, 64 nt, Human
cuguuccccagagaaaggggagcccacuguccugggccugcagaauuuggguucugccugccag

SEQ ID NO: 346478 - RNA, 64 nt, Human
agugcugggauuacgggugugagccaccgugcccggccugcaaacacauuuuaauugacaacac

SEQ ID NO: 346479 - RNA, 64 nt, Human
agaucuugcauuucugcucucuuaugucacagcuggccugcagcaggucccugugagcacauaa

SEQ ID NO: 346480 - RNA, 64 nt, Human
cacgugcauauuuuugccuucauucuuaccaccuggccugcaaaguuugcaggagggccaggua

SEQ ID NO: 346481 - RNA, 64 nt, Human
uagccccuugaccuucccaucaccuccucaucagggccugcauuuauggagugcuugcuaugug

SEQ ID NO: 346482 - RNA, 64 nt, Human
uccacaguucagaucccuuuccagauugcaaccuggccugcaucccagcuccuuccugcucgug

SEQ ID NO: 346483 - RNA, 64 nt, Human
uaaagagaaaauccggaggaccaggggcuacucuggccugcagcgucuguccuuccagguuccu

SEQ ID NO: 346484 - RNA, 64 nt, Human
caucugugggaccaauuugguguaagcaaccuguggccugcacuuguggccucgaaggaagcac

SEQ ID NO: 346485 - RNA, 64 nt, Human
gcccacggaggcccccagcugcccuccgagcccaggccugcagcacugaaagacgaccugccau

SEQ ID NO: 346486 - RNA, 64 nt, Human
ugguaauacccauaucaccucugcucugaggcugggccugcagcuguguagucuuuggaagagg

SEQ ID NO: 346487 - RNA, 64 nt, Human
uaguucauccuccucacauaacuuauuugaaguugucagggaaugucauuacacucugauuuuu

SEQ ID NO: 346488 - RNA, 64 nt, Human
ccuaccaccuccccagccuuugaucagguggggagucagggaccccugcccuugucccacucaa

SEQ ID NO: 346489 - RNA, 64 nt, Human
acagacuuuuaagauguaaccagcacaaagcaaugucagggaggagugauacaugacaauaaau

SEQ ID NO: 346490 - RNA, 64 nt, Human
cagugaguggcucuugugccugcuguagacauuaggccugcacuagggccaugugcugucaaga

SEQ ID NO: 346491 - RNA, 64 nt, Human
cacuggaagccggguuuccggaagcucgcagcuuggccugcaccacacgcccuccccuuuuggc

SEQ ID NO: 346492 - RNA, 64 nt, Human
ugggcccuaaggcugccuuaguggaggugcgcguggccugcaccucaccaagccuagccacucu

SEQ ID NO: 346493 - RNA, 64 nt, Human
aagcaauaacaauugauugaccacaugaaaguguggccugcacuauauucucaauuuuaauauu

SEQ ID NO: 346494 - RNA, 64 nt, Human
gagcugccuaccugcugcuccacgaggaagcucaggccugcacaggcuccaccaggccuuggau

SEQ ID NO: 346495 - RNA, 64 nt, Human
cuacccagugucgauauccacaacccagcccccaggccugcacuuuggagauuucuggauccuu

SEQ ID NO: 346496 - RNA, 64 nt, Human
aagcuaggccccagaggcccuggaggucuccaggggccugcagaaggaaagaagggggcccugc

SEQ ID NO: 346497 - RNA, 64 nt, Human
aggaauggacagacagaggaugagcucuacccagggccugcaggaccugccuguagcccacucu

SEQ ID NO: 346498 - RNA, 64 nt, Human
augggcugaggguaccuuuuuggggagaugggguggccugcagugacacagaaaggaagaaacu

SEQ ID NO: 346499 - RNA, 64 nt, Human
ccucuccuaaaagccaugggcagcaguuuccgagggccugcaugauccaccugcugcacgaucc

SEQ ID NO: 346500 - RNA, 64 nt, Human
agugcugcaggggucugggguuggcaacuccugaggccugcaugggugacuucacauuuuccua

SEQ ID NO: 346501 - RNA, 59 nt, Human
ggaaggcucggaagcugugaugggaaggaggccugcacuuggaccugaccucaagccuc

SEQ ID NO: 346502 - RNA, 64 nt, Human
gcuuucugugauggcuuugcaguaagugccgccuggccugcaugcauuggcuaacaggcugcag

SEQ ID NO: 346503 - RNA, 64 nt, Human
auauggcuccaucuucacgggcgcccaggacccuggccugcagagacgcccccgccacaggauc

SEQ ID NO: 346504 - RNA, 64 nt, Human
agccuguauuauuuaaaaugcauuuuuauugaaaggccugcauuaaacugaaugguuucacagg

SEQ ID NO: 346505 - RNA, 64 nt, Human
uuuguguuggauggucagcaacacauggggauccggccugcaggaccuaugaguggaaugggca

SEQ ID NO: 346506 - RNA, 64 nt, Human
agaccuacuuuguccucuacauaggguagcuucugucagggaaucuugguucuucccaagaaac

SEQ ID NO: 346507 - RNA, 64 nt, Human
ggucuugauuagguuucagucaacucuggaucaugucagggacugauaauuucauuuguggauu

SEQ ID NO: 346508 - RNA, 64 nt, Human
uauuccuuguucccugguggggucugugguaagggucagggaagggcauauaggcaccagagcu

SEQ ID NO: 346509 - RNA, 64 nt, Human
gaaucucagaagguccuccugaaccguccgcgcaggccugcagugggccugccuccuccuugcu

SEQ ID NO: 346510 - RNA, 64 nt, Human
ccuguucucauucucacaaagcugccuugacuguggccugcaaccacgagugccaugcuuucag

SEQ ID NO: 346511 - RNA, 64 nt, Human
cucuggggaguggccggaaagcucccgggccucuggccugcagggcagcccaagucaugacuca

SEQ ID NO: 346512 - RNA, 61 nt, Human
aggaagcaacccagcagugaucagagaggauggccugcagccacaugggaggaaggcccag

SEQ ID NO: 346513 - RNA, 64 nt, Human
ggacacaguugcucguggccacucaguggagcugggccugcagcagacucaaggcuccgagugc

SEQ ID NO: 346514 - RNA, 64 nt, Human
gccccauggcccguuccugggagaugagggccguggccugcaugaacuaccagaugaguaaggg

SEQ ID NO: 346515 - RNA, 64 nt, Human
ccagugugaaaaacagacucacaaggggcuucuuggccugcagcuucauuugcgagagcgccga

SEQ ID NO: 346516 - RNA, 64 nt, Human
ccaggaugugucgcaccagcagcucugccugguuggccugcagugccguggucugcgugcucug

SEQ ID NO: 346517 - RNA, 64 nt, Human
gcugugagcacaccacuguccccucauccaccucggccugcauggggcacccacuuccuucugg

SEQ ID NO: 346518 - RNA, 64 nt, Human
aguccgggccaggacagccucaggggagagugaaggccugcaggagggcaggcgagacaaggag

SEQ ID NO: 346519 - RNA, 64 nt, Human
ugacaaguaccgccugucucaggaugaccgcgauggccugcagcaacucuaugguagggggaga

SEQ ID NO: 346520 - RNA, 64 nt, Human
gcaacagugcggucccugcccggagaacucaggaggccugcagaagagaacugauugguggucg

SEQ ID NO: 346521 - RNA, 64 nt, Human
agacugacccaaagugaaggacauugccgggagaggccugcagcaucccuggauuucagaguuc

SEQ ID NO: 346522 - RNA, 64 nt, Human
gcuguuaauugugaugaauaaacguucaacccucggccugcagccagaguagccaggccgcgca

SEQ ID NO: 346523 - RNA, 64 nt, Human
uggccuccuccuucaggccucaaugccugggggaggccugcacuguccugauuggccgggacac

SEQ ID NO: 346524 - RNA, 64 nt, Human
ggacuaacuugucuuuggacccugaggcccagagggccugcaagggagugaguugauagcacag

SEQ ID NO: 346525 - RNA, 64 nt, Human
caauguuuagcaaucaaauuuacauguauagaucgucagggaauagcccaaauguuuuaaacgc

SEQ ID NO: 346526 - RNA, 64 nt, Human
gggguagguggucggggaugggagaaagggaaaagucagggaaggggagaagaaagaaaaacac

SEQ ID NO: 346527 - RNA, 64 nt, Human
aaagcagaacuuacagggccugcaggaagcuggugucagggagagaaacccaaccccacuguca

SEQ ID NO: 346528 - RNA, 64 nt, Human
ccacugccuaaaugaugcccggccagcaggaccuggccugcagaucccagugagucaugagccu

SEQ ID NO: 346529 - RNA, 64 nt, Human
ccaggucuggguggggcccaggcccggaugcagaggccugcagggccucugucaauuguacgcg

SEQ ID NO: 346530 - RNA, 64 nt, Human
cuggcgccacagaggagccccacgugcacuccccggccugcauccggcuuggguacacaggccc

SEQ ID NO: 346531 - RNA, 64 nt, Human
uguugcuccauaacucuaaccagcacagggcugaggccugcagugcacaccugcagggaggccc

SEQ ID NO: 346532 - RNA, 64 nt, Human
ccugcgccaccuacccgggguccuccacagcggaggccugcaggaaugucccuucccaccacac

SEQ ID NO: 346533 - RNA, 64 nt, Human
ggcccuggcuuuccagggagugcagcaagcagccggccugcaggugagcauggaggcccggccc

SEQ ID NO: 346534 - RNA, 64 nt, Human
ggacagcugcacucagggauacgcccaacaccauggccugcaaccccagggucaagggugaagg

SEQ ID NO: 346535 - RNA, 64 nt, Human
cgcccacccagacaccgcccacuucccggcccggggccugcacaaucuccgaccgcaucacugu

SEQ ID NO: 346536 - RNA, 64 nt, Human
gacccaccgaaugcaguuucugcuugacugacugggccugcagcucccuucuccugggacuuag

SEQ ID NO: 346537 - RNA, 64 nt, Human
auuguucuuguggacuuuuccucagggauacauuggccugcaggucccaguucacauguagucc

SEQ ID NO: 346538 - RNA, 64 nt, Human
gccuaaacacagcugccuccaaggaccgcugccuggccugcauugaggaacccuuuuucucccc

SEQ ID NO: 346539 - RNA, 64 nt, Human
cacgcccugggugcccacauggccugccaacuagggccugcaaauggagugggggaguccuggc

SEQ ID NO: 346540 - RNA, 64 nt, Human
ccucggagcacccccuuccuggugacugagccagggccugcauuuuugguuuuccccaccccac

SEQ ID NO: 346541 - RNA, 64 nt, Human
gggaggguuccuuuuccuguuguugaaugguccuggccugcaggaugggaggccagaugccuuc

SEQ ID NO: 346542 - RNA, 64 nt, Human
uuucggggcucaggagggugggcacacacccagcggccugcagaguaagcuuauuacccacaac

SEQ ID NO: 346543 - RNA, 64 nt, Human
cgcaucucuuucucauauacauggacucucuguuggccugcaaacacauuuacuucuccucuua

SEQ ID NO: 346544 - RNA, 64 nt, Human
ccugcaaauuccgagaaaugugaaacuugguggggucagggaggaaaggcagaagcugggagcc

SEQ ID NO: 346545 - RNA, 64 nt, Human
gggggcugaggagguagugcuguaggcccagggggucagggaaagggaggggggcaugugaggg

SEQ ID NO: 346546 - RNA, 64 nt, Human
ggguguuuuugcggggcugcaauaggggccaaaagucagggaaaggggcacugaccuguaguga

SEQ ID NO: 346547 - RNA, 64 nt, Human
gccagcaacuccacuaagguggauuuucaucaggggccugcagggcccucccuuuucccauugu

SEQ ID NO: 346548 - RNA, 64 nt, Human
ggcuucaguuuuacucugcugcaaaaugaaggcgggccugcaagccgacuacaccuacggaggc

SEQ ID NO: 346549 - RNA, 64 nt, Human
cugggguagggugauggcagugcuccgggaacugggccugcagccuuccucuucugggacugcu

SEQ ID NO: 346550 - RNA, 64 nt, Human
uaaguuguauguccuacauuucaucauugucccgggccugcauugcacuggaaaaaaaaaucgc

SEQ ID NO: 346551 - RNA, 64 nt, Human
ggaccguguugcuccaguauuaaccucuguggguggccugcacucuaccaagaaacacaggaag

SEQ ID NO: 346552 - RNA, 64 nt, Human
ugggcuuugucaugucucugguggugcuggggcuggccugcaggcugcagucccuggaaaaaca

SEQ ID NO: 346553 - RNA, 64 nt, Human
cuaaugauuaucuguaagccuuuguggggagggaggccugcaaggucaugaaaggcagaagagu

SEQ ID NO: 346554 - RNA, 59 nt, Human
agacgcacagcagcaagugacccuucuccggccugcagccucccccaggguggaagccg

SEQ ID NO: 346555 - RNA, 64 nt, Human
gccacggcuggaagcagaggccuucguaggugauggccugcauguuguaacuaccccgucccgc

SEQ ID NO: 346556 - RNA, 64 nt, Human
uccugacaguggccagggaccccugggucccccaggccugcagauguuucuaugaggggcagag

SEQ ID NO: 346557 - RNA, 64 nt, Human
ggucuagaaccacagcaagaagaggaggcaugcuggccugcaccggaagacucacuuugucugc

SEQ ID NO: 346558 - RNA, 64 nt, Human
gcggcugcuaguuguggcccuuccuggaaggagaggccugcagggcucgacccuguggguuucu

SEQ ID NO: 346559 - RNA, 64 nt, Human
gcccuuauccccacugaccaggcgggagccgccaggccugcagcugggccagugcccaggagcc

SEQ ID NO: 346560 - RNA, 64 nt, Human
uucacagcccucgccaggggucugccccaauccuggccugcaucagggcaggacggggucucag

SEQ ID NO: 346561 - RNA, 64 nt, Human
cugccccuccccgucccugucccccagcaucgggggccugcaaaucuagugccgaaugacuaug

SEQ ID NO: 346562 - RNA, 64 nt, Human
accucucccugcauccugaggccaguggcccccgggccugcacagauaccucaucauccacccg

SEQ ID NO: 346563 - RNA, 64 nt, Human
uuagagauguuaaaacugcaguagaaugaaaugagucagggagcuucaguuagaaaauaaaguu

SEQ ID NO: 346564 - RNA, 64 nt, Human
aacgcccucucuuuucuaucccuuuaccuuugaggucagggacagggcauauuacugacacccc

SEQ ID NO: 346565 - RNA, 64 nt, Human
gagagagacagagagagagaauggauccucauaggucagggagugggggagggggcaaaugagc

SEQ ID NO: 346566 - RNA, 64 nt, Human
uagucuacaguacugacagaaagcaaggacaugcggccugcauggugggagcugguugaauugu

SEQ ID NO: 346567 - RNA, 64 nt, Human
cagggaggagcagaagccaucaagauggucaaagggccugcagagggagauguggcccuuccuc

SEQ ID NO: 346568 - RNA, 64 nt, Human
auuugcuuugucccggggcuccacugaacaaguuggccugcacugguguuuuguuguggggagg

SEQ ID NO: 346569 - RNA, 64 nt, Human
cacacacacacauccaccccagggccaagagaaaggccugcacacaagcccacagcacagcucc

SEQ ID NO: 346570 - RNA, 64 nt, Human
ggcacuggccacuccuacauccccagcuccacacggccugcacaccuguguuuccauggaaaug

SEQ ID NO: 346571 - RNA, 54 nt, Human
uggagcgccugcagccguaacccuggccugcaggcgggagcgcucccugccgga

SEQ ID NO: 346572 - RNA, 64 nt, Human
uguauauagcaucuccccccuccuagugagcaggggccugcaaggcaucacucccagccccucg

SEQ ID NO: 346573 - RNA, 64 nt, Human
gguaugucucuguauggcagcaaauguggcccauggccugcagcaaaacguccuauauguagau

SEQ ID NO: 346574 - RNA, 64 nt, Human
aaggcugggccugacgguuaugauuucagcccugggccugcaggagaggcugagaccagcccac

SEQ ID NO: 346575 - RNA, 64 nt, Human
acucucaucaggccaaguggaggacuggccagagggccugcacaugcaaacuccagucccugcc

SEQ ID NO: 346576 - RNA, 64 nt, Human
cccugagaugggggcucagagggggaaggccuguggccugcaugcuucccgauggcccacggca

SEQ ID NO: 346577 - RNA, 64 nt, Human
cucagcacugaugggaggcuggugcccaagcuguggccugcagucugugaggagggcugucuug

SEQ ID NO: 346578 - RNA, 64 nt, Human
aucuggggcccgcuuugccacgaagagcugggcaggccugcaggguguggggaaggaggacaca

SEQ ID NO: 346579 - RNA, 64 nt, Human
acacaccaucccauuuuacagacaaggacgcugaggccugcagcagcagugugacuugcucaag

SEQ ID NO: 346580 - RNA, 64 nt, Human
agagggaccuccacugguucccacucagaguggaggccugcagccuaccugaccaucucuuuag

SEQ ID NO: 346581 - RNA, 60 nt, Human
acccuggggcuguguacugagcacccaucuggccugcacccuugacaaaggaccccagga

SEQ ID NO: 346582 - RNA, 64 nt, Human
ugugcccuuaaagcccuuucaguagaugaggguugucagggaggagaaaugaagaagcuauguu

SEQ ID NO: 346583 - RNA, 64 nt, Human
ucucuuauuagagaaaucuugugacucagaugaagucagggauagaagacccuuggaccuggca

SEQ ID NO: 346584 - RNA, 64 nt, Human
uuaaaaacuuuuuuuucaauugacaagacuuuaagucagggauaacaguauuaauguucucugu

SEQ ID NO: 346585 - RNA, 64 nt, Human
ggcacccccaggacagcacacggugagggugcggggccugcaggccagucccacggcucugugc

SEQ ID NO: 346586 - RNA, 64 nt, Human
ugagcaguggguugcaggaggaggagcugggcagggccugcaccagggaggaguggaggacgag

SEQ ID NO: 346587 - RNA, 64 nt, Human
aggagcauuucuccugaucaggugcauucagggaggccugcaacuccauccuaaggugacauuu

SEQ ID NO: 346588 - RNA, 64 nt, Human
ucugugagaacggaacucggguuauuucagccccggccugcagaguggaagcgcccagcggccu

SEQ ID NO: 346589 - RNA, 64 nt, Human
caaacucagagcccggaagccaagaaggguccuuggccugcacggucuguaguugacuccaagu

SEQ ID NO: 346590 - RNA, 64 nt, Human
uucaguucuuuguuuaugauuccacuuaacaaaaggccugcagaagugauuuauuauuugggua

SEQ ID NO: 346591 - RNA, 64 nt, Human
cagcagagcucaguccccacuuccugcaaacaauggccugcacccuaucccuugugugugugac

SEQ ID NO: 346592 - RNA, 64 nt, Human
aagcgcuggcccggaacagccccugcaacuguggggccugcacacagcccuuccacaguuggca

SEQ ID NO: 346593 - RNA, 64 nt, Human
uuuuuagaggucagacuuccuaaucaaaggccugggccugcaguccuuucaucuuaaugcaacu

SEQ ID NO: 346594 - RNA, 64 nt, Human
ccaaauacgaugcuauuuucagaguccccuccuaggccugcagacaugagggagugaaugauug

SEQ ID NO: 346595 - RNA, 64 nt, Human
gaaacaccgucugagcccaagguacacauugggcggccugcaggaaccugcuccagguggacac

SEQ ID NO: 346596 - RNA, 64 nt, Human
gggcuccuuggucccccacaaccugccccggccaggccugcagacccagacuccagccagaccu

SEQ ID NO: 346597 - RNA, 64 nt, Human
ggccaugccuugguggggccugugucgggcguggggccugcaggugggcgccccgaccacgacu

SEQ ID NO: 346598 - RNA, 64 nt, Human
ggagcugcagaagcagcuucugaggggcuucccaggccugcauuucacagauggggagcucagc

SEQ ID NO: 346599 - RNA, 64 nt, Human
gagacacccgguuaccuuggccgugaggacacguggccugcacccagguguggcugucaggaca

SEQ ID NO: 346600 - RNA, 50 nt, Human
gaguagaaccccugggcugaggccugcagugacccacccaccuaccuuug

SEQ ID NO: 346601 - RNA, 53 nt, Human
gacuucuccgugucccuuaaagcgucagggaagaacaaacacuucaaggugca

SEQ ID NO: 346602 - RNA, 64 nt, Human
ucaccacuaugcaggagagggagguggucauagagucagggaucuauggcccuuggcccagccc

SEQ ID NO: 346603 - RNA, 64 nt, Human
ccagggcgguuccaaacucuaaaccguucccaccgucagggagaccuacaguuucgggggacca

SEQ ID NO: 346604 - RNA, 64 nt, Human
accagcccugccaccaccuugacccuggacuucuggccugcagaacugugagacaauaaacucu

SEQ ID NO: 346605 - RNA, 55 nt, Human
ggucugccuuccacagcugacccccggccugcagaacaucuguccccaagccagc

SEQ ID NO: 346606 - RNA, 64 nt, Human
cuuuggaaauccucuaggaggcuccuccucgcauggccugcagucuggcagcagccccgaguug

SEQ ID NO: 346607 - RNA, 64 nt, Human
auggacgcccacuguggggccccagcagcacuguggccugcaggagggcauggccccagguagg

SEQ ID NO: 346608 - RNA, 64 nt, Human
gcgcaggguggguggggcugccagccaggacccuggccugcagccugauccaaaccaaagacug

SEQ ID NO: 346609 - RNA, 64 nt, Human
gcagcuaggaaugaugugaggugacgggcggggcggccugcaucccagggccccuccaauccca

SEQ ID NO: 346610 - RNA, 64 nt, Human
cugucuccgaaccuucuggaccugcccccacuguggccugcaugcgccccucacgccccuggag

SEQ ID NO: 346611 - RNA, 64 nt, Human
auaaagccgcacaugcugauacacacuguuguuaggccugcaccugcccauccagaaagcagca

SEQ ID NO: 346612 - RNA, 64 nt, Human
agcagaguugagcaguugugacaggagaccauguggccugcagagcccaaauaucuacugucug

SEQ ID NO: 346613 - RNA, 64 nt, Human
ggaugggccucaggccaccaggcaauaaccacagggccugcagcagugccccugccagccccga

SEQ ID NO: 346614 - RNA, 64 nt, Human
ggccucuggggaccugagccccgggggccccaucggccugcagaggggacggcuggggucccga

SEQ ID NO: 346615 - RNA, 64 nt, Human
uuuucuaaguggcuggcaccagagauaacucaagggccugcaccaaaucgcuuuuggguuuucu

SEQ ID NO: 346616 - RNA, 64 nt, Human
uagguaaccaacgggagucgacuuaucuaugccaggccugcaguuucacaucugugacgggaug

SEQ ID NO: 346617 - RNA, 64 nt, Human
acuggccaggccccgcgggccgggcuccaggaagggccugcacgaacccuacagcgagagugac

SEQ ID NO: 346618 - RNA, 64 nt, Human
guuuguggacgacgagaccaagcucacgcugcacggccugcagcaguacuacgucaaacucaaa

SEQ ID NO: 346619 - RNA, 64 nt, Human
agugaccaugacggggccacgugugcuguggccaggccugcagacagaccucaagggacaggga

SEQ ID NO: 346620 - RNA, 64 nt, Human
uaaaggggauauucauuugauuauacgggggagggucagggaagaacgaaccuugacguugcag

SEQ ID NO: 346621 - RNA, 64 nt, Human
auuuauuacuucuucuuuccaggaccugacagaagucagggaagagucccuggguuauguccaa

SEQ ID NO: 346622 - RNA, 64 nt, Human
ggcaugagaguuucagacucagccuucugagccagucagggaaaguggaguucugcagcgcaaa

SEQ ID NO: 346623 - RNA, 64 nt, Human
aaugaccaaccgucccuggacuguggaauguuccggccugcauuucugcccaccccuuccguug

SEQ ID NO: 346624 - RNA, 64 nt, Human
acuggaauugcugcuacccagcuggggugggugaggccugcacugauuggggccuggggcaggg

SEQ ID NO: 346625 - RNA, 64 nt, Human
gccuucaguggagcuagaccugccaggagcacuuggccugcaggggcaggucccagccgcuaaa

SEQ ID NO: 346626 - RNA, 64 nt, Human
aucaagaauuucacagaagacaggucagcugaggggccugcacacacaggguguugaggaacca

SEQ ID NO: 346627 - RNA, 64 nt, Human
agguucuagggggcggugcuggccgcaguggacuggccugcaggugagcacugcccugggcucu

SEQ ID NO: 346628 - RNA, 64 nt, Human
aaacggggucaggcaggaaagcaacuuaaaggagggccugcaagcagccagggucagagacagg

SEQ ID NO: 346629 - RNA, 64 nt, Human
guggugggauuggucccagugccuggcgcacauuggccugcagaguagauuaacugaaugacca

SEQ ID NO: 346630 - RNA, 64 nt, Human
ucccagcaggcccaggccagccagggcuucgucaggccugcagcacaauuugacuuccuaugcc

SEQ ID NO: 346631 - RNA, 64 nt, Human
cagggugucacgagcccugagcugcaauggcccgggccugcagggcgggguaggggagggcagg

SEQ ID NO: 346632 - RNA, 64 nt, Human
aguuuggcccuggagccagggcagaggaauguagggccugcauggagaaggguucugcccugcc

SEQ ID NO: 346633 - RNA, 64 nt, Human
uuaagaagcauuccugcuucucaagggacacaguggccugcaugggccagcauggacccugggc

SEQ ID NO: 346634 - RNA, 64 nt, Human
ugccucuuucaggaaggagccccuuaggaggacaggccugcagcauccuggucucgggaggcuu

SEQ ID NO: 346635 - RNA, 64 nt, Human
cgcaggggcugugaaucccacugggagggcggugggccugcagccugaggaaggcuuguguguc

SEQ ID NO: 346636 - RNA, 64 nt, Human
ggcccggcugcuguucccauguccacaucucugaggccugcacccccucugucuagcucgggga

SEQ ID NO: 346637 - RNA, 64 nt, Human
caccagaagccgcgaggcccucagggaagcccaaggccugcagaagccuccuggccuggcugug

SEQ ID NO: 346638 - RNA, 64 nt, Human
gcgccagcuggggcagcuccgggcucaggaagccggccugcagcaggagcagaggaaggcagac

SEQ ID NO: 346639 - RNA, 64 nt, Human
gucaggggaaaauagaucuaggcagagugccuuagucagggaccacgggcgcugaaucugcagu

SEQ ID NO: 346640 - RNA, 64 nt, Human
guaacuugauccauuucuaauuauguagcucuuugucagggaguguucccuauccaaucaaucu

SEQ ID NO: 346641 - RNA, 64 nt, Human
agggcagagauuggacaucaacaaggcuagaagggucagggaagugggcuaaaggaacagauuc

SEQ ID NO: 346642 - RNA, 64 nt, Human
gggcccuagcucagccccaccaggcccucuguugggccugcacacagcucuguggcuagaacac

SEQ ID NO: 346643 - RNA, 64 nt, Human
cugugcucaccuccuaggccauggagccugagggggccugcaccagguuugcugaaacugacag

SEQ ID NO: 346644 - RNA, 64 nt, Human
uggcuccccugugcccagaucuggccaugggugaggccugcacagauguugaaugaacaucugu

SEQ ID NO: 346645 - RNA, 64 nt, Human
guuugcuuuuagugcuggcccucucuguggguguggccugcaaaggaaccaacagacccuaugc

SEQ ID NO: 346646 - RNA, 64 nt, Human
cguuggaagagucuuaaacuggggcuucauguguggccugcagucauguuucggcuuaguccaa

SEQ ID NO: 346647 - RNA, 64 nt, Human
uaauuaaaauaaaaaacagcuuaaagagaaaaauggccugcaaaccuuuuuuaugaugcuauuu

SEQ ID NO: 346648 - RNA, 64 nt, Human
gaagaaguacuaacgcauugaucucagaggcggaggccugcacuugaccauguagguggcagag

SEQ ID NO: 346649 - RNA, 64 nt, Human
agucaugaagaagcucaugcuugauaucucugagggccugcaaggaggcaaagugagguuggag

SEQ ID NO: 346650 - RNA, 64 nt, Human
gaaacaucuacagauaguuccuacuaaaagaaguggccugcagaaguuuaauaauuugacuuuu

SEQ ID NO: 346651 - RNA, 64 nt, Human
ugugcagaggcuagaggcuucucgggcagccccuggccugcacacuacucaugacagaaaguca

SEQ ID NO: 346652 - RNA, 64 nt, Human
agugagcucaggagagagcuuccuguuucuaaguggccugcaggggccacucucuacugguagg

SEQ ID NO: 346653 - RNA, 64 nt, Human
cagcccuggucacuuggaacugacagcugugugaggccugcacuucucagacccagacuuagaa

SEQ ID NO: 346654 - RNA, 64 nt, Human
aaauugaaaaccucuuuccaaaggcuguuuuaacggccugcaucauucuuucugcuauauuagg

SEQ ID NO: 346655 - RNA, 64 nt, Human
cguccugaggagagaaccggcgcugggcaacacgggccugcaaacucgacaggacccugcccga

SEQ ID NO: 346656 - RNA, 64 nt, Human
ccugaugucaguguguguaacugaccucuggccuggccugcacagagaagcccuauaaucacag

SEQ ID NO: 346657 - RNA, 64 nt, Human
uaacuggcuuguaagaggcucagacaccaagcugggccugcagaggaggggcacaguaggacac

SEQ ID NO: 346658 - RNA, 64 nt, Human
gaggaucugccucggcgucugcaggcgggaccacgucagggaggguuccuucauguguucuccc

SEQ ID NO: 346659 - RNA, 64 nt, Human
ccaucaggguagggugguggguugagaccaggaagucagggaagaucggaauucagggcgacgg

SEQ ID NO: 346660 - RNA, 64 nt, Human
ucuccuuccaccccugcagugugcuguugugcacgucagggacgcuguucucuaugcccacugc

SEQ ID NO: 346661 - RNA, 64 nt, Human
agccaccaugggugaccguccagccucacccgguggccugcacagugagggaagggcuucaggg

SEQ ID NO: 346662 - RNA, 64 nt, Human
aggaccagugcagggucugugcaccuucccugcuggccugcacacagcugcucagcaccacuuu

SEQ ID NO: 346663 - RNA, 64 nt, Human
ugagggguccagagggugggggggcgucagcccuggccugcaugauggguugccugugcgccag

SEQ ID NO: 346664 - RNA, 64 nt, Human
uagccccaagaggccaggaagggcuggaaggcagggccugcaggugcuccccgcccugagaccc

SEQ ID NO: 346665 - RNA, 64 nt, Human
ucagagcagagggccagguauagaaaccgcagugggccugcaagccgcccgagccuccccagca

SEQ ID NO: 346666 - RNA, 64 nt, Human
ucucugcacagccugggauggggcuuggggcuggggccugcagcagaagugugcccagcguuuc

SEQ ID NO: 346667 - RNA, 64 nt, Human
gccgcccccaagcccagagcacagcaauaaggucggccugcaggagccgggguggggguggggg

SEQ ID NO: 346668 - RNA, 64 nt, Human
agaccacagcccgccuucugccaaaagaagugauggccugcaccgagcuuccuugagggcuuca

SEQ ID NO: 346669 - RNA, 64 nt, Human
acucugggggccagccagagcccuggccguccgaggccugcaggagacguuggcuugggccugc

SEQ ID NO: 346670 - RNA, 64 nt, Human
gagccccuucuguugugggcagccuggguuugcaggccugcacaggcuggggaguccucaggac

SEQ ID NO: 346671 - RNA, 64 nt, Human
gccugccuuacagguguggcugacucugagcccaggccugcagggguggagggcagucccucag

SEQ ID NO: 346672 - RNA, 64 nt, Human
augcuguugucuuucuuagaaugcccuuccccuaggccugcauggcuugcuaccucacuuaauu

SEQ ID NO: 346673 - RNA, 64 nt, Human
gcagaggggcagagcuaggcugggaggagcccagggccugcaccacccacuugcaaccaccagg

SEQ ID NO: 346674 - RNA, 64 nt, Human
uucucuuuaccccuucccccucuucucuugcucaggccugcaccacugcagccaccguucauuu

SEQ ID NO: 346675 - RNA, 64 nt, Human
gcucagggcugccagaaucagcggaugcuggaugggccugcagaaacaacacucaccacacaca

SEQ ID NO: 346676 - RNA, 64 nt, Human
ccggcgaugggagucaaacccaggcacgcggccuggccugcaugcugagccacauggugcuguc

SEQ ID NO: 346677 - RNA, 64 nt, Human
gcccagcccccauggucuucuggaaggucccucggucagggauugaaaauaguacagugacucu

SEQ ID NO: 346678 - RNA, 64 nt, Human
aauggacauaagacagacagcaguuucccugguggucagggagggguuuuggugauacccaagu

SEQ ID NO: 346679 - RNA, 64 nt, Human
guuucaaugaaaaaguuaguguuaaaggaagugagucagggagggcggaguuuguuguaaggca

SEQ ID NO: 346680 - RNA, 64 nt, Human
accaggaggccugggagaugcagcuggauggggcggccugcagacccugccaggggguuugagg

SEQ ID NO: 346681 - RNA, 64 nt, Human
cccagcagccccugagagccuguggaggggcuugggccugcacccuuccacagcuggccugguu

SEQ ID NO: 346682 - RNA, 64 nt, Human
gagaugggagggcccaaggaaccuccugggagggggccugcauucuauguuggugggaauggga

SEQ ID NO: 346683 - RNA, 64 nt, Human
uggcagugggaauguucuuucugcucuauacuguggccugcaggaggguuggagugcucuuccc

SEQ ID NO: 346684 - RNA, 64 nt, Human
cuuuauuuacaaaagcagguggagggcuggguuuggccugcaggcuguagcuugccaaucagug

SEQ ID NO: 346685 - RNA, 64 nt, Human
ucugccuugagcugggacugcuuucugucuguccggccugcacccagccccugcccacaaaacc

SEQ ID NO: 346686 - RNA, 64 nt, Human
aaugcaguagaauuuaaaacuuggaugcuuaagaggccugcauauagauaagaauuucaggcaa

SEQ ID NO: 346687 - RNA, 64 nt, Human
acuuaaacacuauccccucagacucccugugugaggccugcagaggcccugaaugcacaaaugg

SEQ ID NO: 346688 - RNA, 64 nt, Human
uuuacuggggaccugcgagcuggccuaaugugguggccugcaagccaggccaucccugggcgcc

SEQ ID NO: 346689 - RNA, 64 nt, Human
caccuacggcagggacacacucgugagcauguguggccugcaguucaggugauacauuuaccag

SEQ ID NO: 346690 - RNA, 64 nt, Human
cagggagccucccuucaaaaagacagcgccccuagucagggaggggauggcgguccuuugauaa

SEQ ID NO: 346691 - RNA, 64 nt, Human
uucccccuguagagagccuaugaauggacgugcagucagggagguuucauaucaccaagauucc

SEQ ID NO: 346692 - RNA, 64 nt, Human
ggaggcuggccaaagagacugugggcuguuuucagucagggagcaugugcauuguuugugcuca

SEQ ID NO: 346693 - RNA, 64 nt, Human
ggaucacagccacuauggaugacauguugucuacucggucuagcaccuugaccgaggauggagc

SEQ ID NO: 346694 - RNA, 64 nt, Human
gacuuuaaaccaccuaguucuccccgauggggcaucggucuaaagcuuugggggagugggcgca

SEQ ID NO: 346695 - RNA, 64 nt, Human
ggguccauugcccacauucucugucuccuucucgucggucuaccccacuaccuccaggguuuug

SEQ ID NO: 346696 - RNA, 64 nt, Human
gacgaucaucacaccugugucguuaccucagccaucggucuagcauaucagucacugggcccaa

SEQ ID NO: 346697 - RNA, 64 nt, Human
cuuuuauuaaaauaaccaugcaacaauaacacuaucggucuaucugacaguuuuucccccaggg

SEQ ID NO: 346698 - RNA, 64 nt, Human
gcgaggcccauguacuccuguggcuuucucacauucggucuacuugcaggguaucuccacagca

SEQ ID NO: 346699 - RNA, 64 nt, Human
ggacugccaggcuggguuggggacccagggaacaucggucuacucaggugugagggggcagguc

SEQ ID NO: 346700 - RNA, 64 nt, Human
aauugaaugagagcaguggacacaucucagcaggucggucuagagaguugcgaaucuaaaccug

SEQ ID NO: 346701 - RNA, 64 nt, Human
cuccugacccguauagugugccacaggaccugggucggucuagaacucucucaggaugccuuuu

SEQ ID NO: 346702 - RNA, 64 nt, Human
guaagcaggccuuaguacggcugcugcacacuucucggucuaggugggagagagugcauaaagg

SEQ ID NO: 346703 - RNA, 64 nt, Human
ucaaagugugccccagcacaagaggcacugguguucggucuacauuuaguucuccccacucuga

SEQ ID NO: 346704 - RNA, 64 nt, Human
gcaagagaauacuguaacaaacuucguacagaguucggucuauuaauuguuucauguuagauau

SEQ ID NO: 346705 - RNA, 64 nt, Human
aaauuucugcccugagcccuccacgucagugccaucggucuagaaccacuaaccccgcauugcu

SEQ ID NO: 346706 - RNA, 64 nt, Human
ugaaggggagaacgucuccagacagaauucuacaucggucuaaucuacuuuaggacuggauccc

SEQ ID NO: 346707 - RNA, 64 nt, Human
uuggacauagaaugcagggagcuacugaaggucugucagggauuuguccauucugcucuuggcc

SEQ ID NO: 346708 - RNA, 64 nt, Human
gucacagaagagagcugcuuaugauuuugaaggggucagggagggugggaguugguaaagagua

SEQ ID NO: 346709 - RNA, 64 nt, Human
ggugaggcccaguauucuguguuuuaacaagcccgucagggaauucugaugcacaguaaaaucc

SEQ ID NO: 346710 - RNA, 64 nt, Human
uuuucuugcagguaagugacacucccuguccuagucggucuaucuggacuugcccuugucuguu

SEQ ID NO: 346711 - RNA, 64 nt, Human
gcuggagugguggcuccauccucucugggccacuucggucuaggaacucaucuuugcaggaacc

SEQ ID NO: 346712 - RNA, 64 nt, Human
uccaguguucgggggccucuggcugcugaaggauucggucuaccacggagggcugugcuguuag

SEQ ID NO: 346713 - RNA, 64 nt, Human
uguucauucugauuugucauuuuauuaucuguuaucggucuaaagugcuaauuuacccauuuga

SEQ ID NO: 346714 - RNA, 64 nt, Human
gccucaagaggccucagaacugcaaacuccugcgucggucuauacuacucggccauggcccaca

SEQ ID NO: 346715 - RNA, 64 nt, Human; identical to SEQ ID NO: 36852

SEQ ID NO: 346716 - RNA, 64 nt, Human; identical to SEQ ID NO: 36853

SEQ ID NO: 346717 - RNA, 64 nt, Human; identical to SEQ ID NO: 36854

SEQ ID NO: 346718 - RNA, 64 nt, Human; identical to SEQ ID NO: 36855

SEQ ID NO: 346719 - RNA, 64 nt, Human; identical to SEQ ID NO: 36856

SEQ ID NO: 346720 - RNA, 64 nt, Human; identical to SEQ ID NO: 36857

SEQ ID NO: 346721 - RNA, 64 nt, Human; identical to SEQ ID NO: 36858

SEQ ID NO: 346722 - RNA, 64 nt, Human; identical to SEQ ID NO: 36859

SEQ ID NO: 346723 - RNA, 64 nt, Human; identical to SEQ ID NO: 36860

SEQ ID NO: 346724 - RNA, 64 nt, Human; identical to SEQ ID NO: 36861

SEQ ID NO: 346725 - RNA, 64 nt, Human; identical to SEQ ID NO: 36862

SEQ ID NO: 346726 - RNA, 64 nt, Human
gucuaucuguuugucugucugugugucugugacagucagggaaggaugccucggagcugaggug

SEQ ID NO: 346727 - RNA, 64 nt, Human
cuggccuuagaaucaacucaccugguguccuauugucagggacaucuuaaccagggugacugca

SEQ ID NO: 346728 - RNA, 64 nt, Human
gauugggagaucagucgugauuuuagauagucuggucagggagggccucaacugagaaggugaa

SEQ ID NO: 346729 - RNA, 64 nt, Human; identical to SEQ ID NO: 36863

SEQ ID NO: 346730 - RNA, 64 nt, Human; identical to SEQ ID NO: 36864

SEQ ID NO: 346731 - RNA, 64 nt, Human; identical to SEQ ID NO: 36865

SEQ ID NO: 346732 - RNA, 64 nt, Human; identical to SEQ ID NO: 36866

SEQ ID NO: 346733 - RNA, 64 nt, Human; identical to SEQ ID NO: 36867

SEQ ID NO: 346734 - RNA, 64 nt, Human; identical to SEQ ID NO: 36868

SEQ ID NO: 346735 - RNA, 64 nt, Human; identical to SEQ ID NO: 36869

SEQ ID NO: 346736 - RNA, 64 nt, Human; identical to SEQ ID NO: 36870

SEQ ID NO: 346737 - RNA, 52 nt, Human; identical to SEQ ID NO: 36871

SEQ ID NO: 346738 - RNA, 63 nt, Human; identical to SEQ ID NO: 36872

SEQ ID NO: 346739 - RNA, 64 nt, Human; identical to SEQ ID NO: 36873

SEQ ID NO: 346740 - RNA, 64 nt, Human; identical to SEQ ID NO: 36874

SEQ ID NO: 346741 - RNA, 64 nt, Human; identical to SEQ ID NO: 36875

SEQ ID NO: 346742 - RNA, 64 nt, Human; identical to SEQ ID NO: 36876

SEQ ID NO: 346743 - RNA, 64 nt, Human; identical to SEQ ID NO: 36877

SEQ ID NO: 346744 - RNA, 64 nt, Human; identical to SEQ ID NO: 36878

SEQ ID NO: 346745 - RNA, 64 nt, Human
ccucacgcugacgagcaaucagagguacucccuggucagggacaaguguuuccugucagccacc

SEQ ID NO: 346746 - RNA, 64 nt, Human
cucucuacagugccaacuccucacacacccugaggucagggagugcuggcucacaguacagcau

SEQ ID NO: 346747 - RNA, 64 nt, Human
uuagggcuuccuggccuacugcauccuugugggagucagggaggagggcccguuggguagcugg

SEQ ID NO: 346748 - RNA, 64 nt, Human; identical to SEQ ID NO: 36879

SEQ ID NO: 346749 - RNA, 64 nt, Human; identical to SEQ ID NO: 36852

SEQ ID NO: 346750 - RNA, 64 nt, Human; identical to SEQ ID NO: 36853

SEQ ID NO: 346751 - RNA, 64 nt, Human; identical to SEQ ID NO: 36854

SEQ ID NO: 346752 - RNA, 64 nt, Human; identical to SEQ ID NO: 36855

SEQ ID NO: 346753 - RNA, 64 nt, Human
aaccagcugucuguggagagaauggggugcuuucgucagggacugcugacggcugguccugagg

SEQ ID NO: 346754 - RNA, 64 nt, Human
caaggguagaaguuaaaggagaaucugaaggcaggucagggaaaagaagaacuggaaaugaaac

SEQ ID NO: 346755 - RNA, 64 nt, Human
uuucaggagagaacuacaccaguucaucaugagggucagggaagcaaaagcucucagauguguc

SEQ ID NO: 346756 - RNA, 64 nt, Human; identical to SEQ ID NO: 36856

SEQ ID NO: 346757 - RNA, 64 nt, Human; identical to SEQ ID NO: 36857

SEQ ID NO: 346758 - RNA, 64 nt, Human; identical to SEQ ID NO: 36858

SEQ ID NO: 346759 - RNA, 64 nt, Human; identical to SEQ ID NO: 36859

SEQ ID NO: 346760 - RNA, 64 nt, Human; identical to SEQ ID NO: 36860

SEQ ID NO: 346761 - RNA, 64 nt, Human; identical to SEQ ID NO: 36861

SEQ ID NO: 346762 - RNA, 64 nt, Human; identical to SEQ ID NO: 36862

SEQ ID NO: 346763 - RNA, 64 nt, Human; identical to SEQ ID NO: 36863

SEQ ID NO: 346764 - RNA, 64 nt, Human; identical to SEQ ID NO: 36864

SEQ ID NO: 346765 - RNA, 64 nt, Human; identical to SEQ ID NO: 36865

SEQ ID NO: 346766 - RNA, 64 nt, Human; identical to SEQ ID NO: 36866

SEQ ID NO: 346767 - RNA, 64 nt, Human; identical to SEQ ID NO: 36867

SEQ ID NO: 346768 - RNA, 64 nt, Human; identical to SEQ ID NO: 36868

SEQ ID NO: 346769 - RNA, 64 nt, Human; identical to SEQ ID NO: 36869

SEQ ID NO: 346770 - RNA, 64 nt, Human; identical to SEQ ID NO: 36870

SEQ ID NO: 346771 - RNA, 52 nt, Human; identical to SEQ ID NO: 36871

SEQ ID NO: 346772 - RNA, 64 nt, Human
aguuccgcuuuuccaacugccccagguagucagggucagggaccuuggacuugucucuuacugc

SEQ ID NO: 346773 - RNA, 64 nt, Human
gaggcuuggcccagcucuaggagcaguccccagggucagggagccccugguguggaaagaggcc

SEQ ID NO: 346774 - RNA, 64 nt, Human
agcugugcaagaaacagccugccagucugucauugucagggaccagggcaaaaccaagagcugu

SEQ ID NO: 346775 - RNA, 63 nt, Human; identical to SEQ ID NO: 36872

SEQ ID NO: 346776 - RNA, 64 nt, Human; identical to SEQ ID NO: 36873

SEQ ID NO: 346777 - RNA, 64 nt, Human; identical to SEQ ID NO: 36874

SEQ ID NO: 346778 - RNA, 64 nt, Human; identical to SEQ ID NO: 36875

SEQ ID NO: 346779 - RNA, 64 nt, Human; identical to SEQ ID NO: 36876

SEQ ID NO: 346780 - RNA, 64 nt, Human; identical to SEQ ID NO: 36877

SEQ ID NO: 346781 - RNA, 64 nt, Human; identical to SEQ ID NO: 36878

SEQ ID NO: 346782 - RNA, 64 nt, Human; identical to SEQ ID NO: 36879

SEQ ID NO: 346783 - RNA, 64 nt, Human
ggcagugugccauccugaagccuuccuccuggaugucagggaagcuggaccaccuggaguugau

SEQ ID NO: 346784 - RNA, 64 nt, Human
gaagaaggugccugucggggcucacuugaagccugucagggaugcuuuguaucuaacacaacgc

SEQ ID NO: 346785 - RNA, 64 nt, Human
uuucacuaaaagcuaccgugguggagugaagucagucagggaagguuuguuuauguuacauuua

SEQ ID NO: 346786 - RNA, 64 nt, Human
uacuucaguuggaaaaauuaaacaggagcacaaagucagggauagggguuagcagaagagagaa

SEQ ID NO: 346787 - RNA, 64 nt, Human
uaggauacgacggggaaaacagaaaugugggguggucagggacauucggauaauucgggcuauu

SEQ ID NO: 346788 - RNA, 64 nt, Human
cgggccugaauggacaggggccacuucacagcaugucagggaaaaucacugucacacaauucca

SEQ ID NO: 346789 - RNA, 64 nt, Human
cucacagggcugaaaggggcuuuuguccuccugggucagggagaacgcggggaccccagaaagg

SEQ ID NO: 346790 - RNA, 64 nt, Human
ggaggguggagugagagugucauguauugggauagucagggaucccugccuuuggccuuucuuc

SEQ ID NO: 346791 - RNA, 64 nt, Human
aucuccccugcuuugguguugagugaugagcugagucagggauagggaguccccuggugcuaac

SEQ ID NO: 346792 - RNA, 64 nt, Human
cauggugaggagcauggaguuaacuaaaggaugugucagggaagaaagacuucucaaggaggug

SEQ ID NO: 346793 - RNA, 64 nt, Human
cacuguuagaaauaggcuuuguuagcugacuagggucagggaaacuuuucucuucaaauuugaa

SEQ ID NO: 346794 - RNA, 64 nt, Human
ccauuccuuccugggugucggaccagggcucugugucagggaaaaccuucuggguggacuuugu

SEQ ID NO: 346795 - RNA, 64 nt, Human
uguggggugggggccguugcagguguacugggcugucagggaucuuuucuauaccagaacugcg

SEQ ID NO: 346796 - RNA, 64 nt, Human
ccgugacugcaguuccugcccccauucucuuggggucagggaggggcugggaagggcuacugaa

SEQ ID NO: 346797 - RNA, 64 nt, Human
cuuggauacuaggcccacugucccugaagggaaugucagggaagugugccugugagcugaauua

SEQ ID NO: 346798 - RNA, 64 nt, Human
cugccucauaagcucccaaucucagacacuggcagucagggagaaucaaacugccugucucccu

SEQ ID NO: 346799 - RNA, 64 nt, Human
caaagaagucauucuuuaagcagcgccagugacagucagggaaggugccucuggaugcugugaa

SEQ ID NO: 346800 - RNA, 64 nt, Human
uacaaaagaaaaaagggaagggggagaggggcuggucagggagaacccagcuugggcagagugc

SEQ ID NO: 346801 - RNA, 64 nt, Human
gcacgcugggccuucagaauuaauggccagcagugucagggaugagcccgucagccagggcaca

SEQ ID NO: 346802 - RNA, 64 nt, Human
gggcuuuuaaauaaauagauguucuguagcauuggucagggaaauaugaauuaggaccacaaug

SEQ ID NO: 346803 - RNA, 64 nt, Human
aggccucugguuggcucucucaggaagagggcaggucagggauugggcgguguaaauugacuca

SEQ ID NO: 346804 - RNA, 62 nt, Human; identical to SEQ ID NO: 278014

SEQ ID NO: 346805 - RNA, 62 nt, Human; identical to SEQ ID NO: 278015

SEQ ID NO: 346806 - RNA, 62 nt, Human; identical to SEQ ID NO: 278016

SEQ ID NO: 346807 - RNA, 62 nt, Human; identical to SEQ ID NO: 278017

SEQ ID NO: 346808 - RNA, 62 nt, Human; identical to SEQ ID NO: 278018

SEQ ID NO: 346809 - RNA, 62 nt, Human; identical to SEQ ID NO: 278019

SEQ ID NO: 346810 - RNA, 62 nt, Human; identical to SEQ ID NO: 278020

SEQ ID NO: 346811 - RNA, 62 nt, Human; identical to SEQ ID NO: 278021

SEQ ID NO: 346812 - RNA, 62 nt, Human; identical to SEQ ID NO: 278022

SEQ ID NO: 346813 - RNA, 62 nt, Human; identical to SEQ ID NO: 278023

SEQ ID NO: 346814 - RNA, 62 nt, Human; identical to SEQ ID NO: 278024

SEQ ID NO: 346815 - RNA, 62 nt, Human; identical to SEQ ID NO: 278028

SEQ ID NO: 346816 - RNA, 62 nt, Human; identical to SEQ ID NO: 278029

SEQ ID NO: 346817 - RNA, 62 nt, Human; identical to SEQ ID NO: 278030

SEQ ID NO: 346818 - RNA, 62 nt, Human; identical to SEQ ID NO: 278031

SEQ ID NO: 346819 - RNA, 62 nt, Human; identical to SEQ ID NO: 278032

SEQ ID NO: 346820 - RNA, 62 nt, Human; identical to SEQ ID NO: 278033

SEQ ID NO: 346821 - RNA, 62 nt, Human; identical to SEQ ID NO: 278688

SEQ ID NO: 346822 - RNA, 62 nt, Human; identical to SEQ ID NO: 278689

SEQ ID NO: 346823 - RNA, 62 nt, Human; identical to SEQ ID NO: 278690

SEQ ID NO: 346824 - RNA, 62 nt, Human; identical to SEQ ID NO: 278691

SEQ ID NO: 346825 - RNA, 62 nt, Human; identical to SEQ ID NO: 278692

SEQ ID NO: 346826 - RNA, 62 nt, Human; identical to SEQ ID NO: 278693

SEQ ID NO: 346827 - RNA, 62 nt, Human; identical to SEQ ID NO: 278694

SEQ ID NO: 346828 - RNA, 62 nt, Human; identical to SEQ ID NO: 278695

SEQ ID NO: 346829 - RNA, 62 nt, Human; identical to SEQ ID NO: 278696

SEQ ID NO: 346830 - RNA, 62 nt, Human; identical to SEQ ID NO: 278700

SEQ ID NO: 346831 - RNA, 62 nt, Human; identical to SEQ ID NO: 278701

SEQ ID NO: 346832 - RNA, 62 nt, Human; identical to SEQ ID NO: 278702

SEQ ID NO: 346833 - RNA, 62 nt, Human; identical to SEQ ID NO: 278703

SEQ ID NO: 346834 - RNA, 62 nt, Human; identical to SEQ ID NO: 278704

SEQ ID NO: 346835 - RNA, 62 nt, Human; identical to SEQ ID NO: 278705

SEQ ID NO: 346836 - RNA, 62 nt, Human; identical to SEQ ID NO: 278706

SEQ ID NO: 346837 - RNA, 62 nt, Human; identical to SEQ ID NO: 278707

SEQ ID NO: 346838 - RNA, 62 nt, Human; identical to SEQ ID NO: 278708

SEQ ID NO: 346839 - RNA, 62 nt, Human; identical to SEQ ID NO: 278709

SEQ ID NO: 346840 - RNA, 62 nt, Human; identical to SEQ ID NO: 278710

SEQ ID NO: 346841 - RNA, 62 nt, Human; identical to SEQ ID NO: 278711

SEQ ID NO: 346842 - RNA, 62 nt, Human; identical to SEQ ID NO: 278712

SEQ ID NO: 346843 - RNA, 62 nt, Human; identical to SEQ ID NO: 278717

SEQ ID NO: 346844 - RNA, 62 nt, Human; identical to SEQ ID NO: 278718

SEQ ID NO: 346845 - RNA, 62 nt, Human; identical to SEQ ID NO: 278719

SEQ ID NO: 346846 - RNA, 62 nt, Human; identical to SEQ ID NO: 278720

SEQ ID NO: 346847 - RNA, 62 nt, Human; identical to SEQ ID NO: 278721

SEQ ID NO: 346848 - RNA, 62 nt, Human; identical to SEQ ID NO: 278722

SEQ ID NO: 346849 - RNA, 62 nt, Human; identical to SEQ ID NO: 278723

SEQ ID NO: 346850 - RNA, 62 nt, Human; identical to SEQ ID NO: 278724

SEQ ID NO: 346851 - RNA, 62 nt, Human; identical to SEQ ID NO: 278725

SEQ ID NO: 346852 - RNA, 62 nt, Human; identical to SEQ ID NO: 278726

SEQ ID NO: 346853 - RNA, 62 nt, Human; identical to SEQ ID NO: 278727

SEQ ID NO: 346854 - RNA, 62 nt, Human; identical to SEQ ID NO: 278728

SEQ ID NO: 346855 - RNA, 62 nt, Human; identical to SEQ ID NO: 278729

SEQ ID NO: 346856 - RNA, 62 nt, Human; identical to SEQ ID NO: 278734

SEQ ID NO: 346857 - RNA, 62 nt, Human; identical to SEQ ID NO: 278735

SEQ ID NO: 346858 - RNA, 62 nt, Human; identical to SEQ ID NO: 278736

SEQ ID NO: 346859 - RNA, 62 nt, Human; identical to SEQ ID NO: 278737

SEQ ID NO: 346860 - RNA, 62 nt, Human; identical to SEQ ID NO: 278738

SEQ ID NO: 346861 - RNA, 62 nt, Human; identical to SEQ ID NO: 278739

SEQ ID NO: 346862 - RNA, 62 nt, Human; identical to SEQ ID NO: 278740

SEQ ID NO: 346863 - RNA, 62 nt, Human; identical to SEQ ID NO: 278741

SEQ ID NO: 346864 - RNA, 62 nt, Human; identical to SEQ ID NO: 278742

SEQ ID NO: 346865 - RNA, 62 nt, Human; identical to SEQ ID NO: 278743

SEQ ID NO: 346866 - RNA, 62 nt, Human; identical to SEQ ID NO: 278744

SEQ ID NO: 346867 - RNA, 62 nt, Human; identical to SEQ ID NO: 278745

SEQ ID NO: 346868 - RNA, 62 nt, Human; identical to SEQ ID NO: 278746

SEQ ID NO: 346869 - RNA, 62 nt, Human; identical to SEQ ID NO: 278751

SEQ ID NO: 346870 - RNA, 62 nt, Human; identical to SEQ ID NO: 278752

SEQ ID NO: 346871 - RNA, 62 nt, Human; identical to SEQ ID NO: 278753

SEQ ID NO: 346872 - RNA, 62 nt, Human; identical to SEQ ID NO: 278754

SEQ ID NO: 346873 - RNA, 62 nt, Human; identical to SEQ ID NO: 278755

SEQ ID NO: 346874 - RNA, 62 nt, Human; identical to SEQ ID NO: 278756

SEQ ID NO: 346875 - RNA, 62 nt, Human; identical to SEQ ID NO: 278757

SEQ ID NO: 346876 - RNA, 62 nt, Human; identical to SEQ ID NO: 278758

SEQ ID NO: 346877 - RNA, 62 nt, Human; identical to SEQ ID NO: 278759

SEQ ID NO: 346878 - RNA, 62 nt, Human; identical to SEQ ID NO: 278760

SEQ ID NO: 346879 - RNA, 62 nt, Human; identical to SEQ ID NO: 278761

SEQ ID NO: 346880 - RNA, 62 nt, Human; identical to SEQ ID NO: 278762

SEQ ID NO: 346881 - RNA, 62 nt, Human; identical to SEQ ID NO: 278763

SEQ ID NO: 346882 - RNA, 62 nt, Human; identical to SEQ ID NO: 278768

SEQ ID NO: 346883 - RNA, 62 nt, Human; identical to SEQ ID NO: 278769

SEQ ID NO: 346884 - RNA, 62 nt, Human; identical to SEQ ID NO: 278770

SEQ ID NO: 346885 - RNA, 62 nt, Human; identical to SEQ ID NO: 278771

SEQ ID NO: 346886 - RNA, 62 nt, Human; identical to SEQ ID NO: 278772

SEQ ID NO: 346887 - RNA, 62 nt, Human; identical to SEQ ID NO: 278773

SEQ ID NO: 346888 - RNA, 62 nt, Human; identical to SEQ ID NO: 278774

SEQ ID NO: 346889 - RNA, 62 nt, Human; identical to SEQ ID NO: 278775

SEQ ID NO: 346890 - RNA, 62 nt, Human; identical to SEQ ID NO: 278776

SEQ ID NO: 346891 - RNA, 62 nt, Human; identical to SEQ ID NO: 278777

SEQ ID NO: 346892 - RNA, 62 nt, Human; identical to SEQ ID NO: 278778

SEQ ID NO: 346893 - RNA, 62 nt, Human; identical to SEQ ID NO: 278779

SEQ ID NO: 346894 - RNA, 62 nt, Human; identical to SEQ ID NO: 278780

SEQ ID NO: 346895 - RNA, 62 nt, Human; identical to SEQ ID NO: 278785

SEQ ID NO: 346896 - RNA, 62 nt, Human; identical to SEQ ID NO: 278786

SEQ ID NO: 346897 - RNA, 62 nt, Human; identical to SEQ ID NO: 278787

SEQ ID NO: 346898 - RNA, 62 nt, Human; identical to SEQ ID NO: 278788

SEQ ID NO: 346899 - RNA, 62 nt, Human; identical to SEQ ID NO: 278789

SEQ ID NO: 346900 - RNA, 62 nt, Human; identical to SEQ ID NO: 278790

SEQ ID NO: 346901 - RNA, 62 nt, Human; identical to SEQ ID NO: 278791

SEQ ID NO: 346902 - RNA, 62 nt, Human; identical to SEQ ID NO: 278792

SEQ ID NO: 346903 - RNA, 62 nt, Human; identical to SEQ ID NO: 278793

SEQ ID NO: 346904 - RNA, 62 nt, Human; identical to SEQ ID NO: 278794

SEQ ID NO: 346905 - RNA, 62 nt, Human; identical to SEQ ID NO: 278795

SEQ ID NO: 346906 - RNA, 62 nt, Human; identical to SEQ ID NO: 278796

SEQ ID NO: 346907 - RNA, 62 nt, Human; identical to SEQ ID NO: 278797

SEQ ID NO: 346908 - RNA, 62 nt, Human; identical to SEQ ID NO: 278802

SEQ ID NO: 346909 - RNA, 62 nt, Human; identical to SEQ ID NO: 278803

SEQ ID NO: 346910 - RNA, 62 nt, Human; identical to SEQ ID NO: 278804

SEQ ID NO: 346911 - RNA, 62 nt, Human; identical to SEQ ID NO: 278805

SEQ ID NO: 346912 - RNA, 62 nt, Human; identical to SEQ ID NO: 278806

SEQ ID NO: 346913 - RNA, 61 nt, Human
uaauauaaguaucuggugaaggaccaaaaccgugugauaagguugugugucgugugggagu

SEQ ID NO: 346914 - RNA, 61 nt, Human
cugaagcguuuguguguguguugaucagguugugugauauuuuugcuugauagagaaucaa

SEQ ID NO: 346915 - RNA, 61 nt, Human
uauaguaaagcugguagccuugaaaaugucagugugauaucuauuauguagauaaauauau

SEQ ID NO: 346916 - RNA, 61 nt, Human
gauggacaaugaaauaucaguugguggauaugugugauagcugauuucaauauugaaguau

SEQ ID NO: 346917 - RNA, 61 nt, Human
ccccgguggaggggcaaauggcugaauccuugugugauauuuuuuucuucgcuuguuuauu

SEQ ID NO: 346918 - RNA, 61 nt, Human
guucuggggugggaguuuugcucucugucaggugugauaaaauguugaacccuccccacca

SEQ ID NO: 346919 - RNA, 61 nt, Human
gaaccuugugccggccaggcccaguuuccuugugugauacacuaauguauuugcuuuuuuu

SEQ ID NO: 346920 - RNA, 61 nt, Human
gauuugacugggauguuuuaugagaauguaagugugauauuauacugucugccuugcugga

SEQ ID NO: 346921 - RNA, 61 nt, Human
cugcaugagcuagaauuuguucuagucuucugugugauacucauacuugcuguccagaggg

SEQ ID NO: 346922 - RNA, 61 nt, Human
ccuacaugggcagcaguggacuaagugcugggugugauaaagaggaaugacuuaauuauga

SEQ ID NO: 346923 - RNA, 61 nt, Human
caaaauguuuaccaauguuuuaagaagcuuugugugauauucuuccaaauguaguuaccaa

SEQ ID NO: 346924 - RNA, 61 nt, Human
ggauggagucaguuguucaggguccccgugugugugauaagcagugcuggcuggcugucuu

SEQ ID NO: 346925 - RNA, 61 nt, Human
gaaaacacacuuccagucuagaugaugcuuugugugauacauuaaguucuuauuuuggauu

SEQ ID NO: 346926 - RNA, 61 nt, Human
ggaaaccguccuguguacacaugggaguuuagugugauaaaggcaguauuucagacuggug

SEQ ID NO: 346927 - RNA, 61 nt, Human
cagaauuucaugcaaaugaggagugccagcagugugauaauuuaaacauauuuaaacaaaa

SEQ ID NO: 346928 - RNA, 61 nt, Human
uuuucucaggccugagggggaaccauuuuuggugugauaaauacccuaaacugccuuuuuu

SEQ ID NO: 346929 - RNA, 61 nt, Human
aaaugguuacccugcuucuuccuacaaugcugugugauaugggugaacccagccccugacc

SEQ ID NO: 346930 - RNA, 61 nt, Human
cauaggaugguaaugccagucccaggggagggugugauaguaaggaaggccacuguuaggu

SEQ ID NO: 346931 - RNA, 61 nt, Human
guggucacagucaucuaaccaaagugaucuagugugauagaucgaaauuaacauauuuuug

SEQ ID NO: 346932 - RNA, 61 nt, Human
ggcugugcaaauaaauggggcugaggccccugugugauauugaaaggguuguugugucugg

SEQ ID NO: 346933 - RNA, 61 nt, Human
uagagauuacagaauuuuuaaacagggagacgugugauauacucccucccuucccuacuau

SEQ ID NO: 346934 - RNA, 61 nt, Human
auguguguauauuauucaaaaaaauguacuggugugauaucuuguaugaaugaucauuuaa

SEQ ID NO: 346935 - RNA, 61 nt, Human
ugaaaucuuauaagguuucaguuugacagaagugugauauauguaacuugugccauggacc

SEQ ID NO: 346936 - RNA, 61 nt, Human
aauuuuuucaacuccuauuguguuucuuugugugugauauuuuaaucaaaagugguugagu

SEQ ID NO: 346937 - RNA, 61 nt, Human
auagugaaucaugacccuaagggagagauuugugugauaaaaguauuguauauaauagauc

SEQ ID NO: 346938 - RNA, 61 nt, Human
uucaggucucuaagccccuggaagcagcauugugugauauucucagaggcaggggaaaaua

SEQ ID NO: 346939 - RNA, 61 nt, Human
ugaaguuauuuguaauucagaaaccuugcuugugugauacauagucucuucauuuauuacu

SEQ ID NO: 346940 - RNA, 61 nt, Human
uauaauugguaauggauaacuuaauaaauuugugugauauaaaaguaguguaucauguucu

SEQ ID NO: 346941 - RNA, 61 nt, Human
cuacugauaaaauuaucccaaagguagguuggugugauaguuuccgaguaagaccuuaagg

SEQ ID NO: 346942 - RNA, 61 nt, Human
gauuaacagugaagaccuuguaaaugcagaugugugauaaagcauuuagucagucccccaa

SEQ ID NO: 346943 - RNA, 61 nt, Human
uuaucuuuuaaaacuucacuaauauagcauugugugauaagcacuaagcagucaguccccu

SEQ ID NO: 346944 - RNA, 61 nt, Human
uguacuccacaugcaacccaacagcagugcagugugauaacugagcggucgcauggcagag

SEQ ID NO: 346945 - RNA, 61 nt, Human
agguuuuguucaugcccccuuugacugaucagugugauaaggacuuuaggaaaaaaagcau

SEQ ID NO: 346946 - RNA, 61 nt, Human
guugcuagucaauguucuauauuuaaugaaugugugauaaaucauccuguaaucaguaugg

SEQ ID NO: 346947 - RNA, 61 nt, Human
ucuguauuccgauacaaaguguuguaucaaagugugauauacaaaguguaccaacauaagu

SEQ ID NO: 346948 - RNA, 61 nt, Human
uaguuauaaucaccuuguaucucuaaauauggugugauaugaaccaguccauucacauugg

SEQ ID NO: 346949 - RNA, 61 nt, Human
guaaaauugaaaauucauuugcuguuucaaagugugauaucuuucacaauagccuuuuuau

SEQ ID NO: 346950 - RNA, 61 nt, Human
gguuugaauuccagcucuacuauuuuugguugugugauagaguuauuuaaccucucugagc

SEQ ID NO: 346951 - RNA, 61 nt, Human
aacaggaucuaagcuuaggaauaauauuuaggugugauauaguguuagauuuuuuugaugu

SEQ ID NO: 346952 - RNA, 61 nt, Human
gcagagggggucauuccaggcccuccagugugugugauagucaccaugccaugcagggaua

SEQ ID NO: 346953 - RNA, 61 nt, Human
caguuucagcguucaaacagcaauagcucaagugugauaacuacugaggauaauaaaaucc

SEQ ID NO: 346954 - RNA, 61 nt, Human
uguauguaaaacccaaauaaagguagaguaagugugauauaugggaguauuaaaauagcuu

SEQ ID NO: 346955 - RNA, 61 nt, Human
cccaucccccgaccccaccacaguccccagagugugauauuccccuuccuguguccacgug

SEQ ID NO: 346956 - RNA, 61 nt, Human
aaaaaaaaacucaagauaguaaaagcaccuagugugauagauuaucgguuaggucauuugu

SEQ ID NO: 346957 - RNA, 61 nt, Human
cauuaaaaacaaauacuucuacuguuugggugugugauaggguucucaaugcagaucuccc

SEQ ID NO: 346958 - RNA, 61 nt, Human
ccugugugauucaguaggguuugagacuuacgugugauacugacagguaagcaacagugcu

SEQ ID NO: 346959 - RNA, 61 nt, Human
acauuucuaucacaaucauuuuauggaagaugugugauaaucuguuuuuacugguauuaau

SEQ ID NO: 346960 - RNA, 59 nt, Human; identical to SEQ ID NO: 278868

SEQ ID NO: 346961 - RNA, 61 nt, Human
agguauaaggagaaaggagauugguaaggaagugugauacauauugaaucaggugucaagg

SEQ ID NO: 346962 - RNA, 61 nt, Human
uuuccucccacuuagacucaaacacauuuuagugugauauuucauuuauuauagguaguau

SEQ ID NO: 346963 - RNA, 61 nt, Human
ucuagacugucucuguggaauauauuugugugugugauauaugcaugugugugaugguaug

SEQ ID NO: 346964 - RNA, 61 nt, Human
uuugcauugugaaaaaaacaaaauaaauuuugugugauaauuuugaugaugaaagguggaa

SEQ ID NO: 346965 - RNA, 61 nt, Human
cuaauaaaaaucuauaugacuuuuuauuauugugugauaaccaaguaaauguuuucuauuu

SEQ ID NO: 346966 - RNA, 61 nt, Human
aauaucuuauguguauauagcauccugagcugugugauacaguagauuucuucuuagcaga

SEQ ID NO: 346967 - RNA, 61 nt, Human
augaagaagaauaaaugaggguaaggggcuagugugauagggagaggggugggaugccauc

SEQ ID NO: 346968 - RNA, 61 nt, Human
gaaggauuuccuaacagcuuuagaaaucuuagugugauacaucucucauacaguuuggggu

SEQ ID NO: 346969 - RNA, 61 nt, Human
uuuuauguggcugcccaacguggagcgggcagugugauaggcugggugggcuaagcagccu

SEQ ID NO: 346970 - RNA, 61 nt, Human
aaaaacaaaaauguacaugugauguuaguaggugugauaugcaaccugguauacagacauu

SEQ ID NO: 346971 - RNA, 61 nt, Human
guuucugcagaucuuguggcauuugucucuagugugauauauaaagguguaauuaagacag

SEQ ID NO: 346972 - RNA, 61 nt, Human
gagcuuuuauauaaaguuuuaaaaauugaaugugugauauguguucuuugaagguuuuuua

SEQ ID NO: 346973 - RNA, 61 nt, Human
uucaaaguagccugacugugugcaugugugugugugauagguuauuuauaaagacuuugga

SEQ ID NO: 346974 - RNA, 61 nt, Human
gauguuagcuuuguggcagaauucccugcaugugugauaacugaucuuguuuuauuuuuug

SEQ ID NO: 346975 - RNA, 61 nt, Human
uucuguuuaauuacaucuguaaauauuaugugugugauaguauucaauaaaguaaaaucaa

SEQ ID NO: 346976 - RNA, 61 nt, Human
uggagugucuccuggagagagugaggagagugugugauagcuagaaagagagagagacaga

SEQ ID NO: 346977 - RNA, 61 nt, Human
uguauaaagaaucuaugacuuuuugagggaagugugauauauuaacaaauauaaccaauuc

SEQ ID NO: 346978 - RNA, 61 nt, Human
uggaggaaauaauauuuucaaacugucguuggugugauacuuuggcucaaaggaucuuugc

SEQ ID NO: 346979 - RNA, 61 nt, Human
uugcgauuugcacauauugaguuuauaacuugugugauauuccugcaguuuuuauccaaua

SEQ ID NO: 346980 - RNA, 61 nt, Human
uguuucuguuuguucccucccccucccccuugugugauaccacauguguauaguauuuaag

SEQ ID NO: 346981 - RNA, 61 nt, Human
ccauuaauuaccaagcccucacccagcccaugugugauaggauuuauguaggaagaaacuu

SEQ ID NO: 346982 - RNA, 61 nt, Human
ucuuuucuucuguaucucuguuacaagcguagugugauaauaccagauaauaaggaaaaca

SEQ ID NO: 346983 - RNA, 61 nt, Human
uuuagcaguauccccuucccacuuauauauugugugauaugauuuugcuugccuauaggag

SEQ ID NO: 346984 - RNA, 61 nt, Human
aauaggaaugguuuucucaagaauagauuuggugugauaccuuguguuugcuuacauuggc

SEQ ID NO: 346985 - RNA, 61 nt, Human
uucccucaucccaucacacaacuuuuuuugugugugauaaacugauuuugguuugcaauaa

SEQ ID NO: 346986 - RNA, 61 nt, Human
uuuuguucuuuucuugacuccuuucucaagugugugauaaggucugcugauaaaauauuua

SEQ ID NO: 346987 - RNA, 61 nt, Human
aaagucugaguaagaaacuucaugcuggccugugugauacaagagucagcaucauuaaagg

SEQ ID NO: 346988 - RNA, 61 nt, Human
agcaugcauuucucacaauaauuauuaagcugugugauaauuucugcuuucaggacacuca

SEQ ID NO: 346989 - RNA, 61 nt, Human
auucagacugacuucuacaggacuucuacgugugugauaaaagccugugaaucgugagucc

SEQ ID NO: 346990 - RNA, 61 nt, Human
gaaacugcuaaauauguauagagagguugacgugugauacgugggacaguucacauagaca

SEQ ID NO: 346991 - RNA, 61 nt, Human
acgccaaguggaagccacuggaccacaggaggugugauagagccuuugaucuucaggaugc

SEQ ID NO: 346992 - RNA, 61 nt, Human
aaccacugaagauugcuguaaauuauaaagggugugauagaauccacauggcugucaagaa

SEQ ID NO: 346993 - RNA, 61 nt, Human
cugagaacacagacaaugaccacuacccugggugugauaucacaggaggccagagagaggc

SEQ ID NO: 346994 - RNA, 61 nt, Human
aauuaagaauguugguuauuuucacgggagcgugugauauuuaacauuaauauuuuauuug

SEQ ID NO: 346995 - RNA, 61 nt, Human
auaggaugauuggaauuauuaauuuuuaaaggugugauaagauacugcacuuggcugggca

SEQ ID NO: 346996 - RNA, 61 nt, Human
aauacuuaaccacuaauuuugaaaauuaccagugugauacauaggaaucauuauucagaau

SEQ ID NO: 346997 - RNA, 61 nt, Human
uucuucccaggcaauacaccucugaacaugugugugauaaauggguuugcuaaugugcugu

SEQ ID NO: 346998 - RNA, 61 nt, Human
ccaagggcugacauggugugagugugugggugugugauaagcuucucaucccugcauagau

SEQ ID NO: 346999 - RNA, 61 nt, Human
uuacauuuuguuauuucuauuuuuauaaauugugugauaauuagagguaagaauaacaagu

SEQ ID NO: 347000 - RNA, 61 nt, Human
ugauuccuguauuauuucagugagagcuacagugugauauuucagagucuauuaaauaaaa

SEQ ID NO: 347001 - RNA, 61 nt, Human
agcucacuaggauuuugcugaacauuaaaaagugugauagcgauauuagugccaaucaaau

SEQ ID NO: 347002 - RNA, 61 nt, Human
cgcacuuggaguaauuuuuaugaaauacugcgugugauaagcaaacgggagaaauuuauau

SEQ ID NO: 347003 - RNA, 61 nt, Human
agagcaucccuaugggcuuggaccacuuacagugugauaaggccuacuauacauuaggaag

SEQ ID NO: 347004 - RNA, 61 nt, Human
auugcauacacaugccuccaugcauauaugugugugauaauacacaugcauuuaugugcgu

SEQ ID NO: 347005 - RNA, 61 nt, Human
uauuauuguguauaucuaauauauuaaguaugugugauacuaagguuugacugcuauaauu

SEQ ID NO: 347006 - RNA, 61 nt, Human
aaagaaaucaauggaacccuugcacaaaaaagugugauaaauauuuuuaaauaaaaacuua

SEQ ID NO: 347007 - RNA, 61 nt, Human
uggauucuuccauccugccggaugagugugggugugauacagccuacauaaagacuguuau

SEQ ID NO: 347008 - RNA, 61 nt, Human
uaguggcuacugauguucaagugggauugaagugugauaaauggauauauuuuguuguuug

SEQ ID NO: 347009 - RNA, 61 nt, Human
uucuaauuaguggaucuuuuuccacuggaaagugugauagcucauugcuaauuuuucauuc

SEQ ID NO: 347010 - RNA, 61 nt, Human
uuugcucugggucaggaagaagcuguucacggugugauaauacucuuuagauugugcuuuc

SEQ ID NO: 347011 - RNA, 61 nt, Human
gaacagauuuuucauuguaauaguggaaguugugugauaguuaggagauaucaacaugcau

SEQ ID NO: 347012 - RNA, 61 nt, Human
guacguauguguguguucuacaagaacggaagugugauauguuuaaagaugaucagagaaa

SEQ ID NO: 347013 - RNA, 61 nt, Human
agaaauaagaagaaaacaggugaaaaagacagugugauaaggccauggugguggauugugg

SEQ ID NO: 347014 - RNA, 61 nt, Human
ucaguugguggguguuaagcuagaaugggcugugugauaggaaacaaaugccuuacagaug

SEQ ID NO: 347015 - RNA, 61 nt, Human
ucucuauugucacccaggcuggagugugguggugugauaauagcucaccuugaccuccuag

SEQ ID NO: 347016 - RNA, 61 nt, Human
uuuuuuuuuuuuuuuuacaaaaugaugauuagugugauaaugugcugcaaaaaauauccaa

SEQ ID NO: 347017 - RNA, 61 nt, Human
uaacuuaugaaaaaauuauuuggggacaggagugugauaccuuccuugguuuuuuuuugca

SEQ ID NO: 347018 - RNA, 61 nt, Human
aaaagcuuuucaacagccuuucuauaucaucgugugauaauuguucaccaaugaaugaguc

SEQ ID NO: 347019 - RNA, 61 nt, Human
gacucaguuucuccacagccuucuccagccugugugauacaaguuugaucccaggaacuug

SEQ ID NO: 347020 - RNA, 61 nt, Human
guccucagcaacugucuggauccugacaggugugugauaauuacuuagugaauucaugggu

SEQ ID NO: 347021 - RNA, 61 nt, Human
cgcuuuauccaccauaacguaaagaacugcggugugauaacagccuucacggggccacggu

SEQ ID NO: 347022 - RNA, 61 nt, Human
auaaaaauuuaaagugagaggcaugguuagugugugauacaauaaaaaguaauuguuuggu

SEQ ID NO: 347023 - RNA, 61 nt, Human
uccccuuuuuuuaaaaaggacuguuuugcuagugugauaaugaauagguaagauaugagau

SEQ ID NO: 347024 - RNA, 61 nt, Human
caaucacucagccccuccaaagauaguugaugugugauaaucucauaauguugagaacccu

SEQ ID NO: 347025 - RNA, 61 nt, Human
aggguagaccuggaccugccaccuaugaguugugugauauagaaaaaaaucucuuagcucu

SEQ ID NO: 347026 - RNA, 61 nt, Human
cuguaaauaaaaucuuugaucacaccacucagugugauaauugugucuacagcuaaaaugg

SEQ ID NO: 347027 - RNA, 61 nt, Human
aagaugaaacaggacaggagagaacuguucagugugauacagagcugccauuuccaaagua

SEQ ID NO: 347028 - RNA, 61 nt, Human
acauaugugauuguuccauaauaaacuucuggugugauacuuucaucuuguaaaucugcuu

SEQ ID NO: 347029 - RNA, 61 nt, Human
aggccggucaccagaagccagcaggcguggggugugauacucucuauagccacuacagggc

SEQ ID NO: 347030 - RNA, 61 nt, Human
uauccaucuauacuuggcagcaacaugagaagugugauacaugugaacccaacaaauucaa

SEQ ID NO: 347031 - RNA, 61 nt, Human
auaaauucaagcacuaccacuggucaguuuugugugauagaauaaaaauauguuaccugca

SEQ ID NO: 347032 - RNA, 61 nt, Human
ccuugucaagcuuucuucuguggucugauuagugugauaccggggcaccuccucugguacu

SEQ ID NO: 347033 - RNA, 61 nt, Human
guaugcagaggaguuuucaagaggcuaucuggugugauauuguaauaggcugaaugcaaaa

SEQ ID NO: 347034 - RNA, 61 nt, Human
uaugguuaguuuugcagguuugcauccagcugugugauauucugcugugcaaauccaugca

SEQ ID NO: 347035 - RNA, 61 nt, Human
uacacuagcaauuuuuuuaaaaacuggaacagugugauaggaagccugcuggaugauuucu

SEQ ID NO: 347036 - RNA, 61 nt, Human
ucaugaacagcguaaguuccuacacacggacgugugauacacacaugcauguacagguaag

SEQ ID NO: 347037 - RNA, 61 nt, Human
agucuaucagggaggcugaagcaagggcgcagugugauauuuuaggaauacagaagauuua

SEQ ID NO: 347038 - RNA, 61 nt, Human
uggccguccuugucucugggccacuuggagugugugauaaaucagucaagcuguugaaguc

SEQ ID NO: 347039 - RNA, 61 nt, Human
aaaacuugaaagaacacuucuaagccuaagugugugauacaguuuguuacuuuuaaguaca

SEQ ID NO: 347040 - RNA, 61 nt, Human
cauuugagaauuuuuuuuguacagcauucaugugugauauuuuccagauuuguuggaucua

SEQ ID NO: 347041 - RNA, 61 nt, Human
uacucacauggauuuuuaagauaaaucaccugugugauaauauuuugaaucugagacgaau

SEQ ID NO: 347042 - RNA, 61 nt, Human
gugaauguaucauguuuuacuuuaaaugugugugugauacuucuucauuauguccugcgcu

SEQ ID NO: 347043 - RNA, 61 nt, Human
agaaguuaauuuuugaaaaugacauauuuuugugugauagaaagaauggagcaaguugugc

SEQ ID NO: 347044 - RNA, 61 nt, Human
uaacaaaacccaguagucaccaaggcagguagugugauaaaugaacacaccacucugaggc

SEQ ID NO: 347045 - RNA, 61 nt, Human
uuuacuuuuguauauaaaucuaagacugccugugugauaaaacacuuguuuaaaaaaaaaa

SEQ ID NO: 347046 - RNA, 61 nt, Human
gacacgcuugguuugcucuauuuuuguuuaugugugauagugguucugucaucaucauuca

SEQ ID NO: 347047 - RNA, 61 nt, Human
ugucaccuugaugggggcugugaguggggcagugugauacccagugacuagacgcacucug

SEQ ID NO: 347048 - RNA, 61 nt, Human
uagguugaugcauuuuguacuuagcuguacugugugauauuuuucauuauuuuaggacgcc

SEQ ID NO: 347049 - RNA, 61 nt, Human
auccacggugggugaguggccaagacaagcagugugauagaguccuugguggguuuaguca

SEQ ID NO: 347050 - RNA, 61 nt, Human
uuaaugaacauuugucuuucagaauaggauugugugauaauguuuaaauggcaaaaacaaa

SEQ ID NO: 347051 - RNA, 61 nt, Human
acuguauuuaguuugugauaaauuuuucacugugugauauuuaugcucuaaaucacuacac

SEQ ID NO: 347052 - RNA, 61 nt, Human
aggaacccuggcaucuuuucuauauuauccagugugauaaucuuuucacguuuuauagagc

SEQ ID NO: 347053 - RNA, 61 nt, Human
caagaauaccacuuuugaaguuaauccuuuugugugauacaggaugaacuugggauguuug

SEQ ID NO: 347054 - RNA, 61 nt, Human
uccauauauuuauuuguuuggaaucacucuugugugauauaaaggcguguauauuaucuuu

SEQ ID NO: 347055 - RNA, 61 nt, Human
gguuggagugacuggugggccuagaucacuggugugauaaaccccaauuuucaccccgggg

SEQ ID NO: 347056 - RNA, 61 nt, Human
cuacguacuuauaucagcaccauguauguaggugugauaguacuuucaaacagcgccucca

SEQ ID NO: 347057 - RNA, 61 nt, Human
cggcaauagacuggaacgauuaaggaccauggugugauagaucccauuucaaaugauucca

SEQ ID NO: 347058 - RNA, 61 nt, Human
agugaaaggguagggggauaguccugaucaagugugauaaauuuuuauagacauauauaaa

SEQ ID NO: 347059 - RNA, 61 nt, Human
agagaaggaaauuuuaucaauuaaaaaugcugugugauaaaaucccagcccagauugcuca

SEQ ID NO: 347060 - RNA, 61 nt, Human
uuucaaaagacaguguugaauaaacauaccugugugauaaaacacagaauuuacauauaca

SEQ ID NO: 347061 - RNA, 61 nt, Human
uuuuuuuuuuuaguguguguuuucccuccaagugugauauuuccugcugaauuaaauuaua

SEQ ID NO: 347062 - RNA, 61 nt, Human
acagucugauuuagaagucaucuuuucagccgugugauaauuaacaugguaagccuuagca

SEQ ID NO: 347063 - RNA, 61 nt, Human
uuuaaauuggucagucagguagaagauacaugugugauauagaaaaauaaugccucuccug

SEQ ID NO: 347064 - RNA, 61 nt, Human
uuuaaagacucauccccagccuccaccuccugugugauacuugggggcuagcuuuuuucuu

SEQ ID NO: 347065 - RNA, 61 nt, Human
guaugauauaaaguuauagucauuuaaaaaugugugauauuaguacauuaguagguaaaug

SEQ ID NO: 347066 - RNA, 61 nt, Human
ucaucauugccuuuccacuacucuacuaucugugugauauuagacaaaauauuugcuucuu

SEQ ID NO: 347067 - RNA, 61 nt, Human
acguaaguguuguacauauuuaugggguacagugugauauuuaaauauauguauaugaugu

SEQ ID NO: 347068 - RNA, 61 nt, Human
acauaacuguuguacucauuuaugggguacagugugauaguuaaugcaaguauacaaugug

SEQ ID NO: 347069 - RNA, 61 nt, Human
augauggugaugaaucuauuaaucaugaugagugugauaggggugcucuucaagacuuaga

SEQ ID NO: 347070 - RNA, 61 nt, Human
guagcuuuguaggauauuuggggauuccauagugugauauccccuucuucccuuugcucaa

SEQ ID NO: 347071 - RNA, 61 nt, Human
gguaagaacaguaauuggcccagacagguaggugugauaaacagaguagaaaagauugugg

SEQ ID NO: 347072 - RNA, 61 nt, Human
aauauuagauaauauuaagaaacuuuguuaugugugauaauagcauugugguuauguaaaa

SEQ ID NO: 347073 - RNA, 61 nt, Human
ucuagucugcauaggaagggaacaccuggacgugugauaaauagguuagcacuucaguuac

SEQ ID NO: 347074 - RNA, 61 nt, Human
ccugacccuuccugucccagggcccaggucugugugauaucuguauauauugcauuuuguu

SEQ ID NO: 347075 - RNA, 61 nt, Human
uuaauugcauccuaucagauuguugaggugggugugauagucuucaggugcagugcguuca

SEQ ID NO: 347076 - RNA, 61 nt, Human
uuccucuuccugugcaaauuccucuagucaagugugauauaucaagaaaucugaggaggau

SEQ ID NO: 347077 - RNA, 61 nt, Human
aucccauuuccgucugcccccucgucaccaggugugauagccccagccaggucacaccugg

SEQ ID NO: 347078 - RNA, 61 nt, Human
gcacaccacuggcgugagacagcgcuugguggugugauacuuuuggugcuguguauaguau

SEQ ID NO: 347079 - RNA, 61 nt, Human
acucuaaaguucugacuucaaucaacgguuagugugauacugccaaagaacuguauacugu

SEQ ID NO: 347080 - RNA, 61 nt, Human
ucucuucagaaauaagaagcuauuucauuaagugugauauaaaccuccucaaacauuuuac

SEQ ID NO: 347081 - RNA, 61 nt, Human
gacaaucgggagaagauagcaagaugcuagugugugauacgugugacaaaggguaucauac

SEQ ID NO: 347082 - RNA, 61 nt, Human
uauuuauugaucaucucuucuccauaagauagugugauaaacacagucaugaauaaaguua

SEQ ID NO: 347083 - RNA, 61 nt, Human
auuuauaugcacugaugaggaaagacauacugugugauagggagaaaaagcagcuuauaaa

SEQ ID NO: 347084 - RNA, 61 nt, Human
aguuugcuguuaauuuaugcauuugaagccagugugauacagccaucuguaccuacuggag

SEQ ID NO: 347085 - RNA, 61 nt, Human
agguagcagggggagugcuggucacaccccugugugauaugugaugcccucggcaaagaau

SEQ ID NO: 347086 - RNA, 61 nt, Human
acuugggcuaaaaucaaaccuuggcacacaggugugauacaacuuaacaggaaucaucgau

SEQ ID NO: 347087 - RNA, 61 nt, Human
uuaagaucucuaccacuccaaucgauguuuagugugauaggacaucaccauuucaaggccc

SEQ ID NO: 347088 - RNA, 61 nt, Human
ccuguagauaucaucuuuucucagauauuuugugugauacucugugguguucuguucaugu

SEQ ID NO: 347089 - RNA, 61 nt, Human
agaagaaaucuuacggaguuugccaugggaugugugauaucagcagucuucagcuccuuac

SEQ ID NO: 347090 - RNA, 61 nt, Human
ccccucccccgaccccaccacaguccccagagugugauauuccccuuccuguguccaugug

SEQ ID NO: 347091 - RNA, 61 nt, Human
aauugauuccucugacuuugcuauugauguagugugauagaaaauucaccccucugaacug

SEQ ID NO: 347092 - RNA, 61 nt, Human
uucuuuuuuucucuagaguagagguauaauugugugauauuucagaaauacagauaaauga

SEQ ID NO: 347093 - RNA, 61 nt, Human
ugaguauuugugccuagggcuugggcuguuugugugauaccggccccccgccagacaauag

SEQ ID NO: 347094 - RNA, 61 nt, Human
caaggccccauccauuaguuuccacugccucgugugauaugaggcccauucuucacucuuu

SEQ ID NO: 347095 - RNA, 61 nt, Human
cagggccccauccauuagcuuccacugccucgugugauaugaggcccauuccugccucuuu

SEQ ID NO: 347096 - RNA, 61 nt, Human; identical to SEQ ID NO: 279034

SEQ ID NO: 347097 - RNA, 61 nt, Human; identical to SEQ ID NO: 279035

SEQ ID NO: 347098 - RNA, 61 nt, Human; identical to SEQ ID NO: 279036

SEQ ID NO: 347099 - RNA, 61 nt, Human; identical to SEQ ID NO: 279037

SEQ ID NO: 347100 - RNA, 61 nt, Human; identical to SEQ ID NO: 279038

SEQ ID NO: 347101 - RNA, 61 nt, Human; identical to SEQ ID NO: 279039

SEQ ID NO: 347102 - RNA, 61 nt, Human; identical to SEQ ID NO: 279040

SEQ ID NO: 347103 - RNA, 61 nt, Human; identical to SEQ ID NO: 279044

SEQ ID NO: 347104 - RNA, 61 nt, Human; identical to SEQ ID NO: 279045

SEQ ID NO: 347105 - RNA, 61 nt, Human; identical to SEQ ID NO: 279046

SEQ ID NO: 347106 - RNA, 61 nt, Human; identical to SEQ ID NO: 279047

SEQ ID NO: 347107 - RNA, 61 nt, Human; identical to SEQ ID NO: 279048

SEQ ID NO: 347108 - RNA, 61 nt, Human; identical to SEQ ID NO: 279049

SEQ ID NO: 347109 - RNA, 61 nt, Human; identical to SEQ ID NO: 279050

SEQ ID NO: 347110 - RNA, 61 nt, Human; identical to SEQ ID NO: 279051

SEQ ID NO: 347111 - RNA, 61 nt, Human; identical to SEQ ID NO: 279052

SEQ ID NO: 347112 - RNA, 61 nt, Human; identical to SEQ ID NO: 279053

SEQ ID NO: 347113 - RNA, 61 nt, Human; identical to SEQ ID NO: 279054

SEQ ID NO: 347114 - RNA, 61 nt, Human; identical to SEQ ID NO: 279055

SEQ ID NO: 347115 - RNA, 61 nt, Human; identical to SEQ ID NO: 279056

SEQ ID NO: 347116 - RNA, 61 nt, Human; identical to SEQ ID NO: 279060

SEQ ID NO: 347117 - RNA, 61 nt, Human; identical to SEQ ID NO: 279061

SEQ ID NO: 347118 - RNA, 61 nt, Human; identical to SEQ ID NO: 279062

SEQ ID NO: 347119 - RNA, 61 nt, Human; identical to SEQ ID NO: 279063

SEQ ID NO: 347120 - RNA, 61 nt, Human; identical to SEQ ID NO: 279064

SEQ ID NO: 347121 - RNA, 61 nt, Human; identical to SEQ ID NO: 279065

SEQ ID NO: 347122 - RNA, 61 nt, Human; identical to SEQ ID NO: 279066

SEQ ID NO: 347123 - RNA, 61 nt, Human; identical to SEQ ID NO: 279067

SEQ ID NO: 347124 - RNA, 61 nt, Human; identical to SEQ ID NO: 279068

SEQ ID NO: 347125 - RNA, 61 nt, Human; identical to SEQ ID NO: 279069

SEQ ID NO: 347126 - RNA, 61 nt, Human; identical to SEQ ID NO: 279070

SEQ ID NO: 347127 - RNA, 61 nt, Human; identical to SEQ ID NO: 279071

SEQ ID NO: 347128 - RNA, 61 nt, Human; identical to SEQ ID NO: 279072

SEQ ID NO: 347129 - RNA, 61 nt, Human; identical to SEQ ID NO: 279076

SEQ ID NO: 347130 - RNA, 61 nt, Human; identical to SEQ ID NO: 279077

SEQ ID NO: 347131 - RNA, 61 nt, Human; identical to SEQ ID NO: 279078

SEQ ID NO: 347132 - RNA, 61 nt, Human; identical to SEQ ID NO: 279079

SEQ ID NO: 347133 - RNA, 61 nt, Human; identical to SEQ ID NO: 279080

SEQ ID NO: 347134 - RNA, 61 nt, Human; identical to SEQ ID NO: 279081

SEQ ID NO: 347135 - RNA, 61 nt, Human; identical to SEQ ID NO: 279082

SEQ ID NO: 347136 - RNA, 61 nt, Human; identical to SEQ ID NO: 279083

SEQ ID NO: 347137 - RNA, 61 nt, Human; identical to SEQ ID NO: 279084

SEQ ID NO: 347138 - RNA, 61 nt, Human; identical to SEQ ID NO: 279085

SEQ ID NO: 347139 - RNA, 61 nt, Human; identical to SEQ ID NO: 279086

SEQ ID NO: 347140 - RNA, 61 nt, Human; identical to SEQ ID NO: 279087

SEQ ID NO: 347141 - RNA, 61 nt, Human; identical to SEQ ID NO: 279088

SEQ ID NO: 347142 - RNA, 61 nt, Human; identical to SEQ ID NO: 279092

SEQ ID NO: 347143 - RNA, 61 nt, Human; identical to SEQ ID NO: 279093

SEQ ID NO: 347144 - RNA, 61 nt, Human; identical to SEQ ID NO: 279094

SEQ ID NO: 347145 - RNA, 61 nt, Human; identical to SEQ ID NO: 279095

SEQ ID NO: 347146 - RNA, 61 nt, Human; identical to SEQ ID NO: 279096

SEQ ID NO: 347147 - RNA, 61 nt, Human; identical to SEQ ID NO: 279097

SEQ ID NO: 347148 - RNA, 61 nt, Human; identical to SEQ ID NO: 279098

SEQ ID NO: 347149 - RNA, 61 nt, Human; identical to SEQ ID NO: 279099

SEQ ID NO: 347150 - RNA, 61 nt, Human; identical to SEQ ID NO: 279100

SEQ ID NO: 347151 - RNA, 61 nt, Human; identical to SEQ ID NO: 279101

SEQ ID NO: 347152 - RNA, 61 nt, Human; identical to SEQ ID NO: 279102

SEQ ID NO: 347153 - RNA, 61 nt, Human; identical to SEQ ID NO: 279103

SEQ ID NO: 347154 - RNA, 61 nt, Human; identical to SEQ ID NO: 279104

SEQ ID NO: 347155 - RNA, 61 nt, Human; identical to SEQ ID NO: 279108

SEQ ID NO: 347156 - RNA, 61 nt, Human; identical to SEQ ID NO: 279109

SEQ ID NO: 347157 - RNA, 61 nt, Human; identical to SEQ ID NO: 279110

SEQ ID NO: 347158 - RNA, 61 nt, Human; identical to SEQ ID NO: 279111

SEQ ID NO: 347159 - RNA, 61 nt, Human; identical to SEQ ID NO: 279112

SEQ ID NO: 347160 - RNA, 61 nt, Human; identical to SEQ ID NO: 279113

SEQ ID NO: 347161 - RNA, 61 nt, Human; identical to SEQ ID NO: 279114

SEQ ID NO: 347162 - RNA, 61 nt, Human; identical to SEQ ID NO: 279115

SEQ ID NO: 347163 - RNA, 61 nt, Human; identical to SEQ ID NO: 279116

SEQ ID NO: 347164 - RNA, 61 nt, Human; identical to SEQ ID NO: 279117

SEQ ID NO: 347165 - RNA, 61 nt, Human; identical to SEQ ID NO: 279118

SEQ ID NO: 347166 - RNA, 61 nt, Human; identical to SEQ ID NO: 279119

SEQ ID NO: 347167 - RNA, 61 nt, Human; identical to SEQ ID NO: 279120

SEQ ID NO: 347168 - RNA, 61 nt, Human; identical to SEQ ID NO: 279124

SEQ ID NO: 347169 - RNA, 61 nt, Human; identical to SEQ ID NO: 279125

SEQ ID NO: 347170 - RNA, 61 nt, Human; identical to SEQ ID NO: 279126

SEQ ID NO: 347171 - RNA, 61 nt, Human; identical to SEQ ID NO: 279127

SEQ ID NO: 347172 - RNA, 61 nt, Human; identical to SEQ ID NO: 279128

SEQ ID NO: 347173 - RNA, 61 nt, Human; identical to SEQ ID NO: 279129

SEQ ID NO: 347174 - RNA, 61 nt, Human; identical to SEQ ID NO: 279130

SEQ ID NO: 347175 - RNA, 61 nt, Human; identical to SEQ ID NO: 279131

SEQ ID NO: 347176 - RNA, 61 nt, Human; identical to SEQ ID NO: 279132

SEQ ID NO: 347177 - RNA, 61 nt, Human; identical to SEQ ID NO: 279133

SEQ ID NO: 347178 - RNA, 61 nt, Human; identical to SEQ ID NO: 279134

SEQ ID NO: 347179 - RNA, 61 nt, Human; identical to SEQ ID NO: 279135

SEQ ID NO: 347180 - RNA, 61 nt, Human; identical to SEQ ID NO: 279136

SEQ ID NO: 347181 - RNA, 61 nt, Human; identical to SEQ ID NO: 279140

SEQ ID NO: 347182 - RNA, 61 nt, Human; identical to SEQ ID NO: 279141

SEQ ID NO: 347183 - RNA, 61 nt, Human; identical to SEQ ID NO: 279142

SEQ ID NO: 347184 - RNA, 61 nt, Human; identical to SEQ ID NO: 279143

SEQ ID NO: 347185 - RNA, 61 nt, Human; identical to SEQ ID NO: 279144

SEQ ID NO: 347186 - RNA, 61 nt, Human; identical to SEQ ID NO: 279145

SEQ ID NO: 347187 - RNA, 61 nt, Human; identical to SEQ ID NO: 279146

SEQ ID NO: 347188 - RNA, 61 nt, Human; identical to SEQ ID NO: 279147

SEQ ID NO: 347189 - RNA, 61 nt, Human; identical to SEQ ID NO: 279148

SEQ ID NO: 347190 - RNA, 61 nt, Human; identical to SEQ ID NO: 279149

SEQ ID NO: 347191 - RNA, 61 nt, Human; identical to SEQ ID NO: 279150

SEQ ID NO: 347192 - RNA, 61 nt, Human; identical to SEQ ID NO: 279151

SEQ ID NO: 347193 - RNA, 61 nt, Human; identical to SEQ ID NO: 279152

SEQ ID NO: 347194 - RNA, 61 nt, Human; identical to SEQ ID NO: 279156

SEQ ID NO: 347195 - RNA, 61 nt, Human; identical to SEQ ID NO: 279157

SEQ ID NO: 347196 - RNA, 61 nt, Human; identical to SEQ ID NO: 279158

SEQ ID NO: 347197 - RNA, 61 nt, Human; identical to SEQ ID NO: 279159

SEQ ID NO: 347198 - RNA, 61 nt, Human; identical to SEQ ID NO: 279160

SEQ ID NO: 347199 - RNA, 61 nt, Human; identical to SEQ ID NO: 279161

SEQ ID NO: 347200 - RNA, 61 nt, Human; identical to SEQ ID NO: 279162

SEQ ID NO: 347201 - RNA, 61 nt, Human; identical to SEQ ID NO: 279163

SEQ ID NO: 347202 - RNA, 61 nt, Human; identical to SEQ ID NO: 279164

SEQ ID NO: 347203 - RNA, 61 nt, Human; identical to SEQ ID NO: 279165

SEQ ID NO: 347204 - RNA, 61 nt, Human; identical to SEQ ID NO: 279166

SEQ ID NO: 347205 - RNA, 61 nt, Human; identical to SEQ ID NO: 279167

SEQ ID NO: 347206 - RNA, 61 nt, Human; identical to SEQ ID NO: 279168

SEQ ID NO: 347207 - RNA, 61 nt, Human; identical to SEQ ID NO: 279173

SEQ ID NO: 347208 - RNA, 61 nt, Human; identical to SEQ ID NO: 279174

SEQ ID NO: 347209 - RNA, 61 nt, Human; identical to SEQ ID NO: 279175

SEQ ID NO: 347210 - RNA, 61 nt, Human; identical to SEQ ID NO: 279176

SEQ ID NO: 347211 - RNA, 61 nt, Human; identical to SEQ ID NO: 279177

SEQ ID NO: 347212 - RNA, 61 nt, Human; identical to SEQ ID NO: 279178

SEQ ID NO: 347213 - RNA, 61 nt, Human; identical to SEQ ID NO: 279179

SEQ ID NO: 347214 - RNA, 61 nt, Human; identical to SEQ ID NO: 279180

SEQ ID NO: 347215 - RNA, 61 nt, Human; identical to SEQ ID NO: 279181

SEQ ID NO: 347216 - RNA, 61 nt, Human; identical to SEQ ID NO: 279182

SEQ ID NO: 347217 - RNA, 61 nt, Human; identical to SEQ ID NO: 279183

SEQ ID NO: 347218 - RNA, 61 nt, Human; identical to SEQ ID NO: 279184

SEQ ID NO: 347219 - RNA, 61 nt, Human; identical to SEQ ID NO: 279185

SEQ ID NO: 347220 - RNA, 61 nt, Human; identical to SEQ ID NO: 279190

SEQ ID NO: 347221 - RNA, 61 nt, Human; identical to SEQ ID NO: 279191

SEQ ID NO: 347222 - RNA, 61 nt, Human; identical to SEQ ID NO: 279192

SEQ ID NO: 347223 - RNA, 61 nt, Human; identical to SEQ ID NO: 279193

SEQ ID NO: 347224 - RNA, 61 nt, Human; identical to SEQ ID NO: 279194

SEQ ID NO: 347225 - RNA, 61 nt, Human; identical to SEQ ID NO: 279195

SEQ ID NO: 347226 - RNA, 61 nt, Human; identical to SEQ ID NO: 279196

SEQ ID NO: 347227 - RNA, 61 nt, Human; identical to SEQ ID NO: 279197

SEQ ID NO: 347228 - RNA, 61 nt, Human; identical to SEQ ID NO: 279198

SEQ ID NO: 347229 - RNA, 61 nt, Human; identical to SEQ ID NO: 279199

SEQ ID NO: 347230 - RNA, 61 nt, Human; identical to SEQ ID NO: 279200

SEQ ID NO: 347231 - RNA, 61 nt, Human; identical to SEQ ID NO: 279201

SEQ ID NO: 347232 - RNA, 61 nt, Human; identical to SEQ ID NO: 279202

SEQ ID NO: 347233 - RNA, 61 nt, Human; identical to SEQ ID NO: 279207

SEQ ID NO: 347234 - RNA, 61 nt, Human; identical to SEQ ID NO: 279208

SEQ ID NO: 347235 - RNA, 61 nt, Human; identical to SEQ ID NO: 279209

SEQ ID NO: 347236 - RNA, 61 nt, Human; identical to SEQ ID NO: 279210

SEQ ID NO: 347237 - RNA, 61 nt, Human; identical to SEQ ID NO: 279211

SEQ ID NO: 347238 - RNA, 61 nt, Human; identical to SEQ ID NO: 279212

SEQ ID NO: 347239 - RNA, 61 nt, Human; identical to SEQ ID NO: 279213

SEQ ID NO: 347240 - RNA, 61 nt, Human; identical to SEQ ID NO: 279214

SEQ ID NO: 347241 - RNA, 61 nt, Human; identical to SEQ ID NO: 279215

SEQ ID NO: 347242 - RNA, 61 nt, Human; identical to SEQ ID NO: 279216

SEQ ID NO: 347243 - RNA, 61 nt, Human; identical to SEQ ID NO: 279217

SEQ ID NO: 347244 - RNA, 61 nt, Human; identical to SEQ ID NO: 279218

SEQ ID NO: 347245 - RNA, 61 nt, Human; identical to SEQ ID NO: 279219

SEQ ID NO: 347246 - RNA, 61 nt, Human; identical to SEQ ID NO: 279224

SEQ ID NO: 347247 - RNA, 61 nt, Human; identical to SEQ ID NO: 279225

SEQ ID NO: 347248 - RNA, 61 nt, Human; identical to SEQ ID NO: 279226

SEQ ID NO: 347249 - RNA, 61 nt, Human; identical to SEQ ID NO: 279227

SEQ ID NO: 347250 - RNA, 61 nt, Human; identical to SEQ ID NO: 279228

SEQ ID NO: 347251 - RNA, 61 nt, Human; identical to SEQ ID NO: 279229

SEQ ID NO: 347252 - RNA, 61 nt, Human; identical to SEQ ID NO: 279230

SEQ ID NO: 347253 - RNA, 61 nt, Human; identical to SEQ ID NO: 279231

SEQ ID NO: 347254 - RNA, 61 nt, Human; identical to SEQ ID NO: 279232

SEQ ID NO: 347255 - RNA, 61 nt, Human; identical to SEQ ID NO: 279233

SEQ ID NO: 347256 - RNA, 61 nt, Human; identical to SEQ ID NO: 279234

SEQ ID NO: 347257 - RNA, 61 nt, Human; identical to SEQ ID NO: 279235

SEQ ID NO: 347258 - RNA, 61 nt, Human; identical to SEQ ID NO: 279236

SEQ ID NO: 347259 - RNA, 61 nt, Human; identical to SEQ ID NO: 279241

SEQ ID NO: 347260 - RNA, 61 nt, Human; identical to SEQ ID NO: 279242

SEQ ID NO: 347261 - RNA, 61 nt, Human; identical to SEQ ID NO: 279243

SEQ ID NO: 347262 - RNA, 61 nt, Human; identical to SEQ ID NO: 279244

SEQ ID NO: 347263 - RNA, 61 nt, Human; identical to SEQ ID NO: 279245

SEQ ID NO: 347264 - RNA, 61 nt, Human; identical to SEQ ID NO: 279246

SEQ ID NO: 347265 - RNA, 61 nt, Human; identical to SEQ ID NO: 279247

SEQ ID NO: 347266 - RNA, 61 nt, Human; identical to SEQ ID NO: 279248

SEQ ID NO: 347267 - RNA, 61 nt, Human; identical to SEQ ID NO: 279249

SEQ ID NO: 347268 - RNA, 61 nt, Human; identical to SEQ ID NO: 279250

SEQ ID NO: 347269 - RNA, 61 nt, Human; identical to SEQ ID NO: 279251

SEQ ID NO: 347270 - RNA, 61 nt, Human; identical to SEQ ID NO: 279252

SEQ ID NO: 347271 - RNA, 61 nt, Human; identical to SEQ ID NO: 279253

SEQ ID NO: 347272 - RNA, 61 nt, Human; identical to SEQ ID NO: 279258

SEQ ID NO: 347273 - RNA, 61 nt, Human; identical to SEQ ID NO: 279259

SEQ ID NO: 347274 - RNA, 61 nt, Human; identical to SEQ ID NO: 279260

SEQ ID NO: 347275 - RNA, 61 nt, Human; identical to SEQ ID NO: 279261

SEQ ID NO: 347276 - RNA, 61 nt, Human; identical to SEQ ID NO: 279262

SEQ ID NO: 347277 - RNA, 61 nt, Human; identical to SEQ ID NO: 279263

SEQ ID NO: 347278 - RNA, 61 nt, Human; identical to SEQ ID NO: 279264

SEQ ID NO: 347279 - RNA, 61 nt, Human; identical to SEQ ID NO: 279265

SEQ ID NO: 347280 - RNA, 61 nt, Human; identical to SEQ ID NO: 279266

SEQ ID NO: 347281 - RNA, 61 nt, Human; identical to SEQ ID NO: 279267

SEQ ID NO: 347282 - RNA, 61 nt, Human; identical to SEQ ID NO: 279268

SEQ ID NO: 347283 - RNA, 61 nt, Human; identical to SEQ ID NO: 279269

SEQ ID NO: 347284 - RNA, 61 nt, Human; identical to SEQ ID NO: 279270

SEQ ID NO: 347285 - RNA, 61 nt, Human; identical to SEQ ID NO: 279275

SEQ ID NO: 347286 - RNA, 61 nt, Human; identical to SEQ ID NO: 279276

SEQ ID NO: 347287 - RNA, 61 nt, Human; identical to SEQ ID NO: 279277

SEQ ID NO: 347288 - RNA, 61 nt, Human; identical to SEQ ID NO: 279278

SEQ ID NO: 347289 - RNA, 61 nt, Human; identical to SEQ ID NO: 279279

SEQ ID NO: 347290 - RNA, 61 nt, Human; identical to SEQ ID NO: 279280

SEQ ID NO: 347291 - RNA, 61 nt, Human; identical to SEQ ID NO: 279281

SEQ ID NO: 347292 - RNA, 61 nt, Human; identical to SEQ ID NO: 279282

SEQ ID NO: 347293 - RNA, 61 nt, Human; identical to SEQ ID NO: 279283

SEQ ID NO: 347294 - RNA, 60 nt, Human
aucugccaugugaagagaauuaacaauaaaagugugaagagcgauugugaggaacaagcc

SEQ ID NO: 347295 - RNA, 60 nt, Human
gagacuucuucccuucaggcuuauuguuugagugugaaguuccagagcaaggagccaugu

SEQ ID NO: 347296 - RNA, 60 nt, Human
ggcugcagggacaaacaucguuggggggugagugugaaaggugcugauggcccucaucuc

SEQ ID NO: 347297 - RNA, 60 nt, Human
uugugaauuuaggaaaaucacuuguaaugaagugugaaucuuguuaucaaauuuauuucu

SEQ ID NO: 347298 - RNA, 60 nt, Human
uaucccugaauucagagugauaauuuuauaagugugaaacuuaauuauguagggcucccc

SEQ ID NO: 347299 - RNA, 60 nt, Human
gggacguuuuauagucacuauccacaugccagugugaaaugggcaucuaugacgugguca

SEQ ID NO: 347300 - RNA, 60 nt, Human
uuagagaaaauuugagucaguguacuuuauagugugaauccugugagcuaauacagucua

SEQ ID NO: 347301 - RNA, 60 nt, Human
aaucaguaucaguaaaaagacaaaaauuacagugugaacaagagaaaaacaggaauagaa

SEQ ID NO: 347302 - RNA, 60 nt, Human
gccuuggacuugaauccaugcaauguuuagagugugaagucaguuacuuguugauguuuu

SEQ ID NO: 347303 - RNA, 60 nt, Human
uuucagugauugacucuucaaaauugcaguagugugaaaauacauuuuuuacaaacugaa

SEQ ID NO: 347304 - RNA, 60 nt, Human
cuugucccccaggagucggagaagcuggaaagugugaaugcugaacugaaggcucagauu

SEQ ID NO: 347305 - RNA, 60 nt, Human
guggaaaggugguucauguucauucucaucagugugaaacugaggagucugcaauuugga

SEQ ID NO: 347306 - RNA, 60 nt, Human
ugccaugcaguguugcgguggcacugaagaagugugaaugugaaggcggcgucggcgcgg

SEQ ID NO: 347307 - RNA, 60 nt, Human
agcuccgugggccuguuucccaaucugcaaagugugaagggauuagaugggauggucucu

SEQ ID NO: 347308 - RNA, 60 nt, Human
gccugggacccucagggucuuagguuggggagugugaauaggaguuugcagauggagaau

SEQ ID NO: 347309 - RNA, 60 nt, Human
cuuacaaucagagccccucucaccuuguaaagugugaaucgcccuucccuuuuguacaga

SEQ ID NO: 347310 - RNA, 60 nt, Human
cucgccaggccagccccacuccuuguaccaagugugaacuggggucauucggucugugau

SEQ ID NO: 347311 - RNA, 60 nt, Human
cucaggcccaauauucucagacagcccagcagugugaacacacaaugccaggccaggaac

SEQ ID NO: 347312 - RNA, 60 nt, Human
caucugcaaagagccauguauucaacaucgagugugaaaagaucuauuggaaaacaacau

SEQ ID NO: 347313 - RNA, 60 nt, Human
gauuccuugagacguacuuuuaaaaucuaaagugugaaagaaacagcagaguaaaagcca

SEQ ID NO: 347314 - RNA, 60 nt, Human
cucuucccuagaguugauugucggguacacagugugaacccccgaagacggaaccucaca

SEQ ID NO: 347315 - RNA, 60 nt, Human
guaaagauagaaaauuuuuuaauuuaaagaagugugaaacauagccauugauugaucaga

SEQ ID NO: 347316 - RNA, 60 nt, Human
uuaguuucuuuucauaaaguaaguuauuuuagugugaaggucaugggaaauggcauacgu

SEQ ID NO: 347317 - RNA, 60 nt, Human
cuccucugcuccuagaagcgagaugagcgcagugugaagagcacagcugugcggguggua

SEQ ID NO: 347318 - RNA, 60 nt, Human
gucuccuaccacuucggagccaugggggcaagugugaagcagccagucccugggucagcc

SEQ ID NO: 347319 - RNA, 60 nt, Human
gacguauguuccauguuuauuuguuaaagcagugugaauagccuucaagcaugugaauaa

SEQ ID NO: 347320 - RNA, 60 nt, Human
caaaguggcauaaaaaacaugugguuacacagugugaauaaagugcugcggagcaagagg

SEQ ID NO: 347321 - RNA, 60 nt, Human
gggaccuccccugaggcucagggaaaggccagugugaaccgaggggcucaggaaaacggg

SEQ ID NO: 347322 - RNA, 60 nt, Human
acccaucaauuuucuauccuuagacaauguagugugaaguucacaguugacaaacaacaa

SEQ ID NO: 347323 - RNA, 60 nt, Human
ccagcugcgugggguacaggcauugcacacagugugaaugggucuacaccugcaugggcu

SEQ ID NO: 347324 - RNA, 60 nt, Human
uguagcaaugaaagcaauaugauaugcugcagugugaagcuccuucugggguuaucguau

SEQ ID NO: 347325 - RNA, 53 nt, Human; identical to SEQ ID NO: 279740

SEQ ID NO: 347326 - RNA, 60 nt, Human; identical to SEQ ID NO: 279741

SEQ ID NO: 347327 - RNA, 60 nt, Human
cuaagauuaaaaugucauuacaaaauauuuagugugaacauuuaauuuaaacuugucuca

SEQ ID NO: 347328 - RNA, 60 nt, Human
ccauguguuagauggaagcauuuccuauccagugugaauaaaaagaacaguuguaguaaa

SEQ ID NO: 347329 - RNA, 60 nt, Human
uggucauaggaaaacacacgguucuaauuaagugugaagguauagcuauugcacuuaugc

SEQ ID NO: 347330 - RNA, 60 nt, Human
uggcgugcagcucaucauggacaugagaccagugugaagacucacccuggaagagaauau

SEQ ID NO: 347331 - RNA, 60 nt, Human
agcugcucauacucaaucccauauucagcaagugugaagcuggacgugaugcaaaauaac

SEQ ID NO: 347332 - RNA, 60 nt, Human
aaacuguaaugaaacuacauuguauuucuaagugugaaaacgacaggcugccccguuuuu

SEQ ID NO: 347333 - RNA, 60 nt, Human
cagcuacucgggaggcugaggcaggagaauagugugaacccaggaggcggagcuugcagu

SEQ ID NO: 347334 - RNA, 60 nt, Human
agagaaaagaaauauuuggaggauauugaaagugugaaaaaaaagaaugauaaucuuuua

SEQ ID NO: 347335 - RNA, 60 nt, Human
uuguagggcccuuuccuuauucauuuagguagugugaacauuaaguauaaaauaaauuau

SEQ ID NO: 347336 - RNA, 60 nt, Human
uuagaaauuaccuguggauauuuguauaaaagugugaaauaaauuuuuuauaaaaguguu

SEQ ID NO: 347337 - RNA, 60 nt, Human
uacgcaacauaauucacauaauuuguaugcagugugaaggagcagaaggcaucuucucac

SEQ ID NO: 347338 - RNA, 60 nt, Human
augcuuagaaauacuauaguaacuagaugcagugugaauuuuuuccauuaacaaacaaac

SEQ ID NO: 347339 - RNA, 60 nt, Human
aggcggcaggcgcggugcacaggaagucucagugugaaggggucuuuucucuccacugcc

SEQ ID NO: 347340 - RNA, 60 nt, Human
cugacaucccagaagaacaucucagauaucagugugaaaagucuggggauuucaaacuga

SEQ ID NO: 347341 - RNA, 60 nt, Human
cucauagguuaaaaaaaaaagucaccaaauagugugaaauauauuacuuaacuguccgua

SEQ ID NO: 347342 - RNA, 60 nt, Human
uuagaaaaggaacccaaaaaacccuuuaacagugugaaucuuuauaguauuugaaaauga

SEQ ID NO: 347343 - RNA, 60 nt, Human
uuuaggaauuacugcuuuguugauauucaaagugugaaacuaaaacuuuaugguuguacu

SEQ ID NO: 347344 - RNA, 60 nt, Human
gagaggaagagcacauguuggucuccucuuagugugaacgagauugccaggcccuuuucu

SEQ ID NO: 347345 - RNA, 60 nt, Human
uaaugacccuuuugcuuuuggguuuugcucagugugaaagguuacuuaauuaaauuacaa

SEQ ID NO: 347346 - RNA, 60 nt, Human
guuaaaauuaaaaacaacguauuccuuuguagugugaauaugagcaaucuauuuuauaug

SEQ ID NO: 347347 - RNA, 60 nt, Human
uuucuuagcuuucugucuuucuuucaacguagugugaagugucuuauccuuuucuaugaa

SEQ ID NO: 347348 - RNA, 60 nt, Human
ucaauaauuauuuucaaugaugaaucacuuagugugaaagacuugccuuguguauucuuu

SEQ ID NO: 347349 - RNA, 60 nt, Human
uuacacuccugcacuaaaggcacguacugcagugugaagaaauguucugaaaaaggguua

SEQ ID NO: 347350 - RNA, 60 nt, Human
aacauuucuagaaaaaacuacuuuuguaccagugugaauaaaguuaguguguugucugug

SEQ ID NO: 347351 - RNA, 60 nt, Human
agcaucagccuucuagaaucggagcuccggagugugaagauucaguauugauaugauaug

SEQ ID NO: 347352 - RNA, 60 nt, Human
ugcuacuguuguucaacaccauuaauggucagugugaaccauuacaaagaauguggcaac

SEQ ID NO: 347353 - RNA, 60 nt, Human
acacugugccuuguguuuggggcuugauagagugugaaagguguguugcuugaaaggugu

SEQ ID NO: 347354 - RNA, 60 nt, Human
uaaauucugaggccacagagaaaugcauugagugugaauguugucaucuguaaucccucc

SEQ ID NO: 347355 - RNA, 60 nt, Human
caucuccauuuauuucuuuuguucccgcucagugugaaguugggaacugagaggggaugg

SEQ ID NO: 347356 - RNA, 60 nt, Human
uugagauguuuuucuuaaacacugccugucagugugaaguggcacagcucugauguagug

SEQ ID NO: 347357 - RNA, 60 nt, Human
cacgucuggcuucacagaugugugauucacagugugaaucuuggugucuacguuaccagg

SEQ ID NO: 347358 - RNA, 60 nt, Human
cgguucagaaagaucugucaaucaagcaguagugugaaaaaagcacuauaagaaaaugca

SEQ ID NO: 347359 - RNA, 60 nt, Human
cucacccagcaucucuuuuaccaaccagagagugugaaacuaguuucauauauuaccuag

SEQ ID NO: 347360 - RNA, 60 nt, Human
aaucagaagacguucuaaagucaguaagaaagugugaaaugcuaguauaaagguuauuuu

SEQ ID NO: 347361 - RNA, 60 nt, Human
ucuuauucccuuuaagaauguuuauguaugagugugaagaugcuagcgaaccuaugcuca

SEQ ID NO: 347362 - RNA, 60 nt, Human
cccagccccuaugguuucacauagacgugcagugugaaccaaagcaagacugaaugugac

SEQ ID NO: 347363 - RNA, 60 nt, Human
uguugugcaacaaaaaugucacuuuaucucagugugaaugaguagucuaaauucccuuuc

SEQ ID NO: 347364 - RNA, 60 nt, Human
uuuauucaauaaaguauuuaauuagugcuaagugugaacuggacccuguugcuaagcccc

SEQ ID NO: 347365 - RNA, 60 nt, Human
ugaagaaaaucuguaaguaaguaaaccuuaagugugaaacuaaacauguucuuuguucaa

SEQ ID NO: 347366 - RNA, 60 nt, Human
ccaggaggcagcagggucuggucauaauccagugugaagaugaggugaggaaggaagggg

SEQ ID NO: 347367 - RNA, 60 nt, Human
cucucuuccccagcaagaugucaauuaagcagugugaauucugacugcaauaggcaccag

SEQ ID NO: 347368 - RNA, 60 nt, Human
ucacucucgccagcucaguuggcuuugugaagugugaaacccuacaaugugaaaggaaag

SEQ ID NO: 347369 - RNA, 60 nt, Human
cucuuggcccggcagggcccccaauaaaccagugugaacccccacuguguugucuggacu

SEQ ID NO: 347370 - RNA, 60 nt, Human
gugguauuucaguuccuaaguuacauaaaaagugugaaagaacacugugaggucccagca

SEQ ID NO: 347371 - RNA, 60 nt, Human
uucugucauauaguugugggaucucuaccaagugugaaggugaaugagguaagggagauc

SEQ ID NO: 347372 - RNA, 60 nt, Human
agaauuugagauuuuuguaauaauagaaguagugugaacccuagaaauuagaaaaucaag

SEQ ID NO: 347373 - RNA, 60 nt, Human
uuuccucaagaaauaacugaagaaggagcaagugugaacaguuucuuguguauccuuuca

SEQ ID NO: 347374 - RNA, 60 nt, Human
cacaccaccaaaugucacaccuucuuauaaagugugaacaaggaaggucauguuuuugug

SEQ ID NO: 347375 - RNA, 60 nt, Human
agguuuuauacauagccauuguauauuuuuagugugaaaaacauuaauauauuauaugca

SEQ ID NO: 347376 - RNA, 60 nt, Human
ggcugagaugauugagaugaaaguuaacauagugugaaugaaagucuggccaacagagca

SEQ ID NO: 347377 - RNA, 60 nt, Human
uaauguuauauuaaccucuuccuacuuuaaagugugaaauguuucaccucagcuguacaa

SEQ ID NO: 347378 - RNA, 60 nt, Human
ugcaaugugacaguguuacauuuggagagaagugugaaaucuaaccaaucgcuagcacau

SEQ ID NO: 347379 - RNA, 60 nt, Human
gcaggcuuuaaaugucaccugcuaccuuagagugugaaggugaugguaacugccacagca

SEQ ID NO: 347380 - RNA, 60 nt, Human
gucaagugacuuuacuaaucaguuguucuaagugugaauauggcaugcuaauuagcuaau

SEQ ID NO: 347381 - RNA, 60 nt, Human
gauaaugauacuuaaccaguuagaagagguagugugaauauuaauuaguuuauauuacuc

SEQ ID NO: 347382 - RNA, 60 nt, Human
aguccgugaaaguuggggcugaaguaccuaagugugaaugucucucccguuaaacugagu

SEQ ID NO: 347383 - RNA, 60 nt, Human
auacagaccaggugagagcccuuuugccuuagugugaaaauguaacauuuuaugcuuuua

SEQ ID NO: 347384 - RNA, 60 nt, Human
cauuucucaaaggaagcaggggauucagugagugugaaggugaacaggauggccuggcag

SEQ ID NO: 347385 - RNA, 60 nt, Human
gguggauggggggagcaagcauaauuuuuaagugugaagcuuugcaucaagaaauuauua

SEQ ID NO: 347386 - RNA, 60 nt, Human
agacauaggccaugaaaaaaaugauccccaagugugaacaaaagaugcucuucuguggac

SEQ ID NO: 347387 - RNA, 60 nt, Human
caaaaaucaguauuguuauuuuuuuccaagagugugaaggaaaauggggcauuccuuucc

SEQ ID NO: 347388 - RNA, 60 nt, Human
ugaauauacacacacacacacacacaggugagugugaauacuuccuuguuggcugaucca

SEQ ID NO: 347389 - RNA, 60 nt, Human
guuuaucuuuaaaauaaauaaaaucuugcuagugugaauauaucuuagaacaaaagguau

SEQ ID NO: 347390 - RNA, 60 nt, Human
ccuggcugcuggcuaccgauuaaauucauuagugugaaagaggugggagugagguuuucu

SEQ ID NO: 347391 - RNA, 60 nt, Human
cuuucaugcuuuuuucugugcacuuaccuaagugugaauauguaaaggguuuguuuugua

SEQ ID NO: 347392 - RNA, 60 nt, Human
acacaagauauaggugcuguguagccugauagugugaaauguuuaaugagggaguuguac

SEQ ID NO: 347393 - RNA, 60 nt, Human
guugauuuaacuuuuaaaauguuguuuaaaagugugaagcuaugaaaagccugauaaugu

SEQ ID NO: 347394 - RNA, 60 nt, Human
aguucuugagacauuuaaacuguauuuaccagugugaaaaaugucauuuauggagauuaa

SEQ ID NO: 347395 - RNA, 60 nt, Human
cuguccuucaguuuguauaaaccuaaggagagugugaaauccagcaacugaauugugguc

SEQ ID NO: 347396 - RNA, 60 nt, Human
aaagaaaauguguuuuuuguuugguaccauagugugaaaugcugggaacaaugacuauaa

SEQ ID NO: 347397 - RNA, 60 nt, Human
guuuguaugggaacauuggcaagaaagaauagugugaaagggaacuguuuuaguuuccua

SEQ ID NO: 347398 - RNA, 60 nt, Human
ugguuagcacaaggaaucuaauuuauagcaagugugaaauaguuaccauuuuuuccugau

SEQ ID NO: 347399 - RNA, 60 nt, Human
uuauucuacuauacuguacaugaaaguagcagugugaaguacaauaauucauauucuuca

SEQ ID NO: 347400 - RNA, 60 nt, Human
ucagugcaguucgguucucagggggaaagaagugugaaacugucaggaagacagaugaaa

SEQ ID NO: 347401 - RNA, 60 nt, Human
ucacaucaugaaaguguacaugcauaugcaagugugaauuacgugguauggauguuugcu

SEQ ID NO: 347402 - RNA, 60 nt, Human
uauguauguauuuauuuauuuauugccuggagugugaacuguauuuauuuuagcagagga

SEQ ID NO: 347403 - RNA, 60 nt, Human
uuuggguagguuaagcugccauacguguucagugugaauaguguuuaaguugaaaauauu

SEQ ID NO: 347404 - RNA, 60 nt, Human
augucccuggucuauucagggaaagauuucagugugaaaugguaaacauccaauugacag

SEQ ID NO: 347405 - RNA, 60 nt, Human
uguacccugugguauugccccucuguccguagugugaacuguccugugagcuuuauguca

SEQ ID NO: 347406 - RNA, 60 nt, Human
ggagaauugguugaguagccaaggaaggucagugugaaaagcuugcuauggcaaauauag

SEQ ID NO: 347407 - RNA, 60 nt, Human
uaauucggagaugccuuucccagccaugggagugugaagugcuaggaugaaccuggccau

SEQ ID NO: 347408 - RNA, 60 nt, Human
ugggguuuuguuauugguuuuuuuuuguaaagugugaauaaaagguauguuuacucauuu

SEQ ID NO: 347409 - RNA, 60 nt, Human
auaggcaucuugugaggguguguuuuucccagugugaauuggcuugaagagccaugggcu

SEQ ID NO: 347410 - RNA, 60 nt, Human
ccgucaaaucucuuaaguaacaacacauuaagugugaauuacuuuucucucauuguuucc

SEQ ID NO: 347411 - RNA, 60 nt, Human
cagcaggauugcagaucauuugaggaucagagugugaaaacgaguuucucuuuuacagau

SEQ ID NO: 347412 - RNA, 60 nt, Human
aguguugagauggguagggccaagaugaccagugugaaaacucucagauagaaaggagcc

SEQ ID NO: 347413 - RNA, 60 nt, Human
cuacacugauugcacugaggauuucuccccagugugaaguuucuggcauagaguccuggc

SEQ ID NO: 347414 - RNA, 60 nt, Human
cugcauuugcuguuuucucaugucucucccagugugaauucuuuggugugcagugcgcuc

SEQ ID NO: 347415 - RNA, 60 nt, Human
ucugaaaccccauucccugcucugaggaacagugugaaaaaaagucuuuuaggagauuua

SEQ ID NO: 347416 - RNA, 60 nt, Human
auaugaauuuguucaugaauauuuuucuguagugugaaacagcugcccugugugggacug

SEQ ID NO: 347417 - RNA, 60 nt, Human
gccuugugguuucaggacugcaaggacuccagugugaacucaggaggggcaggugucaga

SEQ ID NO: 347418 - RNA, 60 nt, Human
ugguuccuucucuguaacacuaaauauuuuagugugaaauugaauuuuuuuauuacuaua

SEQ ID NO: 347419 - RNA, 60 nt, Human
uacuuuaauaauguugcgauggauugccacagugugaaggaaaugcaguguggggauagg

SEQ ID NO: 347420 - RNA, 60 nt, Human
uaggagagauuaucagauggugcuaaagaaagugugaagaucuuaugaaauagguggaug

SEQ ID NO: 347421 - RNA, 60 nt, Human
aagauuugaccuuaagagggaagggaaaaaagugugaaaggaugaugaagaaaauaauuu

SEQ ID NO: 347422 - RNA, 60 nt, Human
uguuuauuuuauggggacuaagggauuaggagugugaacuaaaagguaacauuuuccacu

SEQ ID NO: 347423 - RNA, 60 nt, Human
cccugaggcccuguguguuaucugugauggagugugaauguguaacgggcacuguguuac

SEQ ID NO: 347424 - RNA, 60 nt, Human
acuggggagagcugugugccucaguguugcagugugaauuccuaaauagaggguaaagug

SEQ ID NO: 347425 - RNA, 60 nt, Human
ggaauguggggaucagggagguggagggacagugugaauaaauggcaucuaggaagguaa

SEQ ID NO: 347426 - RNA, 60 nt, Human
uaugaaauauuuugaauacacaucucugucagugugaaaauucagcggcaguguguccau

SEQ ID NO: 347427 - RNA, 50 nt, Human; identical to SEQ ID NO: 279874

SEQ ID NO: 347428 - RNA, 60 nt, Human
gaaaacccacccuggggagaagccccagcaagugugaaaaaagcuucuaacaaaacucug

SEQ ID NO: 347429 - RNA, 60 nt, Human
gucuggaucaguaaaauuauacugugugugagugugaauauaaauguguguauguguguu

SEQ ID NO: 347430 - RNA, 60 nt, Human
ugagaggacuggcuaaagugaagugugcacagugugaaguuuaaugcuguugucaagagg

SEQ ID NO: 347431 - RNA, 60 nt, Human
aaugagauucaaaaguugaccugaaagucaagugugaaaaaaaaaaagagauuaaacaag

SEQ ID NO: 347432 - RNA, 60 nt, Human
augcacaagcuuugcguucugacuauaaaaagugugaacaaaucaaugccagauuccugu

SEQ ID NO: 347433 - RNA, 60 nt, Human
uaaauguucagcaggagaacgccaccgccuagugugaaugcuaggucagaagcugcuuuu

SEQ ID NO: 347434 - RNA, 60 nt, Human
uuaauacuucccuaggauauccuguguuugagugugaaguuaauaucacacaaagcaugu

SEQ ID NO: 347435 - RNA, 60 nt, Human
gagguguaaauuuugcccagauguauacccagugugaaauaucuucuaauaaaaauauau

SEQ ID NO: 347436 - RNA, 60 nt, Human
uguugccauaguugguaaggcuuuccuuuaagugugaaauauuuagaugaaauuuucucu

SEQ ID NO: 347437 - RNA, 60 nt, Human
cucuuguccuuggcugugaucccuauacauagugugaauuuauauccagguuucccagga

SEQ ID NO: 347438 - RNA, 60 nt, Human
uuucaaaggugcuaaaaucugaaaucugcuagugugaaacuugcucuacucucugaaaug

SEQ ID NO: 347439 - RNA, 60 nt, Human
acugugggcuaggcaaacaaaauagaaaaaagugugaaaaacaguaaaguugggagagga

SEQ ID NO: 347440 - RNA, 60 nt, Human
gcgagugugugugagaauggcuguguggugagugugaacuuuguucugugaucauagaaa

SEQ ID NO: 347441 - RNA, 60 nt, Human
augacauucuauuuuugacuuauuaguccuagugugaaagcauuaauauuauuagcauga

SEQ ID NO: 347442 - RNA, 60 nt, Human
ucugccccacaaucaagaauguauguguaaagugugaauaaaucucauaucaaaugucaa

SEQ ID NO: 347443 - RNA, 60 nt, Human
acgcuuccucaagcccagccuucuacagagagugugaacgguacagccccggccugaccc

SEQ ID NO: 347444 - RNA, 60 nt, Human
accuuucuuaaaugugacagaugguccugcagugugaaacugaaggacaguguuaaagcu

SEQ ID NO: 347445 - RNA, 60 nt, Human
gucgggagcagggagccaccuucaccugcgagugugaaguugguuacgggggaggccugu

SEQ ID NO: 347446 - RNA, 60 nt, Human
ugguagcuugguuucuuuuuuuuauuaaauagugugaaaauauaaugggcauuuugaaaa

SEQ ID NO: 347447 - RNA, 60 nt, Human
acaaaaccuggcacaauggcuaauucccagagugugaaacuuccuaaguauaaaugguug

SEQ ID NO: 347448 - RNA, 60 nt, Human
augccaccaacucuggcuuaguuaagugagagugugaacuguguggcaagagagccucac

SEQ ID NO: 347449 - RNA, 60 nt, Human
uguguguauacuuauguguguguaugugugagugugaauauauguauauguguacauaug

SEQ ID NO: 347450 - RNA, 60 nt, Human
uuccuaaauuuaaaagcucuaguuuugcuuagugugaauucuggcacuuuaaaaagauua

SEQ ID NO: 347451 - RNA, 60 nt, Human
aguuuauaauuaaaugcauucuugaaguccagugugaauuuuauuaaugcuaucaucucg

SEQ ID NO: 347452 - RNA, 60 nt, Human
augcucccuucuccuccauucggggggaaaagugugaaaugaagcuacauggaccucaca

SEQ ID NO: 347453 - RNA, 60 nt, Human
agaaaauucauacuggagagaaaccuuacaagugugaagaauguggcaaaacuucuaacc

SEQ ID NO: 347454 - RNA, 60 nt, Human
uaggugcucaaguguuucuguucgggacugagugugaaucuguaaaaggggaaaauccuc

SEQ ID NO: 347455 - RNA, 60 nt, Human
ucuucuguuuugccuuuucacgcccuuuauagugugaaaugaaaaauuagucacuuccuc

SEQ ID NO: 347456 - RNA, 60 nt, Human
cagcagaguaucugucuuauuuuaggaugcagugugaaacuuaccauucaacugaacaac

SEQ ID NO: 347457 - RNA, 60 nt, Human
cuguuuuugauaagaauaagaaagggagugagugugaagauggugguuagcaguuucacu

SEQ ID NO: 347458 - RNA, 60 nt, Human
ugaaguaccguaacugcacuaaagggacguagugugaacaucccgcaguauaggcuuaag

SEQ ID NO: 347459 - RNA, 60 nt, Human
ucucucuuuuguaauuuauguucccaauugagugugaauguccaaguaaugguguaugua

SEQ ID NO: 347460 - RNA, 60 nt, Human
ucacaucacgaaaauucugugccugucgucagugugaaaaugccuuugcugauaauuuau

SEQ ID NO: 347461 - RNA, 60 nt, Human
aacaauauaucccaugggagaagaccuuucagugugaacuguucuauuuuuguguuauaa

SEQ ID NO: 347462 - RNA, 60 nt, Human
ggccuuaaaauucuucugugaaauuucaaaagugugaacuuuuuauucuuccaaagaauu

SEQ ID NO: 347463 - RNA, 60 nt, Human
aagcacuuuguauauauaaggugcuauauaagugugaaauaucauucauuuauaaaugaa

SEQ ID NO: 347464 - RNA, 60 nt, Human
agggaaaagaaauaucuggaguacauuaaaagugugaaagaaaagaaugauaaucuucua

SEQ ID NO: 347465 - RNA, 60 nt, Human
acauccauacacucugacaaucuccacgcuagugugaacgccucugucccgaggcgcagc

SEQ ID NO: 347466 - RNA, 60 nt, Human
aucaacuggcaaggccuagaggagcuacacagugugaaugaaaacaucuaugaguacaga

SEQ ID NO: 347467 - RNA, 60 nt, Human
aguuucuuagcaauuaaaguuuuuuuauucagugugaacugucaguaucuauucuggugc

SEQ ID NO: 347468 - RNA, 60 nt, Human
uuuaauguuuguaaacuuuuacuaauaauuagugugaauugcauucugauacaauaauga

SEQ ID NO: 347469 - RNA, 60 nt, Human
acuucauaucguggaaguauugucuauuucagugugaaacuaucuugaauuugcaaauau

SEQ ID NO: 347470 - RNA, 60 nt, Human
agauggaugaggagaauggcuucaugauccagugugaagagugcuuguguuggcaacaca

SEQ ID NO: 347471 - RNA, 60 nt, Human
aagaugagcaaagaaagguuugcacagaggagugugaauguguguuuguugcuggcugaa

SEQ ID NO: 347472 - RNA, 60 nt, Human
agucaacccauccccagggccauaguguagagugugaaaagcuacccugaaacccaguaa

SEQ ID NO: 347473 - RNA, 60 nt, Human
agcaggacgaaaaagaggcauacacacagcagugugaauagccuggccaccagccauccu

SEQ ID NO: 347474 - RNA, 60 nt, Human
auuuuuaauauauuugagugauugcugggaagugugaaaauauuguuauguaucauauca

SEQ ID NO: 347475 - RNA, 60 nt, Human
ucuuguguuugacacuaagaaaauagcaagagugugaaaucucagauacuuaugaaaucu

SEQ ID NO: 347476 - RNA, 60 nt, Human
acaaaaaacccacaauugaacuuccaggaaagugugaagacccaaaacagcuuugucucc

SEQ ID NO: 347477 - RNA, 60 nt, Human
aaucauucagaucauccccccuuuuuaaguagugugaauugcaaaacccaacauauuuuu

SEQ ID NO: 347478 - RNA, 60 nt, Human
augacacuaaacuccaugauauuuaaggauagugugaagaucuuuggcaugauuuaaagg

SEQ ID NO: 347479 - RNA, 60 nt, Human
gucucacugccuuuccuucccacagaccugagugugaaagacugagaguugaggaguuac

SEQ ID NO: 347480 - RNA, 60 nt, Human
agaggucuucugaccuuuccuuuccccgugagugugaagcuggcagaaaucacuaguaaa

SEQ ID NO: 347481 - RNA, 60 nt, Human
uuggugcuagauucugcaggaaaccccagcagugugaacgcaucccaacauagguuaaga

SEQ ID NO: 347482 - RNA, 60 nt, Human
gauuccuccccuuggcgggagagcucucucagugugaacaugccuucugugggcggaaau

SEQ ID NO: 347483 - RNA, 60 nt, Human
cuuuuaauucucauuuguucucacaccaacagugugaagugcgugguauaaucuccauuu

SEQ ID NO: 347484 - RNA, 60 nt, Human
ggaguuugauggacagggcugccuuuaaugagugugaaggucacuaagucacuuagacau

SEQ ID NO: 347485 - RNA, 60 nt, Human
gugcuguacgugugugugugugugugagcgagugugaacucuucaagaaacaugcauuuu

SEQ ID NO: 347486 - RNA, 60 nt, Human
ucccugggacgugagacuuagcuuccagccagugugaaucauuguaucugucucauaauc

SEQ ID NO: 347487 - RNA, 60 nt, Human
guugaaucaaaauuuucaaauguuuucagcagugugaagaagcuugguguauaccugugc

SEQ ID NO: 347488 - RNA, 60 nt, Human
uuuccuguguaauuuggguagauuuucaagagugugaacacaaauuuaaaauaagcuaua

SEQ ID NO: 347489 - RNA, 60 nt, Human
acauuugaacuauauccuuccuaguggguuagugugaaaaagaguuuggcugauuccuaa

SEQ ID NO: 347490 - RNA, 60 nt, Human
uucuaaugcaagauauuuuuucuuuuuuauagugugaagcaguauucuggaaaguuuuuc

SEQ ID NO: 347491 - RNA, 60 nt, Human; identical to SEQ ID NO: 347428

SEQ ID NO: 347492 - RNA, 60 nt, Human
agauuaauguuucaugauuucuaccuccaaagugugaagacaaguaaaacaauguuucua

SEQ ID NO: 347493 - RNA, 60 nt, Human
guagggagcgauauucaagauauauugugaagugugaaaaaguagguugcugaaccaugu

SEQ ID NO: 347494 - RNA, 60 nt, Human
uauauauauauauuuuuuuuuugguuaggaagugugaaguuuuguguguaugauuucugu

SEQ ID NO: 347495 - RNA, 60 nt, Human
aaaaugucugguugugccagacauuucacaagugugaaaggagauaggagaagcucaacu

SEQ ID NO: 347496 - RNA, 60 nt, Human
ucuuccugaagccuacagacauaaaauaacagugugaagaauuacuuguucacgguuagu

SEQ ID NO: 347497 - RNA, 60 nt, Human
gaaucaagcugguguggggcuuuuauugauagugugaagauuguacacuauauuacauga

SEQ ID NO: 347498 - RNA, 60 nt, Human
guagaucacuuaaauacuggaucuuuugcuagugugaaaacauugggaauuuaaugacau

SEQ ID NO: 347499 - RNA, 60 nt, Human
cuucccugucugccagggccagucuugacgagugugaagcuuccuuggcuuuuacugaag

SEQ ID NO: 347500 - RNA, 60 nt, Human
cuguaaugcaacaugccuugggaauguuauagugugaacuaccuuuauaacauagguuaa

SEQ ID NO: 347501 - RNA, 60 nt, Human
auacacauuuuuuguguauguauucuaauuagugugaauaaagcaguaacauuaaugcau

SEQ ID NO: 347502 - RNA, 60 nt, Human
uuuugguaaugagccauucaaaccgacagcagugugaaggugugucaagguguauauucu

SEQ ID NO: 347503 - RNA, 60 nt, Human
auugacaguguaucauaggauuacccucuaagugugaaaauguguaauuauguacgguau

SEQ ID NO: 347504 - RNA, 60 nt, Human
gaaucaagcuggcauggggcuuuuauugacagugugaagauuguacacuacauuacauga

SEQ ID NO: 347505 - RNA, 60 nt, Human
agauaauucauuuuaaucguaauguauuuuagugugaauuuaaaaauuucauacaucaaa

SEQ ID NO: 347506 - RNA, 60 nt, Human
uuuuaaagugauuuuugccuuuaaagauacagugugaaaauuugcucggguguguagcag

SEQ ID NO: 347507 - RNA, 60 nt, Human
ccugguuuugauggcagcaguaaucaugauagugugaacccgcgaaggccucaggauuau

SEQ ID NO: 347508 - RNA, 60 nt, Human
aauuaagguuagcggaucauguacaagcugagugugaaaguagaaaucaccuacaccaga

SEQ ID NO: 347509 - RNA, 60 nt, Human
aaguguccuuguucauuuucacccaaaugaagugugaacgugauguuuucggaugcaaac

SEQ ID NO: 347510 - RNA, 60 nt, Human
aauguaaaauuuggucuuccagcuuaaugcagugugaacaauagaugguuaggaaaacaa

SEQ ID NO: 347511 - RNA, 60 nt, Human
cccaaagaucaaguugucugaaggagccaaagugugaaugugggugucggcugcggcauu

SEQ ID NO: 347512 - RNA, 60 nt, Human
gaacugaccuugaaucuuuuuaucccauuuagugugaauauuccuuuauuuugcugcuug

SEQ ID NO: 347513 - RNA, 60 nt, Human
cagaaccuuacuaaaguagagggcacaaucagugugaauaaauucacuucagaaucucaa

SEQ ID NO: 347514 - RNA, 60 nt, Human
caguuguuguaaugacaagauuacugcgcaagugugaauccaaacaguauagcuuuuaaa

SEQ ID NO: 347515 - RNA, 60 nt, Human
gucucuggucugugucugugugugccuguaagugugaaauaaaccucucugauggcagca

SEQ ID NO: 347516 - RNA, 60 nt, Human
uugucaagacauuaaaccaucuuagaucggagugugaaguaaauuaugguauauuuuaug

SEQ ID NO: 347517 - RNA, 60 nt, Human
guauuaaucuuguguagucuucaacugguuagugugaaauaguucugccaccucugacgc

SEQ ID NO: 347518 - RNA, 60 nt, Human
ugugguucuuacccauuuaucuaggaugaaagugugaauuagagggacuccuuccaauaa

SEQ ID NO: 347519 - RNA, 60 nt, Human
uacacagaagggaaaaugugcacucaugcuagugugaauuugguaaguugcgugacucug

SEQ ID NO: 347520 - RNA, 60 nt, Human
ucuaauucuccugacuguucuucccaggggagugugaaggucuuggcccuguucccuguc

SEQ ID NO: 347521 - RNA, 60 nt, Human
uuucaguaguuugaucaguugaaggcuagaagugugaagugcagaugaguguguguucuu

SEQ ID NO: 347522 - RNA, 60 nt, Human
uuuucauuucaauauaaaaucaguauaaaaagugugaaugagcuguuuuugcuuuugcuu

SEQ ID NO: 347523 - RNA, 60 nt, Human
ugagggagacagaccacuuuucuauauugcagugugaaugcugggccccugcucaagucu

SEQ ID NO: 347524 - RNA, 60 nt, Human
gaaaagcuuccuugaugugagcucugggggagugugaaggaugcaucucuagcccccgag

SEQ ID NO: 347525 - RNA, 60 nt, Human
uuucguuuuagcaaguaguacuuaauuuaaagugugaacuuaauauauaagaugccagga

SEQ ID NO: 347526 - RNA, 60 nt, Human
uucuuuaaaaaaaagggggggaaauaccaaagugugaaauacugugcuaccuuccagagu

SEQ ID NO: 347527 - RNA, 60 nt, Human
aucucccugaggcuguuuccucgucuguuaagugugaauaucaauaccugccuuucauaa

SEQ ID NO: 347528 - RNA, 60 nt, Human
acaccugucaccuuguaaaacacggacauuagugugaacacaggacagcuucgcucuuuc

SEQ ID NO: 347529 - RNA, 60 nt, Human
ccuguuucuacaggaagucaugcucgagggagugugaagugguucagguuggugcagagg

SEQ ID NO: 347530 - RNA, 57 nt, Human; identical to SEQ ID NO: 280009

SEQ ID NO: 347531 - RNA, 60 nt, Human
cuuuggcccccuuacucuuucauugacugcagugugaauauuggcuugaaccuuuucccu

SEQ ID NO: 347532 - RNA, 60 nt, Human
uaaccuaucaagaaaagcccuuauuuggaaagugugaaauuuguauuuggaaaagcugcc

SEQ ID NO: 347533 - RNA, 60 nt, Human
gaguggagggaagcagggagggagggagcaagugugaagggcacagcugcuggcaaaugc

SEQ ID NO: 347534 - RNA, 60 nt, Human
uuuaacuuuauaguuagaaaaauuggccucagugugaaauuuuuccagucccauagcuca

SEQ ID NO: 347535 - RNA, 60 nt, Human
aauauuaauacuaacugggaaaaaaaaacuagugugaaguuuacaguuagaagaaacaga

SEQ ID NO: 347536 - RNA, 60 nt, Human
gagaccauuggaagggauggaauauaagucagugugaaacugaguauacacugccauguu

SEQ ID NO: 347537 - RNA, 60 nt, Human
uuaaagcacauuacgugcaauggcauagaaagugugaacaaagaaaaugauauuaaggag

SEQ ID NO: 347538 - RNA, 60 nt, Human
cacauaacauccaauuaugacuggguaauaagugugaaaauuuuaauuugugguuuucau

SEQ ID NO: 347539 - RNA, 60 nt, Human
guauaauuuaacagugcccuuuucaucuccagugugaauauauggucugugugucugaug

SEQ ID NO: 347540 - RNA, 60 nt, Human
uccucacaugcagaguugugcaugccccugagugugaacagguuugccuacguuggugca

SEQ ID NO: 347541 - RNA, 60 nt, Human
ucuuaagccaucuugguaaauuuccccaacagugugaaguuagaauuccuucagggugau

SEQ ID NO: 347542 - RNA, 60 nt, Human
aauuuuugagacuuggguuuucuuaaugccagugugaauuugcagauguuuucagaaaau

SEQ ID NO: 347543 - RNA, 60 nt, Human
uguaauuguaauguagaacaguugugugguagugugaaccguaugaaccuaaguaguuug

SEQ ID NO: 347544 - RNA, 60 nt, Human
auggaacaaacuuuaacuuaccaagcaccaagugugaaagugacuuucacgguuccuuca

SEQ ID NO: 347545 - RNA, 60 nt, Human
caacagcugcccuugaggagcacaggcagaagugugaacuugugaauguaauugaucuuu

SEQ ID NO: 347546 - RNA, 60 nt, Human
gcagcuuucucuggaaaaugaaugcuaauuagugugaaccaaaagaguaaguaagagucu

SEQ ID NO: 347547 - RNA, 60 nt, Human
ugcacuuuuuuguuugaauguuagaugcuuagugugaaguugauacgcaaggaaaauggu

SEQ ID NO: 347548 - RNA, 60 nt, Human
uucuaagugguugacagauguucacuuugaagugugaaguuuuaaaaauacgugaauaaa

SEQ ID NO: 347549 - RNA, 60 nt, Human
cuugaaucugacuauagacauuuguuauucagugugaaacaaauauaagauacaucacag

SEQ ID NO: 347550 - RNA, 60 nt, Human
uuaauaaauguaugacacugaaaagauuugagugugaaucuacugaaaucacuauaaugc

SEQ ID NO: 347551 - RNA, 60 nt, Human
uaaaucacuuaucggaaaugcacauuucauagugugaagcacucauuucuaaaccuuauu

SEQ ID NO: 347552 - RNA, 60 nt, Human
uacacuuuuucaaaaugcucaccuacuggaagugugaauuacuugacaauguauggcuua

SEQ ID NO: 347553 - RNA, 60 nt, Human
aggucaucaucgauucuacuuuagaaugagagugugaaauagacauuuguaaauguaaaa

SEQ ID NO: 347554 - RNA, 60 nt, Human
cccauaaaaugauccugccaaucuaaugugagugugaagcuuugcacacuaguuuaugcu

SEQ ID NO: 347555 - RNA, 60 nt, Human
uuaaguguuugaaaauuguuaauuaugcccagugugaacuuaguacuuaacacauuuuga

SEQ ID NO: 347556 - RNA, 60 nt, Human
cuuauuuggaaaguugccauuuuaauguucagugugaaucagguagggauuugcuaguca

SEQ ID NO: 347557 - RNA, 60 nt, Human
caucauuuuuuuaaaaaauguaauugaauaagugugaaugcagaagcaaauauugucugc

SEQ ID NO: 347558 - RNA, 60 nt, Human
cuguaccuuacaacagcgauucaggacccaagugugaacaacacucagcccgcccucugg

SEQ ID NO: 347559 - RNA, 60 nt, Human
uucucgguucucagaggaaaaguaugaaugagugugaaguguaugugagaacuuuuguuu

SEQ ID NO: 347560 - RNA, 60 nt, Human
ugugacuccuuccagagccacagguaggggagugugaaguugagggggaggaaagcugga

SEQ ID NO: 347561 - RNA, 60 nt, Human
agaaguaaagugugaugacgauaacacuuaagugugaauuuuuaaauauaguugaguaga

SEQ ID NO: 347562 - RNA, 60 nt, Human
acuguuaaauauauguguguaaucagccugagugugaaaguuaauggaggccugggaaca

SEQ ID NO: 347563 - RNA, 60 nt, Human
aguguaagaggaaucuacuguugcuauguuagugugaauguugaaggugcaauuaucaca

SEQ ID NO: 347564 - RNA, 60 nt, Human
ucaucucaggguuucuuggaguacaagaccagugugaaguuauucugauuucuugggaau

SEQ ID NO: 347565 - RNA, 60 nt, Human
caacauacuucauuuaauagcucguuaccaagugugaaugaagcaauaugucauaauaga

SEQ ID NO: 347566 - RNA, 60 nt, Human
cuguuugaagugaguauuaaauauuucagaagugugaauuucauguauuugagcuccucu

SEQ ID NO: 347567 - RNA, 60 nt, Human
agucaccauguaccucugacaacaaguuuuagugugaaagucacuaaacuuuuacacacu

SEQ ID NO: 347568 - RNA, 60 nt, Human
agaguauuuuaauccuauuacuugacuaagagugugaagguaguacuuuuuagagugcac

SEQ ID NO: 347569 - RNA, 60 nt, Human
guagcucuacagccuggccucaacucuaaaagugugaagaaugcaaugggcagagaccua

SEQ ID NO: 347570 - RNA, 60 nt, Human
aacaauuugaaaauugugguugcauuuuaaagugugaacacuccccuauguaaauaugcu

SEQ ID NO: 347571 - RNA, 60 nt, Human
guuuauauuuuuauuaaugucauuucuggaagugugaaaauguuaauguucaacaagcaa

SEQ ID NO: 347572 - RNA, 60 nt, Human
gaauguuuauuaccucauaagugcauauauagugugaaagagaaggcauuaaaaagaagu

SEQ ID NO: 347573 - RNA, 60 nt, Human
gaauggcugacuugaagagcaacaucauagagugugaauuucuauuugggaaggagaaaa

SEQ ID NO: 347574 - RNA, 60 nt, Human
ucaugcagacaugacuguucucuuuguacaagugugaaucaaaauauguaucucuuuuuc

SEQ ID NO: 347575 - RNA, 60 nt, Human
guuuuccuguugaggggcaccacauacaauagugugaaguagguaugaggggcagucauu

SEQ ID NO: 347576 - RNA, 60 nt, Human
gggauguuaacaggagccaaaaggagggaaagugugaagaauaaaguagaucugagaaau

SEQ ID NO: 347577 - RNA, 60 nt, Human
cugcagaccuggcugggccugggcuuccacagugugaagacacugugcaggcccaggcag

SEQ ID NO: 347578 - RNA, 60 nt, Human
acaaaaaagcaaaccuuaaaaugugaagaaagugugaauuuuaguuuugucacaguuaac

SEQ ID NO: 347579 - RNA, 60 nt, Human
aacaaacugcuuucugguuagcugaaggcaagugugaaaaucagaauuuagaauauuuag

SEQ ID NO: 347580 - RNA, 60 nt, Human
uggaagguggcccaguaugagcccuagaagagugugaaaaggaauggcaaugguguucac

SEQ ID NO: 347581 - RNA, 60 nt, Human
aaauuccuguacauagagauauauuuuuuaagugugaauguaacaacauacugugaauuc

SEQ ID NO: 347582 - RNA, 60 nt, Human
ugaaucucagaaaaaaguagauuuuaauaaagugugaaaguugucaaucaaagcggaguc

SEQ ID NO: 347583 - RNA, 60 nt, Human
aguuauauuacaaacauuaucggccuuucuagugugaaugaacauuagacacauuauugu

SEQ ID NO: 347584 - RNA, 60 nt, Human
auaccaugcggauuuuauauguacaucaguagugugaauccacuggcacaguguguguaa

SEQ ID NO: 347585 - RNA, 60 nt, Human
aguaggguccuauuauguuuuuuuuucaguagugugaauuaauccuuuugugcuguguuu

SEQ ID NO: 347586 - RNA, 60 nt, Human
uauuuuuuuaaaaaaaaaguuuaccgcuguagugugaaauauugucuggaaagggauggu

SEQ ID NO: 347587 - RNA, 60 nt, Human
gaauuuugucaauuaaaaaagcgugggagcagugugaaggagaagaggcaagaacgaccc

SEQ ID NO: 347588 - RNA, 60 nt, Human
cuguauuuuaugcauucaugucuaggauacagugugaaaauuaaaaaguuuagagggcag

SEQ ID NO: 347589 - RNA, 60 nt, Human
gcagugagcaucacuacagucucagucaacagugugaauguaucauguuuuacuuuaaau

SEQ ID NO: 347590 - RNA, 60 nt, Human
caugcuuuugugcacacucucuggggcuccagugugaagggugcccuggggcugagggcc

SEQ ID NO: 347591 - RNA, 60 nt, Human
uagcagacuaucuguucauaaucaguuuucagugugaauucacugaauguuuauagacaa

SEQ ID NO: 347592 - RNA, 60 nt, Human
agacagauuuguccuuuacagaaauuacugagugugaauaaaaacuucagauccaagaaa

SEQ ID NO: 347593 - RNA, 60 nt, Human
cuuccugcucccccauuuccuaacucccccagugugaauucucagggucacuucugccuc

SEQ ID NO: 347594 - RNA, 60 nt, Human
uuguuccuuguggaacaaaugggcaaaagaagugugaaaauguggguguuuaugucugug

SEQ ID NO: 347595 - RNA, 60 nt, Human
ucaggguaccuggggccaaacccaccugcuagugugaauuaaaguacuuuaauuuuguuu

SEQ ID NO: 347596 - RNA, 60 nt, Human
aaguaaugguggauaagcugcuggugccuuagugugaaucaagguagugccaccaaagug

SEQ ID NO: 347597 - RNA, 60 nt, Human
guagauuucacagcccuucuacuaauagugagugugaaggcaagcuugaugcaaaaccuc

SEQ ID NO: 347598 - RNA, 60 nt, Human
uaaugauagaugauauacuagauuuuucaaagugugaaaaccuuuagacuuuuuuuagca

SEQ ID NO: 347599 - RNA, 60 nt, Human
aaacauggauuaccuguguuuaaaaaaaaaagugugaauggcguuaggguaagggcacag

SEQ ID NO: 347600 - RNA, 60 nt, Human
uccccaaggauuuauugacauugcuacuugagugugaacaguuaccuggaaauacugaug

SEQ ID NO: 347601 - RNA, 60 nt, Human
uauauaaaaccaucuuuaaaaaccaauagaagugugaauaguagaauauuaauuaaaaug

SEQ ID NO: 347602 - RNA, 60 nt, Human
guccaaacuuggggcuucccaggcaccugcagugugaacacugcuuggcuggcucaagau

SEQ ID NO: 347603 - RNA, 60 nt, Human
ggagagcagcuccccucgccccgccccugcagugugaaugugugaaacauccccucaggc

SEQ ID NO: 347604 - RNA, 60 nt, Human
ggccagggacgucacccaaggcugguggucagugugaagggcuccgugccaacuggucag

SEQ ID NO: 347605 - RNA, 60 nt, Human
gagaguucgccccaacccuuccccaggcccagugugaaaaacagacucacaaggggcuuc

SEQ ID NO: 347606 - RNA, 60 nt, Human
caucuucccucuccccauucgguguggugcagugugaaaaguccuugauuguucgggugu

SEQ ID NO: 347607 - RNA, 60 nt, Human
ggcacgggcgcgggccgggccucaagggugagugugaaauaaacaaauccugcaguguuu

SEQ ID NO: 347608 - RNA, 60 nt, Human
cuaggauacuuuuauaugaugggugcuuugagugugaaugcagcaggcucucuuguuucc

SEQ ID NO: 347609 - RNA, 60 nt, Human
uuuuguuuuccacuugaauuacaccacccuagugugaaaucggggacuucaaagugcuug

SEQ ID NO: 347610 - RNA, 60 nt, Human
cuaucagggaagucaauggcuggccaguguagugugaagucccagcuuggcagagacuug

SEQ ID NO: 347611 - RNA, 60 nt, Human
guauauguuaggagguuauaaaucuuguggagugugaauuaaguauguggagugucuaga

SEQ ID NO: 347612 - RNA, 60 nt, Human
gucugaucagugcuaugagauggacagauaagugugaauguuuuauacagaaaauggaaa

SEQ ID NO: 347613 - RNA, 60 nt, Human
aaaaaaaaaaaaacuucauuggcuuguccgagugugaaaugcacauuuaggaagguuaca

SEQ ID NO: 347614 - RNA, 58 nt, Human
gucuuugauuuugugacauuucugcuuggaagugugaacuacccccccccccccgcuu

SEQ ID NO: 347615 - RNA, 60 nt, Human
aaaauuacugaaacuauuuuacugugaaacagugugaacuauuauaaugcaaauacuuuu

SEQ ID NO: 347616 - RNA, 60 nt, Human
ggacuaagggaagaacucucuaguucccucagugugaagccugucguguucucuccccuu

SEQ ID NO: 347617 - RNA, 60 nt, Human
ucacucacuggcugauacauuuaaagcagcagugugaauagcaaggacagacaccuucaa

SEQ ID NO: 347618 - RNA, 60 nt, Human
aauaggaguaaagcaugcacuacuuguugaagugugaaauggagacucuggacuuugggu

SEQ ID NO: 347619 - RNA, 60 nt, Human
aucuuugcacucuugugcuaguaugucuauagugugaauacauucauaaauuucuugauc

SEQ ID NO: 347620 - RNA, 60 nt, Human
ggcacggggcgucggcugcugcggccccgcagugugaacguuggcugcugccuuagcugc

SEQ ID NO: 347621 - RNA, 51 nt, Human; identical to SEQ ID NO: 280128

SEQ ID NO: 347622 - RNA, 60 nt, Human
gccacccuagugugcuaagcugagcagugcagugugaacagggcccaugguguauucuag

SEQ ID NO: 347623 - RNA, 60 nt, Human
uuuuuuuucuucuguuaguuuuuguuuuuaagugugaaugcaagugauuaaugaauacag

SEQ ID NO: 347624 - RNA, 60 nt, Human
guggugaacucuuaaggacuuuucccuucaagugugaaggaaggugugaugaaugcugug

SEQ ID NO: 347625 - RNA, 60 nt, Human
gaacuuucaccuuaaaaucuuucuaagcaaagugugaauaggauuuuuacucccuuugua

SEQ ID NO: 347626 - RNA, 60 nt, Human
ucaacaggguccuggaugagaugcgcugucagugugaaacggugcuugccaacaaucgca

SEQ ID NO: 347627 - RNA, 60 nt, Human
ccacaggagggagauguugucaaaugcuacagugugaacauguauuuugaauauucugua

SEQ ID NO: 347628 - RNA, 60 nt, Human
aaaaagacaaaugcccucauaguagugggaagugugaaggugaccgugaacauccuuccu

SEQ ID NO: 347629 - RNA, 60 nt, Human
caccguauuucuacuacuacuuaaugaaaaagugugaacuuuauagaauccucucuguac

SEQ ID NO: 347630 - RNA, 60 nt, Human
aaaaaugaccugacccuguagagagaacacagugugaauguuuccccucgugugagccca

SEQ ID NO: 347631 - RNA, 60 nt, Human
ucuuaaacuaggugauucuacuugauuuucagugugaagccauuaauaacgaacuuuaug

SEQ ID NO: 347632 - RNA, 60 nt, Human
guauaggucugccugcagggugaaaaugccagugugaauauucuagcuaccaaacauugu

SEQ ID NO: 347633 - RNA, 60 nt, Human
agggccuucuccagaucuguuccaacuuggagugugaagggcuugagcauacgggggaag

SEQ ID NO: 347634 - RNA, 60 nt, Human
ggaaauaagcccugcugcuuucuagaaauaagugugaaggauaaauuuucuuuguugacc

SEQ ID NO: 347635 - RNA, 60 nt, Human
uuuuagcuuuuaaaauuuaaaguguuuuugagugugaaaaguugaguaaaacuauuugca

SEQ ID NO: 347636 - RNA, 60 nt, Human
cauuuuacagaugaggaaauaaagccuacaagugugaaauuaauuuccuuacaguuuucc

SEQ ID NO: 347637 - RNA, 60 nt, Human
ggguacggagaguccccucugugggcuggcagugugaaugagaucuguuuagucucgugc

SEQ ID NO: 347638 - RNA, 60 nt, Human
ugugagugauaucugcauauguuucuguacagugugaaaugacugacccuguaguauagu

SEQ ID NO: 347639 - RNA, 60 nt, Human
gaccuuaauaggaaaaaaagaguaaagcucagugugaaugcaaacauccacaaaauauga

SEQ ID NO: 347640 - RNA, 60 nt, Human
uauaccuuaauauucagcugugaucucacaagugugaaaaaucuuaugaauguaaaaugu

SEQ ID NO: 347641 - RNA, 60 nt, Human
cucaccuucccugcugggucucuggggcacagugugaaacccgcacccuagccaggcccc

SEQ ID NO: 347642 - RNA, 60 nt, Human
acauaauucauaccaaacagaagcccuacaagugugaagaauguggcaaaaccuauaaac

SEQ ID NO: 347643 - RNA, 60 nt, Human
agaacauucauacugaagaggaacccuaugagugugaagaauauggcaaagccuucaaca

SEQ ID NO: 347644 - RNA, 60 nt, Human
agauaguucauacugaagaaaacuucuacaagugugaacaguguggcaaaacuuuuaaug

SEQ ID NO: 347645 - RNA, 60 nt, Human
aaaaaauuuauacuguacaaaaaccccacaagugugaaaaacauggcaaagccuuuaaga

SEQ ID NO: 347646 - RNA, 60 nt, Human
cacauaauuuauacuggacagaaauccuaaagugugaagaaugucacaaagcccuuaaua

SEQ ID NO: 347647 - RNA, 60 nt, Human
guaagauaauucauacuggagaaaacuaccagugugaacaacguggccaagcuucgacaa

SEQ ID NO: 347648 - RNA, 60 nt, Human
aacacgaccagguccgaaaugcaggucaugagugugaaauucucaaauuuacauaaaaag

SEQ ID NO: 347649 - RNA, 60 nt, Human
aaaugacauauaaguuauacauauuuauggagugugaaauuugauacauguauauaaugu

SEQ ID NO: 347650 - RNA, 60 nt, Human
uuauuccccaccugauaccuuauagagaaaagugugaauucagguggagaguaggcccag

SEQ ID NO: 347651 - RNA, 60 nt, Human
gaggagccuggccucuguccacccgucagcagugugaagucuguuguguuugagcuucuc

SEQ ID NO: 347652 - RNA, 60 nt, Human
cuuaccaugugcugauguaugugcucugccagugugaagggugaacagcuccaacuuuau

SEQ ID NO: 347653 - RNA, 60 nt, Human
uuuauaccuauuuauguauuuauuuauugaagugugaaauugagcaauaggcaggcacca

SEQ ID NO: 347654 - RNA, 60 nt, Human
aagugggaaaaucuuccaacuguccucuagagugugaauauaugaaaggagucagagugg

SEQ ID NO: 347655 - RNA, 60 nt, Human
aagauaauucuuacuagaaaaacucuuacaagugugaagaauguggcaaaauuuuuaaug

SEQ ID NO: 347656 - RNA, 60 nt, Human
agauaauuuacauuggaguaaacuucuacaagugugaagaauguggcaaaacuuuuaauu

SEQ ID NO: 347657 - RNA, 60 nt, Human
uccacacucaagagaacgggaugauacaagagugugaauaaguccuggagacaggaccac

SEQ ID NO: 347658 - RNA, 60 nt, Human
acucuuacucaacaucaaagaauucauaccagugugaaacccuaugaauguaaggaaugu

SEQ ID NO: 347659 - RNA, 60 nt, Human
accaugcuaaccaccaaggcaaagcagcacagugugaauagaacagagcgggaucaagaa

SEQ ID NO: 347660 - RNA, 60 nt, Human
ucuuaccgcucaugggccucaguuuccuaaagugugaaaugucaggcacuucccucuaac

SEQ ID NO: 347661 - RNA, 60 nt, Human
ccuccauaucucccucuucccuaggagaggagugugaagcaaggagcuuagauaagacac

SEQ ID NO: 347662 - RNA, 60 nt, Human
uaucuuggggaccagcuaagucucugcaguagugugaaauuccaaaugguuguuuuauca

SEQ ID NO: 347663 - RNA, 60 nt, Human
acuucugagucgcccaucuguugcugugggagugugaacggaucgcugaaggagagggag

SEQ ID NO: 347664 - RNA, 60 nt, Human
ccgcccuucguucugaguaauaauaccgucagugugaaaacauuccguaguuuagaagua

SEQ ID NO: 347665 - RNA, 60 nt, Human
uuccaucacuguuaaugaucagaguaacaaagugugaaaaauaagaaaccaucauugaug

SEQ ID NO: 347666 - RNA, 60 nt, Human
cacacuuccuuccuucuuuggugucugaggagugugaacuguuggggucaguuaagaccc

SEQ ID NO: 347667 - RNA, 60 nt, Human
gagccuugauucccuuguuauucaacagcaagugugaauacugcuugaauaaacaccacu

SEQ ID NO: 347668 - RNA, 60 nt, Human
gagagcccagugaacugacccuucaggcugagugugaagcgucucagaggcauuucagaa

SEQ ID NO: 347669 - RNA, 60 nt, Human
ucaagugauucucaucucagccucccaaguagugugaacuaaaggcaugugccaccacgc

SEQ ID NO: 347670 - RNA, 60 nt, Human
cccaagguagaauuguaauaagcaugugccagugugaaagcuggaaggaaaaaagcuauu

SEQ ID NO: 347671 - RNA, 60 nt, Human
aacguacagccaggcccgugugcuguuaauagugugaaauugucauguuaaaaaaaaaaa

SEQ ID NO: 347672 - RNA, 60 nt, Human
uccuccuuaaccacuuaucucccauaugagagugugaaaaauaggaacacgugcucuacc

SEQ ID NO: 347673 - RNA, 60 nt, Human
uuuauauuccuguuucuaaaucagcucuucagugugaaagaaaacacguuucuguaacag

SEQ ID NO: 347674 - RNA, 60 nt, Human
uacuaacucaugacuugggagcuaagcccaagugugaaaccucuggauccuauggauuug

SEQ ID NO: 347675 - RNA, 60 nt, Human
ccaaagcugcugccuggccccuugcuguaaagugugaagggggcggcugaguucucuuag

SEQ ID NO: 347676 - RNA, 60 nt, Human
uguauguuaaaggaucuccacaaugucugcagugugaaggcagguucauuguggaauagu

SEQ ID NO: 347677 - RNA, 60 nt, Human
uucugaaacuggagcgguucaacguuauccagugugaaaaucagugaguccucccuggca

SEQ ID NO: 347678 - RNA, 60 nt, Human
caugugaugucaugaaacuguacauacugcagugugaauuuuuuuguuuuguuuuuuaau

SEQ ID NO: 347679 - RNA, 60 nt, Human
ggugccacaaugcaaaugcuuaaggcacggagugugaaugugaagacacaagcucuuucu

SEQ ID NO: 347680 - RNA, 60 nt, Human
uagaaauacuuccaggaaaugcuuuuuugaagugugaauuaauaagaaaugggguaaaua

SEQ ID NO: 347681 - RNA, 60 nt, Human
agaaaagaucaauagcuuuagccacauggaagugugaacauccugauggggaaaauacca

SEQ ID NO: 347682 - RNA, 60 nt, Human
auaaaugacuuuuaaagggguuguauguuuagugugaacaaagacaguacaaagcauaua

SEQ ID NO: 347683 - RNA, 60 nt, Human
uaugauacggguuucuugggucugauguacagugugaauaaaugcuugcagcucuuagcu

SEQ ID NO: 347684 - RNA, 60 nt, Human
gugcugagggcugugagaaugugaaacaacagugugaaaauuggcugugacacucugguc

SEQ ID NO: 347685 - RNA, 60 nt, Human
gucaagauauaaaggugucagcuaguuuuaagugugaaacuuauuucacuuucacacugc

SEQ ID NO: 347686 - RNA, 60 nt, Human
gucuggaagggcaggugggagcugugacacagugugaaaaagcauuuguagagagacuuu

SEQ ID NO: 347687 - RNA, 60 nt, Human
gaagccggcguccugcucacaaacugggaaagugugaaaacuauuuaagauaauuauuac

SEQ ID NO: 347688 - RNA, 60 nt, Human
gaaccaacaucaggggcaccugccaugaugagugugaagaaaucauuucucuaugcaaga

SEQ ID NO: 347689 - RNA, 60 nt, Human
uauggcuuuuguguaguuagggguuuuuuaagugugaagaaagguaugugggcuuuaaaa

SEQ ID NO: 347690 - RNA, 60 nt, Human
uguugcuguaaaguguuuuucuccauaggaagugugaacuguguauugucuauuguuagu

SEQ ID NO: 347691 - RNA, 60 nt, Human
ugaggaccucauccaaacaauuuaaaaaugagugugaagggggaacaagucaaaauauuu

SEQ ID NO: 347692 - RNA, 60 nt, Human
cagucaacaggggugugauggugaaggcagagugugaaaaacgugagagaggaagagaaa

SEQ ID NO: 347693 - RNA, 60 nt, Human
uuaaggagaaagaaauuaauauacaagcugagugugaaaguagaaaucaccuacaccaga

SEQ ID NO: 347694 - RNA, 60 nt, Human
auaauaacagcaguggaguaaguauuuagaagugugaauucaccgugaaauaggugagau

SEQ ID NO: 347695 - RNA, 60 nt, Human
ccuaccuuaccccucugccccuagccaaggagugugaauuuauagaucuaacuuucauag

SEQ ID NO: 347696 - RNA, 60 nt, Human
uucuucuaaaaucaaagcaugaugcuugacagugugaaauguccaauuuuaccuuuuaca

SEQ ID NO: 347697 - RNA, 60 nt, Human
gaacagcaacaagagaguucuaacaauucuagugugaagccaaauagugaucuuuuagug

SEQ ID NO: 347698 - RNA, 60 nt, Human
guacagcauaucuauacaaaauucugcuauagugugaaaaucagggcuaaaaaccugaag

SEQ ID NO: 347699 - RNA, 60 nt, Human
uuuacugucacuuuugauauggucuuauccagugugaacagcaauuuauucuuauuuuug

SEQ ID NO: 347700 - RNA, 60 nt, Human
uuuuuauucagcagacuuucucuguguaugagugugaaugaucaaguccuuugugaauau

SEQ ID NO: 347701 - RNA, 60 nt, Human
gucacugcaauaaguggguuuuagaaaauaagugugaaaagaaucagguguuaauauaau

SEQ ID NO: 347702 - RNA, 64 nt, Human
cgcuggcgcauccuggguggaggcaggccccgagcucggggaagggguuuucccuuccucucug

SEQ ID NO: 347703 - RNA, 64 nt, Human
cagcagcaguaacaugguaacacuuaaaaugguacucggggaccuccaaagacuaaacugacaa

SEQ ID NO: 347704 - RNA, 64 nt, Human
ugggggcuucguuuuuuucccugccucugcgccucucggggaacacauuccgggagagaugccu

SEQ ID NO: 347705 - RNA, 64 nt, Human
cucucaucgccucggcgccucccaccuucacccucucggggaugccuccccaagaggguaguua

SEQ ID NO: 347706 - RNA, 64 nt, Human
agagcagaggcugaggcacggggagccagccccacucggggaccagaaguggaaccaaaaacaa

SEQ ID NO: 347707 - RNA, 64 nt, Human
uuccuggagcuggccugagagggcucaauggacccucggggacccaaguggggcuuucaacccu

SEQ ID NO: 347708 - RNA, 64 nt, Human
gcaccacagaagacagggagucaucgaagggcugcucggggagguggcagggcggaggaccugc

SEQ ID NO: 347709 - RNA, 64 nt, Human
ggaggcagggcccaggagaacaaaguguggaggccucggggaguggcuuuuccagcucucaugc

SEQ ID NO: 347710 - RNA, 64 nt, Human
uuuuucuccccauuugggacaucaagccuagcaucucggggaccugcuucacaaguuacaguuc

SEQ ID NO: 347711 - RNA, 64 nt, Human
ccuugaagccgcggcgaaccucuuccuacccuaccucggggaccugguggcagcggcggccucc

SEQ ID NO: 347712 - RNA, 64 nt, Human
gggugguguugggaagaaaaauuggucagcuuggcucggggagaaaccugguaacauaaaagca

SEQ ID NO: 347713 - RNA, 64 nt, Human
uuuugugauuuauuuuggcguuaugaguuugacucucggggaguuuuguuguuaugacucuugu

SEQ ID NO: 347714 - RNA, 64 nt, Human
aggcuagugagcugugacucccacugcacuccagcucggggaacagagcgagaccuugucucua

SEQ ID NO: 347715 - RNA, 64 nt, Human
guguuuuuguuuuuguuuucuuuccaaagcucaccucggggacaauuccuugggcuucuccuga

SEQ ID NO: 347716 - RNA, 64 nt, Human
aaggcccagggcgccagacggccccgaaaaggcgcucggggagcguuuaaaggacacuguacag

SEQ ID NO: 347717 - RNA, 64 nt, Human
ggcgccgccuuuuuagcuuggacuucaguccucccucggggacucaccuccggaguaaacggcu

SEQ ID NO: 347718 - RNA, 64 nt, Human
accucuaagagaacuuucugaauuugcagcuaaucucggggaagagaaagauagguuuaauuua

SEQ ID NO: 347719 - RNA, 64 nt, Human
caugugcaugaaaugaggaguuugaguuagucaccucggggauuuuuuccauuuugcaguaaaa

SEQ ID NO: 347720 - RNA, 64 nt, Human
gcuagugagcugugauuguaccacugcacuccagcucggggaacagagcgagaccuugucucua

SEQ ID NO: 347721 - RNA, 64 nt, Human
gggcuucccuuaucccccagaacacucuaccaaccucggggaacucgggcacauccuucuguuu

SEQ ID NO: 347722 - RNA, 64 nt, Human
agcgggaugacuguucacugccacuguccuguggcucggggaaggagagucgaugcuguucccg

SEQ ID NO: 347723 - RNA, 64 nt, Human
ggaagcuagugacagaaucccaaggauuugaaagcucggggaguccccagccugccugcuagga

SEQ ID NO: 347724 - RNA, 64 nt, Human
ggagaacccugggaaggaccugguucuuuugcuucucggggaacuguaagcccucgcguucugg

SEQ ID NO: 347725 - RNA, 64 nt, Human
uuaucgacaucuuugaagcuggggccccugcaaccucggggagugccacuucgggagaagaagg

SEQ ID NO: 347726 - RNA, 64 nt, Human
guugauguuuaaagagaaguucccagccaagggccucggggagcguucuaaauaugaaugaaug

SEQ ID NO: 347727 - RNA, 64 nt, Human
agggggcugugucugcgugucaguuugugucugucucggggaaugugugucuguggcccaagca

SEQ ID NO: 347728 - RNA, 64 nt, Human
gcaguccagccugggugacagagccagacacugucucggggaaaaaaaaaaaaaaaaaaagaca

SEQ ID NO: 347729 - RNA, 64 nt, Human
augggcagggaaggaaggggucugccgaccccagcucggggaauuucacuagccccuuugcuuc

SEQ ID NO: 347730 - RNA, 64 nt, Human
accuauuuccaaaaaagguccuuucagugguagacucggggagaacuugguggccccuuugaga

SEQ ID NO: 347731 - RNA, 64 nt, Human
ccuggaguagggagagcgaguuugggagcugggacucggggagucaaaaauagaugaguaauug

SEQ ID NO: 347732 - RNA, 64 nt, Human
cagaauucacugucuguugcuucaguaaaaggaccucggggaauaaaacauuucucucuuauau

SEQ ID NO: 347733 - RNA, 64 nt, Human
aggggaggagcauuaaagcugaaagaucgcucugcucggggagccugggcagagcagcagcaac

SEQ ID NO: 347734 - RNA, 64 nt, Human
ggaugucccucuacuguuagcacagauugagaaccucggggacuugagccuucugcaggggaug

SEQ ID NO: 347735 - RNA, 64 nt, Human
ucccgggcccacccagcugcccagccuuugcccacucggggagcagaucaugcaugccaauccc

SEQ ID NO: 347736 - RNA, 64 nt, Human
ccagggcucagccaagcccugcaguguguccccgcucggggagggcccggccgagcgggcaggg

SEQ ID NO: 347737 - RNA, 64 nt, Human
agggucaagagcaugaacgcaucaauagaaagaacucggggaaacaucccaucaacaggacuac

SEQ ID NO: 347738 - RNA, 64 nt, Human
gcuccucuccagcauuuccucucaccuccguguucucggggagugcguggugucagaucccauc

SEQ ID NO: 347739 - RNA, 64 nt, Human
guccaggaggggucccagggccuucaugcguggucucggggaagaagcuuccucuggccuggcg

SEQ ID NO: 347740 - RNA, 64 nt, Human
uuucccagugaaauaaaaaaaaauuuuaaguguucucggggaugcauagauucaucauuuucuc

SEQ ID NO: 347741 - RNA, 64 nt, Human
ccauaauaggaggggaaaaucaccccccagccaccucggggaacuccagaccaagggugagggc

SEQ ID NO: 347742 - RNA, 64 nt, Human
cuuuguguuuuguugcucuguuuccugaaaauaacucggggaugcuccugguuuguccaucuac

SEQ ID NO: 347743 - RNA, 64 nt, Human
cucguuucagaaaagaggccagcucugcagcccccucggggacgcccccaccagcucaaauucc

SEQ ID NO: 347744 - RNA, 64 nt, Human
ugacuuguauuccuuuuagcaguagccuucuucccucggggagccaaagagugugguguguggc

SEQ ID NO: 347745 - RNA, 64 nt, Human
uuacccagcuacccaguagcauaacuuuucacagcucggggaugaauuaacauggcugaaauaa

SEQ ID NO: 347746 - RNA, 64 nt, Human
ggguggcccagagccauacugcguccacccugagcucggggacaggugacaguggcugcucugg

SEQ ID NO: 347747 - RNA, 64 nt, Human
aagcuggugugucaucagcaaagaccucagccgccucggggaugagaggggacucguggggcaa

SEQ ID NO: 347748 - RNA, 64 nt, Human
guaaggccucccggucagcauuauccugccagaccucggggaggauaccugggagacagaagcc

SEQ ID NO: 347749 - RNA, 64 nt, Human
agcacugccacggaagucucccccuuugccaagccucggggacugguuucuaagacaaccgugg

SEQ ID NO: 347750 - RNA, 64 nt, Human
agggccagguagaaaggacaaacuuggucucugccucggggaagcaggaggagggcuagaagcc

SEQ ID NO: 347751 - RNA, 64 nt, Human
agccccuggcucacuggcacagggcaggugggcucucggggaaggugucgggggcccccuagga

SEQ ID NO: 347752 - RNA, 64 nt, Human
cacacaccacccuuccggagcagcucagucagcccucggggacgagaaaccacaagcgcagaga

SEQ ID NO: 347753 - RNA, 64 nt, Human
gucaugccagugagggacgucagacuuggcucagcucggggagccuuagccgcccaugcacugg

SEQ ID NO: 347754 - RNA, 64 nt, Human
ggcgccuuugccccuggagucaagacccacagcccucggggaccaccuggagucucuccauccu

SEQ ID NO: 347755 - RNA, 64 nt, Human
uguuuggcuguuggcucaccgagaccagccucaucucggggaaccugcaccgcaucggagauau

SEQ ID NO: 347756 - RNA, 64 nt, Human
agaccccacuguccaccggggcgcagaccccugacucggggacuugggauguuccucuuggugu

SEQ ID NO: 347757 - RNA, 64 nt, Human
gcucaucuccagcauuuccucucaccuccguguucucggggagugcguggugucagaucccauc

SEQ ID NO: 347758 - RNA, 64 nt, Human
gcucaucuccagcauuuccucucaccucuguguucucggggagugcguggugucagaucccauc

SEQ ID NO: 347759 - RNA, 64 nt, Human
gcuccucuccagaguuuccucucaccuccguguucucggggagugcguggucucagaucccauc

SEQ ID NO: 347760 - RNA, 52 nt, Human
acugcucucaccaccuaugaaacucggggaaaccagcccagcuaaguccgga

SEQ ID NO: 347761 - RNA, 64 nt, Human
ucagaguuugcuuugauuucccuuuccuuuccuucucggggaccaguucuuacuuccuuuuauu

SEQ ID NO: 347762 - RNA, 61 nt, Human
uggggcugcugcggcccuaggccuggcugggcucggggaccacaucuggcccccggcccgc

SEQ ID NO: 347763 - RNA, 64 nt, Human
aggaugcugccuccaagaggugugagcccucugucucggggaugaacaagcagagucugggcua

SEQ ID NO: 347764 - RNA, 64 nt, Human
gucugcaguccaggcguguggagccgccucccggcucggggaggccccggggcugggaacgccu

SEQ ID NO: 347765 - RNA, 64 nt, Human
cccggcaaauaggcaccgcacuuuacucuugggacucggggacuuggcuuccuuccuggcaagg

SEQ ID NO: 347766 - RNA, 64 nt, Human
gccucagggcugccugacuugaauggcguuggaccucggggauuacugguagauaauaugcucu

SEQ ID NO: 347767 - RNA, 64 nt, Human
acugaggccgguuccuuccuggaggccuccuguccucggggaccccagcaccucaucaucagca

SEQ ID NO: 347768 - RNA, 64 nt, Human
uccccuccccugaaagucugggaaccugagaguccucggggagggguccuggaugugaugaggg

SEQ ID NO: 347769 - RNA, 64 nt, Human
cauguuggcuggucccaugugugaaagggacucucucggggaaaccaaggcccagccccucccc

SEQ ID NO: 347770 - RNA, 59 nt, Human
aacuccagcuggcgcuuugaggggucucccucggggaccguucagugucccaggcagca

SEQ ID NO: 347771 - RNA, 64 nt, Human
gugggcacaagacagucaaaugggcaaggccugccucggggaacuagaaccuuccaggaucugg

SEQ ID NO: 347772 - RNA, 54 nt, Human
acaggcuggugaaagaaugagagacucggggagcagggaggggggaagagacgu

SEQ ID NO: 347773 - RNA, 64 nt, Human
caucuaguuccccaaucgaugcucucagggucaucucggggaucacagggauccuuaaaucucc

SEQ ID NO: 347774 - RNA, 64 nt, Human
ugacaguccuccuagcacccccauggcuuugagccucggggacucaucaaguccaagaaaagag

SEQ ID NO: 347775 - RNA, 64 nt, Human
cagcauaccccugggaccccucggccacugcccacucggggagccuucucuguuucuggggccu

SEQ ID NO: 347776 - RNA, 62 nt, Human
agauggagaccccccugugacugacucuucuucucggggacacaggccagcuccacaguguu

SEQ ID NO: 347777 - RNA, 64 nt, Human
ccgcaagcuguuuccagagugcaggagccaagugcucggggacccuuugaaaagugccugggga

SEQ ID NO: 347778 - RNA, 64 nt, Human
gaggcaaggggugccaggaguccccagcggcauccucggggagaugcuggugagggguccguac

SEQ ID NO: 347779 - RNA, 64 nt, Human
uggguuuagggggccauuuguguggaccaaucuacucggggaauuccaggcccaccaggacacg

SEQ ID NO: 347780 - RNA, 64 nt, Human
ugcuaugacaaaaccuuuaaucugcaccuuacaacucggggacaaauggggacaggaaggauca

SEQ ID NO: 347781 - RNA, 64 nt, Human
uccagcacccugggucgcugucaucuguguuuagcucggggagugcccccuaagggggcgaacu

SEQ ID NO: 347782 - RNA, 58 nt, Human
acagaggcagccggcuguagcucaaggccucggggaggagcaggagguggaaucccug

SEQ ID NO: 347783 - RNA, 64 nt, Human
ggaugacucagcagggaugauucagcagagauaacucggggaugacucugauuguccuucagca

SEQ ID NO: 347784 - RNA, 64 nt, Human
cggcgggugggcccgccccacgcacgcacgcacacucggggacuuugugcaugccccucgugcc

SEQ ID NO: 347785 - RNA, 64 nt, Human
caccagucgcguaagacaacagcagugucuccaccucggggaccaaggacgccuccgugccucc

SEQ ID NO: 347786 - RNA, 64 nt, Human
guugugagcccuuaaaagggacaggaauugcucacucggggagcucggcucuugagacagcagu

SEQ ID NO: 347787 - RNA, 64 nt, Human
uccaucagcucccugggccuuccccgcaacccaccucggggaucugaggaucuggugcauagau

SEQ ID NO: 347788 - RNA, 64 nt, Human
gagggucccagggcugcaaaacuggaagcacagccucggggauggggagggaaagacggugcua

SEQ ID NO: 347789 - RNA, 64 nt, Human
caaguggaauaucuuauauugggcgauuugggggcucggggaggcagagaaucucuugggaguc

SEQ ID NO: 347790 - RNA, 64 nt, Human
aggccacguuguauccccaggaccccauccuguucucggggacccugcgcaugaaccuggaccc

SEQ ID NO: 347791 - RNA, 64 nt, Human
gggaacagugugcaaggcagccgugggccccacccucggggauguguccugacacugcaauugg

SEQ ID NO: 347792 - RNA, 64 nt, Human
gguuguuuuuaaugcauggaaacuaaacagauuccucggggaguuccugaaggaaccagguggg

SEQ ID NO: 347793 - RNA, 64 nt, Human
uguucagaguggcucacuggcugggaguccuuaccucggggagagggggagguugguuccuugg

SEQ ID NO: 347794 - RNA, 64 nt, Human
agagcugcagcauugacugugcuuccguucuucccucggggauugcucauggcaugggccucuu

SEQ ID NO: 347795 - RNA, 64 nt, Human
ggaaaugccaauccauccuucccccagcugcuuccucggggaggccccugcccccacccugcca

SEQ ID NO: 347796 - RNA, 64 nt, Human
ccgagcugcccuggaugggcugcuggcaugccaacucggggagcgcccuguucugaaggcaccu

SEQ ID NO: 347797 - RNA, 64 nt, Human
aaaccaauuucuaagaggacuggauugcagaagacucggggacaacauuugauccaagaucuua

SEQ ID NO: 347798 - RNA, 64 nt, Human
caggacccacacagaagccuguggccccacuuaccucggggagucaugugcuuugaacucacgc

SEQ ID NO: 347799 - RNA, 64 nt, Human
gcaugucccacccacccgccgccucccacggcaccucggggacaccagagcugccgacuuggag

SEQ ID NO: 347800 - RNA, 64 nt, Human
gcccggcccccguccgcgcgcgucccccggugaccucggggagcagcaccccgccucccuccag

SEQ ID NO: 347801 - RNA, 64 nt, Human
uguggucucagugacccgucccccugacagugggcucggggagcugcaucacccagccuucccc

SEQ ID NO: 347802 - RNA, 64 nt, Human
acgcugaauacagugaacagggacauucccgccacucggggacagaugggcacaagggagggga

SEQ ID NO: 347803 - RNA, 64 nt, Human
ccucagaugggccccuccgcagccccuucccuugcucggggaaagcccccaauucugcccacac

SEQ ID NO: 347804 - RNA, 64 nt, Human
auguuuugggugacaggaccuauggaccacuauacucggggaggcaggguagcaguucuuccag

SEQ ID NO: 347805 - RNA, 64 nt, Human
cggggauggagugggccggcggccaaaccagucacucggggaggaaugcggaggagcgcucauu

SEQ ID NO: 347806 - RNA, 64 nt, Human
caguggcagcagccagggccgugguccagucccacucggggauggagugggccggcggccaaac

SEQ ID NO: 347807 - RNA, 64 nt, Human
uccagcagcccggccacgcagcuucccaggugggcucggggaggugggagcagggaccaucucu

SEQ ID NO: 347808 - RNA, 64 nt, Human
guuaaacgggcugagcguuccagguaaacugaggcucggggaggggaaggacaggcuggccucu

SEQ ID NO: 347809 - RNA, 64 nt, Human
gggacagccgugcccagacugugcguuugcuuagcucggggacagcacuuggcccggggucucc

SEQ ID NO: 347810 - RNA, 64 nt, Human
uucuacaugcuugagcuugaaaagcagucaccuccucggggaccccucaguguagugacuaagc

SEQ ID NO: 347811 - RNA, 64 nt, Human
ucuggccgucagccgcgggccgcugggaacuccacucggggaacuccuuuccaagcugaccuca

SEQ ID NO: 347812 - RNA, 64 nt, Human
ccacaucucugaggccugcacccccucugucuagcucggggaguccagccccagucccgcaggc

SEQ ID NO: 347813 - RNA, 64 nt, Human
cugguggucgugugugugcggaguccacggaagccucggggagguggagcugcuccuuccauuc

SEQ ID NO: 347814 - RNA, 64 nt, Human
ggcuggccaggacccaaccccuagaucccaccaacucggggaacaucaccccagagcccagccu

SEQ ID NO: 347815 - RNA, 64 nt, Human
ggcugggagcccauucccagugcuucccaaggcccucggggacaucuaccgccaacccagcugc

SEQ ID NO: 347816 - RNA, 64 nt, Human
ucagguagagcaccagcuucccugaccgcugcugcucggggagggcuggggcuggccggggguc

SEQ ID NO: 347817 - RNA, 64 nt, Human
aagccagucaauuaugacaagguuaaagaaguaacucggggaaaagaugaaaaucccgcucugu

SEQ ID NO: 347818 - RNA, 64 nt, Human
agggggcagucuuccucccccuccccgaccaaaccucggggagcccuccugugccccucccucc

SEQ ID NO: 347819 - RNA, 64 nt, Human
aauucugguccccgcucucugucccaucaucugccucggggacuuccucucuccgugguucuca

SEQ ID NO: 347820 - RNA, 64 nt, Human
ccauccuucccuggugauucuugaucuucaaagccucggggaucccagguuuccccauguaacu

SEQ ID NO: 347821 - RNA, 64 nt, Human
cacuaaggugauggacggcgucugcugggcaggccucggggaggaccccucagcuuugcucuca

SEQ ID NO: 347822 - RNA, 64 nt, Human
aggccugucugaagcaugcaguucuguggugcugcucggggauggacuccaugcacaguccacu

SEQ ID NO: 347823 - RNA, 64 nt, Human
uaucccaggaccugagaagggccugcucacccuccucggggaggggaagcaccaggguuggugg

SEQ ID NO: 347824 - RNA, 64 nt, Human
uuguuuuuguuuuuguuuucuuuccaaagcucaccucggggacaauuccuugggcuucuccuga

SEQ ID NO: 347825 - RNA, 64 nt, Human
gaagcuggcugugcacuuacccccaucuuucucccucggggagacgacccaaggaauuucagag

SEQ ID NO: 347826 - RNA, 64 nt, Human
caggaagcauggcagcaucugcuucuggggagaccucggggagcuuuugcucaugguggaaggc

SEQ ID NO: 347827 - RNA, 64 nt, Human
uuuauuuuucaauuuguuuuuucaaaaaucucuucucggggacaacaucugaaggguauguugc

SEQ ID NO: 347828 - RNA, 55 nt, Human
cucaggaagaugacgaguaacuccccucggggauaugacacaugcccaugaugag

SEQ ID NO: 347829 - RNA, 55 nt, Human
cugaagaagacgacgaguaacuccccucggggauacgacacaugcccaugaugag

SEQ ID NO: 347830 - RNA, 55 nt, Human
cugaggaagaugacgaguaacuccccucggggauaugacacaugcccaugaugag

SEQ ID NO: 347831 - RNA, 55 nt, Human
cugaagaagacgacgaguaacuccccucggggauacgacauaugcccaugaugag

SEQ ID NO: 347832 - RNA, 64 nt, Human
augaauguauggaauucaauugaauuugcauggucuucggaauuuuuucuguguguauaaauuu

SEQ ID NO: 347833 - RNA, 64 nt, Human
gaccgggcgcagugacucacaccugugaucggcacuucggaaggccgaggcgggcagaucacug

SEQ ID NO: 347834 - RNA, 64 nt, Human
gauagugaugccacacauucucucucaauuucagcuucggaacgcuaugaaaauaauacaugau

SEQ ID NO: 347835 - RNA, 64 nt, Human
uaaaaagaaaaaacaaacaacaacaaaaaaaacucuucggaauaaagagggcuguaaauuuuga

SEQ ID NO: 347836 - RNA, 64 nt, Human
ugaaaugucuuucauaaaaugugcuacaauuagccuucggaauauuugcugggugauuuaaaug

SEQ ID NO: 347837 - RNA, 64 nt, Human
aguggaggagcugacagacaccuucuauuaucgucuucggaaguuaccagccugugagauccaa

SEQ ID NO: 347838 - RNA, 64 nt, Human
ugaggcuucuuuucucucauuucccauggaaggacuucggaaaugccuuaaguuccccucuuua

SEQ ID NO: 347839 - RNA, 64 nt, Human
guggauucugacggggaagguguagcucuguucucuucggaagaccucguuuucuaaaggcugg

SEQ ID NO: 347840 - RNA, 64 nt, Human
ccggcccgccuccauccaaaaucacgcucgcgugcuucggaagcauccgggucacuccuucucc

SEQ ID NO: 347841 - RNA, 64 nt, Human
aaaaggaaguccucagcugugccagcucccagagcuucggaagaaagagcagcagcucucuccc

SEQ ID NO: 347842 - RNA, 64 nt, Human
caaaggaaguccugggcugugccagcucccagagcuucggaagaaagagcagcagcucucuccc

SEQ ID NO: 347843 - RNA, 64 nt, Human
auccaggaaggggcgcguagaugcuuaacggucucuucggaaauccugcaaauagaaagauaau

SEQ ID NO: 347844 - RNA, 64 nt, Human
caagcuaccuggagggacaggacccaccuccauccuucggaaggccuuccuggaaucccaccuu

SEQ ID NO: 347845 - RNA, 64 nt, Human
uaauuuuugugcaaaaacaaaccugaaaaauaugcuucggaaacugugcauaguucuaauugua

SEQ ID NO: 347846 - RNA, 64 nt, Human
ugaaagagacaguuuuagacaggcauaugaagaucuucggaaacaaaggcuuaaugaauuuaug

SEQ ID NO: 347847 - RNA, 64 nt, Human
ucugcaaggucacuuacauagccccacucagcugcuucggaaagcgugacgaagcaguaguccu

SEQ ID NO: 347848 - RNA, 64 nt, Human
gacugacaggguuauuugccucauccacauccaccuucggaauacauuaacuuccuuuguaauu

SEQ ID NO: 347849 - RNA, 64 nt, Human
acguaacaaccagcuaaaacugagagcacacagccuucggaaacccccaaggugucgaggagga

SEQ ID NO: 347850 - RNA, 64 nt, Human
ggcauuuuuauuugaauaugaugaguauauuuugcuucggaaauaauauaggaaggaaauguaa

SEQ ID NO: 347851 - RNA, 64 nt, Human
ugaccuugcuagucugcccacucccuacccccagcuucggaaaauacagagaccaccaccacgu

SEQ ID NO: 347852 - RNA, 64 nt, Human
gaugcaauuuugaaauguugcuuguucuggaauacuucggaaguuaaacaauaaagucagcuug

SEQ ID NO: 347853 - RNA, 64 nt, Human
aaccuucuaggagaaccggagccuuaccaucaaacuucggaaacggaagccagagaaaaaggua

SEQ ID NO: 347854 - RNA, 64 nt, Human
aaaagaccagggcuuuucccaggaauaucccaaacuucggaaacaaguuauucucuucacuccc

SEQ ID NO: 347855 - RNA, 64 nt, Human
ggcacgguggugacucaagccuauaaucccagcacuucggaaggcggaggcaggaggaucgcuu

SEQ ID NO: 347856 - RNA, 64 nt, Human
gggaguccccuccuccgccaccgagaguccugugcuucggaaugaagggagggcgaccuccuug

SEQ ID NO: 347857 - RNA, 64 nt, Human
ugucaucaugucuguguguauguuagucugucaacuucggaaugugugcgugugugugcaugca

SEQ ID NO: 347858 - RNA, 54 nt, Human
uguuacgauauugugcuugaaguucuucggaaacuucugacuuuggauuaagaa

SEQ ID NO: 347859 - RNA, 64 nt, Human
ggcuccuaaucuccagcuuuccugucauugaaagcuucggaaguuuacuggcucugcucccgcc

SEQ ID NO: 347860 - RNA, 64 nt, Human
cacggugcacgcauuucccugaaggcagccccuucuucggaagcagcuguuccaggccucggaa

SEQ ID NO: 347861 - RNA, 64 nt, Human
acagcuguuccuccccuccccgccgacuccaacucuucggaaucugcccacucggggcugcagg

SEQ ID NO: 347862 - RNA, 64 nt, Human
guguauacagaugaggguguccgcugcugcuuuccuucggaauccagugcuuccacagagauua

SEQ ID NO: 347863 - RNA, 64 nt, Human
acgccacagcccuuuugucucugcaaacugccuucuucggaaagaagaaggugggaggauguga

SEQ ID NO: 347864 - RNA, 64 nt, Human
cuugauuacacuggcagcucuaugaguagaaagucuucggaauuuagaacccaucuaugagaga

SEQ ID NO: 347865 - RNA, 64 nt, Human
uauauacaaccugcuuggguggagaagccauugucuucggaaaccuugguguaguugaacugau

SEQ ID NO: 347866 - RNA, 64 nt, Human
caugggaaguuucgauagaagagaaagcugagaacuucggaaaaggcucaucugucacccugga

SEQ ID NO: 347867 - RNA, 64 nt, Human
cacgaacaaaggcaacaagcaugcagccagcaagcuucggaaaaccacagcaucaaagacaucc

SEQ ID NO: 347868 - RNA, 64 nt, Human
guugugugcggcagcaguuggcguuugcuuugcacuucggaaccuguugcguuuugacccacgg

SEQ ID NO: 347869 - RNA, 64 nt, Human
uugcuuuuuccuaaggauuuugcugcaaagucuccuucggaacccgaacugcaagcugagcgcc

SEQ ID NO: 347870 - RNA, 64 nt, Human
auguguucaauugugggauuauaacuucuuuacacuucggaaagauuagccuagacuaacuuca

SEQ ID NO: 347871 - RNA, 64 nt, Human
acuuccucagcagaaacccgucaugacgcggcugcuucggaagcagacaucuggggacacagcc

SEQ ID NO: 347872 - RNA, 64 nt, Human
guuggaaccacagcucugggaacugggaaaagugcuucggaaggcuggguaaguggucuuggaa

SEQ ID NO: 347873 - RNA, 64 nt, Human
gggccagaaaugaaaacaggcaaguaaaguauuucuucggaaaacauuuuaucaaaccaaaugu

SEQ ID NO: 347874 - RNA, 64 nt, Human
cuuaacaauugcugucugaaaaugagagagaagacuucggaagcacauuguguucauaauguac

SEQ ID NO: 347875 - RNA, 64 nt, Human
gcaggacccgcacgccucuucccacaccugucagcuucggaagcaucucucgaggacucugguc

SEQ ID NO: 347876 - RNA, 64 nt, Human
acccuaugugugccacaauggacguuagcagcugcuucggaacaccgucccuccuaugcacccu

SEQ ID NO: 347877 - RNA, 64 nt, Human
uuugaauauuuuagaugggacaaaaauuguucaucuucggaauuuauuuaaagaaagaucuacu

SEQ ID NO: 347878 - RNA, 64 nt, Human
gagguuuuaagaagcgucugccgugaucauggagcuucggaagcgggaaugguucuuccggguu

SEQ ID NO: 347879 - RNA, 64 nt, Human
aauguuucugaaauggguauaauuucguccucuccuucggaacacuggcugucucugaagacuu

SEQ ID NO: 347880 - RNA, 64 nt, Human
uuuuuuuaucgauaacauagugagcucucugccucuucggaacgauguccacuuugcuuaugau

SEQ ID NO: 347881 - RNA, 64 nt, Human
uugggcagccuugccuccagagagcagauuccagcuucggaagccccuggucuaacuugggauc

SEQ ID NO: 347882 - RNA, 64 nt, Human
agcaucuuucuagucccuaugcuguaugcuugaacuucggaaaaugcuuuuccccgcccaaucu

SEQ ID NO: 347883 - RNA, 64 nt, Human
uaaaugauuguuagcaaguuagauuuuccuggagcuucggaagaaaugaaaauggaaacaugau

SEQ ID NO: 347884 - RNA, 64 nt, Human
gaggcugcggaacggguguggauuugaauguggacuucggaaucccaggaggcaggggccgggc

SEQ ID NO: 347885 - RNA, 64 nt, Human; identical to SEQ ID NO: 255539

SEQ ID NO: 347886 - RNA, 64 nt, Human; identical to SEQ ID NO: 255540

SEQ ID NO: 347887 - RNA, 64 nt, Human; identical to SEQ ID NO: 255541

SEQ ID NO: 347888 - RNA, 64 nt, Human; identical to SEQ ID NO: 255542

SEQ ID NO: 347889 - RNA, 64 nt, Human; identical to SEQ ID NO: 255543

SEQ ID NO: 347890 - RNA, 64 nt, Human; identical to SEQ ID NO: 255544

SEQ ID NO: 347891 - RNA, 64 nt, Human; identical to SEQ ID NO: 255545

SEQ ID NO: 347892 - RNA, 64 nt, Human; identical to SEQ ID NO: 255546

SEQ ID NO: 347893 - RNA, 64 nt, Human; identical to SEQ ID NO: 255547

SEQ ID NO: 347894 - RNA, 64 nt, Human; identical to SEQ ID NO: 255548

SEQ ID NO: 347895 - RNA, 64 nt, Human; identical to SEQ ID NO: 255549

SEQ ID NO: 347896 - RNA, 64 nt, Human; identical to SEQ ID NO: 255550

SEQ ID NO: 347897 - RNA, 64 nt, Human; identical to SEQ ID NO: 255551

SEQ ID NO: 347898 - RNA, 64 nt, Human; identical to SEQ ID NO: 255552

SEQ ID NO: 347899 - RNA, 64 nt, Human; identical to SEQ ID NO: 255553

SEQ ID NO: 347900 - RNA, 64 nt, Human; identical to SEQ ID NO: 255554

SEQ ID NO: 347901 - RNA, 64 nt, Human; identical to SEQ ID NO: 255558

SEQ ID NO: 347902 - RNA, 64 nt, Human; identical to SEQ ID NO: 255559

SEQ ID NO: 347903 - RNA, 64 nt, Human; identical to SEQ ID NO: 255560

SEQ ID NO: 347904 - RNA, 64 nt, Human; identical to SEQ ID NO: 255561

SEQ ID NO: 347905 - RNA, 64 nt, Human; identical to SEQ ID NO: 255562

SEQ ID NO: 347906 - RNA, 64 nt, Human; identical to SEQ ID NO: 255563

SEQ ID NO: 347907 - RNA, 64 nt, Human; identical to SEQ ID NO: 255564

SEQ ID NO: 347908 - RNA, 64 nt, Human; identical to SEQ ID NO: 255565

SEQ ID NO: 347909 - RNA, 64 nt, Human; identical to SEQ ID NO: 255566

SEQ ID NO: 347910 - RNA, 64 nt, Human; identical to SEQ ID NO: 255567

SEQ ID NO: 347911 - RNA, 64 nt, Human; identical to SEQ ID NO: 255568

SEQ ID NO: 347912 - RNA, 64 nt, Human; identical to SEQ ID NO: 255569

SEQ ID NO: 347913 - RNA, 64 nt, Human; identical to SEQ ID NO: 255570

SEQ ID NO: 347914 - RNA, 64 nt, Human; identical to SEQ ID NO: 255571

SEQ ID NO: 347915 - RNA, 64 nt, Human; identical to SEQ ID NO: 255572

SEQ ID NO: 347916 - RNA, 64 nt, Human; identical to SEQ ID NO: 255573

SEQ ID NO: 347917 - RNA, 64 nt, Human; identical to SEQ ID NO: 255577

SEQ ID NO: 347918 - RNA, 64 nt, Human; identical to SEQ ID NO: 255578

SEQ ID NO: 347919 - RNA, 64 nt, Human; identical to SEQ ID NO: 255579

SEQ ID NO: 347920 - RNA, 64 nt, Human; identical to SEQ ID NO: 255580

SEQ ID NO: 347921 - RNA, 64 nt, Human; identical to SEQ ID NO: 255581

SEQ ID NO: 347922 - RNA, 64 nt, Human; identical to SEQ ID NO: 255582

SEQ ID NO: 347923 - RNA, 64 nt, Human; identical to SEQ ID NO: 255583

SEQ ID NO: 347924 - RNA, 64 nt, Human; identical to SEQ ID NO: 255584

SEQ ID NO: 347925 - RNA, 64 nt, Human; identical to SEQ ID NO: 255585

SEQ ID NO: 347926 - RNA, 64 nt, Human; identical to SEQ ID NO: 255586

SEQ ID NO: 347927 - RNA, 64 nt, Human; identical to SEQ ID NO: 255587

SEQ ID NO: 347928 - RNA, 64 nt, Human; identical to SEQ ID NO: 255588

SEQ ID NO: 347929 - RNA, 64 nt, Human; identical to SEQ ID NO: 255589

SEQ ID NO: 347930 - RNA, 64 nt, Human; identical to SEQ ID NO: 255590

SEQ ID NO: 347931 - RNA, 64 nt, Human; identical to SEQ ID NO: 255591

SEQ ID NO: 347932 - RNA, 64 nt, Human; identical to SEQ ID NO: 255592

SEQ ID NO: 347933 - RNA, 64 nt, Human; identical to SEQ ID NO: 255596

SEQ ID NO: 347934 - RNA, 64 nt, Human; identical to SEQ ID NO: 255597

SEQ ID NO: 347935 - RNA, 64 nt, Human; identical to SEQ ID NO: 255598

SEQ ID NO: 347936 - RNA, 64 nt, Human; identical to SEQ ID NO: 255599

SEQ ID NO: 347937 - RNA, 64 nt, Human; identical to SEQ ID NO: 255600

SEQ ID NO: 347938 - RNA, 64 nt, Human; identical to SEQ ID NO: 255601

SEQ ID NO: 347939 - RNA, 64 nt, Human; identical to SEQ ID NO: 255602

SEQ ID NO: 347940 - RNA, 64 nt, Human; identical to SEQ ID NO: 255603

SEQ ID NO: 347941 - RNA, 64 nt, Human; identical to SEQ ID NO: 255604

SEQ ID NO: 347942 - RNA, 64 nt, Human; identical to SEQ ID NO: 255605

SEQ ID NO: 347943 - RNA, 64 nt, Human; identical to SEQ ID NO: 255606

SEQ ID NO: 347944 - RNA, 64 nt, Human; identical to SEQ ID NO: 255607

SEQ ID NO: 347945 - RNA, 64 nt, Human; identical to SEQ ID NO: 255608

SEQ ID NO: 347946 - RNA, 64 nt, Human; identical to SEQ ID NO: 255609

SEQ ID NO: 347947 - RNA, 64 nt, Human; identical to SEQ ID NO: 255610

SEQ ID NO: 347948 - RNA, 64 nt, Human; identical to SEQ ID NO: 255611

SEQ ID NO: 347949 - RNA, 64 nt, Human; identical to SEQ ID NO: 255615

SEQ ID NO: 347950 - RNA, 64 nt, Human; identical to SEQ ID NO: 255616

SEQ ID NO: 347951 - RNA, 52 nt, Human; identical to SEQ ID NO: 255617

SEQ ID NO: 347952 - RNA, 64 nt, Human; identical to SEQ ID NO: 255618

SEQ ID NO: 347953 - RNA, 64 nt, Human; identical to SEQ ID NO: 255619

SEQ ID NO: 347954 - RNA, 64 nt, Human; identical to SEQ ID NO: 255620

SEQ ID NO: 347955 - RNA, 64 nt, Human; identical to SEQ ID NO: 255621

SEQ ID NO: 347956 - RNA, 64 nt, Human; identical to SEQ ID NO: 255622

SEQ ID NO: 347957 - RNA, 64 nt, Human; identical to SEQ ID NO: 255623

SEQ ID NO: 347958 - RNA, 64 nt, Human; identical to SEQ ID NO: 255624

SEQ ID NO: 347959 - RNA, 64 nt, Human; identical to SEQ ID NO: 255625

SEQ ID NO: 347960 - RNA, 64 nt, Human; identical to SEQ ID NO: 255626

SEQ ID NO: 347961 - RNA, 64 nt, Human; identical to SEQ ID NO: 255627

SEQ ID NO: 347962 - RNA, 64 nt, Human; identical to SEQ ID NO: 255628

SEQ ID NO: 347963 - RNA, 64 nt, Human; identical to SEQ ID NO: 255629

SEQ ID NO: 347964 - RNA, 64 nt, Human; identical to SEQ ID NO: 255630

SEQ ID NO: 347965 - RNA, 64 nt, Human; identical to SEQ ID NO: 255634

SEQ ID NO: 347966 - RNA, 64 nt, Human; identical to SEQ ID NO: 255635

SEQ ID NO: 347967 - RNA, 64 nt, Human; identical to SEQ ID NO: 255636

SEQ ID NO: 347968 - RNA, 64 nt, Human; identical to SEQ ID NO: 255637

SEQ ID NO: 347969 - RNA, 64 nt, Human; identical to SEQ ID NO: 255638

SEQ ID NO: 347970 - RNA, 53 nt, Human; identical to SEQ ID NO: 255639

SEQ ID NO: 347971 - RNA, 64 nt, Human; identical to SEQ ID NO: 255640

SEQ ID NO: 347972 - RNA, 64 nt, Human; identical to SEQ ID NO: 255641

SEQ ID NO: 347973 - RNA, 64 nt, Human; identical to SEQ ID NO: 255642

SEQ ID NO: 347974 - RNA, 64 nt, Human; identical to SEQ ID NO: 255643

SEQ ID NO: 347975 - RNA, 64 nt, Human; identical to SEQ ID NO: 255644

SEQ ID NO: 347976 - RNA, 64 nt, Human; identical to SEQ ID NO: 255645

SEQ ID NO: 347977 - RNA, 64 nt, Human; identical to SEQ ID NO: 255646

SEQ ID NO: 347978 - RNA, 64 nt, Human; identical to SEQ ID NO: 255647

SEQ ID NO: 347979 - RNA, 64 nt, Human; identical to SEQ ID NO: 255648

SEQ ID NO: 347980 - RNA, 64 nt, Human; identical to SEQ ID NO: 255649

SEQ ID NO: 347981 - RNA, 64 nt, Human; identical to SEQ ID NO: 255653

SEQ ID NO: 347982 - RNA, 64 nt, Human; identical to SEQ ID NO: 255654

SEQ ID NO: 347983 - RNA, 64 nt, Human; identical to SEQ ID NO: 255655

SEQ ID NO: 347984 - RNA, 64 nt, Human; identical to SEQ ID NO: 255656

SEQ ID NO: 347985 - RNA, 64 nt, Human; identical to SEQ ID NO: 255657

SEQ ID NO: 347986 - RNA, 64 nt, Human; identical to SEQ ID NO: 255658

SEQ ID NO: 347987 - RNA, 64 nt, Human; identical to SEQ ID NO: 255659

SEQ ID NO: 347988 - RNA, 64 nt, Human; identical to SEQ ID NO: 255660

SEQ ID NO: 347989 - RNA, 64 nt, Human; identical to SEQ ID NO: 255661

SEQ ID NO: 347990 - RNA, 64 nt, Human; identical to SEQ ID NO: 255662

SEQ ID NO: 347991 - RNA, 64 nt, Human; identical to SEQ ID NO: 255663

SEQ ID NO: 347992 - RNA, 64 nt, Human; identical to SEQ ID NO: 255664

SEQ ID NO: 347993 - RNA, 64 nt, Human; identical to SEQ ID NO: 255665

SEQ ID NO: 347994 - RNA, 64 nt, Human; identical to SEQ ID NO: 255666

SEQ ID NO: 347995 - RNA, 64 nt, Human; identical to SEQ ID NO: 255667

SEQ ID NO: 347996 - RNA, 64 nt, Human; identical to SEQ ID NO: 255668

SEQ ID NO: 347997 - RNA, 62 nt, Human; identical to SEQ ID NO: 255672

SEQ ID NO: 347998 - RNA, 64 nt, Human; identical to SEQ ID NO: 255673

SEQ ID NO: 347999 - RNA, 64 nt, Human; identical to SEQ ID NO: 255674

SEQ ID NO: 348000 - RNA, 64 nt, Human; identical to SEQ ID NO: 255675

SEQ ID NO: 348001 - RNA, 64 nt, Human; identical to SEQ ID NO: 255676

SEQ ID NO: 348002 - RNA, 64 nt, Human; identical to SEQ ID NO: 255677

SEQ ID NO: 348003 - RNA, 64 nt, Human; identical to SEQ ID NO: 255678

SEQ ID NO: 348004 - RNA, 64 nt, Human; identical to SEQ ID NO: 255679

SEQ ID NO: 348005 - RNA, 64 nt, Human; identical to SEQ ID NO: 255680

SEQ ID NO: 348006 - RNA, 64 nt, Human; identical to SEQ ID NO: 255681

SEQ ID NO: 348007 - RNA, 64 nt, Human; identical to SEQ ID NO: 255682

SEQ ID NO: 348008 - RNA, 64 nt, Human; identical to SEQ ID NO: 255683

SEQ ID NO: 348009 - RNA, 64 nt, Human; identical to SEQ ID NO: 255684

SEQ ID NO: 348010 - RNA, 64 nt, Human; identical to SEQ ID NO: 255685

SEQ ID NO: 348011 - RNA, 64 nt, Human; identical to SEQ ID NO: 255686

SEQ ID NO: 348012 - RNA, 64 nt, Human; identical to SEQ ID NO: 255687

SEQ ID NO: 348013 - RNA, 64 nt, Human; identical to SEQ ID NO: 255691

SEQ ID NO: 348014 - RNA, 64 nt, Human; identical to SEQ ID NO: 255692

SEQ ID NO: 348015 - RNA, 64 nt, Human; identical to SEQ ID NO: 255693

SEQ ID NO: 348016 - RNA, 64 nt, Human; identical to SEQ ID NO: 255694

SEQ ID NO: 348017 - RNA, 64 nt, Human; identical to SEQ ID NO: 255695

SEQ ID NO: 348018 - RNA, 64 nt, Human; identical to SEQ ID NO: 255696

SEQ ID NO: 348019 - RNA, 64 nt, Human; identical to SEQ ID NO: 255697

SEQ ID NO: 348020 - RNA, 64 nt, Human; identical to SEQ ID NO: 255698

SEQ ID NO: 348021 - RNA, 64 nt, Human; identical to SEQ ID NO: 255699

SEQ ID NO: 348022 - RNA, 64 nt, Human; identical to SEQ ID NO: 255700

SEQ ID NO: 348023 - RNA, 64 nt, Human; identical to SEQ ID NO: 255701

SEQ ID NO: 348024 - RNA, 64 nt, Human; identical to SEQ ID NO: 255702

SEQ ID NO: 348025 - RNA, 64 nt, Human; identical to SEQ ID NO: 255703

SEQ ID NO: 348026 - RNA, 53 nt, Human; identical to SEQ ID NO: 255704

SEQ ID NO: 348027 - RNA, 64 nt, Human; identical to SEQ ID NO: 255705

SEQ ID NO: 348028 - RNA, 64 nt, Human; identical to SEQ ID NO: 255710

SEQ ID NO: 348029 - RNA, 64 nt, Human; identical to SEQ ID NO: 255706

SEQ ID NO: 348030 - RNA, 64 nt, Human; identical to SEQ ID NO: 255711

SEQ ID NO: 348031 - RNA, 64 nt, Human; identical to SEQ ID NO: 255712

SEQ ID NO: 348032 - RNA, 64 nt, Human; identical to SEQ ID NO: 255713

SEQ ID NO: 348033 - RNA, 64 nt, Human; identical to SEQ ID NO: 255714

SEQ ID NO: 348034 - RNA, 64 nt, Human; identical to SEQ ID NO: 255715

SEQ ID NO: 348035 - RNA, 64 nt, Human; identical to SEQ ID NO: 255716

SEQ ID NO: 348036 - RNA, 64 nt, Human; identical to SEQ ID NO: 255717

SEQ ID NO: 348037 - RNA, 64 nt, Human; identical to SEQ ID NO: 255718

SEQ ID NO: 348038 - RNA, 64 nt, Human; identical to SEQ ID NO: 255719

SEQ ID NO: 348039 - RNA, 64 nt, Human; identical to SEQ ID NO: 255720

SEQ ID NO: 348040 - RNA, 64 nt, Human; identical to SEQ ID NO: 255721

SEQ ID NO: 348041 - RNA, 64 nt, Human; identical to SEQ ID NO: 255722

SEQ ID NO: 348042 - RNA, 64 nt, Human; identical to SEQ ID NO: 255723

SEQ ID NO: 348043 - RNA, 64 nt, Human; identical to SEQ ID NO: 255724

SEQ ID NO: 348044 - RNA, 64 nt, Human; identical to SEQ ID NO: 255725

SEQ ID NO: 348045 - RNA, 64 nt, Human; identical to SEQ ID NO: 255729

SEQ ID NO: 348046 - RNA, 64 nt, Human; identical to SEQ ID NO: 255730

SEQ ID NO: 348047 - RNA, 64 nt, Human; identical to SEQ ID NO: 255731

SEQ ID NO: 348048 - RNA, 64 nt, Human; identical to SEQ ID NO: 255732

SEQ ID NO: 348049 - RNA, 64 nt, Human; identical to SEQ ID NO: 255733

SEQ ID NO: 348050 - RNA, 64 nt, Human; identical to SEQ ID NO: 255734

SEQ ID NO: 348051 - RNA, 64 nt, Human; identical to SEQ ID NO: 255735

SEQ ID NO: 348052 - RNA, 64 nt, Human; identical to SEQ ID NO: 255736

SEQ ID NO: 348053 - RNA, 60 nt, Human; identical to SEQ ID NO: 255737

SEQ ID NO: 348054 - RNA, 64 nt, Human; identical to SEQ ID NO: 255738

SEQ ID NO: 348055 - RNA, 64 nt, Human; identical to SEQ ID NO: 255739

SEQ ID NO: 348056 - RNA, 64 nt, Human; identical to SEQ ID NO: 255740

SEQ ID NO: 348057 - RNA, 64 nt, Human; identical to SEQ ID NO: 255741

SEQ ID NO: 348058 - RNA, 64 nt, Human; identical to SEQ ID NO: 255742

SEQ ID NO: 348059 - RNA, 64 nt, Human; identical to SEQ ID NO: 255743

SEQ ID NO: 348060 - RNA, 64 nt, Human; identical to SEQ ID NO: 255744

SEQ ID NO: 348061 - RNA, 64 nt, Human; identical to SEQ ID NO: 255748

SEQ ID NO: 348062 - RNA, 64 nt, Human; identical to SEQ ID NO: 255749

SEQ ID NO: 348063 - RNA, 64 nt, Human; identical to SEQ ID NO: 255750

SEQ ID NO: 348064 - RNA, 64 nt, Human; identical to SEQ ID NO: 255751

SEQ ID NO: 348065 - RNA, 64 nt, Human; identical to SEQ ID NO: 255752

SEQ ID NO: 348066 - RNA, 64 nt, Human; identical to SEQ ID NO: 255753

SEQ ID NO: 348067 - RNA, 64 nt, Human; identical to SEQ ID NO: 255754

SEQ ID NO: 348068 - RNA, 64 nt, Human; identical to SEQ ID NO: 255755

SEQ ID NO: 348069 - RNA, 64 nt, Human; identical to SEQ ID NO: 255756

SEQ ID NO: 348070 - RNA, 64 nt, Human; identical to SEQ ID NO: 255757

SEQ ID NO: 348071 - RNA, 64 nt, Human; identical to SEQ ID NO: 255758

SEQ ID NO: 348072 - RNA, 64 nt, Human; identical to SEQ ID NO: 255759

SEQ ID NO: 348073 - RNA, 64 nt, Human; identical to SEQ ID NO: 255760

SEQ ID NO: 348074 - RNA, 64 nt, Human; identical to SEQ ID NO: 255761

SEQ ID NO: 348075 - RNA, 64 nt, Human; identical to SEQ ID NO: 255762

SEQ ID NO: 348076 - RNA, 63 nt, Human; identical to SEQ ID NO: 255763

SEQ ID NO: 348077 - RNA, 64 nt, Human; identical to SEQ ID NO: 255767

SEQ ID NO: 348078 - RNA, 64 nt, Human; identical to SEQ ID NO: 255768

SEQ ID NO: 348079 - RNA, 64 nt, Human; identical to SEQ ID NO: 255769

SEQ ID NO: 348080 - RNA, 64 nt, Human; identical to SEQ ID NO: 255770

SEQ ID NO: 348081 - RNA, 64 nt, Human; identical to SEQ ID NO: 255771

SEQ ID NO: 348082 - RNA, 64 nt, Human; identical to SEQ ID NO: 255772

SEQ ID NO: 348083 - RNA, 64 nt, Human; identical to SEQ ID NO: 255773

SEQ ID NO: 348084 - RNA, 64 nt, Human; identical to SEQ ID NO: 255774

SEQ ID NO: 348085 - RNA, 64 nt, Human; identical to SEQ ID NO: 255775

SEQ ID NO: 348086 - RNA, 64 nt, Human; identical to SEQ ID NO: 255776

SEQ ID NO: 348087 - RNA, 64 nt, Human; identical to SEQ ID NO: 255777

SEQ ID NO: 348088 - RNA, 64 nt, Human; identical to SEQ ID NO: 255778

SEQ ID NO: 348089 - RNA, 64 nt, Human; identical to SEQ ID NO: 255779

SEQ ID NO: 348090 - RNA, 64 nt, Human; identical to SEQ ID NO: 255780

SEQ ID NO: 348091 - RNA, 64 nt, Human; identical to SEQ ID NO: 255781

SEQ ID NO: 348092 - RNA, 64 nt, Human; identical to SEQ ID NO: 255782

SEQ ID NO: 348093 - RNA, 64 nt, Human; identical to SEQ ID NO: 255786

SEQ ID NO: 348094 - RNA, 64 nt, Human; identical to SEQ ID NO: 255787

SEQ ID NO: 348095 - RNA, 64 nt, Human; identical to SEQ ID NO: 255788

SEQ ID NO: 348096 - RNA, 64 nt, Human; identical to SEQ ID NO: 255789

SEQ ID NO: 348097 - RNA, 64 nt, Human; identical to SEQ ID NO: 255790

SEQ ID NO: 348098 - RNA, 64 nt, Human; identical to SEQ ID NO: 255791

SEQ ID NO: 348099 - RNA, 64 nt, Human; identical to SEQ ID NO: 255792

SEQ ID NO: 348100 - RNA, 64 nt, Human; identical to SEQ ID NO: 255793

SEQ ID NO: 348101 - RNA, 64 nt, Human; identical to SEQ ID NO: 255794

SEQ ID NO: 348102 - RNA, 64 nt, Human; identical to SEQ ID NO: 255795

SEQ ID NO: 348103 - RNA, 64 nt, Human; identical to SEQ ID NO: 255796

SEQ ID NO: 348104 - RNA, 64 nt, Human; identical to SEQ ID NO: 255797

SEQ ID NO: 348105 - RNA, 64 nt, Human; identical to SEQ ID NO: 255798

SEQ ID NO: 348106 - RNA, 64 nt, Human; identical to SEQ ID NO: 255799

SEQ ID NO: 348107 - RNA, 64 nt, Human; identical to SEQ ID NO: 255800

SEQ ID NO: 348108 - RNA, 64 nt, Human; identical to SEQ ID NO: 255801

SEQ ID NO: 348109 - RNA, 64 nt, Human; identical to SEQ ID NO: 255805

SEQ ID NO: 348110 - RNA, 64 nt, Human; identical to SEQ ID NO: 255806

SEQ ID NO: 348111 - RNA, 64 nt, Human; identical to SEQ ID NO: 255807

SEQ ID NO: 348112 - RNA, 64 nt, Human; identical to SEQ ID NO: 255808

SEQ ID NO: 348113 - RNA, 64 nt, Human; identical to SEQ ID NO: 255809

SEQ ID NO: 348114 - RNA, 64 nt, Human; identical to SEQ ID NO: 255810

SEQ ID NO: 348115 - RNA, 64 nt, Human; identical to SEQ ID NO: 255811

SEQ ID NO: 348116 - RNA, 64 nt, Human; identical to SEQ ID NO: 255812

SEQ ID NO: 348117 - RNA, 64 nt, Human; identical to SEQ ID NO: 255813

SEQ ID NO: 348118 - RNA, 64 nt, Human; identical to SEQ ID NO: 255814

SEQ ID NO: 348119 - RNA, 64 nt, Human; identical to SEQ ID NO: 255815

SEQ ID NO: 348120 - RNA, 64 nt, Human; identical to SEQ ID NO: 255816

SEQ ID NO: 348121 - RNA, 64 nt, Human; identical to SEQ ID NO: 255817

SEQ ID NO: 348122 - RNA, 64 nt, Human; identical to SEQ ID NO: 255818

SEQ ID NO: 348123 - RNA, 64 nt, Human; identical to SEQ ID NO: 255819

SEQ ID NO: 348124 - RNA, 64 nt, Human; identical to SEQ ID NO: 255820

SEQ ID NO: 348125 - RNA, 64 nt, Human; identical to SEQ ID NO: 255824

SEQ ID NO: 348126 - RNA, 64 nt, Human; identical to SEQ ID NO: 255825

SEQ ID NO: 348127 - RNA, 64 nt, Human; identical to SEQ ID NO: 255826

SEQ ID NO: 348128 - RNA, 64 nt, Human; identical to SEQ ID NO: 255827

SEQ ID NO: 348129 - RNA, 64 nt, Human; identical to SEQ ID NO: 255828

SEQ ID NO: 348130 - RNA, 64 nt, Human; identical to SEQ ID NO: 255829

SEQ ID NO: 348131 - RNA, 64 nt, Human; identical to SEQ ID NO: 255830

SEQ ID NO: 348132 - RNA, 64 nt, Human; identical to SEQ ID NO: 255831

SEQ ID NO: 348133 - RNA, 64 nt, Human; identical to SEQ ID NO: 255832

SEQ ID NO: 348134 - RNA, 64 nt, Human; identical to SEQ ID NO: 255833

SEQ ID NO: 348135 - RNA, 64 nt, Human; identical to SEQ ID NO: 255834

SEQ ID NO: 348136 - RNA, 64 nt, Human; identical to SEQ ID NO: 255835

SEQ ID NO: 348137 - RNA, 64 nt, Human; identical to SEQ ID NO: 255836

SEQ ID NO: 348138 - RNA, 64 nt, Human; identical to SEQ ID NO: 255837

SEQ ID NO: 348139 - RNA, 64 nt, Human; identical to SEQ ID NO: 255838

SEQ ID NO: 348140 - RNA, 64 nt, Human; identical to SEQ ID NO: 255839

SEQ ID NO: 348141 - RNA, 64 nt, Human; identical to SEQ ID NO: 255843

SEQ ID NO: 348142 - RNA, 64 nt, Human; identical to SEQ ID NO: 255844

SEQ ID NO: 348143 - RNA, 64 nt, Human; identical to SEQ ID NO: 255845

SEQ ID NO: 348144 - RNA, 64 nt, Human; identical to SEQ ID NO: 255846

SEQ ID NO: 348145 - RNA, 64 nt, Human; identical to SEQ ID NO: 255847

SEQ ID NO: 348146 - RNA, 64 nt, Human; identical to SEQ ID NO: 255848

SEQ ID NO: 348147 - RNA, 64 nt, Human; identical to SEQ ID NO: 255849

SEQ ID NO: 348148 - RNA, 64 nt, Human; identical to SEQ ID NO: 255850

SEQ ID NO: 348149 - RNA, 64 nt, Human; identical to SEQ ID NO: 255851

SEQ ID NO: 348150 - RNA, 64 nt, Human; identical to SEQ ID NO: 255852

SEQ ID NO: 348151 - RNA, 64 nt, Human; identical to SEQ ID NO: 255853

SEQ ID NO: 348152 - RNA, 64 nt, Human; identical to SEQ ID NO: 255854

SEQ ID NO: 348153 - RNA, 64 nt, Human; identical to SEQ ID NO: 255855

SEQ ID NO: 348154 - RNA, 64 nt, Human; identical to SEQ ID NO: 255856

SEQ ID NO: 348155 - RNA, 64 nt, Human; identical to SEQ ID NO: 255857

SEQ ID NO: 348156 - RNA, 58 nt, Human; identical to SEQ ID NO: 255858

SEQ ID NO: 348157 - RNA, 64 nt, Human; identical to SEQ ID NO: 255862

SEQ ID NO: 348158 - RNA, 64 nt, Human; identical to SEQ ID NO: 255863

SEQ ID NO: 348159 - RNA, 64 nt, Human; identical to SEQ ID NO: 255864

SEQ ID NO: 348160 - RNA, 64 nt, Human; identical to SEQ ID NO: 255865

SEQ ID NO: 348161 - RNA, 64 nt, Human; identical to SEQ ID NO: 255866

SEQ ID NO: 348162 - RNA, 64 nt, Human; identical to SEQ ID NO: 255867

SEQ ID NO: 348163 - RNA, 64 nt, Human; identical to SEQ ID NO: 255868

SEQ ID NO: 348164 - RNA, 64 nt, Human; identical to SEQ ID NO: 255869

SEQ ID NO: 348165 - RNA, 64 nt, Human; identical to SEQ ID NO: 255870

SEQ ID NO: 348166 - RNA, 64 nt, Human; identical to SEQ ID NO: 255871

SEQ ID NO: 348167 - RNA, 64 nt, Human; identical to SEQ ID NO: 255872

SEQ ID NO: 348168 - RNA, 64 nt, Human; identical to SEQ ID NO: 255873

SEQ ID NO: 348169 - RNA, 64 nt, Human; identical to SEQ ID NO: 255874

SEQ ID NO: 348170 - RNA, 64 nt, Human; identical to SEQ ID NO: 255875

SEQ ID NO: 348171 - RNA, 64 nt, Human; identical to SEQ ID NO: 255876

SEQ ID NO: 348172 - RNA, 64 nt, Human; identical to SEQ ID NO: 255877

SEQ ID NO: 348173 - RNA, 64 nt, Human; identical to SEQ ID NO: 255881

SEQ ID NO: 348174 - RNA, 64 nt, Human; identical to SEQ ID NO: 255882

SEQ ID NO: 348175 - RNA, 64 nt, Human; identical to SEQ ID NO: 255883

SEQ ID NO: 348176 - RNA, 64 nt, Human; identical to SEQ ID NO: 255884

SEQ ID NO: 348177 - RNA, 64 nt, Human; identical to SEQ ID NO: 255885

SEQ ID NO: 348178 - RNA, 64 nt, Human; identical to SEQ ID NO: 255886

SEQ ID NO: 348179 - RNA, 64 nt, Human; identical to SEQ ID NO: 255887

SEQ ID NO: 348180 - RNA, 64 nt, Human; identical to SEQ ID NO: 255888

SEQ ID NO: 348181 - RNA, 64 nt, Human; identical to SEQ ID NO: 255889

SEQ ID NO: 348182 - RNA, 64 nt, Human; identical to SEQ ID NO: 255890

SEQ ID NO: 348183 - RNA, 64 nt, Human; identical to SEQ ID NO: 255891

SEQ ID NO: 348184 - RNA, 64 nt, Human; identical to SEQ ID NO: 255892

SEQ ID NO: 348185 - RNA, 64 nt, Human; identical to SEQ ID NO: 255893

SEQ ID NO: 348186 - RNA, 64 nt, Human; identical to SEQ ID NO: 255894

SEQ ID NO: 348187 - RNA, 64 nt, Human; identical to SEQ ID NO: 255895

SEQ ID NO: 348188 - RNA, 64 nt, Human; identical to SEQ ID NO: 255539

SEQ ID NO: 348189 - RNA, 64 nt, Human; identical to SEQ ID NO: 255540

SEQ ID NO: 348190 - RNA, 64 nt, Human; identical to SEQ ID NO: 255541

SEQ ID NO: 348191 - RNA, 64 nt, Human; identical to SEQ ID NO: 255542

SEQ ID NO: 348192 - RNA, 64 nt, Human; identical to SEQ ID NO: 255543

SEQ ID NO: 348193 - RNA, 64 nt, Human; identical to SEQ ID NO: 255544

SEQ ID NO: 348194 - RNA, 64 nt, Human; identical to SEQ ID NO: 255545

SEQ ID NO: 348195 - RNA, 64 nt, Human; identical to SEQ ID NO: 255546

SEQ ID NO: 348196 - RNA, 64 nt, Human; identical to SEQ ID NO: 255547

SEQ ID NO: 348197 - RNA, 64 nt, Human; identical to SEQ ID NO: 255548

SEQ ID NO: 348198 - RNA, 64 nt, Human; identical to SEQ ID NO: 255549

SEQ ID NO: 348199 - RNA, 64 nt, Human; identical to SEQ ID NO: 255550

SEQ ID NO: 348200 - RNA, 64 nt, Human; identical to SEQ ID NO: 255551

SEQ ID NO: 348201 - RNA, 64 nt, Human; identical to SEQ ID NO: 255552

SEQ ID NO: 348202 - RNA, 64 nt, Human; identical to SEQ ID NO: 255553

SEQ ID NO: 348203 - RNA, 64 nt, Human; identical to SEQ ID NO: 255554

SEQ ID NO: 348204 - RNA, 64 nt, Human; identical to SEQ ID NO: 255558

SEQ ID NO: 348205 - RNA, 64 nt, Human; identical to SEQ ID NO: 255559

SEQ ID NO: 348206 - RNA, 64 nt, Human; identical to SEQ ID NO: 255560

SEQ ID NO: 348207 - RNA, 64 nt, Human; identical to SEQ ID NO: 255561

SEQ ID NO: 348208 - RNA, 64 nt, Human; identical to SEQ ID NO: 255562

SEQ ID NO: 348209 - RNA, 64 nt, Human; identical to SEQ ID NO: 255563

SEQ ID NO: 348210 - RNA, 64 nt, Human; identical to SEQ ID NO: 255564

SEQ ID NO: 348211 - RNA, 64 nt, Human; identical to SEQ ID NO: 255565

SEQ ID NO: 348212 - RNA, 64 nt, Human; identical to SEQ ID NO: 255566

SEQ ID NO: 348213 - RNA, 64 nt, Human; identical to SEQ ID NO: 255567

SEQ ID NO: 348214 - RNA, 64 nt, Human; identical to SEQ ID NO: 255568

SEQ ID NO: 348215 - RNA, 64 nt, Human; identical to SEQ ID NO: 255569

SEQ ID NO: 348216 - RNA, 64 nt, Human; identical to SEQ ID NO: 255570

SEQ ID NO: 348217 - RNA, 64 nt, Human; identical to SEQ ID NO: 255571

SEQ ID NO: 348218 - RNA, 64 nt, Human; identical to SEQ ID NO: 255572

SEQ ID NO: 348219 - RNA, 64 nt, Human; identical to SEQ ID NO: 255573

SEQ ID NO: 348220 - RNA, 64 nt, Human; identical to SEQ ID NO: 255577

SEQ ID NO: 348221 - RNA, 64 nt, Human; identical to SEQ ID NO: 255578

SEQ ID NO: 348222 - RNA, 64 nt, Human; identical to SEQ ID NO: 255579

SEQ ID NO: 348223 - RNA, 64 nt, Human; identical to SEQ ID NO: 255580

SEQ ID NO: 348224 - RNA, 64 nt, Human; identical to SEQ ID NO: 255581

SEQ ID NO: 348225 - RNA, 64 nt, Human; identical to SEQ ID NO: 255582

SEQ ID NO: 348226 - RNA, 64 nt, Human; identical to SEQ ID NO: 255583

SEQ ID NO: 348227 - RNA, 64 nt, Human; identical to SEQ ID NO: 255584

SEQ ID NO: 348228 - RNA, 64 nt, Human; identical to SEQ ID NO: 255585

SEQ ID NO: 348229 - RNA, 64 nt, Human; identical to SEQ ID NO: 255586

SEQ ID NO: 348230 - RNA, 64 nt, Human; identical to SEQ ID NO: 255587

SEQ ID NO: 348231 - RNA, 64 nt, Human; identical to SEQ ID NO: 255588

SEQ ID NO: 348232 - RNA, 64 nt, Human; identical to SEQ ID NO: 255589

SEQ ID NO: 348233 - RNA, 64 nt, Human; identical to SEQ ID NO: 255590

SEQ ID NO: 348234 - RNA, 64 nt, Human; identical to SEQ ID NO: 255591

SEQ ID NO: 348235 - RNA, 64 nt, Human; identical to SEQ ID NO: 255592

SEQ ID NO: 348236 - RNA, 64 nt, Human; identical to SEQ ID NO: 255596

SEQ ID NO: 348237 - RNA, 64 nt, Human; identical to SEQ ID NO: 255597

SEQ ID NO: 348238 - RNA, 64 nt, Human; identical to SEQ ID NO: 255598

SEQ ID NO: 348239 - RNA, 64 nt, Human; identical to SEQ ID NO: 255599

SEQ ID NO: 348240 - RNA, 64 nt, Human; identical to SEQ ID NO: 255600

SEQ ID NO: 348241 - RNA, 64 nt, Human; identical to SEQ ID NO: 255601

SEQ ID NO: 348242 - RNA, 64 nt, Human; identical to SEQ ID NO: 255602

SEQ ID NO: 348243 - RNA, 64 nt, Human; identical to SEQ ID NO: 255603

SEQ ID NO: 348244 - RNA, 64 nt, Human; identical to SEQ ID NO: 255604

SEQ ID NO: 348245 - RNA, 64 nt, Human; identical to SEQ ID NO: 255605

SEQ ID NO: 348246 - RNA, 64 nt, Human; identical to SEQ ID NO: 255606

SEQ ID NO: 348247 - RNA, 64 nt, Human; identical to SEQ ID NO: 255607

SEQ ID NO: 348248 - RNA, 64 nt, Human; identical to SEQ ID NO: 255608

SEQ ID NO: 348249 - RNA, 64 nt, Human; identical to SEQ ID NO: 255609

SEQ ID NO: 348250 - RNA, 64 nt, Human; identical to SEQ ID NO: 255610

SEQ ID NO: 348251 - RNA, 64 nt, Human; identical to SEQ ID NO: 255611

SEQ ID NO: 348252 - RNA, 64 nt, Human; identical to SEQ ID NO: 255615

SEQ ID NO: 348253 - RNA, 64 nt, Human; identical to SEQ ID NO: 255616

SEQ ID NO: 348254 - RNA, 52 nt, Human; identical to SEQ ID NO: 255617

SEQ ID NO: 348255 - RNA, 64 nt, Human; identical to SEQ ID NO: 255618

SEQ ID NO: 348256 - RNA, 64 nt, Human; identical to SEQ ID NO: 255619

SEQ ID NO: 348257 - RNA, 64 nt, Human; identical to SEQ ID NO: 255620

SEQ ID NO: 348258 - RNA, 64 nt, Human; identical to SEQ ID NO: 255621

SEQ ID NO: 348259 - RNA, 64 nt, Human; identical to SEQ ID NO: 255622

SEQ ID NO: 348260 - RNA, 64 nt, Human; identical to SEQ ID NO: 255623

SEQ ID NO: 348261 - RNA, 64 nt, Human; identical to SEQ ID NO: 255624

SEQ ID NO: 348262 - RNA, 64 nt, Human; identical to SEQ ID NO: 255625

SEQ ID NO: 348263 - RNA, 64 nt, Human; identical to SEQ ID NO: 255626

SEQ ID NO: 348264 - RNA, 64 nt, Human; identical to SEQ ID NO: 255627

SEQ ID NO: 348265 - RNA, 64 nt, Human; identical to SEQ ID NO: 255628

SEQ ID NO: 348266 - RNA, 64 nt, Human; identical to SEQ ID NO: 255629

SEQ ID NO: 348267 - RNA, 64 nt, Human; identical to SEQ ID NO: 255630

SEQ ID NO: 348268 - RNA, 64 nt, Human; identical to SEQ ID NO: 255634

SEQ ID NO: 348269 - RNA, 64 nt, Human; identical to SEQ ID NO: 255635

SEQ ID NO: 348270 - RNA, 64 nt, Human; identical to SEQ ID NO: 255636

SEQ ID NO: 348271 - RNA, 64 nt, Human; identical to SEQ ID NO: 255637

SEQ ID NO: 348272 - RNA, 64 nt, Human; identical to SEQ ID NO: 255638

SEQ ID NO: 348273 - RNA, 53 nt, Human; identical to SEQ ID NO: 255639

SEQ ID NO: 348274 - RNA, 64 nt, Human; identical to SEQ ID NO: 255640

SEQ ID NO: 348275 - RNA, 64 nt, Human; identical to SEQ ID NO: 255641

SEQ ID NO: 348276 - RNA, 64 nt, Human; identical to SEQ ID NO: 255642

SEQ ID NO: 348277 - RNA, 64 nt, Human; identical to SEQ ID NO: 255643

SEQ ID NO: 348278 - RNA, 64 nt, Human; identical to SEQ ID NO: 255644

SEQ ID NO: 348279 - RNA, 64 nt, Human; identical to SEQ ID NO: 255645

SEQ ID NO: 348280 - RNA, 64 nt, Human; identical to SEQ ID NO: 255646

SEQ ID NO: 348281 - RNA, 64 nt, Human; identical to SEQ ID NO: 255647

SEQ ID NO: 348282 - RNA, 64 nt, Human; identical to SEQ ID NO: 255648

SEQ ID NO: 348283 - RNA, 64 nt, Human; identical to SEQ ID NO: 255649

SEQ ID NO: 348284 - RNA, 64 nt, Human; identical to SEQ ID NO: 255653

SEQ ID NO: 348285 - RNA, 64 nt, Human; identical to SEQ ID NO: 255654

SEQ ID NO: 348286 - RNA, 64 nt, Human; identical to SEQ ID NO: 255655

SEQ ID NO: 348287 - RNA, 64 nt, Human; identical to SEQ ID NO: 255656

SEQ ID NO: 348288 - RNA, 64 nt, Human; identical to SEQ ID NO: 255657

SEQ ID NO: 348289 - RNA, 64 nt, Human; identical to SEQ ID NO: 255658

SEQ ID NO: 348290 - RNA, 64 nt, Human; identical to SEQ ID NO: 255659

SEQ ID NO: 348291 - RNA, 64 nt, Human; identical to SEQ ID NO: 255660

SEQ ID NO: 348292 - RNA, 64 nt, Human; identical to SEQ ID NO: 255661

SEQ ID NO: 348293 - RNA, 64 nt, Human; identical to SEQ ID NO: 255662

SEQ ID NO: 348294 - RNA, 64 nt, Human; identical to SEQ ID NO: 255663

SEQ ID NO: 348295 - RNA, 64 nt, Human; identical to SEQ ID NO: 255664

SEQ ID NO: 348296 - RNA, 64 nt, Human; identical to SEQ ID NO: 255665

SEQ ID NO: 348297 - RNA, 64 nt, Human; identical to SEQ ID NO: 255666

SEQ ID NO: 348298 - RNA, 64 nt, Human; identical to SEQ ID NO: 255667

SEQ ID NO: 348299 - RNA, 64 nt, Human; identical to SEQ ID NO: 255668

SEQ ID NO: 348300 - RNA, 62 nt, Human; identical to SEQ ID NO: 255672

SEQ ID NO: 348301 - RNA, 64 nt, Human; identical to SEQ ID NO: 255673

SEQ ID NO: 348302 - RNA, 64 nt, Human; identical to SEQ ID NO: 255674

SEQ ID NO: 348303 - RNA, 64 nt, Human; identical to SEQ ID NO: 255675

SEQ ID NO: 348304 - RNA, 64 nt, Human; identical to SEQ ID NO: 255676

SEQ ID NO: 348305 - RNA, 64 nt, Human; identical to SEQ ID NO: 255677

SEQ ID NO: 348306 - RNA, 64 nt, Human; identical to SEQ ID NO: 255678

SEQ ID NO: 348307 - RNA, 64 nt, Human; identical to SEQ ID NO: 255679

SEQ ID NO: 348308 - RNA, 64 nt, Human; identical to SEQ ID NO: 255680

SEQ ID NO: 348309 - RNA, 64 nt, Human; identical to SEQ ID NO: 255681

SEQ ID NO: 348310 - RNA, 64 nt, Human; identical to SEQ ID NO: 255682

SEQ ID NO: 348311 - RNA, 64 nt, Human; identical to SEQ ID NO: 255683

SEQ ID NO: 348312 - RNA, 64 nt, Human; identical to SEQ ID NO: 255684

SEQ ID NO: 348313 - RNA, 64 nt, Human; identical to SEQ ID NO: 255685

SEQ ID NO: 348314 - RNA, 64 nt, Human; identical to SEQ ID NO: 255686

SEQ ID NO: 348315 - RNA, 64 nt, Human; identical to SEQ ID NO: 255687

SEQ ID NO: 348316 - RNA, 64 nt, Human; identical to SEQ ID NO: 255691

SEQ ID NO: 348317 - RNA, 64 nt, Human; identical to SEQ ID NO: 255692

SEQ ID NO: 348318 - RNA, 64 nt, Human; identical to SEQ ID NO: 255693

SEQ ID NO: 348319 - RNA, 64 nt, Human; identical to SEQ ID NO: 255694

SEQ ID NO: 348320 - RNA, 64 nt, Human; identical to SEQ ID NO: 255695

SEQ ID NO: 348321 - RNA, 64 nt, Human; identical to SEQ ID NO: 255696

SEQ ID NO: 348322 - RNA, 64 nt, Human; identical to SEQ ID NO: 255697

SEQ ID NO: 348323 - RNA, 64 nt, Human; identical to SEQ ID NO: 255698

SEQ ID NO: 348324 - RNA, 64 nt, Human; identical to SEQ ID NO: 255699

SEQ ID NO: 348325 - RNA, 64 nt, Human; identical to SEQ ID NO: 255700

SEQ ID NO: 348326 - RNA, 64 nt, Human; identical to SEQ ID NO: 255701

SEQ ID NO: 348327 - RNA, 64 nt, Human; identical to SEQ ID NO: 255702

SEQ ID NO: 348328 - RNA, 64 nt, Human; identical to SEQ ID NO: 255703

SEQ ID NO: 348329 - RNA, 53 nt, Human; identical to SEQ ID NO: 255704

SEQ ID NO: 348330 - RNA, 64 nt, Human; identical to SEQ ID NO: 255705

SEQ ID NO: 348331 - RNA, 64 nt, Human; identical to SEQ ID NO: 255706

SEQ ID NO: 348332 - RNA, 64 nt, Human; identical to SEQ ID NO: 255710

SEQ ID NO: 348333 - RNA, 64 nt, Human; identical to SEQ ID NO: 255711

SEQ ID NO: 348334 - RNA, 64 nt, Human; identical to SEQ ID NO: 255712

SEQ ID NO: 348335 - RNA, 64 nt, Human; identical to SEQ ID NO: 255713

SEQ ID NO: 348336 - RNA, 64 nt, Human; identical to SEQ ID NO: 255714

SEQ ID NO: 348337 - RNA, 64 nt, Human; identical to SEQ ID NO: 255715

SEQ ID NO: 348338 - RNA, 64 nt, Human; identical to SEQ ID NO: 255716

SEQ ID NO: 348339 - RNA, 64 nt, Human; identical to SEQ ID NO: 255717

SEQ ID NO: 348340 - RNA, 64 nt, Human; identical to SEQ ID NO: 255718

SEQ ID NO: 348341 - RNA, 64 nt, Human; identical to SEQ ID NO: 255719

SEQ ID NO: 348342 - RNA, 64 nt, Human; identical to SEQ ID NO: 255720

SEQ ID NO: 348343 - RNA, 64 nt, Human; identical to SEQ ID NO: 255721

SEQ ID NO: 348344 - RNA, 64 nt, Human; identical to SEQ ID NO: 255722

SEQ ID NO: 348345 - RNA, 64 nt, Human; identical to SEQ ID NO: 255723

SEQ ID NO: 348346 - RNA, 64 nt, Human; identical to SEQ ID NO: 255724

SEQ ID NO: 348347 - RNA, 64 nt, Human; identical to SEQ ID NO: 255725

SEQ ID NO: 348348 - RNA, 64 nt, Human; identical to SEQ ID NO: 255729

SEQ ID NO: 348349 - RNA, 64 nt, Human; identical to SEQ ID NO: 255730

SEQ ID NO: 348350 - RNA, 64 nt, Human; identical to SEQ ID NO: 255731

SEQ ID NO: 348351 - RNA, 64 nt, Human; identical to SEQ ID NO: 255732

SEQ ID NO: 348352 - RNA, 64 nt, Human; identical to SEQ ID NO: 255733

SEQ ID NO: 348353 - RNA, 64 nt, Human; identical to SEQ ID NO: 255734

SEQ ID NO: 348354 - RNA, 64 nt, Human; identical to SEQ ID NO: 255735

SEQ ID NO: 348355 - RNA, 64 nt, Human; identical to SEQ ID NO: 255736

SEQ ID NO: 348356 - RNA, 60 nt, Human; identical to SEQ ID NO: 255737

SEQ ID NO: 348357 - RNA, 64 nt, Human; identical to SEQ ID NO: 255738

SEQ ID NO: 348358 - RNA, 64 nt, Human; identical to SEQ ID NO: 255739

SEQ ID NO: 348359 - RNA, 64 nt, Human; identical to SEQ ID NO: 255740

SEQ ID NO: 348360 - RNA, 64 nt, Human; identical to SEQ ID NO: 255741

SEQ ID NO: 348361 - RNA, 64 nt, Human; identical to SEQ ID NO: 255742

SEQ ID NO: 348362 - RNA, 64 nt, Human; identical to SEQ ID NO: 255743

SEQ ID NO: 348363 - RNA, 64 nt, Human; identical to SEQ ID NO: 255744

SEQ ID NO: 348364 - RNA, 64 nt, Human; identical to SEQ ID NO: 255748

SEQ ID NO: 348365 - RNA, 64 nt, Human; identical to SEQ ID NO: 255749

SEQ ID NO: 348366 - RNA, 64 nt, Human; identical to SEQ ID NO: 255750

SEQ ID NO: 348367 - RNA, 64 nt, Human; identical to SEQ ID NO: 255751

SEQ ID NO: 348368 - RNA, 64 nt, Human; identical to SEQ ID NO: 255752

SEQ ID NO: 348369 - RNA, 64 nt, Human; identical to SEQ ID NO: 255753

SEQ ID NO: 348370 - RNA, 64 nt, Human; identical to SEQ ID NO: 255754

SEQ ID NO: 348371 - RNA, 64 nt, Human; identical to SEQ ID NO: 255755

SEQ ID NO: 348372 - RNA, 64 nt, Human; identical to SEQ ID NO: 255756

SEQ ID NO: 348373 - RNA, 64 nt, Human; identical to SEQ ID NO: 255757

SEQ ID NO: 348374 - RNA, 64 nt, Human; identical to SEQ ID NO: 255758

SEQ ID NO: 348375 - RNA, 64 nt, Human; identical to SEQ ID NO: 255759

SEQ ID NO: 348376 - RNA, 64 nt, Human; identical to SEQ ID NO: 255760

SEQ ID NO: 348377 - RNA, 64 nt, Human; identical to SEQ ID NO: 255761

SEQ ID NO: 348378 - RNA, 64 nt, Human; identical to SEQ ID NO: 255762

SEQ ID NO: 348379 - RNA, 63 nt, Human; identical to SEQ ID NO: 255763

SEQ ID NO: 348380 - RNA, 64 nt, Human; identical to SEQ ID NO: 255767

SEQ ID NO: 348381 - RNA, 64 nt, Human; identical to SEQ ID NO: 255768

SEQ ID NO: 348382 - RNA, 64 nt, Human; identical to SEQ ID NO: 255769

SEQ ID NO: 348383 - RNA, 64 nt, Human; identical to SEQ ID NO: 255770

SEQ ID NO: 348384 - RNA, 64 nt, Human; identical to SEQ ID NO: 255771

SEQ ID NO: 348385 - RNA, 64 nt, Human; identical to SEQ ID NO: 255772

SEQ ID NO: 348386 - RNA, 64 nt, Human; identical to SEQ ID NO: 255773

SEQ ID NO: 348387 - RNA, 64 nt, Human; identical to SEQ ID NO: 255774

SEQ ID NO: 348388 - RNA, 64 nt, Human; identical to SEQ ID NO: 255775

SEQ ID NO: 348389 - RNA, 64 nt, Human; identical to SEQ ID NO: 255776

SEQ ID NO: 348390 - RNA, 64 nt, Human; identical to SEQ ID NO: 255777

SEQ ID NO: 348391 - RNA, 64 nt, Human; identical to SEQ ID NO: 255778

SEQ ID NO: 348392 - RNA, 64 nt, Human; identical to SEQ ID NO: 255779

SEQ ID NO: 348393 - RNA, 64 nt, Human; identical to SEQ ID NO: 255780

SEQ ID NO: 348394 - RNA, 64 nt, Human; identical to SEQ ID NO: 255781

SEQ ID NO: 348395 - RNA, 64 nt, Human; identical to SEQ ID NO: 255782

SEQ ID NO: 348396 - RNA, 64 nt, Human; identical to SEQ ID NO: 255786

SEQ ID NO: 348397 - RNA, 64 nt, Human; identical to SEQ ID NO: 255787

SEQ ID NO: 348398 - RNA, 64 nt, Human; identical to SEQ ID NO: 255788

SEQ ID NO: 348399 - RNA, 64 nt, Human; identical to SEQ ID NO: 255789

SEQ ID NO: 348400 - RNA, 64 nt, Human; identical to SEQ ID NO: 255790

SEQ ID NO: 348401 - RNA, 64 nt, Human; identical to SEQ ID NO: 255791

SEQ ID NO: 348402 - RNA, 64 nt, Human; identical to SEQ ID NO: 255792

SEQ ID NO: 348403 - RNA, 64 nt, Human; identical to SEQ ID NO: 255793

SEQ ID NO: 348404 - RNA, 64 nt, Human; identical to SEQ ID NO: 255794

SEQ ID NO: 348405 - RNA, 64 nt, Human; identical to SEQ ID NO: 255795

SEQ ID NO: 348406 - RNA, 64 nt, Human; identical to SEQ ID NO: 255796

SEQ ID NO: 348407 - RNA, 64 nt, Human; identical to SEQ ID NO: 255797

SEQ ID NO: 348408 - RNA, 64 nt, Human; identical to SEQ ID NO: 255798

SEQ ID NO: 348409 - RNA, 64 nt, Human; identical to SEQ ID NO: 255799

SEQ ID NO: 348410 - RNA, 64 nt, Human; identical to SEQ ID NO: 255800

SEQ ID NO: 348411 - RNA, 64 nt, Human; identical to SEQ ID NO: 255801

SEQ ID NO: 348412 - RNA, 64 nt, Human; identical to SEQ ID NO: 255805

SEQ ID NO: 348413 - RNA, 64 nt, Human; identical to SEQ ID NO: 255806

SEQ ID NO: 348414 - RNA, 64 nt, Human; identical to SEQ ID NO: 255807

SEQ ID NO: 348415 - RNA, 64 nt, Human; identical to SEQ ID NO: 255808

SEQ ID NO: 348416 - RNA, 64 nt, Human; identical to SEQ ID NO: 255809

SEQ ID NO: 348417 - RNA, 64 nt, Human; identical to SEQ ID NO: 255810

SEQ ID NO: 348418 - RNA, 64 nt, Human; identical to SEQ ID NO: 255811

SEQ ID NO: 348419 - RNA, 64 nt, Human; identical to SEQ ID NO: 255812

SEQ ID NO: 348420 - RNA, 64 nt, Human; identical to SEQ ID NO: 255813

SEQ ID NO: 348421 - RNA, 64 nt, Human; identical to SEQ ID NO: 255814

SEQ ID NO: 348422 - RNA, 64 nt, Human; identical to SEQ ID NO: 255815

SEQ ID NO: 348423 - RNA, 64 nt, Human; identical to SEQ ID NO: 255816

SEQ ID NO: 348424 - RNA, 64 nt, Human; identical to SEQ ID NO: 255817

SEQ ID NO: 348425 - RNA, 64 nt, Human; identical to SEQ ID NO: 255818

SEQ ID NO: 348426 - RNA, 64 nt, Human; identical to SEQ ID NO: 255819

SEQ ID NO: 348427 - RNA, 64 nt, Human; identical to SEQ ID NO: 255820

SEQ ID NO: 348428 - RNA, 64 nt, Human; identical to SEQ ID NO: 255824

SEQ ID NO: 348429 - RNA, 64 nt, Human; identical to SEQ ID NO: 255825

SEQ ID NO: 348430 - RNA, 64 nt, Human; identical to SEQ ID NO: 255826

SEQ ID NO: 348431 - RNA, 64 nt, Human; identical to SEQ ID NO: 255827

SEQ ID NO: 348432 - RNA, 64 nt, Human; identical to SEQ ID NO: 255828

SEQ ID NO: 348433 - RNA, 64 nt, Human; identical to SEQ ID NO: 255829

SEQ ID NO: 348434 - RNA, 64 nt, Human; identical to SEQ ID NO: 255830

SEQ ID NO: 348435 - RNA, 64 nt, Human; identical to SEQ ID NO: 255831

SEQ ID NO: 348436 - RNA, 64 nt, Human; identical to SEQ ID NO: 255832

SEQ ID NO: 348437 - RNA, 64 nt, Human; identical to SEQ ID NO: 255833

SEQ ID NO: 348438 - RNA, 64 nt, Human; identical to SEQ ID NO: 255834

SEQ ID NO: 348439 - RNA, 64 nt, Human; identical to SEQ ID NO: 255835

SEQ ID NO: 348440 - RNA, 64 nt, Human; identical to SEQ ID NO: 255836

SEQ ID NO: 348441 - RNA, 64 nt, Human; identical to SEQ ID NO: 255837

SEQ ID NO: 348442 - RNA, 64 nt, Human; identical to SEQ ID NO: 255838

SEQ ID NO: 348443 - RNA, 64 nt, Human; identical to SEQ ID NO: 255839

SEQ ID NO: 348444 - RNA, 64 nt, Human; identical to SEQ ID NO: 255843

SEQ ID NO: 348445 - RNA, 64 nt, Human; identical to SEQ ID NO: 255844

SEQ ID NO: 348446 - RNA, 64 nt, Human; identical to SEQ ID NO: 255845

SEQ ID NO: 348447 - RNA, 64 nt, Human; identical to SEQ ID NO: 255846

SEQ ID NO: 348448 - RNA, 64 nt, Human; identical to SEQ ID NO: 255847

SEQ ID NO: 348449 - RNA, 64 nt, Human; identical to SEQ ID NO: 255848

SEQ ID NO: 348450 - RNA, 64 nt, Human; identical to SEQ ID NO: 255849

SEQ ID NO: 348451 - RNA, 64 nt, Human; identical to SEQ ID NO: 255850

SEQ ID NO: 348452 - RNA, 64 nt, Human; identical to SEQ ID NO: 255851

SEQ ID NO: 348453 - RNA, 64 nt, Human; identical to SEQ ID NO: 255852

SEQ ID NO: 348454 - RNA, 64 nt, Human; identical to SEQ ID NO: 255853

SEQ ID NO: 348455 - RNA, 64 nt, Human; identical to SEQ ID NO: 255854

SEQ ID NO: 348456 - RNA, 64 nt, Human; identical to SEQ ID NO: 255855

SEQ ID NO: 348457 - RNA, 64 nt, Human; identical to SEQ ID NO: 255856

SEQ ID NO: 348458 - RNA, 64 nt, Human; identical to SEQ ID NO: 255857

SEQ ID NO: 348459 - RNA, 58 nt, Human; identical to SEQ ID NO: 255858

SEQ ID NO: 348460 - RNA, 64 nt, Human; identical to SEQ ID NO: 255862

SEQ ID NO: 348461 - RNA, 64 nt, Human; identical to SEQ ID NO: 255863

SEQ ID NO: 348462 - RNA, 64 nt, Human; identical to SEQ ID NO: 255864

SEQ ID NO: 348463 - RNA, 64 nt, Human; identical to SEQ ID NO: 255865

SEQ ID NO: 348464 - RNA, 64 nt, Human; identical to SEQ ID NO: 255866

SEQ ID NO: 348465 - RNA, 64 nt, Human; identical to SEQ ID NO: 255867

SEQ ID NO: 348466 - RNA, 64 nt, Human; identical to SEQ ID NO: 255868

SEQ ID NO: 348467 - RNA, 64 nt, Human; identical to SEQ ID NO: 255869

SEQ ID NO: 348468 - RNA, 64 nt, Human; identical to SEQ ID NO: 255870

SEQ ID NO: 348469 - RNA, 64 nt, Human; identical to SEQ ID NO: 255871

SEQ ID NO: 348470 - RNA, 64 nt, Human; identical to SEQ ID NO: 255872

SEQ ID NO: 348471 - RNA, 64 nt, Human; identical to SEQ ID NO: 255873

SEQ ID NO: 348472 - RNA, 64 nt, Human; identical to SEQ ID NO: 255874

SEQ ID NO: 348473 - RNA, 64 nt, Human; identical to SEQ ID NO: 255875

SEQ ID NO: 348474 - RNA, 64 nt, Human; identical to SEQ ID NO: 255876

SEQ ID NO: 348475 - RNA, 64 nt, Human; identical to SEQ ID NO: 255877

SEQ ID NO: 348476 - RNA, 64 nt, Human; identical to SEQ ID NO: 255881

SEQ ID NO: 348477 - RNA, 64 nt, Human; identical to SEQ ID NO: 255882

SEQ ID NO: 348478 - RNA, 64 nt, Human; identical to SEQ ID NO: 255883

SEQ ID NO: 348479 - RNA, 64 nt, Human; identical to SEQ ID NO: 255884

SEQ ID NO: 348480 - RNA, 64 nt, Human; identical to SEQ ID NO: 255885

SEQ ID NO: 348481 - RNA, 64 nt, Human; identical to SEQ ID NO: 255886

SEQ ID NO: 348482 - RNA, 64 nt, Human; identical to SEQ ID NO: 255887

SEQ ID NO: 348483 - RNA, 64 nt, Human; identical to SEQ ID NO: 255888

SEQ ID NO: 348484 - RNA, 64 nt, Human; identical to SEQ ID NO: 255889

SEQ ID NO: 348485 - RNA, 64 nt, Human; identical to SEQ ID NO: 255890

SEQ ID NO: 348486 - RNA, 64 nt, Human; identical to SEQ ID NO: 255891

SEQ ID NO: 348487 - RNA, 64 nt, Human; identical to SEQ ID NO: 255892

SEQ ID NO: 348488 - RNA, 64 nt, Human; identical to SEQ ID NO: 255893

SEQ ID NO: 348489 - RNA, 64 nt, Human; identical to SEQ ID NO: 255894

SEQ ID NO: 348490 - RNA, 64 nt, Human; identical to SEQ ID NO: 255895

SEQ ID NO: 348491 - RNA, 64 nt, Human
uucuuuaguggcaacuuaacugaagaagggauguccgcuauauccaaaauuacagcuauuggca

SEQ ID NO: 348492 - RNA, 64 nt, Human
cagaucaacaguuagauuuuaagcagcuccuggcccgcuauaaagguaacaugccucuuggggg

SEQ ID NO: 348493 - RNA, 64 nt, Human
uugaucagaaacucacccuaaaucugaacgggugccgcuauaauuugugacaucuggcaagauu

SEQ ID NO: 348494 - RNA, 64 nt, Human
aacuaaguucaggggccauggaaaaugaaaaaguccgcuauauugugauuugggaagagaaagu

SEQ ID NO: 348495 - RNA, 64 nt, Human
caccagaucauaggagggcauuauuuggaggaaaccgcuauaauguaaaaucagauuucagaag

SEQ ID NO: 348496 - RNA, 64 nt, Human
ugaggcccacagguggcagugggcagaggggaccccgcuauaccaccucgcugcuguuccacug

SEQ ID NO: 348497 - RNA, 64 nt, Human
uggagaacauuugcaagaagcuuucaaaucccuuccgcuauagaauggaguguccagaaauaga

SEQ ID NO: 348498 - RNA, 64 nt, Human
ccuagaaggagagacuucuuggaacgcucaucccccgcuauaccuccccuuccuccugcaucuc

SEQ ID NO: 348499 - RNA, 64 nt, Human
uauuaagggagaguuaucuacauggaugagucuuccgcuauagcacaguuuagaaaagguguuu

SEQ ID NO: 348500 - RNA, 64 nt, Human
uaauaugagcaaccaaagugggacuucugucuccccgcuauauucccauugcucugaaugguug

SEQ ID NO: 348501 - RNA, 64 nt, Human
gauugcuuccaguuuucagugauuaaaaauaaagccgcuauaaacauuugugugcagguuuuug

SEQ ID NO: 348502 - RNA, 64 nt, Human
caucuaaagaugucucuggugauuuuuauauguuccgcuauauaauugaugcuuuauaguuuua

SEQ ID NO: 348503 - RNA, 64 nt, Human
gaaucaccacucgguccaaccuagacaaccaagaccgcuauaccuaaagaccucuauauccugg

SEQ ID NO: 348504 - RNA, 64 nt, Human
gaauacugucuacaugcuuucucauucaagaauucgucaucacgcaucacaggccgcgucuuug

SEQ ID NO: 348505 - RNA, 64 nt, Human
agaaagaguuucugcggaagcuggugaaagcucgcgucaucacugaucuaagcaguggcaucug

SEQ ID NO: 348506 - RNA, 64 nt, Human
cucucccagcacuggcacgaagugcucccugcugcgucaucaccaucucgggacgcaugaccuu

SEQ ID NO: 348507 - RNA, 64 nt, Human
acagugacuguacaguuaucauuaucaucaucaucgucaucaucauagguaacaguuauaucaa

SEQ ID NO: 348508 - RNA, 64 nt, Human
ugagacuccagcccuucucccucagaccagggaccgucaucaucuaaaccugaagccgagcucc

SEQ ID NO: 348509 - RNA, 64 nt, Human
cccggagugcacagcuccaccugggagccuggcgcgucaucauuggccugacagcagagagaau

SEQ ID NO: 348510 - RNA, 64 nt, Human
ugcuauaaucuguuuuuacguauguaggcccagucgucaucagaugcuugcggcaaaaggaaag

SEQ ID NO: 348511 - RNA, 64 nt, Human
caucucauuuaagcccugcaaccaaugagaugcacgucaucauuggcucuuacagacaagaaaa

SEQ ID NO: 348512 - RNA, 64 nt, Human
gugaccaauuuuacuggaugcaauugacaggacccgucaucauaauuaaacaacccauauuggg

SEQ ID NO: 348513 - RNA, 64 nt, Human
cuuucuuuguuuuguaccuuaaauuguucgauuacgucaucaaaagagaugaaagguauguaga

SEQ ID NO: 348514 - RNA, 64 nt, Human
ccuggagggacagugagaauuuauuuguauaugccgucaucacaaugaugauauagggauauuc

SEQ ID NO: 348515 - RNA, 64 nt, Human
aaucaugccgcucaguuccuggagacagaagagccgucaucagugucucacuugugauuuuuau

SEQ ID NO: 348516 - RNA, 64 nt, Human
ugacucauagaauggccuuuuuugucagcauaaucgucaucauuauuuagauacuuucuuccuu

SEQ ID NO: 348517 - RNA, 64 nt, Human
cugcagcugccuucaagccuguaggauccacuggcgucaucaagucaccaagcuggcaacggcc

SEQ ID NO: 348518 - RNA, 64 nt, Human
uuuugcugcugguagaaucaggguccucgggcaugaacgcgagcccaaagugccagucugcgau

SEQ ID NO: 348519 - RNA, 64 nt, Human
aauugaaaggcaaaaacuagagagagagagaauggaacgcgaacgcuuggaaagggaacgcauu

SEQ ID NO: 348520 - RNA, 64 nt, Human
cugaugcugggacagccccgcucccagauguaaagaacgcgacuuccacaaaccuggauuuuuu

SEQ ID NO: 348521 - RNA, 64 nt, Human
ucuuggcguacccucuccacgugcccgucccccucgucaucagagguaaaggcaugagaaaauc

SEQ ID NO: 348522 - RNA, 64 nt, Human
uguauccuuuuucacggggaccagaacacugguacgucaucaccaaagccaaucugcucuagcu

SEQ ID NO: 348523 - RNA, 64 nt, Human
gagggccaagacuuggcaacagaagcaguugagucgucaucacuuuucagugaugggagaguag

SEQ ID NO: 348524 - RNA, 64 nt, Human
gcuuccuuucaguugccuccuggaucuucuuucccgucaucaaaugacugcugaacaggaaacc

SEQ ID NO: 348525 - RNA, 64 nt, Human
uuucucuagcuaauuuuguggccaauguaaaauucgucaucaaccuaacaaacacaaccuucuc

SEQ ID NO: 348526 - RNA, 64 nt, Human
gggguuugaacuggacauccuaaugaugcaauuacgucaucacccagcugauuccgggugguug

SEQ ID NO: 348527 - RNA, 64 nt, Human
uauauguagaguguuuuaaaacauucacaccauucgucaucacuccucugucauaugcagaauu

SEQ ID NO: 348528 - RNA, 64 nt, Human
caggcugcugagcuagacuaaggaaugcauccaccgucaucacaugagacacugacucugugac

SEQ ID NO: 348529 - RNA, 64 nt, Human
gaauuguugcugcacgugcugggcccgccaaugccgucaucaucaggauuuuacaaaucucuuu

SEQ ID NO: 348530 - RNA, 64 nt, Human
uuauaugcauuaucuucuucagucacaacaaccucgucaucauccccacuuuaaaccccaggag

SEQ ID NO: 348531 - RNA, 64 nt, Human
gggcauuggucacauaugaccaguaauugaaagacgucaucacugaaagacagaaugccaucug

SEQ ID NO: 348532 - RNA, 64 nt, Human
cccaguuugguuuccaugggaaccugaguggcagcgucaucacuuugcugaggugaaaugcccc

SEQ ID NO: 348533 - RNA, 64 nt, Human
gugaagacaucuagaaacauuacaccacacacaccgucaucacauuuucacaugcucaauugau

SEQ ID NO: 348534 - RNA, 64 nt, Human
auuuuguugacugucagguuaggugucccuuagucgucaucagaagcugaagccuuccuuucca

SEQ ID NO: 348535 - RNA, 64 nt, Human
aguggaguaccccagauacauuuuagacauuuaucgucaucaucugcucugaguggaaggccgu

SEQ ID NO: 348536 - RNA, 64 nt, Human
acagggccccaagguguccgaguguguugggucugaacgcgaaauaaagaaauccucucagccc

SEQ ID NO: 348537 - RNA, 64 nt, Human
cugaugucucuguuggggaucagagggcuggcgggaacgcgagaagggcaccagcagcauucca

SEQ ID NO: 348538 - RNA, 64 nt, Human
gccccgcaggcagguacuucccggagcgagcggggaacgcgacguaccccagugcgccucggca

SEQ ID NO: 348539 - RNA, 64 nt, Human
gggaccucucugagcaggcucucgugaaucagcucgucaucagauggcuuuggugcauggcaca

SEQ ID NO: 348540 - RNA, 64 nt, Human
cugccucgggccucgcagaggccgcuggucacuucgucaucauuuugccccuggagacgucuuu

SEQ ID NO: 348541 - RNA, 64 nt, Human
acucugagucccaguucccagugcagcuguaggucgucaucaccuaaccacacgugcaauaaag

SEQ ID NO: 348542 - RNA, 64 nt, Human
uuugucuuaaaggucuugaggguugaccauguugcgucaucaucaacauuuuggggguuguguu

SEQ ID NO: 348543 - RNA, 64 nt, Human
ggcccccagauggcgagcagcaccaccuccaagccgucaucaucauccucaggacccaggaccc

SEQ ID NO: 348544 - RNA, 64 nt, Human
ucauauuucuuuucuuucucaucuugaugaugaucgucaucaucaagaauuuaaugauuaaaau

SEQ ID NO: 348545 - RNA, 64 nt, Human
gcugaccgcacagcagucuggcuugauuuucagccgucaucauuggguucuguuuugacagcuc

SEQ ID NO: 348546 - RNA, 64 nt, Human
cccccagcugcuugugucccuccugggaucugcucgucaucauuuuuccuucccuucuccaucu

SEQ ID NO: 348547 - RNA, 64 nt, Human
auggaggugggcagaguaacauaaaacugaugaccgucaucauacuguugcaguuagcacacuu

SEQ ID NO: 348548 - RNA, 64 nt, Human
caggcuuuugucuugaugcccgucuuuugguuuacgucaucauuguagccauaugguaaauuuu

SEQ ID NO: 348549 - RNA, 64 nt, Human
uggcaagguuuuuaaucaaaaaacaacccuugcacgucaucauagaauucauacugcagagaaa

SEQ ID NO: 348550 - RNA, 64 nt, Human
gaaaccaaacugcagccucaacaccauggacacacgucaucaggaccuccugagguucguguua

SEQ ID NO: 348551 - RNA, 64 nt, Human
aaaacaaaagauggaguguuuacaaguagacauucgucaucaguuguucuugaacauggucuuu

SEQ ID NO: 348552 - RNA, 64 nt, Human
uuuuccacaaugaugaugauuucagcagggaugacgucaucaucacauucagggcuauuuuuuc

SEQ ID NO: 348553 - RNA, 64 nt, Human
gcugagucaucaucaucaucaucaucauugucgucgucaucaucuugcugagugucucuugaag

SEQ ID NO: 348554 - RNA, 64 nt, Human
cacacaucaucauuaucaucaucaucauugucgucgucaucaucuugcugagucaucaucauca

SEQ ID NO: 348555 - RNA, 64 nt, Human
caacgcagggcaccaccaccaccaacuugaauuccgucaucaaugcucaccgucaauauguuua

SEQ ID NO: 348556 - RNA, 64 nt, Human
auggucagagggggaugucaacaacagaucaagccgucaucacaacagguauuucugaaguucc

SEQ ID NO: 348557 - RNA, 64 nt, Human
gacaucugacugugggaugugcucucaaguaggacgucaucaggacagauucugaauaggcauc

SEQ ID NO: 348558 - RNA, 64 nt, Human
gaggguccucgcugccaccggucccccccuagcccgucaucagccgguggcagcuccaucuucc

SEQ ID NO: 348559 - RNA, 64 nt, Human
gcguguacccuggcagccccaccagcuggcuggucgucaucauggcaacaguggguuccuccuu

SEQ ID NO: 348560 - RNA, 64 nt, Human
ccuuucacgaacgugggcauggcugcggaccccucgucaucagguguauagcaagugaaagcaa

SEQ ID NO: 348561 - RNA, 64 nt, Human
ccuuucacgaacaugggcauggcugcggcucccucgucaucaggugcauagcaagugaaagcaa

SEQ ID NO: 348562 - RNA, 64 nt, Human
accuuucacgaacaugggcauggcugcggacccucgucaucaggugcauagcaagugaaagcaa

SEQ ID NO: 348563 - RNA, 64 nt, Human
ccuuucacgaacaugggcauggcugcggaccccucgucaucaggugcauagcaagugaaagcaa

SEQ ID NO: 348564 - RNA, 64 nt, Human
ccuuucacgaacaugggcauggcugcggaucccucgucaucagguguauagcaagugaaagcaa

SEQ ID NO: 348565 - RNA, 64 nt, Human
ccuuucacgaacgugggcauggcugcggaccccucgucaucaggugcauagcaagugaaagcaa

SEQ ID NO: 348566 - RNA, 64 nt, Human
ccuuucacgaacaugggcauggcuguggaccccucgucaucaggugcauagcaagugaaagcaa

SEQ ID NO: 348567 - RNA, 64 nt, Human; identical to SEQ ID NO: 348563

SEQ ID NO: 348568 - RNA, 64 nt, Human; identical to SEQ ID NO: 348563

SEQ ID NO: 348569 - RNA, 62 nt, Human
cuucccggcugcgaggacgcccagagaccgcgggcgcugagcgcguugggcagacugguugc

SEQ ID NO: 348570 - RNA, 62 nt, Human
gaacgaaaucucgcuucagucacucugccgaaggcgcugacggcaucgcggccggaaccucu

SEQ ID NO: 348571 - RNA, 62 nt, Human
cucuguaccuuacagcucacguaaugccugcuggcgcugaccacacagcuccuuccuccucu

SEQ ID NO: 348572 - RNA, 62 nt, Human
agguacacaguugcccgguugggaaugugcuuggcgcugacccugcgggcaucugacugguc

SEQ ID NO: 348573 - RNA, 64 nt, Human
uacagaacaugagcccuuuuuaaaugugauuucccgucaucacagcaguaggaugaagccuugu

SEQ ID NO: 348574 - RNA, 64 nt, Human
cugaagccauccaggacgucauccgccacauccgcgucaucaacggccgggccguggaggccua

SEQ ID NO: 348575 - RNA, 64 nt, Human
guucggaggcccucuauuggugccucucuccugccgucaucacuauggcaggaaaacagagaug

SEQ ID NO: 348576 - RNA, 62 nt, Human
gauaacauuuauugagugcuugcuguaugccaggcgcugauguaagcacuuuagguaucauu

SEQ ID NO: 348577 - RNA, 62 nt, Human
aucuaggcagagugccuuagucagggaccacgggcgcugaaucugcagugccaacaccaaac

SEQ ID NO: 348578 - RNA, 62 nt, Human
uaaaauuucauauuuucgcucguaaaaauuuaggcgcugaauaagaauugugcuauuucucu

SEQ ID NO: 348579 - RNA, 62 nt, Human
agcaucgcaguuauagcgaccgcggggagccaggcgcugaggagcgggcccguggugacggc

SEQ ID NO: 348580 - RNA, 62 nt, Human
cugauggaucccgaagaauggagaggaacacaggcgcugaguauggagcagccuggagaccc

SEQ ID NO: 348581 - RNA, 62 nt, Human
gcagcugcccugaaaguagggguggcggcggcggcgcugaguuuauacauuaguucagaccu

SEQ ID NO: 348582 - RNA, 62 nt, Human
aaagggcaaggaggugggggccgcaggguuggggcgcugagcucccagacccccugaucagg

SEQ ID NO: 348583 - RNA, 62 nt, Human
ccuuuaaugagccuguaaggaccagacacuguggcgcugaaucagauuuaauaaugaguuaa

SEQ ID NO: 348584 - RNA, 62 nt, Human
aggauucuagucuucacuugccugugcagcugggcgcugaccuuccagguagagcacagaug

SEQ ID NO: 348585 - RNA, 62 nt, Human
agcgagugauucccgcgcuccggcuccggaccggcgcugacagcuguaggcuguagccugca

SEQ ID NO: 348586 - RNA, 62 nt, Human
agcuaagccugcuggggcugggugaagaaauuggcgcugagauccaggcuggauccauugcu

SEQ ID NO: 348587 - RNA, 62 nt, Human
cuaaguuucccccagugcccacagcacccuccggcgcugaaaauacacgcaccacccaccag

SEQ ID NO: 348588 - RNA, 62 nt, Human
cccuuuccuucccgccagaguggggcugagugggcgcugagccaggccgggggccuauggca

SEQ ID NO: 348589 - RNA, 62 nt, Human
aaacacaauggcugaauuaucuuucuccauguggcgcugaaucacccaucugguuuggagcu

SEQ ID NO: 348590 - RNA, 62 nt, Human
aaaacuggaaaagcccggcaggcccaggagagggcgcugaccuguggucgucauuuauuugg

SEQ ID NO: 348591 - RNA, 62 nt, Human
cugccuucucuagcggcacagaagcagccgggggcgcugacucccgcuagugucaggagaaa

SEQ ID NO: 348592 - RNA, 62 nt, Human
gguggugcuacacggacuucggagcauagaguggcgcugagugaguggcugagaccgaccac

SEQ ID NO: 348593 - RNA, 62 nt, Human
aggagggcucagcgguggggcagccuguccggggcgcugacccaccaucacccugcucugcc

SEQ ID NO: 348594 - RNA, 62 nt, Human
gcagugaugaugggaguuauuuuuaccauccgggcgcugauagcugcacuauuaauaaauug

SEQ ID NO: 348595 - RNA, 62 nt, Human
caguuagacaaggaccaggauugcacugacauggcgcugaggguuuuucuaaguaagaacac

SEQ ID NO: 348596 - RNA, 62 nt, Human
ggguggugcuggugcugcacugggcugacugcggcgcugacgcagcguuuccccccaucccu

SEQ ID NO: 348597 - RNA, 62 nt, Human
aaaccaaagacagauugcuuaaccaacagaugggcgcugacccccuauccagaaucacaugc

SEQ ID NO: 348598 - RNA, 62 nt, Human
aaaccuagccggaaggccgaggucccauuguuggcgcugaggugucuggccugaggucaaug

SEQ ID NO: 348599 - RNA, 62 nt, Human
gggugggcgugguacgugugcgccaggacucgggcgcugagggccacucacacagcugcuac

SEQ ID NO: 348600 - RNA, 62 nt, Human
ccuguuaaccuucuguuacucccugggagaaaggcgcugagcguggcaugcaggugucuuug

SEQ ID NO: 348601 - RNA, 62 nt, Human
gucagugguaacuugugcccagcccugugcuaggcgcugacauuaacaggagcaaccagggc

SEQ ID NO: 348602 - RNA, 62 nt, Human
ccucgcacagggcaugccuggccugaggacccggcgcugaguggcggggccccugcuccgag

SEQ ID NO: 348603 - RNA, 62 nt, Human
ucgcaccuucuucuccuggcuugccagccagaggcgcugaggugugcugggugcacuggagc

SEQ ID NO: 348604 - RNA, 62 nt, Human
guucauuucucacaaacuguacugacucgaggggcgcugauuucauaggaucuggugcugua

SEQ ID NO: 348605 - RNA, 62 nt, Human
gugcuuggaacauacuguucacucacucuaaaggcgcugagacugugcuguuguucucguuu

SEQ ID NO: 348606 - RNA, 62 nt, Human
uggcccuggagaugggaaagugucugugucgaggcgcugagcucucucucuguuucuccuuu

SEQ ID NO: 348607 - RNA, 62 nt, Human
ccccaacaucacuuccuucauggaaagguguuggcgcugauguagcucauggaaggaucaga

SEQ ID NO: 348608 - RNA, 62 nt, Human
gugacccguuuuggaaaacugguguguaccgaggcgcugacugcacggcugaccgccugcuc

SEQ ID NO: 348609 - RNA, 62 nt, Human
ucggggcgucccagcgacgcgggaaggggcagggcgcugaccugcugcugagcuggcugggc

SEQ ID NO: 348610 - RNA, 62 nt, Human
gacaaguuuuccuugcuuuccugauacucuuuggcgcugacuuggaauucuaagagccuugg

SEQ ID NO: 348611 - RNA, 62 nt, Human
ccgaucgugggcugaaccuugccuucgggcacggcgcugauaggcuggauccagcgcugggc

SEQ ID NO: 348612 - RNA, 62 nt, Human
ccuuaagggaaggucaagagggagaugggcaaggcgcugagggaggaugcuuaggggacccc

SEQ ID NO: 348613 - RNA, 62 nt, Human
ugugcuggcuggacuccucgggacaagcccauggcgcugaucgcuggugcugagcccugccc

SEQ ID NO: 348614 - RNA, 62 nt, Human
agugaaacgacuagcagcgaugcuaugcaaaaggcgcugauacuggaaggcuugaacaccgu

SEQ ID NO: 348615 - RNA, 62 nt, Human
cucaccuuccccggagacccuggcgaccgccgggcgcugacaccagacuuggguuuuagacu

SEQ ID NO: 348616 - RNA, 62 nt, Human
cgggauuccaagcuggcacugccacuguggagggcgcugaaacuucaucacacacugagagg

SEQ ID NO: 348617 - RNA, 62 nt, Human
gacugacacauagugcuuggugaggucacgcuggcgcugaauacuuuuuguauaaaccgacg

SEQ ID NO: 348618 - RNA, 62 nt, Human
caccaggccauccccauaccuucugguuugaaggcgcugacacuggcagagagguaaagggu

SEQ ID NO: 348619 - RNA, 62 nt, Human
ccaaaauccugaacuuucucccucaucggcccggcgcugauuccucguguccggaggcaugg

SEQ ID NO: 348620 - RNA, 62 nt, Human
cuggagcaggguggucuccggcuccuccuugcggcgcugacccggccggccccacacccgcu

SEQ ID NO: 348621 - RNA, 62 nt, Human
uccugugcuggaaagcguugauggggagcgucggcgcugaccacacgcgggagcugcggaag

SEQ ID NO: 348622 - RNA, 62 nt, Human
aaccugcugaagggcagagguggaggguggggggcgcugaguagggacucagggccaugccu

SEQ ID NO: 348623 - RNA, 62 nt, Human
aaugagaaagcucccagggaagcgggggauggggcgcugaggcaggguuguuagaggacugu

SEQ ID NO: 348624 - RNA, 51 nt, Human
acaucuuugguccccaguaaaggcgcugaagcacugcaugauguugcugag

SEQ ID NO: 348625 - RNA, 62 nt, Human
aauuuaggguaugaucucggucacgugucccgggcgcugaggggaaaggaagcgggcaugau

SEQ ID NO: 348626 - RNA, 62 nt, Human
ggccagaguggagugcgcagcccugacucccaggcgcugagauuguugccugguuacccagg

SEQ ID NO: 348627 - RNA, 62 nt, Human
gagaaacacugcugcccucuuuguagcagucaggcgcugacccaagagaacucaccuuauuc

SEQ ID NO: 348628 - RNA, 62 nt, Human
gcugcccgcguguccagcccuguugcucuccuggcgcugagagguggguccaagcagaguug

SEQ ID NO: 348629 - RNA, 62 nt, Human
gucggccgcccucccguccucccagagcugcuggcgcugaggucagagcgggucugaugggg

SEQ ID NO: 348630 - RNA, 62 nt, Human
gugucccucugcacgcagcccucgcccggcguggcgcugacacuguauucuuauguuguuug

SEQ ID NO: 348631 - RNA, 62 nt, Human
ggcgcaggcucgacccgggccaggaggcccggggcgcugagcucaggcccagaacuggcuga

SEQ ID NO: 348632 - RNA, 62 nt, Human
acucucuagggacaccuguaccagccccaccuggcgcugagaucccucagacagcauggccc

SEQ ID NO: 348633 - RNA, 62 nt, Human
uuuuuccuucuauguccccucucugcggggggggcgcugaggcugagggggagcugcgucuu

SEQ ID NO: 348634 - RNA, 62 nt, Human
acagaacuucccacuguggaucugugacccugggcgcugaaaaugggacccaggaauccccc

SEQ ID NO: 348635 - RNA, 62 nt, Human
cacggccgcggagaugacgucacgcaagcaacggcgcugacgucacauaucaccguggugau

SEQ ID NO: 348636 - RNA, 62 nt, Human
ugccagcccgucucugugcagucccuggaaggggcgcugagaaaggcaccagcuccuuggac

SEQ ID NO: 348637 - RNA, 62 nt, Human
uuauguuagugaaaccacuacaagguguuucaggcgcugauaacaugcuucacaccugcccu

SEQ ID NO: 348638 - RNA, 62 nt, Human
ccugaaaaucagccuaaugucugggggcagcuggcgcugaggcugugcagauguguauggcc

SEQ ID NO: 348639 - RNA, 62 nt, Human
gagggagcuugggugcagguucacccgcugaaggcgcugauaaguccugugcugaggagcug

SEQ ID NO: 348640 - RNA, 62 nt, Human
uucagccacuaaugccuuuuaucccccauaugggcgcugagcuguggcuguuccuggacacu

SEQ ID NO: 348641 - RNA, 62 nt, Human
acccugacuuuuaucaauaccugcaagaggcaggcgcugaugaccucuucuucuguuaccgc

SEQ ID NO: 348642 - RNA, 62 nt, Human
caggacuccccaagcggaaugaggccaagacuggcgcugacaccacagcagcugggccccuc

SEQ ID NO: 348643 - RNA, 57 nt, Human
ugcucccgcgucuccuguaggccccaaggcgcugagcagccccgggaaacugucgcc

SEQ ID NO: 348644 - RNA, 62 nt, Human
gcgcacacacucacgcacacacaagcagagaaggcgcugaucuugaacuaauccugcacagg

SEQ ID NO: 348645 - RNA, 62 nt, Human
cacagaauucauucacucaacaaacauaauagggcgcugagggcauagaaguaaaaacaccu

SEQ ID NO: 348646 - RNA, 62 nt, Human
gcgcuagagcauucugggguggggcuuggaagggcgcugagggcaggguucuagaaggggcg

SEQ ID NO: 348647 - RNA, 62 nt, Human
gugucgcgucuguuuuccucgugguuuuuuggggcgcugaccgcuccaagcagcgcggcagc

SEQ ID NO: 348648 - RNA, 62 nt, Human
ucuggcagagauucugguacagagaaaggagaggcgcugaguggaaccacgaugggcugagg

SEQ ID NO: 348649 - RNA, 64 nt, Human
guuuauguaucagcucucugcugggucucccuuuccauggcaaaugggcagcuccauccucuug

SEQ ID NO: 348650 - RNA, 64 nt, Human
uggugcccggcccagggugcccagcggggccaugccauggcagauaaagcucaggacgucaaaa

SEQ ID NO: 348651 - RNA, 64 nt, Human
uagaacaucccuacccuuggcaguguggcagugaccauggcacuacacggcugugacgaggugg

SEQ ID NO: 348652 - RNA, 64 nt, Human
gcauguaaguguuuuuguccuaauguugcuacucccauggcaaagaaaaaaaaaagaaugaaaa

SEQ ID NO: 348653 - RNA, 64 nt, Human
gacacacugaggacaaugcggcuauagcagauggccauggcagucaguggcagcagaaagaggc

SEQ ID NO: 348654 - RNA, 64 nt, Human
uugcucccuucucggaccagccuucuuccucccaccauggcagguggggagcaggucucccaga

SEQ ID NO: 348655 - RNA, 64 nt, Human
aagacucuggauuguugcacggcaaccacuccucccauggcauugcucagcaacuacuucuccc

SEQ ID NO: 348656 - RNA, 64 nt, Human
aacaaacaaacaaagcagaacuaaaauauugggaccauggcagagaaaagcaggagaggagcaa

SEQ ID NO: 348657 - RNA, 64 nt, Human
auagcagcccuauacuuuggggaucauuugccuaccauggcauauauuugaaauugcuuuggac

SEQ ID NO: 348658 - RNA, 64 nt, Human
cuugaacgaaaggugguuaacacgugaccaauccccauggcagacagcgggcuggugaacagga

SEQ ID NO: 348659 - RNA, 64 nt, Human
ggaccugggcaugacauccuuucuuuuaaugaugccauggcaacuuagagauugcauuuuuauu

SEQ ID NO: 348660 - RNA, 64 nt, Human
caaaguggcaaccugggaaugaaggcuccauaaaccauggcauguuggguuugcaggacuggcc

SEQ ID NO: 348661 - RNA, 64 nt, Human
aggccucuucuaaacccuauccuaagcuccaguuccauggcaaggcucagacuuuuaaugccau

SEQ ID NO: 348662 - RNA, 64 nt, Human
ccugccagcgucagaggcccuggagaggggcuguccauggcagcuggucuuuauuccucccuca

SEQ ID NO: 348663 - RNA, 64 nt, Human
gacucccuccuccugccacuggugccucgaguagccauggcaacgggcccaguguccagucacu

SEQ ID NO: 348664 - RNA, 64 nt, Human
gggcgacaagagugaaacuccgucuuaaaaaagcccauggcaggcugggcgcgguggcucacgc

SEQ ID NO: 348665 - RNA, 64 nt, Human
ggcacaccacugcccugccugcccacuuagccguccauggcaccagcccccuggaugggcauug

SEQ ID NO: 348666 - RNA, 64 nt, Human
cuccacuaaacauaaaaacaaaauuacuggggccccauggcacacaccuguagucccagcugcu

SEQ ID NO: 348667 - RNA, 64 nt, Human
uggucuccuaaagugcugggauuauaggugugagccauggcacccggucuugguuuauauuuua

SEQ ID NO: 348668 - RNA, 64 nt, Human
uacuacaaccaauuccaaguuuuaauuuuuaacaccauggcaccuuuugcacauaacaugcuuu

SEQ ID NO: 348669 - RNA, 64 nt, Human
gugggccccugagcugagcacagggccaaagcagccauggcagacaccugacggagggcacggg

SEQ ID NO: 348670 - RNA, 64 nt, Human
agcuuuccaguauaccucuucuggaugccauucuccauggcacuauuccuucaucuacugugaa

SEQ ID NO: 348671 - RNA, 64 nt, Human
gaaggggaucaauauuuugcacaccuguaauaggccauggcacaccagccaagaugcucugcuc

SEQ ID NO: 348672 - RNA, 64 nt, Human
gaugaacacuggagugggcagagguggcccaggaccauggcacccuuagagugcagaagcuggg

SEQ ID NO: 348673 - RNA, 64 nt, Human
uuaaccccccauagugugggggaccugcagagaaccauggcauucccuauuccacagucaucuu

SEQ ID NO: 348674 - RNA, 64 nt, Human
acagucaucuuauuaccugccagggcucaucuagccauggcaauguuugccuugaaugggggug

SEQ ID NO: 348675 - RNA, 64 nt, Human
acuugaucuuuuacagggcugucugugaccauuuccauggcagcaggaugcagggauuaauaag

SEQ ID NO: 348676 - RNA, 64 nt, Human
agcaccugacauucugcaccagcuaccucugccuccauggcagagaaaaggccauaagaacagu

SEQ ID NO: 348677 - RNA, 64 nt, Human
ucaguuuauaaauucagguauauucuuuuugucuccauggcaaccauaacuuuugaaccaaaaa

SEQ ID NO: 348678 - RNA, 64 nt, Human
gaugcauuuauuuuaucaauaccaauuuuuguggccauggcagacauugcuaaucaaucacagc

SEQ ID NO: 348679 - RNA, 64 nt, Human
uugacugcuggcagucuaaaacaguccacccaccccauggcacugccgcgugauucccgcggcc

SEQ ID NO: 348680 - RNA, 64 nt, Human
gaguggugaggggccacugggccccauucucccuccauggcaggaaggcgggggauuucaaguu

SEQ ID NO: 348681 - RNA, 64 nt, Human
agcuuuccuaauauugcugugcuccccaccacccccauggcagucccuccgcagccccaguccc

SEQ ID NO: 348682 - RNA, 64 nt, Human
uuuagauguuucguugaaucuauuuagagcuucaccauggcaauauguauuucccuuaaaacac

SEQ ID NO: 348683 - RNA, 64 nt, Human
agcccuugugaugugauuagugucucauguggaaccauggcaugguuauugaugaguuucuuaa

SEQ ID NO: 348684 - RNA, 64 nt, Human
auuugcuggagcucugcccauccugccccugagcccauggcacucuauguucuaagaagugaaa

SEQ ID NO: 348685 - RNA, 64 nt, Human
gugcuuugugcauagcccuucucuauguaagcagccauggcagucauuaaagagaaaggaguag

SEQ ID NO: 348686 - RNA, 64 nt, Human
cauuaggugccuuguauuuuaaaucugugacaaaccauggcaaauuuuuaaaggggaaguauua

SEQ ID NO: 348687 - RNA, 64 nt, Human
gugaagagcaaagcagaagaaaugacagcagaagccauggcacagacuuguauagaggagaaaa

SEQ ID NO: 348688 - RNA, 64 nt, Human
gagacauaucuaaaaaaccgaaaggccagaguugccauggcaucggcuagugucuaaaggaaac

SEQ ID NO: 348689 - RNA, 64 nt, Human
agggaggcacuggaggaagacggcaccucuucccccauggcagggugugagggaggcagguuug

SEQ ID NO: 348690 - RNA, 64 nt, Human
caggggaacuagcuucccaccucugacagggauaccauggcaaauaccacucuuugccuaggau

SEQ ID NO: 348691 - RNA, 64 nt, Human
cugccagccucuggcugcacggucaggcccugccccauggcaggccugccagagcuuggcuggg

SEQ ID NO: 348692 - RNA, 64 nt, Human
guuuuucuucauuugaagaaaauuuguugauaaaccauggcaacugcaagaauuggaaaaaugc

SEQ ID NO: 348693 - RNA, 64 nt, Human
gguuuuucauuuaacuuuugacuacagcauggccccauggcauccacaccaagaggguguugug

SEQ ID NO: 348694 - RNA, 64 nt, Human
cugcugauguggcaacugcugaugcucaugguccccauggcaugggggccucagggcagccugc

SEQ ID NO: 348695 - RNA, 64 nt, Human
aauaaaccaguuaaaacagaaccuuuaagagcaaccauggcacaaaaugaaaauguaguaguac

SEQ ID NO: 348696 - RNA, 64 nt, Human
uuagggggacugaaccccucugaccuuaugaggcccauggcacuggggcagggagcuggggaca

SEQ ID NO: 348697 - RNA, 64 nt, Human
uucaccucuccgucaaguccuuccugugauacugccauggcacaggaucugaguugcagcucug

SEQ ID NO: 348698 - RNA, 64 nt, Human
agccuaccuuucccugccaggcccuugcucagggccauggcauuuaacuaagugcaccugugau

SEQ ID NO: 348699 - RNA, 64 nt, Human
cugcugccaugugcacugggguggcacuggagagccauggcagucgugagauauuguaugugua

SEQ ID NO: 348700 - RNA, 64 nt, Human
agauggagacccucuagucucgugagacuuugccccauggcagaacucugcuggaauccuauug

SEQ ID NO: 348701 - RNA, 64 nt, Human
caugccuugucugaaaaugagcuguguguucgagccauggcaucuuuagagaccauuggcccac

SEQ ID NO: 348702 - RNA, 64 nt, Human
accgcagggcccgacccuccugucauucacagucccauggcacauaggggaaaggaucuacccu

SEQ ID NO: 348703 - RNA, 64 nt, Human
cagugaaaucaaaaaaagaacagaaaugcaaaaaccauggcauuagcguaaaaaggacacguuu

SEQ ID NO: 348704 - RNA, 64 nt, Human
cccccacacacaaccuccccuguuuucacauucaccauggcaucccagagcaaggacacaggag

SEQ ID NO: 348705 - RNA, 64 nt, Human
cauuaauccucucucaccucacagauacccccucccauggcaaauaauauaauaaccagugaau

SEQ ID NO: 348706 - RNA, 64 nt, Human
aggcccaguucucgugcccuuagaggggaaugaaccauggcaccuuugagagagggggcacugu

SEQ ID NO: 348707 - RNA, 64 nt, Human
cuggccaggacacacugaaaagcagccuuuuucaccauggcaaaccuaaaugcagucagucaca

SEQ ID NO: 348708 - RNA, 64 nt, Human
caggcacaaaggcccgaacacaggaagccugugaccauggcagccuugucuuaugggcgcauau

SEQ ID NO: 348709 - RNA, 60 nt, Human
augcaagcacuaugcacugagaugccuuggccauggcacaagagaaaccagccaggaaaa

SEQ ID NO: 348710 - RNA, 64 nt, Human
cccaaguuggucuagugugcugcccaguagcaaaccauggcagacucaccaccuauucugaguu

SEQ ID NO: 348711 - RNA, 64 nt, Human
cugcuccauguauggaccuggaaggccauugcugccauggcacuugggacacuugaggaagaaa

SEQ ID NO: 348712 - RNA, 64 nt, Human
aaaaccagaggcccucugagaucaugugaguccuccauggcaaggaagcaguuccagggagagu

SEQ ID NO: 348713 - RNA, 64 nt, Human
ucucacuggcugaaaagcaaaggggcccacaccaccauggcagaugcccucuggcgccuucgag

SEQ ID NO: 348714 - RNA, 64 nt, Human
uaaaauuauauauaaaggguuauuugaaaccaauccauggcaacgcuggugcuugauacacugu

SEQ ID NO: 348715 - RNA, 64 nt, Human
cucaugaauuuagaacaaggcauguccccaauuaccauggcaaccuuugccagagcacagaccc

SEQ ID NO: 348716 - RNA, 64 nt, Human
uugucauauuucauguugggaccaaguaguuugcccauggcaaaccuaaauuuaugaccugcug

SEQ ID NO: 348717 - RNA, 64 nt, Human
uuauagggacauucccaugggaauguaucuuccuccauggcaugucuugaggguccuuucuugu

SEQ ID NO: 348718 - RNA, 64 nt, Human
cucccuuccucccuggcgauccucaccugcccagccauggcacacacccuuccugcacacccgc

SEQ ID NO: 348719 - RNA, 64 nt, Human
gaaaaugaugcccugcaacuaacccuggucuuucccauggcaauuuaaccacauuuggaaggca

SEQ ID NO: 348720 - RNA, 64 nt, Human
accuuccuacaaucaggaagauagauccaacuggccauggcaaaagcccuggggauuuccgauu

SEQ ID NO: 348721 - RNA, 64 nt, Human
auccagcucuugcucagugaagaggaaaaugccuccauggcagaagucaacgccucggucagug

SEQ ID NO: 348722 - RNA, 50 nt, Human
acucuaccacugaaugguaaccauggcaauaguuacagcauugccagcgg

SEQ ID NO: 348723 - RNA, 64 nt, Human
uuugcugacuugauuauucccuuucucuuaaaaaccauggcauuagacugcacuaaauuaacaa

SEQ ID NO: 348724 - RNA, 64 nt, Human
uuagcagauggagaugagaggacuggguagaguaccauggcagaucucagagagaagaaguagg

SEQ ID NO: 348725 - RNA, 64 nt, Human
agaagcugaggcucugagcggaugcacaggucacccauggcaggugccgugcaguggugucagg

SEQ ID NO: 348726 - RNA, 64 nt, Human
uugcccagaaagcugucuguccaucauguauuguccauggcaacaaauuacauuagguugaacc

SEQ ID NO: 348727 - RNA, 64 nt, Human
caacaugcguagccucuugucuuaaauguacuccccauggcagcauggaggaggcaagaccugu

SEQ ID NO: 348728 - RNA, 64 nt, Human
aucuuaaggggauagacuagacugccacagcagcccauggcacaacuaacaccuacugauauuc

SEQ ID NO: 348729 - RNA, 64 nt, Human
gggaagucgaggcugcaagugagcugagaucaugccauggcagucuagccugggcaacagagcg

SEQ ID NO: 348730 - RNA, 64 nt, Human
auuacaugugcuuaaucucagaugaaccauuucaccauggcaguguuaucucaucucugggcuu

SEQ ID NO: 348731 - RNA, 64 nt, Human
ccaucccccacacaguuggagaauaauuuguagaccauggcaguuaaaaugcuuuuuacucugg

SEQ ID NO: 348732 - RNA, 64 nt, Human
guagaagauggacucugaaaaacauuccaggaaaccauggcagcauggagagccucuuagugau

SEQ ID NO: 348733 - RNA, 64 nt, Human
aucauugaugauagcuuggaaauaaauaauuaugccauggcauuugacaguucauuauuccuau

SEQ ID NO: 348734 - RNA, 64 nt, Human
accaaggcagaugugacagcaagggccacggaccccauggcagggguggcgucuucaugaggga

SEQ ID NO: 348735 - RNA, 64 nt, Human
ugaaugaagcugcugaaguaguguuuaggauccuccauggcaguuagugaauguaagaaguaca

SEQ ID NO: 348736 - RNA, 64 nt, Human
uacugagugaaggauguuggccaaaagcugcuuuccauggcacacugcccucugccacugacag

SEQ ID NO: 348737 - RNA, 64 nt, Human
aauaacaauagcauugucaguggaggcugggccaccauggcagaccuuccaaaaguagugagcu

SEQ ID NO: 348738 - RNA, 64 nt, Human
aguagcagcugccugauuagaugacucucaguccccauggcacccugcuccauguuaccuagag

SEQ ID NO: 348739 - RNA, 64 nt, Human
gaaaauuuaccucgauuuuuaagaacacacauugccauggcaggauuaucuauccaauauggac

SEQ ID NO: 348740 - RNA, 64 nt, Human
accuggggcuguggccucucagggggcagccucuccauggcaggcaucccugccuugggcugcc

SEQ ID NO: 348741 - RNA, 64 nt, Human
aaaaaugauugaaauuaaaauucagcuuuagcuuccauggcaguccucacccccaccucucuaa

SEQ ID NO: 348742 - RNA, 64 nt, Human
cgugaggcuggaagauaauacagaaugucccaggccauggcagagcucguuccauucacgaagg

SEQ ID NO: 348743 - RNA, 64 nt, Human
aaaaccaggaguugaugguagaaaugcauaugauccauggcaggaguaaaucucuccaccuccu

SEQ ID NO: 348744 - RNA, 64 nt, Human
ucccaggcgccccauguccucacaggccaggacgccauggcaggauggagaggacuugguggau

SEQ ID NO: 348745 - RNA, 64 nt, Human
ucgugguagaugcauauaaaggguggaaugggagccauggcaggucauagaguccucucaaugg

SEQ ID NO: 348746 - RNA, 64 nt, Human
accacugcugcugauggauacuuuucccucacugccauggcacaccagucauggaucuuguaau

SEQ ID NO: 348747 - RNA, 64 nt, Human
ugcuggcccuagaaagcgagcauuuucauucuucccauggcagcugauucuuuggugccaguuu

SEQ ID NO: 348748 - RNA, 64 nt, Human
agaggggccaccuccucagccguggguggugggcccauggcagagaagccugaacucuuuacug

SEQ ID NO: 348749 - RNA, 64 nt, Human
acauuuaacgacagaagguugccagguaaagaaaccauggcauaaagcugggaggccaaacacc

SEQ ID NO: 348750 - RNA, 64 nt, Human
auccagccugugccaaaacccgcggagaaggcugccauggcaccgugcaucaucuccucgccca

SEQ ID NO: 348751 - RNA, 64 nt, Human
ucaucuguuccucuuaacuacgguguuucccuuaccauggcauucauaggaugaaaugaaugac

SEQ ID NO: 348752 - RNA, 64 nt, Human
aacauaugaauugcgggggacacaaacauuccguccauggcaccuacuucauaggguuuggcau

SEQ ID NO: 348753 - RNA, 64 nt, Human
ugcgugaauauugggggcccggacgcccaggaccccauggcagugggaaaaauguaggagacug

SEQ ID NO: 348754 - RNA, 64 nt, Human
uagaaggcggagguugcagugagcggagauuguaccauggcacuccagccuggacaacaagagc

SEQ ID NO: 348755 - RNA, 64 nt, Human
ccuagaugcuuguaauucuacaaauuucacauuuccauggcaugcacuacagaaauaacuguau

SEQ ID NO: 348756 - RNA, 64 nt, Human
ucccucccuucccugaauucagaacuguaguucuccauggcaugauacaaacagguccuuguuc

SEQ ID NO: 348757 - RNA, 64 nt, Human
gaauaaaagaauuacauaugaaaaacccucuaaaccauggcacuugaugugauguggcaggagg

SEQ ID NO: 348758 - RNA, 64 nt, Human
cuucucugggcucacgacuguucuggaaaggaccccauggcagacuuggcaaggucuccacuuc

SEQ ID NO: 348759 - RNA, 64 nt, Human
acccuauucuugcuuggaacaugagccuggagacccauggcaguccauaugccucccuaugcag

SEQ ID NO: 348760 - RNA, 64 nt, Human
ggugucccagccuaagagccaccugcugcaguuaccauggcaugcugaguugaugcaccaggug

SEQ ID NO: 348761 - RNA, 64 nt, Human
ucguuaucuucaggaacuggugcaggggcaauuaccauggcagcugcucaagcaguucaggcua

SEQ ID NO: 348762 - RNA, 64 nt, Human
caagcuccuuccccggggucaucacucacggccuccauggcaccagggacaacgcuguccccgc

SEQ ID NO: 348763 - RNA, 64 nt, Human
cagcuugaagaugagggauggugaauggcugugaccauggcagacaucaccaaucaagugcagc

SEQ ID NO: 348764 - RNA, 64 nt, Human
ccccaggccaccaacggcaguccuucugccuuguccauggcauaggccauagaccaggucccug

SEQ ID NO: 348765 - RNA, 64 nt, Human
caggugggcucgggacgggcugggggagggacggccauggcacuugggggcuccagggugacuc

SEQ ID NO: 348766 - RNA, 64 nt, Human
ugcauuguccucaccuuguuauaccugcguggcaccauggcaggauuccacauuucauagaaua

SEQ ID NO: 348767 - RNA, 64 nt, Human
uucauugcagacaaaaccucuugaaacccuucccccauggcacaaacucgcccaugauggaaag

SEQ ID NO: 348768 - RNA, 64 nt, Human
aagaaugacugagggauaguauuggguauuggccccauggcaggaacagccacuugcaucuggu

SEQ ID NO: 348769 - RNA, 64 nt, Human
ugacugaucugacaaaaaaaaaagagggauauuaccauggcaacccuugcauuccacccugagu

SEQ ID NO: 348770 - RNA, 64 nt, Human
cuauaaaaucagacaaacauuagcugggccuguuccauggcauaacacuaaggcgcagacuccu

SEQ ID NO: 348771 - RNA, 64 nt, Human
gagaaacuuguccauuuagcuuucauaagaaaucccauggcaaaggguaauaaaaaggaccuaa

SEQ ID NO: 348772 - RNA, 64 nt, Human
ccagucugcugguuaaauggaaacuuaaaaauauccauggcaagcuuuguauauaaaugaacaa

SEQ ID NO: 348773 - RNA, 64 nt, Human
uugcuguaguuaugaaccuuggggcauuaaaaucccauggcaaggagcauaagagauguucucg

SEQ ID NO: 348774 - RNA, 64 nt, Human
gaucuggacuuugagugagaagaugugauuuggaccauggcacuuaaaaacucuauaaccucag

SEQ ID NO: 348775 - RNA, 57 nt, Human
auuacguugccccggugugaguggucuccauggcaacuuggagccagccaggauggg

SEQ ID NO: 348776 - RNA, 64 nt, Human
acaucgcuggccccacaaacguucagggguacagccauggcagcuccuuccucugccgugagaa

SEQ ID NO: 348777 - RNA, 64 nt, Human
uauagaauggguccauaaacccuucaacucauuuccauggcaaaacucacuuuucuuuuuauac

SEQ ID NO: 348778 - RNA, 64 nt, Human
aucggauccaguuucccaugcaccaacccacugcccauggcaugucuuugggaggugucuguga

SEQ ID NO: 348779 - RNA, 64 nt, Human
ugggaggcagagguugcagugagcugagaucguaccauggcacuccagccugggcgacagagca

SEQ ID NO: 348780 - RNA, 64 nt, Human
ggagauagaagacaaaaucugucucccacgucugccauggcaucaagggggaagaguagauggu

SEQ ID NO: 348781 - RNA, 64 nt, Human
gggcagagcagguguuuaucugccccggcaucugccauggcaucaagagggaagaguggacggu

SEQ ID NO: 348782 - RNA, 64 nt, Human
agaaucuuguuguuugccuacugaagagaugaaaccauggcagaaguagaauccuuauagaaac

SEQ ID NO: 348783 - RNA, 64 nt, Human
aucugagcuaauguagaacaucaaacagaaggacccauggcaguauaaagcaaugaagcaaugg

SEQ ID NO: 348784 - RNA, 64 nt, Human
cuggagaagaaucagagcucagcucaugacucacccauggcaggcggagggucccagaggggcu

SEQ ID NO: 348785 - RNA, 64 nt, Human
accaacccagaugcccugcugagugucccugaaaccauggcagcuccaucugucaagauggcag

SEQ ID NO: 348786 - RNA, 64 nt, Human
uuuaaagucucuuaggaauauuauucauguaacuccauggcauaaauaguuguauuuuugugua

SEQ ID NO: 348787 - RNA, 64 nt, Human
ccaacauagguuaagagcaaguugaaaacaaaggccauggcauucugccacugcauccuucaga

SEQ ID NO: 348788 - RNA, 64 nt, Human
ugggcuagucuguaagucgccccggcuggucccuccauggcacucuggguccucuccucacucu

SEQ ID NO: 348789 - RNA, 64 nt, Human
gugacaaauauuguccagacaacuuacauacacuccauggcaauuuuuuucuauuuauaaucua

SEQ ID NO: 348790 - RNA, 64 nt, Human
gggaagguacgagcucccugcuggagccugggacccauggcacaggccaggcagcccggaggcu

SEQ ID NO: 348791 - RNA, 64 nt, Human
uaugagagauggaggaaaaacuugauuaugucuuccauggcauauuuacucuuacuuuacuucg

SEQ ID NO: 348792 - RNA, 64 nt, Human
cuaggcccucuaggcuggggaagcaaacuggaacccauggcaauaauaggaggguguccaggcu

SEQ ID NO: 348793 - RNA, 64 nt, Human
ucugcugauguggagucauguuuuguggggucuuccauggcacauuuaccuguugcuccgucca

SEQ ID NO: 348794 - RNA, 64 nt, Human
augguacauacgcagccauugucucuguuuuuacccauggcagacauugcuaaucaauggcagc

SEQ ID NO: 348795 - RNA, 64 nt, Human
guggcuccucaagccugccuguccugcagaguccccauggcauggagcuuacaccugacugacu

SEQ ID NO: 348796 - RNA, 64 nt, Human
acggugugggugggcagggcuuggacccccgucuccauggcagguccauacagcauggguggca

SEQ ID NO: 348797 - RNA, 64 nt, Human
cuguacuaguuagcuauuguuauuaacaagaucuccauggcagacaagcuaaagcaucugccua

SEQ ID NO: 348798 - RNA, 61 nt, Human
gcuugugcuaccccaauuagggcccagccugccauggcagcuccaacaaggaccgucuggg

SEQ ID NO: 348799 - RNA, 64 nt, Human
aggagaaacucuagacugcaagaacuguuuuuacccauggcauggguggaauuagaguggaaua

SEQ ID NO: 348800 - RNA, 64 nt, Human
gagccuucagucuugaauuucuaaaaaacagaggccauggcagaauaaucuuuggguaacuuca

SEQ ID NO: 348801 - RNA, 64 nt, Human
auucucauuaugacaccuauugcaaauuagcaucccauggcaaauauauuuugaaaaaauaaag

SEQ ID NO: 348802 - RNA, 64 nt, Human
auguaaucgacuuuauaucuuagucacggaguugccauggcauguaguagaaaaccacaggaag

SEQ ID NO: 348803 - RNA, 64 nt, Human
ggcuccgcaucgccucucuccuaggauacagaaaccauggcaacgaaaguagaauguaaaacuc

SEQ ID NO: 348804 - RNA, 55 nt, Human
guauugcugucaagccgugagcuagccauggcaggacagcuccuggaccaggucu

SEQ ID NO: 348805 - RNA, 64 nt, Human
gcuguaguaggcauuuuuaccaucacugaguuuuccauggcaggaaggcuuguugugcuuuuag

SEQ ID NO: 348806 - RNA, 64 nt, Human
cugggaauccugcugccagagaaccauucccaagccauggcaugcuccuugaagaaucucuccu

SEQ ID NO: 348807 - RNA, 64 nt, Human
cuggagcaggaggaacuccaguccgucccggcauccauggcagcccgcgguuaggugcgccagg

SEQ ID NO: 348808 - RNA, 64 nt, Human
cacagaagagguuucuguuuuucuguggcucuguccauggcaucccacuugcccacucuccuuc

SEQ ID NO: 348809 - RNA, 64 nt, Human
ucuugaucaucuguagguauuaaucacaucacuuccauggcauggauguucacauacagacucu

SEQ ID NO: 348810 - RNA, 64 nt, Human
gccaggagggaccugcaucuaagcaucuggguugccauggcaauggcaugccccccagcuacug

SEQ ID NO: 348811 - RNA, 64 nt, Human
agcggcgcccuggacggcugcuccugcgaacagcccauggcaucuucugcucuucccucccggc

SEQ ID NO: 348812 - RNA, 64 nt, Human
uuauucucugucaaaucuacuccccggaccucaaccauggcaagaaccagagguccaaagaggc

SEQ ID NO: 348813 - RNA, 64 nt, Human
ggaauuaugauuguagucuguugaauaguauuuaccauggcauuucauacccaugguauuuuau

SEQ ID NO: 348814 - RNA, 64 nt, Human
aaagacuacugggaggcugcugccuccuuccugcccauggcacccuccucugcugucugccugg

SEQ ID NO: 348815 - RNA, 64 nt, Human
ccucccugagccaguggcauccugccugggccccccauggcagugcugccucuuguaggugcug

SEQ ID NO: 348816 - RNA, 64 nt, Human
ccugucguuccuccggcaccaguguccuuggcugccauggcaagcucaucaggggcuuguaccc

SEQ ID NO: 348817 - RNA, 64 nt, Human
guuaugaagcugacaaugacugcauucaacggggccauggcaggaaagcugacccuacccagga

SEQ ID NO: 348818 - RNA, 64 nt, Human
ugaauaguugaacuguauccacccggcguaauacccauggcaacuggucuuccacauguaagca

SEQ ID NO: 348819 - RNA, 64 nt, Human
aucuuuggggagguguucacugaagacgccgucuccauggcaucuucgucuucacucuuaggca

SEQ ID NO: 348820 - RNA, 64 nt, Human
cuuugaaaagcuccugagugcaacuuaauuaccaccauggcagggugagggaacauuugcaucg

SEQ ID NO: 348821 - RNA, 64 nt, Human
agguagagagcaccacugaugaggcccuccuagcccauggcagacccagaccucuucuccccca

SEQ ID NO: 348822 - RNA, 64 nt, Human
aggcuaccugcccagggucacagcaaggcugggaccauggcaagcuuggaaccaggacuucuau

SEQ ID NO: 348823 - RNA, 64 nt, Human
uucagauguuucguugaaucuauuuagagcuucaccauggcaauauguauuucccuuaaaacac

SEQ ID NO: 348824 - RNA, 64 nt, Human
ugacaucugcagggaacccacuuugaggcugaggccauggcaggacagcugcuguggggugcag

SEQ ID NO: 348825 - RNA, 64 nt, Human
acaaaguuaaaauuguuaucaaaauagucuaaggccauggcaucccuuuuucauaaauuauuug

SEQ ID NO: 348826 - RNA, 64 nt, Human
gugguugcugagucucagccuugcuuuguuaaugccauggcaaguagaaagguauaucaucaac

SEQ ID NO: 348827 - RNA, 64 nt, Human
ucaauuacacaaaugcuguuaaaaugugaucaaaccauggcaucacuuugcugaaauguuucug

SEQ ID NO: 348828 - RNA, 64 nt, Human
aagaaggcaccuuggaaggcacugccuugggcuuccauggcaggaagaugagaagaaaucuuca

SEQ ID NO: 348829 - RNA, 64 nt, Human
uccacagagaggagcacuugucuccccagggcugccauggcagcuaucaggggaauagaaggga

SEQ ID NO: 348830 - RNA, 64 nt, Human
ccaaguucaugguuacuggacuucuuauuccaagccauggcaccaaaggagaaggggcauuuug

SEQ ID NO: 348831 - RNA, 64 nt, Human
uuacucccuugugauugaauuuuuucuccugcauccauggcaggauccccagccaguauagaga

SEQ ID NO: 348832 - RNA, 64 nt, Human
gauggagucuugcucugucacccagguuggagugccauggcaugaucuuggcucacugcaaccu

SEQ ID NO: 348833 - RNA, 64 nt, Human
cccauuaaagugacaaaaggguggggugugggcaccauggcaugaggaagaaacaaggucccug

SEQ ID NO: 348834 - RNA, 64 nt, Human
ugcugcuggggacccuccaacaccugugcaggccccauggcaccaucuaucuggccuccaagau

SEQ ID NO: 348835 - RNA, 64 nt, Human
uuugucaaggucgaccuaaaaaugguugcauuguccauggcaaaacaggacaucuuauggccug

SEQ ID NO: 348836 - RNA, 64 nt, Human
ggcucauccacaucauggagacuugcuggaugccccauggcaauugucaaggcucuugaugcaa

SEQ ID NO: 348837 - RNA, 64 nt, Human
acccugcugcuuugggaggauuucucaggcuaugccauggcagcugcagaggcccagggagagg

SEQ ID NO: 348838 - RNA, 64 nt, Human
caguuuuauucccaguuguggcugaaaagcaaagccauggcaucaguauccuugugcaaucgga

SEQ ID NO: 348839 - RNA, 64 nt, Human
uauucuuugaucuguugaacugucuuccaaccugccauggcaguuuugacacuacuccuguuug

SEQ ID NO: 348840 - RNA, 64 nt, Human
ugggcuccaucugcuggacaaaaggggaacugcaccauggcacuuggcccaugggaaagagggu

SEQ ID NO: 348841 - RNA, 64 nt, Human
aauccuccuaccucagccuccuggguagcuagcaccauggcaugcgccaccaugcccuauuuuu

SEQ ID NO: 348842 - RNA, 64 nt, Human
uuuggccuugaaaguagcaagugaccagaaucugccauggcaacaggcuuuaaaaaagacccuu

SEQ ID NO: 348843 - RNA, 64 nt, Human
gggaccccauaugucugcguaggagcagaacuuuccauggcaguaaguguccagcucuguuucu

SEQ ID NO: 348844 - RNA, 64 nt, Human
ggggcuagauguggcuccuagugcaaaccggaaaccauggcaccuuccagagccguggucucaa

SEQ ID NO: 348845 - RNA, 64 nt, Human
ggcccccacuguccccgcagauccagcaggccauccauggcaaccugcagaagcacacgguacu

SEQ ID NO: 348846 - RNA, 64 nt, Human
cagccuccugaguagcugggauuacagacacccgccauggcacccagcuaauuuuguauuuuua

SEQ ID NO: 348847 - RNA, 64 nt, Human
cauaaagugguauuaaaacuggaucucuuuucuuccauggcacuacucucauuuugaaguuuau

SEQ ID NO: 348848 - RNA, 64 nt, Human
ggaaaacaaacuuaguaucagggguccaugaagcccauggcaucauuuuugaaaauauuucuag

SEQ ID NO: 348849 - RNA, 64 nt, Human
ucaaauuugaaugucauaguacauugugugcuaaccauggcaagcaaacauuuacauuuguuuu

SEQ ID NO: 348850 - RNA, 64 nt, Human
gaagaaaaagaaacucagggaucacugggagaagccauggcauuaucuucaggcaauuuagucu

SEQ ID NO: 348851 - RNA, 64 nt, Human
cccaggcccaggcgaaagggcagcagcauguggcccauggcaccacccccacggcccagcacaa

SEQ ID NO: 348852 - RNA, 64 nt, Human
uuucagauaucaacuauuuagaguccagagggagccauggcacuagaaauaguugauaaugaaa

SEQ ID NO: 348853 - RNA, 64 nt, Human
ugauuuuuaucccacgugggccuuuugcucaguuccauggcaauuuuguaaauugacccuagcc

SEQ ID NO: 348854 - RNA, 64 nt, Human
aaugcagaagaguauuaagaaagaugcucaagucccauggcacagagcaaggcgggcagggaac

SEQ ID NO: 348855 - RNA, 64 nt, Human
ucugggcacagccuggccccugugcaccgaguggccauggcauguguggcccugucugcuuauc

SEQ ID NO: 348856 - RNA, 64 nt, Human
ggugaaucuagugaucucgggucccuagauuuaaccauggcacugaggugccgugugacggugg

SEQ ID NO: 348857 - RNA, 64 nt, Human
ucugucucugucuugacuccuccugagcauaaaaccauggcagccuugucuccacccaugacuc

SEQ ID NO: 348858 - RNA, 64 nt, Human
ccuuucucucugucacugcuucagcagugaagacccauggcaccuagaaaugcaugccagcuuc

SEQ ID NO: 348859 - RNA, 64 nt, Human
cuggcaaaugccuugcaggagguagaggcuggacccauggcaagccauuuacagaaacccacuc

SEQ ID NO: 348860 - RNA, 64 nt, Human
caugugacacauucccauugguaacaauugcucaccauggcauugucucaaaaaagacuauggu

SEQ ID NO: 348861 - RNA, 64 nt, Human
agucugaggugaugcuggcuacagcccuggcagcccauggcaacucaaagugccuuccaaacca

SEQ ID NO: 348862 - RNA, 64 nt, Human
aacagaagccaagggagaaugcugcugguuuggcccauggcacagccagcuucucugaccagua

SEQ ID NO: 348863 - RNA, 64 nt, Human
uccagccaagguucccuccacauaugaagauggaccauggcaggauacaacugauuguguggca

SEQ ID NO: 348864 - RNA, 64 nt, Human
cgccuuuccucagagugcuucccaaacugaggucccauggcacacuguccugggaggcguucag

SEQ ID NO: 348865 - RNA, 64 nt, Human
cugcaaacuccuuguaggucugcagaugugugucccauggcagacaaagcacccuguaggcaca

SEQ ID NO: 348866 - RNA, 64 nt, Human
auggcacauaccaaagcugcugcacagcuggccaccauggcacccugcaccaggccaucagcac

SEQ ID NO: 348867 - RNA, 64 nt, Human
agaagauaaagaccacuccucaccccagcucaagccauggcaggcguggcaagcaaagugggga

SEQ ID NO: 348868 - RNA, 64 nt, Human
aauagugucauccucacagugaacacucaguggcccauggcauuuuauaggcauaccuccuaug

SEQ ID NO: 348869 - RNA, 64 nt, Human
ccucagagcccacccugagaggcagcagugacccccauggcacacaccugccaacagcacuggg

SEQ ID NO: 348870 - RNA, 62 nt, Human
auguuaacccuaaauuaauaaaagaguuaacaucccauggcacaggagccuguauuucuuuc

SEQ ID NO: 348871 - RNA, 64 nt, Human
ugaccugggcugcccucucagaaacuccagacucccauggcaaugacagccgggacacuuuucu

SEQ ID NO: 348872 - RNA, 64 nt, Human
auuugugguaaugaaagagcgaaugacugaacagccauggcaaggcagaccuacaggcgaggcc

SEQ ID NO: 348873 - RNA, 64 nt, Human
uccagugcuguuagcuuaggcaaacagguggaucccauggcauccccauggaggaaccaggccc

SEQ ID NO: 348874 - RNA, 64 nt, Human
aacaacaucaaggcaaauccaauaaucaguauuaccauggcaaaaagaggaaacacaagaggga

SEQ ID NO: 348875 - RNA, 64 nt, Human
ccucuccaggccugucaagagggaggaaggggccccauggcagcuccugaccuuggguccugaa

SEQ ID NO: 348876 - RNA, 64 nt, Human
gaggagggacuccaucuugagccaugucccccagccauggcauggcugcacuguaaacgccaau

SEQ ID NO: 348877 - RNA, 57 nt, Human
gggccauccagauucagugagcggugcccauggcaccaggagccccucgccggcucc

SEQ ID NO: 348878 - RNA, 64 nt, Human
augggcagggagcuggggggacaucucaccucccccauggcacagagcccuccacaccccugga

SEQ ID NO: 348879 - RNA, 64 nt, Human
gaaccaaagcuaaacccgguguugccaccaugcaccauggcaugccagaguucaacacuguugc

SEQ ID NO: 348880 - RNA, 64 nt, Human
ucagaggauccagggaggcccagguacacacaggccauggcagacaccccaugucuuuguuacc

SEQ ID NO: 348881 - RNA, 64 nt, Human
uguuuuugaguaugagugcagucguguccauccuccauggcacagcccuccugcugccaggacc

SEQ ID NO: 348882 - RNA, 64 nt, Human
uuguauauguugaaauuuguagggguucaggaacccauggcagaaacacuaaacuauuuauuua

SEQ ID NO: 348883 - RNA, 64 nt, Human
gugcacaagccgcccaugcaaagaguagggucagccauggcaaggccggaaguugaacuuucag

SEQ ID NO: 348884 - RNA, 64 nt, Human
caaugcggcccacuuuccugagcugucgcugccuccauggcagcagccagggacccccagaaca

SEQ ID NO: 348885 - RNA, 64 nt, Human
acccuagguugauguaugggagcuaggacaguccccauggcaauggggcuggagcaucccucau

SEQ ID NO: 348886 - RNA, 64 nt, Human
ucagccuuaagcagccaccugagccaccaccgagccauggcaggaucgggagaccccaacuccc

SEQ ID NO: 348887 - RNA, 64 nt, Human
gcuacccacugcuuacucagggaccaggcagcccccauggcaguaaaagcagccuagacagaac

SEQ ID NO: 348888 - RNA, 64 nt, Human
auguuuuggagguccccccagagagcagagugggccauggcagaaguaggggguugguuggacc

SEQ ID NO: 348889 - RNA, 64 nt, Human
cuucugggcaagggcuccuaucuuuccucccuauccauggcacuaaaccacuucucugcugccu

SEQ ID NO: 348890 - RNA, 64 nt, Human
cuccacccugauggggugucccagagacauuuucccauggcaguccuccucucugagaccaggg

SEQ ID NO: 348891 - RNA, 64 nt, Human
gccaauguguggcucagugccuggacaaaugaugccauggcagacaguagacagaacaacacuu

SEQ ID NO: 348892 - RNA, 64 nt, Human
ccaacaggguucuuggugaugcuggcagccauggccauggcagcggguggcauccaggcugccc

SEQ ID NO: 348893 - RNA, 64 nt, Human
guaaccuugcagacccucaaccagacuugcauggccauggcagggccucgggaagaccuucagg

SEQ ID NO: 348894 - RNA, 64 nt, Human
ugauucugucuuuuccucagaaucuggccuuuuuccauggcaaugagguggggcccagccuccu

SEQ ID NO: 348895 - RNA, 64 nt, Human
gggguucucacucugaacuuucccucucuacuacccauggcaggaaccuaguacaggucuccca

SEQ ID NO: 348896 - RNA, 64 nt, Human
gcaaaugaacuuuuaauacuugaaaaucacauggccauggcaguauauguauuugguucuaucu

SEQ ID NO: 348897 - RNA, 64 nt, Human
uagcaucugcuuggccaauuaguucagccucagaccauggcacuuugagggggucucuaccucc

SEQ ID NO: 348898 - RNA, 64 nt, Human
cuggcaggcauacagcacccucuacccuccguggccauggcaacguccagggcccagaacccug

SEQ ID NO: 348899 - RNA, 64 nt, Human
ucaacaacaauaucacagaaucagaccaugugucccauggcaaugugaauccaauagucaauua

SEQ ID NO: 348900 - RNA, 64 nt, Human
auuggcccuuucuucaugaaaagugucugcaaaaccauggcagaggaauacaucucucacacau

SEQ ID NO: 348901 - RNA, 64 nt, Human
auguagaugauggguugaugggugcagcaaaguaccauggcacauguauaccuguguaacaaac

SEQ ID NO: 348902 - RNA, 64 nt, Human
agugacaugggccucuggagaaugcaagucuuugccauggcacggcuccguuucuuaaaguuaa

SEQ ID NO: 348903 - RNA, 64 nt, Human
guuucucucuguccuugacucuugggucugugggccauggcaugaguguuuucuaguaguagau

SEQ ID NO: 348904 - RNA, 55 nt, Human
acuuccuucacuucagcugacggacccauggcagcugcucccaggugggucuuuu

SEQ ID NO: 348905 - RNA, 64 nt, Human
acaagggcccuccuugucauugaccuuagcuaaaccauggcaauucauaaauagaggaaacauu

SEQ ID NO: 348906 - RNA, 61 nt, Human
gcagauuuucuucuccuuaagaugaucguugccauggcauugcugcuuuuagcaaaaaaca

SEQ ID NO: 348907 - RNA, 64 nt, Human
accugauuuuaaucaucagauucgaaauucugugccauggcauauauguucaaauucaaaccau

SEQ ID NO: 348908 - RNA, 64 nt, Human
ggguggagugacaaaccgcauuguccugugcccgccauggcagaagcgcagccuuuguauggag

SEQ ID NO: 348909 - RNA, 64 nt, Human
uggggagcuccgucucaccggccacccgccgucaccauggcagaugcccuuggccggaacuaau

SEQ ID NO: 348910 - RNA, 64 nt, Human
ggccgcucaggcgacccucagcccggcggggaggccauggcaugccccgggcguucgcuugcug

SEQ ID NO: 348911 - RNA, 64 nt, Human
gcgagcccagcuguaggguggggggcaggcucccccauggcaggguccuugggguaccccuuuu

SEQ ID NO: 348912 - RNA, 64 nt, Human
cugaaugccuuaacauuucuuccauggccccacaccauggcauccgggggucuucgggaacccg

SEQ ID NO: 348913 - RNA, 64 nt, Human
ccagcagcacccccuggccccuggagugguggggccauggcaagagacaccguggcgucucaug

SEQ ID NO: 348914 - RNA, 64 nt, Human
ccuggaaugugaagugacuccccaaccccuuuggccauggcaggcaccuuuuggacugggcugc

SEQ ID NO: 348915 - RNA, 64 nt, Human
ugagagaccugcuacaagccagcuuccuuccccuccauggcaccaguugucugaggucacauug

SEQ ID NO: 348916 - RNA, 64 nt, Human
cuuuuccacccccugccauccucacuuagaggggccauggcacuagauggcacuagucccccga

SEQ ID NO: 348917 - RNA, 64 nt, Human
uuuggggccaaaaugaauaagcuggacuuucuccccauggcacuggggaaccauggaaguucag

SEQ ID NO: 348918 - RNA, 64 nt, Human
gggccugggcuuucuuccaagggcacugggggagccauggcaagguuguagguaggguagagau

SEQ ID NO: 348919 - RNA, 64 nt, Human
ugucagccacugccagggaccaaggauccagcauccauggcaccccugguuccugccauccugg

SEQ ID NO: 348920 - RNA, 64 nt, Human
aauggaguccucuagccuaaagauaucagcuguuccauggcagagccuugacuggauggaggug

SEQ ID NO: 348921 - RNA, 64 nt, Human
gaagcacagcuucuuucagacuucccugacaagcccauggcaauuugucauccccuccuuauuu

SEQ ID NO: 348922 - RNA, 64 nt, Human
aucuguugcccagguccugcaaaggagccaggugccauggcauauaagucaguguagacuggug

SEQ ID NO: 348923 - RNA, 64 nt, Human
ggcauggagggcccaggcaacggagacguuuucuccauggcaggacagagcgggaggccgggcc

SEQ ID NO: 348924 - RNA, 64 nt, Human
gcaaaagggaauagugccguggagguguguguguccauggcauccggagcgaggcgacuguccu

SEQ ID NO: 348925 - RNA, 64 nt, Human
uggcucaugccuguaaucccagcacuuugggaggccauggcagguggaucaccugaggucggga

SEQ ID NO: 348926 - RNA, 64 nt, Human
ccuagggccauguugggucaaguuagauggucccccauggcauuguugagaucgaaugugugug

SEQ ID NO: 348927 - RNA, 58 nt, Human
cagggaugguuccaaagugaagaggucuccauggcaacaggacaccagcaagugugug

SEQ ID NO: 348928 - RNA, 64 nt, Human
acacuccugacagcaccaugacaguuuacaaaugccauggcaacaucaggaaguuacccgauau

SEQ ID NO: 348929 - RNA, 64 nt, Human
gcaugcguggcucccuggguauuucugucaguccccauggcaagcagugauuuaguaaaacacc

SEQ ID NO: 348930 - RNA, 64 nt, Human
guuauuuccugcuuucuaauuaaaaaaauaauaaccauggcaagagagaaagaaagagaaagua

SEQ ID NO: 348931 - RNA, 64 nt, Human
gagcaggcgagcugacauucugcagccuggacggccauggcaggaagcuuuuaguuggagagau

SEQ ID NO: 348932 - RNA, 64 nt, Human
cugcugagucucccaggacccccuuuggagaugcccauggcaugggcacugcccacaggcucag

SEQ ID NO: 348933 - RNA, 64 nt, Human
gcaucaaagccuuuccuugggaaucugccucccuccauggcagggguggauucgggagcuggga

SEQ ID NO: 348934 - RNA, 64 nt, Human
uguaccuuaccuguucaacagaccugaaaaugagccauggcauugggacagggucacuucugac

SEQ ID NO: 348935 - RNA, 64 nt, Human
cuauuuaaagacgcaaucccagguuccuugcacaccauggcagccucuccuugcaccuucuccu

SEQ ID NO: 348936 - RNA, 64 nt, Human
uagaaaaggcagacacugguugggaccaaagucuccauggcacaugacugaagacugguggucg

SEQ ID NO: 348937 - RNA, 64 nt, Human
uugaaaugggaucucugucgcccagguuggagugccauggcaccaucucggcucacugcaaccu

SEQ ID NO: 348938 - RNA, 64 nt, Human
ugagaaccugaggggcaucugcccaggacaggagccauggcauaugacaaagaccaaugaggga

SEQ ID NO: 348939 - RNA, 64 nt, Human
accacguggagaaaguagaugucuuauccuggguccauggcagccgaaggaccaacaacuucau

SEQ ID NO: 348940 - RNA, 64 nt, Human
gugaucucauuucuuuuuauggcugcauaguauuccauggcauauauguaccacauuuucuuua

SEQ ID NO: 348941 - RNA, 64 nt, Human
uggcugcagccguggcccguggugcagccguggcccauggcagccuguagaauccaggugcaca

SEQ ID NO: 348942 - RNA, 64 nt, Human
uaguuguggccuuuugagaguugagcuuuaacagccauggcaauuacacacacacacaaacaua

SEQ ID NO: 348943 - RNA, 64 nt, Human
guaauacauccuguacauaagaaauuaguucuuuccauggcaaagcuauuaccuuguacgaugc

SEQ ID NO: 348944 - RNA, 64 nt, Human
ucccagccccuggccuuccugcugcccuccggggccauggcacugcuguucagcucaggcacag

SEQ ID NO: 348945 - RNA, 64 nt, Human
uccacguuccagccgagucacugccugaccggcuccauggcagcuccccaucuucccuagaggc

SEQ ID NO: 348946 - RNA, 64 nt, Human
uuccuugcaaaugggaaaucacauagcaguuaccccauggcauugugacuaauggcaucagggc

SEQ ID NO: 348947 - RNA, 64 nt, Human
uauguuaaugugaaucugugggcaggauacuuuuccauggcaggaaauauccaagcuguugaaa

SEQ ID NO: 348948 - RNA, 64 nt, Human
ugugcugguaccaaacaaggcagacuugcaagaaccauggcaucuuuuuuuuuuuucaaaccuu

SEQ ID NO: 348949 - RNA, 64 nt, Human
ugcccugucuccaucccugucccucaggguagcaccauggcaggacugggggaacuggaguguc

SEQ ID NO: 348950 - RNA, 64 nt, Human
ucauguuugaaaccaugcuuggcuggaccgggacccauggcaagagcaccugggcaccaguguu

SEQ ID NO: 348951 - RNA, 64 nt, Human
uccccugcuuuuugagguuggguuaaaaugccgaccauggcagaggggucacagcucagguucc

SEQ ID NO: 348952 - RNA, 64 nt, Human
ucccgugggugggggcgggccuggcuucccaucuccauggcaacccaaccaaaccaacaacaca

SEQ ID NO: 348953 - RNA, 64 nt, Human
uuguugacacggccaugaccacuuuccccgugggccauggcaauuuuuacacaaaccugaaaag

SEQ ID NO: 348954 - RNA, 64 nt, Human
ucagucuggaggcagcagggaugcugcugggaguccauggcacaggccacagccccucaccuug

SEQ ID NO: 348955 - RNA, 64 nt, Human
gcugaccugguggccgugguggagaugaugcagcccauggcagccaacuauaaugucuuccuca

SEQ ID NO: 348956 - RNA, 64 nt, Human
ucccgacagugcccuuguugccuuugagccagauccauggcaauggucuccccacagaccgcag

SEQ ID NO: 348957 - RNA, 64 nt, Human
agucagggaccccaaacggagggacuggcugaagccauggcagaagaacguggauugugaagau

SEQ ID NO: 348958 - RNA, 64 nt, Human
gaggguauacucacccgaucauugauuugcauccccauggcauuugcuucauuuauuuauugcu

SEQ ID NO: 348959 - RNA, 64 nt, Human
uuucuuuuucuucuucccucccuaucuaacccucccauggcaccuucagacuuugcuucccauu

SEQ ID NO: 348960 - RNA, 64 nt, Human
aagaaauauaaacacaaauauagagauuuuuuaaccauggcagggugcuaguggugggcagaau

SEQ ID NO: 348961 - RNA, 64 nt, Human
agucucuaaugugacuguugagggccuggggaaaccauggcaaaguggauccaguuagagccca

SEQ ID NO: 348962 - RNA, 64 nt, Human
ucaucccaaguuggaaucgcuuuucucucugcaaccauggcacugugauuaugcaucauuuuua

SEQ ID NO: 348963 - RNA, 64 nt, Human
acugggaggagaaauugggguguguuacuguuuaccauggcaguaauggggcaaacaauaaaau

SEQ ID NO: 348964 - RNA, 64 nt, Human
ucccuccuccucuucucccaugccuucuucccugccauggcaaaucugaguggcuucucuaagc

SEQ ID NO: 348965 - RNA, 64 nt, Human
agugcugcacacuuuacagcagcuuccuuucuuuccauggcacugccuaguuaacagaagucuu

SEQ ID NO: 348966 - RNA, 64 nt, Human
gccccaaggcuacccaguauuuuaucguccagacccauggcagggccagcgggcaggacaggga

SEQ ID NO: 348967 - RNA, 64 nt, Human
gugaaggauuuucgucuuuauaauuucuguuuggccauggcaaauaccauaguugaguauuugc

SEQ ID NO: 348968 - RNA, 64 nt, Human
uaaaaaaaacuguucccauaggugcagcaaaccaccauggcacauguauaccuauguaacaaac

SEQ ID NO: 348969 - RNA, 64 nt, Human
uaccuaggugauggguugaggugcagcaaaaccaccauggcacacguucaccuauguaacaaac

SEQ ID NO: 348970 - RNA, 64 nt, Human
auaguuuuuacguacuggaggaaaguguguaaaaccauggcaaugucaccuuuuacacaaaugc

SEQ ID NO: 348971 - RNA, 64 nt, Human
cugcuauaaaaauuugaaauauuagaauggccgaccauggcagugaccaggccucacuacaggc

SEQ ID NO: 348972 - RNA, 64 nt, Human
ucuccgcguccuuuuaccccauggagagccucagccauggcaaguccaucuggaguccaggaag

SEQ ID NO: 348973 - RNA, 64 nt, Human
cagagacaauguuuucuuuuucaggugaguaguugccgcguaauaucauuggaguacauucuuu

SEQ ID NO: 348974 - RNA, 64 nt, Human
ugcaggggagaacccuacauggaaucauauucuagccgcguauucauuaguuuuuagcugggug

SEQ ID NO: 348975 - RNA, 62 nt, Human
uuuccuugcaauaucguuaauggcccuuuucagggccgcguacguuuucuuccgaagggcuc

SEQ ID NO: 348976 - RNA, 64 nt, Human
gagcacgcgcaccucauuguggugcuggacaagggccgcguagugcagcagggcacccaccagc

SEQ ID NO: 348977 - RNA, 64 nt, Human
cucuagggcuuucgguuuccccuucuuccgguaggccgcguagaggcaugcaccggguagguuu

SEQ ID NO: 348978 - RNA, 64 nt, Human
ccggcccgaggccugcccuggcacacgcguuuccgccgcguauggauauacacauguuuucggc

SEQ ID NO: 348979 - RNA, 64 nt, Human
gggccagccggacacaagcggcccugacacgugauggaccaaagccaccugcugcgggggagcc

SEQ ID NO: 348980 - RNA, 64 nt, Human
caccccaucuugucacaucuggcccugaccccacuggaccaaaaggggcagcacuggugcccac

SEQ ID NO: 348981 - RNA, 64 nt, Human
uuuucacuguugacaagcgaggcaaggguugcacuggaccaaaggcugaggcuuggccaucuag

SEQ ID NO: 348982 - RNA, 64 nt, Human
aagacugccaggugguuggguucugccuuuagccuggaccaaagggaagugaggcccaaggagc

SEQ ID NO: 348983 - RNA, 64 nt, Human
gcaaguuuuaaauuuccaaccuuaagugaauuuguggaccaaauuucaaaggaacuuuuugugu

SEQ ID NO: 348984 - RNA, 64 nt, Human
aaauuuauacauagaaacaaauuuugccaauugcuggaccaauggcaaacauuagugccaaaug

SEQ ID NO: 348985 - RNA, 64 nt, Human
uccugugaagaucaaaucuuccugaguaauuaaauggaccaacaaugagccuuugcaaaauuuu

SEQ ID NO: 348986 - RNA, 64 nt, Human
gaaaaugcuguaaauauugcauauuuuauguauuuggaccaaaagguuacaaguaauuagacaa

SEQ ID NO: 348987 - RNA, 64 nt, Human
auguagugaauggaaagaaauuaugcaccuuuuauggaccaaauuuuucugguacuguacgauc

SEQ ID NO: 348988 - RNA, 64 nt, Human
cguggugcgcccuaguacgacuccgcccaguguguggaccaaccaaauagcauucuuugcuguc

SEQ ID NO: 348989 - RNA, 64 nt, Human
cuccauccacacacagcagcuccaaccuggaggcuggaccaacugcuuuguuuuggcugcucuc

SEQ ID NO: 348990 - RNA, 64 nt, Human
ccucuaccccuuccccccacguagggcacuguaguggaccaagcacggggacagccaugggucc

SEQ ID NO: 348991 - RNA, 64 nt, Human
cugcacccuccauagccaccaaaccuguuagaacuggaccaaucaaaccucaggcgaucaaaac

SEQ ID NO: 348992 - RNA, 64 nt, Human
guuuucuuaucuuugaccuagaagagauucuuuuuggaccaaccugcgaaauugguaguuaggu

SEQ ID NO: 348993 - RNA, 64 nt, Human
gagugagcaccuaaaugaacgcaguaaaccuucauggaccaacagugauugaggauuugugggc

SEQ ID NO: 348994 - RNA, 64 nt, Human
aagcccaagcaagggagcccucagaggugguguuuggaccaaagcaucggggugggggaggggu

SEQ ID NO: 348995 - RNA, 64 nt, Human
uaaaggaacugaguacauuacccugaugucuaaauggaccaaagaucugagauccauugugauu

SEQ ID NO: 348996 - RNA, 64 nt, Human
agguuucucuugcagauaugagagauagcacagauggaccaaagguuaugcacaggugggaguc

SEQ ID NO: 348997 - RNA, 64 nt, Human
auaaaaccagaccuuguucuaaagcccaggguuauggaccaacucagugcuucaggucuuaacg

SEQ ID NO: 348998 - RNA, 64 nt, Human
uuguuggcaugggcagggguugagucagcagaaguggaccaaaggauuccucugaauaaaguua

SEQ ID NO: 348999 - RNA, 64 nt, Human
gauuuuuaucuuuuguuaaaauguguauaccccguggaccaacauaauauuaaaguauguauau

SEQ ID NO: 349000 - RNA, 64 nt, Human
acaaguauccauugcuucauaaacuccauuuguuuggaccaaucccuuaaacaaaagcaaggca

SEQ ID NO: 349001 - RNA, 64 nt, Human
aggcagaagcagauacuagaaacaaacaaaacuuuggaccaaaaucccaguucaaagaaacaaa

SEQ ID NO: 349002 - RNA, 64 nt, Human
auuaugcuaggggcuggggcucugguguagaccauggaccaaaagaacuucuuagagucugaag

SEQ ID NO: 349003 - RNA, 64 nt, Human
ccuguuacauuuucccaauaucuuuucuauuccuuggaccaaucagagaugcuguagcuccuug

SEQ ID NO: 349004 - RNA, 64 nt, Human
auugucccaucugugggccucauucugccaaagcuggaccaaggcuaaccuuucuaagcucccu

SEQ ID NO: 349005 - RNA, 64 nt, Human
ggaguaucacccuuccucccuccccaggcaccacuggaccaauuaccuuugaaugcuguauuug

SEQ ID NO: 349006 - RNA, 64 nt, Human
acuaauacauucccuuccccauagccaucaaaacuggaccaacuggccucuuccuuuccccugg

SEQ ID NO: 349007 - RNA, 64 nt, Human
agauuagcucuggaccagccuguuggacccgcucuggaccaacccuguuuccugaguuugggau

SEQ ID NO: 349008 - RNA, 64 nt, Human
caaacuugcagcaguuccuguuuuuugagccuucuggaccaacaaaauggcagcacauccugcu

SEQ ID NO: 349009 - RNA, 64 nt, Human
aacacucccaaacacagacauacuuuuguagaaguggaccaacuucaaagcucuggacaggaga

SEQ ID NO: 349010 - RNA, 64 nt, Human
cccccgccuuuaguucuccacuggggaggaauccuggaccaagcacaaaaacuuaacaaaagug

SEQ ID NO: 349011 - RNA, 64 nt, Human
agaguccaggagcuagggacacagagggagacuauggaccaaggugugugugucuggaggaacc

SEQ ID NO: 349012 - RNA, 64 nt, Human
acccaucacuuuggacagaauuaggaccugguucuggaccaaguggguaagguaaguuuuuaca

SEQ ID NO: 349013 - RNA, 64 nt, Human
uuuucauguaguuguuuaauuguucucuaauuaauggaccaaugaaaaaugaguucaugugugu

SEQ ID NO: 349014 - RNA, 64 nt, Human
aaugacuguggaguuccauucuuggcaucuacucuggaccaaggagcaucccuaauucuucaua

SEQ ID NO: 349015 - RNA, 64 nt, Human
uuauuacucuaaaaagagaauuacacaugccaaauggaccaauguccauuugcuuauuggaggc

SEQ ID NO: 349016 - RNA, 64 nt, Human
cuuuaauuuuacagauaccacuugcuguaggcuguggaccaagauguccagaauuauucuugag

SEQ ID NO: 349017 - RNA, 64 nt, Human
uuugacagaagugugauauauguaacuugugccauggaccaaauggucacuuuaccacagcuaa

SEQ ID NO: 349018 - RNA, 64 nt, Human
aacucugcuuucugcccaccuuggaugggaacuguggaccaagcaauuaccaucgccuuggaac

SEQ ID NO: 349019 - RNA, 64 nt, Human
uuucauucucucuggaaacagacucagguuucuuuggaccaaauccaaaagaacacauagcugu

SEQ ID NO: 349020 - RNA, 64 nt, Human
cguuucagcuuugggcugucaaaaggguaugucauggaccaaagcacuguuaguacggguaugu

SEQ ID NO: 349021 - RNA, 64 nt, Human
cuuaacuugaagcuacuuuuaaaauuugagggucuggaccaaaagaagaggaauaucagguuga

SEQ ID NO: 349022 - RNA, 64 nt, Human
guguugucucuuaagauuucuauaucauguggauuggaccaaaaacuucuaaucacuuauuuag

SEQ ID NO: 349023 - RNA, 64 nt, Human
auuuuguuacugucuguaguguuuuguggaguacuggaccaaaaaaauaaagcauuauaaauau

SEQ ID NO: 349024 - RNA, 64 nt, Human
caaaguuaucacugaagaacaguugacuuaaaauuggaccaagacuaugaggcuuaaaagggac

SEQ ID NO: 349025 - RNA, 64 nt, Human
gccugugcuccccaugggugaccucuggaggcaguggaccaagaugcagcaaggagaggaugca

SEQ ID NO: 349026 - RNA, 64 nt, Human
cuccuccauucccuauggguucugugaccacugcuggaccaaggacguggaugacccuccccua

SEQ ID NO: 349027 - RNA, 64 nt, Human
aauacaguauuauuuaguaaaauuaucuguucuauggaccaaauguaaaauauuuauaaaugaa

SEQ ID NO: 349028 - RNA, 64 nt, Human
uguugagggacuaggggagugguggggaggugaguggaccaaaggauauaggccccaggcaugc

SEQ ID NO: 349029 - RNA, 64 nt, Human
ccaguguaugaauaagggaaagauuaauuuuggcuggaccaauauaaaaaauuguauuugaaga

SEQ ID NO: 349030 - RNA, 64 nt, Human
gagggagcgaaaaaccauuacauuaagauaauauuggaccaaacuacuuacuugcucuaaacag

SEQ ID NO: 349031 - RNA, 64 nt, Human
ggggcuggaccugcugacauaguggauggacagauggaccaaaagaugggugguugaaugauuu

SEQ ID NO: 349032 - RNA, 64 nt, Human
cuuccauccaggagugugcuacugaggggcuggcuggaccaaccugcuggcucaggcaugugac

SEQ ID NO: 349033 - RNA, 64 nt, Human
agaagcacaaugaccaguacaugaaaucagcauuuggaccaaauuagcaagauuuacuguugac

SEQ ID NO: 349034 - RNA, 64 nt, Human
uagucacuuuaccucauccaaaguauaaaggaauuggaccaaauaauuuaccacauagcucuaa

SEQ ID NO: 349035 - RNA, 64 nt, Human
uaaaauguuuuaaagacaaauggcaaauaagauauggaccaaagucacuaauguuuuacaacag

SEQ ID NO: 349036 - RNA, 64 nt, Human
guaaagggccagauuguaaauauuucagacuguguggaccaaaaggccacauacagucucuguc

SEQ ID NO: 349037 - RNA, 64 nt, Human
ugacacucucuccaaaaauccauuccauugucuguggaccaagauguucuauguaauucagaag

SEQ ID NO: 349038 - RNA, 64 nt, Human
ugcuugaccucaacacacuggauuccagguggacuggaccaagagcaggcaaagacacgggaac

SEQ ID NO: 349039 - RNA, 64 nt, Human
cuggcagcagggacaccugggccaaugggccaucuggaccaaaggugggguguggggcccugga

SEQ ID NO: 349040 - RNA, 64 nt, Human
auggacgucgaggaccgggcacucccgggauggguggaccaaacccuuagcagcccagcauuuc

SEQ ID NO: 349041 - RNA, 64 nt, Human
acuguugacaguuuccgcagaaauccuauuucaguggaccaacauuguggcauggcagcaaaug

SEQ ID NO: 349042 - RNA, 64 nt, Human
uaaacucagucaaauguacccagccuaccagagauggaccaacgauccuaugagagaagagagu

SEQ ID NO: 349043 - RNA, 64 nt, Human
caaacuagaagacacaaaucuaacauaguuuuuauggaccaaggaacuuguauauuguauaagc

SEQ ID NO: 349044 - RNA, 64 nt, Human
caguagucauagucuucacagguuuaggagcuacuggaccaacauucuuguuuuugcuuuuguu

SEQ ID NO: 349045 - RNA, 64 nt, Human
cuuccuuucccacuggcucuguauaaaaaacuucuggaccaaaagccaucauuggaagauuuaa

SEQ ID NO: 349046 - RNA, 64 nt, Human
guugacuuaauuccaaaugggaucuccauaccuguggaccaaaccaacaaguaaguuuugacag

SEQ ID NO: 349047 - RNA, 64 nt, Human
ccugaaacaguguagggaaagaccugggaaacacuggaccaaaaaagccugaucucauggagac

SEQ ID NO: 349048 - RNA, 64 nt, Human
ggauaaaaaguuaugaacuauuaaaaaugugauguggaccaaaggcuagguuguaaucuugaua

SEQ ID NO: 349049 - RNA, 64 nt, Human
caaaggaauuuuaacaaagagcaaucaguauuauuggaccaaauuugguguuuguuuucaccuu

SEQ ID NO: 349050 - RNA, 64 nt, Human
gugucuuuuggccaaauugaaccuacuuguaauguggaccaacuuacuuuacacauuuucauca

SEQ ID NO: 349051 - RNA, 64 nt, Human
aaaacaugagugcuuugcccaucagugaauggaauggaccaaugaggugguaucaaugaauaua

SEQ ID NO: 349052 - RNA, 64 nt, Human
cccacugccacacccuccccauucagacacuucauggaccaagaaugagcugguuugucaaaca

SEQ ID NO: 349053 - RNA, 64 nt, Human
uuugggagcagggagggggaaguccuagcccagauggaccaaggacgggccugaaggcacaugg

SEQ ID NO: 349054 - RNA, 64 nt, Human
gggucagugagcacaauuccagccaggggccacuuggaccaagcuccagucaguugaugggcag

SEQ ID NO: 349055 - RNA, 64 nt, Human
gaaggaaggacagaacuugacuggcuccauuucauggaccaacugaucaauugccaguacuaag

SEQ ID NO: 349056 - RNA, 64 nt, Human
uuuauucucagauucaaagaaagagcaacuacuuuggaccaaaagcccauggccuggggagcug

SEQ ID NO: 349057 - RNA, 64 nt, Human
agcuuuuuuccucuuuuggcucaguauuuaaaaguggaccaacuugcucuuaaucacagggcca

SEQ ID NO: 349058 - RNA, 64 nt, Human
aaaauaguuaacauucaaaaaacuuguuuucacauggaccaaaagaugugccauauaaaaauac

SEQ ID NO: 349059 - RNA, 64 nt, Human
aguagcaggggccugguccccacagcccacaggauggaccaaagggggcagguggguaaggccc

SEQ ID NO: 349060 - RNA, 64 nt, Human
gaaagaaaauaucucugaccaacuucuguauucguggaccaaacugaagcuauauuuuucacag

SEQ ID NO: 349061 - RNA, 64 nt, Human
gaccccguuccccuuccucuaugaaggaauaaguuggaccaagggaagucggggacguaaaaaa

SEQ ID NO: 349062 - RNA, 64 nt, Human
augggaaggggauagccagaaucucugaggaaaauggaccaaaaaaaaaaaggccugaacccca

SEQ ID NO: 349063 - RNA, 64 nt, Human
cuguggacaauaacugaugaauauagggcccagauggaccaaguggggccggggagggaugaau

SEQ ID NO: 349064 - RNA, 64 nt, Human
gucucccgcaaugggcagagagagcagagacagguggaccaacagacagcuggccccuggaggc

SEQ ID NO: 349065 - RNA, 64 nt, Human
aauauauauaucauugagggugacuaaucuucaguggaccaaaucucuacccuuccccaacccu

SEQ ID NO: 349066 - RNA, 64 nt, Human
cugcauuuuuuaaaucaaaugaaaaacgucaaauuggaccaauugucuugguuucuugauucau

SEQ ID NO: 349067 - RNA, 64 nt, Human
uaaaccugcugcacauuggacucaaaaggaaaacuggaccaacaauaauugaggaaauagacuc

SEQ ID NO: 349068 - RNA, 64 nt, Human
auuaauaaagggcauuugggcagacacacuguguuggaccaacaaaguaggcucuuuacagggg

SEQ ID NO: 349069 - RNA, 64 nt, Human
acuguuaauggcuccucugugacaaaacacaaguuggaccaaggagaaagcccuuuggagaaac

SEQ ID NO: 349070 - RNA, 64 nt, Human
uugaauuuauuggcuuuucugauccaguuuuguuuggaccaaaaaccaguauuguacaaaguau

SEQ ID NO: 349071 - RNA, 64 nt, Human
uguaucaccgguugaauggacaacuaacccgagcuggaccaacacaauucucuccagagacuuu

SEQ ID NO: 349072 - RNA, 64 nt, Human
aggcaggauuggggucacagccgcuucuucagcauggaccaagugggccuuggggauugcagcg

SEQ ID NO: 349073 - RNA, 64 nt, Human
cagacacagcaggaggagagggagguggcgcugguggaccaaggaucugugcuacccgcucccc

SEQ ID NO: 349074 - RNA, 64 nt, Human
ucucaacuacucauuugccaagucaguuauguuauggaccaaaagccaaaucuccaucugaccc

SEQ ID NO: 349075 - RNA, 64 nt, Human
guggauagugccagaacacuuaggagggugucuuuggaccaaugcauaguugcgacuccugugc

SEQ ID NO: 349076 - RNA, 64 nt, Human
cuacaaauauuucuauuuuuagaaaggguuuuuauggaccaaugccccaguugucagucagagc

SEQ ID NO: 349077 - RNA, 64 nt, Human
ugaacuaugcacauuugugcuuuuuuuguaaguuuggaccaacuuuuauguaacaaacagcccc

SEQ ID NO: 349078 - RNA, 64 nt, Human
ucggauuccagcccacauuggauucaucagcauuuggaccaauagcccacagcugagaaugugg

SEQ ID NO: 349079 - RNA, 64 nt, Human
uaaaaggugcaaaaagacaacuaaaauacccauuuggaccaaaagccaccagauugcuuagugc

SEQ ID NO: 349080 - RNA, 64 nt, Human
caggaaugagggcagcuaaacccauagaaggaguuggaccaaggcgaauuacgaguccuggucc

SEQ ID NO: 349081 - RNA, 64 nt, Human
gaauuucaucacccaaugcagggggagcucuuccuggaccaagggaggagccgcucauucaccc

SEQ ID NO: 349082 - RNA, 64 nt, Human
augguugacacuagcccaaugaaaugaauuaaaguggaccaauagggcugagcucucugugggc

SEQ ID NO: 349083 - RNA, 64 nt, Human
guuacuuauuguaaauacugcccuagugucuccauggaccaaauuuauauuuauaauuguagau

SEQ ID NO: 349084 - RNA, 64 nt, Human
accccagaaacgugcucuucaucugucagccuuuuggaccaagaagcugucacuaucacacaua

SEQ ID NO: 349085 - RNA, 64 nt, Human
ccauuuuuuuaaaaaaaugguuuugcauggaaccuggaccaaggcaaaugucuuuucuucgcag

SEQ ID NO: 349086 - RNA, 64 nt, Human
gccaucgguuuuuacuuagagcccuugacgugcuuggaccaauauuuccuuccuucuuaugaac

SEQ ID NO: 349087 - RNA, 64 nt, Human
uuuugagaauuuaaagcagauuaccuuuuaaaacuggaccaacuaaguaauugguauuuaauca

SEQ ID NO: 349088 - RNA, 64 nt, Human
cauaguaccauaccacuuauaaaguggaaacucuuggaccaagauuuggauuaauuuguuuuug

SEQ ID NO: 349089 - RNA, 64 nt, Human
aaaucaaggcauguacuugcuguucgaggcccuguggaccaacaucggcuucucagauggcuuc

SEQ ID NO: 349090 - RNA, 64 nt, Human
cacgccugcuggccgacccacugacccacucggauggaccaaccugcucuguccccaaaggacg

SEQ ID NO: 349091 - RNA, 64 nt, Human
cugcuuucuuauagcacaaaacuacuuacucugauggaccaauaaugaagaaagcacuaggagc

SEQ ID NO: 349092 - RNA, 64 nt, Human
aaauugggaucugucuuggcauuaaaccacaucauggaccaaaugugccauacuaaugaugagc

SEQ ID NO: 349093 - RNA, 64 nt, Human
uuugcugccagccacuucauccccucccagauguuggaccaacaccccucccugccaccaggca

SEQ ID NO: 349094 - RNA, 64 nt, Human
uaaagaugagccauuaaaauagaaugauccuuuauggaccaaaacuugaaucacugcaaaauga

SEQ ID NO: 349095 - RNA, 64 nt, Human
uacgugggugcccucuccaaaggcgggguggcgguggaccaaaggaaggaagcaagcaucuccg

SEQ ID NO: 349096 - RNA, 64 nt, Human
ucacagucauuggauuaauuauguugaguucuuuuggaccaaaccuuuuugucuuuagaguugu

SEQ ID NO: 349097 - RNA, 64 nt, Human
caucugaagaaggaggaaaaaacccaacauuucuuggaccaaaaguauagugacuaucuguuca

SEQ ID NO: 349098 - RNA, 64 nt, Human
cuggacagacggauagacauacggaagcgaggccuggaccaagagaggcccaggcuacuggagg

SEQ ID NO: 349099 - RNA, 64 nt, Human
acaaaauguggcuuuuagccugucagugaucuauuggaccaaaccuucugcacacucggccagu

SEQ ID NO: 349100 - RNA, 64 nt, Human
uuuuuuuuucuuauuuuaauuuuaaugaacaagguggaccaaagggcugaaccagccccucaac

SEQ ID NO: 349101 - RNA, 64 nt, Human
ggccucaguuuccccaucuguaaaaugaaggaguuggaccaaugcccccuccccuucagcugug

SEQ ID NO: 349102 - RNA, 64 nt, Human
augugccaggcccucuccugccacacagacccgcuggaccaaagcagcugcagccgccuccucg

SEQ ID NO: 349103 - RNA, 64 nt, Human
ccgcccaccccgcugccuggcgggcagccccugcuggaccaaggugcggaccggagcggcugag

SEQ ID NO: 349104 - RNA, 64 nt, Human
cacacaaaacaaauuaaaaacaaauuauuccagguggaccaagaauucacaguuuaauaaucua

SEQ ID NO: 349105 - RNA, 64 nt, Human
agaugggggugggcaccugaggcccaauaauauuuggaccaagugggaaacaagaacacucgga

SEQ ID NO: 349106 - RNA, 64 nt, Human
ucuuugauaggauuguuaccaaauggugucaguauggaccaauugugugaccaugagaaggaug

SEQ ID NO: 349107 - RNA, 64 nt, Human
ggauggcaaggcgugaagccacccuggaaggaacuggaccaaggucuucagaggugcgacaggg

SEQ ID NO: 349108 - RNA, 64 nt, Human
acucaguuuuuuuucuccuacaaggagauauggcuggaccaaaauaaaaugacaugaaacugca

SEQ ID NO: 349109 - RNA, 64 nt, Human
ucaagguugguuggcugauugguggaaaguaggguggaccaaaggaggccacgugagcagucag

SEQ ID NO: 349110 - RNA, 64 nt, Human
aacucuguccauaaauuugauaacuuagcuaaaauggaccaauuccuugcaagacgcauucucu

SEQ ID NO: 349111 - RNA, 64 nt, Human
accgaggguggucucuuggacaaccccaggaacuuggaccaaggcagagccaaucuugcaaacu

SEQ ID NO: 349112 - RNA, 64 nt, Human
cuggaguaggaggucugaagauuaguucaggggauggaccaagaauuucccccagagcuuuaaa

SEQ ID NO: 349113 - RNA, 64 nt, Human
ugcaucuuuuguaucucaggcguggcuucuucaguggaccaagcugcaaugcaguauugacuug

SEQ ID NO: 349114 - RNA, 64 nt, Human
uuucaaauguuuauacacaauguauuuuauuuuuuggaccaagcagugacucuuugauuuugca

SEQ ID NO: 349115 - RNA, 64 nt, Human
auccugcauguaauauaucugcugucaucuuaguuggaccaacuucccauuuauuuaucuuaaa

SEQ ID NO: 349116 - RNA, 64 nt, Human
aggaaucugacccuccccaaaagaagcagugaaauggaccaaaggacuuaagaauuugggggga

SEQ ID NO: 349117 - RNA, 64 nt, Human
uuaguuuccuguuacugaguuagcucuacucuuuuggaccaaagcaacaugagagcaaguacuu

SEQ ID NO: 349118 - RNA, 64 nt, Human
cccagcugguaggauccuugcuuuccccaucuguuggaccaaauaaucucaaaggcccagagag

SEQ ID NO: 349119 - RNA, 64 nt, Human
cgccgcgagaagcagaagcucguggagaagaucauggaccaauaccgcgugcuggagccugugc

SEQ ID NO: 349120 - RNA, 64 nt, Human
ucuuguaauuacaggagccauuucuguagguaacuggaccaagaaugagaaaaauaaugaauuc

SEQ ID NO: 349121 - RNA, 64 nt, Human
ucucauacacaacuguucccgauucacguuuuucuggaccaaggugaagcaaauuugugguugu

SEQ ID NO: 349122 - RNA, 64 nt, Human
cuggguuugaaccaaaugccguagugacuugcuguggaccaaguccuuccaucuaauagaagcu

SEQ ID NO: 349123 - RNA, 64 nt, Human
ggacuugaucauacaaguuagucucauaauguauuggaccaaaauguaaacuucauuggucaga

SEQ ID NO: 349124 - RNA, 64 nt, Human
gccccaccuugaaagcagcauacaggggaaggcuuggaccaagcugggcgaccaagcacauggg

SEQ ID NO: 349125 - RNA, 59 nt, Human
aacaugaugccaucauuuaaggaaauccauggaccaaggauggaauacagauugaugcu

SEQ ID NO: 349126 - RNA, 64 nt, Human
cuuuuggacucuuucacuucgggacauuuaauaauggaccaaauucaacagaacaccaggaagg

SEQ ID NO: 349127 - RNA, 64 nt, Human
uuucacugacaauuccaacauucuuuacuuacaguggaccaauggauaagucuaugcaucuaua

SEQ ID NO: 349128 - RNA, 64 nt, Human
gggucuauuugccuaauguugacaauuagauucuuggaccaagugaggguguacucugauccac

SEQ ID NO: 349129 - RNA, 64 nt, Human
gccaucaucauugggaaguucacaguccacuggcuggaccaauuuucaaacuuggauaaagaaa

SEQ ID NO: 349130 - RNA, 64 nt, Human
auaacuguuuuuauuaacugaauuguuuuuuucauggaccaaacuuuuuuuuguacuguccccu

SEQ ID NO: 349131 - RNA, 64 nt, Human
gugagacuauaggccauaaagaaugggacugcauuggaccaaaauaaaugggaaaaucgugguu

SEQ ID NO: 349132 - RNA, 64 nt, Human
cagccuucugagucugggucaggaagauguccuuuggaccaaagcagacuucuuuauacgcagc

SEQ ID NO: 349133 - RNA, 64 nt, Human
gucuccucuucgggaagccagcgugagcucagcuuggaccaagacaaaauaauuuaguucuucc

SEQ ID NO: 349134 - RNA, 64 nt, Human
cuuccuggaccaggccugaagaggguccuggggguggaccaaaguccaacuugguuucagugca

SEQ ID NO: 349135 - RNA, 64 nt, Human
aauuuaagguucuucuugcucaggauuacagauauggaccaacaccuccuucaagaaaaggugg

SEQ ID NO: 349136 - RNA, 64 nt, Human
caccaaaaucaguaguuaggcagcccagcugagguggaccaacuaauuggaaacacucuucccc

SEQ ID NO: 349137 - RNA, 64 nt, Human
ugggcccaagggcagaccuuucuuugggacuguguggaccaaggagcuuccaucuagugacaag

SEQ ID NO: 349138 - RNA, 64 nt, Human
aguuucuggagggccaggugggaaaugcuuucacuggaccaacacacaaaugaucauccugagg

SEQ ID NO: 349139 - RNA, 64 nt, Human
ucauuaaacaagccaguaggucaccuggcuuccguggaccaauucaucuuucagacaagcuuua

SEQ ID NO: 349140 - RNA, 64 nt, Human
ucauuaaacaagccaguaggucaccuggcuuccguggaccaauucaucuuucagacaaucuuua

SEQ ID NO: 349141 - RNA, 64 nt, Human
uuccuuccacugaaggucuucacgggccuccagguggaccaaagggaugcacaggcggcucgca

SEQ ID NO: 349142 - RNA, 64 nt, Human
uuggggucugggaacuuuuugaaaauuuaauuuguggaccaauguuuugugaaagcuaaagagg

SEQ ID NO: 349143 - RNA, 64 nt, Human
agcucugcccuuuuuaauuaaauauuuugguucauggaccaaaggguuuacuugacaaauuugu

SEQ ID NO: 349144 - RNA, 64 nt, Human
agcaacuguuuauucuguuuauugagcacuuacuuggaccaagcacuguggucuugguguuuua

SEQ ID NO: 349145 - RNA, 64 nt, Human
ugcucugucauccuaaugugcugcauccaccucauggaccaagauggcugccacagcuccugcc

SEQ ID NO: 349146 - RNA, 64 nt, Human
gacuaguuuuaguuuaaaaagaccuucuucagauuggaccaaauaauacuuauaagaucagcag

SEQ ID NO: 349147 - RNA, 64 nt, Human
ugguugguccaagacacagugaguaggagcucuguggaccaagacaaagcuggacuagagagua

SEQ ID NO: 349148 - RNA, 64 nt, Human
aucacuuuauaaaacauacauuaagccuaauaaauggaccaauaagccaaacuaucaguauuuu

SEQ ID NO: 349149 - RNA, 64 nt, Human
aaaaaaaaggagaguauagaaugauggagaaaaauggaccaaaggcuaaaaauauugcagggca

SEQ ID NO: 349150 - RNA, 64 nt, Human
aacauagaggaaagccucuuggaggaaaggugcuuggaccaagucucaggugugucugccugug

SEQ ID NO: 349151 - RNA, 64 nt, Human
cauuuguguuuauggguuuagggggccauuuguguggaccaaucuacucggggaauuccaggcc

SEQ ID NO: 349152 - RNA, 64 nt, Human
uaaaaaauauuuuuuguaguuugaauaugaaauuuggaccaaaugauaaacugcgcugagucua

SEQ ID NO: 349153 - RNA, 64 nt, Human
uauccaugauguugaacaugggaggcauuuuuaauggaccaaauuuuuagaaaaauuaguuuuu

SEQ ID NO: 349154 - RNA, 64 nt, Human
auuucucuccaccuggcucccaaauuuaaagauguggaccaaggccuguggguacuccaggggc

SEQ ID NO: 349155 - RNA, 64 nt, Human
auagcuaggagaugucaaaagcccauaugaggaguggaccaagcagcaguggcgguuucuccuc

SEQ ID NO: 349156 - RNA, 64 nt, Human
aaguaauauuuaaagauuauagcucccaaaagaauggaccaaccacuuucguaucauaauuucu

SEQ ID NO: 349157 - RNA, 64 nt, Human
ugccggaggcugccgcaacuucccagauacuuucuggaccaacccucaguaccgucugaagcuc

SEQ ID NO: 349158 - RNA, 64 nt, Human
auuagcagucuagacauuuuauaaacagaaaucuuggaccaauugauaauauuucugacuguau

SEQ ID NO: 349159 - RNA, 64 nt, Human
caguauguucggcccagcgcucuucgcacccuucuggaccaaagcgccaaggacugcagccagg

SEQ ID NO: 349160 - RNA, 64 nt, Human
cuauaggaagcacuuucugaauuauguaaugauuuggaccaaaaaguauuuugcugaaauacuc

SEQ ID NO: 349161 - RNA, 50 nt, Human
aggcaaaggccaucuccuaauggaccaaggaccccagagcccaccugugu

SEQ ID NO: 349162 - RNA, 64 nt, Human
uuuaaaggcaaucuuuuuaaagauuucacuaauuuggaccaagaaauuacuuuucuuguauuua

SEQ ID NO: 349163 - RNA, 64 nt, Human
uuguuuauuucuggaauuuuccacauaauauuuuuggaccaagguugccucagguaacaaacua

SEQ ID NO: 349164 - RNA, 64 nt, Human
cagugccuuucuguaccccaagccagcacaagauuggaccaauccuuuuugcaccaaagugccg

SEQ ID NO: 349165 - RNA, 64 nt, Human
gauucuccacaguggcuuccgacucaggcuccaauggaccaaauaaaagcguuuuguuuuguaa

SEQ ID NO: 349166 - RNA, 64 nt, Human
uccuguggagauuaaacuuuuuuuuuucaguuuauggaccaagaguuuugauuuauuuagggug

SEQ ID NO: 349167 - RNA, 64 nt, Human
uccauugagaauguaaauaaaugugucuucuuuauggaccaaggauaugaaaucauuuuucuuu

SEQ ID NO: 349168 - RNA, 64 nt, Human
auuuggggguuuucucccccaccucuccacuaguuggaccaagguuucuagcuaaguuacucua

SEQ ID NO: 349169 - RNA, 64 nt, Human
ccugucaaaacagaccacuugacucucuguaaaauggaccaaucagcaggauguggguggggcg

SEQ ID NO: 349170 - RNA, 64 nt, Human
auuaaaccuguacuguugguauuguguuaguguauggaccaauacugccuguaauaaagauuuu

SEQ ID NO: 349171 - RNA, 64 nt, Human
ugcaaaaugaaaaaaauuagaagcaaaugaguuuuggaccaauauuguugauaaaucuaaauug

SEQ ID NO: 349172 - RNA, 64 nt, Human
uacccccuccuccugccauacccgcacaugacaauggaccaaaugugccacacgcucgcucuuu

SEQ ID NO: 349173 - RNA, 64 nt, Human
gcccacagcugggcaacaagaaaaauguuugaauuggaccaacugcuggugauggggccagggc

SEQ ID NO: 349174 - RNA, 64 nt, Human
cucacaccagcugccuccuccacucagcauuccauggaccaaauugugcccuggguagccucag

SEQ ID NO: 349175 - RNA, 64 nt, Human
uucagcucuaacauggaggucagagaaagggacuuggaccaauaaaaugacauggaggccuaac

SEQ ID NO: 349176 - RNA, 64 nt, Human
cacaucuucuaugagccagaugcuuaugaugaccuggaccaagaagacccagaugacgaccugg

SEQ ID NO: 349177 - RNA, 64 nt, Human
aggcaucaaagcuagaaugugaauauaacuuuuguggaccaauacuaagaauaacaagaagccc

SEQ ID NO: 349178 - RNA, 64 nt, Human
cauucuucuugcuacaccccuuuuccaguugcuguggaccaaugcaucucuuuaaaggcaaaua

SEQ ID NO: 349179 - RNA, 64 nt, Human
cacaaggugggcagggaggcaccauucaggaaccuggaccaaagcugacgaggcugggccaagc

SEQ ID NO: 349180 - RNA, 64 nt, Human
cuucucuuucucucugguuguuucuguuucugaguggaccaacagcagaacccacgaggauuug

SEQ ID NO: 349181 - RNA, 64 nt, Human
auugacccugucuuccuucccuggcuuuuucaacuggaccaaagaugaaggcacuuauggaccc

SEQ ID NO: 349182 - RNA, 64 nt, Human
guauguaagugucuugaaguucaguauguuaugauggaccaauaauucugccacuucggguuuc

SEQ ID NO: 349183 - RNA, 64 nt, Human
gggacuggcugagauugcagcccaugguaggagcuggaccaacuguauauaguuuucaauaaac

SEQ ID NO: 349184 - RNA, 64 nt, Human
aaagugcuaggauuacaggugugagccacugcaguggaccaauuuuuguauuuuuuuaaaugcu

SEQ ID NO: 349185 - RNA, 64 nt, Human
cucuugcuacauugccuaaauccauuuguuucuuuggaccaaaaauguuaguuuaccagaccga

SEQ ID NO: 349186 - RNA, 64 nt, Human
auaggaaaaaccaaauauacauacuuauuuucuauggaccaaccagauuaauuuaaaugccaca

SEQ ID NO: 349187 - RNA, 64 nt, Human
agauaguauuugacuugauuggaaaauguuaggauggaccaaggugggccauaccaacucccuc

SEQ ID NO: 349188 - RNA, 64 nt, Human
ccagggacccaagcgcuuccagaugacaauugcauggaccaaggaugcccccugaaccucccuc

SEQ ID NO: 349189 - RNA, 64 nt, Human
ugauaccaaaauugggaaagaacauguguccauuuggaccaaacguuguugguuuuuaaaaaau

SEQ ID NO: 349190 - RNA, 64 nt, Human
uacaaagcacuagagaaugcacagauauacuuuguggaccaauuauugauauauauuauaaaua

SEQ ID NO: 349191 - RNA, 64 nt, Human
aauaccuguaaaacuguuuugucucauguuuuauuggaccaaaguugugguuuguauggagugu

SEQ ID NO: 349192 - RNA, 64 nt, Human
auaaguuaauauaacugauaccuugagagauggcuggaccaauucucuccaugacaaauguuua

SEQ ID NO: 349193 - RNA, 64 nt, Human
auuuuaaaggaagaaaaaagcagcuaaaaaagaguggaccaaaacacugcacacagugaagugu

SEQ ID NO: 349194 - RNA, 64 nt, Human
ucuuaucacuacuauugauucuaguuccaguugguggaccaacugggugaucccugccaucucu

SEQ ID NO: 349195 - RNA, 64 nt, Human
cucaaacuucaggguuuuuucuuccuucaaauuuuggaccaaagucucauuucuguguuuugcc

SEQ ID NO: 349196 - RNA, 64 nt, Human
gaccugcuccgugagauaaugugaaauacgacuguggaccaaacgcaauaaaaccucuguuugu

SEQ ID NO: 349197 - RNA, 64 nt, Human
cuaccucaaccgcgagaccuaugcaaggacgguguggaccaacucgcgcccgcggcauggugcc

SEQ ID NO: 349198 - RNA, 64 nt, Human
cgaggcugcaggauaugcucagacucuagaggcguggaccaaggggcauggagcuucacuccuu

SEQ ID NO: 349199 - RNA, 64 nt, Human
caccccccaccuccaugcauacaccagagcucuguggaccaaggggucauuccuggucacacac

SEQ ID NO: 349200 - RNA, 64 nt, Human
acggagacacgcaccuuggagaaaugaggggagauggaccaagaaagacguggaccuggaugau

SEQ ID NO: 349201 - RNA, 64 nt, Human
gauauauuucuggauuuucuauucuauuccauguuggaccaauaccacacugcccuagucacug

SEQ ID NO: 349202 - RNA, 64 nt, Human
ccagcuuucagccaccaugacuguggggaguggcuggaccaagggcugaccuccccgacugcau

SEQ ID NO: 349203 - RNA, 64 nt, Human
cuccaucucucagggagacaaagaaccuccuuccuggaccaaggaggugcugccaaguuuucua

SEQ ID NO: 349204 - RNA, 64 nt, Human
uaaggauuuggaauaaggauuugguccuguuuucuggaccaaauccuuacucuggcucugcuua

SEQ ID NO: 349205 - RNA, 64 nt, Human
uaagggaugucccgcacucccuuagccauugccuuggaccaaaccacgugguuugcagcuuuuc

SEQ ID NO: 349206 - RNA, 64 nt, Human
auguuuuguaaaacucaaauaacgacuauacuuauggaccaaauaaauggcaucugcauucuug

SEQ ID NO: 349207 - RNA, 64 nt, Human
aauaggcagcuuucuuaacuauccuaacaagccuuggaccaaauggaaauaaagcuuuuugaug

SEQ ID NO: 349208 - RNA, 64 nt, Human
agugcgcgcgcccgccucgcacagggccggggccuggaccaaaccacaugaacuggacugagag

SEQ ID NO: 349209 - RNA, 64 nt, Human
cgcuggugcuccgacaaaaaaaaugcugcuguaauggaccaagagccugcagggaacagaacag

SEQ ID NO: 349210 - RNA, 64 nt, Human
ugcuauggagcagagguuaucaaacuaaagcccauggaccaaauccuaucugcugcuuguuuuu

SEQ ID NO: 349211 - RNA, 64 nt, Human
cgccacccagcccuggggggaggcccacgccugcuggaccaacgcggguucuggggugcacagc

SEQ ID NO: 349212 - RNA, 64 nt, Human
aaacguguuucguaagcccaggcaccaaugggaauggaccaaagaguuucagggaaacuccagu

SEQ ID NO: 349213 - RNA, 64 nt, Human
gagccacagaugccaagcucugggagcuugacuauggaccaaacagcucuggccuagggauugg

SEQ ID NO: 349214 - RNA, 64 nt, Human
augguugucugguaucugaacugagccugcuggcuggaccaacuguccucgaaaagacacagcu

SEQ ID NO: 349215 - RNA, 64 nt, Human
cucuguaagauggaccaaucagcgcucuguaaaauggaccaaucagcaggacaugggcggggac

SEQ ID NO: 349216 - RNA, 64 nt, Human
gauuguaaaauggaccaaucagcacucuguaagauggaccaaucagcgcucuguaaaauggacc

SEQ ID NO: 349217 - RNA, 64 nt, Human
gagaacuuuucugucuuacaagaggauuguaaaauggaccaaucagcacucuguaagauggacc

SEQ ID NO: 349218 - RNA, 64 nt, Human
aauauuccugcuggaaagaaccugagaguugguuuggaccaauucccugguuuuccagcagaug

SEQ ID NO: 349219 - RNA, 64 nt, Human
aauaggcagcuuucuuaacuacccuaacaagccuuggaccaaauggaaauaaggcuuucugaug

SEQ ID NO: 349220 - RNA, 64 nt, Human
cauaaaccuaccauucgguaaccaugugaaaggauggaccaauaucaagguaauuuuuuuuuag

SEQ ID NO: 349221 - RNA, 64 nt, Human
cauagcccuguugcuuagcaaccacuugaaaagcuggaccaauagcaagguaaguuugcuuuuc

SEQ ID NO: 349222 - RNA, 64 nt, Human
cucugcuugagccucguggucucuugucucuuuuuggaccaauauccucagauuggugcagcuu

SEQ ID NO: 349223 - RNA, 64 nt, Human
uuucucuuggcugagugacagguggcuguucagguggaccaaagcaccuugacacaaggacucc

SEQ ID NO: 349224 - RNA, 64 nt, Human
ugucuccucccaccaguccaguuagcuucccuucuggaccaauagacgaggggagaccccaugg

SEQ ID NO: 349225 - RNA, 64 nt, Human
aggucuagggaaccacaacccuuauuguccuggguggaccaauccaaaggcuaagugauaguga

SEQ ID NO: 349226 - RNA, 64 nt, Human
guaauagugacccuuucacguccuggagcccgaguggaccaaucggaagccuaagugacgauga

SEQ ID NO: 349227 - RNA, 64 nt, Human
auacuagcugguauguuucauaaaugucaagcuguggaccaacauauauagccuuuuauuauuu

SEQ ID NO: 349228 - RNA, 64 nt, Human
cugccgaugugucuugagauuguuagguuuuuuuuggaccaaggaggaccguccaguggguagu

SEQ ID NO: 349229 - RNA, 64 nt, Human
uucagauaaaccaucuugguuacugugcuuaauuuggaccaaauuuuauuuagcuuaauaugga

SEQ ID NO: 349230 - RNA, 64 nt, Human
uggaagugggugaauucuacuuuuuauguuggaguggaccaaugucuaucaagagugacaaaua

SEQ ID NO: 349231 - RNA, 64 nt, Human
guaguggacccaguucuauuguuggcuucagcgguggaccaagcacugguguuggcuucugcag

SEQ ID NO: 349232 - RNA, 64 nt, Human
gcgguggaccaagcacugguguuggcuucugcaguggaccaagcaccaguggcuucagcggugg

SEQ ID NO: 349233 - RNA, 64 nt, Human
gcgguggaccgagcacaggagcuggcuucggcgguggaccaaacacuggugcuggcuuuggugg

SEQ ID NO: 349234 - RNA, 64 nt, Human
cugaggacaaacacaaacccuguuaauuauagaauggaccaaauacauuuuuaaaagaaaacug

SEQ ID NO: 349235 - RNA, 64 nt, Human
cugcuagccaggaugggaucucugcagucuucuguggaccaaggagauagacccggcuucuggu

SEQ ID NO: 349236 - RNA, 64 nt, Human
acuugucgucgucaaagucaagggaaaguucuccuggaccaaggcuugggaaagguaacuggag

SEQ ID NO: 349237 - RNA, 64 nt, Human
ggccuggagcaaggcacucucaaaucuugaacccuggaccaaagcuuuuccagaccccacccua

SEQ ID NO: 349238 - RNA, 64 nt, Human
agggaagucagcucugggagcagcccucacuggcuggaccaagguacucuuccuggaguuugcc

SEQ ID NO: 349239 - RNA, 64 nt, Human; identical to SEQ ID NO: 349001

SEQ ID NO: 349240 - RNA, 64 nt, Human
gugugauucugggcagccggccuggcuugaaguccgccaugacccugggcacaggggaagccca

SEQ ID NO: 349241 - RNA, 64 nt, Human
gaacaguguugucuccaccuggccuuagauggcacgccaugauucgggccuggauagacugccu

SEQ ID NO: 349242 - RNA, 64 nt, Human
ugcuaguuuugaaaugucuuuguaagaguagggucgccaugaugcagccauauggaagacuagg

SEQ ID NO: 349243 - RNA, 60 nt, Human
gcugggcuaggcucagcugagggcugccuucgccaugaauccuucugugaguucccuguc

SEQ ID NO: 349244 - RNA, 64 nt, Human
aguugccauggcaucggcuagugucuaaaggaaacgccaugaggcagggggcuggacuucaggc

SEQ ID NO: 349245 - RNA, 64 nt, Human
cguggcugcccugcccuacugugggcauagcgcccgccaugacagugaguguccuuaggggucu

SEQ ID NO: 349246 - RNA, 64 nt, Human
cuaauucaguaguuauuaacuucuaaauuuuauucgccaugacuuucuagugaauuauuaccau

SEQ ID NO: 349247 - RNA, 64 nt, Human
aauuuagcuucacuugagagagaucuggaauggucgccaugauugaaaccacgcaccauuacau

SEQ ID NO: 349248 - RNA, 64 nt, Human
cggagagacgcggccccucccgcguggacaucaccgccaugagccucuuugcgagugaccucug

SEQ ID NO: 349249 - RNA, 64 nt, Human
aaucccaaucgguuaggaaaaucuagucaguaagcgccaugaguauucuucccauaacuaaaug

SEQ ID NO: 349250 - RNA, 64 nt, Human
aaugaaguacuuguaccuauauuaauuaugcuuacgccaugauaaccaauauacagauauauua

SEQ ID NO: 349251 - RNA, 64 nt, Human
cuuaguuaucagaaaucagcucaguggucuuccccgccaugauucacauuugaugaguuuuuaa

SEQ ID NO: 349252 - RNA, 64 nt, Human
aaauagacagaaugauuuccaaaauugcaaaccacgccaugacccauauacgccaaguaagauu

SEQ ID NO: 349253 - RNA, 54 nt, Human
auucccagaggaaauuaugaauuacgccaugagguuuaugacgaauaaaugaau

SEQ ID NO: 349254 - RNA, 64 nt, Human
ucugccgcagcccucgcagagggcgggugcacagcgccaugagcgggcagcgccuccuguagca

SEQ ID NO: 349255 - RNA, 64 nt, Human
uaaggaugagggaagcgaagcaagaggaaccucucgccaugaucagacauacagcugccuaccu

SEQ ID NO: 349256 - RNA, 64 nt, Human
gaagggaagagaauuggugcugcagaaguguacccgccaugaagccgaugagaaaccucguguu

SEQ ID NO: 349257 - RNA, 64 nt, Human
uguccgaaagcaguccaggagauuauuaaggggucgccaugaauccacuuugguuuuaaaacca

SEQ ID NO: 349258 - RNA, 64 nt, Human
uggagaaaauccaaccagcucuucaggagaagcacgccaugaaacaggguaaguuuuuccuggg

SEQ ID NO: 349259 - RNA, 64 nt, Human
uucccuggccagaugccugaucagaugagaagcccgccaugauacugucacagugccuagaaug

SEQ ID NO: 349260 - RNA, 64 nt, Human
acggcuacgagcagcuuaggcagcucucccagcacgccaugaagggggucauccgugugaaguu

SEQ ID NO: 349261 - RNA, 64 nt, Human
ucagacuaggccccacucagccuggccuggacaccgccaugagcacagggcagggcuggggcag

SEQ ID NO: 349262 - RNA, 64 nt, Human
cacugaaacacacaauugacuggacagguccacgcgccaugacaaaacuauaaucaaguuauua

SEQ ID NO: 349263 - RNA, 64 nt, Human
ucacauugaguguggcucauuuucuuuccccgaacgccaugacuguucagaagcacaauacuau

SEQ ID NO: 349264 - RNA, 64 nt, Human
acgaccgcguguguugccccugcccugggcuccccgccaugacaucuucaccuugcagcuugug

SEQ ID NO: 349265 - RNA, 64 nt, Human
cacccgccuugugagauggaauuguaauaaaccacgccaugaggacaccgccgcccgccucggc

SEQ ID NO: 349266 - RNA, 64 nt, Human
gcuggccagaccgugaccaugcugccagugugcucgccaugagcugggucagggcuggggaguu

SEQ ID NO: 349267 - RNA, 64 nt, Human
aagacgaugaccaguuuucaccggaagcagaugccgccaugagcgagaugacggggaauacagc

SEQ ID NO: 349268 - RNA, 64 nt, Human
cguuuccuucauuccucuuagauuccauaguugccgccaugaaaagacugcucuugagccccaa

SEQ ID NO: 349269 - RNA, 64 nt, Human
acuggacauggucacucaguaccgccugcagugucgccaugacugaucauggcucuugcauuuu

SEQ ID NO: 349270 - RNA, 64 nt, Human
accggaauuuuggacucuacuggcuggguuccuucgccaugagcauccugguguuccuuacagg

SEQ ID NO: 349271 - RNA, 64 nt, Human
cugccaccauguaagaugugccugguuccccuuccgccaugauuguaaguuuccugaggccucc

SEQ ID NO: 349272 - RNA, 64 nt, Human
acaaccugaaagaggcgauugaaaccauuguggccgccaugagcaaccuggugccccccgugga

SEQ ID NO: 349273 - RNA, 64 nt, Human
aacugggcauuacccaccauuguagccaccugugcgccaugaccaugcuggcagagucuuuccu

SEQ ID NO: 349274 - RNA, 64 nt, Human
gcaggagcacacggaccagauuuggaaguuccagcgccaugaccugaucgaggaguaccacggc

SEQ ID NO: 349275 - RNA, 64 nt, Human
gcuagggucacccucucggccaucccacgagggucgccaugaucaccccaacucuagaggccgc

SEQ ID NO: 349276 - RNA, 64 nt, Human
acgugcaggcagcccgccugggaaacaucauccacgccaugaucauguaucgccguaaacugga

SEQ ID NO: 349277 - RNA, 64 nt, Human; identical to SEQ ID NO: 313865

SEQ ID NO: 349278 - RNA, 64 nt, Human; identical to SEQ ID NO: 313866

SEQ ID NO: 349279 - RNA, 64 nt, Human; identical to SEQ ID NO: 313867

SEQ ID NO: 349280 - RNA, 64 nt, Human; identical to SEQ ID NO: 313868

SEQ ID NO: 349281 - RNA, 64 nt, Human; identical to SEQ ID NO: 313869

SEQ ID NO: 349282 - RNA, 64 nt, Human; identical to SEQ ID NO: 313870

SEQ ID NO: 349283 - RNA, 64 nt, Human; identical to SEQ ID NO: 313871

SEQ ID NO: 349284 - RNA, 64 nt, Human; identical to SEQ ID NO: 313107

SEQ ID NO: 349285 - RNA, 64 nt, Human; identical to SEQ ID NO: 313108

SEQ ID NO: 349286 - RNA, 64 nt, Human; identical to SEQ ID NO: 310815

SEQ ID NO: 349287 - RNA, 64 nt, Human; identical to SEQ ID NO: 313746

SEQ ID NO: 349288 - RNA, 64 nt, Human; identical to SEQ ID NO: 313747

SEQ ID NO: 349289 - RNA, 64 nt, Human; identical to SEQ ID NO: 313748

SEQ ID NO: 349290 - RNA, 64 nt, Human
accaaucagccaggcugagcccccaccccugccccagcuccaggaccugccccugagccgggcc

SEQ ID NO: 349291 - RNA, 64 nt, Human
guuacucaaggacaaggggggacaguuuugccuacagcuccagagacacagagaacaaaggggu

SEQ ID NO: 349292 - RNA, 64 nt, Human
cugaggucccuccggcgcucauguuccgagucugcagcuccacacuuuaaaucauacucgaaug

SEQ ID NO: 349293 - RNA, 64 nt, Human; identical to SEQ ID NO: 313859

SEQ ID NO: 349294 - RNA, 50 nt, Human; identical to SEQ ID NO: 313860

SEQ ID NO: 349295 - RNA, 64 nt, Human; identical to SEQ ID NO: 310816

SEQ ID NO: 349296 - RNA, 64 nt, Human; identical to SEQ ID NO: 313780

SEQ ID NO: 349297 - RNA, 64 nt, Human; identical to SEQ ID NO: 313781

SEQ ID NO: 349298 - RNA, 64 nt, Human; identical to SEQ ID NO: 313782

SEQ ID NO: 349299 - RNA, 64 nt, Human; identical to SEQ ID NO: 313729

SEQ ID NO: 349300 - RNA, 64 nt, Human; identical to SEQ ID NO: 313730

SEQ ID NO: 349301 - RNA, 64 nt, Human; identical to SEQ ID NO: 311285

SEQ ID NO: 349302 - RNA, 64 nt, Human; identical to SEQ ID NO: 313814

SEQ ID NO: 349303 - RNA, 64 nt, Human; identical to SEQ ID NO: 313815

SEQ ID NO: 349304 - RNA, 64 nt, Human; identical to SEQ ID NO: 313816

SEQ ID NO: 349305 - RNA, 64 nt, Human; identical to SEQ ID NO: 313643

SEQ ID NO: 349306 - RNA, 64 nt, Human; identical to SEQ ID NO: 313644

SEQ ID NO: 349307 - RNA, 64 nt, Human
guugcccuggaucucagaauauauucguccacccccucggcaccccauuaccccgagucccacc

SEQ ID NO: 349308 - RNA, 64 nt, Human
accccgagcguuccaccacacuguccgcccuuggccucggcacacgcucaccuuuucuguuggu

SEQ ID NO: 349309 - RNA, 64 nt, Human
gaggaaaggcaguauggcggaggccaugggggccccucggcauucacacacagccuggccuccc

SEQ ID NO: 349310 - RNA, 64 nt, Human; identical to SEQ ID NO: 311286

SEQ ID NO: 349311 - RNA, 64 nt, Human; identical to SEQ ID NO: 313831

SEQ ID NO: 349312 - RNA, 64 nt, Human; identical to SEQ ID NO: 313832

SEQ ID NO: 349313 - RNA, 64 nt, Human; identical to SEQ ID NO: 313833

SEQ ID NO: 349314 - RNA, 64 nt, Human; identical to SEQ ID NO: 313862

SEQ ID NO: 349315 - RNA, 64 nt, Human; identical to SEQ ID NO: 313863

SEQ ID NO: 349316 - RNA, 64 nt, Human; identical to SEQ ID NO: 311305

SEQ ID NO: 349317 - RNA, 64 nt, Human; identical to SEQ ID NO: 313861

SEQ ID NO: 349318 - RNA, 64 nt, Human; identical to SEQ ID NO: 313848

SEQ ID NO: 349319 - RNA, 64 nt, Human; identical to SEQ ID NO: 313849

SEQ ID NO: 349320 - RNA, 64 nt, Human; identical to SEQ ID NO: 311322

SEQ ID NO: 349321 - RNA, 64 nt, Human; identical to SEQ ID NO: 313553

SEQ ID NO: 349322 - RNA, 64 nt, Human; identical to SEQ ID NO: 313554

SEQ ID NO: 349323 - RNA, 64 nt, Human; identical to SEQ ID NO: 313555

SEQ ID NO: 349324 - RNA, 64 nt, Human
aaccuccccuucccugccacgcaccuuccuuggccagcuccauucuggccuccuccaccaccug

SEQ ID NO: 349325 - RNA, 64 nt, Human
gagaggauaaggauaauuggcucaccucguuccacagcuccacuugcaucuucucaccaaagcc

SEQ ID NO: 349326 - RNA, 64 nt, Human
caguaaccaccuuccuucaagccuucagccccuccagcuccaagucucagaucucgaccauuga

SEQ ID NO: 349327 - RNA, 64 nt, Human; identical to SEQ ID NO: 313850

SEQ ID NO: 349328 - RNA, 64 nt, Human; identical to SEQ ID NO: 311323

SEQ ID NO: 349329 - RNA, 64 nt, Human; identical to SEQ ID NO: 313571

SEQ ID NO: 349330 - RNA, 64 nt, Human; identical to SEQ ID NO: 313572

SEQ ID NO: 349331 - RNA, 64 nt, Human; identical to SEQ ID NO: 313573

SEQ ID NO: 349332 - RNA, 64 nt, Human; identical to SEQ ID NO: 313589

SEQ ID NO: 349333 - RNA, 64 nt, Human; identical to SEQ ID NO: 313590

SEQ ID NO: 349334 - RNA, 64 nt, Human; identical to SEQ ID NO: 311324

SEQ ID NO: 349335 - RNA, 64 nt, Human; identical to SEQ ID NO: 313591

SEQ ID NO: 349336 - RNA, 64 nt, Human; identical to SEQ ID NO: 313645

SEQ ID NO: 349337 - RNA, 64 nt, Human; identical to SEQ ID NO: 311341

SEQ ID NO: 349338 - RNA, 64 nt, Human; identical to SEQ ID NO: 313625

SEQ ID NO: 349339 - RNA, 64 nt, Human; identical to SEQ ID NO: 313626

SEQ ID NO: 349340 - RNA, 64 nt, Human; identical to SEQ ID NO: 313627

SEQ ID NO: 349341 - RNA, 64 nt, Human
ggggaagacagagaaaagcaaacgcauuccuccucagcuccacccaccuggagacgaauguagc

SEQ ID NO: 349342 - RNA, 64 nt, Human
ucacccauuaaaggauaggucuccccggagugcacagcuccaccugggagccuggcgcgucauc

SEQ ID NO: 349343 - RNA, 53 nt, Human
uuauagcuaacugggacuagaaacagcuccaucacccaggugaguuuuauaag

SEQ ID NO: 349344 - RNA, 64 nt, Human; identical to SEQ ID NO: 313661

SEQ ID NO: 349345 - RNA, 64 nt, Human; identical to SEQ ID NO: 313662

SEQ ID NO: 349346 - RNA, 64 nt, Human; identical to SEQ ID NO: 311342

SEQ ID NO: 349347 - RNA, 64 nt, Human; identical to SEQ ID NO: 313663

SEQ ID NO: 349348 - RNA, 64 nt, Human; identical to SEQ ID NO: 313864

SEQ ID NO: 349349 - RNA, 64 nt, Human; identical to SEQ ID NO: 311343

SEQ ID NO: 349350 - RNA, 64 nt, Human; identical to SEQ ID NO: 313678

SEQ ID NO: 349351 - RNA, 64 nt, Human; identical to SEQ ID NO: 313679

SEQ ID NO: 349352 - RNA, 64 nt, Human; identical to SEQ ID NO: 313680

SEQ ID NO: 349353 - RNA, 64 nt, Human; identical to SEQ ID NO: 313695

SEQ ID NO: 349354 - RNA, 64 nt, Human; identical to SEQ ID NO: 313696

SEQ ID NO: 349355 - RNA, 64 nt, Human; identical to SEQ ID NO: 311362

SEQ ID NO: 349356 - RNA, 64 nt, Human; identical to SEQ ID NO: 313712

SEQ ID NO: 349357 - RNA, 64 nt, Human; identical to SEQ ID NO: 313713

SEQ ID NO: 349358 - RNA, 64 nt, Human
gcugcuuucccucuccugccucaucccuuguuggcagcuccaguucaggccguggagggacgug

SEQ ID NO: 349359 - RNA, 64 nt, Human
uuaaagaaugaaagaaguacuucuuuuuacauuucagcuccagcagccagcuauuuaaaaaaua

SEQ ID NO: 349360 - RNA, 64 nt, Human
cagcucauuuucuuuaauaggaggucaggauggucagcuccaguaucuccccuaaguuuagggg

SEQ ID NO: 349361 - RNA, 64 nt, Human; identical to SEQ ID NO: 313714

SEQ ID NO: 349362 - RNA, 64 nt, Human; identical to SEQ ID NO: 313499

SEQ ID NO: 349363 - RNA, 64 nt, Human; identical to SEQ ID NO: 313500

SEQ ID NO: 349364 - RNA, 64 nt, Human; identical to SEQ ID NO: 311379

SEQ ID NO: 349365 - RNA, 64 nt, Human; identical to SEQ ID NO: 313763

SEQ ID NO: 349366 - RNA, 64 nt, Human; identical to SEQ ID NO: 313764

SEQ ID NO: 349367 - RNA, 64 nt, Human; identical to SEQ ID NO: 313765

SEQ ID NO: 349368 - RNA, 64 nt, Human; identical to SEQ ID NO: 313463

SEQ ID NO: 349369 - RNA, 64 nt, Human; identical to SEQ ID NO: 313464

SEQ ID NO: 349370 - RNA, 64 nt, Human; identical to SEQ ID NO: 311380

SEQ ID NO: 349371 - RNA, 64 nt, Human; identical to SEQ ID NO: 313797

SEQ ID NO: 349372 - RNA, 64 nt, Human; identical to SEQ ID NO: 313798

SEQ ID NO: 349373 - RNA, 64 nt, Human; identical to SEQ ID NO: 313799

SEQ ID NO: 349374 - RNA, 64 nt, Human; identical to SEQ ID NO: 313445

SEQ ID NO: 349375 - RNA, 64 nt, Human
aacagcagcuccaccaaaugaagucccucucacgcagcuccacagcgcugucucgugaauggac

SEQ ID NO: 349376 - RNA, 64 nt, Human
aauucagccaugaaacugacucaucaguugagggcagcuccagugccagcaauaggguggcaca

SEQ ID NO: 349377 - RNA, 64 nt, Human
acaacacagaacacgcccuccuccucgcugccugcagcuccaaucugauucugcuugggaaugg

SEQ ID NO: 349378 - RNA, 64 nt, Human; identical to SEQ ID NO: 313446

SEQ ID NO: 349379 - RNA, 64 nt, Human; identical to SEQ ID NO: 311381

SEQ ID NO: 349380 - RNA, 64 nt, Human; identical to SEQ ID NO: 313337

SEQ ID NO: 349381 - RNA, 58 nt, Human; identical to SEQ ID NO: 313338

SEQ ID NO: 349382 - RNA, 64 nt, Human; identical to SEQ ID NO: 313339

SEQ ID NO: 349383 - RNA, 64 nt, Human; identical to SEQ ID NO: 313447

SEQ ID NO: 349384 - RNA, 64 nt, Human; identical to SEQ ID NO: 311433

SEQ ID NO: 349385 - RNA, 64 nt, Human; identical to SEQ ID NO: 313373

SEQ ID NO: 349386 - RNA, 64 nt, Human; identical to SEQ ID NO: 313374

SEQ ID NO: 349387 - RNA, 64 nt, Human; identical to SEQ ID NO: 313375

SEQ ID NO: 349388 - RNA, 64 nt, Human; identical to SEQ ID NO: 313391

SEQ ID NO: 349389 - RNA, 64 nt, Human; identical to SEQ ID NO: 313392

SEQ ID NO: 349390 - RNA, 64 nt, Human; identical to SEQ ID NO: 311434

SEQ ID NO: 349391 - RNA, 64 nt, Human; identical to SEQ ID NO: 313393

SEQ ID NO: 349392 - RNA, 64 nt, Human
ucccagcuagcaccuugcuguccucccuucccugcagcuccagucagugugcaggggacucagg

SEQ ID NO: 349393 - RNA, 64 nt, Human
aggccugggcccucaggauguuucaaaggcuccacagcuccaccgcuccaccuggcuucacucc

SEQ ID NO: 349394 - RNA, 64 nt, Human
uuuaucucuuauaccuguaucucccaacuagaaacagcuccaguguuuuuaagagaauguuucu

SEQ ID NO: 349395 - RNA, 64 nt, Human; identical to SEQ ID NO: 313481

SEQ ID NO: 349396 - RNA, 64 nt, Human; identical to SEQ ID NO: 313482

SEQ ID NO: 349397 - RNA, 64 nt, Human; identical to SEQ ID NO: 311435

SEQ ID NO: 349398 - RNA, 64 nt, Human; identical to SEQ ID NO: 313409

SEQ ID NO: 349399 - RNA, 64 nt, Human; identical to SEQ ID NO: 313410

SEQ ID NO: 349400 - RNA, 64 nt, Human; identical to SEQ ID NO: 313411

SEQ ID NO: 349401 - RNA, 64 nt, Human; identical to SEQ ID NO: 313697

SEQ ID NO: 349402 - RNA, 64 nt, Human; identical to SEQ ID NO: 313089

SEQ ID NO: 349403 - RNA, 64 nt, Human; identical to SEQ ID NO: 313465

SEQ ID NO: 349404 - RNA, 64 nt, Human; identical to SEQ ID NO: 313483

SEQ ID NO: 349405 - RNA, 64 nt, Human; identical to SEQ ID NO: 313090

SEQ ID NO: 349406 - RNA, 64 nt, Human; identical to SEQ ID NO: 313501

SEQ ID NO: 349407 - RNA, 64 nt, Human; identical to SEQ ID NO: 313517

SEQ ID NO: 349408 - RNA, 64 nt, Human; identical to SEQ ID NO: 313518

SEQ ID NO: 349409 - RNA, 64 nt, Human
acccuggcaucugacacugacagcagccuggaagccucggcaggaccccuggguuguugcaggu

SEQ ID NO: 349410 - RNA, 64 nt, Human
ugaaaagaagcucgcuccagaugucugcauggguccucggcacucuuggcugaggacucaaagg

SEQ ID NO: 349411 - RNA, 64 nt, Human
cuucaggaccguggggccuggucagucuguccauccucggcaaggacacaacacugccccagag

SEQ ID NO: 349412 - RNA, 64 nt, Human; identical to SEQ ID NO: 313091

SEQ ID NO: 349413 - RNA, 64 nt, Human
agggauggggggcacaggagcugggagccccgucuccaggaaaaggagagggguuaagaugcac

SEQ ID NO: 349414 - RNA, 64 nt, Human
ugaccacaggcaguuacuucugagggcaucuugguccaggaaaugugcacaaaauucgaccuga

SEQ ID NO: 349415 - RNA, 64 nt, Human
ggguuucugcgccgucggugggcacuuguuauuuuccaggaaccuucuccuggugucuacaugu

SEQ ID NO: 349416 - RNA, 64 nt, Human
ugagagucagccaugaacggaauaccugcuagguuccaggaaugagcucaccuaacagauagca

SEQ ID NO: 349417 - RNA, 64 nt, Human
cugcaggcccugcagaugacggcagccagcugcuuccaggaaccagguguccaaggccaccucu

SEQ ID NO: 349418 - RNA, 64 nt, Human
guugagcauagagaacaaaguaaaaguaguguuguccaggaagucagaauuuuuaacuguacug

SEQ ID NO: 349419 - RNA, 64 nt, Human
gaugucugagcagaaucaguguuugggucaccccuccaggaaugaucucuucuuuuggcuucca

SEQ ID NO: 349420 - RNA, 64 nt, Human
ggaacugaagaaacugccgcucugagacugcacauccaggaaaaaagacuaggacuugccacac

SEQ ID NO: 349421 - RNA, 64 nt, Human
uugcuugcaagugugcaugguucaaucccucacauccaggaaaugaauuuugcaauugggccag

SEQ ID NO: 349422 - RNA, 64 nt, Human
ucuggauuuuaguuuugugcuuaguuaaaucuuuuccaggaaaaagaacuuccccauacaaaua

SEQ ID NO: 349423 - RNA, 64 nt, Human
aaguaaaacuaaguauuucuucauuguaccuuaguccaggaagaaauuaauggaauauggugug

SEQ ID NO: 349424 - RNA, 64 nt, Human
auuaugcccaaaucaaccucugaaaaaagguuuuuccaggaagauuuacauuuagguuuaauau

SEQ ID NO: 349425 - RNA, 64 nt, Human
cacuauguguugcuaaaacacaugcuaugagcacuccaggaaacacuauauuuuuuccaaaaaa

SEQ ID NO: 349426 - RNA, 64 nt, Human
cauguaccaacacuugaaagauggguggauauuuuccaggaaacagauuuugggcaggacauuc

SEQ ID NO: 349427 - RNA, 64 nt, Human
uguuauauacagauggcagcuuggaucucagguacagcuccaggggcaggcagugcccagcugg

SEQ ID NO: 349428 - RNA, 64 nt, Human
aucagccugccagauaauccacaugcucccuccccagcuccacuaagauuuucacuuuagccau

SEQ ID NO: 349429 - RNA, 64 nt, Human
gauugcguggcucuuucagaagacccaggaagggcagcuccagccagaggaccuuccuggcuau

SEQ ID NO: 349430 - RNA, 64 nt, Human
caagccuuuguuccuguccugcauuguccagccccagcuccaccuaagugacuuguggccuugu

SEQ ID NO: 349431 - RNA, 64 nt, Human; identical to SEQ ID NO: 313519

SEQ ID NO: 349432 - RNA, 64 nt, Human; identical to SEQ ID NO: 313301

SEQ ID NO: 349433 - RNA, 64 nt, Human; identical to SEQ ID NO: 313302

SEQ ID NO: 349434 - RNA, 64 nt, Human; identical to SEQ ID NO: 313109

SEQ ID NO: 349435 - RNA, 64 nt, Human; identical to SEQ ID NO: 313607

SEQ ID NO: 349436 - RNA, 64 nt, Human; identical to SEQ ID NO: 313608

SEQ ID NO: 349437 - RNA, 64 nt, Human; identical to SEQ ID NO: 313609

SEQ ID NO: 349438 - RNA, 64 nt, Human; identical to SEQ ID NO: 313265

SEQ ID NO: 349439 - RNA, 64 nt, Human; identical to SEQ ID NO: 313266

SEQ ID NO: 349440 - RNA, 64 nt, Human; identical to SEQ ID NO: 313110

SEQ ID NO: 349441 - RNA, 64 nt, Human; identical to SEQ ID NO: 313731

SEQ ID NO: 349442 - RNA, 64 nt, Human; identical to SEQ ID NO: 313247

SEQ ID NO: 349443 - RNA, 64 nt, Human; identical to SEQ ID NO: 313248

SEQ ID NO: 349444 - RNA, 64 nt, Human; identical to SEQ ID NO: 313126

SEQ ID NO: 349445 - RNA, 64 nt, Human
cuuaauuuguacacacuuuuaaauauugucuuagccucggcaaaccaauuuggggaagaagcaa

SEQ ID NO: 349446 - RNA, 64 nt, Human
uacgauuccaacccgucagcauaggucgcuggggccucggcaguaggcagcugugcagcuucac

SEQ ID NO: 349447 - RNA, 64 nt, Human
uaguuuggccaagcauacucaucauuucuuuguucagcuccacauuuccugugaaacuaacauc

SEQ ID NO: 349448 - RNA, 64 nt, Human; identical to SEQ ID NO: 313249

SEQ ID NO: 349449 - RNA, 64 nt, Human; identical to SEQ ID NO: 313319

SEQ ID NO: 349450 - RNA, 64 nt, Human; identical to SEQ ID NO: 313320

SEQ ID NO: 349451 - RNA, 64 nt, Human; identical to SEQ ID NO: 313321

SEQ ID NO: 349452 - RNA, 64 nt, Human; identical to SEQ ID NO: 313355

SEQ ID NO: 349453 - RNA, 64 nt, Human; identical to SEQ ID NO: 313356

SEQ ID NO: 349454 - RNA, 64 nt, Human; identical to SEQ ID NO: 313357

SEQ ID NO: 349455 - RNA, 64 nt, Human; identical to SEQ ID NO: 313427

SEQ ID NO: 349456 - RNA, 64 nt, Human; identical to SEQ ID NO: 313428

SEQ ID NO: 349457 - RNA, 64 nt, Human; identical to SEQ ID NO: 313429

SEQ ID NO: 349458 - RNA, 64 nt, Human; identical to SEQ ID NO: 313535

SEQ ID NO: 349459 - RNA, 64 nt, Human; identical to SEQ ID NO: 313536

SEQ ID NO: 349460 - RNA, 64 nt, Human; identical to SEQ ID NO: 313537

SEQ ID NO: 349461 - RNA, 64 nt, Human; identical to SEQ ID NO: 313127

SEQ ID NO: 349462 - RNA, 64 nt, Human
gguuuggggcucagagucgagggacgggguguagccucggcauuugcuugaguuucuccacucu

SEQ ID NO: 349463 - RNA, 64 nt, Human
gaagacacuguccccagcuaccagcuacgccaaaccucggcauuuuuuguguuauuuucugacu

SEQ ID NO: 349464 - RNA, 64 nt, Human
caaagggcccagggacccuguugcgcugcccuggccucggcauucgaggcuccccuagggccgu

SEQ ID NO: 349465 - RNA, 64 nt, Human; identical to SEQ ID NO: 313128

SEQ ID NO: 349466 - RNA, 64 nt, Human; identical to SEQ ID NO: 313129

SEQ ID NO: 349467 - RNA, 64 nt, Human; identical to SEQ ID NO: 313145

SEQ ID NO: 349468 - RNA, 64 nt, Human; identical to SEQ ID NO: 313146

SEQ ID NO: 349469 - RNA, 64 nt, Human; identical to SEQ ID NO: 313147

SEQ ID NO: 349470 - RNA, 64 nt, Human; identical to SEQ ID NO: 313148

SEQ ID NO: 349471 - RNA, 64 nt, Human; identical to SEQ ID NO: 313872

SEQ ID NO: 349472 - RNA, 64 nt, Human; identical to SEQ ID NO: 313873

SEQ ID NO: 349473 - RNA, 64 nt, Human; identical to SEQ ID NO: 313874

SEQ ID NO: 349474 - RNA, 64 nt, Human; identical to SEQ ID NO: 313875

SEQ ID NO: 349475 - RNA, 64 nt, Human; identical to SEQ ID NO: 313876

SEQ ID NO: 349476 - RNA, 64 nt, Human; identical to SEQ ID NO: 313877

SEQ ID NO: 349477 - RNA, 64 nt, Human; identical to SEQ ID NO: 313878

SEQ ID NO: 349478 - RNA, 64 nt, Human; identical to SEQ ID NO: 313879

SEQ ID NO: 349479 - RNA, 64 nt, Human
aauugucuccccaagacagcucaaaauauccacaccucggcaacagucuaagaugagagccugu

SEQ ID NO: 349480 - RNA, 64 nt, Human
ucagagcacuucauccacuugcuccucccucuacccucggcacccugggugggaaaggguugau

SEQ ID NO: 349481 - RNA, 64 nt, Human
ggacgcccggggucucccacaggccugugaguugccucggcauaugacgcagaaccccaacugu

SEQ ID NO: 349482 - RNA, 64 nt, Human; identical to SEQ ID NO: 313880

SEQ ID NO: 349483 - RNA, 64 nt, Human; identical to SEQ ID NO: 313881

SEQ ID NO: 349484 - RNA, 64 nt, Human; identical to SEQ ID NO: 313882

SEQ ID NO: 349485 - RNA, 64 nt, Human; identical to SEQ ID NO: 313883

SEQ ID NO: 349486 - RNA, 64 nt, Human; identical to SEQ ID NO: 313884

SEQ ID NO: 349487 - RNA, 64 nt, Human; identical to SEQ ID NO: 313885

SEQ ID NO: 349488 - RNA, 64 nt, Human; identical to SEQ ID NO: 313886

SEQ ID NO: 349489 - RNA, 64 nt, Human; identical to SEQ ID NO: 313887

SEQ ID NO: 349490 - RNA, 64 nt, Human; identical to SEQ ID NO: 313888

SEQ ID NO: 349491 - RNA, 64 nt, Human; identical to SEQ ID NO: 313889

SEQ ID NO: 349492 - RNA, 51 nt, Human; identical to SEQ ID NO: 313890

SEQ ID NO: 349493 - RNA, 64 nt, Human; identical to SEQ ID NO: 313891

SEQ ID NO: 349494 - RNA, 64 nt, Human; identical to SEQ ID NO: 313892

SEQ ID NO: 349495 - RNA, 64 nt, Human; identical to SEQ ID NO: 313893

SEQ ID NO: 349496 - RNA, 64 nt, Human
agauuccuagagacguuaugaugguuacacauguccucggcaucacauguaggagacuguucaa

SEQ ID NO: 349497 - RNA, 64 nt, Human
uuuacuacuaaaauguaaaaaauuaaugugcucaccucggcagcacauauacuaaaaauuaaua

SEQ ID NO: 349498 - RNA, 64 nt, Human
gucagugauauucucccagaauguacuuaucuuaccucggcauguacuguagucacucaguauu

SEQ ID NO: 349499 - RNA, 64 nt, Human; identical to SEQ ID NO: 313894

SEQ ID NO: 349500 - RNA, 64 nt, Human; identical to SEQ ID NO: 313895

SEQ ID NO: 349501 - RNA, 64 nt, Human; identical to SEQ ID NO: 313896

SEQ ID NO: 349502 - RNA, 64 nt, Human; identical to SEQ ID NO: 313897

SEQ ID NO: 349503 - RNA, 64 nt, Human; identical to SEQ ID NO: 313898

SEQ ID NO: 349504 - RNA, 64 nt, Human; identical to SEQ ID NO: 313899

SEQ ID NO: 349505 - RNA, 64 nt, Human; identical to SEQ ID NO: 313900

SEQ ID NO: 349506 - RNA, 64 nt, Human; identical to SEQ ID NO: 313901

SEQ ID NO: 349507 - RNA, 64 nt, Human; identical to SEQ ID NO: 313902

SEQ ID NO: 349508 - RNA, 64 nt, Human; identical to SEQ ID NO: 313903

SEQ ID NO: 349509 - RNA, 64 nt, Human; identical to SEQ ID NO: 313904

SEQ ID NO: 349510 - RNA, 64 nt, Human; identical to SEQ ID NO: 313905

SEQ ID NO: 349511 - RNA, 64 nt, Human; identical to SEQ ID NO: 313906

SEQ ID NO: 349512 - RNA, 64 nt, Human; identical to SEQ ID NO: 313907

SEQ ID NO: 349513 - RNA, 64 nt, Human
uaaguucugaguccccggccagggucccuuaacaccucggcacagaggcuguuggcaaguguag

SEQ ID NO: 349514 - RNA, 64 nt, Human
aaccaccucaccagaaccauuggagcaccuguggccucggcacacugcuuaucacuugaaaaau

SEQ ID NO: 349515 - RNA, 64 nt, Human
ucauuccagaaguauuaaacgucauugcugcaaaccucggcaggugccgugugaggggcuuaau

SEQ ID NO: 349516 - RNA, 58 nt, Human; identical to SEQ ID NO: 313908

SEQ ID NO: 349517 - RNA, 64 nt, Human; identical to SEQ ID NO: 313909

SEQ ID NO: 349518 - RNA, 64 nt, Human; identical to SEQ ID NO: 313910

SEQ ID NO: 349519 - RNA, 64 nt, Human
gugaauaacuuuuguauuaaaauuuuaagaaccuacggccuauucucagaggauuauguaaccc

SEQ ID NO: 349520 - RNA, 64 nt, Human
ggcgccaggacagcagcacucccgcugcacacagacggccuagggguggcgcucagaccccacc

SEQ ID NO: 349521 - RNA, 64 nt, Human
ccccgcugucauuucagucucuucauuuugucauacggccuaaggcuuuaaagagcaauaaaau

SEQ ID NO: 349522 - RNA, 64 nt, Human
ccguccugucaucccugugugcugcagcaucaccacggccuacuucccaauauccacaaagcuu

SEQ ID NO: 349523 - RNA, 64 nt, Human
gaugguacucuccaaaggcccuaccagagggaacacggccuacugagcggacagaaugaugcca

SEQ ID NO: 349524 - RNA, 64 nt, Human
auuauuucaaucuuuauuuuguaaaacggagauaacggccuauaggauuguuaagacugaauau

SEQ ID NO: 349525 - RNA, 64 nt, Human
uggcugguggauugugggcaccaggcucccuggcacggccuaacucugcggacccccauccugc

SEQ ID NO: 349526 - RNA, 64 nt, Human
caaagaaagcaaaauuugauucauaauaauggcaacggccuaggaucaguaccuguugaaaaaa

SEQ ID NO: 349527 - RNA, 64 nt, Human
ggccugaaacccacuccuccaucucauggggcucacggccuacagcagcccacaagcugccacu

SEQ ID NO: 349528 - RNA, 64 nt, Human
caggcccagagcaagacccugaagacccccaaccacggccuaaaagccucuuuguggcugaaag

SEQ ID NO: 349529 - RNA, 64 nt, Human
auagacagcaagaaagguuuugcaccauccucuuacggccuagagaguugacaaguugcuugua

SEQ ID NO: 349530 - RNA, 64 nt, Human
ucguuaacacauggcuuccuaaauggcccuguuuacggccuaugagaugaaauaugugauuuuc

SEQ ID NO: 349531 - RNA, 64 nt, Human
ccaucacgugugauugacauguagguacccugccacggccuaugccccaccugcccugcuuccu

SEQ ID NO: 349532 - RNA, 64 nt, Human
auuucugugucugcuuggcgaccucccugcgugcacggccuaggaggugcacgggccaccauag

SEQ ID NO: 349533 - RNA, 64 nt, Human
aguuuuuuuuaaaaccguggagguugcccacgggccucggcaccuggcccuggcagcacagcuc

SEQ ID NO: 349534 - RNA, 64 nt, Human
agugggacaaaaagaauuuagaccccaaaaguguccucggcauggaucuugaacagaaccagua

SEQ ID NO: 349535 - RNA, 64 nt, Human
gcuccccccagacuggagagcaagcccagcccagccucggcauagacccccuucugguccgccc

SEQ ID NO: 349536 - RNA, 64 nt, Human
ugacuucaccucauggagcccgggaagcugcucgccucggcagccauaggagcgaacacugcug

SEQ ID NO: 349537 - RNA, 64 nt, Human
ccuaacucauguucugacccucugugcacuggauccucggcauagcggacggacacaccucaug

SEQ ID NO: 349538 - RNA, 64 nt, Human
caauucuuagaggggcaguucuaccuccucugucccucggcagaaagacguuuccacaccucuu

SEQ ID NO: 349539 - RNA, 64 nt, Human
ccgagaggccggcggcccugaaggugagugaggcccucggcagcugcagccggggugucuggua

SEQ ID NO: 349540 - RNA, 64 nt, Human
gccuagcacggacauggucuguccugacagcacuccucggcaggcauggcuggugccugaagac

SEQ ID NO: 349541 - RNA, 64 nt, Human
gaaccccacagcaugccugucucagcucccugucccucggcacuuccccaggcucauuugagca

SEQ ID NO: 349542 - RNA, 64 nt, Human
uaaggauggaaggcuguccaaguuauuuggaaggccucggcagcuugggauuagcuugggagcg

SEQ ID NO: 349543 - RNA, 64 nt, Human
cguccagcuuugacagucaguuuugaugucagcuccucggcaggguaggccugaugacagcccu

SEQ ID NO: 349544 - RNA, 64 nt, Human
ugagugccaaaagcuugggggaggagggacagguccucggcaauaaacagugucacacacgcau

SEQ ID NO: 349545 - RNA, 64 nt, Human
cagccacccucuggcucagcggggcccagacccaccucggcacggacaccccugucuccaggag

SEQ ID NO: 349546 - RNA, 64 nt, Human
aguggucacgcuucauccacggcuccuucccaccccucggcaguggcugugcaauguuuuaagu

SEQ ID NO: 349547 - RNA, 64 nt, Human
gaagccuggcuucucugugagcacauacguggguccucggcagcucccuccaggcugucugggc

SEQ ID NO: 349548 - RNA, 64 nt, Human
cauaaagucaccuaggugaggauaggcgcgggagccucggcaugacaccauggagaucggggcc

SEQ ID NO: 349549 - RNA, 64 nt, Human
cccaccucuggguccuuggcucccgggggccccaccucggcacacacugugccccacaaaacuu

SEQ ID NO: 349550 - RNA, 64 nt, Human
ggaggaucaguugaggucaggaguuugagaccagccucggcaacauggcaaaaucuugucucuu

SEQ ID NO: 349551 - RNA, 64 nt, Human
cucugcagcgaccccuccuagacgcucccuggccccucggcacccagaaugccacauucuugug

SEQ ID NO: 349552 - RNA, 64 nt, Human
uguagucuuuucuugaaacaucuugauugcuuuuccucggcagcuuucaaaaaaccaaauaaua

SEQ ID NO: 349553 - RNA, 64 nt, Human
caggaagacuuuccuucacccaccaucccccuaaccucggcagggcuucuguccuguggaguuc

SEQ ID NO: 349554 - RNA, 64 nt, Human
uacggcccggcccccacgcgcccugcucucacggccucggcacaggcagcggcugcacguguuc

SEQ ID NO: 349555 - RNA, 64 nt, Human
ucuccaaaacguucuucccagacugcgaggaccgccucggcagguggcgguaaaagcgccccca

SEQ ID NO: 349556 - RNA, 64 nt, Human
agggccccgggacagaguuuucccagaccuggcuccucggcagagcugccucccgucagggccc

SEQ ID NO: 349557 - RNA, 64 nt, Human
ggaaagcggugaggacgcagagugcaggcuguggccucggcaucccgcaggaggucccuagaac

SEQ ID NO: 349558 - RNA, 64 nt, Human
acaagaaggccagcccacugggcccuggggcugcccucggcaaccguggggaggccauuugcug

SEQ ID NO: 349559 - RNA, 64 nt, Human
ucuccugcuaccucccaccacugucccagcagucccucggcacacaggcauaucagcuuucaca

SEQ ID NO: 349560 - RNA, 64 nt, Human
ggaaggcaagauuggaaagacaggaagaccaaggccucggcagaacucucugucuucucuccac

SEQ ID NO: 349561 - RNA, 64 nt, Human
aguuauuagguuugaagcaaccuccagcuugaggccucggcaucuugagauggaagagcagccu

SEQ ID NO: 349562 - RNA, 64 nt, Human
ucaggccaccuccugguccagucaccaccugcagccucggcagggcagguacaggggccaccuc

SEQ ID NO: 349563 - RNA, 64 nt, Human
aacccggcugccugccuuuuuuucugauccagacccucggcaccugcuacuuaccaacuggaaa

SEQ ID NO: 349564 - RNA, 64 nt, Human
ggaggaucgcuugagcccaggagucugagaccagccucggcaacaugccaagaccccgucucua

SEQ ID NO: 349565 - RNA, 64 nt, Human
aauuggcacagccauacggcacugaacaaggaagccucggcagauguggcugaaccgagcugga

SEQ ID NO: 349566 - RNA, 64 nt, Human
gauggcccccaaccccccacccaccccucuccugccucggcagggacugugaucgaggcgugag

SEQ ID NO: 349567 - RNA, 64 nt, Human
cuuugucuugacccccaagucuucaaccagauauccucggcaacccaccucccacccuccuccu

SEQ ID NO: 349568 - RNA, 64 nt, Human
ggcugguguccucccuccaggcugaaccccacuuccucggcaggaccccagucucagcagccuc

SEQ ID NO: 349569 - RNA, 64 nt, Human
uugccggcauagccccgguccucuccaucucucuccucggcagcagcgggaggcagaggaaggc

SEQ ID NO: 349570 - RNA, 64 nt, Human
gaacccuauguguccauuucugcacacacguauaccucggcauggccgcgucacuucucugauu

SEQ ID NO: 349571 - RNA, 64 nt, Human
cugccugcuggggaggagggacccacacaagcccccucggcaguuuguccccccagcuucggua

SEQ ID NO: 349572 - RNA, 64 nt, Human
ggagucccagcagcgagcuggucuggcgagggcaccucggcagcccccacggguuggcuccuac

SEQ ID NO: 349573 - RNA, 64 nt, Human
acuuccuccgugcaguggcccugccacagcccucccucggcacacuuugacccuuuguaggauu

SEQ ID NO: 349574 - RNA, 64 nt, Human
agcagacagcgagacccccagcggcagaggccucccucggcacuccaggcuuauaauuucgaac

SEQ ID NO: 349575 - RNA, 64 nt, Human
caucuuggagaugagggugccuguccuggacagaccucggcaugccuucuguuucuccuucaau

SEQ ID NO: 349576 - RNA, 64 nt, Human
agugcuggucacaccccugugugauaugugaugcccucggcaaagaaucuacuggaauagauuc

SEQ ID NO: 349577 - RNA, 53 nt, Human
gcgugacaugaucuucguaacggccucggcacgcuccacaccccuggagucuc

SEQ ID NO: 349578 - RNA, 64 nt, Human
uccuagaggggacaagccaggcccucucugcaguccucggcagcuccggaaggacacagucagg

SEQ ID NO: 349579 - RNA, 64 nt, Human
ggagcgagcggggaacgcgacguaccccagugcgccucggcacaccauugcuccccgaaacugg

SEQ ID NO: 349580 - RNA, 64 nt, Human
uuggcaccaucucaccaccgcauaucccucacccccucggcaagcaccaauccuuggugcugcc

SEQ ID NO: 349581 - RNA, 64 nt, Human
ugugcauagucuccagagcuucaaaggcaacacaagcucgcaacucuaagauuuuuuuaaacca

SEQ ID NO: 349582 - RNA, 64 nt, Human
gaagccuuuuucauuaaggauacaaccuauuuguagcucgcacuuuaaaagaugcuugagauac

SEQ ID NO: 349583 - RNA, 64 nt, Human
ugagucaccgccuguccugcaguggagcaugcacagcucgcagccucuuugcacgauuucaucc

SEQ ID NO: 349584 - RNA, 64 nt, Human
gagcccccaggaagcccaggagggcauccauaccagcucgcaccccccuguucuaagggggagg

SEQ ID NO: 349585 - RNA, 64 nt, Human
uccgggaggcucccaggcgcccggcgcagugggaagcucgcagcagcuggggaggagccaaagc

SEQ ID NO: 349586 - RNA, 64 nt, Human
auuucacgggagauuucuuguugcucaaaaaaugagcucgcauuugucaaugacaguuucuuuu

SEQ ID NO: 349587 - RNA, 64 nt, Human
agugggaggaagcccuuccuccucuuaugcaagcagcucgcagccagcccagaaucucuuaugc

SEQ ID NO: 349588 - RNA, 64 nt, Human
gggggcaggggaaggggaggcgggagggaggggaagcucgcaagcccggggagagauuuauaaa

SEQ ID NO: 349589 - RNA, 64 nt, Human
acaggaagcaguucacugagucagcugguucccaagcucgcacagaaggugauaaguuacuauc

SEQ ID NO: 349590 - RNA, 64 nt, Human
caguguccguguguccaugugucugcccuucaggagcucgcagcuggugugcuuggcgguccca

SEQ ID NO: 349591 - RNA, 64 nt, Human
ccuugugcauugagugcauccccgcuggugacuaagcucgcagcaagcggcuaccccccgaucu

SEQ ID NO: 349592 - RNA, 64 nt, Human
agugucuguuauucaaugauguauauacucccacagcucgcaugaaggaacagccucuauugau

SEQ ID NO: 349593 - RNA, 64 nt, Human
acagugaccucacuggccuguggugacugcacacagcucgcaaaacugucuuuggauguucaaa

SEQ ID NO: 349594 - RNA, 64 nt, Human
gcaggaggagcugccucuucucuugacagucugaagcucgcauccagacagucgcucagucugu

SEQ ID NO: 349595 - RNA, 64 nt, Human
uugccaaauugacugucacgcggcagcuucagggagcucgcauucucuuguguucguguugccc

SEQ ID NO: 349596 - RNA, 64 nt, Human
uugguaaguucuuuagcaguguucaaagucuacuagcucgcauuaguuucuguugcugccaaca

SEQ ID NO: 349597 - RNA, 64 nt, Human
ucccggggcgcgaggaaggcgccugcccucucccagcucgcaggccccgggcccggccgcgccu

SEQ ID NO: 349598 - RNA, 64 nt, Human
uuuauaaacuaaagcugccuauguuucuuuuuaaagcucgcauucccagaaucagcuuaggcuu

SEQ ID NO: 349599 - RNA, 64 nt, Human
cccccgaaugcauuuggaaccaaagucuaaacugagcucgcagcccccgcgcccucccuccgcc

SEQ ID NO: 349600 - RNA, 64 nt, Human
agccuggaugggcauaaguagauaaauaacugugagcucgcacaaccgaaagggccugaccccu

SEQ ID NO: 349601 - RNA, 64 nt, Human
cacgaccaaagucacuggaagccggguuuccggaagcucgcagcuuggccugcaccacacgccc

SEQ ID NO: 349602 - RNA, 64 nt, Human
gucugucgaaucgcugccuccgagcccacccccgagcucgcaugcugucacccauuccagccua

SEQ ID NO: 349603 - RNA, 64 nt, Human
ucaggugugggaagaggcgagagggcuguggaggagcucgcacggcgccaggugaugggcugca

SEQ ID NO: 349604 - RNA, 64 nt, Human
ugcuggugcagcguaaggacgaacuccuccagcaagcucgcaaacguuucuugaacaaaaguuc

SEQ ID NO: 349605 - RNA, 64 nt, Human
cgcucuguuuccucccagaagcaucucccagcuaagcucgcauuauuuuucuccucuggcuguu

SEQ ID NO: 349606 - RNA, 64 nt, Human
acagaccucguggguguaagaggaagccucugugagcucgcaccuuacugggugcaaaagaauc

SEQ ID NO: 349607 - RNA, 64 nt, Human
gggagccagcagggggcagcagaggccaacagggagcucgcaggccgggccccugcgucccugc

SEQ ID NO: 349608 - RNA, 64 nt, Human
uuaaagccacauuucagcaagagaaagcgcugagagcucgcagguucauuaaagaaggcaaagc

SEQ ID NO: 349609 - RNA, 64 nt, Human
ucagcugguggugucuccguccuuauccuagccuagcucgcagggugagaaccacuggaguggc

SEQ ID NO: 349610 - RNA, 64 nt, Human
ucgaggggguugggaagggagggagagggggcgcagcucgcaggcguggcaacuugaccuuggg

SEQ ID NO: 349611 - RNA, 64 nt, Human
cugcugaugagcuuuuuggugcucuccacacacaagcucgcaaacacacaugucccagaauagc

SEQ ID NO: 349612 - RNA, 64 nt, Human
gggaggaggccucuggggaagggguucccucccuccugaagaugaacacacaauacacggaaga

SEQ ID NO: 349613 - RNA, 64 nt, Human
cauuauaaaauuaauagcuaaucuuauucuaucuccugaagauuuaauugcuauuguuacccau

SEQ ID NO: 349614 - RNA, 64 nt, Human
accaguuaccugggaccaguaggugcccuuccagccugaagaucugggggcacaguauagccac

SEQ ID NO: 349615 - RNA, 64 nt, Human
gccagaaggagggggacaaccccccaagaccaucccugaagacgagcaucccccuccucucccu

SEQ ID NO: 349616 - RNA, 64 nt, Human
gccugccaccucucccagcccucagcauugucagccugaagaucagagcugcagccagucaggc

SEQ ID NO: 349617 - RNA, 55 nt, Human
agauggauaccucuaccugacauggccugaagaugcagggcagaggaauugccca

SEQ ID NO: 349618 - RNA, 64 nt, Human
augggcuggguaagaccuggcccuccccugcugcccugaagaccaccccagucuaccucggugc

SEQ ID NO: 349619 - RNA, 64 nt, Human
gacaggauggacuuuuaaugggcacuucugggacccugaagagacuucuucccuucaggcuuau

SEQ ID NO: 349620 - RNA, 64 nt, Human
acuggagaucacagaagucaagacugcaagcuccccugaagagaauccaacucaaccugcacac

SEQ ID NO: 349621 - RNA, 64 nt, Human
aggugaaggcccuccugcccuccauggugaagggccugaagaacauggaugggaugcugguggu

SEQ ID NO: 349622 - RNA, 64 nt, Human
ugcugugagcaagaagucaaaguaaaacuugcugccugaagaacaguaacugccaucaagauga

SEQ ID NO: 349623 - RNA, 64 nt, Human
gugcugaucugugacucccaguguucaccaccuuccugaagaccacgcucccucccccugccuc

SEQ ID NO: 349624 - RNA, 64 nt, Human
cagguguagggagcccagggaggccaaucagcccccugaagacucuggucccagucagccugug

SEQ ID NO: 349625 - RNA, 64 nt, Human
auagaagugaggggagcugcuccuccaucuucuuccugaagaagaaccuucucuccuuccucuu

SEQ ID NO: 349626 - RNA, 64 nt, Human
guucccccacaugcaggugguuuuucaguaggcuccugaagagugaucucaacuuuccaggaag

SEQ ID NO: 349627 - RNA, 64 nt, Human
gcagaggcagaauaugcugagugucuggagucagccugaagacacaggguggauuauuuccugg

SEQ ID NO: 349628 - RNA, 64 nt, Human
uguaggcuugcugaacagcacgcauuacuugcuuccugaagaguucccccauucauccauuugu

SEQ ID NO: 349629 - RNA, 64 nt, Human
ucagcuacaugugaccuccagcuuggugagguugccugaagauuagggaaaauaaaaauguccu

SEQ ID NO: 349630 - RNA, 64 nt, Human
ccuccgggggcuggaagccuggguggccggggccccugaagaaggcuccccucuguauccccca

SEQ ID NO: 349631 - RNA, 64 nt, Human
uguuucucaguacuuugaaguuauaacuaaucugccugaagacuucucaugauggaaaaucagc

SEQ ID NO: 349632 - RNA, 64 nt, Human
ucauacaguggcauuugggacacaaucguuggaaccugaagaaucugaaguuuuuuuuaccacc

SEQ ID NO: 349633 - RNA, 64 nt, Human
aagccaugcccauuggagcggagguuuaccacagccugaagaaugucaucaaggagaaauaugg

SEQ ID NO: 349634 - RNA, 64 nt, Human
aaaaguguuacagcugucaaagaaucuucauggaccugaagauaauuucuugugaaguugaaug

SEQ ID NO: 349635 - RNA, 64 nt, Human
cccucagacccuucugggcucugcccgcugggggccugaagacauuccuggaggacacucccau

SEQ ID NO: 349636 - RNA, 62 nt, Human
uguacauacauauuuuuaaaccauuaaaauucuuccugaagaaagcugauuccugacuuuua

SEQ ID NO: 349637 - RNA, 64 nt, Human
ugccgugucaagcccaggcagacgagaccucugcccugaagaccaacaccagcccgugggcugc

SEQ ID NO: 349638 - RNA, 64 nt, Human
uggugcucaggagcgaaggacugugaacuuguggccugaagagccagagcuagcucuggccacc

SEQ ID NO: 349639 - RNA, 64 nt, Human
ggacaggggccucuucuggcugucaggagcaaagccugaagacuuggagcugcaggacuggaag

SEQ ID NO: 349640 - RNA, 64 nt, Human
uuuacacaaaaauguauugaagcaacaaauauuuccugaagauccacccugggugaggcuuuga

SEQ ID NO: 349641 - RNA, 64 nt, Human
cucccugcccuuuuaauacagggacagggugucuccugaagauacuuagggaaaacaggagccu

SEQ ID NO: 349642 - RNA, 64 nt, Human
ccccauuuuaaccuucagcaugggagaugcaugcccugaagagcaggauccagaaggaagauuu

SEQ ID NO: 349643 - RNA, 64 nt, Human
cucuaggcuucggacacaaauaggcuccucuacaccugaagacaaaggcaaagucaaaugggga

SEQ ID NO: 349644 - RNA, 64 nt, Human
cugggcuagguauauuaaggguaguugccaauaaccugaagaagcuggcauuguuuacagaaac

SEQ ID NO: 349645 - RNA, 64 nt, Human
uuauacauuuccagaccauucaucaaggaaaggaccugaagaaguggaaagcacacuucauucu

SEQ ID NO: 349646 - RNA, 64 nt, Human
aguccaucucucuuagcuuuaguuuaucucucugccugaagacaggaaacaggcccaagugcau

SEQ ID NO: 349647 - RNA, 64 nt, Human
gaggugucauuccugcaggcaggaccuauaggcaccugaagauuugaaugaaacuauaguucca

SEQ ID NO: 349648 - RNA, 64 nt, Human
uccugccaacuuacagggguggggcucgaguugcccugaagaucauuaagaauguggagaagua

SEQ ID NO: 349649 - RNA, 64 nt, Human
uccuucaucuacugugaagugaaguuggcgcagcccugaagaaacuaccuaggagaacuaauag

SEQ ID NO: 349650 - RNA, 64 nt, Human
aucuaauauaauacuuguucaugagcacugaaauccugaagaggagagauuugguuauaaauua

SEQ ID NO: 349651 - RNA, 64 nt, Human
agaacagcugggccuccucacucaggacuucucuccugaagaacacgcagugcuaaaacugagg

SEQ ID NO: 349652 - RNA, 64 nt, Human
aauuuuuguuuuccccacauucuauagccauaaaccugaagaugaguaaaacuggugggucuuu

SEQ ID NO: 349653 - RNA, 64 nt, Human
gcagugacagcuucaagaacuuaacagccuugcuccugaagaacuggcugcccaggaagccaag

SEQ ID NO: 349654 - RNA, 64 nt, Human
cugaguugauuucugugucuauuucaacccauaaccugaagaaugaucaccuuauuccuuauuc

SEQ ID NO: 349655 - RNA, 64 nt, Human
uggucaucacggccaucauauucuaugugcuuccccugaagagugaggacccguguaacuggca

SEQ ID NO: 349656 - RNA, 64 nt, Human
ugaauggcccuuucaaugcauaguuacagaaauuccugaagauuccccaggacuucaauuucau

SEQ ID NO: 349657 - RNA, 64 nt, Human
uacaacuccacugccucacguuagcgggagcgcaccugaagaguacggggggagcccucucucc

SEQ ID NO: 349658 - RNA, 64 nt, Human
cuuaugaggucucaggcagugguggcagauuuuuccugaagagucuuuuuccugugucugccuu

SEQ ID NO: 349659 - RNA, 64 nt, Human
ccuguugugcucuuguaaaagaaaaauauaauuuccugaagaauaaaauagauauauggcacuu

SEQ ID NO: 349660 - RNA, 64 nt, Human
ggacuuauaauuucuguuguuucuaauuaaagucccugaagaucauauaccaaaguguuugaga

SEQ ID NO: 349661 - RNA, 64 nt, Human
gugacuaauggguagcaaucguauuauuugcuggccugaagagaaaaaaugguaaugugugccu

SEQ ID NO: 349662 - RNA, 64 nt, Human
caauguuugggaccaucuuagguauuccugcuccccugaagaaugauuacaguguuaacagaag

SEQ ID NO: 349663 - RNA, 64 nt, Human
guacuccuguugucuuuuucccugcuccuggugcccugaagagaccagcaagggggcagacccc

SEQ ID NO: 349664 - RNA, 64 nt, Human
uauuuaccuaguuuguauuuuccuacuuuagugaccugaagaugccugauaauuucauucagaa

SEQ ID NO: 349665 - RNA, 64 nt, Human
gcacuauggcaauuugaaugcuuagaauuuuaaaccugaagagacacugugaauucuuuuguuu

SEQ ID NO: 349666 - RNA, 64 nt, Human
ucgcaucucuacuaagguuuacacaggaauuccaccugaagacuuguguuaaaguucuacagcg

SEQ ID NO: 349667 - RNA, 64 nt, Human
uuuccagcaugcccuggggugcaguggucagccaccugaagagagagccaauagcaugggguuu

SEQ ID NO: 349668 - RNA, 64 nt, Human
cccucaggacuaggcagaggugaggcuggcucacccugaagaggugggauaggaccgggggacc

SEQ ID NO: 349669 - RNA, 64 nt, Human
cuauucaaugcauguaucguugccucugcacugaccugaagaacccugucuccaagucuuuggu

SEQ ID NO: 349670 - RNA, 64 nt, Human
cugguagacccaaggacuuggguggaucaggacaccugaagaagagaagcuuccggcaacccug

SEQ ID NO: 349671 - RNA, 64 nt, Human
ccuggaaaagcaccuuugcugccugucauuguugccugaagaaggcuggaguugcucugagagc

SEQ ID NO: 349672 - RNA, 64 nt, Human
auggucugcugugcagagagaggcaggaaggaucccugaagagucuuggagaaaagguucugug

SEQ ID NO: 349673 - RNA, 64 nt, Human
ccccuggauugccccaguccugugaccauguugcccugaagaagaccaucuucaugacugcuca

SEQ ID NO: 349674 - RNA, 64 nt, Human
gagaaaaguauucaggaagugggugugugggaaaccugaagauggcgugcacaggacacagcgu

SEQ ID NO: 349675 - RNA, 64 nt, Human
cuguacccucuguuuaaacuuuccguucucucaaccugaagauugagaccuugguggcugugcu

SEQ ID NO: 349676 - RNA, 64 nt, Human
aaaauaaauuccuucuaaaccacauuggaacugaccugaagaagcaaacucggaaaauauaaua

SEQ ID NO: 349677 - RNA, 64 nt, Human
cccacagaccgacccugaccccacucacagccacccugaagauagacuauaggaacgggcccau

SEQ ID NO: 349678 - RNA, 64 nt, Human
ugcacguauaaagcacucuaauuugguucugaugccugaagagaggccuaguuuaaaucacaau

SEQ ID NO: 349679 - RNA, 64 nt, Human
aggcaaacuuuaugaggcuuugaaaucuugccuuccugaagauagcugaguaggaugguucuaa

SEQ ID NO: 349680 - RNA, 64 nt, Human
uccuuuaguauccaaggggauugguuccaggacuccugaagaucccaaaaucugaggauacuca

SEQ ID NO: 349681 - RNA, 64 nt, Human
uucauauugcuucucccuuuaguucugcugucucccugaagagugaacccucuuuaguaaauga

SEQ ID NO: 349682 - RNA, 64 nt, Human
caacuugaaaaauauucucaaaauuauuaacuacccugaagauacuuugucuuuaggggaggag

SEQ ID NO: 349683 - RNA, 64 nt, Human
gacuaauauggaaaaggucuguccauagugguucccugaagacuggaauuacuucagcaaaacu

SEQ ID NO: 349684 - RNA, 64 nt, Human
ccaacucgccaaagaaaagauucaccauugcccgccugaagaagcccucaggggaaggaacuua

SEQ ID NO: 349685 - RNA, 64 nt, Human
uugcucuuggguccuucuagggcacugggaagagccugaagaugaggaaaaguuuggaggagca

SEQ ID NO: 349686 - RNA, 64 nt, Human
cacccaagguuucugauucugacccagcagugguccugaagagagcugauggcaagucuuguag

SEQ ID NO: 349687 - RNA, 64 nt, Human
gcucugggcacauuuccuguucuugaauucugcuccugaagagggugaacaaauggggcauuca

SEQ ID NO: 349688 - RNA, 64 nt, Human
cuuuuuaaguugggcuuuagaaaaucuggguuagccugaagaaaauugccucagccuccacagu

SEQ ID NO: 349689 - RNA, 64 nt, Human
cacugggauguucaagucuacuuuuuaguuucaaccugaagaggaaacucaguagguguugggc

SEQ ID NO: 349690 - RNA, 64 nt, Human
cauuggaagucuuggccagcaguccugaauccuuccugaagaguucagaaaauagaugugguau

SEQ ID NO: 349691 - RNA, 64 nt, Human
gacaucauucccugcccuggcagugacuuggagcccugaagaagggaccaaucaugggaccaca

SEQ ID NO: 349692 - RNA, 64 nt, Human
ucagcaggacaacccugaggcaaacuggaaguugccugaagauuuugcugugguguuuggagaa

SEQ ID NO: 349693 - RNA, 64 nt, Human
uuaacagguggccauugucgugaaacgagugaugccugaagaucucagugauguuugaaccuuc

SEQ ID NO: 349694 - RNA, 64 nt, Human
caugacugacaaaaacuccauggggccaaaucugccugaagaucauuaccaaaaauagcaggua

SEQ ID NO: 349695 - RNA, 64 nt, Human
uaugaagugaauagcauaugugucauuuagucucccugaagauucuuuucaagauccuguucag

SEQ ID NO: 349696 - RNA, 64 nt, Human
guuccuccauuuggaauucaaaaaggggagggauccugaagaaaucauauguuaaacauacuuu

SEQ ID NO: 349697 - RNA, 64 nt, Human
gugggcuggaguuaccaguagcuccagcaguuacccugaagagagauugggcuucagccuucag

SEQ ID NO: 349698 - RNA, 64 nt, Human
cagcucugcuaccugguaaugaaggaauacacauccugaagaucucgugacuauacuggcauuu

SEQ ID NO: 349699 - RNA, 64 nt, Human
uagggaccagugaccaucacaucccuucaagaguccugaagaucaagccaguucuccuucccug

SEQ ID NO: 349700 - RNA, 64 nt, Human
caccagcccugagccauggcggccccucagccugccugaagagaggaaacuggcgaucucccag

SEQ ID NO: 349701 - RNA, 64 nt, Human
ucugaacucuucugcugccugccuaggaaggaaaccugaagauuugggcagccugagucucuug

SEQ ID NO: 349702 - RNA, 64 nt, Human
uuuaggguggcuguggcucuuccucagccaggggccugaagaagcuccugccugacuuaggagu

SEQ ID NO: 349703 - RNA, 64 nt, Human
uucuguagguggucugcugugugaauaaauaauuccugaagaaugaagaagauuaauuuuggga

SEQ ID NO: 349704 - RNA, 64 nt, Human
uuugccucauugugcuauuugcccacuuuccuucccugaagaaauaucugaaccuucuuucugu

SEQ ID NO: 349705 - RNA, 64 nt, Human
ugccaguagcuauucucacugaugcacugauggcccugaagaagcggauccagucacauaggaa

SEQ ID NO: 349706 - RNA, 64 nt, Human
uuucuaagcuagaaccuuugagucccccaaacugccugaagacuuaaguuuugugggcacugga

SEQ ID NO: 349707 - RNA, 64 nt, Human
gugauagauuuggguaguaauuuaaagaugaguaccugaagaauucugcuucagaguauaauga

SEQ ID NO: 349708 - RNA, 64 nt, Human
aagcaugcuuucugaggagauaguggggauaaucccugaagaguuggcagugugagugcaacuc

SEQ ID NO: 349709 - RNA, 64 nt, Human
aaaaccagguuucuucuccccauaccacguugugccugaagaacaagccuucccguccuugccu

SEQ ID NO: 349710 - RNA, 64 nt, Human
agaaucaaagccuugucacauggauccucuggugccugaagaaaugagauuuuauuaucccucu

SEQ ID NO: 349711 - RNA, 64 nt, Human
uauauacauacaguguauauaaacaaaauugcacccugaagaugacagaguuuugucacagcuu

SEQ ID NO: 349712 - RNA, 64 nt, Human
agccucacuagaucaacggaccaaauaaacaauuccugaagacaguuuuucauaguguaggauu

SEQ ID NO: 349713 - RNA, 64 nt, Human
ccacccugccccucagagacugaaauuacggguaccugaagaugggagccuuuaccuuuuaugc

SEQ ID NO: 349714 - RNA, 64 nt, Human
aaaaguugugccucaaauuagaauagaacuugaaccugaagacaaugauuauuucuggaggagc

SEQ ID NO: 349715 - RNA, 64 nt, Human
agucugugagaaggagauacuuagacauuucuacccugaagaacuaaugacagcaaucauugga

SEQ ID NO: 349716 - RNA, 64 nt, Human
uuuaccaguuuccagaauuuccaguacaggaccgccugaagagagagccauuguucaauuccaa

SEQ ID NO: 349717 - RNA, 64 nt, Human
guaguugaaacacagaaaaugccacuuuucuguuccugaagaggcucuuuugugcauaauauuc

SEQ ID NO: 349718 - RNA, 64 nt, Human
uaagccuuggguauccugugaugggcugugucucccugaagauugucuggcuugcccacuucuc

SEQ ID NO: 349719 - RNA, 64 nt, Human
gcuuucucucauaacguaaugauuauaugacaauccugaagaaaccacagguuccauagaacua

SEQ ID NO: 349720 - RNA, 64 nt, Human
cuuaagacuauuuuaagaaauagagaugucauagccugaagauuuacugaagcuucugaacaug

SEQ ID NO: 349721 - RNA, 64 nt, Human
cauagcugcacaugcaaaaggacucggcuauuuaccugaagauugacuagcuacacuaaagaaa

SEQ ID NO: 349722 - RNA, 64 nt, Human
cuguuaauucauuucccccugaacaucaaauaugccugaagagaagaaagucuagauucuucua

SEQ ID NO: 349723 - RNA, 64 nt, Human
aaaaguuuaaauagcuuaauaucaauagaaugauccugaagacagaaaaaacuuugucacucuu

SEQ ID NO: 349724 - RNA, 64 nt, Human
ugugagauucuucuagugaaaaagaacagucuucccugaagacucagggcuucaacauucuaga

SEQ ID NO: 349725 - RNA, 64 nt, Human
caaaaucugauacaauauguuaaagaauuaagaaccugaagaugaagauuuagagcauauuuac

SEQ ID NO: 349726 - RNA, 64 nt, Human
accaauaucuguuucuuggugguuauguaaaagaccugaagaauuacuaucuagugugcagucu

SEQ ID NO: 349727 - RNA, 64 nt, Human
uguauugugacuaaguacaacuuuuggaaugauaccugaagaauuauuaguaauagaguuaaau

SEQ ID NO: 349728 - RNA, 64 nt, Human
ugauucccucucuuucuaguuugguaggaaucacccugaagaccuaguccucaauuuaauugug

SEQ ID NO: 349729 - RNA, 64 nt, Human
aauuuuagacacacuguguuaauaaaugacagaaccugaagaagucauaggaaagaaacuugag

SEQ ID NO: 349730 - RNA, 64 nt, Human
gcaaacugaauugagucaacuucugaagauaaaaccugaagaaguuacugggagcugcuauuuu

SEQ ID NO: 349731 - RNA, 64 nt, Human
ugcagucagccaagaucuugccacuguacuccagccugaagagcgagacucugucucaauaaua

SEQ ID NO: 349732 - RNA, 64 nt, Human
uaauuuaauaucuacucuccuacaaaagcucaagccugaagauacaagacuauuagaagaaaca

SEQ ID NO: 349733 - RNA, 64 nt, Human
gauauaacuucaauuaauuguaccacaugcuaauccugaagagauguguagaauuuuggaaagg

SEQ ID NO: 349734 - RNA, 64 nt, Human
agggguccuguuaacgucaucucaggguccagacccugaagauuucagaggcugcaggacuucu

SEQ ID NO: 349735 - RNA, 64 nt, Human
agcagucauggcccugaggugggucagcuacucuccugaagaaauaggucucuuuuaugcuuua

SEQ ID NO: 349736 - RNA, 64 nt, Human
guguagauuguuucagcuucucauguuucauuuuccugaagauuuauguuuuugucuaccuugu

SEQ ID NO: 349737 - RNA, 64 nt, Human
gcaguuaaggaaugggaaccagaguguuuuaggaccugaagaaucuuuaugacucucucucuuu

SEQ ID NO: 349738 - RNA, 64 nt, Human
cugcgaccacaagaaggaugauucaacagguuuuccugaagaauugaaaaaccauuuugcuguc

SEQ ID NO: 349739 - RNA, 64 nt, Human
aaugacaacuggugggaaaccuagcauuuccucuccugaagaauaaauguauaaauguuauuuu

SEQ ID NO: 349740 - RNA, 64 nt, Human
ccuggaaguccaccugucugguccauagugacguccugaagagccagucuguaaaauaaccaac

SEQ ID NO: 349741 - RNA, 64 nt, Human
acaagauuugauuacuuuaaugcauuaaauaggaccugaagaauuucuuguaauugaaaucuaa

SEQ ID NO: 349742 - RNA, 64 nt, Human
gaagaagaaaacacuaguaccuucagauccuaccccugaagauaaucuuagcugccaaguaaau

SEQ ID NO: 349743 - RNA, 64 nt, Human
ucccggauaauagauggguaaaaagucuaggcacccugaagaacaggugagacagcuggccucu

SEQ ID NO: 349744 - RNA, 64 nt, Human
aaaugagcacacccuucacacuguuaucaccuauccugaagaugugauacacugaauggaaaua

SEQ ID NO: 349745 - RNA, 64 nt, Human
cuucagugugauuuagaaaagggacagaucagccccugaagacgaggugaaaagucaauuuuac

SEQ ID NO: 349746 - RNA, 64 nt, Human
ugaugccucuugcugcuccccagaccccaucucuccugaagaccugccacggcaagguaugggg

SEQ ID NO: 349747 - RNA, 64 nt, Human
caauugcuuugcacuuuuccguuucagcggaagaccugaagaguggucagaacagagccuuuga

SEQ ID NO: 349748 - RNA, 64 nt, Human
ucuggacacugcagaggacccauggccauggaacccugaagaagcaugucuggccgccucugag

SEQ ID NO: 349749 - RNA, 64 nt, Human
ugacugggaccuccuuccaggagaucaugcacgcccugaagaugaccuggcacgugcacugcuu

SEQ ID NO: 349750 - RNA, 64 nt, Human
cugcccucucagugcaagacccggaugaggagcaccugaagaaaucaagguacagggacgggca

SEQ ID NO: 349751 - RNA, 64 nt, Human
aacaaaacaaaaaaacaccaaaaaaacccccaaaccugaagaaauucagauacacguguguaau

SEQ ID NO: 349752 - RNA, 64 nt, Human
gccuucauuugggaugcuacucuaguauuccagaccugaagaaucacaauaauuuucuaccugg

SEQ ID NO: 349753 - RNA, 64 nt, Human
cccugcacucacaggagccaauggggucacggugccugaagagggccugacacuucacagagug

SEQ ID NO: 349754 - RNA, 64 nt, Human
aauguguauguagguuuaugugaugggauaucacccugaagaguugugucuuuuguggccagug

SEQ ID NO: 349755 - RNA, 64 nt, Human
uggggccugggucagagcggugcugcccgugccgccugaagagcugcagccagaacagguggcu

SEQ ID NO: 349756 - RNA, 64 nt, Human
ugcaccuggccaagaagagacaucuugacuugagccugaagacuauguacagagacugaccuca

SEQ ID NO: 349757 - RNA, 64 nt, Human
uuaagcauuugauuuucuguguccuuaaguacuuccugaagaugaagcaaaauuuuaaucuggc

SEQ ID NO: 349758 - RNA, 64 nt, Human
ucuggccucccaugucagguagggugagagaggcccugaagauagaagccaggcccgaaggcca

SEQ ID NO: 349759 - RNA, 64 nt, Human
aggacggggcugugucugccucagacugggaaucccugaagauggggccgugucucccucaaag

SEQ ID NO: 349760 - RNA, 64 nt, Human
aggacggggcugugucucccucagacuggggcucccugaagaaagggcugcuucucccucagac

SEQ ID NO: 349761 - RNA, 64 nt, Human
aagaaagggcugcuucucccucagacuggagcucccugaagauggggcugugucccccucagac

SEQ ID NO: 349762 - RNA, 64 nt, Human
uuuagaugucucugaaaacagguuggaaagacuuccugaagaaaucaguggccugacuucauua

SEQ ID NO: 349763 - RNA, 55 nt, Human
agcgcacaggugggaauugaacacaccugaagaagacuugguuccugguaacauu

SEQ ID NO: 349764 - RNA, 64 nt, Human
uggauguaauuacugaagaaugagguuuuucauaccugaagaguaaaagaaaaacuaagagauc

SEQ ID NO: 349765 - RNA, 64 nt, Human
uauuucugcaccaugaaauuaaaaucaucucauuccugaagaugaauguaggaccagacauuuu

SEQ ID NO: 349766 - RNA, 64 nt, Human
uugaaaaugguuugugucuuacuaauaggacucaccugaagacucuacuuugccaagagggaau

SEQ ID NO: 349767 - RNA, 64 nt, Human
uuaaagaaaauagaaaugauuuagauuaaacaagccugaagauuaaacaguaaucauuuuuguc

SEQ ID NO: 349768 - RNA, 64 nt, Human
aaaccccugaaaugcucucagagcaccucugacgccugaagaaguuauaccuuccucuuccccu

SEQ ID NO: 349769 - RNA, 64 nt, Human
agaaagccugugcucuggcuggcugggccucuauccugaagagggaaggugcuagaaauuagaa

SEQ ID NO: 349770 - RNA, 64 nt, Human
gagcacagacaggcuccuagggugcugagugaagccugaagaccaagcccccuccuccuggaau

SEQ ID NO: 349771 - RNA, 64 nt, Human
gagcccacuuugaggagagcaaagcacaagcuugccugaagaauggaucccaacuucuccccgg

SEQ ID NO: 349772 - RNA, 64 nt, Human
cccuucccucacagauucuuuccccuccccuccaccugaagagaaggccuccaaguccuuuugg

SEQ ID NO: 349773 - RNA, 64 nt, Human
aauugguuauauuaggaauagucuguuuuucuuuccugaagaucaguuuuuuuauucaaacaca

SEQ ID NO: 349774 - RNA, 64 nt, Human
uaaaauacuaccaccacacaaucaucuuuuuuuuccugaagaaagcuuuuucuuuagcuaaaau

SEQ ID NO: 349775 - RNA, 64 nt, Human
aauuuaugcuacaacugguaacaaugaccagaagccugaagaauuaaaaugccaacaccaaacc

SEQ ID NO: 349776 - RNA, 64 nt, Human
gucauuuuuuaaacaacacucaacuuugugaaccccugaagauuuuuugaccguuccaagucuu

SEQ ID NO: 349777 - RNA, 64 nt, Human
ggcuuccuuggggcggggggagggcaccucagccccugaagacaagcagcacugcaguggcaaa

SEQ ID NO: 349778 - RNA, 64 nt, Human
auaauuguaaaucaucacagauuuugaauucacaccugaagacaugcucucacauauagaggua

SEQ ID NO: 349779 - RNA, 64 nt, Human
cuggguacugcuggccagaggacuuuagccuaccccugaagagccuguccaugucauuuuccua

SEQ ID NO: 349780 - RNA, 64 nt, Human
uggcugguuccaucuaguaccagaggccucuuuuccugaagaaauccaauccuagcccucauuu

SEQ ID NO: 349781 - RNA, 64 nt, Human
gccucugcagaggggaccucagccugucacuggcccugaagacuggccccacuucuggucucug

SEQ ID NO: 349782 - RNA, 64 nt, Human
uucggaugucuucuagacauuuacuaucacugcaccugaagaaaaaaucacuuuuaccuuccua

SEQ ID NO: 349783 - RNA, 64 nt, Human
ccgacugcucagugcaucuaaucacuuagacuccccugaagaaucccccauggaaacugcccuu

SEQ ID NO: 349784 - RNA, 64 nt, Human
caauguccauuuuaauggccuggaaugcaaaacgccugaagaauacaaaggauggucuguggga

SEQ ID NO: 349785 - RNA, 64 nt, Human
cuaacucagcaacucgcuuuaggucagcagccucccugaagaccaaaauuagaauauccaugac

SEQ ID NO: 349786 - RNA, 64 nt, Human
uagcuccuuuuaagcuagaaacguagccugagcuccugaagaguuccugggagauuugagcuga

SEQ ID NO: 349787 - RNA, 64 nt, Human
uuuagauuuuucaaauuggugaauuuuauuuuucccugaagagguuucuucacuauuaaucuua

SEQ ID NO: 349788 - RNA, 64 nt, Human
ggggaaugacgggccaaucuguguuuccuaagguccugaagaaucuggcaaagaguccuguggg

SEQ ID NO: 349789 - RNA, 64 nt, Human
gucauccaaagaacaucugcacuccugaacacacccugaagaaauccugggaauugaccuugua

SEQ ID NO: 349790 - RNA, 64 nt, Human
ucuccaguccuggcuccuuccuacauccugggcuccugaagaagcugucuucccauuuuccaug

SEQ ID NO: 349791 - RNA, 64 nt, Human
gcucaguuacgggguuuuuaaaccuucaugaaaaccugaagaguucacuuuuguuauuaugcuc

SEQ ID NO: 349792 - RNA, 64 nt, Human
gcagguauuucgggcccuccucuucaggaaucuuccugaagacauggcccagucgaaggcccag

SEQ ID NO: 349793 - RNA, 64 nt, Human
ccguucugaccucagccuuggaacuccucaagaaccugaagauuccaguggucagugucggugg

SEQ ID NO: 349794 - RNA, 64 nt, Human
cccaggcccaagagacccugaagagccugggugcccugaagaagugacucugggagggcccggc

SEQ ID NO: 349795 - RNA, 64 nt, Human
ggcugcagcagcagcugacccaggcccaagagacccugaagagccugggugcccugaagaagug

SEQ ID NO: 349796 - RNA, 64 nt, Human
ucuugaacaagagaaaaaacuaggagauguuucuccugaagagcuuuugggguugggaacuauu

SEQ ID NO: 349797 - RNA, 64 nt, Human
uuaauguagaauaacuccugaguuuauaucaaauccugaagaaauaagccucaguuuuccaucu

SEQ ID NO: 349798 - RNA, 64 nt, Human
uauguucaauacaucauuuaauuuuuuaaguuauccugaagaaggaaagguccuuaauuauuau

SEQ ID NO: 349799 - RNA, 64 nt, Human
uuucuaaacaauuuguugauuaagugaucaacaaccugaagaaaauaucaauuuuuaauugaca

SEQ ID NO: 349800 - RNA, 64 nt, Human
ggaaucccuucauucugcagugagauugccgagaccugaagaggguaagugacuugcccaaggu

SEQ ID NO: 349801 - RNA, 64 nt, Human
ccaaacacacuagauuucuguucuucagcaaagcccugaagagacacuuaagcuaaaaauuccc

SEQ ID NO: 349802 - RNA, 64 nt, Human
cugcaaagccugaggacacugggaauauauucuaccugaagaagcaaacugcccguucuccuug

SEQ ID NO: 349803 - RNA, 53 nt, Human
uuggcagggcaggaguauaacuuccugaagauggagccucaggagguggaguc

SEQ ID NO: 349804 - RNA, 64 nt, Human
uuggcugccucugcauggaaucuugccccggacuccugaagacugcacaaggaaugaggaagau

SEQ ID NO: 349805 - RNA, 64 nt, Human
uugaggcauuuuacuaaccuuauacccuuuuuggccugaagacauuuuagaauuuccuaacaga

SEQ ID NO: 349806 - RNA, 64 nt, Human
aacauaaggaggacuugggccuuucugacaucauccugaagagacaggacuuugcguuuuuccu

SEQ ID NO: 349807 - RNA, 64 nt, Human
uaacagugguggauacuguugcauaagaugagcuccugaagagugaagcuaauucuuuggucaa

SEQ ID NO: 349808 - RNA, 64 nt, Human
uuugucacaguacagcucuugucuuuaccaacugccugaagaggccauaugcuggcauuuugca

SEQ ID NO: 349809 - RNA, 64 nt, Human
cgggacugguuugggugggacaaaguuagaauugccugaagaucacacauucagacuguugugu

SEQ ID NO: 349810 - RNA, 64 nt, Human
auagauggucccagagcuaggugcugugucaggcccugaagacacagaugacucaaccuaagcu

SEQ ID NO: 349811 - RNA, 64 nt, Human
auuucccugguaguguagcuguguggcuuuccuuccugaagaguccgugguugcccuagaaccu

SEQ ID NO: 349812 - RNA, 64 nt, Human
ccagagucaguuucuaucccaauucucccugcagccugaagaacggauccuugucuccaauguc

SEQ ID NO: 349813 - RNA, 64 nt, Human
cugagauguugucuauagcuaugucuauaaacaaccugaagacuugugaaaucaauguuucuuu

SEQ ID NO: 349814 - RNA, 64 nt, Human
gaaaacucauuuucuuuucaagccucaggaccuaccugaagagaaguuuucuuguagcucaagu

SEQ ID NO: 349815 - RNA, 64 nt, Human
acacaaaccuauacuucauaugcugcuuuagucaccugaagaugguuggagaggcccugucgac

SEQ ID NO: 349816 - RNA, 64 nt, Human
gugaaggugcgcgccaggauguggacuacugagcccugaagaaauaaguccuuccacuuugacc

SEQ ID NO: 349817 - RNA, 64 nt, Human
uucugaaugagaagucugauuuuuggaacaguccccugaagaccaauguuggucggcagaauua

SEQ ID NO: 349818 - RNA, 64 nt, Human
caggaaaggggaaugaaucaacucuugguucuuuccugaagacggcaguguuguggauaaguga

SEQ ID NO: 349819 - RNA, 64 nt, Human
uaaaguccaagacauagguuuuucuaguuuauucccugaagaucuguugccacaguugggagau

SEQ ID NO: 349820 - RNA, 64 nt, Human
caguuuuaaagggaggaagaucagcaaauaugcuccugaagaaggcaacagauaugauggcauu

SEQ ID NO: 349821 - RNA, 64 nt, Human
cugacuauaaaaacaaaagugucaucauugaagcccugaagaggcagggaauugagcuucagca

SEQ ID NO: 349822 - RNA, 62 nt, Human
aaccuucuccgagccucugacagagaacacugccugaagacacacagcaauaagugauuaca

SEQ ID NO: 349823 - RNA, 64 nt, Human
gcucuguucagucugugucaggcaguaugcuuguccugaagagagguuuggcuauccccacccc

SEQ ID NO: 349824 - RNA, 64 nt, Human
uaaacauuugcuauuuucugcuuagaaaccacacccugaagacgugcugucuaugcaguuaugg

SEQ ID NO: 349825 - RNA, 64 nt, Human
aaaucaggcuuuuaaacauaaccacuaauauuuaccugaagauaaccaugaguaaaguauacuu

SEQ ID NO: 349826 - RNA, 64 nt, Human
cagcccacuguauaaacuuggauuguccauuccuccugaagaaaucaaguugguauuuuugaug

SEQ ID NO: 349827 - RNA, 64 nt, Human
uccgcacgccagaggccuugccuuucagaagaacccugaagaccgcuuugggguuuugccuguu

SEQ ID NO: 349828 - RNA, 64 nt, Human
caugaugaacucugccauagaaaacuuccuccagccugaagagaaggaugcacuggaggaagcc

SEQ ID NO: 349829 - RNA, 64 nt, Human
gaaaucccagggcaaauguuuacauuuuguauacccugaagaacucuuuuuccucuaauaugcc

SEQ ID NO: 349830 - RNA, 64 nt, Human
uucugaagagguacuuuccuggaauaauugucuaccugaagaaaaaaaauuuauauauacauug

SEQ ID NO: 349831 - RNA, 64 nt, Human
cccacaacuuaggcccuagcggcagaaaggaaaaccugaagacugaggacaaaguggaggaggg

SEQ ID NO: 349832 - RNA, 64 nt, Human
uuaaucagagcaucuagaguggccucuuguuuauccugaagauacugaugggucuuguuuucug

SEQ ID NO: 349833 - RNA, 64 nt, Human
ccgagugagguguagcagaaaaaggcugugcugcccugaagaauggcgccaccagcucugccgu

SEQ ID NO: 349834 - RNA, 64 nt, Human
uggcaccuauugagggugacagccacccagcccuccugaagauagccagagagcccaugagacc

SEQ ID NO: 349835 - RNA, 64 nt, Human
acccucaagcauacggcgcuguuccugccacuguccugaagaugugaaugggugguacgauuuc

SEQ ID NO: 349836 - RNA, 64 nt, Human
gucaaaacugguuuaggauuacuuagauuguguuccugaagaaaagaguccagguaaaugguau

SEQ ID NO: 349837 - RNA, 64 nt, Human
uguccaggcugugcuggacagcaccaccuucuucccugaagacgagcagcucuucuccuccaac

SEQ ID NO: 349838 - RNA, 64 nt, Human
acugucaucuaaaagccggcuacugucagcaaagccugaagaaguggggcuggauacccugccc

SEQ ID NO: 349839 - RNA, 64 nt, Human
gccauuccuaggcugagguccaggcagcccugccccugaagacccucuaggagcagggcaccca

SEQ ID NO: 349840 - RNA, 64 nt, Human
agugcccagcccacgagucccucacccacaucugccugaagagcuuuaaacugcacuucccucu

SEQ ID NO: 349841 - RNA, 64 nt, Human
aacacacacacaaacaagcucuaagcugcuguagccugaagaagacaagauuucuggacaagcu

SEQ ID NO: 349842 - RNA, 64 nt, Human
cacacccuuggcuugggcccaugcccagcgcaggccugaagaccacccucccgagaggaaccag

SEQ ID NO: 349843 - RNA, 64 nt, Human
gggagacuagagggcuacaggccagcguggaugaccugaagagcgcuccucugccuuggacacc

SEQ ID NO: 349844 - RNA, 64 nt, Human
augugaaacaccugaaaggccagaaugaggaagcccugaagagcuuaaaagaagcugaaaacuu

SEQ ID NO: 349845 - RNA, 64 nt, Human
ccuuuucucaccugucaucucacauuuucccuucccugaagaucuagugaacauucgaccucca

SEQ ID NO: 349846 - RNA, 64 nt, Human
aacucuaaacuuucucagauuaaaaguccugagaccugaagauuguaauauucaugucugugaa

SEQ ID NO: 349847 - RNA, 64 nt, Human
uuggcuuaucguuuuuaucucugaagggcaguagccugaagauaacagugcacaaggugggaaa

SEQ ID NO: 349848 - RNA, 64 nt, Human
ggccaggucccaauucccaaagcuccuggaagagccugaagacauugggaaaggcugggccugg

SEQ ID NO: 349849 - RNA, 57 nt, Human
cacagaggcucacccuuugaccacuuuccugaagagaaguucucuuuaugaauuaag

SEQ ID NO: 349850 - RNA, 64 nt, Human
cuccccccaacacacaguaggucacuccccaaccccugaagaaaguggcuuauuugagguuguu

SEQ ID NO: 349851 - RNA, 64 nt, Human
gccuguuagauuguuccagagucugcauggcacuccugaagaagggagugugaccugcagucac

SEQ ID NO: 349852 - RNA, 64 nt, Human
guggugccgggaccccagggcagccuccucgacuccugaagaaaaggcagugcccguggcugcc

SEQ ID NO: 349853 - RNA, 64 nt, Human
agcauaaagcuaaagugaaggcaaaaaacauuguccugaagaauagguuacaaaaaauaaacuc

SEQ ID NO: 349854 - RNA, 64 nt, Human
aaaagaauuggaaggaugugguguguaccuguagccugaagaacuggagagaggcacuggcuuu

SEQ ID NO: 349855 - RNA, 64 nt, Human
acugaacuuuucucauauuuucacauuucucaguccugaagaauaaggaaaacaaagcgacgcc

SEQ ID NO: 349856 - RNA, 64 nt, Human
ccucaccgcauuccaccugcaucccccacaucacccugaagaugacuuccugagccagccccca

SEQ ID NO: 349857 - RNA, 64 nt, Human
uaauuuuucuugcaauuguaaaucuuuugugucuccugaagacuucccuuaaaauuagcucuga

SEQ ID NO: 349858 - RNA, 64 nt, Human
cauuugccaggaagguaucuaacuuggcuuugugccugaagaacuguuucuugucuuucgcugu

SEQ ID NO: 349859 - RNA, 64 nt, Human
uuccggggcauccaguagaggguauggccugaagccugaagacucgccccacccaccacugccc

SEQ ID NO: 349860 - RNA, 64 nt, Human
cacugacugcccuuuuccaugugucuucauucugccugaagaaggcuuucccaggaugcacguc

SEQ ID NO: 349861 - RNA, 64 nt, Human
gaucugaggcucuagugggaaaccucagguagcuccugaagaucugugcuuuccaacaagugac

SEQ ID NO: 349862 - RNA, 64 nt, Human
ucuucugauugcuccuggggaaaacacgccuuguccugaagaacaaauggcuguccaguuuauu

SEQ ID NO: 349863 - RNA, 64 nt, Human
gagcuugguccugugaguuucugggcucuggccuccugaagaaccagccagaagaagaaaagua

SEQ ID NO: 349864 - RNA, 64 nt, Human
ugaggaauccuuuuaagauuauuagaaaacaugcccugaagagaguuguucuuagguuacacau

SEQ ID NO: 349865 - RNA, 64 nt, Human
aaaaaaaaaaaaaaaaaaaaaaaaaaaaaaaaagccugaagagaugagauaggaggaaagaccu

SEQ ID NO: 349866 - RNA, 64 nt, Human
gacauccacaucccaauucugacaagaccucaugccugaagacagcuugggcaggugaaaccag

SEQ ID NO: 349867 - RNA, 64 nt, Human
auaaauuuuguuuaagcaauuuauaaaucuaaaaccugaagauguuuuuaaaacaauauuaaca

SEQ ID NO: 349868 - RNA, 64 nt, Human
augcuuguauucuugcauuucaggguaaguaaacccugaagaaaucuuauuuuaguauagcuac

SEQ ID NO: 349869 - RNA, 64 nt, Human
aaaacgaguguggauuuaucuaaauggaggcagaccugaagauggcacuuaugccuggggcaaa

SEQ ID NO: 349870 - RNA, 64 nt, Human
aaguuccguauggagcucuggacuccuaaauuccccugaagaagaaaccaauguacuguggucu

SEQ ID NO: 349871 - RNA, 64 nt, Human
gucuccaucccugagccgccugccaccucccacuccugaagauccaucucuuggggcuccccug

SEQ ID NO: 349872 - RNA, 64 nt, Human
cacauuacauguuuaaucuggaaaccaaagagacccugaagaauauuugaugugaugauucacu

SEQ ID NO: 349873 - RNA, 64 nt, Human
cuuuuucucuccuaaaaaucgauaaguagcuccaccugaagagggauggaaccucugggucagg

SEQ ID NO: 349874 - RNA, 64 nt, Human
aaaacacauggugugaguccaaagaagguguuuuccugaagaacugucuauuuucucagucauu

SEQ ID NO: 349875 - RNA, 64 nt, Human
uguuaagugucuuuuuaaaaauuguuauuuaaauccugaagagcauuugggguaauacuuccag

SEQ ID NO: 349876 - RNA, 64 nt, Human
caacuucucccugauuccucauccguuuuuuaagccugaagagcuuauuacuuauuugugcgaa

SEQ ID NO: 349877 - RNA, 64 nt, Human
uccugacagcacuccucggcaggcauggcuggugccugaagaccccagaugugagggcaccacc

SEQ ID NO: 349878 - RNA, 64 nt, Human
cauuugggcaaaaauugagccucacaauaaacacccugaagacacaacuugacuuauaacauag

SEQ ID NO: 349879 - RNA, 64 nt, Human
aaccuguaucagaagaacauccuucucugcuugaccugaagaagggccagaccugggcagaaag

SEQ ID NO: 349880 - RNA, 64 nt, Human
gaauucuucauccuccacgguucacuagcuccuaccugaagaggaaagggggccauuugaccug

SEQ ID NO: 349881 - RNA, 64 nt, Human
gaguagaucauaugacuauuggcugggauuaucuccugaagaagauuccacucgugguaugaga

SEQ ID NO: 349882 - RNA, 64 nt, Human
aguaaaacuuauuuagagcuacagaagacaaaacccugaagaguuaagaacaaacgcaaggaaa

SEQ ID NO: 349883 - RNA, 56 nt, Human
uaaagaaagagggcagcuaacucuguccugaagagugggacaaaugcagccgggcg

SEQ ID NO: 349884 - RNA, 64 nt, Human
cacucucucggagcucacuuuauuuuuauugguuccugaagacgggacaaggaacaaauacaua

SEQ ID NO: 349885 - RNA, 64 nt, Human
guguuaagagaaauuacucucacaagagcagaggccugaagauucuuucuucugaaagccaagc

SEQ ID NO: 349886 - RNA, 64 nt, Human
uugcuuggcguagauaacaauacacugaaauacuccugaagaugguggugcuuauugacuacaa

SEQ ID NO: 349887 - RNA, 64 nt, Human
agguggggacaggggcaggggcaggggcggagccccugaagaaggaaucccagccggguucggg

SEQ ID NO: 349888 - RNA, 64 nt, Human
uauuaucaaugcagaacagcuguggagacucuaaccugaagaucuauaccaaacgucgucugcu

SEQ ID NO: 349889 - RNA, 64 nt, Human
cuauccagacaagacaaaauaaaacucaccaucuccugaagaccuuucuuaccuuuuuuuaaaa

SEQ ID NO: 349890 - RNA, 64 nt, Human
cagguugacaguuggaggacuucaccguaccaacccugaagagauuguauuacacauuaaggac

SEQ ID NO: 349891 - RNA, 64 nt, Human
ccuaccauccaauguggaaggaaaacaagaacugccugaagaagaguccaagcuacagauacac

SEQ ID NO: 349892 - RNA, 64 nt, Human
uuugcuggugguccccucugaccacaagcuucugccugaagauuccucaggucaacaccaucau

SEQ ID NO: 349893 - RNA, 64 nt, Human
acccagacccaccacccguacacccucagcagacccugaagacuugcuuuuaaacaaagaaaau

SEQ ID NO: 349894 - RNA, 64 nt, Human
gagcaugcugccaggggagcuggauggugaaacaccugaagaucucauaucgccucucaaaaca

SEQ ID NO: 349895 - RNA, 64 nt, Human
cgagaagccaagugaugcuggggaggauggcgcgccugaagacgcagccgaggugggagcacgg

SEQ ID NO: 349896 - RNA, 64 nt, Human
ccuggucauguggagcuuuccuuccuggaccaggccugaagaggguccuggggguggaccaaag

SEQ ID NO: 349897 - RNA, 64 nt, Human
cccaaggagacugagaugggaggaucccuggagcccugaagauugaggcuacagugagccuuga

SEQ ID NO: 349898 - RNA, 64 nt, Human
gaggacuucugaaauuaauccuuaaaacaaacuuccugaagaccgaaaaguugaaugauuuauu

SEQ ID NO: 349899 - RNA, 64 nt, Human
ucuaacaggaggacauugguuugggggugcaccuccugaagaauggguggggaaggcuuucucu

SEQ ID NO: 349900 - RNA, 64 nt, Human
gaugccugaguccucccaauuucagacucccauuccugaagaaccaguccccccacccucauuc

SEQ ID NO: 349901 - RNA, 64 nt, Human
gagaagcagagaaggcacuugcauccuaugcagcccugaagaccaggcuccuuugggcaaaagg

SEQ ID NO: 349902 - RNA, 64 nt, Human
gcagucaggccuguugacucuaagcagcagacauccugaagaaaugguaaggguggagccaaau

SEQ ID NO: 349903 - RNA, 64 nt, Human
gcuuucugccuuagccuaccaugugaaacucuacccugaagaaagggauggauaggaaguagac

SEQ ID NO: 349904 - RNA, 64 nt, Human
ucccagcucuucacccaggucuccucuuccucucccugaagaaaccaucaugagagagauacuc

SEQ ID NO: 349905 - RNA, 64 nt, Human
ucuucucugguucauguccaccacugacugggacccugaagaggcauuucagaguguuggagaa

SEQ ID NO: 349906 - RNA, 64 nt, Human
agugggaccuugacuggagaaacuccacgaucuuccugaagaagagaaauggauguuuccaaau

SEQ ID NO: 349907 - RNA, 57 nt, Human
cagucuauucaaggcauugagaauguaccugaagagcuccuggauaaaaauuauuca

SEQ ID NO: 349908 - RNA, 64 nt, Human
guauaaauguaauaaucaaacaggaggauaacgaccugaagaaaaugagaaaauaaaauauuuc

SEQ ID NO: 349909 - RNA, 64 nt, Human
cucuguauauugagaccuuggcauaauuggugauccugaagaaagaggucucucuccuaagucu

SEQ ID NO: 349910 - RNA, 64 nt, Human
cuacugucuguuuauuuaacacaacaauugaaugccugaagaaguugcaguggcuuuauuauau

SEQ ID NO: 349911 - RNA, 64 nt, Human
uuaguauacuuccaguggaagaccugagaggguaccugaagagauaccgggaaaauauuggaaa

SEQ ID NO: 349912 - RNA, 64 nt, Human
ggagagaggagcuugcccuucugggguccugguuccugaagagcucacccagagaggcucaaag

SEQ ID NO: 349913 - RNA, 64 nt, Human
agcagauggugaccaggcucuggagaaggcaaggccugaagaugggagauuccuaaguggagga

SEQ ID NO: 349914 - RNA, 64 nt, Human
aucagguguacgaggggaucaccuucgaggacuuccugaagaucuggcaggggaucgacauuga

SEQ ID NO: 349915 - RNA, 64 nt, Human
uuguuuacucauccugcccuguaaugucuguaauccugaagauggaauaaauuguaacauuuag

SEQ ID NO: 349916 - RNA, 64 nt, Human
gggagcaggauguggcccuggccucgccagagcaccugaagaagcaggccgugagcgaggcugc

SEQ ID NO: 349917 - RNA, 64 nt, Human
uauaucccaagugcacuuucuaauguuucuggguccugaagaauuaagauacaaauuaauuuua

SEQ ID NO: 349918 - RNA, 64 nt, Human
ugcauuuuuuagcucugaagauuccuuagguaucccugaagacagcucgcucagaugaucagca

SEQ ID NO: 349919 - RNA, 64 nt, Human
gaaggcaauaccaaccugaaaguuccuucuguagccugaagaguuuguaaaugacuuucauaau

SEQ ID NO: 349920 - RNA, 64 nt, Human
auucaauuucaaacucucuaauuguggguuuucuccugaagaauuuuuuuucacauacuuucca

SEQ ID NO: 349921 - RNA, 64 nt, Human
uagauaucacucucaacuugucauucugccaugcccugaagaaaaccaacauugaaucuuucau

SEQ ID NO: 349922 - RNA, 64 nt, Human
cccuggcccuguaggcuguguuauaugacaucauccugaagaacuucgagaagcucaagaagcc

SEQ ID NO: 349923 - RNA, 64 nt, Human
aaucaaaugggaaucuggggacccaacacaacauccugaagauuauuaaaaggaaaagaugcug

SEQ ID NO: 349924 - RNA, 64 nt, Human
cagauuaucuuuacucccucuuucucauggcaacccugaagauaaucaaggccaguuacucauc

SEQ ID NO: 349925 - RNA, 64 nt, Human
uuuucugugccauccuuuaagucuuugagaggggccugaagagccuccgggcuccugggacauu

SEQ ID NO: 349926 - RNA, 64 nt, Human
auaaaaacuguuugaauaauuagaccuuuacauuccugaagauaaacauguaaucuuuuaucuu

SEQ ID NO: 349927 - RNA, 64 nt, Human
ugauuaguuuagggaucucuggaaaugucaguuuccugaagagccaagcacuuugugaauucug

SEQ ID NO: 349928 - RNA, 64 nt, Human
ucuacccuggguccucgggccccugagccuguguccugaagaaucucgacucucgugauaugcu

SEQ ID NO: 349929 - RNA, 64 nt, Human
auggucugacagggucccuuuugcuggagguguuccugaagagauugaaccuaguaacaggcuu

SEQ ID NO: 349930 - RNA, 64 nt, Human
uuuagauuuucagcuugauggauuuucaguuuuuccugaagaauuuucuuuaccauuagucuuc

SEQ ID NO: 349931 - RNA, 64 nt, Human
cgcacacccgccugccuggccgcaggugguucucccugaagacccccacaugugccauaucccu

SEQ ID NO: 349932 - RNA, 64 nt, Human
gaauaaugauaccccuugugcuagagaugcaaagccugaagacacugguagcuuuuaauaauua

SEQ ID NO: 349933 - RNA, 64 nt, Human
cuaagaauccauagccauggcucuguaagcuaaaccugaagagugauauuuguacaauagcuuu

SEQ ID NO: 349934 - RNA, 64 nt, Human
cucacuuguggccuuugauuaaauuccuaaggggccugaagaagacauuucuacugcagagggu

SEQ ID NO: 349935 - RNA, 64 nt, Human
acccuguggccuucagggcucagagcagcaaaggccugaagagugagcucuggggguuguuggu

SEQ ID NO: 349936 - RNA, 64 nt, Human
gcauaacgccucacaucccaagucuauacccuuaccugaagaaugcuguucuuuccuagccacc

SEQ ID NO: 349937 - RNA, 64 nt, Human
agugcucggggacccuuugaaaagugccuggggaccugaagagcaccggggaauuuguaacccc

SEQ ID NO: 349938 - RNA, 64 nt, Human
gcuugaaaaugcugcaaaugacccucuaaugaucccugaagaucaaaacagggguaaaugacuc

SEQ ID NO: 349939 - RNA, 64 nt, Human
uggcuccaaucuguggaccaguauuucagcuuucccugaagaucaggcagggugccauucauug

SEQ ID NO: 349940 - RNA, 64 nt, Human
cgaugggggcucggacuccagcucggagucugagccugaagagccccaaagcaggaagaagcuc

SEQ ID NO: 349941 - RNA, 64 nt, Human
cgugucacagccagauuucagcuuugaguuauucccugaagaagccacaccaaccuugcuuuca

SEQ ID NO: 349942 - RNA, 64 nt, Human
uauuaaauuaagaaaauguuccaaaagccauaagccugaagauuggcccugugcacgcacgcac

SEQ ID NO: 349943 - RNA, 64 nt, Human
agguccuuaacacagucgugaacaaacacaaggaccugaagacacacggguucacacuggaguc

SEQ ID NO: 349944 - RNA, 64 nt, Human
auggaaacccucaaagcagaaaagggaggaagauccugaagauucucuuaugaagcuccaaaau

SEQ ID NO: 349945 - RNA, 64 nt, Human
guguacccauacugcagccccaucccauggggccccugaagacccacugaggaauuccguaggg

SEQ ID NO: 349946 - RNA, 64 nt, Human
uggaauguggaucugguagugagccaucuuggacccugaagaggaggcaacacaccauuguaga

SEQ ID NO: 349947 - RNA, 64 nt, Human
uugcugaggagugaggaauaguugagccccaaguccugaagaggcgggccagccaggcgggcuc

SEQ ID NO: 349948 - RNA, 62 nt, Human
uucgccuccgcuuggguuagggcuucuuguggccugaagagaaaguucauucacagagacug

SEQ ID NO: 349949 - RNA, 64 nt, Human
gacuaggcuuccccaggcaugccguccgugggggccugaagagacagugagugccauuggcccc

SEQ ID NO: 349950 - RNA, 64 nt, Human
gucuguucagccaggacaacaaauggcuuccaagccugaagaauacaaaagugugcuuguguuu

SEQ ID NO: 349951 - RNA, 64 nt, Human
cuagucuuauuauucagauggagaacuuagaaaaccugaagaguacccaaauuggauuguauuu

SEQ ID NO: 349952 - RNA, 64 nt, Human
gcaagcuugaugcaaaaccuccugaccuuuccuaccugaagagcccuuugacuucuaggaagaa

SEQ ID NO: 349953 - RNA, 64 nt, Human
ccccucccucucucauggcuggguggcugguguuccugaagacccagggcuacccucuguccag

SEQ ID NO: 349954 - RNA, 64 nt, Human
aagccuuguccccaccacacaggacagccuuccuccugaagagaaugucuuuguguguccgaag

SEQ ID NO: 349955 - RNA, 64 nt, Human
gugcccucucaguagacacuggagcugcucugucccugaagaggccccgugccccaggcauggc

SEQ ID NO: 349956 - RNA, 64 nt, Human
acugaggcagacacucccagucagcccgcucgauccugaagaucgugugaaggaagcguucuug

SEQ ID NO: 349957 - RNA, 64 nt, Human
cugggaggaggggaugcucccagggcuggggcugccugaagagaauggcacgcaccuuguaggc

SEQ ID NO: 349958 - RNA, 64 nt, Human
cagcucaggaguaagggaagagguccucuggcccccugaagaugagaaucaccccucucagugc

SEQ ID NO: 349959 - RNA, 64 nt, Human
cagguggggcagcuugaggguugggcuggugucaccugaagacucauucuucuguacgucugac

SEQ ID NO: 349960 - RNA, 64 nt, Human
uccuacccucgucccuaccuguccugauccugguccugaagaccccucggaacacccucuccug

SEQ ID NO: 349961 - RNA, 64 nt, Human
uuggugcuggugguugugguggcagaugauauuaccugaagaagggacgaaugggugcugggca

SEQ ID NO: 349962 - RNA, 64 nt, Human
acuguucauucuuaucuucugcuaguuaauauagccugaagacagaggauaaauaguugucaau

SEQ ID NO: 349963 - RNA, 64 nt, Human
agaaauccuguccucuuggugggagguuaccuuaccugaagaccaucucucccaagcacuguag

SEQ ID NO: 349964 - RNA, 64 nt, Human
auuuuggcuaggcaucguggaaccagcuccagccccugaagaaacgauagaugugcagguugug

SEQ ID NO: 349965 - RNA, 64 nt, Human
ggcauauggcugggagucccuuagcaaggccaacccugaagaggcccuuugaggcauucccuau

SEQ ID NO: 349966 - RNA, 64 nt, Human
ggugcuguccucacucgccccuggcccagaggcuccugaagaugcugggcgguccuggcacagg

SEQ ID NO: 349967 - RNA, 64 nt, Human
caccugcuccuuggaccccccagucuguggccacccugaagaaugugcagaaacacuugugugg

SEQ ID NO: 349968 - RNA, 64 nt, Human
auuggcucagcuugggucagggcagagccuguuaccugaagagaggugagaccaaggccacagg

SEQ ID NO: 349969 - RNA, 64 nt, Human
auguagaagcuuagcugccucagagaagagagaaccugaagaucugaggcaagcuggacaggag

SEQ ID NO: 349970 - RNA, 64 nt, Human
ggccuaguucaagcugaccaauggcagaggacugccugaagaguaaaacugugugaacaaugac

SEQ ID NO: 349971 - RNA, 64 nt, Human
uuucuucaccucauguuaagagaagggaguguguccugaagaagcccuucuucugauguuaaaa

SEQ ID NO: 349972 - RNA, 64 nt, Human
guuugguguguccuccgccuuaccaggagaagaaccugaagaacuauuuuucguuauugguuuu

SEQ ID NO: 349973 - RNA, 64 nt, Human
gcauagucugagcugacgccucugcuuuccuccaccugaagagaaccugcgugcugcuccuuug

SEQ ID NO: 349974 - RNA, 64 nt, Human
acaguaguaguuucuuuuguauuuuguauauucgccugaagaucaucccgcaaggcaggcugga

SEQ ID NO: 349975 - RNA, 64 nt, Human
accccaucugaggucuuggcugagguuggcaucuccugaagaacagagagcacgguguccagag

SEQ ID NO: 349976 - RNA, 64 nt, Human
aguuucuguaccacaccagggccuugcuucagggccugaagacauucauuuucccucaugucgu

SEQ ID NO: 349977 - RNA, 64 nt, Human
gggguuaaggugggcauccuccagguacaacgagccugaagagccccuuucagugcagacgggg

SEQ ID NO: 349978 - RNA, 64 nt, Human
cuggggggccaggccacgagggccagggcuucugccugaagauggagcugcagccugcggggaa

SEQ ID NO: 349979 - RNA, 64 nt, Human
gccacacaucauugcugggagaauuaagcauuauccugaagacucugccaggagaggauaauug

SEQ ID NO: 349980 - RNA, 64 nt, Human
ugugccuuuuguaggcuguucccuuugccuuaaaccugaagaugucuccucaagccugugggca

SEQ ID NO: 349981 - RNA, 64 nt, Human
gcugcuaaacccuaucccccagccuccccccugcccugaagaucuuccauuugcuuccacucag

SEQ ID NO: 349982 - RNA, 64 nt, Human
cuguugcuagaaguuggguuguucuggauuuuccccugaagacuuacuuauucuuccgucacau

SEQ ID NO: 349983 - RNA, 64 nt, Human
uuaaaggucucccacaagacugguauucucuuugccugaagaaacaaggcauugaaucucuaaa

SEQ ID NO: 349984 - RNA, 64 nt, Human
gugagaagccagcuuuccucaucaggccauugucccugaagagaagggcagggcugaggccucu

SEQ ID NO: 349985 - RNA, 64 nt, Human
cgaagaacuuguaaggccaacugcggcgggaggcccugaagaugcagucccccaccuguguccu

SEQ ID NO: 349986 - RNA, 64 nt, Human
ggguaagaaguuaggggguuguuuauuaagaaccccugaagagcaacccuuuaccacucucuua

SEQ ID NO: 349987 - RNA, 64 nt, Human
gagcagggcacaaaggggcugcaguuugggagcuccugaagaaauggcucagauauugagucag

SEQ ID NO: 349988 - RNA, 64 nt, Human
cugggagggaaccuguuagucuccccaccucuucccugaagagacaggcaccccucccagccgu

SEQ ID NO: 349989 - RNA, 64 nt, Human
ccugggucaacaucuuagacccgguccugcccuuccugaagaagaucccagaggaugucacaaa

SEQ ID NO: 349990 - RNA, 64 nt, Human
cccucucuccaagacucuggcaguggccuaugauccugaagacagcucugcagccaacuggugc

SEQ ID NO: 349991 - RNA, 64 nt, Human
gguggggcggggguggucccacagcuggguuccaccugaagagccuccgugccucggagcagga

SEQ ID NO: 349992 - RNA, 64 nt, Human
cagaguaugggcaaaugcuucuggaaaacccuucccugaagagagagaacgugugugugugugu

SEQ ID NO: 349993 - RNA, 64 nt, Human
ugauauuuauucuuucuguccccacguuguggcaccugaagacaucuucaaaauuggcagaaaa

SEQ ID NO: 349994 - RNA, 64 nt, Human
ugucacaagagguggcguguaaggaaugcagcccccugaagacagcacuacaagucugggggag

SEQ ID NO: 349995 - RNA, 64 nt, Human
ucauuuugcaaacuacccagagcuccaaggacagccugaagaucucagugccucaggcucugag

SEQ ID NO: 349996 - RNA, 64 nt, Human
ugaacgugcaauuagauucguugucauggucacaccugaagaccuuaaagccaaugcaggugag

SEQ ID NO: 349997 - RNA, 64 nt, Human
ugcugauaugcacggggaguugaaagggugggugccugaagauguugugcccugagucauugac

SEQ ID NO: 349998 - RNA, 64 nt, Human
ccaaggagggugagugcaaggggcgugggaguggccugaagaguccucugaaugaaccuucugg

SEQ ID NO: 349999 - RNA, 64 nt, Human
gucucaggccaaauugcagaggguccuccaggguccugaagagcacuggacuaagagucuagug

SEQ ID NO: 350000 - RNA, 64 nt, Human
ucucaccugggugcugagggcugccugggccccuccugaagaacagaaagguguucaugugacu

SEQ ID NO: 350001 - RNA, 64 nt, Human
acaguauuguugugauggccaucugcuggaaacuccugaagagcauuauguauuacagugagca

SEQ ID NO: 350002 - RNA, 64 nt, Human
ucacccugauuucuugcuuauucacugaaguucuccugaagaggaacugggccuguugcccuuu

SEQ ID NO: 350003 - RNA, 64 nt, Human
acugguucaggcucaaccuuccaacuuccuguggccugaagaagcacuucugcugcaucgcugu

SEQ ID NO: 350004 - RNA, 64 nt, Human
agacuacuugggagcaccgccugugaaauaccaaccugaagacaccguucauucaggcaacgca

SEQ ID NO: 350005 - RNA, 64 nt, Human
gaauuaaaaggauaguauuuuuauccaugacaggccugaagauauuacuacuuaccauuugcua

SEQ ID NO: 350006 - RNA, 64 nt, Human
ggaaaaaaacaaccacuugcaaucauucaauaacccugaagaauuugguuccugaguguacaaa

SEQ ID NO: 350007 - RNA, 64 nt, Human
ggguuccuguggggggaaguccaugccucccuggccugaagaagagacucuuugcauaugacuc

SEQ ID NO: 350008 - RNA, 64 nt, Human
uaaaguugaagccagcuguguguagcagcuguuaccugaagacgugcuaccucucuacaaagug

SEQ ID NO: 350009 - RNA, 64 nt, Human
guggcucaucggcuucccucuuaaccuuuagugcccugaagacugcugccgcugucaccguugc

SEQ ID NO: 350010 - RNA, 64 nt, Human
uaucaagagggcugggcauucucugcugguaauuccugaagaggcaugacugcuuuucucagcc

SEQ ID NO: 350011 - RNA, 64 nt, Human
ugccucaauccuucaaaugcaugcugggacucacccugaagagaagcccuacgaguguaagcaa

SEQ ID NO: 350012 - RNA, 64 nt, Human
gugguuuuauuuccuaauugauuuaagaaauaaaccugaagaccgucuggugccugcugggagc

SEQ ID NO: 350013 - RNA, 64 nt, Human
ggaacuucucacucauuggcuucuuucccacacaccugaagagcacugacugugugccgggcac

SEQ ID NO: 350014 - RNA, 64 nt, Human
ccuguccugcgggguggcccuggcagaaccacugccugaagaaccagguuccugcccggucagc

SEQ ID NO: 350015 - RNA, 64 nt, Human
gaaauuggaugccuucacaaggcucagugacaaaccugaagaagauuggaggaaccuugaagag

SEQ ID NO: 350016 - RNA, 64 nt, Human
aauauaaaugaucaccuuucauugugaauauaugccugaagauaauguguggaaggauauuugc

SEQ ID NO: 350017 - RNA, 64 nt, Human
ugaacccuacagaaauaugggccugcugccauuuccugaagaccggggcaucggggugggguga

SEQ ID NO: 350018 - RNA, 64 nt, Human
ggaaguuauuaaagaggcugcaaaguccagccacccugaagauacuccccagugcuccccuccu

SEQ ID NO: 350019 - RNA, 64 nt, Human
ggaugcucugagauucaggguggggcuggcaaccccugaagagaacacuuccuguuggucuguc

SEQ ID NO: 350020 - RNA, 64 nt, Human
accuaggcccagccccucagccucaucuggagccccugaagaccagucccacccaccuuucugg

SEQ ID NO: 350021 - RNA, 64 nt, Human
ugugauugagaccuacugucccauugugagguggccugaagaaucccagcuggggcaguggcuu

SEQ ID NO: 350022 - RNA, 64 nt, Human
ccuccuccauuccucucucccugcccuuuuccugccugaagagcagaggugaggaccugggacc

SEQ ID NO: 350023 - RNA, 64 nt, Human
ucggaggcucgaggucuaagagaaacgcugaguuccugaagagccacagacagggugggugauu

SEQ ID NO: 350024 - RNA, 64 nt, Human
ggggagccugggccccuuccagccgugggcaaacccugaagacaccccugccccccuccagaga

SEQ ID NO: 350025 - RNA, 64 nt, Human
ggcuggacaggcacugucagccaaugugggggguccugaagacacccccuuggggcacccgagu

SEQ ID NO: 350026 - RNA, 64 nt, Human
cugccccggccagaacgggcagggcugccacugaccugaagacuccggacugggaccccacucc

SEQ ID NO: 350027 - RNA, 64 nt, Human
uugagcauggauacagccaggcccagagcaagacccugaagacccccaaccacggccuaaaagc

SEQ ID NO: 350028 - RNA, 64 nt, Human
agacaagcagaggucucuauuggauuucucaacaccugaagaaaguugcaguguuuuccucuug

SEQ ID NO: 350029 - RNA, 64 nt, Human
uauauuccagagucagaucuaagcuccaggcacgccugaagauguguugcuacucugacauccc

SEQ ID NO: 350030 - RNA, 64 nt, Human
uucaugggcccagaagauuauguacugagagaauccugaagaauggaacagcuguagaaagccu

SEQ ID NO: 350031 - RNA, 64 nt, Human
ggcaaauguuaauuuuccuagaaaauccuucagaccugaagacgcaggaaaagaaucuggcucu

SEQ ID NO: 350032 - RNA, 64 nt, Human
guggcuuuugaagacacuggguugggaccuuuuuccugaagagagcuggguguagccagagcua

SEQ ID NO: 350033 - RNA, 62 nt, Human
cccuucccaauaaagccugcuaccuggcaguaccccugaagagaucugcguccucucaaggu

SEQ ID NO: 350034 - RNA, 64 nt, Human
gaggaccucaggaggccagcagaacccgcaggcuccugaagacuggccacgccuccugagacca

SEQ ID NO: 350035 - RNA, 64 nt, Human
uggucccuuacaaacuaacugugccccuggggucccugaagacuggcuaguccuggcagaacag

SEQ ID NO: 350036 - RNA, 64 nt, Human
caccgugaagaggaagcggaagagccggugggggccugaagaggauaagguagagcucccaccu

SEQ ID NO: 350037 - RNA, 64 nt, Human
uggcugaucagucauccaccaggaacgaagauuuccugaagaagaccuggucccucuggagguu

SEQ ID NO: 350038 - RNA, 64 nt, Human
agguggaggcccggggagaggcaccugagguggcccugaagaugccccgccuuaguuuuccccg

SEQ ID NO: 350039 - RNA, 64 nt, Human
cuguggcaucacuaaguauaagaccugcucucuuccugaagaccuauaagcuggagguggacaa

SEQ ID NO: 350040 - RNA, 64 nt, Human
acuucauuaggugaggauuauuucucuccaagcuccugaagaaaaaagacucugccuuuuaaaa

SEQ ID NO: 350041 - RNA, 64 nt, Human
uggaggugcggcagcugcugcucaggugccaugcccugaagaggcaggguacacauggggcugg

SEQ ID NO: 350042 - RNA, 64 nt, Human
ggacuucuuccugugccagguccaagucgggggaccugaagaaucaaucugugugagucuguuu

SEQ ID NO: 350043 - RNA, 64 nt, Human
gaaauccaucauaccauuaccucauccugugaggccugaagacauugaauaacccugggcagug

SEQ ID NO: 350044 - RNA, 64 nt, Human
agcacgugcaaaggccccgagacuggaguguguuccugaagagcagccaggaggccagcauggc

SEQ ID NO: 350045 - RNA, 64 nt, Human
uggggcuggauaaccggagaccccaugggaggucccugaagaucagaaggggcuucacgcuucu

SEQ ID NO: 350046 - RNA, 59 nt, Human
gauacaagaggaggaaguagcugucguggccugaagaaauucaugggggcagcccuuaa

SEQ ID NO: 350047 - RNA, 64 nt, Human
ucccucacccuccgggcugagccuggcucuaggaccugaagaacucucgaaggacccagcccug

SEQ ID NO: 350048 - RNA, 64 nt, Human
ggcuguuggccuagaagucgccggaugcacuagcccugaagagggguguccaugacauggccug

SEQ ID NO: 350049 - RNA, 64 nt, Human
uuugccauuuguuucuguagguuaaucccuauauccugaagaagaacaugauccucaugacaaa

SEQ ID NO: 350050 - RNA, 64 nt, Human
ucuuaaaauuccaaacaaaaugaucccugcauuuccugaagauguuuaaacgugagagucuggu

SEQ ID NO: 350051 - RNA, 64 nt, Human
cugcagaguugagaguugggugagguuagucucuccugaagaaaaagccuauaaaaaguggcua

SEQ ID NO: 350052 - RNA, 64 nt, Human
acagcaugccacugagcaaggagagaugggugagccugaagauggucccuuugguuucuggggc

SEQ ID NO: 350053 - RNA, 64 nt, Human
uugcaucauaguagcccagacacauuuucuggguccugaagauaauuuuuauugauagguauau

SEQ ID NO: 350054 - RNA, 64 nt, Human
cguaagacucuguauuuggaugccaauccacaggccugaagaaacugcuuguuguguaucagua

SEQ ID NO: 350055 - RNA, 64 nt, Human
caugaggcgagaucaaucccucaagauuuuaaauccugaagaaauugagaaguauguugcugaa

SEQ ID NO: 350056 - RNA, 64 nt, Human
ucagccaccugcagcucuucaucaagagggugguccugaagacuccggccaagaggcacaagca

SEQ ID NO: 350057 - RNA, 64 nt, Human
ugcgacauccugaaagcucagcugccugggcauuccugaagaguauggaauauuuaaaugaaac

SEQ ID NO: 350058 - RNA, 64 nt, Human
uccaguguagauggccauuccuaacuuguuugugccugaagauggacuugauucaaaugguuua

SEQ ID NO: 350059 - RNA, 64 nt, Human
ugggguggugcaggguggacuuggggacccuaccccugaagacugaggcccugcagcuaccagg

SEQ ID NO: 350060 - RNA, 64 nt, Human
uucucuggccaggcccuucccugacccaauaaauccugaagagguuguuaugucuucauuucug

SEQ ID NO: 350061 - RNA, 64 nt, Human
accuugauuuaacagaggcaaaaugcaagucuucccugaagaauacuggggguagggaaacuuc

SEQ ID NO: 350062 - RNA, 64 nt, Human
caugggaccagcaugggggcagguuaucuguuggccugaagagugaaaccuguaccaggccaaa

SEQ ID NO: 350063 - RNA, 64 nt, Human
caguggccgagguguggcucuuauugcauccaucccugaagauguguggcuguugcugucaccu

SEQ ID NO: 350064 - RNA, 64 nt, Human
cacgcugcagggcucuugcugccauggucucaagccugaagaggcuccgcccacaagcuggccc

SEQ ID NO: 350065 - RNA, 64 nt, Human
gguuccuagguccuguggacaucacagcuucaggccugaagagcagagaagcccuguucucugc

SEQ ID NO: 350066 - RNA, 64 nt, Human
cugacuccuauggugaccucucagaugccagcgaccugaagacgccagagaagcagagugccaa

SEQ ID NO: 350067 - RNA, 64 nt, Human
ucuucaguguucuucccccuccauguugccugccccugaagaccuuugaguucagucuacaccu

SEQ ID NO: 350068 - RNA, 64 nt, Human
cccuaccauccauaccacugugcugaccgcucagccugaagagcagagaaugccauggguggga

SEQ ID NO: 350069 - RNA, 64 nt, Human
ucgaaguaggcccuggcaggcagcugggagccauccugaagagcuguaacaugcaggccuggaa

SEQ ID NO: 350070 - RNA, 64 nt, Human
agcuuugagauaucugcacauaaaauuauuauuaccugaagaaaauaaggcugcauuuugaaau

SEQ ID NO: 350071 - RNA, 64 nt, Human
ccagagccccuccccaagcuccccuccccaagcuccugaagacccgguuucugagggagggaaa

SEQ ID NO: 350072 - RNA, 64 nt, Human
gacaaacaagcccugaggagggaucugcaacaacccugaagacaacaaggaaagaaaccaugaa

SEQ ID NO: 350073 - RNA, 64 nt, Human
aucaaauaaaaagggcaacuuuuaaaauauuaagccugaagacuucuaaaaagacaagaaacau

SEQ ID NO: 350074 - RNA, 64 nt, Human
gaaaacaauguuaaggauguauuuauuccccuacccugaagaaaguguaggauagaauuguuuu

SEQ ID NO: 350075 - RNA, 64 nt, Human
cccuaagcagccagccauggccuggguggaggcaccugaagacgucugucccaaacucccccag

SEQ ID NO: 350076 - RNA, 64 nt, Human
gaggaguaaagaaaacugaagaauuuaaaguuuuccugaagacaguaauaaugcagacacaaac

SEQ ID NO: 350077 - RNA, 64 nt, Human
ccaaaguuaacuugcaggccacaggacauagccaccugaagagccaguuguucuguguauuugc

SEQ ID NO: 350078 - RNA, 64 nt, Human
cugaccuaaaucucuuugccuaacaacuugggauccugaagauaaauauguguuggacaagcau

SEQ ID NO: 350079 - RNA, 64 nt, Human
gauuggguccaugugauccucagguuuggggucuccugaagaugcuauuucuagaauuaguaua

SEQ ID NO: 350080 - RNA, 62 nt, Human
ccauuauggggacuuugguuugacccaggggucagccuuaggaaggccuucaggaggaggcc

SEQ ID NO: 350081 - RNA, 62 nt, Human
caggucucacccugcuugaagcgcagaaggcacagccuuacugaccagcacgcccacugacu

SEQ ID NO: 350082 - RNA, 62 nt, Human
accucuucugcuucaguugaggugacacgucucagccuuagcccugugcccccugaaacagc

SEQ ID NO: 350083 - RNA, 62 nt, Human
uucugccaacauguaaaaccuuugaguacauccagccuuaguucuuggggugcaguaguaug

SEQ ID NO: 350084 - RNA, 62 nt, Human
ccucucugaaagccccagaggaccagagcccccagccuuaccucucaaccuguccccuccac

SEQ ID NO: 350085 - RNA, 62 nt, Human
ccaauugcaaaaaaagucugugccaguaauuucagccuuauaauuagcaaaaacaucuucca

SEQ ID NO: 350086 - RNA, 62 nt, Human
accacaaaaacccugguuagccaucucaugcucagccuuaucacuucccucccuuuagaaac

SEQ ID NO: 350087 - RNA, 62 nt, Human
uguucccaaaguauucccuauuguuggcuccacagccuuaaagugcuauagauuuaaauuca

SEQ ID NO: 350088 - RNA, 62 nt, Human
gggacccgaauuagacacugcugaauccuguacagccuuacucauaaauaaaguacuuacug

SEQ ID NO: 350089 - RNA, 62 nt, Human
ugcugucauuucuccacuugccaguuuaauuccagccuuacccauugacucaaggggacaua

SEQ ID NO: 350090 - RNA, 62 nt, Human
cccaucucccaucugggauagggaccuuccaucagccuuaacccugggaaaugccugcugcc

SEQ ID NO: 350091 - RNA, 62 nt, Human
auggugaagccagccacgguuuuccccagggccagccuuaagguaucuaauaaagucugaac

SEQ ID NO: 350092 - RNA, 62 nt, Human
cccuuguugcuguagaugugcgugcagucuggcagccuuaagcccaccugggcacuuuuaga

SEQ ID NO: 350093 - RNA, 62 nt, Human
gguuugaucagguuuucucuuugaagagaccacagccuuaggaaaugguucuugaucuauac

SEQ ID NO: 350094 - RNA, 62 nt, Human
uuauucaguauuucuccaaguugcuaucuacucagccuuaugaaugccccucgcuuuucuaa

SEQ ID NO: 350095 - RNA, 62 nt, Human
uucugccauuugagcagcuuacuggaaagauccagccuuacuugucuuaaauuguccaacaa

SEQ ID NO: 350096 - RNA, 62 nt, Human
uuggguugcccuuggcuucuccucccucuacucagccuuaaaaagggcuucuuggaacuuua

SEQ ID NO: 350097 - RNA, 62 nt, Human
auccuacucuuugguagucucugcagcagccacagccuuagcagagcugggguuccugucuu

SEQ ID NO: 350098 - RNA, 62 nt, Human
uagagguaggauaucccugauuccugggcucccagccuuaaaacucacugccucccccaagg

SEQ ID NO: 350099 - RNA, 62 nt, Human
gugccuaacaccccuacugaaccccacagcuccagccuuaguuuuuggagucaaguguuaaa

SEQ ID NO: 350100 - RNA, 62 nt, Human
uugguccuucuaucacuaaaacucaucucauucagccuuacagcauaacuaauuauuuguuu

SEQ ID NO: 350101 - RNA, 62 nt, Human
ugucauauuccaguuauucuagaaguucaggacagccuuagcaucugaaaaagaagcccauu

SEQ ID NO: 350102 - RNA, 62 nt, Human
ggcggccagugcuguuagagugcugccaagcacagccuuauuucugccggggccuccccacc

SEQ ID NO: 350103 - RNA, 62 nt, Human
auaauguaaaaccucaaaagcaagggcuucaacagccuuaaccaaauauuauuccccauagc

SEQ ID NO: 350104 - RNA, 62 nt, Human
aaggcuaaaauuugaggaauauaacuaauuuucagccuuaagacauuuaaguuuggaagucc

SEQ ID NO: 350105 - RNA, 62 nt, Human
uggguguuagcacugugguggucucugguccacagccuuagguaaacaacuuagauucugag

SEQ ID NO: 350106 - RNA, 62 nt, Human
gcaucuacucuuuggcacuuuuucacauaagccagccuuagagacuagacaaauaacuacug

SEQ ID NO: 350107 - RNA, 62 nt, Human
auaucucagcagagaagccagugguggccacgcagccuuauaaagcagguuuugguuucuac

SEQ ID NO: 350108 - RNA, 62 nt, Human
agaacuuagccuuuaccugugaaguguuacuacagccuuaauauuuuccuaguagaucuaua

SEQ ID NO: 350109 - RNA, 62 nt, Human
gaaugacaauagugcccccguuuuuagcagaccagccuuaacucuggguuugaauccuaagg

SEQ ID NO: 350110 - RNA, 62 nt, Human
augccuuaaaacauacucugccgaucuaauuacagccuuauuuuuguaugccuuuugggcau

SEQ ID NO: 350111 - RNA, 62 nt, Human
cagccuuguuauuggguuucaugccccuggaccagccuuaucucagaccugcuuaccugcau

SEQ ID NO: 350112 - RNA, 62 nt, Human
gugucguuauaaugaggagagucaaaaacaugcagccuuaagccucagcaaagagcauaauc

SEQ ID NO: 350113 - RNA, 62 nt, Human
guaggccuuauguugauugggaugcuccccuacagccuuacagguagaauagaaggugaguu

SEQ ID NO: 350114 - RNA, 62 nt, Human
guacaccuggggauuucuuuugauuucaagaacagccuuaaucauuccaguuugauuuacgu

SEQ ID NO: 350115 - RNA, 62 nt, Human
augauccugaagcuuacuaugcagccuacaaacagccuuaguaauuaaaacauuuuauacca

SEQ ID NO: 350116 - RNA, 62 nt, Human
gugauaauuuggggaauaugugcacgcuuguucagccuuaaugugacuugaagauguggagg

SEQ ID NO: 350117 - RNA, 62 nt, Human
auugcucuuuuaacauacagugcuugaauauacagccuuaacaauguuaaucaucuccuugg

SEQ ID NO: 350118 - RNA, 62 nt, Human
cuuauuaccuaaacuugucuggcucccaggaacagccuuauagagagagggaguauuguauu

SEQ ID NO: 350119 - RNA, 62 nt, Human
gggacccugagguuggcaaggcucucaccacucagccuuauggucccuuaucuccuaucuuc

SEQ ID NO: 350120 - RNA, 62 nt, Human
uauguauucuuuugugccuggcuucuuucucucagccuuacauuugugagauuccucuguau

SEQ ID NO: 350121 - RNA, 62 nt, Human
cuccaggccguggacuucccccaacuuggggacagccuuauucccaaaugucucuauccuuu

SEQ ID NO: 350122 - RNA, 62 nt, Human
ugccccucaugaucucccacuuucucuagcugcagccuuaaauuagcuucuuugcccacccu

SEQ ID NO: 350123 - RNA, 62 nt, Human
uguuuuauacuguuugauaagaaaaguagguccagccuuaagcagcacagaugcgcugguag

SEQ ID NO: 350124 - RNA, 62 nt, Human
guucuuaauuuuacuugcacaagcaguguucacagccuuauucugaagugaccacuuuucuu

SEQ ID NO: 350125 - RNA, 62 nt, Human
acauauauuaccaggcuuuacuguauuucacucagccuuaaauguuauaauauuuuuggaua

SEQ ID NO: 350126 - RNA, 62 nt, Human
agggcagaguacaagcccagcacccagugucccagccuuacuggguccuuacccugggccaa

SEQ ID NO: 350127 - RNA, 62 nt, Human
gauuugagguuucccccugucuccuuauucggcagccuuaugauuaaacuuccuucucugcu

SEQ ID NO: 350128 - RNA, 62 nt, Human
uuuaugcauuaaauaaaaauauguuccacuaccagccuuacuuguuuaauaaaaaucagugc

SEQ ID NO: 350129 - RNA, 62 nt, Human
uuuuaacaaaaucaucuuaaaaugcuacccuucagccuuacccuuuaauggaaaaaugaaag

SEQ ID NO: 350130 - RNA, 62 nt, Human
guguagaaaaucacagagaagcaguuuugcaccagccuuauuccugugccuuguuuuccucu

SEQ ID NO: 350131 - RNA, 62 nt, Human
ggcucagggaugagagggcaccgcaaggcacccagccuuaccccacaagcaggaauccugcc

SEQ ID NO: 350132 - RNA, 62 nt, Human
gcacaguuuuuuaaagcaacuguacaauuucucagccuuaugagcuugcuguauuucuuggu

SEQ ID NO: 350133 - RNA, 62 nt, Human
gcccuggggccucugccucucgucugaccuugcagccuuagucguuggaggcuggagcgcaa

SEQ ID NO: 350134 - RNA, 62 nt, Human
agcauucuguuuaucgcucacucucccuuguacagccuuauuuuguuggugcuuugcauuuu

SEQ ID NO: 350135 - RNA, 62 nt, Human
agaggauuuggcugaccagcuugcuuguccaacagccuuauuuuguuguuguuaucguuguu

SEQ ID NO: 350136 - RNA, 62 nt, Human
uacagcacuuccauuaacuuuugaaagcaacacagccuuaaacucaaugcuuuugcuuuaug

SEQ ID NO: 350137 - RNA, 62 nt, Human
cacugagcacccagacucaggcuuggguuccccagccuuauuggaaggcagcucccgcauac

SEQ ID NO: 350138 - RNA, 62 nt, Human
auuuuacggucccuccgcaggggagcggccuccagccuuauucuccaccgcucggaucugug

SEQ ID NO: 350139 - RNA, 62 nt, Human
uauucaaauuaauucuuacagcuugagcauaucagccuuauuaccagagcaaauccuuccuu

SEQ ID NO: 350140 - RNA, 62 nt, Human
ccuggucccuucuagguguggucccauaggagcagccuuagcauccccugugaacuuaucaa

SEQ ID NO: 350141 - RNA, 62 nt, Human
aaauguaaugaaaaaucucaagguuggaaauacagccuuacucucucuagagcuggaggaca

SEQ ID NO: 350142 - RNA, 62 nt, Human
uucaaaguagaaucacuacaagugucucacuucagccuuagaaaagcccucaauguaaaccu

SEQ ID NO: 350143 - RNA, 62 nt, Human
gugcugggaucacaggcaugagccaccgaacccagccuuauucugcuuaaauuuaacguguu

SEQ ID NO: 350144 - RNA, 62 nt, Human
uccuauuguaagugauaugagaaaucuuuaaccagccuuaucuaaaaauaaaaagagaagcc

SEQ ID NO: 350145 - RNA, 53 nt, Human
cccagcagagccugcauugauaacagccuuaacccucgaggaauaccucaaua

SEQ ID NO: 350146 - RNA, 62 nt, Human
uuguuuuuuagccaguauuugcccuuucuauccagccuuaugaauaauagcaguaaaaucac

SEQ ID NO: 350147 - RNA, 62 nt, Human
gugugguauacucuugaugguuagaacucuuacagccuuauuuauuuuuaaguuuguuacag

SEQ ID NO: 350148 - RNA, 62 nt, Human
gcuuuccaggcuaaucacuuagggcagagacccagccuuauucaucucuacuuccugauguc

SEQ ID NO: 350149 - RNA, 62 nt, Human
uuucuaggcccgucaccuagggcucuccuguucagccuuaacaggcucagcaaaucagggcg

SEQ ID NO: 350150 - RNA, 62 nt, Human
aggcuacuuccuuuaacgaagugccuuuaauucagccuuauccaacuagggaaaauaauguu

SEQ ID NO: 350151 - RNA, 62 nt, Human
uggggcauuuaauucugacuuuauccccacgucagccuuaauaaagucuucuuuaccuucuc

SEQ ID NO: 350152 - RNA, 62 nt, Human
ucacaucauuauaucuggcuuccuauaaacaacagccuuaauucagucaagacucccuuugg

SEQ ID NO: 350153 - RNA, 62 nt, Human
acccacacuggugguuauuacagcaugguucccagccuuacagugucuaagugcuucucuug

SEQ ID NO: 350154 - RNA, 62 nt, Human
ucauacaguaauuugugcaguugggagauguucagccuuagucccuggcuaauugccuguuc

SEQ ID NO: 350155 - RNA, 62 nt, Human
ugggaagaagcauguuuauugaaacuguccuucagccuuaaauacaaaaauaaaacugaaac

SEQ ID NO: 350156 - RNA, 62 nt, Human
uguuuucucguucucccuccccaccccacucccagccuuaucuauccccccucacugucccc

SEQ ID NO: 350157 - RNA, 62 nt, Human
caggggcuagacacaggcuucucguaagaacacagccuuagaggcaccugagcaacucaaag

SEQ ID NO: 350158 - RNA, 62 nt, Human
acccaccagaguggaacccgcugcaaaauccccagccuuaauucuugcuucaggacccagac

SEQ ID NO: 350159 - RNA, 62 nt, Human
cgcagccggccacacuggagcagcucccagcacagccuuacgcgcccgacgcgcgccacccg

SEQ ID NO: 350160 - RNA, 61 nt, Human
ugcagagucuguuaaaguagauguugcacaccagccuuacagcugggagccuuugccaugg

SEQ ID NO: 350161 - RNA, 62 nt, Human
guuaauuuugauccgguggaggugguacucaacagccuuauucaugaggcuuagaaaacaca

SEQ ID NO: 350162 - RNA, 62 nt, Human
gaauuguaccgccuguacuuuuuugaaccauccagccuuaauucgcugugaacagugugaga

SEQ ID NO: 350163 - RNA, 62 nt, Human
gcagggccagauggaguuggccugcagggagucagccuuaccccaucagagaccaacuugaa

SEQ ID NO: 350164 - RNA, 62 nt, Human
ugcaucacuugcaaaaacgaucucaaaagugucagccuuagauaaacguucagcauuaaaaa

SEQ ID NO: 350165 - RNA, 62 nt, Human
uggacuuaaacaucuuauuuaucugauaaacucagccuuaccuuguggaaucugaagauuga

SEQ ID NO: 350166 - RNA, 62 nt, Human
uccuaugaagcucugagaauuuuuuguacgaucagccuuacugcuaauaaaagcacuuccac

SEQ ID NO: 350167 - RNA, 62 nt, Human
gacucuuuaugaucuggcccuugcuuaccucucagccuuagcucucccaacucuugcacagu

SEQ ID NO: 350168 - RNA, 62 nt, Human
cauuuauuggggaaggucuucaguugagcucucagccuuaggaaggaagcacguggaggagg

SEQ ID NO: 350169 - RNA, 62 nt, Human
caacguugcuauuuccacccauuuguuuucggcagccuuaaggcccucauucucauuucggg

SEQ ID NO: 350170 - RNA, 62 nt, Human
uugcuaguuguuugggcuuuaacauccuuauucagccuuauccagguugguuuugcuguuga

SEQ ID NO: 350171 - RNA, 62 nt, Human
uuccuuuaagccauuuuugucuccugugaauacagccuuaucuccaccuguuucuuagaucc

SEQ ID NO: 350172 - RNA, 62 nt, Human
ggcaaaucguugaauuuucccagaaaucacaccagccuuagaaagcgucaaggcaaguggau

SEQ ID NO: 350173 - RNA, 62 nt, Human
uauauuuuaagucagcugucaaggggagaccacagccuuaguaugacauccugcacaauuug

SEQ ID NO: 350174 - RNA, 62 nt, Human
cuaaucaugccuauuaaggauguaagacauuacagccuuagaagaaagauugugaaaagcug

SEQ ID NO: 350175 - RNA, 62 nt, Human
ugagccucaugucugguauauauuuuaccaaacagccuuaaaauauauuuggaagcaaaaau

SEQ ID NO: 350176 - RNA, 62 nt, Human
gauggagauaacuugucuuuaaaacuguaggccagccuuagccacuguggagcccuugccuc

SEQ ID NO: 350177 - RNA, 62 nt, Human
ggcacugaccuguagugaaaggccacaggacacagccuuauuacugcuggggugggauaagg

SEQ ID NO: 350178 - RNA, 62 nt, Human
ugagccaaaaacaauaaacgaaacacagaacucagccuuaagaaagcuauauaugaauaauu

SEQ ID NO: 350179 - RNA, 62 nt, Human
cuuuucaguuacaagacccaucucccuagucucagccuuacaacaccacgggacuaaggaag

SEQ ID NO: 350180 - RNA, 62 nt, Human
gugcuggaauuacaggcgugagcuacugugcccagccuuacggacauccuuuugaauuaucu

SEQ ID NO: 350181 - RNA, 62 nt, Human
agaggccuuccuagaagaugcaucuagagugucagccuuaucaguguuuaagauuuuucuuu

SEQ ID NO: 350182 - RNA, 62 nt, Human
agaggccuuccuugaagaugcaucuagacuaccagccuuaucaguguuuaagcuuauuccuu

SEQ ID NO: 350183 - RNA, 62 nt, Human
ggcugagagaguauaaauaacccugggcuguccagccuuaauagacuucucuuacauuuucg

SEQ ID NO: 350184 - RNA, 62 nt, Human
aucauauucagagucuggggcuguguguugagcagccuuaaggaugcuagacacucauuuag

SEQ ID NO: 350185 - RNA, 62 nt, Human
uccccuagaaaaacaacucuacaaaaauuuugcagccuuauucauuauaauuuugauaaaau

SEQ ID NO: 350186 - RNA, 62 nt, Human
cauagacauuuuuaaaggguuaauuuauuguucagccuuaucccuuggcacguaaacagacu

SEQ ID NO: 350187 - RNA, 62 nt, Human
guacuccuagggcuugacccugguacccagcccagccuuagcacccagcaugugaccccacu

SEQ ID NO: 350188 - RNA, 62 nt, Human
cuuuauaauguccuucuucauugcugagagggcagccuuagagcuguggauuucugcauccc

SEQ ID NO: 350189 - RNA, 62 nt, Human
acaacucauuauaaggaauacuuuuaguuugacagccuuauaugacaugaaugaaaacugcu

SEQ ID NO: 350190 - RNA, 62 nt, Human
agguauugccugaaaaacaagugaugucugugcagccuuacacucugucuuuacagaagcaa

SEQ ID NO: 350191 - RNA, 62 nt, Human
auaguucuuuguaaccugugugaagcagcagccagccuuaaaguaguccauucuugcuaaug

SEQ ID NO: 350192 - RNA, 62 nt, Human
acaggguucagcagguuccccaaaaggcugcccagccuuacagcagaugcugaaggcagagc

SEQ ID NO: 350193 - RNA, 62 nt, Human
uuccuuuggcagguuggggaagggcuugcccccagccuuaggauuucaggguuugacugggg

SEQ ID NO: 350194 - RNA, 62 nt, Human
aagucagccccaucuuggcugaucaggguguucagccuuaaccccaccuguguucugaaguc

SEQ ID NO: 350195 - RNA, 62 nt, Human
cugaaagcagaaccuggccucccuggccacagcagccuuacccaccgcucuacgugucccgg

SEQ ID NO: 350196 - RNA, 62 nt, Human
ugaugguuggguguuuuuccuuuaaauucucucagccuuacacucacagaagccaacuuucc

SEQ ID NO: 350197 - RNA, 62 nt, Human
aggauuaacguuguuuuaguuuggguccagaucagccuuauacaacauuucuaaacucauuu

SEQ ID NO: 350198 - RNA, 62 nt, Human
aaagccauuggagcuccaauucgugacccacucagccuuauccacggagcuggagccaaccu

SEQ ID NO: 350199 - RNA, 62 nt, Human
cuccuccucuuccccaacccccagaccaugaccagccuuagaaaauccauguacucuguugu

SEQ ID NO: 350200 - RNA, 62 nt, Human
ccucuuccucuccuccagcauucuccucugagcagccuuagauaguguccauggcuggagcc

SEQ ID NO: 350201 - RNA, 62 nt, Human
ggcugacacccccauucccucucuucuuccaccagccuuaugcaucuaaguguagcuccucu

SEQ ID NO: 350202 - RNA, 62 nt, Human
gaaagagaaaagaaaagaaaagcaaccacagccagccuuagggaaaacuuggaaguaaguga

SEQ ID NO: 350203 - RNA, 62 nt, Human
auuuccuuuccaugguuauggucgauugccaacagccuuauaaagaaaaagaagcuuuucua

SEQ ID NO: 350204 - RNA, 62 nt, Human
ggcuuaaaacuugagaauauauauuuggaauacagccuuagaacgguuucuguacacaccca

SEQ ID NO: 350205 - RNA, 62 nt, Human
agccagccaggaaauuaaaguggcgacuaaaacagccuuaagaauugcaguggagcaaauug

SEQ ID NO: 350206 - RNA, 62 nt, Human
uccuuuuugcugcaucacccaggcaacacucccagccuuacucaggaguggugaacauuuuc

SEQ ID NO: 350207 - RNA, 62 nt, Human
cuuguguuugaccuuuucagccauauauuguacagccuuauagaaucuaagcuggucuuaaa

SEQ ID NO: 350208 - RNA, 62 nt, Human
gcagaguuagccagaaaugccuccugcugccccagccuuagagagcucccaucucaaucauu

SEQ ID NO: 350209 - RNA, 62 nt, Human
acaguauuuuucucaaacaaaaacucagaauccagccuuagagguauauauuugaaugaaag

SEQ ID NO: 350210 - RNA, 62 nt, Human
uacugacugaccagucuagguugaaagauaggcagccuuacccagaacacaacauuagcagc

SEQ ID NO: 350211 - RNA, 62 nt, Human
aggcggaucaccugaggucgggaguucgagaccagccuuaccaacauggagaaaccccaucu

SEQ ID NO: 350212 - RNA, 62 nt, Human
gaggucugucaccacccacagccacccuacagcagccuuaacugugacacuugccacacugu

SEQ ID NO: 350213 - RNA, 62 nt, Human
ugaagaugacuuccugagccagcccccagccacagccuuagagcugcgggaacaccgagacc

SEQ ID NO: 350214 - RNA, 62 nt, Human
uuuuggucuaaagagcugacuuguuugaaauucagccuuaaauuaagcucuuaguuguucag

SEQ ID NO: 350215 - RNA, 62 nt, Human
caugaagaccacugaaugaacaccuuuucauccagccuuaauuucuugcuccauaacuacuc

SEQ ID NO: 350216 - RNA, 62 nt, Human
gcggaaggcccaccgugccagaggcugggcaccagccuuaacccucacucugcuagcaccuc

SEQ ID NO: 350217 - RNA, 62 nt, Human
ucccaccccugucacuacagccucaccuccuacagccuuaagucccaggcccaugucugccu

SEQ ID NO: 350218 - RNA, 62 nt, Human
ugugaccugacuucuaagagcuacuucuaacacagccuuaggucuucaauuaacaaaguagg

SEQ ID NO: 350219 - RNA, 62 nt, Human
uguucugucaugggccaugggcuugcuauggccagccuuacugaggccaagcagcuuauggg

SEQ ID NO: 350220 - RNA, 62 nt, Human
cggcgggaacccagaaaaggcuucuuacacagcagccuuacuucaucggcccacagacacca

SEQ ID NO: 350221 - RNA, 62 nt, Human
gccuuguuaaccuaguauucuaaccaguuaaccagccuuaguaugcauuaaaauuguauugu

SEQ ID NO: 350222 - RNA, 62 nt, Human
gcuggguuggccccuucuuugggcucaggaagcagccuuagcacacgggccucuccucccuc

SEQ ID NO: 350223 - RNA, 62 nt, Human
ggaaucccucaaaaaauucuauagggagacagcagccuuaaucuacauaauucuucaucucg

SEQ ID NO: 350224 - RNA, 62 nt, Human
accuuucauacacuagccuuggccucuuuccucagccuuaagaaccaucugccaaaaauuac

SEQ ID NO: 350225 - RNA, 62 nt, Human
uauuaguuauucagacagucaagcagaacccacagccuuauuacaccugucuacaccaugua

SEQ ID NO: 350226 - RNA, 62 nt, Human
uguggaggaaggagcuucucggagcccccucucagccuuaccugggccccuccucuagagaa

SEQ ID NO: 350227 - RNA, 62 nt, Human
auuauucucucgaagagcaacuuacgagaggacagccuuaugaggguuugcuugagaggcag

SEQ ID NO: 350228 - RNA, 62 nt, Human
uaaaagaggcagucuagagaacuaggacugcucagccuuauccuggaguggagcauuuagcc

SEQ ID NO: 350229 - RNA, 62 nt, Human
gggagggcuagugugggggagggaggcuuccccagccuuaagagacccucucagcccaguga

SEQ ID NO: 350230 - RNA, 62 nt, Human
ucccccaacccgggcacccucggcccucccugcagccuuaacauucucuuccccugcuccuc

SEQ ID NO: 350231 - RNA, 62 nt, Human
ugcagucgcugcaaccuacccucucucugccucagccuuacacccaagcaguaggucugugc

SEQ ID NO: 350232 - RNA, 62 nt, Human
cuuaggccucaauucccuuccuuuuccaggggcagccuuaguucccauggcccugaaacaca

SEQ ID NO: 350233 - RNA, 62 nt, Human
gaagggagcaggguggcgguugaggaacgcuucagccuuagcugcuaccuuucggcagcagu

SEQ ID NO: 350234 - RNA, 62 nt, Human
acucuuuuuguaagcagagguggcuggcucugcagccuuaaggccauuuuuuaagucaccac

SEQ ID NO: 350235 - RNA, 62 nt, Human
ugggccaugauuaucuuaaaggcauuauucuccagccuuaaguaagaucuuaggacguuucc

SEQ ID NO: 350236 - RNA, 62 nt, Human
gaauucuagaaauaaauguuaccuaauuauuacagccuuaaagacaaaaauccuuguugaag

SEQ ID NO: 350237 - RNA, 62 nt, Human
caggauuucugaugacauugaaagacuuuaaacagccuuaguaaauuaucuuucuaaugcuc

SEQ ID NO: 350238 - RNA, 54 nt, Human
gggugaauguguguaagugagggucagccuuaccuuggggcuggggaagaggac

SEQ ID NO: 350239 - RNA, 62 nt, Human
agggucagcucagggcuaggaaaaaccauuuccagccuuagccuaaacagggcacauagauc

SEQ ID NO: 350240 - RNA, 62 nt, Human
cuaaagaccuggcauuaauggaggcggaggagcagccuuacgggagggauggagggaggcag

SEQ ID NO: 350241 - RNA, 62 nt, Human
gcccuugagguccagcuguggggcccaaaugacagccuuacaaggguucuaccagagaggaa

SEQ ID NO: 350242 - RNA, 62 nt, Human
auaugcuuggcaagaccgaggucgauuugucccagccuuaccggagaaaagagcuaugguua

SEQ ID NO: 350243 - RNA, 62 nt, Human
uccauuaaaauuaauuugugcaucagaaaaugcagccuuaaacaguguccaggagaugggau

SEQ ID NO: 350244 - RNA, 62 nt, Human
guaauagccuaaacacaacucuuauuuacuuacagccuuauguuuuuguauuuucuugguag

SEQ ID NO: 350245 - RNA, 62 nt, Human
aaaugcauucacaguuucuguaaauuauuuagcagccuuaaaguuuaucaaaaaauugucca

SEQ ID NO: 350246 - RNA, 62 nt, Human
aaguccgaaaagcaaaccuuaauuugaaauaacagccuuaaauccuuuacaagauggagaaa

SEQ ID NO: 350247 - RNA, 62 nt, Human
aaaugccaagggggagagagacacaauauccgcagccuuacaccuuaacuagcugcugcauu

SEQ ID NO: 350248 - RNA, 62 nt, Human
uccccaggaggcucgugucuuuggcccagagccagccuuaguuugucccugccaucuacugu

SEQ ID NO: 350249 - RNA, 62 nt, Human
uguuuguuuguuuguuugcaauacacucagugcagccuuaagcaaaugagaucauuuucaga

SEQ ID NO: 350250 - RNA, 62 nt, Human
uugaagcccagauggaaauacguuuauuucagcagccuuagguuuccccucgcuuucucaac

SEQ ID NO: 350251 - RNA, 62 nt, Human
cuuucuauguuucauuguuaauugccauccuucagccuuaaaaauagaagauucucacguga

SEQ ID NO: 350252 - RNA, 62 nt, Human
cuuaguuuuguuuuucaaaguaaagcuguagucagccuuauguaugccauugacucugaaau

SEQ ID NO: 350253 - RNA, 62 nt, Human
aaagaguagguugaacucuuuauagccgaauacagccuuaaauaugcuuguauagcauccac

SEQ ID NO: 350254 - RNA, 62 nt, Human
aacaucuugaauacucugcccucuagagccuucagccuuaauggaagguuggauccaaggag

SEQ ID NO: 350255 - RNA, 62 nt, Human
gacggaacacagcuauuucccuaugcaagguacagccuuacaaagauuucugcagugauuug

SEQ ID NO: 350256 - RNA, 62 nt, Human
aggaccucagccagcucucaagagguucugcucagccuuaacuucucaacuuugccuuagca

SEQ ID NO: 350257 - RNA, 62 nt, Human
caggaauuuccucuaugggaccuucccagcaucagccuuagaacaagaaccuuaccuucaag

SEQ ID NO: 350258 - RNA, 62 nt, Human
guacugggauuauaggugugagcuacuguacccagccuuaaccuguuucacaguugauuaua

SEQ ID NO: 350259 - RNA, 62 nt, Human
cuaauaguaggaguuuccccagaagucauuuucagccuuaauucucaucauguauaaauuaa

SEQ ID NO: 350260 - RNA, 62 nt, Human
uagaauuuuauaucauuggaugauauguugaucagccuuauguggaagaacugugauaaaaa

SEQ ID NO: 350261 - RNA, 62 nt, Human
aggaaacugaguuuuauuuccuagcucuaaggcagccuuacuauaugucaguaaagugcuga

SEQ ID NO: 350262 - RNA, 62 nt, Human
caagcccuucaggccugagaucagagccagaucagccuuaagucaccucccauccaagaacu

SEQ ID NO: 350263 - RNA, 62 nt, Human
uccguuaucuuucugguacaaccauucccauucagccuuaaaucugaguccuuuuuagcagc

SEQ ID NO: 350264 - RNA, 62 nt, Human
auguggaaaggguuugcaucauagauuuuucccagccuuauaauauaccauaagcuccuacu

SEQ ID NO: 350265 - RNA, 62 nt, Human
uguguaguauuuaccagcaccauucaguaauacagccuuaaccauaccuccuugaacuacuu

SEQ ID NO: 350266 - RNA, 62 nt, Human
gugugucucagcaccgcuaucucagccacuuucagccuuaugcacguagaaugaccacagcc

SEQ ID NO: 350267 - RNA, 62 nt, Human
acaccuuugaguuccugaaggagaauaacuuccagccuuacccccuaccacauguccggcac

SEQ ID NO: 350268 - RNA, 62 nt, Human
aucgaaaacaagagcagaagcaccuucagccacagccuuauaaaagggaagguaaauggcau

SEQ ID NO: 350269 - RNA, 62 nt, Human
aguuugcagcugugugguagugguuuaauuugcagccuuagcucuguggugucuggcucuag

SEQ ID NO: 350270 - RNA, 62 nt, Human
acagccacugugacaacccagagaccuggggucagccuuaaguaggaagaaauugcaguguc

SEQ ID NO: 350271 - RNA, 62 nt, Human
agguagaucaccugaggucagaaguucgagaccagccuuaccaauauggugaagccccaucu

SEQ ID NO: 350272 - RNA, 62 nt, Human
accacagcaugaaccuuuagaacaggguuucucagccuuagcacuauggacauuuugggcug

SEQ ID NO: 350273 - RNA, 62 nt, Human
ugacccuggugauggucgccacugggcagcagcagccuuaccaguccuccaugaucacaccc

SEQ ID NO: 350274 - RNA, 62 nt, Human
uugcuugugaauucuugcuuuuuuccucucaucagccuuaaguuuaggcguuuguuguucuc

SEQ ID NO: 350275 - RNA, 62 nt, Human
cuuuccuacauguucucaaaacacaguaguaccagccuuaccuuucugcuguauguagauag

SEQ ID NO: 350276 - RNA, 62 nt, Human
ucguggcccugugugagcacauguguacaucucagccuuaucucaaggaggugacaccuucu

SEQ ID NO: 350277 - RNA, 62 nt, Human
ucauggucgugggcccuuucccauggaggcugcagccuuaggagagcucugagccucucagc

SEQ ID NO: 350278 - RNA, 62 nt, Human
acuuaaaaguaagacugcagauuaucccccaccagccuuaguccagggguguggcucugucc

SEQ ID NO: 350279 - RNA, 62 nt, Human
auauaaauuuaucaagaauaaaaaugccucuccagccuuaaguauuuacaugcucccagguc

SEQ ID NO: 350280 - RNA, 62 nt, Human
gucuguguuaucugaacacucuacuuccuuugcagccuuagucacacaacugagucaucuca

SEQ ID NO: 350281 - RNA, 62 nt, Human
gugcuuuccuucagacggugcagggccugggccagccuuacaggucaguagacuagacucga

SEQ ID NO: 350282 - RNA, 62 nt, Human
uuauucugcagguucaucucagacccaccuuucagccuuaagcagccaccugagccaccacc

SEQ ID NO: 350283 - RNA, 62 nt, Human
ucaaacacuaaggcacggggcuggcugcagagcagccuuaggacccugggaccaagggcaga

SEQ ID NO: 350284 - RNA, 62 nt, Human
agcagcccccagagacacaacaaccuaccuuccagccuuaacucgaugguccgucccugcca

SEQ ID NO: 350285 - RNA, 62 nt, Human
ucucuaaaggacugguuaaaucaauucugauacagccuuacaauacaauaguaugcagcuaa

SEQ ID NO: 350286 - RNA, 62 nt, Human
gguuuuaaaaacaugcagagagguguuuuaaucagccuuaaaggaugguucauuucuugacc

SEQ ID NO: 350287 - RNA, 62 nt, Human
accccuaacccuaacagcuaaaucaaggaccucagccuuauauaaucauuguccccaccacu

SEQ ID NO: 350288 - RNA, 62 nt, Human
guauugagucuuaacuguauuucaguauuuuccagccuuauguguuacauuauuccaaugau

SEQ ID NO: 350289 - RNA, 62 nt, Human
gcuuuguuuguuuguuuucuucuucagugaagcagccuuacuauucauagaagggcuagaau

SEQ ID NO: 350290 - RNA, 62 nt, Human
uaccgguuagcaugguuuuagcaaauauauaccagccuuauaagguucguauugcuauguuc

SEQ ID NO: 350291 - RNA, 62 nt, Human
ugguuguuacauccagggcauggcaguggccucagccuuaaacuuuuguuccuacucccacc

SEQ ID NO: 350292 - RNA, 62 nt, Human
uaaaucuguggcauuuucagagccucaucugucagccuuaaugucaguggcaggaagucaua

SEQ ID NO: 350293 - RNA, 50 nt, Human
auccuugggauugggaguaacagccuuauuaggugaggucaaacacagag

SEQ ID NO: 350294 - RNA, 62 nt, Human
ccacccucacccacauuuucaggugucuacaucagccuuagucauuauggauaguaaaucga

SEQ ID NO: 350295 - RNA, 62 nt, Human
ugaaacuggcaacgucaccccagaauuacggucagccuuauuccccuucaccucccagugaa

SEQ ID NO: 350296 - RNA, 62 nt, Human
ggaggcugagccagugcgagacugaacuugugcagccuuagccaagacaaagcaguguuuuu

SEQ ID NO: 350297 - RNA, 62 nt, Human
cuggaaugaugauuccaugacucccaccuaugcagccuuaaagccaaauccgcgugugugug

SEQ ID NO: 350298 - RNA, 62 nt, Human
uggacaucaaguuugaacagauaaaucauggacagccuuauugugauugaaaugcuuguagg

SEQ ID NO: 350299 - RNA, 62 nt, Human
agccucccgaguagcugucuuuauaauaccaucagccuuaucauuuauucgucauguaugga

SEQ ID NO: 350300 - RNA, 62 nt, Human
cuauaauaucccauuggugucauguauuagaucagccuuauacuguuaaauuguuauuauuu

SEQ ID NO: 350301 - RNA, 62 nt, Human
ccccugcaagcacuuuacuuccuguuccuccccagccuuaaccccaaagcccuccugcaccc

SEQ ID NO: 350302 - RNA, 62 nt, Human
uuguacgugguuuacguaacuuuaaacuguaacagccuuaauggaagaccaaaugguuuuuu

SEQ ID NO: 350303 - RNA, 62 nt, Human
gcagccccaggguacagccagcaggcauugagcagccuuagcauugucccccuacucccguc

SEQ ID NO: 350304 - RNA, 62 nt, Human
agugacugugggaaauccuuugcugaaaacuccagccuuauuaaacacuugagaguucacac

SEQ ID NO: 350305 - RNA, 62 nt, Human
uaugauuaauaugguauugccuuuacaugccucagccuuaauagugauuccuuuuguauuaa

SEQ ID NO: 350306 - RNA, 62 nt, Human
gggcccggcccacugccuacccucgagucccgcagccuuaacaggaugggaucgaggguccc

SEQ ID NO: 350307 - RNA, 62 nt, Human
gucucuggcuugcuccccacgcugaaacccugcagccuuaagagagaggggccccggccugc

SEQ ID NO: 350308 - RNA, 62 nt, Human
ccgggccagggucagggacccucugccucuggcagccuuaaccuguccucugcuaggaccag

SEQ ID NO: 350309 - RNA, 62 nt, Human
uuggaaaaaagacaugaauggcucccauccuucagccuuaguucuuuguacaguguaucauc

SEQ ID NO: 350310 - RNA, 62 nt, Human
ucuccuggaaguccagggaagaaggagggccccagccuuaaauuuaguaaucugccuuagcc

SEQ ID NO: 350311 - RNA, 62 nt, Human
uggggggugggagauuuuggcugaagccgccccagccuuaguccccagggccaagcgcuggg

SEQ ID NO: 350312 - RNA, 62 nt, Human
ucuccccugcggcucccaccucugccugaccccagccuuaaacauagccccuggccagaggc

SEQ ID NO: 350313 - RNA, 62 nt, Human
uaaagcaguugguguugcuuaugaggaagguucagccuuauccagcacagccuucacguuuu

SEQ ID NO: 350314 - RNA, 62 nt, Human
ggaggacuugggggcagagcagcacaaagaaacagccuuacacugggcacauggaggagacg

SEQ ID NO: 350315 - RNA, 62 nt, Human
cugauuucauuuuggaauucauuugccauccacagccuuacacuaggcacacacuuuagagu

SEQ ID NO: 350316 - RNA, 62 nt, Human
aacgcaucuugcuuuucacaucucuccuccuacagccuuaauggcugcuugcugccauaugu

SEQ ID NO: 350317 - RNA, 62 nt, Human
uagugcuccacagcuuuuccuuccccaccccccagccuuagaugccucgcucuuuucaaucu

SEQ ID NO: 350318 - RNA, 62 nt, Human
cuguggagugcaugacucagccccccgacucgcagccuuaauaaagcgaugguugacgucug

SEQ ID NO: 350319 - RNA, 62 nt, Human
agccugcccgcugcaaugccuagacuucccaacagccuuagcugccagugcuggucacuaac

SEQ ID NO: 350320 - RNA, 62 nt, Human
cccaccaacucggggaacaucaccccagagcccagccuuauccagcagcgccuuccagccuu

SEQ ID NO: 350321 - RNA, 62 nt, Human
uuuccucagugagcuuugauaugguccaaaaacagccuuaaaucaagaauauuuguggaggu

SEQ ID NO: 350322 - RNA, 62 nt, Human
auugccaaucaggacaaggccuugaaggaacgcagccuuagacaucaggugaggaugaugga

SEQ ID NO: 350323 - RNA, 62 nt, Human
gaacgcaagagaaucugcguagaugggugacucagccuuaguuucuauucuuggauguccca

SEQ ID NO: 350324 - RNA, 62 nt, Human
agccagcuuugcuggggcccuaccugcaugcccagccuuaccccucauucucacagcacaga

SEQ ID NO: 350325 - RNA, 62 nt, Human
ggcacccgugccaguggcagaggccacagccccagccuuaggccaggcccugggagggcagg

SEQ ID NO: 350326 - RNA, 62 nt, Human
cgaguugcgcucggaauuugagcugaauuccacagccuuacuuuguuuccugaagugauagc

SEQ ID NO: 350327 - RNA, 62 nt, Human
uggagauuucauuuugucagcagcagugaccacagccuuaccaaagcagacgcgugcgcgug

SEQ ID NO: 350328 - RNA, 62 nt, Human
aagagucagacauuucuuuggaaaacagcgaacagccuuagagcucuuguguucagaagaau

SEQ ID NO: 350329 - RNA, 62 nt, Human
aggugcugagaauaagaaugcucaguuuguuucagccuuaguuggugccuccuuaguuuggg

SEQ ID NO: 350330 - RNA, 62 nt, Human
aaaguuaauaugauuaaccaccugccgcugaucagccuuauguucccaaagagcccugagua

SEQ ID NO: 350331 - RNA, 62 nt, Human
uuuaacuuuuuaaagacugugccaccacaaaacagccuuagccuccuuguugccaaauaauu

SEQ ID NO: 350332 - RNA, 62 nt, Human
ccgccauugagaauaagguuccauugcguagccagccuuaggaaaaacaaacagaacccaaa

SEQ ID NO: 350333 - RNA, 62 nt, Human
gaagucuugcaguuaucuuagcauuguauaaacagccuuaaguauagccuaagaagagaauu

SEQ ID NO: 350334 - RNA, 62 nt, Human
caaagaaucugcagagggugcuacugaagauccagccuuagccaaucaccaccucauugggu

SEQ ID NO: 350335 - RNA, 64 nt, Human; identical to SEQ ID NO: 329514

SEQ ID NO: 350336 - RNA, 64 nt, Human; identical to SEQ ID NO: 329515

SEQ ID NO: 350337 - RNA, 64 nt, Human; identical to SEQ ID NO: 329516

SEQ ID NO: 350338 - RNA, 64 nt, Human; identical to SEQ ID NO: 329517

SEQ ID NO: 350339 - RNA, 64 nt, Human; identical to SEQ ID NO: 329518

SEQ ID NO: 350340 - RNA, 64 nt, Human; identical to SEQ ID NO: 329519

SEQ ID NO: 350341 - RNA, 63 nt, Human
agguggggcagccugaacccugcuucccccuguggccggcaugccccgaucuuucacacacug

SEQ ID NO: 350342 - RNA, 63 nt, Human
cagggagucuauuuaugaagucuccagaccuugggccggcacgcgugacacggcacuucaggc

SEQ ID NO: 350343 - RNA, 63 nt, Human
uccuccuccucuuggcucuauugggagccucagggccggcagggugcuucgggagcccccugc

SEQ ID NO: 350344 - RNA, 63 nt, Human
acggcccggucuagggugucgcucugcuggccuggccggcaaccccaguucugcuccucucca

SEQ ID NO: 350345 - RNA, 63 nt, Human
cugaagaagggccucccccaggcccccagcugaggccggcaacucacccagccgccaccucug

SEQ ID NO: 350346 - RNA, 63 nt, Human
aaaaaaaggaaaagguuuuuagcucauuugccuggccggcaaguuuugcaaauagcucuuccc

SEQ ID NO: 350347 - RNA, 63 nt, Human
cccuuccuaucuaagggagggcugaagacaaggggccggcauucagugggcagcagaaaggag

SEQ ID NO: 350348 - RNA, 63 nt, Human
ggcuguggagggcgaggaaggcgguccagaggcggccggcagguccacguccugggcgaccgc

SEQ ID NO: 350349 - RNA, 63 nt, Human
uaacuucuuccaacuccucgcagaagugggagaggccggcagccugcaccgagaggggcuuuc

SEQ ID NO: 350350 - RNA, 63 nt, Human
gggccagucuguguguguggggacucagcccguggccggcagaugccauccaggauguacaag

SEQ ID NO: 350351 - RNA, 63 nt, Human
gcuugaugcuacuguacagaacuggacagguugggccggcagugguggggccagagggcucug

SEQ ID NO: 350352 - RNA, 60 nt, Human; identical to SEQ ID NO: 233614

SEQ ID NO: 350353 - RNA, 63 nt, Human
gcaggguucugacuggcgugugggagacccuguggccggcacccaccuccacacgaggacuaa

SEQ ID NO: 350354 - RNA, 63 nt, Human
ugagaagggagcucuggagcaggaccagcugggggccggcacugcugcuuagaguggaggagg

SEQ ID NO: 350355 - RNA, 63 nt, Human
gccgaccaucucugcacugaagggcccucugguggccggcacgggcauugggaaacagccucc

SEQ ID NO: 350356 - RNA, 63 nt, Human
uaagcagcaaaacgcuccuccaugucuggauggggccggcagguccuguguccccugcaccug

SEQ ID NO: 350357 - RNA, 63 nt, Human
ugugcaauaacuuguggccacuggaaaucccugggccggcauuuguauugggguugcaaugac

SEQ ID NO: 350358 - RNA, 63 nt, Human
cugggguugcugcccugaacgaacugcguguggggccggcacauccuagcaggcagccccugg

SEQ ID NO: 350359 - RNA, 63 nt, Human
agcugaaguagaggggacgugagagaagggccaggccggcaggccaacccuccuccaauggaa

SEQ ID NO: 350360 - RNA, 63 nt, Human
cagagaagccucuucugccccugccagauguauggccggcagcuucccccucucaugguaggc

SEQ ID NO: 350361 - RNA, 63 nt, Human
gccgcgagcugucccgcgugcggguccccuccuggccggcagagggcgcaggagcccaggaga

SEQ ID NO: 350362 - RNA, 63 nt, Human
aagcagcccugugcucgaugggaggggcucccaggccggcagcccuugccaccucccucugcc

SEQ ID NO: 350363 - RNA, 63 nt, Human
uggaccagcugcccuggcggagagacagcaaggggccggcaggugcucgaugggccccccagg

SEQ ID NO: 350364 - RNA, 63 nt, Human
cccagucuguccuauggggagcaguuugggggcggccggcagcaggagccugggaaagaggcc

SEQ ID NO: 350365 - RNA, 63 nt, Human
guucuagccggcccccucuccaggggucgccguggccggcauuauuuccuaguucuucuugua

SEQ ID NO: 350366 - RNA, 63 nt, Human
ugcuuacugcacagccugaacagacaguucuggggccggcagugcugggcccuuuagcuccuu

SEQ ID NO: 350367 - RNA, 63 nt, Human
cugcguggcccauggucggggcguccacgccgaggccggcaacaaacgacaguaucucggauu

SEQ ID NO: 350368 - RNA, 63 nt, Human
cuguacccccuuagagcugccccucucuggccuggccggcaggcgucuucuuaacuccucugu

SEQ ID NO: 350369 - RNA, 63 nt, Human
ggauuuucgugaugaaggacggaagcagcagcgggccggcaaggccauaccucggugagggac

SEQ ID NO: 350370 - RNA, 63 nt, Human
aagccguugagucucuuccuggaagacccugagggccggcagcuuugccuaggacucuccagg

SEQ ID NO: 350371 - RNA, 63 nt, Human
gagucucccugcugcuguagagccgggcgcccaggccggcaucccccucguggguggcaggag

SEQ ID NO: 350372 - RNA, 50 nt, Human; identical to SEQ ID NO: 233634

SEQ ID NO: 350373 - RNA, 63 nt, Human
ugugggggcgguggggaggucccagaggugggaggccggcauccaggucuuggcucugcccug

SEQ ID NO: 350374 - RNA, 63 nt, Human
caggugucugcagucagcuccugagacacagcuggccggcacaacagguguuacaucaggggu

SEQ ID NO: 350375 - RNA, 63 nt, Human
gcuggggaagccgagacgggcacucccucugccggccggcagcguggcccugagcauggcaag

SEQ ID NO: 350376 - RNA, 63 nt, Human
ccccccgacacauguauucucaucugugguccaggccggcaucguccuggccaccccccagau

SEQ ID NO: 350377 - RNA, 63 nt, Human
cuuuuggcuacagagagggaagggaaagccugaggccggcauaaggggaggccuuggaaccug

SEQ ID NO: 350378 - RNA, 63 nt, Human
uccaggggcgcggagcucuggggaugggcgucgggccggcaguggugcggcucacuccguccc

SEQ ID NO: 350379 - RNA, 63 nt, Human
uccucuccucucuucauucccucacagcagauuggccggcaccaaucuuagucaagaguggcu

SEQ ID NO: 350380 - RNA, 63 nt, Human
uggacuguggccagggcuggcccccaccgcuguggccggcacuccauuccggaaccuccugga

SEQ ID NO: 350381 - RNA, 63 nt, Human
cuccccagccugcgccugcugcaugcccucucaggccggcagccccagccugcuagcuagcuc

SEQ ID NO: 350382 - RNA, 63 nt, Human
gccucaggaccuucaagauuccaucugugggcuggccggcaagauggcaccaguggggaccca

SEQ ID NO: 350383 - RNA, 63 nt, Human
uuaagcauaaaguaacacaacagcauugcacggggccggcacugccgcugccuucacugaagg

SEQ ID NO: 350384 - RNA, 63 nt, Human
cugggcucugcagggacaggaguuccacgugucggccggcacacuggccuucuccgucacccu

SEQ ID NO: 350385 - RNA, 63 nt, Human
cugcuggggccgccacggccuggcuggugggaaggccggcagcgggcggaggggauccagcca

SEQ ID NO: 350386 - RNA, 63 nt, Human
ccccacugaagaggucuguacagugacaacccgggccggcagcaaggacacagaugcagccac

SEQ ID NO: 350387 - RNA, 63 nt, Human
auagaaauuaaagaaugugagaaaguucuggugggccggcaggauugccgcacaaguuuauau

SEQ ID NO: 350388 - RNA, 63 nt, Human
ugagggcaggcaggagguggaguugcagcuguuggccggcaucacguugcucguugcucggcu

SEQ ID NO: 350389 - RNA, 63 nt, Human
agggaagaggcugggagcaaggccgggugcuggggccggcaggcuguguucugagagugccug

SEQ ID NO: 350390 - RNA, 63 nt, Human
agauuuguauugcugagcucaaagccaagcagaggccggcaguggaggcugagcagggacucu

SEQ ID NO: 350391 - RNA, 63 nt, Human
cccggccaggccugcgaggaagggcugagguggggccggcagggggcgccaggcagccgugau

SEQ ID NO: 350392 - RNA, 63 nt, Human
ccgggcuaucggccucuugggagccagcggcagggccggcaccugcgugccugugcccgugug

SEQ ID NO: 350393 - RNA, 63 nt, Human
gccacaggcuguggcugcucccagcagaggcggggccggcagagaaggggccuccuccaccca

SEQ ID NO: 350394 - RNA, 63 nt, Human
ggggagaaaggaagccuuucugagagcgggcuaggccggcacuggagaggccggagccuuugg

SEQ ID NO: 350395 - RNA, 63 nt, Human
ugccacugaagccugcgucagcagcccgagcggggccggcaucugcuccccgccgucugcucc

SEQ ID NO: 350396 - RNA, 63 nt, Human
agggugugagggauggggagcagcugggcacugggccggcagccugguucccucuuuccugug

SEQ ID NO: 350397 - RNA, 63 nt, Human
agguguagcacacgcaugugcagauggcaccacggccggcaccugggggcacacacaugcagg

SEQ ID NO: 350398 - RNA, 62 nt, Human; identical to SEQ ID NO: 233660

SEQ ID NO: 350399 - RNA, 63 nt, Human
cagcugcuuuuguggagguggacgaaaggcuguggccggcagacguggagguccaggccgggg

SEQ ID NO: 350400 - RNA, 63 nt, Human
aaggcuucagccccaagggcaucuccagccucaggccggcagguccuauguccuugacacaaa

SEQ ID NO: 350401 - RNA, 63 nt, Human
agcgagacuccaucuuuaaaaaaaaacaagacgggccggcacgguggcucacgccuguaaucc

SEQ ID NO: 350402 - RNA, 63 nt, Human
ggccgagggcuuuccccaccccacccuccuccuggccggcagucggcccugucuauucaucug

SEQ ID NO: 350403 - RNA, 63 nt, Human
aggcuccgagaaauugcacaaccgaccucagguggccggcaguggcgugccuggugcccuuuc

SEQ ID NO: 350404 - RNA, 63 nt, Human
guucugagcccuggacucugccccgggggauguggccggcacugggcagccccuuggacugag

SEQ ID NO: 350405 - RNA, 63 nt, Human
gccccuccugccaggcccucccucccgggugguggccggcaccucugcuccucacgugggucg

SEQ ID NO: 350406 - RNA, 63 nt, Human
cccguguccccgccccgccccuccguccacacuggccggcacccccugcugggucuccugcau

SEQ ID NO: 350407 - RNA, 52 nt, Human; identical to SEQ ID NO: 233669

SEQ ID NO: 350408 - RNA, 52 nt, Human; identical to SEQ ID NO: 233670

SEQ ID NO: 350409 - RNA, 63 nt, Human
caugccugcaaucccagcacuguagaaggcagaggccggcagaucacuugagcccaggaguug

SEQ ID NO: 350410 - RNA, 63 nt, Human
cccccagggccugucgacacggcggggcccgguggccggcaucuggcccgcacguguccgagg

SEQ ID NO: 350411 - RNA, 63 nt, Human
gacagggaagaccggggcccuccucccuuauggggccggcacaaucagugggcugggcggagc

SEQ ID NO: 350412 - RNA, 63 nt, Human
agggcucagagcagaggccagaaccacugggccggccggcauuccagccuccccagacugcug

SEQ ID NO: 350413 - RNA, 63 nt, Human
ugacacgcgguugcauggaguccagguuacucaggccggcacuucugagugacaggugccacc

SEQ ID NO: 350414 - RNA, 63 nt, Human
aggugagaaggagcgguguguccaggcaccgcuggccggcagcccugggcugaggcacagacu

SEQ ID NO: 350415 - RNA, 63 nt, Human
aggagcauccaggaggcucucgcccgcaacgcuggccggcauagcguggcgucagcccagcug

SEQ ID NO: 350416 - RNA, 63 nt, Human
acccucuggcucaggaggguugggucccugggaggccggcagccaggccacagaauccacacg

SEQ ID NO: 350417 - RNA, 63 nt, Human
aauccacacguggaccauugugggucccugggaggccggcagccaggccacggaauccacacg

SEQ ID NO: 350418 - RNA, 63 nt, Human
agagcuguuuggaggauguucucugcgcucccaggccggcaucgagugucaucaauuucuacc

SEQ ID NO: 350419 - RNA, 63 nt, Human
caucaggacagcgagccgacgggucacgccaggggccggcacgcacuggcaccuggccccagg

SEQ ID NO: 350420 - RNA, 63 nt, Human
uuguucuccccgagaccgcgucgcccgcggcccggccggcaguugcaguguagacagcccgag

SEQ ID NO: 350421 - RNA, 63 nt, Human
ggcugaggccacauggcuuccugugggagccccggccggcacccggcuggucccaccccaaau

SEQ ID NO: 350422 - RNA, 63 nt, Human
cagugccuuaugccacagccgaagaauccguggggccggcaagcaggcaccuucccccagcug

SEQ ID NO: 350423 - RNA, 63 nt, Human
cgcaugcacacacgcagaggugcagagcgaggaggccggcaaaucccgcagcugccacggucc

SEQ ID NO: 350424 - RNA, 58 nt, Human; identical to SEQ ID NO: 233686

SEQ ID NO: 350425 - RNA, 64 nt, Human
cagcaccagccgccauggccaagccugauuguuccagcuccagagacuaaggaaggggcagggg

SEQ ID NO: 350426 - RNA, 64 nt, Human
cccuccacugugacucuccuacuggugcuugguucagcuccaccccaaaucuuaccccaccacu

SEQ ID NO: 350427 - RNA, 64 nt, Human
agcugaguuguuggagggagaagcuggagacuuccagcuccagcucccacucaagauaauaaag

SEQ ID NO: 350428 - RNA, 64 nt, Human
ccggugcugcuuuauuucagacucugccccagguuccaggaauccgaaccccggagugcugacg

SEQ ID NO: 350429 - RNA, 64 nt, Human
gggggucuuccuccaccucccacuuuccaagggcuccaggaaucuggggccugaccacagauuc

SEQ ID NO: 350430 - RNA, 64 nt, Human
gggacacagcggagucagggccagagcccuucccuccaggaacugauccuugggaaaacagcca

SEQ ID NO: 350431 - RNA, 64 nt, Human
gcccuccgcugcuccucuguccugcuagccuuccuccaggaagcacacugggugcagauaauca

SEQ ID NO: 350432 - RNA, 64 nt, Human
ugacauuuccuaccuuuugaggacuugauccuucuccaggaagaaggugcuuucugcuuacuga

SEQ ID NO: 350433 - RNA, 64 nt, Human
guggcucuacaacugaguccuuaaacagggcaucuccaggaaggcggggcuucaaccuugagac

SEQ ID NO: 350434 - RNA, 64 nt, Human
ggcagcaccaggccccagcucccuccgggggcccuccaggaaccaccaagcucucucacgaccu

SEQ ID NO: 350435 - RNA, 64 nt, Human
ucucugcuucccccuccgcucuugacccugcauauccaggaaggaacugccagccucagaggag

SEQ ID NO: 350436 - RNA, 64 nt, Human
ucauuccuugugugugucuuggagugcauuugacuccaggaaaagccauuuugguuuuccuuaa

SEQ ID NO: 350437 - RNA, 64 nt, Human
accaaggaccuaguuccuucuagggauauaaauuuccaggaauguguauuuuuaauguggugag

SEQ ID NO: 350438 - RNA, 64 nt, Human
caucuccuagagaggaauggacccaggcugucauuccaggaagaacugcagagccuucagccuc

SEQ ID NO: 350439 - RNA, 64 nt, Human
uuuucaguaggcuccugaagagugaucucaacuuuccaggaagaaaagagggcaaagggaacaa

SEQ ID NO: 350440 - RNA, 64 nt, Human
aauccuaauuucuccucccuuccuuuucccugcuuccaggaaacuccacaucugccuuaaaacc

SEQ ID NO: 350441 - RNA, 64 nt, Human
acuguggacagcugucugucagcaugcagagggauccaggaauccccccggcagcacggcccgc

SEQ ID NO: 350442 - RNA, 64 nt, Human
ucagccucuacaacagagcagcuucccagacuucuccaggaacccagaaacgggaugguugucg

SEQ ID NO: 350443 - RNA, 64 nt, Human
auguuaggcucuccagggcuucuuuccaaacccccagcuccacaccccccagacccagcugguu

SEQ ID NO: 350444 - RNA, 64 nt, Human
gcccggccaggcagcugggaccagaaugcaaccccagcuccacuccagccuggcguccagggcc

SEQ ID NO: 350445 - RNA, 64 nt, Human
auuucccucuuccuguguccccagauccccacuacagcuccaagaggaugggccuagaaagcca

SEQ ID NO: 350446 - RNA, 64 nt, Human
uugacgucucuauucugccccagcuggagcauugcagcuccaggaagaugaauacauggcuugg

SEQ ID NO: 350447 - RNA, 64 nt, Human
auaauuuuuuccaagccaaggagaccauuggccauccaggaaauuucguacagcugaaauauag

SEQ ID NO: 350448 - RNA, 64 nt, Human
ggcugggccagccuccccacuuacaaggcugcuuuccaggaagggaggucugguguaucucaug

SEQ ID NO: 350449 - RNA, 64 nt, Human
aaauagcuucuccuacagugauucaugucccagguccaggaaauccaauguuggugaaggcagc

SEQ ID NO: 350450 - RNA, 64 nt, Human
agauggccaugcuuaagccagcaauuggcugggguccaggaaacaaagcaaaagcacaauaugu

SEQ ID NO: 350451 - RNA, 64 nt, Human
aaaggggaguugagucacaagagguuaagguggguccaggaaggcagcugcucuuagugcccgc

SEQ ID NO: 350452 - RNA, 64 nt, Human
acucguguccccagggacuucuaaagcuuggggcuccaggaaaucauccaguagaguuggagau

SEQ ID NO: 350453 - RNA, 64 nt, Human
guaaaccaggucccccuccugaccucugccccacuccaggaauggagcucuucccagccuccca

SEQ ID NO: 350454 - RNA, 64 nt, Human
uaaacaguugacaaacugucauucaacaauuagcuccaggaaauaacaguuauuucaucauaaa

SEQ ID NO: 350455 - RNA, 64 nt, Human
uuggaagagcuggagaagcagacucugcugaauuuccaggaacucccagcgccagauucaucau

SEQ ID NO: 350456 - RNA, 64 nt, Human
gguccccucuggguggacaugcacccauccccaguccaggaaaccaucucccccaggaccuucu

SEQ ID NO: 350457 - RNA, 64 nt, Human
ucuaacaaguucccaggugaugcugugcugcuuguccaggaaacacaauuugagagucauguga

SEQ ID NO: 350458 - RNA, 64 nt, Human
ugaauuugaaaaauacacacgaauguccucaguauccaggaacauaaaggcaagaagcaaguca

SEQ ID NO: 350459 - RNA, 64 nt, Human
aguugugaaaauuacaaaucugaagaacauaguguccaggaaagugguuuagcacgaagaggcc

SEQ ID NO: 350460 - RNA, 64 nt, Human
ucauggcuacaaagugcucccucuuuucagugccuccaggaagcccgccaguggugagacugug

SEQ ID NO: 350461 - RNA, 64 nt, Human
ccagauaaggaaacaagccuagauaugcuacauguccaggaacaacugcagccaggaggcagaa

SEQ ID NO: 350462 - RNA, 64 nt, Human
cccuucuacuacuugagacuuuauucucuggguccagcuccauacccuaaauucugaguuucag

SEQ ID NO: 350463 - RNA, 64 nt, Human
ccagcccaucugucucacccucuccuguuguauccagcuccacgacaaacuucugccuucccca

SEQ ID NO: 350464 - RNA, 64 nt, Human
uguuuucuuacccauaagaucaaagcagacucaucagcuccauaucugcauuccacuggggaaa

SEQ ID NO: 350465 - RNA, 64 nt, Human
uaagcucuguuguugacauuuugcagugauacaacagcuccacucauagauuuaaacuuuuauu

SEQ ID NO: 350466 - RNA, 64 nt, Human
uugagugguaaguugguuauuuuuuuagaggugauccaggaaucuuuaguuugaaggcaguuac

SEQ ID NO: 350467 - RNA, 64 nt, Human
uuuugggaaacuuacauguugagaucuacagagauccaggaaaccaaagcccugcugagcagag

SEQ ID NO: 350468 - RNA, 64 nt, Human
uagcgaccuuuggaaaacguuagcgguguaacaguccaggaaacuguuuuuuuuuguuguuguu

SEQ ID NO: 350469 - RNA, 64 nt, Human
cucuuccugguucaaucuugggagauuguguguuuccaggaauuuagccguuuccuccagauuu

SEQ ID NO: 350470 - RNA, 64 nt, Human
gauucucacuucugcuagccuagccagggcuuacuccaggaaucuaaauagaugcccuagucca

SEQ ID NO: 350471 - RNA, 64 nt, Human
aauucugggaaauuagaaaaaguggggugaucuuuccaggaaaaacauguguaacaucugcuua

SEQ ID NO: 350472 - RNA, 64 nt, Human
ucuuccagaugaggcccaaaacauauauagggguuccaggaaucucauucauucauucaguauu

SEQ ID NO: 350473 - RNA, 64 nt, Human
cccauguagcuggcaagcugcaaaaggccugugauccaggaaagaugucccacagggaccacau

SEQ ID NO: 350474 - RNA, 64 nt, Human
uaaacuugguaaaauccaagucuuuuuuuuuuuuuccaggaacaacuacauuuucucauauaca

SEQ ID NO: 350475 - RNA, 64 nt, Human
guucuuguuccugagaaggguggguaacagauauuccaggaaaaagaaugcacauugaauggau

SEQ ID NO: 350476 - RNA, 64 nt, Human
cccucccucugaucauuuccaguugauugucauauccaggaaaaaauggaacagugcacucuuc

SEQ ID NO: 350477 - RNA, 64 nt, Human
uucucauacuuagaaacaaaaagagcuuuccuucuccaggaauacugaacaugggagcucuuga

SEQ ID NO: 350478 - RNA, 64 nt, Human
cugagccugcgugggagaaccccaauucuagcacuccaggaaacugugggagaguguggggcag

SEQ ID NO: 350479 - RNA, 64 nt, Human
ggacaucacucaugggauuuuuaaaaagccucuuuccaggaauggaacugauggauuccucucc

SEQ ID NO: 350480 - RNA, 64 nt, Human
ccuuuuuuuaaagauggauuuaaaccaagaugccuccaggaaagaggacgaaaugaguauauuc

SEQ ID NO: 350481 - RNA, 64 nt, Human
gauuccuuuccucagaguuucagguuuuuucaguuacaucuagagcugaaaucuggauaguacc

SEQ ID NO: 350482 - RNA, 64 nt, Human
uggugaugcagagugguaaaccuugugagcucaguacaucuauuuugugaacaucaguuggauu

SEQ ID NO: 350483 - RNA, 64 nt, Human
aguguguauauauguuugcaucuacauauauuuguacaucuauaugacagauguauuuuaaaag

SEQ ID NO: 350484 - RNA, 64 nt, Human
acuacauacugaauuuguauguuuuuaaaauuguuacaucuagacaacuguaaacauuauuuuu

SEQ ID NO: 350485 - RNA, 64 nt, Human
aacuuuaguaaguuagcugccagcauuagaaccuuccaggaagaauuuuaacuaguaugcuaca

SEQ ID NO: 350486 - RNA, 64 nt, Human
aauaauuuguauauuguguugcagaugaaaguauuccaggaacagugaaugguagaagacacaa

SEQ ID NO: 350487 - RNA, 64 nt, Human
auauuuuucaauuccagauuuuuaauuuuaaggcuccaggaaagaaaggagaguagaacauuuu

SEQ ID NO: 350488 - RNA, 64 nt, Human
ccagaaggaacccggucccaggccgcauggccccuccaggaacauucccacauaauacauucca

SEQ ID NO: 350489 - RNA, 64 nt, Human
caaaagcagccaugagaaggaaggauucaccaccuccaggaaaagguaaauuugccaauacaaa

SEQ ID NO: 350490 - RNA, 64 nt, Human
cacuuucugcaguagcuagagggacagguuuccuuccaggaaggauucgaguuccugugccugu

SEQ ID NO: 350491 - RNA, 64 nt, Human
ccaaaagaaauuuccugccccaagaagcaugggauccaggaaggggcgcguagaugcuuaacgg

SEQ ID NO: 350492 - RNA, 64 nt, Human
cugagcagcauuacacuacaaugcuucuuugguuuccaggaauuuuuuucaaauggggcuguuu

SEQ ID NO: 350493 - RNA, 64 nt, Human
gcuaaacaugcugccaaccagcuuguccaacaacuccaggaaaacuguuuuucaaaacgccaug

SEQ ID NO: 350494 - RNA, 54 nt, Human
cuggaaaccccuuauuuugagagcuccaggaagcgcccucaccccagccccacu

SEQ ID NO: 350495 - RNA, 64 nt, Human
aguaagugcacaaauucuguaguuugccguaucauccaggaaaaccugagggaaaaaaauuaua

SEQ ID NO: 350496 - RNA, 64 nt, Human
cuuuuuggauccucauucucacccauuuggcuaauccaggaauauuguuaucccuucccauuau

SEQ ID NO: 350497 - RNA, 64 nt, Human
uucaucucucacgauccccucaaaggcccccuccuccaggaaggcaaccccugugccccucccc

SEQ ID NO: 350498 - RNA, 64 nt, Human
uaggaggugggaccuucugugggguuuggggaucuccaggaagcccgaccaagcuguccccuuc

SEQ ID NO: 350499 - RNA, 64 nt, Human
gaugcagcgguagcaucugagcuccugucccagcuccaggaaggggaguucuggguggaggagg

SEQ ID NO: 350500 - RNA, 64 nt, Human
gcuccaaaacuggaccaccagagaauggacaccauccaggaagaccccagcacagacucacaua

SEQ ID NO: 350501 - RNA, 64 nt, Human
uguuuuagacuuguuaaaacauugcugucuaguguacaucuagcuaaaagugugguuuaucuaa

SEQ ID NO: 350502 - RNA, 64 nt, Human
cauauuuuucaaaauagguuuuuauuguugaauguacaucuaccccagccccucaaaagaaaaa

SEQ ID NO: 350503 - RNA, 64 nt, Human
ucaugauuacauuaguaacaggauuggcguccguuacaucuagaacuucuaugggcaucauuau

SEQ ID NO: 350504 - RNA, 64 nt, Human
aauggugcucccaaauauucaguaccuugggcaauccaggaaggguuuaaagagaccuguugcu

SEQ ID NO: 350505 - RNA, 64 nt, Human
guugagccacccacuugccauuugcuccuguccuuccaggaaaucacaauuuucaucagagccc

SEQ ID NO: 350506 - RNA, 64 nt, Human
aaccauuaugcuguacuaucuacccauaaauaccuccaggaaacauuccccucuugguaauuug

SEQ ID NO: 350507 - RNA, 64 nt, Human
ucguuuggcaggacacagagagguaggugaacauuccaggaaagaagcagcuuagagaaaaugu

SEQ ID NO: 350508 - RNA, 64 nt, Human
ucuauuauccagagucaugggagaguacacccuuuccaggaauaauguuuugggaaacacugaa

SEQ ID NO: 350509 - RNA, 64 nt, Human
auuuuuuuuaagauuuguucauaaaauggucugauccaggaaaaauaaaaugggaacauggaca

SEQ ID NO: 350510 - RNA, 64 nt, Human
cuauauuacaagcaauccccaaauuuuauggucuuccaggaaaaguuauuaccguuuaugauac

SEQ ID NO: 350511 - RNA, 64 nt, Human
cuguguuaagcuguucaugcacgugccugacgcuuccaggaagcuguagagagggacagaaggg

SEQ ID NO: 350512 - RNA, 64 nt, Human
cucccuuuaaucaaucugagcacaacuacauacauccaggaaucugaagucagauaguaaggau

SEQ ID NO: 350513 - RNA, 64 nt, Human
gcuuccuuuaggauaaagcuaugugcuguuguuuuccaggaacaagugcucugucacauuuggg

SEQ ID NO: 350514 - RNA, 64 nt, Human
aauuacuguuucuguugccuggacaguuacaguuuccaggaaacaucaggaaguaggaaacugu

SEQ ID NO: 350515 - RNA, 64 nt, Human
guggccuugugacuguucuuuaaggcugaagauauccaggaaagggggcuuggacacuggccaa

SEQ ID NO: 350516 - RNA, 64 nt, Human
gcccaaauuagaaugcuuauaaugagacccaaucuccaggaaaacaacacucacauaaguuuaa

SEQ ID NO: 350517 - RNA, 64 nt, Human
uagugaugacaugaaauacaaagaacaagcuauuuccaggaauguguucuguauuuuacauccc

SEQ ID NO: 350518 - RNA, 64 nt, Human
ucacugcucuuaacuugcucaaacuggggcagguuccaggaacuugaacuaaaaauaucuauuu

SEQ ID NO: 350519 - RNA, 64 nt, Human
cugcaucugaacaucuuucccagugcuaucaguauacaucuagagaggaaaugcaaugugacag

SEQ ID NO: 350520 - RNA, 64 nt, Human
acacguguucacugaauuuuaauuugauaggcaauacaucuacccacuccauuauuuuuuaaaa

SEQ ID NO: 350521 - RNA, 64 nt, Human
uucuacauuaaaucaccuugucaagggcucuguuuacaucuauacauuuugaagaugaaauuuu

SEQ ID NO: 350522 - RNA, 64 nt, Human
aucacacugccuccuuuuuauacagacacaaauauacaucuauaagaauaauauauacauaagg

SEQ ID NO: 350523 - RNA, 64 nt, Human
augaggugcuuugagcaguucugaaaaaugcaguuccaggaaagcaacugcuuugguuccuaag

SEQ ID NO: 350524 - RNA, 64 nt, Human
cucuagggguuucaaaagacucaguuaauugauuuccaggaaguacucauagcaaguucauaaa

SEQ ID NO: 350525 - RNA, 64 nt, Human
gccacauggcgcaugaaggagagcccagucucccuccaggaaaggccugaggauguaagucagg

SEQ ID NO: 350526 - RNA, 64 nt, Human
uauugccuccauucuccucucucuaucccugaaauccaggaagucccucuccuggugcuccaag

SEQ ID NO: 350527 - RNA, 64 nt, Human
gggcagggaucugguacagacauaggcgcuuccuuccaggaacagucccucaggagaggcagug

SEQ ID NO: 350528 - RNA, 64 nt, Human
aguguuuuagccaugcucggguggcuaaauuacauccaggaauggugccagggccuuuagccau

SEQ ID NO: 350529 - RNA, 64 nt, Human
ucuccgacccugccacagguuccuggaaagacucuccaggaaauggaagauacugauuuuuuuu

SEQ ID NO: 350530 - RNA, 64 nt, Human
aagggaauuaggcuuuagauuuugauagcaauguuccaggaaugaaauauagauguuagcccaa

SEQ ID NO: 350531 - RNA, 64 nt, Human
auucaauugauauauaauaaccguucuaaccucuuccaggaaaauauuuuuagaacuacuagcu

SEQ ID NO: 350532 - RNA, 64 nt, Human
gaucugaaugcaagcaguuuauaugggagaugauuccaggaaauaccgauaugagaauggggaa

SEQ ID NO: 350533 - RNA, 64 nt, Human
agcagagguauccguguuggcuggauuuugaaaauccaggaauuauguuauaacgugccuguau

SEQ ID NO: 350534 - RNA, 64 nt, Human
auuuuagcuuguccuaaaucuugcuguccacccuuccaggaaagggacauuguaaaugaauaaa

SEQ ID NO: 350535 - RNA, 64 nt, Human
gggacagcaaagaugaugggcucugcacaccaacuccaggaaacucauucugggccagcucuau

SEQ ID NO: 350536 - RNA, 64 nt, Human
agcugacugaauguugguaggugcuccauuacaauccaggaaagucuguguuacugauauuugu

SEQ ID NO: 350537 - RNA, 64 nt, Human
augcaugcccagucagaaaucuguucuauucugcuccaggaaaaucggaaaccugugagucaga

SEQ ID NO: 350538 - RNA, 64 nt, Human
ucuuggcuggggccacuaccuccuuuccuaucuuuacaucuauguguauguugacuuuuuaaaa

SEQ ID NO: 350539 - RNA, 64 nt, Human
cacauggaggguaaauauuaaagugcguauuauguacaucuagaauccaugugacuugcagccu

SEQ ID NO: 350540 - RNA, 64 nt, Human
cuaaucuaccagagcauuguagauauuuuuuuuuuacaucuauuguuuaaaauagaugauuaua

SEQ ID NO: 350541 - RNA, 64 nt, Human
cuccuuaauaaaugccugcucauagaucuguaucuacaucuauaucuguaugugcaucuauauc

SEQ ID NO: 350542 - RNA, 64 nt, Human
uacucaggaggcugaggcacaagaaucgcuugaauccaggaagcaagcggagguugcagugagu

SEQ ID NO: 350543 - RNA, 64 nt, Human
agcagucccucccucaggaacuggaggaggggacuccaggaauggggaaaugugacaccaccau

SEQ ID NO: 350544 - RNA, 64 nt, Human
ucaguaugguuacauugauaaaauaguaagucaauccaggaacaguuauuuagaauucauauug

SEQ ID NO: 350545 - RNA, 64 nt, Human
gaauaaugaaaaggguaaaaagaacaaggggugcuccaggaagaaagaguccccccagucuuca

SEQ ID NO: 350546 - RNA, 64 nt, Human
ugggacccaaaggggaaagaggauuucccgggccuccaggaagaugucuuuguggacccacuau

SEQ ID NO: 350547 - RNA, 64 nt, Human
gaaagccggucucaaagauaacugcauccuucauuccaggaaagcccuagaauuagggcacauu

SEQ ID NO: 350548 - RNA, 64 nt, Human
uuuacccagaauacuugccgccugcuuuuuguccuccaggaaaccagaagcccggguaauuagg

SEQ ID NO: 350549 - RNA, 64 nt, Human
cuuccgcucccugccaccauccuccuuccugggcuccaggaaaguguuucugggaggucaggag

SEQ ID NO: 350550 - RNA, 64 nt, Human
aggggauuaaagaggggaggagagagugcagagcuccaggaaaggguaucagagcugcagccag

SEQ ID NO: 350551 - RNA, 64 nt, Human
aguauucuccaacuccaaacaagcucuagagugcuccaggaaaaguuauauucaguauaugaau

SEQ ID NO: 350552 - RNA, 64 nt, Human
auugaaacagucuauaaacuguauuuuugguccauccaggaagcuagucccuuguuucuccuuu

SEQ ID NO: 350553 - RNA, 64 nt, Human
uuauuuuuaguguuuuuucagauauaaaucgggguccaggaaauccucaccagaaucuggcacu

SEQ ID NO: 350554 - RNA, 64 nt, Human
aaugaaauacugagaugcugggcugucucucccuuccaggaaugcugggcccccagccuggcca

SEQ ID NO: 350555 - RNA, 64 nt, Human
aucucucagcuuuuucaggaggcgugccugggaauccaggaacuuuuugaugcuaauuagaagg

SEQ ID NO: 350556 - RNA, 64 nt, Human
ccucugcccugccucucccagcucccacaaggguuccaggaauuccugguguucccaggacacc

SEQ ID NO: 350557 - RNA, 64 nt, Human
caaauguuucagggaggccaguucugcagggugucagcuccaggacccacagggccagaaccag

SEQ ID NO: 350558 - RNA, 64 nt, Human
uggucugucccuucuuuggggagcagggccucgacagcuccagcucccuugaccuaccuuccuc

SEQ ID NO: 350559 - RNA, 64 nt, Human
cuacuuuuuauaacuuaagaauuuuuauaccaucuacaucuauccuacuuaugcagaaaaauag

SEQ ID NO: 350560 - RNA, 64 nt, Human
uuauauuuugaaaugaacuuguuggcccaucuauuacaucuacagcugacccuugaacaugggg

SEQ ID NO: 350561 - RNA, 64 nt, Human
gcauaggauuuggaagacaggaacggcacaggcguccaggaaagcagcugcacucagacaaugc

SEQ ID NO: 350562 - RNA, 64 nt, Human
aucaucagcuaccuucaaauuauugaccuggacaggguccaagucugauaguaaccuuuuacaa

SEQ ID NO: 350563 - RNA, 64 nt, Human
uuuuaggagggaggauguaaauagccgcacaaagggguccaacagcucuuugaguaggcauuug

SEQ ID NO: 350564 - RNA, 64 nt, Human
ccuguggccuuccacagcagaaaccagggcaaaaggguccaaacacaugguuuuccuugcugca

SEQ ID NO: 350565 - RNA, 64 nt, Human
ccagcagugaucccauaugcuaugaguuacugugggguccaagggcacucgcugcuugaaagua

SEQ ID NO: 350566 - RNA, 64 nt, Human
ugaaagggaaagcagcugucaccugacuucuggcggguccaacauagcccucagcuuaccucug

SEQ ID NO: 350567 - RNA, 64 nt, Human
agucugcgccccguccccagccagacccacucgcugccgggacccuuucacugccccgguggag

SEQ ID NO: 350568 - RNA, 64 nt, Human
uaggugugacacguucacacgacuauguagcacaugccgggagugaucugccagacauucuaau

SEQ ID NO: 350569 - RNA, 64 nt, Human
ggugcgcuuccucagugaccgaaagaacccggugugccgggagauggcugugguacugcuggcc

SEQ ID NO: 350570 - RNA, 64 nt, Human
caccugcuggccugucugacccuccgcacucaccugccgggacccucccuauuccauccaaggg

SEQ ID NO: 350571 - RNA, 64 nt, Human
agcgacgaaacguccaucugaggagccugggccuugccgggagggguacucaccccaccuaagg

SEQ ID NO: 350572 - RNA, 64 nt, Human
ugccucuguuccugaauuacauaagaauguaccaugccgggaagccagagaccugcaggggccu

SEQ ID NO: 350573 - RNA, 64 nt, Human
cccugagagcaagagccuucacuucuucuugcggugccgggaccauguguuggugaagcuggug

SEQ ID NO: 350574 - RNA, 64 nt, Human
ccugaggggcggggcguguagccagccaggugcaugccgggaccauggcccccauacuuggcug

SEQ ID NO: 350575 - RNA, 64 nt, Human
agaacucggugguaaugacugggaggucuauuccugccgggaggaaccucaguuggguaaggug

SEQ ID NO: 350576 - RNA, 64 nt, Human
uaggugugacacguucacauaacugugcagcacaugccgggagugaucagucggacauuuuaau

SEQ ID NO: 350577 - RNA, 64 nt, Human
uaggaacucaugccugucuuggcugcagucccuguacaucuaauauauacugauuuguuugccc

SEQ ID NO: 350578 - RNA, 64 nt, Human
aaacuuacuugacaacaaaacccauucuuucaguuacaucuacuaagagcucguaguucaauaa

SEQ ID NO: 350579 - RNA, 64 nt, Human
uaaaacucaaguuuacauuauucauuaaaaaaaguacaucuaguguugccuguaaugcuggaaa

SEQ ID NO: 350580 - RNA, 64 nt, Human
cgggccugcuucucucgugccugugcuucugaccuccaggaacuguaaacaggaacaccuaugu

SEQ ID NO: 350581 - RNA, 64 nt, Human
uuacccugcugcucagcuuucucagggaagcaacuccaggaacacuccuuccacuccccucucu

SEQ ID NO: 350582 - RNA, 64 nt, Human
gguuaauaauacauuuauguugacaccucccuaauccaggaaacauucacaaacaaggacuccc

SEQ ID NO: 350583 - RNA, 64 nt, Human
ucauucgcuacuaguuauucagagcguacuuuguuccaggaacuaugcuggaaacugauaguuc

SEQ ID NO: 350584 - RNA, 64 nt, Human
uauuuacuacauaguuauucagagccuacuguguuccaggaacuaugcuagaaacugucucucu

SEQ ID NO: 350585 - RNA, 64 nt, Human
cucaccuuugaacagaucccggugacauucuauuuccaggaaaauccggaaccugauuuuaguu

SEQ ID NO: 350586 - RNA, 64 nt, Human
aggacccggaagcagccugagcuguggcggaggauccaggaagcuacggagagaagcagccagc

SEQ ID NO: 350587 - RNA, 64 nt, Human
uucacaacuuacccuguuaagucaaaauuuauuuuccaggaauuuaauauguacuuuaguugga

SEQ ID NO: 350588 - RNA, 64 nt, Human
uuacauuuuaugcugaucuucaguucauaauucuuccaggaaaacucagucuuccaacugcaau

SEQ ID NO: 350589 - RNA, 64 nt, Human
uuuguuuuuuuccucauguaacauuggugaaggauccaggaauaugacacaaagguggaauaaa

SEQ ID NO: 350590 - RNA, 64 nt, Human
guuuauuguuugauguuuuuaaagguuuuugaaauccaggaauuaaaucaucccuuaauaaaau

SEQ ID NO: 350591 - RNA, 64 nt, Human
aguuuugauuucuugcucauuuucagaauaacuuuccaggaagagauggcauuuagaacuucag

SEQ ID NO: 350592 - RNA, 64 nt, Human
caauauguauuuaugucuuuugcuauggagcaaauccaggaaggcaagagaaacauucuuuccu

SEQ ID NO: 350593 - RNA, 64 nt, Human
gucugguuuaauuauuggagaaucgauucccaaguccaggaagagaaauguaagauucuagaaa

SEQ ID NO: 350594 - RNA, 64 nt, Human
uguucacacccaacuugguuuugcuacauaauuauccaggaagggaauaagguacaagaagcau

SEQ ID NO: 350595 - RNA, 64 nt, Human
ucuugauguggaaagucugaaugcaguauuuauagacuucuaagguuuuaaaauccaguaucaa

SEQ ID NO: 350596 - RNA, 64 nt, Human
ccugggccagagaagauaauguucuuuaauguuguccaggaaacccuggcuugcuugccgagcc

SEQ ID NO: 350597 - RNA, 64 nt, Human
augucucuuguagaagauggacucugaaaaacauuccaggaaaccauggcagcauggagagccu

SEQ ID NO: 350598 - RNA, 64 nt, Human
uguguuccccauguguguguacaacacuggugacuccaggaaccauuuucaccuauuaccagug

SEQ ID NO: 350599 - RNA, 64 nt, Human
uaagagcauuuccaugaaacaacacaugcagcauuccaggaacuugauuguuaaauucaauaag

SEQ ID NO: 350600 - RNA, 64 nt, Human
accuucuguuuguaaggaugauuuuaauauuaauuccaggaacacauguuuuuauuuccucugc

SEQ ID NO: 350601 - RNA, 64 nt, Human
cuugagcauggguccuuguucuuccuauuucaccuccaggaaagcaaaagugggagcagaaauu

SEQ ID NO: 350602 - RNA, 64 nt, Human
ugcagcugguguccccgauucuggcuguccuauguccaggaagaagcccauuuguugaggcuga

SEQ ID NO: 350603 - RNA, 64 nt, Human
gcauuugugcugguaguacaaguccuuuaauauguccaggaagggagccauugcccaguggucc

SEQ ID NO: 350604 - RNA, 64 nt, Human
aaagaagagccagccuugcaggaggguuuacaucuccaggaagaugggcugccagcaacugcag

SEQ ID NO: 350605 - RNA, 64 nt, Human
cagaccacacucugccuggccuugagccgugaccuccaggaagggaccccacuggaauuuuauu

SEQ ID NO: 350606 - RNA, 64 nt, Human
cucaccuuauucugacuuuuggauuucauggcauuccaggaagcuccuugccaugcuguuggcc

SEQ ID NO: 350607 - RNA, 64 nt, Human
gcugcaacugaagaacugcagccaagaccuuaauuccaggaaagcacagaggacaaaguuaauu

SEQ ID NO: 350608 - RNA, 64 nt, Human
ggcucugcugacgugcagggcucagcccagggcauccaggaacaggcuccagggcaggaaccug

SEQ ID NO: 350609 - RNA, 59 nt, Human
cugugugcaccaaggucugaaaaaugacuuccaggaaagguaggaugugucuaugguuu

SEQ ID NO: 350610 - RNA, 64 nt, Human
aguaccuagcacacugccuaguacauaguagaaguccaggaaauggaagccauuauuauguaaa

SEQ ID NO: 350611 - RNA, 64 nt, Human
aguuacauuaccaauguguagaagucagaaacuagacuucuaguuugguucaacauuugagggu

SEQ ID NO: 350612 - RNA, 64 nt, Human
uaagccaaauggaaauucuuaaugcaaucaugaggacuucuauugucucuuacuguuguauuag

SEQ ID NO: 350613 - RNA, 64 nt, Human
caagaaauuaugucagcuuauaaaaucaaacagagacuucuagacaaaaaccauuguugaugag

SEQ ID NO: 350614 - RNA, 64 nt, Human
cuuuauuugagcaaauuauuuuuucacuuuaggagacuucuacaaguuuguuuccuguuucaaa

SEQ ID NO: 350615 - RNA, 64 nt, Human
ucuggagaagacagcaggagccucucaguucuuuuccaggaaggaacgagggugggagcgagau

SEQ ID NO: 350616 - RNA, 64 nt, Human
acacuaggaauucuugacguggggucucuggagcuccaggaaauucgggcacaucauaugucca

SEQ ID NO: 350617 - RNA, 64 nt, Human
augucuggccgccucugagcuccucccacccuccuccaggaaccuccacaucuccaaaaaucuc

SEQ ID NO: 350618 - RNA, 64 nt, Human
uagacaacacacaaacgagagggcuuggcucccuuccaggaagauuuauuuaacaggcucccag

SEQ ID NO: 350619 - RNA, 64 nt, Human
ugggcucuccaccagcacaucacuaugcaucuguuccaggaaagaagaaaagcgagcgaggaag

SEQ ID NO: 350620 - RNA, 64 nt, Human
gucccagcuuucacugccagggucccagucagauuccaggaauuugcgcccuaacuuugcuugc

SEQ ID NO: 350621 - RNA, 64 nt, Human
cugaagaguugugucuuuuguggccagugacaaauccaggaaaugaauguugcugauagggaua

SEQ ID NO: 350622 - RNA, 64 nt, Human
uauuucuguuggcuaaggccagcccuggacauuguccaggaaggccuggggaggaggagugaag

SEQ ID NO: 350623 - RNA, 64 nt, Human
ugauggagcugaucaaggucauguuucucacuguuccaggaaauugaucaacucuuccaauggg

SEQ ID NO: 350624 - RNA, 64 nt, Human
cuugcccugaccccagcccgugcagcugcucuacuccaggaauggauguggggacucuuccugg

SEQ ID NO: 350625 - RNA, 64 nt, Human
augguaauauaaaggacuaggaagcagucauacuuccaggaaaugcuuggauucauguggacau

SEQ ID NO: 350626 - RNA, 64 nt, Human
aggucaaauuccauuugacaaaucccagggacuauccaggaauuuuuuuuuaacuggauauugu

SEQ ID NO: 350627 - RNA, 64 nt, Human
cagaugaaauuucaacccugaugguuuucggugauccaggaagucagugagacaaucucucuau

SEQ ID NO: 350628 - RNA, 64 nt, Human
ucugcuuuccaccgaguacuguguuuauucucucuccaggaaagcagaucaaaagaaaguuagc

SEQ ID NO: 350629 - RNA, 64 nt, Human
uacugagagaugaagcaucauauugacaacuuacuccaggaaaaaagguguguguauaggugug

SEQ ID NO: 350630 - RNA, 64 nt, Human
ccugaagcaagcuuuuggaagccugcaguccucccagcuccagugcagaagccucucucuccag

SEQ ID NO: 350631 - RNA, 64 nt, Human
caguccaggauggaaccugguucacccuucauaccagcuccaagccccagaccaugggagcugu

SEQ ID NO: 350632 - RNA, 64 nt, Human
cagacacauccgacauaaaauuccugcucugccacagcuccacucagggaucaugguugggaca

SEQ ID NO: 350633 - RNA, 64 nt, Human
cccucccccuuguccuuucccuucaguacccucucagcuccagguggcucugaggugccugucc

SEQ ID NO: 350634 - RNA, 64 nt, Human
gaugaaaacauaaauaucugccacauaaaagaaguccaggaaaauaacacguaauaagacuguu

SEQ ID NO: 350635 - RNA, 64 nt, Human
ugaagauuaaacaguaaucauuuuugucaaccacuccaggaagagucauuacuacauaugcuag

SEQ ID NO: 350636 - RNA, 64 nt, Human
ugggggugggaugggcuggugagaaaguucaaauuccaggaagccacuuuuuauuggauauaag

SEQ ID NO: 350637 - RNA, 64 nt, Human
cgucucuauucugccccagcuggagcauugcagcuccaggaagaugaauacauggcuuggugug

SEQ ID NO: 350638 - RNA, 64 nt, Human
gagguggggugggguggggugggggcugucuguguccaggaaacuuaauucccuggugacuaga

SEQ ID NO: 350639 - RNA, 64 nt, Human
guaggucucuggguuucagaugaagugcccaggcuccaggaaguugagggacccacaggagagg

SEQ ID NO: 350640 - RNA, 64 nt, Human
agggcuccuugugaggaaaccuugaacauuuccuuccaggaaugaaagagaaccucguccucaa

SEQ ID NO: 350641 - RNA, 53 nt, Human
cagguuugggaagcaauugaauuuccaggaaauauccauccaugaauuaugcc

SEQ ID NO: 350642 - RNA, 64 nt, Human
ccaagucugaguucccacaggggacccagcagccuccaggaaguccauacccugggguggcuga

SEQ ID NO: 350643 - RNA, 64 nt, Human
cagaggaggggccgcugccacccaccucccugccuccaggaaccacaccacaucuaagccugaa

SEQ ID NO: 350644 - RNA, 64 nt, Human
gccuagcuuuauaaucaguauaaauuuuaauuauuccaggaauaugcauaauauugaaauauuu

SEQ ID NO: 350645 - RNA, 64 nt, Human
uugccuugaaagaaucaacuucuaaccucaaccauccaggaaauugacaguggcugcaguauug

SEQ ID NO: 350646 - RNA, 64 nt, Human
accaacuuuucaaagcccaccaauccacauuuucuccaggaaauuaaauauuuaaguaagugag

SEQ ID NO: 350647 - RNA, 64 nt, Human
aaaaauggauagaaacaaaauucucuaguacucauccaggaaaccauucuucaauguugcaugu

SEQ ID NO: 350648 - RNA, 64 nt, Human
uagaaagacuccuaaaguauaggauuacaaagacuccaggaagcguaagaaagagauuguguuu

SEQ ID NO: 350649 - RNA, 64 nt, Human
cccugcuucuccucacagggccuggccauauagccagcuccaacccaaagcccugcacagugcc

SEQ ID NO: 350650 - RNA, 64 nt, Human
acagcaucugagcaccucucaaguuuuuccaggccagcuccaguuucagugaggagaguguggg

SEQ ID NO: 350651 - RNA, 64 nt, Human
gcuaguggcuguguagcauccucagugcaaaacccagcuccagaauuuucaccugguaacgaau

SEQ ID NO: 350652 - RNA, 64 nt, Human
aguguacgugaaugcucgcugucugauaggguuccagcuccauauauauagaaagaucgggggu

SEQ ID NO: 350653 - RNA, 64 nt, Human
uucuagcugaguaaccacugaccugugagcuggguccaggaaugcugugaggaacaacuuaaaa

SEQ ID NO: 350654 - RNA, 64 nt, Human
caucugaccucccccaccccagugugauuuaacauccaggaacugaggccugaaccauuuugca

SEQ ID NO: 350655 - RNA, 64 nt, Human
ggaaaagguaaaaugguaaucaaauagauuguguuccaggaaugcaaagguggcuuaauauuca

SEQ ID NO: 350656 - RNA, 64 nt, Human
aagaggaggccugggaguugacauucagcacucuuccaggaauaggacccccagugaggaugag

SEQ ID NO: 350657 - RNA, 64 nt, Human
caugacuuagggaggugggacccacccacccccauccaggaaccgugacguccaaggaaccaaa

SEQ ID NO: 350658 - RNA, 64 nt, Human
ucagaacucagcauccauccaucaguggcgcgaguccaggaaggucauggguagguggccggga

SEQ ID NO: 350659 - RNA, 64 nt, Human
cguuggcaguuggccuuaacuucuuaaucauugauccaggaauauuucaaccagagacacaacu

SEQ ID NO: 350660 - RNA, 64 nt, Human
agcaggcaggcaggagguccuguuagcccugccuuccaggaagguuggggugggaguuuugagu

SEQ ID NO: 350661 - RNA, 64 nt, Human
gucaaugggaugucaccuaccaaaauccaaauccuccaggaaaaacuacuacacuaaauggacc

SEQ ID NO: 350662 - RNA, 64 nt, Human
ccuuccauuucucuucuuugaccgugcuaggaauuccaggaaagugcauuccugcccuggugac

SEQ ID NO: 350663 - RNA, 64 nt, Human
agaguuccuuuagggcagagcugagggccugggauccaggaaccagugggauuggaugggagaa

SEQ ID NO: 350664 - RNA, 64 nt, Human
cuguccagaggcugcaaggauucagcauuauuccuccaggaaggagcaaaacgccucuuuuccc

SEQ ID NO: 350665 - RNA, 64 nt, Human
aacuguuuuauagagaauggggcagaggcacaacuccaggaauucucuagcuccuggucaggaa

SEQ ID NO: 350666 - RNA, 64 nt, Human
acucgacugguguuugaucacgaugggaaaaucauccaggaaacccccuacccccaccccagag

SEQ ID NO: 350667 - RNA, 64 nt, Human
cucuucuucugggagcugugaccucccuuccuccuccaggaagcccuccucuugugaugacuac

SEQ ID NO: 350668 - RNA, 64 nt, Human
cucugcuguggcggugacugcuucuggaccagaacagcuccagcucccagguauuuucuacagg

SEQ ID NO: 350669 - RNA, 64 nt, Human
guccaauggugaaccagguugccacuacuuugagcagcuccauuacaaugacauguggcugaag

SEQ ID NO: 350670 - RNA, 64 nt, Human
ucagagaaagccuuccauuauucucagcaagucucagcuccaggauacauuaauacaucuaaua

SEQ ID NO: 350671 - RNA, 64 nt, Human
guugugaugugaugcuggccacguuuccaaacggcagcuccacuggguccccuuugguuguagg

SEQ ID NO: 350672 - RNA, 64 nt, Human
uguuuguaauuauagauuugcuuggacaaaauauuccaggaacucauagcgagcucaaagcaau

SEQ ID NO: 350673 - RNA, 64 nt, Human
cccagcuucaaagcuuaaaaagagcucaggcuuuuccaggaagauccaggagggcuaauuagaa

SEQ ID NO: 350674 - RNA, 64 nt, Human
uuccacaaccagccuggaguguguagccccuuuguccaggaauuugacuagucaaucagugaca

SEQ ID NO: 350675 - RNA, 64 nt, Human
gccauaauggucuucucugcuguuccuugaacauuccaggaacauuccccccauccccucgugg

SEQ ID NO: 350676 - RNA, 64 nt, Human
ccugcgcugcaccaacauugggggccuggagcucuccaggaaagccaagcuggcggccaccgca

SEQ ID NO: 350677 - RNA, 64 nt, Human
uaacaaugcaguagccagcacguucgaggcgguuuccaggaagagugugcuugucaucugccac

SEQ ID NO: 350678 - RNA, 64 nt, Human
auuaauauguaucgccuuagagcaagagcuguguuccaggaaccagaucacgauuuuuagccau

SEQ ID NO: 350679 - RNA, 64 nt, Human
guucuagcugagagggccuggcccuggggugggcuccaggaaaacgcugguuaggccugggauu

SEQ ID NO: 350680 - RNA, 64 nt, Human
aaagcuaaguccuggguuccgucugauuuuagguuccaggaacuuccugagaacacccgaucgc

SEQ ID NO: 350681 - RNA, 64 nt, Human
ucacuugucauucuacuuucuauauuguuaucaguccaggaaacagguaaacagauguaauuag

SEQ ID NO: 350682 - RNA, 64 nt, Human
caugugcccuccugagggaggaccuggggcacaguccaggaacaagcuaauugggaguccaggc

SEQ ID NO: 350683 - RNA, 64 nt, Human
cugcuucucuugugaccacaauuaucuugccuuauccaggaauaauugccccuuugcagagaaa

SEQ ID NO: 350684 - RNA, 64 nt, Human
ucucuuuacguuuuuucucacaucuaucugcuaguccaggaauuuguuacuaaauagauuuucu

SEQ ID NO: 350685 - RNA, 63 nt, Human
accuguacugguuuaaauaaguuuaccuuuuccuccaggaaauauaaugauuucugggaacau

SEQ ID NO: 350686 - RNA, 64 nt, Human
uugauccuuuggcacuuaaauaaaugugaaauccuccaggaauuuuccugugauucuccuugua

SEQ ID NO: 350687 - RNA, 64 nt, Human
gagccaugagacccacagacuuggugccugagcgcagcuccagggaagccccagccccuuccag

SEQ ID NO: 350688 - RNA, 64 nt, Human
agagagaaaaaggguaucugcccuucuugccaggcagcuccacucucccgcugacugcccacac

SEQ ID NO: 350689 - RNA, 64 nt, Human
ggcuggaaguaauauucuaccagcaggaacucaacagcuccaguuaaaugcuuugauauagugg

SEQ ID NO: 350690 - RNA, 64 nt, Human
agguuccuauggcuggccacugcacagagcucuccagcuccaagaccuguugguuccaagcccu

SEQ ID NO: 350691 - RNA, 64 nt, Human
auugagauuuguuaaaacgguuaggacuguuuuguccaggaaagauaagaggaccaaacauaua

SEQ ID NO: 350692 - RNA, 64 nt, Human
auaauuguuagauuucuuccaugcauguauguguuccaggaauguuaaugagaugguauuguaa

SEQ ID NO: 350693 - RNA, 64 nt, Human
augauggaaaguggaagacauauaccaauuauauuccaggaaaaaauacuuuaauaguauuguu

SEQ ID NO: 350694 - RNA, 64 nt, Human
cccucauggcccccaggggcaggacugaguccccuccaggaagaagcaggggggaaucuauuuu

SEQ ID NO: 350695 - RNA, 64 nt, Human
ccugcacauccagaacugccuccuugccgcugccuccaggaagcccaccuugagccagagucaa

SEQ ID NO: 350696 - RNA, 64 nt, Human
cccugggguggcccaccgcauggguacaggggguuccaggaauccaaauccagcauggcuugga

SEQ ID NO: 350697 - RNA, 64 nt, Human
ugccuggcugcaucuguaugaaaucaaggcacacuccaggaagacugccacgucgcgccaacac

SEQ ID NO: 350698 - RNA, 64 nt, Human
gaaauccaucaucucuaucguugauauccuuccauccaggaauagauuuuucuuacucuacaua

SEQ ID NO: 350699 - RNA, 64 nt, Human
cucccccuccccaggcuggagacccccccccaacuccaggaaagagcagucagaguccagugcu

SEQ ID NO: 350700 - RNA, 64 nt, Human
uacugaaagaucucugucacauccaacuggaaauuccaggaaccaaaaagagcaucccuauggg

SEQ ID NO: 350701 - RNA, 64 nt, Human
gucagaugggaagacaugaaugcacacuagccucuccaggaaugccuccucccugggcagaaag

SEQ ID NO: 350702 - RNA, 64 nt, Human
aaaagaguuuaaacaaaaaacccacaauugaacuuccaggaaagugugaagacccaaaacagcu

SEQ ID NO: 350703 - RNA, 64 nt, Human
aaugaaagauuuuuguaaaaagucaguauuuauuuccaggaaaagccugaccuugcuauuugaa

SEQ ID NO: 350704 - RNA, 64 nt, Human
ugcaagaauuuuuugcauuaauugauuuuguaaauccaggaauauuaggcucuuugucaucuua

SEQ ID NO: 350705 - RNA, 64 nt, Human
agugcaugagacacacaccuacccuccccagcuuuccaggaacccuacuggcugccagacugau

SEQ ID NO: 350706 - RNA, 64 nt, Human
guuuauucuguaaggggaagguggcaaugggacccagcuccaucagacacuugucaagcuagca

SEQ ID NO: 350707 - RNA, 64 nt, Human
gaggggccucuucagugucuacugaguaaggggacagcuccaggccggggccugucuccugcac

SEQ ID NO: 350708 - RNA, 64 nt, Human
auaaucuccaaagguccacgaugggcuuucccaacagcuccaccuuacuucuucucauacuauu

SEQ ID NO: 350709 - RNA, 64 nt, Human
guccagaauucugccuggaaaccagcuuccuccucagcuccagcucuuuuaaugggcauaucaa

SEQ ID NO: 350710 - RNA, 64 nt, Human
auuacacuuaaagcaacaaccaacuaguaacagcuccaggaaaggggaaugaaucaacucuugg

SEQ ID NO: 350711 - RNA, 64 nt, Human
gggucuggcauccauaugaggaaaaaugcucagcuccaggaaagauggggaguccaaguggauu

SEQ ID NO: 350712 - RNA, 64 nt, Human
gugcaguugugauuucuguggaucccagcuugguuccaggaauuuugugugauuggcuuaaauc

SEQ ID NO: 350713 - RNA, 64 nt, Human
gcauaguggaagaggagagcaugaagcaaagaauuccaggaaacccaagaggcugagaauucuu

SEQ ID NO: 350714 - RNA, 64 nt, Human
uccgccagcucugagucccaggcagcuggacaucuccaggaaaccaggccaucugggcaggagg

SEQ ID NO: 350715 - RNA, 64 nt, Human
uggggcaggggucugcuucaggaaauggaagcuguccaggaaaugagcagagauucacaagaca

SEQ ID NO: 350716 - RNA, 64 nt, Human
auguugaauggaacuccaagaucucaccucuccauccaggaauggaguccauguaaucaaagug

SEQ ID NO: 350717 - RNA, 64 nt, Human
cucaguagaauuggauuuccaugucagcccccacuccaggaaggcagcccaaucccuaggugau

SEQ ID NO: 350718 - RNA, 64 nt, Human
acacugucuguuauuuucuguacauugugguagguccaggaaauaugacauuuucccccuugau

SEQ ID NO: 350719 - RNA, 64 nt, Human
uugugaccucugcauuaguauuuggagcagacccuccaggaaguccuuuuauacuagacugacc

SEQ ID NO: 350720 - RNA, 64 nt, Human
agacuuuagcuuuuccuuccauccgguggccuauuccaggaauuccucuuuugcuuaaaucagu

SEQ ID NO: 350721 - RNA, 64 nt, Human
ccccgccuggaggagauccgcaucuggggaccccuccaggaagaugcugacauccaggucagca

SEQ ID NO: 350722 - RNA, 64 nt, Human
uuccugugcauggacucugcccucagggugccuguccaggaagagcuguguggccuggcaagca

SEQ ID NO: 350723 - RNA, 62 nt, Human
gugaccuguaaacccaacagcucaccuccgccuccaggaagaccagacucccacccuuccac

SEQ ID NO: 350724 - RNA, 64 nt, Human
cauaccaaagcccugugaguucaucagagucagcuccaggaaccaucaugguaagugguauuuu

SEQ ID NO: 350725 - RNA, 64 nt, Human
cccagccagguuucuccgugcucacuaauuuauuuccaggaagguguguggaagacaugagccg

SEQ ID NO: 350726 - RNA, 64 nt, Human
guggcugagcucugugaucgcugugauguggacccagcuccagggagcagagugucgaggaugg

SEQ ID NO: 350727 - RNA, 64 nt, Human
caugaacuuuugaccaauaauuguuguuuugugucagcuccagccauuuuuguacauguuguau

SEQ ID NO: 350728 - RNA, 64 nt, Human
ccucccaaucuccuuccaccucccucccucccgccagcuccacgauuuuucgguguuucucugu

SEQ ID NO: 350729 - RNA, 53 nt, Human
caacacgcaggaucuacuagaccuccaggaacagacauggaccuucucuccag

SEQ ID NO: 350730 - RNA, 64 nt, Human
uauuugaaaucucaggacucuucuggccguagguuccaggaaagcucguggaagcuuuggggcu

SEQ ID NO: 350731 - RNA, 64 nt, Human
caaugcuaauagauccacugaagaucuggaaaauuccaggaacuuuucaccugagccuuucuuc

SEQ ID NO: 350732 - RNA, 64 nt, Human
uucagaaaucagggcacuugcauccauugccuuuuccaggaaagggaagaaaacacucaguuga

SEQ ID NO: 350733 - RNA, 64 nt, Human
acaaggucacucugaggauugaaacuugaucuuguccaggaaagcuuuguaccaaacagugaag

SEQ ID NO: 350734 - RNA, 64 nt, Human
ugucuucauuuuaauguguuugcaaucgcuccgcuccaggaagaacggaaaugcugucuuguga

SEQ ID NO: 350735 - RNA, 64 nt, Human
ugaggccuagaagagaaacugagagcucucucauuccaggaagccuuuucccuaguggaacauu

SEQ ID NO: 350736 - RNA, 64 nt, Human
cuuuuuucaaaguaggauuuccuuuuucaacuguuccaggaaagaaucucuaagacuggguagc

SEQ ID NO: 350737 - RNA, 64 nt, Human
aaaugccuauaacgcugugaguguccaguccuuguccaggaaacucagaucccggccuggcuuc

SEQ ID NO: 350738 - RNA, 54 nt, Human
gggauaguuuuaaaguguagcaucuccaggaagaagaggaaaaggagggaaccc

SEQ ID NO: 350739 - RNA, 64 nt, Human
gagcuguuuggucagugcauuauguugaaugagguccaggaacccagagccacccagcagacac

SEQ ID NO: 350740 - RNA, 64 nt, Human
ugucuucugggagccacugggcaauugccagggcuccaggaagggcucuggcucagguugcaga

SEQ ID NO: 350741 - RNA, 64 nt, Human
aauuuucagaauguuguuuuuuucauguagauacuccaggaagaguuaagcacugcuuucaguu

SEQ ID NO: 350742 - RNA, 64 nt, Human
aaugccauuccuauuuucuaauauaaaacucuuuuccaggaagcaugcuuaagcaucuuguuac

SEQ ID NO: 350743 - RNA, 64 nt, Human
cagaguggaaucuuuuaaagacaggaccccuauguccaggaaaggggaaaaggaacuuugccaa

SEQ ID NO: 350744 - RNA, 64 nt, Human
gcagggguucugccuguucccaaacuuuuuccauuccaggaacaaaggagaagccacuuucccc

SEQ ID NO: 350745 - RNA, 64 nt, Human
cucccgccagccuuguuuucagguggucuggaggcagcuccacguccacacaguggccggcccu

SEQ ID NO: 350746 - RNA, 64 nt, Human
cccccuuguuccaaaugaagacggcaucacgaagcagcuccaaaaggaaaagcuugggcggugc

SEQ ID NO: 350747 - RNA, 64 nt, Human
gcgccccgccaaggaggcaccuggaggugaaacccagcuccagcucccguuagccaggacuugu

SEQ ID NO: 350748 - RNA, 64 nt, Human
ucuuaguuaaauuggauugagaaugccuuuuguuuccaggaaaauauugaucaccaugaaagaa

SEQ ID NO: 350749 - RNA, 64 nt, Human
uuuuucucucuuagaauuggaggauuugccauuguccaggaaagaaacuugcagcuuuaaccug

SEQ ID NO: 350750 - RNA, 64 nt, Human
gcagaugccagcgaugccaggaaacaaguugaaauccaggaaucucuuuaacugauuuugcuaa

SEQ ID NO: 350751 - RNA, 64 nt, Human
agcggcaaaaauagacccagcuucugcaagguuuuccaggaaaaucugcuuggggcagcauuug

SEQ ID NO: 350752 - RNA, 64 nt, Human
ccagccccaaggauggcugggaguugcucaggcauccaggaaaaguggggaaugcugccaucug

SEQ ID NO: 350753 - RNA, 64 nt, Human
gagcaguggggugcuuggcagcuguucuguguuuuccaggaauccaacugagcauugaaaucuc

SEQ ID NO: 350754 - RNA, 64 nt, Human
uggugugucugauaacccaaagcagcgggcagauuccaggaaugaagaauuaggcuugguuuca

SEQ ID NO: 350755 - RNA, 63 nt, Human
gcagggaccuucaagccugagcagaugaaugacuccaggaagaagguaacuacccuaaugcua

SEQ ID NO: 350756 - RNA, 64 nt, Human
aacuugacuacacaacauaaaucacuuuuuaaauuccaggaacggguagucugacacggugauu

SEQ ID NO: 350757 - RNA, 64 nt, Human
ccacuggagagaucucuuggcuucccuaacuuaguccaggaacacagccuuguucuucucuucc

SEQ ID NO: 350758 - RNA, 64 nt, Human
agucuccaugggggcaaggagcauagagauguuuuccaggaaggggcucagaagcugcacuagg

SEQ ID NO: 350759 - RNA, 64 nt, Human
cacaggcaucuacacagccuggacuuugguucucuccaggaagguagcccagcacugugaagac

SEQ ID NO: 350760 - RNA, 64 nt, Human
cuuaagaaaacagaauauucaaaaacagcacuuuuccaggaaguuagugaggaagauaaggcac

SEQ ID NO: 350761 - RNA, 64 nt, Human
auuagacugauucuuccaccuauuuuuaugaaccuccaggaagaaaaacacuugccaaaacauu

SEQ ID NO: 350762 - RNA, 64 nt, Human
cuugccucuuagcauguuugauuuaagaaaagccuccaggaaaucuugagagccugucuuggca

SEQ ID NO: 350763 - RNA, 64 nt, Human
ugacaagacagguggggccuggcuccccacccgccagcuccaggacugccccuuccugggccaa

SEQ ID NO: 350764 - RNA, 64 nt, Human
cuuucuuggguuucuuucaggauuuuucuucucacagcuccaagcacgugucccgugccucccc

SEQ ID NO: 350765 - RNA, 63 nt, Human
auguggaucugccgaauugaagaggccugauuucagcuccaccagaugcagauuuguguuuug

SEQ ID NO: 350766 - RNA, 64 nt, Human
aguuuccucugcagcugcuaaaacuacauguggccagcuccauucuuccacacugcguacuaca

SEQ ID NO: 350767 - RNA, 64 nt, Human
uugcagcuccccagucucuaccugucaggaugacuccaggaagacagcuggaguacugcauuug

SEQ ID NO: 350768 - RNA, 64 nt, Human
gucauuuuugugauuuaauaacacacagugaaaauccaggaagaaugaauuaagcuucuucugg

SEQ ID NO: 350769 - RNA, 64 nt, Human
aaaacuugaucaacgcgacuguauuuugaaacauuccaggaagguuacuucuugucaaacuugc

SEQ ID NO: 350770 - RNA, 64 nt, Human
gcaaguaaggaggucugcccggagcagcagcuucuccaggaagcccagggcaccauccagcucc

SEQ ID NO: 350771 - RNA, 64 nt, Human
aaagaggaaaacaagugaggacacugguuuuaccuccaggaaacaugaaaaauaauccaaaucc

SEQ ID NO: 350772 - RNA, 64 nt, Human
ucuuccauauaaauuguuuauucaaccaucagguuccaggaaaaagccuguuaguauuuucauu

SEQ ID NO: 350773 - RNA, 64 nt, Human
gggguaggaaggugcugugggcuggucccacacauccaggaaagaggccaguagagaauucugc

SEQ ID NO: 350774 - RNA, 64 nt, Human
gaccgcgacaaggacgacauucuguucuacacccuccaggaaaugacagcagucagugccgccc

SEQ ID NO: 350775 - RNA, 64 nt, Human
ugugcugugugugccccaggcucuguugaccccguccaggaacuaacuuacccagcuuggucuc

SEQ ID NO: 350776 - RNA, 64 nt, Human
cacaaaccucaguggguccuacagauccgggcucuccaggaaugauugcagcuguguccugaau

SEQ ID NO: 350777 - RNA, 64 nt, Human
gccagucucacuuguggccuauuucucugcuucuuccaggaauuugcuuuuauuagucaaguau

SEQ ID NO: 350778 - RNA, 64 nt, Human
cccuugcccaaggcagggaagaaggauguguguguccaggaaggaaaaaaagguggaucaguga

SEQ ID NO: 350779 - RNA, 64 nt, Human
aacugaugauauccuauccucuccaagcuccuauuccaggaaaaaagauccaauguuuuuucua

SEQ ID NO: 350780 - RNA, 64 nt, Human
guucauauccagaggaauggcagaucugagacgauccaggaagagcuaaaacauggcccuguaa

SEQ ID NO: 350781 - RNA, 51 nt, Human
ugggacacacagccuccugacuccaggaagagccagagcugugcagggagg

SEQ ID NO: 350782 - RNA, 64 nt, Human
guucagagcugacccccuagcaacguaguugacacagcuccagguuuuuaaauuacuaaaauaa

SEQ ID NO: 350783 - RNA, 64 nt, Human
agcucuaacugauucagggccccugaagugaccccagcuccaggcaggaaaccccgagaaggaa

SEQ ID NO: 350784 - RNA, 64 nt, Human
guuuaauguuaccuuuuggcuugagaaugucuuucagcuccagaauuauuguuacucauauuuu

SEQ ID NO: 350785 - RNA, 64 nt, Human
ucuucugaggccgcaguggugguggcugcgcacacagcuccacagguugggagccgucguggga

SEQ ID NO: 350786 - RNA, 64 nt, Human
ucccuuggauuuagggauagugucccucuccauguccaggaaacuuguaaccacccuuuucuaa

SEQ ID NO: 350787 - RNA, 64 nt, Human
gggcuuccuguccugugucccuugguggguccccuccaggaaccaaggaguggcccuccaggug

SEQ ID NO: 350788 - RNA, 64 nt, Human
auguaauugcagcugguaggaugucuggugccaauccaggaagugagagccauuucuuuuguac

SEQ ID NO: 350789 - RNA, 64 nt, Human
guugcagcuuggagcguggagguccugccuagauuccaggaaguccagggcgauacuguuuucc

SEQ ID NO: 350790 - RNA, 64 nt, Human
acugucccccguuugccuccacgagccugcuguuuccaggaaauuacauaacguucaguuggga

SEQ ID NO: 350791 - RNA, 64 nt, Human
uuuaaagucuguagagucagcacagccccaucaguccaggaacuucccaccaccagcccuugac

SEQ ID NO: 350792 - RNA, 64 nt, Human
guucuccccacucugauccccugacucuccagcuuccaggaagguuccuucucagagccaaaua

SEQ ID NO: 350793 - RNA, 64 nt, Human
uuuccuucuccuccugucuuuaaagccugccucuuccaggaagaccccccuauugcugcugggg

SEQ ID NO: 350794 - RNA, 64 nt, Human
ugauauaugaguuaaaugaccaagcagacuugauuccaggaauguuaaggaauguucauuauuu

SEQ ID NO: 350795 - RNA, 64 nt, Human
cugcugggccgucuggcugccaggaagaagauauuccaggaaccuaagagcgcacaccaggugg

SEQ ID NO: 350796 - RNA, 64 nt, Human
auaucuuggccaaauaaauuacuuuccuugaauauccaggaaucuuuuagucuaaagcaaugag

SEQ ID NO: 350797 - RNA, 64 nt, Human
ccuacagucugcaucuguagugccuugugggguauccaggaacacccucccagcaggggauggg

SEQ ID NO: 350798 - RNA, 64 nt, Human
cuuggaguuuuuuuucauucauauuuuuguuguuuccaggaauuuauuugauauuaaugggcgu

SEQ ID NO: 350799 - RNA, 64 nt, Human
ugcaaggcuagagcugauggcacugucugcacuguccaggaaaaaaguaaaacuguacuguugc

SEQ ID NO: 350800 - RNA, 64 nt, Human
aaaagcuuccagaaagcagccaugaaccaggcuguccaggaauggcagcuguauccaaccacaa

SEQ ID NO: 350801 - RNA, 64 nt, Human
cuuuguggaugugaugugagcagggccccucccccagcuccauuccgcucccaccccagccggc

SEQ ID NO: 350802 - RNA, 64 nt, Human
ccucuacucccacccccacuaccucugggaaccacagcuccacaagggggagaggcagcugggc

SEQ ID NO: 350803 - RNA, 64 nt, Human
acaguuuuaggccugcguuacauauugccucuuccagcuccaaaguuuuggacccugucaguuu

SEQ ID NO: 350804 - RNA, 50 nt, Human
ccuccucuuccucccaguagcagcuccaugcucgcuacgucuugaaccuu

SEQ ID NO: 350805 - RNA, 64 nt, Human
gcccccugucucucagggccaggccucucccuccuccaggaagccuuccccuaccccuugucgc

SEQ ID NO: 350806 - RNA, 64 nt, Human
uuacaauccauagauagccagcaguggauguuacuccaggaaaaugcaggauuaaaauuguccu

SEQ ID NO: 350807 - RNA, 64 nt, Human
cuuguuugaaugcugccuccauuauauagguccuuccaggaacucaaacacuguaagugaaaua

SEQ ID NO: 350808 - RNA, 64 nt, Human
gacauccaggacuacgaggcggccaaggcucuguuccaggaaauucuugaagaguauaaugaaa

SEQ ID NO: 350809 - RNA, 64 nt, Human
guggcuugauuuuggccuauuuuacauuauuugguccaggaaauuagguuauauuagguuuuuu

SEQ ID NO: 350810 - RNA, 64 nt, Human
agcuccgaggaaaaauuggcccuucucaaacagauccaggaagccuauggcaagugcaaggaau

SEQ ID NO: 350811 - RNA, 58 nt, Human
uucguacuuugggacuuugauagcaacuuccaggaaugucacacacgaugaaauaucu

SEQ ID NO: 350812 - RNA, 64 nt, Human
uuccaaacagaacuauggaaaaaaaggaagaaauuccaggaaaaucugcacugugggcuuuuau

SEQ ID NO: 350813 - RNA, 64 nt, Human
ggcaauuguuucaaccaguuugaaccaagaacuuuccaggaaggcuaaagggaaaccgaauuuu

SEQ ID NO: 350814 - RNA, 64 nt, Human
ucuccuuccccccccccaccccgagauacgggguuccaggaaaggggagggguagcgggggagg

SEQ ID NO: 350815 - RNA, 64 nt, Human
aucucucccccucacccccuguggacaucacgguuccaggaacagcccuucccccaccacuggg

SEQ ID NO: 350816 - RNA, 64 nt, Human
ugucaauauuuaguaaagcuuuucuuuuuuaauuuccaggaaaaaauaaaaagaguaugagucu

SEQ ID NO: 350817 - RNA, 64 nt, Human
ggcuuauaaagcuuguacagcugccucccggcaguccaggaaaacugcaaaaaaugggaaguaa

SEQ ID NO: 350818 - RNA, 64 nt, Human
cguccaguuguucuccugauugacccgacuccacuccaggaaggccaucugacccugugacagg

SEQ ID NO: 350819 - RNA, 64 nt, Human
uuaaaugucuuucuucaugaaugcuucauggggcuccaggaagccuguaucaccuguguaaguu

SEQ ID NO: 350820 - RNA, 64 nt, Human
gacuuugcugccauccagccccagaucgcuuuacuccaggaaaugcacguuacacauuuucgcu

SEQ ID NO: 350821 - RNA, 64 nt, Human
ggauggaaacagugcagcccaggucccaugggggcagcuccaucccagagcauuucugauaguu

SEQ ID NO: 350822 - RNA, 55 nt, Human
uagugacaugugagaaauaaaauagcagcuccaccauggacuucaggcuguuagu

SEQ ID NO: 350823 - RNA, 64 nt, Human
gagauaaagcuggcuguuaucucaacaucuucaucagcuccagacugagacucagugucuaagu

SEQ ID NO: 350824 - RNA, 64 nt, Human
cugggugcucuccccaccacuacccuuguaaacuuccaggaagauugguugaaagucugaauaa

SEQ ID NO: 350825 - RNA, 64 nt, Human
uuuauuucagauuuuauuugugugacuuagaaauuccaggaacacaauuaggauauuuucauac

SEQ ID NO: 350826 - RNA, 64 nt, Human
ugugccugucaugacuguaauucauuaugacugcuccaggaagggcuaauggggccaauauauu

SEQ ID NO: 350827 - RNA, 64 nt, Human
ugcaagggaaggcauuaucggguggcucccuugcuccaggaacugaacgaggcccuuuucauac

SEQ ID NO: 350828 - RNA, 64 nt, Human
aauuuauauaacuguuguugauaaggaacauuuauccaggaauugauacguuuauuaggaaaag

SEQ ID NO: 350829 - RNA, 64 nt, Human
uuacuguagccucagaugauuuccccccuccgccuccaggaagaaagaauguuacugccuuaau

SEQ ID NO: 350830 - RNA, 64 nt, Human
aucuaacacuguuuugauuuuugugggaaaauauuccaggaaacgcuaauucucuuuagacucc

SEQ ID NO: 350831 - RNA, 64 nt, Human
cuuuuguuuuuaauuuuaaccauagugcacauauuccaggaaagugucuuuaaaaacaaaaaca

SEQ ID NO: 350832 - RNA, 64 nt, Human
uucuguuacauccaccuuugaggcuggucauaccuccaggaacaauacagagccagucaacuuc

SEQ ID NO: 350833 - RNA, 64 nt, Human
caccugagcgcaccaccaccuggcguguagaaucuccaggaagccuggcugcagcuucccauuu

SEQ ID NO: 350834 - RNA, 64 nt, Human
ucaguggguuaacaucaguuuuguuuacucauccuccaggaacugcaggucaaguugucagguu

SEQ ID NO: 350835 - RNA, 64 nt, Human
agagggcacgagaacccaaagggaauagagauucuccaggaauuuccucuaugggaccuuccca

SEQ ID NO: 350836 - RNA, 64 nt, Human
uugucauugacuucaagaugccucuucuaccucuuccaggaagcacaggccaggggaucugggu

SEQ ID NO: 350837 - RNA, 64 nt, Human
gcccccccugagccccaccuccuccagggagcccuccaggaagccccuucccugacuccuggcc

SEQ ID NO: 350838 - RNA, 64 nt, Human
ccucccuccuccugagucggugugugugucucucuccaggaaucuuugucucuaucugugacac

SEQ ID NO: 350839 - RNA, 64 nt, Human
caacugugccugcuaguguccccgugcacacaggcagcuccagggggcucugguugccaacaaa

SEQ ID NO: 350840 - RNA, 64 nt, Human
ucugucaccagacuggagugcaguggugccaucucagcuccaugcaaccucugccuccuggguu

SEQ ID NO: 350841 - RNA, 64 nt, Human
aaagaacccgacgucccacagccagauauacacccagcuccaugccagcccuucauguuuaccu

SEQ ID NO: 350842 - RNA, 64 nt, Human
uucuuaaaaucguuuagauuuuuuuugguuuguacagcuccaccuuuuagaggucuuacugcaa

SEQ ID NO: 350843 - RNA, 64 nt, Human
gaaagcaccugaauugugcuucugaauuaaccaauccaggaacugcuuuaccuuuggacuuuuu

SEQ ID NO: 350844 - RNA, 64 nt, Human
uuaauaaaagcuaugagacaaauaguccucuaguuccaggaaacacagucuuuuuuuaaaaaaa

SEQ ID NO: 350845 - RNA, 64 nt, Human
ggacccaggcucguggggagguuccacccuuggauccaggaagaacccuccacccugccucgug

SEQ ID NO: 350846 - RNA, 64 nt, Human
ucccuuuauuugcuucccccuccuccccucggccuccaggaagccaccguggccggccaagcac

SEQ ID NO: 350847 - RNA, 64 nt, Human
ccuagaguccagcugcagaaggaguggcuuuuccuccaggaaggggcuucuggguguccccuca

SEQ ID NO: 350848 - RNA, 64 nt, Human
acuuuugaggccacugcaaagauuccagccuggguccaggaacuucccaggagagccagcuggg

SEQ ID NO: 350849 - RNA, 64 nt, Human
cacccaggacagccuguggccuuugugagccaguuccaggaaccacacuucuguggccaucuca

SEQ ID NO: 350850 - RNA, 64 nt, Human
gaucugaugauuuauuuaaagagccguugaugccuccaggaaacuuaaguauuuuauuaauaua

SEQ ID NO: 350851 - RNA, 64 nt, Human
gucuucuuaacugcccaagugaaaagcaaccaaguccaggaaauuacaauagcuguuaaggaaa

SEQ ID NO: 350852 - RNA, 64 nt, Human
accaggagccacuuaagagauuauugugcuguuuuccaggaaagcugcagcuagaaaauggucu

SEQ ID NO: 350853 - RNA, 64 nt, Human
gguccagugccaaaaugagcuuaaaaucuuuguuuccaggaauuagcuaacuuggauuugugga

SEQ ID NO: 350854 - RNA, 64 nt, Human
ccugccccacuucagggcugcugugagauggaauuccaggaaagaacuucaggugucuggaccc

SEQ ID NO: 350855 - RNA, 64 nt, Human
ugaagauuuuuccucuugccuuacacauggagguuccaggaaaccucuugcagaacuucacacg

SEQ ID NO: 350856 - RNA, 64 nt, Human
gaagcagugcccgccaggccugggccaggagagcuccaggaagggcacugagcgcugcuggcgc

SEQ ID NO: 350857 - RNA, 64 nt, Human
agugcccggaauucccucaaaccacccaacuucauccaggaauacagucugcagugcagcaaca

SEQ ID NO: 350858 - RNA, 64 nt, Human
gcccuaggauccagguccucucucaccucugacccagcuccaugccagagcaggagccccgguc

SEQ ID NO: 350859 - RNA, 64 nt, Human
ucagaaggaaaagagaauuuuggccaucaaaauccagcuccaagugaacuuaaagagcuuauau

SEQ ID NO: 350860 - RNA, 64 nt, Human
ugggcauugccgggguaggguggugucuucaccacagcuccagaaggcacuggugggaugugga

SEQ ID NO: 350861 - RNA, 64 nt, Human
acaugcgggagccaggagagcacccuucuccacucagcuccaaagcgaaucuuugaaaacaccc

SEQ ID NO: 350862 - RNA, 64 nt, Human
aaagucauacacuuuaaaaaaaaaaaaaacuuuuuccaggaaaauauauugaaaucaugcugcu

SEQ ID NO: 350863 - RNA, 64 nt, Human
uuggauuuuugguaucuguggguuggggggacgguccaggaaccaauaccccauggauaccaag

SEQ ID NO: 350864 - RNA, 64 nt, Human
aaauugugugugagacugaguauguguucuuuuuuccaggaaaggcuccagugguucuuacuug

SEQ ID NO: 350865 - RNA, 64 nt, Human
uacaaagcugcaaguggauucuagugcugagucuuccaggaaaaaaucccguuuggccaccgug

SEQ ID NO: 350866 - RNA, 64 nt, Human
cccacgcuugagguccccggagcucccgggcacauccaggaaggaccuugcuuuggacccuaca

SEQ ID NO: 350867 - RNA, 64 nt, Human
acccaaugccucccuuugcuccuggaugccccacuccaggaaucaugcuugcuccccugggcca

SEQ ID NO: 350868 - RNA, 64 nt, Human
ccccagaccucucuguguugugugcguggcagccuccaggaauaaacauucuuguuguccuuug

SEQ ID NO: 350869 - RNA, 64 nt, Human
gaagugggaauauuuuacagaauaguaaaaugcuuccaggaacuacaagaugccaucugccguu

SEQ ID NO: 350870 - RNA, 64 nt, Human
uuuacguuuucccgagauguaaugaacugccauguccaggaagcuuggcugugagaagaaaccu

SEQ ID NO: 350871 - RNA, 64 nt, Human
gcuggccacaggcacaagggcugcagcugcuucuuccaggaaacugacacagggagcucagcgg

SEQ ID NO: 350872 - RNA, 64 nt, Human
ccggucgcgcgcuggccccgcaggaccuuccuuuuccaggaagagccagcuuuucucggagcgc

SEQ ID NO: 350873 - RNA, 64 nt, Human
agucuuguuccugacuccagaggaacgagagcauuccaggaaagagagauucccuggaaaauug

SEQ ID NO: 350874 - RNA, 64 nt, Human
ucaugaggccgaaaugaauuacaauguaaaguguuccaggaaccaaauuggauuuucuuucuuu

SEQ ID NO: 350875 - RNA, 64 nt, Human
gguauacauuccaaacugauaguacauugccaucuccaggaagacuugacggcuuugggauuuu

SEQ ID NO: 350876 - RNA, 64 nt, Human
aagagccuacucugaugaccguggccuuggcuccuccaggaaggcucaggagcccuaccucccu

SEQ ID NO: 350877 - RNA, 64 nt, Human
uggccacaauuuagccaugucaucugguggugaccagcuccaccaagccccuuucugagcccuu

SEQ ID NO: 350878 - RNA, 64 nt, Human
cccaggcccgugcccgccugcggcucaagcggaccagcuccauggauuccccaggagguccccu

SEQ ID NO: 350879 - RNA, 64 nt, Human
cgaacccuaauggaggcaguuuugaggagguccucagcuccacggcccaugccagugcccagag

SEQ ID NO: 350880 - RNA, 63 nt, Human
gcacaguaacugaaguuuaaauaaaaaugucuucagcuccaugcucaagguugaaaggguuac

SEQ ID NO: 350881 - RNA, 64 nt, Human
gccuugggauagcaaacuccagguuccugaaauauccaggaauauaugucagugaugacuauuc

SEQ ID NO: 350882 - RNA, 64 nt, Human
cagaagccugaucuuugggcaucagaaaacaggguccaggaauggugcuuuaugugagauaccc

SEQ ID NO: 350883 - RNA, 64 nt, Human
uuucuuuuugugcauuguccucaugccuguauucuccaggaaacuuguccuucuggaaaucaua

SEQ ID NO: 350884 - RNA, 64 nt, Human
acugccaucuugccauguacaggcuugggguggcuccaggaagccucguccagugauauauuuc

SEQ ID NO: 350885 - RNA, 64 nt, Human
uggggaucaccagcucugacuccaccaacccucauccaggaaucugccaugagucccagggagu

SEQ ID NO: 350886 - RNA, 64 nt, Human
agacccuucugaucacagcacccaggagcuugucuccaggaaggcggccccguccccuacucau

SEQ ID NO: 350887 - RNA, 64 nt, Human
gagugaccaaaccacaugaaccagacuuuucccguccaggaaauagcauuucagauuugguuuu

SEQ ID NO: 350888 - RNA, 64 nt, Human
uggaacuccauuccaccugacccuguguguacaauccaggaaaaaaacaaaccccacucagaaa

SEQ ID NO: 350889 - RNA, 64 nt, Human
aggcagcacacacagaauaacccugcauccaaauuccaggaagcucuuaggggucauccagcug

SEQ ID NO: 350890 - RNA, 64 nt, Human
uauuaaaaauguggaugugcuagaauuggauauguccaggaacaugggaagggcucacuauugg

SEQ ID NO: 350891 - RNA, 64 nt, Human
cuuguucuugggaagcagauuaaguagcagaaaguccaggaaagaaagaccagaaggaguaaug

SEQ ID NO: 350892 - RNA, 64 nt, Human
gcuuguaucccugcugauaagaggagggagucacuccaggaauaagacaaaaggagaggaggag

SEQ ID NO: 350893 - RNA, 64 nt, Human
uccuuuccccacuugcugaaaugcaccaugacgguccaggaaggggaagaccacuuucacauuc

SEQ ID NO: 350894 - RNA, 64 nt, Human
cugguuggcagugcccagauucgucaagugaggguccaggaaagcucuugcccucuugcccagc

SEQ ID NO: 350895 - RNA, 64 nt, Human
aucugguuuaauuauuggagaaucgauucccaaguccaggaagagaaauguaggguuuuacaga

SEQ ID NO: 350896 - RNA, 64 nt, Human
cccccaacuuuccccuacccccaacuuuccccaccagcuccacaacccuguuuggagcuacugc

SEQ ID NO: 350897 - RNA, 64 nt, Human
uaaucaccccaauccagcuccuggaggagggacccagcuccaucgcgcuggaggagagucaccu

SEQ ID NO: 350898 - RNA, 64 nt, Human
aggcgcucaucagguccagccugggcuccuccaccagcuccacccugagcuuccucuucggcaa

SEQ ID NO: 350899 - RNA, 64 nt, Human
gaggagucugagaagcagggaugccuggggugaucagcuccaaccaguggcagcagaguggugg

SEQ ID NO: 350900 - RNA, 64 nt, Human
acuuugggaggccgaggugggaggauugcuugaguccaggaauuugagaccagccuggacaaca

SEQ ID NO: 350901 - RNA, 64 nt, Human
gagggcaagaggugccugggaggaguggcccugauccaggaaaaugugaggggaaucuggaacg

SEQ ID NO: 350902 - RNA, 64 nt, Human
cagccgccacauccccgcuggcugggggccucacuccaggaaggggcuggacuggcuguccuuu

SEQ ID NO: 350903 - RNA, 64 nt, Human
uaacaugucccacucuuggauuagcagggguggguccaggaagaugauauuugcgucuuuugcc

SEQ ID NO: 350904 - RNA, 64 nt, Human
ccggucagaagccgccucccucgcucccugcuccuccaggaauucccagcaggcucucuggugu

SEQ ID NO: 350905 - RNA, 64 nt, Human
uguguguggaggacaaagcuucuuccugcguggcuccaggaaaagauguggcucacguaggugg

SEQ ID NO: 350906 - RNA, 64 nt, Human
uguaaagagggagcacauugacuugggaauuuccuccaggaaacucagggcuguuuucucuucc

SEQ ID NO: 350907 - RNA, 64 nt, Human
ggcucaggaggggcucucagggacuccuggugacuccaggaaaaugcugccaucguuaaacauu

SEQ ID NO: 350908 - RNA, 64 nt, Human
cucgcccugcccauggccaccccagacucugaucuccaggaaccccauagccccucuccaccuc

SEQ ID NO: 350909 - RNA, 64 nt, Human
caaaugguguuccaaguugguugcugugacaaccuccaggaagagccacuuguuacccucuauu

SEQ ID NO: 350910 - RNA, 64 nt, Human
caggauuuagaucuuggcuacugucaugcaggcuuccaggaacauagacuguuuuaccuccaca

SEQ ID NO: 350911 - RNA, 64 nt, Human
ucauggagaaugcaggcaguuaacuuaauaucccuccaggaaugguuccuacguuguguauuac

SEQ ID NO: 350912 - RNA, 64 nt, Human
cgugagguggcuuccuaguuacaugaggaugugauccaggaaauccaguuuggaggcuugaugu

SEQ ID NO: 350913 - RNA, 64 nt, Human
uucuaaauugaaaacacgccccccuccccacaccuccaggaacuccacucccagucuuagagcu

SEQ ID NO: 350914 - RNA, 64 nt, Human
uuucaaagcgccagucauuugcuccguuuucaaauccaggaaaugcagaagaggaaugugcaac

SEQ ID NO: 350915 - RNA, 64 nt, Human
cucccucccagccccagcgccucagccccagccccagcuccagcccugaggacagcucugaugg

SEQ ID NO: 350916 - RNA, 64 nt, Human
gaguuucccaugaguaacugaggggagggguacucagcuccaucuccaaagauaaaccuacucc

SEQ ID NO: 350917 - RNA, 64 nt, Human
gggucgugguggagaaucugagggcacucucugccagcuccacagggugggaugagccucuccu

SEQ ID NO: 350918 - RNA, 64 nt, Human
cauucccacauaauacauuccaucacagccagcccagcuccacucagggcuggcccggggaguc

SEQ ID NO: 350919 - RNA, 64 nt, Human
cccacuggaagggguucugccuucugaggugacauccaggaagcuguccccauucccuucuccu

SEQ ID NO: 350920 - RNA, 64 nt, Human
aggacgagccuucuccuuaucugcugcccaucuuuccaggaagucaggauggagucagaacaac

SEQ ID NO: 350921 - RNA, 64 nt, Human
cccuccugggcagauuggguagaaaggacauucuuccaggaaaguugacugcugacugauuggg

SEQ ID NO: 350922 - RNA, 64 nt, Human
gcaagggaggcaaucacacugaagcgggucuuccuccaggaacggggucccacaggcguguugu

SEQ ID NO: 350923 - RNA, 64 nt, Human
ugccgggcacgggcgcuccugcugccgucucugcuccaggaagcugccuccucugggcccucuc

SEQ ID NO: 350924 - RNA, 64 nt, Human
augacuucccuuucuagggcagacugggaggguauccaggaaucggccccugccccacgggcgu

SEQ ID NO: 350925 - RNA, 64 nt, Human
ccccaacacgguguccugccacccagcgccuggcuccaggaaaacacgcuugccuuccuucccg

SEQ ID NO: 350926 - RNA, 64 nt, Human
ccacccauccuuugccuuaucuaacaaacauuuuuccaggaagguggaaaaggaaguguugcuc

SEQ ID NO: 350927 - RNA, 64 nt, Human
cacuccggccuaggugacagagggaaacuccaucuccaggaaaaaaaaaaaaaaacccaauuug

SEQ ID NO: 350928 - RNA, 64 nt, Human
uguucuuaugcucauuuuguauuuuccuuucaacuccaggaauauccuugagcauaugagaguc

SEQ ID NO: 350929 - RNA, 64 nt, Human
caaagcagaaauguacaauuucuggucuguguuuuccaggaaauucauagagaagagaauagag

SEQ ID NO: 350930 - RNA, 64 nt, Human
gaagaccacccggcauucucugcccacuuugccuuccaggaaaugggcuuuucaggaagugaau

SEQ ID NO: 350931 - RNA, 64 nt, Human
uuugcauuguaacuuuucuuuuacauccuauuuuuccaggaacuuuggauuuaaguacucucac

SEQ ID NO: 350932 - RNA, 64 nt, Human
uggcgcacucuaguggacaggagaaggaacgccuuccaggaaccuguggacuaggggugcaggg

SEQ ID NO: 350933 - RNA, 64 nt, Human
cgggauugccuuuccccaggaucugugucggccauccaggaagaacuguacuggccaagccugg

SEQ ID NO: 350934 - RNA, 64 nt, Human
cccagacugaaaaaggaagaggaugguauuacaucagcuccauuguuugagccaagaaucuaag

SEQ ID NO: 350935 - RNA, 64 nt, Human
uugagauguaaguuucauuccagaauucauuccccagcuccauacucuguccccccagcuaaua

SEQ ID NO: 350936 - RNA, 64 nt, Human
uagugaugagaauuguaugucauguuagcaaacgcagcuccaacuuauauaaaauagacuuacu

SEQ ID NO: 350937 - RNA, 64 nt, Human
gcuuggggugaaaaguucugcccuccgcagggagcagcuccagcugccuggcagugcucccagu

SEQ ID NO: 350938 - RNA, 64 nt, Human
gcccggggggaccaggaugacaccuccauuucucuccaggaaguuuugaguuucucuccaccgu

SEQ ID NO: 350939 - RNA, 64 nt, Human
acccuugccauccugcaacagcuggacucaaguuuccaggaaguggagauguguuucuagaagu

SEQ ID NO: 350940 - RNA, 64 nt, Human
uucagacuuagucaauguuggcugaauuccuaaauccaggaagaagccuggacguagggucauu

SEQ ID NO: 350941 - RNA, 64 nt, Human
auuagaucaaugagacagaaaguuaacaaggauauccaggaauugaacacagcucugcaccaag

SEQ ID NO: 350942 - RNA, 64 nt, Human
gaacacuggaacauuccaguggacccuggaccauuccaggaaaacugggacauaggaucguccc

SEQ ID NO: 350943 - RNA, 64 nt, Human
cuccccaauccaggccaaagccccaugugccuuguccaggaacugccugggccaugcgaggggc

SEQ ID NO: 350944 - RNA, 64 nt, Human
cucugggacaggcccucccccauguucuucugucuccaggaagggcagcggcccucccaucacu

SEQ ID NO: 350945 - RNA, 64 nt, Human
ucucccugccagccccuaacuacccuccccagccuccaggaacuauccauccacucuuaucucc

SEQ ID NO: 350946 - RNA, 64 nt, Human
caacuucucccaccccuuggccccucacauccucuccaggaagggagugaggggcugugacauu

SEQ ID NO: 350947 - RNA, 64 nt, Human
acuuggguuguaaauuuauuuguggggagugcgcuccaggaagagccaccaucccugcccccgu

SEQ ID NO: 350948 - RNA, 64 nt, Human
agcccugguuaggcacugagggcucuggacgggcuccaggaacccugggcugaugggagcagug

SEQ ID NO: 350949 - RNA, 64 nt, Human
cccggaccagcuccgccuccccugcccuccucucuccaggaaggagccagaacccucaccccuc

SEQ ID NO: 350950 - RNA, 64 nt, Human
ggcgcacggacuggccaggccccgcgggccgggcuccaggaagggccugcacgaacccuacagc

SEQ ID NO: 350951 - RNA, 64 nt, Human
ugguaaagcccuuuggcucuuggcaggcagacuuuccaggaagaggcuccauguggcuccugcu

SEQ ID NO: 350952 - RNA, 64 nt, Human
gggagaaggugugagaccucuaggggcugucuccuccaggaagcccuccgggaagcacagcaaa

SEQ ID NO: 350953 - RNA, 64 nt, Human
ugagcaucauacuggaaagcaaacaccuuuccuccagcuccagaauuccuugucucugaaugac

SEQ ID NO: 350954 - RNA, 64 nt, Human
gagcucacaccgaguugugcuuggcuugcuugugcagcuccaggcacccggugggcacucuggu

SEQ ID NO: 350955 - RNA, 64 nt, Human
auuauaacauuaauaaaaauguugcuuuugucuucagcuccaugcagagcuacagcaugauaug

SEQ ID NO: 350956 - RNA, 64 nt, Human
guagaaagacagagcugggauguuucugucacaucagcuccacuuucagugaaagcaucacuug

SEQ ID NO: 350957 - RNA, 64 nt, Human
ucccuuuggugaccugaagucacugugacaguucuccaggaaggaggagcuuccuacuuuugag

SEQ ID NO: 350958 - RNA, 64 nt, Human
guggaugauccuacugcucccagcaaccucuacauccaggaaugagucccuaggggggugucag

SEQ ID NO: 350959 - RNA, 64 nt, Human
guaguuaguggucaaauuuccauuaaaggguguguccaggaaggaaauucuaauugggaugauc

SEQ ID NO: 350960 - RNA, 64 nt, Human
ggacuacauuucccaagaggcucugcuccaggaguccaggaaagacgaggcaccuuggccgcgg

SEQ ID NO: 350961 - RNA, 64 nt, Human
gcccaggcucacccccaccuugggccucaccuccuccaggaagccuucccagcuacccgaagcu

SEQ ID NO: 350962 - RNA, 64 nt, Human
guuucucuagagguguaggggacuggaaaccacauccaggaaguacagcuuucucuccugagca

SEQ ID NO: 350963 - RNA, 64 nt, Human
gauagcaacauacacauggccaguaaugcucuuguccaggaagaucuaauaccagagcuaaaaa

SEQ ID NO: 350964 - RNA, 64 nt, Human
gggggauggucaccuggugauuucaaugauggcauccaggaauuagcugagccaacagaccaug

SEQ ID NO: 350965 - RNA, 64 nt, Human
auagagagcccuaguuacugcauggggaaagagauccaggaagcaugagugcuggauauuuuac

SEQ ID NO: 350966 - RNA, 64 nt, Human
caguggcuugccccacccccuuauagcaucucccuccaggaagcugcugccaccaccuaaccag

SEQ ID NO: 350967 - RNA, 54 nt, Human
aguuugucaucaaggucuaagccuuccaggaaggggcuggccucugcugagcug

SEQ ID NO: 350968 - RNA, 64 nt, Human
caugcacuugcccuuaaaaacaaugauuugugaguccaggaacaauuuacuauuuuuaaaauau

SEQ ID NO: 350969 - RNA, 64 nt, Human
uucuuucaagggcuaaggcugcagagauauuuccuccaggaaucguguuucaauuguaaccaag

SEQ ID NO: 350970 - RNA, 64 nt, Human
uguagccuugacuccuugagacuguagauuucgauccaggaaacauuuauuuagcaccugccag

SEQ ID NO: 350971 - RNA, 64 nt, Human
uucauuugccauucauguccuguaauacuucaccuccaggaacugucauggauguccaaauggc

SEQ ID NO: 350972 - RNA, 64 nt, Human
gaagucauugucgcucagcaauagggugcaguuuuccaggaauaggcauuugccuaauuccugg

SEQ ID NO: 350973 - RNA, 64 nt, Human
caaggucagcauagacugaggcacacuggcuccucagcuccagccacccucacuccugccaugu

SEQ ID NO: 350974 - RNA, 64 nt, Human
ugaucuugggucuggggugauccaaauaccaccccagcuccagcugucuucuaccacuagaaga

SEQ ID NO: 350975 - RNA, 64 nt, Human
ggaccucagcucuucuuguuucuacagauggcaacagcuccauagggacagcuuguauaauuac

SEQ ID NO: 350976 - RNA, 64 nt, Human
guuucuuccccgaguggagcuucgacccacccacuccaggaacccagagccacauuagaaguuc

SEQ ID NO: 350977 - RNA, 64 nt, Human
acagauuuaaagacagguggccacugacagccacuccaggaacuugaacugcaggggcagagcc

SEQ ID NO: 350978 - RNA, 64 nt, Human
cugauugcuccaggcggacaaggcugacaagcaauccaggaacaaaauacucaccaggacgagg

SEQ ID NO: 350979 - RNA, 64 nt, Human
agugaagacaaucagaacuuugagaguucagaguuccaggaauauuguuauuguuaucuuccuc

SEQ ID NO: 350980 - RNA, 64 nt, Human
aagaccuccuggccaaguccugcccucuuaagucuccaggaacgcugcagggaaaacccagcug

SEQ ID NO: 350981 - RNA, 64 nt, Human
gggugccuggaguucccacgugucccggggcuuuuccaggaagcccgagcccaggaccuguugg

SEQ ID NO: 350982 - RNA, 64 nt, Human
acguccacgggcaggagaagguggauauuucagcuccaggaaagagagcuaauucacucucucu

SEQ ID NO: 350983 - RNA, 64 nt, Human
ucauuucugccuccaggaugccacugccucugcuuccaggaaaggcaagggggagggugcuuau

SEQ ID NO: 350984 - RNA, 64 nt, Human
cuccgaggacccaggaaaggcaggauugaaaauguccaggaaaguggccaagaagcaguggccu

SEQ ID NO: 350985 - RNA, 64 nt, Human
gcagcuggggacacaacugcccgggacucuaacuuccaggaauuaaagacucaccacacacgaa

SEQ ID NO: 350986 - RNA, 64 nt, Human
uacccgcgggaccucuuguaacccaucggcaucuuccaggaauccgccgagugacuugaggaag

SEQ ID NO: 350987 - RNA, 64 nt, Human
gaggccccugguggccuucaguuucaguuucucauccaggaagguaaccuugggcauuggcagu

SEQ ID NO: 350988 - RNA, 64 nt, Human
acuugggaguuuggucagugggguugguuugugauccaggaauaaaccuugcggauguggcugu

SEQ ID NO: 350989 - RNA, 64 nt, Human
gaauguuguggauuuuguguuauaauuuacuuuguccaggaacuugugcaagggagagccaagg

SEQ ID NO: 350990 - RNA, 64 nt, Human
acuuuaaaaugcgcauuacaaacuucuuagguguuccaggaauuaucaagugacuuuaaaauga

SEQ ID NO: 350991 - RNA, 64 nt, Human
cuugucccuuuugaucauuauuaacucaggguuucagcuccaaccucgcugaguuggugcagcu

SEQ ID NO: 350992 - RNA, 64 nt, Human
ucaggguuucagcuccaaccucgcugaguuggugcagcuccaggucauuccuggggugggaauc

SEQ ID NO: 350993 - RNA, 64 nt, Human
cgugcggccuuggccacaucccuauuaacagaggcagcuccacuucagacagggacaaggcuuc

SEQ ID NO: 350994 - RNA, 64 nt, Human
gguagaugcagcgguagcaucugagcuccugucccagcuccaggaaggggaguucuggguggag

SEQ ID NO: 350995 - RNA, 64 nt, Human
gcgcagaguggauuaaaggcaaaagagagaagaguccaggaaggggcggggagaagccugggug

SEQ ID NO: 350996 - RNA, 64 nt, Human
ggccacgcagcccagaccacaccugccacggucuuccaggaacggugcuccugcuucugcaaca

SEQ ID NO: 350997 - RNA, 64 nt, Human
uuauauauuacaaaccaucacacuuagaaauacuuccaggaaaugcuuuuuugaagugugaauu

SEQ ID NO: 350998 - RNA, 64 nt, Human
agcugcugggcccagaggugacauuugacuuuuuuccaggaaaaauguaagugugaggaaaccc

SEQ ID NO: 350999 - RNA, 64 nt, Human
cuccucuucacuuggccaguuucagcucacuuccuccaggaagucuuuccugauauaucaaacu

SEQ ID NO: 351000 - RNA, 64 nt, Human
aggugcugggcugucggggaggccucaggccaccuccaggaacagaacacaguuuuaaguuuga

SEQ ID NO: 351001 - RNA, 64 nt, Human
gaagccuggaaugaccucuugcacaagccuaaauuccaggaaucuuccccaaaucccagauccu

SEQ ID NO: 351002 - RNA, 64 nt, Human
caauaugaguuaaucuucucugaucgauguagauuccaggaagggguguccaggacaauuaccu

SEQ ID NO: 351003 - RNA, 64 nt, Human
ggguucuuugcuucagcugcacaucggcugccucuccaggaagcguguucaacacauggaauca

SEQ ID NO: 351004 - RNA, 64 nt, Human
ucugauguacccugugccauucaaggagaugugguccaggaaagugagccucaugguuuucaga

SEQ ID NO: 351005 - RNA, 64 nt, Human
uggaaagcccauucccuuuauuuagaaaacgagcuccaggaagccgcuacuuuguguccauuuc

SEQ ID NO: 351006 - RNA, 64 nt, Human
ggccugccuguggucagggccaaguguucccuccuccaggaaagccuuuacccuccucaugccc

SEQ ID NO: 351007 - RNA, 64 nt, Human
cgugacucagccuggacaccggacaugacugcccuccaggaauaaccccucccugagacauagu

SEQ ID NO: 351008 - RNA, 64 nt, Human
uugauuacaaguucucugcugugguugcugcagcuccaggaaguccccgcaaugucucacguug

SEQ ID NO: 351009 - RNA, 64 nt, Human
caugaacccuuggguagcuugauucugccuaccauccaggaaaacuugugcuggaauugcugau

SEQ ID NO: 351010 - RNA, 64 nt, Human
cugcagccugccccugugaucccuucggcgccagcagcuccaaaacuggaccaccagagaaugg

SEQ ID NO: 351011 - RNA, 64 nt, Human
cuuggcuaucccugaaagagggaggacuccgcugcagcuccaccaauaaacuugugucucacug

SEQ ID NO: 351012 - RNA, 64 nt, Human
uucuggggucuggaggacgguggcccucuucucacagcuccacuaggcagugccccaguaggga

SEQ ID NO: 351013 - RNA, 64 nt, Human
cucccugcugagugaacauaucccagaccauugccagcuccacucucugguuucuaauaaacag

SEQ ID NO: 351014 - RNA, 64 nt, Human
ucaccauaauuuugaagacuugcaugcagagggcuccaggaauuguagacauuaaggaauuuca

SEQ ID NO: 351015 - RNA, 64 nt, Human
ccaaucuacuagauaaauggccuucaggcagugcuccaggaauccuggggggucccaggccacc

SEQ ID NO: 351016 - RNA, 64 nt, Human
ugagacgcaucccaggaggugacgaggcaggggcuccaggaaaggaaucagagacaauucacag

SEQ ID NO: 351017 - RNA, 64 nt, Human
ucagagagcaugaacugaugcuggcaugaaggauuccaggaagaucauggagaccuggcuggua

SEQ ID NO: 351018 - RNA, 64 nt, Human
auagucucaggugggaacaccuucucuugcuagcuccaggaaggcuuugugggaaaugaguuga

SEQ ID NO: 351019 - RNA, 64 nt, Human
accccaucgccagucgucuucugccacaaugacauccaggaagguaggagaaggcaucugaguc

SEQ ID NO: 351020 - RNA, 64 nt, Human
ugauuugucugaauaaaggugucccacucacuguuccaggaauucuugcaguguagagguauuc

SEQ ID NO: 351021 - RNA, 64 nt, Human
ccggggacggacagggcagagggcagcgggcagcuccaggaacacgguggaacgggguucauug

SEQ ID NO: 351022 - RNA, 64 nt, Human
gcacagccaaucuccaggcucccucccucccagauccaggaacacaugcacacacacacacaca

SEQ ID NO: 351023 - RNA, 64 nt, Human
augcaccagucaucagcuauucaguugguaagcuuccaggaaaaaggacaggcagaaagaguuu

SEQ ID NO: 351024 - RNA, 64 nt, Human
cauauauagggcuacaucuuguuaauugcaauuguccaggaagguuuugggcaagauccaaaag

SEQ ID NO: 351025 - RNA, 64 nt, Human
gacucacagacauuaccaaagaggagcuugugaauccaggaaaagcuccagggggcuagcugau

SEQ ID NO: 351026 - RNA, 64 nt, Human
caacucaccguucccgggacaggcugcccccuguuccaggaagcucauccucaccuguguaggc

SEQ ID NO: 351027 - RNA, 64 nt, Human
cuucaaauucagucaccacuguuauauuaccuucuccaggaacccuccaguggggaaggcugcg

SEQ ID NO: 351028 - RNA, 64 nt, Human
uuccuguguguuaaaauauuuaaaaaguggauauuccaggaauguuuugcagcuuuguacaagu

SEQ ID NO: 351029 - RNA, 64 nt, Human
guuagucugggaggagcuauuucaucuuccagcucagcuccacacaaagcugcagaaggacgaa

SEQ ID NO: 351030 - RNA, 64 nt, Human
aacugaggcuuagagauagacaaucacuacaagucagcuccagcuuucugccaucuagccagcc

SEQ ID NO: 351031 - RNA, 64 nt, Human
ggacuuggccuaggguugucugagccggagccggcagcuccacuggagagcagugcaggcagag

SEQ ID NO: 351032 - RNA, 64 nt, Human
gggcgugugugugguggggcuuggcaugugauggcagcuccaggcaugccgcugcuuguauggc

SEQ ID NO: 351033 - RNA, 64 nt, Human
cauaaugcuuaaccaugucuuuuacuuaaacaauuccaggaacuggccuuaggagauccaaaua

SEQ ID NO: 351034 - RNA, 64 nt, Human
uuagcagaggccagccagcacugugcugcacaacuccaggaacuccaugguaugcucacaauuu

SEQ ID NO: 351035 - RNA, 64 nt, Human
guuuuguuuuauuauuccuggccauacucagggguccaggaagaauuuguaccauuuaaugggu

SEQ ID NO: 351036 - RNA, 64 nt, Human
ucuuuucccacaugaaccuccagcaaauagcaaguccaggaaaaacucuucucauucaaagagg

SEQ ID NO: 351037 - RNA, 57 nt, Human
ugaaggauaucguucucuaaaccagucuccaggaagaagagaaagaaaccacacugg

SEQ ID NO: 351038 - RNA, 64 nt, Human
aggaaggcaccaaaaggaaacaagcuggaaucgcuccaggaaaaacucugguuacaccuggaag

SEQ ID NO: 351039 - RNA, 64 nt, Human
gggugcguaaggaugugugaguuuugcuuuugacuccaggaacaaaaagguaaaucccacaucc

SEQ ID NO: 351040 - RNA, 64 nt, Human
aauaggaggagguuuugaagaauaaagccucauauccaggaaaaagugaucaagugaaaaagcu

SEQ ID NO: 351041 - RNA, 64 nt, Human
gaucuuaggucucaugaucugagugcauacccucuccaggaaggaaacugcaccagugucuauu

SEQ ID NO: 351042 - RNA, 64 nt, Human
ucucucuucauuucuccguagugcuugucuuuguuccaggaauagcgcuccaguuaccugcugc

SEQ ID NO: 351043 - RNA, 64 nt, Human
gcuccucucuggggcacccuaucugcuugucucguccaggaagcguuagggcugaugggugacu

SEQ ID NO: 351044 - RNA, 64 nt, Human
ggugagugcauugaagaaguagguuuuggagccuuccaggaauuccuuguugacaacaggggua

SEQ ID NO: 351045 - RNA, 64 nt, Human
uggagagccucagccauggcaaguccaucuggaguccaggaagcaggcaacuggccugacccau

SEQ ID NO: 351046 - RNA, 64 nt, Human
cacuaccccaccccacaugguugacucuuucccucagcuccaccagcucuucaucaugccacuc

SEQ ID NO: 351047 - RNA, 64 nt, Human
cucugagauagcagcuaccccggcaccaucugcccagcuccaaggacccuuggugagggcgugg

SEQ ID NO: 351048 - RNA, 64 nt, Human
aucauggaugccauggauuagcugugcaacugaccagcuccagguuugaucaaaccaaaagcaa

SEQ ID NO: 351049 - RNA, 64 nt, Human
uacuaggagugagaccagcuucuggcaacugccccagcuccaggccaucccauagccccuccuc

SEQ ID NO: 351050 - RNA, 64 nt, Human
uuccaccccacccccaaccuugucccaagugcccuggacuaaauuuccugugccagugacugca

SEQ ID NO: 351051 - RNA, 64 nt, Human
cuauguuaguuacuugaucuggaaguuuaaaauuuggacuaaaagguuuuauugaaauaaagcc

SEQ ID NO: 351052 - RNA, 64 nt, Human
gaugauucuguacccuaguauaucuuuuugggcauggacuaauuuguaucuguuuaacucauau

SEQ ID NO: 351053 - RNA, 64 nt, Human
uauguauagaaguaauaagaccauuuggaauuacuggacuaauugaauaguuaagguuucuauu

SEQ ID NO: 351054 - RNA, 64 nt, Human
gaauauuauuuucaacuguagucuuucuauacuguggacuaaugaaaugguguuguugauaauc

SEQ ID NO: 351055 - RNA, 64 nt, Human
ccauguugucgauggggccagagaugaagggaaguggacuaaaguauuaaacccucuagcuccc

SEQ ID NO: 351056 - RNA, 64 nt, Human
aguucccauccuuaaugacucacuugucaacuaguggacuaauuaacccuccaccaaaaaaaca

SEQ ID NO: 351057 - RNA, 64 nt, Human
aagagaauuagagaggugaggaucugguauuuccuggacuaaauuccccuuggggaagacgaag

SEQ ID NO: 351058 - RNA, 64 nt, Human
ccagucucagauauucuguuacagaaacacaaaauggacuaagacaccacccuuuuccaaaauc

SEQ ID NO: 351059 - RNA, 64 nt, Human
aauuuuuucuggcaacuguaaauggaaaaauauauggacuaaacguagcccugugcuguaucau

SEQ ID NO: 351060 - RNA, 64 nt, Human
uagaauauauggucuaauaguuuuuuaaagcuuuuggacuaaaguauuccacaaaucuuaccuc

SEQ ID NO: 351061 - RNA, 64 nt, Human
cuguucucuucggaagaccucguuuucuaaaggcuggacuaaauggcugcagaacucccuuugg

SEQ ID NO: 351062 - RNA, 64 nt, Human
aaauucagcccugaaaucaggcacaucuguucguuggacuaaacccacagguuaguucagucaa

SEQ ID NO: 351063 - RNA, 64 nt, Human
uccagcucccccugggaccuccagcauaugacaguggacuaaggacugugggguuuuccuccaa

SEQ ID NO: 351064 - RNA, 64 nt, Human
uuucacuucaaagcugucuggaaggaaaugcagucagcuccagcuaguacuauuuauguaccca

SEQ ID NO: 351065 - RNA, 64 nt, Human
gccuggaguaccuuucaaggucaaagugcauggccagcuccauugagacauuccauuucaaagc

SEQ ID NO: 351066 - RNA, 64 nt, Human
gagacaagagaagcccccaaccugauucucaugacagcuccaucaagaaugugggaugugccga

SEQ ID NO: 351067 - RNA, 64 nt, Human
uuuaggucccaccccauuggcccgucaccuccaucagcuccacuucucaaacuuuauuugagau

SEQ ID NO: 351068 - RNA, 64 nt, Human
uuaccaauuugagugccuccuacaugggcagcaguggacuaagugcugggugugauaaagagga

SEQ ID NO: 351069 - RNA, 64 nt, Human
cuguuucauaugaaggucguuucugagaauuaaauggacuaauguaugcaaaaagccuggcaaa

SEQ ID NO: 351070 - RNA, 64 nt, Human
acucuguaauuccuaacuaucacugguuugguucuggacuaaaacuacauugacagauugaauu

SEQ ID NO: 351071 - RNA, 64 nt, Human
cuugcucugaguuaugugacaugccucagccccauggacuaagcaggggucugguauaaaaaca

SEQ ID NO: 351072 - RNA, 64 nt, Human
ugcuucaccuuaaauuggaaaacaauaauagucuuggacuaagucuuuguacuaaagcauuugc

SEQ ID NO: 351073 - RNA, 64 nt, Human
ugcugcuguucagacuuuuuuaaaaaaaacuauuuggacuaaagaaacagauucugaaauuuau

SEQ ID NO: 351074 - RNA, 64 nt, Human
ccucuucuuccucacuguccccgcccccuauuuguggacuaaagaugaacucuggugugcaugc

SEQ ID NO: 351075 - RNA, 64 nt, Human
caagauucagucuugacaauauaauagcaaaagcuggacuaaagcccaaauggauugucugugg

SEQ ID NO: 351076 - RNA, 64 nt, Human
aggacccaggcaauagacuggccccaacucaggcuggacuaaggugugauuaauucuuuguuuu

SEQ ID NO: 351077 - RNA, 64 nt, Human
uuauuaaugauuacuuagaucaauuauuuagcaguggacuaauggaagcuacagagcagggaag

SEQ ID NO: 351078 - RNA, 64 nt, Human
auccaccaaaauaaauguuuucuacauuuucauuuggacuaaaucccacgaaugacaacuacca

SEQ ID NO: 351079 - RNA, 64 nt, Human
auuuuucauuuuguuucuccuucaaaaauuaaguuggacuaacauucacguaucaaacuaauau

SEQ ID NO: 351080 - RNA, 64 nt, Human
ucaccaguugcuuuuucagucaauuuggccgggauggacuaaugaggcucuaacacugcucagg

SEQ ID NO: 351081 - RNA, 64 nt, Human
aggugccauggaucgaugucaggguggucagcucuggacuaagccacccaccuccaauuuguac

SEQ ID NO: 351082 - RNA, 64 nt, Human
uuguuuguagugaacaaaguugaaacauuugcucuggacuaaagaagccuagugguuugugugg

SEQ ID NO: 351083 - RNA, 64 nt, Human
uauguuccaagacaaagaugaacccauacaugaucagcuccacgguaauuuuuagggacucagg

SEQ ID NO: 351084 - RNA, 64 nt, Human
cagcccuaacaagaacuguuuuugaaucguugugcagcuccaggcaauagaguaugugaagcga

SEQ ID NO: 351085 - RNA, 64 nt, Human
cugagagcugggcggcguccacaccuaagaacagcagcuccaccaaaugaagucccucucacgc

SEQ ID NO: 351086 - RNA, 64 nt, Human
uguucgugccuguaagauugguuuguguccugaccagcuccaaaaauauacuucacugcccuga

SEQ ID NO: 351087 - RNA, 64 nt, Human
caucacuuuuugugucuguuuuuuuuuuuuuucuuggacuaaauucaacugcauggaagcggug

SEQ ID NO: 351088 - RNA, 64 nt, Human
ugugauuuauuuauuucuaccuuucugagucucuuggacuaagaagauguuuugaaauguacca

SEQ ID NO: 351089 - RNA, 64 nt, Human
ugauuuacuuaagucaauaacagauggaauccuguggacuaaugugccaccaguuuucuaacaa

SEQ ID NO: 351090 - RNA, 64 nt, Human
aucugaacugcuaauguggcugcuuuguagggaauggacuaauaucaguguguuagaucuuaag

SEQ ID NO: 351091 - RNA, 64 nt, Human
gaagucucuuuaaugcaaugauuuguuuuauauuuggacuaagguucuugagcuuaucucccaa

SEQ ID NO: 351092 - RNA, 64 nt, Human
auuagauguucucuaucauuuaauaauauacuuguggacuaaaagauauaagugcuguauaaaa

SEQ ID NO: 351093 - RNA, 64 nt, Human
aaguggaauuagaaagcuggagugcuucuucagauggacuaaauuuaugucgugugugugugug

SEQ ID NO: 351094 - RNA, 64 nt, Human
aaagauaaagggauugugaaaagagcauuuauauuggacuaaucagaugagaguguuuuguuau

SEQ ID NO: 351095 - RNA, 64 nt, Human
aauccaggaacuuuuugaugcuaauuagaaggccuggacuaaaaauguccacuauggggugcac

SEQ ID NO: 351096 - RNA, 64 nt, Human
ucaagaaauuuaaaauucucucuuugagaugggguggacuaagaccacccccaaaguuuaaaaa

SEQ ID NO: 351097 - RNA, 64 nt, Human
uaaaccuugcauuaaaauaauaucacaguaucaguggacuaaacauuaaaauguaccacucuaa

SEQ ID NO: 351098 - RNA, 64 nt, Human
guguguguaauuauggccaaaaggacauaggagauggacuaagaugucuuggaccaccuuugug

SEQ ID NO: 351099 - RNA, 64 nt, Human
gaauucuaacauuaaaucacagcccaaaauuugauggacuaauuauuauuuuaaaauauaugaa

SEQ ID NO: 351100 - RNA, 64 nt, Human
gcccaggcggacgggagggaggcacccggccggcuggacuaaucugggaucgcggugauuugca

SEQ ID NO: 351101 - RNA, 64 nt, Human
cucaaucgugcacugcaaauuugcauguuuguuuuggacuaauuuuuuucaauuuauuuuuuca

SEQ ID NO: 351102 - RNA, 64 nt, Human
uuuccaccugucaggaugccuguggucaugcucucagcuccaccuggcaugagaagggauccug

SEQ ID NO: 351103 - RNA, 64 nt, Human
uuccucucuuuguucucagcucccccuguccccucagcuccagacguaggggagggguugccac

SEQ ID NO: 351104 - RNA, 64 nt, Human
ccucuccugagccugucucucccuacccucuucucagcuccacucugaagucccuuccuguccu

SEQ ID NO: 351105 - RNA, 64 nt, Human
gcuacaugugcuggauaucucuuguuuuccccuccagcuccacucugcucuugcccacaaagcu

SEQ ID NO: 351106 - RNA, 64 nt, Human
guacaccaugccucgaaaauaaguccagaagcacuggacuaaagagugcuaaugcaggaaauaa

SEQ ID NO: 351107 - RNA, 64 nt, Human
aaaguauucuuugaguuuccauauugaauguguuuggacuaaacaaacaauaaacuacugaugu

SEQ ID NO: 351108 - RNA, 64 nt, Human
aacuccauauuucugugaggucacugaggccuuauggacuaacucugugaggauaggaguuaua

SEQ ID NO: 351109 - RNA, 64 nt, Human
gcauggcuuugagaagugccucagcacccugaaauggacuaaggccagcuuucauuaagaaucu

SEQ ID NO: 351110 - RNA, 64 nt, Human
caauuuuuaucaucauaaaugggcaaaaaguaguuggacuaauuucgguuuuuauacaaguaaa

SEQ ID NO: 351111 - RNA, 64 nt, Human
aaauguauuugaacauugguucuguaaaagauaauggacuaaaaaaguagagaggaguuguaga

SEQ ID NO: 351112 - RNA, 64 nt, Human
agggaggggaccgcucccccuuucucuguggggguggacuaacacaauuaaaaugaacauccug

SEQ ID NO: 351113 - RNA, 64 nt, Human
auguguauagaaagacuuucuuuuacgauaacucuggacuaaaaaaaucaggaucauuaaaaga

SEQ ID NO: 351114 - RNA, 64 nt, Human
ugacaauuuccagugaaggugagcuggagcugguuggacuaaugagacugaggaagcagcuuuu

SEQ ID NO: 351115 - RNA, 64 nt, Human
cuuuauucacaguacauuauauugugugaugcacuggacuaacucuuguuuaccauucauguaa

SEQ ID NO: 351116 - RNA, 64 nt, Human
cagcagccuacaacuaaguuccuaaacgccacuuuggacuaauuuaaaaaagaaucccaguuuu

SEQ ID NO: 351117 - RNA, 64 nt, Human
uccagaauccaguguggugcuguggaaggagcacuggacuaaaggcuucaguggcugcgugucc

SEQ ID NO: 351118 - RNA, 64 nt, Human
aagaaaacacucaacaaaaccaaucuacauguuuuggacuaaaaaaaaaaauagagguuguauu

SEQ ID NO: 351119 - RNA, 64 nt, Human
uccuccccaucucucagucuaugaagugaacaguuggacuaacugauuauuaaggacucuguca

SEQ ID NO: 351120 - RNA, 64 nt, Human
agccuucagggcugcucggagucaccuguuggaauggacuaaaaggacccuugugugggaacag

SEQ ID NO: 351121 - RNA, 64 nt, Human
augugggccccaggcaaggugcagccuuugcucacagcuccauccaugucuagaccuucaggcc

SEQ ID NO: 351122 - RNA, 64 nt, Human
guuggggcucugccagguccccugggaccaacuacagcuccaaucagaaacccugcgcuuccuu

SEQ ID NO: 351123 - RNA, 64 nt, Human
aaguacaguguggauuucaaaugguguguaacuucagcuccagcugguuuuugacagcuguugc

SEQ ID NO: 351124 - RNA, 64 nt, Human
aaauauugaauaacuagaacacaagccacuguuucagcuccagaaaaaagaaagggcuuuaacg

SEQ ID NO: 351125 - RNA, 61 nt, Human
acuuucaaacagaaguuuaaaaaaaucaaaauggacuaagguagagacaaaacuuuauugc

SEQ ID NO: 351126 - RNA, 64 nt, Human
auauuuuaugcacuagacaauggaucugcaacuuuggacuaaggucauucaauguacccaaacu

SEQ ID NO: 351127 - RNA, 64 nt, Human
aaauauucuugcaauaauuguaaaaauuugaauguggacuaaguccuagauuauauuaaaauau

SEQ ID NO: 351128 - RNA, 64 nt, Human
aggcauuuuagaauccauacuguuccagcagaacuggacuaauucuguggacccucagaccccu

SEQ ID NO: 351129 - RNA, 64 nt, Human
gaggaaggugggaagcagaugacugaggaagggauggacuaagcuaauccccuuuugguggugu

SEQ ID NO: 351130 - RNA, 64 nt, Human
aauuuggccuugguugggcucugccaaagacuaauggacuaaaaugugaaacagccucuugccc

SEQ ID NO: 351131 - RNA, 64 nt, Human
ccagcucugacccagguccgcccagggacccacauggacuaaaggcaaugccaggagcccugaa

SEQ ID NO: 351132 - RNA, 64 nt, Human
guuuggauagaauauaauugauugguuuguuacuuggacuaacaaggcaguagauuugccugug

SEQ ID NO: 351133 - RNA, 64 nt, Human
aaagaugauagcaauauauuauuugguuacauaguggacuaacauuuuuaguaaucucuuuugc

SEQ ID NO: 351134 - RNA, 64 nt, Human
aacuuuuagagggaacggccacuggagguagagcuggacuaauccagugccugguagacagcgg

SEQ ID NO: 351135 - RNA, 64 nt, Human
acaguguagcaaguagcuuacaaggggacaauucuggacuaaugagaaagaccugaagugaagg

SEQ ID NO: 351136 - RNA, 64 nt, Human
cugggucccuguccugcccugcuccgcgagggccuggacuaacucagauggugcucggcuggac

SEQ ID NO: 351137 - RNA, 64 nt, Human
uuuggacucuaaagaccaauguuuggccacuaacuggacuaauauguaucuuucugugauuuca

SEQ ID NO: 351138 - RNA, 64 nt, Human
ccacauaaaauagccauuuucuuuaaaauaguuuuggacuaacgaagcugaaaucuauucucau

SEQ ID NO: 351139 - RNA, 64 nt, Human
guacagacaaaacuacagacuuagucugguggacuggacuaauuacuugaaggauuuagauaga

SEQ ID NO: 351140 - RNA, 64 nt, Human
ugaaauuucagagauucauuguucuuaaccauauuggacuaaagucuguugguuagugcuguug

SEQ ID NO: 351141 - RNA, 64 nt, Human
uugccaagccagugcucuuuugguauauggcauacagcuccauuggaggggacacaucacuggc

SEQ ID NO: 351142 - RNA, 64 nt, Human
gccuuggaguguaauuaccugucaucugggccaccagcuccacuggccugcccguugccgggcc

SEQ ID NO: 351143 - RNA, 64 nt, Human
accgaugcacgccaccaccaugccuguguuacagcagcuccaugaugguuguugcccgagguua

SEQ ID NO: 351144 - RNA, 64 nt, Human
accagccgaaccaaugucaaaauuaauaaagaaauggacuaauggcacagggcucuaucucucc

SEQ ID NO: 351145 - RNA, 64 nt, Human
auuauuugugaacuuguuacccuuuugguaaugguggacuaauugcuguauaguuauuuuuguu

SEQ ID NO: 351146 - RNA, 64 nt, Human
uagcuuuuguaaaacucguuuguuuucaaaggucuggacuaagcaaaacaacagugucaguuua

SEQ ID NO: 351147 - RNA, 64 nt, Human
cagucaugggcaguccuuuacagcagcaugagaauggacuaauacacuccucaaauguuuugaa

SEQ ID NO: 351148 - RNA, 64 nt, Human
uuuucuuccuuugaagcuuuaggcagagccauaauggacuaaaacauuuugacuaaguuuuuau

SEQ ID NO: 351149 - RNA, 64 nt, Human
cgucccgggcaccgguggcaggcagcuggccuucuggacuaaggcagccuggggggacacugca

SEQ ID NO: 351150 - RNA, 64 nt, Human
auucuaaagcuagaggaaguaugugauauacacauggacuaaggcucaggugacacuauggcua

SEQ ID NO: 351151 - RNA, 64 nt, Human
auuguacuuugauaagucuguacauugacguguauggacuaaauccaggguaaaaucaauguua

SEQ ID NO: 351152 - RNA, 64 nt, Human
cuagcuucagggcucuuauaggaaaugcuaagccuggacuaagugcccagcucagccaucaucc

SEQ ID NO: 351153 - RNA, 64 nt, Human
gcuucaguuuucucaucuguaaaaucaggaagauuggacuaagugauccugaaauguauuuuuu

SEQ ID NO: 351154 - RNA, 64 nt, Human
uucaaaauauguaaugacugguauggcaaaagauuggacuaagacacuggccauaccacuggac

SEQ ID NO: 351155 - RNA, 64 nt, Human
uguguuaauugcguagaggcuacagggguuagccuggacuaaaggcauccuugucuuuugagcu

SEQ ID NO: 351156 - RNA, 64 nt, Human
guaauuuuguuuugcacauucauguuuauugaaguggacuaauuucuauaaugcaaaucagagu

SEQ ID NO: 351157 - RNA, 64 nt, Human
ggaagaggaaggaagguggguggggcugguaguauggacuaaggugcugcaggaccuggggcca

SEQ ID NO: 351158 - RNA, 64 nt, Human
uuuuuucacccuuagaaaagggacuguuuuucuauggacuaaguagaaguuacagagucaugua

SEQ ID NO: 351159 - RNA, 64 nt, Human
ugaauaacccaguuuaaaaagaguccaguuaggguggacuaacuuuggacacaaauuggcuucc

SEQ ID NO: 351160 - RNA, 64 nt, Human
gucccuccucccccacgccuccauccacacacagcagcuccaaccuggaggcuggaccaacugc

SEQ ID NO: 351161 - RNA, 64 nt, Human
gacacucuaguccuccaggauagugcuccucccccagcuccagggcuccuggauguccuuccuc

SEQ ID NO: 351162 - RNA, 64 nt, Human
cccagggcuaccacugguauuccugagccucucccagcuccacuucuaaugcuagagaaugaua

SEQ ID NO: 351163 - RNA, 64 nt, Human
cuccuugcuuuugacaaauuucuuuauuccccucuggacuaaaguaguggcuauuuuugugcca

SEQ ID NO: 351164 - RNA, 64 nt, Human
ccacaacugacacaggaaaccaacacccaaagcauggacuaaccccaacgcacaggaaaaggua

SEQ ID NO: 351165 - RNA, 64 nt, Human
cgccguccuggcugcgcaggaggggccgcuggcauggacuaagaaauccugacaccaagaaggg

SEQ ID NO: 351166 - RNA, 64 nt, Human
gaggcuguucucuguaagucuuuuaaguuuugguuggacuaaaggcugaagugaaaaucucccu

SEQ ID NO: 351167 - RNA, 64 nt, Human
acacuuacauguauguauuuugauagauauuacauggacuaaauuuugucaauuucauguaauu

SEQ ID NO: 351168 - RNA, 64 nt, Human
aggagcaaaccagaaauggcuuuauuuucucccuuggacuaauuuuuaagucucgauuggaauu

SEQ ID NO: 351169 - RNA, 64 nt, Human
ggucuuuggaaauauaauaaaacaucaacuaacuuggacuaauugugaggaagagcagaacaaa

SEQ ID NO: 351170 - RNA, 64 nt, Human
uuaagaguuuuccuucaggcuuuacuuaggagaauggacuaagcugaagguguacuucaccagc

SEQ ID NO: 351171 - RNA, 64 nt, Human
gagacccuucugggucagaggagagagacugaauuggacuaaacccguccucuguucccagcac

SEQ ID NO: 351172 - RNA, 64 nt, Human
acgacuagaaccuuaggcauuggggaguuuuagauggacuaauuuuauuaaaggauuguuuuuu

SEQ ID NO: 351173 - RNA, 64 nt, Human
cuagguucuccagugacagaaagauccugaagcauggacuaacaugcucucuggagcuuaguac

SEQ ID NO: 351174 - RNA, 64 nt, Human
cuuuuuguucccuaguuggucuaagggucuguauuggacuaauucugaacuacagacaaauugg

SEQ ID NO: 351175 - RNA, 64 nt, Human
aauuaauuaaccaugauggaugaaucuauguuauuggacuaauuugcuucaagaaacaccagaa

SEQ ID NO: 351176 - RNA, 64 nt, Human
aggcucuagagccagcacaggucacugccugaccuggacuaagaaccccacggccccacugucc

SEQ ID NO: 351177 - RNA, 64 nt, Human
cagccuaggcccuuaaucuugcuguuauuuuccauggacuaaaggucuggucaucugagcucac

SEQ ID NO: 351178 - RNA, 64 nt, Human
ccuguuuaucuacacugcugcccacuccucucuccagcuccacaugcuguaccuggaucauucu

SEQ ID NO: 351179 - RNA, 64 nt, Human
gccugccagcaaagccucgcuaaccccauuacaacagcuccaggacaucucagcccagguucua

SEQ ID NO: 351180 - RNA, 64 nt, Human
ucucucaccccugccccuuagagucuaggugcagcagcuccaagcaugggaccaaggaggccag

SEQ ID NO: 351181 - RNA, 64 nt, Human
gcaggucgccaccgagugucuucucauuuuauuucagcuccauuuugcccauagaugggcagag

SEQ ID NO: 351182 - RNA, 64 nt, Human
uuauuaacaguugguguuucuuccuuggcccuuuuggacuaauguuacuguccaaguucuuucu

SEQ ID NO: 351183 - RNA, 64 nt, Human
uaaucuuagcuuuguaauucauguuuugcuuuuguggacuaagguaaggacagcauuuaaauau

SEQ ID NO: 351184 - RNA, 64 nt, Human
caagucuguaccucaaaugaauucuuuaaggagauggacuaauugacuugcaaagaccuaccuc

SEQ ID NO: 351185 - RNA, 64 nt, Human
uuaaaucccacaaauugacacuuucuaucuucaauggacuaagauuuuuuuggucaguaaucuc

SEQ ID NO: 351186 - RNA, 64 nt, Human
ggcccuuuaagaguuagcuuuuuaccugcacaaauggacuaaaaaaucuggcacaaaacauugu

SEQ ID NO: 351187 - RNA, 64 nt, Human
auagaguuuggugucaacuaaaugagauuauauguggacuaaauaucugucauauaguaaacac

SEQ ID NO: 351188 - RNA, 64 nt, Human
cugccaccccucuucugcuccuuagacaccugaauggacuaagaugaaaugcacuguauugcuc

SEQ ID NO: 351189 - RNA, 64 nt, Human
cacagucaccuucccuguuuccuuaggucccauguggacuaacgacuucucauuuuccucgcug

SEQ ID NO: 351190 - RNA, 64 nt, Human
uccucaaguaagaggugcagagaugagguccuucuggacuaaaagccaaaaaaagaaagaaaaa

SEQ ID NO: 351191 - RNA, 64 nt, Human
uugggaagguuauaacugaaugcagcucuuuauuuggacuaaagugucaggauaugcauuagau

SEQ ID NO: 351192 - RNA, 64 nt, Human
aaaagcuacauuaagcguagcuaaaauuauuuauuggacuaaaaacuaacagaacuucauuucc

SEQ ID NO: 351193 - RNA, 64 nt, Human
auagauaauugauauaaaagaaucgccaugcccauggacuaagaacgaugcuggcuuucaagca

SEQ ID NO: 351194 - RNA, 64 nt, Human
cuucauauuuuuccaucauuagacaaauacaaaauggacuaaauaauuuuaagagauaguggag

SEQ ID NO: 351195 - RNA, 64 nt, Human
agguuuccuuuacaugagaucccauuucucacccuggacuaagacaaagauauuuagguugagc

SEQ ID NO: 351196 - RNA, 64 nt, Human
uacucuggacuuuauuguccuguuucuaucaaauuggacuaacaaaaauugauauaauacauuc

SEQ ID NO: 351197 - RNA, 64 nt, Human
cuuugccuuacauuuccauauuuaaaacuagaaacagcuccagcccaaaccuuguuuaugggga

SEQ ID NO: 351198 - RNA, 64 nt, Human
cugggugaugccaggcccaagucuuuguggcacccagcuccaugcuuugaauacuauguggcug

SEQ ID NO: 351199 - RNA, 64 nt, Human
caacuucaccaagaugcauucucauaccugcccacagcuccauuuuggaggcaggcagguuggu

SEQ ID NO: 351200 - RNA, 64 nt, Human
ggcuuuuccaccuccagcaaguguucccagcaaccagcuccauccuggcugcuugccuuccauu

SEQ ID NO: 351201 - RNA, 64 nt, Human
ugugaacuuguagcuguaaaacgcugucaaaaguuggacuaaaugccuaguuuuuaguaaucug

SEQ ID NO: 351202 - RNA, 64 nt, Human
gaauauacagagccuugauccagaagccagaggauggacuaagugggagaaauuagaaaacaaa

SEQ ID NO: 351203 - RNA, 64 nt, Human
cccaccaauuuauacaucuccauuuucugaccucuggacuaacugguugcucagcaagguucug

SEQ ID NO: 351204 - RNA, 54 nt, Human
ccuuaagugcugggcaguaaggacuggacuaauauucaggacccacuaaaguag

SEQ ID NO: 351205 - RNA, 64 nt, Human
gggagggaacucuugacacugagccacuaaaauauggacuaauuuuuuggacaaaucuucaaac

SEQ ID NO: 351206 - RNA, 64 nt, Human
acucccacgccuguccuccuggaagggaccugguuggacuaacggcuaaccuggaccuggaacu

SEQ ID NO: 351207 - RNA, 64 nt, Human
ugacugugguuuuguauuugcuaaauauagggguuggacuaaaauauaauaaaucuguaccuua

SEQ ID NO: 351208 - RNA, 64 nt, Human
gcccuuccccagcauaccugcugguguguaaguguggacuaacccgccgccaccacccucuguu

SEQ ID NO: 351209 - RNA, 64 nt, Human
uuaccagcagagcaccuuagacagucccugccaauggacuaacuugucuuuggacccugaggcc

SEQ ID NO: 351210 - RNA, 64 nt, Human
gcuguugacuacccuuucugauguguguggccauuggacuaacuggcacggggccucucuaggg

SEQ ID NO: 351211 - RNA, 64 nt, Human
uuuuuucuaugaaccuuuacuuacuugacuggauuggacuaaaagcacugaucagaggccacga

SEQ ID NO: 351212 - RNA, 64 nt, Human
uuucucuuuccuuugcucccucccauguuucugguggacuaaauuguguaucugggaguucuca

SEQ ID NO: 351213 - RNA, 64 nt, Human
ccuuaccucccugguccccguuugucaaagaggauggacuaaaugaucucugaaaguguugaag

SEQ ID NO: 351214 - RNA, 64 nt, Human
auuucaagggcuauaccucagcaucuaggcuuuuuggacuaaggagcuuuccuuuuugaaguua

SEQ ID NO: 351215 - RNA, 64 nt, Human
agaaugcaagcguuaacuuuggucuucuguauuuuggacuaaauacuaauugacuagagugcug

SEQ ID NO: 351216 - RNA, 64 nt, Human
cauguuagcuacacagugcagaggcucuugaugguggacuaagcaauuuccccccucgugcgca

SEQ ID NO: 351217 - RNA, 64 nt, Human
ccacggcuuugguuccucacccacuucccccgggcagcuccagggauguggccucauugcuguc

SEQ ID NO: 351218 - RNA, 64 nt, Human
guuccuguguuaguuugcuuaugauaauggcuuccagcuccauccauauugcuacagaggacau

SEQ ID NO: 351219 - RNA, 64 nt, Human
uaugacuagcucuugccgauuaaugagaagagagcagcuccacaauuuuuaauuuuuuuaacuu

SEQ ID NO: 351220 - RNA, 64 nt, Human
aguggcuauuucauuaagauuuaauaguuuuuuuuggacuaaguaguggaaaaacuuuuauacu

SEQ ID NO: 351221 - RNA, 64 nt, Human
ugccagagccucuccagggguggaauacauguccuggacuaagccaaugacaccuuccaucuuu

SEQ ID NO: 351222 - RNA, 64 nt, Human
uguuauuaaauugaucugacuucucagccucauuuggacuaaaaaaagaaagcagaaauccaug

SEQ ID NO: 351223 - RNA, 64 nt, Human
uagaugcuguuauucaggcgaacuugcucauggguggacuaacaccugguuugguacagagacu

SEQ ID NO: 351224 - RNA, 64 nt, Human
uggccuaggaucuucacugucuuacucaagauacuggacuaaguggaacguucucuaccuucaa

SEQ ID NO: 351225 - RNA, 64 nt, Human
uuuacaaaaucugcuuugauacuuaggaccucucuggacuaauuucucuuccuagacagcucag

SEQ ID NO: 351226 - RNA, 64 nt, Human
cacccccagaguggggagggucaggugccagaccuggacuaaacugcaccaaggaaacacccag

SEQ ID NO: 351227 - RNA, 64 nt, Human
uugcuuugcauuuucugauuuuauaccaacuguguggacuaagaugcauuaaaauaaacaucag

SEQ ID NO: 351228 - RNA, 64 nt, Human
auugcagaggguccuccaggguccugaagagcacuggacuaagagucuagugguuccagggccc

SEQ ID NO: 351229 - RNA, 64 nt, Human
cccucuuuaaugcugucuuuguggacugugggucuggacuaacccugugguugccugcccuccu

SEQ ID NO: 351230 - RNA, 64 nt, Human
ugaacaaugggaaaaguauaccuuaaggcauuucuggacuaaaauauuuucaauacuauuuucu

SEQ ID NO: 351231 - RNA, 64 nt, Human
agcuggaauaccacacugaccaaaucuggaucuuuggacuaaaguauucaaaauagcauagcaa

SEQ ID NO: 351232 - RNA, 64 nt, Human
cuaucaccuuuuuagacuuuguaagguaaauauuuggacuaacuuuuagaaaaguuucccuuuu

SEQ ID NO: 351233 - RNA, 64 nt, Human
aguccaagagugggcaaaaaauaauuuucuacuuuggacuaaucuauagagguuuuugaaaguc

SEQ ID NO: 351234 - RNA, 64 nt, Human
agccauuuuggagacagugagggaaguguggacauggacuaaauauuaaaugauauuuacauau

SEQ ID NO: 351235 - RNA, 64 nt, Human
gaaaggauaaggauauuuggcucaccucguuccacagcuccaccuucaucuucucaucaaagcc

SEQ ID NO: 351236 - RNA, 64 nt, Human
uaacaccugugccuaacaccccuacugaaccccacagcuccagccuuaguuuuuggagucaagu

SEQ ID NO: 351237 - RNA, 64 nt, Human
ugguguguguuuacaaagggagaguuggcugcuccagcuccacagcccugggaccccaacuccu

SEQ ID NO: 351238 - RNA, 64 nt, Human
uucaggucuugcaggugucgacugucuuccggcccagcuccaagcccuccucugguugccugga

SEQ ID NO: 351239 - RNA, 64 nt, Human
gaaauucaagacaaagaaaaaaacccaauuuuauuggacuaaauagucaaaacaauguuuucau

SEQ ID NO: 351240 - RNA, 64 nt, Human
auacaaguuccugauaacuucaagaucauaccacuggacuaagaacuuucaaaauuuuaaugaa

SEQ ID NO: 351241 - RNA, 64 nt, Human
auucaagacaaagaagaaaagaacuccauuucauuggacuaaauaacaaaaggauaauguuuuc

SEQ ID NO: 351242 - RNA, 64 nt, Human
auacaaguuccugauaacuucaagaucauaccacuggacuaagaacuuucaaaauuuugaugaa

SEQ ID NO: 351243 - RNA, 64 nt, Human
auucaagacaaagaagaaaaauacucaauguuauuggacuaaauaaucaaaaggauaaugauuu

SEQ ID NO: 351244 - RNA, 64 nt, Human
auacaagcuccugauaacuucaagaucauaccacuggacuaagaacuuucaaaauuuuaaugaa

SEQ ID NO: 351245 - RNA, 64 nt, Human
auucuagacaaagaagaaaaaaacuccauguuauuggacuaaauaaucaaaagcauaauguuuu

SEQ ID NO: 351246 - RNA, 64 nt, Human; identical to SEQ ID NO: 351240

SEQ ID NO: 351247 - RNA, 64 nt, Human
auucaagacaaagaagaaaaaaacucaauguuauuggacuaaauaaucaaaaggauaauguuuu

SEQ ID NO: 351248 - RNA, 64 nt, Human
ggagcuguccggugcuaccacaccgugcccucaguggacuaaccacagcagcagccagggaugg

SEQ ID NO: 351249 - RNA, 64 nt, Human
agagggaucccuaacgugcccagcauguagauucuggacuaacagacaacauacauucaccgcu

SEQ ID NO: 351250 - RNA, 64 nt, Human
ugaugucccauguucacauaaauuugggaaauucuggacuaagacuuaagucucguuaaucaaa

SEQ ID NO: 351251 - RNA, 64 nt, Human
uguuuaagauacuugauuugaaguccuuuucauauggacuaauuguaguaucaauuuccuccug

SEQ ID NO: 351252 - RNA, 64 nt, Human
ucgacaccuaaaauauaaucuggcuucuugugucuggacuaaguuaaaagaauuaaaauacuuu

SEQ ID NO: 351253 - RNA, 64 nt, Human
agaggccucacauggcugugucacauauaaauguuggacuaaacucuuacuugaacucaggaaa

SEQ ID NO: 351254 - RNA, 64 nt, Human
aacuaaaauuugacccugucuucaccuuuguucucagcuccacagucuggauugcugacaguag

SEQ ID NO: 351255 - RNA, 64 nt, Human
guagacaagucaccuuuguagcuagcaccagugccagcuccaugccauugcaccuucuuuaguc

SEQ ID NO: 351256 - RNA, 64 nt, Human
ugcucauccuccugccuaugcugagauacgcacucagcuccaugucuuguacacacagaaacau

SEQ ID NO: 351257 - RNA, 64 nt, Human
acuguuggcuguuuucccgauacugagaauucaacagcuccagagcagaagccacaggggcaua

SEQ ID NO: 351258 - RNA, 64 nt, Human
agaaacuauuuauuguaagcuuaugucacaggccuggacuaaauugauuuuacguuccucuuaa

SEQ ID NO: 351259 - RNA, 64 nt, Human
gaguuuacaaagaaauauggggaaaagcgaccuguggacuaaaaucugccacgauugguuccag

SEQ ID NO: 351260 - RNA, 64 nt, Human
ugugcuacccaccccuuccauggacugaauaagauggacuaacaggccuguguuuuuguguuua

SEQ ID NO: 351261 - RNA, 64 nt, Human
gagaguguggggaaugggaagaaguaguuuacuuuggacuaaagaauauauugggcgaagaaua

SEQ ID NO: 351262 - RNA, 64 nt, Human
gucaugcuggcugguuggauuuugggguggcaguuggacuaaugugaaaaaaacauugcugaaa

SEQ ID NO: 351263 - RNA, 64 nt, Human
cgugugugcuaguuaauagguuuaguagcuuuuauggacuaaaaaugauugauuguaucuugac

SEQ ID NO: 351264 - RNA, 64 nt, Human
cuuacuuuuauuacagucaauuuugaggauauucuggacuaaauauuuaagugcagucauuucu

SEQ ID NO: 351265 - RNA, 64 nt, Human
agcuguucuucacccuuucagaugugaccucuuuuggacuaagcagcaaucuguucucuugcuc

SEQ ID NO: 351266 - RNA, 64 nt, Human
uguugcaauagaugccacugggccacggggugccuggacuaauaacuauucucacaguaaaaga

SEQ ID NO: 351267 - RNA, 64 nt, Human
cuaacuuuuauuacagucaauuuugaggauauucuggacuaaauauuuaagugcagucauuucu

SEQ ID NO: 351268 - RNA, 64 nt, Human
aucucaauauggaauuaaauugucuuuuugggguuggacuaaauaugaaauccgaaagccaaac

SEQ ID NO: 351269 - RNA, 64 nt, Human
aagaccagccugcccaacauggugaaaccccaucuggacuaaaaaugcagaaauuuacccaggc

SEQ ID NO: 351270 - RNA, 64 nt, Human
ucucugcugggucucccuuuccauggcaaaugggcagcuccauccucuugacucuucuaaaugc

SEQ ID NO: 351271 - RNA, 64 nt, Human
aaggaugucugagaccacuugggcgcuguuuucucagcuccaauuucaagagugagcuaucaaa

SEQ ID NO: 351272 - RNA, 64 nt, Human
cuucccccaucaccaccugccccucccuccagcccagcuccauucuuuggcauaacaggcaacu

SEQ ID NO: 351273 - RNA, 64 nt, Human
ggcgcucugcuggcagugcugaggacggguacuccagcuccaggccuggagaggcuucccagca

SEQ ID NO: 351274 - RNA, 64 nt, Human
cagccuuccugaggaugggcaacccccaggucugcagcuccagguacauaucacgcgcacagcc

SEQ ID NO: 351275 - RNA, 64 nt, Human
cagguacaugagcaaucucagggauagccagcagcagcuccaggucugcgcagcaggaauuacu

SEQ ID NO: 351276 - RNA, 64 nt, Human
ggguguuugggucagauaaaugaagaucaaacuccagcuccagccucauuugcuugagacuuug

SEQ ID NO: 351277 - RNA, 64 nt, Human
cccagaagggggccucgccguuccaccagaagcucagcuccaggcccuggaggggcugcugcuc

SEQ ID NO: 351278 - RNA, 64 nt, Human
uacauaaguccuuucaauuccaccagggccagagcagcuccaccacugugcacuuagccaugau

SEQ ID NO: 351279 - RNA, 64 nt, Human
gcagcaguuggcaguagcugccgaugucuguccccagcuccaccauuccucccuguggcugugc

SEQ ID NO: 351280 - RNA, 64 nt, Human
acuuguauuuauuugaaacacugggcuguuugcacagcuccaacugugcaugcucaaaaugugc

SEQ ID NO: 351281 - RNA, 64 nt, Human
uguuuuuagacuguuagacaaaagugcucacgugcagcuccagaauauggaaacagagcaaaag

SEQ ID NO: 351282 - RNA, 64 nt, Human
uauaggauuucugacaggacucugggccccuccccagcuccacucccuaccucaagaaugugac

SEQ ID NO: 351283 - RNA, 64 nt, Human
augacggcaucgucuaugcuucccuugcccucuccagcuccaccucacccagagcaccucccag

SEQ ID NO: 351284 - RNA, 64 nt, Human
uguagaagucacauuccugaacaggauauucucacagcuccaagaauuucuaggacugaauuau

SEQ ID NO: 351285 - RNA, 64 nt, Human
cuaauccagccaacgucugcucaggaaguggggccagcuccacugggacccauaguuuuacuuc

SEQ ID NO: 351286 - RNA, 64 nt, Human
gaaaacaggagucgauuuuccgucuuuuggauugcagcuccacugacugacaguaaagcugcag

SEQ ID NO: 351287 - RNA, 64 nt, Human
gggcgccaucuaugguguggaugggaaacugcuccagcuccaagagguuuuucagcucuuugac

SEQ ID NO: 351288 - RNA, 64 nt, Human
ccuggacauuuacuggggaggugaguagcaggcccagcuccaggaucugaauuggaaucucaga

SEQ ID NO: 351289 - RNA, 64 nt, Human
cagagcaugcgcacuuaugauauaaacagaggaccagcuccauucucaggaaagaaauguugug

SEQ ID NO: 351290 - RNA, 64 nt, Human
ucacuucccugggaacucauccuguguggggaggcagcuccaacagcuugaccagaccuagacc

SEQ ID NO: 351291 - RNA, 64 nt, Human
gccccuccuggaaaaugguguuggguuuggucuccagcuccaauacuuauuaaggcuguugcug

SEQ ID NO: 351292 - RNA, 64 nt, Human
ugggagaacuggaagaauaacauccauugucguacagcuccaaacaacuucagaugaauuuuua

SEQ ID NO: 351293 - RNA, 64 nt, Human
cagccaccuuugcgugucaccuucacgggacuuccagcuccagcuaccuuugugugucaccuca

SEQ ID NO: 351294 - RNA, 64 nt, Human
cccaaggugccugugcucccagcagguccaagugcagcuccagccaccuuugcgugucaccuuc

SEQ ID NO: 351295 - RNA, 64 nt, Human
guucauguguugguuugcuuaggguaauggccuccagcuccauccauguugcugcaaagacaug

SEQ ID NO: 351296 - RNA, 64 nt, Human
uuuuuguauaaauaaaagaaaaugggacgugucccagcuccaggggugaugggggugauggacu

SEQ ID NO: 351297 - RNA, 64 nt, Human
uucccgcagaccaaagagagugugacucccuugccagcuccagagugggggggcugucccaggg

SEQ ID NO: 351298 - RNA, 64 nt, Human
aaaaugcaacccugcccccuccccagcaaagucacagcuccauuucaguaaagguuggagucaa

SEQ ID NO: 351299 - RNA, 64 nt, Human
caucacagagaucuccacaacuccuuggcuuaaacagcuccaccgguaaaaaaaaaaaaaaaaa

SEQ ID NO: 351300 - RNA, 64 nt, Human
aaggggcaugauccagggucccccagggugggcucagcuccagggagaggccacccacguggca

SEQ ID NO: 351301 - RNA, 64 nt, Human
cccgcagcacgccgaugacgucgccggccucguccagcuccaugucgcccuccgucgccaggau

SEQ ID NO: 351302 - RNA, 64 nt, Human
ucuauauauauaguucaaaaauacuuuagguggucagcuccacauucuuuguugacgugacacu

SEQ ID NO: 351303 - RNA, 64 nt, Human
cuuuuucuguuauuuucaauuuauuacaacuugacagcuccaagcucuuauuacuaaaguauuu

SEQ ID NO: 351304 - RNA, 64 nt, Human
aaccuugguuucuugagaggcccccaagaugccgcagcuccagggcucuuccuccucaccagaa

SEQ ID NO: 351305 - RNA, 64 nt, Human
gccagaggaagaaccaucccaaucauuugaucuccagcuccacaguagagagaaaccuacaaaa

SEQ ID NO: 351306 - RNA, 64 nt, Human
ggauuugaggcuccuccccuccagggacaggcugcagcuccagcgaguggcaguggagcugauu

SEQ ID NO: 351307 - RNA, 64 nt, Human
cccagucacugggcauauccuccuucuccuuaaccagcuccacagcagccccugagucaccugc

SEQ ID NO: 351308 - RNA, 64 nt, Human
gaccccagcucuucccuugcugcagccgcaccugcagcuccagggaguuaacucuucuucuggg

SEQ ID NO: 351309 - RNA, 64 nt, Human
uguucaaauuuuaucaugccaguaggagaaaucucagcuccacaacccaagcaacauuuguaug

SEQ ID NO: 351310 - RNA, 64 nt, Human
gcaccaagaaaacagccgauacuggcagccauugcagcuccaaacugcagaggcaaggccaauu

SEQ ID NO: 351311 - RNA, 64 nt, Human
gccacacccaccugaggccccugcagccggacaccagcuccaggguccccuuugccaggcuuuc

SEQ ID NO: 351312 - RNA, 64 nt, Human
aacaucuccucuuggugccuuccugggcccuccccagcuccagcucucccagaccuacccucug

SEQ ID NO: 351313 - RNA, 64 nt, Human
ccugacuguagcacggaguguuggggcugggggccagcuccaggagggcuugagagcucagccu

SEQ ID NO: 351314 - RNA, 59 nt, Human
augccccggggaccuugugauccagcucacagcuccacgaagacucaaaaggaaaagcc

SEQ ID NO: 351315 - RNA, 64 nt, Human
caaagaacuuuccaggucagccggacagcuccagcagcuccacguuccaggcagccucgcccgc

SEQ ID NO: 351316 - RNA, 64 nt, Human
ccuagaggccaaagaacuuuccaggucagccggacagcuccagcagcuccacguuccaggcagc

SEQ ID NO: 351317 - RNA, 64 nt, Human
accucuugccucauggaugucuggucccucugcacagcuccaaccaacaggacuguagggugau

SEQ ID NO: 351318 - RNA, 64 nt, Human
cccaguagcccccuuagcgcccccgcggaccccgcagcuccagacuccgcuuuggcaccucugc

SEQ ID NO: 351319 - RNA, 64 nt, Human
auauugaaaaaaauaauuuuaaaaaugguggcuucagcuccagccccuuuccaaaauuuuucaa

SEQ ID NO: 351320 - RNA, 64 nt, Human
ugugcacauaaucuauuaugauccaaugcaaauacagcuccaaaaauauuaaauguauauauau

SEQ ID NO: 351321 - RNA, 64 nt, Human
gguuauuacacuuaaagcaacaaccaacuaguaacagcuccaggaaaggggaaugaaucaacuc

SEQ ID NO: 351322 - RNA, 64 nt, Human
agaagggucuggcauccauaugaggaaaaaugcucagcuccaggaaagauggggaguccaagug

SEQ ID NO: 351323 - RNA, 64 nt, Human
gaauuaacccuguguccucagucgccagcacuuacagcuccaacuuuuuugaaugaccaucugg

SEQ ID NO: 351324 - RNA, 64 nt, Human
agcagaccugaugucccggugcuuccuggccccucagcuccagugauucacgcccgccuggaga

SEQ ID NO: 351325 - RNA, 64 nt, Human
agacgaucuugcuggcagggccuggccuuguccccagcuccaccuggccccuucuccagcaagc

SEQ ID NO: 351326 - RNA, 64 nt, Human
ggcaccucccccagacuuggggugggggcccugccagcuccagcaccacccuugccccaagucu

SEQ ID NO: 351327 - RNA, 64 nt, Human
cucucaucaucauggccccaccggguacccugagcagcuccacacucuucuugaggugucuaga

SEQ ID NO: 351328 - RNA, 64 nt, Human
ccagaugcccugcugagugucccugaaaccauggcagcuccaucugucaagauggcaggggccg

SEQ ID NO: 351329 - RNA, 64 nt, Human
cugcccagcccggccacagcagcucagccagucacagcuccaccuccaacuucuacagcagcaa

SEQ ID NO: 351330 - RNA, 64 nt, Human
cugcccagaaaguggggguggaggaccgaggcuacagcuccacacgccccggucccccagagca

SEQ ID NO: 351331 - RNA, 64 nt, Human
cguguucuuugccaccagccugucacuccaguggcagcuccagaaacggaggcuguugcuuuua

SEQ ID NO: 351332 - RNA, 64 nt, Human
ucccaccaugccagaaugggaaguugugacguugcagcuccaaccgacgugcucauagugauca

SEQ ID NO: 351333 - RNA, 64 nt, Human
cuuccucgucaguggucaaggugugucauccauacagcuccaugccuuugucuuuuuuaaaugu

SEQ ID NO: 351334 - RNA, 64 nt, Human
accucugacaagcaggagaagguaagggcccggucagcuccaaggagcgcgcuccacgcgcgug

SEQ ID NO: 351335 - RNA, 60 nt, Human
cugcagaagugaggaggugaggccggcacacagcuccagugcugagaagucagugccccg

SEQ ID NO: 351336 - RNA, 64 nt, Human
aucccauaccaaagcccugugaguucaucagagucagcuccaggaaccaucaugguaaguggua

SEQ ID NO: 351337 - RNA, 64 nt, Human
uuugggucagaaccuucucucucugaauuuggaucagcuccaagcagugaaaauaguaaucaga

SEQ ID NO: 351338 - RNA, 64 nt, Human
cgcaacacaacaaucagauggcaccagggacuggcagcuccacugccgucaacuccuguucucc

SEQ ID NO: 351339 - RNA, 64 nt, Human
acaccccuaaaacaucagacucaccauccaggugcagcuccagaggcuacaaaaggcuucaugg

SEQ ID NO: 351340 - RNA, 64 nt, Human
ugguaccucucccugcaucauacccaggaacugccagcuccaaaauauugggguacagcucacc

SEQ ID NO: 351341 - RNA, 64 nt, Human
cuccuagacacugaccucuguccagggcacuuugcagcuccauccucaaguuccacacgaagau

SEQ ID NO: 351342 - RNA, 64 nt, Human
acaucagaaauaauugagaugggaaagaauagugcagcuccauagaggagacggacuguagaca

SEQ ID NO: 351343 - RNA, 64 nt, Human
uaguauacuucuccuucugucucuuggaaagauacagcuccaggguuaaaaagagaguuuuuag

SEQ ID NO: 351344 - RNA, 64 nt, Human
cacuacccagauuuccacagugcugcuaauaucccagcuccagccagcaccccaucugcaccug

SEQ ID NO: 351345 - RNA, 64 nt, Human
accaacaggugcauggugaguguggcaguccccacagcuccacaaugggcucccccgccaacgg

SEQ ID NO: 351346 - RNA, 64 nt, Human
aggaaacaguguaaugugucucugccccauugcgcagcuccacccauugugccccaggccagcc

SEQ ID NO: 351347 - RNA, 64 nt, Human
ugcuggagaggaugucucuguccgcauucccgugcagcuccaggcucgcgcaguuuucucucuc

SEQ ID NO: 351348 - RNA, 64 nt, Human
ucagggcaaaugucacagcaggauuuccccaacccagcuccaucaucacagacacagagagcug

SEQ ID NO: 351349 - RNA, 64 nt, Human
ugugcuaccccaauuagggcccagccugccauggcagcuccaacaaggaccgucugggauagca

SEQ ID NO: 351350 - RNA, 64 nt, Human
agcugaaagaggccaaacaggcccuccucccucccagcuccaccccgcaagcaccauccccucc

SEQ ID NO: 351351 - RNA, 64 nt, Human
gaaguguucaauaauaucaauuuugcaacucacucagcuccauggcuucccccggucuaccugu

SEQ ID NO: 351352 - RNA, 64 nt, Human
gccgcccugucuccgcaggcuagauccgagguggcagcuccagcccccgggcucgcccccucgc

SEQ ID NO: 351353 - RNA, 64 nt, Human
caaaggcccugcuuccuggaaaggacacucagagcagcuccaagacagaggcucuguggcgggg

SEQ ID NO: 351354 - RNA, 64 nt, Human
ccccuuggccagggccaugggagucccgcgcagucagcuccacauuggccucugcagcugggug

SEQ ID NO: 351355 - RNA, 64 nt, Human
ggcucagccccucccugcagacggcgccggcgcccagcuccagauccuguuugcgggggaagcc

SEQ ID NO: 351356 - RNA, 64 nt, Human
gggugcugugcucucuggcgccccacagccuggccagcuccagggaccccaguugcagggccca

SEQ ID NO: 351357 - RNA, 64 nt, Human
aagucucucuagacaauucagggccugcuuuccccagcuccaugcauggcuggacuggugauuc

SEQ ID NO: 351358 - RNA, 64 nt, Human
guauaauagugugcacugcacaucugucucuucccagcuccacauucagugcugucuugguagc

SEQ ID NO: 351359 - RNA, 64 nt, Human
gaggaaacggacacaacuccgggaagccuuugagcagcuccaggccaagguacacccagggguc

SEQ ID NO: 351360 - RNA, 64 nt, Human
cacacauacacacacagagagcauuucaaggccacagcuccacaccugccaugggauguuaaug

SEQ ID NO: 351361 - RNA, 64 nt, Human
ugcucucagggaacauggugauggaggguugcaucagcuccacccauggccaacagcccuuguu

SEQ ID NO: 351362 - RNA, 64 nt, Human
aacucuacaucugcuucuccuguggcucugccaucagcuccaauaucaauaugaacucguauug

SEQ ID NO: 351363 - RNA, 64 nt, Human
auaagauagcugaaagaagcugcugugaggagcucagcuccaaacacaggaucagcaccuugua

SEQ ID NO: 351364 - RNA, 64 nt, Human
ggcaaagccuucauugccuuaacuggagccccaucagcuccagcugcucugucuucuuugccca

SEQ ID NO: 351365 - RNA, 64 nt, Human
ucagugggcuuugccuuauaggugccacagggcacagcuccaucauugccacugguuuuuccua

SEQ ID NO: 351366 - RNA, 64 nt, Human
ccgcaauaucugcccuaacucaggcuuccuccggcagcuccagguucuggacaaccgacugggg

SEQ ID NO: 351367 - RNA, 64 nt, Human
aggccuggguccagggcaucuuaaguucauccagcagcuccaugagccacacagauauccuaga

SEQ ID NO: 351368 - RNA, 64 nt, Human
ccugaggcggagguuucagaguagaagguggugucagcuccagcuccccucugucggugguggg

SEQ ID NO: 351369 - RNA, 64 nt, Human
guaugucugucauccagcuccuaugucuguuauccagcuccaaguacagcuuguguauaucaac

SEQ ID NO: 351370 - RNA, 61 nt, Human
agcaggggggcaggcccuagcccuccuaggucagcuccaugugccaugcaccgccaugcac

SEQ ID NO: 351371 - RNA, 64 nt, Human
gcucugggccccuccucccugcugccacuuaucccagcuccaaguuuuuuuaaaaauaauauua

SEQ ID NO: 351372 - RNA, 64 nt, Human
cugcuuucugaccaaauguuuuuccaucuguguacagcuccagcuguuugaagagagggaacaa

SEQ ID NO: 351373 - RNA, 64 nt, Human
uucaacagugaagacagaaguuugcacuaucuuucagcuccaguuggaguuuuuuguaccaacu

SEQ ID NO: 351374 - RNA, 64 nt, Human
aaggugacguggcccagcguccaagggacagacucagcuccaggcugcuuggcagcccagccug

SEQ ID NO: 351375 - RNA, 64 nt, Human
gcucugucauggguuccgucucucuguggagaagcagcuccaccucugggggggcucggggcag

SEQ ID NO: 351376 - RNA, 64 nt, Human
ugaccagugcugcauuucaguucuggcugucccacagcuccaggaguuguguccccugaauuuu

SEQ ID NO: 351377 - RNA, 64 nt, Human
cagugcaugucuuaguugcuguucccucagcucccagcuccaccucugggguucagcuucuguc

SEQ ID NO: 351378 - RNA, 64 nt, Human
aacugguucuuucggagccauccuguugaucaugcagcuccaccaaaccuuagggggacgugaa

SEQ ID NO: 351379 - RNA, 64 nt, Human
augccacccccuucccuguccuuccccaacuccccagcuccaagaguggaagaaauccccaaga

SEQ ID NO: 351380 - RNA, 64 nt, Human
ccuguucaugaggguuccgcccccaugacccaaucagcuccaaaggccccaccuccuaauacug

SEQ ID NO: 351381 - RNA, 64 nt, Human
gaugggcaccugacagcuuugccuuuugcugacacagcuccauaaagacucgugcuuucucacu

SEQ ID NO: 351382 - RNA, 64 nt, Human
guguguuugugggcccugagagacucagagaccucagcuccagcauaccccaccaccuucuccu

SEQ ID NO: 351383 - RNA, 64 nt, Human
agcacgcgcugguggagcuggaguugcaccgcggcagcuccauggaaaucaaucugggggagaa

SEQ ID NO: 351384 - RNA, 64 nt, Human
uguguggacaggggggauggcuggcccccacgagcagcuccaggcuggaguucugguucuucca

SEQ ID NO: 351385 - RNA, 64 nt, Human
gaccucuccuagcuccacacaagcaguagagucucagcuccacagcuuuacccagaagcccugu

SEQ ID NO: 351386 - RNA, 64 nt, Human
augggcagugucccuguucugaagugcccaguggcagcuccagugguagaggaccaaggauuga

SEQ ID NO: 351387 - RNA, 64 nt, Human
cagccugagcccuggaggcugggccugcccacuccagcuccaucccuuauuuauuccuuccagc

SEQ ID NO: 351388 - RNA, 64 nt, Human
ucagcugguuagaggcugggaggacacgcaaguucagcuccagccgacuggggcauugguggua

SEQ ID NO: 351389 - RNA, 64 nt, Human
gggaaggggcggugcccacaccggggacaggccgcagcuccauuuucuuauugcgcugcuaccg

SEQ ID NO: 351390 - RNA, 64 nt, Human
agaugaguguguguucuuccccaagguccccccacagcuccaggacaccgcuguccuggcauuu

SEQ ID NO: 351391 - RNA, 64 nt, Human
acucggcuagacuaucucuucauccucgcaaagccagcuccaccgcccucucugcaagaauucc

SEQ ID NO: 351392 - RNA, 64 nt, Human
gggccagagaucucaagugucaaccuugaggucccagcuccauccccuaguugcagacucauca

SEQ ID NO: 351393 - RNA, 64 nt, Human
gaaaaagauauggugaaggcagaacugcucacaccagcuccagaagcacguccucugacuucac

SEQ ID NO: 351394 - RNA, 64 nt, Human
gggccgggcaggcuggaccauacccccaguccaccagcuccagucuccacagccauccuggccc

SEQ ID NO: 351395 - RNA, 64 nt, Human
agcugaucugcggaucucagcuuugagaagccuucagcuccagggaauccaagccuccacagcg

SEQ ID NO: 351396 - RNA, 64 nt, Human
gcccuaagcagccccuggcuucacccugucaggccagcuccacuccaggacugaauaaaggucu

SEQ ID NO: 351397 - RNA, 64 nt, Human
ucugguucacaccgcacccugcacucacccacagcagcuccauccacugggaaaacugggguuu

SEQ ID NO: 351398 - RNA, 64 nt, Human
gcguguucugccagguccaugggggcuggcaucccagcuccaacucgaggagccucaguuuccu

SEQ ID NO: 351399 - RNA, 64 nt, Human
uggggcucuccaaggagccuucuucacccacuuccagcuccacuucugcaagguuaagucaagu

SEQ ID NO: 351400 - RNA, 64 nt, Human
cacaccacugccucaugcuuccuggggccuccagcagcuccacuaauggaggagaggcaguagc

SEQ ID NO: 351401 - RNA, 64 nt, Human
ccuuaggacuguggaugaggccagacuggaagagcagcuccagguagggggccauguuucccag

SEQ ID NO: 351402 - RNA, 64 nt, Human
auuccgucuguagcaggagcuagggcugcugccucagcuccaagacaagaaugaaccuggcugu

SEQ ID NO: 351403 - RNA, 64 nt, Human
cuuauugugcucagugaacauccagugcugggugcagcuccaucacccucuuguguguuuacau

SEQ ID NO: 351404 - RNA, 64 nt, Human
caagugauagucuauaggaguguuuaauuucuugcagcuccaucugguugcugcauuugaagca

SEQ ID NO: 351405 - RNA, 64 nt, Human
ggcaucaacaaauacugagggauggguuuugggacagcuccaugggcauggggaaggcacugaa

SEQ ID NO: 351406 - RNA, 64 nt, Human
ccaguuccccaacccacucccuuccaacaacaaccagcuccaacugacucuggucuugggaggu

SEQ ID NO: 351407 - RNA, 64 nt, Human
gucuuuaccucagcuccuagggccuccagccccccagcuccaccacggugacuuggugaagggg

SEQ ID NO: 351408 - RNA, 64 nt, Human
cccugcuuagccagcuucuguguguccgcccucccagcuccagcccugcaggccgucuuuuccg

SEQ ID NO: 351409 - RNA, 64 nt, Human
agucgggauuuuuacagagggagcugucuccagacagcuccaucaggaaccaagcaaaggccag

SEQ ID NO: 351410 - RNA, 64 nt, Human
uguccucuaagagaauaagcauuuccuguucuuccagcuccagguccaccuccuguugggaggc

SEQ ID NO: 351411 - RNA, 64 nt, Human
aggcugaggacuccgaucgcgaugucucaucugacagcuccaugagauagagaccugccucccc

SEQ ID NO: 351412 - RNA, 64 nt, Human
cuuuaguugaccuucaaauauucaagcuauucugcagcuccaagaugcaauuauagaaacagcu

SEQ ID NO: 351413 - RNA, 64 nt, Human
acugcaccuucuuagggaagggcaugccagccaucagcuccaaacaggcuguaaccaaguccac

SEQ ID NO: 351414 - RNA, 64 nt, Human
ggauuccugggugccacugcucucuuuuccucuacagcuccaucuuguuucacccaccccacau

SEQ ID NO: 351415 - RNA, 64 nt, Human
cugagccguucuccugagucccugagggcagacacagcuccagggacccaggccagcugccaca

SEQ ID NO: 351416 - RNA, 64 nt, Human
cccagccccagacagcugcugcccagagaagaaccagcuccacggcuccugcuucugcccccag

SEQ ID NO: 351417 - RNA, 64 nt, Human
cuugcgaggcccgggcagcuggaaaguccuccuccagcuccaccucccucccucccuccagaug

SEQ ID NO: 351418 - RNA, 64 nt, Human
uggaucccacacuguacuucccacagcccacucucagcuccaucuccacccugcugguccugcu

SEQ ID NO: 351419 - RNA, 64 nt, Human
aagcaaguucugcuucuguccuguuuccuccugacagcuccauucuuuugaagccugacccuuc

SEQ ID NO: 351420 - RNA, 64 nt, Human
cacaaggauagaugcuggcccagggcccagagcccagcuccaaggggaaucagaacucaaaugg

SEQ ID NO: 351421 - RNA, 64 nt, Human
cuuugggccagacaugccacaaggacuuccuguccagcuccaaccugcaaagaucuguccucag

SEQ ID NO: 351422 - RNA, 64 nt, Human
aaaucuccaugguuccugcuuuguguuccucucccagcuccaucucuuucccuagggaccaggc

SEQ ID NO: 351423 - RNA, 64 nt, Human
auucuuucuguccagccccucccucccacuggagcagcuccagagccauuccucacccccguga

SEQ ID NO: 351424 - RNA, 64 nt, Human
cuuuccuaccccucuuaaaacucaguucagguagcagcuccacuaggaagccuuggcugaccau

SEQ ID NO: 351425 - RNA, 64 nt, Human
agauuuuuuuuuaaugacugagaaaacuuguuuacagcuccagcauauaaggaaaguguucaag

SEQ ID NO: 351426 - RNA, 64 nt, Human
agcccaccgccuacacaguaggggcaguagcccccagcuccacgccuguugccauguggaaaag

SEQ ID NO: 351427 - RNA, 64 nt, Human
uuuucaccaaaauuggggaaggagugccacuuuccagcuccacuucaaauuccuuaaaauauaa

SEQ ID NO: 351428 - RNA, 64 nt, Human
cacccucacucccagguccccucccauuugguagcagcuccaacagggguccagccugcaucuu

SEQ ID NO: 351429 - RNA, 64 nt, Human
gguggguucuuauugauucgcugugucaucacaucagcuccacuguugccaaacuuugucgcau

SEQ ID NO: 351430 - RNA, 64 nt, Human
cacagagugcuuaccugccccgagggaaguccagcagcuccaccagauagagaucuggagaugc

SEQ ID NO: 351431 - RNA, 64 nt, Human
gggccuggcccugcuuucuacgccaauguuaugccagcuccauguucucccaaauaccguugau

SEQ ID NO: 351432 - RNA, 64 nt, Human
cauguucaaccagauauauagccauuauuuuucucagcuccagcauuguuugauuuuucuugag

SEQ ID NO: 351433 - RNA, 64 nt, Human
accauggcuguguccccaggcaauaggaauuuuucagcuccauuguaaucuuacgggaucauca

SEQ ID NO: 351434 - RNA, 64 nt, Human
uugccagguaauaagugugaucauuguugaacuucagcuccagugucucuccagaauaagacau

SEQ ID NO: 351435 - RNA, 64 nt, Human
ccgaugagggucccauggccugcucccucaggaacagcuccagcaccaauaaagaggcaucuua

SEQ ID NO: 351436 - RNA, 64 nt, Human
ugagccucaccugcuugaguggcugccgcccugucagcuccagccgccuccagcucagcccuuu

SEQ ID NO: 351437 - RNA, 64 nt, Human
cuccuuuguucaaguaucagaagaaauaaacccacagcuccagagaaggugaccauucucagaa

SEQ ID NO: 351438 - RNA, 64 nt, Human
cuuucugucccguaauuguguaugucuuucuuuccagcuccaugaugcguuaucugggucugga

SEQ ID NO: 351439 - RNA, 64 nt, Human
uguuaccuuguuauugcugucucaacauuuacuacagcuccauuuacagaacuguugcuuuuuu

SEQ ID NO: 351440 - RNA, 64 nt, Human
ugugucuuugucauugucugguucuuaagagucccagcuccagguggcguccucccugccucuc

SEQ ID NO: 351441 - RNA, 64 nt, Human
ugucaaauggccugcccaugaagcccuggaauuccagcuccaccuccacuaccacuccaagccu

SEQ ID NO: 351442 - RNA, 64 nt, Human
ccugugacugacucuucuucucggggacacaggccagcuccacaguguugccagagccuuaaua

SEQ ID NO: 351443 - RNA, 64 nt, Human
uucugcccuggcucugcacauaaguguuagccagcagcuccagaaaaaucccgauucccgggau

SEQ ID NO: 351444 - RNA, 64 nt, Human
ggaguuuaucuaucggaagaacaugaaucucuaacagcuccauacuucuuucacuacucaaaug

SEQ ID NO: 351445 - RNA, 64 nt, Human
cagacugcuggucuccacagauaccugcuguucucagcuccagcuucaaaccucgagucucgag

SEQ ID NO: 351446 - RNA, 64 nt, Human
aaggaggccugcacuuggaccugaccucaagccucagcuccagugggaccuuguaaaaugcucc

SEQ ID NO: 351447 - RNA, 64 nt, Human
acuugaggauagcagcuucacuaggcuggccggccagcuccacaucugacuggguucuuacuuc

SEQ ID NO: 351448 - RNA, 64 nt, Human
acugccucaacucugucuccaggucuauucccuccagcuccaaaaggagcagcccuacuucuac

SEQ ID NO: 351449 - RNA, 64 nt, Human
ccuucuucuagugguagcucuggcuuugcaggcccagcuccaggcccugcuccucagagagacu

SEQ ID NO: 351450 - RNA, 64 nt, Human
ggggauuggagagggauggggagggaagggaaggcagcuccaagaagaggucccuguggcgaag

SEQ ID NO: 351451 - RNA, 64 nt, Human
ccucgaugaagccuucucuggaaccacuccagcccagcuccaccucagccuuggccuucacgcu

SEQ ID NO: 351452 - RNA, 64 nt, Human
ugcugacucauugguggaguagacuucuggcucccagcuccacuggcccauggggccuccauug

SEQ ID NO: 351453 - RNA, 64 nt, Human
cgcccagugcccuggggcugaucucagggaagcccagcuccagggccagaugagcagaagcucu

SEQ ID NO: 351454 - RNA, 64 nt, Human
caggcccuggagggugauccugccagcagcccuacagcuccacacccuacccacccaucggcag

SEQ ID NO: 351455 - RNA, 64 nt, Human
acucaggguacugggccucaacgggaaccugagacagcuccagcuucgcagcccuucccggagc

SEQ ID NO: 351456 - RNA, 64 nt, Human
auuuguguuuuugcuuuuuuuccaaaaagaucuccagcuccacacauguuuccacuuaauacca

SEQ ID NO: 351457 - RNA, 64 nt, Human
gaggccuccgugugcccucguugccguggggacccagcuccaugcacgucaacccagucccgcc

SEQ ID NO: 351458 - RNA, 64 nt, Human
ugccugcccuccaccuugagugccauacucccaacagcuccagguacccaccgggggaugugcc

SEQ ID NO: 351459 - RNA, 64 nt, Human
cggcacuaccacccugcuccaucaucacuacguccagcuccaacggcacuggugccccauucca

SEQ ID NO: 351460 - RNA, 64 nt, Human
ggcaccagugccucgcuccauuggcaccaacgcccagcuccaccgguacuggcucccugcucca

SEQ ID NO: 351461 - RNA, 64 nt, Human
agcuuacuccugguggcagugggagcugccuguucagcuccagcucaccagccccagugcccac

SEQ ID NO: 351462 - RNA, 64 nt, Human
ucuggucacuuuaagacccuaaauaaaaggcagacagcuccacucaaaaacuaaggcugaugug

SEQ ID NO: 351463 - RNA, 64 nt, Human
aaggcucuuuccuagugauggagaugaccaccaucagcuccaggcuucuauccugcuaacccag

SEQ ID NO: 351464 - RNA, 64 nt, Human
gaggagugcgggugcacagcgcgggacuggcaggcagcuccaccugcugccccagugcuggauc

SEQ ID NO: 351465 - RNA, 64 nt, Human
ccgggacuggacgagcaguagauccagcagccugcagcuccaaggaacauugccucucuggauc

SEQ ID NO: 351466 - RNA, 64 nt, Human
acccccuccugauuuuggcuaggcaucguggaaccagcuccagccccugaagaaacgauagaug

SEQ ID NO: 351467 - RNA, 64 nt, Human
acccauagcucuggcauccucagggguugugauccagcuccauauauuguuuaccuucaaagau

SEQ ID NO: 351468 - RNA, 64 nt, Human
gucccuguuuuaccauccugggagcaaggcccugcagcuccacgagaccuuuaccccgggaaga

SEQ ID NO: 351469 - RNA, 64 nt, Human
ggcauggcagaaggaggccagcacgcagccccuccagcuccacguggagacagaagggaucccg

SEQ ID NO: 351470 - RNA, 64 nt, Human
ccacgugugagcugcuccugucucugucuuauugcagcuccaggccugacguuuuacgguuuug

SEQ ID NO: 351471 - RNA, 64 nt, Human
gauagucaaugagagugaagcugcagccggcauccagcuccaagcuuccugcauucaguccuuu

SEQ ID NO: 351472 - RNA, 64 nt, Human
gagcucuccccuggcagugacaagauggcugcagcagcuccagcaaccucagaggacuccccca

SEQ ID NO: 351473 - RNA, 64 nt, Human
agcucucagaagguaccuagaggagcccaagccccagcuccauccuccacuuauucugccuguu

SEQ ID NO: 351474 - RNA, 64 nt, Human
acauuguuaagaagugcauugggcgggcucuguccagcuccagcauugacugucucugugccau

SEQ ID NO: 351475 - RNA, 64 nt, Human
ucaggggucccaaaccaggccauccuagaccagccagcuccagcugauccgcacgcagccacuu

SEQ ID NO: 351476 - RNA, 64 nt, Human
ggccugccggacacagcaccgugccaaccccacccagcuccaggcccaccggaugcugugccug

SEQ ID NO: 351477 - RNA, 64 nt, Human
uuggcaccucugccccgacagaauggggcugaaucagcuccaggaggaaccaggcccugcucuc

SEQ ID NO: 351478 - RNA, 64 nt, Human
agaucgggagacaggauguugacauauaggaauucagcuccacaaagcuucaggccugaccaca

SEQ ID NO: 351479 - RNA, 64 nt, Human
gcuccucucucuccccuccacuuuuuuuuuuugucagcuccaugacaacaugaccagcucagca

SEQ ID NO: 351480 - RNA, 64 nt, Human
augucucuuuucucucccuuauacccuugggucacagcuccaguuguccccagagcacccuggg

SEQ ID NO: 351481 - RNA, 64 nt, Human
ccccauccccuuuccuccccaccuuccccagacucagcuccagaauaccuucuucgcugcuaga

SEQ ID NO: 351482 - RNA, 64 nt, Human
ggacagugaguggcugggaggaagccagaaucaacagcuccagcccucugcgcuacaaccgcca

SEQ ID NO: 351483 - RNA, 64 nt, Human
caagaguuuggggauuagggguauuagggcuuuucagcuccagcuuccugaugaaagggcuguc

SEQ ID NO: 351484 - RNA, 64 nt, Human
aagccccaugcucaguccccucccaucccccacgcagcuccaccccagucccaagccaccagcu

SEQ ID NO: 351485 - RNA, 64 nt, Human
ccguggcccuggcaugagcugugcccagcuucgucagcuccagcguuugccuggucuggaaguc

SEQ ID NO: 351486 - RNA, 64 nt, Human
ccguggggaucccaugaagggauuugagcucuuucagcuccaugucauuuaacuuuuuuguuua

SEQ ID NO: 351487 - RNA, 64 nt, Human
agcuagcuugagggggcagaugccccaggugucccagcuccacagccccuggcagaucccagac

SEQ ID NO: 351488 - RNA, 64 nt, Human
gaagggguagaaggccaggggggcauggagagugcagcuccauuauagugaagagccaaacaua

SEQ ID NO: 351489 - RNA, 64 nt, Human
ccuucccugcugccaggaugcccaagaaaaaggucagcuccaccgaaggggcugccauggaaga

SEQ ID NO: 351490 - RNA, 64 nt, Human
cauugcaucaacuucaagaaagggacaauuugugcagcuccaggaugggaagguggagugggug

SEQ ID NO: 351491 - RNA, 64 nt, Human
ucaguguacaggaagaggcaggcacuggcuggcucagcuccacucggguggaguggaaguggcc

SEQ ID NO: 351492 - RNA, 64 nt, Human
cacugaguggguuucaugagccccaagccaaaaccagcuccagucacagcuggacugggucugc

SEQ ID NO: 351493 - RNA, 64 nt, Human
guccaccugcaccccuucugggcugggaggaaaccagcuccagauggguuuucucuggaggaca

SEQ ID NO: 351494 - RNA, 64 nt, Human
ggguggcugccucggcccucccagcucuuacacucagcuccaguggcuucuccuuucugucaag

SEQ ID NO: 351495 - RNA, 64 nt, Human
gaagcacacgggcuuuggagucaggcacaggugccagcuccagcuuuugaacuugggcaauugu

SEQ ID NO: 351496 - RNA, 64 nt, Human
agaugugucuuaucccaauccuuuggcaggcaugcagcuccacaggcgauuucuucaagcagcu

SEQ ID NO: 351497 - RNA, 64 nt, Human
ugccaggcggcaacaccagaaucuuccagaagcccagcuccacccgcacacgcagcuucccauc

SEQ ID NO: 351498 - RNA, 64 nt, Human
ccagccucgggccaucagccuaggagagcagaugcagcuccaggggcucgacuuauagccaguu

SEQ ID NO: 351499 - RNA, 64 nt, Human
ugacuagcacucagagggacuuaugauaaagguucagcuccagggguaguaccugagugugugc

SEQ ID NO: 351500 - RNA, 64 nt, Human
guuuugcaagacaguggucaacaggaagacccagcagcuccacccucccaagugacaggccauu

SEQ ID NO: 351501 - RNA, 64 nt, Human
ucugauggaaugugccaccuguccggcccagugccagcuccagugccgcuccugcuuccccucc

SEQ ID NO: 351502 - RNA, 64 nt, Human
gggagggggaccugucccccacucucucacccaccagcuccacacauuccagccaggcccaggc

SEQ ID NO: 351503 - RNA, 64 nt, Human
agcacuccgucugaugggaggagucgugggagcccagcuccaggcccugguaccccucuucaug

SEQ ID NO: 351504 - RNA, 64 nt, Human
uaggcaggcucucagauguagguggcaaguggcacagcuccauguccggaggcccagcacuccg

SEQ ID NO: 351505 - RNA, 64 nt, Human
cauuucuaucucccagcccagucacaaaaauacucagcuccaucaagaggaauugugucuaaga

SEQ ID NO: 351506 - RNA, 64 nt, Human
cguggacaccgggcacuggccacuccuacauccccagcuccacacggccugcacaccuguguuu

SEQ ID NO: 351507 - RNA, 64 nt, Human
gguggacaccaacuccucaacagccccaugacuucagcuccaccuggggcacccagcaccccac

SEQ ID NO: 351508 - RNA, 64 nt, Human
agagaugguggcugaugucaaucucccugcagcacagcuccagauugccauggggauuccucua

SEQ ID NO: 351509 - RNA, 64 nt, Human
auugugcccaagccaggagcugcuugggcagucccagcuccacacuggcccugagccccuucac

SEQ ID NO: 351510 - RNA, 64 nt, Human
cagaaugauuaagggccuggcccccaggguuguccagcuccauaagguggagcugggcaagauu

SEQ ID NO: 351511 - RNA, 64 nt, Human
cuggcagggggccucgggcacuccacuaccaacccagcuccacccagcaguguccuggggagaa

SEQ ID NO: 351512 - RNA, 64 nt, Human
acguacagccagcgggucagcccagaggcagccucagcuccagggcuaaggacucucggcuccc

SEQ ID NO: 351513 - RNA, 64 nt, Human
accucacuucugggagacagagcuacagcugggacagcuccaagcuacccuaaccccuccuuuc

SEQ ID NO: 351514 - RNA, 64 nt, Human
agcaugggauugaucggcagcaagaguaaagacacagcuccagaggcccacacuguggggucug

SEQ ID NO: 351515 - RNA, 64 nt, Human
aagucuuaacucuauaauguucauuuaguuguuucagcuccagggaaauggagguauugauguu

SEQ ID NO: 351516 - RNA, 64 nt, Human
ggcugcagcagaguuugaagggcccagccgugcccagcuccaagcagacacacaggcaguggcc

SEQ ID NO: 351517 - RNA, 64 nt, Human
uagcaauuggcuuccucuuuugucuuccuauuuucagcuccauuuaaaccaggaguuauuuaua

SEQ ID NO: 351518 - RNA, 64 nt, Human
gguguagcgguccgaggggcccgguccugccugucagcuccagguccuggagccacguccagca

SEQ ID NO: 351519 - RNA, 64 nt, Human
cugcgccaggucgguccucccugccaaccuuccccagcuccaauauguagcagucucucuggau

SEQ ID NO: 351520 - RNA, 64 nt, Human
cacucagcagcgcuggggcaggugccucugcugucagcuccacccgacaggcagacgaaggcca

SEQ ID NO: 351521 - RNA, 64 nt, Human
uccuguuugcauuucacugggagcuugcacuaugcagcuccaguuuccugcagugaucaggguc

SEQ ID NO: 351522 - RNA, 64 nt, Human
ggccaggguggggggcagucacugugggaggucccagcuccagccccccucugguuugcugccu

SEQ ID NO: 351523 - RNA, 64 nt, Human
ggagguggagucccaacgcuagagcagcccuucucagcuccacccugcccggggagggaggagg

SEQ ID NO: 351524 - RNA, 64 nt, Human
acagcuuuuggagggguucacagaauccuggcagcagcuccagucaagaaugucacugguuggc

SEQ ID NO: 351525 - RNA, 64 nt, Human
caggccuccuguggcuguuggguuccagaugcugcagcuccaugugacuuccaagcaggcccuc

SEQ ID NO: 351526 - RNA, 64 nt, Human
ugacccccggccugcagaacaucuguccccaagccagcuccacugcccaggcccccaagagggc

SEQ ID NO: 351527 - RNA, 64 nt, Human
caagccagcuccacugcccaggcccccaagagggcagcuccagaagcugcccagggcuccggga

SEQ ID NO: 351528 - RNA, 64 nt, Human
caaacgccaccuuacacucugcaggcugcagcggcagcuccagauggccuccugagcuggacga

SEQ ID NO: 351529 - RNA, 64 nt, Human
cgucuucuagguccccagcucagggagccauccccagcuccaguuuucucaugcgaauaugcac

SEQ ID NO: 351530 - RNA, 64 nt, Human
ccagggaggguuccuuggggacaagggugguuggcagcuccaagccuuuaaaccuggcuucuga

SEQ ID NO: 351531 - RNA, 63 nt, Human
guucccagguccccccacaccaguaaacaucccccagcuccacacuggugucugcuccggucc

SEQ ID NO: 351532 - RNA, 64 nt, Human
acuccugccaggcugcccccgccugcugugcacccagcuccagugucucagcucacuucccugg

SEQ ID NO: 351533 - RNA, 64 nt, Human
aguguggaaggaaaucuguagguacccagguccucagcuccagacugggugaugcuggagaccc

SEQ ID NO: 351534 - RNA, 64 nt, Human
cggugaccacuuccgagacccaacccugcacgcccagcuccagugauuacucggaccuacagag

SEQ ID NO: 351535 - RNA, 64 nt, Human
caguagagaagccugaggaauuuacaaaaugaugcagcuccaagccauuguauggcccaugugg

SEQ ID NO: 351536 - RNA, 64 nt, Human
uuuuaaaaaagaaaaagaaccgacuucugaaucgcagcuccacucaugacuaauaccucauuau

SEQ ID NO: 351537 - RNA, 64 nt, Human
uaggcccaggccccaugaggcaccaguggaagcacagcuccaaguucagacaggugcccuuaga

SEQ ID NO: 351538 - RNA, 64 nt, Human
ucccagccaccccccaucuuccuggccucuuuggcagcuccacccuguccccccaccccacaaa

SEQ ID NO: 351539 - RNA, 64 nt, Human
ccggccccccucccauggcccugcuguggcuccccagcuccagucggcugcacgcacaccccug

SEQ ID NO: 351540 - RNA, 64 nt, Human
ccaagcucagcucuaagaaccgccccaaccccuccagcuccaaaucugagccuccaccacauag

SEQ ID NO: 351541 - RNA, 64 nt, Human
uccugccauggccccuaugaggcugccauccccccagcuccaguggugccccugcuggccggag

SEQ ID NO: 351542 - RNA, 64 nt, Human
gggagacaacagcccugucucaaaacuggguugccagcuccaauguaccagcagcuggaaucug

SEQ ID NO: 351543 - RNA, 64 nt, Human
acaaaugcagcaaaugugggaaauuuuuuauggacagcuccacacucauuagucaugagagagu

SEQ ID NO: 351544 - RNA, 64 nt, Human
cugauguaugugcucugccagugugaagggugaacagcuccaacuuuauguccccccagggaca

SEQ ID NO: 351545 - RNA, 64 nt, Human
ucccugaggccaugagggugggagccggccugggcagcuccaacuccagagaaggguacagcug

SEQ ID NO: 351546 - RNA, 64 nt, Human
agcuggaguggcacaggugacccaggcguccuuucagcuccagaauguugcaagucuaggagag

SEQ ID NO: 351547 - RNA, 64 nt, Human
gccuccgagagcgcgggcuccaagggcaauaaagcagcuccacucucucuacuugguucuuuuu

SEQ ID NO: 351548 - RNA, 64 nt, Human
cuucccugggggagccccgacggccacaggacuccagcuccaaguggguuuucuuggcuccccu

SEQ ID NO: 351549 - RNA, 64 nt, Human
uugcauuauuccagggcuguuuugaggucaucuccagcuccauuucccaucucaaaccuacacu

SEQ ID NO: 351550 - RNA, 64 nt, Human
gacagaagcuggaggaguuccggaaagccaaggccagcuccacaggcagcuucacagcaccuga

SEQ ID NO: 351551 - RNA, 64 nt, Human
gcugagcccguccugacaucuguguucuuccugucagcuccacgcccgggccccuggaccacgg

SEQ ID NO: 351552 - RNA, 64 nt, Human
caguucacaaccgcuccgagcgugggucuccgcccagcuccaguccugugauccgggcccgccc

SEQ ID NO: 351553 - RNA, 64 nt, Human
cccccacccaguccgccaaacacuccacccccuccagcuccaguuuccaaguuccugcacucca

SEQ ID NO: 351554 - RNA, 64 nt, Human
gacgugaggguccugauucucccugguuuuaccccagcuccauccuugcaucacuggggaggac

SEQ ID NO: 351555 - RNA, 64 nt, Human
gugaggagggagcugggggacacuuucgagcucccagcuccagcuucgucucaccuugaguuag

SEQ ID NO: 351556 - RNA, 64 nt, Human
ugguguugggacugccaaaggaaacacagaaugacagcuccaucucugcagaccucagauuuga

SEQ ID NO: 351557 - RNA, 64 nt, Human
gcaagauugggccacacugucuggacucaaagcccagcuccaccacugagcacccgugugacuc

SEQ ID NO: 351558 - RNA, 64 nt, Human
cgugugaagacauccaacauccacgugacuuuuccagcuccauuuuugaacagugacugagauu

SEQ ID NO: 351559 - RNA, 64 nt, Human
ugcccauccucaccacugaggccacgacaaagcacagcuccagcucggacagcacccucagugc

SEQ ID NO: 351560 - RNA, 64 nt, Human
gccucagccucucugguagcugagacugcaugcccagcuccaaaucaccuugauucauaucagc

SEQ ID NO: 351561 - RNA, 64 nt, Human
gggaggugggggcacuccacacuggggggcccugcagcuccagggcuggugcucuagcagaucc

SEQ ID NO: 351562 - RNA, 64 nt, Human
ggucacggcauccugugguguccaugagguaccacagcuccacuccuggcuggaacccagcacc

SEQ ID NO: 351563 - RNA, 64 nt, Human
aaaacuucugagcaaggccaggcugugagggccccagcuccacccaggcuuugggugaauucug

SEQ ID NO: 351564 - RNA, 63 nt, Human
ugaacaagcagccauacugaugaccacagcaaccagcuccacggccugaugcagccccuccca

SEQ ID NO: 351565 - RNA, 64 nt, Human
cucuccauaccugccccugccugacagccuuccccagcuccagcaggaaggaccccacauccuu

SEQ ID NO: 351566 - RNA, 64 nt, Human
gggagcuggagcccagcaugcuggggagugcggucagcuccacacaguaguccccacguggccc

SEQ ID NO: 351567 - RNA, 64 nt, Human
cgugugccugguaauauggggcggaauuuccacucagcuccauuugcuggggauuuaaagagaa

SEQ ID NO: 351568 - RNA, 64 nt, Human
ccugccaugcagacccaugccccccucccccaggcagcuccaagaaagcucccugacucgcccc

SEQ ID NO: 351569 - RNA, 64 nt, Human
gccagccgugccccccaggcaccuucucagccagcagcuccagcucagagcagugccagcccca

SEQ ID NO: 351570 - RNA, 64 nt, Human
ccaggcucacaggcugugccacccgucccuccgacagcuccaauacugugacccuccuuccuca

SEQ ID NO: 351571 - RNA, 64 nt, Human
ccuagggcuccagaggggugaaugggccuuugcucagcuccaggcccagcgggaagggaggcug

SEQ ID NO: 351572 - RNA, 64 nt, Human
aguccauggggaucucaucacccacucccagccccagcuccagcugcccucaccucucuagcag

SEQ ID NO: 351573 - RNA, 64 nt, Human
gagagaaggagcuggcgagaaccuuccccacacucagcuccaaacgccuccucucccaggucau

SEQ ID NO: 351574 - RNA, 64 nt, Human
auuccgcuugaccuuuggugcacugcccacuucccagcuccacuggcccaagucugagccggag

SEQ ID NO: 351575 - RNA, 64 nt, Human
agccaucuguggggcaggcacacacaccucccgccagcuccaauuuugcacuuuuucccugcuu

SEQ ID NO: 351576 - RNA, 64 nt, Human
gacugcaucccguaccucuucccaugacugcacccagcuccaggggcccuugggacagccagag

SEQ ID NO: 351577 - RNA, 64 nt, Human
caggcccaugugugagaguccucucccuucuggccagcuccagcccccucacccuugcuggggg

SEQ ID NO: 351578 - RNA, 64 nt, Human
auuacacucaaggaaaagaugugcucccaccaggcagcuccagcuguuaccugagauacugaag

SEQ ID NO: 351579 - RNA, 64 nt, Human
aucucguguacagauagaccggccucgccccuuccagcuccaagggcuacaucaaccgaccuuu

SEQ ID NO: 351580 - RNA, 64 nt, Human
acuuugaaaacaguuuaaaacacgugugcuuggucagcuccagugugucgucccgugcgggggu

SEQ ID NO: 351581 - RNA, 64 nt, Human
ucugacguccacgggcaggagaagguggauauuucagcuccaggaaagagagcuaauucacucu

SEQ ID NO: 351582 - RNA, 60 nt, Human
agagaguugaacaguggugagcugggcucacagcuccauccaugggccccauuuuguacc

SEQ ID NO: 351583 - RNA, 64 nt, Human
ccucaaucuggggucuagaguugugcaaggaauucagcuccaguaaggccuggauugcccgggg

SEQ ID NO: 351584 - RNA, 64 nt, Human
cugagagaagugcucugccugccagugcagugcccagcuccaaggcucuagaggguguucaggu

SEQ ID NO: 351585 - RNA, 64 nt, Human
caaaugagccaugagaugauacauccaaagcagacagcuccacccuggccgaguccaagcuggg

SEQ ID NO: 351586 - RNA, 64 nt, Human
ucuuuuugcuuugcccuuuuaaagcugaaauaaccagcuccauucuuuucaugaauaguaaguu

SEQ ID NO: 351587 - RNA, 64 nt, Human
ccggccgggugcuucugggggcucgucggggggacagcuccacucugacuggcacagucuuugc

SEQ ID NO: 351588 - RNA, 64 nt, Human
uggacucagucugucaaguccccgaagcuuccugcagcuccaccuuguaaaaaugcugccuuug

SEQ ID NO: 351589 - RNA, 64 nt, Human
ccauguuccagucccuccacccacccaccgggcucagcuccagggcacagucacuuguccguug

SEQ ID NO: 351590 - RNA, 64 nt, Human
ggccccaccuuuguccccuagcaaauucaggguacagcuccaccuagaaccaggcugcccucua

SEQ ID NO: 351591 - RNA, 64 nt, Human
ccuuggccccugccugcgucugugcucaaagcagcagcuccaacccugccucuguccccuuccc

SEQ ID NO: 351592 - RNA, 64 nt, Human
guguuuccuuaggccugggguaggggauggagagcagcuccaaggcugagcuggggcucuggcc

SEQ ID NO: 351593 - RNA, 64 nt, Human
cccaggaccccaagcugcagagcccagggaagagcagcuccagagcccuggccggggccgcggg

SEQ ID NO: 351594 - RNA, 64 nt, Human
cagugccuccccgccccgccgcuggcgucaaguucagcuccacgugugccaucaguggauccga

SEQ ID NO: 351595 - RNA, 64 nt, Human
gucuuccuauuuugaguuugguucagaucuuaagcagcuccaugcaacuguauuuauuuuugau

SEQ ID NO: 351596 - RNA, 64 nt, Human
ugccuagugaggaagauggaccuggacagacagucagcuccacaccuugcgcugagcagcugug

SEQ ID NO: 351597 - RNA, 64 nt, Human
ccugcaggggcccggcgagccccaggaagagccucagcuccaggcuggggcucuggcugcugga

SEQ ID NO: 351598 - RNA, 64 nt, Human
uuucuguuuuaaccaguuaaacaugccucuucuacagcuccauuuuugauaguuggauaaucca

SEQ ID NO: 351599 - RNA, 64 nt, Human
acacgcugucacuuccucucacucguucuugaaucagcuccaugugcccaugaaaucaauggcc

SEQ ID NO: 351600 - RNA, 64 nt, Human
cauggacucugcccagagccuucuuguuuaugaucagcuccagcuaccugggcaguuguggugg

SEQ ID NO: 351601 - RNA, 64 nt, Human
aaggccugcugucuccuucugggggucagggacgcagcuccacccucaccacuagcccacccug

SEQ ID NO: 351602 - RNA, 64 nt, Human
agcccauggcagccaacuauaaugucuuccucaacagcuccaagcuagcugaguggcguaugca

SEQ ID NO: 351603 - RNA, 64 nt, Human
aaaauugauuacaaguucucugcugugguugcugcagcuccaggaaguccccgcaaugucucac

SEQ ID NO: 351604 - RNA, 64 nt, Human
acugucagggugcuggccccucugcagauggaaucagcuccaggcugacaccagcagaguccug

SEQ ID NO: 351605 - RNA, 64 nt, Human
gggagguucucccaaccccacuuucuuccuuccccagcuccacuaaauucccuccugccuuaac

SEQ ID NO: 351606 - RNA, 64 nt, Human
gaguuagaacuguuggauacaggagaagaaacagcagcuccacuaccgacccccccccagguuu

SEQ ID NO: 351607 - RNA, 64 nt, Human
agcucagggacuggcacacuggccuccagaagggcagcuccacagggcagggccucauuauuuu

SEQ ID NO: 351608 - RNA, 64 nt, Human
ggcugcccuccccagaccaccccggcagccugagcagcuccaaagcacuggcuugggguccgag

SEQ ID NO: 351609 - RNA, 64 nt, Human
accggucccccccuagcccgucaucagccgguggcagcuccaucuuccauuccugguuuuaggg

SEQ ID NO: 351610 - RNA, 64 nt, Human
cagccccaccucagucuccaggacauuccuuucccagcuccagccuggagggaaggggacaaag

SEQ ID NO: 351611 - RNA, 64 nt, Human
auucuauuuguuagaaguaaaccacaggucccaccagcuccaugggagugaccaccucagucca

SEQ ID NO: 351612 - RNA, 64 nt, Human
uguagguuucaggugugucauuuccugcugcuuccagcuccaucccuacagacuccuccccgag

SEQ ID NO: 351613 - RNA, 64 nt, Human
cucugguccagcugccccacccagcugcccuuaucagcuccaagucccucucugagccuuuauu

SEQ ID NO: 351614 - RNA, 64 nt, Human
ucugccggggacggacagggcagagggcagcgggcagcuccaggaacacgguggaacgggguuc

SEQ ID NO: 351615 - RNA, 64 nt, Human
agggagggaggacagaccuccaccacacugacaucagcuccagcucccccagguugggggggag

SEQ ID NO: 351616 - RNA, 64 nt, Human
acacaucccccccaaccuacccccaccccaaaagcagcuccaacagaauggccagagggccuca

SEQ ID NO: 351617 - RNA, 64 nt, Human
uaaaagcaaagcuuccuaaaaagauuuuucuuggcagcuccaggucuauacauuuagguaauga

SEQ ID NO: 351618 - RNA, 64 nt, Human
ugugaacgaaugggauaggauuuuuaaaaucagccagcuccaugcccaaaccuuccuguuugca

SEQ ID NO: 351619 - RNA, 64 nt, Human
agaggaauuccagcaucugaagacucaggcagagcagcuccacaaccaccuccagccugggaga

SEQ ID NO: 351620 - RNA, 64 nt, Human
aaggcuauuuuccaacugaagucagggacauugccagcuccagaaaacauccauaacauaguaa

SEQ ID NO: 351621 - RNA, 64 nt, Human
gggauuggggagggaccagagcgcccaauacacacagcuccauuaugcaauccauuccagcaaa

SEQ ID NO: 351622 - RNA, 64 nt, Human
aggaggaaacuacaccacacuaaaacauugucuacagcuccagauguuucucauuuuaaacaac

SEQ ID NO: 351623 - RNA, 64 nt, Human
augacccaccucagcucagccccccagccccugccagcuccacacuaucucuuagcugaguuuu

SEQ ID NO: 351624 - RNA, 64 nt, Human
ucccauguaccuuauaucccucucugaaacagaacagcuccaauagcaacaagcuaguuguucu

SEQ ID NO: 351625 - RNA, 64 nt, Human
ugcagagccaacgggcuugccaggccgacugcagcagcuccagcuuccaguugccuuagggaca

SEQ ID NO: 351626 - RNA, 64 nt, Human
gagcuaggguuugugaggcuuucuacaaauaggucagcuccaccuggagugcgaauugccagag

SEQ ID NO: 351627 - RNA, 64 nt, Human
gcagcaccugccacugccgucaccucucccuccucagcuccagggcagugucccucccuggcuu

SEQ ID NO: 351628 - RNA, 64 nt, Human
augggguugcagcucuguucaaacacaauucuaucagcuccaaaaugugugaacuugacuugug

SEQ ID NO: 351629 - RNA, 64 nt, Human
ggggagaacggugucuaggagggaugaccccacucagcuccaggcaguguucugccgagacccc

SEQ ID NO: 351630 - RNA, 62 nt, Human
uuuuuguaggagguaggauauuuuauauucugccgcaggauagaacccacgcaaggauuuuc

SEQ ID NO: 351631 - RNA, 62 nt, Human
cuccggaaggcucuggccccaagcuggccggcccgcaggagccccauucucagagaaugugu

SEQ ID NO: 351632 - RNA, 62 nt, Human
uauuuauuaauagauuaaguucugaggcagcuccgcaggacugugugugaauguguauguau

SEQ ID NO: 351633 - RNA, 62 nt, Human
cagucagaggcccccgucccuccuuuugccuuccgcaggacugaagaccugaaggggcuggc

SEQ ID NO: 351634 - RNA, 62 nt, Human
ggcaguauugggggacugugcuagcuuuacccccgcaggacauacacaggagccuuugaucu

SEQ ID NO: 351635 - RNA, 62 nt, Human
ggugggaaugaccccuaggcaaggggaugagaccgcaggaggaaauggcggggaggaggcau

SEQ ID NO: 351636 - RNA, 62 nt, Human
accaagccagggaugggcuggccauuguguccccgcaggagagaugggcagaauggcccuag

SEQ ID NO: 351637 - RNA, 62 nt, Human
cugagcucaaaggaacaggauggcacccagagccgcaggacggagacugggggcagcccuca

SEQ ID NO: 351638 - RNA, 62 nt, Human
gaauguuuccaauagacuaaauacuguuuaggccgcaggagaguuuggaauccggaauaaau

SEQ ID NO: 351639 - RNA, 62 nt, Human
gacuccuguggcuucuggaccccuccucugccccgcaggaggaaguuccacggcagguggug

SEQ ID NO: 351640 - RNA, 62 nt, Human
aguagccagcaucugccuccccuucacucccaccgcaggauuugggcucuuggaauccuggg

SEQ ID NO: 351641 - RNA, 62 nt, Human
gugagcaggccccaugcccagcacgccagccaccgcaggauaccucagucauaccaguugua

SEQ ID NO: 351642 - RNA, 62 nt, Human
cuaggacuugccacacacugccaauucauaauccgcaggaucuguagaagacauuuugggaa

SEQ ID NO: 351643 - RNA, 62 nt, Human
uauuccauuagccuguggucugcaggguaggcccgcaggaaaugaggaauggccgagcugga

SEQ ID NO: 351644 - RNA, 62 nt, Human
gugucccuggccccuuccugccaugggcaggcccgcaggaagagccgguagggguggaaagg

SEQ ID NO: 351645 - RNA, 62 nt, Human
cauguagaauaaaugaagaaagggaggcccagccgcaggaaggcagaauaaauccuugggag

SEQ ID NO: 351646 - RNA, 62 nt, Human
uaaggggucaggccagauggggcaggaaggcuccgcaggaccggaccccuagaccacccugc

SEQ ID NO: 351647 - RNA, 62 nt, Human
ccuuaucugcggccggugaagaagcccaagauccgcaggaagaagugaguuggaggcugggg

SEQ ID NO: 351648 - RNA, 62 nt, Human
uuucacguuuucuuuacacacacguugacgggccgcaggagggaggcggggaggaggaacgg

SEQ ID NO: 351649 - RNA, 62 nt, Human
gccgucaccucagacaucacuccagggagcacccgcaggagcugggcccccucacgccugcc

SEQ ID NO: 351650 - RNA, 62 nt, Human
cgcaguucucggacgccgaggggcuggcgcucccgcaggacggccucuauuaccucuacugu

SEQ ID NO: 351651 - RNA, 62 nt, Human
ccacagacacacucacgcccgccaccugcuccccgcaggaugugucugugugugggaauugg

SEQ ID NO: 351652 - RNA, 62 nt, Human
aagccugcaguaggaucucagccacaagggccccgcaggauggagcugggucaaggaccagg

SEQ ID NO: 351653 - RNA, 62 nt, Human
accgagaggcaggucaagaucugguuccagaaccgcaggaugaaaaugaagaaaaucaacaa

SEQ ID NO: 351654 - RNA, 62 nt, Human
ggaugccauguagccccagcuggaagugacuuccgcaggaauugagagggaauagcucaccc

SEQ ID NO: 351655 - RNA, 62 nt, Human
cuguccucuccguggaggacccugggcccucaccgcaggaagcaguuuggguuuugaaaggu

SEQ ID NO: 351656 - RNA, 62 nt, Human
ugcugcugaccuuacgccuguauauuaagccuccgcaggaugccggacaauggugaagaaac

SEQ ID NO: 351657 - RNA, 62 nt, Human
agccccacucacagcugcugcaccaccaccuuccgcaggaugcacaggugaguacagugaug

SEQ ID NO: 351658 - RNA, 62 nt, Human
augccguuggggcggaggcugcccuugcagcgccgcaggaacucggccaggugcugaucggu

SEQ ID NO: 351659 - RNA, 62 nt, Human
aggcagcccacagugcugcacguagccaugggccgcaggagugcauacaacccugcauccag

SEQ ID NO: 351660 - RNA, 62 nt, Human
ucgcagccccaucggacgcucucccgggaccgccgcaggaccaguuuccauagacugcggac

SEQ ID NO: 351661 - RNA, 62 nt, Human
cacauacaacacagaucauuucccaguuagauccgcaggaaguagguugguggggguggaug

SEQ ID NO: 351662 - RNA, 62 nt, Human
uuugaaacugugaagccucgccccgcggccugccgcaggauauguuuugguaaauguagacu

SEQ ID NO: 351663 - RNA, 62 nt, Human
uuccgugcaugcaguggaauaguaccagccuuccgcaggaaggaaauucugacauaugcggu

SEQ ID NO: 351664 - RNA, 62 nt, Human
uccgcauccuugucccucugcauucccaguuuccgcaggagccuugaucaauggggaagccu

SEQ ID NO: 351665 - RNA, 62 nt, Human
ccuggaggccauuugugccugccucugugcugccgcaggagggcaggccgcaagugggguug

SEQ ID NO: 351666 - RNA, 62 nt, Human
ggucagaaucaauccuuuggugaaaguaagaaccgcaggaguugaguuuugguuugguccug

SEQ ID NO: 351667 - RNA, 62 nt, Human
ugggaaaucugccuaugucauaccgugacagcccgcaggaucaggugacuucuagcagagac

SEQ ID NO: 351668 - RNA, 62 nt, Human
ccugcccccgugaggaugucacucagauggaaccgcaggaagcugcuccgugcuuguuugcu

SEQ ID NO: 351669 - RNA, 62 nt, Human
gggugcugugagaaggcugugcccauguggggccgcaggaauccccuguauguucagggcug

SEQ ID NO: 351670 - RNA, 62 nt, Human
cucauauagcccucagucacugagggagucccccgcaggauuggagaggcacauucccuugg

SEQ ID NO: 351671 - RNA, 53 nt, Human; identical to SEQ ID NO: 221598

SEQ ID NO: 351672 - RNA, 62 nt, Human
ccuggcuuccugguaaggaguuucagccgccuccgcaggaacccccaaagugcagauuccgg

SEQ ID NO: 351673 - RNA, 62 nt, Human
accuagucagaugguagacgagcugucugcugccgcaggagcaccucuauacaggacuuaga

SEQ ID NO: 351674 - RNA, 62 nt, Human
cauggcugagagccaggcuuccuuccuggucuccgcaggaggcuguggcagcuguggcaucc

SEQ ID NO: 351675 - RNA, 62 nt, Human
cucagcucgguacccggggcccagggcaagcuccgcaggacuuccccggagggcugcggcgu

SEQ ID NO: 351676 - RNA, 62 nt, Human
gcaaccacagugcauguugcagauaccggcggccgcaggaggggcagcauccaguagaggac

SEQ ID NO: 351677 - RNA, 62 nt, Human
gacccuccugaggagugaagagugacaugccaccgcaggauccuuugcucugcacgaguuac

SEQ ID NO: 351678 - RNA, 62 nt, Human
cagaugagugggagacugguugcaaggugugaccgcaggaauccuggaggaauagagaguaa

SEQ ID NO: 351679 - RNA, 62 nt, Human
cagaugagugggagacugguugcaaggugugaccgcaggaauccuggaggaacagagaguaa

SEQ ID NO: 351680 - RNA, 62 nt, Human
uuuaguuuccugacaccuguguccugagugagccgcaggaguucuuagcuccucagcgagca

SEQ ID NO: 351681 - RNA, 62 nt, Human
guggccaggauccaauacgaguccaggggugaccgcaggauggugggggcagcgggcuucuc

SEQ ID NO: 351682 - RNA, 62 nt, Human
uguucacagaccucagcagggcaucgcauggaccgcaggagggcagauucggaccacuaggc

SEQ ID NO: 351683 - RNA, 62 nt, Human
ccggaggacagccagcggcugcuuuguggacaccgcaggaaguuccucgggacacggcugcu

SEQ ID NO: 351684 - RNA, 62 nt, Human
ugacgaagcugcucagcaacuccaccugcccgccgcaggaaggagcaguccccugcuauccc

SEQ ID NO: 351685 - RNA, 62 nt, Human
uccugccgccucuucccuaccuccuccacuagccgcaggaagggccuccagcacccacaacu

SEQ ID NO: 351686 - RNA, 62 nt, Human
ccaggccaagcacacacaggcugcgcccaguuccgcaggagccgucccacagcguggcucuc

SEQ ID NO: 351687 - RNA, 62 nt, Human
ggggucugcaccccaggcacagcggugucaccccgcaggaccgcgggccugccccaaccccc

SEQ ID NO: 351688 - RNA, 62 nt, Human
ggagggacggcagccccggucgcgcgcuggccccgcaggaccuuccuuuuccaggaagagcc

SEQ ID NO: 351689 - RNA, 62 nt, Human
ggggguggggguggggguggggguggaagcagccgcaggagcaagggccccucccacauaca

SEQ ID NO: 351690 - RNA, 62 nt, Human
auggccacugaguaggccccagaggucgcacuccgcaggaggacugaggccaugugccauuc

SEQ ID NO: 351691 - RNA, 62 nt, Human
cuaggaaaucucggugcacuaggaagugaaucccgcaggacagcugcacucagggauacgcc

SEQ ID NO: 351692 - RNA, 62 nt, Human
cagcagccagggacccccagaacaagaagaccccgcaggaucccuccugagcucggggggcu

SEQ ID NO: 351693 - RNA, 62 nt, Human
uguauuguugccggcaugacaccgcgggacggccgcaggacgcaggcgagggccgcacggcu

SEQ ID NO: 351694 - RNA, 62 nt, Human
aaccugucccacccccgugcccccuccuuaccccgcaggacgggccuacaggggggucuccc

SEQ ID NO: 351695 - RNA, 62 nt, Human
ggacgcagagugcaggcuguggccucggcaucccgcaggaggucccuagaacaugccguuuc

SEQ ID NO: 351696 - RNA, 62 nt, Human
uccaugaccugcgcucucagcugaccaucaucccgcaggaccccauccuguucucggggacc

SEQ ID NO: 351697 - RNA, 62 nt, Human
ccgccuggcagaaucuagcaccguccgaauccccgcaggacccauggagcuaugaccacacc

SEQ ID NO: 351698 - RNA, 62 nt, Human
gccugauuucgcucgggcuucgggugacuucgccgcaggaccuacccagcucgcucacuucg

SEQ ID NO: 351699 - RNA, 62 nt, Human
gcagguaggcugcagccaggagcucccuggcaccgcaggaccucgugguacucuugccuuag

SEQ ID NO: 351700 - RNA, 62 nt, Human
gcacaggguggggcgcgcaguaggaaccucccccgcaggagcuggcgcccucucgcuccugc

SEQ ID NO: 351701 - RNA, 62 nt, Human
ucccaggccccuuguggacuuagacucaaaacccgcaggagaaacagguccgacucaguaug

SEQ ID NO: 351702 - RNA, 62 nt, Human
gcaggccaugugagcccugccucuuuaaggagccgcaggacaugaaagaugaccuugugaca

SEQ ID NO: 351703 - RNA, 62 nt, Human
cgcggggcucucugggccgguucccugcagacccgcaggagagcacaugugccuugcaugaa

SEQ ID NO: 351704 - RNA, 62 nt, Human
ccuggucugugaagagccgguggugcccgugcccgcaggaacugggcugggccucgugcgcc

SEQ ID NO: 351705 - RNA, 62 nt, Human
uuauucaagagaccaccugacaugcaucuccuccgcaggaauacauucguccucucuuagag

SEQ ID NO: 351706 - RNA, 62 nt, Human
aggaaugcagugcucaaaaccuacccaaauucccgcaggauucuaccaaacccuuccccagg

SEQ ID NO: 351707 - RNA, 62 nt, Human
gccagcagccgcgaaccuugaagcuggggugaccgcaggagacccuguaaggccugugagcg

SEQ ID NO: 351708 - RNA, 62 nt, Human
acgggagcuccacugugaaucggcggcacgcgccgcaggaggcugggacugguccaguuugu

SEQ ID NO: 351709 - RNA, 62 nt, Human
acgcaacguuuccaacucucgggacgccaaggccgcaggacuggagggccaggccccgccac

SEQ ID NO: 351710 - RNA, 62 nt, Human
cgcuguggucuggcccccucccuguccaggccccgcaggaggcagaugcagucccaggcauc

SEQ ID NO: 351711 - RNA, 62 nt, Human
gcacaaccagcucgcccucccccuacccggggccgcaggacgcugagacgguuugggggugg

SEQ ID NO: 351712 - RNA, 62 nt, Human
cucacguggccuuuaaaaaccuacuuccccgcccgcaggagcucagagcaucgcugggccug

SEQ ID NO: 351713 - RNA, 62 nt, Human
cagaagcccugggguuccuggccccccgugagccgcaggaggaugcguugccugcagugcag

SEQ ID NO: 351714 - RNA, 62 nt, Human
aagccaaagccgaaugagaacggugucucugcccgcaggacgccugcccccagcccccgcag

SEQ ID NO: 351715 - RNA, 62 nt, Human
cccagaugccugaggccuggcuggggcugcccccgcaggacacuguggccaugccacggagg

SEQ ID NO: 351716 - RNA, 62 nt, Human
gaguaggggugggggugggauggcaggaggagccgcaggaggaaggagguugugcagggucu

SEQ ID NO: 351717 - RNA, 62 nt, Human
uaagugaguucacaccuagaacacuguccugaccgcaggacgcgugccuuggacuugguauu

SEQ ID NO: 351718 - RNA, 62 nt, Human
agccagauccauggcaauggucuccccacagaccgcaggacugagccuggagagagaaguug

SEQ ID NO: 351719 - RNA, 62 nt, Human
cuugucuggccaugaucuggagagcaucaggcccgcaggacugcacaacucugccaggggug

SEQ ID NO: 351720 - RNA, 62 nt, Human
gucccccaccccaucagcugggaaagcccaggccgcaggagugggaugcccguuggacuuug

SEQ ID NO: 351721 - RNA, 62 nt, Human
ccauccguggaggaggggccgguccuggacucccgcaggacuccucugaggcagggccugaa

SEQ ID NO: 351722 - RNA, 62 nt, Human
uagaguguacucugaaaccaacucgucucuggccgcaggagucuauauguuuucguaaucuu

SEQ ID NO: 351723 - RNA, 62 nt, Human
uggcugaguuacuugcugcccugugcuccuccccgcaggacauggcucccccuccaccugcu

SEQ ID NO: 351724 - RNA, 62 nt, Human
uuuguuuugcccucuggguguuuucuuuggucccgcaggaggguggguggagcagguggacu

SEQ ID NO: 351725 - RNA, 64 nt, Human
uuuuccaccaagguaccuacauucuaccacgccuggguccaaaaccacggugcuggccuguuug

SEQ ID NO: 351726 - RNA, 59 nt, Human
accgggccaucauggaguaggugcuuccaggguccaagggauucucagccauccaggca

SEQ ID NO: 351727 - RNA, 64 nt, Human
cauuucaaaucaguaguuugggcagugccuuuugggguccaaucuuuuuggauuggauucuauu

SEQ ID NO: 351728 - RNA, 64 nt, Human
aauggugaagcacacuccccucccuccucaccugggguccaauguucugucuaguggcagcuuu

SEQ ID NO: 351729 - RNA, 64 nt, Human
ccacugggauuccuacuuaggugucugcccucagggguccaaaucacuucaggacaccccaaga

SEQ ID NO: 351730 - RNA, 55 nt, Human
aguacaccagcuccaagugagucccugccgggaccuggcgcucgcucgcucgagu

SEQ ID NO: 351731 - RNA, 64 nt, Human
uugugacuuuggacuucaacaguuuguauauugggacuucuaaugugauuacuguacuaaauaa

SEQ ID NO: 351732 - RNA, 64 nt, Human
acauuuaaaacaagauccuggguuuuugugguuugacuucuaugguguuuuaaaaaaacacaga

SEQ ID NO: 351733 - RNA, 64 nt, Human
aggaggccgaggucucuaacucuuaucuuccacaggguccaagaguucaucaggacccccaaga

SEQ ID NO: 351734 - RNA, 64 nt, Human
uuucccgcgcacugaaagggcagaguaggccgaaggguccaagggccagacugccucacccucu

SEQ ID NO: 351735 - RNA, 64 nt, Human
agacuuggagagcugcagugaugacgacaaccagggguccaaguccccaaagaugugagacuuc

SEQ ID NO: 351736 - RNA, 64 nt, Human
uggaucagguccuuucuccaucccacuaccuccuggguccaaagccuggugagagcauagggcc

SEQ ID NO: 351737 - RNA, 64 nt, Human
acaagcauauauucugaucaaaaauugggagccaggguccaauaguuggacuauucaaaguugc

SEQ ID NO: 351738 - RNA, 64 nt, Human
caccaagaaggggcucgagugccccugcaggggaggguccaaucuccggugugagcccaccucg

SEQ ID NO: 351739 - RNA, 64 nt, Human
gucuuugguggggcaggggaguugacagggaugaggguccaaggaauaagcaugaaugacaaga

SEQ ID NO: 351740 - RNA, 64 nt, Human
uucucuuguaggaauguaaaucuguauuaaaaggggguccaagccaggcccccaggucuucuca

SEQ ID NO: 351741 - RNA, 64 nt, Human
gcuucaguucucagcuguuuaccacagcccuccaggguccaaagauugaggagcuuucucuuuc

SEQ ID NO: 351742 - RNA, 64 nt, Human
gagccagugacugucccucccagcagccuccaaaggguccaaaguccaagcuagcucuggccug

SEQ ID NO: 351743 - RNA, 64 nt, Human
aaagacaacuauaaucauucaaaaauuccaaguuggguccaaaaugucaaagguagguauugga

SEQ ID NO: 351744 - RNA, 64 nt, Human
acacgaccucggcucacugcagccuccuucuccuggguccaagcaauuauugugccucagccuc

SEQ ID NO: 351745 - RNA, 64 nt, Human
ucagcauaaugagagaucaaccgugguggggaguggguccaaguaaggguucucauuguugccu

SEQ ID NO: 351746 - RNA, 64 nt, Human
ucuuuuacacaauaugcacauuuuuaccauugugggguccaaauuuaagauaccuuccacucac

SEQ ID NO: 351747 - RNA, 64 nt, Human
uaaaacccaaaccacauaugaaaaaauccauuaaggguccaagaagucuguccauaugaaaaug

SEQ ID NO: 351748 - RNA, 64 nt, Human
ucuauauaucuacauauaucuaucuaucuauaucuacaucuauauaaucuuacauuuaaaauug

SEQ ID NO: 351749 - RNA, 64 nt, Human
ucugccaaggagugguuuguacugcuguguuugguacaucuagucuuuuuucugcuauaaguuu

SEQ ID NO: 351750 - RNA, 64 nt, Human
gagucaugaccaagcaacccuucuuuuucccuuugacuucuacagaaaucugggccugagacau

SEQ ID NO: 351751 - RNA, 64 nt, Human
aauacucauagugaguacgcucuaugcauaguaugacuucuauuuuaaugugaagaauuuuuug

SEQ ID NO: 351752 - RNA, 64 nt, Human
uuauauaaguuagauuuauuuaugauaucaacuuggguccaagaugauaguuuuagcuagcuua

SEQ ID NO: 351753 - RNA, 64 nt, Human
gcagggggugugggagggccaguuucccgccacuggguccaaggagccuuuguucaaaggaaga

SEQ ID NO: 351754 - RNA, 64 nt, Human
agaugggaauucaaauaugaauccucucuggagaggguccaacugggaauccugcuaaaggagc

SEQ ID NO: 351755 - RNA, 64 nt, Human
ggcucacucacagagucaaggccugcucccuguaggguccaaccagaccuggaagaacaggccu

SEQ ID NO: 351756 - RNA, 64 nt, Human
gaaagagccucaccagcagcugcuuuuggagcagggguccaaggaagagaggguggccucgaca

SEQ ID NO: 351757 - RNA, 64 nt, Human
ugucggccaggcuggagugcagccucaaccuccuggguccaagugauccucccaccucagcaca

SEQ ID NO: 351758 - RNA, 64 nt, Human
uuuccugcucucuccccucuuuugugaagaaagcggguccaaaugugauucaaacaacuguacg

SEQ ID NO: 351759 - RNA, 64 nt, Human
uggugaggggccuugcccucccgcucccagcccaggguccaaccugacccagugaucuuccaug

SEQ ID NO: 351760 - RNA, 64 nt, Human
ugccagacgcuaacacacuuuucucccugugucuggguccaaacgugcauccucuugguuggcc

SEQ ID NO: 351761 - RNA, 64 nt, Human
caagcuggaagggauggggcuguugguggggucaggguccaagaggaauggguguucuguggcc

SEQ ID NO: 351762 - RNA, 57 nt, Human
gaagaaggagaaaauucugaauuucuaggguccaaaaguugacaaaaccauuaguag

SEQ ID NO: 351763 - RNA, 64 nt, Human
aggcccuacaaaacagauuagagggaagacagagggguccaagggagauggucucucuucucaa

SEQ ID NO: 351764 - RNA, 64 nt, Human
cccaauuucuggccuucaacuucuccccuugaccggguccaacucugccacucaucugccaacu

SEQ ID NO: 351765 - RNA, 64 nt, Human
cccguuaacauagugcugaaaccaaaggcaguggggguccaaacucguggugcagcaagucaca

SEQ ID NO: 351766 - RNA, 64 nt, Human
gucaucucugaaaugcauuugggguaguuuccugggguccaagggccaauuccuauacccaguc

SEQ ID NO: 351767 - RNA, 64 nt, Human
aaauaaccucuuguaguuauaaaauaaaacguuugacuucuaaacucugucucuaugagugucc

SEQ ID NO: 351768 - RNA, 64 nt, Human
uaggggaaugaacauguuuuccuacugcauuggggacuucuagauagguuaaugaaaggccuuu

SEQ ID NO: 351769 - RNA, 64 nt, Human
gcuggaacuauuguauagaagauaauaugauugugacuucuaguucuuuucuagaggaugcugc

SEQ ID NO: 351770 - RNA, 64 nt, Human
cauucuaugguuacauuuuauuuuggacuauggggacuucuaauacguuuugguaaagaagaga

SEQ ID NO: 351771 - RNA, 64 nt, Human
agaauugcuacaaucccaaagcgcucgccccgcaggguccaaaggccagcggugaccagccugu

SEQ ID NO: 351772 - RNA, 64 nt, Human
aagacaggaugggggcuggccucuggcucucaugggguccaaguuuuguguauucuucaaccuc

SEQ ID NO: 351773 - RNA, 64 nt, Human
ccuuguaagaaagcauuccugggaagucuucuguggguccaaacauguugcuccgaucaucaca

SEQ ID NO: 351774 - RNA, 64 nt, Human
auuaagaaauaaaguccuagcuucuuacagagagggguccaaauggugaaugcucauccugccu

SEQ ID NO: 351775 - RNA, 64 nt, Human
cagguucaaaaguaaaagcaguggcccugcuuugggguccaagaauaggagugaugggugaagg

SEQ ID NO: 351776 - RNA, 64 nt, Human
ugugcaaacggguucccuagcaaaguauuuguggggguccaaugcaaggaggcagggaagaaag

SEQ ID NO: 351777 - RNA, 64 nt, Human
aaccuucgaggggcgaguagggagugggggagguggguccaagucucccucaggaaggccuuuu

SEQ ID NO: 351778 - RNA, 64 nt, Human
acucacuugcugcgagacuucaggccgcuucugcggguccaaacucccugagccuaucgucucc

SEQ ID NO: 351779 - RNA, 64 nt, Human
aauaaaaaccuccugaggcauuucuugcccagcuggguccaacacuuguucaguuaauaaguau

SEQ ID NO: 351780 - RNA, 64 nt, Human
cacucugaucucuuagcacauuucuuaggauuaaggguccaaaaaugcugaucuaagggguugc

SEQ ID NO: 351781 - RNA, 64 nt, Human
ccgggguccuguggcaggcagcgccaagcaaccuggguccaaauaaaaacuaaauuguaaacuc

SEQ ID NO: 351782 - RNA, 64 nt, Human
cauguuccuaugucagguggcagcggggaagcgaggguccaauccugcccugcgcuaguccuca

SEQ ID NO: 351783 - RNA, 64 nt, Human
ucagugaccaccaacauucuguguucacauguguggguccaacacuuacuaccugguguaugaa

SEQ ID NO: 351784 - RNA, 62 nt, Human
accagaccuugagcaagugagaagagaggccaggguccaaccaggcacccguccuugggacc

SEQ ID NO: 351785 - RNA, 64 nt, Human
uuugaacccugaaauguuguguagacacccucuuggguccaaugagguaguugguugaaguagc

SEQ ID NO: 351786 - RNA, 64 nt, Human
aguaugugguacuacuguaagagacaugaauggagacuucuaauuuguaucggagggaaacaga

SEQ ID NO: 351787 - RNA, 64 nt, Human
uuucucuuaguuuaaauaaacuccaagguaacuggacuucuaaagcaccuuucuguuugccuga

SEQ ID NO: 351788 - RNA, 64 nt, Human
uugccauaaaugcuucuaagauauauccagcugggacuucuauuacucccuuuggaaaccuuaa

SEQ ID NO: 351789 - RNA, 64 nt, Human
guaaaccccuuaacauuggagccgacuuugucuugacuucuagugagaauuauaaacuguauau

SEQ ID NO: 351790 - RNA, 64 nt, Human
gaaaauaaaugugccuugagagaccacucagagaggguccaagggugauggagaaggaagcaug

SEQ ID NO: 351791 - RNA, 64 nt, Human
ggcauggagagggcagacugugcacauuucacuaggguccaaauacagaagggcccagggccca

SEQ ID NO: 351792 - RNA, 64 nt, Human
ccugcccucagcacuagauuuaauggggccaagaggguccaaaccccuugcuaacauaccacuu

SEQ ID NO: 351793 - RNA, 64 nt, Human
gaccuaaagauguagucuacauagccccagcuugggguccaauccaucugucccuggcaugugc

SEQ ID NO: 351794 - RNA, 64 nt, Human
ccauaccccuuaaccccgggaugcaagguagcauggguccaagagacauggaagagagagccau

SEQ ID NO: 351795 - RNA, 64 nt, Human
ccaucaccgccucaaugugaugagccuaaagcuaggguccaagggcagagccugugcccuucag

SEQ ID NO: 351796 - RNA, 64 nt, Human
cccccgccuuggccuguguucuuccuggccgccuggguccaaugcucaggugcuggggccuggu

SEQ ID NO: 351797 - RNA, 64 nt, Human
uuaaauaacuuaucauuccagcuauguuggacuaggguccaaagcauuuuauaauauuuuuuuu

SEQ ID NO: 351798 - RNA, 64 nt, Human
cuccuacuguguuuggugaucagaaacuauagagggguccaacccaggauuucauguuuguauc

SEQ ID NO: 351799 - RNA, 64 nt, Human
ucauacauucacaugcuucucaccuaaguccccaggguccaagggagaagccccagacccccuu

SEQ ID NO: 351800 - RNA, 64 nt, Human
ggacggucaaggcugaaggcuccucuggguuugaggguccaagggacaaggaggagaagccuag

SEQ ID NO: 351801 - RNA, 64 nt, Human
ccugggugcauugucaccguggguggccacucaaggguccaagccucuagggccauccuugggc

SEQ ID NO: 351802 - RNA, 64 nt, Human
auacucugaauuuggagucugacugugcccaaguggguccaaguggcugugacaucuacguaug

SEQ ID NO: 351803 - RNA, 64 nt, Human
agaugucuaacccuugaggugaagggcucugggaggguccaagaagacguaggcuucauuuuca

SEQ ID NO: 351804 - RNA, 64 nt, Human
uaaugcuuguucuguuaacucaccgggaccuugaggguccaaugggaccuugaggguuuucucu

SEQ ID NO: 351805 - RNA, 64 nt, Human
aauucuacaccuccuuuaagauuuacuuaauugcuacaucuaaauucugauaauuuaaaaucca

SEQ ID NO: 351806 - RNA, 64 nt, Human
auauauuuggcuuggaaauguguuuuucuucaauuacaucuacaaguaaguacagcugaaauuc

SEQ ID NO: 351807 - RNA, 64 nt, Human
ucuggaagugaccacggaccaggguggaggaauagacuucuaguucauucugggacacuugagc

SEQ ID NO: 351808 - RNA, 64 nt, Human
gugaaauaccacaagccugagaacugaauuuugggacuucuacccagauggaaaaauaacaacu

SEQ ID NO: 351809 - RNA, 64 nt, Human
gcaucucucaaaaaauucacaguacuccauuuugggguccaaacuguaaugcucaaaauaauaa

SEQ ID NO: 351810 - RNA, 64 nt, Human
ucaacacuggagaacugagccuugcaucucuccaggguccaaggccacgcuuggugcacaggca

SEQ ID NO: 351811 - RNA, 64 nt, Human
auuccacauuuggugaaauuaauacuuuuuuaaaggguccaaauaaaauaauuuucuaaugugu

SEQ ID NO: 351812 - RNA, 64 nt, Human
uggggcuauuuugcuuaguguggggugaacccagggguccaaacucuguuucucuucagugcuc

SEQ ID NO: 351813 - RNA, 64 nt, Human
cugcccuggggacaggaaggacaggagcuaagcaggguccaagccuggggcugccucugcucuc

SEQ ID NO: 351814 - RNA, 64 nt, Human
agguguucugagaccuugagggacccagaccuuuggguccaagaguuucccaaacagccacgcc

SEQ ID NO: 351815 - RNA, 64 nt, Human
gcugcucccugcccuugcccuuucccuuucccugggguccaaaccacauguguccugccucucc

SEQ ID NO: 351816 - RNA, 64 nt, Human
ccagagggaugagcuagccuguagaggggaacugggguccaaaggucuuuggggagggaggcag

SEQ ID NO: 351817 - RNA, 64 nt, Human
agaaauaguuuacucgcaacaacuuaauuucuaaggguccaagucccagagaauccauagucgu

SEQ ID NO: 351818 - RNA, 64 nt, Human
gauuuugguaacuaggugucucagggcuggguugggguccaaaguguaaggacccccugcccuu

SEQ ID NO: 351819 - RNA, 64 nt, Human
ggaacagggaccaggcugccccacggucccugaaggguccaaggaggggcccuccccauggccc

SEQ ID NO: 351820 - RNA, 64 nt, Human
gcgggcgggugguggaaccagccccuccagccugggguccaacucagacuugaaagacugcaau

SEQ ID NO: 351821 - RNA, 64 nt, Human
caggcaacccuggcagacccagguccaacugcugggguccaagaaccaauuaccaaaggaaaga

SEQ ID NO: 351822 - RNA, 64 nt, Human
aaaauaaauuuuugugugugugugcagaaauuaaggguccaauugagauugggugauguuagua

SEQ ID NO: 351823 - RNA, 64 nt, Human
acugcacaggacucuggguuccugcucuguucugggguccaaaccuuggucucccuuugguccu

SEQ ID NO: 351824 - RNA, 64 nt, Human
ugcuaaaucaaaagaagcguuguccaggugugucuacaucuaguguuacuuuuaaugagaauuu

SEQ ID NO: 351825 - RNA, 64 nt, Human
caauucuaauccacuuuggguuuucagcuguuuuuacaucuaaagcaauagacuagaacugaau

SEQ ID NO: 351826 - RNA, 64 nt, Human
uuuuuuaaauguaucucuugccuaaaggacuauauacaucuaauaaaguaacacugugucaucu

SEQ ID NO: 351827 - RNA, 64 nt, Human
uguuuucaucugagagccaguuuuccuuuauuucuacaucuaaaauaagaacauauuguacacu

SEQ ID NO: 351828 - RNA, 64 nt, Human
uugaaaaggugugggucccuguguccucuuccagggguccaagggaacgggagaggucacuggg

SEQ ID NO: 351829 - RNA, 64 nt, Human
augcagcugauuugucugucuguaacugaaguguggguccaaggacuccuaacuacuuugcauc

SEQ ID NO: 351830 - RNA, 64 nt, Human
gacacaagggaaucucaacaaccagggaucaggaggguccaaagccgacauucccaguccugug

SEQ ID NO: 351831 - RNA, 64 nt, Human
uuuuagacaugguugugggucuggagggagacguggguccaagguccucaucccauccucccuc

SEQ ID NO: 351832 - RNA, 64 nt, Human
ccuggaaacagcaugaauaaaacacucaucccauggguccaaauuaauaugauucugcuccccc

SEQ ID NO: 351833 - RNA, 64 nt, Human
guccagcccuguugcucuccuggcgcugagagguggguccaagcagaguugaucagucccugcc

SEQ ID NO: 351834 - RNA, 64 nt, Human
acagccggccgcccugagggucgggccggagccaggguccaagaggggcgcguuugugucucgg

SEQ ID NO: 351835 - RNA, 64 nt, Human
aauguaccaaugaugaauuuaucagcguauuucaggguccaaacaaaauagagcuaagauacug

SEQ ID NO: 351836 - RNA, 52 nt, Human
aucacaugggacagauguaaaaggguccaaguugccacauugcuucauuaaa

SEQ ID NO: 351837 - RNA, 64 nt, Human
ggccugggggcuggggggagccccaggcugaaaaggguccaauuaaaacaaauggagccaaauu

SEQ ID NO: 351838 - RNA, 64 nt, Human
gggggaaggggacccuccgcucuguagugcuacaggguccaacauagagccggguguccccaac

SEQ ID NO: 351839 - RNA, 64 nt, Human
ccuauagagccaggagacaggauagggguuucuaggguccaacaccagcuuaccuuggaguaug

SEQ ID NO: 351840 - RNA, 64 nt, Human
gccaagagaaucccuggaccggcucuuccuggauggguccaagaauuggacagcucagauggag

SEQ ID NO: 351841 - RNA, 64 nt, Human
uggccgugggcaugagaccgagggugaggcuggaggguccaaagcuggcccagcgagcaccagg

SEQ ID NO: 351842 - RNA, 64 nt, Human
ccaggaauuucugcgccuguccaggcucagcaagggguccaaagacauuguucuuuaaaaaaaa

SEQ ID NO: 351843 - RNA, 64 nt, Human
uaagacugauguguugauuuuacugauuguacuguacaucuauuaaagccuuagauuauuacau

SEQ ID NO: 351844 - RNA, 64 nt, Human
cuagcuugugacugaaaguuuuagaaaaaggaaguacaucuauagccaaauugauaagguuauu

SEQ ID NO: 351845 - RNA, 64 nt, Human
uauguugcgcuguuauauaugaauguuuggacuguacaucuaaagaaugauuccguccuaacac

SEQ ID NO: 351846 - RNA, 64 nt, Human
cucuuguccaccuauuaauuguuuacaauauuuguacaucuaugcaaaauacuugaaugggcca

SEQ ID NO: 351847 - RNA, 64 nt, Human
ccucauccuccccaggaccccuguccaggauggaggguccaauccuaggacagccuuguuccuc

SEQ ID NO: 351848 - RNA, 64 nt, Human
gcacuuguaccucccuggcauacugagaauuccuggguccaaucaaaggcccugacgggcccug

SEQ ID NO: 351849 - RNA, 64 nt, Human
acagaccccuggagguccaggggggcccgaggcaggguccaaaccugagugagggccagccaug

SEQ ID NO: 351850 - RNA, 64 nt, Human
uaaaguguuuuugaguguccuaugggccggggcaggguccaagaucuuuucccuuccccaggcc

SEQ ID NO: 351851 - RNA, 64 nt, Human
gggaaccaaccugggaaguggccagaacugccugggguccaagaacucuugugccuccguccau

SEQ ID NO: 351852 - RNA, 64 nt, Human
ggcucaggaaagcugccaaauucaguccuauguuggguccaagcugccccugugcuguuucugu

SEQ ID NO: 351853 - RNA, 64 nt, Human
cugucaugguguccagacagagcccugugaggcuggguccaauuguggcacuuggggcaccuug

SEQ ID NO: 351854 - RNA, 64 nt, Human
cucuccaguccuuuuccgagaugaggugagacaaggguccaacuuuuccuggauucgccuccca

SEQ ID NO: 351855 - RNA, 64 nt, Human
aaaaugaccuucaggaccggccuguuucccgucuggguccaacuccuuucuuuguggcuuguuu

SEQ ID NO: 351856 - RNA, 64 nt, Human
gggaagcggucuccccaccggcacugggauuggcggguccaagcccagcaaccggcuucgcucc

SEQ ID NO: 351857 - RNA, 64 nt, Human
uccgcugcugcugacguuuaugcauuucaugaugggguccaacaagaacaccugacuuggguga

SEQ ID NO: 351858 - RNA, 64 nt, Human
uucggccucccuauuuucuuagggaaggggagugggguccaagugacagcuggaugggagaagc

SEQ ID NO: 351859 - RNA, 64 nt, Human
aaucccgcccacuaagacgcgaccccucagacagggguccaagaagccccugcuggaggacgac

SEQ ID NO: 351860 - RNA, 64 nt, Human
aaggacucugugaaguuuagaguacaguuuguugggguccaaaagacaccaucucuaccccacc

SEQ ID NO: 351861 - RNA, 64 nt, Human
guauaggaaauuuuauguugugcacauuugcauuggguccaaauccuaauugcaguuuagugaa

SEQ ID NO: 351862 - RNA, 64 nt, Human
agagugauuuguauuggaugguaacuaaggucuauacaucuacucuuuuaauucuuauuuccuu

SEQ ID NO: 351863 - RNA, 64 nt, Human
aaaaaacagacaaaacacacugaaauuuccuaacuacaucuauuucuauaauuuuuaaggacuc

SEQ ID NO: 351864 - RNA, 64 nt, Human
ccuuggggcagggacauguuuuguuuauaauuuauacaucuauuaaguucuggauauuuacagc

SEQ ID NO: 351865 - RNA, 64 nt, Human
uggaaaagauacaagagcuugccggaaauaaagcuacaucuauccacaucucuguccucgugcg

SEQ ID NO: 351866 - RNA, 64 nt, Human
cgcccugggaagagggccgagggcggggcgguggugccgggaccucugagguccuggggauuug

SEQ ID NO: 351867 - RNA, 64 nt, Human
uaauuuagggcacucuugcugggaugcuuucuccagagcuuauauauuucuucuuacuagaacu

SEQ ID NO: 351868 - RNA, 64 nt, Human
uugggucuguuuauauguguauauaugcagagagagagcuuauauauuauuuauauuuauauua

SEQ ID NO: 351869 - RNA, 64 nt, Human
aaauccuuuggguaauucgaauuacagauuuaaaagagcuuaagaucugguguuuuguuaaugc

SEQ ID NO: 351870 - RNA, 64 nt, Human
uggaagauagcuagaugaaaaucuuugcacucacagagcuuacaugccagugagugaagaucga

SEQ ID NO: 351871 - RNA, 64 nt, Human
aggaauuagaauacagcagaauuggccucagugaagagcuuaaaauuguucuccucguagaacu

SEQ ID NO: 351872 - RNA, 64 nt, Human
gucuuggaguauagauuuuuauuaguagcuugaaagagcuuaaucauaugcaguaaguauuuuu

SEQ ID NO: 351873 - RNA, 64 nt, Human
gagcaacccauauaagucacaaagucuguguguuagagcuuaugcauuuguuuuuaugagagau

SEQ ID NO: 351874 - RNA, 64 nt, Human
cuuuuuugcaguccuuuaacuguccacccuaccaagagcuuauaaccaguaucagaacuggaua

SEQ ID NO: 351875 - RNA, 64 nt, Human
gcauaccaguuuccacgggguuggguugccggucagagcuuaagaggacuagcacccugcaaug

SEQ ID NO: 351876 - RNA, 64 nt, Human
uuauaccaguauaaaagcuacuuugcuccuggugagagcuuaaaagaaaugggcuguuuugccc

SEQ ID NO: 351877 - RNA, 64 nt, Human
uuugguuuacccugcaagcuaaauacuccacggcagagcuuaauuauccuuuuaauuccucuuu

SEQ ID NO: 351878 - RNA, 64 nt, Human
aaauuacaaaaaugaauuuuucuucccugaaaucagagcuuacauguguguuuuuuuauaacau

SEQ ID NO: 351879 - RNA, 64 nt, Human
uuggccaucaaaauccagcuccaagugaacuuaaagagcuuauauauuucaugaagcugauccu

SEQ ID NO: 351880 - RNA, 64 nt, Human
ggugaaaugcagagucaaugaacuuuccacauucagagcuuacuuaaaauuguauuuuaguaag

SEQ ID NO: 351881 - RNA, 64 nt, Human
ugaguagggcagagagggccuuuccuggcugaucagagcuuaccagccccaccccaccauggua

SEQ ID NO: 351882 - RNA, 64 nt, Human
uuuauaaggucucaccugugguccacuguguugagacuucuacagaagagcuucuguauaguaa

SEQ ID NO: 351883 - RNA, 64 nt, Human
accaacuggggaacugugacuaucuaucucccccgacuucuaccagggaugccuucacgccaag

SEQ ID NO: 351884 - RNA, 64 nt, Human
acuaggagaugauuuugugugguuggauuuuuuugacuucuacuuuacuggcugagugugagcc

SEQ ID NO: 351885 - RNA, 64 nt, Human
cuuacacacacucuuccuguucugccuucaccuaugccgggauaagcagagaucucaucaauua

SEQ ID NO: 351886 - RNA, 64 nt, Human
aagucagcagcaggaggcccaucccuuacucaguugccgggacauccccagucucgggggaaga

SEQ ID NO: 351887 - RNA, 64 nt, Human
ccgcgagugauccgccagccucggccucccgaggugccgggauugcagacggagucugguucac

SEQ ID NO: 351888 - RNA, 64 nt, Human
gcaagcccgaccgagcacuuggacucgaacucugugccgggaggggcccccaccccuccuuuuu

SEQ ID NO: 351889 - RNA, 64 nt, Human
ugcccaaccccggccugugggcagccgcgccagcugccgggacacugcugccagaccugccccc

SEQ ID NO: 351890 - RNA, 64 nt, Human
gaccucgugauccacccgccucggccucccaaagugccgggauuacaggcgugagccacugcgc

SEQ ID NO: 351891 - RNA, 64 nt, Human
ugcucagcugugaaccccguauccugggccccacugccgggaccgggucugacaugccagugcc

SEQ ID NO: 351892 - RNA, 64 nt, Human
gcugccuuuccagcgaggucagccgagaugacgcugccgggagagcagucuucucuguaguccc

SEQ ID NO: 351893 - RNA, 64 nt, Human
agaccuuucuugaagacccacuagguccagacacugccgggacuugcagguaugggggguagaa

SEQ ID NO: 351894 - RNA, 64 nt, Human
ucucugacuuuguucuucuuauauauuuuuucagugccgggauauucauauuccuaaagccacu

SEQ ID NO: 351895 - RNA, 64 nt, Human
agacuccucucuucugacuguuuacaccuuuccgugccgggagcgcaccucgccgugucuugug

SEQ ID NO: 351896 - RNA, 64 nt, Human
aggugaugcccuucuguaagugcccaccgcgggaugccgggaaggggcauuauuugugcacuga

SEQ ID NO: 351897 - RNA, 64 nt, Human
auggaagauuaugcagaagaaaauagaagagcuuugccgggaaguaaagcuuuggaggaaaauc

SEQ ID NO: 351898 - RNA, 64 nt, Human
cauccagccauuguguuuagagggcagagcgaccugccgggaccuugacaacaccuggccccac

SEQ ID NO: 351899 - RNA, 64 nt, Human
agucuacuaacagccagagguccaucuagcagggugccgggaggagcugagcccccggaggugg

SEQ ID NO: 351900 - RNA, 64 nt, Human
cccccagccccgcucacgccagucccucuuccucugccgggaggguguuuucaacuccaaaccc

SEQ ID NO: 351901 - RNA, 64 nt, Human
guuauuaauguaaauuauagauuaaaauucuacuuacaucuaauuuuugcuguucaaccauguu

SEQ ID NO: 351902 - RNA, 64 nt, Human
uuuauucuuggccuggguugucugcuggcacuaauacaucuauuauuaacguaguguagguacu

SEQ ID NO: 351903 - RNA, 64 nt, Human
auuuauuguacuaugacuaaaugaaauuauuucuuacaucuaauuuguagaaacaguauaaguu

SEQ ID NO: 351904 - RNA, 64 nt, Human
aggaauacagacuauuagagaagauccuuauauuuacaucuaguauauaugugguaaggaaaug

SEQ ID NO: 351905 - RNA, 64 nt, Human
agcuggggcgcgaugucaaaggucgggacagcugugccgggaggcagccacagggaagcucaca

SEQ ID NO: 351906 - RNA, 64 nt, Human
ccucaggugaucaacccaccuuggccucccuaaaugccgggauuacaggcaugagccaccgcuc

SEQ ID NO: 351907 - RNA, 64 nt, Human
auccgacuaaggacucugggcuggcagggccuucugccgggaaagcuagaaacacuagguucuu

SEQ ID NO: 351908 - RNA, 64 nt, Human
ggagagcauuccagagcaguacaucugcuauaucugccgggacccaccagguaaggcuuucugu

SEQ ID NO: 351909 - RNA, 64 nt, Human
gcaugcagucuggaagggggucccagcaguggagugccgggacccucagaguggagagagagac

SEQ ID NO: 351910 - RNA, 64 nt, Human
agcauguaaaagugauccacgcagccggaguguaugccgggagcuaaguggucuaugggugaac

SEQ ID NO: 351911 - RNA, 64 nt, Human
uggagaacaggucacgccuguccuggagacagugugccgggaaaagggaacgugguacucacug

SEQ ID NO: 351912 - RNA, 64 nt, Human
uaaaauuaauaauaauaaaaccuuccaaaaaaagugccgggaccaaauggauucacugaugugc

SEQ ID NO: 351913 - RNA, 64 nt, Human
cuucagaaaguucuuccuccgagucagucaguggugccgggaccccagggcagccuccucgacu

SEQ ID NO: 351914 - RNA, 62 nt, Human
ugcugcuguucagaaacugaccuguucaccucugccgggaaguuccuguguugugcugauga

SEQ ID NO: 351915 - RNA, 64 nt, Human
cagggucucagaugguuaggacaaaguggauggaugccgggaaguuuaaccugagccuuaggau

SEQ ID NO: 351916 - RNA, 64 nt, Human
gggagguggagagaccccuucagagcagggauugugccgggagagugccucugacuuugggaca

SEQ ID NO: 351917 - RNA, 64 nt, Human
gggcccccagggcuggucugagugcaggugggggugccgggauggguugggccugggcccggcc

SEQ ID NO: 351918 - RNA, 64 nt, Human
gcauaggccugccuuccggagacccuguccacauugccgggaccacccugguggggccacuggu

SEQ ID NO: 351919 - RNA, 64 nt, Human
uucuuuuuugucaguauuguuugggaaggagacaugccgggaugugucaucgugccaaauacca

SEQ ID NO: 351920 - RNA, 64 nt, Human
aguauuaggugaggauggaugcgggcgcuguccuugccgggaagucacuguugaaguugcagug

SEQ ID NO: 351921 - RNA, 64 nt, Human
gaagcacuuucauacgcaggcaucucuuguuaccuacaucuaagcuguucccgaaagaguguua

SEQ ID NO: 351922 - RNA, 64 nt, Human
caggaccuggaguugcuggcuaccuuaccgcagguacaucuacaucagucaugucuaaccugcc

SEQ ID NO: 351923 - RNA, 64 nt, Human
uuaaaaacaugaagagauaaaauuauaaaaaugauacaucuaaagcaguggugaagaaagcuga

SEQ ID NO: 351924 - RNA, 64 nt, Human
guuuuuaguguaucccuaugaaaaucauuuuugguacaucuaaguuuucacuuauaaacuguua

SEQ ID NO: 351925 - RNA, 64 nt, Human
uacaccaucuggugaggaaccaaggccaccucugugccgggaaagacaucacauaccuucagca

SEQ ID NO: 351926 - RNA, 64 nt, Human
caaaacuaaccagauacagaaacagaagagaggcugccgggaccagcauauuuccguugcagcc

SEQ ID NO: 351927 - RNA, 64 nt, Human
agccgcgcuuuccccuccucccugggauggacgcugccgggagacugccaguggagacggaauc

SEQ ID NO: 351928 - RNA, 64 nt, Human
agacccguagaugccagggcuggaagcuuucauuugccgggacacucgggcccaugggauugca

SEQ ID NO: 351929 - RNA, 64 nt, Human
gaagaugcuuccacuuaaagcaugagaaauggggugccgggaugugggguguggugugugcccu

SEQ ID NO: 351930 - RNA, 64 nt, Human
gaacgucaaaaccuauacccacuaaagggaaggcugccgggaaggcaaauggaacaggaaugga

SEQ ID NO: 351931 - RNA, 64 nt, Human
auucuuaaugaauucacuggcaugaguaauuuuaugccgggaaaaucugauuuguggucuauuu

SEQ ID NO: 351932 - RNA, 64 nt, Human
uucuuccccacagcaggcugcucagagggggugcugccgggacugccaugcccaccugagaggg

SEQ ID NO: 351933 - RNA, 64 nt, Human
aaccaaugcaacauacucucagcaccuaaaauagugccgggaacauaguaagggcucaguaaau

SEQ ID NO: 351934 - RNA, 64 nt, Human
gcccagggcgacagaggggcacugguuuacacuuugccgggaccaucagggccgccaagcaggu

SEQ ID NO: 351935 - RNA, 64 nt, Human
gcagcuccccuugcggccccugcucucccgagacugccgggaccuacugcagcggcuccuggag

SEQ ID NO: 351936 - RNA, 64 nt, Human
guguccugguguucccagccccaccagagccccgugccgggagcugacagcuuucacgcuuaag

SEQ ID NO: 351937 - RNA, 64 nt, Human
cuggcccaggagacugacccaaagugaaggacauugccgggagaggccugcagcaucccuggau

SEQ ID NO: 351938 - RNA, 64 nt, Human
cgaggcgggccagagcugagcgugaggacgugcuugccgggacagcaggcaguggccaccuggu

SEQ ID NO: 351939 - RNA, 64 nt, Human
aucccacccccuaccccaccuaacacauuugcacugccgggaauggacacuggaagugccagga

SEQ ID NO: 351940 - RNA, 64 nt, Human
ggaggcccccuccauccaggcggugcuccuggggugccgggaccgggcagugucacacccugcc

SEQ ID NO: 351941 - RNA, 64 nt, Human
cuguacuuggggccugcaauggcuguguguacacuacaucuaaugcccaaaugccagccagugu

SEQ ID NO: 351942 - RNA, 64 nt, Human
auucucagcaagucucagcuccaggauacauuaauacaucuaauaaagguauguaggauaccaa

SEQ ID NO: 351943 - RNA, 64 nt, Human
guaacaaacaaaacuucaagugucuagcacauacuacaucuaagaggcuaaacucugauaggaa

SEQ ID NO: 351944 - RNA, 64 nt, Human
uugggggguacuuuuaaaggugacuauuguuuuguacaucuaauuuugggaaagcaagucuaua

SEQ ID NO: 351945 - RNA, 64 nt, Human
agcagccgcagcgcagccgccgggcaggccugcgugccgggagaggacucugccuuuuuucaca

SEQ ID NO: 351946 - RNA, 64 nt, Human
cgccgccacgccugacugccucggccucccgaggugccgggauugcagacggagucucguucac

SEQ ID NO: 351947 - RNA, 64 nt, Human
aggauggagcagguagcucaucuggccuuguaggugccgggaacgggcaagacauguuuugaaa

SEQ ID NO: 351948 - RNA, 64 nt, Human
auggagagcugcuggguuggcgaacacauccaugugccgggaggauggugcaccccaacuccac

SEQ ID NO: 351949 - RNA, 64 nt, Human
ccucaaaugagccuccugcuucagucucccaaauugccgggauuacaggcaugagccacugugu

SEQ ID NO: 351950 - RNA, 64 nt, Human
cacugcaccagugugacaucuacaacuccaagauugccgggaagcuccuggggugagugcccuc

SEQ ID NO: 351951 - RNA, 64 nt, Human
uuugacuaauccugcuucccucucugggccuggcugccgggaucuggggucccuaagucccucu

SEQ ID NO: 351952 - RNA, 64 nt, Human
ggcagugugcucugugggggcugcaaucaauaaaugccgggagcugccacaucuguuccugccu

SEQ ID NO: 351953 - RNA, 64 nt, Human
cgcauggaaccuugagaacccagggacgagccagugccgggaaggaacugccgggacucaccga

SEQ ID NO: 351954 - RNA, 64 nt, Human
agaacccagggacgagccagugccgggaaggaacugccgggacucaccgagcugcacuuaacug

SEQ ID NO: 351955 - RNA, 57 nt, Human
ccacgccaaguaccaagugaccagggaugccgggaacacugucgaagaacggaaggc

SEQ ID NO: 351956 - RNA, 64 nt, Human
gcuucacccaugcuaggcaagcccagggcacagaugccgggauggccccucccucucagugcgg

SEQ ID NO: 351957 - RNA, 64 nt, Human
cggggagggaggaggagcucugguuucagagcagugccgggauugccuuuccccaggaucugug

SEQ ID NO: 351958 - RNA, 64 nt, Human
uguggacuccucccaguucagcgaguaugugcuuugccgggaggagcggcggccgcagcccacc

SEQ ID NO: 351959 - RNA, 64 nt, Human
ugagucagaaaaaccagaacgggguccccggaucugccgggaaggcuucugaggggcugcccug

SEQ ID NO: 351960 - RNA, 64 nt, Human
cgcaagucuccuggaaaggcuggagugaccggcaugccgggauugggagauuaggauuugauuu

SEQ ID NO: 351961 - RNA, 64 nt, Human
agcgguguacuguacuucagagaaagcauaaaaguacaucuagcucagucccuaugagguagcu

SEQ ID NO: 351962 - RNA, 53 nt, Human
auaaacacgaugaguuauagagauacaucuacccuuuuaauauagcacucauc

SEQ ID NO: 351963 - RNA, 64 nt, Human
auuuuuguaaucaagauuuuaggaaaaacagaaguacaucuaucuuuaugaaauuuugggcagg

SEQ ID NO: 351964 - RNA, 64 nt, Human
caacaauuauagacaauuugcccuaucauuuauuuacaucuauguaucuaccaucuaaucuaug

SEQ ID NO: 351965 - RNA, 64 nt, Human
uacagaccucaagauuccacucugugcccgccucugccgggagggagggaggcacacaggugga

SEQ ID NO: 351966 - RNA, 64 nt, Human
gccccuucauuucccaggucuggaucgauucacuugccgggagagacuuuuuacaacucaucug

SEQ ID NO: 351967 - RNA, 64 nt, Human
cgagugcacacaccgaccgccacaugugcuuuucugccgggaaucccuggggugaacgcauguu

SEQ ID NO: 351968 - RNA, 64 nt, Human
ugguucaccugagaggccggcauggugccugggcugccgggaaccucaucugccuggggccuca

SEQ ID NO: 351969 - RNA, 64 nt, Human
ugguucaccugagaggccggcauggggccugggcugccgggaccucacuuucccagggccucac

SEQ ID NO: 351970 - RNA, 60 nt, Human
uugcaaaacccaaggugugagcccugugccugccgggaccuccagccugcagaaugcguc

SEQ ID NO: 351971 - RNA, 64 nt, Human
gugcaggcuucauggaggacagaagcgacuuuugugccgggacuuaaaaagauaaggaggccag

SEQ ID NO: 351972 - RNA, 64 nt, Human
gaggcccgaucuccacuguugggugggugggcccugccgggacccugcucacaggcaggcuuuu

SEQ ID NO: 351973 - RNA, 57 nt, Human
ccagggacgaguguaaguaggcgcccaugccgggagccgcgccgguggccagcggug

SEQ ID NO: 351974 - RNA, 64 nt, Human
cccagucauccugcccagcccugccuccuggccaugccgggaggggucggauccucuaggcauc

SEQ ID NO: 351975 - RNA, 64 nt, Human
cucgaggccucuucuccccagcaccgcuguggugugccgggauccugagccuaggccucccgau

SEQ ID NO: 351976 - RNA, 64 nt, Human
gggggauggggugggguacaaccaccaugacaacugccgggagggccacgcaggucguggucac

SEQ ID NO: 351977 - RNA, 64 nt, Human
ccccccacccccuuuuuuaaacaaguguuacuugugccgggaaaauuuugcugucuuuguaauu

SEQ ID NO: 351978 - RNA, 64 nt, Human
gaccucgugaucugcccgccuugaccucccaaagugccgggauuacaggcaugagccuccacac

SEQ ID NO: 351979 - RNA, 64 nt, Human
ccugggagccccacugcccugccauccccaguacugccgggaagugucggccguccuugucauu

SEQ ID NO: 351980 - RNA, 64 nt, Human
cccuaacuuauuuuggcgucacagcugagcaccgugccgggagguggccaagguacagcccgca

SEQ ID NO: 351981 - RNA, 64 nt, Human
aaauauauagcaauaaauugcuguuuauuuuuucuacaucuauuuuguguacuuguacacagug

SEQ ID NO: 351982 - RNA, 64 nt, Human
guuagcgucucgucccaccuggaauuguaauaaauacaucuaaauaaaacaugccuugggagug

SEQ ID NO: 351983 - RNA, 64 nt, Human
ggaucuuugaagucuauuuaaauauucauuccauuacaucuagacucaccaagaacuacauguu

SEQ ID NO: 351984 - RNA, 64 nt, Human
caacucagcaggacacagaacuaaaacuacuacuuacaucuaacagacacacuacaaguugaau

SEQ ID NO: 351985 - RNA, 64 nt, Human
uauuuaucguuuguaauuuaauuauugcuacaagugccgggaacugaacaauauuuauggauaa

SEQ ID NO: 351986 - RNA, 64 nt, Human; identical to SEQ ID NO: 350567

SEQ ID NO: 351987 - RNA, 64 nt, Human; identical to SEQ ID NO: 350568

SEQ ID NO: 351988 - RNA, 64 nt, Human; identical to SEQ ID NO: 350569

SEQ ID NO: 351989 - RNA, 64 nt, Human; identical to SEQ ID NO: 350570

SEQ ID NO: 351990 - RNA, 64 nt, Human; identical to SEQ ID NO: 350571

SEQ ID NO: 351991 - RNA, 64 nt, Human; identical to SEQ ID NO: 350572

SEQ ID NO: 351992 - RNA, 64 nt, Human; identical to SEQ ID NO: 350573

SEQ ID NO: 351993 - RNA, 64 nt, Human; identical to SEQ ID NO: 350574

SEQ ID NO: 351994 - RNA, 64 nt, Human; identical to SEQ ID NO: 350575

SEQ ID NO: 351995 - RNA, 64 nt, Human
auaaaguacaguaauuuuacuuuuuuucuuguguuacaucuaaauuacaacccuuaauugccac

SEQ ID NO: 351996 - RNA, 64 nt, Human
uucacugcucacguguuugcugucaagccauuuuuacaucuaaacuaagaugugcagcauuuca

SEQ ID NO: 351997 - RNA, 64 nt, Human
gauauaugaguuggcugauugagacugcaacaacuacaucuauauuuaugggcaauauuuuguu

SEQ ID NO: 351998 - RNA, 64 nt, Human; identical to SEQ ID NO: 350576

SEQ ID NO: 351999 - RNA, 55 nt, Human; identical to SEQ ID NO: 351730

SEQ ID NO: 352000 - RNA, 64 nt, Human; identical to SEQ ID NO: 351866

SEQ ID NO: 352001 - RNA, 64 nt, Human; identical to SEQ ID NO: 351885

SEQ ID NO: 352002 - RNA, 64 nt, Human; identical to SEQ ID NO: 351886

SEQ ID NO: 352003 - RNA, 64 nt, Human; identical to SEQ ID NO: 351887

SEQ ID NO: 352004 - RNA, 64 nt, Human; identical to SEQ ID NO: 351888

SEQ ID NO: 352005 - RNA, 64 nt, Human; identical to SEQ ID NO: 351889

SEQ ID NO: 352006 - RNA, 64 nt, Human; identical to SEQ ID NO: 351890

SEQ ID NO: 352007 - RNA, 64 nt, Human; identical to SEQ ID NO: 351891

SEQ ID NO: 352008 - RNA, 64 nt, Human; identical to SEQ ID NO: 351892

SEQ ID NO: 352009 - RNA, 64 nt, Human; identical to SEQ ID NO: 351893

SEQ ID NO: 352010 - RNA, 64 nt, Human; identical to SEQ ID NO: 351894

SEQ ID NO: 352011 - RNA, 64 nt, Human; identical to SEQ ID NO: 351895

SEQ ID NO: 352012 - RNA, 64 nt, Human; identical to SEQ ID NO: 351896

SEQ ID NO: 352013 - RNA, 64 nt, Human; identical to SEQ ID NO: 351897

SEQ ID NO: 352014 - RNA, 64 nt, Human
ggaggcucagcuucuucaccaucaacaggaggauuacaucuaaugcaggcaaucaucuauuaca

SEQ ID NO: 352015 - RNA, 64 nt, Human
auuuaguaaaagagaaaguuucaggaaauaaaacuacaucuagaaguauaagcauaaaacuguu

SEQ ID NO: 352016 - RNA, 64 nt, Human
uuaaugaaagauuuugugauagagcugaugcuuauacaucuauucuauaacagugaugaauauu

SEQ ID NO: 352017 - RNA, 64 nt, Human
guauaccuauuucauuaguagcuaggugcacauauacaucuagcacagcugugaggacagacag

SEQ ID NO: 352018 - RNA, 64 nt, Human; identical to SEQ ID NO: 351898

SEQ ID NO: 352019 - RNA, 64 nt, Human; identical to SEQ ID NO: 351899

SEQ ID NO: 352020 - RNA, 64 nt, Human; identical to SEQ ID NO: 351900

SEQ ID NO: 352021 - RNA, 64 nt, Human; identical to SEQ ID NO: 351905

SEQ ID NO: 352022 - RNA, 64 nt, Human; identical to SEQ ID NO: 351906

SEQ ID NO: 352023 - RNA, 64 nt, Human; identical to SEQ ID NO: 351907

SEQ ID NO: 352024 - RNA, 64 nt, Human; identical to SEQ ID NO: 351908

SEQ ID NO: 352025 - RNA, 64 nt, Human; identical to SEQ ID NO: 351909

SEQ ID NO: 352026 - RNA, 64 nt, Human; identical to SEQ ID NO: 351910

SEQ ID NO: 352027 - RNA, 64 nt, Human; identical to SEQ ID NO: 351911

SEQ ID NO: 352028 - RNA, 64 nt, Human; identical to SEQ ID NO: 351912

SEQ ID NO: 352029 - RNA, 64 nt, Human; identical to SEQ ID NO: 351913

SEQ ID NO: 352030 - RNA, 62 nt, Human; identical to SEQ ID NO: 351914

SEQ ID NO: 352031 - RNA, 64 nt, Human; identical to SEQ ID NO: 351915

SEQ ID NO: 352032 - RNA, 64 nt, Human; identical to SEQ ID NO: 351916

SEQ ID NO: 352033 - RNA, 64 nt, Human; identical to SEQ ID NO: 351917

SEQ ID NO: 352034 - RNA, 64 nt, Human
uuguauaaauaauaaagaacuccuuauuuuguauuacaucuaaugcuucaaguguugcucuugg

SEQ ID NO: 352035 - RNA, 64 nt, Human
agaaaauauuuaaguuggauguacuuguuuuagguacaucuacuauacuuauucucucaaaccu

SEQ ID NO: 352036 - RNA, 64 nt, Human
augaccucagcuugaguuucuccauaugugcauguacaucuagcauucugccuacaguucagac

SEQ ID NO: 352037 - RNA, 64 nt, Human
cucugauguugcaacauacguguaaaauggguguuacaucuauccugccauuuaaccccacagu

SEQ ID NO: 352038 - RNA, 64 nt, Human; identical to SEQ ID NO: 351918

SEQ ID NO: 352039 - RNA, 64 nt, Human; identical to SEQ ID NO: 351919

SEQ ID NO: 352040 - RNA, 64 nt, Human; identical to SEQ ID NO: 351920

SEQ ID NO: 352041 - RNA, 64 nt, Human; identical to SEQ ID NO: 351925

SEQ ID NO: 352042 - RNA, 64 nt, Human; identical to SEQ ID NO: 351926

SEQ ID NO: 352043 - RNA, 64 nt, Human; identical to SEQ ID NO: 351927

SEQ ID NO: 352044 - RNA, 64 nt, Human; identical to SEQ ID NO: 351928

SEQ ID NO: 352045 - RNA, 64 nt, Human; identical to SEQ ID NO: 351929

SEQ ID NO: 352046 - RNA, 64 nt, Human; identical to SEQ ID NO: 351930

SEQ ID NO: 352047 - RNA, 64 nt, Human; identical to SEQ ID NO: 351931

SEQ ID NO: 352048 - RNA, 64 nt, Human; identical to SEQ ID NO: 351932

SEQ ID NO: 352049 - RNA, 64 nt, Human; identical to SEQ ID NO: 351933

SEQ ID NO: 352050 - RNA, 64 nt, Human; identical to SEQ ID NO: 351934

SEQ ID NO: 352051 - RNA, 64 nt, Human; identical to SEQ ID NO: 351935

SEQ ID NO: 352052 - RNA, 64 nt, Human; identical to SEQ ID NO: 351936

SEQ ID NO: 352053 - RNA, 64 nt, Human; identical to SEQ ID NO: 351937

SEQ ID NO: 352054 - RNA, 64 nt, Human
gacugaauaguuuaguccagauuuuuacagaggauacaucuauuuuuaucauuauuugggguuu

SEQ ID NO: 352055 - RNA, 64 nt, Human
aguaaccaggcaugaucaauuuauaguggucguuuacaucuaauaauuaucaggacuuuuuuca

SEQ ID NO: 352056 - RNA, 64 nt, Human
aucuagcaagaagauucuaaaacauucuuuaacauacaucuaagucaguuucacauauuuguag

SEQ ID NO: 352057 - RNA, 64 nt, Human
gcaagcuccaauaugcaagagcuuaucgauccuguacaucuaucauauuuacuaauguuccauu

SEQ ID NO: 352058 - RNA, 64 nt, Human; identical to SEQ ID NO: 351938

SEQ ID NO: 352059 - RNA, 64 nt, Human; identical to SEQ ID NO: 351939

SEQ ID NO: 352060 - RNA, 64 nt, Human; identical to SEQ ID NO: 351940

SEQ ID NO: 352061 - RNA, 64 nt, Human; identical to SEQ ID NO: 351945

SEQ ID NO: 352062 - RNA, 64 nt, Human; identical to SEQ ID NO: 351946

SEQ ID NO: 352063 - RNA, 64 nt, Human; identical to SEQ ID NO: 351947

SEQ ID NO: 352064 - RNA, 64 nt, Human; identical to SEQ ID NO: 351948

SEQ ID NO: 352065 - RNA, 64 nt, Human; identical to SEQ ID NO: 351949

SEQ ID NO: 352066 - RNA, 64 nt, Human; identical to SEQ ID NO: 351950

SEQ ID NO: 352067 - RNA, 64 nt, Human; identical to SEQ ID NO: 351951

SEQ ID NO: 352068 - RNA, 64 nt, Human; identical to SEQ ID NO: 351952

SEQ ID NO: 352069 - RNA, 64 nt, Human; identical to SEQ ID NO: 351953

SEQ ID NO: 352070 - RNA, 64 nt, Human; identical to SEQ ID NO: 351954

SEQ ID NO: 352071 - RNA, 57 nt, Human; identical to SEQ ID NO: 351955

SEQ ID NO: 352072 - RNA, 64 nt, Human; identical to SEQ ID NO: 351956

SEQ ID NO: 352073 - RNA, 64 nt, Human; identical to SEQ ID NO: 351957

SEQ ID NO: 352074 - RNA, 64 nt, Human
auaugaacuuuuuauccaaugacucaacucuaauuacaucuaaguuagacuugcucacguucag

SEQ ID NO: 352075 - RNA, 64 nt, Human
gcagaaagugcccauuguucaggauucuaauagcuacaucuacuuaauaucuucauuucuaaau

SEQ ID NO: 352076 - RNA, 64 nt, Human
guaaauuuauuuaccaacaucuauugucaacauguacaucuaccuuaguauggucugcauucuu

SEQ ID NO: 352077 - RNA, 60 nt, Human
acucuuuaucaccuaaguaacuauguauuguacaucuaaagaguaauagcuuuuccugau

SEQ ID NO: 352078 - RNA, 64 nt, Human; identical to SEQ ID NO: 351958

SEQ ID NO: 352079 - RNA, 64 nt, Human; identical to SEQ ID NO: 351959

SEQ ID NO: 352080 - RNA, 64 nt, Human; identical to SEQ ID NO: 351960

SEQ ID NO: 352081 - RNA, 64 nt, Human; identical to SEQ ID NO: 351965

SEQ ID NO: 352082 - RNA, 64 nt, Human; identical to SEQ ID NO: 351966

SEQ ID NO: 352083 - RNA, 64 nt, Human; identical to SEQ ID NO: 351967

SEQ ID NO: 352084 - RNA, 64 nt, Human; identical to SEQ ID NO: 351968

SEQ ID NO: 352085 - RNA, 64 nt, Human; identical to SEQ ID NO: 351969

SEQ ID NO: 352086 - RNA, 60 nt, Human; identical to SEQ ID NO: 351970

SEQ ID NO: 352087 - RNA, 64 nt, Human; identical to SEQ ID NO: 351971

SEQ ID NO: 352088 - RNA, 64 nt, Human; identical to SEQ ID NO: 351972

SEQ ID NO: 352089 - RNA, 57 nt, Human; identical to SEQ ID NO: 351973

SEQ ID NO: 352090 - RNA, 64 nt, Human; identical to SEQ ID NO: 351974

SEQ ID NO: 352091 - RNA, 64 nt, Human; identical to SEQ ID NO: 351975

SEQ ID NO: 352092 - RNA, 64 nt, Human; identical to SEQ ID NO: 351976

SEQ ID NO: 352093 - RNA, 64 nt, Human; identical to SEQ ID NO: 351977

SEQ ID NO: 352094 - RNA, 64 nt, Human
cuucauggcagcagaucagagcugugacauuuucuacaucuagacaugcuaccagacaugggga

SEQ ID NO: 352095 - RNA, 64 nt, Human
uuaaaaauacggacguacuuugugcugggaacucuacaucuagcaauuucucuuuaaaaccaua

SEQ ID NO: 352096 - RNA, 64 nt, Human
cagcuaacgauuacucauugauccaaaacuuaaauacaucuauaauuuccuggggcuauuguga

SEQ ID NO: 352097 - RNA, 64 nt, Human
ccaagaaccauaguuacugaaaagggaguccugauacaucuaauauugguagcauguaacagug

SEQ ID NO: 352098 - RNA, 64 nt, Human; identical to SEQ ID NO: 351978

SEQ ID NO: 352099 - RNA, 64 nt, Human; identical to SEQ ID NO: 351979

SEQ ID NO: 352100 - RNA, 64 nt, Human; identical to SEQ ID NO: 351980

SEQ ID NO: 352101 - RNA, 64 nt, Human; identical to SEQ ID NO: 351985

SEQ ID NO: 352102 - RNA, 64 nt, Human
gagugcggaugggccccggacccgguguccugucuacaucuacagcuguucacuggaagcgcug

SEQ ID NO: 352103 - RNA, 64 nt, Human
aagaaccauauuuacauugcuuaacacagaauuuuacaucuaagcaaggacuggcuuuagaagc

SEQ ID NO: 352104 - RNA, 64 nt, Human
uguuuucuuuuaaauuaaaaaugaugcuauuaaauacaucuauuucuaucuucugcacuuuuca

SEQ ID NO: 352105 - RNA, 64 nt, Human
uguuguaauuaaucauauuacacuaaaauugggauacaucuaaggaacuuuaucuuacuaucag

SEQ ID NO: 352106 - RNA, 64 nt, Human
gaccagagcuagagacaccaucugcaaugaucucuacaucuaugauacucgugagagccagacu

SEQ ID NO: 352107 - RNA, 64 nt, Human
uggcugcgucuggcuaauucuaagcacuaaagucuacaucuaagcuauagauuuaagcuugaag

SEQ ID NO: 352108 - RNA, 64 nt, Human
ugaagucuccccucuuuauacacacguaugaaaauacaucuaucccucauuuugagagccucca

SEQ ID NO: 352109 - RNA, 64 nt, Human
uuaaguaauuauuauucaaauaagauuauacucauacaucuauaugucacuguuuuaaagagau

SEQ ID NO: 352110 - RNA, 64 nt, Human
uuuuaaauuguuguaaaaauuauuauaggccagcuacaucuaguaguagguuugggguacagau

SEQ ID NO: 352111 - RNA, 64 nt, Human
ugaaaaagacugggugaccuggaucucugcuuaauacaucuacaaccauugucucacuggagac

SEQ ID NO: 352112 - RNA, 64 nt, Human
uaggaacaguauagacaacccagaaacaaauucauacaucuauggugaccacuuuugacaaagg

SEQ ID NO: 352113 - RNA, 64 nt, Human
uggagcucaagaauagcuuuuaaaaguucuuauuuacaucuagugauuucccuguauuggguuu

SEQ ID NO: 352114 - RNA, 64 nt, Human
cuugguguuaaaacaggauuagagcauguaaagguacaucuagauucauauuugaaucuuaaac

SEQ ID NO: 352115 - RNA, 64 nt, Human
auuacagguucaaguggguuaaggagaccuccuguacaucuacaguguuuccuuuuaaauuguc

SEQ ID NO: 352116 - RNA, 64 nt, Human
acucaauuugauaaagaacuacuacaaaaaacccuacaucuagcaucauccuugauguuuccaa

SEQ ID NO: 352117 - RNA, 64 nt, Human
caaucucuuccacacaugugcaguugucaguugguacaucuaaacucccuccauccugacucac

SEQ ID NO: 352118 - RNA, 64 nt, Human
uaaaacuguguacuuuaaaaaaaaauucaaccuuuacaucuagaauaauuugcaucucauuuug

SEQ ID NO: 352119 - RNA, 64 nt, Human
aggggacccguauuuuaaaaucuccagacuugcuuacaucuagauuauccagcacaaucauaaa

SEQ ID NO: 352120 - RNA, 64 nt, Human
cugaauguaguauuaucuauagauuauacauaacuacaucuauugcuuuuggugguaaaucaag

SEQ ID NO: 352121 - RNA, 64 nt, Human
gugcauacuaagaaagcaauuccaaauagauguauacaucuagagagagugguauuagagauuc

SEQ ID NO: 352122 - RNA, 64 nt, Human
cuauuuuuuuauaucccgauuugcacuuugagaauacaucuaaggucaucuuucaaaagagaaa

SEQ ID NO: 352123 - RNA, 64 nt, Human
ugagguagaugaagaagcagcauaguggucuccuuacaucuaggccuaacugucccucuuccug

SEQ ID NO: 352124 - RNA, 64 nt, Human
aacucagaugcauaaaacguaagguauauaaaaauacaucuaugcuugcguuugaaacuacaac

SEQ ID NO: 352125 - RNA, 64 nt, Human
cuuuucuaugggucuuguuuauuuuauaaaauuuuacaucuaaauuuuugcuaaggauguauuu

SEQ ID NO: 352126 - RNA, 64 nt, Human
gggucccuacgaugcgcccgguggugaugacuccuacaucuaaguggccccuccacccucuccc

SEQ ID NO: 352127 - RNA, 64 nt, Human
uuuucucuggcuggaauaguaaacuaaaguaugguacaucuaccuaaaggacuauuauguggaa

SEQ ID NO: 352128 - RNA, 64 nt, Human
gaugguuuucaugacuuugaaugauauauuuuuguacaucuagcuguaucgaggcaucaggccu

SEQ ID NO: 352129 - RNA, 64 nt, Human
gcacaugauugauaccguucauacaaaauggucuuacaucuauguaaaauuuucugauucaucu

SEQ ID NO: 352130 - RNA, 64 nt, Human
aucuggaaaacaauguaacuauuuuuaaagugguuacaucuauucuugcugaagaacaauaaac

SEQ ID NO: 352131 - RNA, 64 nt, Human
ucauucucucuucuccaucacccauacccacacauacaucuaguauguuuaggguucuguguuc

SEQ ID NO: 352132 - RNA, 64 nt, Human
uuagguccuuuaaaaaaacauauuaaucauugacuacaucuaugauaaaagugcuuauuuuggu

SEQ ID NO: 352133 - RNA, 64 nt, Human
auuaagacaauguuuuuaauuuaauuugccucauuacaucuaauaguucccauuugauggcaug

SEQ ID NO: 352134 - RNA, 64 nt, Human
gaguaaaauacacuucccgaccuuaaggaucugauacaucuaguuauuggucuggaaauuggag

SEQ ID NO: 352135 - RNA, 64 nt, Human
ugcugauaaaaagccugaaggaaauaagugaaacuacaucuaugggaaaaaaaaaaacauugag

SEQ ID NO: 352136 - RNA, 64 nt, Human
uuuuucuguaaacuuaaguuuccguugacuucuguacaucuacaaugaauaccuccucauagaa

SEQ ID NO: 352137 - RNA, 64 nt, Human
guuccaauuuaauuccaaaaauacucuguaauucuacaucuaaaaaaaccgauucccuaauucg

SEQ ID NO: 352138 - RNA, 64 nt, Human
augguacaagucuaacacaaauuguacguaaugauacaucuacuagaaacauacauuauucauc

SEQ ID NO: 352139 - RNA, 64 nt, Human
uucuuauuuauuauuagacauuacuacuaaaagguacaucuaacuauucagggacauuuuucca

SEQ ID NO: 352140 - RNA, 64 nt, Human
cuuuuccacgcacuguggucaucacugugcaaucuacaucuaguaugaaauccacacauaggag

SEQ ID NO: 352141 - RNA, 64 nt, Human
uuggaugcaggcucuuaacucagcagggauaucguacaucuauugcucuaccucagggguccag

SEQ ID NO: 352142 - RNA, 64 nt, Human
ggcucauuaccuaaagcagucuauuuauauuuucuacaucuaauuuuagaagccuggcuacaau

SEQ ID NO: 352143 - RNA, 64 nt, Human
gguguacuguuauacuucagagaaaggguaagaguacaucuaguucaguuccuaugagguagcu

SEQ ID NO: 352144 - RNA, 64 nt, Human
uucagguucugcuccuguaguacagaaggugcaguacaucuaugggcugugauuccccuugccc

SEQ ID NO: 352145 - RNA, 64 nt, Human
cccccaggcaucuugaucccagccugacugcugcuacaucuaauccccuaccaaugccuccugu

SEQ ID NO: 352146 - RNA, 64 nt, Human
uuuaguaacuaugcacauaucagcucuauuuuccuacaucuacuuuauaucucauauugcugua

SEQ ID NO: 352147 - RNA, 64 nt, Human
cagucuugccugagucuuucuccagcauuuccaguacaucuaucagaaucaucaagucuuggcc

SEQ ID NO: 352148 - RNA, 64 nt, Human
uccaguuucagcaucugguugcuuuuaagccaaguacaucuaguuucccuauuaaaaauguguc

SEQ ID NO: 352149 - RNA, 64 nt, Human
cugaccuucccgggacacauucuucuggaggcuuuacaucuacuggaguugaaugauugcuguu

SEQ ID NO: 352150 - RNA, 64 nt, Human
gcucugguuugcucaaauaacugcaguuuaugcuuacaucuaaauuuuguuucuguuaccuaaa

SEQ ID NO: 352151 - RNA, 64 nt, Human
acugcugcaggugugauuuuggucugucacacuguacaucuaucauaaugugcccuguaucuau

SEQ ID NO: 352152 - RNA, 64 nt, Human
cagaagacaaauuaacugaaggcuuuucuuuuauuacaucuaaagagcucuacauaaacaggua

SEQ ID NO: 352153 - RNA, 64 nt, Human
ggaaucuaaacuguauagcacuuugugaagugauuacaucuaaggaccuccagaagcaugggaa

SEQ ID NO: 352154 - RNA, 64 nt, Human
auacuuggauuaaaauauuucauccagauuuguuuacaucuagagagaaccccuuguagguuau

SEQ ID NO: 352155 - RNA, 64 nt, Human
uaucauugacuuaaaaugaagaauuaacuuguguuacaucuauaaagagcaaaauaacacacuc

SEQ ID NO: 352156 - RNA, 64 nt, Human
aaaacacuuaaaaauauuuuuagcuuguuuuaccuacaucuaguuucauuucaucuugcuuugc

SEQ ID NO: 352157 - RNA, 64 nt, Human
cugacucugcuucugucaagaggguugucauuaauacaucuaggguacccucccaugucaugaa

SEQ ID NO: 352158 - RNA, 64 nt, Human
ucagccugguggaaccuguguauaugaaaagcccuacaucuaugcagguuucccaucccugaau

SEQ ID NO: 352159 - RNA, 64 nt, Human
guggaagcggcuccccauuuuauaccaaaggugcuacaucuaugugaugggugggguggggagg

SEQ ID NO: 352160 - RNA, 64 nt, Human
uuugaaacuguaguaucauaaaauugaaauaaaauacaucuacuaggcuguuagccaaagcauc

SEQ ID NO: 352161 - RNA, 64 nt, Human
aucaugguaucauucaugcguguuugaauaguucuacaucuagugcuucuugccaaaaagaaua

SEQ ID NO: 352162 - RNA, 64 nt, Human
aaagcaaaguaugauaguuuguuuugcuauacaguacaucuauauugauagagguucauguuua

SEQ ID NO: 352163 - RNA, 64 nt, Human
gauuggaguguguccggagaugagaugaaaaaaauacaucuauauuuaagaaucccaggugugg

SEQ ID NO: 352164 - RNA, 64 nt, Human
ggucugcuagacaaauaauuuugcaaaauuuuucuacaucuaaguuaccucaucaguaagugcc

SEQ ID NO: 352165 - RNA, 64 nt, Human
uauuggaaauguuuuaaucacucuugccauuaccuacaucuauuagcauagaugaugaaaagcu

SEQ ID NO: 352166 - RNA, 58 nt, Human
ugcuuggccccacaggcugaccccgcacuacaucuacccaccagccaucgugcagccc

SEQ ID NO: 352167 - RNA, 64 nt, Human
uuuuagaccuuugaaggugauuuagaguuuuguguacaucuaggagaagguguucagcuucuca

SEQ ID NO: 352168 - RNA, 64 nt, Human
acugcagauuaaguaaagaacuuagaugcuaaauuacaucuaauuuuguauguuuuuuuaaaug

SEQ ID NO: 352169 - RNA, 64 nt, Human
cacacauaccagcccuucugcacacucugcuccuuacaucuaggcccagcugaacccagguuag

SEQ ID NO: 352170 - RNA, 64 nt, Human
uaacugaagaucaaaguaaagcaacagaggaauguacaucuaccuaauaacuuucuaaaauuua

SEQ ID NO: 352171 - RNA, 64 nt, Human
aagccccgggcauuauuauuauuauuucuuuuguuacaucuauuacaaguuuagaaaaaacaaa

SEQ ID NO: 352172 - RNA, 64 nt, Human
ccaagugaagcaaaacgaacugagagagcugauuuacaucuauagauauuuuaagccuuauuua

SEQ ID NO: 352173 - RNA, 64 nt, Human
ugcuugcguugugucuguuuuauguuuuuauaucuacaucuauauaucuauaauuuuauuaaaa

SEQ ID NO: 352174 - RNA, 64 nt, Human
gggacagucagggugaccccaccgccuaccucucuacaucuaaagagcccucugggccuguguu

SEQ ID NO: 352175 - RNA, 64 nt, Human
ggaaaaaaggcuggacuccaugacuauauauacauacaucuaucuacaucugccuguguacaca

SEQ ID NO: 352176 - RNA, 64 nt, Human
uucuguuucuugaaagaauuuuuuucguuauuuuuacaucuaacaaaguaaaaaaauuaaaaag

SEQ ID NO: 352177 - RNA, 64 nt, Human
caaauacaucagauaucgagcaaaugguuugaguuacaucuagcagcacuaaaacuuauucaac

SEQ ID NO: 352178 - RNA, 64 nt, Human
caccuccccacaggugagugacuggugggaagaguacaucuaccuucgaggcaggagcccucuc

SEQ ID NO: 352179 - RNA, 64 nt, Human
auaugaccaguuugggucuauguugguucacauguacaucuacuuuauaugaaagaaaaaacag

SEQ ID NO: 352180 - RNA, 64 nt, Human
uuuguauacaguacaguaagcacaauuggcacuguacaucuaaaaauauuacaguagaaucuga

SEQ ID NO: 352181 - RNA, 64 nt, Human
guaaucugcaaguuaaugacccuauuggcuuguguacaucuauaugcuaaaaugacuuccccac

SEQ ID NO: 352182 - RNA, 64 nt, Human
uauauuuacaaaauaauauaauuaauaaacuuccuacaucuauagaauguauaggaaauuuuau

SEQ ID NO: 352183 - RNA, 64 nt, Human
cucugaguauuuagcuauuguucuauauacuggauacaucuauuaugggaacuuaaauagauaa

SEQ ID NO: 352184 - RNA, 64 nt, Human
cccauuguuagauagauaucuauggauauagaucuacaucuauagauauagauauacacacaua

SEQ ID NO: 352185 - RNA, 64 nt, Human
auuuugaaguuugacugcuugaaaaagauuagcauacaucuaaugugaaaagaccacauuugau

SEQ ID NO: 352186 - RNA, 64 nt, Human
agaacuuaaaacaaguuuuaaaguuacauuucuauacaucuaauacauaauaccuucuuagcca

SEQ ID NO: 352187 - RNA, 64 nt, Human
ucacauuaaagaucuguuucagaauuguaaaaaguacaucuagauguguuuacagaaagcaagu

SEQ ID NO: 352188 - RNA, 64 nt, Human
uugguaaaccugucucuauuacagcauguugccauacaucuauuuaagugcauaaggucuuugg

SEQ ID NO: 352189 - RNA, 64 nt, Human
cugcaauauuacauuuuucacuuaagcaguuuuuuacaucuacguuguugcuuucuaaaaugaa

SEQ ID NO: 352190 - RNA, 64 nt, Human
gacgacauagcggcccccgcguccggguuacaaauacaucuacagauauuuucagggauugcuu

SEQ ID NO: 352191 - RNA, 64 nt, Human
auauaauuguauagauuuuaaaaguuuuauuuuuuacaucuaugguaguuuuugaggugccuau

SEQ ID NO: 352192 - RNA, 64 nt, Human
aaugaacacucuuuugcuuuauuccagaaugcuguacaucuauuuuggauuguauauuguguuu

SEQ ID NO: 352193 - RNA, 64 nt, Human; identical to SEQ ID NO: 229286

SEQ ID NO: 352194 - RNA, 64 nt, Human; identical to SEQ ID NO: 229287

SEQ ID NO: 352195 - RNA, 64 nt, Human; identical to SEQ ID NO: 229288

SEQ ID NO: 352196 - RNA, 64 nt, Human; identical to SEQ ID NO: 229289

SEQ ID NO: 352197 - RNA, 64 nt, Human; identical to SEQ ID NO: 229290

SEQ ID NO: 352198 - RNA, 64 nt, Human; identical to SEQ ID NO: 229291

SEQ ID NO: 352199 - RNA, 64 nt, Human; identical to SEQ ID NO: 229292

SEQ ID NO: 352200 - RNA, 64 nt, Human; identical to SEQ ID NO: 229293

SEQ ID NO: 352201 - RNA, 64 nt, Human; identical to SEQ ID NO: 229294

SEQ ID NO: 352202 - RNA, 64 nt, Human; identical to SEQ ID NO: 229295

SEQ ID NO: 352203 - RNA, 64 nt, Human; identical to SEQ ID NO: 229296

SEQ ID NO: 352204 - RNA, 64 nt, Human; identical to SEQ ID NO: 229300

SEQ ID NO: 352205 - RNA, 64 nt, Human; identical to SEQ ID NO: 229301

SEQ ID NO: 352206 - RNA, 64 nt, Human; identical to SEQ ID NO: 229302

SEQ ID NO: 352207 - RNA, 64 nt, Human; identical to SEQ ID NO: 229303

SEQ ID NO: 352208 - RNA, 64 nt, Human; identical to SEQ ID NO: 229304

SEQ ID NO: 352209 - RNA, 64 nt, Human; identical to SEQ ID NO: 229305

SEQ ID NO: 352210 - RNA, 64 nt, Human; identical to SEQ ID NO: 229306

SEQ ID NO: 352211 - RNA, 64 nt, Human; identical to SEQ ID NO: 229307

SEQ ID NO: 352212 - RNA, 64 nt, Human; identical to SEQ ID NO: 229308

SEQ ID NO: 352213 - RNA, 64 nt, Human; identical to SEQ ID NO: 229309

SEQ ID NO: 352214 - RNA, 64 nt, Human; identical to SEQ ID NO: 229310

SEQ ID NO: 352215 - RNA, 64 nt, Human; identical to SEQ ID NO: 229311

SEQ ID NO: 352216 - RNA, 64 nt, Human; identical to SEQ ID NO: 229312

SEQ ID NO: 352217 - RNA, 64 nt, Human; identical to SEQ ID NO: 229313

SEQ ID NO: 352218 - RNA, 64 nt, Human; identical to SEQ ID NO: 229314

SEQ ID NO: 352219 - RNA, 64 nt, Human; identical to SEQ ID NO: 229318

SEQ ID NO: 352220 - RNA, 64 nt, Human; identical to SEQ ID NO: 229319

SEQ ID NO: 352221 - RNA, 64 nt, Human; identical to SEQ ID NO: 229320

SEQ ID NO: 352222 - RNA, 64 nt, Human; identical to SEQ ID NO: 229321

SEQ ID NO: 352223 - RNA, 64 nt, Human; identical to SEQ ID NO: 229322

SEQ ID NO: 352224 - RNA, 64 nt, Human; identical to SEQ ID NO: 229323

SEQ ID NO: 352225 - RNA, 54 nt, Human; identical to SEQ ID NO: 229324

SEQ ID NO: 352226 - RNA, 64 nt, Human; identical to SEQ ID NO: 229325

SEQ ID NO: 352227 - RNA, 64 nt, Human; identical to SEQ ID NO: 229326

SEQ ID NO: 352228 - RNA, 64 nt, Human; identical to SEQ ID NO: 229327

SEQ ID NO: 352229 - RNA, 64 nt, Human; identical to SEQ ID NO: 229328

SEQ ID NO: 352230 - RNA, 64 nt, Human; identical to SEQ ID NO: 229329

SEQ ID NO: 352231 - RNA, 64 nt, Human; identical to SEQ ID NO: 229330

SEQ ID NO: 352232 - RNA, 64 nt, Human; identical to SEQ ID NO: 229331

SEQ ID NO: 352233 - RNA, 64 nt, Human; identical to SEQ ID NO: 229332

SEQ ID NO: 352234 - RNA, 64 nt, Human; identical to SEQ ID NO: 229336

SEQ ID NO: 352235 - RNA, 64 nt, Human; identical to SEQ ID NO: 229337

SEQ ID NO: 352236 - RNA, 64 nt, Human; identical to SEQ ID NO: 229338

SEQ ID NO: 352237 - RNA, 51 nt, Human; identical to SEQ ID NO: 229339

SEQ ID NO: 352238 - RNA, 64 nt, Human; identical to SEQ ID NO: 229340

SEQ ID NO: 352239 - RNA, 64 nt, Human; identical to SEQ ID NO: 229341

SEQ ID NO: 352240 - RNA, 64 nt, Human; identical to SEQ ID NO: 229342

SEQ ID NO: 352241 - RNA, 64 nt, Human; identical to SEQ ID NO: 229343

SEQ ID NO: 352242 - RNA, 64 nt, Human; identical to SEQ ID NO: 229344

SEQ ID NO: 352243 - RNA, 64 nt, Human; identical to SEQ ID NO: 229345

SEQ ID NO: 352244 - RNA, 64 nt, Human; identical to SEQ ID NO: 229346

SEQ ID NO: 352245 - RNA, 64 nt, Human; identical to SEQ ID NO: 229347

SEQ ID NO: 352246 - RNA, 64 nt, Human; identical to SEQ ID NO: 229348

SEQ ID NO: 352247 - RNA, 64 nt, Human; identical to SEQ ID NO: 229349

SEQ ID NO: 352248 - RNA, 64 nt, Human; identical to SEQ ID NO: 229350

SEQ ID NO: 352249 - RNA, 64 nt, Human; identical to SEQ ID NO: 229354

SEQ ID NO: 352250 - RNA, 64 nt, Human; identical to SEQ ID NO: 229355

SEQ ID NO: 352251 - RNA, 64 nt, Human; identical to SEQ ID NO: 229356

SEQ ID NO: 352252 - RNA, 64 nt, Human; identical to SEQ ID NO: 229357

SEQ ID NO: 352253 - RNA, 64 nt, Human; identical to SEQ ID NO: 229358

SEQ ID NO: 352254 - RNA, 64 nt, Human; identical to SEQ ID NO: 229359

SEQ ID NO: 352255 - RNA, 64 nt, Human; identical to SEQ ID NO: 229360

SEQ ID NO: 352256 - RNA, 64 nt, Human; identical to SEQ ID NO: 229361

SEQ ID NO: 352257 - RNA, 64 nt, Human; identical to SEQ ID NO: 229362

SEQ ID NO: 352258 - RNA, 64 nt, Human; identical to SEQ ID NO: 229363

SEQ ID NO: 352259 - RNA, 64 nt, Human; identical to SEQ ID NO: 229364

SEQ ID NO: 352260 - RNA, 54 nt, Human; identical to SEQ ID NO: 229365

SEQ ID NO: 352261 - RNA, 64 nt, Human; identical to SEQ ID NO: 229366

SEQ ID NO: 352262 - RNA, 64 nt, Human; identical to SEQ ID NO: 229367

SEQ ID NO: 352263 - RNA, 64 nt, Human; identical to SEQ ID NO: 229368

SEQ ID NO: 352264 - RNA, 64 nt, Human; identical to SEQ ID NO: 229372

SEQ ID NO: 352265 - RNA, 64 nt, Human; identical to SEQ ID NO: 229373

SEQ ID NO: 352266 - RNA, 64 nt, Human; identical to SEQ ID NO: 229374

SEQ ID NO: 352267 - RNA, 64 nt, Human; identical to SEQ ID NO: 229375

SEQ ID NO: 352268 - RNA, 64 nt, Human; identical to SEQ ID NO: 229376

SEQ ID NO: 352269 - RNA, 64 nt, Human; identical to SEQ ID NO: 229377

SEQ ID NO: 352270 - RNA, 64 nt, Human; identical to SEQ ID NO: 229378

SEQ ID NO: 352271 - RNA, 64 nt, Human; identical to SEQ ID NO: 229379

SEQ ID NO: 352272 - RNA, 64 nt, Human; identical to SEQ ID NO: 229380

SEQ ID NO: 352273 - RNA, 64 nt, Human; identical to SEQ ID NO: 229381

SEQ ID NO: 352274 - RNA, 64 nt, Human; identical to SEQ ID NO: 229382

SEQ ID NO: 352275 - RNA, 64 nt, Human; identical to SEQ ID NO: 229383

SEQ ID NO: 352276 - RNA, 64 nt, Human; identical to SEQ ID NO: 229384

SEQ ID NO: 352277 - RNA, 64 nt, Human; identical to SEQ ID NO: 229385

SEQ ID NO: 352278 - RNA, 64 nt, Human; identical to SEQ ID NO: 229386

SEQ ID NO: 352279 - RNA, 64 nt, Human; identical to SEQ ID NO: 229390

SEQ ID NO: 352280 - RNA, 64 nt, Human; identical to SEQ ID NO: 229391

SEQ ID NO: 352281 - RNA, 64 nt, Human; identical to SEQ ID NO: 229392

SEQ ID NO: 352282 - RNA, 64 nt, Human; identical to SEQ ID NO: 229393

SEQ ID NO: 352283 - RNA, 64 nt, Human; identical to SEQ ID NO: 229394

SEQ ID NO: 352284 - RNA, 57 nt, Human; identical to SEQ ID NO: 229395

SEQ ID NO: 352285 - RNA, 64 nt, Human; identical to SEQ ID NO: 229396

SEQ ID NO: 352286 - RNA, 64 nt, Human; identical to SEQ ID NO: 229397

SEQ ID NO: 352287 - RNA, 64 nt, Human; identical to SEQ ID NO: 229398

SEQ ID NO: 352288 - RNA, 64 nt, Human; identical to SEQ ID NO: 229399

SEQ ID NO: 352289 - RNA, 64 nt, Human; identical to SEQ ID NO: 229400

SEQ ID NO: 352290 - RNA, 64 nt, Human; identical to SEQ ID NO: 229401

SEQ ID NO: 352291 - RNA, 64 nt, Human; identical to SEQ ID NO: 229402

SEQ ID NO: 352292 - RNA, 64 nt, Human; identical to SEQ ID NO: 229403

SEQ ID NO: 352293 - RNA, 61 nt, Human; identical to SEQ ID NO: 229404

SEQ ID NO: 352294 - RNA, 63 nt, Human; identical to SEQ ID NO: 229408

SEQ ID NO: 352295 - RNA, 64 nt, Human; identical to SEQ ID NO: 229409

SEQ ID NO: 352296 - RNA, 64 nt, Human; identical to SEQ ID NO: 229410

SEQ ID NO: 352297 - RNA, 64 nt, Human; identical to SEQ ID NO: 229411

SEQ ID NO: 352298 - RNA, 64 nt, Human; identical to SEQ ID NO: 229412

SEQ ID NO: 352299 - RNA, 64 nt, Human; identical to SEQ ID NO: 229413

SEQ ID NO: 352300 - RNA, 55 nt, Human; identical to SEQ ID NO: 229414

SEQ ID NO: 352301 - RNA, 64 nt, Human; identical to SEQ ID NO: 229415

SEQ ID NO: 352302 - RNA, 64 nt, Human; identical to SEQ ID NO: 229416

SEQ ID NO: 352303 - RNA, 64 nt, Human; identical to SEQ ID NO: 229417

SEQ ID NO: 352304 - RNA, 64 nt, Human; identical to SEQ ID NO: 229418

SEQ ID NO: 352305 - RNA, 64 nt, Human
accuacccccaaaaaacaauuauguaauugaaaaccaaccgauugccuuuauuuugcuuccaca

SEQ ID NO: 352306 - RNA, 64 nt, Human
ucuauaggcauaccaaccuggaucacucuuccacccaaccgaggaguagaugcaucugaaucuu

SEQ ID NO: 352307 - RNA, 64 nt, Human
aaauuuuaaaaauacuacaauauuuaacuaaggcccaaccgauuuccauaauguagcaguuacc

SEQ ID NO: 352308 - RNA, 64 nt, Human
cuguaggaacgucaaggucgugggaaauaaaaggcaguucuacacagacugcagcaacgguugc

SEQ ID NO: 352309 - RNA, 64 nt, Human
ggagauauugguuaucaguuugcagaugaauacacaguucuauccaacagaaacuguaucuuuc

SEQ ID NO: 352310 - RNA, 64 nt, Human
ggggauugcugggccauaugauaagcauauguuucaguucuaccaaucuuguuuccagaguagu

SEQ ID NO: 352311 - RNA, 64 nt, Human
uguuuagcgcgggacuacuguuccaaaaagaauuccaaccgaccagcuuguuugugaaacaaaa

SEQ ID NO: 352312 - RNA, 64 nt, Human
cgggcacauugggggucaccggccgauggagacaccaaccgacaggcccuggcugagggcagcu

SEQ ID NO: 352313 - RNA, 64 nt, Human
augaggaucgucugguuagaaaacauaacugauaccaaccgaaacugaagggaguuagaccaag

SEQ ID NO: 352314 - RNA, 64 nt, Human
cguuguguuaaaaggggacauuuguccaaacuccccaaccgaguucuagaagcuccugacaagg

SEQ ID NO: 352315 - RNA, 64 nt, Human
ccugggucccccagccggcuggguggcucuggggccaaccgaccacaggugucacugaucacag

SEQ ID NO: 352316 - RNA, 64 nt, Human
gagaaagagaaauauauauauauccacccccagcccaaccgagggcggcccuuggcggcaacau

SEQ ID NO: 352317 - RNA, 64 nt, Human
cagacacaaccccgaggcaggagagugacuguggccaaccgagcaggggaacaggggcuuugga

SEQ ID NO: 352318 - RNA, 64 nt, Human
ccuggugcccaggcccugggccugcuccuugccaccaaccgaaccgugaauguagggcccccag

SEQ ID NO: 352319 - RNA, 64 nt, Human
guacugauuuuuuuuuaauaaacugcaucgagauccaaccgacugaauuguuaaaaaaaaaaaa

SEQ ID NO: 352320 - RNA, 64 nt, Human
ggucucgggccugggugagacaaugaagugacuuccaaccgacaguugcuagaauucacagggc

SEQ ID NO: 352321 - RNA, 64 nt, Human
cuccaggcccccucacccucaaaguguagcgcccccaaccgagcaaccucgguuuggucccuaa

SEQ ID NO: 352322 - RNA, 64 nt, Human
ugcaggcuggcauaugcuaauuugggggugguaaccaaccgauuuuaucucauguaagcauuac

SEQ ID NO: 352323 - RNA, 64 nt, Human
gaggcgggcggaucaugaggucaggaguucgagaccaaccgaccaacauggugaaaccccaucu

SEQ ID NO: 352324 - RNA, 64 nt, Human
ccaugccagaaugggaaguugugacguugcagcuccaaccgacgugcucauagugaucagcugu

SEQ ID NO: 352325 - RNA, 64 nt, Human
cucaauauucacacccauaaacauuacuaagccccaguucuaucguuggaaggaguuguuauuc

SEQ ID NO: 352326 - RNA, 64 nt, Human
cagccaaaucaugaacucaaaauguauuugaucacaguucuauaauguuuuuaccuaccuauua

SEQ ID NO: 352327 - RNA, 64 nt, Human
uugaucaucuuauaccacgaaucguuaauuuugacaguucuacugauccguaaaugauaaccac

SEQ ID NO: 352328 - RNA, 64 nt, Human
caacaccaggugcuuggggauuucuuagagaucaccaaccgacucccucacugugaaauuaaac

SEQ ID NO: 352329 - RNA, 64 nt, Human
ccuucagcagcugagaaacgaacacgaauccaucccaaccgagaugccauuaacauucaucuaa

SEQ ID NO: 352330 - RNA, 64 nt, Human
agaaccaccacccgagggguacagccccucucuuccaaccgagaaguuccugucccagaaugga

SEQ ID NO: 352331 - RNA, 64 nt, Human
caggaagcuccugcgcuacuacagcaagaaccgcccaaccgaggcugucaggugcuacgagcug

SEQ ID NO: 352332 - RNA, 64 nt, Human
uccgcugagacccugcaggaacacgaaacagaugccaaccgagagggugagugggggacugugg

SEQ ID NO: 352333 - RNA, 64 nt, Human
uaaggggcucugagcuucugcccccagaaucauuccaaccgacccacugcaaagacuaugacag

SEQ ID NO: 352334 - RNA, 64 nt, Human
agaaaccaaaauacaaacacaauauuuaaucuugccaaccgaagacgaugugacugcaugaagu

SEQ ID NO: 352335 - RNA, 64 nt, Human
cccggcgccccgcaccuguacaguggaaccguugccaaccgagagaaugcugaccugacuugcc

SEQ ID NO: 352336 - RNA, 64 nt, Human
ucaggaguccuaggcucccauuccugcuccauuaccaaccgaaggcucggucuuaauuccccca

SEQ ID NO: 352337 - RNA, 62 nt, Human
cacucauguuauuaaagguuuugccuugucguaaccaaccgagccggggguguuuuguuucu

SEQ ID NO: 352338 - RNA, 64 nt, Human
uaaacaucuccacacaaaaaaaaaaaugucuuaaccaaccgaaaagaaaaauuaaaaaaggauu

SEQ ID NO: 352339 - RNA, 64 nt, Human
ugcaggggagucaccgcccagaccuccccagccaccaaccgaccccaccucuguuccuaacaaa

SEQ ID NO: 352340 - RNA, 64 nt, Human
acccaguuucuggaaaaaguugaugcuaaugaggccaaccgaugggcgagagguggagugucac

SEQ ID NO: 352341 - RNA, 64 nt, Human
gcauucaucucucaaacuuaguuuuuaucuuugaccaaccgaacaugaccaaaaaccaaaagug

SEQ ID NO: 352342 - RNA, 64 nt, Human
auuaaacacauuuugcuaggaugucaaauagucacaguucuaaguaguuggaaacaaaauugac

SEQ ID NO: 352343 - RNA, 64 nt, Human
ggaaugaaggacugugggcgcuggguucaaauuccaguucuaugcaccacuccagguagggaua

SEQ ID NO: 352344 - RNA, 64 nt, Human
caaaaagucuauuuaaaacuguagcaguaguuuacaguucuagcaaagaggaaaguuguggggu

SEQ ID NO: 352345 - RNA, 64 nt, Human
aucugccauaaaagaaaagcaaaagauaaaaagcccaaccgauguggggauagagaggcggaag

SEQ ID NO: 352346 - RNA, 64 nt, Human
uuggaucugaauuaauuguccuuucuucuaaaucccaaccgaacuucuuccaaccuccaaacug

SEQ ID NO: 352347 - RNA, 64 nt, Human
aagagcggcgugagcggagggagugugaugauucccaaccgaaagcagcugucucgccuuuaga

SEQ ID NO: 352348 - RNA, 64 nt, Human
guacaaaauaaauacagucauauguuuaauaaaacaguucuauuguaguaacuuguaaaaauuc

SEQ ID NO: 352349 - RNA, 64 nt, Human
uuugaauugauucuuuagaccccccaaaaagugucaguucuaauggggaaauauauuccaucaa

SEQ ID NO: 352350 - RNA, 64 nt, Human
ggcugaagcaugggcugcccagaaccccaaccaccaguucuaucuuucucuuucugucaccuuu

SEQ ID NO: 352351 - RNA, 64 nt, Human
uuaaaacaauugugaacagaaacugaagaugguacaguucuacaucugcaccugcccuuuuuuc

SEQ ID NO: 352352 - RNA, 64 nt, Human
ucagucaagugaucagaucccgaaucuagauucccaguucuaaggccuuaucaccuccccugcc

SEQ ID NO: 352353 - RNA, 64 nt, Human
agcuagauuacuaguaaggcuuccagacuucuaucaguucuauugauucuacaucagacuucca

SEQ ID NO: 352354 - RNA, 64 nt, Human
aauaugaauuuuauuaagcuauucuuuagaaauucaguucuaaggaaagaguugauccuuauga

SEQ ID NO: 352355 - RNA, 64 nt, Human
caguguguuuaauaaauuguaauuauuuuguguacaguucuauacuguuaucuguguccauuuc

SEQ ID NO: 352356 - RNA, 64 nt, Human
aauccugauccucagaacuucucugggacaauuucaguucuaauaauguccuuaaauuuuauuu

SEQ ID NO: 352357 - RNA, 64 nt, Human
aaugguguugaaauagaaccucauacauuuauuacaguucuacuuauacagaaaaucuagacac

SEQ ID NO: 352358 - RNA, 64 nt, Human
cuuacagcuuuucuaugcuaaacuuuguucuguucaguucuagaguguauacagaacgaauuga

SEQ ID NO: 352359 - RNA, 64 nt, Human
uuggaaguuuagcucugagaaccguagaugauuucaguucuaggaaaauaaaacccguugauua

SEQ ID NO: 352360 - RNA, 64 nt, Human
cucuacaugguugaugcgggcagugugggacccucaguucuaggacugguccgcagagaaagca

SEQ ID NO: 352361 - RNA, 64 nt, Human
uuacaaucuaccuggucauuauuuuauuucuauccaguucuaagaacugccuccacuguuuaua

SEQ ID NO: 352362 - RNA, 64 nt, Human
agaacaggccucccaaguuuuaggacaaacagcucaguucuagucucucuggggccacacagaa

SEQ ID NO: 352363 - RNA, 64 nt, Human
ucugguuuaggggagagauuuuauuuuacugaaccaguucuauagaaauuuauuuuauuaggaa

SEQ ID NO: 352364 - RNA, 64 nt, Human
aaacagguguuugccuuauuuaauuuuuuacuuucaguucuacgugaauuagcuuuuucucaga

SEQ ID NO: 352365 - RNA, 64 nt, Human
ggcuggaauuuuacaaccugauguauauauuagacaguucuaggauguuaguucccuucauucc

SEQ ID NO: 352366 - RNA, 64 nt, Human
cugugaugcugguccuucaucuuagguguucaugcaguucuaacacaguugggguugggucaau

SEQ ID NO: 352367 - RNA, 64 nt, Human
guguuaacacauugguagagcuaugauuccuucccaguucuaagagauacgaucuguaaguccc

SEQ ID NO: 352368 - RNA, 64 nt, Human
ugugaagugcauuuaaauguuuguuggcuuguugcaguucuaugaaacagagcuguuaauaaug

SEQ ID NO: 352369 - RNA, 64 nt, Human
ucucccuaaggaaucugaaaguauauuuuccucccaguucuacaagcauauuugagaacccuuc

SEQ ID NO: 352370 - RNA, 64 nt, Human
acuuuucugccccaucucccauacuuuugaaggucaguucuaugacagugaauuuugcacagga

SEQ ID NO: 352371 - RNA, 64 nt, Human
ugggacaaaacaggagcucaucucuuuggggucacaguucuauuuuguuugugaguuuguauua

SEQ ID NO: 352372 - RNA, 64 nt, Human
ugggaccaaggaccguuccaacagcauucacugccaguucuaauaggcgaggaaaaugcccgag

SEQ ID NO: 352373 - RNA, 64 nt, Human
uucaacgauucuuucuuuggguuugggguucuugcaguucuaucaucuaaaauaaccuuuggac

SEQ ID NO: 352374 - RNA, 64 nt, Human
acaauauugaacuuuuuuccacugaaguagugugcaguucuaguuugcauuccugauaugauuu

SEQ ID NO: 352375 - RNA, 64 nt, Human
gcuucugcucucauucauuuagugcuacgcugcacaguucuacacugucaagggaaaagggaga

SEQ ID NO: 352376 - RNA, 64 nt, Human
uguuuccuccccucaaaguucugccuaagccguucaguucuaacauggucucaguuaaucuggu

SEQ ID NO: 352377 - RNA, 64 nt, Human
ucguggcaggagagauuaagguaauuacaacacucaguucuaugucuuacaagcacuuugucuu

SEQ ID NO: 352378 - RNA, 64 nt, Human
caaaacaggugacagugaguaaccaaaugcagaccaguucuaugcaggauaaugauaaauuccc

SEQ ID NO: 352379 - RNA, 64 nt, Human
auguaaauuuccuuagagaccauccuggagaagacaguucuaaaucggggcuugauuuuucauc

SEQ ID NO: 352380 - RNA, 64 nt, Human
uucuuaguuuuaaaaggaaguggcaucauuguuucaguucuaguuuguauuuuucucucagaua

SEQ ID NO: 352381 - RNA, 64 nt, Human
cauccuccaaaacuucccagaauaccucccuuuccaguucuaccaaaucuguacuugggagcag

SEQ ID NO: 352382 - RNA, 64 nt, Human
auuuugcugaggggaguggcugucaugagcaugucaguucuaaaagggguuuucauuauccugg

SEQ ID NO: 352383 - RNA, 64 nt, Human
ucucucugagaugucaugcagcgcuguugauguccaguucuaugucaucaguacacaaggagaa

SEQ ID NO: 352384 - RNA, 64 nt, Human
uuggggaaaugugaaagugaaaucgauaauaccacaguucuaaaugugcacuguuggcugaacu

SEQ ID NO: 352385 - RNA, 64 nt, Human
ugcagcuaguaaaggauauuuuugcucuguucagcaguucuaaaaauugcugaaguaggggcca

SEQ ID NO: 352386 - RNA, 64 nt, Human
agauaagacauaucucuaauuccauccauaaauccaguucuacuauggcugaguucuggucaaa

SEQ ID NO: 352387 - RNA, 64 nt, Human
cuuuuguuuccagaaaaaguugggcuuucccaagcaguucuauuacccgguucagaauugcuuc

SEQ ID NO: 352388 - RNA, 64 nt, Human
acuaauuuccaaaauauaagcuguuuucauuagccaguucuauaauaucuuccugugauuuaug

SEQ ID NO: 352389 - RNA, 64 nt, Human
augcuuuuaaguaaguuuuucucaaauuuuguuucaguucuaggucccuugucacagcuugguu

SEQ ID NO: 352390 - RNA, 64 nt, Human
gacagcaugaccucugggugucucuccaacucaccaguucuaaaaaggguaucagauucuauug

SEQ ID NO: 352391 - RNA, 64 nt, Human
ucacuuucucaccuugggaaggugucaguguuuucaguucuaagguaagagguguagagcuguu

SEQ ID NO: 352392 - RNA, 64 nt, Human
gagcuugcuguuuaaaggauuauaugauguacaucaguucuauaaaugugcucagcaguuuaac

SEQ ID NO: 352393 - RNA, 64 nt, Human
aguugauaaauuauaaaauuuuaaaaagucaauucaguucuagaaauagauuuaaagaauauga

SEQ ID NO: 352394 - RNA, 64 nt, Human
guaagcuaaacaaacaaacaaacaaacaaacaaacaguucuauauauaauaguuucaacacaga

SEQ ID NO: 352395 - RNA, 64 nt, Human
cgagauacauuauaauuacugucugauuuucuuacaguucuagaaugaagacuuauauugaaau

SEQ ID NO: 352396 - RNA, 64 nt, Human
gauacuugaccaauauuugagcacagcaagcugacaguucuauacagauaggcagugaaagagu

SEQ ID NO: 352397 - RNA, 64 nt, Human
cuugguggugaaacuacaacucucacgugugcuccaguucuaaaauuaaccugugccuggucuc

SEQ ID NO: 352398 - RNA, 64 nt, Human
uagauuuuccucuggagagacagaucugaauguucaguucuagccaagguagauuuuacuuuca

SEQ ID NO: 352399 - RNA, 64 nt, Human
ccccccauccccgaccucaggccuccaagggcugcaguucuacaggcuacaccgggaagaaagg

SEQ ID NO: 352400 - RNA, 64 nt, Human
ccucccaggccaucucuguuccucuggggugguccaguucuagagugggagaaagggagucagg

SEQ ID NO: 352401 - RNA, 64 nt, Human
ccauuuuaugaagguugaaguggauuuaugcaggcaguucuauauauagaaauacaauucuuuu

SEQ ID NO: 352402 - RNA, 64 nt, Human
cuacaguggagcuacacucauugaaauguaauuucaguucuaaaaagauguaauaaucauuuua

SEQ ID NO: 352403 - RNA, 64 nt, Human
aaaacagagaugugguucuuaauguuuaacagaacaguucuaauccugccacguguuaucauua

SEQ ID NO: 352404 - RNA, 64 nt, Human
gcuguggucuauuuccacuguuuaauuuucuacucaguucuaccaaauaggaugucauguuuga

SEQ ID NO: 352405 - RNA, 64 nt, Human
aguauaguuuugacagaguugguguucauaauuucaguucuaguugauugcgagaauuuucaaa

SEQ ID NO: 352406 - RNA, 64 nt, Human
uaaacucauaccuuuaauuaaccaauucauggcccaguucuacaguugaauuggacaaggcuaa

SEQ ID NO: 352407 - RNA, 64 nt, Human
cuguucucagggugacgacugccaccaggagaugcaguucuaguucuuaaaauuaaauuugccc

SEQ ID NO: 352408 - RNA, 64 nt, Human
uuuucuauguuuggcucaauuagggcaguaucaucaguucuauaauguaaaagaaauuuucuuu

SEQ ID NO: 352409 - RNA, 64 nt, Human
ugaaaccacuuuacuacuuuuuuuaaacuuaacucaguucuaaauacuuugucuggagcacaaa

SEQ ID NO: 352410 - RNA, 64 nt, Human
uuuucugucuaguacuuguuuucauucuggccagcaguucuacauuaaaucaccuugucaaggg

SEQ ID NO: 352411 - RNA, 64 nt, Human
uggaaaccuaauuauuuguaaugaauuauuuagacaguucuaagcccugucuucugggaguuau

SEQ ID NO: 352412 - RNA, 64 nt, Human
aaaggaaaugcuguaacuaaagcucaauuauuaucaguucuaugcuaacguauacauuuuaauc

SEQ ID NO: 352413 - RNA, 64 nt, Human
ugccuccuagcagagaagugugugugugacaagccaguucuacaggcauuaccuaggugugaga

SEQ ID NO: 352414 - RNA, 64 nt, Human
ugaagcagcucugccuucuuagggcuacccaaaacaguucuaggugcuaaaauucagauuuuca

SEQ ID NO: 352415 - RNA, 64 nt, Human
cuguuaucgcugcuguccucccaacagcugucuccaguucuaguuccuugguuuucaggcacag

SEQ ID NO: 352416 - RNA, 64 nt, Human
ucauuauucuuuuucaguuuuaccucuucucucucaguucuacacugauacacuugaaggacca

SEQ ID NO: 352417 - RNA, 64 nt, Human
uucucaaauguacacuuguauuauaauaaccucccaguucuaggggauauuugugcaauaaaua

SEQ ID NO: 352418 - RNA, 64 nt, Human
uaguaagcacaugaaguaguuugauaauaaauagcaguucuaguacuucacauuucacccgugu

SEQ ID NO: 352419 - RNA, 64 nt, Human
uagaauuaaaaggaguccaacauucccagcuccccaguucuaagaaacuuuugucaaacccaau

SEQ ID NO: 352420 - RNA, 64 nt, Human
ggaauguuuuggaauuugauagacuuucggcaaccaguucuacuaaugcuucacuccuggcucu

SEQ ID NO: 352421 - RNA, 64 nt, Human
ggcuccccaaugccuuggaggccauaaggccagccaguucuagcucucuauuaccuguccccac

SEQ ID NO: 352422 - RNA, 64 nt, Human
uaggccuuacacaaguuguucagauucuuugccccaguucuaaucuagugacaaaggcauagaa

SEQ ID NO: 352423 - RNA, 64 nt, Human
gaaguuugaucugagaaccaaccauagaauguuucaguucuaggaaauaaaaccaguugauuaa

SEQ ID NO: 352424 - RNA, 64 nt, Human
aauucccagaaaaaugauuguuucaaggaagugacaguucuacuuuagaaguacuaauuggaga

SEQ ID NO: 352425 - RNA, 64 nt, Human
auuacugugaaggagaaaaauagcuauuucuugacaguucuauaguuauacacauaaauuuuca

SEQ ID NO: 352426 - RNA, 64 nt, Human
uuacaggcgugagucacugugccuggccaaguuucaguucuauaugaaguauuugauguuuugu

SEQ ID NO: 352427 - RNA, 64 nt, Human
uuuuaaaauaggccuuguuuuucagcuucaucugcaguucuaugugaagauugauaaaucaguu

SEQ ID NO: 352428 - RNA, 64 nt, Human
ugauucaguauugcuggguggugcccaaaugcuccaguucuaauguauucccagguguugcuga

SEQ ID NO: 352429 - RNA, 64 nt, Human
gcuccauuuacagccauuucuaaaauggcagcuucaguucuagagaagaaagaacaacaucagc

SEQ ID NO: 352430 - RNA, 64 nt, Human
ugguggacaaguguaaauauggaauaagaacaaacaguucuaauuaauuccuucuucugcagua

SEQ ID NO: 352431 - RNA, 64 nt, Human
gccaacaugggcuucugaacccuucaggcagggacaguucuauugcugucccuacaauauauaa

SEQ ID NO: 352432 - RNA, 64 nt, Human
uggucaaauuuuaacauuauaccaaaguuauacccaguucuaccuacuuguauauuucuuuacu

SEQ ID NO: 352433 - RNA, 64 nt, Human
gccggcgggggaucugcuguccucccuuuugagucaguucuaaucccaugugugucugggccac

SEQ ID NO: 352434 - RNA, 64 nt, Human
gggggcaguauuauuacaaauggaucugaaaugucaguucuaguauuuagagagacuucucuaa

SEQ ID NO: 352435 - RNA, 64 nt, Human
auauugagcaauaugucagucacuaaaaggaagacaguucuacagaaaaacaaugguaacauuu

SEQ ID NO: 352436 - RNA, 64 nt, Human
ccgccuccuggguucaagcaauucucuggggcagcaguucuaagcucugguugcacauuaggau

SEQ ID NO: 352437 - RNA, 64 nt, Human
uugcuguacauuuuuaaaguuugaguuuuuagcucaguucuaccuuuuaucugacacauuauua

SEQ ID NO: 352438 - RNA, 64 nt, Human
gacagaggagugaaccccaaagguguccaugccccaguucuaagcccuguggccaggugcuguc

SEQ ID NO: 352439 - RNA, 64 nt, Human
ccauuuuuguuauagaaaguaauccauaaaauuucaguucuaaaauacuuuuuaagacucuuuu

SEQ ID NO: 352440 - RNA, 64 nt, Human
ugcggagggccaaagcccgggaccucuacuugaacaguucuacuggggaggcuggagaacuaag

SEQ ID NO: 352441 - RNA, 64 nt, Human
ccagucccuguuggcuuucgguagcucucgcaugcaguucuauuaacagccgucuagaagcgau

SEQ ID NO: 352442 - RNA, 64 nt, Human
gacgauuaauuguaaauaauuuauuugauuggugcaguucuaaucccuaaaucauaaucuuaaa

SEQ ID NO: 352443 - RNA, 64 nt, Human
caaauguagaugguucuguccucaucccugagaucaguucuacugaaauggcaacaacaacucc

SEQ ID NO: 352444 - RNA, 64 nt, Human
cccacaucccaucgucucggccuucacaaucugucaguucuaaccuccuaagcaacuaggccuu

SEQ ID NO: 352445 - RNA, 64 nt, Human
uuugugagcuccggcuccuguuuagcuuuuauuucaguucuaaccucaguccagaaacauaugu

SEQ ID NO: 352446 - RNA, 64 nt, Human
gucuuugcuggguggugauugggauguaacagaucaguucuacuggacuuguagcuugauagug

SEQ ID NO: 352447 - RNA, 64 nt, Human
ucugaacaauacacaccaggacaauugugugcaacaguucuacaaacugauauuucuaauuaaa

SEQ ID NO: 352448 - RNA, 64 nt, Human
ucaaaaagacacuaagggauuuccuucugggccucaguucuauuuguaagauggagaauaaucc

SEQ ID NO: 352449 - RNA, 64 nt, Human
uuuuuuaaccuuuuugccacucauuauauguuugcaguucuaggucuuugacagcugaagacca

SEQ ID NO: 352450 - RNA, 64 nt, Human
gcaacauuaaugguaccagccugucacaacugagcaguucuaauaaugcagaauaaauacaugu

SEQ ID NO: 352451 - RNA, 64 nt, Human
agcuagugcauugugcucuuuccaaguucagcagcaguucuaucaguggugccacugaaacugg

SEQ ID NO: 352452 - RNA, 64 nt, Human
aauugugauugugacccaugaguggaggaacuuucaguucuaaagcugauaaaguguguagcca

SEQ ID NO: 352453 - RNA, 64 nt, Human
agaacuguuauuugcaguguuaggucuaggaucccaguucuaguaggacagcccugcaagacaa

SEQ ID NO: 352454 - RNA, 64 nt, Human
uggcugccuaaagugcuucuuuucuaacccaaaacaguucuacucacuuccuuuuacagaauuc

SEQ ID NO: 352455 - RNA, 64 nt, Human
uuuguugcugaauugcuucugugaguucacuuuucaguucuaaggaagaauaauauuugcuaca

SEQ ID NO: 352456 - RNA, 64 nt, Human
uguuugaauaucuucauuccucucaaauucauaacaguucuauuuaacugaauuaaauaaccau

SEQ ID NO: 352457 - RNA, 64 nt, Human
agguggaaguaacugaauuauuuuuuaaauuaagcaguucuacucgaucaccaagaugcuucug

SEQ ID NO: 352458 - RNA, 64 nt, Human
uguaaauguagguagaaaugaguacaaacugauucaguucuaaaguuccaaagcacuaaaaacu

SEQ ID NO: 352459 - RNA, 64 nt, Human
gcuguucuucaguccuuugucuuucuuugucauucaguucuaggccuuuccucugcacgcucaa

SEQ ID NO: 352460 - RNA, 64 nt, Human
auaaaguuaaguucauuaggaauauaaaaacuugcaguucuaugauagauugcauuuauuaaaa

SEQ ID NO: 352461 - RNA, 64 nt, Human
aaugagcagucagucucaagagguuacugcacuucaguucuaacuagacauuuguacuaaggua

SEQ ID NO: 352462 - RNA, 64 nt, Human
cccuuucagaaucuuuucaauggguuuuaauuuucaguucuauuuaaaauggugaaugacacua

SEQ ID NO: 352463 - RNA, 64 nt, Human
cuagcugaacuuauuuuggcauuuucaaugugaucaguucuagaccuagaagggggucaggcug

SEQ ID NO: 352464 - RNA, 64 nt, Human
gcagaaccagucaggcuuauuucaguaaguuccacaguucuacaagacugcaggaauucuccuu

SEQ ID NO: 352465 - RNA, 64 nt, Human
uaacauuuuuuggacacuuacuaugugcgaggcacaguucuauguuuuuuacauguaauaaagc

SEQ ID NO: 352466 - RNA, 64 nt, Human
cauuuagcaguagaugugcauuauuaugagaaaacaguucuauaaguccaggguuaauuauauu

SEQ ID NO: 352467 - RNA, 64 nt, Human
gcauccucuuuauucaguauaagccggcagcaagcaguucuaccuaacgucccacauccuucuc

SEQ ID NO: 352468 - RNA, 64 nt, Human
aaaagaaacauaaaaguauguuguguauuacugacaguucuagauuaauuucuuuuagaauuaa

SEQ ID NO: 352469 - RNA, 64 nt, Human
cccaagguaacccgauaugauuuaggaugcauaucaguucuaacaauucaaucagaagucaagc

SEQ ID NO: 352470 - RNA, 64 nt, Human
cagacuggagggcaagggguucccuugagggcugcaguucuacucaggcugguggagaacucug

SEQ ID NO: 352471 - RNA, 64 nt, Human
cacccacucccuucauacaaucuagucagaauagcaguucuagagcacagguucucagucuaag

SEQ ID NO: 352472 - RNA, 64 nt, Human
aggauucuccacuucuuccagcccugcugggccacaguucuaacugcccuuccucccaggcccu

SEQ ID NO: 352473 - RNA, 64 nt, Human
ccugguuucucaguuacugagagaggccugugaacaguucuagcuaugaucaugaacauguguu

SEQ ID NO: 352474 - RNA, 64 nt, Human
ucucgacaccagaaaugcaucggaggaccacaaucaguucuaugcugccaaagauuaaaaauaa

SEQ ID NO: 352475 - RNA, 64 nt, Human
uguuucuuuugcccccuuggaacacauuggucagcaguucuaagagacacugcccacaugaugg

SEQ ID NO: 352476 - RNA, 64 nt, Human
uucuguacacacccacgugcacuucacgggugaucaguucuaguaccuacuugaaacagugucu

SEQ ID NO: 352477 - RNA, 64 nt, Human
gaguacaaaauccucugagaugaagcaaccuauccaguucuauggaaugaauggagaaucuuuc

SEQ ID NO: 352478 - RNA, 64 nt, Human
accagaagcagaugccagcgccaugcuuccuauacaguucuaugcagaacagugagccaaauaa

SEQ ID NO: 352479 - RNA, 64 nt, Human
uucccuuguaaauuuucuugauaaaugaggcaaacaguucuaagaucuuugauaaacaucugcu

SEQ ID NO: 352480 - RNA, 64 nt, Human
aauacauuggaacacuaggaaaguuuuuaaauaacaguucuaauuuaucagaaaauuguguuuu

SEQ ID NO: 352481 - RNA, 64 nt, Human
ccaaauuaacucuuguggacagucccuaaaaguccaguucuacauuugugaaaauuguggugcc

SEQ ID NO: 352482 - RNA, 64 nt, Human
aaagcagagccaaggagcugcuucucucuucucccaguucuaccuccccagaagccuuccuccc

SEQ ID NO: 352483 - RNA, 64 nt, Human
uaagccccuuugaaauguauaaaaaguucauuuacaguucuaaauguaauguuuuuaagccuuc

SEQ ID NO: 352484 - RNA, 64 nt, Human
uaucaguguuaauagcaucucagcuuccucagaucaguucuaucacuggcacuacagaauccuu

SEQ ID NO: 352485 - RNA, 64 nt, Human
ggaagcacgacagggcugauggugaggaucagagcaguucuaaggugacucguugggguaagga

SEQ ID NO: 352486 - RNA, 64 nt, Human
cugggugauaauuauuuagaugugaauguuaggucaguucuacuguaauaacuaaucguaaaag

SEQ ID NO: 352487 - RNA, 64 nt, Human
aggugaagaagugggaauaauuggaacuaaacaacaguucuaaaacuuccaugauuuuuguagc

SEQ ID NO: 352488 - RNA, 64 nt, Human
aagugaaaaaggacaagaucaauucuuuucuagucaguucuaagacugcuagagagagauacca

SEQ ID NO: 352489 - RNA, 64 nt, Human
gccaaguauuugccagugcuuaaauuacaccauacaguucuaauuauauauaaucuuuuguucu

SEQ ID NO: 352490 - RNA, 64 nt, Human
cugacucaaacuccucccuuuuaucuucuagccacaguucuaagacccaaagugggggguggac

SEQ ID NO: 352491 - RNA, 64 nt, Human
aggcuaucuuccagauuccuuaagugccguuguucaguucuaaucacacuaaucaaaaagaaac

SEQ ID NO: 352492 - RNA, 64 nt, Human
auuccuuguagagcugcugcaauucuuagaggggcaguucuaccuccucugucccucggcagaa

SEQ ID NO: 352493 - RNA, 64 nt, Human
acuuccucaaaacaaacaagagauggcaaagcagcaguucuaccaagcccauuggaauuauccu

SEQ ID NO: 352494 - RNA, 64 nt, Human
cuaaucuaugugcuugaacauucuaaaacgaguccaguucuaguaaccuaaaguaaauuuguua

SEQ ID NO: 352495 - RNA, 64 nt, Human
uagguaguggggaccaaguucauuaccucccuaucaguucuagcauaguaaacuacgguaccag

SEQ ID NO: 352496 - RNA, 53 nt, Human
ccgaacagucauugaucuagcagcaguucuagccucuaaagauaguaaggaag

SEQ ID NO: 352497 - RNA, 64 nt, Human
uuguagguccuguguguggaaccaacuauaaacccaguucuaaaguuguguaugauggugaacc

SEQ ID NO: 352498 - RNA, 64 nt, Human
acuuaaaaccuaagacauguggcgaaauuccauccaguucuaagugaaagaguuucagaaggca

SEQ ID NO: 352499 - RNA, 64 nt, Human
gguaaacucuccucccgaaacuacugaccacccacaguucuacuaacuauauuaccuguccuuu

SEQ ID NO: 352500 - RNA, 64 nt, Human
auucucaggaauuaaggacucaccauaacauugucaguucuaaugaaauuuuguaaaagauggc

SEQ ID NO: 352501 - RNA, 64 nt, Human
ucaggcaauuacugaaauaggaggguggcaagaacaguucuauccuggugccuuacgaauaaaa

SEQ ID NO: 352502 - RNA, 64 nt, Human
auaguauaguuauuguuuguuuuuaagaaaagcucaguucuagagacauacuauuacuuuagga

SEQ ID NO: 352503 - RNA, 64 nt, Human
gggcccaugggguggaagcccccagaugacugagcaguucuacaaaagaauggccagcacgagc

SEQ ID NO: 352504 - RNA, 64 nt, Human
ggaagcaagccauugccuuacucuugauuuucaacaguucuaaacagcaacagcauccaccuaa

SEQ ID NO: 352505 - RNA, 64 nt, Human
gcagcccuggccccgcggugcaugaggcugggugcaguucuaaaccuacauucucgauuuuucu

SEQ ID NO: 352506 - RNA, 64 nt, Human
uucuguucccauguuugcuaaggauaauggucuccaguucuaccgauguucccacaaaagacau

SEQ ID NO: 352507 - RNA, 64 nt, Human
uucaaauacuucuuaaaauuuuauacaguugggccaguucuagaaagucugaugucucaaaggg

SEQ ID NO: 352508 - RNA, 64 nt, Human
ucacacauacacuugaaaaaacuuucagccuagccaguucuagccccuguccucuuagauauau

SEQ ID NO: 352509 - RNA, 64 nt, Human
gagccccauucccagccccuggucucccgugccgcaguucuauauucugcuucaaaucagccuu

SEQ ID NO: 352510 - RNA, 64 nt, Human
uauauucuauuuguauggaauucuuauucaaauacaguucuauuaaagaguauacuccuauugg

SEQ ID NO: 352511 - RNA, 64 nt, Human
guugggcaugagccuggagagaugugacugucuacaguucuauuuguauauauaaaaagaagac

SEQ ID NO: 352512 - RNA, 64 nt, Human
agcaucugugccccuugaauugcuuaggugcagacaguucuaaagcaaggagcugcagcauucu

SEQ ID NO: 352513 - RNA, 64 nt, Human
aaugauuuaguuucuggcucuuagacucaucuggcaguucuacacaugaaacaucuuuuguuau

SEQ ID NO: 352514 - RNA, 64 nt, Human
ucaauugagcugguugaauacuuugaaaaaugcucaguucuaacuaaugaaauggauuucccag

SEQ ID NO: 352515 - RNA, 64 nt, Human
aauaucuaaacaauuauccuuguuacugcuuugccaguucuacguuauuuacaauuauucagcu

SEQ ID NO: 352516 - RNA, 64 nt, Human
aauucaucaagcaauuucccuccaacaagggcugcaguucuagugauaaauagcaucuuuagcu

SEQ ID NO: 352517 - RNA, 64 nt, Human
caacuuuggaaaaauggauuugacaguacauaaucaguucuacuaaccaaagcuuguauuugga

SEQ ID NO: 352518 - RNA, 57 nt, Human
ucuucagugaggcgugcuagaccugagcaguucuacccucccaaggcaccaguacuc

SEQ ID NO: 352519 - RNA, 64 nt, Human
ugaaguguaauauagguuguagaauuguuaccugcaguucuaugguuuuguuucacuucuuuuc

SEQ ID NO: 352520 - RNA, 64 nt, Human
acauuccuagagaggagccaaguucuaguaguuucaguucuaggcuuuccuucaagaacaguca

SEQ ID NO: 352521 - RNA, 64 nt, Human
aggcagcuggaauggcaagugcagaaaauaggaacaguucuauacagugcucucauuuacuaau

SEQ ID NO: 352522 - RNA, 64 nt, Human
gugccauaccuguuucuuccugugacuguagagacaguucuagaccuuugugauagaacuaaaa

SEQ ID NO: 352523 - RNA, 64 nt, Human
auauaauguuugcuuaauuauaucaugugaugcucaguucuauuuugauuuauucauuaguauu

SEQ ID NO: 352524 - RNA, 64 nt, Human
aaacucugaaacuucaguauaaauguaaauauaucaguucuauaagcaggauuugaguaauuac

SEQ ID NO: 352525 - RNA, 64 nt, Human
uuccauuuguguuuuauuauuuucuguccuaugacaguucuaugcuaaauguauuuuaaaauaa

SEQ ID NO: 352526 - RNA, 64 nt, Human
aggaggcccuuuaaagacggaacaaguaauuuaccaguucuacugggguuccugcccaccgucc

SEQ ID NO: 352527 - RNA, 64 nt, Human
ggaauaguuucuugggggacucacucacuggugccaguucuaagucagagacaaaauuccacug

SEQ ID NO: 352528 - RNA, 64 nt, Human
uuuuuugucaucucuguugucaacaggauuaacucaguucuaguguaguguuuacugaauuucc

SEQ ID NO: 352529 - RNA, 64 nt, Human
aaggacaguugaaaagggcaagaggaaaccagggcaguucuagaggagugcuggugacuggaua

SEQ ID NO: 352530 - RNA, 64 nt, Human
uguaauuccaaugagauugaaacuuuggaauugacaguucuaaagugcauuugggagagugaau

SEQ ID NO: 352531 - RNA, 64 nt, Human
cucuuuguaaauguugugcucaacuucuaggggccaguucuagacuuuggagaugcagugucuc

SEQ ID NO: 352532 - RNA, 64 nt, Human
auuuaagcaagguaagaugagaagcaaggggucucaguucuaggaauacagugcuaguugauug

SEQ ID NO: 352533 - RNA, 64 nt, Human
ccagucugcccacugaggggcuagggcuggaagccaguucuaggcuuccaggcgaaagcugagg

SEQ ID NO: 352534 - RNA, 64 nt, Human
acuaaaccuucuccacuaaacgucguuagggccucaguucuagacgagucauaccugauucacc

SEQ ID NO: 352535 - RNA, 64 nt, Human
ccaugacuagccugguggcguguuaguuucugcccaguucuacccccucaugugcuucuucuga

SEQ ID NO: 352536 - RNA, 64 nt, Human
auucccuuauuuauugauauuuaguccagaacaccaguucuaacgaagcaugcgugucucuuca

SEQ ID NO: 352537 - RNA, 64 nt, Human
agaaaaacccaacaggaaacacagacacauccuccaguucuaucaauggauugugcagacacug

SEQ ID NO: 352538 - RNA, 64 nt, Human
uuugaauuugugggguagaacuucaacaauaagucaguucuaguggcugucgccuggggacuag

SEQ ID NO: 352539 - RNA, 64 nt, Human
augcagcauuaccugcuggacagagcagggcaggcaguucuaugccuuggagcuccugacugca

SEQ ID NO: 352540 - RNA, 64 nt, Human
uuuucaccucuccaguuuuuccaagugauacucccaguucuagagcaaucuacagcuguuuaug

SEQ ID NO: 352541 - RNA, 64 nt, Human
gagacuuggggaaauugcuuuuccucuugaaccacaguucuaccccugggauguuuugaggguc

SEQ ID NO: 352542 - RNA, 64 nt, Human
ggagugccaggcaggggcugccgagaugcgggagcaguucuaccacuccugcaagcaguauggc

SEQ ID NO: 352543 - RNA, 64 nt, Human
gagauaaggggccaggagggauugaaaggcaucccaguucuaaggcugcugcuaauuacagccc

SEQ ID NO: 352544 - RNA, 64 nt, Human
uguaccuguccgucaguguguggauguauguuuacaguucuacauaaaugggaucauuuuauac

SEQ ID NO: 352545 - RNA, 64 nt, Human
ugaaaauuuacaucaaacuaguguuuuaauaugacaguucuaguguuguuuaagucuaagugaa

SEQ ID NO: 352546 - RNA, 64 nt, Human
ucagggacagguaucugugugucauuauacaaaacaguucuaggggguugaacuacauaguaaa

SEQ ID NO: 352547 - RNA, 64 nt, Human
cagccagcauuggugaauauucaguuuaggggaacaguucuagggagugagacauuuuugggag

SEQ ID NO: 352548 - RNA, 64 nt, Human
ggauaaaugggaugcccuugccccagagagaacccaguucuagguacugucugggccugggagg

SEQ ID NO: 352549 - RNA, 64 nt, Human
cuuacuaaguggaaugagccgaggauuugaauaucaguucuaaccuugauagaagaaccuuggg

SEQ ID NO: 352550 - RNA, 64 nt, Human
gguguucccuggcccacucuccucucuccuucugcaguucuaaaccacagucuauaagcccgag

SEQ ID NO: 352551 - RNA, 64 nt, Human
aggguaccgucuguuuacacguccaguuaggcuacaguucuauguacugagaaaccuuuaagcu

SEQ ID NO: 352552 - RNA, 64 nt, Human
acaaaaccccuaagagacugcguucugcaagcaucaguucuacggaucaucaacaagauuuccu

SEQ ID NO: 352553 - RNA, 64 nt, Human
uuugcuuucuuuucuuucucuuuuuuucuuagcacaguucuagcucaaauuuguguauuuuuug

SEQ ID NO: 352554 - RNA, 64 nt, Human
ggguagagucucuggaagguuuuaagcccauuuucaguucuaacuuacuuucauccuauuuugc

SEQ ID NO: 352555 - RNA, 64 nt, Human
cagaauucuggaucacccaagaggaaaagacuggcaguucuagauuccucuauauggggagacc

SEQ ID NO: 352556 - RNA, 64 nt, Human
uuuuccucuacaggccuauaagaagcagguacuucaguucuaaauucugacuuguguucuuuuc

SEQ ID NO: 352557 - RNA, 64 nt, Human
ucaccaccuuuuaaauuuuggucacuguauguaucaguucuaaaauuuccauuuuguucucuau

SEQ ID NO: 352558 - RNA, 64 nt, Human
acuagcaaaacaucuuuuccugauggcuggcaggcaguucuagaagccacagugcccaccugcu

SEQ ID NO: 352559 - RNA, 64 nt, Human
acuuucccucugucuuccuucuuuauacuuuucucaguucuacuuaugacaccucacuucccua

SEQ ID NO: 352560 - RNA, 64 nt, Human
uguucauucuggggauaaaggggaacuaggcuagcaguucuaaugugacauucuuuaagcauau

SEQ ID NO: 352561 - RNA, 64 nt, Human
uauugauguacuagauuuguguaugucuuuuaaacaguucuaguuucaccuuacacagaauaau

SEQ ID NO: 352562 - RNA, 64 nt, Human
ucaccagcaacucugacucuuugacgggaggccucaguucuaguccuuggucugcuggugucau

SEQ ID NO: 352563 - RNA, 64 nt, Human
uuugguuuuuugaacugguauguggggugguucacaguucuaauguaagcacucuauucuccaa

SEQ ID NO: 352564 - RNA, 64 nt, Human
ucaugguggaaaaaguuggaaacacagaucugugcaguucuacauucacugauuauuacagugu

SEQ ID NO: 352565 - RNA, 64 nt, Human
uacuugauguuggucauuucucaguccuauuucucaguucuauuauuuuagaaccuagucaguu

SEQ ID NO: 352566 - RNA, 64 nt, Human
uugcaaaauugccacauuuaaauuguuuuacuggcaguucuauaguaguccagacuuuagaaac

SEQ ID NO: 352567 - RNA, 64 nt, Human
uccuuccuaugcccagguaccacccuucagaccccaguucuaggggagaagagcccuggacacc

SEQ ID NO: 352568 - RNA, 64 nt, Human
cugcugagucacuugucuguccacccacccagcccaguucuaggucguuccccagcaccuccag

SEQ ID NO: 352569 - RNA, 64 nt, Human
ucacccccuuauguugguguuuggcgugugacagcaguucuacagagcucuguguuggggucau

SEQ ID NO: 352570 - RNA, 64 nt, Human
guguguuccugggcuugugugguacuuagaaccucaguucuauuacguuauagucagacauuuu

SEQ ID NO: 352571 - RNA, 64 nt, Human
aguuuaauauaugaggcuuucuuugauuccuccucaguucuaccuaguuucacagaggaaaaaa

SEQ ID NO: 352572 - RNA, 64 nt, Human
uccaggaauuguagacauuaaggaauuucacuuucaguucuacccacuacuuaaguacuuguca

SEQ ID NO: 352573 - RNA, 64 nt, Human
guggcacaggcaccguccuguugaucucacaacacaguucuaaguuaggacguucuuggcuccg

SEQ ID NO: 352574 - RNA, 64 nt, Human
uuuccuucccuaggacuaugcccagucucgguuccaguucuacuuccagcagaaggggcagcug

SEQ ID NO: 352575 - RNA, 56 nt, Human
accagcacgggcuucaguaguggacccaguucuauuguuggcuucagcgguggacc

SEQ ID NO: 352576 - RNA, 64 nt, Human
aggggcccuagaaagggccuaguuacuauccugucaguucuaacaguaguggaacaggagaauc

SEQ ID NO: 352577 - RNA, 64 nt, Human
ucucuaauucuaaagagagagcuauagauuucugcaguucuagaggugaagauagagacauaga

SEQ ID NO: 352578 - RNA, 64 nt, Human
cugggaccuaauaaaaggaggaaauguuuucccacaguucuagggacaggacucugaggugggu

SEQ ID NO: 352579 - RNA, 64 nt, Human
cuucuucaaaguuaauuuugucaacauauuucagcaguucuacuuucccguacauuuuuuagaa

SEQ ID NO: 352580 - RNA, 64 nt, Human
uuguuuuauaguauuaagugaaauuuuaaaugcacaguucuauuugcuaucugaacuaauucau

SEQ ID NO: 352581 - RNA, 64 nt, Human
ggaugacgcaaggaguuccuuugugcugauggaacaguucuauaugauuaugaugauuacgaug

SEQ ID NO: 352582 - RNA, 64 nt, Human
gcuuaauuauaaacauauuuuuauaucaaauauacaguucuaauauaaaaguuauaaauaauua

SEQ ID NO: 352583 - RNA, 64 nt, Human
cuuugaaaugcuaacagaauucccaagcuuuuuccaguucuagauaucuuuacuagaccuuugg

SEQ ID NO: 352584 - RNA, 64 nt, Human; identical to SEQ ID NO: 303272

SEQ ID NO: 352585 - RNA, 64 nt, Human; identical to SEQ ID NO: 303289

SEQ ID NO: 352586 - RNA, 64 nt, Human; identical to SEQ ID NO: 303290

SEQ ID NO: 352587 - RNA, 64 nt, Human; identical to SEQ ID NO: 303291

SEQ ID NO: 352588 - RNA, 64 nt, Human; identical to SEQ ID NO: 303292

SEQ ID NO: 352589 - RNA, 64 nt, Human; identical to SEQ ID NO: 303293

SEQ ID NO: 352590 - RNA, 55 nt, Human; identical to SEQ ID NO: 303294

SEQ ID NO: 352591 - RNA, 64 nt, Human; identical to SEQ ID NO: 303295

SEQ ID NO: 352592 - RNA, 64 nt, Human; identical to SEQ ID NO: 303296

SEQ ID NO: 352593 - RNA, 64 nt, Human; identical to SEQ ID NO: 303297

SEQ ID NO: 352594 - RNA, 64 nt, Human; identical to SEQ ID NO: 303298

SEQ ID NO: 352595 - RNA, 64 nt, Human; identical to SEQ ID NO: 303299

SEQ ID NO: 352596 - RNA, 64 nt, Human; identical to SEQ ID NO: 303300

SEQ ID NO: 352597 - RNA, 64 nt, Human; identical to SEQ ID NO: 303301

SEQ ID NO: 352598 - RNA, 64 nt, Human; identical to SEQ ID NO: 303302

SEQ ID NO: 352599 - RNA, 64 nt, Human; identical to SEQ ID NO: 303303

SEQ ID NO: 352600 - RNA, 64 nt, Human; identical to SEQ ID NO: 303307

SEQ ID NO: 352601 - RNA, 64 nt, Human; identical to SEQ ID NO: 303308

SEQ ID NO: 352602 - RNA, 64 nt, Human; identical to SEQ ID NO: 303309

SEQ ID NO: 352603 - RNA, 64 nt, Human; identical to SEQ ID NO: 303310

SEQ ID NO: 352604 - RNA, 64 nt, Human; identical to SEQ ID NO: 303311

SEQ ID NO: 352605 - RNA, 64 nt, Human; identical to SEQ ID NO: 303312

SEQ ID NO: 352606 - RNA, 64 nt, Human; identical to SEQ ID NO: 303313

SEQ ID NO: 352607 - RNA, 64 nt, Human; identical to SEQ ID NO: 303314

SEQ ID NO: 352608 - RNA, 64 nt, Human; identical to SEQ ID NO: 303315

SEQ ID NO: 352609 - RNA, 64 nt, Human; identical to SEQ ID NO: 303316

SEQ ID NO: 352610 - RNA, 64 nt, Human; identical to SEQ ID NO: 303317

SEQ ID NO: 352611 - RNA, 64 nt, Human; identical to SEQ ID NO: 303318

SEQ ID NO: 352612 - RNA, 64 nt, Human; identical to SEQ ID NO: 303319

SEQ ID NO: 352613 - RNA, 64 nt, Human; identical to SEQ ID NO: 303320

SEQ ID NO: 352614 - RNA, 64 nt, Human; identical to SEQ ID NO: 303321

SEQ ID NO: 352615 - RNA, 64 nt, Human; identical to SEQ ID NO: 303325

SEQ ID NO: 352616 - RNA, 64 nt, Human; identical to SEQ ID NO: 303326

SEQ ID NO: 352617 - RNA, 64 nt, Human; identical to SEQ ID NO: 303327

SEQ ID NO: 352618 - RNA, 64 nt, Human; identical to SEQ ID NO: 303328

SEQ ID NO: 352619 - RNA, 64 nt, Human; identical to SEQ ID NO: 303329

SEQ ID NO: 352620 - RNA, 64 nt, Human; identical to SEQ ID NO: 303330

SEQ ID NO: 352621 - RNA, 64 nt, Human; identical to SEQ ID NO: 303331

SEQ ID NO: 352622 - RNA, 60 nt, Human; identical to SEQ ID NO: 303332

SEQ ID NO: 352623 - RNA, 64 nt, Human; identical to SEQ ID NO: 303333

SEQ ID NO: 352624 - RNA, 64 nt, Human; identical to SEQ ID NO: 303334

SEQ ID NO: 352625 - RNA, 64 nt, Human; identical to SEQ ID NO: 303335

SEQ ID NO: 352626 - RNA, 64 nt, Human; identical to SEQ ID NO: 303336

SEQ ID NO: 352627 - RNA, 64 nt, Human; identical to SEQ ID NO: 303337

SEQ ID NO: 352628 - RNA, 64 nt, Human; identical to SEQ ID NO: 303338

SEQ ID NO: 352629 - RNA, 64 nt, Human; identical to SEQ ID NO: 303339

SEQ ID NO: 352630 - RNA, 64 nt, Human; identical to SEQ ID NO: 303343

SEQ ID NO: 352631 - RNA, 64 nt, Human; identical to SEQ ID NO: 303344

SEQ ID NO: 352632 - RNA, 61 nt, Human; identical to SEQ ID NO: 303345

SEQ ID NO: 352633 - RNA, 64 nt, Human; identical to SEQ ID NO: 303346

SEQ ID NO: 352634 - RNA, 64 nt, Human; identical to SEQ ID NO: 303347

SEQ ID NO: 352635 - RNA, 64 nt, Human; identical to SEQ ID NO: 303348

SEQ ID NO: 352636 - RNA, 64 nt, Human; identical to SEQ ID NO: 303349

SEQ ID NO: 352637 - RNA, 64 nt, Human; identical to SEQ ID NO: 303350

SEQ ID NO: 352638 - RNA, 64 nt, Human; identical to SEQ ID NO: 303351

SEQ ID NO: 352639 - RNA, 64 nt, Human; identical to SEQ ID NO: 303352

SEQ ID NO: 352640 - RNA, 64 nt, Human; identical to SEQ ID NO: 303353

SEQ ID NO: 352641 - RNA, 64 nt, Human; identical to SEQ ID NO: 303354

SEQ ID NO: 352642 - RNA, 64 nt, Human; identical to SEQ ID NO: 303355

SEQ ID NO: 352643 - RNA, 64 nt, Human; identical to SEQ ID NO: 303356

SEQ ID NO: 352644 - RNA, 64 nt, Human; identical to SEQ ID NO: 303357

SEQ ID NO: 352645 - RNA, 64 nt, Human; identical to SEQ ID NO: 303361

SEQ ID NO: 352646 - RNA, 64 nt, Human; identical to SEQ ID NO: 303362

SEQ ID NO: 352647 - RNA, 64 nt, Human; identical to SEQ ID NO: 303363

SEQ ID NO: 352648 - RNA, 64 nt, Human; identical to SEQ ID NO: 303364

SEQ ID NO: 352649 - RNA, 64 nt, Human; identical to SEQ ID NO: 303365

SEQ ID NO: 352650 - RNA, 64 nt, Human; identical to SEQ ID NO: 303366

SEQ ID NO: 352651 - RNA, 64 nt, Human; identical to SEQ ID NO: 303367

SEQ ID NO: 352652 - RNA, 64 nt, Human; identical to SEQ ID NO: 303368

SEQ ID NO: 352653 - RNA, 64 nt, Human; identical to SEQ ID NO: 303369

SEQ ID NO: 352654 - RNA, 64 nt, Human; identical to SEQ ID NO: 303370

SEQ ID NO: 352655 - RNA, 64 nt, Human; identical to SEQ ID NO: 303371

SEQ ID NO: 352656 - RNA, 64 nt, Human; identical to SEQ ID NO: 303372

SEQ ID NO: 352657 - RNA, 64 nt, Human; identical to SEQ ID NO: 303373

SEQ ID NO: 352658 - RNA, 64 nt, Human; identical to SEQ ID NO: 303374

SEQ ID NO: 352659 - RNA, 64 nt, Human; identical to SEQ ID NO: 303375

SEQ ID NO: 352660 - RNA, 64 nt, Human; identical to SEQ ID NO: 303379

SEQ ID NO: 352661 - RNA, 64 nt, Human; identical to SEQ ID NO: 303380

SEQ ID NO: 352662 - RNA, 64 nt, Human; identical to SEQ ID NO: 303381

SEQ ID NO: 352663 - RNA, 64 nt, Human; identical to SEQ ID NO: 303382

SEQ ID NO: 352664 - RNA, 64 nt, Human; identical to SEQ ID NO: 303383

SEQ ID NO: 352665 - RNA, 64 nt, Human; identical to SEQ ID NO: 303384

SEQ ID NO: 352666 - RNA, 64 nt, Human; identical to SEQ ID NO: 303385

SEQ ID NO: 352667 - RNA, 64 nt, Human; identical to SEQ ID NO: 303386

SEQ ID NO: 352668 - RNA, 64 nt, Human; identical to SEQ ID NO: 303387

SEQ ID NO: 352669 - RNA, 64 nt, Human; identical to SEQ ID NO: 303388

SEQ ID NO: 352670 - RNA, 64 nt, Human; identical to SEQ ID NO: 303389

SEQ ID NO: 352671 - RNA, 64 nt, Human; identical to SEQ ID NO: 303390

SEQ ID NO: 352672 - RNA, 64 nt, Human; identical to SEQ ID NO: 303391

SEQ ID NO: 352673 - RNA, 64 nt, Human; identical to SEQ ID NO: 303392

SEQ ID NO: 352674 - RNA, 64 nt, Human; identical to SEQ ID NO: 303393

SEQ ID NO: 352675 - RNA, 64 nt, Human; identical to SEQ ID NO: 303397

SEQ ID NO: 352676 - RNA, 64 nt, Human; identical to SEQ ID NO: 303398

SEQ ID NO: 352677 - RNA, 64 nt, Human; identical to SEQ ID NO: 303399

SEQ ID NO: 352678 - RNA, 64 nt, Human; identical to SEQ ID NO: 303400

SEQ ID NO: 352679 - RNA, 64 nt, Human; identical to SEQ ID NO: 303401

SEQ ID NO: 352680 - RNA, 64 nt, Human; identical to SEQ ID NO: 303402

SEQ ID NO: 352681 - RNA, 64 nt, Human; identical to SEQ ID NO: 303403

SEQ ID NO: 352682 - RNA, 64 nt, Human; identical to SEQ ID NO: 303405

SEQ ID NO: 352683 - RNA, 64 nt, Human; identical to SEQ ID NO: 303406

SEQ ID NO: 352684 - RNA, 64 nt, Human; identical to SEQ ID NO: 303404

SEQ ID NO: 352685 - RNA, 64 nt, Human; identical to SEQ ID NO: 303407

SEQ ID NO: 352686 - RNA, 64 nt, Human; identical to SEQ ID NO: 303408

SEQ ID NO: 352687 - RNA, 64 nt, Human; identical to SEQ ID NO: 303409

SEQ ID NO: 352688 - RNA, 64 nt, Human; identical to SEQ ID NO: 303410

SEQ ID NO: 352689 - RNA, 64 nt, Human; identical to SEQ ID NO: 303411

SEQ ID NO: 352690 - RNA, 64 nt, Human; identical to SEQ ID NO: 303415

SEQ ID NO: 352691 - RNA, 64 nt, Human; identical to SEQ ID NO: 303416

SEQ ID NO: 352692 - RNA, 64 nt, Human; identical to SEQ ID NO: 303417

SEQ ID NO: 352693 - RNA, 64 nt, Human; identical to SEQ ID NO: 303418

SEQ ID NO: 352694 - RNA, 64 nt, Human; identical to SEQ ID NO: 303419

SEQ ID NO: 352695 - RNA, 64 nt, Human; identical to SEQ ID NO: 303420

SEQ ID NO: 352696 - RNA, 64 nt, Human; identical to SEQ ID NO: 303421

SEQ ID NO: 352697 - RNA, 64 nt, Human; identical to SEQ ID NO: 303422

SEQ ID NO: 352698 - RNA, 64 nt, Human; identical to SEQ ID NO: 303423

SEQ ID NO: 352699 - RNA, 64 nt, Human; identical to SEQ ID NO: 303424

SEQ ID NO: 352700 - RNA, 64 nt, Human; identical to SEQ ID NO: 303425

SEQ ID NO: 352701 - RNA, 60 nt, Human; identical to SEQ ID NO: 303452

SEQ ID NO: 352702 - RNA, 64 nt, Human; identical to SEQ ID NO: 303453

SEQ ID NO: 352703 - RNA, 64 nt, Human; identical to SEQ ID NO: 303454

SEQ ID NO: 352704 - RNA, 64 nt, Human; identical to SEQ ID NO: 303426

SEQ ID NO: 352705 - RNA, 64 nt, Human; identical to SEQ ID NO: 303427

SEQ ID NO: 352706 - RNA, 64 nt, Human; identical to SEQ ID NO: 303428

SEQ ID NO: 352707 - RNA, 64 nt, Human; identical to SEQ ID NO: 303429

SEQ ID NO: 352708 - RNA, 64 nt, Human; identical to SEQ ID NO: 303433

SEQ ID NO: 352709 - RNA, 64 nt, Human; identical to SEQ ID NO: 303434

SEQ ID NO: 352710 - RNA, 64 nt, Human; identical to SEQ ID NO: 303435

SEQ ID NO: 352711 - RNA, 64 nt, Human; identical to SEQ ID NO: 303436

SEQ ID NO: 352712 - RNA, 64 nt, Human; identical to SEQ ID NO: 303437

SEQ ID NO: 352713 - RNA, 64 nt, Human; identical to SEQ ID NO: 303438

SEQ ID NO: 352714 - RNA, 64 nt, Human; identical to SEQ ID NO: 303439

SEQ ID NO: 352715 - RNA, 64 nt, Human; identical to SEQ ID NO: 303440

SEQ ID NO: 352716 - RNA, 64 nt, Human; identical to SEQ ID NO: 303441

SEQ ID NO: 352717 - RNA, 64 nt, Human; identical to SEQ ID NO: 303442

SEQ ID NO: 352718 - RNA, 64 nt, Human; identical to SEQ ID NO: 303443

SEQ ID NO: 352719 - RNA, 64 nt, Human; identical to SEQ ID NO: 303444

SEQ ID NO: 352720 - RNA, 64 nt, Human; identical to SEQ ID NO: 303445

SEQ ID NO: 352721 - RNA, 64 nt, Human; identical to SEQ ID NO: 303446

SEQ ID NO: 352722 - RNA, 64 nt, Human; identical to SEQ ID NO: 303447

SEQ ID NO: 352723 - RNA, 64 nt, Human; identical to SEQ ID NO: 303451

SEQ ID NO: 352724 - RNA, 64 nt, Human; identical to SEQ ID NO: 303455

SEQ ID NO: 352725 - RNA, 52 nt, Human; identical to SEQ ID NO: 303456

SEQ ID NO: 352726 - RNA, 64 nt, Human; identical to SEQ ID NO: 303457

SEQ ID NO: 352727 - RNA, 64 nt, Human; identical to SEQ ID NO: 303458

SEQ ID NO: 352728 - RNA, 64 nt, Human; identical to SEQ ID NO: 303459

SEQ ID NO: 352729 - RNA, 64 nt, Human; identical to SEQ ID NO: 303460

SEQ ID NO: 352730 - RNA, 64 nt, Human; identical to SEQ ID NO: 303461

SEQ ID NO: 352731 - RNA, 64 nt, Human; identical to SEQ ID NO: 303462

SEQ ID NO: 352732 - RNA, 64 nt, Human; identical to SEQ ID NO: 303463

SEQ ID NO: 352733 - RNA, 64 nt, Human; identical to SEQ ID NO: 303464

SEQ ID NO: 352734 - RNA, 64 nt, Human; identical to SEQ ID NO: 303465

SEQ ID NO: 352735 - RNA, 64 nt, Human; identical to SEQ ID NO: 303469

SEQ ID NO: 352736 - RNA, 64 nt, Human; identical to SEQ ID NO: 303470

SEQ ID NO: 352737 - RNA, 64 nt, Human; identical to SEQ ID NO: 303471

SEQ ID NO: 352738 - RNA, 64 nt, Human; identical to SEQ ID NO: 303472

SEQ ID NO: 352739 - RNA, 64 nt, Human; identical to SEQ ID NO: 303473

SEQ ID NO: 352740 - RNA, 64 nt, Human; identical to SEQ ID NO: 303474

SEQ ID NO: 352741 - RNA, 64 nt, Human; identical to SEQ ID NO: 303475

SEQ ID NO: 352742 - RNA, 54 nt, Human; identical to SEQ ID NO: 303476

SEQ ID NO: 352743 - RNA, 64 nt, Human; identical to SEQ ID NO: 303477

SEQ ID NO: 352744 - RNA, 64 nt, Human; identical to SEQ ID NO: 303478

SEQ ID NO: 352745 - RNA, 64 nt, Human; identical to SEQ ID NO: 303479

SEQ ID NO: 352746 - RNA, 64 nt, Human; identical to SEQ ID NO: 303480

SEQ ID NO: 352747 - RNA, 64 nt, Human; identical to SEQ ID NO: 303481

SEQ ID NO: 352748 - RNA, 64 nt, Human; identical to SEQ ID NO: 303482

SEQ ID NO: 352749 - RNA, 64 nt, Human; identical to SEQ ID NO: 303483

SEQ ID NO: 352750 - RNA, 64 nt, Human; identical to SEQ ID NO: 303487

SEQ ID NO: 352751 - RNA, 64 nt, Human; identical to SEQ ID NO: 303488

SEQ ID NO: 352752 - RNA, 59 nt, Human; identical to SEQ ID NO: 303489

SEQ ID NO: 352753 - RNA, 64 nt, Human; identical to SEQ ID NO: 303490

SEQ ID NO: 352754 - RNA, 64 nt, Human; identical to SEQ ID NO: 303491

SEQ ID NO: 352755 - RNA, 64 nt, Human; identical to SEQ ID NO: 303492

SEQ ID NO: 352756 - RNA, 64 nt, Human; identical to SEQ ID NO: 303493

SEQ ID NO: 352757 - RNA, 64 nt, Human; identical to SEQ ID NO: 303494

SEQ ID NO: 352758 - RNA, 64 nt, Human; identical to SEQ ID NO: 303495

SEQ ID NO: 352759 - RNA, 64 nt, Human; identical to SEQ ID NO: 303496

SEQ ID NO: 352760 - RNA, 64 nt, Human; identical to SEQ ID NO: 303497

SEQ ID NO: 352761 - RNA, 64 nt, Human; identical to SEQ ID NO: 303498

SEQ ID NO: 352762 - RNA, 64 nt, Human; identical to SEQ ID NO: 303499

SEQ ID NO: 352763 - RNA, 64 nt, Human; identical to SEQ ID NO: 303500

SEQ ID NO: 352764 - RNA, 64 nt, Human; identical to SEQ ID NO: 303501

SEQ ID NO: 352765 - RNA, 64 nt, Human; identical to SEQ ID NO: 303505

SEQ ID NO: 352766 - RNA, 64 nt, Human; identical to SEQ ID NO: 303506

SEQ ID NO: 352767 - RNA, 64 nt, Human; identical to SEQ ID NO: 303507

SEQ ID NO: 352768 - RNA, 64 nt, Human; identical to SEQ ID NO: 303508

SEQ ID NO: 352769 - RNA, 64 nt, Human; identical to SEQ ID NO: 303509

SEQ ID NO: 352770 - RNA, 64 nt, Human; identical to SEQ ID NO: 303510

SEQ ID NO: 352771 - RNA, 64 nt, Human; identical to SEQ ID NO: 303511

SEQ ID NO: 352772 - RNA, 64 nt, Human; identical to SEQ ID NO: 303512

SEQ ID NO: 352773 - RNA, 64 nt, Human; identical to SEQ ID NO: 303513

SEQ ID NO: 352774 - RNA, 64 nt, Human; identical to SEQ ID NO: 303514

SEQ ID NO: 352775 - RNA, 64 nt, Human; identical to SEQ ID NO: 303515

SEQ ID NO: 352776 - RNA, 64 nt, Human; identical to SEQ ID NO: 303516

SEQ ID NO: 352777 - RNA, 64 nt, Human; identical to SEQ ID NO: 303517

SEQ ID NO: 352778 - RNA, 64 nt, Human; identical to SEQ ID NO: 303518

SEQ ID NO: 352779 - RNA, 64 nt, Human; identical to SEQ ID NO: 303519

SEQ ID NO: 352780 - RNA, 64 nt, Human; identical to SEQ ID NO: 303523

SEQ ID NO: 352781 - RNA, 64 nt, Human; identical to SEQ ID NO: 303524

SEQ ID NO: 352782 - RNA, 64 nt, Human; identical to SEQ ID NO: 303525

SEQ ID NO: 352783 - RNA, 64 nt, Human; identical to SEQ ID NO: 303526

SEQ ID NO: 352784 - RNA, 64 nt, Human; identical to SEQ ID NO: 303527

SEQ ID NO: 352785 - RNA, 64 nt, Human; identical to SEQ ID NO: 303528

SEQ ID NO: 352786 - RNA, 64 nt, Human; identical to SEQ ID NO: 303529

SEQ ID NO: 352787 - RNA, 64 nt, Human; identical to SEQ ID NO: 303530

SEQ ID NO: 352788 - RNA, 62 nt, Human
acucccuuaagcccagacaucuguugagaccugaccccuagucauugguuaccaguguguca

SEQ ID NO: 352789 - RNA, 62 nt, Human
cacaucucuuuuccggauacauuauaauucuggaccccuauuuaucucaaaacucuuaauau

SEQ ID NO: 352790 - RNA, 62 nt, Human
uuuuuuuuaaugggggacaaaagagagggaaagaccccuauaaaucuauauauaacaaugua

SEQ ID NO: 352791 - RNA, 62 nt, Human
cugcacacccugccccagcccagcugccuccagaccccuaagcaucuccuguccuggccucu

SEQ ID NO: 352792 - RNA, 62 nt, Human
cugaguggggagagguugggcagugagugagggaccccuaaugcagggacuagaagccucag

SEQ ID NO: 352793 - RNA, 62 nt, Human
auuguuuuauuguauacucuuugucuuuuuaagaccccuaauagccuuuuguaacuugaugg

SEQ ID NO: 352794 - RNA, 62 nt, Human
aauaaaagaaaauuacaaaaaaaaauuuuaaagaccccuaacccuuugugugcucuccauuc

SEQ ID NO: 352795 - RNA, 62 nt, Human
aguuccccuuaucugagcaguauauguucuaagaccccuaguagauucgcaaaccacagaua

SEQ ID NO: 352796 - RNA, 62 nt, Human
gcccuuagccuuuggagcuagagcacccuugggaccccuaguuccacugcacauggcccucc

SEQ ID NO: 352797 - RNA, 62 nt, Human
uuugucaauugcaccaaaagaaugagugccuugaccccuaaugcugcauauguuacaauucu

SEQ ID NO: 352798 - RNA, 62 nt, Human
uguagggccugacaagaacauauuguuucccugaccccuaggccgucacaccacacccucca

SEQ ID NO: 352799 - RNA, 62 nt, Human
agccagauucuucugccucuuucuccuuuccagaccccuacucugugcagugcugaccacag

SEQ ID NO: 352800 - RNA, 62 nt, Human
gagagacucuggagguggugggucucucgggagaccccuaaugaggaaguugagguaaugcu

SEQ ID NO: 352801 - RNA, 62 nt, Human
ccucuaggacugguuuggggacgggugggaaugaccccuaggcaaggggaugagaccgcagg

SEQ ID NO: 352802 - RNA, 62 nt, Human
gucugcuuagaguuuacuccuacccuuccagggaccccuauccugauccccaacugaagcuu

SEQ ID NO: 352803 - RNA, 62 nt, Human
cacauuccacuaggccuuuucauuccaaaggggaccccuaugaaguaaagaacugcacauga

SEQ ID NO: 352804 - RNA, 62 nt, Human
ccccaugccugcccugcgugcugguuccuucagaccccuaacccuacuaaccagcaggcuca

SEQ ID NO: 352805 - RNA, 62 nt, Human
uaauuauaaagugaaggaccaguuggaccacggaccccuagaaacucagccaaggagaccug

SEQ ID NO: 352806 - RNA, 62 nt, Human
gcccugguuuuucaauccccagggucggguaggaccccuacuggcagccagccucuguuucu

SEQ ID NO: 352807 - RNA, 62 nt, Human
uggaaggccuuggauuuauauugcacuucauagaccccuaggcugcugugcggugggacucc

SEQ ID NO: 352808 - RNA, 62 nt, Human
gcagacuggugggguggcagauguuagccuaagaccccuagcagugccuguugcuuugugag

SEQ ID NO: 352809 - RNA, 62 nt, Human
ccccuccaugcgcugcguuccuccuccagaucgaccccuagaugccuacacaauaucuuuaa

SEQ ID NO: 352810 - RNA, 59 nt, Human
ucagcuucuuccgagggugacaggugaaagaccccuacagguaauacccuuuccuuuac

SEQ ID NO: 352811 - RNA, 62 nt, Human
gaguuuuuaaucuggacucucuggcuugcugugaccccuaaggcaaugcuucucuucccugg

SEQ ID NO: 352812 - RNA, 62 nt, Human
ccccagcacugcuguggaaccaccuggcuuaugaccccuauggaugaucuuuaggaaaagca

SEQ ID NO: 352813 - RNA, 62 nt, Human
gccaauguuuuccacccauaauccuuucugccgaccccuaguucccucugcucagccaagcu

SEQ ID NO: 352814 - RNA, 62 nt, Human
cuauacacuauuuuaagaaggggcuugagcaugaccccuaaagcuacauguaaaguucuugu

SEQ ID NO: 352815 - RNA, 62 nt, Human
gccagauggggcaggaaggcuccgcaggaccggaccccuagaccacccugccccaccugccc

SEQ ID NO: 352816 - RNA, 62 nt, Human
cuucucuucuaccccaaccccugaaacacacugaccccuauucuccagaugacagcacagcu

SEQ ID NO: 352817 - RNA, 54 nt, Human
uucaagagucacccuucuaaggaggaccccuagacugcucgcuaguggaacacg

SEQ ID NO: 352818 - RNA, 62 nt, Human
cagcagaacuggacuaauucuguggacccucagaccccuaaauggggccgucuuggaaagua

SEQ ID NO: 352819 - RNA, 62 nt, Human
aaagguagccuuuugggcuuuuuaaugaauaugaccccuauagaaaagucaagaaaaaaaaa

SEQ ID NO: 352820 - RNA, 62 nt, Human
uuugagcugagcugaagcugaugcuggggucagaccccuacagagaaccagugcuuccuucg

SEQ ID NO: 352821 - RNA, 62 nt, Human
aagcacguuucaaagaugaacacuuuuguuaagaccccuauugccucuucuucaugcucauu

SEQ ID NO: 352822 - RNA, 62 nt, Human
gggacacagauguggaauacaagaagaagcaggaccccuacuugcugaagacaggccgcuuu

SEQ ID NO: 352823 - RNA, 62 nt, Human
ggagccccauccuguguuaucugugguuuuuggaccccuaaugucagcuuggcuguaggacu

SEQ ID NO: 352824 - RNA, 62 nt, Human
gcccucacccagcccggcccccacccuguccagaccccuacagcugugucuaagcucaggag

SEQ ID NO: 352825 - RNA, 62 nt, Human
ucagaguccagucaaguucccuccugcagccugaccccuaggcagcucgagcaugcccugag

SEQ ID NO: 352826 - RNA, 62 nt, Human
aaaacaccauuugucaaagaggccuuugaagagaccccuaagaaacacagagaguguuuagu

SEQ ID NO: 352827 - RNA, 62 nt, Human
ugauuccauuuacucaugcuugcaaaacuagagaccccuaaggcagaacugagaauaaacau

SEQ ID NO: 352828 - RNA, 62 nt, Human
ggaggagaccuauggagggacaguuuugaccugaccccuagaggagacaguuuugaccucuu

SEQ ID NO: 352829 - RNA, 62 nt, Human
auaacuuguuuccgaacuagaaaagucugugagaccccuacaucauucugguuuuuuugcuu

SEQ ID NO: 352830 - RNA, 62 nt, Human
uucagccucagaguggaaucuuuuaaagacaggaccccuauguccaggaaaggggaaaagga

SEQ ID NO: 352831 - RNA, 62 nt, Human
cccuggcuacccuguuguuuucaucuaccucagaccccuaucauggggcucuacccugugac

SEQ ID NO: 352832 - RNA, 62 nt, Human
aggcagccgaccugaggccugggggcaccguggaccccuaugcccgggucagcgucuccacc

SEQ ID NO: 352833 - RNA, 62 nt, Human
agggaggguaagggggcacccugagcccacaggaccccuacuucacagcucacaggggcagg

SEQ ID NO: 352834 - RNA, 62 nt, Human
ucagcucccucuguccucugucagccuggccugaccccuacccuccagcauugcucuuccua

SEQ ID NO: 352835 - RNA, 62 nt, Human
gaaacaggggacccccucaccuccugggcagugaccccuacuaggcucccauuccagguacu

SEQ ID NO: 352836 - RNA, 62 nt, Human
aucaggugcugguccuccucccuccuggccucgaccccuaagggcuucgccccucccagggg

SEQ ID NO: 352837 - RNA, 62 nt, Human
agaggaugccucccccacagacccuaccccaagaccccuagcccugcccccauccccccaag

SEQ ID NO: 352838 - RNA, 62 nt, Human
acccaacaaccaccuggcaauaugacucacuugaccccuaugggacccaaaugggcacuuuc

SEQ ID NO: 352839 - RNA, 62 nt, Human
agggggaccaaugccagaagaaaggggcuguagaccccuauuccccaccccauggccacagg

SEQ ID NO: 352840 - RNA, 62 nt, Human
gugggcuccagucagucuuacacugcccuucugaccccuacaaauggguccuuugcuaucca

SEQ ID NO: 352841 - RNA, 62 nt, Human
gaagagauguccuaauaucucuuagggacccagaccccuaaauucuccuccucccccauuuu

SEQ ID NO: 352842 - RNA, 62 nt, Human
ccccuuguauuuuccuuaucuuccucuuucaagaccccuacccauuuugccuauccguaggc

SEQ ID NO: 352843 - RNA, 62 nt, Human
ucccgugcaggagccacauggguccugugcaggaccccuagcaguggugggcugagcccagg

SEQ ID NO: 352844 - RNA, 62 nt, Human
cuguggcuggacugccgcgccacgggcaccaggaccccuaagaccaagugacaacugggaga

SEQ ID NO: 352845 - RNA, 62 nt, Human
cuuuuuauacacuguccuccuccaccuugauggaccccuagugaugcauccugccuaggcug

SEQ ID NO: 352846 - RNA, 62 nt, Human
uuggauagcacgggaggagaaguugacuuugugaccccuaguuuaggacccacuucagcugu

SEQ ID NO: 352847 - RNA, 62 nt, Human
gucuccccuuaucuguaagagauacauuccaagaccccuaguggaugccugaaaccucagau

SEQ ID NO: 352848 - RNA, 62 nt, Human
guuaccccuuuacccuuacaguagcaaaauaagaccccuaucuagugagggagacaggugca

SEQ ID NO: 352849 - RNA, 62 nt, Human
agaugagucagugccaugacugagaaggaaccgaccccuaguugagagcaccuugcaguucc

SEQ ID NO: 352850 - RNA, 62 nt, Human
cccuacugggagacugggacaccuuuaacacagaccccuagggauuuaaagggacaccccua

SEQ ID NO: 352851 - RNA, 62 nt, Human
accuggggguugccuggggaccucucccacccgaccccuacagagcuugagagccacagacg

SEQ ID NO: 352852 - RNA, 62 nt, Human
agaguucaagaccagccugggcaacauagcgagaccccuaucuguauuaaaaaaaaaucuga

SEQ ID NO: 352853 - RNA, 62 nt, Human
gcucacacaagcgacugggccggccggcccuggaccccuagaccccgagccgccugccgacu

SEQ ID NO: 352854 - RNA, 62 nt, Human
uggccccgcugccaggacaucuguugggcccagaccccuaugccuuguuccgagcacgaaga

SEQ ID NO: 352855 - RNA, 62 nt, Human
guggagacggcaguccaguuucucuccccucugaccccuagaaggggaguuguagccccaug

SEQ ID NO: 352856 - RNA, 62 nt, Human
uggggucaugagagcuaguuaguacucagccugaccccuaggucugguccugccagccuggg

SEQ ID NO: 352857 - RNA, 62 nt, Human
ucuccagcccuauggaagucucaaggucacgggaccccuaaucagaguggccaaucccugug

SEQ ID NO: 352858 - RNA, 62 nt, Human
agagcuggaaaccaagaaguuugucaacagaggaccccuacuccaugcaggacagggucucc

SEQ ID NO: 352859 - RNA, 62 nt, Human
gaucugauugaggauaaaaaggaaggagagaugaccccuacccccucaucccccaguuuuga

SEQ ID NO: 352860 - RNA, 62 nt, Human
gggaggggaagaauuggagggcagcuugccuggaccccuaacggcuguucucaggaacaggu

SEQ ID NO: 352861 - RNA, 62 nt, Human
cgcccuccucacgucaggagcaagcagccguggaccccuaagccgagcugguggaaggcccc

SEQ ID NO: 352862 - RNA, 62 nt, Human
caugaugggucuggggccuugcugauuccccagaccccuaauuaaauguuucuugucccagc

SEQ ID NO: 352863 - RNA, 62 nt, Human
gacuucugcacccucgguucugaggguacggugaccccuagugggcaguuugcaaaauguga

SEQ ID NO: 352864 - RNA, 50 nt, Human
ugcccucuucggggccguaggaccccuaacuccaccccccucccuggcag

SEQ ID NO: 352865 - RNA, 62 nt, Human
cccagccaaucgggacaguucaaggaggaggagaccccuauuacacagguuggaauaaaaua

SEQ ID NO: 352866 - RNA, 62 nt, Human
uuucagccacaaaacugucauucacucuaggggaccccuacuaaaggguaacuucaggugug

SEQ ID NO: 352867 - RNA, 62 nt, Human
gcgggcgggugggaggugggaguggcugcagggaccccuagugucccuggucuaucucucca

SEQ ID NO: 352868 - RNA, 62 nt, Human
ccccuucagccugcccuacagcgacuucccccgaccccuaccccacgcuacccagggcccag

SEQ ID NO: 352869 - RNA, 62 nt, Human
gcccugccccaaggacucacugcauguacccggaccccuaggccuggccuuugcagcauagu

SEQ ID NO: 352870 - RNA, 62 nt, Human
ugucaggacaccagccuggugcccauccucccgaccccuacccacuuccauucccguggucu

SEQ ID NO: 352871 - RNA, 62 nt, Human
ggacacccagccaggcagagcugggauugaaggaccccuauagagaagggcuuggcccccau

SEQ ID NO: 352872 - RNA, 62 nt, Human
cggacugcgggugacggcccugcccgccaccagaccccuaaaucuuggccaucguguggccg

SEQ ID NO: 352873 - RNA, 62 nt, Human
augggggcccagggacucugaacccuccugaugaccccuauggccaacaucaacccggcacc

SEQ ID NO: 352874 - RNA, 62 nt, Human
ccuggguccccugcaaccucccaucaaaggaugaccccuaaacacagaggagcggggcaggc

SEQ ID NO: 352875 - RNA, 62 nt, Human
acuggcuagccauaugcaggauauugaaacuggaccccuauccuucacgauauacaaaaauc

SEQ ID NO: 352876 - RNA, 62 nt, Human
auaugcaauucucccucccccagcccuucccugaccccuaaguuauugcccgcucaccucuc

SEQ ID NO: 352877 - RNA, 62 nt, Human
uaagcacuggaugucuccugaucccaggcugggaccccuacccccacccccuuugauccuuu

SEQ ID NO: 352878 - RNA, 62 nt, Human
auucuguuuauacuugccugguacucaugauagaccccuaauuauuuuguaucuuuuuucau

SEQ ID NO: 352879 - RNA, 62 nt, Human
ccaguggacaccagugaaccccagucagccuggaccccuaacacagaccaugaggagacgcu

SEQ ID NO: 352880 - RNA, 62 nt, Human
ccaguggacaccaaugaaccccagccagccuggaccccuaacaaagaccaccaggacauccu

SEQ ID NO: 352881 - RNA, 62 nt, Human
ccaguggacaccaaugaaccccagucagccuggaccccuaacaaagaccaugaggagaugcu

SEQ ID NO: 352882 - RNA, 62 nt, Human
aggaacagggugcugguugagggcccccagcugaccccuacugcagauccgcauguggacca

SEQ ID NO: 352883 - RNA, 62 nt, Human
aggaaaggaggaggugccgggggccuggcacagaccccuaggugccucgcuccaugggauug

SEQ ID NO: 352884 - RNA, 62 nt, Human
cagaagaggcuggaaccuccugcucaagucuagaccccuacuucucugcugcccccacccug

SEQ ID NO: 352885 - RNA, 62 nt, Human
gcagguccgccugugcgggugccccugacuucgaccccuagcuuaugucacagcccgaacca

SEQ ID NO: 352886 - RNA, 62 nt, Human
ucaacccggagcacugcagccccaauggcaccgaccccuacaagccuaagugccccgagagc

SEQ ID NO: 352887 - RNA, 62 nt, Human
uaacugagacacccugccuguuagcccugggagaccccuaaccuuggcccaagaccccuuug

SEQ ID NO: 352888 - RNA, 62 nt, Human
cuugcacucacuuccccugccccagucacgaugaccccuaaagcuuccuuugcccuugcuuu

SEQ ID NO: 352889 - RNA, 62 nt, Human
aagaggcuucuggcagcuuccauccuacccaugaccccuacuuggggcagaaaaaacccauc

SEQ ID NO: 352890 - RNA, 62 nt, Human
ugucuggcuguggccccuccuucuccccuccagaccccuacccuuucccaaacccuucggua

SEQ ID NO: 352891 - RNA, 62 nt, Human
ucaaggauagcaggaauauaaaaauucucaaagaccccuaccugcagaggaagcugcuaaag

SEQ ID NO: 352892 - RNA, 64 nt, Human; identical to SEQ ID NO: 303272

SEQ ID NO: 352893 - RNA, 64 nt, Human; identical to SEQ ID NO: 303289

SEQ ID NO: 352894 - RNA, 64 nt, Human; identical to SEQ ID NO: 303290

SEQ ID NO: 352895 - RNA, 64 nt, Human; identical to SEQ ID NO: 303291

SEQ ID NO: 352896 - RNA, 64 nt, Human; identical to SEQ ID NO: 303292

SEQ ID NO: 352897 - RNA, 64 nt, Human; identical to SEQ ID NO: 303293

SEQ ID NO: 352898 - RNA, 55 nt, Human; identical to SEQ ID NO: 303294

SEQ ID NO: 352899 - RNA, 64 nt, Human; identical to SEQ ID NO: 303295

SEQ ID NO: 352900 - RNA, 64 nt, Human; identical to SEQ ID NO: 303296

SEQ ID NO: 352901 - RNA, 64 nt, Human; identical to SEQ ID NO: 303297

SEQ ID NO: 352902 - RNA, 64 nt, Human; identical to SEQ ID NO: 303298

SEQ ID NO: 352903 - RNA, 64 nt, Human; identical to SEQ ID NO: 303299

SEQ ID NO: 352904 - RNA, 64 nt, Human; identical to SEQ ID NO: 303300

SEQ ID NO: 352905 - RNA, 64 nt, Human; identical to SEQ ID NO: 303301

SEQ ID NO: 352906 - RNA, 64 nt, Human; identical to SEQ ID NO: 303302

SEQ ID NO: 352907 - RNA, 64 nt, Human; identical to SEQ ID NO: 303303

SEQ ID NO: 352908 - RNA, 64 nt, Human; identical to SEQ ID NO: 303307

SEQ ID NO: 352909 - RNA, 64 nt, Human; identical to SEQ ID NO: 303308

SEQ ID NO: 352910 - RNA, 64 nt, Human; identical to SEQ ID NO: 303309

SEQ ID NO: 352911 - RNA, 64 nt, Human; identical to SEQ ID NO: 303310

SEQ ID NO: 352912 - RNA, 64 nt, Human; identical to SEQ ID NO: 303311

SEQ ID NO: 352913 - RNA, 64 nt, Human; identical to SEQ ID NO: 303312

SEQ ID NO: 352914 - RNA, 64 nt, Human; identical to SEQ ID NO: 303313

SEQ ID NO: 352915 - RNA, 64 nt, Human; identical to SEQ ID NO: 303314

SEQ ID NO: 352916 - RNA, 64 nt, Human; identical to SEQ ID NO: 303315

SEQ ID NO: 352917 - RNA, 64 nt, Human; identical to SEQ ID NO: 303316

SEQ ID NO: 352918 - RNA, 64 nt, Human; identical to SEQ ID NO: 303317

SEQ ID NO: 352919 - RNA, 64 nt, Human; identical to SEQ ID NO: 303318

SEQ ID NO: 352920 - RNA, 64 nt, Human; identical to SEQ ID NO: 303319

SEQ ID NO: 352921 - RNA, 64 nt, Human; identical to SEQ ID NO: 303320

SEQ ID NO: 352922 - RNA, 64 nt, Human; identical to SEQ ID NO: 303321

SEQ ID NO: 352923 - RNA, 64 nt, Human; identical to SEQ ID NO: 303325

SEQ ID NO: 352924 - RNA, 64 nt, Human; identical to SEQ ID NO: 303326

SEQ ID NO: 352925 - RNA, 64 nt, Human; identical to SEQ ID NO: 303327

SEQ ID NO: 352926 - RNA, 64 nt, Human; identical to SEQ ID NO: 303328

SEQ ID NO: 352927 - RNA, 64 nt, Human; identical to SEQ ID NO: 303329

SEQ ID NO: 352928 - RNA, 64 nt, Human; identical to SEQ ID NO: 303330

SEQ ID NO: 352929 - RNA, 64 nt, Human; identical to SEQ ID NO: 303331

SEQ ID NO: 352930 - RNA, 60 nt, Human; identical to SEQ ID NO: 303332

SEQ ID NO: 352931 - RNA, 64 nt, Human; identical to SEQ ID NO: 303333

SEQ ID NO: 352932 - RNA, 64 nt, Human; identical to SEQ ID NO: 303334

SEQ ID NO: 352933 - RNA, 64 nt, Human; identical to SEQ ID NO: 303335

SEQ ID NO: 352934 - RNA, 64 nt, Human; identical to SEQ ID NO: 303336

SEQ ID NO: 352935 - RNA, 64 nt, Human; identical to SEQ ID NO: 303337

SEQ ID NO: 352936 - RNA, 64 nt, Human; identical to SEQ ID NO: 303338

SEQ ID NO: 352937 - RNA, 64 nt, Human; identical to SEQ ID NO: 303339

SEQ ID NO: 352938 - RNA, 64 nt, Human; identical to SEQ ID NO: 303343

SEQ ID NO: 352939 - RNA, 64 nt, Human; identical to SEQ ID NO: 303344

SEQ ID NO: 352940 - RNA, 61 nt, Human; identical to SEQ ID NO: 303345

SEQ ID NO: 352941 - RNA, 64 nt, Human; identical to SEQ ID NO: 303346

SEQ ID NO: 352942 - RNA, 64 nt, Human; identical to SEQ ID NO: 303347

SEQ ID NO: 352943 - RNA, 64 nt, Human; identical to SEQ ID NO: 303348

SEQ ID NO: 352944 - RNA, 64 nt, Human; identical to SEQ ID NO: 303349

SEQ ID NO: 352945 - RNA, 64 nt, Human; identical to SEQ ID NO: 303350

SEQ ID NO: 352946 - RNA, 64 nt, Human; identical to SEQ ID NO: 303351

SEQ ID NO: 352947 - RNA, 64 nt, Human; identical to SEQ ID NO: 303352

SEQ ID NO: 352948 - RNA, 64 nt, Human; identical to SEQ ID NO: 303353

SEQ ID NO: 352949 - RNA, 64 nt, Human; identical to SEQ ID NO: 303354

SEQ ID NO: 352950 - RNA, 64 nt, Human; identical to SEQ ID NO: 303355

SEQ ID NO: 352951 - RNA, 64 nt, Human; identical to SEQ ID NO: 303356

SEQ ID NO: 352952 - RNA, 64 nt, Human; identical to SEQ ID NO: 303357

SEQ ID NO: 352953 - RNA, 64 nt, Human; identical to SEQ ID NO: 303361

SEQ ID NO: 352954 - RNA, 64 nt, Human; identical to SEQ ID NO: 303362

SEQ ID NO: 352955 - RNA, 64 nt, Human; identical to SEQ ID NO: 303363

SEQ ID NO: 352956 - RNA, 64 nt, Human; identical to SEQ ID NO: 303364

SEQ ID NO: 352957 - RNA, 64 nt, Human; identical to SEQ ID NO: 303365

SEQ ID NO: 352958 - RNA, 64 nt, Human; identical to SEQ ID NO: 303366

SEQ ID NO: 352959 - RNA, 64 nt, Human; identical to SEQ ID NO: 303367

SEQ ID NO: 352960 - RNA, 64 nt, Human; identical to SEQ ID NO: 303368

SEQ ID NO: 352961 - RNA, 64 nt, Human; identical to SEQ ID NO: 303369

SEQ ID NO: 352962 - RNA, 64 nt, Human; identical to SEQ ID NO: 303370

SEQ ID NO: 352963 - RNA, 64 nt, Human; identical to SEQ ID NO: 303371

SEQ ID NO: 352964 - RNA, 64 nt, Human; identical to SEQ ID NO: 303372

SEQ ID NO: 352965 - RNA, 64 nt, Human; identical to SEQ ID NO: 303373

SEQ ID NO: 352966 - RNA, 64 nt, Human; identical to SEQ ID NO: 303374

SEQ ID NO: 352967 - RNA, 64 nt, Human; identical to SEQ ID NO: 303375

SEQ ID NO: 352968 - RNA, 64 nt, Human; identical to SEQ ID NO: 303379

SEQ ID NO: 352969 - RNA, 64 nt, Human; identical to SEQ ID NO: 303380

SEQ ID NO: 352970 - RNA, 64 nt, Human; identical to SEQ ID NO: 303381

SEQ ID NO: 352971 - RNA, 64 nt, Human; identical to SEQ ID NO: 303382

SEQ ID NO: 352972 - RNA, 64 nt, Human; identical to SEQ ID NO: 303383

SEQ ID NO: 352973 - RNA, 64 nt, Human; identical to SEQ ID NO: 303384

SEQ ID NO: 352974 - RNA, 64 nt, Human; identical to SEQ ID NO: 303385

SEQ ID NO: 352975 - RNA, 64 nt, Human; identical to SEQ ID NO: 303386

SEQ ID NO: 352976 - RNA, 64 nt, Human; identical to SEQ ID NO: 303387

SEQ ID NO: 352977 - RNA, 64 nt, Human; identical to SEQ ID NO: 303388

SEQ ID NO: 352978 - RNA, 64 nt, Human; identical to SEQ ID NO: 303389

SEQ ID NO: 352979 - RNA, 64 nt, Human; identical to SEQ ID NO: 303390

SEQ ID NO: 352980 - RNA, 64 nt, Human; identical to SEQ ID NO: 303391

SEQ ID NO: 352981 - RNA, 64 nt, Human; identical to SEQ ID NO: 303392

SEQ ID NO: 352982 - RNA, 64 nt, Human; identical to SEQ ID NO: 303393

SEQ ID NO: 352983 - RNA, 64 nt, Human; identical to SEQ ID NO: 303397

SEQ ID NO: 352984 - RNA, 64 nt, Human; identical to SEQ ID NO: 303398

SEQ ID NO: 352985 - RNA, 64 nt, Human; identical to SEQ ID NO: 303399

SEQ ID NO: 352986 - RNA, 64 nt, Human; identical to SEQ ID NO: 303400

SEQ ID NO: 352987 - RNA, 64 nt, Human; identical to SEQ ID NO: 303401

SEQ ID NO: 352988 - RNA, 64 nt, Human; identical to SEQ ID NO: 303402

SEQ ID NO: 352989 - RNA, 64 nt, Human; identical to SEQ ID NO: 303403

SEQ ID NO: 352990 - RNA, 64 nt, Human; identical to SEQ ID NO: 303404

SEQ ID NO: 352991 - RNA, 64 nt, Human; identical to SEQ ID NO: 303405

SEQ ID NO: 352992 - RNA, 64 nt, Human; identical to SEQ ID NO: 303406

SEQ ID NO: 352993 - RNA, 64 nt, Human; identical to SEQ ID NO: 303407

SEQ ID NO: 352994 - RNA, 64 nt, Human; identical to SEQ ID NO: 303408

SEQ ID NO: 352995 - RNA, 64 nt, Human; identical to SEQ ID NO: 303409

SEQ ID NO: 352996 - RNA, 64 nt, Human; identical to SEQ ID NO: 303410

SEQ ID NO: 352997 - RNA, 64 nt, Human; identical to SEQ ID NO: 303411

SEQ ID NO: 352998 - RNA, 64 nt, Human; identical to SEQ ID NO: 303415

SEQ ID NO: 352999 - RNA, 64 nt, Human; identical to SEQ ID NO: 303416

SEQ ID NO: 353000 - RNA, 64 nt, Human; identical to SEQ ID NO: 303417

SEQ ID NO: 353001 - RNA, 64 nt, Human; identical to SEQ ID NO: 303418

SEQ ID NO: 353002 - RNA, 64 nt, Human; identical to SEQ ID NO: 303419

SEQ ID NO: 353003 - RNA, 64 nt, Human; identical to SEQ ID NO: 303420

SEQ ID NO: 353004 - RNA, 64 nt, Human; identical to SEQ ID NO: 303421

SEQ ID NO: 353005 - RNA, 64 nt, Human; identical to SEQ ID NO: 303422

SEQ ID NO: 353006 - RNA, 64 nt, Human; identical to SEQ ID NO: 303423

SEQ ID NO: 353007 - RNA, 64 nt, Human; identical to SEQ ID NO: 303424

SEQ ID NO: 353008 - RNA, 64 nt, Human; identical to SEQ ID NO: 303425

SEQ ID NO: 353009 - RNA, 64 nt, Human; identical to SEQ ID NO: 303426

SEQ ID NO: 353010 - RNA, 64 nt, Human; identical to SEQ ID NO: 303427

SEQ ID NO: 353011 - RNA, 64 nt, Human; identical to SEQ ID NO: 303428

SEQ ID NO: 353012 - RNA, 64 nt, Human; identical to SEQ ID NO: 303429

SEQ ID NO: 353013 - RNA, 64 nt, Human; identical to SEQ ID NO: 303433

SEQ ID NO: 353014 - RNA, 64 nt, Human; identical to SEQ ID NO: 303434

SEQ ID NO: 353015 - RNA, 64 nt, Human; identical to SEQ ID NO: 303435

SEQ ID NO: 353016 - RNA, 64 nt, Human; identical to SEQ ID NO: 303436

SEQ ID NO: 353017 - RNA, 64 nt, Human; identical to SEQ ID NO: 303437

SEQ ID NO: 353018 - RNA, 64 nt, Human; identical to SEQ ID NO: 303438

SEQ ID NO: 353019 - RNA, 64 nt, Human; identical to SEQ ID NO: 303439

SEQ ID NO: 353020 - RNA, 64 nt, Human; identical to SEQ ID NO: 303440

SEQ ID NO: 353021 - RNA, 64 nt, Human; identical to SEQ ID NO: 303441

SEQ ID NO: 353022 - RNA, 64 nt, Human; identical to SEQ ID NO: 303442

SEQ ID NO: 353023 - RNA, 64 nt, Human; identical to SEQ ID NO: 303443

SEQ ID NO: 353024 - RNA, 64 nt, Human; identical to SEQ ID NO: 303444

SEQ ID NO: 353025 - RNA, 64 nt, Human; identical to SEQ ID NO: 303445

SEQ ID NO: 353026 - RNA, 64 nt, Human; identical to SEQ ID NO: 303446

SEQ ID NO: 353027 - RNA, 64 nt, Human; identical to SEQ ID NO: 303447

SEQ ID NO: 353028 - RNA, 64 nt, Human; identical to SEQ ID NO: 303451

SEQ ID NO: 353029 - RNA, 60 nt, Human; identical to SEQ ID NO: 303452

SEQ ID NO: 353030 - RNA, 64 nt, Human; identical to SEQ ID NO: 303453

SEQ ID NO: 353031 - RNA, 64 nt, Human; identical to SEQ ID NO: 303454

SEQ ID NO: 353032 - RNA, 64 nt, Human; identical to SEQ ID NO: 303455

SEQ ID NO: 353033 - RNA, 52 nt, Human; identical to SEQ ID NO: 303456

SEQ ID NO: 353034 - RNA, 64 nt, Human; identical to SEQ ID NO: 303457

SEQ ID NO: 353035 - RNA, 64 nt, Human; identical to SEQ ID NO: 303458

SEQ ID NO: 353036 - RNA, 64 nt, Human; identical to SEQ ID NO: 303459

SEQ ID NO: 353037 - RNA, 64 nt, Human; identical to SEQ ID NO: 303460

SEQ ID NO: 353038 - RNA, 64 nt, Human; identical to SEQ ID NO: 303461

SEQ ID NO: 353039 - RNA, 64 nt, Human; identical to SEQ ID NO: 303462

SEQ ID NO: 353040 - RNA, 64 nt, Human; identical to SEQ ID NO: 303463

SEQ ID NO: 353041 - RNA, 64 nt, Human; identical to SEQ ID NO: 303464

SEQ ID NO: 353042 - RNA, 64 nt, Human; identical to SEQ ID NO: 303465

SEQ ID NO: 353043 - RNA, 64 nt, Human; identical to SEQ ID NO: 303469

SEQ ID NO: 353044 - RNA, 64 nt, Human; identical to SEQ ID NO: 303470

SEQ ID NO: 353045 - RNA, 64 nt, Human; identical to SEQ ID NO: 303471

SEQ ID NO: 353046 - RNA, 64 nt, Human; identical to SEQ ID NO: 303472

SEQ ID NO: 353047 - RNA, 64 nt, Human; identical to SEQ ID NO: 303473

SEQ ID NO: 353048 - RNA, 64 nt, Human; identical to SEQ ID NO: 303474

SEQ ID NO: 353049 - RNA, 64 nt, Human; identical to SEQ ID NO: 303475

SEQ ID NO: 353050 - RNA, 54 nt, Human; identical to SEQ ID NO: 303476

SEQ ID NO: 353051 - RNA, 64 nt, Human; identical to SEQ ID NO: 303477

SEQ ID NO: 353052 - RNA, 64 nt, Human; identical to SEQ ID NO: 303478

SEQ ID NO: 353053 - RNA, 64 nt, Human; identical to SEQ ID NO: 303479

SEQ ID NO: 353054 - RNA, 64 nt, Human; identical to SEQ ID NO: 303480

SEQ ID NO: 353055 - RNA, 64 nt, Human; identical to SEQ ID NO: 303481

SEQ ID NO: 353056 - RNA, 64 nt, Human; identical to SEQ ID NO: 303482

SEQ ID NO: 353057 - RNA, 64 nt, Human; identical to SEQ ID NO: 303483

SEQ ID NO: 353058 - RNA, 64 nt, Human; identical to SEQ ID NO: 303487

SEQ ID NO: 353059 - RNA, 64 nt, Human; identical to SEQ ID NO: 303488

SEQ ID NO: 353060 - RNA, 59 nt, Human; identical to SEQ ID NO: 303489

SEQ ID NO: 353061 - RNA, 64 nt, Human; identical to SEQ ID NO: 303490

SEQ ID NO: 353062 - RNA, 64 nt, Human; identical to SEQ ID NO: 303491

SEQ ID NO: 353063 - RNA, 64 nt, Human; identical to SEQ ID NO: 303492

SEQ ID NO: 353064 - RNA, 64 nt, Human; identical to SEQ ID NO: 303493

SEQ ID NO: 353065 - RNA, 64 nt, Human; identical to SEQ ID NO: 303494

SEQ ID NO: 353066 - RNA, 64 nt, Human; identical to SEQ ID NO: 303495

SEQ ID NO: 353067 - RNA, 64 nt, Human; identical to SEQ ID NO: 303496

SEQ ID NO: 353068 - RNA, 64 nt, Human; identical to SEQ ID NO: 303497

SEQ ID NO: 353069 - RNA, 64 nt, Human; identical to SEQ ID NO: 303498

SEQ ID NO: 353070 - RNA, 64 nt, Human; identical to SEQ ID NO: 303499

SEQ ID NO: 353071 - RNA, 64 nt, Human; identical to SEQ ID NO: 303500

SEQ ID NO: 353072 - RNA, 64 nt, Human; identical to SEQ ID NO: 303501

SEQ ID NO: 353073 - RNA, 64 nt, Human; identical to SEQ ID NO: 303505

SEQ ID NO: 353074 - RNA, 64 nt, Human; identical to SEQ ID NO: 303506

SEQ ID NO: 353075 - RNA, 64 nt, Human; identical to SEQ ID NO: 303507

SEQ ID NO: 353076 - RNA, 64 nt, Human; identical to SEQ ID NO: 303508

SEQ ID NO: 353077 - RNA, 64 nt, Human; identical to SEQ ID NO: 303509

SEQ ID NO: 353078 - RNA, 64 nt, Human; identical to SEQ ID NO: 303510

SEQ ID NO: 353079 - RNA, 64 nt, Human; identical to SEQ ID NO: 303511

SEQ ID NO: 353080 - RNA, 64 nt, Human; identical to SEQ ID NO: 303512

SEQ ID NO: 353081 - RNA, 64 nt, Human; identical to SEQ ID NO: 303513

SEQ ID NO: 353082 - RNA, 64 nt, Human; identical to SEQ ID NO: 303514

SEQ ID NO: 353083 - RNA, 64 nt, Human; identical to SEQ ID NO: 303515

SEQ ID NO: 353084 - RNA, 64 nt, Human; identical to SEQ ID NO: 303516

SEQ ID NO: 353085 - RNA, 64 nt, Human; identical to SEQ ID NO: 303517

SEQ ID NO: 353086 - RNA, 64 nt, Human; identical to SEQ ID NO: 303518

SEQ ID NO: 353087 - RNA, 64 nt, Human; identical to SEQ ID NO: 303519

SEQ ID NO: 353088 - RNA, 64 nt, Human; identical to SEQ ID NO: 303523

SEQ ID NO: 353089 - RNA, 64 nt, Human; identical to SEQ ID NO: 303524

SEQ ID NO: 353090 - RNA, 64 nt, Human; identical to SEQ ID NO: 303525

SEQ ID NO: 353091 - RNA, 64 nt, Human; identical to SEQ ID NO: 303526

SEQ ID NO: 353092 - RNA, 64 nt, Human; identical to SEQ ID NO: 303527

SEQ ID NO: 353093 - RNA, 64 nt, Human; identical to SEQ ID NO: 303528

SEQ ID NO: 353094 - RNA, 64 nt, Human; identical to SEQ ID NO: 303529

SEQ ID NO: 353095 - RNA, 64 nt, Human; identical to SEQ ID NO: 303530

SEQ ID NO: 353096 - RNA, 62 nt, Human; identical to SEQ ID NO: 352788

SEQ ID NO: 353097 - RNA, 62 nt, Human; identical to SEQ ID NO: 352789

SEQ ID NO: 353098 - RNA, 62 nt, Human; identical to SEQ ID NO: 352790

SEQ ID NO: 353099 - RNA, 62 nt, Human; identical to SEQ ID NO: 352791

SEQ ID NO: 353100 - RNA, 62 nt, Human; identical to SEQ ID NO: 352792

SEQ ID NO: 353101 - RNA, 62 nt, Human; identical to SEQ ID NO: 352793

SEQ ID NO: 353102 - RNA, 62 nt, Human; identical to SEQ ID NO: 352794

SEQ ID NO: 353103 - RNA, 62 nt, Human; identical to SEQ ID NO: 352795

SEQ ID NO: 353104 - RNA, 62 nt, Human; identical to SEQ ID NO: 352796

SEQ ID NO: 353105 - RNA, 62 nt, Human; identical to SEQ ID NO: 352797

SEQ ID NO: 353106 - RNA, 62 nt, Human; identical to SEQ ID NO: 352798

SEQ ID NO: 353107 - RNA, 62 nt, Human; identical to SEQ ID NO: 352799

SEQ ID NO: 353108 - RNA, 62 nt, Human; identical to SEQ ID NO: 352800

SEQ ID NO: 353109 - RNA, 62 nt, Human; identical to SEQ ID NO: 352801

SEQ ID NO: 353110 - RNA, 62 nt, Human; identical to SEQ ID NO: 352802

SEQ ID NO: 353111 - RNA, 62 nt, Human; identical to SEQ ID NO: 352803

SEQ ID NO: 353112 - RNA, 62 nt, Human; identical to SEQ ID NO: 352804

SEQ ID NO: 353113 - RNA, 62 nt, Human; identical to SEQ ID NO: 352805

SEQ ID NO: 353114 - RNA, 62 nt, Human; identical to SEQ ID NO: 352806

SEQ ID NO: 353115 - RNA, 62 nt, Human; identical to SEQ ID NO: 352807

SEQ ID NO: 353116 - RNA, 62 nt, Human; identical to SEQ ID NO: 352808

SEQ ID NO: 353117 - RNA, 62 nt, Human; identical to SEQ ID NO: 352809

SEQ ID NO: 353118 - RNA, 59 nt, Human; identical to SEQ ID NO: 352810

SEQ ID NO: 353119 - RNA, 62 nt, Human; identical to SEQ ID NO: 352811

SEQ ID NO: 353120 - RNA, 62 nt, Human; identical to SEQ ID NO: 352812

SEQ ID NO: 353121 - RNA, 62 nt, Human; identical to SEQ ID NO: 352813

SEQ ID NO: 353122 - RNA, 62 nt, Human; identical to SEQ ID NO: 352814

SEQ ID NO: 353123 - RNA, 62 nt, Human; identical to SEQ ID NO: 352815

SEQ ID NO: 353124 - RNA, 62 nt, Human; identical to SEQ ID NO: 352816

SEQ ID NO: 353125 - RNA, 54 nt, Human; identical to SEQ ID NO: 352817

SEQ ID NO: 353126 - RNA, 62 nt, Human; identical to SEQ ID NO: 352818

SEQ ID NO: 353127 - RNA, 62 nt, Human; identical to SEQ ID NO: 352819

SEQ ID NO: 353128 - RNA, 62 nt, Human; identical to SEQ ID NO: 352820

SEQ ID NO: 353129 - RNA, 62 nt, Human; identical to SEQ ID NO: 352821

SEQ ID NO: 353130 - RNA, 62 nt, Human; identical to SEQ ID NO: 352822

SEQ ID NO: 353131 - RNA, 62 nt, Human; identical to SEQ ID NO: 352823

SEQ ID NO: 353132 - RNA, 62 nt, Human; identical to SEQ ID NO: 352824

SEQ ID NO: 353133 - RNA, 62 nt, Human; identical to SEQ ID NO: 352825

SEQ ID NO: 353134 - RNA, 62 nt, Human; identical to SEQ ID NO: 352826

SEQ ID NO: 353135 - RNA, 62 nt, Human; identical to SEQ ID NO: 352827

SEQ ID NO: 353136 - RNA, 62 nt, Human; identical to SEQ ID NO: 352828

SEQ ID NO: 353137 - RNA, 62 nt, Human; identical to SEQ ID NO: 352829

SEQ ID NO: 353138 - RNA, 62 nt, Human; identical to SEQ ID NO: 352830

SEQ ID NO: 353139 - RNA, 62 nt, Human; identical to SEQ ID NO: 352831

SEQ ID NO: 353140 - RNA, 62 nt, Human; identical to SEQ ID NO: 352832

SEQ ID NO: 353141 - RNA, 62 nt, Human; identical to SEQ ID NO: 352833

SEQ ID NO: 353142 - RNA, 62 nt, Human; identical to SEQ ID NO: 352834

SEQ ID NO: 353143 - RNA, 62 nt, Human; identical to SEQ ID NO: 352835

SEQ ID NO: 353144 - RNA, 62 nt, Human; identical to SEQ ID NO: 352836

SEQ ID NO: 353145 - RNA, 62 nt, Human; identical to SEQ ID NO: 352837

SEQ ID NO: 353146 - RNA, 62 nt, Human; identical to SEQ ID NO: 352838

SEQ ID NO: 353147 - RNA, 62 nt, Human; identical to SEQ ID NO: 352839

SEQ ID NO: 353148 - RNA, 62 nt, Human; identical to SEQ ID NO: 352840

SEQ ID NO: 353149 - RNA, 62 nt, Human; identical to SEQ ID NO: 352841

SEQ ID NO: 353150 - RNA, 62 nt, Human; identical to SEQ ID NO: 352842

SEQ ID NO: 353151 - RNA, 62 nt, Human; identical to SEQ ID NO: 352843

SEQ ID NO: 353152 - RNA, 62 nt, Human; identical to SEQ ID NO: 352844

SEQ ID NO: 353153 - RNA, 62 nt, Human; identical to SEQ ID NO: 352845

SEQ ID NO: 353154 - RNA, 62 nt, Human; identical to SEQ ID NO: 352846

SEQ ID NO: 353155 - RNA, 62 nt, Human; identical to SEQ ID NO: 352847

SEQ ID NO: 353156 - RNA, 62 nt, Human; identical to SEQ ID NO: 352848

SEQ ID NO: 353157 - RNA, 62 nt, Human; identical to SEQ ID NO: 352849

SEQ ID NO: 353158 - RNA, 62 nt, Human; identical to SEQ ID NO: 352850

SEQ ID NO: 353159 - RNA, 62 nt, Human; identical to SEQ ID NO: 352851

SEQ ID NO: 353160 - RNA, 62 nt, Human; identical to SEQ ID NO: 352852

SEQ ID NO: 353161 - RNA, 62 nt, Human; identical to SEQ ID NO: 352853

SEQ ID NO: 353162 - RNA, 62 nt, Human; identical to SEQ ID NO: 352854

SEQ ID NO: 353163 - RNA, 62 nt, Human; identical to SEQ ID NO: 352855

SEQ ID NO: 353164 - RNA, 62 nt, Human; identical to SEQ ID NO: 352856

SEQ ID NO: 353165 - RNA, 62 nt, Human; identical to SEQ ID NO: 352857

SEQ ID NO: 353166 - RNA, 62 nt, Human; identical to SEQ ID NO: 352858

SEQ ID NO: 353167 - RNA, 62 nt, Human; identical to SEQ ID NO: 352859

SEQ ID NO: 353168 - RNA, 62 nt, Human; identical to SEQ ID NO: 352860

SEQ ID NO: 353169 - RNA, 62 nt, Human; identical to SEQ ID NO: 352861

SEQ ID NO: 353170 - RNA, 62 nt, Human; identical to SEQ ID NO: 352862

SEQ ID NO: 353171 - RNA, 62 nt, Human; identical to SEQ ID NO: 352863

SEQ ID NO: 353172 - RNA, 50 nt, Human; identical to SEQ ID NO: 352864

SEQ ID NO: 353173 - RNA, 62 nt, Human; identical to SEQ ID NO: 352865

SEQ ID NO: 353174 - RNA, 62 nt, Human; identical to SEQ ID NO: 352866

SEQ ID NO: 353175 - RNA, 62 nt, Human; identical to SEQ ID NO: 352867

SEQ ID NO: 353176 - RNA, 62 nt, Human; identical to SEQ ID NO: 352868

SEQ ID NO: 353177 - RNA, 62 nt, Human; identical to SEQ ID NO: 352869

SEQ ID NO: 353178 - RNA, 62 nt, Human; identical to SEQ ID NO: 352870

SEQ ID NO: 353179 - RNA, 62 nt, Human; identical to SEQ ID NO: 352871

SEQ ID NO: 353180 - RNA, 62 nt, Human; identical to SEQ ID NO: 352872

SEQ ID NO: 353181 - RNA, 62 nt, Human; identical to SEQ ID NO: 352873

SEQ ID NO: 353182 - RNA, 62 nt, Human; identical to SEQ ID NO: 352874

SEQ ID NO: 353183 - RNA, 62 nt, Human; identical to SEQ ID NO: 352875

SEQ ID NO: 353184 - RNA, 62 nt, Human; identical to SEQ ID NO: 352876

SEQ ID NO: 353185 - RNA, 62 nt, Human; identical to SEQ ID NO: 352877

SEQ ID NO: 353186 - RNA, 62 nt, Human; identical to SEQ ID NO: 352878

SEQ ID NO: 353187 - RNA, 62 nt, Human; identical to SEQ ID NO: 352879

SEQ ID NO: 353188 - RNA, 62 nt, Human; identical to SEQ ID NO: 352880

SEQ ID NO: 353189 - RNA, 62 nt, Human; identical to SEQ ID NO: 352881

SEQ ID NO: 353190 - RNA, 62 nt, Human; identical to SEQ ID NO: 352882

SEQ ID NO: 353191 - RNA, 62 nt, Human; identical to SEQ ID NO: 352883

SEQ ID NO: 353192 - RNA, 62 nt, Human; identical to SEQ ID NO: 352884

SEQ ID NO: 353193 - RNA, 62 nt, Human; identical to SEQ ID NO: 352885

SEQ ID NO: 353194 - RNA, 62 nt, Human; identical to SEQ ID NO: 352886

SEQ ID NO: 353195 - RNA, 62 nt, Human; identical to SEQ ID NO: 352887

SEQ ID NO: 353196 - RNA, 62 nt, Human; identical to SEQ ID NO: 352888

SEQ ID NO: 353197 - RNA, 62 nt, Human; identical to SEQ ID NO: 352889

SEQ ID NO: 353198 - RNA, 62 nt, Human; identical to SEQ ID NO: 352890

SEQ ID NO: 353199 - RNA, 62 nt, Human; identical to SEQ ID NO: 352891

SEQ ID NO: 353200 - RNA, 64 nt, Human; identical to SEQ ID NO: 303272

SEQ ID NO: 353201 - RNA, 64 nt, Human; identical to SEQ ID NO: 303289

SEQ ID NO: 353202 - RNA, 64 nt, Human; identical to SEQ ID NO: 303290

SEQ ID NO: 353203 - RNA, 64 nt, Human; identical to SEQ ID NO: 303291

SEQ ID NO: 353204 - RNA, 64 nt, Human; identical to SEQ ID NO: 303292

SEQ ID NO: 353205 - RNA, 64 nt, Human; identical to SEQ ID NO: 303293

SEQ ID NO: 353206 - RNA, 55 nt, Human; identical to SEQ ID NO: 303294

SEQ ID NO: 353207 - RNA, 64 nt, Human; identical to SEQ ID NO: 303295

SEQ ID NO: 353208 - RNA, 64 nt, Human; identical to SEQ ID NO: 303296

SEQ ID NO: 353209 - RNA, 64 nt, Human; identical to SEQ ID NO: 303297

SEQ ID NO: 353210 - RNA, 64 nt, Human; identical to SEQ ID NO: 303298

SEQ ID NO: 353211 - RNA, 64 nt, Human; identical to SEQ ID NO: 303299

SEQ ID NO: 353212 - RNA, 64 nt, Human; identical to SEQ ID NO: 303300

SEQ ID NO: 353213 - RNA, 64 nt, Human; identical to SEQ ID NO: 303301

SEQ ID NO: 353214 - RNA, 64 nt, Human; identical to SEQ ID NO: 303302

SEQ ID NO: 353215 - RNA, 64 nt, Human; identical to SEQ ID NO: 303303

SEQ ID NO: 353216 - RNA, 64 nt, Human; identical to SEQ ID NO: 303307

SEQ ID NO: 353217 - RNA, 64 nt, Human; identical to SEQ ID NO: 303308

SEQ ID NO: 353218 - RNA, 64 nt, Human; identical to SEQ ID NO: 303309

SEQ ID NO: 353219 - RNA, 64 nt, Human; identical to SEQ ID NO: 303310

SEQ ID NO: 353220 - RNA, 64 nt, Human; identical to SEQ ID NO: 303311

SEQ ID NO: 353221 - RNA, 64 nt, Human; identical to SEQ ID NO: 303312

SEQ ID NO: 353222 - RNA, 64 nt, Human; identical to SEQ ID NO: 303313

SEQ ID NO: 353223 - RNA, 64 nt, Human; identical to SEQ ID NO: 303314

SEQ ID NO: 353224 - RNA, 64 nt, Human; identical to SEQ ID NO: 303315

SEQ ID NO: 353225 - RNA, 64 nt, Human; identical to SEQ ID NO: 303316

SEQ ID NO: 353226 - RNA, 64 nt, Human; identical to SEQ ID NO: 303317

SEQ ID NO: 353227 - RNA, 64 nt, Human; identical to SEQ ID NO: 303318

SEQ ID NO: 353228 - RNA, 64 nt, Human; identical to SEQ ID NO: 303319

SEQ ID NO: 353229 - RNA, 64 nt, Human; identical to SEQ ID NO: 303320

SEQ ID NO: 353230 - RNA, 64 nt, Human; identical to SEQ ID NO: 303321

SEQ ID NO: 353231 - RNA, 64 nt, Human; identical to SEQ ID NO: 303325

SEQ ID NO: 353232 - RNA, 64 nt, Human; identical to SEQ ID NO: 303326

SEQ ID NO: 353233 - RNA, 64 nt, Human; identical to SEQ ID NO: 303327

SEQ ID NO: 353234 - RNA, 64 nt, Human; identical to SEQ ID NO: 303328

SEQ ID NO: 353235 - RNA, 64 nt, Human; identical to SEQ ID NO: 303329

SEQ ID NO: 353236 - RNA, 64 nt, Human; identical to SEQ ID NO: 303330

SEQ ID NO: 353237 - RNA, 64 nt, Human; identical to SEQ ID NO: 303331

SEQ ID NO: 353238 - RNA, 60 nt, Human; identical to SEQ ID NO: 303332

SEQ ID NO: 353239 - RNA, 64 nt, Human; identical to SEQ ID NO: 303333

SEQ ID NO: 353240 - RNA, 64 nt, Human; identical to SEQ ID NO: 303334

SEQ ID NO: 353241 - RNA, 64 nt, Human; identical to SEQ ID NO: 303335

SEQ ID NO: 353242 - RNA, 64 nt, Human; identical to SEQ ID NO: 303336

SEQ ID NO: 353243 - RNA, 64 nt, Human; identical to SEQ ID NO: 303337

SEQ ID NO: 353244 - RNA, 64 nt, Human; identical to SEQ ID NO: 303338

SEQ ID NO: 353245 - RNA, 64 nt, Human; identical to SEQ ID NO: 303339

SEQ ID NO: 353246 - RNA, 64 nt, Human; identical to SEQ ID NO: 303343

SEQ ID NO: 353247 - RNA, 64 nt, Human; identical to SEQ ID NO: 303344

SEQ ID NO: 353248 - RNA, 61 nt, Human; identical to SEQ ID NO: 303345

SEQ ID NO: 353249 - RNA, 64 nt, Human; identical to SEQ ID NO: 303346

SEQ ID NO: 353250 - RNA, 64 nt, Human; identical to SEQ ID NO: 303347

SEQ ID NO: 353251 - RNA, 64 nt, Human; identical to SEQ ID NO: 303348

SEQ ID NO: 353252 - RNA, 64 nt, Human; identical to SEQ ID NO: 303349

SEQ ID NO: 353253 - RNA, 64 nt, Human; identical to SEQ ID NO: 303350

SEQ ID NO: 353254 - RNA, 64 nt, Human; identical to SEQ ID NO: 303351

SEQ ID NO: 353255 - RNA, 64 nt, Human; identical to SEQ ID NO: 303352

SEQ ID NO: 353256 - RNA, 64 nt, Human; identical to SEQ ID NO: 303353

SEQ ID NO: 353257 - RNA, 64 nt, Human; identical to SEQ ID NO: 303354

SEQ ID NO: 353258 - RNA, 64 nt, Human; identical to SEQ ID NO: 303355

SEQ ID NO: 353259 - RNA, 64 nt, Human; identical to SEQ ID NO: 303356

SEQ ID NO: 353260 - RNA, 64 nt, Human; identical to SEQ ID NO: 303357

SEQ ID NO: 353261 - RNA, 64 nt, Human; identical to SEQ ID NO: 303361

SEQ ID NO: 353262 - RNA, 64 nt, Human; identical to SEQ ID NO: 303362

SEQ ID NO: 353263 - RNA, 64 nt, Human; identical to SEQ ID NO: 303363

SEQ ID NO: 353264 - RNA, 64 nt, Human; identical to SEQ ID NO: 303364

SEQ ID NO: 353265 - RNA, 64 nt, Human; identical to SEQ ID NO: 303365

SEQ ID NO: 353266 - RNA, 64 nt, Human; identical to SEQ ID NO: 303366

SEQ ID NO: 353267 - RNA, 64 nt, Human; identical to SEQ ID NO: 303367

SEQ ID NO: 353268 - RNA, 64 nt, Human; identical to SEQ ID NO: 303368

SEQ ID NO: 353269 - RNA, 64 nt, Human; identical to SEQ ID NO: 303369

SEQ ID NO: 353270 - RNA, 64 nt, Human; identical to SEQ ID NO: 303370

SEQ ID NO: 353271 - RNA, 64 nt, Human; identical to SEQ ID NO: 303371

SEQ ID NO: 353272 - RNA, 64 nt, Human; identical to SEQ ID NO: 303372

SEQ ID NO: 353273 - RNA, 64 nt, Human; identical to SEQ ID NO: 303373

SEQ ID NO: 353274 - RNA, 64 nt, Human; identical to SEQ ID NO: 303374

SEQ ID NO: 353275 - RNA, 64 nt, Human; identical to SEQ ID NO: 303375

SEQ ID NO: 353276 - RNA, 64 nt, Human; identical to SEQ ID NO: 303379

SEQ ID NO: 353277 - RNA, 64 nt, Human; identical to SEQ ID NO: 303380

SEQ ID NO: 353278 - RNA, 64 nt, Human; identical to SEQ ID NO: 303381

SEQ ID NO: 353279 - RNA, 64 nt, Human; identical to SEQ ID NO: 303382

SEQ ID NO: 353280 - RNA, 64 nt, Human; identical to SEQ ID NO: 303383

SEQ ID NO: 353281 - RNA, 64 nt, Human; identical to SEQ ID NO: 303384

SEQ ID NO: 353282 - RNA, 64 nt, Human; identical to SEQ ID NO: 303385

SEQ ID NO: 353283 - RNA, 64 nt, Human; identical to SEQ ID NO: 303386

SEQ ID NO: 353284 - RNA, 64 nt, Human; identical to SEQ ID NO: 303387

SEQ ID NO: 353285 - RNA, 64 nt, Human; identical to SEQ ID NO: 303388

SEQ ID NO: 353286 - RNA, 64 nt, Human; identical to SEQ ID NO: 303389

SEQ ID NO: 353287 - RNA, 64 nt, Human; identical to SEQ ID NO: 303390

SEQ ID NO: 353288 - RNA, 64 nt, Human; identical to SEQ ID NO: 303391

SEQ ID NO: 353289 - RNA, 64 nt, Human; identical to SEQ ID NO: 303392

SEQ ID NO: 353290 - RNA, 64 nt, Human; identical to SEQ ID NO: 303393

SEQ ID NO: 353291 - RNA, 64 nt, Human; identical to SEQ ID NO: 303397

SEQ ID NO: 353292 - RNA, 64 nt, Human; identical to SEQ ID NO: 303398

SEQ ID NO: 353293 - RNA, 64 nt, Human; identical to SEQ ID NO: 303399

SEQ ID NO: 353294 - RNA, 64 nt, Human; identical to SEQ ID NO: 303400

SEQ ID NO: 353295 - RNA, 64 nt, Human; identical to SEQ ID NO: 303401

SEQ ID NO: 353296 - RNA, 64 nt, Human; identical to SEQ ID NO: 303402

SEQ ID NO: 353297 - RNA, 64 nt, Human; identical to SEQ ID NO: 303403

SEQ ID NO: 353298 - RNA, 64 nt, Human; identical to SEQ ID NO: 303404

SEQ ID NO: 353299 - RNA, 64 nt, Human; identical to SEQ ID NO: 303405

SEQ ID NO: 353300 - RNA, 64 nt, Human; identical to SEQ ID NO: 303406

SEQ ID NO: 353301 - RNA, 64 nt, Human; identical to SEQ ID NO: 303407

SEQ ID NO: 353302 - RNA, 64 nt, Human; identical to SEQ ID NO: 303408

SEQ ID NO: 353303 - RNA, 64 nt, Human; identical to SEQ ID NO: 303409

SEQ ID NO: 353304 - RNA, 64 nt, Human; identical to SEQ ID NO: 303410

SEQ ID NO: 353305 - RNA, 64 nt, Human; identical to SEQ ID NO: 303411

SEQ ID NO: 353306 - RNA, 64 nt, Human; identical to SEQ ID NO: 303415

SEQ ID NO: 353307 - RNA, 64 nt, Human; identical to SEQ ID NO: 303416

SEQ ID NO: 353308 - RNA, 64 nt, Human; identical to SEQ ID NO: 303417

SEQ ID NO: 353309 - RNA, 64 nt, Human; identical to SEQ ID NO: 303418

SEQ ID NO: 353310 - RNA, 64 nt, Human; identical to SEQ ID NO: 303419

SEQ ID NO: 353311 - RNA, 64 nt, Human; identical to SEQ ID NO: 303420

SEQ ID NO: 353312 - RNA, 64 nt, Human; identical to SEQ ID NO: 303421

SEQ ID NO: 353313 - RNA, 64 nt, Human; identical to SEQ ID NO: 303422

SEQ ID NO: 353314 - RNA, 64 nt, Human; identical to SEQ ID NO: 303423

SEQ ID NO: 353315 - RNA, 64 nt, Human; identical to SEQ ID NO: 303424

SEQ ID NO: 353316 - RNA, 64 nt, Human; identical to SEQ ID NO: 303425

SEQ ID NO: 353317 - RNA, 64 nt, Human; identical to SEQ ID NO: 303426

SEQ ID NO: 353318 - RNA, 64 nt, Human; identical to SEQ ID NO: 303427

SEQ ID NO: 353319 - RNA, 64 nt, Human; identical to SEQ ID NO: 303428

SEQ ID NO: 353320 - RNA, 64 nt, Human; identical to SEQ ID NO: 303429

SEQ ID NO: 353321 - RNA, 64 nt, Human; identical to SEQ ID NO: 303433

SEQ ID NO: 353322 - RNA, 64 nt, Human; identical to SEQ ID NO: 303434

SEQ ID NO: 353323 - RNA, 64 nt, Human; identical to SEQ ID NO: 303435

SEQ ID NO: 353324 - RNA, 64 nt, Human; identical to SEQ ID NO: 303436

SEQ ID NO: 353325 - RNA, 64 nt, Human; identical to SEQ ID NO: 303437

SEQ ID NO: 353326 - RNA, 64 nt, Human; identical to SEQ ID NO: 303438

SEQ ID NO: 353327 - RNA, 64 nt, Human; identical to SEQ ID NO: 303439

SEQ ID NO: 353328 - RNA, 64 nt, Human; identical to SEQ ID NO: 303440

SEQ ID NO: 353329 - RNA, 64 nt, Human; identical to SEQ ID NO: 303441

SEQ ID NO: 353330 - RNA, 64 nt, Human; identical to SEQ ID NO: 303442

SEQ ID NO: 353331 - RNA, 64 nt, Human; identical to SEQ ID NO: 303443

SEQ ID NO: 353332 - RNA, 64 nt, Human; identical to SEQ ID NO: 303444

SEQ ID NO: 353333 - RNA, 64 nt, Human; identical to SEQ ID NO: 303445

SEQ ID NO: 353334 - RNA, 64 nt, Human; identical to SEQ ID NO: 303446

SEQ ID NO: 353335 - RNA, 64 nt, Human; identical to SEQ ID NO: 303447

SEQ ID NO: 353336 - RNA, 64 nt, Human; identical to SEQ ID NO: 303451

SEQ ID NO: 353337 - RNA, 60 nt, Human; identical to SEQ ID NO: 303452

SEQ ID NO: 353338 - RNA, 64 nt, Human; identical to SEQ ID NO: 303453

SEQ ID NO: 353339 - RNA, 64 nt, Human; identical to SEQ ID NO: 303454

SEQ ID NO: 353340 - RNA, 64 nt, Human; identical to SEQ ID NO: 303455

SEQ ID NO: 353341 - RNA, 52 nt, Human; identical to SEQ ID NO: 303456

SEQ ID NO: 353342 - RNA, 64 nt, Human; identical to SEQ ID NO: 303457

SEQ ID NO: 353343 - RNA, 64 nt, Human; identical to SEQ ID NO: 303458

SEQ ID NO: 353344 - RNA, 64 nt, Human; identical to SEQ ID NO: 303459

SEQ ID NO: 353345 - RNA, 64 nt, Human; identical to SEQ ID NO: 303460

SEQ ID NO: 353346 - RNA, 64 nt, Human; identical to SEQ ID NO: 303461

SEQ ID NO: 353347 - RNA, 64 nt, Human; identical to SEQ ID NO: 303462

SEQ ID NO: 353348 - RNA, 64 nt, Human; identical to SEQ ID NO: 303463

SEQ ID NO: 353349 - RNA, 64 nt, Human; identical to SEQ ID NO: 303464

SEQ ID NO: 353350 - RNA, 64 nt, Human; identical to SEQ ID NO: 303465

SEQ ID NO: 353351 - RNA, 64 nt, Human; identical to SEQ ID NO: 303469

SEQ ID NO: 353352 - RNA, 64 nt, Human; identical to SEQ ID NO: 303470

SEQ ID NO: 353353 - RNA, 64 nt, Human; identical to SEQ ID NO: 303471

SEQ ID NO: 353354 - RNA, 64 nt, Human; identical to SEQ ID NO: 303472

SEQ ID NO: 353355 - RNA, 64 nt, Human; identical to SEQ ID NO: 303473

SEQ ID NO: 353356 - RNA, 64 nt, Human; identical to SEQ ID NO: 303474

SEQ ID NO: 353357 - RNA, 64 nt, Human; identical to SEQ ID NO: 303475

SEQ ID NO: 353358 - RNA, 54 nt, Human; identical to SEQ ID NO: 303476

SEQ ID NO: 353359 - RNA, 64 nt, Human; identical to SEQ ID NO: 303477

SEQ ID NO: 353360 - RNA, 64 nt, Human; identical to SEQ ID NO: 303478

SEQ ID NO: 353361 - RNA, 64 nt, Human; identical to SEQ ID NO: 303479

SEQ ID NO: 353362 - RNA, 64 nt, Human; identical to SEQ ID NO: 303480

SEQ ID NO: 353363 - RNA, 64 nt, Human; identical to SEQ ID NO: 303481

SEQ ID NO: 353364 - RNA, 64 nt, Human; identical to SEQ ID NO: 303482

SEQ ID NO: 353365 - RNA, 64 nt, Human; identical to SEQ ID NO: 303483

SEQ ID NO: 353366 - RNA, 64 nt, Human; identical to SEQ ID NO: 303487

SEQ ID NO: 353367 - RNA, 64 nt, Human; identical to SEQ ID NO: 303488

SEQ ID NO: 353368 - RNA, 59 nt, Human; identical to SEQ ID NO: 303489

SEQ ID NO: 353369 - RNA, 64 nt, Human; identical to SEQ ID NO: 303490

SEQ ID NO: 353370 - RNA, 64 nt, Human; identical to SEQ ID NO: 303491

SEQ ID NO: 353371 - RNA, 64 nt, Human; identical to SEQ ID NO: 303492

SEQ ID NO: 353372 - RNA, 64 nt, Human; identical to SEQ ID NO: 303493

SEQ ID NO: 353373 - RNA, 64 nt, Human; identical to SEQ ID NO: 303494

SEQ ID NO: 353374 - RNA, 64 nt, Human; identical to SEQ ID NO: 303495

SEQ ID NO: 353375 - RNA, 64 nt, Human; identical to SEQ ID NO: 303496

SEQ ID NO: 353376 - RNA, 64 nt, Human; identical to SEQ ID NO: 303497

SEQ ID NO: 353377 - RNA, 64 nt, Human; identical to SEQ ID NO: 303498

SEQ ID NO: 353378 - RNA, 64 nt, Human; identical to SEQ ID NO: 303499

SEQ ID NO: 353379 - RNA, 64 nt, Human; identical to SEQ ID NO: 303500

SEQ ID NO: 353380 - RNA, 64 nt, Human; identical to SEQ ID NO: 303501

SEQ ID NO: 353381 - RNA, 64 nt, Human; identical to SEQ ID NO: 303505

SEQ ID NO: 353382 - RNA, 64 nt, Human; identical to SEQ ID NO: 303506

SEQ ID NO: 353383 - RNA, 64 nt, Human; identical to SEQ ID NO: 303507

SEQ ID NO: 353384 - RNA, 64 nt, Human; identical to SEQ ID NO: 303508

SEQ ID NO: 353385 - RNA, 64 nt, Human; identical to SEQ ID NO: 303509

SEQ ID NO: 353386 - RNA, 64 nt, Human; identical to SEQ ID NO: 303510

SEQ ID NO: 353387 - RNA, 64 nt, Human; identical to SEQ ID NO: 303511

SEQ ID NO: 353388 - RNA, 64 nt, Human; identical to SEQ ID NO: 303512

SEQ ID NO: 353389 - RNA, 64 nt, Human; identical to SEQ ID NO: 303513

SEQ ID NO: 353390 - RNA, 64 nt, Human; identical to SEQ ID NO: 303514

SEQ ID NO: 353391 - RNA, 64 nt, Human; identical to SEQ ID NO: 303515

SEQ ID NO: 353392 - RNA, 64 nt, Human; identical to SEQ ID NO: 303516

SEQ ID NO: 353393 - RNA, 64 nt, Human; identical to SEQ ID NO: 303517

SEQ ID NO: 353394 - RNA, 64 nt, Human; identical to SEQ ID NO: 303518

SEQ ID NO: 353395 - RNA, 64 nt, Human; identical to SEQ ID NO: 303519

SEQ ID NO: 353396 - RNA, 64 nt, Human; identical to SEQ ID NO: 303523

SEQ ID NO: 353397 - RNA, 64 nt, Human; identical to SEQ ID NO: 303524

SEQ ID NO: 353398 - RNA, 64 nt, Human; identical to SEQ ID NO: 303525

SEQ ID NO: 353399 - RNA, 64 nt, Human; identical to SEQ ID NO: 303526

SEQ ID NO: 353400 - RNA, 64 nt, Human; identical to SEQ ID NO: 303527

SEQ ID NO: 353401 - RNA, 64 nt, Human; identical to SEQ ID NO: 303528

SEQ ID NO: 353402 - RNA, 64 nt, Human; identical to SEQ ID NO: 303529

SEQ ID NO: 353403 - RNA, 64 nt, Human; identical to SEQ ID NO: 303530

SEQ ID NO: 353404 - RNA, 62 nt, Human; identical to SEQ ID NO: 352788

SEQ ID NO: 353405 - RNA, 62 nt, Human; identical to SEQ ID NO: 352789

SEQ ID NO: 353406 - RNA, 62 nt, Human; identical to SEQ ID NO: 352790

SEQ ID NO: 353407 - RNA, 62 nt, Human; identical to SEQ ID NO: 352791

SEQ ID NO: 353408 - RNA, 62 nt, Human; identical to SEQ ID NO: 352792

SEQ ID NO: 353409 - RNA, 62 nt, Human; identical to SEQ ID NO: 352793

SEQ ID NO: 353410 - RNA, 62 nt, Human; identical to SEQ ID NO: 352794

SEQ ID NO: 353411 - RNA, 62 nt, Human; identical to SEQ ID NO: 352795

SEQ ID NO: 353412 - RNA, 62 nt, Human; identical to SEQ ID NO: 352796

SEQ ID NO: 353413 - RNA, 62 nt, Human; identical to SEQ ID NO: 352797

SEQ ID NO: 353414 - RNA, 62 nt, Human; identical to SEQ ID NO: 352798

SEQ ID NO: 353415 - RNA, 62 nt, Human; identical to SEQ ID NO: 352799

SEQ ID NO: 353416 - RNA, 62 nt, Human; identical to SEQ ID NO: 352800

SEQ ID NO: 353417 - RNA, 62 nt, Human; identical to SEQ ID NO: 352801

SEQ ID NO: 353418 - RNA, 62 nt, Human; identical to SEQ ID NO: 352802

SEQ ID NO: 353419 - RNA, 62 nt, Human; identical to SEQ ID NO: 352803

SEQ ID NO: 353420 - RNA, 62 nt, Human; identical to SEQ ID NO: 352804

SEQ ID NO: 353421 - RNA, 62 nt, Human; identical to SEQ ID NO: 352805

SEQ ID NO: 353422 - RNA, 62 nt, Human; identical to SEQ ID NO: 352806

SEQ ID NO: 353423 - RNA, 62 nt, Human; identical to SEQ ID NO: 352807

SEQ ID NO: 353424 - RNA, 62 nt, Human; identical to SEQ ID NO: 352808

SEQ ID NO: 353425 - RNA, 62 nt, Human; identical to SEQ ID NO: 352809

SEQ ID NO: 353426 - RNA, 59 nt, Human; identical to SEQ ID NO: 352810

SEQ ID NO: 353427 - RNA, 62 nt, Human; identical to SEQ ID NO: 352811

SEQ ID NO: 353428 - RNA, 62 nt, Human; identical to SEQ ID NO: 352812

SEQ ID NO: 353429 - RNA, 62 nt, Human; identical to SEQ ID NO: 352813

SEQ ID NO: 353430 - RNA, 62 nt, Human; identical to SEQ ID NO: 352814

SEQ ID NO: 353431 - RNA, 62 nt, Human; identical to SEQ ID NO: 352815

SEQ ID NO: 353432 - RNA, 62 nt, Human; identical to SEQ ID NO: 352816

SEQ ID NO: 353433 - RNA, 54 nt, Human; identical to SEQ ID NO: 352817

SEQ ID NO: 353434 - RNA, 62 nt, Human; identical to SEQ ID NO: 352818

SEQ ID NO: 353435 - RNA, 62 nt, Human; identical to SEQ ID NO: 352819

SEQ ID NO: 353436 - RNA, 62 nt, Human; identical to SEQ ID NO: 352820

SEQ ID NO: 353437 - RNA, 62 nt, Human; identical to SEQ ID NO: 352821

SEQ ID NO: 353438 - RNA, 62 nt, Human; identical to SEQ ID NO: 352822

SEQ ID NO: 353439 - RNA, 62 nt, Human; identical to SEQ ID NO: 352823

SEQ ID NO: 353440 - RNA, 62 nt, Human; identical to SEQ ID NO: 352824

SEQ ID NO: 353441 - RNA, 62 nt, Human; identical to SEQ ID NO: 352825

SEQ ID NO: 353442 - RNA, 62 nt, Human; identical to SEQ ID NO: 352826

SEQ ID NO: 353443 - RNA, 62 nt, Human; identical to SEQ ID NO: 352827

SEQ ID NO: 353444 - RNA, 62 nt, Human; identical to SEQ ID NO: 352828

SEQ ID NO: 353445 - RNA, 62 nt, Human; identical to SEQ ID NO: 352829

SEQ ID NO: 353446 - RNA, 62 nt, Human; identical to SEQ ID NO: 352830

SEQ ID NO: 353447 - RNA, 62 nt, Human; identical to SEQ ID NO: 352831

SEQ ID NO: 353448 - RNA, 62 nt, Human; identical to SEQ ID NO: 352832

SEQ ID NO: 353449 - RNA, 62 nt, Human; identical to SEQ ID NO: 352833

SEQ ID NO: 353450 - RNA, 62 nt, Human; identical to SEQ ID NO: 352834

SEQ ID NO: 353451 - RNA, 62 nt, Human; identical to SEQ ID NO: 352835

SEQ ID NO: 353452 - RNA, 62 nt, Human; identical to SEQ ID NO: 352836

SEQ ID NO: 353453 - RNA, 62 nt, Human; identical to SEQ ID NO: 352837

SEQ ID NO: 353454 - RNA, 62 nt, Human; identical to SEQ ID NO: 352838

SEQ ID NO: 353455 - RNA, 62 nt, Human; identical to SEQ ID NO: 352839

SEQ ID NO: 353456 - RNA, 62 nt, Human; identical to SEQ ID NO: 352840

SEQ ID NO: 353457 - RNA, 62 nt, Human; identical to SEQ ID NO: 352841

SEQ ID NO: 353458 - RNA, 62 nt, Human; identical to SEQ ID NO: 352842

SEQ ID NO: 353459 - RNA, 62 nt, Human; identical to SEQ ID NO: 352843

SEQ ID NO: 353460 - RNA, 62 nt, Human; identical to SEQ ID NO: 352844

SEQ ID NO: 353461 - RNA, 62 nt, Human; identical to SEQ ID NO: 352845

SEQ ID NO: 353462 - RNA, 62 nt, Human; identical to SEQ ID NO: 352846

SEQ ID NO: 353463 - RNA, 62 nt, Human; identical to SEQ ID NO: 352847

SEQ ID NO: 353464 - RNA, 62 nt, Human; identical to SEQ ID NO: 352848

SEQ ID NO: 353465 - RNA, 62 nt, Human; identical to SEQ ID NO: 352849

SEQ ID NO: 353466 - RNA, 62 nt, Human; identical to SEQ ID NO: 352850

SEQ ID NO: 353467 - RNA, 62 nt, Human; identical to SEQ ID NO: 352851

SEQ ID NO: 353468 - RNA, 62 nt, Human; identical to SEQ ID NO: 352852

SEQ ID NO: 353469 - RNA, 62 nt, Human; identical to SEQ ID NO: 352853

SEQ ID NO: 353470 - RNA, 62 nt, Human; identical to SEQ ID NO: 352854

SEQ ID NO: 353471 - RNA, 62 nt, Human; identical to SEQ ID NO: 352855

SEQ ID NO: 353472 - RNA, 62 nt, Human; identical to SEQ ID NO: 352856

SEQ ID NO: 353473 - RNA, 62 nt, Human; identical to SEQ ID NO: 352857

SEQ ID NO: 353474 - RNA, 62 nt, Human; identical to SEQ ID NO: 352858

SEQ ID NO: 353475 - RNA, 62 nt, Human; identical to SEQ ID NO: 352859

SEQ ID NO: 353476 - RNA, 62 nt, Human; identical to SEQ ID NO: 352860

SEQ ID NO: 353477 - RNA, 62 nt, Human; identical to SEQ ID NO: 352861

SEQ ID NO: 353478 - RNA, 62 nt, Human; identical to SEQ ID NO: 352862

SEQ ID NO: 353479 - RNA, 62 nt, Human; identical to SEQ ID NO: 352863

SEQ ID NO: 353480 - RNA, 50 nt, Human; identical to SEQ ID NO: 352864

SEQ ID NO: 353481 - RNA, 62 nt, Human; identical to SEQ ID NO: 352865

SEQ ID NO: 353482 - RNA, 62 nt, Human; identical to SEQ ID NO: 352866

SEQ ID NO: 353483 - RNA, 62 nt, Human; identical to SEQ ID NO: 352867

SEQ ID NO: 353484 - RNA, 62 nt, Human; identical to SEQ ID NO: 352868

SEQ ID NO: 353485 - RNA, 62 nt, Human; identical to SEQ ID NO: 352869

SEQ ID NO: 353486 - RNA, 62 nt, Human; identical to SEQ ID NO: 352870

SEQ ID NO: 353487 - RNA, 62 nt, Human; identical to SEQ ID NO: 352871

SEQ ID NO: 353488 - RNA, 62 nt, Human; identical to SEQ ID NO: 352872

SEQ ID NO: 353489 - RNA, 62 nt, Human; identical to SEQ ID NO: 352873

SEQ ID NO: 353490 - RNA, 62 nt, Human; identical to SEQ ID NO: 352874

SEQ ID NO: 353491 - RNA, 62 nt, Human; identical to SEQ ID NO: 352875

SEQ ID NO: 353492 - RNA, 62 nt, Human; identical to SEQ ID NO: 352876

SEQ ID NO: 353493 - RNA, 62 nt, Human; identical to SEQ ID NO: 352877

SEQ ID NO: 353494 - RNA, 62 nt, Human; identical to SEQ ID NO: 352878

SEQ ID NO: 353495 - RNA, 62 nt, Human; identical to SEQ ID NO: 352879

SEQ ID NO: 353496 - RNA, 62 nt, Human; identical to SEQ ID NO: 352880

SEQ ID NO: 353497 - RNA, 62 nt, Human; identical to SEQ ID NO: 352881

SEQ ID NO: 353498 - RNA, 62 nt, Human; identical to SEQ ID NO: 352882

SEQ ID NO: 353499 - RNA, 62 nt, Human; identical to SEQ ID NO: 352883

SEQ ID NO: 353500 - RNA, 62 nt, Human; identical to SEQ ID NO: 352884

SEQ ID NO: 353501 - RNA, 62 nt, Human; identical to SEQ ID NO: 352885

SEQ ID NO: 353502 - RNA, 62 nt, Human; identical to SEQ ID NO: 352886

SEQ ID NO: 353503 - RNA, 62 nt, Human; identical to SEQ ID NO: 352887

SEQ ID NO: 353504 - RNA, 62 nt, Human; identical to SEQ ID NO: 352888

SEQ ID NO: 353505 - RNA, 62 nt, Human; identical to SEQ ID NO: 352889

SEQ ID NO: 353506 - RNA, 62 nt, Human; identical to SEQ ID NO: 352890

SEQ ID NO: 353507 - RNA, 62 nt, Human; identical to SEQ ID NO: 352891

SEQ ID NO: 353508 - RNA, 64 nt, Human
cuugaugugagagagacucugagacuucuuccaucgcaaugaccuguauuaaacacaagccccc

SEQ ID NO: 353509 - RNA, 64 nt, Human
ggguuuggcuuaggcugguagcuucuauguaauucgcaaugauuccaucuaaauaaaaguucua

SEQ ID NO: 353510 - RNA, 64 nt, Human
auucugacauuuggcccagccuguacuggugugccgcaaugagagucaaucucuauugacagcc

SEQ ID NO: 353511 - RNA, 64 nt, Human
uuaaaacagcugaaaauugggacaacauacuuuacgcaaugaacaguaguuaaauaggaaauaa

SEQ ID NO: 353512 - RNA, 64 nt, Human
auauauuacauuugguaaaaucagugcuuaaauacgcaaugauuuaaacuggaaccugagguau

SEQ ID NO: 353513 - RNA, 64 nt, Human
auuguucuguucuaaaaagcuguugcacagcauucgcaaugagaucuuuaguuggcggauuuuc

SEQ ID NO: 353514 - RNA, 64 nt, Human; identical to SEQ ID NO: 335276

SEQ ID NO: 353515 - RNA, 64 nt, Human; identical to SEQ ID NO: 335277

SEQ ID NO: 353516 - RNA, 64 nt, Human; identical to SEQ ID NO: 335278

SEQ ID NO: 353517 - RNA, 64 nt, Human
uacaauuuuggauaaauagcacauuuauaagaaccgcaaugaaaacugacuugaaauaaugcuu

SEQ ID NO: 353518 - RNA, 64 nt, Human
cuaggcauaguaccugaggccaggagguccaggccgcaaugagauguguuugugccauugcaca

SEQ ID NO: 353519 - RNA, 64 nt, Human
ccuaaaugcacagucaugugccuacguccugccucgcaaugagggagcauguaccccagguaca

SEQ ID NO: 353520 - RNA, 64 nt, Human
ucugcucagucugucccccuucccccucgacccccgcaaugagugggcaccaggggacgcucug

SEQ ID NO: 353521 - RNA, 64 nt, Human
gagcugaggaacagagcaaauguagugauagaagcgcaaugagagaagcagcaguggguacaag

SEQ ID NO: 353522 - RNA, 64 nt, Human
caacaaucaacugguuuucaccaaguccaaccaccgcaaugaguucuggagugcucugcuggag

SEQ ID NO: 353523 - RNA, 64 nt, Human
auucuuuauugucaucauaaggaaaaacuuuuaucgcaaugauagucaguucacauuaguuuag

SEQ ID NO: 353524 - RNA, 64 nt, Human
gacgauauacaggcacauuauguaaacauacacacgcaaugaaaccgaagcuuggcggccuggg

SEQ ID NO: 353525 - RNA, 64 nt, Human
uggguuaccagcuacccuguguauacagcccugacgcaaugaaaagucguuuuccaaacugacu

SEQ ID NO: 353526 - RNA, 64 nt, Human
acggguccccugggucugcauaggucucccauggcgcaaugagucaguggcccccagccaggca

SEQ ID NO: 353527 - RNA, 64 nt, Human
aucaugugcaauauuucuuacugugccgagaagccgcaaugagcgagauuaaagcuguuuaaca

SEQ ID NO: 353528 - RNA, 64 nt, Human
ucucuccaggaaugucaccgucucccucuucuaccgcaaugacuccgcccaccugccccugccu

SEQ ID NO: 353529 - RNA, 64 nt, Human
aacauuaagagauuauuggcacagccguggguuacgcaaugauuucuuaguacacaaaacacag

SEQ ID NO: 353530 - RNA, 64 nt, Human
auucucagggcguuugaaugugaauuaggaccagcgcaaugaaugcucaaguugggguugggcg

SEQ ID NO: 353531 - RNA, 64 nt, Human; identical to SEQ ID NO: 335279

SEQ ID NO: 353532 - RNA, 64 nt, Human; identical to SEQ ID NO: 335280

SEQ ID NO: 353533 - RNA, 64 nt, Human; identical to SEQ ID NO: 335281

SEQ ID NO: 353534 - RNA, 64 nt, Human
aggaguggggaauugugaagcccacagaugcgcacgcaaugaccagcaggaaccggaagcccug

SEQ ID NO: 353535 - RNA, 64 nt, Human
aaacuugcuccuaaaugaacacauaaguuuagaucgcaaugaggaguagcaggguagcugguug

SEQ ID NO: 353536 - RNA, 64 nt, Human; identical to SEQ ID NO: 252227

SEQ ID NO: 353537 - RNA, 64 nt, Human; identical to SEQ ID NO: 252228

SEQ ID NO: 353538 - RNA, 64 nt, Human; identical to SEQ ID NO: 252229

SEQ ID NO: 353539 - RNA, 64 nt, Human; identical to SEQ ID NO: 252230

SEQ ID NO: 353540 - RNA, 64 nt, Human; identical to SEQ ID NO: 252231

SEQ ID NO: 353541 - RNA, 64 nt, Human; identical to SEQ ID NO: 252232

SEQ ID NO: 353542 - RNA, 64 nt, Human; identical to SEQ ID NO: 252233

SEQ ID NO: 353543 - RNA, 64 nt, Human; identical to SEQ ID NO: 252234

SEQ ID NO: 353544 - RNA, 64 nt, Human; identical to SEQ ID NO: 252235

SEQ ID NO: 353545 - RNA, 64 nt, Human; identical to SEQ ID NO: 252236

SEQ ID NO: 353546 - RNA, 64 nt, Human; identical to SEQ ID NO: 252237

SEQ ID NO: 353547 - RNA, 64 nt, Human; identical to SEQ ID NO: 252238

SEQ ID NO: 353548 - RNA, 64 nt, Human
gaaauaugaaaaauguuugaauaugaucuuuagggacuucuaaugaaaaggguauaugaaaugg

SEQ ID NO: 353549 - RNA, 64 nt, Human
gccaccuuccugacuucuaucugggcuuggccaggacuucuagucccucauaccagcccuccuu

SEQ ID NO: 353550 - RNA, 64 nt, Human
guguaaaauuccaccaguuuccagccaccuuccugacuucuaucugggcuuggccaggacuucu

SEQ ID NO: 353551 - RNA, 57 nt, Human; identical to SEQ ID NO: 252239

SEQ ID NO: 353552 - RNA, 64 nt, Human; identical to SEQ ID NO: 252240

SEQ ID NO: 353553 - RNA, 64 nt, Human; identical to SEQ ID NO: 252241

SEQ ID NO: 353554 - RNA, 64 nt, Human; identical to SEQ ID NO: 251914

SEQ ID NO: 353555 - RNA, 64 nt, Human; identical to SEQ ID NO: 250147

SEQ ID NO: 353556 - RNA, 64 nt, Human; identical to SEQ ID NO: 252130

SEQ ID NO: 353557 - RNA, 64 nt, Human; identical to SEQ ID NO: 252131

SEQ ID NO: 353558 - RNA, 64 nt, Human; identical to SEQ ID NO: 252132

SEQ ID NO: 353559 - RNA, 64 nt, Human; identical to SEQ ID NO: 252073

SEQ ID NO: 353560 - RNA, 64 nt, Human; identical to SEQ ID NO: 250148

SEQ ID NO: 353561 - RNA, 64 nt, Human; identical to SEQ ID NO: 252149

SEQ ID NO: 353562 - RNA, 64 nt, Human; identical to SEQ ID NO: 252150

SEQ ID NO: 353563 - RNA, 64 nt, Human; identical to SEQ ID NO: 252151

SEQ ID NO: 353564 - RNA, 64 nt, Human; identical to SEQ ID NO: 251977

SEQ ID NO: 353565 - RNA, 64 nt, Human; identical to SEQ ID NO: 250164

SEQ ID NO: 353566 - RNA, 64 nt, Human; identical to SEQ ID NO: 252184

SEQ ID NO: 353567 - RNA, 64 nt, Human
ccuccauaauaaucaaacggugauucaucuaaaugacuucuagcaaccuaaguaaaaacauucc

SEQ ID NO: 353568 - RNA, 64 nt, Human
uccuaggaagcccacugauccccaacgggagcaagacuucuaacggcugauugguauggaccga

SEQ ID NO: 353569 - RNA, 64 nt, Human
cauuauauaucggacauauaauauguaaauaaaugacuucuagaaagagaaauuuguuuaauuu

SEQ ID NO: 353570 - RNA, 64 nt, Human; identical to SEQ ID NO: 252185

SEQ ID NO: 353571 - RNA, 64 nt, Human; identical to SEQ ID NO: 252186

SEQ ID NO: 353572 - RNA, 64 nt, Human; identical to SEQ ID NO: 251915

SEQ ID NO: 353573 - RNA, 64 nt, Human; identical to SEQ ID NO: 250165

SEQ ID NO: 353574 - RNA, 64 nt, Human; identical to SEQ ID NO: 252202

SEQ ID NO: 353575 - RNA, 62 nt, Human; identical to SEQ ID NO: 252203

SEQ ID NO: 353576 - RNA, 64 nt, Human; identical to SEQ ID NO: 252204

SEQ ID NO: 353577 - RNA, 64 nt, Human; identical to SEQ ID NO: 252220

SEQ ID NO: 353578 - RNA, 64 nt, Human; identical to SEQ ID NO: 250166

SEQ ID NO: 353579 - RNA, 64 nt, Human; identical to SEQ ID NO: 252221

SEQ ID NO: 353580 - RNA, 64 nt, Human; identical to SEQ ID NO: 252222

SEQ ID NO: 353581 - RNA, 64 nt, Human; identical to SEQ ID NO: 252168

SEQ ID NO: 353582 - RNA, 64 nt, Human; identical to SEQ ID NO: 250182

SEQ ID NO: 353583 - RNA, 64 nt, Human; identical to SEQ ID NO: 251878

SEQ ID NO: 353584 - RNA, 64 nt, Human; identical to SEQ ID NO: 251879

SEQ ID NO: 353585 - RNA, 53 nt, Human; identical to SEQ ID NO: 251880

SEQ ID NO: 353586 - RNA, 64 nt, Human
aacucauacuaacugguuuggaugccuggguugugacuucuacugaccgcuagauaaacgugug

SEQ ID NO: 353587 - RNA, 64 nt, Human; identical to SEQ ID NO: 251864

SEQ ID NO: 353588 - RNA, 64 nt, Human; identical to SEQ ID NO: 250183

SEQ ID NO: 353589 - RNA, 64 nt, Human; identical to SEQ ID NO: 251896

SEQ ID NO: 353590 - RNA, 64 nt, Human; identical to SEQ ID NO: 251897

SEQ ID NO: 353591 - RNA, 64 nt, Human; identical to SEQ ID NO: 251898

SEQ ID NO: 353592 - RNA, 64 nt, Human; identical to SEQ ID NO: 251916

SEQ ID NO: 353593 - RNA, 64 nt, Human; identical to SEQ ID NO: 250184

SEQ ID NO: 353594 - RNA, 64 nt, Human; identical to SEQ ID NO: 251932

SEQ ID NO: 353595 - RNA, 64 nt, Human; identical to SEQ ID NO: 251933

SEQ ID NO: 353596 - RNA, 64 nt, Human; identical to SEQ ID NO: 251934

SEQ ID NO: 353597 - RNA, 64 nt, Human; identical to SEQ ID NO: 251950

SEQ ID NO: 353598 - RNA, 64 nt, Human; identical to SEQ ID NO: 250200

SEQ ID NO: 353599 - RNA, 64 nt, Human; identical to SEQ ID NO: 251978

SEQ ID NO: 353600 - RNA, 64 nt, Human; identical to SEQ ID NO: 251979

SEQ ID NO: 353601 - RNA, 64 nt, Human; identical to SEQ ID NO: 251980

SEQ ID NO: 353602 - RNA, 64 nt, Human; identical to SEQ ID NO: 252074

SEQ ID NO: 353603 - RNA, 62 nt, Human
gguggugugcaccuguaaucccagcuacucgagaggccaaggcaugagaaucgcuugaaccu

SEQ ID NO: 353604 - RNA, 62 nt, Human
aguggcucaugccuauaauuccagcacuuugggaggccaaggcagaaggaucacuugagacc

SEQ ID NO: 353605 - RNA, 62 nt, Human
gaaaugccaagacucuaugcucuggaaaaccugaggccaaauauugaucuguauuaagcucc

SEQ ID NO: 353606 - RNA, 64 nt, Human; identical to SEQ ID NO: 250201

SEQ ID NO: 353607 - RNA, 58 nt, Human; identical to SEQ ID NO: 251997

SEQ ID NO: 353608 - RNA, 64 nt, Human; identical to SEQ ID NO: 251998

SEQ ID NO: 353609 - RNA, 64 nt, Human; identical to SEQ ID NO: 251999

SEQ ID NO: 353610 - RNA, 64 nt, Human; identical to SEQ ID NO: 251830

SEQ ID NO: 353611 - RNA, 64 nt, Human; identical to SEQ ID NO: 250202

SEQ ID NO: 353612 - RNA, 64 nt, Human; identical to SEQ ID NO: 252016

SEQ ID NO: 353613 - RNA, 64 nt, Human; identical to SEQ ID NO: 252017

SEQ ID NO: 353614 - RNA, 64 nt, Human; identical to SEQ ID NO: 252018

SEQ ID NO: 353615 - RNA, 64 nt, Human; identical to SEQ ID NO: 252092

SEQ ID NO: 353616 - RNA, 64 nt, Human; identical to SEQ ID NO: 250204

SEQ ID NO: 353617 - RNA, 64 nt, Human; identical to SEQ ID NO: 252054

SEQ ID NO: 353618 - RNA, 64 nt, Human; identical to SEQ ID NO: 252055

SEQ ID NO: 353619 - RNA, 64 nt, Human; identical to SEQ ID NO: 252056

SEQ ID NO: 353620 - RNA, 64 nt, Human; identical to SEQ ID NO: 251865

SEQ ID NO: 353621 - RNA, 64 nt, Human; identical to SEQ ID NO: 250205

SEQ ID NO: 353622 - RNA, 64 nt, Human
gugagaaauguaaugcugacuuuuauaaagccuggacuucuacuuuauuuaauaaaucaauguu

SEQ ID NO: 353623 - RNA, 64 nt, Human
acuucccgagagcaguggugguuuugaggguuuugacuucuauuacuuuuggcagccuggaaag

SEQ ID NO: 353624 - RNA, 62 nt, Human
gaggcuugcauaauaagcuaaagaggcugaaagaggccaaugccccacuggcagcaucuuca

SEQ ID NO: 353625 - RNA, 64 nt, Human; identical to SEQ ID NO: 252075

SEQ ID NO: 353626 - RNA, 64 nt, Human; identical to SEQ ID NO: 251797

SEQ ID NO: 353627 - RNA, 64 nt, Human; identical to SEQ ID NO: 250206

SEQ ID NO: 353628 - RNA, 64 nt, Human; identical to SEQ ID NO: 252093

SEQ ID NO: 353629 - RNA, 64 nt, Human; identical to SEQ ID NO: 252094

SEQ ID NO: 353630 - RNA, 64 nt, Human; identical to SEQ ID NO: 251746

SEQ ID NO: 353631 - RNA, 64 nt, Human; identical to SEQ ID NO: 250207

SEQ ID NO: 353632 - RNA, 64 nt, Human; identical to SEQ ID NO: 252111

SEQ ID NO: 353633 - RNA, 64 nt, Human; identical to SEQ ID NO: 252112

SEQ ID NO: 353634 - RNA, 64 nt, Human; identical to SEQ ID NO: 252113

SEQ ID NO: 353635 - RNA, 64 nt, Human; identical to SEQ ID NO: 251715

SEQ ID NO: 353636 - RNA, 64 nt, Human; identical to SEQ ID NO: 250208

SEQ ID NO: 353637 - RNA, 64 nt, Human; identical to SEQ ID NO: 252169

SEQ ID NO: 353638 - RNA, 64 nt, Human; identical to SEQ ID NO: 252170

SEQ ID NO: 353639 - RNA, 64 nt, Human; identical to SEQ ID NO: 251698

SEQ ID NO: 353640 - RNA, 57 nt, Human; identical to SEQ ID NO: 250209

SEQ ID NO: 353641 - RNA, 62 nt, Human
gguggcucaugccuauaaucccagcacuuugggaggccaagguggguggaucaccugagguc

SEQ ID NO: 353642 - RNA, 62 nt, Human
ucauggcguaaugggccugcccaaugcuuugggaggccaaggcagguagaucgcuugagccc

SEQ ID NO: 353643 - RNA, 62 nt, Human
gguggugggugccuguaaucccagcuacucgagaggccaaggcaggagaauugcuagaaccu

SEQ ID NO: 353644 - RNA, 64 nt, Human; identical to SEQ ID NO: 251664

SEQ ID NO: 353645 - RNA, 64 nt, Human; identical to SEQ ID NO: 251665

SEQ ID NO: 353646 - RNA, 64 nt, Human; identical to SEQ ID NO: 251666

SEQ ID NO: 353647 - RNA, 64 nt, Human; identical to SEQ ID NO: 251699

SEQ ID NO: 353648 - RNA, 64 nt, Human; identical to SEQ ID NO: 250210

SEQ ID NO: 353649 - RNA, 64 nt, Human; identical to SEQ ID NO: 251681

SEQ ID NO: 353650 - RNA, 64 nt, Human; identical to SEQ ID NO: 251682

SEQ ID NO: 353651 - RNA, 64 nt, Human; identical to SEQ ID NO: 251683

SEQ ID NO: 353652 - RNA, 64 nt, Human; identical to SEQ ID NO: 251716

SEQ ID NO: 353653 - RNA, 64 nt, Human; identical to SEQ ID NO: 250211

SEQ ID NO: 353654 - RNA, 64 nt, Human; identical to SEQ ID NO: 251700

SEQ ID NO: 353655 - RNA, 64 nt, Human; identical to SEQ ID NO: 251747

SEQ ID NO: 353656 - RNA, 64 nt, Human; identical to SEQ ID NO: 250212

SEQ ID NO: 353657 - RNA, 64 nt, Human; identical to SEQ ID NO: 251717

SEQ ID NO: 353658 - RNA, 62 nt, Human
ggccccagaugcgcugugccaaagccagguccgaggccaaaguucucccugccauccuuggu

SEQ ID NO: 353659 - RNA, 62 nt, Human
caagcgaucuuuggaggaaacaagaaucccaagaggccaagaacagccccaucugacgcaug

SEQ ID NO: 353660 - RNA, 62 nt, Human
gguggcucacgccuguaaucccaacacuuugggaggccaaggcaggcggaucaccugagguc

SEQ ID NO: 353661 - RNA, 64 nt, Human
cuguucuuacuucauggcuugggaguugccaaaaagagcuuauagccggaagcccugggacaac

SEQ ID NO: 353662 - RNA, 64 nt, Human
aaacagcguggauuuuacuuaucuguguauucacagagcuuagcacagugccugguaaugagca

SEQ ID NO: 353663 - RNA, 64 nt, Human
gugggugguuuuuugucuucuguuguccacagccagagcuuaguggaugggugugugugugugu

SEQ ID NO: 353664 - RNA, 64 nt, Human
caccacuccuuaccuucuaugugauggaaagacuagagcuuauaaaaguacuuccauuuuuuua

SEQ ID NO: 353665 - RNA, 64 nt, Human
cuugcuuuaagcagugaaguuauccuaaugcaaaagagcuuaguagaaaaugagugguuuaccu

SEQ ID NO: 353666 - RNA, 64 nt, Human
gaccucugagaggggacuggcauggggggaucucagagcuuacaggcugagccaagcccacggc

SEQ ID NO: 353667 - RNA, 64 nt, Human
uauuuauugauuccagguucccaugcuuuuuguuagagcuuauuaguacagguucucaagagau

SEQ ID NO: 353668 - RNA, 64 nt, Human
ggugggagagagaguuugagacagcuccguguggagagcuuagccccuggaggcagcacaagga

SEQ ID NO: 353669 - RNA, 64 nt, Human
auagacaccauaggggaaaguuuggggaugaaggagagcuuaaagguguuucaauuaaguuaga

SEQ ID NO: 353670 - RNA, 64 nt, Human
cagaagaaaugaaauccaacuagacaaauaaaguagagcuuaugaaaugguucaguaaagauga

SEQ ID NO: 353671 - RNA, 64 nt, Human
ccuuccuaauuccacagcugcucaauaaaguacaagagcuuaacaguguguuggcgcuuugcuu

SEQ ID NO: 353672 - RNA, 64 nt, Human
cuaucucaugcaaugaaagcauuuucuuccacaaagagcuuaauccucaugauaggauugccua

SEQ ID NO: 353673 - RNA, 64 nt, Human
cugggagcgcggaaagcagagcggacaggucagugacuucuauuuuugacucguguuuuuuuuu

SEQ ID NO: 353674 - RNA, 64 nt, Human
uuccuaaauuguuacaaugcuuuaccaaaucuaugacuucuacauaacacaaaccaguggucaa

SEQ ID NO: 353675 - RNA, 64 nt, Human
auuuuguaggauuuuuuuccuccccaccuucaaugacuucuaauuuauauuauccauagguuuc

SEQ ID NO: 353676 - RNA, 64 nt, Human
aagaauugaaagagagagagaagaaagaauacagagagcuuaccuuuugccuuucuguugaugu

SEQ ID NO: 353677 - RNA, 64 nt, Human; identical to SEQ ID NO: 337807

SEQ ID NO: 353678 - RNA, 64 nt, Human; identical to SEQ ID NO: 337808

SEQ ID NO: 353679 - RNA, 64 nt, Human; identical to SEQ ID NO: 337809

SEQ ID NO: 353680 - RNA, 64 nt, Human; identical to SEQ ID NO: 337810

SEQ ID NO: 353681 - RNA, 64 nt, Human; identical to SEQ ID NO: 337811

SEQ ID NO: 353682 - RNA, 64 nt, Human; identical to SEQ ID NO: 337812

SEQ ID NO: 353683 - RNA, 64 nt, Human; identical to SEQ ID NO: 337813

SEQ ID NO: 353684 - RNA, 64 nt, Human; identical to SEQ ID NO: 337814

SEQ ID NO: 353685 - RNA, 64 nt, Human; identical to SEQ ID NO: 337815

SEQ ID NO: 353686 - RNA, 64 nt, Human; identical to SEQ ID NO: 337808

SEQ ID NO: 353687 - RNA, 64 nt, Human; identical to SEQ ID NO: 337820

SEQ ID NO: 353688 - RNA, 64 nt, Human; identical to SEQ ID NO: 337821

SEQ ID NO: 353689 - RNA, 64 nt, Human; identical to SEQ ID NO: 337822

SEQ ID NO: 353690 - RNA, 64 nt, Human; identical to SEQ ID NO: 337823

SEQ ID NO: 353691 - RNA, 61 nt, Human
gccuccuuguccaggucucacugcuuugcaccguggucagagggacugucagcugagcuug

SEQ ID NO: 353692 - RNA, 61 nt, Human
uuauauuugugaguucaguuccgauggugcccguggucaaaagcgaaaaacauggacaauu

SEQ ID NO: 353693 - RNA, 59 nt, Human
accagcuguccccgcaguaaagaagccugcguggucaacuccugucuucaggccacacc

SEQ ID NO: 353694 - RNA, 64 nt, Human
aacagcugagucccugaugucauccuuaucucgaagagcuuagaaacaaagagugggaaauucc

SEQ ID NO: 353695 - RNA, 64 nt, Human
ccuuaagggguaucauguauggugauagguaucuagagcuuaaugcuacaugugagugacgaug

SEQ ID NO: 353696 - RNA, 64 nt, Human
cccaagacaacagcacuaguaaucccacuuaauaagagcuuauuuaauuggaugucagccucuu

SEQ ID NO: 353697 - RNA, 64 nt, Human
uguauagauuaauuuaauaacuuuuugaaauugcagagcuuaacucgccuaguagauuugcacc

SEQ ID NO: 353698 - RNA, 64 nt, Human
aauugaugucugggcaauuaaaauaaauggcauaagagcuuaaaaaccaaaguugugccagugg

SEQ ID NO: 353699 - RNA, 64 nt, Human
aacucccccaccugugguuuuaccugcagccagcagagcuuagcuucaaggacaccugccuuca

SEQ ID NO: 353700 - RNA, 64 nt, Human
ucuuccuauagaacacugugcauaccuugaauaaagagcuuauuauacuauauuguuauuuucu

SEQ ID NO: 353701 - RNA, 64 nt, Human
ugaccagcucacuugcagacacccugccggaagcagagcuuaaucuuccuaggacugaggucuu

SEQ ID NO: 353702 - RNA, 64 nt, Human
aggggauggagcaugaggcaagggaaggaaaagcagagcuuauuuuucaccuaagguggagaag

SEQ ID NO: 353703 - RNA, 64 nt, Human
gauccucaacuuagagaggaagaaaccaagacagagagcuuaacucacuucucucagggaaaau

SEQ ID NO: 353704 - RNA, 64 nt, Human
gcucagugcuauaaauuguagccaggaaauaagaagagcuuacacagagucgggggaucuuaau

SEQ ID NO: 353705 - RNA, 64 nt, Human
uacugucugagaucagaauaugacauugcaguaaagagcuuaaauaguuucaucuuugguuuuu

SEQ ID NO: 353706 - RNA, 64 nt, Human
cuuguaaagacacaucuuauugaauaaagagaugagagcuuaaguuuguauauuguuuccuucg

SEQ ID NO: 353707 - RNA, 64 nt, Human
uguguacuuuuucuacuuuuaggaaaauuuaaugagagcuuauugcaaaaauuguuauaauuug

SEQ ID NO: 353708 - RNA, 64 nt, Human
acagaaucauaaucauaaugcggcccccuuccccagagcuuaccucgaaugugaaaucccuacu

SEQ ID NO: 353709 - RNA, 64 nt, Human
gaggauauagcuuuuuaaaacccccuccuguuucagagcuuauauucuaguggaggaaguuaga

SEQ ID NO: 353710 - RNA, 61 nt, Human
aaaaauuguuauuaugggauuggaagaaacacguggucaugaauagaaaaaaaacaaaccc

SEQ ID NO: 353711 - RNA, 61 nt, Human
ggggggauguagaggggagggucaaagcacucguggucaauuuugaaucuaucuuaaaaua

SEQ ID NO: 353712 - RNA, 61 nt, Human
gaugggaaauggggcuagggaggugaaagugcguggucacaaaauaucagaaaugccagua

SEQ ID NO: 353713 - RNA, 64 nt, Human
ugaaaugacauuuguaccugaggcaauucuuauuagagcuuacucaggacuuuucaaacaucag

SEQ ID NO: 353714 - RNA, 64 nt, Human
ggggcccuguccagguagaaaagaaaugguauguagagcuuagauuucccuauugugacagagc

SEQ ID NO: 353715 - RNA, 64 nt, Human
cauccuaauaacagaagaucuugcaaagaaucacagagcuuaaugggucaagaaguugaauuug

SEQ ID NO: 353716 - RNA, 64 nt, Human
ccuguggcauaccuucaugugcuccacugcacccagagcuuaagccacaguccugcucaggcua

SEQ ID NO: 353717 - RNA, 64 nt, Human
gccucacuuucuucuagcugagcuuuaaaucauuagagcuuaaauugucagaucguucauugcc

SEQ ID NO: 353718 - RNA, 64 nt, Human
aaggaauauccugccauaguaaaauuggcucugaagagcuuagaggcaaguuacacaauguuuu

SEQ ID NO: 353719 - RNA, 64 nt, Human
acauuuuguaugauauguaaaacagauuuuuuguagagcuuacuuuuauuauuaaauguauuga

SEQ ID NO: 353720 - RNA, 64 nt, Human
gguuuuguuuuaauaaaacagcauguuuucagguagagcuuaaacuaaaugauguguuuacuua

SEQ ID NO: 353721 - RNA, 64 nt, Human
gcuuggcccagaauuagaguuauuagagcaagagagagcuuaggaagcaugagggcaacuauag

SEQ ID NO: 353722 - RNA, 55 nt, Human
ggaugaggaugccucuguagcaggcagagcuuaccaagucucuccgaacucaaau

SEQ ID NO: 353723 - RNA, 64 nt, Human
uacaaaccuacagagguggcgaguauguaacacaagagcuuaauaagacccucauagagcuuga

SEQ ID NO: 353724 - RNA, 64 nt, Human
aacccuggagcaauugagaggacuguuuaaacacagagcuuaacaauggcagaauuguauaucu

SEQ ID NO: 353725 - RNA, 64 nt, Human
auagcauuagagcaaguugcuugucauggcuugaagagcuuaacuuugucuuuugggugaguag

SEQ ID NO: 353726 - RNA, 64 nt, Human
ucauucuguuaaccaccauuccaacaggucgaggagagcuuaaacaccuucuuccucugccuug

SEQ ID NO: 353727 - RNA, 64 nt, Human
ucuuugaaaaccuuggcuuuagcccucuggaaucagagcuuacccaccauaguauauuuugaua

SEQ ID NO: 353728 - RNA, 64 nt, Human
aucucauuguacaagugagaaaacugagacccagagagcuuaagugacuuccucgaggucauag

SEQ ID NO: 353729 - RNA, 64 nt, Human
uggaaaagaucccuucaguuuggggugucaccaagacuucuacacaacccaggacuaccauuga

SEQ ID NO: 353730 - RNA, 64 nt, Human
guagcagacaauggacaacuguaguuucugaauugacuucuauagccaucuuuucccuuuuuug

SEQ ID NO: 353731 - RNA, 64 nt, Human
uaaaaaaaaaguugaaugacuucgugauacuuuggacuucuaaauuaaauuuaucaggcauaaa

SEQ ID NO: 353732 - RNA, 64 nt, Human
agaagcguggugcagcugggucugggacuucacuagagcuuacucuggagcaccuauuuucugu

SEQ ID NO: 353733 - RNA, 64 nt, Human
ugaaauuccaccuuucauccccuauggaugacggagagcuuacagaugacccuauugaaugcaa

SEQ ID NO: 353734 - RNA, 64 nt, Human
ccaacugaaucauuugugcacguguauagcucaaagagcuuagacuucaaauauaucuggugaa

SEQ ID NO: 353735 - RNA, 64 nt, Human
agggacaguucaacacccugcucccugaucugucagagcuuaccuuccaaccacaaggcaacuu

SEQ ID NO: 353736 - RNA, 64 nt, Human
ggauauuucacuuuaccaaguagauagaugguauagagcuuaaggcauuuucaugcucauaaau

SEQ ID NO: 353737 - RNA, 64 nt, Human
auuccuaguuacauucaacaaguauaaagauuauagagcuuauuuuaugaacuauaaacuauaa

SEQ ID NO: 353738 - RNA, 64 nt, Human
ccuuuuuacguuuauacucuguucuucuguacauagagcuuaaaauaaacauucuuuuugaacu

SEQ ID NO: 353739 - RNA, 64 nt, Human
agagauuuuagaaccuuguaacauacaauuuuuaagagcuuauauggcagcuuccuuuuuaccu

SEQ ID NO: 353740 - RNA, 64 nt, Human
agaauucuuuuucaacaauuuaaagcuuuuccauagagcuuauuuauauccuuuuuuuucauuu

SEQ ID NO: 353741 - RNA, 64 nt, Human
augagucuuuucaacauggucuucaacauggucuagagcuuaccagugaucuucugaucuucaa

SEQ ID NO: 353742 - RNA, 64 nt, Human
uaaccacucuacuguuucaaguuaaucuaguaauagagcuuacauauauuuguauaacugcuau

SEQ ID NO: 353743 - RNA, 64 nt, Human
aaagguuaucaaccauaugaauuuacuacuuuaaagagcuuacaagacccuaugaaaaaauuag

SEQ ID NO: 353744 - RNA, 64 nt, Human
uuuaaaacuggccugguuugccuuuuuuaucaagagagcuuaacagauaaaaaaugaaauuagu

SEQ ID NO: 353745 - RNA, 64 nt, Human
cuuuuuaguugaccaaauacaaacauccuaaaguagagcuuagggcaaauauuugauugagagg

SEQ ID NO: 353746 - RNA, 64 nt, Human
acuauugaguaaaaacuuguagaaagcacauuauagagcuuauguuggaauccaucuuggagga

SEQ ID NO: 353747 - RNA, 64 nt, Human
gucugcaucucaguuggccgccaucaguguaaauagagcuuaaagucaugguuuggcugcauaa

SEQ ID NO: 353748 - RNA, 64 nt, Human
aaacagucucaggaaaucaaauaugcaaagcacugacuucuaaguaaaaccacagcaguugaaa

SEQ ID NO: 353749 - RNA, 64 nt, Human
ccaagcaaaucccaacauuucucuucaguguguugacuucuauccuguuaacacuguaauaucu

SEQ ID NO: 353750 - RNA, 64 nt, Human
guuguguguugacuuacuauguuuugaaaguggugacuucuaccgaaugaguggaaguucccau

SEQ ID NO: 353751 - RNA, 64 nt, Human
guaacuauuuggguccuaugaaaauaguccuuaaagagcuuacauucaugugcuacuuuaacau

SEQ ID NO: 353752 - RNA, 64 nt, Human
uuaaccuggaggaagucucugguauggaguucugagagcuuaagagcuaaacaugaguuuagac

SEQ ID NO: 353753 - RNA, 64 nt, Human
auugcuagucagggugaauugugaaauugggugaagagcuuaggauucuaaucucauguuuuuu

SEQ ID NO: 353754 - RNA, 64 nt, Human
gaaaacaucuuaagagagcaagcuccaauaugcaagagcuuaucgauccuguacaucuaucaua

SEQ ID NO: 353755 - RNA, 64 nt, Human
uagacuuucuuaauauauuauaacacucauuccuagagcuuaggggugacucuuuaauauuacc

SEQ ID NO: 353756 - RNA, 64 nt, Human
uagagaacaaggcauuauucuuuuagggaaggugagagcuuauuuguaucagagcuuauuacuu

SEQ ID NO: 353757 - RNA, 64 nt, Human
auucuuuuagggaaggugagagcuuauuuguaucagagcuuauuacuugucaggauaaguaaau

SEQ ID NO: 353758 - RNA, 64 nt, Human
acgugucacuuagcaagguuugcugaugcuucaaagagcuuaguuugcgguuuccuggacgugg

SEQ ID NO: 353759 - RNA, 64 nt, Human
cacgguauuguuauuuuuguuaagaaucauguacagagcuuaaauguaauuuauauguuuuuaa

SEQ ID NO: 353760 - RNA, 64 nt, Human
gcaggugaccagcagugucauuguauuuauauacagagcuuaugacuuuaauuuuucaauaaag

SEQ ID NO: 353761 - RNA, 64 nt, Human
uuguagagugaagccaugggaagccauguguaacagagcuuagacauccaaaacuaaucaaugc

SEQ ID NO: 353762 - RNA, 64 nt, Human
ucagcaccugcauaucucugugacauggucacuuagagcuuaucuucccuaugaaucuccagau

SEQ ID NO: 353763 - RNA, 64 nt, Human
cccaccucaaacccaggagcagaacucaguauccagagcuuacaaggagcugcaaggguuugcc

SEQ ID NO: 353764 - RNA, 64 nt, Human
gaaauugcuaauagcucaugcaacucuuucaugaagagcuuagcuaugaccuuagaagacaaag

SEQ ID NO: 353765 - RNA, 64 nt, Human
agcgauacacuugcuuuggucaccagaggaggacagagcuuagagcagcuguggagaaucugaa

SEQ ID NO: 353766 - RNA, 64 nt, Human
aaacaccugaaaggccagaaugaggaagcccugaagagcuuaaaagaagcugaaaacuuaaugc

SEQ ID NO: 353767 - RNA, 64 nt, Human
ucaucacuaaucauucaagcuucgcagccagggcgacuucuaucaaccccugcucugcugagaa

SEQ ID NO: 353768 - RNA, 64 nt, Human
cuuaagucaauguaaaaaguauaaaaccccuucagacuucuacauuaaugauguauguguugcu

SEQ ID NO: 353769 - RNA, 64 nt, Human
aaaguugacauuugucguggaaugacuuuggaaagacuucuaaaagaaucuuuuucaaaucccu

SEQ ID NO: 353770 - RNA, 64 nt, Human
gcagguaucacuuuacuccauuguuaucugaccuagagcuuaauuaaguuuuagaaauauguaa

SEQ ID NO: 353771 - RNA, 64 nt, Human
gugggugggaagaggcccugaugcuggucuuuccagagcuuauaguugcuaacacuuuucuuug

SEQ ID NO: 353772 - RNA, 64 nt, Human
caaauccacaaauagccccgagauucaccguccuagagcuuaggccugucuuccaccccuccug

SEQ ID NO: 353773 - RNA, 64 nt, Human
guucaaggucacgguuugcugugggguuccugggagagcuuacucaccccggagucuuuucuuu

SEQ ID NO: 353774 - RNA, 64 nt, Human
acccacugaucucaccacuggggcaagcuaggucagagcuuagugauucacacugaaauuggca

SEQ ID NO: 353775 - RNA, 64 nt, Human
acuucuccacccucuugcauaccuccagggacagagagcuuacuaccucccaaggcagccuccu

SEQ ID NO: 353776 - RNA, 64 nt, Human
gugaggagaugcucaguagcagcagccuauggcaagagcuuauaaaugauugaugcaaauuugc

SEQ ID NO: 353777 - RNA, 64 nt, Human
augccagcaguggucauauugagugccaaagagaagagcuuacuggguaguuagaguucaucag

SEQ ID NO: 353778 - RNA, 64 nt, Human
augauuuuaaagcaaaaaucacccucuaguugaaagagcuuacagcucgagucaccuuuuagcu

SEQ ID NO: 353779 - RNA, 64 nt, Human
gacguuaaaggcauuuuauuccagcgucuucuagagagcuuaguguauacagaugagggugucc

SEQ ID NO: 353780 - RNA, 64 nt, Human
gccucgguccuugccgcagcacaaucccguggacagagcuuacuccaucuaacucguuuucaag

SEQ ID NO: 353781 - RNA, 64 nt, Human
aaacugaggcuuaggaagagaaugaaacuuguggagagcuuauacagagccucugggggaaaaa

SEQ ID NO: 353782 - RNA, 64 nt, Human
uuaauaugguuacauuuagccaaaguugagggaaagagcuuauaaaauuuaacuucuucauaau

SEQ ID NO: 353783 - RNA, 64 nt, Human
aauguuuuuuuugguauauauaaccagguacaccagagcuuacauauguuugaguuagacucuu

SEQ ID NO: 353784 - RNA, 64 nt, Human
ucucccugauuccucauccguuuuuuaagccugaagagcuuauuacuuauuugugcgaagugcc

SEQ ID NO: 353785 - RNA, 64 nt, Human
cagagaaccccaaagugggcaggcaaccccgacgagagcuuaucccuguggcggcaucaggagu

SEQ ID NO: 353786 - RNA, 64 nt, Human
auauuuuuuguaagauauaugcacauagaagggggacuucuaggaauuuauaaccaaaauuuua

SEQ ID NO: 353787 - RNA, 64 nt, Human
gauugaucagagagaauugaacugugaccuuuaagacuucuagacuaauucuuuuaguugauag

SEQ ID NO: 353788 - RNA, 64 nt, Human
gucacuuuauuacucccagaacaacaacuauccugacuucuaauaucauucacuagcuuugccu

SEQ ID NO: 353789 - RNA, 64 nt, Human
gugcuauacaauggaaagaugaaaauggaaaggaagagcuuauuuaagagacgcuggagaucuc

SEQ ID NO: 353790 - RNA, 64 nt, Human
aguaaaggugcuuuuuaaugugcagucuauuuccagagcuuacuuaguugcugauuuccagauu

SEQ ID NO: 353791 - RNA, 64 nt, Human
cuacacauuagcuccagcuaaaaagacacauuggagagcuuagaggauaagucucuggagcaga

SEQ ID NO: 353792 - RNA, 64 nt, Human
uuuauuuuagaugguguuaacuuuucguugcugaagagcuuaacuuuuuaaaggcuuuguccua

SEQ ID NO: 353793 - RNA, 64 nt, Human
acagacauaaauaagucacggcccaugaccuugaagagcuuacggccuuauaaagagguucacu

SEQ ID NO: 353794 - RNA, 64 nt, Human
gugauaagagcacaaaacaauuuucuaaucucaaagagcuuauauucuagugggguagagauaa

SEQ ID NO: 353795 - RNA, 64 nt, Human
agaauuuaacaccaucucucaaaugcuuuuuuggagagcuuaaugggauucugaauauuugcaa

SEQ ID NO: 353796 - RNA, 64 nt, Human
cauagauauuuuauauguauggaucuauauuuucagagcuuaucucugaagaucuaaacuuuug

SEQ ID NO: 353797 - RNA, 64 nt, Human
uaucauacuaagugugagcuucuggacauuuucaagagcuuacaaaaacuaaguggcauuguau

SEQ ID NO: 353798 - RNA, 64 nt, Human
gcugaggcaggagaauggcgugaaccugugaggcagagcuuacagugagccgagaucgugccac

SEQ ID NO: 353799 - RNA, 64 nt, Human
cuaccuuuucuaaaaucugugugcacauaauuaaagagcuuaauuuuuuuuuaaucguguguuu

SEQ ID NO: 353800 - RNA, 64 nt, Human
aaaccagccucuaaaaaauuaggugcugguaaugagagcuuaauaccaugguucccugcagguc

SEQ ID NO: 353801 - RNA, 64 nt, Human
ggccuauaggauuguuaagacugaauauuuuaaaagagcuuagaauggugccugacaaaugaga

SEQ ID NO: 353802 - RNA, 64 nt, Human
gcauauucuaaugaagcuacuuuauauaaauuggagagcuuauaaaaugcagaacauuucuauc

SEQ ID NO: 353803 - RNA, 64 nt, Human
auacaaaaggcauuuuauaugaauuauaaacugaagagcuuaaagauaguuacaaaauacaaaa

SEQ ID NO: 353804 - RNA, 64 nt, Human
cauccugcauuuacagaaaaagaaaugaaaacagagagcuuaaauaauuugccacaguaauguc

SEQ ID NO: 353805 - RNA, 64 nt, Human
cucaauccacccuuuuccaaguugauugcccaaggacuucuaacaauaaacucucuuuugcacc

SEQ ID NO: 353806 - RNA, 64 nt, Human
uuuuuuuuucugugcaggcuugauuggcaaauacgacuucuacauccauauucucaucuuucau

SEQ ID NO: 353807 - RNA, 64 nt, Human
uaauagcucaugcaucuuauuaaaugggauucuggacuucuacaauaguguggaaagccacauc

SEQ ID NO: 353808 - RNA, 64 nt, Human
uggccgugaagugggagcucuccuuuccaaaggcagagcuuacugucauggcucagauguucac

SEQ ID NO: 353809 - RNA, 64 nt, Human
aucuuuuucagaccaaaaaaaacuuuauuguaugagagcuuaucuuauccuguuuauuuuucca

SEQ ID NO: 353810 - RNA, 64 nt, Human
cauuuggaggcaauccuaccuugcuuuugcuucuagagcuuagcauaucugauuguugucaggc

SEQ ID NO: 353811 - RNA, 64 nt, Human
gccuaucaucauaucaaauaugccaauucuaaaaagagcuuaacauuagaauaguauaugguag

SEQ ID NO: 353812 - RNA, 64 nt, Human
ggggaaaaagucuuucgauuacuuaugccucuauagagcuuaauuucuugagaaauucaacagu

SEQ ID NO: 353813 - RNA, 64 nt, Human
aguugagaaagcauuuagcaugguggaaauguggagagcuuauuggugagagaggauggagcua

SEQ ID NO: 353814 - RNA, 64 nt, Human
ucccacagcccccucuagauucuuggaguuccgcagagcuuacuauacgcggucuguccuaauc

SEQ ID NO: 353815 - RNA, 64 nt, Human
aucugcaacugcuugauaaguauguugcauuuuaagagcuuauaauuguguauaauuuguuaac

SEQ ID NO: 353816 - RNA, 64 nt, Human
aucucugggaauggggagggaaauuauauguaauagagcuuaaaaauaaagugucaauuuccaa

SEQ ID NO: 353817 - RNA, 64 nt, Human
aacuagauuagcugguuaaagguaugauuauaagagagcuuauuguuuuaaaaaguuauauaaa

SEQ ID NO: 353818 - RNA, 64 nt, Human
ugugaaauauaacuuacaaauaaguacuuaaaacagagcuuaauggguaaagcaacagcugugu

SEQ ID NO: 353819 - RNA, 64 nt, Human
ggcagcugauacaaauugcagacuguguaaaaagagagcuuaaugauaauauuguggugccaca

SEQ ID NO: 353820 - RNA, 64 nt, Human
cugccuuuggaauaugacagaaucaauagcccagagagcuuagucaaagacgauaucacggucu

SEQ ID NO: 353821 - RNA, 64 nt, Human
uuuugugcaugaaaugagacuuccuuucaguguaagagcuuaaagcaagcucagucauacauga

SEQ ID NO: 353822 - RNA, 64 nt, Human
auucuagccugcauugagcuugcaugcuugcauaagagcuuaagaaccauugauuuaauguaau

SEQ ID NO: 353823 - RNA, 64 nt, Human
guguuuuuaaaaauuaaagaagaagaaaaguaaaagagcuuaccacuggcgccuaugcgaucac

SEQ ID NO: 353824 - RNA, 64 nt, Human
caaugaauuuaucuccaacuuccuaaaggcuuaugacuucuaaaaagugaaucuaucagcauuc

SEQ ID NO: 353825 - RNA, 64 nt, Human
gucuuagaaagcuagauuacuaguaaggcuuccagacuucuaucaguucuauugauucuacauc

SEQ ID NO: 353826 - RNA, 62 nt, Human
ucaagccaaauacaugacauaagaucaauaaagaggccaaauuuuuagcuguuuuauguaca

SEQ ID NO: 353827 - RNA, 64 nt, Human
guggagucugguucagccccgugcagacucacccagagcuuaacguugucuuucaaacacccug

SEQ ID NO: 353828 - RNA, 64 nt, Human
cuagaauugccuaauuuuuaguugauuucucuacagagcuuagcuuguguaguuauuucucuuu

SEQ ID NO: 353829 - RNA, 64 nt, Human
aagaugggaaacugugguacagauagacaugaagagagcuuagcagugauugagguggugacua

SEQ ID NO: 353830 - RNA, 64 nt, Human
aaaaaaaaaaaaaaaacaaucccaaggguacagaagagcuuaugaauaaaaguaguuuucuccu

SEQ ID NO: 353831 - RNA, 64 nt, Human
gaaauagaggagagaaaagagggccacguaacugagagcuuacagugccaaugccguuuguguu

SEQ ID NO: 353832 - RNA, 64 nt, Human
guucugcuguuuuuagcaaaagcguccagaaaggagagcuuagcaggaguccuagcccuuucac

SEQ ID NO: 353833 - RNA, 64 nt, Human
cagcuguuugaaguuuguauauuuuccguacugcagagcuuacacaaaauugaagaauguuaau

SEQ ID NO: 353834 - RNA, 64 nt, Human
cccgcccggcauuggugcucuacugucuuuggcuagagcuuaguuguguuuaaauaaucaucuu

SEQ ID NO: 353835 - RNA, 64 nt, Human
ucuccuaucuacugcuacagauccuguugaagaaagagcuuaccccuuucccccggaaaacuug

SEQ ID NO: 353836 - RNA, 64 nt, Human
ccuuguuguuugcuuuggucuguguucaauccagagagcuuaaauugucauuauuuugggaaga

SEQ ID NO: 353837 - RNA, 64 nt, Human
cgaagacuuagcuaugaauugcuaucuaaaucucagagcuuagaagccaacccagugacuagac

SEQ ID NO: 353838 - RNA, 64 nt, Human
uucuaaaagucauaaaagggucacagucuuaagcagagcuuaguuuucuucucacuugucaaau

SEQ ID NO: 353839 - RNA, 64 nt, Human
gagccuccaucuccuguccaaugacaugugugcuagagcuuacucugagaaggugacagaguuc

SEQ ID NO: 353840 - RNA, 64 nt, Human
guucuguugaauuucacccuggcgauguaaacugagagcuuaucuucacagaugugggaaagag

SEQ ID NO: 353841 - RNA, 64 nt, Human
ucuccaggcaccaucucccuuccugugggagcagagagcuuagccuggagcaccuuuccuucaa

SEQ ID NO: 353842 - RNA, 64 nt, Human
ugugaucgugucauuaucaucugcacuucacucaagagcuuacuaugugucuaagucauguucu

SEQ ID NO: 353843 - RNA, 64 nt, Human
uuuguuggccacuuguaugucuucuuugaaaacugacuucuaaucuugaggccuauuaauaauu

SEQ ID NO: 353844 - RNA, 64 nt, Human
cggacuuguuaaccuaaccuaauuaugcucaguggacuucuauagaugguuuugaaaaaugaac

SEQ ID NO: 353845 - RNA, 64 nt, Human
aguaauuucuaaaaagaaaaaaugaucuuuuuccgacuucuaaacaagugacuauacuagcaua

SEQ ID NO: 353846 - RNA, 64 nt, Human
aaauaauaaaguauacccuucugguauaucaucaagagcuuaagaaucuuggcuuucauauuua

SEQ ID NO: 353847 - RNA, 64 nt, Human
cuggcagcauuaucucaggcucccuagaaucuggagagcuuaccaacauguaaagcuguucauu

SEQ ID NO: 353848 - RNA, 64 nt, Human
accuacuauuuuaugauaaaauguaguugucuccagagcuuaaauauaauuuguaaagcacuug

SEQ ID NO: 353849 - RNA, 64 nt, Human
gugguucacagacccgccacaucagcaccauccgagagcuuauuaguaauguguagauucucau

SEQ ID NO: 353850 - RNA, 64 nt, Human
ucacauggaaugaggguuugagagagcagccaggagagcuuagggucucagggugucccagacc

SEQ ID NO: 353851 - RNA, 64 nt, Human
augaagguuuacauuucuguaguuuguuuguuuuagagcuuaauuuguaguuuuuuagcuauua

SEQ ID NO: 353852 - RNA, 64 nt, Human
gagacccuauuucaaaaaaauaaaaauuggaagaagagcuuaaaaaagauaagauuuuaaagag

SEQ ID NO: 353853 - RNA, 64 nt, Human
cagacauauauauauauauuuauuuuuuuuacugagagcuuaugacuuccagaaagugcuaaag

SEQ ID NO: 353854 - RNA, 64 nt, Human
gcaagccucucugcauggcugggggagucagggcagagcuuacuuuaaaaaagaauguucgauu

SEQ ID NO: 353855 - RNA, 64 nt, Human
gccaagaugaccuguugugucauauaauuuaagcagagcuuagcauuuauuuuauucuuuagaa

SEQ ID NO: 353856 - RNA, 64 nt, Human
uaagcuuucacaaaaauccgggaagagauaauuaagagcuuagcaucccucuuagaguagaagg

SEQ ID NO: 353857 - RNA, 64 nt, Human
uugugucucauacagugcuuaggaugucuuucacagagcuuauuaaaaagaugaaaccugagaa

SEQ ID NO: 353858 - RNA, 64 nt, Human
aguguagcuuucuacaucccacaucagguauauuagagcuuauccgaacuggggaaagacggau

SEQ ID NO: 353859 - RNA, 64 nt, Human
ggucacaugaaaccaaaacgggcccugcuccauaagagcuuauauaucugaagcagcaacccca

SEQ ID NO: 353860 - RNA, 64 nt, Human
uaggucaauauaaaauaauagcaaguauuuacugagagcuuacugugugcuaggcauuuucuua

SEQ ID NO: 353861 - RNA, 64 nt, Human
uuuagaaggagccuaggcugaauuugauuccaagagagcuuaggaugacagcaccccugagcug

SEQ ID NO: 353862 - RNA, 64 nt, Human
agcccuuuaaggaaugaaaucauguagaauuuuggacuucuaaaaacauuaaaaucagcuuauu

SEQ ID NO: 353863 - RNA, 64 nt, Human
uuuguuaguaccaaaauaaucuguuauaugaacagacuucuaaaauaacgucuguauauuuuau

SEQ ID NO: 353864 - RNA, 64 nt, Human
uucuauuuguaacaaggaguuuuaaaagaaaccugacuucuaaguguggguuuuucuucucucc

SEQ ID NO: 353865 - RNA, 64 nt, Human
ugaaagcgaugaggggaccauuuacauaaaacacagagcuuagacacucuuccccuccuaugaa

SEQ ID NO: 353866 - RNA, 64 nt, Human
agaaaacacuguuaucauuuuuuccuguuugggaagagcuuagaaacuggaaauacuagauuug

SEQ ID NO: 353867 - RNA, 64 nt, Human
ucuaguaagcaagguguuccuacaucuuuucuggagagcuuaccauaguuuuauagcauuguuc

SEQ ID NO: 353868 - RNA, 64 nt, Human
guacaaacaugcaucucgugauaguccugccuugagagcuuaggaaucuuccggauaaguauga

SEQ ID NO: 353869 - RNA, 64 nt, Human
gaaggaaggaggagggcgcccauucgucugucccagagcuuauuggccacugggucucacuccu

SEQ ID NO: 353870 - RNA, 61 nt, Human
gccacggggaggcuccugcaggaggcucaacccgacggaucacagugaaagggauuccucc

SEQ ID NO: 353871 - RNA, 61 nt, Human
ccucccucugcgccgcagcuggacgccaccuccgacggacacagccagccccuuccugcug

SEQ ID NO: 353872 - RNA, 61 nt, Human
agaugucaagcuggccguggagucgagcuggccgacggaccccuuucaccugguuaugagc

SEQ ID NO: 353873 - RNA, 61 nt, Human
acaguucugugcacauacuuuucaauacuccccgacggaagagcaaggguggauuuaauuu

SEQ ID NO: 353874 - RNA, 61 nt, Human
cugccgugggccugagaccaaggcccccgggccgacggagccgggaaagaagagccggagc

SEQ ID NO: 353875 - RNA, 61 nt, Human
gagucaggaccuccggggagagcagaggguuccgacggauuccuuuaugagucagucucuc

SEQ ID NO: 353876 - RNA, 61 nt, Human
ggguccugccccuguuggccauaucuuuccaccgacggacuugaguguugcauuuguuuug

SEQ ID NO: 353877 - RNA, 61 nt, Human
cugucccagagagguccgcguucuccccaccccgacggaauuucucucccauuguugacac

SEQ ID NO: 353878 - RNA, 61 nt, Human
gguguggggcacuguagagacuagccagcucccgacggaaggggucugugucuuguauuga

SEQ ID NO: 353879 - RNA, 61 nt, Human
ggccugagggccgccagcggccucuacggccccgacggacgcuugugaggcccgaggcaga

SEQ ID NO: 353880 - RNA, 61 nt, Human
uuacgguagcgacuauuacgacccgucagagccgacggaggaggaggagccuuccaaacag

SEQ ID NO: 353881 - RNA, 61 nt, Human
auagcuucaaaaacaaaaacaaauguguuauccgacggauacuuuuaugguuacuaacuag

SEQ ID NO: 353882 - RNA, 61 nt, Human
uguccuaucugcucaccaucacccuuccugcccgacggagcugcuucugcucccuggggca

SEQ ID NO: 353883 - RNA, 61 nt, Human
cuccugggccccagaaagccucagaguccugccgacggagccacuggggugggagggggca

SEQ ID NO: 353884 - RNA, 64 nt, Human
cgaugccuuccugugcagagcuugggcaucuccuuuacgccagggugaggaagacaccaggaca

SEQ ID NO: 353885 - RNA, 64 nt, Human
aucggaauguaccauaauaaauccaaacucucaauuacgccaugguaauucagucacuaaaaua

SEQ ID NO: 353886 - RNA, 64 nt, Human
ccagaauagaacucguagcucgugacugcacgguuuacgccacaaaagugcucuugacauccgu

SEQ ID NO: 353887 - RNA, 64 nt, Human
uaaauuuaacagguaaugauacagagauuggccauuacgccagcucucaggagaaaaacaacua

SEQ ID NO: 353888 - RNA, 64 nt, Human
gaaauauauacacauauauauauuuuuuacauauuuacgccauuuuuacuuguuaugaaaccac

SEQ ID NO: 353889 - RNA, 64 nt, Human
acaacuuguuuuuuauuugauuaagaagugaaguuuacgccacccaauguauagccaaauugua

SEQ ID NO: 353890 - RNA, 64 nt, Human
uauaauucucuucuuaaccgaaugucagauggucuuacgccacagggugcagguaacccuuggu

SEQ ID NO: 353891 - RNA, 64 nt, Human
acaaaauaaaaaacaaaaugcuguauuucucuucuuacgccagucagaaccaauccgaaaagaa

SEQ ID NO: 353892 - RNA, 64 nt, Human
cacaguugcuaccucuccugcuuuucucuaauuauuacgccaacucaaguaguuaaaaaucagu

SEQ ID NO: 353893 - RNA, 64 nt, Human
auaaaugaaguacuuguaccuauauuaauuaugcuuacgccaugauaaccaauauacagauaua

SEQ ID NO: 353894 - RNA, 64 nt, Human
aggcgugagccacugcacccggcucucacuggucuuacgccaccuucuggacacucccuccuug

SEQ ID NO: 353895 - RNA, 64 nt, Human
gagcccaggagagugaggcugcagugagcugagauuacgccacugcacucuagccugggcaacg

SEQ ID NO: 353896 - RNA, 51 nt, Human
auucccagaggaaauuaugaauuacgccaugagguuuaugacgaauaaaug

SEQ ID NO: 353897 - RNA, 64 nt, Human
gauuuugugucugagaccacaccccaguagcagguuacgccaugucaccgagccccauugauuc

SEQ ID NO: 353898 - RNA, 64 nt, Human
gaaaaggcagaaagcaguguauuaagguguugaauuacgccagaagaccugaaaugccuuguac

SEQ ID NO: 353899 - RNA, 64 nt, Human
uacacacaguugugugugcauauaaaauacauauuuacgccaggcgugguggcucacgccugua

SEQ ID NO: 353900 - RNA, 64 nt, Human
gccaccaguucugcagcggcugcuacaaugccuuuuacgccaagaauguaagcccagagaguug

SEQ ID NO: 353901 - RNA, 62 nt, Human
aauaugugguuuccacgaugaaaaacuuccaugaggccaaacguuuugaacuaauaaaagca

SEQ ID NO: 353902 - RNA, 62 nt, Human
ccccacagggugcccgguccccacggcgcaaggaggccaagcucagcugugugucugagccc

SEQ ID NO: 353903 - RNA, 62 nt, Human
cauuucuuuuuucuccagugcaagcccuggcugaggccaaugcugugaagcuccacagagcc

SEQ ID NO: 353904 - RNA, 64 nt, Human
cuuuacagccuuugaaaugguuuccacgugauuguuacgccagcaguucucguuuuguuuguuu

SEQ ID NO: 353905 - RNA, 64 nt, Human
cagggcacagcacuggcucuacauuuaccaggucuuacgccaacaauagcugacaauuccaaga

SEQ ID NO: 353906 - RNA, 64 nt, Human
guuuuucauaacuuauguuuuuauaugguugcauuuacgccaauaaauccucagcuggggucug

SEQ ID NO: 353907 - RNA, 64 nt, Human
gaaccagggagaucauggucacagugaacuaugauuacgccaaccugggucacauagcaagacu

SEQ ID NO: 353908 - RNA, 62 nt, Human
guucgcccgguuuucuguuuucaguaaagucucguuacgccagcucggcucuccgccuccuu

SEQ ID NO: 353909 - RNA, 64 nt, Human
gcgggaccugauuucuuugaccggcuugucauccuuacgccacuaaccugugagcuuccccagg

SEQ ID NO: 353910 - RNA, 64 nt, Human
cauuggguuuuuauuguuguuuaguuuugguuuguuacgccagcccagucugucugcggaacac

SEQ ID NO: 353911 - RNA, 64 nt, Human
cccauuuucuuaucucccugaccaaaauugcuuugacuucuaaauguuucugcuucccagaaug

SEQ ID NO: 353912 - RNA, 64 nt, Human
uggauauaagguagccacacaauaacucuaacuugacuucuaaccauucuaucuuauugauuug

SEQ ID NO: 353913 - RNA, 64 nt, Human
gaugcccucauaaaccaauguggcaagacuacuggacuucuaucaaugguacucuaaucagucc

SEQ ID NO: 353914 - RNA, 64 nt, Human
ccaggucagauugacgggaccagaagggaacaucgacuucuaauccagcuuucuuguuuaauua

SEQ ID NO: 353915 - RNA, 64 nt, Human
aaaaacgggaagaaugugucuuucuucccuucuugacuucuaauaggugucauugaaauguaaa

SEQ ID NO: 353916 - RNA, 64 nt, Human
gcacuaggaaucucgacauuaaucuugcacagaggacuucuacagagucugagaagauaucauc

SEQ ID NO: 353917 - RNA, 64 nt, Human
gaacaaacuggagucuagccuggaguuaaauugagacuucuaaaaugauuggaacaaagacuaa

SEQ ID NO: 353918 - RNA, 64 nt, Human
cuuuguccacauuggauuugguccaaacauguaagacuucuacccuaaucaguauccuucagcu

SEQ ID NO: 353919 - RNA, 64 nt, Human
cugccaggggcuucccacuuuggcuuauuuuucugacuucuagcugucugugaauauccagaaa

SEQ ID NO: 353920 - RNA, 64 nt, Human
cagccccccuaaaaaaaucacucguguccccagggacuucuaaagcuuggggcuccaggaaauc

SEQ ID NO: 353921 - RNA, 64 nt, Human
gucuuaccugccuuuagguccuauugcugaguuugacuucuaaggauacauuugguaaauuccu

SEQ ID NO: 353922 - RNA, 64 nt, Human
aaucagggcauauagaaucauucagcuaaagagugacuucuaugaugauggaacaggucucuaa

SEQ ID NO: 353923 - RNA, 64 nt, Human
aguggaaucaaagaugaauccaaguucacaaauagacuucuacuuccaagguaguacuuuugac

SEQ ID NO: 353924 - RNA, 64 nt, Human
aacuguguuuaauuaugaauaauauguaagcuaggacuucuacuuuagguucacauaccugccu

SEQ ID NO: 353925 - RNA, 64 nt, Human
ggauguucacugucuguuaucugaagacuaugaagacuucuaugcuaaccgaauuaaaauguac

SEQ ID NO: 353926 - RNA, 54 nt, Human
caaaucgugauuuugacugagugagacuucuagcaugaaagucccacuuugauu

SEQ ID NO: 353927 - RNA, 64 nt, Human
uuguuuaaaugugcccauauuuugcucuuucuuugacuucuauagacuaaaguuggcccagcuu

SEQ ID NO: 353928 - RNA, 64 nt, Human
gagaacguccucugaacacacaugcagauagcuggacuucuagacagaggaaauccaaaucguu

SEQ ID NO: 353929 - RNA, 64 nt, Human
guucuuccauuuucucccccacgaguggaaaauagacuucuacauaggaaagcuaaaauauguu

SEQ ID NO: 353930 - RNA, 64 nt, Human
ccauauaaaguucuacucaugccauuauuuuuaugacuucuacguucaguuacaaguaugcugu

SEQ ID NO: 353931 - RNA, 64 nt, Human
aguacugaacaccuaagaggcacucauucagacugacuucuacaggacuucuacgugugugaua

SEQ ID NO: 353932 - RNA, 64 nt, Human
ccuaagaggcacucauucagacugacuucuacaggacuucuacgugugugauaaaagccuguga

SEQ ID NO: 353933 - RNA, 64 nt, Human
cugaaagcagcacagagacugugucgucccuacagacuucuaacccugcauucagcaacaucau

SEQ ID NO: 353934 - RNA, 64 nt, Human
uacuacuuccauaaaacaggauuggugaaucacggacuucuagucaaccuacagcuuaauuauu

SEQ ID NO: 353935 - RNA, 64 nt, Human
uaaacaauauaagaaggaaaaauuugaaguauuagacuucuaaauaaggugugaaaucaucaaa

SEQ ID NO: 353936 - RNA, 64 nt, Human
aaaaguaauucagaagaacaguguggcaugaucagacuucuaauugaauagcguaacaacagug

SEQ ID NO: 353937 - RNA, 64 nt, Human
cugauaugaaaauguuagaaaaggcaaacuccgggacuucuaaagauuuacuuaaaucccauua

SEQ ID NO: 353938 - RNA, 64 nt, Human
gcggcggcacagccugacucacaccccgcggcaggacuucuagagaagcccaggaucugucccg

SEQ ID NO: 353939 - RNA, 64 nt, Human
uagaaaugcuuuaaccccaaaccuuuauaugggggacuucuagcuuugugucuuguuucagacc

SEQ ID NO: 353940 - RNA, 64 nt, Human
uuccguuuuguucuuuucccauuuuuuuuuuuuugacuucuagauccuuugcauuuucguauaa

SEQ ID NO: 353941 - RNA, 64 nt, Human
ucagauuuugaacaagcggccuuuucuaaacaucgacuucuacuacucucuagccuuaaaauac

SEQ ID NO: 353942 - RNA, 64 nt, Human
ccacaguggauugacucagccucugugggugacagacuucuaagcaggaagauagacgugaagc

SEQ ID NO: 353943 - RNA, 64 nt, Human
aaaguauuuuccauugccgugcucuuugaaugcagacuucuauuuccagaagugacagcacaag

SEQ ID NO: 353944 - RNA, 64 nt, Human
aaaugaaauuucuccaguccuacauuucugaauugacuucuagcacaucaaaaauauuucaguc

SEQ ID NO: 353945 - RNA, 64 nt, Human
ucagucuguugaaugucgauggggcaagaacucagacuucuacuuuaccaaguaccacacacuc

SEQ ID NO: 353946 - RNA, 64 nt, Human
cagaagaaacaaaaucaccagcaccuugaucuuugacuucuaaucuccagaauagugagaaaua

SEQ ID NO: 353947 - RNA, 64 nt, Human
acagguuuuccagcggaggguggauggcucuguggacuucuaccgggacugggccacguacaag

SEQ ID NO: 353948 - RNA, 64 nt, Human
ccuaguccuugcauuuagaagcugcuuuuccuaagacuucuaguauguaugaauucuuugaaaa

SEQ ID NO: 353949 - RNA, 64 nt, Human
aaacucauuuguacuuuuaaaaaauuuaaacacagacuucuaaaauuacuugauguaaguaauu

SEQ ID NO: 353950 - RNA, 64 nt, Human
agaaucaaagucagggcaagaaagcgaaagcuuggacuucuauucaaaguggcagcagaguggg

SEQ ID NO: 353951 - RNA, 64 nt, Human
agcagucugcccuugggagcguaggccccagggagacuucuaaagcccccccugucgucugcuc

SEQ ID NO: 353952 - RNA, 64 nt, Human
cuccauggcuguugcauaccaagacucuuggaaggacuucuaagauauauguugauugaucccu

SEQ ID NO: 353953 - RNA, 64 nt, Human
uuuaguucauugucaagacugcuauuuucuaagagacuucuaaagacgccacucaagccaaugg

SEQ ID NO: 353954 - RNA, 64 nt, Human
uuucuggccuuuggcuauuuuagcauuucaaagugacuucuaugaagcuuuuuuuuuaauguga

SEQ ID NO: 353955 - RNA, 64 nt, Human
uguuaggagacuacuguuauuugaccaaugaauugacuucuaauaaaaucuaguggugaugcau

SEQ ID NO: 353956 - RNA, 64 nt, Human
uaauaaugcaauaauggagcuccaaguugucuuggacuucuacaccacacucagacuucuggaa

SEQ ID NO: 353957 - RNA, 64 nt, Human
ggucuauguuucuuguaccagaaauuguccuuuugacuucuagauccuucuucccuaauguguu

SEQ ID NO: 353958 - RNA, 64 nt, Human
cuguggcaugauggccggaggcaagaagcaccuggacuucuagggauuccuccuuagucgcugc

SEQ ID NO: 353959 - RNA, 64 nt, Human
agcagacucuggguugcuguuaacccagggccuagacuucuagugccucugaggcagaaccaaa

SEQ ID NO: 353960 - RNA, 64 nt, Human
ugcuccccacagcgucccuggcgcaggugggcuggacuucuaccugcccucaaggguguguaua

SEQ ID NO: 353961 - RNA, 64 nt, Human
cuaugucauaccgugacagcccgcaggaucaggugacuucuagcagagacccugguuuuuuucc

SEQ ID NO: 353962 - RNA, 64 nt, Human
guauauaguuaauauuuguuugagcuugugaccugacuucuaagagcuacuucuaacacagccu

SEQ ID NO: 353963 - RNA, 64 nt, Human
aaaccgucccgcccugaggcuggaccggccccuggacuucuacgagcggccgaacaugaccuuc

SEQ ID NO: 353964 - RNA, 64 nt, Human
aaacuuugauucucaaaugcaauuugagaggcuggacuucuaccuaaagggaaaagucauuuaa

SEQ ID NO: 353965 - RNA, 64 nt, Human
agcaaggcugggaccauggcaagcuuggaaccaggacuucuaucucccaaccccagcagccuga

SEQ ID NO: 353966 - RNA, 64 nt, Human
ccucaauauuuacuauuucaauacuuacauaucugacuucuaggauuuauuguuauauuacuug

SEQ ID NO: 353967 - RNA, 64 nt, Human
uuucacuuuauaacuaaccaguccuacauauuaagacuucuaaguguccauaugcaucuuuuuu

SEQ ID NO: 353968 - RNA, 64 nt, Human
aacuguauucauuuucuuccuuguacaaagugaugacuucuaaugcuuauaucucaagguauuu

SEQ ID NO: 353969 - RNA, 64 nt, Human
gcgucaaaguugaugcaaaguuuauguaccaugagacuucuagugauugccuacuuucacauuu

SEQ ID NO: 353970 - RNA, 64 nt, Human
auccucaguaugagaaucuaucuguucugugcuggacuucuaauauauagaacugugagauaau

SEQ ID NO: 353971 - RNA, 64 nt, Human
cugucccuugucugcccaguugacaccuacuggugacuucuagggcacugaggagugaaagcgc

SEQ ID NO: 353972 - RNA, 64 nt, Human
acaucucuguccaugccagcauaguaguuguauggacuucuaaccaguugaguuuuuuaaagca

SEQ ID NO: 353973 - RNA, 64 nt, Human
gacuugggaggagaagaguaucggugcccauggugacuucuagaaaaccuggccacugguagga

SEQ ID NO: 353974 - RNA, 64 nt, Human
aucauugaggucuccugagaagaaagacacuugugacuucuauagacaauuuuuuuuucuuguu

SEQ ID NO: 353975 - RNA, 64 nt, Human
uauuuugcccacccuguuugugacauugaguugugacuucuauauucaauagauuuuuguaaau

SEQ ID NO: 353976 - RNA, 64 nt, Human
cgugcggggccgggagcaggccuccggccucccagacuucuagagcccgccgggcccaucuuug

SEQ ID NO: 353977 - RNA, 64 nt, Human
gaaauucugaauaucaaaggcaguuuguuuggaagacuucuaaagaaacugcuccagcuuuugc

SEQ ID NO: 353978 - RNA, 64 nt, Human
aaguaggcccuuacuucuggcagggugcugagcugacuucuaccuagccccuuuucaguuucuu

SEQ ID NO: 353979 - RNA, 64 nt, Human
cuaaguguugugaaacuguaaauuucauacauuugacuucuagaaaacauuuuuguggcuuaug

SEQ ID NO: 353980 - RNA, 64 nt, Human
gauuauccuucagaugcuggcuagaauccccuuugacuucuagccauaagcuggccacauugga

SEQ ID NO: 353981 - RNA, 64 nt, Human
aaauacuuuacuuuuucucauauccucuauaauugacuucuauuuuccuuaaucaaaccagcuc

SEQ ID NO: 353982 - RNA, 64 nt, Human
augaaugaaaagaaacauaaggaguggguacaaagacuucuaucuaugaaugauuaaaaaggcu

SEQ ID NO: 353983 - RNA, 64 nt, Human
uuugaguuggaagacaacauucuucaucucucaggacuucuaauuccuugaugcuaaaagaaga

SEQ ID NO: 353984 - RNA, 64 nt, Human
uaaguuccuaucuuuugaaaguuuguucugcagagacuucuaggaggaugcugugccucccaag

SEQ ID NO: 353985 - RNA, 64 nt, Human
ccagaucuaacauuguagugucuuucaccagauagacuucuacuguuucaucaaacucccuucu

SEQ ID NO: 353986 - RNA, 64 nt, Human
aggaaaaaaguugguugacuguuuuuguuuaauugacuucuaaaauguucaaauugucuaguuc

SEQ ID NO: 353987 - RNA, 64 nt, Human
ugugucagcugggauuggccgacagcgugguggugacuucuagguagaccgauggacccuaaau

SEQ ID NO: 353988 - RNA, 64 nt, Human
aauccauuccugguaguauaagucaccuaaaaaagacuucuagaaauauguacuuuaauuauuu

SEQ ID NO: 353989 - RNA, 64 nt, Human
auccagccuaacuuacauucuuaaagugucgaaugacuucuaguguagaauugugcaaccauca

SEQ ID NO: 353990 - RNA, 64 nt, Human
ugguuggucugaaaauagaguugggcuuaauguugacuucuauuacuccugcauggagcaguug

SEQ ID NO: 353991 - RNA, 64 nt, Human
uauuucuugugaaggagaaguagaaaguaacagugacuucuagauuucuggguugggucaucuu

SEQ ID NO: 353992 - RNA, 64 nt, Human
accacacucccaaagaaucauuuaaaaguaaagugacuucuaagagacaaggaaguaggaacau

SEQ ID NO: 353993 - RNA, 64 nt, Human
aaccuccugaccuuuccuaccugaagagcccuuugacuucuaggaagaaaggucaaaaauguua

SEQ ID NO: 353994 - RNA, 64 nt, Human
auuuucuguucaccugccgcacagggacaagcuugacuucuauuuucuguguagugaaaacaau

SEQ ID NO: 353995 - RNA, 64 nt, Human
aucuuauuuucuaauaugucucagguauuuuuaugacuucuacuaaaauucacacugaaacuuu

SEQ ID NO: 353996 - RNA, 64 nt, Human
uacaauaucugauauuuuuacagucugaucuuuugacuucuacauauaguggaaaucugccaau

SEQ ID NO: 353997 - RNA, 64 nt, Human
cacccaguuccuccucacauggcaggugagcacagacuucuaguuggcaggagcugaggagggu

SEQ ID NO: 353998 - RNA, 64 nt, Human
cccucugggggacagaaaaucugacuacuaggaagacuucuaggcuaugaaacugacuucuagg

SEQ ID NO: 353999 - RNA, 64 nt, Human
cugacuacuaggaagacuucuaggcuaugaaacugacuucuaggcuaugaaacuuacaggguau

SEQ ID NO: 354000 - RNA, 60 nt, Human
agaagccucagcuagccugaugacaaaaaugacuucuagggugaagccugggugaugagg

SEQ ID NO: 354001 - RNA, 64 nt, Human
gcucuuccccucgccugcuagggcugcggcuucugacuucuagaagacuaaggcuggucugugu

SEQ ID NO: 354002 - RNA, 64 nt, Human
cuuuauccugccugugguuuucagcucagagcuggacuucuauuuauaaguuaccuguauuuau

SEQ ID NO: 354003 - RNA, 64 nt, Human
gcagagcccagagccuuguuuggcccugaucucugacuucuagagccccagcugcuggcggcug

SEQ ID NO: 354004 - RNA, 64 nt, Human
accggccaaggaacgggauuaugaugacuaugcggacuucuauauugucuucaucucauugugu

SEQ ID NO: 354005 - RNA, 64 nt, Human
uauuuuuuacuuuuccagguugcaccauuacucagacuucuaaagagacuauuugaaguaagaa

SEQ ID NO: 354006 - RNA, 64 nt, Human
acucucucagauucccucuucauaaagcuuccgugacuucuaaaccaucaggucggugccauaa

SEQ ID NO: 354007 - RNA, 64 nt, Human
aagggucccagaucccuuggcccuuuccuccgaggacuucuauccuccccaggccuuuguuucu

SEQ ID NO: 354008 - RNA, 64 nt, Human
gaagcgucagcccccguagcaccucuguuaccacgacuucuagugccucuguuaccaccaccuc

SEQ ID NO: 354009 - RNA, 64 nt, Human
auccaaaguaugggcuacagaaaccgugccaaaagacuucuacagagugaacccgaaaauccuu

SEQ ID NO: 354010 - RNA, 64 nt, Human
cacuguucaaccgcaugguaucuuucuguugugugacuucuacaaauguaauuuuaaaugaaau

SEQ ID NO: 354011 - RNA, 64 nt, Human
uucccccaccacugggcagaggcuggacagcacggacuucuagagagagccgcguugccaguuc

SEQ ID NO: 354012 - RNA, 64 nt, Human
uaacuuuaaaagacaagugcaacaaaguuagacugacuucuauaugugcucuuuuacucugaua

SEQ ID NO: 354013 - RNA, 64 nt, Human
aaggagucccagugaucuguuaccauuugguuaugacuucuaaagagccaaaugcuauuccuuc

SEQ ID NO: 354014 - RNA, 64 nt, Human
gcccaccuguccccucgggaggggagcugagcccgacuucuaccggggucccccagcuuccgga

SEQ ID NO: 354015 - RNA, 64 nt, Human
cucuuugagugucugcagcagcccuggacuuccagacuucuaucacaugagaaaaaauaaaacu

SEQ ID NO: 354016 - RNA, 64 nt, Human
uaguuguuaccuccucacaguugaccaugauucugacuucuaacauuacaaauuaguuuuuacu

SEQ ID NO: 354017 - RNA, 64 nt, Human
guguucaaauguacagugguccuuuucagaguuggacuucuagacucaccuguucucacucccu

SEQ ID NO: 354018 - RNA, 64 nt, Human
cucccggggcccaggacucuggcuucucuccucagacuucuauuuuuuaaagacugugaaaugu

SEQ ID NO: 354019 - RNA, 64 nt, Human
cagcaccaucagccugggcucccacaccgugcuggacuucuacgagccgcggcggccagaggac

SEQ ID NO: 354020 - RNA, 64 nt, Human
cagugcugucugccuggcugccucccuuaacccugacuucuaagccaucaauuucauguuauuu

SEQ ID NO: 354021 - RNA, 64 nt, Human
ccuguuuuuuguuucuuuaacaaaaaguuauagagacuucuaugaguauuguaccgaaucuaaa

SEQ ID NO: 354022 - RNA, 64 nt, Human
auuaguuuuauauaacauuuauuugacacguacugacuucuaucugagaagaacaaaccaaaac

SEQ ID NO: 354023 - RNA, 64 nt, Human
uaucugaaaccagagagacuuggaaugucugacugacuucuauuuaacagcuugaguauugcau

SEQ ID NO: 354024 - RNA, 64 nt, Human
caguagugucacuuuuuuccugucaauauauagagacuucuaaaucauaaucauccuuuuuuaa

SEQ ID NO: 354025 - RNA, 64 nt, Human
aaaauaaggaacugggggcauuuguuuaggccaugacuucuacaagcagauuucuuuucuuuua

SEQ ID NO: 354026 - RNA, 64 nt, Human
cuuucuugauugacccaucucccuaucaucaaaugacuucuagucuagaacacacuuaagguuu

SEQ ID NO: 354027 - RNA, 64 nt, Human
uuucuucaauguaaaaaguaggcaucaaagauacgacuucuacuauauacauuucucugucccu

SEQ ID NO: 354028 - RNA, 64 nt, Human
guaacuuaccuuucuaaacuccuuuagaguuaacgacuucuauuuaguauuguugguaucucca

SEQ ID NO: 354029 - RNA, 64 nt, Human
aaaauggcacacaaagaauggcaguuaugaacgugacuucuagauuuuguccuuguaggaggcc

SEQ ID NO: 354030 - RNA, 64 nt, Human
aaggugguuggagacuguuaacacugagcucauugacuucuagagauuuuauuuuuacugguug

SEQ ID NO: 354031 - RNA, 64 nt, Human
cuuugcuggggcaacuaaauguaucuuuauuagugacuucuaguccaaauauaagaaacuguca

SEQ ID NO: 354032 - RNA, 64 nt, Human
gcugagagagauagcucccugagcugggccaucugacuucuaccucccauguuugcucucccaa

SEQ ID NO: 354033 - RNA, 64 nt, Human
caugucaaucaagaugggugauuaugaaaugccagacuucuaaaauaaauguuuuggaauucaa

SEQ ID NO: 354034 - RNA, 64 nt, Human
cguuccuagagaagacaggcuggaagauagcugugacuucuauuuuaaagacaauguuaaacuu

SEQ ID NO: 354035 - RNA, 64 nt, Human
cagcuaggcagggagggggcugggaaagaacuuggacuucuaaaggcggagggucucccugggc

SEQ ID NO: 354036 - RNA, 64 nt, Human
ccacccucuuaaauuccuaaacaauaucaucuaggacuucuauuuaaguuauuuaaaauaaauc

SEQ ID NO: 354037 - RNA, 64 nt, Human
ccgccgcuucccccacacgcuugcucggcgcucugacuucuaggagcacaagagaggagccugu

SEQ ID NO: 354038 - RNA, 64 nt, Human
uuuugugaaucuuucuuaaaagcucaaauuuguagacuucuaaauagaauaaacacuugcagca

SEQ ID NO: 354039 - RNA, 64 nt, Human
cugggacuaacuuaauguccuaaagcauuuuggugacuucuagggaauagcaaagaccuauuuc

SEQ ID NO: 354040 - RNA, 64 nt, Human
acaguugcuuuuacaaauauuugcuguaacauuugacuucuaagguuuagaugccauuuaagaa

SEQ ID NO: 354041 - RNA, 64 nt, Human
uaaaaagggcaacuuuuaaaauauuaagccugaagacuucuaaaaagacaagaaacauggccua

SEQ ID NO: 354042 - RNA, 64 nt, Human
cuuucucccuugagucccuugaaggcagggaauagacuucuagaaaaccugagaggaaaaagaa

SEQ ID NO: 354043 - RNA, 64 nt, Human
aguagugggaaaacuggggugggggugggggugggacuucuaacugcaugaauuaauccacaaa

SEQ ID NO: 354044 - RNA, 64 nt, Human
aauguuccauguuugguuuuaugugcagcaccuugacuucuaagaaaugaaucaugucccuuug

SEQ ID NO: 354045 - RNA, 64 nt, Human
cuccguacagcugaagaguugggcgaggugcagagacuucuagcuggacaaccuacacaaaccu

SEQ ID NO: 354046 - RNA, 64 nt, Human
aaaagcaaaaauaagucaggagcagcgaaaaugggacuucuagagagcucucuugccccacgcc

SEQ ID NO: 354047 - RNA, 64 nt, Human
ggacauuuauuuaaugaugaaagugccuuuuguugacuucuaacuuccaaauacuauauuauca

SEQ ID NO: 354048 - RNA, 64 nt, Human
guucuucagauucuucuauugaguuuaggaauugcggcacgaagaaugccaagaguuuaccugg

SEQ ID NO: 354049 - RNA, 64 nt, Human
cuaagucuccaagaauacagaaaaugcuuuuccgcggcacgaaucagacucaucuacacagcag

SEQ ID NO: 354050 - RNA, 64 nt, Human
ggaccgccacuacaacaucugucuggccaggcugcggcacgaggauguggucaacucagugguc

SEQ ID NO: 354051 - RNA, 64 nt, Human
gaguuucgcucuuguugcccaggcuggagugcaacggcacgaucucggcucaccgcaaccuccg

SEQ ID NO: 354052 - RNA, 64 nt, Human
ggugcucaccucuaccuccuguccucaggccgugcggcacgacauggccagcacgcagaaggag

SEQ ID NO: 354053 - RNA, 64 nt, Human
agaguagcugauguaggaguacugggaggccagacggcacgaggucuccaaggccccagcaaag

SEQ ID NO: 354054 - RNA, 64 nt, Human
uuuuggaaugcgagcucccaccagaagaagguuccggcacgaaucccauccccacgucugggcc

SEQ ID NO: 354055 - RNA, 64 nt, Human
aggggagggaccccagccaguauucccucagagccggcacgacccugcuguggggcggcgggcc

SEQ ID NO: 354056 - RNA, 64 nt, Human
gccccuugagcugcuucagugaauguacagugcccggcacgagcugaaccucauguguuccacu

SEQ ID NO: 354057 - RNA, 64 nt, Human
uuggucuuuuuuuuccccugugugaaagaagaaacggcacgaccccuucucaagcuggcucacu

SEQ ID NO: 354058 - RNA, 64 nt, Human
gccccguggagggcgcccguagugauaagcacaccggcacgaacgucagguccauuccucgaag

SEQ ID NO: 354059 - RNA, 64 nt, Human
cacaaaacaguccuuugaaacugaggaaaacugacggcacgaaucgccucagaauagagcaggg

SEQ ID NO: 354060 - RNA, 64 nt, Human; identical to SEQ ID NO: 221691

SEQ ID NO: 354061 - RNA, 64 nt, Human; identical to SEQ ID NO: 221692

SEQ ID NO: 354062 - RNA, 64 nt, Human; identical to SEQ ID NO: 221693

SEQ ID NO: 354063 - RNA, 64 nt, Human; identical to SEQ ID NO: 221694

SEQ ID NO: 354064 - RNA, 64 nt, Human; identical to SEQ ID NO: 336112

SEQ ID NO: 354065 - RNA, 64 nt, Human; identical to SEQ ID NO: 336113

SEQ ID NO: 354066 - RNA, 64 nt, Human; identical to SEQ ID NO: 336114

SEQ ID NO: 354067 - RNA, 64 nt, Human; identical to SEQ ID NO: 336115

SEQ ID NO: 354068 - RNA, 64 nt, Human; identical to SEQ ID NO: 336120

SEQ ID NO: 354069 - RNA, 64 nt, Human; identical to SEQ ID NO: 336121

SEQ ID NO: 354070 - RNA, 64 nt, Human; identical to SEQ ID NO: 336122

SEQ ID NO: 354071 - RNA, 64 nt, Human; identical to SEQ ID NO: 336123

SEQ ID NO: 354072 - RNA, 64 nt, Human; identical to SEQ ID NO: 336124

SEQ ID NO: 354073 - RNA, 64 nt, Human; identical to SEQ ID NO: 336125

SEQ ID NO: 354074 - RNA, 64 nt, Human; identical to SEQ ID NO: 336126

SEQ ID NO: 354075 - RNA, 64 nt, Human; identical to SEQ ID NO: 336127

SEQ ID NO: 354076 - RNA, 64 nt, Human; identical to SEQ ID NO: 336128

SEQ ID NO: 354077 - RNA, 64 nt, Human; identical to SEQ ID NO: 336129

SEQ ID NO: 354078 - RNA, 64 nt, Human; identical to SEQ ID NO: 336130

SEQ ID NO: 354079 - RNA, 64 nt, Human; identical to SEQ ID NO: 221695

SEQ ID NO: 354080 - RNA, 64 nt, Human; identical to SEQ ID NO: 221696

SEQ ID NO: 354081 - RNA, 64 nt, Human; identical to SEQ ID NO: 221697

SEQ ID NO: 354082 - RNA, 64 nt, Human; identical to SEQ ID NO: 221698

SEQ ID NO: 354083 - RNA, 64 nt, Human; identical to SEQ ID NO: 336131

SEQ ID NO: 354084 - RNA, 64 nt, Human; identical to SEQ ID NO: 336132

SEQ ID NO: 354085 - RNA, 64 nt, Human; identical to SEQ ID NO: 336133

SEQ ID NO: 354086 - RNA, 64 nt, Human; identical to SEQ ID NO: 336134

SEQ ID NO: 354087 - RNA, 64 nt, Human; identical to SEQ ID NO: 336135

SEQ ID NO: 354088 - RNA, 64 nt, Human; identical to SEQ ID NO: 336139

SEQ ID NO: 354089 - RNA, 64 nt, Human; identical to SEQ ID NO: 336140

SEQ ID NO: 354090 - RNA, 64 nt, Human; identical to SEQ ID NO: 336141

SEQ ID NO: 354091 - RNA, 64 nt, Human; identical to SEQ ID NO: 336142

SEQ ID NO: 354092 - RNA, 64 nt, Human; identical to SEQ ID NO: 336143

SEQ ID NO: 354093 - RNA, 64 nt, Human; identical to SEQ ID NO: 336144

SEQ ID NO: 354094 - RNA, 64 nt, Human; identical to SEQ ID NO: 336145

SEQ ID NO: 354095 - RNA, 64 nt, Human; identical to SEQ ID NO: 336146

SEQ ID NO: 354096 - RNA, 64 nt, Human; identical to SEQ ID NO: 336147

SEQ ID NO: 354097 - RNA, 64 nt, Human; identical to SEQ ID NO: 336148

SEQ ID NO: 354098 - RNA, 64 nt, Human; identical to SEQ ID NO: 336149

SEQ ID NO: 354099 - RNA, 64 nt, Human; identical to SEQ ID NO: 221699

SEQ ID NO: 354100 - RNA, 64 nt, Human; identical to SEQ ID NO: 221700

SEQ ID NO: 354101 - RNA, 64 nt, Human; identical to SEQ ID NO: 221701

SEQ ID NO: 354102 - RNA, 64 nt, Human; identical to SEQ ID NO: 221702

SEQ ID NO: 354103 - RNA, 64 nt, Human; identical to SEQ ID NO: 336150

SEQ ID NO: 354104 - RNA, 64 nt, Human; identical to SEQ ID NO: 336151

SEQ ID NO: 354105 - RNA, 64 nt, Human; identical to SEQ ID NO: 336152

SEQ ID NO: 354106 - RNA, 64 nt, Human; identical to SEQ ID NO: 336153

SEQ ID NO: 354107 - RNA, 64 nt, Human; identical to SEQ ID NO: 336154

SEQ ID NO: 354108 - RNA, 64 nt, Human; identical to SEQ ID NO: 336158

SEQ ID NO: 354109 - RNA, 64 nt, Human; identical to SEQ ID NO: 336159

SEQ ID NO: 354110 - RNA, 64 nt, Human; identical to SEQ ID NO: 336160

SEQ ID NO: 354111 - RNA, 64 nt, Human; identical to SEQ ID NO: 336161

SEQ ID NO: 354112 - RNA, 64 nt, Human; identical to SEQ ID NO: 336162

SEQ ID NO: 354113 - RNA, 64 nt, Human; identical to SEQ ID NO: 221703

SEQ ID NO: 354114 - RNA, 64 nt, Human; identical to SEQ ID NO: 221704

SEQ ID NO: 354115 - RNA, 64 nt, Human; identical to SEQ ID NO: 221705

SEQ ID NO: 354116 - RNA, 64 nt, Human; identical to SEQ ID NO: 221706

SEQ ID NO: 354117 - RNA, 64 nt, Human; identical to SEQ ID NO: 221707

SEQ ID NO: 354118 - RNA, 64 nt, Human; identical to SEQ ID NO: 221708

SEQ ID NO: 354119 - RNA, 64 nt, Human; identical to SEQ ID NO: 221709

SEQ ID NO: 354120 - RNA, 64 nt, Human; identical to SEQ ID NO: 215537

SEQ ID NO: 354121 - RNA, 64 nt, Human; identical to SEQ ID NO: 215538

SEQ ID NO: 354122 - RNA, 64 nt, Human; identical to SEQ ID NO: 215539

SEQ ID NO: 354123 - RNA, 64 nt, Human; identical to SEQ ID NO: 215556

SEQ ID NO: 354124 - RNA, 64 nt, Human; identical to SEQ ID NO: 215557

SEQ ID NO: 354125 - RNA, 64 nt, Human; identical to SEQ ID NO: 215558

SEQ ID NO: 354126 - RNA, 64 nt, Human; identical to SEQ ID NO: 221710

SEQ ID NO: 354127 - RNA, 64 nt, Human; identical to SEQ ID NO: 221711

SEQ ID NO: 354128 - RNA, 64 nt, Human; identical to SEQ ID NO: 221712

SEQ ID NO: 354129 - RNA, 64 nt, Human; identical to SEQ ID NO: 221713

SEQ ID NO: 354130 - RNA, 64 nt, Human; identical to SEQ ID NO: 221714

SEQ ID NO: 354131 - RNA, 64 nt, Human; identical to SEQ ID NO: 221715

SEQ ID NO: 354132 - RNA, 64 nt, Human; identical to SEQ ID NO: 221716

SEQ ID NO: 354133 - RNA, 64 nt, Human; identical to SEQ ID NO: 221717

SEQ ID NO: 354134 - RNA, 64 nt, Human; identical to SEQ ID NO: 221718

SEQ ID NO: 354135 - RNA, 64 nt, Human; identical to SEQ ID NO: 221719

SEQ ID NO: 354136 - RNA, 64 nt, Human; identical to SEQ ID NO: 221720

SEQ ID NO: 354137 - RNA, 64 nt, Human; identical to SEQ ID NO: 221721

SEQ ID NO: 354138 - RNA, 64 nt, Human; identical to SEQ ID NO: 221722

SEQ ID NO: 354139 - RNA, 64 nt, Human; identical to SEQ ID NO: 221723

SEQ ID NO: 354140 - RNA, 64 nt, Human; identical to SEQ ID NO: 221724

SEQ ID NO: 354141 - RNA, 63 nt, Human; identical to SEQ ID NO: 221725

SEQ ID NO: 354142 - RNA, 64 nt, Human; identical to SEQ ID NO: 221726

SEQ ID NO: 354143 - RNA, 64 nt, Human; identical to SEQ ID NO: 221727

SEQ ID NO: 354144 - RNA, 64 nt, Human; identical to SEQ ID NO: 221728

SEQ ID NO: 354145 - RNA, 64 nt, Human; identical to SEQ ID NO: 221729

SEQ ID NO: 354146 - RNA, 64 nt, Human; identical to SEQ ID NO: 221730

SEQ ID NO: 354147 - RNA, 64 nt, Human; identical to SEQ ID NO: 221731

SEQ ID NO: 354148 - RNA, 64 nt, Human; identical to SEQ ID NO: 221732

SEQ ID NO: 354149 - RNA, 64 nt, Human; identical to SEQ ID NO: 221733

SEQ ID NO: 354150 - RNA, 64 nt, Human; identical to SEQ ID NO: 221734

SEQ ID NO: 354151 - RNA, 50 nt, Human; identical to SEQ ID NO: 221735

SEQ ID NO: 354152 - RNA, 63 nt, Human; identical to SEQ ID NO: 221736

SEQ ID NO: 354153 - RNA, 64 nt, Human; identical to SEQ ID NO: 221737

SEQ ID NO: 354154 - RNA, 64 nt, Human; identical to SEQ ID NO: 221738

SEQ ID NO: 354155 - RNA, 64 nt, Human; identical to SEQ ID NO: 221739

SEQ ID NO: 354156 - RNA, 64 nt, Human; identical to SEQ ID NO: 221740

SEQ ID NO: 354157 - RNA, 64 nt, Human; identical to SEQ ID NO: 221741

SEQ ID NO: 354158 - RNA, 64 nt, Human; identical to SEQ ID NO: 221742

SEQ ID NO: 354159 - RNA, 64 nt, Human; identical to SEQ ID NO: 221743

SEQ ID NO: 354160 - RNA, 64 nt, Human; identical to SEQ ID NO: 221744

SEQ ID NO: 354161 - RNA, 64 nt, Human; identical to SEQ ID NO: 221745

SEQ ID NO: 354162 - RNA, 64 nt, Human; identical to SEQ ID NO: 221746

SEQ ID NO: 354163 - RNA, 64 nt, Human; identical to SEQ ID NO: 221747

SEQ ID NO: 354164 - RNA, 64 nt, Human; identical to SEQ ID NO: 221748

SEQ ID NO: 354165 - RNA, 64 nt, Human; identical to SEQ ID NO: 221749

SEQ ID NO: 354166 - RNA, 64 nt, Human; identical to SEQ ID NO: 221750

SEQ ID NO: 354167 - RNA, 64 nt, Human; identical to SEQ ID NO: 221751

SEQ ID NO: 354168 - RNA, 64 nt, Human; identical to SEQ ID NO: 221752

SEQ ID NO: 354169 - RNA, 64 nt, Human; identical to SEQ ID NO: 221753

SEQ ID NO: 354170 - RNA, 64 nt, Human; identical to SEQ ID NO: 221754

SEQ ID NO: 354171 - RNA, 64 nt, Human; identical to SEQ ID NO: 221755

SEQ ID NO: 354172 - RNA, 55 nt, Human; identical to SEQ ID NO: 221756

SEQ ID NO: 354173 - RNA, 64 nt, Human; identical to SEQ ID NO: 221757

SEQ ID NO: 354174 - RNA, 64 nt, Human; identical to SEQ ID NO: 221758

SEQ ID NO: 354175 - RNA, 64 nt, Human; identical to SEQ ID NO: 221759

SEQ ID NO: 354176 - RNA, 64 nt, Human; identical to SEQ ID NO: 221760

SEQ ID NO: 354177 - RNA, 64 nt, Human; identical to SEQ ID NO: 221761

SEQ ID NO: 354178 - RNA, 64 nt, Human; identical to SEQ ID NO: 221762

SEQ ID NO: 354179 - RNA, 64 nt, Human; identical to SEQ ID NO: 221763

SEQ ID NO: 354180 - RNA, 64 nt, Human; identical to SEQ ID NO: 221764

SEQ ID NO: 354181 - RNA, 64 nt, Human; identical to SEQ ID NO: 221765

SEQ ID NO: 354182 - RNA, 64 nt, Human; identical to SEQ ID NO: 221766

SEQ ID NO: 354183 - RNA, 64 nt, Human; identical to SEQ ID NO: 221767

SEQ ID NO: 354184 - RNA, 64 nt, Human; identical to SEQ ID NO: 221768

SEQ ID NO: 354185 - RNA, 62 nt, Human; identical to SEQ ID NO: 221769

SEQ ID NO: 354186 - RNA, 64 nt, Human; identical to SEQ ID NO: 221770

SEQ ID NO: 354187 - RNA, 62 nt, Human
aaucaacacauuuuuaaaugacuaacuucuaaaagccccaacacaugacgccaucugaagac

SEQ ID NO: 354188 - RNA, 62 nt, Human
cgagauuucaggauaaguuacccccaggcccgaagccccagcuugcccuggccugugccugc

SEQ ID NO: 354189 - RNA, 62 nt, Human
uucaaagcacauaaaaagcacccagggugagaaagccccaucccgggggccguuggcaggca

SEQ ID NO: 354190 - RNA, 62 nt, Human
ugcuuucagcccuucccacaggaaacaucaagaagccccagccaggaggggccaggcugcca

SEQ ID NO: 354191 - RNA, 62 nt, Human
uuccugcccacaggaagggccacaggcccgcuaagccccaaaggcaggaucuaggugagucc

SEQ ID NO: 354192 - RNA, 62 nt, Human
gaacugaaauaggacaaccgaaucaggaagcgaagccccaggagcugcagccauccgugauc

SEQ ID NO: 354193 - RNA, 62 nt, Human
gugcccacucucugagaaguuggggcuccaucaagccccauucuagucaugugccccuuucc

SEQ ID NO: 354194 - RNA, 62 nt, Human
cuccccacaagacaccacaugacaagggguauaagccccagcccugcucauucccacucacc

SEQ ID NO: 354195 - RNA, 62 nt, Human
cuguuaccucacuggauagaagaaagcuuuccaagccccaggagcugugccacccaaaucca

SEQ ID NO: 354196 - RNA, 62 nt, Human
gcgacuuuaaauacaguugcuauaauccugaaaagccccaggagcacaucagggagcuggga

SEQ ID NO: 354197 - RNA, 62 nt, Human
cugcaggcucaagccuaucugggccucuggggaagccccacagccuuggcugugccugcccc

SEQ ID NO: 354198 - RNA, 62 nt, Human
gaaucaagacauguuacucuguauuuaaggguaagccccacagcgggcagcacaaacagccu

SEQ ID NO: 354199 - RNA, 62 nt, Human
uguccuuggguuacacuaccauuuauuggaacaagccccagaggcaguauuugauuuccuca

SEQ ID NO: 354200 - RNA, 62 nt, Human
uuccuagagccuuauuagaaaugcagaaucugaagccccacucuggacccaggacauuuuga

SEQ ID NO: 354201 - RNA, 62 nt, Human
acaccucaauauucacacccauaaacauuacuaagccccaguucuaucguuggaaggaguug

SEQ ID NO: 354202 - RNA, 62 nt, Human
cucagggcucagacuugggagggccuaggcagaagccccaaguucuguuuucugagguaugu

SEQ ID NO: 354203 - RNA, 62 nt, Human
uaguuuaauguaaaucugacaggagcauucugaagccccauuaggaaaaaauuuaaaugguu

SEQ ID NO: 354204 - RNA, 62 nt, Human
ucuggcaccugugaagcccuuuaaacacccuuaagccccaggcuccccguuuaccucagaga

SEQ ID NO: 354205 - RNA, 62 nt, Human
gcugaagcuuuugcagcacuuuaccucucugaaagccccagaggaccagagcccccagccuu

SEQ ID NO: 354206 - RNA, 62 nt, Human
ucucacucccaguaauacccagcuccuaucuaaagccccauucugcaugagaauuugguguu

SEQ ID NO: 354207 - RNA, 62 nt, Human
aaacaguuuuccacaacuguaaacaaacugcuaagccccaccucaaacuuguucacugggga

SEQ ID NO: 354208 - RNA, 62 nt, Human
aaauaccauuccuucacaacuguauugucuggaagccccaugagaugguaauuauaggccuu

SEQ ID NO: 354209 - RNA, 62 nt, Human
ccacaguucuggguuaucuccucucauacaucaagccccagaggaggcggcaagaggaacag

SEQ ID NO: 354210 - RNA, 62 nt, Human
guuguagggugagaagugcaagaaugaagaugaagccccacugcucggucagucugccuccg

SEQ ID NO: 354211 - RNA, 62 nt, Human
cccaacucaugaaaagauucuauggacugaaaaagccccaggcugaaaggacuggacugccu

SEQ ID NO: 354212 - RNA, 62 nt, Human
ccggccaauggcgagacggugacgcugcccacaagccccagcauccccguaggcaucucgcu

SEQ ID NO: 354213 - RNA, 62 nt, Human
cggaggucucugggagcccagaacccacauaaaagccccagcuuggcucacaaggcccagga

SEQ ID NO: 354214 - RNA, 62 nt, Human
cugcuggcucucgcccaccaaccaaguguuacaagccccagaaugcugcccggccugcccug

SEQ ID NO: 354215 - RNA, 62 nt, Human
cugccuggccuggcuccccacgagucaccugcaagccccagggccugggggcagugacuggc

SEQ ID NO: 354216 - RNA, 62 nt, Human
cgugacgguaaacuuccccucuaccagccuccaagccccacgccagcgagcaggcugccugc

SEQ ID NO: 354217 - RNA, 62 nt, Human
cuuggcccagcgccaaguaaacaggguaccucaagccccauuuccucacacuaagagggcag

SEQ ID NO: 354218 - RNA, 62 nt, Human
uuucccuagaaggaaguuaggguggguggagcaagccccaccugcguuuuucugccacagca

SEQ ID NO: 354219 - RNA, 62 nt, Human
uucccagucgcucccagcccaccucugccuccaagccccagaugguucuggaggcugcgaga

SEQ ID NO: 354220 - RNA, 62 nt, Human
aaauaagaaaacugucuuggagaaugggucagaagccccaaacggcacacacuuuccaaauu

SEQ ID NO: 354221 - RNA, 53 nt, Human
ggccucauuucaaacacugagagaagccccagguccuucugagacugcuuucc

SEQ ID NO: 354222 - RNA, 62 nt, Human
caggggcuggaggccccuagaaaaagaucaguaagccccaguguccccccagcccccaugcu

SEQ ID NO: 354223 - RNA, 62 nt, Human
ccagucuacguucuccagcccacaccccuccaaagccccaccuuuaaguccucucuucucua

SEQ ID NO: 354224 - RNA, 62 nt, Human
ugcucccaguggauuguacagugaugacuuuuaagccccacggcccugaaauaaaauccuuc

SEQ ID NO: 354225 - RNA, 62 nt, Human
ggaagggcauauaggcaccagagcuuuauccaaagccccaaaucccuagagugcuuucuggu

SEQ ID NO: 354226 - RNA, 62 nt, Human
ggaagggaaaagcccaugaucuucaagcagggaagccccagugaguagcugcauuccuagaa

SEQ ID NO: 354227 - RNA, 62 nt, Human
ugucugcacuccuggcugcagcuggacaacagaagccccaugccgccuguccaguucggagg

SEQ ID NO: 354228 - RNA, 62 nt, Human
uucuugguccacucugucacucugcucuggucaagccccauuuggucuacagcccaugagaa

SEQ ID NO: 354229 - RNA, 62 nt, Human
uggcauucacucuuacagaugguguucacugcaagccccagaagcauauggcauguguucac

SEQ ID NO: 354230 - RNA, 62 nt, Human
ggaguagugagagcacuuccugcccuuguuggaagccccaggguggacacucagcacgaagg

SEQ ID NO: 354231 - RNA, 62 nt, Human
ccgccccacccuggaaugccaaugucagcaucaagccccacaguucuuaauacaggagaccc

SEQ ID NO: 354232 - RNA, 62 nt, Human
ugugcucaaccaucugcuucaaauugaaguaaaagccccaaaaugucaagaaaauacuugug

SEQ ID NO: 354233 - RNA, 62 nt, Human
ggcuaaaacuugcaccucuucuucucuuagcuaagccccaaaaugaagauuuccuucagaag

SEQ ID NO: 354234 - RNA, 62 nt, Human
ccacgaccuuugaagagcuucauuuugagaucaagccccacgaugacugcacaguagagcaa

SEQ ID NO: 354235 - RNA, 62 nt, Human
aaaaugaccuguaguuaccagugcaacgagcaaagccccacaguuuaguccuuuggaguuau

SEQ ID NO: 354236 - RNA, 62 nt, Human
ugggcauccugggguucuuagggucccagaacaagccccaggcaagcuggaacuuggguggg

SEQ ID NO: 354237 - RNA, 62 nt, Human
ggcugaugucaauuucuguguugccaagcuccaagccccaucuucuaaauggcaaaggaagg

SEQ ID NO: 354238 - RNA, 62 nt, Human
ccagauguccacaacaauaugaaguacagcagaagccccaagcaacuuuccuuuccuggagc

SEQ ID NO: 354239 - RNA, 62 nt, Human
caaggauggucagccauuucuucccacagccaaagccccauccccuucauuucccuccaguc

SEQ ID NO: 354240 - RNA, 62 nt, Human
agccucccacuggagugcccggccaggucuccaagccccaaaugaguccuugugaaccacaa

SEQ ID NO: 354241 - RNA, 62 nt, Human
cacaaugucucauacuaaccaagaagcaagaaaagccccaugcuuucauuuuucacuuggag

SEQ ID NO: 354242 - RNA, 62 nt, Human
accacuccagugcauuuccgccuggcuccuagaagccccauucaauaucacuacucuuuaac

SEQ ID NO: 354243 - RNA, 62 nt, Human
aaguggauuuaaaauauauauauacguaacccaagccccauaaccccuaacuggacaaauga

SEQ ID NO: 354244 - RNA, 62 nt, Human
cggaaguuauuaucugcaucuuuaucaaccccaagccccacuuccucccugaccuccccaug

SEQ ID NO: 354245 - RNA, 62 nt, Human
uuuuugagggcuguacuagguuuaucucauuuaagccccacaacaccccacaggaggguaau

SEQ ID NO: 354246 - RNA, 62 nt, Human
aacucuauccaaaacauuuuuggagcauuuuaaagccccauacacagaaguauacgaaagca

SEQ ID NO: 354247 - RNA, 62 nt, Human
ccagcuaccuuccuguguaugcugagguacagaagccccauguguaccuacagagcagccag

SEQ ID NO: 354248 - RNA, 62 nt, Human
ugaagaagccacugguucuaggcauuucugggaagccccagggacugcaaguggccauuacc

SEQ ID NO: 354249 - RNA, 62 nt, Human
ggaggcacugugacaagggaaaccugcgugucaagccccaacagggcacagcagucuucugg

SEQ ID NO: 354250 - RNA, 62 nt, Human
aggcuggacgacuucacccccaaaggguccugaagccccagaacuggcauguggaaggggcu

SEQ ID NO: 354251 - RNA, 62 nt, Human
gguggagaaaggggaagugguccagaaacaaaaagccccauugggcaugauaagccgaggag

SEQ ID NO: 354252 - RNA, 62 nt, Human
uaguaucagcccaagaguguguugcuauuuguaagccccauggaucaauacauaaacuaugc

SEQ ID NO: 354253 - RNA, 62 nt, Human
uccugcccugccacccucggccucuguccuggaagccccaccccuuuccuccuguacauaau

SEQ ID NO: 354254 - RNA, 62 nt, Human
uuagugcuaagugugaacuggacccuguugcuaagccccagcaagcaauccuagguaggguu

SEQ ID NO: 354255 - RNA, 62 nt, Human
uuguguguagagacgggggauagugagaaccuaagccccaucguagcacaguauuacaugug

SEQ ID NO: 354256 - RNA, 62 nt, Human
accugagguuucccugcaucccugcagugccaaagccccaccuucagggaccaccuggaaug

SEQ ID NO: 354257 - RNA, 62 nt, Human
aguauuaacaaaaccaaaggacacaagggugcaagccccauucacggccuggcaugcagcuu

SEQ ID NO: 354258 - RNA, 62 nt, Human
ggugcuccauggaggcaacaagucauuccaugaagccccagagguagaagggaccucaagca

SEQ ID NO: 354259 - RNA, 62 nt, Human
gaaaaacuuuuuuuuuuuuuucucaccaccccaagccccauuugugcccugccacacaaaua

SEQ ID NO: 354260 - RNA, 62 nt, Human
cacagacuuggugccugagcgcagcuccagggaagccccagccccuuccaggcggggaaccu

SEQ ID NO: 354261 - RNA, 62 nt, Human
uuucucaaaggcagugaguaaaaucccaaauaaagccccaaagaguuugcuuuuccaaucau

SEQ ID NO: 354262 - RNA, 62 nt, Human
gaaugcuaucuuguauguauuuuuuucauuacaagccccaugagcugcuuuuaugcugaaaa

SEQ ID NO: 354263 - RNA, 62 nt, Human
auggagaaugagaacauauauauauauauauuaagccccaggcugaauacucagggacagca

SEQ ID NO: 354264 - RNA, 62 nt, Human
ccacacagcgauucugcagcaccggccucgggaagccccauccaacacuggauggucaucuc

SEQ ID NO: 354265 - RNA, 62 nt, Human
ccccucccacacccaaagcugagccugcagggaagccccacauguccagcaccuugugccug

SEQ ID NO: 354266 - RNA, 62 nt, Human
uuagagaaggaggaggaagcccauagacccccaagccccacugaggccccuacugaggccag

SEQ ID NO: 354267 - RNA, 62 nt, Human
uacuugacuaccuacugguguaaucucaaugcaagccccaacuuucuuauccaacuuuuuca

SEQ ID NO: 354268 - RNA, 62 nt, Human
acacauagcaugcguuuaaauucuauuauauaaagccccaagugcuuuaccuucuaaaacau

SEQ ID NO: 354269 - RNA, 62 nt, Human
cuaaacucucuaaguguggacggagaaugagcaagccccagaaguauuuuacaaccagagug

SEQ ID NO: 354270 - RNA, 62 nt, Human
uggaauacucuauuuggaguugugcaagugagaagccccaaauuuauaagucaauauccuca

SEQ ID NO: 354271 - RNA, 62 nt, Human
uguaaccaucaagaaaccucuacaggguacuuaagccccagaagauuuugcuaccagggcuc

SEQ ID NO: 354272 - RNA, 62 nt, Human
guuccuuccagaccguuacgugucuccuggccaagccccaggaaggaaaugaugcagcucug

SEQ ID NO: 354273 - RNA, 62 nt, Human
cuacuuagguugacagcaacaaagcauaagacaagccccagguaaacgucuaaacuguuuac

SEQ ID NO: 354274 - RNA, 62 nt, Human
aagcagaaugucacagaaggcagcuacuuuauaagccccaaugggccauggagaccacuguc

SEQ ID NO: 354275 - RNA, 62 nt, Human
cacauggcccuuucccagauuauucucuagccaagccccaccuuuguuacguugaaaucccu

SEQ ID NO: 354276 - RNA, 62 nt, Human
gcagugauucugccuccauccugguuuccccaaagccccagggcaccauccuuaggggagaa

SEQ ID NO: 354277 - RNA, 62 nt, Human
gguggaugaucucaaucucccgugggcaucucaagccccaaaugguugggggaggggccuag

SEQ ID NO: 354278 - RNA, 62 nt, Human
ucguuuuuaauucaguccuacaaaauggugguaagccccagucucaggggucacccugucuu

SEQ ID NO: 354279 - RNA, 62 nt, Human
guuuuugaggcccuaggccugcugucuuuuugaagccccacauucugaauuugucagauugu

SEQ ID NO: 354280 - RNA, 62 nt, Human
gcacuuauuuauuuaacuuacuuaucuggucaaagccccaggaaaccuaccaaagcuagaau

SEQ ID NO: 354281 - RNA, 62 nt, Human
cccacgguccccaggaggacgcuuccuggccaaagccccaagccuuuggugagaagccaauu

SEQ ID NO: 354282 - RNA, 62 nt, Human
ggugaggguuaggacuucagaaaccagagcacaagccccacagagggggaacagccagcacc

SEQ ID NO: 354283 - RNA, 62 nt, Human
guggaaggacucccccuaccugagcagagcagaagccccagggcggagcucccagccagcau

SEQ ID NO: 354284 - RNA, 62 nt, Human
auugucugugguaucaugucagcagagucuccaagccccacgaacccugaggaguggaguca

SEQ ID NO: 354285 - RNA, 62 nt, Human
gccucucuccuccacucgcucgggcucaccccaagccccagcccgcgaggccuccccuccgc

SEQ ID NO: 354286 - RNA, 62 nt, Human
gaucacuugagaccagcuugggcaacauggcaaagccccaucucuacaaaaaacacaaaaau

SEQ ID NO: 354287 - RNA, 62 nt, Human
acagugccuugcucggcgcccaccacccccucaagccccagcagcccucaacaggcccaggg

SEQ ID NO: 354288 - RNA, 62 nt, Human
gcgcggaggacgcacgcggggccccggcucgcaagccccagcucaccgcgccgcggaccuca

SEQ ID NO: 354289 - RNA, 62 nt, Human
ucuuuccaacagcccaaguggggucaacuccuaagccccacccccucacacacaccgccuuc

SEQ ID NO: 354290 - RNA, 62 nt, Human
cuccuuaaaaccccagaagccccaauuuccccaagccccauuuuuucuugucuuuaucuaau

SEQ ID NO: 354291 - RNA, 62 nt, Human
acguucuuucagcaugcuccuuaaaaccccagaagccccaauuuccccaagccccauuuuuu

SEQ ID NO: 354292 - RNA, 62 nt, Human
agugaaugucaaacuguguuucuuagagccauaagccccacauauuaucccugaacaagggc

SEQ ID NO: 354293 - RNA, 62 nt, Human
augaugaaaaaagagucuauuuuaguguuaggaagccccagcaggggagucggaagagcuug

SEQ ID NO: 354294 - RNA, 62 nt, Human
ggcccgacaagccuuucugacaguuugugucgaagccccagugcucugccuggaaaccuggu

SEQ ID NO: 354295 - RNA, 62 nt, Human
uggcagaucuugcagccaggugcccaggacagaagccccagccccagccucaucuacacccc

SEQ ID NO: 354296 - RNA, 62 nt, Human
auaugugaguuacaugagauggcacagugauaaagccccauuuagugaccuugccuccuucu

SEQ ID NO: 354297 - RNA, 62 nt, Human
gaacaugaauccucugagcuguccucaaaagaaagccccaaacaacagaaagcauaguguuu

SEQ ID NO: 354298 - RNA, 62 nt, Human
ucucacuccccuaagccuggugaaagagucagaagccccaggcuccuuuuucuguuucuuaa

SEQ ID NO: 354299 - RNA, 62 nt, Human
ugggaggguuccccuggccuuaaaaggggcccaagccccaucucauccuggcacgcccuacu

SEQ ID NO: 354300 - RNA, 62 nt, Human
auggaaccugguucacccuucauaccagcuccaagccccagaccaugggagcugucugggau

SEQ ID NO: 354301 - RNA, 62 nt, Human
gggauggggauuccuaggggcagaugaaggacaagccccacuggagugggguucuuugagug

SEQ ID NO: 354302 - RNA, 62 nt, Human
gggccaugggacuuccagugcuaaaacugggaaagccccagguaaccccggacuggugguca

SEQ ID NO: 354303 - RNA, 62 nt, Human
accuaucaauccugcccccagccauggugaggaagccccaagccauggugacacacagcagc

SEQ ID NO: 354304 - RNA, 62 nt, Human
uggcugugcccucuucugccaaggaaagacacaagccccaggaagaacucagagccgucaug

SEQ ID NO: 354305 - RNA, 62 nt, Human
cagcaggagauuauucucaccaaaguuaugucaagccccauuggucccagaguagcugaagg

SEQ ID NO: 354306 - RNA, 62 nt, Human
ccuuguguugaaggcaguaaacuaagggugucaagccccauucccucucuacucuugacagc

SEQ ID NO: 354307 - RNA, 62 nt, Human
cgaucagcccuccuaaagcuggcuggaaaaagaagccccagcccagccugccucaucccacc

SEQ ID NO: 354308 - RNA, 62 nt, Human
cuuaaaacucccuugcuaccgaucuggaacucaagccccaagacauccccuuagaugaucug

SEQ ID NO: 354309 - RNA, 62 nt, Human
gugucauuuccacaugaaggagaggcaaggaaaagccccacaaaauuccuguuacccgcuga

SEQ ID NO: 354310 - RNA, 62 nt, Human
aaauaaugucaacagucacaacagguuuccucaagccccauuugucaacuaaaagagacgga

SEQ ID NO: 354311 - RNA, 62 nt, Human
uuggaauuuuccuccuuucucuuucguuacagaagccccacccugccucacccacccuuuuu

SEQ ID NO: 354312 - RNA, 62 nt, Human
ucauuggaccucagaaaacccacccuggggagaagccccagcaagugugaaaaaagcuucua

SEQ ID NO: 354313 - RNA, 62 nt, Human
aaguaggaagcuggcgugugaaaaccgcaacaaagccccaaaggcucuuuucagagccaccc

SEQ ID NO: 354314 - RNA, 62 nt, Human
cuuuugucuuuuuuaugaaauauuucuuuuaaaagccccagucucaccuacgaaauaugaag

SEQ ID NO: 354315 - RNA, 62 nt, Human
ccagguggacagggcuucuuggaagacccccaaagccccagguauccugggugaagccuguu

SEQ ID NO: 354316 - RNA, 62 nt, Human
agcaaaauuggucuuuggggcccuuuuuguccaagccccacugaaaggccucuucagaaaac

SEQ ID NO: 354317 - RNA, 62 nt, Human
cagcagauauagucuacaagggggaagguacuaagccccaggaccaaugguagacaaaauaa

SEQ ID NO: 354318 - RNA, 62 nt, Human
gcauauauacuuguuaaagcucuuauauaaaaaagccccaaaauauugaaguucaucugaaa

SEQ ID NO: 354319 - RNA, 62 nt, Human
gcugccuguuuacucguaccaaaaaugaagacaagccccacacccaccucagcccuugcuug

SEQ ID NO: 354320 - RNA, 62 nt, Human
uggaguaaacuaacgucucgaguugccauuggaagccccauuguccucauuuuguuuuguuu

SEQ ID NO: 354321 - RNA, 62 nt, Human
acuucucccugccucguuccuuauauucacagaagccccauaguuucacuggguugcgguua

SEQ ID NO: 354322 - RNA, 62 nt, Human
uuuuuccuuucuacacauaggguguuccugaaaagccccauagugauugagucuucaaaacc

SEQ ID NO: 354323 - RNA, 62 nt, Human
acaagauguucuacucccagguugacuuuuucaagccccaagauguugagucagccauucuc

SEQ ID NO: 354324 - RNA, 50 nt, Human
aggaaauggugcauucuuaaaagccccagucucuggagaaaagagagaaa

SEQ ID NO: 354325 - RNA, 62 nt, Human
ugcacugaccauaaaauguuucucuucugaacaagccccaucauuuggugaaccuccacccu

SEQ ID NO: 354326 - RNA, 62 nt, Human
acucgcacaagaugaccacauauagaagcagaaagccccaaauucccugggaacuguuuuuu

SEQ ID NO: 354327 - RNA, 62 nt, Human
agaaaaauaucaacagaacucuagccaaaggcaagccccagaacucagacaacagaaaggaa

SEQ ID NO: 354328 - RNA, 62 nt, Human
aacagugaccucgcacggucauccggaguacuaagccccaguaagguguucaggacugguaa

SEQ ID NO: 354329 - RNA, 62 nt, Human
ucuaggacgccuccggugagcagggucaguggaagccccaacgggaaaggaaacgccccggg

SEQ ID NO: 354330 - RNA, 62 nt, Human
ccagcaguuucccagggcucccugggguugaaaagccccaaggaaaccuuugcggguggggc

SEQ ID NO: 354331 - RNA, 62 nt, Human
auuuuccagauggcuuuuucucuuauuuuuugaagccccagucuuugauuuuacagguaacu

SEQ ID NO: 354332 - RNA, 62 nt, Human
ucaccuccugaggaauaaaugcugaaccucacaagccccaucauucauuucuucucaauuca

SEQ ID NO: 354333 - RNA, 62 nt, Human
cacggcguggggacuggacagaaaaccacugcaagccccaaggagccagcugaagccuccca

SEQ ID NO: 354334 - RNA, 62 nt, Human
ugcaucccucaccugccaguuauguggcugccaagccccacaggcugucaugguggcucuug

SEQ ID NO: 354335 - RNA, 62 nt, Human
cuuacgguucugagaggaggggccacauaggaaagccccacggugggucagaaggcggaagg

SEQ ID NO: 354336 - RNA, 62 nt, Human
cacggguccuucccugucuuccacggcaggaaaagccccacguuuuuggcagguguggaagu

SEQ ID NO: 354337 - RNA, 62 nt, Human
gucuguggccccacaacgugggcuuaaagcagaagccccacagccuggcacgaaggccccgc

SEQ ID NO: 354338 - RNA, 62 nt, Human
uuuagaguuccguuuuuauuuauuaaaaacaaaagccccagcccugccgaggccugggcggc

SEQ ID NO: 354339 - RNA, 62 nt, Human
guugcuuuuaucccuaaacugcauccacagagaagccccaagaaggagguuggggccagcuc

SEQ ID NO: 354340 - RNA, 62 nt, Human
agauggccaguaucauuuuacccccaccucccaagccccaagagguguaccuuuucagaugc

SEQ ID NO: 354341 - RNA, 62 nt, Human
ggccagcugggccccucccaggcacugccaggaagccccagcugccccuggcggguguggug

SEQ ID NO: 354342 - RNA, 62 nt, Human
auuguuaaugagacaaaaguuguuuccaauuuaagccccaaaaccauuuguuguauuagugg

SEQ ID NO: 354343 - RNA, 62 nt, Human
cccccagcuacccauaggggcugcagaguuauaagccccaaacaggucaugcuccaauaaaa

SEQ ID NO: 354344 - RNA, 62 nt, Human; identical to SEQ ID NO: 354312

SEQ ID NO: 354345 - RNA, 62 nt, Human
gacugaccucuccucacggaggcccagccccaaagccccagggcuggcccguuugggacagc

SEQ ID NO: 354346 - RNA, 62 nt, Human
uccuagucucccaccaggucccaggcuguggaaagccccagcccagggauggucagaacuca

SEQ ID NO: 354347 - RNA, 62 nt, Human
gccaggguggggccgccgcagaugggcucaggaagccccaggugcacucagcgagagcccug

SEQ ID NO: 354348 - RNA, 62 nt, Human
agcuucuagaaggugcuuaguaaauacuugauaagccccacgugaaaacagcgaagcaaaua

SEQ ID NO: 354349 - RNA, 62 nt, Human
gagggaggugcagaggcauccggggcgggagcaagccccagguugugacaggugcagguaga

SEQ ID NO: 354350 - RNA, 62 nt, Human
uccuucagcguuaaguggaggaaagcuuggggaagccccaauagcuggacagaccucggccu

SEQ ID NO: 354351 - RNA, 62 nt, Human
agacauacagcugccuaccuaaugaggacuucaagccccaccacauagcaugcuuccuuucu

SEQ ID NO: 354352 - RNA, 62 nt, Human
aacucaucuuccagaacuuuucccucucuccuaagccccaguugcaccuacuaacugcaguc

SEQ ID NO: 354353 - RNA, 62 nt, Human
cuaaugcagucgauacaaugcguagauagaagaagccccacgggagccaggaugggacuggu

SEQ ID NO: 354354 - RNA, 62 nt, Human
auggauuuaucaauuuuguuccucuuuuccaaaagccccagguuuuggcuucacuggauuug

SEQ ID NO: 354355 - RNA, 62 nt, Human
auuccaacuucccaguucaggagucccaaggaaagccccagcacuaacguaaauacacaaca

SEQ ID NO: 354356 - RNA, 62 nt, Human
ggcagccagugcccugagccagggucuccagaaagccccacccaggccaggcauguggcagg

SEQ ID NO: 354357 - RNA, 62 nt, Human
uugauauauuagccaugcuuccggguaaaggcaagccccaaacuccuuaucuuuugcagucu

SEQ ID NO: 354358 - RNA, 62 nt, Human
ugccucugccuuuauccugggagauggggaggaagccccaucucugcuguucccugcgugga

SEQ ID NO: 354359 - RNA, 62 nt, Human
uuauucuauaggaccucaagauuccuggaaagaagccccagcccccaggggaaaccuccaga

SEQ ID NO: 354360 - RNA, 62 nt, Human
cccauuuuaagcaggagcagguggcugguuugaagccccagguaucccccuucccugcuaug

SEQ ID NO: 354361 - RNA, 62 nt, Human
uuggcgccugccagaaaaauuuggggcuaggcaagccccagguugcagacauggugaagcag

SEQ ID NO: 354362 - RNA, 62 nt, Human
gaucugaacuccuuggcuucuuuacuuaguucaagccccagccuaggaaagccaguuacaua

SEQ ID NO: 354363 - RNA, 62 nt, Human
caauuuucuuuucuaucaguuuguauauuacuaagccccaagagacauuuccugugcuagag

SEQ ID NO: 354364 - RNA, 62 nt, Human
uugcucuuauuuccugcaucuuuccuuaagggaagccccauccucucccaggaccaggaguu

SEQ ID NO: 354365 - RNA, 62 nt, Human
gguaguguuuuuguacaaggucauaccgccagaagccccaaauccuauuuuggcucaucuuc

SEQ ID NO: 354366 - RNA, 62 nt, Human
gugaguggcucgagcccugggggugcuccuggaagccccaagagcauccaggauugccuccc

SEQ ID NO: 354367 - RNA, 62 nt, Human
ucccggcucugcccugcacauccuguugagccaagccccagugacccggagagcuggccuga

SEQ ID NO: 354368 - RNA, 62 nt, Human
cccccaagcuggaggcggcagaggacugggccaagccccaaccugccucccagccaggcucc

SEQ ID NO: 354369 - RNA, 62 nt, Human
gaagccuguacccagaggccuuggacuagacgaagccccagccaguggcagaacugggucuc

SEQ ID NO: 354370 - RNA, 62 nt, Human
uggggccugauccaccucuacaccagcccaggaagccccaucugugccugcccucagguggu

SEQ ID NO: 354371 - RNA, 62 nt, Human
cggacccaaugcacuuucuugucuccucuaauaagccccacccuccccgccugggcuccccu

SEQ ID NO: 354372 - RNA, 62 nt, Human
uucccaagcacuguaagugagugggucaggcaaagccccaaauggaggguugguuagauucc

SEQ ID NO: 354373 - RNA, 62 nt, Human
uccaaauaaauucauaucuagauuuucaaacaaagccccaagaugaagucuaauucugaaaa

SEQ ID NO: 354374 - RNA, 62 nt, Human
ccugagccccccgcagcggcccgagcuggcggaagccccacggcggugagguccauccugac

SEQ ID NO: 354375 - RNA, 62 nt, Human
cuccgggcauaaggccccugaccacacuucagaagccccauccccccugccaccgggcgauc

SEQ ID NO: 354376 - RNA, 62 nt, Human
gccucugcauaaggccccuggguacacugcagaagccccauccuucccgccuccgggcauaa

SEQ ID NO: 354377 - RNA, 62 nt, Human
uucauaggccacacacaggugugcugcgcgggaagccccaugcuccaaucaaagggauuuuu

SEQ ID NO: 354378 - RNA, 62 nt, Human
caccacuuggaccagcauccuuaaguaucagaaagccccaagcaauugcugcaucuuaguag

SEQ ID NO: 354379 - RNA, 62 nt, Human
ggagacuuugaagaccaguccuguuugcagggaagccccacuugaaggaagaagucuaagag

SEQ ID NO: 354380 - RNA, 62 nt, Human
uggccgcaccuuaaaaacuauuuauucaccaaaagccccaggcauuucagaagguggcacuc

SEQ ID NO: 354381 - RNA, 62 nt, Human
cucccuaucugguaggcugcccugcuuugcagaagccccacugcaugaaggccugagugcaa

SEQ ID NO: 354382 - RNA, 62 nt, Human
uuaauguggaacaaaaguuuucaccaucucucaagccccaaggacuggagccaccucuggaa

SEQ ID NO: 354383 - RNA, 62 nt, Human
cuauguauuuuaacucauuagugcauaaaggcaagccccauauaaugaagucucaggguaua

SEQ ID NO: 354384 - RNA, 62 nt, Human
uugaacuucugcccucuguucagggcugacacaagccccacaggcuggggggcuccgguucc

SEQ ID NO: 354385 - RNA, 62 nt, Human
ugagccugcugagaaauccuuuuagcgccagcaagccccacccagggcccuguccugugucu

SEQ ID NO: 354386 - RNA, 62 nt, Human
aaacccagucuguucccugcucccucgcuggcaagccccaccacacaggagugaggccaggg

SEQ ID NO: 354387 - RNA, 62 nt, Human
aaaucagauauacaugucuagauguuacagcaaagccccaacuaaucuuuagaagcauauug

SEQ ID NO: 354388 - RNA, 62 nt, Human
cuuucuccauauccucugggagggguggaaucaagccccagugcugccugcuugguggcggg

SEQ ID NO: 354389 - RNA, 62 nt, Human
caguaccucaagaucauggcaggcagcaagugaagccccagcuggacucauggaugugcacc

SEQ ID NO: 354390 - RNA, 62 nt, Human
ugagaaagagacugaaauggaguaauaaaugaaagccccacaccaagccuccuuucuuccac

SEQ ID NO: 354391 - RNA, 62 nt, Human
gauaguguaugcauauguauauguacauagggaagccccauauguauauaguauguuguaca

SEQ ID NO: 354392 - RNA, 62 nt, Human
ucuuuaaaucucuuuaaugagugaauccaugcaagccccauaaaacaguuccuagcaugcag

SEQ ID NO: 354393 - RNA, 62 nt, Human
gccugcuuuuucuguacucucaaguucccccaaagccccaaagaguuggaggccaagggaag

SEQ ID NO: 354394 - RNA, 62 nt, Human
cuguacaacugauuuuaaaaaaaugcuacaaaaagccccaaagcauauaaucucuacuccuu

SEQ ID NO: 354395 - RNA, 62 nt, Human
auguuccuuguuuccuuuuauucuuccaucugaagccccacucuuaaaaaguugcacuguuc

SEQ ID NO: 354396 - RNA, 62 nt, Human
aagaagaucugggggaauaaaaagccaacaguaagccccaggaaaggguuuuuugagaccau

SEQ ID NO: 354397 - RNA, 62 nt, Human
ccugucuguggcagggacccaagcgcuugcuuaagccccagugcuccaugccagcacuugaa

SEQ ID NO: 354398 - RNA, 62 nt, Human
cuucucaccuaaguccccaggguccaagggagaagccccagacccccuucucuugcagagug

SEQ ID NO: 354399 - RNA, 62 nt, Human
gcugagggaccccuucccaguagggcugucccaagccccacuccauggggccagguuuccug

SEQ ID NO: 354400 - RNA, 62 nt, Human
uuugaagagcauggcaaagcccuuucucucccaagccccaggcagaguacaagcucauuuuu

SEQ ID NO: 354401 - RNA, 62 nt, Human
ccuuggagaccccuggucccaccccugccgugaagccccaggcccacuucccaagaaucuca

SEQ ID NO: 354402 - RNA, 62 nt, Human
guggugugccgauaccuccucgccugcccuccaagccccagcugccuuccuuuuggauuccc

SEQ ID NO: 354403 - RNA, 62 nt, Human
ggacuaacuuccagggugccaagaaggaagaaaagccccagguucucuuuucuuauugagga

SEQ ID NO: 354404 - RNA, 62 nt, Human
uguggucuuccccagguugaggagagaaguggaagccccauggaagacagugcucccagcug

SEQ ID NO: 354405 - RNA, 62 nt, Human
uuucccugagagcucacaguacaauguuucagaagccccauuugcacagguuuucagcaacu

SEQ ID NO: 354406 - RNA, 62 nt, Human
uacagguuuugcccugauuaaaaaaucucccaaagccccaaauuccuguuagccagguggag

SEQ ID NO: 354407 - RNA, 62 nt, Human
uauccuaauauugcaggaggggccucucuuccaagccccacccuaaggguuagcccuuggcc

SEQ ID NO: 354408 - RNA, 62 nt, Human
aaaguauauaagaugaaacuugauuugcuaucaagccccaagcaauuuuucaacugggcauu

SEQ ID NO: 354409 - RNA, 62 nt, Human
ugacugucucaaauauguaggacagaaaugagaagccccaagcuugcuuuuaacucuaaggu

SEQ ID NO: 354410 - RNA, 62 nt, Human
uuaggaccccguuccaagugcacugcccggccaagccccagccucagccugcgccugagcug

SEQ ID NO: 354411 - RNA, 62 nt, Human
aggguccacgcccauguaccugaaacauuuggaagccccauaauuguucuaguuagaaaggg

SEQ ID NO: 354412 - RNA, 62 nt, Human
uuuuuuaaacuauuucuagguuugugaaugugaagccccaggccgcagggggcaaggggcca

SEQ ID NO: 354413 - RNA, 62 nt, Human
uguguucccguaaggauacagcuuccuuugggaagccccaucuauggcuguagaucucucgg

SEQ ID NO: 354414 - RNA, 62 nt, Human
cuugagauauagccaacuaacgacgcuacuggaagccccagagcagaaaagaagcacauccu

SEQ ID NO: 354415 - RNA, 62 nt, Human
ugugugauugugggaaauuacuuaaccucuucaagccccaauuuccucaaccauaaaaugaa

SEQ ID NO: 354416 - RNA, 62 nt, Human
gccucugagccuccccugugccuugggcccugaagccccauauguaguauagagcaaaggug

SEQ ID NO: 354417 - RNA, 62 nt, Human
accucaggaggcucugggcacuccagcccugaaagccccagguguacccaauuggcagccuc

SEQ ID NO: 354418 - RNA, 62 nt, Human
uaaaccaauguagcauuauuuuuuucuaaaugaagccccaaaaaagaaaagugccuugcauc

SEQ ID NO: 354419 - RNA, 62 nt, Human
ccauucacccagccaaauuguguuaaagaggaaagccccacaaacuaaaacagccuuuccua

SEQ ID NO: 354420 - RNA, 62 nt, Human
ucuugaucugcucagcccuggaggugccagcaaagccccaugcuggagccuguguaacagcu

SEQ ID NO: 354421 - RNA, 62 nt, Human
ucagccauuucguucucccuuccuugcugacaaagccccauuuuuuuuuucuuuuuuuuugg

SEQ ID NO: 354422 - RNA, 62 nt, Human
acgaguuuaagaccagccugggcaacauggugaagccccaucucuacaaaaaauacaaaaaa

SEQ ID NO: 354423 - RNA, 62 nt, Human
ucuuuuuggcaucagcggcaaaucuuuucaugaagccccaaggacacaaaacauuuucccau

SEQ ID NO: 354424 - RNA, 62 nt, Human
ugcacugcccuggagaggcagcaucaggaccuaagccccaggaacuucacccaacuuaggcc

SEQ ID NO: 354425 - RNA, 62 nt, Human
gaggaccucgaaggcugcaacggcccugccccaagccccagaaaaagaaacucuuggaggga

SEQ ID NO: 354426 - RNA, 62 nt, Human
aucuucagaaugauuuuauugaagagggccgcaagccccaaauggaaaacuguuuuuagaaa

SEQ ID NO: 354427 - RNA, 62 nt, Human
ucacccagcaggccugguccaccucucauugcaagccccaagcacugagccagcaggugcca

SEQ ID NO: 354428 - RNA, 62 nt, Human
cucucaguauucucuccaaagauugaaaugugaagccccagccccacccucugcccuucagc

SEQ ID NO: 354429 - RNA, 62 nt, Human
guccagacagcacaaaacggcaaggagagcccaagccccaaugccagaauucuuccaaacuc

SEQ ID NO: 354430 - RNA, 62 nt, Human
auguuggaauccgaagccacuuccccgccuucaagccccagaugggcugcucuccuguaacu

SEQ ID NO: 354431 - RNA, 62 nt, Human
accagaaacugagagcuagugaggguucagagaagccccauccuaagccagacacaugaugu

SEQ ID NO: 354432 - RNA, 62 nt, Human
aggauuuucaagacaaacuggaguaagaauuaaagccccagaggauuuaauuauccugguuu

SEQ ID NO: 354433 - RNA, 62 nt, Human
ccacccgagugguuccgaccuccauucaccucaagccccaacaggccccugucauuccacuu

SEQ ID NO: 354434 - RNA, 62 nt, Human
ggcuguugauauuaaaaacaaacaaaacaaaaaagccccacacauaacuguuuugcacgugc

SEQ ID NO: 354435 - RNA, 62 nt, Human
auuauguuuucaucauucauuugaaaaugaaaaagccccaaagugagaacuuugggggaggg

SEQ ID NO: 354436 - RNA, 62 nt, Human
gccaguaagagugaagucugcuccuugaauccaagccccaucuggggcuucucuaacaaauc

SEQ ID NO: 354437 - RNA, 62 nt, Human
auuccaaguucauauagaacugauaauguagcaagccccaaguaugauaauaggcagacuau

SEQ ID NO: 354438 - RNA, 62 nt, Human
ggaaaaucuaguuaaaauaauccaauggacagaagccccaggaagggguauuuccaacacuu

SEQ ID NO: 354439 - RNA, 62 nt, Human
agaaguucgagaccagccuuaccaauauggugaagccccaucucuacuaaaaauacaaaaau

SEQ ID NO: 354440 - RNA, 62 nt, Human
guccucucugaaugccuuggagggaucccaggaagccccaguaggagggagcuucagacagu

SEQ ID NO: 354441 - RNA, 62 nt, Human
gcauuguugcuuguuggguaaaaaugaagcagaagccccaaaguucacauuaacucaggcau

SEQ ID NO: 354442 - RNA, 62 nt, Human
uuuacgggucuugagagggaaggacucuuccaaagccccaaagccgaggguuucacccacac

SEQ ID NO: 354443 - RNA, 62 nt, Human
gucacuagaaaugggccagcugggucaaugugaagccccaaauuugcccagauucaccuuuc

SEQ ID NO: 354444 - RNA, 61 nt, Human
guaguggcuucagccucugacagucaggaugaagccccaugccacuccacacugcugggac

SEQ ID NO: 354445 - RNA, 62 nt, Human
aaugcccccugggcaggaggcaguggagaaccaagccccauggccucagaauuuccccccag

SEQ ID NO: 354446 - RNA, 62 nt, Human
ucugugaucucugcuggggagauaaaaagauuaagccccaacauguucagaaaagaagugaa

SEQ ID NO: 354447 - RNA, 62 nt, Human
gcuccaaaugucaggguguuugcccaauaauaaagccccagagaacugggcugggcccuaug

SEQ ID NO: 354448 - RNA, 62 nt, Human
ucaaagcucucagaagguaccuagaggagcccaagccccagcuccauccuccacuuauucug

SEQ ID NO: 354449 - RNA, 62 nt, Human
gggcuucugaggacacaaggugggcugcccucaagccccagagagccccucauccuuccucu

SEQ ID NO: 354450 - RNA, 62 nt, Human
uggaccgugugccccuuugggaggaagaagacaagccccacuagggccaagggcagcagagc

SEQ ID NO: 354451 - RNA, 62 nt, Human
aauuacguagguuuaagacuagucccuuggauaagccccaagcgaauuugucuucagauuau

SEQ ID NO: 354452 - RNA, 62 nt, Human
gacccugccccuaacuccugccuaugacacagaagccccacaccaguugcccagaugaacug

SEQ ID NO: 354453 - RNA, 62 nt, Human
ggucgagagaccuguucuuucacagaugugagaagccccaggaugauugaccaugguguuca

SEQ ID NO: 354454 - RNA, 62 nt, Human
cagggagaggggaggagugggcagugaagaugaagccccaugcucaguccccucccaucccc

SEQ ID NO: 354455 - RNA, 62 nt, Human
uuguguccucgccagcucuuuggccaccuuucaagccccaguguucaagcucagagaggaug

SEQ ID NO: 354456 - RNA, 62 nt, Human
cagccccacagacaacaguugcacagugccucaagccccagaguggcucacccuguccagac

SEQ ID NO: 354457 - RNA, 62 nt, Human
ccuguaacuuauaaagugcaccucgcccccgcaagccccagccccgaggaccguccauggac

SEQ ID NO: 354458 - RNA, 62 nt, Human
gucggcaggagagucaguugugugcucuguugaagccccacagagcagguguugccaaugcu

SEQ ID NO: 354459 - RNA, 62 nt, Human
agugaguguggcuccccucuauuuagcaugacaagccccaggcaggcugugcgcugacaacc

SEQ ID NO: 354460 - RNA, 62 nt, Human
uuaggaagcuucggggagacaaguuuugagagaagccccagagggagcuauuuccuugcacc

SEQ ID NO: 354461 - RNA, 62 nt, Human
uucuuucagagucuguuuuuccauccaaauauaagccccaggccauuccacuuagugucuuu

SEQ ID NO: 354462 - RNA, 62 nt, Human
uugaugccucagggucucugaaaucucccgggaagccccagagcuuuccugaggcugccugg

SEQ ID NO: 354463 - RNA, 62 nt, Human
ugcacaguggagcuuacacuuaaaagaaaacaaagccccaugggcugccuugaaaucaagag

SEQ ID NO: 354464 - RNA, 62 nt, Human
uguggcagaggagcagcugggauucccgaccaaagccccagggggugcagaagacucaccac

SEQ ID NO: 354465 - RNA, 62 nt, Human
ucucccucagggcugcaggggcaggugcagggaagccccaggaugggcuucccuggaggggg

SEQ ID NO: 354466 - RNA, 62 nt, Human
cacgugagaggaaaauguuaauaaaaaaugcaaagccccaucauuugcacaaaacucagccc

SEQ ID NO: 354467 - RNA, 62 nt, Human
agggccugcccacccguuggaggccgguggagaagccccaccuggcuuaugcccuggagagg

SEQ ID NO: 354468 - RNA, 62 nt, Human
ggcuucacagcccuacaauuggguucucagcuaagccccagaguucugguagaaccaucccg

SEQ ID NO: 354469 - RNA, 62 nt, Human
guaggggucacugucacaugcuugugcccuggaagccccaaggcucuuccuccagcuggcuc

SEQ ID NO: 354470 - RNA, 62 nt, Human
guuuguugaaguacuguuuguagaggggggcaaagccccaacugcaaacaaagugaaugccc

SEQ ID NO: 354471 - RNA, 62 nt, Human
aagcucccagggcugcuuccuucaccugcagaaagccccaagugagccaccagcacucaugg

SEQ ID NO: 354472 - RNA, 62 nt, Human
aaaaacaguugauguuuugguguaugggguaaaagccccaggagcauacagaacuugagcug

SEQ ID NO: 354473 - RNA, 62 nt, Human
cucauggggaaggucacugacucuggagacugaagccccagugugcgcagcucgagccacca

SEQ ID NO: 354474 - RNA, 62 nt, Human
cugguucucagagaacccugugaugaucacccaagccccaggcugucuuagccccuggaguu

SEQ ID NO: 354475 - RNA, 62 nt, Human
gguguuaccaucccagcucccgggaggcccuuaagccccagcugucgguuuuuaccugccug

SEQ ID NO: 354476 - RNA, 62 nt, Human
cagcuugaggccccuccuucugcugccuggccaagccccacacccgcagacccuccuuccca

SEQ ID NO: 354477 - RNA, 62 nt, Human
uugcugguggacacagaugcuccccccaauggaagccccaagcucugagguaugcggguaga

SEQ ID NO: 354478 - RNA, 62 nt, Human
gaagagcucagcugucaccgggcauagccuggaagccccaagucuguucugacuuugccugg

SEQ ID NO: 354479 - RNA, 62 nt, Human
gaagcagccccugcucccaucugucccugaggaagccccacuucucuguaggagcccggacu

SEQ ID NO: 354480 - RNA, 62 nt, Human
ucugggccugcugagcucccuccacacaccucaagccccaugccgugcucauccuaccccca

SEQ ID NO: 354481 - RNA, 62 nt, Human
aaaaaucugaaagaaacgucuuuaguggcuuuaagccccaaaacgucccuaaggcguccucg

SEQ ID NO: 354482 - RNA, 62 nt, Human
cacuuaggaaggucuucgaaauacuaauuuguaagccccaccucaggccuacugaaucagaa

SEQ ID NO: 354483 - RNA, 54 nt, Human
ugguggaaagcccuuugugagaacaagccccauuugcagccauggucacgaguc

SEQ ID NO: 354484 - RNA, 62 nt, Human
gcacccuggggagauugauuguccuuaaaccuaagccccacaaacuugacaccugaucaggu

SEQ ID NO: 354485 - RNA, 62 nt, Human
uacaggauaucagcauauuugugcaccuuauuaagccccaucuuaagaaaacacaaagucua

SEQ ID NO: 354486 - RNA, 62 nt, Human
acuuuccaaauuggggacaagggcucuaaaaaaagccccaaaaggagaagaacaucugagaa

SEQ ID NO: 354487 - RNA, 62 nt, Human
uguccacucggggguggagugagacugacugcaagccccacccuccuugagacuggagcugg

SEQ ID NO: 354488 - RNA, 62 nt, Human
caggcggacagggcuggccucccccaguccccaagccccacugugccuuguugucugcuggg

SEQ ID NO: 354489 - RNA, 62 nt, Human
ucacuugagcaugugaauauucucacggagagaagccccagcgagauuuuccggugaauacg

SEQ ID NO: 354490 - RNA, 62 nt, Human
cucuuucaucacggaaacagaccccccgagagaagccccaacgagauuuuccggugaauacg

SEQ ID NO: 354491 - RNA, 62 nt, Human
gcuucacugcagguaaugccuuucccuucaggaagccccagaacacccacaggucuugguaa

SEQ ID NO: 354492 - RNA, 62 nt, Human
aggucccuucaaggccuccccaauccaggccaaagccccaugugccuuguccaggaacugcc

SEQ ID NO: 354493 - RNA, 62 nt, Human
aaugaaaagaaaaaaacagacauacaaaauaaaagccccaguuuuuuauuaugguauuuaac

SEQ ID NO: 354494 - RNA, 62 nt, Human
aucaggagaacaucauaacccaugaaggauaaaagccccaaauggugguaacugauaauagc

SEQ ID NO: 354495 - RNA, 62 nt, Human
uuugucccuuuaucucuccugguuuuuuucuuaagccccagaaagccaaaaagaacauguaa

SEQ ID NO: 354496 - RNA, 62 nt, Human
ucugcguccaccccugaacuccugagcgacagaagccccaggccuccaccagccuugaaccc

SEQ ID NO: 354497 - RNA, 62 nt, Human
cuguagaccuaucggcucucaucccuugggauaagccccaguccagguccaggaggcucccu

SEQ ID NO: 354498 - RNA, 62 nt, Human
cucccucccuucaucauccgcccucccacuacaagccccaguguguguuguuccccucccug

SEQ ID NO: 354499 - RNA, 62 nt, Human
acaccugugagagagacaaguaccugauuuggaagccccaacaucuaaggauauacaguggg

SEQ ID NO: 354500 - RNA, 62 nt, Human
cagagcugccugggcuuguaccuggccacauaaagccccaguuuaaagcagucccugcuucu

SEQ ID NO: 354501 - RNA, 62 nt, Human
agagggcagauaaucagacuugaggaaacugaaagccccagguugagagaacagaggccuag

SEQ ID NO: 354502 - RNA, 62 nt, Human
cacccucgguccccuuccagguuccuguuuauaagccccaaccccucuguccccaucuugua

SEQ ID NO: 354503 - RNA, 62 nt, Human
ggagcaagcgcuuguggagaaccaaagcccaaaagccccagauccccuuaaagcagagaggg

SEQ ID NO: 354504 - RNA, 62 nt, Human
uaguuggugagcagagcgggacucuguccaacaagccccacagccccucaaagacuuuuuuu

SEQ ID NO: 354505 - RNA, 62 nt, Human
cagggccucagaccagccaaccuuuguggaauaagccccagcccagccaaaccaaacccaga

SEQ ID NO: 354506 - RNA, 62 nt, Human
agcaucugggcugccagccacagggaagggccaagccccauguagccccagucauccugccc

SEQ ID NO: 354507 - RNA, 62 nt, Human
ggaaagcgauggacagacagacgauggggccgaagccccaagcugggcacaaaguaguuuuu

SEQ ID NO: 354508 - RNA, 62 nt, Human
agagaaucauguuccuuugcuguggaacacauaagccccacaguuuuccagucagccuaaua

SEQ ID NO: 354509 - RNA, 62 nt, Human
cagcuguguaauccuaugucagcucucuuaggaagccccaguacuuauauugggcaugcacu

SEQ ID NO: 354510 - RNA, 62 nt, Human
ugucacugccgcucaugcauagaaaccaccaaaagccccaauaaagcauccaggaggaacag

SEQ ID NO: 354511 - RNA, 62 nt, Human
ucucaggaauggggauagaugggagguucuugaagccccaggcgaagcugguaccucuggcu

SEQ ID NO: 354512 - RNA, 62 nt, Human
uauguagcaucuugaaaagaaaaauuauaauaaagccccaaaauuaagaauucuuuugucau

SEQ ID NO: 354513 - RNA, 62 nt, Human
guguacccagggaucagugauggugguuucugaagccccaugucccuggugaaggaggacug

SEQ ID NO: 354514 - RNA, 62 nt, Human
gauaaggcuucagccaugagucaccccgcaguaagccccagaguauauugaauagaaauucu

SEQ ID NO: 354515 - RNA, 62 nt, Human
acggagugagacucccucucaaaaaaagaaaaaagccccagcauguagcaaaagcauuucuu

SEQ ID NO: 354516 - RNA, 62 nt, Human
ucuuacccuccggugugcuuguguucuuagaaaagccccagcauggccgggcaugguggcuc

SEQ ID NO: 354517 - RNA, 62 nt, Human
auuggucuccucagauuucuggggccaccugcaagccccauuccauuccuacagaucucuca

SEQ ID NO: 354518 - RNA, 62 nt, Human
uuuuuuuccuagcccucucacauuuaugaagcaagccccacuuauuccccauucuuccuagu

SEQ ID NO: 354519 - RNA, 62 nt, Human
cccuagacccaaaagugguggaggcugagaagaagccccacugcccucgcuccuaggcccug

SEQ ID NO: 354520 - RNA, 62 nt, Human
acguguuaaugucaucuuugcucauguguuauaagccccaaguugcuguauauuuucacaag

SEQ ID NO: 354521 - RNA, 62 nt, Human
ccucaucccacccauucucagggcaguaugggaagccccaaggugaccuggccaaguagcaa

SEQ ID NO: 354522 - RNA, 62 nt, Human
cucuaguggagaagaauccucagagcauccugaagccccauucuccgacuuacaacgacgag

SEQ ID NO: 354523 - RNA, 62 nt, Human
ugaccugugcccaggagggcgugauccgagugaagccccaggucucagagagcaagcuguag

SEQ ID NO: 354524 - RNA, 62 nt, Human
ugauuugccuuucugaacauaagagagcuucaaagccccaaauuccugggcuggggauucca

SEQ ID NO: 354525 - RNA, 62 nt, Human
acaauauccuuguuuacagaagagaaacaaacaagccccacucagcucagucacaggagaga

SEQ ID NO: 354526 - RNA, 62 nt, Human
agaaggugccgauuucaugcauucuagugcagaagccccaacugugaucacgauccagucug

SEQ ID NO: 354527 - RNA, 62 nt, Human
caggugcgguaacugccgcacuggacccuaggaagccccagguauucgcaaucugaccuccu

SEQ ID NO: 354528 - RNA, 62 nt, Human
ccgccaacccagcugcuucuggcaggggcuccaagccccagcguggggaagggcccuggaga

SEQ ID NO: 354529 - RNA, 62 nt, Human
guaccacugcagcaucccccacuucuccacggaagccccaucccaaagcugcugccuggccc

SEQ ID NO: 354530 - RNA, 62 nt, Human
agaaaguggagaagcucacuguucacugugcaaagccccaguagucggauuccggggaaaag

SEQ ID NO: 354531 - RNA, 62 nt, Human
aaugggucgcugaggcuggucucucagugaugaagccccaggcguggaagcauccacucucu

SEQ ID NO: 354532 - RNA, 62 nt, Human
aggacggaccugcgggggcacccagagguccuaagccccaggacugagggucgugcaucacc

SEQ ID NO: 354533 - RNA, 62 nt, Human
uuuaagcugcuguuccuggccaguugcagguuaagccccagaaaaguucaccuuggagaagc

SEQ ID NO: 354534 - RNA, 62 nt, Human
caguccuggcaccucaacugugacaaucagcaaagccccacccaggcccccaucugggauga

SEQ ID NO: 354535 - RNA, 62 nt, Human
aggaguucaagaucagccugaccaacauggagaagccccaugucuacuaaaaauaaaaaauu

SEQ ID NO: 354536 - RNA, 62 nt, Human
aagacuugugaugcucuggggcuucuguggccaagccccacccuuuccuggucaugguaccc

SEQ ID NO: 354537 - RNA, 62 nt, Human
aggaguuccagaccaggcugggucacaugacaaagccccaucucuacaaaaaaaaaaaaaaa

SEQ ID NO: 354538 - RNA, 62 nt, Human
aggaauucgagaccagccugggccacaugacaaagccccaucucuacaaaaaaauuacaaaa

SEQ ID NO: 354539 - RNA, 62 nt, Human
cuuggcugcagaccuccuuuacccugacucacaagccccacugaugcucugggccaugcccg

SEQ ID NO: 354540 - RNA, 62 nt, Human
caauaaagaccuggaaggauguugugcuucugaagccccacuggguguuacugcagcagggc

SEQ ID NO: 354541 - RNA, 62 nt, Human
cagaacauucccugcucuguacugggugugugaagccccagcagagaaggccggagggaggg

SEQ ID NO: 354542 - RNA, 62 nt, Human
aguugggccucccaugggcccaagggaguaggaagccccauuccccaccuguccuuccucua

SEQ ID NO: 354543 - RNA, 62 nt, Human
gcguaugccucauuuuucaucuggugaugccaaagccccauggauucaggugcagaagaggg

SEQ ID NO: 354544 - RNA, 62 nt, Human
cuuuacaaacaccugcaggagaagggccacggaagccccaggcuuuagagcccucagcaggu

SEQ ID NO: 354545 - RNA, 62 nt, Human
gacccacccgccccauccaggcuccagcagcaaagccccaggagaacaggcuggacagagga

SEQ ID NO: 354546 - RNA, 62 nt, Human
gcagccggaaggucccucugaggcagaagcucaagccccauggggacaguggcuccccagug

SEQ ID NO: 354547 - RNA, 62 nt, Human
cauaauuuaaaaagucaaggcuuauaacaaaaaagccccagcccauuccucccauucaagau

SEQ ID NO: 354548 - RNA, 62 nt, Human
auaauauaggaaguuucaccuugccuuuguccaagccccaccuauuaaaacccuuuacucac

SEQ ID NO: 354549 - RNA, 62 nt, Human
gcugguuuucuccugauaagaagaaaggaagaaagccccagacgcuugguuuuucucagaac

SEQ ID NO: 354550 - RNA, 62 nt, Human
ucuauacauuaccuuguagcagcaguaccuggaagccccagcccgucacagaaguguggagg

SEQ ID NO: 354551 - RNA, 62 nt, Human
auucccuucgacagcauuuuccucugcuuugaaagccccagaaaucaguguuggccaugaug

SEQ ID NO: 354552 - RNA, 62 nt, Human
auauaugaugaagauuguaggacugucuucccaagccccauguucaugguggggcaaugguu

SEQ ID NO: 354553 - RNA, 62 nt, Human
accacagaugaugcuacugccauggccagugcaagccccagugucauguccaccaacuucug

SEQ ID NO: 354554 - RNA, 62 nt, Human
uucaccuuuucugugaacaggcagccuucuaaaagccccaaacauccuucuugaugcuuugg

SEQ ID NO: 354555 - RNA, 62 nt, Human
cccuguuuauuuauuauaaauauauuuuuuacaagccccagcuccucuucuugccccgcaua

SEQ ID NO: 354556 - RNA, 62 nt, Human
uuccucccaaaagaaaaggcaucaggcuccccaagccccacagcucuccuuuccaccaaagc

SEQ ID NO: 354557 - RNA, 62 nt, Human
gaggacugcaccauugcugcuccuuagcugccaagccccauccugccgcccgagguggcugc

SEQ ID NO: 354558 - RNA, 62 nt, Human
auauuacuguacaugggacuaugcuuuucucaaagccccauuaacugcuuccuauaauuuug

SEQ ID NO: 354559 - RNA, 62 nt, Human
auaagcuucuugguucuacuucucuucuccacaagccccaauuucacuuucucagaggaaau

SEQ ID NO: 354560 - RNA, 62 nt, Human
uuugcuuugcuuuucucacccaugcuuccuugaagccccaggugccacuuugcuggucuugu

SEQ ID NO: 354561 - RNA, 62 nt, Human
uucuccuuugucucccauccacucugacaccuaagccccacucuuuucccauuagauauaug

SEQ ID NO: 354562 - RNA, 62 nt, Human
ucugccauuagaccuucuuaucauccauacuaaagccccauuauuuagauugagcuugugca

SEQ ID NO: 354563 - RNA, 62 nt, Human
gaaaguagcagaaauuaaaucuuaauaaaagaaagccccacugacuccuuuauuugcugaac

SEQ ID NO: 354564 - RNA, 62 nt, Human
aaggugcuuagauggugagggcucuagaaaccaagccccaugagcagcaguggaagaccucg

SEQ ID NO: 354565 - RNA, 62 nt, Human
uguggauugguaagaaucaccaggaaaccauuaagccccaauagcuacaaggagggugguua

SEQ ID NO: 354566 - RNA, 62 nt, Human
ggacagagcaaggagagggcuccccacucccuaagccccacagccagcucugcaucaccaca

SEQ ID NO: 354567 - RNA, 64 nt, Human; identical to SEQ ID NO: 337676

SEQ ID NO: 354568 - RNA, 64 nt, Human; identical to SEQ ID NO: 337677

SEQ ID NO: 354569 - RNA, 64 nt, Human; identical to SEQ ID NO: 337678

SEQ ID NO: 354570 - RNA, 64 nt, Human; identical to SEQ ID NO: 337679

SEQ ID NO: 354571 - RNA, 64 nt, Human; identical to SEQ ID NO: 337680

SEQ ID NO: 354572 - RNA, 64 nt, Human; identical to SEQ ID NO: 337681

SEQ ID NO: 354573 - RNA, 62 nt, Human
ggugggucacgccuguaaucccagcacuuugggaggccaaggcggguugaucacccgagguc

SEQ ID NO: 354574 - RNA, 62 nt, Human
gguggcucaugccuguaaucccagcacuuggggaggccaaggcaggcggaucacaugaggcc

SEQ ID NO: 354575 - RNA, 62 nt, Human
gcuuaucaaaugaaguauuauuuuguggacuggaggccaaaaagucaaugugagcuucucac

SEQ ID NO: 354576 - RNA, 64 nt, Human; identical to SEQ ID NO: 337682

SEQ ID NO: 354577 - RNA, 64 nt, Human; identical to SEQ ID NO: 337683

SEQ ID NO: 354578 - RNA, 64 nt, Human; identical to SEQ ID NO: 337684

SEQ ID NO: 354579 - RNA, 64 nt, Human; identical to SEQ ID NO: 337685

SEQ ID NO: 354580 - RNA, 64 nt, Human; identical to SEQ ID NO: 337686

SEQ ID NO: 354581 - RNA, 64 nt, Human; identical to SEQ ID NO: 337687

SEQ ID NO: 354582 - RNA, 64 nt, Human; identical to SEQ ID NO: 337688

SEQ ID NO: 354583 - RNA, 64 nt, Human; identical to SEQ ID NO: 337689

SEQ ID NO: 354584 - RNA, 64 nt, Human; identical to SEQ ID NO: 337690

SEQ ID NO: 354585 - RNA, 64 nt, Human; identical to SEQ ID NO: 337694

SEQ ID NO: 354586 - RNA, 64 nt, Human; identical to SEQ ID NO: 337695

SEQ ID NO: 354587 - RNA, 64 nt, Human; identical to SEQ ID NO: 337696

SEQ ID NO: 354588 - RNA, 64 nt, Human; identical to SEQ ID NO: 337697

SEQ ID NO: 354589 - RNA, 64 nt, Human; identical to SEQ ID NO: 337698

SEQ ID NO: 354590 - RNA, 64 nt, Human; identical to SEQ ID NO: 337699

SEQ ID NO: 354591 - RNA, 62 nt, Human
cgacugcccuaccagccugcacauggguagaagaggccaaauugaggcacccaagugaucca

SEQ ID NO: 354592 - RNA, 62 nt, Human
gguggcucacaccuguaaucccagcacuuugggaggccaaggugggugggucaucugagguc

SEQ ID NO: 354593 - RNA, 62 nt, Human
cgcuccagguaccuugaccuuuguacagcccagaggccaacacugugggugugugacucuuu

SEQ ID NO: 354594 - RNA, 64 nt, Human; identical to SEQ ID NO: 337700

SEQ ID NO: 354595 - RNA, 64 nt, Human; identical to SEQ ID NO: 337701

SEQ ID NO: 354596 - RNA, 64 nt, Human; identical to SEQ ID NO: 337702

SEQ ID NO: 354597 - RNA, 64 nt, Human; identical to SEQ ID NO: 337703

SEQ ID NO: 354598 - RNA, 64 nt, Human; identical to SEQ ID NO: 337704

SEQ ID NO: 354599 - RNA, 64 nt, Human; identical to SEQ ID NO: 337705

SEQ ID NO: 354600 - RNA, 64 nt, Human; identical to SEQ ID NO: 337706

SEQ ID NO: 354601 - RNA, 64 nt, Human; identical to SEQ ID NO: 337707

SEQ ID NO: 354602 - RNA, 64 nt, Human; identical to SEQ ID NO: 337708

SEQ ID NO: 354603 - RNA, 64 nt, Human; identical to SEQ ID NO: 337712

SEQ ID NO: 354604 - RNA, 64 nt, Human; identical to SEQ ID NO: 337713

SEQ ID NO: 354605 - RNA, 64 nt, Human; identical to SEQ ID NO: 337714

SEQ ID NO: 354606 - RNA, 64 nt, Human; identical to SEQ ID NO: 337715

SEQ ID NO: 354607 - RNA, 64 nt, Human; identical to SEQ ID NO: 337716

SEQ ID NO: 354608 - RNA, 64 nt, Human; identical to SEQ ID NO: 337717

SEQ ID NO: 354609 - RNA, 62 nt, Human
gccucauguaaacauuuuauuuucaaaugaaugaggccaagcugaagcugaagcugaagauu

SEQ ID NO: 354610 - RNA, 62 nt, Human
aggggcucacaccuguaauccuagcacuuugggaggccaaggcggguggaucacuugagacc

SEQ ID NO: 354611 - RNA, 62 nt, Human
aguggcucacgccuguaaucccagcacuuugggaggccaaggcaaacggaucacgaggucag

SEQ ID NO: 354612 - RNA, 64 nt, Human; identical to SEQ ID NO: 337718

SEQ ID NO: 354613 - RNA, 64 nt, Human; identical to SEQ ID NO: 337719

SEQ ID NO: 354614 - RNA, 64 nt, Human; identical to SEQ ID NO: 337720

SEQ ID NO: 354615 - RNA, 64 nt, Human; identical to SEQ ID NO: 337721

SEQ ID NO: 354616 - RNA, 64 nt, Human; identical to SEQ ID NO: 337722

SEQ ID NO: 354617 - RNA, 64 nt, Human; identical to SEQ ID NO: 337723

SEQ ID NO: 354618 - RNA, 64 nt, Human; identical to SEQ ID NO: 337724

SEQ ID NO: 354619 - RNA, 64 nt, Human; identical to SEQ ID NO: 337725

SEQ ID NO: 354620 - RNA, 64 nt, Human; identical to SEQ ID NO: 337726

SEQ ID NO: 354621 - RNA, 64 nt, Human; identical to SEQ ID NO: 337730

SEQ ID NO: 354622 - RNA, 64 nt, Human; identical to SEQ ID NO: 337731

SEQ ID NO: 354623 - RNA, 64 nt, Human; identical to SEQ ID NO: 337732

SEQ ID NO: 354624 - RNA, 64 nt, Human; identical to SEQ ID NO: 337733

SEQ ID NO: 354625 - RNA, 64 nt, Human; identical to SEQ ID NO: 337734

SEQ ID NO: 354626 - RNA, 64 nt, Human; identical to SEQ ID NO: 337735

SEQ ID NO: 354627 - RNA, 62 nt, Human
uuaaaggaccacugcccugagguuacugcacugaggccaaguuaggauggcaucacucugug

SEQ ID NO: 354628 - RNA, 62 nt, Human
cagcuggggggcaggggggagaggggguaauggaggccaagccugcagcuuucuggaaauuc

SEQ ID NO: 354629 - RNA, 62 nt, Human
gguggcucacgccuguaaucccaacacuuugggaggccaagguggguggaucacaaggucag

SEQ ID NO: 354630 - RNA, 64 nt, Human; identical to SEQ ID NO: 337736

SEQ ID NO: 354631 - RNA, 64 nt, Human; identical to SEQ ID NO: 337737

SEQ ID NO: 354632 - RNA, 64 nt, Human; identical to SEQ ID NO: 337738

SEQ ID NO: 354633 - RNA, 64 nt, Human; identical to SEQ ID NO: 337739

SEQ ID NO: 354634 - RNA, 64 nt, Human; identical to SEQ ID NO: 337740

SEQ ID NO: 354635 - RNA, 64 nt, Human; identical to SEQ ID NO: 337741

SEQ ID NO: 354636 - RNA, 64 nt, Human; identical to SEQ ID NO: 337742

SEQ ID NO: 354637 - RNA, 64 nt, Human; identical to SEQ ID NO: 337743

SEQ ID NO: 354638 - RNA, 64 nt, Human; identical to SEQ ID NO: 337744

SEQ ID NO: 354639 - RNA, 64 nt, Human; identical to SEQ ID NO: 337748

SEQ ID NO: 354640 - RNA, 64 nt, Human; identical to SEQ ID NO: 337749

SEQ ID NO: 354641 - RNA, 64 nt, Human; identical to SEQ ID NO: 337750

SEQ ID NO: 354642 - RNA, 64 nt, Human; identical to SEQ ID NO: 337751

SEQ ID NO: 354643 - RNA, 64 nt, Human; identical to SEQ ID NO: 337752

SEQ ID NO: 354644 - RNA, 64 nt, Human; identical to SEQ ID NO: 337753

SEQ ID NO: 354645 - RNA, 62 nt, Human
acgguggcucaccuguaaucccagcacuuugggaggccaaggcgggcagaucaccugagguc

SEQ ID NO: 354646 - RNA, 62 nt, Human
aacugcugaggaugggggguguccccucagcggaggccaagggaggggagcagccuaguugg

SEQ ID NO: 354647 - RNA, 62 nt, Human
gguggcucaggccuguaaucccagcacuuugggaggccaagaugggcggaucaugaagucag

SEQ ID NO: 354648 - RNA, 64 nt, Human; identical to SEQ ID NO: 337754

SEQ ID NO: 354649 - RNA, 64 nt, Human; identical to SEQ ID NO: 337755

SEQ ID NO: 354650 - RNA, 64 nt, Human; identical to SEQ ID NO: 337756

SEQ ID NO: 354651 - RNA, 64 nt, Human; identical to SEQ ID NO: 337757

SEQ ID NO: 354652 - RNA, 64 nt, Human; identical to SEQ ID NO: 337758

SEQ ID NO: 354653 - RNA, 64 nt, Human; identical to SEQ ID NO: 337759

SEQ ID NO: 354654 - RNA, 64 nt, Human; identical to SEQ ID NO: 337760

SEQ ID NO: 354655 - RNA, 64 nt, Human; identical to SEQ ID NO: 337761

SEQ ID NO: 354656 - RNA, 64 nt, Human; identical to SEQ ID NO: 337762

SEQ ID NO: 354657 - RNA, 64 nt, Human; identical to SEQ ID NO: 337765

SEQ ID NO: 354658 - RNA, 64 nt, Human; identical to SEQ ID NO: 337766

SEQ ID NO: 354659 - RNA, 64 nt, Human; identical to SEQ ID NO: 337767

SEQ ID NO: 354660 - RNA, 64 nt, Human; identical to SEQ ID NO: 337768

SEQ ID NO: 354661 - RNA, 64 nt, Human; identical to SEQ ID NO: 337769

SEQ ID NO: 354662 - RNA, 64 nt, Human; identical to SEQ ID NO: 337770

SEQ ID NO: 354663 - RNA, 62 nt, Human
ugguggggaaugaguguucagaagccuugggagaggccaaagagccauucuagcaugaucug

SEQ ID NO: 354664 - RNA, 62 nt, Human
ucccugucccccucacucuugccccaagaaaagaggccaaagcaagagcagauucccuaggc

SEQ ID NO: 354665 - RNA, 61 nt, Human
gcacaucagugguaacagcggacguuguccucguggucacacgucccgucuugggugugga

SEQ ID NO: 354666 - RNA, 64 nt, Human; identical to SEQ ID NO: 337771

SEQ ID NO: 354667 - RNA, 64 nt, Human; identical to SEQ ID NO: 337772

SEQ ID NO: 354668 - RNA, 64 nt, Human; identical to SEQ ID NO: 337773

SEQ ID NO: 354669 - RNA, 64 nt, Human; identical to SEQ ID NO: 337774

SEQ ID NO: 354670 - RNA, 64 nt, Human; identical to SEQ ID NO: 337775

SEQ ID NO: 354671 - RNA, 64 nt, Human; identical to SEQ ID NO: 337776

SEQ ID NO: 354672 - RNA, 64 nt, Human; identical to SEQ ID NO: 337777

SEQ ID NO: 354673 - RNA, 64 nt, Human; identical to SEQ ID NO: 337778

SEQ ID NO: 354674 - RNA, 64 nt, Human; identical to SEQ ID NO: 337779

SEQ ID NO: 354675 - RNA, 64 nt, Human; identical to SEQ ID NO: 337783

SEQ ID NO: 354676 - RNA, 64 nt, Human; identical to SEQ ID NO: 337784

SEQ ID NO: 354677 - RNA, 64 nt, Human; identical to SEQ ID NO: 337785

SEQ ID NO: 354678 - RNA, 64 nt, Human; identical to SEQ ID NO: 337786

SEQ ID NO: 354679 - RNA, 64 nt, Human; identical to SEQ ID NO: 337787

SEQ ID NO: 354680 - RNA, 64 nt, Human; identical to SEQ ID NO: 337788

SEQ ID NO: 354681 - RNA, 62 nt, Human
gguggcucacgccuguaaucccaguaguuugggaggccaaggcgggcagaucaccugagguc

SEQ ID NO: 354682 - RNA, 62 nt, Human
gguggcucaugccuguaaucccaacacuuugggaggccaaggcaggcagaucacuuaaggcc

SEQ ID NO: 354683 - RNA, 61 nt, Human
cuuuucuucugaauuuagaggauuucuagaacguggucaggaauagccauucuaggcgggg

SEQ ID NO: 354684 - RNA, 64 nt, Human; identical to SEQ ID NO: 337789

SEQ ID NO: 354685 - RNA, 64 nt, Human; identical to SEQ ID NO: 337790

SEQ ID NO: 354686 - RNA, 64 nt, Human; identical to SEQ ID NO: 337791

SEQ ID NO: 354687 - RNA, 64 nt, Human; identical to SEQ ID NO: 337792

SEQ ID NO: 354688 - RNA, 64 nt, Human; identical to SEQ ID NO: 337793

SEQ ID NO: 354689 - RNA, 64 nt, Human; identical to SEQ ID NO: 337794

SEQ ID NO: 354690 - RNA, 64 nt, Human; identical to SEQ ID NO: 337795

SEQ ID NO: 354691 - RNA, 64 nt, Human; identical to SEQ ID NO: 337796

SEQ ID NO: 354692 - RNA, 64 nt, Human; identical to SEQ ID NO: 337797

SEQ ID NO: 354693 - RNA, 64 nt, Human; identical to SEQ ID NO: 337801

SEQ ID NO: 354694 - RNA, 64 nt, Human; identical to SEQ ID NO: 337802

SEQ ID NO: 354695 - RNA, 64 nt, Human; identical to SEQ ID NO: 337803

SEQ ID NO: 354696 - RNA, 64 nt, Human; identical to SEQ ID NO: 337804

SEQ ID NO: 354697 - RNA, 64 nt, Human; identical to SEQ ID NO: 337805

SEQ ID NO: 354698 - RNA, 64 nt, Human; identical to SEQ ID NO: 337806

SEQ ID NO: 354699 - RNA, 61 nt, Human
aucuccacuaaaaauacaaaaauuagccaggcguggucacaugcgccuguaaucccagcua

SEQ ID NO: 354700 - RNA, 61 nt, Human
augauuaaguguccaucaccugccugucagccguggucagaauaaguuuuacacgaagcag

SEQ ID NO: 354701 - RNA, 61 nt, Human
ccauccccugacucuuucaccggcaggggcacguggucaacaggacuccccaagcggaaug

SEQ ID NO: 354702 - RNA, 64 nt, Human; identical to SEQ ID NO: 337824

SEQ ID NO: 354703 - RNA, 64 nt, Human
ccucacaccugugggcagggcagaacagccuggcgggcuacaguuuagcauggccuucuugagc

SEQ ID NO: 354704 - RNA, 64 nt, Human
gccacuggggugggggccagguucacugggaccagggcuacaggcacagagucuccuggaaaag

SEQ ID NO: 354705 - RNA, 64 nt, Human
ggugagccaagaucgugccacugcacuccagccugggcuacaagauugaaaagaucgaaacucu

SEQ ID NO: 354706 - RNA, 64 nt, Human
ugagagccuugggggucuccaccagugcagacaagggcuacagucuccagggccgggucuuguc

SEQ ID NO: 354707 - RNA, 64 nt, Human
ucggggucuccaccccaggccagcagcgcccacugggcuacagcaagccaacaggucacagaag

SEQ ID NO: 354708 - RNA, 64 nt, Human
gugugacaguuguucagucugcauuuucgaucaugggcuacaugccgagugcuggggcacagag

SEQ ID NO: 354709 - RNA, 64 nt, Human
gccagcuggguuuggccaggauuucuccgugugggggcuacaugcgacccucuccccuccuccc

SEQ ID NO: 354710 - RNA, 64 nt, Human
ccaccuagaauucuuccagcagccuguaaugggagggcuacagguuagcccuggaaccugcaau

SEQ ID NO: 354711 - RNA, 64 nt, Human
ggaucacuugaacucaggaauucgagaccagccugggcuacauagugagaccacaucucuacua

SEQ ID NO: 354712 - RNA, 64 nt, Human
guucuggaggacugaaguccaaaugcaucucacggggcuacaucaagcuguugacagggcugcu

SEQ ID NO: 354713 - RNA, 64 nt, Human
gagaacuggggugauguuuuacuuuucacaguaugggcuacacagcagcuguucaacaagagua

SEQ ID NO: 354714 - RNA, 64 nt, Human
agugucuuguaacaacuaauuauaaugcaaauuagggcuacauuguaaucugcuuuguuaauga

SEQ ID NO: 354715 - RNA, 64 nt, Human
acgccgccucgccugccacggcugccagcuucgugggcuacagcuacccugccgccgugcccca

SEQ ID NO: 354716 - RNA, 64 nt, Human
uugaagcauggaaauucuuguuugggggaucuuggggcuacaguaguggguaaacaaaugccca

SEQ ID NO: 354717 - RNA, 61 nt, Human
cccaggguucaaguguguggcugggucagggcguggucacccgucauucugcauaggucgg

SEQ ID NO: 354718 - RNA, 61 nt, Human
uugcuuuguugcccaggcuggagugcagugacguggucauagcucacugcagccucaaccu

SEQ ID NO: 354719 - RNA, 61 nt, Human
agggcacucgcugcuugaaaguacuggagcacguggucagggucaaugcaagaguucucau

SEQ ID NO: 354720 - RNA, 64 nt, Human; identical to SEQ ID NO: 337825

SEQ ID NO: 354721 - RNA, 64 nt, Human; identical to SEQ ID NO: 337826

SEQ ID NO: 354722 - RNA, 64 nt, Human; identical to SEQ ID NO: 337827

SEQ ID NO: 354723 - RNA, 64 nt, Human; identical to SEQ ID NO: 337828

SEQ ID NO: 354724 - RNA, 64 nt, Human; identical to SEQ ID NO: 337829

SEQ ID NO: 354725 - RNA, 64 nt, Human; identical to SEQ ID NO: 337830

SEQ ID NO: 354726 - RNA, 64 nt, Human; identical to SEQ ID NO: 337831

SEQ ID NO: 354727 - RNA, 64 nt, Human; identical to SEQ ID NO: 337832

SEQ ID NO: 354728 - RNA, 64 nt, Human; identical to SEQ ID NO: 337833

SEQ ID NO: 354729 - RNA, 64 nt, Human; identical to SEQ ID NO: 337837

SEQ ID NO: 354730 - RNA, 64 nt, Human; identical to SEQ ID NO: 337838

SEQ ID NO: 354731 - RNA, 64 nt, Human; identical to SEQ ID NO: 337839

SEQ ID NO: 354732 - RNA, 64 nt, Human; identical to SEQ ID NO: 337840

SEQ ID NO: 354733 - RNA, 64 nt, Human; identical to SEQ ID NO: 337841

SEQ ID NO: 354734 - RNA, 64 nt, Human; identical to SEQ ID NO: 337842

SEQ ID NO: 354735 - RNA, 64 nt, Human; identical to SEQ ID NO: 58972

SEQ ID NO: 354736 - RNA, 64 nt, Human; identical to SEQ ID NO: 58978

SEQ ID NO: 354737 - RNA, 64 nt, Human; identical to SEQ ID NO: 58984

SEQ ID NO: 354738 - RNA, 64 nt, Human; identical to SEQ ID NO: 337843

SEQ ID NO: 354739 - RNA, 64 nt, Human; identical to SEQ ID NO: 337844

SEQ ID NO: 354740 - RNA, 64 nt, Human; identical to SEQ ID NO: 337845

SEQ ID NO: 354741 - RNA, 64 nt, Human; identical to SEQ ID NO: 337846

SEQ ID NO: 354742 - RNA, 64 nt, Human; identical to SEQ ID NO: 337847

SEQ ID NO: 354743 - RNA, 64 nt, Human; identical to SEQ ID NO: 337848

SEQ ID NO: 354744 - RNA, 64 nt, Human; identical to SEQ ID NO: 337849

SEQ ID NO: 354745 - RNA, 64 nt, Human; identical to SEQ ID NO: 337850

SEQ ID NO: 354746 - RNA, 64 nt, Human; identical to SEQ ID NO: 337851

SEQ ID NO: 354747 - RNA, 64 nt, Human; identical to SEQ ID NO: 337855

SEQ ID NO: 354748 - RNA, 64 nt, Human; identical to SEQ ID NO: 337856

SEQ ID NO: 354749 - RNA, 64 nt, Human; identical to SEQ ID NO: 337857

SEQ ID NO: 354750 - RNA, 64 nt, Human; identical to SEQ ID NO: 337858

SEQ ID NO: 354751 - RNA, 64 nt, Human; identical to SEQ ID NO: 337859

SEQ ID NO: 354752 - RNA, 64 nt, Human; identical to SEQ ID NO: 337860

SEQ ID NO: 354753 - RNA, 62 nt, Human
aguggcucacaccuguaaucccaacaccuugggaggccaaggugggcggaucacuugagguc

SEQ ID NO: 354754 - RNA, 62 nt, Human
gagaggucgggauuugcccugggggaggaagagaggccaaguucagagcucucugucucccc

SEQ ID NO: 354755 - RNA, 62 nt, Human
gguggaucacgccuguaaucccagcacucugggaggccaaagcgggcagaucaccugagguc

SEQ ID NO: 354756 - RNA, 64 nt, Human; identical to SEQ ID NO: 337861

SEQ ID NO: 354757 - RNA, 64 nt, Human; identical to SEQ ID NO: 337862

SEQ ID NO: 354758 - RNA, 64 nt, Human; identical to SEQ ID NO: 337863

SEQ ID NO: 354759 - RNA, 64 nt, Human; identical to SEQ ID NO: 337864

SEQ ID NO: 354760 - RNA, 64 nt, Human; identical to SEQ ID NO: 337865

SEQ ID NO: 354761 - RNA, 64 nt, Human; identical to SEQ ID NO: 337866

SEQ ID NO: 354762 - RNA, 64 nt, Human; identical to SEQ ID NO: 337867

SEQ ID NO: 354763 - RNA, 64 nt, Human; identical to SEQ ID NO: 337868

SEQ ID NO: 354764 - RNA, 64 nt, Human; identical to SEQ ID NO: 337869

SEQ ID NO: 354765 - RNA, 64 nt, Human; identical to SEQ ID NO: 337873

SEQ ID NO: 354766 - RNA, 64 nt, Human; identical to SEQ ID NO: 337874

SEQ ID NO: 354767 - RNA, 64 nt, Human; identical to SEQ ID NO: 337875

SEQ ID NO: 354768 - RNA, 64 nt, Human; identical to SEQ ID NO: 337876

SEQ ID NO: 354769 - RNA, 64 nt, Human; identical to SEQ ID NO: 337877

SEQ ID NO: 354770 - RNA, 64 nt, Human; identical to SEQ ID NO: 337878

SEQ ID NO: 354771 - RNA, 62 nt, Human
ccucucugcuguuccucucuacaagaaccugggaggccaacgccuaaagaucauaauaucac

SEQ ID NO: 354772 - RNA, 62 nt, Human
uggaccccaugaacgaguacaacgcgcugaacgaggccaagcagaugaucgccgucgccgac

SEQ ID NO: 354773 - RNA, 62 nt, Human
ugaagcgggagauggcgcaggggcugcucccugaggccaagaagccucggcuccugcacggc

SEQ ID NO: 354774 - RNA, 64 nt, Human; identical to SEQ ID NO: 337879

SEQ ID NO: 354775 - RNA, 64 nt, Human; identical to SEQ ID NO: 337880

SEQ ID NO: 354776 - RNA, 64 nt, Human; identical to SEQ ID NO: 337881

SEQ ID NO: 354777 - RNA, 64 nt, Human; identical to SEQ ID NO: 337882

SEQ ID NO: 354778 - RNA, 64 nt, Human; identical to SEQ ID NO: 337883

SEQ ID NO: 354779 - RNA, 64 nt, Human; identical to SEQ ID NO: 337884

SEQ ID NO: 354780 - RNA, 64 nt, Human; identical to SEQ ID NO: 337885

SEQ ID NO: 354781 - RNA, 64 nt, Human; identical to SEQ ID NO: 337886

SEQ ID NO: 354782 - RNA, 64 nt, Human; identical to SEQ ID NO: 337887

SEQ ID NO: 354783 - RNA, 64 nt, Human; identical to SEQ ID NO: 337891

SEQ ID NO: 354784 - RNA, 64 nt, Human; identical to SEQ ID NO: 337892

SEQ ID NO: 354785 - RNA, 64 nt, Human; identical to SEQ ID NO: 337893

SEQ ID NO: 354786 - RNA, 64 nt, Human; identical to SEQ ID NO: 337894

SEQ ID NO: 354787 - RNA, 64 nt, Human; identical to SEQ ID NO: 337895

SEQ ID NO: 354788 - RNA, 64 nt, Human; identical to SEQ ID NO: 337896

SEQ ID NO: 354789 - RNA, 62 nt, Human
uguccuucaaauacucagcauuaccauugguugaggccaaauucagagcuuucucaaaucag

SEQ ID NO: 354790 - RNA, 62 nt, Human
aguggcugacaccuguaaucucagcacuuugagaggccaaggcaguaggacugauugaagac

SEQ ID NO: 354791 - RNA, 62 nt, Human
ccccagcugggcccgcuuagcccaccaggcaugaggccaagggcuccacugaccaggaggcc

SEQ ID NO: 354792 - RNA, 64 nt, Human; identical to SEQ ID NO: 337897

SEQ ID NO: 354793 - RNA, 64 nt, Human; identical to SEQ ID NO: 337898

SEQ ID NO: 354794 - RNA, 64 nt, Human; identical to SEQ ID NO: 337899

SEQ ID NO: 354795 - RNA, 64 nt, Human; identical to SEQ ID NO: 337900

SEQ ID NO: 354796 - RNA, 64 nt, Human; identical to SEQ ID NO: 337901

SEQ ID NO: 354797 - RNA, 64 nt, Human; identical to SEQ ID NO: 337902

SEQ ID NO: 354798 - RNA, 64 nt, Human; identical to SEQ ID NO: 337903

SEQ ID NO: 354799 - RNA, 64 nt, Human; identical to SEQ ID NO: 337904

SEQ ID NO: 354800 - RNA, 64 nt, Human; identical to SEQ ID NO: 337905

SEQ ID NO: 354801 - RNA, 64 nt, Human; identical to SEQ ID NO: 337909

SEQ ID NO: 354802 - RNA, 64 nt, Human; identical to SEQ ID NO: 337910

SEQ ID NO: 354803 - RNA, 64 nt, Human; identical to SEQ ID NO: 337911

SEQ ID NO: 354804 - RNA, 64 nt, Human; identical to SEQ ID NO: 337912

SEQ ID NO: 354805 - RNA, 64 nt, Human; identical to SEQ ID NO: 337913

SEQ ID NO: 354806 - RNA, 64 nt, Human; identical to SEQ ID NO: 337914

SEQ ID NO: 354807 - RNA, 62 nt, Human
gguggcucacaccuauaaccccagcacuuugggaggccaaggcaggcagaucaccugaaguc

SEQ ID NO: 354808 - RNA, 62 nt, Human
aggggagguagagcacugaugggugaaaaagugaggccaacacacagggcaaguggugucga

SEQ ID NO: 354809 - RNA, 62 nt, Human
cuguuucugcuuugagcaauaauuucuaaccugaggccaacaugucccacugccccuugggu

SEQ ID NO: 354810 - RNA, 64 nt, Human; identical to SEQ ID NO: 337915

SEQ ID NO: 354811 - RNA, 64 nt, Human; identical to SEQ ID NO: 337916

SEQ ID NO: 354812 - RNA, 64 nt, Human; identical to SEQ ID NO: 337917

SEQ ID NO: 354813 - RNA, 64 nt, Human; identical to SEQ ID NO: 337918

SEQ ID NO: 354814 - RNA, 64 nt, Human; identical to SEQ ID NO: 337919

SEQ ID NO: 354815 - RNA, 64 nt, Human; identical to SEQ ID NO: 337920

SEQ ID NO: 354816 - RNA, 64 nt, Human; identical to SEQ ID NO: 337921

SEQ ID NO: 354817 - RNA, 64 nt, Human; identical to SEQ ID NO: 337922

SEQ ID NO: 354818 - RNA, 64 nt, Human; identical to SEQ ID NO: 337923

SEQ ID NO: 354819 - RNA, 64 nt, Human; identical to SEQ ID NO: 337927

SEQ ID NO: 354820 - RNA, 64 nt, Human; identical to SEQ ID NO: 337928

SEQ ID NO: 354821 - RNA, 64 nt, Human; identical to SEQ ID NO: 337929

SEQ ID NO: 354822 - RNA, 64 nt, Human; identical to SEQ ID NO: 337930

SEQ ID NO: 354823 - RNA, 64 nt, Human; identical to SEQ ID NO: 337931

SEQ ID NO: 354824 - RNA, 64 nt, Human; identical to SEQ ID NO: 337932

SEQ ID NO: 354825 - RNA, 62 nt, Human
gguaguuuaagccuauaaucucagcccuuuuggaggccaagguaagaggaucgcuugagguc

SEQ ID NO: 354826 - RNA, 62 nt, Human
gguggcucaugccucuaaucucagcacuuugggaggccaaggugggcggaucacuugagguc

SEQ ID NO: 354827 - RNA, 64 nt, Human; identical to SEQ ID NO: 58990

SEQ ID NO: 354828 - RNA, 64 nt, Human; identical to SEQ ID NO: 337933

SEQ ID NO: 354829 - RNA, 64 nt, Human; identical to SEQ ID NO: 337934

SEQ ID NO: 354830 - RNA, 64 nt, Human; identical to SEQ ID NO: 337935

SEQ ID NO: 354831 - RNA, 64 nt, Human; identical to SEQ ID NO: 337936

SEQ ID NO: 354832 - RNA, 64 nt, Human; identical to SEQ ID NO: 337937

SEQ ID NO: 354833 - RNA, 64 nt, Human; identical to SEQ ID NO: 337938

SEQ ID NO: 354834 - RNA, 64 nt, Human; identical to SEQ ID NO: 337939

SEQ ID NO: 354835 - RNA, 64 nt, Human; identical to SEQ ID NO: 337940

SEQ ID NO: 354836 - RNA, 64 nt, Human; identical to SEQ ID NO: 337941

SEQ ID NO: 354837 - RNA, 64 nt, Human; identical to SEQ ID NO: 337945

SEQ ID NO: 354838 - RNA, 64 nt, Human; identical to SEQ ID NO: 337946

SEQ ID NO: 354839 - RNA, 64 nt, Human; identical to SEQ ID NO: 337947

SEQ ID NO: 354840 - RNA, 64 nt, Human; identical to SEQ ID NO: 337948

SEQ ID NO: 354841 - RNA, 64 nt, Human; identical to SEQ ID NO: 337949

SEQ ID NO: 354842 - RNA, 64 nt, Human; identical to SEQ ID NO: 337950

SEQ ID NO: 354843 - RNA, 62 nt, Human
cagagccggagagcgugcugcuggugcauggcgaggccaagaagauggaguuccugaagcag

SEQ ID NO: 354844 - RNA, 62 nt, Human
gguggcucacgccuguaaucccagcacuuugggaggccaaggugggcggaucacaaggucag

SEQ ID NO: 354845 - RNA, 62 nt, Human
gguggcucacaccuguaaucccuguacuuugggaggccaaggggggagaucacuugagguca

SEQ ID NO: 354846 - RNA, 64 nt, Human; identical to SEQ ID NO: 337951

SEQ ID NO: 354847 - RNA, 64 nt, Human; identical to SEQ ID NO: 337952

SEQ ID NO: 354848 - RNA, 64 nt, Human; identical to SEQ ID NO: 337953

SEQ ID NO: 354849 - RNA, 64 nt, Human; identical to SEQ ID NO: 337954

SEQ ID NO: 354850 - RNA, 64 nt, Human; identical to SEQ ID NO: 337955

SEQ ID NO: 354851 - RNA, 64 nt, Human; identical to SEQ ID NO: 337956

SEQ ID NO: 354852 - RNA, 64 nt, Human; identical to SEQ ID NO: 337957

SEQ ID NO: 354853 - RNA, 64 nt, Human; identical to SEQ ID NO: 337958

SEQ ID NO: 354854 - RNA, 64 nt, Human; identical to SEQ ID NO: 337959

SEQ ID NO: 354855 - RNA, 64 nt, Human; identical to SEQ ID NO: 337963

SEQ ID NO: 354856 - RNA, 64 nt, Human; identical to SEQ ID NO: 337964

SEQ ID NO: 354857 - RNA, 64 nt, Human; identical to SEQ ID NO: 337965

SEQ ID NO: 354858 - RNA, 64 nt, Human; identical to SEQ ID NO: 337966

SEQ ID NO: 354859 - RNA, 64 nt, Human; identical to SEQ ID NO: 337967

SEQ ID NO: 354860 - RNA, 64 nt, Human; identical to SEQ ID NO: 337968

SEQ ID NO: 354861 - RNA, 62 nt, Human
cacaccucaugccuguaaucccagcacucugggaggccaaggcagaugaucaccugagguca

SEQ ID NO: 354862 - RNA, 62 nt, Human
gggacuacagaguuaaucuccuuuuuacaaaugaggccaagagaagccucauugguucacag

SEQ ID NO: 354863 - RNA, 62 nt, Human
cgguggcucacgccuguaaucccaguacuugggaggccaaggcaggcauaucaacuugaggc

SEQ ID NO: 354864 - RNA, 64 nt, Human; identical to SEQ ID NO: 337969

SEQ ID NO: 354865 - RNA, 64 nt, Human; identical to SEQ ID NO: 337970

SEQ ID NO: 354866 - RNA, 64 nt, Human; identical to SEQ ID NO: 337971

SEQ ID NO: 354867 - RNA, 64 nt, Human; identical to SEQ ID NO: 337972

SEQ ID NO: 354868 - RNA, 64 nt, Human; identical to SEQ ID NO: 337973

SEQ ID NO: 354869 - RNA, 64 nt, Human; identical to SEQ ID NO: 337974

SEQ ID NO: 354870 - RNA, 64 nt, Human; identical to SEQ ID NO: 337975

SEQ ID NO: 354871 - RNA, 64 nt, Human; identical to SEQ ID NO: 337969

SEQ ID NO: 354872 - RNA, 64 nt, Human; identical to SEQ ID NO: 337977

SEQ ID NO: 354873 - RNA, 64 nt, Human; identical to SEQ ID NO: 337981

SEQ ID NO: 354874 - RNA, 64 nt, Human; identical to SEQ ID NO: 337982

SEQ ID NO: 354875 - RNA, 64 nt, Human; identical to SEQ ID NO: 337983

SEQ ID NO: 354876 - RNA, 64 nt, Human; identical to SEQ ID NO: 337984

SEQ ID NO: 354877 - RNA, 62 nt, Human
auaggggacugaggagcaaggguggccuugaagaggccaaaggaauguccauuugcugaguu

SEQ ID NO: 354878 - RNA, 62 nt, Human
uguggcucacgccuauaaucccagcacuuugggaggccaaggcaggcggaucccugaguucg

SEQ ID NO: 354879 - RNA, 62 nt, Human
ugccagcagcucucauuaacagugaaaugacagaggccaaagauggccaagugaagacccaa

SEQ ID NO: 354880 - RNA, 62 nt, Human
accuggguaaggacuugccagagaacuacaacgaggccaaaugugucaccuucagccugcuc

SEQ ID NO: 354881 - RNA, 62 nt, Human
gcggccgcagcgaagcugccguucauguguuggaggccaaauguggcaaaccaaccccaggc

SEQ ID NO: 354882 - RNA, 62 nt, Human
gguggcucacgccuguaaucccagcacauugggaggccaaggcagguggaucaccugagguc

SEQ ID NO: 354883 - RNA, 62 nt, Human
gguggcucacgcuuguaaucccagcacuuugggaggccaagguggguggaucaccugagguc

SEQ ID NO: 354884 - RNA, 62 nt, Human
uugggggccuuccauguagaaaguggggucaggaggccaagaaagggaauaugaauguauau

SEQ ID NO: 354885 - RNA, 62 nt, Human
cuccaugcuuaauggugugaggcgucaggagagaggccaaguacauaaaaaaaaaaaaagca

SEQ ID NO: 354886 - RNA, 62 nt, Human
aguggcucacaccuguaaucccagcacuuugggaggccaaggugaguggaucaccugagguc

SEQ ID NO: 354887 - RNA, 62 nt, Human
uuagcguggcuggguggccgugggugcuucuagaggccaaagccuuuguguuuuucacuggu

SEQ ID NO: 354888 - RNA, 62 nt, Human
gugauaguuaacuggauuuguuaggugagggugaggccaagggugacuuccagguuccugac

SEQ ID NO: 354889 - RNA, 62 nt, Human
aguggcucacgccuguaaucucaacacuuugggaggccaaggugggaagaucacuugauccc

SEQ ID NO: 354890 - RNA, 62 nt, Human
gguggcucacaccuguaaucccagcacuuugggaggccaaggcaggcaaucaccugagguca

SEQ ID NO: 354891 - RNA, 62 nt, Human
auuuuggccccaacccacacaggccaaugcaagaggccaaggcuggagaggcgugccagcaa

SEQ ID NO: 354892 - RNA, 62 nt, Human
ugguuuggagguguaaaacaauguccuucgcugaggccaaaguuuccauguaagcgggaucc

SEQ ID NO: 354893 - RNA, 62 nt, Human
ccuccuuccagcaccugccagagcuucuccaggaggccaagcagaggcuccccucaugaagg

SEQ ID NO: 354894 - RNA, 62 nt, Human
agucaccccaaggcagguguagggagcccagggaggccaaucagcccccugaagacucuggu

SEQ ID NO: 354895 - RNA, 62 nt, Human
gguggcucaugccuguaaucccgacacuuugggaggccaaggcaggaggauggcuugaagcc

SEQ ID NO: 354896 - RNA, 62 nt, Human
gguggcucacgccuguaauccuagcacuuugggaggccaaggugggaggauugcuugagcuc

SEQ ID NO: 354897 - RNA, 62 nt, Human
aacgggucaguauuaagguuuucaaccggaaggaggccaaccagcccgacagugccaucccc

SEQ ID NO: 354898 - RNA, 62 nt, Human
gguggcucacgccuguaaucccagcacuuugggaggccaaggugggcggaucgccugagguc

SEQ ID NO: 354899 - RNA, 62 nt, Human
gaaugggcaguuaguccagugcccucauuuaagaggccaagauccugauucagaggaggcau

SEQ ID NO: 354900 - RNA, 62 nt, Human
gguagcacacaccuguagucccagauacuugggaggccaaggcaggaggauugcuugagacc

SEQ ID NO: 354901 - RNA, 62 nt, Human
gguggcucacgccuguaaucccagcacuuugggaggccaaggugggcggaucaccugauguc

SEQ ID NO: 354902 - RNA, 62 nt, Human
aguggcucacaccuguaaucccagcacuuugggaggccaaggagggcagaucacuucagguc

SEQ ID NO: 354903 - RNA, 62 nt, Human
aguggcucacgccuguaaucccagcacuuugggaggccaagguggguggaucaccugugguc

SEQ ID NO: 354904 - RNA, 62 nt, Human
aggggaggggagggaucaggcgaugagacugugaggccaaaagaagggggccuguuggaggc

SEQ ID NO: 354905 - RNA, 62 nt, Human
gguggcucaugccuguaaucucaguacauugggaggccaaggcagguggaucaccugagguc

SEQ ID NO: 354906 - RNA, 62 nt, Human
guggcgguaacugccccaaggccccagggacagaggccaaggacugacuuugccaaaaauac

SEQ ID NO: 354907 - RNA, 62 nt, Human
gcauggagaagaccagggaagaagcagaacuugaggccaacaguguguuucgucaaaaguag

SEQ ID NO: 354908 - RNA, 62 nt, Human
gguggcuuacgccuguaauccuagcacuuugggaggccaagacgggcggaucaccugaggug

SEQ ID NO: 354909 - RNA, 62 nt, Human
agccagaugacucaaucagaugaaaugugccugaggccaacgauguacacuugcucuauaga

SEQ ID NO: 354910 - RNA, 62 nt, Human
aaaguauuggacugagauauuugguuaccauggaggccaaugcuuuuuucaucuuauuaaau

SEQ ID NO: 354911 - RNA, 62 nt, Human
ggugucuguguacccgcuggucuuguuuggaggaggccaagugaaugugcagcuucaaagag

SEQ ID NO: 354912 - RNA, 62 nt, Human
cuguuuuuucagguuuuacugaugaggcuugugaggccaaucaaaauaauguuugugaucuc

SEQ ID NO: 354913 - RNA, 62 nt, Human
ggcccaugguccugcuucaugcuuugggucaggaggccaaagcugauguucaggccccaccc

SEQ ID NO: 354914 - RNA, 62 nt, Human
gguggcugacaccuguaaucccagcacuuugggaggccaagguggggggauuacccgagguc

SEQ ID NO: 354915 - RNA, 62 nt, Human
caggcaaagccugugugacuguggcagugccggaggccaagggggccaagaggaaaagcauc

SEQ ID NO: 354916 - RNA, 62 nt, Human
gagcaguucaucuuuuccagagguaaggguaggaggccaacuucagggucugggucugagcc

SEQ ID NO: 354917 - RNA, 62 nt, Human
cacuuugggaggcugaggugggcagaucacuugaggccaauaguucgagaucagccugacca

SEQ ID NO: 354918 - RNA, 62 nt, Human
aguggcucacuccuguaauccgagcaauuugggaggccaaggugggaguuuugcuugaggcc

SEQ ID NO: 354919 - RNA, 62 nt, Human
aguggcucaugcuuguaauccuagcacuuuuugaggccaagguaggaggauugcuugagucc

SEQ ID NO: 354920 - RNA, 62 nt, Human
caugagagaagcagaaggaggaaacauaagaggaggccaaaaguuaaacguucuaaaaagag

SEQ ID NO: 354921 - RNA, 62 nt, Human
ggcccaccugcccuauccccucccuugcuccugaggccaaagccagagacucgaacagccuc

SEQ ID NO: 354922 - RNA, 62 nt, Human
acucaggagguuucuauaaugccacauagaaagaggccaauugcaugaguaauuauugcaau

SEQ ID NO: 354923 - RNA, 62 nt, Human
aguggcucacaccuguaaucccagcacguugggaggccaaggcgggcagaucacgaggucaa

SEQ ID NO: 354924 - RNA, 62 nt, Human
guucucugaacuaaaaggacuaauuguacuuugaggccaaugcugcuuucugguguauauuc

SEQ ID NO: 354925 - RNA, 62 nt, Human
ggugacucaugccuguaaucccggcacuuugggaggccaagggaggugaucacuugagccca

SEQ ID NO: 354926 - RNA, 62 nt, Human
gaaguuagaaaagccucgauuucaucuuuggagaggccaaauggucuuagccucagucucug

SEQ ID NO: 354927 - RNA, 62 nt, Human
uuguggaaccagaggcacagagagagucaacugaggccaaaagaggccugagagaaacugag

SEQ ID NO: 354928 - RNA, 62 nt, Human
cguccaccccagagacccugcccuuccacccggaggccaaaggccaacuguacucccaaagg

SEQ ID NO: 354929 - RNA, 62 nt, Human
gcagcaugcacggaggcggggucaggggagacgaggccaagcugaggaggugcugcaggucc

SEQ ID NO: 354930 - RNA, 62 nt, Human
aguggcucaugccuguaaucccagcacuuugagaggccaaggcagguggaucacgaggucaa

SEQ ID NO: 354931 - RNA, 62 nt, Human
aacucucugcuggguucugacucagaccauaggaggccaacccaaaauaagcaggcgugacc

SEQ ID NO: 354932 - RNA, 62 nt, Human
uuagcauggggcuagauuaaugaagcugggcugaggccaacuuauggcagagggcggcgccu

SEQ ID NO: 354933 - RNA, 62 nt, Human
cccaccccuacacacacacucccugcuugcaggaggccaaacugucccucccuugcugaaca

SEQ ID NO: 354934 - RNA, 62 nt, Human
auguuggagauuacgucuauguggaaccugcagaggccaaccuacaaccacauaucgucugu

SEQ ID NO: 354935 - RNA, 62 nt, Human
ugcuauaaucagaauuguaauuauguucuccagaggccaauuucauuaacucugauuaauua

SEQ ID NO: 354936 - RNA, 62 nt, Human
uucacuuggaacaugaugagagauuucuuauugaggccaagagauguuuccugucccagagg

SEQ ID NO: 354937 - RNA, 62 nt, Human
aauauuuucaucuguuuacuuguagugccauagaggccaauaugcacaauauuaacuaaugc

SEQ ID NO: 354938 - RNA, 62 nt, Human
auccauggcuaaugaaagauaccaagaacauggaggccaagaaacucuccaaggaccggaug

SEQ ID NO: 354939 - RNA, 62 nt, Human
ggugacucacaccuguaauuccagcacuucaggaggccaaggugggaagaucauuugaguuc

SEQ ID NO: 354940 - RNA, 62 nt, Human
guguaugccaauuucacuggcaucuagcuuaugaggccaaauaaucccaaagugucacuuua

SEQ ID NO: 354941 - RNA, 62 nt, Human
aguggcuuacaccuauaaucccagcaauuugggaggccaaggugggcagaucacuugagguc

SEQ ID NO: 354942 - RNA, 62 nt, Human
aguggcucacgccuguaaucccagcacuuuaggaggccaaggcggguggaucaccugagguc

SEQ ID NO: 354943 - RNA, 62 nt, Human
auggcucacaccuguuaaucccagcacuucgggaggccaaggugggcaguucgcuugggccc

SEQ ID NO: 354944 - RNA, 62 nt, Human
auugcacgggagaauauacaaauagcaaaauugaggccaagggccaagagaauauccgaacu

SEQ ID NO: 354945 - RNA, 62 nt, Human
aaugggauaugccugcaggcccagcuacacgggaggccaaggcaggaggaucacuugaaauc

SEQ ID NO: 354946 - RNA, 62 nt, Human
gguggcucacgccuguaaucccagcacuuugggaggccaagguggguggaccacaugagguc

SEQ ID NO: 354947 - RNA, 62 nt, Human
gguggcucacgccugugaucccagcacuuugggaggccaagacgggcggaucaugaggucaa

SEQ ID NO: 354948 - RNA, 62 nt, Human
uucggcauuucugcaaggaggacuugaagcaagaggccaagugaggggcugcccaguucuca

SEQ ID NO: 354949 - RNA, 62 nt, Human
aguggcucaugccuauauucccugcacuuugggaggccaaagcaggaggaucgcuugagccc

SEQ ID NO: 354950 - RNA, 62 nt, Human
gguggcucaagccuguaaccccagcacuuugggaggccaaggagggaggaucacaaggucag

SEQ ID NO: 354951 - RNA, 62 nt, Human
agggacuagacaucaaagcagcguuccaaccugaggccaacccaucucaccugacacugaau

SEQ ID NO: 354952 - RNA, 62 nt, Human
gacugaugccuguaaucccaacacuuuguugggaggccaaagcaggaggauagcuugaggcc

SEQ ID NO: 354953 - RNA, 62 nt, Human
gguggcucacgccuguaaucccagcacuuuaggaggccaagguagguggaucacuugagguu

SEQ ID NO: 354954 - RNA, 62 nt, Human
gguggcucacgccuguaaucccagcccuuugggaggccaaggcggguggaucacuugagguc

SEQ ID NO: 354955 - RNA, 62 nt, Human
aguggcucaugccuguaaucccagcacuuugagaggccaagguggguagaucaucugagguc

SEQ ID NO: 354956 - RNA, 62 nt, Human
auaugauugcacuaaauaaacuacuuugaauagaggccaaauuaaucuuuuaaaaaugauga

SEQ ID NO: 354957 - RNA, 62 nt, Human
gguggcucacaccuauaaucccaacacuuucggaggccaaggagggacaaacgaacccuuga

SEQ ID NO: 354958 - RNA, 62 nt, Human
ccuggcacacaaggaggcgaggcuaugcguucgaggccaaccuaggcaaaauuggaaaaaaa

SEQ ID NO: 354959 - RNA, 62 nt, Human
ccuuuauuuuuccucauuucucaugggcaacagaggccaaagaaacgaagcaagacaaacag

SEQ ID NO: 354960 - RNA, 62 nt, Human
gagcguguuuuauaaaaaacucacagguguuugaggccaaaacagauuuuagacuuaccuug

SEQ ID NO: 354961 - RNA, 62 nt, Human
gcagcuuaugucuauaaucccagcacuuuugagaggccaaggcaggaggauugcuugaguuc

SEQ ID NO: 354962 - RNA, 62 nt, Human
gguggcucaugccuguaaucccagcacuuugggaggccaagguaggcagaucaccugagguc

SEQ ID NO: 354963 - RNA, 62 nt, Human
gguggcucacaccuguaauccaagcacuuugggaggccaaggugggagcaucacuugauccu

SEQ ID NO: 354964 - RNA, 62 nt, Human
uguuugucacuaguuuuucauuauuaaaugcugaggccaauaccaagaaguuuauuuucuau

SEQ ID NO: 354965 - RNA, 62 nt, Human
aguggcgcacaccugcaaucccaacacuuugggaggccaagagaggaagauugcuugagccc

SEQ ID NO: 354966 - RNA, 62 nt, Human
guggccugacaccugcaaucccaacauuuugggaggccaaggugggagggucccuuccuuga

SEQ ID NO: 354967 - RNA, 62 nt, Human
aguggcucauuccuguaaucccagcacuuugggaggccaaggcgggcagaucaccuuagguc

SEQ ID NO: 354968 - RNA, 62 nt, Human
cccaucaguuguccuuacuuagaggagacagagaggccaaucaggucccagagcuugaaugc

SEQ ID NO: 354969 - RNA, 62 nt, Human
aguggcucacaccuguaaucccagcacuuugggaggccaaaguggguggaucacuugaggag

SEQ ID NO: 354970 - RNA, 62 nt, Human
aguggcucaugccuauaaucccagcacuuugggaggccaaggugggcggaucaccugagcuc

SEQ ID NO: 354971 - RNA, 62 nt, Human
aaacuagcuuugcucuuuagaugcaaguggcugaggccaauaggugccuaguaaauguuaac

SEQ ID NO: 354972 - RNA, 62 nt, Human
gguggcucaugccuguaaucccaacacuuugggaggccaaggaggguggaucacuuaagguc

SEQ ID NO: 354973 - RNA, 62 nt, Human
uguuugaggggggcacucagucacauguggcugaggccaaagagaaugaagauauauuuuaa

SEQ ID NO: 354974 - RNA, 62 nt, Human
guagcucacguccuauagucgcagcacuuugggaggccaaggugggcaguucacgugaggug

SEQ ID NO: 354975 - RNA, 62 nt, Human
gaauggucucccucuccccagcccagguacaugaggccaaggugaacugugcauccugagac

SEQ ID NO: 354976 - RNA, 62 nt, Human
ucgaugagauaauaugagauuucuacuucggagaggccaagucuaaugaagagaaaaaaagg

SEQ ID NO: 354977 - RNA, 62 nt, Human
ccacaugguucucccguggccccuagguggaugaggccaaagucaaauccaaggcugagaca

SEQ ID NO: 354978 - RNA, 62 nt, Human
cuccauagggacagcuuguauaauuaccuucagaggccaacugacagaauccuggcaggaac

SEQ ID NO: 354979 - RNA, 62 nt, Human
gcaggggccgugaccagcccucugccuccagggaggccaacugacucugagccaggguuccc

SEQ ID NO: 354980 - RNA, 62 nt, Human
cuagcuucccauucccagagcaaggcaggcgggaggccaaggacuggacuuggcuuauuucu

SEQ ID NO: 354981 - RNA, 62 nt, Human
ucccacugagucacagguuugagauucccagagaggccaaagacagcuacaggaaguacccu

SEQ ID NO: 354982 - RNA, 57 nt, Human
uuaagcccugcgucaugugaacggaaagaggccaagcgauggccgcucucuccucuc

SEQ ID NO: 354983 - RNA, 62 nt, Human
gguggcucacaccuguaaucccaacacuuugggaggccaaggcagguagaucacuugaugcc

SEQ ID NO: 354984 - RNA, 62 nt, Human
aguggcucacgccuguaaucccaacaccuugggaggccaaggcaggcagaucacgacaucag

SEQ ID NO: 354985 - RNA, 62 nt, Human
uggugguaggggccuguaacccagcuacucgugaggccaaggcaggagaauugcuugagccu

SEQ ID NO: 354986 - RNA, 62 nt, Human
ccaguuggcaccagaugcuguggacuuggaaugaggccaacaggguucaccaggaugagaga

SEQ ID NO: 354987 - RNA, 62 nt, Human
auaaaaucacuggguuccacaucagccuccaugaggccaagccuuguaccugcaaggcucuu

SEQ ID NO: 354988 - RNA, 62 nt, Human
uccauggagucaguguggaccucaugauuauagaggccaauggaacuggucagugauucucu

SEQ ID NO: 354989 - RNA, 62 nt, Human
agaugauagacuucaagugaaugucagccuaagaggccaagcugcagaucguggcaacagau

SEQ ID NO: 354990 - RNA, 62 nt, Human
acaaaggggacccuggauaggcugcaaggaaagaggccaagggccaagcugcuaagccaaag

SEQ ID NO: 354991 - RNA, 62 nt, Human
gguggcucacgccuguaaucccagcacuuugggaggccaaggcgggcagaccaugaggucag

SEQ ID NO: 354992 - RNA, 62 nt, Human
aguggcucauaccuguaaugccagcacuuugggaggccaaggcgggcagaucacgaggucag

SEQ ID NO: 354993 - RNA, 62 nt, Human
guugaugcuuccccagggucccccuggcuggggaggccaagaauagggaagggacuuguagc

SEQ ID NO: 354994 - RNA, 62 nt, Human
ggugacucacaccuauaaucccaauacuuugggaggccaaggcaggaggauugcuugagguc

SEQ ID NO: 354995 - RNA, 62 nt, Human
uguauuaaguaaaagucuguaaauauguuaaugaggccaauuuuuccagcauuuauaauuau

SEQ ID NO: 354996 - RNA, 62 nt, Human
ugccagguaaagaaaccauggcauaaagcugggaggccaaacacccaagcacaaacugucgu

SEQ ID NO: 354997 - RNA, 62 nt, Human
aguggcucacaccuguaaucccagcacuuugggaggccaaggcgagcggaucaugaggucag

SEQ ID NO: 354998 - RNA, 62 nt, Human
gguggcucacgccuguaauccuagcacuuugggaggccaaguugggcagaucacaaguucaa

SEQ ID NO: 354999 - RNA, 62 nt, Human
gcucacgccuguaaucccagcacuuacuuugggaggccaaggugggcagauaaccugcgguc

SEQ ID NO: 355000 - RNA, 62 nt, Human
gguggcucacgccuguaauuccagugcuuugggaggccaagaugggaggaucauuugagccc

SEQ ID NO: 355001 - RNA, 62 nt, Human
ccacagagccauccugcccugacagcuagcaagaggccaagacccacagaacaaccacuaca

SEQ ID NO: 355002 - RNA, 62 nt, Human
aggccacaucuaagaaguaaagagcuuuccgggaggccaauuuggaaagaacccaaaggcuc

SEQ ID NO: 355003 - RNA, 62 nt, Human
cacuuugggaggccaaggggacaggacugcuugaggccaagagguggaaaccaucuugggcu

SEQ ID NO: 355004 - RNA, 62 nt, Human
aguggcucauuccuguaaucccagcacuuugggaggccaaggggacaggacugcuugaggcc

SEQ ID NO: 355005 - RNA, 62 nt, Human
ucccucuucccaccccugcaguccucugaagagaggccaacagccuuccccugccuuggauu

SEQ ID NO: 355006 - RNA, 62 nt, Human
guugggaaagcucuguagagcaugguuccagugaggccaagauugaaauuugauacuaaaaa

SEQ ID NO: 355007 - RNA, 62 nt, Human
ucccaaguuuaauuagauuucugaaucucguugaggccaaggaaugauccauacugaaaaaa

SEQ ID NO: 355008 - RNA, 62 nt, Human
uucccacaugcugaagcgaggacuagaggcuggaggccaagcagcugagccaaagaagauca

SEQ ID NO: 355009 - RNA, 62 nt, Human
gaagauuuucagguuuuaauaacgcagucauggaggccaagaacuugcaauaccaauguucu

SEQ ID NO: 355010 - RNA, 62 nt, Human
gaagauuuucagguuuuaauaaagcagcuauggaggccaagaacaugccagaccaauauucu

SEQ ID NO: 355011 - RNA, 62 nt, Human
ggaggcucaugccuguaaucccagcacuuugggaggccaaggugggcggaucacgaggucag

SEQ ID NO: 355012 - RNA, 62 nt, Human
agugccucaugccuauaaucccagcacuuugggaggccaagguggguggaucacuugaguuc

SEQ ID NO: 355013 - RNA, 62 nt, Human
uccuucuuggucagagguagcugcagaggggggaggccaaggguuuggucuaagcugugccc

SEQ ID NO: 355014 - RNA, 62 nt, Human
ugacgauggcugggggccagguguuucuguuagaggccaaguauuauugacacaggauugca

SEQ ID NO: 355015 - RNA, 62 nt, Human
gcuggcucacaucuguaaugccagcacuuugggaggccaagguggguggaucaccugagggc

SEQ ID NO: 355016 - RNA, 62 nt, Human
cuugggugcgugggagggcgcacaucagggcagaggccaaguuccaggugucuguguuccca

SEQ ID NO: 355017 - RNA, 62 nt, Human
aguggcucaugccuauaaucuuagcacuuugggaggccaagguaggaggauugcuugaagcu

SEQ ID NO: 355018 - RNA, 62 nt, Human
cauucugggaagaaaaaaaaaacauuaaugaagaggccaauaauaugaagggaaucauggau

SEQ ID NO: 355019 - RNA, 62 nt, Human
uagggcacaaagauggauguaaugcacuuugggaggccaaggcgggaggauugcuugagccc

SEQ ID NO: 355020 - RNA, 62 nt, Human
gagccgagaccagccuuuuaccucgggguuuugaggccaacagggacgacagagacaguuuc

SEQ ID NO: 355021 - RNA, 62 nt, Human
gguggcuuacaccuguaacccuggcauuuugggaggccaaggugggcagauugccugagcuc

SEQ ID NO: 355022 - RNA, 62 nt, Human
gguggcucaccccuguaaucccagcacuuugggaggccaaggcggguggaucaugaggucag

SEQ ID NO: 355023 - RNA, 62 nt, Human
gguggcucacgccuguaaucccagcacuuugggaggccaagguggggggaucacaaggucac

SEQ ID NO: 355024 - RNA, 62 nt, Human
gguggcucaugccuauaaucccagcacuuugggaggccaaggugggcagaucaggaggucag

SEQ ID NO: 355025 - RNA, 62 nt, Human
aaacaugggugguaacaagaguuccaucccaggaggccaaacggugcaacagaaggguaggu

SEQ ID NO: 355026 - RNA, 62 nt, Human
acaauaaagccggggccgagcagcuggcaggggaggccaaucccucccuccccuccccaguc

SEQ ID NO: 355027 - RNA, 62 nt, Human
gauggcucaccccuguaaucccagcacuuugugaggccaaggugggcggaucacuugaggcc

SEQ ID NO: 355028 - RNA, 50 nt, Human
cuguaaucccagcauuuuaggaggccaaggcaggaggaucacuuggagcc

SEQ ID NO: 355029 - RNA, 62 nt, Human
ggucgcucaugccuguaaucccagcacuuugggaggccaaggcaggcagaucacuugagguc

SEQ ID NO: 355030 - RNA, 62 nt, Human
gguaauguucaccugcagucccagcuacuugggaggccaaggcacgagaauugcuugaacaa

SEQ ID NO: 355031 - RNA, 62 nt, Human
agcucacgcccagagacugggcugcucucccggaggccaaacccaagaaggucuggcaaagu

SEQ ID NO: 355032 - RNA, 62 nt, Human
aguggcgcaugccuguaaucccagaacuuugggaggccaagacgggaugauugcuugagcuc

SEQ ID NO: 355033 - RNA, 62 nt, Human
gguggcgggcgccuauaauccuagcuacuagggaggccaaggugggagaucgcuuaaaccca

SEQ ID NO: 355034 - RNA, 62 nt, Human
gguggcucacgccuauaaucccagcacuuugggaggccaaggcaggcagaucauuugagauc

SEQ ID NO: 355035 - RNA, 62 nt, Human
cccucccucaccuguuauaaaaaauucgcugggaggccaauaggcugaaauggcuccugcac

SEQ ID NO: 355036 - RNA, 62 nt, Human
agugccucaugccuguaaucccagcacuuugggaggccaaggugggaggaucguuugagccc

SEQ ID NO: 355037 - RNA, 62 nt, Human
gguggcucacacuuguaaucccagcacuuugggaggccaaggugggcggaucaugaggucag

SEQ ID NO: 355038 - RNA, 62 nt, Human
gacggugcacaccucuagucccagcuacucgggaggccaagacagaaggaucaccuugaggc

SEQ ID NO: 355039 - RNA, 62 nt, Human
gucuacaauucccaaaagaccucuuacuuugggaggccaaggugggugggucacuugaaccc

SEQ ID NO: 355040 - RNA, 62 nt, Human
cugcaugguugcauuuucaucacugaaagucagaggccaaggaaaucauuucuacuucuuua

SEQ ID NO: 355041 - RNA, 62 nt, Human
cguggcacacaccuguaaucccagcuauuugggaggccaaggcaggagaauugccugaaccc

SEQ ID NO: 355042 - RNA, 51 nt, Human
aaugcugcaaaaagccaugaggaggccaagaagcugcuguggcugaugcgg

SEQ ID NO: 355043 - RNA, 62 nt, Human
gcuguauaacuccuugccaugcaaacucucaagaggccaauauauuccuggccauguuugaa

SEQ ID NO: 355044 - RNA, 62 nt, Human
gguggcuuacgccuguaaucccagcacuuugggaggccaaggcgggcggaucaugaggucag

SEQ ID NO: 355045 - RNA, 62 nt, Human
ucuggggagucggauucaggaaacacccccaggaggccaagccugaaaacagaggggaggga

SEQ ID NO: 355046 - RNA, 62 nt, Human
gguggcucacaccuguaaucccagcacuuugggaggccaaggcaggcggaucaccugagguu

SEQ ID NO: 355047 - RNA, 62 nt, Human
uccagcaguauuuuaaguggggaaugcaacgugaggccaacugaacaauuccccccguggcu

SEQ ID NO: 355048 - RNA, 62 nt, Human
gguggcucacaccuguaaucccagcacuuugggaggccaauguggguggaucaugaggucag

SEQ ID NO: 355049 - RNA, 62 nt, Human
uggcucaugccuauaaaauuccagcacuuugggaggccaaggcaggaggaucacuugagccu

SEQ ID NO: 355050 - RNA, 62 nt, Human
ucucuuuaucacuaacuuggauugaaaugagugaggccaacucacauucccaucaaacacuc

SEQ ID NO: 355051 - RNA, 62 nt, Human
ccuccagguaccaccccauccuccggcugcaggaggccaagccgcagagguccgcgaggucc

SEQ ID NO: 355052 - RNA, 62 nt, Human
ugaagguugcugucugucaugagugcaugaaggaggccaagaguuuaugcuaugggaggaaa

SEQ ID NO: 355053 - RNA, 56 nt, Human
aggaagaggccuccagguaaagccuagaggccaaagaacuuuccaggucagccgga

SEQ ID NO: 355054 - RNA, 62 nt, Human
gguggcucccgccuguaaucucagcacuuugggaggccaaggcaggcaaucaccugagggca

SEQ ID NO: 355055 - RNA, 62 nt, Human
gguagcaggcaccuguagucuuagcuacucgagaggccaaagaaggaggauggcuugagccc

SEQ ID NO: 355056 - RNA, 62 nt, Human
agugaaucaaagugucuagacauauuugcauagaggccaagguauucuauucuaauaacugc

SEQ ID NO: 355057 - RNA, 62 nt, Human
aaauuuuucccaguguucugauaugugacuuugaggccaaugagucauaaacaaauauaaga

SEQ ID NO: 355058 - RNA, 62 nt, Human
gauggacacuguauaauuugguuaagacugcugaggccaagugcuauuuuguuacaagaaag

SEQ ID NO: 355059 - RNA, 62 nt, Human
gguggcucacaccuguaaucccagcacuuuuggaggccaagguggguggaucaccugagguc

SEQ ID NO: 355060 - RNA, 62 nt, Human
aguggcucacgccuguaaucccaacacuuugggaggccaaggaggguggaucaccugagguc

SEQ ID NO: 355061 - RNA, 62 nt, Human
acuuuuauuuaaauuaauauacguagauaccagaggccaagccacagagaggauaauaguuc

SEQ ID NO: 355062 - RNA, 62 nt, Human
gguggcucaugccuauaaucccagcacuuugggaggccaaggcagguggaucaccugagguc

SEQ ID NO: 355063 - RNA, 62 nt, Human
aauggcucaugccuguaaucccaacacuuugggaggccaaggugggaggauggcuugugucc

SEQ ID NO: 355064 - RNA, 62 nt, Human
cugggcugggcacaguggcucacacacuuugggaggccaagcgggggugcagaucaccugag

SEQ ID NO: 355065 - RNA, 62 nt, Human
ccaugggggauuuuaccccaacuccaggguucgaggccaaucugagaauggcuuaggauugc

SEQ ID NO: 355066 - RNA, 62 nt, Human
gguggcucacgccuauaaucccagcacuuagggaggccaaggcgggcagaucaccugagguc

SEQ ID NO: 355067 - RNA, 62 nt, Human
cguuuuuaacaaccuccaacacgauccauuuagaggccaaaugucauucugcaggugccuuc

SEQ ID NO: 355068 - RNA, 62 nt, Human
acugccaucagggcuguuaguggcaccuguaugaggccaagugugcguccaggggaacagca

SEQ ID NO: 355069 - RNA, 62 nt, Human
ucuccuugcuuuaagccuugauaggagacggggaggccaacccuucucugcagaccgugauc

SEQ ID NO: 355070 - RNA, 62 nt, Human
aguggcucacaccugugaucccagcacuuugggaggccaaggcagggggauuacuucagccc

SEQ ID NO: 355071 - RNA, 62 nt, Human
ccuuuuaaagggugauuaaaaucugaagcaaagaggccaaagauuggaaaccccccaccccc

SEQ ID NO: 355072 - RNA, 62 nt, Human
ucuguuaaagcaucuucauaggugcuuggugggaggccaaggucgccgaauccucgugguuu

SEQ ID NO: 355073 - RNA, 62 nt, Human
aguggcucacaccuguaaucccaacacuuugggaggccaagguggguggaucaucuaaggcc

SEQ ID NO: 355074 - RNA, 62 nt, Human
guggcuaacaccuauaauucccagcacuuugggaggccaagaugggcaaaucacuugagucu

SEQ ID NO: 355075 - RNA, 62 nt, Human
gcccagagcuccaggccagcacagaaauuccugaggccaacgucaccaaaguuagauugaau

SEQ ID NO: 355076 - RNA, 62 nt, Human
uaaaauccaauauuguaauccuagcacuuugggaggccaaggcggguggaucacaaggucaa

SEQ ID NO: 355077 - RNA, 62 nt, Human
gcuuccagaacccacccugccccucuaccugggaggccaaaugggugagugggcuggggcuu

SEQ ID NO: 355078 - RNA, 62 nt, Human
gaccccuucccugagguggcugucuccaugaggaggccaacccuugccauugaccguggcca

SEQ ID NO: 355079 - RNA, 62 nt, Human
aaaugguugcguccuuugaaccugugcaauaugaggccaaauuuaaucuuugagucuaacac

SEQ ID NO: 355080 - RNA, 62 nt, Human
aguggcucacgccuguaaucccagcacuuugggaggccaaagcagguggauuacccaaggcc

SEQ ID NO: 355081 - RNA, 62 nt, Human
aagauccaaaagaaaacagaaaacaauuccacgaggccaaucuaaagggaaaaaauccuaca

SEQ ID NO: 355082 - RNA, 62 nt, Human
gguggcacaugccuguaaucccagcacuuugggaggccaaggcugguggaucaccugagguc

SEQ ID NO: 355083 - RNA, 62 nt, Human
aaugacucaugccuguaaucccagcacguugggaggccaagucgggcggaucacaaggucag

SEQ ID NO: 355084 - RNA, 62 nt, Human
gccaguaaagaauacuucuggcagcacuuugggaggccaaggcgggcggaucacgaggucag

SEQ ID NO: 355085 - RNA, 62 nt, Human; identical to SEQ ID NO: 353604

SEQ ID NO: 355086 - RNA, 62 nt, Human
ugacgaugcugcagcgccuggagcagcugguggaggccaaguaacuggccaacaccugccuc

SEQ ID NO: 355087 - RNA, 62 nt, Human
aguuaucuugaguugcagcucuguaguuucuugaggccaaacacacuguauuuuacaaguca

SEQ ID NO: 355088 - RNA, 62 nt, Human
uggggaccagcuuggcucaggcugagcugaaagaggccaaacaggcccuccucccucccagc

SEQ ID NO: 355089 - RNA, 62 nt, Human
gguggcucauaccuguaaucccagcaguuggggaggccaaggugggaggauugcuugagccc

SEQ ID NO: 355090 - RNA, 62 nt, Human
augcugcuacgagugaccagugcuguguggaggaggccaagggcggccccugggaaaccggg

SEQ ID NO: 355091 - RNA, 62 nt, Human
gguggcucaugccuguaaucccagcuacgcaggaggccaaggcaggagaaucacuugaaccu

SEQ ID NO: 355092 - RNA, 62 nt, Human
gguggcucacgccuguaaucccagcacuuugggaggccaaggugggcagaucaugaggucag

SEQ ID NO: 355093 - RNA, 62 nt, Human
aguggcucaugccuguaauccuaacacuuugggaggccaaggugggaagauugccugagcuc

SEQ ID NO: 355094 - RNA, 62 nt, Human
guugcucacgccuguaaucccagcacuuuucagaggccaaggcgggcaaaucaccugagguc

SEQ ID NO: 355095 - RNA, 62 nt, Human
ccuggaacccuggaagggagggaggcccaugggaggccaagccugggggcugggggcgggug

SEQ ID NO: 355096 - RNA, 53 nt, Human
aguuccaagugaggacaugagaagaggccaaaauuccucaggaccaguuuguu

SEQ ID NO: 355097 - RNA, 62 nt, Human
gccgcuucagcuugcugaggacugucuccaaggaggccaaauggaaaaggagaggcuacuuc

SEQ ID NO: 355098 - RNA, 62 nt, Human
aaguaguuuuaauuucucacguuguagaaaaagaggccaaaaaggucaccuuaguuuauuuu

SEQ ID NO: 355099 - RNA, 62 nt, Human
cugaucauuggccaaagggacuuaccccuggagaggccaagugccuucuaggaaguuaggag

SEQ ID NO: 355100 - RNA, 62 nt, Human
auggggcugggggaugggccugagugagaggggaggccaagaguggccccaccuggcccucu

SEQ ID NO: 355101 - RNA, 62 nt, Human
gguggcucacgccuguaaucccagcacugugggaggccaagccaggcaaaucgcuugaggcu

SEQ ID NO: 355102 - RNA, 62 nt, Human
agggcuggcacguaaaaauccaaaaucacucagaggccaaaucuguaaaaucaaaaugaggu

SEQ ID NO: 355103 - RNA, 62 nt, Human
ugggaagauguaccuaugucaagagaagggaugaggccaaggcugccuucaauuagaagcag

SEQ ID NO: 355104 - RNA, 62 nt, Human
auggguugccccaggauccggcugccagcccugaggccaagcacggcuggagacccacgacc

SEQ ID NO: 355105 - RNA, 62 nt, Human
agggcacaaguccuggauguuguguguaucgagaggccaaaggcugguggcaagugcacggg

SEQ ID NO: 355106 - RNA, 62 nt, Human
aguggcucaugccuguaaucucagcaauuugggaggccaaggaaggaggaaugcuugagccc

SEQ ID NO: 355107 - RNA, 62 nt, Human
agucguacucuuccagguuuggaagacccagagaggccaagaucccauccuuagccauagcg

SEQ ID NO: 355108 - RNA, 62 nt, Human
caauuaagggucuucauguucuuauuuuaggagaggccaaauuguuuuuugucauuggcgug

SEQ ID NO: 355109 - RNA, 62 nt, Human
ugaagccgcgcuccccuggaagcgacccaggggaggccaaguugucagcuuuuugauccucu

SEQ ID NO: 355110 - RNA, 62 nt, Human
caguggcucaugcauguaauucuagcacuuuggaggccaaggcaggaggacugcuugagccc

SEQ ID NO: 355111 - RNA, 62 nt, Human
gguagcuuaugccuguaaucucagcacuuugggaggccaaggcaggcagaucaugaggucaa

SEQ ID NO: 355112 - RNA, 62 nt, Human
ugcagggcuggucagggugucuggggcaggaggaggccaacucacugaacuagugcagggua

SEQ ID NO: 355113 - RNA, 62 nt, Human
aaauggaguagcaucccccuggggcacuugcugaggccaagccacucacauccucacuuugc

SEQ ID NO: 355114 - RNA, 62 nt, Human
ugggccaugggcuugcuauggccagccuuacugaggccaagcagcuuaugggauguucuuua

SEQ ID NO: 355115 - RNA, 62 nt, Human
aggggcucaccccuauaaucccaggacuuugggaggccaaggcaggaggaucacuugagucc

SEQ ID NO: 355116 - RNA, 62 nt, Human
cucauccaagccaagguuggaccccuccccaagaggccaacccagugcccccucccauuuuc

SEQ ID NO: 355117 - RNA, 62 nt, Human
guuuaggcacagcuauuuauaggggaaaacaagaggccaaauauaguaauggaggugccaaa

SEQ ID NO: 355118 - RNA, 62 nt, Human
caaggcaacuccuucuuucaacguggcccagggaggccaaaagauuggacaccccugcaaac

SEQ ID NO: 355119 - RNA, 62 nt, Human
gccccucccccacagagccuccagagcuagcugaggccaacgcaggcccauccgucucuuca

SEQ ID NO: 355120 - RNA, 62 nt, Human
gggcagguccagaguccaagcccugguggguagaggccaagcagaagcccugaaguggacuc

SEQ ID NO: 355121 - RNA, 62 nt, Human
ucuugcuucuaucugggggacgcugcucgagagaggccaagaggccgcagaacaugccaggu

SEQ ID NO: 355122 - RNA, 62 nt, Human
cuaccauuuuccuuuauugugaucacuaaaaugaggccaagguuuaggaggugagaaaaagu

SEQ ID NO: 355123 - RNA, 62 nt, Human
gcuacugcacguaacacuccuccuuaggccuggaggccaagguguggguccccacgccugau

SEQ ID NO: 355124 - RNA, 62 nt, Human
gucucaccucuaggcccucugcuggugcuguggaggccaagaccccauuaagccuaaaggug

SEQ ID NO: 355125 - RNA, 62 nt, Human
aguggcucacgccuguaaucccagcacuuugggaggccaaggcggguggauuaccuccaucu

SEQ ID NO: 355126 - RNA, 62 nt, Human
accucagauggucaccaucauuccugugcucagaggccaacccaucacaggggugagauagg

SEQ ID NO: 355127 - RNA, 62 nt, Human
cuguuugaaaacuauccaguaaaaagcugauggaggccaauuacauggcggguguauugaca

SEQ ID NO: 355128 - RNA, 62 nt, Human
ggugggaccuccugcagccuggaaagaggagggaggccaaggccauucccuaacucccuccu

SEQ ID NO: 355129 - RNA, 62 nt, Human
cuuggaggacacgggguuaguccaggaccaaagaggccaauggauuuuucaaagugugcccc

SEQ ID NO: 355130 - RNA, 62 nt, Human
aagagaaaccauccucucccuucuuacaccgugaggccaagauccccucagaaggcaggagu

SEQ ID NO: 355131 - RNA, 62 nt, Human
ccgcaucccagcauugggccacccaucugagggaggccaaaaucaucacagaugcugcugug

SEQ ID NO: 355132 - RNA, 62 nt, Human
cuguacaaagugauaggaguagagcugugaaugaggccaaccagauuuccacucucucggag

SEQ ID NO: 355133 - RNA, 62 nt, Human
gagaucauaccuccccagagggaagcaggaaugaggccaaaaagugugcauuggauagggga

SEQ ID NO: 355134 - RNA, 62 nt, Human
ccagcagaagcaggguacccuuuggggagcaggaggccaauaaaaaguucagaguucauugg

SEQ ID NO: 355135 - RNA, 62 nt, Human
cugaugcacggcgagugaacaccguuggcgccgaggccaagacuuugauuuaaaagaaaaca

SEQ ID NO: 355136 - RNA, 62 nt, Human
aauggcucacgccugugaucccagcacuuugggaggccaaggcggguggaucacgaggucag

SEQ ID NO: 355137 - RNA, 62 nt, Human
auuuacaaguacuuaaaagcgugguccccagugaggccaagaaaguuuccgguuaaguucuu

SEQ ID NO: 355138 - RNA, 62 nt, Human
gguggcucacgccuguaaucccagcacuuugggaggccaaggccagcggaucacuugagguc

SEQ ID NO: 355139 - RNA, 62 nt, Human
cuucagaagaaaggacagcucagaaaaucaaagaggccaacugcccagagccacagaaaaug

SEQ ID NO: 355140 - RNA, 62 nt, Human
uuuuucugcuguuuuuuauggaugggauuugagaggccaaaggugagugggcuauuggccuu

SEQ ID NO: 355141 - RNA, 62 nt, Human
gacuucuggguacugagaagcagcagcagaaugaggccaaaugcagagaugaggcuaaggca

SEQ ID NO: 355142 - RNA, 62 nt, Human
accccguguucguguaccagccggccauccgggaggccaacgggaucguggagugcgggccc

SEQ ID NO: 355143 - RNA, 62 nt, Human
gugucuggggcuccugguacgacagaggggccgaggccaaaagugucuuccaucacuguaag

SEQ ID NO: 355144 - RNA, 62 nt, Human
cucucaaguucccccaaagccccaaagaguuggaggccaagggaaggggcagggaggggagu

SEQ ID NO: 355145 - RNA, 62 nt, Human
agccuuaguaaauuaucuuucuaaugcucugugaggccaaacauuuauguucagauugaaau

SEQ ID NO: 355146 - RNA, 62 nt, Human
uauauaguguaaauauccccacuguacuguuagaggccaacaauucuaguauggcuuguugg

SEQ ID NO: 355147 - RNA, 62 nt, Human
auuuuuauucaccuguuccgugcuauauggaggaggccaaguccauuuagugacauuucuuc

SEQ ID NO: 355148 - RNA, 62 nt, Human
gaccagcggcuuguucuagggauuuggaccuggaggccaagggcaauaggagagggucugaa

SEQ ID NO: 355149 - RNA, 62 nt, Human
aguggcucacaccuguaauccuagcacuuugggaggccaaggcagguggaucaccugagguc

SEQ ID NO: 355150 - RNA, 62 nt, Human
gugugccuucucuaguagaaugugagcucuuugaggccaaggucuauuuaauuuguuugaaa

SEQ ID NO: 355151 - RNA, 62 nt, Human
gguggcucaugccuguaaucccagcauuuugggaggccaaggcgggcggaucacuugagguc

SEQ ID NO: 355152 - RNA, 62 nt, Human
guggcucacaccuuguaaucccagcacuuugggaggccaaggugggcggaucacccugaggu

SEQ ID NO: 355153 - RNA, 62 nt, Human
gguggcucacgcauguaaucccagcacuuugggaggccaaggcagguggaucacgaggucag

SEQ ID NO: 355154 - RNA, 62 nt, Human
uuugucugguuaaaaaauaggugguagauauugaggccaagaauauugcaaaauacaugaag

SEQ ID NO: 355155 - RNA, 62 nt, Human
caaaaaagaauaaugcaaauaguugcaacuuugaggccaaucauuuuuaggcauauguuuua

SEQ ID NO: 355156 - RNA, 62 nt, Human
ggugucucaugccuauaauuccagcacuuugggaggccaaggcaggcagaucacuuugaggu

SEQ ID NO: 355157 - RNA, 62 nt, Human
uuaacuucuuguuaucaggagcccacuaugcagaggccaaaggucggcagccagcgaggcua

SEQ ID NO: 355158 - RNA, 62 nt, Human
ugaucugcccccacuguccugugaggacagcugaggccaaggagugaaaaaccuauuacuac

SEQ ID NO: 355159 - RNA, 62 nt, Human
gguggcucaugccuguaauuccagcacuuugggaggccaaggcggguggaucaccugagguc

SEQ ID NO: 355160 - RNA, 62 nt, Human
ugcauguaccacagccccccacgccccauagggaggccaagccccggaccaugcaccaggcu

SEQ ID NO: 355161 - RNA, 62 nt, Human
gguggcuuacgccuguaaucccagcacuuugggaggccaaggugggcggaucacaaggucag

SEQ ID NO: 355162 - RNA, 62 nt, Human
uguggcucaugccuguaaucccagcacuuugggaggccaaggcagguggaucaccugagguc

SEQ ID NO: 355163 - RNA, 62 nt, Human
acugaugcuuuauagguguguguagggugguagaggccaaggugcugccagcaauccuuucc

SEQ ID NO: 355164 - RNA, 62 nt, Human
cguguggggcagguguggagaagggcuuuaaggaggccaauuugcugcgcgggugaccugug

SEQ ID NO: 355165 - RNA, 62 nt, Human
gggagagagggacucaagggaaaggcaagcuugaggccaagauggcugcugccugcucaugg

SEQ ID NO: 355166 - RNA, 62 nt, Human
cacuuugggaggcugagaugggaggaucacuugaggccaagaguuugagaccaaccugggua

SEQ ID NO: 355167 - RNA, 62 nt, Human
gguggcucacgccugcagucccagcacuuugggaggccaaggcguguggaucaccugagguc

SEQ ID NO: 355168 - RNA, 62 nt, Human
ccugguuuguccccugucuugauggccuacgagaggccaaguuccacugggcugggaaaagu

SEQ ID NO: 355169 - RNA, 62 nt, Human
auucucagaacuguuacuagacucaugacuuggaggccaaaccuuaaauccagagauagcag

SEQ ID NO: 355170 - RNA, 62 nt, Human
gguggcucaccccuguaaucccagcacuuugggaggccaaagcaggcggaucaccugagguc

SEQ ID NO: 355171 - RNA, 62 nt, Human
uacgucgagauguuggaccuugaagcccuccugaggccaacaugcaaaucuggcugugacgg

SEQ ID NO: 355172 - RNA, 62 nt, Human
ucucuaguucaauggccagucauagcagaagggaggccaagcaccaguccaucaccccuccc

SEQ ID NO: 355173 - RNA, 62 nt, Human
agugaugugcaguuauagucccagcuacuugggaggccaaggcaggaggauuacuugagccc

SEQ ID NO: 355174 - RNA, 62 nt, Human
aguaugguggggucagugaccuaaaauggagugaggccaaagcacuguccuguaagucuuac

SEQ ID NO: 355175 - RNA, 62 nt, Human
ucuggaccaugagcugaguaggaaggauagcagaggccaacccugaccuuccuggaaguugu

SEQ ID NO: 355176 - RNA, 62 nt, Human
cccuggaggaggaguaccuagcacaguugcaggaggccaaggaguacuagugacgggguugc

SEQ ID NO: 355177 - RNA, 62 nt, Human
uagagagcagcgggaaaacgggcugugccugcgaggccaaguugcccacccugcggagcuag

SEQ ID NO: 355178 - RNA, 62 nt, Human
agucgcucaugccucuaaucccagcacgaugggaggccaagacaggcagaucacuugagccc

SEQ ID NO: 355179 - RNA, 62 nt, Human
gauaguggagugagaaagggaggguggagggugaggccaaaucagguccagcaaaagucagu

SEQ ID NO: 355180 - RNA, 62 nt, Human
ccugacauccuccuucaggaacacggggagcagaggccaaagcacuaaggggagggcgcaua

SEQ ID NO: 355181 - RNA, 62 nt, Human
ccuugcgccucagcaguuugcagugggguaaggaggccaagcccauuuguguaaucacccaa

SEQ ID NO: 355182 - RNA, 62 nt, Human
gguggcucaugccuguaaucccagcacuuugggaggccaagauggguggaucaccugaaguc

SEQ ID NO: 355183 - RNA, 62 nt, Human
gucucccagaugauucuaauacaggagggccagaggccaaacuugaagaacugcugguguua

SEQ ID NO: 355184 - RNA, 62 nt, Human
uuaaaagaaaaaaaacaaaagcccuggaaguugaggccaagccugcugaguauugcagcugc

SEQ ID NO: 355185 - RNA, 62 nt, Human
gagguuagggucccccacccuccaccugcccagaggccaacucuguucccuucuccuuucau

SEQ ID NO: 355186 - RNA, 62 nt, Human
caagugcagggccuguaaucccagcauuuuaggaggccaagguuggaggaucauuugagccc

SEQ ID NO: 355187 - RNA, 62 nt, Human
gauggcucacgccuguaaucccggcacuuugggaggccaagguggguggaucacuugagguc

SEQ ID NO: 355188 - RNA, 62 nt, Human
aguggcucaugccuguaauccuagcacuuugggaggccaaggcagaaagauagcuugagucc

SEQ ID NO: 355189 - RNA, 62 nt, Human
gcagcuauggcugcauagcaaguaguaggcaggaggccaaagacuucugagaccuggggcac

SEQ ID NO: 355190 - RNA, 62 nt, Human
cauuuggggaggcaaagguggaaguaucccucgaggccaagaguucaugaccagccuggucu

SEQ ID NO: 355191 - RNA, 62 nt, Human
caccagagaaccaggcuacaagagaaaaagcagaggccaagaguuugagggagaaauagucg

SEQ ID NO: 355192 - RNA, 62 nt, Human
aguggcucacgccuguaaucccagcaguuugggaggccaaggcaaguggaucaugugagguc

SEQ ID NO: 355193 - RNA, 62 nt, Human
cguggcucacucuuguaaucccaaaacuuuaggaggccaaggugggaggaucgcuugagccc

SEQ ID NO: 355194 - RNA, 62 nt, Human
agcauuuaacaaccugugaugugggcagagaugaggccaagaacggagaagggaggagcaug

SEQ ID NO: 355195 - RNA, 62 nt, Human
agcucuguccgcaaaaccaaaucugggugucagaggccaagacccuggggugggaucaggga

SEQ ID NO: 355196 - RNA, 62 nt, Human
ucuggugaggauaaugguggcuccagcgacaggaggccaacccuggagaccaagaacagggc

SEQ ID NO: 355197 - RNA, 62 nt, Human
gguggcaagcgcccuuggguccagcuacucaggaggccaaggugggaggaucacuugagccc

SEQ ID NO: 355198 - RNA, 62 nt, Human
gguggcucacgccuguacucccagcauuuugugaggccaagguggguggaucaccugagguc

SEQ ID NO: 355199 - RNA, 62 nt, Human
gggggcucacgccugucaccccagagcuuugggaggccaaggugggaggaucgcuugagacc

SEQ ID NO: 355200 - RNA, 62 nt, Human
ucuacaaaaaaaaauuaaaaagggggcuuugggaggccaaggcgggcagaucaugagggcag

SEQ ID NO: 355201 - RNA, 62 nt, Human
uaaaacuauuugagaugcacuuuuguacucaggaggccaaggcaggaggauugcuugagccc

SEQ ID NO: 355202 - RNA, 62 nt, Human
ggugguucacgccuguaaucccagcacuuugggaggccaaggaggguggaucaccugagguc

SEQ ID NO: 355203 - RNA, 62 nt, Human
ugggccugccuccccaagggcucacuaagccagaggccaaagugcccccucccguucaccua

SEQ ID NO: 355204 - RNA, 62 nt, Human
aguggcucacgccuguaaucccagcacuuugggaggccaagguggguggaucaccugagguc

SEQ ID NO: 355205 - RNA, 62 nt, Human
uauauguauuugaaaacagaguaaauacuuaagaggccaaauagaugaauggaagaauuuua

SEQ ID NO: 355206 - RNA, 62 nt, Human
ugcccacugccgaugcccaauccaggcccggugaggccaagguuucccagugagccucugcg

SEQ ID NO: 355207 - RNA, 62 nt, Human
aaaaccucuccaccugggccaggguugccucagaggccaaguuuccagaagccucuuaccug

SEQ ID NO: 355208 - RNA, 62 nt, Human
aguggcucgcgccuguaaucccagcacuuugggaggccaaggcggacggaucacuugagguu

SEQ ID NO: 355209 - RNA, 62 nt, Human
gguggcucaggccuguaauccuggcacuuugggaggccaaggugggaagaucgcuugaggcc

SEQ ID NO: 355210 - RNA, 62 nt, Human
cacuuugggaggccaaggugggaagaucgcuugaggccaagaguucaagaccagccugggca

SEQ ID NO: 355211 - RNA, 62 nt, Human
gguggcuuaccccuguaaucccagcacuuugggaggccaaagcaggacgaucacuugagccc

SEQ ID NO: 355212 - RNA, 62 nt, Human
ucaaaaaugcagugccaggagugcuaaaccuagaggccaauacugaugaccuggaaggugau

SEQ ID NO: 355213 - RNA, 62 nt, Human
gguggcucacgccuguaaccccagcacuuugggaggccaaggugggcagaucacgaggucaa

SEQ ID NO: 355214 - RNA, 62 nt, Human
caccugccuauaccccacaucccuucugccucgaggccaagaugccuaaaaaagcuaaaggc

SEQ ID NO: 355215 - RNA, 62 nt, Human
aguggcucccaccuauaauccuagcacuuugggaggccaacgcggguggauugcuugagccc

SEQ ID NO: 355216 - RNA, 62 nt, Human
gguggcaggcgccuguaaucccagcuacucgggaggccaaggcaggagaauugcucgaacuc

SEQ ID NO: 355217 - RNA, 62 nt, Human
gguggcucacgccuguaaucccagcacuuugggaggccaagccagauggaucaugaagccag

SEQ ID NO: 355218 - RNA, 62 nt, Human
gguggcucacgccuguaaucucagcacuuugggaggccaaggcaggugggucaccugggguc

SEQ ID NO: 355219 - RNA, 62 nt, Human
aguggcucacgccuauaaucccaacacuucgggaggccaaggugagaggauaacuugaaacu

SEQ ID NO: 355220 - RNA, 62 nt, Human
guucuucaagggaugaauccagagcccuccaugaggccaagcuuguccuucaaucauguuuc

SEQ ID NO: 355221 - RNA, 62 nt, Human
aggcccaggcuggcaggcaucucggcuugcaggaggccaacugcugagaccucuucuccauc

SEQ ID NO: 355222 - RNA, 62 nt, Human
ugcuuugggaagccgaagcaggaggaucacuggaggccaagaguuggagagcagacugggca

SEQ ID NO: 355223 - RNA, 62 nt, Human
cuuccugacaacaggaagaauucaaugacuaugaggccaacgacccuuggguacaacaguuc

SEQ ID NO: 355224 - RNA, 62 nt, Human
agcccaaccaacauggcagcuaacacaugaaugaggccaaucaagaccagaagaaccacuca

SEQ ID NO: 355225 - RNA, 62 nt, Human
aauauucuagaaaaccauauacugugcugguugaggccaaagguuaacauugcuccacuguu

SEQ ID NO: 355226 - RNA, 62 nt, Human
ggugauuucugugacucugggcccacagcggggaggccaagaggggcccuguggacuuucac

SEQ ID NO: 355227 - RNA, 62 nt, Human
accaggcccugcucuccuguguaggccucagagaggccaagaagggaagcuuugggcuucgg

SEQ ID NO: 355228 - RNA, 62 nt, Human
gcauccccaccaagcuccucccccagaacccugaggccaagggggccacuggcuaccccuac

SEQ ID NO: 355229 - RNA, 62 nt, Human
gguggcucacgccuguaaucccagcacuuugggaggccaaggcgggcggaucaccugagguc

SEQ ID NO: 355230 - RNA, 62 nt, Human
gguggcucacaccuguaauuccagcacuuugggaggccaaggcaggcggaucacgaggucag

SEQ ID NO: 355231 - RNA, 62 nt, Human
gaggcugaagcaggaggauugauugagccugcgaggccaaggcugcagcaggcugugauugc

SEQ ID NO: 355232 - RNA, 62 nt, Human
ccuagcuaagggauguccaaacaucagaaugugaggccaaccuucuaucagaguuaaacuuu

SEQ ID NO: 355233 - RNA, 62 nt, Human
aguggcucaccccuguaaucccagcacuuugggaggccaaggcgggucgauuacuugagguc

SEQ ID NO: 355234 - RNA, 62 nt, Human
ccuagacuagggcugccuggucagucccaggugaggccaagggcuuucuggccaucucaggg

SEQ ID NO: 355235 - RNA, 62 nt, Human
gguggcucacaccuguaaucccagcacuuugggaggccaaggcggguggaucacaaggucaa

SEQ ID NO: 355236 - RNA, 62 nt, Human
ccaugauucgcccaaagccagacagcaacggggaggccaagugcaggcuggcaccgccuucu

SEQ ID NO: 355237 - RNA, 62 nt, Human
gguggcucacaccuguaaucccagcacuuugggaggccaaggcgggcggaucagcugagguc

SEQ ID NO: 355238 - RNA, 62 nt, Human
ccacccaguuucuggaaaaaguugaugcuaaugaggccaaccgaugggcgagagguggagug

SEQ ID NO: 355239 - RNA, 62 nt, Human
auaacugucuugauacuuuucauucuuuguaagaggccaaaucgucuaaggacguugcugaa

SEQ ID NO: 355240 - RNA, 62 nt, Human
ugguggcucaugccuguaauccagcacuuugggaggccaaggcggacagaccaccugagguc

SEQ ID NO: 355241 - RNA, 62 nt, Human
gguggcucacgccuguaaucccagcacuuugggaggccaagguggguggaucacuugagguc

SEQ ID NO: 355242 - RNA, 62 nt, Human
gcgggaggggaaguggauugagaggaaagagagaggccaagacaauuuguaacuagaauccg

SEQ ID NO: 355243 - RNA, 62 nt, Human
aggugaugaaaaugacccacauuuaugaaacagaggccaauacaugcuccugccagagaggu

SEQ ID NO: 355244 - RNA, 62 nt, Human
gguggcucacaccuguaaucccagcauuuugggaggccaagguggguggaucacuugaggcc

SEQ ID NO: 355245 - RNA, 62 nt, Human
gggagaaaugcaggcaacacugagacaugggagaggccaagauaugcuugacagaaagggug

SEQ ID NO: 355246 - RNA, 62 nt, Human
gguggcucaugccuguaaucccagcacuuugggaggccaaggcggguggaucgcgagaucag

SEQ ID NO: 355247 - RNA, 62 nt, Human; identical to SEQ ID NO: 354844

SEQ ID NO: 355248 - RNA, 62 nt, Human
caccacagagggucucuagggucugcaaaauagaggccaaauccagggaccaggcccuaaua

SEQ ID NO: 355249 - RNA, 62 nt, Human
gguggcucacgccugaaaucccagcacuuugggaggccaaggugggcggaucaugaggucag

SEQ ID NO: 355250 - RNA, 62 nt, Human
ccacggcucacaccuauaaucgagcacuuugggaggccaagacaggaggaucacuugaggcc

SEQ ID NO: 355251 - RNA, 62 nt, Human
uggaagagcauuugggaaagcuggguauuauagaggccaaugaaagaugaauuugcauugua

SEQ ID NO: 355252 - RNA, 62 nt, Human
aaggggcauuuccucuccaacuuucuuccuuggaggccaaguucucacccuguccaacuauu

SEQ ID NO: 355253 - RNA, 62 nt, Human
cggagcccaaaagggugggggugggaggggcagaggccaacggaucccccugccugucgcac

SEQ ID NO: 355254 - RNA, 62 nt, Human
gucaguaucggcccggcgcagccgcggcgggcgaggccaauggaaaggagacugaggggagu

SEQ ID NO: 355255 - RNA, 62 nt, Human
cccaacccuucucuagaauccagcccagaucugaggccaagcuaugugcuagagcccaggcc

SEQ ID NO: 355256 - RNA, 62 nt, Human
ugaccccacaguggggcuggaccagggcccuggaggccaauaaagagcuuucuggguagacc

SEQ ID NO: 355257 - RNA, 62 nt, Human
acugggcagcuacccaccuggggaugggacgugaggccaagaccccagcagagaugccagaa

SEQ ID NO: 355258 - RNA, 62 nt, Human
uguggcucaugacuauaaucccagcuguuugagaggccaaugcaggaggaugguugagcuca

SEQ ID NO: 355259 - RNA, 62 nt, Human
gguggcucacgcuuguaaucccaguacuuugggaggccaaggcagucugggcaauauaguga

SEQ ID NO: 355260 - RNA, 62 nt, Human
gguggcucacgccuguaaucccagcacuuuaagaggccaaggcggauggaucacuugagccc

SEQ ID NO: 355261 - RNA, 62 nt, Human
aguggcucacgccuauaaucucagcacucugggaggccaagauggaggauugcuugaagcca

SEQ ID NO: 355262 - RNA, 62 nt, Human
gguggcucaugccuguaaucccagcacuuugggaggccaagacgggcggaucuuuugagguc

SEQ ID NO: 355263 - RNA, 62 nt, Human
gggagaaaauagaugauauugucuaugacguugaggccaaggagcuuuuuuuuuuuuuuuuu

SEQ ID NO: 355264 - RNA, 62 nt, Human
agcaccgcagcgggagccagcagggggcagcagaggccaacagggagcucgcaggccgggcc

SEQ ID NO: 355265 - RNA, 62 nt, Human
gguggcucaugccuauaauccuagcacuuugagaggccaaggugggcugaucacaaggucaa

SEQ ID NO: 355266 - RNA, 62 nt, Human
gggccagaccucacccccagugacuuccgauugaggccaaagaccccaagcugcccgccagc

SEQ ID NO: 355267 - RNA, 62 nt, Human
aguggcuuaugcuuguaaucccagcacuuugggaggccaaggcaggaggaucguuugaggcc

SEQ ID NO: 355268 - RNA, 62 nt, Human
aguggaucacgccuguaaucccagcacauugggaggccaaggcacauaggucacuugagguc

SEQ ID NO: 355269 - RNA, 62 nt, Human
guucaagcgauuccucugccucagcacuuugggaggccaaggcaggcagauaacaaagucag

SEQ ID NO: 355270 - RNA, 62 nt, Human
gguggcucacaccuguaaucccagcacuuugagaggccaaggagggaggaucgcuuaagccc

SEQ ID NO: 355271 - RNA, 62 nt, Human
gguggcucaugccuguaaucccagcacuuugggaggccaaggcagguggaucaccugagguc

SEQ ID NO: 355272 - RNA, 62 nt, Human
uggccgggcaugguguaauccuaacacuuugggaggccaaggcgggcggauugccugagcuc

SEQ ID NO: 355273 - RNA, 62 nt, Human
cacuuugggaggcugagguaggaggauugauugaggccaagaguuaaagaccagccugguca

SEQ ID NO: 355274 - RNA, 62 nt, Human
gguggcucucgccuguaaucccagcacuuugggaggccaaggcaggcggaucaccugagguc

SEQ ID NO: 355275 - RNA, 62 nt, Human
caagguuagugauccaagagaggaccaauacagaggccaaaauggcuuuuaugaccuauccu

SEQ ID NO: 355276 - RNA, 62 nt, Human
ggcuggaggcagcccccccccccacaacacuugaggccaaaggacaccccuguccccggggc

SEQ ID NO: 355277 - RNA, 62 nt, Human
uggggagggcaucccugcaaaagggaacagaagaggccaaguccccccaagccacggcccgg

SEQ ID NO: 355278 - RNA, 62 nt, Human
caggagaguuccagggggcugaggcacacagagaggccaacuuccucccugcccagccuucc

SEQ ID NO: 355279 - RNA, 62 nt, Human
aguggcucacaccuguaaucccagcacuuugggaggccaagaugggcggaucacgaggucag

SEQ ID NO: 355280 - RNA, 62 nt, Human
acccccgcacgccuguaaucccagcacuuggggaggccaaggcgggaggaucgcuugagccc

SEQ ID NO: 355281 - RNA, 62 nt, Human
agugucucaccccugucaucccagcacuuugagaggccaaggcgggcggaucacuggagguc

SEQ ID NO: 355282 - RNA, 62 nt, Human
guuggcucaugccuauagucccagcacuuugggaggccaaggugcaaggcaggcagaucauu

SEQ ID NO: 355283 - RNA, 62 nt, Human
ccccaaccccagcaaaucucuaacaccuccuagaggccaaggcuuaaacaggcaucucuacc

SEQ ID NO: 355284 - RNA, 62 nt, Human
gguggcucacaccuguaaucccugcacuuugggaggccaaggugggaggaucaguugagccc

SEQ ID NO: 355285 - RNA, 62 nt, Human
ccuacccugcucuaccgcuuuucugggucacagaggccaaaugugagagcauugaauaaaua

SEQ ID NO: 355286 - RNA, 62 nt, Human
cacuccccaaggcucgggugggggcugaggcugaggccaaaggggcuggggaggcaggccug

SEQ ID NO: 355287 - RNA, 62 nt, Human
cccgauuuggggcucgagcaaaggaaguugcugaggccaagguagccaaggucagcccugag

SEQ ID NO: 355288 - RNA, 62 nt, Human
aguggcuuccgccuguaaucccaacauuuugggaggccaaggcgggaggacugcuugaggcc

SEQ ID NO: 355289 - RNA, 62 nt, Human
gaggcaggagaauugcuugaacuugggagguggaggccaagauuguaccacuguauuccagc

SEQ ID NO: 355290 - RNA, 62 nt, Human
aguggcucacaccuguaaucucagcacuuugggaggccaaggcaggaagaucacuugagccc

SEQ ID NO: 355291 - RNA, 62 nt, Human
gguuucucacaccuguaauuccagcacgguuggaggccaaggcacauaggucacuugagguc

SEQ ID NO: 355292 - RNA, 62 nt, Human
uguggcucacgccugcaaugccagcacuuugagaggccaagacugguaggucacuggagguu

SEQ ID NO: 355293 - RNA, 62 nt, Human
ucuggcucaugccuguaaucccagcacuuugggaggccaaggugggcagaucaccugagauc

SEQ ID NO: 355294 - RNA, 62 nt, Human
ggugucucacaccuguaaucccagcacuuugagaggccaagacagguaggucacuugagguc

SEQ ID NO: 355295 - RNA, 62 nt, Human
gguggcucacaccuguaaucccaguacuuugggaggccaaggcaagcagaucaccugaaguc

SEQ ID NO: 355296 - RNA, 62 nt, Human
aguggaucaugucuguaauccuagcacugugggaggccaaggcaggaggaucgcuugagccc

SEQ ID NO: 355297 - RNA, 62 nt, Human
ggugggucacacuuguaaucccacuacuuugggaggccaaggcaggaagauugcuugagcuc

SEQ ID NO: 355298 - RNA, 62 nt, Human
aacuaaaucagauuguaaucccaguacuuugggaggccaaggcaggcugauugcuugagguc

SEQ ID NO: 355299 - RNA, 62 nt, Human
gguggcucaugccuguaaucccagcacuuugggaggccaaggcaggcggaucacaaggucag

SEQ ID NO: 355300 - RNA, 62 nt, Human
caccaagggagugugcacugugcuugcucagagaggccaaacccugcucccaggcugaagcc

SEQ ID NO: 355301 - RNA, 62 nt, Human
cuugagccagccaggcccugccaguggggaaggaggccaagcagugccugccuaugaaauuu

SEQ ID NO: 355302 - RNA, 62 nt, Human
accagcccagugcgcccugccgccgcgcuugggaggccaagcuuuaaacaucucugguuccu

SEQ ID NO: 355303 - RNA, 62 nt, Human
gccaucccgucuucuccaacaccaccucuccagaggccaaggaggccuuggaaacgauuccc

SEQ ID NO: 355304 - RNA, 62 nt, Human
caggauggcuuugcggaaaggagauggguuuggaggccaacaaaccugcuugucaauauugc

SEQ ID NO: 355305 - RNA, 62 nt, Human
cagugggugagcugggcugggcuggcuggcaugaggccaagggguaggccugagcgccagag

SEQ ID NO: 355306 - RNA, 62 nt, Human
cgguggcucacgccuguaaucccagacuuugagaggccaaggcggucacgaggucaggaguu

SEQ ID NO: 355307 - RNA, 62 nt, Human
ccccauacccggaaggaggaacgcugcacagagaggccaagaagcaucuggacagacaggcc

SEQ ID NO: 355308 - RNA, 62 nt, Human
accagaaagaggaauaaaaugauuaagugcuugaggccaaaugaguucccuugauucaaaua

SEQ ID NO: 355309 - RNA, 62 nt, Human
gguggcucaugccuauuaucccagcacuuugggaggccaagguggguggaucacuugagguc

SEQ ID NO: 355310 - RNA, 62 nt, Human
cagagggaguuccuacacacacuuuuucccuggaggccaaggucuagggguagaaaggggag

SEQ ID NO: 355311 - RNA, 62 nt, Human
ugucucuuuggaugaugccuaggcccaaaggagaggccaaaagggaaaccaaggcugcacac

SEQ ID NO: 355312 - RNA, 62 nt, Human
uguggcucacgccuguaaucccaggacuuugggaggccaaggcgggcagaucaccggagguc

SEQ ID NO: 355313 - RNA, 62 nt, Human
cuguuucccuucacggaucaauucucacuuaagaggccaauaaacaacccaacaugaaaagg

SEQ ID NO: 355314 - RNA, 62 nt, Human
aguguaaaaccaagauucccagugaagcaccugaggccaagcaggggagaggaaugagggga

SEQ ID NO: 355315 - RNA, 62 nt, Human
aaggcuccggaccacacuggcccccugcggcggaggccaacgcagggcaccaccaccaccaa

SEQ ID NO: 355316 - RNA, 62 nt, Human
cggaggcugugggcuccucaaagcuggagaaagaggccaagauuuuucugcacacggagugu

SEQ ID NO: 355317 - RNA, 62 nt, Human
cagcacugugaugggaguccacggcuagggaggaggccaagcuggccccgcagcgccucuug

SEQ ID NO: 355318 - RNA, 62 nt, Human
auuuauuaugggaauuggcucucgcaauuauggaggccaagaagucccacagucuugcauuu

SEQ ID NO: 355319 - RNA, 62 nt, Human
guggcucaugccuauaaucucagcacuuuugggaggccaagacaggaggaucacuucaggcc

SEQ ID NO: 355320 - RNA, 62 nt, Human
gguggcucacaccuguaaucucagcacuuugggaggccaaggcaggcagaucacuugagguc

SEQ ID NO: 355321 - RNA, 62 nt, Human
caccaggcaagagaguugccugcaccagguaagaggccaaagccccugggguaacagucccc

SEQ ID NO: 355322 - RNA, 62 nt, Human
aggaccccaggcccuggggaggguggcugugggaggccaaguccacugcccggaagucuugu

SEQ ID NO: 355323 - RNA, 62 nt, Human
ggugguucgugccuguaaucccagcucuuugggaggccaaggcagguagaucacaaggucag

SEQ ID NO: 355324 - RNA, 62 nt, Human
cuaccugcugggugccgucugugcguuccagugaggccaagggguccuggccggguugggga

SEQ ID NO: 355325 - RNA, 62 nt, Human
gguggcgcaugccuguaaucccagcacuuugggaggccaaggugggugaaucaccugaaguc

SEQ ID NO: 355326 - RNA, 62 nt, Human
cauggcucacaccuguaaucuuaacacugugggaggccaaggcaaggggaucacuugagccc

SEQ ID NO: 355327 - RNA, 62 nt, Human
guuaagagccucacaaggaaacuggguuauuggaggccaaggcggcuuacaguucucugcgu

SEQ ID NO: 355328 - RNA, 62 nt, Human
ggcagcucaugacuguaaucccagcacuuugggaggccaaggugggaggaucaauugaggcc

SEQ ID NO: 355329 - RNA, 62 nt, Human
gcagcagugcacauggaggagacgucucccacgaggccaaggccuccaaugcucaccgaugc

SEQ ID NO: 355330 - RNA, 62 nt, Human
ggcggcucacgcauguaaucccagcacuuugggaggccaaggcgggcggaucacgaggucag

SEQ ID NO: 355331 - RNA, 62 nt, Human
agauggccuguguguacaagggcggcuacugggaggccaaggagaagcaagacuggcauaug

SEQ ID NO: 355332 - RNA, 62 nt, Human
gacgcuuccauggugggcacugaggcacagaggaggccaaggagagguuguuuguucaugca

SEQ ID NO: 355333 - RNA, 62 nt, Human
uguaaucauugguaccauugguggccucaacagaggccaaggaguucugugagcccuggcag

SEQ ID NO: 355334 - RNA, 62 nt, Human
aguggcucaugccuguaauccgagcacuuugggaggccaaggcgggcggaucacgaggucag

SEQ ID NO: 355335 - RNA, 62 nt, Human
aguggcuuauaccuguaauuucagcacuuggggaggccaaggcaggaggcuugcuugaggca

SEQ ID NO: 355336 - RNA, 62 nt, Human
cgguggcucacgccuguaaucccagcacuuuggaggccaaggcggguggaucacgaggucag

SEQ ID NO: 355337 - RNA, 62 nt, Human
aucaccuuguagucuuuaaauucuuggucccugaggccaaguccacaacuugccuucuaguc

SEQ ID NO: 355338 - RNA, 62 nt, Human
ccaccucuccgggggacuugacaaggggcccugaggccaagggaggucacuccucccuccag

SEQ ID NO: 355339 - RNA, 62 nt, Human
aguggcacacggcuguaaucccagcacuuugggaggccaagguuggcagaucaccugagguc

SEQ ID NO: 355340 - RNA, 62 nt, Human
cguggcucacaccuguaauccuagcacauugggaggccaaggcaggcacaucaccugaguuc

SEQ ID NO: 355341 - RNA, 62 nt, Human
ggcccaggccgagggauggugccagcaggguggaggccaagucccaggcuuucaggugugug

SEQ ID NO: 355342 - RNA, 62 nt, Human
gguggcucacgccuguaaucccagcacuuugggaggccaagauggguggaucaccugagguc

SEQ ID NO: 355343 - RNA, 62 nt, Human
agggacggcaggagagcucgcggcaccuuccugaggccaagcaaggggagcaggguuagggc

SEQ ID NO: 355344 - RNA, 62 nt, Human
cccccaucacacucggccacuagugggguccugaggccaagaaagaaaccagacccuguaug

SEQ ID NO: 355345 - RNA, 62 nt, Human
acaccucccagcgugggaccccaagugaagacgaggccaaggcugaaaccauccgcaaccug

SEQ ID NO: 355346 - RNA, 62 nt, Human
ucuuuuugucccccccccaucuuacagaaguugaggccaagggagaaugguaggcacagaag

SEQ ID NO: 355347 - RNA, 62 nt, Human
accacagauuuggacaggaagggcucugagaagaggccaaagcccucauuuuacagaugagg

SEQ ID NO: 355348 - RNA, 62 nt, Human
ccagccuggagggaaggggacaaagaccccaggaggccaaagggcugcagucaccccuugug

SEQ ID NO: 355349 - RNA, 62 nt, Human
ggcuuccugccuguuuggcaaagucccaggcagaggccaaggaugaggccugacucggcucc

SEQ ID NO: 355350 - RNA, 62 nt, Human
uaugcuggcaguggugauggugacaacacaaugaggccaaguagcaaugcucccagguccug

SEQ ID NO: 355351 - RNA, 62 nt, Human
gcacguggucaacaggacuccccaagcggaaugaggccaagacuggcgcugacaccacagca

SEQ ID NO: 355352 - RNA, 62 nt, Human
uuucaaggacucaggaaauuucacuuugaacugaggccaagugagcuguuaagauaacccac

SEQ ID NO: 355353 - RNA, 62 nt, Human
gugagcaguucaggcuaucuccugauggggaugaggccaaggcuuucuuaucuuuugguugu

SEQ ID NO: 355354 - RNA, 62 nt, Human
guaugagugaaacucuggguauggucuuuccugaggccaaauuccucuuccucugagaacca

SEQ ID NO: 355355 - RNA, 62 nt, Human
acaccuucaaagucuuauugacacaguaaagggaggccaaccacuacuaacaaguucuagaa

SEQ ID NO: 355356 - RNA, 62 nt, Human
gguagcucaugcuuguaaucucaccacuuugggaggccaagaugggaggagugcuugagguu

SEQ ID NO: 355357 - RNA, 62 nt, Human
cccggaaggcguggagacacccacggaccagggaggccaagcagccgagcgagagcagcagg

SEQ ID NO: 355358 - RNA, 62 nt, Human
ugguggcucaucccuauaauccuacacuuugggaggccaaggugggcggaucacuugagcuc

SEQ ID NO: 355359 - RNA, 62 nt, Human
agugacuuacgccuguaaucucagcacuuugggaggccaaggcaggcagaucacgaggucag

SEQ ID NO: 355360 - RNA, 62 nt, Human
auuacaucaaugugcagaaagccagaggacuagaggccaagacuuguuucagaaagauggaa

SEQ ID NO: 355361 - RNA, 62 nt, Human
ugaacccuggcugaacuuuguuggcuguggaagaggccaauccuauggcagagcauucagaa

SEQ ID NO: 355362 - RNA, 62 nt, Human
guaaccuccaggagaaaacaagaugaauagcagaggccaauucaauagaaucaguuuuuuga

SEQ ID NO: 355363 - RNA, 62 nt, Human
auuuggccagauggggaaggucacuggaaauugaggccaaagggcugaucagaauugccuuu

SEQ ID NO: 355364 - RNA, 62 nt, Human
gccccccaaguggugaugcccaggcagaugccgaggccaaguggacugacccccagauuucc

SEQ ID NO: 355365 - RNA, 62 nt, Human
gguggcucacgccuguaaucccagcacuuugggaggccaaggcaggaggaucgcuggagccc

SEQ ID NO: 355366 - RNA, 62 nt, Human
agugugucaugccugcaaucccagcacuuugggaggccaaggcaggcagaucaccugagguc

SEQ ID NO: 355367 - RNA, 62 nt, Human
gguggcucacgccuguaaucccagcacuuugggaggccaaggcaggcggaucaccugagguc

SEQ ID NO: 355368 - RNA, 64 nt, Human
guuccggggcauggaagauucccagucacccacucacucagaaagccgggagucaucggacacc

SEQ ID NO: 355369 - RNA, 64 nt, Human
gggagaagaugacccguggaacacuugccuggcccacucagaauccacggugaccucuccgcuu

SEQ ID NO: 355370 - RNA, 64 nt, Human
cuuuuauggccaaaucauccuucagaguagggaacacucagacauucugugcauguuguucccc

SEQ ID NO: 355371 - RNA, 64 nt, Human
cgcgcugcuugccuuggccaagguggacgagaaccacucagaguuuacucuguacgaaucacgg

SEQ ID NO: 355372 - RNA, 64 nt, Human
cugcucugaggggagaggggugggucuccugagccacucagaugggaaagucccuuacucggcc

SEQ ID NO: 355373 - RNA, 64 nt, Human
ggauggacaggggguuuucaaaaggaacauggcucacucagagcuauaugguuagacguuucuc

SEQ ID NO: 355374 - RNA, 64 nt, Human
cccuguaacugcuuuccuuauggcccagcccggccacucagacuuguuugaagcugcacuggca

SEQ ID NO: 355375 - RNA, 64 nt, Human
auguuaaugucauugagaaacacccucacaggaacacucagaauaauguuugaccaaauagcug

SEQ ID NO: 355376 - RNA, 64 nt, Human
uaaagcaaacauagcaguuguuugccauuucuugcacucagaccuguguaauauaugcuccugg

SEQ ID NO: 355377 - RNA, 64 nt, Human
ucugggggagucuuaggaacugggaguuggucuucacucagaugccucaucuugccuuucccag

SEQ ID NO: 355378 - RNA, 64 nt, Human
cucacggcacacacacuuuguaucaugcaggccacacucagagcuagucaguacaugaacagug

SEQ ID NO: 355379 - RNA, 64 nt, Human
acuaacauaggaaacacacacauacagacacccccacucagacaguguacaaacuaagaaggcc

SEQ ID NO: 355380 - RNA, 64 nt, Human
gaccuugaauucagccuggguguucaggaaacaucacucagaacuauugauucaaaguugggua

SEQ ID NO: 355381 - RNA, 64 nt, Human
cuuugguucauccuucuuuaacaggcugcugagucacucagaaauccuucaaacaugauuaauu

SEQ ID NO: 355382 - RNA, 64 nt, Human
guuggcagcugccguacuccaggcuugugucggccacucagaugagggcuguggugcgagccag

SEQ ID NO: 355383 - RNA, 64 nt, Human
ggaugguucauuaaggacuccaccccucagagcucacucagaccccaaggacagaggugacugg

SEQ ID NO: 355384 - RNA, 64 nt, Human
agaagcaccucaacaaugucaguggcugaggcugcacucagagggaugacugcuggggguagac

SEQ ID NO: 355385 - RNA, 64 nt, Human
acugaauaucauuaauuuaaauugcuuaaguacucacucagacauuccagucucugauagcuuu

SEQ ID NO: 355386 - RNA, 64 nt, Human
acaggaucccccagagaccccauuugccucucaacacucagaccuucaacuguuuuuuaauaaa

SEQ ID NO: 355387 - RNA, 64 nt, Human
cguuacuuuucuugauaagaauuuacagauaagacacucagagagacauugugucauucucuau

SEQ ID NO: 355388 - RNA, 64 nt, Human
aggcccagcuggggcccacaugcugacacagacucacucagagacccuuagacacuggaccagg

SEQ ID NO: 355389 - RNA, 64 nt, Human
cucucagcccacucucccuguuacacacugcccacacucagagcaagaugaguugcugcuauuc

SEQ ID NO: 355390 - RNA, 64 nt, Human
uagcagggucuugugagggcugggggcauccaggcacucagaaggcaaaggaaccacccuaccc

SEQ ID NO: 355391 - RNA, 64 nt, Human
accagcucauggugugugaauguuauaaaauugucacucagauauauuuuuuaaauguaauguu

SEQ ID NO: 355392 - RNA, 64 nt, Human
cuguaccaacagaggagggaucaugaguugccaccacucagaaguuuauucuuccagacgacca

SEQ ID NO: 355393 - RNA, 64 nt, Human
gguacucuggucagcucagcuggcuguccugguucacucagaagauaagucucuccaaagcaaa

SEQ ID NO: 355394 - RNA, 64 nt, Human
guuuccugcuuaaaacccugcagguuucccaaugcacucagaaagaaauccaguuuccauggcc

SEQ ID NO: 355395 - RNA, 64 nt, Human
uccuggaagcacagcgcugagcauggggcgcucccacucagaacucuccagggaggcgaugcca

SEQ ID NO: 355396 - RNA, 64 nt, Human
aauuacuauaaauccaggaggcaaacuauuuuagcacucagauuaucugauuuaauacauauua

SEQ ID NO: 355397 - RNA, 64 nt, Human
gggccagcucuaugugguagguggaucaaauggccacucagaugaccugaguuguggagagaug

SEQ ID NO: 355398 - RNA, 64 nt, Human
gaucuaguuuaauuuuuuuuuuugcaacauaucccacucagaaacauucagguuugaagccagc

SEQ ID NO: 355399 - RNA, 64 nt, Human
ccauacuguguuggggcaaaggugucccguguagcacucagauaaguauacagcgacaauccug

SEQ ID NO: 355400 - RNA, 64 nt, Human
cacucagauuugugcccauucaggggcaauuuggcacucagauucuacucuacuucaccuaacc

SEQ ID NO: 355401 - RNA, 64 nt, Human
aauuugguuacagugugcuacggugcauuuguaacacucagauuugugcccauucaggggcaau

SEQ ID NO: 355402 - RNA, 64 nt, Human
cgaaugugagaaugccuucauuuauccuauaacucacucagagacacaugguaacacauacucc

SEQ ID NO: 355403 - RNA, 64 nt, Human
uuaaguaccaaaauugguuucagaacacugauaacacucagaaaaccacaguguguuuucauau

SEQ ID NO: 355404 - RNA, 64 nt, Human
gguauacaugaagucacauacuuuuuuaaaggaacacucagaacauucugucauuccagucaga

SEQ ID NO: 355405 - RNA, 64 nt, Human
agcuggauaauaagagaacgugccaucuguaaagcacucagaaggcagccaucccuagauguug

SEQ ID NO: 355406 - RNA, 64 nt, Human
gccugguggggaggggagagcucagcccccgacucacucagaccccaaggcccacuguccagcu

SEQ ID NO: 355407 - RNA, 64 nt, Human
ggaauucaggaaccaccucaccaaccccaucucccacucagaaaucaccucccagccucaggaa

SEQ ID NO: 355408 - RNA, 64 nt, Human
uguguaaugguuacacuaaccaaaagacaccagccacucagaguucuauacuguaaagcgcaga

SEQ ID NO: 355409 - RNA, 64 nt, Human
uaacuugacucggugucagagcauuuuaacuagccacucagaugagaauuuauguuuaacuucu

SEQ ID NO: 355410 - RNA, 64 nt, Human
cuauacgcggauccuuguuuugagcucucagaaucacucagacaacauuuuguaacugcugcug

SEQ ID NO: 355411 - RNA, 64 nt, Human
auagugaugaagaaagggaucagagucugacugucacucagaauccugggcucaguugcuugac

SEQ ID NO: 355412 - RNA, 64 nt, Human
caguggccucaagugugaugccuuacaaaagcaccacucagaugggcagcuggacucugguguc

SEQ ID NO: 355413 - RNA, 64 nt, Human
ccaugagucagagaggcuugccccaagucacagccacucagauguucgacgcccccuaaggucc

SEQ ID NO: 355414 - RNA, 64 nt, Human
accaaugaggcagaggcuugccccaagucacagccacucagaugcuuccugccccccagugccc

SEQ ID NO: 355415 - RNA, 64 nt, Human
guggauuuuuccagcagugaagggacauucucuacacucagaugacucuaccaguggccuuuua

SEQ ID NO: 355416 - RNA, 64 nt, Human
uuuugcuuaaggaaggccuuuaucaugcugaaagcacucagacaugucuguccucacagcagaa

SEQ ID NO: 355417 - RNA, 64 nt, Human
agaucuaucucucuucguagaucaagaucagcuucacucagaagaucuaggucugguucuauaa

SEQ ID NO: 355418 - RNA, 64 nt, Human
ccaaaagaccucucuuuaccaccaccacccucaucacucagaaacccuacuguuuguuagacag

SEQ ID NO: 355419 - RNA, 64 nt, Human
aggaagcagguuaaaugagaccuguccucugcugcacucagaaaaaauaggcagucccugaugc

SEQ ID NO: 355420 - RNA, 64 nt, Human
cacuuauguagacugcauuuccaaauguguugagcacucagaguguagucaacaguaaguucuu

SEQ ID NO: 355421 - RNA, 64 nt, Human
ugcuuauuuuccugugcuuuuaguuucccuucaucacucagaucuagcuccuucaacuaagaag

SEQ ID NO: 355422 - RNA, 64 nt, Human
guuacagccacagcaggaagaaccacuggagagacacucagaaggacuucccugacaucugcac

SEQ ID NO: 355423 - RNA, 64 nt, Human
gacagcuuugcgaauauuuuguaaauuacagucucacucagaacuguuuuuggacacauuuaag

SEQ ID NO: 355424 - RNA, 64 nt, Human
gaaaacccaacagauccaucccuugagcuguaaacacucagaacuccuuucauaucaagacaag

SEQ ID NO: 355425 - RNA, 64 nt, Human
aggcccaauggcccaauguacuucccccagaucccacucagaacagcagguacgcccaggcucc

SEQ ID NO: 355426 - RNA, 64 nt, Human
ccacacagcaacagcaacauacagaagauauguucacucagauaagacugcccuaaacaaccau

SEQ ID NO: 355427 - RNA, 64 nt, Human
acucaccacuacaucacuugagacaaaucuaugccacucagaaucuccuucuuuccuggacuua

SEQ ID NO: 355428 - RNA, 64 nt, Human
aagaaacaaguucucggguggggaaucuauguuucacucagauuuauauguuuggaggaaaaaa

SEQ ID NO: 355429 - RNA, 64 nt, Human
aguauguggucugaaggaccccgaccggcauggccacucagacacaaguccacaccacagcacu

SEQ ID NO: 355430 - RNA, 64 nt, Human
gcaugccccccucuucaccccacacccauguguacacucagaguccugcugccgcuccaggcug

SEQ ID NO: 355431 - RNA, 64 nt, Human
uguagcucccccaccaaagacccagcggcuucuucacucagaggccuaccugaaauacauugaa

SEQ ID NO: 355432 - RNA, 64 nt, Human
cuaaccacaccuacccagggcugccgcauuccugcacucagaagucugcagcggugccucacaa

SEQ ID NO: 355433 - RNA, 64 nt, Human
acuuauauuuaucacagugaaaggcaaaauuauucacucagaaguaauauaaauuaccucuuua

SEQ ID NO: 355434 - RNA, 64 nt, Human
caaccuuuaaauauauucuuagaccugguaaaugcacucagacuugcgucuuuaggaauuuuua

SEQ ID NO: 355435 - RNA, 64 nt, Human
cagguugcaaaauuagcuaauccuucagugccagcacucagaagucuggcaggugggggaauga

SEQ ID NO: 355436 - RNA, 64 nt, Human
uuucauuuuugguaggcuuaucaaaaucuuucagcacucagaaaagaaaaccauuuuaguuccu

SEQ ID NO: 355437 - RNA, 64 nt, Human
aaucuggcuucuagucucuuuacuguuuucguuucacucagauuagcucaguuuucucaucaaa

SEQ ID NO: 355438 - RNA, 64 nt, Human
aaguuucacagaggcuaaguggcgugccccugaucacucagauagcaaguagcuaccccaggag

SEQ ID NO: 355439 - RNA, 64 nt, Human
ucgccuuucauugugugaggucggcacuuggacucacucagaacugucgcucaccuguggcuga

SEQ ID NO: 355440 - RNA, 64 nt, Human
uggaacaagcaggaaugggauccaaagagacucccacucagauucuaaagcauuuaaagacaau

SEQ ID NO: 355441 - RNA, 64 nt, Human
ugcauucuugacauacccaguaaguaugcagggacacucagagcccauaguggauagucucuuc

SEQ ID NO: 355442 - RNA, 64 nt, Human
ucuucuuugcauccuaaggacgaaaaacacagugcacucagagcugcugaggacaaugucuggc

SEQ ID NO: 355443 - RNA, 64 nt, Human
aaaggaggcccucugaucacacgcaggacccaaacacucagaaaucaagaaccucugccuccga

SEQ ID NO: 355444 - RNA, 64 nt, Human
acaggaacggcacaggcguccaggaaagcagcugcacucagacaaugccuucuccauuacuuga

SEQ ID NO: 355445 - RNA, 64 nt, Human
agccagcucuaggcuucaggccgagccagguucacacucagaaagaggucuccccauccccauu

SEQ ID NO: 355446 - RNA, 64 nt, Human
gacuuuaagcaaugaagauugagacaauaaauagcacucagagaaugaagcauugauguuacau

SEQ ID NO: 355447 - RNA, 64 nt, Human
gaagcaagagacaugcauucuauaaucauguagacacucagacucaggggaaaauacaaguuau

SEQ ID NO: 355448 - RNA, 64 nt, Human
ccugccuuaugcaaggggaaaccugugaaagcugcacucagagggaggaguuuuucuuacauaa

SEQ ID NO: 355449 - RNA, 64 nt, Human
cauuaccaagucuaggcacauauaggaaaugcagcacucagaaugguuucaauguaguaguuga

SEQ ID NO: 355450 - RNA, 64 nt, Human
agcuagagccgcaggcacccucucacucaauuuccacucagaacccuauaaacaccagugggaa

SEQ ID NO: 355451 - RNA, 64 nt, Human
uuggggagggaaaaccuuuuuaagcaugguggggcacucagauaggagugaauacaccuaccug

SEQ ID NO: 355452 - RNA, 50 nt, Human
aaaaaaacacaacugauugacacucagaacucuuagcuguggaagaacau

SEQ ID NO: 355453 - RNA, 64 nt, Human
accugugucugacuugcuccuggaugggcacccacacucagaggcuacauauggcccuagagca

SEQ ID NO: 355454 - RNA, 64 nt, Human
acuuucccacuguuauucuuuccucauaucccaacacucagaacucuugugacauuagccagug

SEQ ID NO: 355455 - RNA, 64 nt, Human
aagugucugugugauuguaaucacauggugacaacacucagaaucuaaauuggacuucuguugu

SEQ ID NO: 355456 - RNA, 64 nt, Human
guacuuggcugguacuuaaauucguuuugucaggcacucagagaaucucauuuuguacuugguu

SEQ ID NO: 355457 - RNA, 64 nt, Human
ucuggggccagucgagagccacugagggacccagcacucagagacacaacacacauguguagcu

SEQ ID NO: 355458 - RNA, 64 nt, Human
uaggacauggccuggaccagggaggcaggccucccacucagagucugggucucacuggccccaa

SEQ ID NO: 355459 - RNA, 64 nt, Human
gcacugguuauauucaguaggaaacugaacucagcacucagaauuuuaaauuaaaucaaugauc

SEQ ID NO: 355460 - RNA, 64 nt, Human
aaguuuauguggccuauugucucaggacucucaucacucagaagccugccucugauuuacccua

SEQ ID NO: 355461 - RNA, 64 nt, Human
ccaacuccuccucuagaauuuucuaacagauuuacacucagagccuggucgccccccguuagcc

SEQ ID NO: 355462 - RNA, 64 nt, Human
acaggcgguuaugaaauucacccccuuuccuggacacucagaccugaauucuuuuucauuugag

SEQ ID NO: 355463 - RNA, 64 nt, Human
ugccucucacccuuuccccacagcgacuacuucccacucagaggcaacaaguauuacaguugcu

SEQ ID NO: 355464 - RNA, 64 nt, Human
uuuccaacuaacaucuagugagacugggauucaccacucagaauggggguccaccaugagcaac

SEQ ID NO: 355465 - RNA, 64 nt, Human
cucucagaaccccagccuugaaaauaguggggggcacucagaggggccaccuccucagccgugg

SEQ ID NO: 355466 - RNA, 64 nt, Human
uaaaaaaaaucucuacugugcaaauaucauuauucacucagacuuccauaagaguaaauaaaaa

SEQ ID NO: 355467 - RNA, 64 nt, Human
agccuaccuaacccagaaaaucugaauuggaaugcacucagacuguauaaggacaguccuauuu

SEQ ID NO: 355468 - RNA, 64 nt, Human
aaggcaauaucugcugguaagucaagcugauaaacacucagacaucuaguaccagggauuauua

SEQ ID NO: 355469 - RNA, 64 nt, Human
gaaaacaaaaacaaaccucguaagggaaguaucacacucagacaccaccgcuuccuagagccaa

SEQ ID NO: 355470 - RNA, 64 nt, Human
uuaguuucaucagaaacuuaaaacauagacugaucacucagaaauuaaaguccguuuuacugug

SEQ ID NO: 355471 - RNA, 64 nt, Human
guguuuuuuuccaacucaaugaaugacaucacugcacucagaccagaaaucuagaagucaguca

SEQ ID NO: 355472 - RNA, 64 nt, Human
uaaaagaagaaacacugccuugauuauacgaauacacucagaaaguacauuuagcuuguagugu

SEQ ID NO: 355473 - RNA, 64 nt, Human
gcaguaaacauggagacacgggggacagcguccacacucagagggccugggccacagccccgau

SEQ ID NO: 355474 - RNA, 64 nt, Human
uuaauuacuagaccucaguacugaaucaggaccucacucagaaagacuaaaggaaauguaauuu

SEQ ID NO: 355475 - RNA, 64 nt, Human
ugccuaccuccugcccaucaggcgucuacacugucacucagacaccuguggcauguggaggaga

SEQ ID NO: 355476 - RNA, 64 nt, Human
gcagguuugggagccugaggggccaucucccugacacucagaggcacugccuugcagacaccau

SEQ ID NO: 355477 - RNA, 64 nt, Human
aaugaaaaagaacaggaaauucugaauagaauugcacucagaacuuauauuaaaaauuccauuu

SEQ ID NO: 355478 - RNA, 64 nt, Human
uaggguuaggauuuucaaagaauggagguugcugcacucagaaaauaauucagaucauguuuau

SEQ ID NO: 355479 - RNA, 64 nt, Human
uaccugcaggaaggcaccugucacacagggcguucacucagaccaucugugcucugcccugagu

SEQ ID NO: 355480 - RNA, 64 nt, Human
auggacgggcugccccucccauuccuucaagcaucacucagagagcccuggccuggcucuaggc

SEQ ID NO: 355481 - RNA, 64 nt, Human
gagucccagcaggagcacagcccugguuuccugucacucagagcugauucacaggaggagggga

SEQ ID NO: 355482 - RNA, 64 nt, Human
cugaugaagcuggaggagucucuccucugcucuccacucagaugugggacaucagucgccaaaa

SEQ ID NO: 355483 - RNA, 64 nt, Human
gcaugaaaccucuaaguuggaaauugaagcuagccacucagagaaacuugaauugcuaaagaag

SEQ ID NO: 355484 - RNA, 64 nt, Human
uuuuuuucuucuuuuuuaaaauauucccacucagcacucagagacacaaaaauacuguaagucu

SEQ ID NO: 355485 - RNA, 64 nt, Human
gaaugcccuucugguucuggcacauuggaaagcacacucagaaggcuucaucaccaagauuuug

SEQ ID NO: 355486 - RNA, 64 nt, Human
uuuaacuaaauacaaauauaugcauuguguaauccacucagaauuaaacagacaaaagguaugc

SEQ ID NO: 355487 - RNA, 64 nt, Human
acaaaaacaccucagcagaaaugaauauaccuagcacucagaucuucgugucuaauauaguuug

SEQ ID NO: 355488 - RNA, 64 nt, Human
uaauuccaaaaugcugcaauguagcugauuuccucacucagacagcuggcuuuguggguggcuu

SEQ ID NO: 355489 - RNA, 64 nt, Human
auuguguaccgagugggauucacgagaccagcuacacucagaccaacagauggccagcccuucc

SEQ ID NO: 355490 - RNA, 64 nt, Human
aaacaccagguuuguuuguagaugucuuaggcaacacucagagcagaucucccuuacugucagg

SEQ ID NO: 355491 - RNA, 64 nt, Human
uaccacuuuuacagcgguguuucaagcggacugucacucagaucugcagagaugaauauuacuc

SEQ ID NO: 355492 - RNA, 64 nt, Human
gcaggcguucagugcugcggagccuguuaaaggucacucagaugugcagguguuaaucuucucu

SEQ ID NO: 355493 - RNA, 64 nt, Human
uuuaccaguacagcacugggcuuuauaaagacugcacucagaaccacacugcacaguccaguuu

SEQ ID NO: 355494 - RNA, 64 nt, Human
gccuguccuuguaaggcccagccuuccaggggaacacucagacauguucauucucuuccugcuu

SEQ ID NO: 355495 - RNA, 64 nt, Human
cuuguucucucaacccagucucccuucccagggccacucagaaccagaggucuuuagggccagu

SEQ ID NO: 355496 - RNA, 64 nt, Human
cugcccucuggaccugucuuucaucgggagaaaccacucagagauggaucccauucccuaaagg

SEQ ID NO: 355497 - RNA, 64 nt, Human
agguaagagacagccucccaagcccaggcuuuggcacucagaaugggcccagugggggcugggc

SEQ ID NO: 355498 - RNA, 64 nt, Human
uucacuacccaucauauucagugucccuguuccucacucagagaggaaggcagaaccagucagg

SEQ ID NO: 355499 - RNA, 64 nt, Human
gccugaggaaggccaagcugcccucccugggaaucacucagaugccccaagauguccguuggga

SEQ ID NO: 355500 - RNA, 64 nt, Human
ggggcuguuuuguaaugagaugcugcuggcaggccacucagaggcucccagcuggguugguggg

SEQ ID NO: 355501 - RNA, 64 nt, Human
ggcaggagccgggaggcacuccucccaaacacuccacucagaccauaaagcacuccuguuucac

SEQ ID NO: 355502 - RNA, 64 nt, Human
cugugcagugaagggagaggcccugggugggggacacucagagugggagcacaucccagcagug

SEQ ID NO: 355503 - RNA, 51 nt, Human
ggguggcagccccagccugaccacucagacagccgcggcccccaaggccug

SEQ ID NO: 355504 - RNA, 64 nt, Human
cagugacagcugacugagggcaaagagcaggcaccacucagaacguggugaguacagcucagcu

SEQ ID NO: 355505 - RNA, 64 nt, Human
ccuuccucacucaggaguggaaacucagaugugucacucagacucaacuugcugggacacugac

SEQ ID NO: 355506 - RNA, 64 nt, Human
agccccgacacaccacuuuccugaggcugucgcucacucagauuguccguuugcuaugccgaau

SEQ ID NO: 355507 - RNA, 64 nt, Human
aauguuuuuccgcuuugagggauguaaccacauccacucagaggacacuacuuuucugaaagcu

SEQ ID NO: 355508 - RNA, 64 nt, Human
aaaaguguagauaagcaagaaaguguuauaccaccacucagaaguaaccacuguuaacauguug

SEQ ID NO: 355509 - RNA, 64 nt, Human
cuuuuuuuuuuuaacuuccuacuuugaugauaagcacucagauauauaucagcguaaacaugaa

SEQ ID NO: 355510 - RNA, 64 nt, Human
ccccugaccuauaagccaagauaccccauaaacacacucagaaagcagagaaaaaggacaagag

SEQ ID NO: 355511 - RNA, 57 nt, Human
ccaccucugaggucaacuaaggcaggucacucagagaucaggaccagugcuucccac

SEQ ID NO: 355512 - RNA, 64 nt, Human
cacaguuggugggguccugccggagaggaagagacacucagaccagagaaggggugugcaugcg

SEQ ID NO: 355513 - RNA, 64 nt, Human
agcggggggcaucgaggggugcuuagccccagggcacucagaaacccgggcgcugccugcucug

SEQ ID NO: 355514 - RNA, 64 nt, Human
uuugcuuucauguuuguuaucuucuuuuucuguucacucagaggucaucaauuucuuucucucc

SEQ ID NO: 355515 - RNA, 64 nt, Human
gaaaaaaacacaaacauagacgauuguaccauugcacucagaagaaacaucccaggcccugagc

SEQ ID NO: 355516 - RNA, 64 nt, Human
augcccgggcaaaggcccugcuuccuggaaaggacacucagagcagcuccaagacagaggcucu

SEQ ID NO: 355517 - RNA, 64 nt, Human
gggaaaucaaaugcuaccugacucacaucuguaucacucagaaacauuauguaaaaaauaucaa

SEQ ID NO: 355518 - RNA, 64 nt, Human
uuuaagacuuaaaaggcuuacugccucuacauuucacucagacuaguacaucucaaugccagua

SEQ ID NO: 355519 - RNA, 64 nt, Human
auggagcuccaaguugucuuggacuucuacaccacacucagacuucuggaaaguuuucuguacc

SEQ ID NO: 355520 - RNA, 64 nt, Human
uugagaaauguaggcuauuuuuucaguguauauccacucagauuuuguguauuuuugauguaca

SEQ ID NO: 355521 - RNA, 64 nt, Human
uugcagcagagaaaauaaaugugccuugagagaccacucagagaggguccaagggugauggaga

SEQ ID NO: 355522 - RNA, 64 nt, Human
cugaccagcagcuuuagaaucccagcccccugaccacucagagacaugcagagauuggguuuuu

SEQ ID NO: 355523 - RNA, 64 nt, Human
acagcaucagcucaagacgucacccuccauucugcacucagaaaauggcacuugggggacuggg

SEQ ID NO: 355524 - RNA, 64 nt, Human
caacgagcaauagcagagaaugccagaagguaaucacucagauacacuugggaccaagagacag

SEQ ID NO: 355525 - RNA, 64 nt, Human
aaucuaguacaaccuuguugcuuuaggugagucacacucagaaaauggggcuugcccuggguca

SEQ ID NO: 355526 - RNA, 64 nt, Human
uggccauuagggcuggcacguaaaaauccaaaaucacucagaggccaaaucuguaaaaucaaaa

SEQ ID NO: 355527 - RNA, 64 nt, Human
cuucuaagucuucaucucagagacccugaguucccacucagacccacucagccaaaucucaugg

SEQ ID NO: 355528 - RNA, 64 nt, Human
uugcaaaggcuacuuauggccggucacaauccagcacucagacagagccaaggcaauauccucu

SEQ ID NO: 355529 - RNA, 64 nt, Human
cguguccagaaguaagccagcuguggaucccgcccacucagaaaaggcgagaaggcuuugugau

SEQ ID NO: 355530 - RNA, 64 nt, Human
cccaggaagccgugcccugcccccgugaggaugucacucagauggaaccgcaggaagcugcucc

SEQ ID NO: 355531 - RNA, 64 nt, Human
uugggauggggcucccacaccucccucagguccccacucagaccagcaccagugucugccucug

SEQ ID NO: 355532 - RNA, 64 nt, Human
agaacagccugcccugggcaccagguggcagacacacucagagcaugucuggcuuuccuggugg

SEQ ID NO: 355533 - RNA, 64 nt, Human
cuccacccccuccugucaccggccuugugacauucacucagagaagaccacaccaaggaggcgg

SEQ ID NO: 355534 - RNA, 64 nt, Human
acugcucccauuuguggggggacauuagcaacaucacucagaagccuguguucuucaagagcag

SEQ ID NO: 355535 - RNA, 64 nt, Human
cccccgccugugucagguguggaugaggucgucacacucagaaggacaggcuugucugccagcu

SEQ ID NO: 355536 - RNA, 64 nt, Human
uuaacaacucuaacccaggacagaccacaagccacacucagaggccucacugugcugggggcuu

SEQ ID NO: 355537 - RNA, 64 nt, Human
agaaagacaugguauuuguucagcagacgccgaccacucagacggaggggccccugggauuccc

SEQ ID NO: 355538 - RNA, 64 nt, Human
aaaccucacaccuagccagugcccugcucugagacacucagacuaccacccuuuccccaaguau

SEQ ID NO: 355539 - RNA, 64 nt, Human
uuuagagaauccguauugaauuugugugguaugucacucagaaagaaucguaauggguauauug

SEQ ID NO: 355540 - RNA, 64 nt, Human
gggaacaaaaggccuuugagcauauggguccagccacucagaaguguaggggccaugccuuggu

SEQ ID NO: 355541 - RNA, 64 nt, Human
ugugcacagaguggguguuccuucgagccccuuccacucagagggccacacccagcgaugccag

SEQ ID NO: 355542 - RNA, 64 nt, Human
ucacacuucuuuucucccaucccgguugcaaucucacucagacaucacaguaccaccccagggg

SEQ ID NO: 355543 - RNA, 64 nt, Human
gauuuuguggggugggaguggggagcaggaauugcacucagacaugacauuucaauucaucucu

SEQ ID NO: 355544 - RNA, 64 nt, Human
cccugagucccuaaaggcagcagcucaaggauggcacucagaucuccauggcccagcaaggcca

SEQ ID NO: 355545 - RNA, 64 nt, Human
gcaccuguggacagugggugggggcacuacuccccacucagagcacaaaugcaacuccuucccc

SEQ ID NO: 355546 - RNA, 64 nt, Human
ugucccugagucaugugggcugaauccugacuuucacucagagcaggugguuuuuuguguaggu

SEQ ID NO: 355547 - RNA, 64 nt, Human
ugggguaggucggggagaggguaagggaauagaucacucagauguauuuuagauaagcuauuua

SEQ ID NO: 355548 - RNA, 64 nt, Human
ccaguugccuuuuaggaacguaaaguccuuuaagcacucagaagccauaccucaucucucuggc

SEQ ID NO: 355549 - RNA, 64 nt, Human
aaggguaaacucaggguucccugagcuauaugcacacucagaccucuuugcuuuaccaguggug

SEQ ID NO: 355550 - RNA, 64 nt, Human
agggcacaggagcuaccuguguggacaggacuaacacucagaagccugggggccuggcuggcug

SEQ ID NO: 355551 - RNA, 64 nt, Human
uccugugaggcagacaggacagugagguugucaccacucagacuucaccuauucagcauucuuu

SEQ ID NO: 355552 - RNA, 64 nt, Human
uuccucaaugauuuuagugccuccuuuuguacuucacucagauacuaaauaguaguuuauucuu

SEQ ID NO: 355553 - RNA, 64 nt, Human
ucucuuauucaaauuguuuuuguauuaaaucaugcacucagaauuugucgagggagagaauaac

SEQ ID NO: 355554 - RNA, 64 nt, Human
acuauuuuuccuacuuugcuuuugagaaaauugacacucagacuugcccuaaucaugcacuuua

SEQ ID NO: 355555 - RNA, 64 nt, Human
cagacacuugccuauacagagacauaaccacacacacucagaggauagugaacaaaucugucuu

SEQ ID NO: 355556 - RNA, 64 nt, Human
uccuguugcuuaccaucaagucaacaguuaucagcacucagacaugcgaauguccuuuuuaguu

SEQ ID NO: 355557 - RNA, 64 nt, Human
ggcuugcagucagauucacagcuaggcacauucucacucagaccccgcucugcuggcccugcug

SEQ ID NO: 355558 - RNA, 64 nt, Human
acucagccaguggacuguggcagagaaaguccuccacucagaggcagagacugaguuaagucau

SEQ ID NO: 355559 - RNA, 64 nt, Human
ccagccccaggauggcagagggaccagaaccucccacucagacuggcccgggagguucucccag

SEQ ID NO: 355560 - RNA, 64 nt, Human
uuuuccccaguggccccuggggaugugccacugucacucagaagggcaagcuaggcagggccca

SEQ ID NO: 355561 - RNA, 64 nt, Human
uuaaggacaucccaagcccaagugguacgugccucacucagaacugacgggccgaguucuaucu

SEQ ID NO: 355562 - RNA, 64 nt, Human
aacaguacugaagaugcauaagaaaugcccaagucacucagaggacaacuacccauauuccaga

SEQ ID NO: 355563 - RNA, 64 nt, Human
ccugggauuuguuguaaggaguuuucacuggccucacucagaccaauuucugcuucaaaaagca

SEQ ID NO: 355564 - RNA, 64 nt, Human
ggguucugguguuugguuucuucauucuuuacugcacucagauuuaagccuuacaaagggaaag

SEQ ID NO: 355565 - RNA, 64 nt, Human
ucucagggaugccuaugcugcuggccuaaaaccacacucagaaacgaggaccuagaagaucccu

SEQ ID NO: 355566 - RNA, 64 nt, Human
aaaagucagguauuagcagcacuaaagcaaauaucacucagaugaaacaaagcagugaaacccc

SEQ ID NO: 355567 - RNA, 64 nt, Human
auauucacacaacacuuaggcuuaaaaaugagcucacucagaauuucuauucuuucuaaaaaga

SEQ ID NO: 355568 - RNA, 64 nt, Human
ucggcccugacgccaggccccagugggcgccucacacucagaaccucauaccccagagcaaacc

SEQ ID NO: 355569 - RNA, 64 nt, Human
cccccgaguuuggucccugggguaccgccuugcacacucagaagccuuugggaaggggugcuau

SEQ ID NO: 355570 - RNA, 64 nt, Human
ccaggccucuguccagcccuuccucagcucucaucacucagacuugguaaucccugggcuacac

SEQ ID NO: 355571 - RNA, 64 nt, Human
aagcaugagguggaguuacugugcccaaaguccucacucagaccagugccccuccaguucaguu

SEQ ID NO: 355572 - RNA, 64 nt, Human
aagcagccagauuuccaauguuguuuuuccccuccacucagaaaccccugcccuuucccuucag

SEQ ID NO: 355573 - RNA, 64 nt, Human
uucucugaccccaaggaguggcagaagaucccuucacucagagaagcaaggcugauauuagcuu

SEQ ID NO: 355574 - RNA, 64 nt, Human
cuuuuuuuuuucuuuucuggaaacauaugugagacacucagaguaaugucuacuguauccagcu

SEQ ID NO: 355575 - RNA, 64 nt, Human
ccucccugccccgacaccucgggcacaucgcaugcacucagagcacagagccgggcagacgcag

SEQ ID NO: 355576 - RNA, 64 nt, Human
acaacuuucuggaaaaacaggauacgaugacugacacucagaugcccaguaucauacguugaua

SEQ ID NO: 355577 - RNA, 64 nt, Human
gcuucaccagaagacccugcaggccaugaagagccacucagaaaaggcccauggccauggagcu

SEQ ID NO: 355578 - RNA, 51 nt, Human
ugaagaaaacucugacuuaggcacucagaggcauacacuuuuuacagaugg

SEQ ID NO: 355579 - RNA, 64 nt, Human
uacccuuauuugguuacauggcaccugagaguuucacucagaccagggaucuuccuuaggaggg

SEQ ID NO: 355580 - RNA, 64 nt, Human
cccugcagcgugacaccuuuugauugucacugaccacucagaaggggccacggccuccuggcug

SEQ ID NO: 355581 - RNA, 64 nt, Human
aggcuucugcagcccagggcacuagaacgucucacacucagagccggcuggcccgggagcuccu

SEQ ID NO: 355582 - RNA, 64 nt, Human
cgacuggaagauccaccuccccacugccuuuucucacucagauggggacaccgagguccagagg

SEQ ID NO: 355583 - RNA, 64 nt, Human
gacuuggggggcagacuugacacuaggccccacucacucagauguccugaaauuccaccacggg

SEQ ID NO: 355584 - RNA, 64 nt, Human
auugucccacagggguggcgcacagcucugggaccacucagaagaugggauguguggguggagg

SEQ ID NO: 355585 - RNA, 64 nt, Human
cugggccggauucggaccggcucuguguucacuacacucagaauagccuggcugcuucucuguc

SEQ ID NO: 355586 - RNA, 64 nt, Human
ucuccgaccagacaccuugacagggcacaccgggcacucagaagacacugaugggcaaccccca

SEQ ID NO: 355587 - RNA, 64 nt, Human
cccagaacgaacacuaggcggcaccguugguccacacucagaggcccuuggcgccaagacugca

SEQ ID NO: 355588 - RNA, 64 nt, Human
ugaguuccgggugggcgugggcucggcggggccccacucagagcagcuggccggccccaggcag

SEQ ID NO: 355589 - RNA, 64 nt, Human
cauaggcaguagccuccuccugggcuccagagggcacucagaaguugugcuaaaccaaguuaag

SEQ ID NO: 355590 - RNA, 64 nt, Human
cccuguguguacaauccaggaaaaaaacaaaccccacucagaaacagagaaaacuggggucgcg

SEQ ID NO: 355591 - RNA, 64 nt, Human
ccauugcuaacaacaugguacauuccggccccaccacucagagccuuccgaagccaacacuugu

SEQ ID NO: 355592 - RNA, 64 nt, Human
gugaggggcuccacaccaaccccaggcggaggaacacucagacagauuaaggauacuguugacc

SEQ ID NO: 355593 - RNA, 64 nt, Human
uguuccugcuuuuccccaaguacaaccacacccacacucagauccuccucauucacaucgcaga

SEQ ID NO: 355594 - RNA, 64 nt, Human
ugacauugccuacaggauuuccagaugugacuugcacucagaagaucaguggucaacuucagaa

SEQ ID NO: 355595 - RNA, 64 nt, Human
cuguacuguauugggauuguaaagaacaucucugcacucagacaguuuacagaaauaaauguuu

SEQ ID NO: 355596 - RNA, 64 nt, Human
cccaaagcugcccaguccauggggacagaaccgucacucagauccacauucaagugugcccacc

SEQ ID NO: 355597 - RNA, 64 nt, Human
uacacacacacacacacacacacacgcuuguucacacucagaacccaggacagccacagccacc

SEQ ID NO: 355598 - RNA, 64 nt, Human
acugccaucuuaguaaaaauuuugaaaggaugaccacucagaacaacucucuugaugaccauuc

SEQ ID NO: 355599 - RNA, 64 nt, Human
cacauaccuggccacgaacccacaccuccucagacacucagacaccacuccaggcucauagccc

SEQ ID NO: 355600 - RNA, 64 nt, Human
ggauggagcuggaagccauuauccuaaaugaacucacucagaaacagaaaaccaaauaccacau

SEQ ID NO: 355601 - RNA, 64 nt, Human
gagccagccagggaugagugccaucauggcucuccacucagacugugccuggccccugcacuua

SEQ ID NO: 355602 - RNA, 64 nt, Human
aacuugcaaugaaaagaaaaugugccauuuuuuucacucagaauuauucauagcuguauauuug

SEQ ID NO: 355603 - RNA, 64 nt, Human
cccggccugugcuuaaauauucuaggaguagaagcacucagacuuuuaaaacuaugagccguuu

SEQ ID NO: 355604 - RNA, 64 nt, Human
ccagcccucaaaacacaaaggaacaaagacaguccacucagacacuuauuuaauaacuguagaa

SEQ ID NO: 355605 - RNA, 64 nt, Human
guugaaauaccagggcuugugccccgcuauuccucacucagaggaagacuuugauccaggugcc

SEQ ID NO: 355606 - RNA, 64 nt, Human
uggcuauccucuuugcuucuggaaguuucugccucacucagaaugggcaggacagacccacuga

SEQ ID NO: 355607 - RNA, 64 nt, Human
ugcagcgauuccgccauugagaaugucaaggccacacucagauccuuucucgagcagcugcugc

SEQ ID NO: 355608 - RNA, 64 nt, Human
cccuuuccuccucacccaccuccaaacugacuagcacucagagggacuuaugauaaagguucag

SEQ ID NO: 355609 - RNA, 59 nt, Human
gcacacucaagcuggcuugaggacgaggccacucagaggcccccaguggggacagggag

SEQ ID NO: 355610 - RNA, 64 nt, Human
auaccaauuucaauaacaaucuugccugucauugcacucagaaucuuaagaucauguuucaaau

SEQ ID NO: 355611 - RNA, 64 nt, Human
caaaaaaagaacuuuggcugauuccuuguggugacacucagaggggucugaacagacuugacaa

SEQ ID NO: 355612 - RNA, 64 nt, Human
cacacagguagucugccacggauccagagcacggcacucagaggcgagaaacuccaucgagugu

SEQ ID NO: 355613 - RNA, 64 nt, Human
ggggugucucaucagagggaccuccacugguucccacucagaguggaggccugcagccuaccug

SEQ ID NO: 355614 - RNA, 64 nt, Human
agcagagagcucuauuuuuagaagaaauauguuacacucagaaaugaugaaaccaaaucuuaua

SEQ ID NO: 355615 - RNA, 64 nt, Human
uuuggaggaaaucagagaagugucaauggaccgucacucagacugagacuugaguuauuacaga

SEQ ID NO: 355616 - RNA, 64 nt, Human
gccagucagaggauaauauauauauucucaucagcacucagaguagucagugaagagaguagau

SEQ ID NO: 355617 - RNA, 64 nt, Human
agcgacaagcuacaggguguugcagaauucuucccacucagaagaauggcauauucguucucau

SEQ ID NO: 355618 - RNA, 64 nt, Human
gccagacauggugguguaugccuguagucccagccacucagaaggcugaggcaggaggaucgcu

SEQ ID NO: 355619 - RNA, 64 nt, Human
cacggaggcccguguccacaucagcugcagcucccacucagacagacggccugccccacagccu

SEQ ID NO: 355620 - RNA, 64 nt, Human
uuuugaauaaauaaacugaacucacaccugguaccacucagaaccuccaacugacugaaugcca

SEQ ID NO: 355621 - RNA, 64 nt, Human
gcagcuuugaccuccugggcuuaggugaucuucccacucagacuccugcguagcugggaccaca

SEQ ID NO: 355622 - RNA, 64 nt, Human
uugaugucauggagugacagaauggcuuugcuggcacucagagcuccucacuuagcuauauucu

SEQ ID NO: 355623 - RNA, 64 nt, Human
cccaaacugaacgggcucaggaaauguuccuuuacacucagaacauucuauuuuaaguauauua

SEQ ID NO: 355624 - RNA, 64 nt, Human
cccagggccugacugaggcccacgcaggaaccgacacucagacacaaggcaaagagggccacag

SEQ ID NO: 355625 - RNA, 64 nt, Human
acacugccacaauccucgggguguggucaaggggcacucagagacaccugcacuagaaauugca

SEQ ID NO: 355626 - RNA, 64 nt, Human
uuaaagggaaaacccucaggccugaggugugugccacucagagacuucaccuaacuagagacag

SEQ ID NO: 355627 - RNA, 64 nt, Human
uuuuaacagaaccccagucacaugcggcucaagucacucagaggcuguugcauuucagggcuau

SEQ ID NO: 355628 - RNA, 64 nt, Human
uguacuucauccuugcaaagagaauccuguacuucacucagaaugaaggaacaaguaucucagg

SEQ ID NO: 355629 - RNA, 64 nt, Human
ugugaguguuuacucaacaaauguuuauuggacacacucagagagagggagugugcacacgugc

SEQ ID NO: 355630 - RNA, 64 nt, Human
cuuaagacgcacuggaaaucacacaauggaacaacacucagaaaugcggaauacccuacagcaa

SEQ ID NO: 355631 - RNA, 64 nt, Human
gcaaaaauuuuugggaguaguuuagcuggggccucacucagauaccuaggacacagaguuggaa

SEQ ID NO: 355632 - RNA, 64 nt, Human
cacagacacacucugccaugucuuagcuguaggacacucagaauucuuaccuccccuaacuugc

SEQ ID NO: 355633 - RNA, 64 nt, Human
ugagacagaccgccaaauaaacggacucaguggacacucagaccagcucccagauggcccugga

SEQ ID NO: 355634 - RNA, 64 nt, Human
acggccgggugaccacucuggccugcguacuccucacucagaaacaagaacagcgacagcccuu

SEQ ID NO: 355635 - RNA, 64 nt, Human
uucaaggaaaaacccucaugccugagaugugggccacucagagcuaaccaaaauguucaacacc

SEQ ID NO: 355636 - RNA, 64 nt, Human
uucaugggaaaauccuuguaccugaugucugagccacucagaacucaccaaaauguucaacacc

SEQ ID NO: 355637 - RNA, 64 nt, Human
uucaugggaaaacccuuguaccugacaugugagccacucagaacucaccaaaauguucgacacc

SEQ ID NO: 355638 - RNA, 64 nt, Human
aauaauaaauacuggcacuuuuccuugcagaaagcacucagaccugaaucagagaaaaucauau

SEQ ID NO: 355639 - RNA, 64 nt, Human
aucaauaaauuauuauauauuuucuacuuuuaaucacucagaagauuuaaaaaacucaugagaa

SEQ ID NO: 355640 - RNA, 64 nt, Human
guuauaacaugucugaacaggguuugguuugaggcacucagauggguaagacaugaguuugaaa

SEQ ID NO: 355641 - RNA, 64 nt, Human
acguggcuuuuuuuuuuucccuuccugggucuaccacucagagaaacaauggcuaagauaccaa

SEQ ID NO: 355642 - RNA, 64 nt, Human
gucagcuuguucacuguaauuucuggaagaaguucacucagaccuuccugaauucagaucaucu

SEQ ID NO: 355643 - RNA, 58 nt, Human
acuuguucaagaauaacugauaugccuucacucagaagaaaagaaaugaaugugaaag

SEQ ID NO: 355644 - RNA, 64 nt, Human
cugugcugggccuguagagcugacaggugggucacacucagaccuggggacagaggugaaaugc

SEQ ID NO: 355645 - RNA, 64 nt, Human
agaagaaacggcacgaccccuucucaagcuggcucacucagacacauugggacaaacccuggac

SEQ ID NO: 355646 - RNA, 64 nt, Human
ggucuagagguugugggcagcauggacagucccccacucagaagugcaagaguuccaaagagcc

SEQ ID NO: 355647 - RNA, 64 nt, Human
cuuggggggaaaacagggcaugagccuucuggggcacucagauuauggacuguuaccagaucuu

SEQ ID NO: 355648 - RNA, 64 nt, Human
gcuggagaggcggcucccguguccguccaccgagcacucagauggaugcugaucaccagggccg

SEQ ID NO: 355649 - RNA, 64 nt, Human
ucucccacacggggcccugcaggcuguggauaugcacucagaggacuaagggggugcucugcaa

SEQ ID NO: 355650 - RNA, 64 nt, Human
guuaugugaccucacgugcaaagccaccaacagccacucagaaaagacgcaccagcccagaagu

SEQ ID NO: 355651 - RNA, 64 nt, Human
gggcaggaggguugggcccugcuuuccaccaagucacucagaaggucccaaucacacaugauug

SEQ ID NO: 355652 - RNA, 64 nt, Human
cccaaaacauggccugcuggcuggggagugggaacacucagagaaaggggagaucugggccugg

SEQ ID NO: 355653 - RNA, 64 nt, Human
gcugcagcgcccagccaugugggccaggugcauucacucagaguggggccacacacccaucuac

SEQ ID NO: 355654 - RNA, 64 nt, Human
gcaaaagugcuuugccaucuuaaaaaugccagaucacucagagccuaugaauguggauaucaac

SEQ ID NO: 355655 - RNA, 64 nt, Human
cccuucugcaauccucccuaccguccuccugagccacucagagcucccucacacccccucuguu

SEQ ID NO: 355656 - RNA, 64 nt, Human
uaagagaaacaagggcugguagcuguacuauuuucacucagaagcauguucauuuauguagaug

SEQ ID NO: 355657 - RNA, 64 nt, Human
caucuccaauggcugggauuuguggcagggauuccacucagaaccucucuggaauuugugccug

SEQ ID NO: 355658 - RNA, 64 nt, Human
gggcccugaccuggggugucaugaccgcugacaccacucagagcuggaaccaagaucuagauag

SEQ ID NO: 355659 - RNA, 64 nt, Human
acaugacucucauuuuauuuacagcugugcuccacacucagaaaauucccuggggucaccuucu

SEQ ID NO: 355660 - RNA, 64 nt, Human
cuggacugcacuguuguccuugcccucacauagacacucagacacccucacaaacacaguaguc

SEQ ID NO: 355661 - RNA, 64 nt, Human
gcaaauuaaaucuuguuuguugguauuuauaacucacucagaucccuuuuuuaauuguuaaauu

SEQ ID NO: 355662 - RNA, 64 nt, Human
ugaggagaaacaggcuggggccucgagaaggagucacucagacaagccauauuuuuagaaagua

SEQ ID NO: 355663 - RNA, 64 nt, Human
uugccugaggggucaggcugccucucccaacacacacucagauagcacaaauucuaccaucccc

SEQ ID NO: 355664 - RNA, 64 nt, Human
agagagugaguacaugcacacucaugugcaaacccacucagagaugcauuuggaacagugcuac

SEQ ID NO: 355665 - RNA, 64 nt, Human
cgcuaauccaauuacugugccuucuaaacggagacacucagacacuugaacucaucuuuuuaug

SEQ ID NO: 355666 - RNA, 64 nt, Human
auuuguuaugucuguuuucccuuagauguuugggcacucagaugcuaucuuggugcacacacac

SEQ ID NO: 355667 - RNA, 64 nt, Human
ccaacaggggcuccaugccagccgaccuugaccucacucagaaguccagagucuagcguagugc

SEQ ID NO: 355668 - RNA, 64 nt, Human
ggcagagcacagcggggugagagggauuccuaaucacucagagcagucugugacuuaguggaca

SEQ ID NO: 355669 - RNA, 64 nt, Human
cccccacacuccaccaaaguucucaugcacuaugcacucagaaaaauccaggcuuauuuuuuuu

SEQ ID NO: 355670 - RNA, 64 nt, Human
uugcauccaagagaaaacaccacacugugaugucaucgggaaaugaucucccaagucgcugcca

SEQ ID NO: 355671 - RNA, 64 nt, Human
cagaguuuaaagagaagcaaauuaaacauccugaaucgggaacaaaggguuuuaucuaauaaag

SEQ ID NO: 355672 - RNA, 64 nt, Human
caccagacaucgcccuggcccugcuggcccggguaucgggaaggaggagcgagggaaugacgga

SEQ ID NO: 355673 - RNA, 64 nt, Human
ucuaucuguaguaugaggcauggaauaguuuuguaucgggaauuucucagagcugaguaaaaug

SEQ ID NO: 355674 - RNA, 64 nt, Human
uguggugaugauguguauauauaugugaggauguaucgggaagauuucuaaauaaaaguuuuac

SEQ ID NO: 355675 - RNA, 64 nt, Human
agaucuaacuaugggaugggagaacuugagggugaucgggaaccuccccugcugaggguggugu

SEQ ID NO: 355676 - RNA, 64 nt, Human
gauccugcuggggauuccauuguaagcaccuauaaucgggaauuuucauguaacagcuuugaca

SEQ ID NO: 355677 - RNA, 64 nt, Human
cucaccauauuugaauuggccugaacagauguaaaucgggaaggaugggaaaaacugcagucau

SEQ ID NO: 355678 - RNA, 64 nt, Human
ugugaugugcaugggagcaacuuguucgugggucaucgggaauacuagggagaagguuucauug

SEQ ID NO: 355679 - RNA, 64 nt, Human
gaaugggugcaucaucuuucuuaauggccuaacuaucgggaaauuugagugucaguaacugugg

SEQ ID NO: 355680 - RNA, 64 nt, Human
ucuaucaucuuuuuaggucagguggagaaacacuaucgggaaauggaagagaaaucagcacuga

SEQ ID NO: 355681 - RNA, 64 nt, Human
caagcuuggcucaugggaucugcugcugcauuaaaucgggaaagaaaaugugaagauuucauuu

SEQ ID NO: 355682 - RNA, 64 nt, Human
aucuccauauguuacacuaaggguguaaguaauuaucgggaacaguguuucccauaauuuucuu

SEQ ID NO: 355683 - RNA, 64 nt, Human
guggggagauugcuuuuguuuuccugcugguaauaucgggaaagauuuuaaugaaaccagggua

SEQ ID NO: 355684 - RNA, 64 nt, Human
aaagcaugaaauugcuuucagaagaauguauaucaucgggaaaaguucgggggcagaguggggg

SEQ ID NO: 355685 - RNA, 64 nt, Human
ugaaauagaaugaauccugaaaugcaccucugggaucgggaauggucuguguguuaucagcugc

SEQ ID NO: 355686 - RNA, 64 nt, Human
caaaauaauaauuuuaagaaugaaaaauuuaaucaucgggaagaacgucccacuacagacuucc

SEQ ID NO: 355687 - RNA, 64 nt, Human
ccagguaauaauuauuuugcauuaaacucuuuuuaucgggaauaguaugauauuuucaguguca

SEQ ID NO: 355688 - RNA, 64 nt, Human
caguuaguuaguuaguuacucacucuagugauaaaucgggaaauuuacacacacacacacacac

SEQ ID NO: 355689 - RNA, 64 nt, Human
ccaggggccuggcccgccagcccaaaagauggucaucgggaagagaaaaagaaaaaaaugcugc

SEQ ID NO: 355690 - RNA, 64 nt, Human
gucagaucgcccaggugacgggccaggcgcagccaucgggaaggucauucagccaacccagagg

SEQ ID NO: 355691 - RNA, 64 nt, Human
ucgaaagcccuucuaaaaaguugaaauugcaagaaucgggaagaacaugaaaggcaguuuauaa

SEQ ID NO: 355692 - RNA, 64 nt, Human
aaaccacaucuaaaguucaagaaacuagucugucaucgggaaaaaguuucacugcuacauagga

SEQ ID NO: 355693 - RNA, 64 nt, Human
ugauucauuuggggauggaaggaaucugucccgcaucgggaauaaaauuuaugaugcaaauuug

SEQ ID NO: 355694 - RNA, 64 nt, Human
uuuuguaauuuggaaacuccaguuuuuucauauuaucgggaaauauuuuugucuaaaagaguga

SEQ ID NO: 355695 - RNA, 64 nt, Human
aagaggccauguaguauagugagcaggguugagaaucgggaaaacuagaccccugccacuaaca

SEQ ID NO: 355696 - RNA, 64 nt, Human
aagacgccuucaucugggacaaaacuggagaugcaucgggaaagaagaaacuccgaagaaaaga

SEQ ID NO: 355697 - RNA, 64 nt, Human
guucugccccuccaggugaacgcacuuaucaaggaucgggaagguuaugcuccuggcacagaau

SEQ ID NO: 355698 - RNA, 64 nt, Human
uggggccugucauugguauuuggccaaggccugcaucgggaauaaaguccagagaauuucuuuc

SEQ ID NO: 355699 - RNA, 64 nt, Human
acguacccuuaucuguuuccccuuccuugucagcaucgggaagaugguaugaaguccucuuugg

SEQ ID NO: 355700 - RNA, 64 nt, Human
ccugcaccuggccagagugucacaggcaaaaggcaucgggaagcaggagcaucuucuuggcagc

SEQ ID NO: 355701 - RNA, 64 nt, Human
gggcauucagucgcuccucucacgcggcugccuuaucgggaaggaaauuuguuugccaaauaaa

SEQ ID NO: 355702 - RNA, 64 nt, Human
uuucacacuccaucuccccgcuuuguaaauacccaucgggaagagacuuuuuuuccauggugaa

SEQ ID NO: 355703 - RNA, 64 nt, Human
accugaccucugcaagagggggcauugauacaucaucgggaaaaaacuuugcuccaggcaucac

SEQ ID NO: 355704 - RNA, 64 nt, Human
cgccugcuggaggccgccuggcugauguagggcuaucgggaagugccagggccuguguucccaa

SEQ ID NO: 355705 - RNA, 64 nt, Human
caauguaaaagaaacaaacuuuguauaauagcaaaucgggaaggggacugcuuaaaauguuaau

SEQ ID NO: 355706 - RNA, 64 nt, Human
cuuguuuacgauuucacuaggacucagaaacgagaucgggaagcagaaauauagugcaauagug

SEQ ID NO: 355707 - RNA, 64 nt, Human
agucacuccucuguucaccuuaaguaacacacaaaucgggaacaggaggacagaaccguuggca

SEQ ID NO: 355708 - RNA, 64 nt, Human
caauuugaacagagcauggaagaccuuucaguucaucgggaaagaaugagggagggagaauaag

SEQ ID NO: 355709 - RNA, 64 nt, Human
gggaggcuggcccacacagaaagguggcaagaagaucgggaagacugaguagggaaggcagggc

SEQ ID NO: 355710 - RNA, 64 nt, Human
uuccugcugcuaauaaaguaaggcccauuacuguaucgggaauuucuaguguuuccccuguaau

SEQ ID NO: 355711 - RNA, 62 nt, Human
gggaucagucuuuucuuguggaauaaauccuuggaucgggaacccugcugcucaguccccuu

SEQ ID NO: 355712 - RNA, 64 nt, Human
ccuccccacgcacuucccaggccagaauccaaacaucgggaacccuguuuucuucugggugugu

SEQ ID NO: 355713 - RNA, 64 nt, Human
caaaugcccccacuccaaguacgggugcacguucaucgggaaccaggacacuuacgagacccac

SEQ ID NO: 355714 - RNA, 64 nt, Human
aaauagcugcaccaucccaggcccugugcggagcaucgggaauacaaagaugagauaaaacauu

SEQ ID NO: 355715 - RNA, 58 nt, Human
caaugaguuuguacaaauaacuggggucaucgggaaaggcaaagaaacugaaggcaga

SEQ ID NO: 355716 - RNA, 64 nt, Human
caaagaggggauaggccugguuuccuuuguacuaaucgggaaggcugugagauuaauccagagc

SEQ ID NO: 355717 - RNA, 64 nt, Human
ugaagcggaugcuguuuggaggacaggaaaauuuaucgggaaaauuacauaaucccucugauuc

SEQ ID NO: 355718 - RNA, 64 nt, Human
uucugucuuugacuuccaauggcaaaccugggugaucgggaacaagcacguuguacccuuggcu

SEQ ID NO: 355719 - RNA, 64 nt, Human
aaaagcuucauucagaagcuccaggaggaagaagaucgggaaguaaagaagcugaugcgcaagu

SEQ ID NO: 355720 - RNA, 64 nt, Human
acacggacagucugaccuccagcaccccuuccgaaucgggaaucugcagguucacugcaucucc

SEQ ID NO: 355721 - RNA, 64 nt, Human
ucugcuucuguggccacagauucuccagcuauguaucgggaaccaugaucuauuuaugaggaga

SEQ ID NO: 355722 - RNA, 64 nt, Human
cgucuucucauuucagagcaugggcauguguuucaucgggaagaggaauuuugaacauuuccuu

SEQ ID NO: 355723 - RNA, 64 nt, Human
cuuggcggccaccccacagaaaaucacugugcugaucgggaagcccuucagugcccugccugua

SEQ ID NO: 355724 - RNA, 64 nt, Human
ggguguggcgggacggcccacaccuggguccuccaucgggaacuuuucaugcuucuuucuccac

SEQ ID NO: 355725 - RNA, 64 nt, Human
cuggaggcgggccccccuggcagcaguauuggaggggcuacaggcagcuggagaaaggggccca

SEQ ID NO: 355726 - RNA, 64 nt, Human
aguaggccaagaugaugccacugcacuccagccugggcuacagagcgagacacggucucaaaaa

SEQ ID NO: 355727 - RNA, 53 nt, Human
gugucuuccagaagaguugaugagggcuacagcuguuggggcucugccagguc

SEQ ID NO: 355728 - RNA, 64 nt, Human
caggagugccaggaccagccuguaccuugcuguggggcuacaggauggugggcaggaucucaag

SEQ ID NO: 355729 - RNA, 64 nt, Human
cuugcaaacuuucaguggugcugucccuggaugggggcuacaaaaacaagaauuggugaagauc

SEQ ID NO: 355730 - RNA, 64 nt, Human
ccccccugucuucaugcagggaaguuggaaaugggggcuacauaugcccucuccuccccgucua

SEQ ID NO: 355731 - RNA, 64 nt, Human
uucagggaguagccuuuugcggaaaaauucucuagggcuacagacagucaugugugacuucucu

SEQ ID NO: 355732 - RNA, 64 nt, Human; identical to SEQ ID NO: 58997

SEQ ID NO: 355733 - RNA, 64 nt, Human; identical to SEQ ID NO: 59002

SEQ ID NO: 355734 - RNA, 64 nt, Human; identical to SEQ ID NO: 59008

SEQ ID NO: 355735 - RNA, 53 nt, Human
gcucugggggcugcugcugaccugggcuacagaagagcucuugggacugaaug

SEQ ID NO: 355736 - RNA, 64 nt, Human
agaucgcuugagcccaggaguucaagaccagccugggcuacaugacgaaacuccaucucuauca

SEQ ID NO: 355737 - RNA, 64 nt, Human
aaaauuauauuuagaauuuuuaaacauguacaaagggcuacauuuuaauuuuaaaauagcuuca

SEQ ID NO: 355738 - RNA, 64 nt, Human
cucccuggggacggggcuccccuggacagaggcggggcuacagauugggcggggcuucucuugg

SEQ ID NO: 355739 - RNA, 64 nt, Human
ccuuggacucugccugggcuggagucuagggcuggggcuacauuuggcuucuguacuggcugag

SEQ ID NO: 355740 - RNA, 64 nt, Human
ugugggguuauuagggucucaauacuuucucaaggggcuacacuccccaucaggcagcauccca

SEQ ID NO: 355741 - RNA, 64 nt, Human
ucugccucgcuuccuggagauaguaacugagcaggggcuacaaagaggucuccugggaacccug

SEQ ID NO: 355742 - RNA, 64 nt, Human
aauauucacuggccccuacuuuguggcaaucugugggcuacaugcuggggucaaggcaguagaa

SEQ ID NO: 355743 - RNA, 64 nt, Human
uggaggcugcguccugaggaguguccugucugcugggcuacaaaccaggagcaaccgugcagcc

SEQ ID NO: 355744 - RNA, 64 nt, Human
acacuugacugcuccuagcagaugauacagcagugggcuacauacaaugagagcccugagcccu

SEQ ID NO: 355745 - RNA, 64 nt, Human
agccuuugagaauggggagaaacagccugggcuggggcuacaggucugucacuaugcucucuug

SEQ ID NO: 355746 - RNA, 64 nt, Human
gccaaugccaugacugcucaggccucaccucccagggcuacacagacccugcccaccccauccc

SEQ ID NO: 355747 - RNA, 64 nt, Human
ccugggaaaucacgcagacccaguacauccuggagggcuacagcauccuggacaacaacgcggc

SEQ ID NO: 355748 - RNA, 64 nt, Human
gggccuugaaugcuaaaaagaagcaggguacgcagggcuacauguagauaccacaccaaggcug

SEQ ID NO: 355749 - RNA, 64 nt, Human
ccuuuccccagcccaggguggacuuagaaagcaggggcuacaagagggaauccccgaaggugcu

SEQ ID NO: 355750 - RNA, 61 nt, Human
uuugugcuguggggcugguagcucaggugggcguggucacugcugucaucaauugaauggu

SEQ ID NO: 355751 - RNA, 61 nt, Human
uuagccgcgugacggacauccaggcgugggacguggucagggcagggcucauucauugccc

SEQ ID NO: 355752 - RNA, 61 nt, Human
gagagacuacaggaacuucagggucacuccccguggucacauggagguugugggccgaggc

SEQ ID NO: 355753 - RNA, 61 nt, Human
agaucauuugaggucagaaauucgagaccagcguggucaacaugguguaaccccaucucua

SEQ ID NO: 355754 - RNA, 64 nt, Human
uggggggaggggauacagauguagaagguggguagggcuacaggggugggugauuuagggacag

SEQ ID NO: 355755 - RNA, 64 nt, Human
aacauauggcaucucucaacuuuucuuccuuauggggcuacauuuguucauuuccagcaguagc

SEQ ID NO: 355756 - RNA, 64 nt, Human
acaacagauaccuucuauuuuaguugcuaauaaagggcuacacaacucaaaauagucugauuua

SEQ ID NO: 355757 - RNA, 64 nt, Human
cacagguuacucaugaugcuucugcagagacugugggcuacaccacauauguuauuuggaaaua

SEQ ID NO: 355758 - RNA, 64 nt, Human
aaucugugaccucugacaacugugaagccacccugggcuacagaaaccacagucuucccagcaa

SEQ ID NO: 355759 - RNA, 64 nt, Human
uugucaugggggcucugccaagacccucaucucugggcuacacggugauucagauugagcacca

SEQ ID NO: 355760 - RNA, 64 nt, Human
ccaccuccaauuuguacaacaguauugauacauagggcuacacucauuacuguucaaguguucu

SEQ ID NO: 355761 - RNA, 64 nt, Human
gaagcucccagaacuucguacccuuugcacacaggggcuacagcgcauuuucuaccugaaauug

SEQ ID NO: 355762 - RNA, 64 nt, Human
agugagcugagaucaugcuacugcaguccagccugggcuacagagugagacugcaucucaaaaa

SEQ ID NO: 355763 - RNA, 64 nt, Human
agaagccguauuuguacgcacaacauuaaaucaagggcuacaauucaagcacuuuuauucguau

SEQ ID NO: 355764 - RNA, 64 nt, Human
cccauagcaccccgcccuugccccaucacccugugggcuacaugcaggacacggcaugggccug

SEQ ID NO: 355765 - RNA, 64 nt, Human
cuuuagugacaaugcagcugauuuaugaaagagagggcuacacugcuauggaaacuuagcuuca

SEQ ID NO: 355766 - RNA, 64 nt, Human
cagggagcauucgggucaaauccauggacacccugggcuacaaaccaaggcugcuguucauccc

SEQ ID NO: 355767 - RNA, 64 nt, Human
ggcucaggucccaucugagccucccgaguagcuggggcuacaggugugugccacccugccagcu

SEQ ID NO: 355768 - RNA, 64 nt, Human
caugaaugcuuauuuagguuguucaaaguaaaaagggcuacaggucacagaucgucagugccug

SEQ ID NO: 355769 - RNA, 64 nt, Human
agugaggaaccaggagccgucacugaguguggcugggcuacaucauagcucaucacggagcuac

SEQ ID NO: 355770 - RNA, 64 nt, Human
cuagacuugugcugaucgugcuaaauuuucaguagggcuacaaaaccugauguuaaaauuccau

SEQ ID NO: 355771 - RNA, 64 nt, Human
gcuguccccguuccagaacuugcauacacugagcgggcuacagagcuagaaggcccugcagcua

SEQ ID NO: 355772 - RNA, 64 nt, Human
ccauagaagcuggugacauguuccuggaagcucugggcuacaccuggcaugacacuugcuuugu

SEQ ID NO: 355773 - RNA, 64 nt, Human
gguuagcccugaucugaauauaaaagugagaaaagggcuacagugcauuucuugguaacuuaaa

SEQ ID NO: 355774 - RNA, 64 nt, Human
acaaccagaaucuugaguugggcagggaaggucagggcuacagaggcucuugaggcuccgaggc

SEQ ID NO: 355775 - RNA, 64 nt, Human
ugggcauugucuuuucagagagcuuguagcacaagggcuacacaugggcgccaagaugguggua

SEQ ID NO: 355776 - RNA, 64 nt, Human
aaggcccaggaggcuuaguccagucugugcuccugggcuacaaggacccagccugagauggucc

SEQ ID NO: 355777 - RNA, 64 nt, Human
ugaauaaguugaagaccagagaaaaguacacacugggcuacaaaggaauuuggagauagccaag

SEQ ID NO: 355778 - RNA, 64 nt, Human
uuuugaaacccgaauugaaaauguugcaggcaacgggcuacagcuuuauuagugguucucuaac

SEQ ID NO: 355779 - RNA, 64 nt, Human
gcaguccuccuaccucagccucccuaauagccaggggcuacaggcauauaccaccaugcccaac

SEQ ID NO: 355780 - RNA, 64 nt, Human
cgccauucuccugccucagccuccugaguagcuggggcuacaggcgucugccaccaugcccagc

SEQ ID NO: 355781 - RNA, 64 nt, Human
gugacucagcgugugacuuguagcagcaguacgagggcuacacuccucugcugaggaugucuac

SEQ ID NO: 355782 - RNA, 64 nt, Human
ggacugcuugaggccaagagguggaaaccaucuugggcuacauagagagaccccaucucuacaa

SEQ ID NO: 355783 - RNA, 64 nt, Human
cagagacccucugccuggaggcgggccuuccccagggcuacaucugcacgccccguggugucac

SEQ ID NO: 355784 - RNA, 64 nt, Human
aucugaaugguuaaaaauacuggaagaguugucagggcuacaauagugaauguccuuuuuuuua

SEQ ID NO: 355785 - RNA, 64 nt, Human
acaaggaagugauuugcugcaccuugaguugagagggcuacauguagaaaagucuuaaaauaga

SEQ ID NO: 355786 - RNA, 64 nt, Human
uacuuccuguaaugaggacguucaacauggugaggggcuacaagaaaacgcuuuucuguacaga

SEQ ID NO: 355787 - RNA, 64 nt, Human
uuucagguaugcuuaagcauccguguauuuggcugggcuacaauuuguuaauuccuaugaaguu

SEQ ID NO: 355788 - RNA, 64 nt, Human
cuaggcuacccuccucuagaaggcugaguaccaugggcuacagugucuggccuugggaagaagu

SEQ ID NO: 355789 - RNA, 64 nt, Human
uccgugucuucaagaugaccaagcgggaggaugggggcuacaccuucacagccaccccagagga

SEQ ID NO: 355790 - RNA, 64 nt, Human
caaagugagcgcucagccuauggguuuaagcagagggcuacagaaaacagggaagagacauacc

SEQ ID NO: 355791 - RNA, 64 nt, Human
acuccagcagguggcugggcuggaaaggagggcagggcuacauccuggcucggugggaucugac

SEQ ID NO: 355792 - RNA, 64 nt, Human
gcuaaccugaccagccgcucaggacaggacccuggggcuacacuccugcauugcugcaauacug

SEQ ID NO: 355793 - RNA, 64 nt, Human
ucucuguuucuuuugucuugucuuagagaugagggggcuacagcagcaucaugcaaagagggaa

SEQ ID NO: 355794 - RNA, 64 nt, Human
uauuuauuauuaauaaaauaauaaaagaauucaugggcuacaacuagcacagggaauuuagagg

SEQ ID NO: 355795 - RNA, 64 nt, Human
gcauguuugcugauugauauuacauuuaaacuuggggcuacagcuuguuaccuagaauuuugag

SEQ ID NO: 355796 - RNA, 64 nt, Human
ugcugaugucuaugguguuacagaagugcuacacgggcuacagcugaagauuggaauacuaaag

SEQ ID NO: 355797 - RNA, 64 nt, Human
uuuauccuaauguaaaugcuuuauuuauuuauuugggcuacauuguaagauccaucuacacagu

SEQ ID NO: 355798 - RNA, 64 nt, Human
cccucgcacucugguggcaggugccuuguccucagggcuacagcaguagggaggucagugcuuc

SEQ ID NO: 355799 - RNA, 64 nt, Human
agaaacgugccaaauggaacucaaggugccccuucagaauuaaaaucauuaccuugugugugaa

SEQ ID NO: 355800 - RNA, 64 nt, Human
ucaggacccaguccacuguauggcauuugugaugcagaauuaugcacugacaugacccugggug

SEQ ID NO: 355801 - RNA, 64 nt, Human
cgcaacuguggggcuaagaauucuuaagaugucacagaauuauaccauccuaccucaucuaaag

SEQ ID NO: 355802 - RNA, 64 nt, Human
aucggauuauaagcuucuagcuaacacaaggauucagaauuagguaaacaucugaagguuuagu

SEQ ID NO: 355803 - RNA, 64 nt, Human
uuuucuaacaaacuguugaucagcaaaaauaaaggggcuacagaaacacucauuuuuaugcugu

SEQ ID NO: 355804 - RNA, 64 nt, Human
uccuauuaaguguaacaaauaguuaagcaaacucgggcuacaaacaaagacuuugcuaccuccc

SEQ ID NO: 355805 - RNA, 64 nt, Human
ggauacgccauccacccuggcucuugucccaagugggcuacauuugaagaauucacccaggcuc

SEQ ID NO: 355806 - RNA, 64 nt, Human
cgugggaggcgaagucccaggacagcccagaggggggcuacagagaggagucggcugcagcaga

SEQ ID NO: 355807 - RNA, 64 nt, Human
agaagggugcagggcugcuggugucagagcaagagggcuacagggaaagggcccuuucucaggg

SEQ ID NO: 355808 - RNA, 64 nt, Human
cugccugccugucugcugagguaaggugggaggagggcuacagcccacaucccacccccucguc

SEQ ID NO: 355809 - RNA, 64 nt, Human
cugggggccaggcuggguguccucacaggagugagggcuacacccaauuccaaaagccugagaa

SEQ ID NO: 355810 - RNA, 64 nt, Human
cccagaccugccagccccggcguccuggagcugggggcuacagcccagccugagcucugggugg

SEQ ID NO: 355811 - RNA, 64 nt, Human
ugucuauguagucauacugaauuuagauagauaagggcuacagcauacuaaaucgacaaccaaa

SEQ ID NO: 355812 - RNA, 64 nt, Human
uauuuuguaauuaugauuuggguuggggaagggggggcuacauuauaaacgcuuauuguaagaa

SEQ ID NO: 355813 - RNA, 64 nt, Human
agggacagguauauguacagggcugagcugcagagggcuacaacuuccauauaagguagguuuu

SEQ ID NO: 355814 - RNA, 64 nt, Human
uguuggggugaucagacccaacacccggccaugggggcuacaaaguccagccgagucaaaggaa

SEQ ID NO: 355815 - RNA, 51 nt, Human
cccagagugggggagacuagagggcuacaggccagcguggaugaccugaag

SEQ ID NO: 355816 - RNA, 64 nt, Human
gguuuuugccaagucauacaacauacuuaaugcagggcuacacugaaccuccagaaucauuuug

SEQ ID NO: 355817 - RNA, 64 nt, Human
cucugauccagcuggcgcgcagauaccugcagaagggcuacaccacgcugcuguuccaggaggg

SEQ ID NO: 355818 - RNA, 64 nt, Human
uaggaaggcaugucuauugugauuuugaugaagacagaauuauuuuucucuguagaaacacaga

SEQ ID NO: 355819 - RNA, 64 nt, Human
ugggcucccucucccaccugucugcauagaaaggcagaauuagacauagcaugcuuuggaaaag

SEQ ID NO: 355820 - RNA, 64 nt, Human
auacacaccuucaugaauaaucaaagugauuuuucagaauuaugugugcaaaaaauuaaugugc

SEQ ID NO: 355821 - RNA, 64 nt, Human
uucauauauuuucuguuguuuuuaaaauaguuuucagaauuaugcaaguaauaagugcauguau

SEQ ID NO: 355822 - RNA, 64 nt, Human
uauauauggcaggcuucccuggugccgauguaaagggcuacauuugggaacauuugacuuccuu

SEQ ID NO: 355823 - RNA, 64 nt, Human
cagccccguuuuggagggugggggacagaagauggggcuacauuucccccauaccuacuauuuu

SEQ ID NO: 355824 - RNA, 64 nt, Human
agugagccgagguugugccacugcacugcagccugggcuacagagagcaagacucugucucaaa

SEQ ID NO: 355825 - RNA, 64 nt, Human
aguaauuaacuuuacccaaggcguuuggcucagagggcuacagacuauggccagaacucaucug

SEQ ID NO: 355826 - RNA, 64 nt, Human
gauuauccuuccuccucacccugccggguagcuggggcuacaggagcauaccaccaugccugac

SEQ ID NO: 355827 - RNA, 64 nt, Human
uaguuguaugacgaacugauaaaucugucugacugggcuacaauccauuguucuuaguccaaua

SEQ ID NO: 355828 - RNA, 64 nt, Human
ugcugccccucccugccuccacccacaguggagagggcuacaaaggaggacaagacccucucag

SEQ ID NO: 355829 - RNA, 64 nt, Human
gaaaggaaugaaauccauucaggaaauaucgacagggcuacacgugauguccccaaacugcugc

SEQ ID NO: 355830 - RNA, 64 nt, Human
gcagucuuugccucuuucuguugguugugcccaagggcuacaguagcucugaaauaacaagagc

SEQ ID NO: 355831 - RNA, 64 nt, Human
aagcaaccaauacaugauagacagggcuaaaacugggcuacagaauuuucaaaaagaaugauac

SEQ ID NO: 355832 - RNA, 64 nt, Human
cuuugaaaacaaaacuuuucaacaugggcauacugggcuacauggaaaaugacaucacccagga

SEQ ID NO: 355833 - RNA, 64 nt, Human
cucacuauguugcccagucuagucuugaacuccugggcuacaguuacccuccuaccucggcuuc

SEQ ID NO: 355834 - RNA, 64 nt, Human
cauuucccuuauuugguucagcuuuuagcaaaaagggcuacaguucacccugcagaguauuaag

SEQ ID NO: 355835 - RNA, 64 nt, Human
gacaucaugguuagucaugguacugcagcuuagggggcuacacgguugcugugugaguggagag

SEQ ID NO: 355836 - RNA, 64 nt, Human
ccucagcucucaucacucagacuugguaaucccugggcuacacgacugacucucucccagcugc

SEQ ID NO: 355837 - RNA, 64 nt, Human
aaagaaaauguuauaagaugcaguaaacuaauaacagaauuauuaaaauauaucaggcuauuuu

SEQ ID NO: 355838 - RNA, 64 nt, Human
guuugauaugauuuauuuaugaaaccuaaugaagcagaauuaaauacuguauuaaaauaaguuc

SEQ ID NO: 355839 - RNA, 64 nt, Human
cucuuguuuuugcauaacugguuuuguuuuuuugcagaauuaacuauaacaaucacuggcuacc

SEQ ID NO: 355840 - RNA, 64 nt, Human
guuaaacauuauuuccucuaugguaguuaaaauacagaauuagauuuuuaacaggugucauuug

SEQ ID NO: 355841 - RNA, 64 nt, Human
gagucugacacagcuuucaugagguuacagaaaagggcuacagauuugggaagcuguguguaau

SEQ ID NO: 355842 - RNA, 64 nt, Human
uuaaaaucuuugcaaauugaauaauuacagaaaagggcuacauuuaaaauuuguauuuguuuuu

SEQ ID NO: 355843 - RNA, 64 nt, Human
gucagacagacgggagaguccagaaacagacccagggcuacaggaauuuaguauaugguaagag

SEQ ID NO: 355844 - RNA, 64 nt, Human
ccagggagcccacagcagcaucagacccauccaggggcuacagggccugccccccugcagguag

SEQ ID NO: 355845 - RNA, 64 nt, Human
ccugcuuggccguggucacuggccgccaagaucagggcuacagaugucugcucucuggacccca

SEQ ID NO: 355846 - RNA, 64 nt, Human
acagcacccccaacccuggcacccagggugggaagggcuacaccuuagccugcccuccuuuccg

SEQ ID NO: 355847 - RNA, 64 nt, Human
ugaccgcuugagcccaggauuucaaguccagccugggcuacauagugagaccgugucucuguuu

SEQ ID NO: 355848 - RNA, 64 nt, Human
ggcaucgcauuacccaacuucaaacuauacuacagggcuacaguaaccaaaacugcaugauacu

SEQ ID NO: 355849 - RNA, 64 nt, Human
ucacuccaggcauauguuuccccaucucugucuggggcuacagaauaggguggcagaaguguca

SEQ ID NO: 355850 - RNA, 64 nt, Human
augaacuuuuuuuuuuuuuuuuuuuuuuuuuucugggcuacagagaccuagcuuucugguuccu

SEQ ID NO: 355851 - RNA, 64 nt, Human
gaaaaaaaggucuauuuuuuuuucuccuauacuugggcuacauuuuuugauuguaaaaauauuu

SEQ ID NO: 355852 - RNA, 64 nt, Human
uccucugauuggauggaguccgccagcaggcauggggcuacauuccagugccugacuauaggga

SEQ ID NO: 355853 - RNA, 64 nt, Human
auaugaaaaagguuaugugaaagauguggaugaugggcuacaggcagcugaggaaguuggauau

SEQ ID NO: 355854 - RNA, 64 nt, Human
cuucuucuguagcuuuacaccagaaggaaggaaugggcuacagcagguaguggaggaagagggg

SEQ ID NO: 355855 - RNA, 64 nt, Human
aucuaaaagaugaaguuucuaucauccaaaguaugggcuacagaaaccgugccaaaagacuucu

SEQ ID NO: 355856 - RNA, 61 nt, Human
cuuguggcugggaaagagggaugugcagugacguggucaccaaggcagugagccccgcuga

SEQ ID NO: 355857 - RNA, 61 nt, Human
uggcuccugguccccuguccgccacacaggccguggucauccacacaacucacugucugca

SEQ ID NO: 355858 - RNA, 61 nt, Human
cuguuaggauggcaugaacauuuccuuagaucguggucagcuccgaggaauguggcgucca

SEQ ID NO: 355859 - RNA, 61 nt, Human
caaagaauaaccacagcucagaagacgaugacguggucaucugugucgccauccccuuccu

SEQ ID NO: 355860 - RNA, 64 nt, Human
cgugaagauauaacagaggcagacagaauccagagggcuacagagaaccugaauucaacccaug

SEQ ID NO: 355861 - RNA, 64 nt, Human; identical to SEQ ID NO: 123442

SEQ ID NO: 355862 - RNA, 64 nt, Human; identical to SEQ ID NO: 123443

SEQ ID NO: 355863 - RNA, 64 nt, Human; identical to SEQ ID NO: 123444

SEQ ID NO: 355864 - RNA, 64 nt, Human; identical to SEQ ID NO: 123445

SEQ ID NO: 355865 - RNA, 64 nt, Human; identical to SEQ ID NO: 123446

SEQ ID NO: 355866 - RNA, 64 nt, Human; identical to SEQ ID NO: 123447

SEQ ID NO: 355867 - RNA, 61 nt, Human; identical to SEQ ID NO: 123448

SEQ ID NO: 355868 - RNA, 64 nt, Human; identical to SEQ ID NO: 123449

SEQ ID NO: 355869 - RNA, 64 nt, Human; identical to SEQ ID NO: 123450

SEQ ID NO: 355870 - RNA, 64 nt, Human; identical to SEQ ID NO: 123451

SEQ ID NO: 355871 - RNA, 64 nt, Human; identical to SEQ ID NO: 123452

SEQ ID NO: 355872 - RNA, 64 nt, Human; identical to SEQ ID NO: 123453

SEQ ID NO: 355873 - RNA, 64 nt, Human; identical to SEQ ID NO: 123454

SEQ ID NO: 355874 - RNA, 64 nt, Human; identical to SEQ ID NO: 123455

SEQ ID NO: 355875 - RNA, 64 nt, Human; identical to SEQ ID NO: 59012

SEQ ID NO: 355876 - RNA, 64 nt, Human; identical to SEQ ID NO: 59015

SEQ ID NO: 355877 - RNA, 64 nt, Human; identical to SEQ ID NO: 59020

SEQ ID NO: 355878 - RNA, 64 nt, Human
uccuguuugcccugagccgccuggcuguagagaagggcuacaucccugaacccaggugggaccc

SEQ ID NO: 355879 - RNA, 64 nt, Human
uuuucuuauagauguuagcccugcccaacagccagggcuacacuacaaaaggcaagaaugccca

SEQ ID NO: 355880 - RNA, 64 nt, Human
acagauagaccggccucgccccuuccagcuccaagggcuacaucaaccgaccuuucggguuuca

SEQ ID NO: 355881 - RNA, 64 nt, Human
cuuugacccugcugaguguaagcugccuggggaggggcuacaaggaguaauuguggcuuuaggg

SEQ ID NO: 355882 - RNA, 64 nt, Human
accacuccuaccucaccaucuucgggcagaucccgggcuacaucgacgguaggagccgggcgcc

SEQ ID NO: 355883 - RNA, 64 nt, Human
aguggaggccagagaucuggaaucggggucagcggggcuacaguccuuccaggggcucuggggc

SEQ ID NO: 355884 - RNA, 64 nt, Human
agcacgagaugcagcauuucgugaaggucauccagggcuacaucgccaaccagauccugcacgu

SEQ ID NO: 355885 - RNA, 64 nt, Human
ugcaguuuguccugggcacagacagcuuccaccugggcuacacggagaccgggcacugccuggg

SEQ ID NO: 355886 - RNA, 64 nt, Human
agcaguccuccugccuuagccucuagaguagcuggggcuacaggugcuggccgccuggcccagc

SEQ ID NO: 355887 - RNA, 64 nt, Human
aguaucuuaaugaaaaauacuacuucuuuagcuugggcuacaugugucaggguuuuucuccagg

SEQ ID NO: 355888 - RNA, 64 nt, Human
cuaucuucaaccuaguuccuccucagaucacucugggcuacagcaucccuccuguuuagaucag

SEQ ID NO: 355889 - RNA, 64 nt, Human
ggaaauggaguuuuaaggcaagaggccauauauagggcuacaucuuguuaauugcaauugucca

SEQ ID NO: 355890 - RNA, 64 nt, Human
auugucaaauucacuuugaauaauaauagaaccugggcuacauuccuaacucauauuaacagca

SEQ ID NO: 355891 - RNA, 64 nt, Human
uuuaauuacaauggaaauuuaaacauuuuuaugugggcuacacaauggauggcucuucuuaagu

SEQ ID NO: 355892 - RNA, 61 nt, Human
gcccagccuguggucuucuccguacccgcaacguggucaucugugcccgugacgucaccug

SEQ ID NO: 355893 - RNA, 61 nt, Human
ccugcacguuacggagaccaucacaugugggcguggucagugcccaggaccgcaccgcugc

SEQ ID NO: 355894 - RNA, 64 nt, Human
acaccuccuaccuggccccuugccaaaucccaagcagaauuagcaacaggaaaagcagagcccc

SEQ ID NO: 355895 - RNA, 64 nt, Human
aaaauuuuacuacuuuugagauugccccaauguacagaauuauauaauucuaacgcuuaaauca

SEQ ID NO: 355896 - RNA, 64 nt, Human; identical to SEQ ID NO: 303238

SEQ ID NO: 355897 - RNA, 64 nt, Human; identical to SEQ ID NO: 303239

SEQ ID NO: 355898 - RNA, 64 nt, Human; identical to SEQ ID NO: 303240

SEQ ID NO: 355899 - RNA, 64 nt, Human; identical to SEQ ID NO: 303241

SEQ ID NO: 355900 - RNA, 64 nt, Human; identical to SEQ ID NO: 303242

SEQ ID NO: 355901 - RNA, 50 nt, Human; identical to SEQ ID NO: 303243

SEQ ID NO: 355902 - RNA, 64 nt, Human; identical to SEQ ID NO: 303244

SEQ ID NO: 355903 - RNA, 64 nt, Human; identical to SEQ ID NO: 303245

SEQ ID NO: 355904 - RNA, 64 nt, Human; identical to SEQ ID NO: 303246

SEQ ID NO: 355905 - RNA, 64 nt, Human; identical to SEQ ID NO: 303247

SEQ ID NO: 355906 - RNA, 64 nt, Human; identical to SEQ ID NO: 303248

SEQ ID NO: 355907 - RNA, 64 nt, Human; identical to SEQ ID NO: 303249

SEQ ID NO: 355908 - RNA, 63 nt, Human; identical to SEQ ID NO: 303250

SEQ ID NO: 355909 - RNA, 61 nt, Human
ggugggcuacccagagcgagcacgcuucucucguggucaugccaagaacacaggaggguga

SEQ ID NO: 355910 - RNA, 61 nt, Human
aacugcacuaguguuuaauaccagcaagccacguggucaaccaccuuucugacuuuuuauu

SEQ ID NO: 355911 - RNA, 61 nt, Human
cccaccgcagucaccaccacccgaaaugccacguggucacugugcacugcccuguucaugu

SEQ ID NO: 355912 - RNA, 64 nt, Human; identical to SEQ ID NO: 303254

SEQ ID NO: 355913 - RNA, 64 nt, Human; identical to SEQ ID NO: 303255

SEQ ID NO: 355914 - RNA, 64 nt, Human; identical to SEQ ID NO: 303256

SEQ ID NO: 355915 - RNA, 64 nt, Human; identical to SEQ ID NO: 303257

SEQ ID NO: 355916 - RNA, 64 nt, Human; identical to SEQ ID NO: 303258

SEQ ID NO: 355917 - RNA, 64 nt, Human; identical to SEQ ID NO: 303259

SEQ ID NO: 355918 - RNA, 64 nt, Human; identical to SEQ ID NO: 303260

SEQ ID NO: 355919 - RNA, 64 nt, Human; identical to SEQ ID NO: 303261

SEQ ID NO: 355920 - RNA, 64 nt, Human; identical to SEQ ID NO: 303262

SEQ ID NO: 355921 - RNA, 64 nt, Human; identical to SEQ ID NO: 303263

SEQ ID NO: 355922 - RNA, 64 nt, Human; identical to SEQ ID NO: 303264

SEQ ID NO: 355923 - RNA, 64 nt, Human; identical to SEQ ID NO: 303265

SEQ ID NO: 355924 - RNA, 64 nt, Human; identical to SEQ ID NO: 303266

SEQ ID NO: 355925 - RNA, 64 nt, Human; identical to SEQ ID NO: 303267

SEQ ID NO: 355926 - RNA, 64 nt, Human; identical to SEQ ID NO: 303268

SEQ ID NO: 355927 - RNA, 61 nt, Human
agagacauuuggugucuuuuuauaauucgcucguggucauugaauagagcaauaaacggag

SEQ ID NO: 355928 - RNA, 61 nt, Human
gugcuuccaaggcagaagcagcaggggauggcguggucaagcacucgggaaaccuggggcu

SEQ ID NO: 355929 - RNA, 61 nt, Human
ggaaauacuuuguauucuaaaaacucacugacguggucaguuagacauacguugguuucca

SEQ ID NO: 355930 - RNA, 64 nt, Human; identical to SEQ ID NO: 302445

SEQ ID NO: 355931 - RNA, 64 nt, Human; identical to SEQ ID NO: 302446

SEQ ID NO: 355932 - RNA, 64 nt, Human; identical to SEQ ID NO: 302447

SEQ ID NO: 355933 - RNA, 64 nt, Human; identical to SEQ ID NO: 302448

SEQ ID NO: 355934 - RNA, 64 nt, Human; identical to SEQ ID NO: 302449

SEQ ID NO: 355935 - RNA, 64 nt, Human; identical to SEQ ID NO: 302450

SEQ ID NO: 355936 - RNA, 64 nt, Human; identical to SEQ ID NO: 302451

SEQ ID NO: 355937 - RNA, 64 nt, Human; identical to SEQ ID NO: 302452

SEQ ID NO: 355938 - RNA, 64 nt, Human; identical to SEQ ID NO: 302453

SEQ ID NO: 355939 - RNA, 64 nt, Human; identical to SEQ ID NO: 302454

SEQ ID NO: 355940 - RNA, 64 nt, Human; identical to SEQ ID NO: 302455

SEQ ID NO: 355941 - RNA, 64 nt, Human; identical to SEQ ID NO: 302456

SEQ ID NO: 355942 - RNA, 64 nt, Human; identical to SEQ ID NO: 302457

SEQ ID NO: 355943 - RNA, 64 nt, Human
aguggcccuucacacaacuuuugaaucucuaaaaauccauaaaauccuuaaagaacuguaaggc

SEQ ID NO: 355944 - RNA, 61 nt, Human
ccaaagccaagggcaacagaucaguaaagaacguggucagaguagaaccccugaaguauuu

SEQ ID NO: 355945 - RNA, 61 nt, Human
gcaaggugaauggcaccuaacugcaggcgggcguggucagcugggaggagagcugugccca

SEQ ID NO: 355946 - RNA, 61 nt, Human
uccgcacccaagacugugcaacgggcaggaacguggucacagagcugcuuccccacgagca

SEQ ID NO: 355947 - RNA, 64 nt, Human
gaaaugaaauugaacuauugacugggccccagaaauccauaaaauggcugcagacaguuguuuc

SEQ ID NO: 355948 - RNA, 64 nt, Human
ucuggggugaggauacaaagacauugucuugcauauccauaagcaggucuuagagcauuauucc

SEQ ID NO: 355949 - RNA, 64 nt, Human
uaucugcaaaauggaaaucuagaccuccuucuucauccauaaguggacugugccaguacaauac

SEQ ID NO: 355950 - RNA, 64 nt, Human
uuauguuguccagugguucuuccuuauuguugauauccauaagcuggcacuggaugcucucagu

SEQ ID NO: 355951 - RNA, 64 nt, Human
agcauuccacaaauaugagaugaugguauuauccauccauaaauagguagauauaucucuauuu

SEQ ID NO: 355952 - RNA, 64 nt, Human
guggggaaggguauaaaggaggcuuaaaauuugaauccauaauauaucuaauuacaggagaauu

SEQ ID NO: 355953 - RNA, 64 nt, Human
uaugaauuaggaccacaaugagauuccauuuuauauccauaagauuugcaaagguugggucuga

SEQ ID NO: 355954 - RNA, 64 nt, Human
ggcuuagcggggccagugacggccguggcucaggauccauaagucgggguuuggucucagcauu

SEQ ID NO: 355955 - RNA, 64 nt, Human
ccucccgccccuuccacauccauguugugauuggauccauaaguuuacuuucuucaaagaguug

SEQ ID NO: 355956 - RNA, 64 nt, Human
cguaaaucaagccauucauuuuggggaacagaagauccauaacuuuagaaauacggguuuugac

SEQ ID NO: 355957 - RNA, 64 nt, Human
cugugugugaaaggucccaaaaucaaaaugguacauccauaaucagccaccauuuaacccuucc

SEQ ID NO: 355958 - RNA, 64 nt, Human
gguaauaauuucccucuuuuguagucugcacaagauccauaaaagauuguauuuuuauuacuau

SEQ ID NO: 355959 - RNA, 64 nt, Human
aguuuuuaaaaugcugcuuuguccaggugagaacauccauaauuuggggcccugaguuuuaccc

SEQ ID NO: 355960 - RNA, 64 nt, Human
ccccagggauuggccuggucucuguauucacuggauccauaauggguugcuguuguuuuggaug

SEQ ID NO: 355961 - RNA, 61 nt, Human
cgcuaagaaaugaaaauucugucuuuccuuccguggucacagcugaaagaaacaauaaauu

SEQ ID NO: 355962 - RNA, 61 nt, Human
aauccccgucacucuuggaggacuccugugacguggucagccucauucauccuugcccuuc

SEQ ID NO: 355963 - RNA, 61 nt, Human
gaaugagugcucacuugucccggguuuaggacguggucaagugaacagcagggucuaacug

SEQ ID NO: 355964 - RNA, 64 nt, Human
ccuucgggggacagauucugcccagucucugggcauccauaauugcugcuaaccuagacauuuc

SEQ ID NO: 355965 - RNA, 64 nt, Human
aacaguauauauucccuauuuuuauguuuauuuaauccauaacagaaaugaguaaggguagcac

SEQ ID NO: 355966 - RNA, 64 nt, Human
guucagagcaagaagucuugcuuuauacaaauguauccauaaaauaucagagcuuguugggcau

SEQ ID NO: 355967 - RNA, 64 nt, Human
cccauuuuucaugugcuucacuuugauagaguuaauccauaaaauugcucuuuacuuuagcuua

SEQ ID NO: 355968 - RNA, 64 nt, Human
gagagauggaagccagcccugccaaaggauggagauccauaauauggaugccagugaacuuauu

SEQ ID NO: 355969 - RNA, 64 nt, Human
gagagcccguaguuacaguguccucuaauuugaaauccauaaguuaacaagucuauaucaggug

SEQ ID NO: 355970 - RNA, 64 nt, Human
uguugguuucauguauauuacacuaucuacuacuauccauaaaugcaauaauaugcauguuaac

SEQ ID NO: 355971 - RNA, 64 nt, Human
uuaaguuucaugaaugcaugcucaguuuauuaaaauccauaaccauguaauucuuguaauaugu

SEQ ID NO: 355972 - RNA, 64 nt, Human
uguaacuuuguugcucuguauggcauaauauuguauccauaaacaugguaauuuugauacaguu

SEQ ID NO: 355973 - RNA, 64 nt, Human
uuuuuuugaacaaaugaugguguaacauuuugacauccauaaggacaaauguagauauuuuucu

SEQ ID NO: 355974 - RNA, 64 nt, Human
cagguaggcgaaaagaugacaggauacagagucaauccauaaacuaaauauuuauaacuguucu

SEQ ID NO: 355975 - RNA, 64 nt, Human
cauuuauuauuaauuugaaagauaaacaguugugauccauaauggaucauuucuuaugucuuuu

SEQ ID NO: 355976 - RNA, 64 nt, Human
augcucaacucugaaaaccuugaacacggccaaaauccauaaagauuauaaaagcaaacuaagu

SEQ ID NO: 355977 - RNA, 64 nt, Human
cuaagauuauaauuuccaccaacauugcugagacauccauaaccaucgaugauguugucuaugu

SEQ ID NO: 355978 - RNA, 61 nt, Human
acuuagugaauucuaaggaacucagggggcacguggucaggcuccaccgcacagaagagcc

SEQ ID NO: 355979 - RNA, 61 nt, Human
uuauugucugucuacauuucugcagaucuuccguggucagagugccacugcgggagcucug

SEQ ID NO: 355980 - RNA, 64 nt, Human; identical to SEQ ID NO: 59026

SEQ ID NO: 355981 - RNA, 64 nt, Human
aaaagaaauucaguuuauaagauaaaucugaaaaauccauaaugaaauaggaguuauaaaaaau

SEQ ID NO: 355982 - RNA, 64 nt, Human
cuuuugauuuuuaaucacaauuccaaacuuuugaauccauaagauuuuucaauggauaauuucc

SEQ ID NO: 355983 - RNA, 64 nt, Human
auggagaauaaacuaauaaacuuguaucgaggaaauccauaaaguuauaaauuagccugaaaaa

SEQ ID NO: 355984 - RNA, 64 nt, Human
caucccaccaccucuaccugcucaugccaggagaauccauaacugccuagaggccuggggcccc

SEQ ID NO: 355985 - RNA, 64 nt, Human
agauuacacaguuaggaugcugacacagucuagaauccauaaugcucccuacaucucacacuaa

SEQ ID NO: 355986 - RNA, 64 nt, Human
gaggaaauugcacacaguagcaaaauuuggggaaauccauaacauuuucagaccaugaaugaau

SEQ ID NO: 355987 - RNA, 64 nt, Human
gcuguugaaagcaucauucuuuaauuacuguaccauccauaaugcaggacauuucuuacugccu

SEQ ID NO: 355988 - RNA, 64 nt, Human
aaaugauagcacuucucuugcacuuaagaauggcauccauaagauucuguauuuggcauuuaga

SEQ ID NO: 355989 - RNA, 64 nt, Human
ugauuccccuauuuuaacaaacugacaagagcacauccauaaaaugaaaaccuguuacaacuau

SEQ ID NO: 355990 - RNA, 61 nt, Human
ugauccugcagcaguucugaggcccuaugccauccauaaggauuccuugggauucugguuu

SEQ ID NO: 355991 - RNA, 64 nt, Human
ucuuagaagccagauaugguuuaaauguuuuauuauccauaaugaucuaaacuaauaagauuca

SEQ ID NO: 355992 - RNA, 64 nt, Human
guugucacaucagauaagacauaucucuaauuccauccauaaauccaguucuacuauggcugag

SEQ ID NO: 355993 - RNA, 64 nt, Human
gccuccauuugcacauucauuucaguuauuucugauccauaaauauaacauuuacaaaauucuu

SEQ ID NO: 355994 - RNA, 64 nt, Human
agcuguuuuugcuuaggugauccacugccaugugauccauaauuuuucuacauaaaaaaucaaa

SEQ ID NO: 355995 - RNA, 61 nt, Human
cuucccugaagagacaggcaccccucccagccguggucaacggagggaguggcacuucugc

SEQ ID NO: 355996 - RNA, 61 nt, Human
guccugggccccgggcgaggucccgcccucccguggucacuggcuccgcccccagcaccag

SEQ ID NO: 355997 - RNA, 61 nt, Human
agcccaguaaguauuggccagucaggcgccucguggucagagcagagccaccaggucccac

SEQ ID NO: 355998 - RNA, 64 nt, Human
caaacuaugguauuauuuuaauguuacuuuaaaaauccauaaucugcuaguuuugcauguacuu

SEQ ID NO: 355999 - RNA, 64 nt, Human
agaaaccaaggggaaguaauaaguugaaaaagaaauccauaacuauuaaaagauuuuaacuuuu

SEQ ID NO: 356000 - RNA, 64 nt, Human
uaaaaaagcauuuaagguauaauuuauuuguaaaauccauaaaguacuucuguacaguauuaga

SEQ ID NO: 356001 - RNA, 64 nt, Human
guguuuaggauuuaguagugcauaaagcauuaauauccauaaacauaccuagaaguuuguuuug

SEQ ID NO: 356002 - RNA, 64 nt, Human
ucccaaucaaagaauuacaguacacauccccagaauccauaaauguguuccuggcccacucugu

SEQ ID NO: 356003 - RNA, 64 nt, Human
caauuuuacccugaggucacugcuagagacgcugauccauaaagacaaucacugccaaccccuc

SEQ ID NO: 356004 - RNA, 64 nt, Human
cauuugucuguccaccguaauuuuagaaaagcauauccauaacguuuacaguuguaguacaguu

SEQ ID NO: 356005 - RNA, 64 nt, Human
agcuauuuuaguaaccccaagaguuucuucucauauccauaaaauuggauuacaguauggcaau

SEQ ID NO: 356006 - RNA, 64 nt, Human
auuuucguaaacuuuguuuuauauuaaaagaaaaauccauaagucuguguguguuaaacaugag

SEQ ID NO: 356007 - RNA, 64 nt, Human
gaauuuagaugagaauucacuuguucugucaguaauccauaagacagaaaucuguuuuuuuaaa

SEQ ID NO: 356008 - RNA, 64 nt, Human
uaucuaaauucucaauuucacuucaaauuagagaauccauaauggacuagaauauaaauuacaa

SEQ ID NO: 356009 - RNA, 64 nt, Human
gguuuucaaacaucugaggcaugauaaauuuauuauccauaauuauaguaauaauaaccuuaau

SEQ ID NO: 356010 - RNA, 64 nt, Human
guggauccagaaaacaaaaaguaggauacuuacaauccauaacauccauaugacugaacacuug

SEQ ID NO: 356011 - RNA, 64 nt, Human
cuccaguauaugcugauggaccaggaagcccugaauccauaaaggcauaccuuaaacaagcucg

SEQ ID NO: 356012 - RNA, 61 nt, Human
gaaguugcugugccccaucagcagcuugacgcguggucacaggacgauuucacugacacug

SEQ ID NO: 356013 - RNA, 61 nt, Human
uauauauguacauagccagagagucaugccacguggucauuaaaccgaugaugauugaggc

SEQ ID NO: 356014 - RNA, 64 nt, Human; identical to SEQ ID NO: 58983

SEQ ID NO: 356015 - RNA, 64 nt, Human
uaacguguaggaaguccuuuaucacuuauccucgauccauaagcauaucuugcagaggggaacu

SEQ ID NO: 356016 - RNA, 64 nt, Human
uuuuuuguaaaacaaguacuugagauuuugguuuauccauaauagaauguauuucauuagauuc

SEQ ID NO: 356017 - RNA, 64 nt, Human
aucuuuuaauuccuguuauuaguuuuggaagcuuauccauaaguuuccaaagacaagaugauau

SEQ ID NO: 356018 - RNA, 64 nt, Human
auccacaauuagaccacaaugcaccuuugguuguauccauaaaggaugcuagccugccuuguac

SEQ ID NO: 356019 - RNA, 64 nt, Human
agccucgggggcuccgacuccagcucugggcaagauccauaaacuuuuaaagaagccucaaaac

SEQ ID NO: 356020 - RNA, 64 nt, Human
uuaagauucucagaaaucaggagauuuuuauccuauccauaaguaauauguaacugccauaagu

SEQ ID NO: 356021 - RNA, 64 nt, Human
gauugggaggguggucagagggaacuuuagcuuuauccauaacauuaauuuuuuuaaaaaauaa

SEQ ID NO: 356022 - RNA, 64 nt, Human
auuccccagcagggucuuuucaucugggaaagacauccauaaagaagcaauaaagaagagugcc

SEQ ID NO: 356023 - RNA, 64 nt, Human
gggggucuguacuuauggccugaaaauauuugugauccauaacucuacacagccuuuacucaua

SEQ ID NO: 356024 - RNA, 64 nt, Human
ucaauuauauugcaucuuggguccauaaacccuaauccauaaucccaucaagaaaagcucugcu

SEQ ID NO: 356025 - RNA, 64 nt, Human
gaauuaaggaucauagucgggcauacuuaucuauauccauaaccucuauaucuuuaaauaaaug

SEQ ID NO: 356026 - RNA, 64 nt, Human
ugguuaugcucugauuuccuacccuguuacuuucauccauaauuuauaguacauccauuuugug

SEQ ID NO: 356027 - RNA, 64 nt, Human
auuaccuauacuaugccaauauuuccuuauaucuauccauaacauuuauacuacauuuguaaga

SEQ ID NO: 356028 - RNA, 64 nt, Human
ugcagaauaaaugagaaaaauguaaguaaaugccauccauaaauaacuauucaguucccuuuuu

SEQ ID NO: 356029 - RNA, 61 nt, Human
cggucccccagcccauccgccauccccagcccguggucagguagagagugagccccacgcc

SEQ ID NO: 356030 - RNA, 61 nt, Human
uggcugcgucuugcacccagcgggcaucugccguggucagauccauuucaaaugaaaugug

SEQ ID NO: 356031 - RNA, 61 nt, Human
acgccagggucccucaaagcuucuguggcuucguggucacugcuccagccucagccagggc

SEQ ID NO: 356032 - RNA, 64 nt, Human
aauagucaucacauuucuaugccaaacaggaacaauccauaacuuuagucuuaauguacacauu

SEQ ID NO: 356033 - RNA, 64 nt, Human
uuuuguguguguguguguguguguguguguguguauccauaaaaugcauauguaaauuuuuuuu

SEQ ID NO: 356034 - RNA, 64 nt, Human
uguuggauccguuugaccaauuugcaccaguuuuauccauaaugauggauuuaacagcaugaca

SEQ ID NO: 356035 - RNA, 64 nt, Human
uuauauugucauuccauuuuuguuauagaaaguaauccauaaaauuucaguucuaaaauacuuu

SEQ ID NO: 356036 - RNA, 64 nt, Human
cuagaagggcuacugcuccuggaagaguggacggauccauaauaaagacgucccaaauggugga

SEQ ID NO: 356037 - RNA, 64 nt, Human
agucuuuuagugucucaaaauagauuauuaauacauccauaagucugugguucuucucauucuc

SEQ ID NO: 356038 - RNA, 64 nt, Human
ggaucauuuugaguggaacaaagugaccucuugcauccauaacaucuuaagcgggcagaggugg

SEQ ID NO: 356039 - RNA, 64 nt, Human
acuacuugugcaguaauugcuuuaugcggcuguaauccauaaccugugaagacagcacaucauc

SEQ ID NO: 356040 - RNA, 64 nt, Human
ucagauuuuuguacaaggcuaaaaugucuuucccauccauaaccaaguccuccuauggguacau

SEQ ID NO: 356041 - RNA, 64 nt, Human
uccaaaauucaguauuuaauguaauuaaucuuuaauccauaaaaauacauccccacuguagcgg

SEQ ID NO: 356042 - RNA, 63 nt, Human
ccauggccaucaaaagcuaaccuguugacuggcauccauaagugugccucugccuuaucucau

SEQ ID NO: 356043 - RNA, 64 nt, Human
auuuugaagaaaauccuaaacaucaaauacuuucauccauaaaaaugucagcauuuauuaaaaa

SEQ ID NO: 356044 - RNA, 64 nt, Human
gcaucacuuaacggaccaaagcaagacccuaaacauccauaauugugauuagacagaacaccua

SEQ ID NO: 356045 - RNA, 64 nt, Human
cccuuugagccaaaauuuuuuuuuuuuuuucagaauccauaagaguuuauuuguuggcuucacu

SEQ ID NO: 356046 - RNA, 64 nt, Human; identical to SEQ ID NO: 58989

SEQ ID NO: 356047 - RNA, 64 nt, Human; identical to SEQ ID NO: 58990

SEQ ID NO: 356048 - RNA, 64 nt, Human; identical to SEQ ID NO: 58991

SEQ ID NO: 356049 - RNA, 64 nt, Human
aaaaccaucuuggcuaauauguacuggggaaauaauccauaagagauaucaccagacuagaauu

SEQ ID NO: 356050 - RNA, 64 nt, Human
uaaaugguccacguuucaaaaauguuaauggcuaauccauaauuaaagaagguuuaacuguuac

SEQ ID NO: 356051 - RNA, 64 nt, Human
uaaaguaugucuguugaagcaagcaagcaaacaaauccauaacaaccacaacaagcaacaagaa

SEQ ID NO: 356052 - RNA, 64 nt, Human
gauccauuuagguaccacuugauauaaaaaggauauccauaaugaauauuuuauacugcauccu

SEQ ID NO: 356053 - RNA, 64 nt, Human
agauggggcuugcaacauuaaacaugagcugagcauccauaagcauugaauugggauuaaauaa

SEQ ID NO: 356054 - RNA, 64 nt, Human
ggacgcauagcuaauacuuuagagaggaugacagauccauaaagagaguaaagauaagagaaaa

SEQ ID NO: 356055 - RNA, 64 nt, Human
caaaauccuaaaauugaaaaaaacaucuagccauauccauaaacuauaucaucaccaagagaug

SEQ ID NO: 356056 - RNA, 64 nt, Human
cauccuuaauauguucuaaauuguuuauauugcuauccauaaugggauucaccuccaaauuauc

SEQ ID NO: 356057 - RNA, 64 nt, Human
uguugaaaaccaaaaugacaucuuuuuaaagcuuauccauaaaaaaaaauagaugucuuuuaua

SEQ ID NO: 356058 - RNA, 64 nt, Human
uaacuugcggauguucagcgugcauguggaauccauccauaaugguacauagcgaaauaauaua

SEQ ID NO: 356059 - RNA, 64 nt, Human
uuucuccagcaauaauaugcaaaugaagacauguauccauaagaaggagugcucuucaucaacu

SEQ ID NO: 356060 - RNA, 63 nt, Human
cugaugcccugaguuguuugugauucaauaaagaauccauaagauccuguguguguggccuga

SEQ ID NO: 356061 - RNA, 64 nt, Human
uauuuguaaugaagugaauccacuguuuaaucagauccauaaucuuuaacagauucaccacaaa

SEQ ID NO: 356062 - RNA, 64 nt, Human
ucaacagcccaaauauuuugguuuauuccuuuuuauccauaaagucuuuauucuucaaguuugg

SEQ ID NO: 356063 - RNA, 64 nt, Human; identical to SEQ ID NO: 58993

SEQ ID NO: 356064 - RNA, 64 nt, Human; identical to SEQ ID NO: 58994

SEQ ID NO: 356065 - RNA, 64 nt, Human; identical to SEQ ID NO: 58995

SEQ ID NO: 356066 - RNA, 64 nt, Human
guguaguagagcaauauaauguuaguuuuuucugauccauaagaagcaaauuuauaccuauuug

SEQ ID NO: 356067 - RNA, 64 nt, Human
ccugcccccgacagcccagccuagcccacuugucauccauaaagcaagcucaaccuuggcgucu

SEQ ID NO: 356068 - RNA, 64 nt, Human
cacagcuuagauuucauaguucagaauuuaguguauccauaaugcauucuucucuguugucgua

SEQ ID NO: 356069 - RNA, 64 nt, Human
cugugcugauguugggaacuuaucuuuuuccaggauccauaacauuuaggggaauuauuugcgg

SEQ ID NO: 356070 - RNA, 64 nt, Human
ccuucgcagcuccccuaaacuucccaggugccucauccauaaugagauaaugcauguaggggaa

SEQ ID NO: 356071 - RNA, 64 nt, Human
uguauuaacaaauauauacauuucuauuuuuauaauccauaaggauaugccuguuuuaaauaac

SEQ ID NO: 356072 - RNA, 64 nt, Human
agcuaugccuuuaugguuaagauuagaauauaugauccauaaaaauuuaaagugagaggcaugg

SEQ ID NO: 356073 - RNA, 64 nt, Human
cagaguugguuccuucuggaggcucuaaggaagaauccauaaacagacauucuaugucuguuuc

SEQ ID NO: 356074 - RNA, 64 nt, Human
guggcauggggagcagcuagaacaaugcagauucauccauaaucccuuucugcuguucaccacc

SEQ ID NO: 356075 - RNA, 64 nt, Human
aaaaaagaaaauggauuagugacaaaagucacugauccauaacuuuccuuaguuuugugcuuau

SEQ ID NO: 356076 - RNA, 64 nt, Human
uuugcaauugucaaguguuuuguuguagcuuaguauccauaagggaaacuuagacuauagacau

SEQ ID NO: 356077 - RNA, 64 nt, Human
uaccacauuuucaugacagauacauucaugcacaauccauaauuugaguuuuacauaaaauaga

SEQ ID NO: 356078 - RNA, 64 nt, Human
cuccuuucuacccaccccuuucuauccuaaacacauccauaaaaaaugugcuuaucacugugcu

SEQ ID NO: 356079 - RNA, 64 nt, Human
gcucaagaaaaagcaugagcuggccacacauguaauccauaaccaccaaaaauacuauggagag

SEQ ID NO: 356080 - RNA, 61 nt, Human
aaccgcccaaggucacccagcugugaaugaacguggucagaacacagaaucugaguugguc

SEQ ID NO: 356081 - RNA, 61 nt, Human
ugaugccccaagucugcgaauccagggugcacguggucaauauccccuccugcauucagga

SEQ ID NO: 356082 - RNA, 61 nt, Human
cccagcccccuaagagagcaccuggugaucacguggucacggcaaaggaagacgugaugcc

SEQ ID NO: 356083 - RNA, 64 nt, Human
caacucaaggcaauggcuuucuacaccaacucuaauccauaaacgggucuuaugacaucuauga

SEQ ID NO: 356084 - RNA, 64 nt, Human
ucuguggaacugguuaucugccauggccucaacaauccauaauccagucauggagaggauuccc

SEQ ID NO: 356085 - RNA, 64 nt, Human
uguggacaaaucauuaaaauuacagagcuauaugauccauaauugauuagucaaaauaacuuau

SEQ ID NO: 356086 - RNA, 64 nt, Human
auaauggggguaaaguuaaguugagauaguuuucauccauaacugaacauccaaaaucuugauc

SEQ ID NO: 356087 - RNA, 64 nt, Human
ucauucccauaucuaccuaagaaggaagcaguaaauccauaauuuaccuuuugggcaaugcuuu

SEQ ID NO: 356088 - RNA, 64 nt, Human
uguuugauuucagggagagagauuuucuuuggucauccauaauagagauugauaagauuuagca

SEQ ID NO: 356089 - RNA, 64 nt, Human
cuaucgagacauguuuguucggaaaaacagaaagauccauaaagaugcagaguccgcccaguca

SEQ ID NO: 356090 - RNA, 64 nt, Human
cauugacucuuuaagacaucuaaaguaucacauuauccauaauuuauugcuuuucuuugcaucu

SEQ ID NO: 356091 - RNA, 64 nt, Human
aguuugagggagaaauagucggugaagaaaccguauccauaaagacccgauuccaccaaaugug

SEQ ID NO: 356092 - RNA, 64 nt, Human
gccuauuaagcacgacacaguaucaguggaauugauccauaaaccucccuguccacaucuugcc

SEQ ID NO: 356093 - RNA, 64 nt, Human
gugacuuaaaguuugauggagagaaagcuguaggauccauaaauucuaccaggaaaccaggguc

SEQ ID NO: 356094 - RNA, 64 nt, Human
acaaagcuuuucccaucuccagucucaguuucccauccauaaaaugggggaagugguaggucuu

SEQ ID NO: 356095 - RNA, 64 nt, Human
guauuaaauacuugaguguuuagguggaaggcgcauccauaauaugcaugugaggaccaauucu

SEQ ID NO: 356096 - RNA, 64 nt, Human
cugucagccagacuggacaggcaaagacugcaguauccauaacccccugcccacguccccaccc

SEQ ID NO: 356097 - RNA, 61 nt, Human
uguaccaggcaaaagacaggcccugcuuggccguggucacuggccgccaagaucagggcua

SEQ ID NO: 356098 - RNA, 61 nt, Human
acagaaauguggcuccaguugcucugucucucguggucacccugagggcacucugcauccu

SEQ ID NO: 356099 - RNA, 61 nt, Human
gggccugugauuggaugggaagaugugcauccguggucaaaagucagcugccagcccugcg

SEQ ID NO: 356100 - RNA, 64 nt, Human
gcggugccagggaccuagcgcaggacuuuugguaauccauaaaauggauucugagacugcgacg

SEQ ID NO: 356101 - RNA, 64 nt, Human
gcacacauuugcauccacauauuagggaagaggaauccauaaguagcugaaauaucuauucugu

SEQ ID NO: 356102 - RNA, 64 nt, Human
ggucaaaguuacauucauuuuaauuuugguacauauccauaaauucuccauaaaaguaggacca

SEQ ID NO: 356103 - RNA, 64 nt, Human
uggauugagagacugugaaggaacucgguuacaaauccauaacaaaugacuggaaaagccacac

SEQ ID NO: 356104 - RNA, 64 nt, Human
ccauacauaauauaugacuuccuagggaucugaaauccauaaacuaagagaaacuguguauagc

SEQ ID NO: 356105 - RNA, 64 nt, Human
ccucuuucuccuccuaccucugcccugugagcccauccauaaggcucucagaugggacauugug

SEQ ID NO: 356106 - RNA, 64 nt, Human
uucauuguuaaguagaauauguauguugcauuuuauccauaagaaauaaagagaaaaaaacuaa

SEQ ID NO: 356107 - RNA, 64 nt, Human
ccaaaguugaagagcccaggaaacgggaaacuguauccauaaugcugaccaaauaugcagccua

SEQ ID NO: 356108 - RNA, 64 nt, Human
agacaaacaaggacuuuuuuuuuuauauagagccauccauaaaauccuaagcccuuuuauuaau

SEQ ID NO: 356109 - RNA, 64 nt, Human
uugauacauaguuguauauagaaaaugcuaaagaauccauaaaaaguaauaaaugaguucaaca

SEQ ID NO: 356110 - RNA, 64 nt, Human
aucaagcuuuggggcucuguggggcacaugauuuauccauaaaggagaugcaguaugcuuacuu

SEQ ID NO: 356111 - RNA, 64 nt, Human
gauucuguuagaugauaugucugacccaaauuuaauccauaauaaaaaaaaaugggagauuguu

SEQ ID NO: 356112 - RNA, 64 nt, Human
gcaaaauaucuugagagcaguuuuuauauggauuauccauaaaaugaccuuuacauaucccugc

SEQ ID NO: 356113 - RNA, 64 nt, Human
ucuucugaacuguaauacauaucacaaaaaguacauccauaauucagggcaauugucagucuuu

SEQ ID NO: 356114 - RNA, 61 nt, Human
gggggaugugcacggcagcuugagccugucacguggucaaggcccggccccaucagaggcu

SEQ ID NO: 356115 - RNA, 61 nt, Human
gcuugcagagcaugaccugaggagggaggaacguggucaacucacaccugccucuuccugc

SEQ ID NO: 356116 - RNA, 61 nt, Human
cucugaacauguauguugcccauggugggagcguggucacugugcaguugugcacagaugu

SEQ ID NO: 356117 - RNA, 64 nt, Human
auuuuuuccagaugcaguaaaaguaaaauauuuaauccauaauuaagucuaugcaaauaucaga

SEQ ID NO: 356118 - RNA, 64 nt, Human
uuucauauuucaucuuugaaaaagucugagaaaaauccauaauauuuucugguaugaaaguuug

SEQ ID NO: 356119 - RNA, 64 nt, Human
ucccaacccugcccccaaucuccccucaacuccaauccauaacccccuucaaaccauccucaac

SEQ ID NO: 356120 - RNA, 64 nt, Human
caguaacgcuacaacgauugcaaaucauuggagaauccauaaugaagagagaucuuccgagugu

SEQ ID NO: 356121 - RNA, 64 nt, Human
cacggauccugcagagcgugucaggaaugaaaccauccauaacugccagugcccuuucacagcu

SEQ ID NO: 356122 - RNA, 64 nt, Human
cauggauccugcagagcaugucaggagugaaaccauccauaacugccagugcccuuucacagcu

SEQ ID NO: 356123 - RNA, 64 nt, Human
caguaaugcuacaacgauuacaaaucauuggagaauccauaaugaagagagaucuuacaagugu

SEQ ID NO: 356124 - RNA, 64 nt, Human
caguaaugcuacaaccauugcaaaucauuggagaauccauaaugagagaucuuacaaguguaau

SEQ ID NO: 356125 - RNA, 64 nt, Human
uguaggaguuacuagguuagcaauuaguccauacauccauaagccugaugaguugaaauugcag

SEQ ID NO: 356126 - RNA, 64 nt, Human
ugagugcuuuaccuuuaaaaucauucccuuucccauccauaaggugcaguaggagcaagagagg

SEQ ID NO: 356127 - RNA, 64 nt, Human
gcuuagcaacaacaacaaaaaauugcucucucagauccauaauccauacucagugaaagcaggg

SEQ ID NO: 356128 - RNA, 64 nt, Human
ggagacgguguugcagagacgcaagggagaagaaauccauaacacccccaccccaacaccccca

SEQ ID NO: 356129 - RNA, 64 nt, Human
gcacguggcacuaaaagucauuuuucuucuguggauccauaagaggaacauuuccucaguguag

SEQ ID NO: 356130 - RNA, 64 nt, Human
ccaaauaaauugcaagcauucuauccaaauggacauccauaaaaauucaucagagagcauuuua

SEQ ID NO: 356131 - RNA, 61 nt, Human
cccauccaagcgcuguuggggcugguggugacguggucacauguccuggcauaucuggggc

SEQ ID NO: 356132 - RNA, 61 nt, Human
ccaugacaacugccgggagggccacgcaggucguggucaccugccagcgacugucucagac

SEQ ID NO: 356133 - RNA, 61 nt, Human
ggcugagccccuugcccccgacugacccccacguggucacuuuucucaucagucacaauag

SEQ ID NO: 356134 - RNA, 64 nt, Human
uucuccacggugguccccaaaacacugucugcauauccauaagaauugagcgcuauggguguua

SEQ ID NO: 356135 - RNA, 64 nt, Human
cugaggagugugugauguguuuccauauaucuauauccauaacucugauuaugaauacagauau

SEQ ID NO: 356136 - RNA, 64 nt, Human
acccacagugucauggaaucuucucugaaaacuaauccauaaaguucccuggagaaauugguca

SEQ ID NO: 356137 - RNA, 64 nt, Human
uguuuaccaucauuugcaaaaagguaccaaaaaaauccauaaauaaauauggaauacauucaua

SEQ ID NO: 356138 - RNA, 64 nt, Human
aaaccacauguucugucugagccucaguuuuccuauccauaaaaugaagguagccaggccugcc

SEQ ID NO: 356139 - RNA, 64 nt, Human
aggaaacuauuuugaauguucucuuuggcaacuuauccauaauuugggaucaaauguuaaaacc

SEQ ID NO: 356140 - RNA, 64 nt, Human
ggugggguggaugggaaggcccacagcccaagggauccauaauaauaauugcuuggccagccau

SEQ ID NO: 356141 - RNA, 64 nt, Human
guuaguggggacccaaagauucuagugagucaacauccauaacucuguaucuaguuguauuauu

SEQ ID NO: 356142 - RNA, 64 nt, Human
gcccauuuccuuguguacauccugucccugccacauccauaagcuccugagagaaaggucugac

SEQ ID NO: 356143 - RNA, 64 nt, Human
uaugcauauuuauagaguuauuauaguuauucaaauccauaagcagguuauuuuuauuuuuuua

SEQ ID NO: 356144 - RNA, 64 nt, Human
aggugugauacaacuuaacaggaaucaucgauucauccauaaauaauauaaggaaaaacuuaug

SEQ ID NO: 356145 - RNA, 64 nt, Human
auuuuguaacaaauagcagacaucugaucauuuuauccauaaauauucuuuauauaucucugaa

SEQ ID NO: 356146 - RNA, 64 nt, Human
gggacagaguuagaaaacugggaaugaauaagacauccauaacuacuauucuuuuuucacuguu

SEQ ID NO: 356147 - RNA, 64 nt, Human
gcuguauauaguucaauucauaauuaucgcaauuauccauaacauuuauauagcgguguaauaa

SEQ ID NO: 356148 - RNA, 61 nt, Human
uuggccaggugugauuuuuacacaagguaaacguggucaagggcaucggggaauuugcucc

SEQ ID NO: 356149 - RNA, 61 nt, Human
caaugcccugguuuuccugcuugaaucuguucguggucaaagguuugggggaauuugugac

SEQ ID NO: 356150 - RNA, 61 nt, Human
auccugguguuccucauuccucccaccuucccguggucauuuuaauuacggggcaguguca

SEQ ID NO: 356151 - RNA, 64 nt, Human
ggugacaaguucuuggacuuugccccgaaagcacauccauaaaagacaaaaucugauauauugg

SEQ ID NO: 356152 - RNA, 64 nt, Human
gauguccuacaacagguacaugguuaaacaaaccauccauaacuuggaauacugcucuggaaug

SEQ ID NO: 356153 - RNA, 64 nt, Human
acugaagucagggacauugccagcuccagaaaacauccauaacauaguaaagacuuucuacacc

SEQ ID NO: 356154 - RNA, 64 nt, Human
aacaaaaaagaaacaagguuuauauuaaauggaaauccauaaaccacaauuaauccuauuuugu

SEQ ID NO: 356155 - RNA, 64 nt, Human
gguaugauacaacuuuaacaggagucaucaauucauccauaaauauaaaaagggaaaaaaacuu

SEQ ID NO: 356156 - RNA, 61 nt, Human
cuaacacccuggugcccugcaccagacaggccguggucaggcccaggccaccggccggguu

SEQ ID NO: 356157 - RNA, 61 nt, Human
auauaaacauuuuuuaguuuuuaaaauauuccguggucaaaauucuuccucacuauaauug

SEQ ID NO: 356158 - RNA, 61 nt, Human
ccacaugccagugugaaaugggcaucuaugacguggucaggguguccauuccuaaucaugg

SEQ ID NO: 356159 - RNA, 61 nt, Human
gagucacaucuuagcuuuugcacaaggcauucguggucaggaauagguuagggaaugguca

SEQ ID NO: 356160 - RNA, 61 nt, Human
uccuggcacccuugaggucucuccuuugagccguggucaccgagaggguugaggacgcagc

SEQ ID NO: 356161 - RNA, 61 nt, Human
gagcauuuggcaaucaaggccccagagucuccguggucagauccuccucuuugggagucca

SEQ ID NO: 356162 - RNA, 61 nt, Human
gaugcgaacuuaaaaucuggauucacagaaccguggucacauuuccccaucaaaaucccca

SEQ ID NO: 356163 - RNA, 61 nt, Human
ccagaagcccauaguaaagaaaaugacagaucguggucagcagacucuuaucaaauuggua

SEQ ID NO: 356164 - RNA, 61 nt, Human
ucacccuccacuucccgucucagaaucuaaacguggucaccuucgaguagagaggcccgcc

SEQ ID NO: 356165 - RNA, 61 nt, Human
agaugcccucgccugagccgucugggccuaccguggucacugcguagccucuuuuucuucu

SEQ ID NO: 356166 - RNA, 61 nt, Human
gugcacugccccaaagugagaacuugcucuacguggucaggaaagagcagggagaccaagc

SEQ ID NO: 356167 - RNA, 61 nt, Human
aucaggaguuuuauaaaacaacauuuuuagacguggucaucuuuuauugguuuccaucauc

SEQ ID NO: 356168 - RNA, 61 nt, Human
acgacgauggcaccugaccaggugacgugggcguggucaccucaccugcaaggcuuugugg

SEQ ID NO: 356169 - RNA, 61 nt, Human
cuguacuguguucuucacagacccuuuguagcguggucaggucugcuguaacauuucccac

SEQ ID NO: 356170 - RNA, 64 nt, Human
accuucucauucuccuauccagggauuuaaucagcagaauuacuuuuugauaggggagguauaa

SEQ ID NO: 356171 - RNA, 64 nt, Human
auaauacaguaucucagggccuggucguuuucaacagaauuauaauuaguuccucauuagcauu

SEQ ID NO: 356172 - RNA, 64 nt, Human
uaguacagguaagggggaaauuguaaagaauuagcagaauuaggcauauguacaaaaccaaaau

SEQ ID NO: 356173 - RNA, 64 nt, Human
uugucucaggagaagaaaccuuucuccaauguagcagaauuauccucuucccuguauuauagca

SEQ ID NO: 356174 - RNA, 64 nt, Human
ccaauauagugaaacacugucuguacuaaaaauacagaauuagccgggcauggugcaugccugu

SEQ ID NO: 356175 - RNA, 64 nt, Human
acugauucucuuugacucauuugagacuaaaaugcagaauuaccaacauuuaaaacauauauau

SEQ ID NO: 356176 - RNA, 64 nt, Human
agauaaaauuggacuucauuuaguaucuuuuuaacagaauuacuuggaauaaugagauacaaua

SEQ ID NO: 356177 - RNA, 64 nt, Human
ggaugaguaaaugguggaggaugggagucaaaaucagaauuauagaagaaguauuuccuguaac

SEQ ID NO: 356178 - RNA, 64 nt, Human
cuuaccuccaucaugcaauuuugaaaauuguguccagaauuaaaagugcauagaaauagccuuu

SEQ ID NO: 356179 - RNA, 64 nt, Human
uucauugugaucugagcccugcacgcugggccuucagaauuaauggccagcagugucagggaug

SEQ ID NO: 356180 - RNA, 64 nt, Human
aacauaguuuucuauuugucuuuauuucaaguaccagaauuacaaaauaucuaaguaauauauu

SEQ ID NO: 356181 - RNA, 64 nt, Human
acagugcucugccucuaacucccuccucacacuccagaauuacccuuccucaucugugccuguc

SEQ ID NO: 356182 - RNA, 64 nt, Human
ggagaaauuauauuuaacuaaguaaaaguuaagucagaauuacuugggugaugugauucaauuu

SEQ ID NO: 356183 - RNA, 64 nt, Human
uguaacacuaugcucaugcuaagaaccgacauaacagaauuacugaaauaaaugugcugugagg

SEQ ID NO: 356184 - RNA, 64 nt, Human
cuuuucaucuaggauagauucaagaccuuuaccucagaauuauguaaacugugauuguguuuua

SEQ ID NO: 356185 - RNA, 64 nt, Human
ccaaguuccucccagauuaaacuucccagguguucagaauuacuuuugcucuucucacgauccc

SEQ ID NO: 356186 - RNA, 64 nt, Human
aggcugcugugguaauucuauuuguauaucucaacagaauuaaaaugucuagcuuggugguauu

SEQ ID NO: 356187 - RNA, 64 nt, Human
aggaacaguaccuuggcuuggcucuugacguggacagaauuaaaaaggaccaagaagaggaaga

SEQ ID NO: 356188 - RNA, 64 nt, Human
acaccacauggugguguccuuggaucucacuguacagaauuagcaguguauaaccaucuucucu

SEQ ID NO: 356189 - RNA, 64 nt, Human
uaaguggaauuuagggcauagcugaaaggggaaacagaauuaaagacaccagaaguagcagaga

SEQ ID NO: 356190 - RNA, 64 nt, Human
auuuauuaaauauuugggguuuugguuuuaaagccagaauuacggcuagcaccuagcauuucag

SEQ ID NO: 356191 - RNA, 64 nt, Human
ccaacacggagaaaccccgucucuacuaaaaauacagaauuagucaggcgugguggugggcgcc

SEQ ID NO: 356192 - RNA, 64 nt, Human
caagaggaagggcagguacuagguguuucauuuccagaauuaaaaaaaaaauccauuuaagacg

SEQ ID NO: 356193 - RNA, 64 nt, Human
ccaguauucauuuaagaggcaauaaggcaaaugccagaauuaaaaaaaaaaaucaucaaagaca

SEQ ID NO: 356194 - RNA, 64 nt, Human
gggcccuaagcuuugucgcagaugucaucauuggcagaauuacuugucuugaaaaauaaguagc

SEQ ID NO: 356195 - RNA, 64 nt, Human
ugaagaacaucugggguggacccaucacuuuggacagaauuaggaccugguucuggaccaagug

SEQ ID NO: 356196 - RNA, 64 nt, Human
aucuaaucugcaggaagaauuuucuuccccaaaacagaauuauaaaagcuuacuuuaaacagga

SEQ ID NO: 356197 - RNA, 64 nt, Human
ucuauuucaccaucuacagaagagaaauacuucacagaauuauuguggggauuaaguuagauaa

SEQ ID NO: 356198 - RNA, 64 nt, Human
aguacauggggagauggggaguuuuuuugaaaaccagaauuacaguucucauuucacuacuuac

SEQ ID NO: 356199 - RNA, 64 nt, Human
ucaucugucaaauggaaccaauucugcuuggcuacagaauuauugugaggauaaaaucauauau

SEQ ID NO: 356200 - RNA, 64 nt, Human
aucuuuguagaguuaauuuuauggaaauuaaaaucagaauuaaaugcuauguugugaugucuuu

SEQ ID NO: 356201 - RNA, 64 nt, Human
caacauggagaaacccccaucucuacugaaaauacagaauuagccaggcaugguggcacaugcc

SEQ ID NO: 356202 - RNA, 64 nt, Human
ugguggaagaauuccccaccagaucuccuugaagcagaauuagggaucagcaucauuaacaccu

SEQ ID NO: 356203 - RNA, 64 nt, Human
ccaaaaugaagauuuccuucagaagucuuguuagcagaauuauuuaucagucacagagagaaaa

SEQ ID NO: 356204 - RNA, 64 nt, Human
auaccacuugcuguaggcuguggaccaagauguccagaauuauucuugagcacugauguaaauu

SEQ ID NO: 356205 - RNA, 64 nt, Human
ucuccaguuuacccuucagguugguuuaaucaaucagaauuagagcaugggaggucaucacuuu

SEQ ID NO: 356206 - RNA, 64 nt, Human
aaugaacauuaucuuagacuugcaguuguacugccagaauuaucuacagcacugguguaaaaga

SEQ ID NO: 356207 - RNA, 64 nt, Human
cugcuuuuucuucuguauuucuagguacaaauaccagaauuauacuugaaaauacaguuggugc

SEQ ID NO: 356208 - RNA, 64 nt, Human
cuguuucgcacagaguacuaugacaaggaaacaucagaauuacuaaucuagcuagugucauuua

SEQ ID NO: 356209 - RNA, 64 nt, Human
uauuaguucccuuaacaaaauccuaacuguauaccagaauuaggucacugaaagaacuugauuu

SEQ ID NO: 356210 - RNA, 64 nt, Human
agguuugugcugagcuccuugauugccuuagggacagaauuaccccagccucuugagcugaagu

SEQ ID NO: 356211 - RNA, 64 nt, Human
ugaugucuuuccuuauguugcuuuuucaacauagcagaauuaauguagggagcuaaauccagug

SEQ ID NO: 356212 - RNA, 64 nt, Human
acugggcaagcauggaugacauauuaauauuugucagaauuaagugacucaaagugcuaucgag

SEQ ID NO: 356213 - RNA, 64 nt, Human
uaaaaaacaauuaccuggugagaaguugcauaaacagaauuagguaguauauugaagacagcau

SEQ ID NO: 356214 - RNA, 64 nt, Human
uucuuuugcuuuccaugcauuugcacaaaacaaccagaauuaaagauuccacaaccaagaucug

SEQ ID NO: 356215 - RNA, 64 nt, Human
cuuucaaauugugugugcucugcuucaauguagucagaauuagcugcuucuauguuucauaguu

SEQ ID NO: 356216 - RNA, 64 nt, Human
uagcgguaccaugauagaauacugcaauuguggucagaauuacaguaugcacaaagaauuaauu

SEQ ID NO: 356217 - RNA, 64 nt, Human
agcccucagcccauagguguuuuuuguuuuuuaacagaauuauauaugucugggggugaaaaaa

SEQ ID NO: 356218 - RNA, 64 nt, Human
uuuaaaauguauuuaccuguuaguuggaaguacccagaauuaucagaaacgaaugcaaaaaaaa

SEQ ID NO: 356219 - RNA, 64 nt, Human
gauguacagggguuaaguccuauggaagaaacagcagaauuauucaaaauuauuuacauaaugu

SEQ ID NO: 356220 - RNA, 64 nt, Human
guccaauuguauucacagaaccaccaucaauucacagaauuacagucaacguugguacauuuuc

SEQ ID NO: 356221 - RNA, 64 nt, Human
gaaaacacugcccugccuaggcauacccccuuuccagaauuaacuuuccauuuaauucuauagu

SEQ ID NO: 356222 - RNA, 64 nt, Human
aguccugaacgcuacggggaaaaugcauuuucuucagaauuauccauuacgugcauuuaaacuc

SEQ ID NO: 356223 - RNA, 64 nt, Human
ucacugucauuuagcauuuaauaacaaaacuauacagaauuaugugcauaccaaugaauguuuu

SEQ ID NO: 356224 - RNA, 64 nt, Human
auuauuuguaacuccaaaauagaaaugacaauuucagaauuaccuaacaaacaguguauuuauu

SEQ ID NO: 356225 - RNA, 64 nt, Human
uauuuauaaacaccacaagaagaucucuugggaucagaauuauauaauaucuuugaaguaaauu

SEQ ID NO: 356226 - RNA, 64 nt, Human
ucaaagcuuguuaucuuuucugaccauuuuaguacagaauuaguacuuggugguuacuaacauc

SEQ ID NO: 356227 - RNA, 64 nt, Human
cuauugucuaauaggagaaauaucuucccgagcucagaauuaaaaguucuccuaaauuaugaag

SEQ ID NO: 356228 - RNA, 64 nt, Human
uucaccuaagagauucugauuugccacugauauucagaauuaugauggaagacaggaaaguuca

SEQ ID NO: 356229 - RNA, 64 nt, Human
ccucaucccccuguuacccuugccaaagccccugcagaauuaccuacuuuuggagccacagggu

SEQ ID NO: 356230 - RNA, 64 nt, Human
agggugaacaaauggggcauucaaguugugagcucagaauuacuuuaaaaggagguaacagcca

SEQ ID NO: 356231 - RNA, 64 nt, Human
cuugucaggguguuugguaagaacuguauauagucagaauuaccuaaaucaccuagagguaccg

SEQ ID NO: 356232 - RNA, 64 nt, Human
uuucaaaguuuaaguagaccuguagaagagcuaacagaauuauauuucuauuuaguuaaaauug

SEQ ID NO: 356233 - RNA, 64 nt, Human
agaagagacuuaugauagagucaaguuucuaauacagaauuauuuuaaguguuuugaacuuaau

SEQ ID NO: 356234 - RNA, 64 nt, Human
gacugcuaggagaacuuguacauuuaugauaaugcagaauuaggaaaacgguucaccaguguuu

SEQ ID NO: 356235 - RNA, 64 nt, Human
uuuuucuuuuaugugaucuuugggaaaacacauucagaauuauaucucguuucuacuuaaaugu

SEQ ID NO: 356236 - RNA, 64 nt, Human
gcagucaagugucugucauguguugauauccacacagaauuaggcccuaaugagagccuuagac

SEQ ID NO: 356237 - RNA, 64 nt, Human
ccaauaaaaacuaugacuuuuccccuugcagaggcagaauuaaagcuaaucuagggacucaaau

SEQ ID NO: 356238 - RNA, 64 nt, Human
gcuucaagagaaaaugcgguuauaaaaaaugguucagaauuaaacuuuuaauucauucgauugu

SEQ ID NO: 356239 - RNA, 64 nt, Human
guccccaagcauuaaagguguggccaugaguuuacagaauuacccacauuccaguugccacugg

SEQ ID NO: 356240 - RNA, 64 nt, Human
uaccaagugaaaauugauguguguuaagaggguacagaauuaucaacugauuuggucaguugcu

SEQ ID NO: 356241 - RNA, 64 nt, Human
guuauugcaaauauuguucugaaaugcuuaacuucagaauuacauuuuuuaaaguaaauaauug

SEQ ID NO: 356242 - RNA, 64 nt, Human
agggccuucacacagacugauguggcuaccuucucagaauuaacaggggaugucaauccuuugc

SEQ ID NO: 356243 - RNA, 64 nt, Human
guaagaccuuaaguaaaaggcacaauggguacuacagaauuaaaauguaggucuaacauaaugc

SEQ ID NO: 356244 - RNA, 64 nt, Human
uacugguuuaauuaagcucucuccugacaacccccagaauuaaaugaaccaugauugugaagag

SEQ ID NO: 356245 - RNA, 64 nt, Human
ugaaugcuguaaguguuguacaugucucugguuucagaauuaaaagaauucagaguuaccuugu

SEQ ID NO: 356246 - RNA, 64 nt, Human
ugucuuuuaagaacuauuugguauuaacuaguuucagaauuaguaaaugugagauucagucaca

SEQ ID NO: 356247 - RNA, 64 nt, Human
gcuuucauacacauugucucaauuccugugaggucagaauuaucucugcauuugaaacuugagg

SEQ ID NO: 356248 - RNA, 64 nt, Human
auaugaaacgcuccccgcaaauucacuggcagcucagaauuauucuggaaagaaagccugccag

SEQ ID NO: 356249 - RNA, 64 nt, Human
cugcuccaaaaagcuggccacaucucugaggugucagaauuaagcugccucaguaacugcuccc

SEQ ID NO: 356250 - RNA, 64 nt, Human
ucggcuucuuuuuuucuuuguuuucuuguaaauacagaauuauuagcuuaaaacuguacuguug

SEQ ID NO: 356251 - RNA, 64 nt, Human
gaauucaagcgugaacccauauugauaagugggccagaauuauuuaggggccuggcuugcugcu

SEQ ID NO: 356252 - RNA, 64 nt, Human
aucacuagaguuauuauauucuguuauguuugaccagaauuauaugacaagaacuggugacagu

SEQ ID NO: 356253 - RNA, 64 nt, Human
aaaguuacugccuaugcuuuuuaccuuaggcuuacagaauuaaauaaaaauuagccauuccaga

SEQ ID NO: 356254 - RNA, 64 nt, Human
caugaagaccaaucucuugaaucccauaucuacccagaauuaacuccauuccagucucugcaug

SEQ ID NO: 356255 - RNA, 64 nt, Human
uaaacaaaaaccuuaauacuuacuaucuucuuuucagaauuaguuuauuuuugucaguuacagu

SEQ ID NO: 356256 - RNA, 64 nt, Human
aucacauugauguuaagcacacaaugggcaaaugcagaauuauaguugggccugagaugucuga

SEQ ID NO: 356257 - RNA, 64 nt, Human
cuugccagugccggcccccggcccaguucagggacagaauuauaguguuugggauucaaaccaa

SEQ ID NO: 356258 - RNA, 64 nt, Human
caugaauuuuugagcauuuguccuaaucugcugccagaauuaaagaccuauuuuuagaggauuu

SEQ ID NO: 356259 - RNA, 64 nt, Human
uccagguccauucuguuuaaaucccuaagaaugucagaauuaaaauaacagggcuaucccguaa

SEQ ID NO: 356260 - RNA, 64 nt, Human
uucuaaauuggugaaaaaagcagcauuagagugccagaauuagcacuggggaaaacuggccagg

SEQ ID NO: 356261 - RNA, 64 nt, Human
cuccugcccgcccccgccguugguuguugguggucagaauuauuguguaauaaauaauagacau

SEQ ID NO: 356262 - RNA, 64 nt, Human
aacucucuuuuaaaaaguacauuuauagauugaucagaauuauaaccauggagaauuuuuucuu

SEQ ID NO: 356263 - RNA, 64 nt, Human
gucaauacaaaaacuuguacacaaauauuuauagcagaauuauucauaauggccaaaagcugaa

SEQ ID NO: 356264 - RNA, 64 nt, Human
cugauacugauuaccaagucauucaccugaacaccagaauuagaauuaaacauuguaccauaca

SEQ ID NO: 356265 - RNA, 64 nt, Human
guaugugcuacuacuaacauucuucauguccaugcagaauuacuuacagacacucuuucuuggu

SEQ ID NO: 356266 - RNA, 64 nt, Human
uggaugucccuugccuagagcaggaaaaaagucucagaauuaccuaaaaacauacuuuauaacu

SEQ ID NO: 356267 - RNA, 64 nt, Human
cucuuaaaauucuuuaucuuuuucuuggcaaaaccagaauuaagaguguaagauagauuccaug

SEQ ID NO: 356268 - RNA, 64 nt, Human
auuuugaaucuuguccauauaggaaaaugaagcacagaauuacucagucuuccauauuguauuu

SEQ ID NO: 356269 - RNA, 64 nt, Human
aaggcaaugaaaaugccuuaaauuuuaucaauaacagaauuauuguauuuaaaaaaaaacuaau

SEQ ID NO: 356270 - RNA, 64 nt, Human
uuucaaggacaguguauuauaacaaucccuuucccagaauuaguuguauaggguuggcccaaga

SEQ ID NO: 356271 - RNA, 64 nt, Human
ucaaugaaaaauguaauuuagaaacugauuucuucagaauuagauggcuuauuuuuuaaaauau

SEQ ID NO: 356272 - RNA, 64 nt, Human
ccaauauuaccaucuuaaucuuuauuuuauuauucagaauuauacagaccuaauaucauuuuau

SEQ ID NO: 356273 - RNA, 64 nt, Human
augccaggcauugaccaguugcaauuuuaugguccagaauuaauauuauuauucguaaacuagc

SEQ ID NO: 356274 - RNA, 64 nt, Human
guuucuucaacucugaaucaaaagcugaaauucucagaauuacaggaaaugcaaaccaucauuu

SEQ ID NO: 356275 - RNA, 64 nt, Human
uacaaagaguuugaacaaaaaaucccuguaagaccagaauuaucuuuguacuaaaagagaaguu

SEQ ID NO: 356276 - RNA, 64 nt, Human
auuuagaauaccaaugauagcuaucuuuaagaaucagaauuaguacuagaaauuuaaaaaaccc

SEQ ID NO: 356277 - RNA, 64 nt, Human
uguuaccuuuuggcuugagaaugucuuucagcuccagaauuauuguuacucauauuuuaaucag

SEQ ID NO: 356278 - RNA, 64 nt, Human
ccgcacuuuguaaucagucccgugguugucuguacagaauuaaacuauuuuccgaugacugcug

SEQ ID NO: 356279 - RNA, 64 nt, Human
ccaggcuuaaccuuccccuguaucuuacucaucccagaauuauuacuggccauuucuaaauaga

SEQ ID NO: 356280 - RNA, 64 nt, Human
aaaauacaucauguggccaaagaaugagaaaggacagaauuaaccaaggauucuuaauuguuaa

SEQ ID NO: 356281 - RNA, 64 nt, Human
cugaauugaagaccacccaucuuccaggcagggccagaauuacagaaaacaauucugguaaaau

SEQ ID NO: 356282 - RNA, 64 nt, Human
aacaagggguaaaaaaaggaaagaaagaaguguacagaauuaacauauaaacuuuguuguaaaa

SEQ ID NO: 356283 - RNA, 64 nt, Human
ggggaguguaaaacugggaaaugcugcucacugacagaauuaaaaaaaaaaauaaccaguauga

SEQ ID NO: 356284 - RNA, 64 nt, Human
uuacagguugacacauugcuugaccugauuuaugcagaauuaauaagcuauuuggauaguguag

SEQ ID NO: 356285 - RNA, 64 nt, Human
ucucaaaugaacuuuuuauagacaaugaugaaaacagaauuaaagucaauguuuccugacuccc

SEQ ID NO: 356286 - RNA, 64 nt, Human
auuuacagugcauucugaaagaggagacaucaaacagaauuaggaguugugcaacagcucuuuu

SEQ ID NO: 356287 - RNA, 64 nt, Human
ugucucaugccagcagcacgucgccauccgucaccagaauuaguccucacagccuaggaccagu

SEQ ID NO: 356288 - RNA, 64 nt, Human
uauuuuccugucuucuuucuccugugguuugcuccagaauuaagguuuguuuuccauccauucu

SEQ ID NO: 356289 - RNA, 64 nt, Human
augggugggccauuugauuguagaggguccaccacagaauuaugggaugccuuaagugcuguua

SEQ ID NO: 356290 - RNA, 64 nt, Human
gauuaugaagcugcuuaaucacucuucauguguucagaauuacuguuuuuuuuguuuguuuuuc

SEQ ID NO: 356291 - RNA, 64 nt, Human
uguacaggaugccaguaaaaaaaaaaaauggcuucagaauuaaaacuaugaaauauuuuacagu

SEQ ID NO: 356292 - RNA, 64 nt, Human
ugcuugugccaagucucauauuucuuugccaucucagaauuaucuuuuuaccaccacuguuuau

SEQ ID NO: 356293 - RNA, 64 nt, Human
uuucugucuguuuugugcuguaccuuuucugauucagaauuauagaaaacuugauaaauacuug

SEQ ID NO: 356294 - RNA, 64 nt, Human
agacacuggucaacaggaaaacaauacagacucccagaauuagaaaguguuauuuuaaugcaac

SEQ ID NO: 356295 - RNA, 64 nt, Human
guuuuuaaauaaugaauauuauuuaauaccacaacagaauuauccccaauuuccaauaaguccu

SEQ ID NO: 356296 - RNA, 64 nt, Human
gcuggggacaaguuucuguugaaacuuuagauagcagaauuauuugcaauuuguagcauagaaa

SEQ ID NO: 356297 - RNA, 64 nt, Human
cucugacaucaccuuguuucaucauuuuuuaugacagaauuagaaacccauccuucaagcacaa

SEQ ID NO: 356298 - RNA, 64 nt, Human
aguaucucaaaaaauauguugcuuugcaacgagucagaauuacuaaucauagaucuugaagaua

SEQ ID NO: 356299 - RNA, 64 nt, Human
agauguguuuucugcccucugacuccagugguugcagaauuagcccaggaacuagaauuggaug

SEQ ID NO: 356300 - RNA, 64 nt, Human
ugaccccuuccucauaguuguuuggcuauugcuucagaauuauguggagucuguuacaagauua

SEQ ID NO: 356301 - RNA, 64 nt, Human
gaauucaguacuuugcuuuaaaaaaauuuuguggcagaauuaaauuucuaauugagcagauuag

SEQ ID NO: 356302 - RNA, 64 nt, Human
agaacuuuauucccuuauauuccugaaaagaaaucagaauuaacauuuuuauguugaauaaauu

SEQ ID NO: 356303 - RNA, 64 nt, Human
aguccaauauagcauuccccaaaugaacagcagccagaauuaggugaaguagcaugauagcagu

SEQ ID NO: 356304 - RNA, 64 nt, Human
ccuuuuuuauaccugccuuaaauaauuuggcaaucagaauuaaaaaguuuuuuuuuuuuuaaau

SEQ ID NO: 356305 - RNA, 64 nt, Human
cuaggaagaaagaauggcacucuugggcuuggcccagaauuagaguuauuagagcaagagagag

SEQ ID NO: 356306 - RNA, 64 nt, Human
aggcugguccuggcugccuguucccugugcucuucagaauuacuguuuuuguuuccuuuuaccc

SEQ ID NO: 356307 - RNA, 64 nt, Human
cauuaggacguuucauuuguugcugaaugcuuuccagaauuauuuauuccauaggguuucucuc

SEQ ID NO: 356308 - RNA, 64 nt, Human
cugaccucaguuucaugaaagaaaguggaagcuacagaauuauuuucuaaaauaaaggcugaau

SEQ ID NO: 356309 - RNA, 64 nt, Human
gccauccauuauuuuaaauaaacuaauagguuuucagaauuaugaauuuuucagaacucaucca

SEQ ID NO: 356310 - RNA, 64 nt, Human
ccucucuauggcccacuuugaccacuaacaacaucagaauuaucuacaucaauuucauugagcc

SEQ ID NO: 356311 - RNA, 64 nt, Human
uuaagaguaauauguagccagauuacuuaaaucucagaauuacuaagcauguggcauaaauuug

SEQ ID NO: 356312 - RNA, 64 nt, Human
ugaaagaauuaucaaagcugauacagcacauauacagaauuagccaaaugguauaagacaauag

SEQ ID NO: 356313 - RNA, 64 nt, Human
agaggcccugaagauagaagccaggcccgaaggccagaauuaaagggguagcuuggccaucagc

SEQ ID NO: 356314 - RNA, 64 nt, Human
cuaaaagaucucugguuggauggaaaucaacugucagaauuaccucagguaagugguaauuuca

SEQ ID NO: 356315 - RNA, 64 nt, Human
aguguuguuuugaccgggagaucuagagagugcucagaauuagggccuggcauuuggaaucaca

SEQ ID NO: 356316 - RNA, 64 nt, Human
uaaaggaacuuuuauuaaagccugagacucaggccagaauuaggagggagcuuuuugaaggaag

SEQ ID NO: 356317 - RNA, 64 nt, Human
cuauaauaaguuccuauagggagacugaggcuugcagaauuaagguucaggggaaauuuuggaa

SEQ ID NO: 356318 - RNA, 64 nt, Human
ucuuucaagcaaaugcaauggcuggaauauaauucagaauuaacugaaacccagccagaagagg

SEQ ID NO: 356319 - RNA, 64 nt, Human
aaucaagaaaaagaacaguaugcauuuaaaaagacagaauuaugaaauuauaugagugcuuaga

SEQ ID NO: 356320 - RNA, 64 nt, Human
gcugacuggaccauaguuguucacuuuugucugccagaauuaaguuaaucugauguucauguuc

SEQ ID NO: 356321 - RNA, 64 nt, Human
ggugccaaaugggacuuuuagauuaaaaaaaaaucagaauuaugcuuaacuuucccuacaaaga

SEQ ID NO: 356322 - RNA, 64 nt, Human
gugcauucuuccagaaagaauucagcaauguuaucagaauuaauucuuuuauaugaguuuaugu

SEQ ID NO: 356323 - RNA, 64 nt, Human
ucuguuuaaaucauuguauaaaguaauugcaggucagaauuauaccacagaacuguuuaugaga

SEQ ID NO: 356324 - RNA, 64 nt, Human
uuguacuaaauacauuuuuuuucugauuagguuucagaauuauaauuaaaauguuuugcugaaa

SEQ ID NO: 356325 - RNA, 64 nt, Human
ucagcaccgaucggaacuguaaagcuauaauccccagaauuaaaguuuuuauuauuuuuuauac

SEQ ID NO: 356326 - RNA, 64 nt, Human
ucuuuguagaugauguauuuugcuugggcaccaacagaauuaaaaacgaaaaacaaaaaaaaac

SEQ ID NO: 356327 - RNA, 62 nt, Human
auguauaauaguguuaaauugauuaaaaaucuuccagaauuaauauucccuuuugucacuuu

SEQ ID NO: 356328 - RNA, 64 nt, Human
uguauaaauguuaaaugauauuaaauaugaacaucagaauuacuuugaaggcuacuauuaauau

SEQ ID NO: 356329 - RNA, 64 nt, Human
uaagccuuaaaaagucauagauuugugcugcugccagaauuauauuaauuauuauuaauguuau

SEQ ID NO: 356330 - RNA, 64 nt, Human
ccguguggcccaccccaggcacggcucauuccuccagaauuauagaagcucagccuggccugcu

SEQ ID NO: 356331 - RNA, 64 nt, Human
ucuucaucaacaucuguaucuuuccagagguauacagaauuaaaauuugaucuucaagcuuuaa

SEQ ID NO: 356332 - RNA, 64 nt, Human
gccuuggcagcaaguauuuauuguugacauuauucagaauuagugauaauaaaaagcagaguga

SEQ ID NO: 356333 - RNA, 64 nt, Human
ucaaagguaggcagaggcaggaaaagcaaggagccagaauuaagagguugggucagucugcagu

SEQ ID NO: 356334 - RNA, 64 nt, Human
uuuguguauuuuguaggguucucuguuuugaagacagaauuauguuacaaauguuuuuguugua

SEQ ID NO: 356335 - RNA, 64 nt, Human
gcaggugcuugaguuucaccuuucuccaguccagcagaauuacauuuugaugaccuccauuuug

SEQ ID NO: 356336 - RNA, 64 nt, Human
ucugaugucuuccugcauauuaaggaugaaucuacagaauuagaucaauaaggaucaacaaaua

SEQ ID NO: 356337 - RNA, 64 nt, Human
uaauagccaaagauuucauaucuaacuuuguaaccagaauuauacaguaaguugacaccacuua

SEQ ID NO: 356338 - RNA, 64 nt, Human
uacacaucuuaaaaguguguaaaugcuuaaauuucagaauuaccaucagaaccucaauugacau

SEQ ID NO: 356339 - RNA, 64 nt, Human
aaccuucuaaaaaguagacuaaggaaaccauaaucagaauuacuaugucuuuugauucccaaug

SEQ ID NO: 356340 - RNA, 64 nt, Human
uucuaauuugaccagauuucuuaaugaauagacacagaauuaacuaaaaacagucucaccccau

SEQ ID NO: 356341 - RNA, 64 nt, Human
aaucauaguuuaaacugcauuauaaauuuuauaacagaauuaaaguagauuuuaaaagauaaaa

SEQ ID NO: 356342 - RNA, 64 nt, Human
augacauuuauucaaaguuaaaagcaaacacuuacagaauuaugaagagguaucuguuuaacau

SEQ ID NO: 356343 - RNA, 64 nt, Human
aguggauauagauaacugcauaaaugaauaaauucagaauuaacuccuucaauauuucuaguag

SEQ ID NO: 356344 - RNA, 64 nt, Human
acagacaucuuucuuaagccgagagcugucuuugcagaauuaucuuauuaaaaaaaaauacaaa

SEQ ID NO: 356345 - RNA, 64 nt, Human
uguucuuuuuuugccgcagccaauaagauaauagcagaauuagccaauccuaaaaccuucuaaa

SEQ ID NO: 356346 - RNA, 64 nt, Human
uaaaacuaaaaacaaggaaauguaccucuuucuucagaauuaaaacuaaaaucuuaaauaaaac

SEQ ID NO: 356347 - RNA, 64 nt, Human
ucccauguccucagacccagcaaaagcguagaggcagaauuagaggccucuccaggccagcucc

SEQ ID NO: 356348 - RNA, 64 nt, Human
guacaauucugaaauaaccugggaauauugaaugcagaauuauguaagaaguaauaagauuaaa

SEQ ID NO: 356349 - RNA, 64 nt, Human
uaauguuuucaacuaaauuuuuuuuuuacuuucucagaauuaccuaaauguuuuguagaguuuu

SEQ ID NO: 356350 - RNA, 64 nt, Human
aucaccagccguaguugauagaaaauauuaguuucagaauuacccuccuuuaaaaaauaagaga

SEQ ID NO: 356351 - RNA, 64 nt, Human
uaacauucugguagcucaguuaauaaaacaauuucagaauuaaagaaauuuucuaugcaagguu

SEQ ID NO: 356352 - RNA, 64 nt, Human
auuuggucuucauuauuuuauauucugauuuuaucagaauuauucuauuuuaaaauuguuuuaa

SEQ ID NO: 356353 - RNA, 64 nt, Human
uuuuggauagucuugugauucucagacuaacuuccagaauuauacuuuaaccccucccagauau

SEQ ID NO: 356354 - RNA, 64 nt, Human
ugguauguuauuaugauguacuagcauuuauuuacagaauuauuuauuaacguuuacuuccuuc

SEQ ID NO: 356355 - RNA, 64 nt, Human
cauauaggacaucaauuucuaacaucugauauaccagaauuauuuccaugcaauuauaagggga

SEQ ID NO: 356356 - RNA, 64 nt, Human
aaaaagggaugcuuuuauauauuuuucuuuuccccagaauuacuuagauuaauuagauguauag

SEQ ID NO: 356357 - RNA, 64 nt, Human
acuaaauacaaauauaugcauuguguaauccacucagaauuaaacagacaaaagguaugcuugc

SEQ ID NO: 356358 - RNA, 64 nt, Human
caugaaucggagacuaacaaaguuuucaugugcucagaauuauuaauuaucgugucugcauuuu

SEQ ID NO: 356359 - RNA, 64 nt, Human
uuccucguggggcacuauuugcgacauaggccuacagaauuagacuuucauacuuagaagauaa

SEQ ID NO: 356360 - RNA, 64 nt, Human
uuggaacaguccccugaagaccaauguuggucggcagaauuagcaaacuggcaaaaucacauug

SEQ ID NO: 356361 - RNA, 64 nt, Human
auucauggagccaucauaaaaauauuuuuaaaaucagaauuauugauacccuguagugcaaaau

SEQ ID NO: 356362 - RNA, 64 nt, Human
ccaagucauuucuuuuuucaucucuauuuagcaacagaauuaaguggaugaagauauucuacua

SEQ ID NO: 356363 - RNA, 64 nt, Human
agaaggaugcacaaauaaguaauggaugagcaaacagaauuaccugagcuaacuucaagguggu

SEQ ID NO: 356364 - RNA, 64 nt, Human
gccuauggcuuuaagcaagcacuacugcacuuuacagaauuaccccacuggauccuggacccac

SEQ ID NO: 356365 - RNA, 64 nt, Human
agagcugcuaguaaaaagaagaccagaugcuucacagaauuaucauuuuuucaacuggaauaaa

SEQ ID NO: 356366 - RNA, 64 nt, Human
uuucuccugcccugcuugccggcaugaucuuggccagaauuacaucaugauucccaaugagauu

SEQ ID NO: 356367 - RNA, 64 nt, Human
cuccuuucaacauacuuaggcuguggagugcaagcagaauuaugcauagaaauuguggcagggc

SEQ ID NO: 356368 - RNA, 64 nt, Human
ucaggaacauggagcaggcagggacuccauuuuacagaauuacugagauuucucaguuguaaaa

SEQ ID NO: 356369 - RNA, 64 nt, Human
ugagcacaguuauggcagagaaguuucuccgcaccagaauuauccacagcaacuuggcugagcc

SEQ ID NO: 356370 - RNA, 64 nt, Human
gggacuggguuagaggagucuguggcuuuuuguucagaauuaagcagaacacugcagucagauc

SEQ ID NO: 356371 - RNA, 64 nt, Human
cugagaauuuauuuuuguuucauugguuguuucacagaauuagaacacacacgacuuuuuauuc

SEQ ID NO: 356372 - RNA, 64 nt, Human
caacagucuucuguccuaauuugcauucucaaugcagaauuauugggucuuucauaaauaacau

SEQ ID NO: 356373 - RNA, 64 nt, Human
uuuaaaauuugaaucuauuugagcuuuaguucagcagaauuaaauuuuuacuugacauuaucau

SEQ ID NO: 356374 - RNA, 64 nt, Human
ugugggaugugguuucugccuucuagagagagaucagaauuaaacuaguacuaugaaauguccu

SEQ ID NO: 356375 - RNA, 64 nt, Human
uccaccaggccuuggagacaggcuagccuggccacagaauuaaacguguugccacaccugccgg

SEQ ID NO: 356376 - RNA, 64 nt, Human
aauagacaaagugaagccgcagacagcaguccuucagaauuaaaauacuuaggcuuggauacuc

SEQ ID NO: 356377 - RNA, 64 nt, Human
cuaacaaagucacuaacaaaugcauuauuuucuacagaauuagauguuaguaguacaguacugc

SEQ ID NO: 356378 - RNA, 64 nt, Human
gcuaagcaguuuauaguucuucuccauguuucuccagaauuaaucaguguuaguccucuguuua

SEQ ID NO: 356379 - RNA, 64 nt, Human
aaugguuuguagcagagaugacauuguagcaacccagaauuaugcuuuuggaaugugguccuca

SEQ ID NO: 356380 - RNA, 64 nt, Human
cccaauugacucagaguuugaggaguuaguaucacagaauuagauuuuuuuaaagcauuuguac

SEQ ID NO: 356381 - RNA, 64 nt, Human
aaaauuugugcucuuucauuugcuguuagaaaaacagaauuaacaaagacaguaaugugaagag

SEQ ID NO: 356382 - RNA, 64 nt, Human
guuuuuuguaccacuauaaucucuaauacuuacucagaauuacuguguauuuacuuaauuucuu

SEQ ID NO: 356383 - RNA, 64 nt, Human
gcuugaagcagccaagaaccacaugggcauugcccagaauuacaggaguuagcacaccagcucu

SEQ ID NO: 356384 - RNA, 64 nt, Human
cauaaguuguacaaccaucaccaccauccaucuucagaauuauuuucaucuuauacaauugaaa

SEQ ID NO: 356385 - RNA, 64 nt, Human
gagugugucucaugcuuucagaugugcauaugagcagaauuaauuaaacauuugccuaugacuc

SEQ ID NO: 356386 - RNA, 64 nt, Human
cuaaguagacagauauuuguacugaagucugauacagaauuagaaaaaaaaaauucuuguugaa

SEQ ID NO: 356387 - RNA, 64 nt, Human
uuuuaagucauuacugaguuacuuguuacccuuacagaauuaagaaaaauagcacaguaugaca

SEQ ID NO: 356388 - RNA, 64 nt, Human
gaaauguuauaaaguagaacuaaauauaaauuuucagaauuaaugcauucaaaguaauauauca

SEQ ID NO: 356389 - RNA, 64 nt, Human
uuuaauuuuccuacaaaguccuuuuuggaaguugcagaauuauuagcuuugaugagaacaacuu

SEQ ID NO: 356390 - RNA, 64 nt, Human
aauaguauuuaccaguuagcaaagucuguguuuucagaauuacagugagcacagagguguucau

SEQ ID NO: 356391 - RNA, 64 nt, Human
ucaaugaaaaagauguacguuguagacaaaguugcagaauuaaaaaaagaaaucugcuuuuaau

SEQ ID NO: 356392 - RNA, 64 nt, Human
uauccuuuuauucaugugggacaugagcaaauggcagaauuaggggcgagugcuuucaaugcuc

SEQ ID NO: 356393 - RNA, 64 nt, Human
ugcuuuaaaaaaaauaaaagauaaugauuuauugcagaauuaugauucuauuuucucaauaugu

SEQ ID NO: 356394 - RNA, 64 nt, Human
uuuggaaacuucuuuccaccauucaggagguuaucagaauuaauaaaaguaucuguuaugugca

SEQ ID NO: 356395 - RNA, 64 nt, Human
cugcacuugauguuuguuugcaugaugucuaccucagaauuaaaacuuuaaggaagaagaaacu

SEQ ID NO: 356396 - RNA, 64 nt, Human
aaguauauauauccauucuguauuuuacgugcagcagaauuaucuuccguaggauuuuuuugug

SEQ ID NO: 356397 - RNA, 64 nt, Human
cauauuguguguaauguuguaugucuuguuuacucagaauuaagucugugagauucauucaugu

SEQ ID NO: 356398 - RNA, 64 nt, Human
guccuuucuuugugcuaagguucuugcggugaaccagaauuauaacagugagcucaucugacug

SEQ ID NO: 356399 - RNA, 64 nt, Human
ucagauuuuaccacuaucaaauauaauucaagggcagaauuaaacgugagugugugugugugug

SEQ ID NO: 356400 - RNA, 64 nt, Human
gaaaaccucuaaauuucaaaauuaugaagaauuacagaauuacucauuuaagguacuuuaaaag

SEQ ID NO: 356401 - RNA, 64 nt, Human
uguguacggaaccccuggcugucugcauauaucucagaauuaccccaggaccauugucccaaag

SEQ ID NO: 356402 - RNA, 64 nt, Human
uggcucacccaagcucucccuuacagaggcaacacagaauuauaaggaaucagaaaucccccuu

SEQ ID NO: 356403 - RNA, 64 nt, Human
uaauaaaaaauuuuaggagaauuugagaaguuuacagaauuacuuauucauuguuuucuuagua

SEQ ID NO: 356404 - RNA, 64 nt, Human
agaacauguccaaaauggauucuugucuccucuucagaauuagccauuuaaaauauuuucugug

SEQ ID NO: 356405 - RNA, 64 nt, Human
gccaugcuggaaaauaauacugcugagauacauacagaauuacuguaacugauuacacuuggua

SEQ ID NO: 356406 - RNA, 64 nt, Human
guaagaaaacauuugucagauuuaaaugauaucacagaauuaauguuggauagaaauaucauug

SEQ ID NO: 356407 - RNA, 64 nt, Human
cuuuauuuaaaucugaacaauccuacagggaaaucagaauuaggaaaaaaaucuggagaacaau

SEQ ID NO: 356408 - RNA, 64 nt, Human
uacaauagaagacauuuucacuggaauuacaaagcagaauuaaaauuauauuguagaaggaaac

SEQ ID NO: 356409 - RNA, 64 nt, Human
uuuccaaaauagucaguaaaggaucuaauagaaccagaauuauuugggugaauucugcagguuu

SEQ ID NO: 356410 - RNA, 64 nt, Human
agaaaauguccucauuaaaguauuaaagugugggcagaauuacaauuacaaagugccagccacc

SEQ ID NO: 356411 - RNA, 64 nt, Human
uuuuaauauggcugaaagcaaaggauaacgaauucagaauuaguaauguaaaaucuugauaccc

SEQ ID NO: 356412 - RNA, 64 nt, Human
acaucagaaccuuggaagcugcugcugcugcuuacagaauuauauuuuuuucuuuugaagaguu

SEQ ID NO: 356413 - RNA, 64 nt, Human
agaagcagcuugcugagccccuccgagcgguccccagaauuagcugguucacaacccccacccu

SEQ ID NO: 356414 - RNA, 64 nt, Human
aauaagagccugcccaagacuuugggccucuugacagaauuaaccacuuuuauacaucugaguu

SEQ ID NO: 356415 - RNA, 64 nt, Human
ggaauuucaggugggcugggcggggccccgaucccagaauuaucaacuccacccaucaucauuu

SEQ ID NO: 356416 - RNA, 64 nt, Human
cagggacagugacauuucuguagucccagaugcacagaauuaugggagagaauguugauuucua

SEQ ID NO: 356417 - RNA, 64 nt, Human
ucucaauuuaucaauggauacgugcauguuauuucagaauuaugcaaaacgucaaaaucugcuu

SEQ ID NO: 356418 - RNA, 64 nt, Human
cuuacaaauagauuuccaugaagauauuugucuucagaauuaaaacugcccuuaauuuuaauau

SEQ ID NO: 356419 - RNA, 64 nt, Human
auauguuuuuauuuaaaagaguagaauaaccuuucagaauuacugaguuuuuuauuccaguugu

SEQ ID NO: 356420 - RNA, 64 nt, Human
uggaauucuucacuugcuuuugaauugcacugaacagaauuaagaaauacucaugugcaauagg

SEQ ID NO: 356421 - RNA, 64 nt, Human
guccaugcugucuguuaaauaaaaugccauucugcagaauuaaccaucccaccagagcaauauu

SEQ ID NO: 356422 - RNA, 64 nt, Human
aguggcaugccaagaucacugaguauaucaguagcagaauuaggauucagacuuuguuaggccu

SEQ ID NO: 356423 - RNA, 64 nt, Human
ugaugaauuggagcauccauauggaaagcaaaggcagaauuaucccagcuguauuauuuugauc

SEQ ID NO: 356424 - RNA, 64 nt, Human
gauuguuauuuacucccagauccucuugcagacccagaauuaucaggaacauagcucugugauu

SEQ ID NO: 356425 - RNA, 64 nt, Human
gcauaaugagaaagucagacugagguaauaagaccagaauuaagugauagaagaaacuguuguu

SEQ ID NO: 356426 - RNA, 64 nt, Human
caguuccagggaugaucaugagcaggcgcaaaaucagaauuaaaggucgcacauagacguuuca

SEQ ID NO: 356427 - RNA, 64 nt, Human
acagcacaggguauuaaggacacagaaaaaaaaucagaauuagucuuuuguguuguuuauuuuc

SEQ ID NO: 356428 - RNA, 64 nt, Human
gagcuuugaaaacacugcacauaucuguacaagccagaauuacuauuucuuugacuuauuauua

SEQ ID NO: 356429 - RNA, 64 nt, Human
uuugggaggcugagaugggaagaucacuugagcccagaauuagagauaagccuauggaaacaua

SEQ ID NO: 356430 - RNA, 62 nt, Human
gcucucacuggccagaguaaguccuguaaacacagaauuaaauuaggggacucaagcaacua

SEQ ID NO: 356431 - RNA, 64 nt, Human
uuuauuuucugagcuuuguuggaaaacaugauaccagaauuaauuugccacauguugucuguuu

SEQ ID NO: 356432 - RNA, 64 nt, Human
aaauguuuuuuguuuauuauguaaacauggcuuacagaauuaugaacaguggauagauuaaagg

SEQ ID NO: 356433 - RNA, 64 nt, Human
gaagaccauuccuguuacaaaugaaaauaagcaacagaauuagcuacauccaucugauggcaca

SEQ ID NO: 356434 - RNA, 64 nt, Human
gcuuuagaacugugaauagaguucuaacugaaaccagaauuaauuuggcucuuguagcuuagua

SEQ ID NO: 356435 - RNA, 64 nt, Human
cacacagacucugggccuccccgcaaaauggcuccagaauuagaguaauuaugagaugguggga

SEQ ID NO: 356436 - RNA, 64 nt, Human
aauuaaagauaacggaguguaaagucauuagacccagaauuagagcagccagcagcuggcccag

SEQ ID NO: 356437 - RNA, 64 nt, Human
cauaaggagacucaaugauuuuaauugaucuagacagaauuauuuaaguuuuaucaauauugga

SEQ ID NO: 356438 - RNA, 64 nt, Human
ucuggguuggaugcaaugugagaggauggcaugccagaauuaggacacgacaugaaaccagagu

SEQ ID NO: 356439 - RNA, 64 nt, Human
accaaaggcacuauuuuagcuauguuuuucccaucagaauuaugcaauaaaauauauuaauuug

SEQ ID NO: 356440 - RNA, 64 nt, Human
cuaaauuguaauuguccuauuauauuacuuuuuucagaauuagagaacaugcuguacaacuuaa

SEQ ID NO: 356441 - RNA, 64 nt, Human
uccaaacaaugucucaaccugauaauuuccuuagcagaauuaccuauugcaacuucuguucaga

SEQ ID NO: 356442 - RNA, 64 nt, Human
ggacagagaagaaaaugaccaggagugucaucuccagaauuauuggggucacauaugucccuuc

SEQ ID NO: 356443 - RNA, 64 nt, Human
gggagucuugagauauaaaagaaugugguaaccacagaauuaauaacuguacuacccugacaag

SEQ ID NO: 356444 - RNA, 64 nt, Human
ccuuuuuuggucuuuaugaauauauuuauauggacagaauuaagauaaacaaaauugauugccc

SEQ ID NO: 356445 - RNA, 64 nt, Human
ugugcuagccaaaguaaugcuaugaaaucauuugcagaauuaacccgugaguuaauguuaaaug

SEQ ID NO: 356446 - RNA, 64 nt, Human
aaguugacaagcucagggaaaauaaauaguuggccagaauuaagcaaccaauacaugauagaca

SEQ ID NO: 356447 - RNA, 64 nt, Human
uuauuuauuaaaauuuugauguuuacuuaauggucagaauuauuucugagacacacugaauucu

SEQ ID NO: 356448 - RNA, 64 nt, Human
aaugucacaacccaaaacuuuacaagcuuugcuucagaauuagauugcuuuauaauucuugaau

SEQ ID NO: 356449 - RNA, 64 nt, Human
auugaccauagaugacuccguuugcauucuucugcagaauuauuuccuucagggacagauuuuc

SEQ ID NO: 356450 - RNA, 64 nt, Human
ggugauaauugugccuaccucagauagacagugccagaauuaagugagucaagccaaguaaagc

SEQ ID NO: 356451 - RNA, 64 nt, Human
uagccagacuuguuuugcuaucuuauaagcaguucagaauuagggaaugcugguuuugaagagc

SEQ ID NO: 356452 - RNA, 64 nt, Human
agggaauguggucgagaaagggcagcccauugcccagaauuaacacauauuguagagacuugua

SEQ ID NO: 356453 - RNA, 64 nt, Human
ggaaaaugugugauuuuguguuuugaauuacugucagaauuacauacacaauuacaacaaacuu

SEQ ID NO: 356454 - RNA, 64 nt, Human
cuguaggauauucucuuccugauggugcagaacccagaauuagaaguuugugguuacagcauac

SEQ ID NO: 356455 - RNA, 64 nt, Human
ugcugaggacgaccagcugaggguguauuauaugcagaauuacauaaacgaagcucucaaaggu

SEQ ID NO: 356456 - RNA, 64 nt, Human
cauuuacuguauuccugcucugaagauguggauacagaauuagucacucuugucacuuuauuua

SEQ ID NO: 356457 - RNA, 64 nt, Human
cagcuagcuuuuaggaaaaucacuuugucuaacucagaauuauuuuuaaaaagaaaucuggucu

SEQ ID NO: 356458 - RNA, 64 nt, Human
ucacacggccucacugggcuuccuaccaguuucucagaauuacacgcacgaccauccaaacauu

SEQ ID NO: 356459 - RNA, 64 nt, Human
caaugguuucguuuugaccaaacuuguauuaggacagaauuaaugaugcuuaaagagaaaagaa

SEQ ID NO: 356460 - RNA, 64 nt, Human
ccacagaaaauggaggcuuucacaaggguuugaucagaauuaaaaccccaaacccgcccucugu

SEQ ID NO: 356461 - RNA, 64 nt, Human
aaagaccuguuuuugugacugccuugaguuuuaucagaauuauuggccuaguaauccuucagaa

SEQ ID NO: 356462 - RNA, 64 nt, Human
gcaguagaucuacgaaaauauuguucauacugaucagaauuaaauuuguauagagcagaguuuu

SEQ ID NO: 356463 - RNA, 64 nt, Human
agaagaaaucauugggugacuaugacuaauguuucagaauuacuuuuuaauuguuuuaaaaagc

SEQ ID NO: 356464 - RNA, 64 nt, Human
ucgaccuguuuaauaauuuaccauccugaaaguccagaauuaaaauauggaagcaagaacuaua

SEQ ID NO: 356465 - RNA, 64 nt, Human
uguuuuucuaaucauauguggucauaacgggaagcagaauuaugcuuuauucaaacaaaccugc

SEQ ID NO: 356466 - RNA, 64 nt, Human
aagagacucuuguagcagugguuacccagacuuacagaauuauguccuccagaaaccagcaaga

SEQ ID NO: 356467 - RNA, 64 nt, Human
cugacccaucauacuacuauacuucuggguugaacagaauuauuuaugcagaauaauucaauug

SEQ ID NO: 356468 - RNA, 64 nt, Human
aaaugucuggacauucugaaauaauuuccgguuacagaauuacccuuuuuaggaucaucuucua

SEQ ID NO: 356469 - RNA, 64 nt, Human
ucucaaagagguaugugcacucccauguucacugcagaauuauuugcaaaagccaagaggugua

SEQ ID NO: 356470 - RNA, 64 nt, Human
ccacaucguuuugcuguugaaugggguuuaaaaucagaauuaacauuugccaccccccguggaa

SEQ ID NO: 356471 - RNA, 64 nt, Human
cuggcugaggggucaguuuuauggcugggaggugcagaauuacacagaagucccagucugagga

SEQ ID NO: 356472 - RNA, 64 nt, Human
acuccuaacaaaagacaauggauggccuuagcaucagaauuaaaauaaucuggauuaaauggca

SEQ ID NO: 356473 - RNA, 64 nt, Human
ugaucuacaagauccaaauaauuaucccuaucuucagaauuaacuuagucuguaauguggcuuc

SEQ ID NO: 356474 - RNA, 64 nt, Human
cacugugcacugacauguuucacaacaggcauuccagaauuaugaggcauugaggggauagaug

SEQ ID NO: 356475 - RNA, 64 nt, Human
aacauuuuaguucuugguuauaaaaauguuaauucagaauuaguuuaaugccuuaauuaaacua

SEQ ID NO: 356476 - RNA, 64 nt, Human
acuugguaacaucccuagacuccacucaugaacgcagaauuauuaccugcuguuugcuuucuga

SEQ ID NO: 356477 - RNA, 64 nt, Human
augaagagguuccugucauuucuuaugggguucacagaauuauuuggggcuuaaaugguacaau

SEQ ID NO: 356478 - RNA, 64 nt, Human
aacuuuagguccuuccucuucuuuggggcuggaacagaauuaaauuuguuuggaaaaaaaaaaa

SEQ ID NO: 356479 - RNA, 64 nt, Human
uguugaauuagcaugagagaaaauuauguaccaacagaauuauuugugagaagaaugaacaaau

SEQ ID NO: 356480 - RNA, 64 nt, Human
uggcuguuacccuuccuugaaaauaacccgaacucagaauuauuuaaagcauucauguuucucc

SEQ ID NO: 356481 - RNA, 64 nt, Human
gcuuaacaaaaguauuuuauaauacaguuucauacagaauuaccuuaaaagggagucuuauguu

SEQ ID NO: 356482 - RNA, 64 nt, Human
gauacccaaaaauauauuccagguaaagccaggucagaauuaggcuuuugcaggaauuuaacuu

SEQ ID NO: 356483 - RNA, 64 nt, Human
gcauuuauuugguggcagaauguuugccuagguacagaauuaauagcccuuagcaacgacugcu

SEQ ID NO: 356484 - RNA, 64 nt, Human
augcugagaugacuacagaaauuaacuuugagaccagaauuacagagaagaaaaaccaaaaccc

SEQ ID NO: 356485 - RNA, 64 nt, Human
uaagaguaucauccauaugguccauccuaauucacagaauuaaaugagcuuaaauagaaaauuc

SEQ ID NO: 356486 - RNA, 64 nt, Human
gagguuaagauauuaaguuauuuuccauaugaaucagaauuauauugauucugugcaaucaaaa

SEQ ID NO: 356487 - RNA, 64 nt, Human
auauuugcaaaaaaguccaagcuggaagcaccugcagaauuaaucacaugcucuuauuucguug

SEQ ID NO: 356488 - RNA, 64 nt, Human
cugauccccacccuuacucaucaccugcaguggccagaauuagggaaucagaaucaaaccagug

SEQ ID NO: 356489 - RNA, 64 nt, Human
augguuuuauggcaugaauuauccaaaaaaauaucagaauuacuuauuauucugugauuucauu

SEQ ID NO: 356490 - RNA, 64 nt, Human
aaugacuucuaguguagaauugugcaaccaucaccagaauuaauuuuauuauucuuauuauuuu

SEQ ID NO: 356491 - RNA, 64 nt, Human
guuguauuuuacacucuuaagucuuaaccacagucagaauuaucuuaauguagauuauaauuuu

SEQ ID NO: 356492 - RNA, 64 nt, Human
aaauaguuucucuucagcuguaaauaacaggauacagaauuaacaagagaaaaugucuaacuuu

SEQ ID NO: 356493 - RNA, 64 nt, Human
auagcaacuguucuaguguuuuguguuuuuaaaacagaauuaggaauuugagauaucugauuau

SEQ ID NO: 356494 - RNA, 64 nt, Human
ugagaaggggaaauuuuucaauauguagaagcuucagaauuagaggucccucuuuaccccagac

SEQ ID NO: 356495 - RNA, 64 nt, Human
uagaagguuaaagcugacaacaugugaaacaucccagaauuaugacucuucccaaguuuaaaau

SEQ ID NO: 356496 - RNA, 64 nt, Human
cuaacauggagagacccugucucuacuaaaaguacagaauuagccgggcgugguggcgcaugcc

SEQ ID NO: 356497 - RNA, 64 nt, Human
acccauacaaaucgucccaccgcccuagaggccacagaauuagcccaaaauuaucaaagaacau

SEQ ID NO: 356498 - RNA, 64 nt, Human
auuucuauuuguguuuuaugucauggaaauauuccagaauuaacagauaauagugguaaaguaa

SEQ ID NO: 356499 - RNA, 64 nt, Human
ugaugacugagaaucuauuugaguuuccagcuggcagaauuaauuguuauuauuuuccuaggcg

SEQ ID NO: 356500 - RNA, 64 nt, Human
cugcaagauaaauuagaucgcccugugggguuugcagaauuagugaaggguccaggacgauccc

SEQ ID NO: 356501 - RNA, 64 nt, Human
caguguggggggagauaccuuuaccaugaacuuacagaauuaaagauggcccauaaggaauucc

SEQ ID NO: 356502 - RNA, 64 nt, Human
agucacugugggaugucuucaaagucagcaguuacagaauuaguuuacuuugaauuuuguuguc

SEQ ID NO: 356503 - RNA, 64 nt, Human
uuugaaagcuucagcgugccuuaguuucuaggaucagaauuaguuuuccucucacuuggccuug

SEQ ID NO: 356504 - RNA, 64 nt, Human
uuuuauuuuaguugaauuuuauuucuaugcaaugcagaauuaacagaccucuucuccucauggu

SEQ ID NO: 356505 - RNA, 64 nt, Human
gaaagcaaaaauugacaaaugggacaugauuaaacagaauuaccauuugacucagcaaucccau

SEQ ID NO: 356506 - RNA, 64 nt, Human
ucccucuucccucuuucuccccauggccccacugcagaauuaaagaaggaagaagggaaggcgg

SEQ ID NO: 356507 - RNA, 64 nt, Human
cuuacuuuacuuuaucaauaccuggcaaacugaccagaauuaccuuccucauggcaaaggggga

SEQ ID NO: 356508 - RNA, 64 nt, Human
uuaacgaggacccuauggcaaaugcacaauuauucagaauuacauuuuaucguuuucacauuga

SEQ ID NO: 356509 - RNA, 64 nt, Human
uauuuuguuuaguacaguuucauauuugaguuugcagaauuaucuaauagucuuuuuuuggcua

SEQ ID NO: 356510 - RNA, 64 nt, Human
ugcaaugaaaagaaaaugugccauuuuuuucacucagaauuauucauagcuguauauuugaaac

SEQ ID NO: 356511 - RNA, 64 nt, Human
gaaaugccacugcuuuuagcaaaagccucccucccagaauuagccagcuugccuccugcacccc

SEQ ID NO: 356512 - RNA, 64 nt, Human
ugacuagggccagcgcaaauacuggaaccuguaacagaauuaaaggugaauguucugagauguu

SEQ ID NO: 356513 - RNA, 64 nt, Human
aaugaauguaguuaacugguuccugcucacacuccagaauuaaauucuauugaaaaaggaaaau

SEQ ID NO: 356514 - RNA, 64 nt, Human
gauugcugccuucucuguggcuacaagggacccacagaauuacagggaaguuacagggaagcag

SEQ ID NO: 356515 - RNA, 64 nt, Human
uuuuuucaacuguauguagggcugcagugguggccagaauuagauaucuuuaaagaauuuuaaa

SEQ ID NO: 356516 - RNA, 64 nt, Human
aaacuuuauaaaucaaagagauauuaggaacauucagaauuauuuguguuuuguuuuuguuuua

SEQ ID NO: 356517 - RNA, 64 nt, Human
aagaaacucacuuucccuguggcacguuaugcuucagaauuaaaacaaugaagauuaaaauuug

SEQ ID NO: 356518 - RNA, 64 nt, Human
caaacugucucaagcugagagauguuuuuaguagcagaauuaacacaggguuuuaacuugcaau

SEQ ID NO: 356519 - RNA, 64 nt, Human
cuuccugccagcuguuugcccuuaggccaguacacagaauuaaagugggggagauggcagacgc

SEQ ID NO: 356520 - RNA, 64 nt, Human
ucuuucuuauggggguuaccaaauauuuuggccucagaauuaucugauuccuuucaauuccaga

SEQ ID NO: 356521 - RNA, 64 nt, Human
auucaguuucucacauuuuaugcuuucaucuauucagaauuauuucauaguaaaauaaucuacu

SEQ ID NO: 356522 - RNA, 64 nt, Human
cuuaaacaggauaguaguuggcaagaugaaaugccagaauuaaaaccaaucauaaguagaaccc

SEQ ID NO: 356523 - RNA, 64 nt, Human
guuuguuuuguuuuuuaaaauagcaguuuacaaccagaauuagaacaaucuuaauucuacguuu

SEQ ID NO: 356524 - RNA, 64 nt, Human
uuuaucuaugacuaugaaacuggcaacgucaccccagaauuacggucagccuuauuccccuuca

SEQ ID NO: 356525 - RNA, 64 nt, Human
gaaacaaugagaaacuuacuuuugcuccuuuauacagaauuauuaacuauauuuuacuaacuaa

SEQ ID NO: 356526 - RNA, 64 nt, Human
aaaaguuuauuuuuaauauuacuuauagcugagucagaauuaaaggagggaauuguauugauac

SEQ ID NO: 356527 - RNA, 64 nt, Human
aaccugcaacacauuagaaacuuauauuuaaaaacagaauuaaucacacugaccaacuuuuaaa

SEQ ID NO: 356528 - RNA, 64 nt, Human
uuuguuuuaaaacugaucaguuuugccaaggggccagaauuauuccuuguuagaauugcuccag

SEQ ID NO: 356529 - RNA, 64 nt, Human
cuaaauuuacaguuacuuuaagaaaaugggcagucagaauuagggacuagaauguauaugagaa

SEQ ID NO: 356530 - RNA, 64 nt, Human
ucaugcugucuguuaaaucaaaacugaucuaaaucagaauuauuaaaugugaggagcuuuuuua

SEQ ID NO: 356531 - RNA, 64 nt, Human
aacucuggcaggcuuaagauuuggaauaaagucacagaauuaaggaagcaccucaauuuaguuc

SEQ ID NO: 356532 - RNA, 64 nt, Human
aucaagggagaaagaaaaugggcacuuuaugucucagaauuacucaaaucaauuuauuuuuagu

SEQ ID NO: 356533 - RNA, 64 nt, Human
uauuuuuucaauggucuuuuuuuuuuguauuauacagaauuacugauucauugaaaaauuauuu

SEQ ID NO: 356534 - RNA, 64 nt, Human
ccguggauucuagauagauuuuagaggcagcagacagaauuacugaggaauugaguguaagagu

SEQ ID NO: 356535 - RNA, 64 nt, Human
ccuaaguuuguaaaaaugcacuuuuguagcuuuucagaauuaauauaaaaauauuuccuaccaa

SEQ ID NO: 356536 - RNA, 64 nt, Human
uaaucuauuccuggggccauaacucaugggaaaacagaauuauccccuaggacuccuuucuaag

SEQ ID NO: 356537 - RNA, 64 nt, Human
guguccccacccaaaucuuaucuagaauuguaaucagaauuauaauccccauguguugggggag

SEQ ID NO: 356538 - RNA, 64 nt, Human
augaaaauuaugacuuuuuuguuugguuggaaagcagaauuaugcauaaauuuccucuuacagu

SEQ ID NO: 356539 - RNA, 64 nt, Human
auuucuuuauuucugucucauaauugucaaaaaccagaauuaggucaaguucauaguuucugua

SEQ ID NO: 356540 - RNA, 64 nt, Human
accucacagaagaugcccagggcccagaagccaucagaauuaucaguggagaagcaccuuuuga

SEQ ID NO: 356541 - RNA, 64 nt, Human
uuuaaauugucucuugucuccuucaguuaauuuucagaauuaaaaacauaccaugggaaaaaag

SEQ ID NO: 356542 - RNA, 64 nt, Human
auaucuuuguuaaaguagauuuuucaauguuuuacagaauuacauuuucaaaaaaagguuuuua

SEQ ID NO: 356543 - RNA, 64 nt, Human
guguucaguaaauauuugcugcuugaaucugcuccagaauuaacaagaaagccaucucuuccuc

SEQ ID NO: 356544 - RNA, 64 nt, Human
ucagagccauacaaaaauaagccacaaccagcuucagaauuaauucccaaucccccauuccacc

SEQ ID NO: 356545 - RNA, 64 nt, Human
aacaguuuagcauuaaggguuucuauuaaugacacagaauuauuggccaaguguaauuucuuaa

SEQ ID NO: 356546 - RNA, 64 nt, Human
agugauuugguuauuuugguaccugagaacguaacagaauuaaaaggcaguugcuguggaaaca

SEQ ID NO: 356547 - RNA, 64 nt, Human
aauuacucuuaguggagaugccagauaucccauacagaauuagcagagaaaauacacacaggcu

SEQ ID NO: 356548 - RNA, 64 nt, Human
uaacuacuuuacuaaauuaauacuccuccuuuuacagaauuagaaaaguuaacauuuaucuuua

SEQ ID NO: 356549 - RNA, 64 nt, Human
gcuguauucaugaaucuugagaguguuccugagacagaauuaauggucauuugggaaaacuauc

SEQ ID NO: 356550 - RNA, 64 nt, Human
auacauucugagcuaacccagaaucuuuagucggcagaauuaagugcuggugucuuucacuggc

SEQ ID NO: 356551 - RNA, 64 nt, Human
agaaaaaggaugccugaacacgcaaagucggcugcagaauuauugccaaguugcugcugcuucc

SEQ ID NO: 356552 - RNA, 64 nt, Human
ccccaaauaccucagccauggagaccaugucaugcagaauuaacaagguagcaccgagcauauc

SEQ ID NO: 356553 - RNA, 64 nt, Human
agccgauaaaugcaucugaucagaaaucagcagacagaauuaccaaaguguaucuggugcugaa

SEQ ID NO: 356554 - RNA, 64 nt, Human
gcuggagcagaucgugcugcacaaccggagaagacagaauuaccucugcucuuuuaauauauaa

SEQ ID NO: 356555 - RNA, 64 nt, Human
uguucauuuauguagaugccacuuuaagcuuuaucagaauuaaaugugagauuucuucuuugag

SEQ ID NO: 356556 - RNA, 64 nt, Human
uugggggcagaccagagagcucaaguuucagagucagaauuaggcacuuggagcguuuuugcug

SEQ ID NO: 356557 - RNA, 64 nt, Human
uguguuguacaggugcugugagaccuacccuauucagaauuaaaccucacugcaaauuuccucc

SEQ ID NO: 356558 - RNA, 64 nt, Human
uugcagccaaaaaauguaaucugcuuuuuuaugacagaauuauuauagcugagcugacuuacua

SEQ ID NO: 356559 - RNA, 64 nt, Human
ucaauuguuaauaagaaauugcuaucugggaugacagaauuaccucugcuuaguaucucauuau

SEQ ID NO: 356560 - RNA, 63 nt, Human
agaagauucgaauggauugaauguuaccugugccagaauuagaaaaggggguuggaaauuggc

SEQ ID NO: 356561 - RNA, 64 nt, Human
ugaaaaaugagucuccauugcuuuuauaaaauagcagaauuagcuuugcuucaaaagaaauagg

SEQ ID NO: 356562 - RNA, 64 nt, Human
cuaugaggcaucuggccccugguagccagcucuccagaauuacuuguagguaauuccucucuuc

SEQ ID NO: 356563 - RNA, 64 nt, Human
uuccaaacaauucugagaaacaaaaacacacacgcagaauuaacaauucuuuucccugugcuuc

SEQ ID NO: 356564 - RNA, 64 nt, Human
uguaaucaacauggcuacuugcuuugaggcucaccagaauuauuuuuaagugguuuuaauaaaa

SEQ ID NO: 356565 - RNA, 64 nt, Human
caagcugcugacugggcacacucaugccaaguuucagaauuauuggucuucuggguuuuugcuu

SEQ ID NO: 356566 - RNA, 64 nt, Human
guaagcaaaaugaaaagcacuuauugcuuucugacagaauuauagauguaauuuuaagaguugc

SEQ ID NO: 356567 - RNA, 64 nt, Human
ugaaaugccauuucagaauguauaaaaguacuuucagaauuagaagaaaagugagagcuucagc

SEQ ID NO: 356568 - RNA, 64 nt, Human
ucagaguagauggugauaaaaagggagguuuuuucagaauuauuuucaggacacccaagauauu

SEQ ID NO: 356569 - RNA, 64 nt, Human
acagcuacugugacaugcaaaggaaaggacagugcagaauuaaaccguguugaagaccagugga

SEQ ID NO: 356570 - RNA, 64 nt, Human
uauuuauucaugggagauaauuuauuuuaaaggacagaauuaccaagcguuacaaaaucaguuc

SEQ ID NO: 356571 - RNA, 64 nt, Human
uuaggagugcagggguucugcuucauugcauuuucagaauuaaccugaaaguugaaacaaccau

SEQ ID NO: 356572 - RNA, 64 nt, Human
gcauggcuucacacuguuuguguagccaagaggacagaauuacaugaaugacagugcccagagu

SEQ ID NO: 356573 - RNA, 64 nt, Human
auggggaacauuuugcuagcccauuagaagcacacagaauuauccuuguccuccuaauauugac

SEQ ID NO: 356574 - RNA, 64 nt, Human; identical to SEQ ID NO: 58996

SEQ ID NO: 356575 - RNA, 64 nt, Human; identical to SEQ ID NO: 123337

SEQ ID NO: 356576 - RNA, 58 nt, Human; identical to SEQ ID NO: 123338

SEQ ID NO: 356577 - RNA, 64 nt, Human; identical to SEQ ID NO: 123339

SEQ ID NO: 356578 - RNA, 64 nt, Human; identical to SEQ ID NO: 123340

SEQ ID NO: 356579 - RNA, 64 nt, Human; identical to SEQ ID NO: 123341

SEQ ID NO: 356580 - RNA, 64 nt, Human; identical to SEQ ID NO: 123342

SEQ ID NO: 356581 - RNA, 64 nt, Human; identical to SEQ ID NO: 123343

SEQ ID NO: 356582 - RNA, 64 nt, Human; identical to SEQ ID NO: 123344

SEQ ID NO: 356583 - RNA, 64 nt, Human; identical to SEQ ID NO: 123345

SEQ ID NO: 356584 - RNA, 64 nt, Human; identical to SEQ ID NO: 123346

SEQ ID NO: 356585 - RNA, 64 nt, Human; identical to SEQ ID NO: 123347

SEQ ID NO: 356586 - RNA, 64 nt, Human; identical to SEQ ID NO: 123348

SEQ ID NO: 356587 - RNA, 64 nt, Human; identical to SEQ ID NO: 123349

SEQ ID NO: 356588 - RNA, 64 nt, Human; identical to SEQ ID NO: 123350

SEQ ID NO: 356589 - RNA, 64 nt, Human; identical to SEQ ID NO: 123351

SEQ ID NO: 356590 - RNA, 64 nt, Human; identical to SEQ ID NO: 58970

SEQ ID NO: 356591 - RNA, 64 nt, Human; identical to SEQ ID NO: 58971

SEQ ID NO: 356592 - RNA, 64 nt, Human; identical to SEQ ID NO: 58997

SEQ ID NO: 356593 - RNA, 64 nt, Human; identical to SEQ ID NO: 123352

SEQ ID NO: 356594 - RNA, 64 nt, Human; identical to SEQ ID NO: 123353

SEQ ID NO: 356595 - RNA, 64 nt, Human; identical to SEQ ID NO: 123354

SEQ ID NO: 356596 - RNA, 64 nt, Human; identical to SEQ ID NO: 123355

SEQ ID NO: 356597 - RNA, 64 nt, Human; identical to SEQ ID NO: 123356

SEQ ID NO: 356598 - RNA, 64 nt, Human; identical to SEQ ID NO: 123357

SEQ ID NO: 356599 - RNA, 64 nt, Human; identical to SEQ ID NO: 123358

SEQ ID NO: 356600 - RNA, 64 nt, Human; identical to SEQ ID NO: 123359

SEQ ID NO: 356601 - RNA, 64 nt, Human; identical to SEQ ID NO: 123360

SEQ ID NO: 356602 - RNA, 64 nt, Human; identical to SEQ ID NO: 123361

SEQ ID NO: 356603 - RNA, 64 nt, Human; identical to SEQ ID NO: 123362

SEQ ID NO: 356604 - RNA, 64 nt, Human; identical to SEQ ID NO: 123363

SEQ ID NO: 356605 - RNA, 64 nt, Human; identical to SEQ ID NO: 123364

SEQ ID NO: 356606 - RNA, 64 nt, Human; identical to SEQ ID NO: 123365

SEQ ID NO: 356607 - RNA, 63 nt, Human; identical to SEQ ID NO: 123366

SEQ ID NO: 356608 - RNA, 64 nt, Human; identical to SEQ ID NO: 58998

SEQ ID NO: 356609 - RNA, 64 nt, Human; identical to SEQ ID NO: 58999

SEQ ID NO: 356610 - RNA, 64 nt, Human; identical to SEQ ID NO: 59000

SEQ ID NO: 356611 - RNA, 64 nt, Human; identical to SEQ ID NO: 123367

SEQ ID NO: 356612 - RNA, 58 nt, Human; identical to SEQ ID NO: 123368

SEQ ID NO: 356613 - RNA, 64 nt, Human; identical to SEQ ID NO: 123369

SEQ ID NO: 356614 - RNA, 56 nt, Human; identical to SEQ ID NO: 123370

SEQ ID NO: 356615 - RNA, 64 nt, Human; identical to SEQ ID NO: 123371

SEQ ID NO: 356616 - RNA, 64 nt, Human; identical to SEQ ID NO: 123372

SEQ ID NO: 356617 - RNA, 64 nt, Human; identical to SEQ ID NO: 123373

SEQ ID NO: 356618 - RNA, 64 nt, Human; identical to SEQ ID NO: 123374

SEQ ID NO: 356619 - RNA, 64 nt, Human; identical to SEQ ID NO: 123375

SEQ ID NO: 356620 - RNA, 50 nt, Human; identical to SEQ ID NO: 123376

SEQ ID NO: 356621 - RNA, 64 nt, Human; identical to SEQ ID NO: 123377

SEQ ID NO: 356622 - RNA, 64 nt, Human; identical to SEQ ID NO: 123378

SEQ ID NO: 356623 - RNA, 64 nt, Human; identical to SEQ ID NO: 123379

SEQ ID NO: 356624 - RNA, 64 nt, Human; identical to SEQ ID NO: 123380

SEQ ID NO: 356625 - RNA, 64 nt, Human; identical to SEQ ID NO: 123381

SEQ ID NO: 356626 - RNA, 64 nt, Human; identical to SEQ ID NO: 59001

SEQ ID NO: 356627 - RNA, 64 nt, Human; identical to SEQ ID NO: 59002

SEQ ID NO: 356628 - RNA, 64 nt, Human; identical to SEQ ID NO: 59003

SEQ ID NO: 356629 - RNA, 64 nt, Human; identical to SEQ ID NO: 123382

SEQ ID NO: 356630 - RNA, 64 nt, Human; identical to SEQ ID NO: 123383

SEQ ID NO: 356631 - RNA, 64 nt, Human; identical to SEQ ID NO: 123384

SEQ ID NO: 356632 - RNA, 64 nt, Human; identical to SEQ ID NO: 123385

SEQ ID NO: 356633 - RNA, 64 nt, Human; identical to SEQ ID NO: 123386

SEQ ID NO: 356634 - RNA, 64 nt, Human; identical to SEQ ID NO: 123387

SEQ ID NO: 356635 - RNA, 64 nt, Human; identical to SEQ ID NO: 123388

SEQ ID NO: 356636 - RNA, 64 nt, Human; identical to SEQ ID NO: 123389

SEQ ID NO: 356637 - RNA, 64 nt, Human; identical to SEQ ID NO: 123390

SEQ ID NO: 356638 - RNA, 64 nt, Human; identical to SEQ ID NO: 123391

SEQ ID NO: 356639 - RNA, 64 nt, Human; identical to SEQ ID NO: 123392

SEQ ID NO: 356640 - RNA, 64 nt, Human; identical to SEQ ID NO: 123393

SEQ ID NO: 356641 - RNA, 64 nt, Human; identical to SEQ ID NO: 123394

SEQ ID NO: 356642 - RNA, 64 nt, Human; identical to SEQ ID NO: 123395

SEQ ID NO: 356643 - RNA, 54 nt, Human; identical to SEQ ID NO: 123396

SEQ ID NO: 356644 - RNA, 64 nt, Human; identical to SEQ ID NO: 59004

SEQ ID NO: 356645 - RNA, 64 nt, Human; identical to SEQ ID NO: 59005

SEQ ID NO: 356646 - RNA, 64 nt, Human; identical to SEQ ID NO: 59006

SEQ ID NO: 356647 - RNA, 52 nt, Human; identical to SEQ ID NO: 123397

SEQ ID NO: 356648 - RNA, 64 nt, Human; identical to SEQ ID NO: 123398

SEQ ID NO: 356649 - RNA, 64 nt, Human; identical to SEQ ID NO: 123399

SEQ ID NO: 356650 - RNA, 64 nt, Human; identical to SEQ ID NO: 123400

SEQ ID NO: 356651 - RNA, 64 nt, Human; identical to SEQ ID NO: 123401

SEQ ID NO: 356652 - RNA, 64 nt, Human; identical to SEQ ID NO: 123402

SEQ ID NO: 356653 - RNA, 64 nt, Human; identical to SEQ ID NO: 123403

SEQ ID NO: 356654 - RNA, 64 nt, Human; identical to SEQ ID NO: 123404

SEQ ID NO: 356655 - RNA, 64 nt, Human; identical to SEQ ID NO: 123405

SEQ ID NO: 356656 - RNA, 64 nt, Human; identical to SEQ ID NO: 123406

SEQ ID NO: 356657 - RNA, 50 nt, Human; identical to SEQ ID NO: 123407

SEQ ID NO: 356658 - RNA, 64 nt, Human; identical to SEQ ID NO: 123408

SEQ ID NO: 356659 - RNA, 64 nt, Human; identical to SEQ ID NO: 123409

SEQ ID NO: 356660 - RNA, 64 nt, Human; identical to SEQ ID NO: 123410

SEQ ID NO: 356661 - RNA, 64 nt, Human; identical to SEQ ID NO: 123411

SEQ ID NO: 356662 - RNA, 64 nt, Human
ccaccuuguguucacuucaaagauggcccaacccccgcccuacacucagcucaugccuaaccua

SEQ ID NO: 356663 - RNA, 64 nt, Human
gaggcagcgggggcuucagccauguccuagcuccccgcccuaaaaggaggcagugaggaccagg

SEQ ID NO: 356664 - RNA, 64 nt, Human
gagguauccauucauaaaaugaaugugggugaagccgcccuaaggauuuuccuuuaauuucucu

SEQ ID NO: 356665 - RNA, 64 nt, Human; identical to SEQ ID NO: 123412

SEQ ID NO: 356666 - RNA, 64 nt, Human; identical to SEQ ID NO: 123413

SEQ ID NO: 356667 - RNA, 64 nt, Human; identical to SEQ ID NO: 123414

SEQ ID NO: 356668 - RNA, 64 nt, Human; identical to SEQ ID NO: 123415

SEQ ID NO: 356669 - RNA, 64 nt, Human; identical to SEQ ID NO: 123416

SEQ ID NO: 356670 - RNA, 64 nt, Human; identical to SEQ ID NO: 123417

SEQ ID NO: 356671 - RNA, 64 nt, Human; identical to SEQ ID NO: 123418

SEQ ID NO: 356672 - RNA, 64 nt, Human; identical to SEQ ID NO: 123419

SEQ ID NO: 356673 - RNA, 64 nt, Human; identical to SEQ ID NO: 123420

SEQ ID NO: 356674 - RNA, 60 nt, Human; identical to SEQ ID NO: 123421

SEQ ID NO: 356675 - RNA, 64 nt, Human; identical to SEQ ID NO: 123422

SEQ ID NO: 356676 - RNA, 64 nt, Human; identical to SEQ ID NO: 123423

SEQ ID NO: 356677 - RNA, 54 nt, Human; identical to SEQ ID NO: 123424

SEQ ID NO: 356678 - RNA, 64 nt, Human; identical to SEQ ID NO: 123425

SEQ ID NO: 356679 - RNA, 64 nt, Human; identical to SEQ ID NO: 123426

SEQ ID NO: 356680 - RNA, 59 nt, Human; identical to SEQ ID NO: 58987

SEQ ID NO: 356681 - RNA, 64 nt, Human; identical to SEQ ID NO: 58988

SEQ ID NO: 356682 - RNA, 64 nt, Human; identical to SEQ ID NO: 58992

SEQ ID NO: 356683 - RNA, 64 nt, Human; identical to SEQ ID NO: 123427

SEQ ID NO: 356684 - RNA, 64 nt, Human; identical to SEQ ID NO: 123428

SEQ ID NO: 356685 - RNA, 64 nt, Human; identical to SEQ ID NO: 123429

SEQ ID NO: 356686 - RNA, 64 nt, Human; identical to SEQ ID NO: 123430

SEQ ID NO: 356687 - RNA, 64 nt, Human; identical to SEQ ID NO: 123431

SEQ ID NO: 356688 - RNA, 63 nt, Human; identical to SEQ ID NO: 123432

SEQ ID NO: 356689 - RNA, 64 nt, Human; identical to SEQ ID NO: 123433

SEQ ID NO: 356690 - RNA, 64 nt, Human; identical to SEQ ID NO: 123434

SEQ ID NO: 356691 - RNA, 64 nt, Human; identical to SEQ ID NO: 123435

SEQ ID NO: 356692 - RNA, 61 nt, Human; identical to SEQ ID NO: 123436

SEQ ID NO: 356693 - RNA, 64 nt, Human; identical to SEQ ID NO: 123437

SEQ ID NO: 356694 - RNA, 64 nt, Human; identical to SEQ ID NO: 123438

SEQ ID NO: 356695 - RNA, 64 nt, Human; identical to SEQ ID NO: 123439

SEQ ID NO: 356696 - RNA, 64 nt, Human; identical to SEQ ID NO: 123440

SEQ ID NO: 356697 - RNA, 64 nt, Human; identical to SEQ ID NO: 123441

SEQ ID NO: 356698 - RNA, 64 nt, Human; identical to SEQ ID NO: 58981

SEQ ID NO: 356699 - RNA, 64 nt, Human; identical to SEQ ID NO: 58982

SEQ ID NO: 356700 - RNA, 64 nt, Human
auguggcaccauagugcggugcccuguggcuucaccgcccuacuuccaccuccgcccagccugu

SEQ ID NO: 356701 - RNA, 64 nt, Human; identical to SEQ ID NO: 123456

SEQ ID NO: 356702 - RNA, 64 nt, Human
aaugggauauaagaggcagcgugaaagcagaugagcuguggacuagcaauauaggguuuuguuu

SEQ ID NO: 356703 - RNA, 64 nt, Human
aacccagggccagcuggaaguguggagcacacaugcuguggagcacacaugcuguggagauugc

SEQ ID NO: 356704 - RNA, 64 nt, Human
gaaguguggagcacacaugcuguggagcacacaugcuguggagauugcagugugucugagguuu

SEQ ID NO: 356705 - RNA, 64 nt, Human
uagcuuucauauuucuuuauuauuguaaaugggggcuguggaaggugagaaaacacaugcuuuc

SEQ ID NO: 356706 - RNA, 64 nt, Human
ccaagaaauauuccuuaagauauuaacugagaaggcuguggauuuaauguggaaaugauguuuc

SEQ ID NO: 356707 - RNA, 64 nt, Human
cugaagugaauacaugguagcagggucuuugugugcuguggauuuuguggcuucaaucuacgau

SEQ ID NO: 356708 - RNA, 64 nt, Human
cguucuauuuuuguucaaaucauuugaaguugaagcuguggacgguuuguugugucuauuucag

SEQ ID NO: 356709 - RNA, 64 nt, Human
auugaguccugccacauguuagguaccgugcucugcuguggagacagagcagugaccccaagga

SEQ ID NO: 356710 - RNA, 64 nt, Human
gacccuccacaucucacuggugugggugcauggggcuguggagugggugucaguauggaugugu

SEQ ID NO: 356711 - RNA, 64 nt, Human
ccaaagcccaugcccugccgugguggcagcuggggcuguggaugggagggguccccaacaugga

SEQ ID NO: 356712 - RNA, 64 nt, Human
auguaacugcgggaaacccacugccccuuuguaagcuguggaacccaaacuguauggggauauu

SEQ ID NO: 356713 - RNA, 64 nt, Human
aagcuuugugaaacuggcacagugauagagaauugcuguggagaguuauagagcaaagggaugg

SEQ ID NO: 356714 - RNA, 64 nt, Human
aaaaaacacaacugauugacacucagaacucuuagcuguggaagaacaucaugccuauuuauaa

SEQ ID NO: 356715 - RNA, 64 nt, Human
ugcuccauugaaucuacuauucuuguuuuccacugcuguggaaaccuccuugcuacuauagcgu

SEQ ID NO: 356716 - RNA, 64 nt, Human
acguuggggacccuggguggggccuccaggugcagcuguggauggaagacagggauuggccugu

SEQ ID NO: 356717 - RNA, 64 nt, Human
ugcugcaggaaugaaugacguccuuccuaacaguccgcccuacuucccccgcuuuggacaggug

SEQ ID NO: 356718 - RNA, 62 nt, Human
ccaugugccucauggcacugccaccuggcccuuugcccuauuuucuguucaguuuuuuaaaa

SEQ ID NO: 356719 - RNA, 62 nt, Human
ugcucugcuuuuccugucuguauauaacuuauuugcccuaagaacuuugagaaucccaauua

SEQ ID NO: 356720 - RNA, 62 nt, Human
uucuuucuguggaggauauacuaagugcgacuuugcccuauccuauuuggaaaucccuaaca

SEQ ID NO: 356721 - RNA, 64 nt, Human; identical to SEQ ID NO: 123457

SEQ ID NO: 356722 - RNA, 64 nt, Human; identical to SEQ ID NO: 123458

SEQ ID NO: 356723 - RNA, 64 nt, Human; identical to SEQ ID NO: 123459

SEQ ID NO: 356724 - RNA, 64 nt, Human; identical to SEQ ID NO: 123460

SEQ ID NO: 356725 - RNA, 64 nt, Human; identical to SEQ ID NO: 123461

SEQ ID NO: 356726 - RNA, 64 nt, Human; identical to SEQ ID NO: 123462

SEQ ID NO: 356727 - RNA, 64 nt, Human; identical to SEQ ID NO: 123463

SEQ ID NO: 356728 - RNA, 64 nt, Human; identical to SEQ ID NO: 123464

SEQ ID NO: 356729 - RNA, 64 nt, Human; identical to SEQ ID NO: 123465

SEQ ID NO: 356730 - RNA, 64 nt, Human; identical to SEQ ID NO: 123466

SEQ ID NO: 356731 - RNA, 64 nt, Human; identical to SEQ ID NO: 123467

SEQ ID NO: 356732 - RNA, 64 nt, Human; identical to SEQ ID NO: 123468

SEQ ID NO: 356733 - RNA, 64 nt, Human; identical to SEQ ID NO: 123469

SEQ ID NO: 356734 - RNA, 64 nt, Human; identical to SEQ ID NO: 123470

SEQ ID NO: 356735 - RNA, 64 nt, Human; identical to SEQ ID NO: 123471

SEQ ID NO: 356736 - RNA, 62 nt, Human
gaagcaaauauucguguuguacaaauuucugauugcccuaaauguagagagacugaugggga

SEQ ID NO: 356737 - RNA, 62 nt, Human
uggacuucaugcgggccacagguuggacaagcuugcccuagggcauugugugcuuuccguaa

SEQ ID NO: 356738 - RNA, 62 nt, Human
uauuuaaaauauauacgucuauucuuuaugccuugcccuagccagauggaagaagaugaaga

SEQ ID NO: 356739 - RNA, 64 nt, Human; identical to SEQ ID NO: 123472

SEQ ID NO: 356740 - RNA, 64 nt, Human; identical to SEQ ID NO: 123473

SEQ ID NO: 356741 - RNA, 64 nt, Human; identical to SEQ ID NO: 123474

SEQ ID NO: 356742 - RNA, 64 nt, Human; identical to SEQ ID NO: 123475

SEQ ID NO: 356743 - RNA, 64 nt, Human; identical to SEQ ID NO: 123476

SEQ ID NO: 356744 - RNA, 64 nt, Human; identical to SEQ ID NO: 123477

SEQ ID NO: 356745 - RNA, 51 nt, Human; identical to SEQ ID NO: 123478

SEQ ID NO: 356746 - RNA, 64 nt, Human; identical to SEQ ID NO: 123479

SEQ ID NO: 356747 - RNA, 64 nt, Human; identical to SEQ ID NO: 123480

SEQ ID NO: 356748 - RNA, 64 nt, Human; identical to SEQ ID NO: 123481

SEQ ID NO: 356749 - RNA, 64 nt, Human; identical to SEQ ID NO: 123482

SEQ ID NO: 356750 - RNA, 64 nt, Human; identical to SEQ ID NO: 123483

SEQ ID NO: 356751 - RNA, 64 nt, Human; identical to SEQ ID NO: 123484

SEQ ID NO: 356752 - RNA, 64 nt, Human; identical to SEQ ID NO: 123485

SEQ ID NO: 356753 - RNA, 64 nt, Human; identical to SEQ ID NO: 123486

SEQ ID NO: 356754 - RNA, 64 nt, Human; identical to SEQ ID NO: 58998

SEQ ID NO: 356755 - RNA, 64 nt, Human; identical to SEQ ID NO: 58999

SEQ ID NO: 356756 - RNA, 64 nt, Human; identical to SEQ ID NO: 59000

SEQ ID NO: 356757 - RNA, 64 nt, Human; identical to SEQ ID NO: 123487

SEQ ID NO: 356758 - RNA, 64 nt, Human; identical to SEQ ID NO: 123488

SEQ ID NO: 356759 - RNA, 64 nt, Human; identical to SEQ ID NO: 123489

SEQ ID NO: 356760 - RNA, 64 nt, Human; identical to SEQ ID NO: 123490

SEQ ID NO: 356761 - RNA, 64 nt, Human; identical to SEQ ID NO: 123491

SEQ ID NO: 356762 - RNA, 64 nt, Human; identical to SEQ ID NO: 123492

SEQ ID NO: 356763 - RNA, 64 nt, Human; identical to SEQ ID NO: 123493

SEQ ID NO: 356764 - RNA, 64 nt, Human; identical to SEQ ID NO: 123494

SEQ ID NO: 356765 - RNA, 64 nt, Human; identical to SEQ ID NO: 123495

SEQ ID NO: 356766 - RNA, 64 nt, Human; identical to SEQ ID NO: 123496

SEQ ID NO: 356767 - RNA, 64 nt, Human; identical to SEQ ID NO: 123497

SEQ ID NO: 356768 - RNA, 64 nt, Human; identical to SEQ ID NO: 123498

SEQ ID NO: 356769 - RNA, 64 nt, Human; identical to SEQ ID NO: 123499

SEQ ID NO: 356770 - RNA, 64 nt, Human; identical to SEQ ID NO: 123500

SEQ ID NO: 356771 - RNA, 64 nt, Human; identical to SEQ ID NO: 123501

SEQ ID NO: 356772 - RNA, 64 nt, Human; identical to SEQ ID NO: 59003

SEQ ID NO: 356773 - RNA, 64 nt, Human; identical to SEQ ID NO: 59004

SEQ ID NO: 356774 - RNA, 64 nt, Human; identical to SEQ ID NO: 59005

SEQ ID NO: 356775 - RNA, 50 nt, Human; identical to SEQ ID NO: 123502

SEQ ID NO: 356776 - RNA, 64 nt, Human; identical to SEQ ID NO: 123503

SEQ ID NO: 356777 - RNA, 64 nt, Human; identical to SEQ ID NO: 123504

SEQ ID NO: 356778 - RNA, 64 nt, Human; identical to SEQ ID NO: 123505

SEQ ID NO: 356779 - RNA, 64 nt, Human; identical to SEQ ID NO: 123506

SEQ ID NO: 356780 - RNA, 64 nt, Human; identical to SEQ ID NO: 123507

SEQ ID NO: 356781 - RNA, 64 nt, Human; identical to SEQ ID NO: 123508

SEQ ID NO: 356782 - RNA, 64 nt, Human; identical to SEQ ID NO: 123509

SEQ ID NO: 356783 - RNA, 64 nt, Human; identical to SEQ ID NO: 123510

SEQ ID NO: 356784 - RNA, 64 nt, Human; identical to SEQ ID NO: 123511

SEQ ID NO: 356785 - RNA, 64 nt, Human; identical to SEQ ID NO: 123512

SEQ ID NO: 356786 - RNA, 64 nt, Human; identical to SEQ ID NO: 123513

SEQ ID NO: 356787 - RNA, 64 nt, Human; identical to SEQ ID NO: 123514

SEQ ID NO: 356788 - RNA, 64 nt, Human; identical to SEQ ID NO: 123515

SEQ ID NO: 356789 - RNA, 64 nt, Human; identical to SEQ ID NO: 123516

SEQ ID NO: 356790 - RNA, 64 nt, Human; identical to SEQ ID NO: 59006

SEQ ID NO: 356791 - RNA, 64 nt, Human; identical to SEQ ID NO: 59007

SEQ ID NO: 356792 - RNA, 64 nt, Human; identical to SEQ ID NO: 59009

SEQ ID NO: 356793 - RNA, 64 nt, Human; identical to SEQ ID NO: 123517

SEQ ID NO: 356794 - RNA, 64 nt, Human; identical to SEQ ID NO: 123518

SEQ ID NO: 356795 - RNA, 64 nt, Human; identical to SEQ ID NO: 123519

SEQ ID NO: 356796 - RNA, 64 nt, Human; identical to SEQ ID NO: 123520

SEQ ID NO: 356797 - RNA, 64 nt, Human; identical to SEQ ID NO: 123521

SEQ ID NO: 356798 - RNA, 64 nt, Human; identical to SEQ ID NO: 123522

SEQ ID NO: 356799 - RNA, 64 nt, Human; identical to SEQ ID NO: 123523

SEQ ID NO: 356800 - RNA, 64 nt, Human; identical to SEQ ID NO: 123524

SEQ ID NO: 356801 - RNA, 64 nt, Human; identical to SEQ ID NO: 123525

SEQ ID NO: 356802 - RNA, 64 nt, Human; identical to SEQ ID NO: 123526

SEQ ID NO: 356803 - RNA, 64 nt, Human; identical to SEQ ID NO: 123527

SEQ ID NO: 356804 - RNA, 64 nt, Human; identical to SEQ ID NO: 123528

SEQ ID NO: 356805 - RNA, 64 nt, Human; identical to SEQ ID NO: 123529

SEQ ID NO: 356806 - RNA, 64 nt, Human; identical to SEQ ID NO: 123530

SEQ ID NO: 356807 - RNA, 64 nt, Human; identical to SEQ ID NO: 123531

SEQ ID NO: 356808 - RNA, 62 nt, Human
guggcagcuugugaagauuggggacacucauauugcccuaauuaaaaacugugauuuuuauc

SEQ ID NO: 356809 - RNA, 62 nt, Human
ccuuaacccccggcuuuuggaacaagccauguuugcccuaguccaggauugccucacuugag

SEQ ID NO: 356810 - RNA, 62 nt, Human
cugugccugcacacaggaguggcucauggcguuugcccuacacggaugggcuguccugggag

SEQ ID NO: 356811 - RNA, 64 nt, Human; identical to SEQ ID NO: 123532

SEQ ID NO: 356812 - RNA, 64 nt, Human; identical to SEQ ID NO: 123533

SEQ ID NO: 356813 - RNA, 64 nt, Human; identical to SEQ ID NO: 123534

SEQ ID NO: 356814 - RNA, 64 nt, Human; identical to SEQ ID NO: 123535

SEQ ID NO: 356815 - RNA, 64 nt, Human; identical to SEQ ID NO: 123536

SEQ ID NO: 356816 - RNA, 64 nt, Human; identical to SEQ ID NO: 123537

SEQ ID NO: 356817 - RNA, 64 nt, Human; identical to SEQ ID NO: 123538

SEQ ID NO: 356818 - RNA, 64 nt, Human; identical to SEQ ID NO: 123539

SEQ ID NO: 356819 - RNA, 64 nt, Human; identical to SEQ ID NO: 123540

SEQ ID NO: 356820 - RNA, 64 nt, Human; identical to SEQ ID NO: 123541

SEQ ID NO: 356821 - RNA, 64 nt, Human; identical to SEQ ID NO: 123542

SEQ ID NO: 356822 - RNA, 64 nt, Human; identical to SEQ ID NO: 123543

SEQ ID NO: 356823 - RNA, 64 nt, Human; identical to SEQ ID NO: 123544

SEQ ID NO: 356824 - RNA, 64 nt, Human; identical to SEQ ID NO: 123545

SEQ ID NO: 356825 - RNA, 64 nt, Human; identical to SEQ ID NO: 123546

SEQ ID NO: 356826 - RNA, 64 nt, Human; identical to SEQ ID NO: 58976

SEQ ID NO: 356827 - RNA, 64 nt, Human; identical to SEQ ID NO: 58977

SEQ ID NO: 356828 - RNA, 64 nt, Human; identical to SEQ ID NO: 59013

SEQ ID NO: 356829 - RNA, 64 nt, Human; identical to SEQ ID NO: 123547

SEQ ID NO: 356830 - RNA, 64 nt, Human; identical to SEQ ID NO: 123548

SEQ ID NO: 356831 - RNA, 64 nt, Human; identical to SEQ ID NO: 123549

SEQ ID NO: 356832 - RNA, 64 nt, Human; identical to SEQ ID NO: 123550

SEQ ID NO: 356833 - RNA, 64 nt, Human; identical to SEQ ID NO: 123551

SEQ ID NO: 356834 - RNA, 64 nt, Human; identical to SEQ ID NO: 123552

SEQ ID NO: 356835 - RNA, 64 nt, Human; identical to SEQ ID NO: 123553

SEQ ID NO: 356836 - RNA, 64 nt, Human; identical to SEQ ID NO: 123554

SEQ ID NO: 356837 - RNA, 64 nt, Human; identical to SEQ ID NO: 123555

SEQ ID NO: 356838 - RNA, 64 nt, Human; identical to SEQ ID NO: 123556

SEQ ID NO: 356839 - RNA, 64 nt, Human; identical to SEQ ID NO: 123557

SEQ ID NO: 356840 - RNA, 64 nt, Human; identical to SEQ ID NO: 123558

SEQ ID NO: 356841 - RNA, 64 nt, Human; identical to SEQ ID NO: 123559

SEQ ID NO: 356842 - RNA, 64 nt, Human; identical to SEQ ID NO: 123560

SEQ ID NO: 356843 - RNA, 64 nt, Human; identical to SEQ ID NO: 123561

SEQ ID NO: 356844 - RNA, 64 nt, Human; identical to SEQ ID NO: 59016

SEQ ID NO: 356845 - RNA, 64 nt, Human; identical to SEQ ID NO: 59017

SEQ ID NO: 356846 - RNA, 64 nt, Human; identical to SEQ ID NO: 59018

SEQ ID NO: 356847 - RNA, 64 nt, Human; identical to SEQ ID NO: 123562

SEQ ID NO: 356848 - RNA, 64 nt, Human; identical to SEQ ID NO: 123563

SEQ ID NO: 356849 - RNA, 64 nt, Human; identical to SEQ ID NO: 123564

SEQ ID NO: 356850 - RNA, 64 nt, Human; identical to SEQ ID NO: 123565

SEQ ID NO: 356851 - RNA, 64 nt, Human; identical to SEQ ID NO: 123566

SEQ ID NO: 356852 - RNA, 64 nt, Human; identical to SEQ ID NO: 123567

SEQ ID NO: 356853 - RNA, 64 nt, Human; identical to SEQ ID NO: 123568

SEQ ID NO: 356854 - RNA, 64 nt, Human; identical to SEQ ID NO: 123569

SEQ ID NO: 356855 - RNA, 64 nt, Human; identical to SEQ ID NO: 123570

SEQ ID NO: 356856 - RNA, 64 nt, Human; identical to SEQ ID NO: 123571

SEQ ID NO: 356857 - RNA, 64 nt, Human; identical to SEQ ID NO: 123572

SEQ ID NO: 356858 - RNA, 64 nt, Human; identical to SEQ ID NO: 123573

SEQ ID NO: 356859 - RNA, 64 nt, Human; identical to SEQ ID NO: 123574

SEQ ID NO: 356860 - RNA, 64 nt, Human; identical to SEQ ID NO: 123575

SEQ ID NO: 356861 - RNA, 64 nt, Human; identical to SEQ ID NO: 123576

SEQ ID NO: 356862 - RNA, 64 nt, Human; identical to SEQ ID NO: 59010

SEQ ID NO: 356863 - RNA, 64 nt, Human; identical to SEQ ID NO: 59011

SEQ ID NO: 356864 - RNA, 64 nt, Human; identical to SEQ ID NO: 59019

SEQ ID NO: 356865 - RNA, 64 nt, Human; identical to SEQ ID NO: 123577

SEQ ID NO: 356866 - RNA, 64 nt, Human; identical to SEQ ID NO: 123578

SEQ ID NO: 356867 - RNA, 64 nt, Human; identical to SEQ ID NO: 123579

SEQ ID NO: 356868 - RNA, 64 nt, Human; identical to SEQ ID NO: 123580

SEQ ID NO: 356869 - RNA, 64 nt, Human; identical to SEQ ID NO: 123581

SEQ ID NO: 356870 - RNA, 64 nt, Human; identical to SEQ ID NO: 123582

SEQ ID NO: 356871 - RNA, 64 nt, Human; identical to SEQ ID NO: 123583

SEQ ID NO: 356872 - RNA, 64 nt, Human; identical to SEQ ID NO: 123584

SEQ ID NO: 356873 - RNA, 64 nt, Human; identical to SEQ ID NO: 123585

SEQ ID NO: 356874 - RNA, 64 nt, Human; identical to SEQ ID NO: 123586

SEQ ID NO: 356875 - RNA, 64 nt, Human; identical to SEQ ID NO: 123587

SEQ ID NO: 356876 - RNA, 64 nt, Human; identical to SEQ ID NO: 123588

SEQ ID NO: 356877 - RNA, 64 nt, Human; identical to SEQ ID NO: 123589

SEQ ID NO: 356878 - RNA, 64 nt, Human; identical to SEQ ID NO: 123590

SEQ ID NO: 356879 - RNA, 64 nt, Human; identical to SEQ ID NO: 123591

SEQ ID NO: 356880 - RNA, 64 nt, Human; identical to SEQ ID NO: 59021

SEQ ID NO: 356881 - RNA, 64 nt, Human; identical to SEQ ID NO: 59022

SEQ ID NO: 356882 - RNA, 64 nt, Human; identical to SEQ ID NO: 59023

SEQ ID NO: 356883 - RNA, 64 nt, Human; identical to SEQ ID NO: 123592

SEQ ID NO: 356884 - RNA, 64 nt, Human; identical to SEQ ID NO: 123593

SEQ ID NO: 356885 - RNA, 64 nt, Human; identical to SEQ ID NO: 123594

SEQ ID NO: 356886 - RNA, 64 nt, Human; identical to SEQ ID NO: 123595

SEQ ID NO: 356887 - RNA, 64 nt, Human; identical to SEQ ID NO: 123596

SEQ ID NO: 356888 - RNA, 64 nt, Human; identical to SEQ ID NO: 123597

SEQ ID NO: 356889 - RNA, 64 nt, Human; identical to SEQ ID NO: 123598

SEQ ID NO: 356890 - RNA, 64 nt, Human; identical to SEQ ID NO: 123599

SEQ ID NO: 356891 - RNA, 51 nt, Human; identical to SEQ ID NO: 123600

SEQ ID NO: 356892 - RNA, 64 nt, Human; identical to SEQ ID NO: 123601

SEQ ID NO: 356893 - RNA, 64 nt, Human; identical to SEQ ID NO: 123602

SEQ ID NO: 356894 - RNA, 64 nt, Human; identical to SEQ ID NO: 123603

SEQ ID NO: 356895 - RNA, 64 nt, Human; identical to SEQ ID NO: 123604

SEQ ID NO: 356896 - RNA, 64 nt, Human; identical to SEQ ID NO: 123605

SEQ ID NO: 356897 - RNA, 64 nt, Human; identical to SEQ ID NO: 123606

SEQ ID NO: 356898 - RNA, 64 nt, Human; identical to SEQ ID NO: 59024

SEQ ID NO: 356899 - RNA, 64 nt, Human; identical to SEQ ID NO: 59025

SEQ ID NO: 356900 - RNA, 62 nt, Human
cuacuuuuguuccacauucucucucuuuaccuuugcccuaccuucuguuuguaaggaugauu

SEQ ID NO: 356901 - RNA, 64 nt, Human; identical to SEQ ID NO: 123607

SEQ ID NO: 356902 - RNA, 64 nt, Human; identical to SEQ ID NO: 123608

SEQ ID NO: 356903 - RNA, 64 nt, Human; identical to SEQ ID NO: 123609

SEQ ID NO: 356904 - RNA, 64 nt, Human; identical to SEQ ID NO: 123610

SEQ ID NO: 356905 - RNA, 64 nt, Human; identical to SEQ ID NO: 123611

SEQ ID NO: 356906 - RNA, 64 nt, Human; identical to SEQ ID NO: 123612

SEQ ID NO: 356907 - RNA, 64 nt, Human; identical to SEQ ID NO: 123613

SEQ ID NO: 356908 - RNA, 64 nt, Human; identical to SEQ ID NO: 123614

SEQ ID NO: 356909 - RNA, 64 nt, Human; identical to SEQ ID NO: 123615

SEQ ID NO: 356910 - RNA, 64 nt, Human; identical to SEQ ID NO: 123616

SEQ ID NO: 356911 - RNA, 64 nt, Human; identical to SEQ ID NO: 123617

SEQ ID NO: 356912 - RNA, 64 nt, Human; identical to SEQ ID NO: 123618

SEQ ID NO: 356913 - RNA, 64 nt, Human; identical to SEQ ID NO: 123619

SEQ ID NO: 356914 - RNA, 64 nt, Human; identical to SEQ ID NO: 123620

SEQ ID NO: 356915 - RNA, 64 nt, Human; identical to SEQ ID NO: 123621

SEQ ID NO: 356916 - RNA, 64 nt, Human; identical to SEQ ID NO: 59027

SEQ ID NO: 356917 - RNA, 64 nt, Human; identical to SEQ ID NO: 59028

SEQ ID NO: 356918 - RNA, 64 nt, Human; identical to SEQ ID NO: 59029

SEQ ID NO: 356919 - RNA, 64 nt, Human; identical to SEQ ID NO: 123622

SEQ ID NO: 356920 - RNA, 64 nt, Human; identical to SEQ ID NO: 123623

SEQ ID NO: 356921 - RNA, 64 nt, Human; identical to SEQ ID NO: 123624

SEQ ID NO: 356922 - RNA, 64 nt, Human; identical to SEQ ID NO: 123625

SEQ ID NO: 356923 - RNA, 64 nt, Human; identical to SEQ ID NO: 123626

SEQ ID NO: 356924 - RNA, 64 nt, Human; identical to SEQ ID NO: 123627

SEQ ID NO: 356925 - RNA, 64 nt, Human; identical to SEQ ID NO: 123628

SEQ ID NO: 356926 - RNA, 64 nt, Human; identical to SEQ ID NO: 123629

SEQ ID NO: 356927 - RNA, 64 nt, Human; identical to SEQ ID NO: 123630

SEQ ID NO: 356928 - RNA, 64 nt, Human; identical to SEQ ID NO: 123631

SEQ ID NO: 356929 - RNA, 64 nt, Human; identical to SEQ ID NO: 123632

SEQ ID NO: 356930 - RNA, 64 nt, Human; identical to SEQ ID NO: 123633

SEQ ID NO: 356931 - RNA, 64 nt, Human; identical to SEQ ID NO: 123634

SEQ ID NO: 356932 - RNA, 54 nt, Human; identical to SEQ ID NO: 123635

SEQ ID NO: 356933 - RNA, 64 nt, Human; identical to SEQ ID NO: 123636

SEQ ID NO: 356934 - RNA, 64 nt, Human; identical to SEQ ID NO: 58995

SEQ ID NO: 356935 - RNA, 64 nt, Human; identical to SEQ ID NO: 58996

SEQ ID NO: 356936 - RNA, 61 nt, Human
ccgcggcggacugccccaggacugcgggaaggcgcgggagccaggggccuccaccccaacc

SEQ ID NO: 356937 - RNA, 64 nt, Human; identical to SEQ ID NO: 123637

SEQ ID NO: 356938 - RNA, 64 nt, Human; identical to SEQ ID NO: 123638

SEQ ID NO: 356939 - RNA, 64 nt, Human; identical to SEQ ID NO: 123639

SEQ ID NO: 356940 - RNA, 64 nt, Human; identical to SEQ ID NO: 123640

SEQ ID NO: 356941 - RNA, 64 nt, Human; identical to SEQ ID NO: 123641

SEQ ID NO: 356942 - RNA, 64 nt, Human; identical to SEQ ID NO: 123642

SEQ ID NO: 356943 - RNA, 64 nt, Human; identical to SEQ ID NO: 123643

SEQ ID NO: 356944 - RNA, 64 nt, Human; identical to SEQ ID NO: 123644

SEQ ID NO: 356945 - RNA, 64 nt, Human; identical to SEQ ID NO: 123645

SEQ ID NO: 356946 - RNA, 64 nt, Human; identical to SEQ ID NO: 123646

SEQ ID NO: 356947 - RNA, 64 nt, Human; identical to SEQ ID NO: 123647

SEQ ID NO: 356948 - RNA, 64 nt, Human; identical to SEQ ID NO: 123648

SEQ ID NO: 356949 - RNA, 64 nt, Human; identical to SEQ ID NO: 123649

SEQ ID NO: 356950 - RNA, 64 nt, Human; identical to SEQ ID NO: 123650

SEQ ID NO: 356951 - RNA, 64 nt, Human; identical to SEQ ID NO: 123651

SEQ ID NO: 356952 - RNA, 64 nt, Human; identical to SEQ ID NO: 58988

SEQ ID NO: 356953 - RNA, 64 nt, Human; identical to SEQ ID NO: 58989

SEQ ID NO: 356954 - RNA, 64 nt, Human; identical to SEQ ID NO: 59001

SEQ ID NO: 356955 - RNA, 64 nt, Human; identical to SEQ ID NO: 123652

SEQ ID NO: 356956 - RNA, 64 nt, Human; identical to SEQ ID NO: 123653

SEQ ID NO: 356957 - RNA, 64 nt, Human; identical to SEQ ID NO: 123654

SEQ ID NO: 356958 - RNA, 64 nt, Human; identical to SEQ ID NO: 123655

SEQ ID NO: 356959 - RNA, 64 nt, Human; identical to SEQ ID NO: 123656

SEQ ID NO: 356960 - RNA, 64 nt, Human; identical to SEQ ID NO: 123657

SEQ ID NO: 356961 - RNA, 64 nt, Human; identical to SEQ ID NO: 123658

SEQ ID NO: 356962 - RNA, 64 nt, Human; identical to SEQ ID NO: 123659

SEQ ID NO: 356963 - RNA, 64 nt, Human; identical to SEQ ID NO: 123660

SEQ ID NO: 356964 - RNA, 64 nt, Human; identical to SEQ ID NO: 123661

SEQ ID NO: 356965 - RNA, 64 nt, Human; identical to SEQ ID NO: 123662

SEQ ID NO: 356966 - RNA, 64 nt, Human; identical to SEQ ID NO: 123663

SEQ ID NO: 356967 - RNA, 64 nt, Human; identical to SEQ ID NO: 123664

SEQ ID NO: 356968 - RNA, 64 nt, Human; identical to SEQ ID NO: 123665

SEQ ID NO: 356969 - RNA, 64 nt, Human; identical to SEQ ID NO: 123666

SEQ ID NO: 356970 - RNA, 64 nt, Human; identical to SEQ ID NO: 58973

SEQ ID NO: 356971 - RNA, 64 nt, Human; identical to SEQ ID NO: 58974

SEQ ID NO: 356972 - RNA, 64 nt, Human; identical to SEQ ID NO: 58975

SEQ ID NO: 356973 - RNA, 64 nt, Human; identical to SEQ ID NO: 123667

SEQ ID NO: 356974 - RNA, 64 nt, Human; identical to SEQ ID NO: 123668

SEQ ID NO: 356975 - RNA, 64 nt, Human; identical to SEQ ID NO: 123669

SEQ ID NO: 356976 - RNA, 64 nt, Human; identical to SEQ ID NO: 123670

SEQ ID NO: 356977 - RNA, 64 nt, Human; identical to SEQ ID NO: 123671

SEQ ID NO: 356978 - RNA, 64 nt, Human; identical to SEQ ID NO: 123672

SEQ ID NO: 356979 - RNA, 64 nt, Human; identical to SEQ ID NO: 123673

SEQ ID NO: 356980 - RNA, 64 nt, Human; identical to SEQ ID NO: 123674

SEQ ID NO: 356981 - RNA, 64 nt, Human; identical to SEQ ID NO: 123675

SEQ ID NO: 356982 - RNA, 58 nt, Human; identical to SEQ ID NO: 123676

SEQ ID NO: 356983 - RNA, 64 nt, Human; identical to SEQ ID NO: 123677

SEQ ID NO: 356984 - RNA, 64 nt, Human; identical to SEQ ID NO: 123678

SEQ ID NO: 356985 - RNA, 64 nt, Human; identical to SEQ ID NO: 123679

SEQ ID NO: 356986 - RNA, 64 nt, Human; identical to SEQ ID NO: 123680

SEQ ID NO: 356987 - RNA, 64 nt, Human; identical to SEQ ID NO: 123681

SEQ ID NO: 356988 - RNA, 64 nt, Human; identical to SEQ ID NO: 58984

SEQ ID NO: 356989 - RNA, 64 nt, Human; identical to SEQ ID NO: 58985

SEQ ID NO: 356990 - RNA, 64 nt, Human; identical to SEQ ID NO: 58986

SEQ ID NO: 356991 - RNA, 64 nt, Human; identical to SEQ ID NO: 123682

SEQ ID NO: 356992 - RNA, 64 nt, Human; identical to SEQ ID NO: 123683

SEQ ID NO: 356993 - RNA, 64 nt, Human; identical to SEQ ID NO: 123684

SEQ ID NO: 356994 - RNA, 64 nt, Human; identical to SEQ ID NO: 123685

SEQ ID NO: 356995 - RNA, 64 nt, Human; identical to SEQ ID NO: 123686

SEQ ID NO: 356996 - RNA, 50 nt, Human; identical to SEQ ID NO: 123687

SEQ ID NO: 356997 - RNA, 64 nt, Human; identical to SEQ ID NO: 123688

SEQ ID NO: 356998 - RNA, 64 nt, Human; identical to SEQ ID NO: 123689

SEQ ID NO: 356999 - RNA, 64 nt, Human; identical to SEQ ID NO: 123690

SEQ ID NO: 357000 - RNA, 64 nt, Human; identical to SEQ ID NO: 123691

SEQ ID NO: 357001 - RNA, 64 nt, Human; identical to SEQ ID NO: 123692

SEQ ID NO: 357002 - RNA, 64 nt, Human; identical to SEQ ID NO: 123693

SEQ ID NO: 357003 - RNA, 64 nt, Human; identical to SEQ ID NO: 123694

SEQ ID NO: 357004 - RNA, 64 nt, Human; identical to SEQ ID NO: 123695

SEQ ID NO: 357005 - RNA, 64 nt, Human; identical to SEQ ID NO: 123696

SEQ ID NO: 357006 - RNA, 64 nt, Human; identical to SEQ ID NO: 58979

SEQ ID NO: 357007 - RNA, 64 nt, Human; identical to SEQ ID NO: 58980

SEQ ID NO: 357008 - RNA, 64 nt, Human; identical to SEQ ID NO: 58981

SEQ ID NO: 357009 - RNA, 64 nt, Human; identical to SEQ ID NO: 123697

SEQ ID NO: 357010 - RNA, 64 nt, Human; identical to SEQ ID NO: 123698

SEQ ID NO: 357011 - RNA, 64 nt, Human; identical to SEQ ID NO: 123699

SEQ ID NO: 357012 - RNA, 64 nt, Human; identical to SEQ ID NO: 123700

SEQ ID NO: 357013 - RNA, 64 nt, Human; identical to SEQ ID NO: 123701

SEQ ID NO: 357014 - RNA, 64 nt, Human; identical to SEQ ID NO: 123702

SEQ ID NO: 357015 - RNA, 64 nt, Human; identical to SEQ ID NO: 123703

SEQ ID NO: 357016 - RNA, 64 nt, Human; identical to SEQ ID NO: 123704

SEQ ID NO: 357017 - RNA, 64 nt, Human; identical to SEQ ID NO: 123705

SEQ ID NO: 357018 - RNA, 64 nt, Human; identical to SEQ ID NO: 123706

SEQ ID NO: 357019 - RNA, 64 nt, Human; identical to SEQ ID NO: 58985

SEQ ID NO: 357020 - RNA, 64 nt, Human; identical to SEQ ID NO: 58986

SEQ ID NO: 357021 - RNA, 59 nt, Human; identical to SEQ ID NO: 58987

SEQ ID NO: 357022 - RNA, 64 nt, Human
gucacguguggacaucuccucaggcuuugugucacgcguggacaucuccucaggcuguccccag

SEQ ID NO: 357023 - RNA, 64 nt, Human
acggcucaacuccuccuuuaucauuaccaucucccgcguggaguucuccucaggucgugcgaaa

SEQ ID NO: 357024 - RNA, 64 nt, Human
gacgaagcgaggagaguucuccauccccucuccccgcguggacuccugagccugcggguccagg

SEQ ID NO: 357025 - RNA, 64 nt, Human
guucagggaacccaggaaaaugggaggagaacgccgcguggacugaagcucuucaugaugagau

SEQ ID NO: 357026 - RNA, 64 nt, Human
cgagugggcucuggaccgggccuaccgcgaugcgcgcguggaacucugagggaagaguuagccc

SEQ ID NO: 357027 - RNA, 64 nt, Human
acaagggggcccucaaacaugauagcaggaacuacgcguggaacaucugucuaauguagcaucc

SEQ ID NO: 357028 - RNA, 64 nt, Human
ccccgcggaucaaccaggcagaguucuguggcgccgcguggacagccggagcaguuggccugug

SEQ ID NO: 357029 - RNA, 64 nt, Human
uaaggagccucuggcaaaugggugcucaucagaacgcguggauucucuuucauggcagaaugcu

SEQ ID NO: 357030 - RNA, 64 nt, Human
guucacucccgaggauguguccuagacuccgggucgcguggaucuacccucuaguuuacuugcu

SEQ ID NO: 357031 - RNA, 64 nt, Human
ucuuuccauucuuugcccccagcaugaguuaacucgcguggacucugcagugcgaguagugacc

SEQ ID NO: 357032 - RNA, 64 nt, Human
aggacccaggguugcggagagacgcggccccucccgcguggacaucaccgccaugagccucuuu

SEQ ID NO: 357033 - RNA, 64 nt, Human
augugucacuuggaccacugucaguauuccaugccgcguggaugggcccaguucugggagagga

SEQ ID NO: 357034 - RNA, 64 nt, Human; identical to SEQ ID NO: 58982

SEQ ID NO: 357035 - RNA, 64 nt, Human; identical to SEQ ID NO: 58983

SEQ ID NO: 357036 - RNA, 64 nt, Human; identical to SEQ ID NO: 59014

SEQ ID NO: 357037 - RNA, 64 nt, Human
gacuucaggguccccuaacggaaaggccaggcuccgcguggacggccaacucccugcccgcucc

SEQ ID NO: 357038 - RNA, 64 nt, Human
gcccgaggucaucaccucccaguacaacaacaugcgcguggaguucaaguccgacaacaccgug

SEQ ID NO: 357039 - RNA, 64 nt, Human
uaccucugcccggguguuugagacaggucacaagcgcguggauguuuccuggaaguguauuccc

SEQ ID NO: 357040 - RNA, 64 nt, Human
cgugaaugucucagcgagguguaaaguuguucgccgcguggaaugugaguguguuugugugcau

SEQ ID NO: 357041 - RNA, 64 nt, Human
gggagggagaggcaggggagagagaauggcaucucgcguggagggcugucguuugaacucuccc

SEQ ID NO: 357042 - RNA, 64 nt, Human
ggggccagucucuugucacuuuggaaacugaggacgcguggauucuacucaagccuccaaguag

SEQ ID NO: 357043 - RNA, 64 nt, Human
cacuggccccggcccacggcacagcaauccccugcgcguggauuucaccucacccuuuguacca

SEQ ID NO: 357044 - RNA, 64 nt, Human
gugaugggaaugacagugagaagguccgccugugcgcguggaacacuguggacgcucgacuucc

SEQ ID NO: 357045 - RNA, 64 nt, Human
gcguuuuuccucuggaaaugcccacagggcuugccgcguggagacugaucuguuccauccguua

SEQ ID NO: 357046 - RNA, 64 nt, Human
gguggcucgggaggcgaagcguuguccucagccccgcguggaacucgugucuggcacagccugg

SEQ ID NO: 357047 - RNA, 64 nt, Human
ugagagugcaugccauggagacugguuuagacaccgcguggagccuaguugccuguugucacgg

SEQ ID NO: 357048 - RNA, 64 nt, Human
accagucuucgguguguggaaugugguauuuucccgcguggaggugugcuuucucacaacgggg

SEQ ID NO: 357049 - RNA, 64 nt, Human
ugaauuuuauccaccuccauuucagcauguggcucgcguggacagguggacggacgcuguggcc

SEQ ID NO: 357050 - RNA, 64 nt, Human
uaagagcagcagccaacacguuuagcagacacugcgcguggagaagggcuuaucugcaguacac

SEQ ID NO: 357051 - RNA, 64 nt, Human
aagaaggcgaguucugaguguuggaugagucagucgcguggaaggacguggagcguggcgcucu

SEQ ID NO: 357052 - RNA, 64 nt, Human
cugaggugaacuguggggguugcgcacagccagccgcguggaucccacgcagcgcugaaccgaa

SEQ ID NO: 357053 - RNA, 64 nt, Human; identical to SEQ ID NO: 58991

SEQ ID NO: 357054 - RNA, 64 nt, Human; identical to SEQ ID NO: 58992

SEQ ID NO: 357055 - RNA, 64 nt, Human; identical to SEQ ID NO: 58993

SEQ ID NO: 357056 - RNA, 64 nt, Human; identical to SEQ ID NO: 58994

SEQ ID NO: 357057 - RNA, 64 nt, Human
gcgcaaagcuuucugggaguuguaguucuuaucccgcguggaauguugggagauugaguuuucg

SEQ ID NO: 357058 - RNA, 64 nt, Human
uggcccugccgcugacucaggucuccgccaugcacgcguggacucucggaugagcucagcagaa

SEQ ID NO: 357059 - RNA, 64 nt, Human
acacaucugucagggugugagcacuccaaggccucgcguggagcauccuuagucccaccuguag

SEQ ID NO: 357060 - RNA, 64 nt, Human
accucugccugggggcucccuguaaccccucacacgcguggagacuuaugacucgucgugggcg

SEQ ID NO: 357061 - RNA, 50 nt, Human; identical to SEQ ID NO: 58964

SEQ ID NO: 357062 - RNA, 64 nt, Human; identical to SEQ ID NO: 58965

SEQ ID NO: 357063 - RNA, 64 nt, Human; identical to SEQ ID NO: 58966

SEQ ID NO: 357064 - RNA, 64 nt, Human; identical to SEQ ID NO: 58967

SEQ ID NO: 357065 - RNA, 64 nt, Human; identical to SEQ ID NO: 58968

SEQ ID NO: 357066 - RNA, 64 nt, Human; identical to SEQ ID NO: 58969

SEQ ID NO: 357067 - RNA, 61 nt, Human
gccagauggagccaaaggucagcucucugcagcgcgggaugugcucggugauggcuuuguc

SEQ ID NO: 357068 - RNA, 61 nt, Human
agcgaggcuuuggguccacgcacaggaucgcgcgcgggaucgcagguagagcaggacgcug

SEQ ID NO: 357069 - RNA, 61 nt, Human
gccagauuugauuagauuguaauuggagggggcgcgggaagacuuugggcccagaaccauc

SEQ ID NO: 357070 - RNA, 50 nt, Human; identical to SEQ ID NO: 58964

SEQ ID NO: 357071 - RNA, 64 nt, Human; identical to SEQ ID NO: 58965

SEQ ID NO: 357072 - RNA, 64 nt, Human; identical to SEQ ID NO: 58966

SEQ ID NO: 357073 - RNA, 64 nt, Human; identical to SEQ ID NO: 58967

SEQ ID NO: 357074 - RNA, 64 nt, Human; identical to SEQ ID NO: 58968

SEQ ID NO: 357075 - RNA, 64 nt, Human; identical to SEQ ID NO: 58969

SEQ ID NO: 357076 - RNA, 64 nt, Human; identical to SEQ ID NO: 58970

SEQ ID NO: 357077 - RNA, 64 nt, Human; identical to SEQ ID NO: 58971

SEQ ID NO: 357078 - RNA, 64 nt, Human; identical to SEQ ID NO: 58972

SEQ ID NO: 357079 - RNA, 64 nt, Human; identical to SEQ ID NO: 58973

SEQ ID NO: 357080 - RNA, 64 nt, Human; identical to SEQ ID NO: 58974

SEQ ID NO: 357081 - RNA, 64 nt, Human; identical to SEQ ID NO: 58975

SEQ ID NO: 357082 - RNA, 64 nt, Human; identical to SEQ ID NO: 58976

SEQ ID NO: 357083 - RNA, 64 nt, Human; identical to SEQ ID NO: 58977

SEQ ID NO: 357084 - RNA, 64 nt, Human; identical to SEQ ID NO: 58978

SEQ ID NO: 357085 - RNA, 64 nt, Human; identical to SEQ ID NO: 58979

SEQ ID NO: 357086 - RNA, 64 nt, Human; identical to SEQ ID NO: 58980

SEQ ID NO: 357087 - RNA, 64 nt, Human; identical to SEQ ID NO: 59007

SEQ ID NO: 357088 - RNA, 64 nt, Human; identical to SEQ ID NO: 59008

SEQ ID NO: 357089 - RNA, 64 nt, Human; identical to SEQ ID NO: 59009

SEQ ID NO: 357090 - RNA, 64 nt, Human; identical to SEQ ID NO: 59010

SEQ ID NO: 357091 - RNA, 64 nt, Human; identical to SEQ ID NO: 59011

SEQ ID NO: 357092 - RNA, 64 nt, Human; identical to SEQ ID NO: 59012

SEQ ID NO: 357093 - RNA, 64 nt, Human; identical to SEQ ID NO: 59013

SEQ ID NO: 357094 - RNA, 64 nt, Human; identical to SEQ ID NO: 59014

SEQ ID NO: 357095 - RNA, 64 nt, Human; identical to SEQ ID NO: 59015

SEQ ID NO: 357096 - RNA, 64 nt, Human; identical to SEQ ID NO: 59016

SEQ ID NO: 357097 - RNA, 64 nt, Human; identical to SEQ ID NO: 59017

SEQ ID NO: 357098 - RNA, 64 nt, Human; identical to SEQ ID NO: 59018

SEQ ID NO: 357099 - RNA, 64 nt, Human; identical to SEQ ID NO: 59019

SEQ ID NO: 357100 - RNA, 64 nt, Human; identical to SEQ ID NO: 59020

SEQ ID NO: 357101 - RNA, 64 nt, Human; identical to SEQ ID NO: 59021

SEQ ID NO: 357102 - RNA, 64 nt, Human; identical to SEQ ID NO: 59022

SEQ ID NO: 357103 - RNA, 64 nt, Human; identical to SEQ ID NO: 59023

SEQ ID NO: 357104 - RNA, 64 nt, Human; identical to SEQ ID NO: 59024

SEQ ID NO: 357105 - RNA, 64 nt, Human; identical to SEQ ID NO: 59025

SEQ ID NO: 357106 - RNA, 64 nt, Human; identical to SEQ ID NO: 59026

SEQ ID NO: 357107 - RNA, 64 nt, Human; identical to SEQ ID NO: 59027

SEQ ID NO: 357108 - RNA, 64 nt, Human; identical to SEQ ID NO: 59028

SEQ ID NO: 357109 - RNA, 64 nt, Human; identical to SEQ ID NO: 59029

SEQ ID NO: 357110 - RNA, 61 nt, Human
ccaagcuucccacgacccugguugccaaugggcgcgggagacauuguauacacaucaugcu

SEQ ID NO: 357111 - RNA, 64 nt, Human
cgccccagggccguugccugcucagaccuugcaggcuguggagcaagaggcccugggucucucc

SEQ ID NO: 357112 - RNA, 64 nt, Human
ucgcccaguucuuuguggcucugaagaauuggccgcuguggaaaagagcaaauguccgagaccc

SEQ ID NO: 357113 - RNA, 64 nt, Human
cagcucuggaaaaaccugggaguugaugccggaggcuguggaagaacucugcucgagggcaggg

SEQ ID NO: 357114 - RNA, 64 nt, Human
aaaagaguucuacccagcaguuggcagauuaucagcuguggacuccagcauguuucugauaauu

SEQ ID NO: 357115 - RNA, 64 nt, Human
uuccccucucccccuuccugacccuacuugcacugcuguggauuuuuuuaagagaagcaaaaac

SEQ ID NO: 357116 - RNA, 64 nt, Human
agauucuuccuaaagccucccccauaaaaagggagcuguggauccacuuagaucagggcggaac

SEQ ID NO: 357117 - RNA, 64 nt, Human
uaggugccaggggaccaucgugguucucuagggcgcuguggaaauugggucuugggcugggugg

SEQ ID NO: 357118 - RNA, 64 nt, Human
gcaggacugaggaguggccagcucuggauagcuggcuguggagaggaagccuccaugggcugcu

SEQ ID NO: 357119 - RNA, 64 nt, Human
uggagugggcaagaccaggccaccugcugaggucgcuguggagcacccucgcuccucuccuggc

SEQ ID NO: 357120 - RNA, 64 nt, Human
uuuggaugggaguagaggaaguugguguagaccagcuguggagcugaaggcacagucugcccca

SEQ ID NO: 357121 - RNA, 64 nt, Human
gccccugaagccuggcuuggguugaaaaguguucccgcccuaaggccuuggugcccugaaccuc

SEQ ID NO: 357122 - RNA, 64 nt, Human
cgccacguccucccaaggggccuucugcccgcccccgcccuagcugugccuuagucagugugua

SEQ ID NO: 357123 - RNA, 63 nt, Human
gagaccuauuuuuguacaaagaacccuugaccuggggcguaauaaagaugaccuggaccccug

SEQ ID NO: 357124 - RNA, 63 nt, Human
gugaggcugggcagauggucucggagccuccauggggcguagcaggaaccgggcuuggcuucc

SEQ ID NO: 357125 - RNA, 64 nt, Human
uguuuuuugagccuacaauacugagcgcaacaaggcuguggagacccauggugaggagcaugga

SEQ ID NO: 357126 - RNA, 64 nt, Human
ugcugagggccucuggacacaggcuggaccagaugcuguggaugucgaccccugcacugacuau

SEQ ID NO: 357127 - RNA, 64 nt, Human
gucugucaggucgaugucucagaacacucucccagcuguggaccacguggaccacuuagcagac

SEQ ID NO: 357128 - RNA, 64 nt, Human
uuccuggcccacaguggccagugccauaggcagugcuguggacaguagaggcugccaaaggcaa

SEQ ID NO: 357129 - RNA, 64 nt, Human
aauaaaagcaauagauuugauuaguaauauuauugcuguggaguucuuuacaaagggcuuaggc

SEQ ID NO: 357130 - RNA, 64 nt, Human
gaaacuucgcugucccccaacacugagcaaguaugcuguggagucccaaccccagcuacucuga

SEQ ID NO: 357131 - RNA, 64 nt, Human
caccugcucuccaccuggacucaggccgggcugggcuguggauuccugauccccuccccucccc

SEQ ID NO: 357132 - RNA, 64 nt, Human
gaguucccccauucauccauuugucccauuaguugcuguggauuaucaaguuuugaaggaacug

SEQ ID NO: 357133 - RNA, 64 nt, Human
aaaagaaguauaaaaacaacuguauugaguugaggcuguggagaaauaaggacacauauauggg

SEQ ID NO: 357134 - RNA, 64 nt, Human
uugcuuccccuugccccuucccacuuuucuaaaagcuguggagggaucuagcuggccuaugucu

SEQ ID NO: 357135 - RNA, 64 nt, Human
gauggccccuccacuggggaaugcucccagcugugcuguggagagaagcugauguuuuggugua

SEQ ID NO: 357136 - RNA, 64 nt, Human
cuugauacugggccucuuccuugucaugucugaagcuguggaccagagaccuggacuuuugucu

SEQ ID NO: 357137 - RNA, 64 nt, Human
ucuggagaaugcucuggggaguacaccaggcucagcuguggaccccucaacuuccugcugcuca

SEQ ID NO: 357138 - RNA, 64 nt, Human
aauaaucugaaauccagucugaacuaaggccugagcuguggauaccauggcgcgugaguuagau

SEQ ID NO: 357139 - RNA, 64 nt, Human
caccccagagugggagaggcugggagguugggaggcuguggagagaagugagcaaggugcucuu

SEQ ID NO: 357140 - RNA, 64 nt, Human
gccugaggaaaacccccuuagguaccugugcgaggcuguggagugcaggccagagcagggugug

SEQ ID NO: 357141 - RNA, 62 nt, Human
gcuuuuaugcuugcuuccauuauuucaguugguugcccuaauauuuaaaauuuacacuucua

SEQ ID NO: 357142 - RNA, 62 nt, Human
uucaaacaacuguacggaguggcauauuagaauugcccuaaacugaacugcaaauaauuaug

SEQ ID NO: 357143 - RNA, 62 nt, Human
ccagaguauguggaccccccaaaguccagagauugcccuaggggaucuuuagauucuuguuu

SEQ ID NO: 357144 - RNA, 62 nt, Human
cuccauguucugcauguaagaaacacaaugccuugcccuacucagaccugauaggauugccu

SEQ ID NO: 357145 - RNA, 64 nt, Human
ucaucaggacauucugaaauuuacccacagugaggcuguggauggaucaggggaccuguauaaa

SEQ ID NO: 357146 - RNA, 64 nt, Human
cucccgugagucuccagccugcccagcaccggcagcuguggagcacguggaugcugccuacccc

SEQ ID NO: 357147 - RNA, 64 nt, Human
ccugguacugcccuuccuuugagggccguggagggcuguggacagcccagcaaccugucgcucu

SEQ ID NO: 357148 - RNA, 64 nt, Human
cguggccguggagcagucguggugaaaccggucagcuguggaccugcccugcgaaucggcagag

SEQ ID NO: 357149 - RNA, 64 nt, Human
caagcaguuauaaguuauuuauuuguuaacgcuggcuguggaaaccccaguucuuggggggaga

SEQ ID NO: 357150 - RNA, 64 nt, Human
cuugguggggcucguggccuuccccuuuugccuggcuguggaggccugaugcugccccguuccc

SEQ ID NO: 357151 - RNA, 64 nt, Human
ucaaaacauacauaacauugaaacagaaggaaaugcuguggaccacagaacuccaagaauuguu

SEQ ID NO: 357152 - RNA, 64 nt, Human
acccacucaggauugggaauugucuuuagugccggcuguggagcaaaaggcagcucaccccugg

SEQ ID NO: 357153 - RNA, 64 nt, Human
ggaaccuuucccuuguguguaccacacccugccugcuguggagcccauuguggaggcggugggg

SEQ ID NO: 357154 - RNA, 64 nt, Human
ggugcugauucagcaucacaagugacugaaauuggcuguggaucuguucuuugugaaagaauuc

SEQ ID NO: 357155 - RNA, 64 nt, Human
uccuacgaucugguuacugccuggccgauccaaggcuguggagucccagagccagcaguucacu

SEQ ID NO: 357156 - RNA, 64 nt, Human
ccgccuccagaguggccuggcagcuuugccagaggcuguggagcgaggguaguaggagcuuuuc

SEQ ID NO: 357157 - RNA, 64 nt, Human
ucuccccaaugagacuugccuuccuaagccuguggcuguggagacaaugucugcagcccugaga

SEQ ID NO: 357158 - RNA, 64 nt, Human
agagacuggcccaggcacugaaugucuaggacaugcuguggaugaagauaaagaugguggaaua

SEQ ID NO: 357159 - RNA, 64 nt, Human
cccccacccucccuccccucgaggugguaccuaagcuguggauuugcuaaaugaauuaagcaac

SEQ ID NO: 357160 - RNA, 64 nt, Human
gcucacaugggaggcuggagguggguacccagcugcuguggaacggguauggacaggucauaaa

SEQ ID NO: 357161 - RNA, 62 nt, Human
acuagaauuaaauggauguuuagacuggcuacuugcccuaaaccagcacuuggugaugucua

SEQ ID NO: 357162 - RNA, 62 nt, Human
acaugguuauugaccugaagccagccuaggccuugcccuacaguuguuuuucccuuguagcc

SEQ ID NO: 357163 - RNA, 62 nt, Human
auuuuccuguuuucuuccagagucccaauccuuugcccuaguucuuucacuaguuugaaauc

SEQ ID NO: 357164 - RNA, 62 nt, Human
aggccagauacauucuagagaauugugagacuuugcccuaagcugccaagugcuccccaagg

SEQ ID NO: 357165 - RNA, 64 nt, Human
uacuggacagacccuuuugagaugugccuguggugcuguggagauguguguaguggucuuagcu

SEQ ID NO: 357166 - RNA, 64 nt, Human
gaaaaccugcagugaaaccuauugacauggccacgcuguggaaugaugugaauuggcccuguuu

SEQ ID NO: 357167 - RNA, 64 nt, Human
cccuuaacuugauauaauguguuaugcuuauggcgcuguggacaaucugauuuuucaugucaac

SEQ ID NO: 357168 - RNA, 64 nt, Human
cacagacccugcccaccccaucccuggcugaccugcuguggaugucccuauucugccaugggag

SEQ ID NO: 357169 - RNA, 64 nt, Human
ucucauuucuuucuaacuguagcuaucauuacuggcuguggauagcccauagcuauuuuccuug

SEQ ID NO: 357170 - RNA, 64 nt, Human
gagaucugccacaugucugaggguugcagagcccgcuguggagguaagauuggaaacacaugag

SEQ ID NO: 357171 - RNA, 64 nt, Human
gauauugccauacugaaccucauucuaaacuggugcuguggauagucuuucccucuccccuccu

SEQ ID NO: 357172 - RNA, 64 nt, Human
auggcgccgcccaaaugcgcccggaggccguuaggcuguggagggcgaggaaggcgguccagag

SEQ ID NO: 357173 - RNA, 64 nt, Human
caaauuaguucuuccuccucaacucauaggaguagcuguggacagaggaaccaacaucugccac

SEQ ID NO: 357174 - RNA, 64 nt, Human
cucuggggaugccggggcaggaggacgagggugcgcuguggacacagcaguccgcggaauuccg

SEQ ID NO: 357175 - RNA, 64 nt, Human
aaaaaaaaaaaaaaaaaaccaaaaaaacuguccagcuguggacuuucaggauucaggacugcug

SEQ ID NO: 357176 - RNA, 64 nt, Human
cacauuucccucuggccuggcggccuccaggcuggcuguggaaacaguuccugaggaaauuaga

SEQ ID NO: 357177 - RNA, 64 nt, Human
aguccacgguccucccccacuggauggugcuacugcuguggaaucuuguaaaaaccaugugggg

SEQ ID NO: 357178 - RNA, 64 nt, Human
guacacggugggcugaguacagucauucuguugggcuguggagauagugccagggugcggccug

SEQ ID NO: 357179 - RNA, 64 nt, Human
uauccuuuaauuuuacagauaccacuugcuguaggcuguggaccaagauguccagaauuauucu

SEQ ID NO: 357180 - RNA, 64 nt, Human
uaccacagacuauuaaaacuaauaaucaccauaugcuguggacaccaccuauuuucuuuguugg

SEQ ID NO: 357181 - RNA, 62 nt, Human
guacuucauaaaauccucuuauagaguuacucuugcccuagauuguaaauuaaguuuggcau

SEQ ID NO: 357182 - RNA, 62 nt, Human
ccaguuacucuucccacaaguucccuuaagucuugcccuagcugugcucugccaccuuccag

SEQ ID NO: 357183 - RNA, 62 nt, Human
uucuuuucucacauuuacucaaaugcauugucuugcccuauagacucaggaguugcuucuca

SEQ ID NO: 357184 - RNA, 62 nt, Human
aaauacgacucuguugucuuacuugauauuucuugcccuaguaauguacuugacauuuaugu

SEQ ID NO: 357185 - RNA, 64 nt, Human
agcugaauaaaggugaauuauauaauuuauaauagcuguggaugagcacaggagagagaggaaa

SEQ ID NO: 357186 - RNA, 64 nt, Human
ucuccuggucucugggucuggcuuccaggcucuggcuguggaugucuucagccucugggugcug

SEQ ID NO: 357187 - RNA, 64 nt, Human
ucccagaagcaucugacugucaccacugccaguggcuguggaacaguccugggcccugggccuu

SEQ ID NO: 357188 - RNA, 64 nt, Human
aagggcccuguauucaccuccacugcccccaggggcuguggacaaaccggcugggggacugccc

SEQ ID NO: 357189 - RNA, 64 nt, Human
caucaaacuugcauuaagcaguuggcgggagauggcuguggagcuggggguuuaagugaugguu

SEQ ID NO: 357190 - RNA, 64 nt, Human
uggccuagccuaguagaaaugggggaaaagcauugcuguggaccauuguuaaagugacaggagu

SEQ ID NO: 357191 - RNA, 64 nt, Human
cugugugaggggagagaagggagagggugggccugcuguggacaauggcauacucucuuccagc

SEQ ID NO: 357192 - RNA, 64 nt, Human
aaugggggcgcugguugggcuuggagcucaggcugcuguggaucccggcgcaucaguucugacu

SEQ ID NO: 357193 - RNA, 64 nt, Human
uucuggcaaaacauagauucaaauuacaguugaugcuguggauggcuauggguuaacuacucuu

SEQ ID NO: 357194 - RNA, 64 nt, Human
auuuugcaaauauuuguaaguaagcuauuuuggggcuguggaaauauuuucuguugguaacugu

SEQ ID NO: 357195 - RNA, 64 nt, Human
ggggcuuggacacuggccaaggagaccccuucgugcuguggacacagcucucuucacucuuugc

SEQ ID NO: 357196 - RNA, 64 nt, Human
uuccacggugggggacaccauuaguccagacaccgcuguggagauuagcauuuuaguuugugug

SEQ ID NO: 357197 - RNA, 64 nt, Human
cgcgcguagcgcgggagcagggcacugugcugcugcuguggagcggcgccgaccuucgcccggu

SEQ ID NO: 357198 - RNA, 64 nt, Human
auaaauauauacaagguaucauguagugauaauugcuguggagaaaaauaaagcaggggaggga

SEQ ID NO: 357199 - RNA, 64 nt, Human
guuguggacucuacccaggcagguggaugaaaaugcuguggauaaaaggaagguuaugauuccu

SEQ ID NO: 357200 - RNA, 64 nt, Human
ggaucugucacaccagccauacuuaucucucugugcuguggaagcaacaggaaucaagagcugc

SEQ ID NO: 357201 - RNA, 62 nt, Human
caucacccuuuuccccuuugguuuugaaggccuugcccuaagcuaccugaggguuuaggagg

SEQ ID NO: 357202 - RNA, 62 nt, Human
cuuaacucaacauuaaauuuuaugauucuguuuugcccuauauguucaccguuguauuuaag

SEQ ID NO: 357203 - RNA, 62 nt, Human
cccucauguguaaaaugaaaagaaaacuaaauuugcccuaauaccaaggcgcuacguuuauu

SEQ ID NO: 357204 - RNA, 62 nt, Human
uauggugagauggugggaugugauaaccaagauugcccuauagaaugguuccauuauggcug

SEQ ID NO: 357205 - RNA, 64 nt, Human
gaaccuggcagcaccuaaugcugccacauccagugcuguggaaguuaagguguugaccacugug

SEQ ID NO: 357206 - RNA, 64 nt, Human
uguguauaguaugcauuuuaaagauagugucacugcuguggaaaaccugaacagacaguaugau

SEQ ID NO: 357207 - RNA, 61 nt, Human
uuguucucaucaccaaguagccuugucugaugcuguggagccuuaguugagauuucagcau

SEQ ID NO: 357208 - RNA, 64 nt, Human
acaggcucuugaagaaaugaagagagguaucauugcuguggaaaaaucucuggagucagaggcc

SEQ ID NO: 357209 - RNA, 64 nt, Human
uaucuuggcugacagcaggcaagcuucaguuugggcuguggacgcugccacacaagccugagua

SEQ ID NO: 357210 - RNA, 64 nt, Human
gacaccugagauuagaggcuggggcucacugcaggcuguggagaggucaugcugguccacagga

SEQ ID NO: 357211 - RNA, 64 nt, Human
agaccugcccugccccauuguccagaugggcacugcuguggagucugcuucucccauguaccag

SEQ ID NO: 357212 - RNA, 64 nt, Human
cacgggacggaagugcuucuggacggaagugguggcuguggaaggcguagcaucauccugcaga

SEQ ID NO: 357213 - RNA, 64 nt, Human
ugaagagcuccuauuuuguacuccuggcuagaaugcuguggaacaaauacaaagugaaaaaagu

SEQ ID NO: 357214 - RNA, 64 nt, Human
uuaggacuuugcccaccuccuucucauggcacuugcuguggaaaaugccuggcuggccucgugg

SEQ ID NO: 357215 - RNA, 64 nt, Human
guaggcuaaucaacaaugaaaggguuagaaaauugcuguggaacauccaggugaacuucaggaa

SEQ ID NO: 357216 - RNA, 64 nt, Human
guauuaagugacagugcuagaaaucaaacccagagcuguggacuuuguucacuagacugugccc

SEQ ID NO: 357217 - RNA, 64 nt, Human
gguauuuuguaauagggaauaggaaaccuuguuggcuguggaauauccgaugcuuugaaucaug

SEQ ID NO: 357218 - RNA, 64 nt, Human
cuagaaauuagaugaagcaagcaugacagacacagcuguggaggucacagcugcuccuuuuugg

SEQ ID NO: 357219 - RNA, 64 nt, Human
agggagaggcugccgcccccucuccccuucccuggcuguggacacuggcagccaauggggaggc

SEQ ID NO: 357220 - RNA, 64 nt, Human
gguucugccaucucucccacucugccaggugcuggcuguggagcaaaggcucaccuuuguggag

SEQ ID NO: 357221 - RNA, 62 nt, Human
gcuccucaagccgauuuuuucuuguagaaauguugcccuauuugucuucuccaauguauggu

SEQ ID NO: 357222 - RNA, 62 nt, Human
auuuucaagauuuaauaugagcaacccauuauuugcccuauccaaaauauauucaagggccu

SEQ ID NO: 357223 - RNA, 62 nt, Human
uuuaaugugaacuuuuagaaaagugauuaauguugcccuaauacuuuauauguuuuuaaugg

SEQ ID NO: 357224 - RNA, 62 nt, Human
ccagugucaccugcugaccucuaguauuuccuuugcccuagagcuagagucaugauagcuga

SEQ ID NO: 357225 - RNA, 64 nt, Human
agacccaggccccuguggcuuucaacacagcacagcuguggaaguggcuguguucuucuacagc

SEQ ID NO: 357226 - RNA, 64 nt, Human
agacuuggcacauggcuagggauacugcucacuagcuguggagguccucaggaguggagagaau

SEQ ID NO: 357227 - RNA, 64 nt, Human
gggcaguccugcaacauguauuuauggagugccugcuguggacccugucuucugggcacagugg

SEQ ID NO: 357228 - RNA, 64 nt, Human
gggugcccucucacuugaagaucaggcacagauggcuguggaguucaaaugucgaugcuacccu

SEQ ID NO: 357229 - RNA, 64 nt, Human
gcacagcgagguacugcagcuuccuccacagccggcuguggagcagcaggaccuggcccuucug

SEQ ID NO: 357230 - RNA, 64 nt, Human
guggccuuaauaaauauaguugucuuucuuugcugcuguggaaaggauucuaaacagauguccc

SEQ ID NO: 357231 - RNA, 64 nt, Human
uccgagcuuaucuaaauaugaauguggccacaaagcuguggaaggugacaaagcuuaaacaccu

SEQ ID NO: 357232 - RNA, 64 nt, Human
cacugucacgcugacacuaugcugccaugccugggcuguggaccuacugggcauuugaggaauu

SEQ ID NO: 357233 - RNA, 64 nt, Human
cuaugagaaacuucuuagauuuuuauauguaaaugcuguggaccacugggagcacaaugcccac

SEQ ID NO: 357234 - RNA, 64 nt, Human
ucugugccuuagaagcgugacaguucagcucucugcuguggaaaguaacacagggcaauagaaa

SEQ ID NO: 357235 - RNA, 64 nt, Human
aacuucuccgugaaccugcugaagaggcagaaaggcuguggaaagcuguauuuccauucuuggg

SEQ ID NO: 357236 - RNA, 64 nt, Human
ucacucugcuguaggcagacccccugaaacuauugcuguggaauaaaagaugaaaugcuccuga

SEQ ID NO: 357237 - RNA, 64 nt, Human
gcaccgacuuggagcucuuugagaaugggacguugcuguggacacccaagucgcuggagccauu

SEQ ID NO: 357238 - RNA, 64 nt, Human
caucagaggcgugugcugagaagggugguguuaagcuguggaaaaugacucaagagcaauaaau

SEQ ID NO: 357239 - RNA, 64 nt, Human
ucacucacaaccugaauucaccacagcuggaauagcuguggaaaacaaaauaaaacaacaaaau

SEQ ID NO: 357240 - RNA, 64 nt, Human
ucuaucauacauuccuuaaagucuuaccgaaaaggcuguggauuucguauggaaauaauguuuu

SEQ ID NO: 357241 - RNA, 62 nt, Human
gucuuuuuuuucccuccucuuauuuguuauuguugcccuaagauugucagugacaauaaauu

SEQ ID NO: 357242 - RNA, 62 nt, Human
uguguuccuucugugaagaagcccuguucucguugcccuaauucaucuuuuaaucaugagcc

SEQ ID NO: 357243 - RNA, 62 nt, Human
ccugggacagccuauguaaggccaugugccccuugcccuaacaacucacugcagugcucuuc

SEQ ID NO: 357244 - RNA, 62 nt, Human
uccagccuucucccaaaugguuaauuugccaguugcccuagaguuacauauugucuuauuug

SEQ ID NO: 357245 - RNA, 64 nt, Human
gggugaguggagagcagagccaggagcucuggcagcuguggacagaugugcuuccugagcaugg

SEQ ID NO: 357246 - RNA, 64 nt, Human
cacgcuucuguccacuucugguugccaggagacagcaagcaaagccagcaggacaugaaguugc

SEQ ID NO: 357247 - RNA, 64 nt, Human
cuggaaauucaguucuuagcuuaaagacuaaaaugcaagcaaacccugcaauuccuggaccuga

SEQ ID NO: 357248 - RNA, 64 nt, Human
ucuaagggaaaggaauauuaugggauuaagcugagcaagcaauucugguggaaagucaaaccug

SEQ ID NO: 357249 - RNA, 64 nt, Human
aauagaagauucaggggccugagcucuggaagcugcaagcaaaagggaugggacuagggcugag

SEQ ID NO: 357250 - RNA, 64 nt, Human
augauucagagcuuucaaggauaggcuuuauucugcaagcaauacaaauaauaaaucuauucug

SEQ ID NO: 357251 - RNA, 64 nt, Human
augaugcagagcuuucaaggauaggcuuuauucugcaagcaaucaaauaauaaaucuauucugc

SEQ ID NO: 357252 - RNA, 64 nt, Human
ggauuuucugcuguauuuuucugaguucuugguugcaagcaacagaaaucuaucauuuacaaca

SEQ ID NO: 357253 - RNA, 64 nt, Human
ccaucugcucaacgcucugugguuugucagaccugcaagcaagcccccugcuggggaagccuag

SEQ ID NO: 357254 - RNA, 64 nt, Human
auggacaguucacacccugcaaggcccacaggaggcaagcaagcucucuugccgaggagccagg

SEQ ID NO: 357255 - RNA, 64 nt, Human
agauacucagggaagcaaauccuuguuugggcuggcaagcaaauccgacacgacgagguccaca

SEQ ID NO: 357256 - RNA, 64 nt, Human
gccaaggcuaagauuuaguaagccuagcccugaagcaagcaaagaauauggcaguguaaugcag

SEQ ID NO: 357257 - RNA, 64 nt, Human
caggcuucuacucaagugaacuaagaagaagucagcaagcaaacugagagaggugaaauccaug

SEQ ID NO: 357258 - RNA, 64 nt, Human
auuacugguuauauacauuuggccauuaugaugugcaagcaauuggaaaaaaagucaaguaaau

SEQ ID NO: 357259 - RNA, 64 nt, Human
acuaaccccucaugcugggaugagcgacugccuagcaagcaacccacugccuacuaacaucaag

SEQ ID NO: 357260 - RNA, 64 nt, Human
gcacaauacuugcuguucacguuaugacucucaugcaagcaaaauacacaguuucauuguucug

SEQ ID NO: 357261 - RNA, 64 nt, Human
uggaggaagcaucugaguuugagaccauggcuguuacagggaucauguaaacuugcuguuuuug

SEQ ID NO: 357262 - RNA, 64 nt, Human
caggggacuggcccuccccuccccacagcugcucuacagggaccacggcuuugguuccucaccc

SEQ ID NO: 357263 - RNA, 64 nt, Human
ggauccuucaaaaccaaagacuugccccagcacugcuguggaaccaccuggcuuaugaccccua

SEQ ID NO: 357264 - RNA, 64 nt, Human
gaacacaaugacuaucauuacugaugcagaccuggcuguggagagcagcuaauguguggcccag

SEQ ID NO: 357265 - RNA, 64 nt, Human
cugggaggagcugccagagagaagcaaaaaggcggcuguggaucgcccugggcugggcaccagu

SEQ ID NO: 357266 - RNA, 64 nt, Human
gugaacucauguucuuugggaaaagggaaggcgugcuguggaaauaaaauguuuauuugcuucu

SEQ ID NO: 357267 - RNA, 64 nt, Human
agauaauuucagauauauucuaaguauuuuaccagcuguggaauaaguuguguuuguccaucac

SEQ ID NO: 357268 - RNA, 64 nt, Human
acaccaaaagccaaucuaaacaacucccagguuugcuguggacaaucagcauggaauguuuucu

SEQ ID NO: 357269 - RNA, 64 nt, Human
accaaaggggucagcagggauggcguggagucaugcuguggaacuuauucuaggcugaauccua

SEQ ID NO: 357270 - RNA, 64 nt, Human
uuuugguuauaagcccuuugagaaucugauaaaagcuguggaucaucuccuaggaaaauagaac

SEQ ID NO: 357271 - RNA, 64 nt, Human
cccuggcuggaaagacuccagaauccaguguggugcuguggaaggagcacuggacuaaaggcuu

SEQ ID NO: 357272 - RNA, 64 nt, Human
uugccgugggucauccuugcugugggucauccuugcuguggagauccauuccccaccuuuccug

SEQ ID NO: 357273 - RNA, 64 nt, Human
ccaaggaagucccaggaggauggggaccaggaaggcuguggacccccaucuccagggggccuuc

SEQ ID NO: 357274 - RNA, 64 nt, Human
uaccgcccccagcccuaccagccgcccgcccugggcuguggacccugcguuugccgagcgcuau

SEQ ID NO: 357275 - RNA, 64 nt, Human
gcugcuggccccaggagauagcuuuccggugacagcuguggaacgcgucaacaggacaaacugg

SEQ ID NO: 357276 - RNA, 64 nt, Human
uagcaagagaaaauauuuuccccuuauccccacugcuguggagguuucuguaccucgcuuggau

SEQ ID NO: 357277 - RNA, 64 nt, Human
agugaagauuuaccucguucugcucagaggccuugcuguggagcuccacugccauguacccagu

SEQ ID NO: 357278 - RNA, 64 nt, Human
ccauuaauugccgaguugcuucuaucagggcaaggcuguggaauccuguuauccuagacaauga

SEQ ID NO: 357279 - RNA, 62 nt, Human
uuagguuuauggugaguuagcuuugagguguguugcccuaauacuagccagcguuguuguag

SEQ ID NO: 357280 - RNA, 62 nt, Human
gcccacucuaauauucaacaauuauagacaauuugcccuaucauuuauuuacaucuauguau

SEQ ID NO: 357281 - RNA, 62 nt, Human
gguuuugcaagauuuuguauacacuuugcuccuugcccuagggcucagaguggugguuucug

SEQ ID NO: 357282 - RNA, 62 nt, Human
ucaucccuucuguggcccaucacgcagcagaguugcccuacaaauuucauuuggcagcgcca

SEQ ID NO: 357283 - RNA, 64 nt, Human
cacauuaagcccaauaugccaguuggcaccagaugcuguggacuuggaaugaggccaacagggu

SEQ ID NO: 357284 - RNA, 64 nt, Human
acagaggagacuggccccacuucuaugggucugagcuguggaaaagggagagcagagaggaacu

SEQ ID NO: 357285 - RNA, 64 nt, Human
gaauuagccaaaugguauaagacaauagaaaaaggcuguggauucuuugaggacaucacuagaa

SEQ ID NO: 357286 - RNA, 64 nt, Human
auauuucucugcuuuggauggggcauauuucugugcuguggaugacauggccuuacuccagaau

SEQ ID NO: 357287 - RNA, 64 nt, Human
uucuugcuaucuccuauaccaauaaauacgaagggcuguggaagaucagagcccuuguucacga

SEQ ID NO: 357288 - RNA, 64 nt, Human
caccaccacguccugcagaacgagcccugccuuggcuguggagaagcacuccaggccgcuagca

SEQ ID NO: 357289 - RNA, 64 nt, Human
cccucuggacuagaguagaaaugcaggggaaacugcuguggauuugagaggcaaaguuggcuca

SEQ ID NO: 357290 - RNA, 64 nt, Human
gccagugcuuccccucuccccagguaguuggucagcuguggacucugugaccuuugucuaaacc

SEQ ID NO: 357291 - RNA, 64 nt, Human
cgcccaggguggggaggaagagucugcaagcagggcuguggaguuaggguucaccccaauggga

SEQ ID NO: 357292 - RNA, 64 nt, Human
aaggggucaagguggugauggacauccccuaugagcuguggaacgagacuucugcagagguggc

SEQ ID NO: 357293 - RNA, 64 nt, Human
cugaccaagggaggucaaaaggagaaaaguauaggcuguggacaauaacugaugaauauagggc

SEQ ID NO: 357294 - RNA, 64 nt, Human
gcugaacguguaccagacacagcuguuguucggggcuguggaacugcccuccaagcugcugguc

SEQ ID NO: 357295 - RNA, 64 nt, Human
ucuucauaaucaaauauaugacauauaccuaggagcuguggauguaauuacugaagaaugaggu

SEQ ID NO: 357296 - RNA, 64 nt, Human
aaaaaugcuucugcaagauuuucauaauucaggggcuguggauaggauuguuccucuguuuccc

SEQ ID NO: 357297 - RNA, 64 nt, Human
uugugugugugcguucugagcguguuggccaguggcuguggaggggaccaccugccacccacgg

SEQ ID NO: 357298 - RNA, 64 nt, Human
aaauacaauuuccaccuucuggaaagguagguuugcuguggaggaaauaauguacuagaucauu

SEQ ID NO: 357299 - RNA, 62 nt, Human
acuuaugguuggacaccaucuucuaaaggcuuuugcccuacucagcccaaccuagaccugua

SEQ ID NO: 357300 - RNA, 62 nt, Human
ggaagagucacauugcugcuuaacaugcuggauugcccuagucuucagaaugguccugagaa

SEQ ID NO: 357301 - RNA, 62 nt, Human
uguugacugcauuguuguagucuucccaaaguuugcccuauuuuuaaauucauuauuuuugu

SEQ ID NO: 357302 - RNA, 62 nt, Human
augaaauacagaugcauuauccagaacugaaguugcccuacuuuuaacuuugaacuuggcua

SEQ ID NO: 357303 - RNA, 64 nt, Human
ccccaggaagccuugcugcccagaaaacaccagcgcuguggauggucccagggcuccuugugag

SEQ ID NO: 357304 - RNA, 64 nt, Human
caucgguggaagcagugggguaggcugcugcccugcuguggaagaggagcaacaaucagacaug

SEQ ID NO: 357305 - RNA, 64 nt, Human
aaaccugauagcugccuauuccugucugguuggggcuguggaggauguaguuguauuuauugca

SEQ ID NO: 357306 - RNA, 64 nt, Human
ucucaaggccauguaaguugcccaucucuaccuggcuguggacaaaagguuaucugcucuuggc

SEQ ID NO: 357307 - RNA, 64 nt, Human
aguguacaauaagcauaugcuuugacuuuccuuugcuguggagguuuuugguuuuucauugaug

SEQ ID NO: 357308 - RNA, 64 nt, Human
cuuggaagcaauguuugaacaaacucaaagaacagcuguggaaagaagucacaaaacacugggu

SEQ ID NO: 357309 - RNA, 64 nt, Human
uuacauaauuaugaguuuguucauauaaagaaaagcuguggaaaagagucuuagagauuuugua

SEQ ID NO: 357310 - RNA, 64 nt, Human
auugaucauugauuggaccucauuacauaagggggcuguggacgucuuuggaauuuguuagggg

SEQ ID NO: 357311 - RNA, 64 nt, Human
ccaauuccuauacccaguccugcagugucugugagcuguggaaugagagagaaaaccauggcug

SEQ ID NO: 357312 - RNA, 64 nt, Human
ggagugaccuggagcacugugcgcagccgugugugcuguggagccgaggccguccugcaggaag

SEQ ID NO: 357313 - RNA, 64 nt, Human
aaucccuuuagccagauugcuuuuugcaaccaaagcuguggacagaaaagccuccuuaagugag

SEQ ID NO: 357314 - RNA, 64 nt, Human
ucuugaagacugcaaagugauccugaggauuacagcuguggaauuuuuguccaagcuucaaaua

SEQ ID NO: 357315 - RNA, 64 nt, Human
cagaauuuuccugguucuguuuucucagccaguugcuguggaaggagaaugcuuucuuuguggc

SEQ ID NO: 357316 - RNA, 64 nt, Human
aggggucugaacgucuccuagccaaucagaacuggcuguggaccacccuagcacggccaccucu

SEQ ID NO: 357317 - RNA, 64 nt, Human
cccgcauggaauuaucuguaugaaaucaaggugcgcuguggaaacaauaauucacccaguuuag

SEQ ID NO: 357318 - RNA, 64 nt, Human
gugagagauagagguacaugucuucugaugaugugcuguggaaugcaaugugggaaaccuacau

SEQ ID NO: 357319 - RNA, 62 nt, Human
cucagcauuuauaaugagcaguugguaaugaguugcccuaugugcuugucgcaagcagucac

SEQ ID NO: 357320 - RNA, 62 nt, Human
uuuuuguggcaauuagugugacaguuuccaaauugcccuaugcugugcuccauauuugauuu

SEQ ID NO: 357321 - RNA, 62 nt, Human
gacagggcauauuacugacaccccacuggcuauugcccuauaccugccaaucacccaaagaa

SEQ ID NO: 357322 - RNA, 62 nt, Human
ggagauuuauucucauuuucaggacgagacuuuugcccuacaucuuuccuagaauaagaggu

SEQ ID NO: 357323 - RNA, 64 nt, Human
cucucucucuuuuuccccgauuuuccagagcuaggcuguggaguagaguuuguauagguaacua

SEQ ID NO: 357324 - RNA, 64 nt, Human
gucagaggccuccuaccugcgcagucuaaacauagcuguggaucauuuccaacuuucaacuuca

SEQ ID NO: 357325 - RNA, 64 nt, Human
caaacuccacgcccgccugggagguugucagguugcuguggauguaaggauaggaggugcccag

SEQ ID NO: 357326 - RNA, 64 nt, Human
uuuuuuuuuuuuuuuaauucugagauuuccccaagcuguggauucuuccuacuccuuaagaaaa

SEQ ID NO: 357327 - RNA, 64 nt, Human
aaaaagacgauguuuauguucuuauagaauaaaagcuguggaaugaagcuuuuuaauuuuaccu

SEQ ID NO: 357328 - RNA, 64 nt, Human
aggccacuggccccugagaucucugcaggaaauggcuguggaguguggcaguuuggcaaacucu

SEQ ID NO: 357329 - RNA, 64 nt, Human
aacaucuuccugaaaauaacauucccuuaaacaugcuguggaauaaaauggauugugaugauuu

SEQ ID NO: 357330 - RNA, 64 nt, Human
uugucaauaacagguuuguuugugcuuuguccaagcuguggagacucuuguacuugauccccuc

SEQ ID NO: 357331 - RNA, 64 nt, Human
ggccucucuucccacugcaggaagauugcagaaggcuguggauuaauuguagcauuucacugau

SEQ ID NO: 357332 - RNA, 64 nt, Human
ugggaaaaaccacacucacaccccaccccgaagagcuguggagaccaaaccaagacuacgcuac

SEQ ID NO: 357333 - RNA, 64 nt, Human
uggcuuaugggucccccucagcaagcccuacagagcuguggaggauugcuaucuggaggccuuc

SEQ ID NO: 357334 - RNA, 64 nt, Human
uuucaacccccacaggggcugccugcucuucacagcuguggaggugagggugggcgugggcggg

SEQ ID NO: 357335 - RNA, 53 nt, Human
cuccaggacauguggacugaggggcuguggagucugggccuguggcucccguc

SEQ ID NO: 357336 - RNA, 64 nt, Human
aaaagucuaaauuacuguugguugaaacacagcagcuguggaguucaguccaggcaugaagacu

SEQ ID NO: 357337 - RNA, 64 nt, Human
acuguugauuuguugaacaauucaggaaucaagggcuguggagaaacucccucauguuguuggc

SEQ ID NO: 357338 - RNA, 64 nt, Human
ggacagcgugggggcacaccugggccucccggaagcuguggacgaaagggagagcggguccucc

SEQ ID NO: 357339 - RNA, 62 nt, Human
ccccaguuuauuacauuuagcuuguucacacuuugcccuaugacauuucuacaucacuggcu

SEQ ID NO: 357340 - RNA, 62 nt, Human
uauucaggcucauccacgcagcugcuggguucuugcccuaacggcccuccccugcaacaucc

SEQ ID NO: 357341 - RNA, 62 nt, Human
ggugcugguuacuuuuccgcaguuggcauggguugcccuacaggcccacagggccaccagca

SEQ ID NO: 357342 - RNA, 62 nt, Human
uuucuauuuccuuuuuugagaacugccaaauguugcccuaguagccaaaaauaucagguugc

SEQ ID NO: 357343 - RNA, 64 nt, Human
uaaaaauugucaccaaugaacucccccaaacauggcuguggagagacaacaaaacaaaacaaag

SEQ ID NO: 357344 - RNA, 64 nt, Human
gaugaggagugacagaauaucaaaauaauuuguggcuguggauuuuuuuaacugcuaguagugg

SEQ ID NO: 357345 - RNA, 64 nt, Human
ucgggccgaggcccagcgggcagaugggcggacggcuguggaccguggacaggcccagcgcggc

SEQ ID NO: 357346 - RNA, 64 nt, Human
acguuagggcugcccccauuccagugguggaggcgcuguggauggcugcuuuuccucaaccuuu

SEQ ID NO: 357347 - RNA, 64 nt, Human
gcagcuggauuccugggaacuggaggaucagagugcuguggacuggacccaggagccccggcgg

SEQ ID NO: 357348 - RNA, 64 nt, Human
agggcacgcgggcaagccuaggagaguaggaagagcuguggaggacacacucucaguuuguuuu

SEQ ID NO: 357349 - RNA, 64 nt, Human
uaggaggacuggaugaggauguccuguuauaguugcuguggaggaaguuccucugguuaauucu

SEQ ID NO: 357350 - RNA, 64 nt, Human
gaaggaguaagucugcccuuugccauacugaacagcuguggaccccgauuggugagggcucugc

SEQ ID NO: 357351 - RNA, 64 nt, Human
gcacaaaacauaaaggauaguggcgaguuuacaagcuguggauggguuuccauagucuuccuuu

SEQ ID NO: 357352 - RNA, 64 nt, Human
gaaucuacacacagauuuuacugugacuucugaagcuguggauaaauuggaauuuuuuauguug

SEQ ID NO: 357353 - RNA, 64 nt, Human
augacuuuggugggcaucaucagcuggggccugggcuguggacagaaggaugucccgggugugu

SEQ ID NO: 357354 - RNA, 64 nt, Human
gacugcccgaggaaugcggucggaggauuguguugcuguggacgugguuccaacauucacuccu

SEQ ID NO: 357355 - RNA, 64 nt, Human
auuuggacggcagccaugcauccaucgcugaagggcuguggacaugaauguguauuucccaugg

SEQ ID NO: 357356 - RNA, 64 nt, Human
uggaaauauauucaagagauuaugauucuguaaagcuguggaaugaagcugcagauuuagagaa

SEQ ID NO: 357357 - RNA, 64 nt, Human
cccuuuggaaaagaguuggugaaaugcgcagccggcuguggacgggggaggaggaaggggacag

SEQ ID NO: 357358 - RNA, 64 nt, Human
uagauuuacagaacaaaguuuuauauuucacauugcuguggacuauuauuacauauaucauuau

SEQ ID NO: 357359 - RNA, 62 nt, Human
uaguugacuucaaauguguaacuuuauuggucuugcccuauuauaauugucaugacuuucag

SEQ ID NO: 357360 - RNA, 62 nt, Human
gaaaaagaucugccggcccagagcacucccucuugcccuaauccuggcagggucuggaugua

SEQ ID NO: 357361 - RNA, 64 nt, Human
aucugaacuuuuuuucuccuuucaacauacuuaggcuguggagugcaagcagaauuaugcauag

SEQ ID NO: 357362 - RNA, 64 nt, Human
ggggagauggggcgggagggccagacucagugcugcuguggagcuaggugcuucccccuucccc

SEQ ID NO: 357363 - RNA, 64 nt, Human
uguccuucuucauugcugagagggcagccuuagagcuguggauuucugcauccccccugagucu

SEQ ID NO: 357364 - RNA, 64 nt, Human
uccauagcccuccugaugcaguagacagugcuaugcuguggauauaauaccaaccagaaauugg

SEQ ID NO: 357365 - RNA, 64 nt, Human
accgcauaaauggauagaagagagaagcaccugugcuguggaguggcauuuuagaugcccucac

SEQ ID NO: 357366 - RNA, 64 nt, Human
aauugcuuuccaaacucacuugaaugaugacauugcuguggaccuggguucuggaccugaucug

SEQ ID NO: 357367 - RNA, 64 nt, Human
auugggcucugcucuccucccugccauuacgggagcuguggacagagcucccucacuucaagau

SEQ ID NO: 357368 - RNA, 64 nt, Human
acuaaccugugagaggggcccgagagaaggaacagcuguggaacaggcuuuuuacaccccaagu

SEQ ID NO: 357369 - RNA, 64 nt, Human
ggugagagacuuuggcccccucccucccuauaaggcuguggaaccugaggaaguagauacuuga

SEQ ID NO: 357370 - RNA, 64 nt, Human
auggguucuggaggccccugaacagagggcuauggcuguggagaagguucuuggcccguuggac

SEQ ID NO: 357371 - RNA, 64 nt, Human
ccuguccaucgcucuagcugcuaauacagcccuggcuguggaauccuucaccgucucagcuggu

SEQ ID NO: 357372 - RNA, 64 nt, Human
ugagaccaguaaaugccggagguggagcugggcagcuguggagccccaggccacaggccagucu

SEQ ID NO: 357373 - RNA, 64 nt, Human
uccugcucugaucugugguuuaacacugugcagggcuguggagcucugagacaccugaaccccu

SEQ ID NO: 357374 - RNA, 64 nt, Human
ggagacgguaguacacgggccuggugaggcaacagcuguggagugggggccaaacacauggaug

SEQ ID NO: 357375 - RNA, 64 nt, Human
ggcugugaggagccccugagccgcgggugccacugcuguggaugcguuucuggcccgucuugga

SEQ ID NO: 357376 - RNA, 64 nt, Human
ucuggagggaaaagccagagagaccaagauggaggcuguggagcagcauuucccguugccucca

SEQ ID NO: 357377 - RNA, 64 nt, Human
gccacuccagugagaaucccccuacccucgaaggccgcccuaacaacuucccauccgcugaccc

SEQ ID NO: 357378 - RNA, 64 nt, Human
cagcggcugcgcuucggaccgcggcgcgcgcuggccgcccuagugcgcaggggcuggcgcugcg

SEQ ID NO: 357379 - RNA, 64 nt, Human
ggaggcugccuccuagucucccaccaggucccaggcuguggaaagccccagcccagggaugguc

SEQ ID NO: 357380 - RNA, 64 nt, Human
ucucccagagaggaagaugccugacuugccuggagcuguggaugagcccuaugacagacgcuuc

SEQ ID NO: 357381 - RNA, 64 nt, Human
cugcguuucagaaaauaacccccagaggccuugggcuguggaccuggggguuggaaggaugggg

SEQ ID NO: 357382 - RNA, 64 nt, Human
uguguuaauaacaauaagaaacuuagggaagcaggcuguggacuucuggaauuaccaacaggaa

SEQ ID NO: 357383 - RNA, 64 nt, Human
cuuuggucaccagaggaggacagagcuuagagcagcuguggagaaucugaagcauucugcggag

SEQ ID NO: 357384 - RNA, 64 nt, Human
acacuuauuuuacuaguuuucaaucauaauaccugcuguggaugcuucaugugcugccugcaag

SEQ ID NO: 357385 - RNA, 64 nt, Human
uguuuuccucccugccccuggagguugucuucaagcuguggacuucugggauuugcagauuuug

SEQ ID NO: 357386 - RNA, 64 nt, Human
uaacaauuauuuuuaaaaggaggaauuuaaaugagcuguggauuauucauuuugucccauaaga

SEQ ID NO: 357387 - RNA, 64 nt, Human
uuuuccuuagacagguccacgucccucuccugaggcuguggaagauuucagccguauuaaaaga

SEQ ID NO: 357388 - RNA, 64 nt, Human
uguugauaguaucacagaugauaccaacagugaagcuguggaaugcccagcuaguuaaagaaug

SEQ ID NO: 357389 - RNA, 64 nt, Human
gucugauacucaguggcacuuuauuaaaacaucagcuguggaguguggcggugcacaccuguag

SEQ ID NO: 357390 - RNA, 64 nt, Human
uauaagaaucuuuuaugagauuauagauuucaaugcuguggauagugucuugcacccaaacaag

SEQ ID NO: 357391 - RNA, 64 nt, Human
gauuuuuaccaccuguguuugcauauuuauauaugcuguggaugaaaauaacuuacuagagaau

SEQ ID NO: 357392 - RNA, 64 nt, Human
accuacuugggagagaacgcagagcucccagccugcuguggaggcagcugagaagugguggccu

SEQ ID NO: 357393 - RNA, 61 nt, Human
uuccagccugcccgcucuaggagaaugcugugcuguggaugacugcagcuggccgccugag

SEQ ID NO: 357394 - RNA, 64 nt, Human
aacaaagccagccgugaaaaggugccccagaguugcuguggacagaccuguaaggacuugcaaa

SEQ ID NO: 357395 - RNA, 62 nt, Human
uuugcaaucagugacuacucagggugacacccuugcccuaaagcaggaguccccccuaccug

SEQ ID NO: 357396 - RNA, 62 nt, Human
ccagcuuguuuacaugcuuauuccaugacugcuugcccuaagcagaaagugccuuucaggau

SEQ ID NO: 357397 - RNA, 62 nt, Human
uauauuugacaucauuuuaaaugcucaaagaguugcccuauauaugcauguuauccauuaua

SEQ ID NO: 357398 - RNA, 62 nt, Human
auccuuuuguaugacuuguccagaccggccuauugcccuacccguuugauucucugggaggc

SEQ ID NO: 357399 - RNA, 64 nt, Human
accauguaaccccucucaccugccgugcguacuggcuguggaccaguaggacucaagguggacg

SEQ ID NO: 357400 - RNA, 64 nt, Human
cugggugugcugccugucugagcaagcuucccuagcuguggaaccccgggcccccugcugcggg

SEQ ID NO: 357401 - RNA, 64 nt, Human
cuccccauucaggccugguggcaggaagggacaagcuguggagcuggcugagucacagccaccu

SEQ ID NO: 357402 - RNA, 64 nt, Human
gcugacuuggaaaccggugggugcaaugcccgaggcuguggaacaaucagcccaucucuuugug

SEQ ID NO: 357403 - RNA, 64 nt, Human
caccuuccuuccucuucccucuucuaggacacaggcuguggaccccuucaggugcacuauaaug

SEQ ID NO: 357404 - RNA, 64 nt, Human
ccccugcaguuccccuggaagcagugcccagguggcuguggaauaggaacgcuauguccgugua

SEQ ID NO: 357405 - RNA, 64 nt, Human
cuccaguguuuccucaucauugauuauugggcuagcuguggauagcuugcauuaauuguauauu

SEQ ID NO: 357406 - RNA, 64 nt, Human
uauaccauggaaugaggacaaggugauacucugagcuguggacugaacuggcagacacaaccug

SEQ ID NO: 357407 - RNA, 64 nt, Human
gaaguuauccaggacuugauauucauaauucagugcuguggaaaugaaaaaaaugauugaagag

SEQ ID NO: 357408 - RNA, 64 nt, Human
ucccuagaccuccuucccucccuccucacgucaggcuguggagcaggagcacagcaguucuggc

SEQ ID NO: 357409 - RNA, 64 nt, Human
gcauaugauagaugacaaauuggggcugucgggggcuguggauggguggggagcaaaucaucug

SEQ ID NO: 357410 - RNA, 64 nt, Human
ucucaguccaugcuccguguccagaaguaagccagcuguggaucccgcccacucagaaaaggcg

SEQ ID NO: 357411 - RNA, 64 nt, Human
cgcccgcccggauugcuccccgagccccgggaccgcuguggaccucgggaccuggacgccgucc

SEQ ID NO: 357412 - RNA, 64 nt, Human
ugaugacuaaaaagagcacuuugcccguacuuaggcuguggacccuaaaacagcaguguuucaa

SEQ ID NO: 357413 - RNA, 64 nt, Human
cuucaauucacuuucuugagaggacaaaugaaaagcuguggagaaaauguccucauuaaaguau

SEQ ID NO: 357414 - RNA, 64 nt, Human
gggacagagcuuuaccuggcagugauaaagaugggcuguggagcuuggaaaaccaccucuguuu

SEQ ID NO: 357415 - RNA, 62 nt, Human
uauuuuuguaaaccuguucauacuauuaaauuuugcccuaaaagaccucuuaauaaugauug

SEQ ID NO: 357416 - RNA, 62 nt, Human
ggaaugcuguauuuggaccacacauuucaaaguugcccuauggaaaugaauccuacuuagug

SEQ ID NO: 357417 - RNA, 62 nt, Human
aagcuuauguaauaguuuggccauuaaauaucuugcccuauuuucccuauuacugcuaguau

SEQ ID NO: 357418 - RNA, 62 nt, Human
cuaaaaaagaaaaaaaaaaaacccuuuugaguuugcccuagaauaaaugagacuuaauucaa

SEQ ID NO: 357419 - RNA, 64 nt, Human
caccuugucccucauuccuuccacccugaggcuugcuguggacucagagaggagacuuaccuga

SEQ ID NO: 357420 - RNA, 64 nt, Human
ucuugggccugucaccuccugaaaggcugcuuuagcuguggaugcccuugauuaagggagagag

SEQ ID NO: 357421 - RNA, 64 nt, Human
gccuucgaugaagugagacccuuggggagaacgggcuguggaugaaggaguggacugcagccuu

SEQ ID NO: 357422 - RNA, 64 nt, Human
ugcauuauaaaccaaauuuacuaugaaguccuuugcuguggaggcaauguuguuccagagucaa

SEQ ID NO: 357423 - RNA, 64 nt, Human
aaaacuggguuugaaccaaaugccguagugacuugcuguggaccaaguccuuccaucuaauaga

SEQ ID NO: 357424 - RNA, 64 nt, Human
ugaugagagaggguguucccgcuggaggguuggugcuguggagccuacaccggcagggacagcc

SEQ ID NO: 357425 - RNA, 64 nt, Human
gaagggauguucccuguuaucguuauuuuacugagcuguggaaacucauuuuuacccuuuuuaa

SEQ ID NO: 357426 - RNA, 64 nt, Human
uuucagggugucucagggucccucuguaccaucugcuguggaaugcaggacccucugugacauu

SEQ ID NO: 357427 - RNA, 64 nt, Human
agaagcguucaggggugccugggccuccccaggagcuguggacucaguuccugaccucugcuuu

SEQ ID NO: 357428 - RNA, 64 nt, Human
ccauuucccuguggcucacugucuuacaaucacugcuguggaaucaugauaccacuuuuagcuc

SEQ ID NO: 357429 - RNA, 64 nt, Human
ccagaugucccaguagcgaugaguaacagagguggcuguggacuuccucuacuucuccuugcug

SEQ ID NO: 357430 - RNA, 64 nt, Human
accuggggauugcgucuggggccuccagaacucugcuguggacugcaucaggucucaguguccc

SEQ ID NO: 357431 - RNA, 64 nt, Human
ggugacccccuucccgggcugcacuuuggguccagcuguggaagccagaaguugggcgguuuca

SEQ ID NO: 357432 - RNA, 64 nt, Human
ugacuucgaggcacgcuucccuucauuagagacggcuguggagagcgccgcgccuccguggguu

SEQ ID NO: 357433 - RNA, 64 nt, Human
ccauuucugucucaccucuaggcccucugcuggugcuguggaggccaagaccccauuaagccua

SEQ ID NO: 357434 - RNA, 64 nt, Human
aaaauuagacugugauucagaaaauguucuguuugcuguggaacuacauuacuguacaggguua

SEQ ID NO: 357435 - RNA, 64 nt, Human
uuucuucccuucgggcccccauguuuuccugcacccgcccuaccauggucucucucugcaguua

SEQ ID NO: 357436 - RNA, 64 nt, Human
cuucgauaggccugacgcagcccccagcccagggccgcccuagcaacuuccuguacauaugacu

SEQ ID NO: 357437 - RNA, 62 nt, Human
ccacaggcuucuucagcccucccaaauugcccuugcccuaccugugcucccagaagcccucg

SEQ ID NO: 357438 - RNA, 62 nt, Human
uuggccacauuucccuugagagagagugggauuugcccuauccacagagagccucauuucca

SEQ ID NO: 357439 - RNA, 64 nt, Human
cuuuguggaggacagcaguggcugcugggagagggcuguggaggaaggagcuucucggagcccc

SEQ ID NO: 357440 - RNA, 64 nt, Human
cugacaaaaugacaucauggcagaguuguaaacugcuguggauguauuuuauuuaauuucucaa

SEQ ID NO: 357441 - RNA, 64 nt, Human
ccaaaggcaaggaaccaugauugacaacagucaagcuguggaugaaaugaccaggaacggagaa

SEQ ID NO: 357442 - RNA, 64 nt, Human
uuauuagagggaugggacaguuuuccauauccuugcuguggagcucuggaacacucucuaaauu

SEQ ID NO: 357443 - RNA, 64 nt, Human
agcagacaugagcacugcuggcccguguggcagagcuguggacuuucuucucggcucccucaac

SEQ ID NO: 357444 - RNA, 64 nt, Human
auuuuuaaaaaguaccacauuccaugacgcaggagcuguggaaauggugagcgcugugagaugg

SEQ ID NO: 357445 - RNA, 64 nt, Human
uuacaaacuuccugaauauuaucaaugcagaacagcuguggagacucuaaccugaagaucuaua

SEQ ID NO: 357446 - RNA, 64 nt, Human
aaccccugagggccaaacagcagaguggagcugagcuguggaccucucgggcaacucugugggu

SEQ ID NO: 357447 - RNA, 64 nt, Human
ugaccaacauauuucuuugcacugaggccuugcugcuguggauacggaaaugguuaaguacugu

SEQ ID NO: 357448 - RNA, 64 nt, Human
caaagugcuggcacuuacacccacaacccggaaggcuguggaccgauuccucuaggguggugac

SEQ ID NO: 357449 - RNA, 64 nt, Human
caaauuggaaagaagacuugugguguuuuaaguugcuguggacacuuuuaagaaacuuagaacc

SEQ ID NO: 357450 - RNA, 64 nt, Human
uuggauggugccugugugccuggccuuggggauggcuguggagggaacguggcagaagcagccc

SEQ ID NO: 357451 - RNA, 64 nt, Human
gggcgagcacggaacaauggggccuucagcuggagcuguggacuuuuguacauacacuaaaauu

SEQ ID NO: 357452 - RNA, 64 nt, Human
gagcccccacugaggggccguagcccuaucuagggcuguggaaggagcagacugguuccuaacu

SEQ ID NO: 357453 - RNA, 64 nt, Human
acuuguaauuccccuaaccauaagauuuacugcugcuguggauaucuccaugaaguuuucccac

SEQ ID NO: 357454 - RNA, 64 nt, Human
caugcccaagaugacuugcgaggcaaucucaggagcuguggacuuaaccguugcaaagcacacu

SEQ ID NO: 357455 - RNA, 61 nt, Human
uggcugcaguucuggacgggcuggccgagcugcgcgggauccuugugcagggaagagcugc

SEQ ID NO: 357456 - RNA, 61 nt, Human
ggaaccccaugggccgcacaggacugcgugggcgcgggagccucagcugcuucggacccaa

SEQ ID NO: 357457 - RNA, 64 nt, Human
cucauuuguccucaucuccuucuugcuuugcuuugcuguggaccucuccuccuucuccuugacc

SEQ ID NO: 357458 - RNA, 64 nt, Human
ccaauucaccugauaaacucuagggacacuggcagcuguggaaaugaaugaggcacagccguag

SEQ ID NO: 357459 - RNA, 64 nt, Human
augggaaguagguggaucagugaaggcauaaugggcuguggagaccuucacuucuagauuauug

SEQ ID NO: 357460 - RNA, 64 nt, Human
gugugaaacugaaagugggcuagguucuaccaaggcuguggaacucuccuacgaguucugcuga

SEQ ID NO: 357461 - RNA, 64 nt, Human
cauuuguuuuguauaggaauuauuugugccaccugcuguggacuguuuucuuugccuagugacu

SEQ ID NO: 357462 - RNA, 64 nt, Human
ggugggggagccccaugggccugggaaggagggugcuguggagggggcugcagggcugaccagc

SEQ ID NO: 357463 - RNA, 64 nt, Human
agugugcaguucaggaauuaagauacuuggaauagcuguggaggaagaaccuaaauugcaaaga

SEQ ID NO: 357464 - RNA, 64 nt, Human
uuuuuuuucuuuuaaugaagaaacaccaaagaaagcuguggaaaggaccugccccacaugaaaa

SEQ ID NO: 357465 - RNA, 52 nt, Human
aagaagggccgggagagugacugcuguggacucgccuccgugcgccgcugcc

SEQ ID NO: 357466 - RNA, 64 nt, Human
auguccugucuauucauucagcuggcugugcugugcuguggaccagcuguguggaucucuagcc

SEQ ID NO: 357467 - RNA, 64 nt, Human
ggaggagccggcccucacgcccgccccgcgccacgcuguggaacggggcuccggcaagugaaac

SEQ ID NO: 357468 - RNA, 64 nt, Human
caccugugccauuucugggacucugauugauccagcuguggacauuggaaggcgaaggaaggga

SEQ ID NO: 357469 - RNA, 64 nt, Human
uaagcaaggauuguuucccguaggauuaggacgugcuguggauguguguuuugauaccagugug

SEQ ID NO: 357470 - RNA, 64 nt, Human
acaaaaagcauggaaaauuuauccaccagaauuugcuguggagauacuuuuuggcgagaaauga

SEQ ID NO: 357471 - RNA, 64 nt, Human
agcugcccacugauacuccuuuggaaaauggugcgcuguggaucaagacacuuugguaugaugc

SEQ ID NO: 357472 - RNA, 64 nt, Human
gccaggccaagccaagcagggggccacagggugggcuguggagcucucaggaagggcccugagg

SEQ ID NO: 357473 - RNA, 62 nt, Human
uucuugcagaaacauucauuauuuuauuaauauugcccuaaguacaacuaggcaagugauug

SEQ ID NO: 357474 - RNA, 62 nt, Human
aaacuaauuauacaaacuugaaaggguucaccuugcccuagcaaaacuaggauugggacacc

SEQ ID NO: 357475 - RNA, 62 nt, Human
uugacuuugcuguauggaaaaauaaagugaaauugcccuaauaaaacuucucuuucuuaagu

SEQ ID NO: 357476 - RNA, 62 nt, Human
cacuuaucagggcuuccacacacuuauuuauuuugcccuaguuaauccuguuguuugcugcc

SEQ ID NO: 357477 - RNA, 64 nt, Human
uuauuuccuucaugaauuugucacuggaucagcagcuguggaaauaaagcuugugagcccucug

SEQ ID NO: 357478 - RNA, 64 nt, Human
gaaccaugacuuggagccggcagaguaggcuguggcuguggacuucagcacaaccaucaacauu

SEQ ID NO: 357479 - RNA, 64 nt, Human
guccacagguggccuccagcacaccccucaggaagcuguggaggcuggauuccaggcucccucc

SEQ ID NO: 357480 - RNA, 64 nt, Human
cauuuguacauuaguaugguucuacaggaccccagcuguggaaguaacaaauuucuucucccuc

SEQ ID NO: 357481 - RNA, 64 nt, Human
uccagcagagucuaggcagucgucugccaggcaugcuguggaagggauuucuguacagggucau

SEQ ID NO: 357482 - RNA, 64 nt, Human
uucaauagaacaugcaagaauuucuggaagaaaggcuguggaagggccaauggagaaaaugaau

SEQ ID NO: 357483 - RNA, 64 nt, Human
gucgauugcccugcuuccugcugggaugcugcgagcuguggagucuaucagacgugggcugaau

SEQ ID NO: 357484 - RNA, 64 nt, Human
ugaagaaaauaacuugcuggcuauauaggaaaaugcuguggaaaugaacuguguauauacuucu

SEQ ID NO: 357485 - RNA, 64 nt, Human
ucuccagauccacagggagaggucucacccuccagcuguggauguuaaacccugccagaugucc

SEQ ID NO: 357486 - RNA, 64 nt, Human
gguuccccccaguuucugaucauguugauuuguagcuguggaucaugaacacugaauccucaga

SEQ ID NO: 357487 - RNA, 64 nt, Human
agccagcagcagcaaccuguucaggucgccugccgcuguggaagcuuuguccuuuugcucuuca

SEQ ID NO: 357488 - RNA, 62 nt, Human
ccgucgccagccagaucugagugcucucccgggcuguggaaguaccugucauuccugcagga

SEQ ID NO: 357489 - RNA, 64 nt, Human
ugcccuggcucugcuuuucacccuggacaaagucgcuguggacuucaauuucuucaccucuaaa

SEQ ID NO: 357490 - RNA, 64 nt, Human
cuucauguucuaccccaagagacucccgaugucggcuguggaggguuaaagggaugaggcuuuc

SEQ ID NO: 357491 - RNA, 64 nt, Human
ggaggcagaugaaugguuucugacccucaccagggcuguggaagggugggggugggucauuaua

SEQ ID NO: 357492 - RNA, 64 nt, Human
aaaaaaaaagaauguuuuugcuaguaucagaucugcuguggaauugguauuguauguccaugaa

SEQ ID NO: 357493 - RNA, 62 nt, Human
agucuuuuuagugcccucugcucucagucuuguugcccuaguaucaagcaaucuuagacaaa

SEQ ID NO: 357494 - RNA, 62 nt, Human
cuccuaaaggcagcugaguccgcgacagaaauuugcccuaugugaguaaaacauacuuuggg

SEQ ID NO: 357495 - RNA, 64 nt, Human
cgggaugguucagccagggccucccaggaagagugcuguggagccacggugacuguccuggaca

SEQ ID NO: 357496 - RNA, 64 nt, Human
agacccuugacagccccagccuaggcagaugggggcuguggaaagauuguucugugucucauuc

SEQ ID NO: 357497 - RNA, 64 nt, Human
uccagcccagcuccaccucagccuuggccuucacgcuguggaagcagccaaggcacuuccucac

SEQ ID NO: 357498 - RNA, 64 nt, Human
gcugcuagcucacauacaggacagccagcaguaggcuguggagcggguaggagagagauggcug

SEQ ID NO: 357499 - RNA, 64 nt, Human
ucccagcccuucucgcugccaaggcagcaguggugcuguggaugggcuggggacugcgggacag

SEQ ID NO: 357500 - RNA, 64 nt, Human
gagaaggaguguucucugucugccuggcaaaggugcuguggaauaggcuuggcaugccacccug

SEQ ID NO: 357501 - RNA, 64 nt, Human
uggcugcaugugcugugaauaucccaaggaacuggcuguggaaugcguguuugggucagucugu

SEQ ID NO: 357502 - RNA, 64 nt, Human
gucaauuguucagguacaccaaagaggaagaagagcuguggaggccacccucuacaaagcuuua

SEQ ID NO: 357503 - RNA, 64 nt, Human
gcuggcugugucccggggccgacucuucucaggggcuguggauagcacugugaaggucagugcc

SEQ ID NO: 357504 - RNA, 64 nt, Human
uuguagaccaggaccauagaugauacaugucagugcuguggaaugugcauucucugaguguugu

SEQ ID NO: 357505 - RNA, 64 nt, Human
cccaaaacgggagagagcagugaaaacaugcagggcuguggacgggggaaggguuguggcgggu

SEQ ID NO: 357506 - RNA, 64 nt, Human
cuugcuagacacacuccauagauccccccacugagcuguggaugggcaaaccccgguggaaucc

SEQ ID NO: 357507 - RNA, 64 nt, Human
caggcaguccccaguggcgggacacagggguccggcuguggagcuccccugccagccccuggag

SEQ ID NO: 357508 - RNA, 64 nt, Human
gaagaguuuacagacaauaaaauggaaagguccugcuguggaaacuuacccaaucuugucuagu

SEQ ID NO: 357509 - RNA, 64 nt, Human
uucagacacacucccuucugccuuccggcuuaaagcuguggaugauccacguuuuuguuuuuuu

SEQ ID NO: 357510 - RNA, 64 nt, Human
ugaacgggacucaggugugggaagaggcgagagggcuguggaggagcucgcacggcgccaggug

SEQ ID NO: 357511 - RNA, 62 nt, Human
caaccaaaaaauucuuaccguaauauuauaucuugcccuacuuauuuacaaaauaauauguu

SEQ ID NO: 357512 - RNA, 62 nt, Human
auuuuuuuuuaucaugauuaaauaucaaaaaauugcccuaugaaaacuuuaaaucucuaaaa

SEQ ID NO: 357513 - RNA, 62 nt, Human
gucucugggguguggugucacagcacuccucuuugcccuagagauaagggaccugacuuccc

SEQ ID NO: 357514 - RNA, 62 nt, Human
cacucagccagaccucuccacagcucaaagcauugcccuaagaaucagaaguaaagauaauc

SEQ ID NO: 357515 - RNA, 64 nt, Human
aguuccucaggucagcauguaugagcuuucuucugcuguggagagaucuagccagucccugacu

SEQ ID NO: 357516 - RNA, 64 nt, Human
uguccauuguuugggccuauggccaagucacccagcuguggaagcagagguagaagacgaggcc

SEQ ID NO: 357517 - RNA, 64 nt, Human
gcucaccuuugggacauaagccuuugccccacaagcuguggagagggccaaaaccaagcugcuu

SEQ ID NO: 357518 - RNA, 64 nt, Human
cagaaauguggccuuugaagagguugcugaggcugcuguggaccaguugcugcagucccaugaa

SEQ ID NO: 357519 - RNA, 64 nt, Human
cagggaauuuuggagaaacuacagcaucauggaugcuguggacauggccaucgcaugggaggag

SEQ ID NO: 357520 - RNA, 64 nt, Human
aaaagugcuaaaacggacaaguagaauaaauguugcuguggaaugccaugcuuuagaacaaacc

SEQ ID NO: 357521 - RNA, 64 nt, Human
ggaagacagagcuuucauuggaaaugccuauauugcuguggauuggcaccccacagcccuucac

SEQ ID NO: 357522 - RNA, 64 nt, Human
aauguaugcuacacaucuugggcucacaagugaggcuguggaggccaggagguucaaguaugga

SEQ ID NO: 357523 - RNA, 64 nt, Human
ggagcaauugagaccccucaggaguuuccacacugcuguggacgggauagccagggcagaccug

SEQ ID NO: 357524 - RNA, 64 nt, Human
acauuagauccugcaucugggugaagaaacgggagcuguggaccacaggccagccagugaaccu

SEQ ID NO: 357525 - RNA, 64 nt, Human
guggacacugaaaaacaguugggaaaucuuucgagcuguggaaauccaaacaaagacugauaau

SEQ ID NO: 357526 - RNA, 64 nt, Human
uuaugauucuagauccuagacagaggcugggucagcuguggaugggguggugccuuggucucuc

SEQ ID NO: 357527 - RNA, 64 nt, Human
agagaaaaauuuaugccuuuuuauucauaacccagcuguggaccacugccugaaagguuuguac

SEQ ID NO: 357528 - RNA, 64 nt, Human
agggagcaagccuuccuccauggcccaucacucggcuguggagaacaaagaccaaugugaagac

SEQ ID NO: 357529 - RNA, 64 nt, Human
uuuccauucuucuugcuacaccccuuuuccaguugcuguggaccaaugcaucucuuuaaaggca

SEQ ID NO: 357530 - RNA, 64 nt, Human
cucccaggccagaaccugagaacgggcccagggugcuguggagaucaacuucaaaagagcuaac

SEQ ID NO: 357531 - RNA, 64 nt, Human
gccuccgcuucucuaucuccuacaggcggcuggaccgcccuaccaggauccgcuucucagacuc

SEQ ID NO: 357532 - RNA, 64 nt, Human
caaaucauagaccguggcuauaaccauaacgagaccgcccuagagaaaaagauucugaaggaac

SEQ ID NO: 357533 - RNA, 64 nt, Human
ugaauagagggaugcuacagaugucauuugucucccgcccuaaguccuccagucuccuuagagc

SEQ ID NO: 357534 - RNA, 64 nt, Human
gagaaagggucccaagugcuggucccaaccugaagcuguggagugacuagaucacaggagcacu

SEQ ID NO: 357535 - RNA, 64 nt, Human
cuggcccuggggaucuucccacaggagggccagcgcuguggaccuuacaacgccgagugcacug

SEQ ID NO: 357536 - RNA, 64 nt, Human
acgaaugaugucagauuuggaaucuaacaucguggcuguggagagggucaaggaguacuccaag

SEQ ID NO: 357537 - RNA, 64 nt, Human
caaguuacaguccaacuggucuuccucugauucagcuguggagugugguuggagaugaaguaag

SEQ ID NO: 357538 - RNA, 64 nt, Human
acuucacauuuauuaagugaaauuuauuucccaugcuguggaaaguuuauugagaacuuguuuc

SEQ ID NO: 357539 - RNA, 64 nt, Human
gggguagggaaacauucagacuguccauugcauggcuguggagugagacugcccuuagccuggg

SEQ ID NO: 357540 - RNA, 64 nt, Human
gggcucagugaaguugcugcuucucccaggcaaggcuguggaccauggaguggcagcccagcca

SEQ ID NO: 357541 - RNA, 64 nt, Human
guauugugugaaaugagaugguggcgaggggugcgcuguggaacugccgcagccacgcaggagg

SEQ ID NO: 357542 - RNA, 64 nt, Human
ccagauggaaggacaggcagcacgggagccaggcgcuguggacagggucuguccacgcaccacc

SEQ ID NO: 357543 - RNA, 64 nt, Human
ccugagaaauaaaaagccugucauuucaaacacugcuguggacccuacuggguuuuuaaaauau

SEQ ID NO: 357544 - RNA, 64 nt, Human
augcccugggcccaggccugacccugguaccgaagcuguggacguucucgccacacucaacccc

SEQ ID NO: 357545 - RNA, 62 nt, Human
cagccgccccagaggccugacuuaggggucuggcuguggaaggauguguggccucaaaugag

SEQ ID NO: 357546 - RNA, 64 nt, Human
ugcuuaaugagcuggcuuuacucuaggguaaguggcuguggacuuuucugcacaguguuuucau

SEQ ID NO: 357547 - RNA, 64 nt, Human
uguggauuuccauaacccaagaggggggucugaggcuguggaaguccgacugggcaguggaaug

SEQ ID NO: 357548 - RNA, 64 nt, Human
ggcuggcuccccgggguccccgacucagcugguggcuguggagcugaguccccuccccguaacc

SEQ ID NO: 357549 - RNA, 64 nt, Human
acuauagguaaugaagaugguaaugaccuuaacagcuguggagucuggcuguauccauuacguc

SEQ ID NO: 357550 - RNA, 64 nt, Human
ccggccugaccugcucaggggcugagggucuggcccgcccuaagcagccccuggcuucacccug

SEQ ID NO: 357551 - RNA, 64 nt, Human
ggucuaagggcacccagcagcagagcuaggacuuccgcccuaaggcugugccucacugccacca

SEQ ID NO: 357552 - RNA, 62 nt, Human
agcugggcuggggaggaccugacccuacucccuugcccuagauaguuuauuauuauuauuau

SEQ ID NO: 357553 - RNA, 62 nt, Human
ggcaaaaauauuuaacccccaaauauauuucuuugcccuaccuugaacuugcccugcagagu

SEQ ID NO: 357554 - RNA, 64 nt, Human
uuucccuucaagugugaaggaaggugugaugaaugcuguggagaggcaucuggaacagaaauuc

SEQ ID NO: 357555 - RNA, 64 nt, Human
caaccucccccucugugaggggagccaccugagggcuguggaacccagcaggcaugagaugaac

SEQ ID NO: 357556 - RNA, 64 nt, Human
auaaccccaccuccccaccccaaaaagggcaagagcuguggaaaaugauugccaaaugagaugg

SEQ ID NO: 357557 - RNA, 52 nt, Human
aauggucguuauugaaaugaaggcuguggauucaaggcucccugccccccag

SEQ ID NO: 357558 - RNA, 64 nt, Human
ggaggucuacgugccucaucccagaaacacggaggcuguggaucugaucaccaggcugcccaag

SEQ ID NO: 357559 - RNA, 64 nt, Human
uugcuuuagaaguggauguguacuucaccucuuggcuguggaggaacuuaguugccaggaaauu

SEQ ID NO: 357560 - RNA, 64 nt, Human
uuacauucauuuaacucuuuaugaccuucacucagcuguggauuugggggcacuuugugggaga

SEQ ID NO: 357561 - RNA, 64 nt, Human
uucuccuggcagagccucccuggggccggggcaggcuguggauggggcggagcagggcagaaga

SEQ ID NO: 357562 - RNA, 64 nt, Human
gugccuggccagccugcccccuucccuggacagggcuguggagauggcuccggcggcuugggga

SEQ ID NO: 357563 - RNA, 64 nt, Human
aagcacaggacauccaaggguacucuccaguuuggcuguggagacuugagcaagcccuaaaguc

SEQ ID NO: 357564 - RNA, 64 nt, Human
uagcucugaaguuaaaaugauuuacauaggccgagcuguggacaaaaaaaaaagaagcagcagc

SEQ ID NO: 357565 - RNA, 64 nt, Human
uauuuccuauucuauaaguaaguauaccuaacaugcuguggaaucuugaguuuccaacaccgug

SEQ ID NO: 357566 - RNA, 64 nt, Human
caccuuuuauuugcaaacugauguuacuuuuugugcuguggaagagcauuugggaaagcugggu

SEQ ID NO: 357567 - RNA, 64 nt, Human
gcaugcucuccugcuguuaaaaacacauuguuaagcuguggauuuguacucaauaaugacuuag

SEQ ID NO: 357568 - RNA, 64 nt, Human
ugcaguaguggcuccuuuggcuuugggcagccuggcuguggaguuuccacggcgacacacagcc

SEQ ID NO: 357569 - RNA, 64 nt, Human
gguggcaaagggaagcauguuccugccaagguuugcuguggauucagaagcaccaggagcaaga

SEQ ID NO: 357570 - RNA, 53 nt, Human; identical to SEQ ID NO: 280895

SEQ ID NO: 357571 - RNA, 64 nt, Human
aguuuuaguuuugcauggcuguuugacugccuuuccgcccuaugaaaaucaagaaaaucuuuuu

SEQ ID NO: 357572 - RNA, 64 nt, Human
caccugccccugcuggaggggcaccaugugugagccgcccuacucccuucaccuggcccucugu

SEQ ID NO: 357573 - RNA, 64 nt, Human
uggcauugaaaugccucuugaccuuccccuccacccgcccuaacccccucucauuuaccucgca

SEQ ID NO: 357574 - RNA, 64 nt, Human
agggacggggcggcccaguggcugagaggagccggcuguggagccccgcccgccccccacccuc

SEQ ID NO: 357575 - RNA, 64 nt, Human
uugagaaacuccucccuugucuagcccuguguucgcuguggacgcuguagaggcagguuggcca

SEQ ID NO: 357576 - RNA, 64 nt, Human
ucucgaggggagggcaggcccggccuggaggggugcuguggagcugucuugcccaggcccuccu

SEQ ID NO: 357577 - RNA, 64 nt, Human
accuaagggacucccacaacaacaaaagcuugaagcuguggagggccacgguggcguggcucuc

SEQ ID NO: 357578 - RNA, 64 nt, Human
ggcauggccccagguagggggacuguucuagccagcuguggacacauaggaaugcuggaccagg

SEQ ID NO: 357579 - RNA, 64 nt, Human
cccaagcgcuccuccuguugccccaccugugguugcuguggacugcacacgacagcagauucgc

SEQ ID NO: 357580 - RNA, 64 nt, Human
ccaagagcugaggguaagggcagguaggcgugaggcuguggacauuuucggaauguuuugguuu

SEQ ID NO: 357581 - RNA, 64 nt, Human
ccccgccuggguggccggaccccugggccuuggggcuguggauccugguucccuguuuggaaaa

SEQ ID NO: 357582 - RNA, 64 nt, Human
ccucccccagacuaacagacccuuggaggcaggggcuguggaaauaaaucucugccugcuggcu

SEQ ID NO: 357583 - RNA, 64 nt, Human
aaacaggccucauucccuacccuugacugguuuagcuguggacaugacccaccucuggccggag

SEQ ID NO: 357584 - RNA, 64 nt, Human
gcggagaaauggaaacauaucacucaagggggaugcuguggaaaccuggcuuauucuucuaaag

SEQ ID NO: 357585 - RNA, 64 nt, Human
cggggaugggaugcgguggguugcccaauaaacggcuguggaguggaaauuccuccagagccaa

SEQ ID NO: 357586 - RNA, 64 nt, Human
ggaacgccaccauguugacccucuggaggagagcgcuguggagccccucccguguuccagcucc

SEQ ID NO: 357587 - RNA, 64 nt, Human
ugcacagcccacacgcugcgcccggaaggccccugcuguggagaagccggacccauccccgagg

SEQ ID NO: 357588 - RNA, 64 nt, Human
gccccaugggcacgggaggggcgccagccguggagcuguggaauugggccccguggcagagccc

SEQ ID NO: 357589 - RNA, 64 nt, Human
ucuguccaaguucaccgucaccaucaagccacuggcuguggaaggaguuuguccaacaggguca

SEQ ID NO: 357590 - RNA, 64 nt, Human
gagaugggagcagcuugggagccccccauuggcgccgcccuacuggggaagccgguccguacgu

SEQ ID NO: 357591 - RNA, 64 nt, Human
gaugcauuauacuccauaccugcuuuucccauggccgcccuacggaaaaucccauccacagagg

SEQ ID NO: 357592 - RNA, 64 nt, Human
gagcaccucccagccccugccccucaugccaaccccgcccuaggccuggcauggcaccugucgc

SEQ ID NO: 357593 - RNA, 64 nt, Human
uacugacaagagaauacccauacaaaucgucccaccgcccuagaggccacagaauuagcccaaa

SEQ ID NO: 357594 - RNA, 64 nt, Human
aguuucagcuucucaaccuucuccccuacccagggcuguggacccagacuggccuugagccaca

SEQ ID NO: 357595 - RNA, 64 nt, Human
ccgagcuauaggagggcggggugaccccucacccgcuguggacucugguuucugagaauaaaca

SEQ ID NO: 357596 - RNA, 64 nt, Human
uugcccugaguggacagucgucuucgaccugucggcuguggaacccgcugagcgcccgagccgg

SEQ ID NO: 357597 - RNA, 64 nt, Human
ccccuagcccuccacaagaagcagcauugagagagcuguggacucaggacccaggacucuguuu

SEQ ID NO: 357598 - RNA, 64 nt, Human
gugacuacagguaacugaaaccauggaaagcaaagcuguggauaagggggaacuacuauauaua

SEQ ID NO: 357599 - RNA, 64 nt, Human
gccaacccuugggcucggagccccggcuccgccugcuguggaggccccagccgugggaauccag

SEQ ID NO: 357600 - RNA, 64 nt, Human
auugccaaccaggacaagaaguugaugacuucaugcuguggacaguuuuucccaagauguccca

SEQ ID NO: 357601 - RNA, 64 nt, Human
uugccuuugcuuuuuagcaaaucugcuguggcaggcuguggauuuugagagucaggggaggggu

SEQ ID NO: 357602 - RNA, 64 nt, Human
uguggagcguggaagcaggagggcagaggcuacagcuguggaaacgaggccaugcugccuccuc

SEQ ID NO: 357603 - RNA, 64 nt, Human
gggcuguucccagccucccacagcagagcuggacgcuguggaaauggcuggauuccucuguguu

SEQ ID NO: 357604 - RNA, 64 nt, Human
ccccugcugggugcuuguucagcccccacucugggcuguggagugggugggcaacgggccuggg

SEQ ID NO: 357605 - RNA, 64 nt, Human
gcuugccccuccagcuagcacuaagcaacaucucgcuguggacgccuguaaauuacugagaaau

SEQ ID NO: 357606 - RNA, 64 nt, Human
aaaccauugagacuucagaagagcaggacacaaugcuguggacaggcaccaauuucuuuaaaga

SEQ ID NO: 357607 - RNA, 64 nt, Human
uacugguuuuucauaaugguuaaaaaugaaaccagcuguggauuucaaaacacaguguauucua

SEQ ID NO: 357608 - RNA, 64 nt, Human
agccaggcuggaggcggcaggcggcaggcagcaggcuguggaggaggccccucggucagggagc

SEQ ID NO: 357609 - RNA, 64 nt, Human
ccagugaaacaacagcagagaaucauguuccuuugcuguggaacacauaagccccacaguuuuc

SEQ ID NO: 357610 - RNA, 62 nt, Human
cugugagggugggcuggcaggaggccuaggccuugcccuaggggcaguccugcuuccucauu

SEQ ID NO: 357611 - RNA, 62 nt, Human
ugcaaaauuaccaaccuauauagcaguuuuauuugcccuauagguugcauacuaacuuaagc

SEQ ID NO: 357612 - RNA, 62 nt, Human
uaagaacauuuuacuaccugcagcuuugagucuugcccuacauuuugggcaugacauaagau

SEQ ID NO: 357613 - RNA, 62 nt, Human
auuuccuagaaguacuggaauguugucauaucuugcccuauuuuaauucugcuauagaaaac

SEQ ID NO: 357614 - RNA, 64 nt, Human
uucuagcuucauaggaauauugugagcucaccaugcuguggagguugggaaagagcagagucuu

SEQ ID NO: 357615 - RNA, 64 nt, Human
gguagccauuggugguuuuccuauuacugauguggcuguggaaugauaagguccuagaggggcc

SEQ ID NO: 357616 - RNA, 64 nt, Human
ugggcgucacuacugcuacccucauuucaccugcgcuguggacacugagaacauccgccgugug

SEQ ID NO: 357617 - RNA, 64 nt, Human
ccucuguccgucucuugcagugguggggucagaugcuguggacucugggaccugcagcucugcc

SEQ ID NO: 357618 - RNA, 64 nt, Human
gcccauucccuccagcggugcaaugaacuaucaugcuguggaccgucaacccagcccugcuucu

SEQ ID NO: 357619 - RNA, 64 nt, Human
uccccccaucaagaaaagaaccagcauuuguaaagcuguggacaccaucagggaagcuuguugu

SEQ ID NO: 357620 - RNA, 64 nt, Human
uucacacucaggcaccaggccugguccaggaggagcuguggacacagucgugguucaagugucc

SEQ ID NO: 357621 - RNA, 64 nt, Human
aucccacccuggccucuccuggaacucugaaccugcuguggaaggaauuggccaugaccuucac

SEQ ID NO: 357622 - RNA, 64 nt, Human
gaaagaauguugucgucuguguuccgguggaggagcuguggaaccugaguuuccagaaccccaa

SEQ ID NO: 357623 - RNA, 64 nt, Human
cucaagccgccagggcucaucaugguagcugggagcuguggacgggagucaccagguggugggg

SEQ ID NO: 357624 - RNA, 64 nt, Human
aaagcuuaaauauauuugccuaguugauaaagaggcuguggaacaacugaaggagaacuuucag

SEQ ID NO: 357625 - RNA, 64 nt, Human
ggugugagagggacagcucacgaggcuuggaccugcuguggagggugcccagcagggggcugag

SEQ ID NO: 357626 - RNA, 64 nt, Human
ggcgugagagggacggcucacgaggcuuggaccugcuguggagggugcccagcagacguggugu

SEQ ID NO: 357627 - RNA, 53 nt, Human
gcuacgagaacccgaccugagcugcuguggagcgggcauggccgggcccugcu

SEQ ID NO: 357628 - RNA, 64 nt, Human
guaccugagaacguaacagaauuaaaaggcaguugcuguggaaacaguuuggguuauuuggggg

SEQ ID NO: 357629 - RNA, 64 nt, Human
accaugccagccucucccacacggggcccugcaggcuguggauaugcacucagaggacuaaggg

SEQ ID NO: 357630 - RNA, 64 nt, Human
guccuccaagccagcgggaauggcagcugccacgccgcccuaaaagcacacucauccccucacu

SEQ ID NO: 357631 - RNA, 64 nt, Human
aaaacaaggaaaagaggaaaaaaaaaacagaggcccgcccuaccccacuccugccccuccguuu

SEQ ID NO: 357632 - RNA, 64 nt, Human
cuagguggcucggccucagcugccuggguuguggccgcccuagcauccuguaugcccacagcua

SEQ ID NO: 357633 - RNA, 64 nt, Human
cagaugccacaagauucccgaaccuccccaaaccccgcccuacugucucuuccuguuuguuccc

SEQ ID NO: 357634 - RNA, 64 nt, Human
cauugugcacagaucugaggaugggauuagcgaagcuguggagacugcacauccggaccugccc

SEQ ID NO: 357635 - RNA, 64 nt, Human
cagcuauuucaacuuccuuccguuuccagaaagagcuguggauauuuuacuggaaauuaagaac

SEQ ID NO: 357636 - RNA, 64 nt, Human
ccuguuaauguugaaguuauaccucugaauuucugcuguggauaucaaggaaauaauaaagcag

SEQ ID NO: 357637 - RNA, 64 nt, Human
uuuacuuucacggugguuuuuguuuuuucuuauugcuguggaaccucuuuuggaggacguuaaa

SEQ ID NO: 357638 - RNA, 64 nt, Human
cacagaggagugccuuauccccacacuugacugggcuguggaggugggcaugugggccccuggg

SEQ ID NO: 357639 - RNA, 64 nt, Human
gcuuuccacuguggguaccuggugaucagggcaagcuguggagggccagggguggggcugagac

SEQ ID NO: 357640 - RNA, 64 nt, Human
aaccaaaaagcuggguccucuggaggaggggcgagcuguggagcagccacccacugcugcccca

SEQ ID NO: 357641 - RNA, 64 nt, Human
cccacccacgguccucaccuggagcuguggccuggcuguggagggccgggugguggcucugagg

SEQ ID NO: 357642 - RNA, 64 nt, Human
cuugggcagcagcucagcaugggcagacaugggggcuguggauucuuccagggcggggauggca

SEQ ID NO: 357643 - RNA, 64 nt, Human
ggacccgccugaggggugacaguggaguagagaagcuguggaaacacaucaagcacaaguauga

SEQ ID NO: 357644 - RNA, 64 nt, Human
uggggcaggauggccccacuggggcuccuacagagcuguggaauguaccucuccccaacacugu

SEQ ID NO: 357645 - RNA, 64 nt, Human
uggcagaaauggccacuggaaaggggagcgaugagcuguggaggaagcccuggugguaccagag

SEQ ID NO: 357646 - RNA, 64 nt, Human
cucugaggccaucggcugucucugcauuucauuggcuguggaggagagacuccuaggauggcug

SEQ ID NO: 357647 - RNA, 64 nt, Human
cacugaugcucugggccaugcccggcugacggcugcuguggaugccgcgagggacggacacacg

SEQ ID NO: 357648 - RNA, 57 nt, Human
aguacaagaacguggagugacgggggagcuguggaugguggcaggagugucccagca

SEQ ID NO: 357649 - RNA, 64 nt, Human
ugccgcaggcaucucagggccaugcagaucccaggcuguggauuacgucacugcaggaacugcu

SEQ ID NO: 357650 - RNA, 62 nt, Human
uauggaacuuaacacuccccauuggagcaagcuugcccuagagacggcaggaucaugggagc

SEQ ID NO: 357651 - RNA, 62 nt, Human
uugaucuuaaacuggaacaugcuuuuacuuuauugcccuaacaauuuuuuauuaaauuuauu

SEQ ID NO: 357652 - RNA, 62 nt, Human
gccugccucuaacccaccacuggccagcccccuugcccuacucugggcugcugaacacuggu

SEQ ID NO: 357653 - RNA, 62 nt, Human
uuuuuucccauuauuuuuauuuuauuuucugguugcccuagcuucccccccuauuuuugugu

SEQ ID NO: 357654 - RNA, 64 nt, Human
ccagucgggacaccccccgcagcccguccugguggcuguggaacugcacuggguggcgggcaga

SEQ ID NO: 357655 - RNA, 64 nt, Human
uguaauacuagcugguauguuucauaaaugucaagcuguggaccaacauauauagccuuuuauu

SEQ ID NO: 357656 - RNA, 64 nt, Human
uaggccuggggaccaggcuugggucuggagguuugcuguggaagucaccaggccuccccuccug

SEQ ID NO: 357657 - RNA, 64 nt, Human
gacaaggagcggcaggaaucaccacccaucuccagcuguggagcccuguggaggggaaggggaa

SEQ ID NO: 357658 - RNA, 64 nt, Human
uuaccuugaacucuccucucuggcuuugcggugggcuguggaggcugguuuugaccaaaaguga

SEQ ID NO: 357659 - RNA, 64 nt, Human
cuuccccugcaccuggccugggccacaccugagcgcuguggacuguccugaggagcccugagga

SEQ ID NO: 357660 - RNA, 64 nt, Human
uguugaggagcugugggagcaggcccagugggaggcuguggacaccccgaggacaguguccugu

SEQ ID NO: 357661 - RNA, 64 nt, Human
gaaagcacccaaagugguggucaggagggucgcugcuguggaaggggucuccguucuuggugcu

SEQ ID NO: 357662 - RNA, 64 nt, Human
ucuugauuccaaauccuaaaccaggaagaguugggcuguggaaggacaucuucaccgucuccau

SEQ ID NO: 357663 - RNA, 64 nt, Human
gccagggucuugguggcauuuguaaaagcaaagagcuguggacugccgugguccuaguguggug

SEQ ID NO: 357664 - RNA, 64 nt, Human
gccucccucuggcccguuggaggggcaggcugaggcuguggaggggacaagcacgccccccaga

SEQ ID NO: 357665 - RNA, 64 nt, Human
cacugcaggcagcuggcacagcguggcccgaggggcuguggaacgggucccggaacugucagac

SEQ ID NO: 357666 - RNA, 64 nt, Human
gguggcagcugcuccuucgcccucuuguaguguggcuguggagggcucugccuauggggggugg

SEQ ID NO: 357667 - RNA, 64 nt, Human
uacuuauuuuuccucucaggucuuaucagauacggcuguggagaggaugaggcauaugcguugu

SEQ ID NO: 357668 - RNA, 64 nt, Human
guggaaccaugugacaaggacuggagugccauuggcuguggacuguucaggcagggaaguacaa

SEQ ID NO: 357669 - RNA, 64 nt, Human
uugggagccaggacucccagaaccucuaagugcugcuguggagugagguguauugguguugcag

SEQ ID NO: 357670 - RNA, 64 nt, Human
aaggaaccagggcugccccaccgcccgccgucugccgcccuaggcuuccugacuccauuaguuc

SEQ ID NO: 357671 - RNA, 64 nt, Human
cuauugcaucuucauugcaaaagcacuggcucauccgcccuacuucccaucccacacaaaccca

SEQ ID NO: 357672 - RNA, 64 nt, Human
agcccccugcccaaacaaaacaggacaucugugaccgcccuacccccacgccagccccaaacua

SEQ ID NO: 357673 - RNA, 64 nt, Human
ccccagaaagccucccuucuucuccagguccccuccgcccuagucccugccugucucaucuaac

SEQ ID NO: 357674 - RNA, 64 nt, Human
agggauguggguaagaggagcagagggcaggggugcuguggacauguggguggagaagggaggg

SEQ ID NO: 357675 - RNA, 64 nt, Human
guaacagcagagggaguuaagccauaggaauuuggcuguggaguaagagggaaugcggugaggc

SEQ ID NO: 357676 - RNA, 64 nt, Human
ucaucuuugaguuuaaggccuuuuguuguauaaggcuguggaaguuguacuccaauggcugaag

SEQ ID NO: 357677 - RNA, 64 nt, Human
guauauagugacauagcauucugcugccaucuuagcuguggacaaaggggggucagcuggcaug

SEQ ID NO: 357678 - RNA, 64 nt, Human
cuauuguuuagucccuaggucaccuuugugcugugcuguggaguucagaaacgggguaccauga

SEQ ID NO: 357679 - RNA, 64 nt, Human
uguacucgagcggcuccgggcggagaacaagucggcuguggagaugcggaaagcccugacggac

SEQ ID NO: 357680 - RNA, 64 nt, Human
accaguuggcuaggggagcagggggcccaccagagcuguggagaggggacccuaagacuccucg

SEQ ID NO: 357681 - RNA, 64 nt, Human
cagaacguggugaccuuucacgaacaugggcauggcuguggaccccucgucaucaggugcauag

SEQ ID NO: 357682 - RNA, 64 nt, Human
cugaagcucgaguacuucccaaugccgcuacuuugcuguggacaccccugcuuuaaaaacccuu

SEQ ID NO: 357683 - RNA, 64 nt, Human
ccuucauguggugaggggaucacuucagcugccugcuguggacaaagaacaucaaauuacagca

SEQ ID NO: 357684 - RNA, 64 nt, Human
gggaugaagauugaacccuggcugaacuuuguuggcuguggaagaggccaauccuauggcagag

SEQ ID NO: 357685 - RNA, 64 nt, Human
guauuauuguuguuucauacuuuaaauuuauauggcuguggaaaaacgaauuaaaauguuuuga

SEQ ID NO: 357686 - RNA, 64 nt, Human
agggccucugguuuguuguauuauaguauauuucgcuguggaaaaugucacguuuagucaccuu

SEQ ID NO: 357687 - RNA, 64 nt, Human
gccuugggauuccacgcucgccgcccucccuuggccgcccuacuccccaguuuccuggcgauga

SEQ ID NO: 357688 - RNA, 64 nt, Human
cugggagcccacagccaccccacuaugccgcaggccgcccuacccaccuucaggcagccuaugg

SEQ ID NO: 357689 - RNA, 64 nt, Human
ggcaggcccccagccugcucucuaggaucaccccccgcccuaaggggccuggccuggggugacg

SEQ ID NO: 357690 - RNA, 62 nt, Human
acagaaucccugcccuaaaaucccaggcuuaauugcccuacaaaggguuauuaauuuaaaac

SEQ ID NO: 357691 - RNA, 62 nt, Human
cuugcaagugaaauauguuacagaacaugcacuugcccuaauaaaaaaucagugaaaugguc

SEQ ID NO: 357692 - RNA, 62 nt, Human
gagccaccucucucacuuucuuuaguugugccuugcccuaucgccucccauuuucccuucaa

SEQ ID NO: 357693 - RNA, 62 nt, Human
cuguguggcuuuccuuccugaagaguccgugguugcccuagaaccuaacacccccuagcaaa

SEQ ID NO: 357694 - RNA, 62 nt, Human
uaaaguuuuacagaaaguagugcugugauugauugcccuagccaauucacaaguuacacugc

SEQ ID NO: 357695 - RNA, 62 nt, Human
aggaauauuuggauauuuuuaauccuaagauuuugcccuacaauuaggcagaggucaaaaag

SEQ ID NO: 357696 - RNA, 62 nt, Human
uuuuccuuacugugcauccgccugaaaguguuuugcccuauauaccucacuagccaugcuuu

SEQ ID NO: 357697 - RNA, 62 nt, Human
uuuaagcuauauaggaaacauuguuauugguguugcccuaucgugauuucaguugaauucau

SEQ ID NO: 357698 - RNA, 62 nt, Human
aaguaggaucuuacuguaaguugaagggaguuuugcccuaacucauggauugugcaagaaug

SEQ ID NO: 357699 - RNA, 62 nt, Human
uuuuaaugaaaucuguauggauauggaaaugcuugcccuaauaaaagccuacauauaccuuc

SEQ ID NO: 357700 - RNA, 62 nt, Human
uuuuaaagaaauauuuaugguuauggaaacgcuugcccuaauaaaaauccugcauauucauu

SEQ ID NO: 357701 - RNA, 62 nt, Human
auacuucuugaaaacuuaguuuacuauacaucuugcccuauuaauauguucucuuaacgugu

SEQ ID NO: 357702 - RNA, 62 nt, Human
gacuggugagauuggugguaggccugugaaauuugcccuaguuacuaccauucucguuuugg

SEQ ID NO: 357703 - RNA, 62 nt, Human
caacaccaguacccuugucucuggggaaacuuuugcccuaugaaccugagaauuaccccuac

SEQ ID NO: 357704 - RNA, 62 nt, Human
gaucagucaucccucuuguaugcugggccugguugcccuaccucgaacaagcaccagcuuuu

SEQ ID NO: 357705 - RNA, 62 nt, Human
uucuaaagcuaguaaacuucccuaacguuuaauugcccuacagaugcuucucuugcuguggg

SEQ ID NO: 357706 - RNA, 62 nt, Human
gggcaguagagggaaucugucagucucaugguuugcccuaggaaaccuucugcucagcccca

SEQ ID NO: 357707 - RNA, 62 nt, Human
accagggcccgggguuugggagggcugcaccuuugcccuagugcccaucuuccugaaaggau

SEQ ID NO: 357708 - RNA, 62 nt, Human
auuacaaguuugagccacugcaccuggcuaacuugcccuauuuuaaagucaagcaaugggaa

SEQ ID NO: 357709 - RNA, 62 nt, Human
auccuguuucucuuauuuauugaaacucaccauugcccuauccuugugucuccacccccuuc

SEQ ID NO: 357710 - RNA, 62 nt, Human
agccuccuggaggagugggguccaccuucuucuugcccuaugcagugcaagcucacuucuca

SEQ ID NO: 357711 - RNA, 62 nt, Human
uuuuagaacuucccagacgaaaacucacgcccuugcccuaacgcgcuuugcugugagccugg

SEQ ID NO: 357712 - RNA, 62 nt, Human
caauggcuuuguacuugugaugagagauaaccuugcccuaguugugggcaacacaugcagaa

SEQ ID NO: 357713 - RNA, 62 nt, Human
cagccugguaucagggaaauugagacuuauuuuugcccuaaaacgucucccuagcuguucuu

SEQ ID NO: 357714 - RNA, 62 nt, Human
gucugguccauugcuggcaguggacauuauucuugcccuaagagacacugccuuuucagcag

SEQ ID NO: 357715 - RNA, 62 nt, Human
ccuucucagggggucccgagccccgacuagcuuugcccuaacuccuucaucaaaagaccccc

SEQ ID NO: 357716 - RNA, 62 nt, Human
cagaaguugcccccaggugguggggccccuccuugcccuaggcugguugguaaaagagagga

SEQ ID NO: 357717 - RNA, 62 nt, Human
ugagcgcccacccucucgaaagaauuuucugcuugcccuaugacugugcagacucuggcucg

SEQ ID NO: 357718 - RNA, 62 nt, Human
uguguaaauguguacacacagacauaaaguacuugcccuaguuuguggcuaauguggacaca

SEQ ID NO: 357719 - RNA, 62 nt, Human
aagaaaccugggugucagggaggugaagugacuugcccuaggagcagacagcaugccaagaa

SEQ ID NO: 357720 - RNA, 62 nt, Human
guuuuaugugucaccaccuuucauguuuuugauugcccuacaaagagaaaccaaaugagcug

SEQ ID NO: 357721 - RNA, 62 nt, Human
aaaagccaucuuccauaguugguguuagaacauugcccuauugguuuggacaucuguagaau

SEQ ID NO: 357722 - RNA, 62 nt, Human
acaacuuuuaaaugaauaaagaggaagucaaguugcccuauggaaaacuuguccaaauaaca

SEQ ID NO: 357723 - RNA, 62 nt, Human
aaaguugcacuguuccaguaguuauaauccacuugcccuaggaacaaguuagcacugaauuu

SEQ ID NO: 357724 - RNA, 62 nt, Human
uacuuugcuuuugagaaaauugacacucagacuugcccuaaucaugcacuuuacuuaaggaa

SEQ ID NO: 357725 - RNA, 62 nt, Human
acuguguaacugcauaaacugcaguagcaucauugcccuagaugccccaggagaccuggcac

SEQ ID NO: 357726 - RNA, 62 nt, Human
ggagggguuucaagacuagaaacuguucuuaauugcccuaaugaucuacgguggucugugaa

SEQ ID NO: 357727 - RNA, 62 nt, Human
aaaauaaaguaccuuaauucuuuauugacuuuuugcccuaaauugcuaggugugacccagca

SEQ ID NO: 357728 - RNA, 62 nt, Human
ggacaggaaaaguaggaggaggaucuggggcauugcccuaggaaaugaaagaauuguguaua

SEQ ID NO: 357729 - RNA, 62 nt, Human
uauuaaccgaaaaaugacccaagacuuaguucuugcccuacuguaucugccuuguuugguug

SEQ ID NO: 357730 - RNA, 62 nt, Human
gaaucugauucagaggcaugcauuuacauauguugcccuaauuaccauuugaugaucauaaa

SEQ ID NO: 357731 - RNA, 62 nt, Human
aaaaaauuugauuauauauuuuuaauccuucuuugcccuaaagacuuuaagaagacuugaaa

SEQ ID NO: 357732 - RNA, 62 nt, Human
aacauugaggcuuggaaaauguguuauuuucguugcccuaaguuugagucgacuuuagacuc

SEQ ID NO: 357733 - RNA, 62 nt, Human
acuauauauacacggaaaccaauuucuuacccuugcccuagauugcucaguaaauuugugcc

SEQ ID NO: 357734 - RNA, 62 nt, Human
uuuguaccucaacaaaugcaaauuuuccccguuugcccuacgccccuuuugguacaccuaga

SEQ ID NO: 357735 - RNA, 62 nt, Human
uuaguuugagggugaggguacauaugugacauuugcccuagccuaagaguagcagguaaaaa

SEQ ID NO: 357736 - RNA, 60 nt, Human
ccauggaggucuccuguugaauggcccuuguugcccuagagugggacccagcccucaccu

SEQ ID NO: 357737 - RNA, 62 nt, Human
cacuaaaggacauaagaguuguuuucaguuuuuugcccuaauaaagcugcugugaacauuca

SEQ ID NO: 357738 - RNA, 62 nt, Human
gagacccuugaaccacugggcagccaccuccuuugcccuagaccagcuccucuccaauccug

SEQ ID NO: 357739 - RNA, 62 nt, Human
cagugcaguguacauuuccacaaaucuaagaauugcccuauaaacauagcaggauuuugaga

SEQ ID NO: 357740 - RNA, 62 nt, Human
uauuuuuguaaaccucuucauacuauuaaauuuugcccuaaaagaccucuuaauaaugauug

SEQ ID NO: 357741 - RNA, 62 nt, Human
aaauaccaugggauuuaugcuguauugacaucuugcccuaaacguacaacaucauaguaauu

SEQ ID NO: 357742 - RNA, 62 nt, Human
acggacucggccugccuuugcccucggccuacuugcccuagcaugaggcucugagagccacc

SEQ ID NO: 357743 - RNA, 62 nt, Human
cuucccaugagggccuggcccacccgcugcaguugcccuaaggaaaaauaaagcugccuuuc

SEQ ID NO: 357744 - RNA, 62 nt, Human
caggaugaacauuuucggcuuccuuaggaguuuugcccuaccguauuccaaagcgugugcug

SEQ ID NO: 357745 - RNA, 62 nt, Human
aaagacgagcuuuuguuaucaguuccacgggguugcccuagagagaaaacaggcaaacucac

SEQ ID NO: 357746 - RNA, 62 nt, Human
agacccugaguccugccaucuaacugugaucauugcccuauccgaauaucuuccugugaucu

SEQ ID NO: 357747 - RNA, 62 nt, Human
uggcuuuuuccuaccaacugauacguuuaaauuugcccuaggauugagcuaacagcaaaaaa

SEQ ID NO: 357748 - RNA, 62 nt, Human
aaagaauauucauauuaccuccuucuucuaacuugcccuauuugcaaaagcacuuuuguagu

SEQ ID NO: 357749 - RNA, 62 nt, Human
uucacauaggccucugggagugauuugguucuuugcccuaauguuucauuugacggucucuu

SEQ ID NO: 357750 - RNA, 62 nt, Human
gaaagaaauggggagggggggcaggggaaauguugcccuaagaaugcuucucauuccucugu

SEQ ID NO: 357751 - RNA, 62 nt, Human
cagaagcaaguaaucuuuccccagauaauauuuugcccuagaagaagccgugauuuagcucu

SEQ ID NO: 357752 - RNA, 62 nt, Human
uccugugccuuauguaacugcccuuccuucccuugcccuaggaaaaaggcugcaucuuuaua

SEQ ID NO: 357753 - RNA, 62 nt, Human
acuuauagcagugucauuuggaaaaguugaauuugcccuacaaggcauguucuccauucaag

SEQ ID NO: 357754 - RNA, 62 nt, Human
gcugggauugggaaggaguuucacccugaccauugcccuagccagguucccaggaggccuca

SEQ ID NO: 357755 - RNA, 62 nt, Human
gucucuggggcagauccccacuguccuaccaguugcccuagcccagacucugagcugcucac

SEQ ID NO: 357756 - RNA, 62 nt, Human
auccucguucugguggcuuuguguaaauauguuugcccuaguugaauuaagaaacucuaaag

SEQ ID NO: 357757 - RNA, 62 nt, Human
accuguucccacaaauggcaucccgcgcaugcuugcccuauuaaaggcagcugacagcugua

SEQ ID NO: 357758 - RNA, 62 nt, Human
ugggcuggccaguuggaaccacggagaucuccuugcccuagaugagcccagcccuguucugg

SEQ ID NO: 357759 - RNA, 62 nt, Human
cuuccauucucuuaggcacaguaauagcuuauuugcccuauaagaaccuucccagagcagca

SEQ ID NO: 357760 - RNA, 62 nt, Human
aucggcugcagccaucccccucauuuuaaauguugcccuaauaaucaaugcaguuaacaagu

SEQ ID NO: 357761 - RNA, 62 nt, Human
acagggagucucuccgcagagccuucuugguguugcccuaacuugccaguggccuuugcuca

SEQ ID NO: 357762 - RNA, 62 nt, Human
cuuccacacucugaucacagccccccuaccuuuugcccuaggaggaagcaauaaugguguau

SEQ ID NO: 357763 - RNA, 62 nt, Human
gcuaggcccggagccguuggcccgggccggccuugcccuauuccucuccuccuccuccuccu

SEQ ID NO: 357764 - RNA, 62 nt, Human
gcaacacuggggagagccuggagcauccggacuugcccuaugggagaggggacgcuggagga

SEQ ID NO: 357765 - RNA, 62 nt, Human
uuccuauuccacucagggcugugggguggugguugcccuaccuguuuuugccaaaaauaaau

SEQ ID NO: 357766 - RNA, 62 nt, Human
ucccagagaccuugaugcuuggccucccaaucuugcccuaggauacccagaugccaaccaga

SEQ ID NO: 357767 - RNA, 62 nt, Human
guucucagucuaguuugaccuaauuuacacuauugcccuaggcuugcuaggaaagacugaaa

SEQ ID NO: 357768 - RNA, 62 nt, Human
gguccaggagcacugcucgccuguacauacuguugcccuagcccaccuggugccgugggagc

SEQ ID NO: 357769 - RNA, 62 nt, Human
gagccauagaagcuucuaagcagaagagggacuugcccuaauucaggugaucacaggugucu

SEQ ID NO: 357770 - RNA, 62 nt, Human
cuucuaagccaucaauuucauguuauuuauuauugcccuaugugggguggggagggaaccuc

SEQ ID NO: 357771 - RNA, 62 nt, Human
gaugugugucuguccucaggaggugaaauaauuugcccuagagaucaauuugaugaauacag

SEQ ID NO: 357772 - RNA, 62 nt, Human
accugagucaaaugucuaucugauugcuucccuugcccuauuuauguaaaaauacagggucc

SEQ ID NO: 357773 - RNA, 62 nt, Human
cuauuucucuuuuguggccuuuuagacuuuuguugcccuaaaauuccauuuuauugggaacc

SEQ ID NO: 357774 - RNA, 62 nt, Human
ugucuuguucaacgauguaagcagaaacugaauugcccuaauuuugccaacuggccauuauu

SEQ ID NO: 357775 - RNA, 62 nt, Human
cuaaugguguugaguugcucugucccuauuauuugcccuaggcuuucuccuaaugaagguuu

SEQ ID NO: 357776 - RNA, 62 nt, Human
cccauccuaagugaguucagaaucaggguaucuugcccuauaagauaaacagucaaaaugcc

SEQ ID NO: 357777 - RNA, 62 nt, Human
gccucucccccuccuuccaucucuucucucucuugcccuaucucucuuucuacuucagaaaa

SEQ ID NO: 357778 - RNA, 62 nt, Human
uuucuuuuuaucaaguagaaaaaaaaauguauuugcccuaaauccuuaaaauacaaaugcua

SEQ ID NO: 357779 - RNA, 62 nt, Human
uauuuguaauuaagccugcacauauuuuuuuauugcccuagaguacucaaguguuuuucacc

SEQ ID NO: 357780 - RNA, 62 nt, Human
agaacgagagcaagaaaaagaugauguagauguugcccuacuaccuaccauuguggaaaagg

SEQ ID NO: 357781 - RNA, 62 nt, Human
aagcugaguccugcaggaagcugccuuucccuuugcccuaagcagacagcugcagaugagag

SEQ ID NO: 357782 - RNA, 62 nt, Human
cucuuggcuccuguggaaggagggcugcccucuugcccuagugagggccccauguggaucca

SEQ ID NO: 357783 - RNA, 62 nt, Human
gaauuuaaagauguucaguguuggguaacagauugcccuaagcauugccacauauucugucu

SEQ ID NO: 357784 - RNA, 62 nt, Human
cucaggcuugugucuaucacaaaagcacaaacuugcccuaacccacaugggccuggcugugg

SEQ ID NO: 357785 - RNA, 52 nt, Human
auuccaccacuagaguauagcuuugcccuauuucccuuccuaucccucugcc

SEQ ID NO: 357786 - RNA, 62 nt, Human
gugucuguaucauacaaguacaaauacuaauuuugcccuauguauccguaaaugucauuugu

SEQ ID NO: 357787 - RNA, 62 nt, Human
aagcacugggcuuccacaggccccuggccuccuugcccuagcacacugggacuggccccacu

SEQ ID NO: 357788 - RNA, 62 nt, Human
ggcgaggcaugcuaucauggaaugagacuggcuugcccuaggcuuaauggaugggcagucau

SEQ ID NO: 357789 - RNA, 64 nt, Human
ggccuguggcuuggauccgccaugcagagauguggccgggcacccaucuuccuucccuccucug

SEQ ID NO: 357790 - RNA, 64 nt, Human
uaaacuugauggucauuguuaugauuaagauaaugccgggcaggccgggcacaguggcucacgc

SEQ ID NO: 357791 - RNA, 64 nt, Human
uggucauuguuaugauuaagauaaugccgggcaggccgggcacaguggcucacgccuguaaucc

SEQ ID NO: 357792 - RNA, 64 nt, Human
ucaggagcacaggcaaggggugcuuguggcaguggccgggcaccugagccccagcucguuguua

SEQ ID NO: 357793 - RNA, 64 nt, Human
agcucugacguuuuguuguaauaaauguuuucaggccgggcacuguggcucacgccuguaaucc

SEQ ID NO: 357794 - RNA, 64 nt, Human
ggagaccucaucucugcaaaaaauaacaaaauuagccgggcaugguggugcacaccuguagucc

SEQ ID NO: 357795 - RNA, 64 nt, Human
agcugugccaaucuaccucacaggcccacccccugccgggcaugccgugggaucaugggcaggg

SEQ ID NO: 357796 - RNA, 64 nt, Human
ugaaaccccaucucuacgaaaaauacaaaauuuagccgggcaugguagcaggcgcuuguaaucc

SEQ ID NO: 357797 - RNA, 64 nt, Human
gcuaccaucacuuccucaucaugaaaacugggaggccgggcaugguggcucaugccuguaaucc

SEQ ID NO: 357798 - RNA, 64 nt, Human
uauuauagcaaguucuuuauuaaagauuuuugaggccgggcacagugacucacgccuguaaccc

SEQ ID NO: 357799 - RNA, 64 nt, Human
gugaaacacugucuguacuaaaaauacagaauuagccgggcauggugcaugccuguaaucccag

SEQ ID NO: 357800 - RNA, 64 nt, Human
augucuggggccucaccagcaggagcgcgugcaagccgggcaggcgguccaccuagacccacag

SEQ ID NO: 357801 - RNA, 64 nt, Human
aaaaccccaucucuacuaaaacauacaaaaauuagccgggcaugguggcacacgccuguagucc

SEQ ID NO: 357802 - RNA, 64 nt, Human
ugaaaccccgucucuacuaaaaauacaaaaauuagccgggcaugguggcacgcgccuguagucc

SEQ ID NO: 357803 - RNA, 64 nt, Human
aauggcuugaaacuggcaagauuaacaaaauuaggccgggcaugguggcucacgccuguaaucc

SEQ ID NO: 357804 - RNA, 64 nt, Human
uauuuacuguacuaauuagaaaauauaguuugaggccgggcacgguggcucacgccuguaaucc

SEQ ID NO: 357805 - RNA, 64 nt, Human
guacugggccauguugugccucccuggugagagggccgggcagaggggcagauggaaaggagcc

SEQ ID NO: 357806 - RNA, 63 nt, Human
augaaaccaugcccaacugagauugucuuccaagccgggcauccuugcgagccccccaagcug

SEQ ID NO: 357807 - RNA, 64 nt, Human
ccccagguagguguauaagaugaguugcaaauuagccgggcaugcuggcacgcaccaguaaucc

SEQ ID NO: 357808 - RNA, 64 nt, Human
cuugucuuggcaucaagaauagucaaguuuuuuggccgggcaugguggcucaugccuguaaucc

SEQ ID NO: 357809 - RNA, 64 nt, Human
ugaaaccccgucucuacuaaaaauacaaaaauuagccgggcaugguggcgcgcaccuguaaucc

SEQ ID NO: 357810 - RNA, 64 nt, Human
gcagguuaacaaagaaugcguccgaggacuuugggccgggcagcagcaggagcuuauauuucuu

SEQ ID NO: 357811 - RNA, 64 nt, Human
gagcccucgcggcaggcccgagcaggcgaucgcggccgggcacgcgcgccccgggcucccgccc

SEQ ID NO: 357812 - RNA, 64 nt, Human
ugaagaccaacaagcuaauaaauaaaaaguugaggccgggcacgguggcucacgccuguaaucc

SEQ ID NO: 357813 - RNA, 64 nt, Human
uuucauuaaaauauguuuucaaaaccauuuucaggccgggcacgguggcucaccuguaauccca

SEQ ID NO: 357814 - RNA, 64 nt, Human
accggcagcccaaggggaaggaccgguugggggagccgggcaugugaggcccugggcaagggga

SEQ ID NO: 357815 - RNA, 64 nt, Human
gugaaacuccgucucuaccaauauacaaaaauuagccgggcaugauggugguggccuguaaucc

SEQ ID NO: 357816 - RNA, 64 nt, Human
ugaaaccccgucucuaauaaaaauacaaaaauuagccgggcauggugacgugcaccuguagucc

SEQ ID NO: 357817 - RNA, 64 nt, Human
aggauacucaagucccuuauauaaaaugguguaggccgggcaugguggcucacgccuguaaucc

SEQ ID NO: 357818 - RNA, 57 nt, Human
uggaguuaagugggcacugaaagguaggccgggcaugguggcucaugccuguaaucc

SEQ ID NO: 357819 - RNA, 64 nt, Human
agcgagacuucgucucaaacaaacaaaaaaauuagccgggcaugguggcaggugccuguaaucc

SEQ ID NO: 357820 - RNA, 64 nt, Human
accaccagucaugccuaggaccuggggcccaaaagccgggcaaccucuggcuacaggggccauu

SEQ ID NO: 357821 - RNA, 64 nt, Human
uauuuucuccgaaaggcaaaaaugugcccuuuuggccgggcaugguagcucaagccuauaaucc

SEQ ID NO: 357822 - RNA, 64 nt, Human
gccagacagacccugaaaagaaggacggguuggggccgggcacauugggggucaccggccgaug

SEQ ID NO: 357823 - RNA, 64 nt, Human
ggccuucuuacacuucucagagggcagaguggcagccgggcacccuacagaaacucagagggca

SEQ ID NO: 357824 - RNA, 64 nt, Human
guuggcagcuggagaaagaggcaaaaagcccguagccgggcaagaggagcucaagucggucugg

SEQ ID NO: 357825 - RNA, 64 nt, Human
ugaauaaacucugccuuuuaaauugagcaucugggccgggcaugguggcucacgccuguaaucc

SEQ ID NO: 357826 - RNA, 64 nt, Human
cucuuugagccuguccucagaggauggcgaggcagccgggcaguggaggccuucaugguaacaa

SEQ ID NO: 357827 - RNA, 64 nt, Human
guugaagauaaauaagcuuaaacaaauaacuuuggccgggcacgguggcucacaccuauaaucc

SEQ ID NO: 357828 - RNA, 64 nt, Human
acuguucauccuucuucaagaagaagcuugccaggccgggcacgguggcucacgccuauaaucc

SEQ ID NO: 357829 - RNA, 64 nt, Human
cacgccuucucgaccgcgcacuucgauauucggagccgggcaauucuuugcugcgugggcuucu

SEQ ID NO: 357830 - RNA, 64 nt, Human
cagaggcacucuucacuucccagacagaggggcggccgggcagaggugcuccucacuucccaga

SEQ ID NO: 357831 - RNA, 64 nt, Human
uuauguuaacuuuauuuaaaacacaauuuauuuggccgggcacgguggcucacaccuguaaucu

SEQ ID NO: 357832 - RNA, 64 nt, Human
gauguuguuuugccaguauuagaaaauacugugagccgggcaugguggcuuacaucuguaaucc

SEQ ID NO: 357833 - RNA, 64 nt, Human
gugaaacccugucucuaccaaaauacaaaaauuagccgggcaugauggcgggugccuguaaucc

SEQ ID NO: 357834 - RNA, 64 nt, Human
gagaccccgucuccgcuaaaaauacaaaaaauuagccgggcaugguggcaggugccuguagucc

SEQ ID NO: 357835 - RNA, 64 nt, Human
agugagacucaucucugccaaaaaaaaaaaauuagccgggcaugguggcacacaucucuagucc

SEQ ID NO: 357836 - RNA, 64 nt, Human
uuaucuuuaguagagacgggguuucaccacguuggccgggcagguuuuaaacucuugaccucau

SEQ ID NO: 357837 - RNA, 64 nt, Human
gcugcagggccucuugcugcuuaagagcugaugggccgggcauguuggcucacaccugugagca

SEQ ID NO: 357838 - RNA, 64 nt, Human
gguuggagcuuaaagauccaaacugagaaagcaggccgggcaugguggcucaugccuguaaucc

SEQ ID NO: 357839 - RNA, 64 nt, Human
acagccucagugugacuccacaguggccccuguagccgggcaagcaggagcaggucucucugca

SEQ ID NO: 357840 - RNA, 64 nt, Human
ccagcuggggccccucggcuaccccccgucuccugccgggcaggucccagguuggaggcccuag

SEQ ID NO: 357841 - RNA, 64 nt, Human
ugaaacccugucucuacuaaaaauacaaaaauuagccgggcauggugguaggggccuguaaccc

SEQ ID NO: 357842 - RNA, 64 nt, Human
cccauuucuuuuuuaaaugaagaaagugaaguaggccgggcacgguggcucacgccuguaaucc

SEQ ID NO: 357843 - RNA, 64 nt, Human
cgucucuacuaaaaauacaaaaaauaaaaaauuagccgggcauggugacgggcaccuguagucc

SEQ ID NO: 357844 - RNA, 64 nt, Human
gauaguuaaaagacugcagcugcugaaguucugagccgggcaagucgagagggcuguuggacag

SEQ ID NO: 357845 - RNA, 50 nt, Human
gugacaagccgaggcggugagccgggcaggaggaaggagccucccucagg

SEQ ID NO: 357846 - RNA, 64 nt, Human
gcagcucucuguaccgggcggggggcgccuacgggccgggcacucccgagcugcugcucgaggg

SEQ ID NO: 357847 - RNA, 64 nt, Human
aauacucccuuccacccaucccagccccugggcagccgggcagaagggaauccaggcuauggac

SEQ ID NO: 357848 - RNA, 64 nt, Human
agcaggaaggggcauccacugcgggugacuggaggccgggcaggaagcaagucaucagagccgc

SEQ ID NO: 357849 - RNA, 64 nt, Human
uuuaacaugaacuaacauuucugcacuguaacgugccgggcacacacuaaacucaguuacugua

SEQ ID NO: 357850 - RNA, 64 nt, Human
uggcaugcaaccugcaaaagaaaaaugcgaagcggccgggcacgguggcucaugccuguaaucc

SEQ ID NO: 357851 - RNA, 64 nt, Human
aucugcacgccccguggugucacccucagccggcgccgggcacccuggacagugcggugggcga

SEQ ID NO: 357852 - RNA, 64 nt, Human
cucuugguaggguaaacauaaagaagauacacaggccgggcaugguggcucacaccuguaaucc

SEQ ID NO: 357853 - RNA, 64 nt, Human
uaaaaucccgucucuacuaaaauuauaaaaauuagccgggcaugauggugggcaccuguaaucc

SEQ ID NO: 357854 - RNA, 64 nt, Human
ucacuguugcuuugaaaaaucucauuauuucugggccgggcaugguggcucaccccuguaaucc

SEQ ID NO: 357855 - RNA, 64 nt, Human
ugagaguagccgucacgugucucuucccagcagcgccgggcaagugggugcuagagucugagcc

SEQ ID NO: 357856 - RNA, 64 nt, Human
guacuuucucuuuacucuauuaaaucuagaauuagccgggcauggucgcucaugccuguaaucc

SEQ ID NO: 357857 - RNA, 64 nt, Human
gggcuucugaucccuuuaagaaauuacagggccagccgggcaugguggcucacgcccguaaucc

SEQ ID NO: 357858 - RNA, 64 nt, Human
uggggcagcuuccccagcagccacggcuuugcgggccgggcagucgacuucggggcccagggac

SEQ ID NO: 357859 - RNA, 64 nt, Human
ugaaaccccgucucuacuaaaaauacaaaaauuagccgggcaugguggcaggcgccuauaaucc

SEQ ID NO: 357860 - RNA, 64 nt, Human
accucaucucuacuaaaauucaaaaacaaaauuagccgggcaugauggugcaugccuguagucu

SEQ ID NO: 357861 - RNA, 64 nt, Human
uaguguaauggaucaaauuaagauucucugcccagccgggcacaguggcgcaugccuguaaucc

SEQ ID NO: 357862 - RNA, 64 nt, Human
uucuaacucauauguucccaauuaccaagggguggccgggcacaguggcucacgccuguaaucc

SEQ ID NO: 357863 - RNA, 64 nt, Human
gacaaaauaaauucccgugaaguuccacaaccaggccgggcaugguggcucaugccuguaaucc

SEQ ID NO: 357864 - RNA, 64 nt, Human
uaaaauccugucucuacuaaaaauacaaaaaugagccgggcaugguggugcaugccuguaagcc

SEQ ID NO: 357865 - RNA, 64 nt, Human
caccgcaagagccauggcugucccuguuggcccagccgggcacucacagggcagaagggugggu

SEQ ID NO: 357866 - RNA, 64 nt, Human
agcagacacaguguucauaacaaagaaagguugugccgggcacgguggcucacaccuguaaucc

SEQ ID NO: 357867 - RNA, 64 nt, Human
cgaaaccccaucucuacgaaaaauagaaauauuagccgggcauggugucaggcaccuguaaucc

SEQ ID NO: 357868 - RNA, 64 nt, Human
gcaguaauaaacucuguuacagaagagaaaaagggccgggcacaguggcuuauuccuguaaucc

SEQ ID NO: 357869 - RNA, 64 nt, Human
cuuacaugcuuauaaaaguaaaggagaauaacuggccgggcacgguggcucaugccuauaaaau

SEQ ID NO: 357870 - RNA, 64 nt, Human
auacacacacuucaagagaauaugcacagucuaggccgggcacgguggcucacgccuguaaucc

SEQ ID NO: 357871 - RNA, 62 nt, Human
ugaaggguauccauguguaggaucacagcgcugccgggcaacagaaguuaccaacagcagua

SEQ ID NO: 357872 - RNA, 64 nt, Human
ucaugcuuaacacaguagugaaaauagaagguaggccgggcacaguggcucaugccuguaaucc

SEQ ID NO: 357873 - RNA, 64 nt, Human
uuuuauuguuauuuuauagaaaugcuuuuuguuggccgggcacaguugcucauccauguaaucc

SEQ ID NO: 357874 - RNA, 64 nt, Human
aucaaaugaauuaauaucacuguauuaaaagucugccgggcacaguggcucacgccuguaaucc

SEQ ID NO: 357875 - RNA, 64 nt, Human
ggacguuggccucagggccaggaaggacagacuggccgggcaggcgugacucagcagccugcgc

SEQ ID NO: 357876 - RNA, 64 nt, Human
acugaaaccaagauucccaacguuuuucauagcagccgggcacacuuuggugaccccaacgaga

SEQ ID NO: 357877 - RNA, 64 nt, Human
ggaaaccccgucucuacuaaaaauacaaaaauuagccgggcaugguggugggcgccuguaaucc

SEQ ID NO: 357878 - RNA, 64 nt, Human
cugccuuuuccccuuguccuuauuuagcgaugccgccgggcauuuaacacccaccuggacuuca

SEQ ID NO: 357879 - RNA, 64 nt, Human
cguggcugccgugugcgcuucugagcuggaagaggccgggcauuggugguccccaggcugggcc

SEQ ID NO: 357880 - RNA, 64 nt, Human
uucauccugaaguuugcauuaauaauccuuccaggccgggcacaguggcucacgccuguaaucc

SEQ ID NO: 357881 - RNA, 64 nt, Human
ccgcgucccacucccgugcucgccucgaccccgcgccgggcaccuguggcuugggacagauaga

SEQ ID NO: 357882 - RNA, 64 nt, Human
ucggccauucccuccaccuccaagacagguggcggccgggcaggcacucuuaagcccaccuccc

SEQ ID NO: 357883 - RNA, 64 nt, Human
caaaaccccuuauuuacuaaaaauacaaaaauuagccgggcaugguggcaugugccuguauucc

SEQ ID NO: 357884 - RNA, 64 nt, Human
cagggaacauccuggacuuaaaaagccagggcaggccgggcacaguggcucacgccuguaaucc

SEQ ID NO: 357885 - RNA, 64 nt, Human
aggaaucuggugcccugaaaggcccagccggacugccgggcauuggggccguuuguuaagcggc

SEQ ID NO: 357886 - RNA, 64 nt, Human
gugggcucccguguuuuguaggagacuugccagagccgggcacauugagcugugcaacgccgug

SEQ ID NO: 357887 - RNA, 64 nt, Human
ccucauuauucuuguuuuaaaagaaagaaaacaggccgggcacaguggcucaugccuguaaucc

SEQ ID NO: 357888 - RNA, 64 nt, Human
ugaaacccugucucuacuaaaaauacaaaaauuagccgggcaugguggugcacaucgguagucc

SEQ ID NO: 357889 - RNA, 64 nt, Human
agccuugggaagcacgggcgacuggacagcagccgccgggcacgguuaugggggcggggugggc

SEQ ID NO: 357890 - RNA, 64 nt, Human
gagaggaggggugauggcaggggaguggaggguggccgggcagguccugccggcgcagggagcc

SEQ ID NO: 357891 - RNA, 64 nt, Human
ccgagguccggcccaucccaguccuguggggcuggccgggcagagaccccggacccaggcccag

SEQ ID NO: 357892 - RNA, 64 nt, Human
agauucagaagccaugaguucaguuagcucaugggccgggcacgugcacugacucacuggcugc

SEQ ID NO: 357893 - RNA, 64 nt, Human
aagaggggaggucaaaauaaagacccaaucugaggccgggcacgguggcucacgccgguaaucc

SEQ ID NO: 357894 - RNA, 64 nt, Human
uguugcuagcucagguggcugacacaugggguaugccgggcacugggcaggucccagagccggg

SEQ ID NO: 357895 - RNA, 50 nt, Human
cccugcgugccugcugcugagccgggcacccccggacgccccccggccug

SEQ ID NO: 357896 - RNA, 64 nt, Human
gcggacccgcccucccuccgcuccugcuguugcugccgggcagugaggcccagcccagcgcccc

SEQ ID NO: 357897 - RNA, 64 nt, Human
cauuuugguauaagaaauuuguguuauuugauaggccgggcaugguggcucaugccuguaaucc

SEQ ID NO: 357898 - RNA, 64 nt, Human
gcucuugccaccuccagcugccaaacagcagccugccgggcagggagcagccccaggccagaga

SEQ ID NO: 357899 - RNA, 64 nt, Human
agguggcccugugggcaccuggugccugcccccugccgggcagcuuuaaggacagacccccagg

SEQ ID NO: 357900 - RNA, 64 nt, Human
uccuguagcuaugccagcggggcugggcaggccagccgggcauccugaccgaugggcacccucu

SEQ ID NO: 357901 - RNA, 64 nt, Human
accgggagggcugcugggagccucuccuguccccgccgggcagugucacugaguccuugaaauc

SEQ ID NO: 357902 - RNA, 64 nt, Human
acagcaaauuauauuuuagaaaauacuuugugaggccgggcaugguggcagagcgagacuccgu

SEQ ID NO: 357903 - RNA, 64 nt, Human
agcuggucucugggcugggggcccccgggccugggccgggcaggcuggaccauacccccagucc

SEQ ID NO: 357904 - RNA, 64 nt, Human
cccucucucucggaaucugaagagccagauuuaggccgggcaaaggggcucaccccuauaaucc

SEQ ID NO: 357905 - RNA, 64 nt, Human
agguucaaagaccguuaacaaaaaaguaagucuggccgggcaugguggcucaagccuguaaucc

SEQ ID NO: 357906 - RNA, 64 nt, Human
ugaaaccccgucucuacuaaaaauacaaaaauuagccgggcauggugguggguaccuguagucc

SEQ ID NO: 357907 - RNA, 64 nt, Human
auuuauugagcaucuauuaugugccaggcacugugccgggcacuggggauauacacaaagccau

SEQ ID NO: 357908 - RNA, 64 nt, Human
agaucaguuuucucuuaauaugucaaggaagguagccgggcauggugccaggcaccuguaggaa

SEQ ID NO: 357909 - RNA, 64 nt, Human
auuugucugucucuuuuuuuuaaaaaaaaaaaaggccgggcacuguggcucacgccuguaaucc

SEQ ID NO: 357910 - RNA, 64 nt, Human
ccagcugugcacuuugcccaaguggugaaggaaugccgggcaguggucauugcgggggguacca

SEQ ID NO: 357911 - RNA, 64 nt, Human
cgaaagcuuacugagccccgggccccaagcacgggccgggcauagauuuccucuuccacaagcu

SEQ ID NO: 357912 - RNA, 64 nt, Human
uauuaaaaauacaaaaaaaaaaaaaaaaaaaauagccgggcaugguggcgcaagccuguaaucc

SEQ ID NO: 357913 - RNA, 64 nt, Human
auuugagaaauggcuucuuugcagagcuggggaagccgggcagaagaugccgcagccuccuacu

SEQ ID NO: 357914 - RNA, 64 nt, Human
gcccagcgggagagacacccccauccccacgcgggccgggcacgaccacaccgggcggaccgcu

SEQ ID NO: 357915 - RNA, 64 nt, Human
ccgccucagcgccacacaucgccgggacacccgcgccgggcagccccgccggccgcccucacgc

SEQ ID NO: 357916 - RNA, 64 nt, Human
uagagagaaauaaacgcaguaaugcaugaagagugccgggcauggugcugagcccuguuccugc

SEQ ID NO: 357917 - RNA, 64 nt, Human
caacaccccauuucuacuaauaaucaaaaaauuggccgggcaugguggcaugugccuguagucc

SEQ ID NO: 357918 - RNA, 64 nt, Human
ugaaacccugucucuacuaaaaauacaaaaauuagccgggcaugguggcacaugccuguaaucc

SEQ ID NO: 357919 - RNA, 64 nt, Human
aaaugaggacgugcagcagcauuggaaggcuggggccgggcaggccaggccaagccaagcaggg

SEQ ID NO: 357920 - RNA, 64 nt, Human
aaaaccccaucucuacaaaaaauacaaaaaguaggccgggcacggugguucacaccuguaaucc

SEQ ID NO: 357921 - RNA, 64 nt, Human
cggcuuuuggcagucuacgcacuccccagcuggggccgggcagagcuggcacugucacugcugc

SEQ ID NO: 357922 - RNA, 64 nt, Human
aguggucuccggaggccucccagaaccaaggguagccgggcagcugguuuggcccagggccucc

SEQ ID NO: 357923 - RNA, 64 nt, Human
cugcccaccgcacccuccguucauccccugcccugccgggcaccucgcucuaccccaggaaaau

SEQ ID NO: 357924 - RNA, 64 nt, Human
gagacagcccuuuucucagaacuacccagaggaggccgggcaugguggcucacgcuuguaaucc

SEQ ID NO: 357925 - RNA, 64 nt, Human
ugcgcaagcacauggaaaagagaaacgagauugggccgggcacgguggcucaugccuggaaucu

SEQ ID NO: 357926 - RNA, 64 nt, Human
guguccugcccacccuaccagcuccuccagcccugccgggcacaugcccgggggacgccugccc

SEQ ID NO: 357927 - RNA, 64 nt, Human
cagccucaccugccgcucaggccucagaggcccugccgggcaccagggcuugugccaucgcccc

SEQ ID NO: 357928 - RNA, 64 nt, Human
acuucugcagcuaugcgcaauguggcauuggggggccgggcagguccugcccauguguccccuc

SEQ ID NO: 357929 - RNA, 64 nt, Human
accucgggcacaucgcaugcacucagagcacagagccgggcagacgcagcaccugcauggggag

SEQ ID NO: 357930 - RNA, 64 nt, Human
cagaagcccaaaucuuguaaaaguuccuuucugggccgggcacaguggcucacgccuguaaucc

SEQ ID NO: 357931 - RNA, 64 nt, Human
agcuaaugaaaauauacuuaaaaguauuucuuaggccgggcaugguggcucacaccuguaaucc

SEQ ID NO: 357932 - RNA, 64 nt, Human
gagaaaccccgucucuacuaaaaauacaaaauuagccgggcauugugguggugcaugccuguaa

SEQ ID NO: 357933 - RNA, 64 nt, Human
aaugugaugcuugauauaauaauuacuuaauguggccgggcacgguggcucacaccuguaaucc

SEQ ID NO: 357934 - RNA, 64 nt, Human
cgaaacccugucucuacuaaaaauaaaaaaauuagccgggcaugguagugcacgccuguaaucc

SEQ ID NO: 357935 - RNA, 64 nt, Human
ccuagcuaucaugauacgaggcgaaugggugacggccgggcaggagcaggcaugauaacccaac

SEQ ID NO: 357936 - RNA, 64 nt, Human
uaggggaaaaagcaaauaaaaauaguaaaauuuggccgggcacaguggcucacgccuguaaucc

SEQ ID NO: 357937 - RNA, 64 nt, Human
ugaggccggggcggggggcagggacccccgggcggccgggcaggggaaggggccuggccgccac

SEQ ID NO: 357938 - RNA, 64 nt, Human
uugagaucaccuguuuggcagguccuggacuggggccgggcaggcaggggcagggaggcgcccc

SEQ ID NO: 357939 - RNA, 64 nt, Human
caguaaccccugggggcucugaccaccuaugggggccgggcaggagccucuggggccuccacuc

SEQ ID NO: 357940 - RNA, 64 nt, Human
gggugggcaccaguucucagcaccgcucacugcugccgggcacacugggaccagcaggcuccuc

SEQ ID NO: 357941 - RNA, 64 nt, Human
cugccccgugggcauagguggacaggcucuggcagccgggcagugcccuccccgucccaugcuc

SEQ ID NO: 357942 - RNA, 64 nt, Human
ggucaucgucuagcaugaggucugcgggguccuggccgggcagggacagggcagaggacucuga

SEQ ID NO: 357943 - RNA, 64 nt, Human
acccccagaauaaauaugcucagccacccugugggccgggcaauccagacagcaggcauaaggc

SEQ ID NO: 357944 - RNA, 64 nt, Human
aggggucagcaaaugucagaaguuaccugggacagccgggcacgauggcucacaccuguaaucc

SEQ ID NO: 357945 - RNA, 64 nt, Human
uccggaaauccuaucaaggucucauuugcuacucgccgggcagacuuuaaucggggugguggca

SEQ ID NO: 357946 - RNA, 64 nt, Human
gugccuuguucacuucuguugaaccccucguacugccgggcauuuauuauacuacuuccuguca

SEQ ID NO: 357947 - RNA, 64 nt, Human
cucaggaugggcgcgucugggcgcggcgcgagcggccgggcagggcccugcagaagcacaacuc

SEQ ID NO: 357948 - RNA, 64 nt, Human
gcucugcuccuuagggcaugguagucaccgcgaagccgggcaccgucccacagcaucuccuaga

SEQ ID NO: 357949 - RNA, 64 nt, Human
uacucuggaguucacuuucccagagcuggggcaggccgggcagucugcgggcaagcuccggggu

SEQ ID NO: 357950 - RNA, 64 nt, Human
cccacaugcaugcaggccaagacagcaaaugccagccgggcacgacgcccgugugcccaggccu

SEQ ID NO: 357951 - RNA, 64 nt, Human
gagaugacauucuuccacacgagacggggcuucagccgggcauggucccucucaaguaucuccu

SEQ ID NO: 357952 - RNA, 64 nt, Human
uguauuuaaaaaaauaaaaauagaagaagaaaaggccgggcaugguggcucaugccuguaaucc

SEQ ID NO: 357953 - RNA, 64 nt, Human
agcauuucaugugguccucauaaaaaucuugagggccgggcaugguggcucacgccuguaaucu

SEQ ID NO: 357954 - RNA, 64 nt, Human
ugaaacccugucucuccuaaaaauacaaaaauuagccgggcaugguggaaugugccuguaaucc

SEQ ID NO: 357955 - RNA, 64 nt, Human
ccaugcccacagccacagccacagcugaggaguggccgggcaggcagcaggcuccccagccagg

SEQ ID NO: 357956 - RNA, 64 nt, Human
ucuaacacauuucaaggauagaaaauacuucacugccgggcaugguggcucaugccuauaaucc

SEQ ID NO: 357957 - RNA, 64 nt, Human
gcucauaugcgucccaagcagccgcagcgcagccgccgggcaggccugcgugccgggagaggac

SEQ ID NO: 357958 - RNA, 64 nt, Human
gcaggcucagacucugggucccucggagcugccagccgggcacccccaaccucauggucaugga

SEQ ID NO: 357959 - RNA, 64 nt, Human
gcccuggaugcccaggaaucuguauauauuuauggccgggcaggguguggggccaugccuccuc

SEQ ID NO: 357960 - RNA, 64 nt, Human
ugaaacccugucucuacuaaaaaugcaaaaacuagccgggcaugguggcgcacaccuguaaucc

SEQ ID NO: 357961 - RNA, 64 nt, Human
agcuugggggccugggcaggggcccgcuuggcgggccgggcaacacgucaacauucuuuucugu

SEQ ID NO: 357962 - RNA, 64 nt, Human
auccgccuccuggcauagacugaggcaggagcuggccgggcaagggugggaagacaucugcggg

SEQ ID NO: 357963 - RNA, 64 nt, Human
ugcugauaacaaauguucugaaagaaguaaacuagccgggcacaguggcgugcgccuguagucc

SEQ ID NO: 357964 - RNA, 64 nt, Human
uugcucgucaggguguucgacucugggaugcugggccgggcagacauuuaugcucugagcagca

SEQ ID NO: 357965 - RNA, 64 nt, Human
auuuuccuucccuuucuugaagaacaaaaagaaagccgggcaugacggcucaugccuguaaucc

SEQ ID NO: 357966 - RNA, 64 nt, Human
aggugaccucaaaaauuaaaaguauaauuauucggccgggcaugguggcucacaccuguaauuc

SEQ ID NO: 357967 - RNA, 64 nt, Human
cugcgagguuucuucucaucaccagcucagcuaggccgggcagacaaggacagaagacucuggg

SEQ ID NO: 357968 - RNA, 64 nt, Human
gcuuggggccaucgguccugucuccccucugcuggccgggcacagcuguggugagguugggcag

SEQ ID NO: 357969 - RNA, 64 nt, Human
ugaggcucaaggaaggugguccucagcucggcuggccgggcagccccuccuccgcuguggcccg

SEQ ID NO: 357970 - RNA, 64 nt, Human
caccguggaggucauuguggucaaccaggucaaugccgggcaccuguucgugcagcagcacaca

SEQ ID NO: 357971 - RNA, 64 nt, Human
gagaaacuccgccucuaguaaaaauacaaaauuagccgggcaugguggugcacgccucuaaucc

SEQ ID NO: 357972 - RNA, 64 nt, Human
cuggccaaaugucagauacuaaagcccauucuuggccgggcauguuggcucccgccuguaaucc

SEQ ID NO: 357973 - RNA, 64 nt, Human
aggcuuaccacaacggaagagaccucccgcuggggccgggcaggccuggcucagcugccacagg

SEQ ID NO: 357974 - RNA, 64 nt, Human
ggccccaagccaguguggggucucccacagcugugccgggcagggggccugccccgccauccug

SEQ ID NO: 357975 - RNA, 64 nt, Human
agcauagccuuucuguauuuaagaaacuuaagcagccgggcaugguggcucacgccuguaaucc

SEQ ID NO: 357976 - RNA, 64 nt, Human
auucagcgaagucucaugggaagcaggaccuagagccgggcacagcccucagcgucagacagca

SEQ ID NO: 357977 - RNA, 51 nt, Human
ccgugcugaagaggaggugaugccgggcacgggcgcuccugcugccgucuc

SEQ ID NO: 357978 - RNA, 64 nt, Human
caaaaccccgucucuacuaaaaauacaaaaauuagccgggcaugguggugugcgccuguaaucc

SEQ ID NO: 357979 - RNA, 64 nt, Human
cagccacccguggggugcugcccuuaugcccggcgccgggcaccaacuccauguuugguguuug

SEQ ID NO: 357980 - RNA, 64 nt, Human
aauaauuauuauuuuuaaaaauuuuuauuuguuggccgggcaugguggcucacgccugaaaucc

SEQ ID NO: 357981 - RNA, 64 nt, Human
cgcugcagggacacccacgcccuucucuccagaagccgggcaggcagaauccggccagacgacg

SEQ ID NO: 357982 - RNA, 64 nt, Human
cgaaauaagccucauccuuaaagagaagucaccggccgggcacgguggcucacgccuguaaucc

SEQ ID NO: 357983 - RNA, 64 nt, Human
gggugcucagaacccugcagcucccacuucuuuagccgggcagcuguuugggggacaagagagg

SEQ ID NO: 357984 - RNA, 64 nt, Human
aaagcacaaggucugcggaaaguucugguugucggccgggcaccacggcucacaccuauaaucg

SEQ ID NO: 357985 - RNA, 64 nt, Human
acuguaaagcuguacccuuaaaaguacagauguggccgggcacaguggcucacaccuguaaucc

SEQ ID NO: 357986 - RNA, 64 nt, Human
uggacuucucugcaugucgggcuuaaggucaccagccgggcaggguggaaggagcuugccucuu

SEQ ID NO: 357987 - RNA, 64 nt, Human
accacgccccaggaccuccggagcgcccugcagggccgggcagggggacagcagggaccgggcg

SEQ ID NO: 357988 - RNA, 64 nt, Human
gcgggcgguuccccaguggggugcccuggaggcugccgggcagaguggagcagcuuggggccgu

SEQ ID NO: 357989 - RNA, 64 nt, Human
ccacuggggggaaagggagacacagcggaccccggccgggcagcggagaccgcagaggcgggca

SEQ ID NO: 357990 - RNA, 54 nt, Human
ucuucaccaggauccgguaaaccugccgggcaggaccgugccacaccagcuguc

SEQ ID NO: 357991 - RNA, 64 nt, Human
cgaaaccccgucucuaauaaaaauacaaaaauuagccgggcaugguggugcaugccuguaaucc

SEQ ID NO: 357992 - RNA, 64 nt, Human
ugggcuggaguccuugcuuugcugcugcugagcugccgggcaaccucagaugaccgacuuuucc

SEQ ID NO: 357993 - RNA, 64 nt, Human
cugaggcucacgguacagaggccugcccugccuggccgggcaggagguucucacuguugugaag

SEQ ID NO: 357994 - RNA, 64 nt, Human
cugugacugguauuuauuggacccagagaaccgggccgggcacagcguggcuacagagggucuc

SEQ ID NO: 357995 - RNA, 64 nt, Human
ucuuucccacacaccugaagagcacugacugugugccgggcacuagugauacaaaagaguguga

SEQ ID NO: 357996 - RNA, 64 nt, Human
gaaacccgaucucuacuaaaaaauauaaaaauuagccgggcaugguggcacaugccuauagucc

SEQ ID NO: 357997 - RNA, 64 nt, Human
uaugcauacauuccuugagugacuaugaaugacugccgggcaguaacuucugggcugugguugu

SEQ ID NO: 357998 - RNA, 64 nt, Human
aagacccacucacaauaaaaaaauaaaaggccgagccgggcaugguugcucacucccguaauaa

SEQ ID NO: 357999 - RNA, 64 nt, Human
gaaaccucgucucuacuaaaaauacaaaaacuuagccgggcaugguggugggcaccuguagucu

SEQ ID NO: 358000 - RNA, 64 nt, Human
acuaucgcugagaucauuaucagaaaauagucuggccgggcaugguguaauccuaacacuuugg

SEQ ID NO: 358001 - RNA, 64 nt, Human
gcaaaacugucucuauuaaaaauacaggccaggggccgggcacggugccucacaccuguaaucc

SEQ ID NO: 358002 - RNA, 64 nt, Human
accccgucucuacuaaaaauacaaaaaaaaaugagccgggcaugguagcaggugucuguuaucc

SEQ ID NO: 358003 - RNA, 64 nt, Human
ugaaaccccaucucuacuaaaaauacagaaauuagccgggcauggugucgcgugccuguagucc

SEQ ID NO: 358004 - RNA, 64 nt, Human
ucagagaauucacaguggaaauaucuaagguagggccgggcaugguggcucacgccuguaaugc

SEQ ID NO: 358005 - RNA, 64 nt, Human
uggaaugcagcugucaggccugaagguguccacagccgggcagguggucacugagggccaugac

SEQ ID NO: 358006 - RNA, 64 nt, Human
gaggggaaaaaaaucuuuuaaaacuuggcuguuggccgggcacgguggcucacgccuguaaucc

SEQ ID NO: 358007 - RNA, 64 nt, Human
ccugcccuggccgccacgcuggcugggguguagggccgggcagguggggcugaggugagggcag

SEQ ID NO: 358008 - RNA, 64 nt, Human
ugaaacccuaucucuacuaaaaauacaaaaauuagccgggcaugguggugcacgccuauagucc

SEQ ID NO: 358009 - RNA, 64 nt, Human
ugaaaccccaucucuacuaaaaauacaaaaauuagccgggcaugguggcgggcgccuaaaaucc

SEQ ID NO: 358010 - RNA, 64 nt, Human
gagcacuguggguaugggaagaaauucucuacuggccgggcacaguggcucacgccuguaaugc

SEQ ID NO: 358011 - RNA, 64 nt, Human
cgucucuacuaaaaaaaaaaauuacaaaaaauuagccgggcaugguagcaggugccuguagucc

SEQ ID NO: 358012 - RNA, 64 nt, Human
ccaccuuucagggagucucccagcaugggcggaugccgggcaugagcugcuguaaacuauuugu

SEQ ID NO: 358013 - RNA, 64 nt, Human
agcaggugaagggcaucgcugccccaggccucaagccgggcacccaacccuggaugccaccccc

SEQ ID NO: 358014 - RNA, 64 nt, Human
ugauuccuucauuguuuuaagaaguuaaccuagggccgggcaugguggcucauaccuguaaucc

SEQ ID NO: 358015 - RNA, 64 nt, Human
ggugugcuuguguucuuagaaaagccccagcauggccgggcaugguggcucaugccuauuaucc

SEQ ID NO: 358016 - RNA, 64 nt, Human
acggaauggccgccuggggagccuguguggcugugccgggcagccauccugcauucccacccag

SEQ ID NO: 358017 - RNA, 64 nt, Human
agggcccucaacuuccauccugcgggaggccuuggccgggcacugccagugucuuccagaguca

SEQ ID NO: 358018 - RNA, 64 nt, Human
gaauccuccugugaugaaacugaggaaucggguggccgggcaagcugggaagagcaaagccaga

SEQ ID NO: 358019 - RNA, 64 nt, Human
cuagugccgaggacacguuaaacgaacaggaugggccgggcacgguggcucacgccuguaaucc

SEQ ID NO: 358020 - RNA, 64 nt, Human
ugaaaccccaucuccacuaaaaauagaaaaauuagccgggcauggugacacaugccuguagucc

SEQ ID NO: 358021 - RNA, 64 nt, Human
ugaaaccccgucucugcugaaaauacaaaaauuagccgggcaugguggcgcgugccuguaaucc

SEQ ID NO: 358022 - RNA, 64 nt, Human
ugccuugcccuccauccuuccucuguuccuucuggccgggcaccacagcacuggggcucaccuc

SEQ ID NO: 358023 - RNA, 64 nt, Human
gaaaccccgucucuacuaaaaauacaaaaaauuagccgggcaugguggcgggcgccuguaguuc

SEQ ID NO: 358024 - RNA, 64 nt, Human
guccaccucaccccugcaccucucagccucugccgccgggcacccccccccaggcuccuggugc

SEQ ID NO: 358025 - RNA, 64 nt, Human
ucccacgcuaccgggcacgggcggccuccuauuggccgggcaccgcgcggcuagcggagguugc

SEQ ID NO: 358026 - RNA, 64 nt, Human
ugaaaccccaucucuacuaaaaauacgaaaauuagccgggcaugguggcgagugccuguaaucu

SEQ ID NO: 358027 - RNA, 64 nt, Human
cucagcccuuucccuuuucugaaagcuguuccuggccgggcaucccagggaagaaggaggggac

SEQ ID NO: 358028 - RNA, 64 nt, Human
ugaaacccugucucuacuaaaaauacaaaaauuagccgggcaugguggcgugcaccuguaaucc

SEQ ID NO: 358029 - RNA, 64 nt, Human
gaccccagagcagugcagccaccagggcagaaaugccgggcacaggccaggacaaaaugcagac

SEQ ID NO: 358030 - RNA, 64 nt, Human
cccaagagagugucagaaucuuaagagcugagaggccgggcacgguggcucacgccuguaaucc

SEQ ID NO: 358031 - RNA, 52 nt, Human
agcgcugcuucgucuucugagggccgggcacggucacacggccacccgcccc

SEQ ID NO: 358032 - RNA, 64 nt, Human
gacugggcccagaggcuggccagaguucaggaacgccgggcacagaccaaagaccgcgguccag

SEQ ID NO: 358033 - RNA, 64 nt, Human
aguccucggcagcuccggaaggacacagucaggggccgggcaaacacuuuggccacagccccaa

SEQ ID NO: 358034 - RNA, 64 nt, Human
ugaaacccugucucuacuaaaaauacaaaaauuagccgggcaugguggcaggcaccuguaaucc

SEQ ID NO: 358035 - RNA, 64 nt, Human
ccggcugccccugcccuccaucacagacagcagagccgggcagcuuucuuaugccauuuucuac

SEQ ID NO: 358036 - RNA, 64 nt, Human
caccgugugccuuucccgggcccucagcccucgggccgggcaccacccccaguccccccaguaa

SEQ ID NO: 358037 - RNA, 64 nt, Human
ugagaccucaucucuacaaaauacaaaaaaauuagccgggcaugguggcacgugaguguagucu

SEQ ID NO: 358038 - RNA, 64 nt, Human
uuucuuugccaucucugcuccaaccgggaugggagccgggcaaacuggccgcgggggcagggga

SEQ ID NO: 358039 - RNA, 64 nt, Human
aggacaaggugcaggcaggcuggccuggggucaggccgggcagagcacagcggggugagaggga

SEQ ID NO: 358040 - RNA, 64 nt, Human
ccgccgcacccugcaccuuggaccggcauccguagccauggacagaggucccuggucuucccuc

SEQ ID NO: 358041 - RNA, 64 nt, Human
uuuuagcagcccacaggugauccuaacauaucaggccauggacucaggaccugcccggugaugc

SEQ ID NO: 358042 - RNA, 64 nt, Human
ugaucaagcaggggccggacuugggggaaauguugccauggauucgaugggacuuuggggaccu

SEQ ID NO: 358043 - RNA, 64 nt, Human
uggcuucagacucggacuugaaugcugcccgguugccauggagaucugaaggggcgggguuaga

SEQ ID NO: 358044 - RNA, 64 nt, Human
ggcagugcccagggagggguuauuugucuucccugccauggagugggaauccccagccgaggcc

SEQ ID NO: 358045 - RNA, 64 nt, Human
gagaugacugggcuggggaagcaggugcuugcuggccauggagccucauugcaaguuguucuug

SEQ ID NO: 358046 - RNA, 64 nt, Human
ccagcugaucccagucacugcuugcuggggccaugccauggaagcuucccaucagucucccagc

SEQ ID NO: 358047 - RNA, 64 nt, Human
cugaccccagagcucuguguauuugcauccagaggccauggaaacauucuuugcauuuaagaga

SEQ ID NO: 358048 - RNA, 64 nt, Human
ggugguccagaagcuucgggcaccacgcacucaggccauggaggagcagcuggucagcaccuug

SEQ ID NO: 358049 - RNA, 64 nt, Human
cugcccuaugaccugccuuuggcauguuacccaagccauggagagagccccuucuccaucccug

SEQ ID NO: 358050 - RNA, 64 nt, Human
uaaaauaugggaagggagaacccccaauaaaacugccauggacuggacucuauucauucauuca

SEQ ID NO: 358051 - RNA, 64 nt, Human
ucuauuuucuggugcugcccagccagugccuucugccauggauguuacuggcuacuugagaaaa

SEQ ID NO: 358052 - RNA, 64 nt, Human
aacagaaguaaucugauuagucaaauuauuaagugccauggauuacuuuaugcagcagucaggu

SEQ ID NO: 358053 - RNA, 64 nt, Human
cuaaaguuccuuuaauguccuuuugagauuuugagccauggaacuuacuuguucaccuggcuaa

SEQ ID NO: 358054 - RNA, 64 nt, Human
aauggucacagagcacuguagcacuuaacagauugccauggacaccaguugcgaagggaaauag

SEQ ID NO: 358055 - RNA, 64 nt, Human
caagaucuggaacuaacgccaguagcauguggaugccauggagacuggaagaccauuccaacuu

SEQ ID NO: 358056 - RNA, 64 nt, Human
uugguuucccauugguucaccugugacuccuguugccauggauucaccccccucugcugccggc

SEQ ID NO: 358057 - RNA, 64 nt, Human
ccuggggucucugcugcauuugugucaucuuguugccauggaguugugaucaucccaucuaagc

SEQ ID NO: 358058 - RNA, 64 nt, Human
cuggccgagaguccaggccuugccucccccgaccgccauggagggggcagcccggcacagcugc

SEQ ID NO: 358059 - RNA, 64 nt, Human
auauuuuuaugagaauuuaaacuuagcaagaauggccauggaggcaaagccuucacccagaccc

SEQ ID NO: 358060 - RNA, 64 nt, Human
uggaaucucuuccacgggaccagcccagagcuaugccauggaaaugauauuggauguugguaag

SEQ ID NO: 358061 - RNA, 64 nt, Human
ucuugagggucaaaaaaaaauacuuaggaagcuagccauggaagcuucuugccucugacccagc

SEQ ID NO: 358062 - RNA, 64 nt, Human
gcuacccucaucaucuuacucaucuuaagcccgagccauggaucaacuaggagcccauauaaau

SEQ ID NO: 358063 - RNA, 64 nt, Human
acucugcucauguucaggugcagcugaaucuaucgccauggauucauucuuucaauuacucauc

SEQ ID NO: 358064 - RNA, 64 nt, Human
cagaccgacccugaagcagaacucuugacuuccugccauggaucucuugggcccaggacuguug

SEQ ID NO: 358065 - RNA, 64 nt, Human
gguggugaggaagaggaagggaggggcaggaugggccauggaggugccccacccccacaccuga

SEQ ID NO: 358066 - RNA, 64 nt, Human
aaauuauuuuaauuuuuuuuuuauccuuuacaaagccauggauuuuauuugguugaugugugcu

SEQ ID NO: 358067 - RNA, 64 nt, Human
uacuaggauacugcugcgucauuacagggcacaggccauggauggaaaacgcucucuacucugc

SEQ ID NO: 358068 - RNA, 64 nt, Human
uucccugcccuuccuuugguugccauauggaauggccauggaaugcacgaagucacaaugcacc

SEQ ID NO: 358069 - RNA, 64 nt, Human
ucucuuugagcaucucucuucauuccuggaaugagccauggacaguaaaguugugugggaaaag

SEQ ID NO: 358070 - RNA, 64 nt, Human
ucuggauaguaccugcaggaacaauauuccuguagccauggaagagggccaaggcucagucacu

SEQ ID NO: 358071 - RNA, 64 nt, Human
gcggcuucacccuucguaaccaggagacaaggcggccauggauuugcccuugauucuauuuugc

SEQ ID NO: 358072 - RNA, 64 nt, Human
ggucgugaaagcucuccuaauacuuacuuaaauagccauggaagaaaauuaugcuugucccuuc

SEQ ID NO: 358073 - RNA, 64 nt, Human
guuaacagaagggagggcagagcuggugcggcuggccauggagaaagcugacuuggcuggugug

SEQ ID NO: 358074 - RNA, 64 nt, Human
ccgucccaggcagccagcaccaugggcaggcccugccauggacagaaaaagaguuuuucucuug

SEQ ID NO: 358075 - RNA, 64 nt, Human
uucaaccaaauggcgaagucagagacuaucgggggccauggagacacucugggccauuuuuaug

SEQ ID NO: 358076 - RNA, 64 nt, Human
ucccuuccugcuguguuauagaacuguaggggaggccauggaaaugacucuaaagauacaaaau

SEQ ID NO: 358077 - RNA, 64 nt, Human
ugugagauuugucuuacuuauuuuucuuuugguugccauggaaguuauggcccugaaaaucguc

SEQ ID NO: 358078 - RNA, 64 nt, Human
acagcagauguugcaaacuuucauaccacugcuggccauggaagccucuuaacaacacacuguc

SEQ ID NO: 358079 - RNA, 64 nt, Human
ucaguuugacagaagugugauauauguaacuugugccauggaccaaauggucacuuuaccacag

SEQ ID NO: 358080 - RNA, 64 nt, Human
gagugagcaguuuccuaccccguggaucuagcaagccauggagacagguagcauuuguaagaug

SEQ ID NO: 358081 - RNA, 64 nt, Human
aauuguuuggucucugguuuucauccuuagagaagccauggagaacagacuugaaaaguuuagg

SEQ ID NO: 358082 - RNA, 64 nt, Human
cgaugggcccaauucuuacaaacaugugguuaaugccauggacagaagaaggcagcagguggca

SEQ ID NO: 358083 - RNA, 64 nt, Human
uccucaucuguaaaauggagacaccaccacccuugccauggagguuaagcacuuuaacacagug

SEQ ID NO: 358084 - RNA, 52 nt, Human
agagcaucacugccagcuagccgccauggaugcagcagccugaaacuugaga

SEQ ID NO: 358085 - RNA, 64 nt, Human
gucgucauccccggagucccuauacagagguccugccauggaaccuuccccuccccgugcgcuc

SEQ ID NO: 358086 - RNA, 64 nt, Human
gcugucacccccggagucgccacacagacguccugccauggaaccuuccccucccggugcaccc

SEQ ID NO: 358087 - RNA, 64 nt, Human
augaaauaaguaauuuauuguaagacaacaucaagccauggaaacuuggcagaagauucaaagc

SEQ ID NO: 358088 - RNA, 64 nt, Human
gucaauauucagucaccaauucugcucacuucuugccauggauaaaauugggucuuucuggcua

SEQ ID NO: 358089 - RNA, 64 nt, Human
ucugaguccacaugugugcaguugucuucugccagccauggauuccaggcuauauauuucuuuu

SEQ ID NO: 358090 - RNA, 64 nt, Human
cuucuggagaaguggccaucccaugcccaccugugccauggaggagugggcccugccagcugcc

SEQ ID NO: 358091 - RNA, 64 nt, Human
aaaaaucaagagaagccuggaagacaucauggaugccauggauuagcugugcaacugaccagcu

SEQ ID NO: 358092 - RNA, 64 nt, Human
cuuguuaaaaacguggcaacgguuacucuuaggugccauggaucgaugucaggguggucagcuc

SEQ ID NO: 358093 - RNA, 64 nt, Human
caucuagaaacuauaguucacaggacagagcagagccauggagacuaagcauugacuaccuuga

SEQ ID NO: 358094 - RNA, 64 nt, Human
ccaaacauuucuuugagaucuauauuuauaagcagccauggaauuccuauuaugggauguuggc

SEQ ID NO: 358095 - RNA, 64 nt, Human
uaaagauagaaucuuuuuucuuuuuugucauucugccauggagcagcauuacccuaauggauug

SEQ ID NO: 358096 - RNA, 64 nt, Human
gccugggagcugccuaaauucagaagccuccacugccauggagacugccuggcuguguccucuc

SEQ ID NO: 358097 - RNA, 64 nt, Human
gucucugaguauuacugagaagcaacagaaaagagccauggauggagcccuugggcucucuggg

SEQ ID NO: 358098 - RNA, 64 nt, Human
gguaaccauugccuguaagcagcacagaauuggugccauggauuaucuuuuccauguugaugga

SEQ ID NO: 358099 - RNA, 64 nt, Human
uugccaggggcuggaagcuggaggggucucuugggccauggacauccccacuuccagcccaugu

SEQ ID NO: 358100 - RNA, 64 nt, Human
cuaugcauauaaaucaaggaaccaaauaucuguagccauggaaaugucugacuagaaauauuua

SEQ ID NO: 358101 - RNA, 64 nt, Human
ccuuuuaaaggccugguucuaaguccuuuuuaaagccauggaacaaaaccugauacaucacccu

SEQ ID NO: 358102 - RNA, 64 nt, Human
acaaaagugaaaguaguuguucacaaaagaauucgccauggaauucuuucaguuaccaagcucu

SEQ ID NO: 358103 - RNA, 64 nt, Human
caccaugcccagucgauaucucacuuuuuauuuugccauggaugagaguccugggugugaggaa

SEQ ID NO: 358104 - RNA, 64 nt, Human
ucaugcuucuugaguugcuucaugguuuaugcucgccauggaaagcuaucaguaacaguuucau

SEQ ID NO: 358105 - RNA, 64 nt, Human
cagccacugugugcauuagcagggagguuuguaggccauggaggaaaugaggagacaccaccua

SEQ ID NO: 358106 - RNA, 64 nt, Human
uaagggaaaaaguuguaucaguaccauuugaucugccauggacaugaguuuaaagcggcuuucu

SEQ ID NO: 358107 - RNA, 64 nt, Human
acaguugcuaggcuucaaugccuaucgguagcaagccauggaaaaagaugugucagcuagguaa

SEQ ID NO: 358108 - RNA, 64 nt, Human
uaccuucugucugguuuccacugauuccuucuuagccauggagagcauuugugauuaauuaauu

SEQ ID NO: 358109 - RNA, 64 nt, Human
ggugagaugagugaugguccagcagugaacuugggccauggaugauguuaaggauagaagccac

SEQ ID NO: 358110 - RNA, 64 nt, Human
guuugacggugcaucagcaugccgcguuaggcucgccauggaaauacgcgcggggagcggccgc

SEQ ID NO: 358111 - RNA, 64 nt, Human
auuagaccuucggaaauagcgcuacuaguuggaagccauggaccgacuaugaauguguacauag

SEQ ID NO: 358112 - RNA, 64 nt, Human
ucaggcccagccccaauccauccccuuacuuucugccauggaguuccagcaggucacucucccu

SEQ ID NO: 358113 - RNA, 64 nt, Human
aauacagauuauuaugcccucuuugguacuauaugccauggaugugaauuucccauagaagcug

SEQ ID NO: 358114 - RNA, 64 nt, Human
ucucucucucucuuuuuuuuuucuuuuuccuuuugccauggaaucugggugggagaggauacug

SEQ ID NO: 358115 - RNA, 64 nt, Human
gaaaauuauuuuaaaagaugaaagagggaaauaggccauggacgguggcucacgccuguaaucc

SEQ ID NO: 358116 - RNA, 64 nt, Human
ucacagaaggcagcuacuuuauaagccccaaugggccauggagaccacugucagaaaugggaua

SEQ ID NO: 358117 - RNA, 64 nt, Human
agagacaugacucagccuguuccaugaaggcagagccauggaccacgcaggaagggccuacagc

SEQ ID NO: 358118 - RNA, 64 nt, Human
acucaacuaaauauugucuauaagaaacuucagugccauggacaugauuuaaacugaaaccucc

SEQ ID NO: 358119 - RNA, 64 nt, Human
gaagguugugcugguaagacaucucugacgaagagccauggaugcuuuccacaaaaugucaccu

SEQ ID NO: 358120 - RNA, 64 nt, Human
uauaaaucgugcaauaaccauaugcgacuauuuugccauggagaaaucugacagcauugcaaac

SEQ ID NO: 358121 - RNA, 64 nt, Human
guguggccuucucuugcaagagggagaagaaagagccauggagauaguagcagacaggcugccc

SEQ ID NO: 358122 - RNA, 64 nt, Human
agagcccugcccugcacccuuguacagugucugugccauggauuucguuuuucuugggguacuc

SEQ ID NO: 358123 - RNA, 64 nt, Human
ccugugccagaaucacugcucuauuccauaccgugccauggaggcuguuuuagaagugguugga

SEQ ID NO: 358124 - RNA, 64 nt, Human
augucugcuugugugcucaugaagacaugcccacgccauggagccaggggcuuauagagagggg

SEQ ID NO: 358125 - RNA, 64 nt, Human
ggcuuuuagagacccagacuugguuggcagcgcugccauggaacaccccagcaagcaccuccca

SEQ ID NO: 358126 - RNA, 64 nt, Human
aaagacacaaaauuauuuuuuuccagacuagugugccauggauuucugauaagaauuaacauuc

SEQ ID NO: 358127 - RNA, 64 nt, Human
uccuaagcuucaaaucagaagcagaaacuggcaggccauggaccuuaauugucccucagguaga

SEQ ID NO: 358128 - RNA, 64 nt, Human
ccuugagcucucuggacacugcagaggacccauggccauggaacccugaagaagcaugucuggc

SEQ ID NO: 358129 - RNA, 64 nt, Human
caacccaaguuuagaguuggcccccaccucccaugccauggacugagcagcaggggcccagcau

SEQ ID NO: 358130 - RNA, 64 nt, Human
uucagaauaaagcagaauguaaguuucaguugaggccauggauuugauuguuccauggcuggaa

SEQ ID NO: 358131 - RNA, 64 nt, Human
uguuacagaccuaguuacugggaauucauuacuugccauggacuaccuuugcuaagaaaagucu

SEQ ID NO: 358132 - RNA, 64 nt, Human
ccggggguggggggugggggugggucagaacccugccauggaacuguuuccuucaucaugaguu

SEQ ID NO: 358133 - RNA, 64 nt, Human
uguccucccucacccccuccuucauaugaaaggugccauggaagaggcuacagggccaaacgcu

SEQ ID NO: 358134 - RNA, 64 nt, Human
uggccuccucccuuagcucccuguucuuggaucugccauggagggaucuggugccuccagacgu

SEQ ID NO: 358135 - RNA, 64 nt, Human
guacaucuucagaguuucagucggcaauuucuuggccauggauguagaaccuacagauaaggug

SEQ ID NO: 358136 - RNA, 64 nt, Human
uaauuuucauuaccaaaauguacagcuauuauuugccauggaaaagguuagucucauuuagaaa

SEQ ID NO: 358137 - RNA, 64 nt, Human
cacaggccgcuucgcggguggagcccucugccuggccauggaggaaggaucccgcuaggcuggu

SEQ ID NO: 358138 - RNA, 57 nt, Human
gaaagauuuucagguuuuaauaaagcagccauggaggcuaagaacaugcaagaccaa

SEQ ID NO: 358139 - RNA, 64 nt, Human
aaaaguguauuuuauucaguaguuugaggaucuugccauggaagauacuagcccagccuagcag

SEQ ID NO: 358140 - RNA, 64 nt, Human
cacaguggaaggcagaggguuuacuacaggccaggccauggacaccccacccagguacugcagu

SEQ ID NO: 358141 - RNA, 64 nt, Human
gcagaaacacuucuuugcugacacuuacacuguugccauggaccuacauaagcagugggagaac

SEQ ID NO: 358142 - RNA, 64 nt, Human
ccacgaagccaggagagguagagugaaaaucccagccauggaugaauguacuaauuugaaagcc

SEQ ID NO: 358143 - RNA, 64 nt, Human
ucuccucuguccaggaggccgggaucaggcuguugccauggaaguucagggccauagacugccc

SEQ ID NO: 358144 - RNA, 64 nt, Human
ucauuuuauguuaagggaagaauuccaggguauggccauggaguguacaaguaugugggcagau

SEQ ID NO: 358145 - RNA, 64 nt, Human
ugaaccucgucagacauucauuccuuuggccauugccauggaugaaaccgagaucugcagucug

SEQ ID NO: 358146 - RNA, 64 nt, Human
guuagggacaucacacccugucucacgucgcagugccauggacgcagcaguuacagcaccauug

SEQ ID NO: 358147 - RNA, 64 nt, Human
uaaccaaaaagagaugacaaaacuaaguucaggggccauggaaaaugaaaaaguccgcuauauu

SEQ ID NO: 358148 - RNA, 64 nt, Human
ugaugaauugguuuuugaaucccagaaagggucugccauggaguuggcagucaucacgguagau

SEQ ID NO: 358149 - RNA, 64 nt, Human
aaggggcuuuuccuguugcauuauucuauggucugccauggacugugcacuuuauuugagggug

SEQ ID NO: 358150 - RNA, 64 nt, Human
guuucacucuuagaaauugaauuagcauaauugggccauggaacacauaugcuggaaaucuuug

SEQ ID NO: 358151 - RNA, 64 nt, Human
gaagccuccuuucauuucuaugggccaaacaaaggccauggauaacccuacccgcuuuauguca

SEQ ID NO: 358152 - RNA, 64 nt, Human
ucagggagggcuagggggcagguggggaggggaagccauggaaauacaagucaaaggggugaga

SEQ ID NO: 358153 - RNA, 64 nt, Human
aaugccaaagccauucucccccucuuugggcagugccauggauuuccacugcuucuuauggugg

SEQ ID NO: 358154 - RNA, 64 nt, Human
ucagugcaggucccugacucuuauuuucccagaggccauggagcugagauugagacuagccuug

SEQ ID NO: 358155 - RNA, 64 nt, Human
ugaacugaaccucuccaggcucuccuguugcuuugccauggagccaggucagcucucugucugu

SEQ ID NO: 358156 - RNA, 64 nt, Human
agcuagcuuauuucagccacuucuagcagaucaugccauggagcucacgacgugugaccauuuc

SEQ ID NO: 358157 - RNA, 64 nt, Human
gagcuguguuccaggaaccagaucacgauuuuuagccauggaacaauauaucccaugggagaag

SEQ ID NO: 358158 - RNA, 64 nt, Human
acccacccgcucccuuuuuuccuuagccuucagugccauggaacuaaucaagggaggaaaaggu

SEQ ID NO: 358159 - RNA, 64 nt, Human
agaugaaauaacuguccugucacaugugcagcaggccauggaguguagcgggcaucgcugccgc

SEQ ID NO: 358160 - RNA, 64 nt, Human
auucaaugacacucgaguucugguccaaucugaagccauggauuaaucucaaagaaucagucag

SEQ ID NO: 358161 - RNA, 64 nt, Human
uguuaaauggaauucguguuaugaaucugugcuggccauggacgaauaugaaugucacauuuga

SEQ ID NO: 358162 - RNA, 64 nt, Human
cccuuuucaguugggaagaaaggagagggguggcgccauggacguggcccuaaacgcuguggga

SEQ ID NO: 358163 - RNA, 64 nt, Human
aggugugguaaagccauuggaugaggaggggacugccauggaaaggagaguuuguuacuuacgg

SEQ ID NO: 358164 - RNA, 64 nt, Human
uuacugcucucaagcaguggccucucucacuuuagccauggaauggcuccgaucuaccucacag

SEQ ID NO: 358165 - RNA, 64 nt, Human
aaaaggagaagauaacugaggauuuuaaaaagaagccauggaaaaacuuccuaguaagcaucua

SEQ ID NO: 358166 - RNA, 64 nt, Human
uacacacuaacauuagcauuaacaggugauaguugccauggauauaauggaauuauggcuggac

SEQ ID NO: 358167 - RNA, 64 nt, Human
uagguggugaaauacuggccagagauuucaucaagccauggauucuugguuuggcgcuaucuuu

SEQ ID NO: 358168 - RNA, 64 nt, Human
aaagcagguggugagcuccugccugcuggagguugccauggagggccauuccugcccggcaaca

SEQ ID NO: 358169 - RNA, 64 nt, Human
uaaucaggaauggguuuuggugccugaaaaauuggccauggaggcacaccaaagcuucaagcac

SEQ ID NO: 358170 - RNA, 64 nt, Human
aagacuaauucucuuugauacugcagaggcaguggccauggaucuguuccucugugcuaaaugu

SEQ ID NO: 358171 - RNA, 64 nt, Human
aggcaugcccagguucaggucacuucggacaccugccauggacacuucacccacccuccaggac

SEQ ID NO: 358172 - RNA, 64 nt, Human
cacaacacgcagagaggacucaagacucccgcuggccauggaguggccugaaagagagcaagaa

SEQ ID NO: 358173 - RNA, 64 nt, Human
ccuguucugacuuuaagccagaacuuguggcugggccauggaagcugugacuccucuguggaca

SEQ ID NO: 358174 - RNA, 64 nt, Human
uuugaggccagugagggaaguggcugggcccuaggccauggagaaaaccuuaaacaaacccugg

SEQ ID NO: 358175 - RNA, 64 nt, Human
cuuccuucuuccugccacacucugcuuucuuccugccauggaccccuggaggagaccuauggag

SEQ ID NO: 358176 - RNA, 63 nt, Human
ugacagccaaacucugcuaacccgggacuccuugccauggacuuuuccuguuguuguacacac

SEQ ID NO: 358177 - RNA, 64 nt, Human
uaaaguacguggcauguguaggugaauuacaggggccauggauguggacaccauggagggggaa

SEQ ID NO: 358178 - RNA, 64 nt, Human
aucugugcuggcgcaggaugaagccacgcuccaggccauggacgagaagcugcggaaguggaag

SEQ ID NO: 358179 - RNA, 64 nt, Human
ggggggacugcaaaccgcucaggguugcggcagagccauggacuuccggucccugcaacgggug

SEQ ID NO: 358180 - RNA, 64 nt, Human
gcugccugaggagcugaccacggagcuggggguugccauggauggggacccaaagaccugcagc

SEQ ID NO: 358181 - RNA, 64 nt, Human
agccagagucuccaggacuccucacucaaccucggccauggacgcagguugggugugagggggg

SEQ ID NO: 358182 - RNA, 64 nt, Human
uuguuuacacauguauugacaccauuugcuucaggccauggagcacuguuucucccuuuuuacu

SEQ ID NO: 358183 - RNA, 64 nt, Human
uugaagaugagaagagagugcaggagggcugggggccauggaggaaaggccuaaaguuucacuu

SEQ ID NO: 358184 - RNA, 64 nt, Human
ccugugcuccaagcugcccccggcugcagcccaggccauggacaugugcaccaguauguaccug

SEQ ID NO: 358185 - RNA, 64 nt, Human
acuuggaccaaggcagagccaaucuugcaaacuggccauggauggggaagugcccgguagccag

SEQ ID NO: 358186 - RNA, 64 nt, Human
ugguucuccuguugcagguuuccauguugcugaggccauggagauucccagagcuggucacacc

SEQ ID NO: 358187 - RNA, 64 nt, Human
gugaccuuacucaggagcagauaucuccuuggccgccauggagccucauccauccacacgugcc

SEQ ID NO: 358188 - RNA, 64 nt, Human
ggacagucgcaaucuuuguuuuaaguuucacauggccauggagaaugugcccaagaagaaaaag

SEQ ID NO: 358189 - RNA, 64 nt, Human
aaacaacuuucacuucuuccuauuguaaucgugugccauggaucugaucuguaccaugacccua

SEQ ID NO: 358190 - RNA, 64 nt, Human
agccuuugagcagcuccaggccaagaaacaaauggccauggagaaacgcagagcaguccagaac

SEQ ID NO: 358191 - RNA, 64 nt, Human
gccucaggauuaugguuaaccuggagaggagcaggccauggaggcaggugccaggucaguauug

SEQ ID NO: 358192 - RNA, 64 nt, Human
gcucaaacaaugacaaagcagauucagaaaugaggccauggacucuguccugaaggccugaggu

SEQ ID NO: 358193 - RNA, 64 nt, Human
cuggagugugugaggccacagccugugcuaaagagccauggagcccuccccuggccaugucugg

SEQ ID NO: 358194 - RNA, 64 nt, Human
ugucugaagugaacuuugcauugaauaaauuuuugccauggaaagaacaucaaacaagccacuc

SEQ ID NO: 358195 - RNA, 64 nt, Human
cugggcgcccucuuaccgcucacggggagcuggggccauggaugggacaggagucuuugucccu

SEQ ID NO: 358196 - RNA, 64 nt, Human
agcuagacugccuugaggcugcuguccuuucacagccauggaguagaggccuaaguugacacug

SEQ ID NO: 358197 - RNA, 64 nt, Human
guguguuuuauuucugcugagaguauucagguuugccauggacaucagaaguuugaauuccagu

SEQ ID NO: 358198 - RNA, 64 nt, Human
auggaugaggaccugguccucgacaugugggugagccauggaccuugccuucccuucucguccu

SEQ ID NO: 358199 - RNA, 64 nt, Human
auuuuugcuuccgaauuugaaugaaaaacuuaaugccauggauuuuuuucuuuugcaagacacc

SEQ ID NO: 358200 - RNA, 64 nt, Human
ggguaccucugcugugcgcuccuucccagguggcgccauggauuccucugggggcuggcgcaug

SEQ ID NO: 358201 - RNA, 64 nt, Human
ugcuuagaagccagucaccagcccucugccugcagccauggaagggggugugcacgugccucug

SEQ ID NO: 358202 - RNA, 64 nt, Human
gaugaagagcaucaguggaaaacccaccccacacgccauggaccucagggcacucuccucccug

SEQ ID NO: 358203 - RNA, 64 nt, Human
agaccugggccuggcucuugagaggucccagucagccauggagagcuggggaaaccacauuaag

SEQ ID NO: 358204 - RNA, 64 nt, Human
aggugccaacccuucaucccccauguuuuccugggccauggagggcugaccuccguuucugggg

SEQ ID NO: 358205 - RNA, 64 nt, Human
gcaaaagaauggcagaaaaguuuagccccugaaagccauggagauucucauaacuugagaccua

SEQ ID NO: 358206 - RNA, 64 nt, Human
gauagaggaagugauuggaaguacuccacuuaaagccauggaauuagcaauaguuugcuuuuua

SEQ ID NO: 358207 - RNA, 64 nt, Human
ggaacgcuuucauaaacuucagggaucccguguugccauggaggcaugccaaauguuccauaug

SEQ ID NO: 358208 - RNA, 64 nt, Human
ugacauucuuuaucccuucuuccccggguugguggccauggagggucuugucugcugugauucg

SEQ ID NO: 358209 - RNA, 64 nt, Human
cccugagccagaggcagaauggauggacagacaggccauggaggcagcacugagccagcaccac

SEQ ID NO: 358210 - RNA, 64 nt, Human
aagagagaucauggguuugaccucugcccacauggccauggagucagccucagcccugucugua

SEQ ID NO: 358211 - RNA, 64 nt, Human
acacuucuguuucaugguugagacagaaucagaggccauggauacugacaacugauuugucugu

SEQ ID NO: 358212 - RNA, 64 nt, Human
aagaggcgguggcuguguggcccccuugaguggagccauggaagggguggcauggugccacugg

SEQ ID NO: 358213 - RNA, 64 nt, Human
gccuucucagggacuucugcggggccugaggcaagccauggagugagacccaggagccggacac

SEQ ID NO: 358214 - RNA, 64 nt, Human
acugugggagcugguggcucugcccugacagagagccauggagcagaggagccucucaccuccu

SEQ ID NO: 358215 - RNA, 64 nt, Human
cacacuccuagcagcugguaaaggggugcuggaggccauggaggagcucuagaaacauuagcau

SEQ ID NO: 358216 - RNA, 64 nt, Human
gcuuuggcaccaaguaccugaaagagaacuucucgccauggauccagcagcacgguggaugggu

SEQ ID NO: 358217 - RNA, 64 nt, Human
uccaacuguaacugacaguggcugccuucucugggccauggaucacaccuguaagguacuaauu

SEQ ID NO: 358218 - RNA, 64 nt, Human
aagucacauacaugaugucuugggcauuuucucagccauggagaacucugaaaggaagaaucgc

SEQ ID NO: 358219 - RNA, 64 nt, Human
gagaaauugggcugaugugagcuccccgucacccgccauggagccggcuguguguguucaucag

SEQ ID NO: 358220 - RNA, 64 nt, Human
auucuaguuuuaucuuccuuggcuuuaagagugugccauggaaagugauaagaaaugaacuucu

SEQ ID NO: 358221 - RNA, 64 nt, Human
uuaacuauuugcaucaaauuaagauacacaaauggccauggauguugccuuagccuuaaacauu

SEQ ID NO: 358222 - RNA, 64 nt, Human
gcuuacacaggucucacuaguuagaaaccugugggccauggaggucagacauccaucuugucca

SEQ ID NO: 358223 - RNA, 64 nt, Human
ggggccacuagucuaacagacggucacaaccagugccauggaaaaccaaggauauuagcaaaag

SEQ ID NO: 358224 - RNA, 64 nt, Human
cugagaagaauuaucuaaucaauuagugaugucugccauggaugcaguagaggaaagugguggu

SEQ ID NO: 358225 - RNA, 64 nt, Human
ugggguccugguguugggcaggugguggggcugggccauggagcuggcccagaggccccucagc

SEQ ID NO: 358226 - RNA, 64 nt, Human
aacgaguccccagucugcgggaggcagugguggggccauggacccaugcgggggguuccagggu

SEQ ID NO: 358227 - RNA, 64 nt, Human
cagucuccacagugagagcaacauuaagggcaaagccauggagaaaugugggagaggccggccu

SEQ ID NO: 358228 - RNA, 64 nt, Human
cuccucaaaaugcaugcccauugucuucagguuugccauggaaagucaaaugauuuccacuuca

SEQ ID NO: 358229 - RNA, 64 nt, Human
guauagcucuagagcauggcuugguaaccuguuugccauggagcacuagaugguccuuuucacu

SEQ ID NO: 358230 - RNA, 64 nt, Human
ccugacucgucugacuguguguggaggaguccaggccauggaggcagaauccuggcccucugug

SEQ ID NO: 358231 - RNA, 64 nt, Human
cuccugguuucuccauccccaugaccuucccagggccauggagguccugcugcuggucugggau

SEQ ID NO: 358232 - RNA, 64 nt, Human
cgaugucucagcucuucgaagguuugccuugucagccauggauauggaacagaaagacuaugac

SEQ ID NO: 358233 - RNA, 64 nt, Human
augaagguaauccggagugagcaauggaguggcugccauggaaggaagaaaagcugccauuucc

SEQ ID NO: 358234 - RNA, 64 nt, Human
aacacuagggcuguuguacaaaauaguaaugauagccauggaaguuuuaccuuauucugugaga

SEQ ID NO: 358235 - RNA, 51 nt, Human
cccuccagaaaauaaaguaaagccauggacagaauguggucugucagcugu

SEQ ID NO: 358236 - RNA, 64 nt, Human
uuuuuauacagaaggcagucaagcucaacucagagccauggaggcaaguaccuuaauuaguuuu

SEQ ID NO: 358237 - RNA, 64 nt, Human
aaauccauccauccaaaggcagagaaccaaaggggccauggaagguucucugugcuccuccuac

SEQ ID NO: 358238 - RNA, 64 nt, Human
uggaaaggcgagcagaaaacuccggcggucugaggccauggaggugguugcugcauuugagagg

SEQ ID NO: 358239 - RNA, 64 nt, Human
ccccgcacgcaugcauccacugcggccggaggaggccauggagcccgaguagcugccuggaucg

SEQ ID NO: 358240 - RNA, 64 nt, Human
caucuggggaggagaucccugucaugucucuugugccauggagcuauuauggcuggucuuccau

SEQ ID NO: 358241 - RNA, 64 nt, Human
gcaaguucccaggcaacucgaauuugcaaacacagccauggauacacuauuuaccuuacaguag

SEQ ID NO: 358242 - RNA, 64 nt, Human
accccugacauccauacuuauguugucuggaagagccauggacacaucauuauuuucagcaacc

SEQ ID NO: 358243 - RNA, 64 nt, Human
aagggaagaccccaguggugggacccuggaccaggccauggaugaaggacaaagaccagggcag

SEQ ID NO: 358244 - RNA, 64 nt, Human
ggggcagggggcugcuuauucacucuggggauucgccauggacacgucucaacugcgcaagcug

SEQ ID NO: 358245 - RNA, 64 nt, Human
auaaacauuuucucuaccuucccagcaguuugcugccauggacauaaauccccaaacccugaau

SEQ ID NO: 358246 - RNA, 64 nt, Human
ggauacuucaaggauagaaguguuggcacgcacagccauggacccagcugagcagagcagacgc

SEQ ID NO: 358247 - RNA, 64 nt, Human
aaugaagaaaccaaaccaccaucuuuuauaaauugccauggaaaccaagugccuucaaugaaac

SEQ ID NO: 358248 - RNA, 64 nt, Human
agaauuagaguuuaagacucuaaaccugauuuuugccauggauuccuucuggccaagaaauuaa

SEQ ID NO: 358249 - RNA, 64 nt, Human
aaccagugaaucccuuaagcagaacaaccgugaugccauggaacucaagcccaacggcggugcu

SEQ ID NO: 358250 - RNA, 64 nt, Human
ccugcccagcugcccgugugccuacccacuggaggccauggacagcccugugagccuacaggac

SEQ ID NO: 358251 - RNA, 64 nt, Human
uugaguuuaugucagcuuugcuuaguguuagaaggccauggagcuuaaaccuccagcagucccu

SEQ ID NO: 358252 - RNA, 64 nt, Human
ggaaggagacuccaucacagccaggaccuuucgugccauggagaguguuggccucuugucuuuc

SEQ ID NO: 358253 - RNA, 64 nt, Human
gagggugaacuggggacccugcacccuccgggaagccauggagucugcuggaggcaccauauca

SEQ ID NO: 358254 - RNA, 64 nt, Human
cuacgaagcucugaaaggugggaacaccacagaggccauggaggacuucacaggagggguggca

SEQ ID NO: 358255 - RNA, 64 nt, Human
caggccaugaagagccacucagaaaaggcccauggccauggagcuucaaggaaagaaaccccuc

SEQ ID NO: 358256 - RNA, 64 nt, Human
gggggccugugggccagaggacuccaugacaguagccauggagucccaccugugccaggucaga

SEQ ID NO: 358257 - RNA, 64 nt, Human
ccccagugacuuugacagugugcucacucucagagccauggauuaccuggaacaaagugcagau

SEQ ID NO: 358258 - RNA, 64 nt, Human
cccuggggacagcaagggcuaucccuuuccaaaggccauggagagcuggagccuggugcccuaa

SEQ ID NO: 358259 - RNA, 64 nt, Human
ccugguuuuccagcauguuuacccacauguuuuggccauggauaaagugaagaggccuacucac

SEQ ID NO: 358260 - RNA, 64 nt, Human
gugcaugguuacagcccacagggaggcauggagugccauggaaggauucgccacuacccagacc

SEQ ID NO: 358261 - RNA, 64 nt, Human
uagcacuauccugaggagcgacaugugguugaacgccauggacgggacacaagcggaccaagga

SEQ ID NO: 358262 - RNA, 64 nt, Human
aaaaaguugucucuagauacagaugcacgauuuggccauggauccgacuacucucgccaacaga

SEQ ID NO: 358263 - RNA, 64 nt, Human
gaguucugaaacccuugauagaaacuggaagccugccauggaacacaauacuuugggcaauaau

SEQ ID NO: 358264 - RNA, 64 nt, Human
ccaggcucuggcgcucugcugggugggagggugggccauggagggcaucugaauacaggaguag

SEQ ID NO: 358265 - RNA, 64 nt, Human
gcugagccuauagguugccaucaguuacgcugaagccauggaucaacuucuuucuugugucucc

SEQ ID NO: 358266 - RNA, 64 nt, Human
ggcucgcucccacaccgccccgguguuggcccucgccauggagcagaggcggggacagcuggcc

SEQ ID NO: 358267 - RNA, 64 nt, Human
ccccaaggcagagucggcugggcguggaccaggggccauggacacgugaugugcugcucuguac

SEQ ID NO: 358268 - RNA, 64 nt, Human
auggaaucaugggggaaacggguuggaauuuguagccauggaauauauauuagauguaaagaau

SEQ ID NO: 358269 - RNA, 64 nt, Human
aucccauuugcccagggaacugccacuccugguugccauggaaauagcagccaacggacaccuc

SEQ ID NO: 358270 - RNA, 64 nt, Human
gugcugggauuacaggcaugagccacugcgcccggccauggaccuggcugucuuuaucaucccc

SEQ ID NO: 358271 - RNA, 64 nt, Human
ucaccuguuguuucuauacaacagcagggaaggggccauggagcuuuucccugcugggugcucc

SEQ ID NO: 358272 - RNA, 64 nt, Human
ucuuuuuauuccuagauggaacugcgacuuccgagccauggaaggguggauugauguuuaaaga

SEQ ID NO: 358273 - RNA, 64 nt, Human
cacggcagacccuggugucccuggaccucaccgggccauggaccccccccccguccccgcacgu

SEQ ID NO: 358274 - RNA, 64 nt, Human
gacacuaacuuuuguugaguuuuguccacuuccugccauggagugagcuuuagaaccauacuac

SEQ ID NO: 358275 - RNA, 64 nt, Human
uugauauuuuucucuggcaacagaacguuauuaagccauggagacauaaggaaaauuaaauaca

SEQ ID NO: 358276 - RNA, 64 nt, Human
ugaccuugugguauuuuucuuggccuaguugugugccauggauauuaaaaaaaaaaaaaaaaaa

SEQ ID NO: 358277 - RNA, 64 nt, Human
ccaagaaauccuagcugcgcucuugagagugcaugccauggagacugguuuagacaccgcgugg

SEQ ID NO: 358278 - RNA, 64 nt, Human
ccuugaaagcaaugucaggcguggcaguggggaagccauggaggcugggaagggcaaagugugg

SEQ ID NO: 358279 - RNA, 64 nt, Human
guacguggaucccugaguagaucccagcaucugggccauggagagguuggggcaacagguuauu

SEQ ID NO: 358280 - RNA, 64 nt, Human
cccugaaggccuucacuccuuguuggguaacucagccauggagaugccaagcacuagccaggag

SEQ ID NO: 358281 - RNA, 64 nt, Human
ugacugggcccuagcagguggcagguauaacauggccauggacacucuucuuuuuuaaauuuua

SEQ ID NO: 358282 - RNA, 64 nt, Human
gcccaagaaaaaggucagcuccaccgaaggggcugccauggaagagcccaagaggagaucagcg

SEQ ID NO: 358283 - RNA, 64 nt, Human
ccagagacucagagggaggaaucgaggaaccagagccauggacucuacacugugaacuugggga

SEQ ID NO: 358284 - RNA, 64 nt, Human
uuucacauuccuaagcuggcuucccggcacagaagccauggauuuccccucucucccuuccccc

SEQ ID NO: 358285 - RNA, 64 nt, Human
cagcccacugcccaaugccugcuuccugggcauagccauggaacccugccaggcugcuaaagga

SEQ ID NO: 358286 - RNA, 64 nt, Human
gaacaagcaggacccuaacuaccuggccaccauggccauggauggaauggaggugagcacuccu

SEQ ID NO: 358287 - RNA, 64 nt, Human
gagagugccaaagcggagaucuguucaccugggggccauggaggggggacccacuaaagaucaa

SEQ ID NO: 358288 - RNA, 64 nt, Human
gcaagugagucugguggaggagcugagggagggagccauggaaggugccagaaggaagguuggc

SEQ ID NO: 358289 - RNA, 64 nt, Human
gccagccucaccucacccugcaguucccguuuccgccauggaugccucaucaccaacccugacc

SEQ ID NO: 358290 - RNA, 64 nt, Human
cuggagaagacaccagggcugacuuugaccgagggccauggacgcgacaggccuguggcccugc

SEQ ID NO: 358291 - RNA, 64 nt, Human
aguggccacacugcagcugaggccccagguggcagccauggaucauguagacuuccagaugguc

SEQ ID NO: 358292 - RNA, 62 nt, Human
aagucauaagugaagagugaucauguccugaugccauggaaugacugaagacaggcacaaaa

SEQ ID NO: 358293 - RNA, 64 nt, Human
ggagccgagggccucccagcagagcuugggaagggccauggacccaacugggccccagaagagc

SEQ ID NO: 358294 - RNA, 64 nt, Human
cgcugcuugccagccucaccugcuggggcuggaggccauggaucccucauaguauccaagguuu

SEQ ID NO: 358295 - RNA, 64 nt, Human
ucgacaugagcacggacuccuaaaccuuuuccacgccauggagggcaucagccaccuucaccuc

SEQ ID NO: 358296 - RNA, 64 nt, Human
ccguuuuuacccugcccuggcuggcaugugagaagccauggaagguugugguuguaaaugaguu

SEQ ID NO: 358297 - RNA, 64 nt, Human
cuucagcugaggaguuuugcuuuaguuucuuaucgccauggacugggaauuaacauguauuuaa

SEQ ID NO: 358298 - RNA, 64 nt, Human
uggcugcggcacccuugcgcuuuugcuggucacugccauggaggcacacagcugcagagacaga

SEQ ID NO: 358299 - RNA, 64 nt, Human
aaaagaaagggcaggugaggccuggguaaccccagccauggaccgucaguggcuggagggagcu

SEQ ID NO: 358300 - RNA, 64 nt, Human
ggcaaguugauacgauggggugcuugguggaugggccauggagguccgugagcuggaacugggc

SEQ ID NO: 358301 - RNA, 64 nt, Human
acuuuuggaaaaauggguucaagcuuuccuauuagccauggaaaugcaaaguuuagcagaagca

SEQ ID NO: 358302 - RNA, 64 nt, Human
uccuuccccggagccccuggcccgccuggcccuagccauggagcugagccggcgcguggccggg

SEQ ID NO: 358303 - RNA, 64 nt, Human
cagccugccugggcucugaccacuaacacucuuggccauggacagccugcacaggaccgccucc

SEQ ID NO: 358304 - RNA, 64 nt, Human
auccacuaauccaggggggacccagaccccacaagccauggagacucaggaccccagaaggcau

SEQ ID NO: 358305 - RNA, 64 nt, Human
ggaaacagauaacucagaagcaucugggaaauuugccauggaauuaaugaagaaaagcccucag

SEQ ID NO: 358306 - RNA, 55 nt, Human
agcgcccggugcccacguagccccugccauggaaggaagaacgggacaaaggagg

SEQ ID NO: 358307 - RNA, 64 nt, Human
uguguaugggaggugcuggugucaggguucacaagccauggaacuaccuugcuucacaucacaa

SEQ ID NO: 358308 - RNA, 64 nt, Human
ccucaacuucuggcugucccuacccugacucaccgccauggagaucacccuccccgaagcuguc

SEQ ID NO: 358309 - RNA, 64 nt, Human
gaagaugucauucccgcccuguauggcugguuuagccauggacaugaccagcuuuuggcuguga

SEQ ID NO: 358310 - RNA, 64 nt, Human
gcuggaggugcagaggccuggccucugucuguuugccauggagccugguggugcuaacggcccu

SEQ ID NO: 358311 - RNA, 64 nt, Human
agugugcaccacucacccaucccaguguauucaggccauggaccugacccaguuuggcccagag

SEQ ID NO: 358312 - RNA, 64 nt, Human
agcuuaugaaggaccccacuugcaccccaccccagccauggaagagcagcuggaggguggaugg

SEQ ID NO: 358313 - RNA, 64 nt, Human
cucuaauucacagaaugcacuuucuacccugugugccauggagaccuccuauggaaaaaugauc

SEQ ID NO: 358314 - RNA, 64 nt, Human
gagccaggccucaccuguuuguuuaggccaagaugccauggacaugcagcguuagugaucccac

SEQ ID NO: 358315 - RNA, 64 nt, Human
ugucacucccggggcugucccuguacuacacggugccauggagccggggagagcggggaagucu

SEQ ID NO: 358316 - RNA, 64 nt, Human
gucgcccagguuagcccacaggauuccuuugugugccauggaaugcugaaagaugggugacugg

SEQ ID NO: 358317 - RNA, 64 nt, Human
gcuccagcaggaaggaccccacauccuucucacugccauggaauucccuccugagugccccacu

SEQ ID NO: 358318 - RNA, 64 nt, Human
auauuuacucaucaggucauuauuuuuuacaauggccauggaauaaaccauuuuuacaaaaaua

SEQ ID NO: 358319 - RNA, 64 nt, Human
uacgaauuugggucccagccuuguuggguugucagccauggacauggauuucaaccccuggaga

SEQ ID NO: 358320 - RNA, 64 nt, Human
cgugugcacagcaaguuaacuagaggggcugugggccauggaacugucagcguuauucucagaa

SEQ ID NO: 358321 - RNA, 64 nt, Human
uggccuccucccuuagcucccuguucuuggaucugccauggagggaucuggugccuccagacau

SEQ ID NO: 358322 - RNA, 64 nt, Human
gugucuagugaugcucucugugcucaccuccuaggccauggagccugagggggccugcaccagg

SEQ ID NO: 358323 - RNA, 64 nt, Human
aaaucuacacaaacuauucauuaaaaaccauagagccauggacugucauuucugauuucuguuu

SEQ ID NO: 358324 - RNA, 64 nt, Human
uguggcccucucuuaaugccacggcagccacccugccauggaggcgccuuccuggguuggccag

SEQ ID NO: 358325 - RNA, 64 nt, Human
cagggagacccugggagagugaggucaucccggggccauggaagcuggcaggagacacuggucu

SEQ ID NO: 358326 - RNA, 64 nt, Human
cgugugagagggacgguucacaaggcuuggaccugccauggagggugcccagcagacguggugu

SEQ ID NO: 358327 - RNA, 64 nt, Human
acccuuuuacacggcagagaggaaggacgcggccgccauggaccccaugggagagugaguauga

SEQ ID NO: 358328 - RNA, 64 nt, Human
uagagagguuuucuuaauuaacaaaaggacguaugccauggagaaacacacccgcgcacacagc

SEQ ID NO: 358329 - RNA, 64 nt, Human
ugaggaccggcugcuuuccagugguagcccuuuugccauggaggucugggagagagagcagagg

SEQ ID NO: 358330 - RNA, 64 nt, Human
cguucgccaagggccguguguaaauacgaacugcgccauggagaggagaggcacugccggagcc

SEQ ID NO: 358331 - RNA, 64 nt, Human
agaaaagacacagagaaggaugugacaugccugggccauggagcacucugagaucucaucgcgg

SEQ ID NO: 358332 - RNA, 64 nt, Human
ggguguccgggggcuggccagucagagaaagggggccauggacugcuguggcaaauagggagac

SEQ ID NO: 358333 - RNA, 64 nt, Human
ccggcacccggcuggucccaccccaaauaccucagccauggagaccaugucaugcagaauuaac

SEQ ID NO: 358334 - RNA, 64 nt, Human
uccagcugccaacccuggagcccagaccgagguggccauggagacuccaccuggauccccugua

SEQ ID NO: 358335 - RNA, 64 nt, Human
uggggcagcacguggguggcgcagccuugguaacgccauggacugcagcgacaaucaauggaug

SEQ ID NO: 358336 - RNA, 64 nt, Human
gggucuucaggagugggccuuggcuggugcuggugccauggacucugcccagagccuucuuguu

SEQ ID NO: 358337 - RNA, 64 nt, Human
caugaugcaagagcugcaggccggggggcucagugccauggaagcuacuccaaguugcauugcc

SEQ ID NO: 358338 - RNA, 64 nt, Human
agaccacacagcccugaccgggccuuggaggagagccauggacaggcuccuccaugccgucuuu

SEQ ID NO: 358339 - RNA, 64 nt, Human
cacuaauauacguauuuagcaccucugaggcuuugccauggagacccauuucuguagggcuaag

SEQ ID NO: 358340 - RNA, 64 nt, Human
cucaggaagcacaucuguagugcacucccagcaggccauggacuagucacuaaccccacacuca

SEQ ID NO: 358341 - RNA, 64 nt, Human
cacuugagugcgccuugcaggcacucccagagcagccauggaaggagcuggcccucacaccauc

SEQ ID NO: 358342 - RNA, 53 nt, Human
augaugacacugcauuauaaaaggccauggagagugcugccaguuuaacuugu

SEQ ID NO: 358343 - RNA, 64 nt, Human
uucgucucugauuugccagagaaaaacggugguagccauggaaaucgggagugaaggagcacug

SEQ ID NO: 358344 - RNA, 64 nt, Human
cucaagggacguccuccaacggguggcgcuagaggccauggaggcaguaggacaaggugcaggc

SEQ ID NO: 358345 - RNA, 64 nt, Human
acuuugggcgagucucagugccacuugguccccagccauggacucuauacagugagggccacuc

SEQ ID NO: 358346 - RNA, 64 nt, Human
uaagggaaacauuuguaucaguaucauuugaucugccauggacauguguuuaaaguggcuuucu

SEQ ID NO: 358347 - RNA, 64 nt, Human; identical to SEQ ID NO: 358346

SEQ ID NO: 358348 - RNA, 64 nt, Human
ucacugaacccauuguuucuuucugaagagacuuuccuuucaaggcuucccauggguccgcgcc

SEQ ID NO: 358349 - RNA, 64 nt, Human
agugugggaacucauagguucugucuuugucucuuccuuucaccucauucugguagcagcauaa

SEQ ID NO: 358350 - RNA, 64 nt, Human
ccuuuucuauaauuguacuuguuuuuuaauuacuuccuuucacugccaaccucgaauuacugua

SEQ ID NO: 358351 - RNA, 64 nt, Human
uucauccaugaugaccauccucauagcucagaucuccuuucaaaguaguggcuuucuggauggu

SEQ ID NO: 358352 - RNA, 64 nt, Human
cgccuccuuccuugcuguccuaggccacaccaucuccuuucagggaauuucaggaacuagagau

SEQ ID NO: 358353 - RNA, 64 nt, Human
accguuguuugcuuuaaauuuucauaaacuggaauccuuucacccgcuccuacagcuaacccuc

SEQ ID NO: 358354 - RNA, 64 nt, Human
acggacaaacagcauugggaggccuuaguccugcuccuuucaauuccauccuguaaagaacagg

SEQ ID NO: 358355 - RNA, 64 nt, Human
gcccugauaugaucacuuguugagucacuggaguuccuuucauuuuggcacugaugcuguuuuc

SEQ ID NO: 358356 - RNA, 64 nt, Human
guagcuucuucucauucaugcaguaaauaauacauccuuucacucagcagagauggccauauua

SEQ ID NO: 358357 - RNA, 64 nt, Human
uuugaagaagacugaugagacuaggugcuuugcuuccuuucaucagguaucuuucuguggcauu

SEQ ID NO: 358358 - RNA, 64 nt, Human
gagauuguugaaaauucuauuuuuguuuuucuaguccuuucaccccaggacucuaaauuauugg

SEQ ID NO: 358359 - RNA, 64 nt, Human
guauuuuugucuucuuccccuuugccacaagagauccuuucagucccuagaccuccauucacuc

SEQ ID NO: 358360 - RNA, 64 nt, Human
caguuuaauuuugcuuuuuuuuuuuuuuuuuuuuuccuuucaacuuaguugacauacgugccuu

SEQ ID NO: 358361 - RNA, 64 nt, Human
ugacucaauauuccaaauguuuuuuuuuccuuccuccuuucaaaagaguucuuaacccaauuag

SEQ ID NO: 358362 - RNA, 64 nt, Human
ggcagaccauuaguuacuauggauuuauuuuuuuuccuuucaaacacgguaaggaaacaaucua

SEQ ID NO: 358363 - RNA, 64 nt, Human
guaaaugugaugggugcuuacacacuguaccuuuuccuuucauacugaugcugcaguucagggc

SEQ ID NO: 358364 - RNA, 64 nt, Human
aggaaucaauaauuuuuuugccuaggugccugacuccuuucagauucccucuuuaucuucccuc

SEQ ID NO: 358365 - RNA, 64 nt, Human
ggagaugugccuucccaauaacucuuuuuuuuuuuccuuucagaacauuuuccagauggcgagg

SEQ ID NO: 358366 - RNA, 64 nt, Human
uccccuucccuucccuucacccccauccucuuacuccuuucaugucccauuucagacagaguaa

SEQ ID NO: 358367 - RNA, 64 nt, Human
aauaagcccaaccaacuugccaaagguaucuuuguccuuucaccugggccucauaccaacagcc

SEQ ID NO: 358368 - RNA, 64 nt, Human
accugcuacagccugaugcuuaacuauuuccccuuccuuucauuccacucauggguggacaggg

SEQ ID NO: 358369 - RNA, 64 nt, Human
agcauugagaaauauuuuucuuucaaauucugguuccuuucaccuauguaaccgcaucccucag

SEQ ID NO: 358370 - RNA, 64 nt, Human
ucccaaaggacuuacauuaauuauggcucuugcuuccuuucacaaaugagcugaggccucuacu

SEQ ID NO: 358371 - RNA, 64 nt, Human
agggcugguuucagcugggggcucucaccagcccuccuuucagccucuacaacagagcagcuuc

SEQ ID NO: 358372 - RNA, 64 nt, Human
caggucauuuacaauugggagauuucagaaacauuccuuucaccaucauuuagaaaugguuugc

SEQ ID NO: 358373 - RNA, 64 nt, Human
cuacuaguuuaaaaaccccacucuggcccucuuguccuuucagaaaacaugcaaauaccaagau

SEQ ID NO: 358374 - RNA, 64 nt, Human
gcauuugauuaaauuaugaaugaguuuuacaaauuccuuucagaguuuuacuaagaucacacaa

SEQ ID NO: 358375 - RNA, 64 nt, Human
ugcugaaaaugaaacccuaucuuucacuuuacauuccuuucaauccaacugaucaaaacuggua

SEQ ID NO: 358376 - RNA, 64 nt, Human
aucgaauauaucaguaauuucagaaucagaugcauccuuucauaagaagugagaggacucugac

SEQ ID NO: 358377 - RNA, 64 nt, Human
gauguguauguaaaaauuuucuguuucauauuuuuccuuucacuuucgguuuaaaacaugcuau

SEQ ID NO: 358378 - RNA, 64 nt, Human
ggaaucucuuaaguuuugcccaaagacugguacuuccuuucaguagggcgcuaauguauacaca

SEQ ID NO: 358379 - RNA, 64 nt, Human
uaaggauuucuaugcauucauuauaauuuguuauuccuuucaauauccuuguauuucaaaucuu

SEQ ID NO: 358380 - RNA, 64 nt, Human
auuaucauggaaaacuaauuuuucccagagaauuuccuuucaaaccucccaguaucuauaugau

SEQ ID NO: 358381 - RNA, 64 nt, Human
aaaugucauugaaagccuuauuacgcuuuucagauccuuucaauaaacaagacuuguagaaaau

SEQ ID NO: 358382 - RNA, 64 nt, Human
gggacacgcuguccucccccgaguucgacagcgguccuuucagcucccagucugaugagaccuc

SEQ ID NO: 358383 - RNA, 64 nt, Human
auaugugugaauucugcaacuagccaaggcuaguuccuuucaauuccauuuaaaaaacaaaaac

SEQ ID NO: 358384 - RNA, 64 nt, Human
uuuagaaauaaaaaugugguuucuuaaacguauauccuuucauguauauuuccacauuuuugug

SEQ ID NO: 358385 - RNA, 64 nt, Human
gccccucauugccugacugaccggguugggggcuuccuuucauagcuacaugaugaaaacccuc

SEQ ID NO: 358386 - RNA, 64 nt, Human
uaucagcaaaggcuacuucagauggccacuuuaguccuuucagcuguagucaggauuauuuaac

SEQ ID NO: 358387 - RNA, 64 nt, Human
aucaaccacaugcacauccuuacuacagaauccguccuuucauuucaacuuauagcaagcuaug

SEQ ID NO: 358388 - RNA, 64 nt, Human
gcuuccugauuccucggcgcaaaggagacguuuauccuuucaaauuccugccuucccccucccu

SEQ ID NO: 358389 - RNA, 64 nt, Human
uuauuuugagcuguguauagguagaauaaaaaauuccuuucauaucguuauuguacaaaaagua

SEQ ID NO: 358390 - RNA, 64 nt, Human
cacucaaaggauugccuagcaauacagcaucuuuuccuuucacuaguccaagccaaaaauuuua

SEQ ID NO: 358391 - RNA, 64 nt, Human
gucauuguagccucaaccucccaggcucaagcaguccuuucaccucaaccccccacauagcugg

SEQ ID NO: 358392 - RNA, 64 nt, Human
cacugacuccuguggagaugacuuggcaccacucuccuuucacagagcagagucugaauagucu

SEQ ID NO: 358393 - RNA, 64 nt, Human
auuauuuagauauuuccccuagagauuagaaaccuccuuucauccuguccacuuuuuguuagca

SEQ ID NO: 358394 - RNA, 64 nt, Human
cagcauaugaaacuagucuuaacuguugagccuuuccuuucauauccacagaagacacugucuc

SEQ ID NO: 358395 - RNA, 64 nt, Human
cugccucucugccagucagccacagagacccuccuccuuucacgaggaaaagaccuuccccuga

SEQ ID NO: 358396 - RNA, 64 nt, Human
cugagggcugaucuuuaacuggaaggcugcuuucuccuuucaccacccccuccuucccuguguc

SEQ ID NO: 358397 - RNA, 64 nt, Human
uucugucaaagguuggcggggggagguguugggguccuuucaucuggcuccguuucuggugcuu

SEQ ID NO: 358398 - RNA, 64 nt, Human
gcagacccuuccccuccucaaggaucacccauccuccuuucagcccccuuuauggggaccaggc

SEQ ID NO: 358399 - RNA, 64 nt, Human
ugcuguuaagauaauguauacucuuuuauuuucuuccuuucaugguuaagauuuuuuuuuuaag

SEQ ID NO: 358400 - RNA, 64 nt, Human
ugcuguaaauuuggcuucuguugucaccuucaccuccuuucaagguaacuguacugggccaugu

SEQ ID NO: 358401 - RNA, 64 nt, Human
ucaacaacuuuacuagugacuuucuggaacaauuuccuuucaggaauacauauucacugcuuag

SEQ ID NO: 358402 - RNA, 64 nt, Human
auagaagaaauuguguuaaaauagaaguguuucauccuuucaaaaccauuucagugauguuuau

SEQ ID NO: 358403 - RNA, 64 nt, Human
auguuuaucauguuguaaaguagcaucaguuguauccuuucauuaaaacuugauaaacaaaaga

SEQ ID NO: 358404 - RNA, 64 nt, Human
uuauuuauuuuugacguauaauguaguauaucaauccuuucaaacuauuuagauaaccacuuga

SEQ ID NO: 358405 - RNA, 64 nt, Human
acuaugacaugaaaaccaaauuugaaaacucacauccuuucagcagaagguaacuguucuuguc

SEQ ID NO: 358406 - RNA, 64 nt, Human
accacaacucuguaugggguugcccagcuacucuuccuuucaguugcagucccaauuuuacucc

SEQ ID NO: 358407 - RNA, 64 nt, Human
uguaaacucagacuucgcuuuuuuugugagacuauccuuucaauauuuuuauaaacuuuugugu

SEQ ID NO: 358408 - RNA, 64 nt, Human
cuacauauuuuaguauaaaucacuaagacauauuuccuuucacuuggcaggauuccuuucaaaa

SEQ ID NO: 358409 - RNA, 64 nt, Human
ucacuaagacauauuuccuuucacuuggcaggauuccuuucaaaauggaaucugaguauuagac

SEQ ID NO: 358410 - RNA, 64 nt, Human
aauagcauuagcaguuauaauucuguuuauaauuuccuuucagcauuuacagugaaaagugaga

SEQ ID NO: 358411 - RNA, 64 nt, Human
accauguaaaauauguaaauucuaguaccugaaauccuuucaacagauuuuuauauagcaacug

SEQ ID NO: 358412 - RNA, 64 nt, Human
uuccacuucuccccgcagaccuaggucagacuuuuccuuucaucuuuguguucaucuacuguaa

SEQ ID NO: 358413 - RNA, 60 nt, Human
gcaggcaguucucucacugaacacaugccuuccuuucaucuugaauaacuuuguccuaaa

SEQ ID NO: 358414 - RNA, 64 nt, Human
ccacauuguuuccuauuuggacauagacuucauuuccuuucaguauaagcugaauaaauuuaga

SEQ ID NO: 358415 - RNA, 64 nt, Human
gaacauaaaauguauuucugacuaacacaaaugguccuuucacaugugcuuuauuagacucugg

SEQ ID NO: 358416 - RNA, 64 nt, Human
cugcgugggacccucuucucuggaaaccuaauccuccuuucauuuccucugggcaggacucucu

SEQ ID NO: 358417 - RNA, 64 nt, Human
uuuagcaaacacggaagaauuuuaaaaugagcucuccuuucaacccuuguuaacaagugccuaa

SEQ ID NO: 358418 - RNA, 64 nt, Human
uuccuggaaguauuuaauaaguugcaaaugcaguuccuuucauaauaucucagcaccagaaaca

SEQ ID NO: 358419 - RNA, 64 nt, Human
acuuccccagaaaugaaccauaaauuuuggaacuuccuuucagcucaagagguucagcuauauu

SEQ ID NO: 358420 - RNA, 64 nt, Human
ucucucuauggucaguaucacuggauaagccuucuccuuucauaagaaaggauguauuuaaaua

SEQ ID NO: 358421 - RNA, 64 nt, Human
cuauuucauucaagcauguuuaaaacaaauaauuuccuuucaccaguuuuucuuaguaaacucc

SEQ ID NO: 358422 - RNA, 64 nt, Human
guguugacaugugcuuuggggcuuuuacaccaguuccuuucaaugguuugcaaggaagccacag

SEQ ID NO: 358423 - RNA, 64 nt, Human
agccucagccaggcaacccgucagucugucuccauccuuucaccccuucccuggagaugggagg

SEQ ID NO: 358424 - RNA, 64 nt, Human
cagaguugggaaauagauggcucccacuccucccuccuuucacuucucugccuaugggcuaccc

SEQ ID NO: 358425 - RNA, 64 nt, Human
auuucuacauucccucccuuacucuucggggguuuccuuucaguaagcaacuuuuccaugcucu

SEQ ID NO: 358426 - RNA, 64 nt, Human
aaacaugaauucagucauggugauaauuggaaacuccuuucagguuuuugcaaguagauuuugu

SEQ ID NO: 358427 - RNA, 64 nt, Human
uccccuuagucaugagaacagaaagugcaauauuuccuuucaccuggcaggggaggggggauuu

SEQ ID NO: 358428 - RNA, 64 nt, Human
gcucccgccagccgcuccccagcccugccgcauuuccuuucaguggcuuggacucuuucccauc

SEQ ID NO: 358429 - RNA, 64 nt, Human
caggcaguguuaaacugaguuuuuaauuugacucuccuuucagcuguucacauaaagcaccugg

SEQ ID NO: 358430 - RNA, 64 nt, Human
auuuguggggggacacaaccaaaccauaucagcauccuuucaagaauauuagauaauuggagcu

SEQ ID NO: 358431 - RNA, 64 nt, Human
ccucuguggcuaguuguccuaccucccuggcuguuccuuucaggcuuccgugcaggcuucucca

SEQ ID NO: 358432 - RNA, 64 nt, Human
uggcugacaggaucccuguguuguaauuggucccuccuuucagcucucuagugagaugcccgug

SEQ ID NO: 358433 - RNA, 64 nt, Human
aaaccaggauggaaacuucuucccugccuuaccuuccuuucacuccauucauuguccucucugu

SEQ ID NO: 358434 - RNA, 64 nt, Human
aucacagaauucaguguaguuuauacauuucgauuccuuucaucucagcaaaaugggcacugcc

SEQ ID NO: 358435 - RNA, 64 nt, Human
aucuccuguccaucagccaggacagucagcucucuccuuucagggccaauccccagcccuuuug

SEQ ID NO: 358436 - RNA, 64 nt, Human
acaagacuccaauuugaauucaggauuacagugcuccuuucauucuuucaaacagauaacauaa

SEQ ID NO: 358437 - RNA, 62 nt, Human
aggaagaaagucgcuuuugacggauugugguguccuuucaaauuagcuuauuucacaaauau

SEQ ID NO: 358438 - RNA, 64 nt, Human
acuacugcagcagucccugaaccacuaaacuuguuccuuucauuuacaaaagagauaccugaca

SEQ ID NO: 358439 - RNA, 64 nt, Human
aacaaaaggaauuuucuauccagaagccuauuucuccuuucauuguuguuauuucuguuauaau

SEQ ID NO: 358440 - RNA, 64 nt, Human
auaauauuuccaaagcuccuuuguaaaccccgucuccuuucauucagagagucagagacgguau

SEQ ID NO: 358441 - RNA, 64 nt, Human
uucccgccaucauugugcuguagccauauggaacuccuuucaguucucugaccaugcccuuucc

SEQ ID NO: 358442 - RNA, 64 nt, Human
ccacgauggauccaccagucccaccccagccuuuuccuuucaucugaacagaaugugcauuuuu

SEQ ID NO: 358443 - RNA, 64 nt, Human
aaaaaaaaaaauucacacugccagcguuaacaguuccuuucaaaggagaaugaaucaugauggc

SEQ ID NO: 358444 - RNA, 64 nt, Human
ggaaaugcuggcuuaaacaaaggcgagaggaaguuccuuucacgucaggauuuaugaaugccua

SEQ ID NO: 358445 - RNA, 64 nt, Human
uccacagacuucugaucaucucccucuucuccccuccuuucacaccgaggcuccugcucuccug

SEQ ID NO: 358446 - RNA, 64 nt, Human
ugagaacuaauaaaugcaccuuaauggucaguguuccuuucaaacaugugaguucuuuaacaaa

SEQ ID NO: 358447 - RNA, 64 nt, Human
cugggggguccucguucacucucugaaguuggccuccuuucacuggggauugaaaagcaccucc

SEQ ID NO: 358448 - RNA, 64 nt, Human
auaacuuaaccugcuuuaugggcuuacauaauauuccuuucauccauucuuuuuaaagaacggc

SEQ ID NO: 358449 - RNA, 64 nt, Human
aaaaaaaaaaaaaaagcuugaucucuaucagacuuccuuucaacuguccuccccuccaagcaga

SEQ ID NO: 358450 - RNA, 64 nt, Human
ccaugcucacccuuuccaugcuguccccauucucuccuuucaccaucucuccucucccccuccu

SEQ ID NO: 358451 - RNA, 64 nt, Human
agaaaugacauaguuuucccuuuauuucccaaauuccuuucauguucuuaacugcuacccagaa

SEQ ID NO: 358452 - RNA, 64 nt, Human
uugcagaauaaguaauauauuuuaaaaaccuagcuccuuucauuauuuaaaacagcaaaauuau

SEQ ID NO: 358453 - RNA, 64 nt, Human
ucguagguguccugccccccagccuaggcuuggcuccuuucaccccauccacauggguacuguc

SEQ ID NO: 358454 - RNA, 64 nt, Human
agcauuccuccccagggcucuucccuugggggccuccuuucaucuggggcacagccacaagucu

SEQ ID NO: 358455 - RNA, 64 nt, Human
cagauccaucccuugagcuguaaacacucagaacuccuuucauaucaagacaaguuauuuguaa

SEQ ID NO: 358456 - RNA, 64 nt, Human
ugugucuuuuuuccuuugcugauuuuguuuuguauccuuucacuguaauaaaucauggccguga

SEQ ID NO: 358457 - RNA, 64 nt, Human
cagugaagcugaugccuaggaacuuuuaaagggauccuuucaaaaggaucacuuagcaaacaca

SEQ ID NO: 358458 - RNA, 64 nt, Human
uucuccagaauaauucuuaacagugguucaaauuuccuuucauaccuugaaguauguguuuagu

SEQ ID NO: 358459 - RNA, 64 nt, Human
caaguuucagcucaaacaucaccuucuuucugacuccuuucauucauuccuccaggcaguaagg

SEQ ID NO: 358460 - RNA, 64 nt, Human
guccuagugauuuuaccuuuguucuagaaggcgcuccuuucaggguugugguauucuuagguua

SEQ ID NO: 358461 - RNA, 64 nt, Human
ugcccagugcugccagagugagugaguguaauucuccuuucagguaaagauaggcuaucucaac

SEQ ID NO: 358462 - RNA, 64 nt, Human
uugccaggauuuuuucagcuggaaagauacgccauccuuucaaacccucaugacugacaaaaac

SEQ ID NO: 358463 - RNA, 64 nt, Human
cagaaucugcuauuccccaaaccacuucccaguuuccuuucaguaaucuuucugaaggagccag

SEQ ID NO: 358464 - RNA, 64 nt, Human
ucacaugugcaguuugaaguauuuaaauaaccacuccuuucacaguuuauuuucuucucaagcg

SEQ ID NO: 358465 - RNA, 64 nt, Human
ugguacuauggaacuuuucuuaggggacacguccuccuuucacagcuucuaagguguccagugc

SEQ ID NO: 358466 - RNA, 64 nt, Human
cauuuuauguaggaguuuuaaauguguguuuuuuuccuuucaagucuuacaaagcuaagacuuu

SEQ ID NO: 358467 - RNA, 64 nt, Human
aucuaaggugacagagcagugcuggaauagcaucuccuuucacuuucccaaaacugccacagau

SEQ ID NO: 358468 - RNA, 64 nt, Human
caaaaaaugaaccccuugugucguuguuaacccauccuuucauuuacucauauaauuagccaaa

SEQ ID NO: 358469 - RNA, 64 nt, Human
aaacauaguuucugcaccaaguuaauuaucccuguccuuucacauuuauagggggaaaauaaau

SEQ ID NO: 358470 - RNA, 64 nt, Human
agggaacuuuuauuuauuguguucacaaacuccauccuuucagcauauccuuuuaaguuuaguu

SEQ ID NO: 358471 - RNA, 64 nt, Human
gaagaaggagcaagugugaacaguuucuuguguauccuuucagaauauuuuaauguacauauga

SEQ ID NO: 358472 - RNA, 64 nt, Human
guuuuuuaaaaugcugguauuaaacuaaauggacuccuuucacuaacugcugauuucagaguuu

SEQ ID NO: 358473 - RNA, 64 nt, Human
ucaaaugcaaaagaauaagcuggaggcaauuauuuccuuucauacagaguucaugaauuguuuu

SEQ ID NO: 358474 - RNA, 64 nt, Human
gauaaaugcagcuaagucauacauucauuuugacuccuuucaaugucacacacauaguauugau

SEQ ID NO: 358475 - RNA, 64 nt, Human
uagauugcuuugaaaacaugacucaauaaaaguuuccuuucaauuuaaacacugaagccgcucu

SEQ ID NO: 358476 - RNA, 64 nt, Human
uuacuguccacccucauuucugccagcgcauguguccuuucaaggggaaaaugugaagcugaac

SEQ ID NO: 358477 - RNA, 64 nt, Human
uuauuuuuuaaaaaagaaauagucaguguuuuccuccuuucaaccgagacuauuucuggauugu

SEQ ID NO: 358478 - RNA, 64 nt, Human
caagggaggaagcaguggauggaccaggauuaauuccuuucauuucuuaguaaauuaaaaccug

SEQ ID NO: 358479 - RNA, 64 nt, Human
acuuauucuguauaaaacugucuuuuaagaauuauccuuucaaaauaaaaauguuauuguuuca

SEQ ID NO: 358480 - RNA, 64 nt, Human
ccuuacauuugcuaaacagacaguuaauaucaaauccuuucaauauucugggaacccagggaag

SEQ ID NO: 358481 - RNA, 64 nt, Human
cagcaaucguuuccaucugucacccucuucccucuccuuucauaccagucacuaucuuggguaa

SEQ ID NO: 358482 - RNA, 64 nt, Human
guagacauuucauauccagcuuccuugcuuagucuccuuucaguauuuggcaauaaaagaaaga

SEQ ID NO: 358483 - RNA, 64 nt, Human
aucucuuuucuauacugcuccuuucugaugcuuauccuuucaucugugugauuguuuuuucccc

SEQ ID NO: 358484 - RNA, 64 nt, Human
agggaaagcauuuaaagggugauguacacauguauccuuucacacauuugccuugacaaacuuc

SEQ ID NO: 358485 - RNA, 64 nt, Human
auuagaaaugaccucagcugccccauaucuacguuccuuucagcaguuguccaaguaggagugu

SEQ ID NO: 358486 - RNA, 64 nt, Human
uguuucuaaacauauaaaugugaauuuaaucaauuccuuucauaguuuuauaauucucuggcag

SEQ ID NO: 358487 - RNA, 57 nt, Human
cgacuccuaauuuucauugauuaaaacuccuuucagacauauaaguuuaauaaauaa

SEQ ID NO: 358488 - RNA, 64 nt, Human
guacaaaauaaaauuccauuucauugugaccuacuccuuucauaaaugccaaucugugagaacu

SEQ ID NO: 358489 - RNA, 64 nt, Human
guauuuaaaaauugaauccauucugcugacuucuuccuuucacugcuguuuauaaaauguguaa

SEQ ID NO: 358490 - RNA, 64 nt, Human
uaaagaauguuuucaacugcuugccugaauuuacuccuuucacagcaaguguuagaagaaagau

SEQ ID NO: 358491 - RNA, 64 nt, Human
cagucuauuggugccauguuuccaauaaaacuucuccuuucaugucucguauauugugauaauu

SEQ ID NO: 358492 - RNA, 64 nt, Human
aauaucaguaagucaaaucuguuugaauuauaauuccuuucaaauaguuuugcuauuuaauuua

SEQ ID NO: 358493 - RNA, 64 nt, Human
ugcuaauaaguuugaaauauauuauuuccuuuauuccuuucagcaauccaugagauagcuauua

SEQ ID NO: 358494 - RNA, 64 nt, Human
uaaauccccaaagacauuaucuguggucuuuuuuuccuuucaagcucagccugugugccugaug

SEQ ID NO: 358495 - RNA, 64 nt, Human
agaauauuuacguaguuuuucauaggucuguuuuuccuuucaugccucuuaaaaacuucugugc

SEQ ID NO: 358496 - RNA, 64 nt, Human
uaagaugaagagagaggaaaugaagccaaacacauccuuucaucagaagcccauucccucuaua

SEQ ID NO: 358497 - RNA, 64 nt, Human
caggaagagagacuggccuccuuggcugaaagaguccuuucaggaagguggagcugcauugguu

SEQ ID NO: 358498 - RNA, 59 nt, Human
cuaucaagggagcaguuuaaauaaccguuuccuuucauuuacuguggcuucuuaaucuu

SEQ ID NO: 358499 - RNA, 64 nt, Human
uucuacuuuuucuguaguuaauccuugcauauucuccuuucauccuggcuugccaacgcagucu

SEQ ID NO: 358500 - RNA, 64 nt, Human
cauauuuccuauguuacauuucuuuugucuauuuuccuuucaaaauugguauuuuuguugggcu

SEQ ID NO: 358501 - RNA, 64 nt, Human
guuuucuugguguaaucuuccagaugcccccuuuuccuuucacaaagauuggcucugaugguuu

SEQ ID NO: 358502 - RNA, 64 nt, Human
ucccacauccgugcugugucauuguugcucugcuuccuuucaaugugucagugccuggggggag

SEQ ID NO: 358503 - RNA, 64 nt, Human
uaaacuguaugcuaaaacguauuuguuuauccuauccuuucagaaaauugaaauaaauaugaaa

SEQ ID NO: 358504 - RNA, 64 nt, Human
uaaacaccccagccaucccuucuuucaaaagggauccuuucauaggagaacacacugaggagau

SEQ ID NO: 358505 - RNA, 64 nt, Human
auguagucagacugacacuacuaaagcucccagcuccuuucaugcuccauuuuuaaccacuugc

SEQ ID NO: 358506 - RNA, 64 nt, Human
caaacuguuuaagcuguaucaucccaacaaaguauccuuucaugaacggggcaugcaauagcuu

SEQ ID NO: 358507 - RNA, 64 nt, Human
aggcaccgcuguccaccuugggcaccauuuauccuccuuucaucguccccggggcaguugcgug

SEQ ID NO: 358508 - RNA, 64 nt, Human
uuaaggagaaaaaaaaauauggugagaagcucgcuccuuucaacuuguuugguacugacagcug

SEQ ID NO: 358509 - RNA, 64 nt, Human
uacuccgagcaaugaaauagaccugaguuaugcuuccuuucauuuaauuucugcagauaaauag

SEQ ID NO: 358510 - RNA, 64 nt, Human
cccuagacucugugucacucucaacacacacagcuccuuucacuccugccugacugccaagcca

SEQ ID NO: 358511 - RNA, 64 nt, Human
ggaccccaaaaaaccagaacaaguucugugugccuccuuucagcacagaagggagacaucucau

SEQ ID NO: 358512 - RNA, 64 nt, Human
cagagguacagaagaaaccuauuuccaaaaaagguccuuucagugguagacucggggagaacuu

SEQ ID NO: 358513 - RNA, 64 nt, Human
cuguuguguaauguuuguauauuucugagccagauccuuucaaagauugccuuuuuauaaaauu

SEQ ID NO: 358514 - RNA, 64 nt, Human
agauacauccuuuuagcaaaagacuggaauuuuauccuuucaacuucaagaacuuuggaaaugc

SEQ ID NO: 358515 - RNA, 64 nt, Human
agcauggggcuuguaaaccuuugggcuagaucccuccuuucauugcuguugucucugcucuucc

SEQ ID NO: 358516 - RNA, 64 nt, Human
uccccggaucccaagguggucuguugcucuggcuuccuuucauugucuuaggccuucauggagu

SEQ ID NO: 358517 - RNA, 64 nt, Human
ggcucaaucuuguaacugccugcuagccauagauuccuuucagccuugcugacuucucccuaua

SEQ ID NO: 358518 - RNA, 64 nt, Human
ccagcacuuccaugggaaugucucuuuggcgaccuccuuucaucacacugggugguggccuggu

SEQ ID NO: 358519 - RNA, 64 nt, Human
aaaauucuuuuggcacacuauuaaaugcaaaaacuccuuucaaaacaaaaaagaacuaccuuau

SEQ ID NO: 358520 - RNA, 64 nt, Human
caccccugcucauugguggauguuaaaccaauauuccuuucaacugcugccugcuagggaaaaa

SEQ ID NO: 358521 - RNA, 64 nt, Human
cacuccuggucauugguggauguuaaacccauauuccuuucaacugcugccugcuagggaaaac

SEQ ID NO: 358522 - RNA, 64 nt, Human
ggcaaaguggaagagauccugcaagacacaucuauccuuucacaguguucccaagggaacuugg

SEQ ID NO: 358523 - RNA, 64 nt, Human
cuguagagacucgccuuugggacccaucuuugcuuccuuucaguugccuccuggaucuucuuuc

SEQ ID NO: 358524 - RNA, 64 nt, Human
ggaaggaagagaccugggcacccaagaccugguuuccuuucauucaucccaggagaccccuccc

SEQ ID NO: 358525 - RNA, 64 nt, Human
ccccaccuacccagcugauggggguuggggugcuuccuuucaggccaaggcuaugaagggacag

SEQ ID NO: 358526 - RNA, 64 nt, Human
cacagcugcuggacauagagugauuugcagccccuccuuucagaguaccacaucccucucaagu

SEQ ID NO: 358527 - RNA, 64 nt, Human
gccccuuccccuuggugcucuguccccauccaccuccuuucagcugcuccugggccucagcucu

SEQ ID NO: 358528 - RNA, 64 nt, Human
gggagcugaggaguuuaucaguauucaucuuccauccuuucauagucacaaguuuuguuauuuu

SEQ ID NO: 358529 - RNA, 64 nt, Human
ucuauggaggugucccuuucugcucuuugcuguguccuuucagaauuuuuaccaggaacauaau

SEQ ID NO: 358530 - RNA, 64 nt, Human
aaacauuccucaaaaugaucuuuagugccuuuauuccuuucaggccaauaauccacccaaaaau

SEQ ID NO: 358531 - RNA, 64 nt, Human
gauagaagagggaaaguuuuggugccauaauuucuccuuucacugguguuggacuuaaaucagu

SEQ ID NO: 358532 - RNA, 64 nt, Human
acccagccagaagagggaccaccuguaaagcaaguccuuucaaguuucacugcacaucccaaac

SEQ ID NO: 358533 - RNA, 64 nt, Human
gcguuugaccuuccacgugacaguucuucacaauuccuuucaucauuuuuuaaauauuuuuuuu

SEQ ID NO: 358534 - RNA, 64 nt, Human
auaaaaaauaucuauguuuguauauuuuuauaacuccuuucaguccucuggggcuccugucauu

SEQ ID NO: 358535 - RNA, 64 nt, Human
ccaauuagaaaccaccaucuaaccucuaacuagguccuuucaacuuuaaccaaguauuuucuuu

SEQ ID NO: 358536 - RNA, 64 nt, Human
uuggccuguguuguaaacuuaguugcacuucaguuccuuucaucccuucacaaaauuuuguuuc

SEQ ID NO: 358537 - RNA, 64 nt, Human
uaaugacacuuugguagcacuaauauggagauuauccuuucauugagccuuuuauccucuguuc

SEQ ID NO: 358538 - RNA, 64 nt, Human
uaccauuuuaucacuguucaaagcacugucaaauuccuuucauccuuuaauaguuaagaucuuu

SEQ ID NO: 358539 - RNA, 64 nt, Human
cccuccucuagcccagcagcggcuggggucuggcuccuuucagagacacuacacuucccgugca

SEQ ID NO: 358540 - RNA, 64 nt, Human
uuuuagcaggacuuaauuuucuuaauuuauucuuuccuuucaauuauagugacauagaguaguu

SEQ ID NO: 358541 - RNA, 64 nt, Human
uucagaagcgagaugccauugccaacuguuuuauuccuuucaacaacugcauugugaauaaacu

SEQ ID NO: 358542 - RNA, 64 nt, Human
gugggacugcugggagaucagaaauuuccacaaguccuuucauggaucuugagguucucaaaaa

SEQ ID NO: 358543 - RNA, 64 nt, Human
gaaaaaggcucuaucucagauguaguaaauuauuuccuuucaguuugugaaagcaggauuugac

SEQ ID NO: 358544 - RNA, 64 nt, Human
aauagaaaucauauauaacauuucuaaauauaaguccuuucacauacuguguuuccaguugucu

SEQ ID NO: 358545 - RNA, 64 nt, Human
uaguugaguucucaaauuuguaaguuuuuauacauccuuucauugaauaaacguuuaauuaaau

SEQ ID NO: 358546 - RNA, 64 nt, Human
ccguagcaaaaaucaugaaaaacacuucaacguguccuuucaaucauccaauuaaaugugggua

SEQ ID NO: 358547 - RNA, 64 nt, Human
uaggggugugggggccgucuuccuccugucucuuuccuuucacccuagccugacuggaagcaga

SEQ ID NO: 358548 - RNA, 64 nt, Human
aucagcuuugaaggcuggauucuaucuacauaaguccuuucaauuccaccagggccagagcagc

SEQ ID NO: 358549 - RNA, 64 nt, Human
cuuuacuuuagacacuggcccaacuccaggcguuuccuuucauucccucagugcuucucuucug

SEQ ID NO: 358550 - RNA, 64 nt, Human
auggaacaguauuuaaugcuuaaaaacaaggaaauccuuucaucugugacaaccuggaggacau

SEQ ID NO: 358551 - RNA, 64 nt, Human
uaauaaaauaucuauuugaauaaauuaugagcuauccuuucaaacagcuauuggcaaguuuuaa

SEQ ID NO: 358552 - RNA, 64 nt, Human
cguuuacaggaugugcgagacgucagcgccacguuccuuucagaccuggaagagaacuuugaga

SEQ ID NO: 358553 - RNA, 64 nt, Human
acuaaaaacuuggaccucauccucaauuauuuucuccuuucaacucuguugacccucugucugg

SEQ ID NO: 358554 - RNA, 64 nt, Human
uccugcuuuuaggagaauucacagaaccuacuguuccuuucagaugaccuuuuggaaaauaguu

SEQ ID NO: 358555 - RNA, 64 nt, Human
aagaagucuaguaagaauuaauuacacagaagccuccuuucauuucuaugggccaaacaaaggc

SEQ ID NO: 358556 - RNA, 64 nt, Human
uuuccugagucaggaacauuuguuuucuccaauuuccuuucagacuuaaaauuguucuuaugcu

SEQ ID NO: 358557 - RNA, 64 nt, Human
aaauuugccuguauguuuuguggguuuuuuuuuuuccuuucaagauguuuucuauuucuaaauu

SEQ ID NO: 358558 - RNA, 64 nt, Human
gaaaaugagaaaggacagagccagcggcuccaacuccuuucagccacaugccccaggcucucgc

SEQ ID NO: 358559 - RNA, 64 nt, Human
cuccgugaggaacacaaucucaaucguugcugaauccuuucauauccuaauaggaauuaaccuc

SEQ ID NO: 358560 - RNA, 64 nt, Human
auuauuaguuuugauuuaauguuuucagcccaucuccuuucauauuucugggagacagaaaaca

SEQ ID NO: 358561 - RNA, 64 nt, Human
cucuacugauuucuguuuuugugaucucugacuuuccuuucaaauuuuuacugagaauaucgaa

SEQ ID NO: 358562 - RNA, 64 nt, Human
ucaacuaucugcaucuggcugagagagacccguuuccuuucagggauguggacaggguaagggc

SEQ ID NO: 358563 - RNA, 64 nt, Human
ccucucuuugcuaaucauuucagagguccaguuuuccuuucacuggacaaucuugaauaggagg

SEQ ID NO: 358564 - RNA, 64 nt, Human
cuaacgguugaguuuugacugcuuggaacuggaauccuuucagcaagacuucucuuugccucaa

SEQ ID NO: 358565 - RNA, 64 nt, Human
uccugcuagcaaccacacugaagagaucgaugccuccuuucaagcuagccaaguuuucugcgag

SEQ ID NO: 358566 - RNA, 64 nt, Human
ucauuuaguuucuucugcgcaagccacucuggcuuccuuucaguuuugugguucccauuuuuag

SEQ ID NO: 358567 - RNA, 64 nt, Human
caaauuaacuuugacuccuggaaguauugagucuuccuuucaaggaccauaagguacaucaguu

SEQ ID NO: 358568 - RNA, 64 nt, Human
auaugauauauauuaucuuauacugaaaaaaaauuccuuucagauugggguguuagaagugcac

SEQ ID NO: 358569 - RNA, 64 nt, Human
uuuuuucccccuucucagcuguagauaugauaucuccuuucagggccccagcuuaagggcaaag

SEQ ID NO: 358570 - RNA, 64 nt, Human
uaauuugauugcuugcuaaugguacuaguaguacuccuuucagaagaaaaaauggagcgauuua

SEQ ID NO: 358571 - RNA, 64 nt, Human
gccugggagugauggauuuuaaugugcuccagaguccuuucagaagguggucauuucccuuggc

SEQ ID NO: 358572 - RNA, 64 nt, Human
cuuuguuuuaguuucuuugguuuuuauuuuguaguccuuucaguuauuuuuaaugugccaaaaa

SEQ ID NO: 358573 - RNA, 64 nt, Human
uaguauuucucuauacguauugguacuugaagauuccuuucaaaagaaauccagcguuuuccua

SEQ ID NO: 358574 - RNA, 64 nt, Human
uaagaaguaaaaacucagaauguaccaucuuguuuccuuucaguuuauuaaauggcaucauaaa

SEQ ID NO: 358575 - RNA, 64 nt, Human
uguggcuuguguuugggcgucauuuuuguauggauccuuucacuugaucauaugacgaaaugcu

SEQ ID NO: 358576 - RNA, 64 nt, Human
ucaguucucauucaguauaaauaaaauuuuaaaauccuuucauaguucuauuagaaauaaguag

SEQ ID NO: 358577 - RNA, 64 nt, Human
uuuacagagccaacuugcagcaccugguuaugccuccuuucaucucaaagccaaagagcugcca

SEQ ID NO: 358578 - RNA, 64 nt, Human
gccauucugugucugcaguauugucauaaaauuguccuuucauucuuuugaagauauuacaaaa

SEQ ID NO: 358579 - RNA, 64 nt, Human
ugccaucaacuuuguuuccucaucucaaauaaaguccuuucagcaaguucuuuuguguuugugc

SEQ ID NO: 358580 - RNA, 64 nt, Human
cuguggcaucuagccagaagaaauugaggauguuuccuuucacagcugcuccaagccuguugcc

SEQ ID NO: 358581 - RNA, 64 nt, Human
cagccauaguauagugugucacucgugguugguguccuuucaugcuucugcccugucaaagguc

SEQ ID NO: 358582 - RNA, 64 nt, Human
cauuugauauuuuaggauauuuuucuagguuuuuuccuuucauuuuauucucuucuaguuuuga

SEQ ID NO: 358583 - RNA, 64 nt, Human
uuuuuuuuaauuugcuagguuuguauauagaagauccuuucauuaucaagaaugaguaugguug

SEQ ID NO: 358584 - RNA, 64 nt, Human
aaaaugcaucacauauucauauuguucaauaauguccuuucauuuguuucugauuguuuucauc

SEQ ID NO: 358585 - RNA, 64 nt, Human
cccuuucagacugagaaggggacaaaaagaccuuuccuuucauguccagaagaauguauguaac

SEQ ID NO: 358586 - RNA, 64 nt, Human
cuuaaaagugggcuuugaagugugugcugcuuacuccuuucaucuuucuccccgcuuccccagu

SEQ ID NO: 358587 - RNA, 64 nt, Human
ccuucuucauuggaugugaucugaacuuuuuuucuccuuucaacauacuuaggcuguggagugc

SEQ ID NO: 358588 - RNA, 64 nt, Human
gugugggucugacccacaccagcccuguguccuguccuuucagucauuugucccugcguaauuu

SEQ ID NO: 358589 - RNA, 64 nt, Human
guuuucuaaccugugacuuuuugaaaugaauuauuccuuucagucuuuauuuuucaaagaaaca

SEQ ID NO: 358590 - RNA, 64 nt, Human
uuuugaugguuugaaugcuugcuuucuuguaguauccuuucacuucuuaaaggaaacaaagggg

SEQ ID NO: 358591 - RNA, 64 nt, Human
accuuuuuuaugcuuauuuuugucaaacauguacuccuuucauacggguggcuuuuacaaggca

SEQ ID NO: 358592 - RNA, 64 nt, Human
uagggcuuaauaagcagccguuugcuaaugugcuuccuuucaaaggguuggaccuuuaaauugc

SEQ ID NO: 358593 - RNA, 64 nt, Human
uauuccaggaucuaaaugaaugggaauuuauaauuccuuucauagacucaaaccugaaagcaga

SEQ ID NO: 358594 - RNA, 64 nt, Human
ccaggcucuaggccaggcucucuaagcacauuucuccuuucauucccccuaaaaacagagugac

SEQ ID NO: 358595 - RNA, 64 nt, Human
cccaggcaggucugcaagggcccagagugaaccguccuuucacacaucugggugcccugaaagg

SEQ ID NO: 358596 - RNA, 64 nt, Human
uguuccccucacuuggaggaaccagcacucuccauccuuucagaaagucuccaagccaaguuca

SEQ ID NO: 358597 - RNA, 64 nt, Human
uagauaucaguugaaugccuuauauuguauacauuccuuucaaauaaagaccuugagaaaacag

SEQ ID NO: 358598 - RNA, 64 nt, Human
gcccccagggucuuccucauccaccacuucugguuccuuucaucuggaaagaagaccucuucca

SEQ ID NO: 358599 - RNA, 64 nt, Human
gcacuaguccuuuacagaugaccauucugaugucuccuuucaucuauuuauuuaaauauuuauu

SEQ ID NO: 358600 - RNA, 64 nt, Human
cuggaugugcagcaaguuuuuaugcaauaagccuuccuuucaggucucuaaaagcuccugcucu

SEQ ID NO: 358601 - RNA, 64 nt, Human
ggagcucccagggcccaaggaggagaaugcugccuccuuucagucuggucuacacccacuuucu

SEQ ID NO: 358602 - RNA, 64 nt, Human
uuuaccaaacuuaacuggauuaauauaccaaugauccuuucaaauuauaugacauaaacuuauu

SEQ ID NO: 358603 - RNA, 64 nt, Human
uaacauuuauuucaugucaguacagggugcuuuuuccuuucagggacauucuggaauuguauug

SEQ ID NO: 358604 - RNA, 64 nt, Human
ugcuggugagggcuggcccuaaacauccaccuaauccuuucaaaucagcccggcaaaagcuaga

SEQ ID NO: 358605 - RNA, 64 nt, Human
ccucaaauaugaucagagaauuguggaaaagacauccuuucaauguaaugaaauugauaguacc

SEQ ID NO: 358606 - RNA, 64 nt, Human
acuguuuuaaugcuuuacgacuaaacucaucugauccuuucaucagcccuagaggguagaaagu

SEQ ID NO: 358607 - RNA, 64 nt, Human
gugggaaaccucaaagaugguugcccauuuuaaauccuuucaucucucaucucucuuucuucuc

SEQ ID NO: 358608 - RNA, 64 nt, Human
cagguugguucacacagugaugcagggacucagcuccuuucauccugugcucugcccuccccgg

SEQ ID NO: 358609 - RNA, 64 nt, Human
agcuuggucauaauagauccaguguuuuucagauuccuuucacugccuuaaucuuugcaacagg

SEQ ID NO: 358610 - RNA, 64 nt, Human
uagaagcagggaaguauuguuagucuagcuuauuuccuuucagucuuuuuucaauauuuuuaua

SEQ ID NO: 358611 - RNA, 64 nt, Human
uccuuguccaggaaacucagaucccggccuggcuuccuuucaugagaggagcaggccuuggaca

SEQ ID NO: 358612 - RNA, 64 nt, Human
ggugggcagaaugcagaguagacucgggggaggauccuuucacuuuccgcuuccccuucugaug

SEQ ID NO: 358613 - RNA, 64 nt, Human
cacagcuguuggugguugggccagggcggcuuccuccuuucagaaugcuaggguggcucucacc

SEQ ID NO: 358614 - RNA, 64 nt, Human
agaggcucucauuuccugugucuuguauauucaguccuuucaauacguccaccuggaggcucac

SEQ ID NO: 358615 - RNA, 64 nt, Human
cugauauucaaauggacaaacugccaguuuuguuuccuuucacuggccacaguuguuugaugca

SEQ ID NO: 358616 - RNA, 64 nt, Human
cugcagaggaaugaaacuacuuacaacauuuaauuccuuucauaauaugaaagaauugauacaa

SEQ ID NO: 358617 - RNA, 64 nt, Human
uuacagauuucuauuuuugucaaaacuucaugguuccuuucaagaucuuuuuugccaaaacauu

SEQ ID NO: 358618 - RNA, 64 nt, Human
auugacuuuuacacacauucacacaagaaaaaaauccuuucaaaauucuuaaaucuucuguucc

SEQ ID NO: 358619 - RNA, 64 nt, Human
aauccuuugaaagagcuccaaauugguggcauuauccuuucaaaaucucagggauuugggauga

SEQ ID NO: 358620 - RNA, 64 nt, Human
cugucaacaauaaaucuaacccuaguuguaucccuccuuucaguauuuuucacuuguugcccca

SEQ ID NO: 358621 - RNA, 64 nt, Human
aaugauuggaacuuuuaaaccuccccuccucuccuccuuucaccucugcaccuaguuuuuuccc

SEQ ID NO: 358622 - RNA, 64 nt, Human
acauccugaggcuuaaaacccugaugcaaacuucuccuuucagugguuggagaaauuggccgag

SEQ ID NO: 358623 - RNA, 64 nt, Human
ccugauuuucuaaucguagccacucaaggaacaguccuuucauaguaccccaaguauuucaauu

SEQ ID NO: 358624 - RNA, 64 nt, Human
gcacggagccugccugccucugccguccucaguuuccuuucaugaggcuucuagccaaagauga

SEQ ID NO: 358625 - RNA, 64 nt, Human
cagcccccaaacagcccagugccgacaccauuguuccuuucacacuuuccuuuguugcaugcag

SEQ ID NO: 358626 - RNA, 64 nt, Human
ccuuuccccugcucccugcccagcuacggggcccuccuuucagccuugaccccuuccugguugc

SEQ ID NO: 358627 - RNA, 64 nt, Human
uuuucacuauucauuuagguuuuuauacuccaccuccuuucaaaaaagauuuaagauguacgac

SEQ ID NO: 358628 - RNA, 64 nt, Human
gggguucagccgagcccaagacucaaagcugcuuuccuuucaggauuuguaguaacguaaggug

SEQ ID NO: 358629 - RNA, 64 nt, Human
gaguacgggcuguccaaaguuuacauuuucauuuuccuuucagggauuuguggggucagggagg

SEQ ID NO: 358630 - RNA, 64 nt, Human
ggaaaacaggauaaucgugguguaaaugaguguuuccuuucaaaguccacugcagagcuuuuau

SEQ ID NO: 358631 - RNA, 64 nt, Human
gccuuaggagacuggaaguuuaaaaauguacaaguccuuucagugaugagggaauugauuuuuu

SEQ ID NO: 358632 - RNA, 64 nt, Human
aagcuaccuuuccugaaaggggaggagggcacuguccuuucagacaaagcuuguacaaauuccu

SEQ ID NO: 358633 - RNA, 64 nt, Human
ggcccugcaggacuggcucuccauuuccugccucuccuuucaccaagcucuguuuuggccuuuc

SEQ ID NO: 358634 - RNA, 64 nt, Human
auuaaaggcugauggguggauuagcuaccccagcuccuuucauaagacacaaagacgugcacag

SEQ ID NO: 358635 - RNA, 64 nt, Human
gcgcuauguuaaguugucuuauuaaguaauugaguccuuucaaugucuucuugagguauguauu

SEQ ID NO: 358636 - RNA, 64 nt, Human
caggcagcgaugcugagccaccuccuccgagccuuccuuucacacagaccaccccggaggacac

SEQ ID NO: 358637 - RNA, 64 nt, Human
ccuuaauguuagcacagaggacuuauucaaccuguccuuucagggaguuuauuggaggaucaaa

SEQ ID NO: 358638 - RNA, 64 nt, Human
ugugcccaggagcuagacugccuugaggcugcuguccuuucacagccauggaguagaggccuaa

SEQ ID NO: 358639 - RNA, 64 nt, Human
cccaacacuacucacucaguagcuagcagccccuuccuuucaacugggaguguuauuagaauga

SEQ ID NO: 358640 - RNA, 64 nt, Human
cccaaaguuaggccuccuauaauguccaaaacauuccuuucagccuuuuuauuucuuacuguac

SEQ ID NO: 358641 - RNA, 64 nt, Human
uggauauuguauuacccuggguauuaaaaagaacuccuuucacauuuuaaaauaacaaucugag

SEQ ID NO: 358642 - RNA, 64 nt, Human
uguauaaaauaagaaauaaauacaguacucaacuuccuuucauauuagcaucaucaacccucua

SEQ ID NO: 358643 - RNA, 64 nt, Human
uauguggaaauacccaaagauaauagugcauagcuccuuucagccucuagccuucacuccuggg

SEQ ID NO: 358644 - RNA, 64 nt, Human
cccaccugccccuuucuuucaaucccacgcuguuuccuuucaaaguucugggaggacgaacuca

SEQ ID NO: 358645 - RNA, 64 nt, Human
ccuuuuuugccuguuguaaugugcaggacccuucuccuuucaugggagagacagguaguuaccu

SEQ ID NO: 358646 - RNA, 64 nt, Human
acuuacuuuuucauguauauccaggcuauaaauauccuuucaaaucauguucuuauaccuaauu

SEQ ID NO: 358647 - RNA, 64 nt, Human
cuggcuacagaccaggacguggcuuguguucuguuccuuucacaaaagcucucugggaccuuca

SEQ ID NO: 358648 - RNA, 64 nt, Human
uuagcucauggcuuuaucuuauuugucccccuccuccuuucacgcuccaguuuauaaagaaaca

SEQ ID NO: 358649 - RNA, 64 nt, Human
uuuuuaaaucgucagaaggcaacauuuaccauguuccuuucagucuauccaaaguagcaacuua

SEQ ID NO: 358650 - RNA, 64 nt, Human
caauucauuccuucaucucuuugccaaguuguuuuccuuucagggccuguccuuccaguuuaga

SEQ ID NO: 358651 - RNA, 64 nt, Human
uagucacauccguuugacuuugguugugacaucuuccuuucaggaugauggaauuagaugcagu

SEQ ID NO: 358652 - RNA, 64 nt, Human
ucuaaguggacagcucagaauaauuuagcauauuuccuuucacacuuaaaguucuuaagaugag

SEQ ID NO: 358653 - RNA, 64 nt, Human
ccuccccugugcuugugccuugucccaaaauaaauccuuucagaauguagcacucacgcccuaa

SEQ ID NO: 358654 - RNA, 64 nt, Human
uaaauguauaauaaacaggaaccugaccuuuaccuccuuucagcuguuucaaacaggugccagg

SEQ ID NO: 358655 - RNA, 64 nt, Human
agguuauaacaguauaauauucuuuucuaaguuuuccuuucagauuuacuguuauguuggcuuu

SEQ ID NO: 358656 - RNA, 64 nt, Human
uuuaaaguuugagguacacugucuuccugugguuuccuuucacaugccaucccuuaaaauccca

SEQ ID NO: 358657 - RNA, 64 nt, Human
ucaacuccacccaucaucauuuggucaugaagcauccuuucauucuucuucuucuuuuuuuugg

SEQ ID NO: 358658 - RNA, 64 nt, Human
uuaauaguuaauauuagaaacucuuuaauaguuuuccuuucaguuugugagcucuucucugucg

SEQ ID NO: 358659 - RNA, 64 nt, Human
cuguguaugugugaaugugagagagacacagcccuccuuucagaaggaaaggggccugaggugc

SEQ ID NO: 358660 - RNA, 64 nt, Human
uggccuucuggccagagguccuccuggaagccccuccuuucagugccuggcugcagcggugcua

SEQ ID NO: 358661 - RNA, 64 nt, Human
gaucuccaggcccagccuggccccaaauguucuuuccuuucauccucagcaagugcugagucug

SEQ ID NO: 358662 - RNA, 64 nt, Human
cuggacaggagagacaccgccugcggugguucauuccuuucagccaucguccuuuccuccggcg

SEQ ID NO: 358663 - RNA, 64 nt, Human
cugucuccugaggcccagcugggccaggacuccauccuuucagaugccccugcaggccuggggc

SEQ ID NO: 358664 - RNA, 64 nt, Human
guagccuuagcaaugcuacaggguuauaggccucuccuuucacauuccagacaauggagagugu

SEQ ID NO: 358665 - RNA, 64 nt, Human
uugaucccagagagcagcuucagugacaaacauauccuuucaagacagaaagagacaggagaca

SEQ ID NO: 358666 - RNA, 64 nt, Human
guuuuucuuugcaaaaccccuccacaaaagcaaauccuuucaagaauggcaugggcauucugua

SEQ ID NO: 358667 - RNA, 64 nt, Human
gguuugcagcacuuugucaucauucuucauggacuccuuucacuccuuuaacaaaaaccuugcu

SEQ ID NO: 358668 - RNA, 64 nt, Human
caaaagggauaaaagccaauuugucuguuacauuuccuuucacguauuucuuuuagcagcacuu

SEQ ID NO: 358669 - RNA, 64 nt, Human
uucccucccuuccucucccaccaugcgaugagcauccuuucaggccagugucugcagagccuca

SEQ ID NO: 358670 - RNA, 64 nt, Human
uguuuugaucuucuuguuuucugacuuggaaguauccuuucaaaaaaacucuuaagauaucuag

SEQ ID NO: 358671 - RNA, 64 nt, Human
uuugaagucacacuguaaccucagucuaccccucuccuuucacuccuuuccucccucccucgau

SEQ ID NO: 358672 - RNA, 64 nt, Human
cagaaaaagaggaauaauagaccaauggauuuucuccuuucaccaguauguuuggaacccucug

SEQ ID NO: 358673 - RNA, 64 nt, Human
uaaucaaaagagcucuaaauuuguaauuucuuucuccuuucaaaaaaugucuacuuuguuuugg

SEQ ID NO: 358674 - RNA, 64 nt, Human
auucaguaagauguuauuuuugaggaguuccugguccuuucacuaagaauuuccacaucuuuua

SEQ ID NO: 358675 - RNA, 64 nt, Human
gaagguugguucuuccuguuauucucucuggcuuuccuuucaacccacuuauuuucagaggccu

SEQ ID NO: 358676 - RNA, 64 nt, Human
gccguucucaugcaaaauaccugugucagaauacuccuuucauccaucacucagccagagucuu

SEQ ID NO: 358677 - RNA, 64 nt, Human
uuuguucuguucugcugccuuuuacguuuucuuguccuuucaaaaguguucuugaaagaaacaa

SEQ ID NO: 358678 - RNA, 64 nt, Human
agaguggugagauaguaaaacacuuauucccucauccuuucagguuuucagguugcccauuuau

SEQ ID NO: 358679 - RNA, 64 nt, Human
gccaggguguaggauucauucuccauguaaaguuuccuuucauccugccuagccauccccaagg

SEQ ID NO: 358680 - RNA, 64 nt, Human
uuuuuauuucuaaaugagacgaaaugcugauguauccuuucauucagcuaacaaacuagaaaag

SEQ ID NO: 358681 - RNA, 64 nt, Human
uggagacggugaucuugucuuuaaaacaugauaguccuuucaguauaaugucuuagauuaaaga

SEQ ID NO: 358682 - RNA, 64 nt, Human
uagccaguaucuguaaauaccucaguaauauggguccuuucauuuuuccagccaugcauuccua

SEQ ID NO: 358683 - RNA, 64 nt, Human
accugcaggcagauggaccggaggguuuucugcuuccuuucaaccagauaacuuccuaagugga

SEQ ID NO: 358684 - RNA, 64 nt, Human
uauugaucuuaauaguaugccccuccuuccccuguccuuucauuucucuauccaaguagcaguc

SEQ ID NO: 358685 - RNA, 64 nt, Human
uuccucuuuaggaacccaccagagggcagcaagcuccuuucacuucgcuaguaagaaccccucc

SEQ ID NO: 358686 - RNA, 64 nt, Human
agacaucugaaaagaaugaugucucugaaagcuguccuuucagaugagggagaaaugaaggauu

SEQ ID NO: 358687 - RNA, 64 nt, Human
ugccggaagcagaagcugggaaaauugaggagaguccuuucagugucgagguauaguaaaaucc

SEQ ID NO: 358688 - RNA, 64 nt, Human
cuauugaccacgagucucacuucaguuucccaguuccuuucaaccucuuucugauagauuuccu

SEQ ID NO: 358689 - RNA, 64 nt, Human
ugggguuucuggguuuuuuccuuuucuuuuucuuuccuuucauuuuuuuucuuuguaaugcacc

SEQ ID NO: 358690 - RNA, 64 nt, Human
aaugauaaugauuaacuuauauugcauguucucuuccuuucacuuuuuucaguuucuacauuuc

SEQ ID NO: 358691 - RNA, 64 nt, Human
aauuuuaguacaaaucuuaaauauuuuuaauaaauccuuucauuuuaaaaagagaauugccaau

SEQ ID NO: 358692 - RNA, 64 nt, Human
uguguucuaagaucuccauugaacagcacugauuuccuuucauuagcaaagugaucuuugucuc

SEQ ID NO: 358693 - RNA, 64 nt, Human
uggcagcuugagauugggcaggagcauucgaucuuccuuucaccucccugccaugcuggggucc

SEQ ID NO: 358694 - RNA, 64 nt, Human
uauggcaacaucuauuuauuaaccaaguuuccuguccuuucacauuguuuuuugcuaccucuuc

SEQ ID NO: 358695 - RNA, 64 nt, Human
cgauguuuggcuaucaagucauuaauuacuguccuccuuucacugagcuuuauucaaauuuuga

SEQ ID NO: 358696 - RNA, 64 nt, Human
acacaaaagggcaugaaaaacuaacugcuagcuuuccuuucauuucaaaaguccaagaauuucu

SEQ ID NO: 358697 - RNA, 64 nt, Human
cuuaccagucccacccugaucucauggcugucucuccuuucauugucagacucccccuggucua

SEQ ID NO: 358698 - RNA, 64 nt, Human
caacauccucugauucuaggugugguguugacuguccuuucaaggaaaaacuugcaauagaggg

SEQ ID NO: 358699 - RNA, 64 nt, Human
agcugagcaguguguuaugggaagcugcucaauuuccuuucauucaauuccaccuccuuccuga

SEQ ID NO: 358700 - RNA, 64 nt, Human
ggagggccagguauauucacuugugucuucuggguccuuucauugcugacaggcugugauggcc

SEQ ID NO: 358701 - RNA, 64 nt, Human
gacugaacagaaggaaacagcuguaccucuaagcuccuuucacagaaaucgucaucugccuugg

SEQ ID NO: 358702 - RNA, 64 nt, Human
uauacagacuagcugaggugucaaguccugccuuuccuuucaucaucccaaauuuccccugcca

SEQ ID NO: 358703 - RNA, 64 nt, Human
ggggggguggggacagagaaguuaagagcuuucauccuuucacggaauacaguuucuagaccga

SEQ ID NO: 358704 - RNA, 64 nt, Human
cccuuuuaagguuucaacaaauuucauugcacuuuccuuucaauaaaguuguugcauucccaau

SEQ ID NO: 358705 - RNA, 64 nt, Human
aauaauugccguuaggcuucacaguagugcuuuuuccuuucacuuggauuugcauuuuaaccug

SEQ ID NO: 358706 - RNA, 64 nt, Human
gggacucauccugugacuuuguaaccacacucauuccuuucaaacacagaggaggaauuauugc

SEQ ID NO: 358707 - RNA, 64 nt, Human
aauaauguacugaauucuuuaucccauuuuaucauccuuucaguuuuuauuaaucuacuguauc

SEQ ID NO: 358708 - RNA, 64 nt, Human
uucauguucaguuuuuuaaaaauagacuguaguauccuuucauuggagaauuuacaaaaauauc

SEQ ID NO: 358709 - RNA, 64 nt, Human
ucauuuacagguaugugaaacaagaaguucuggguccuuucaucauaagggagaagcuucagaa

SEQ ID NO: 358710 - RNA, 64 nt, Human
uuucuauaaacacuauaagugauaguuucccccauccuuucauugacauuauuugccaaugcug

SEQ ID NO: 358711 - RNA, 64 nt, Human
auuuauugguuuuuuuuuaaccaucuguguacauuccuuucauaggguagaguucuaguucuag

SEQ ID NO: 358712 - RNA, 64 nt, Human
uucagauauauaagcagauaagcacagauuauuguccuuucaaguuaagaguauauaaucugga

SEQ ID NO: 358713 - RNA, 64 nt, Human
guauauuuuuaaagaauguuaguaaaggaaccauuccuuucauagggauggcagugauucuguu

SEQ ID NO: 358714 - RNA, 64 nt, Human
auagcuuucugaaaccgugcauucuguaguuucuuccuuucagugaaauugcuaaaugucaaug

SEQ ID NO: 358715 - RNA, 64 nt, Human
gaagaguuaagaccagaaguacuggaaucauacuuccuuucaggucaaaacauuuugugggaaa

SEQ ID NO: 358716 - RNA, 64 nt, Human
cauugcugccagccagcucugccuucccaucaucuccuuucaggaccgucccacaccuuuuacu

SEQ ID NO: 358717 - RNA, 64 nt, Human
ccauuuugaaucacaugaauuauuacaguguuuauccuuucauauaguuagcuaauaaaaagcu

SEQ ID NO: 358718 - RNA, 64 nt, Human
cacuuucaugcaguuuguuugaaguuaaguggaauccuuucaaaugacgagcugcagagaacuc

SEQ ID NO: 358719 - RNA, 64 nt, Human
cauuaccuuuacacauauuuauucuuauuuucucuccuuucagaguuuacauuuuuauauuuaa

SEQ ID NO: 358720 - RNA, 64 nt, Human
cuuagauaguauucucuaaggcauccacugcauuuccuuucauuugacauagcuucuguuacaa

SEQ ID NO: 358721 - RNA, 64 nt, Human
aagguucaguauuuucuuuuuaguauaacuuacauccuuucaaauaagucuuugcccucaugaa

SEQ ID NO: 358722 - RNA, 64 nt, Human
uaggagcaggugaauaaaggaucucuauaacagauccuuucaaaagaagaguuuuagagaaaau

SEQ ID NO: 358723 - RNA, 64 nt, Human
agauagucuugcauaucuuaaucgacauucccaguccuuucaccaccagaaccaacuccucuuu

SEQ ID NO: 358724 - RNA, 64 nt, Human
uuuuucaauuuaaguaauaauacauuuguuauauuccuuucaguguaaguuucuauuuggacaa

SEQ ID NO: 358725 - RNA, 64 nt, Human
uuuaggaucuguuuuuucaucgaggucucggguauccuuucaaagauagugagaagcagacacu

SEQ ID NO: 358726 - RNA, 64 nt, Human
auuaaagaaaacucaaguuagaagcauaccauuuuccuuucauggaaggguacaguauuacaaa

SEQ ID NO: 358727 - RNA, 64 nt, Human
gcaauaaaaacugucugucuccaucgucucauccuccuuucaguucguugguagagcccucaga

SEQ ID NO: 358728 - RNA, 64 nt, Human
aacgcugacuaguguggccucacugccccaggcuuccuuucagaggaaggccuguccugcugga

SEQ ID NO: 358729 - RNA, 64 nt, Human
ccagaagguucucuuguauaccugcucagucaguuccuuucacucccaauuguuggcagccauu

SEQ ID NO: 358730 - RNA, 64 nt, Human
aucucugaucuuuuuggaacaaacuguuuuacauuccuuucauuuuauuaugcauuagacguug

SEQ ID NO: 358731 - RNA, 64 nt, Human
uuuuguccuucuccaggucuuggcagcaccugucuccuuucaccccagggccugagccuggcca

SEQ ID NO: 358732 - RNA, 64 nt, Human
gagucuggaaggacugaaaccuggucauacccaguccuuucaaggggccucuuuucuacuaaua

SEQ ID NO: 358733 - RNA, 64 nt, Human
ccuuagccaagauuucaggcaucauuugcuccaguccuuucauuuucuuuaugguggaaaguga

SEQ ID NO: 358734 - RNA, 64 nt, Human
ccacaaucccuugaacauguagcacaacuuccuuuccuuucaguucugccaaaugcuacaauca

SEQ ID NO: 358735 - RNA, 64 nt, Human
uagguuguggaucuucagauaaauucugucauuuuccuuucacuuccugaaagccagggucggu

SEQ ID NO: 358736 - RNA, 64 nt, Human
uccaugugagugaauuccuggauaaagcaagauuuccuuucaauaaacgcugucacccaauggg

SEQ ID NO: 358737 - RNA, 64 nt, Human
agugaucaguauaaauuuucuugguguauccuuuuccuuucaacacagugcagauaagaguuga

SEQ ID NO: 358738 - RNA, 64 nt, Human
uuguacacauuuucuuuuauuccuucuuuuuuccuccuuucauuucccacuacgcacaaagagu

SEQ ID NO: 358739 - RNA, 64 nt, Human
cuccaccugcccagaggccaacucuguucccuucuccuuucaucccagaggggccucaucagca

SEQ ID NO: 358740 - RNA, 64 nt, Human
uuuggaauuccugagggcagccagagcuccuugguccuuucaguacuaggcagaacagcccccg

SEQ ID NO: 358741 - RNA, 64 nt, Human
agagggcagggaguuugggcuugguuuugaacuuuccuuucaauguagcaaagcauuccuaguu

SEQ ID NO: 358742 - RNA, 64 nt, Human
uuucauuuguucaaucagaagagcaaauaaccauuccuuucauguuuugaucacugaguguguc

SEQ ID NO: 358743 - RNA, 64 nt, Human
gcuauuccuugucccggcacaccuucucauuccuuccuuucagagccuaaaaccucauuugaua

SEQ ID NO: 358744 - RNA, 64 nt, Human
uucuccuuaauauguuacuuaucuacuuuuuauuuccuuucauucacuagucauuugagacuga

SEQ ID NO: 358745 - RNA, 64 nt, Human
ggcaugcaacagauuuugugcaugaaaugagacuuccuuucaguguaagagcuuaaagcaagcu

SEQ ID NO: 358746 - RNA, 64 nt, Human
gugguaacaggacugaugccgaaaugucaccagguccuuucagucuucacaguggagaacucuu

SEQ ID NO: 358747 - RNA, 64 nt, Human
ggucucaccauguaagagugauuuccgauuucucuccuuucaguugugugaaaaaacagcuggc

SEQ ID NO: 358748 - RNA, 64 nt, Human
accugcacuccaguccuggugcaacagauggagauccuuucagggagagagagagagagagagg

SEQ ID NO: 358749 - RNA, 64 nt, Human
ucaaaacguuggggaaaaauguauuugguuuuguuccuuucauccugucuguguuaugugggug

SEQ ID NO: 358750 - RNA, 64 nt, Human
ccucaggacuaggacagggugagccagugcucccuccuuucauguacuuggccugagacugacc

SEQ ID NO: 358751 - RNA, 64 nt, Human
gcacccgccagagaggggaagguaccagguugcguccuuucaggccccgcguuguuacaggaca

SEQ ID NO: 358752 - RNA, 64 nt, Human
cucuaacagcuuuuguccggagcuagacuucguguccuuucaguugguaaaugguuuucuauag

SEQ ID NO: 358753 - RNA, 64 nt, Human
agugugacaaggauugcuacuguccuacccacccuccuuucaccacaugugcacaugcacgugu

SEQ ID NO: 358754 - RNA, 64 nt, Human
cagaucauuccaggcagcauagcuuucuucacaguccuuucagaauucccaggcugaaaucagc

SEQ ID NO: 358755 - RNA, 64 nt, Human
auuuuacaucuucuccuguuagcuguucagcuuuuccuuucauauugagaacacuacacagugc

SEQ ID NO: 358756 - RNA, 64 nt, Human
ggcugcccuggugcugccacacuucaggcucuucuccuuucacaaccuucuguggcucacagaa

SEQ ID NO: 358757 - RNA, 64 nt, Human
caggaucuuaccaacaguaucauuacagcuguguuccuuucaguaguugccaucuuggccaugc

SEQ ID NO: 358758 - RNA, 64 nt, Human
ugcccuaguacuugcuuagugagccaugucauccuccuuucauuuuuggauggugacagcauuu

SEQ ID NO: 358759 - RNA, 64 nt, Human
acaaacacuaacugcugagcugggccauuugaucuccuuucaccuugcauugcugucacagcac

SEQ ID NO: 358760 - RNA, 64 nt, Human
ugguccuggcgggacuucacuauuugacuugguuuccuuucagauauucuuggcucagggccug

SEQ ID NO: 358761 - RNA, 64 nt, Human
uauuaaaucaagaugaaagaccuacaggacagauuccuuucaguguucacaucaguggcuuugu

SEQ ID NO: 358762 - RNA, 64 nt, Human
ccaggccuacaaccgucccaacugcuaauucuuuuccuuucauuuugcuuucugaaagcaguuu

SEQ ID NO: 358763 - RNA, 64 nt, Human
cucacugcaccgaguucauaaacugacugaagaauccuuucagcucuuccugacuuucccagcc

SEQ ID NO: 358764 - RNA, 64 nt, Human
guuaccccauugagcucuguuuaaauaaauauuguccuuucauguaaauuauucuggauguaga

SEQ ID NO: 358765 - RNA, 64 nt, Human
auuggauucaugcccagcgcauuagcauaguaacuccuuucagauuuuuuggagggacguuugg

SEQ ID NO: 358766 - RNA, 64 nt, Human
uguucuucuucccuagcauccuccuccccacaucuccuuucacccucuuggcuucuuauccugu

SEQ ID NO: 358767 - RNA, 64 nt, Human
ucuuauucuguggagaagaagggcgggaagaacuuccuuucaggaggaagcuggaacuuacuga

SEQ ID NO: 358768 - RNA, 64 nt, Human
ggcugucuuguucauuccauccuacauuucugacuccuuucagacucaacacaguucccuucuu

SEQ ID NO: 358769 - RNA, 64 nt, Human
ugagaaaagcccccacaucccggaaaacccacuuuccuuucacgacccacaucucaauccugaa

SEQ ID NO: 358770 - RNA, 64 nt, Human
augugccuuucuucauugcugauuuuaaucuguauccuuucacuguaauaaacuguaacuauga

SEQ ID NO: 358771 - RNA, 64 nt, Human
gggggagggaguggcucggaaggggcccccacucuccuuucaugucccugugccccccaguucu

SEQ ID NO: 358772 - RNA, 64 nt, Human
uguuccccuccccgcugcucuguagucauguugguccuuucaggcaccucuguggcauagcucc

SEQ ID NO: 358773 - RNA, 64 nt, Human
cuacauauggaaaagcccaugcguggaguuccccuccuuucaacauugcaacaacaguaacaac

SEQ ID NO: 358774 - RNA, 64 nt, Human
acgacaaagaaacauuuuacgcuagauuaaaauauccuuucaucaaugggauuuucuaguuucc

SEQ ID NO: 358775 - RNA, 64 nt, Human
gaguuacuggcacaaguuuaucuucuuccagauuuccuuucagaacacucaaagguaugaguca

SEQ ID NO: 358776 - RNA, 64 nt, Human
acuguugaguucugauuguguugaagaaggguuauccuuucauuaggcaaaguacaaaauugcc

SEQ ID NO: 358777 - RNA, 64 nt, Human
ggagucaaaauuauugcuccggcagugcuucccuuccuuucauccacuggccucguguggucca

SEQ ID NO: 358778 - RNA, 64 nt, Human
gaaaccacagaggaagauguauuuugcauguuuuuccuuucaguguucuuacacguuguaucac

SEQ ID NO: 358779 - RNA, 64 nt, Human
gagucuagucaguguagugcuuuuaaaaauuuuguccuuucauguaacuuuuuuauuuuaagag

SEQ ID NO: 358780 - RNA, 64 nt, Human
aguuauaaaaauuuuaguucauuuauuuuuaaacuccuuucagauuauuuuaccauuaggagga

SEQ ID NO: 358781 - RNA, 64 nt, Human
acugcccaaggggcucagaaccccagcaaucccuuccuuucacuaccuucuuuuuuggggguag

SEQ ID NO: 358782 - RNA, 64 nt, Human
cccaggccuuuguuucuucggcuaaagguacaguuccuuucaagagguaacagcacugggaucc

SEQ ID NO: 358783 - RNA, 64 nt, Human
gacauguauucgccuccagggggcgcugucucccuccuuucagaugccuuugcucaaagcuugg

SEQ ID NO: 358784 - RNA, 64 nt, Human
ccuuaggaacaagaaauuuacaaguagaaauuauuccuuucagaguaacaugcuguauuacuuc

SEQ ID NO: 358785 - RNA, 64 nt, Human
guuaccaaauauuuuggccucagaauuaucugauuccuuucaauuccagaaagaccuuacucuu

SEQ ID NO: 358786 - RNA, 64 nt, Human
ucauucuccugcuccucuuuucccuuagucaguguccuuucauccugauucagcucugccuugc

SEQ ID NO: 358787 - RNA, 64 nt, Human
uaguuggauuugucgcagacaaugaguuaaggaauccuuucacguuuuucccaacuuuaaaauu

SEQ ID NO: 358788 - RNA, 64 nt, Human
cugggcucuuggcucagauguguucaucaaauacuccuuucagagcuguuguggguguaaguga

SEQ ID NO: 358789 - RNA, 64 nt, Human
caggacucuauuuauacaacccugacugacagccuccuuucagcagaguuucaaagaauaugcu

SEQ ID NO: 358790 - RNA, 64 nt, Human
cuauuucuaggagcuuucucugaaucgcuaauuguccuuucaguugaaaucuaauuuauacaau

SEQ ID NO: 358791 - RNA, 64 nt, Human
gcagaagaggcuucuggaguuucgaggccauaccuccuuucaagagcuuuggauuuggggcgac

SEQ ID NO: 358792 - RNA, 64 nt, Human
auucucuguggauguugcuguaaaguaugcauguuccuuucauguguauuuaaucaugauguuu

SEQ ID NO: 358793 - RNA, 64 nt, Human
uauuuuuuaacauuuuaaguuuaacagauuguauuccuuucaaguuucuauacuugcuuaagca

SEQ ID NO: 358794 - RNA, 64 nt, Human
gugcacgugaaguuugcaaaaugcuuuaaggccuuccuuucaaagcauaguccuuuuggagccg

SEQ ID NO: 358795 - RNA, 64 nt, Human
uuuaaauuauuucauugcaaaguaauugugucucuccuuucacggggacuugucucacuagcau

SEQ ID NO: 358796 - RNA, 64 nt, Human
gucuguaaucuguucuuaugcucauuuuguauuuuccuuucaacuccaggaauauccuugagca

SEQ ID NO: 358797 - RNA, 64 nt, Human
gcccagcugaaaugauggggaaaggaguccuuaguccuuucagccucagaggucacagugggug

SEQ ID NO: 358798 - RNA, 64 nt, Human
uuagucgagacaucaucaucugagaagcaccacauccuuucagacacauccucggacacacaug

SEQ ID NO: 358799 - RNA, 64 nt, Human
gucagacuuccuaaucaaaggccugggccugcaguccuuucaucuuaaugcaacuuccuuugaa

SEQ ID NO: 358800 - RNA, 64 nt, Human
gauuauuuuagacaugauugucuguuuaaaacucuccuuucacuuuuuauccucccuggagcua

SEQ ID NO: 358801 - RNA, 64 nt, Human
uccucuuccuccuccuccuccuccuccgucugucuccuuucaccucugcgccaggucgguccuc

SEQ ID NO: 358802 - RNA, 64 nt, Human
ccccagauuggggcccgagauguggcccucgguuuccuuucauaaaggaguuguguccccagcc

SEQ ID NO: 358803 - RNA, 64 nt, Human
uaaagaaugcagaaaagcauucagcuugccuacuuccuuucauagacaugaaaagacucacacu

SEQ ID NO: 358804 - RNA, 64 nt, Human
caugccaugugguaaagccuucaaucuuuccaguuccuuucaguaucaugaaaggacucacacu

SEQ ID NO: 358805 - RNA, 64 nt, Human
uaaguaacaugggaaagcuuucaaucauuuuaguuccuuucaaauacaugaaagaacucaucau

SEQ ID NO: 358806 - RNA, 64 nt, Human
gcugggccccugcuggccgccacucuccgggcucuccuuucaaaaagccacgucgugcugcugc

SEQ ID NO: 358807 - RNA, 64 nt, Human
cuccagugucucagcucacuucccugggacauucuccuuucagcccuucugggggcuuccuuag

SEQ ID NO: 358808 - RNA, 64 nt, Human
gcaggugcaaguucauaggucuccaagaccacccuccuuucauuugcuagaaggacucacuaga

SEQ ID NO: 358809 - RNA, 64 nt, Human
gcugcuacacauccagccaucacaugcagauaauuccuuucaaaaacagcagaaagaggcucgu

SEQ ID NO: 358810 - RNA, 64 nt, Human
gacuguagcuggaguggcacaggugacccaggcguccuuucagcuccagaauguugcaagucua

SEQ ID NO: 358811 - RNA, 64 nt, Human
gcagaacugcuuuccuauguuuacccaggggaccuccuuucagaugaacugggaagagaugaaa

SEQ ID NO: 358812 - RNA, 64 nt, Human
auguaaaugugggaaagccuuucauaauuuuuauuccuuucaaaaucaugaaauaucucacacu

SEQ ID NO: 358813 - RNA, 64 nt, Human
gggguuggaacauuauuacucaacccauuucagguccuuucacauucuugagcugccauguugu

SEQ ID NO: 358814 - RNA, 64 nt, Human
cccuuccagaacuuacccaucauccccccauggauccuuucaguaaaaacccuuucaauuucca

SEQ ID NO: 358815 - RNA, 64 nt, Human
ucaggcuaaccuuugagaucacucagcucccaucuccuuucagaaaaauucaagguccuccucu

SEQ ID NO: 358816 - RNA, 64 nt, Human
cuccacccguucugccucagugguuucaaaucucuccuuucagggcuuuauuugaauggacagu

SEQ ID NO: 358817 - RNA, 64 nt, Human
cucgccgugaaugucaaugggccaauccucucuguccuuucagacacacacacaccugugucca

SEQ ID NO: 358818 - RNA, 64 nt, Human
gcauccccaccugcugcagggacagcccugacacuccuuucagacccucauuccuucccagaga

SEQ ID NO: 358819 - RNA, 64 nt, Human
ucuagaagcugcccaaauucugugguuuggggccuccuuucaaaaccagcaauggccaaucagu

SEQ ID NO: 358820 - RNA, 64 nt, Human
aaugaguguggugaggucauuagguacaauucacuccuuucacaucaguuaauuucauucuuga

SEQ ID NO: 358821 - RNA, 64 nt, Human
cucauauugaaauacauuugaacauuaguucauauccuuucauugccuuuuguuuuuccucuuc

SEQ ID NO: 358822 - RNA, 64 nt, Human
ccgcucugcagcuagcauuucaaccauauguggauccuuucauuucucagcucccuggauuccu

SEQ ID NO: 358823 - RNA, 64 nt, Human
aauuggaauuaagcuuuuguaaagcuuucccaaauccuuucaucauucuacaguuuuaugcuau

SEQ ID NO: 358824 - RNA, 64 nt, Human
cugcuacccuaacucaaacugccacaugcucguguccuuucaguggggagagugguucauuaga

SEQ ID NO: 358825 - RNA, 64 nt, Human
auuauuguuuaaauuuuugguaaaggaaguaaucuccuuucauucauugugacuuuuguucuua

SEQ ID NO: 358826 - RNA, 64 nt, Human
gccaagcagugccugccuaugaaauuucaacuuuuccuuucauacgucuuuauuacccaagucu

SEQ ID NO: 358827 - RNA, 64 nt, Human
caguagagaggaagggaacuccacugugugacaguccuuucaaucugccccuuuucagcccuac

SEQ ID NO: 358828 - RNA, 64 nt, Human
uaauuaugucccagggguauauuuagacccuguuuccuuucaggaggguccccagcugguccag

SEQ ID NO: 358829 - RNA, 64 nt, Human
ugaauuuucaauauuguggaaucacuccagaagauccuuucaugugaaguuuuuugcuggcauu

SEQ ID NO: 358830 - RNA, 64 nt, Human
cgugaaaucugccaccacuuuauaaccagaugguuccuuucacaacccugggucaaaaagagaa

SEQ ID NO: 358831 - RNA, 64 nt, Human
uucuaugcagcgaucuugggauaugaugaggggauccuuucagaugaucaugggcuggccgcug

SEQ ID NO: 358832 - RNA, 64 nt, Human
ccuggccccugccugcuggagaucagcaugccuguccuuucagucugauccauccaucucucuc

SEQ ID NO: 358833 - RNA, 64 nt, Human
gagaaagaaacugccuaagcagcacuuccccauguccuuucaccuucauguuaacgucccuucu

SEQ ID NO: 358834 - RNA, 64 nt, Human
aagacuccuucugggccaauggggcugccucuuuuccuuucaucagacacugugaaaacauucc

SEQ ID NO: 358835 - RNA, 64 nt, Human
ggcuggagguccucccccaguggccuuccucccuuccuuucacagccggucucucugccaggaa

SEQ ID NO: 358836 - RNA, 64 nt, Human
guuucggcacagacuaucccaucaagccguuggcuccuuucagcuacuacguuaccacguuccu

SEQ ID NO: 358837 - RNA, 64 nt, Human
ggaggcugugcugguggucguguagagguccuucuccuuucacauggugcagagagcgaggacc

SEQ ID NO: 358838 - RNA, 64 nt, Human
agaacauguuacgugugcaacagguaaacagaaauccuuucauaaagcaccagcaguguuuaaa

SEQ ID NO: 358839 - RNA, 64 nt, Human
uucauguuuguggaaaaaucuugcaagacauuucuccuuucacagaacugcccagguguuaaca

SEQ ID NO: 358840 - RNA, 64 nt, Human
cucugcucccgcccggcaccagcccuccaguagauccuuucacgaccuuggccucuaaggcuuc

SEQ ID NO: 358841 - RNA, 64 nt, Human
caaacccauuuauuacuggcuugaccaggacaaauccuuucagugacaggacugcugcuccugg

SEQ ID NO: 358842 - RNA, 64 nt, Human
guuacucacagcuuguaaauuacaacagaaagguuccuuucaaauaguagagcugcaccuaaag

SEQ ID NO: 358843 - RNA, 64 nt, Human
ccagauaccauuuuaacuggcccaguucauuuucuccuuucauuuuacaaaagaaaucaugcag

SEQ ID NO: 358844 - RNA, 64 nt, Human
ugcaagaagucuggccauuuuggaaagcaagguuuccuuucagcccugucuacugaccaauacc

SEQ ID NO: 358845 - RNA, 64 nt, Human
gagucaagcuccacuugaagcucacucaguaauauccuuucaauguguuuuauauuguuuugac

SEQ ID NO: 358846 - RNA, 64 nt, Human
auuucuggcacaaaugaaaaguaggacggaaagcuccuuucauucaguuuaucuuuccaggaua

SEQ ID NO: 358847 - RNA, 64 nt, Human
ggguuuucaauuccaauucuuguauuaaguuuuuuccuuucaguuuuaggugcgaaaguaauca

SEQ ID NO: 358848 - RNA, 64 nt, Human
augcagaugguuauuccagcucuggucacccgacuccuuucaccaaauugcuccuaacuggaag

SEQ ID NO: 358849 - RNA, 64 nt, Human
accaacugaugacuuaccugccuaguuaauaucuuccuuucaccuuugucuucaauauaguugg

SEQ ID NO: 358850 - RNA, 64 nt, Human
ccacacuccacucugauucaccucuuccucugguuccuuucaucucucuaccuccacccugcau

SEQ ID NO: 358851 - RNA, 64 nt, Human
ugacauaauuuuuagaauauuuauuuugaaucaauccuuucauuacgaaagacuugaaguuuug

SEQ ID NO: 358852 - RNA, 64 nt, Human
acuacagggagauuagcacuucgucuagugaaacuccuuucaucucuguccuauggccccaccc

SEQ ID NO: 358853 - RNA, 64 nt, Human
aaguacgaaaagguuuuuaagucuucgaacagucuccuuucaugacuuuaacaggauucugccc

SEQ ID NO: 358854 - RNA, 64 nt, Human
auuauuucugacacccacaagcaggguuugaucauccuuucagcuuugagauaucugcacauaa

SEQ ID NO: 358855 - RNA, 64 nt, Human
uugggugguccuguugcguggagaucuccucugguccuuucaaagggaaacgcuguugaaccuu

SEQ ID NO: 358856 - RNA, 64 nt, Human
gcacccaacuccagagauggaagccugguggccuuccuuucacagagcucagcugcucgcaggc

SEQ ID NO: 358857 - RNA, 64 nt, Human
ccaugacucagauucgaagagacagauuuuaucuuccuuucauuucuuucucuugugcauuuaa

SEQ ID NO: 358858 - RNA, 64 nt, Human
aucauguguagagccccuacugugggcaaaguccuccuuucauuacccuacagacagcuuacag

SEQ ID NO: 358859 - RNA, 64 nt, Human
auucuuguauacacauggcaaaaugugaagaaacuccuuucaucucagcagguagaggaggacu

SEQ ID NO: 358860 - RNA, 64 nt, Human
ggaguucuuccuuuccuaccccuuuucucuuuuauccuuucauauauacacaugcaaaguuuac

SEQ ID NO: 358861 - RNA, 64 nt, Human
agcagcgcggauuucucuuucucucucacucucuuccuuucauucuaguauucuuuauuauuuu

SEQ ID NO: 358862 - RNA, 64 nt, Human
ccccuuuuucuuucccuucuuuuucccuuuccuuuccuuucauuuucuuuccuuuccccuuccc

SEQ ID NO: 358863 - RNA, 63 nt, Human
auuuuaagucugcugauugaggcagggaaaacauccuuucauuuuucgaagacccuugcaucc

SEQ ID NO: 358864 - RNA, 64 nt, Human
ucauuuucuccaccuuguuuauaugguaaaggaauccuuucagcugccaguuuugaauaaugaa

SEQ ID NO: 358865 - RNA, 64 nt, Human
ucuuugaaagcuaagcuuuaaacuucauuuuauguccuuucacaaauaaauuaguuuaaaacag

SEQ ID NO: 358866 - RNA, 64 nt, Human
agugcuccagaacagcgggagcacugugcugugcuccuuucaguuucuuuuggguuuguuuuuc

SEQ ID NO: 358867 - RNA, 64 nt, Human
cacuuuuuauauaauguuuuauauauauauuuuuuccuuucaaaucagacgaugagacuagaag

SEQ ID NO: 358868 - RNA, 64 nt, Human
aaaguguuuuugcuaaauuuacaguauauauagauccuuucauauuauuuuacuaagaauguuu

SEQ ID NO: 358869 - RNA, 64 nt, Human
uggauucugaugcaauuucaauauaaaaaguuguuccuuucauaguuuuuccccccaaaagaag

SEQ ID NO: 358870 - RNA, 64 nt, Human
cuggggggauggaauugagagggagacaacuguauccuuucauagcuuuugaaaaugugggugu

SEQ ID NO: 358871 - RNA, 64 nt, Human
aaucuacaaagcaaguuguguggggacuucugcuuccuuucacauuggugcuuuuccauuuaug

SEQ ID NO: 358872 - RNA, 64 nt, Human
ccucacaacuucucugcacacaagcuucuaaaauuccuuucaaauaaaguuacuuuaauauuuu

SEQ ID NO: 358873 - RNA, 64 nt, Human
uacugcuuuuccacuugcucauauaguaaagggauccuuucagcugccaguguugaauaaugua

SEQ ID NO: 358874 - RNA, 64 nt, Human
uauccaaauaauuuaaaaaacacuuuucaccuacuccuuucaugguuauaacacauuggcagac

SEQ ID NO: 358875 - RNA, 64 nt, Human
agacauaaaggagggugaugugauuuucagcuaguccuuucacauuuucaauaaugagguaauc

SEQ ID NO: 358876 - RNA, 64 nt, Human
caacugugcucacuaggcuucaaguaaaaaguuuuccuuucaucuuugacuguaagaugucaaa

SEQ ID NO: 358877 - RNA, 64 nt, Human
acuucuagagagcucucuugccccacgccgcugcuccuuucaccuuuguaggcugggaaucgcu

SEQ ID NO: 358878 - RNA, 64 nt, Human
ucuccccuuccauuucugccuuuuguucauuucauccuuucacuucuuucccuuccuccauccu

SEQ ID NO: 358879 - RNA, 64 nt, Human
ccccuuuauuggaaugcauguuuucauugccuucuccuuucaaaguguacguuuguguguucau

SEQ ID NO: 358880 - RNA, 64 nt, Human
ucuguucaauuccuaacgcaaacuacaauaaauggugacacacguucagaagaaaucuucuuug

SEQ ID NO: 358881 - RNA, 64 nt, Human
ugcuguuacagagugugacagaggauccaugucugugacacaggacggugggaagccugagaga

SEQ ID NO: 358882 - RNA, 64 nt, Human
ggcuggcucugagagccccaggacuggcugccccgugacacaugcucuaagaagcucguuucuu

SEQ ID NO: 358883 - RNA, 64 nt, Human
acauauggacucugcacaugaaucccacccacaugugacacauaugcaccuugugucuguacac

SEQ ID NO: 358884 - RNA, 64 nt, Human
uccugccuguaagucuucccaagacagaggcccggugacacaguucagccaggacugaccacag

SEQ ID NO: 358885 - RNA, 64 nt, Human
cuucucaagcuuucuuuacugaggaauucagcuugugacacagauacaucccacuagcuuguga

SEQ ID NO: 358886 - RNA, 64 nt, Human
ucacagcaagcuguguaugaacuuguguuuuguggugacacauuaauaaucaaauugcuaaaac

SEQ ID NO: 358887 - RNA, 64 nt, Human
ggucucuugccauugagccuugaagcugccuuuggugacacacugagugaaagggacugggcca

SEQ ID NO: 358888 - RNA, 64 nt, Human
cguacuacuaaacucagcagaugaagagcuucaugugacacagggguguugugagagcugggau

SEQ ID NO: 358889 - RNA, 64 nt, Human
cugccuuccauguucauaggcccagcccaagagagugacacacagugcuggcccugagacauuu

SEQ ID NO: 358890 - RNA, 64 nt, Human
ggaaauuauuacaagcagauuaaucccucuuuuugugacacaaguacaaucuaaaaguuauauu

SEQ ID NO: 358891 - RNA, 64 nt, Human
ugagccgagauugugccacugcacuccagccugggugacacagcaagacuccaucucaaaaaaa

SEQ ID NO: 358892 - RNA, 64 nt, Human
uucccugcaggagcucagccaccacugugccauggugacacaggccaaggcagacauuggcccu

SEQ ID NO: 358893 - RNA, 64 nt, Human
agcagacuguggguauccauauuuuaauugucgggugacacauguucuugguaacuaaacucaa

SEQ ID NO: 358894 - RNA, 64 nt, Human
ugggagggaguggggaggaauugcuagcuguagugugacacauuguaguguuugccaggaaagg

SEQ ID NO: 358895 - RNA, 64 nt, Human
uguauauucccuauaggcagcuggagagaucugugugacacaagaugcuuuuguacggguuccc

SEQ ID NO: 358896 - RNA, 64 nt, Human
aagcaucccuugugcaagaucacauagucaggaggugacacagggcuaagacuugaaccaaggc

SEQ ID NO: 358897 - RNA, 64 nt, Human
uuauuuucaccuguuuuuaagcuguuuccauagggugacacacuaugguauuugaguguuuuaa

SEQ ID NO: 358898 - RNA, 64 nt, Human
caaagucucacugugucacccagacuggaaugcagugacacaaucucggcucacugaaaccucu

SEQ ID NO: 358899 - RNA, 64 nt, Human
ugaaagauaauuaagaucccccguggagaaagcagugacacauucacacagcuguucccucgca

SEQ ID NO: 358900 - RNA, 64 nt, Human
caccccuugcuuccucccucuguugucugccugugugacacacaucaauggcaauaacuucuuc

SEQ ID NO: 358901 - RNA, 64 nt, Human
ccggucguccaagguggaugcugucaaugcccgagugacacaugagagcuguaugaauugagag

SEQ ID NO: 358902 - RNA, 51 nt, Human
aacuuaaaacugaacuaugaagugacacacuccuuuuuccccuccuaguuc

SEQ ID NO: 358903 - RNA, 64 nt, Human
aaguaagucaggucccuaagccccgucccaagaagugacacaaguggccaacauccacacugua

SEQ ID NO: 358904 - RNA, 64 nt, Human
acaacaaacaauggagaaaaagaauugauucuuagugacacagaagauugccuuacgcucguga

SEQ ID NO: 358905 - RNA, 64 nt, Human
auuaguuuugcaucuguuuugugaccuguuagaugugacacauucucuuuuuguuuauucccuu

SEQ ID NO: 358906 - RNA, 64 nt, Human
uuaggguacaagaagccuguucuguccagcuucagugacacaagcugcuuuagcuaaagucccg

SEQ ID NO: 358907 - RNA, 64 nt, Human
acccagaucaggaaccagggccucccuguucacggugacacaggucagggcucagagugacccu

SEQ ID NO: 358908 - RNA, 64 nt, Human
uaguagugauaccuauauuuccacauugugcauugugacacacuugucuagggaugccuggaag

SEQ ID NO: 358909 - RNA, 64 nt, Human
aaugagccacuuugaccacccucgggugcuaugggugacacaagagcuguccacuggguguuug

SEQ ID NO: 358910 - RNA, 64 nt, Human
auagcaguauauguuaauuuguguguuuuuagcugugacacaacugugugauuaaaagguauac

SEQ ID NO: 358911 - RNA, 64 nt, Human
ccaguuggaguuacucacucugauucuuccuucagugacacagaacuugaccgaagguaaacac

SEQ ID NO: 358912 - RNA, 64 nt, Human
auccauugccaccuccuguucgugaccugacagggugacacagccccuuucacacucuguccuc

SEQ ID NO: 358913 - RNA, 64 nt, Human
guacagagagcacccaggagguacacauacuaaagugacacaaagagaaugaagcagaaguaga

SEQ ID NO: 358914 - RNA, 64 nt, Human
accugagcagguuuggugaaagccaccguccuccgugacacacggcccccuuccuccugucccc

SEQ ID NO: 358915 - RNA, 64 nt, Human
ggaggcgaucaaacuaaaaugucuuaauggcugugugacacacguaaggaaaggaaaggggguc

SEQ ID NO: 358916 - RNA, 64 nt, Human
ccacagagucugauucaggaugacguggaccuccgugacacacggaggcacugugacaagggaa

SEQ ID NO: 358917 - RNA, 64 nt, Human
ugcauacacuggggcccagcagcugccuccugaggugacacagccuguaggaacauacacagcu

SEQ ID NO: 358918 - RNA, 64 nt, Human
uccucugcucuccagaggaccaagaaauaccugugugacacagacccacuucaguguguacagc

SEQ ID NO: 358919 - RNA, 64 nt, Human
agaguaccauuguuccuuauaucguuaaaucuuugugacacacuuugacaaaaauguagaaccu

SEQ ID NO: 358920 - RNA, 64 nt, Human
ugagaggcagcucuaaagcacaagaccuggaugugugacacacaguuuuggaaaaaggucugug

SEQ ID NO: 358921 - RNA, 64 nt, Human
cagggcguagggggcaucacccugcucacucucagugacacagaggacuccuugcauuuuuugc

SEQ ID NO: 358922 - RNA, 64 nt, Human
uggcuuucaucugcaguguaggucuccauagcuagugacacacaaagccuuaugagaguauucc

SEQ ID NO: 358923 - RNA, 64 nt, Human
gugacuaggacuccacagugaagaugguugacuagugacacagccccaucuaaagaaucccuuu

SEQ ID NO: 358924 - RNA, 64 nt, Human
cuaaaaaauaccuaaaaggaagcuuagaugggcugugacacaaaaaauucaauuacugucaucu

SEQ ID NO: 358925 - RNA, 64 nt, Human
uuacaaaccccugccugggucuuagcauugaucagugacacaccucuccccucaaccuugacca

SEQ ID NO: 358926 - RNA, 64 nt, Human
gaccugauagcucccuggaacuuugggucugugugugacacaugagacucacaguuggaguucu

SEQ ID NO: 358927 - RNA, 64 nt, Human
ggggucaccuagccauugaaagcagaaagcaguagugacacagcuuucccuucaaagagccauu

SEQ ID NO: 358928 - RNA, 64 nt, Human
uauauuuaugcauagcaagccuucgugaacggaagugacacacucuggauugaauaauacugua

SEQ ID NO: 358929 - RNA, 64 nt, Human
cuuaacagauacaugcugguucuccuugcugugugugacacagcagacagaggcacuauuccug

SEQ ID NO: 358930 - RNA, 64 nt, Human
uaauaauuaacuggggauaaaagaauggcaaggggugacacaaaguagcaaacugaauacuucu

SEQ ID NO: 358931 - RNA, 64 nt, Human
gcacagucugguccuuuggggcuugggcagggccgugacacagguucuggccaaugauuugcaa

SEQ ID NO: 358932 - RNA, 64 nt, Human
cagugacggagcgggacccgcccucaucccauuggugacacauguuggugucacagcccucauc

SEQ ID NO: 358933 - RNA, 64 nt, Human
acauugcuuccucugccacaaagacaauacucuggugacacaugucuagacccagcacaggcug

SEQ ID NO: 358934 - RNA, 64 nt, Human
aacaaaguacgugaaaaucagguuucaauagaaugugacacaacgugcaaggaaaugaagcgga

SEQ ID NO: 358935 - RNA, 64 nt, Human
gcauucuuguuaauuuuuuuuuuggcuuuggaaugugacacagccuuuuugaucauuucuuuga

SEQ ID NO: 358936 - RNA, 64 nt, Human
uauucgaggaggaggcuguuauuuugggccugaugugacacaacaguugcuacaaaaauacaac

SEQ ID NO: 358937 - RNA, 64 nt, Human
cuuuauguuauguuuacugauggggauacaagaugugacacacccuucuuuauuugaaacaaac

SEQ ID NO: 358938 - RNA, 64 nt, Human
augucauuacaaccuggaaaauaaaucacccuaagugacacaaauugaagcauguacaaauuau

SEQ ID NO: 358939 - RNA, 64 nt, Human
acaagagcucaggacuccagcccacugccacugggugacacagacugucguuugggcauuauuu

SEQ ID NO: 358940 - RNA, 64 nt, Human
gcuucagugggggcuccaggguugcagaguaugagugacacagaccgggacuauuccauuagcc

SEQ ID NO: 358941 - RNA, 64 nt, Human
gucaugcccuucucaugugggcagcuucugaguggugacacagcaagccuuuguuccuguccug

SEQ ID NO: 358942 - RNA, 64 nt, Human
guuucugccaacugugaaguauccuccuggagcagugacacaaucuuggcggagcauugcuacc

SEQ ID NO: 358943 - RNA, 64 nt, Human
aaaaagggacaggaggcaugggauagcaggucuggugacacagcuagggucuuccuagcagcuc

SEQ ID NO: 358944 - RNA, 64 nt, Human
ucccacacagaauauacauuguccucuuugacuagugacacauuguacaugguacgaauggcag

SEQ ID NO: 358945 - RNA, 64 nt, Human
cggggucuugcucugucucccaggcuggagugcagugacacaaucucagcucacugugaccucc

SEQ ID NO: 358946 - RNA, 64 nt, Human
acgccgcugcacgagagcgaggcugaagaacuuugugacacaauaguccaccucccugcaaagg

SEQ ID NO: 358947 - RNA, 64 nt, Human
ggcuacugugaggcucuucuaacacccucagucagugacacacccaucccauccaccacuuccc

SEQ ID NO: 358948 - RNA, 64 nt, Human
uuuagcuguucaaaucuguuugucucuugaaacagugacacaaagguguaauucucuaugguuu

SEQ ID NO: 358949 - RNA, 64 nt, Human
gcccccagccauggugaggaagccccaagccauggugacacacagcagcacugcagauagccag

SEQ ID NO: 358950 - RNA, 64 nt, Human
uugccuuuguuguugaaaaaguguugcacucugugugacacaauuacagcugauugcagccuca

SEQ ID NO: 358951 - RNA, 64 nt, Human
cuagcaggguuugaagucuguggcuuaucagccugugacacagaguacccagugaaaguggcug

SEQ ID NO: 358952 - RNA, 64 nt, Human
uguaggucacauuaaauacugacuugagcagugggugacacaacacaguguuugucuuccacag

SEQ ID NO: 358953 - RNA, 64 nt, Human
ugaaugccucuuaucuuccuaagcggaguuuuaggugacacaggaugaagcagaagagaucuac

SEQ ID NO: 358954 - RNA, 64 nt, Human
acccugggucagggacguuccaauggccaagagagugacacagccaggacccugguggacagcc

SEQ ID NO: 358955 - RNA, 64 nt, Human
ugagccaaagaagaucaccugggccagggccuacgugacacaaggagacaugggcuagggaagg

SEQ ID NO: 358956 - RNA, 63 nt, Human
auugucacagagccccccgaauacucugucuauagugacacacuguaggugucauaaauuuua

SEQ ID NO: 358957 - RNA, 64 nt, Human
guguaaguucugaaugguuccuugcugacuuugggugacacauguaccacauacuggcucaguu

SEQ ID NO: 358958 - RNA, 64 nt, Human
gguguguguauucuguuugcaucucccugucacugugacacaccuagauguguguuacuucaau

SEQ ID NO: 358959 - RNA, 64 nt, Human
gcagccugucacccauccuaaucugggagagaaggugacacagcugggcccagacccuggagag

SEQ ID NO: 358960 - RNA, 64 nt, Human
ucuggggugcacauggggugggaaugcuccgggggugacacaggccacgguggcuccagccagg

SEQ ID NO: 358961 - RNA, 64 nt, Human
gcugggcaagggcugcuucggccaggcuaucaaggugacacaccgugagacaggugaggugaug

SEQ ID NO: 358962 - RNA, 64 nt, Human
gcucaguaaagcacuugcaaccgucuguuaugcugugacacauggccccucccccugccaggag

SEQ ID NO: 358963 - RNA, 64 nt, Human
uuuucaguaauauuuuuugguccacuguauuccugugacacagugcauuaucuguucuuguauu

SEQ ID NO: 358964 - RNA, 64 nt, Human
auacuucaacaguuucauaaaacgauuccccugagugacacaagaacauaaaauguuaauauca

SEQ ID NO: 358965 - RNA, 64 nt, Human
cugauuacaaaacgugcaauucaggagcccagcagugacacacuuaucacgccuaggcuccagu

SEQ ID NO: 358966 - RNA, 64 nt, Human
uuugcuuuaaaucucugguaguuuuuccaccccugugacacaauccuaauagacaguguccugu

SEQ ID NO: 358967 - RNA, 64 nt, Human
cugggugacaaaauuaccuguacaccacaccccugugacacacaacuuacucauguaacaaacc

SEQ ID NO: 358968 - RNA, 64 nt, Human
aauucaguagaguguaacuuagagaauauugcaagugacacauugaauccugcccgucagggca

SEQ ID NO: 358969 - RNA, 64 nt, Human
cauaucguugaccugcaaaauucaccuuuggaacgugacacaauguuaggcauaccuccuuuuu

SEQ ID NO: 358970 - RNA, 64 nt, Human
acagcgaggagcagacccaggcagggccgccagggugacacaggccacccuuccuugccuucag

SEQ ID NO: 358971 - RNA, 64 nt, Human
ugagccaagauugcaccacggcacgcuagccugggugacacagcaagacuccaucucaaaaaaa

SEQ ID NO: 358972 - RNA, 64 nt, Human
ugagccgagaucacgccauugcacuccagccugggugacacagugagacuccaucucaaaaaaa

SEQ ID NO: 358973 - RNA, 64 nt, Human
cugcugugcuuccccguccacguguaucucugcugugacacacugagcugacgcacauuuccag

SEQ ID NO: 358974 - RNA, 64 nt, Human
cccuugagggacucccaaacuguuuuccaauguggugacacaauuuuauaucccaucaacaggg

SEQ ID NO: 358975 - RNA, 64 nt, Human
gcgggacgguuccacacagccccggccuuucgcggugacacaaugguuagggaacgguuagaac

SEQ ID NO: 358976 - RNA, 64 nt, Human
ugucuggagacguuucuucuguggaagagaagaagugacacaaaccuauacuucauaugcugcu

SEQ ID NO: 358977 - RNA, 64 nt, Human
uuaggcuuugcuauauccccaggccaaauagcaugugacacaggacagccauaguauagugugu

SEQ ID NO: 358978 - RNA, 64 nt, Human
gacccacacaaggagccugcacagcaagccagcggugacacaccugcaggugucaggcauggca

SEQ ID NO: 358979 - RNA, 64 nt, Human
uugcugugugguguuucaagugcauuuaaaaugugugacacagaaacggcacacucuuccacau

SEQ ID NO: 358980 - RNA, 64 nt, Human
uucaaaaccaaggaagcagccucagaguggucgagugacacaccucacgcaggcugaguccaga

SEQ ID NO: 358981 - RNA, 64 nt, Human
gcuuguaaucaagccuuuauggcugcugggcugagugacacaagcacuuuaauggccuggaggg

SEQ ID NO: 358982 - RNA, 64 nt, Human
ccaaacauuguugcuaaucccuauuuuucuuuaagugacacacauucuccugucucuggcuucu

SEQ ID NO: 358983 - RNA, 64 nt, Human
gagaggcccugccuggacccagggagaggagccagugacacaggcagagcggugcagcccuccu

SEQ ID NO: 358984 - RNA, 64 nt, Human
agaguagggacucuaccccccucuccccuuguaggugacacaugcucugcccucugaggcaguc

SEQ ID NO: 358985 - RNA, 64 nt, Human
uaagccaugccaugcccaggagacugguuucccggugacacauccauugcuggcaaugagugug

SEQ ID NO: 358986 - RNA, 64 nt, Human
guuggggaagaugcuauugggaaaccucuucuccgugacacagaauguucugggugggagccgc

SEQ ID NO: 358987 - RNA, 64 nt, Human
augggcgcagcccugccacuuaacuuguuuguuggugacacaguuguucagaguggggagaauu

SEQ ID NO: 358988 - RNA, 64 nt, Human
agauguuuguguaucuguuuacauccagaguucugugacacaugccccccagauugcugcaaag

SEQ ID NO: 358989 - RNA, 64 nt, Human
caugaggucugccagaaggcccugcguguggauggugacacagaggauggcucuaugcugguga

SEQ ID NO: 358990 - RNA, 64 nt, Human
ugagccaagaucauaccacugcacugcagccugagugacacaguaagacugucuccaaaaaaaa

SEQ ID NO: 358991 - RNA, 64 nt, Human
gagguuguucuacuccauacaguucacacugauugugacacauucuuaguagcuagugucuguu

SEQ ID NO: 358992 - RNA, 64 nt, Human
agaugucugcuggcagcaggcaggguucauucuggugacacagcaacagaugccuggccuggga

SEQ ID NO: 358993 - RNA, 64 nt, Human
cgcaagaugucuuagaguaggguuaagguucucagugacacaagaauucaguauuaaguacaua

SEQ ID NO: 358994 - RNA, 64 nt, Human
cuaacuuccccgugcuguggugugaccugaguuggugacacaggccacagaccccagagcuugg

SEQ ID NO: 358995 - RNA, 64 nt, Human
gugccaaacacacacuaacuguccuggccucuccgugacacaagucucuucccagccuuccuca

SEQ ID NO: 358996 - RNA, 64 nt, Human
aacacgauuuucaagauucuaaagcucaauucaagugacacauuaaugauaaacucagaucuga

SEQ ID NO: 358997 - RNA, 64 nt, Human
gggcgcgaccugcuggcgcgcgccggauguuucugugacacacaaucagcgcggaccgcagcgc

SEQ ID NO: 358998 - RNA, 64 nt, Human
cacuuuggaccuuacgaucaggcacaggucaggggugacacagacucauccugaacagcauggc

SEQ ID NO: 358999 - RNA, 64 nt, Human
cccuccagcacaaacacaaggucauggccacacugugacacacuacaccacacacaacagccaa

SEQ ID NO: 359000 - RNA, 64 nt, Human
ucaaaguguuuaauuguauaaaacaguguuuccagugacacaacucauccagaacugucuuagu

SEQ ID NO: 359001 - RNA, 64 nt, Human
ggcacacaacauuauuuggggaaaaacaccucuagugacacauuuucuucaucugcacugauua

SEQ ID NO: 359002 - RNA, 64 nt, Human; identical to SEQ ID NO: 358989

SEQ ID NO: 359003 - RNA, 64 nt, Human
uauuucuaaaugguugaaagaaucaaagaauauugugacacaugaaaauuauaugauauucaaa

SEQ ID NO: 359004 - RNA, 64 nt, Human
acuuccuccucucucgcuugcucucucucaccaugugacacacuggcuccccuucaccuucugc

SEQ ID NO: 359005 - RNA, 64 nt, Human
cacauauuaugaauaaaugaggaagggccugaaagugacacacaggccugcaugucacuguguc

SEQ ID NO: 359006 - RNA, 64 nt, Human
acauaguauucaugacuauggauaaacuaaacacgugacacaaacacacacaaaagggaaccca

SEQ ID NO: 359007 - RNA, 64 nt, Human
ucuggacuugccuccagagacugcuccagaguuggugacacagcugucccaagggccccucugu

SEQ ID NO: 359008 - RNA, 64 nt, Human
caacagacaaaugcuccagaaaucuaugcugacugugacacaagagccucacaugagaaauuac

SEQ ID NO: 359009 - RNA, 64 nt, Human
cuuccucccuccucaggugccggaagcugcgaaggugacacauggcuuuucagacucagcaggg

SEQ ID NO: 359010 - RNA, 64 nt, Human
cagcaaggagcccgacacugauuugaucgauucugugacacaaaccccaccaauuguuaaugca

SEQ ID NO: 359011 - RNA, 64 nt, Human
gcagcuccccugccuccaggacccuguugcuauggugacacagcguuucuaggacagaggggcc

SEQ ID NO: 359012 - RNA, 64 nt, Human
guucuuugcacgccaagucucuugguuguaccaugugacacacccugugcacuggucgcugucu

SEQ ID NO: 359013 - RNA, 64 nt, Human
agcuuggaccuugguacuaccucagcugaggguggugacacaaccccuuccauuugucagcacu

SEQ ID NO: 359014 - RNA, 64 nt, Human
cccagaaaccgccuucaucuccauucggaagcaggugacacaccccuucagaaggugcccuggg

SEQ ID NO: 359015 - RNA, 64 nt, Human
ggugaagagaaccgagcaaagaucaaaauaaaaagugacacagcagcuucaccagagcauuucc

SEQ ID NO: 359016 - RNA, 64 nt, Human
gauuuuuuuuuuuuuuuaggggugggucaggguugugacacaccagcccaggugagagcugcug

SEQ ID NO: 359017 - RNA, 64 nt, Human
ggaguguguucaagugggucauguuuuugcuguggugacacaugguacaggcuuggagcuugca

SEQ ID NO: 359018 - RNA, 64 nt, Human
uugaaucuuaaaguguuuagcuaaaagcaugaaugugacacaguaaccaacuccuaaugauaac

SEQ ID NO: 359019 - RNA, 64 nt, Human
ucugucguuauuucugaaugugaagcucagagaagugacacagaguaaauggcugaucuucuau

SEQ ID NO: 359020 - RNA, 64 nt, Human
gcuuugacaaauuacaaaaggcucguuuggaucugugacacaucguuuuggggggaaugcuccu

SEQ ID NO: 359021 - RNA, 64 nt, Human
acacaacacugcaaacagaagggagaaagugucagugacacaguuuccucugaugcagcugcuu

SEQ ID NO: 359022 - RNA, 64 nt, Human
ucuccugcuccucuucggaguagaaauaaaggcugugacacaaggaagccaguggggugggagg

SEQ ID NO: 359023 - RNA, 64 nt, Human
ugcagccaccagacuuggccuccagcuguucuuagugacacacacugucuggggccccaucagc

SEQ ID NO: 359024 - RNA, 64 nt, Human
aauuuaaugaauucacaugaaagggguagucugagugacacaguuccccacuccguacuguauu

SEQ ID NO: 359025 - RNA, 64 nt, Human
auauugccuuauuucccuauggcugagccuuguugugacacaucaagcuuuucuguagauguug

SEQ ID NO: 359026 - RNA, 64 nt, Human
ccaugugcagaauuugacuuaagagagagccccagugacacaucucuccauggugggcuccagu

SEQ ID NO: 359027 - RNA, 64 nt, Human
ccucccguccagcauugaguguguacaugugugugugacacauaaauauacucauaaggacacc

SEQ ID NO: 359028 - RNA, 64 nt, Human
gaauuucuuucuuuuaauuguggcauauagguuugugacacaagaagucauacuuugguggcua

SEQ ID NO: 359029 - RNA, 64 nt, Human
aacuaaugagauuuucucucauuccgaguucagggugacacauuuugggacaucugcugguagc

SEQ ID NO: 359030 - RNA, 64 nt, Human
guucuacaaccguaagaugacaguuuucaauguagugacacaaaagggcaugaaaaacuaacug

SEQ ID NO: 359031 - RNA, 64 nt, Human
ugagccgagaucgcgccacugcacuccagccugggugacacagcaagacucuugucucaaacaa

SEQ ID NO: 359032 - RNA, 64 nt, Human
ugaacugagauugugccacugcacuccagacugggugacacagcgagacuucaucucaaaaaaa

SEQ ID NO: 359033 - RNA, 64 nt, Human
agcaggacugcaaauuauccuucugccugccccugugacacacacacacacacacacacacaca

SEQ ID NO: 359034 - RNA, 64 nt, Human
uacuaguaggauagaaacaacuagaaaggaaagugugacacaguuuuuaaauuuagauguagaa

SEQ ID NO: 359035 - RNA, 64 nt, Human
accacugugugguuaguaaugcacuugccauuuggugacacagacugaaggcuauccuacaccu

SEQ ID NO: 359036 - RNA, 64 nt, Human
cauaagacaaacacugccauauuguguaauuuaagugacacagacauuuugugugagacuuaaa

SEQ ID NO: 359037 - RNA, 64 nt, Human
gcugcaaaugcauugugaauugccugccauggcugugacacagacggaggacuggaacugcaac

SEQ ID NO: 359038 - RNA, 64 nt, Human
cauacagagcaacaccuguugagccagggaguaggugacacaaggaaaccuucauggaucuucc

SEQ ID NO: 359039 - RNA, 64 nt, Human
cuuuuuuaaaaacaaauaaaugaauaaagcugcugugacacacacacaaaaggaauuuaauagu

SEQ ID NO: 359040 - RNA, 64 nt, Human
uauuuuaacaaaccuguccuugauauuaguuaaggugacacauaagggugacacagaaugugua

SEQ ID NO: 359041 - RNA, 64 nt, Human
cuguccuugauauuaguuaaggugacacauaagggugacacagaauguguaaugcaaauuucau

SEQ ID NO: 359042 - RNA, 64 nt, Human
uauaguuuacagcuguacuuuccagaucuucuaugugacacaaugcacuguccuuguggguuug

SEQ ID NO: 359043 - RNA, 64 nt, Human
ugcuaggcaaccaaauuuaagcuccucacuuuuugugacacauggugucagauauggggucccg

SEQ ID NO: 359044 - RNA, 64 nt, Human
ggaccagugccaggcacugggggguggaaguguggugacacagugaaugggagguggaggaggg

SEQ ID NO: 359045 - RNA, 64 nt, Human
uagagcaugaagguagaacagucuauauacucuugugacacauacaaucccuaccuugugcugc

SEQ ID NO: 359046 - RNA, 64 nt, Human
aguggaggugauuuacugcugaauuaaaacucaagugacacaaguuacaaguugauaucguuga

SEQ ID NO: 359047 - RNA, 64 nt, Human
aggguaccuuuuuggggagaugggguggccugcagugacacagaaaggaagaaacuagcggugu

SEQ ID NO: 359048 - RNA, 64 nt, Human
guccacgcccagaacaacaguuggcaggacaggugugacacagccacagcagaggcaaggggug

SEQ ID NO: 359049 - RNA, 64 nt, Human
auuuuuaaaaagugucucacuacauuuaagacaugugacacauucccauugguaacaauugcuc

SEQ ID NO: 359050 - RNA, 64 nt, Human
acggguaucccaucccgaucugccucccagaacugugacacacugggcucugcccucauuuucu

SEQ ID NO: 359051 - RNA, 64 nt, Human
gaucaugccaccaugccacugcacuccagccugggugacacagccaaaaaaaaaaccacuaagu

SEQ ID NO: 359052 - RNA, 64 nt, Human
caguccuacuccuguccuuuuagaguggcuuagugugacacacaggcaucucccaggccaagca

SEQ ID NO: 359053 - RNA, 64 nt, Human
aauauuuuuaacccuguaaauacggccagcucuugugacacagagacuauuuuaucaauuguca

SEQ ID NO: 359054 - RNA, 64 nt, Human
aagucuccccaccuuucucggaugcagggccagagugacacagccgaaaaauugcaguuugucu

SEQ ID NO: 359055 - RNA, 64 nt, Human
uugaggcacagaaagauuaaguuaccggcccaaggugacacagugaggagguggcagagcuagg

SEQ ID NO: 359056 - RNA, 64 nt, Human
agcauccuuuugcucuguccuccccaccccgauagugacacaucuucaggcagagcuguggcac

SEQ ID NO: 359057 - RNA, 64 nt, Human
uggaaccccgucugagaggucucccugaauuucagugacacauagugcagcccggcaguguccc

SEQ ID NO: 359058 - RNA, 64 nt, Human
aucucuacuaaaaaaaaaaaaaaaauuagguguggugacacauggcugugguccuaguuacuug

SEQ ID NO: 359059 - RNA, 64 nt, Human
ggaguuuugcucuuguugcccaggcuggagugcagugacacaaucucuacucacugcaaccucc

SEQ ID NO: 359060 - RNA, 64 nt, Human
gccacccagcaucucccccaccugccccuucugggugacacagccgguaaacggaaucacguau

SEQ ID NO: 359061 - RNA, 64 nt, Human
acaggcucugaguguccaguggcagccagaacaggugacacagagcaggggcuucagccacaga

SEQ ID NO: 359062 - RNA, 64 nt, Human
augucuccgagaucuaaguguggaucuucugucugugacacaguggccauuguaguuuaucccg

SEQ ID NO: 359063 - RNA, 64 nt, Human
ccucuuccuucacagcauuuacuuggagcucuuugugacacaccaugucagucaugaugaaucg

SEQ ID NO: 359064 - RNA, 64 nt, Human
cagcagguggcuucucaguuccucugggccuggagugacacaggaaggaucugcacuuccucug

SEQ ID NO: 359065 - RNA, 64 nt, Human
cagcauuugaauguuucucagaaaagaacauguagugacacagggcagaggcauccauggcugg

SEQ ID NO: 359066 - RNA, 64 nt, Human
aguggauuccgucuucuacucaggaauggaaugugugacacaggccugacucagccucugaucc

SEQ ID NO: 359067 - RNA, 64 nt, Human
aagggcuuucuuccccuuuaacucucuccuucuggugacacauccugcagcagcugagggggug

SEQ ID NO: 359068 - RNA, 64 nt, Human
caccuguucccacccucuugaccgaaauuuccuugugacacagagaagggcaaaggucugagcc

SEQ ID NO: 359069 - RNA, 64 nt, Human
ucauguggggaacccucaaggccugucuggagaagugacacaggauuuacuggggugggcuggu

SEQ ID NO: 359070 - RNA, 64 nt, Human
aguggacagucacagccucagcucaugucuggcugugacacacacugcccccagcuucccuugg

SEQ ID NO: 359071 - RNA, 64 nt, Human
cgcucuugcuacuucggcaagacaucuuaagaaugugacacauuuucaagggcaucucuaucuu

SEQ ID NO: 359072 - RNA, 64 nt, Human
auggauuccccuggacauauucccaugguagacugugacacagcugagcuggccuauuuuggac

SEQ ID NO: 359073 - RNA, 64 nt, Human
ucacccauggugcccaugucguucuucucucccugugacacagcuuguacagucugauucuuuu

SEQ ID NO: 359074 - RNA, 64 nt, Human
acugaggcccagaaagaggcagugauuugccaaagugacacagagcaaugguagcaaaacaagg

SEQ ID NO: 359075 - RNA, 64 nt, Human
uguuuuggcuuaagaaauccauaggccucucuuggugacacaucucuaguacuuuuugucauaa

SEQ ID NO: 359076 - RNA, 64 nt, Human
aguaaagucuuggagacuagaagcaagauaguuugugacacauaagcuucccaaaaacuagaau

SEQ ID NO: 359077 - RNA, 64 nt, Human
aauacccacaaaugauagaccggauaaagaaaacgugacacauauacaccauggaauacuaugc

SEQ ID NO: 359078 - RNA, 64 nt, Human
aggaagggaaggauuuuggagguagguggcuuuggugacacacucacuucuuucucagccucca

SEQ ID NO: 359079 - RNA, 64 nt, Human
cacuccaguuugcuuucuagguccucaagugcucgugacacauaaucauuccauccaaugaucg

SEQ ID NO: 359080 - RNA, 64 nt, Human
cucagggggcguggccacaccacacacugcgccagugacacauaguuacuuccuggcugggacg

SEQ ID NO: 359081 - RNA, 64 nt, Human
cauugaaacagugauuaaguuugaucaagccauggugacacaaaaaugcauugaucaugaauag

SEQ ID NO: 359082 - RNA, 64 nt, Human
ggaagagaguuccgggaaacauagccucaccaaggugacacauuacaaagccacccuaccauga

SEQ ID NO: 359083 - RNA, 64 nt, Human
uguucuguaaggaauguuauguaugggugagcgggugacacauccauuggguauguaugcaugu

SEQ ID NO: 359084 - RNA, 64 nt, Human
ugagacccgaggggcggcggcgcgguuuuuuauggugacacaaauguauauuuugcuaacagca

SEQ ID NO: 359085 - RNA, 64 nt, Human
uuucucuccaggaaguuuugaguuucucuccaccgugacacaauccucaaacauggaagaugaa

SEQ ID NO: 359086 - RNA, 64 nt, Human
uuacgucaccccuggggacagaggucagccuaaggugacacacggggacuacugugcuuccgga

SEQ ID NO: 359087 - RNA, 64 nt, Human
agagugauccuccuuccuucccuggcccuuggcugugacacaagauccuccugcagggcuaggc

SEQ ID NO: 359088 - RNA, 64 nt, Human
ugagccaagauggugccgcugcacuccagucugggugacacagcaagacuccaucucaaaaaaa

SEQ ID NO: 359089 - RNA, 64 nt, Human
uauaccaaaagaguguacaaaguguugcagggcugugacacaauagggacucuauggaaaacug

SEQ ID NO: 359090 - RNA, 64 nt, Human
gggagggguggggcccacccuggaagaguggacagugacacaagguggacacucucuacagauc

SEQ ID NO: 359091 - RNA, 64 nt, Human
cauacuaaguggaaaucauauaaaugaaauguaugugacacaggcuuuaucaaggccugccaaa

SEQ ID NO: 359092 - RNA, 64 nt, Human
ucccugcccccgacccccccauacccccuucucugugacacacacaucuucucgucucuuuuuc

SEQ ID NO: 359093 - RNA, 64 nt, Human
gcaacuuagcgagacuccaucucuacaaaauguggugacacaugccuguagucccagcuacuca

SEQ ID NO: 359094 - RNA, 64 nt, Human
cuguaugaccuugauugugugccuuaaccgcucugugacacagucuaccugucugcaaaauggg

SEQ ID NO: 359095 - RNA, 64 nt, Human
aagccuguuugguggucucuucacacggacgcgcgugacacaaugcugggugguuuucccacga

SEQ ID NO: 359096 - RNA, 64 nt, Human
uggacacugagcuugaacuucauauaucagucaugugacacaaaauaucauucuucuuuuuauu

SEQ ID NO: 359097 - RNA, 64 nt, Human
gcccugugugccgggguccauggugucauaugcagugacacacacugucaagcgccauuucccu

SEQ ID NO: 359098 - RNA, 64 nt, Human
auaugccugcaggguuuauaaaaaauggccuggagugacacauuuuauuauaccuaauauucac

SEQ ID NO: 359099 - RNA, 64 nt, Human
ucucgaggugacucuucugaccaagggugguuaagugacacauagaacuuuucuaagagaagac

SEQ ID NO: 359100 - RNA, 64 nt, Human
cucagccaccuguaaguccuuugugaagaugugggugacacagggggacaggaaaacccauuuc

SEQ ID NO: 359101 - RNA, 64 nt, Human
ucugagaacccacucucugccggagaaccccauggugacacauuuucaucuuucugaccagagg

SEQ ID NO: 359102 - RNA, 64 nt, Human
ggaguuuugcucuugucucccaggcuggagugcagugacacaaucucggcucacugcaaccucc

SEQ ID NO: 359103 - RNA, 64 nt, Human
aggacaccaugccgugacagaggcagagggugcagugacacagccacaaaccaaggaaggccga

SEQ ID NO: 359104 - RNA, 64 nt, Human
uuauggugcuauuccuaagguuaacuuugaauaugugacacacacacuccuaaguaccuuuaag

SEQ ID NO: 359105 - RNA, 64 nt, Human
ucuccacuaaaaauagaaaaauuagccgggcauggugacacaugccuguaguccuagcuacuug

SEQ ID NO: 359106 - RNA, 64 nt, Human
aggagagguuguuuguucaugcaugcauucauccgugacacaugaguaccuacugaggacucca

SEQ ID NO: 359107 - RNA, 64 nt, Human
guggcuuugcagucuggaagggcaggugggagcugugacacagugugaaaaagcauuuguagag

SEQ ID NO: 359108 - RNA, 64 nt, Human
aggcuucaugugggggaggaggagaggucuccaugugacacaugggcucagggcugccagaauc

SEQ ID NO: 359109 - RNA, 64 nt, Human
gagaggggaaugaauacuucagaugcuuucaggagugacacaagaacacaaugauuuuugcuua

SEQ ID NO: 359110 - RNA, 64 nt, Human
uaaggaaauaaaugugacucacauuucuuuuacugugacacaauaaugugauccuaaaacuggc

SEQ ID NO: 359111 - RNA, 64 nt, Human
acuuuggaccaucacacacauuucagcauuugaagugacacaagcuaccugguaacugcccaug

SEQ ID NO: 359112 - RNA, 64 nt, Human
uuggaggaauguacuguauuuaaaaaaaccuucugugacacauucaaaaauuucaucugagcug

SEQ ID NO: 359113 - RNA, 64 nt, Human
cacacuuaguguucuucuuucacacuucucaaaagugacacaagagaaauccaguucaccuaca

SEQ ID NO: 359114 - RNA, 64 nt, Human
ugcagagaguuacagaaauaguuucgaugagcuagugacacauccuaaagaugcaaagauccuc

SEQ ID NO: 359115 - RNA, 64 nt, Human
gaaaggggaaaucuauaacauuucuuuugcccaagugacacaaaaaugauuacugcauagaaau

SEQ ID NO: 359116 - RNA, 64 nt, Human
ucaacagaaaucuguaauuuccuugcucucagaggugacacagaauaugauucccucacugccc

SEQ ID NO: 359117 - RNA, 64 nt, Human
agcgugacccagagaugggguguccuggcccuuagugacacagcuccucucuggggcacccuau

SEQ ID NO: 359118 - RNA, 64 nt, Human
cauauguuuuguguacguaugacaaacugucaaagugacacagaauacugauuugaagauagcc

SEQ ID NO: 359119 - RNA, 64 nt, Human
cagcuguggacuccagcauguuucugauaauuaugcaagcaacaauucuguagccucaaguaag

SEQ ID NO: 359120 - RNA, 64 nt, Human
ccuggccagaugucgcuggguccucugcaguguggcaagcaagagcucuugugaauauuguggc

SEQ ID NO: 359121 - RNA, 64 nt, Human
uuaguuuggaauuguguucuucguaaagacugaggcaagcaagugcugugaaauaacaucaucu

SEQ ID NO: 359122 - RNA, 64 nt, Human
ccccagugcaguaccccagcucaugggggacucagcaagcaagcguggcaccaucuuggaucug

SEQ ID NO: 359123 - RNA, 64 nt, Human
uauauaguagaagccuuaagaaaaaagaaaaugagcaagcaaauauuugaagaaauguauaaaa

SEQ ID NO: 359124 - RNA, 64 nt, Human
aggugaaguugggugguuuuauccaaugucucaagcaagcaaugucugggaauaucauagagua

SEQ ID NO: 359125 - RNA, 64 nt, Human
guuuggcuagcaccccaggaagaugugagagggagcaagcaagguuagcaacugugaacagaga

SEQ ID NO: 359126 - RNA, 64 nt, Human
aauuugugacaacugccuugggugaaaaucagaagcaagcaacucagcgaaaaacucagaaggu

SEQ ID NO: 359127 - RNA, 64 nt, Human
gacgcagagcuugcauucucuccggagcaucucagcaagcaaggccucaccaccuggugaccug

SEQ ID NO: 359128 - RNA, 64 nt, Human
acucuuccaaccagacaagagugccagaaacuuggcaagcaauucauccuguggaaguugcaaa

SEQ ID NO: 359129 - RNA, 64 nt, Human
uguccugcccaggcccgauggccacuaggacccugcaagcaacucugcucugugaccaggccag

SEQ ID NO: 359130 - RNA, 61 nt, Human
gcggcgcugccgucugcagccacgcgggggcgcgcgggagcucugcgggcgcuggaaccug

SEQ ID NO: 359131 - RNA, 61 nt, Human
gggcggggacgcggcgagacugucggcgggggcgcgggaagggacuuggacgcccggcucu

SEQ ID NO: 359132 - RNA, 64 nt, Human
gaucucggcucacugcaaccucugccuccugggugcaagcaauuauccugccucagccucccga

SEQ ID NO: 359133 - RNA, 64 nt, Human
aauuuaucaccuaaaauauacccaucaguauaaggcaagcaaaagucuuaacauggcagccauu

SEQ ID NO: 359134 - RNA, 64 nt, Human
gagccgaagcuauagaacuuuguuagacuauuuggcaagcaaaauauaugacaguaaauaucag

SEQ ID NO: 359135 - RNA, 64 nt, Human
auuuugcaauguuuuacagaaagcacugaguugagcaagcaauuccuuuauuuaaaaaaaaaag

SEQ ID NO: 359136 - RNA, 64 nt, Human
ucaaagaacucuucucuauuauguuuaaucaauugcaagcaaauagauuuuucuuuguaacaau

SEQ ID NO: 359137 - RNA, 64 nt, Human
accacuuccuaucugguuuuucccaguaaaugaggcaagcaauucuaagaucuuccacaaaaca

SEQ ID NO: 359138 - RNA, 63 nt, Human
ccuucuauuucuuuagguaaagagaucaggacagcaagcaagacuucaguagcaaaccacuac

SEQ ID NO: 359139 - RNA, 64 nt, Human
gcacccacuaccauacagacagcacaagguggcagcaagcaauucugccccacacccagccagc

SEQ ID NO: 359140 - RNA, 64 nt, Human
ccucuuucaucccauacucaaaauacccaguuuagcaagcaacugagauuuaagucucucuggc

SEQ ID NO: 359141 - RNA, 64 nt, Human
ucccucuggacaaaggaucauacagguguuauuagcaagcaagagauacugaagcgaucaaaca

SEQ ID NO: 359142 - RNA, 64 nt, Human
uugagcuugcagggaagccaagcuugcaguuccagcaagcaaagauuuuuuuuaauagaccaaa

SEQ ID NO: 359143 - RNA, 64 nt, Human
aagaaaaauuacagaauggaaaauaauauuuugggcaagcaaacaaauucacugagaauuccaa

SEQ ID NO: 359144 - RNA, 64 nt, Human
aauauggcauaauuguaauaaauuauuuaggaaagcaagcaaagauguaaguuuuuuuaauuua

SEQ ID NO: 359145 - RNA, 64 nt, Human
uagaagccaugggaccuccucccucauucaucuugcaagcaaaucccauuucuugaaaagccuu

SEQ ID NO: 359146 - RNA, 64 nt, Human
guccccaccccagugcacucuucuggcccaggcagcaagcaagcugugaacagcuggccugagc

SEQ ID NO: 359147 - RNA, 64 nt, Human
ggucuuggugggugggagguggggcaugugcaaagcaagcaaggaacauuugggguaagaaaac

SEQ ID NO: 359148 - RNA, 61 nt, Human
uuggcuuucauaggccacacacaggugugcugcgcgggaagccccaugcuccaaucaaagg

SEQ ID NO: 359149 - RNA, 61 nt, Human
cggcugcggaccccaucggcagggagaggaggcgcgggagggggacgcaaacaaaaaaugg

SEQ ID NO: 359150 - RNA, 64 nt, Human
gacuaaaccagaacaagcaacaaacuguauuuaugcaagcaaaauugaugagaaaauuauauuc

SEQ ID NO: 359151 - RNA, 64 nt, Human
gggguauuuuguucuggcauuagaagaaaaacaagcaagcaaacaaaaacacagccuccgaugc

SEQ ID NO: 359152 - RNA, 64 nt, Human
agaggcaucugcccuuuccccagccaccuccccagcaagcaaccugaaaucucagcagaugccc

SEQ ID NO: 359153 - RNA, 64 nt, Human
auuuauguuuaacuucucuuuuuacucaucagcugcaagcaaaaucuuguaguuuuuaaucuua

SEQ ID NO: 359154 - RNA, 64 nt, Human
gugcuaugagcaucagcuuacuuugucacuuagagcaagcaaaacccagugcaagagucucguu

SEQ ID NO: 359155 - RNA, 64 nt, Human
uguacaucagacuuuuaaaaucuguaauauacaagcaagcaaaauuauuuuaaaugacuuaauu

SEQ ID NO: 359156 - RNA, 64 nt, Human
auuugggggggaauaagauuauauggacuuucuugcaagcaacaagcuauuuuuuaaaaaaaac

SEQ ID NO: 359157 - RNA, 64 nt, Human
ggguucaauacuguccuugcuuguuuuauugcaggcaagcaaggcaaauggccuaaaaugcugu

SEQ ID NO: 359158 - RNA, 59 nt, Human
uggaacuggagcaagcuugauuuauauuugcaagcaacuaaauuaauugaccugaaaaa

SEQ ID NO: 359159 - RNA, 64 nt, Human
uauuggucagaauagaauccauucagcuguagcagcaagcaauccccaaccuuucacugcaaug

SEQ ID NO: 359160 - RNA, 64 nt, Human
uauuggucagaauagaauccauucggcuguagcagcaagcaauccccaaccucugacugcaaug

SEQ ID NO: 359161 - RNA, 64 nt, Human
ucuuccugggcccggcaggagagccugcaggagcgcaagcaagcacuauaugaauacgcaagaa

SEQ ID NO: 359162 - RNA, 64 nt, Human
ugucuguauguuucugcguugugugucuuuguaggcaagcaaacguugucuacacaaacgggaa

SEQ ID NO: 359163 - RNA, 64 nt, Human
uuauaaauuuuuccuucaaugacaugaaaacugugcaagcaaaaaccgaagaaaaacacuuaag

SEQ ID NO: 359164 - RNA, 64 nt, Human
caggcuacuuucuguuuacuccuaacaaaauaaagcaagcaaauuugagucaaauauuggugca

SEQ ID NO: 359165 - RNA, 64 nt, Human
gagucagagagagagaggauggacgugggagaaagcaagcaaaagcuacccuagggaagagccg

SEQ ID NO: 359166 - RNA, 64 nt, Human
ugugccgagaccauccuaaggguccgaugugacagcaagcaagugaaauaaacaaugauuugcu

SEQ ID NO: 359167 - RNA, 64 nt, Human
guucuuauguugcccaguguguuucugaucugaugcaagcaagaaacacugggcuucuagaacc

SEQ ID NO: 359168 - RNA, 64 nt, Human
ggaaaucuguaacagguauuuuguuucuuuuaaagcaagcaacacagaggaauuuauaccucaa

SEQ ID NO: 359169 - RNA, 64 nt, Human
guaccuuccauuuugaaaaguagagguugcuuaagcaagcaauggauaauaagagacuuuuccu

SEQ ID NO: 359170 - RNA, 64 nt, Human
aguccuuuagcucaauugauagggucagcgucucgcaagcaaaaaaucucaugaccucauauuu

SEQ ID NO: 359171 - RNA, 64 nt, Human
cuaaagcauuccucagaacugucccauuugaagggcaagcaaaccugggguauuuauccacuga

SEQ ID NO: 359172 - RNA, 64 nt, Human
uggcuaacuaaaaccaaaaaaaccuguccagugugcaagcaaaaaguuguuccuucucaaggcg

SEQ ID NO: 359173 - RNA, 64 nt, Human
gucuccaagcgacgaaaaaaauguuuuaauauuugcaagcaacuuuuguacaguauuuaucgag

SEQ ID NO: 359174 - RNA, 64 nt, Human
cuaagugugaacuggacccuguugcuaagccccagcaagcaauccuagguaggguuuaaucccc

SEQ ID NO: 359175 - RNA, 64 nt, Human
gggucgguggaggggucauucaccugccccugcagcaagcaaaaguugucuguggugccauuug

SEQ ID NO: 359176 - RNA, 64 nt, Human
gaaccaacugaaaaaaaaauucucaggcuuuacagcaagcaaacuucacuaugauuuuuacaau

SEQ ID NO: 359177 - RNA, 64 nt, Human
cgcuguuggagcaaaccauuauaccuuacuuccagcaagcaaagugcuuugacuucuugcuuca

SEQ ID NO: 359178 - RNA, 64 nt, Human
aacucugucugucugcugcccaucugcugucugugcaagcaacuucuggacccuggcacccugg

SEQ ID NO: 359179 - RNA, 64 nt, Human
uuuaauuguuuucagauugugcuggguuaguuuugcaagcaauugauaauuuuuaaaaaauuau

SEQ ID NO: 359180 - RNA, 64 nt, Human
uagagagcaguggcagagguagcccccuaaaugggcaagcaaggagccccccaaagacacuacc

SEQ ID NO: 359181 - RNA, 64 nt, Human
cacuuugcucauuuuucuucaauaaaucuuuuuggcaagcaacugauuuacuguguguaggugu

SEQ ID NO: 359182 - RNA, 64 nt, Human
uuucuguaacugucaccugaaauaauacauugcagcaagcaauaaacacaacauuuuguaaagu

SEQ ID NO: 359183 - RNA, 64 nt, Human
cacuguugcugcgugggagagucacaagccacuggcaagcaagugguauagucugugaagcacu

SEQ ID NO: 359184 - RNA, 64 nt, Human
gagccagugggcuuuuguguagccuuuuuguucugcaagcaacuuucuaaaguuguguacauga

SEQ ID NO: 359185 - RNA, 64 nt, Human
gugaggaagaguguuuacuaaauaaaugacuggggcaagcaaaauugaggaggaaauuagaaac

SEQ ID NO: 359186 - RNA, 64 nt, Human
aggguggggaacuggaggguggggggauugaaaugcaagcaauuaguggaucacuguuagggua

SEQ ID NO: 359187 - RNA, 64 nt, Human
caaaauguagacaagaugccucaagguauugguagcaagcaagauuuugcccuuuaguuuucga

SEQ ID NO: 359188 - RNA, 64 nt, Human
gaaccuucuuacugcaugauaacaaagcagcaaggcaagcaaaagcguaagaugaagagagagg

SEQ ID NO: 359189 - RNA, 64 nt, Human
ugcccacgugguauugcugggcuccuggcuagaugcaagcaagguggacaagagcucaggacuc

SEQ ID NO: 359190 - RNA, 64 nt, Human
cauuugaguuucacuuuuuagaaguauguuuuaagcaagcaaaaacaaaaugggaugugaagaa

SEQ ID NO: 359191 - RNA, 64 nt, Human
uuaaaagcagccuaugauugcuucuuuuuguaaagcaagcaaccucccuccacuuuagcuguuu

SEQ ID NO: 359192 - RNA, 64 nt, Human
gcagcaaggcugcagccagcaaagaggugcggaggcaagcaagcuccaugugguggggacagcg

SEQ ID NO: 359193 - RNA, 64 nt, Human
agauggcuauauuguuagcuauacuccuaccaaagcaagcaaggagauaggauuauagauaauu

SEQ ID NO: 359194 - RNA, 64 nt, Human
guuucuuuucugcuaauucguucugugauggugagcaagcaaaucauuaaccucucuguuuuuu

SEQ ID NO: 359195 - RNA, 64 nt, Human
caguuuauaguucugagauggaaaguugaagggggcaagcaagaccucuccucagcccaugccc

SEQ ID NO: 359196 - RNA, 64 nt, Human
augaggaauccuuucuaugugauuuucaaucauagcaagcaagaaaggcuccagugucaaggua

SEQ ID NO: 359197 - RNA, 64 nt, Human
uguggugagccugccuguuguccacguggcugcagcaagcaaacauggguuuuccuuggaagga

SEQ ID NO: 359198 - RNA, 61 nt, Human
cgcucgggggagcccccgcgcccccggcccagcgcgggaggcggggcgagccgagggaaag

SEQ ID NO: 359199 - RNA, 61 nt, Human
ccccgugcaauaccugcugggccuccugcccgcgcgggaggggagggcgccccgggaccag

SEQ ID NO: 359200 - RNA, 64 nt, Human
uaaugcgaucuggcaucuucucccacaagcccccuacagggaacaacuacccccuaccuuaacu

SEQ ID NO: 359201 - RNA, 64 nt, Human
uguauuaaaauugcaguccaaaucccauaggauggcaagcaaaguucuucuagaauuccacaug

SEQ ID NO: 359202 - RNA, 64 nt, Human
uguguuuuauuugccaaauguuaccaaucagugagcaagcaagcacagccaaaaucggaccuca

SEQ ID NO: 359203 - RNA, 64 nt, Human
ccuucaccugguagagaaagagaggucagaaauagcaagcaaaaagcaggacucccaggagcca

SEQ ID NO: 359204 - RNA, 64 nt, Human
auuaggcaguguaguagguucaagaaacacaggagcaagcaaaacaaauuccauaaugucauca

SEQ ID NO: 359205 - RNA, 64 nt, Human
gcuuuuuucuuuuuaugcuuucguuuguuuaccagcaagcaacuucccuggggaagccaaacac

SEQ ID NO: 359206 - RNA, 64 nt, Human
aaauuguuuguuuuauucaagacucauucuacuugcaagcaaaguguauuuguaguccuaugaa

SEQ ID NO: 359207 - RNA, 64 nt, Human
uucaaagucaugaaaccaaucaacagccaagucagcaagcaaucagguaaugaugugcgagucc

SEQ ID NO: 359208 - RNA, 64 nt, Human
ucuaaauauuuaaguaaaaaguaacaaaaacucugcaagcaagggaauuuuuuuguacuguaau

SEQ ID NO: 359209 - RNA, 64 nt, Human
guggacauggcucauuuuguuuuaccaguuauuugcaagcaaaauguaauuuaauguauagaug

SEQ ID NO: 359210 - RNA, 64 nt, Human
auuagccucugucucgguggcagguucccaccucgcaagcaauuggaaacaaaacuuuugggga

SEQ ID NO: 359211 - RNA, 64 nt, Human
ucccuaaacuaaugguuuaagcuuugaagcaugcgcaagcaacaugaacaacugaauacagaaa

SEQ ID NO: 359212 - RNA, 64 nt, Human
auugaagugugugaagcucugugcuugcaugagggcaagcaaggaauggcugugccugaggcug

SEQ ID NO: 359213 - RNA, 64 nt, Human
ucauccaggacugagaugcaaaugucacaguaaugcaagcaaaguaucaaagaaaaacaaugaa

SEQ ID NO: 359214 - RNA, 64 nt, Human
ccauggcaagcuuuguauauaaaugaacaaaaaagcaagcaaagcaaaacaauaaacuagcaga

SEQ ID NO: 359215 - RNA, 64 nt, Human
uaagaucauucuguauauacauauuuuaaauuaugcaagcaaacuaggaggagaaugugcaauu

SEQ ID NO: 359216 - RNA, 64 nt, Human
gaacaccaaagucaugggagugggcugcagcccugcaagcaaccccgcgcuugggaaggcucuu

SEQ ID NO: 359217 - RNA, 64 nt, Human
gugggaaggguggggacgaggcgucgggaggguauacagggagccccucccgugcauggcugcc

SEQ ID NO: 359218 - RNA, 64 nt, Human
acucacucugcacagaaacaaagaagaaauguuauacagggaaguccguuuucacuauuaguau

SEQ ID NO: 359219 - RNA, 64 nt, Human
aggacuccagaaucuaaagccaguggcuugaggcuacagggaguguaguaaagccguuguuuac

SEQ ID NO: 359220 - RNA, 64 nt, Human
auuuauccucuaaacaaaugaguaaaauccacaggcaagcaaccauaugucuguaauugcugug

SEQ ID NO: 359221 - RNA, 64 nt, Human
cauucucuucuguuugucugagucucaucucucugcaagcaagggcugaaaucauuuuguuugg

SEQ ID NO: 359222 - RNA, 64 nt, Human
uugccuuaucuuacuaaagugaaguuuuccuaaggcaagcaagaagaggaguggaagcacaguu

SEQ ID NO: 359223 - RNA, 64 nt, Human
ggcagccuaggcccuggggagcccaguccacugagcaagcaagggacugagugagccuuuugca

SEQ ID NO: 359224 - RNA, 64 nt, Human
uguucaaaaagauauuguuguuuuccaugauuuagcaagcaacuaauuuucucccaagcugauu

SEQ ID NO: 359225 - RNA, 64 nt, Human
uuuucauuuuauuuuguauuacuuaaucuuuuaagcaagcaaaaauuuauucucagggucagcu

SEQ ID NO: 359226 - RNA, 64 nt, Human
aaugcgagcugugguuaggcuugguuagagugcagcaagcaacaugacagaugguggcacgcug

SEQ ID NO: 359227 - RNA, 64 nt, Human
gggaucacauuugaagacaauaguguuuaagaaagcaagcaagucccuuagcagucaggucaua

SEQ ID NO: 359228 - RNA, 64 nt, Human
uuaaaauuuuaaucaauaaaguaugucuguugaagcaagcaagcaaacaaauccauaacaacca

SEQ ID NO: 359229 - RNA, 64 nt, Human
aauuuuaaucaauaaaguaugucuguugaagcaagcaagcaaacaaauccauaacaaccacaac

SEQ ID NO: 359230 - RNA, 64 nt, Human
uuauuacauuugcaacucugcccaacaaaaacaagcaagcaaaccacaaugguaaagugguuaa

SEQ ID NO: 359231 - RNA, 64 nt, Human
agauuugugaaaucggcucaacucccaggugagagcaagcaaaaaucuuggcuggguggaaagg

SEQ ID NO: 359232 - RNA, 64 nt, Human
gggguauuuuguucuggcauuaaaagaaaaacaagcaagcaaacaaaaacacagccuccgaugc

SEQ ID NO: 359233 - RNA, 64 nt, Human
uuuuuguuauugguuaaggagacaauuuuggagagcaagcaaaucuuuuuaaaaaauaguauga

SEQ ID NO: 359234 - RNA, 64 nt, Human
accaggagaggacacagugagaaggcaguuaucugcaagcaaagagagaggcuucagaagaaac

SEQ ID NO: 359235 - RNA, 64 nt, Human
cccaccugccucccugcccccugugacggagggggcaagcaagcccccagaggcugugucucug

SEQ ID NO: 359236 - RNA, 64 nt, Human
uguauaaccagguccuaacagugaucagacauauuacagggaaauagcuuguaggccgggagug

SEQ ID NO: 359237 - RNA, 64 nt, Human
gggaaaguucccugugcucauggagcuuacauucuacagggagaaagagauagccaauacauag

SEQ ID NO: 359238 - RNA, 64 nt, Human
gacauggacaauaaaguaguauaugauccucagauacagggagaaggacaaggcauacagcuua

SEQ ID NO: 359239 - RNA, 64 nt, Human
aggcggaaaugcuccaugaaacaggaagccacuugcaagcaacaucugcucuguuccucaggug

SEQ ID NO: 359240 - RNA, 64 nt, Human
cagggugccuguccaggaagagcuguguggccuggcaagcaagccugggagccggcgggagguc

SEQ ID NO: 359241 - RNA, 64 nt, Human
ucagccgccucggggaugagaggggacucguggggcaagcaagcugcccugugcucugagugag

SEQ ID NO: 359242 - RNA, 64 nt, Human; identical to SEQ ID NO: 359232

SEQ ID NO: 359243 - RNA, 64 nt, Human
aaaaaaaaaaacgccauagcacagcugucuuuaugcaagcaagagcacaucuacuccagcauga

SEQ ID NO: 359244 - RNA, 64 nt, Human
uauauuguaggcagaagagauccaucaacagauugcaagcaaggaaguauguucacuuuaaagu

SEQ ID NO: 359245 - RNA, 64 nt, Human
uaauuucaaugaaggggaccuccagcuaaauagggcaagcaaaguguucucccagaaagugcuc

SEQ ID NO: 359246 - RNA, 64 nt, Human
gaggugggacguuugggcuugggggcucggcaaggcaagcaagacacaccagagcucuucccuc

SEQ ID NO: 359247 - RNA, 64 nt, Human
ccugagcagcugguuuuccugcaggaagguuggagcaagcaaaguccuucucugcccucagggu

SEQ ID NO: 359248 - RNA, 64 nt, Human
aaaaaaaaaaaugcaaauguccuucaccaguaaagcaagcaaauuuuuaaaaucucuguuuuug

SEQ ID NO: 359249 - RNA, 64 nt, Human
ccuaauccauuccucuccuuccaaguccauuguugcaagcaauauucuucucaauuuuuauaug

SEQ ID NO: 359250 - RNA, 64 nt, Human
ucccagcugcgcucauuccagcugacagcgagaugcaagcaaaugcucagcucuccuuacccug

SEQ ID NO: 359251 - RNA, 64 nt, Human
gucaccuggagaaaaggaacguugcucuuggacagcaagcaaaccauuucucuccgucuguucu

SEQ ID NO: 359252 - RNA, 64 nt, Human
ucccugccugcaugcauucuggcggaagagacaagcaagcaaugaacaaauuagcagaaaaccu

SEQ ID NO: 359253 - RNA, 64 nt, Human
aaaaaccuccugaacugggaacaaagaucuacaggcaagcaagaugcccacacaacaggcuuau

SEQ ID NO: 359254 - RNA, 64 nt, Human
uguuugucuaguaugcucuuggaaagaaaaccaagcaagcaaguugcugccuauucuauaguaa

SEQ ID NO: 359255 - RNA, 64 nt, Human
gggccugcaugcagucaggcuggcaguggcgcgguacagggagggaacuggugcauauuuuagc

SEQ ID NO: 359256 - RNA, 64 nt, Human
cgcuuaccuuacccauguuuauauauagcuguccuacagggagcuuuuauuuagaaaaugucug

SEQ ID NO: 359257 - RNA, 64 nt, Human
guguaaguuuuucaaguggaaucuagaaucaaaauacagggagagauaugaagaccuauucaga

SEQ ID NO: 359258 - RNA, 64 nt, Human
ggaaucuuagucauucauguuucaccagaggacagcaagcaaaagguaauugacagccaccagu

SEQ ID NO: 359259 - RNA, 64 nt, Human; identical to SEQ ID NO: 205746

SEQ ID NO: 359260 - RNA, 64 nt, Human; identical to SEQ ID NO: 205747

SEQ ID NO: 359261 - RNA, 64 nt, Human; identical to SEQ ID NO: 205748

SEQ ID NO: 359262 - RNA, 64 nt, Human; identical to SEQ ID NO: 205749

SEQ ID NO: 359263 - RNA, 64 nt, Human; identical to SEQ ID NO: 205750

SEQ ID NO: 359264 - RNA, 64 nt, Human; identical to SEQ ID NO: 205751

SEQ ID NO: 359265 - RNA, 64 nt, Human; identical to SEQ ID NO: 205752

SEQ ID NO: 359266 - RNA, 64 nt, Human; identical to SEQ ID NO: 205753

SEQ ID NO: 359267 - RNA, 64 nt, Human; identical to SEQ ID NO: 205754

SEQ ID NO: 359268 - RNA, 64 nt, Human; identical to SEQ ID NO: 205755

SEQ ID NO: 359269 - RNA, 64 nt, Human; identical to SEQ ID NO: 205756

SEQ ID NO: 359270 - RNA, 64 nt, Human; identical to SEQ ID NO: 205757

SEQ ID NO: 359271 - RNA, 64 nt, Human; identical to SEQ ID NO: 205758

SEQ ID NO: 359272 - RNA, 64 nt, Human; identical to SEQ ID NO: 205759

SEQ ID NO: 359273 - RNA, 64 nt, Human; identical to SEQ ID NO: 205760

SEQ ID NO: 359274 - RNA, 64 nt, Human
guaaccucuuacuuauuaucuucaggacacucacuacagggaccagggaugaugcaacauccuu

SEQ ID NO: 359275 - RNA, 64 nt, Human
acucugguuuccuuugggguucccauuaggugucuacagggagaggugaaauuggaaguuggag

SEQ ID NO: 359276 - RNA, 64 nt, Human
caggcagcaccuuugggcuuuguuuugguguuucuacagggacaauacagacccuggagugugu

SEQ ID NO: 359277 - RNA, 64 nt, Human
uuuauggaaauugauuaucuacacucaguuucauuacagggaaggaacccaugaaaacaucagu

SEQ ID NO: 359278 - RNA, 64 nt, Human
agugauaguuaaauuaacuggggcuaggggaagagcaagcaaaaagggaagaaggacuccuagg

SEQ ID NO: 359279 - RNA, 64 nt, Human
gaaauagcugaauguaaauagcagggaggaagaagcaagcaaagugagagcuuuucuucaucca

SEQ ID NO: 359280 - RNA, 64 nt, Human
agccucaacuuacccaggaggagcuagaagcaaagcaagcaaagcaaaagcuggaagaucgccu

SEQ ID NO: 359281 - RNA, 64 nt, Human
cuagccacuggauuuugcagauuuuccuguccaugcaagcaaggacguaaaauuaaaaaauuac

SEQ ID NO: 359282 - RNA, 64 nt, Human
auuucgugccuucauuuguguuacauacauagcugcaagcaaaccauuuuuccccuuucuuuua

SEQ ID NO: 359283 - RNA, 64 nt, Human
aaacguggguuaagagaacuugcagacuggauaugcaagcaaacgggcaacucuggagaaaaau

SEQ ID NO: 359284 - RNA, 64 nt, Human
gccccuuccugccccaccccauuccuuauauucagcaagcaacaaggcaauagaaaagccaggg

SEQ ID NO: 359285 - RNA, 64 nt, Human
auuuuaaaccaaauugagauuaaauugaagaaaagcaagcaaauuaauuucagcuugauuauca

SEQ ID NO: 359286 - RNA, 64 nt, Human
aaauuuccagagcauuauguagguagaaaaaaaugcaagcaagcuguuaaagaucuuggauccc

SEQ ID NO: 359287 - RNA, 64 nt, Human
agugcaaaugucauccugcaagguuccucuuccugcaagcaaaguggagagaaagaagaugcau

SEQ ID NO: 359288 - RNA, 64 nt, Human
caaagaugaucaacuagaaauguuaaguggcuaugcaagcaaaagcauagauagguuaaaaaaa

SEQ ID NO: 359289 - RNA, 64 nt, Human
aagucucuauacaaugucuuuaucccugugggcagcaagcaaugaugauaaugacaaacaggau

SEQ ID NO: 359290 - RNA, 64 nt, Human
aaaaauauuuuuuaucuauuuacuguguguuuaagcaagcaacagugcacugaucugguaguua

SEQ ID NO: 359291 - RNA, 64 nt, Human
uuuugaauauuuuagcuauauuuaguggcuuucugcaagcaacuagaacagagaaguaaugggu

SEQ ID NO: 359292 - RNA, 64 nt, Human
uuugaaugucauaguacauugugugcuaaccauggcaagcaaacauuuacauuuguuuuuuaca

SEQ ID NO: 359293 - RNA, 64 nt, Human
cugaagcgucucugacaaucuaacuuauuagacagcaagcaauauauaauacugaaaaaguauu

SEQ ID NO: 359294 - RNA, 61 nt, Human
ccacccaagggcugaggagugcgggugcacagcgcgggacuggcaggcagcuccaccugcu

SEQ ID NO: 359295 - RNA, 61 nt, Human
gaagacucggugguucagagccugggucucagcgcgggacccgucuggggugaagaccuug

SEQ ID NO: 359296 - RNA, 61 nt, Human
ggggaggcacggugcggagagcgucgcauaugcgcgggaaaucaagaacuaugauauuuuu

SEQ ID NO: 359297 - RNA, 64 nt, Human
gguaauagcagaggaaagggugaagggagucugggcaagcaaagcauagagauggugggguggu

SEQ ID NO: 359298 - RNA, 64 nt, Human
uggacuuuaggccaaacccaguaccacgcaaugugcaagcaagggcaggagguagguccaaucu

SEQ ID NO: 359299 - RNA, 64 nt, Human
cugacacuuuggcccgaaauagauccagugcugagcaagcaauguacaccagagccucagugag

SEQ ID NO: 359300 - RNA, 64 nt, Human
cuuucaacaccccaggauuaaaaaaacugauuaugcaagcaauuggaauauaaguauuaaauua

SEQ ID NO: 359301 - RNA, 64 nt, Human
acaaaccacucaucacaguauucccaacucacaggcaagcaacuguuagaaaaauuagaaaauu

SEQ ID NO: 359302 - RNA, 64 nt, Human
uuuuuuaacccgguaguagccugagcaaugacucgcaagcaauguuagaggggaagcauaucuu

SEQ ID NO: 359303 - RNA, 64 nt, Human
ggaauuagcuaacuuggauuuguggaagcuuuuggcaagcaauauggaaucuugccugguauca

SEQ ID NO: 359304 - RNA, 64 nt, Human
aaggcaccucaugguuuucaggaugcugacagcugcaagcaacaggcacugccaaauucaggga

SEQ ID NO: 359305 - RNA, 64 nt, Human
ggaguauuauggaaauccacaauaacaaucuauggcaagcaacuaaguuuggugucaaaaugaa

SEQ ID NO: 359306 - RNA, 64 nt, Human
ucucuuagguuuccuugagauauguuccuccagugcaagcaagauaaugguuuacagaauuugc

SEQ ID NO: 359307 - RNA, 64 nt, Human
acuccucaccccagcucaagccauggcaggcguggcaagcaaaguggggaggagacagucccug

SEQ ID NO: 359308 - RNA, 64 nt, Human
uaauauagcaaacuuaaaaugaauuuaaacuuaagcaagcaagcguguauuuuccuugucugcu

SEQ ID NO: 359309 - RNA, 64 nt, Human
gguauagccugcccuggaggggaaggaaguccaugcaagcaaagacaugcaguuugcuugcaca

SEQ ID NO: 359310 - RNA, 64 nt, Human
aggauugaagaaaguagugcaugagacaccugcugcaagcaagacuguuuuuuucuuuuuuagu

SEQ ID NO: 359311 - RNA, 64 nt, Human
guuuagcuaacaguaaacagacaucuuuacaccagcaagcaacuaaggagauucaggaugcagc

SEQ ID NO: 359312 - RNA, 64 nt, Human
ggaggggugacgauucuccucaggcuuuggcccugcaagcaaacccacauaucugcucuguaug

SEQ ID NO: 359313 - RNA, 61 nt, Human
augaauaacuccacagcuccuccuggacccugcgcgggagcaggcagcuccugugcuguaa

SEQ ID NO: 359314 - RNA, 61 nt, Human
cuggcagccgcguguccacacaguuagcggagcgcgggacuucugcaguccucaggugacc

SEQ ID NO: 359315 - RNA, 61 nt, Human
ggauggcgguucugcccaguggugucucugagcgcgggaugacaggagcaaccgaagcacc

SEQ ID NO: 359316 - RNA, 64 nt, Human
aacaaguuucgagagagaagggagcaagacaagagcaagcaacggcuauuaaaugucacaaucc

SEQ ID NO: 359317 - RNA, 64 nt, Human
ugugaucacggauguuggcucccccucgcccuaugcaagcaaacacacucucaccuccucuccc

SEQ ID NO: 359318 - RNA, 64 nt, Human
gcaucccaagguucaauaaggccuuauuuaacaagcaagcaaaaugcaaaccaaaccauuauuc

SEQ ID NO: 359319 - RNA, 64 nt, Human
cugaucugacaggaggcagagcucaggcgguaaugcaagcaauggggaguggcuguaaauauag

SEQ ID NO: 359320 - RNA, 64 nt, Human
uauaaaacauuucauacaacacgauuguauuuuggcaagcaaauacacacacacacacauacuc

SEQ ID NO: 359321 - RNA, 64 nt, Human
aaaaaacaguguggaugaugauaugcuuuugugagcaagcaaaagcagaaacgugaagccguga

SEQ ID NO: 359322 - RNA, 64 nt, Human
ggacagaugccuccuuccucuuuuccuucccaaagcaagcaagaggccguggcugcugugggaa

SEQ ID NO: 359323 - RNA, 64 nt, Human
uaagcauauuuauuuucugccacuuuauuuaaaggcaagcaauauuuucuugaucauaaauauu

SEQ ID NO: 359324 - RNA, 64 nt, Human
ugggccuuggucacacuccuuggcuucucccaccgcaagcaacgcugccugccucugccgcucc

SEQ ID NO: 359325 - RNA, 64 nt, Human
ugagagguagaaguacuucaaauucaacaggccagcaagcaaucggcuuaaaauucccuuucuu

SEQ ID NO: 359326 - RNA, 64 nt, Human
ccaguacauuuuauaaccauccaggccuugguuugcaagcaacagaccuuaaacauacaggaaa

SEQ ID NO: 359327 - RNA, 64 nt, Human
auuguguaaaggaacaacugauauacuugagugugcaagcaaagaacccauuugccaugcugcu

SEQ ID NO: 359328 - RNA, 64 nt, Human
uaggguaagaagaaugaaaaugauccagaaaaaugcaagcaaguccacauggagauuuggagga

SEQ ID NO: 359329 - RNA, 64 nt, Human
aaggcuggaagaggcucuuggcaaacuucuuagugcaagcaaugguuagauuaauuugugaggc

SEQ ID NO: 359330 - RNA, 64 nt, Human
uuuuuccagccauucuuuucuucccccuccugaagcaagcaaagagcguggaggcgugugcagg

SEQ ID NO: 359331 - RNA, 64 nt, Human
cuuguucacugcagucuuaagaaagagguaaaaggcaagcaaaggagaugaaaucuguucuggg

SEQ ID NO: 359332 - RNA, 61 nt, Human
ggggauggagggguggugaugucaggguugggcgcgggaagaaaaggagaggaggaagcug

SEQ ID NO: 359333 - RNA, 61 nt, Human
ggaggagagcggugcgggcgacaagggcugagcgcgggagccaggcuggcccaguccuggg

SEQ ID NO: 359334 - RNA, 61 nt, Human
ccuuuccauaaagucaccuaggugaggauaggcgcgggagccucggcaugacaccauggag

SEQ ID NO: 359335 - RNA, 64 nt, Human
gaaggguuacuugcugcucacacuauauacagaugcaagcaaggggcguggagagugagggcuc

SEQ ID NO: 359336 - RNA, 64 nt, Human
uggccuuguauucucucugcucuguuauuaaaaagcaagcaaguggagcccgaguugucuuucu

SEQ ID NO: 359337 - RNA, 64 nt, Human
augaagaauacagucagcuuugugaaauaguauugcaagcaagccccgugggcaaauuuguauu

SEQ ID NO: 359338 - RNA, 64 nt, Human
ugaaacauucuggccauagcagcaacuaaaaacugcaagcaacuugguaacagaacuuucuaaa

SEQ ID NO: 359339 - RNA, 64 nt, Human
ucuaagcacagcucucuucuccuauuuucauccugcaagcaacucaaaauauuuaaaauaaagu

SEQ ID NO: 359340 - RNA, 64 nt, Human
auugcuuuaaaugcacugcugguguaaauaauuagcaagcaaagcguuucugugacuucaggua

SEQ ID NO: 359341 - RNA, 64 nt, Human
cgcagguaggaaaccacagaaccgucugcaaggagcaagcaacgguggcccuguccaccccagc

SEQ ID NO: 359342 - RNA, 64 nt, Human
ucagauuggaccagugcucuucaggaauguggcugcaagcaaggggcuagaaguucaccuccug

SEQ ID NO: 359343 - RNA, 64 nt, Human
ugaucaagguaggaauuacaauugcaugcagguagcaagcaagaaagcagaaacuacuguuccc

SEQ ID NO: 359344 - RNA, 64 nt, Human
auucggaccccaagcaucgccccaauaaagaccagcaagcaaccggcugggguguccgugcgug

SEQ ID NO: 359345 - RNA, 64 nt, Human
gaaaagacucacacuggaaggaaacacuaugaaugcaagcaauguggcaaagcuuucacuucuu

SEQ ID NO: 359346 - RNA, 64 nt, Human
gaaaaaauucacacuggagagaaacccuauaaaugcaagcaaugugguaaagccuuaauuguuc

SEQ ID NO: 359347 - RNA, 64 nt, Human
gaaaaaacucacacugcagagaaacccuaugaaugcaagcaaugugguaaagccuucaguaguu

SEQ ID NO: 359348 - RNA, 64 nt, Human
aauaaaaaaaagcuuccaucucccagcccuucuugcaagcaagggcaggccauuuccuccgguc

SEQ ID NO: 359349 - RNA, 64 nt, Human
ccuauuagccauggaaaugcaaaguuuagcagaagcaagcaauuaggcagagaacaaaaauguu

SEQ ID NO: 359350 - RNA, 64 nt, Human
cauuuuuuuuuuuuccaguaaacaaaaccugaaagcaagcaacaaaacauacacuuugucagag

SEQ ID NO: 359351 - RNA, 64 nt, Human
guaaaauuuagaucaauuccaugucuuuguuaaguacagggauuuaauauauuuugaauauaau

SEQ ID NO: 359352 - RNA, 64 nt, Human
gaagaacuaauaaauggacuacaguagcucacguuacagggaaggaggguaggcagggaggcuc

SEQ ID NO: 359353 - RNA, 64 nt, Human
cuuuauauuguucuucauaucccaaauuagaguuuacagggacagucuucauuuacuuguaaau

SEQ ID NO: 359354 - RNA, 64 nt, Human
uccccuugauccuggcauucuggaagacacgaaagcaagcaaggauauauaaggcacuguggug

SEQ ID NO: 359355 - RNA, 64 nt, Human
aagcuccuuuccccuugcucuuggucccugccccgcaagcaaaccugcccccucugccucccag

SEQ ID NO: 359356 - RNA, 64 nt, Human
cacccagagcacacggccgcggagaugacgucacgcaagcaacggcgcugacgucacauaucac

SEQ ID NO: 359357 - RNA, 64 nt, Human
cagccucuccuccuugggcagggucucugcuccagcaagcaaacaggguggcccagguggcuau

SEQ ID NO: 359358 - RNA, 64 nt, Human
acccuuuagcuaccuugaacuucagcgguacgcggcaagcaacaaauccacagccccugaugac

SEQ ID NO: 359359 - RNA, 64 nt, Human
agauuuuuguuuucuuuccaauagcaaauucaaagcaagcaacuugcaggcuccauggaacuuu

SEQ ID NO: 359360 - RNA, 64 nt, Human
ucucagccaacccuccuuagacugagcugucagagcaagcaauuaggggccagccugccuccac

SEQ ID NO: 359361 - RNA, 64 nt, Human
agaggggcaucgggccagggaaaaccucggauuagcaagcaauaaaaacaugaccucacucuuc

SEQ ID NO: 359362 - RNA, 64 nt, Human
uucuuugcuccuuuuuacagucuuugucuuugcagcaagcaaaugaaauuaagccacuuuggga

SEQ ID NO: 359363 - RNA, 59 nt, Human
ugggcagguccucugccuagaaacacaaggcaagcaacaucagguaaaaaccaauccuu

SEQ ID NO: 359364 - RNA, 64 nt, Human
cgcuacccucggccugcccaccaccaagcaagcagcaagcaagaugggguucucaucaguucuu

SEQ ID NO: 359365 - RNA, 64 nt, Human
uuagagguucaaaaggaagugccucaaagcaaaggcaagcaaaggaaccccacgaugaacuugc

SEQ ID NO: 359366 - RNA, 64 nt, Human
caggacagugcuacccuagauucugugagauucugcaagcaacucagaaagcuuuauaaaccug

SEQ ID NO: 359367 - RNA, 64 nt, Human
gggccuuguaaaaggccaggguaaaaugucucaggcaagcaaaagauuguccccuucugcauau

SEQ ID NO: 359368 - RNA, 64 nt, Human
aaucaaauaauucuuuucuguaauccaauaugcagcaagcaagggugaccuccaguggcccacu

SEQ ID NO: 359369 - RNA, 64 nt, Human
acuaaacuaagaguaucagguuauuuauauauuugcaagcaaaggacaguaagaaguugacugg

SEQ ID NO: 359370 - RNA, 61 nt, Human
ccgaggaaacuccgcugccgacccugccugagcgcgggagccugaggaccggguggaggcg

SEQ ID NO: 359371 - RNA, 61 nt, Human
gcgcccgcucacccaggagcccuggaucccggcgcgggaaagucacagagcugccugggcu

SEQ ID NO: 359372 - RNA, 61 nt, Human
caggccccagcagucuccgcucccgcagcgggcgcgggacaggacuugugcgccggcgccc

SEQ ID NO: 359373 - RNA, 64 nt, Human
accuugauugcaccaacagguccagaguaugagugcaagcaaagcagaacucucaugcgugacc

SEQ ID NO: 359374 - RNA, 64 nt, Human
cccaguaagaauacccggacuucagauacguuaagcaagcaacagcagacccugcgaaugcaca

SEQ ID NO: 359375 - RNA, 64 nt, Human
gaaguucgccgggcccggccacccugccccaagggcaagcaaggaauacguucccccagcccca

SEQ ID NO: 359376 - RNA, 64 nt, Human
guuccccuuuguccucucguggaaacagcacacagcaagcaaccacaaaaccagagcggaagga

SEQ ID NO: 359377 - RNA, 64 nt, Human
cuaggccauaugugcauuguggcuguagaugcuagcaagcaaugucaucaacugucagguuguu

SEQ ID NO: 359378 - RNA, 64 nt, Human
cuugaaagcaucuguuugagggaaaggucucugggcaagcaagugguuauuuggauugcuugcu

SEQ ID NO: 359379 - RNA, 64 nt, Human
guuuucguaaucuucaucaagaaguuuuuaaaaggcaagcaaaaacagaagcaaaucauaucaa

SEQ ID NO: 359380 - RNA, 64 nt, Human
uaacaacugugggauggcgauggugggaugugucgcaagcaauucacuagacaaucuucacaug

SEQ ID NO: 359381 - RNA, 64 nt, Human
caggcuccaucccuggcuuccccagccugcggccgcaagcaaaaccaagcgcgagaugcagcua

SEQ ID NO: 359382 - RNA, 64 nt, Human
ugucugcuuucuaagugggaagaggaagggagaggcaagcaacuagguacaaugucuaucagga

SEQ ID NO: 359383 - RNA, 64 nt, Human
acauucagcaauagcauuugagcaaguuuuaucagcaagcaauauuuucaguuaauaagguuuc

SEQ ID NO: 359384 - RNA, 64 nt, Human
cauuguuucauagagcuaugaucaggccauuucugcaagcaauguaugaccccaccugagcaac

SEQ ID NO: 359385 - RNA, 64 nt, Human
cuuuaaagcuaucaacaaaaacugaauauuauaagcaagcaauaucauaguaauuggcagauua

SEQ ID NO: 359386 - RNA, 64 nt, Human
uugaaauccaacugggaagaagauaauucuuugagcaagcaaugguagauucaggcuccuacag

SEQ ID NO: 359387 - RNA, 64 nt, Human
uugagucucaauugaagauaaaagaauguacugagcaagcaaagccaauggagaguauuucaca

SEQ ID NO: 359388 - RNA, 64 nt, Human
ucauuuuucauagaucuauaaucaggcaauuucugcaagcaauguaugaccccaccugagcaac

SEQ ID NO: 359389 - RNA, 61 nt, Human
gacugugccggagucccugggggaggugcuggcgcgggaugaggacgggccacccuggcac

SEQ ID NO: 359390 - RNA, 61 nt, Human
ccugccuggcucacuggaaauccucuuuugagcgcgggauauggcuugcccuuguccgugu

SEQ ID NO: 359391 - RNA, 61 nt, Human
ucaggccugggcaggacccugcugacucguggcgcgggagcugggagccaggcucuccggg

SEQ ID NO: 359392 - RNA, 61 nt, Human
cuccguccacccaggcugcacugcagugauggcgcgggaggcaccagcucuguggccugug

SEQ ID NO: 359393 - RNA, 61 nt, Human
auggggguggggaggcaagaaccaguguuuagcgcgggacuacuguuccaaaaagaauucc

SEQ ID NO: 359394 - RNA, 61 nt, Human
cccccgccucugauccccgggggcgagauuggcgcgggaguguggccgcgccccaucagau

SEQ ID NO: 359395 - RNA, 61 nt, Human
cgugcagguuggaaaucagaagucugugagagcgcgggagugcauggcagcucuggguccc

SEQ ID NO: 359396 - RNA, 61 nt, Human
uugcugggcguggaguggggacggaagaugagcgcgggaaaggcacuccaaccucacucuu

SEQ ID NO: 359397 - RNA, 61 nt, Human
ccacagcucccuuccgaggcugcagggccaggcgcgggaccgcagguagcccaggguguug

SEQ ID NO: 359398 - RNA, 61 nt, Human
agacaggcuggggcagcgccaaggcggucucgcgcgggacuuuguacagcagugucuuauc

SEQ ID NO: 359399 - RNA, 61 nt, Human
gccguggcucugggcggcgcggacgcgcguagcgcgggagcagggcacugugcugcugcug

SEQ ID NO: 359400 - RNA, 61 nt, Human
acucccgcgccgggacgcggggugggaccaggcgcgggaccuggggcgggggacgggacuu

SEQ ID NO: 359401 - RNA, 61 nt, Human
ggagucacccaggaaagcaccgcacaggcuggcgcgggacagacuccuaaccuggggccuc

SEQ ID NO: 359402 - RNA, 54 nt, Human
aggacaugcucaagaaguagccgcgcgcgggacagcggccccgcggagcccccg

SEQ ID NO: 359403 - RNA, 61 nt, Human
gguagaggcauuugucuuagagagagagagagcgcgggagagagugagagagagugagagc

SEQ ID NO: 359404 - RNA, 61 nt, Human
ccccugugagcaugggaagggccugcagugggcgcgggagugagcugaggaacuggggugc

SEQ ID NO: 359405 - RNA, 61 nt, Human
cucgcucagugccauagccuuaccgcagccugcgcgggaggccacagcccgugccgauucc

SEQ ID NO: 359406 - RNA, 52 nt, Human
ggcagaaacauagcuccugagagcgcgggacuuggacacggaccucggcggg

SEQ ID NO: 359407 - RNA, 61 nt, Human
guccagcugaagccggggggccgggggaggggcgcgggagggggcggggcggggcagcaac

SEQ ID NO: 359408 - RNA, 61 nt, Human
uucuuuuuauagaaaagaucaaggcugucuggcgcgggacuccaugagccccaggcgcugg

SEQ ID NO: 359409 - RNA, 61 nt, Human
acugugggcccacuugccccacugugcuagggcgcgggaggagagagcacuguggucgccc

SEQ ID NO: 359410 - RNA, 62 nt, Human
gagugacucagacacaccacaguaacaacucucgcugcaauuuuauuuuaauuugagaaaua

SEQ ID NO: 359411 - RNA, 62 nt, Human
ccaggcuggagugcaguggcaugaucucagcucgcugcaacccccaccucccagguucaagc

SEQ ID NO: 359412 - RNA, 62 nt, Human
ugccugugucuauuauuauauucauaucucuacgcugcaaauuuugggucucaauuuuuacu

SEQ ID NO: 359413 - RNA, 62 nt, Human
agcaaagcuuguugauaguguaguuuucuaaacgcugcaaauuugcagccuuuaccacuaca

SEQ ID NO: 359414 - RNA, 62 nt, Human
ccagugaacugacuuucuaguucuagaaguuccgcugcaaggccaggaaagcuugagaaagg

SEQ ID NO: 359415 - RNA, 62 nt, Human
ccaggcuggagugcaguggcgcagucucggcucgcugcaaccucugacucccugguucaaac

SEQ ID NO: 359416 - RNA, 62 nt, Human
uucuagggaaaugaaagaaaggccagcaaauucgcugcaaccuguugauagcaagugaauuu

SEQ ID NO: 359417 - RNA, 62 nt, Human
agccacaggguguuuugcacugaaacgcagaacgcugcaaccaauacuguuguucuccucgc

SEQ ID NO: 359418 - RNA, 62 nt, Human
ugcaagugagccccgugugcacaccacccucccgcugcaagucagauugcugggaggacugg

SEQ ID NO: 359419 - RNA, 62 nt, Human
uccccucaguuguuucuaagagcagagucucccgcugcaaucugggugguaacugccagccu

SEQ ID NO: 359420 - RNA, 62 nt, Human
aacaggggaugucaaaucgauucuugaauucccgcugcaagcuagagccgcaggcacccucu

SEQ ID NO: 359421 - RNA, 62 nt, Human
ucuucccacccuccacccaccagaguggaacccgcugcaaaauccccagccuuaauucuugc

SEQ ID NO: 359422 - RNA, 62 nt, Human
uaucuauuauauauuaaacauucuugcugcugcgcugcaaaaccauagcagauuugaggcac

SEQ ID NO: 359423 - RNA, 62 nt, Human
cccaagucacagaaauaaaaaacugacuuuaccgcugcaauuuuucuguuuuccuccuuacu

SEQ ID NO: 359424 - RNA, 62 nt, Human
ccucccggaggcauacuugguuuccugacagccgcugcaauacacagucuugacggugccau

SEQ ID NO: 359425 - RNA, 62 nt, Human
ccccaauggacuccagaagaaacuugauucaucgcugcaaaggaaagaacaaccuuaaaacu

SEQ ID NO: 359426 - RNA, 62 nt, Human
gcgaguagaugccugggcagggaccaggccagcgcugcaaccuccuucggcuuugcccccuu

SEQ ID NO: 359427 - RNA, 62 nt, Human
accccgaggccgccaauuguccgccccgccagcgcugcaaauaaaccuucugagucagcccu

SEQ ID NO: 359428 - RNA, 62 nt, Human
ugcugugucucgcccacccugugcccuggcgccgcugcaacagccccucauggccaggagcc

SEQ ID NO: 359429 - RNA, 62 nt, Human
augcuugagaugguuuuugcaaaagcagaaaucgcugcaagguaaucacaauagauaaaagu

SEQ ID NO: 359430 - RNA, 62 nt, Human
aucccgcuggagagcaaacacgaacuucuguucgcugcaaaaugguuagaaagaaacagcug

SEQ ID NO: 359431 - RNA, 62 nt, Human
agaggcagaaaaguugguuugguuugcaguaacgcugcaacuagaaaauauaugcacuucag

SEQ ID NO: 359432 - RNA, 62 nt, Human
ccuuugaccccaaggccuggagggcccaaugucgcugcaaacacagccacgaagaacaugca

SEQ ID NO: 359433 - RNA, 62 nt, Human
ccuacacaaucagaauuugccuuuuuaagucacgcugcaacuauuccggcuuuuuauauggc

SEQ ID NO: 359434 - RNA, 62 nt, Human
aagccucgugccacacuggcuuugagguagcacgcugcaaguuagugaguggaguugcccaa

SEQ ID NO: 359435 - RNA, 62 nt, Human
gguuaucaucauuauuuguauuuugugaauuacgcugcaaaaaaaaaaaaaauguuggcuac

SEQ ID NO: 359436 - RNA, 62 nt, Human
cuccaccgagggaggccucacaaaccacaggacgcugcaacgggucaggcuggcgggcccgg

SEQ ID NO: 359437 - RNA, 62 nt, Human
cucggcagcuugggauuagcuugggagcgcagcgcugcaaaguggaaaauaugaaaagacca

SEQ ID NO: 359438 - RNA, 62 nt, Human
caugcauuuacucucugccgugggucugcagucgcugcaaccuacccucucucugccucagc

SEQ ID NO: 359439 - RNA, 62 nt, Human
uggguugucucgaucuguguuucaauaaaugccgcugcaaugcaagagcguguggucuugug

SEQ ID NO: 359440 - RNA, 62 nt, Human
cuuguccccagugucaccagaccuucugugugcgcugcaagcgccaggugaggcacauucau

SEQ ID NO: 359441 - RNA, 62 nt, Human
cuuucugacguaauguaauucaggaagacagacgcugcaaucacagauuuuaaaaaauuguu

SEQ ID NO: 359442 - RNA, 62 nt, Human
ccaggcuggagugcaauggcacuaucucagcucgcugcaaccuucaccuccuggguucaagc

SEQ ID NO: 359443 - RNA, 62 nt, Human
ucucagccuuccugaccucugccccaaacacacgcugcaauuuugucuccuccuuuucuguu

SEQ ID NO: 359444 - RNA, 62 nt, Human
guucuguguuguuuccuuagaccugugguguccgcugcaacagcuacuagccacguguagcu

SEQ ID NO: 359445 - RNA, 62 nt, Human
uggugaccauugauugcugcuucugcccaggccgcugcaaagguuaggacuuuguccacuca

SEQ ID NO: 359446 - RNA, 62 nt, Human
ggaaggaggcaacugccucacuuaacauccuccgcugcaaggugguggcgccgagaggcgug

SEQ ID NO: 359447 - RNA, 62 nt, Human
cugcagggcccucccuuuucccauuguuccugcgcugcaaauugcaggccccagcaaucgug

SEQ ID NO: 359448 - RNA, 62 nt, Human
cggagggcugguguucaccaaguuucccuccucgcugcaacccaaugacaccuguauuguuc

SEQ ID NO: 359449 - RNA, 62 nt, Human
ccaggcuggagugcaguggcaugaucucaggucgcugcaaccucugccuccaggguucaagc

SEQ ID NO: 359450 - RNA, 62 nt, Human
acuaaacauggaaaggaacaacugauaccagccgcugcaaaaucaugccaaaauguaaagac

SEQ ID NO: 359451 - RNA, 62 nt, Human
ccaggcuggagugcaguggcacaaucucagcucgcugcaaccucugccuccuggguucaagc

SEQ ID NO: 359452 - RNA, 62 nt, Human
guaaccagcgggguaaguuaagccaggaccuucgcugcaaaccugguuuuauugcuccuuca

SEQ ID NO: 359453 - RNA, 62 nt, Human
uucuaagcccggccucgucucgccggaggagacgcugcaauaaagguugggagaaggcgcgg

SEQ ID NO: 359454 - RNA, 62 nt, Human
ugugugacucaguucuuuccaucuguuugucccgcugcaagccucuuucugcgcugacugug

SEQ ID NO: 359455 - RNA, 62 nt, Human
uaucuauuauauauuaaacauucuugcugcugcgcugcaaagccauagcagauuugaggcgc

SEQ ID NO: 359456 - RNA, 62 nt, Human
cuggacaccccugcucuacccaugagccugcccgcugcaaugccuagacuucccaacagccu

SEQ ID NO: 359457 - RNA, 62 nt, Human; identical to SEQ ID NO: 359415

SEQ ID NO: 359458 - RNA, 64 nt, Human; identical to SEQ ID NO: 205450

SEQ ID NO: 359459 - RNA, 64 nt, Human; identical to SEQ ID NO: 205451

SEQ ID NO: 359460 - RNA, 64 nt, Human; identical to SEQ ID NO: 204922

SEQ ID NO: 359461 - RNA, 64 nt, Human; identical to SEQ ID NO: 204923

SEQ ID NO: 359462 - RNA, 64 nt, Human; identical to SEQ ID NO: 204924

SEQ ID NO: 359463 - RNA, 64 nt, Human; identical to SEQ ID NO: 204925

SEQ ID NO: 359464 - RNA, 64 nt, Human; identical to SEQ ID NO: 204942

SEQ ID NO: 359465 - RNA, 64 nt, Human; identical to SEQ ID NO: 204943

SEQ ID NO: 359466 - RNA, 64 nt, Human; identical to SEQ ID NO: 204944

SEQ ID NO: 359467 - RNA, 64 nt, Human
auucuccugccucagccucucugguagcugggauuacagggaaggaaaauagcuggcauuucuu

SEQ ID NO: 359468 - RNA, 64 nt, Human
cuuaaugccaagucagcagauuugcuuuaugaauuacagggacuagaaaugcccacauucagga

SEQ ID NO: 359469 - RNA, 64 nt, Human
agcuaaggaacaauggaaagagcugaaggccaccuacagggagcacguagaggccaucaaaauu

SEQ ID NO: 359470 - RNA, 64 nt, Human; identical to SEQ ID NO: 204945

SEQ ID NO: 359471 - RNA, 64 nt, Human; identical to SEQ ID NO: 205635

SEQ ID NO: 359472 - RNA, 64 nt, Human; identical to SEQ ID NO: 205636

SEQ ID NO: 359473 - RNA, 64 nt, Human; identical to SEQ ID NO: 205637

SEQ ID NO: 359474 - RNA, 64 nt, Human; identical to SEQ ID NO: 205638

SEQ ID NO: 359475 - RNA, 64 nt, Human; identical to SEQ ID NO: 205639

SEQ ID NO: 359476 - RNA, 64 nt, Human; identical to SEQ ID NO: 205640

SEQ ID NO: 359477 - RNA, 64 nt, Human; identical to SEQ ID NO: 205641

SEQ ID NO: 359478 - RNA, 64 nt, Human; identical to SEQ ID NO: 205642

SEQ ID NO: 359479 - RNA, 64 nt, Human; identical to SEQ ID NO: 205643

SEQ ID NO: 359480 - RNA, 64 nt, Human; identical to SEQ ID NO: 205644

SEQ ID NO: 359481 - RNA, 64 nt, Human; identical to SEQ ID NO: 205645

SEQ ID NO: 359482 - RNA, 64 nt, Human; identical to SEQ ID NO: 205646

SEQ ID NO: 359483 - RNA, 64 nt, Human; identical to SEQ ID NO: 205647

SEQ ID NO: 359484 - RNA, 64 nt, Human; identical to SEQ ID NO: 205648

SEQ ID NO: 359485 - RNA, 64 nt, Human; identical to SEQ ID NO: 205649

SEQ ID NO: 359486 - RNA, 63 nt, Human
ugcgccugugaugcugggcacuucaucugaucgggggcguagcaucauaguaguuuuuacagc

SEQ ID NO: 359487 - RNA, 63 nt, Human
ggcugauuaaauggccaucugauggcugaaagaggggcguauuuuucacucuguagugaaagg

SEQ ID NO: 359488 - RNA, 64 nt, Human
gggacaucugagggcuucacagggcugcaaaggguacagggauugcaccagggcagaacagggg

SEQ ID NO: 359489 - RNA, 64 nt, Human
aggacucggauuucacaagcaugaccagccugcuuacagggagcgugaagcgcuuuuccacaau

SEQ ID NO: 359490 - RNA, 64 nt, Human; identical to SEQ ID NO: 205650

SEQ ID NO: 359491 - RNA, 64 nt, Human; identical to SEQ ID NO: 205651

SEQ ID NO: 359492 - RNA, 64 nt, Human; identical to SEQ ID NO: 205652

SEQ ID NO: 359493 - RNA, 64 nt, Human; identical to SEQ ID NO: 205653

SEQ ID NO: 359494 - RNA, 64 nt, Human; identical to SEQ ID NO: 205654

SEQ ID NO: 359495 - RNA, 64 nt, Human; identical to SEQ ID NO: 205655

SEQ ID NO: 359496 - RNA, 64 nt, Human; identical to SEQ ID NO: 205656

SEQ ID NO: 359497 - RNA, 64 nt, Human; identical to SEQ ID NO: 205657

SEQ ID NO: 359498 - RNA, 64 nt, Human; identical to SEQ ID NO: 205658

SEQ ID NO: 359499 - RNA, 64 nt, Human; identical to SEQ ID NO: 205659

SEQ ID NO: 359500 - RNA, 64 nt, Human; identical to SEQ ID NO: 205660

SEQ ID NO: 359501 - RNA, 64 nt, Human; identical to SEQ ID NO: 205661

SEQ ID NO: 359502 - RNA, 64 nt, Human; identical to SEQ ID NO: 205662

SEQ ID NO: 359503 - RNA, 64 nt, Human; identical to SEQ ID NO: 205663

SEQ ID NO: 359504 - RNA, 64 nt, Human; identical to SEQ ID NO: 205664

SEQ ID NO: 359505 - RNA, 64 nt, Human; identical to SEQ ID NO: 205665

SEQ ID NO: 359506 - RNA, 64 nt, Human
guacggaguugucagcacucacugaaccucacuuuacagggauaagagugguguggcauuuuaa

SEQ ID NO: 359507 - RNA, 64 nt, Human
uacuaaaguuaaaacgucacaaaggugcugcuuuuacagggaagcuuauucuguuuuaaacauu

SEQ ID NO: 359508 - RNA, 64 nt, Human
aguaagauaauaacagcugaccugccaacagcauuacagggagauucuuugcucagcuaacaca

SEQ ID NO: 359509 - RNA, 64 nt, Human
augauguacaccaaauacccacuuuauagauaauuacagggauggugaaaaauuaguaaauagc

SEQ ID NO: 359510 - RNA, 64 nt, Human; identical to SEQ ID NO: 205666

SEQ ID NO: 359511 - RNA, 64 nt, Human; identical to SEQ ID NO: 205667

SEQ ID NO: 359512 - RNA, 64 nt, Human; identical to SEQ ID NO: 205668

SEQ ID NO: 359513 - RNA, 64 nt, Human; identical to SEQ ID NO: 205669

SEQ ID NO: 359514 - RNA, 64 nt, Human; identical to SEQ ID NO: 205670

SEQ ID NO: 359515 - RNA, 64 nt, Human; identical to SEQ ID NO: 205671

SEQ ID NO: 359516 - RNA, 64 nt, Human; identical to SEQ ID NO: 205672

SEQ ID NO: 359517 - RNA, 64 nt, Human; identical to SEQ ID NO: 205673

SEQ ID NO: 359518 - RNA, 64 nt, Human; identical to SEQ ID NO: 205674

SEQ ID NO: 359519 - RNA, 64 nt, Human; identical to SEQ ID NO: 205675

SEQ ID NO: 359520 - RNA, 64 nt, Human; identical to SEQ ID NO: 205676

SEQ ID NO: 359521 - RNA, 64 nt, Human; identical to SEQ ID NO: 205677

SEQ ID NO: 359522 - RNA, 64 nt, Human; identical to SEQ ID NO: 205678

SEQ ID NO: 359523 - RNA, 64 nt, Human; identical to SEQ ID NO: 205679

SEQ ID NO: 359524 - RNA, 64 nt, Human; identical to SEQ ID NO: 205680

SEQ ID NO: 359525 - RNA, 64 nt, Human; identical to SEQ ID NO: 205681

SEQ ID NO: 359526 - RNA, 64 nt, Human
uuucucugugccagaucuucagugccccuuuccauacagggauuuuuuucucauagaguaauua

SEQ ID NO: 359527 - RNA, 64 nt, Human
gucagacugaucuggaagugaaacacaguuuauguacagggaaaaggauuuuauuauccuuagg

SEQ ID NO: 359528 - RNA, 64 nt, Human
cugcaggcaccuuaguggcuuuuuuccuccuguguacagggaagagagggguacauuucccugu

SEQ ID NO: 359529 - RNA, 64 nt, Human
acagaagaaaaaccuucagccagauugaaugcuuuacagggaagaauucauacugcagagcggu

SEQ ID NO: 359530 - RNA, 64 nt, Human; identical to SEQ ID NO: 205682

SEQ ID NO: 359531 - RNA, 64 nt, Human; identical to SEQ ID NO: 205683

SEQ ID NO: 359532 - RNA, 64 nt, Human; identical to SEQ ID NO: 205684

SEQ ID NO: 359533 - RNA, 64 nt, Human; identical to SEQ ID NO: 205685

SEQ ID NO: 359534 - RNA, 64 nt, Human; identical to SEQ ID NO: 205686

SEQ ID NO: 359535 - RNA, 64 nt, Human; identical to SEQ ID NO: 205687

SEQ ID NO: 359536 - RNA, 64 nt, Human; identical to SEQ ID NO: 205688

SEQ ID NO: 359537 - RNA, 64 nt, Human; identical to SEQ ID NO: 205689

SEQ ID NO: 359538 - RNA, 64 nt, Human; identical to SEQ ID NO: 205690

SEQ ID NO: 359539 - RNA, 64 nt, Human; identical to SEQ ID NO: 205691

SEQ ID NO: 359540 - RNA, 64 nt, Human; identical to SEQ ID NO: 205692

SEQ ID NO: 359541 - RNA, 64 nt, Human; identical to SEQ ID NO: 205693

SEQ ID NO: 359542 - RNA, 64 nt, Human; identical to SEQ ID NO: 205694

SEQ ID NO: 359543 - RNA, 64 nt, Human; identical to SEQ ID NO: 205695

SEQ ID NO: 359544 - RNA, 64 nt, Human; identical to SEQ ID NO: 205696

SEQ ID NO: 359545 - RNA, 64 nt, Human; identical to SEQ ID NO: 205697

SEQ ID NO: 359546 - RNA, 64 nt, Human
cucgggugacgaagccugacuuugucucaaaaaauacagggaugaauaugucaauuacccugau

SEQ ID NO: 359547 - RNA, 64 nt, Human
gccaggcaggguggcaugugccuuuaaucccagcuacagggaggcugaggcaggagaaucacuu

SEQ ID NO: 359548 - RNA, 64 nt, Human
cugugggcccggccuuaggguggaggcuuuaguguacagggacagccauggccacacagcacac

SEQ ID NO: 359549 - RNA, 64 nt, Human
uuaauuaugagcuagccaaaugugggcauacuauuacagggaaaguuuaaaggucugauaacuu

SEQ ID NO: 359550 - RNA, 64 nt, Human; identical to SEQ ID NO: 205698

SEQ ID NO: 359551 - RNA, 64 nt, Human; identical to SEQ ID NO: 205699

SEQ ID NO: 359552 - RNA, 64 nt, Human; identical to SEQ ID NO: 205700

SEQ ID NO: 359553 - RNA, 64 nt, Human; identical to SEQ ID NO: 205701

SEQ ID NO: 359554 - RNA, 64 nt, Human; identical to SEQ ID NO: 205702

SEQ ID NO: 359555 - RNA, 64 nt, Human; identical to SEQ ID NO: 205703

SEQ ID NO: 359556 - RNA, 64 nt, Human; identical to SEQ ID NO: 205704

SEQ ID NO: 359557 - RNA, 64 nt, Human; identical to SEQ ID NO: 205705

SEQ ID NO: 359558 - RNA, 64 nt, Human; identical to SEQ ID NO: 205706

SEQ ID NO: 359559 - RNA, 64 nt, Human; identical to SEQ ID NO: 205707

SEQ ID NO: 359560 - RNA, 64 nt, Human; identical to SEQ ID NO: 205708

SEQ ID NO: 359561 - RNA, 64 nt, Human; identical to SEQ ID NO: 205709

SEQ ID NO: 359562 - RNA, 64 nt, Human; identical to SEQ ID NO: 205710

SEQ ID NO: 359563 - RNA, 64 nt, Human; identical to SEQ ID NO: 205711

SEQ ID NO: 359564 - RNA, 64 nt, Human; identical to SEQ ID NO: 205712

SEQ ID NO: 359565 - RNA, 64 nt, Human; identical to SEQ ID NO: 205713

SEQ ID NO: 359566 - RNA, 54 nt, Human
uaacccccuucaaaaaaugauaccuacagggaggcagauaauuuuaaaauaaag

SEQ ID NO: 359567 - RNA, 64 nt, Human; identical to SEQ ID NO: 277291

SEQ ID NO: 359568 - RNA, 64 nt, Human; identical to SEQ ID NO: 277295

SEQ ID NO: 359569 - RNA, 64 nt, Human; identical to SEQ ID NO: 277299

SEQ ID NO: 359570 - RNA, 64 nt, Human; identical to SEQ ID NO: 205714

SEQ ID NO: 359571 - RNA, 64 nt, Human; identical to SEQ ID NO: 205715

SEQ ID NO: 359572 - RNA, 64 nt, Human; identical to SEQ ID NO: 205716

SEQ ID NO: 359573 - RNA, 64 nt, Human; identical to SEQ ID NO: 205717

SEQ ID NO: 359574 - RNA, 64 nt, Human; identical to SEQ ID NO: 205718

SEQ ID NO: 359575 - RNA, 64 nt, Human; identical to SEQ ID NO: 205719

SEQ ID NO: 359576 - RNA, 64 nt, Human; identical to SEQ ID NO: 205720

SEQ ID NO: 359577 - RNA, 64 nt, Human; identical to SEQ ID NO: 205721

SEQ ID NO: 359578 - RNA, 64 nt, Human; identical to SEQ ID NO: 205722

SEQ ID NO: 359579 - RNA, 64 nt, Human; identical to SEQ ID NO: 205723

SEQ ID NO: 359580 - RNA, 64 nt, Human; identical to SEQ ID NO: 205724

SEQ ID NO: 359581 - RNA, 63 nt, Human; identical to SEQ ID NO: 205725

SEQ ID NO: 359582 - RNA, 64 nt, Human; identical to SEQ ID NO: 205726

SEQ ID NO: 359583 - RNA, 64 nt, Human; identical to SEQ ID NO: 205727

SEQ ID NO: 359584 - RNA, 64 nt, Human; identical to SEQ ID NO: 205728

SEQ ID NO: 359585 - RNA, 64 nt, Human; identical to SEQ ID NO: 205729

SEQ ID NO: 359586 - RNA, 64 nt, Human; identical to SEQ ID NO: 277303

SEQ ID NO: 359587 - RNA, 64 nt, Human; identical to SEQ ID NO: 277310

SEQ ID NO: 359588 - RNA, 64 nt, Human; identical to SEQ ID NO: 277314

SEQ ID NO: 359589 - RNA, 64 nt, Human; identical to SEQ ID NO: 277321

SEQ ID NO: 359590 - RNA, 64 nt, Human; identical to SEQ ID NO: 205730

SEQ ID NO: 359591 - RNA, 64 nt, Human; identical to SEQ ID NO: 205731

SEQ ID NO: 359592 - RNA, 64 nt, Human; identical to SEQ ID NO: 205732

SEQ ID NO: 359593 - RNA, 64 nt, Human; identical to SEQ ID NO: 205733

SEQ ID NO: 359594 - RNA, 64 nt, Human; identical to SEQ ID NO: 205734

SEQ ID NO: 359595 - RNA, 64 nt, Human; identical to SEQ ID NO: 205735

SEQ ID NO: 359596 - RNA, 64 nt, Human; identical to SEQ ID NO: 205736

SEQ ID NO: 359597 - RNA, 64 nt, Human; identical to SEQ ID NO: 205737

SEQ ID NO: 359598 - RNA, 64 nt, Human; identical to SEQ ID NO: 205738

SEQ ID NO: 359599 - RNA, 64 nt, Human; identical to SEQ ID NO: 205739

SEQ ID NO: 359600 - RNA, 63 nt, Human; identical to SEQ ID NO: 205740

SEQ ID NO: 359601 - RNA, 64 nt, Human; identical to SEQ ID NO: 205741

SEQ ID NO: 359602 - RNA, 64 nt, Human; identical to SEQ ID NO: 205742

SEQ ID NO: 359603 - RNA, 64 nt, Human; identical to SEQ ID NO: 205743

SEQ ID NO: 359604 - RNA, 64 nt, Human; identical to SEQ ID NO: 205744

SEQ ID NO: 359605 - RNA, 64 nt, Human; identical to SEQ ID NO: 205745

SEQ ID NO: 359606 - RNA, 64 nt, Human; identical to SEQ ID NO: 277326

SEQ ID NO: 359607 - RNA, 64 nt, Human; identical to SEQ ID NO: 277330

SEQ ID NO: 359608 - RNA, 64 nt, Human; identical to SEQ ID NO: 277335

SEQ ID NO: 359609 - RNA, 64 nt, Human; identical to SEQ ID NO: 277341

SEQ ID NO: 359610 - RNA, 64 nt, Human; identical to SEQ ID NO: 205761

SEQ ID NO: 359611 - RNA, 64 nt, Human; identical to SEQ ID NO: 277346

SEQ ID NO: 359612 - RNA, 64 nt, Human; identical to SEQ ID NO: 277351

SEQ ID NO: 359613 - RNA, 64 nt, Human; identical to SEQ ID NO: 277356

SEQ ID NO: 359614 - RNA, 64 nt, Human; identical to SEQ ID NO: 277363

SEQ ID NO: 359615 - RNA, 64 nt, Human; identical to SEQ ID NO: 277368

SEQ ID NO: 359616 - RNA, 64 nt, Human; identical to SEQ ID NO: 277375

SEQ ID NO: 359617 - RNA, 62 nt, Human; identical to SEQ ID NO: 57488

SEQ ID NO: 359618 - RNA, 62 nt, Human; identical to SEQ ID NO: 57493

SEQ ID NO: 359619 - RNA, 62 nt, Human; identical to SEQ ID NO: 57498

SEQ ID NO: 359620 - RNA, 62 nt, Human; identical to SEQ ID NO: 57505

SEQ ID NO: 359621 - RNA, 62 nt, Human; identical to SEQ ID NO: 57511

SEQ ID NO: 359622 - RNA, 62 nt, Human; identical to SEQ ID NO: 57516

SEQ ID NO: 359623 - RNA, 62 nt, Human; identical to SEQ ID NO: 57521

SEQ ID NO: 359624 - RNA, 62 nt, Human; identical to SEQ ID NO: 57528

SEQ ID NO: 359625 - RNA, 62 nt, Human; identical to SEQ ID NO: 57533

SEQ ID NO: 359626 - RNA, 62 nt, Human; identical to SEQ ID NO: 57540

SEQ ID NO: 359627 - RNA, 62 nt, Human; identical to SEQ ID NO: 57547

SEQ ID NO: 359628 - RNA, 62 nt, Human; identical to SEQ ID NO: 57552

SEQ ID NO: 359629 - RNA, 64 nt, Human; identical to SEQ ID NO: 205762

SEQ ID NO: 359630 - RNA, 64 nt, Human; identical to SEQ ID NO: 205763

SEQ ID NO: 359631 - RNA, 64 nt, Human; identical to SEQ ID NO: 205764

SEQ ID NO: 359632 - RNA, 64 nt, Human; identical to SEQ ID NO: 205765

SEQ ID NO: 359633 - RNA, 64 nt, Human; identical to SEQ ID NO: 205766

SEQ ID NO: 359634 - RNA, 64 nt, Human; identical to SEQ ID NO: 205767

SEQ ID NO: 359635 - RNA, 64 nt, Human; identical to SEQ ID NO: 205768

SEQ ID NO: 359636 - RNA, 64 nt, Human; identical to SEQ ID NO: 205769

SEQ ID NO: 359637 - RNA, 64 nt, Human; identical to SEQ ID NO: 205770

SEQ ID NO: 359638 - RNA, 64 nt, Human; identical to SEQ ID NO: 205771

SEQ ID NO: 359639 - RNA, 64 nt, Human; identical to SEQ ID NO: 205772

SEQ ID NO: 359640 - RNA, 64 nt, Human; identical to SEQ ID NO: 205773

SEQ ID NO: 359641 - RNA, 64 nt, Human; identical to SEQ ID NO: 205774

SEQ ID NO: 359642 - RNA, 64 nt, Human; identical to SEQ ID NO: 205775

SEQ ID NO: 359643 - RNA, 64 nt, Human; identical to SEQ ID NO: 205776

SEQ ID NO: 359644 - RNA, 64 nt, Human; identical to SEQ ID NO: 205777

SEQ ID NO: 359645 - RNA, 64 nt, Human; identical to SEQ ID NO: 64439

SEQ ID NO: 359646 - RNA, 64 nt, Human; identical to SEQ ID NO: 64444

SEQ ID NO: 359647 - RNA, 64 nt, Human; identical to SEQ ID NO: 64451

SEQ ID NO: 359648 - RNA, 64 nt, Human; identical to SEQ ID NO: 205778

SEQ ID NO: 359649 - RNA, 64 nt, Human; identical to SEQ ID NO: 205779

SEQ ID NO: 359650 - RNA, 64 nt, Human; identical to SEQ ID NO: 205780

SEQ ID NO: 359651 - RNA, 64 nt, Human; identical to SEQ ID NO: 205781

SEQ ID NO: 359652 - RNA, 64 nt, Human; identical to SEQ ID NO: 205782

SEQ ID NO: 359653 - RNA, 64 nt, Human; identical to SEQ ID NO: 205783

SEQ ID NO: 359654 - RNA, 64 nt, Human; identical to SEQ ID NO: 205784

SEQ ID NO: 359655 - RNA, 64 nt, Human; identical to SEQ ID NO: 205785

SEQ ID NO: 359656 - RNA, 64 nt, Human; identical to SEQ ID NO: 205786

SEQ ID NO: 359657 - RNA, 64 nt, Human; identical to SEQ ID NO: 205787

SEQ ID NO: 359658 - RNA, 64 nt, Human; identical to SEQ ID NO: 205788

SEQ ID NO: 359659 - RNA, 64 nt, Human; identical to SEQ ID NO: 205789

SEQ ID NO: 359660 - RNA, 64 nt, Human; identical to SEQ ID NO: 205790

SEQ ID NO: 359661 - RNA, 64 nt, Human; identical to SEQ ID NO: 205791

SEQ ID NO: 359662 - RNA, 64 nt, Human; identical to SEQ ID NO: 205792

SEQ ID NO: 359663 - RNA, 64 nt, Human; identical to SEQ ID NO: 205793

SEQ ID NO: 359664 - RNA, 64 nt, Human; identical to SEQ ID NO: 64463

SEQ ID NO: 359665 - RNA, 64 nt, Human; identical to SEQ ID NO: 64464

SEQ ID NO: 359666 - RNA, 64 nt, Human; identical to SEQ ID NO: 64465

SEQ ID NO: 359667 - RNA, 64 nt, Human; identical to SEQ ID NO: 64466

SEQ ID NO: 359668 - RNA, 64 nt, Human; identical to SEQ ID NO: 205794

SEQ ID NO: 359669 - RNA, 64 nt, Human; identical to SEQ ID NO: 205795

SEQ ID NO: 359670 - RNA, 64 nt, Human; identical to SEQ ID NO: 205796

SEQ ID NO: 359671 - RNA, 64 nt, Human; identical to SEQ ID NO: 205797

SEQ ID NO: 359672 - RNA, 64 nt, Human; identical to SEQ ID NO: 205798

SEQ ID NO: 359673 - RNA, 64 nt, Human; identical to SEQ ID NO: 205799

SEQ ID NO: 359674 - RNA, 64 nt, Human; identical to SEQ ID NO: 205800

SEQ ID NO: 359675 - RNA, 64 nt, Human; identical to SEQ ID NO: 205801

SEQ ID NO: 359676 - RNA, 64 nt, Human; identical to SEQ ID NO: 205802

SEQ ID NO: 359677 - RNA, 64 nt, Human; identical to SEQ ID NO: 205803

SEQ ID NO: 359678 - RNA, 64 nt, Human; identical to SEQ ID NO: 205804

SEQ ID NO: 359679 - RNA, 64 nt, Human; identical to SEQ ID NO: 205805

SEQ ID NO: 359680 - RNA, 64 nt, Human; identical to SEQ ID NO: 205806

SEQ ID NO: 359681 - RNA, 64 nt, Human; identical to SEQ ID NO: 205807

SEQ ID NO: 359682 - RNA, 64 nt, Human; identical to SEQ ID NO: 205808

SEQ ID NO: 359683 - RNA, 64 nt, Human; identical to SEQ ID NO: 205809

SEQ ID NO: 359684 - RNA, 64 nt, Human; identical to SEQ ID NO: 64467

SEQ ID NO: 359685 - RNA, 64 nt, Human; identical to SEQ ID NO: 64468

SEQ ID NO: 359686 - RNA, 64 nt, Human; identical to SEQ ID NO: 64469

SEQ ID NO: 359687 - RNA, 64 nt, Human; identical to SEQ ID NO: 64470

SEQ ID NO: 359688 - RNA, 64 nt, Human; identical to SEQ ID NO: 205810

SEQ ID NO: 359689 - RNA, 64 nt, Human; identical to SEQ ID NO: 205811

SEQ ID NO: 359690 - RNA, 64 nt, Human; identical to SEQ ID NO: 205812

SEQ ID NO: 359691 - RNA, 64 nt, Human; identical to SEQ ID NO: 205813

SEQ ID NO: 359692 - RNA, 64 nt, Human; identical to SEQ ID NO: 205814

SEQ ID NO: 359693 - RNA, 64 nt, Human; identical to SEQ ID NO: 205815

SEQ ID NO: 359694 - RNA, 64 nt, Human; identical to SEQ ID NO: 205816

SEQ ID NO: 359695 - RNA, 64 nt, Human; identical to SEQ ID NO: 205817

SEQ ID NO: 359696 - RNA, 64 nt, Human; identical to SEQ ID NO: 205818

SEQ ID NO: 359697 - RNA, 64 nt, Human; identical to SEQ ID NO: 205819

SEQ ID NO: 359698 - RNA, 64 nt, Human; identical to SEQ ID NO: 205820

SEQ ID NO: 359699 - RNA, 64 nt, Human; identical to SEQ ID NO: 205821

SEQ ID NO: 359700 - RNA, 64 nt, Human; identical to SEQ ID NO: 205822

SEQ ID NO: 359701 - RNA, 64 nt, Human; identical to SEQ ID NO: 205823

SEQ ID NO: 359702 - RNA, 64 nt, Human; identical to SEQ ID NO: 205824

SEQ ID NO: 359703 - RNA, 64 nt, Human; identical to SEQ ID NO: 205825

SEQ ID NO: 359704 - RNA, 64 nt, Human; identical to SEQ ID NO: 64471

SEQ ID NO: 359705 - RNA, 64 nt, Human; identical to SEQ ID NO: 64472

SEQ ID NO: 359706 - RNA, 64 nt, Human; identical to SEQ ID NO: 64473

SEQ ID NO: 359707 - RNA, 50 nt, Human; identical to SEQ ID NO: 64474

SEQ ID NO: 359708 - RNA, 64 nt, Human; identical to SEQ ID NO: 205826

SEQ ID NO: 359709 - RNA, 64 nt, Human; identical to SEQ ID NO: 205827

SEQ ID NO: 359710 - RNA, 64 nt, Human; identical to SEQ ID NO: 205828

SEQ ID NO: 359711 - RNA, 64 nt, Human; identical to SEQ ID NO: 205829

SEQ ID NO: 359712 - RNA, 64 nt, Human; identical to SEQ ID NO: 205830

SEQ ID NO: 359713 - RNA, 52 nt, Human; identical to SEQ ID NO: 205831

SEQ ID NO: 359714 - RNA, 64 nt, Human; identical to SEQ ID NO: 205832

SEQ ID NO: 359715 - RNA, 64 nt, Human; identical to SEQ ID NO: 205833

SEQ ID NO: 359716 - RNA, 64 nt, Human; identical to SEQ ID NO: 205834

SEQ ID NO: 359717 - RNA, 64 nt, Human; identical to SEQ ID NO: 205835

SEQ ID NO: 359718 - RNA, 64 nt, Human; identical to SEQ ID NO: 205836

SEQ ID NO: 359719 - RNA, 64 nt, Human; identical to SEQ ID NO: 205837

SEQ ID NO: 359720 - RNA, 64 nt, Human; identical to SEQ ID NO: 205838

SEQ ID NO: 359721 - RNA, 64 nt, Human; identical to SEQ ID NO: 205839

SEQ ID NO: 359722 - RNA, 62 nt, Human; identical to SEQ ID NO: 205840

SEQ ID NO: 359723 - RNA, 64 nt, Human; identical to SEQ ID NO: 205841

SEQ ID NO: 359724 - RNA, 62 nt, Human; identical to SEQ ID NO: 57557

SEQ ID NO: 359725 - RNA, 62 nt, Human; identical to SEQ ID NO: 57558

SEQ ID NO: 359726 - RNA, 64 nt, Human
gcucuggcaccugugaagcccuuuaaacacccuuaagccccaggcuccccguuuaccucagaga

SEQ ID NO: 359727 - RNA, 64 nt, Human
cagcugaagcuuuugcagcacuuuaccucucugaaagccccagaggaccagagcccccagccuu

SEQ ID NO: 359728 - RNA, 64 nt, Human; identical to SEQ ID NO: 205842

SEQ ID NO: 359729 - RNA, 64 nt, Human; identical to SEQ ID NO: 205843

SEQ ID NO: 359730 - RNA, 64 nt, Human; identical to SEQ ID NO: 205844

SEQ ID NO: 359731 - RNA, 64 nt, Human; identical to SEQ ID NO: 205845

SEQ ID NO: 359732 - RNA, 64 nt, Human; identical to SEQ ID NO: 205846

SEQ ID NO: 359733 - RNA, 64 nt, Human; identical to SEQ ID NO: 205847

SEQ ID NO: 359734 - RNA, 64 nt, Human; identical to SEQ ID NO: 205848

SEQ ID NO: 359735 - RNA, 64 nt, Human; identical to SEQ ID NO: 205849

SEQ ID NO: 359736 - RNA, 64 nt, Human; identical to SEQ ID NO: 205850

SEQ ID NO: 359737 - RNA, 64 nt, Human; identical to SEQ ID NO: 205851

SEQ ID NO: 359738 - RNA, 64 nt, Human; identical to SEQ ID NO: 205852

SEQ ID NO: 359739 - RNA, 64 nt, Human; identical to SEQ ID NO: 205853

SEQ ID NO: 359740 - RNA, 64 nt, Human; identical to SEQ ID NO: 205854

SEQ ID NO: 359741 - RNA, 64 nt, Human; identical to SEQ ID NO: 205855

SEQ ID NO: 359742 - RNA, 64 nt, Human; identical to SEQ ID NO: 205856

SEQ ID NO: 359743 - RNA, 64 nt, Human; identical to SEQ ID NO: 205857

SEQ ID NO: 359744 - RNA, 64 nt, Human
uaaaauaccauuccuucacaacuguauugucuggaagccccaugagaugguaauuauaggccuu

SEQ ID NO: 359745 - RNA, 64 nt, Human
aucugccuggccuggcuccccacgagucaccugcaagccccagggccugggggcagugacuggc

SEQ ID NO: 359746 - RNA, 64 nt, Human
gccaggggcuggaggccccuagaaaaagaucaguaagccccaguguccccccagcccccaugcu

SEQ ID NO: 359747 - RNA, 64 nt, Human
guuucuugguccacucugucacucugcucuggucaagccccauuuggucuacagcccaugagaa

SEQ ID NO: 359748 - RNA, 64 nt, Human; identical to SEQ ID NO: 205858

SEQ ID NO: 359749 - RNA, 64 nt, Human; identical to SEQ ID NO: 205859

SEQ ID NO: 359750 - RNA, 64 nt, Human; identical to SEQ ID NO: 205860

SEQ ID NO: 359751 - RNA, 64 nt, Human; identical to SEQ ID NO: 205861

SEQ ID NO: 359752 - RNA, 64 nt, Human; identical to SEQ ID NO: 205862

SEQ ID NO: 359753 - RNA, 64 nt, Human; identical to SEQ ID NO: 205863

SEQ ID NO: 359754 - RNA, 64 nt, Human; identical to SEQ ID NO: 205864

SEQ ID NO: 359755 - RNA, 64 nt, Human; identical to SEQ ID NO: 205865

SEQ ID NO: 359756 - RNA, 64 nt, Human; identical to SEQ ID NO: 205866

SEQ ID NO: 359757 - RNA, 64 nt, Human; identical to SEQ ID NO: 205867

SEQ ID NO: 359758 - RNA, 64 nt, Human; identical to SEQ ID NO: 205868

SEQ ID NO: 359759 - RNA, 64 nt, Human; identical to SEQ ID NO: 205869

SEQ ID NO: 359760 - RNA, 64 nt, Human; identical to SEQ ID NO: 205870

SEQ ID NO: 359761 - RNA, 64 nt, Human; identical to SEQ ID NO: 205871

SEQ ID NO: 359762 - RNA, 64 nt, Human; identical to SEQ ID NO: 205872

SEQ ID NO: 359763 - RNA, 64 nt, Human; identical to SEQ ID NO: 205873

SEQ ID NO: 359764 - RNA, 64 nt, Human
ggaaaaugaccuguaguuaccagugcaacgagcaaagccccacaguuuaguccuuuggaguuau

SEQ ID NO: 359765 - RNA, 64 nt, Human
ggagccucccacuggagugcccggccaggucuccaagccccaaaugaguccuugugaaccacaa

SEQ ID NO: 359766 - RNA, 64 nt, Human
gaaaguggauuuaaaauauauauauacguaacccaagccccauaaccccuaacuggacaaauga

SEQ ID NO: 359767 - RNA, 64 nt, Human
caugaagaagccacugguucuaggcauuucugggaagccccagggacugcaaguggccauuacc

SEQ ID NO: 359768 - RNA, 64 nt, Human; identical to SEQ ID NO: 205874

SEQ ID NO: 359769 - RNA, 64 nt, Human; identical to SEQ ID NO: 205875

SEQ ID NO: 359770 - RNA, 57 nt, Human; identical to SEQ ID NO: 205876

SEQ ID NO: 359771 - RNA, 64 nt, Human; identical to SEQ ID NO: 205877

SEQ ID NO: 359772 - RNA, 64 nt, Human; identical to SEQ ID NO: 205878

SEQ ID NO: 359773 - RNA, 64 nt, Human; identical to SEQ ID NO: 205879

SEQ ID NO: 359774 - RNA, 64 nt, Human; identical to SEQ ID NO: 205880

SEQ ID NO: 359775 - RNA, 64 nt, Human; identical to SEQ ID NO: 205881

SEQ ID NO: 359776 - RNA, 64 nt, Human; identical to SEQ ID NO: 205882

SEQ ID NO: 359777 - RNA, 64 nt, Human; identical to SEQ ID NO: 205883

SEQ ID NO: 359778 - RNA, 64 nt, Human; identical to SEQ ID NO: 205884

SEQ ID NO: 359779 - RNA, 64 nt, Human; identical to SEQ ID NO: 205885

SEQ ID NO: 359780 - RNA, 64 nt, Human; identical to SEQ ID NO: 205886

SEQ ID NO: 359781 - RNA, 64 nt, Human; identical to SEQ ID NO: 205887

SEQ ID NO: 359782 - RNA, 64 nt, Human; identical to SEQ ID NO: 205888

SEQ ID NO: 359783 - RNA, 64 nt, Human; identical to SEQ ID NO: 205889

SEQ ID NO: 359784 - RNA, 64 nt, Human
aaaacucuauccaaaacauuuuuggagcauuuuaaagccccauacacagaaguauacgaaagca

SEQ ID NO: 359785 - RNA, 64 nt, Human
uuccagcuaccuuccuguguaugcugagguacagaagccccauguguaccuacagagcagccag

SEQ ID NO: 359786 - RNA, 64 nt, Human
acggaggcacugugacaagggaaaccugcgugucaagccccaacagggcacagcagucuucugg

SEQ ID NO: 359787 - RNA, 64 nt, Human
ggaggcuggacgacuucacccccaaaggguccugaagccccagaacuggcauguggaaggggcu

SEQ ID NO: 359788 - RNA, 64 nt, Human; identical to SEQ ID NO: 205890

SEQ ID NO: 359789 - RNA, 64 nt, Human; identical to SEQ ID NO: 205891

SEQ ID NO: 359790 - RNA, 64 nt, Human; identical to SEQ ID NO: 205892

SEQ ID NO: 359791 - RNA, 64 nt, Human; identical to SEQ ID NO: 205893

SEQ ID NO: 359792 - RNA, 62 nt, Human; identical to SEQ ID NO: 205894

SEQ ID NO: 359793 - RNA, 57 nt, Human; identical to SEQ ID NO: 205895

SEQ ID NO: 359794 - RNA, 64 nt, Human; identical to SEQ ID NO: 205896

SEQ ID NO: 359795 - RNA, 64 nt, Human; identical to SEQ ID NO: 205897

SEQ ID NO: 359796 - RNA, 64 nt, Human; identical to SEQ ID NO: 205898

SEQ ID NO: 359797 - RNA, 64 nt, Human; identical to SEQ ID NO: 205899

SEQ ID NO: 359798 - RNA, 64 nt, Human; identical to SEQ ID NO: 205900

SEQ ID NO: 359799 - RNA, 64 nt, Human; identical to SEQ ID NO: 205901

SEQ ID NO: 359800 - RNA, 64 nt, Human; identical to SEQ ID NO: 205902

SEQ ID NO: 359801 - RNA, 64 nt, Human; identical to SEQ ID NO: 205903

SEQ ID NO: 359802 - RNA, 64 nt, Human; identical to SEQ ID NO: 205904

SEQ ID NO: 359803 - RNA, 64 nt, Human; identical to SEQ ID NO: 205905

SEQ ID NO: 359804 - RNA, 64 nt, Human
ggccccucccacacccaaagcugagccugcagggaagccccacauguccagcaccuugugccug

SEQ ID NO: 359805 - RNA, 64 nt, Human
uguuagagaaggaggaggaagcccauagacccccaagccccacugaggccccuacugaggccag

SEQ ID NO: 359806 - RNA, 64 nt, Human
aguacuugacuaccuacugguguaaucucaaugcaagccccaacuuucuuauccaacuuuuuca

SEQ ID NO: 359807 - RNA, 64 nt, Human
cuacacauagcaugcguuuaaauucuauuauauaaagccccaagugcuuuaccuucuaaaacau

SEQ ID NO: 359808 - RNA, 64 nt, Human; identical to SEQ ID NO: 205906

SEQ ID NO: 359809 - RNA, 64 nt, Human; identical to SEQ ID NO: 205907

SEQ ID NO: 359810 - RNA, 64 nt, Human; identical to SEQ ID NO: 205908

SEQ ID NO: 359811 - RNA, 64 nt, Human; identical to SEQ ID NO: 205909

SEQ ID NO: 359812 - RNA, 64 nt, Human; identical to SEQ ID NO: 205910

SEQ ID NO: 359813 - RNA, 64 nt, Human; identical to SEQ ID NO: 205911

SEQ ID NO: 359814 - RNA, 64 nt, Human; identical to SEQ ID NO: 205912

SEQ ID NO: 359815 - RNA, 64 nt, Human; identical to SEQ ID NO: 205913

SEQ ID NO: 359816 - RNA, 64 nt, Human; identical to SEQ ID NO: 205914

SEQ ID NO: 359817 - RNA, 64 nt, Human; identical to SEQ ID NO: 205915

SEQ ID NO: 359818 - RNA, 64 nt, Human; identical to SEQ ID NO: 205916

SEQ ID NO: 359819 - RNA, 64 nt, Human; identical to SEQ ID NO: 205917

SEQ ID NO: 359820 - RNA, 64 nt, Human; identical to SEQ ID NO: 205918

SEQ ID NO: 359821 - RNA, 64 nt, Human; identical to SEQ ID NO: 205919

SEQ ID NO: 359822 - RNA, 64 nt, Human; identical to SEQ ID NO: 205920

SEQ ID NO: 359823 - RNA, 64 nt, Human; identical to SEQ ID NO: 205921

SEQ ID NO: 359824 - RNA, 62 nt, Human; identical to SEQ ID NO: 57550

SEQ ID NO: 359825 - RNA, 62 nt, Human; identical to SEQ ID NO: 57551

SEQ ID NO: 359826 - RNA, 64 nt, Human
auauucaaaaaguacaucuucccccccccccccccccccgcaaaauaauucuguggcagggcaa

SEQ ID NO: 359827 - RNA, 64 nt, Human
aggcccugcugcgaaaguucuuggugguggaugacccccgcaaguuugcacucuuugagcgcgc

SEQ ID NO: 359828 - RNA, 64 nt, Human; identical to SEQ ID NO: 205922

SEQ ID NO: 359829 - RNA, 64 nt, Human; identical to SEQ ID NO: 205923

SEQ ID NO: 359830 - RNA, 64 nt, Human; identical to SEQ ID NO: 205924

SEQ ID NO: 359831 - RNA, 64 nt, Human; identical to SEQ ID NO: 205925

SEQ ID NO: 359832 - RNA, 64 nt, Human; identical to SEQ ID NO: 205926

SEQ ID NO: 359833 - RNA, 64 nt, Human; identical to SEQ ID NO: 205927

SEQ ID NO: 359834 - RNA, 64 nt, Human; identical to SEQ ID NO: 205928

SEQ ID NO: 359835 - RNA, 64 nt, Human; identical to SEQ ID NO: 205929

SEQ ID NO: 359836 - RNA, 64 nt, Human; identical to SEQ ID NO: 205930

SEQ ID NO: 359837 - RNA, 64 nt, Human; identical to SEQ ID NO: 205931

SEQ ID NO: 359838 - RNA, 64 nt, Human; identical to SEQ ID NO: 205932

SEQ ID NO: 359839 - RNA, 64 nt, Human; identical to SEQ ID NO: 205933

SEQ ID NO: 359840 - RNA, 64 nt, Human; identical to SEQ ID NO: 205934

SEQ ID NO: 359841 - RNA, 64 nt, Human; identical to SEQ ID NO: 205935

SEQ ID NO: 359842 - RNA, 64 nt, Human; identical to SEQ ID NO: 205936

SEQ ID NO: 359843 - RNA, 64 nt, Human; identical to SEQ ID NO: 205937

SEQ ID NO: 359844 - RNA, 64 nt, Human
cucucagccucccaaccccagggcccccacaggccccccgcagcacccugcagagcacacaggu

SEQ ID NO: 359845 - RNA, 64 nt, Human
accagaagggaaaggcggcuguuuggcucuuucucccccgcaaggacccgcugacccgcuggau

SEQ ID NO: 359846 - RNA, 64 nt, Human
agagccuggggggcgccggguggcaaaggacucacccccgcacaggcccgccuggcuucgaguu

SEQ ID NO: 359847 - RNA, 64 nt, Human
ccgcccggcccgcgcucccgcccgcacugcccuccccccgcagcaggggcgccuugggacuccg

SEQ ID NO: 359848 - RNA, 64 nt, Human; identical to SEQ ID NO: 205938

SEQ ID NO: 359849 - RNA, 64 nt, Human; identical to SEQ ID NO: 205939

SEQ ID NO: 359850 - RNA, 64 nt, Human; identical to SEQ ID NO: 205940

SEQ ID NO: 359851 - RNA, 64 nt, Human; identical to SEQ ID NO: 205941

SEQ ID NO: 359852 - RNA, 64 nt, Human; identical to SEQ ID NO: 205942

SEQ ID NO: 359853 - RNA, 64 nt, Human; identical to SEQ ID NO: 205943

SEQ ID NO: 359854 - RNA, 64 nt, Human; identical to SEQ ID NO: 205944

SEQ ID NO: 359855 - RNA, 64 nt, Human; identical to SEQ ID NO: 205945

SEQ ID NO: 359856 - RNA, 64 nt, Human; identical to SEQ ID NO: 205946

SEQ ID NO: 359857 - RNA, 64 nt, Human; identical to SEQ ID NO: 205947

SEQ ID NO: 359858 - RNA, 64 nt, Human; identical to SEQ ID NO: 205948

SEQ ID NO: 359859 - RNA, 52 nt, Human; identical to SEQ ID NO: 205949

SEQ ID NO: 359860 - RNA, 64 nt, Human; identical to SEQ ID NO: 205950

SEQ ID NO: 359861 - RNA, 64 nt, Human; identical to SEQ ID NO: 205951

SEQ ID NO: 359862 - RNA, 64 nt, Human; identical to SEQ ID NO: 205952

SEQ ID NO: 359863 - RNA, 64 nt, Human
ccggccaccgccccagccucaccccaucccacgacccccgcaacccuucacaucaccccccucg

SEQ ID NO: 359864 - RNA, 64 nt, Human
aggcaugggaaacagugcagugacucacccccugcccccgcaccaaccacccauauucaggaga

SEQ ID NO: 359865 - RNA, 50 nt, Human; identical to SEQ ID NO: 301172

SEQ ID NO: 359866 - RNA, 64 nt, Human
ugacgauuuagcuguggcucccuccuccuguccucccccgcacccccucccuucugggaaacaa

SEQ ID NO: 359867 - RNA, 64 nt, Human
gugugcuuuuuuuuuuuugcaauaugaccccgucucucugaagugggacauucggacggaugga

SEQ ID NO: 359868 - RNA, 64 nt, Human; identical to SEQ ID NO: 64454

SEQ ID NO: 359869 - RNA, 64 nt, Human; identical to SEQ ID NO: 64455

SEQ ID NO: 359870 - RNA, 64 nt, Human; identical to SEQ ID NO: 64456

SEQ ID NO: 359871 - RNA, 64 nt, Human
guucuggggcugggagggagaggggcuccggcuuucucugaaaugaacacugcucuucagcagu

SEQ ID NO: 359872 - RNA, 64 nt, Human
cacaaccuuguuucucacuuccugguugggcucaucucugaagaacaggucucccagcuucgcu

SEQ ID NO: 359873 - RNA, 64 nt, Human
aucuuuugauguaauuuucuaggcuaaauggcaaucucugaaagaugaauaaagcuauauuuau

SEQ ID NO: 359874 - RNA, 64 nt, Human
uccuccaacucaggguuggcugugucucuuuucuucucugaagacagcguccuggcuccaguug

SEQ ID NO: 359875 - RNA, 64 nt, Human
acacuccugggcucugaacacacacgccagcuccucucugaagcgacucuccuguuuggaacgg

SEQ ID NO: 359876 - RNA, 64 nt, Human
ugauguuuguaaagcgcuuuguaaauaaacgugcucucugaaugccacagagcagcccugugug

SEQ ID NO: 359877 - RNA, 64 nt, Human
aguuuggugucaacaugaaacaccaagaugucugucucugaagcgugauuuuaaaauccccaug

SEQ ID NO: 359878 - RNA, 64 nt, Human
gguuccacagcacagcagacauggaacgcugaagucucugaaagugaaguuguaaaaagaaaag

SEQ ID NO: 359879 - RNA, 63 nt, Human
ccaaacgaagaggauuaugauguguacacuccaucucugaagaaacaacccaucguucuuuuu

SEQ ID NO: 359880 - RNA, 64 nt, Human
gucauagauuagcaauuuucaaauaauuauuuuuucucugaaaauuuugugugugauugcacaa

SEQ ID NO: 359881 - RNA, 64 nt, Human
ggagugguuaauugaaauagucaauuuuaaaguuucucugaagcaaaaugauaggcaucauucu

SEQ ID NO: 359882 - RNA, 64 nt, Human
auugaaugaaacaggguuuuucaaguuguauaauucucugaaauacucagcuuuugucauaugg

SEQ ID NO: 359883 - RNA, 64 nt, Human
aguuagaugggacaaagaugaauggcaugucccuucucugaaguccguuugagcagaacuaccu

SEQ ID NO: 359884 - RNA, 64 nt, Human
aagaugcagagcagcagugcagauggcaaugaacucucugaauucucuuuuaccuuauuuagaa

SEQ ID NO: 359885 - RNA, 64 nt, Human
gugcuaugaagcuuucuuuccuacacacucugagucucugaaugaagcugaaggucuuaguacc

SEQ ID NO: 359886 - RNA, 64 nt, Human
agugugggugccugacuuccucucugugcagcacucucugaaucccuccuauucaccuugcugc

SEQ ID NO: 359887 - RNA, 64 nt, Human; identical to SEQ ID NO: 64449

SEQ ID NO: 359888 - RNA, 52 nt, Human; identical to SEQ ID NO: 64450

SEQ ID NO: 359889 - RNA, 64 nt, Human; identical to SEQ ID NO: 64452

SEQ ID NO: 359890 - RNA, 64 nt, Human; identical to SEQ ID NO: 64453

SEQ ID NO: 359891 - RNA, 64 nt, Human
aauggucacuucugauuuuccaacaguugcuccuucucugaagagaucuugauuccuuugggaa

SEQ ID NO: 359892 - RNA, 64 nt, Human
uccuguccagcugaagcuuuugcagcacuuuaccucucugaaagccccagaggaccagagcccc

SEQ ID NO: 359893 - RNA, 64 nt, Human
ccuccuauguauuggucaaggcaggcaucucuguucucugaacauucauugcacuuucccaccu

SEQ ID NO: 359894 - RNA, 64 nt, Human
agagcagagguucuucaguccacgcaacgguucuucucugaacagcaacagagcaaacagauag

SEQ ID NO: 359895 - RNA, 64 nt, Human
auacagaaaagggcuaaccauaccacagcuggaaucucugaauauuuccuauuaaaaauuuuuu

SEQ ID NO: 359896 - RNA, 64 nt, Human
ggugcuauaaccccuugggacacucauccagacuucucugaagcagaaaaccugagcuccccac

SEQ ID NO: 359897 - RNA, 64 nt, Human
guguaccuaaucucaccaucucuucacuucuagcucucugaaacaagggucacacuacucagag

SEQ ID NO: 359898 - RNA, 64 nt, Human
ugcugaguaccaggagagguccugccccauccucucucugaagccagggcccuuccauuccauu

SEQ ID NO: 359899 - RNA, 64 nt, Human
cugguugaaaucccgaggugucauuugacaugguucucugaacuuaucuuuccuauaaaauggu

SEQ ID NO: 359900 - RNA, 64 nt, Human
agccacaggccgccucuguggcaucaccaggguuucucugaagaagagggucugcauuuuccua

SEQ ID NO: 359901 - RNA, 64 nt, Human
gccuccagaccccuaagcaucuccuguccuggccucucugaagcagacaagggccaccuauccc

SEQ ID NO: 359902 - RNA, 64 nt, Human
uguaauggaaugaugucuuguauagaaaugcccuucucugaaauaaagagaacuccugggcuuu

SEQ ID NO: 359903 - RNA, 64 nt, Human
ggauucaugccacguugaagauaaaauuauccucucucugaaauacgguaaagauuuaaauagg

SEQ ID NO: 359904 - RNA, 64 nt, Human
aacuauaaaagugcaaugacuaagauccuucacuucucugaaaguaaggcccuagaugccucag

SEQ ID NO: 359905 - RNA, 64 nt, Human
ugcuggucuccaggcugacaaggauucaaaguugucucugaaacuccucuuugucauacugcac

SEQ ID NO: 359906 - RNA, 64 nt, Human
aggcuggggggccuuggguaccugcagagccuuuucucugaauuccuuauguccggugggccag

SEQ ID NO: 359907 - RNA, 64 nt, Human; identical to SEQ ID NO: 64442

SEQ ID NO: 359908 - RNA, 64 nt, Human; identical to SEQ ID NO: 64443

SEQ ID NO: 359909 - RNA, 64 nt, Human; identical to SEQ ID NO: 64457

SEQ ID NO: 359910 - RNA, 64 nt, Human; identical to SEQ ID NO: 64458

SEQ ID NO: 359911 - RNA, 64 nt, Human
cuaagcccuauaugccucacucauaaugaggcugucucugaaccccggagggcgggaccuacaa

SEQ ID NO: 359912 - RNA, 64 nt, Human
ggucuccacugggcugccauuuagccaugugccaucucugaagucagagguguuugacucccau

SEQ ID NO: 359913 - RNA, 64 nt, Human
uaauacccuuaaaccauuuauaauuucuaguauuucucugaaagaucguuuuggggacaaaagu

SEQ ID NO: 359914 - RNA, 64 nt, Human
guuugagggagaagguugcagagcacuucccaccucucugaauaguguguauguguugguuuau

SEQ ID NO: 359915 - RNA, 64 nt, Human
guugcacuagaugauuacgaagaucacaucccacucucugaacuacaaucacugugcucccugg

SEQ ID NO: 359916 - RNA, 64 nt, Human
agcugagagauagcgagugucuggagcggaggccucucugaaugggcagggguuuguccuugca

SEQ ID NO: 359917 - RNA, 64 nt, Human
uaaauucaaagacccauaaaaggcuuuuaaggauucucugaaagugcugauggcuggauccaau

SEQ ID NO: 359918 - RNA, 52 nt, Human
guucuguaugcuuucuguaaagucucugaauuaguuccgaauucaggcuguu

SEQ ID NO: 359919 - RNA, 64 nt, Human
aaccaggagcauuaaguucugaaauuuugaaucaucucugaaaugaagcagguguagccugccc

SEQ ID NO: 359920 - RNA, 64 nt, Human
uuugacucguguuuuuuuuuccauugagauguacucucugaaguuuggucuugauuuguuuuau

SEQ ID NO: 359921 - RNA, 64 nt, Human
uuugagaaccacaacucuaaagucaagauauuuuucucugaagugauuucugcuuggcacgcua

SEQ ID NO: 359922 - RNA, 64 nt, Human
ggcacaagacaccggccccucccaccccccugccucucugaagggccauggcuaugcuucccug

SEQ ID NO: 359923 - RNA, 55 nt, Human
accacacccacaaagaguagguagcucucugaaggcuuuuuacccagcaaugucc

SEQ ID NO: 359924 - RNA, 64 nt, Human
aggcaauuagagaucgaagccuccuaucuccacaucucugaagaaguugaggggugggggagag

SEQ ID NO: 359925 - RNA, 64 nt, Human
gggugggaguguugagcaucugucccccuuuagaucucugaagccacaaauaggaugcuuggga

SEQ ID NO: 359926 - RNA, 64 nt, Human
gauugacaaacaacagagccuugaccacguggagucucugaaucagccuugucuggaaccagau

SEQ ID NO: 359927 - RNA, 64 nt, Human
uaaaauuauugucaaaguuuaaauaccuauauauucucugaaugcaauaaagggacuuaagagu

SEQ ID NO: 359928 - RNA, 62 nt, Human; identical to SEQ ID NO: 57506

SEQ ID NO: 359929 - RNA, 62 nt, Human; identical to SEQ ID NO: 57507

SEQ ID NO: 359930 - RNA, 62 nt, Human; identical to SEQ ID NO: 57508

SEQ ID NO: 359931 - RNA, 64 nt, Human
aucuuugaguagcacuguuuuggggcccucggucucucugaagacccuagcagaacugauaccu

SEQ ID NO: 359932 - RNA, 64 nt, Human
ucccauggggguaauaagagcaguagcagcagcaucucugaacauuucucuggauuugcaaccc

SEQ ID NO: 359933 - RNA, 64 nt, Human
agaggagugaaagggacaauuuggcugaagucuuucucugaaaaaagccaaaggguuauagggg

SEQ ID NO: 359934 - RNA, 64 nt, Human
augucacaaucaguauaucuucuuugggguuaccucucugaauauuauguaaacaauccaaaga

SEQ ID NO: 359935 - RNA, 64 nt, Human
cuaagugccuuuuugugugcaaccacuuacccuuucucugaaaaaccuguucucaggaaggauc

SEQ ID NO: 359936 - RNA, 64 nt, Human
ccccagauggacaguaaggggaaccuccaaugucucucugaacuuaaagacaggagcuggcauu

SEQ ID NO: 359937 - RNA, 64 nt, Human
gauuggauagauguguacauuugguguuugaaauucucugaaaaucccauuaggaaaccaggug

SEQ ID NO: 359938 - RNA, 64 nt, Human
ccacaggggugcagguggcuggcagcaaacaggcucucugaagacaguagccaagauuauucac

SEQ ID NO: 359939 - RNA, 64 nt, Human
gcaaaguggugaggagaaaacaggaaacgggcuuucucugaauugguaaaugggaaagaaguga

SEQ ID NO: 359940 - RNA, 64 nt, Human
uuaagaggaaaaugaaaguguuccuggggugcugucucugaagaagcagaguuucauuaccugu

SEQ ID NO: 359941 - RNA, 64 nt, Human
uuuauaauucuuuuuccuuguuugaguauuucugucucugaaauaaccuuuuacuuggcuuuuc

SEQ ID NO: 359942 - RNA, 64 nt, Human
aaagugacaguuuuaaaaguaaaaugguguuaaaucucugaaacuugaacguaugaugcucugg

SEQ ID NO: 359943 - RNA, 64 nt, Human
caauggauucugcgaugcugucuggacuuugcugucucugaacaguauguguguguugcuuuaa

SEQ ID NO: 359944 - RNA, 64 nt, Human
uuugugggaaaaauauugcuacaauuuuuuuuaaucucugaauguaauuucgauacuguguaca

SEQ ID NO: 359945 - RNA, 64 nt, Human
ucagacuuugccauaaugauagacucaauuuagcucucugaacuaguugguaauuuuuuuuuuu

SEQ ID NO: 359946 - RNA, 64 nt, Human
ccugcauccucuucuuuucccagaagugaacauuucucugaauuugaugcuuauuaugcccaug

SEQ ID NO: 359947 - RNA, 62 nt, Human; identical to SEQ ID NO: 57509

SEQ ID NO: 359948 - RNA, 62 nt, Human; identical to SEQ ID NO: 57510

SEQ ID NO: 359949 - RNA, 62 nt, Human; identical to SEQ ID NO: 57512

SEQ ID NO: 359950 - RNA, 62 nt, Human; identical to SEQ ID NO: 57513

SEQ ID NO: 359951 - RNA, 64 nt, Human
aaauuguaauuuaauagauuaucucagaaaaaccucucugaaugaugacccuuccuuaauacug

SEQ ID NO: 359952 - RNA, 64 nt, Human
ugggcacuccgcgccgaugccaccggccugugggucucugaagggacccccccccaaucggacu

SEQ ID NO: 359953 - RNA, 64 nt, Human
gcaaacaccuuuccuccagcuccagaauuccuugucucugaaugacucugucuugugggugucu

SEQ ID NO: 359954 - RNA, 64 nt, Human
agacuccgucucaaaaaaagggcaauaaaugcccucucugaauguuugaacugccaagaaaagg

SEQ ID NO: 359955 - RNA, 64 nt, Human
acuaucuucaauccuucagucccagccagaagaaucucugaaagcauauugugaauguauacaa

SEQ ID NO: 359956 - RNA, 64 nt, Human
uuuguaauauuuauguguuaaucacacaguaugcucucugaaguucucuuaagccuucaguuua

SEQ ID NO: 359957 - RNA, 64 nt, Human
agauaaugaucccgguagagaaacagaugacaaaucucugaaagagguuuuuaaaacuuuugau

SEQ ID NO: 359958 - RNA, 64 nt, Human
uaucaggcuucaauuccauuauguuuuaauguugucucugaagaugacuugugauuuuuuuuuc

SEQ ID NO: 359959 - RNA, 64 nt, Human
gaacuccugagcucaagaaauccuccugccugagucucugaaagugcugggauuacaggcguga

SEQ ID NO: 359960 - RNA, 64 nt, Human
auuaagcacacacacacaugcacacaaauggacuucucugaagcuguguuuagugaaaugagcu

SEQ ID NO: 359961 - RNA, 64 nt, Human
aaugguuaagacaaaauaguguuauagccuucauucucugaauaggccaucuuugacucauaaa

SEQ ID NO: 359962 - RNA, 64 nt, Human
acacacuccucaccuguucuuucugaguguccuuucucugaaaggauuuauguuuuucuucguu

SEQ ID NO: 359963 - RNA, 64 nt, Human
ugucagccccagaauuucuucuuaaguucgccugucucugaaaucccaaagucacggaaccgca

SEQ ID NO: 359964 - RNA, 64 nt, Human
agauaagccuuaaacagaaaccccuaagaaagguucucugaaaauuauuugguggguuaaaugc

SEQ ID NO: 359965 - RNA, 64 nt, Human
accugcaccaaagcuggcaccagggcucggaaggucucugaacucagaaggauggcauuuuuug

SEQ ID NO: 359966 - RNA, 64 nt, Human
ccauaagagaauaaguauagcuagagaaauugcuucucugaaauguacaugagcccuuaaggua

SEQ ID NO: 359967 - RNA, 62 nt, Human; identical to SEQ ID NO: 57514

SEQ ID NO: 359968 - RNA, 62 nt, Human; identical to SEQ ID NO: 57515

SEQ ID NO: 359969 - RNA, 62 nt, Human; identical to SEQ ID NO: 57517

SEQ ID NO: 359970 - RNA, 62 nt, Human; identical to SEQ ID NO: 57518

SEQ ID NO: 359971 - RNA, 64 nt, Human
aaccacacaaauuccgcaguuuauucuggaugauucucugaauggaccaccugagaagguagcc

SEQ ID NO: 359972 - RNA, 64 nt, Human
cacuguggcuucaagcaccucuguucauagagcgucucugaaauugagucucggucaugacuua

SEQ ID NO: 359973 - RNA, 64 nt, Human
ccuuuauuuaagauucacuuauuagucugcuguuucucugaaaaauuuuagagcuagguauagu

SEQ ID NO: 359974 - RNA, 64 nt, Human
aaucagugaaacuacuuaacacagcuaauuuuuuucucugaaaaaucaucgagacaaaagagcc

SEQ ID NO: 359975 - RNA, 64 nt, Human
ugcugucuuaaaaguuaaugauccaaguggcaccucucugaaccuacuuuggcuugggaggcug

SEQ ID NO: 359976 - RNA, 64 nt, Human
agaguaccacccaacacuuuugcuuucuucuccaucucugaagaucugcucaagacguccagca

SEQ ID NO: 359977 - RNA, 64 nt, Human
agcaucagugagguuaaacuaaggcccucuugaaucucugaauuugagauacaaacauguuccu

SEQ ID NO: 359978 - RNA, 64 nt, Human
cuuggcaauguuaaauguauuuauuaacuuugugucucugaaucucuguucuaaugugccaugu

SEQ ID NO: 359979 - RNA, 64 nt, Human
augauguuucuugcuuuuggaaaaaaaaaaaaagucucugaaauuugauucuuacuacagauuu

SEQ ID NO: 359980 - RNA, 64 nt, Human
uuuuuaauauuuauguauuaaucacacagugugcucucugaaguucucuuaagccuucaguuua

SEQ ID NO: 359981 - RNA, 64 nt, Human
gucauucuuucuacuaaauccauuucaagcuaguucucugaaaauuuugccauuuaucuacaga

SEQ ID NO: 359982 - RNA, 64 nt, Human
acaacauuguauguacauauacaaaauuucauuuucucugaaagucgagaauuccaagaacugu

SEQ ID NO: 359983 - RNA, 64 nt, Human
uuucuucccaacaccaaaggacuuaccaucugucucucugaaucucagaucuccagcuuugauc

SEQ ID NO: 359984 - RNA, 64 nt, Human
caugcaucuuacugaagguaaaauugaaaggcauucucugaagaguggguuucacaagugaaaa

SEQ ID NO: 359985 - RNA, 64 nt, Human
gcaacucccugaauuuuuauacaucuucaguuuuucucugaauugaauucauaccacacaaaca

SEQ ID NO: 359986 - RNA, 64 nt, Human
aucccaaagacaguccacagcaggacuugcuccaucucugaacuggucuuacccccuuaaaccu

SEQ ID NO: 359987 - RNA, 62 nt, Human; identical to SEQ ID NO: 57522

SEQ ID NO: 359988 - RNA, 62 nt, Human; identical to SEQ ID NO: 57523

SEQ ID NO: 359989 - RNA, 62 nt, Human; identical to SEQ ID NO: 57524

SEQ ID NO: 359990 - RNA, 62 nt, Human; identical to SEQ ID NO: 57525

SEQ ID NO: 359991 - RNA, 64 nt, Human
gcccagacagcuuauaccacccaguguucagggaucucugaagaacccacagaccaggugaauu

SEQ ID NO: 359992 - RNA, 64 nt, Human
uuauggcuuggcagaaucuuuguagugugugggaucucugaaggcccuauuuaaguuuuucuuc

SEQ ID NO: 359993 - RNA, 64 nt, Human
gcuugaucaagggccuuauguggagcagagguugucucugaaccaggagagaagguacuauacc

SEQ ID NO: 359994 - RNA, 64 nt, Human
agugcugugagaauacaguagcacaaguccuuguucucugaagagugggaaggagaggagugag

SEQ ID NO: 359995 - RNA, 64 nt, Human
gguugacuuggcaugcugggggguccucguucacucucugaaguuggccuccuuucacugggga

SEQ ID NO: 359996 - RNA, 64 nt, Human
gacuuuguuuuaacuguaccuuaagcggucauguucucugaaguggaauguggcuuuccuagga

SEQ ID NO: 359997 - RNA, 64 nt, Human
cccuuccaaauaauaaagucuauggacagggcugucucugaaguacuaacacaaggacacucgu

SEQ ID NO: 359998 - RNA, 64 nt, Human
aagaaggcaaagacuuaauucauuuucaaaagguucucugaaugugcacagaacacguggcuca

SEQ ID NO: 359999 - RNA, 64 nt, Human
uaucuauuauucuguuguagucauuaggugcccuucucugaaguuauguaaaauaaaagcaucu

SEQ ID NO: 360000 - RNA, 64 nt, Human
ccaguacagcccauaguaucccuucacuacaaauucucugaagaccaccuaaauaucacuugcu

SEQ ID NO: 360001 - RNA, 64 nt, Human
ccuaugggguuuaugaaaaauacuuggggaucauucucugaauggucuaaggaagcgguagcca

SEQ ID NO: 360002 - RNA, 64 nt, Human
ugucacugugaggcccuacuagguguaagcauucucucugaauuuuaauuuccucucauuaaaa

SEQ ID NO: 360003 - RNA, 64 nt, Human
aggggaaugcuauacagcugggaacagcagacuuucucugaagggccagaugguaacuacauua

SEQ ID NO: 360004 - RNA, 64 nt, Human
augagugaagagguuaauuagagggacacacuuaucucugaaguuuuucuccaggcugaacauu

SEQ ID NO: 360005 - RNA, 64 nt, Human
aaauaauucuguucaucauuucacuccgugcaguucucugaauugagagauguaccucuuaaac

SEQ ID NO: 360006 - RNA, 64 nt, Human
uugcaauaccugucaccaugcagccgcugauaguucucugaacuaaaaggacuaauuguacuuu

SEQ ID NO: 360007 - RNA, 62 nt, Human; identical to SEQ ID NO: 57519

SEQ ID NO: 360008 - RNA, 62 nt, Human; identical to SEQ ID NO: 57520

SEQ ID NO: 360009 - RNA, 62 nt, Human; identical to SEQ ID NO: 57529

SEQ ID NO: 360010 - RNA, 62 nt, Human; identical to SEQ ID NO: 57530

SEQ ID NO: 360011 - RNA, 64 nt, Human
guggucaguuuuguuacucugagagcuguucacuucucugaauucaccuagagugguuggacca

SEQ ID NO: 360012 - RNA, 64 nt, Human
uucuuguuacuuuuaagaaaacucaugcucuguuucucugaaucaaaugaaguagaaguuuaca

SEQ ID NO: 360013 - RNA, 64 nt, Human
uccaucugucuuuauuggugaaucaucagcuaauucucugaaagaugaauucacauaugaaaaa

SEQ ID NO: 360014 - RNA, 64 nt, Human
gccgaacucgagcuuguagacagcuuggauccuuucucugaaggaaucauguucagguguguaa

SEQ ID NO: 360015 - RNA, 64 nt, Human
aagaaagcugcagauggauguuuccaugaagaaaucucugaagaaaccaaaagagcugaaacug

SEQ ID NO: 360016 - RNA, 64 nt, Human
cuugacaguuugaauuucuucaccuaaagauaauucucugaaaguacuguuucuucauucuauu

SEQ ID NO: 360017 - RNA, 64 nt, Human
agcauguuaguuuugggaggcaaugucaacugugucucugaauuccugucuuccaaauugaagc

SEQ ID NO: 360018 - RNA, 64 nt, Human
cugcauaaccugaaugaaagaagcaaaugacuauucucugaagacaaccaagagaaaauugcaa

SEQ ID NO: 360019 - RNA, 64 nt, Human
auugcgagcuugggaauuagacuuuggagucuuuucucugaagucaccaggccaggggucagga

SEQ ID NO: 360020 - RNA, 64 nt, Human
auauacauaacaccaaucagaccguguggauuuuucucugaauugacugauuuuguuuuuuucu

SEQ ID NO: 360021 - RNA, 64 nt, Human
caagagcgcaucaccugaaugucgugaagaaguaucucugaauguauccaggagaggaacugca

SEQ ID NO: 360022 - RNA, 64 nt, Human
acugcagacucuaccaaucacgggcauuuuaucuucucugaacacugcaguuuguuagacuaga

SEQ ID NO: 360023 - RNA, 64 nt, Human
cgguaucucuauuggucaaagaauauuaaaucugucucugaauuacuucaaauucucaggugaa

SEQ ID NO: 360024 - RNA, 64 nt, Human
uuuuuuaaaaggggcagccccuugauggcucaucucucugaauaacaguuacgucuucauaucg

SEQ ID NO: 360025 - RNA, 64 nt, Human
cuuggcaguucuuuuuggggccaugggacaccuuucucugaagagggguuggauaaggcaaagg

SEQ ID NO: 360026 - RNA, 64 nt, Human
uucugauaacccccaaauacagaaauguucuacaucucugaaugaccucugacuuuaaaaaagu

SEQ ID NO: 360027 - RNA, 62 nt, Human; identical to SEQ ID NO: 57541

SEQ ID NO: 360028 - RNA, 62 nt, Human; identical to SEQ ID NO: 57542

SEQ ID NO: 360029 - RNA, 62 nt, Human; identical to SEQ ID NO: 57543

SEQ ID NO: 360030 - RNA, 62 nt, Human; identical to SEQ ID NO: 57544

SEQ ID NO: 360031 - RNA, 64 nt, Human
aaugaguaguauaagccaccuauuuuuacuuccuucucugaaauauuccaguuaacucagcuug

SEQ ID NO: 360032 - RNA, 64 nt, Human
uggaauuuuugauucuuagcugcuaccagcuaguucucugaagaacugauguuauuacaaagaa

SEQ ID NO: 360033 - RNA, 64 nt, Human
aaaaaagaaauucaugcauagcuucugucagacuucucugaaagccaugccuaucaaaauuuga

SEQ ID NO: 360034 - RNA, 64 nt, Human
ggccccaaaaaaggccuuugcuacauccugauuaucucugaaaguaaucaaucaaguggcucca

SEQ ID NO: 360035 - RNA, 64 nt, Human
cuuuggucuggccaggaggcuggagaaugcggggucucugaagguccucuuuggcaccccagaa

SEQ ID NO: 360036 - RNA, 64 nt, Human
ccgggguuuuucuuccaucugacaucugccagccucucugaauggaaguugugaauguuugcaa

SEQ ID NO: 360037 - RNA, 64 nt, Human
ccucagccugcacccucuucuccucuggcuucccucucugaaauagccgaacuccaggcugggc

SEQ ID NO: 360038 - RNA, 64 nt, Human
ccccuccuuuuucugauugaugguuguauuauuuucucugaauccucuucacuggccaaagguu

SEQ ID NO: 360039 - RNA, 64 nt, Human
ccugagaauggcuuaguccugagaaucugcaaagucucugaagagaacucucucuucccacuaa

SEQ ID NO: 360040 - RNA, 64 nt, Human
auuuuuuuuuuaacugcaaaaaaugauggucucaucucugaauuuauauuucucauucuuuuga

SEQ ID NO: 360041 - RNA, 64 nt, Human
uuuuuagaguuuauauagggcaagugguucuuuuucucugaauuacaggauggaaaaaggucau

SEQ ID NO: 360042 - RNA, 64 nt, Human
agacaauucaaucuauuuaaucuauuaaauuuuuucucugaauuggguauauggcaucauuauu

SEQ ID NO: 360043 - RNA, 64 nt, Human
gugugcuccaguucuaaaauuaaccugugccuggucucugaagcccuuucuugcucugugccuu

SEQ ID NO: 360044 - RNA, 64 nt, Human
ucgauaagaaacaguuuacaaccugcucucucucucucugaagucugcugagagcuuccccugc

SEQ ID NO: 360045 - RNA, 64 nt, Human
augaaaaugucagaaaccaguuaugugaaugaucucucugaauccuaagggcuggucucugcug

SEQ ID NO: 360046 - RNA, 64 nt, Human
ccugcacccccgggcuucgcagccuugcuuguuuucucugaacagcaacagaacaguguucaca

SEQ ID NO: 360047 - RNA, 62 nt, Human; identical to SEQ ID NO: 57534

SEQ ID NO: 360048 - RNA, 62 nt, Human; identical to SEQ ID NO: 57535

SEQ ID NO: 360049 - RNA, 62 nt, Human; identical to SEQ ID NO: 57536

SEQ ID NO: 360050 - RNA, 62 nt, Human; identical to SEQ ID NO: 57537

SEQ ID NO: 360051 - RNA, 64 nt, Human
ggcugcuggguggccccgggacaguggcuuuuccucucugaaccuuagcuuccucacccuuguu

SEQ ID NO: 360052 - RNA, 64 nt, Human
cauguacauuuuaauuugauucagcuggucugaaucucugaauuuauaucauccaaaacuucca

SEQ ID NO: 360053 - RNA, 64 nt, Human
gauugaugaggcuugaaagagcccacugagccacucucugaauaugugaaauguacucuguguc

SEQ ID NO: 360054 - RNA, 64 nt, Human
uaauuuuggacugccacacauugguaccuuuaguucucugaaggcccacguuuuuaucauuaag

SEQ ID NO: 360055 - RNA, 64 nt, Human
uauuucuauuuacagauaugauugaaaauuucauucucugaauuucuccucucaaggaaaacca

SEQ ID NO: 360056 - RNA, 64 nt, Human
aaacuacugcuuuaaugucaaguuugcagaauugucucugaaaauaaaaacccugacuuuaguu

SEQ ID NO: 360057 - RNA, 64 nt, Human
gguaaugaggagggggcuuacuggaaucgucauaucucugaauauugaaaacaacaacuaaaaa

SEQ ID NO: 360058 - RNA, 64 nt, Human
aaugcaauagguugaaguuuuggagauauguuucucucugaaauuacugugaauauuuaacaaa

SEQ ID NO: 360059 - RNA, 64 nt, Human
caguggccuuacucuuuguggguuuuuuuuuuuuucucugaacuugauauaaagauuuuauuug

SEQ ID NO: 360060 - RNA, 64 nt, Human
gaguuucuuaaaugcguggauucuuguucauuuaucucugaauaugucucuuuuauauuuuggc

SEQ ID NO: 360061 - RNA, 64 nt, Human
uauauuuuuauugugguucuuacccccuuuuccuucucugaaguguuaaugcuuaagaaaagag

SEQ ID NO: 360062 - RNA, 64 nt, Human
guguggugcaagccgggggucuccacaucuuccuucucugaaguccagguaccugcacaagcag

SEQ ID NO: 360063 - RNA, 64 nt, Human
cagaugcaacggcccaaauucuugaucugcagcuucucugaaguuuggaaaagaaaccuuccuu

SEQ ID NO: 360064 - RNA, 64 nt, Human
cucuacuccaguaaaccugauuggguuuguucacucucugaaugauuauuagccagacuucaaa

SEQ ID NO: 360065 - RNA, 64 nt, Human
aagaaaaauauguugcuaagauuguguuggucgcucucugaagcagaaaagggacuggaaccaa

SEQ ID NO: 360066 - RNA, 64 nt, Human
uuucccagucuucagcagagaaguuuucuggaggucucugaacccagggaagacaagaaggaaa

SEQ ID NO: 360067 - RNA, 62 nt, Human; identical to SEQ ID NO: 57526

SEQ ID NO: 360068 - RNA, 62 nt, Human; identical to SEQ ID NO: 57527

SEQ ID NO: 360069 - RNA, 62 nt, Human; identical to SEQ ID NO: 57538

SEQ ID NO: 360070 - RNA, 62 nt, Human; identical to SEQ ID NO: 57539

SEQ ID NO: 360071 - RNA, 64 nt, Human
agguuuuugaucccaaaauuccagagcuuucaacucucugaauuuguaguccugaauaucccag

SEQ ID NO: 360072 - RNA, 64 nt, Human
aaugccaagauuuaacagacuuaagaacuauuguucucugaaugacaguuguaagagaaaugua

SEQ ID NO: 360073 - RNA, 64 nt, Human
uuuuuuucuagacacuuuucuuuuaucccagucaucucugaauuuacauuuuauauuaaagaaa

SEQ ID NO: 360074 - RNA, 64 nt, Human
ccagauacagagaugacuaaggucauugauagcgucucugaacaaucagacggaucaccuuauc

SEQ ID NO: 360075 - RNA, 64 nt, Human
gcuaacuucuauugacccacaaaguuucagaaauucucugaaaguuucuuccuuuuuucucuua

SEQ ID NO: 360076 - RNA, 64 nt, Human
gaugcaugugcagcaguggggaguucuagauugaucucugaaugugaucgacgcccagcaagga

SEQ ID NO: 360077 - RNA, 64 nt, Human
ccacuucuaccaaaacauaaaucugugauugugaucucugaaagucaguccuuuuaucuacuca

SEQ ID NO: 360078 - RNA, 64 nt, Human
uaaaaaauuuuaaaaaucuaagcagcuuauuguuucucugaaaguguguguaguuuuacuuucc

SEQ ID NO: 360079 - RNA, 64 nt, Human
uuccacauaaggaaacuggguuccugcaaugaagucucugaagugaaacugcuuguuuccuagc

SEQ ID NO: 360080 - RNA, 64 nt, Human; identical to SEQ ID NO: 360077

SEQ ID NO: 360081 - RNA, 64 nt, Human
aaauauccuauguuuucuugcucaaacaccuuucucucugaaagcagaaaaaggcacugauaua

SEQ ID NO: 360082 - RNA, 64 nt, Human
uauuuaaauaggauuauuacagcaccaaaaaacuucucugaagccuuucuccacaaccuuguuc

SEQ ID NO: 360083 - RNA, 64 nt, Human
uauacaaccaaccaguuucuuuucuagccaaucaucucugaagaguugcuguuucuuacugaca

SEQ ID NO: 360084 - RNA, 64 nt, Human
aauuucuaacaguaccaguguaaauucagucuuuucucugaaaagcaaaggauguguuuucagu

SEQ ID NO: 360085 - RNA, 64 nt, Human
cuggaguauuaugucuccccaccuucugcaguuuucucugaacauguauguugcccaugguggg

SEQ ID NO: 360086 - RNA, 64 nt, Human
uucaugauguuguaauucaagaaaauaggcacuuucucugaaagaccugcuccuuccacaagaa

SEQ ID NO: 360087 - RNA, 62 nt, Human; identical to SEQ ID NO: 57545

SEQ ID NO: 360088 - RNA, 62 nt, Human; identical to SEQ ID NO: 57546

SEQ ID NO: 360089 - RNA, 62 nt, Human; identical to SEQ ID NO: 57548

SEQ ID NO: 360090 - RNA, 62 nt, Human; identical to SEQ ID NO: 57549

SEQ ID NO: 360091 - RNA, 64 nt, Human
uguguuugaaauuauguccaugaaaucacagggaucucugaaauaucuuuaggaaacuugaaau

SEQ ID NO: 360092 - RNA, 64 nt, Human
ucuguaaacacucugaucuuccuauuccacugagucucugaagggaauagggcugguagugggu

SEQ ID NO: 360093 - RNA, 64 nt, Human
uuaucugugaauucagauuuuaaaaagucuucacucucugaagaugaucauuugcccuuaagga

SEQ ID NO: 360094 - RNA, 64 nt, Human
ggcagagaugccacuugccucccccaccaugccaucucugaagaauauuacagaccauuuugga

SEQ ID NO: 360095 - RNA, 64 nt, Human
ucugaaguuaguuucuuaagugaguuuucaggugucucugaaaaauuuauaacaaucauguauu

SEQ ID NO: 360096 - RNA, 64 nt, Human
aagaaaggaagcuaagcaguggguaccugggaucucucugaacuauuuuuauaacuucuuguga

SEQ ID NO: 360097 - RNA, 64 nt, Human
auugccucagauuauguuaaauuugggucagucuucucugaacuuuuucucucuugguuucuuu

SEQ ID NO: 360098 - RNA, 64 nt, Human
acagacauuuuuaaaaaugugacaacacuuuuauucucugaauuuugaucucaaaggacacaga

SEQ ID NO: 360099 - RNA, 64 nt, Human
gugaggguuuucauagcuuuuggaaauacuuuggucucugaacuguaauuagcaagaaguaaaa

SEQ ID NO: 360100 - RNA, 64 nt, Human
ucaagcuggcccagauacaaguaccaaacaguagucucugaaguucccccauuuccuucaguac

SEQ ID NO: 360101 - RNA, 64 nt, Human
gcagccuucuggugccagccccaugcagggggacucucugaagcugugcaggcugccuguaugg

SEQ ID NO: 360102 - RNA, 64 nt, Human
aacgaucccuuccuucuuccacuuucacagcuuuucucugaacuaggagaaccuggggguggau

SEQ ID NO: 360103 - RNA, 64 nt, Human
aucagaguggggaaggugagugguagagagggggucucugaaggcccuuggggcugacagggcc

SEQ ID NO: 360104 - RNA, 64 nt, Human
uaaaguaucuacuguguaacaggcacuaugcuauucucugaaagaugcagcaguggacaagaca

SEQ ID NO: 360105 - RNA, 64 nt, Human
cauggcaggaguaaaucucuccaccuccucuaacucucugaaaacucuagaguuggagcaaguc

SEQ ID NO: 360106 - RNA, 64 nt, Human
gaggaucggugugugagacccgcgagugggcacgucucugaaugugaggucucgggcagcacgu

SEQ ID NO: 360107 - RNA, 62 nt, Human; identical to SEQ ID NO: 57553

SEQ ID NO: 360108 - RNA, 62 nt, Human; identical to SEQ ID NO: 57554

SEQ ID NO: 360109 - RNA, 62 nt, Human; identical to SEQ ID NO: 57555

SEQ ID NO: 360110 - RNA, 62 nt, Human; identical to SEQ ID NO: 57556

SEQ ID NO: 360111 - RNA, 64 nt, Human
aagcucauacaugccucaugugaaguguccacccucucugaaaaucuuucuuguucaaaacagc

SEQ ID NO: 360112 - RNA, 64 nt, Human
cugucacuauuugucuuucuaaucuccuucuguuucucugaauaucuucauuucuaucucugug

SEQ ID NO: 360113 - RNA, 64 nt, Human
augugaccgggaucccacucugauugcauccauuucucugaaagacuuguuuguucugcuucuc

SEQ ID NO: 360114 - RNA, 64 nt, Human
cuuucuguaacacccucagcauccugcacugcccucucugaaaacacccacauucuuuggucac

SEQ ID NO: 360115 - RNA, 64 nt, Human
cuguccuaaagugcugucaggguggcaccacugcucucugaacaacuuaccuuggucagaggga

SEQ ID NO: 360116 - RNA, 64 nt, Human
cuaaucagccugugugauuggggcucauuuugauucucugaauuaucgguuugacgguuacacu

SEQ ID NO: 360117 - RNA, 64 nt, Human
cgguuucugagcauaaugcucccaucuccugauuucucugaacagaaaacaaaagagagaauga

SEQ ID NO: 360118 - RNA, 64 nt, Human
cuuucucuucuuagucucucucuuuauuuuucaaucucugaauauuuuagucucucucugaguc

SEQ ID NO: 360119 - RNA, 64 nt, Human
auaggaaaucugaagaaccugcuguguuuagaugucucugaaaacagguuggaaagacuuccug

SEQ ID NO: 360120 - RNA, 64 nt, Human
ugaguacacugaagccacaggcugguggccauguucucugaauugggugcagaagacaagggca

SEQ ID NO: 360121 - RNA, 64 nt, Human
ucagggggcacuuucaccaagagcaguguaauuaucucugaaagagcaagucagcuugugccgc

SEQ ID NO: 360122 - RNA, 64 nt, Human
uuucuacuucuuugauuguagaaaagcagacacuucucugaaacaugaccuuauucuuccaaac

SEQ ID NO: 360123 - RNA, 64 nt, Human
guagcuggaacaaugcugcugucacacagucucuucucugaaacuucaggaugcuccuugguca

SEQ ID NO: 360124 - RNA, 64 nt, Human
aaggucaguaauuccgacuuucucagcaguggugucucugaauuacugcaaaggguaaaaaaaa

SEQ ID NO: 360125 - RNA, 64 nt, Human
cuggaaaagaucauugcugagaaagaggagcgugucucugaacugcgccaucaacuccagucuc

SEQ ID NO: 360126 - RNA, 64 nt, Human
aucaucucaugggguccagaguggaguccaggcuucucugaaaccagggcugagcauauuucca

SEQ ID NO: 360127 - RNA, 62 nt, Human; identical to SEQ ID NO: 57503

SEQ ID NO: 360128 - RNA, 62 nt, Human; identical to SEQ ID NO: 57504

SEQ ID NO: 360129 - RNA, 64 nt, Human
ugaggacugguugucucucuucgguggccuugagucucugaauuugucggguucucccaugauu

SEQ ID NO: 360130 - RNA, 64 nt, Human
uucgucaacccuguggcuuguuagcaucagaaccucucugaagaccaaacuucccuguguggcc

SEQ ID NO: 360131 - RNA, 64 nt, Human
acucccaaaucacauuacuaaaugccaacaauuaucucugaauucccuauccaggcuccccuca

SEQ ID NO: 360132 - RNA, 64 nt, Human
uuagcagccauuuguguugugaagggguagaagaucucugaaacuugucuugagauugaacuca

SEQ ID NO: 360133 - RNA, 60 nt, Human
gcaucaucuuccucaucugaggaggccucgucucugaacuuggguugugccgagagaguu

SEQ ID NO: 360134 - RNA, 64 nt, Human
acuagcaaaugcugugaauuacucuuccuccccuucucugaaauggguaaaggacaaauugugu

SEQ ID NO: 360135 - RNA, 64 nt, Human
uacaagguuuucagcagacuuugcuccuaauggcucucugaaagugacagacuuaaauauugcu

SEQ ID NO: 360136 - RNA, 64 nt, Human
aucauuaccuuuacaauacuguauaaucagaaguucucugaaccucaauuguauaucuagacau

SEQ ID NO: 360137 - RNA, 64 nt, Human
ggcacuucaucugaagaauguuggugaaggcaagucucugaaagcagaacuauccaguguuauc

SEQ ID NO: 360138 - RNA, 64 nt, Human
ugauguuuugcugaaauauuuuguucuuuaaggaucucugaaacauauuuauaguuuaauaccc

SEQ ID NO: 360139 - RNA, 64 nt, Human
uucuaugcuaaccgaauuaaaauguacuuguugaucucugaauagcucacuucuuacaauguac

SEQ ID NO: 360140 - RNA, 64 nt, Human
aucaggcagauuugaaaacagugacauugcuugaucucugaauggauggaugcccuuggguggu

SEQ ID NO: 360141 - RNA, 64 nt, Human
uuucauuuuuauucuuccuuccaacguggugcuaucucugaaacgagcguuagagugccgccuu

SEQ ID NO: 360142 - RNA, 64 nt, Human
aaacaugccacaggagaauucggggauuugaguuucucugaauagcauauauaugaugcaucgg

SEQ ID NO: 360143 - RNA, 64 nt, Human
gauuacuuucaguauauuucuugagaccgggucaucucugaaaugcauuugggguaguuuccug

SEQ ID NO: 360144 - RNA, 64 nt, Human
aaucugaaaucugcuagugugaaacuugcucuacucucugaaaugauucaaauacacuaauuuu

SEQ ID NO: 360145 - RNA, 64 nt, Human; identical to SEQ ID NO: 64459

SEQ ID NO: 360146 - RNA, 52 nt, Human; identical to SEQ ID NO: 64460

SEQ ID NO: 360147 - RNA, 64 nt, Human; identical to SEQ ID NO: 64461

SEQ ID NO: 360148 - RNA, 64 nt, Human; identical to SEQ ID NO: 64462

SEQ ID NO: 360149 - RNA, 64 nt, Human
aauugagguuguucaaaguuuaagcaauucauucucucugaacacacauugcuauucccauccc

SEQ ID NO: 360150 - RNA, 64 nt, Human
aaucucugaagucagaucucaauuuuuagaaaacucucugaauauaaugaauauggggaaucca

SEQ ID NO: 360151 - RNA, 64 nt, Human
aucccccuugcuugucuucuuuugaaaccgggcaucucugaaguccuggugucaaggggaucaa

SEQ ID NO: 360152 - RNA, 64 nt, Human
cuuuccguugcugaaaaauauuugaaacuuguggucucugaagcucgguggcaccuggaauuua

SEQ ID NO: 360153 - RNA, 64 nt, Human
auucgugugugguuuucuugaucggugagaucugucucugaagucacugccagccucccuggga

SEQ ID NO: 360154 - RNA, 64 nt, Human
aaacuguugcacaacauaugaugaaauuuugauuucucugaaucucagaguaauuuaagauggg

SEQ ID NO: 360155 - RNA, 64 nt, Human
agggucucaacuuuuaaauacacuuugaacuucuucucugaauuauuaaaguucuuuaugaccu

SEQ ID NO: 360156 - RNA, 64 nt, Human
gucuuccccuauuuucugucccagcucauccgugucucugaagaacaaauaugcuuuuggacca

SEQ ID NO: 360157 - RNA, 64 nt, Human
cugcuggcuggcagaggagaaggcagucguuuccucucugaagaguauuuuuuucgauugcccu

SEQ ID NO: 360158 - RNA, 64 nt, Human
uguacugagauuuugguauuacacuguauuuguaucucugaagcauguuucauguuuugugacu

SEQ ID NO: 360159 - RNA, 64 nt, Human
auaauugaaauaucuuacuuuaaaaauauuuucaucucugaaauaucucguuauuuauuggagg

SEQ ID NO: 360160 - RNA, 64 nt, Human
ggaauuugcacuguuaacucauuauuguaaguaaucucugaaagccuuuuuacuuuaaccaaau

SEQ ID NO: 360161 - RNA, 64 nt, Human
aguguucaaauagaaaccauucgugucccuucacucucugaacauagucugcaaaucucucccu

SEQ ID NO: 360162 - RNA, 64 nt, Human
uugcauaaaagacuuuuuuuuaacacuuuggacuucucugaaauauuuagaagugcuaauuucu

SEQ ID NO: 360163 - RNA, 64 nt, Human
cauuucuccucugugcggccuccagcugagccugucucugaauuguucccucccccgcaaugug

SEQ ID NO: 360164 - RNA, 64 nt, Human
gaauuuccuaccuaaauauuaaccauaugccuagucucugaaacuaaaaacuuggaccucaucc

SEQ ID NO: 360165 - RNA, 62 nt, Human; identical to SEQ ID NO: 57496

SEQ ID NO: 360166 - RNA, 62 nt, Human; identical to SEQ ID NO: 57497

SEQ ID NO: 360167 - RNA, 62 nt, Human; identical to SEQ ID NO: 57531

SEQ ID NO: 360168 - RNA, 62 nt, Human; identical to SEQ ID NO: 57532

SEQ ID NO: 360169 - RNA, 64 nt, Human
uuccaggggauggcuagaggcauuucuguuguuaucucugaaacauuuuuauaucaaaaaucag

SEQ ID NO: 360170 - RNA, 64 nt, Human
uuuugaaaaugauuuaaaguguuuuccuuaauguucucugaaaacaaguuucuuuuguaguuuu

SEQ ID NO: 360171 - RNA, 64 nt, Human
uguuggguguggguggucuccaaggccacgcugcucucugaauugauuuuuugaguuuuguuug

SEQ ID NO: 360172 - RNA, 64 nt, Human
aacuccugucucugugagaauguauacuuuaugcucucugaaauguaugacacccagcuuuaaa

SEQ ID NO: 360173 - RNA, 64 nt, Human
gcauuagcuuccugcugaauguaguauuuggcauucucugaauuuauuuccucuccuuccccca

SEQ ID NO: 360174 - RNA, 64 nt, Human
guugauagagaaaaacaacccagcgaaggcgccuucucugaaaacaaugcugagaaugagagcg

SEQ ID NO: 360175 - RNA, 64 nt, Human
uaacuauuacaguguuggagaacaacaaauauguucucugaaugagccuuugugcuuuuuguca

SEQ ID NO: 360176 - RNA, 64 nt, Human
gcccaggcuuuaaaaauuaaaaauggauggaucuucucugaacucagggagggcacauacuuag

SEQ ID NO: 360177 - RNA, 64 nt, Human
uucugaugacacagaaugaaagggcaucucagccucucugaacuuuguaaaaaucuguccccag

SEQ ID NO: 360178 - RNA, 64 nt, Human
aaacaaauuuuaaaagauuugaaauaauuguauuucucugaauucagugaagaaauaauucaug

SEQ ID NO: 360179 - RNA, 64 nt, Human
ggaguaaaugugacuccaaagggaguucaguuaaucucugaaaugcacaaaaccuagcuauuuu

SEQ ID NO: 360180 - RNA, 64 nt, Human
ugaacacaaacauaagaacuggucuucuacacuuucucugaaucauuuagguuuaagauguaag

SEQ ID NO: 360181 - RNA, 64 nt, Human
cccuagaggcgacuucauugcuauggaucuggagucucugaacucuuaauaggaugcagccuca

SEQ ID NO: 360182 - RNA, 64 nt, Human
cgugcuucucuuuggggggccgcgagaucuagcaucucugaaauccuggcugucgaggcuuuga

SEQ ID NO: 360183 - RNA, 64 nt, Human
agaccuuaccucucaacucccucaagaguaccagucucugaaguuauaaugcuuuggucucuac

SEQ ID NO: 360184 - RNA, 64 nt, Human
cgcuuccauaaaucaaagcaugacuaauagggggucucugaaauguaagggcacaaacuucacu

SEQ ID NO: 360185 - RNA, 64 nt, Human
ccacaguagaaccgggagcagggauagcucagcuucucugaauagcacacuuugcucaggucuu

SEQ ID NO: 360186 - RNA, 64 nt, Human
ccuuuucauucuaagacaaaacauuucuccuaaaucucugaauaaaaucagugcuguaggaaga

SEQ ID NO: 360187 - RNA, 64 nt, Human
acauguuacuaugaaagacuuguauuuuuuauugucucugaacuuuaauccugugaaaaugcuc

SEQ ID NO: 360188 - RNA, 64 nt, Human
cagugcuauucuuugaaagcugcuauguguauuuucucugaagucugcauuuuacuaaaauuua

SEQ ID NO: 360189 - RNA, 64 nt, Human
ucacccagaugacaccuccccaaaguccacagacucucugaaagcauuuugaugcaggucugca

SEQ ID NO: 360190 - RNA, 64 nt, Human
aaugguuuguacuaauacagacguacagauacuuucucugaagaguauuuucgaagaggagcaa

SEQ ID NO: 360191 - RNA, 64 nt, Human
ugcuuuuuccccauuggaacuagucauuaacccaucucugaacugguagaaaaacaucugaaga

SEQ ID NO: 360192 - RNA, 64 nt, Human
cucccacacuucccacccccaggcaaggcugacuucucugaaucagaaaagcuauuaaaguuug

SEQ ID NO: 360193 - RNA, 64 nt, Human
cagacuuuucccugggcuuguuuuuucucgcacaucucugaagaguuuuuaaucuucagcucau

SEQ ID NO: 360194 - RNA, 64 nt, Human
gcacacauaccgcacuucauagaaucaaaguugcucucugaaggagcuuuggcuccugauauuu

SEQ ID NO: 360195 - RNA, 64 nt, Human
aaaauaaauuaauuuguuguauauaguuccucaaucucugaaguaaagguaugaguaauauagg

SEQ ID NO: 360196 - RNA, 64 nt, Human
cccuuggauuagagagaaguucguaccuugcauuucucugaauucuagucucucauaagcacug

SEQ ID NO: 360197 - RNA, 64 nt, Human
guacauaacgaaaugaaggcagaaauaaagauauucucugaaagcaaugagaacaaagacacaa

SEQ ID NO: 360198 - RNA, 64 nt, Human
uuucuuuaaaaugcaagcagugagaaauaagaccucucugaauuaguagcucuaaacuguuaac

SEQ ID NO: 360199 - RNA, 64 nt, Human
ccacaacacagaacgauguugaccuguuaaguauucucugaaacauggccaaaaugcauuuuau

SEQ ID NO: 360200 - RNA, 64 nt, Human
ggaagggagggaugaaaggggacacaagucccugucucugaaguuucuuuaaaaucugaguucc

SEQ ID NO: 360201 - RNA, 64 nt, Human; identical to SEQ ID NO: 64437

SEQ ID NO: 360202 - RNA, 64 nt, Human; identical to SEQ ID NO: 64438

SEQ ID NO: 360203 - RNA, 64 nt, Human; identical to SEQ ID NO: 64440

SEQ ID NO: 360204 - RNA, 64 nt, Human; identical to SEQ ID NO: 64441

SEQ ID NO: 360205 - RNA, 64 nt, Human
gagcugggaaauuuguaucuccaaggcggcucugucucugaaauaaauggcaucaagugcaugu

SEQ ID NO: 360206 - RNA, 64 nt, Human
ccugaccccuaggcagcucgagcaugcccugagcucucugaaaguugucacccuggaauagggu

SEQ ID NO: 360207 - RNA, 64 nt, Human
gccugaccccaggcagcucgagcaugcccugagcucucugaaaguugucacccuggaauacgau

SEQ ID NO: 360208 - RNA, 64 nt, Human
gagaccuagaaccgaaccucaucuccgaguugggucucugaagacgggggugaggugagguagg

SEQ ID NO: 360209 - RNA, 64 nt, Human
gagagcaaguucuucugccagggucacacuguggucucugaacugaccaguauaucccuaacuc

SEQ ID NO: 360210 - RNA, 64 nt, Human
guaacaaggaacacuaaaacaguguugauucuugucucugaagacaaauaauuaaaccuuuuuu

SEQ ID NO: 360211 - RNA, 64 nt, Human
acacaccccugcucaacagagguuuaguuuacagucucugaacuaaaguaguaaccucccaaau

SEQ ID NO: 360212 - RNA, 64 nt, Human
auaauuagaucagagacugguagcaucguuucucucucugaaagcaccagugcccagagucugc

SEQ ID NO: 360213 - RNA, 64 nt, Human
cugggggucaggacagggccugauuugagccuccucucugaagaugauuuggccgagcggaagg

SEQ ID NO: 360214 - RNA, 64 nt, Human
uuggacaggaggugcugaggcuggcugcaccugcucucugaagacgccuuccucucuagguuca

SEQ ID NO: 360215 - RNA, 64 nt, Human
ugacugacugugaaguggcuucuccguacgauugucucugaaacaucguggccucaggugccag

SEQ ID NO: 360216 - RNA, 64 nt, Human
aauuaagaauuuacaucuuuuacaaauauguauaucucugaaauaaugaaauauauugaugggu

SEQ ID NO: 360217 - RNA, 64 nt, Human
uuuggggcucuggaauuugggucagaaccuucucucucugaauuuggaucagcuccaagcagug

SEQ ID NO: 360218 - RNA, 64 nt, Human
agucaacaacacucgguccccuugaagaggcaacucucugaacccgucucugacuguuggaggg

SEQ ID NO: 360219 - RNA, 64 nt, Human
agacagauggaaccuucacaagggcgccuuugguucucugaacaucuccuuucucuucuugcuu

SEQ ID NO: 360220 - RNA, 64 nt, Human
cgugauccuccuucccgcagccaccagcgugagcucucugaaucccgggaccccuucacguggc

SEQ ID NO: 360221 - RNA, 64 nt, Human; identical to SEQ ID NO: 277352

SEQ ID NO: 360222 - RNA, 64 nt, Human; identical to SEQ ID NO: 277353

SEQ ID NO: 360223 - RNA, 64 nt, Human; identical to SEQ ID NO: 277354

SEQ ID NO: 360224 - RNA, 64 nt, Human
gcuucaucaccaacucagugcuauuaauucuccuucucugaaugacucaggguacccuauaggg

SEQ ID NO: 360225 - RNA, 64 nt, Human
ccaaaggaaaucuauuuuuucccuucauguuuucucucugaaaguuggcuugagaguuguuguc

SEQ ID NO: 360226 - RNA, 64 nt, Human
acauuggccuuuauuuacuacuuccuuggaaccaucucugaauucugaauagcugacaaccccc

SEQ ID NO: 360227 - RNA, 64 nt, Human
aaagcaaucaugagugcguggcuggggacagaccucucugaagugucuccuguugugaggggcu

SEQ ID NO: 360228 - RNA, 64 nt, Human
cuaccaucuacugugcuugugucaugaugcuuuuucucugaaguggugugggaaguaccagggg

SEQ ID NO: 360229 - RNA, 64 nt, Human
accgccugacgaaucgagugccugugugucuaccucucugaagccugagcaccaugauucccac

SEQ ID NO: 360230 - RNA, 64 nt, Human
cccauggaauaagcuggcuugcuacuucccuacaucucugaagggcuccaccauuccucuagca

SEQ ID NO: 360231 - RNA, 64 nt, Human
aacagggaagaaacuuucuggugcugucuuuuguucucugaauuuucagagacuuuuuuuauaa

SEQ ID NO: 360232 - RNA, 64 nt, Human
aacuugagcuuuaaacuugauuugaguuucagugucucugaauugaacaucccacguuggaaga

SEQ ID NO: 360233 - RNA, 64 nt, Human
uaacuucuuguuugcugaguaauuguuucuaaugucucugaacucaaagugaggugcuccaaga

SEQ ID NO: 360234 - RNA, 64 nt, Human
caaaagcagaguuuugugcaagcacucacugugcucucugaaagagccugaggccgggcguggu

SEQ ID NO: 360235 - RNA, 64 nt, Human
gcuauguaaacugacaaggaugcuaaaauaaaagucucugaaguauuccaugccuuuuggaccc

SEQ ID NO: 360236 - RNA, 64 nt, Human
augucuguaacaugguauuggcuuaucguuuuuaucucugaagggcaguagccugaagauaaca

SEQ ID NO: 360237 - RNA, 64 nt, Human
cgucuccuccaugguggucacugccccuggcaggucucugaaagggaaaugcuuuucugcagag

SEQ ID NO: 360238 - RNA, 64 nt, Human
gagguuaacuuauuuaagggggauguacauauauucucugaaacuaggaugcaugcaauugugu

SEQ ID NO: 360239 - RNA, 64 nt, Human
cgccaccuuccccagcugccuccuaccagcaguuucucugaagaucugucaacagguuaaguca

SEQ ID NO: 360240 - RNA, 64 nt, Human; identical to SEQ ID NO: 277357

SEQ ID NO: 360241 - RNA, 64 nt, Human; identical to SEQ ID NO: 277358

SEQ ID NO: 360242 - RNA, 64 nt, Human; identical to SEQ ID NO: 277359

SEQ ID NO: 360243 - RNA, 64 nt, Human; identical to SEQ ID NO: 277360

SEQ ID NO: 360244 - RNA, 64 nt, Human
ggggucggccaagcugacuguaaauuucacagucucucugaagaaaccauugugcuucugagac

SEQ ID NO: 360245 - RNA, 64 nt, Human
ugagagccauaaaugaccuaacguuucccguuagucucugaacuaggugaucucaguucucuuu

SEQ ID NO: 360246 - RNA, 64 nt, Human
aaaccuucuaaugucgggacaucaucuucaccucucucugaaguuaacuccacuuuaaaacucg

SEQ ID NO: 360247 - RNA, 64 nt, Human
gagaggggaggccaagaguggccccaccuggcccucucugaaggaggccaccuccuaaaaggcc

SEQ ID NO: 360248 - RNA, 64 nt, Human
ugcgaauauaagagaauacuucuaaggacagaaaucucugaaucaauggcuaagacaacaguaa

SEQ ID NO: 360249 - RNA, 64 nt, Human
gaucgccuguggauuuuguccauucaucucaugcucucugaacagaagguauaccugggaagau

SEQ ID NO: 360250 - RNA, 64 nt, Human
uugcucccuuguucuuggagggaccauuauuacaucucugaacuaccuuuguauccaacauguu

SEQ ID NO: 360251 - RNA, 64 nt, Human
cuucaaaaugccauugaucauuauuccuguauuuucucugaaacugauuauaaaaaccaauguc

SEQ ID NO: 360252 - RNA, 64 nt, Human
cucuuacuccuuaggugcccagaauuuaccaucaucucugaaggaguuacagggaaguggucuc

SEQ ID NO: 360253 - RNA, 64 nt, Human
acccagggaauagcccuccucuccccaggaaacuucucugaaaucuuagacuuagccagucuua

SEQ ID NO: 360254 - RNA, 64 nt, Human
ccuccucaggaacccccuuucccgggugagccccucucugaagagacuguccuugggccuccuc

SEQ ID NO: 360255 - RNA, 64 nt, Human
gugaucuaaauuugcagcaaugauacuaaacaacucucugaaauuucucaagcaccaagagaaa

SEQ ID NO: 360256 - RNA, 64 nt, Human
uguaaauagucauuuugcauuugauuagugcaguucucugaaucauaaagcaaguuuuaccucu

SEQ ID NO: 360257 - RNA, 64 nt, Human
agucagcccaacauuuuccaccagucuguccccaucucugaaauccuuccuucucuuucccccu

SEQ ID NO: 360258 - RNA, 64 nt, Human
guggggcuuccauauuucaaaguggaagcuuucuucucugaagucgauauaugguuuugaauua

SEQ ID NO: 360259 - RNA, 64 nt, Human
ugauugcagcuguguccugaauuccugaagcacgucucugaaucuguccuccucuggacuaagg

SEQ ID NO: 360260 - RNA, 64 nt, Human; identical to SEQ ID NO: 277361

SEQ ID NO: 360261 - RNA, 64 nt, Human; identical to SEQ ID NO: 277362

SEQ ID NO: 360262 - RNA, 64 nt, Human; identical to SEQ ID NO: 277364

SEQ ID NO: 360263 - RNA, 64 nt, Human; identical to SEQ ID NO: 277365

SEQ ID NO: 360264 - RNA, 64 nt, Human
agggacuguaaacacagacagggucaaaguguuuucucugaacacauugaguuggaaucacugu

SEQ ID NO: 360265 - RNA, 64 nt, Human
agaaaauguacacagacugauuuggagaacacauucucugaaaauacuguaaauacguugggga

SEQ ID NO: 360266 - RNA, 64 nt, Human
ccagcucaccccacucccuucugccccuuuuuugucucugaaauuugcacuacgucuuggacgg

SEQ ID NO: 360267 - RNA, 64 nt, Human
uggcuugagugaauguuaggccuugggggcugagucucugaaaagucuaagaagcucugccuag

SEQ ID NO: 360268 - RNA, 64 nt, Human
ucgggaagcagaaauauagugcaauagugcaacaucucugaauccuuuuaaucuagagaaggca

SEQ ID NO: 360269 - RNA, 64 nt, Human
cugcaucccugggcccagggaguuuacucagagcucucugaagauguggcaacccaugcccccu

SEQ ID NO: 360270 - RNA, 64 nt, Human
uuucuccucuuuggugaaagcauuucuuaugguuucucugaaucaguucaucccacacaucauc

SEQ ID NO: 360271 - RNA, 64 nt, Human
uguuugucacgucuucugagaaugacuuucagucucucugaaaaugaaaagcuuaggaccagaa

SEQ ID NO: 360272 - RNA, 64 nt, Human
ucuugcuagagaaaaggugaggguuguuuuucuuucucugaaaccuacaguaaauggguaugau

SEQ ID NO: 360273 - RNA, 64 nt, Human
aagggcuugcuugaccugaugauuuuccuucagcucucugaaggugcuuuuuccacaauccaag

SEQ ID NO: 360274 - RNA, 64 nt, Human
uucuugauguccaggguagauaaagggucgaaucucucugaagaacugccaccuggucaucagc

SEQ ID NO: 360275 - RNA, 64 nt, Human
cacucacccugcuagcuuugcccuugacucgucuucucugaaccucagccucgugcauugccug

SEQ ID NO: 360276 - RNA, 64 nt, Human
cuuaaagagcaauaguuugccccuuuuggaaugaucucugaauauauaaaacacacacacaaag

SEQ ID NO: 360277 - RNA, 64 nt, Human
caacuuaacuauuuuggcuuuuuaaacauaauuuucucugaaaauuaauuguggcucuuauuug

SEQ ID NO: 360278 - RNA, 64 nt, Human
aguuccaccuucuauguuucuacucccucccuggucucugaaugccuucgccuguauaaagagu

SEQ ID NO: 360279 - RNA, 64 nt, Human
aaagccuuccuacacguuagauuugccguaccaaucucugaaugccccauaauuauuauuucca

SEQ ID NO: 360280 - RNA, 64 nt, Human
aaaagugguuggggauccacaggaacgacauucauacagggacauuugugaaagcaaagcaaga

SEQ ID NO: 360281 - RNA, 64 nt, Human
ugaaacaaacuuuaaaaaggaaaaaaaagcauuuuacagggaaaaauaccucuccucaugaagg

SEQ ID NO: 360282 - RNA, 64 nt, Human
cuuuuuguauguaauauuuuuauugaugaauacaucucugaacguuccagaagucuuaagguuc

SEQ ID NO: 360283 - RNA, 64 nt, Human
aaguaacugagaguuugguaaaagaauauuuucuucucugaauaauaauuauuuucacagugaa

SEQ ID NO: 360284 - RNA, 64 nt, Human
aaaaaauauauaacuuacuauauguuucaguugcucucugaacaaaaauuaucuucaauuuaau

SEQ ID NO: 360285 - RNA, 64 nt, Human
aucuucaauggacuaagauuuuuuuggucaguaaucucugaaauuuccuuaaauuauauacuua

SEQ ID NO: 360286 - RNA, 64 nt, Human
gaaacauuuucuuucauuccaguggccuuagucaucucugaagaaauacuuacuugauuuuuuu

SEQ ID NO: 360287 - RNA, 64 nt, Human
acuuccucgcccuccuccacccgagaugccagagucucugaagaagaagcuuggguuaacucag

SEQ ID NO: 360288 - RNA, 64 nt, Human
acuuuaguugaagcguaaaucuaaagaaacauuuucucugaaauauauuauuaagggcaaugga

SEQ ID NO: 360289 - RNA, 63 nt, Human
uuauagauccaaauaaaagaaaagaagcaaagacucucugaaaauuaguauaugaguucuucc

SEQ ID NO: 360290 - RNA, 64 nt, Human
auuuuuaauuuguuuuuuucuccaaguccaccagucucugaaauuagaacaguaggcgguauga

SEQ ID NO: 360291 - RNA, 64 nt, Human
acaguauuguuuucucuguuuuucuucucuaacuucucugaaaucaucuccuauuaagggauag

SEQ ID NO: 360292 - RNA, 64 nt, Human
uccucuccauagcugggaaguuuauuuuguuuugucucugaagacagcaguuuuauugcaucac

SEQ ID NO: 360293 - RNA, 64 nt, Human
auuuuuaaaaaauagauucaaauguguuauccucucucugaaacgcuuccuauaacucgaguuu

SEQ ID NO: 360294 - RNA, 64 nt, Human
aacauucuccacagccucacuucauuccaccuauucucugaaaauauucccugagagagaacag

SEQ ID NO: 360295 - RNA, 64 nt, Human
aguuggggggacugugaugacaauuaaaucaccuucucugaaguucuggcucugcagagaccaa

SEQ ID NO: 360296 - RNA, 64 nt, Human
cgacguccaccgucccaaggcugucacuaguauuucucugaagugccugaagguaggaaugggc

SEQ ID NO: 360297 - RNA, 64 nt, Human
ucacaacuucaggagacaucugaaaagaaugaugucucugaaagcuguccuuucagaugaggga

SEQ ID NO: 360298 - RNA, 64 nt, Human; identical to SEQ ID NO: 277369

SEQ ID NO: 360299 - RNA, 64 nt, Human; identical to SEQ ID NO: 277370

SEQ ID NO: 360300 - RNA, 64 nt, Human; identical to SEQ ID NO: 277371

SEQ ID NO: 360301 - RNA, 64 nt, Human; identical to SEQ ID NO: 277372

SEQ ID NO: 360302 - RNA, 64 nt, Human
agaugcccaaaaaugauggauagagaaacagaaaucucugaaugucagaacccugucuuuuaaa

SEQ ID NO: 360303 - RNA, 64 nt, Human
uuuuauauguauggaucuauauuuucagagcuuaucucugaagaucuaaacuuuugagaauguu

SEQ ID NO: 360304 - RNA, 64 nt, Human
uauccugucucugcuuugaggcaaucaaguacccucucugaaccuagguucccucaucuguaaa

SEQ ID NO: 360305 - RNA, 64 nt, Human
aguauuuucaaugugaauccaaagcuugucugguucucugaaaauaauuuuuuccccuuuaggu

SEQ ID NO: 360306 - RNA, 64 nt, Human
aaacugcuucaagauuaccaggacuccuacacacucucugaaacucaggcugaggcagcagcug

SEQ ID NO: 360307 - RNA, 64 nt, Human
uucucaucaaaagaagccaaauucaugaucaacaucucugaaguuucaaguaaggcccacacuu

SEQ ID NO: 360308 - RNA, 64 nt, Human
ugcuuaaucauuuaaaguaaacacaauugaagccucucugaaguuaaacccaacuauguuuauu

SEQ ID NO: 360309 - RNA, 64 nt, Human
ccauaugaauaauuucacauacagaaccuuuuuuucucugaaguccuguggacuugcaaauaua

SEQ ID NO: 360310 - RNA, 64 nt, Human
guuggcucuugagauuaauaguaaccccagcaucucucugaaacgaaaaaagaaauuaauuaag

SEQ ID NO: 360311 - RNA, 64 nt, Human
gaggccaggaaaaaaaaaaaaaagacucccuggaucucugaauauaugcaaaaagaaggcccca

SEQ ID NO: 360312 - RNA, 64 nt, Human
uggguguuguauagauccaguugcacuaaauuccucucugaaucuuggcugcuggagccauuca

SEQ ID NO: 360313 - RNA, 64 nt, Human
acauguguauggcguguguucuugaaaugaugucucucugaauauccaaaaaaguacuguacug

SEQ ID NO: 360314 - RNA, 64 nt, Human
gauaaauuuuguagcugguacacucuggccugggucucugaauucagccugucaccgauggcug

SEQ ID NO: 360315 - RNA, 64 nt, Human
agguccuugaucuuuucuuuagauugaaagucugucucugaacacaauuauuuguaaaaguuag

SEQ ID NO: 360316 - RNA, 64 nt, Human
ccaugcauuuuguuuguuucuucacuuauccuguucucugaagauguuuugugaccagguuugu

SEQ ID NO: 360317 - RNA, 64 nt, Human
uugaaaaaagaacguauuuuuugugcuuugaagaucucugaagaauuucuuuuauaauagaaug

SEQ ID NO: 360318 - RNA, 63 nt, Human
aggggccacccgggguuggggugggagugugguggggcguagugguggcaggacaagagaagg

SEQ ID NO: 360319 - RNA, 63 nt, Human
caacaaggaacgaaugguagcagccagcuuugcggggcguauguguggccagcucuuaaccau

SEQ ID NO: 360320 - RNA, 64 nt, Human; identical to SEQ ID NO: 277376

SEQ ID NO: 360321 - RNA, 64 nt, Human; identical to SEQ ID NO: 277377

SEQ ID NO: 360322 - RNA, 64 nt, Human
ggaccuugaggguccaaugggaccuugaggguuuucucugaaauauacaaacuuaaaggacucu

SEQ ID NO: 360323 - RNA, 64 nt, Human
ggaucgcacaccuuugcaacagauguguucugauucucugaaccuacaaaauaguuauacauag

SEQ ID NO: 360324 - RNA, 64 nt, Human
cauucauacacaacguaaucaaauaugugguccaucucugaaaacaagagacugcuugacaaag

SEQ ID NO: 360325 - RNA, 64 nt, Human
uaauccagugucgggaagacaaagauguuuugcuucucugaagaagcuuauaauaauauacagu

SEQ ID NO: 360326 - RNA, 64 nt, Human
acuaggcugcggcuggccacugugucuccucacuucucugaacaaagcaguuccuccccuacca

SEQ ID NO: 360327 - RNA, 64 nt, Human
accuaccugcaguggacugucauuuuccuuucuuucucugaauuacugcuuuuucugugggcau

SEQ ID NO: 360328 - RNA, 64 nt, Human
ccuucacugguuuugaacucagugccuaagaaagucucugaaauguucguuuuuaggcaauaua

SEQ ID NO: 360329 - RNA, 64 nt, Human
cuccuccacaguggcucccagagguuccacacacucucugaagcuccuucucccacacugcacc

SEQ ID NO: 360330 - RNA, 55 nt, Human
ucugcgacucaguugauugagcugcucucugaagaggaagaggagaaagccagag

SEQ ID NO: 360331 - RNA, 64 nt, Human
aaaauuauucuccacaauauuaccaugcaaguuaucucugaaauuuaaaauguuaaagaaaaac

SEQ ID NO: 360332 - RNA, 64 nt, Human
caccucaguauguuaaacagguaauguaagaaguucucugaaaugucagcaaguaaguucugaa

SEQ ID NO: 360333 - RNA, 64 nt, Human
gcuaaucaggaaauaaacuugacuuuucuauuuuucucugaagcuuuacaggacauacucccac

SEQ ID NO: 360334 - RNA, 64 nt, Human
cauuaagaagauaaauccaguuaucagcuuccugucucugaaguuuggaucauuuuauagaucc

SEQ ID NO: 360335 - RNA, 64 nt, Human
auaaaauaucucacccaagacuuaaaggaagaauucucugaagggauaaagauuacuaaaaaaa

SEQ ID NO: 360336 - RNA, 64 nt, Human
agaaugauuuacucugaagaaacaaacaaugguaucucugaaacucacaaccuaaagcccaauc

SEQ ID NO: 360337 - RNA, 64 nt, Human
auugggaguaugucagcaugaucgaacugaaggaucucugaaaggccacagcuggagcaauuug

SEQ ID NO: 360338 - RNA, 64 nt, Human; identical to SEQ ID NO: 277366

SEQ ID NO: 360339 - RNA, 64 nt, Human; identical to SEQ ID NO: 277367

SEQ ID NO: 360340 - RNA, 64 nt, Human
uagagggauuuaaacagcuccuuuggcacgugccucucugaauccagccugccauuccaucaaa

SEQ ID NO: 360341 - RNA, 64 nt, Human
guagggagugugauuuuguuggaggugcacauggucucugaauuugacagagaacaccuucccu

SEQ ID NO: 360342 - RNA, 64 nt, Human
auggccccugauggcgucccugcugguuuucaauucucugaagccuuguguagcuuucagagca

SEQ ID NO: 360343 - RNA, 64 nt, Human
ggcagccccacaacuuuaaacauugacgauuccuucucugaacacaggcagcuuucuagaaguu

SEQ ID NO: 360344 - RNA, 64 nt, Human
ugugaugcuccaugucugaauuucguccagccucucucugaacugugaucuuuguccucaugaa

SEQ ID NO: 360345 - RNA, 50 nt, Human
cagaccuugaugauacaugaucucugaaagacuagacugucuuauauuau

SEQ ID NO: 360346 - RNA, 64 nt, Human
auuuuuguuucaucaacuaagaugcacuguaacaucucugaaaucuggauauauuaucaauggu

SEQ ID NO: 360347 - RNA, 64 nt, Human
auaaauuuauguagugaguaaaguugcucucuagucucugaaaagcaaaaaaagugagaaaaua

SEQ ID NO: 360348 - RNA, 64 nt, Human
uuugggggaagggguaugugucacuaauagaauaucucugaagcuggauugauacggggaaaac

SEQ ID NO: 360349 - RNA, 64 nt, Human
gagucucaaggucauuccccucuucccucaagacucucugaaugcugcuccacugucuuuuguc

SEQ ID NO: 360350 - RNA, 64 nt, Human
aagccugugggcaacguucuuuugagccaagacuucucugaauggcccugcugguggaaggggu

SEQ ID NO: 360351 - RNA, 64 nt, Human
ccauggcucuuagccagaaaugucuugccucuggucucugaaaagcuggggugagugguuaccu

SEQ ID NO: 360352 - RNA, 64 nt, Human
gcugcugguguguauuuuuguaaauguuaugcacucucugaaaggaaaaacacacacaaaagaa

SEQ ID NO: 360353 - RNA, 64 nt, Human
gucauuccuaaucuuggucucuauagcaguguucucucugaaugcugagcugaagaaauuauac

SEQ ID NO: 360354 - RNA, 64 nt, Human
ggagaaagucauguauuuguucgcaauuaugcuuucucugaauuuaauaaaaauauuccuaaug

SEQ ID NO: 360355 - RNA, 64 nt, Human
ccucuugucuuucuucccugcuuugcugcuuugcucucugaaaccuacauuccgucaguuuccg

SEQ ID NO: 360356 - RNA, 64 nt, Human
uggccuacacagagaaccguucguguugggcuucucucugaacgccccgaaccuugcaucaagg

SEQ ID NO: 360357 - RNA, 64 nt, Human
uuuuuccuaaauggaaaaugggaaggagauacugucucugaacaaaaauagcuggaaaaacaca

SEQ ID NO: 360358 - RNA, 64 nt, Human
caugggcccagccccaaagggcagugaauggccuucucugaaacccugcgucaagcagugggag

SEQ ID NO: 360359 - RNA, 64 nt, Human
uguguaguguccauggguucuucaugugcuaugaucucugaaaagacguuaucaccuuaaagcu

SEQ ID NO: 360360 - RNA, 64 nt, Human
ccccaccaggagggggaauucauccuccgggucuucucugaaaagaggaaccucucugagugag

SEQ ID NO: 360361 - RNA, 64 nt, Human
gagaacugcuuuuuacacauuuaauaaaaaaaggucucugaauuaucugaugucauuuaucaag

SEQ ID NO: 360362 - RNA, 64 nt, Human
acauuuaccuguauuguaaguacccacaucugugucucugaaguccuuugaaacaucucauuau

SEQ ID NO: 360363 - RNA, 64 nt, Human
agacugcagcacaccuagagggcccuuuccugcuucucugaaagcacaggucacccagccucag

SEQ ID NO: 360364 - RNA, 64 nt, Human
uuguugauguuugagucuucaggaaguauuugcaucucugaaaucuuuuuuauauguguuuugc

SEQ ID NO: 360365 - RNA, 64 nt, Human
ggcuccaggguucucugguucucuggagcagaguucucugaauaccccaucccccaacugcuga

SEQ ID NO: 360366 - RNA, 64 nt, Human
gaagaucauaagaaauccuuuaagaguuuaaaugucucugaaacaggcauacaggcucuaguca

SEQ ID NO: 360367 - RNA, 64 nt, Human
ccuguuguccacagucuucaggcagcuccccaggucucugaaccccagagugucaucauuggag

SEQ ID NO: 360368 - RNA, 64 nt, Human
uuacuuuagauucuuauugaauucauaauacuuaucucugaaaaugucuuugacuguaaauuua

SEQ ID NO: 360369 - RNA, 64 nt, Human
ggaaaucuuuguacagcuuuaaguugugucagauucucugaaaacauuuuuuagaaagcaaaau

SEQ ID NO: 360370 - RNA, 64 nt, Human
gaugaugucacugugccacuuggacagggcguuuucucugaauugaagggaaagccaauggugu

SEQ ID NO: 360371 - RNA, 64 nt, Human
uauuauuaaagcuuaauugccaugccguuuaucuucucugaaagaacuucaaaucuuaccugcc

SEQ ID NO: 360372 - RNA, 64 nt, Human
aauucacccuacauuccucuccucuucacuagccucucugaagguguccuggccagcccuggag

SEQ ID NO: 360373 - RNA, 64 nt, Human
caaccuggaauggagacuuuuaucuacuucucucucucugaagaugucaaaucgugguuuagau

SEQ ID NO: 360374 - RNA, 64 nt, Human
guggaacaggcaaggaugggggccugggcuguccucucugaaugccuuggagggaucccaggaa

SEQ ID NO: 360375 - RNA, 64 nt, Human
uccuuugauugugaaguagccccaaaugaugucgucucugaagugggaauauuuuacagaauag

SEQ ID NO: 360376 - RNA, 64 nt, Human
aacuucacuguguguuuucuaucucggaucccagucucugaagacaacuugcuuugauucaacc

SEQ ID NO: 360377 - RNA, 64 nt, Human
ggcagcugcgguccacccaggagccccgaggccuucucugaaggacauugcggacagccacggc

SEQ ID NO: 360378 - RNA, 64 nt, Human
gcuuuauggaaaucauugaaggucuggaucccuuucucugaauggagagauugagagggauguc

SEQ ID NO: 360379 - RNA, 64 nt, Human
augucccaaagguggaauacaaccagaggucucaucucugaacuuucuugcguacugauuacau

SEQ ID NO: 360380 - RNA, 64 nt, Human
uaauucaugcuuuuuaaauucagccagcccccccucucugaaauuuuauuauguaaauaauuug

SEQ ID NO: 360381 - RNA, 64 nt, Human
agccuauggucucaacugugcuugaaaaacacugucucugaaaacaacuuugugauucucccug

SEQ ID NO: 360382 - RNA, 64 nt, Human
ccccaaacuacuugaaaagggcauuuggcaccacucucugaaacaacacagucacucuagcaag

SEQ ID NO: 360383 - RNA, 64 nt, Human
uagaggggaccugcucagcaggugugaccaggguucucugaaucuguuauuguuuuugcuucug

SEQ ID NO: 360384 - RNA, 64 nt, Human
auugaacauguacagacuuuuuucuugucauuauucucugaacaauacaagaacucuuuaugua

SEQ ID NO: 360385 - RNA, 64 nt, Human
caaaggcuuaaggacaacaguuucuaaccaaguuucucugaauccuuuccugagaggugguggg

SEQ ID NO: 360386 - RNA, 64 nt, Human
ugaugcugaggaugauugaggugggucuaccucaucucugaaaauucuggaaggaauggaggag

SEQ ID NO: 360387 - RNA, 64 nt, Human
cccaucuuguaauauccagagcuacuuuauaaauucucugaaccaaaaguauuuuccucagugu

SEQ ID NO: 360388 - RNA, 64 nt, Human; identical to SEQ ID NO: 277333

SEQ ID NO: 360389 - RNA, 64 nt, Human; identical to SEQ ID NO: 277334

SEQ ID NO: 360390 - RNA, 64 nt, Human
cuuugcugccaccuggugucagccucagucacuuucucugaaugcuucugagccuugccuacau

SEQ ID NO: 360391 - RNA, 64 nt, Human
gguccccguuugucaaagaggauggacuaaaugaucucugaaaguguugaagcgcggacccuuc

SEQ ID NO: 360392 - RNA, 64 nt, Human
gugccuccaggaggugagcccugggugcagcuggucucugaaugacguuacacccucaccuucu

SEQ ID NO: 360393 - RNA, 64 nt, Human
ccagcucagguuuuuuuauuugaacuggguugaaucucugaagaaaucuguucaagaccaugcu

SEQ ID NO: 360394 - RNA, 64 nt, Human
ggcuaggacuuugggguuaggccauggggcucuuucucugaaggccacuuuccugacguacucu

SEQ ID NO: 360395 - RNA, 64 nt, Human
gugaggaacaggguugccucuuggcuggguggagucucugaaauguuagaagaagcgcugaagc

SEQ ID NO: 360396 - RNA, 64 nt, Human
cggcagccuuccaugaggcagaaggggucgucguucucugaaaacagugacucugaaauguugg

SEQ ID NO: 360397 - RNA, 64 nt, Human
cuguugaucuaugaccuuacccccaaccuggugcucucugaaacaugugcuguguccacucagg

SEQ ID NO: 360398 - RNA, 64 nt, Human
aagaucaucccagagguucaggcaguuccugucaucucugaaaagacugggggauaugaaaucu

SEQ ID NO: 360399 - RNA, 64 nt, Human
aaagauuccuuuccuauccauccuuccauccaguucucugaaucuuuaaugaaaucauuugcca

SEQ ID NO: 360400 - RNA, 64 nt, Human
guuaccuuucuaggucaaggccugucccuggccaucucugaacuucagcuagagcuucaagucu

SEQ ID NO: 360401 - RNA, 64 nt, Human
gaccauggaagauugagagcccaagguuuaaacuucucugaagggagguggggaugagaagagg

SEQ ID NO: 360402 - RNA, 64 nt, Human
ggaugcuaaugaaaucauaguauuuuguguagcuucucugaagaccuuagagaucugcagcuuu

SEQ ID NO: 360403 - RNA, 64 nt, Human
ggggccuggagaggggaggcaggggccccugugcucucugaacaaguugaaaguccaaauaaaa

SEQ ID NO: 360404 - RNA, 64 nt, Human
ccaguuaaucagcaaccugacucaggccagugugucucugaaacggauccagcaauuccugagc

SEQ ID NO: 360405 - RNA, 64 nt, Human
uugucgaucuaguucaguucaacucaguggauguucucugaaugcuuacugggugccaggacca

SEQ ID NO: 360406 - RNA, 64 nt, Human; identical to SEQ ID NO: 277373

SEQ ID NO: 360407 - RNA, 64 nt, Human; identical to SEQ ID NO: 277374

SEQ ID NO: 360408 - RNA, 62 nt, Human; identical to SEQ ID NO: 57489

SEQ ID NO: 360409 - RNA, 62 nt, Human; identical to SEQ ID NO: 57490

SEQ ID NO: 360410 - RNA, 64 nt, Human
acacguuccccaggcccauaacagaggacuaaaaucucugaauuuuaaagacacagaugacugg

SEQ ID NO: 360411 - RNA, 64 nt, Human
aaauuuguguaaauuuguauccacacaaauucagucucugaauacacaguauucagagucucug

SEQ ID NO: 360412 - RNA, 64 nt, Human
uaaagguucaucuguccaugcaguccucuuggauucucugaauguaguaacuaugaagcuaugc

SEQ ID NO: 360413 - RNA, 64 nt, Human
ccuccccgaaaaaggguguuuugaugccucagggucucugaaaucucccgggaagccccagagc

SEQ ID NO: 360414 - RNA, 64 nt, Human
gucucaagcccuuaaccucuguaagccuguuucuucucugaaaucacaguaauaaagcgucgua

SEQ ID NO: 360415 - RNA, 64 nt, Human
ccuccugacuugccuuauuuauuuguucgacgcgucucugaauguauccgccucgguucccacc

SEQ ID NO: 360416 - RNA, 64 nt, Human
gcuuggauguugcccuuaguucuuguuuaaugucucucugaaugcaguuuuaaaauagaaaaca

SEQ ID NO: 360417 - RNA, 64 nt, Human
uggaugugccuuuauccucuaaugccccaaucucucucugaacacccccauucuccaccuguug

SEQ ID NO: 360418 - RNA, 64 nt, Human
gcugaugguagcuggcuuuugaaauccuauggggucucugaaugaaaacauucuccagcugcuc

SEQ ID NO: 360419 - RNA, 64 nt, Human
ggaccuacuuaaguuguucacuuuacuugccuggucucugaaggcauuugaguuugccucuucu

SEQ ID NO: 360420 - RNA, 64 nt, Human
gcccagccuaccuucucucacagggggacccaauucucugaagucuacgauggagcauuuuuug

SEQ ID NO: 360421 - RNA, 64 nt, Human
ggaaguuuggaucugcuccucgucaggcgcagcaucucugaagcuuggaaagcugucuuccagc

SEQ ID NO: 360422 - RNA, 64 nt, Human
ugaggaaaagcggacaucagcuggucaaacaaacucucugaaccccucccuccaucguuuucuu

SEQ ID NO: 360423 - RNA, 64 nt, Human
aguuugcuuauuuucaauugccuaggucacagugucucugaacuguucaucccuugaccaccuc

SEQ ID NO: 360424 - RNA, 64 nt, Human
cuacccucuaccaaaugaauacaaguuugaauuuucucugaaauaugucaaccccauguucccu

SEQ ID NO: 360425 - RNA, 64 nt, Human
uguggaauucuguuuguuaaaucaaauuagcuggucucugaauuaagggggagacgaccuucuc

SEQ ID NO: 360426 - RNA, 62 nt, Human; identical to SEQ ID NO: 57491

SEQ ID NO: 360427 - RNA, 62 nt, Human; identical to SEQ ID NO: 57492

SEQ ID NO: 360428 - RNA, 62 nt, Human; identical to SEQ ID NO: 57494

SEQ ID NO: 360429 - RNA, 62 nt, Human; identical to SEQ ID NO: 57495

SEQ ID NO: 360430 - RNA, 64 nt, Human
ugauucuuaaccccauggacuccuuucccuuucuucucugaaaaaaacuaauuuaaauuugcuu

SEQ ID NO: 360431 - RNA, 64 nt, Human
ucugaggaugucauggagaaugcuuaauuuucuuucucugaacuucaaaauauuaaauauuuuc

SEQ ID NO: 360432 - RNA, 64 nt, Human
agccucaaugaaauggagcuggcucacucuuccuucucugaaaugcagacagcugugagugaca

SEQ ID NO: 360433 - RNA, 64 nt, Human
uauggcuuuguuuucagucuauuucuaggagcuuucucugaaucgcuaauuguccuuucaguug

SEQ ID NO: 360434 - RNA, 64 nt, Human
ggagcugcucagggugcccucuccugcggaccagucucugaauguucaaagaugagggccuggc

SEQ ID NO: 360435 - RNA, 64 nt, Human
cagagaauuuuuauuuuguaauagaagugaacugucucugaagggugaaggcaggccguccugg

SEQ ID NO: 360436 - RNA, 64 nt, Human
uugaaggagggcgucgccggaaacccagggaaccucucugaagugacaccucaccccuacacac

SEQ ID NO: 360437 - RNA, 64 nt, Human
auaaguaaaagaaauauaggaauauuccagucaaucucugaaauguuuaugaaaaacagguuaa

SEQ ID NO: 360438 - RNA, 64 nt, Human
gaccuagaagaauccauccaaaucccugccuuccucucugaaccaacaguucccuucucugaca

SEQ ID NO: 360439 - RNA, 64 nt, Human
aacuacugcuuuagaaugaagucguauaauaaagucucugaaaaggccuuauucagaauaagca

SEQ ID NO: 360440 - RNA, 64 nt, Human
gauucacuuuugcuucuggggcuggcaaaaaccuucucugaacccacacaccaaguucguaguu

SEQ ID NO: 360441 - RNA, 64 nt, Human
cgucuuagccauuccguccugcuccccagcucacucucugaagcacacaucauuggcuuuccua

SEQ ID NO: 360442 - RNA, 64 nt, Human
ggagaggacucagauuuccuggaggcaaagucuaucucugaaacuccaugaagacuuuugcagc

SEQ ID NO: 360443 - RNA, 64 nt, Human
ucgcugaccgaugacccuggaacuccacggugccucucugaaucucuguuauggaucccccacu

SEQ ID NO: 360444 - RNA, 64 nt, Human
ccccauaagagcaguagcuuuugaaacucauaauucucugaaauaaaugaaagacauuuaauuc

SEQ ID NO: 360445 - RNA, 64 nt, Human
agcaugcaugaagagaugaguguguucuaauaagucucugaaagccaguggcuuuaugacuuuu

SEQ ID NO: 360446 - RNA, 62 nt, Human; identical to SEQ ID NO: 57499

SEQ ID NO: 360447 - RNA, 62 nt, Human; identical to SEQ ID NO: 57500

SEQ ID NO: 360448 - RNA, 62 nt, Human; identical to SEQ ID NO: 57501

SEQ ID NO: 360449 - RNA, 62 nt, Human; identical to SEQ ID NO: 57502

SEQ ID NO: 360450 - RNA, 64 nt, Human
ucagggcuuuguccaguuaucuucauaugacuguucucugaaaaaaggucuuacuaccugauau

SEQ ID NO: 360451 - RNA, 64 nt, Human
aacuaacacaguuauuccuauacuggauuuuaggucucugaagaacugcugguguuuaggaaua

SEQ ID NO: 360452 - RNA, 64 nt, Human
ugacaugauaucuuugcuuuugaguuccucacgcucucugaauuuuauuaguuggacaauucca

SEQ ID NO: 360453 - RNA, 64 nt, Human
ucugauuuagaaagacugcgugagucuuauuuauucucugaaacacagcccaaguuucauguua

SEQ ID NO: 360454 - RNA, 64 nt, Human
ggaugaagacuucauugggcaugaaugagucaagucucugaagcgguggccacuucuuggacau

SEQ ID NO: 360455 - RNA, 64 nt, Human
accccagcccccacccccaguuaacacugcugcuucucugaaugcaugucacgcugcaccccau

SEQ ID NO: 360456 - RNA, 64 nt, Human
cccaaucuuccaagggugccagccccuccguucaucucugaaacccagcauccuuuucagcugc

SEQ ID NO: 360457 - RNA, 64 nt, Human
ugucagucgugugauuugcaagucuucuuccuagucucugaaguuucuuucuuucauagagcaa

SEQ ID NO: 360458 - RNA, 64 nt, Human
acuccaucucaagaaaaaauaaaaauaaaguuguucucugaagagcaaaugucucauuccagua

SEQ ID NO: 360459 - RNA, 64 nt, Human
cacccucccaagacuaaaccaggaagaaguugaaucucugaauagaccaauaacagccucuggg

SEQ ID NO: 360460 - RNA, 64 nt, Human
ucugaauacuuuaauaucagcuuguuuugugaauucucugaauacugucaacacucuuaucuaa

SEQ ID NO: 360461 - RNA, 64 nt, Human
uagauuaaacuuccauuuauaaagucagaaccuaucucugaaaauuaaugugagaaagaaaucu

SEQ ID NO: 360462 - RNA, 64 nt, Human
gguaggggauggaggugagaauacuccuugguuuucucugaagcccacccuuucccccaacucu

SEQ ID NO: 360463 - RNA, 64 nt, Human
uauaauuucguccucuccuucggaacacuggcugucucugaagacuucucgcucaguuucagug

SEQ ID NO: 360464 - RNA, 64 nt, Human
uagaaaauaaggaacaaagagaaacuuguaauggucucugaaaaggaauugagaaguaauuccu

SEQ ID NO: 360465 - RNA, 64 nt, Human
caaaguuucuaucuugugucacuauccaucucauucucugaauacuuauccaggauuaagauac

SEQ ID NO: 360466 - RNA, 63 nt, Human
uuggaauuugacuuuccauuucugagacccaagggggcguagauguaguggcaaguguggcga

SEQ ID NO: 360467 - RNA, 63 nt, Human
ucucucucucauauauacauaugaaaggcacucggggcguaucgaggcugcugcuggcuguga

SEQ ID NO: 360468 - RNA, 63 nt, Human
gugcagcccacggagggugagcugaagcaggguggggcguaaccucaccugggaagugcaagg

SEQ ID NO: 360469 - RNA, 63 nt, Human
ucacggugcugcaaugaccggaagucgccccugggggcguagcacagcgucuucucggaggcu

SEQ ID NO: 360470 - RNA, 64 nt, Human
ggagaaaggccuuagggugacagguuauguacugucucugaaucaauaugaccucacuuaaaac

SEQ ID NO: 360471 - RNA, 64 nt, Human
ccccuaagcugcucucccuuggaaccugcacagcucucugaaauggggcauuuuguugggacca

SEQ ID NO: 360472 - RNA, 64 nt, Human
ccagcuccuaccucugaccccaacuucucuuugaucucugaauccccucugacuccaacuucuc

SEQ ID NO: 360473 - RNA, 64 nt, Human
gaggcuucugaccuuugauccgcuaggccccccaucucugaacccuagagccccgcuuucccuc

SEQ ID NO: 360474 - RNA, 64 nt, Human
aggaaugugggaaaaccuaaaggugucccuguucucucugaagacaugaaaacucacuggggag

SEQ ID NO: 360475 - RNA, 64 nt, Human
uuaaaccauuuucucucuuucgguaauagaaaaaucucugaaagacuuuacugaccaaucagcc

SEQ ID NO: 360476 - RNA, 64 nt, Human
ggcggugguggcuggugguuuaaagguugaacuuucucugaagcuccuuuccccuugcucuugg

SEQ ID NO: 360477 - RNA, 64 nt, Human
gaaagggaggugaguggguggaggcagggugacgucucugaacccaaaacccugacggccucuc

SEQ ID NO: 360478 - RNA, 64 nt, Human
gaccagccugggcaacauagcaagacccccaccaucucugaaaaaaaaaauuagccaggcaugg

SEQ ID NO: 360479 - RNA, 64 nt, Human
aaagaauuuggagaugguucugcccacucugguuucucugaaaaaacgagguaauucccugagc

SEQ ID NO: 360480 - RNA, 64 nt, Human
cuuccuuggucccuucagggaagcccucaacucaucucugaacuuagaaucucauccuuagggc

SEQ ID NO: 360481 - RNA, 64 nt, Human
caucuuuuguauuugucuuuauacuuugcugaauucucugaaauaccuauuacuguauguugcu

SEQ ID NO: 360482 - RNA, 64 nt, Human
aucaugcuguugcgccuggcacgcccagccaaacucucugaacucauccagccccuuccccugg

SEQ ID NO: 360483 - RNA, 64 nt, Human
cccugcugugugacuuugggcaagccaagugcccucucugaaccucaguuuccucaucugcaaa

SEQ ID NO: 360484 - RNA, 64 nt, Human
cacacacacacacacacacacagucaaauacuguucucugaaaaaugaugucccaaaaguauua

SEQ ID NO: 360485 - RNA, 64 nt, Human
aaaucaaagcugaggacagggugugagcgccacaucucugaaagcacaggagacacugugcuau

SEQ ID NO: 360486 - RNA, 64 nt, Human; identical to SEQ ID NO: 64445

SEQ ID NO: 360487 - RNA, 64 nt, Human; identical to SEQ ID NO: 64446

SEQ ID NO: 360488 - RNA, 64 nt, Human; identical to SEQ ID NO: 64447

SEQ ID NO: 360489 - RNA, 64 nt, Human; identical to SEQ ID NO: 64448

SEQ ID NO: 360490 - RNA, 64 nt, Human
aguggaucuauuuuagaugagcccagguaagaccucucugaagagcugucaugaaggagggagg

SEQ ID NO: 360491 - RNA, 64 nt, Human
aaaguaaaugaaucccaccuuuacuaaaacacuuucucugaaccccccuugccccucacugauc

SEQ ID NO: 360492 - RNA, 64 nt, Human
uugguccauguguuggguuuggccuuaguagaaaucucugaaggcagcagccaucauccucuuc

SEQ ID NO: 360493 - RNA, 64 nt, Human
agaauuucacacauuuagccaaucuuucuagaugucucugaagguaagaucauuuaauaucuuu

SEQ ID NO: 360494 - RNA, 64 nt, Human
gauuuucuauuguagauacuuugucccuugcacuucucugaaucuguccuuuuguggauucuug

SEQ ID NO: 360495 - RNA, 64 nt, Human
uuaagcuuuuuuuuuuugaaccccauucuuuccuucucugaaaguggugcuauaaguuuuagaa

SEQ ID NO: 360496 - RNA, 64 nt, Human
ggauguggacauuuugguugcagcuaaaaaucagucucugaagucucucucccuucuagagguu

SEQ ID NO: 360497 - RNA, 64 nt, Human
cugauugcucucacagcccaggcccaucgucuguucucugaaugcagcccuguucucaacaaca

SEQ ID NO: 360498 - RNA, 64 nt, Human
cgucuugucagauuucaucuguauaccuucaaauucucugaaaguaaaaauaaaaguuuuuaaa

SEQ ID NO: 360499 - RNA, 64 nt, Human
ucagugauucccauugguguaggaaaugagacccucucugaagcugaggagagcacguugaucu

SEQ ID NO: 360500 - RNA, 64 nt, Human
uagagguuugucuacccacagugucauggaaucuucucugaaaacuaauccauaaaguucccug

SEQ ID NO: 360501 - RNA, 64 nt, Human
guaagccucugcaauuuuaacuucucaaaggaugucucugaaaagaaucacuuuaaaccaaugc

SEQ ID NO: 360502 - RNA, 64 nt, Human
acccucguaggugcgaggucagaagccagcaggcucucugaacuccugccaggcaguccccaca

SEQ ID NO: 360503 - RNA, 64 nt, Human
ccucggccgaggccugcgcccugacaugcuaaccucucugaacugcaacacuggauuguucuuu

SEQ ID NO: 360504 - RNA, 64 nt, Human
ccuuuauuuauucuguucccccagcucggccacuucucugaaggagggcuggguucugggccug

SEQ ID NO: 360505 - RNA, 64 nt, Human
ugagcccacgguccccucagcagggaugcgauggucucugaaucagugugcagcugggguccca

SEQ ID NO: 360506 - RNA, 63 nt, Human
ggggugagguggggacaggccucagcagggaauggggcguauauguuaguguugcugcaacaa

SEQ ID NO: 360507 - RNA, 63 nt, Human
ugacuuccgucggcugugaauccuugucugucaggggcguauccacaaaaucaccgaauucau

SEQ ID NO: 360508 - RNA, 64 nt, Human
uguaguacauucuccaagaugcagcccaggagccucucugaaggaccagucugguuacgauggu

SEQ ID NO: 360509 - RNA, 64 nt, Human
gucucaauuuaaaacaagagagaaccagacugagucucugaagaccacagggacagggucucuu

SEQ ID NO: 360510 - RNA, 64 nt, Human
cagggcuugguuuuuccuuguugugaaaucgacaucucugaagacagguuauuuuauaaaagau

SEQ ID NO: 360511 - RNA, 64 nt, Human
ugugggaaggaaaauauugagcuaggcacauuacucucugaacgaaauucauauuaucuuauua

SEQ ID NO: 360512 - RNA, 64 nt, Human
uuuuuaaaaaggauauaggaaccugcauugucauucucugaauuaagaacugaugguuucuauc

SEQ ID NO: 360513 - RNA, 64 nt, Human
aaguucauccaacgugaagauaccauaagcuuuuucucugaaccagagaaaugaaagucaguuu

SEQ ID NO: 360514 - RNA, 63 nt, Human
aaauuugaaaauucucucaauaaaguuugaguuuucucugaagaagucaugcgugucuuuugu

SEQ ID NO: 360515 - RNA, 64 nt, Human
ucugaucauuuuauccauaaauauucuuuauauaucucugaaagcuaugggaugauauggaaaa

SEQ ID NO: 360516 - RNA, 64 nt, Human
gaaauggcucuguauaaucuauggcuauccgaauucucugaaaaaauaauaaaaguccccucua

SEQ ID NO: 360517 - RNA, 64 nt, Human
aggaaugagguugugaucuuuccuguccugacccucucugaauuauguuucaauaguacucuug

SEQ ID NO: 360518 - RNA, 64 nt, Human
uacagcucuccgucugugucccacccaugcagacucucugaauaaccuagccaauaucaaacga

SEQ ID NO: 360519 - RNA, 64 nt, Human
uuacauaaaugaagaugcuugugauuccaguuuaucucugaaacuauucaacauggaguuauuu

SEQ ID NO: 360520 - RNA, 64 nt, Human
auuuagauuaaaaaugagguagguugaaguuucuucucugaaaugauagauaaauggugaagau

SEQ ID NO: 360521 - RNA, 64 nt, Human
acagggagcucucauagauacuaguugaaaaaagucucugaacaauucucucuaauacauauuu

SEQ ID NO: 360522 - RNA, 64 nt, Human
uguguuucacaaaauuaaguguuguucauuauacucucugaaauauagguuuaauuucaaauag

SEQ ID NO: 360523 - RNA, 64 nt, Human
ugcauuccagccugggugacagagugagauccugucucugaagaaaaaaaaaaccugccuggca

SEQ ID NO: 360524 - RNA, 64 nt, Human; identical to SEQ ID NO: 277304

SEQ ID NO: 360525 - RNA, 64 nt, Human; identical to SEQ ID NO: 277305

SEQ ID NO: 360526 - RNA, 57 nt, Human; identical to SEQ ID NO: 277306

SEQ ID NO: 360527 - RNA, 64 nt, Human; identical to SEQ ID NO: 277307

SEQ ID NO: 360528 - RNA, 64 nt, Human
agucccugagcccaccucccagcccucuccucauucucugaacccacuguggugagaagaauuu

SEQ ID NO: 360529 - RNA, 64 nt, Human
agaaauuuguacuaccuaaaagucccagugcaugucucugaauguguaagcuauauaaaugcua

SEQ ID NO: 360530 - RNA, 64 nt, Human
uaaauaagugguagaagagugucacugaauuuugucucugaauucaguauaacugaguuuuguc

SEQ ID NO: 360531 - RNA, 64 nt, Human
ugucuuucuucccgccucuccagguugacagccuucucugaacgaccucuccauuacucucaug

SEQ ID NO: 360532 - RNA, 64 nt, Human
ucaguggacacucuuuuuuccuaauuauaacucaucucugaaugcauugugccaaucaagagua

SEQ ID NO: 360533 - RNA, 64 nt, Human
ucagcuucuuacacuacuauauuugcuuauuuugucucugaauaagcuuuaggcaccacaaggg

SEQ ID NO: 360534 - RNA, 64 nt, Human
guagugagaagcuguugucacgacuaaccuucugucucugaaauuguuuguuucaaauaaagag

SEQ ID NO: 360535 - RNA, 64 nt, Human
uaaucagaaauauuuuuaaaaaauacaauuuagaucucugaaaauuggaaccacucaagaguau

SEQ ID NO: 360536 - RNA, 64 nt, Human
agucuucagcacccucccauguaccuuauaucccucucugaaacagaacagcuccaauagcaac

SEQ ID NO: 360537 - RNA, 64 nt, Human
gucaccacuaucuggagauuucgacguguuuuccucucugaaucuguuaugaacacguugguug

SEQ ID NO: 360538 - RNA, 64 nt, Human
cauuuuggcgcugcuucucauucauuuuaaggcuucucugaauugugcucauuccaaauuaacc

SEQ ID NO: 360539 - RNA, 64 nt, Human
gcacuccaaccuagguaacagagagacaccucugucucugaaaaaacaaaacuugaaguuugaa

SEQ ID NO: 360540 - RNA, 64 nt, Human
uggguggagaaaggaguuucuuuagcugacagaaucucugaauuuuaaaucacuuaguaagcgg

SEQ ID NO: 360541 - RNA, 63 nt, Human
gaaacguuuauauccugugauuacucuaggaaaggggcguauuaacgguccuuugcuuccccg

SEQ ID NO: 360542 - RNA, 63 nt, Human
uuaaggaaaaaagcaaguuugaagagaccacauggggcguacuauuuuuauugagcccaaaaa

SEQ ID NO: 360543 - RNA, 63 nt, Human
guucagcggggcagcuugucucccuugucagcaggggcguaagggcuggguuuggccauacaa

SEQ ID NO: 360544 - RNA, 63 nt, Human
uguguaagugaaaucaguugugugcaauagacaggggcguauucaugggagcaucagccaguu

SEQ ID NO: 360545 - RNA, 63 nt, Human
ugaugggaggagagacgaggcauucgggccgguggggcguaaggguuaucguuaagcacaaga

SEQ ID NO: 360546 - RNA, 63 nt, Human
cuuuggcuucuccugugaccccaccuugacgguggggcguagacuugacaacaucccacagug

SEQ ID NO: 360547 - RNA, 63 nt, Human
ucccaagauggagaugcuaacgaaacugagaagggggcguauguuugacgaagguuugugcaa

SEQ ID NO: 360548 - RNA, 64 nt, Human
cucagcugcugggccccaccuccccacugcacccagggggcaacuccaccuggacugaugggca

SEQ ID NO: 360549 - RNA, 64 nt, Human
cucuggcccugggagggcagcuuggagcccagguagggggcagagcuguccucagcugcacugc

SEQ ID NO: 360550 - RNA, 64 nt, Human
uccacuucccucagaugaugaggagccagggcuaagggggcagccuucucucuucccagugaug

SEQ ID NO: 360551 - RNA, 64 nt, Human
ugaccuuugccccuaacacgaggaacucguuugaagggggcagcguagcaugucugauuugcca

SEQ ID NO: 360552 - RNA, 64 nt, Human
auaauugcuagguugaaguucaacauguaaaaaaagggggcauggauuuacauugcaaaaggug

SEQ ID NO: 360553 - RNA, 64 nt, Human
uuugagugucagaagcacucugagccaaggggacagggggcacgugcacuggucacgagaaaac

SEQ ID NO: 360554 - RNA, 64 nt, Human
ugauggcugccaacucccaaucucccaggaaggcagggggcagaaucuuuuuuucacuuggccu

SEQ ID NO: 360555 - RNA, 64 nt, Human
caaaugaaaaucaaauguggggggaaaacacuaaagggggcaagaaacaaaggaauuacaaacc

SEQ ID NO: 360556 - RNA, 64 nt, Human
uccccuagggccuggaagggugggagguaugucuagggggcagugucucuuccagggggaauuc

SEQ ID NO: 360557 - RNA, 64 nt, Human
caggggaggggaaaccuuuuucauucaacauuguagggggcaagcuuuggugcgcccccugcug

SEQ ID NO: 360558 - RNA, 51 nt, Human
uugaaagcacugcauguuaagagggggcacagcccuccucccaagggaaag

SEQ ID NO: 360559 - RNA, 64 nt, Human
ucacagcacugaucacacugagauggaagacuccagggggcaaggaccaagggccauaucccaa

SEQ ID NO: 360560 - RNA, 64 nt, Human
ccucucccaggaacuggaaaagcccuguccggugagggggcagaaggacucagcgccccuggac

SEQ ID NO: 360561 - RNA, 64 nt, Human
acuucucauuuuccuguuuacacuggggauuuggagggggcaggcaaagucaaagugaaugacc

SEQ ID NO: 360562 - RNA, 64 nt, Human
caucagaccacucccuucccccauccuccaggagagggggcaagggcaacccaccaucuaccca

SEQ ID NO: 360563 - RNA, 55 nt, Human; identical to SEQ ID NO: 277308

SEQ ID NO: 360564 - RNA, 64 nt, Human; identical to SEQ ID NO: 277309

SEQ ID NO: 360565 - RNA, 64 nt, Human; identical to SEQ ID NO: 277311

SEQ ID NO: 360566 - RNA, 64 nt, Human; identical to SEQ ID NO: 277312

SEQ ID NO: 360567 - RNA, 64 nt, Human
cccaaagcccaugcuccgacagguggcccuucacagggggcagcgggacaggcaucuugaaggg

SEQ ID NO: 360568 - RNA, 64 nt, Human
acggaugcgugcgagcugaggacagggcgggaggagggggcacacaugccccaggggagcgagg

SEQ ID NO: 360569 - RNA, 64 nt, Human
gguaaaguguaacucagacugaccuguggggcacagggggcaccagcuggccuugcccucucug

SEQ ID NO: 360570 - RNA, 64 nt, Human
agaguccaggccuugccucccccgaccgccauggagggggcagcccggcacagcugcugggagc

SEQ ID NO: 360571 - RNA, 64 nt, Human
gcccggccgucugucucuugguauuggguaaaggagggggcaccugcaugucuccugcaaugag

SEQ ID NO: 360572 - RNA, 64 nt, Human
uccaauuuuauauuuaagggggguggugggugggagggggcaaguaaagacggaacaaguuuag

SEQ ID NO: 360573 - RNA, 64 nt, Human
uaaauaacccccgucaguggaguguucgggaugcagggggcacuauaguguucuuggacuuguc

SEQ ID NO: 360574 - RNA, 64 nt, Human
uccaagaguucaucaggacccccaagagugagugagggggcaaggcucuggcacaaaaccuccu

SEQ ID NO: 360575 - RNA, 64 nt, Human
cuggccauccccagaggugacccaaugcuccuggagggggcaagccuguauagacagcacuugg

SEQ ID NO: 360576 - RNA, 64 nt, Human
ccaccgagagccccgccuccagcagccguuccccagggggcaggaaguaggcuccccugagcac

SEQ ID NO: 360577 - RNA, 64 nt, Human
uguggcccaaaugguggaccagaaugauggugggagggggcaacccccaguagcuuugccugcu

SEQ ID NO: 360578 - RNA, 64 nt, Human
ggcaaaggaaccacccuacccauuuggccucuggagggggcagaagaaagaaauaaaccucauc

SEQ ID NO: 360579 - RNA, 64 nt, Human
cugacagcccaacaccaccuuccuccuggcuuccagggggcagcccaguggaauggaaagaaug

SEQ ID NO: 360580 - RNA, 64 nt, Human
aaagcagccuucuguacaacagaugggagggugaagggggcagaaugaaaaucgaaccaaccuu

SEQ ID NO: 360581 - RNA, 64 nt, Human
cauauguugggauacugugggcucuggagagaggagggggcaauagagcuaggaauuaagaauc

SEQ ID NO: 360582 - RNA, 64 nt, Human; identical to SEQ ID NO: 277315

SEQ ID NO: 360583 - RNA, 64 nt, Human; identical to SEQ ID NO: 277316

SEQ ID NO: 360584 - RNA, 64 nt, Human; identical to SEQ ID NO: 277317

SEQ ID NO: 360585 - RNA, 62 nt, Human; identical to SEQ ID NO: 277318

SEQ ID NO: 360586 - RNA, 64 nt, Human
cucccagcaugccaugcagucaucuuccccuccaagggggcagaaauuccaccagaaaucacca

SEQ ID NO: 360587 - RNA, 64 nt, Human
ccuaguggggaauccaauauuaugaauaugaaaaagggggcaauaaaaggguauguaaaauaug

SEQ ID NO: 360588 - RNA, 64 nt, Human
caaaaaugucucuauacauugccagauuucuccuagggggcaaaaucgccuccauuugagaacc

SEQ ID NO: 360589 - RNA, 64 nt, Human
aacaugugagggaggguaaaggggcuuagggaaaagggggcauaccaggugggguauuugguuu

SEQ ID NO: 360590 - RNA, 64 nt, Human
caacagugaggccccaucccugacccuguccuggagggggcagaggccaggccccagugcugac

SEQ ID NO: 360591 - RNA, 64 nt, Human
cugagaccucaggcaggauuggagaucaaaccagagggggcaggcccccagccugcucucuagg

SEQ ID NO: 360592 - RNA, 64 nt, Human
gaggagagggcugaggagggcagaagggcuaggcagggggcaaauugagccccucccuucccca

SEQ ID NO: 360593 - RNA, 64 nt, Human
guaauagcaugaacagucagaaaaauaccuuaugagggggcagggcugaagcugggccuugaag

SEQ ID NO: 360594 - RNA, 64 nt, Human
agagaauggauccucauaggucagggagugggggagggggcaaaugagccuuaagaaaugguuu

SEQ ID NO: 360595 - RNA, 64 nt, Human
cauuugaugcugcaggggccuuucaggaucugggagggggcagucuggagagaaggagggagac

SEQ ID NO: 360596 - RNA, 64 nt, Human
ggaccagagcgcccccucguguaugccccagcucagggggcaaacucaggagcuuccuuuuuau

SEQ ID NO: 360597 - RNA, 64 nt, Human
cugggaggaaggcuuuuccuucacaauuguauacagggggcaccuguggccaggccuccuccug

SEQ ID NO: 360598 - RNA, 64 nt, Human
ucaugucccccagauuccaacauuucucacugaaagggggcauguaugcaaaccucaucuuucu

SEQ ID NO: 360599 - RNA, 64 nt, Human
aggaaugccagaugugcacgguuuuuggcaaaguagggggcacauuuccauuauagcaauguua

SEQ ID NO: 360600 - RNA, 64 nt, Human
aggccugcggcugcagguagcgcgagggccggggagggggcagccacgcggccgaggaucccca

SEQ ID NO: 360601 - RNA, 64 nt, Human
acaaacaggaguuuccagggagaaugggaaagccagggggcauaaaagguacagucaggggaaa

SEQ ID NO: 360602 - RNA, 64 nt, Human; identical to SEQ ID NO: 277293

SEQ ID NO: 360603 - RNA, 64 nt, Human; identical to SEQ ID NO: 277294

SEQ ID NO: 360604 - RNA, 64 nt, Human; identical to SEQ ID NO: 277313

SEQ ID NO: 360605 - RNA, 64 nt, Human
gaacucagaggaagaggcaggggcagcagccgacagggggcagcaugacccaagcaaggggccu

SEQ ID NO: 360606 - RNA, 64 nt, Human
ugccauuauuaugcagccagcgguucucuuguggagggggcaggugacguuucagaagacaccg

SEQ ID NO: 360607 - RNA, 64 nt, Human
caucagcuguggcccacagagagccuugcugagaagggggcagguaaagcagagauuuuagcau

SEQ ID NO: 360608 - RNA, 64 nt, Human
uuucccugcuccuggugcccugaagagaccagcaagggggcagaccccgcacucgccacaccgc

SEQ ID NO: 360609 - RNA, 64 nt, Human
uccucuugacaggcggacagggggugagggggccagggggcaucuccaaaggaagcuuuuaaac

SEQ ID NO: 360610 - RNA, 64 nt, Human
cccagcaccaagcuugagcugugucguuucguggagggggcagcgaggaugggcuugagcuguu

SEQ ID NO: 360611 - RNA, 64 nt, Human
ccggucugaggccggucagaggccaggauuggagagggggcaccgcguuccagggcccagugcu

SEQ ID NO: 360612 - RNA, 64 nt, Human
aacaauauaggcuucaagaagggcugguccuaagagggggcagaaaugaaugaccagguuaaau

SEQ ID NO: 360613 - RNA, 64 nt, Human
agaacaccuuucaccaccugucaguaaacgggggagggggcaaaagaccaugcuauaaaaagaa

SEQ ID NO: 360614 - RNA, 64 nt, Human
caccagccccaccccuagagucccuucuauagggagggggcaggagaccuuccagacuucggcu

SEQ ID NO: 360615 - RNA, 64 nt, Human
uccugaaacuucagacccuggguaggggaagagaagggggcaugugguauccuggagcauugug

SEQ ID NO: 360616 - RNA, 64 nt, Human
gaugauugugaaggaggccccuccccuugugaggagggggcacuccucuccagccccugguacc

SEQ ID NO: 360617 - RNA, 64 nt, Human
gccccccuggcuggaggccaccgccacccuaggaagggggcagggacgugaccuugacuuaccu

SEQ ID NO: 360618 - RNA, 64 nt, Human
gccccagauuguaccuccugcccuguaggaggggagggggcaaagccuucugacuucaccuuug

SEQ ID NO: 360619 - RNA, 64 nt, Human
uugcugggcauuaaugaagucaagggagaacagcagggggcaaguuggucugugugaauuaugg

SEQ ID NO: 360620 - RNA, 64 nt, Human; identical to SEQ ID NO: 277319

SEQ ID NO: 360621 - RNA, 64 nt, Human; identical to SEQ ID NO: 277320

SEQ ID NO: 360622 - RNA, 64 nt, Human; identical to SEQ ID NO: 277322

SEQ ID NO: 360623 - RNA, 64 nt, Human; identical to SEQ ID NO: 277323

SEQ ID NO: 360624 - RNA, 64 nt, Human
ucccaagggacuguucuuguggcccuuaaugggaagggggcaggggugaggagcugagccugcu

SEQ ID NO: 360625 - RNA, 64 nt, Human
cucaggggccuucccuggggguggccagccugguagggggcagagaaggaaaagcugagggggg

SEQ ID NO: 360626 - RNA, 64 nt, Human
gacaagcccacugggucugguccaggugaggggcagggggcauggggcugggaggucucagggg

SEQ ID NO: 360627 - RNA, 64 nt, Human
ugggcauguccccaguguggacucuggacugggaagggggcaggccccuuuggaccugcaguug

SEQ ID NO: 360628 - RNA, 64 nt, Human
uuguuuguuuuauucauuggucuaauuuauucaaagggggcaagaaguagcagugucuguaaaa

SEQ ID NO: 360629 - RNA, 64 nt, Human
caaaggaacuggaaugauaauggaaacugucaagagggggcaagucacaugggcagagauagcc

SEQ ID NO: 360630 - RNA, 64 nt, Human
gcaguucuuucacugaccuccuaauuuuagguggagggggcagggggagccauaaaaguuggua

SEQ ID NO: 360631 - RNA, 64 nt, Human
aauugaccccccgagguggucuuuuguuuuaaacagggggcaacagcuggaucuccaaguacau

SEQ ID NO: 360632 - RNA, 64 nt, Human
guagaagaguuguuggggaaggagggagcugaggagggggcaucucccaacuucucccuuuugg

SEQ ID NO: 360633 - RNA, 64 nt, Human
uguuccaacaggagauggcccgccuugcccgagaagggggcaccgacucacagcccgagugggc

SEQ ID NO: 360634 - RNA, 64 nt, Human
cucagcacagggagaauguugacuuagaagcaauagggggcagcaggccaccaagagcacaacc

SEQ ID NO: 360635 - RNA, 64 nt, Human
ccuguguggcccccacauaaauaaauuaguggggagggggcagaccugggggcccuugggugcc

SEQ ID NO: 360636 - RNA, 64 nt, Human
auucccuggcauaaaaagugcucaaacacaccagagggggcaggcaccagccaggguaugaugg

SEQ ID NO: 360637 - RNA, 64 nt, Human
aaaccccacuuuccuccacuuagcaccauaggcaagggggcagaucccagagccccucucaccc

SEQ ID NO: 360638 - RNA, 64 nt, Human
ugggcugauguguggcucucauauaccuucugcaagggggcagucuccccagcucccugaugau

SEQ ID NO: 360639 - RNA, 64 nt, Human
uccugacucuagaaggccccccacagcagggcguagggggcaucacccugcucacucucaguga

SEQ ID NO: 360640 - RNA, 64 nt, Human; identical to SEQ ID NO: 277349

SEQ ID NO: 360641 - RNA, 64 nt, Human; identical to SEQ ID NO: 277350

SEQ ID NO: 360642 - RNA, 64 nt, Human; identical to SEQ ID NO: 277355

SEQ ID NO: 360643 - RNA, 64 nt, Human
cuguguuuguggaucagagaaggcuuuauagcacagggggcauucagaugagucuuagaggaag

SEQ ID NO: 360644 - RNA, 64 nt, Human
cugucggagggcuggacauuuguggcagugcugaagggggcauugccggcgaguaaaguauuau

SEQ ID NO: 360645 - RNA, 64 nt, Human
cuuagaggggaaugaaccauggcaccuuugagagagggggcacuguggucaggcccagccucuc

SEQ ID NO: 360646 - RNA, 64 nt, Human
ugacccaugaccucuguucugugaggaaccagggagggggcacugcuacaaugcauugaaugca

SEQ ID NO: 360647 - RNA, 64 nt, Human
gaacuggcugggcuugucagggggcaccccaaagagggggcacugccagguagcugggggagug

SEQ ID NO: 360648 - RNA, 64 nt, Human
cccuuuugacuggaaugaacuggcugggcuugucagggggcaccccaaagagggggcacugcca

SEQ ID NO: 360649 - RNA, 51 nt, Human
gggagguggaggccacguagaagggggcagaggagggguggucaggauggg

SEQ ID NO: 360650 - RNA, 64 nt, Human
ggaacagguggggucaggggccagagugcaggggagggggcaaugguggagguggcggggggaa

SEQ ID NO: 360651 - RNA, 64 nt, Human
uucugaaggcuucacucagguguggcugugacugagggggcagaggcaguggcucuuuagaagg

SEQ ID NO: 360652 - RNA, 64 nt, Human
auaaugauuugcaugauaccuugaaauuggggggagggggcaugccaaguugggcaucacuuug

SEQ ID NO: 360653 - RNA, 64 nt, Human
cacgcccuguucccuccaccuagacugccugcugagggggcagugccaggagguugccuguccu

SEQ ID NO: 360654 - RNA, 64 nt, Human
gacuucuccaggaccuagucgggggguggcugccagggggcaaggagaaagcaccgacaaucuu

SEQ ID NO: 360655 - RNA, 64 nt, Human
caaguagauucuuacgaacuccaacuugcaauucagggggcaugucccaguguuuuuuuuguug

SEQ ID NO: 360656 - RNA, 64 nt, Human
aaauguacucugugucuuuuccuuuagaguggggagggggcauaaucguuucgguuucugcauu

SEQ ID NO: 360657 - RNA, 64 nt, Human
cugcagagacugguccgggcugucaggaggcgggagggggcagcgcugggccucgugucgcuug

SEQ ID NO: 360658 - RNA, 64 nt, Human
acaacucuggcacagaaccugcccugcaggcuguagggggcauggugccuggagcugaggggca

SEQ ID NO: 360659 - RNA, 64 nt, Human; identical to SEQ ID NO: 277289

SEQ ID NO: 360660 - RNA, 64 nt, Human; identical to SEQ ID NO: 277290

SEQ ID NO: 360661 - RNA, 64 nt, Human; identical to SEQ ID NO: 277327

SEQ ID NO: 360662 - RNA, 64 nt, Human
gcugaaaauuuuaacagucuucuuaaaaguauugagggggcaaaaauuaccaauuaugguauac

SEQ ID NO: 360663 - RNA, 64 nt, Human
cuaaaggcguauaacgguggugccuaucuacuuaagggggcauucuagucuuaacuuaaaaguu

SEQ ID NO: 360664 - RNA, 64 nt, Human
guaccccaaauuccuaggauggcaucugcccuucagggggcacuaaaauguauuauugaaacag

SEQ ID NO: 360665 - RNA, 64 nt, Human
ccauacuggacaagacauuuuggacaugaguucaagggggcagguuaauuccuggcauugccag

SEQ ID NO: 360666 - RNA, 64 nt, Human
uuuaaguagcaugagccaugucccuguagucgguagggggcagucuugcuuuauucauccucca

SEQ ID NO: 360667 - RNA, 64 nt, Human
cuugcaaagccguuuucucaugaguacccugaauagggggcacucauuuuguuucaacggucca

SEQ ID NO: 360668 - RNA, 64 nt, Human
cucuggauugagagggaggcccugggaggagagaagggggcagagucuucccuaccagguuucu

SEQ ID NO: 360669 - RNA, 64 nt, Human
gaaugauauggacuuagugaauucuaaggaacucagggggcacguggucaggcuccaccgcaca

SEQ ID NO: 360670 - RNA, 64 nt, Human
cccucuagacaucuaguaugcugaaaacugucagagggggcaagaagaguuacuuugaguuaua

SEQ ID NO: 360671 - RNA, 64 nt, Human
uagaacuucaagcaucuugaggagcgggcauuugagggggcauggaguaauuuguauuuaaaaa

SEQ ID NO: 360672 - RNA, 64 nt, Human
uggacgccauaauccugaggccuccuagaggcugagggggcaacggugugauccagcuggcuca

SEQ ID NO: 360673 - RNA, 64 nt, Human
gggggcuggcuaggaccuggggcuguggccucucagggggcagccucuccauggcaggcauccc

SEQ ID NO: 360674 - RNA, 64 nt, Human
gggccugguccccacagcccacaggauggaccaaagggggcaggaugcugauccucccgcuggc

SEQ ID NO: 360675 - RNA, 64 nt, Human
uaucaaacugguuaggaaagcccagggggaagggagggggcaggggaggaggcaauucugaaug

SEQ ID NO: 360676 - RNA, 64 nt, Human
ccauugugcaggcagcugccggaggggugccaggagggggcagcaacaacggcaagacucccgu

SEQ ID NO: 360677 - RNA, 64 nt, Human; identical to SEQ ID NO: 277328

SEQ ID NO: 360678 - RNA, 64 nt, Human; identical to SEQ ID NO: 277329

SEQ ID NO: 360679 - RNA, 64 nt, Human; identical to SEQ ID NO: 277331

SEQ ID NO: 360680 - RNA, 64 nt, Human; identical to SEQ ID NO: 277332

SEQ ID NO: 360681 - RNA, 64 nt, Human
ccuagcaguuuauaguucugagauggaaaguugaagggggcaagcaagaccucuccucagccca

SEQ ID NO: 360682 - RNA, 64 nt, Human
ucuuuaaguauaaacuugauguaauugguuugggagggggcagugaugaugacuucugaaacaa

SEQ ID NO: 360683 - RNA, 64 nt, Human
aaugucaaagccaguccugcuguucucuguugccagggggcaggucugggccugggccaaccac

SEQ ID NO: 360684 - RNA, 64 nt, Human
aagcgauggccgcucucuccucuccccuccucagagggggcagauagaaacugggacggauuca

SEQ ID NO: 360685 - RNA, 64 nt, Human
ugucaccuuauugggggaaaaaugccugaaaauuagggggcacuucaaguagauagcuucuauu

SEQ ID NO: 360686 - RNA, 64 nt, Human
auggcucugugcaguaccugguugaguggggaggagggggcaucuucugaacagccugccucug

SEQ ID NO: 360687 - RNA, 64 nt, Human
gacaaccuaggggcagggcugggguggggaccgcagggggcagccagggcuggggaacacugug

SEQ ID NO: 360688 - RNA, 64 nt, Human
ggggacccagggaacaucggucuacucaggugugagggggcaggucugaccugccccaaaguug

SEQ ID NO: 360689 - RNA, 64 nt, Human
acaugccuucccuccccagccacaccgugcacgaagggggcacaggagaggagaggggcugugc

SEQ ID NO: 360690 - RNA, 64 nt, Human
uaggaagacaccuauuccacagagacugauuuauagggggcagcacuuuauuuuuuucuggaaa

SEQ ID NO: 360691 - RNA, 64 nt, Human
cugcacugaaaacucacugcugccaugcccugggagggggcaaacuggggguugccacaggccg

SEQ ID NO: 360692 - RNA, 64 nt, Human
cugucucuguguacugguagaggcugggaggaguagggggcagccuguuccauuucugauagug

SEQ ID NO: 360693 - RNA, 64 nt, Human
ccgcauggguagaguucugccucugguccuucucagggggcacuuucaccaagagcaguguaau

SEQ ID NO: 360694 - RNA, 64 nt, Human
ccaggauaaaguggcaccuucuggaguacacuggagggggcagcccaaguuagaggccagcauu

SEQ ID NO: 360695 - RNA, 64 nt, Human
ucccucuucaccuccccaccccccaaaaaauaaaagggggcauaaacuuuauuccacuggagaa

SEQ ID NO: 360696 - RNA, 64 nt, Human; identical to SEQ ID NO: 277336

SEQ ID NO: 360697 - RNA, 64 nt, Human; identical to SEQ ID NO: 277337

SEQ ID NO: 360698 - RNA, 64 nt, Human; identical to SEQ ID NO: 277338

SEQ ID NO: 360699 - RNA, 64 nt, Human; identical to SEQ ID NO: 277339

SEQ ID NO: 360700 - RNA, 64 nt, Human
cuaagaacaggaauccucuuggugggggccgagcagggggcaaggagcccaggcccccucccug

SEQ ID NO: 360701 - RNA, 64 nt, Human
uuaguaagagaagucugucugucugaugauggauagggggcaaaucuuuuuccccuuucuguua

SEQ ID NO: 360702 - RNA, 64 nt, Human
ugaggcagcccccuggaccccagaaccccagacaagggggcaggcgggggaccagggccucucc

SEQ ID NO: 360703 - RNA, 64 nt, Human
ccaaauagaaggggucuggcccgggcauccacguagggggcaggggcaggggcgggcggaggga

SEQ ID NO: 360704 - RNA, 64 nt, Human
uuggagggggaagagaucccaggaggugcaguggagggggcaagcuuugcuccuucaguucugc

SEQ ID NO: 360705 - RNA, 64 nt, Human
gcaaaccuaccccggaucucuggcuucagccgccagggggcaguggcagcccuggggcccuuuc

SEQ ID NO: 360706 - RNA, 64 nt, Human
cccuuccaccuuuccccgagaccgucgucgcuggagggggcaggguccagcccgccuggaucgg

SEQ ID NO: 360707 - RNA, 64 nt, Human
cugggcaggaagaguccucagucccaagaccaggagggggcaaugggcccagccuuucuguggu

SEQ ID NO: 360708 - RNA, 64 nt, Human
cccuuaauaccuacacucuccaauuguaagagaaagggggcagggaagcaauauagcuuccauu

SEQ ID NO: 360709 - RNA, 64 nt, Human
ggacuacugaggggcuggccagucagggagggcuagggggcagguggggaggggaagccaugga

SEQ ID NO: 360710 - RNA, 64 nt, Human
cuucagggugaggcugcuggcgagggcaggggagagggggcauucugguuaaaagcaagaaauu

SEQ ID NO: 360711 - RNA, 64 nt, Human
aaggggcccccugugaccgaggagcaggguccccagggggcagcucccacggagcgggcuugaa

SEQ ID NO: 360712 - RNA, 64 nt, Human
ugcccccgacccccugccacaggccggaagccgcagggggcaccguggggaagcuaacccggcc

SEQ ID NO: 360713 - RNA, 64 nt, Human
ucccuugccagcuccagagugggggggcugucccagggggcaagaaggggugucagggcccagu

SEQ ID NO: 360714 - RNA, 64 nt, Human
aaacauccuuaaagagguagggugugggcugcugagggggcaagagggauagacugaaucuguc

SEQ ID NO: 360715 - RNA, 64 nt, Human
gcugcuuggaauaaaaaaugcagcuggcccugaguacagggaaguggaacauaggcaggauuuu

SEQ ID NO: 360716 - RNA, 64 nt, Human
gaagugugagcacgggccuggcuggcacccgguuuacagggaggugauugaggacgucguuaug

SEQ ID NO: 360717 - RNA, 64 nt, Human; identical to SEQ ID NO: 277324

SEQ ID NO: 360718 - RNA, 64 nt, Human; identical to SEQ ID NO: 277325

SEQ ID NO: 360719 - RNA, 64 nt, Human
augucaugcagccgcuccugccagaauccccggaagggggcaaugccagugccuggacccacca

SEQ ID NO: 360720 - RNA, 64 nt, Human
ucuggggagaguguaaguggacagaguccuggucagggggcaggagugucccaagggcuggccc

SEQ ID NO: 360721 - RNA, 64 nt, Human
uuccccagggaauaggggugugaguacacucacuagggggcagggcgcugcugguuccuggggg

SEQ ID NO: 360722 - RNA, 60 nt, Human
ggccccagccccucacguagucugggaggcagggggcagcagccccugggccgccucccc

SEQ ID NO: 360723 - RNA, 64 nt, Human
cuaccccuagugcuagucccagaggaugcugcggagggggcagccucagcucucuuuucagaga

SEQ ID NO: 360724 - RNA, 64 nt, Human
uggcucuaggcuugggacugcggcugccacaggaagggggcaucccccuacuuuggguguuggg

SEQ ID NO: 360725 - RNA, 64 nt, Human
ggccaguuccucccaucuucaggcccagccaggcagggggcagucggcuccucaacugggugac

SEQ ID NO: 360726 - RNA, 64 nt, Human
cugggggugucagacaggcuacccugugccagggagggggcagaaugggccugcagcuuccugc

SEQ ID NO: 360727 - RNA, 64 nt, Human
cagcuaagccucucuucaucuggaagaagaggcaagggggcaggagaccaggcucuagcucugg

SEQ ID NO: 360728 - RNA, 64 nt, Human
ugccccgggcacugcguccagcagcagaggggacagggggcaggugugugacuggguuccuggg

SEQ ID NO: 360729 - RNA, 64 nt, Human
agggggaugggcuggcuguggccagguuuagggcagggggcauuuguccccuccaugcuauaau

SEQ ID NO: 360730 - RNA, 64 nt, Human
ccugggcaaugcagugcagcaugggaaaggaauaagggggcaacaaggugcacagaccucagag

SEQ ID NO: 360731 - RNA, 64 nt, Human
gcuacagccaggccggcugccucaucucagcucuagggggcacgagccauauggggucugcaca

SEQ ID NO: 360732 - RNA, 64 nt, Human
cuacugcuccuucuccccuugcacagggaaaugcagggggcaggacuugggagguuccagcagg

SEQ ID NO: 360733 - RNA, 64 nt, Human
cccugcccaccugccucccugcccccugugacggagggggcaagcaagcccccagaggcugugu

SEQ ID NO: 360734 - RNA, 64 nt, Human
ugaagcaaaguaucuaaaaggaccaugucuaggcuacagggaaagagaauuauuugaugcaaaa

SEQ ID NO: 360735 - RNA, 64 nt, Human
aggggauaugaaacaaucuguagauugguuuccauacagggaaguucucuguccuaugcaaugu

SEQ ID NO: 360736 - RNA, 64 nt, Human; identical to SEQ ID NO: 277342

SEQ ID NO: 360737 - RNA, 64 nt, Human; identical to SEQ ID NO: 277343

SEQ ID NO: 360738 - RNA, 64 nt, Human
ugucaugaaagcagcauugaaauaauuuguuuaaagggggcacucuuuuaaacgggaagaaaau

SEQ ID NO: 360739 - RNA, 64 nt, Human
aaaacaacuuccucccuuacagagcauacaacagagggggcacccggggaggagagcacauacu

SEQ ID NO: 360740 - RNA, 64 nt, Human
guucuggggaccugaggagcccuguggcacccacagggggcaccuaugucugccguggcuccuc

SEQ ID NO: 360741 - RNA, 64 nt, Human
cccagacgccucccuggguggacagcaauagaaaagggggcagacgcccaggaagugaccuucu

SEQ ID NO: 360742 - RNA, 64 nt, Human
ugugcagaagggcugacaucaaaccaaaaacuagagggggcagggccagggcagggaggcuucc

SEQ ID NO: 360743 - RNA, 64 nt, Human
gaggggaggaggguggccuguugguuucccucagagggggcagguggccuggagagagaggggc

SEQ ID NO: 360744 - RNA, 64 nt, Human
aucguugcugguagagccugggcuugcugugccaagggggcagagcaauaaauaaacucuucaa

SEQ ID NO: 360745 - RNA, 64 nt, Human
aaagaguuucuucauagaaauuucugugguggggagggggcaaucucugugugucucaguauac

SEQ ID NO: 360746 - RNA, 64 nt, Human
ugcaaaggggcugucuauuagcauauuuccuuugagggggcaaaaaaaagugccaguaucgacu

SEQ ID NO: 360747 - RNA, 64 nt, Human
acuggugauuuuguggguugaaacuucuggcaaaagggggcagcccuugggagcugggggccag

SEQ ID NO: 360748 - RNA, 64 nt, Human
gucacucgagaauucauggacacggcccccagucagggggcaucuugcaagaccuuuagugcca

SEQ ID NO: 360749 - RNA, 64 nt, Human
aauuauaaccagggguuuucuuggggccgggaguagggggcauuccacagggacaacgguuuag

SEQ ID NO: 360750 - RNA, 64 nt, Human
ggucucugugggugggaaugcaagugaacuugggagggggcacgggccuguagaucagggauag

SEQ ID NO: 360751 - RNA, 64 nt, Human
cccuagcccuucuaccccaccugaccucugcaagagggggcauugauacaucaucgggaaaaaa

SEQ ID NO: 360752 - RNA, 64 nt, Human
cggccaaauacccggcauuauggggacagagagcagggggcagacagcaccccuggaguccucc

SEQ ID NO: 360753 - RNA, 64 nt, Human; identical to SEQ ID NO: 277344

SEQ ID NO: 360754 - RNA, 64 nt, Human; identical to SEQ ID NO: 277345

SEQ ID NO: 360755 - RNA, 64 nt, Human
gaaaccugggcuagccccacccagagcgcagaggagggggcaccgacagcgcugcgagccaggc

SEQ ID NO: 360756 - RNA, 64 nt, Human
cccggcucuacgggggccgcguggugccauccccagggggcaugaccagaugcgucccaagaug

SEQ ID NO: 360757 - RNA, 64 nt, Human
cugcguccuuugguccuguccccgcagcccuggcagggggcaugcggucgggcaggggcuggag

SEQ ID NO: 360758 - RNA, 64 nt, Human
caccucuccuguucgguuuagacccccaaacuggagggggcauggagaaccguagagcgcagga

SEQ ID NO: 360759 - RNA, 64 nt, Human
agcaggaugggcugucguguauauagcuggggcgagggggcaggccccccuugugcagagccag

SEQ ID NO: 360760 - RNA, 64 nt, Human
aggcaugguagccugagcgcgcccccaggguaguagggggcaccugaggagcagggucugcccu

SEQ ID NO: 360761 - RNA, 64 nt, Human
ccccauguggaggucggaggggcugggacuggggagggggcagccaccuccauccaaggcucuu

SEQ ID NO: 360762 - RNA, 64 nt, Human
uuucuuccccacacccaagaggaggauuggugguagggggcaggcagaggggguggggagaagu

SEQ ID NO: 360763 - RNA, 64 nt, Human
ugaagguuuggggagagggggguaucaggcagggagggggcagaggcaaaucaccgggcagagg

SEQ ID NO: 360764 - RNA, 50 nt, Human
ccugugacuaugggcucugaagggggcaggagucagcaauaaagcuaugu

SEQ ID NO: 360765 - RNA, 64 nt, Human
aaggaaauguuuuuucuuuuuuuuuuguuuuucgagggggcaaggagggacagaaaaguaaccu

SEQ ID NO: 360766 - RNA, 64 nt, Human
cgccucuuggugaugcuggggucucacuagcuugagggggcacaugaagauaagccacaaauga

SEQ ID NO: 360767 - RNA, 64 nt, Human
aguugaagaugauaccuaugggucgcguuaacacagggggcaacugccuugaucggccugccau

SEQ ID NO: 360768 - RNA, 64 nt, Human
uuccuuucagggauuuguggggucagggaggggcagggggcaccuggcagcauauuuucuguga

SEQ ID NO: 360769 - RNA, 64 nt, Human
gugauugaaggauuuuaaagcaggggaggagaguagggggcaucucuguacacucuggggguaa

SEQ ID NO: 360770 - RNA, 64 nt, Human
acucgcagcagauaucagugggaagggcugggggagggggcacccagcugccuuuccucccuca

SEQ ID NO: 360771 - RNA, 64 nt, Human
ugccuucucuguggcuacaagggacccacagaauuacagggaaguuacagggaagcagguuuca

SEQ ID NO: 360772 - RNA, 64 nt, Human
uggcuacaagggacccacagaauuacagggaaguuacagggaagcagguuucaucucaauauug

SEQ ID NO: 360773 - RNA, 64 nt, Human
uuauaugccaaaagucuagcucuuugcuuuaccauacagggaccugucccaaagaaaaaggcuc

SEQ ID NO: 360774 - RNA, 64 nt, Human
cugccauccugcugccuucccaguggggcuggucagggggcagccuggccacugccuagcugga

SEQ ID NO: 360775 - RNA, 64 nt, Human
gagauaauuagucaaagggcacauggaguauggaagggggcauguugauuaaccauacauagaa

SEQ ID NO: 360776 - RNA, 64 nt, Human
agggaccgcuggcugcucugccugagcaucagggagggggcaggaaagaccaagcuggguuugc

SEQ ID NO: 360777 - RNA, 63 nt, Human
ccuuccacaucagccucugaagggcuggggggcagggggcaugcacccaugcaaaaggcucag

SEQ ID NO: 360778 - RNA, 64 nt, Human
gccugaugcugagaguguguccuccuggggcuuuagggggcaggaaggugggacgaaugacgau

SEQ ID NO: 360779 - RNA, 64 nt, Human
cuccaccugccccagagcuucucaagggaggguaagggggcacccugagcccacaggaccccua

SEQ ID NO: 360780 - RNA, 64 nt, Human
cuguugcuaggaggggcacauggagugggacaggagggggcaccuucuccagaugaugucccug

SEQ ID NO: 360781 - RNA, 64 nt, Human
aggagggggcaccuucuccagaugaugucccuggagggggcaggagguaccucccucucccucu

SEQ ID NO: 360782 - RNA, 64 nt, Human
cccuuggccgcagaggccucagcccuggggagggagggggcacuggugcccccagccucuccaa

SEQ ID NO: 360783 - RNA, 64 nt, Human
ggugcaguggcucacaccuguaagcccagcugucagggggcagaagcgggaggauagcuugagc

SEQ ID NO: 360784 - RNA, 64 nt, Human
gcccucaguccucuagaucaagaugcugacuauuagggggcagugauugccaucuggggaccug

SEQ ID NO: 360785 - RNA, 64 nt, Human
guggaacugacaggagacccgccaccguggaggcagggggcaagaaacucaagaacgcaucaag

SEQ ID NO: 360786 - RNA, 64 nt, Human
gucaugccaagacaguaucagacacagccccagaagggggcauuaugggcccugccuccccaua

SEQ ID NO: 360787 - RNA, 64 nt, Human
accccuccccagcccucccgucggcaggggcagcagggggcagggugcaggguccacauaggug

SEQ ID NO: 360788 - RNA, 64 nt, Human
cacugaccuuugccgaccuccagcggaaccccccagggggcaccagccccccagcagacaaugg

SEQ ID NO: 360789 - RNA, 64 nt, Human
guccugagagcuugcaucgguuucuucagugccuuacagggaaauagccuggggugucugggcu

SEQ ID NO: 360790 - RNA, 64 nt, Human
ccuuuacuccucuggagggcucuguggggagagauacagggaaaggagcuguucuucaaggucc

SEQ ID NO: 360791 - RNA, 64 nt, Human
cacacccaccaccucuggccuugggugguggcauuacagggaugagggagucacuguggguggc

SEQ ID NO: 360792 - RNA, 64 nt, Human
aucagguuagguggggcugugggggaaaagcuacuacagggaagaguguucucugcugucucuu

SEQ ID NO: 360793 - RNA, 64 nt, Human
aucugcagauggcccagaauggaagcuuccagugagggggcacaggacugacuuuuuaaaccau

SEQ ID NO: 360794 - RNA, 64 nt, Human
gggguaaggagcggggcacgggggaggaggagguagggggcaguaaaaaacuuacucucuuuuu

SEQ ID NO: 360795 - RNA, 64 nt, Human
ggagggugcccagccugugaggcacuggcaagguagggggcagauggggcauggagaacccaga

SEQ ID NO: 360796 - RNA, 64 nt, Human
cccaagucugaggccccguggacugcugggagggagggggcagcaggccccuggccccucccug

SEQ ID NO: 360797 - RNA, 64 nt, Human
cuucccacccuccagccaaggagcagcccugcccagggggcauuagguguggguacccggggag

SEQ ID NO: 360798 - RNA, 64 nt, Human
cuaaaaguuugaggaauauuucaagcucugcaacagggggcaaagauuaaucuaccuugcagug

SEQ ID NO: 360799 - RNA, 64 nt, Human
gagggacucuggaguagcagaggggcugggaaagagggggcaggggcugcugggacacugagca

SEQ ID NO: 360800 - RNA, 64 nt, Human
uccauguaucaggacagaggugucuuauguagggagggggcaaguaugaaguaagguaauuaua

SEQ ID NO: 360801 - RNA, 64 nt, Human
gcacugagguggggcagauaacggggcauauuuaagggggcaucuuuguguaaaagaugcaugg

SEQ ID NO: 360802 - RNA, 64 nt, Human
cuggaagggcaagaccaggugcuaaggaggggagagggggcauccugucucucuccagaccauc

SEQ ID NO: 360803 - RNA, 64 nt, Human
agggugcguggugcccucaccccugcccagagcgagggggcaaggacucugccuccagggcauc

SEQ ID NO: 360804 - RNA, 64 nt, Human
cuccuuccccuacaaucccauccugagccauugcagggggcagggaaguucacccccccccacc

SEQ ID NO: 360805 - RNA, 64 nt, Human
cccgacuuuccucugggauauaaaaaaggggguaagggggcaaagagagcccucugggccucuc

SEQ ID NO: 360806 - RNA, 64 nt, Human
gaccugucugacugggaagggaguuccgagagggagggggcaaucccuucccccaucccccacu

SEQ ID NO: 360807 - RNA, 60 nt, Human
cccuggagugggaguucugaaggcagggugagggggcaagggacauacccugguaacuac

SEQ ID NO: 360808 - RNA, 64 nt, Human
uucuuuacuggccccuuuguagggccuugcugccagggggcagggaugcuuuccagccugcagc

SEQ ID NO: 360809 - RNA, 64 nt, Human
uuaagaaggcauuagucaugguuuggaagcaccauacagggagacagcugugugaauacaggcu

SEQ ID NO: 360810 - RNA, 64 nt, Human
uaaugaguuaacacaugugcuguuggggcgucuuuacagggaguccgaguucggugcccacccc

SEQ ID NO: 360811 - RNA, 64 nt, Human
gucugcaggggccuggcuugauggggucuugaagagggggcaguguguaaaaagaaagagccug

SEQ ID NO: 360812 - RNA, 64 nt, Human
ccuuccucugugccaagaggauucauccugggagagggggcaagguggaaugcagauaacucac

SEQ ID NO: 360813 - RNA, 64 nt, Human
auuugggguaggggcuagaccuccuuuuauuugaagggggcaagggcugagaugugguccccaa

SEQ ID NO: 360814 - RNA, 64 nt, Human
cuggacagucacaccagggacuucccagugaacaagggggcauaggcuccucucuggaucccac

SEQ ID NO: 360815 - RNA, 64 nt, Human
cucugccccagugcucucuugcugucugcugacaagggggcauggagcaucucuuccucuucug

SEQ ID NO: 360816 - RNA, 64 nt, Human
aguggacucugugcucacuggguggagcuguggcagggggcacugagccuccagacccugcuaa

SEQ ID NO: 360817 - RNA, 64 nt, Human
agguugccuuggugcugccccagaucuguccagcagggggcaguaagugaucuugguaguaucc

SEQ ID NO: 360818 - RNA, 64 nt, Human
ucagaagcuguugcuacugcgucucucugucugcagggggcacuuguuccugagguccucgccu

SEQ ID NO: 360819 - RNA, 64 nt, Human
uacucaggagguuggggcagaauugcuugaacccagggggcagagguugcagugagccgagauu

SEQ ID NO: 360820 - RNA, 64 nt, Human
augcccuagccccaggucuagccgggcccauugcagggggcagcacuugggggcaucuccggca

SEQ ID NO: 360821 - RNA, 64 nt, Human
caaucucacaccuuagcuauucccagggaaccccagggggcaacugacauugcuccaagauguu

SEQ ID NO: 360822 - RNA, 52 nt, Human
uggaggugacugugcagugaggagggggcaccaugcagagauggcaguugcu

SEQ ID NO: 360823 - RNA, 64 nt, Human
cugugacugugcagcgcccguggugaucugggguagggggcaccccuacagugggaccccuccc

SEQ ID NO: 360824 - RNA, 64 nt, Human
cuaccccuuccaugcucaucucacugcccagugaagggggcaagggcagcgaggggcaggaccc

SEQ ID NO: 360825 - RNA, 64 nt, Human
gugggcugggggaggggaacaggaugcccagcccagggggcaaggacacagcugcuccccucug

SEQ ID NO: 360826 - RNA, 64 nt, Human
uuucuagguuugugaaugugaagccccaggccgcagggggcaaggggccaggugccccccacca

SEQ ID NO: 360827 - RNA, 64 nt, Human
uguuacauuggggaucaaguuuccaauaugugaauacagggaagcaccaacagaccauaucagu

SEQ ID NO: 360828 - RNA, 64 nt, Human
ccugaaaguccacacuuaaguagagccuuagaccuacagggaaagugcugucucuguaguauug

SEQ ID NO: 360829 - RNA, 64 nt, Human
ucagaugaagggacucaggacaggcucugugacuuacagggacccaaucaauucacaaugagaa

SEQ ID NO: 360830 - RNA, 64 nt, Human
acuguggcuugaagucacuguggaucgagcucacagggggcacccauccuguugucaacagagu

SEQ ID NO: 360831 - RNA, 64 nt, Human
ugugugggcucuggccuggccugguggcuggcccagggggcagcagugcuuagagcuucugcag

SEQ ID NO: 360832 - RNA, 64 nt, Human
gccacugucuuugcagagcugggcacaugugcccagggggcagaaaaaauggcuucucaguugu

SEQ ID NO: 360833 - RNA, 64 nt, Human
cuggugcucgggaagggaggggaaggggccggggagggggcacggcaggcguguggcagccaca

SEQ ID NO: 360834 - RNA, 64 nt, Human
ugauuuuucaagaaaagagaaaugcaggaagcucagggggcaguagcacacuuugcacacgaua

SEQ ID NO: 360835 - RNA, 64 nt, Human
uuaguugaguuguuuuugggggggagguggggguagggggcacagaacaccagaaagaguguug

SEQ ID NO: 360836 - RNA, 64 nt, Human
ugaucuguucacgucucuccccagugggcuccuaagggggcaggcgugugaguggacgccaucc

SEQ ID NO: 360837 - RNA, 64 nt, Human
agcaagaacacuuggaaugaacgaaugaacuuguagggggcauagaggauucuugaaaaaaaaa

SEQ ID NO: 360838 - RNA, 64 nt, Human
agggcagcaugacaaggagaggaaauaaauggaaagggggcauaugggauuuguggacacagcu

SEQ ID NO: 360839 - RNA, 64 nt, Human
auugacagauuaaauagauaacuucguaaccaccagggggcagauucaauacaucacagaaugg

SEQ ID NO: 360840 - RNA, 64 nt, Human
agcuggggcugaggcccaaaggcagaacagccagagggggcaggaggggaccaaaaaggaaaau

SEQ ID NO: 360841 - RNA, 64 nt, Human
augggggaaagagauuagagauaauugucuaguuagggggcagcuggagaaaauaagcuaaguu

SEQ ID NO: 360842 - RNA, 64 nt, Human
acuggagauguguguagggccacaagaaugagaaagggggcaauggagugacaggugaccugcu

SEQ ID NO: 360843 - RNA, 64 nt, Human
ggagcgcuagagguaguuggguagagaagccagcagggggcagcgugggacccauaucccagcc

SEQ ID NO: 360844 - RNA, 64 nt, Human
gggucaugcuuuugcaaugaauggucagaugcuuagggggcauuugugcuccucuggccaggaa

SEQ ID NO: 360845 - RNA, 64 nt, Human
aucagaaacacuuuggagauuuccauuugucucauacagggaagaguuguaugucuccuguggc

SEQ ID NO: 360846 - RNA, 64 nt, Human
agguguauuugguccuugagaagugggagcacccuacagggacacuaucacucaugcugguggc

SEQ ID NO: 360847 - RNA, 64 nt, Human; identical to SEQ ID NO: 277301

SEQ ID NO: 360848 - RNA, 64 nt, Human; identical to SEQ ID NO: 277302

SEQ ID NO: 360849 - RNA, 64 nt, Human
gcccaggagggcauagggcagccuaccaccuccaagggggcaggcgcccucaucugggguuggg

SEQ ID NO: 360850 - RNA, 64 nt, Human
cuggggcuacccaugggcaaguggggcucgggguagggggcacugcuugaagcacagcacuugg

SEQ ID NO: 360851 - RNA, 64 nt, Human
gagggaagaugggugcugggagaggguugggggcagggggcaaggaaaauugcuaccugauuug

SEQ ID NO: 360852 - RNA, 64 nt, Human
cccagagccaaaugacacuaacuuauagaaggggagggggcaaagggcuucuuccucaggccag

SEQ ID NO: 360853 - RNA, 64 nt, Human
uagaaacuggaaaacauauauauguuagcaucaaagggggcagaagcaaagaagauacagaucu

SEQ ID NO: 360854 - RNA, 64 nt, Human
cucacaggagaguccuucaccguauaugaaagccagggggcagugccaaacacgcggcaccagg

SEQ ID NO: 360855 - RNA, 64 nt, Human
cucagugaccuggaucugaccucacaccaucagcagggggcacccaccaugcacaccugucucg

SEQ ID NO: 360856 - RNA, 64 nt, Human
gggacagcaggagugaggugaagagggcggagagagggggcaggcucggcaccggcccucccag

SEQ ID NO: 360857 - RNA, 64 nt, Human
cccucaaggugauuugacuguugcaagcuaaagcagggggcaagguagauaaaugugagggcuu

SEQ ID NO: 360858 - RNA, 64 nt, Human
cccaccccgccccaggcaccaucaggagcaggcuagggggcaggccugggcccagcuccgggcu

SEQ ID NO: 360859 - RNA, 64 nt, Human
agggcccagccgcggggagggacucgcaggcgucagggggcagccuugucccggcccagugugu

SEQ ID NO: 360860 - RNA, 64 nt, Human
aacacgauagaggagaccagucaguacuucuuggagggggcaggaggagagaggaaaagggagg

SEQ ID NO: 360861 - RNA, 64 nt, Human
ccucaugggguguugugagccccaugaggggugcagggggcacugcccggcagaugucugcuca

SEQ ID NO: 360862 - RNA, 64 nt, Human
cuuuuuagcuaggcgaguacagacggggccugggagggggcagagauguuccccaggcccugcc

SEQ ID NO: 360863 - RNA, 64 nt, Human
gugauuuucuuaagaaccagaacugcuggcagaaagggggcacccacacgcuuagauagccgau

SEQ ID NO: 360864 - RNA, 64 nt, Human
aacaaagagguuaauaaaagcccaucucgucauguacagggacucaugccuuuaauuccagugu

SEQ ID NO: 360865 - RNA, 64 nt, Human
guuacuuuuaauacucagguaaugcuacaaauauuacagggagucaaaugcuuuuauaaaguuc

SEQ ID NO: 360866 - RNA, 64 nt, Human
agggugagcuuuggcugggguugcccuuguguaguacagggaagucugacacagccucuccagc

SEQ ID NO: 360867 - RNA, 64 nt, Human
auucuccugucucagccucccaaguagcuggaauuacagggacccgccaccacgcccggcuaau

SEQ ID NO: 360868 - RNA, 64 nt, Human
ccugggaagguggggccagcaggagaugaccaacagggggcaggaccuggggaccugggcugga

SEQ ID NO: 360869 - RNA, 64 nt, Human
uuccaucuuuuccuaaaggucagagcugcagccuagggggcacugcccuacagaaaaggucugc

SEQ ID NO: 360870 - RNA, 64 nt, Human
ggcacagaaccgaggagcugccauuaccccccauagggggcagugucuuguuccugccagccuc

SEQ ID NO: 360871 - RNA, 64 nt, Human
uaaagugccaguaauccgccaagagggggugcgaagggggcaugucacgacagcuccgccaccc

SEQ ID NO: 360872 - RNA, 64 nt, Human
agcugcccuacuucccagguuuguagccaggagaagggggcaucacagagcugaugguccaaua

SEQ ID NO: 360873 - RNA, 64 nt, Human
uuauagcaucuugaauagagagcugcaaaccaccagggggcagaguugcauuuuuccaggcuuu

SEQ ID NO: 360874 - RNA, 64 nt, Human
ugcuccauggcugccaucucaccuccugcugggcagggggcaugaugcgggccagugcuccagc

SEQ ID NO: 360875 - RNA, 64 nt, Human
caucugcuuugcuuuggcaugugagccuugccuaagggggcauaucugggucccuagaaggccc

SEQ ID NO: 360876 - RNA, 64 nt, Human
gauggacugugcugcaguaucaccagaagacauuagggggcaguaggcccccacacaaaaccuu

SEQ ID NO: 360877 - RNA, 64 nt, Human
gcugaccguuuuaagaaguggcaugugccuugaaagggggcagaauguucagucggucguguuu

SEQ ID NO: 360878 - RNA, 64 nt, Human
caaagguuaacauugcuccacuguucaccaaggaagggggcaguggccauccgccgcggccuca

SEQ ID NO: 360879 - RNA, 64 nt, Human
cccaccccuaccacaguguuugugccuucagcugagggggcagccucugggcccugaaccccug

SEQ ID NO: 360880 - RNA, 64 nt, Human
gagaaugaggucagcggugcuggggaacagauggagggggcaguggggacagggcuugggcaga

SEQ ID NO: 360881 - RNA, 62 nt, Human
ccaaugcccccccacccuaaugcaggcugaggagggggcacauguugggagacaccuaccag

SEQ ID NO: 360882 - RNA, 64 nt, Human
uuucuuugcaacggccucagaaguuuggccggagagggggcagccagagcggcagcccccggcc

SEQ ID NO: 360883 - RNA, 64 nt, Human
ccauauccacaugcagagggcgagcucauaaaacuacagggaagcgugaaaugauggcuuuggu

SEQ ID NO: 360884 - RNA, 64 nt, Human
gaagggaagagcaggucaguacagagguucugucuacagggaggggcccugggucuaugcacag

SEQ ID NO: 360885 - RNA, 64 nt, Human
aggaauuagaccucuccccauucugcuagcaacauacagggacacuuggaaaaccauuuccccu

SEQ ID NO: 360886 - RNA, 64 nt, Human
ccccacacccaaagaucccagccuagggaugggguacagggacuuuaaauagucccuaaucccu

SEQ ID NO: 360887 - RNA, 64 nt, Human
uaaaaauauucuucugggcucaaaagcuagcuugagggggcagaugccccaggugucccagcuc

SEQ ID NO: 360888 - RNA, 64 nt, Human
uggaggcugggaucugccgcucccuccagccaccagggggcaggagugcacuaccugcugucag

SEQ ID NO: 360889 - RNA, 64 nt, Human
aaguuuggagacuagacugaaacuuuuuugggggagggggcaaaggggacuuuuuacagugaug

SEQ ID NO: 360890 - RNA, 64 nt, Human
uccuuuuccucuuuugugagaagaugggggcuggagggggcagaguggccugugagcaagagcc

SEQ ID NO: 360891 - RNA, 55 nt, Human
gcugcugcuccuucaugugaaucccagggggcagagaggaggcucuggaggcaca

SEQ ID NO: 360892 - RNA, 64 nt, Human
agagcaggggcuaggugucuccugggaggcaugaagggggcaagguccguccucugugggccca

SEQ ID NO: 360893 - RNA, 64 nt, Human
cucugcagcucuggcccaggagcugcaggcugggagggggcagccaagaagccggagcuggcag

SEQ ID NO: 360894 - RNA, 64 nt, Human
uugcccacuuggggcccuucauugggcccaugucagggggcaucuaccugugggaagaacauag

SEQ ID NO: 360895 - RNA, 64 nt, Human
ucccccuccucccugcaggcccaaggcguugguaagggggcagcugagcaauggaacgcguuuc

SEQ ID NO: 360896 - RNA, 64 nt, Human
cuguggcugccaggucugggccacauggcagcccagggggcaggagaagcccgggagaggccca

SEQ ID NO: 360897 - RNA, 64 nt, Human
uuauaaacugaaccaugaccuuuauggcgcaugcagggggcaaccugcauaauuaucaauggcg

SEQ ID NO: 360898 - RNA, 64 nt, Human
cauuucucaaaguccagaaaauuagggucccagaagggggcagcagcaggcugggaguuaggag

SEQ ID NO: 360899 - RNA, 64 nt, Human
ucuccugggacaacuagggcugcgaaucuagaggagggggcaggcugagggucgugggaaaggg

SEQ ID NO: 360900 - RNA, 64 nt, Human
gcaggaaggagcugccuggacccguucaugggggagggggcagaaguguuuuuuauauaugugu

SEQ ID NO: 360901 - RNA, 64 nt, Human
agggauccugugcaggggccaccugggagauagcagggggcacagagagagcagggucagcucc

SEQ ID NO: 360902 - RNA, 64 nt, Human
uggggguucccauucccacacaugugcccagaguagggggcauggaggagauggucccuguccu

SEQ ID NO: 360903 - RNA, 64 nt, Human
uuagggggcucaauucuccacucugcucagucccuacagggaaagcucaggucgggucuuucug

SEQ ID NO: 360904 - RNA, 64 nt, Human
ugugaggcgugcgugaagcaagaacuccuggagcuacagggacagggagccaucauuccugccu

SEQ ID NO: 360905 - RNA, 64 nt, Human
uuguaaaguauguauuauuuacauuuaauagacuuacagggauaaggccugugggggguaaucc

SEQ ID NO: 360906 - RNA, 64 nt, Human
auggggcggagcagggcagaagauggacugggggagggggcagagagaggagaccaaaaugagg

SEQ ID NO: 360907 - RNA, 64 nt, Human
cuuagaggcugggauggcuccuggccccaccgccagggggcagcgcaggccgggcugggaggcg

SEQ ID NO: 360908 - RNA, 64 nt, Human
ugaaggcaagaacuggacagucagagaacaguggagggggcaagugacugaagagcaccgggua

SEQ ID NO: 360909 - RNA, 64 nt, Human
agugugcaugagcgugucugaagauggggggcucagggggcacguuugcguuuggaccugucug

SEQ ID NO: 360910 - RNA, 64 nt, Human
ucccucgccccuucuccaucgucccaggaaucccagggggcagcacagccggcccccggcccac

SEQ ID NO: 360911 - RNA, 64 nt, Human
ugaggcaccccuguaacccuggggacuaggaggaagggggcagagagaguuaugaccccgagag

SEQ ID NO: 360912 - RNA, 64 nt, Human
aggcucccuguguccuggaggagaaaagcauuagagggggcagcuggacaagcucccaacugca

SEQ ID NO: 360913 - RNA, 64 nt, Human
uccugcuccuucccccagccccacgcccuaccagagggggcaaagggcacgucccaucacucac

SEQ ID NO: 360914 - RNA, 64 nt, Human
cucagaguccugccgacggagccacuggggugggagggggcagggggcuuggcucgcaccccca

SEQ ID NO: 360915 - RNA, 64 nt, Human
cucuuccugccugagcaccgcagcgggagccagcagggggcagcagaggccaacagggagcucg

SEQ ID NO: 360916 - RNA, 64 nt, Human
cgcuggugagguccccuggaccauccagggugcuagggggcagggaggggacacccccuccccg

SEQ ID NO: 360917 - RNA, 64 nt, Human
gccccaucaugggggcugggguugucaccuggacagggggcagccguggaggccaccguuacca

SEQ ID NO: 360918 - RNA, 64 nt, Human
guccccauccuccaaagggccugggcccgccccgagggggcagcgagaggagcuuccccauccc

SEQ ID NO: 360919 - RNA, 64 nt, Human
aguaggauucggaaaagauuguacauaugggaggagggggcagauuccuggcccucccucccca

SEQ ID NO: 360920 - RNA, 64 nt, Human
aucgucuguguccaggucagaaaguggcccaggaagggggcaguuucugucgcggguccggugg

SEQ ID NO: 360921 - RNA, 64 nt, Human
guggcccaugugcccagggcgccugcagggcugcuacagggaccuggucaggaggugcacaugg

SEQ ID NO: 360922 - RNA, 64 nt, Human
ucugcaggccccccggacagaccacccagcccuguacagggaccugcugaggaccagccgcgug

SEQ ID NO: 360923 - RNA, 64 nt, Human
uugacacccucccccuggagcugaugucugugacuacagggagauuagcacuucgucuagugaa

SEQ ID NO: 360924 - RNA, 64 nt, Human
ucucaaagugggaagguuuugggggagggggaaauacagggaugguccauguuuucaagaguag

SEQ ID NO: 360925 - RNA, 64 nt, Human
acaggcacuuuagcccgagccaggcacaccugcgagggggcaggugugcuccgccgcccugcug

SEQ ID NO: 360926 - RNA, 64 nt, Human
cucccauuucuguccuuggccuugggaguagcugagggggcagacuagggaguagggcuggcag

SEQ ID NO: 360927 - RNA, 64 nt, Human
gagggggcagacuagggaguagggcuggcaggggagggggcagacagccucgccucgcacccuu

SEQ ID NO: 360928 - RNA, 64 nt, Human
uuuaugcuuuuguacaucaaccgugcgcggccggagggggcaggggggcgggggcgaggggcgu

SEQ ID NO: 360929 - RNA, 64 nt, Human
auccccgagcccccgcugccagggcagagggaggagggggcacagcugugccaagcccggcccc

SEQ ID NO: 360930 - RNA, 64 nt, Human
ugucccccacccuggggggggccaggcuccagagagggggcaccuccccacacacccccccccc

SEQ ID NO: 360931 - RNA, 64 nt, Human
gggcacugcccggcccggcugugaggagggcggcagggggcacggccuccagcuuccaaagagc

SEQ ID NO: 360932 - RNA, 64 nt, Human
agcgcugggcccucccuugcccccaagcucaagaagggggcacugcccggcccggcugugagga

SEQ ID NO: 360933 - RNA, 64 nt, Human
cgucuucuccccagccccguccucccaccaccccagggggcaggcaggcaggcccccucccgug

SEQ ID NO: 360934 - RNA, 64 nt, Human
cacucauacccaguuuuguuucugaaacuacgguagggggcaggaagaggagcagaaaagaagg

SEQ ID NO: 360935 - RNA, 64 nt, Human
ccagcuggugcccccagacagcugcucagagccaagggggcagagggcuuucagcgcccccagg

SEQ ID NO: 360936 - RNA, 64 nt, Human
uguggucugaauggcgugaauuuuuaucccgaggagggggcaguugugacaaccuccagugcau

SEQ ID NO: 360937 - RNA, 64 nt, Human
gaggguggcauucugggacaugaggagcaaaggaagggggcaauaaauguugagccaagagcuu

SEQ ID NO: 360938 - RNA, 64 nt, Human
gccagaagugagggcccagaggucugggucccccagggggcaggggccaaagguccagaccccc

SEQ ID NO: 360939 - RNA, 64 nt, Human
uuauuuaaauuauggcuggggucggggaggguacagggggcacugggaccuggauuuguuuuuc

SEQ ID NO: 360940 - RNA, 64 nt, Human
ucagucuguuauugcaaaguaauaaaaugucaccuacagggagccucugagccuacucuaguuc

SEQ ID NO: 360941 - RNA, 64 nt, Human
gauggagcuuugggaacgcggagaacagugggguuacagggagucaucaucagcccuaccccuu

SEQ ID NO: 360942 - RNA, 64 nt, Human
aaagagcauaacaauguaguugauugguaagauuuacagggauuugguuucugaguuugaggca

SEQ ID NO: 360943 - RNA, 64 nt, Human
uguuagguugcgcaagcgauguuugcgcucgcauuacagggaccucaaccuaggugcaauccug

SEQ ID NO: 360944 - RNA, 64 nt, Human
gucugucucugucuuccucccaaucccuaggggaagggggcauuuggcuagggggugccccugu

SEQ ID NO: 360945 - RNA, 64 nt, Human
aggucuguuucaugggacuuuucuuuuuugggggagggggcaggguuucacucugucacccagg

SEQ ID NO: 360946 - RNA, 64 nt, Human
gcugcccccgcaggacacuguggccaugccacggagggggcaguggacaaaaccaauccaaagc

SEQ ID NO: 360947 - RNA, 64 nt, Human
ggcaggaccaggacagaaccacaggcacacacugagggggcaguguggcucccugccuguccca

SEQ ID NO: 360948 - RNA, 64 nt, Human
uuuugugcuugaggaggcccauuuucugccuggcagggggcaggucugugcccucccgcugacu

SEQ ID NO: 360949 - RNA, 64 nt, Human
gccucccccagggaccggcggaccccagccauccagggggcaagaggaauuacgugcucugugg

SEQ ID NO: 360950 - RNA, 64 nt, Human
caggagucgcgggcagcguggacaucugucccagagggggcagaaucuccaauagaggacugag

SEQ ID NO: 360951 - RNA, 64 nt, Human
cugccgcaggcacagaaggguagaaagccacagcagggggcaguccagcagacucugacucaac

SEQ ID NO: 360952 - RNA, 64 nt, Human
aagagaaaacacacagcuucacacauccaggcauagggggcaagcucuuggggcaucaggaccc

SEQ ID NO: 360953 - RNA, 64 nt, Human
uuuugucaggguuuuucuacguguaggcgugaauagggggcaccccuucaaaacuguacaaaga

SEQ ID NO: 360954 - RNA, 64 nt, Human
auccucuggcugggaagccacugaccagguggccagggggcagggugggaagagggguuaaggu

SEQ ID NO: 360955 - RNA, 64 nt, Human
cccagugauuguggcugcuccuccuagaggugggagggggcaagaggccuccuuggucaguguc

SEQ ID NO: 360956 - RNA, 64 nt, Human
cugaaaucaccccaggcacugugagggcuucuccagggggcacccuuugagcugugggucugau

SEQ ID NO: 360957 - RNA, 64 nt, Human
ugucacccuuguccacguuguuucacaucugguuagggggcagauuuuaaaauguaguuuugua

SEQ ID NO: 360958 - RNA, 64 nt, Human
ugguggcugcccccaggacaugcaggauuucugcagggggcagcacagguucugggauugugag

SEQ ID NO: 360959 - RNA, 64 nt, Human
ugguguuguuuacgaguguauucucgugucaacauacagggauuuagacauuuaacucucugug

SEQ ID NO: 360960 - RNA, 64 nt, Human
acuguccucuacaucaauuaacaucgugggucacuacagggagaaaauccaggucaugcaguuc

SEQ ID NO: 360961 - RNA, 64 nt, Human; identical to SEQ ID NO: 277347

SEQ ID NO: 360962 - RNA, 64 nt, Human; identical to SEQ ID NO: 277348

SEQ ID NO: 360963 - RNA, 64 nt, Human
ccagcgccaggcuccucggagcccaacagucccaagggggcaggagacggggugguccagugcu

SEQ ID NO: 360964 - RNA, 64 nt, Human
uuucugaaaguagcuugucgggcuugggugaggaagggggcacaggagccgugaccccugagga

SEQ ID NO: 360965 - RNA, 64 nt, Human
gccgcccucucucuagcuguuucacuuagccuagagggggcaagggcagguggggccacucugg

SEQ ID NO: 360966 - RNA, 64 nt, Human
aaugacgcugacuuuguauagaaggauuuugcuaagggggcaaaaagcccagauaccauuuuaa

SEQ ID NO: 360967 - RNA, 64 nt, Human
agcuggggcucggcacaugcagagaugacagggcagggggcagucuuccucccccuccccgacc

SEQ ID NO: 360968 - RNA, 64 nt, Human
ggaagagguuuuccugucuggcuucugagguuggagggggcacuuagcagugaaccuuaagucu

SEQ ID NO: 360969 - RNA, 64 nt, Human
aggggggcccagcccugggaggcuggugggaggcagggggcaggccugcggaugcaugaaauaa

SEQ ID NO: 360970 - RNA, 64 nt, Human
ccaaggacagauggcaguggagcuagaccugaguagggggcagggaguucaggacaacccuccu

SEQ ID NO: 360971 - RNA, 64 nt, Human
ugacaguguccagccgguucugcagcacuaggggagggggcagauggugguugcaugggcuucc

SEQ ID NO: 360972 - RNA, 64 nt, Human
gaccagaggaacauuaggggccggucagacacguagggggcagugaggaaacgggguaaagugg

SEQ ID NO: 360973 - RNA, 64 nt, Human
uagacucccucaggaggcugaauugaaaaagggcagggggcacuugagcugggcuggggcucag

SEQ ID NO: 360974 - RNA, 64 nt, Human
gggccauuucagcuugaccuccuuuuuugaggucagggggcacugucugucuggcuacaauuug

SEQ ID NO: 360975 - RNA, 64 nt, Human
uauagauucucuaguuuucucccuagggaugggaagggggcauugaggcaagccuggagaggag

SEQ ID NO: 360976 - RNA, 64 nt, Human
acagcauaagggagcguagaaucuguguagacgaagggggcaucuggccuuacaccucguuagg

SEQ ID NO: 360977 - RNA, 64 nt, Human
gaagucuagggcagauucuucccucugaguuugaagggggcagucgaguuucuacgugguggag

SEQ ID NO: 360978 - RNA, 64 nt, Human
aucaccuccuggauggauuccacuguuagacagcuacagggaaugauuggucauggggaagucu

SEQ ID NO: 360979 - RNA, 64 nt, Human
uacaugugugccucucacagcaguuggccacaguuacagggagagaacaauaucacagucauuc

SEQ ID NO: 360980 - RNA, 64 nt, Human
uguuagaguggucgagauuucaaacccaauuauguacagggagcugucugagagcuagccagaa

SEQ ID NO: 360981 - RNA, 64 nt, Human; identical to SEQ ID NO: 277292

SEQ ID NO: 360982 - RNA, 64 nt, Human
gcgugcacugugaggcuggaccuguugacucugcagggggcauccauuuagcuucagguugucu

SEQ ID NO: 360983 - RNA, 64 nt, Human
acuuucaugaccagugaugaggggaaauggggggagggggcaggccaaugaggucugcauggcc

SEQ ID NO: 360984 - RNA, 64 nt, Human
gagcuucggccugccuaagucugaggaagggagaagggggcagcugucugccaggagucuggcu

SEQ ID NO: 360985 - RNA, 64 nt, Human
cacucagagcagucugugacuuaguggacaggggagggggcaaagggggaggagaagaaaaugu

SEQ ID NO: 360986 - RNA, 64 nt, Human
gaaggcaaguuaguuaaguaucacugauguggguugagaccagcacucugugaaaccuugaaau

SEQ ID NO: 360987 - RNA, 64 nt, Human
gccaaggcagguggaucaccugaggucagaaguuugagaccagccuggccaacauggugaaacc

SEQ ID NO: 360988 - RNA, 64 nt, Human
ugugccuuuggggcagaccccaggcaaggaugucugagaccacuugggcgcuguuuucucagcu

SEQ ID NO: 360989 - RNA, 64 nt, Human
uugagcagauguccgaagccguuucuucaucccaugagaccaacaacacugucugccucagaac

SEQ ID NO: 360990 - RNA, 64 nt, Human
ugaacguggcagugcuugugauucaggcuuccauugagaccaaggggagaaccugguugcagga

SEQ ID NO: 360991 - RNA, 64 nt, Human
gcugagguagguggaucacccaaggucaggaguuugagaccagccuggccaaauggugaaaccc

SEQ ID NO: 360992 - RNA, 64 nt, Human
cacaaagaauguuaaguacugaaucaugugugacugagaccagagauggcaaaugaauggcaca

SEQ ID NO: 360993 - RNA, 64 nt, Human
gccaaggugaguggaucaccugaggucagaaguuugagaccagccugaccaacauggugaaaug

SEQ ID NO: 360994 - RNA, 64 nt, Human
guacaagguaccccuuucuggcucucccauuuccugagaccacagagagaggggagaagccugg

SEQ ID NO: 360995 - RNA, 64 nt, Human
uaaaaauccuuaggauaacuugaggccaggaguuugagaccagugugaccuugucucuguaaaa

SEQ ID NO: 360996 - RNA, 64 nt, Human
cguagagugaccucggacagagccccccuagcaauacagggaggcucccggggccuggacaggc

SEQ ID NO: 360997 - RNA, 64 nt, Human
cuccccagcacccuccucccuggccggugcaaaguacagggagguaaagcaggacccuugcaga

SEQ ID NO: 360998 - RNA, 64 nt, Human
auguccaaaugauaucagguccucaaucuucagcuacagggaaugaguaacuuugaguggagaa

SEQ ID NO: 360999 - RNA, 64 nt, Human
gcugaggcggguggaucacuugaggucaggaguuugagaccaaccuggccaacauggugaaacc

SEQ ID NO: 361000 - RNA, 64 nt, Human
cugcucaugcaacuugaagccagggagaucaagaugagaccaaagaaucuggcaaacaucacag

SEQ ID NO: 361001 - RNA, 64 nt, Human
auucuucucuucuaguuacuacaguguggaguguugagaccagacaccuuuugcugucucaugg

SEQ ID NO: 361002 - RNA, 64 nt, Human
aauuaaagaugucauugaacuacugucuuguuuaugagaccauucaguggugaacuguuucugg

SEQ ID NO: 361003 - RNA, 64 nt, Human
ugaugcauaguaaccagugauuauaggauauaccugagaccaucaggaacugucaacaaaugau

SEQ ID NO: 361004 - RNA, 64 nt, Human
gaccugagaaccuggacccuggaaucagcauggaugagaccagaggagguauggauggaaacaa

SEQ ID NO: 361005 - RNA, 64 nt, Human
gccaaggugggaggauugcuugagcucaggaguuugagaccaaccuggguaacauagugagaca

SEQ ID NO: 361006 - RNA, 64 nt, Human
aacacacuuggcagauggaggaagcaucugaguuugagaccauggcuguuacagggaucaugua

SEQ ID NO: 361007 - RNA, 64 nt, Human
uaacccuccaccaaaaaaacacaaagugcuucugugagaccaauuuugugcuaaugagcauuga

SEQ ID NO: 361008 - RNA, 64 nt, Human
cagcacuuugggaggccaaggcagaaggaucacuugagaccaggaguucaagaccagccugaga

SEQ ID NO: 361009 - RNA, 64 nt, Human
uguggccacagggcucagguucacacuucugcuuugagaccaggaugggguguaagccauagag

SEQ ID NO: 361010 - RNA, 64 nt, Human
gccaaggugggcggaucacuugaggucuggaguuugagaccagccugagcaacauggugagacc

SEQ ID NO: 361011 - RNA, 64 nt, Human
aggucaaguaagaagacaugaaccaaguggaccuugagaccacaggguucaaaaugucuguagc

SEQ ID NO: 361012 - RNA, 64 nt, Human
caauggaaguccuccgcugauuccuagaaggcugugagaccacacuagggcauuguuucccugg

SEQ ID NO: 361013 - RNA, 64 nt, Human
ggaguugagagugugcuuauuuucacugcgaucaugagaccacaguucuggguuaucuccucuc

SEQ ID NO: 361014 - RNA, 64 nt, Human
auuagaaugauuccaacacugcucuucugcaccaugagaccaacccagggcaagaucccauccc

SEQ ID NO: 361015 - RNA, 64 nt, Human
ugguauacaacacaguaucauugcaaaugcaguuuacagggauuuuugauauacuggcuuggga

SEQ ID NO: 361016 - RNA, 64 nt, Human
gaacaugcugcauacuugccuaguagcaaaacaauacagggaagagucaaaagggcuucuccaa

SEQ ID NO: 361017 - RNA, 64 nt, Human
uaucgcccaccuuggccucccaaagugcugggauuacagggaugagccaccgugccuggcuggg

SEQ ID NO: 361018 - RNA, 64 nt, Human
ugcaugauugucuuuaugcauccccaaucuuaauugagaccauacuuguauaagauuuuuguaa

SEQ ID NO: 361019 - RNA, 64 nt, Human
guuugaguuucauacuucagccccucuguaggaaugagaccaagccacagcugucuuuugaauu

SEQ ID NO: 361020 - RNA, 64 nt, Human
agaugauaaaauggaauuuuugcauuauuaaacuugagaccagugaugcucagaagcuccccug

SEQ ID NO: 361021 - RNA, 64 nt, Human
gugagguuccugccuucacuaggauccacggauaugagaccauuuuugucauuuccugaaguca

SEQ ID NO: 361022 - RNA, 64 nt, Human
auagauguucaaaguucaguccuugccauuugacugagaccacauggugugccccuugagugag

SEQ ID NO: 361023 - RNA, 64 nt, Human
aagggcggacaccaccaaggggcccucuggaacuugagaccacuggaggcacaccugcuauacc

SEQ ID NO: 361024 - RNA, 64 nt, Human
gcugaggugggaggaucgccugagcccaggaguuugagaccagucuaagcaacauaaugagacu

SEQ ID NO: 361025 - RNA, 64 nt, Human
aguggacaugucagagacaacacuucccagcaucugagaccaaacugcagaggggagccuucug

SEQ ID NO: 361026 - RNA, 64 nt, Human
cggcacuuugggagacugaggugggagcaucacuugagaccaggaguuugggaccaggcugggc

SEQ ID NO: 361027 - RNA, 64 nt, Human
acugaggcuagaagauccuuugaaccuaggaguuugagaccagccugggcgauauagugaggcc

SEQ ID NO: 361028 - RNA, 64 nt, Human
ccuacccaaccacucaaauuaaucuuucuuuaccugagaccaguugggagcacuggagugcagg

SEQ ID NO: 361029 - RNA, 64 nt, Human
ggaggccuaggcaggcagacugagcucaggagcuugagaccagccugggcaacauggcaaaaac

SEQ ID NO: 361030 - RNA, 64 nt, Human
gggcugaaguguugugaauaugaugaaaaugugaugagaccaaacaaaccauggggcacaguag

SEQ ID NO: 361031 - RNA, 64 nt, Human
aggccgaggugggcagaucacgaggucaggaguuugagaccagccugaccaacaugguaaaacc

SEQ ID NO: 361032 - RNA, 64 nt, Human
gcugaagcaggaggaucacuugaggccaggaguuugagaccagccugggcaacauagugagauc

SEQ ID NO: 361033 - RNA, 64 nt, Human
gcccaggugggcggaucaccugagguuagaaguuugagaccagccuggccaacauggugaaacc

SEQ ID NO: 361034 - RNA, 64 nt, Human
caauuacaaggcuucuccuggcgugggagacgucuacagggaagacaccagcguuugggcuucu

SEQ ID NO: 361035 - RNA, 64 nt, Human
uguauaauaaaacacaggguuuggaagguuuuguuacagggagcauggucuguugaagauuuuu

SEQ ID NO: 361036 - RNA, 64 nt, Human
gucugcggcuagaaccugacucccugguucuucuuacagggaggauccuuuuucuccuccaacc

SEQ ID NO: 361037 - RNA, 64 nt, Human
ucuucucuggaccuaauugggcauugggcuuuagugagaccacagaccaggcccgucucuccug

SEQ ID NO: 361038 - RNA, 64 nt, Human
aaugaaggggacuggcauguugguggguggucacugagaccacucccuccccccuuuccccacu

SEQ ID NO: 361039 - RNA, 64 nt, Human
cauacauuuuuuaggauccacuugugcauguaguugagaccacugucucuuaaaauauagcacu

SEQ ID NO: 361040 - RNA, 64 nt, Human
ggucucuagggcuuugggauuggcaggcacacugugagaccaacaacuccuuccuuccccuccc

SEQ ID NO: 361041 - RNA, 64 nt, Human
ugaggcccucgaggcucagcagagcgugcaccaaugagaccacgaugggaaagggccuauuuaa

SEQ ID NO: 361042 - RNA, 64 nt, Human
auuagaaguuaccaaauuaagaugguaagaccucugagaccaaaauuuugucccaucucuaccc

SEQ ID NO: 361043 - RNA, 64 nt, Human
uacuucuuccuccugccccuuuucccagcagcucugagaccagauguuggcugcuguacuuacu

SEQ ID NO: 361044 - RNA, 64 nt, Human
cccagagcacaugcugaccugauaacugggguguugagaccagcuuuguccaugguaugauguu

SEQ ID NO: 361045 - RNA, 64 nt, Human
gauuuuucuuuugguaauuucccugucuauaaagugagaccaaagggauaucuguucccuguua

SEQ ID NO: 361046 - RNA, 64 nt, Human
cuaaacuucaaaguaagauuuugucagaauaaauugagaccauuaaucuaauauaauacuuguu

SEQ ID NO: 361047 - RNA, 64 nt, Human
gccgaggcagguggaucacuugagcucaggaguuugagaccagccugggcaauaucgugagacc

SEQ ID NO: 361048 - RNA, 64 nt, Human
uguagagaccaugcaugcucuaagccuuagggagugagaccaacacccaucccugcccagccaa

SEQ ID NO: 361049 - RNA, 64 nt, Human
aggccgagacaggcagaucacgaggucaacagauugagaccauccuggcaaacauggugaaacc

SEQ ID NO: 361050 - RNA, 64 nt, Human
gcugagguuggaggauugcuugagcccaggaauuugagaccagccuaggugacauagugagacc

SEQ ID NO: 361051 - RNA, 64 nt, Human
ccagaccugcuccugcugcacagagccgcagggcugagaccacguccaugcuggcugccuucag

SEQ ID NO: 361052 - RNA, 64 nt, Human
uagcacuuugggaggccaaggcggguggaucacuugagaccaggaauucgagaccagccuggcc

SEQ ID NO: 361053 - RNA, 64 nt, Human
cauccuauuagccucccacauucuaggcccgugauacagggaugaggucagcaccagcaaacuc

SEQ ID NO: 361054 - RNA, 64 nt, Human
agaggacaagaaacaaucuguagauugguuuccauacagggaaguucuccguccuaugcaaugu

SEQ ID NO: 361055 - RNA, 64 nt, Human; identical to SEQ ID NO: 277296

SEQ ID NO: 361056 - RNA, 64 nt, Human
gcugaggcagguggaucucuugaggucgggaguuugagaccagccuggccaacauggugaaacc

SEQ ID NO: 361057 - RNA, 64 nt, Human
gcagaagccagagggugggaggggccaugcugugugagaccaggggaccagagggaugggagag

SEQ ID NO: 361058 - RNA, 64 nt, Human
gcagaagauacauuggcucuaagaggauauauuuugagaccaauuuaauuucauuuauaagaac

SEQ ID NO: 361059 - RNA, 64 nt, Human
cagccugagcuuggcgugcagcucaucauggacaugagaccagugugaagacucacccuggaag

SEQ ID NO: 361060 - RNA, 64 nt, Human
gggugccaauguggauuaccugagcccaggaguuugagaccagccuggguaacagugagacccc

SEQ ID NO: 361061 - RNA, 64 nt, Human
cuuaauaaauugaauacuagguguuguaaggaagugagaccagaaggacaagcuaaauuaugca

SEQ ID NO: 361062 - RNA, 64 nt, Human
ugguaugaaaacuuauuaggaaccuuuuuguuuuugagaccauugcauucuggcugguuugugc

SEQ ID NO: 361063 - RNA, 64 nt, Human
ugguuuaacgacaucuaagaagguuuagaaauggugagaccaaaacaauaacuguuaaugaugg

SEQ ID NO: 361064 - RNA, 64 nt, Human
aaagguacgggccagcuugugccuaauagaagguugagaccagcagagacugcugugaguuucu

SEQ ID NO: 361065 - RNA, 64 nt, Human
gcugaggcagguggauuacuugaggccaggagauugagaccaguguggccaacauagcaaaaac

SEQ ID NO: 361066 - RNA, 64 nt, Human
gcgugcaggcagcaggauagagugggacaguuccugagaccagccaaccugggggcuuuaggga

SEQ ID NO: 361067 - RNA, 64 nt, Human
cucaugcuggacgggaccccugggcggguggacaugagaccacuguuggccagggacgccgugc

SEQ ID NO: 361068 - RNA, 64 nt, Human
aguuauuuuacuuuucuaacccaacauuccuuggugagaccauuaaauccaaacacuugucacc

SEQ ID NO: 361069 - RNA, 64 nt, Human
gaauguucuccucuuaaagaauagcuucaaauuuugagaccagugguucccacuaaguauagaa

SEQ ID NO: 361070 - RNA, 64 nt, Human
gaauccugaauucagcaccuauuuugaauuaaugugagaccacagguggcaggcagauuccugc

SEQ ID NO: 361071 - RNA, 64 nt, Human
acuuacugccaaauuucaaacaguuaguaguauuugagaccaguaguauggcucuaaucuuacc

SEQ ID NO: 361072 - RNA, 64 nt, Human
gaaguuuuaggaaugcaaaauaagucaucuugcauacagggagugguuaaguaagguuucauca

SEQ ID NO: 361073 - RNA, 64 nt, Human
gcuguauuuaucucugaggcaugguguguggugcuacagggaauuuguacguuuauaccgcagg

SEQ ID NO: 361074 - RNA, 64 nt, Human
ugcuuuacaggcuuuauuuaaaucugaacaauccuacagggaaaucagaauuaggaaaaaaauc

SEQ ID NO: 361075 - RNA, 64 nt, Human
cacccuugucagccgcgcuuugggggaagucuucugagaccacccagugaauaggcacuacccu

SEQ ID NO: 361076 - RNA, 64 nt, Human
cagccuguguuuggugugcaacucaucaugggcaugagaccagugugaggacucacccuggaag

SEQ ID NO: 361077 - RNA, 64 nt, Human
cugaugcucagaucuuagccuugauauuaauaguugagaccaccuacccacaaugcagccuaua

SEQ ID NO: 361078 - RNA, 64 nt, Human
gccgagguggguggaucaccugaggucaggaguuugagaccagccuggccaacacuaucuguac

SEQ ID NO: 361079 - RNA, 64 nt, Human
agcuaaaauuagaugaacucaacuuugacaaccaugagaccacuguuaucaaaacuuucuuuuc

SEQ ID NO: 361080 - RNA, 64 nt, Human
uucuagcuccacacacuaguccuuggaggaagguugagaccaaugauuuccuguuaugagucau

SEQ ID NO: 361081 - RNA, 64 nt, Human
ucgcucuuagcuccucuguccgggcuacuaggagugagaccagcuucuggcaacugccccagcu

SEQ ID NO: 361082 - RNA, 64 nt, Human
ucucuuuauuuuuuuccuucuaaacaaggacaaaugagaccagcaaugugaacuguauuuacau

SEQ ID NO: 361083 - RNA, 64 nt, Human
gccgaggugggaggaucacuugagcacaggaguuugagaccagccugugcaacaucaugaaaca

SEQ ID NO: 361084 - RNA, 64 nt, Human
uauuuucucucugucucucaaaaaaaaauugaacugagaccagugaguaaguuggugucugggu

SEQ ID NO: 361085 - RNA, 64 nt, Human
uugcguauccuagacuuaacaauucaucaguuucugagaccacagaaucagguuuuccguagua

SEQ ID NO: 361086 - RNA, 64 nt, Human
gcugaagugagagguuaauuugaggguagggguaugagaccaucuuggccaauauagcaagacc

SEQ ID NO: 361087 - RNA, 64 nt, Human
aaaaacuauagagcagaagaauugagaaagagaaugagaccaugucaacaaggcuguuuccaac

SEQ ID NO: 361088 - RNA, 64 nt, Human
gcugucuccggaccaucaggguagggugguggguugagaccaggaagucagggaagaucggaau

SEQ ID NO: 361089 - RNA, 64 nt, Human
ugugaauguaaugugauggaauuuaaaaguuuuaugagaccaggcacaguggcucacgacugua

SEQ ID NO: 361090 - RNA, 64 nt, Human
cuuccagcuuucucuuuguucuucaaugugaaacugagaccaagucucucuaagacaaaugcag

SEQ ID NO: 361091 - RNA, 64 nt, Human
aauaagauuuuuauguaaagcuuagaauuugauuuacagggaccuugcugcaguaaauaccauc

SEQ ID NO: 361092 - RNA, 64 nt, Human
uguguuaggugcugagaccuuuuacaugggcuuauacagggagagagucuucaauaaauguagu

SEQ ID NO: 361093 - RNA, 64 nt, Human
ggaucccucuuccugcagccuuguccuuggggaguacagggaaguaccugcagugacccugccc

SEQ ID NO: 361094 - RNA, 64 nt, Human
cugugagaugccuuugcuaagaggauaaaggaacugagaccagaugagaaaaagaaaggauaua

SEQ ID NO: 361095 - RNA, 64 nt, Human
gcugaggugggaggauugcuugaguccaggaguuugagaccagccugggcaacauggcgagacc

SEQ ID NO: 361096 - RNA, 64 nt, Human
gcagaguugggaggaucaccugaugucagggguuugagaccagccuggucaacauugcaaaacc

SEQ ID NO: 361097 - RNA, 64 nt, Human
ccacuguguccaguuuuauuuacacaaagcgagcugagaccacagguucuugcucuggaugagc

SEQ ID NO: 361098 - RNA, 64 nt, Human
gguaguggcagaauggccaugcccagguguguguugagaccauugacaacugcucguguacagg

SEQ ID NO: 361099 - RNA, 64 nt, Human
gccgaagcgaguggaucaccugaggucaggauuuugagaccagccugaccaacauggugaaacc

SEQ ID NO: 361100 - RNA, 64 nt, Human
auuuacucagucuuugcccugaauggucucagcuugagaccauuucaaacuggagagaagcaag

SEQ ID NO: 361101 - RNA, 64 nt, Human
aggccgaggcgggcggaucacgaggucaggagauugagaccagccugacuaacauggugaaauc

SEQ ID NO: 361102 - RNA, 64 nt, Human
cagggggagggguagccagcuugggcuguccccuugagaccaggacaagaggcuggggguguca

SEQ ID NO: 361103 - RNA, 64 nt, Human
uuuuguaacagcuggaccuuccauucuagaauuaugagaccaccuuggagaaagguguguggua

SEQ ID NO: 361104 - RNA, 64 nt, Human
aauaggaacacuugagacuaaugaaagagagaguugagaccaaucuuuauuuguacuggccaaa

SEQ ID NO: 361105 - RNA, 64 nt, Human
uggcugccacuuuaauauaacugaaaauucauuuugagaccaagcaggaucaaguuuguagaau

SEQ ID NO: 361106 - RNA, 64 nt, Human
gccgaggugggcggaucaccagaggucaagaguuugagaccagcuuggugaaacccugucucua

SEQ ID NO: 361107 - RNA, 64 nt, Human
caagcaauucucaugccucagccuccugaguagcugagaccacaggcacccgccaccacaccca

SEQ ID NO: 361108 - RNA, 64 nt, Human
acauaccugcccaauggccaaaggaaccgccuugugagaccaaauugcugaccugggucagugc

SEQ ID NO: 361109 - RNA, 64 nt, Human
aaucguugagaacacuuuucuauaugggugauuuugagaccaucguuacgcugugcguaaagaa

SEQ ID NO: 361110 - RNA, 64 nt, Human; identical to SEQ ID NO: 277297

SEQ ID NO: 361111 - RNA, 63 nt, Human; identical to SEQ ID NO: 277298

SEQ ID NO: 361112 - RNA, 64 nt, Human; identical to SEQ ID NO: 277300

SEQ ID NO: 361113 - RNA, 64 nt, Human
agggcucaaaacuccuggacaaguugcuggcuccugagaccaguauuuccuggagcugugccuc

SEQ ID NO: 361114 - RNA, 64 nt, Human
acugggauuaaucucuaaucaggugaguagaccaugagaccaaugugugcucacauuacccuuu

SEQ ID NO: 361115 - RNA, 64 nt, Human
caacagugcauguaccucuggaugucaucugaggugagaccaccgaggccuuuucucucugugu

SEQ ID NO: 361116 - RNA, 64 nt, Human
gacgccagaaggucagccguugaucaauggaggcugagaccaugaugcuugggcuuaggaucuu

SEQ ID NO: 361117 - RNA, 64 nt, Human
gucucagcuacuagggaggcugaggcaagaggcuugagaccaggagcucgaggcuguaaugugc

SEQ ID NO: 361118 - RNA, 64 nt, Human
auggcauaaaaauauuaaaucacaaauggauaagugagaccaaggcaauuuagcaaauucuacu

SEQ ID NO: 361119 - RNA, 64 nt, Human
agccacccaugacuuugugggcuccuuguuagccugagaccaggcuuugcagaggggcgggggg

SEQ ID NO: 361120 - RNA, 64 nt, Human
aaggaugagucugaggguuccgguugucuuggccugagaccacccaaggucuuuuaacagaaaa

SEQ ID NO: 361121 - RNA, 64 nt, Human
auggccagagugggucgucaaccucguguggagcugagaccaaggucugugggcucuaggcagc

SEQ ID NO: 361122 - RNA, 64 nt, Human
aaaccauauuugcauuccagaaccaaaucuuaaaugagaccaaaguccagguuagcacagguuu

SEQ ID NO: 361123 - RNA, 64 nt, Human
gcugaggcaggaggauuguuugaggccagaaauuugagaccagccugggcaacauagcaaaacc

SEQ ID NO: 361124 - RNA, 64 nt, Human
cggaugaauguagcccuuccaacaccugacagaaugagaccaaacgcagccagccagaucggga

SEQ ID NO: 361125 - RNA, 64 nt, Human
aggcugagguggguggaucacaaggucaggaguuugagaccagccuggccaagaugguaaaacc

SEQ ID NO: 361126 - RNA, 64 nt, Human
uucugccuucugggugagcuggcacucuucucccugagaccaaagauuugaccugucggucuug

SEQ ID NO: 361127 - RNA, 64 nt, Human
guauugucuguauuuggagacuuuaauuucugugugagaccaaaggaggagagauguguuuugu

SEQ ID NO: 361128 - RNA, 64 nt, Human
gccgaggcgaguggauuuccuaaggucaggaguuugagaccagccugagcaauguggugaaacc

SEQ ID NO: 361129 - RNA, 64 nt, Human
augacucuuaacaaugagucacauccauugauuuuacagggauuuuaguucguaauccagaaag

SEQ ID NO: 361130 - RNA, 64 nt, Human
gcccaagugauacucccaccucugccuuacaaaauacagggauuacuggugugagccacugugu

SEQ ID NO: 361131 - RNA, 64 nt, Human
acauuugccucauuuuuuaguguucguaugaaaguacagggacacggagccaagacagagucua

SEQ ID NO: 361132 - RNA, 64 nt, Human
gcugaagcaagcagaucacuugaggucaggaguuugagaccagccuggccaacauggugaaacc

SEQ ID NO: 361133 - RNA, 64 nt, Human
uuugcaacugaauuuaauguuauaacucaucuagugagaccaacuuacuaaauuuuuaguaugc

SEQ ID NO: 361134 - RNA, 64 nt, Human
guucggcugaauuugaagauuggaagacuuauauugagaccaguaacuuuacuguaaauuuacu

SEQ ID NO: 361135 - RNA, 64 nt, Human
caggccagcuuaaccucugaaacacaaaugaucuugagaccacuuuaguguacuuacauuuaga

SEQ ID NO: 361136 - RNA, 56 nt, Human
ugccagaucgucagcgcuaagggaacugagaccagagaaagaacccaagagaacua

SEQ ID NO: 361137 - RNA, 64 nt, Human
ucacaguguaaagcaggaaauggugugggagaugugagaccauucugaggucagcgauagccca

SEQ ID NO: 361138 - RNA, 64 nt, Human
uccaggugaaucacagcugaggaggaaauccagaugagaccaaugcacuucacaggcaagacug

SEQ ID NO: 361139 - RNA, 64 nt, Human
uaaacugcccacauaaauuuuaugucuguguguuugagaccaagagaaaggguguauuggcuug

SEQ ID NO: 361140 - RNA, 64 nt, Human
ucuuaauuccauuuccugagguaaaagauuagugugagaccaucauggugccagucuaggaccc

SEQ ID NO: 361141 - RNA, 64 nt, Human
aggcugaggcgggcagaucaugaggucaggaguuugagaccaggcuggccaacguggugaaacc

SEQ ID NO: 361142 - RNA, 64 nt, Human
gccgaggagagaggaucacuuaagcccaggagucugagaccagccugggcaacauagcaagacc

SEQ ID NO: 361143 - RNA, 64 nt, Human
ggccgaaugggcagaucacuugaggucaggaguuugagaccagccucgccaacauggugagacc

SEQ ID NO: 361144 - RNA, 64 nt, Human
accaaggcgggcagaucacuugaggucagaaguuugagaccagccaggccaacauggugaaacu

SEQ ID NO: 361145 - RNA, 64 nt, Human
gccaagagaggaagauugcuugagcccaggaguuugagaccaaucuaggcaauguagugagacc

SEQ ID NO: 361146 - RNA, 64 nt, Human
gccgaggcagguggaucaccugacgucaguaguuugagaccagccuggccaacauggugaaacc

SEQ ID NO: 361147 - RNA, 64 nt, Human
gcaaaggcgggaggaucacuugaggccaggacuuugagaccagccagggcaacauaauaagacu

SEQ ID NO: 361148 - RNA, 64 nt, Human
uuucagauauuuuugaugacuguauuguaaauacuacagggauagcacuauaguauuguaguca

SEQ ID NO: 361149 - RNA, 64 nt, Human
guaaacuuguuaaaaaucaaaaucuuacugauuguacagggagaaauuaagcauucuguuuuaa

SEQ ID NO: 361150 - RNA, 64 nt, Human
gacccccagcccggacaccucauuccccucccacuacagggaucaagugaccugggaagaaccg

SEQ ID NO: 361151 - RNA, 64 nt, Human
aggcugaggcaggcagaucaugaugucaggaguuugagaccagccuggccaauauggugaaacc

SEQ ID NO: 361152 - RNA, 64 nt, Human
ccaacagccuggggaagcucugcacagagugaccugagaccagguacaggaaaccuguagcuca

SEQ ID NO: 361153 - RNA, 64 nt, Human
aggugggagggucccuuccuugagcccagcaguuugagaccaauguagugagacucaucucugc

SEQ ID NO: 361154 - RNA, 64 nt, Human
gccaaggcgggcagaucaccuuaggucacgaguuugagaccagccugaccaacguuaaguaacc

SEQ ID NO: 361155 - RNA, 64 nt, Human
aggccgaggcgggcggaucacgaggucaggagauugagaccauccuggcuacgacggugaaacc

SEQ ID NO: 361156 - RNA, 64 nt, Human
gccgaggcaggaggaucaccugaggucaggaguuugagaccagucuggccaaaauaguggaacc

SEQ ID NO: 361157 - RNA, 64 nt, Human
gaaagaacguggguaagaugucccuucccagcccugagaccacuggucacaguuggccaccucc

SEQ ID NO: 361158 - RNA, 64 nt, Human
uucgcacaaucuagucgguaacagccacuuuccuugagaccaagagagugcgguggggaugggg

SEQ ID NO: 361159 - RNA, 64 nt, Human
ccucggacggcuccggacgcugcugccgugggccugagaccaaggcccccgggccgacggagcc

SEQ ID NO: 361160 - RNA, 64 nt, Human
gccaaggugggcggaucaccugagcucaggaguuugagaccagccugggcaacauggggaaacu

SEQ ID NO: 361161 - RNA, 64 nt, Human
gccaaggaggguggaucacuuaaggucaggaguuugagaccagccuggccaacauggcaaaacc

SEQ ID NO: 361162 - RNA, 64 nt, Human
ggauguggauuaugcuuaacagugagagcugaaaugagaccauuuacuuuguuuaaaaugcugu

SEQ ID NO: 361163 - RNA, 64 nt, Human
cagcgcuuugggaggcuaaggcaggcagaucacuugagaccagcuugggcaacauggcaaagcc

SEQ ID NO: 361164 - RNA, 64 nt, Human
auuaaauucugaaugcaauuuuuuuuuguucccuugagaccaaaauuuaaguuaacuguugcug

SEQ ID NO: 361165 - RNA, 64 nt, Human
gcugagguguggggauugcgugaagccacaaguuugagaccagccugguuagcaaggcaagauc

SEQ ID NO: 361166 - RNA, 64 nt, Human
cacaaccacuguagcaaaauaccuugacugcuugugagaccauuagcauugcaggccaaaccgu

SEQ ID NO: 361167 - RNA, 64 nt, Human
gagaggguaauauauugugacaauuuuugcaacuuacagggaauaggacaggucauuagggugu

SEQ ID NO: 361168 - RNA, 64 nt, Human
uuuaaaaaugaucccuccuggugauaacccauuuuacagggaugaagaaagaccaaugcugcuu

SEQ ID NO: 361169 - RNA, 64 nt, Human
aaagguuauuccuggacacaggaaagacgggcauuacagggaccaaagcucugaaaggugacuu

SEQ ID NO: 361170 - RNA, 64 nt, Human
aaagcuggcccugccuccugggaagaugagguucugagaccaguguaucaggucagggacuugg

SEQ ID NO: 361171 - RNA, 64 nt, Human
acagcaaugaagguagucauccauagacuugaaaugagaccacauauggggaugagauccuucu

SEQ ID NO: 361172 - RNA, 64 nt, Human
agcacauugggaagaucacuugaggcaaggaguuugagaccagacuggccaacacagcgagacc

SEQ ID NO: 361173 - RNA, 64 nt, Human
aggccgagguggguggaucacaagguugggagauugagaccauccuggcuaacacagugaaacc

SEQ ID NO: 361174 - RNA, 64 nt, Human
aucaggacuuacaucacuugcugcucuauggaguugagaccaccaaguaaagcauccugggcua

SEQ ID NO: 361175 - RNA, 64 nt, Human
uuuuuuccagugaggauagaccacaaguggguggugagaccauugaaagccuuuaucaacugaa

SEQ ID NO: 361176 - RNA, 64 nt, Human
gagggaacaggaaaugcugaucucuaccccugggugagaccagaaccucagggcugauacuguu

SEQ ID NO: 361177 - RNA, 64 nt, Human
caagugauccuccugacucagccucuugaauagcugagaccacaggcuugugucaccaugccca

SEQ ID NO: 361178 - RNA, 64 nt, Human
gccaaggugggcugaucacuugaucccaggaguuugagaccagccugggcaccauggugaaacc

SEQ ID NO: 361179 - RNA, 64 nt, Human
auuuguuuuguuuuuuaaaaacacuguaacucaaugagaccacaguauacuuggcccuugguaa

SEQ ID NO: 361180 - RNA, 64 nt, Human
aggccaaggcgggcagaccaugaggucaggagauugagaccauccuggccaacauggugaaacc

SEQ ID NO: 361181 - RNA, 60 nt, Human
uggcagggacuugcgguuaaucgaagucacugagaccauuugcaagaggcuccuggauua

SEQ ID NO: 361182 - RNA, 64 nt, Human
gccgaggcagacagaucaccugaggucaggaguuugagaccagccuggccaacauggcaaaacc

SEQ ID NO: 361183 - RNA, 64 nt, Human
gccgaggcagguggaucacucaaggucacaaguuugagaccagucuggccaacauggugaaacc

SEQ ID NO: 361184 - RNA, 64 nt, Human
ggaaacauuuuggaaacuucacaugcauuccgcuugagaccauaguguuuaaucuauggcacca

SEQ ID NO: 361185 - RNA, 64 nt, Human
gccaaggugggcagauaaccugcggucaggaguuugagaccaggcuggacaacauggugaaacc

SEQ ID NO: 361186 - RNA, 64 nt, Human
cuuggaaagaaacaaccguuggaaacauaaccauuacagggagcugggacacuuaacagaugca

SEQ ID NO: 361187 - RNA, 64 nt, Human
ggugcccagaauuuaccaucaucucugaaggaguuacagggaaguggucuccccaauucucccc

SEQ ID NO: 361188 - RNA, 64 nt, Human
uccuaagaguuuuacuagugcuuuuuugaggaauuacagggaagcuccuggaauuguacaugga

SEQ ID NO: 361189 - RNA, 64 nt, Human
gccaagaugggaggaucauuugagcccaggaguuugagaccagcuggggcaacauauggagacu

SEQ ID NO: 361190 - RNA, 64 nt, Human
gaauuugccucuuugggacugaagucuaaggggcugagaccaagaagggagagcacaagacuaa

SEQ ID NO: 361191 - RNA, 64 nt, Human
gcuaagauggguggaucacuugaggucaggaguuugagaccagccuggccaacauggcgaaacc

SEQ ID NO: 361192 - RNA, 64 nt, Human
gucagaagacuuaggaagcuuugccaguaguuccugagaccagaaauacauauuaugaagcagg

SEQ ID NO: 361193 - RNA, 64 nt, Human
ggcugcugcugcugcugggaaucuuccuugcuuaugagaccaagaguguguccacugagaagau

SEQ ID NO: 361194 - RNA, 64 nt, Human
auagccagucuggagacuugauaaaauacuucagugagaccagcuucucaucaacuugggcccg

SEQ ID NO: 361195 - RNA, 64 nt, Human
auguaaaaaaaaaaaaaaaaacaaaaaaaaacccugagaccaugaguggggcuggcaucuugcc

SEQ ID NO: 361196 - RNA, 64 nt, Human
ucauuuuuggcuaugaauaaacuuucuggucuuuugagaccacccauuuuuauagaucagaauc

SEQ ID NO: 361197 - RNA, 64 nt, Human
gcccaggaguuugagaccagcuaaggcaauauagugagaccaugucucuacagaaaaaauuuaa

SEQ ID NO: 361198 - RNA, 64 nt, Human
gcugagucgggaggauagcgugagcccaggaguuugagaccagcuaaggcaauauagugagacc

SEQ ID NO: 361199 - RNA, 64 nt, Human
uguugcuuccagaaacuaaagggaaagcuuugccugagaccaucgaggaagccgaaaauaugca

SEQ ID NO: 361200 - RNA, 62 nt, Human
gugacaagauagcuauuuaaagauaguuccccugagaccacuuguaaauagguuagauuggu

SEQ ID NO: 361201 - RNA, 64 nt, Human
gccaagguggguggaucaccugagggcaggagucugagaccagccuggccaacauagcaaaacc

SEQ ID NO: 361202 - RNA, 64 nt, Human
gccaagguaggaggauugcuugaagcuaggaguuugagaccagccugggcaacaggguaagguc

SEQ ID NO: 361203 - RNA, 64 nt, Human
caucagucauucacugaucagcagcuaaaguccaugagaccaaaugguuuuauauggaaccaac

SEQ ID NO: 361204 - RNA, 64 nt, Human
ccgaggugagcggaucaccugaggucaggaguuuugagaccagccuggccaacaugguaaaauc

SEQ ID NO: 361205 - RNA, 64 nt, Human
cuguucuuuguuuaagagcaauacuugucgugauuacagggagauccuuuaguaaaauuaaucc

SEQ ID NO: 361206 - RNA, 64 nt, Human
uccugcaaggacucagauguucaguaccuuaugauacagggaagauaguuuucuuacaaguagu

SEQ ID NO: 361207 - RNA, 64 nt, Human
gucccccugccuucucccacuccucacacucuucuacagggauaggcuuuugcaaauauaucag

SEQ ID NO: 361208 - RNA, 64 nt, Human
ucuguggcaggaggauugcuugaggccaggaguuugagaccagccugggcaacauagcgagacc

SEQ ID NO: 361209 - RNA, 64 nt, Human
gcugaggcgggcagaucaccugagaucgggaguuugagaccaagccugaccaauauggagaaac

SEQ ID NO: 361210 - RNA, 64 nt, Human
gccccacccagugagcagcagaagacaagcacucugagaccacacuuuaggccaccggugggac

SEQ ID NO: 361211 - RNA, 64 nt, Human
ccgcaguccaugccccauuguggaccacccacacugagaccaccugcccccaccucaguuauug

SEQ ID NO: 361212 - RNA, 64 nt, Human
cagccugccgccauuggaccucccuuuuaaaaacugagaccaagacucccaucagcuggucucg

SEQ ID NO: 361213 - RNA, 64 nt, Human
auagucguacaacaacccaggggauccagauacaugagaccagggcagcguucagcacacuccu

SEQ ID NO: 361214 - RNA, 64 nt, Human
guggaggcagccagggcuuaccuguacacugacuugagaccaguugaauaaaagugcacaccuu

SEQ ID NO: 361215 - RNA, 64 nt, Human
gccaaggcaggaggaucacuuggagccaggaguuugagaccagccugggcaacaaagugagacc

SEQ ID NO: 361216 - RNA, 64 nt, Human
ugcuuuuuucuuaugcaaaaauacuccuuuccggugagaccagauuaacuaucuccauguuugu

SEQ ID NO: 361217 - RNA, 64 nt, Human
gccaaggcaggcagaucacuugaggucaggcguuugagaccagccuggucaacauggcgaaacc

SEQ ID NO: 361218 - RNA, 64 nt, Human
uuuaaaauguugcaacugggaauauaccacgacaugagaccagguuauagcacaaauuagcacc

SEQ ID NO: 361219 - RNA, 64 nt, Human
acgaaacuucuaagguaucaucuguguuaagugaugagaccauauuucuuugauguuucugaac

SEQ ID NO: 361220 - RNA, 64 nt, Human
gccaagacgggaugauugcuugagcucaggaguuugagaccaggcugggcaucauagcaagacc

SEQ ID NO: 361221 - RNA, 64 nt, Human
aagaaaacuuugagggcccaaguccacaauuuggugagaccacuaaauuuuacauauaauuaua

SEQ ID NO: 361222 - RNA, 64 nt, Human
ucauauaucugucucucuccugcaagaaucuaccugagaccaugccacuagcuuuuaagggcua

SEQ ID NO: 361223 - RNA, 64 nt, Human
gcccaggugggaggaucgcuugagcccagaaguuugagaccagccuaggcaacauugcaagacu

SEQ ID NO: 361224 - RNA, 64 nt, Human
cagggggcccuaccuccucagcucugugcuuggauacagggagcagccaggagacucccuagug

SEQ ID NO: 361225 - RNA, 64 nt, Human
aaaacgauuucuaaagcaacagcagguauuuuuguacagggaaguuuaaauguguuuguguaug

SEQ ID NO: 361226 - RNA, 64 nt, Human
aucagcacugauuauccagaaacauuggagaggguacagggaaaggaaaaauuuucaccaacag

SEQ ID NO: 361227 - RNA, 64 nt, Human
guagacugauggaacagaauagagaauuuagaaaugagaccacacaccuauaauuuuuuugauc

SEQ ID NO: 361228 - RNA, 64 nt, Human
cugcuuugaagcggagaccauuuccaggccuuauugagaccagaccccaagucccccaccccca

SEQ ID NO: 361229 - RNA, 64 nt, Human
aagugguguauugucacaguagcuuauuugaacuugagaccauuguaagcaugacccaaccuac

SEQ ID NO: 361230 - RNA, 64 nt, Human
gcugaggcaggcggaucacuugaugccagaaguuugagaccagcccagccaacauggugaaacc

SEQ ID NO: 361231 - RNA, 64 nt, Human
gccgaggcaggcagauuauuugagcucaggaguuugagaccauccugggcaacauggcgaaacc

SEQ ID NO: 361232 - RNA, 64 nt, Human
cuauaaucccagcacuuugggaggcugaggcaguugagaccaggaguucgaguccagccugacc

SEQ ID NO: 361233 - RNA, 64 nt, Human
gccgaggcauguggaucaccugaggucaggaguuugagaccagccuagacaacauggugaaacc

SEQ ID NO: 361234 - RNA, 64 nt, Human
gcugaggcagguggauugcuugagcucgggaguuugagaccagccucaucaacacagugaaacu

SEQ ID NO: 361235 - RNA, 64 nt, Human
caacuuccucugccauguuuuuccccugcuccccugagaccacccccaaacacaaaacauucau

SEQ ID NO: 361236 - RNA, 64 nt, Human
caucuaucaguaguauaggucucaauauuuauuaugagaccaguggucuggaaacagcuuguug

SEQ ID NO: 361237 - RNA, 64 nt, Human
gggugagccaaucugcaauuucuacuacaggcauugagaccaguuagauuauugaaauauuaua

SEQ ID NO: 361238 - RNA, 64 nt, Human
ucagccuugccauguaucaguuucacuugaaauuugagaccaauuaaauuucaacuguuuaggg

SEQ ID NO: 361239 - RNA, 64 nt, Human
gcauauuuguuacuuuacuuuugcuguuuauacuugagaccaacuuuucaaugugauucuucua

SEQ ID NO: 361240 - RNA, 64 nt, Human
cccuagagccaccucuuugacccuuuacccacccugagaccagaacuugcagccccucugcaga

SEQ ID NO: 361241 - RNA, 64 nt, Human
uaacauggcuggaugaaagaaaugaccuucauucugagaccaaaguagauuuacagaacaaagu

SEQ ID NO: 361242 - RNA, 64 nt, Human
ggugggcguggcaugugcuuuuuaaaacaucaucugagaccagccaguagucacagaacugcug

SEQ ID NO: 361243 - RNA, 64 nt, Human
uuuuguaauuuuuauggauuuaugucacuuuuauuacagggauauauugcauaguggugaaauc

SEQ ID NO: 361244 - RNA, 64 nt, Human
uguggugugauuauucugaagauaaaugucuggcuacagggaauauuuuguacuaaaaaaugau

SEQ ID NO: 361245 - RNA, 64 nt, Human
aaggcucacaccucauaccagcauacgcucaccuuacagggaaauggguuuauccaggaucaug

SEQ ID NO: 361246 - RNA, 64 nt, Human
cuauaauuccagaaagucacacagcuccucuguaugagaccagugggcgccauuuaaaagaaca

SEQ ID NO: 361247 - RNA, 64 nt, Human
accucugauggcacuuguugacaaaucauucaagugagaccauguuacuagacaugaucuugaa

SEQ ID NO: 361248 - RNA, 64 nt, Human
gccgaggugggcagaucacuugaggccaggagauugagaccagccugaccgucauggcgaaacc

SEQ ID NO: 361249 - RNA, 64 nt, Human
acaagcaaaucaacauaguugcugcaggcggaacugagaccagccucucugggcgaugaaggac

SEQ ID NO: 361250 - RNA, 64 nt, Human
aagcgggggugcagaucaccugaggucaggaguuugagaccagccuggccaauguggugaaacc

SEQ ID NO: 361251 - RNA, 64 nt, Human
uucugucuuguccccacccaugcgccuucgugccugagaccaggguggccacacaggcagggcc

SEQ ID NO: 361252 - RNA, 64 nt, Human
cagccagugagugggcacccaaugccucucaggaugagaccaguaaaugccggagguggagcug

SEQ ID NO: 361253 - RNA, 64 nt, Human
gcccaggaugaaggggccagaccacgccccugccugagaccacgguccaauccagccuucuucc

SEQ ID NO: 361254 - RNA, 64 nt, Human
uuccugagacuugagguuguggcuuauacuggaaugagaccacuguacguguaggugguucaga

SEQ ID NO: 361255 - RNA, 64 nt, Human
caagugauccuuccaccucagucucccagcuaauugagaccacaggcuuguuaccaccaugcuc

SEQ ID NO: 361256 - RNA, 64 nt, Human
ccuucccuacacuagaaguccccacaaaggcuucugagaccacaaaauacaaggccagaccuag

SEQ ID NO: 361257 - RNA, 64 nt, Human
gccgaggugggcggaucaccugaggucgggaguuugagaccagccugaccaacauggagaaacc

SEQ ID NO: 361258 - RNA, 64 nt, Human
gagcugcugccuuuggggacccacgcuccaaggcugagaccaguucccuggaggccacccaccc

SEQ ID NO: 361259 - RNA, 64 nt, Human
auguauaaaauggucauggggaugaaaggaucucugagaccacagaggcucagacucacuguua

SEQ ID NO: 361260 - RNA, 64 nt, Human
ugcuggccuccaagcuggcagugggaagggcuagugagaccacacagggguagccccagcagca

SEQ ID NO: 361261 - RNA, 64 nt, Human
uuuugggugaguuuccccccuccuuauucuguccugagaccacgggcaaagcucuucauuuuga

SEQ ID NO: 361262 - RNA, 64 nt, Human
gaggcucaagccuucacagugagcugauggucucuacagggaggggagucuagggaauuuauuu

SEQ ID NO: 361263 - RNA, 64 nt, Human
uugauaggaaggaaacuggaauucuuuguacuaauacagggagcacacuccuucaguucagcaa

SEQ ID NO: 361264 - RNA, 64 nt, Human
uucuaaaaugccaaacauguuggcaucaauuuuauacagggauauaaaaaaguauauguggaua

SEQ ID NO: 361265 - RNA, 64 nt, Human
ggucgagguggguggaucacuuggggucaggguuugagaccagccuggccaacauggcggaacc

SEQ ID NO: 361266 - RNA, 64 nt, Human
ccuucugaugagaacuaggaggguuugccuucucugagaccagcuauuacaacugugccucuag

SEQ ID NO: 361267 - RNA, 64 nt, Human
aucguuugagaauauaucuccuugcccaagaguuugagaccagccuggacaacauaaugagacc

SEQ ID NO: 361268 - RNA, 64 nt, Human
gucaagguggguggguugcuugagcucaggaguuugagaccagccugggcaacauggcacaauu

SEQ ID NO: 361269 - RNA, 64 nt, Human
cagcacuuugggaggccaaggcagaaggaucacuugagaccaggaguucgagaccagccugaga

SEQ ID NO: 361270 - RNA, 64 nt, Human
gugagccucgcacagcucagccccaacacagaggugagaccaggaauaaggccacaaguaucuc

SEQ ID NO: 361271 - RNA, 64 nt, Human
uggccugggaacccagggauuucaccuccaccagugagaccacggggccacuguggggugaggg

SEQ ID NO: 361272 - RNA, 64 nt, Human
cgagccuuggaggagcacuggcaguugguggcagugagaccagcccacccaccaccacccacca

SEQ ID NO: 361273 - RNA, 64 nt, Human
aggccgaggugggcggaucacgaggucuggaguuugagaccauccuggcuaacacagugaaauc

SEQ ID NO: 361274 - RNA, 64 nt, Human
gcugaggcggguggauugcuugagcccaggaguuugagaccagccuggccaacguggcaaaacc

SEQ ID NO: 361275 - RNA, 64 nt, Human
accgaggcggguggaucacuugaagucaggaguuugagaccagccuggccaacauggugaaacc

SEQ ID NO: 361276 - RNA, 64 nt, Human
gagacaaaagcuggaggaggguagggagagaagcugagaccaggaccggugggguacaaagggg

SEQ ID NO: 361277 - RNA, 64 nt, Human
gagcuuguccgccaugcuguacccugcaacauccugagaccaaagaccuugugcccuucccagg

SEQ ID NO: 361278 - RNA, 64 nt, Human
cuauaaucccaacacuuugggaggccaggaguuuugagaccagccugggaaacaucugucucua

SEQ ID NO: 361279 - RNA, 64 nt, Human
uagucuguuuucacgcugcugauaaagacauaccugagaccaggaagaaaaagagguuuaauug

SEQ ID NO: 361280 - RNA, 64 nt, Human
uacuccaguucccaaaaaguuuuucaucuccaucugagaccaccucagccugaauuuuauuguc

SEQ ID NO: 361281 - RNA, 64 nt, Human
uucaagugauucugaugcaggugagcugggggcauacagggaggaacacugcccuggacuaucc

SEQ ID NO: 361282 - RNA, 64 nt, Human
acuaucagcccaagaugcuuuaagugcacaacauuacagggaaugccugagugccuggccaaag

SEQ ID NO: 361283 - RNA, 64 nt, Human
aauugccagaaagauauaaaacugguuaggguccuacagggaaauaaaauuauaaccguggagg

SEQ ID NO: 361284 - RNA, 64 nt, Human
uaaaagcuaaauuauuuuugaauggaaauacuacugagaccauugacacuggauaacaguaaug

SEQ ID NO: 361285 - RNA, 64 nt, Human
gcggaggcaggcggguugcuugagcuccggagcuugagaccagccugagcaacauggcgaaacc

SEQ ID NO: 361286 - RNA, 64 nt, Human
accaaggcgggagcaucucuugaggccaggaguuugagaccagccugggcagcauagcaagaca

SEQ ID NO: 361287 - RNA, 64 nt, Human
gccaaggugggaagauugccugagcucaggaguuugagaccagccugggcaacacggugaaacc

SEQ ID NO: 361288 - RNA, 64 nt, Human
gccaaggcgggcaaaucaccugaggucaagaguuugagaccagccuggccaacauggugaaacc

SEQ ID NO: 361289 - RNA, 64 nt, Human
uguugguuucauuugaauaaucagaugcugguguugagaccaaguaugauugacauaaucauuc

SEQ ID NO: 361290 - RNA, 64 nt, Human
agcagcugccgaaagcugcagccuuuccgcacucugagaccaugaucuuccuccugccagggga

SEQ ID NO: 361291 - RNA, 64 nt, Human
gucacaguagaggccccacaaggaccugcuugggugagaccaccucuccccucucagcagcgcu

SEQ ID NO: 361292 - RNA, 64 nt, Human
ggcugagguggaaggaucacuugaagccagaguuugagaccagccugugcaacacagcaagacc

SEQ ID NO: 361293 - RNA, 64 nt, Human
aggcugaggcggguggaucacgaggucaggagauugagaccauccuggccaacauggugaaacc

SEQ ID NO: 361294 - RNA, 64 nt, Human
acugcaacagucugucuuucugccuacauccgccugagaccaaggagggucuuugguacagucc

SEQ ID NO: 361295 - RNA, 64 nt, Human
auuagguuuggguuauugaacuauuuuuuacuuuugagaccacaaccauauucaauaucauacc

SEQ ID NO: 361296 - RNA, 64 nt, Human
cucuguagaccaacauccagugugauuuugugucugagaccacaccccaguagcagguuacgcc

SEQ ID NO: 361297 - RNA, 64 nt, Human
gugggagaggccugaugccguuucugcuuucugcugagaccacccccacccugacaccaucagu

SEQ ID NO: 361298 - RNA, 64 nt, Human
agcaaauggcucugacaggguggccaugagcagaugagaccagcucuugcuugguuggaagcca

SEQ ID NO: 361299 - RNA, 64 nt, Human
ucagauaucgugccucuuagugccaaacccacagugagaccaaaagugucagguguuuuuuuuu

SEQ ID NO: 361300 - RNA, 64 nt, Human
agugaaggcugcuaugaccuguguucacucugguuacagggaggugcaaaccauucugucuccc

SEQ ID NO: 361301 - RNA, 64 nt, Human
cauaucuaagauuuuucuaccugccccucuucaguacagggauggcuggcugcucaacacacuc

SEQ ID NO: 361302 - RNA, 64 nt, Human
ucuugauguuuauuggcucauguggacagaaauguacagggagaauuacauuauuuuaacacac

SEQ ID NO: 361303 - RNA, 64 nt, Human
ugggccuugcugcugcugcacccaacuacugagcugagaccacugaguaccaggggcugggcuc

SEQ ID NO: 361304 - RNA, 64 nt, Human
gagacucagauucugcaccugaguucaucucuacugagaccaucucuuccuuucuuuccccuuc

SEQ ID NO: 361305 - RNA, 64 nt, Human
cauguucuagaaccccagaauggcccaaguuaccugagaccaggguuucucaaccuugacacca

SEQ ID NO: 361306 - RNA, 64 nt, Human
ggauaggugggcggaucaccugaggucaggaguuugagaccagccuggccaacauggcaaaacc

SEQ ID NO: 361307 - RNA, 64 nt, Human
aggccgaggugggcagaucacgaagucaguaguuugagaccagccuggccaacauagugaaacc

SEQ ID NO: 361308 - RNA, 64 nt, Human
gccgagguggacggaucacccgaggucaggaguuugagaccagccuggccaacaaggugaaacc

SEQ ID NO: 361309 - RNA, 64 nt, Human
gcugaggcaggaggacuguuugagcccaggaguuugagaccaaccugaguaagguggcaaaacc

SEQ ID NO: 361310 - RNA, 64 nt, Human
uauucauauuuauagccagguaccuucucaccugugagaccaaauugagcuaggggggucagcc

SEQ ID NO: 361311 - RNA, 64 nt, Human
ucaugaaauggugggagagagucugcugcaagggugagaccaggcagccugcugggccacacug

SEQ ID NO: 361312 - RNA, 64 nt, Human
aagacauagcagaauuccuuagguaugggauuuaugagaccaguaccugaacugucaucauucc

SEQ ID NO: 361313 - RNA, 64 nt, Human
gccaaggcaggaggacugcuugagcccaggaguuugagaccagccugggcaauguagcaagacc

SEQ ID NO: 361314 - RNA, 64 nt, Human
gcccaggaguucgagaccagccagagcaacauagugagaccacaucucuaccaguaaauaaaua

SEQ ID NO: 361315 - RNA, 64 nt, Human
gccgagguggguggaucauuugagguuaggaguuugagaccagccuggccaacauggcgaaauc

SEQ ID NO: 361316 - RNA, 64 nt, Human
cugaggcuagguggguugaaagccaaggagucacugagaccaaggcuuucucuacugauuccgc

SEQ ID NO: 361317 - RNA, 64 nt, Human
cacaccagauaucgacagaguggucuucucugccugagaccaccucucacuacauccauuaucc

SEQ ID NO: 361318 - RNA, 64 nt, Human
cagcacuuugggaggccgaggcgggcggaucacuugagaccaggaguucgagaccagccuggcc

SEQ ID NO: 361319 - RNA, 64 nt, Human
auccucucaucuuggccucccaaagugcugggauuacagggacgagccaccacaccccaccuau

SEQ ID NO: 361320 - RNA, 64 nt, Human
aguuucugcaaccuaacguuuaauaguccgggucuacagggaagaacaaugacacagcuugagc

SEQ ID NO: 361321 - RNA, 64 nt, Human
acccuaugggacuccucuuuuccacugugagaucuacagggaagccaaaagaaugaucuagagu

SEQ ID NO: 361322 - RNA, 64 nt, Human
aaauuuucaaaauuaauugauguuuuaaaaauguugagaccaaaguaguauagaaguauggacu

SEQ ID NO: 361323 - RNA, 64 nt, Human
agugguagugaugggauucaaaccuggguggcccugagaccagagcuuccgcucuacccacuuc

SEQ ID NO: 361324 - RNA, 64 nt, Human
cucuaggaagggccugcuaauaaggucuagggucugagaccaaguuuuuucuaaucucagcccc

SEQ ID NO: 361325 - RNA, 51 nt, Human
gucccagcuuugagaaguaacugagaccaugcccgggccucuucacugcug

SEQ ID NO: 361326 - RNA, 64 nt, Human
ggaagaagguuugaaagauacgguugucuagaggugagaccaaaggauccagagacuuggggac

SEQ ID NO: 361327 - RNA, 64 nt, Human
aaacccuccaagugauuuugauguauucuaauuuugagaccaucucuagaaaagaauugcuacc

SEQ ID NO: 361328 - RNA, 64 nt, Human
aagcacguaucuuuagucucuuugauauuuauucugagaccaagggcuugcuugaccugaugau

SEQ ID NO: 361329 - RNA, 64 nt, Human
gccgagaugggcggaucuuuugaggucaggaguuugagaccagccuggccaacauggugaaacc

SEQ ID NO: 361330 - RNA, 64 nt, Human
gcagagagguggguggcgggcaccucaugccagcugagaccaagagugguuguauacauuucug

SEQ ID NO: 361331 - RNA, 64 nt, Human
ugagagaaggagcaagaggcagaaacacugacucugagaccaugaccuuggaagauccucagag

SEQ ID NO: 361332 - RNA, 64 nt, Human
cuuauuacuuauuugugcgaagugccuuaugcuaugagaccauucagaauaucaucuuuuagac

SEQ ID NO: 361333 - RNA, 64 nt, Human
auuuugagauggauuuaaucucccacaguauucaugagaccaucugauggaaucagaucccuga

SEQ ID NO: 361334 - RNA, 64 nt, Human
cguucccacuugauuuagccauuuucuuccauugugagaccacugccaucuauccaccugccca

SEQ ID NO: 361335 - RNA, 64 nt, Human
aagaugaucacuuuaagguggauaaugaugaaaaugagaccaguuaucuuuaagaacggucagc

SEQ ID NO: 361336 - RNA, 64 nt, Human
aggccgaggugggagaaucacaaggucaggagacugagaccauccuggcuaacaccaugauggg

SEQ ID NO: 361337 - RNA, 64 nt, Human
cuaauugaggacaauuuuuuuuuaauuuccuaaaugagaccaccuuggauuuuuauuuuugcca

SEQ ID NO: 361338 - RNA, 64 nt, Human
uauaggaaauuuggaugaagggagcuagaagaaauacagggauuuuuuuuuuuuuuuaagaugg

SEQ ID NO: 361339 - RNA, 64 nt, Human
gggauuacaggcuugagccaccgggugaccggcuuacagggauauuuuuaaucccguuauggac

SEQ ID NO: 361340 - RNA, 64 nt, Human
uauaggaaauuuggaucaaggaagcuaaaagaauuacagggauguuuuuaaucccacuauggac

SEQ ID NO: 361341 - RNA, 64 nt, Human
aaaagagcugauucaaguaaguagaugccuguuuugagaccagaagguuucauaauugguucua

SEQ ID NO: 361342 - RNA, 64 nt, Human
gcugaggcagaaggauuaccugaggcaaggaguuugagaccagcuuagccaacauaguaagacc

SEQ ID NO: 361343 - RNA, 64 nt, Human
uguguguggaauugcuaaaggucaagauauucagugagaccagcuuaaaugaauaguuguuauu

SEQ ID NO: 361344 - RNA, 64 nt, Human
auaccacaucgugaaaucuuuuauuuuuuuacucugagaccagcaccagauguaaguaagcauc

SEQ ID NO: 361345 - RNA, 64 nt, Human
gccccagggcagccccggaggacaggcaagggccugagaccacugccgacucaaagccaaagcg

SEQ ID NO: 361346 - RNA, 64 nt, Human
gcugagguggguggaucacuugaggucaggaguuugagaccagccuggguaauauggcaaaacc

SEQ ID NO: 361347 - RNA, 64 nt, Human
cuaaagaugugcuuccuccgugucugucauacacugagaccaacaggcuacagugucccugauu

SEQ ID NO: 361348 - RNA, 64 nt, Human
gccgagccgggcggaucaccuguggucaggaguuugagaccagccuggccaacauggcaaaacc

SEQ ID NO: 361349 - RNA, 64 nt, Human
uuuucauuuaggugaggaagcaaaagcaucuaugugagaccauuuagcacacugcuugugaaag

SEQ ID NO: 361350 - RNA, 64 nt, Human
aaaagccaacaguaagccccaggaaaggguuuuuugagaccauauguaugcuauuaaaauauau

SEQ ID NO: 361351 - RNA, 61 nt, Human
aaccaccuuccacaccauaaugccuccaaaaugagaccaugauauuaagcaucuaggauca

SEQ ID NO: 361352 - RNA, 64 nt, Human
gcacuccauucgaaugcagaaccucaccucuaguugagaccaagaauuggcaaauuugcaugag

SEQ ID NO: 361353 - RNA, 64 nt, Human
augcaguuuugcacaagguagaaguuagugacccugagaccaucuuaccacccuggaccugguc

SEQ ID NO: 361354 - RNA, 64 nt, Human
cacgcuugccccugggccugggugggggccggaaugagaccacaugagagcgcagagagguggg

SEQ ID NO: 361355 - RNA, 64 nt, Human
cucucuacagcuguuuccucagagggaaaaaucuugagaccagaugguggagcucuggagucag

SEQ ID NO: 361356 - RNA, 56 nt, Human
cuuaugacuuggacacauagacugaaugagaccaaaggaaaagcuuaacauacuac

SEQ ID NO: 361357 - RNA, 64 nt, Human
auccaccugccucggccucccaaagugcugggauuacagggaugagccaccgcgcccagccuca

SEQ ID NO: 361358 - RNA, 64 nt, Human
gaguagggggugggagagggaagaggagagaaaauacagggacuuugaaccuaggccaucuccu

SEQ ID NO: 361359 - RNA, 64 nt, Human
guucugaguccacuucuuuuuuccuaaauaacacuacagggauuuugucauauuagauuuaauu

SEQ ID NO: 361360 - RNA, 64 nt, Human
ccaaggcaggcagaucacuuugaggucaggaguuugagaccagccuggccaacauggagaaccc

SEQ ID NO: 361361 - RNA, 64 nt, Human
aguggaaauauggcugaaugagcgucuaaaucguugagaccagugcaacuuugggugcaaggcu

SEQ ID NO: 361362 - RNA, 64 nt, Human
gccgaggcaggcagaucaccugaggucaggaguuugagaccagccuggucaacaugguaaaacc

SEQ ID NO: 361363 - RNA, 64 nt, Human
gcugaggcggguggaucaccugaggucgggaguuugagaccagccuggccaacauggugaaacc

SEQ ID NO: 361364 - RNA, 64 nt, Human
uccgucccuuccagaucuggcaggggaucgacauugagaccaagaugcacguccgcuuccuuaa

SEQ ID NO: 361365 - RNA, 64 nt, Human
aaacccuggggugaccaagguuuggaaagccaccugagaccacuucauagcaagggaaggcuuu

SEQ ID NO: 361366 - RNA, 64 nt, Human
ucuuucuuaaggcaaggcaugcauaagagucauuugagaccaugugucccaucucaagccacag

SEQ ID NO: 361367 - RNA, 64 nt, Human
gccgaggcaggcggaucaccugaggucaggaguuugagaccagccugacauggugaaaccccau

SEQ ID NO: 361368 - RNA, 64 nt, Human
gaggccgagauggguggaucaugaggucagcaguugagaccagccugaacaacauggugaaacc

SEQ ID NO: 361369 - RNA, 64 nt, Human
cuucugcugaaggcaugauguaugcggcuccacuugagaccagguaucaggauguucagaggga

SEQ ID NO: 361370 - RNA, 64 nt, Human
cuuaguauauuccaaccuaagauaguuaacuaccugagaccagcugugauguuuaaagacauaa

SEQ ID NO: 361371 - RNA, 64 nt, Human
aaggauaaaacaaauacauaugggaaaaaguacuugagaccaaggccagcaucaauuccagaca

SEQ ID NO: 361372 - RNA, 64 nt, Human
uuuacaaucugaaagacaggguuuuuaacuaacaugagaccaaaacuauguucuuugauuaguu

SEQ ID NO: 361373 - RNA, 64 nt, Human
gcugaggugggaggauugcuucagcccaggaguuugagaccagccugggcaacauagcaaaacc

SEQ ID NO: 361374 - RNA, 64 nt, Human
ggccaaagggggaagaucucuugagguaagaauuugagaccagccugggcaaaauagaccccau

SEQ ID NO: 361375 - RNA, 64 nt, Human
gcugagaugggaggaucacuugaggccaagaguuugagaccaaccuggguaacaaagugagacc

SEQ ID NO: 361376 - RNA, 64 nt, Human
acccucccaccuuagccucccuaguagcugggacuacagggauguaccaccacacccagcuaau

SEQ ID NO: 361377 - RNA, 64 nt, Human
uaugaaaguuaauuugaauguugaauguuugaauuacagggaagaaaucaaguuaauguacuuu

SEQ ID NO: 361378 - RNA, 64 nt, Human
gcucacugcuaagaauauuugaauguaugcuucauacagggaugguguucaaaaaacuuguaaa

SEQ ID NO: 361379 - RNA, 64 nt, Human
uucugaugacgccugucugugugcaucauguuucugagaccacaguuuaccucaggugugccug

SEQ ID NO: 361380 - RNA, 64 nt, Human
gacgaggcggguggaucacucgaugucaggaguuugagaccagccuggccaacaugguaaaacg

SEQ ID NO: 361381 - RNA, 64 nt, Human
gccgaggcagguggaucaccugaggucaggaguuugagaccagccuggccaacauggugaaacc

SEQ ID NO: 361382 - RNA, 64 nt, Human
gccaaagcugauggaucgcuugagcccaggaguuugagaccagccugggcaacauggcaaaacc

SEQ ID NO: 361383 - RNA, 64 nt, Human
gccgagauagguggaucaccugaagucagguguuugagaccagccuggccaacaugguggaacc

SEQ ID NO: 361384 - RNA, 64 nt, Human
gcugaagcaggaggauugcuugaggccaggaguuugagaccagccugggcaacauagggagacc

SEQ ID NO: 361385 - RNA, 64 nt, Human
uauguuaauuccucugauauguuaaaguaaugggugagaccagaaaaagaaauuucaauaacag

SEQ ID NO: 361386 - RNA, 64 nt, Human
gccaaagcaggcggaucaccugaggucaggaguuugagaccagccgggccaacauggugcaacc

SEQ ID NO: 361387 - RNA, 64 nt, Human
gagcgggcugaggaaacccagagggaccaagcgcugagaccaaaguugacccucggguaggguu

SEQ ID NO: 361388 - RNA, 64 nt, Human
uggggucgcuggaggugauccuaggaucugucucugagaccaaugugcuguuucagcccccugc

SEQ ID NO: 361389 - RNA, 64 nt, Human
uugugcugcugauuaccugucuuauguaacuacuugagaccaucugcaagagacaugauuuagu

SEQ ID NO: 361390 - RNA, 64 nt, Human
uucggcuuauuguccauuagaaaaucacuuccauugagaccagacauggagcaacacuuuuuuu

SEQ ID NO: 361391 - RNA, 64 nt, Human
uugggaggccacggaucacuugaggacagggguuugagaccagcuuggccaacauggugaaacc

SEQ ID NO: 361392 - RNA, 64 nt, Human
cggugcuaagagcugugggaaacaugaagagcaaugagaccaggucccugcucugaggagacgu

SEQ ID NO: 361393 - RNA, 64 nt, Human
aggcugaggugggcagaucacaaggucaggaguuugagaccagccugaccaaaauggugaaacc

SEQ ID NO: 361394 - RNA, 64 nt, Human
acugcggagccugcuccacugccaccacggagugugagaccaucugaggccgcuagcugcucuc

SEQ ID NO: 361395 - RNA, 64 nt, Human
acagaaagcugcaagaauggcacuuuuugauucauacagggauuucuuaugucuuuggcuacac

SEQ ID NO: 361396 - RNA, 64 nt, Human
uucccaucuuugugccuguacuuaugcagcuuucuacagggagaguuugguuuggggucuauau

SEQ ID NO: 361397 - RNA, 63 nt, Human; identical to SEQ ID NO: 277340

SEQ ID NO: 361398 - RNA, 64 nt, Human
auugagaaggaacugauacaucugaugcaugcuuugagaccagaagaaaagacuuaccugaaua

SEQ ID NO: 361399 - RNA, 64 nt, Human
ugagagaugcugagaugacuacagaaauuaacuuugagaccagaauuacagagaagaaaaacca

SEQ ID NO: 361400 - RNA, 64 nt, Human
uggaccaggguggaaaugccucuucuugguuuaaugagaccagccucagcugacucacagagcu

SEQ ID NO: 361401 - RNA, 64 nt, Human
gagacgccaauagcaauaucuaggaaauuugcauugagaccauuguauuuuccacuagcaguga

SEQ ID NO: 361402 - RNA, 64 nt, Human
gccgagacgggaggaucaguugaggucaggaguuugagaccagccucggcaacauggcaaaauc

SEQ ID NO: 361403 - RNA, 64 nt, Human
uucacuguaggcauuauggcuccuccaccugguaugagaccacccaugggcccaccaauugggc

SEQ ID NO: 361404 - RNA, 64 nt, Human
auugcacugcugcauuccagccagggugacagagugagaccauguuucaaacaagaaacauuuc

SEQ ID NO: 361405 - RNA, 64 nt, Human
agcuuuuugguaaucaauacuucucucagaaguaugagaccauccucugcacucugcucuguca

SEQ ID NO: 361406 - RNA, 64 nt, Human
gccgaggcgggcggaucaccugaagucaggaguuugagaccagccugaccaacaugaugaaacc

SEQ ID NO: 361407 - RNA, 64 nt, Human
acgccgaggcggguggaucaugaggucaaaagauugagaccauccuggccaacauggugaaacc

SEQ ID NO: 361408 - RNA, 64 nt, Human
gugggaggcagggaggggagcaucugucugccacugagaccaaucacagccucuuugcacagca

SEQ ID NO: 361409 - RNA, 64 nt, Human
uuugagucacaagccaaguuuucgcccugucuccugagaccauuucccuacgcuuugcugcugc

SEQ ID NO: 361410 - RNA, 64 nt, Human
uaagaaaaguaaucaagaccugcuccuaagcauaugagaccagauguaauuaaucaauggcaau

SEQ ID NO: 361411 - RNA, 64 nt, Human
gccaaggcagaaagauagcuugaguccaggaguuugagaccagccugggcaacauagugauacc

SEQ ID NO: 361412 - RNA, 64 nt, Human
gccgaggcggguggaucacucaaggucaggcauuugagaccagccuggccaacauagugaaacc

SEQ ID NO: 361413 - RNA, 64 nt, Human
gaugauucugugacucauagaacaugauguuaaaugagaccagacucaacugccaccagucccc

SEQ ID NO: 361414 - RNA, 64 nt, Human
accccucugcucuuccgcaucaccccauccaccuuacagggaccagggggcccacguaaccagg

SEQ ID NO: 361415 - RNA, 64 nt, Human
uggguaucacacccaagacuacccaccaagcucauacagggaaccacacccaacacuuagacau

SEQ ID NO: 361416 - RNA, 64 nt, Human
uucauauacaccaaauaaugucucaucucuauaguacagggaauauaaaauugguuuccugugg

SEQ ID NO: 361417 - RNA, 64 nt, Human
ucccugggagccaguggucagacaccauuucaccugagaccaauaggugcacccucugaggccc

SEQ ID NO: 361418 - RNA, 64 nt, Human
ugcucagcacagcccuggauugcagccccgaggcugagaccagacaaagcccgggaggcagaaa

SEQ ID NO: 361419 - RNA, 64 nt, Human
gccaaggugggaggaucgcuugagcccaggaguuugagaccagccuggccaacacaguaaaccc

SEQ ID NO: 361420 - RNA, 64 nt, Human
gaaauccagaccugaguuuggaagacugauuuuuugagaccaucccuguguuuggaguggauaa

SEQ ID NO: 361421 - RNA, 64 nt, Human
uguccugggccugggaaacuagguucccagggguugagaccagaaaggugaccaagacagauuu

SEQ ID NO: 361422 - RNA, 64 nt, Human
gccgaggcgggcggaucaccugagguggggaguaugagaccacccugacuaacauggagagacc

SEQ ID NO: 361423 - RNA, 64 nt, Human
gccagggugggaggaucacuugagcucaggaguuugagaccagccuagacaacauacuacgacc

SEQ ID NO: 361424 - RNA, 64 nt, Human
uacucgggaggcugagugaggcaggaggaucacuugagaccaggagguuguggcuguagugagu

SEQ ID NO: 361425 - RNA, 64 nt, Human
cauucaguaggagcauuugggcuuccggggccccugagaccaaagaagaggggccaaguacccu

SEQ ID NO: 361426 - RNA, 64 nt, Human
cagcuauucaggaggcugaggcaggagaaucacuugagaccaggaaguugaggcugcaaugagc

SEQ ID NO: 361427 - RNA, 64 nt, Human
ucagugacugacagaggauccggaucucagagccugagaccagguuuauuggggccuggccugu

SEQ ID NO: 361428 - RNA, 64 nt, Human
guguugauuuuucucuggguuguuuuuucugccaugagaccaacaggucaccagccuuguucaa

SEQ ID NO: 361429 - RNA, 64 nt, Human
gccaagguggguggaucaccugaggucaggaguuugagaccagccugaccaaacauggcgaaac

SEQ ID NO: 361430 - RNA, 64 nt, Human
ucuccgacacaggcugguggaccaccuaccccacugagaccaccucucagggugccugcccugg

SEQ ID NO: 361431 - RNA, 64 nt, Human
cagagcuuugggaggccaaggugggaggaucgcuugagaccaggaguucgagaccagccugggc

SEQ ID NO: 361432 - RNA, 64 nt, Human
gccaaggcaggaggauugcuugagcccaggaguuugagaccagccugggcaacacagcgagacc

SEQ ID NO: 361433 - RNA, 64 nt, Human
aacaugugauacauucaauugguuaaaugguuuauacagggacugauuugcuucccuuccugcc

SEQ ID NO: 361434 - RNA, 64 nt, Human
auuauuuuaaccuuuuaacucccugcccuuuuaauacagggacagggugucuccugaagauacu

SEQ ID NO: 361435 - RNA, 64 nt, Human
caaaagaagacucuguuuuacgaaggggauucacuacagggacuuagagaacagucucuuuucu

SEQ ID NO: 361436 - RNA, 64 nt, Human
guugagcugguaggaucacaauaggccacgaauuugagaccagccugguaaaauagugagaccu

SEQ ID NO: 361437 - RNA, 64 nt, Human
gcugaggcgggaagaucacuugaguucaggaguuugagaccagccuggccaacauggugaaacc

SEQ ID NO: 361438 - RNA, 64 nt, Human
acagugauacacacacguauuuaaggacuaucccugagaccauccuucucauuuuggaaacugc

SEQ ID NO: 361439 - RNA, 64 nt, Human
accgaaugagaaggauugcuugagcccaggaguuugagaccagccagggcaacagagugauacc

SEQ ID NO: 361440 - RNA, 64 nt, Human
accucagggcaggucuaugggccacugcaggagaugagaccagccuucuguguucaccuaacga

SEQ ID NO: 361441 - RNA, 64 nt, Human
gucaaggugagcagaacaccugaggacaggaguuugagaccagccugcccaacguggugaaacc

SEQ ID NO: 361442 - RNA, 64 nt, Human
acugugauggcaucgggaccaguccugggcgcccugagaccacucgcugcucucacccucugca

SEQ ID NO: 361443 - RNA, 64 nt, Human
caaagugaacucucaaauccaaaaugguuaucuuugagaccauccauucuccucaguggcuucu

SEQ ID NO: 361444 - RNA, 64 nt, Human
gccaaggcggacggaucacuugagguuaggaguuugagaccagccuggccaacauggugaaacc

SEQ ID NO: 361445 - RNA, 64 nt, Human
agccaagacgauuggccagacaucaccucagaucugagaccagcgucuuccaucucucagagcc

SEQ ID NO: 361446 - RNA, 64 nt, Human
gaccaguuguaccccgagugccaggcuugugagaugagaccaagagggaggaggggaaggacuc

SEQ ID NO: 361447 - RNA, 64 nt, Human
gugggggaaaauuuuuagaagaaaagcaaacaugugagaccaaucauuaucaaauacuuuuauu

SEQ ID NO: 361448 - RNA, 64 nt, Human
gccgaggagggaggaucaccugaggucaggaguuugagaccagccuggccaacaugaugaaaug

SEQ ID NO: 361449 - RNA, 64 nt, Human
ugggucagggcagagccuguuaccugaagagaggugagaccaaggccacagggagcuccaccuu

SEQ ID NO: 361450 - RNA, 64 nt, Human
ugagaccacgcccggccccacucacucuauccugugagaccacgccuggccccacucccaccau

SEQ ID NO: 361451 - RNA, 64 nt, Human
uaagacugugcccggccccauucacuccauccugugagaccacgcccggccccacucacucuau

SEQ ID NO: 361452 - RNA, 64 nt, Human
ccucaugugaucugcccaccucagccucccaaaguacagggauuagaguugugagccaccgcug

SEQ ID NO: 361453 - RNA, 64 nt, Human
ccaaaacgccuuggcuuucaggccuggccuuuccuacagggagcucaguaaccuggacggcucu

SEQ ID NO: 361454 - RNA, 64 nt, Human
cgugugcauguguguaaaccccgugggcagggacuacagggaaggcuccuucaucccaguuuug

SEQ ID NO: 361455 - RNA, 64 nt, Human
gagccccgcacccggccccucucacaccauccugugagaccacgcccggccccacucccaccau

SEQ ID NO: 361456 - RNA, 64 nt, Human
ggauuaaugaacuaugauuuuuuuuuuuuuuuuuugagaccaaaucuugcucuguggcccaggc

SEQ ID NO: 361457 - RNA, 64 nt, Human
uucauuucaguagaagauaaucuuaucuaauuuuugagaccagaauaagccuuuuaagguaaac

SEQ ID NO: 361458 - RNA, 64 nt, Human
ucucuguccucugugaacagugugugugcgugcgugagaccacagaucuguggacacaccauuu

SEQ ID NO: 361459 - RNA, 64 nt, Human
gcugucuggccgggacuugggccuggguggcuuuugagaccagugaagaagggagagccggccu

SEQ ID NO: 361460 - RNA, 64 nt, Human
aaagagggcccacuuucuaacaggguggagcaaaugagaccaagaaaucauugguaagaugaug

SEQ ID NO: 361461 - RNA, 64 nt, Human
gacacagcugagagauagaggaggcugugaaugcugagaccagaguuuaucaugcuggacaagc

SEQ ID NO: 361462 - RNA, 64 nt, Human
uuaccuuucaaccucuagagagaccagcugccuuugagaccaggagcugagcaccgagaaccau

SEQ ID NO: 361463 - RNA, 64 nt, Human
cugccgucucacgccuuugugaaccccaaauaucugagaccagucucaguuuauuuugccaagg

SEQ ID NO: 361464 - RNA, 64 nt, Human
gaagggacugguuggguuugcuuuaugggaucuuugagaccaaaacagaugcuccuguuugcug

SEQ ID NO: 361465 - RNA, 64 nt, Human
gccuguucaggagccucagauaaguauuuguacuugagaccaccucacacaaucuguaugggcc

SEQ ID NO: 361466 - RNA, 64 nt, Human
uugugaccuugauuauuuuggcuuacucuuuggaugagaccagacaagaaaaggauuaaacggg

SEQ ID NO: 361467 - RNA, 64 nt, Human
gcugaggcgggugguucaccugaggucaggaguuugagaccagccuggccaacauggagaaacu

SEQ ID NO: 361468 - RNA, 64 nt, Human
gccaaggcgggcggaucaccugaggucgggaguuugagaccagcccgaccaacauggagaaacc

SEQ ID NO: 361469 - RNA, 64 nt, Human
gcugaggugggaggauuacuugaaacccacaguuugagaccagccugggcaacauagugagacc

SEQ ID NO: 361470 - RNA, 64 nt, Human
gcugaggcagguggaucacuggaggucaggaguuugagaccagccuggccaacauggugaaacc

SEQ ID NO: 361471 - RNA, 64 nt, Human
gacgaaacggguucagaaacugccaggggccucauacagggauaucaaaauacccuuugugcua

SEQ ID NO: 361472 - RNA, 64 nt, Human
gcuuugucaaucucugccccggucugauguuuccuacagggagaugccuuggauccagguucag

SEQ ID NO: 361473 - RNA, 64 nt, Human
ccuccugcucugggacguggacaugccucaaggauacagggagccggcggccucucgacggcac

SEQ ID NO: 361474 - RNA, 64 nt, Human
aagaaggcucuggauuuaagcggguggucaccugugagaccaggucuaccuugggacuguuauu

SEQ ID NO: 361475 - RNA, 64 nt, Human
caagugauccucccaccucagccuccugaguagcugagaccacaggcgugugccaccacgccua

SEQ ID NO: 361476 - RNA, 64 nt, Human
gccgaggugggaggauugcuugaguccaggaauuugagaccagccuggacaacacagugagacc

SEQ ID NO: 361477 - RNA, 64 nt, Human
augacuuucccacagagacuggaaugcgucagccugagaccacuggccuauuuucucagcugcc

SEQ ID NO: 361478 - RNA, 64 nt, Human
aucccagcccuuugggaagcugaggcaggaggauugagaccaggaguucgagaagagccugggc

SEQ ID NO: 361479 - RNA, 64 nt, Human
cugccuucugggcaaggugagggaugccauaccuugagaccaagccggugcccaccuaagggcu

SEQ ID NO: 361480 - RNA, 64 nt, Human
uagccuggauggccccuccuugcaaccaggcagcugagaccagggucuuaccucucugggaccu

SEQ ID NO: 361481 - RNA, 64 nt, Human
cgugacugacguuugcuccuugacuccaagaaacugagaccaaagaagcugcuguucuuagcaa

SEQ ID NO: 361482 - RNA, 64 nt, Human
cccagagacauuuucccauggcaguccuccucucugagaccagggcugucacuuuucugccagg

SEQ ID NO: 361483 - RNA, 64 nt, Human
aagggaauacuacaguuuuguccacacuuuaauuugagaccauuuuucuuugaaucguaaguua

SEQ ID NO: 361484 - RNA, 64 nt, Human
gaccugucguuugcuccagcaugcacaaacuucgugagaccaacacagccgugcccugcaggca

SEQ ID NO: 361485 - RNA, 64 nt, Human
ugucuguuucucaggcuccugugagccucaguccugagaccagagucaagaggaaguacacguc

SEQ ID NO: 361486 - RNA, 64 nt, Human
cuuuugcagcccacucugacuuccaucugggggcugagaccacccuugccugcccccuucuuuc

SEQ ID NO: 361487 - RNA, 64 nt, Human
agagguccaacuugccacccgcgucccugguaccugagaccaccgacauccucagguuccugac

SEQ ID NO: 361488 - RNA, 64 nt, Human
gcccagcaaaagcacguaugcuucaggggccuucugagaccaccuuccccacugagccccagcu

SEQ ID NO: 361489 - RNA, 64 nt, Human
acaagaucccgcgucagcggauuauggauuacuaugagaccaacagccagugcuccaagcccgg

SEQ ID NO: 361490 - RNA, 64 nt, Human
augauagugaguauucuuacacuguucccaguauuacagggaaugcuuagaaauuuucuuuauu

SEQ ID NO: 361491 - RNA, 64 nt, Human
aucuaaucagugacuuaagagagauuuucuuguauacagggagagugagauaacuuauugugaa

SEQ ID NO: 361492 - RNA, 64 nt, Human
aauaauaacugaacuacagcaaaaggcagagaauuacagggagaaaaaacuuguacuuaccagc

SEQ ID NO: 361493 - RNA, 64 nt, Human
gcugaggugggaggguugcuugagcccagggguuugagaccagcuugggcaacaacaacaaaaa

SEQ ID NO: 361494 - RNA, 64 nt, Human
gcugaggcaggcggaucaccugaagucagaaguuugagaccagccuggccaacauaauuaaaau

SEQ ID NO: 361495 - RNA, 64 nt, Human
guuaugauuucagcccugggccugcaggagaggcugagaccagcccacccagccaguggucgag

SEQ ID NO: 361496 - RNA, 64 nt, Human
augggugaggccgggcuccccgccucacugcccuugagaccaaaggggcagcccuggcccuccc

SEQ ID NO: 361497 - RNA, 64 nt, Human
uacaguauugggcagcaauucuggauucuagacuugagaccacagaaucaaccauuucaugagg

SEQ ID NO: 361498 - RNA, 64 nt, Human
gcuggcagggggagaucccaagccuagccuugggugagaccaagcccuacuuuuguucuucuau

SEQ ID NO: 361499 - RNA, 64 nt, Human
agagcucaccugugucccagcccucugaugguggugagaccaggggaaaggccagcucagaggg

SEQ ID NO: 361500 - RNA, 64 nt, Human
cuugggucucaguuccuaauaucccgcuccuugcugagaccaucuccuggggcaggguccuuuu

SEQ ID NO: 361501 - RNA, 64 nt, Human
acggcgaugggccucacgggcccgcccagcacccugagaccacacuguugccucccagugaccc

SEQ ID NO: 361502 - RNA, 64 nt, Human
cugcaaagaucacuuugucaccagcccugggaccugagaccaagggggugucuugugggcagug

SEQ ID NO: 361503 - RNA, 64 nt, Human
ucaguguugcuucuuggccauguucgacagaugcugagaccaucguacaggcagaagcuuuggc

SEQ ID NO: 361504 - RNA, 64 nt, Human
ccaccuuuucucucucuuagcuccacgucagcacugagaccagacucgagcaccccuguccugu

SEQ ID NO: 361505 - RNA, 64 nt, Human
cagccacucagaaggcugaggcaggaggaucgcuugagaccaagaguuugagccugcggugagc

SEQ ID NO: 361506 - RNA, 64 nt, Human
uugggcagagaucauguuagaaucaaguggaugaugagaccaauuacaggccgucucucugcac

SEQ ID NO: 361507 - RNA, 64 nt, Human
aaaacucauggagcgauuuuauuaucuugggggaugagaccaugagauuggaaaauguacauua

SEQ ID NO: 361508 - RNA, 64 nt, Human
augcacuuguuauuuuauuaauuugccugaaugaugagaccagaccagugucuacagauuuuca

SEQ ID NO: 361509 - RNA, 64 nt, Human
ggaggccuuccaaggggguuucagucuggacuuauacagggaggccagaagggcuccaugcacu

SEQ ID NO: 361510 - RNA, 64 nt, Human
gaagcuuggcugccaacccucuuacuuccuuuguuacagggagggguuggcuuggggugaaaag

SEQ ID NO: 361511 - RNA, 64 nt, Human
cagcugcuggauaauacagaggaacuucaacuucuacagggaacagugguuggccaggcugcag

SEQ ID NO: 361512 - RNA, 64 nt, Human
aggccaagcuaugugcuagagcccaggccagcucugagaccaagcccagcauugagaauaagcu

SEQ ID NO: 361513 - RNA, 64 nt, Human
gggcuccugagaugagaguuugagauucagggaaugagaccaccucucauuucuuccagcauga

SEQ ID NO: 361514 - RNA, 64 nt, Human
gcugaggcaggaggaucacuugaggucaggaguuugagaccagugugcaaaacauagcaagacc

SEQ ID NO: 361515 - RNA, 64 nt, Human
uggggggugucaguggaaaggcauaaggcugagcugagaccaguugcuggugaaacugggccaa

SEQ ID NO: 361516 - RNA, 64 nt, Human
gccaagguggaaggaucacuuagagcuaggaguuugagaccagccugggcaauauagcaagacc

SEQ ID NO: 361517 - RNA, 64 nt, Human
aggucaaggugggcagaucaugaggucaggaguuugagaccagccuggccaauauggugaaacc

SEQ ID NO: 361518 - RNA, 64 nt, Human
aaccccuaaccauaccccaagagcucccaaagccugagaccagggucauuuguccccaacuccc

SEQ ID NO: 361519 - RNA, 64 nt, Human
caaggccccagcccuccucugggagccucacaccugagaccagcaggacaaggccauugggggc

SEQ ID NO: 361520 - RNA, 64 nt, Human
gccgaggugggaggaucgcuugagcccaggagucugagaccagccucggcaacaugccaagacc

SEQ ID NO: 361521 - RNA, 64 nt, Human
cuaguguuuauuacagcuugugaggccaggaguuugagaccauccuaggcaacauaaugagaca

SEQ ID NO: 361522 - RNA, 64 nt, Human
guacccgauucaaagaaggacucugcucccugucugagaccacccccggcucugacugagagua

SEQ ID NO: 361523 - RNA, 64 nt, Human
ggugcaguggcucacgccuguaauccuagcacuuugagaccacuaaggcagguggaucaccuga

SEQ ID NO: 361524 - RNA, 64 nt, Human
uguugcaagauguaauuuuucuuuuccuuuuuuuugagaccaagucucacucugucacccacgc

SEQ ID NO: 361525 - RNA, 64 nt, Human
gccaaggcagguggaucaccugaggucaggaguuugagaccagccugaccaacauggugaaauc

SEQ ID NO: 361526 - RNA, 64 nt, Human
gcugagguggguggaucaccugaagucagaaguuugagaccagccuggcaaacauggcaaaacu

SEQ ID NO: 361527 - RNA, 64 nt, Human
aggccaagguggguggaucacgaggucaggagauugagaccauccuggcuaauauggugaaacc

SEQ ID NO: 361528 - RNA, 64 nt, Human
uuuguuuaacaaccucauggguugccucuucauuuacagggaagaaaugaaauguacaucugca

SEQ ID NO: 361529 - RNA, 64 nt, Human
ggugaccuauucuaacucaaggaggagagcuauguacagggagagcauuuuagauugaagguug

SEQ ID NO: 361530 - RNA, 64 nt, Human
cacacacacacacacuauauauauauauauuauuuacagggaaauuuuucaggguuuacaaaag

SEQ ID NO: 361531 - RNA, 64 nt, Human
gcugagguggguggaucacuugaggucaggaguuugagaccacccuggccaacauggugaaacc

SEQ ID NO: 361532 - RNA, 64 nt, Human
uuucugcaauucaggucuccuuuugcauuuuugcugagaccagcugggucauggagacccugac

SEQ ID NO: 361533 - RNA, 64 nt, Human
acucaggaauucgagaccagccugggcuacauagugagaccacaucucuacuagaacuuaaaaa

SEQ ID NO: 361534 - RNA, 64 nt, Human
ccuuuagacucauuguaaguugccacugccaacaugagaccaaagugugugacuagucaaugaa

SEQ ID NO: 361535 - RNA, 64 nt, Human
ggugaggcaggaggauggcucaagcccaggaguuugagaccagugugggcaacagagugagaac

SEQ ID NO: 361536 - RNA, 64 nt, Human
gguaauugauguaaauuuauaguggaauaugaccugagaccacaauuuguucacuuuuguauuc

SEQ ID NO: 361537 - RNA, 64 nt, Human
uuugggaggcugagguggguggaucacuggaguuugagaccacccuggccaacauggugaaacc

SEQ ID NO: 361538 - RNA, 64 nt, Human
gcugaggugggaggacugcuuaagcucaggaguuugagaccagccugggcaacauagcaagacc

SEQ ID NO: 361539 - RNA, 64 nt, Human
aacccgcaggcuccugaagacuggccacgccuccugagaccacuuggaaacagaccaacugccc

SEQ ID NO: 361540 - RNA, 64 nt, Human
aggcugaggugggcagaucaugaggucaacagauugagaccauccuggucaacaugguaaaacc

SEQ ID NO: 361541 - RNA, 64 nt, Human
gccauggcagguggaucaccugaggucgggauuuugagaccagccugaccaacacugagaaacc

SEQ ID NO: 361542 - RNA, 64 nt, Human
gacaagguggguggaucacuugaggccaggaguuugagaccaaccugguuaacauggugaaacc

SEQ ID NO: 361543 - RNA, 64 nt, Human
cagcuacucaggaggcuugggugggaggauugccugagaccaggagguugaggcugcagugagc

SEQ ID NO: 361544 - RNA, 64 nt, Human
gccgaggcaggcagaugaccugaguuugggaguuugagaccagccugaccaacauggagaaagc

SEQ ID NO: 361545 - RNA, 64 nt, Human
aggccgagacgggcggaucacgaggucaggagacugagaccauccuggcuaacacggugaaacc

SEQ ID NO: 361546 - RNA, 64 nt, Human
aucucacuucgccuugguuuccuuaucuguaaaaugagaccaucuuauugcugacuucaaaggg

SEQ ID NO: 361547 - RNA, 64 nt, Human
cucacggcugaucaauaauguugcaaagggagacuacagggaucucacgacgaauauucugaua

SEQ ID NO: 361548 - RNA, 64 nt, Human
gggcucaccuaggugagugcacagccugugacgcuacagggagaggcugaguaaaccgagaucc

SEQ ID NO: 361549 - RNA, 64 nt, Human
cugugccaggccauagccagaggccacccuguaguacagggaugagucuugguguguucugcag

SEQ ID NO: 361550 - RNA, 64 nt, Human
aaacacaaaacccucagugcuggagaagagucagugagaccagcacucucaaacacuggaacug

SEQ ID NO: 361551 - RNA, 64 nt, Human
gccaaggcaggaagaucacuugagcccgcaaguuugagaccacccugggcaacauagcgagacu

SEQ ID NO: 361552 - RNA, 64 nt, Human
uguacugaauguggcaaggucuuaagguaaaaucugagaccaggauucuucaaagaauucuugc

SEQ ID NO: 361553 - RNA, 64 nt, Human
aaaacugaaacaagaagaaacaucaaauuugcgaugagaccagaugcuguggcucaggccugua

SEQ ID NO: 361554 - RNA, 64 nt, Human
gccaagacagguaggucacuugaggucaugaauuugagaccagccuggccaacagacgggagcc

SEQ ID NO: 361555 - RNA, 64 nt, Human
caguacuuuaggacauggaagggggaggaucacuugagaccaggaguugugaggucaaccuggg

SEQ ID NO: 361556 - RNA, 64 nt, Human
caggguggccgcagcugcagagagccacuucaccugagaccacgcccuuccuggggcagccugu

SEQ ID NO: 361557 - RNA, 64 nt, Human
uagccagcagcggccgucuacuccuguucuggccugagaccaccggugugggucacgagggccc

SEQ ID NO: 361558 - RNA, 64 nt, Human
agagcggggaaauguugagcucaaauggguaaauugagaccagaaaauuauuuuuucaaccuag

SEQ ID NO: 361559 - RNA, 64 nt, Human
cacacagucaccuucucggcaacuaagcagucccugagaccauuuaacaugcaacccgaagguu

SEQ ID NO: 361560 - RNA, 64 nt, Human
gccaaggcaggcugauugcuugaggucaggaguuugagaccagccuggccaaaaucuauacuaa

SEQ ID NO: 361561 - RNA, 64 nt, Human
aggccaaggcaggcggaucacaaggucaggagauugagaccauccuggccaacauggugaaacc

SEQ ID NO: 361562 - RNA, 64 nt, Human
caugugacuggccaucagccagacaugucuagggugagaccagugcucagcaccacccgccaag

SEQ ID NO: 361563 - RNA, 64 nt, Human
gacucugccguuucuccaggccuccgcucagugaugagaccaagagaucggagacaagcauggu

SEQ ID NO: 361564 - RNA, 64 nt, Human
uuugccugccccugggcgagugcgggcagggaucugagaccagauuguucucgcaccccugcca

SEQ ID NO: 361565 - RNA, 64 nt, Human
ugcugccauuuucaaauuuccucccugccucaugugagaccacaggguuuggagaagcaguugg

SEQ ID NO: 361566 - RNA, 64 nt, Human
augacgugugggugggagcaaccaaaguuauuuuuacagggacuuuauuuuuugaucuuuauuu

SEQ ID NO: 361567 - RNA, 64 nt, Human
cucacacagcccuggccucugcucaacuagcagauacagggaugaggcagaccugacucucuua

SEQ ID NO: 361568 - RNA, 64 nt, Human
ucuauguguagauauuaacucagaacuuacaauauacagggagaagacauguugcaauacaagc

SEQ ID NO: 361569 - RNA, 64 nt, Human
ugcuucgcugccguguccugacuucuggaaucuuugagaccaaguuccagguggacaaagucaa

SEQ ID NO: 361570 - RNA, 64 nt, Human
aggccgaggcugguggaucacaaggucaggagauugagaccauccuggcuaacacagugaaacc

SEQ ID NO: 361571 - RNA, 64 nt, Human
ccccauccacaccuggacgcaggcccugccgcccugagaccacaguccaaccccagaccauccc

SEQ ID NO: 361572 - RNA, 64 nt, Human
caucuugguuguaagucccuuuauucacagaccuugagaccacuggggucucccacaagguggg

SEQ ID NO: 361573 - RNA, 64 nt, Human
cauuggauucaguucccaaaauagaauguuucagugagaccaugagaauuccaggcucacaaag

SEQ ID NO: 361574 - RNA, 64 nt, Human
gcugaggcagguggaucacuugagcucaggagcuugagaccagccugggcaacauggugaaacc

SEQ ID NO: 361575 - RNA, 64 nt, Human
agaaagucauuuucagaaaaucuacaagucucguugagaccaccaccauaccucagaagguagg

SEQ ID NO: 361576 - RNA, 64 nt, Human
gcuuacuauaauuuuuuuaacacuguaacaacuuugagaccaccucugaaucgucgcauuauaa

SEQ ID NO: 361577 - RNA, 64 nt, Human
gugagguuuguuacugguauuuuuuucacgugccugagaccagccugguaccaggaccuuuugu

SEQ ID NO: 361578 - RNA, 64 nt, Human
cagcuuuccuuaaugugguugcacagggguccucugagaccaccuggcgugagguggacacccu

SEQ ID NO: 361579 - RNA, 64 nt, Human
cugacuauauuaguauacaaagaggucaugugguugagaccaggugaauagucacuaucagugu

SEQ ID NO: 361580 - RNA, 64 nt, Human
auaaaaccacuaaacuuuuguguccauauuuuacugagaccauguuucauuaaaagcauaguuu

SEQ ID NO: 361581 - RNA, 64 nt, Human
gaucacgacacugcacuccagcugugugacagaaugagaccaucuccaaaaaaaaaaaaaagua

SEQ ID NO: 361582 - RNA, 64 nt, Human
gugugugcagggagacgguaaagcuggaggugccugagaccagggcuuccauggagcgggacac

SEQ ID NO: 361583 - RNA, 64 nt, Human
gccgagguggccagaucaccugaggucaggaguuugagaccagacugaccaacauggagaaacc

SEQ ID NO: 361584 - RNA, 64 nt, Human
cgcaggggugaaggggcagaccaacgaaaccagaugagaccaacgacaccaugcgagacacgcu

SEQ ID NO: 361585 - RNA, 64 nt, Human
cuagaaaacucaauaccaucaucucuuaucucuauacagggacuagguaauaaaaccuucaaag

SEQ ID NO: 361586 - RNA, 64 nt, Human
uacugagcaucucccaugugcaagguccuggaacuacagggauaagacaggguccaugccgucu

SEQ ID NO: 361587 - RNA, 64 nt, Human
aaagaaaaaugagcucaaaauuugcuuugagagcuacagggaauugcuauuacuccuguaccuu

SEQ ID NO: 361588 - RNA, 64 nt, Human
ggccaccugccaggccucccucgggcuggugucuugagaccagccugccaggcccuccagcagg

SEQ ID NO: 361589 - RNA, 64 nt, Human
uuugaaaaauaaaaagcauccaagugagagcuggugagaccacgugcugcuggcguaguguagg

SEQ ID NO: 361590 - RNA, 64 nt, Human
gacaaguucauauauagaauuuacgggagaaacuugagaccauuuacggggagaaacuugauuc

SEQ ID NO: 361591 - RNA, 64 nt, Human
ucccaucagugucguccccugcugagaggccaugugagaccauauggaaaaacaacagccauaa

SEQ ID NO: 361592 - RNA, 64 nt, Human
aggccaaggcagguagaucacaaggucaggaaauugagaccauccuggcuaauacagugaaacc

SEQ ID NO: 361593 - RNA, 64 nt, Human
ggaccgugaaagcccucagagucagcaccuaguuugagaccaagcacccuuucgaaucccugga

SEQ ID NO: 361594 - RNA, 64 nt, Human
guuaacucuaccugaucuucacuugucaguaauuugagaccacuucaaagcccucugcaaacac

SEQ ID NO: 361595 - RNA, 64 nt, Human
guccaaggagggggaucgcuugaguccaggaguuugagaccagccuggacaacauggugaaacc

SEQ ID NO: 361596 - RNA, 64 nt, Human
uccaacugaaagugucauccuaaguaccuugaaaugagaccacgucagagacauguacugcccc

SEQ ID NO: 361597 - RNA, 64 nt, Human
cagcacuuugggagguccaggcagguggaucucuugagaccaggaggucaagaccagccuggcc

SEQ ID NO: 361598 - RNA, 64 nt, Human
gccuuaccccucauucucacagcacagaugagguugagaccaugcagucaaugcauugcuuaag

SEQ ID NO: 361599 - RNA, 64 nt, Human
ugggggcagaggugggcucuguuuaggagggcagugagaccacccagccaaauugcuucucaac

SEQ ID NO: 361600 - RNA, 64 nt, Human
ugccccaucaggucaucuccagggcucagaggggugagaccauuucccaaggucacagaaccag

SEQ ID NO: 361601 - RNA, 64 nt, Human
gccgaggcaggcggaucaccugaggucaggaguuugagaccagucuggccaacauggcgaaacc

SEQ ID NO: 361602 - RNA, 64 nt, Human
ugcuagcuccaggaaggcuuugugggaaaugaguugagaccauggacuugggaguugggggcca

SEQ ID NO: 361603 - RNA, 64 nt, Human
acauuucuugcugcuccuggcguggaaacuuaagugagaccaccaaauacauugguccugucca

SEQ ID NO: 361604 - RNA, 64 nt, Human
cauccuauuagccucccacauucaaggcccgugauacagggaugaggucagcaccagcaaacuc

SEQ ID NO: 361605 - RNA, 64 nt, Human
ggucaggcagaaggugcccuggugagagcuccuuuacagggacuuuaugugguuuagggcucag

SEQ ID NO: 361606 - RNA, 64 nt, Human
acaagaauaugacuagauuucagaaauuaauuauuacagggagcuauugaucuacuagcaucaa

SEQ ID NO: 361607 - RNA, 64 nt, Human
uuuuuuacugcuuuuauguuuuucugucuuguuuugagaccaugaugguuacacuuuugguucc

SEQ ID NO: 361608 - RNA, 64 nt, Human
gcauuugugaaggauuccagagccuuucccaaagugagaccauuucugggguauuuguaccagg

SEQ ID NO: 361609 - RNA, 64 nt, Human
ugggcuauuuguuugacaguagcaugauguuuuuugagaccaucaggggugguuacauagacca

SEQ ID NO: 361610 - RNA, 64 nt, Human
agagcuauaugcuuuucccuggagaguggggagaugagaccaguguuccucacacuggagggug

SEQ ID NO: 361611 - RNA, 64 nt, Human
auagaauggaccaaauacauuuuuaaaagaaaacugagaccaaucagauggaaauggaguuuua

SEQ ID NO: 361612 - RNA, 64 nt, Human
cagcauuuugggaggcuaaggcagggagauggcuugagaccaggaguucaagaccagccugggc

SEQ ID NO: 361613 - RNA, 64 nt, Human; identical to SEQ ID NO: 361381

SEQ ID NO: 361614 - RNA, 64 nt, Human
cagcacuuugggagacugagaugggaggaucgcuugagaccagccugggaaacauagugagacc

SEQ ID NO: 361615 - RNA, 64 nt, Human
aauugccuuucuguguuuauucaaacugaaaagcugagaccaagagcaaggaagguaaaaaguu

SEQ ID NO: 361616 - RNA, 64 nt, Human
gccgaaguggguggaucacuugaggccaggaguuugagaccagccuggccaacauggugaaacc

SEQ ID NO: 361617 - RNA, 64 nt, Human
uggucuucaauucuuaacaaauggacuucccugaugagaccaaaauggugauuuaacaguuuuu

SEQ ID NO: 361618 - RNA, 64 nt, Human
ccuggguugggaggauugcuuaaggccaggaguuugagaccagcuugggcaacauagugaaacc

SEQ ID NO: 361619 - RNA, 64 nt, Human
gccaaggcaggcagaucaccugaggucaggaguuugagaccagccuggccaacaugaugaaacc

SEQ ID NO: 361620 - RNA, 64 nt, Human
cagucccccagauaccuauuauuuuacacaauuugaccuauaggaggacacugaguaauuuaca

SEQ ID NO: 361621 - RNA, 64 nt, Human
guaugugugguugcucugggaagcccaaagcacagaccuauaucccuuugcagcuugucuuuuu

SEQ ID NO: 361622 - RNA, 64 nt, Human
uggcuggggaacguucuggugcugauggugcugggaccuauauguauauuuauauauaucuggg

SEQ ID NO: 361623 - RNA, 64 nt, Human
uaguuauguguuuuuuagaguauauacuaagcucuacagggacagaaugcuuaauaaauacuuu

SEQ ID NO: 361624 - RNA, 64 nt, Human
cuuauucacauuuugcuuccuaaucuuuuuguuguacagggauucagguuucuuauucuuacaa

SEQ ID NO: 361625 - RNA, 64 nt, Human; identical to SEQ ID NO: 361587

SEQ ID NO: 361626 - RNA, 64 nt, Human
gaaugaaaaggagggugauuagccuucauaagaugaccuauagagcaaagaaaggugacuggaa

SEQ ID NO: 361627 - RNA, 64 nt, Human
guauguuugaagacuguuauuuugagcuaauugagaccuauaauucaccaauaacuguuuauau

SEQ ID NO: 361628 - RNA, 64 nt, Human
uacaguuucuuugacuccuggcauuugccuuaaggaccuauagcaagcuguuucuaggaucaga

SEQ ID NO: 361629 - RNA, 64 nt, Human
gagacaaaaagcacuaguauaaagauuauauaaagaccuauaaaucauuaagacaacugaguuu

SEQ ID NO: 361630 - RNA, 64 nt, Human
uuacuaagccgagaggugucauuccugcaggcaggaccuauaggcaccugaagauuugaaugaa

SEQ ID NO: 361631 - RNA, 64 nt, Human
gaaugacuucugccuucaucugcaguaacggggggaccuauacugaccucuuccccagccauuu

SEQ ID NO: 361632 - RNA, 64 nt, Human
uugugaaggccucgcaggaagacccaacacaugggaccuauaacugcccagcggacaguggcag

SEQ ID NO: 361633 - RNA, 64 nt, Human
gaaacauaugagaaaggucagcaaacagaugcaagaccuauaaggcuagucauugagcuauauu

SEQ ID NO: 361634 - RNA, 64 nt, Human
gaaauagacaaaacacaucuucuuaacggauggugaccuauaaccauuaauguugaaaauggaa

SEQ ID NO: 361635 - RNA, 64 nt, Human
uuacuggcuuugugccuguagcucauuuuauuaugaccuauaugcuccugauuuaaagagaucu

SEQ ID NO: 361636 - RNA, 64 nt, Human
uaaaucuaacagaacaacugaaauacuugaaauagaccuauaaaauaguaauuaaaaugagaaa

SEQ ID NO: 361637 - RNA, 64 nt, Human
gauacaucaaugggaaggaaaccagggaagcauagaccuauaguacaacagggguguagugacc

SEQ ID NO: 361638 - RNA, 64 nt, Human
uuaaagcuauaucucaaagcaguugagagaagaggaccuauaugaaugguuuuaugucauuuuu

SEQ ID NO: 361639 - RNA, 64 nt, Human
auaauaagaaaaaggccauuucauuuuaaauugugaccuauaauucuuugucuuggguugguaa

SEQ ID NO: 361640 - RNA, 64 nt, Human
gugacucuguggggacugcauagguuuguuaauugaccuauagcuaaaccuuaauguguuugug

SEQ ID NO: 361641 - RNA, 64 nt, Human
aaugguguucagccuauaagacgaagucucacaagaccuauaggaaaguuuaccaucugccuua

SEQ ID NO: 361642 - RNA, 64 nt, Human
gcaugaauaguacaaguuauuaucaaggauguuuuacagggaaaucaaaagaauauuaucauac

SEQ ID NO: 361643 - RNA, 64 nt, Human
caccagccccugccccagcccaaguccaaauguuuacagggagccuccugcccagucccccaac

SEQ ID NO: 361644 - RNA, 64 nt, Human
uacccuuuucuggagaaccauagacuucccuuacuacagggacuugcauguccuaaagcacugg

SEQ ID NO: 361645 - RNA, 64 nt, Human
aaaccuaaucccugccaucaaauuuauuagaagagaccuauauaugaacaacuuaaaggcacug

SEQ ID NO: 361646 - RNA, 64 nt, Human
cacaauuuucuuuacugucuagcaugaucugcaugaccuauaaucuuugaaccacuuucguacc

SEQ ID NO: 361647 - RNA, 64 nt, Human
uaugauaaaugugaagaagauucuguuuuuuugugaccuauaauaauuauacaaacuucaugca

SEQ ID NO: 361648 - RNA, 64 nt, Human
cugcuuguucuacaaagguaguagaaucaaucucgaccuauauaaauaguagauuuuuuauggu

SEQ ID NO: 361649 - RNA, 64 nt, Human
uaugugagcaugcauauauacuucacaaagagaugaccuauauaaaucaaaguacacauuauuu

SEQ ID NO: 361650 - RNA, 64 nt, Human
aaauuugagggcauuuuauauaaagaaaaauacagaccuauaaaguuuggcauauucauuaagu

SEQ ID NO: 361651 - RNA, 64 nt, Human
gucuguaacuuaacuauaguauaaugaaaagaaugaccuauaauauagguguuuuguagauucu

SEQ ID NO: 361652 - RNA, 64 nt, Human
gagauuuuagaaauuugaguaaagaaacaauaaggaccuauacaaucauaugagaacaaaaaua

SEQ ID NO: 361653 - RNA, 64 nt, Human
uguuccuaaagcuaagcuuugcugggaaggaaaugaccuauaguuucuuaaagaaucauuaauc

SEQ ID NO: 361654 - RNA, 64 nt, Human
uaaaggaccaaauucaguuccuugguccuuggaagaccuauauucucuguaguuacugaaaacc

SEQ ID NO: 361655 - RNA, 64 nt, Human
ggaaggcuucuaauuagaaaacacagcaacagaagaccuauaccccggugccccugugucccac

SEQ ID NO: 361656 - RNA, 64 nt, Human
cacuaagaauugugauuugcauuguacgguuuuggaccuauauuguucacguuuugauggcgga

SEQ ID NO: 361657 - RNA, 64 nt, Human
aggcaaaacaucuguuuaucauagacaucaacaugaccuauaaguaaagugcgugucuaguguc

SEQ ID NO: 361658 - RNA, 64 nt, Human
agauauuaguguugcaaauauguuuagguaaacugaccuauaacagaauaugugaaaugaauuu

SEQ ID NO: 361659 - RNA, 64 nt, Human
ccugcuuuauauuguuguucugaagcuuacaauugaccuauacauugcauucagcaagcuccug

SEQ ID NO: 361660 - RNA, 64 nt, Human
cacuccugccagcucauuuccuucaauuuccuuugaccuauaggcuaaaaaagaaaggcucauu

SEQ ID NO: 361661 - RNA, 64 nt, Human
gcaagagaccuuaaaggcuuccuaucccaccaauuacagggaaaaaacgugugaugauccugaa

SEQ ID NO: 361662 - RNA, 64 nt, Human
agagaagcaagccagccaauagaauggggugauuuacagggauuucuguuuacugucaaaauau

SEQ ID NO: 361663 - RNA, 64 nt, Human
uaaaggaaaguccuuguugaggcagaacuaaguuuacagggaaagguacacacauucucucucu

SEQ ID NO: 361664 - RNA, 64 nt, Human
auuuuuuuaagaaaaaaguguugaucaaccauucgaccuauaagaagccuuaauuugcacagug

SEQ ID NO: 361665 - RNA, 64 nt, Human
cuucuuuuagcaaggucugaaaguuucaaagggagaccuauagguuaauuguuuaguuauaggc

SEQ ID NO: 361666 - RNA, 64 nt, Human
caauguguauaaauugucuuuaaaaacuguuuuagaccuauaauccuugauaauauauuguguu

SEQ ID NO: 361667 - RNA, 64 nt, Human
cagucaauuacaagaguaauuguauaguuauugagaccuauaguguguggcuuagaugaaaggg

SEQ ID NO: 361668 - RNA, 64 nt, Human
gcagauagguaucaauauguuuucaaugccugaugaccuauaagaagaaaguauugaaaagaag

SEQ ID NO: 361669 - RNA, 64 nt, Human
auauugggauuaagagcuuucuagccagaaucuggaccuauaccaugggaaaauuuaggggugc

SEQ ID NO: 361670 - RNA, 64 nt, Human
gcuacucaggaggcugaggcaggaggaucacagugaccuauaaugagccguugugcuccagccu

SEQ ID NO: 361671 - RNA, 64 nt, Human
uuuugaagcugugguugccugcucguccccaagugaccuauaccuguguuucuugccucauuuu

SEQ ID NO: 361672 - RNA, 64 nt, Human
augcuucuccuuuguuuguguugauccaaauucugaccuauauucuuuuccuucccuccagaga

SEQ ID NO: 361673 - RNA, 64 nt, Human
uuaugguaaaauaaaauuggaaaaaauuaaaacugaccuauaagaguguuaaggaccuaauaga

SEQ ID NO: 361674 - RNA, 64 nt, Human
agcccaccucaacccagaggcuacucuugacuuagaccuauacugaaagaucucugucacaucc

SEQ ID NO: 361675 - RNA, 64 nt, Human
uucagucuuugaacuuuaaccuuugacuggaagugaccuauaggcaaugaagacuacuuccuuu

SEQ ID NO: 361676 - RNA, 64 nt, Human
uuuagcacuaaaaugccuagaagauuuuacuccagaccuauaaggaaauguuuaguuuuuauga

SEQ ID NO: 361677 - RNA, 64 nt, Human
auggaagaagaaacagaacuucauggccaaaguagaccuauagauuuugauuggguucuuuguu

SEQ ID NO: 361678 - RNA, 64 nt, Human
uuggaacaguauaaaauaccaguuuguacaguaugaccuauaugugaccauguuacucccuucc

SEQ ID NO: 361679 - RNA, 64 nt, Human
uaagaaguauguccuuuguaucucuaaguuacaugaccuauaucuuuuccucuuuaauaguagu

SEQ ID NO: 361680 - RNA, 64 nt, Human
guucucauugauaacaagcuccauacugcugagauacagggaaauggaggggggaaagcuggag

SEQ ID NO: 361681 - RNA, 64 nt, Human
uuucuuuuuuaaagaaauggaaaauguuuacuauuacagggaccucaacacugcccucccauac

SEQ ID NO: 361682 - RNA, 64 nt, Human
ugcuuuguguuaggaggauccagaucauguuggcuacagggagaugcucucuuugagaggcucc

SEQ ID NO: 361683 - RNA, 64 nt, Human
cucucgggggccaggggucaucgguuugaccccugaccuauaagccaagauaccccauaaacac

SEQ ID NO: 361684 - RNA, 64 nt, Human
gcaguuuacagggauuuuugauauacuggcuugggaccuauaagauucuucucagcaguugcug

SEQ ID NO: 361685 - RNA, 64 nt, Human
uguacugggcucuguguaagugucguugggguaggaccuauauuuuaauacuguuccuaacauu

SEQ ID NO: 361686 - RNA, 64 nt, Human
gaaugcucugaaugggaagagcccauaacagaaugaccuauauuacaaccgauauaaaaccuag

SEQ ID NO: 361687 - RNA, 64 nt, Human
acugcuccagggucucuuuuugguccaaaggcuagaccuauagaguuggaucacuuuuuuucuu

SEQ ID NO: 361688 - RNA, 64 nt, Human
cuggguauugagcaaaaaccuuauuaucguuaaugaccuauaauuggaagcuuccugccuuuuu

SEQ ID NO: 361689 - RNA, 64 nt, Human
uguaucugugcagcauuuuauggaaaucacuggugaccuauaggauauuacuaaauuauuucaa

SEQ ID NO: 361690 - RNA, 64 nt, Human
uuuuucaucauuuuccguacuccuaaggaaaacugaccuauaccucauaaaaugagaccgcuau

SEQ ID NO: 361691 - RNA, 64 nt, Human
cauugaacauccuuccagaaagucuuugagggaggaccuauacccauaauagaauuauggcacu

SEQ ID NO: 361692 - RNA, 64 nt, Human
auuuguauuuuaaaacauaagaacgucauuuugggaccuauaucucaguggcacagguuuaaga

SEQ ID NO: 361693 - RNA, 64 nt, Human
uuugugaacuugagucaguccuauugaacauuuugaccuauauucuugcaaauuauguuaauuu

SEQ ID NO: 361694 - RNA, 64 nt, Human
ugaaugauuucuuggugguauuagcaucaucacagaccuauacuugcuuucugaaacucuacca

SEQ ID NO: 361695 - RNA, 64 nt, Human
guaucugagucugccauaauucugagaagaaaaugaccuauauccccauaagaacugaaacuca

SEQ ID NO: 361696 - RNA, 64 nt, Human
auaaauuggugucccauaccagcuuuuaaugguggaccuauagaauccaguacuuuuaauggug

SEQ ID NO: 361697 - RNA, 64 nt, Human
agugaauauaugugugagcagauauggcuauaaagaccuauagcuuuugcacuuuaugcauaua

SEQ ID NO: 361698 - RNA, 64 nt, Human
acuuauuauuauuuaugauuauauaaaugaaauggaccuauaucaagaggcagacugaagcuug

SEQ ID NO: 361699 - RNA, 64 nt, Human
aguagauccaggacgcccugcaggacucagccuguacagggagaugaagugccccagguuggga

SEQ ID NO: 361700 - RNA, 64 nt, Human
gggugcagggcugcuggugucagagcaagagggcuacagggaaagggcccuuucucaggggaug

SEQ ID NO: 361701 - RNA, 64 nt, Human
uuuuucuuuuccuaaaacagacuugaaaguauuauacagggauuggcauucuucccggucacug

SEQ ID NO: 361702 - RNA, 64 nt, Human
aaaaauguauauagaugucugaguguugucuggagaccuauacguaugguuaaaaagauuuaug

SEQ ID NO: 361703 - RNA, 64 nt, Human
aaugaaauaaaaucugaaaaguggauuucuuauugaccuauauucaugaaagcauauaaauuaa

SEQ ID NO: 361704 - RNA, 64 nt, Human
acuaaugcugguuauuuccuugaagcuuuauguggaccuauaaauaaaaauccaaucuccugcu

SEQ ID NO: 361705 - RNA, 64 nt, Human
aaaaacaauagauucauuuaauuuuccugugguugaccuauacgaccaggauguagaaaacuag

SEQ ID NO: 361706 - RNA, 64 nt, Human
gaccgagucugacaaacacaauacauuuaucugugaccuauaucaaguacacauuuaggagcca

SEQ ID NO: 361707 - RNA, 64 nt, Human
aucaguuuccuguccuaccugccucuuuggcuuggaccuauauggccaugcucuggcucuaccc

SEQ ID NO: 361708 - RNA, 64 nt, Human
gcuuuuuaagaaaaaaaauaacaugcugaggggugaccuauaucccaugugaguggucacuuua

SEQ ID NO: 361709 - RNA, 64 nt, Human
cccucccgcgccgcccgggcccuccccgcacacugaccuauaccucaggaugggcgcgucuggg

SEQ ID NO: 361710 - RNA, 64 nt, Human
gauuguuccaugcacugugcauacccggaagaaagaccuauaugaugcgguuuggauucaagua

SEQ ID NO: 361711 - RNA, 64 nt, Human
cacugcagcaugcccagugccacgcacaggugcugaccuauaguaagugcuuaacauuuguuga

SEQ ID NO: 361712 - RNA, 64 nt, Human
ccaagcccuaagccuguccccagaccaacccugggaccuauacagaacagagggccagagcuag

SEQ ID NO: 361713 - RNA, 64 nt, Human
agauuauauauguaguuuccaaggaagaaacaaagaccuauacaguuuagacuuuauuuguuug

SEQ ID NO: 361714 - RNA, 64 nt, Human
aauggaguagaguaugugauaguaucugcuucaagaccuauagaaaaguacauuccaguuugau

SEQ ID NO: 361715 - RNA, 64 nt, Human
uucugugauauggaaagggcacccagagcagcaggaccuauagccacguuaugucagcaaugaa

SEQ ID NO: 361716 - RNA, 64 nt, Human
accucugccccccaugaaucccauuuuaccucuagaccuauaaguucugguuuauguuugaccc

SEQ ID NO: 361717 - RNA, 64 nt, Human
caucacuaaguauaagaccugcucucuuccugaagaccuauaagcuggagguggacaacucaau

SEQ ID NO: 361718 - RNA, 64 nt, Human
agauuacuuauuuugagaauucauuguuaaaaauuacagggaauuaaaauaauugccuuuuuuu

SEQ ID NO: 361719 - RNA, 64 nt, Human
uugcacaauggccugggaaguugaggucacuuuuuacagggaaauagaagaaacugagaaccua

SEQ ID NO: 361720 - RNA, 64 nt, Human
cugccaugaucccuuugagagguggcucaaaagcuacagggaacuccagguccuuuauuacugc

SEQ ID NO: 361721 - RNA, 64 nt, Human
cccccugccuggaacccucugagcaacuugcucugaccuauaaugucuuaggugcaacacggac

SEQ ID NO: 361722 - RNA, 64 nt, Human
gauacucuucauuccuauaaaaguaauuaagauagaccuauaggauuguugaacuuugcugcca

SEQ ID NO: 361723 - RNA, 64 nt, Human
cuaaccuaugacaauucagggaccucaccugucggaccuauagcuugcugagcaggaaccuugc

SEQ ID NO: 361724 - RNA, 64 nt, Human
guucucaauuuucguuuucauuuugcuguauugagaccuauaaauaaauguauauuuuuuuuug

SEQ ID NO: 361725 - RNA, 64 nt, Human
cagccucgggacagggcugaggccugcgggggaagaccuauaccccacgccugggccuggcuuc

SEQ ID NO: 361726 - RNA, 64 nt, Human
augcugcaauucaggagucuggcucucuucuuaagaccuauauuaaauauuucccaagaagcac

SEQ ID NO: 361727 - RNA, 64 nt, Human
gaagucaucugucucuuuguaaauuauuuuauaugaccuauaaauuuaaaaauguuuuucagug

SEQ ID NO: 361728 - RNA, 64 nt, Human
uuauauuaaaacugucauauuuuggcuaaguuuggaccuauaacuacacuuucauuguuugcau

SEQ ID NO: 361729 - RNA, 64 nt, Human
cugaaaacuaugcaagagaaauuccaaccguccugaccuauaaccuguaggaaaccgacgaaaa

SEQ ID NO: 361730 - RNA, 64 nt, Human
cuuugauauucucuacuuccuggccuuuaaaaaugaccuauaauuuuucaguuugcuuuacuau

SEQ ID NO: 361731 - RNA, 64 nt, Human
uuuuaaaucauucauucaauagauaccaccgugugaccuauaauuuugcaaaucuguuaccucu

SEQ ID NO: 361732 - RNA, 64 nt, Human
gacagauuaugaaauuucauggaugaauuuuccagaccuauaucuggagugagaggcccccacc

SEQ ID NO: 361733 - RNA, 64 nt, Human
auuuuauuuuuucuuaauccaguucugcaaaaaugaccuauaaauuuauucauguacaauuuug

SEQ ID NO: 361734 - RNA, 64 nt, Human
aaagacuuuguugccugcugcuuauugucuaauuuacagggauauuuaauuuugucaggucuau

SEQ ID NO: 361735 - RNA, 64 nt, Human
uuuauaacauucacuuucugccucugaggaaagauacagggaacaaaaaucaauuuguacaguc

SEQ ID NO: 361736 - RNA, 64 nt, Human
gcccuggggacaccugcccagugggccccagcccuacagggacugggcaaagaugauguuucca

SEQ ID NO: 361737 - RNA, 64 nt, Human
auaaggaugaaauacugaugaaucucugugacauuacagggaaaaaaauauaguuuucuaucuc

SEQ ID NO: 361738 - RNA, 64 nt, Human
caccaggucaacccuucuccuccugcuguccagauacagggaagacucaggaugagggugcccg

SEQ ID NO: 361739 - RNA, 64 nt, Human; identical to SEQ ID NO: 277268

SEQ ID NO: 361740 - RNA, 64 nt, Human; identical to SEQ ID NO: 277269

SEQ ID NO: 361741 - RNA, 64 nt, Human; identical to SEQ ID NO: 277270

SEQ ID NO: 361742 - RNA, 64 nt, Human; identical to SEQ ID NO: 277271

SEQ ID NO: 361743 - RNA, 64 nt, Human; identical to SEQ ID NO: 277272

SEQ ID NO: 361744 - RNA, 64 nt, Human; identical to SEQ ID NO: 277273

SEQ ID NO: 361745 - RNA, 64 nt, Human; identical to SEQ ID NO: 277274

SEQ ID NO: 361746 - RNA, 64 nt, Human; identical to SEQ ID NO: 277275

SEQ ID NO: 361747 - RNA, 64 nt, Human; identical to SEQ ID NO: 277276

SEQ ID NO: 361748 - RNA, 64 nt, Human; identical to SEQ ID NO: 277277

SEQ ID NO: 361749 - RNA, 64 nt, Human; identical to SEQ ID NO: 277278

SEQ ID NO: 361750 - RNA, 64 nt, Human; identical to SEQ ID NO: 277279

SEQ ID NO: 361751 - RNA, 64 nt, Human; identical to SEQ ID NO: 277280

SEQ ID NO: 361752 - RNA, 64 nt, Human; identical to SEQ ID NO: 277281

SEQ ID NO: 361753 - RNA, 64 nt, Human; identical to SEQ ID NO: 277282

SEQ ID NO: 361754 - RNA, 64 nt, Human; identical to SEQ ID NO: 277283

SEQ ID NO: 361755 - RNA, 64 nt, Human; identical to SEQ ID NO: 277284

SEQ ID NO: 361756 - RNA, 64 nt, Human; identical to SEQ ID NO: 277285

SEQ ID NO: 361757 - RNA, 64 nt, Human; identical to SEQ ID NO: 277286

SEQ ID NO: 361758 - RNA, 64 nt, Human; identical to SEQ ID NO: 277287

SEQ ID NO: 361759 - RNA, 64 nt, Human; identical to SEQ ID NO: 277288

SEQ ID NO: 361760 - RNA, 64 nt, Human; identical to SEQ ID NO: 64475

SEQ ID NO: 361761 - RNA, 64 nt, Human; identical to SEQ ID NO: 64476

SEQ ID NO: 361762 - RNA, 64 nt, Human; identical to SEQ ID NO: 64477

SEQ ID NO: 361763 - RNA, 64 nt, Human; identical to SEQ ID NO: 64478

SEQ ID NO: 361764 - RNA, 64 nt, Human; identical to SEQ ID NO: 64479

SEQ ID NO: 361765 - RNA, 64 nt, Human; identical to SEQ ID NO: 64480

SEQ ID NO: 361766 - RNA, 64 nt, Human; identical to SEQ ID NO: 64481

SEQ ID NO: 361767 - RNA, 64 nt, Human; identical to SEQ ID NO: 64482

SEQ ID NO: 361768 - RNA, 64 nt, Human; identical to SEQ ID NO: 64483

SEQ ID NO: 361769 - RNA, 64 nt, Human; identical to SEQ ID NO: 64484

SEQ ID NO: 361770 - RNA, 64 nt, Human; identical to SEQ ID NO: 64485

SEQ ID NO: 361771 - RNA, 64 nt, Human; identical to SEQ ID NO: 64486

SEQ ID NO: 361772 - RNA, 64 nt, Human; identical to SEQ ID NO: 64487

SEQ ID NO: 361773 - RNA, 64 nt, Human; identical to SEQ ID NO: 64488

SEQ ID NO: 361774 - RNA, 64 nt, Human; identical to SEQ ID NO: 64489

SEQ ID NO: 361775 - RNA, 64 nt, Human; identical to SEQ ID NO: 64490

SEQ ID NO: 361776 - RNA, 55 nt, Human; identical to SEQ ID NO: 64491

SEQ ID NO: 361777 - RNA, 64 nt, Human; identical to SEQ ID NO: 64492

SEQ ID NO: 361778 - RNA, 64 nt, Human; identical to SEQ ID NO: 64493

SEQ ID NO: 361779 - RNA, 64 nt, Human; identical to SEQ ID NO: 64494

SEQ ID NO: 361780 - RNA, 64 nt, Human; identical to SEQ ID NO: 64495

SEQ ID NO: 361781 - RNA, 64 nt, Human; identical to SEQ ID NO: 64496

SEQ ID NO: 361782 - RNA, 64 nt, Human; identical to SEQ ID NO: 64497

SEQ ID NO: 361783 - RNA, 64 nt, Human; identical to SEQ ID NO: 64498

SEQ ID NO: 361784 - RNA, 51 nt, Human; identical to SEQ ID NO: 64499

SEQ ID NO: 361785 - RNA, 64 nt, Human; identical to SEQ ID NO: 64500

SEQ ID NO: 361786 - RNA, 64 nt, Human; identical to SEQ ID NO: 64501

SEQ ID NO: 361787 - RNA, 64 nt, Human; identical to SEQ ID NO: 64502

SEQ ID NO: 361788 - RNA, 64 nt, Human; identical to SEQ ID NO: 64503

SEQ ID NO: 361789 - RNA, 64 nt, Human; identical to SEQ ID NO: 64504

SEQ ID NO: 361790 - RNA, 64 nt, Human; identical to SEQ ID NO: 64505

SEQ ID NO: 361791 - RNA, 64 nt, Human; identical to SEQ ID NO: 64506

SEQ ID NO: 361792 - RNA, 64 nt, Human; identical to SEQ ID NO: 64507

SEQ ID NO: 361793 - RNA, 64 nt, Human; identical to SEQ ID NO: 64508

SEQ ID NO: 361794 - RNA, 64 nt, Human; identical to SEQ ID NO: 64509

SEQ ID NO: 361795 - RNA, 64 nt, Human; identical to SEQ ID NO: 64510

SEQ ID NO: 361796 - RNA, 64 nt, Human; identical to SEQ ID NO: 64511

SEQ ID NO: 361797 - RNA, 64 nt, Human; identical to SEQ ID NO: 64512

SEQ ID NO: 361798 - RNA, 64 nt, Human; identical to SEQ ID NO: 64513

SEQ ID NO: 361799 - RNA, 64 nt, Human; identical to SEQ ID NO: 64514

SEQ ID NO: 361800 - RNA, 64 nt, Human; identical to SEQ ID NO: 64515

SEQ ID NO: 361801 - RNA, 64 nt, Human; identical to SEQ ID NO: 64516

SEQ ID NO: 361802 - RNA, 64 nt, Human; identical to SEQ ID NO: 57906

SEQ ID NO: 361803 - RNA, 64 nt, Human; identical to SEQ ID NO: 57907

SEQ ID NO: 361804 - RNA, 64 nt, Human; identical to SEQ ID NO: 57908

SEQ ID NO: 361805 - RNA, 64 nt, Human; identical to SEQ ID NO: 57909

SEQ ID NO: 361806 - RNA, 64 nt, Human; identical to SEQ ID NO: 57910

SEQ ID NO: 361807 - RNA, 64 nt, Human; identical to SEQ ID NO: 57911

SEQ ID NO: 361808 - RNA, 64 nt, Human; identical to SEQ ID NO: 57912

SEQ ID NO: 361809 - RNA, 64 nt, Human; identical to SEQ ID NO: 57913

SEQ ID NO: 361810 - RNA, 64 nt, Human; identical to SEQ ID NO: 57914

SEQ ID NO: 361811 - RNA, 64 nt, Human; identical to SEQ ID NO: 57915

SEQ ID NO: 361812 - RNA, 64 nt, Human; identical to SEQ ID NO: 57916

SEQ ID NO: 361813 - RNA, 64 nt, Human; identical to SEQ ID NO: 57917

SEQ ID NO: 361814 - RNA, 64 nt, Human; identical to SEQ ID NO: 57918

SEQ ID NO: 361815 - RNA, 64 nt, Human; identical to SEQ ID NO: 57919

SEQ ID NO: 361816 - RNA, 64 nt, Human; identical to SEQ ID NO: 57920

SEQ ID NO: 361817 - RNA, 64 nt, Human; identical to SEQ ID NO: 57921

SEQ ID NO: 361818 - RNA, 55 nt, Human; identical to SEQ ID NO: 57922

SEQ ID NO: 361819 - RNA, 64 nt, Human; identical to SEQ ID NO: 57923

SEQ ID NO: 361820 - RNA, 64 nt, Human; identical to SEQ ID NO: 57924

SEQ ID NO: 361821 - RNA, 64 nt, Human; identical to SEQ ID NO: 57925

SEQ ID NO: 361822 - RNA, 64 nt, Human; identical to SEQ ID NO: 57926

SEQ ID NO: 361823 - RNA, 64 nt, Human; identical to SEQ ID NO: 57927

SEQ ID NO: 361824 - RNA, 50 nt, Human; identical to SEQ ID NO: 57928

SEQ ID NO: 361825 - RNA, 64 nt, Human; identical to SEQ ID NO: 57929

SEQ ID NO: 361826 - RNA, 64 nt, Human; identical to SEQ ID NO: 57930

SEQ ID NO: 361827 - RNA, 64 nt, Human; identical to SEQ ID NO: 57931

SEQ ID NO: 361828 - RNA, 64 nt, Human; identical to SEQ ID NO: 57932

SEQ ID NO: 361829 - RNA, 64 nt, Human; identical to SEQ ID NO: 57933

SEQ ID NO: 361830 - RNA, 64 nt, Human; identical to SEQ ID NO: 57934

SEQ ID NO: 361831 - RNA, 64 nt, Human; identical to SEQ ID NO: 57935

SEQ ID NO: 361832 - RNA, 64 nt, Human; identical to SEQ ID NO: 57936

SEQ ID NO: 361833 - RNA, 64 nt, Human; identical to SEQ ID NO: 57937

SEQ ID NO: 361834 - RNA, 64 nt, Human; identical to SEQ ID NO: 57938

SEQ ID NO: 361835 - RNA, 64 nt, Human; identical to SEQ ID NO: 57939

SEQ ID NO: 361836 - RNA, 64 nt, Human; identical to SEQ ID NO: 57940

SEQ ID NO: 361837 - RNA, 64 nt, Human; identical to SEQ ID NO: 57941

SEQ ID NO: 361838 - RNA, 64 nt, Human; identical to SEQ ID NO: 57942

SEQ ID NO: 361839 - RNA, 64 nt, Human; identical to SEQ ID NO: 57943

SEQ ID NO: 361840 - RNA, 64 nt, Human; identical to SEQ ID NO: 57944

SEQ ID NO: 361841 - RNA, 64 nt, Human; identical to SEQ ID NO: 57945

SEQ ID NO: 361842 - RNA, 64 nt, Human; identical to SEQ ID NO: 57946

SEQ ID NO: 361843 - RNA, 64 nt, Human; identical to SEQ ID NO: 57947

SEQ ID NO: 361844 - RNA, 64 nt, Human; identical to SEQ ID NO: 57948

SEQ ID NO: 361845 - RNA, 64 nt, Human; identical to SEQ ID NO: 57949

SEQ ID NO: 361846 - RNA, 64 nt, Human; identical to SEQ ID NO: 57950

SEQ ID NO: 361847 - RNA, 64 nt, Human; identical to SEQ ID NO: 57951

SEQ ID NO: 361848 - RNA, 64 nt, Human; identical to SEQ ID NO: 57952

SEQ ID NO: 361849 - RNA, 64 nt, Human; identical to SEQ ID NO: 57953

SEQ ID NO: 361850 - RNA, 64 nt, Human; identical to SEQ ID NO: 57954

SEQ ID NO: 361851 - RNA, 57 nt, Human; identical to SEQ ID NO: 57955

SEQ ID NO: 361852 - RNA, 64 nt, Human; identical to SEQ ID NO: 57956

SEQ ID NO: 361853 - RNA, 64 nt, Human; identical to SEQ ID NO: 57957

SEQ ID NO: 361854 - RNA, 64 nt, Human; identical to SEQ ID NO: 57958

SEQ ID NO: 361855 - RNA, 64 nt, Human; identical to SEQ ID NO: 57959

SEQ ID NO: 361856 - RNA, 64 nt, Human; identical to SEQ ID NO: 57960

SEQ ID NO: 361857 - RNA, 64 nt, Human; identical to SEQ ID NO: 57961

SEQ ID NO: 361858 - RNA, 63 nt, Human; identical to SEQ ID NO: 57962

SEQ ID NO: 361859 - RNA, 64 nt, Human; identical to SEQ ID NO: 57963

SEQ ID NO: 361860 - RNA, 64 nt, Human; identical to SEQ ID NO: 57964

SEQ ID NO: 361861 - RNA, 64 nt, Human; identical to SEQ ID NO: 57965

SEQ ID NO: 361862 - RNA, 64 nt, Human; identical to SEQ ID NO: 57966

SEQ ID NO: 361863 - RNA, 64 nt, Human; identical to SEQ ID NO: 57967

SEQ ID NO: 361864 - RNA, 64 nt, Human; identical to SEQ ID NO: 57968

SEQ ID NO: 361865 - RNA, 64 nt, Human; identical to SEQ ID NO: 57969

SEQ ID NO: 361866 - RNA, 64 nt, Human; identical to SEQ ID NO: 57970

SEQ ID NO: 361867 - RNA, 64 nt, Human; identical to SEQ ID NO: 57971

SEQ ID NO: 361868 - RNA, 64 nt, Human; identical to SEQ ID NO: 57972

SEQ ID NO: 361869 - RNA, 64 nt, Human; identical to SEQ ID NO: 57973

SEQ ID NO: 361870 - RNA, 64 nt, Human; identical to SEQ ID NO: 57974

SEQ ID NO: 361871 - RNA, 64 nt, Human; identical to SEQ ID NO: 57975

SEQ ID NO: 361872 - RNA, 64 nt, Human; identical to SEQ ID NO: 57976

SEQ ID NO: 361873 - RNA, 64 nt, Human; identical to SEQ ID NO: 57977

SEQ ID NO: 361874 - RNA, 64 nt, Human; identical to SEQ ID NO: 57978

SEQ ID NO: 361875 - RNA, 64 nt, Human; identical to SEQ ID NO: 57979

SEQ ID NO: 361876 - RNA, 64 nt, Human; identical to SEQ ID NO: 57980

SEQ ID NO: 361877 - RNA, 64 nt, Human; identical to SEQ ID NO: 57981

SEQ ID NO: 361878 - RNA, 64 nt, Human; identical to SEQ ID NO: 57982

SEQ ID NO: 361879 - RNA, 64 nt, Human; identical to SEQ ID NO: 57983

SEQ ID NO: 361880 - RNA, 64 nt, Human; identical to SEQ ID NO: 57984

SEQ ID NO: 361881 - RNA, 64 nt, Human; identical to SEQ ID NO: 57985

SEQ ID NO: 361882 - RNA, 64 nt, Human; identical to SEQ ID NO: 57986

SEQ ID NO: 361883 - RNA, 64 nt, Human; identical to SEQ ID NO: 57987

SEQ ID NO: 361884 - RNA, 64 nt, Human; identical to SEQ ID NO: 57988

SEQ ID NO: 361885 - RNA, 64 nt, Human; identical to SEQ ID NO: 57989

SEQ ID NO: 361886 - RNA, 64 nt, Human; identical to SEQ ID NO: 57990

SEQ ID NO: 361887 - RNA, 64 nt, Human; identical to SEQ ID NO: 57991

SEQ ID NO: 361888 - RNA, 64 nt, Human; identical to SEQ ID NO: 57992

SEQ ID NO: 361889 - RNA, 64 nt, Human; identical to SEQ ID NO: 57993

SEQ ID NO: 361890 - RNA, 64 nt, Human; identical to SEQ ID NO: 57994

SEQ ID NO: 361891 - RNA, 64 nt, Human; identical to SEQ ID NO: 57995

SEQ ID NO: 361892 - RNA, 64 nt, Human; identical to SEQ ID NO: 57996

SEQ ID NO: 361893 - RNA, 64 nt, Human; identical to SEQ ID NO: 57997

SEQ ID NO: 361894 - RNA, 64 nt, Human; identical to SEQ ID NO: 57998

SEQ ID NO: 361895 - RNA, 64 nt, Human; identical to SEQ ID NO: 57999

SEQ ID NO: 361896 - RNA, 64 nt, Human; identical to SEQ ID NO: 58000

SEQ ID NO: 361897 - RNA, 64 nt, Human; identical to SEQ ID NO: 58001

SEQ ID NO: 361898 - RNA, 64 nt, Human; identical to SEQ ID NO: 58002

SEQ ID NO: 361899 - RNA, 64 nt, Human; identical to SEQ ID NO: 58003

SEQ ID NO: 361900 - RNA, 64 nt, Human; identical to SEQ ID NO: 58004

SEQ ID NO: 361901 - RNA, 64 nt, Human; identical to SEQ ID NO: 58005

SEQ ID NO: 361902 - RNA, 60 nt, Human
gcgugauugacccuuuaacuguauccuuaaccaccgcauaugcaugccaggcugggcacg

SEQ ID NO: 361903 - RNA, 60 nt, Human
accccggccucucaguucuugagggccuccccaccgcagcagcaaggaaagcucacgaac

SEQ ID NO: 361904 - RNA, 60 nt, Human
aggaacuucuagucagaugaccuugcagaaccaccgcauuccacccugcccuuuggggag

SEQ ID NO: 361905 - RNA, 60 nt, Human
caaagagaugagcuuuuggggcacaacaucccaccgcagucccccucacccgacaacacc

SEQ ID NO: 361906 - RNA, 60 nt, Human
uaaaacuuguuuucuccuauucacuacuccccaccgcacuuaaaaucuaugaguuuuuac

SEQ ID NO: 361907 - RNA, 60 nt, Human
gucuuaguuuauuuaaacgcuuaacaucuuccaccgcaacagcuugccucuagaggggga

SEQ ID NO: 361908 - RNA, 60 nt, Human
uucccaaagugcugagauuacaggugugagccaccgcacccggccaacuuucugaaauuu

SEQ ID NO: 361909 - RNA, 60 nt, Human
uccuuaaagugcugggauuacaggcaugagccaccgcacccagccgcuuuuuaaaauuuu

SEQ ID NO: 361910 - RNA, 60 nt, Human
auugaccggcuuuagacgcccaccccccacccaccgcaagcuuugagugggacaccauuc

SEQ ID NO: 361911 - RNA, 60 nt, Human
caagggugacaucgacaaccacguaccaagccaccgcagcugcugccacucugcugccug

SEQ ID NO: 361912 - RNA, 60 nt, Human
cucccaaagugcugggauuacaggugugagccaccgcacccggcuggccaaucuuaucag

SEQ ID NO: 361913 - RNA, 60 nt, Human
cccugaauucacccaggaccauccaaggggccaccgcagcauuggccccaucaccacguc

SEQ ID NO: 361914 - RNA, 60 nt, Human
gcucuccgcuccaccccuuagccugggaacccaccgcaggugugaguucugugagucacu

SEQ ID NO: 361915 - RNA, 60 nt, Human
gggaaguugcugggguggagaagggcuagcccaccgcagcagccucccucccucucagca

SEQ ID NO: 361916 - RNA, 60 nt, Human
aggcagagguugcagugaaccgagaucaugccaccgcacuucagccugggugacagagaa

SEQ ID NO: 361917 - RNA, 60 nt, Human
cucccaaagugcugggauuacaggugugagccaccgcaccuggccuaaaccagauuucuu

SEQ ID NO: 361918 - RNA, 60 nt, Human
gccucccaaagugcugggauuaggugugagccaccgcaccuggccgauauuuucuuuaau

SEQ ID NO: 361919 - RNA, 60 nt, Human
aagcagagguugcagugagcugagaucacaccaccgcacuccagccugggugacagagug

SEQ ID NO: 361920 - RNA, 60 nt, Human
agagccugccugccugggcgggcccgcccgccaccgcagccucccagcugcucuccgugu

SEQ ID NO: 361921 - RNA, 60 nt, Human
ucaucccggccuucccggcccacuuccuggccaccgcaggccccucgcccauggccgcug

SEQ ID NO: 361922 - RNA, 60 nt, Human
cucccaaagugcugggaugacaggcaugagccaccgcacccggccaacacagauguuuau

SEQ ID NO: 361923 - RNA, 60 nt, Human
ucccccagaggcacauuccucuccaucuuuccaccgcacaccuggaccaggcuugcaggc

SEQ ID NO: 361924 - RNA, 60 nt, Human
cagugccugagaagacagucccuuuucuacccaccgcacuccauaaccuccaucuucucc

SEQ ID NO: 361925 - RNA, 60 nt, Human
ccgacuugcagaccuagguugagcagagcuccaccgcagucccgggugucugcggccgca

SEQ ID NO: 361926 - RNA, 60 nt, Human
cuaucaaaguguugggauuacaggcuugagccaccgcacccggccgagaauauguguugu

SEQ ID NO: 361927 - RNA, 60 nt, Human
gcucaggcugcuggucccaaccucagagccccaccgcagcccaguagggaugcagcacgc

SEQ ID NO: 361928 - RNA, 60 nt, Human
cucccaaaguguugggauuacaggcgugagccaccgcacccggcccuuguguacauuuuu

SEQ ID NO: 361929 - RNA, 60 nt, Human
cucccaaagugcugggauuacagaugugagccaccgcauccagccccacacccucauuua

SEQ ID NO: 361930 - RNA, 60 nt, Human
caguagccagcaucugccuccccuucacucccaccgcaggauuugggcucuuggaauccu

SEQ ID NO: 361931 - RNA, 60 nt, Human
ugugagcaggccccaugcccagcacgccagccaccgcaggauaccucagucauaccaguu

SEQ ID NO: 361932 - RNA, 54 nt, Human
auucgcgccucgaucucugagagcccaccgcaugccggugcagacggaugcgag

SEQ ID NO: 361933 - RNA, 60 nt, Human
cucccagagugcugggauuacaggcgugagccaccgcacccagccuaauuugccuuuuga

SEQ ID NO: 361934 - RNA, 60 nt, Human
cucccaaacugcugggauuacaggugugagccaccgcacguagcauuuacauuagguauu

SEQ ID NO: 361935 - RNA, 60 nt, Human
ccaucucucucccacuucuucuccccucccccaccgcaucuggccagauggacuguccua

SEQ ID NO: 361936 - RNA, 60 nt, Human
gaauaucccuggccagccuuuccacggcgcccaccgcagugccgcugccuggcccucagu

SEQ ID NO: 361937 - RNA, 60 nt, Human
ugccaccccagugagauguccccugacccuccaccgcagaaggaaggcagggaggaggca

SEQ ID NO: 361938 - RNA, 60 nt, Human
cucccaaagugcugggauuacaggcaugagccaccgcacccagccuauuuuauacuuuuu

SEQ ID NO: 361939 - RNA, 60 nt, Human
caaugccuuuuugauuacaguguagcuugcccaccgcauuugucguuuuagauacuuugc

SEQ ID NO: 361940 - RNA, 60 nt, Human
ucccaaauugcugggauuuacaggcaugagccaccgcacccagccuacaauaauuuucuu

SEQ ID NO: 361941 - RNA, 60 nt, Human
cucccaaggugcugggauuacaagcgugagccaccgcacccggccugaaaauauuuucua

SEQ ID NO: 361942 - RNA, 60 nt, Human
caucccggccggcgcgcucaucccacccgcccaccgcagggugaacugcagcgaguacuu

SEQ ID NO: 361943 - RNA, 60 nt, Human
uaaggaacucagggggcacguggucaggcuccaccgcacagaagagccacagucuccaga

SEQ ID NO: 361944 - RNA, 60 nt, Human
uucccaaaguggugggauuacaggcgugagccaccgcacccggccuccauaucccccuuu

SEQ ID NO: 361945 - RNA, 60 nt, Human
cucccaaagugcugggauuacaggugugagccaccgcagccggaccauuuuuaguauauu

SEQ ID NO: 361946 - RNA, 60 nt, Human
caugcagauaagcccuggccaucucagcagccaccgcacaaccccccuaaugaaagacac

SEQ ID NO: 361947 - RNA, 60 nt, Human
cauguagacaagcccuggucaucucagcagccaccgcacaacaccccugguggaagacac

SEQ ID NO: 361948 - RNA, 60 nt, Human
gggcuguggucauacacacuguguacguggccaccgcaaaggacggcgucgugcaacccu

SEQ ID NO: 361949 - RNA, 60 nt, Human
aggcagagguuggagugagcugagaucgcgccaccgcacuccagccugggcaacagagcg

SEQ ID NO: 361950 - RNA, 60 nt, Human
cucccaaagugcugggauuacaggugugagccaccgcaccuggccucuguccucuuuuag

SEQ ID NO: 361951 - RNA, 60 nt, Human
cucccgaagugcugggauuauaggugugagccaccgcacccaguugggaacaaagccuuu

SEQ ID NO: 361952 - RNA, 60 nt, Human
aagcccgaggagaacugagacucugccuuaccaccgcagugcggggcaccucucccagcg

SEQ ID NO: 361953 - RNA, 60 nt, Human
cucccaaagugcugggauuacaggcgugagccaccgcacccagccagggggaauguucua

SEQ ID NO: 361954 - RNA, 60 nt, Human
cucccaaacugcugagauuacagaugugagccaccgcacccuaccucauuuucuguaaca

SEQ ID NO: 361955 - RNA, 60 nt, Human
cgucuguggucugugucgcuguccccagucccaccgcaguccugccgcaggccuaacccu

SEQ ID NO: 361956 - RNA, 60 nt, Human
cucccaaagugcugggauuacaggcaugagccaccgcaccuggccuucccugcuuccucu

SEQ ID NO: 361957 - RNA, 60 nt, Human
uggagcucuccaggaaagccaagcuggcggccaccgcaggggcccuccacauucuggccg

SEQ ID NO: 361958 - RNA, 60 nt, Human
gaauuucaguucaucagauguucaccauggccaccgcagaacaccgaaguaauuccagca

SEQ ID NO: 361959 - RNA, 60 nt, Human
uccucuguaaaaugggcaugauuagagugcccaccgcauuagggauguuggggugaguca

SEQ ID NO: 361960 - RNA, 60 nt, Human
ccaucucuccuccccucccccugggguggcccaccgcauggguacaggggguuccaggaa

SEQ ID NO: 361961 - RNA, 60 nt, Human
gugaaaagcaaaccagaacaaaacaaaaagccaccgcaauaauucgguaaggacaggaua

SEQ ID NO: 361962 - RNA, 60 nt, Human
gcccacucuacugccccagcuccguuucuaccaccgcauccucacugggcucacugcagg

SEQ ID NO: 361963 - RNA, 60 nt, Human
ugcacacaggaggagagcuggaccugagggccaccgcagcggugcacacauuccucuggg

SEQ ID NO: 361964 - RNA, 60 nt, Human
gccgaucaguggagucaguaucgagccugaccaccgcaagccaggaagcaggugaagugc

SEQ ID NO: 361965 - RNA, 60 nt, Human
ugccauuucaaagacucauuucuccuauaaccaccgcaugaguugaaucaaaauuuucag

SEQ ID NO: 361966 - RNA, 60 nt, Human
ccuccugaguagccaggacuauggcauguaccaccgcaccugccucacauuuucuuucuc

SEQ ID NO: 361967 - RNA, 60 nt, Human
cucccaaagugcugggauuacaggugucagccaccgcacccagccaagcaccccuaucuc

SEQ ID NO: 361968 - RNA, 60 nt, Human
ccccaccagggucuuguuuaaaggggugagccaccgcacccaguccugagggguggccuc

SEQ ID NO: 361969 - RNA, 60 nt, Human
agguggagguugcagugagccaagaucgcaccaccgcaugagagagagagauuacuauuu

SEQ ID NO: 361970 - RNA, 60 nt, Human
cucccaaagugcugggaauacaggcaugagccaccgcacucggccaggagcuaguuuuac

SEQ ID NO: 361971 - RNA, 60 nt, Human
acuggaugcacccaggccggcccgagccucccaccgcagacaguguggaacagagugagc

SEQ ID NO: 361972 - RNA, 60 nt, Human
aggcagagguugcacugagcugagauuaagccaccgcacuccagccugggcgacagagca

SEQ ID NO: 361973 - RNA, 60 nt, Human
uggagagggaggcggcccgcagcagaacagccaccgcacuuccuccucagcuuccucugg

SEQ ID NO: 361974 - RNA, 60 nt, Human
gcugguagaggccauccagacggugcaggcccaccgcaauaucugcccuaacucaggcuu

SEQ ID NO: 361975 - RNA, 60 nt, Human
gguggaggcugcugugggacggucaggccaccaccgcaaagaggcagccggagcuucugc

SEQ ID NO: 361976 - RNA, 60 nt, Human
ucucccucgacagcgccccugcugucuuccccaccgcagucaccaccacccgaaaugcca

SEQ ID NO: 361977 - RNA, 60 nt, Human
uccgugagcaaagccugggugcccaagcagccaccgcagcagcagaguacaaccugcaga

SEQ ID NO: 361978 - RNA, 60 nt, Human
gcccacguccugucagugccgccgccucgcccaccgcaugcccccucgugccagucgcgc

SEQ ID NO: 361979 - RNA, 60 nt, Human
cagcagccuuacuucaucggcccacagacaccaccgcaguuucuucuuaaaggcucugcu

SEQ ID NO: 361980 - RNA, 60 nt, Human
aggcacaacuccccgggcagaaaacgugccccaccgcaucccuaccuggaaacugaccag

SEQ ID NO: 361981 - RNA, 58 nt, Human
ccaagggugccaagcugugaugagagggccaccgcagagcccaggaggcagcaucucc

SEQ ID NO: 361982 - RNA, 60 nt, Human
cucucagagugcugggaucacaggcgugagccaccgcacccagccuuuuaccaugugggu

SEQ ID NO: 361983 - RNA, 60 nt, Human
ugugcgcgacauggggaaagaggguggcucccaccgcaaggagacagaaggugaagacau

SEQ ID NO: 361984 - RNA, 60 nt, Human
guacacagugacccaggagucugggccagcccaccgcaaagaauucaccaugaccugucg

SEQ ID NO: 361985 - RNA, 60 nt, Human
cccgggucccccccagccugcucuagcugcccaccgcacccugaucucucuucucuaugc

SEQ ID NO: 361986 - RNA, 60 nt, Human
aguguaaaaaugucccaaguguagccccucccaccgcagagccuguuucuaacguaccug

SEQ ID NO: 361987 - RNA, 60 nt, Human
cucccaaagugcugguauuacagaugugagccaccgcacccagccugaguuucucuuucu

SEQ ID NO: 361988 - RNA, 60 nt, Human
agacccuccugaggagugaagagugacaugccaccgcaggauccuuugcucugcacgagu

SEQ ID NO: 361989 - RNA, 60 nt, Human
uccuagguaggcucaaagguagacccguuuccaccgcagcaggugaacaugaccguguuu

SEQ ID NO: 361990 - RNA, 60 nt, Human
cucccaaagugcuuggauuacagguguaagccaccgcaccccgcccagccuggcagauuu

SEQ ID NO: 361991 - RNA, 60 nt, Human
cucccaaagugcuuggauuacaggcaugagccaccgcacccagcaagaguuauuuucuua

SEQ ID NO: 361992 - RNA, 60 nt, Human
cucccaaagugcugggauuacaggugugauccaccgcaccuggcccuaacuuuuaauaua

SEQ ID NO: 361993 - RNA, 60 nt, Human
gagggcagagggaaggcgauacauccuuccccaccgcaggcaccccgggggcuggagggg

SEQ ID NO: 361994 - RNA, 60 nt, Human
cucccaaagugcugggauuacaggcaugagccaccgcacccagccugcauuccuguuuuu

SEQ ID NO: 361995 - RNA, 60 nt, Human
guggacaucuuugggaggccguuauucugcccaccgcacccuccguucauccccugcccu

SEQ ID NO: 361996 - RNA, 60 nt, Human
cugcucugaccucagcagcuacaccuaaccccaccgcacccuacccagugucgauaucca

SEQ ID NO: 361997 - RNA, 60 nt, Human
caagcaccaccaaucgcuuuaaugcuucagccaccgcaugaggcccuguccaccaccuuu

SEQ ID NO: 361998 - RNA, 60 nt, Human
aggauguucugggcuaauauacuuguaaaaccaccgcauucuaggguuuucuuucauuuu

SEQ ID NO: 361999 - RNA, 60 nt, Human
cugugccccgacuucccacaccagccgcgcccaccgcaggugggacucagguucgcccuc

SEQ ID NO: 362000 - RNA, 60 nt, Human
caacaaucaacugguuuucaccaaguccaaccaccgcaaugaguucuggagugcucugcu

SEQ ID NO: 362001 - RNA, 60 nt, Human
ucccagggguucaggugguggagcaggaagccaccgcacccccaaagucacugggcccug

SEQ ID NO: 362002 - RNA, 60 nt, Human
gccgcaacccaagcagaugacaggcacaggccaccgcaugaggagauggagggcgggacu

SEQ ID NO: 362003 - RNA, 60 nt, Human
cgcgugucagacuccaucccuccucugccgccaccgcagcagccacaggcagaggaggac

SEQ ID NO: 362004 - RNA, 60 nt, Human
cucccaaagugcugggauuacaggcaugagccaccgcacccgacggucuuuucaaagcua

SEQ ID NO: 362005 - RNA, 60 nt, Human
ccccuugacauucaggauguagcuuccugcccaccgcauacccuggcgccucacuccuca

SEQ ID NO: 362006 - RNA, 60 nt, Human
aggcagagguugcagugagccgagauugcaccaccgcacuccagccugggugacagagcg

SEQ ID NO: 362007 - RNA, 60 nt, Human
ccuccaagaccuucuccuucaccuuuguccccaccgcagacaggaccagggauuuccaug

SEQ ID NO: 362008 - RNA, 60 nt, Human
ugagccggagcucaugccgaccuuuccccaccaccgcaacaagcgggccgccccagccac

SEQ ID NO: 362009 - RNA, 60 nt, Human
cagaagagccccacgggcuuccugcaucuuccaccgcaccauaccuggagcccuccgagg

SEQ ID NO: 362010 - RNA, 60 nt, Human
acaggggaccaaggucagggccccccugccccaccgcacccccagaauauaagcuaucaa

SEQ ID NO: 362011 - RNA, 60 nt, Human
cucccagagugcugggauuacaggcgugagccaccgcacccggccucuguguagcuuuua

SEQ ID NO: 362012 - RNA, 60 nt, Human
augggccuuggucacacuccuuggcuucucccaccgcaagcaacgcugccugccucugcc

SEQ ID NO: 362013 - RNA, 60 nt, Human
ggcagccagccccuggcaggggcgacugugccaccgcaggcagcgcuccagucgggaaug

SEQ ID NO: 362014 - RNA, 60 nt, Human
cacugcuccacauggugucggcucacagagccaccgcaacucugcccagcgggagugaca

SEQ ID NO: 362015 - RNA, 60 nt, Human
ugcugugcuggaauuccacagggaccagggccaccgcaggggacugucucagaagacuug

SEQ ID NO: 362016 - RNA, 60 nt, Human
ccccaacuccaaccucucggccccaucgccccaccgcagcuacuccccuuucuuccaaac

SEQ ID NO: 362017 - RNA, 60 nt, Human
cagaggcacccuggugccccgccuggcagaccaccgcacacagaucaagcggggcagcac

SEQ ID NO: 362018 - RNA, 60 nt, Human
cucccaaggugcuaggauuacaggcaugagccaccgcaccgggcccuccuugccuguuuu

SEQ ID NO: 362019 - RNA, 60 nt, Human
aaaggcccacaugauacaauuagagaauucccaccgcacaaaaaaaguuccuaaguaugu

SEQ ID NO: 362020 - RNA, 60 nt, Human
gggacagguuucucccuggauacucuuggcccaccgcagaucuguagccagucagaggag

SEQ ID NO: 362021 - RNA, 60 nt, Human
cucccaaagugcugggauuacaggugugagccaccgcacccaauccuauuagguuucuuu

SEQ ID NO: 362022 - RNA, 60 nt, Human
uacaaagccggcugcccagccccagccucaccaccgcaucccaccuccugcccuccauac

SEQ ID NO: 362023 - RNA, 60 nt, Human
aggcaaagguugcagugaacugagauugcgccaccgcacuccagccugggcgacagagcg

SEQ ID NO: 362024 - RNA, 60 nt, Human
ccccgcuagcggggccaggagccgggccucccaccgcagcgucccccgccgcgccagucc

SEQ ID NO: 362025 - RNA, 60 nt, Human
ggagcuaaaggaagggcaggcccacaggggccaccgcagagccgagucggggcggcaucg

SEQ ID NO: 362026 - RNA, 60 nt, Human
ccccucgaagggacucucuggccaccuccuccaccgcaguccagcucccucagucuggca

SEQ ID NO: 362027 - RNA, 60 nt, Human
gcuccugaaacgcugcaguggaacgcgcagccaccgcaccugagacgcaggcuggcuggg

SEQ ID NO: 362028 - RNA, 60 nt, Human
cucggccacccgggggucgcucccucgugcccaccgcaccugccgagccucuuuggaccc

SEQ ID NO: 362029 - RNA, 60 nt, Human
guuguaagccuugcacgggacagaccacacccaccgcaaccucauccccucagcacuaac

SEQ ID NO: 362030 - RNA, 60 nt, Human
cucccaaguagcugggauaacaggcgcccaccaccgcacccugcuaauuuuuuguauuuu

SEQ ID NO: 362031 - RNA, 60 nt, Human
ggcucuggucacccugacccucugcccugcccaccgcaggucccccggggucccggaagc

SEQ ID NO: 362032 - RNA, 60 nt, Human
aggcacgggggcacugagggcgcagccccuccaccgcagcccugcugcuucugaggacuu

SEQ ID NO: 362033 - RNA, 60 nt, Human
cucccaaagugcuaggauaacaggugugagccaccgcacccugccaaguuauuuuaaaau

SEQ ID NO: 362034 - RNA, 60 nt, Human
cucccaaagugcugggauuacaggcgugagccaccgcaccuggcccuccuuuuucaucua

SEQ ID NO: 362035 - RNA, 60 nt, Human
gcaggagccccgccuggcccgaagccguuuccaccgcagcaggcagaggggcuggacagg

SEQ ID NO: 362036 - RNA, 60 nt, Human
cucccaaagugcuggaaucacaggggugagccaccgcacccagcccucucucuuccucaa

SEQ ID NO: 362037 - RNA, 60 nt, Human
cucgguuucccgcggacuuggcugcugcucccaccgcaguaccgccuccuggaacggaag

SEQ ID NO: 362038 - RNA, 60 nt, Human
gggcccccugggcagguuccccaccccgccccaccgcauccuucucggagcuggugccug

SEQ ID NO: 362039 - RNA, 60 nt, Human
ucugaccgaccuacgccacuggaaacacacccaccgcaaccucaagaaccagacugugca

SEQ ID NO: 362040 - RNA, 60 nt, Human
gguuuguuggucacagugggagagguuucaccaccgcauucugaccuccuccucccaaaa

SEQ ID NO: 362041 - RNA, 60 nt, Human
cucccaaagugcugggauuacaggcaugagccaccgcacccagccugguuauuggauuua

SEQ ID NO: 362042 - RNA, 60 nt, Human
gggcggcaaugacacugcaccucuccuuucccaccgcauucccuggagcucccuaaauaa

SEQ ID NO: 362043 - RNA, 60 nt, Human
cucccaaaguguuaggauuaggggcaugagccaccgcacccagcuugcauugaauauuuu

SEQ ID NO: 362044 - RNA, 60 nt, Human
cuccaaaguugcuaggaccauagccaggugccaccgcaccgggcaaauuuuuguguuccu

SEQ ID NO: 362045 - RNA, 60 nt, Human
cucccaaagcguugggauuauaggcgugagccaccgcaccuggccagggaaccuucuuua

SEQ ID NO: 362046 - RNA, 60 nt, Human
gggaaggaacaggacugcaaaaauccuucuccaccgcacagacugggaaccccuccuggc

SEQ ID NO: 362047 - RNA, 60 nt, Human
cagcagcuccagcucagagcagugccagccccaccgcaacugcacggcccugggccuggc

SEQ ID NO: 362048 - RNA, 60 nt, Human
ugugucuccccuggccucgccuucugcaaaccaccgcagccaccacagcgucagggugga

SEQ ID NO: 362049 - RNA, 60 nt, Human
gcugcccgaggaggagcucuaggccgacgcccaccgcaggccuuacagucuucucuggac

SEQ ID NO: 362050 - RNA, 60 nt, Human
cccacccaggcccccagcuccccgcgggggccaccgcagggccugugggcugggucacgu

SEQ ID NO: 362051 - RNA, 60 nt, Human
caugaaguagacgccaccuggaugccccauccaccgcaugcggugcccguggcccgcccc

SEQ ID NO: 362052 - RNA, 60 nt, Human
cucccacagugcugggauuacaggcgugagccaccgcacccggcuugcaauuuagaaagg

SEQ ID NO: 362053 - RNA, 60 nt, Human
cugguagccauagcagccccugcuucagccccaccgcaccccuccagggggccugccuuu

SEQ ID NO: 362054 - RNA, 60 nt, Human
augaaauaauugguuguuggcaccaucucaccaccgcauaucccucacccccucggcaag

SEQ ID NO: 362055 - RNA, 63 nt, Human
uggauucaucaccugucaugcauugacaccugauacccagacuuaauugguauuuguucuugc

SEQ ID NO: 362056 - RNA, 63 nt, Human
cagauuauucccagucucccaguaacacguuucuacccagauccuuuuucauuuccuuaaguu

SEQ ID NO: 362057 - RNA, 63 nt, Human
guaccccaaaacaaugucaccaugguuaccaccuacccagaagacuguucccuccucccaaga

SEQ ID NO: 362058 - RNA, 63 nt, Human
gcugagaaugaaccugacuagagguucuggagauacccagaggucccccaggucaucacuugg

SEQ ID NO: 362059 - RNA, 63 nt, Human
aaaaaaucuguaucuuuuacugagaacacccaauacccagauaaaugacuguaucaggauuuc

SEQ ID NO: 362060 - RNA, 63 nt, Human
cuguguucucaggaagacugccuccaccaccgcuacccagagaaccucugcaucuggcauuuc

SEQ ID NO: 362061 - RNA, 63 nt, Human
caaggaccaagggccauaucccaagugacuuuguacccagaaaauaacagcuguucaauaaau

SEQ ID NO: 362062 - RNA, 63 nt, Human
cagaaccccuacuuccaagugcucuauuuguauuacccagaugacugaagcuuaagagaaggc

SEQ ID NO: 362063 - RNA, 63 nt, Human
auggaucuuagagcuaaaaaggacuguaaaaauuacccagaacagcguccucagacuuaaccu

SEQ ID NO: 362064 - RNA, 63 nt, Human
cucagauccugucuuuagcaaccagcuaauauuuacccagagguacugcaauagaguauuuca

SEQ ID NO: 362065 - RNA, 63 nt, Human
auuuucucuaggauuucugaaaguuacugacaauacccagacaggggcuuugcuauuuaaaaa

SEQ ID NO: 362066 - RNA, 63 nt, Human
uagugguuuaguguuuucaaaucauguuucucauacccagauaguagauuauucacuuaggac

SEQ ID NO: 362067 - RNA, 63 nt, Human
agucuuccaccuuucuguucaaggcuguuugucuacccagaggaaggaggcacugcugaaugg

SEQ ID NO: 362068 - RNA, 63 nt, Human
ucaccuucuccaagcaaagccauauggagcaucuacccagacucccacucugcacacacucac

SEQ ID NO: 362069 - RNA, 55 nt, Human
uacuggccucagaccacuagccccuuacccagaguggcccacaggaaacagccug

SEQ ID NO: 362070 - RNA, 64 nt, Human
cuguggagaccagacucugcaaguggggagaccacccccgcaagccagugacaagggagcccug

SEQ ID NO: 362071 - RNA, 64 nt, Human
cuaucauuuuuggcuccgagaagagggcaaggggcccccgcaggguacuucugugcuugcccuc

SEQ ID NO: 362072 - RNA, 50 nt, Human; identical to SEQ ID NO: 301202

SEQ ID NO: 362073 - RNA, 63 nt, Human
ggcccucucagccuuccuaucaucccacgugucuacccagacccuugugcggcccaugcccug

SEQ ID NO: 362074 - RNA, 63 nt, Human
ucagaacucugaaaaugucccuguccuccccuuuacccagagggaggucgugaagggccccgg

SEQ ID NO: 362075 - RNA, 63 nt, Human
auagauguuuguggauguagcacugaguggugauacccagaccagcagucaccccaggaagug

SEQ ID NO: 362076 - RNA, 63 nt, Human
guccucuugcucaaaaaucuguuugaucccuguuacccagagaauauauacauucuuuaucuu

SEQ ID NO: 362077 - RNA, 63 nt, Human
ccgacccacugcagacacaggcucugauucucuuacccagagaugcccaugagcugacauuuu

SEQ ID NO: 362078 - RNA, 63 nt, Human
cuaauauaauuuuauauuuacacacauacgugcuacccagagauuaauuuaguccauaugaac

SEQ ID NO: 362079 - RNA, 63 nt, Human
cccagggccaaccccuacggaacaccacuacuuuacccagacgccacaggucaucaucuggau

SEQ ID NO: 362080 - RNA, 63 nt, Human
gugagaacauccauaauuuggggcccugaguuuuacccagacucaaggaguugguaaaggguu

SEQ ID NO: 362081 - RNA, 63 nt, Human
uugcaacaccagucuguuuuuaacagguucuauuacccagaacuuuuuuguaaaugcggcagu

SEQ ID NO: 362082 - RNA, 63 nt, Human
uguaugaugacuauuugggaggacacauuuauguacccagaggcccccacuaauaagugguac

SEQ ID NO: 362083 - RNA, 63 nt, Human
uccacucuuccuuuaauuuauuugaccucccacuacccagaaugggagacgugccuccccuuc

SEQ ID NO: 362084 - RNA, 63 nt, Human
uggcccagcuccauacucuguccccccagcuaauacccagagcacccagaucagacucuccuu

SEQ ID NO: 362085 - RNA, 63 nt, Human
uguauuccauaugucuauaacaaaagcaauauauacccagacuacacuaguccauaagcuuua

SEQ ID NO: 362086 - RNA, 63 nt, Human
cauucacauaugggagguuagauuuuuuuccucuacccagagucccuuuuuaguuuaccccac

SEQ ID NO: 362087 - RNA, 63 nt, Human
cuccagagaccauauuuucucucccuccauuucuacccagaccuccaggccuccuucuggaau

SEQ ID NO: 362088 - RNA, 63 nt, Human
acuaaagacccccaguguuguaacguaccuuuguacccagacaaaacaauuauguuacauucc

SEQ ID NO: 362089 - RNA, 64 nt, Human
ggcucagggcucagacuugggagggccuaggcagaagccccaaguucuguuuucugagguaugu

SEQ ID NO: 362090 - RNA, 64 nt, Human
gauaguuuaauguaaaucugacaggagcauucugaagccccauuaggaaaaaauuuaaaugguu

SEQ ID NO: 362091 - RNA, 64 nt, Human
gaacccgccugagacggugcugugcaggggaaagcccccgcacccacacaggaauucugcugag

SEQ ID NO: 362092 - RNA, 64 nt, Human
cugggguccagaguaaggaugugcggcccccaggcccccgcacaccucccucagcaccaagacc

SEQ ID NO: 362093 - RNA, 63 nt, Human
uguauuguagccccaaugucauuauguaauuauuacccagaauugcucuuccauaaagcuugu

SEQ ID NO: 362094 - RNA, 63 nt, Human
gaaacuauauucagugcacuuucuccaaaagacuacccagaaaaauagacuuauuuucaaaua

SEQ ID NO: 362095 - RNA, 63 nt, Human
uaagaagcucccaguccucagagacccugcugguacccagacccccaccuucggaggggacuu

SEQ ID NO: 362096 - RNA, 63 nt, Human
uucucucagaaagcaaaugaaaugcuacagcuauacccagaccuuuuauagguaaugaagcag

SEQ ID NO: 362097 - RNA, 63 nt, Human
aaaggugagcaaagugaaagauacuugguauuuuacccagauuucuaaguggcaacauuuuua

SEQ ID NO: 362098 - RNA, 63 nt, Human
uaugcagaggagcacaucuguugucaacugcuguacccagaaaucuagaacucugccgacagc

SEQ ID NO: 362099 - RNA, 63 nt, Human
aauuuggaauuacaaaauaaacguccuggggguuacccagaauacagauuuaaaaguuugccu

SEQ ID NO: 362100 - RNA, 63 nt, Human
auaaaguauagcaauguccaucuguaauucuaauacccagaaauaacgcuauuuagcuuuaua

SEQ ID NO: 362101 - RNA, 63 nt, Human
cuucuccugagggcugcuccagacaacauuuauuacccagaagaccuuuugucugaaaaccag

SEQ ID NO: 362102 - RNA, 63 nt, Human
uugucucuaaauugugggucuauuucuaguuauuacccagaguuuuuauguagcagggaaaau

SEQ ID NO: 362103 - RNA, 63 nt, Human
cucuuuaaaauguauuuaccuguuaguuggaaguacccagaauuaucagaaacgaaugcaaaa

SEQ ID NO: 362104 - RNA, 63 nt, Human
ucugugugcuguuauuccaaaagaugcgaugaauacccagaacuaggcuauucaugggcuguu

SEQ ID NO: 362105 - RNA, 59 nt, Human
ugcaauuugugucuuccuaaagagagcuguacccagagaguccugugcugaauguggac

SEQ ID NO: 362106 - RNA, 63 nt, Human
cucagguagaauauuuuuauuuuuacuguuuuauacccagaaguuauuucuacauuguucuac

SEQ ID NO: 362107 - RNA, 63 nt, Human
caggaggagaggaaaggacauggguagcaauucuacccagagccuucuccugccuacauuccc

SEQ ID NO: 362108 - RNA, 63 nt, Human
gugcguguguguguguguguguguauugagauuuacccagacugguuugggcaagcagacugu

SEQ ID NO: 362109 - RNA, 64 nt, Human
cgccuccagaggcccaccccucaugcaacagccgcccccgcaggcagggggcuggggacugcag

SEQ ID NO: 362110 - RNA, 64 nt, Human
cacaggcacacagggcccggccacacccagcggccccccgcacagccacccguggggugcugcc

SEQ ID NO: 362111 - RNA, 64 nt, Human
acgccuccauugcugcuuguucuggagacccccgcccccgcaccuuccagacuuagcagaagaa

SEQ ID NO: 362112 - RNA, 64 nt, Human
agugacaccggccccucccucuacccacccccuucccccgcaugcugaucccccugcccaggug

SEQ ID NO: 362113 - RNA, 63 nt, Human
augaccucagcaaauccucuucuaacucauggguacccagacucuaaauauuucaugauucac

SEQ ID NO: 362114 - RNA, 63 nt, Human
uauuucccaaauuccuuucauguucuuaacugcuacccagaaauugagcuucagaagauugag

SEQ ID NO: 362115 - RNA, 63 nt, Human
ugccaccuccaugugacaaguuugacaccugucuacccagagccagugacugucccucccagc

SEQ ID NO: 362116 - RNA, 63 nt, Human
caucuagucuuccauagaccaugcauugcaguguacccagaacuguuuagcuaauauucuaug

SEQ ID NO: 362117 - RNA, 63 nt, Human
cauggccuagaaaugagagaagagagagguauuuacccagaggauuuuccuaugguuggggau

SEQ ID NO: 362118 - RNA, 63 nt, Human
cccugcaaaagggucuuuauauuugcuacacaguacccagagcagccuaucuacacaggacau

SEQ ID NO: 362119 - RNA, 63 nt, Human
ucacagauuuaaccuugaucuaaagacaaguuguacccagaguaugugaaaagaaugggacga

SEQ ID NO: 362120 - RNA, 62 nt, Human
ucugccgaacaucugacuagccacaaguauguuacccagauguagaauuuucaucacuaaac

SEQ ID NO: 362121 - RNA, 63 nt, Human
ccucaugaagaccaaucucuugaaucccauaucuacccagaauuaacuccauuccagucucug

SEQ ID NO: 362122 - RNA, 63 nt, Human
gacagacugcagcugcguuacugugcugagagguacccagaagguucccaugaagggcagcau

SEQ ID NO: 362123 - RNA, 63 nt, Human
cugccugaauuggagccccccagagugucccucuacccagaguuuuuauuucuuuaauuaguc

SEQ ID NO: 362124 - RNA, 63 nt, Human
augucacuccacagcagaggaccgguugcagcuuacccagaaccacuccuccaggagagcugg

SEQ ID NO: 362125 - RNA, 63 nt, Human
gggggacggugggggaagacuuugggaggauuuuacccagaauacuugccgccugcuuuuugu

SEQ ID NO: 362126 - RNA, 63 nt, Human
agggugauaacuacuuagcacugcccuggugauuacccagagauaucuaugaaaaccaguggc

SEQ ID NO: 362127 - RNA, 63 nt, Human
agugcugcuagauuugacugcaagauugaaggauacccagaccccgagguugucugguucaaa

SEQ ID NO: 362128 - RNA, 63 nt, Human
gccuaguacaccuuuguaucucauuugaugugauacccagaagagaucauuguuuuuuguuuu

SEQ ID NO: 362129 - RNA, 64 nt, Human
acggugucucugcccgcaggacgccugcccccagcccccgcagcccucuggcccccuccaucuc

SEQ ID NO: 362130 - RNA, 64 nt, Human
auuuuccuguggacgccggggaagcacagcaccacccccgcaccugcccucggccuuugugagc

SEQ ID NO: 362131 - RNA, 64 nt, Human
gaaagggggcuaguccccuucuuuuggcccuccgcccccgcaggcuucugugugcugcuaacug

SEQ ID NO: 362132 - RNA, 63 nt, Human
uuccuggcauggaguugggggcgagcucaucaguacccagagcgccuggugugcagccaaagg

SEQ ID NO: 362133 - RNA, 63 nt, Human
ccuaagcaggccaagggugcguagggacggugguacccagaugcccaagucuuccaggcaaua

SEQ ID NO: 362134 - RNA, 63 nt, Human
uauucuuacagaaugccuuucuaaccugaaggauacccagauuucuuucuuuauguacaagau

SEQ ID NO: 362135 - RNA, 63 nt, Human
gagagacguauuuaaggagaagggaaggcaggauacccagaacuagcagccuagggaaaaggc

SEQ ID NO: 362136 - RNA, 63 nt, Human
gaaagaacccaagagaacuacaguuaugucagcuacccagacuuaaugggccagagccaugac

SEQ ID NO: 362137 - RNA, 63 nt, Human
uuagauaacaaacacucaugcuuuaauggauuauacccagagcacuuugaacaaaggucagug

SEQ ID NO: 362138 - RNA, 59 nt, Human
aggcagaagaagaauuuuaaugaaaaaauuacccagauuggcuccauggaaaaggagga

SEQ ID NO: 362139 - RNA, 63 nt, Human
gugcccuuuaaaccggcauuugcugcuaaaggauacccagaacccucacuacuguaacauaca

SEQ ID NO: 362140 - RNA, 63 nt, Human
aaggagauguaaugacagagaguucuggugagauacccagagagaaaaagagagagcagggug

SEQ ID NO: 362141 - RNA, 63 nt, Human
cagucauaugagaccugaucaauaaauauccaauacccagaguccugcucucagaguucuucu

SEQ ID NO: 362142 - RNA, 63 nt, Human
aaaaccaagcuuugauuuagauugaguaagauuuacccagaaugucagauuccuuucccuuua

SEQ ID NO: 362143 - RNA, 63 nt, Human
ucuguuuccagcuuuguccagggcagccuguuuuacccagaugggccugcaccuccagcuucu

SEQ ID NO: 362144 - RNA, 63 nt, Human
guuuugacuauuugaauuuucacauauugggcuuacccagaguggagcacaccuccagggcau

SEQ ID NO: 362145 - RNA, 63 nt, Human
aaugaauauuguugaguucaaaauauucucauauacccagauuuacagagaugacacaguauu

SEQ ID NO: 362146 - RNA, 63 nt, Human
uuacuucaacaagaugcuuggagaacaacaagguacccagaauuuuuagaagccuucagaaga

SEQ ID NO: 362147 - RNA, 63 nt, Human
accacaagccugagaacugaauuuugggacuucuacccagauggaaaaauaacaacuauuuuu

SEQ ID NO: 362148 - RNA, 64 nt, Human
guggaagggaaaagcccaugaucuucaagcagggaagccccagugaguagcugcauuccuagaa

SEQ ID NO: 362149 - RNA, 64 nt, Human
gaugucugcacuccuggcugcagcuggacaacagaagccccaugccgccuguccaguucggagg

SEQ ID NO: 362150 - RNA, 64 nt, Human
gggguggagaaaggggaagugguccagaaacaaaaagccccauugggcaugauaagccgaggag

SEQ ID NO: 362151 - RNA, 64 nt, Human
gauaguaucagcccaagaguguguugcuauuuguaagccccauggaucaauacauaaacuaugc

SEQ ID NO: 362152 - RNA, 63 nt, Human
ucuucuucagugaaauuuugggugccaaacaccuacccagaauguccagggcuuucauuuuca

SEQ ID NO: 362153 - RNA, 63 nt, Human
acauggacuccugcccacuugggggaaaccuuauacccagaggaaaauacacaccuggggagu

SEQ ID NO: 362154 - RNA, 63 nt, Human
uauaggaucaauaccauacuugcuagacaaagcuacccagauuugucuuauauuauaauuuuu

SEQ ID NO: 362155 - RNA, 63 nt, Human
aagaaggaaagaggaaaaaagaaaaaacaccaauacccagauuuaaaaaaaaaaaaacgauca

SEQ ID NO: 362156 - RNA, 63 nt, Human
ugaauuaacuaucuccuuauugauucucuccuguacccagaugcaaaaagugcuaaguuucuc

SEQ ID NO: 362157 - RNA, 63 nt, Human
aaaugcagucagcuccagcuaguacuauuuauguacccagauaacuaagauauuguuucaugg

SEQ ID NO: 362158 - RNA, 63 nt, Human
ugccucauugguaauuuggaagacaccaacacuuacccagaaucuguugcuauuuaaaaauca

SEQ ID NO: 362159 - RNA, 63 nt, Human
aaacuaauuucuuuugaguucauaaaucauuuguacccagaauguauuaauauauugcuauua

SEQ ID NO: 362160 - RNA, 63 nt, Human
uacaugaaaucaguaugaaaauaguuuuuuagauacccagaagcuuguucugggagaagcuag

SEQ ID NO: 362161 - RNA, 63 nt, Human
cguacaggaucugguuaccugugcaguugugaauacccagagguugggcagaucagugucucu

SEQ ID NO: 362162 - RNA, 63 nt, Human
uugggaaaggggaggaggaaggaaaugauaugguacccagacacugggcuaggcugcaacuuu

SEQ ID NO: 362163 - RNA, 63 nt, Human
uaaacacaacucuauagaaagaaaggagauuauuacccagaauucacauguagugauuauuaa

SEQ ID NO: 362164 - RNA, 63 nt, Human
guaacucuuagacugaguaaaguguuaauaccauacccagauguuuuauuuaugaaguuuuua

SEQ ID NO: 362165 - RNA, 63 nt, Human
aaauacgacacuguagcgacugauguuaguuguuacccagauccccuggaaaagcacacuacc

SEQ ID NO: 362166 - RNA, 63 nt, Human
uuuuaaaagggcaaguacaggagcaacugcugcuacccagaaaaauguguguauuauaaauaa

SEQ ID NO: 362167 - RNA, 63 nt, Human
aggaccaggcacuauuuccuccgagguuacuucuacccagaugacaccugccuguucacgccc

SEQ ID NO: 362168 - RNA, 64 nt, Human
ggcggaggucucugggagcccagaacccacauaaaagccccagcuuggcucacaaggcccagga

SEQ ID NO: 362169 - RNA, 64 nt, Human
uccugcuggcucucgcccaccaaccaaguguuacaagccccagaaugcugcccggccugcccug

SEQ ID NO: 362170 - RNA, 64 nt, Human
ccaccacuccagugcauuuccgccuggcuccuagaagccccauucaauaucacuacucuuuaac

SEQ ID NO: 362171 - RNA, 63 nt, Human
ugcuuuuaauccaaagaacauguauaguuuuuguacccagagacuaugauuuauauugauugc

SEQ ID NO: 362172 - RNA, 63 nt, Human
ggcaggaccaggacuauagcccagguccucugauacccagagcauuacgugagccagguaaug

SEQ ID NO: 362173 - RNA, 63 nt, Human
cuugcacauccagggcaagaaacauguccaaguuacccagaccauugauaacaguugcauuua

SEQ ID NO: 362174 - RNA, 63 nt, Human
ucuucaucugacuaugacauaaaaacaacuuuauacccagaaaguuauugauaaguucauaca

SEQ ID NO: 362175 - RNA, 63 nt, Human
acaaauaauaauuggaacaaauaaagguucuuguacccagagugauucuacaugggaaaaaca

SEQ ID NO: 362176 - RNA, 63 nt, Human
aaaaaggacuauggccacauucaaucgcccaacuacccagacgauuaccggcccagcaaaguc

SEQ ID NO: 362177 - RNA, 63 nt, Human
uuaaaaugguuuuuguuuuuugguuuuuuuuuuuacccagacaacucuagaaaugcggaccaa

SEQ ID NO: 362178 - RNA, 63 nt, Human
guuuucauagcgugguuacuuucuauaaugcuguacccagauucuaagaaccuggagaaggau

SEQ ID NO: 362179 - RNA, 63 nt, Human
gacggggggccccagucagccucucucccagucuacccagagaagccccuuccccaugggaag

SEQ ID NO: 362180 - RNA, 63 nt, Human
ugccaacagacacuacauuacccuaauggcugcuacccagaaccuuuuuauagguuguucuua

SEQ ID NO: 362181 - RNA, 63 nt, Human
ccugugagguguccaccucccugcacauggcacuacccagacugccagagcccaggcuggccu

SEQ ID NO: 362182 - RNA, 63 nt, Human; identical to SEQ ID NO: 362160

SEQ ID NO: 362183 - RNA, 63 nt, Human
guguggcccagagaagcuuccagcacagcccucuacccagaacauccgggcuggagggaggcu

SEQ ID NO: 362184 - RNA, 63 nt, Human
cauucuggucaccaaacaggaggguccuggcacuacccagauuuccacagugcugcuaauauc

SEQ ID NO: 362185 - RNA, 63 nt, Human
aaggugagaaaguuuugaacuuuuaacccuuucuacccagagcuaucuggaauguugaugacu

SEQ ID NO: 362186 - RNA, 63 nt, Human
agucauauucguuuucuucuucggcuggugggcuacccagagcgagcacgcuucucucguggu

SEQ ID NO: 362187 - RNA, 64 nt, Human
aguccugcccugccacccucggccucuguccuggaagccccaccccuuuccuccuguacauaau

SEQ ID NO: 362188 - RNA, 64 nt, Human
aauuagugcuaagugugaacuggacccuguugcuaagccccagcaagcaauccuagguaggguu

SEQ ID NO: 362189 - RNA, 64 nt, Human
guuuguguguagagacgggggauagugagaaccuaagccccaucguagcacaguauuacaugug

SEQ ID NO: 362190 - RNA, 64 nt, Human
ucaccugagguuucccugcaucccugcagugccaaagccccaccuucagggaccaccuggaaug

SEQ ID NO: 362191 - RNA, 63 nt, Human
ggugggcaggggccucaugacaagcgacaaguguacccagaguagaaggccuuccccacuccc

SEQ ID NO: 362192 - RNA, 63 nt, Human
ugcccaaacuugugacugcaucccucuggagucuacccagagacagagaaugugucuuuaugu

SEQ ID NO: 362193 - RNA, 63 nt, Human
aucagaccgcucaaagguccccguguucacuguuacccagaggcucuuguuacuacccacuuc

SEQ ID NO: 362194 - RNA, 63 nt, Human
ucaaugagaaaaaugugggaaguaacuuuucuguacccagaggcuaaguauaagucugugauc

SEQ ID NO: 362195 - RNA, 63 nt, Human
ccuaauaaacauccuucaagaacucugggcugcuacccagaaaucauuuuacccuuggcucaa

SEQ ID NO: 362196 - RNA, 63 nt, Human
uucugagaucaccucacugccucucauuugccuuacccagacgcaccgucacccugcaccagc

SEQ ID NO: 362197 - RNA, 63 nt, Human
agggcuguuggacugucauuucauugcucauuguacccagacagggaucugggccuucagaga

SEQ ID NO: 362198 - RNA, 63 nt, Human
caaauuccuuaacaccuuugguggagaauuucuuacccagacuuggggcugugaugcccuuca

SEQ ID NO: 362199 - RNA, 63 nt, Human
acuacaguugauccuccgcaaaggaaagcucuuuacccagaauguccuuccagagucauucag

SEQ ID NO: 362200 - RNA, 63 nt, Human
aauauggccuugaugguguagugcauggacaucuacccagauaaacaaauuguugacugcuga

SEQ ID NO: 362201 - RNA, 63 nt, Human
acugaccagucuagguugaaagauaggcagccuuacccagaacacaacauuagcagcugggaa

SEQ ID NO: 362202 - RNA, 63 nt, Human
guucccuagggucucuucuugcuugacucaaucuacccagagaugccccuuagcacaccuaga

SEQ ID NO: 362203 - RNA, 63 nt, Human
ggggcagggccuuccugguuuuguucacugcuguacccagaugccuacaaccaucccugccac

SEQ ID NO: 362204 - RNA, 63 nt, Human
auauaaauauaaauacauacauacauagauauauacccagacuugggugcuuagcuucagaua

SEQ ID NO: 362205 - RNA, 63 nt, Human
uaauuuacaauuuggagauuuaauaaccagggcuacccagaaaaagugacuugauaacauggu

SEQ ID NO: 362206 - RNA, 63 nt, Human
gcccauuugaggucuggggaaucauguaaaggguacccagaccucacuuuuaguuauuuacau

SEQ ID NO: 362207 - RNA, 64 nt, Human
agaguauuaacaaaaccaaaggacacaagggugcaagccccauucacggccuggcaugcagcuu

SEQ ID NO: 362208 - RNA, 64 nt, Human
gaggugcuccauggaggcaacaagucauuccaugaagccccagagguagaagggaccucaagca

SEQ ID NO: 362209 - RNA, 64 nt, Human
uagaaaaacuuuuuuuuuuuuuucucaccaccccaagccccauuugugcccugccacacaaaua

SEQ ID NO: 362210 - RNA, 63 nt, Human
ugccaagacccaggacauaggacggaccccugguacccagaagaggaguucuugcucacuaac

SEQ ID NO: 362211 - RNA, 64 nt, Human
uuuuaaacucgauaacucuuuauuuuaguaaaaugcccaggaguccuggaagcuacgcggacuu

SEQ ID NO: 362212 - RNA, 64 nt, Human
auuccucaggccugcggggcgggggcgggguggcgcccaggacgacuccccgggcucagcuugg

SEQ ID NO: 362213 - RNA, 64 nt, Human
acuccuacacugggcaguuugcccuucagcugaagcccaggaccccuuuuccacccugggcccc

SEQ ID NO: 362214 - RNA, 64 nt, Human
caccuucuuccugguaacggguaacgggggcagcgcccaggaucacccagagcugggccuucca

SEQ ID NO: 362215 - RNA, 64 nt, Human
gacugacgccuuuugaugcucacgggaaauuucugcccaggaucucagccccaggcugguuguu

SEQ ID NO: 362216 - RNA, 64 nt, Human
gcacagccuggacuauucccaggcacagcugugggcccaggagccagcucaggugcuccccucc

SEQ ID NO: 362217 - RNA, 64 nt, Human
cacuuugggaggcugaggcgggaggaucacuugagcccaggaguucaagaccagccugagcaac

SEQ ID NO: 362218 - RNA, 64 nt, Human
cagguuuuugcuccucaagaauuuguuugccugggcccaggauuggagggcuucacaccaauac

SEQ ID NO: 362219 - RNA, 64 nt, Human
gaggccucuggacccaucugucuuccugagggcagcccaggaccuuuggccaaucccaguuccc

SEQ ID NO: 362220 - RNA, 64 nt, Human
gggagauuauauucacuccugccaaggacucccagcccaggacucucuuuagagcaaggaagcc

SEQ ID NO: 362221 - RNA, 64 nt, Human
cuccgagucagccugugugggucaugaggcuggggcccaggagacacggucccaggcacugcac

SEQ ID NO: 362222 - RNA, 64 nt, Human
uauaaaucugcgagguaguuucuuugguauucuugcccaggaaauggguugauucaucacagau

SEQ ID NO: 362223 - RNA, 64 nt, Human
auggaccagccaugcacccgcccagccaccacgucccccgcaugaauguacuguacacuuucaa

SEQ ID NO: 362224 - RNA, 64 nt, Human
cagguuucuagaguuguuuucuuccucccccccccccccgcaccauugguuguguaucacuuuc

SEQ ID NO: 362225 - RNA, 63 nt, Human
cacacaagcaguagagucucagcuccacagcuuuacccagaagcccuguaagccuggccccug

SEQ ID NO: 362226 - RNA, 63 nt, Human
gacaggcacugugugccuggcagcaggacuuccuacccagaggagguucgagcuaggauccca

SEQ ID NO: 362227 - RNA, 63 nt, Human
agggugaaggcugaaccaagaaccugaagccuguacccagaggccuuggacuagacgaagccc

SEQ ID NO: 362228 - RNA, 63 nt, Human
aaguagcaacuuaacuaguugcuggcaacugaauacccagaguaguggaaauuuuaggacuug

SEQ ID NO: 362229 - RNA, 63 nt, Human
agaagugccagcaggggacugggaaaagcacucuacccagaccucaccucccuuccuccuuuu

SEQ ID NO: 362230 - RNA, 63 nt, Human
auauucuacccaaaugucaggaccaggauuuucuacccagagaccaagguguucuucccaaag

SEQ ID NO: 362231 - RNA, 63 nt, Human
auauucuacccauaugucaggaccaggauuuucuacccagagaccaagguuaucuuccuaaag

SEQ ID NO: 362232 - RNA, 63 nt, Human
auauucuacccauaugucaggaccgggauuuucuacccagagaccugcauguucucuccaacg

SEQ ID NO: 362233 - RNA, 63 nt, Human
acugccucuuccugagaugacuaggacagucuguacccagaggccacccagaagcccucagau

SEQ ID NO: 362234 - RNA, 63 nt, Human
ggcuuucccaauaggccaaaaaaaugcugcgcauacccagagcugguuguugugcugaggcca

SEQ ID NO: 362235 - RNA, 63 nt, Human
augcuaugcuucuacuuuuaaaauuugugguaauacccagaauggauguaaaauaacauuuuu

SEQ ID NO: 362236 - RNA, 63 nt, Human
gguauucccacauagaaauaacaaugcauguauuacccagaauuuaauguugcguaccuuaug

SEQ ID NO: 362237 - RNA, 63 nt, Human
uauaauauuacauagagucuuguauugucuguguacccagaguuuacaauuauguccauauaa

SEQ ID NO: 362238 - RNA, 63 nt, Human
gucugaucugccugugcgccucccauucuucucuacccagaaccugucaugggcuggggcuca

SEQ ID NO: 362239 - RNA, 63 nt, Human
ugcacaucaugaugacuuuaccuccauucccucuacccagaacccuaaauuauucuguuauug

SEQ ID NO: 362240 - RNA, 63 nt, Human
uucauuuacaugucauuugacugucucacuuuuuacccagaacaguaacaacccacaccgucu

SEQ ID NO: 362241 - RNA, 64 nt, Human
gaccacaguucuggguuaucuccucucauacaucaagccccagaggaggcggcaagaggaacag

SEQ ID NO: 362242 - RNA, 64 nt, Human
ugguuguagggugagaagugcaagaaugaagaugaagccccacugcucggucagucugccuccg

SEQ ID NO: 362243 - RNA, 64 nt, Human
cccccaacucaugaaaagauucuauggacugaaaaagccccaggcugaaaggacuggacugccu

SEQ ID NO: 362244 - RNA, 64 nt, Human
ugccggccaauggcgagacggugacgcugcccacaagccccagcauccccguaggcaucucgcu

SEQ ID NO: 362245 - RNA, 63 nt, Human
ggagauggguaaagcguuucuucuaaaggggucuacccagaaagcaugauuuccugcccuaag

SEQ ID NO: 362246 - RNA, 63 nt, Human
ugagagucuuuuaaguaccugagcucucgaagcuacccagaacugaacuagacuccccuaccu

SEQ ID NO: 362247 - RNA, 63 nt, Human
gugaagccagaggagauggacuggucugagcuauacccagaguucuucgcuccacucacucaa

SEQ ID NO: 362248 - RNA, 63 nt, Human
uagaugccgagugggcgaaugccagaccaaugauacccagagcuaccugccgccaacuuguug

SEQ ID NO: 362249 - RNA, 63 nt, Human
ggguucauuuugguauaucacacugaaacuggguacccagagugcugcuguuuaauauuucac

SEQ ID NO: 362250 - RNA, 63 nt, Human
agcauguaagagagggaacauuuccuuagauguuacccagaugguucugggggagacagaaaa

SEQ ID NO: 362251 - RNA, 63 nt, Human
ggcgugacaagugcccacaaguaacacaccagguacccagagcaggguggacaggagagaccu

SEQ ID NO: 362252 - RNA, 63 nt, Human
cgagacauccacuugacaguggagcagagggguuacccagauuucaaccucaucgugaacccu

SEQ ID NO: 362253 - RNA, 63 nt, Human
gagguuuagccugcuuucuuaccaaauucauguuacccagacuuguguucucuugcgucccuu

SEQ ID NO: 362254 - RNA, 63 nt, Human
uucuuucccuucucuuggcaauggaagcuccaguacccagauuggagauuaggaugagacaac

SEQ ID NO: 362255 - RNA, 63 nt, Human
acugucuuuauugcagaagacaguguguugccuuacccagaaugagauugaauuguuuugcuu

SEQ ID NO: 362256 - RNA, 63 nt, Human
acacacacuauuucagaagacaguguguugccuuacccagaaugagugcuaggauuacaggcg

SEQ ID NO: 362257 - RNA, 63 nt, Human
acaguaaaggagaaaauaaaauuguuagcauucuacccagagauaauaucaauucauauugua

SEQ ID NO: 362258 - RNA, 63 nt, Human
cugagcacaucaagagacucuuguagcagugguuacccagacuuacagaauuauguccuccag

SEQ ID NO: 362259 - RNA, 63 nt, Human
aaaaacuguagccagugaggcuucuacccuuaguacccagaacuccuuuuagguauagcaauu

SEQ ID NO: 362260 - RNA, 63 nt, Human
uacacaugaaaacaagaaagaaauggcuuuucuuacccagauuguguacauagagcaauguug

SEQ ID NO: 362261 - RNA, 64 nt, Human
gccgugacgguaaacuuccccucuaccagccuccaagccccacgccagcgagcaggcugccugc

SEQ ID NO: 362262 - RNA, 64 nt, Human
ggcuuggcccagcgccaaguaaacaggguaccucaagccccauuuccucacacuaagagggcag

SEQ ID NO: 362263 - RNA, 64 nt, Human
cauuucccuagaaggaaguuaggguggguggagcaagccccaccugcguuuuucugccacagca

SEQ ID NO: 362264 - RNA, 64 nt, Human
cauucccagucgcucccagcccaccucugccuccaagccccagaugguucuggaggcugcgaga

SEQ ID NO: 362265 - RNA, 63 nt, Human
cacaaugccacccauccacuccuugccaaguguuacccagaugguggaggaugugaagggauu

SEQ ID NO: 362266 - RNA, 63 nt, Human
uuuuuauggugacuuuagcuacagcauuuccuauacccagagcuaaacacuggaauaauacug

SEQ ID NO: 362267 - RNA, 63 nt, Human
gguaucucuaaggccaauaaggauaacauuaucuacccagagaguuuagaagaaaaguaggag

SEQ ID NO: 362268 - RNA, 63 nt, Human
cgcuuuuaaggacgcuuaugaucacauugcgccuacccagagaacccaggucgucuuucuauu

SEQ ID NO: 362269 - RNA, 63 nt, Human
uuucugucacagagacagcccuuuucucagaacuacccagaggaggccgggcaugguggcuca

SEQ ID NO: 362270 - RNA, 63 nt, Human
auuaaauaucaguucuguuuaucugaaggcuccuacccagagauucuacccagugaaacuccc

SEQ ID NO: 362271 - RNA, 63 nt, Human
gaaaaguuucaaaaauaguacaaagagcucucuuacccagauucacuaauuguucauacgugc

SEQ ID NO: 362272 - RNA, 63 nt, Human
gccccaguguguccccaccucucccagccuguauacccagauuacuuuggugaacugagagcu

SEQ ID NO: 362273 - RNA, 63 nt, Human
ggaggcauggagugccauggaaggauucgccacuacccagaccuuguuuuuuguuguauuuug

SEQ ID NO: 362274 - RNA, 63 nt, Human
uaaugaagauuucaccuguuuacuuaggguaucuacccagacccaucgauucugaguucggga

SEQ ID NO: 362275 - RNA, 63 nt, Human
uccuaugagggauguuacugggcugugguccuguacccagaggucccagggaucggcuccugg

SEQ ID NO: 362276 - RNA, 63 nt, Human
ccccaaacccugcuucugcugcccugaugcgucuacccagacucagagaccgugagcgccccg

SEQ ID NO: 362277 - RNA, 63 nt, Human
cucugccuccuccccugccagcccuagcgugacuacccagagacaaaaaaaaaaaaaaaaaaa

SEQ ID NO: 362278 - RNA, 63 nt, Human
cucagcguccgugacugcaguaacagccagcccuacccagaguauuucugagccaugaggggc

SEQ ID NO: 362279 - RNA, 63 nt, Human
gguaguuggauugguacauucacugcugccagguacccagagaugucaucucucuccagguag

SEQ ID NO: 362280 - RNA, 63 nt, Human
uuuaagggcuuggaaaaggggggaacaucucuuuacccagacuagaccuagcaaaacccugga

SEQ ID NO: 362281 - RNA, 64 nt, Human
ccccagucuacguucuccagcccacaccccuccaaagccccaccuuuaaguccucucuucucua

SEQ ID NO: 362282 - RNA, 64 nt, Human
uuugcucccaguggauuguacagugaugacuuuuaagccccacggcccugaaauaaaauccuuc

SEQ ID NO: 362283 - RNA, 64 nt, Human
agggaagggcauauaggcaccagagcuuuauccaaagccccaaaucccuagagugcuuucuggu

SEQ ID NO: 362284 - RNA, 63 nt, Human
cuuccuaggccguucugucacccaaauagcugcuacccagaggggcgggguugaccuaggcug

SEQ ID NO: 362285 - RNA, 63 nt, Human
uaaagugguugugcuuuuagaagaaaaauauuuuacccagaguugcacauguuuuaugaauuu

SEQ ID NO: 362286 - RNA, 63 nt, Human
ucuguguuugcuuguuugcccaccuuuggcugauacccagagaaccugggcacuugcugccug

SEQ ID NO: 362287 - RNA, 63 nt, Human
uuucaggaggugacaguugucuuaguugucaucuacccagacaaacguccugggcccguccuc

SEQ ID NO: 362288 - RNA, 63 nt, Human
ugggguggcuaggcaggaguggcguggggccaauacccagaccccuucagccaccagccccug

SEQ ID NO: 362289 - RNA, 63 nt, Human
ucuguucucagggaccaucucggcugccuccuguacccagacucuaaccuguagcuucagagg

SEQ ID NO: 362290 - RNA, 63 nt, Human
gagggggcagccaagaagccggagcuggcagcauacccagagauccggggcccccccaccccc

SEQ ID NO: 362291 - RNA, 63 nt, Human
gguucauaaaguuuagagaaaaggaauggaaaguacccagaacuaugccuggagcacgcacga

SEQ ID NO: 362292 - RNA, 63 nt, Human
uuuuguuuuguuuuuuguuuguuuguuuuguuuuacccagaaauaagauaacuccaucucgcc

SEQ ID NO: 362293 - RNA, 63 nt, Human
cuacugauaguuccucuuucucauuuugcaaacuacccagagcuccaaggacagccugaagau

SEQ ID NO: 362294 - RNA, 63 nt, Human
cugaauuucuucacuagagcuuccucaucagguuacccagaagugggucccauccaccaucca

SEQ ID NO: 362295 - RNA, 63 nt, Human
ucgucugaauacacaaaaaguugugucauaacuuacccagauauguuuuucuaucauuugaaa

SEQ ID NO: 362296 - RNA, 63 nt, Human
augguuguauagugccccauuaggccauuuacauacccagaguuauacucaagcagaaugcac

SEQ ID NO: 362297 - RNA, 63 nt, Human
uugaugaccccaggcuugaguuuuuaaaaugacuacccagaagggcacaagggggaaggaaau

SEQ ID NO: 362298 - RNA, 63 nt, Human
agugugcaaguguacuuuuaaggccaucguuuguacccagagucggcauggccaccuaagucu

SEQ ID NO: 362299 - RNA, 63 nt, Human
gcaaucugguccccagucgcacaacuucccacauacccagaggagagcauaugccuguggggg

SEQ ID NO: 362300 - RNA, 64 nt, Human
aauggcauucacucuuacagaugguguucacugcaagccccagaagcauauggcauguguucac

SEQ ID NO: 362301 - RNA, 64 nt, Human
uaggaguagugagagcacuuccugcccuuguuggaagccccaggguggacacucagcacgaagg

SEQ ID NO: 362302 - RNA, 64 nt, Human
gaccgccccacccuggaaugccaaugucagcaucaagccccacaguucuuaauacaggagaccc

SEQ ID NO: 362303 - RNA, 64 nt, Human
ucugugcucaaccaucugcuucaaauugaaguaaaagccccaaaaugucaagaaaauacuugug

SEQ ID NO: 362304 - RNA, 63 nt, Human
uuucggugacuuccgcaucaggaaggcuagaguuacccagagcaucaggccgccacaagugcc

SEQ ID NO: 362305 - RNA, 63 nt, Human
acuccugccccuguucucuuccacucuccuugcuacccagaaauccaucuaaauaccugcccu

SEQ ID NO: 362306 - RNA, 63 nt, Human
cgugugugagugaguggucgccacacagcauuguacccagagucuguccccagacauugcacc

SEQ ID NO: 362307 - RNA, 63 nt, Human
cuugaugcuuggccucccaaucuugcccuaggauacccagaugccaaccagacaccuccuucu

SEQ ID NO: 362308 - RNA, 63 nt, Human
ucaugaacgagcaugacacccugcugcccuggguacccagaagaucaucuguuuacuucccag

SEQ ID NO: 362309 - RNA, 63 nt, Human
ugaacccacacuccucauccacacaccuuucuuuacccagagccacugaaaacuauuuuuaua

SEQ ID NO: 362310 - RNA, 63 nt, Human
caggaucccuacucuuuggccacgagaucccaguacccagauccuggauccuagacuccuaug

SEQ ID NO: 362311 - RNA, 63 nt, Human
cugucucaagaaagaaaagaaaaagagacaaauuacccagaaaccccucccuuccccacaugg

SEQ ID NO: 362312 - RNA, 63 nt, Human
aaaggacuugaauagacauuucuccaaagaagauacccagauggccaauaagcacguaacaau

SEQ ID NO: 362313 - RNA, 63 nt, Human
cgggagaugucuauugccgaguagaguaauauauacccagaguaugucuauagcagagggggu

SEQ ID NO: 362314 - RNA, 63 nt, Human
gauuggcuuguaaaccuucgucucccucucuuuuacccagagacagcacauacgugugcacac

SEQ ID NO: 362315 - RNA, 63 nt, Human
cuccauucccaacuagacauuaccaaagugaccuacccagagauugcuucucauccccagucc

SEQ ID NO: 362316 - RNA, 63 nt, Human
acacuguguaagaagcugugaauauuccuaacuuacccagauguugcuuuugaaaaguugaaa

SEQ ID NO: 362317 - RNA, 63 nt, Human
uuaucugaguuuuauugaccccucuaauucucuuacccagaauauuuauccuucaccagcaac

SEQ ID NO: 362318 - RNA, 63 nt, Human
agaauagugucaguuauuucuuaaguaacucaguacccagaacagccaguuuuacugugauuc

SEQ ID NO: 362319 - RNA, 59 nt, Human
ugaggggcauccaggucuaggccgugugguacccagaagugucccagcccaccacaccg

SEQ ID NO: 362320 - RNA, 64 nt, Human
caccagauguccacaacaauaugaaguacagcagaagccccaagcaacuuuccuuuccuggagc

SEQ ID NO: 362321 - RNA, 64 nt, Human
cccaaggauggucagccauuucuucccacagccaaagccccauccccuucauuucccuccaguc

SEQ ID NO: 362322 - RNA, 64 nt, Human
cccacagacuuggugccugagcgcagcuccagggaagccccagccccuuccaggcggggaaccu

SEQ ID NO: 362323 - RNA, 64 nt, Human
gauuucucaaaggcagugaguaaaaucccaaauaaagccccaaagaguuugcuuuuccaaucau

SEQ ID NO: 362324 - RNA, 63 nt, Human
aacagggcucagguggguggagcaguaaggcacuacccagagagcuugcugcugcggcccugu

SEQ ID NO: 362325 - RNA, 63 nt, Human
cccaacagggcaacuggaaccccugccugaccuuacccagagaagccaugggccaccugcucu

SEQ ID NO: 362326 - RNA, 63 nt, Human
gcuguuuagccuucaguuugcuccgcugccuccuacccagagguuugugcgagccuguguugc

SEQ ID NO: 362327 - RNA, 63 nt, Human
uggagccacuaucaaaugcugugaagagaaauguacccagauguaucauuauccuugugcugc

SEQ ID NO: 362328 - RNA, 63 nt, Human
uuguaccugccagacuuccaggggacgauggaauacccagaacgcuccuucugaagaaauggg

SEQ ID NO: 362329 - RNA, 63 nt, Human
ggcagccuccuccaaaucccuccuggaggggccuacccagaagccuccuugaaccagucugca

SEQ ID NO: 362330 - RNA, 63 nt, Human
agucacuaguugggguuugguggccauguuuucuacccagacaggcccugcuuuucuaggaug

SEQ ID NO: 362331 - RNA, 63 nt, Human
uaauaacagaaacaacaaccugcaugcucacaauacccagacagucuacuagccaaaaguccu

SEQ ID NO: 362332 - RNA, 63 nt, Human
uuuuguaauuauaagaaaacaagacuuuuccuauacccagaaaucccuuugcauuuccgaaga

SEQ ID NO: 362333 - RNA, 63 nt, Human
uccagcuguccuucaaauagcuccgucucccucuacccagaacugauuuuuaaaaagaaguaa

SEQ ID NO: 362334 - RNA, 63 nt, Human
gagaguggucgugagcuggucuuggggcacaauuacccagagauauauuuauuaacagccaac

SEQ ID NO: 362335 - RNA, 63 nt, Human
gguucccaucauuuccugugucagcgccuggccuacccagauuguaucaugugcuagauugga

SEQ ID NO: 362336 - RNA, 63 nt, Human
uuaauaaggauccuuaugaugacuuuuagggacuacccagauuacuccaggauaaucuccuca

SEQ ID NO: 362337 - RNA, 63 nt, Human
uguggagaauuguuugaauauuaucccauugaauacccagagccacuaaaucuuuuuuuacua

SEQ ID NO: 362338 - RNA, 63 nt, Human
cccuuugaugagugauauuucccuauaccuauguacccagauagauauaugcauagauaaaag

SEQ ID NO: 362339 - RNA, 63 nt, Human
acacaagggaccaucccccaaacucuacucuuauacccagaaaagaacauauuucagaaucug

SEQ ID NO: 362340 - RNA, 64 nt, Human
aaaaauaagaaaacugucuuggagaaugggucagaagccccaaacggcacacacuuuccaaauu

SEQ ID NO: 362341 - RNA, 53 nt, Human; identical to SEQ ID NO: 354221

SEQ ID NO: 362342 - RNA, 64 nt, Human
ugugggcauccugggguucuuagggucccagaacaagccccaggcaagcuggaacuuggguggg

SEQ ID NO: 362343 - RNA, 64 nt, Human
aaggcugaugucaauuucuguguugccaagcuccaagccccaucuucuaaauggcaaaggaagg

SEQ ID NO: 362344 - RNA, 63 nt, Human
auggcaugaaugcuauguggacagcccaagccauacccagaaucaccuuaauuccaacuuuuu

SEQ ID NO: 362345 - RNA, 63 nt, Human
uaaaauaucugccaucaucugccauaggaaagauacccagagacccaucauguucucuuuuug

SEQ ID NO: 362346 - RNA, 63 nt, Human
uaguagagauaauaauugacauuucucguagacuacccagaaacuuuuuuaauaccugugcca

SEQ ID NO: 362347 - RNA, 63 nt, Human
uaucuuuucuuccaagccccucccugccugacuuacccagacugggauuaccagauaccaggu

SEQ ID NO: 362348 - RNA, 63 nt, Human
cuacccaaggucuagcuaggcccaagaccuaguuacccagacagugagaagccccuggaaggc

SEQ ID NO: 362349 - RNA, 63 nt, Human
ugcacugccagaggggcccuggguucugccauauacccagaggagccuuucucaguguguuuc

SEQ ID NO: 362350 - RNA, 64 nt, Human
caucucacucccaguaauacccagcuccuaucuaaagccccauucugcaugagaauuugguguu

SEQ ID NO: 362351 - RNA, 64 nt, Human
uaaaacaguuuuccacaacuguaaacaaacugcuaagccccaccucaaacuuguucacugggga

SEQ ID NO: 362352 - RNA, 64 nt, Human
aacacaaugucucauacuaaccaagaagcaagaaaagccccaugcuuucauuuuucacuuggag

SEQ ID NO: 362353 - RNA, 64 nt, Human
cucuugccauggccucaggucuugagggaaggcucgggccuagguuucuggacugcaaagggga

SEQ ID NO: 362354 - RNA, 64 nt, Human
ugaacaaaaaggcagaaaugauucaggggaaaaucgggccuagaauuuacacuggguugacuag

SEQ ID NO: 362355 - RNA, 64 nt, Human
gggcaccgacucacagcccgagugggcucuggaccgggccuaccgcgaugcgcgcguggaacuc

SEQ ID NO: 362356 - RNA, 64 nt, Human
cccugcagaguucuccccucucucugauccaggccgggccuauacagaggugcuggcugcuugu

SEQ ID NO: 362357 - RNA, 64 nt, Human
gccagcagcggcuggagagccuguccgagacacccgggccuagcucuccgcggcagccucggaa

SEQ ID NO: 362358 - RNA, 64 nt, Human
cuccacccugccucugcaucccuuaauggagaaacgggccuaaaaccaaacggguaaaaagccc

SEQ ID NO: 362359 - RNA, 64 nt, Human
uccccucucugcugcagcggauuucggccuggcccgggccuauggugucccaguaaagccaaug

SEQ ID NO: 362360 - RNA, 64 nt, Human
cagaaugcuaucuuguauguauuuuuuucauuacaagccccaugagcugcuuuuaugcugaaaa

SEQ ID NO: 362361 - RNA, 64 nt, Human
uaauggagaaugagaacauauauauauauauauuaagccccaggcugaauacucagggacagca

SEQ ID NO: 362362 - RNA, 64 nt, Human
ucccacacagcgauucugcagcaccggccucgggaagccccauccaacacuggauggucaucuc

SEQ ID NO: 362363 - RNA, 64 nt, Human
uauuauaggcaguacuuuaaauugcaaagucuuccgggccuauuuuccucuacauuuuuguaau

SEQ ID NO: 362364 - RNA, 64 nt, Human
agaucugcaugaccucacguugcuuuccagagcccgggccuauuuugccaucucaguuuuccug

SEQ ID NO: 362365 - RNA, 64 nt, Human
ucccacccccgugcccccuccuuaccccgcaggacgggccuacaggggggucuccccucacccc

SEQ ID NO: 362366 - RNA, 64 nt, Human
cugaccugagcuauguggaggauggcacagccugcgggccuaacauguugugccuggaccaucg

SEQ ID NO: 362367 - RNA, 64 nt, Human
cuuuucggagacagugacuggugccagugucauccgggccuacaaccgcagccgggauuuugag

SEQ ID NO: 362368 - RNA, 64 nt, Human
guggaguuccggaauuauucugugcgcuaccggccgggccuagaccuggugcugagagaccuga

SEQ ID NO: 362369 - RNA, 64 nt, Human
cuagcauuuuuccaacgagggaacuuauuccgcacgggccuacuguaggaccauugucucgugu

SEQ ID NO: 362370 - RNA, 64 nt, Human
guugaaguuguugcaaggaaaagaggaaacaucucgggccuaguucaaaccuuugccucaaagc

SEQ ID NO: 362371 - RNA, 64 nt, Human
gagaguggggggugcccacccaccccccccgccccgggccuaccaagcccccgcccuucccacc

SEQ ID NO: 362372 - RNA, 64 nt, Human
ucagggaccgggccgggccgggggugcgggcgcgcgggccuaccggguucguaguagucguaca

SEQ ID NO: 362373 - RNA, 64 nt, Human
gcgugugauggggcggcagccccgggccucucugcgggccuaggcuucugcccagcgccccugc

SEQ ID NO: 362374 - RNA, 64 nt, Human
gccccucucuccucuauguacccccugcccaccucgggccuaccucagcccucaccccucugcc

SEQ ID NO: 362375 - RNA, 64 nt, Human
cuucugacacaacuccccugggggcugcgguaggcgggccuagcccggccuccauggccccaac

SEQ ID NO: 362376 - RNA, 64 nt, Human
ugaagaaaaguaaaccgagaacauaauuaggcaucgggccuaaguguccuggggagauuggagg

SEQ ID NO: 362377 - RNA, 64 nt, Human
ccagguccuccagcucugucagauggagggcucucgggccuagaucccacugguaggccucgug

SEQ ID NO: 362378 - RNA, 64 nt, Human
cuggcuaaaacuugcaccucuucuucucuuagcuaagccccaaaaugaagauuuccuucagaag

SEQ ID NO: 362379 - RNA, 64 nt, Human
gaccacgaccuuugaagagcuucauuuugagaucaagccccacgaugacugcacaguagagcaa

SEQ ID NO: 362380 - RNA, 64 nt, Human
ggcggaaguuauuaucugcaucuuuaucaaccccaagccccacuuccucccugaccuccccaug

SEQ ID NO: 362381 - RNA, 64 nt, Human
uauuuuugagggcuguacuagguuuaucucauuuaagccccacaacaccccacaggaggguaau

SEQ ID NO: 362382 - RNA, 64 nt, Human
aaaaucaacacauuuuuaaaugacuaacuucuaaaagccccaacacaugacgccaucugaagac

SEQ ID NO: 362383 - RNA, 64 nt, Human
gccgagauuucaggauaaguuacccccaggcccgaagccccagcuugcccuggccugugccugc

SEQ ID NO: 362384 - RNA, 64 nt, Human
ucuucaaagcacauaaaaagcacccagggugagaaagccccaucccgggggccguuggcaggca

SEQ ID NO: 362385 - RNA, 64 nt, Human
cuugcuuucagcccuucccacaggaaacaucaagaagccccagccaggaggggccaggcugcca

SEQ ID NO: 362386 - RNA, 64 nt, Human
gauuccugcccacaggaagggccacaggcccgcuaagccccaaaggcaggaucuaggugagucc

SEQ ID NO: 362387 - RNA, 64 nt, Human
gugaacugaaauaggacaaccgaaucaggaagcgaagccccaggagcugcagccauccgugauc

SEQ ID NO: 362388 - RNA, 64 nt, Human
uugugcccacucucugagaaguuggggcuccaucaagccccauucuagucaugugccccuuucc

SEQ ID NO: 362389 - RNA, 64 nt, Human
uucuccccacaagacaccacaugacaagggguauaagccccagcccugcucauucccacucacc

SEQ ID NO: 362390 - RNA, 64 nt, Human
cgcuguuaccucacuggauagaagaaagcuuuccaagccccaggagcugugccacccaaaucca

SEQ ID NO: 362391 - RNA, 64 nt, Human
cagcgacuuuaaauacaguugcuauaauccugaaaagccccaggagcacaucagggagcuggga

SEQ ID NO: 362392 - RNA, 64 nt, Human
cucugcaggcucaagccuaucugggccucuggggaagccccacagccuuggcugugccugcccc

SEQ ID NO: 362393 - RNA, 64 nt, Human
aggaaucaagacauguuacucuguauuuaaggguaagccccacagcgggcagcacaaacagccu

SEQ ID NO: 362394 - RNA, 64 nt, Human
acuguccuuggguuacacuaccauuuauuggaacaagccccagaggcaguauuugauuuccuca

SEQ ID NO: 362395 - RNA, 64 nt, Human
auuuccuagagccuuauuagaaaugcagaaucugaagccccacucuggacccaggacauuuuga

SEQ ID NO: 362396 - RNA, 64 nt, Human
ugacaccucaauauucacacccauaaacauuacuaagccccaguucuaucguuggaaggaguug

SEQ ID NO: 362397 - RNA, 64 nt, Human
uccuaaacucucuaaguguggacggagaaugagcaagccccagaaguauuuuacaaccagagug

SEQ ID NO: 362398 - RNA, 64 nt, Human
cuuggaauacucuauuuggaguugugcaagugagaagccccaaauuuauaagucaauauccuca

SEQ ID NO: 362399 - RNA, 64 nt, Human
gguguaaccaucaagaaaccucuacaggguacuuaagccccagaagauuuugcuaccagggcuc

SEQ ID NO: 362400 - RNA, 64 nt, Human
gaguuccuuccagaccguuacgugucuccuggccaagccccaggaaggaaaugaugcagcucug

SEQ ID NO: 362401 - RNA, 64 nt, Human
uacuacuuagguugacagcaacaaagcauaagacaagccccagguaaacgucuaaacuguuuac

SEQ ID NO: 362402 - RNA, 64 nt, Human
ucaagcagaaugucacagaaggcagcuacuuuauaagccccaaugggccauggagaccacuguc

SEQ ID NO: 362403 - RNA, 64 nt, Human
aacacauggcccuuucccagauuauucucuagccaagccccaccuuuguuacguugaaaucccu

SEQ ID NO: 362404 - RNA, 64 nt, Human
aggcagugauucugccuccauccugguuuccccaaagccccagggcaccauccuuaggggagaa

SEQ ID NO: 362405 - RNA, 64 nt, Human
aggguggaugaucucaaucucccgugggcaucucaagccccaaaugguugggggaggggccuag

SEQ ID NO: 362406 - RNA, 64 nt, Human
guucguuuuuaauucaguccuacaaaauggugguaagccccagucucaggggucacccugucuu

SEQ ID NO: 362407 - RNA, 64 nt, Human
uuguuuuugaggcccuaggccugcugucuuuuugaagccccacauucugaauuugucagauugu

SEQ ID NO: 362408 - RNA, 64 nt, Human
gugcacuuauuuauuuaacuuacuuaucuggucaaagccccaggaaaccuaccaaagcuagaau

SEQ ID NO: 362409 - RNA, 64 nt, Human
gccccacgguccccaggaggacgcuuccuggccaaagccccaagccuuuggugagaagccaauu

SEQ ID NO: 362410 - RNA, 64 nt, Human
cuggugaggguuaggacuucagaaaccagagcacaagccccacagagggggaacagccagcacc

SEQ ID NO: 362411 - RNA, 64 nt, Human
ccguggaaggacucccccuaccugagcagagcagaagccccagggcggagcucccagccagcau

SEQ ID NO: 362412 - RNA, 64 nt, Human
gaauugucugugguaucaugucagcagagucuccaagccccacgaacccugaggaguggaguca

SEQ ID NO: 362413 - RNA, 64 nt, Human
ucgccucucuccuccacucgcucgggcucaccccaagccccagcccgcgaggccuccccuccgc

SEQ ID NO: 362414 - RNA, 64 nt, Human
cagaucacuugagaccagcuugggcaacauggcaaagccccaucucuacaaaaaacacaaaaau

SEQ ID NO: 362415 - RNA, 64 nt, Human
auacagugccuugcucggcgcccaccacccccucaagccccagcagcccucaacaggcccaggg

SEQ ID NO: 362416 - RNA, 64 nt, Human
gggcgcggaggacgcacgcggggccccggcucgcaagccccagcucaccgcgccgcggaccuca

SEQ ID NO: 362417 - RNA, 64 nt, Human
gcucuuuccaacagcccaaguggggucaacuccuaagccccacccccucacacacaccgccuuc

SEQ ID NO: 362418 - RNA, 64 nt, Human
ugcuccuuaaaaccccagaagccccaauuuccccaagccccauuuuuucuugucuuuaucuaau

SEQ ID NO: 362419 - RNA, 64 nt, Human
uuacguucuuucagcaugcuccuuaaaaccccagaagccccaauuuccccaagccccauuuuuu

SEQ ID NO: 362420 - RNA, 64 nt, Human
gcagugaaugucaaacuguguuucuuagagccauaagccccacauauuaucccugaacaagggc

SEQ ID NO: 362421 - RNA, 64 nt, Human
agaugaugaaaaaagagucuauuuuaguguuaggaagccccagcaggggagucggaagagcuug

SEQ ID NO: 362422 - RNA, 62 nt, Human; identical to SEQ ID NO: 354294

SEQ ID NO: 362423 - RNA, 64 nt, Human
aauggcagaucuugcagccaggugcccaggacagaagccccagccccagccucaucuacacccc

SEQ ID NO: 362424 - RNA, 64 nt, Human
agauaugugaguuacaugagauggcacagugauaaagccccauuuagugaccuugccuccuucu

SEQ ID NO: 362425 - RNA, 64 nt, Human
cagaacaugaauccucugagcuguccucaaaagaaagccccaaacaacagaaagcauaguguuu

SEQ ID NO: 362426 - RNA, 64 nt, Human
ccucucacuccccuaagccuggugaaagagucagaagccccaggcuccuuuuucuguuucuuaa

SEQ ID NO: 362427 - RNA, 64 nt, Human
ccugggaggguuccccuggccuuaaaaggggcccaagccccaucucauccuggcacgcccuacu

SEQ ID NO: 362428 - RNA, 64 nt, Human
ggauggaaccugguucacccuucauaccagcuccaagccccagaccaugggagcugucugggau

SEQ ID NO: 362429 - RNA, 64 nt, Human
uggggauggggauuccuaggggcagaugaaggacaagccccacuggagugggguucuuugagug

SEQ ID NO: 362430 - RNA, 64 nt, Human
cugggccaugggacuuccagugcuaaaacugggaaagccccagguaaccccggacuggugguca

SEQ ID NO: 362431 - RNA, 64 nt, Human
aaaccuaucaauccugcccccagccauggugaggaagccccaagccauggugacacacagcagc

SEQ ID NO: 362432 - RNA, 64 nt, Human
cuuggcugugcccucuucugccaaggaaagacacaagccccaggaagaacucagagccgucaug

SEQ ID NO: 362433 - RNA, 64 nt, Human
aacagcaggagauuauucucaccaaaguuaugucaagccccauuggucccagaguagcugaagg

SEQ ID NO: 362434 - RNA, 64 nt, Human
guccuuguguugaaggcaguaaacuaagggugucaagccccauucccucucuacucuugacagc

SEQ ID NO: 362435 - RNA, 64 nt, Human
uucgaucagcccuccuaaagcuggcuggaaaaagaagccccagcccagccugccucaucccacc

SEQ ID NO: 362436 - RNA, 64 nt, Human
cacuuaaaacucccuugcuaccgaucuggaacucaagccccaagacauccccuuagaugaucug

SEQ ID NO: 362437 - RNA, 64 nt, Human
gugugucauuuccacaugaaggagaggcaaggaaaagccccacaaaauuccuguuacccgcuga

SEQ ID NO: 362438 - RNA, 64 nt, Human
ugaaauaaugucaacagucacaacagguuuccucaagccccauuugucaacuaaaagagacgga

SEQ ID NO: 362439 - RNA, 64 nt, Human
uuuuggaauuuuccuccuuucucuuucguuacagaagccccacccugccucacccacccuuuuu

SEQ ID NO: 362440 - RNA, 64 nt, Human
ucucauuggaccucagaaaacccacccuggggagaagccccagcaagugugaaaaaagcuucua

SEQ ID NO: 362441 - RNA, 64 nt, Human
agaaguaggaagcuggcgugugaaaaccgcaacaaagccccaaaggcucuuuucagagccaccc

SEQ ID NO: 362442 - RNA, 64 nt, Human
ugcuuuugucuuuuuuaugaaauauuucuuuuaaaagccccagucucaccuacgaaauaugaag

SEQ ID NO: 362443 - RNA, 64 nt, Human
uuccagguggacagggcuucuuggaagacccccaaagccccagguauccugggugaagccuguu

SEQ ID NO: 362444 - RNA, 64 nt, Human
ugagcaaaauuggucuuuggggcccuuuuuguccaagccccacugaaaggccucuucagaaaac

SEQ ID NO: 362445 - RNA, 64 nt, Human
aucagcagauauagucuacaagggggaagguacuaagccccaggaccaaugguagacaaaauaa

SEQ ID NO: 362446 - RNA, 64 nt, Human
gugcauauauacuuguuaaagcucuuauauaaaaaagccccaaaauauugaaguucaucugaaa

SEQ ID NO: 362447 - RNA, 64 nt, Human
gugcugccuguuuacucguaccaaaaaugaagacaagccccacacccaccucagcccuugcuug

SEQ ID NO: 362448 - RNA, 64 nt, Human
ucuggaguaaacuaacgucucgaguugccauuggaagccccauuguccucauuuuguuuuguuu

SEQ ID NO: 362449 - RNA, 64 nt, Human
cgacuucucccugccucguuccuuauauucacagaagccccauaguuucacuggguugcgguua

SEQ ID NO: 362450 - RNA, 64 nt, Human
cauaggacgacaguuagcuauggguguuccugaaaagccccauagugauugagucuucaaaacc

SEQ ID NO: 362451 - RNA, 64 nt, Human
aaacaagauguucuacucccagguugacuuuuucaagccccaagauguugagucagccauucuc

SEQ ID NO: 362452 - RNA, 50 nt, Human; identical to SEQ ID NO: 354324

SEQ ID NO: 362453 - RNA, 64 nt, Human
cuugcacugaccauaaaauguuucucuucugaacaagccccaucauuuggugaaccuccacccu

SEQ ID NO: 362454 - RNA, 64 nt, Human
acacucgcacaagaugaccacauauagaagcagaaagccccaaauucccugggaacuguuuuuu

SEQ ID NO: 362455 - RNA, 64 nt, Human
ggagaaaaauaucaacagaacucuagccaaaggcaagccccagaacucagacaacagaaaggaa

SEQ ID NO: 362456 - RNA, 64 nt, Human
guaacagugaccucgcacggucauccggaguacuaagccccaguaagguguucaggacugguaa

SEQ ID NO: 362457 - RNA, 64 nt, Human
caucuaggacgccuccggugagcagggucaguggaagccccaacgggaaaggaaacgccccggg

SEQ ID NO: 362458 - RNA, 64 nt, Human
ggccagcaguuucccagggcucccugggguugaaaagccccaaggaaaccuuugcggguggggc

SEQ ID NO: 362459 - RNA, 64 nt, Human
uuauuuuccagauggcuuuuucucuuauuuuuugaagccccagucuuugauuuuacagguaacu

SEQ ID NO: 362460 - RNA, 64 nt, Human
ggucaccuccugaggaauaaaugcugaaccucacaagccccaucauucauuucuucucaauuca

SEQ ID NO: 362461 - RNA, 64 nt, Human
ggcacggcguggggacuggacagaaaaccacugcaagccccaaggagccagcugaagccuccca

SEQ ID NO: 362462 - RNA, 64 nt, Human
ugugcaucccucaccugccaguuauguggcugccaagccccacaggcugucaugguggcucuug

SEQ ID NO: 362463 - RNA, 64 nt, Human
uacuuacgguucugagaggaggggccacauaggaaagccccacggugggucagaaggcggaagg

SEQ ID NO: 362464 - RNA, 64 nt, Human
cucacggguccuucccugucuuccacggcaggaaaagccccacguuuuuggcagguguggaagu

SEQ ID NO: 362465 - RNA, 64 nt, Human
aagucuguggccccacaacgugggcuuaaagcagaagccccacagccuggcacgaaggccccgc

SEQ ID NO: 362466 - RNA, 64 nt, Human
uuuuuagaguuccguuuuuauuuauuaaaaacaaaagccccagcccugccgaggccugggcggc

SEQ ID NO: 362467 - RNA, 64 nt, Human
cuguugcuuuuaucccuaaacugcauccacagagaagccccaagaaggagguuggggccagcuc

SEQ ID NO: 362468 - RNA, 64 nt, Human
caagauggccaguaucauuuuacccccaccucccaagccccaagagguguaccuuuucagaugc

SEQ ID NO: 362469 - RNA, 64 nt, Human
ccggccagcugggccccucccaggcacugccaggaagccccagcugccccuggcggguguggug

SEQ ID NO: 362470 - RNA, 64 nt, Human
gcauuguuaaugagacaaaaguuguuuccaauuuaagccccaaaaccauuuguuguauuagugg

SEQ ID NO: 362471 - RNA, 64 nt, Human
cacccccagcuacccauaggggcugcagaguuauaagccccaaacaggucaugcuccaauaaaa

SEQ ID NO: 362472 - RNA, 64 nt, Human; identical to SEQ ID NO: 362440

SEQ ID NO: 362473 - RNA, 64 nt, Human
ccgacugaccucuccucacggaggcccagccccaaagccccagggcuggcccguuugggacagc

SEQ ID NO: 362474 - RNA, 64 nt, Human
ccuccuagucucccaccaggucccaggcuguggaaagccccagcccagggauggucagaacuca

SEQ ID NO: 362475 - RNA, 64 nt, Human
aggccaggguggggccgccgcagaugggcucaggaagccccaggugcacucagcgagagcccug

SEQ ID NO: 362476 - RNA, 64 nt, Human
caagcuucuagaaggugcuuaguaaauacuugauaagccccacgugaaaacagcgaagcaaaua

SEQ ID NO: 362477 - RNA, 64 nt, Human
gugagggaggugcagaggcauccggggcgggagcaagccccagguugugacaggugcagguaga

SEQ ID NO: 362478 - RNA, 64 nt, Human
aguccuucagcguuaaguggaggaaagcuuggggaagccccaauagcuggacagaccucggccu

SEQ ID NO: 362479 - RNA, 64 nt, Human
ucagacauacagcugccuaccuaaugaggacuucaagccccaccacauagcaugcuuccuuucu

SEQ ID NO: 362480 - RNA, 64 nt, Human
caaacucaucuuccagaacuuuucccucucuccuaagccccaguugcaccuacuaacugcaguc

SEQ ID NO: 362481 - RNA, 64 nt, Human
aacuaaugcagucgauacaaugcguagauagaagaagccccacgggagccaggaugggacuggu

SEQ ID NO: 362482 - RNA, 64 nt, Human
cuauggauuuaucaauuuuguuccucuuuuccaaaagccccagguuuuggcuucacuggauuug

SEQ ID NO: 362483 - RNA, 64 nt, Human
ucauuccaacuucccaguucaggagucccaaggaaagccccagcacuaacguaaauacacaaca

SEQ ID NO: 362484 - RNA, 64 nt, Human
caggcagccagugcccugagccagggucuccagaaagccccacccaggccaggcauguggcagg

SEQ ID NO: 362485 - RNA, 64 nt, Human
uuuugauauauuagccaugcuuccggguaaaggcaagccccaaacuccuuaucuuuugcagucu

SEQ ID NO: 362486 - RNA, 64 nt, Human
gcugccucugccuuuauccugggagauggggaggaagccccaucucugcuguucccugcgugga

SEQ ID NO: 362487 - RNA, 64 nt, Human
uuuuauucuauaggaccucaagauuccuggaaagaagccccagcccccaggggaaaccuccaga

SEQ ID NO: 362488 - RNA, 64 nt, Human
gccccauuuuaagcaggagcagguggcugguuugaagccccagguaucccccuucccugcuaug

SEQ ID NO: 362489 - RNA, 64 nt, Human
gcuuggcgccugccagaaaaauuuggggcuaggcaagccccagguugcagacauggugaagcag

SEQ ID NO: 362490 - RNA, 64 nt, Human
uagaucugaacuccuuggcuucuuuacuuaguucaagccccagccuaggaaagccaguuacaua

SEQ ID NO: 362491 - RNA, 64 nt, Human
ggcaauuuucuuuucuaucaguuuguauauuacuaagccccaagagacauuuccugugcuagag

SEQ ID NO: 362492 - RNA, 64 nt, Human
uuuugcucuuauuuccugcaucuuuccuuaagggaagccccauccucucccaggaccaggaguu

SEQ ID NO: 362493 - RNA, 64 nt, Human
aagguaguguuuuuguacaaggucauaccgccagaagccccaaauccuauuuuggcucaucuuc

SEQ ID NO: 362494 - RNA, 64 nt, Human
cugugaguggcucgagcccugggggugcuccuggaagccccaagagcauccaggauugccuccc

SEQ ID NO: 362495 - RNA, 64 nt, Human
ccucccggcucugcccugcacauccuguugagccaagccccagugacccggagagcuggccuga

SEQ ID NO: 362496 - RNA, 64 nt, Human
cucccccaagcuggaggcggcagaggacugggccaagccccaaccugccucccagccaggcucc

SEQ ID NO: 362497 - RNA, 64 nt, Human
cugaagccuguacccagaggccuuggacuagacgaagccccagccaguggcagaacugggucuc

SEQ ID NO: 362498 - RNA, 64 nt, Human
ucuggggccugauccaccucuacaccagcccaggaagccccaucugugccugcccucagguggu

SEQ ID NO: 362499 - RNA, 64 nt, Human
cccggacccaaugcacuuucuugucuccucuaauaagccccacccuccccgccugggcuccccu

SEQ ID NO: 362500 - RNA, 64 nt, Human
cuuucccaagcacuguaagugagugggucaggcaaagccccaaauggaggguugguuagauucc

SEQ ID NO: 362501 - RNA, 64 nt, Human
cuuccaaauaaauucauaucuagauuuucaaacaaagccccaagaugaagucuaauucugaaaa

SEQ ID NO: 362502 - RNA, 64 nt, Human
ccccugagccccccgcagcggcccgagcuggcggaagccccacggcggugagguccauccugac

SEQ ID NO: 362503 - RNA, 64 nt, Human
gccuccgggcauaaggccccugaccacacuucagaagccccauccccccugccaccgggcgauc

SEQ ID NO: 362504 - RNA, 64 nt, Human
cagccucugcauaaggccccuggguacacugcagaagccccauccuucccgccuccgggcauaa

SEQ ID NO: 362505 - RNA, 64 nt, Human
cuuucauaggccacacacaggugugcugcgcgggaagccccaugcuccaaucaaagggauuuuu

SEQ ID NO: 362506 - RNA, 64 nt, Human
aucaccacuuggaccagcauccuuaaguaucagaaagccccaagcaauugcugcaucuuaguag

SEQ ID NO: 362507 - RNA, 64 nt, Human
ugggagacuuugaagaccaguccuguuugcagggaagccccacuugaaggaagaagucuaagag

SEQ ID NO: 362508 - RNA, 64 nt, Human
ucuggccgcaccuuaaaaacuauuuauucaccaaaagccccaggcauuucagaagguggcacuc

SEQ ID NO: 362509 - RNA, 64 nt, Human
gccucccuaucugguaggcugcccugcuuugcagaagccccacugcaugaaggccugagugcaa

SEQ ID NO: 362510 - RNA, 64 nt, Human
aguuaauguggaacaaaaguuuucaccaucucucaagccccaaggacuggagccaccucuggaa

SEQ ID NO: 362511 - RNA, 64 nt, Human
uccuauguauuuuaacucauuagugcauaaaggcaagccccauauaaugaagucucaggguaua

SEQ ID NO: 362512 - RNA, 64 nt, Human
ccuugaacuucugcccucuguucagggcugacacaagccccacaggcuggggggcuccgguucc

SEQ ID NO: 362513 - RNA, 64 nt, Human
ccugagccugcugagaaauccuuuuagcgccagcaagccccacccagggcccuguccugugucu

SEQ ID NO: 362514 - RNA, 64 nt, Human
ccaaacccagucuguucccugcucccucgcuggcaagccccaccacacaggagugaggccaggg

SEQ ID NO: 362515 - RNA, 64 nt, Human
ccaaaucagauauacaugucuagauguuacagcaaagccccaacuaaucuuuagaagcauauug

SEQ ID NO: 362516 - RNA, 64 nt, Human
ggcuuucuccauauccucugggagggguggaaucaagccccagugcugccugcuugguggcggg

SEQ ID NO: 362517 - RNA, 64 nt, Human
ugcaguaccucaagaucauggcaggcagcaagugaagccccagcuggacucauggaugugcacc

SEQ ID NO: 362518 - RNA, 64 nt, Human
acugagaaagagacugaaauggaguaauaaaugaaagccccacaccaagccuccuuucuuccac

SEQ ID NO: 362519 - RNA, 64 nt, Human
uagauaguguaugcauauguauauguacauagggaagccccauauguauauaguauguuguaca

SEQ ID NO: 362520 - RNA, 64 nt, Human
caucuuuaaaucucuuuaaugagugaauccaugcaagccccauaaaacaguuccuagcaugcag

SEQ ID NO: 362521 - RNA, 64 nt, Human
cugccugcuuuuucuguacucucaaguucccccaaagccccaaagaguuggaggccaagggaag

SEQ ID NO: 362522 - RNA, 64 nt, Human
aucuguacaacugauuuuaaaaaaaugcuacaaaaagccccaaagcauauaaucucuacuccuu

SEQ ID NO: 362523 - RNA, 64 nt, Human
ccauguuccuuguuuccuuuuauucuuccaucugaagccccacucuuaaaaaguugcacuguuc

SEQ ID NO: 362524 - RNA, 64 nt, Human
uuaagaagaucugggggaauaaaaagccaacaguaagccccaggaaaggguuuuuugagaccau

SEQ ID NO: 362525 - RNA, 64 nt, Human
ucccugucuguggcagggacccaagcgcuugcuuaagccccagugcuccaugccagcacuugaa

SEQ ID NO: 362526 - RNA, 64 nt, Human
ugcuucucaccuaaguccccaggguccaagggagaagccccagacccccuucucuugcagagug

SEQ ID NO: 362527 - RNA, 64 nt, Human
uggcugagggaccccuucccaguagggcugucccaagccccacuccauggggccagguuuccug

SEQ ID NO: 362528 - RNA, 64 nt, Human
aauuugaagagcauggcaaagcccuuucucucccaagccccaggcagaguacaagcucauuuuu

SEQ ID NO: 362529 - RNA, 64 nt, Human
ggccuuggagaccccuggucccaccccugccgugaagccccaggcccacuucccaagaaucuca

SEQ ID NO: 362530 - RNA, 64 nt, Human
ugguggugugccgauaccuccucgccugcccuccaagccccagcugccuuccuuuuggauuccc

SEQ ID NO: 362531 - RNA, 64 nt, Human
gaggacuaacuuccagggugccaagaaggaagaaaagccccagguucucuuuucuuauugagga

SEQ ID NO: 362532 - RNA, 64 nt, Human
ccuguggucuuccccagguugaggagagaaguggaagccccauggaagacagugcucccagcug

SEQ ID NO: 362533 - RNA, 64 nt, Human
ccuuucccugagagcucacaguacaauguuucagaagccccauuugcacagguuuucagcaacu

SEQ ID NO: 362534 - RNA, 64 nt, Human
aguacagguuuugcccugauuaaaaaaucucccaaagccccaaauuccuguuagccagguggag

SEQ ID NO: 362535 - RNA, 64 nt, Human
gcuauccuaauauugcaggaggggccucucuuccaagccccacccuaaggguuagcccuuggcc

SEQ ID NO: 362536 - RNA, 64 nt, Human
uaaaaguauauaagaugaaacuugauuugcuaucaagccccaagcaauuuuucaacugggcauu

SEQ ID NO: 362537 - RNA, 64 nt, Human
gaugacugucucaaauauguaggacagaaaugagaagccccaagcuugcuuuuaacucuaaggu

SEQ ID NO: 362538 - RNA, 64 nt, Human
ccuuaggaccccguuccaagugcacugcccggccaagccccagccucagccugcgccugagcug

SEQ ID NO: 362539 - RNA, 64 nt, Human
uuaggguccacgcccauguaccugaaacauuuggaagccccauaauuguucuaguuagaaaggg

SEQ ID NO: 362540 - RNA, 64 nt, Human
ccuuuuuuaaacuauuucuagguuugugaaugugaagccccaggccgcagggggcaaggggcca

SEQ ID NO: 362541 - RNA, 64 nt, Human
ucuguguucccguaaggauacagcuuccuuugggaagccccaucuauggcuguagaucucucgg

SEQ ID NO: 362542 - RNA, 64 nt, Human
cccuugagauauagccaacuaacgacgcuacuggaagccccagagcagaaaagaagcacauccu

SEQ ID NO: 362543 - RNA, 64 nt, Human
cuugugugauugugggaaauuacuuaaccucuucaagccccaauuuccucaaccauaaaaugaa

SEQ ID NO: 362544 - RNA, 64 nt, Human
aggccucugagccuccccugugccuugggcccugaagccccauauguaguauagagcaaaggug

SEQ ID NO: 362545 - RNA, 64 nt, Human
ugaccucaggaggcucugggcacuccagcccugaaagccccagguguacccaauuggcagccuc

SEQ ID NO: 362546 - RNA, 64 nt, Human
aauaaaccaauguagcauuauuuuuuucuaaaugaagccccaaaaaagaaaagugccuugcauc

SEQ ID NO: 362547 - RNA, 64 nt, Human
guccauucacccagccaaauuguguuaaagaggaaagccccacaaacuaaaacagccuuuccua

SEQ ID NO: 362548 - RNA, 64 nt, Human
caucuugaucugcucagcccuggaggugccagcaaagccccaugcuggagccuguguaacagcu

SEQ ID NO: 362549 - RNA, 64 nt, Human
caucagccauuucguucucccuuccuugcugacaaagccccauuuuuuuuuucuuuuuuuuugg

SEQ ID NO: 362550 - RNA, 64 nt, Human
ccacgaguuuaagaccagccugggcaacauggugaagccccaucucuacaaaaaauacaaaaaa

SEQ ID NO: 362551 - RNA, 64 nt, Human
ccucuuuuuggcaucagcggcaaaucuuuucaugaagccccaaggacacaaaacauuuucccau

SEQ ID NO: 362552 - RNA, 64 nt, Human
acugcacugcccuggagaggcagcaucaggaccuaagccccaggaacuucacccaacuuaggcc

SEQ ID NO: 362553 - RNA, 64 nt, Human
cagaggaccucgaaggcugcaacggcccugccccaagccccagaaaaagaaacucuuggaggga

SEQ ID NO: 362554 - RNA, 64 nt, Human
aaaucuucagaaugauuuuauugaagagggccgcaagccccaaauggaaaacuguuuuuagaaa

SEQ ID NO: 362555 - RNA, 64 nt, Human
ccucacccagcaggccugguccaccucucauugcaagccccaagcacugagccagcaggugcca

SEQ ID NO: 362556 - RNA, 64 nt, Human
uccucucaguauucucuccaaagauugaaaugugaagccccagccccacccucugcccuucagc

SEQ ID NO: 362557 - RNA, 64 nt, Human
guguccagacagcacaaaacggcaaggagagcccaagccccaaugccagaauucuuccaaacuc

SEQ ID NO: 362558 - RNA, 64 nt, Human
guauguuggaauccgaagccacuuccccgccuucaagccccagaugggcugcucuccuguaacu

SEQ ID NO: 362559 - RNA, 63 nt, Human
uaccagaaacugagagcuagugaggguucagagaagccccauccuaagccagacacaugaugu

SEQ ID NO: 362560 - RNA, 64 nt, Human
caaggauuuucaagacaaacuggaguaagaauuaaagccccagaggauuuaauuauccugguuu

SEQ ID NO: 362561 - RNA, 64 nt, Human
agccacccgagugguuccgaccuccauucaccucaagccccaacaggccccugucauuccacuu

SEQ ID NO: 362562 - RNA, 64 nt, Human
agggcuguugauauuaaaaacaaacaaaacaaaaaagccccacacauaacuguuuugcacgugc

SEQ ID NO: 362563 - RNA, 64 nt, Human
aaauuauguuuucaucauucauuugaaaaugaaaaagccccaaagugagaacuuugggggaggg

SEQ ID NO: 362564 - RNA, 64 nt, Human
gggccaguaagagugaagucugcuccuugaauccaagccccaucuggggcuucucuaacaaauc

SEQ ID NO: 362565 - RNA, 64 nt, Human
uaauuccaaguucauauagaacugauaauguagcaagccccaaguaugauaauaggcagacuau

SEQ ID NO: 362566 - RNA, 64 nt, Human
aaggaaaaucuaguuaaaauaauccaauggacagaagccccaggaagggguauuuccaacacuu

SEQ ID NO: 362567 - RNA, 64 nt, Human
ucagaaguucgagaccagccuuaccaauauggugaagccccaucucuacuaaaaauacaaaaau

SEQ ID NO: 362568 - RNA, 64 nt, Human
cuguccucucugaaugccuuggagggaucccaggaagccccaguaggagggagcuucagacagu

SEQ ID NO: 362569 - RNA, 64 nt, Human
gggcauuguugcuuguuggguaaaaaugaagcagaagccccaaaguucacauuaacucaggcau

SEQ ID NO: 362570 - RNA, 64 nt, Human
ucuuuacgggucuugagagggaaggacucuuccaaagccccaaagccgaggguuucacccacac

SEQ ID NO: 362571 - RNA, 64 nt, Human
aggucacuagaaaugggccagcugggucaaugugaagccccaaauuugcccagauucaccuuuc

SEQ ID NO: 362572 - RNA, 61 nt, Human; identical to SEQ ID NO: 354444

SEQ ID NO: 362573 - RNA, 64 nt, Human
ccaaugcccccugggcaggaggcaguggagaaccaagccccauggccucagaauuuccccccag

SEQ ID NO: 362574 - RNA, 64 nt, Human
ugucugugaucucugcuggggagauaaaaagauuaagccccaacauguucagaaaagaagugaa

SEQ ID NO: 362575 - RNA, 64 nt, Human
gugcuccaaaugucaggguguuugcccaauaauaaagccccagagaacugggcugggcccuaug

SEQ ID NO: 362576 - RNA, 64 nt, Human
ugucaaagcucucagaagguaccuagaggagcccaagccccagcuccauccuccacuuauucug

SEQ ID NO: 362577 - RNA, 64 nt, Human
augggcuucugaggacacaaggugggcugcccucaagccccagagagccccucauccuuccucu

SEQ ID NO: 362578 - RNA, 64 nt, Human
gcuggaccgugugccccuuugggaggaagaagacaagccccacuagggccaagggcagcagagc

SEQ ID NO: 362579 - RNA, 64 nt, Human
uaaauuacguagguuuaagacuagucccuuggauaagccccaagcgaauuugucuucagauuau

SEQ ID NO: 362580 - RNA, 64 nt, Human
cagacccugccccuaacuccugccuaugacacagaagccccacaccaguugcccagaugaacug

SEQ ID NO: 362581 - RNA, 64 nt, Human
guggucgagagaccuguucuuucacagaugugagaagccccaggaugauugaccaugguguuca

SEQ ID NO: 362582 - RNA, 64 nt, Human
gccagggagaggggaggagugggcagugaagaugaagccccaugcucaguccccucccaucccc

SEQ ID NO: 362583 - RNA, 64 nt, Human
auuuguguccucgccagcucuuuggccaccuuucaagccccaguguucaagcucagagaggaug

SEQ ID NO: 362584 - RNA, 64 nt, Human
ugcagccccacagacaacaguugcacagugccucaagccccagaguggcucacccuguccagac

SEQ ID NO: 362585 - RNA, 64 nt, Human
ggccuguaacuuauaaagugcaccucgcccccgcaagccccagccccgaggaccguccauggac

SEQ ID NO: 362586 - RNA, 64 nt, Human
uggucggcaggagagucaguugugugcucuguugaagccccacagagcagguguugccaaugcu

SEQ ID NO: 362587 - RNA, 64 nt, Human
ggagugaguguggcuccccucuauuuagcaugacaagccccaggcaggcugugcgcugacaacc

SEQ ID NO: 362588 - RNA, 64 nt, Human
uguuaggaagcuucggggagacaaguuuugagagaagccccagagggagcuauuuccuugcacc

SEQ ID NO: 362589 - RNA, 64 nt, Human
cauucuuucagagucuguuuuuccauccaaauauaagccccaggccauuccacuuagugucuuu

SEQ ID NO: 362590 - RNA, 64 nt, Human
uuuugaugccucagggucucugaaaucucccgggaagccccagagcuuuccugaggcugccugg

SEQ ID NO: 362591 - RNA, 64 nt, Human
uuugcacaguggagcuuacacuuaaaagaaaacaaagccccaugggcugccuugaaaucaagag

SEQ ID NO: 362592 - RNA, 64 nt, Human
gcuguggcagaggagcagcugggauucccgaccaaagccccagggggugcagaagacucaccac

SEQ ID NO: 362593 - RNA, 64 nt, Human
ggucucccucagggcugcaggggcaggugcagggaagccccaggaugggcuucccuggaggggg

SEQ ID NO: 362594 - RNA, 64 nt, Human
accacgugagaggaaaauguuaauaaaaaaugcaaagccccaucauuugcacaaaacucagccc

SEQ ID NO: 362595 - RNA, 64 nt, Human
ccagggccugcccacccguuggaggccgguggagaagccccaccuggcuuaugcccuggagagg

SEQ ID NO: 362596 - RNA, 64 nt, Human
cgggcuucacagcccuacaauuggguucucagcuaagccccagaguucugguagaaccaucccg

SEQ ID NO: 362597 - RNA, 64 nt, Human
uuguaggggucacugucacaugcuugugcccuggaagccccaaggcucuuccuccagcuggcuc

SEQ ID NO: 362598 - RNA, 64 nt, Human
auguuuguugaaguacuguuuguagaggggggcaaagccccaacugcaaacaaagugaaugccc

SEQ ID NO: 362599 - RNA, 64 nt, Human
agaagcucccagggcugcuuccuucaccugcagaaagccccaagugagccaccagcacucaugg

SEQ ID NO: 362600 - RNA, 64 nt, Human
auaaaaacaguugauguuuugguguaugggguaaaagccccaggagcauacagaacuugagcug

SEQ ID NO: 362601 - RNA, 64 nt, Human
cccucauggggaaggucacugacucuggagacugaagccccagugugcgcagcucgagccacca

SEQ ID NO: 362602 - RNA, 64 nt, Human
accugguucucagagaacccugugaugaucacccaagccccaggcugucuuagccccuggaguu

SEQ ID NO: 362603 - RNA, 64 nt, Human
uugguguuaccaucccagcucccgggaggcccuuaagccccagcugucgguuuuuaccugccug

SEQ ID NO: 362604 - RNA, 64 nt, Human
gacagcuugaggccccuccuucugcugccuggccaagccccacacccgcagacccuccuuccca

SEQ ID NO: 362605 - RNA, 64 nt, Human
uguugcugguggacacagaugcuccccccaauggaagccccaagcucugagguaugcggguaga

SEQ ID NO: 362606 - RNA, 64 nt, Human
cugaagagcucagcugucaccgggcauagccuggaagccccaagucuguucugacuuugccugg

SEQ ID NO: 362607 - RNA, 64 nt, Human
acgaagcagccccugcucccaucugucccugaggaagccccacuucucuguaggagcccggacu

SEQ ID NO: 362608 - RNA, 64 nt, Human
cuucugggccugcugagcucccuccacacaccucaagccccaugccgugcucauccuaccccca

SEQ ID NO: 362609 - RNA, 64 nt, Human
acaaaaaucugaaagaaacgucuuuaguggcuuuaagccccaaaacgucccuaaggcguccucg

SEQ ID NO: 362610 - RNA, 64 nt, Human
aacacuuaggaaggucuucgaaauacuaauuuguaagccccaccucaggccuacugaaucagaa

SEQ ID NO: 362611 - RNA, 54 nt, Human; identical to SEQ ID NO: 354483

SEQ ID NO: 362612 - RNA, 64 nt, Human
aagcacccuggggagauugauuguccuuaaaccuaagccccacaaacuugacaccugaucaggu

SEQ ID NO: 362613 - RNA, 64 nt, Human
aauacaggauaucagcauauuugugcaccuuauuaagccccaucuuaagaaaacacaaagucua

SEQ ID NO: 362614 - RNA, 64 nt, Human
gcacuuuccaaauuggggacaagggcucuaaaaaaagccccaaaaggagaagaacaucugagaa

SEQ ID NO: 362615 - RNA, 64 nt, Human
acuguccacucggggguggagugagacugacugcaagccccacccuccuugagacuggagcugg

SEQ ID NO: 362616 - RNA, 64 nt, Human
gacaggcggacagggcuggccucccccaguccccaagccccacugugccuuguugucugcuggg

SEQ ID NO: 362617 - RNA, 64 nt, Human
ccucacuugagcaugugaauauucucacggagagaagccccagcgagauuuuccggugaauacg

SEQ ID NO: 362618 - RNA, 64 nt, Human
uacucuuucaucacggaaacagaccccccgagagaagccccaacgagauuuuccggugaauacg

SEQ ID NO: 362619 - RNA, 64 nt, Human
uggcuucacugcagguaaugccuuucccuucaggaagccccagaacacccacaggucuugguaa

SEQ ID NO: 362620 - RNA, 64 nt, Human
ugaggucccuucaaggccuccccaauccaggccaaagccccaugugccuuguccaggaacugcc

SEQ ID NO: 362621 - RNA, 64 nt, Human
aaaaugaaaagaaaaaaacagacauacaaaauaaaagccccaguuuuuuauuaugguauuuaac

SEQ ID NO: 362622 - RNA, 64 nt, Human
ucaucaggagaacaucauaacccaugaaggauaaaagccccaaauggugguaacugauaauagc

SEQ ID NO: 362623 - RNA, 64 nt, Human
uuuuugucccuuuaucucuccugguuuuuuucuuaagccccagaaagccaaaaagaacauguaa

SEQ ID NO: 362624 - RNA, 64 nt, Human
uuucugcguccaccccugaacuccugagcgacagaagccccaggccuccaccagccuugaaccc

SEQ ID NO: 362625 - RNA, 64 nt, Human
gccuguagaccuaucggcucucaucccuugggauaagccccaguccagguccaggaggcucccu

SEQ ID NO: 362626 - RNA, 64 nt, Human
cucucccucccuucaucauccgcccucccacuacaagccccaguguguguuguuccccucccug

SEQ ID NO: 362627 - RNA, 64 nt, Human
guacaccugugagagagacaaguaccugauuuggaagccccaacaucuaaggauauacaguggg

SEQ ID NO: 362628 - RNA, 64 nt, Human
cacagagcugccugggcuuguaccuggccacauaaagccccaguuuaaagcagucccugcuucu

SEQ ID NO: 362629 - RNA, 64 nt, Human
gaagagggcagauaaucagacuugaggaaacugaaagccccagguugagagaacagaggccuag

SEQ ID NO: 362630 - RNA, 64 nt, Human
ugcacccucgguccccuuccagguuccuguuuauaagccccaaccccucuguccccaucuugua

SEQ ID NO: 362631 - RNA, 64 nt, Human
auggagcaagcgcuuguggagaaccaaagcccaaaagccccagauccccuuaaagcagagaggg

SEQ ID NO: 362632 - RNA, 64 nt, Human
gguaguuggugagcagagcgggacucuguccaacaagccccacagccccucaaagacuuuuuuu

SEQ ID NO: 362633 - RNA, 64 nt, Human
gucagggccucagaccagccaaccuuuguggaauaagccccagcccagccaaaccaaacccaga

SEQ ID NO: 362634 - RNA, 64 nt, Human
gcagcaucugggcugccagccacagggaagggccaagccccauguagccccagucauccugccc

SEQ ID NO: 362635 - RNA, 64 nt, Human
cgggaaagcgauggacagacagacgauggggccgaagccccaagcugggcacaaaguaguuuuu

SEQ ID NO: 362636 - RNA, 64 nt, Human
gcagagaaucauguuccuuugcuguggaacacauaagccccacaguuuuccagucagccuaaua

SEQ ID NO: 362637 - RNA, 64 nt, Human
ggcagcuguguaauccuaugucagcucucuuaggaagccccaguacuuauauugggcaugcacu

SEQ ID NO: 362638 - RNA, 64 nt, Human
ggugucacugccgcucaugcauagaaaccaccaaaagccccaauaaagcauccaggaggaacag

SEQ ID NO: 362639 - RNA, 64 nt, Human
ugucucaggaauggggauagaugggagguucuugaagccccaggcgaagcugguaccucuggcu

SEQ ID NO: 362640 - RNA, 64 nt, Human
acuauguagcaucuugaaaagaaaaauuauaauaaagccccaaaauuaagaauucuuuugucau

SEQ ID NO: 362641 - RNA, 64 nt, Human
agguguacccagggaucagugauggugguuucugaagccccaugucccuggugaaggaggacug

SEQ ID NO: 362642 - RNA, 64 nt, Human
uagauaaggcuucagccaugagucaccccgcaguaagccccagaguauauugaauagaaauucu

SEQ ID NO: 362643 - RNA, 64 nt, Human
cgacggagugagacucccucucaaaaaaagaaaaaagccccagcauguagcaaaagcauuucuu

SEQ ID NO: 362644 - RNA, 64 nt, Human
ugucuuacccuccggugugcuuguguucuuagaaaagccccagcauggccgggcaugguggcuc

SEQ ID NO: 362645 - RNA, 64 nt, Human
ucauuggucuccucagauuucuggggccaccugcaagccccauuccauuccuacagaucucuca

SEQ ID NO: 362646 - RNA, 64 nt, Human
uuuuuuuuuccuagcccucucacauuuaugaagcaagccccacuuauuccccauucuuccuagu

SEQ ID NO: 362647 - RNA, 64 nt, Human
ugcccuagacccaaaagugguggaggcugagaagaagccccacugcccucgcuccuaggcccug

SEQ ID NO: 362648 - RNA, 64 nt, Human
gcacguguuaaugucaucuuugcucauguguuauaagccccaaguugcuguauauuuucacaag

SEQ ID NO: 362649 - RNA, 64 nt, Human
gcccucaucccacccauucucagggcaguaugggaagccccaaggugaccuggccaaguagcaa

SEQ ID NO: 362650 - RNA, 64 nt, Human
cccucuaguggagaagaauccucagagcauccugaagccccauucuccgacuuacaacgacgag

SEQ ID NO: 362651 - RNA, 64 nt, Human
ugugaccugugcccaggagggcgugauccgagugaagccccaggucucagagagcaagcuguag

SEQ ID NO: 362652 - RNA, 64 nt, Human
gaugauuugccuuucugaacauaagagagcuucaaagccccaaauuccugggcuggggauucca

SEQ ID NO: 362653 - RNA, 64 nt, Human
aaacaauauccuuguuuacagaagagaaacaaacaagccccacucagcucagucacaggagaga

SEQ ID NO: 362654 - RNA, 64 nt, Human
aaagaaggugccgauuucaugcauucuagugcagaagccccaacugugaucacgauccagucug

SEQ ID NO: 362655 - RNA, 64 nt, Human
ggcaggugcgguaacugccgcacuggacccuaggaagccccagguauucgcaaucugaccuccu

SEQ ID NO: 362656 - RNA, 64 nt, Human
uaccgccaacccagcugcuucuggcaggggcuccaagccccagcguggggaagggcccuggaga

SEQ ID NO: 362657 - RNA, 64 nt, Human
uuguaccacugcagcaucccccacuucuccacggaagccccaucccaaagcugcugccuggccc

SEQ ID NO: 362658 - RNA, 64 nt, Human
cuagaaaguggagaagcucacuguucacugugcaaagccccaguagucggauuccggggaaaag

SEQ ID NO: 362659 - RNA, 64 nt, Human
cuaaugggucgcugaggcuggucucucagugaugaagccccaggcguggaagcauccacucucu

SEQ ID NO: 362660 - RNA, 64 nt, Human
ccaggacggaccugcgggggcacccagagguccuaagccccaggacugagggucgugcaucacc

SEQ ID NO: 362661 - RNA, 64 nt, Human
auuuuaagcugcuguuccuggccaguugcagguuaagccccagaaaaguucaccuuggagaagc

SEQ ID NO: 362662 - RNA, 64 nt, Human
cucaguccuggcaccucaacugugacaaucagcaaagccccacccaggcccccaucugggauga

SEQ ID NO: 362663 - RNA, 64 nt, Human
ucaggaguucaagaucagccugaccaacauggagaagccccaugucuacuaaaaauaaaaaauu

SEQ ID NO: 362664 - RNA, 64 nt, Human
caaagacuugugaugcucuggggcuucuguggccaagccccacccuuuccuggucaugguaccc

SEQ ID NO: 362665 - RNA, 64 nt, Human
ccaggaguuccagaccaggcugggucacaugacaaagccccaucucuacaaaaaaaaaaaaaaa

SEQ ID NO: 362666 - RNA, 64 nt, Human
ccaggaauucgagaccagccugggccacaugacaaagccccaucucuacaaaaaaauuacaaaa

SEQ ID NO: 362667 - RNA, 64 nt, Human
agcuuggcugcagaccuccuuuacccugacucacaagccccacugaugcucugggccaugcccg

SEQ ID NO: 362668 - RNA, 64 nt, Human
gucaauaaagaccuggaaggauguugugcuucugaagccccacuggguguuacugcagcagggc

SEQ ID NO: 362669 - RNA, 64 nt, Human
ugcagaacauucccugcucuguacugggugugugaagccccagcagagaaggccggagggaggg

SEQ ID NO: 362670 - RNA, 64 nt, Human
gaaguugggccucccaugggcccaagggaguaggaagccccauuccccaccuguccuuccucua

SEQ ID NO: 362671 - RNA, 64 nt, Human
gggcguaugccucauuuuucaucuggugaugccaaagccccauggauucaggugcagaagaggg

SEQ ID NO: 362672 - RNA, 64 nt, Human
gccuuuacaaacaccugcaggagaagggccacggaagccccaggcuuuagagcccucagcaggu

SEQ ID NO: 362673 - RNA, 64 nt, Human
augacccacccgccccauccaggcuccagcagcaaagccccaggagaacaggcuggacagagga

SEQ ID NO: 362674 - RNA, 64 nt, Human
uggcagccggaaggucccucugaggcagaagcucaagccccauggggacaguggcuccccagug

SEQ ID NO: 362675 - RNA, 64 nt, Human
aucauaauuuaaaaagucaaggcuuauaacaaaaaagccccagcccauuccucccauucaagau

SEQ ID NO: 362676 - RNA, 64 nt, Human
ugauaauauaggaaguuucaccuugccuuuguccaagccccaccuauuaaaacccuuuacucac

SEQ ID NO: 362677 - RNA, 64 nt, Human
aagcugguuuucuccugauaagaagaaaggaagaaagccccagacgcuugguuuuucucagaac

SEQ ID NO: 362678 - RNA, 64 nt, Human
uaucuauacauuaccuuguagcagcaguaccuggaagccccagcccgucacagaaguguggagg

SEQ ID NO: 362679 - RNA, 64 nt, Human
ucauucccuucgacagcauuuuccucugcuuugaaagccccagaaaucaguguuggccaugaug

SEQ ID NO: 362680 - RNA, 64 nt, Human
aaauauaugaugaagauuguaggacugucuucccaagccccauguucaugguggggcaaugguu

SEQ ID NO: 362681 - RNA, 64 nt, Human
acaccacagaugaugcuacugccauggccagugcaagccccagugucauguccaccaacuucug

SEQ ID NO: 362682 - RNA, 64 nt, Human
cauucaccuuuucugugaacaggcagccuucuaaaagccccaaacauccuucuugaugcuuugg

SEQ ID NO: 362683 - RNA, 64 nt, Human
agcccuguuuauuuauuauaaauauauuuuuuacaagccccagcuccucuucuugccccgcaua

SEQ ID NO: 362684 - RNA, 64 nt, Human
cuuuccucccaaaagaaaaggcaucaggcuccccaagccccacagcucuccuuuccaccaaagc

SEQ ID NO: 362685 - RNA, 64 nt, Human
cugaggacugcaccauugcugcuccuuagcugccaagccccauccugccgcccgagguggcugc

SEQ ID NO: 362686 - RNA, 64 nt, Human
gcauauuacuguacaugggacuaugcuuuucucaaagccccauuaacugcuuccuauaauuuug

SEQ ID NO: 362687 - RNA, 64 nt, Human
caauaagcuucuugguucuacuucucuucuccacaagccccaauuucacuuucucagaggaaau

SEQ ID NO: 362688 - RNA, 64 nt, Human
uuuuugcuuugcuuuucucacccaugcuuccuugaagccccaggugccacuuugcuggucuugu

SEQ ID NO: 362689 - RNA, 64 nt, Human
gcuucuccuuugucucccauccacucugacaccuaagccccacucuuuucccauuagauauaug

SEQ ID NO: 362690 - RNA, 64 nt, Human
uaucugccauuagaccuucuuaucauccauacuaaagccccauuauuuagauugagcuugugca

SEQ ID NO: 362691 - RNA, 64 nt, Human
aagaaaguagcagaaauuaaaucuuaauaaaagaaagccccacugacuccuuuauuugcugaac

SEQ ID NO: 362692 - RNA, 64 nt, Human
ggaaggugcuuagauggugagggcucuagaaaccaagccccaugagcagcaguggaagaccucg

SEQ ID NO: 362693 - RNA, 64 nt, Human
auuguggauugguaagaaucaccaggaaaccauuaagccccaauagcuacaaggagggugguua

SEQ ID NO: 362694 - RNA, 64 nt, Human
cuggacagagcaaggagagggcuccccacucccuaagccccacagccagcucugcaucaccaca

SEQ ID NO: 362695 - RNA, 62 nt, Human
ccauguacagaggcaggagucacguuuggucaccauggaagcuuuuauugcucccacauggu

SEQ ID NO: 362696 - RNA, 62 nt, Human
ccaccuucucuuuucacauaggagggaacagaccauggaaauuuaaacgacuuccucacggu

SEQ ID NO: 362697 - RNA, 62 nt, Human
gagggccaguuccacauugagccagccuggucccauggaaaaugauggccugggcuuucuga

SEQ ID NO: 362698 - RNA, 62 nt, Human
ugaggaguagaagaggaugaccagcuagacucccauggaauuggaacuccuauuccuugcuu

SEQ ID NO: 362699 - RNA, 62 nt, Human
uuauuuccaaccccaacagacacugacaggguccauggaauucuucgggaaauccuccaagg

SEQ ID NO: 362700 - RNA, 62 nt, Human
gcugaucccagucacugcuugcuggggccaugccauggaagcuucccaucagucucccagcu

SEQ ID NO: 362701 - RNA, 62 nt, Human
accccagagcucuguguauuugcauccagaggccauggaaacauucuuugcauuuaagagac

SEQ ID NO: 362702 - RNA, 62 nt, Human
ccugccugcugcugccccauuugaucaagagaccauggaagugucagagauucagaauccaa

SEQ ID NO: 362703 - RNA, 62 nt, Human
acccaagcuguggcagccgucccaggccacccccauggaagcaauaaagcucuucccugagc

SEQ ID NO: 362704 - RNA, 62 nt, Human
gcuauguauaaaugaaauuaccauuuugagaaccauggaaccacaggaaaggaaauggugaa

SEQ ID NO: 362705 - RNA, 62 nt, Human
gauggcaucuacucaagguauuuuacagauuaccauggaaaugguagauacaguuuaaaagu

SEQ ID NO: 362706 - RNA, 62 nt, Human
gugucagccugaggcuucuuuucucucauuucccauggaaggacuucggaaaugccuuaagu

SEQ ID NO: 362707 - RNA, 62 nt, Human
uggggaaggccauggggaccugaaacauugccccauggaaaugucgacccugugcggacauu

SEQ ID NO: 362708 - RNA, 62 nt, Human
cuaacugccaauaucaaguugcagauuuuaauccauggaaauuguguuuugugcugaauugu

SEQ ID NO: 362709 - RNA, 62 nt, Human
acaucacuuuugaaauguaauucuggucuauaccauggaagucauaaauggacauuauaguc

SEQ ID NO: 362710 - RNA, 62 nt, Human
gugggcauuuuucugugugcccccaaaaagcuccauggaaacaggcaccugguagcugcgga

SEQ ID NO: 362711 - RNA, 62 nt, Human
auaucgugccaagccucaaaaauaggcuuauuccauggaacaagaauuaaaaaugaauaagc

SEQ ID NO: 362712 - RNA, 62 nt, Human
aaguuccuuuaauguccuuuugagauuuugagccauggaacuuacuuguucaccuggcuaag

SEQ ID NO: 362713 - RNA, 62 nt, Human
uuccacucugaguagcacaucuccccaggugcccauggaacaccugcuuucaucccaaauau

SEQ ID NO: 362714 - RNA, 62 nt, Human
aaaggcccccuugacacauccaggccaaccucccauggaauagguaggcaagccaggacucc

SEQ ID NO: 362715 - RNA, 62 nt, Human
aaucucuuccacgggaccagcccagagcuaugccauggaaaugauauuggauguugguaaga

SEQ ID NO: 362716 - RNA, 62 nt, Human
aauuauauucccaaaaaugaaaacacugagaaccauggaaaaacuaguccuuacuugguaau

SEQ ID NO: 362717 - RNA, 62 nt, Human
cccggcgucccgucuaaagguguucugcagauccauggaaagcuuccugggaaacguaugcu

SEQ ID NO: 362718 - RNA, 62 nt, Human
gucuucuaccaggggcugcugacuccaguuacccauggaaugcaggaccugggagggguagc

SEQ ID NO: 362719 - RNA, 62 nt, Human
ugagggucaaaaaaaaauacuuaggaagcuagccauggaagcuucuugccucugacccagcc

SEQ ID NO: 362720 - RNA, 62 nt, Human
cucaauauugggaaauauauugaggaguuauuccauggaaauacaaugcuuuccaccuacua

SEQ ID NO: 362721 - RNA, 62 nt, Human
uguuccuuugaaaagaguccaguacccaggccccauggaaaggucugaaaauaauauuccag

SEQ ID NO: 362722 - RNA, 62 nt, Human
ccugcccuuccuuugguugccauauggaauggccauggaaugcacgaagucacaaugcacca

SEQ ID NO: 362723 - RNA, 62 nt, Human
agugugauagaucgaaauuaacauauuuuugaccauggaaggaaauaaggaaauucaaccca

SEQ ID NO: 362724 - RNA, 62 nt, Human
ggauaguaccugcaggaacaauauuccuguagccauggaagagggccaaggcucagucacuc

SEQ ID NO: 362725 - RNA, 62 nt, Human
gggaagagaagcugaugcagccggugcuccacccauggaagaaaggcuggcuguccuugggc

SEQ ID NO: 362726 - RNA, 50 nt, Human; identical to SEQ ID NO: 90959

SEQ ID NO: 362727 - RNA, 62 nt, Human
uucaaaugcuuaaauauauaauacauuuuuuuccauggaagugagggaauauuucaguuucc

SEQ ID NO: 362728 - RNA, 62 nt, Human
ccuccauguguggguccuuuguuuuauuagaaccauggaagaagguuccugggccaucagua

SEQ ID NO: 362729 - RNA, 62 nt, Human
cgugaaagcucuccuaauacuuacuuaaauagccauggaagaaaauuaugcuugucccuucu

SEQ ID NO: 362730 - RNA, 62 nt, Human
uccaaaauguaaauucuaauguuuaccuuguaccauggaaaacaugaaaagagucuuagaag

SEQ ID NO: 362731 - RNA, 62 nt, Human
cuuccugcuguguuauagaacuguaggggaggccauggaaaugacucuaaagauacaaaauu

SEQ ID NO: 362732 - RNA, 62 nt, Human
gagauuugucuuacuuauuuuucuuuugguugccauggaaguuauggcccugaaaaucgucu

SEQ ID NO: 362733 - RNA, 62 nt, Human
cccaguuacugcacuugccacuaccaugcuguccauggaaggaauaaucagcaguucaguug

SEQ ID NO: 362734 - RNA, 62 nt, Human
gcagauguugcaaacuuucauaccacugcuggccauggaagccucuuaacaacacacuguca

SEQ ID NO: 362735 - RNA, 62 nt, Human
gucauccccggagucccuauacagagguccugccauggaaccuuccccuccccgugcgcucu

SEQ ID NO: 362736 - RNA, 62 nt, Human
gucacccccggagucgccacacagacguccugccauggaaccuuccccucccggugcacccu

SEQ ID NO: 362737 - RNA, 62 nt, Human
auacagaaccuguccaucuuuaagaccuucauccauggaaucuacuauacaggaggaugcag

SEQ ID NO: 362738 - RNA, 62 nt, Human
aaauaaguaauuuauuguaagacaacaucaagccauggaaacuuggcagaagauucaaagca

SEQ ID NO: 362739 - RNA, 62 nt, Human
cuuuuguuuaucuuguuuuugguuacaugauaccauggaaauauuccaaauaaauuuuuuuc

SEQ ID NO: 362740 - RNA, 62 nt, Human
ccaguucccuccucccucgguuauaaagauucccauggaaaguguccaaucagauccccaaa

SEQ ID NO: 362741 - RNA, 62 nt, Human
uuguuuauguaaauguuuguuaaaaauaaaucccauggaauauuuccauguaacuuaguugu

SEQ ID NO: 362742 - RNA, 62 nt, Human
caccucuaccuugcuuucaaaaggacugcuuaccauggaagugcuccagaagaaucauuuga

SEQ ID NO: 362743 - RNA, 62 nt, Human
agaagacuaaccagcuuagucagaagaugguuccauggaagaaaaaggccaaggaguuugaa

SEQ ID NO: 362744 - RNA, 62 nt, Human
gauuuaauaggagggguuaagguucaugagaaccauggaaagauguggucugagaugggugc

SEQ ID NO: 362745 - RNA, 62 nt, Human
uuuugugcucuucugugaucacaggaccauuuccauggaaugcagauucauacccagccagc

SEQ ID NO: 362746 - RNA, 62 nt, Human
auaugacauguuuauauuguaaaugcacuuuuccauggaauaauuuagggaaguguuuuaau

SEQ ID NO: 362747 - RNA, 62 nt, Human
aacauuucuuugagaucuauauuuauaagcagccauggaauuccuauuaugggauguuggca

SEQ ID NO: 362748 - RNA, 62 nt, Human
aggcuugaagcuuuccuuuauucuugaaucucccauggaaggguuguaccccagcugccacu

SEQ ID NO: 362749 - RNA, 62 nt, Human
agaaggaaugcgaguaaggauuggcuugaauuccauggaauuucuaguaugagacuauuuau

SEQ ID NO: 362750 - RNA, 62 nt, Human
ugagguaccuccaaggaccggccuuugcaccuccauggaaacgaagcaccaucauucccguu

SEQ ID NO: 362751 - RNA, 62 nt, Human
uauaauaaccugguuaucuaaccuguuccauuccauggaaccauggaggaggaagacccuca

SEQ ID NO: 362752 - RNA, 52 nt, Human; identical to SEQ ID NO: 90985

SEQ ID NO: 362753 - RNA, 62 nt, Human
cugaauuauaagaggcugauaauuccagugguccauggaaugcuugaaaaaugugcaaaaca

SEQ ID NO: 362754 - RNA, 62 nt, Human
cagcaguuuguacgagcucuuaaguguugauuccauggaacugacggcuuugcuuguuuuga

SEQ ID NO: 362755 - RNA, 62 nt, Human
ccuugccuuucugggacuuggccucaccccacccauggaauaccugccucaucccaaagauc

SEQ ID NO: 362756 - RNA, 62 nt, Human
agggaggaaaaccagagcacacaguuuugucaccauggaacaccccaaaugccauucuucag

SEQ ID NO: 362757 - RNA, 62 nt, Human
ugcauauaaaucaaggaaccaaauaucuguagccauggaaaugucugacuagaaauauuuau

SEQ ID NO: 362758 - RNA, 62 nt, Human
cuacagugagaagacacagcguuuuggcaacaccauggaaagugggcuuaaaaaaggguuuu

SEQ ID NO: 362759 - RNA, 62 nt, Human
uacugggcuugcuacuauuuguaacuccuugaccauggaauuauacuuguuuaucuuguugc

SEQ ID NO: 362760 - RNA, 62 nt, Human
uuuaaaggccugguucuaaguccuuuuuaaagccauggaacaaaaccugauacaucacccua

SEQ ID NO: 362761 - RNA, 62 nt, Human
uuuugcuuccuaaagauuugaauuuuuuguucccauggaagaaguaaagaagaggucacuag

SEQ ID NO: 362762 - RNA, 62 nt, Human
aaagugaaaguaguuguucacaaaagaauucgccauggaauucuuucaguuaccaagcucuc

SEQ ID NO: 362763 - RNA, 62 nt, Human
ugcuucuugaguugcuucaugguuuaugcucgccauggaaagcuaucaguaacaguuucaug

SEQ ID NO: 362764 - RNA, 62 nt, Human
aggugcagcuuccaugucaguugguguuguaaccauggaaaagucccuuuccaaucaaacuu

SEQ ID NO: 362765 - RNA, 62 nt, Human
guugcuaggcuucaaugccuaucgguagcaagccauggaaaaagaugugucagcuagguaaa

SEQ ID NO: 362766 - RNA, 62 nt, Human
caagcugaugaagggaagccuuugccaauggcccauggaagacacuugguuugagaaacccu

SEQ ID NO: 362767 - RNA, 62 nt, Human
uaaacacuauagcaucuguuaagauccaguguccauggaaacauucccacaugccgugacuc

SEQ ID NO: 362768 - RNA, 62 nt, Human
cggaggcaccccgaagaaugaaaaguacacacccauggaauucaaggugggagccuucuuuu

SEQ ID NO: 362769 - RNA, 62 nt, Human
ugacggugcaucagcaugccgcguuaggcucgccauggaaauacgcgcggggagcggccgcu

SEQ ID NO: 362770 - RNA, 62 nt, Human
uaugagaucaucaaacauugauaguagggacuccauggaauauuugcccaguaaugguaaga

SEQ ID NO: 362771 - RNA, 62 nt, Human
auaguguaaaaauucccugagcuaagcuaaaaccauggaagaaacaugcuacuuuaguguuu

SEQ ID NO: 362772 - RNA, 62 nt, Human
ucugaagauggacucuaaacuuugguuuaccuccauggaaaauaaagauuuagaaaccaggu

SEQ ID NO: 362773 - RNA, 62 nt, Human
ucgcccaccuggaugucccaaagugcuagauuccauggaauuuuccugcauggagugcuaca

SEQ ID NO: 362774 - RNA, 62 nt, Human
cucucucucuuuuuuuuuucuuuuuccuuuugccauggaaucugggugggagaggauacugc

SEQ ID NO: 362775 - RNA, 62 nt, Human
ugcagaagcgugcgugggaaugcagcuguuuuccauggaaccagacgcuacagagacugcaa

SEQ ID NO: 362776 - RNA, 62 nt, Human
gaauuuuaaugaaaaaauuacccagauuggcuccauggaaaaggaggaacagcguuuccgua

SEQ ID NO: 362777 - RNA, 62 nt, Human
ccuggccagcccuggcuuuaauaggacugauaccauggaauauuucaucucaccaagaugug

SEQ ID NO: 362778 - RNA, 62 nt, Human
uggugucacaaaaagacaaaugauuguaggauccauggaagugcacuuaggcuugcuguggu

SEQ ID NO: 362779 - RNA, 62 nt, Human
uauuuuagcuuucaguuauucuaguuuguuucccauggaaucuguccuaaacugguguuuuu

SEQ ID NO: 362780 - RNA, 62 nt, Human
gugaagcaacauggaugcagucagccaaguccccauggaagucgugcuucccaagcacaucc

SEQ ID NO: 362781 - RNA, 62 nt, Human
cagccuggccuguggcaucagucccugagucaccauggaagcagcauccugaccacagcugg

SEQ ID NO: 362782 - RNA, 62 nt, Human
cugucccaugugcaucuuauuuaaaauuucccccauggaaaucacucuccuguugacuauuu

SEQ ID NO: 362783 - RNA, 62 nt, Human
acauuaauuuacuuuucucuauaccaaaucacccauggaauaguuauugaacaccugcuuug

SEQ ID NO: 362784 - RNA, 62 nt, Human
uuuuagagacccagacuugguuggcagcgcugccauggaacaccccagcaagcaccucccag

SEQ ID NO: 362785 - RNA, 62 nt, Human
caacccucuucccuauuucccuaaaaguaucuccauggaaugaacugugcaaaaucuguagg

SEQ ID NO: 362786 - RNA, 62 nt, Human
augguuguuauugugcuguugacaugaauagaccauggaaacauuuucaucauuauuauuca

SEQ ID NO: 362787 - RNA, 62 nt, Human
agcaugaaguacguguguguguguguguguuaccauggaaaaggauauucacaguaguacag

SEQ ID NO: 362788 - RNA, 62 nt, Human
guuguauauuguguugaugacguacguuauuuccauggaagauagccgcuguggcagcuguc

SEQ ID NO: 362789 - RNA, 62 nt, Human
gcaggggggucauuuuaauguaacaccacaccccauggaaacacuaguccugauaauaaaca

SEQ ID NO: 362790 - RNA, 62 nt, Human
uccuccucuucaggacaugcuccauuuauuuuccauggaagacacagggucagagaucuguc

SEQ ID NO: 362791 - RNA, 62 nt, Human
ugagcucucuggacacugcagaggacccauggccauggaacccugaagaagcaugucuggcc

SEQ ID NO: 362792 - RNA, 62 nt, Human
augucagcagaguggcgccugccugugcuggcccauggaacggagacagcauugggcugacu

SEQ ID NO: 362793 - RNA, 62 nt, Human
uggugggguuugagcaaugcuucucugcccuuccauggaaaguggaaccagaaauggugcca

SEQ ID NO: 362794 - RNA, 62 nt, Human
ccuaauuccucaaugaccuuuaucuaaaaucuccauggaagcaauaaauucccuuuugaugc

SEQ ID NO: 362795 - RNA, 62 nt, Human
gggguggggggugggggugggucagaacccugccauggaacuguuuccuucaucaugaguuc

SEQ ID NO: 362796 - RNA, 62 nt, Human
ccucccucacccccuccuucauaugaaaggugccauggaagaggcuacagggccaaacgcug

SEQ ID NO: 362797 - RNA, 62 nt, Human
ggcuccacaagcgugucuggcauucccacccaccauggaagacuggauacgcaccuggaaac

SEQ ID NO: 362798 - RNA, 62 nt, Human
cugcaaucaggaaagcagcagcccacuccuucccauggaaucuagacagcauuuaucccucu

SEQ ID NO: 362799 - RNA, 62 nt, Human
cuuguaauuagguucuuguuaauacagucauuccauggaauuacuuuuuaaaauuccuguga

SEQ ID NO: 362800 - RNA, 62 nt, Human
uuuucauuaccaaaauguacagcuauuauuugccauggaaaagguuagucucauuuagaaaa

SEQ ID NO: 362801 - RNA, 62 nt, Human
aauucagaauuuuucuuuuuaauauauuucuuccauggaagaguugucaucacuaaaacuuc

SEQ ID NO: 362802 - RNA, 62 nt, Human
uagagaagaaagaacaacaucagcaguaaaguccauggaauagcuaguggucuguguuucuu

SEQ ID NO: 362803 - RNA, 62 nt, Human
cauuguggaaucauguuggaagcuccacauguccauggaaguuugugauguacggccgaccc

SEQ ID NO: 362804 - RNA, 62 nt, Human
caaguuauuuccuuuuauaauacuuuucuuccccauggaacaaaugggaucaauuugugagu

SEQ ID NO: 362805 - RNA, 62 nt, Human
agauuacgaaugcuuuugacuuuuuuuuuuguccauggaauauuugacagaugaaguaggac

SEQ ID NO: 362806 - RNA, 62 nt, Human
cuuuaaaagaaacugagguucagauacacauaccauggaaaaaucuuacuuuucuuguuacu

SEQ ID NO: 362807 - RNA, 62 nt, Human
accuuuggcuacacaauuggaagucuaagaacccauggaaaaaugccaucaaaugaauaaug

SEQ ID NO: 362808 - RNA, 62 nt, Human
aguguauuuuauucaguaguuugaggaucuugccauggaagauacuagcccagccuagcaga

SEQ ID NO: 362809 - RNA, 62 nt, Human
uaaugcauuuaucuucccccccaccccccgccccauggaauauuuaaucuauuuaaucuucu

SEQ ID NO: 362810 - RNA, 62 nt, Human
aucuuuacucaaaaaaacaaaaaaacaaaaacccauggaagcaacaaaagaguuaaacauga

SEQ ID NO: 362811 - RNA, 62 nt, Human
gacaagaaucaaauuuuaccaggaguaauugcccauggaaacauucuguuuuucaaaagaag

SEQ ID NO: 362812 - RNA, 62 nt, Human
auugauccaaggccuucaauguaggagugcuaccauggaaauggacagaguuaucgaggcac

SEQ ID NO: 362813 - RNA, 62 nt, Human
aggcgcuggugagcccuggucaaugagcgcuuccauggaaaccgcucggcugauuacauuuu

SEQ ID NO: 362814 - RNA, 62 nt, Human
gagguaguucaugaaaaugcugugcacucauuccauggaauaaauguuggaaagcugaucuu

SEQ ID NO: 362815 - RNA, 62 nt, Human
ugagcuuagauuaccuagauuauuccaguaucccauggaagcugaggacuuauuccgcuuuc

SEQ ID NO: 362816 - RNA, 62 nt, Human
ugugcucaggaugcagcccugggauccagcacccauggaagcuucugcugggauggugucac

SEQ ID NO: 362817 - RNA, 62 nt, Human
ccucuguccaggaggccgggaucaggcuguugccauggaaguucagggccauagacugcccc

SEQ ID NO: 362818 - RNA, 62 nt, Human
ccugcauagacuuucuaaacagugaguaaauaccauggaaugucagaaaugacuuuaucauc

SEQ ID NO: 362819 - RNA, 62 nt, Human
aucuaaucacuuagacuccccugaagaaucccccauggaaacugcccuuauccgcuguccag

SEQ ID NO: 362820 - RNA, 62 nt, Human
ggcagagaaacaauuuuugaaaaagagcaaacccauggaaaaugucucagaucuaauauuaa

SEQ ID NO: 362821 - RNA, 62 nt, Human
uugccuugcauuuguaccuuauugaucuuugcccauggaagucucaaagaucuuucguuggu

SEQ ID NO: 362822 - RNA, 62 nt, Human
ccaaaaagagaugacaaaacuaaguucaggggccauggaaaaugaaaaaguccgcuauauug

SEQ ID NO: 362823 - RNA, 62 nt, Human
ucacucuuagaaauugaauuagcauaauugggccauggaacacauaugcuggaaaucuuuga

SEQ ID NO: 362824 - RNA, 62 nt, Human
ugugagauggaaaaacaaauucuggggcaaauccauggaaauuguuccaauuggcacaaccc

SEQ ID NO: 362825 - RNA, 62 nt, Human; identical to SEQ ID NO: 362814

SEQ ID NO: 362826 - RNA, 62 nt, Human
gggagggcuagggggcagguggggaggggaagccauggaaauacaagucaaaggggugagau

SEQ ID NO: 362827 - RNA, 62 nt, Human
agaaauaucgaccaacaccucccuggucacauccauggaaucagagcaagauuuccuuucug

SEQ ID NO: 362828 - RNA, 62 nt, Human
cuguguuccaggaaccagaucacgauuuuuagccauggaacaauauaucccaugggagaaga

SEQ ID NO: 362829 - RNA, 62 nt, Human
uuauuauuccuuaagaacucuguguuauauuaccauggaacgccuaauaaagcaaaaugugg

SEQ ID NO: 362830 - RNA, 62 nt, Human
cacccgcucccuuuuuuccuuagccuucagugccauggaacuaaucaagggaggaaaagguc

SEQ ID NO: 362831 - RNA, 62 nt, Human
cgcaguuuguccuggagugacauacacauccaccauggaaagggaagcaucucugccugugg

SEQ ID NO: 362832 - RNA, 61 nt, Human; identical to SEQ ID NO: 91065

SEQ ID NO: 362833 - RNA, 53 nt, Human; identical to SEQ ID NO: 91066

SEQ ID NO: 362834 - RNA, 62 nt, Human
uaagccacacuauaucuucaugaguugcaaauccauggaaacacaguaaaccagcccugaaa

SEQ ID NO: 362835 - RNA, 62 nt, Human
ugugguaaagccauuggaugaggaggggacugccauggaaaggagaguuuguuacuuacggu

SEQ ID NO: 362836 - RNA, 62 nt, Human
cugcucucaagcaguggccucucucacuuuagccauggaauggcuccgaucuaccucacagc

SEQ ID NO: 362837 - RNA, 62 nt, Human
acccugaggaagguucauugccauugucaucaccauggaaacaacguuccucuccaccugca

SEQ ID NO: 362838 - RNA, 62 nt, Human
aggagaagauaacugaggauuuuaaaaagaagccauggaaaaacuuccuaguaagcaucuac

SEQ ID NO: 362839 - RNA, 62 nt, Human
ccagcacucuggaagcuuugggaucccaggaaccauggaauuauucccaaauggacucugac

SEQ ID NO: 362840 - RNA, 62 nt, Human
agauaggcaagaaggacagcaguaaaugaagaccauggaagaaaagaaggaaugccaaagau

SEQ ID NO: 362841 - RNA, 62 nt, Human
uugcacccagaaucuagugauuuuagucagauccauggaacagagcagcuucguaauacauu

SEQ ID NO: 362842 - RNA, 62 nt, Human
cgucaacugaugaguggauuaauaaaauguuuccauggaauauuccuuggauuacucagcca

SEQ ID NO: 362843 - RNA, 62 nt, Human
aaaacugcuguuuuaaagugguuuauuauguuccauggaagaaacuggucuuauugaaugca

SEQ ID NO: 362844 - RNA, 62 nt, Human
accacaugguaauucuaagacuuguucuuuacccauggaauguaauauuuuugcaaagaugg

SEQ ID NO: 362845 - RNA, 62 nt, Human
aaaaaaaaaaaaagccucagcauuuuaucauuccauggaaggagaaucuuuugaaagaaagc

SEQ ID NO: 362846 - RNA, 62 nt, Human
ccggcacugugcacucuacucugcgacgauccccauggaacagcccugcacgcccaggauga

SEQ ID NO: 362847 - RNA, 62 nt, Human
gaggcuuauuguaacauauaauauuagugaaaccauggaauuauaugaaaaugauacaugag

SEQ ID NO: 362848 - RNA, 62 nt, Human
guucugacuuuaagccagaacuuguggcugggccauggaagcugugacuccucuguggacau

SEQ ID NO: 362849 - RNA, 62 nt, Human
uuuggaggaaaauguaugcauuuauaaguguuccauggaaucaguuuuuauuguaucgauau

SEQ ID NO: 362850 - RNA, 62 nt, Human
gucaacaugccccaagucaaagucuucuuuacccauggaauaagcuggcuugcuacuucccu

SEQ ID NO: 362851 - RNA, 62 nt, Human
agggcugcauuuuggguugaguaauauggacaccauggaaguacaggaucugaguccaacau

SEQ ID NO: 362852 - RNA, 62 nt, Human
uuuucugcgguuuuugcaagaauaagcaaagcccauggaauuuaauuuuucauugugaucag

SEQ ID NO: 362853 - RNA, 62 nt, Human
acggaauuuugagggcaaagaaaccuguguuuccauggaauugcugagacguggcuccuggg

SEQ ID NO: 362854 - RNA, 62 nt, Human
cuaaggguaauguacagcccgugcuuggagaaccauggaagcuacaccccuacaggugcaua

SEQ ID NO: 362855 - RNA, 62 nt, Human
uugguagcuuggacuuagugggaguguuuacaccauggaaauugacaaacuauaaaucaggg

SEQ ID NO: 362856 - RNA, 62 nt, Human
uuucuuuuguccaucagaucucuugugaaaucccauggaagguugugcucagccugucgggu

SEQ ID NO: 362857 - RNA, 62 nt, Human
aaauucugagcuccugagauacugacuagcaaccauggaaugaaugugugaccagaaagugg

SEQ ID NO: 362858 - RNA, 62 nt, Human
cugaagugaacuuugcauugaauaaauuuuugccauggaaagaacaucaaacaagccacuca

SEQ ID NO: 362859 - RNA, 62 nt, Human
ggcaaguaccgccuuauggaguauacgggcaaccauggaaucaacaaggauuuggaguagag

SEQ ID NO: 362860 - RNA, 62 nt, Human
uauuuauuguauuuuuauguucugaaaauuacccauggaacaauaugcuuaggauuacagga

SEQ ID NO: 362861 - RNA, 62 nt, Human
uguuuaucuaaccugacaguugcaguuuucacccauggaaagcauuagucugacaguacaau

SEQ ID NO: 362862 - RNA, 62 nt, Human
gguucaaggugcugcuuugcaugccugccaacccauggaaguuguuucuuacuucuuuucuc

SEQ ID NO: 362863 - RNA, 62 nt, Human
cccgcagaccuguccccccgcaacagcuuauaccauggaaugaggacaaggugauacucuga

SEQ ID NO: 362864 - RNA, 62 nt, Human
gcugguggagcuggaguugcaccgcggcagcuccauggaaaucaaucugggggagaaggaca

SEQ ID NO: 362865 - RNA, 62 nt, Human
gucagugguguccccaaggauagugcuggcuuccauggaaacccucacuccuggagauucca

SEQ ID NO: 362866 - RNA, 62 nt, Human
cugcuugccagagccccuuccucucuuguuucccauggaaacggccucuucagaaggcagau

SEQ ID NO: 362867 - RNA, 62 nt, Human
uuagaagccagucaccagcccucugccugcagccauggaagggggugugcacgugccucugu

SEQ ID NO: 362868 - RNA, 62 nt, Human
gaggagggucacagaguggggcacgugaggacccauggaaccguccuggugcccaggcccuc

SEQ ID NO: 362869 - RNA, 62 nt, Human
ccgaggggcccuggcaucugacucaggccacaccauggaaucacugcauccaaggccauucc

SEQ ID NO: 362870 - RNA, 62 nt, Human
cagaucucagaaucaggccuauuuguguaggcccauggaaaucacuacuugugaaguagaga

SEQ ID NO: 362871 - RNA, 62 nt, Human
ucaccugugcugcucugucccuaacuagugacccauggaagcuuccaagcaguuuucucuuc

SEQ ID NO: 362872 - RNA, 62 nt, Human
acccuguaucuccuccauagauucuuaguauuccauggaacauauuuugaaaaccuugggau

SEQ ID NO: 362873 - RNA, 62 nt, Human
agaggaagugauuggaaguacuccacuuaaagccauggaauuagcaauaguuugcuuuuuaa

SEQ ID NO: 362874 - RNA, 62 nt, Human
aucaaggcuucggccaccugugcaauauuuucccauggaaugcagcaguaaauccaaguagg

SEQ ID NO: 362875 - RNA, 62 nt, Human
gaggggaaggguacagagaaaccaucuacauuccauggaauguuuuuaauaaguaggcaaga

SEQ ID NO: 362876 - RNA, 62 nt, Human
aggcgguggcuguguggcccccuugaguggagccauggaagggguggcauggugccacuggg

SEQ ID NO: 362877 - RNA, 62 nt, Human
cuagagaagagcucaacucucucccaaccucaccauggaaagaaaauaauuaugaaugccac

SEQ ID NO: 362878 - RNA, 62 nt, Human
acuggauugggcugagcagagaacaaggccaaccauggaaauggauaaaugguacugaaugg

SEQ ID NO: 362879 - RNA, 62 nt, Human
gucucuaacuauugaggguaaacacaagcuuuccauggaauccugggaaaauuaauaaugau

SEQ ID NO: 362880 - RNA, 62 nt, Human
ugagucagugauugaagccaauauucugauucccauggaagauggaugggcaagaguguacu

SEQ ID NO: 362881 - RNA, 62 nt, Human
aguuccaucuguaguccuaaccaggagcccccccauggaacugcagcccccugucuccccuc

SEQ ID NO: 362882 - RNA, 62 nt, Human
cuaguuuuaucuuccuuggcuuuaagagugugccauggaaagugauaagaaaugaacuucua

SEQ ID NO: 362883 - RNA, 62 nt, Human
uucaggaagcacacagucuacuacggugguuuccauggaagucacagagucaucaucuggcu

SEQ ID NO: 362884 - RNA, 62 nt, Human
gccacuagucuaacagacggucacaaccagugccauggaaaaccaaggauauuagcaaaagc

SEQ ID NO: 362885 - RNA, 62 nt, Human
uagacgaugcuuuaaagccuccgauccauguuccauggaagguacaucagcaauuaauucua

SEQ ID NO: 362886 - RNA, 62 nt, Human
guugcuguggacacuuuuaagaaacuuagaacccauggaacccuuguuuaucgccaugcaaa

SEQ ID NO: 362887 - RNA, 62 nt, Human
uuaaggaagcauuuucccauugaaaguguguuccauggaaagucacauuccagauuugaagc

SEQ ID NO: 362888 - RNA, 62 nt, Human
gaggguguuagcagugugagaucuuuggacacccauggaauccuuuccuccacaccacccgu

SEQ ID NO: 362889 - RNA, 62 nt, Human
cucaaaaugcaugcccauugucuucagguuugccauggaaagucaaaugauuuccacuucau

SEQ ID NO: 362890 - RNA, 62 nt, Human
agacuggauuaagaaaauguggcacauauacaccauggaauacuaugcagccauaaagaagg

SEQ ID NO: 362891 - RNA, 62 nt, Human
aucucaaaaaauaaauagauaaaaauaaaaacccauggaaaugguuuaagaaaaugguucug

SEQ ID NO: 362892 - RNA, 62 nt, Human
uuuucuuugcacuuuggaugcugaaauuuuucccauggaacauagccacaucuagauagaug

SEQ ID NO: 362893 - RNA, 62 nt, Human
gggcacaccacaguucugcucuguggaucaucccauggaaguuuccucacaaagucagcucc

SEQ ID NO: 362894 - RNA, 62 nt, Human
ucuuccccagguugaggagagaaguggaagccccauggaagacagugcucccagcugaggua

SEQ ID NO: 362895 - RNA, 62 nt, Human
aagguaauccggagugagcaauggaguggcugccauggaaggaagaaaagcugccauuuccc

SEQ ID NO: 362896 - RNA, 52 nt, Human; identical to SEQ ID NO: 91129

SEQ ID NO: 362897 - RNA, 62 nt, Human
acuagggcuguuguacaaaauaguaaugauagccauggaaguuuuaccuuauucugugagaa

SEQ ID NO: 362898 - RNA, 62 nt, Human
ucucuugauguuuucuugucaucuugaaggcuccauggaaugagauaaagcauugacccacc

SEQ ID NO: 362899 - RNA, 62 nt, Human
uccauccauccaaaggcagagaaccaaaggggccauggaagguucucugugcuccuccuacc

SEQ ID NO: 362900 - RNA, 62 nt, Human
cauaaacuauguagcaaaaguaucuguaaaauccauggaaaauaaaaguuguaucauucuuu

SEQ ID NO: 362901 - RNA, 62 nt, Human
gaugcccgcagaaggcgucugggccuaaggauccauggaagucaggagcauuaaaucccaaa

SEQ ID NO: 362902 - RNA, 62 nt, Human
uuugcuuucucuucaagauaaguuguauuuuaccauggaaaaauacaguaucuaacauuacc

SEQ ID NO: 362903 - RNA, 52 nt, Human; identical to SEQ ID NO: 91136

SEQ ID NO: 362904 - RNA, 62 nt, Human
uucuccuuggugaguuuucuaaaaguauuuccccauggaaaggagaaagugguuugggacag

SEQ ID NO: 362905 - RNA, 62 nt, Human
uacuuaaccauauguguaacugauacuuggcaccauggaauuuuucauugaguuauuuccuc

SEQ ID NO: 362906 - RNA, 62 nt, Human
gaagaaaccaaaccaccaucuuuuauaaauugccauggaaaccaagugccuucaaugaaaca

SEQ ID NO: 362907 - RNA, 62 nt, Human
gguuuuguuucaaaugaauaguuugcuuguuaccauggaaaccuaauggccugccaacaaaa

SEQ ID NO: 362908 - RNA, 62 nt, Human
cagugaaucccuuaagcagaacaaccgugaugccauggaacucaagcccaacggcggugcug

SEQ ID NO: 362909 - RNA, 62 nt, Human
cucuguagucucaguucguguuugauuccauuccauggaaauaaaaaguauguuguacauac

SEQ ID NO: 362910 - RNA, 62 nt, Human
agcagccuucuucuuugggaccccucgauaucccauggaaugcucgcacguucucaaagacu

SEQ ID NO: 362911 - RNA, 62 nt, Human
aaaucauaaugaugucaugugaucaaaggaaaccauggaaggguucacgcugauagcugaua

SEQ ID NO: 362912 - RNA, 62 nt, Human
ugccucacugacccccaggggccucauccuccccauggaaugggcuguauguccugccccaa

SEQ ID NO: 362913 - RNA, 62 nt, Human
uuccugaaagaauaucauccucugcauuauccccauggaacguuucacuuuaacccugacug

SEQ ID NO: 362914 - RNA, 62 nt, Human
aguguuuuuacuugugaggaaugagaagccauccauggaaauuugaacugagugggggcaga

SEQ ID NO: 362915 - RNA, 62 nt, Human
agcauggcaucuuguccuugcuuuuagaacacccauggaagaaaacacagaguagauauugc

SEQ ID NO: 362916 - RNA, 62 nt, Human
caugguuacagcccacagggaggcauggagugccauggaaggauucgccacuacccagaccu

SEQ ID NO: 362917 - RNA, 62 nt, Human
cuugaccuguuuucuuaaaaggccuacguccuccauggaagugccagcucauuacuaccacu

SEQ ID NO: 362918 - RNA, 62 nt, Human
gcugauccauuuauaaaugcaguuuuaauaaaccauggaauaccaaggcacaacauaucaaa

SEQ ID NO: 362919 - RNA, 58 nt, Human; identical to SEQ ID NO: 91152

SEQ ID NO: 362920 - RNA, 62 nt, Human
gugugagggaccaauccugugaccucccagaaccauggaagccaggacgucaggcugaccaa

SEQ ID NO: 362921 - RNA, 62 nt, Human
uucugaaacccuugauagaaacuggaagccugccauggaacacaauacuuugggcaauaauc

SEQ ID NO: 362922 - RNA, 62 nt, Human
ggcccuuccccagaggaauuguggagacugucccauggaacaaacccucaggcaccagcaca

SEQ ID NO: 362923 - RNA, 62 nt, Human
gaaucaugggggaaacggguuggaauuuguagccauggaauauauauuagauguaaagaauu

SEQ ID NO: 362924 - RNA, 62 nt, Human
ccauuugcccagggaacugccacuccugguugccauggaaauagcagccaacggacaccucc

SEQ ID NO: 362925 - RNA, 62 nt, Human
agucauuugcuguacuucccuguggcacguuaccauggaagccgcuccagggugggucaggg

SEQ ID NO: 362926 - RNA, 62 nt, Human
ccgacccugcuccccacagagccucaguaaacccauggaacacacgucggcgcuguccgucu

SEQ ID NO: 362927 - RNA, 62 nt, Human
uuuuauuccuagauggaacugcgacuuccgagccauggaaggguggauugauguuuaaagaa

SEQ ID NO: 362928 - RNA, 62 nt, Human
ucucaacacauggccccagucaagacagaacaccauggaaaaaacccuguaaguauuauggc

SEQ ID NO: 362929 - RNA, 62 nt, Human
acuggaggaggccugucccaauucugcccgcuccauggaaaagcgggcuugacugcauugcc

SEQ ID NO: 362930 - RNA, 62 nt, Human
gggaaagccaguugcccugaacccagcagacaccauggaauguccuuugcacgcauuaaaug

SEQ ID NO: 362931 - RNA, 62 nt, Human
aaaaaaaaaaaagaaaauguggcacauauacaccauggaauacuaugcagccauaaaaaaga

SEQ ID NO: 362932 - RNA, 62 nt, Human
cucuugacugucccuucucuuccuaccuccauccauggaaaauuaguuauuuucugauccuu

SEQ ID NO: 362933 - RNA, 62 nt, Human
aggcuguaggacucgcagucaggggcagcugaccauggaagauugagagcccaagguuuaaa

SEQ ID NO: 362934 - RNA, 62 nt, Human
aaaacucaaaccuacccagccuuccccccacuccauggaaguccuugggaugggcgucugcu

SEQ ID NO: 362935 - RNA, 62 nt, Human
caagaaaaaggucagcuccaccgaaggggcugccauggaagagcccaagaggagaucagcgc

SEQ ID NO: 362936 - RNA, 62 nt, Human
aaaaaaauaaaaauaaaaaaaaaaucuuaguuccauggaauuuuaagcauuguucccccucu

SEQ ID NO: 362937 - RNA, 62 nt, Human
cccacugcccaaugccugcuuccugggcauagccauggaacccugccaggcugcuaaaggac

SEQ ID NO: 362938 - RNA, 62 nt, Human
cucaaaauaccgacugcguccauucucugccuccauggaaacagccccuagaaucugaaagg

SEQ ID NO: 362939 - RNA, 62 nt, Human
gaaaaaaagauacuauggggucaaguguaacuccauggaaaugccacgucugcucuucagug

SEQ ID NO: 362940 - RNA, 62 nt, Human
aguggauaaagacaaugcgguguacauauacaccauggaauacuauucagccacaaaaagga

SEQ ID NO: 362941 - RNA, 62 nt, Human
agugagucugguggaggagcugagggagggagccauggaaggugccagaaggaagguuggcg

SEQ ID NO: 362942 - RNA, 62 nt, Human
cauagcugcaacgccuccugcccagccgguuuccauggaaacaacugcucaguuccuuguga

SEQ ID NO: 362943 - RNA, 62 nt, Human
uccaggaggauuuugacccacagaaaaggagcccauggaacacaaguuaaagagguuuugcu

SEQ ID NO: 362944 - RNA, 62 nt, Human
agcagccucacucuuaacuucguguucacacuccauggaaaccccagacugggacacaggcg

SEQ ID NO: 362945 - RNA, 62 nt, Human
agucauaagugaagagugaucauguccugaugccauggaaugacugaagacaggcacaaaau

SEQ ID NO: 362946 - RNA, 62 nt, Human
uuccagggaauuugaaugauuguauuuuguguccauggaacguuuauagacauggaggcagg

SEQ ID NO: 362947 - RNA, 62 nt, Human
cccagcuccacacggccugcacaccuguguuuccauggaaaugccaccgugucugcucccag

SEQ ID NO: 362948 - RNA, 62 nt, Human
gagugauacugcccuccagcucuuuccuccuuccauggaaccugacguagcugcaaaggaca

SEQ ID NO: 362949 - RNA, 62 nt, Human
cuagaguuggggagugagaugaguggugcuguccauggaaucaggccacagcaggaacugcc

SEQ ID NO: 362950 - RNA, 62 nt, Human
ccccccaucccugugccaccuggguguggagcccauggaacacucugguccgccucauuuua

SEQ ID NO: 362951 - RNA, 62 nt, Human
agcccacgcucugagucucagcgccgacgagaccauggaagagccaucuguccuucucagga

SEQ ID NO: 362952 - RNA, 62 nt, Human
gggcugggccuuccacgcaucccccccaccccccauggaacagaaagccauguuuuuaagca

SEQ ID NO: 362953 - RNA, 62 nt, Human
ccugcugcaaagcuuugauuuggcaaaggagaccauggaagaaucaugguggauccagaagu

SEQ ID NO: 362954 - RNA, 62 nt, Human
agaccggauaaagaaaacgugacacauauacaccauggaauacuaugcagccauagaaaagg

SEQ ID NO: 362955 - RNA, 62 nt, Human
agaaaacugauaauaauacaaaugauuguuguccauggaaaggcaaauaaauuuucuacagu

SEQ ID NO: 362956 - RNA, 62 nt, Human
ucucauugugugacucagugcugcuguccaucccauggaaacaugggcacaaucaaguauuu

SEQ ID NO: 362957 - RNA, 62 nt, Human
uuuuuacccugcccuggcuggcaugugagaagccauggaagguugugguuguaaaugaguug

SEQ ID NO: 362958 - RNA, 62 nt, Human
cuugccgaucaccaggcauaaccuaauuuuauccauggaagaaacacagaaaggcaucuaag

SEQ ID NO: 362959 - RNA, 62 nt, Human
cccauacucaauaaucaugccauccugccuuuccauggaauaacugauggaugguuagaaau

SEQ ID NO: 362960 - RNA, 62 nt, Human
uagaaaguaugauaaacaacaguuggaggaauccauggaaaauagacgagaaaauguaaaua

SEQ ID NO: 362961 - RNA, 62 nt, Human
agacauuuaaaucucuugggaauucgaugcucccauggaauuuauaccaguuauaugaauug

SEQ ID NO: 362962 - RNA, 62 nt, Human
uuuggaaaaauggguucaagcuuuccuauuagccauggaaaugcaaaguuuagcagaagcaa

SEQ ID NO: 362963 - RNA, 62 nt, Human
aauucuucuagcuccuccaaucccauuuuaucccauggaaccacuaaaaacaaggucugcuc

SEQ ID NO: 362964 - RNA, 62 nt, Human
aagcuggacuuucuccccauggcacuggggaaccauggaaguucagggaacuucagggaaga

SEQ ID NO: 362965 - RNA, 62 nt, Human
cacauauuagugcuugacccuggcaggggaccccauggaaaagauggggaagagcaaaauac

SEQ ID NO: 362966 - RNA, 62 nt, Human
agaccagauaaagaaaauuugguacauauacaccauggaauacuaugcagccauaaaaaaga

SEQ ID NO: 362967 - RNA, 62 nt, Human
gaagcccugaacuugagacaccaaguuugucuccauggaaacacguagccgcugcaguugga

SEQ ID NO: 362968 - RNA, 62 nt, Human
aacagauaacucagaagcaucugggaaauuugccauggaauuaaugaagaaaagcccucagc

SEQ ID NO: 362969 - RNA, 56 nt, Human; identical to SEQ ID NO: 91202

SEQ ID NO: 362970 - RNA, 62 nt, Human
guaugggaggugcuggugucaggguucacaagccauggaacuaccuugcuucacaucacaag

SEQ ID NO: 362971 - RNA, 62 nt, Human
gggugacccaacauccaguucuccggcucucaccauggaaacaaacugucccuguccccagg

SEQ ID NO: 362972 - RNA, 62 nt, Human
uuaugaacuguggugacuacagguaacugaaaccauggaaagcaaagcuguggauaaggggg

SEQ ID NO: 362973 - RNA, 62 nt, Human
aauucuacuaguuccuccaauuccaucuucucccauggaaccucaaagagcaagacccacuc

SEQ ID NO: 362974 - RNA, 62 nt, Human
aauucuacuaguuccuccaauuccauuuucucccauggaaucacgaagagcaagacccacuc

SEQ ID NO: 362975 - RNA, 62 nt, Human
aaaaaauguauauggguaaggaccugaaagauccauggaaaaguuaacccaguugagauuuu

SEQ ID NO: 362976 - RNA, 62 nt, Human
gaagauuuccccuuuagaucaaacugccccuuccauggaaaagcuggaaaaaaacucuggaa

SEQ ID NO: 362977 - RNA, 62 nt, Human
aaacuuggacaacacggagcagggagagcucaccauggaaugaaccccccgcccaugcuguc

SEQ ID NO: 362978 - RNA, 62 nt, Human
uuaugaaggaccccacuugcaccccaccccagccauggaagagcagcuggaggguggauggg

SEQ ID NO: 362979 - RNA, 62 nt, Human
auagcaaauucaaagcaagcaacuugcaggcuccauggaacuuuuaaugaaggacagugucu

SEQ ID NO: 362980 - RNA, 62 nt, Human
ccccgaagccagggccaugccagcaggccccaccauggaaaucaaaacaccgcaccagccag

SEQ ID NO: 362981 - RNA, 62 nt, Human
gcccagguuagcccacaggauuccuuugugugccauggaaugcugaaagaugggugacuggg

SEQ ID NO: 362982 - RNA, 62 nt, Human
ccagcaggaaggaccccacauccuucucacugccauggaauucccuccugagugccccacuu

SEQ ID NO: 362983 - RNA, 62 nt, Human
uuuacucaucaggucauuauuuuuuacaauggccauggaauaaaccauuuuuacaaaaauaa

SEQ ID NO: 362984 - RNA, 62 nt, Human
gugcacagcaaguuaacuagaggggcugugggccauggaacugucagcguuauucucagaag

SEQ ID NO: 362985 - RNA, 62 nt, Human
auaagacccccaggaagcuaggcacuuucuuuccauggaaacauuuagacacaaaccucccc

SEQ ID NO: 362986 - RNA, 62 nt, Human
ggcccaccgaaagcucaggggagcacagaagcccauggaagcccagggagaugucccugggg

SEQ ID NO: 362987 - RNA, 62 nt, Human
uccauucauuguuuacgcuggaauuuuucuccccauggaauguaaguaaaacuuaaguguuu

SEQ ID NO: 362988 - RNA, 62 nt, Human
ggagacccugggagagugaggucaucccggggccauggaagcuggcaggagacacuggucuc

SEQ ID NO: 362989 - RNA, 62 nt, Human
uguaaaaacaucuccaggcuuugauuuuuguaccauggaaauuguauuuaaccauacagggu

SEQ ID NO: 362990 - RNA, 62 nt, Human
ugaacccauuccacuguaugaggcaaaaguuuccauggaagcuguucagaaaaaucaaggaa

SEQ ID NO: 362991 - RNA, 62 nt, Human
uauaaauugagcuugcuucuuucuugcuuugaccauggaaagaaauaugauucccuuuucuu

SEQ ID NO: 362992 - RNA, 62 nt, Human
gacggugggcagagaggccugucuuaaaguuuccauggaauuguuuuauaaaauaucuuaag

SEQ ID NO: 362993 - RNA, 62 nt, Human
agagcuacuuccaagugugguuacaaaugaacccauggaaugaugacuucauguucuucucg

SEQ ID NO: 362994 - RNA, 62 nt, Human
gggcgcccucugccaccuugcuccccgggaacccauggaaggagaagcgaggugaugcagca

SEQ ID NO: 362995 - RNA, 62 nt, Human
gaugcaagagcugcaggccggggggcucagugccauggaagcuacuccaaguugcauugccu

SEQ ID NO: 362996 - RNA, 62 nt, Human
uugagugcgccuugcaggcacucccagagcagccauggaaggagcuggcccucacaccaucc

SEQ ID NO: 362997 - RNA, 54 nt, Human; identical to SEQ ID NO: 91230

SEQ ID NO: 362998 - RNA, 62 nt, Human
aacuaaguuguccuuuucugguuucguguucaccauggaacauuuugauuauaguuaauccu

SEQ ID NO: 362999 - RNA, 62 nt, Human
gucucugauuugccagagaaaaacggugguagccauggaaaucgggagugaaggagcacugc

SEQ ID NO: 363000 - RNA, 62 nt, Human
gaacagcagaguuauggaguaucagaaucuuuccauggaaaccuccauauggccuuucuaua

SEQ ID NO: 363001 - RNA, 62 nt, Human
ugaagaaguagauuccuaaauuuuauuggggaccauggaaugguaguugagaagaaaacuau

SEQ ID NO: 363002 - RNA, 64 nt, Human
uucauuuguugcaagccuacucagacuccaaacacggaacgaauucagacuuccagcacgagcu

SEQ ID NO: 363003 - RNA, 64 nt, Human
cuguuggacagugguguguauugaggggaugaaucggaacgauagucucaugcagaaaauagug

SEQ ID NO: 363004 - RNA, 64 nt, Human
cgaccccgacguggaacgcugccucagggcccaccggaacgacauggagaccaucuaccccuuc

SEQ ID NO: 363005 - RNA, 64 nt, Human
agaggagcagguggaggcgcucaggcauaccgugcggaacgaccguaccaccaucaggcgcgcg

SEQ ID NO: 363006 - RNA, 64 nt, Human
uuuuaucgauaacauagugagcucucugccucuucggaacgauguccacuuugcuuaugaucaa

SEQ ID NO: 363007 - RNA, 64 nt, Human
ccacacgcuguaccccauggucacgcgguggaggcggaacgaggauggagccaucugcaggaag

SEQ ID NO: 363008 - RNA, 64 nt, Human
ccucuuuggaguccugcugucugggugccagggccggaacgagguaguggccaucucauaccua

SEQ ID NO: 363009 - RNA, 64 nt, Human
cagaaguguguaccaaucaaggcucuuuaaaauacggaacgacucacuuaauaaccagggaacc

SEQ ID NO: 363010 - RNA, 64 nt, Human; identical to SEQ ID NO: 6086

SEQ ID NO: 363011 - RNA, 64 nt, Human; identical to SEQ ID NO: 6087

SEQ ID NO: 363012 - RNA, 64 nt, Human; identical to SEQ ID NO: 6088

SEQ ID NO: 363013 - RNA, 57 nt, Human; identical to SEQ ID NO: 6089

SEQ ID NO: 363014 - RNA, 64 nt, Human; identical to SEQ ID NO: 6090

SEQ ID NO: 363015 - RNA, 64 nt, Human
aggugccaggggagucaggguuguagccaagacgcccccgcacggggaggguugggaagggggu

SEQ ID NO: 363016 - RNA, 64 nt, Human
gccuccagcugagccugucucugaauuguucccucccccgcaaugugggcacuuaccauguucc

SEQ ID NO: 363017 - RNA, 64 nt, Human
gccaggcccugggacucugagcguccgugucucucccccgcaacccauccucagccggggccgu

SEQ ID NO: 363018 - RNA, 64 nt, Human; identical to SEQ ID NO: 6091

SEQ ID NO: 363019 - RNA, 63 nt, Human; identical to SEQ ID NO: 6092

SEQ ID NO: 363020 - RNA, 64 nt, Human; identical to SEQ ID NO: 6093

SEQ ID NO: 363021 - RNA, 64 nt, Human; identical to SEQ ID NO: 6094

SEQ ID NO: 363022 - RNA, 64 nt, Human; identical to SEQ ID NO: 6095

SEQ ID NO: 363023 - RNA, 64 nt, Human; identical to SEQ ID NO: 6096

SEQ ID NO: 363024 - RNA, 64 nt, Human; identical to SEQ ID NO: 6097

SEQ ID NO: 363025 - RNA, 64 nt, Human; identical to SEQ ID NO: 6098

SEQ ID NO: 363026 - RNA, 64 nt, Human; identical to SEQ ID NO: 6099

SEQ ID NO: 363027 - RNA, 64 nt, Human; identical to SEQ ID NO: 6100

SEQ ID NO: 363028 - RNA, 64 nt, Human; identical to SEQ ID NO: 6101

SEQ ID NO: 363029 - RNA, 64 nt, Human; identical to SEQ ID NO: 6102

SEQ ID NO: 363030 - RNA, 64 nt, Human; identical to SEQ ID NO: 6103

SEQ ID NO: 363031 - RNA, 64 nt, Human; identical to SEQ ID NO: 6104

SEQ ID NO: 363032 - RNA, 64 nt, Human; identical to SEQ ID NO: 6105

SEQ ID NO: 363033 - RNA, 64 nt, Human; identical to SEQ ID NO: 6106

SEQ ID NO: 363034 - RNA, 64 nt, Human
agaggggcaguauugggggacugugcuagcuuuacccccgcaggacauacacaggagccuuuga

SEQ ID NO: 363035 - RNA, 64 nt, Human
gagaaagcgguccucugaaaugguuuccucccaacccccgcauuuaaagggacucaaggugccu

SEQ ID NO: 363036 - RNA, 64 nt, Human
aggaguuggacacuccgagagugcagcuguucuccccccgcaccauccguguccugcauucugc

SEQ ID NO: 363037 - RNA, 64 nt, Human; identical to SEQ ID NO: 6107

SEQ ID NO: 363038 - RNA, 64 nt, Human; identical to SEQ ID NO: 6108

SEQ ID NO: 363039 - RNA, 64 nt, Human; identical to SEQ ID NO: 6109

SEQ ID NO: 363040 - RNA, 64 nt, Human; identical to SEQ ID NO: 6110

SEQ ID NO: 363041 - RNA, 64 nt, Human; identical to SEQ ID NO: 6111

SEQ ID NO: 363042 - RNA, 64 nt, Human; identical to SEQ ID NO: 6112

SEQ ID NO: 363043 - RNA, 64 nt, Human; identical to SEQ ID NO: 6113

SEQ ID NO: 363044 - RNA, 64 nt, Human; identical to SEQ ID NO: 6114

SEQ ID NO: 363045 - RNA, 64 nt, Human; identical to SEQ ID NO: 6115

SEQ ID NO: 363046 - RNA, 64 nt, Human; identical to SEQ ID NO: 6116

SEQ ID NO: 363047 - RNA, 64 nt, Human; identical to SEQ ID NO: 6117

SEQ ID NO: 363048 - RNA, 64 nt, Human; identical to SEQ ID NO: 6118

SEQ ID NO: 363049 - RNA, 64 nt, Human; identical to SEQ ID NO: 6119

SEQ ID NO: 363050 - RNA, 64 nt, Human; identical to SEQ ID NO: 6120

SEQ ID NO: 363051 - RNA, 64 nt, Human; identical to SEQ ID NO: 6121

SEQ ID NO: 363052 - RNA, 64 nt, Human; identical to SEQ ID NO: 6122

SEQ ID NO: 363053 - RNA, 64 nt, Human
gccgagucuggagaagggaggcgccuggcuguaucccccgcaggcccucuuccgagagccuucc

SEQ ID NO: 363054 - RNA, 64 nt, Human
ccuggaggcgucuacacuggcuccacauccacuucccccgcagcucgugugggcgcucguccac

SEQ ID NO: 363055 - RNA, 64 nt, Human
aauggcaugccccccagcuacuguaugcccccgacccccgcagaggcagaaugaacccauaggg

SEQ ID NO: 363056 - RNA, 64 nt, Human; identical to SEQ ID NO: 6123

SEQ ID NO: 363057 - RNA, 64 nt, Human; identical to SEQ ID NO: 6124

SEQ ID NO: 363058 - RNA, 64 nt, Human; identical to SEQ ID NO: 6125

SEQ ID NO: 363059 - RNA, 64 nt, Human; identical to SEQ ID NO: 6126

SEQ ID NO: 363060 - RNA, 64 nt, Human; identical to SEQ ID NO: 6127

SEQ ID NO: 363061 - RNA, 64 nt, Human; identical to SEQ ID NO: 6128

SEQ ID NO: 363062 - RNA, 64 nt, Human; identical to SEQ ID NO: 6129

SEQ ID NO: 363063 - RNA, 64 nt, Human; identical to SEQ ID NO: 6130

SEQ ID NO: 363064 - RNA, 64 nt, Human; identical to SEQ ID NO: 6131

SEQ ID NO: 363065 - RNA, 64 nt, Human; identical to SEQ ID NO: 6132

SEQ ID NO: 363066 - RNA, 64 nt, Human; identical to SEQ ID NO: 6133

SEQ ID NO: 363067 - RNA, 64 nt, Human; identical to SEQ ID NO: 6134

SEQ ID NO: 363068 - RNA, 64 nt, Human; identical to SEQ ID NO: 6135

SEQ ID NO: 363069 - RNA, 64 nt, Human; identical to SEQ ID NO: 6136

SEQ ID NO: 363070 - RNA, 64 nt, Human; identical to SEQ ID NO: 6137

SEQ ID NO: 363071 - RNA, 64 nt, Human; identical to SEQ ID NO: 6138

SEQ ID NO: 363072 - RNA, 50 nt, Human; identical to SEQ ID NO: 301172

SEQ ID NO: 363073 - RNA, 64 nt, Human
uggccgcccuggcuuggcagcccugcccacgcugcccccgcaaacaauggugugugcguuuuua

SEQ ID NO: 363074 - RNA, 64 nt, Human
auggggagaaaaacucucaucccugacccuuccccccccgcaaauguuagaccagagcuguuga

SEQ ID NO: 363075 - RNA, 64 nt, Human; identical to SEQ ID NO: 6139

SEQ ID NO: 363076 - RNA, 64 nt, Human; identical to SEQ ID NO: 6140

SEQ ID NO: 363077 - RNA, 64 nt, Human; identical to SEQ ID NO: 6141

SEQ ID NO: 363078 - RNA, 64 nt, Human; identical to SEQ ID NO: 6142

SEQ ID NO: 363079 - RNA, 64 nt, Human; identical to SEQ ID NO: 6143

SEQ ID NO: 363080 - RNA, 64 nt, Human; identical to SEQ ID NO: 6144

SEQ ID NO: 363081 - RNA, 64 nt, Human; identical to SEQ ID NO: 6145

SEQ ID NO: 363082 - RNA, 64 nt, Human; identical to SEQ ID NO: 6146

SEQ ID NO: 363083 - RNA, 64 nt, Human; identical to SEQ ID NO: 6147

SEQ ID NO: 363084 - RNA, 64 nt, Human; identical to SEQ ID NO: 6148

SEQ ID NO: 363085 - RNA, 64 nt, Human; identical to SEQ ID NO: 6149

SEQ ID NO: 363086 - RNA, 64 nt, Human; identical to SEQ ID NO: 6150

SEQ ID NO: 363087 - RNA, 64 nt, Human; identical to SEQ ID NO: 6151

SEQ ID NO: 363088 - RNA, 64 nt, Human; identical to SEQ ID NO: 6152

SEQ ID NO: 363089 - RNA, 64 nt, Human; identical to SEQ ID NO: 6153

SEQ ID NO: 363090 - RNA, 64 nt, Human; identical to SEQ ID NO: 6154

SEQ ID NO: 363091 - RNA, 64 nt, Human
cuaaugauggcccauucuacuugcucuggaccugcccccgcauccccugccuccauccuaguaa

SEQ ID NO: 363092 - RNA, 50 nt, Human; identical to SEQ ID NO: 301202

SEQ ID NO: 363093 - RNA, 64 nt, Human; identical to SEQ ID NO: 362091

SEQ ID NO: 363094 - RNA, 64 nt, Human; identical to SEQ ID NO: 6155

SEQ ID NO: 363095 - RNA, 64 nt, Human; identical to SEQ ID NO: 6156

SEQ ID NO: 363096 - RNA, 64 nt, Human; identical to SEQ ID NO: 6157

SEQ ID NO: 363097 - RNA, 64 nt, Human; identical to SEQ ID NO: 6158

SEQ ID NO: 363098 - RNA, 64 nt, Human; identical to SEQ ID NO: 6159

SEQ ID NO: 363099 - RNA, 64 nt, Human; identical to SEQ ID NO: 6160

SEQ ID NO: 363100 - RNA, 64 nt, Human; identical to SEQ ID NO: 6161

SEQ ID NO: 363101 - RNA, 64 nt, Human; identical to SEQ ID NO: 6162

SEQ ID NO: 363102 - RNA, 64 nt, Human; identical to SEQ ID NO: 6163

SEQ ID NO: 363103 - RNA, 64 nt, Human; identical to SEQ ID NO: 6164

SEQ ID NO: 363104 - RNA, 64 nt, Human; identical to SEQ ID NO: 6165

SEQ ID NO: 363105 - RNA, 64 nt, Human; identical to SEQ ID NO: 6166

SEQ ID NO: 363106 - RNA, 64 nt, Human; identical to SEQ ID NO: 6167

SEQ ID NO: 363107 - RNA, 64 nt, Human; identical to SEQ ID NO: 6168

SEQ ID NO: 363108 - RNA, 64 nt, Human; identical to SEQ ID NO: 6169

SEQ ID NO: 363109 - RNA, 64 nt, Human; identical to SEQ ID NO: 6170

SEQ ID NO: 363110 - RNA, 64 nt, Human
gugaccuuggggggagaacagaagggggacgacgcccccgcaccuccugcgaucuggcuggcuu

SEQ ID NO: 363111 - RNA, 64 nt, Human
cuugguuagcgggagugugcugcccccacccccacccccgcacccccauucuacacaaggcaga

SEQ ID NO: 363112 - RNA, 52 nt, Human; identical to SEQ ID NO: 302726

SEQ ID NO: 363113 - RNA, 64 nt, Human; identical to SEQ ID NO: 6171

SEQ ID NO: 363114 - RNA, 64 nt, Human; identical to SEQ ID NO: 6172

SEQ ID NO: 363115 - RNA, 64 nt, Human; identical to SEQ ID NO: 6173

SEQ ID NO: 363116 - RNA, 64 nt, Human; identical to SEQ ID NO: 6174

SEQ ID NO: 363117 - RNA, 64 nt, Human; identical to SEQ ID NO: 6175

SEQ ID NO: 363118 - RNA, 64 nt, Human; identical to SEQ ID NO: 6176

SEQ ID NO: 363119 - RNA, 64 nt, Human; identical to SEQ ID NO: 6177

SEQ ID NO: 363120 - RNA, 64 nt, Human; identical to SEQ ID NO: 6178

SEQ ID NO: 363121 - RNA, 64 nt, Human; identical to SEQ ID NO: 6179

SEQ ID NO: 363122 - RNA, 64 nt, Human; identical to SEQ ID NO: 6180

SEQ ID NO: 363123 - RNA, 64 nt, Human; identical to SEQ ID NO: 6181

SEQ ID NO: 363124 - RNA, 64 nt, Human; identical to SEQ ID NO: 6182

SEQ ID NO: 363125 - RNA, 64 nt, Human; identical to SEQ ID NO: 6183

SEQ ID NO: 363126 - RNA, 64 nt, Human; identical to SEQ ID NO: 6184

SEQ ID NO: 363127 - RNA, 64 nt, Human; identical to SEQ ID NO: 6185

SEQ ID NO: 363128 - RNA, 64 nt, Human
ggguacgggggcgcggcagggguccccggccccucccccgcagaggucaaugccaacgaacaaa

SEQ ID NO: 363129 - RNA, 64 nt, Human
ggccugggucaagccagcauccccuugguaaagacccccgcaggccaccaggcauucuggacac

SEQ ID NO: 363130 - RNA, 64 nt, Human
aacugaguugggugacuugguaccugcucaggaccccccgcacugucccaaucccacucaggcc

SEQ ID NO: 363131 - RNA, 64 nt, Human
gcuccccagcggcccagggugggccagaccagcagcccaggaagcagcacacgcggccgugggg

SEQ ID NO: 363132 - RNA, 64 nt, Human
cagcaccugcuggggacgguggcccugccuucaugcccaggacaccagcuggguccagcuagca

SEQ ID NO: 363133 - RNA, 64 nt, Human
ccuaccccugagugggacaagaagggcccugagugcccaggagugccccacguucugagaaggg

SEQ ID NO: 363134 - RNA, 64 nt, Human
cuacuugagaggcugagccaggaggaucgcuugagcccaggaggcggagguugcagugagcuga

SEQ ID NO: 363135 - RNA, 64 nt, Human
caacgucuagcggccccgcgggacuggggacugagcccaggagguuugcacaagccgggcgauu

SEQ ID NO: 363136 - RNA, 64 nt, Human
guuggggaacagauggcugaggcugcagacucaggcccaggacacucaaccccaggaggggagc

SEQ ID NO: 363137 - RNA, 64 nt, Human
gaggggagccgcucggcgaaugagcugggugggugcccaggagccggcccgcagcaccugcaca

SEQ ID NO: 363138 - RNA, 64 nt, Human
uccuguagcccccucggugggcccagggccuagggcccaggaucaagucacucaucucagaaug

SEQ ID NO: 363139 - RNA, 64 nt, Human
cuguacucaggaggcugaggggaggaucacuggagcccaggaguuugaggcugcagcgagcuau

SEQ ID NO: 363140 - RNA, 64 nt, Human; identical to SEQ ID NO: 362129

SEQ ID NO: 363141 - RNA, 64 nt, Human; identical to SEQ ID NO: 362130

SEQ ID NO: 363142 - RNA, 64 nt, Human; identical to SEQ ID NO: 362131

SEQ ID NO: 363143 - RNA, 64 nt, Human
uauuuugggaggccgagguggaaagaucgcuugagcccaggaguucaagaccagccugggcuac

SEQ ID NO: 363144 - RNA, 64 nt, Human; identical to SEQ ID NO: 275025

SEQ ID NO: 363145 - RNA, 64 nt, Human; identical to SEQ ID NO: 275029

SEQ ID NO: 363146 - RNA, 64 nt, Human; identical to SEQ ID NO: 275034

SEQ ID NO: 363147 - RNA, 64 nt, Human; identical to SEQ ID NO: 275043

SEQ ID NO: 363148 - RNA, 64 nt, Human; identical to SEQ ID NO: 275050

SEQ ID NO: 363149 - RNA, 64 nt, Human; identical to SEQ ID NO: 275059

SEQ ID NO: 363150 - RNA, 64 nt, Human; identical to SEQ ID NO: 275066

SEQ ID NO: 363151 - RNA, 64 nt, Human; identical to SEQ ID NO: 275071

SEQ ID NO: 363152 - RNA, 64 nt, Human; identical to SEQ ID NO: 275080

SEQ ID NO: 363153 - RNA, 64 nt, Human; identical to SEQ ID NO: 275087

SEQ ID NO: 363154 - RNA, 64 nt, Human; identical to SEQ ID NO: 275092

SEQ ID NO: 363155 - RNA, 64 nt, Human; identical to SEQ ID NO: 275103

SEQ ID NO: 363156 - RNA, 64 nt, Human; identical to SEQ ID NO: 275108

SEQ ID NO: 363157 - RNA, 64 nt, Human; identical to SEQ ID NO: 275113

SEQ ID NO: 363158 - RNA, 64 nt, Human
ucccucccacaggaugcggaaggauugcaaugcccgccagcacaguggcggcaacauugaagac

SEQ ID NO: 363159 - RNA, 64 nt, Human
gcagguuuaaguacuaaacugcagccuuuucugucgccagcaauuaaagaccaccaaucuuguu

SEQ ID NO: 363160 - RNA, 64 nt, Human
cccagcuucaccucugggaccccagcugcucuaagcccaggaucucuuuccccaaggacccagc

SEQ ID NO: 363161 - RNA, 64 nt, Human
ggccucagucccuaaaaaugauguggaaaggaaagcccaggaucugacaaugagcccuggugga

SEQ ID NO: 363162 - RNA, 64 nt, Human
gagguacaggauaucaccugaauuauuaaugaaugcccaggaaguaauuuucuucucauucuuc

SEQ ID NO: 363163 - RNA, 64 nt, Human
aguucaacuuccucuguaaauauccaaguauaaagcccaggaacuucuagaauaacccagaugc

SEQ ID NO: 363164 - RNA, 64 nt, Human
uaaucccagcuacuaaggcuggaggaucacuucagcccaggaguuuaaggcugcagugagcuau

SEQ ID NO: 363165 - RNA, 64 nt, Human
acuacuuggaggcugaagcaggaagaucacgugagcccaggaguuugaggcugcagcgagcuau

SEQ ID NO: 363166 - RNA, 64 nt, Human
gugcuagggugccugcucuccuugcccugggccagcccaggauuguacgugggagaggcagaaa

SEQ ID NO: 363167 - RNA, 64 nt, Human
uccagagaugagacucuuagaaucaaaguguucagcccaggaagucuuggagaucccaccuucu

SEQ ID NO: 363168 - RNA, 64 nt, Human
cacuucacgcccuuggccaugggucccauucuuggcccaggauuauugucaaagaagucauucu

SEQ ID NO: 363169 - RNA, 64 nt, Human
agccugcugccagcggggcagccccucauaggaggcccaggagggagccccaaggcguagaagc

SEQ ID NO: 363170 - RNA, 64 nt, Human
cgccccagcaaggagggucaugggcccugagcuggcccaggagacccuggcccugcccugugcc

SEQ ID NO: 363171 - RNA, 64 nt, Human
caggaggagcacaggcucuuggguggcgaagccagcccaggauccauuaccuggaagguuucug

SEQ ID NO: 363172 - RNA, 64 nt, Human
gaacccacauaaaagccccagcuuggcucacaaggcccaggagaccuccagcuaaacaccaacc

SEQ ID NO: 363173 - RNA, 64 nt, Human
ccaccgcugggucugcggccuaagggaccucccucgccagcagagguccauuccguucccagcu

SEQ ID NO: 363174 - RNA, 64 nt, Human
ugcuguggccuccagcuuggcugguuuugcaggccgccagcaggaaggcgaaggugguaguaca

SEQ ID NO: 363175 - RNA, 64 nt, Human
gggagacccugagccugcugagaaauccuuuuagcgccagcaagccccacccagggcccugucc

SEQ ID NO: 363176 - RNA, 64 nt, Human
ugagggcugaagucucccuuuguuacggacccuggcccaggaguugaaugccugaggacgugug

SEQ ID NO: 363177 - RNA, 64 nt, Human
uggugggaggaaagggaaggaggaggcuaaggcugcccaggaggccuuggauaccaggcuugga

SEQ ID NO: 363178 - RNA, 64 nt, Human
uuuucccugcagugaggcuuguccagaugauugagcccaggagaggaagaacaaacaaacuacg

SEQ ID NO: 363179 - RNA, 64 nt, Human
gcuccauccacuacaagaaggaaggauguccccagcccaggaggucuuucugcuccaucguccc

SEQ ID NO: 363180 - RNA, 64 nt, Human
accuggggcgacuggaggaagccaggcgaguggggcccaggacugguuccagugagagaaacca

SEQ ID NO: 363181 - RNA, 64 nt, Human
cuauucaaggggcugaggugggaggaucgccugagcccaggaguuugagaccagucuaagcaac

SEQ ID NO: 363182 - RNA, 64 nt, Human
cugcuggggguagacugggugccaggggccaugggcccaggacccagucuuggccauucaguug

SEQ ID NO: 363183 - RNA, 64 nt, Human
accuccugggaccacugccaccugcaagagcccugcccaggagauagaagaccuggacuccagc

SEQ ID NO: 363184 - RNA, 64 nt, Human
cuacucgggagacugaaguggaaggcuugcuugagcccaggaggucaaggcugcagugagccgu

SEQ ID NO: 363185 - RNA, 64 nt, Human
agguggagacuggaggugguggggcuugaaaugagcccaggaaaccagagcagugagggcgggc

SEQ ID NO: 363186 - RNA, 64 nt, Human
cugguuccaauuuccuguucuaagcaggacuagggcccaggaggcuaaggcugggagagaaagg

SEQ ID NO: 363187 - RNA, 64 nt, Human
cauucugggaggcccaggcgggagaacugcuugagcccaggaguucagaaucagccugggcaac

SEQ ID NO: 363188 - RNA, 64 nt, Human
agggcuccuggacccaggcuuucccauaccacgggcccaggacuguggcuccuuuucuaaacca

SEQ ID NO: 363189 - RNA, 64 nt, Human
cagcugggccccaccacggccacgccaggcaaagcgccagcagcccugcacuccacgcuggcca

SEQ ID NO: 363190 - RNA, 64 nt, Human
ggaacagaguccccagaacucauguggccauuuccgccagcaucacuccccggugccuaugggg

SEQ ID NO: 363191 - RNA, 64 nt, Human
auuugaacagggccuugaagggugugcaggaguucgccagcaaagccaggcaggccaagacuug

SEQ ID NO: 363192 - RNA, 64 nt, Human
accaccaucuugcugauggaaggaacaacagguggcccaggacaugcuccugcauacuccuggg

SEQ ID NO: 363193 - RNA, 64 nt, Human
ccuuugcugagcaagcaugugguugcauuggguggcccaggaugacaaugcacagcacagaugc

SEQ ID NO: 363194 - RNA, 64 nt, Human
acaugcaaccagggucccucuuccaugcccugcugcccaggaguugcugagcuccucuuccccu

SEQ ID NO: 363195 - RNA, 64 nt, Human
caucccacucuccugugauccaggugguccaggagcccaggacaggccuuuucugugggcccug

SEQ ID NO: 363196 - RNA, 64 nt, Human
cugcuugggaggcugagguugcaggaucacuugagcccaggaggucaaggcugcagugagccaa

SEQ ID NO: 363197 - RNA, 64 nt, Human
cacuuuggaaggcugaggcagaaggaucacuugagcccaggaauuugagguuguaguaagcuac

SEQ ID NO: 363198 - RNA, 64 nt, Human
cuacuagggaggcugagacacacgaaucccuugagcccaggaagcagagguugcagugagccuc

SEQ ID NO: 363199 - RNA, 64 nt, Human
ccuugcugcgugcccaccaggauuuccugugagggcccaggaaugagcaaggcauggucugcca

SEQ ID NO: 363200 - RNA, 64 nt, Human
cuacucaggaagcugagacaagaggaucaauugagcccaggaguucaaagcuguagugagcugu

SEQ ID NO: 363201 - RNA, 64 nt, Human
cuacccaggaggcugaggugggaggaucacuugagcccaggaauuugaagcugcagugagcugu

SEQ ID NO: 363202 - RNA, 64 nt, Human
cacaaggcccaggcgcccagggucccaccgaccugcccaggaaugcaucacauuguucucuggu

SEQ ID NO: 363203 - RNA, 64 nt, Human
ccaugcugaaggcucccauuuucaguucccuccugcccaggacugcauuguuuucuagccccga

SEQ ID NO: 363204 - RNA, 64 nt, Human
cuaugcagaugucuaagacaggaggaucacaagagcccaggagguugagaaugcagugagcuug

SEQ ID NO: 363205 - RNA, 64 nt, Human
gcuuccaaaacgaugccagcccgaggcacugcuacgccagcagcugccacaugggaugguggcu

SEQ ID NO: 363206 - RNA, 64 nt, Human
auuccauuuaaagucugcgggacgcgcccaguggcgccagcaagcugcccaugcaaagccgcag

SEQ ID NO: 363207 - RNA, 64 nt, Human
uuccugugagugcaccaucuguccugacugcuuccgccagcacuucaccaucgccuugaaggag

SEQ ID NO: 363208 - RNA, 64 nt, Human
acuuugggaggcugaaguaggaggaucgucuugagcccaggaguucaagaccagccuggacaac

SEQ ID NO: 363209 - RNA, 64 nt, Human
cuuuccacaggccauccucuuauuccguucuggggcccaggaaguggggaagaguagguucucg

SEQ ID NO: 363210 - RNA, 61 nt, Human
ucaccaacggcaucaugugacacgcuccucagcccaggaguggugggggguccagggcacc

SEQ ID NO: 363211 - RNA, 64 nt, Human
acaagcgauuuuggaggaaacaagaaucccaagggcccaggaaaaccccaucuugaugcaugag

SEQ ID NO: 363212 - RNA, 64 nt, Human
cagaacucuugacuuccugccauggaucucuugggcccaggacuguugaugccuuugaguuuug

SEQ ID NO: 363213 - RNA, 64 nt, Human
gcugagcagagccauuuuguggcuauuucuggaggcccaggaguguggcugcaagagaaaaggg

SEQ ID NO: 363214 - RNA, 64 nt, Human
agggaggccuagcugcucagaggcugcagggagggcccaggagccggcugggaggguggggucc

SEQ ID NO: 363215 - RNA, 64 nt, Human
ugagcagaaugaaguggggaggacccagcuuccagcccaggaagcccacuguaccuggagccau

SEQ ID NO: 363216 - RNA, 64 nt, Human
gaucacaaugaaggccaagcuugcucgccuagaggcccaggagcaggccuuccuggcucgucuc

SEQ ID NO: 363217 - RNA, 64 nt, Human
aggcuguggggagcagggcugugacucuggcugagcccaggaaagcgacaagggugaacuggga

SEQ ID NO: 363218 - RNA, 64 nt, Human
gauucaggggcuuugggcccaagaacugcagauagcccaggagcaacagccuaaucccgugccc

SEQ ID NO: 363219 - RNA, 64 nt, Human
uuaaggggcugggaugcuuuugaacuagcuuaaggcccaggacuguggaguguguggaccaccc

SEQ ID NO: 363220 - RNA, 64 nt, Human
ggggaagugaacuacccagggcagccccuuuguggcccaggauaaucaacacuguucucucugu

SEQ ID NO: 363221 - RNA, 64 nt, Human
cccgguccagacagggcugccucgacuucaccuuucccccuaacuuccuccaagggaugcugcc

SEQ ID NO: 363222 - RNA, 64 nt, Human
caguggcugggugggcccagaacugcccccacugucccccuacccaccgauggagcccccagau

SEQ ID NO: 363223 - RNA, 64 nt, Human
ccuugcccuuccugacccggauuggcccugccccucccccuaccgcauggcagcugggcccaca

SEQ ID NO: 363224 - RNA, 64 nt, Human
gugacuguguuucccagagugugagccgcucuccucccccuaaaaagcugacucacugugagug

SEQ ID NO: 363225 - RNA, 64 nt, Human
agacgugagaugaacacuggagugggcagagguggcccaggaccauggcacccuuagagugcag

SEQ ID NO: 363226 - RNA, 64 nt, Human
cucucugaguucugugcugucucuuggaggcagggcccaggagaacaaaguguggaggccucgg

SEQ ID NO: 363227 - RNA, 64 nt, Human
cacuuugggaggcugaggugagagggucacuugagcccaggaguucuagacaagccugggaaac

SEQ ID NO: 363228 - RNA, 64 nt, Human
agcuucguuccaggugggugaccaagcugcggaagcccaggacaguucgcugggaccagugcua

SEQ ID NO: 363229 - RNA, 64 nt, Human
ugggcucagggccagguccucacagcagucacaggcccaggaaggcggcaggcagagaagugga

SEQ ID NO: 363230 - RNA, 64 nt, Human
gcuaaagccccuccagucccagcuuugaggcugggcccaggaucacucuacagccugccuccug

SEQ ID NO: 363231 - RNA, 64 nt, Human
ccagccagaucugaaggacauuugggagagggaugcccaggaacgccucaucucagcagccugg

SEQ ID NO: 363232 - RNA, 64 nt, Human
agaacuuaacagccuugcuccugaagaacuggcugcccaggaagccaagcuagcuuuuuagggg

SEQ ID NO: 363233 - RNA, 64 nt, Human
uccccuacuccaccuccuuccaaguccagcucaggcccaggaggugggagaaggucacagagcc

SEQ ID NO: 363234 - RNA, 64 nt, Human
gagggggugcuggccaagagccaacacauucuuggcccaggagcauugcuuuucugugaauuca

SEQ ID NO: 363235 - RNA, 64 nt, Human
uuuccuacugaguguaccacugccuucccuucuagcccaggagaauguuuacucaguuuagugu

SEQ ID NO: 363236 - RNA, 64 nt, Human
ugaagcuccgccuccgccgcuuagucccaacccugcccaggaagaagggcccguggggcuuugc

SEQ ID NO: 363237 - RNA, 64 nt, Human
cacuuuuggaggcugagguuggaggauugcuugagcccaggaauuugagaccagccuaggugac

SEQ ID NO: 363238 - RNA, 64 nt, Human
gugaucaugauaaugugaucuuguuuugguggugucccccuacuccgucucuaugccaugacag

SEQ ID NO: 363239 - RNA, 64 nt, Human
uaacucgugcaagagccaguuacccacccacaggucccccuacuuccugccaagcauuccauug

SEQ ID NO: 363240 - RNA, 64 nt, Human
ggcacuucuuguuuuauguacaggaugucauaugucccccuaccccuguaccugccaaggauug

SEQ ID NO: 363241 - RNA, 64 nt, Human
guggauggagaagagguugcugauuaaaauacacucccccuauaaaggggaagggggaguguga

SEQ ID NO: 363242 - RNA, 64 nt, Human
ccuuucugccuuggccucggcgggcuuuucuggggcccaggaagcccacacuaugcacagagcc

SEQ ID NO: 363243 - RNA, 64 nt, Human
ucccaagucagacagaugucagcuucccagccaugcccaggacguccuaucucccccaacccac

SEQ ID NO: 363244 - RNA, 64 nt, Human
gaggugagaaaggaagcgucuucuagagacauuggcccaggagcucuguucuuuccuaaucuaa

SEQ ID NO: 363245 - RNA, 64 nt, Human
auuguuguuucauaaaaguuggaucuguuccuaugcccaggaugauuuugugaaccgugaagua

SEQ ID NO: 363246 - RNA, 50 nt, Human
ggcgguuccaggucuugugagcccaggaaugaaagaggagaagaaacgca

SEQ ID NO: 363247 - RNA, 64 nt, Human
cccagcacuuagggugccaauguggauuaccugagcccaggaguuugagaccagccuggguaac

SEQ ID NO: 363248 - RNA, 64 nt, Human
acaaaaucuaggcagugaacaagucuucauccuggcccaggaaauagccuauuaaaaaaugcug

SEQ ID NO: 363249 - RNA, 64 nt, Human
agggggaggaugacaagccgcugcccaccuccaagcccaggaaacaguacaagauggcuaagga

SEQ ID NO: 363250 - RNA, 64 nt, Human
ggaaaacuggguuuaucucaaggcagcagccugagcccaggagcagaggacccaguuguuauaa

SEQ ID NO: 363251 - RNA, 64 nt, Human
uguauuuuuaguagagacgggguuucaccauguugcccaggauggucucgaucuccucaccucg

SEQ ID NO: 363252 - RNA, 56 nt, Human
ucugggccauuugccccuaacgugcugcccaggauggccuccucuugacaggcgga

SEQ ID NO: 363253 - RNA, 64 nt, Human
uuuuuuuuuuuucaagacagggucucgcucuuuugcccaggauggaguacaguggcauggucaa

SEQ ID NO: 363254 - RNA, 64 nt, Human
ucuggauucauagaauuaagaauaucuuguuagugcccaggauuuccacguuuuguguuuuauu

SEQ ID NO: 363255 - RNA, 62 nt, Human
gccuucugguuuuccugguuugcaagacuaaguguaccuaaucucaccaucucuucacuucu

SEQ ID NO: 363256 - RNA, 62 nt, Human
gaugaaauggcuuaauggugcuguuaaguauuuguaccuaacagucuugugugacagaugaa

SEQ ID NO: 363257 - RNA, 62 nt, Human
cauuuuuagacaaaaucuuuucaacgcugaaauguaccuaaucugguucuacuaccauaaug

SEQ ID NO: 363258 - RNA, 64 nt, Human
ugagcccauaacuggccucucuccaaaagccucugcccaggagcaugggcaucagcuaccucac

SEQ ID NO: 363259 - RNA, 64 nt, Human
caggacugagccccgcagaccuccccagccccuagcccaggagagagaaagccaggcagguagc

SEQ ID NO: 363260 - RNA, 64 nt, Human
agcuaccuggaggugaggugggaacaucacuugagcccaggaguuggaggcugcagugcgcuac

SEQ ID NO: 363261 - RNA, 64 nt, Human
guuuccuucccuggaccccugcagagcucacagggcccaggacaccaacgccgcauaggacugc

SEQ ID NO: 363262 - RNA, 64 nt, Human
ggagccgcugcugagcugcgugccacaucgcuacgcccaggaggugagccggcucugccuccug

SEQ ID NO: 363263 - RNA, 64 nt, Human
cuacucaggaggcugagacaggaggauugcuuaagcccaggagcucaagucccaccugggcaac

SEQ ID NO: 363264 - RNA, 64 nt, Human
cagcgucuccuccuccugcgcccccacugcgucugcccaggaacagcauccuggguagcagaac

SEQ ID NO: 363265 - RNA, 64 nt, Human
cccuaugucccacaggagauucacagagagacgagcccaggaggcugacugagcucaaaggaac

SEQ ID NO: 363266 - RNA, 64 nt, Human
uuuuauauaaaaaguguuucugugauucuucagagcccaggagucagugcuggugguuggaggg

SEQ ID NO: 363267 - RNA, 64 nt, Human
cuacccaggaggcugaggcaugagaaucgcuugggcccaggagguggagguugcagugagccga

SEQ ID NO: 363268 - RNA, 64 nt, Human
acagggaagcaugugacacccacaaucccaccuagcccaggagagagcuacggcagggugugug

SEQ ID NO: 363269 - RNA, 64 nt, Human
aggagaauuacuugaacgcaggagaaucacugcagcccaggaggcagagguugcagugagccga

SEQ ID NO: 363270 - RNA, 64 nt, Human
ggggagugucuuugagggccuuaaaaggaccauggcccaggaaugggggcgcugguugggcuug

SEQ ID NO: 363271 - RNA, 62 nt, Human
guaguuuuuaguagaugaaaauaauggauucuuguaccuaacauuuuauccucuuagaucua

SEQ ID NO: 363272 - RNA, 62 nt, Human
ucugcugaaagcaagccauucaguuucuuguuuguaccuaaaacaccaaaaaagaaacacuc

SEQ ID NO: 363273 - RNA, 62 nt, Human
ucuaaaaauuauauuuaaaauuguaaucaaaauguaccuaguuuauaaauguuuauuuugua

SEQ ID NO: 363274 - RNA, 64 nt, Human
cuggggucgggagaggugggcgcuagaagaugcagcccaggauguggcaaucaaugacacuauu

SEQ ID NO: 363275 - RNA, 64 nt, Human
acagguauagacaaggcugagcaggguuccuguggcccaggauggaggccaccgcugcccugcc

SEQ ID NO: 363276 - RNA, 64 nt, Human
gcacccagagaaaacccauacagacaguggccuugcccaggaaucagucuuguuucuuuuuugu

SEQ ID NO: 363277 - RNA, 64 nt, Human
ggaagaaauggagcgaugacugacuguggggugggcccaggauuuccacaucuuggugaaguug

SEQ ID NO: 363278 - RNA, 64 nt, Human
ucagaggagacugaagcagaaacccugcacacgggcccaggauguggcugauuuugugguuccg

SEQ ID NO: 363279 - RNA, 64 nt, Human
ccauaccccgaggucugggauuccccccucugcugcccaggaguggccaguguucggcguugcu

SEQ ID NO: 363280 - RNA, 64 nt, Human
cagagcugaagagcuauaggcacugguguggauggcccaggaggugcuggagcuaggucuccag

SEQ ID NO: 363281 - RNA, 64 nt, Human
uccuccaucugagaaguggcccaugugcuucaaggcccaggagggagaucugucagcucauucu

SEQ ID NO: 363282 - RNA, 50 nt, Human
cuaaagagucaagcaucuaagcccaggacaugagugucuguccagacuca

SEQ ID NO: 363283 - RNA, 64 nt, Human
cagugagcagucaaguguucaggccacacagucagcccaggaaaaagagaagcagggccaaaug

SEQ ID NO: 363284 - RNA, 64 nt, Human
gacuuugggaggccgaggugggaagaucccuugagcccaggaguucgagacaagccuggguaac

SEQ ID NO: 363285 - RNA, 64 nt, Human
uugcacagacagaaucacuuugccacacugcagggcccaggagugggagcccaggcccucccuc

SEQ ID NO: 363286 - RNA, 64 nt, Human
uuaauaugaaauuuuuuuucaugcuuuaucaauagcccaggauauauuuuauuuuuagaauuuu

SEQ ID NO: 363287 - RNA, 64 nt, Human
gccccgcuacagaagccagacugggucccgcggacgccagcaggggcagccccagccuaggcug

SEQ ID NO: 363288 - RNA, 64 nt, Human
accagcagcgaggaauuaacccuguguccucagucgccagcacuuacagcuccaacuuuuuuga

SEQ ID NO: 363289 - RNA, 62 nt, Human
caugauaaccuaaaugaccuaaauaagaacacuguaccuaaaauaaagaggcaacuuuauua

SEQ ID NO: 363290 - RNA, 64 nt, Human
uaagagacaauuucugcagguggcaggugagcaagcccaggagaaugcugcaaucuugggggug

SEQ ID NO: 363291 - RNA, 64 nt, Human
acugucucauucauuuacauuucuguuacagucagcccaggagguuacagugagcucuccacua

SEQ ID NO: 363292 - RNA, 64 nt, Human
uauauuucaaaaugguauuuugaugccaucaaaugcccaggaaauugacuuugcagugucacca

SEQ ID NO: 363293 - RNA, 64 nt, Human
cacaccugcuuccuuaaaaugcucucugcaaaaugcccaggaagcccucauugugacauggcag

SEQ ID NO: 363294 - RNA, 64 nt, Human
cacuuugggaggcugagauggguggauugcuugagcccaggaguucaagaccagccugggcaac

SEQ ID NO: 363295 - RNA, 64 nt, Human
uuuaauuuuuuucgagacaggaucucacucuguugcccaggauggagugcaguggugagaucac

SEQ ID NO: 363296 - RNA, 64 nt, Human
gcacuuugggaggccaagggaggugaucacuugagcccaggaguaaagaccagccugggcaaca

SEQ ID NO: 363297 - RNA, 64 nt, Human
uaucagcugcaacacacugucuuuaauacccccagcccaggagcucgugccuuacaugcugggc

SEQ ID NO: 363298 - RNA, 64 nt, Human
ccugccaggggcacucagcaaacagaaccacagggcccaggaggcauuccacacaggcacugcc

SEQ ID NO: 363299 - RNA, 64 nt, Human
augaaauauguugcugggugcguuaaucaccuccgcccaggauuuagucacuugcaggaccucu

SEQ ID NO: 363300 - RNA, 64 nt, Human
aauaaauucaggcugcugaaacaagaaauucugagcccaggaagcgggcucuucuuucuucaaa

SEQ ID NO: 363301 - RNA, 64 nt, Human
aaggcuuccucuagggccaccaggcugaggacucgcccaggacauggacuggucucucagaccc

SEQ ID NO: 363302 - RNA, 64 nt, Human
gcagcuacugcgagaacuucaggccaaugucucagcccaggaaccaggcuuugcugaggugcug

SEQ ID NO: 363303 - RNA, 64 nt, Human; identical to SEQ ID NO: 275111

SEQ ID NO: 363304 - RNA, 64 nt, Human; identical to SEQ ID NO: 275112

SEQ ID NO: 363305 - RNA, 62 nt, Human
ugucacaguauaggauugccauucagguguuuuguaccuauuucuuuccugacguugucccc

SEQ ID NO: 363306 - RNA, 64 nt, Human; identical to SEQ ID NO: 44320

SEQ ID NO: 363307 - RNA, 64 nt, Human
cugugacugaggauugaugacuccauggagccuggcccaggagaaccagagaugaucccgaggc

SEQ ID NO: 363308 - RNA, 64 nt, Human
gugaggaacaccucccaccaggcuagaggcaacugcccaggaaggacugugcuuccgucaccuc

SEQ ID NO: 363309 - RNA, 64 nt, Human
agcgccagacauuuugcacauaaggcaccaaacagcccaggacugccgagacucuggccgcccg

SEQ ID NO: 363310 - RNA, 64 nt, Human
cuacucaagaggcugaggcaggaggacugcuugagcccaggaguucagggcugcagugagguac

SEQ ID NO: 363311 - RNA, 64 nt, Human
uuacucaggaggcugaggcaggaggaucacuugagcccaggagguugaggcuggagugagccau

SEQ ID NO: 363312 - RNA, 64 nt, Human
gcacuuugggaggcugaugugggcggauaguugagcccaggaguucgagaccagccugggcaac

SEQ ID NO: 363313 - RNA, 64 nt, Human
ccacagcccagcccagccugacguggauguggcugcccaggaaaagacuuaacugugaaaaagu

SEQ ID NO: 363314 - RNA, 64 nt, Human
gcuguuacauucugccaggggcaaaagauacuaggcccaggagucaagaaaagcuuuugugaaa

SEQ ID NO: 363315 - RNA, 64 nt, Human
gugccaagaaacgcaggcucugggccugccccuugcccaggaggccuugccagccugugugcuu

SEQ ID NO: 363316 - RNA, 64 nt, Human
caugggaaagccaggagggcccugaccucccacugcccaggaggcaguggcgggcuccccgaug

SEQ ID NO: 363317 - RNA, 64 nt, Human
cuacucaggaggcugaggugggaaaaucacuugagcccaggaggucgaggcugcagugugcugu

SEQ ID NO: 363318 - RNA, 64 nt, Human
cacuaugggaggcugaggcaagcagguuguuugagcccaggaauuugagaacaggauuuugaga

SEQ ID NO: 363319 - RNA, 64 nt, Human
aggcagacucagugggauccuccuacuugggaaagcccaggagaugaugccagccuugagcaug

SEQ ID NO: 363320 - RNA, 64 nt, Human
agccuaccucccuccuggcugcuggccaggaugucgccagcauuaccuuccacugccuuucucc

SEQ ID NO: 363321 - RNA, 64 nt, Human
ccgagaccagcaguacgagaugcucaagcgcuggcgccagcagcagcccgcgggccucggagcc

SEQ ID NO: 363322 - RNA, 64 nt, Human; identical to SEQ ID NO: 44322

SEQ ID NO: 363323 - RNA, 64 nt, Human
caucuugggaggcugaggcaugaaaaucgcuugagcccaggaggcagagguuguagugaggcaa

SEQ ID NO: 363324 - RNA, 64 nt, Human
aacuggagucuggagugggcagagcccccaggaagcccaggagggcauccauaccagcucgcac

SEQ ID NO: 363325 - RNA, 64 nt, Human
aagaagccacccuccuugcaggaugcccggcggggcccaggacggggcacaagugucaggcgcc

SEQ ID NO: 363326 - RNA, 64 nt, Human
ggccgccacugcaguucugcuaggucugcuuccugcccaggaaggugccugcacaugagaggag

SEQ ID NO: 363327 - RNA, 64 nt, Human
aggcauccuggugccugcauaccucuggcagcuggcccaggaagagccagcaagagcaaggcau

SEQ ID NO: 363328 - RNA, 64 nt, Human
cacuggugguccaggcucuggugaagcccucugagcccaggaggaagagaaagcauuguccaga

SEQ ID NO: 363329 - RNA, 64 nt, Human
uuauaggaggcagaggcucgggaggauugcuugagcccaggaguucaagaucagccuaggcaac

SEQ ID NO: 363330 - RNA, 64 nt, Human
cuacucaagaggcugaggcagaaggaucccuugagcccaggagugcaaggcugcaaugagccag

SEQ ID NO: 363331 - RNA, 64 nt, Human
aggccucagccuugcccucaaugcacgaaagguggcccaggagagaggaucaaugccauaggag

SEQ ID NO: 363332 - RNA, 64 nt, Human
acggcggggugugguggccugugaggggccccuggcccaggaggaggauugugcugauguagug

SEQ ID NO: 363333 - RNA, 64 nt, Human
ggcugaggcaggaggaucauuugagcucaugagggcccaggaggucaaggcuucagugagccau

SEQ ID NO: 363334 - RNA, 64 nt, Human
aguccucugaauggagcccccaucacaaaacagugcccaggaggcuggcuccucaagcuaccca

SEQ ID NO: 363335 - RNA, 64 nt, Human
uccuuuggguaccccucaggcuccuaauauucuugcccaggauccuuggaacuuaagaaugcag

SEQ ID NO: 363336 - RNA, 64 nt, Human
ccugugcucuagaaggcccauucuaugucugcuucgccagcacccuuuccccaucauggggcag

SEQ ID NO: 363337 - RNA, 55 nt, Human
gggcagggagcagacagugagcaaacgccagcagggcugcugugaauuuguguaa

SEQ ID NO: 363338 - RNA, 64 nt, Human
uacagccuuugaaaugguuuccacgugauuguuacgccagcaguucucguuuuguuuguuuuuc

SEQ ID NO: 363339 - RNA, 64 nt, Human
guugggcugcauuccuccgaggaccagucugaucgcccaggacuaagaguggcagcguaugaga

SEQ ID NO: 363340 - RNA, 64 nt, Human
acagugaaauggagaauuucaggucuccacgucugcccaggaaagaacuucagcugacuccacg

SEQ ID NO: 363341 - RNA, 64 nt, Human
gugguggcauugauuuuuuuccuccaugcaucuugcccaggaucacucagucaagcaugucuuc

SEQ ID NO: 363342 - RNA, 64 nt, Human
cguucuuauaccacguuccacggaggagugaggagcccaggaacgacguggucuuccagcccau

SEQ ID NO: 363343 - RNA, 64 nt, Human
gaagugccaagauuggcuuggcaucugcacuccagcccaggacuguggucugccauugcaaugc

SEQ ID NO: 363344 - RNA, 64 nt, Human
ugaaggcuggcacgugcagcguccuuggcaguuggcccaggaacuggagccacagagcuggugc

SEQ ID NO: 363345 - RNA, 64 nt, Human
gccuuggcggcuauuuuugccaccugccuugggugcccaggaguccccuacugcugugggcugg

SEQ ID NO: 363346 - RNA, 64 nt, Human
cuugggagugggcugagaugggagaaucgcuugagcccaggaggucaaggguacagugagccga

SEQ ID NO: 363347 - RNA, 64 nt, Human
cacuuugggaggccgaaacaggcgaaucacuugagcccaggaguucaagaccaacaugggcaau

SEQ ID NO: 363348 - RNA, 64 nt, Human
uuuaaauagaucuuucuugccaaggaaugcucuggcccaggagcaagguggaauguuucccuga

SEQ ID NO: 363349 - RNA, 64 nt, Human
cacuuugggaggccaaagcaggaggaucgcuugagcccaggaguucaagaccaaccuggugaaa

SEQ ID NO: 363350 - RNA, 64 nt, Human
agccuccugcagacgggcgaagccgccugcugcagcccaggaagccagcccucugcucggccuc

SEQ ID NO: 363351 - RNA, 64 nt, Human
ccacucugaacgcugagaugggaaggucacuugagcccaggaccccaccacugcacuccagccu

SEQ ID NO: 363352 - RNA, 62 nt, Human; identical to SEQ ID NO: 275101

SEQ ID NO: 363353 - RNA, 64 nt, Human; identical to SEQ ID NO: 275102

SEQ ID NO: 363354 - RNA, 64 nt, Human
gggcuuuuaggguccuguggcgagcugugagcaccgccagcauuagacgucacauccagguggc

SEQ ID NO: 363355 - RNA, 64 nt, Human
uuuucuuccaauuauaaucucugcuagccacuuccgccagcaguugguggaagacuuacuaggu

SEQ ID NO: 363356 - RNA, 64 nt, Human
gacuagguuccaguuuucuccuaacacgugccaagcccaggagcaguucuucccuauggauaca

SEQ ID NO: 363357 - RNA, 64 nt, Human
cuacucaggaggcugaagcaggaggauagcuugagcccaggaguuugaggcuacagugagcugu

SEQ ID NO: 363358 - RNA, 64 nt, Human
cauggcuggcagcgcggcugacacacacguucaagcccaggacugcccgggcgcaggauccagg

SEQ ID NO: 363359 - RNA, 64 nt, Human
ggugacacaugucuagacccagcacaggcuguaggcccaggagugacucaaaggaguuuuuccc

SEQ ID NO: 363360 - RNA, 64 nt, Human
cacuuugagaggccgagauaggcggauugcuugagcccaggaguuugagggcagccugggaaac

SEQ ID NO: 363361 - RNA, 64 nt, Human
uuaggaggagaauuugugagcagugaaucugacagcccaggaggugggcucgcugauaggcaug

SEQ ID NO: 363362 - RNA, 64 nt, Human
aaaacggguucuguaguauuuguaaaaaggcccggcccaggaccacugugagcuggaaaaggga

SEQ ID NO: 363363 - RNA, 64 nt, Human
caaagaggaaaggagaaaaacaaacagaccaaaugcccaggagcccaugaaguaauagcguaaa

SEQ ID NO: 363364 - RNA, 64 nt, Human
cgucauuucacauuuuaccccaacugaccugcaugcccaggacacaaguaaaacauuugugaga

SEQ ID NO: 363365 - RNA, 64 nt, Human
cuacuugggaggcugaggcaggagaaucauuugagcccaggaggucaaggcugcagugagcuuu

SEQ ID NO: 363366 - RNA, 64 nt, Human
uauuuugggaggccgaggagagaggaucacuuaagcccaggagucugagaccagccugggcaac

SEQ ID NO: 363367 - RNA, 64 nt, Human
cuacaugggaggcugaggugggaggaucacuugagcccaggaaguccagaacguagugagccuu

SEQ ID NO: 363368 - RNA, 64 nt, Human
gggauggagagguuagugugaugagguggugucugcccaggagguuucuuucaaacaucauggc

SEQ ID NO: 363369 - RNA, 64 nt, Human
gagaaauaacuugcucuggugucaauucgcuauucgccagcagacaucagaacacaccgaguuu

SEQ ID NO: 363370 - RNA, 56 nt, Human
ccgcagcccugggucugugacgccaacgccagcaccaaugucgcgccugucccgcg

SEQ ID NO: 363371 - RNA, 64 nt, Human
cccuccgcaccguccccuccugagcagcacucggcgccagcagccucugccagaguggaagcca

SEQ ID NO: 363372 - RNA, 64 nt, Human
acaugaaacuugucaccaugagauagcauuagcugcccaggaugcugcuauauauauauauaua

SEQ ID NO: 363373 - RNA, 64 nt, Human
cacuuugggagaccaaggcggguagaucccuugugcccaggaguucaagaccagccugggcaac

SEQ ID NO: 363374 - RNA, 64 nt, Human
agauucaauaaugagagcucagacugggaacagggcccaggaaucugugugguacaaaccugca

SEQ ID NO: 363375 - RNA, 64 nt, Human
cacuuugggaggccaagagaggaagauugcuugagcccaggaguuugagaccaaucuaggcaau

SEQ ID NO: 363376 - RNA, 64 nt, Human
gagaggcccucuagagaauccagggaaacugugagcccaggaguugcccaucuaugguuucauu

SEQ ID NO: 363377 - RNA, 64 nt, Human
gaugggcagcuagaggggugcagaaagccugugggcccaggagauggagaugccguuuguggcg

SEQ ID NO: 363378 - RNA, 64 nt, Human
gcuagggcagggaccaaaugaacagaaagucucagcccaggauggggcuucuucaacagggccc

SEQ ID NO: 363379 - RNA, 64 nt, Human
gagaaugaauugguuaucagaguggaagaccauggcccaggaucccugagcuuucccaguagcc

SEQ ID NO: 363380 - RNA, 64 nt, Human
ggggacucgggugcugggaguguggcuccugugggcccaggaggucugguccgagucucagccc

SEQ ID NO: 363381 - RNA, 64 nt, Human
aggaccaggagucuucuugaaucccaugagcucugcccaggacccucucucaagcaccuguggc

SEQ ID NO: 363382 - RNA, 64 nt, Human
aucacauuccacaaucuauggcuuccaccagcuagcccaggaaauacuugaaaucagcauucca

SEQ ID NO: 363383 - RNA, 64 nt, Human
uccucauuccauagagcauuagaagcugccaccagcccaggacccuccagaggcagccuggccu

SEQ ID NO: 363384 - RNA, 64 nt, Human
gaaacaagguuggauaagcgcuuccuuuuuuuuagcccaggagagguggauguuugucugagaa

SEQ ID NO: 363385 - RNA, 64 nt, Human
ggacuccuuccaacuuccuggaacaaagcgacaucgccagcagcaggcuggcagggagugguug

SEQ ID NO: 363386 - RNA, 64 nt, Human
auccagagaaugaaugaguuccuuuaagugccaccgccagcaagcccagaggcacacaguccga

SEQ ID NO: 363387 - RNA, 64 nt, Human
aucuccugggaaucuaucccuaaggaauaaaaagcgccagcacuuaagauuauauguuuacuaa

SEQ ID NO: 363388 - RNA, 64 nt, Human
caggugaggugagcgugugugcucucagggaagggcccaggaucccaugccugggaggagcugc

SEQ ID NO: 363389 - RNA, 64 nt, Human
cauggauucacaugaacugaaacgccaccacuuggcccaggauguugaaagggugcaaauuccu

SEQ ID NO: 363390 - RNA, 64 nt, Human
gcggccuugcuggggacugcggugggaguagagugcccaggagagggucugaggggugggaugg

SEQ ID NO: 363391 - RNA, 64 nt, Human
caggcuggcacugccacucacacucggccccagggcccaggagggacagugccuggagccuggg

SEQ ID NO: 363392 - RNA, 64 nt, Human
cugcucaggaggcuaaggcagaaagaccauucaagcccaggaguuccagccugaaguaugcugu

SEQ ID NO: 363393 - RNA, 64 nt, Human
ggccaugcccuccauguguaagaacaaugccagggcccaggaggaccgccugcccugccugggc

SEQ ID NO: 363394 - RNA, 64 nt, Human
aaacccuucugcgccugaggcgggcgggucccgagcccaggagggaacccgcgcucaggcggac

SEQ ID NO: 363395 - RNA, 64 nt, Human
gaagcagcuugaguguuuucaucuugccugggaagcccaggaauuccaccugguccacaccggc

SEQ ID NO: 363396 - RNA, 64 nt, Human
cacuuugggaggcucaggugggcgaauugcuugagcccaggaguucgagaccagccggggcaac

SEQ ID NO: 363397 - RNA, 64 nt, Human
uuucugcccucugacuccagugguugcagaauuagcccaggaacuagaauuggauggagucaca

SEQ ID NO: 363398 - RNA, 64 nt, Human
ccaaacucuuguugggguguaguguuugcuaggagcccaggauaccugcccuggacuuaaauug

SEQ ID NO: 363399 - RNA, 64 nt, Human
cucuuugguuuucagaagacugugacaaguucuggcccaggauucgcucacugacccucaauug

SEQ ID NO: 363400 - RNA, 64 nt, Human
ggcgggcguuggguuuggggggacggugcccccagcccaggaucgggcacucaguggagccgca

SEQ ID NO: 363401 - RNA, 64 nt, Human
cagggcaagacccuaucucaaaaaaaaaaaaagucgccagcaacaagcacguaguguaguguuc

SEQ ID NO: 363402 - RNA, 64 nt, Human
gugggucuguggcacagcaggaagagcccggugccgccagcaccuuguggaagaccacacaugg

SEQ ID NO: 363403 - RNA, 64 nt, Human
gucgugaccucaguggcugcagcucugaccgucccgccagcacgccagccccgacucagcuccu

SEQ ID NO: 363404 - RNA, 64 nt, Human
gcauccaggaacaggcuccagggcaggaaccugggcccaggaguugcaagucucugcuucuuac

SEQ ID NO: 363405 - RNA, 64 nt, Human
cuggaguuuuuacccggcuuugccugccaccucugcccaggacacucuucccucucgggaugug

SEQ ID NO: 363406 - RNA, 64 nt, Human
aaaacggccagguacaacaccuuuuucauacaaggcccaggaggcuuaguccagucugugcucc

SEQ ID NO: 363407 - RNA, 64 nt, Human
uaaugcuucacuccuggcucuguucagggaggcugcccaggaggaagacuggccauuaugcauc

SEQ ID NO: 363408 - RNA, 64 nt, Human
cuguucaggaggaugaggcaggaggaucucuugagcccaggaggucaaggcuauggugagccgu

SEQ ID NO: 363409 - RNA, 52 nt, Human
aguaugagccagaggcguaggggcccaggagagcccccaccagcagcacaau

SEQ ID NO: 363410 - RNA, 64 nt, Human
acugaguggcgccuccggcggggccugucccugggcccaggagccaaugugaacuuuuuuuuuu

SEQ ID NO: 363411 - RNA, 64 nt, Human
cggaugaggagcaccugaagaaaucaagccaggugcccaggacagaagccccagccccagccuc

SEQ ID NO: 363412 - RNA, 64 nt, Human
ugggccugcaucuccuggcgccggcugcuucugggcccaggaagaggcuguggcucccaccuuc

SEQ ID NO: 363413 - RNA, 64 nt, Human
gcaguaagccacacaccugccacuuagccagaaugcccaggaucgcguuggucacuguuauuug

SEQ ID NO: 363414 - RNA, 64 nt, Human
cacuuugggaggcugaggugggagaauugccugagcccaggaguucaagaccagcuugugcaau

SEQ ID NO: 363415 - RNA, 64 nt, Human
caggaacacacagggcuguguagcaugauaccaggcccaggagaucaguaauuacaaauuaagg

SEQ ID NO: 363416 - RNA, 64 nt, Human
cuggaagggcccucgaaugccauucacaggaacagcccaggaacccagggacuucagaagggcu

SEQ ID NO: 363417 - RNA, 64 nt, Human; identical to SEQ ID NO: 275060

SEQ ID NO: 363418 - RNA, 64 nt, Human; identical to SEQ ID NO: 275061

SEQ ID NO: 363419 - RNA, 64 nt, Human; identical to SEQ ID NO: 275062

SEQ ID NO: 363420 - RNA, 64 nt, Human; identical to SEQ ID NO: 275063

SEQ ID NO: 363421 - RNA, 64 nt, Human
uaaucccagcucuggaagcugaaggauagcuugagcccaggaguucgaggcugcagugagcuau

SEQ ID NO: 363422 - RNA, 64 nt, Human
gagugaguaucuuggugaugacuccuccugaccagcccaggaccagcuuucuugucaccuugag

SEQ ID NO: 363423 - RNA, 64 nt, Human
cagauuccagcagggucccucugaguggggccaggcccaggacugucacacaaggcuugagaag

SEQ ID NO: 363424 - RNA, 64 nt, Human
aggaggccugcaucccuccugagcucuuggaggugcccaggaacccugcuucuccucacagggc

SEQ ID NO: 363425 - RNA, 64 nt, Human
caucucuaccagcagcagcagcagcgagguucuagcccaggaggguggggugcuucuuguagcc

SEQ ID NO: 363426 - RNA, 64 nt, Human
cuauuugggaggcugaugcaggagaauagcuuaagcccaggaauuugagucugggaguuugagu

SEQ ID NO: 363427 - RNA, 64 nt, Human
uaauucuacaaugugccagauacauguuuccuaugcccaggaaguuaugaagacuucaacaauu

SEQ ID NO: 363428 - RNA, 64 nt, Human
uuguagacucaugaugcugcuaucucaaccagaugcccaggacaggugcucuagccauuaggac

SEQ ID NO: 363429 - RNA, 64 nt, Human
caaggugggaaugacugggugguggcugccacuagcccaggaacaugacaacgugaccacacca

SEQ ID NO: 363430 - RNA, 64 nt, Human
uauaauccgaggcugaggugggaggaucacuugagcccaggaguuugagguugcagugagcugu

SEQ ID NO: 363431 - RNA, 64 nt, Human
ugcuuugggaggccaagaugggaggaucauuugagcccaggaguuugagaccagcuggggcaac

SEQ ID NO: 363432 - RNA, 64 nt, Human
uuauuuuuagguagagguagggucuuccuauguugcccaggauggucuucaaaucuuggucucg

SEQ ID NO: 363433 - RNA, 64 nt, Human
agaagccaacagcaaaacuggaaaagcccggcaggcccaggagagggcgcugaccuguggucgu

SEQ ID NO: 363434 - RNA, 64 nt, Human; identical to SEQ ID NO: 275064

SEQ ID NO: 363435 - RNA, 64 nt, Human; identical to SEQ ID NO: 275065

SEQ ID NO: 363436 - RNA, 64 nt, Human; identical to SEQ ID NO: 275067

SEQ ID NO: 363437 - RNA, 64 nt, Human; identical to SEQ ID NO: 275068

SEQ ID NO: 363438 - RNA, 64 nt, Human
uauacauuucaaccaaaaugaccucauuugaaaugcccaggaaguauuuguuuugccauucuua

SEQ ID NO: 363439 - RNA, 64 nt, Human
guggugcgagugcgugaauauugggggcccggacgcccaggaccccauggcagugggaaaaaug

SEQ ID NO: 363440 - RNA, 64 nt, Human
gggccccugggcugcguggaaaaagggcucuuuggcccaggagaauugggggguggggggucug

SEQ ID NO: 363441 - RNA, 64 nt, Human
uccaaacagaggaugcucagauuucucacauccugcccaggaucuccucuuaggguagaagucu

SEQ ID NO: 363442 - RNA, 64 nt, Human
ccacuggggaggcugaggccggaggagugcuugagcccaggaguucaaggcugcagugagccaa

SEQ ID NO: 363443 - RNA, 64 nt, Human
aggauugaggauucaucuaccugccaggccucaggcccaggacccaggaggccuccccaccuac

SEQ ID NO: 363444 - RNA, 64 nt, Human
gcggguccccuccuggccggcagagggcgcaggagcccaggagauggccucagcguggccagcc

SEQ ID NO: 363445 - RNA, 64 nt, Human
gagagacacgugaaggaagaugaugggaggaaaagcccaggagaagucccaccagggaccagcc

SEQ ID NO: 363446 - RNA, 64 nt, Human
uaccacugauggcccugcuuccucugagugagaugcccaggaggaggagcccuagggaagaagu

SEQ ID NO: 363447 - RNA, 64 nt, Human
cuacuugggaggcugaggugggagaauugcucaagcccaggaguuugaaguugcaaugagcuau

SEQ ID NO: 363448 - RNA, 64 nt, Human
uaauggcuucuguuacauggagcucaauggacgugcccaggaaugcuuuuggcuguuauuuugc

SEQ ID NO: 363449 - RNA, 64 nt, Human
ggucuuuccuaaggcugcaagguuuaggcugguggcccaggaccaucauccuacuguaauaaag

SEQ ID NO: 363450 - RNA, 64 nt, Human
cuccuggugacucgggggcugucucagacgacuagcccaggacccaucuuucucacacggauuu

SEQ ID NO: 363451 - RNA, 64 nt, Human; identical to SEQ ID NO: 275069

SEQ ID NO: 363452 - RNA, 64 nt, Human; identical to SEQ ID NO: 275070

SEQ ID NO: 363453 - RNA, 64 nt, Human; identical to SEQ ID NO: 275072

SEQ ID NO: 363454 - RNA, 64 nt, Human; identical to SEQ ID NO: 275073

SEQ ID NO: 363455 - RNA, 64 nt, Human
aucacagaccagcucugcagcaggggauuggggagcccaggaggcagccuucccuuuugccuua

SEQ ID NO: 363456 - RNA, 64 nt, Human
cacuuuggggggccaagguggguggauugcuuaagcccaggaguucaagaccagccugggcaac

SEQ ID NO: 363457 - RNA, 64 nt, Human
ccauaagggacucuggaagcuguagguuagcucugcccaggagaaaggagaaccagaccuuggu

SEQ ID NO: 363458 - RNA, 64 nt, Human
gcuacuugagaggcugaggcaggaggauuguugagcccaggaguuugagugcaaucuggguaac

SEQ ID NO: 363459 - RNA, 64 nt, Human
auuccguagccagcugcuccccagcagcggaaccgcccaggaucagauugcaugugacucugaa

SEQ ID NO: 363460 - RNA, 64 nt, Human
cuacugaggaggcugaggugggaggauugcuugagcccaggaggcagagguugcagugagccaa

SEQ ID NO: 363461 - RNA, 64 nt, Human
cacuuugggaggcugagguggguagauuacuugagcccaggaauucaagaccagccugggcaac

SEQ ID NO: 363462 - RNA, 64 nt, Human
cuucucaggaggcuggggugggaagaucacuugagcccaggaggucgaggcugcagugagccau

SEQ ID NO: 363463 - RNA, 64 nt, Human
cacuuugggaggcugagucgggaggauagcgugagcccaggaguuugagaccagcuaaggcaau

SEQ ID NO: 363464 - RNA, 64 nt, Human
uccccggccgaccuagugucucuuuucaaggucugcccaggaugcugcuucccggcaugcaccu

SEQ ID NO: 363465 - RNA, 64 nt, Human
uuuuuuuuuaaguaaaguuuguagcuccucccaugcccaggaaagcacagaacucaaguguggu

SEQ ID NO: 363466 - RNA, 64 nt, Human
uggcccuuuugcuuuucacgcccagggcucaguggcccaggaagugugcugggcagccuguucu

SEQ ID NO: 363467 - RNA, 64 nt, Human
uuggguucguaccagcaaguagacuaggaacugagcccaggaaagggggauguuuuccuggugu

SEQ ID NO: 363468 - RNA, 64 nt, Human; identical to SEQ ID NO: 275081

SEQ ID NO: 363469 - RNA, 64 nt, Human; identical to SEQ ID NO: 275082

SEQ ID NO: 363470 - RNA, 64 nt, Human; identical to SEQ ID NO: 275083

SEQ ID NO: 363471 - RNA, 64 nt, Human; identical to SEQ ID NO: 275084

SEQ ID NO: 363472 - RNA, 64 nt, Human
cucacugcccaagucauggcaacaggcuggagcagcccaggagaugggccuaaaauguucugga

SEQ ID NO: 363473 - RNA, 64 nt, Human
gcugaagagcuguuuugugaagcaucccaggcuugcccaggagagacauuugccacuaugucac

SEQ ID NO: 363474 - RNA, 64 nt, Human
cuacucuggaggcugaggcaggaggaucacuugagcccaggagauuaagacuguaguauacuau

SEQ ID NO: 363475 - RNA, 64 nt, Human
ccucugggacugugccuugcucaccgaaacccgcgcccaggaguauggcugaggccuugcccac

SEQ ID NO: 363476 - RNA, 64 nt, Human
gcuacuugaaggcugagacaggaggaucgguugagcccaggagguuguggcugcagugagcugu

SEQ ID NO: 363477 - RNA, 64 nt, Human
cagcuacucugaagccugaggcagaaucaagugagcccaggaguucagggccagcuuugauaau

SEQ ID NO: 363478 - RNA, 64 nt, Human
ccccucccucgucccacccccacccaggcaggaagcccaggaggagugcgggcagggccugacc

SEQ ID NO: 363479 - RNA, 64 nt, Human
cugaaggggucccccauuguuuugcuuccccagcgcccaggaugagcgguuuaccaucgagcuu

SEQ ID NO: 363480 - RNA, 64 nt, Human
gacggcuaaccaggguaagaauguucagggggcugcccaggaggggcccccaaccugacuauca

SEQ ID NO: 363481 - RNA, 64 nt, Human
cacuuugggaggccaaggcgggaggauugcuugagcccaggaguucaagaccagccugggcaac

SEQ ID NO: 363482 - RNA, 64 nt, Human
guacucaggaggcugaggcaggaggauugccugagcccaggagguggaaacugcagagagucau

SEQ ID NO: 363483 - RNA, 64 nt, Human
cacucaggaggcugaggcagggaggauccauugagcccaggaguccagccugggcaaaauagcg

SEQ ID NO: 363484 - RNA, 64 nt, Human
ggcgggaggggaucugugucacuguagguacugugcccaggaaggcugggugaagugaccaucu

SEQ ID NO: 363485 - RNA, 64 nt, Human; identical to SEQ ID NO: 275074

SEQ ID NO: 363486 - RNA, 64 nt, Human; identical to SEQ ID NO: 275079

SEQ ID NO: 363487 - RNA, 64 nt, Human; identical to SEQ ID NO: 275088

SEQ ID NO: 363488 - RNA, 64 nt, Human; identical to SEQ ID NO: 275089

SEQ ID NO: 363489 - RNA, 64 nt, Human
accccaaaccuaauaacccaaauuuggggauggggcccaggaauaugcauuuuuaaaaagucau

SEQ ID NO: 363490 - RNA, 64 nt, Human
agcccccaguuccucccccaguuccucccaggaagcccaggagccucacuggggcagacaauaa

SEQ ID NO: 363491 - RNA, 51 nt, Human
guaguccuagccuccuauaaggcccaggaagagggcagaggggccagaagg

SEQ ID NO: 363492 - RNA, 64 nt, Human
aaaaaaaacuaagauacccauucuuucugccuuugcccaggauggaggcuuugaagacaggugg

SEQ ID NO: 363493 - RNA, 64 nt, Human
cuuuuuuuuuuuugagauggagucuuguucuguugcccaggagggagugcaguggugcaaccuc

SEQ ID NO: 363494 - RNA, 64 nt, Human
gagcgcugguccccucccucugucuucaggcucugcccaggaacucgcaccugugcuggagccc

SEQ ID NO: 363495 - RNA, 64 nt, Human
caagagaagggcccaggaaggaugcucucauaaggcccaggaaggaugcucucauaagcaccuu

SEQ ID NO: 363496 - RNA, 64 nt, Human
ucugccauccacggccuuuucuggcaagagaagggcccaggaaggaugcucucauaaggcccag

SEQ ID NO: 363497 - RNA, 64 nt, Human
caggaaucuuccugaagacauggcccagucgaaggcccaggauggcuuuugcugcggccccgug

SEQ ID NO: 363498 - RNA, 64 nt, Human
cuacucaggaggcugaggugggagaauugcuugggcccaggaauucaaggcuagagugagccgu

SEQ ID NO: 363499 - RNA, 64 nt, Human
ugagaaagaggccccacgcuguagagucccgaaagcccaggagugaaggggguuccuggagucu

SEQ ID NO: 363500 - RNA, 64 nt, Human
ucucaaaaaaaaaaagauucugugucagagcccagcccaggaguuugaggcugcaaugagccau

SEQ ID NO: 363501 - RNA, 64 nt, Human
acacaaaacaaacagugauuguacagcaggcugggcccaggaggucagguucauuuuguuacau

SEQ ID NO: 363502 - RNA, 64 nt, Human; identical to SEQ ID NO: 275093

SEQ ID NO: 363503 - RNA, 64 nt, Human; identical to SEQ ID NO: 275094

SEQ ID NO: 363504 - RNA, 64 nt, Human; identical to SEQ ID NO: 275099

SEQ ID NO: 363505 - RNA, 64 nt, Human; identical to SEQ ID NO: 275100

SEQ ID NO: 363506 - RNA, 64 nt, Human
aaaggagaaggaauuggagcagcuuuuccuggaggcccaggauauuucuuuucuggguaucuug

SEQ ID NO: 363507 - RNA, 64 nt, Human
gugacaccugguacuggcaguuuugggaguggcagcccaggauggacagcaguggggagggaac

SEQ ID NO: 363508 - RNA, 64 nt, Human
ggccugcgacaggugugcucucuuuccaagaccugcccaggauuuaguaagggaaagucaauca

SEQ ID NO: 363509 - RNA, 64 nt, Human
cucccagagcucacccgcgggugaccgggggccagcccaggagggcgggugguuugugcgaguu

SEQ ID NO: 363510 - RNA, 64 nt, Human
cacuuugggaggccaaggugggaggaucguuugagcccaggaguugaagaccagccugggcaac

SEQ ID NO: 363511 - RNA, 64 nt, Human
agcaagacuccaucucaaaaaaaaaagaguucuagcccaggagcgguggcucacacuuguaauc

SEQ ID NO: 363512 - RNA, 64 nt, Human
gccaucacugccucuccagggacccuccucuccugcccaggacagacccagccagaaccacugc

SEQ ID NO: 363513 - RNA, 64 nt, Human
guacuugggaggcugaggugggaggaucacuugagcccaggagauagaggcugcagugagcugu

SEQ ID NO: 363514 - RNA, 64 nt, Human
ggucuuuuugucugcagugaauguucaacaguuugcccaggaacugggggaucauauaugucuu

SEQ ID NO: 363515 - RNA, 64 nt, Human
uacuuugggagguugaggcaggaggaucgcuugagcccaggaggcagaggcugcagugagccau

SEQ ID NO: 363516 - RNA, 64 nt, Human
ucccagcugcucugauaagaggaggcucacuugagcccaggagguugaggcugcagugagcaga

SEQ ID NO: 363517 - RNA, 64 nt, Human
cugcucagguggcuaggguggauggaucgcuugagcccaggagguggagguugcagugagcuga

SEQ ID NO: 363518 - RNA, 64 nt, Human
acggauacuggggaguaaacggcccaggccaggugcccaggaaaggacggcugagcauguggag

SEQ ID NO: 363519 - RNA, 64 nt, Human; identical to SEQ ID NO: 275032

SEQ ID NO: 363520 - RNA, 64 nt, Human; identical to SEQ ID NO: 275033

SEQ ID NO: 363521 - RNA, 64 nt, Human; identical to SEQ ID NO: 275104

SEQ ID NO: 363522 - RNA, 64 nt, Human; identical to SEQ ID NO: 275105

SEQ ID NO: 363523 - RNA, 64 nt, Human
gaucuugggaggucgaggcaagcugaucgcuugagcccaggaguuuaagaccggccugaguagc

SEQ ID NO: 363524 - RNA, 64 nt, Human
cuacugggggugcugaggugggaggaucgcuugagcccaggagagugaggcugcagugagcuga

SEQ ID NO: 363525 - RNA, 64 nt, Human
aaccuuggugcagcugcagccaggaggggagcgggcccaggagccaggcucagguccagcuggu

SEQ ID NO: 363526 - RNA, 64 nt, Human
ggcgacucugcagagucacucacaccguucguacgcccaggacagcugguucgugguuuuuaca

SEQ ID NO: 363527 - RNA, 64 nt, Human
caauagcuaggaaucauguucaauauugaauucugcccaggagcaugaacugauccaugaaugc

SEQ ID NO: 363528 - RNA, 64 nt, Human
guggcugagguggaagaauggaagaaucacuugagcccaggaguuugaggcugcagugagcuau

SEQ ID NO: 363529 - RNA, 64 nt, Human
cuacuugggaggcugagucaggagaaucgcuugagcccaggagauggagguugcagugagccaa

SEQ ID NO: 363530 - RNA, 64 nt, Human
cagaucuauuacaaauauauaucggagugacggugcccaggauagauguaauauuucuuacaga

SEQ ID NO: 363531 - RNA, 64 nt, Human
cugacucacaccccgcggcaggacuucuagagaagcccaggaucugucccgugccgccgcugcu

SEQ ID NO: 363532 - RNA, 64 nt, Human
gauagaugguaguuugguacuucugguucccagugcccaggaaugguccacucccaagaaauuc

SEQ ID NO: 363533 - RNA, 64 nt, Human
cacagaccagaaaaaguuccaucuaaaauaucaugcccaggaaagcacaugggaucaaaaguaa

SEQ ID NO: 363534 - RNA, 64 nt, Human
gagcccaguagccauguggccagucuaccauggggcccaggaguuggggaaacacaauaaaggu

SEQ ID NO: 363535 - RNA, 64 nt, Human
cccucaaugcugccaccaugccugagugccugcagcccaggaggcccgcacaccgguacacucg

SEQ ID NO: 363536 - RNA, 64 nt, Human; identical to SEQ ID NO: 275085

SEQ ID NO: 363537 - RNA, 64 nt, Human; identical to SEQ ID NO: 275086

SEQ ID NO: 363538 - RNA, 64 nt, Human; identical to SEQ ID NO: 275109

SEQ ID NO: 363539 - RNA, 64 nt, Human; identical to SEQ ID NO: 275110

SEQ ID NO: 363540 - RNA, 64 nt, Human
agguacgccacccaccuccgucgcccaccucagcgcccaggagccuugggacuuccuuccauau

SEQ ID NO: 363541 - RNA, 64 nt, Human
acgcccaguguguacaggcgcaccccguggacuggcccaggaggacgugcaucaucacugcaau

SEQ ID NO: 363542 - RNA, 64 nt, Human
uuauuuauuuauuuauaaguagauguuuacauaugcccaggauuuugaagagccugguaucuuu

SEQ ID NO: 363543 - RNA, 64 nt, Human
cuacucgagaggccaaagaaggaggauggcuugagcccaggaguucaagaccagccuggacagc

SEQ ID NO: 363544 - RNA, 64 nt, Human
aucauuaacuaacacuccaaacaaaggugagcuugcccaggacuuggcauuuccaaaucaaagu

SEQ ID NO: 363545 - RNA, 64 nt, Human
cacuuugggaggccgaggcgggaggaucacuugagcccaggaguucaagaccagccugggcaac

SEQ ID NO: 363546 - RNA, 64 nt, Human
ccaggagugggucgcccacggguguggcucgggugcccaggacggucugugcccgagguuccug

SEQ ID NO: 363547 - RNA, 64 nt, Human
gguuuccagcuguuucuccaguggcauugccauugcccaggaggggcccagucaccaugagagc

SEQ ID NO: 363548 - RNA, 62 nt, Human
uuuuauuaccaagacauuaaaguagcauggcugcccaggagaaaagaagacauucuaauucc

SEQ ID NO: 363549 - RNA, 64 nt, Human
cagauacuugggaggcugagauaggaucacuugggcccaggaguuugaggcugcagugagccau

SEQ ID NO: 363550 - RNA, 64 nt, Human
uuaccugggaggcugaggcaggagaaucucuugagcccaggaggcggagguugcagugagcuga

SEQ ID NO: 363551 - RNA, 64 nt, Human
cugaggacucugcaagugucuggagcggcugcucgcccaggaaggccuaggcuaggacguuggc

SEQ ID NO: 363552 - RNA, 64 nt, Human
ggaaacccuaagcacugcugcccauggggacacggcccaggacagcccgggggcccugcagcuu

SEQ ID NO: 363553 - RNA, 64 nt, Human; identical to SEQ ID NO: 275106

SEQ ID NO: 363554 - RNA, 64 nt, Human; identical to SEQ ID NO: 275107

SEQ ID NO: 363555 - RNA, 64 nt, Human; identical to SEQ ID NO: 275114

SEQ ID NO: 363556 - RNA, 64 nt, Human; identical to SEQ ID NO: 275119

SEQ ID NO: 363557 - RNA, 64 nt, Human
gguggcagcaggaugguggguguucagccugaaugcccaggagcauuucuggggggcagcuaag

SEQ ID NO: 363558 - RNA, 64 nt, Human
cgcuauggaagaguguccacugaggcugcacauggcccaggaguggcaccauguugcagggaca

SEQ ID NO: 363559 - RNA, 64 nt, Human
cacuuugggaggccgaguugggagguuugcuugagcccaggaguuccagaccagccugggcaac

SEQ ID NO: 363560 - RNA, 64 nt, Human
aagcucaguuugaaaaggguuuauucccaucacugcccaggacacccuguggcuuuacuugcuc

SEQ ID NO: 363561 - RNA, 64 nt, Human
gaggcuccccccugcccugggccccuuccccacugcccaggagcccccauccuaagcuccaagc

SEQ ID NO: 363562 - RNA, 64 nt, Human
cagcuccccaccugcccugcacucugcccucuuugcccaggauacugaggagggcuggagcucg

SEQ ID NO: 363563 - RNA, 64 nt, Human
agcuugggccacugccugggacccagcagacacugcccaggacucuuuagugcacucacucuug

SEQ ID NO: 363564 - RNA, 64 nt, Human
cccuggguggacagcaauagaaaagggggcagacgcccaggaagugaccuucuccuggaugagc

SEQ ID NO: 363565 - RNA, 64 nt, Human
guggcugacaagggacuagugagucagcaccuuggcccaggagcucugcgccaggcagagcuga

SEQ ID NO: 363566 - RNA, 64 nt, Human
acucugcgacgauccccauggaacagcccugcacgcccaggaugaaggggccagaccacgcccc

SEQ ID NO: 363567 - RNA, 64 nt, Human
uuuucuauuuauaaucuacgccagaaggccgggugcccaggagcugaaggugggggugacacug

SEQ ID NO: 363568 - RNA, 64 nt, Human
agagccgccaguguuucucagggaugugacugaggcccaggagggaccugugagggucuguuua

SEQ ID NO: 363569 - RNA, 64 nt, Human
gcccgugcccccucugacagccauccuccugggagcccaggaaggcauccacgagggagcuccu

SEQ ID NO: 363570 - RNA, 61 nt, Human; identical to SEQ ID NO: 275120

SEQ ID NO: 363571 - RNA, 64 nt, Human
gcgcagugguugcuguccucucauuugcagucagcgccagcacuguauuccugucauugcgagu

SEQ ID NO: 363572 - RNA, 64 nt, Human
uuuggcaacugcagguaaccccagucagccaugucgccagcacaggucuaugucgagggaaugg

SEQ ID NO: 363573 - RNA, 64 nt, Human
auacguacauucaucccuuaauguucucaaggaggcccaggauccccaaaauauuauaagcauu

SEQ ID NO: 363574 - RNA, 64 nt, Human
gcugcagcccugaaggccccuggccuagccuggagcccaggaccuaaguccaccucaccuagag

SEQ ID NO: 363575 - RNA, 64 nt, Human
uuccuuuggggguaugauguggaagcugguuucagcccaggacccaccacugaggagaggaucu

SEQ ID NO: 363576 - RNA, 64 nt, Human
gccuggaccuuguucccugggggugggggcgcuugcccaggagagggaccaggggugcgcccac

SEQ ID NO: 363577 - RNA, 64 nt, Human
gcuuauuuuuuuuaaaaagaaaacacaucuaaaagcccaggaacugauuuuuuuaagaggaaaa

SEQ ID NO: 363578 - RNA, 64 nt, Human
uucuuucauaaaggaccucauuccuugcgucccagcccaggaacagugcugucuuugcugucuu

SEQ ID NO: 363579 - RNA, 64 nt, Human
cacuuugggaggccaaggcagggggauuacuucagcccaggaguuccagacugccuggcuaaca

SEQ ID NO: 363580 - RNA, 64 nt, Human
guaaugcacauccucauucacuaagccaugccaugcccaggagacugguuucccggugacacau

SEQ ID NO: 363581 - RNA, 64 nt, Human
agcagaggccuuucccucagacaagcuacaaagugcccaggaugccauccaccaugguccccuu

SEQ ID NO: 363582 - RNA, 64 nt, Human
caggaacuggugcuguacuggguacacaguaggcgcccaggacaaguggguugcaagacaggaa

SEQ ID NO: 363583 - RNA, 64 nt, Human
uccccuucagcacaccccagcuucugaccucagagcccaggagcugcguggacaguguggggug

SEQ ID NO: 363584 - RNA, 64 nt, Human
agaaccuucaacccagugggucugggauauggcugcccaggagacagaccacuugccacgcugu

SEQ ID NO: 363585 - RNA, 64 nt, Human
cuacucccaaggcugaggcaggagaauugcuugagcccaggaguuuaagguuguagugcgcuag

SEQ ID NO: 363586 - RNA, 64 nt, Human
auuuucuaccugaaauuggaagacuuggugccaccgccagcaauaauugacaaacuuuuccugg

SEQ ID NO: 363587 - RNA, 64 nt, Human
uuuguauuuuuaguagagacggguucaccauguugcccaggagggucucgaacuccuggccuca

SEQ ID NO: 363588 - RNA, 64 nt, Human
ccucuccuuugcuuuccucgggaugccacucugugcccaggacgguucugagacugaacacuga

SEQ ID NO: 363589 - RNA, 64 nt, Human
cccgcuggugggcugagccacaaggcccccgauggcccaggagcagaugggaggaccccgaggc

SEQ ID NO: 363590 - RNA, 64 nt, Human
aguucugaggucccuguguguaggcuggggcggggcccaggagaccacggggagcaaaccagcu

SEQ ID NO: 363591 - RNA, 64 nt, Human
ccaccccacccucagcgucucugccccuaaggcagcccaggaaauaggaacugagacucuggua

SEQ ID NO: 363592 - RNA, 64 nt, Human
uugaaccuggaggugccaaaaaagccagcugcgggcccaggacagcugccgugagacucccgau

SEQ ID NO: 363593 - RNA, 64 nt, Human
ccugaggagcagggucugcccuggcaugagcagagcccaggauggggucagggucaggcccugc

SEQ ID NO: 363594 - RNA, 64 nt, Human
gaguggaggcagaggagugaggcccacgggcagcgcccaggagcccaccuuccccucuggccca

SEQ ID NO: 363595 - RNA, 64 nt, Human
agccugaagaagacaagauuucuggacaagcucagcccaggaaacaaaggguaaacaaaaaacu

SEQ ID NO: 363596 - RNA, 64 nt, Human
caguuacuugggaggcugagacaggauugcuuaagcccaggaguuugagucuguaaugcacuau

SEQ ID NO: 363597 - RNA, 60 nt, Human
gucccaaggucuucccuugaagccacuggcgcccaggagcggugggccgaagacgugccc

SEQ ID NO: 363598 - RNA, 64 nt, Human
ugcaggucccccggcaucucucucugucccggcagcccaggauggccuggugcccccaccugcu

SEQ ID NO: 363599 - RNA, 64 nt, Human
cagacuuccacugauggaagagcugaaaacacaagcccaggagugcagacacugcccuaauugc

SEQ ID NO: 363600 - RNA, 64 nt, Human; identical to SEQ ID NO: 275027

SEQ ID NO: 363601 - RNA, 64 nt, Human; identical to SEQ ID NO: 275028

SEQ ID NO: 363602 - RNA, 64 nt, Human; identical to SEQ ID NO: 275053

SEQ ID NO: 363603 - RNA, 64 nt, Human; identical to SEQ ID NO: 275054

SEQ ID NO: 363604 - RNA, 64 nt, Human
cacuuugggaggcugaggcggguggauugcuugagcccaggaguuugagaccagccuggccaac

SEQ ID NO: 363605 - RNA, 64 nt, Human
guaccuuuuugcguaauguuugggauauucaguagcccaggauugcuacaaaaagguccuuuga

SEQ ID NO: 363606 - RNA, 64 nt, Human
cacgcugcacuuaauggacuggacucuugccauggcccaggagucagguguuuggagcgaggca

SEQ ID NO: 363607 - RNA, 64 nt, Human
uccagauaaauaaccauacacugaccucauacuugcccaggacccauuaaaguugcgguauuua

SEQ ID NO: 363608 - RNA, 64 nt, Human
agacuccuguugggacacaguuggucugcagucggcccaggacggucuacucagcacaacugac

SEQ ID NO: 363609 - RNA, 64 nt, Human
uggguuaucaugguuggcuuagguaccucagguggcccaggagguccccccuccauaaggacgu

SEQ ID NO: 363610 - RNA, 64 nt, Human
cugccuccccuccaccccugccucuccuccacccgcccaggagagccccaccuccuccaccccu

SEQ ID NO: 363611 - RNA, 52 nt, Human
acaucaccucucucuccuagacgcccaggaccggcccugugagccgugcugg

SEQ ID NO: 363612 - RNA, 64 nt, Human
gacaagugcaauuccuuccaugucgccccagagugcccaggaggcaggcagugcggggugccca

SEQ ID NO: 363613 - RNA, 64 nt, Human
ccacucaggaggcugaggcaggaggauugcuugagcccaggaguucgaggcugcagucagucau

SEQ ID NO: 363614 - RNA, 64 nt, Human
gaagcccaagugaaaucaaaggugcuaaauggucgcccaggagacauccguugugcuugccugc

SEQ ID NO: 363615 - RNA, 64 nt, Human
ugggcuacucuggaggcccuugaggaucacuugagcccaggagauugaggcugcagugagccau

SEQ ID NO: 363616 - RNA, 64 nt, Human
uaaucccagcacuuugaggugggcaauggcuugagcccaggaguucgacaccagccuggccaac

SEQ ID NO: 363617 - RNA, 52 nt, Human; identical to SEQ ID NO: 275090

SEQ ID NO: 363618 - RNA, 64 nt, Human; identical to SEQ ID NO: 275091

SEQ ID NO: 363619 - RNA, 64 nt, Human
acucugugaagugcaguucuucuccaccuaggaccgccagcagagcggggggaucucccugccc

SEQ ID NO: 363620 - RNA, 64 nt, Human
cccagcugcugcuggcugggugggccagggagcccgccagcagaccccacacagcauguccgcc

SEQ ID NO: 363621 - RNA, 64 nt, Human
cugcucaggaggcugaggcaggaggaucucuugagcccaggauuuugaauccaucguggacaac

SEQ ID NO: 363622 - RNA, 64 nt, Human
ccauugucccaggucugagcggaggggagggggcgcccaggagggguggggaggggggcgagga

SEQ ID NO: 363623 - RNA, 64 nt, Human
ggaaauauccuucauggccacagaaauggagggcgcccaggauccaggcagccaccgggaacag

SEQ ID NO: 363624 - RNA, 64 nt, Human
agggggugaugaaaaggggaggggcggagcuccugcccaggagaggggcuguggggccccagga

SEQ ID NO: 363625 - RNA, 64 nt, Human
agaaugauguaacugccaggacacuuuuguguuugcccaggacuccuaguaagaauugaaucuu

SEQ ID NO: 363626 - RNA, 64 nt, Human
ggcccugccccaaguagcccagaagccuccggcggcccaggauucuaaggaugcaauccucgag

SEQ ID NO: 363627 - RNA, 64 nt, Human
agaccaagcuuguccaacccgaggcccgcaugcggcccaggauggcuuugaaugcggcccaacg

SEQ ID NO: 363628 - RNA, 64 nt, Human
cucucagcagcgcuggugggcucuuuguccuggugcccaggagcccuccagcccccugcccaca

SEQ ID NO: 363629 - RNA, 64 nt, Human
cuacucgggaagcugaggcaguaagaucacuugagcccaggaggccgaugcugcagugaacugu

SEQ ID NO: 363630 - RNA, 64 nt, Human
cacuuugggaggccgaggggggcagaucacuugagcccaggaguucgagagcagccugggcaac

SEQ ID NO: 363631 - RNA, 64 nt, Human
ucugagccaacugggguggguggggcagugcuuggcccaggaguuuggccagaagucaaggcuu

SEQ ID NO: 363632 - RNA, 64 nt, Human
ccucucucuaggguacauggugcugggagaggcagcccaggaagucucaucuggggagcaggca

SEQ ID NO: 363633 - RNA, 64 nt, Human
uucuagagagauguauuuaugagggugauaacuagcccaggauugauuucuuuccuaaaguccc

SEQ ID NO: 363634 - RNA, 64 nt, Human; identical to SEQ ID NO: 275048

SEQ ID NO: 363635 - RNA, 64 nt, Human; identical to SEQ ID NO: 275049

SEQ ID NO: 363636 - RNA, 64 nt, Human
aggaaaagcacaaggacugccgccuucucgcucccgccagcagcauagacuggacuggaccaga

SEQ ID NO: 363637 - RNA, 64 nt, Human
acacucaguggugccccugcaguugggugggguacgccagcaaaggaucaguuuggcugccuua

SEQ ID NO: 363638 - RNA, 64 nt, Human
aauuucucucuaaagcaagcuuguccaacccuuggcccaggacggcuuugaauauggcccgaca

SEQ ID NO: 363639 - RNA, 64 nt, Human
cuacucuggaagcugaagcagcaagaucacuugagcccaggaguuuaagaccagccugggcaac

SEQ ID NO: 363640 - RNA, 64 nt, Human
ugcuaaccaccugcccagaagaguggaucucacagcccaggaacauucccaagcaggaaaaccg

SEQ ID NO: 363641 - RNA, 64 nt, Human
cggcuucagacacucccagcgcccacucuuacaggcccaggacuggagcuuucucuggccaagu

SEQ ID NO: 363642 - RNA, 64 nt, Human
gcccacgcugacuacagggccgccggcaauaaaagcccaggagcccauuuggagggccugggcc

SEQ ID NO: 363643 - RNA, 64 nt, Human
uuagcuggauaugggaggggguuuggcugccugugcccaggagcuagacugccuugaggcugcu

SEQ ID NO: 363644 - RNA, 64 nt, Human
ucaucuucuggcagcagaaauccaugaagcccgggcccaggaaaauuagaaguuuuccauuccu

SEQ ID NO: 363645 - RNA, 64 nt, Human
ugacuauuccuuagccuuauagauuucuaguacugcccaggaaaucuaauuucaauacauuuau

SEQ ID NO: 363646 - RNA, 64 nt, Human
cugugcagaaauuaaauuuuauuuucagcauuuagcccaggaauucuuccaguaggugcucagc

SEQ ID NO: 363647 - RNA, 64 nt, Human
ccugaggcccuuaaguacaucgcuuucugguggugcccaggaggcugcugcugggccgcugggu

SEQ ID NO: 363648 - RNA, 64 nt, Human
ggugccguggguucuccagagaccccagcaacuggcccaggaugcaggcugcucuagagaccaa

SEQ ID NO: 363649 - RNA, 64 nt, Human
uuuaugaaguuagugcgggcuuugcugcucccuggcccaggaaagagggacuaccugacccuca

SEQ ID NO: 363650 - RNA, 64 nt, Human
ugagagaaaugcccguauuaggaggauuacuugagcccaggaggucaaagcugaggugagccau

SEQ ID NO: 363651 - RNA, 50 nt, Human; identical to SEQ ID NO: 302493

SEQ ID NO: 363652 - RNA, 64 nt, Human
gugcccauccccccucagauccagacaugccccucccccgcagacacaccccaaggcagcccaa

SEQ ID NO: 363653 - RNA, 64 nt, Human
ccaaacccagaugccugaggccuggcuggggcugcccccgcaggacacuguggccaugccacgg

SEQ ID NO: 363654 - RNA, 64 nt, Human
uuuuuuaaccccaauuauccuucucucucuccugcccccgcaucccacucccagggugucacga

SEQ ID NO: 363655 - RNA, 64 nt, Human
gccccccugccagcuauugacacagcugcgaagugcccaggaagaggagaaccggcagcugcug

SEQ ID NO: 363656 - RNA, 64 nt, Human
guggcgccauggauuccucugggggcuggcgcaugcccaggaaagccugggccacacgggacac

SEQ ID NO: 363657 - RNA, 64 nt, Human
ggucacuguccuguaaugucucccggucagggcagcccaggacugcccagccuggugggcuggg

SEQ ID NO: 363658 - RNA, 64 nt, Human
caaauccauagaaagacaaacggccaccuugggugcccaggauacuggugccuggccccacgua

SEQ ID NO: 363659 - RNA, 64 nt, Human
cacuuuaggaggcugaggcaggaggacuguuugagcccaggaguuugagaccaaccugaguaag

SEQ ID NO: 363660 - RNA, 64 nt, Human
gagggaugcguccuacccgcgccaucgccccguggcccaggacggggaccuccccuuaguccgu

SEQ ID NO: 363661 - RNA, 64 nt, Human
gcuccugacagggaugcucaugcccagaaagcaagcccaggagaggaaggcagagugugacaga

SEQ ID NO: 363662 - RNA, 64 nt, Human
cccucccccuaacugcaugacauguuaacugugugcccaggacagccgugguggggaccgggua

SEQ ID NO: 363663 - RNA, 64 nt, Human
ucucgcugaugcugggcugggugcgaccccaucugcccaggacggggccggccaggugggcggg

SEQ ID NO: 363664 - RNA, 64 nt, Human
gcugucagggggcagaagcgggaggauagcuugagcccaggagugcaagaccugccugggcaau

SEQ ID NO: 363665 - RNA, 64 nt, Human
cuguuacuccacagcggaggagaccagcucagaggcccaggaaucggagcgaagcagagaggug

SEQ ID NO: 363666 - RNA, 64 nt, Human
ugcuggagccaaggguaggagcccuacacuaggagcccaggaugggacggcgcaucagccgaga

SEQ ID NO: 363667 - RNA, 64 nt, Human
uccuccuguggagggugugacccugucugccguggcccaggacucgcccgcccaccugccuuca

SEQ ID NO: 363668 - RNA, 64 nt, Human
gguugagugcagaagggugcgccucuucccucuacccccgcaccaccugcugugugccagccug

SEQ ID NO: 363669 - RNA, 64 nt, Human
ugggggugcugcggcuacaccaccacccgcgcggcccccgcagccuagaccucccaggccugug

SEQ ID NO: 363670 - RNA, 64 nt, Human
gcuuuccccagcaccccagagccagucgggacaccccccgcagcccguccugguggcuguggaa

SEQ ID NO: 363671 - RNA, 64 nt, Human
ccucccugaggaacagccaggaccccaucugccacccccgcagcagugacccccacccagggcc

SEQ ID NO: 363672 - RNA, 64 nt, Human
gcaagcuuccaacccggcccaagggccgcauguggcccaggauauggcuuugaauggggccuaa

SEQ ID NO: 363673 - RNA, 64 nt, Human
guucuccucuggggccugauccaccucuacaccagcccaggaagccccaucugugccugcccuc

SEQ ID NO: 363674 - RNA, 64 nt, Human
gcaccugguucuccgaugccugggcuggugucaggcccaggacuguagugcugggagcaguaaa

SEQ ID NO: 363675 - RNA, 64 nt, Human
cuacuuggggugcugaggcgggaggauuacuugagcccaggaggauuacuucaaccugggaggu

SEQ ID NO: 363676 - RNA, 64 nt, Human
gcacuuuggaggccaaggcaggaggacugcuugagcccaggaguuugagaccagccugggcaau

SEQ ID NO: 363677 - RNA, 64 nt, Human
uguagucccaggcugaggcaagagaauuacuugagcccaggaguuugaauccauccugggcagc

SEQ ID NO: 363678 - RNA, 64 nt, Human
cacuuugggagguugagguagguagauugcuugagcccaggaguuagagaccagccugggcaac

SEQ ID NO: 363679 - RNA, 64 nt, Human
acuccugccccccaacaaugccaugagcugcuuagcccaggagaccugggagcuauggcaggac

SEQ ID NO: 363680 - RNA, 64 nt, Human
cacuuugggaggccgaggcaggaagacugcuugagcccaggaguucaagaccagccugggcaac

SEQ ID NO: 363681 - RNA, 64 nt, Human
cuacucaggagguugaggugggaagauugcuugagcccaggaguuugagguugcagugagcuga

SEQ ID NO: 363682 - RNA, 64 nt, Human
ugcuuugggaggccauagcaggaggauugcuugagcccaggaguucgagaccagccagagcaac

SEQ ID NO: 363683 - RNA, 64 nt, Human
cuacuugggagguugaggugggaggauugcuugagcccaggauuucaaggcugcagugagccau

SEQ ID NO: 363684 - RNA, 64 nt, Human
cucugggagugggggcuccagcccuccccacuaugcccaggagucuucccaaguugaugcgguu

SEQ ID NO: 363685 - RNA, 64 nt, Human
uuuucuucagacugaggccuuuugguagucggagcccccgcagucgucagccucccugacgucu

SEQ ID NO: 363686 - RNA, 64 nt, Human
uggcccaguagagcaaggcagacagugaccuccacccccgcagcccucuuaaaaggccaguacu

SEQ ID NO: 363687 - RNA, 64 nt, Human
aagccacagagauagagcugaggaguccuguguucccccgcaaggagcaccccgggaucauuuu

SEQ ID NO: 363688 - RNA, 64 nt, Human
uauaccuuggcucuuccuuuuuuucuccugcuuccccccgcaccuuguggggaagcuucagggg

SEQ ID NO: 363689 - RNA, 64 nt, Human
uggaaguggccucauggaugaauccgggguaugagcccaggagaacgugcugcuuuugguaacu

SEQ ID NO: 363690 - RNA, 64 nt, Human
cucagagaagaccacaccaaggaggcggccgcuggcccaggagagaacacggggagguuuguuu

SEQ ID NO: 363691 - RNA, 64 nt, Human
cagaugaggaaggaacccccucaccaccugcccggcccaggagcgcagcugcauuugggguggg

SEQ ID NO: 363692 - RNA, 64 nt, Human
gcagggccgguguggggcuggagccaggcagcuagcccaggacggagcaagggaagaccccucc

SEQ ID NO: 363693 - RNA, 64 nt, Human
gccagccgacugcugacagcuugggagcugcugugcccaggacguggguucagcgugggcgagg

SEQ ID NO: 363694 - RNA, 64 nt, Human
guggcucagugagacuccugcugggaggguggaggcccaggaaugggcgggcaggacacccuca

SEQ ID NO: 363695 - RNA, 64 nt, Human
cagugagugggcagguuuggaggagccccgaguggcccaggaguccccccacacacagaugcau

SEQ ID NO: 363696 - RNA, 64 nt, Human
cugcagcugcuagcucagacaccaaagggguaaggcccaggacauucauaucuuuaaaagcugc

SEQ ID NO: 363697 - RNA, 64 nt, Human
gaccugaaccagagcuggagugaggaucaaacaggcccaggagccugaggaaauacccagucag

SEQ ID NO: 363698 - RNA, 64 nt, Human
gcuuauccaacccacggccugugggccgcauacggcccaggauggcuuugaaugcagcccaaca

SEQ ID NO: 363699 - RNA, 64 nt, Human
cuggagacauuccuagucgguauuccuggucgaagcccaggagccuuccuuuuuaacaagcuga

SEQ ID NO: 363700 - RNA, 64 nt, Human
acuuuugggagguccaggcaggaggaucacuugggcccaggaggucaagccugcagcgagcuga

SEQ ID NO: 363701 - RNA, 64 nt, Human
aggcacagaccuugugggacugggccccaggccugcccaggaugugguuuuccaaguccugacc

SEQ ID NO: 363702 - RNA, 64 nt, Human
acgauucagaacacaagaggagaaugagcuggagcgccagcaccacgauggccccaggacguug

SEQ ID NO: 363703 - RNA, 64 nt, Human
aguucuccuggaagggagguuuuugcuuuacccccgccagcacuuccgcacacaaucauagaga

SEQ ID NO: 363704 - RNA, 64 nt, Human
aaggggccccagccgcugcagcagcggagacagucgccagcagcugggcuggggugcaggucau

SEQ ID NO: 363705 - RNA, 64 nt, Human
cuacuccagaggcugaaaugggaggaucucuugagcccaggaguuggaguccaguccagccagg

SEQ ID NO: 363706 - RNA, 64 nt, Human
cuacugggugcugcccugcguggcugaccagcuggcccaggauuucacagucgaaaaggaagcc

SEQ ID NO: 363707 - RNA, 64 nt, Human
ucacccagacacacuagugcucuccagaaucucugcccaggaggcaggggaaaaaucuccuuuc

SEQ ID NO: 363708 - RNA, 64 nt, Human
ucuuccugucagucucaaagcacaaggagguucagcccaggaggaagccagcugcaauguggag

SEQ ID NO: 363709 - RNA, 64 nt, Human
cugccccggcugugccagggugagggagggccaagcccaggaggauuugucugagacauuucca

SEQ ID NO: 363710 - RNA, 64 nt, Human
uccgggaucccagaacucuggucuccaaauuacagcccaggacaccuuucucugccgccugcug

SEQ ID NO: 363711 - RNA, 64 nt, Human
acuuugagaggcugaggcagggcagauugcaugagcccaggaguucgagaccaacuugggcaac

SEQ ID NO: 363712 - RNA, 64 nt, Human
gggugccaagcugugaugagagggccaccgcagagcccaggaggcagcaucuccagagcuggcc

SEQ ID NO: 363713 - RNA, 64 nt, Human
caugcucugagaagaggagcccucaucuugaagggcccaggagggucuauggggagaggaacuc

SEQ ID NO: 363714 - RNA, 64 nt, Human
agaagccaagacaguggcagcaaaggaagacuuggcccaggaaaaaccuguggguugugcuaau

SEQ ID NO: 363715 - RNA, 64 nt, Human
ggagucuuuuuuuccucugcccugaucaacuggggcccaggaaaagcaaugucucuucacgggc

SEQ ID NO: 363716 - RNA, 64 nt, Human
ccagggcugcaggcaaagcuggacaugugcccuggcccaggaggccauguugggcccucguuuc

SEQ ID NO: 363717 - RNA, 64 nt, Human
cggggugucugguacccccccggcguggugcuuagcccaggacuuucagacgcggccgcuggcc

SEQ ID NO: 363718 - RNA, 64 nt, Human
uugccccaaagcuggaaauucaucacaaccugaggcccaggaucugcucugugccgguccucug

SEQ ID NO: 363719 - RNA, 64 nt, Human
cuauuugggaagcugaggugggagggucgcuugagcccaggaguuugaggcugcagugagcuau

SEQ ID NO: 363720 - RNA, 64 nt, Human
uggcuggguuucagcaauuccugcagagccugcagcccaggacgacugaaggugaggcaggagg

SEQ ID NO: 363721 - RNA, 64 nt, Human
gggcaaggagccaaggaccacagagccucagccagcccaggauccguccucauuuuauugguga

SEQ ID NO: 363722 - RNA, 64 nt, Human
gucccuguccagucaccuuuccaucagggcacuagcccaggaaugacuccucacacuuucaccu

SEQ ID NO: 363723 - RNA, 64 nt, Human
aaagacacacacacauacaugauaaugauucccagcccaggagcugaggggugagggcugggga

SEQ ID NO: 363724 - RNA, 64 nt, Human
gcagcagaaacugaauagguuccagagacuuuuggcccaggaggaauauuuacuuuuagcucug

SEQ ID NO: 363725 - RNA, 64 nt, Human
gcugguuccgagcugacacccgucuuaacaaaaggcccaggagugccucuuccaaacaaaaaca

SEQ ID NO: 363726 - RNA, 64 nt, Human
gcaaguacagccacuguaaauaacccucgucccugcccaggaacccagacuggacuucagucuc

SEQ ID NO: 363727 - RNA, 64 nt, Human
ccaagaaggucauuuccaaacccauccuggaagggcccaggauccaaaggucaucaguccugcu

SEQ ID NO: 363728 - RNA, 64 nt, Human
acaagcccauaugaagagcugggggcggaugguggcccaggagacagcacaccaccaggcucca

SEQ ID NO: 363729 - RNA, 64 nt, Human
cuagagcuugccucacccgcuguagccgccgagagcccaggauguacuggcggauggggccugc

SEQ ID NO: 363730 - RNA, 64 nt, Human
cugagcagggccggggaacuggccaagcugaggugcccaggagaagaaagaggugaccccaggg

SEQ ID NO: 363731 - RNA, 64 nt, Human
uguguguugugugcaggaucuguuugcccacucggcccaggaggucagcagucuguucuuggcu

SEQ ID NO: 363732 - RNA, 64 nt, Human
ggacgcaacugugagcugaggugugagccuaggagcccaggaccccugaccccggccgcugcug

SEQ ID NO: 363733 - RNA, 64 nt, Human
cacuuugggaggcugaggcaggaggaucacuugagcccaggaguucaagaccagccugggaaca

SEQ ID NO: 363734 - RNA, 64 nt, Human
gagcuccugcuuagggaaggucagcaggcacugugcccaggaagagccugcggccucggcgucc

SEQ ID NO: 363735 - RNA, 64 nt, Human
ccgugaucugccaggcucgugggcacuuuccacagcccaggagagcuucugaaaggacaguaua

SEQ ID NO: 363736 - RNA, 64 nt, Human
agacuccugccacgccuuccauccagaggagaaugcccaggacugcggcggcgccucggacacc

SEQ ID NO: 363737 - RNA, 64 nt, Human
gcugcaagaccguguaaaugagcuccaggaggaagcccaggaggcugaugccugccaggaggag

SEQ ID NO: 363738 - RNA, 64 nt, Human
ccacucaggaggcugaugcaagaggaucgcuugagcccaggaguugaaguccagccuaagcaac

SEQ ID NO: 363739 - RNA, 64 nt, Human
aauacugggaagccaaggugggaguaucgcuugagcccaggaguuugagaccgacaugggcaac

SEQ ID NO: 363740 - RNA, 64 nt, Human
cagcacuuugggcugaagcaggcagauauuuugagcccaggaccagccugggcaacauggugaa

SEQ ID NO: 363741 - RNA, 64 nt, Human
gaaaacacucaaauuuauuuugcaacaagugagagcccaggagaccuccuuauuauccugucuc

SEQ ID NO: 363742 - RNA, 64 nt, Human
accucguccucccccugccagugccuuaccuccugcccaggagagccagcccucccuguccucc

SEQ ID NO: 363743 - RNA, 64 nt, Human
cuaaggaagaagucugaggcagacggugaggguggcccaggagccauggccucacacagacccg

SEQ ID NO: 363744 - RNA, 64 nt, Human
aggccgagugacagccagcccuggaaccccccgacccccgcagcugcugcagccagugugccag

SEQ ID NO: 363745 - RNA, 64 nt, Human
aggcccuucacauuuuuggccuggguggggcugggcccaggaaggggugggcuggauuuuguaa

SEQ ID NO: 363746 - RNA, 64 nt, Human
cacuuugggaagacaaugugggagaauggcuugagcccaggaguucaagaccggccugagcaac

SEQ ID NO: 363747 - RNA, 64 nt, Human
gccuggcccuccccuccuuggcauucaugggggagcccaggaaccccccacaccuaugggguua

SEQ ID NO: 363748 - RNA, 64 nt, Human
cacuuugggaggcugaagcaggaggaucacuugagcccaggaguucaagaccagcuugggcaac

SEQ ID NO: 363749 - RNA, 64 nt, Human
uguccaagugcuuggcgugggacccaugaccaaagcccaggauggcuuggugggagugucccug

SEQ ID NO: 363750 - RNA, 64 nt, Human
cuagauucuuaccuccccaaaagcagcauauuaggcccaggacauaccugaaggcuggucgacu

SEQ ID NO: 363751 - RNA, 64 nt, Human
augccaucauccaccauuuaguaaaauguagcuggcccaggacauguaaaaaaaaaaaaaaaac

SEQ ID NO: 363752 - RNA, 64 nt, Human
agcaggcuuuccuucgcgccuccgcguccacccagcccaggaggaagacugcucugagcgugcg

SEQ ID NO: 363753 - RNA, 64 nt, Human
uuauuagggaagcugaggugggaggauagcuuaagcccaggauuucaaggcugcauugagcuau

SEQ ID NO: 363754 - RNA, 64 nt, Human
gcaguggcagaaaagugaccacucugcaggcugggcccaggaugugguguccugagauaguuuu

SEQ ID NO: 363755 - RNA, 64 nt, Human
auguuucagguuuuggucaauacuugacaagggugcccaggacaggaagacguguacugcugag

SEQ ID NO: 363756 - RNA, 64 nt, Human
cacuuugggaggcugaggugggaggacugcuugagcccaggaguucaagaucagccugggcaac

SEQ ID NO: 363757 - RNA, 64 nt, Human
ggaaaagcacacgcaugcgccucagcaaauggcagcccaggagcuguuuguccaguuuagcaug

SEQ ID NO: 363758 - RNA, 64 nt, Human
uuccccugugauccguaaggccggcggcucggggcccccgcagcagcagcagcagcagcagcag

SEQ ID NO: 363759 - RNA, 64 nt, Human
ugggguuuguugaugaaccuccacccccaccccacccccgcacgccuguaaucccagcacuugg

SEQ ID NO: 363760 - RNA, 64 nt, Human; identical to SEQ ID NO: 275026

SEQ ID NO: 363761 - RNA, 64 nt, Human
gugcugggauuacaggcgugagccaccgugcccggcccaggacuuuuaaaacaagcaucccagg

SEQ ID NO: 363762 - RNA, 64 nt, Human
gguucucaacuccuuaauuuauacucucucaaaugcccaggauacucuacccacuuaagaaccu

SEQ ID NO: 363763 - RNA, 64 nt, Human
cucuucugucuuugguggaugggaugguggcaaagcccaggaucuggcuuugccagagguugca

SEQ ID NO: 363764 - RNA, 64 nt, Human
acuaacggcuuauaugaacagaaaguacuguguagcccaggaguuuauuuagcaagauaaauag

SEQ ID NO: 363765 - RNA, 64 nt, Human
ccagacgugauggcacauaccuguaauccaagcugcccaggagcugaggccggagaaucgcuug

SEQ ID NO: 363766 - RNA, 64 nt, Human
cacugugggagaccacggugggggaaucccuugagcccaggaguuggagagcaacaucacaaca

SEQ ID NO: 363767 - RNA, 64 nt, Human
guagaccuucagagucagaaugucugguuguugggcccaggagucuucauguuaauaagcuucu

SEQ ID NO: 363768 - RNA, 64 nt, Human
agcaacucggggcugaggugggaggauugcuucagcccaggaguuugagaccagccugggcaac

SEQ ID NO: 363769 - RNA, 64 nt, Human
uacucagggagguugaggcagcaggauugcuggagcccaggaaauugaggcugcagugagccau

SEQ ID NO: 363770 - RNA, 64 nt, Human
ugggaauggaagauuuucucugcaguuugcugaggcccaggaggggcgcuauucaaagcugcac

SEQ ID NO: 363771 - RNA, 64 nt, Human
gcaaggaaacaggcuccaagaggcugaggacuuugcccaggaugacauagccaauggacaagca

SEQ ID NO: 363772 - RNA, 64 nt, Human
uggagcccgugcccuaccacacaucuguggagaugcccaggauuugacucgggccuuagaacuu

SEQ ID NO: 363773 - RNA, 64 nt, Human
aggagugggggcggcugcguagcuguggucccaggcccaggagccugagggggugucuagguga

SEQ ID NO: 363774 - RNA, 64 nt, Human
ccgggcugggccccuccaggagucacagaugaggcccccgcagagacuggugaguggugacccu

SEQ ID NO: 363775 - RNA, 64 nt, Human; identical to SEQ ID NO: 362112

SEQ ID NO: 363776 - RNA, 64 nt, Human
uggggacagcccuccugggaaucuacauuguguucccccgcauuccaggcucagggucugagga

SEQ ID NO: 363777 - RNA, 64 nt, Human
uuucacaugcagaagagaaaaggccccccuccaccccccgcauucccugccgagugagagccag

SEQ ID NO: 363778 - RNA, 64 nt, Human
cacuuugggaagccaaagcugauggaucgcuugagcccaggaguuugagaccagccugggcaac

SEQ ID NO: 363779 - RNA, 64 nt, Human
cagccaggaccgggccuuccugcgccgcuugcuugcccaggagugugccguguguggcugggcc

SEQ ID NO: 363780 - RNA, 64 nt, Human
ggggguccagauuccuuaggagcuuugggaugaggcccaggaggcugcauuuuuccagguccuu

SEQ ID NO: 363781 - RNA, 64 nt, Human
uaaguuugcaauaacagaguacacaaguauaguggcccaggauguagugaaagaacaaauccua

SEQ ID NO: 363782 - RNA, 64 nt, Human
auuuagaacugccaaaguauauguucagcagugugcccaggauugaagguguaaaugggacaaa

SEQ ID NO: 363783 - RNA, 64 nt, Human
uggcagccccaggugggagcugggaggguccccagcccaggagguggcuggauugcagggcugg

SEQ ID NO: 363784 - RNA, 64 nt, Human
aaagaaagauuacguugaugaaaaagaacauccugcccaggacccaucauacauauuuucaaga

SEQ ID NO: 363785 - RNA, 64 nt, Human
gaugcccccacccaccucgguccagcgcggcccugcccaggaggcggcagccgggcgcacccuc

SEQ ID NO: 363786 - RNA, 64 nt, Human
guaaggauugagggacaguugcuuuucagcaugggcccaggaaugccaaggagacaucuaugca

SEQ ID NO: 363787 - RNA, 64 nt, Human
aguguggcuggguucgggaccccacagggccauugcccaggagaaugaggagccucccugcagu

SEQ ID NO: 363788 - RNA, 64 nt, Human
cuacuugggaggccaaggcaggaggauuacuugagcccaggaguuugaggcugcaaugaacuau

SEQ ID NO: 363789 - RNA, 64 nt, Human
aucaggccucaagugggcaugggggcagggacgggcccaggaacuguuguuuucucaggauucu

SEQ ID NO: 363790 - RNA, 64 nt, Human
uacuuaggagguugaggcugggaggaucacuugagcccaggagucugaggcuuuagugaucuaa

SEQ ID NO: 363791 - RNA, 64 nt, Human; identical to SEQ ID NO: 275023

SEQ ID NO: 363792 - RNA, 64 nt, Human; identical to SEQ ID NO: 275024

SEQ ID NO: 363793 - RNA, 64 nt, Human; identical to SEQ ID NO: 275030

SEQ ID NO: 363794 - RNA, 64 nt, Human; identical to SEQ ID NO: 275031

SEQ ID NO: 363795 - RNA, 64 nt, Human
ugccugccaacccccucccucaaggaauggccuugcccaggaaugcccaccacacauacccucu

SEQ ID NO: 363796 - RNA, 64 nt, Human
uugugguguagugggggcugggugggguggcuccgcccaggaggcggcugcacgguucucugca

SEQ ID NO: 363797 - RNA, 64 nt, Human
uauuccagguauaugaguagaccagugaugaguggcccaggacucuaugacccuacaaccauca

SEQ ID NO: 363798 - RNA, 64 nt, Human
cauuuaucauggaugaaagagaucuguaaaaccugcccaggaacuuacagaauuuacuuugcag

SEQ ID NO: 363799 - RNA, 64 nt, Human
cauuuugggaggccacagugggcagauugcuugagcccaggaguugaagaacguggcgaaaccc

SEQ ID NO: 363800 - RNA, 64 nt, Human
agaaguccugcugaccaccuagucauggacaaaggcccaggaccagugacacccugcgucccug

SEQ ID NO: 363801 - RNA, 64 nt, Human
ugcugggauuaacgggugugagccacggcgcccagcccaggaagaguuuuuaaauuagagcucu

SEQ ID NO: 363802 - RNA, 64 nt, Human
caccaugcuggaggucacccagcacuguggcagcgcccaggagggcauagggcagccuaccacc

SEQ ID NO: 363803 - RNA, 64 nt, Human
ucagaccccugcuccagggccacuugaguugugggcccaggagcccugcggcugccggcaggug

SEQ ID NO: 363804 - RNA, 64 nt, Human
cacgaugggaggccaagacaggcagaucacuugagcccaggaguuugaggccagccugggcaac

SEQ ID NO: 363805 - RNA, 64 nt, Human
cuacucaggaggcaaagaugggaggauuacuugagcccaggaggucaaggcuacagugagccau

SEQ ID NO: 363806 - RNA, 64 nt, Human
uuccuccugagaguugaggccuguaaauacaagggcccaggacagagugugugcgugcgugugg

SEQ ID NO: 363807 - RNA, 64 nt, Human
cacuuugggaggccgaggcagguggaucgcuugagcccaggaguuuuaaguccagcuuggccaa

SEQ ID NO: 363808 - RNA, 64 nt, Human; identical to SEQ ID NO: 362111

SEQ ID NO: 363809 - RNA, 64 nt, Human
caccgcccccuccgccgccccuuccccagcccugcccccgcagacucccccugccgccaagacu

SEQ ID NO: 363810 - RNA, 64 nt, Human; identical to SEQ ID NO: 275039

SEQ ID NO: 363811 - RNA, 64 nt, Human; identical to SEQ ID NO: 275040

SEQ ID NO: 363812 - RNA, 64 nt, Human
cgagccagcaagaggaaggggugcugugaggcuugcccaggagcaagugaggccggagaggagu

SEQ ID NO: 363813 - RNA, 64 nt, Human
ugcuuugggaggcugaggugggaagauucuuugagcccaggaguucaaggcugcagugaauucu

SEQ ID NO: 363814 - RNA, 64 nt, Human
ggggcccccgugaggcugccgcagggcacugaaagcccaggaccaguaaccaaggagaacaacc

SEQ ID NO: 363815 - RNA, 64 nt, Human
cauuuuaggaggccaagguuggaggaucauuugagcccaggaauuggaaagcagccuggccaac

SEQ ID NO: 363816 - RNA, 64 nt, Human
augcccagagugaccaagcagcaccagcaggccugcccaggaugcugaaagcagauuucuucuu

SEQ ID NO: 363817 - RNA, 64 nt, Human
ucaauaagaaaauaggggugauggagggggagaagcccaggacugggagaaucgcacaugcccc

SEQ ID NO: 363818 - RNA, 64 nt, Human
gaaacgcccugugucucuggcuacagcaagaccagcccaggagcccaccagcaccugccucuca

SEQ ID NO: 363819 - RNA, 64 nt, Human
ggcccagacucugcuucggccaugauuugugacugcccaggacucucagguugggcuggcccua

SEQ ID NO: 363820 - RNA, 64 nt, Human
gagaagagcuuccaggacgcacccaggacgcugagcccaggagccugccaggcugacgugcauc

SEQ ID NO: 363821 - RNA, 64 nt, Human
ccuacccucgggcccaccuggccaccugaggugggcccaggaccagcuggggcguggggagggc

SEQ ID NO: 363822 - RNA, 64 nt, Human
gcgccugcaggaauauggcuccaucuucacgggcgcccaggacccuggccugcagagacgcccc

SEQ ID NO: 363823 - RNA, 64 nt, Human
uccacaagaguugggugaccagcuguccuaguuugcccaggacucucccuguuuuagcacugaa

SEQ ID NO: 363824 - RNA, 64 nt, Human
cagcuacuuguaaggcuguggcagaagugcuuuagcccaggagguugaggcugcagugagccau

SEQ ID NO: 363825 - RNA, 64 nt, Human; identical to SEQ ID NO: 275044

SEQ ID NO: 363826 - RNA, 64 nt, Human; identical to SEQ ID NO: 275045

SEQ ID NO: 363827 - RNA, 64 nt, Human; identical to SEQ ID NO: 275046

SEQ ID NO: 363828 - RNA, 64 nt, Human; identical to SEQ ID NO: 275047

SEQ ID NO: 363829 - RNA, 64 nt, Human
ggagguuaggacacgcaggaaagaccacaugaaggcccaggagugggagggggaauagccaucg

SEQ ID NO: 363830 - RNA, 64 nt, Human
aacuuuaggaggccaaggugggaggaucgcuugagcccaggaguuugagaccagccuggccaac

SEQ ID NO: 363831 - RNA, 64 nt, Human
aauugggagcugccaagagugaagggaagagacagcccaggauacuggcacagagguagucuca

SEQ ID NO: 363832 - RNA, 64 nt, Human
ggacagauccaggucugcagaucgacaccagugggcccaggaccuggggguggcuuuaaaugag

SEQ ID NO: 363833 - RNA, 64 nt, Human
ccagcaggaggaagcccaggagcuggguccugccgcccaggagcugggcccugccacccaggcc

SEQ ID NO: 363834 - RNA, 64 nt, Human
cacacuuccccaagggcggacccagcaggaggaagcccaggagcuggguccugccgcccaggag

SEQ ID NO: 363835 - RNA, 64 nt, Human
cccugcugaugagcccacucuaggagccccaguagcccaggagcuugggugugcugacgagcag

SEQ ID NO: 363836 - RNA, 64 nt, Human
gaggggccuccccgcaggcacuugcccccacugugcccaggagcucucuaggaggggccugggg

SEQ ID NO: 363837 - RNA, 64 nt, Human
ggcagggcucagccgcucccaccuccccacagaagcccaggaguguguggacgucugagcccag

SEQ ID NO: 363838 - RNA, 64 nt, Human
uuuuuuuuuuuuugagauggcaucuugcucugucgcccaggauggagugcaguggcgcgaucuu

SEQ ID NO: 363839 - RNA, 64 nt, Human
ggguggccaacuuggcaggacuuggccagcagcugcccaggacacagugcaggccagagcgggc

SEQ ID NO: 363840 - RNA, 64 nt, Human
cccaggacugagguccugagaaggggauagcacugcccaggacgugugucccuagccuggaaug

SEQ ID NO: 363841 - RNA, 64 nt, Human
guccagcugcccucuacgaucaggugcaggggcugcccaggacaaagcgggggcaggggaaaga

SEQ ID NO: 363842 - RNA, 64 nt, Human
uuagcacaagggcagugccuggacggacccggagcccccgcauaucagcaguucacccaguacu

SEQ ID NO: 363843 - RNA, 64 nt, Human; identical to SEQ ID NO: 362071

SEQ ID NO: 363844 - RNA, 64 nt, Human
guuaccucccacagaacgugguggacuccuucuucccccgcagcaugacccgguuuuaugccaa

SEQ ID NO: 363845 - RNA, 64 nt, Human
cagcagcgagaacaucccaccccucccccccccccccccgcagccagugcuccuugucaagcuc

SEQ ID NO: 363846 - RNA, 64 nt, Human
gcccccaccuccccaguaauuguuuccuuccguugcccaggacacuggcuggccuuccuucucu

SEQ ID NO: 363847 - RNA, 64 nt, Human
ccaagggcaauaauaagguggaauuugcaggucagcccaggaauuggcagaggaaguagguguc

SEQ ID NO: 363848 - RNA, 64 nt, Human
cuacucaggaggccaaggugggaggaucacuugagcccaggaguuuuagacuagccuggacaac

SEQ ID NO: 363849 - RNA, 64 nt, Human
aucucaaaaugaucucuuuaguucugucuccaaggcccaggacacuugucagaaggaugcaaaa

SEQ ID NO: 363850 - RNA, 64 nt, Human
ugagaaaccaggacaggccaucugcagugacccagcccaggacgaaguuuacaaacaccuccug

SEQ ID NO: 363851 - RNA, 64 nt, Human
cugugguggcuacuuuuggucugaaacccacuuggcccaggaaagagaaaagguuguauguuuu

SEQ ID NO: 363852 - RNA, 64 nt, Human
aauggcaguauuuuugaaagcacuuucaccucuggcccaggagacugacccaaagugaaggaca

SEQ ID NO: 363853 - RNA, 64 nt, Human
cacuuugggaggcccaggcagaaggaucgcugcagcccaggaguucgagacuagccugggcaac

SEQ ID NO: 363854 - RNA, 64 nt, Human
guacucaggaggccaaggcaggaggauugcuugagcccaggaguuugagaccagccugggcaac

SEQ ID NO: 363855 - RNA, 64 nt, Human
cuacuugggaagcagaggcuggaggaucauuucagcccaggagguuguggauacagugaguuau

SEQ ID NO: 363856 - RNA, 64 nt, Human
aggacuggaaugacgcgguccagggagggcggaggcccaggagaccaaagggaggggcucugcc

SEQ ID NO: 363857 - RNA, 64 nt, Human
gaaugcaaccaguguaaggccccuaaaccagauggcccaggagggggaccagguggcucucaca

SEQ ID NO: 363858 - RNA, 64 nt, Human
aaggccgggaagccagucuccuucccugaagcaagcccaggagaagacucuccgccccacgcca

SEQ ID NO: 363859 - RNA, 64 nt, Human; identical to SEQ ID NO: 363776

SEQ ID NO: 363860 - RNA, 64 nt, Human; identical to SEQ ID NO: 363777

SEQ ID NO: 363861 - RNA, 64 nt, Human
gugccgccaucucucccuuccugccucauuucaucccccgcagcagccgggauugauugugcuu

SEQ ID NO: 363862 - RNA, 64 nt, Human
uccugucugggaggcccuuaugagggcagcccagcccccgcacccacccccaaccagagaagca

SEQ ID NO: 363863 - RNA, 64 nt, Human
cuuuuauuuauauguuguggggacugcauaacuagcccaggaaaugacucugguuuugaguggc

SEQ ID NO: 363864 - RNA, 64 nt, Human
caauuugggagaccgaaugagaaggauugcuugagcccaggaguuugagaccagccagggcaac

SEQ ID NO: 363865 - RNA, 64 nt, Human
gagggagggagggcuccagacacauguccaagaagcccaggaaaggcuccaggagcagccacau

SEQ ID NO: 363866 - RNA, 64 nt, Human
uccccuacaccccagccuccugcuguccccugaagcccaggacugcguuguaugcuuuccaucc

SEQ ID NO: 363867 - RNA, 64 nt, Human
cuugaagcagggagaaauugaccuuugccuugucgcccaggaaguggggcucggcacccauaac

SEQ ID NO: 363868 - RNA, 64 nt, Human
gggaccugggcucucuccacgauucuggcuguuugcccaggaacuuaggguggguaccucugag

SEQ ID NO: 363869 - RNA, 64 nt, Human
cgggagguggcuggacccaucgcaucuaaaacuggcccaggacacuugguguaugcgugacuug

SEQ ID NO: 363870 - RNA, 64 nt, Human
augaaucaacugcuauccuuccccucaccccucagcccaggagggaaagggcauuuucuuuuuc

SEQ ID NO: 363871 - RNA, 64 nt, Human
ucucagugcugacucacgggcaugcuucauugaggcccaggaagaggcccugguuuggggcugu

SEQ ID NO: 363872 - RNA, 64 nt, Human
cacuuugggaggccaaagcaggacgaucacuugagcccaggaguucaacaccagcuugggcaac

SEQ ID NO: 363873 - RNA, 64 nt, Human
agcucaaagcaagugagcucaccuaccugccaccgcccaggaccagucugcccacugccuaaau

SEQ ID NO: 363874 - RNA, 64 nt, Human
ugcagugacaagaagggcagagggcagucauggggcccaggaccaugccacuggcccugcuccc

SEQ ID NO: 363875 - RNA, 64 nt, Human
uuauaauaaaguccucguuuucguuucgauuugggcccaggaacaggcagcuacgacguuaaga

SEQ ID NO: 363876 - RNA, 64 nt, Human
gcuucauuagucauggguggaagaaaaaccacaccccccgcaccccuccguucuuucugcauag

SEQ ID NO: 363877 - RNA, 64 nt, Human
cuugcuggcagcuggcaucgugucgcuuuaucugcccccgcacaguuugcuuuguacgucugcc

SEQ ID NO: 363878 - RNA, 64 nt, Human
aagaggaucuuuaggccugaguugugaagcgcaacccccgcaaaacgcauuugccaucacaguu

SEQ ID NO: 363879 - RNA, 64 nt, Human
uuguuaaaggaguuccugucaccugcuccccccacccccgcaugcgucuguccacuuggcuaac

SEQ ID NO: 363880 - RNA, 64 nt, Human
ugcacagaauggacgagugcagcccagcccucaugcccaggaucagcaugcgcaucuccauguc

SEQ ID NO: 363881 - RNA, 64 nt, Human
cacuuugggaggccaacgcggguggauugcuugagcccaggaguucaagagcagccugggcaau

SEQ ID NO: 363882 - RNA, 64 nt, Human
cuacuagggaggcugagccaggaagaacgcuccagcccaggacuucgaggcugcaaugagcuau

SEQ ID NO: 363883 - RNA, 64 nt, Human
gcauuuugggaggcugagugggaugaccgcuugagcccaggauuucaaguccagccugggcuac

SEQ ID NO: 363884 - RNA, 64 nt, Human
cugcuugggaggcugaggugggagaaucacuugagcccaggaguucgaggcugcagugagccag

SEQ ID NO: 363885 - RNA, 64 nt, Human
gcaauuuggaggcugaggugggaggaucauuugagcccaggaguucgagaccaaccugggcaac

SEQ ID NO: 363886 - RNA, 64 nt, Human
uccgcccccagccagagcaagcuuggggcaccaugcccaggagggaagaagccauccacagccu

SEQ ID NO: 363887 - RNA, 64 nt, Human
uucuaaggucccuuccagcccagccguucugggagcccaggaauccaugaugccggacagaguu

SEQ ID NO: 363888 - RNA, 64 nt, Human
gcuacucaggaggcugaggcuagaggauccuugagcccaggagguugaggcugcagugaggugu

SEQ ID NO: 363889 - RNA, 64 nt, Human
cacuuugggaggcugaggcaggaggaucacuugagcccaggaguucaagacuagccuaggcaac

SEQ ID NO: 363890 - RNA, 64 nt, Human
cucugacccacgccucccgccuccuggccgacuugcccaggaggugucucuggcucaccuccgu

SEQ ID NO: 363891 - RNA, 64 nt, Human
cggagcugacccaggggugggaacgauggcagcugcccaggacccaugugcuuggcccaggcua

SEQ ID NO: 363892 - RNA, 64 nt, Human
ggcccagagcagaauucuggccccagaacucugugcccaggagccaugccuugagcaguauuag

SEQ ID NO: 363893 - RNA, 64 nt, Human; identical to SEQ ID NO: 275041

SEQ ID NO: 363894 - RNA, 64 nt, Human; identical to SEQ ID NO: 275042

SEQ ID NO: 363895 - RNA, 64 nt, Human; identical to SEQ ID NO: 275051

SEQ ID NO: 363896 - RNA, 64 nt, Human; identical to SEQ ID NO: 275052

SEQ ID NO: 363897 - RNA, 64 nt, Human
gugccugagcuuagguuguggaguggcugagagggcccaggagggcucgggacagcugugugcu

SEQ ID NO: 363898 - RNA, 64 nt, Human
ccccauuccucucuugcuacaaauaaggaaacaggcccaggagauuaagugacuuggcuaaagu

SEQ ID NO: 363899 - RNA, 64 nt, Human
ccgagugggguuugaaggcagccggcccggcccagcccaggagcgcuauuuauugcauauuuau

SEQ ID NO: 363900 - RNA, 64 nt, Human
accccagcucugcgucgguccuggugcccuggaugcccaggaaucuguauauauuuauggccgg

SEQ ID NO: 363901 - RNA, 64 nt, Human
ggccuuagagcaggccccgaacuguggucgccaggcccaggaggcgacugcaugguggagaggg

SEQ ID NO: 363902 - RNA, 64 nt, Human
cuacuugggaggcugaggcaggagaauuuuuugagcccaggaugcagagguugaagugagccaa

SEQ ID NO: 363903 - RNA, 64 nt, Human
ccaggggcgccuggcaagugcugugcccacguccgcccaggacccagccguguugagugaagcu

SEQ ID NO: 363904 - RNA, 64 nt, Human
ugagggccagggacccaggugugccugugcuccugcccaggagcagcuuuuggucuccuugggc

SEQ ID NO: 363905 - RNA, 64 nt, Human
ccugcagacgcagggggacugcacaauuccaccugcccaggaccugacccuggcgugugcuugg

SEQ ID NO: 363906 - RNA, 64 nt, Human
acggccgcaggacgcaggcgagggccgcacggcugcccaggacugcugcugagccccaggggcg

SEQ ID NO: 363907 - RNA, 64 nt, Human
ggcagggacaccccugcagggucucgggcucugagcccaggacauucccugccccuuacucacc

SEQ ID NO: 363908 - RNA, 64 nt, Human
caagggggccacuggcuaccccuacugcgcggcggcccaggagcucggacugcugguccuggag

SEQ ID NO: 363909 - RNA, 64 nt, Human
gacgcugcuuccccagaagugcuggggcagggaggcccaggagaugagagagaagguccgagua

SEQ ID NO: 363910 - RNA, 64 nt, Human
cccgcccugcccgcccccccccccaccaguccugcccccgcauggagcccccgugauuaguagc

SEQ ID NO: 363911 - RNA, 64 nt, Human
uggaaagacguuuuugugcugugggcagcacccucccccgcagcgggguagggaagaaaacuau

SEQ ID NO: 363912 - RNA, 64 nt, Human
ccauuccugugccuacuuugccugaguucuucuacccccgcaguugccagccacauugggaguc

SEQ ID NO: 363913 - RNA, 64 nt, Human
aguccaauuccaaagccagaccagaagauucuaucccccgcagcgcucuccuuugagcaagccg

SEQ ID NO: 363914 - RNA, 64 nt, Human
aagaccacucccaccucaggaagcuaguauucaugcccaggaucggugaguucaggggauccau

SEQ ID NO: 363915 - RNA, 64 nt, Human
aaccacucacaccccagggggaugagcucuccaagcccaggauucuggcaagagaggugaagaa

SEQ ID NO: 363916 - RNA, 64 nt, Human
uggggaagagggcaggagcugaaguuccaggggagcccaggaccccuggggaccuguacacuag

SEQ ID NO: 363917 - RNA, 64 nt, Human
ucaguucugcucuaacauggcaugcccuuucucagcccaggaaacagcaugugguucagagaaa

SEQ ID NO: 363918 - RNA, 64 nt, Human
cgaggccuccccuucagcucaggcacagcaacuugcccaggacugacacugucacccugacugc

SEQ ID NO: 363919 - RNA, 64 nt, Human
uggcuguuaagaggagaaagugcacugccuuccagcccaggaggaggacagcauuuuguauuug

SEQ ID NO: 363920 - RNA, 64 nt, Human
aaccucagcccgagggucuccaggauguugccuggcccaggacuugggacaguggccuugucuu

SEQ ID NO: 363921 - RNA, 64 nt, Human
gggccugggcacuguauucugagcaaaggccugggcccaggagccagccagggaugagugccau

SEQ ID NO: 363922 - RNA, 64 nt, Human
accaagccccuaggcuggggcacagccuggccaugcccaggaagacccaccccauucccacucc

SEQ ID NO: 363923 - RNA, 64 nt, Human
ccuggaagcugcgagggcccagugaacuuggugggcccaggagggaacaggagccugagccagg

SEQ ID NO: 363924 - RNA, 64 nt, Human
aaaucugcugcaaaaucucucuuggaauccaugugcccaggauuauauuagcauuauuuuuaau

SEQ ID NO: 363925 - RNA, 64 nt, Human
ccuuggucaggucaggugcacauugcagggauaagcccaggaccggcagagagugguugccuuu

SEQ ID NO: 363926 - RNA, 64 nt, Human
ucagagccaaauuaguggcucccuucgagcgaaugcccaggacuucaacgcaugcacuuugugu

SEQ ID NO: 363927 - RNA, 64 nt, Human
agaagggccagggccuggcacccaccuggagaagcccccgcacccgagggaacccaugguggac

SEQ ID NO: 363928 - RNA, 64 nt, Human
cacuaacugaggagcuaguguuaauccagagaaccccccgcaaugugcuuccgagauucagacu

SEQ ID NO: 363929 - RNA, 64 nt, Human
gaagggcgggucaggcccacagccuuccugcaaagcccaggacccaggcaguccaccugcaccc

SEQ ID NO: 363930 - RNA, 64 nt, Human
ugccaucaccauacacaguggcaccuucaccugggcccaggaccugccccccacucugcacagg

SEQ ID NO: 363931 - RNA, 64 nt, Human
guaaagugaugaacugagaugaaagcagccaacagcccaggagcuuuucagaauagcgucugca

SEQ ID NO: 363932 - RNA, 64 nt, Human
ggcacuguggcucugcaugacaaacacacauccagcccaggacucuaagccucucaccuggacu

SEQ ID NO: 363933 - RNA, 64 nt, Human
cuucagggaucucucuugcacgggccuugccaaggcccaggagggacuugggcaguauguucau

SEQ ID NO: 363934 - RNA, 64 nt, Human
gccccaggucugggacgcaggugaugccagccaggcccaggagugcccagcaucccccaacuga

SEQ ID NO: 363935 - RNA, 64 nt, Human
cucguguacccccucaaggcugaccccuuagauggcccaggaauggcaggugcuacaaaaaugg

SEQ ID NO: 363936 - RNA, 64 nt, Human
ccaagcaggugucggacugcucagaguccgcauggcccaggagcagguggucggaggccccugg

SEQ ID NO: 363937 - RNA, 64 nt, Human
ggccagguggcgaaaggggcccagucguucuugggcccaggauggggccucuagacuugcaagg

SEQ ID NO: 363938 - RNA, 64 nt, Human
cuguggugcagacaggagcuguguggacagucccgcccaggaggggccgcagggcguguaugag

SEQ ID NO: 363939 - RNA, 64 nt, Human
ggaggcaggcgcagugccccccucccaugggcuggcccaggaccgugggugaaaccugggucug

SEQ ID NO: 363940 - RNA, 64 nt, Human
aggcgggagccgccaggccugcagcugggccagugcccaggagccauccuggcguggggccagg

SEQ ID NO: 363941 - RNA, 64 nt, Human
guuggcccaggccccuggcagugcucccggaggggcccaggaaggccugggcagagacccugua

SEQ ID NO: 363942 - RNA, 64 nt, Human
cccuccagaauccugaugguaucaauggauuuaucccccgcaaagacaucaaaccugaguauca

SEQ ID NO: 363943 - RNA, 64 nt, Human; identical to SEQ ID NO: 362092

SEQ ID NO: 363944 - RNA, 64 nt, Human
ggggcugggggcuggcaccgagaguucaaggagagcccaggagccagucucuggcuguggcucc

SEQ ID NO: 363945 - RNA, 64 nt, Human
uacuuugagacgcugaggugggaggaucacuugagcccaggaguucaaaaccagccugggcaau

SEQ ID NO: 363946 - RNA, 64 nt, Human
uggaggaugggugcgcagcucugcccucccugaggcccaggacuaugccagaagcgauggggua

SEQ ID NO: 363947 - RNA, 64 nt, Human
ugauuuuauauuauuaggagcaaaaguaaaugaagcccaggaaaacaccuuugggaacaaacuc

SEQ ID NO: 363948 - RNA, 64 nt, Human
acucuccugggaaguucccugcucugcagcucuggcccaggagcugcaggcugggagggggcag

SEQ ID NO: 363949 - RNA, 64 nt, Human
ccagaaaaaugauaggggucggauggguggguaagcccaggauuugcacaugaccuuccauccu

SEQ ID NO: 363950 - RNA, 64 nt, Human
uuacaguuaugugauaaaggaaaaauucuuuccugcccaggaccugcgccauccuuuaggccga

SEQ ID NO: 363951 - RNA, 64 nt, Human
acugaccgaccauugccauuucuggccucgcuaggcccaggagaggagggaggcaagccagucg

SEQ ID NO: 363952 - RNA, 64 nt, Human
uccucugucuccuugcuccaauggaggcagaagagcccaggacccaagcgucuuggcaggggug

SEQ ID NO: 363953 - RNA, 64 nt, Human
cauggaacaggugguaggagagccccagggagacgcccaggagcuggcugaaagccacuuugua

SEQ ID NO: 363954 - RNA, 64 nt, Human
agcccaguggucaccccugugugcgcccgccccagcccaggaguagucuuaccucugaggaacu

SEQ ID NO: 363955 - RNA, 64 nt, Human
aaccuagggaaugccagaggagcaaggaugcagggcccaggacuccagagcugugaccuggcuc

SEQ ID NO: 363956 - RNA, 64 nt, Human
cuacuugggaggcugaggcgggaggaucgccagagcccaggaguuugaggcugcagugagcuau

SEQ ID NO: 363957 - RNA, 64 nt, Human
agcugacagaagagguacccuugggacagaguaucccccgcaggcggaaguagcugagggcaag

SEQ ID NO: 363958 - RNA, 64 nt, Human
acauuguaacuaaaaucuuccucaggacuauuaacccccgcaaaguuucuauagggaacugccu

SEQ ID NO: 363959 - RNA, 64 nt, Human
ucccggcuucccuuacccuaucacuggccucaggcccccgcaggcugccucuucccaaccuccu

SEQ ID NO: 363960 - RNA, 64 nt, Human
cauggccgcuucuagagccucgacacccccccaacccccgcaccaagcagacaaagucaauaaa

SEQ ID NO: 363961 - RNA, 64 nt, Human
agccagaugauaguaguuaaacugcuaagcuugggcccaggaggcuuugagaaagccuucucug

SEQ ID NO: 363962 - RNA, 64 nt, Human
auuggucaccagauaucucugagggccaagcuaugcccaggaaugugucagagucaccuccaua

SEQ ID NO: 363963 - RNA, 64 nt, Human
agaagcaucuucaguuuucauaugaaaaacuuaagcccaggagugauuugugcagccaaggaca

SEQ ID NO: 363964 - RNA, 64 nt, Human
gaggcucagccccaccccagggcagccagggagagcccaggagcuccccuccccaacugaccac

SEQ ID NO: 363965 - RNA, 64 nt, Human
gccuggcccccagcuguggguacagagaggucaagcccaggaggacugccccgugcagacugga

SEQ ID NO: 363966 - RNA, 64 nt, Human
cagauguggccagagcaccggccucccagagaaagcccaggaaguccccgugguguccccuggc

SEQ ID NO: 363967 - RNA, 64 nt, Human
uguggcucagccaucccggcuggguuugccaucagcccaggauacucaccgugucacagcugug

SEQ ID NO: 363968 - RNA, 64 nt, Human
guucagcuuccuccaccucgcuuccacugcacaggcccaggaaggagaaaggccaagccaaagu

SEQ ID NO: 363969 - RNA, 64 nt, Human
agacuuucagugggcucugcugagaaggaaggcagcccaggagucagguaugcaggcauugcau

SEQ ID NO: 363970 - RNA, 64 nt, Human
ccaaccagcuccugcugccauccccagggagguggcccaggaaggugccuggcccagaauaagg

SEQ ID NO: 363971 - RNA, 64 nt, Human
caucagauucaagcccaggaggcugaaaacgagggcccaggaccagaaucgcugccuccucucc

SEQ ID NO: 363972 - RNA, 64 nt, Human
cauggccaccagccccagcugccaucagauucaagcccaggaggcugaaaacgagggcccagga

SEQ ID NO: 363973 - RNA, 64 nt, Human
agagagguugggaccaggcuagguuccgggugacgcccaggagaggugguggccuucacacaug

SEQ ID NO: 363974 - RNA, 64 nt, Human
uaagagacagacaugagagacaagcaucuucuuucccccgcaaguccauuuuauuuccuucuug

SEQ ID NO: 363975 - RNA, 64 nt, Human
cgaaccugugccaacuaagggcccccacuguaagcccccgcacccccacccccugcccagagca

SEQ ID NO: 363976 - RNA, 64 nt, Human
gucuuagagcuguuaggacccgauggggaggcagcccccgcaguggacaacccccgcuuggaca

SEQ ID NO: 363977 - RNA, 52 nt, Human; identical to SEQ ID NO: 302726

SEQ ID NO: 363978 - RNA, 64 nt, Human
auuucguccuccugguacacgaagggaacugucugcccaggagccugagccucaggcuguugga

SEQ ID NO: 363979 - RNA, 64 nt, Human
ugggggucaugggaagcgagcacgcagcaggcgugcccaggagcgugugcaugugucagagcca

SEQ ID NO: 363980 - RNA, 64 nt, Human
acacagaagugauaaaggaauccaaaguugaagagcccaggaaacgggaaacuguauccauaau

SEQ ID NO: 363981 - RNA, 64 nt, Human
cacuuugggaggcagauguggaagcaucauuugagcccaggaguuugaggcugcagugagcuau

SEQ ID NO: 363982 - RNA, 64 nt, Human
cuacuugggaggcugaggugggaaaaugacuugagcccaggaggaggaggcugcagugagcuaa

SEQ ID NO: 363983 - RNA, 64 nt, Human
uauguauaaauaauaacagagccgacguguccucgcccaggagggcuucccugucagcaauaac

SEQ ID NO: 363984 - RNA, 64 nt, Human
ggugcccuuccucacagaguuaaauaugcaucuggcccaggaauuagagaagcugaaaggauga

SEQ ID NO: 363985 - RNA, 64 nt, Human
ccagcuccucuuccuccggauccucuuuugaucugcccaggaaagggaugcauugacacucucc

SEQ ID NO: 363986 - RNA, 64 nt, Human
acuaaaugcagcuauguaaaaauaaaauucaaacgcccaggauuaaaauaaaauauaaucugaa

SEQ ID NO: 363987 - RNA, 64 nt, Human
guuacggagaccaucacaugugggcguggucagugcccaggaccgcaccgcugcucaucuuguc

SEQ ID NO: 363988 - RNA, 64 nt, Human
gcucguguagaaaugggggaauugguuccccauggcccaggacagcugagaggagguggagggg

SEQ ID NO: 363989 - RNA, 64 nt, Human
cugaacgcuggggccugcugcagccaccaacacugcccaggacugcggguugcuggcuuguaca

SEQ ID NO: 363990 - RNA, 64 nt, Human
gggggggcgggggcagcugugucaucuuucuggggcccaggaggaucugggcugguuugucugg

SEQ ID NO: 363991 - RNA, 64 nt, Human
aacugucccuuucugugugaagaucacguuccuucccccgcaaugugcccccagacgcacgugg

SEQ ID NO: 363992 - RNA, 64 nt, Human
aggaagcugccuuguggggacuuaccuggggugucccccgcaugccuguaccccagaugggugg

SEQ ID NO: 363993 - RNA, 64 nt, Human; identical to SEQ ID NO: 363128

SEQ ID NO: 363994 - RNA, 64 nt, Human
cccccaccccacccacccucggggcgccccccuccccccgcaagccagccugggccagccccgc

SEQ ID NO: 363995 - RNA, 64 nt, Human
cacuuugggaggccgaggcaggagaaucgcuugagcccaggaguucgagaccagccuggacaac

SEQ ID NO: 363996 - RNA, 64 nt, Human
cuacuugggaggcugaggcaggaggaucgccugagcccaggagguggagguugcagugagccau

SEQ ID NO: 363997 - RNA, 64 nt, Human
ccacuugggaggcugaggugggaggaucgguugagcccaggaguucgaagcugcagggaccucu

SEQ ID NO: 363998 - RNA, 64 nt, Human
cacuuuaagaggccaaggcggauggaucacuugagcccaggaguucaacaccagccugagcaac

SEQ ID NO: 363999 - RNA, 64 nt, Human
uaagcugccuggcauguggcacuuugucagggcagcccaggaaucugaaacaggaucaaacucu

SEQ ID NO: 364000 - RNA, 64 nt, Human
ggcugcauucccuggagacucacugcaaguuccugcccaggaggcugagggcaccccauccuca

SEQ ID NO: 364001 - RNA, 64 nt, Human
guccacauagagcugacgugagaaauaucuuucagcccaggagagagggguccugaucuuaacc

SEQ ID NO: 364002 - RNA, 64 nt, Human
cugcagggggccccucgggccucacuugcccugagcccaggaguccaagggcagggugggucca

SEQ ID NO: 364003 - RNA, 64 nt, Human
agggcucaagacaccacccccuccagcuucuggggcccaggagccucucccugcuacagggggu

SEQ ID NO: 364004 - RNA, 64 nt, Human
cuaacugggaggcugaggcaggaggaucacuugagcccaggagauugaggcugcagugagcaug

SEQ ID NO: 364005 - RNA, 64 nt, Human
cugaagagccugagucccaggaggccuccuggaagcccaggacugcccacccaccacgcuggug

SEQ ID NO: 364006 - RNA, 64 nt, Human
agagucgugagguccuucugaauguaaaacuggagcccaggagaagcugucccaggagggcugu

SEQ ID NO: 364007 - RNA, 64 nt, Human
cccauccagcaaucgcccccuuucugcccugggggcccaggauguagauauuguacaaagguuu

SEQ ID NO: 364008 - RNA, 64 nt, Human
ucgcacugaccacacccaccccguucggccccgccccccgcacugaacacacccgcccucaacc

SEQ ID NO: 364009 - RNA, 64 nt, Human
ccuggacacguggccacaaaucugggacaaggggcccccgcacagcaugaaauaaaaagugccu

SEQ ID NO: 364010 - RNA, 64 nt, Human; identical to SEQ ID NO: 363809

SEQ ID NO: 364011 - RNA, 64 nt, Human; identical to SEQ ID NO: 363129

SEQ ID NO: 364012 - RNA, 64 nt, Human
ugccuuugucuauauucugcucccagccugccaggcccaggaggaaauaaacaugccccaguug

SEQ ID NO: 364013 - RNA, 64 nt, Human
cacuuugggaggugcaggcaggcagauggcuugagcccaggaauucaagaccaguccgagcaac

SEQ ID NO: 364014 - RNA, 64 nt, Human
ccagaugaaggaaggcaacuuggaaguggugggugcccaggacggugccuccagccucaacagu

SEQ ID NO: 364015 - RNA, 64 nt, Human
cuccagcugcccacucaugggcccuucaccaccugcccaggaucucacccaguacugacagcuc

SEQ ID NO: 364016 - RNA, 64 nt, Human
gagaugagggggucgacagguugaacgucuucaggcccaggaccccaagcuccucagccuggcc

SEQ ID NO: 364017 - RNA, 57 nt, Human
cccagccuggcugcacuugagguucccgcccaggaaggugaguggggcaccuggggg

SEQ ID NO: 364018 - RNA, 64 nt, Human
ccaggcaggauauuccaagggcuuagagaugaaugcccaggagcugaggauaaagggcccgauc

SEQ ID NO: 364019 - RNA, 64 nt, Human
cuacucaggaggcugagguaggaugauggcuugagcccaggaguucgagaccagccugggcaac

SEQ ID NO: 364020 - RNA, 64 nt, Human
gggcguugaggaauuguggcguugacuggauguggcccaggagggggucgagggggccaacuca

SEQ ID NO: 364021 - RNA, 64 nt, Human
cacuuugggaggccgaggugggaggaucgcuugagcccaggagucugagaccagccucggcaac

SEQ ID NO: 364022 - RNA, 64 nt, Human
cggaggacaucgucuguguccaggucagaaaguggcccaggaagggggcaguuucugucgcggg

SEQ ID NO: 364023 - RNA, 64 nt, Human
ccugcccaccuccgugcagcugaccugcccuccagcccaggacuaggggcaggacucuugccug

SEQ ID NO: 364024 - RNA, 64 nt, Human
uccacuccggugccuccauuuagcuggccaaucagcccaggaggggcagguuccccggggccgg

SEQ ID NO: 364025 - RNA, 64 nt, Human; identical to SEQ ID NO: 363130

SEQ ID NO: 364026 - RNA, 64 nt, Human
caugcuugcugugacuccgccccugcccccucuccccccgcaugugggugcccccacuccccca

SEQ ID NO: 364027 - RNA, 64 nt, Human
cacccccgacucugaaucccgggcgggaggaggacccccgcaccgcccccuccccagcguguaa

SEQ ID NO: 364028 - RNA, 64 nt, Human
gggcuguugcgggugcgcggcagcuggagacacucccccgcagggccaaccccugcccuguugc

SEQ ID NO: 364029 - RNA, 64 nt, Human
cacuuugagaggccaaggagggaggaucgcuuaagcccaggaauucgaaaucagccuaggcaac

SEQ ID NO: 364030 - RNA, 64 nt, Human
ucagcugcauuuccagcccaggcuguuuggcgcugcccaggaaugguaucaauuccccuguuuc

SEQ ID NO: 364031 - RNA, 64 nt, Human
cugagcgccucugugcagggcucucacuggcggugcccaggacggacgccagauggcugcgcgc

SEQ ID NO: 364032 - RNA, 64 nt, Human
caguuugcgaggccgaggcagguggaucacuugagcccaggaguuugaaaccagccuggguaac

SEQ ID NO: 364033 - RNA, 64 nt, Human
ggugccacagagccucaccgugccugaguggcaugcccaggaggccgcucuccuucaguaaaug

SEQ ID NO: 364034 - RNA, 64 nt, Human
ccaaguagcugggauuacaggugugcgccaccacgcccaggaaauuauuguaguuuuaguagag

SEQ ID NO: 364035 - RNA, 64 nt, Human
agcgccagguuaacgcugaagccugccccgcugagcccaggagccgggaggccugcgggcugac

SEQ ID NO: 364036 - RNA, 64 nt, Human
aggccagagacacugcucagcagcacccugcagugcccaggacggccccgucccagagaacaau

SEQ ID NO: 364037 - RNA, 64 nt, Human
gacacacacuccacgagagcagccccuccacucugcccaggagaggggccgacccuccucggga

SEQ ID NO: 364038 - RNA, 64 nt, Human
ugauggcugugggaaucccccacuuccaagaugugcccaggaugugaggagcuggaguggaagc

SEQ ID NO: 364039 - RNA, 64 nt, Human
caauucggcggggugcugccuguugcugccauuagcccaggaggaggucgugggacggggaggg

SEQ ID NO: 364040 - RNA, 64 nt, Human
uaagagcucagaguucagacagguccaaguucaagcccaggaccaccacuuauaggguacaggu

SEQ ID NO: 364041 - RNA, 64 nt, Human
ccaaaccaacugcagagaagaaagacgagccucggcccaggacgcgauuucuaacgaaaugcaa

SEQ ID NO: 364042 - RNA, 64 nt, Human; identical to SEQ ID NO: 363758

SEQ ID NO: 364043 - RNA, 64 nt, Human; identical to SEQ ID NO: 363759

SEQ ID NO: 364044 - RNA, 64 nt, Human
ucccgaguuggggggaggggguguggcaacgugccccccgcagaggccacgcauguuugaccaa

SEQ ID NO: 364045 - RNA, 64 nt, Human
ggagccuggccuguaacuuauaaagugcaccucgcccccgcaagccccagccccgaggaccguc

SEQ ID NO: 364046 - RNA, 64 nt, Human
cacuuugggaggccgaggugaaaggaucacuugagcccaggaauuggagaccagcgugggcaac

SEQ ID NO: 364047 - RNA, 64 nt, Human
cacuguagaaggcagaggccggcagaucacuugagcccaggaguuggagaccagacuggggaac

SEQ ID NO: 364048 - RNA, 64 nt, Human
gcauuuauuuuaagcucuuagaagcaacuccuuggcccaggaaugcgugaccccugagaugggu

SEQ ID NO: 364049 - RNA, 64 nt, Human
ggcuuuaggaggcugagguggggggacugcuuaagcccaggaguucaagaccagccugggcaac

SEQ ID NO: 364050 - RNA, 64 nt, Human
gucauuugacagcauucagaaauaaaugccaguagcccaggagcaaaaauuuuugggaguaguu

SEQ ID NO: 364051 - RNA, 64 nt, Human
uacgacacgcguccucgggcgccaccgggcgcucgcccaggacuccccgggccucgggcccggc

SEQ ID NO: 364052 - RNA, 64 nt, Human
ggccgcccacggggggccacagcagcggccgcucgcccaggauggagaggcgggucccaggccc

SEQ ID NO: 364053 - RNA, 64 nt, Human
gaacuucccggccaucgccauccaccggggcauggcccaggaggagcggugagugcgagccgcc

SEQ ID NO: 364054 - RNA, 64 nt, Human
cacuuugggagggugaggcaggaggauggcucaagcccaggaguuugagaccagugugggcaac

SEQ ID NO: 364055 - RNA, 64 nt, Human
caagaccugcuggacuagugguccuugcuggccugcccaggaggcauggauacucaggaaggaa

SEQ ID NO: 364056 - RNA, 64 nt, Human
cacuucgggaggccguggugagaggauagcuuaagcccaggaguucaagaccaaccuggacaac

SEQ ID NO: 364057 - RNA, 64 nt, Human
cuacuugggaggcugaggcaggagaaucacuugagcccaggagguggagguuucagcgagcuga

SEQ ID NO: 364058 - RNA, 64 nt, Human
cagggaaugcugaggccucgaggggccucccggggcccaggacucuggcuucucuccucagacu

SEQ ID NO: 364059 - RNA, 50 nt, Human; identical to SEQ ID NO: 302493

SEQ ID NO: 364060 - RNA, 64 nt, Human; identical to SEQ ID NO: 363652

SEQ ID NO: 364061 - RNA, 64 nt, Human; identical to SEQ ID NO: 363653

SEQ ID NO: 364062 - RNA, 64 nt, Human; identical to SEQ ID NO: 363654

SEQ ID NO: 364063 - RNA, 64 nt, Human
uacucagaagguugagacaaaggggaucgcuugagcccaggaguuggaggcugaagagagcuau

SEQ ID NO: 364064 - RNA, 64 nt, Human
gcgcggcccccggggauuccccccccccgagggugcccaggacucgacaagcuggacccccugc

SEQ ID NO: 364065 - RNA, 64 nt, Human
ggugcggcccuggggacccccccuccccgagugugcccaggaacucagagagggcgcggccccc

SEQ ID NO: 364066 - RNA, 64 nt, Human
uaagauccccgagguggagcuggucacgcugggcgcccaggaggaagggagggcagagggggcu

SEQ ID NO: 364067 - RNA, 64 nt, Human
ccaaggucucaugggggcuagggccaaguugggggcccaggaggcggggagggaggaggaggag

SEQ ID NO: 364068 - RNA, 64 nt, Human
ugggcuucccagucuugccuggcucuccuccuuggcccaggagcucaggaucccuggggcuggg

SEQ ID NO: 364069 - RNA, 64 nt, Human
ccaccacaucgcccaucucuuccccgucccccaggcccaggaccgccccugucaguccccccaa

SEQ ID NO: 364070 - RNA, 50 nt, Human
aggcggccggcgaggccugagcccaggaaagccccccucacugucccugg

SEQ ID NO: 364071 - RNA, 64 nt, Human
cacuuugggaggcugaggccggaggauugcuugagcccaggaguucaagaccagccugggcaac

SEQ ID NO: 364072 - RNA, 64 nt, Human
uaaauuucuagauuggggauagggagaaagggaggcccaggaaggucuccccugauuuuuuuuc

SEQ ID NO: 364073 - RNA, 57 nt, Human
gccggacuggccgggccugagacccaugcccaggaaaauaacagagcuggaugcuga

SEQ ID NO: 364074 - RNA, 64 nt, Human
caggaauaucuguucccagccccuccucccucaggcccaggaguccaggcccccagccccuccu

SEQ ID NO: 364075 - RNA, 64 nt, Human
cacugugggaggccaaggcaggaggaucgcuugagcccaggaguucaagaccagccugggcaac

SEQ ID NO: 364076 - RNA, 64 nt, Human; identical to SEQ ID NO: 363111

SEQ ID NO: 364077 - RNA, 64 nt, Human
uucuugcacaggguggggcgcgcaguaggaaccucccccgcaggagcuggcgcccucucgcucc

SEQ ID NO: 364078 - RNA, 64 nt, Human
uuugcuccuagaguaaggcucaucugggccucggcccccgcaccugguggccuuguccuugagg

SEQ ID NO: 364079 - RNA, 64 nt, Human; identical to SEQ ID NO: 363774

SEQ ID NO: 364080 - RNA, 64 nt, Human
cuuaugcugccacaagucaguuugcacccuaggugcccaggagcuaguauccuuagaucuuucu

SEQ ID NO: 364081 - RNA, 64 nt, Human
acagauuuuguuguuauaaggggagggucugggugcccaggaguagaauaugaagugcuaaauc

SEQ ID NO: 364082 - RNA, 64 nt, Human
gaaaagccuucagaagcuacucuguuucugaccagcccaggaaccuuugcagggccaucucacc

SEQ ID NO: 364083 - RNA, 64 nt, Human
gagugccccugccacuccgagauaaccaguggaugcccaggaucuuuuaccacaaccccucugu

SEQ ID NO: 364084 - RNA, 64 nt, Human
ugggucaccaagggcccacgcuggggcccugggggcccaggagacaccagcgggggcugccgcu

SEQ ID NO: 364085 - RNA, 64 nt, Human
cccaccaccaccagggcacucacucgcagcuauagcccaggacagaaaaacugugcuuuggaca

SEQ ID NO: 364086 - RNA, 64 nt, Human
ucuucucccccaaacccacgcguguucugaaggugcccaggagcggcgaugcacucgcacugca

SEQ ID NO: 364087 - RNA, 64 nt, Human
cuacuugugaggcugaggcaggaggauucuuugagcccaggaguuugagguuacagugagccac

SEQ ID NO: 364088 - RNA, 64 nt, Human
cgucaucggacucucucuuauuacaaagaucacugcccaggaccaucuucccgagaagcauccc

SEQ ID NO: 364089 - RNA, 64 nt, Human
ggucacccauggccucagaugauggggucagcaggcccaggagaauuaggaaggccauggggca

SEQ ID NO: 364090 - RNA, 64 nt, Human
guuguaggcauguagcuacaggacauuuuuaagggcccaggaucguuuuuucccagggcaagca

SEQ ID NO: 364091 - RNA, 64 nt, Human
uggucaguuucacacagaagucacgagggccucugcccaggaccuucuauucacauuucaagaa

SEQ ID NO: 364092 - RNA, 64 nt, Human
cacucugggaggccgaggcaggaggaucccuuuagcccaggaguuaaagaccagccugggcaac

SEQ ID NO: 364093 - RNA, 64 nt, Human; identical to SEQ ID NO: 363110

SEQ ID NO: 364094 - RNA, 64 nt, Human; identical to SEQ ID NO: 363942

SEQ ID NO: 364095 - RNA, 64 nt, Human
auuucugugcuguccacacucucuugccucccgacccccgcacucccuucuagcacccccaaag

SEQ ID NO: 364096 - RNA, 64 nt, Human
gccuaugcgcucaauggcccggaggggcagcaaccccccgcacacgucagccaacagcagugcc

SEQ ID NO: 364097 - RNA, 64 nt, Human
aauucgucggaggcaucauggaaagacugggacagcccaggaaacaaggggucugaggaugcau

SEQ ID NO: 364098 - RNA, 64 nt, Human
aggauagauguauucuagaguagggguggaggcggcccaggaggcugaagacaggugcacagau

SEQ ID NO: 364099 - RNA, 64 nt, Human
cuauuugggaggcugaggcaggaggaucgcuugagcccaggaguuuaaagcugcagugcccugu

SEQ ID NO: 364100 - RNA, 64 nt, Human
ucugacgccaggugccaaggcuucaggcaggcaggcccaggaugggcguuugcugcgcacagac

SEQ ID NO: 364101 - RNA, 64 nt, Human
ugauuuauuggcucuuccauugccacugagcaaugcccaggaagcaggcacauugccaaggacu

SEQ ID NO: 364102 - RNA, 64 nt, Human
ugagaagccaccgggaaagcagccagcacaaagggcccaggaagccagcccccgagagcugagc

SEQ ID NO: 364103 - RNA, 64 nt, Human
uugacuuggcagcauggagccaaggucuguccccgcccaggagggugccuuccucggggguagg

SEQ ID NO: 364104 - RNA, 64 nt, Human
gcacggagcccaagagguggggugucguggcucugcccaggaucugagcucauuggucaaagcc

SEQ ID NO: 364105 - RNA, 64 nt, Human
cccccacuccauggggacagaagcuccagcauuugcccaggacccguccagaccucacccugug

SEQ ID NO: 364106 - RNA, 64 nt, Human
cagccaugccuauccaaugacgucuccauaaaaggcccaggaacacgggagcuucugaagagcu

SEQ ID NO: 364107 - RNA, 64 nt, Human
augucccugccucccugccacccccccugccugagcccaggacccacuggagccagccccaccc

SEQ ID NO: 364108 - RNA, 64 nt, Human
uagcuucuugggaggcugaggcaggauugcuugagcccaggaguuugagccuucagugagcuau

SEQ ID NO: 364109 - RNA, 64 nt, Human
uugugcuggccucuugggugagugaaccugugaagcccaggaggugguguuggcugcaggguac

SEQ ID NO: 364110 - RNA, 64 nt, Human; identical to SEQ ID NO: 363668

SEQ ID NO: 364111 - RNA, 64 nt, Human; identical to SEQ ID NO: 363669

SEQ ID NO: 364112 - RNA, 64 nt, Human; identical to SEQ ID NO: 363670

SEQ ID NO: 364113 - RNA, 64 nt, Human; identical to SEQ ID NO: 363671

SEQ ID NO: 364114 - RNA, 64 nt, Human
gcuuacugaggccaugagaaccugaggggcaucugcccaggacaggagccauggcauaugacaa

SEQ ID NO: 364115 - RNA, 64 nt, Human
cucccugcugcagagagcacagcccuugccuggagcccaggaaccccauccuugcuucaucuca

SEQ ID NO: 364116 - RNA, 64 nt, Human
ccccaacccugagggagacuggauuggucuuggggcccaggacccagacgcaggacagagugga

SEQ ID NO: 364117 - RNA, 64 nt, Human
cuggccccauuuguguugaguuuccucuuagugugcccaggagucugaucugcugggguacagg

SEQ ID NO: 364118 - RNA, 64 nt, Human
uccacucccugcuccacgaagccuuaagccauaggcccaggauauuucugagagugaaaccaug

SEQ ID NO: 364119 - RNA, 64 nt, Human
ucuguuuggggaagaugcaaggaaguaaugagaagcccaggaaauuucuccaccuguguuuaug

SEQ ID NO: 364120 - RNA, 64 nt, Human
auguggcaaggcuuggaugagauggggcaccagugcccaggaauuugaacauuuuccuuuaccc

SEQ ID NO: 364121 - RNA, 64 nt, Human
augagauucaaaagcugcauuccuuccuccaaaggcccaggacaggacagugcuacccuagauu

SEQ ID NO: 364122 - RNA, 64 nt, Human
guggcgucaggauggaguccuagcugugaccugugcccaggagggcgugauccgagugaagccc

SEQ ID NO: 364123 - RNA, 64 nt, Human
cugaucagcuggauccccacgugagcaacagcuggcccaggaaaggcugccugcagaggacagg

SEQ ID NO: 364124 - RNA, 64 nt, Human
cagaaacgacgguacccaggagaagggauuuugggcccaggagaaacacuuacauucuggugcc

SEQ ID NO: 364125 - RNA, 64 nt, Human
cacacaccugcacaccgucccucuccccggacaagcccaggacacugccuuugcugccuucugu

SEQ ID NO: 364126 - RNA, 64 nt, Human
gguuuuguaccagucccugcucucaggccacccugcccaggacccaggcccgccucccccucca

SEQ ID NO: 364127 - RNA, 64 nt, Human; identical to SEQ ID NO: 363876

SEQ ID NO: 364128 - RNA, 64 nt, Human; identical to SEQ ID NO: 363877

SEQ ID NO: 364129 - RNA, 64 nt, Human; identical to SEQ ID NO: 363685

SEQ ID NO: 364130 - RNA, 64 nt, Human; identical to SEQ ID NO: 363686

SEQ ID NO: 364131 - RNA, 64 nt, Human
cccacgugucccggggcuuuuccaggaagcccgagcccaggaccuguuggcagaguugccaggg

SEQ ID NO: 364132 - RNA, 64 nt, Human
ggauuaccugaaggccagcaggagccgggggcaggcccaggauccucagaggaagauggagagg

SEQ ID NO: 364133 - RNA, 64 nt, Human
ucuggcccucaagcauguaaccucggggucugaggcccaggacccaccccccugccaccccucc

SEQ ID NO: 364134 - RNA, 64 nt, Human
uuuugacugcgaccuuggcggugcugucuccgcagcccaggaagccugcuguggggaggcuucg

SEQ ID NO: 364135 - RNA, 64 nt, Human
cagcucugggggcugaggugggaggauugcuugagcccaggaguuagaagcugcagugagcucu

SEQ ID NO: 364136 - RNA, 64 nt, Human
cacugugggaggccaaggcaaggggaucacuugagcccaggagucuaggaccagccuggacaac

SEQ ID NO: 364137 - RNA, 64 nt, Human
gagccgggaggcccuugaggugaggacacagcaggcccaggaccauggcuggggaggauauguc

SEQ ID NO: 364138 - RNA, 64 nt, Human
ccaccaugccuccuucccaggacccaggucugcugcccaggaacccuccagaccucccagagag

SEQ ID NO: 364139 - RNA, 64 nt, Human
cguuuugggaggcugagaugggaggauugcuugagcccaggaggucgaggcugcagugagcuau

SEQ ID NO: 364140 - RNA, 64 nt, Human
ccucuggcccguccugggaaggggggugucuagagcccaggaaacuucuucuuccguggcuuuu

SEQ ID NO: 364141 - RNA, 64 nt, Human
ggaaaucgauuucacaauccaaaaauggcccacagcccaggaagcuacccugaacaugccaguu

SEQ ID NO: 364142 - RNA, 64 nt, Human
gauuccacugcaaaaguggcugcuuuggaugccagcccaggaugaguaguuccuguucucaggg

SEQ ID NO: 364143 - RNA, 64 nt, Human
aggaagcucagaucucuagagcugucuugucgccgcccaggauugaccuguguguaagucccaa

SEQ ID NO: 364144 - RNA, 64 nt, Human; identical to SEQ ID NO: 363958

SEQ ID NO: 364145 - RNA, 64 nt, Human; identical to SEQ ID NO: 363074

SEQ ID NO: 364146 - RNA, 64 nt, Human; identical to SEQ ID NO: 363687

SEQ ID NO: 364147 - RNA, 64 nt, Human; identical to SEQ ID NO: 363688

SEQ ID NO: 364148 - RNA, 64 nt, Human
gcucuucagagcccaagagaguugugcuaagauggcccaggauggagguccgggccugccccaa

SEQ ID NO: 364149 - RNA, 64 nt, Human
cuccucuguccucgcacagcgaaccugggcuccugcccaggacaggcaccagggucauggccug

SEQ ID NO: 364150 - RNA, 64 nt, Human
caauuugggaggcaaaggugggagaaucgcgugagcccaggaguuccagaccaggcugggucac

SEQ ID NO: 364151 - RNA, 64 nt, Human
caauuugggaggcagaggugagagaaucgcuugagcccaggaauucgagaccagccugggccac

SEQ ID NO: 364152 - RNA, 64 nt, Human
uugggucauucauguccuacgcagcuaaaacagagcccaggagccagggaggaaaagcagucag

SEQ ID NO: 364153 - RNA, 64 nt, Human
ucuuccccaucaggcugggcucuggcagggaccugcccaggauggagaugagagagggugagag

SEQ ID NO: 364154 - RNA, 64 nt, Human
guggcucccuccuccccaucaagcacaagagagggcccaggaaaaaagguuucacauaagugua

SEQ ID NO: 364155 - RNA, 64 nt, Human
cgggaaacugagcccuggagaggggaagcagccagcccaggaugcuucagggcccuggcagcaa

SEQ ID NO: 364156 - RNA, 64 nt, Human
uccccagcccaaccucgggccugcgucugagguggcccaggaccccaagcugcagagcccaggg

SEQ ID NO: 364157 - RNA, 64 nt, Human
ccauucacucccaggcaggggugaggguggccuggcccaggaggccaggaaggagggcccuguc

SEQ ID NO: 364158 - RNA, 64 nt, Human
gacucagucugugaguaaaacugggggcucaaaugcccaggaugaggggaucagugacugucua

SEQ ID NO: 364159 - RNA, 64 nt, Human
gcucugcaauugucaccgguuaacuguggccugugcccaggaagagccauucacuccugccccu

SEQ ID NO: 364160 - RNA, 64 nt, Human
gucucccauguuguaguacauucuccaagaugcagcccaggagccucucugaaggaccagucug

SEQ ID NO: 364161 - RNA, 64 nt, Human
gcugagacuccccgcccgcccuccucugcccccucccccgcagacagacagacagacggacggg

SEQ ID NO: 364162 - RNA, 64 nt, Human
cugcagccugcccagcagcacauuccagucacugcccccgcacucccacagggcucaggcuggg

SEQ ID NO: 364163 - RNA, 64 nt, Human
uuggaacugcucagcuaggcaggugcccccaucccccccgcauucuggccuaggcaggagagga

SEQ ID NO: 364164 - RNA, 64 nt, Human; identical to SEQ ID NO: 363053

SEQ ID NO: 364165 - RNA, 64 nt, Human
cacuuugggaggccgaggugggaggaucacuugagcccaggaguucgagaccagccuaggcaac

SEQ ID NO: 364166 - RNA, 64 nt, Human
uggggcagaaacccagaacucagcauucaaggaugcccaggagagcugucccuguuuuaaagag

SEQ ID NO: 364167 - RNA, 64 nt, Human
gaacuugggaggcugaggugggcggauuacuugagcccaggaguucgggaccagccugggaaau

SEQ ID NO: 364168 - RNA, 50 nt, Human
ggaccuuccccucauccuaggcccaggacccauuauggggacaggagcug

SEQ ID NO: 364169 - RNA, 64 nt, Human
acuggucucaucuccauugccuuaaugccagguggcccaggaguacccaugcacagcagcugug

SEQ ID NO: 364170 - RNA, 64 nt, Human
gucuugucuaucuugauggagaagagggguuccugcccaggaucuuacaacacagcaaguagca

SEQ ID NO: 364171 - RNA, 64 nt, Human
gucauguugccugcagggacucuuuccuuacugggcccaggaguucgaggugcaguuuggcaac

SEQ ID NO: 364172 - RNA, 64 nt, Human
agcugccucuaccaaccacccucuaucagcaguggcccaggaaggaggucaagcaucuucggcc

SEQ ID NO: 364173 - RNA, 64 nt, Human
aggaagcacagaucucuagagcuguccugucgcugcccaggauugaccuguguguaagucccaa

SEQ ID NO: 364174 - RNA, 64 nt, Human
uuuuuuuuuuuuugagauggagucucgcucuaucgcccaggauggagugcaguggcucaaucuc

SEQ ID NO: 364175 - RNA, 64 nt, Human
gcagucccuggcagggccuucgggugguuggcaagcccaggaucugaguggcaauuggcacuga

SEQ ID NO: 364176 - RNA, 64 nt, Human
gggcugggagcagcccuaagguagaggccucauggcccaggagaccccaccucuggcagagcca

SEQ ID NO: 364177 - RNA, 64 nt, Human
cuacuuaggaggcugaggugggaggauugcuugagcccaggaguuugagguuguagggagcuau

SEQ ID NO: 364178 - RNA, 64 nt, Human; identical to SEQ ID NO: 363744

SEQ ID NO: 364179 - RNA, 64 nt, Human
cugguguuggauagaugccagggccccuccucuggcccaggacgccugcugcaagcccacccag

SEQ ID NO: 364180 - RNA, 64 nt, Human
agaggcaagacuaggaucagggacagaucuggaggcccaggacauggcugagagguggucagca

SEQ ID NO: 364181 - RNA, 64 nt, Human
uugaacccagcuucagugugcaggcucugaggcugcccaggacgggaaaguccaaggaaggggc

SEQ ID NO: 364182 - RNA, 64 nt, Human
cggggacaggccagcggggggacggaggcggcgggcccaggagccucagccagccacgugggca

SEQ ID NO: 364183 - RNA, 64 nt, Human
cuacuugggaggcugaggauggaggaucauuugagcccaggaggucgaggcugcagugaaccgu

SEQ ID NO: 364184 - RNA, 64 nt, Human
aggcuaaggguggauaccagcgacucccuuugcugcccaggaucuccaugggcagugccacagc

SEQ ID NO: 364185 - RNA, 64 nt, Human
ccauuacucaaaaugcaggacagaucaggucagagcccaggaauucucacagguucacccagcg

SEQ ID NO: 364186 - RNA, 64 nt, Human; identical to SEQ ID NO: 363251

SEQ ID NO: 364187 - RNA, 64 nt, Human
cucuuccacugguagaaggccuuuaaugaucugggcccaggaugauuuccugcccuuuuaucau

SEQ ID NO: 364188 - RNA, 64 nt, Human
uggccucaucuuccuuccugcuguaccacagauggcccaggagaggcacuugucuuuuauuaua

SEQ ID NO: 364189 - RNA, 64 nt, Human
ugccucaggaggcugaggcagaagaauagcuugagcccaggagcuuuagucuagccugagcaau

SEQ ID NO: 364190 - RNA, 64 nt, Human
ggagacucccauccucucuucccccucaccaagugcccaggagaccccuggcucagaccagccc

SEQ ID NO: 364191 - RNA, 64 nt, Human
cuauucaggagauuaaggcaggaggaucacuugagcccaggaggucaaggcugcagugagcugc

SEQ ID NO: 364192 - RNA, 64 nt, Human
ccuccuggggacauuuccucaaagcaguuuugcgcccccgcaagggaauggucagccuaagggu

SEQ ID NO: 364193 - RNA, 64 nt, Human
guacccauuaaacaguaauucccacuccucccagcccccgcagccaccauucugcuuucugucu

SEQ ID NO: 364194 - RNA, 64 nt, Human; identical to SEQ ID NO: 363054

SEQ ID NO: 364195 - RNA, 64 nt, Human
aacacugugugugucaccauauaacugcaccucacccccgcacgugugcaugacucgcagagaa

SEQ ID NO: 364196 - RNA, 64 nt, Human
cugccucugcccagauuugcccuccuccugcucugcccaggagguggcguccagcaguccaggc

SEQ ID NO: 364197 - RNA, 64 nt, Human
cgugcagucugcgcuuuccucucccgccugccuagcccaggaugaagggcuggguggccacaac

SEQ ID NO: 364198 - RNA, 64 nt, Human
ucccagcuacuagggaggcaggaggaucacuugagcccaggaguuugaggcugcggugagcugu

SEQ ID NO: 364199 - RNA, 64 nt, Human
cuacuccagaggcugaggugggaagaucauuugagcccaggaggcugaggcugcaaugagcuau

SEQ ID NO: 364200 - RNA, 64 nt, Human
cacuuugggaggcugagguggguggauugcuugagcccaggaguuggagaccagucugggaaac

SEQ ID NO: 364201 - RNA, 64 nt, Human
uugauuucagaauguaugcuuggugagucucagugcccaggaacacuuuuggaauaauuuauca

SEQ ID NO: 364202 - RNA, 64 nt, Human
uccuagcaaaccaaacauaguucgagaacagcuggcccaggagcuaccacuggcuacucagagg

SEQ ID NO: 364203 - RNA, 64 nt, Human
ggggcuguccaguuagcugugcccugcaccuucagcccaggaaagauuugaacagagcaaaggc

SEQ ID NO: 364204 - RNA, 64 nt, Human
gucccauauugggucaagcugcuuaccugccucagcccaggauucuuuauucugggggagguaa

SEQ ID NO: 364205 - RNA, 64 nt, Human
ggaugaaggaaggggcuauccugggaccuccccagcccaggaaaaacuggaagccuucccccag

SEQ ID NO: 364206 - RNA, 63 nt, Human
ccuucuccaaucagauguagucuggucagugaagcccaggaggaccuggggggggcaagagcu

SEQ ID NO: 364207 - RNA, 64 nt, Human
gucuguccuguggccaugucccucagggugacaggcccaggaaccaaugcuacucauucugaag

SEQ ID NO: 364208 - RNA, 64 nt, Human
uugacuggaucccaaguagcuuggaaguuuuugugcccaggagaguaaauaacugugaacaaga

SEQ ID NO: 364209 - RNA, 64 nt, Human
ccaguccagugaauccacgacccgcagaccuguccccccgcaacagcuuauaccauggaaugag

SEQ ID NO: 364210 - RNA, 64 nt, Human; identical to SEQ ID NO: 363055

SEQ ID NO: 364211 - RNA, 64 nt, Human
cccggcccugccuccccaggcggugccccugagccccccgcagcggcccgagcuggcggaagcc

SEQ ID NO: 364212 - RNA, 64 nt, Human
uccgcccccagcgagccggggacccacccaccaccccccgcaccgccgacgccgccucguucgu

SEQ ID NO: 364213 - RNA, 64 nt, Human
cuacucaggaggcugaggugggaggaucauuugagcccaggaggucaaggcugcagugagcugu

SEQ ID NO: 364214 - RNA, 64 nt, Human
uguauguugggagggagcacagugucuguggggagcccaggaagcugcucacccaagauuuggu

SEQ ID NO: 364215 - RNA, 64 nt, Human
cucugaauuuuaaaucacuuaguaagcggcucaagcccaggagggagcagagggauacgagcgg

SEQ ID NO: 364216 - RNA, 64 nt, Human
ggaaugcagguucuagaaggggugggggcauggggcccaggagguugcuagagauaggaaaugg

SEQ ID NO: 364217 - RNA, 64 nt, Human
cgagaccauccuggccccuccagacccugccugagcccaggagcugagucaccuccuccacuca

SEQ ID NO: 364218 - RNA, 64 nt, Human
ccugcacagacuggcugcuggaccugcgcacgcagcccaggaauggacauuccuaacggguggu

SEQ ID NO: 364219 - RNA, 64 nt, Human
cacuuugggaggcuggggcgagaggauugcuugagcccaggaguucaauaccugucugggaaac

SEQ ID NO: 364220 - RNA, 64 nt, Human
cuacucgggaggcugaggcggaagauucgcuugagcccaggagguggagguugcagugagccaa

SEQ ID NO: 364221 - RNA, 64 nt, Human
gguuucugcucagucugucccccuucccccucgacccccgcaaugagugggcaccaggggacgc

SEQ ID NO: 364222 - RNA, 64 nt, Human
ugcguggaaaguugcugggcccccgcccccggcucccccgcacgcaugcauccacugcggccgg

SEQ ID NO: 364223 - RNA, 64 nt, Human
cagagugaggugagcaccaugguuucucagccugcccccgcauggcaguuccuagguugcaguu

SEQ ID NO: 364224 - RNA, 64 nt, Human; identical to SEQ ID NO: 363928

SEQ ID NO: 364225 - RNA, 64 nt, Human; identical to SEQ ID NO: 362223

SEQ ID NO: 364226 - RNA, 64 nt, Human
ccuggaagggccggcuucugccuggggugcauuucccccgcagugcauaccggacuugucacac

SEQ ID NO: 364227 - RNA, 64 nt, Human; identical to SEQ ID NO: 363957

SEQ ID NO: 364228 - RNA, 64 nt, Human
gaggacucguggcuggagagagccacacagcguguaaccugaagucaucuagauuauggggaaa

SEQ ID NO: 364229 - RNA, 64 nt, Human
uaguauauuagaaacacccaaaccaguaauaugcuaaccugaugcacugcugaaagaaaaugug

SEQ ID NO: 364230 - RNA, 64 nt, Human
aaccugccuaaauuaaauugggcuucaaucacuguaaccugauucauccugggauguaaaccau

SEQ ID NO: 364231 - RNA, 64 nt, Human
ugggggugugcagucugcccuguccuucugcucauaaccugacaaaaugccaaacuaguaagca

SEQ ID NO: 364232 - RNA, 64 nt, Human
auaugccauguccuucacacgugcuugggcuccuuaaccugaaggcaaauugcuacuugcaaga

SEQ ID NO: 364233 - RNA, 64 nt, Human
gcuggccuugugcccuggcuaccugucuccauucuaaccugacuggcacaucucagccuaacca

SEQ ID NO: 364234 - RNA, 64 nt, Human
augaaacuuuaaaaaaauucacagauuauauuuauaaccugacuagagcaggugauguauuuuu

SEQ ID NO: 364235 - RNA, 64 nt, Human
cagcauggagcucuggcauccccaccucaguaucuaaccugaaccagccuggcuuuucaaacac

SEQ ID NO: 364236 - RNA, 64 nt, Human
aguauuguuacccuuccaggauacauaucaggguuaaccugacuuugaaaacugcuuaaagguu

SEQ ID NO: 364237 - RNA, 64 nt, Human
ggacacaacuguuucugcuuugagcaauaauuucuaaccugaggccaacaugucccacugcccc

SEQ ID NO: 364238 - RNA, 64 nt, Human
uauaaaucuccuuaauucuauaaauuugugucuguaaccugaauaguuugaaaacuucuuuaaa

SEQ ID NO: 364239 - RNA, 64 nt, Human
gaucugggcuagguauauuaaggguaguugccaauaaccugaagaagcuggcauuguuuacaga

SEQ ID NO: 364240 - RNA, 64 nt, Human
uuuagucaggaagacuucuugggaccauucuuaguaaccugaaauuucuuuuuuaauugcauga

SEQ ID NO: 364241 - RNA, 64 nt, Human; identical to SEQ ID NO: 364077

SEQ ID NO: 364242 - RNA, 64 nt, Human; identical to SEQ ID NO: 362109

SEQ ID NO: 364243 - RNA, 64 nt, Human; identical to SEQ ID NO: 363974

SEQ ID NO: 364244 - RNA, 64 nt, Human; identical to SEQ ID NO: 363975

SEQ ID NO: 364245 - RNA, 64 nt, Human
uacuuuccucugugacaccaaaaagaaaagucuauaaccugaaaauguuucauguucucugcug

SEQ ID NO: 364246 - RNA, 64 nt, Human
ccucacacuuucccaugaaaagggugaauguauauaaccugagcccucuccauucagaguuguu

SEQ ID NO: 364247 - RNA, 64 nt, Human
ugaccaccauccuguauccaaccaucaccaccucuaaccugaauccuaccuuaagaucagaaca

SEQ ID NO: 364248 - RNA, 64 nt, Human
aggaauguguucauucuuuuauuguccguuguuuuaaccugacugaauacaagaucaacaagag

SEQ ID NO: 364249 - RNA, 64 nt, Human
ggauccuuauuacaggaaaagcaugagugguggcuaaccugaccaauaaaguuauuuuaugauu

SEQ ID NO: 364250 - RNA, 64 nt, Human
cagcugaguugauuucugugucuauuucaacccauaaccugaagaaugaucaccuuauuccuua

SEQ ID NO: 364251 - RNA, 64 nt, Human
acuauauucuaagcacuuacauguggagauacuguaaccugagggcagaaagcccaauguguca

SEQ ID NO: 364252 - RNA, 64 nt, Human
ucagugaaaaugaagaaaguuuuccugcaguugcuaaccugaguugcaguguuuaaggccauca

SEQ ID NO: 364253 - RNA, 64 nt, Human
cauuggguucuguugggcaucuuuaaauccaccuuaaccugaggaauguaugugggcaaccagg

SEQ ID NO: 364254 - RNA, 64 nt, Human
ggaauuccuaaggagaaacagagugaggccuuuuuaaccugagauuacagauacuuauaaaacc

SEQ ID NO: 364255 - RNA, 64 nt, Human
gaaucauuaugugagaaagcaggauaacauuagguaaccugagccuccugugugguauuagaaa

SEQ ID NO: 364256 - RNA, 64 nt, Human
agaugaauuucauuuauugacuguucaacagaguuaaccugaauuauguugucuuuguuuuuaa

SEQ ID NO: 364257 - RNA, 64 nt, Human
ugaaggacaggaaguggacacgaagugauuuuuguaaccugagcaguuaaugaaugugccaaca

SEQ ID NO: 364258 - RNA, 64 nt, Human
cguuucucauauagcccucagucacugagggagucccccgcaggauuggagaggcacauucccu

SEQ ID NO: 364259 - RNA, 64 nt, Human
ugaaagugcuguacaaauuccacccgccccaggacccccgcaccugcccucuggcaccagaugc

SEQ ID NO: 364260 - RNA, 64 nt, Human; identical to SEQ ID NO: 363910

SEQ ID NO: 364261 - RNA, 64 nt, Human; identical to SEQ ID NO: 363911

SEQ ID NO: 364262 - RNA, 64 nt, Human
ugccuuuuuggagauguaacuuuuagcaguuuguuaaccugacaucucugccagucuaguuucu

SEQ ID NO: 364263 - RNA, 64 nt, Human
uagacguauuagaagauauauucugucguuuugguaaccugaucgaaguuuaccuugugucagg

SEQ ID NO: 364264 - RNA, 64 nt, Human
cuuuucuucuuugaguuaguaaagauuuauucuguaaccugacacucaucuggcccuuugcagu

SEQ ID NO: 364265 - RNA, 64 nt, Human
acaaccauaguacucugcuuucacugugcucagauaaccugaaauauauaguuguuucugagua

SEQ ID NO: 364266 - RNA, 64 nt, Human
guaaauacucccacuaugccugaugugacgcuacuaaccugacaucaccaaguguggaauugga

SEQ ID NO: 364267 - RNA, 64 nt, Human
uagggcucccacugccaaaugcaagcagauagcauaaccugacuguuaugugcccucaggcagc

SEQ ID NO: 364268 - RNA, 64 nt, Human
uagguaauauugcaaggcaaagacuauucccuucuaaccugaacugauggguuucuccagaggg

SEQ ID NO: 364269 - RNA, 64 nt, Human
auuuauaauuugaagcuauucuguaauuaaaauauaaccugaauucagcuugcagaauggaagc

SEQ ID NO: 364270 - RNA, 64 nt, Human
ggcugguugggagcagagcuaaguggcuucccauuaaccugaggucucuuucuuuacucugggu

SEQ ID NO: 364271 - RNA, 64 nt, Human
aauaugaaugacuuuuuaggaacuacuuuuugucuaaccugaaaaaguuccacauuuggaagac

SEQ ID NO: 364272 - RNA, 64 nt, Human
gguccccuccaaugcugaauacagaugauuuguguaaccugaggccaggauuaaggggaggcaa

SEQ ID NO: 364273 - RNA, 64 nt, Human
gcaacuaaauuuuguuuuguucuuugaaaaaggcuaaccugagcuagguaaagguuauaucauu

SEQ ID NO: 364274 - RNA, 64 nt, Human
augaaguauauuagacaacaacaaaaggaacaacuaaccugaaauauauaauaacuuugaacuu

SEQ ID NO: 364275 - RNA, 64 nt, Human; identical to SEQ ID NO: 363036

SEQ ID NO: 364276 - RNA, 64 nt, Human
caggccccugucgagcuggggucccagccaggugcccccgcaugcccuccugcaguugcuggau

SEQ ID NO: 364277 - RNA, 64 nt, Human
cagaaugcacugcugaggagcaugcccacccccacccccgcagugugcagauuaaagcaaguca

SEQ ID NO: 364278 - RNA, 64 nt, Human
cuucauccuaggcaacagagcgagacucugucuccccccgcaaaaaaaaaaaagaaagaaagaa

SEQ ID NO: 364279 - RNA, 64 nt, Human
uguugcucuaucuuauuguauaugcauugaguauuaaccugaauguuuuguuacuuaaauauua

SEQ ID NO: 364280 - RNA, 64 nt, Human
ugccucaugucucaaggcagcagcuccucucugguaaccugauggugauguggccagggugccg

SEQ ID NO: 364281 - RNA, 64 nt, Human
caucacacacgaacaauaaaauaaaguguucuauuaaccugaucucuuugcccuuuugcuaugu

SEQ ID NO: 364282 - RNA, 64 nt, Human
acacuaagcugaauuagucauguccauucagacauaaccugaacuacugaaaagaucaauuucc

SEQ ID NO: 364283 - RNA, 64 nt, Human
uuacucuuuuugggguuuaaagaaauggucugcauaaccugaaugaaagaagcaaaugacuauu

SEQ ID NO: 364284 - RNA, 64 nt, Human
uauauuugggauuauacugaaccuauuuguccaauaaccugaguuuucaaauaauuuuaguucu

SEQ ID NO: 364285 - RNA, 64 nt, Human
auauucuaaacaauauuuuucaaaguucucuuaauaaccugagauuucuaugguuugacuccag

SEQ ID NO: 364286 - RNA, 64 nt, Human
uauagaguuucuuuuuccacgguagucagugacuuaaccugaauuguaaauguuuguaaagggu

SEQ ID NO: 364287 - RNA, 64 nt, Human
cacaauaaaacuuggccuccacaauccuuuaucuuaaccugaacauuccuuuccauugauccca

SEQ ID NO: 364288 - RNA, 64 nt, Human
ucagccaguggugacccugcuuuuguaaccgcguuaaccugacaaaaccucagcagcagaaguc

SEQ ID NO: 364289 - RNA, 64 nt, Human
gaaaugaacauagcguuuugcacuaaugauaagauaaccugagagguaggguugaggaacacag

SEQ ID NO: 364290 - RNA, 64 nt, Human
aaaauagcucuaaaauuuguuucaaccuaauugguaaccugaguuuauaucuggcaugaauuca

SEQ ID NO: 364291 - RNA, 64 nt, Human
aacucuggaacacuauucuuacagaaugccuuucuaaccugaaggauacccagauuucuuucuu

SEQ ID NO: 364292 - RNA, 61 nt, Human; identical to SEQ ID NO: 302794

SEQ ID NO: 364293 - RNA, 64 nt, Human; identical to SEQ ID NO: 363017

SEQ ID NO: 364294 - RNA, 64 nt, Human; identical to SEQ ID NO: 363844

SEQ ID NO: 364295 - RNA, 64 nt, Human; identical to SEQ ID NO: 363845

SEQ ID NO: 364296 - RNA, 64 nt, Human
acagggacuacguauuuuucugacuuuuacagauuaaccugaaagaacauacaugauacauuuu

SEQ ID NO: 364297 - RNA, 64 nt, Human
cacaugaguaugccacucuaucagcuacucugauuaaccugacagucggguuguuuagucagua

SEQ ID NO: 364298 - RNA, 64 nt, Human
agaggaaguuuauuuguugaauagcacaacucuuuaaccugagggagucaucuacuuuuuuuuc

SEQ ID NO: 364299 - RNA, 64 nt, Human
uuuauaaagcuaguauuguaaagauuugugaugauaaccugacccaugagcaguuguaaaacag

SEQ ID NO: 364300 - RNA, 64 nt, Human
uagccaacagaaccuccugacuuucaccugcuuuuaaccugaaaauauauuaauacgccucuga

SEQ ID NO: 364301 - RNA, 64 nt, Human
ugcucuuccccuccuauaaucauaauaaucaugauaaccugaaacauguuacugggacucgaca

SEQ ID NO: 364302 - RNA, 64 nt, Human
ugggagguuaaaaagaaaaguuuauaaaagugaauaaccugaggauucuauuaguccccaccca

SEQ ID NO: 364303 - RNA, 64 nt, Human
aagugcuuaguuuuauuccuaauucugccccuuuuaaccugauguguaccuuacucuuuccucc

SEQ ID NO: 364304 - RNA, 64 nt, Human
aaaccaaccauagaacuuuauaauaggacaguuauaaccugacugaaccaaauccaucagcaua

SEQ ID NO: 364305 - RNA, 64 nt, Human
cccucugccuggcaccuggauacccugggccagguaaccugagggcaggggagagguggggugg

SEQ ID NO: 364306 - RNA, 64 nt, Human
cuauggcugcuuuuguagccuuuccaagaagcacuaaccugaaauaagauuagauaauugugag

SEQ ID NO: 364307 - RNA, 64 nt, Human
ccuuuuuugcacuuuggugaauuacgugccuccauaaccugaacugugccgacuccacaaaacg

SEQ ID NO: 364308 - RNA, 64 nt, Human
aaucaauuuuguucauuuuuaauuugcaaaucgauaaccugaacuaauuuguucuuauuuuuug

SEQ ID NO: 364309 - RNA, 64 nt, Human; identical to SEQ ID NO: 363912

SEQ ID NO: 364310 - RNA, 64 nt, Human; identical to SEQ ID NO: 363913

SEQ ID NO: 364311 - RNA, 64 nt, Human; identical to SEQ ID NO: 363861

SEQ ID NO: 364312 - RNA, 64 nt, Human; identical to SEQ ID NO: 363862

SEQ ID NO: 364313 - RNA, 64 nt, Human
guacucugagguccaaauacugucugucaauguguaaccugaugucucaacccccugugagaag

SEQ ID NO: 364314 - RNA, 64 nt, Human
aucaaucaucugugugaaaauggguuggugcuucuaaccugauggcacuuagcuaucagaagac

SEQ ID NO: 364315 - RNA, 64 nt, Human
gaaaguguuugugccugucagacacuuaaaaaaauaaccugagaugaagaauuuacaauugaag

SEQ ID NO: 364316 - RNA, 64 nt, Human
aaaaaaaaaauggaauaauguucucugcuacuuuuaaccugauuuucuuuguuaccuaaauagg

SEQ ID NO: 364317 - RNA, 64 nt, Human
cagcucuuugcugcuucacuucuuuguaaaguuguaaccugaugguaauuagcuggcuucauua

SEQ ID NO: 364318 - RNA, 64 nt, Human
ccaguugcaggccgcugauugccauguugauuuuuaaccugauauucuuuuuaauuguuuuaaa

SEQ ID NO: 364319 - RNA, 64 nt, Human
uaacuuuuaucauuuaacucucucauguuuguuguaaccugagguauccaaaugcuacagaaaa

SEQ ID NO: 364320 - RNA, 64 nt, Human
uugugauaguaaucacaaauuuuuggcuaauuuuuaaccugagguuuuguuuuuuuuuuaaagg

SEQ ID NO: 364321 - RNA, 64 nt, Human
guugguaauauagcuuuuaaggagaacccaugaauaaccugauuugggcagugaugauuuauua

SEQ ID NO: 364322 - RNA, 64 nt, Human
ugggaguuuugcuuguugauauaaccuuuuuaguuaaccugaaagauuccaaaaauuguucuua

SEQ ID NO: 364323 - RNA, 64 nt, Human
ggucugagggcucaggccuccaccugagagguuauaaccugagagacagcucuacccuuccucc

SEQ ID NO: 364324 - RNA, 64 nt, Human
uuauuauaguuuucaaauugauuuauaccauuauuaaccugauguggucugcuuaaaaaaugaa

SEQ ID NO: 364325 - RNA, 64 nt, Human
ucaccuggaguuuucuuacguuaauacauuaaaauaaccugaaggaaacuuucguuaugggcca

SEQ ID NO: 364326 - RNA, 64 nt, Human
caggccuggugcagcccacucugugccuggacaucccccgcaggccgccgcgucuguguugggg

SEQ ID NO: 364327 - RNA, 64 nt, Human
ccagcagccugugcaaauucugaugauggccccacccccgcacacgcacacgcacaucaugcuu

SEQ ID NO: 364328 - RNA, 64 nt, Human
agcccaccuuuuuuccuaaucugugugugcccuguaaccugacugguuaacagcaguccuuugu

SEQ ID NO: 364329 - RNA, 64 nt, Human
gcuuucgcaaaccuagccuuuuaagagagguuuuuaaccugaagcaugagaauauaucaccugu

SEQ ID NO: 364330 - RNA, 64 nt, Human
cuguacagagucuuacuguagcuacgcuaaugguuaaccugauagaauuaacucguauuuuucu

SEQ ID NO: 364331 - RNA, 64 nt, Human
ccugauagaauuaacucguauuuuucuaugguuuuaaccugaugcuccacugucuccgucaugg

SEQ ID NO: 364332 - RNA, 64 nt, Human
cuuuucuaacucacaagucuucccugagacagacuaaccugaaagcuuugccuaacaguagcuu

SEQ ID NO: 364333 - RNA, 64 nt, Human
ucccuucgauauaugacuuuuucucaguaaauauuaaccugaauuauuccaacuccccuuguac

SEQ ID NO: 364334 - RNA, 64 nt, Human
cuuuuacccugcuuucaucauggauuuuuuuguguaaccugaaacaagucaccagugcucacug

SEQ ID NO: 364335 - RNA, 64 nt, Human
aaagacaggagaaaagaaaacagaaaccugguuauaaccugacgcuaaaacuaaaaacaaggaa

SEQ ID NO: 364336 - RNA, 64 nt, Human
gggucaggagcuccaucugggaacuaacagcugcuaaccugaccagccgcucaggacaggaccc

SEQ ID NO: 364337 - RNA, 64 nt, Human
cuugaagauaaacuaugcuucuuuuuucuucuguuaaccugaaagauaucauuugggucagagc

SEQ ID NO: 364338 - RNA, 64 nt, Human
uccaggaaaacgcugguuaggccugggauugagcuaaccugaaacaaagguagcaggcaggacc

SEQ ID NO: 364339 - RNA, 64 nt, Human
ugccuuucuaaaaacccaaaauguaguucucuauuaaccugaaauguacacuagcccagaacag

SEQ ID NO: 364340 - RNA, 64 nt, Human
aacuuugacaaaaaugguuuugaauagaucuuuauaaccugaugccauaaauacaagauucucu

SEQ ID NO: 364341 - RNA, 64 nt, Human; identical to SEQ ID NO: 363878

SEQ ID NO: 364342 - RNA, 64 nt, Human; identical to SEQ ID NO: 363879

SEQ ID NO: 364343 - RNA, 64 nt, Human; identical to SEQ ID NO: 363959

SEQ ID NO: 364344 - RNA, 64 nt, Human; identical to SEQ ID NO: 363960

SEQ ID NO: 364345 - RNA, 64 nt, Human
gacauuaaauugacuuuuaagaaaaacaugucacuaaccugaagcucagccacacagugacuuu

SEQ ID NO: 364346 - RNA, 64 nt, Human
ucaacuguugugugaaugagccagacacauugcuuaaccugaguccgagauggacaaugguaua

SEQ ID NO: 364347 - RNA, 64 nt, Human
ucaggcugcuggcgccucugcaagggcagaacacuaaccugaccgugggcggggccuugcggua

SEQ ID NO: 364348 - RNA, 64 nt, Human
gaagcccccucugcuuuaauccacacaaggaacguaaccugaaguaaccugauguuaaccaauc

SEQ ID NO: 364349 - RNA, 64 nt, Human
cugcuuuaauccacacaaggaacguaaccugaaguaaccugauguuaaccaaucugcugugucu

SEQ ID NO: 364350 - RNA, 64 nt, Human
acucaugccaacaagaaccugugccccuccuuccuaaccugaggccugggguuccucagaccau

SEQ ID NO: 364351 - RNA, 64 nt, Human
caaaaacuuuuuaaaaagguccagaauucuauuuuaaccugauguugagcaccuuuaaaauguu

SEQ ID NO: 364352 - RNA, 64 nt, Human
aaacuagaaaaagaagagcaaauuaaauccaaaguaaccugaaaaaacauuagaguaaaaauca

SEQ ID NO: 364353 - RNA, 64 nt, Human
gacauguagcaaugucuauauuggcucauaaaacuaaccugaaaaacaaauaaaugcuuuggaa

SEQ ID NO: 364354 - RNA, 64 nt, Human
ugaaaguaauucagcaacaggucacuuugggauauaaccugaaccuuuuuuuggaguggggugg

SEQ ID NO: 364355 - RNA, 64 nt, Human
guuccuuuuugccaguuauguucaggaaacccaauaaccugaaaaaguuugacuuugaugugac

SEQ ID NO: 364356 - RNA, 64 nt, Human
uauuuuuauuucuaaccacaauuuuacagaacuuuaaccugaaaucuguugaugauuuaaagaa

SEQ ID NO: 364357 - RNA, 64 nt, Human
aaacuuguaaauuucuuuguauauaaacuagcuguaaccugacuauccuuuguguuuacuguuu

SEQ ID NO: 364358 - RNA, 64 nt, Human
gguggucuucaagccuggcccagugagagugaggcccccgcacgcaagccucagccacucccag

SEQ ID NO: 364359 - RNA, 64 nt, Human
uuguaauauucuccccacccaccccacgcccgcacccccgcacccuuaagaagguauuuuguaa

SEQ ID NO: 364360 - RNA, 64 nt, Human
gugagccuggcugcccgccugcacgcccccacugcccccgcacgaaucaccuccugcuggcuac

SEQ ID NO: 364361 - RNA, 64 nt, Human; identical to SEQ ID NO: 363927

SEQ ID NO: 364362 - RNA, 64 nt, Human
uucagguagcuacacagaaucuacacagcaaaguuaaccugacacagaaaauccuugugcaaau

SEQ ID NO: 364363 - RNA, 64 nt, Human
guggucccucaaggucuucgaauagauguuuaucuaaccugacaguugcaguuuucacccaugg

SEQ ID NO: 364364 - RNA, 64 nt, Human
ugguuaggacaaaguggauggaugccgggaaguuuaaccugagccuuaggauccaaugagugga

SEQ ID NO: 364365 - RNA, 64 nt, Human
aaguucauauucuaccucuaaaaacagguagugguaaccugacucuucuaaucuugaaccaaaa

SEQ ID NO: 364366 - RNA, 64 nt, Human
ugagagccuccugggcauguuugucugugugcuguaaccugaagucaaaccuuaagauaaugga

SEQ ID NO: 364367 - RNA, 64 nt, Human
ucauauacauccaaaaaguauaggcuaauauauauaaccugaaguugcagcugguucuuuuuga

SEQ ID NO: 364368 - RNA, 64 nt, Human
ccaguccccucuugcagggguugcuauaucuacuuaaccugaauagguguuucacacaggucug

SEQ ID NO: 364369 - RNA, 64 nt, Human
cuguaccaaagucaaaaugaacguuacaucacucuaaccugaacagcucacaauguagcuguaa

SEQ ID NO: 364370 - RNA, 64 nt, Human
ucucuuucaaacaaagauaaaggaauuuauuuuuuaaccugagaaacugauugcaaaaaggaaa

SEQ ID NO: 364371 - RNA, 64 nt, Human
aaucccagcacuuugcgauaccaaggcggguggauaaccugagguagggaguucgagaccagcc

SEQ ID NO: 364372 - RNA, 64 nt, Human
uucuuugaccuaaaguugaaggguuuagaguuuuuaaccugaucuguagagcagagagguugaa

SEQ ID NO: 364373 - RNA, 64 nt, Human
cucugguuagaaacagguccucaggaguauucucuaaccugauauuuucuaaaaagauauguug

SEQ ID NO: 364374 - RNA, 63 nt, Human
uuuuaacucguuccaauaugccuuauaaaccacuuaaccugauucugugacaguugcaugauu

SEQ ID NO: 364375 - RNA, 64 nt, Human; identical to SEQ ID NO: 363073

SEQ ID NO: 364376 - RNA, 59 nt, Human; identical to SEQ ID NO: 302995

SEQ ID NO: 364377 - RNA, 64 nt, Human; identical to SEQ ID NO: 363091

SEQ ID NO: 364378 - RNA, 64 nt, Human; identical to SEQ ID NO: 363842

SEQ ID NO: 364379 - RNA, 64 nt, Human
agcacuucucacaauguaacugcuuuagucauauuaaccugaaguugcaguuuagacacauguu

SEQ ID NO: 364380 - RNA, 64 nt, Human
gaauauuaucaaugcagaacagcuguggagacucuaaccugaagaucuauaccaaacgucgucu

SEQ ID NO: 364381 - RNA, 64 nt, Human
acugaagggaacagccugagccgaacauguuauuuaaccugaguauaguauuuaacgaagccua

SEQ ID NO: 364382 - RNA, 64 nt, Human
gcacuguaugacuugcaaucguagguauaguuuauaaccugauagcaaaaaacuugaaauauug

SEQ ID NO: 364383 - RNA, 64 nt, Human
acuuguuagcugagcucacguccccugaugcugguaaccugaaagauacgacauugcugagccu

SEQ ID NO: 364384 - RNA, 64 nt, Human
guauauaaagcaccauaagaaauccaauggcagauaaccugaaauaacguauuauguuuaaaca

SEQ ID NO: 364385 - RNA, 64 nt, Human
gagccacagaaaauggaggauaauugaggcuaaguaaccugauuacaaguuguacuaacauauu

SEQ ID NO: 364386 - RNA, 64 nt, Human
cucucccucccccaaaccuguuuacagucaauuauaaccugacaaacgagacuuuuguaacaua

SEQ ID NO: 364387 - RNA, 64 nt, Human
ucucccugaagcauaaggaucuggaagaggcuuguaaccugaacuucugugugguggcaguacu

SEQ ID NO: 364388 - RNA, 64 nt, Human
acaaaaaaggagcagagaaagacagugguacagcuaaccugaacaagggaacugggaccguugg

SEQ ID NO: 364389 - RNA, 64 nt, Human
ggggauguuuccaaugcuuugaucccuucuuacuuaaccugaagcuagacgagcaggcuucuuc

SEQ ID NO: 364390 - RNA, 64 nt, Human
caggguaguuguaugauuuuguuaccagcagugcuaaccugaaugugaccugguuaccuuggaa

SEQ ID NO: 364391 - RNA, 64 nt, Human
acaaguacauugugucaacuuaauuuaaaguauguaaccugaauuaacucguguaauauuugug

SEQ ID NO: 364392 - RNA, 64 nt, Human
uuccaggcggggaaccugcuuccugccuucacugcccccgcagcacucacagacaucucccugg

SEQ ID NO: 364393 - RNA, 64 nt, Human
gaacuguuggcugcuccccacccgccucccgccucccccgcagguuaugucagcagcucugaga

SEQ ID NO: 364394 - RNA, 64 nt, Human
ccuggggggcccuugaugccacuaaucccccgaccccccgcaucugccaaacugcacagacaca

SEQ ID NO: 364395 - RNA, 64 nt, Human
cuuauuggaaggcagcucccgcauaccaggauaacccccgcaaaccacauagcagacccccgcc

SEQ ID NO: 364396 - RNA, 64 nt, Human
augauuccauuccauucuagaaauuugaaguauguaaccugaaauccuuaauaaaauuuggauu

SEQ ID NO: 364397 - RNA, 64 nt, Human
uauuguguuuuaggugacauaguuaacuguaaaguaaccugacucaguauaguuacugguacca

SEQ ID NO: 364398 - RNA, 64 nt, Human
auauuuugacgaaucggcaugaguguaacagugauaaccugaucuguuuguuuuaaagauuauu

SEQ ID NO: 364399 - RNA, 64 nt, Human
gagcucucacagaaagcuuaaucauagauauaauuaaccugauccaaaugaguaaaguggaccu

SEQ ID NO: 364400 - RNA, 64 nt, Human
gcuuuuucuugaugcuaagaucacugcagaagaauaaccugaccuuuucuuugcauuuguuuug

SEQ ID NO: 364401 - RNA, 64 nt, Human
uguuacaaagauacuuaguauagcuccucagccauaaccugagacuugggaugaaauuuaaacc

SEQ ID NO: 364402 - RNA, 64 nt, Human
uuuuuuaaucaccguuuguuuugugcuuucuaguuaaccugaugccaguacagugcaauuggaa

SEQ ID NO: 364403 - RNA, 64 nt, Human
accagaaaaaaauguuuauacaacccuaagucaauaaccugaccuuagaaaauugugagagcca

SEQ ID NO: 364404 - RNA, 64 nt, Human
ugaaauaauaagugggaguccuuggaccacauccuaaccugagacaaugccgagccugagacaa

SEQ ID NO: 364405 - RNA, 64 nt, Human
ucaucauucucucuucuagugucuaucuuuaucauaaccugaugucccaaacuugugacaaguu

SEQ ID NO: 364406 - RNA, 64 nt, Human
ugugaacuucuguguuucuaaaguauuuauguauuaaccugaccauacuggaaucagacauaaa

SEQ ID NO: 364407 - RNA, 64 nt, Human
ccccagugaucugauucuucuguuuuuuaauuuuuaaccugauucucugaugucaugaucuaaa

SEQ ID NO: 364408 - RNA, 64 nt, Human
uuuuccagcuccucauccagggcucugaccaguuuaaccugaugcagucacguggaggagcagu

SEQ ID NO: 364409 - RNA, 64 nt, Human; identical to SEQ ID NO: 362224

SEQ ID NO: 364410 - RNA, 64 nt, Human
cagcacuucagaaaauacacaacagccccuucugcccccgcacagaaaugcugcagaguauaua

SEQ ID NO: 364411 - RNA, 64 nt, Human; identical to SEQ ID NO: 364044

SEQ ID NO: 364412 - RNA, 64 nt, Human; identical to SEQ ID NO: 364045

SEQ ID NO: 364413 - RNA, 64 nt, Human
cagaggcugcaggacccuccagggccugcgggcauaaccugaucuguagcugggcucagccaca

SEQ ID NO: 364414 - RNA, 64 nt, Human
agcugagucuucugcaucagauuauugcaacauuuaaccugaauuuaaaagcacacgaaacaaa

SEQ ID NO: 364415 - RNA, 64 nt, Human
gcauaaccucuagcaucgauucaaagcagaguuuuaaccugacggcauggaauguauaaaugag

SEQ ID NO: 364416 - RNA, 64 nt, Human
auucagucugugccuacauguucucaugcaugucuaaccugauuuaccucuuaccuguaaccua

SEQ ID NO: 364417 - RNA, 64 nt, Human
ggccauggagagguuggggcaacagguuauugauuaaccugacuuuauagggacugaaguccac

SEQ ID NO: 364418 - RNA, 64 nt, Human
caugucccuucccuuccccagcccugccaggccuuaaccugaucacggggcagggcugggcccu

SEQ ID NO: 364419 - RNA, 64 nt, Human
ccaucuguuuucagaucuguuaccauugggaugauaaccugaggacccccacuggaaaucuccc

SEQ ID NO: 364420 - RNA, 64 nt, Human
uucuaccaugaguuauaugagucaagauccugccuaaccugaaauuauuagggauuuacucagc

SEQ ID NO: 364421 - RNA, 64 nt, Human
aaccccagcacuuugggaggcggagacgggcagauaaccugaggucaggauuucgagaccaacc

SEQ ID NO: 364422 - RNA, 64 nt, Human
uucuccagcccuuggggcaacugagcaauauacuuaaccugaaucucuacucacagcccccacc

SEQ ID NO: 364423 - RNA, 64 nt, Human
cauucauaagaggucuuagaagaaaauaaccaguuaaccugauuucaauuuugauaccguuuuc

SEQ ID NO: 364424 - RNA, 64 nt, Human
acucuucucccuauacaagguggauggcugauuuuaaccugaaauuuuaaauccacagauugag

SEQ ID NO: 364425 - RNA, 64 nt, Human
caggaacggggucccacaggcguguuguuuuaaauaaccugaugcugugugcaugaugcuggug

SEQ ID NO: 364426 - RNA, 59 nt, Human; identical to SEQ ID NO: 302837

SEQ ID NO: 364427 - RNA, 64 nt, Human; identical to SEQ ID NO: 363015

SEQ ID NO: 364428 - RNA, 64 nt, Human
acaggcuguacugccaggcugcgaugcgugcuggcccccgcacaggcuccugugugcagggacu

SEQ ID NO: 364429 - RNA, 64 nt, Human
acucucagcugugguacugcccuguaagaaccugcccccgcaaaacucuggagucccugggaca

SEQ ID NO: 364430 - RNA, 64 nt, Human
agcuuaguuugacaaagggugucauaugcuuuccuaaccugauuuguaguuaacauucacagag

SEQ ID NO: 364431 - RNA, 64 nt, Human
gacaagacacauccaaugcugcaaaaauggugaauaaccugauucaggguuagcagcaaugagu

SEQ ID NO: 364432 - RNA, 64 nt, Human
ugcauagcgggucauguagucucuagaaaauacauaaccugauggaaauguagaagcuauaugu

SEQ ID NO: 364433 - RNA, 64 nt, Human
aaacauaagaaaauuuauacuggagagaaacuacuaaccugaaagaugugacaauaauuuugac

SEQ ID NO: 364434 - RNA, 64 nt, Human
gguggccuggguggggucguccaacuagguuugcuaaccugaggggucacugggccuggccacu

SEQ ID NO: 364435 - RNA, 64 nt, Human
agaaguccccucuacuuuaacuuuuacaaaaaaguaaccugaacuaaucugauguuaaccaaug

SEQ ID NO: 364436 - RNA, 64 nt, Human
cagugguauuggacauaucuguuacccccaaaguuaaccugaggcccuuaaccuuucucucagu

SEQ ID NO: 364437 - RNA, 64 nt, Human
ccagccaccagcuaaaugccagugagcgacuugguaaccugaacugaugccauguagaauggaa

SEQ ID NO: 364438 - RNA, 64 nt, Human
ccuuuugguauuggcuauuucaacuaaagcagauuaaccugaaauccauccaaguuguucugca

SEQ ID NO: 364439 - RNA, 64 nt, Human
aaccacaaaguccugcuuaaaacuauggaaaaccuaaccugauuagagccuugacuauuuugaa

SEQ ID NO: 364440 - RNA, 64 nt, Human
uccaccugacaguuuguaagagugaaagagcaucuaaccugaugcucuuggagagagauaaccu

SEQ ID NO: 364441 - RNA, 64 nt, Human
uggugcucucagccauuguagaagaugguggcuuuaaccugacugucuaaaaauucccagcuaa

SEQ ID NO: 364442 - RNA, 64 nt, Human
ccaccugcccaugcuuccuugaauuaggcuuuccuaaccugaagcgccuucaaacuuccaauaa

SEQ ID NO: 364443 - RNA, 64 nt, Human; identical to SEQ ID NO: 363016

SEQ ID NO: 364444 - RNA, 64 nt, Human
uggaugggagaagaaggaaggggguggcccgucacccccgcaagacuugcauccagguagccua

SEQ ID NO: 364445 - RNA, 64 nt, Human
acaacugugcuuaucaaaauugugaacacccccacccccgcauuuuuguguguugaaauucuug

SEQ ID NO: 364446 - RNA, 64 nt, Human
ccagcagccugugcaaauucugaugaugaccccacccccgcacacgcacacgcacaucaugcuu

SEQ ID NO: 364447 - RNA, 64 nt, Human
aauuccaucuuguaaaggauauuaaauguugcuuuaaccugaaccuugagcaaauuaguugguu

SEQ ID NO: 364448 - RNA, 64 nt, Human
aauaccuuuuccuuccucagagagaaaucuccccuaaccugaauugcagcccccuccaguuugc

SEQ ID NO: 364449 - RNA, 64 nt, Human
cagggggagaaauccuugagccagggcugccauauaaccugacaggaacaugcuacugaaguuu

SEQ ID NO: 364450 - RNA, 64 nt, Human
ucucuccgggaccugaucgagcgcugucuggcuuuaaccugagcugguccaguagacaucguuu

SEQ ID NO: 364451 - RNA, 64 nt, Human
ucuuccuagauagucgcccacuccaccuccuacuuaaccugagacucauuauuuagcuauuucu

SEQ ID NO: 364452 - RNA, 64 nt, Human
uucccagaagugccucugcugugcuggcauaaaauaaccugaaaagauucugaaaagccaggau

SEQ ID NO: 364453 - RNA, 64 nt, Human
ccuguucucuaguuuuccagacugcugguuuggguaaccugaaguuuuaugaucccugaacaua

SEQ ID NO: 364454 - RNA, 64 nt, Human
auuaaauaauaauaggucugggcaguauuguuuuuaaccugacucauccagcuguccuucaaau

SEQ ID NO: 364455 - RNA, 64 nt, Human
auuaauccuuuuuggagggaggaguagagauauauaaccugaaaauacuuauucuuucuuaucg

SEQ ID NO: 364456 - RNA, 64 nt, Human
ccugaggagcagcaguugcugguggcuaaugguguaaccugagauggcccucugguagacacag

SEQ ID NO: 364457 - RNA, 64 nt, Human
gcuacuugagauugcaguaagaagauacguuuucuaaccugaaaguuaaaucgcauuuguuuuc

SEQ ID NO: 364458 - RNA, 64 nt, Human
aucuaacuauaaccucccccauaguuaugaagaguaaccugaaaugccacuauuguggaaauag

SEQ ID NO: 364459 - RNA, 64 nt, Human
augcucuacaugccuaauguuuugugauucacuuuaaccugaugguuugcauuugcuguuuuuc

SEQ ID NO: 364460 - RNA, 64 nt, Human
ccccaggaccugagcucccagcaucugcagacgacccccgcagccuuucccucggaccccccuc

SEQ ID NO: 364461 - RNA, 64 nt, Human
aucuaugacuugagccaggucugguccguggugucccccgcacccagcaggggacaggcacuca

SEQ ID NO: 364462 - RNA, 64 nt, Human
auggaucaaagaaauucagaacagccugccuguccccccgcacuuuuuacauauauuuguuuca

SEQ ID NO: 364463 - RNA, 64 nt, Human
ugguucuagucaauucugaaccaccaccccccgccccccgcaaaaaaguaaaagucaaaccaaa

SEQ ID NO: 364464 - RNA, 64 nt, Human
uacaucuuugcaguucuguuaggugcucuguaauuaaccugacuuauaugugaacaauuuucau

SEQ ID NO: 364465 - RNA, 64 nt, Human
cauacagccuugaaaaaaguaaaacccugaccuguaaccugaacacuauuauuccuuauaguca

SEQ ID NO: 364466 - RNA, 64 nt, Human
gugcagggguucugcuucauugcauuuucagaauuaaccugaaaguugaaacaaccauuuuuuu

SEQ ID NO: 364467 - RNA, 64 nt, Human
ccacaaauuuuaaacuuaugaugaaaauuuacaauaaccugaaagauccagagauguaugagag

SEQ ID NO: 364468 - RNA, 64 nt, Human
gcggggcucagcccccuccaggaugcagcccccucccccgcaccccggaaccggcgucgcuggc

SEQ ID NO: 364469 - RNA, 64 nt, Human
ugugacauuuugccaacuuaaacgagaaaaagaccccccgcacccggcacacucccccuuccuc

SEQ ID NO: 364470 - RNA, 64 nt, Human
uggaaagcagguucugugggaccccccgccccgccccccgcacuccuucauagcagcaguagug

SEQ ID NO: 364471 - RNA, 64 nt, Human
acaguuggcagagaaggccucuugugcucacgcucccccgcaguccccagcccuucugccuuuc

SEQ ID NO: 364472 - RNA, 64 nt, Human
ucuauuaauacaugccuuuuccucccauccaccucccccgcacacacacaaagaugaccuggga

SEQ ID NO: 364473 - RNA, 64 nt, Human
gguugcccuacaggcccacagggccaccagcacacccccgcacgcugggcaccaacagagccac

SEQ ID NO: 364474 - RNA, 64 nt, Human
ugcacagcguggcuuuuccuaaacugguguuuuucccccgcauuugguggauuuuuuauuauua

SEQ ID NO: 364475 - RNA, 64 nt, Human; identical to SEQ ID NO: 313922

SEQ ID NO: 364476 - RNA, 64 nt, Human; identical to SEQ ID NO: 313923

SEQ ID NO: 364477 - RNA, 64 nt, Human; identical to SEQ ID NO: 313924

SEQ ID NO: 364478 - RNA, 64 nt, Human; identical to SEQ ID NO: 313925

SEQ ID NO: 364479 - RNA, 64 nt, Human; identical to SEQ ID NO: 313929

SEQ ID NO: 364480 - RNA, 64 nt, Human; identical to SEQ ID NO: 313930

SEQ ID NO: 364481 - RNA, 64 nt, Human; identical to SEQ ID NO: 313931

SEQ ID NO: 364482 - RNA, 64 nt, Human; identical to SEQ ID NO: 313932

SEQ ID NO: 364483 - RNA, 64 nt, Human; identical to SEQ ID NO: 313933

SEQ ID NO: 364484 - RNA, 64 nt, Human; identical to SEQ ID NO: 313934

SEQ ID NO: 364485 - RNA, 64 nt, Human; identical to SEQ ID NO: 313935

SEQ ID NO: 364486 - RNA, 64 nt, Human; identical to SEQ ID NO: 313936

SEQ ID NO: 364487 - RNA, 64 nt, Human; identical to SEQ ID NO: 313937

SEQ ID NO: 364488 - RNA, 64 nt, Human; identical to SEQ ID NO: 313938

SEQ ID NO: 364489 - RNA, 64 nt, Human; identical to SEQ ID NO: 313939

SEQ ID NO: 364490 - RNA, 64 nt, Human; identical to SEQ ID NO: 313940

SEQ ID NO: 364491 - RNA, 64 nt, Human; identical to SEQ ID NO: 364222

SEQ ID NO: 364492 - RNA, 64 nt, Human; identical to SEQ ID NO: 364223

SEQ ID NO: 364493 - RNA, 64 nt, Human; identical to SEQ ID NO: 363976

SEQ ID NO: 364494 - RNA, 64 nt, Human; identical to SEQ ID NO: 313941

SEQ ID NO: 364495 - RNA, 64 nt, Human; identical to SEQ ID NO: 313942

SEQ ID NO: 364496 - RNA, 64 nt, Human; identical to SEQ ID NO: 313946

SEQ ID NO: 364497 - RNA, 64 nt, Human; identical to SEQ ID NO: 313947

SEQ ID NO: 364498 - RNA, 64 nt, Human; identical to SEQ ID NO: 313948

SEQ ID NO: 364499 - RNA, 64 nt, Human; identical to SEQ ID NO: 313949

SEQ ID NO: 364500 - RNA, 64 nt, Human; identical to SEQ ID NO: 313950

SEQ ID NO: 364501 - RNA, 64 nt, Human; identical to SEQ ID NO: 313951

SEQ ID NO: 364502 - RNA, 64 nt, Human; identical to SEQ ID NO: 313952

SEQ ID NO: 364503 - RNA, 64 nt, Human; identical to SEQ ID NO: 313953

SEQ ID NO: 364504 - RNA, 64 nt, Human; identical to SEQ ID NO: 313954

SEQ ID NO: 364505 - RNA, 64 nt, Human; identical to SEQ ID NO: 313955

SEQ ID NO: 364506 - RNA, 64 nt, Human; identical to SEQ ID NO: 313956

SEQ ID NO: 364507 - RNA, 64 nt, Human; identical to SEQ ID NO: 313957

SEQ ID NO: 364508 - RNA, 64 nt, Human; identical to SEQ ID NO: 313958

SEQ ID NO: 364509 - RNA, 64 nt, Human; identical to SEQ ID NO: 313959

SEQ ID NO: 364510 - RNA, 64 nt, Human; identical to SEQ ID NO: 364095

SEQ ID NO: 364511 - RNA, 64 nt, Human; identical to SEQ ID NO: 364096

SEQ ID NO: 364512 - RNA, 64 nt, Human; identical to SEQ ID NO: 362110

SEQ ID NO: 364513 - RNA, 64 nt, Human; identical to SEQ ID NO: 313964

SEQ ID NO: 364514 - RNA, 64 nt, Human; identical to SEQ ID NO: 313965

SEQ ID NO: 364515 - RNA, 64 nt, Human; identical to SEQ ID NO: 313966

SEQ ID NO: 364516 - RNA, 64 nt, Human; identical to SEQ ID NO: 313967

SEQ ID NO: 364517 - RNA, 64 nt, Human; identical to SEQ ID NO: 313968

SEQ ID NO: 364518 - RNA, 64 nt, Human; identical to SEQ ID NO: 313969

SEQ ID NO: 364519 - RNA, 64 nt, Human; identical to SEQ ID NO: 313970

SEQ ID NO: 364520 - RNA, 64 nt, Human; identical to SEQ ID NO: 313971

SEQ ID NO: 364521 - RNA, 64 nt, Human; identical to SEQ ID NO: 313972

SEQ ID NO: 364522 - RNA, 64 nt, Human; identical to SEQ ID NO: 313973

SEQ ID NO: 364523 - RNA, 64 nt, Human; identical to SEQ ID NO: 313974

SEQ ID NO: 364524 - RNA, 64 nt, Human; identical to SEQ ID NO: 313975

SEQ ID NO: 364525 - RNA, 64 nt, Human; identical to SEQ ID NO: 313976

SEQ ID NO: 364526 - RNA, 64 nt, Human; identical to SEQ ID NO: 313977

SEQ ID NO: 364527 - RNA, 64 nt, Human; identical to SEQ ID NO: 313981

SEQ ID NO: 364528 - RNA, 64 nt, Human; identical to SEQ ID NO: 313982

SEQ ID NO: 364529 - RNA, 64 nt, Human; identical to SEQ ID NO: 364444

SEQ ID NO: 364530 - RNA, 64 nt, Human; identical to SEQ ID NO: 364445

SEQ ID NO: 364531 - RNA, 64 nt, Human; identical to SEQ ID NO: 364446

SEQ ID NO: 364532 - RNA, 64 nt, Human; identical to SEQ ID NO: 313983

SEQ ID NO: 364533 - RNA, 64 nt, Human; identical to SEQ ID NO: 313984

SEQ ID NO: 364534 - RNA, 64 nt, Human; identical to SEQ ID NO: 313985

SEQ ID NO: 364535 - RNA, 64 nt, Human; identical to SEQ ID NO: 313986

SEQ ID NO: 364536 - RNA, 64 nt, Human; identical to SEQ ID NO: 313987

SEQ ID NO: 364537 - RNA, 64 nt, Human; identical to SEQ ID NO: 313988

SEQ ID NO: 364538 - RNA, 64 nt, Human; identical to SEQ ID NO: 313989

SEQ ID NO: 364539 - RNA, 64 nt, Human; identical to SEQ ID NO: 313990

SEQ ID NO: 364540 - RNA, 64 nt, Human; identical to SEQ ID NO: 313991

SEQ ID NO: 364541 - RNA, 64 nt, Human; identical to SEQ ID NO: 313992

SEQ ID NO: 364542 - RNA, 64 nt, Human; identical to SEQ ID NO: 313993

SEQ ID NO: 364543 - RNA, 64 nt, Human; identical to SEQ ID NO: 313994

SEQ ID NO: 364544 - RNA, 64 nt, Human; identical to SEQ ID NO: 313998

SEQ ID NO: 364545 - RNA, 64 nt, Human; identical to SEQ ID NO: 313999

SEQ ID NO: 364546 - RNA, 64 nt, Human; identical to SEQ ID NO: 314000

SEQ ID NO: 364547 - RNA, 64 nt, Human; identical to SEQ ID NO: 314001

SEQ ID NO: 364548 - RNA, 64 nt, Human; identical to SEQ ID NO: 359846

SEQ ID NO: 364549 - RNA, 64 nt, Human; identical to SEQ ID NO: 364460

SEQ ID NO: 364550 - RNA, 64 nt, Human; identical to SEQ ID NO: 364461

SEQ ID NO: 364551 - RNA, 64 nt, Human; identical to SEQ ID NO: 314002

SEQ ID NO: 364552 - RNA, 64 nt, Human; identical to SEQ ID NO: 314003

SEQ ID NO: 364553 - RNA, 64 nt, Human; identical to SEQ ID NO: 314004

SEQ ID NO: 364554 - RNA, 64 nt, Human; identical to SEQ ID NO: 314005

SEQ ID NO: 364555 - RNA, 64 nt, Human; identical to SEQ ID NO: 314006

SEQ ID NO: 364556 - RNA, 64 nt, Human; identical to SEQ ID NO: 314007

SEQ ID NO: 364557 - RNA, 64 nt, Human; identical to SEQ ID NO: 314008

SEQ ID NO: 364558 - RNA, 64 nt, Human; identical to SEQ ID NO: 314009

SEQ ID NO: 364559 - RNA, 64 nt, Human; identical to SEQ ID NO: 314010

SEQ ID NO: 364560 - RNA, 64 nt, Human; identical to SEQ ID NO: 314011

SEQ ID NO: 364561 - RNA, 64 nt, Human; identical to SEQ ID NO: 314015

SEQ ID NO: 364562 - RNA, 64 nt, Human; identical to SEQ ID NO: 314016

SEQ ID NO: 364563 - RNA, 64 nt, Human; identical to SEQ ID NO: 314017

SEQ ID NO: 364564 - RNA, 62 nt, Human; identical to SEQ ID NO: 314018

SEQ ID NO: 364565 - RNA, 64 nt, Human; identical to SEQ ID NO: 314019

SEQ ID NO: 364566 - RNA, 64 nt, Human; identical to SEQ ID NO: 314020

SEQ ID NO: 364567 - RNA, 64 nt, Human; identical to SEQ ID NO: 364462

SEQ ID NO: 364568 - RNA, 64 nt, Human; identical to SEQ ID NO: 364463

SEQ ID NO: 364569 - RNA, 64 nt, Human; identical to SEQ ID NO: 364209

SEQ ID NO: 364570 - RNA, 64 nt, Human; identical to SEQ ID NO: 314021

SEQ ID NO: 364571 - RNA, 64 nt, Human; identical to SEQ ID NO: 314022

SEQ ID NO: 364572 - RNA, 64 nt, Human; identical to SEQ ID NO: 314023

SEQ ID NO: 364573 - RNA, 64 nt, Human; identical to SEQ ID NO: 314024

SEQ ID NO: 364574 - RNA, 64 nt, Human; identical to SEQ ID NO: 314025

SEQ ID NO: 364575 - RNA, 64 nt, Human; identical to SEQ ID NO: 314026

SEQ ID NO: 364576 - RNA, 64 nt, Human; identical to SEQ ID NO: 314027

SEQ ID NO: 364577 - RNA, 64 nt, Human; identical to SEQ ID NO: 314028

SEQ ID NO: 364578 - RNA, 64 nt, Human; identical to SEQ ID NO: 314032

SEQ ID NO: 364579 - RNA, 64 nt, Human; identical to SEQ ID NO: 314033

SEQ ID NO: 364580 - RNA, 64 nt, Human; identical to SEQ ID NO: 314034

SEQ ID NO: 364581 - RNA, 64 nt, Human; identical to SEQ ID NO: 314035

SEQ ID NO: 364582 - RNA, 64 nt, Human; identical to SEQ ID NO: 314036

SEQ ID NO: 364583 - RNA, 64 nt, Human; identical to SEQ ID NO: 314037

SEQ ID NO: 364584 - RNA, 64 nt, Human; identical to SEQ ID NO: 314038

SEQ ID NO: 364585 - RNA, 64 nt, Human; identical to SEQ ID NO: 314039

SEQ ID NO: 364586 - RNA, 64 nt, Human; identical to SEQ ID NO: 364276

SEQ ID NO: 364587 - RNA, 64 nt, Human; identical to SEQ ID NO: 359847

SEQ ID NO: 364588 - RNA, 64 nt, Human; identical to SEQ ID NO: 364161

SEQ ID NO: 364589 - RNA, 64 nt, Human; identical to SEQ ID NO: 314040

SEQ ID NO: 364590 - RNA, 64 nt, Human; identical to SEQ ID NO: 314041

SEQ ID NO: 364591 - RNA, 64 nt, Human; identical to SEQ ID NO: 314042

SEQ ID NO: 364592 - RNA, 64 nt, Human; identical to SEQ ID NO: 314043

SEQ ID NO: 364593 - RNA, 64 nt, Human; identical to SEQ ID NO: 314044

SEQ ID NO: 364594 - RNA, 64 nt, Human; identical to SEQ ID NO: 314045

SEQ ID NO: 364595 - RNA, 64 nt, Human; identical to SEQ ID NO: 313216

SEQ ID NO: 364596 - RNA, 64 nt, Human; identical to SEQ ID NO: 313217

SEQ ID NO: 364597 - RNA, 64 nt, Human; identical to SEQ ID NO: 313218

SEQ ID NO: 364598 - RNA, 64 nt, Human; identical to SEQ ID NO: 313219

SEQ ID NO: 364599 - RNA, 64 nt, Human; identical to SEQ ID NO: 313220

SEQ ID NO: 364600 - RNA, 64 nt, Human; identical to SEQ ID NO: 313221

SEQ ID NO: 364601 - RNA, 64 nt, Human; identical to SEQ ID NO: 313222

SEQ ID NO: 364602 - RNA, 64 nt, Human; identical to SEQ ID NO: 313223

SEQ ID NO: 364603 - RNA, 64 nt, Human; identical to SEQ ID NO: 313224

SEQ ID NO: 364604 - RNA, 64 nt, Human; identical to SEQ ID NO: 313225

SEQ ID NO: 364605 - RNA, 64 nt, Human; identical to SEQ ID NO: 363991

SEQ ID NO: 364606 - RNA, 64 nt, Human; identical to SEQ ID NO: 363992

SEQ ID NO: 364607 - RNA, 64 nt, Human; identical to SEQ ID NO: 313226

SEQ ID NO: 364608 - RNA, 64 nt, Human; identical to SEQ ID NO: 313227

SEQ ID NO: 364609 - RNA, 64 nt, Human; identical to SEQ ID NO: 313228

SEQ ID NO: 364610 - RNA, 64 nt, Human; identical to SEQ ID NO: 314050

SEQ ID NO: 364611 - RNA, 64 nt, Human; identical to SEQ ID NO: 314069

SEQ ID NO: 364612 - RNA, 63 nt, Human; identical to SEQ ID NO: 314070

SEQ ID NO: 364613 - RNA, 64 nt, Human; identical to SEQ ID NO: 314071

SEQ ID NO: 364614 - RNA, 64 nt, Human; identical to SEQ ID NO: 314072

SEQ ID NO: 364615 - RNA, 64 nt, Human; identical to SEQ ID NO: 314073

SEQ ID NO: 364616 - RNA, 64 nt, Human; identical to SEQ ID NO: 314074

SEQ ID NO: 364617 - RNA, 64 nt, Human; identical to SEQ ID NO: 314075

SEQ ID NO: 364618 - RNA, 64 nt, Human; identical to SEQ ID NO: 314076

SEQ ID NO: 364619 - RNA, 64 nt, Human; identical to SEQ ID NO: 314077

SEQ ID NO: 364620 - RNA, 64 nt, Human; identical to SEQ ID NO: 314078

SEQ ID NO: 364621 - RNA, 64 nt, Human; identical to SEQ ID NO: 314079

SEQ ID NO: 364622 - RNA, 64 nt, Human; identical to SEQ ID NO: 314080

SEQ ID NO: 364623 - RNA, 64 nt, Human; identical to SEQ ID NO: 364277

SEQ ID NO: 364624 - RNA, 64 nt, Human; identical to SEQ ID NO: 364278

SEQ ID NO: 364625 - RNA, 64 nt, Human; identical to SEQ ID NO: 359863

SEQ ID NO: 364626 - RNA, 64 nt, Human; identical to SEQ ID NO: 314081

SEQ ID NO: 364627 - RNA, 64 nt, Human; identical to SEQ ID NO: 314082

SEQ ID NO: 364628 - RNA, 53 nt, Human; identical to SEQ ID NO: 314086

SEQ ID NO: 364629 - RNA, 64 nt, Human; identical to SEQ ID NO: 314087

SEQ ID NO: 364630 - RNA, 64 nt, Human; identical to SEQ ID NO: 314088

SEQ ID NO: 364631 - RNA, 64 nt, Human; identical to SEQ ID NO: 314089

SEQ ID NO: 364632 - RNA, 64 nt, Human; identical to SEQ ID NO: 314090

SEQ ID NO: 364633 - RNA, 64 nt, Human; identical to SEQ ID NO: 314091

SEQ ID NO: 364634 - RNA, 64 nt, Human; identical to SEQ ID NO: 314092

SEQ ID NO: 364635 - RNA, 64 nt, Human; identical to SEQ ID NO: 314093

SEQ ID NO: 364636 - RNA, 64 nt, Human; identical to SEQ ID NO: 314094

SEQ ID NO: 364637 - RNA, 64 nt, Human; identical to SEQ ID NO: 314095

SEQ ID NO: 364638 - RNA, 64 nt, Human; identical to SEQ ID NO: 314096

SEQ ID NO: 364639 - RNA, 64 nt, Human; identical to SEQ ID NO: 314097

SEQ ID NO: 364640 - RNA, 64 nt, Human; identical to SEQ ID NO: 314098

SEQ ID NO: 364641 - RNA, 64 nt, Human; identical to SEQ ID NO: 314099

SEQ ID NO: 364642 - RNA, 64 nt, Human; identical to SEQ ID NO: 364162

SEQ ID NO: 364643 - RNA, 64 nt, Human; identical to SEQ ID NO: 364163

SEQ ID NO: 364644 - RNA, 64 nt, Human; identical to SEQ ID NO: 364195

SEQ ID NO: 364645 - RNA, 64 nt, Human; identical to SEQ ID NO: 314104

SEQ ID NO: 364646 - RNA, 64 nt, Human; identical to SEQ ID NO: 314105

SEQ ID NO: 364647 - RNA, 64 nt, Human; identical to SEQ ID NO: 314106

SEQ ID NO: 364648 - RNA, 64 nt, Human; identical to SEQ ID NO: 314107

SEQ ID NO: 364649 - RNA, 64 nt, Human; identical to SEQ ID NO: 314108

SEQ ID NO: 364650 - RNA, 64 nt, Human; identical to SEQ ID NO: 314109

SEQ ID NO: 364651 - RNA, 64 nt, Human; identical to SEQ ID NO: 314110

SEQ ID NO: 364652 - RNA, 64 nt, Human; identical to SEQ ID NO: 314111

SEQ ID NO: 364653 - RNA, 64 nt, Human; identical to SEQ ID NO: 314112

SEQ ID NO: 364654 - RNA, 64 nt, Human; identical to SEQ ID NO: 314113

SEQ ID NO: 364655 - RNA, 64 nt, Human; identical to SEQ ID NO: 314114

SEQ ID NO: 364656 - RNA, 64 nt, Human; identical to SEQ ID NO: 314115

SEQ ID NO: 364657 - RNA, 64 nt, Human; identical to SEQ ID NO: 314116

SEQ ID NO: 364658 - RNA, 64 nt, Human; identical to SEQ ID NO: 314117

SEQ ID NO: 364659 - RNA, 64 nt, Human; identical to SEQ ID NO: 314121

SEQ ID NO: 364660 - RNA, 64 nt, Human; identical to SEQ ID NO: 314122

SEQ ID NO: 364661 - RNA, 64 nt, Human; identical to SEQ ID NO: 363994

SEQ ID NO: 364662 - RNA, 64 nt, Human; identical to SEQ ID NO: 364008

SEQ ID NO: 364663 - RNA, 64 nt, Human; identical to SEQ ID NO: 364009

SEQ ID NO: 364664 - RNA, 64 nt, Human; identical to SEQ ID NO: 314123

SEQ ID NO: 364665 - RNA, 64 nt, Human; identical to SEQ ID NO: 314124

SEQ ID NO: 364666 - RNA, 64 nt, Human; identical to SEQ ID NO: 314125

SEQ ID NO: 364667 - RNA, 64 nt, Human; identical to SEQ ID NO: 314126

SEQ ID NO: 364668 - RNA, 64 nt, Human; identical to SEQ ID NO: 314127

SEQ ID NO: 364669 - RNA, 64 nt, Human; identical to SEQ ID NO: 314128

SEQ ID NO: 364670 - RNA, 64 nt, Human; identical to SEQ ID NO: 314129

SEQ ID NO: 364671 - RNA, 64 nt, Human; identical to SEQ ID NO: 314130

SEQ ID NO: 364672 - RNA, 64 nt, Human; identical to SEQ ID NO: 314131

SEQ ID NO: 364673 - RNA, 64 nt, Human; identical to SEQ ID NO: 314132

SEQ ID NO: 364674 - RNA, 64 nt, Human; identical to SEQ ID NO: 314133

SEQ ID NO: 364675 - RNA, 64 nt, Human; identical to SEQ ID NO: 314134

SEQ ID NO: 364676 - RNA, 64 nt, Human; identical to SEQ ID NO: 314138

SEQ ID NO: 364677 - RNA, 64 nt, Human; identical to SEQ ID NO: 314139

SEQ ID NO: 364678 - RNA, 64 nt, Human; identical to SEQ ID NO: 314140

SEQ ID NO: 364679 - RNA, 64 nt, Human; identical to SEQ ID NO: 314141

SEQ ID NO: 364680 - RNA, 64 nt, Human; identical to SEQ ID NO: 359864

SEQ ID NO: 364681 - RNA, 64 nt, Human; identical to SEQ ID NO: 364211

SEQ ID NO: 364682 - RNA, 64 nt, Human; identical to SEQ ID NO: 364212

SEQ ID NO: 364683 - RNA, 64 nt, Human; identical to SEQ ID NO: 314142

SEQ ID NO: 364684 - RNA, 64 nt, Human; identical to SEQ ID NO: 314143

SEQ ID NO: 364685 - RNA, 64 nt, Human; identical to SEQ ID NO: 314144

SEQ ID NO: 364686 - RNA, 64 nt, Human; identical to SEQ ID NO: 314145

SEQ ID NO: 364687 - RNA, 64 nt, Human; identical to SEQ ID NO: 314146

SEQ ID NO: 364688 - RNA, 64 nt, Human; identical to SEQ ID NO: 314147

SEQ ID NO: 364689 - RNA, 64 nt, Human; identical to SEQ ID NO: 314148

SEQ ID NO: 364690 - RNA, 64 nt, Human; identical to SEQ ID NO: 314149

SEQ ID NO: 364691 - RNA, 64 nt, Human; identical to SEQ ID NO: 314150

SEQ ID NO: 364692 - RNA, 64 nt, Human; identical to SEQ ID NO: 314151

SEQ ID NO: 364693 - RNA, 59 nt, Human; identical to SEQ ID NO: 314156

SEQ ID NO: 364694 - RNA, 64 nt, Human; identical to SEQ ID NO: 314157

SEQ ID NO: 364695 - RNA, 64 nt, Human; identical to SEQ ID NO: 314158

SEQ ID NO: 364696 - RNA, 64 nt, Human; identical to SEQ ID NO: 314159

SEQ ID NO: 364697 - RNA, 64 nt, Human; identical to SEQ ID NO: 314160

SEQ ID NO: 364698 - RNA, 64 nt, Human; identical to SEQ ID NO: 314161

SEQ ID NO: 364699 - RNA, 64 nt, Human; identical to SEQ ID NO: 364258

SEQ ID NO: 364700 - RNA, 64 nt, Human; identical to SEQ ID NO: 364259

SEQ ID NO: 364701 - RNA, 64 nt, Human; identical to SEQ ID NO: 364078

SEQ ID NO: 364702 - RNA, 64 nt, Human; identical to SEQ ID NO: 314162

SEQ ID NO: 364703 - RNA, 64 nt, Human; identical to SEQ ID NO: 314163

SEQ ID NO: 364704 - RNA, 64 nt, Human; identical to SEQ ID NO: 314164

SEQ ID NO: 364705 - RNA, 64 nt, Human; identical to SEQ ID NO: 314165

SEQ ID NO: 364706 - RNA, 64 nt, Human; identical to SEQ ID NO: 314166

SEQ ID NO: 364707 - RNA, 64 nt, Human; identical to SEQ ID NO: 314167

SEQ ID NO: 364708 - RNA, 64 nt, Human; identical to SEQ ID NO: 314168

SEQ ID NO: 364709 - RNA, 64 nt, Human; identical to SEQ ID NO: 314169

SEQ ID NO: 364710 - RNA, 64 nt, Human; identical to SEQ ID NO: 314173

SEQ ID NO: 364711 - RNA, 64 nt, Human; identical to SEQ ID NO: 314174

SEQ ID NO: 364712 - RNA, 64 nt, Human; identical to SEQ ID NO: 314175

SEQ ID NO: 364713 - RNA, 64 nt, Human; identical to SEQ ID NO: 314176

SEQ ID NO: 364714 - RNA, 64 nt, Human; identical to SEQ ID NO: 314177

SEQ ID NO: 364715 - RNA, 64 nt, Human; identical to SEQ ID NO: 314178

SEQ ID NO: 364716 - RNA, 64 nt, Human; identical to SEQ ID NO: 314179

SEQ ID NO: 364717 - RNA, 64 nt, Human; identical to SEQ ID NO: 314180

SEQ ID NO: 364718 - RNA, 64 nt, Human; identical to SEQ ID NO: 364327

SEQ ID NO: 364719 - RNA, 64 nt, Human; identical to SEQ ID NO: 359845

SEQ ID NO: 364720 - RNA, 61 nt, Human; identical to SEQ ID NO: 302794

SEQ ID NO: 364721 - RNA, 64 nt, Human; identical to SEQ ID NO: 314181

SEQ ID NO: 364722 - RNA, 64 nt, Human; identical to SEQ ID NO: 314182

SEQ ID NO: 364723 - RNA, 64 nt, Human; identical to SEQ ID NO: 314183

SEQ ID NO: 364724 - RNA, 64 nt, Human; identical to SEQ ID NO: 314184

SEQ ID NO: 364725 - RNA, 64 nt, Human; identical to SEQ ID NO: 314185

SEQ ID NO: 364726 - RNA, 64 nt, Human; identical to SEQ ID NO: 314186

SEQ ID NO: 364727 - RNA, 64 nt, Human; identical to SEQ ID NO: 314189

SEQ ID NO: 364728 - RNA, 64 nt, Human; identical to SEQ ID NO: 314190

SEQ ID NO: 364729 - RNA, 64 nt, Human; identical to SEQ ID NO: 314191

SEQ ID NO: 364730 - RNA, 64 nt, Human; identical to SEQ ID NO: 314192

SEQ ID NO: 364731 - RNA, 64 nt, Human; identical to SEQ ID NO: 314193

SEQ ID NO: 364732 - RNA, 64 nt, Human; identical to SEQ ID NO: 314194

SEQ ID NO: 364733 - RNA, 64 nt, Human; identical to SEQ ID NO: 314195

SEQ ID NO: 364734 - RNA, 64 nt, Human; identical to SEQ ID NO: 314196

SEQ ID NO: 364735 - RNA, 64 nt, Human; identical to SEQ ID NO: 314197

SEQ ID NO: 364736 - RNA, 64 nt, Human; identical to SEQ ID NO: 314198

SEQ ID NO: 364737 - RNA, 64 nt, Human; identical to SEQ ID NO: 359844

SEQ ID NO: 364738 - RNA, 59 nt, Human; identical to SEQ ID NO: 302837

SEQ ID NO: 364739 - RNA, 64 nt, Human; identical to SEQ ID NO: 364221

SEQ ID NO: 364740 - RNA, 64 nt, Human; identical to SEQ ID NO: 314199

SEQ ID NO: 364741 - RNA, 64 nt, Human; identical to SEQ ID NO: 314200

SEQ ID NO: 364742 - RNA, 64 nt, Human; identical to SEQ ID NO: 314201

SEQ ID NO: 364743 - RNA, 64 nt, Human; identical to SEQ ID NO: 314202

SEQ ID NO: 364744 - RNA, 64 nt, Human; identical to SEQ ID NO: 314206

SEQ ID NO: 364745 - RNA, 64 nt, Human; identical to SEQ ID NO: 314207

SEQ ID NO: 364746 - RNA, 64 nt, Human; identical to SEQ ID NO: 314208

SEQ ID NO: 364747 - RNA, 64 nt, Human; identical to SEQ ID NO: 314209

SEQ ID NO: 364748 - RNA, 64 nt, Human; identical to SEQ ID NO: 314210

SEQ ID NO: 364749 - RNA, 64 nt, Human; identical to SEQ ID NO: 314211

SEQ ID NO: 364750 - RNA, 64 nt, Human; identical to SEQ ID NO: 314212

SEQ ID NO: 364751 - RNA, 64 nt, Human; identical to SEQ ID NO: 314213

SEQ ID NO: 364752 - RNA, 64 nt, Human; identical to SEQ ID NO: 314214

SEQ ID NO: 364753 - RNA, 64 nt, Human; identical to SEQ ID NO: 314215

SEQ ID NO: 364754 - RNA, 64 nt, Human; identical to SEQ ID NO: 314216

SEQ ID NO: 364755 - RNA, 64 nt, Human; identical to SEQ ID NO: 314217

SEQ ID NO: 364756 - RNA, 59 nt, Human; identical to SEQ ID NO: 302995

SEQ ID NO: 364757 - RNA, 64 nt, Human; identical to SEQ ID NO: 359866

SEQ ID NO: 364758 - RNA, 64 nt, Human; identical to SEQ ID NO: 364226

SEQ ID NO: 364759 - RNA, 64 nt, Human; identical to SEQ ID NO: 314218

SEQ ID NO: 364760 - RNA, 64 nt, Human; identical to SEQ ID NO: 314219

SEQ ID NO: 364761 - RNA, 64 nt, Human; identical to SEQ ID NO: 314223

SEQ ID NO: 364762 - RNA, 64 nt, Human; identical to SEQ ID NO: 314224

SEQ ID NO: 364763 - RNA, 64 nt, Human; identical to SEQ ID NO: 314225

SEQ ID NO: 364764 - RNA, 64 nt, Human; identical to SEQ ID NO: 314226

SEQ ID NO: 364765 - RNA, 64 nt, Human; identical to SEQ ID NO: 314227

SEQ ID NO: 364766 - RNA, 64 nt, Human; identical to SEQ ID NO: 314228

SEQ ID NO: 364767 - RNA, 64 nt, Human; identical to SEQ ID NO: 314229

SEQ ID NO: 364768 - RNA, 64 nt, Human; identical to SEQ ID NO: 314230

SEQ ID NO: 364769 - RNA, 64 nt, Human; identical to SEQ ID NO: 314231

SEQ ID NO: 364770 - RNA, 64 nt, Human; identical to SEQ ID NO: 314232

SEQ ID NO: 364771 - RNA, 64 nt, Human; identical to SEQ ID NO: 314233

SEQ ID NO: 364772 - RNA, 64 nt, Human; identical to SEQ ID NO: 314234

SEQ ID NO: 364773 - RNA, 64 nt, Human; identical to SEQ ID NO: 314235

SEQ ID NO: 364774 - RNA, 64 nt, Human; identical to SEQ ID NO: 314236

SEQ ID NO: 364775 - RNA, 64 nt, Human; identical to SEQ ID NO: 364192

SEQ ID NO: 364776 - RNA, 64 nt, Human; identical to SEQ ID NO: 364193

SEQ ID NO: 364777 - RNA, 64 nt, Human; identical to SEQ ID NO: 362070

SEQ ID NO: 364778 - RNA, 64 nt, Human; identical to SEQ ID NO: 314240

SEQ ID NO: 364779 - RNA, 64 nt, Human; identical to SEQ ID NO: 314241

SEQ ID NO: 364780 - RNA, 64 nt, Human; identical to SEQ ID NO: 314242

SEQ ID NO: 364781 - RNA, 64 nt, Human; identical to SEQ ID NO: 314243

SEQ ID NO: 364782 - RNA, 64 nt, Human; identical to SEQ ID NO: 314244

SEQ ID NO: 364783 - RNA, 64 nt, Human; identical to SEQ ID NO: 314245

SEQ ID NO: 364784 - RNA, 64 nt, Human; identical to SEQ ID NO: 314246

SEQ ID NO: 364785 - RNA, 64 nt, Human; identical to SEQ ID NO: 314247

SEQ ID NO: 364786 - RNA, 64 nt, Human; identical to SEQ ID NO: 314248

SEQ ID NO: 364787 - RNA, 64 nt, Human; identical to SEQ ID NO: 314249

SEQ ID NO: 364788 - RNA, 64 nt, Human; identical to SEQ ID NO: 314250

SEQ ID NO: 364789 - RNA, 64 nt, Human; identical to SEQ ID NO: 314251

SEQ ID NO: 364790 - RNA, 64 nt, Human; identical to SEQ ID NO: 314252

SEQ ID NO: 364791 - RNA, 64 nt, Human; identical to SEQ ID NO: 314253

SEQ ID NO: 364792 - RNA, 64 nt, Human; identical to SEQ ID NO: 314257

SEQ ID NO: 364793 - RNA, 64 nt, Human; identical to SEQ ID NO: 314258

SEQ ID NO: 364794 - RNA, 64 nt, Human; identical to SEQ ID NO: 359827

SEQ ID NO: 364795 - RNA, 64 nt, Human; identical to SEQ ID NO: 364392

SEQ ID NO: 364796 - RNA, 64 nt, Human; identical to SEQ ID NO: 364393

SEQ ID NO: 364797 - RNA, 64 nt, Human; identical to SEQ ID NO: 314259

SEQ ID NO: 364798 - RNA, 64 nt, Human; identical to SEQ ID NO: 314260

SEQ ID NO: 364799 - RNA, 64 nt, Human; identical to SEQ ID NO: 314261

SEQ ID NO: 364800 - RNA, 64 nt, Human; identical to SEQ ID NO: 314262

SEQ ID NO: 364801 - RNA, 64 nt, Human; identical to SEQ ID NO: 314263

SEQ ID NO: 364802 - RNA, 64 nt, Human; identical to SEQ ID NO: 314264

SEQ ID NO: 364803 - RNA, 64 nt, Human; identical to SEQ ID NO: 314265

SEQ ID NO: 364804 - RNA, 64 nt, Human; identical to SEQ ID NO: 314266

SEQ ID NO: 364805 - RNA, 64 nt, Human; identical to SEQ ID NO: 314267

SEQ ID NO: 364806 - RNA, 64 nt, Human; identical to SEQ ID NO: 314268

SEQ ID NO: 364807 - RNA, 64 nt, Human; identical to SEQ ID NO: 314269

SEQ ID NO: 364808 - RNA, 64 nt, Human; identical to SEQ ID NO: 314270

SEQ ID NO: 364809 - RNA, 64 nt, Human; identical to SEQ ID NO: 314274

SEQ ID NO: 364810 - RNA, 64 nt, Human; identical to SEQ ID NO: 314275

SEQ ID NO: 364811 - RNA, 64 nt, Human; identical to SEQ ID NO: 314276

SEQ ID NO: 364812 - RNA, 64 nt, Human; identical to SEQ ID NO: 314277

SEQ ID NO: 364813 - RNA, 64 nt, Human; identical to SEQ ID NO: 364394

SEQ ID NO: 364814 - RNA, 64 nt, Human; identical to SEQ ID NO: 364395

SEQ ID NO: 364815 - RNA, 64 nt, Human; identical to SEQ ID NO: 364410

SEQ ID NO: 364816 - RNA, 64 nt, Human; identical to SEQ ID NO: 314278

SEQ ID NO: 364817 - RNA, 64 nt, Human; identical to SEQ ID NO: 314279

SEQ ID NO: 364818 - RNA, 64 nt, Human; identical to SEQ ID NO: 314280

SEQ ID NO: 364819 - RNA, 64 nt, Human; identical to SEQ ID NO: 314281

SEQ ID NO: 364820 - RNA, 64 nt, Human; identical to SEQ ID NO: 314282

SEQ ID NO: 364821 - RNA, 64 nt, Human; identical to SEQ ID NO: 314283

SEQ ID NO: 364822 - RNA, 64 nt, Human; identical to SEQ ID NO: 314284

SEQ ID NO: 364823 - RNA, 64 nt, Human; identical to SEQ ID NO: 314285

SEQ ID NO: 364824 - RNA, 64 nt, Human; identical to SEQ ID NO: 314286

SEQ ID NO: 364825 - RNA, 64 nt, Human; identical to SEQ ID NO: 314287

SEQ ID NO: 364826 - RNA, 64 nt, Human; identical to SEQ ID NO: 314291

SEQ ID NO: 364827 - RNA, 64 nt, Human; identical to SEQ ID NO: 314292

SEQ ID NO: 364828 - RNA, 64 nt, Human; identical to SEQ ID NO: 314293

SEQ ID NO: 364829 - RNA, 64 nt, Human; identical to SEQ ID NO: 314294

SEQ ID NO: 364830 - RNA, 64 nt, Human; identical to SEQ ID NO: 314295

SEQ ID NO: 364831 - RNA, 64 nt, Human; identical to SEQ ID NO: 314296

SEQ ID NO: 364832 - RNA, 64 nt, Human; identical to SEQ ID NO: 364026

SEQ ID NO: 364833 - RNA, 64 nt, Human; identical to SEQ ID NO: 364027

SEQ ID NO: 364834 - RNA, 64 nt, Human; identical to SEQ ID NO: 364028

SEQ ID NO: 364835 - RNA, 64 nt, Human; identical to SEQ ID NO: 314297

SEQ ID NO: 364836 - RNA, 64 nt, Human; identical to SEQ ID NO: 314298

SEQ ID NO: 364837 - RNA, 64 nt, Human; identical to SEQ ID NO: 314299

SEQ ID NO: 364838 - RNA, 64 nt, Human; identical to SEQ ID NO: 314300

SEQ ID NO: 364839 - RNA, 64 nt, Human; identical to SEQ ID NO: 314301

SEQ ID NO: 364840 - RNA, 64 nt, Human; identical to SEQ ID NO: 314302

SEQ ID NO: 364841 - RNA, 64 nt, Human; identical to SEQ ID NO: 314303

SEQ ID NO: 364842 - RNA, 64 nt, Human; identical to SEQ ID NO: 314304

SEQ ID NO: 364843 - RNA, 64 nt, Human; identical to SEQ ID NO: 314308

SEQ ID NO: 364844 - RNA, 64 nt, Human; identical to SEQ ID NO: 314309

SEQ ID NO: 364845 - RNA, 64 nt, Human; identical to SEQ ID NO: 314310

SEQ ID NO: 364846 - RNA, 64 nt, Human; identical to SEQ ID NO: 314311

SEQ ID NO: 364847 - RNA, 64 nt, Human; identical to SEQ ID NO: 314312

SEQ ID NO: 364848 - RNA, 64 nt, Human; identical to SEQ ID NO: 314313

SEQ ID NO: 364849 - RNA, 64 nt, Human; identical to SEQ ID NO: 314314

SEQ ID NO: 364850 - RNA, 64 nt, Human; identical to SEQ ID NO: 314315

SEQ ID NO: 364851 - RNA, 64 nt, Human; identical to SEQ ID NO: 364428

SEQ ID NO: 364852 - RNA, 64 nt, Human; identical to SEQ ID NO: 364429

SEQ ID NO: 364853 - RNA, 64 nt, Human; identical to SEQ ID NO: 364326

SEQ ID NO: 364854 - RNA, 64 nt, Human; identical to SEQ ID NO: 314316

SEQ ID NO: 364855 - RNA, 64 nt, Human; identical to SEQ ID NO: 314317

SEQ ID NO: 364856 - RNA, 64 nt, Human; identical to SEQ ID NO: 314318

SEQ ID NO: 364857 - RNA, 64 nt, Human; identical to SEQ ID NO: 364468

SEQ ID NO: 364858 - RNA, 64 nt, Human; identical to SEQ ID NO: 364469

SEQ ID NO: 364859 - RNA, 64 nt, Human; identical to SEQ ID NO: 364470

SEQ ID NO: 364860 - RNA, 64 nt, Human; identical to SEQ ID NO: 364471

SEQ ID NO: 364861 - RNA, 64 nt, Human; identical to SEQ ID NO: 364472

SEQ ID NO: 364862 - RNA, 64 nt, Human; identical to SEQ ID NO: 364473

SEQ ID NO: 364863 - RNA, 64 nt, Human; identical to SEQ ID NO: 364474

SEQ ID NO: 364864 - RNA, 64 nt, Human; identical to SEQ ID NO: 363034

SEQ ID NO: 364865 - RNA, 64 nt, Human; identical to SEQ ID NO: 363035

SEQ ID NO: 364866 - RNA, 64 nt, Human; identical to SEQ ID NO: 359826

SEQ ID NO: 364867 - RNA, 64 nt, Human; identical to SEQ ID NO: 364358

SEQ ID NO: 364868 - RNA, 64 nt, Human; identical to SEQ ID NO: 364359

SEQ ID NO: 364869 - RNA, 64 nt, Human; identical to SEQ ID NO: 364360

SEQ ID NO: 364870 - RNA, 64 nt, Human; identical to SEQ ID NO: 187799

SEQ ID NO: 364871 - RNA, 64 nt, Human; identical to SEQ ID NO: 187800

SEQ ID NO: 364872 - RNA, 64 nt, Human; identical to SEQ ID NO: 187801

SEQ ID NO: 364873 - RNA, 56 nt, Human; identical to SEQ ID NO: 100692

SEQ ID NO: 364874 - RNA, 64 nt, Human; identical to SEQ ID NO: 187803

SEQ ID NO: 364875 - RNA, 64 nt, Human; identical to SEQ ID NO: 187804

SEQ ID NO: 364876 - RNA, 64 nt, Human; identical to SEQ ID NO: 187805

SEQ ID NO: 364877 - RNA, 64 nt, Human; identical to SEQ ID NO: 187806

SEQ ID NO: 364878 - RNA, 64 nt, Human
cucuccgucuguuuuugcaacuagguauuucuaacgccagcacacuauuuacaagauggacuua

SEQ ID NO: 364879 - RNA, 64 nt, Human
ggccgccugcagccugccccugugaucccuucggcgccagcagcuccaaaacuggaccaccaga

SEQ ID NO: 364880 - RNA, 64 nt, Human
ugugcgaccuuuccaagccuucccucacccuccccgccagcacccucuuuggggagcaggaacu

SEQ ID NO: 364881 - RNA, 64 nt, Human; identical to SEQ ID NO: 275019

SEQ ID NO: 364882 - RNA, 64 nt, Human; identical to SEQ ID NO: 275019

SEQ ID NO: 364883 - RNA, 64 nt, Human; identical to SEQ ID NO: 275021

SEQ ID NO: 364884 - RNA, 64 nt, Human; identical to SEQ ID NO: 275022

SEQ ID NO: 364885 - RNA, 64 nt, Human
gaaaaagugaggccaacacacagggcaaguggugucgauggagucgaagcgcugaaggaauagg

SEQ ID NO: 364886 - RNA, 64 nt, Human
ccugagacuggguaauuuauaaagaaaaauagguucgauggacucacagguccgcguggcuggg

SEQ ID NO: 364887 - RNA, 64 nt, Human
acugcuucauugaauagauuuguucauugaccuaucgauggacaccuggguuguuuccaguuug

SEQ ID NO: 364888 - RNA, 64 nt, Human
guuggguugauuccccaaaaccuugacagauguaucgauggaauaaaaguauguuuuaaagguu

SEQ ID NO: 364889 - RNA, 64 nt, Human
accacuugcaacccacauguuuguagguguauggucgauggaaguuucuggcauccauguuggu

SEQ ID NO: 364890 - RNA, 64 nt, Human
aagaaaaaagccugguuuuguuuuucccagaauaucgauggacuuaaaaaggcucagguuuuug

SEQ ID NO: 364891 - RNA, 64 nt, Human
aauaaaaagcccuccucagauuggaacccccaaaucgauggagccacauuaauaauacuuuuca

SEQ ID NO: 364892 - RNA, 64 nt, Human
ugacagccaugcuuuccuauacuuguucaaaggaucgauggaccguaaauaagcugccauuaac

SEQ ID NO: 364893 - RNA, 64 nt, Human
aacaaacagacuugacuguugcucaaucuaaucuucgauggaaauucuaaaaauuaauacagag

SEQ ID NO: 364894 - RNA, 64 nt, Human
uugcauacaaggcuuuguaacgaucaagugcuaaucgauggaaauguuaagguagauuaacaua

SEQ ID NO: 364895 - RNA, 64 nt, Human
aguuuaggccacauaaaauugcuguuuaauguagucgauggaagacuuuaaacuaugcuucuag

SEQ ID NO: 364896 - RNA, 64 nt, Human
uuccuuguuucuguauagauguaagcacauaaauucgauggaauagaauuacguuaacaauguu

SEQ ID NO: 364897 - RNA, 64 nt, Human
caagguggggauggaagcacagucgggacagaauucgauggauuccuuuaguuggaguccgcgu

SEQ ID NO: 364898 - RNA, 64 nt, Human
ccaugugugugccaagcccuggcccccacagcgcucgauggaccucagcaagcugcccagcccu

SEQ ID NO: 364899 - RNA, 64 nt, Human
gcaagaaugaacugcuguuggguuugauugacugucgauggauuguggugugguguaucugaag

SEQ ID NO: 364900 - RNA, 64 nt, Human
ugggugcuuucuguuccucugauuggauggaguccgccagcaggcauggggcuacauuccagug

SEQ ID NO: 364901 - RNA, 64 nt, Human
caacucuguggugccaaaaggagacgcggccucccgccagcacucgggggugcagggcccugug

SEQ ID NO: 364902 - RNA, 64 nt, Human
cucagccucccgaguagcuggaauuacaggcaugcgccagcacgcccggcuaaguuuuguauuu

SEQ ID NO: 364903 - RNA, 64 nt, Human
ggcagccagagcccuuggacuggcacagggacccucgauggagcgaagcccucaaacgggaugc

SEQ ID NO: 364904 - RNA, 64 nt, Human
ugucuccagugggggcagcagcugucccccagccucgauggagacacuggggcagucugccuug

SEQ ID NO: 364905 - RNA, 64 nt, Human
aagccugagaggcgccggcucucuugcuccuccaucgauggacacugcauugcuucucaucgga

SEQ ID NO: 364906 - RNA, 64 nt, Human
aucuuaauuauuuucaauaggcuuguaaaucuuaucgauggaaggagaaaggagacaagaugug

SEQ ID NO: 364907 - RNA, 64 nt, Human
ucuuuuuagcauucucaucagaaagucacaaaaaucgauggaaucauuuccacugggaagauug

SEQ ID NO: 364908 - RNA, 64 nt, Human
ucccuguguuccagcguggagggacaaucgugccucgauggaugcgagugcggcggucuucaga

SEQ ID NO: 364909 - RNA, 64 nt, Human
cuaccuaagugugugucgccacccgauggaagauucgauggacauggacaugagcccccugagg

SEQ ID NO: 364910 - RNA, 64 nt, Human
cccuuugcugaccucugccaggacccacacagcuucgauggaucucaguguuuguuaacaaaau

SEQ ID NO: 364911 - RNA, 64 nt, Human
cuaacaguuauuuccccggguccagcuuaaagacucgauggaaggagguagaaccucugcuguu

SEQ ID NO: 364912 - RNA, 64 nt, Human
uaauggucacccuaaaaacacccacauaugcuuuucgauggaaccagguaaguugacgcuaaag

SEQ ID NO: 364913 - RNA, 64 nt, Human
ucagauuauucugaguauuguuaacagugccuuuucgauggaaucacacuuuuuggcugucacc

SEQ ID NO: 364914 - RNA, 64 nt, Human
uuuaaacaggguggauuccacucugugggagccuucgauggaacucaagguggagcucagccuu

SEQ ID NO: 364915 - RNA, 64 nt, Human
ugcucauaauauauuccaauuuuuauuggaauuuucgauggaauguuauuucaauaaagccaug

SEQ ID NO: 364916 - RNA, 64 nt, Human
gccuugggaccauggccaccccagagccauccgaucgauggaugggaugcacucucagaccaag

SEQ ID NO: 364917 - RNA, 64 nt, Human
aagcccagcuccagggccagaugagcagaagcucucgauggacaaugaacggccuugcuggggg

SEQ ID NO: 364918 - RNA, 64 nt, Human
ccccaccuucucuauagccggcacugggagcagccgccagcagggaaaucuggccugagcacaa

SEQ ID NO: 364919 - RNA, 64 nt, Human
aggcugcccgccucuaguucccaaggcguccgcgcgccagcacagaaacagaggagagucccag

SEQ ID NO: 364920 - RNA, 64 nt, Human; identical to SEQ ID NO: 44323

SEQ ID NO: 364921 - RNA, 64 nt, Human; identical to SEQ ID NO: 44324

SEQ ID NO: 364922 - RNA, 64 nt, Human
gcagaccaggcugagauggaggaaccugcuaaaaucgauggagaugcuucuagccucccaguag

SEQ ID NO: 364923 - RNA, 64 nt, Human
ucgugaagucacgucacacaggggagaggcgaggucgauggaacuggccacgcacaggcucugg

SEQ ID NO: 364924 - RNA, 64 nt, Human
ccguggagcaacuuccugcuccacgggaaagaggucgauggauuuaccccuggacccauaaguc

SEQ ID NO: 364925 - RNA, 64 nt, Human
gcagugcccagagcccacgcccccccaagagcccucgauggacagccucacccaccccaccugg

SEQ ID NO: 364926 - RNA, 64 nt, Human
gugaccugaaucuuucccuuaaccguacaguuucucgauggaauugugugaucagaagguggaa

SEQ ID NO: 364927 - RNA, 64 nt, Human
augccgcugggugcccggaggcggccauggugucucgauggacggcagccaggauggagcaccc

SEQ ID NO: 364928 - RNA, 64 nt, Human
auuuuauuaaauuuuuuccuuuuuucuauucauuucgauggacgcaaucuuaagccacccuggc

SEQ ID NO: 364929 - RNA, 64 nt, Human
guuuuuuaguuuuuccuuaaaaaaaaacaacacaucgauggacuuugcuucccuguucuugaag

SEQ ID NO: 364930 - RNA, 64 nt, Human
aggagcagggguuggagaaaggcaucccaaagcuucgauggagagcagggaagggggacccaag

SEQ ID NO: 364931 - RNA, 64 nt, Human
gguaggaggaugcauggaugaguggaugaguggaucgauggauguauugauaaauagauagaac

SEQ ID NO: 364932 - RNA, 64 nt, Human
cccuuguuugagugucuuaucccugagcaaucuuucgauggauggagaugaucauuagguacuu

SEQ ID NO: 364933 - RNA, 64 nt, Human
ugugcccuguugaaacuuagguuuuuccacgcaaucgauggauuguguccuaggaagacuuuuc

SEQ ID NO: 364934 - RNA, 64 nt, Human
uuuccaccagcugccagucaagggcagugggaucucgauggagccuccccccccccccacccau

SEQ ID NO: 364935 - RNA, 64 nt, Human
ccucccaccgccuugccucacuggcaaucuggacucgauggagaacauccccccaccuccauuu

SEQ ID NO: 364936 - RNA, 64 nt, Human
acccaccugucacccccucuacgcucuccuuccucgccagcacgccuuagcuuugcaagccugc

SEQ ID NO: 364937 - RNA, 64 nt, Human
uuaacgagaaagugccugcccacugcaacggagccgccagcaccuccuccccuccagauccggg

SEQ ID NO: 364938 - RNA, 64 nt, Human
uuacuuucaggggagggcauccuauuaaaugccacgccagcaguccgggucuggguuuguccca

SEQ ID NO: 364939 - RNA, 64 nt, Human
cugacgcuguccgacgaaggcggccacggacggacgccagcacacgaagucacgugcaagugcc

SEQ ID NO: 364940 - RNA, 64 nt, Human
ggacggcagcuacagcagccucugcguccugguccgccagcaccucccgcuucuccguggugac

SEQ ID NO: 364941 - RNA, 64 nt, Human
acgaggccugggccagcugaccacggaggggguccgccagcagcuggagcugggccgcuuccug

SEQ ID NO: 364942 - RNA, 64 nt, Human
agacugacagccagggcaggggaggagggaggggcgccagcaccugaugaucgccuacugucug

SEQ ID NO: 364943 - RNA, 64 nt, Human
ugcuccagauccaccgacccguagcaucucgucacgccagcacucgccucccuaccaaugacuc

SEQ ID NO: 364944 - RNA, 64 nt, Human
gugggaugugguguuccacaugugccuguuuccacgccagcaccuugacuuggcagcauggagc

SEQ ID NO: 364945 - RNA, 64 nt, Human
ggaaacauuucuuuacauuugcauuccuccauuucgccagcacaagucuugcuaaaugugauac

SEQ ID NO: 364946 - RNA, 64 nt, Human
agcucuaguuuucuaguuuuccauuuccagauugcgccagcauuacaguaacuaacucuuucua

SEQ ID NO: 364947 - RNA, 64 nt, Human
agacuuggugccacaaagaaugccacaguggauacgccagcaggccacauggcuggccaagcaa

SEQ ID NO: 364948 - RNA, 64 nt, Human
agaccguucaccaccaucuccagcugcucacagacgccagcaaagcaguaugcucccgaucaag

SEQ ID NO: 364949 - RNA, 54 nt, Human
ucuuccaucgcccugccuagcacccgccagcacacccuuagccuccagcacccc

SEQ ID NO: 364950 - RNA, 55 nt, Human
cccgagcacggaaucuuuaagaauccgccagcacuugguagcgucugcagccacc

SEQ ID NO: 364951 - RNA, 64 nt, Human
cccggcacacuguguggagguggaaacagagcuacgccagcaggcgccaagcacccaacuccag

SEQ ID NO: 364952 - RNA, 64 nt, Human
gugcccccgccaucccgccaccaggacugcuccccgccagcacguccagagcaacuuaccccgg

SEQ ID NO: 364953 - RNA, 64 nt, Human; identical to SEQ ID NO: 116549

SEQ ID NO: 364954 - RNA, 64 nt, Human; identical to SEQ ID NO: 116555

SEQ ID NO: 364955 - RNA, 64 nt, Human; identical to SEQ ID NO: 116561

SEQ ID NO: 364956 - RNA, 64 nt, Human; identical to SEQ ID NO: 72642

SEQ ID NO: 364957 - RNA, 64 nt, Human; identical to SEQ ID NO: 72643

SEQ ID NO: 364958 - RNA, 64 nt, Human; identical to SEQ ID NO: 72644

SEQ ID NO: 364959 - RNA, 64 nt, Human; identical to SEQ ID NO: 72645

SEQ ID NO: 364960 - RNA, 64 nt, Human; identical to SEQ ID NO: 72646

SEQ ID NO: 364961 - RNA, 64 nt, Human; identical to SEQ ID NO: 72647

SEQ ID NO: 364962 - RNA, 64 nt, Human; identical to SEQ ID NO: 72648

SEQ ID NO: 364963 - RNA, 64 nt, Human; identical to SEQ ID NO: 72649

SEQ ID NO: 364964 - RNA, 64 nt, Human; identical to SEQ ID NO: 72650

SEQ ID NO: 364965 - RNA, 64 nt, Human; identical to SEQ ID NO: 72651

SEQ ID NO: 364966 - RNA, 64 nt, Human; identical to SEQ ID NO: 72652

SEQ ID NO: 364967 - RNA, 64 nt, Human; identical to SEQ ID NO: 72653

SEQ ID NO: 364968 - RNA, 64 nt, Human; identical to SEQ ID NO: 72654

SEQ ID NO: 364969 - RNA, 64 nt, Human; identical to SEQ ID NO: 72655

SEQ ID NO: 364970 - RNA, 64 nt, Human; identical to SEQ ID NO: 72656

SEQ ID NO: 364971 - RNA, 64 nt, Human
ucuggauaucacgaugcugcgaguugccuaacccucccccuaccuuuaugagaggaauuccuuc

SEQ ID NO: 364972 - RNA, 64 nt, Human
uuucaguuucuggcaaccccguguauuuccguuuucccccuaaagaacauaucauaaucauugc

SEQ ID NO: 364973 - RNA, 64 nt, Human
caugcccccucccuucacagggguacagaaauuaucccccuacaaccccagccuccugagggcu

SEQ ID NO: 364974 - RNA, 64 nt, Human; identical to SEQ ID NO: 72657

SEQ ID NO: 364975 - RNA, 64 nt, Human; identical to SEQ ID NO: 72658

SEQ ID NO: 364976 - RNA, 64 nt, Human; identical to SEQ ID NO: 72659

SEQ ID NO: 364977 - RNA, 64 nt, Human; identical to SEQ ID NO: 72660

SEQ ID NO: 364978 - RNA, 64 nt, Human; identical to SEQ ID NO: 72661

SEQ ID NO: 364979 - RNA, 64 nt, Human; identical to SEQ ID NO: 72662

SEQ ID NO: 364980 - RNA, 64 nt, Human; identical to SEQ ID NO: 72663

SEQ ID NO: 364981 - RNA, 64 nt, Human; identical to SEQ ID NO: 72664

SEQ ID NO: 364982 - RNA, 64 nt, Human; identical to SEQ ID NO: 72665

SEQ ID NO: 364983 - RNA, 64 nt, Human; identical to SEQ ID NO: 72666

SEQ ID NO: 364984 - RNA, 64 nt, Human; identical to SEQ ID NO: 72667

SEQ ID NO: 364985 - RNA, 60 nt, Human; identical to SEQ ID NO: 72668

SEQ ID NO: 364986 - RNA, 64 nt, Human; identical to SEQ ID NO: 72669

SEQ ID NO: 364987 - RNA, 64 nt, Human; identical to SEQ ID NO: 72670

SEQ ID NO: 364988 - RNA, 64 nt, Human; identical to SEQ ID NO: 72671

SEQ ID NO: 364989 - RNA, 64 nt, Human; identical to SEQ ID NO: 72672

SEQ ID NO: 364990 - RNA, 64 nt, Human
auccaguuuuucauuuuuuaccuguauugcauuuucccccuagagaaauagaucaaaagagcac

SEQ ID NO: 364991 - RNA, 64 nt, Human
aaccugaagccgagcuccccgcccaccccugucgucccccuaagcccaccccuccucacccagu

SEQ ID NO: 364992 - RNA, 64 nt, Human
ggaggggggaugaggccuuaaucugggaggccuaucccccuaucccaggcaucccagacgagga

SEQ ID NO: 364993 - RNA, 64 nt, Human; identical to SEQ ID NO: 72673

SEQ ID NO: 364994 - RNA, 64 nt, Human; identical to SEQ ID NO: 72674

SEQ ID NO: 364995 - RNA, 64 nt, Human; identical to SEQ ID NO: 72675

SEQ ID NO: 364996 - RNA, 64 nt, Human; identical to SEQ ID NO: 72676

SEQ ID NO: 364997 - RNA, 56 nt, Human; identical to SEQ ID NO: 72677

SEQ ID NO: 364998 - RNA, 64 nt, Human; identical to SEQ ID NO: 72678

SEQ ID NO: 364999 - RNA, 64 nt, Human; identical to SEQ ID NO: 72679

SEQ ID NO: 365000 - RNA, 64 nt, Human; identical to SEQ ID NO: 72680

SEQ ID NO: 365001 - RNA, 64 nt, Human; identical to SEQ ID NO: 72681

SEQ ID NO: 365002 - RNA, 64 nt, Human; identical to SEQ ID NO: 72682

SEQ ID NO: 365003 - RNA, 64 nt, Human; identical to SEQ ID NO: 72683

SEQ ID NO: 365004 - RNA, 64 nt, Human; identical to SEQ ID NO: 72684

SEQ ID NO: 365005 - RNA, 64 nt, Human; identical to SEQ ID NO: 72685

SEQ ID NO: 365006 - RNA, 57 nt, Human; identical to SEQ ID NO: 72686

SEQ ID NO: 365007 - RNA, 64 nt, Human; identical to SEQ ID NO: 72687

SEQ ID NO: 365008 - RNA, 64 nt, Human; identical to SEQ ID NO: 72688

SEQ ID NO: 365009 - RNA, 64 nt, Human
uaaaugucccaaauaaauuuauaacaauugauuuucccccuaauucuuauuuuauaauuuuaaa

SEQ ID NO: 365010 - RNA, 64 nt, Human
ucuccuagcccuucccauacaggccgcccaacacucccccuacguugcgcugcucaucacagcc

SEQ ID NO: 365011 - RNA, 64 nt, Human
aaaaugaagaaauucaacuaguagauuccugaggucccccuagcuuaaaaaaaaaaaaaaucug

SEQ ID NO: 365012 - RNA, 64 nt, Human; identical to SEQ ID NO: 72689

SEQ ID NO: 365013 - RNA, 64 nt, Human; identical to SEQ ID NO: 72690

SEQ ID NO: 365014 - RNA, 64 nt, Human; identical to SEQ ID NO: 72691

SEQ ID NO: 365015 - RNA, 64 nt, Human; identical to SEQ ID NO: 72692

SEQ ID NO: 365016 - RNA, 64 nt, Human; identical to SEQ ID NO: 72693

SEQ ID NO: 365017 - RNA, 64 nt, Human; identical to SEQ ID NO: 72694

SEQ ID NO: 365018 - RNA, 64 nt, Human; identical to SEQ ID NO: 72695

SEQ ID NO: 365019 - RNA, 64 nt, Human; identical to SEQ ID NO: 72696

SEQ ID NO: 365020 - RNA, 64 nt, Human; identical to SEQ ID NO: 72697

SEQ ID NO: 365021 - RNA, 64 nt, Human; identical to SEQ ID NO: 72698

SEQ ID NO: 365022 - RNA, 64 nt, Human; identical to SEQ ID NO: 72699

SEQ ID NO: 365023 - RNA, 64 nt, Human; identical to SEQ ID NO: 72700

SEQ ID NO: 365024 - RNA, 64 nt, Human; identical to SEQ ID NO: 72701

SEQ ID NO: 365025 - RNA, 64 nt, Human; identical to SEQ ID NO: 72702

SEQ ID NO: 365026 - RNA, 64 nt, Human; identical to SEQ ID NO: 72703

SEQ ID NO: 365027 - RNA, 64 nt, Human; identical to SEQ ID NO: 72704

SEQ ID NO: 365028 - RNA, 64 nt, Human
uuucccccaccaaaaggcuagagguaaagcuguaucccccuaaacuuaggggagauacuggagc

SEQ ID NO: 365029 - RNA, 64 nt, Human
aaaucagaacugcuuucugcagcaaaucagggcuucccccuaacaucugaacuccuguaaaccu

SEQ ID NO: 365030 - RNA, 64 nt, Human
ccccuagucaugagcacuugaaguacaaggugucucccccuaggugcaauuagguuguuucuuu

SEQ ID NO: 365031 - RNA, 64 nt, Human; identical to SEQ ID NO: 72705

SEQ ID NO: 365032 - RNA, 64 nt, Human; identical to SEQ ID NO: 72706

SEQ ID NO: 365033 - RNA, 64 nt, Human; identical to SEQ ID NO: 72707

SEQ ID NO: 365034 - RNA, 64 nt, Human; identical to SEQ ID NO: 72708

SEQ ID NO: 365035 - RNA, 64 nt, Human; identical to SEQ ID NO: 72709

SEQ ID NO: 365036 - RNA, 64 nt, Human; identical to SEQ ID NO: 72710

SEQ ID NO: 365037 - RNA, 64 nt, Human; identical to SEQ ID NO: 72711

SEQ ID NO: 365038 - RNA, 64 nt, Human; identical to SEQ ID NO: 72712

SEQ ID NO: 365039 - RNA, 64 nt, Human; identical to SEQ ID NO: 72713

SEQ ID NO: 365040 - RNA, 64 nt, Human; identical to SEQ ID NO: 72714

SEQ ID NO: 365041 - RNA, 64 nt, Human; identical to SEQ ID NO: 72715

SEQ ID NO: 365042 - RNA, 64 nt, Human; identical to SEQ ID NO: 72716

SEQ ID NO: 365043 - RNA, 64 nt, Human; identical to SEQ ID NO: 72717

SEQ ID NO: 365044 - RNA, 64 nt, Human; identical to SEQ ID NO: 72718

SEQ ID NO: 365045 - RNA, 64 nt, Human; identical to SEQ ID NO: 72719

SEQ ID NO: 365046 - RNA, 64 nt, Human; identical to SEQ ID NO: 72720

SEQ ID NO: 365047 - RNA, 64 nt, Human
aacuuuggaaacucucuuuuggaggcuucucauuucccccuaauucugugcugccugagcccua

SEQ ID NO: 365048 - RNA, 64 nt, Human
aggauuaaaauauuauuuuaaagaaaccacuguuucccccuaaaaugucauaagagcacugaag

SEQ ID NO: 365049 - RNA, 64 nt, Human
cauugaaggcacagaauuugcuaccaucucucucucccccuaccuaccaaacuauccacaauuu

SEQ ID NO: 365050 - RNA, 59 nt, Human; identical to SEQ ID NO: 72721

SEQ ID NO: 365051 - RNA, 64 nt, Human; identical to SEQ ID NO: 72722

SEQ ID NO: 365052 - RNA, 64 nt, Human; identical to SEQ ID NO: 72723

SEQ ID NO: 365053 - RNA, 64 nt, Human; identical to SEQ ID NO: 72724

SEQ ID NO: 365054 - RNA, 64 nt, Human; identical to SEQ ID NO: 72725

SEQ ID NO: 365055 - RNA, 64 nt, Human; identical to SEQ ID NO: 72726

SEQ ID NO: 365056 - RNA, 64 nt, Human; identical to SEQ ID NO: 72727

SEQ ID NO: 365057 - RNA, 64 nt, Human; identical to SEQ ID NO: 72728

SEQ ID NO: 365058 - RNA, 64 nt, Human; identical to SEQ ID NO: 72729

SEQ ID NO: 365059 - RNA, 64 nt, Human; identical to SEQ ID NO: 72730

SEQ ID NO: 365060 - RNA, 64 nt, Human; identical to SEQ ID NO: 72731

SEQ ID NO: 365061 - RNA, 64 nt, Human; identical to SEQ ID NO: 72732

SEQ ID NO: 365062 - RNA, 64 nt, Human; identical to SEQ ID NO: 72733

SEQ ID NO: 365063 - RNA, 64 nt, Human; identical to SEQ ID NO: 72734

SEQ ID NO: 365064 - RNA, 62 nt, Human; identical to SEQ ID NO: 72735

SEQ ID NO: 365065 - RNA, 64 nt, Human; identical to SEQ ID NO: 72736

SEQ ID NO: 365066 - RNA, 64 nt, Human
uacuauccuuauaaauacugaucaaucccaguucucccccuaaaaaugaauacauaguaggacu

SEQ ID NO: 365067 - RNA, 64 nt, Human
gggguucugggaguucccugaacaucugugugugucccccuaugcuccaguauggaagaauggg

SEQ ID NO: 365068 - RNA, 64 nt, Human
cagcaagcccaagauuccgaagaagacagacaacucccccuaguaccaccuagacauuacuuuu

SEQ ID NO: 365069 - RNA, 64 nt, Human; identical to SEQ ID NO: 72737

SEQ ID NO: 365070 - RNA, 64 nt, Human; identical to SEQ ID NO: 72738

SEQ ID NO: 365071 - RNA, 64 nt, Human; identical to SEQ ID NO: 72739

SEQ ID NO: 365072 - RNA, 64 nt, Human; identical to SEQ ID NO: 72740

SEQ ID NO: 365073 - RNA, 64 nt, Human; identical to SEQ ID NO: 72741

SEQ ID NO: 365074 - RNA, 64 nt, Human; identical to SEQ ID NO: 72742

SEQ ID NO: 365075 - RNA, 64 nt, Human; identical to SEQ ID NO: 72743

SEQ ID NO: 365076 - RNA, 64 nt, Human; identical to SEQ ID NO: 72744

SEQ ID NO: 365077 - RNA, 64 nt, Human; identical to SEQ ID NO: 72745

SEQ ID NO: 365078 - RNA, 64 nt, Human; identical to SEQ ID NO: 72746

SEQ ID NO: 365079 - RNA, 64 nt, Human; identical to SEQ ID NO: 72747

SEQ ID NO: 365080 - RNA, 64 nt, Human; identical to SEQ ID NO: 72748

SEQ ID NO: 365081 - RNA, 64 nt, Human; identical to SEQ ID NO: 72749

SEQ ID NO: 365082 - RNA, 64 nt, Human; identical to SEQ ID NO: 72750

SEQ ID NO: 365083 - RNA, 64 nt, Human; identical to SEQ ID NO: 72751

SEQ ID NO: 365084 - RNA, 64 nt, Human; identical to SEQ ID NO: 72752

SEQ ID NO: 365085 - RNA, 64 nt, Human
gugagaaacuagaggcuucuccaguguugccauaucccccuagguugucuugauccaugaacca

SEQ ID NO: 365086 - RNA, 64 nt, Human
auggaacugacggcuuugcuuguuuugauucuuuucccccuacuuuuccuaaugguuuaaauuc

SEQ ID NO: 365087 - RNA, 64 nt, Human
agcgugcuagcacacugccaccaucucaaagccaucccccuagccaucgugagcaucccagcgg

SEQ ID NO: 365088 - RNA, 64 nt, Human; identical to SEQ ID NO: 141836

SEQ ID NO: 365089 - RNA, 64 nt, Human; identical to SEQ ID NO: 141837

SEQ ID NO: 365090 - RNA, 64 nt, Human; identical to SEQ ID NO: 141838

SEQ ID NO: 365091 - RNA, 64 nt, Human; identical to SEQ ID NO: 141839

SEQ ID NO: 365092 - RNA, 64 nt, Human; identical to SEQ ID NO: 141840

SEQ ID NO: 365093 - RNA, 64 nt, Human; identical to SEQ ID NO: 141841

SEQ ID NO: 365094 - RNA, 64 nt, Human; identical to SEQ ID NO: 141842

SEQ ID NO: 365095 - RNA, 64 nt, Human; identical to SEQ ID NO: 141843

SEQ ID NO: 365096 - RNA, 64 nt, Human; identical to SEQ ID NO: 141844

SEQ ID NO: 365097 - RNA, 64 nt, Human; identical to SEQ ID NO: 141845

SEQ ID NO: 365098 - RNA, 51 nt, Human; identical to SEQ ID NO: 141846

SEQ ID NO: 365099 - RNA, 64 nt, Human; identical to SEQ ID NO: 141847

SEQ ID NO: 365100 - RNA, 64 nt, Human; identical to SEQ ID NO: 141848

SEQ ID NO: 365101 - RNA, 64 nt, Human; identical to SEQ ID NO: 141849

SEQ ID NO: 365102 - RNA, 64 nt, Human; identical to SEQ ID NO: 116567

SEQ ID NO: 365103 - RNA, 64 nt, Human; identical to SEQ ID NO: 116573

SEQ ID NO: 365104 - RNA, 64 nt, Human; identical to SEQ ID NO: 116578

SEQ ID NO: 365105 - RNA, 64 nt, Human
uagaugaauguguuaagugaaaugauacuuguacucccccuaccccuuugucaacugcugugaa

SEQ ID NO: 365106 - RNA, 64 nt, Human
aaauaaaccuucccuuaucuuccuacucugccccucccccuaaugaaaucauauuaaguuguuu

SEQ ID NO: 365107 - RNA, 64 nt, Human
uuaccucaucagaagcaguggcucagcuaagugcucccccuagcucccaucucaggagaccaaa

SEQ ID NO: 365108 - RNA, 64 nt, Human
acauguccgucuacccucucgcacucaugacaccucccccuaccagcccuccucuuccuccucc

SEQ ID NO: 365109 - RNA, 64 nt, Human
cccucuuuggagucaacccuccuucccgacccccucccccuagcccagccccagucacugucag

SEQ ID NO: 365110 - RNA, 64 nt, Human
aaaucaggcucauagcagcuacuguguagaaaauucccccuacuucuaauuugcugaaugaaga

SEQ ID NO: 365111 - RNA, 64 nt, Human
ucuuuacucccaagacuucauugucccucuucacucccccuaaaccccugucccaugcaggccc

SEQ ID NO: 365112 - RNA, 64 nt, Human; identical to SEQ ID NO: 365111

SEQ ID NO: 365113 - RNA, 62 nt, Human
agacucagaugaucaagugaagagccccagauucccccuaagaagcaaaggaucgucuuuua

SEQ ID NO: 365114 - RNA, 64 nt, Human
ggaccucuaugucaacaugacagggugaaacuauucccccuaagacuguucaacuuguagauac

SEQ ID NO: 365115 - RNA, 64 nt, Human
aaggucuguccuugggaugcucucuggucuuuuuucccccuaagucuuucucuuucccaucaua

SEQ ID NO: 365116 - RNA, 64 nt, Human
aaagcagcugcuuuaagaaugguuuuccaccuuuucccccuaaucucuaccaaucagacacauu

SEQ ID NO: 365117 - RNA, 64 nt, Human
gggucacccaggaguaaugucccuccagcaacguucccccuauggccuccagcagagcugaucu

SEQ ID NO: 365118 - RNA, 64 nt, Human
ucccucagcuuuuguggauuuaaaaccauucugcucccccuaaaccuuuuguuugauuucagcc

SEQ ID NO: 365119 - RNA, 64 nt, Human
uauucccuuccagccagacuggcagaugggggcuucccccuaccccugaggaugaggacaagcc

SEQ ID NO: 365120 - RNA, 64 nt, Human
agacuuggggaagaguuguguauguggguguuucucccccuaguuaauuccuguuguguaaggg

SEQ ID NO: 365121 - RNA, 64 nt, Human
gccaagcaugaggccucuugccaaagaucagcugucccccuaaagccacagggaugggguaucu

SEQ ID NO: 365122 - RNA, 64 nt, Human
ggguggacucagaugggugggacacaugccuuccucccccuauuccacccccaaguugaucuga

SEQ ID NO: 365123 - RNA, 64 nt, Human
ugggggcuucucccucuacccagggcugggcugaucccccuacugcaacuaacuguugcccccc

SEQ ID NO: 365124 - RNA, 64 nt, Human
acacuacucagcucucuugcacugaggaaauuuuucccccuacauugacuccuggccuacauca

SEQ ID NO: 365125 - RNA, 64 nt, Human
ucaguaugcccugaaugaaugggugucacccuccucccccuagugagagauaaggaccucaggc

SEQ ID NO: 365126 - RNA, 64 nt, Human
uuaaaggugguuuaaauaaauaaggaugugcuggucccccuacucugugugugcugaauaaaug

SEQ ID NO: 365127 - RNA, 64 nt, Human
ccucugauauuuuguauuuauguguuugucugucucccccuacuagaauguaagcuccaugggg

SEQ ID NO: 365128 - RNA, 64 nt, Human
uugaauuuuuaagcuacuuauucauaguuuuauaucccccuaaacuaccuuuuuguuccccauu

SEQ ID NO: 365129 - RNA, 64 nt, Human
caauguauaguaguuccccccccuuuuccuucuuucccccuauccuuuuucucuccaccccauc

SEQ ID NO: 365130 - RNA, 64 nt, Human
gcgcgggacagcggccccgcggagcccccgccccucccccuacagauccuccgcggaggccccu

SEQ ID NO: 365131 - RNA, 64 nt, Human
gaucucuucaaggucaacugcaguguugcuucccucccccuauagggcuggaaucugucuagga

SEQ ID NO: 365132 - RNA, 64 nt, Human
gcuccuagaccuugggcgcuucccaccugccccgucccccuagagacucagaggacccaccugg

SEQ ID NO: 365133 - RNA, 64 nt, Human
gaggagggagagagauguacuuuuuaaaucauguucccccuaaacauggcuguuaacccacugc

SEQ ID NO: 365134 - RNA, 64 nt, Human
ugcaccugcugcggccacagcuccguggaaggacucccccuaccugagcagagcagaagcccca

SEQ ID NO: 365135 - RNA, 64 nt, Human
cuuaaaauaguuuagauauguuaagcauggauuuucccccuaaauucuacucuaaagcuucuau

SEQ ID NO: 365136 - RNA, 64 nt, Human
cuuuuggggcuucagauuuuaugauuacaucuugucccccuagaacaucccccuuccucccaua

SEQ ID NO: 365137 - RNA, 64 nt, Human
auaaaugcauuauuaugacugugacagugacuaaucccccuaugaccccaaagcccugauuaaa

SEQ ID NO: 365138 - RNA, 64 nt, Human
ugucuaauguccuugucuucuuuuucuugugcuuucccccuauuccagggugugcacccucucc

SEQ ID NO: 365139 - RNA, 64 nt, Human
caguguccccggggaagggcagaugacacucccuucccccuaagccaaccgcacugaaggagug

SEQ ID NO: 365140 - RNA, 64 nt, Human
auauuugucauuuguauuuauuaucucuguguuuucccccuaaggcauaaaaugguuuacugug

SEQ ID NO: 365141 - RNA, 64 nt, Human
aaggcauuuuauugcuugaguuauauguucacugucccccuaauauuagggaguaaaacggaua

SEQ ID NO: 365142 - RNA, 64 nt, Human
cacucaauguggguggcucccuauuccuuuacgcucccccuaucccuaccccacaagccuuucg

SEQ ID NO: 365143 - RNA, 64 nt, Human
ucuucauauaacugagcuggccuuauccuuggcaucccccuaaacaaacaagaggugaccaccu

SEQ ID NO: 365144 - RNA, 64 nt, Human
uuucuuuuguauggacaguuccccuucagucccaucccccuacacauacacccagccggggcca

SEQ ID NO: 365145 - RNA, 64 nt, Human
aaggggucuguaaagcgggagaacaaggcuagccucccccuaacaauccuagacugagacgcag

SEQ ID NO: 365146 - RNA, 62 nt, Human
auaguauccuagaguguuaauagcagcaguccucccccuaccccgccccgagaccccacccc

SEQ ID NO: 365147 - RNA, 64 nt, Human
acuguagcagaguaucuggugauugucaauucauucccccuauaggaauacaaggggcacacag

SEQ ID NO: 365148 - RNA, 64 nt, Human
uuugaccccgauauauuuuagcauuuuaauucucucccccuauuuauugacuuugacaauuacu

SEQ ID NO: 365149 - RNA, 64 nt, Human
auaaaagcaacuuuuaauuguauagauauauauuucccccuauggggccugacugcacugauau

SEQ ID NO: 365150 - RNA, 64 nt, Human
uugaaaggcuuuuguuuauaguggaacccucuuuucccccuagaagaaccaccacaaggaaaaa

SEQ ID NO: 365151 - RNA, 64 nt, Human
uuaacgcugcuacucuuaaucuucucuaaauuuuucccccuacuuucuugcuucuguuucacau

SEQ ID NO: 365152 - RNA, 64 nt, Human
cuuguccucucugucccauaaccuaccuccacccucccccuagccagccaggcagcuucucugc

SEQ ID NO: 365153 - RNA, 64 nt, Human
ucagggcucaggcuggggccucccauugacauccucccccuacacucccucucugagccuccgu

SEQ ID NO: 365154 - RNA, 64 nt, Human
uaaauaaaccugaaugccaugugggccauucuauucccccuauguguagaacuguaacucacau

SEQ ID NO: 365155 - RNA, 64 nt, Human
aaaggauguucguauaaauggcacugcuccauccucccccuaugcauugguuuuuuucccugua

SEQ ID NO: 365156 - RNA, 64 nt, Human
auguuuccuuuggaaacauuuaggaauauuuuucucccccuaccccauaaauuguguagcacuu

SEQ ID NO: 365157 - RNA, 64 nt, Human
gcaacguuuuaaacugcuaacagaccuuaaaauaucccccuaccuggguccucagugcuauguu

SEQ ID NO: 365158 - RNA, 64 nt, Human
ggcuugggacugcggcugccacaggaagggggcaucccccuacuuuggguguugggucagaucc

SEQ ID NO: 365159 - RNA, 64 nt, Human
gucuccauccuucccucuccuuuucugucaccuuucccccuagcuggcuccuuuggaccuaccc

SEQ ID NO: 365160 - RNA, 64 nt, Human
gagugugaccugacagugcuggagccuccuaguuucccccuaugaagguucccuuaggcugcug

SEQ ID NO: 365161 - RNA, 64 nt, Human
uccaucuguugacaaaugacagaucuuuuuuuuuucccccuaucaguugauuuuucuuauuuac

SEQ ID NO: 365162 - RNA, 64 nt, Human
uuuauuuuuuaaaaaaaagaaacaaaaauauuuuucccccuaaaauaggagagagccaaaacug

SEQ ID NO: 365163 - RNA, 64 nt, Human
uuuaagggggaaaaaaaaacccaccauucucuucucccccuauuaaauuugcaacaauaaaggg

SEQ ID NO: 365164 - RNA, 64 nt, Human
gugacucaugaggggcuuuggcuaccucuugcguucccccuagagauguccaggccuuacauuu

SEQ ID NO: 365165 - RNA, 64 nt, Human
aggccaggcucucuaagcacauuucuccuuucauucccccuaaaaacagagugaccuggaagua

SEQ ID NO: 365166 - RNA, 64 nt, Human
ucccagggccagacagcccuuccuggcucccccaucccccuaugggcucccagccccuugcacc

SEQ ID NO: 365167 - RNA, 64 nt, Human
cugaauacuggugcccagccagcccgugacagcuucccccuaaucaggaggggacagcuggggg

SEQ ID NO: 365168 - RNA, 64 nt, Human
cugcacuugacucaaugcugcccgagcccucccuucccccuauccaaccuggguagguggguag

SEQ ID NO: 365169 - RNA, 64 nt, Human
acugguauuugugaucucaccauuaugacauccaucccccuagcucaccacauagcacauagaa

SEQ ID NO: 365170 - RNA, 64 nt, Human
gaaccagccguccucucuuggaggauaaacagccucccccuacccaauugccagggcaaggugg

SEQ ID NO: 365171 - RNA, 64 nt, Human
gcuucagugggaaccucugagagcauuuuccuguucccccuaucaaccgcccccagugauaaca

SEQ ID NO: 365172 - RNA, 64 nt, Human
aauggucaauuggauucaacuuuaguccucuccuucccccuaaaagcgaauguuugugugugca

SEQ ID NO: 365173 - RNA, 64 nt, Human
cguucccucuguuucuguccucagaugaugucccucccccuaccuguaaccuuucuuugacaua

SEQ ID NO: 365174 - RNA, 64 nt, Human
gccacauagcugcucagaacccaagauuguaagcucccccuagggccagaggccucuuucuuuc

SEQ ID NO: 365175 - RNA, 64 nt, Human
cuggcuggaacuuacacuucacguucccuuuuuuucccccuagagauggggucucgccguguug

SEQ ID NO: 365176 - RNA, 64 nt, Human
ugguaauguccuucccggacucuuuuuaaaugucucccccuaaguuuuauacuugauuguauua

SEQ ID NO: 365177 - RNA, 64 nt, Human
ugauuaaacuguauucuaaaacauuugggguuuuucccccuauucaguuuuaaucuuggaauau

SEQ ID NO: 365178 - RNA, 64 nt, Human
caccuuguaaggaggaagugaaugaaauaaaggaucccccuaaggauuuucuacuguguccugu

SEQ ID NO: 365179 - RNA, 64 nt, Human
acugacucccccccugcccucuccccucucucccucccccuaacugcaugacauguuaacugug

SEQ ID NO: 365180 - RNA, 64 nt, Human
uuuagcuuucuccuuuacaaugcaugaaugccuaucccccuacaaaacaaagauuaaaugugau

SEQ ID NO: 365181 - RNA, 64 nt, Human
uuguguuuuaaaauaaggauuuuucucuuauuucucccccuaguuugugagaaacaucucaaua

SEQ ID NO: 365182 - RNA, 64 nt, Human
gucuguccccaucucugaaauccuuccuucucuuucccccuaagucuuuugagugucaucaugu

SEQ ID NO: 365183 - RNA, 64 nt, Human
gcagucgucuuucauuuuggcagaccuuagaauaucccccuagcuuaauaaaucuuuguugaau

SEQ ID NO: 365184 - RNA, 64 nt, Human
gcuugcaggaaaugaauccagcagccaacucgaaucccccuagggcucaggcacugagggccug

SEQ ID NO: 365185 - RNA, 64 nt, Human
gguaacucccgaaaacccugccuuaccucucccuucccccuaacauuaaacuauuuggcaugag

SEQ ID NO: 365186 - RNA, 64 nt, Human
gggcagcucauagaguccccccucccaccuccagucccccuauccuuggcaccaaagaugcagc

SEQ ID NO: 365187 - RNA, 64 nt, Human
gucagagcugaagccauauacgacuggguguuugucccccuacuuuggccccaggaguaaaaaa

SEQ ID NO: 365188 - RNA, 64 nt, Human
ugugcccagcucaagucucucucccccuccuuucucccccuaaacuuuggccggccgccgggcg

SEQ ID NO: 365189 - RNA, 64 nt, Human
cugucccauuaacugacauggucagauuuccagcucccccuacucccugcugugaaacaauccc

SEQ ID NO: 365190 - RNA, 64 nt, Human
uccccaaacuugcugucaauuccgagaucuaaucucccccuacgcucugccaggaauucuuuca

SEQ ID NO: 365191 - RNA, 64 nt, Human
gaaaugaggcccacagacucaaaguuacucuccuucccccuaccugggccagugaaauagaaag

SEQ ID NO: 365192 - RNA, 64 nt, Human
ccuccaacccaucauguggagauacucauccuguucccccuagagcugcucuuccugcugcauu

SEQ ID NO: 365193 - RNA, 64 nt, Human
aacaggucuguguugucuagaucuuugcuuuuuaucccccuaucaguccagggcauauacuaac

SEQ ID NO: 365194 - RNA, 64 nt, Human
caccggaacaauugcgaauucucucugccucgccucccccuaucuuguccgugugggcacacac

SEQ ID NO: 365195 - RNA, 64 nt, Human
augaauuugagcaggucucauagguugagcaauuucccccuaaaccaacugaaggcuaaaaagc

SEQ ID NO: 365196 - RNA, 64 nt, Human
uguaacagguuaaaugaaccccugggcuuaauuuucccccuacuuaguucuguggcagcaaaga

SEQ ID NO: 365197 - RNA, 64 nt, Human
ccacagaggagaaguaaagccauuucugccacuuucccccuagagagccgauuccaccccgggg

SEQ ID NO: 365198 - RNA, 64 nt, Human
ugauuucuucuucauuccauuuauggaacuucccucccccuaguccgguucuucuugucuuugu

SEQ ID NO: 365199 - RNA, 64 nt, Human
aaaaugugagcucguuuuccugcucggcaugugcucccccuaaggcucugcuccucccugggcc

SEQ ID NO: 365200 - RNA, 64 nt, Human
ggauccaugucauuccuuuauuuuuauaaauuauucccccuaucauuccuuuacagugccuagu

SEQ ID NO: 365201 - RNA, 64 nt, Human
ucugcucaucucaaccucucacagaggugucuucucccccuaaccuacagcuuuuuguacaagc

SEQ ID NO: 365202 - RNA, 64 nt, Human
guauuuuauaguuuaaauuacaaaccaaggugguucccccuaagauauauaucuugguuuacca

SEQ ID NO: 365203 - RNA, 64 nt, Human
uaaaauauccuacuucugguagccauuuaauuccucccccuacccccaaauaaaucaggcaugc

SEQ ID NO: 365204 - RNA, 64 nt, Human
cuuucucccugggcuugucuuuuuguuguuuuuuucccccuauauucagagcuccuugagaagu

SEQ ID NO: 365205 - RNA, 64 nt, Human
uggggccccugcccucaggaggcugucagacuguucccccuaaacacacuucugaagguuguag

SEQ ID NO: 365206 - RNA, 64 nt, Human
cauaaagcaauugaggaggaggaggaaccccucgucccccuaggagcagacccaagcuuguggc

SEQ ID NO: 365207 - RNA, 64 nt, Human
gugcuucuguuuucuugucuauucugcauaucuuucccccuaggauuauggugauuaucugugu

SEQ ID NO: 365208 - RNA, 64 nt, Human
gaaacccugcacccauuagcagucccuccacauuucccccuagccugccuccccugccucacca

SEQ ID NO: 365209 - RNA, 64 nt, Human
guuuucuauuuucuuuucaugaaaacacuguuuuucccccuaauaaagcauauuuuacuuuggu

SEQ ID NO: 365210 - RNA, 64 nt, Human
ucucucuacugcccuggcccguucauccuguguaucccccuacaagaaugggcaccuccugccc

SEQ ID NO: 365211 - RNA, 64 nt, Human
cagaguggcccaggguuucaagggaggaggaaccucccccuaccuaggacccuuccuguggggg

SEQ ID NO: 365212 - RNA, 64 nt, Human
cugugaaaacaggcaaggagcccggguuaaaauaucccccuauucgcccccaaaaugcaauaaa

SEQ ID NO: 365213 - RNA, 64 nt, Human
gcacgcacacacucuuacacgagagcacacucgaucccccuaggccagcggggacaccccagcc

SEQ ID NO: 365214 - RNA, 64 nt, Human
agaugagaaucaccccucucagugcaccuggggaucccccuaaacugugaauucugcccuggac

SEQ ID NO: 365215 - RNA, 64 nt, Human
ugcaggccccaggaagacuuuccuucacccaccaucccccuaaccucggcagggcuucuguccu

SEQ ID NO: 365216 - RNA, 64 nt, Human
agcccacccacacucaccagaaucuccacuguagucccccuaacaaacagcccuucacuuccuc

SEQ ID NO: 365217 - RNA, 64 nt, Human
gagccagaaccauccccauuucuuuugugguaucucccccuaccacaaaccaggcuggaaccca

SEQ ID NO: 365218 - RNA, 64 nt, Human
caaaggccagaguguccuuuggguccuccuagagucccccuaggucucuggcugcccaugaggc

SEQ ID NO: 365219 - RNA, 64 nt, Human
uccagagacaaguccaaguucuugauccacccauucccccuauaauggcagaggaccuuuaugu

SEQ ID NO: 365220 - RNA, 64 nt, Human
cuaccccucgguuggggcugagucagccagauccucccccuacuucuccccaagggccaagaac

SEQ ID NO: 365221 - RNA, 64 nt, Human
gucaucucugaaaagacugggggauaugaaaucuucccccuaccccacuuaaugcguuggauau

SEQ ID NO: 365222 - RNA, 64 nt, Human
ggagggugcccucugcucaggccucccuagcaccucccccuaaccaaauucucccuggacccca

SEQ ID NO: 365223 - RNA, 64 nt, Human
ucauuucuugaccuuaauguuuuuccaaucuucuucccccuacuuggguaauugauuaaaauac

SEQ ID NO: 365224 - RNA, 64 nt, Human
cucauagucuaaaaccauuuuucuuucuuuuuuuucccccuaaacaaccucuuaaagggguaag

SEQ ID NO: 365225 - RNA, 64 nt, Human
uacaguggagaaugggggugaccacaaaagaggcucccccuaaacacacagugcugccacuuaa

SEQ ID NO: 365226 - RNA, 64 nt, Human
ccuguucaauucuuuuguuucuucuccuucccccucccccuaccuccuuccccucacuccuccc

SEQ ID NO: 365227 - RNA, 64 nt, Human
ugggcugggggccagggcuggauggacagacaccucccccuacccauaucccucccgugugugg

SEQ ID NO: 365228 - RNA, 64 nt, Human
aaauugcuagaagucagaacaggauggcugggucucccccuaccucuuccagcucccacaauuu

SEQ ID NO: 365229 - RNA, 64 nt, Human
gcuuggcaucauggacuguuaauguaugugauuuucccccuauuuucucucuccaaaaugauaa

SEQ ID NO: 365230 - RNA, 64 nt, Human
aucauuuucuuuuugaucucacacaccagggcauucccccuaagaggcagugagauguagccug

SEQ ID NO: 365231 - RNA, 64 nt, Human
guccuuuccugaugucuccucccuugucuuauugucccccuacccuaaaugccccccugccaua

SEQ ID NO: 365232 - RNA, 64 nt, Human
ucuaggcugcuuggcugccugucuuucuaggcagucccccuagaggaaaaauguaggaauuuau

SEQ ID NO: 365233 - RNA, 64 nt, Human
ucagagacaacuucccaaagcacaaagcaguuuuucccccuaggggugggaggaagcaaaagac

SEQ ID NO: 365234 - RNA, 64 nt, Human
agccagcccagagaggagcaugucuuccuuuaccucccccuaaggagauacuacaugggagggg

SEQ ID NO: 365235 - RNA, 64 nt, Human
ccugaauuccacuuccaggcagaaaggagugggcucccccuacucccucagaggaacugacuca

SEQ ID NO: 365236 - RNA, 64 nt, Human
cuagcugaugauaaauacaccuuuuuuucccucuucccccuaaaaaugguaaaucugaucauau

SEQ ID NO: 365237 - RNA, 64 nt, Human
ccuggacaccaggaugggacugcaaccucaggucucccccuacauauuaauaccagucaccagg

SEQ ID NO: 365238 - RNA, 64 nt, Human
guggccaucgucugccugguaaaauaagaucgccucccccuacgccgucuuggcuuuuccccuc

SEQ ID NO: 365239 - RNA, 64 nt, Human
ugcuuuaccaauaugauuuacauuuguuaacuucucccccuaacauaucagauauguaaagaca

SEQ ID NO: 365240 - RNA, 64 nt, Human
aaacuucaauuaaauguauaaugagagaccuuggucccccuaaaggaugaauuuccuuuaggcc

SEQ ID NO: 365241 - RNA, 64 nt, Human
gugaaggcaguuuuuuuucuuuuuuaacuccccaucccccuaugcagggugucauuucaccauc

SEQ ID NO: 365242 - RNA, 64 nt, Human
auucucacagcaagccccuuaguccccaagccccucccccuaaggcagcugggggagaggugac

SEQ ID NO: 365243 - RNA, 64 nt, Human
gauggccuggcugccuggugguugaugguuuugcucccccuaccuuuuuuuuuugaguuuauuc

SEQ ID NO: 365244 - RNA, 64 nt, Human
ggaugcccacggccguucaucaucuugucccucgucccccuaccacacucccccuccuagaccg

SEQ ID NO: 365245 - RNA, 64 nt, Human
agauccuggccacuaugccaguucugaccucgcaucccccuaccccgagcccaugcagucuggg

SEQ ID NO: 365246 - RNA, 64 nt, Human
uacagccagcaggcauugagcagccuuagcauugucccccuacucccguccuccaggugucccc

SEQ ID NO: 365247 - RNA, 64 nt, Human
acuagguauaucuccuaaugcuaucccuccccccucccccuaauguaaaugacgaguuaauggu

SEQ ID NO: 365248 - RNA, 64 nt, Human
ccagagaacaauccagccccgaaugucagcaccuucccccuacccgaguugugaaaauaaaaaa

SEQ ID NO: 365249 - RNA, 64 nt, Human
gcggaaacuuccaugugucuccugccaggcucugucccccuacgccaucccgacacguccccgu

SEQ ID NO: 365250 - RNA, 64 nt, Human
cccuccgccacaaggaagcacaaccagcucgcccucccccuacccggggccgcaggacgcugag

SEQ ID NO: 365251 - RNA, 64 nt, Human
ccaaacucuggaguccgagguaacagaacaccugucccccuaggcuuuuccuuguggacaacgg

SEQ ID NO: 365252 - RNA, 64 nt, Human
ccuaggcccccuccccaacucuaaccagaccccaucccccuaagucccuuugucuugaccccca

SEQ ID NO: 365253 - RNA, 64 nt, Human
ggcgaaacagccaggugauccccccgccauuaucucccccuaguuagagacaguccuuccguga

SEQ ID NO: 365254 - RNA, 64 nt, Human
aaggcuuuucccuccuuugucccucugacaccccucccccuaauucucaucugucagauccagu

SEQ ID NO: 365255 - RNA, 64 nt, Human
ugguccccuuuugccaacaccugcuggucagaugucccccuacccccaccccacuguccuccaa

SEQ ID NO: 365256 - RNA, 64 nt, Human
gugugcuucccaaauacauuaacaagcucuuacuucccccuaaccccuaugaacucuugauaac

SEQ ID NO: 365257 - RNA, 64 nt, Human
uaucauucuucgcuaauuuguauuuguauucccuucccccuacaagauuaugagaccccagagg

SEQ ID NO: 365258 - RNA, 64 nt, Human
agaggcucugcguucugggggcuuuuucuucuccucccccuacccgguuucccucccuguuuuc

SEQ ID NO: 365259 - RNA, 64 nt, Human
guccgacgccgcuuacucagagcccuggccucccucccccuaccucacacgcugcucaugaaag

SEQ ID NO: 365260 - RNA, 64 nt, Human
ggaaaugaaaugaaaucaaauuuaucaguuuuuuucccccuaauuacccaaaagaucuuuugca

SEQ ID NO: 365261 - RNA, 64 nt, Human
caccacuggauuguagauugauuuuucuuuccugucccccuacucccucccuaccuuuuccauc

SEQ ID NO: 365262 - RNA, 64 nt, Human
cugcaagauccucauugagccacuccagugagaaucccccuacccucgaaggccgcccuaacaa

SEQ ID NO: 365263 - RNA, 64 nt, Human
gcuguuugcuuuugguaaugugauguugauguucucccccuacccacaaccaugcccuugaggg

SEQ ID NO: 365264 - RNA, 64 nt, Human
cuuguauccauugacuggaagucugucacguggcucccccuagccgcacacuagugugggaagg

SEQ ID NO: 365265 - RNA, 64 nt, Human
uguuaguaaugcccaaaagaaaagucucaagcagucccccuauccagucauuuuuauggaguuu

SEQ ID NO: 365266 - RNA, 64 nt, Human
ggcccaacuagccaagucugguguucccucaucaucccccuaccugaaccccucuugccacugc

SEQ ID NO: 365267 - RNA, 64 nt, Human
auguuuagcauguaacucgcuuaaaguugagguuucccccuaaaaucuacaaguuucccucuuu

SEQ ID NO: 365268 - RNA, 64 nt, Human
guauuuuauaauucugggaagcaaaacccaugccucccccuagccauuuuuacuguuauccuau

SEQ ID NO: 365269 - RNA, 64 nt, Human
uaaaggcaaccccagauuucuaaucuaccaagugucccccuaaccuccuuuccucucugcuaau

SEQ ID NO: 365270 - RNA, 64 nt, Human
cucucccaaucucuggauauuugacucccaaccuucccccuaccuccuggcccuuuuuggugua

SEQ ID NO: 365271 - RNA, 64 nt, Human
auucucuuuuuucaagucacuuuuguuauaggucucccccuaggccugucucucccuuagccca

SEQ ID NO: 365272 - RNA, 64 nt, Human
cauguuggauucuccaacaggcugggugcauguaucccccuacuccuacccucaucucauccuu

SEQ ID NO: 365273 - RNA, 53 nt, Human
agcugugcccugcugccugagcgucccccuacccccccagggccugcugccuu

SEQ ID NO: 365274 - RNA, 63 nt, Human
cuuaagaaaacaggaccagccggcaccaggcccgucucucacguacuuuaacacauccuugaa

SEQ ID NO: 365275 - RNA, 63 nt, Human
aagugcuaguuaauacuaaucaccuccuccucugucucucauccuccuuucucccaucaaagc

SEQ ID NO: 365276 - RNA, 63 nt, Human
gcauaauggauauuuuuuaacuuggcgagaugugucucucaauccuguggcuuuggugagaga

SEQ ID NO: 365277 - RNA, 63 nt, Human
aaaggaaugaagcaccagcaggagguggacagagucucucauggaugccggcacaaaacugcc

SEQ ID NO: 365278 - RNA, 63 nt, Human
aacuuuugucauuugggugcaggcugugaauuugucucucagucacugauugccacugccauc

SEQ ID NO: 365279 - RNA, 63 nt, Human
acauuagugagaaagaaaaagaucgcuauuucagucucucagauaaagaugccaauucuaaug

SEQ ID NO: 365280 - RNA, 63 nt, Human
uuauucagcauggucuucacaguaauauuccuugucucucaaagcuauuauauauugcuuugu

SEQ ID NO: 365281 - RNA, 63 nt, Human
acuuccauuucaucagugccugccagaagcugugucucucauugggcuccaaagaggugggau

SEQ ID NO: 365282 - RNA, 63 nt, Human
ccuuuuuauggcucacacagcuuaagaguagcugucucucaaacgugcgcucacaguugagcu

SEQ ID NO: 365283 - RNA, 63 nt, Human
gacaaucuuucacucacugacggcagcagccaugucucucaaaguggugaaacuaauaucuga

SEQ ID NO: 365284 - RNA, 63 nt, Human
aguuuacaaacccaguaucaugucugucugugugucucucaaggugagagucugauuuuuaua

SEQ ID NO: 365285 - RNA, 63 nt, Human
gacuguuuccugaguaccagcaggucccuuuuugucucucaugggccuagcauagguaugagc

SEQ ID NO: 365286 - RNA, 63 nt, Human
aguggggagugggcuucuuccuccaagaucucagucucucagugcuuggcagaggggugaggc

SEQ ID NO: 365287 - RNA, 63 nt, Human
gcuaucacaguaucauuguuaagugacacuuuugucucucauaacaccaucacacucuuccuu

SEQ ID NO: 365288 - RNA, 63 nt, Human
aaaccugucucuaauuuguaauuuguaaacccugucucucauauuuguaaaacuacaaaaauu

SEQ ID NO: 365289 - RNA, 63 nt, Human
cccugccgcccucacccugcccuuguugucucugucucucacgucucucuucugcugucucuc

SEQ ID NO: 365290 - RNA, 63 nt, Human
ggacacagggucugugugugggcagcagccccugucucucagcaagaauaaagcagcuuccug

SEQ ID NO: 365291 - RNA, 63 nt, Human
ggaacucaugguggucuccugggcuuggucacugucucucaccagcauguuucuuugugcggu

SEQ ID NO: 365292 - RNA, 63 nt, Human
ugauaugcuagaucugugccguuaauaggcaucgucucucagccugagggaggcuggauucug

SEQ ID NO: 365293 - RNA, 63 nt, Human
caggccccuggaguuguuuucggcaggggccuugucucucacugcauuuggucaggggggcau

SEQ ID NO: 365294 - RNA, 63 nt, Human
uuucuaucauaaauacauguuuucacagccuuugucucucagacucugcuaaauaauguagcu

SEQ ID NO: 365295 - RNA, 63 nt, Human
agggacacuggggccuuucuucuccuuguaggggucucucagagguucuuuccacaggccauc

SEQ ID NO: 365296 - RNA, 63 nt, Human
agcuccccacauucucucuugauguugaaagcagucucucaaaagacuuuguuguuguguggu

SEQ ID NO: 365297 - RNA, 63 nt, Human
gagccauaaggaaauugcugucuugugcuuugugucucucauccagucucuggcucuugggau

SEQ ID NO: 365298 - RNA, 63 nt, Human
ugcuggcuuccagagauggaaacaaacccaggugucucucaacaagcuacuuuuuuacugggg

SEQ ID NO: 365299 - RNA, 63 nt, Human
uggccauuuuuaauggccagagcuugaagucuggucucucauuuuguuucagaaaugagugag

SEQ ID NO: 365300 - RNA, 63 nt, Human
guuuuucuuuuucuuuuuuuuuuuugagacggagucucucacugucgcccaggcuggagugca

SEQ ID NO: 365301 - RNA, 63 nt, Human
uuuaccgugcuaguucucuucuacaccuacucugucucucaagccauuuugccacucgcuucc

SEQ ID NO: 365302 - RNA, 63 nt, Human
cugccgugaccucgcgcaugcgagcaccuuccugucucucauuuucaccaucugacuggggcu

SEQ ID NO: 365303 - RNA, 63 nt, Human
uuuuuucauuuuuuuuaauggaaauaagauuuggucucucauuuuagguuaaaugauaacuag

SEQ ID NO: 365304 - RNA, 63 nt, Human
ugugauuuguuuucuucaauagucuuauuuucagucucucaaauacagccaacuuaaaguuuu

SEQ ID NO: 365305 - RNA, 63 nt, Human
gcuugugugcgugagugcagugugagugugugugucucucacugaaauaaaaggaaaacaaug

SEQ ID NO: 365306 - RNA, 63 nt, Human
guuuaugauggaaaaacggacauuuggcuaggugucucucacggcugcuccauccuagccccc

SEQ ID NO: 365307 - RNA, 63 nt, Human
uguggaaaaauuagguaauuauugcagauugaugucucucaaucccauguauugcgcuuaugu

SEQ ID NO: 365308 - RNA, 63 nt, Human
gcaguguagacagagacccuuugaaaugcauuugucucucaaauagacuaguaaacaccgacu

SEQ ID NO: 365309 - RNA, 63 nt, Human
uuaugugacuaauuaguuggcauauuguuaaaagucucucaaauuaggccagauucuaaaaca

SEQ ID NO: 365310 - RNA, 63 nt, Human
agguccaccuggaaaguauaguuggccaguugagucucucaaaugaggggcuacugggagugc

SEQ ID NO: 365311 - RNA, 63 nt, Human
guuuacguugaagaaacaguauacaagaacccugucucucaaaugaucagacaaagguguuuu

SEQ ID NO: 365312 - RNA, 63 nt, Human
uuuagagcuauauauuugccugccuacuggccugucucucacaauccauauauucaagaauga

SEQ ID NO: 365313 - RNA, 63 nt, Human
ucacucaaggagaaccaaucauauuuucucucugucucucaaaaaaaaauugaacugagacca

SEQ ID NO: 365314 - RNA, 63 nt, Human
uacuuagggauaaggaagaaugcuagcaucucugucucucaaacauagggaggauaagaagag

SEQ ID NO: 365315 - RNA, 63 nt, Human
acucagagggcagaguggcagccaggcccacaugucucucaaguaccuguccccucgcucugg

SEQ ID NO: 365316 - RNA, 63 nt, Human
cccuuaagagacaaguccuuacuauauugcccugucucucaagggaagacaucaagacuggac

SEQ ID NO: 365317 - RNA, 63 nt, Human
caacuccugggcucaagcgauccuccugccucagucucucaaagugcugggauuacaggugug

SEQ ID NO: 365318 - RNA, 63 nt, Human
cugucucacucugcuugaguaucccacugaucagucucucagugccugccuacugggcagcuc

SEQ ID NO: 365319 - RNA, 63 nt, Human
guuuguccuuaccaggauuuaaucuauagaauugucucucaacucugcuuuucuccaguucca

SEQ ID NO: 365320 - RNA, 63 nt, Human
uccgugaaaaacaaaagagccucugacauuacugucucucaguguugguucagauugaggcuu

SEQ ID NO: 365321 - RNA, 63 nt, Human
accaggcugaggacucgcccaggacauggacuggucucucagaccccugggccaccauguagg

SEQ ID NO: 365322 - RNA, 63 nt, Human
aauuucuuugagcucacgggccuuuugcugaaggucucucaggguguagugguguggcucucu

SEQ ID NO: 365323 - RNA, 63 nt, Human
ccugcccugcauuguauacuagauuucauuguugucucucaugcuucuugaguugcuucaugg

SEQ ID NO: 365324 - RNA, 63 nt, Human
aagagccaaggcccaccaaggaguuuuccacccgucucucauggucacagcgcuagucauuca

SEQ ID NO: 365325 - RNA, 63 nt, Human
acaaaguuagugaagcucaucacagcgaaccaggucucucaaaagaaaggacagauagaccac

SEQ ID NO: 365326 - RNA, 53 nt, Human
uucuccuccuagaagccuagcgugucucucaacacuggggcugcugcaacacc

SEQ ID NO: 365327 - RNA, 63 nt, Human
gagagaaguuagcgucccuggcccuggccgguggucucucauccuugugugcugcucugcuaa

SEQ ID NO: 365328 - RNA, 63 nt, Human
ucuuuaacugaaaugcacauggcaccaggaggugucucucauaguugguugcuagccuaaaac

SEQ ID NO: 365329 - RNA, 63 nt, Human
uguugacaaaucaggaaccuaacagauuauuuugucucucauuauuaauuugaaagagccucu

SEQ ID NO: 365330 - RNA, 63 nt, Human
cagggaaaggaaaaauuuucaccaacagaggcagucucucauagaguauaaagcagcugucac

SEQ ID NO: 365331 - RNA, 63 nt, Human
cugacauauggccgcagguccaguucagcccaggucucucaugguuaucuuccaacccacugu

SEQ ID NO: 365332 - RNA, 63 nt, Human
gaaucauaggguaaaauggaugaguagauagaagucucucauuuaaaaagugucuuuugcaau

SEQ ID NO: 365333 - RNA, 63 nt, Human
gggucuugcucgaauguucucacucacuaucuugucucucauacacauauccaucugcagacc

SEQ ID NO: 365334 - RNA, 63 nt, Human
aaauguuaagaaauggguuucuugccuuaaccagucucucaagugaugagacagugaaguaaa

SEQ ID NO: 365335 - RNA, 63 nt, Human
guuaaagggaggcuacgugugaauuuaucaucagucucucaauggaauguucauggucaaauu

SEQ ID NO: 365336 - RNA, 63 nt, Human
auugcuaauauggaauuuaagauaccauacacagucucucauggaccuaucucuauuguagaa

SEQ ID NO: 365337 - RNA, 63 nt, Human
ccgguagcuucagggaagaucauaguuaauaacgucucucaacaaaugauuacuucuuuguuu

SEQ ID NO: 365338 - RNA, 63 nt, Human
auuuuucuagaagauaucaugauuuuauguaaagucucucaauggguaaccauuaagaaaugu

SEQ ID NO: 365339 - RNA, 63 nt, Human
auaguuuaucauuuacugugugaucuucaguaagucucucaggcucucugagcuuguucaucc

SEQ ID NO: 365340 - RNA, 63 nt, Human
aagggacucuaggagucagaaacuaaaugcugagucucucaaaggcguagagagaauuucaga

SEQ ID NO: 365341 - RNA, 63 nt, Human
gagaaaucugcugcauguuguggguuaaagggagucucucaccagcccaggcccucaggagga

SEQ ID NO: 365342 - RNA, 63 nt, Human
aaggcuggucccuaaaacccacaccugccuuuggucucucagaggccuggcuugcccucuggg

SEQ ID NO: 365343 - RNA, 63 nt, Human
agagaaaugcagaugagaaaaguuagcacugaugucucucaggcuacaccucuuuugguuuua

SEQ ID NO: 365344 - RNA, 63 nt, Human
uaagucagcaagugagaaaaugugcaaucaggugucucucaccccgaauuguccuuccuccuu

SEQ ID NO: 365345 - RNA, 63 nt, Human
gugaucccuagcugugaccucuccccuggaacugucucucaugaaccucaagcugcaucuaga

SEQ ID NO: 365346 - RNA, 63 nt, Human
ucuaggcagugacagugcccagggcucuaaugugucucucacggcuuguaaaugugacacccc

SEQ ID NO: 365347 - RNA, 63 nt, Human
auauuuuauuccuuacacuuuuuuucugaauaagucucucauaaugagugcagugucagacug

SEQ ID NO: 365348 - RNA, 63 nt, Human
aaaaagccuaauauucugugguccccucacucagucucucauuugguaaacagaaagcuguuu

SEQ ID NO: 365349 - RNA, 63 nt, Human
cuacaauacauagaaguagugaggaaagugugagucucucaaaugaacaaauaagcaaacugu

SEQ ID NO: 365350 - RNA, 63 nt, Human
aauacuguucacacuuuauuaccaagcaucuuggucucucauucaacaaguacuguaucucac

SEQ ID NO: 365351 - RNA, 63 nt, Human
acaugucccccugugaguucugggcugauuugggucucucauaccucugggaaacagaccuuu

SEQ ID NO: 365352 - RNA, 63 nt, Human
aguguccucucaauaauuuaguaggggcuuauugucucucaaaacuaaccuaaaagaaaauga

SEQ ID NO: 365353 - RNA, 63 nt, Human
uuauauauuguuuuuaaucugcaggaaaauggugucucucaucauuugcucuguuaagggaac

SEQ ID NO: 365354 - RNA, 63 nt, Human
cuguguggcaagacgugcagugagggugcaagggucucucagaaguugcaucauuagccagua

SEQ ID NO: 365355 - RNA, 63 nt, Human
uugaacaucacgaucaaagcagcaggugcuguggucucucaaaauugauuuuuauuugacucu

SEQ ID NO: 365356 - RNA, 63 nt, Human
aaugucuauaaaccgaacugauguaaguaaacggucucucacuuguuuuauuuaaccucuaaa

SEQ ID NO: 365357 - RNA, 63 nt, Human
acuuauuuagcauagucgagugcucuaguuucugucucucaggcacucguaacuaaggaccac

SEQ ID NO: 365358 - RNA, 63 nt, Human
ccaggugugacacucuuccaccuagagcauuccgucucucauccucugccauguguaagucuu

SEQ ID NO: 365359 - RNA, 63 nt, Human
gggaaaugcauccccucagaggacugaggcauagucucucaucugcuauugaauaaagaccuu

SEQ ID NO: 365360 - RNA, 63 nt, Human
ggugacacuccugggcuccuccccaucccccgugucucucacugagggaaagaaaauccccaa

SEQ ID NO: 365361 - RNA, 63 nt, Human
uaggagcuccagccugaucuuggauugucaggcgucucucaacacugccagccaccugagaug

SEQ ID NO: 365362 - RNA, 63 nt, Human
guucauggggucccccuuggggccccacaccccgucucucaccaagaguuacugauuuugcuc

SEQ ID NO: 365363 - RNA, 63 nt, Human
gcucaagcgugugugcugggccggggagucccugucucucacagcaucuagcaguauuauuaa

SEQ ID NO: 365364 - RNA, 63 nt, Human
gcaaauggugaaaaaaguggucacuaugcuuuugucucucauaggcacugacuuuuuguuauu

SEQ ID NO: 365365 - RNA, 63 nt, Human
auggguauuuacauuugaacacuagaauuuuaggucucucaaauaauuaagaauagagccagu

SEQ ID NO: 365366 - RNA, 63 nt, Human
accugugccugucccuguuugcagcgaggccuugucucucauccaucgucggagggcaacauc

SEQ ID NO: 365367 - RNA, 63 nt, Human
agaaguucguaccuugcauuucucugaauucuagucucucauaagcacugcuuugcuggauga

SEQ ID NO: 365368 - RNA, 63 nt, Human
guaaaaguaaaauaacagaaauuauuacaaacggucucucagaccacauugcaaucacacuag

SEQ ID NO: 365369 - RNA, 63 nt, Human
aauggcuugagaagccgcagggggagcaugccugucucucagugauagaguaugggagggacc

SEQ ID NO: 365370 - RNA, 63 nt, Human
auucuuaagaggccuucaucugccaucacucgugucucucagugaaaggcugcuuaaacagaa

SEQ ID NO: 365371 - RNA, 63 nt, Human
ccucuuggcugagauagcagaggggcuccccgggucucucacuguugcaguggccuggccguu

SEQ ID NO: 365372 - RNA, 63 nt, Human
uguguguguguguguguguguuagggagugagggucucucaggccuccaggucucccagcccc

SEQ ID NO: 365373 - RNA, 63 nt, Human
ucgcacagugauucugggcccuuuaugcuugcugucucucagaauuguuuucuuaccuuuuaa

SEQ ID NO: 365374 - RNA, 63 nt, Human
cugcagucuucucuccugcaggcugcuugccuugucucucaugcggaagaggcauucgaguua

SEQ ID NO: 365375 - RNA, 63 nt, Human
cugcggccaagcaccacgcaggaggccacucuugucucucagcagcuguucccaggaggcagc

SEQ ID NO: 365376 - RNA, 63 nt, Human
acacaccccacugaaagauguaggcaggggcaggucucucaaccaggcauauuuuuaaaaguu

SEQ ID NO: 365377 - RNA, 63 nt, Human
ucauagucuuuaucaugagggauucuguauccugucucucaucuacacuugcuggccuuccug

SEQ ID NO: 365378 - RNA, 63 nt, Human
uucuaaucucacguuuuguuuuuaagagauggagucucucacucuguggcccaggcuggagug

SEQ ID NO: 365379 - RNA, 63 nt, Human
ugaagacuuuuaaguuuccuuccagcccagaaagucucucauucuaggccuccuggcccaggu

SEQ ID NO: 365380 - RNA, 63 nt, Human
ucccuuccucucaagaaaauauucuuucacccugucucucaaaccaccuagaacuuuagagga

SEQ ID NO: 365381 - RNA, 63 nt, Human
uagggugggcaugaaagcuugggaagcacugucgucucucagacaggcguccuaaagaccucu

SEQ ID NO: 365382 - RNA, 63 nt, Human
caguaugucauucuguucucaucuucugccacagucucucagauagcucaugaagacaaucac

SEQ ID NO: 365383 - RNA, 63 nt, Human
ccuuugaguguuugauuugaaaagccuagucuugucucucaagagcaucucggacccagaaca

SEQ ID NO: 365384 - RNA, 63 nt, Human
uucucucuccaacacuucauucucucuugcccugucucucaaauaaacccaaugcugcgugug

SEQ ID NO: 365385 - RNA, 63 nt, Human
ccagguuacuuaaguccgcucugaugaaacccagucucucaauaccuuccuauuucucaauag

SEQ ID NO: 365386 - RNA, 63 nt, Human
agugggcuuuaaaauuuccauuugcagaauuuggucucucaggcuguuugggagcucuuuuuu

SEQ ID NO: 365387 - RNA, 63 nt, Human
gcacaggcuguggcuugcacuccagccgcucuagucucucaggaauuugcuuguuacuuguac

SEQ ID NO: 365388 - RNA, 63 nt, Human
gucgcggugggcucagugggugcccugagcggggucucucagacugacgucaggccuuggugg

SEQ ID NO: 365389 - RNA, 63 nt, Human
ugcucucaccuugguuccuggggcauccauggggucucucacagacaggaccccugcaguucc

SEQ ID NO: 365390 - RNA, 63 nt, Human
gguggcccaaggugaugugcugcagggaagcaugucucucaugccaagaaccaagaucggacu

SEQ ID NO: 365391 - RNA, 63 nt, Human
uacauccucuugaagcacauccauuucuuuagcgucucucaguaaguuacaguacuuguuuga

SEQ ID NO: 365392 - RNA, 63 nt, Human
uggggggcaacuuugauuuuucucuguguuguagucucucauauuuacucaaggagggaccag

SEQ ID NO: 365393 - RNA, 63 nt, Human
uccuccacagcaccucguggcccguacucuugugucucucaagcuaagagcugcuugaaguug

SEQ ID NO: 365394 - RNA, 63 nt, Human
acuagacgaagccccagccaguggcagaacugggucucucagcccuggggaucagaaaggugg

SEQ ID NO: 365395 - RNA, 63 nt, Human
ccuaauccuacugauuugggcacugcuuguauagucucucaaguucacaggaaauguugauuu

SEQ ID NO: 365396 - RNA, 63 nt, Human
aaauuguaucucaaaggcagaaaaggccauuucgucucucauuuguuuuauccaugaggaaga

SEQ ID NO: 365397 - RNA, 63 nt, Human
ucggaguggcuuucgcuggagaggugcuuugcugucucucagacucagucacuguguucccuc

SEQ ID NO: 365398 - RNA, 63 nt, Human
ccauuaugcuucuaagcacauuucauugaccuugucucucauacuucaagaaaaggacaguac

SEQ ID NO: 365399 - RNA, 63 nt, Human
aaacuccugaccucagguacuccacccgccuuggucucucaaagugcugggauuacaggcaua

SEQ ID NO: 365400 - RNA, 63 nt, Human
auuguauccagaggauuugccaauguauguucagucucucaagauuuggcauuagucagacau

SEQ ID NO: 365401 - RNA, 63 nt, Human
uuauucacucaagaguucggaaaccacaguuuugucucucauccauacacugggguuuauuuu

SEQ ID NO: 365402 - RNA, 63 nt, Human
guaugaggguugaagacggaaaacaaucuaagggucucucauuuuuuuaauuuuguuuuguuc

SEQ ID NO: 365403 - RNA, 63 nt, Human
ggucugagaccuggccuccgugcuccucggucugucucucaccacacucccaccucccugcuu

SEQ ID NO: 365404 - RNA, 63 nt, Human
gccuucucucucccuuuucagggaccgcccccugucucucagggccaggccucucccuccucc

SEQ ID NO: 365405 - RNA, 63 nt, Human
uagauccagcccuggugguaguuccuuucugaggucucucagucccuugagacuuugggguag

SEQ ID NO: 365406 - RNA, 63 nt, Human
agucuagcucugacuuaggucaggggccuguuggucucucauuggacguuuuugggucucacu

SEQ ID NO: 365407 - RNA, 63 nt, Human
agucggggcuccagccaggagcgcuccaggggagucucucaggaaaaagaagcccagaucucu

SEQ ID NO: 365408 - RNA, 63 nt, Human
uccgccccgaucucacgucagugagggucuccugucucucaaguguguuuccuuuggcuguuc

SEQ ID NO: 365409 - RNA, 63 nt, Human
cuuugcaugccgucagucuggaguuuccuccgagucucucauggcaucuccagcuccugcccu

SEQ ID NO: 365410 - RNA, 63 nt, Human
ccagaucccugagagucuuucuggcugguuugagucucucaaaucauggauuaggaguaaaga

SEQ ID NO: 365411 - RNA, 63 nt, Human
ccccaaacacaacucaacuucccacaccaccaugucucucaccacaccuucugggccucauua

SEQ ID NO: 365412 - RNA, 63 nt, Human
ucaaggccagccugggcaacauaacaagauccugucucucaaaaaaaaaaaaaaaaaaaagaa

SEQ ID NO: 365413 - RNA, 63 nt, Human
acugguguuucuuuuuauaaccccuugaaacaagucucucaccugagccugucuaaacuuucg

SEQ ID NO: 365414 - RNA, 63 nt, Human
uggugagguuuggcucugcuaaacucaaaacuugucucucaagcuuguucuuuaaaauacaua

SEQ ID NO: 365415 - RNA, 63 nt, Human
acugcaagagccuugguguccaccuggccccaugucucucagaauucuucagguggaaaaaca

SEQ ID NO: 365416 - RNA, 63 nt, Human
ucccucccucccuccagaugcagaggcuggggagucucucaaugccagguugucacccaccug

SEQ ID NO: 365417 - RNA, 63 nt, Human
cucugccugcaugucccugugcagaggaaggcugucucucaaggguaaccccaaucugccugu

SEQ ID NO: 365418 - RNA, 63 nt, Human
ugaugaaaugcaaaaggaaggagagcucuggcugucucucagagaucuugcauuucugcucuc

SEQ ID NO: 365419 - RNA, 63 nt, Human
gaaagugcuuguuggguggguaagcaccaccuggucucucagcaaacacuccugagugguuga

SEQ ID NO: 365420 - RNA, 63 nt, Human
ccccauuggaaaugugggcccuccuaucucagggucucucagggguucccucucccgcugcuc

SEQ ID NO: 365421 - RNA, 63 nt, Human
ccuuuuccaguucaguauuuggaguucaacacugucucucaaucagaucaucuugaucuuuuu

SEQ ID NO: 365422 - RNA, 63 nt, Human
aacauguauuauuaagaccaccucccuuccuaugucucucagcagcacguuggggcacacuug

SEQ ID NO: 365423 - RNA, 63 nt, Human
cccacucucuucccccuccccccuccucccacugucucucaccucccccaccccccacucucu

SEQ ID NO: 365424 - RNA, 63 nt, Human
uugguggacacuguguacaccucuggauucauugucucucacagaugugacuguauaacuuuc

SEQ ID NO: 365425 - RNA, 63 nt, Human
guuuuuguuuaugcugucagcacauuugugugggucucucauugucccuuaacagugccgcau

SEQ ID NO: 365426 - RNA, 63 nt, Human
gaaugugaagugucauuggcaugucuggcaguagucucucauucacuccucaauaaacaacau

SEQ ID NO: 365427 - RNA, 63 nt, Human
gaagaaaaaaagcacagaauuguuucaacagaugucucucauuuucagcuagcauuucucucc

SEQ ID NO: 365428 - RNA, 63 nt, Human
cuggagcaacuuaaaugucuuuagaaaugacaagucucucaguuauccaguuagccguaaaca

SEQ ID NO: 365429 - RNA, 63 nt, Human
cacacagucuucacugugcugcagccagaugaagucucucagauggguggggagggucagcuc

SEQ ID NO: 365430 - RNA, 63 nt, Human
ggauuuaaaccuuucuaaauagauccugaaacugucucucacauuauauaguagauguuuguu

SEQ ID NO: 365431 - RNA, 63 nt, Human
aaaagagggauaagcagaccauguagguuuucugucucucaaaucuuagaguucauaaauuua

SEQ ID NO: 365432 - RNA, 63 nt, Human
caaauucauauaugauaaaagugaauguucuaagucucucaaacuagcguuuuauguaauaau

SEQ ID NO: 365433 - RNA, 63 nt, Human
acagaagcauagcccuuaacaaaucuucagcuugucucucaguauuucccaaucaugaaaauc

SEQ ID NO: 365434 - RNA, 63 nt, Human
ugccagcuccucaguguuacauuccucgccagggucucucagugggucuucgacagagagcuu

SEQ ID NO: 365435 - RNA, 63 nt, Human
ggcaucauuaaguagaccagguaauuacugcuugucucucaaggcugcugucuuuaucagcac

SEQ ID NO: 365436 - RNA, 63 nt, Human
ggucuggcuaacggugagggcugacucugaacugucucucagucuccagaaaguguucaagcc

SEQ ID NO: 365437 - RNA, 63 nt, Human
ugucuuguuccugacucugacaagaaagcauaagucucucaccauuuagugugauuuuagcug

SEQ ID NO: 365438 - RNA, 63 nt, Human
gcuucagcuucugaggaucugccgggugcugaggucucucaaacuccuugcacaauuccguca

SEQ ID NO: 365439 - RNA, 63 nt, Human
aaucccugacagcuguguccguaucaagcaucagucucucaaacaguugccccagccugacag

SEQ ID NO: 365440 - RNA, 63 nt, Human
cuuuuuuuuuuuuuuuuuuuuaaaugguggaaugucucucagcacaguugcggcuuccucaaa

SEQ ID NO: 365441 - RNA, 63 nt, Human
cacuugagacaaaccugccuuugcagggaaagugucucucacgggcauuggugugggcgugcc

SEQ ID NO: 365442 - RNA, 63 nt, Human
ggcuuguaaaggcccacgccacacucggcaggggucucucauguguguccaucugcguguaug

SEQ ID NO: 365443 - RNA, 63 nt, Human
ccagauuguaauuuugccaaguguuagauuugagucucucauguggaugcauuagucaggugg

SEQ ID NO: 365444 - RNA, 63 nt, Human
gauucagcaaggcuuccucuccugcucaccccugucucucaccuccaccaaccccacucacuu

SEQ ID NO: 365445 - RNA, 63 nt, Human
cuggugccauauugggcagugauggugucuugugucucucagggucugaguucuguggaccca

SEQ ID NO: 365446 - RNA, 63 nt, Human
ucgguggugucauccuacauguagcauaauagagucucucagccuuugcuuacugguguuucc

SEQ ID NO: 365447 - RNA, 63 nt, Human
ucuaacagccucugcuguuguauaaaaagugcugucucucaguaguauagcgguuacuucaug

SEQ ID NO: 365448 - RNA, 63 nt, Human
cacugcuguagacauuugcuaugagcuggggaugucucucaugaccaaaugcuuuuccucaaa

SEQ ID NO: 365449 - RNA, 63 nt, Human
ccuggaugggaucuguauuagacuugagugcaggucucucagcacugacccaaggaguucugu

SEQ ID NO: 365450 - RNA, 63 nt, Human
aguggccugaagucccucgcuuuuggggggggggucucucacccccaggccacauagggccag

SEQ ID NO: 365451 - RNA, 63 nt, Human
gaaauaaagucccuuuccuugcuccaacuccuugucucucaacguauuggcuaugacgcagca

SEQ ID NO: 365452 - RNA, 63 nt, Human
uccuacuuucuccccaggaccuggaggcaggcugucucucaagguggucucuucugcugcuag

SEQ ID NO: 365453 - RNA, 63 nt, Human
aaagucacacauucaacaaggugugccgugugggucucucagccuugccccuccugcuccucu

SEQ ID NO: 365454 - RNA, 63 nt, Human
gguaaucuauucaaauuucuucacagauuucaagucucucaaacaucaagacaacuucagcag

SEQ ID NO: 365455 - RNA, 63 nt, Human
cauguaauuugcauagagaagguccucugguuagucucucaaauugaggcuguuuagggaaau

SEQ ID NO: 365456 - RNA, 63 nt, Human
acacagcgaaucgagggcuuuggccaaggccaggucucucaaacuuguccgccaaguaaacca

SEQ ID NO: 365457 - RNA, 51 nt, Human
gaggggguccuaggcgauaaugucucucaagauuucaaagucauaugagau

SEQ ID NO: 365458 - RNA, 63 nt, Human
caugaaccuccagcuuuagcaacucauauaucagucucucacauggccacaauucuagacaaa

SEQ ID NO: 365459 - RNA, 63 nt, Human
cuaccauaagucagguuguuuguucccuaaccugucucucauagcaaagucacuuuuauaaca

SEQ ID NO: 365460 - RNA, 60 nt, Human
ugacccaacacagcaguuagugcaaguacagucucucaaggagaauugauuuuguggcac

SEQ ID NO: 365461 - RNA, 63 nt, Human
ggaacccacgaggauggccuggaacccaugucagucucucaccaccuccagcuucgaugaugu

SEQ ID NO: 365462 - RNA, 63 nt, Human
gcaaauguaaaggaacaaaaauuauaacaaacugucucucagaccacagugcaaucaaacuag

SEQ ID NO: 365463 - RNA, 63 nt, Human
ucuguuucucauucucuuucauguuccgucugugucucucaauuaaccacucgucaacugcug

SEQ ID NO: 365464 - RNA, 63 nt, Human
ugguucugagggccagggcaaaugaaggcgcaugucucucagaacucagcgucccaagacgcu

SEQ ID NO: 365465 - RNA, 63 nt, Human
gggagugauguaucugggugguuguggcccagagucucucaugagguugcaguuaagacauca

SEQ ID NO: 365466 - RNA, 63 nt, Human
agggcugcuguggccacagcccugccugggccugucucucaagggcacccagcuugcucggcc

SEQ ID NO: 365467 - RNA, 63 nt, Human
aucucuugaaccuuaggggugaccugggcccaagucucucaucagcccccaauccccugggua

SEQ ID NO: 365468 - RNA, 63 nt, Human
agacuugcaccccccucauuaucuaccaugacugucucucagccucacgggcccucagcacuu

SEQ ID NO: 365469 - RNA, 63 nt, Human
gauccacauuuuucccccugcauuauggaaaaugucucucagcauugcuuuauuacaaaguaa

SEQ ID NO: 365470 - RNA, 63 nt, Human
uguccugcucacugcagugcugauguauuucaagucucucacccucaucacuaggagauuccu

SEQ ID NO: 365471 - RNA, 63 nt, Human
cuagaagcuucaaagaaucuugacaggaaagaagucucucaaaugcuguguuuuagacuuggu

SEQ ID NO: 365472 - RNA, 63 nt, Human
ccgaccuaccaccccacuggcugguuccagaacgucucucaccuagaccuugccuccccuccu

SEQ ID NO: 365473 - RNA, 63 nt, Human
aaccugaaugucccaacccagacaauggcccaggucucucaacuucaucaguguggcuucuau

SEQ ID NO: 365474 - RNA, 63 nt, Human
caucucccacugcggucuaacaaaucuccuuucgucucucagaacgggucuugcaggcaguuu

SEQ ID NO: 365475 - RNA, 63 nt, Human
auauaaucccuuuacaucuguguucuaugcaaagucucucauuucuuucaagacagccuaaug

SEQ ID NO: 365476 - RNA, 63 nt, Human
guagccuaagcugauuuucugcugguuacacgugucucucacaccacauuuccucaaagcuaa

SEQ ID NO: 365477 - RNA, 63 nt, Human
gaauguaucuggcuucauauuuucaagucacaugucucucagaccccuggauucagaacccaa

SEQ ID NO: 365478 - RNA, 63 nt, Human
cuggaggauccaccccggaacagacagaauggugucucucaggauggugcucugagagagggc

SEQ ID NO: 365479 - RNA, 63 nt, Human
agggcgaggccccugggacggacagggcuggcugucucucagccgcggcagcagggagcgggc

SEQ ID NO: 365480 - RNA, 63 nt, Human
ccuucucuucuccccccaacacaaucuuuccuugucucucauucucuuucuuuuucugucucu

SEQ ID NO: 365481 - RNA, 63 nt, Human
uuucguugugcuccuaaugggucgcugaggcuggucucucagugaugaagccccaggcgugga

SEQ ID NO: 365482 - RNA, 63 nt, Human
gacgcuaaguugcugaucguggcggucaguggugucucucaccucaaauuaggaaaagcuuuu

SEQ ID NO: 365483 - RNA, 63 nt, Human
uuguuccagggggcuccagcaaaccccuucguggucucucaaaggacugaucacuguccuugc

SEQ ID NO: 365484 - RNA, 63 nt, Human
caaccuccugacccauucauaaaugcugagaaugucucucaugggaacacuguuaaugaccca

SEQ ID NO: 365485 - RNA, 63 nt, Human
ugccuucaggcugaugccaaucuagccucuccugucucucaucagccacccugacaggugggc

SEQ ID NO: 365486 - RNA, 63 nt, Human
acugggggaauucuccggccgugggguccccgcgucucucaucuccauucggcccccaggccg

SEQ ID NO: 365487 - RNA, 63 nt, Human
uccuuccaagaauggaauccuucccuggugauggucucucacccugucuuaccagcauccacu

SEQ ID NO: 365488 - RNA, 63 nt, Human
cuggguggggucuggccguuggcccuggcuaaugucucucagucauuccccuggggcucaagc

SEQ ID NO: 365489 - RNA, 63 nt, Human
aggaaagaaggaaauaaaacaucacauuuuggugucucucaggcuuucccccccaacuauggu

SEQ ID NO: 365490 - RNA, 63 nt, Human
ccaccauaccuuagagacuuugauacuaccagggucucucagggauggagggaagaccugaaa

SEQ ID NO: 365491 - RNA, 63 nt, Human
cucuacauuaaaaaggagaaagagaaauaaccugucucucauuccuaaguugccucauuaauu

SEQ ID NO: 365492 - RNA, 63 nt, Human
acccucccucuaugaaaauagccaugcagacaagucucucaucugaagaacaaauuagauuua

SEQ ID NO: 365493 - RNA, 63 nt, Human
uuauauuacauguguaucuaucuauugucagucgucucucaguucuugagguauauuauuuua

SEQ ID NO: 365494 - RNA, 63 nt, Human
ccuaggcccagguguuccuggcagccaaaucgagucucucauuuucucuuguggaccaguuag

SEQ ID NO: 365495 - RNA, 63 nt, Human
uuaauuacaaaauuugaucacgaucauauuguagucucucaaagugcucuagaaauugucagu

SEQ ID NO: 365496 - RNA, 63 nt, Human
gagacucgaguccccaugauucccuccucgucagucucucaaagaccccaugguccauccccu

SEQ ID NO: 365497 - RNA, 63 nt, Human
cucauuuaauuuggcauaagacuaacagaugaagucucucauuugcuugaagauauuuuacaa

SEQ ID NO: 365498 - RNA, 63 nt, Human
aacuaugagaagagaaguggcagcaauaaggcagucucucaaaagucauacugccagagucuc

SEQ ID NO: 365499 - RNA, 63 nt, Human
gcagccauaaagaacucuccuucugaauggcaagucucucagacucuuggucuaauggcuguu

SEQ ID NO: 365500 - RNA, 63 nt, Human
auaaagacaggauugugcaaucuaaguugaucagucucucagugggguucugugugaguucau

SEQ ID NO: 365501 - RNA, 63 nt, Human
uuuaucccugaccucucugagaagugggguguggucucucagcuguucugcccucauacccuu

SEQ ID NO: 365502 - RNA, 64 nt, Human; identical to SEQ ID NO: 272999

SEQ ID NO: 365503 - RNA, 64 nt, Human; identical to SEQ ID NO: 273000

SEQ ID NO: 365504 - RNA, 64 nt, Human; identical to SEQ ID NO: 273001

SEQ ID NO: 365505 - RNA, 64 nt, Human; identical to SEQ ID NO: 273002

SEQ ID NO: 365506 - RNA, 64 nt, Human; identical to SEQ ID NO: 273003

SEQ ID NO: 365507 - RNA, 64 nt, Human; identical to SEQ ID NO: 273004

SEQ ID NO: 365508 - RNA, 64 nt, Human; identical to SEQ ID NO: 273005

SEQ ID NO: 365509 - RNA, 64 nt, Human; identical to SEQ ID NO: 273006

SEQ ID NO: 365510 - RNA, 64 nt, Human; identical to SEQ ID NO: 273007

SEQ ID NO: 365511 - RNA, 64 nt, Human; identical to SEQ ID NO: 273008

SEQ ID NO: 365512 - RNA, 64 nt, Human; identical to SEQ ID NO: 273009

SEQ ID NO: 365513 - RNA, 64 nt, Human; identical to SEQ ID NO: 273010

SEQ ID NO: 365514 - RNA, 64 nt, Human; identical to SEQ ID NO: 273011

SEQ ID NO: 365515 - RNA, 64 nt, Human
acuacauucuuuaccccuuguuuuaauuugaaccccaccauauggauuuuuuuccuuaagaaaa

SEQ ID NO: 365516 - RNA, 64 nt, Human
ugugaaagucagaugcccagagggcccaggcaggccaccauauucagugcuguggccugggcaa

SEQ ID NO: 365517 - RNA, 64 nt, Human
aacaccccuuugcuuuuucuaugggaccuccaggccaccauauuuagaacuaguuaccuuauua

SEQ ID NO: 365518 - RNA, 64 nt, Human
gaccccacuggaccaaaaggggcagcacuggugcccaccauacacacaggugucucaugugacu

SEQ ID NO: 365519 - RNA, 64 nt, Human
uaaggaauguggauguuugguuucuccaaaguucccaccauaaaagauccaaagcaugagagga

SEQ ID NO: 365520 - RNA, 64 nt, Human
gcauugucacccuagaccccucuuccucucucccccaccauagugugcaauaaagugucuguuc

SEQ ID NO: 365521 - RNA, 64 nt, Human
ugguaacugcuuugcuucuugaguagagccaccaccaccauagcccagccagaugagugcucug

SEQ ID NO: 365522 - RNA, 64 nt, Human
auaccugguugaaauacaacacuauacauacacaccaccauauauacuagcuguuaauccuaug

SEQ ID NO: 365523 - RNA, 64 nt, Human
auuuaaaaaggccccagagagcuaacucacccuuccaccauaugaggacguggcaagaagauga

SEQ ID NO: 365524 - RNA, 64 nt, Human
acuacauaaaaauguuuauaggacaagaaaaaccccaccauaacccaaggcaaacaauguauug

SEQ ID NO: 365525 - RNA, 64 nt, Human
ggaaugaugaucacugugcuauaauguacugaaaccaccauauuacagaaauauuuacuacaua

SEQ ID NO: 365526 - RNA, 64 nt, Human
cucacucugucaccuaggguagagugcaguggugccaccauagcuccuucgacuauugggcuua

SEQ ID NO: 365527 - RNA, 64 nt, Human
agccucccaaagcagcugggacuacaggcaugcaccaccauacccagcccuagaaagcucuuuc

SEQ ID NO: 365528 - RNA, 64 nt, Human
cagcgcugugagucgugaagacacgggagaaaauccaccauaauaaaacugacauucaauuuuc

SEQ ID NO: 365529 - RNA, 64 nt, Human
cagucucccaacuaagugggacuacaggcacgugccaccauacucagcuuuuuuuuguuuguuu

SEQ ID NO: 365530 - RNA, 64 nt, Human
cagccucccauguagcaggaaccacaggcaggcaccaccauacccagcuaauuuuuguauuuuu

SEQ ID NO: 365531 - RNA, 64 nt, Human
uggcccuguguccaguggcccacaggacacgccuccaccauaugcucauccuuccugccugaaa

SEQ ID NO: 365532 - RNA, 64 nt, Human
auaacauuuuuggguuaaaaaauguaauuuaaagccaccauagaaaguauuuucugauuuacug

SEQ ID NO: 365533 - RNA, 64 nt, Human
uaccuuugaaauauaacuagaaaagaaugacuugccaccauauccacuaggugucacuaccucu

SEQ ID NO: 365534 - RNA, 64 nt, Human
cagccuccugaguagcugggauuacaggcacgcaccaccauaccuggcuaauuuuuguauuuug

SEQ ID NO: 365535 - RNA, 64 nt, Human
cagccucccuaguagcugggauuacaggcacacaccaccauaccuggcuaauuuuuguauuuuu

SEQ ID NO: 365536 - RNA, 64 nt, Human
ugcccguccacucuucaacaggaggaacagcaugccaccauaguaacacacauuagagaaagga

SEQ ID NO: 365537 - RNA, 64 nt, Human
ugcaagaaccaggacacacaauucgccaaucaucccaccauauaaccuucgauugugcuucuca

SEQ ID NO: 365538 - RNA, 64 nt, Human
uaauugccccagggccugauucaggacugacucuccaccauaaaacuggaagcugcuuccccug

SEQ ID NO: 365539 - RNA, 64 nt, Human
ugguguuggaggggcaggccuuuuugagccaaucccaccauaaugugaauaugccagugacugc

SEQ ID NO: 365540 - RNA, 64 nt, Human
guagcaagacagcagcugcuaugcacacuggaguccaccauaccaaagcacgaaccagacuguu

SEQ ID NO: 365541 - RNA, 64 nt, Human
auuaggucauacuggcuagaaugcagcuuuucucccaccauaacaugaaaacaguguaagaaca

SEQ ID NO: 365542 - RNA, 64 nt, Human
auauuauagugccccuuuaaggauuucucucuugccaccauaccuuuuguacuuuccccuauac

SEQ ID NO: 365543 - RNA, 50 nt, Human
agcucuccagagacugguagccaccauaggacuuuauuuucaugauaucu

SEQ ID NO: 365544 - RNA, 64 nt, Human
gggggaaaagccaauagaaauuuccuuagcuuccccaccauauguauuuucuaggauuugagag

SEQ ID NO: 365545 - RNA, 64 nt, Human
aguggccugggagaggcagugagccuucucuccaccaccauagacagguguuaaugcaucuaug

SEQ ID NO: 365546 - RNA, 64 nt, Human
acaucuugggcaacuaguuaccaaaugaauugugccaccauaacugauuuuaauuuugcauuau

SEQ ID NO: 365547 - RNA, 64 nt, Human
ccaguugccucccuagcuuguguguggccugccuccaccauagcagggacuagggagggaggca

SEQ ID NO: 365548 - RNA, 64 nt, Human
auuauucagaccuuaguacagcaagacacucuggccaccauaaaaaacgcagaaaagaaaaaaa

SEQ ID NO: 365549 - RNA, 64 nt, Human
ugcccagaacuuuggucaccugcuuguucacaggccaccauaucuuacuucacugaagucauau

SEQ ID NO: 365550 - RNA, 63 nt, Human
ggagcagaauugaauauuaagcauaaaguguugccaccauaccuccuuccccgagugacucug

SEQ ID NO: 365551 - RNA, 64 nt, Human
ugcaacuggcuaaaggauaguaccacccucacccccaccauaggcaggcuggaucguggacuau

SEQ ID NO: 365552 - RNA, 64 nt, Human
auggucuuagccucagucucugucucuaaauauuccaccauaaaacagcugaguuauuuaugaa

SEQ ID NO: 365553 - RNA, 64 nt, Human
cagcuguuccagccggugccaaccugugaacuucccaccauaucccagaaucugcuauucccca

SEQ ID NO: 365554 - RNA, 64 nt, Human
gucuaauauauuguuucaaaagauacauuuuuacccaccauaaauguuacaauaucugaauaug

SEQ ID NO: 365555 - RNA, 64 nt, Human
cauaccauggagauauuacaggaucaguuccagaccaccauaauaaaguggauaucgcaauaaa

SEQ ID NO: 365556 - RNA, 64 nt, Human
aaaagagaggagaagacucggaauucccugagucccaccauagcgcccaagcucagcuuagaag

SEQ ID NO: 365557 - RNA, 64 nt, Human
uauccuuaccuuuuaguuucagcaguccucaccaccaccauauccccagugcugggauggcaca

SEQ ID NO: 365558 - RNA, 64 nt, Human
uugcuguaacaagcacacuauuuauaugcccugaccaccauaggaugcuagucuuugugaccga

SEQ ID NO: 365559 - RNA, 64 nt, Human
caccacgccuggccagaguuuuuuauuuuuaucaccaccauagauguuacaguuggcugugguc

SEQ ID NO: 365560 - RNA, 64 nt, Human
cuugaagcuaugagcauuuaaaaacuguuuacagccaccauagggauucaaaagaauuuggaau

SEQ ID NO: 365561 - RNA, 64 nt, Human
uuccuuauucaaucagauuuuccaaaguaccuuuccaccauaagaaaugaauuuucuacuucua

SEQ ID NO: 365562 - RNA, 64 nt, Human
aaggaagugaugucccauuauuauccacccugagccaccauaauaugcuguuuacauuuauuuu

SEQ ID NO: 365563 - RNA, 64 nt, Human
uugcuaaugauguguuuuuauauuauacauuuucccaccauaaacucuguuugcuuauuccaca

SEQ ID NO: 365564 - RNA, 64 nt, Human
cagccucccaaguaacuaagacuacaggcaugcaccaccauacccaacuaauuuuauuuuuuau

SEQ ID NO: 365565 - RNA, 64 nt, Human
ugacaauacaacguuuuuacaagguuguuuucuaccaccauauuuuaaagauauuuuuaugacc

SEQ ID NO: 365566 - RNA, 64 nt, Human
ugggagggaccaagguuguaaggauggcuaagucccaccauaagagcuaaaggguccugggaga

SEQ ID NO: 365567 - RNA, 64 nt, Human
ugggagggaccaagguuguaaggguggcuaagucccaccauaacagcuaaggggaccugggaga

SEQ ID NO: 365568 - RNA, 64 nt, Human
ccaccucccaaagugcugggauuacaggcgugagccaccauaccuggcgcaugcauauuuuuua

SEQ ID NO: 365569 - RNA, 64 nt, Human
gcguuuaccacugcugucaagccacagcccuuggccaccauacgggccauccucagugaggcag

SEQ ID NO: 365570 - RNA, 64 nt, Human
gugcauagcagcugaaugccagcccuguaaaagaccaccauaaagagagcuccauguucuuuug

SEQ ID NO: 365571 - RNA, 64 nt, Human
cuucucccauuccagaucaucagcacacccacacccaccauaggucucucuccuccggucuucc

SEQ ID NO: 365572 - RNA, 64 nt, Human
accuuggcuuuagcccucuggaaucagagcuuacccaccauaguauauuuugauauuagguggu

SEQ ID NO: 365573 - RNA, 64 nt, Human
ucccucaaagaaauccuccaaucaaaaucaccucccaccauaaucccugucuucuuuccauccc

SEQ ID NO: 365574 - RNA, 64 nt, Human
guguacucaaaauaucauaauuguacaguuuaugccaccauaauuugaggccuauagauuuagc

SEQ ID NO: 365575 - RNA, 64 nt, Human
acauuuugcuguucucuuuuuuguuauuguuaugccaccauaccauuuuguuaaaauguuuucu

SEQ ID NO: 365576 - RNA, 64 nt, Human
uacucuauauaagcagucuugcaauaacuaaucaccaccauagaagaaagaaacagacugcaag

SEQ ID NO: 365577 - RNA, 64 nt, Human
uaauaaaauggaaaaauaugcuucuacauauuuaccaccauaggcguuuuguucauaugagccu

SEQ ID NO: 365578 - RNA, 64 nt, Human
uaaaaaaagcaggccaucugcuuaacccuuggcuccaccauaaggcacugggacucggauuucu

SEQ ID NO: 365579 - RNA, 64 nt, Human
gucuuaauguuacuuuugaaaaucugcugagcggccaccauaugcaggcugagagcugggcaca

SEQ ID NO: 365580 - RNA, 64 nt, Human
agucuaggaaaaaauaauguuaaaagugaauaugccaccauaauuacuuaauuauguuaguaua

SEQ ID NO: 365581 - RNA, 64 nt, Human
cagccuccagaguagcuaggauuacagauacgugccaccauacccggcuaauuuuuauauuuuu

SEQ ID NO: 365582 - RNA, 64 nt, Human
uucaaagugauuauugauauaguuggauuaauauccaccauauuuguuauugucuucuauuugu

SEQ ID NO: 365583 - RNA, 64 nt, Human
gaacacugaucccaaauuuguccauagcugaaguccaccauaaaguggauuuacuuuuuuucuu

SEQ ID NO: 365584 - RNA, 64 nt, Human
uauauauuuaaaucaugcuuuguuaauauuugucccaccauaaugccuccuucagaacauaagu

SEQ ID NO: 365585 - RNA, 64 nt, Human
auuuaaaccaauuuuuaaaacaaaacugcggacaccaccauaaaaauggaaucaaaagaaaguu

SEQ ID NO: 365586 - RNA, 64 nt, Human
ucaacccacaaguagcuacgacugcaagcaccugccaccauaaagggcugcauuuugccaccau

SEQ ID NO: 365587 - RNA, 64 nt, Human
gcaagcaccugccaccauaaagggcugcauuuugccaccauaaagggcugcauuuuuuuaaaaa

SEQ ID NO: 365588 - RNA, 64 nt, Human
caagcagcugggacuacaccaccacagguaugcaccaccauaccuggcugauuuuuaaaauuuu

SEQ ID NO: 365589 - RNA, 64 nt, Human
uguuucuccaugggcucuucuggacugcacacuuccaccauagcuugcuggguugaucuagaug

SEQ ID NO: 365590 - RNA, 64 nt, Human
ugauuacuucaaacacuggcaccuugggucucacccaccauaggaaacaagacaacauucaauu

SEQ ID NO: 365591 - RNA, 64 nt, Human
uaagcuaccugccuucaaaauaguuuagggaccaccaccauauuuuauuuuguuuuuauuuuug

SEQ ID NO: 365592 - RNA, 64 nt, Human
aaaaaaaaaaagagaccaaaaauaacuuuaggaaccaccauauuauaucacucccaauagcacu

SEQ ID NO: 365593 - RNA, 64 nt, Human
ucuguuucccaaugcagaaaagaagggguaggguccaccauacugguaauugggguacucugua

SEQ ID NO: 365594 - RNA, 64 nt, Human
gaucaaagaaauugauaccuguuagcauucacugccaccauauuuuaaggagaaagaacucuau

SEQ ID NO: 365595 - RNA, 64 nt, Human
aaugaaacggacucugcuuugacaucgccccuucccaccauacugcucauaauaacauuuuagg

SEQ ID NO: 365596 - RNA, 64 nt, Human
ccggacuguguaaguaaaaguacaaacauuauuuccaccauaaaguauguauugaaaucaaguu

SEQ ID NO: 365597 - RNA, 64 nt, Human
aaagccugaagaaguggggcuggauacccugcccccaccauaucccuaccaucccuucucaguc

SEQ ID NO: 365598 - RNA, 64 nt, Human
uguuauaccauccuuguaaguaaguuuguaauuuccaccauaaauuaugguaaauauaaaacuc

SEQ ID NO: 365599 - RNA, 64 nt, Human
ccccuacuuuacccucccacccucacuuuuaaauccaccauacugaaugccacacuauggaaug

SEQ ID NO: 365600 - RNA, 64 nt, Human
aaggagacaagauguggaagaauugacauguaucccaccauaaaaugguagaagaugaguuuuc

SEQ ID NO: 365601 - RNA, 64 nt, Human
ccccucugcucaucccuccucauucagacauccuccaccauaccaguguuuagaagcaaaacau

SEQ ID NO: 365602 - RNA, 64 nt, Human
uuuuuuaauaaaagcucuuucaucuauaguuuggccaccauacaguggccucaaagcaaccaug

SEQ ID NO: 365603 - RNA, 64 nt, Human
gccuggacuuggagagaugggaggcagacccccaccaccauacaugcugucuguggccccucag

SEQ ID NO: 365604 - RNA, 64 nt, Human
gguucgggccagcaggaggugccggcuggagucuccaccauagacucaguggccuggccucccc

SEQ ID NO: 365605 - RNA, 64 nt, Human
gcaugguccauccagaguguucccugagcccccuccaccauacuggaaccccucuucaguguag

SEQ ID NO: 365606 - RNA, 64 nt, Human
ggaaaccuggcuccaaccaaccccuccccugccuccaccauauccacuaccaggcacccuuuag

SEQ ID NO: 365607 - RNA, 64 nt, Human
uuagggguguggaggaggggaagggaggaaugggccaccauauuuggccuuacaggaauuaagg

SEQ ID NO: 365608 - RNA, 64 nt, Human
ugugcaucacucugcuagguugggggcccccgacccaccauaccuacgccuagggagcccgucc

SEQ ID NO: 365609 - RNA, 64 nt, Human
acugaaaggcaggaguguuagcaucucgcuuuauccaccauaacguaaagaacugcggugugau

SEQ ID NO: 365610 - RNA, 64 nt, Human
ugcuucuucuuccaaaugcaguucauugcagacaccaccauauugcuaucuaauggggaaaugu

SEQ ID NO: 365611 - RNA, 64 nt, Human
gcauggguugaacuuccaaaauauaaaaauagagccaccauaucaacacuuagcccuacccauu

SEQ ID NO: 365612 - RNA, 64 nt, Human
uuccccucuggccuuuagauggccucagccccagccaccauauaccccugcaguuugcacuuua

SEQ ID NO: 365613 - RNA, 64 nt, Human
ggaucauuucaagauauaagaaauuuuggaaauuccaccauaaauaaaauuuuuuacuacaaga

SEQ ID NO: 365614 - RNA, 64 nt, Human
ucuagggugagaguucccaauuuggauagaacggccaccauauugguuacugaaucucucuccc

SEQ ID NO: 365615 - RNA, 64 nt, Human
guguggggcaggcaccccacuggcugcagcuagcccaccauaggcacagcacaucccaccacuc

SEQ ID NO: 365616 - RNA, 64 nt, Human
uuccuucuuuuggaaaaaaccuacaugcuacaagccaccauaugcacagacuauacagugaguu

SEQ ID NO: 365617 - RNA, 64 nt, Human
ugagugaggcgugugugugugucuuuccuaggacccaccauacccuguguauguaugcauguuu

SEQ ID NO: 365618 - RNA, 64 nt, Human
acucggggagccuucucuguuucuggggccucccccaccauagcucugauucccaccccacaua

SEQ ID NO: 365619 - RNA, 64 nt, Human
gcaucuccggcacuugggugggaccaaggagaugccaccauagaccuuucccucgccuucuucc

SEQ ID NO: 365620 - RNA, 64 nt, Human
uccccuaaugccuaucugaccaaacuggauagaaccaccauagugaagugugaggcggcccuga

SEQ ID NO: 365621 - RNA, 64 nt, Human
gcuaauuuuuguauuuuuaguagagacggggguuccaccauauuggucaggcuuaucuugaacu

SEQ ID NO: 365622 - RNA, 64 nt, Human
ggaccagguacaguagcugaaacccaauucagauccaccauaggauucuuugacuacauaccuc

SEQ ID NO: 365623 - RNA, 64 nt, Human
uuuggcuuuuuacuuguuuuuuuggauagccaucccaccauaggauguguacauagauacugaa

SEQ ID NO: 365624 - RNA, 64 nt, Human
uaauguucaauauuaaaaggauaauucacauuugccaccauaauguucuuuuuuauguaaaaag

SEQ ID NO: 365625 - RNA, 64 nt, Human
auucauguuuagccaguguuuuccagccuuguacccaccauacagaucuguuuauucuguuuca

SEQ ID NO: 365626 - RNA, 64 nt, Human
agauagcuauuaagauacuuagauuagaccuaacccaccauagucaauccaagacuagacuacu

SEQ ID NO: 365627 - RNA, 64 nt, Human
cagccucccaaguagcugggaauacaggugucugccaccauacccaguuucauuuuuguuuuuu

SEQ ID NO: 365628 - RNA, 64 nt, Human
uuuguaucuaauugauacauuuuauguuaauuuaccaccauacauuuuauuaaucaaaauugua

SEQ ID NO: 365629 - RNA, 64 nt, Human
cagccucccaaguagcugggauuacagacgugugccaccauaccuggguaauuuuugcauuuuu

SEQ ID NO: 365630 - RNA, 64 nt, Human
uaaauuuggaaaggagcuaguagcuuuaaggccaccaccauauuuuacuuuuuuaggauuuuuc

SEQ ID NO: 365631 - RNA, 64 nt, Human
ugccagaugucaacauuaagcugcaacauccuaaccaccauaagccggaggugguuacagcuua

SEQ ID NO: 365632 - RNA, 64 nt, Human
auaccuuugccuuggaaguugcauggcaucaccuccaccauacuccaucaguuagagcugacac

SEQ ID NO: 365633 - RNA, 64 nt, Human
cuccguuguugcgugagaacccgugugccccuucccaccauauccacccucgcuccaucuuuga

SEQ ID NO: 365634 - RNA, 64 nt, Human
ugacuugggggaaaaauuagugaugaaacagccaccaccauauugccauuaguggaaaaaaaga

SEQ ID NO: 365635 - RNA, 64 nt, Human
ggguucuacagccuugucccccucccccucaaccccaccauaugaauuguacagaauauuucua

SEQ ID NO: 365636 - RNA, 64 nt, Human
cccaguggaaaaaucgguugugccucccugcuucccaccauagcugccugaaaacaugacgcuc

SEQ ID NO: 365637 - RNA, 64 nt, Human
aaaugauugccacauugcaagcuauuauuuucucccaccauauuuuuuaauuaaaaaaaagucu

SEQ ID NO: 365638 - RNA, 64 nt, Human
gacucugcagggcagccauccuggaugauggaagccaccauauugacuugggguauaggcccaa

SEQ ID NO: 365639 - RNA, 64 nt, Human
uccugggacaaccagacucuguaacucacccccaccaccauacacacacacaaaaacagaaaca

SEQ ID NO: 365640 - RNA, 64 nt, Human
gagccugggguuggauagggccauggcuggucccccaccauaccuccccuccacaucacugaca

SEQ ID NO: 365641 - RNA, 64 nt, Human
uagaccaaccagugggaaacugccccagcuucucccaccauagggggccggacccccaucacca

SEQ ID NO: 365642 - RNA, 64 nt, Human
uuuccaggagagaaugggagacaauccuagacuuccaccauaaugcaguuaccuguaggcauaa

SEQ ID NO: 365643 - RNA, 64 nt, Human
cucucucucuccucucucucucucucuuuuuaaaccaccauagacucucacuuauuuuggagga

SEQ ID NO: 365644 - RNA, 64 nt, Human
cguagggaugguggaccacagaaggcuauaaaggccaccauagaaagcugaagagccauuuaau

SEQ ID NO: 365645 - RNA, 64 nt, Human
aggaaaaaaaacuauugauaaguuuauaggcaaaccaccauaaggggugagucagacaggucug

SEQ ID NO: 365646 - RNA, 64 nt, Human
gugcuaaaacuuggauauuugugaaaacuccuuaccaccauacaagcaucagaagagcucucuu

SEQ ID NO: 365647 - RNA, 64 nt, Human
ggagaagcaggucuaggacuccccugcaccuuugccaccauaauggcccacacucccugggucc

SEQ ID NO: 365648 - RNA, 64 nt, Human
cagccucccuaguagcugggauuacaggcaugcaccaccauacccagcuaauuucuguauuuuu

SEQ ID NO: 365649 - RNA, 64 nt, Human
aucccagucuccuggcccccaggccagggucuguccaccauagaaugucuuccucuacuggggu

SEQ ID NO: 365650 - RNA, 59 nt, Human
ucauuuuacaacagaacugagacagacgaccaccauauucacugaggucuaaauuugca

SEQ ID NO: 365651 - RNA, 64 nt, Human
ggaacagaaaauggaggccuguuuuuuauugcuaccaccauagaucuggagaucuucgccagua

SEQ ID NO: 365652 - RNA, 64 nt, Human
auacaucaagccaauaccguguggcccaagacccccaccauaaaucacaucauuagcaugaacc

SEQ ID NO: 365653 - RNA, 64 nt, Human
gggggcuccgugaguggccugcuaucugcaaugaccaccauagcuuaaccccauccccacccuc

SEQ ID NO: 365654 - RNA, 64 nt, Human
uuacuggguguauaccuaaaggaauauaaucauuccaccauaaagacaaacacuuguauguuca

SEQ ID NO: 365655 - RNA, 64 nt, Human
cagccucccaaguagcugggauuacaggcguguaccaccauacccagcuaauuuuuguauuuuu

SEQ ID NO: 365656 - RNA, 64 nt, Human
acaacucauucccacauucuucagucccuggcgaccaccauauuuuuaagucauuaugacucug

SEQ ID NO: 365657 - RNA, 64 nt, Human
cuuggcucuuccagguuguccuacccucuggcauccaccauagacguuuuucaaacagaaaaug

SEQ ID NO: 365658 - RNA, 64 nt, Human
caaagacccuuguucuuaucccucaagaagaaacccaccauaaccagcccacugucaccccuaa

SEQ ID NO: 365659 - RNA, 64 nt, Human
agcugcccucguuuacucacaguuugcuuauuugccaccauaagaaaugguacaauaaaaauuc

SEQ ID NO: 365660 - RNA, 64 nt, Human
ccaaaaaaacacauacauaggaacugguuauauuccaccauaacacacacacacacacacacac

SEQ ID NO: 365661 - RNA, 64 nt, Human
gagccaggaucgaauggaaggggggaauugggguccaccauagucuucugcucugguccuccac

SEQ ID NO: 365662 - RNA, 64 nt, Human
cauguugccccuuucucuuuuccccuuuccugucccaccauacgagcaccuccagccugaacag

SEQ ID NO: 365663 - RNA, 64 nt, Human
ggagcaagagagggcaaguguucccaaauugacgccaccauaauaaucaucaccacaccgugag

SEQ ID NO: 365664 - RNA, 64 nt, Human
agcaugcacaggaugguaaauuggauugguggauccaccauaucaugggauuuaaauuuaucau

SEQ ID NO: 365665 - RNA, 64 nt, Human
aaagugaaacguaauuguacaagcaguuaaucacccaccauagggcaugauuaacaaagcaacc

SEQ ID NO: 365666 - RNA, 64 nt, Human
auuuucagaaaaucuacaagucucguugagaccaccaccauaccucagaagguaggacuguggc

SEQ ID NO: 365667 - RNA, 64 nt, Human
cagccucccgaguagcugagacuacaggcaccugccaccauacccagcuaaguuauguauuuuu

SEQ ID NO: 365668 - RNA, 64 nt, Human
cugcccagaugcccuuuggaaagccauugaccacccaccauauuguuugaucuacuucauagcu

SEQ ID NO: 365669 - RNA, 64 nt, Human
uccuggccccaccagggccuugggcaaguccugcccaccauaggccucugcuaccugccaguca

SEQ ID NO: 365670 - RNA, 64 nt, Human
uggggucugugguccauccuccaggcauccauguccaccauagaauuugguuacuugguaagug

SEQ ID NO: 365671 - RNA, 64 nt, Human
uuucugcgggaaggaauuaagcuauguauuagguccaccauacgaucuguguaaguaagauuau

SEQ ID NO: 365672 - RNA, 64 nt, Human
ugcugcuacgguuuuaaucauccagggugccauuccaccauagaagagcaauccuuuuaggaaa

SEQ ID NO: 365673 - RNA, 64 nt, Human
cuuccagccugccaaucaacccuccuggguguggccaccauaugugugugccuagguccuccuu

SEQ ID NO: 365674 - RNA, 64 nt, Human
ucccacaacuacuagugugacuccuuaucucuuuccaccauaccuuagagacuuugauacuacc

SEQ ID NO: 365675 - RNA, 64 nt, Human
uuucaauuugaucauauuuuaaaauauguuuucaccaccauauaagauuuugguucuacuugcu

SEQ ID NO: 365676 - RNA, 64 nt, Human
ccucccugcgugcacggccuaggaggugcacgggccaccauagucacacuggcacugaaaagaa

SEQ ID NO: 365677 - RNA, 64 nt, Human; identical to SEQ ID NO: 272999

SEQ ID NO: 365678 - RNA, 64 nt, Human; identical to SEQ ID NO: 273000

SEQ ID NO: 365679 - RNA, 64 nt, Human; identical to SEQ ID NO: 273001

SEQ ID NO: 365680 - RNA, 64 nt, Human; identical to SEQ ID NO: 273002

SEQ ID NO: 365681 - RNA, 64 nt, Human; identical to SEQ ID NO: 273003

SEQ ID NO: 365682 - RNA, 64 nt, Human; identical to SEQ ID NO: 273004

SEQ ID NO: 365683 - RNA, 64 nt, Human; identical to SEQ ID NO: 273005

SEQ ID NO: 365684 - RNA, 64 nt, Human; identical to SEQ ID NO: 273006

SEQ ID NO: 365685 - RNA, 64 nt, Human; identical to SEQ ID NO: 273007

SEQ ID NO: 365686 - RNA, 64 nt, Human; identical to SEQ ID NO: 273008

SEQ ID NO: 365687 - RNA, 64 nt, Human; identical to SEQ ID NO: 273009

SEQ ID NO: 365688 - RNA, 64 nt, Human; identical to SEQ ID NO: 273010

SEQ ID NO: 365689 - RNA, 64 nt, Human; identical to SEQ ID NO: 273011

SEQ ID NO: 365690 - RNA, 64 nt, Human; identical to SEQ ID NO: 365515

SEQ ID NO: 365691 - RNA, 64 nt, Human; identical to SEQ ID NO: 365516

SEQ ID NO: 365692 - RNA, 64 nt, Human; identical to SEQ ID NO: 365517

SEQ ID NO: 365693 - RNA, 64 nt, Human; identical to SEQ ID NO: 365518

SEQ ID NO: 365694 - RNA, 64 nt, Human; identical to SEQ ID NO: 365519

SEQ ID NO: 365695 - RNA, 64 nt, Human; identical to SEQ ID NO: 365520

SEQ ID NO: 365696 - RNA, 64 nt, Human; identical to SEQ ID NO: 365521

SEQ ID NO: 365697 - RNA, 64 nt, Human; identical to SEQ ID NO: 365522

SEQ ID NO: 365698 - RNA, 64 nt, Human; identical to SEQ ID NO: 365523

SEQ ID NO: 365699 - RNA, 64 nt, Human; identical to SEQ ID NO: 365524

SEQ ID NO: 365700 - RNA, 64 nt, Human; identical to SEQ ID NO: 365525

SEQ ID NO: 365701 - RNA, 64 nt, Human; identical to SEQ ID NO: 365526

SEQ ID NO: 365702 - RNA, 64 nt, Human; identical to SEQ ID NO: 365527

SEQ ID NO: 365703 - RNA, 64 nt, Human; identical to SEQ ID NO: 365528

SEQ ID NO: 365704 - RNA, 64 nt, Human; identical to SEQ ID NO: 365529

SEQ ID NO: 365705 - RNA, 64 nt, Human; identical to SEQ ID NO: 365530

SEQ ID NO: 365706 - RNA, 64 nt, Human; identical to SEQ ID NO: 365531

SEQ ID NO: 365707 - RNA, 64 nt, Human; identical to SEQ ID NO: 365532

SEQ ID NO: 365708 - RNA, 64 nt, Human; identical to SEQ ID NO: 365533

SEQ ID NO: 365709 - RNA, 64 nt, Human; identical to SEQ ID NO: 365534

SEQ ID NO: 365710 - RNA, 64 nt, Human; identical to SEQ ID NO: 365535

SEQ ID NO: 365711 - RNA, 64 nt, Human; identical to SEQ ID NO: 365536

SEQ ID NO: 365712 - RNA, 64 nt, Human; identical to SEQ ID NO: 365537

SEQ ID NO: 365713 - RNA, 64 nt, Human; identical to SEQ ID NO: 365538

SEQ ID NO: 365714 - RNA, 64 nt, Human; identical to SEQ ID NO: 365539

SEQ ID NO: 365715 - RNA, 64 nt, Human; identical to SEQ ID NO: 365540

SEQ ID NO: 365716 - RNA, 64 nt, Human; identical to SEQ ID NO: 365541

SEQ ID NO: 365717 - RNA, 64 nt, Human; identical to SEQ ID NO: 365542

SEQ ID NO: 365718 - RNA, 50 nt, Human; identical to SEQ ID NO: 365543

SEQ ID NO: 365719 - RNA, 64 nt, Human; identical to SEQ ID NO: 365544

SEQ ID NO: 365720 - RNA, 64 nt, Human; identical to SEQ ID NO: 365545

SEQ ID NO: 365721 - RNA, 64 nt, Human; identical to SEQ ID NO: 365546

SEQ ID NO: 365722 - RNA, 64 nt, Human; identical to SEQ ID NO: 365547

SEQ ID NO: 365723 - RNA, 64 nt, Human; identical to SEQ ID NO: 365548

SEQ ID NO: 365724 - RNA, 64 nt, Human; identical to SEQ ID NO: 365549

SEQ ID NO: 365725 - RNA, 63 nt, Human; identical to SEQ ID NO: 365550

SEQ ID NO: 365726 - RNA, 64 nt, Human; identical to SEQ ID NO: 365551

SEQ ID NO: 365727 - RNA, 64 nt, Human; identical to SEQ ID NO: 365552

SEQ ID NO: 365728 - RNA, 64 nt, Human; identical to SEQ ID NO: 365553

SEQ ID NO: 365729 - RNA, 64 nt, Human; identical to SEQ ID NO: 365554

SEQ ID NO: 365730 - RNA, 64 nt, Human; identical to SEQ ID NO: 365555

SEQ ID NO: 365731 - RNA, 64 nt, Human; identical to SEQ ID NO: 365556

SEQ ID NO: 365732 - RNA, 64 nt, Human; identical to SEQ ID NO: 365557

SEQ ID NO: 365733 - RNA, 64 nt, Human; identical to SEQ ID NO: 365558

SEQ ID NO: 365734 - RNA, 64 nt, Human; identical to SEQ ID NO: 365559

SEQ ID NO: 365735 - RNA, 64 nt, Human; identical to SEQ ID NO: 365560

SEQ ID NO: 365736 - RNA, 64 nt, Human; identical to SEQ ID NO: 365561

SEQ ID NO: 365737 - RNA, 64 nt, Human; identical to SEQ ID NO: 365562

SEQ ID NO: 365738 - RNA, 64 nt, Human; identical to SEQ ID NO: 365563

SEQ ID NO: 365739 - RNA, 64 nt, Human; identical to SEQ ID NO: 365564

SEQ ID NO: 365740 - RNA, 64 nt, Human; identical to SEQ ID NO: 365565

SEQ ID NO: 365741 - RNA, 64 nt, Human; identical to SEQ ID NO: 365566

SEQ ID NO: 365742 - RNA, 64 nt, Human; identical to SEQ ID NO: 365567

SEQ ID NO: 365743 - RNA, 64 nt, Human; identical to SEQ ID NO: 365568

SEQ ID NO: 365744 - RNA, 64 nt, Human; identical to SEQ ID NO: 365569

SEQ ID NO: 365745 - RNA, 64 nt, Human; identical to SEQ ID NO: 365570

SEQ ID NO: 365746 - RNA, 64 nt, Human; identical to SEQ ID NO: 365571

SEQ ID NO: 365747 - RNA, 64 nt, Human; identical to SEQ ID NO: 365572

SEQ ID NO: 365748 - RNA, 64 nt, Human; identical to SEQ ID NO: 365573

SEQ ID NO: 365749 - RNA, 64 nt, Human; identical to SEQ ID NO: 365574

SEQ ID NO: 365750 - RNA, 64 nt, Human; identical to SEQ ID NO: 365575

SEQ ID NO: 365751 - RNA, 64 nt, Human; identical to SEQ ID NO: 365576

SEQ ID NO: 365752 - RNA, 64 nt, Human; identical to SEQ ID NO: 365577

SEQ ID NO: 365753 - RNA, 64 nt, Human; identical to SEQ ID NO: 365578

SEQ ID NO: 365754 - RNA, 64 nt, Human; identical to SEQ ID NO: 365579

SEQ ID NO: 365755 - RNA, 64 nt, Human; identical to SEQ ID NO: 365580

SEQ ID NO: 365756 - RNA, 64 nt, Human; identical to SEQ ID NO: 365581

SEQ ID NO: 365757 - RNA, 64 nt, Human; identical to SEQ ID NO: 365582

SEQ ID NO: 365758 - RNA, 64 nt, Human; identical to SEQ ID NO: 365583

SEQ ID NO: 365759 - RNA, 64 nt, Human; identical to SEQ ID NO: 365584

SEQ ID NO: 365760 - RNA, 64 nt, Human; identical to SEQ ID NO: 365585

SEQ ID NO: 365761 - RNA, 64 nt, Human; identical to SEQ ID NO: 365586

SEQ ID NO: 365762 - RNA, 64 nt, Human; identical to SEQ ID NO: 365587

SEQ ID NO: 365763 - RNA, 64 nt, Human; identical to SEQ ID NO: 365588

SEQ ID NO: 365764 - RNA, 64 nt, Human; identical to SEQ ID NO: 365589

SEQ ID NO: 365765 - RNA, 64 nt, Human; identical to SEQ ID NO: 365590

SEQ ID NO: 365766 - RNA, 64 nt, Human; identical to SEQ ID NO: 365591

SEQ ID NO: 365767 - RNA, 64 nt, Human; identical to SEQ ID NO: 365592

SEQ ID NO: 365768 - RNA, 64 nt, Human; identical to SEQ ID NO: 365593

SEQ ID NO: 365769 - RNA, 64 nt, Human; identical to SEQ ID NO: 365594

SEQ ID NO: 365770 - RNA, 64 nt, Human; identical to SEQ ID NO: 365595

SEQ ID NO: 365771 - RNA, 64 nt, Human; identical to SEQ ID NO: 365596

SEQ ID NO: 365772 - RNA, 64 nt, Human; identical to SEQ ID NO: 365597

SEQ ID NO: 365773 - RNA, 64 nt, Human; identical to SEQ ID NO: 365598

SEQ ID NO: 365774 - RNA, 64 nt, Human; identical to SEQ ID NO: 365599

SEQ ID NO: 365775 - RNA, 64 nt, Human; identical to SEQ ID NO: 365600

SEQ ID NO: 365776 - RNA, 64 nt, Human; identical to SEQ ID NO: 365601

SEQ ID NO: 365777 - RNA, 64 nt, Human; identical to SEQ ID NO: 365602

SEQ ID NO: 365778 - RNA, 64 nt, Human; identical to SEQ ID NO: 365603

SEQ ID NO: 365779 - RNA, 64 nt, Human; identical to SEQ ID NO: 365604

SEQ ID NO: 365780 - RNA, 64 nt, Human; identical to SEQ ID NO: 365605

SEQ ID NO: 365781 - RNA, 64 nt, Human; identical to SEQ ID NO: 365606

SEQ ID NO: 365782 - RNA, 64 nt, Human; identical to SEQ ID NO: 365607

SEQ ID NO: 365783 - RNA, 64 nt, Human; identical to SEQ ID NO: 365608

SEQ ID NO: 365784 - RNA, 64 nt, Human; identical to SEQ ID NO: 365609

SEQ ID NO: 365785 - RNA, 64 nt, Human; identical to SEQ ID NO: 365610

SEQ ID NO: 365786 - RNA, 64 nt, Human; identical to SEQ ID NO: 365611

SEQ ID NO: 365787 - RNA, 64 nt, Human; identical to SEQ ID NO: 365612

SEQ ID NO: 365788 - RNA, 64 nt, Human; identical to SEQ ID NO: 365613

SEQ ID NO: 365789 - RNA, 64 nt, Human; identical to SEQ ID NO: 365614

SEQ ID NO: 365790 - RNA, 64 nt, Human; identical to SEQ ID NO: 365615

SEQ ID NO: 365791 - RNA, 64 nt, Human; identical to SEQ ID NO: 365616

SEQ ID NO: 365792 - RNA, 64 nt, Human; identical to SEQ ID NO: 365617

SEQ ID NO: 365793 - RNA, 64 nt, Human; identical to SEQ ID NO: 365618

SEQ ID NO: 365794 - RNA, 64 nt, Human; identical to SEQ ID NO: 365619

SEQ ID NO: 365795 - RNA, 64 nt, Human; identical to SEQ ID NO: 365620

SEQ ID NO: 365796 - RNA, 64 nt, Human; identical to SEQ ID NO: 365621

SEQ ID NO: 365797 - RNA, 64 nt, Human; identical to SEQ ID NO: 365622

SEQ ID NO: 365798 - RNA, 64 nt, Human; identical to SEQ ID NO: 365623

SEQ ID NO: 365799 - RNA, 64 nt, Human; identical to SEQ ID NO: 365624

SEQ ID NO: 365800 - RNA, 64 nt, Human; identical to SEQ ID NO: 365625

SEQ ID NO: 365801 - RNA, 64 nt, Human; identical to SEQ ID NO: 365626

SEQ ID NO: 365802 - RNA, 64 nt, Human; identical to SEQ ID NO: 365627

SEQ ID NO: 365803 - RNA, 64 nt, Human; identical to SEQ ID NO: 365628

SEQ ID NO: 365804 - RNA, 64 nt, Human; identical to SEQ ID NO: 365629

SEQ ID NO: 365805 - RNA, 64 nt, Human; identical to SEQ ID NO: 365630

SEQ ID NO: 365806 - RNA, 64 nt, Human; identical to SEQ ID NO: 365631

SEQ ID NO: 365807 - RNA, 64 nt, Human; identical to SEQ ID NO: 365632

SEQ ID NO: 365808 - RNA, 64 nt, Human; identical to SEQ ID NO: 365633

SEQ ID NO: 365809 - RNA, 64 nt, Human; identical to SEQ ID NO: 365634

SEQ ID NO: 365810 - RNA, 64 nt, Human; identical to SEQ ID NO: 365635

SEQ ID NO: 365811 - RNA, 64 nt, Human; identical to SEQ ID NO: 365636

SEQ ID NO: 365812 - RNA, 64 nt, Human; identical to SEQ ID NO: 365637

SEQ ID NO: 365813 - RNA, 64 nt, Human; identical to SEQ ID NO: 365638

SEQ ID NO: 365814 - RNA, 64 nt, Human; identical to SEQ ID NO: 365639

SEQ ID NO: 365815 - RNA, 64 nt, Human; identical to SEQ ID NO: 365640

SEQ ID NO: 365816 - RNA, 64 nt, Human; identical to SEQ ID NO: 365641

SEQ ID NO: 365817 - RNA, 64 nt, Human; identical to SEQ ID NO: 365642

SEQ ID NO: 365818 - RNA, 64 nt, Human; identical to SEQ ID NO: 365643

SEQ ID NO: 365819 - RNA, 64 nt, Human; identical to SEQ ID NO: 365644

SEQ ID NO: 365820 - RNA, 64 nt, Human; identical to SEQ ID NO: 365645

SEQ ID NO: 365821 - RNA, 64 nt, Human; identical to SEQ ID NO: 365646

SEQ ID NO: 365822 - RNA, 64 nt, Human; identical to SEQ ID NO: 365647

SEQ ID NO: 365823 - RNA, 64 nt, Human; identical to SEQ ID NO: 365648

SEQ ID NO: 365824 - RNA, 64 nt, Human; identical to SEQ ID NO: 365649

SEQ ID NO: 365825 - RNA, 59 nt, Human; identical to SEQ ID NO: 365650

SEQ ID NO: 365826 - RNA, 64 nt, Human; identical to SEQ ID NO: 365651

SEQ ID NO: 365827 - RNA, 64 nt, Human; identical to SEQ ID NO: 365652

SEQ ID NO: 365828 - RNA, 64 nt, Human; identical to SEQ ID NO: 365653

SEQ ID NO: 365829 - RNA, 64 nt, Human; identical to SEQ ID NO: 365654

SEQ ID NO: 365830 - RNA, 64 nt, Human; identical to SEQ ID NO: 365655

SEQ ID NO: 365831 - RNA, 64 nt, Human; identical to SEQ ID NO: 365656

SEQ ID NO: 365832 - RNA, 64 nt, Human; identical to SEQ ID NO: 365657

SEQ ID NO: 365833 - RNA, 64 nt, Human; identical to SEQ ID NO: 365658

SEQ ID NO: 365834 - RNA, 64 nt, Human; identical to SEQ ID NO: 365659

SEQ ID NO: 365835 - RNA, 64 nt, Human; identical to SEQ ID NO: 365660

SEQ ID NO: 365836 - RNA, 64 nt, Human; identical to SEQ ID NO: 365661

SEQ ID NO: 365837 - RNA, 64 nt, Human; identical to SEQ ID NO: 365662

SEQ ID NO: 365838 - RNA, 64 nt, Human; identical to SEQ ID NO: 365663

SEQ ID NO: 365839 - RNA, 64 nt, Human; identical to SEQ ID NO: 365664

SEQ ID NO: 365840 - RNA, 64 nt, Human; identical to SEQ ID NO: 365665

SEQ ID NO: 365841 - RNA, 64 nt, Human; identical to SEQ ID NO: 365666

SEQ ID NO: 365842 - RNA, 64 nt, Human; identical to SEQ ID NO: 365667

SEQ ID NO: 365843 - RNA, 64 nt, Human; identical to SEQ ID NO: 365668

SEQ ID NO: 365844 - RNA, 64 nt, Human; identical to SEQ ID NO: 365669

SEQ ID NO: 365845 - RNA, 64 nt, Human; identical to SEQ ID NO: 365670

SEQ ID NO: 365846 - RNA, 64 nt, Human; identical to SEQ ID NO: 365671

SEQ ID NO: 365847 - RNA, 64 nt, Human; identical to SEQ ID NO: 365672

SEQ ID NO: 365848 - RNA, 64 nt, Human; identical to SEQ ID NO: 365673

SEQ ID NO: 365849 - RNA, 64 nt, Human; identical to SEQ ID NO: 365674

SEQ ID NO: 365850 - RNA, 64 nt, Human; identical to SEQ ID NO: 365675

SEQ ID NO: 365851 - RNA, 64 nt, Human; identical to SEQ ID NO: 365676

SEQ ID NO: 365852 - RNA, 64 nt, Human
uucaggaccuugaggacacgugaccccacccgcccaccgccacuaucaggccccgggaccgcac

SEQ ID NO: 365853 - RNA, 64 nt, Human
augaggaggugugugagcagggaacucagugugacaccgccagguccagcacccaugggggcgg

SEQ ID NO: 365854 - RNA, 64 nt, Human
ggaauaaaauguugccuuccccacuucucaccaccaccgccaucaugacgcucauacuggcuuu

SEQ ID NO: 365855 - RNA, 64 nt, Human
gcgccagagacuggcggugucuuaagacuccgggcaccgccacgcgcugucaagcaacacucug

SEQ ID NO: 365856 - RNA, 64 nt, Human
caggcggggcgccccaagagcccaaaagagggcacaccgccauccucugccucaaauucugcgu

SEQ ID NO: 365857 - RNA, 64 nt, Human
ccugcgagacgcacacagcugagcacuuagcaggcaccgccacgucccagcaucccuggagcag

SEQ ID NO: 365858 - RNA, 64 nt, Human
cugagccaccaacuggaccccucuccagcaacaccaccgccaccaccucccacaucccugaggu

SEQ ID NO: 365859 - RNA, 64 nt, Human
gcacagcaguauagccacccggccuggccgccaccaccgccaccgagagccccgccuccagcag

SEQ ID NO: 365860 - RNA, 64 nt, Human
cucagccucccgaguagcugggagugcaggugcacaccgccaugccuggcugauuuuuuguauu

SEQ ID NO: 365861 - RNA, 64 nt, Human
ccccugggaccaaaauuuaggggccucagucccucaccgccaugcccuggccuauucugucucu

SEQ ID NO: 365862 - RNA, 64 nt, Human
cugccucagccucccgaguagcugggacugcaggcaccgccaccacgccuggcuaauuuuuugu

SEQ ID NO: 365863 - RNA, 64 nt, Human
ggaucaggcccgaaggaaaaugcuggaaaaccaccaccgccacccagcagucagagaggaccuu

SEQ ID NO: 365864 - RNA, 64 nt, Human
ccugggcuccaggcucccccgcgcgggcgccgcccaccgccauacuaaacgaucgaggaauaaa

SEQ ID NO: 365865 - RNA, 64 nt, Human
ggcguggucuuccaggcuggcccuuccuucuccucaccgccaccuucccugccccagccccagc

SEQ ID NO: 365866 - RNA, 64 nt, Human
ugguauuaaccuggaagccccccuggcuggaggccaccgccacccuaggaagggggcagggacg

SEQ ID NO: 365867 - RNA, 64 nt, Human
cgcauuuucuaccugaaauuggaagacuuggugccaccgccagcaauaauugacaaacuuuucc

SEQ ID NO: 365868 - RNA, 64 nt, Human
augucccuugaugucacccugaucugucaugccccaccgccaccccuacucccuucaacccucc

SEQ ID NO: 365869 - RNA, 64 nt, Human
agacacaucgacaaugagcaccaccaucaaugaccaccgccauucacaagaacuuugacuguuu

SEQ ID NO: 365870 - RNA, 64 nt, Human
gccuuuucguaccugggcucaggugcgguguggccaccgccacccucauccccugccugggagg

SEQ ID NO: 365871 - RNA, 64 nt, Human
agcuuagcuucucaaaggccuaaccaagccuuggcaccgccagauccuuucuguaggcuaauuc

SEQ ID NO: 365872 - RNA, 64 nt, Human
gccaucccccuagccaucgugagcaucccagcggcaccgccauugucucaaccagccggcuccu

SEQ ID NO: 365873 - RNA, 64 nt, Human
cagugggcacacggcagccugcaaagcacagggccaccgccacagcccggcagaggggcacacu

SEQ ID NO: 365874 - RNA, 64 nt, Human
ucucuaucuaauucaaacauaucuccccaugauacaccgccagagugacauugcagacagucug

SEQ ID NO: 365875 - RNA, 64 nt, Human
uuauacagaaggaacagcaggagguuuuccuggacaccgccaacuucacauugcucaguggacu

SEQ ID NO: 365876 - RNA, 64 nt, Human
ugucugggugccccauagucacagaacaccuggacaccgccacaugcagucaucaucauguuac

SEQ ID NO: 365877 - RNA, 64 nt, Human
uggugcuguacccccgacgugcuccccugcucggcaccgccagccgccuucccuuuaacccuca

SEQ ID NO: 365878 - RNA, 64 nt, Human
ccuggagagaaacuuccagaccagccccucacaccaccgccaggagaggccuuucccaccggga

SEQ ID NO: 365879 - RNA, 64 nt, Human
gccaacugccccgcgucuucagcuguuucgcauccaccgccaccccacugagagcugcuccuuu

SEQ ID NO: 365880 - RNA, 64 nt, Human
ucuguuuaaaaaaauaaaaaggaaaggaagcguucaccgccacaaaucauaaaauggacaugac

SEQ ID NO: 365881 - RNA, 64 nt, Human
augucuguuuagcccacaucacgucaguuaucaacaccgccacugugcuuacuguuccuacagc

SEQ ID NO: 365882 - RNA, 64 nt, Human
uugcggagagacgcggccccucccgcguggacaucaccgccaugagccucuuugcgagugaccu

SEQ ID NO: 365883 - RNA, 64 nt, Human
gcauggaugugcugaacgaggccauugguacccucaccgccaggggggaccggaaugccugggu

SEQ ID NO: 365884 - RNA, 64 nt, Human
cuguucagagacuucguggaucacagcugcagcucaccgccacaucacaggauccguuaacguu

SEQ ID NO: 365885 - RNA, 64 nt, Human
acauagacgugggggcauaggcucccacugccaccaccgccaucgccucaccugcagcucugaa

SEQ ID NO: 365886 - RNA, 64 nt, Human
uucaagaugucaggauacccuuccaucaccccaccaccgccaccccaacuugacuuucaagaac

SEQ ID NO: 365887 - RNA, 64 nt, Human
gguguaggcaccacccacccagcaguaccguccgcaccgccaggcucagccccugcccacccca

SEQ ID NO: 365888 - RNA, 64 nt, Human
aauuuuucccccuucauuucugaaauuuuuugcucaccgccauguuuaaaugggguugaaucau

SEQ ID NO: 365889 - RNA, 64 nt, Human
aguuggcacugacaucacagcuucauaaccccaccaccgccagcuuccccugccuccuacaucc

SEQ ID NO: 365890 - RNA, 64 nt, Human
guugggaggagucgggggcgagccuuagcagcugcaccgccauccccaugcugguuggugcugc

SEQ ID NO: 365891 - RNA, 51 nt, Human
ggccugccgggcacucaugaucaccgccauccuccugggcuuccucggccu

SEQ ID NO: 365892 - RNA, 64 nt, Human
caaucagaaaccuccguuguggcagaggggccuucaccgccaccagggugucccgccagacagg

SEQ ID NO: 365893 - RNA, 64 nt, Human
gcauccaggcgcgugucaucuaccagaugcccuccaccgccauuucuuggucugucuaugaguu

SEQ ID NO: 365894 - RNA, 64 nt, Human
uauuugccugccugauucucuguguuuccuguuucaccgccacccuuucaggagagaacuacac

SEQ ID NO: 365895 - RNA, 64 nt, Human
acaccuguguaaccaccaccaccuguguaaccaccaccgccagaaccaaaaacguuucugucac

SEQ ID NO: 365896 - RNA, 64 nt, Human
ccccaauacacagaaccaccgccaccaccaccaacaccgccacaccaacaccaccacuacaaaa

SEQ ID NO: 365897 - RNA, 64 nt, Human
aaauauaacccucccuucccccaauacacagaaccaccgccaccaccaccaacaccgccacacc

SEQ ID NO: 365898 - RNA, 64 nt, Human
gcaugcgccacgccguggcucccaccagcagugccaccgccaccacaccccagaucccacccac

SEQ ID NO: 365899 - RNA, 64 nt, Human
gauauuccaugacccagugcacgcuguggccugucaccgccaccguggccccgccagcuggccu

SEQ ID NO: 365900 - RNA, 64 nt, Human
gccuuguggguggaggcggggcagggcuguguggcaccgccagggagcgggcccaccugaguca

SEQ ID NO: 365901 - RNA, 64 nt, Human
cuaauucugccguuguaaugagacuugauuaaaacaccgccacuuuuuugcauugcugcucuuu

SEQ ID NO: 365902 - RNA, 64 nt, Human
cucagugacucccccacaaaacagcaacagccuccaccgccaacucaacaaacuucagaguagc

SEQ ID NO: 365903 - RNA, 64 nt, Human
guuuccucuuuucaggucagcuccaugugccaugcaccgccaugcacccuguucccugacaagu

SEQ ID NO: 365904 - RNA, 64 nt, Human
acccggcuggccccuugggucagacuggagccaacaccgccagccacccccucuggccugcugg

SEQ ID NO: 365905 - RNA, 64 nt, Human
caggauguggcacugcuugaggaggggcaccugccaccgccagaggacaaggaagugggggccg

SEQ ID NO: 365906 - RNA, 64 nt, Human
gauggggagggucucggugguaccaggucuccuccaccgccauggcuuccaagguggucugcuc

SEQ ID NO: 365907 - RNA, 64 nt, Human
cguggacaucugagggcgccaggcaggcgggcgccaccgccacccgcagcgagggcggagccgg

SEQ ID NO: 365908 - RNA, 64 nt, Human
cuccgggggagaauguggaacccagccacacugccaccgccacacuagugcugaacguggugcc

SEQ ID NO: 365909 - RNA, 64 nt, Human
uggaggccagugcgcacuagcugggccugguggccaccgccagagcuccuggcgacaucuuggc

SEQ ID NO: 365910 - RNA, 64 nt, Human
acagaggcugguggucgccgggauaauuaaugaccaccgccaauucaucccucacgugucuccu

SEQ ID NO: 365911 - RNA, 64 nt, Human
ggagacacguccuccuccccaacccaccucaugccaccgccaacccccugccccaggagcgggc

SEQ ID NO: 365912 - RNA, 64 nt, Human
auuuuccaagaguccuccauuuuuugcacccccucaccgccaacucuguuauucaguagagaga

SEQ ID NO: 365913 - RNA, 64 nt, Human
agguggauauggacaucugccgccgcaucgacaucaccgccaagcucugcgauguggcucagca

SEQ ID NO: 365914 - RNA, 64 nt, Human
ugaucagacuaggccccacucagccuggccuggacaccgccaugagcacagggcagggcugggg

SEQ ID NO: 365915 - RNA, 64 nt, Human
gcccugccugcugcaucuuuucuguugccccauccaccgccagcuucccuucacuccccuaucc

SEQ ID NO: 365916 - RNA, 64 nt, Human
gauuuggaaguuuagucaccucugagccacccaucaccgccaaagugugggggaaggauagcug

SEQ ID NO: 365917 - RNA, 64 nt, Human
ucuccaccccgcgggcucuccaggagccucagcccaccgccaguacucucccagcaaccgcgag

SEQ ID NO: 365918 - RNA, 64 nt, Human
uuaacauggaaaccauggcccucugccacugacccaccgccaccuccgcggagaaacugcacuu

SEQ ID NO: 365919 - RNA, 64 nt, Human
uaaagacguucccuuuuguauucucuuccucauccaccgccacugggccugucacugauggugg

SEQ ID NO: 365920 - RNA, 64 nt, Human
cgcugggguuucccucucccagaaccgcugccaccaccgccacgcccuccgcagaaagcccacc

SEQ ID NO: 365921 - RNA, 64 nt, Human
caggggcuuuuaggguccuguggcgagcugugagcaccgccagcauuagacgucacauccaggu

SEQ ID NO: 365922 - RNA, 64 nt, Human
acgugugccagagcccccucccucaccuucccuccaccgccagccccagaguuagauuuuaugc

SEQ ID NO: 365923 - RNA, 64 nt, Human
uucugaucagguuauuggugacuuacuggacuggcaccgccaggagaaaauucuccugcuaacu

SEQ ID NO: 365924 - RNA, 64 nt, Human
gcuucgccgucuccauccucaucauuggcaugcucaccgccaucauuggggaccuggccucgca

SEQ ID NO: 365925 - RNA, 64 nt, Human
accgagagaaugcugaccugacuugccuccgugucaccgccaccccgcaccccgcguguccccg

SEQ ID NO: 365926 - RNA, 64 nt, Human
agcugacggacaacugagucuccggcccaccuaccaccgccagccaggaucccccaaagugugc

SEQ ID NO: 365927 - RNA, 64 nt, Human
caguaauguaucaauaaucccagcccagucaaagcaccgccaccuguaggcuucugucucaugg

SEQ ID NO: 365928 - RNA, 64 nt, Human
caccgucugccuugcuccucucuucccaaaucaucaccgccaugggcccagccccaaagggcag

SEQ ID NO: 365929 - RNA, 64 nt, Human
gccccggcgggaggggcgggugggaggccgcggccaccgccaccugccggccucgagaggggcc

SEQ ID NO: 365930 - RNA, 64 nt, Human
cccauccagagaaugaaugaguuccuuuaagugccaccgccagcaagcccagaggcacacaguc

SEQ ID NO: 365931 - RNA, 64 nt, Human
gcaagaacagcaggacgcugguuuaaaaauaacucaccgccaaaccuguggagcaguguggggc

SEQ ID NO: 365932 - RNA, 64 nt, Human
acccagacaaccaaaacauauucaaagcagcagccaccgccauccgguccccugccuggaacug

SEQ ID NO: 365933 - RNA, 64 nt, Human
cuugaucccgcugacgacgcccacgucgaggccccaccgccauccuugcgccggcucauguucc

SEQ ID NO: 365934 - RNA, 64 nt, Human
ucacaccacagcuucccugguccacagaggcucucaccgccauugccaccaguauggugguaug

SEQ ID NO: 365935 - RNA, 64 nt, Human
aagaugggcuucaauuagauggcaaaggagaggacaccgccagugguccaaaaaggcugcucuc

SEQ ID NO: 365936 - RNA, 64 nt, Human
gcuggccugcgccugcaccugcgccuggcucugucaccgccaugcaacuccaugccuauuuacu

SEQ ID NO: 365937 - RNA, 64 nt, Human
uggagcccuccgaggggugucaggggaaacaggccaccgccaaagccauggcccgccgccgaga

SEQ ID NO: 365938 - RNA, 64 nt, Human
gcaggagcauggagcucuacaggaaugcaccccccaccgccauuggcauccccaccaagcuccu

SEQ ID NO: 365939 - RNA, 64 nt, Human
cuuguuuuuuuuuuaaaaauacacuccccucccccaccgccacacaccuuacaguucaaaaggu

SEQ ID NO: 365940 - RNA, 64 nt, Human
cuccccggccaggcacguggcaccgucgccuugacaccgccaucucuuuucuuuaaggcuucag

SEQ ID NO: 365941 - RNA, 64 nt, Human
aggucgggggagggugaugccagggauuccaaggcaccgccauguacugcacugcccuggucga

SEQ ID NO: 365942 - RNA, 64 nt, Human
ccugaaccugcacaccuacgugcgcagggcccuccaccgccacuaugggcccgagcucaucgac

SEQ ID NO: 365943 - RNA, 64 nt, Human
ggggccggggcaguggggagcccccaucccuucacaccgccaccaacuaaccaagcuuggccuc

SEQ ID NO: 365944 - RNA, 64 nt, Human
uguggcagaaucgcaccgccccggcuccccagcccaccgccaugcagggcucgcgugcgggaaa

SEQ ID NO: 365945 - RNA, 64 nt, Human
ggcuuauauugccuaugaacuuaacagcguacaacaccgccagcuuaaggacaacaccugugug

SEQ ID NO: 365946 - RNA, 64 nt, Human
cgccaaugccuccuaagccaggagcuggguuaugcaccgccauggcccacauuaacgcuccacc

SEQ ID NO: 365947 - RNA, 64 nt, Human
ccuacugcaggacacugagggcuuggcugccugccaccgccaucuggagcccaccacagcucuu

SEQ ID NO: 365948 - RNA, 64 nt, Human
ucgggggcuuagaggcugggauggcuccuggccccaccgccagggggcagcgcaggccgggcug

SEQ ID NO: 365949 - RNA, 64 nt, Human
ugucuaacugauaagaaucaacaaggucacccaucaccgccaccugcaccugggccuuuucccc

SEQ ID NO: 365950 - RNA, 64 nt, Human
gguuuucacgugcuucagagaagaggggcugccccaccgccacucacgucacucggggcucggu

SEQ ID NO: 365951 - RNA, 64 nt, Human
gcaccagggcucacgugggaaccccccucccacccaccgccacaauaaagaucgcccccaccuc

SEQ ID NO: 365952 - RNA, 64 nt, Human
uugucacccgcuccagguuggagccacagacacccaccgccaccccggcugggucugcguccuu

SEQ ID NO: 365953 - RNA, 64 nt, Human
uaggauacgggggugguauggaagggagcguucacaccgccagccucgggccugggauuugagg

SEQ ID NO: 365954 - RNA, 64 nt, Human
gggcggggcuggugaggguuuguccuaagaggaccaccgccaucucugggucuccagggggaga

SEQ ID NO: 365955 - RNA, 64 nt, Human
uucgccuccuccagcuccugccccgccggccgcgcaccgccaugcaugauggguaaagcaauac

SEQ ID NO: 365956 - RNA, 64 nt, Human
gcgggggccagggaaguccccgaguuuccccagacaccgccacauggcuuccuccugcgcgcau

SEQ ID NO: 365957 - RNA, 64 nt, Human
gggcuguuggcagugucacaucacugaguuuauccaccgccauccaccucuauccaccccauaa

SEQ ID NO: 365958 - RNA, 64 nt, Human
aaaaaaacaaauuuuuuuuuucucacuuguaagucaccgccaguaccuaaguuaggcuaacgga

SEQ ID NO: 365959 - RNA, 64 nt, Human
uaugaugagagauuccagcccaagccuggccccccaccgccaggccauagggcauaauuugcau

SEQ ID NO: 365960 - RNA, 64 nt, Human
agaaggaugucagugugugaccugccccagcuaccaccgccaccugcuuccaggccccuaugug

SEQ ID NO: 365961 - RNA, 64 nt, Human
ccacuuguggguccuggggucgucuuagcagagccaccgccaagguuugcacucagggaggggc

SEQ ID NO: 365962 - RNA, 64 nt, Human
uccaccucaacuucuggcugucccuacccugacucaccgccauggagaucacccuccccgaagc

SEQ ID NO: 365963 - RNA, 64 nt, Human
gggguugagguuauuguagacguuagauugcgggcaccgccagggauuuugcagcgcuucagug

SEQ ID NO: 365964 - RNA, 64 nt, Human
ugugagggagugcuggccgcaggcagccucgagucaccgccaggcucacaggcugugccacccg

SEQ ID NO: 365965 - RNA, 64 nt, Human
ucuggcccacugugguaauuccacauccagguaccaccgccauucagaguugucucaccccuuc

SEQ ID NO: 365966 - RNA, 64 nt, Human
guacugagaggagagaauguacguuugcuuuacccaccgccaccaagaaagcaguccgaugaga

SEQ ID NO: 365967 - RNA, 64 nt, Human
gacugugagaccuggccucgcacaggcgcgcacacaccgccaagcagcucagcauucucccccg

SEQ ID NO: 365968 - RNA, 64 nt, Human
gcuuggcccacugccaucacccagcaccccagaucaccgccaggccagcccccaaugguccccu

SEQ ID NO: 365969 - RNA, 64 nt, Human
gacuacauggacauuugaggggccacugcagccccaccgccacgccccaggggaccagccaggc

SEQ ID NO: 365970 - RNA, 64 nt, Human
aaagccagugcuaacaugcaaccauuccucacgccaccgccacaucagagcugguugggaaccc

SEQ ID NO: 365971 - RNA, 64 nt, Human
cugcaucuaucuccuuaaaguccacuccuuacaucaccgccacuacugcagcucagugcccagc

SEQ ID NO: 365972 - RNA, 64 nt, Human
aagccuagagaggccgcaaggggaccgccccaggcaccgccagaguguccugcuaccuuugucu

SEQ ID NO: 365973 - RNA, 64 nt, Human
cacggggccuucagcuuccccuguccucuggccacaccgccagcccuugguccuuaucugugug

SEQ ID NO: 365974 - RNA, 64 nt, Human
ccgccagaacggccuuuugcuuccagccaaagaacaccgccaacacgcacaccuccaaccuggg

SEQ ID NO: 365975 - RNA, 64 nt, Human
cagcccucggagugcugccaagugccuaccuguccaccgccaccggggucugcgauggcacgcc

SEQ ID NO: 365976 - RNA, 64 nt, Human
cucccuacuuagacccagucauucuagagggauccaccgccacacuggccggcccacguccugg

SEQ ID NO: 365977 - RNA, 58 nt, Human
cuacuucuguuuucuuuuagcgaccccccaccgccaggcugaucagaagcugaugacu

SEQ ID NO: 365978 - RNA, 64 nt, Human
gucugcggagccagcgccugcccgagagagaccccaccgccaccgugugccuuucccgggcccu

SEQ ID NO: 365979 - RNA, 64 nt, Human
agcaagcggggcaaggggcccuuccagaugccaccaccgccaacaggccaggccucugccuccu

SEQ ID NO: 365980 - RNA, 64 nt, Human
acagcuucccaaguagcugggauuuacaggugugcaccgccaugccaggcuaauuuuuguguuu

SEQ ID NO: 365981 - RNA, 64 nt, Human
gccccucacauuuagccgacugacugcugcagaccaccgccaacugcagcucuccaucagcucc

SEQ ID NO: 365982 - RNA, 62 nt, Human
augucaaucuuuuuuuccuaagaaaaaaaguccgcgaguauuaaauauuuagaucaauguuu

SEQ ID NO: 365983 - RNA, 62 nt, Human
ccuuggggucugccugcccacccacaugagcccgcgaguauggcagcaggacaagccagcgg

SEQ ID NO: 365984 - RNA, 62 nt, Human
ucccaguucaagugauuccccugccucagccucgcgaguagcuaggacuacaggcgcauguc

SEQ ID NO: 365985 - RNA, 62 nt, Human
ccagagaagcgcccacaucugaaggaccugcucgcgaguaucaguucuuccuuguugaauuc

SEQ ID NO: 365986 - RNA, 62 nt, Human
gaugagccaggguccaggagacagaugcccaucgcgaguacagacuuuguccuauuggcaac

SEQ ID NO: 365987 - RNA, 62 nt, Human
cccggguucaggcaauucucuugcaucagccucgcgaguaguuggaauuauaggcaugugcc

SEQ ID NO: 365988 - RNA, 62 nt, Human
gagagcggauggacuacaugaaacgcaagagccgcgaguaugagcagcucaagagcgagugg

SEQ ID NO: 365989 - RNA, 64 nt, Human
ggaugugauaaacagggcuauuagggguaucagccacgucgagcccccagacucugugcacuuc

SEQ ID NO: 365990 - RNA, 64 nt, Human
caaaaugugaauuacuuuguacgauuacagucuccacgucgaccuaacccaauauuauugguau

SEQ ID NO: 365991 - RNA, 64 nt, Human
guauuauaauuuuuuagaaaaaccaccaucgugucacgucgacgaugccaaauuauguuagcgu

SEQ ID NO: 365992 - RNA, 64 nt, Human
gucauguuguucccuuugcucgggaugcccacuucacgucgacggcauucauugguaguacuuc

SEQ ID NO: 365993 - RNA, 64 nt, Human
uaguuuacaaaacagagauuccuucaacacuggacacgucgagcauuuuguagcuuaauuaaac

SEQ ID NO: 365994 - RNA, 64 nt, Human
ccugguuagaugcacuuccugguguugagaugaacacgucgauuuuucaccaaucgaugaagcc

SEQ ID NO: 365995 - RNA, 64 nt, Human
cugagcgccugcccagauucucccauggguauuucacgucgaaaggacgcuguuacauauguau

SEQ ID NO: 365996 - RNA, 64 nt, Human
uugaugcacagaauuuaccucaucucacagagcccacgucgacgagcaccauuuggccagacau

SEQ ID NO: 365997 - RNA, 64 nt, Human
uccuguugaagcccuugaucccgcugacgacgcccacgucgaggccccaccgccauccuugcgc

SEQ ID NO: 365998 - RNA, 64 nt, Human
uuccuucccggcagcgcccgcagcgggccauuuacacgucgaggcuggcaccuggcgcgcucgg

SEQ ID NO: 365999 - RNA, 60 nt, Human
cguuuccccagugucauucaauaugcucuaaacgacgagguaaugcugaggcuauugcug

SEQ ID NO: 366000 - RNA, 60 nt, Human
uugcccaucucuccggccaccccgccaggaaacgacgagaaggccgaggaauccucagag

SEQ ID NO: 366001 - RNA, 60 nt, Human
cgaccaagauugacuaguuuguuggacuuaaacgacgauuugcugcugugaacccagcag

SEQ ID NO: 366002 - RNA, 60 nt, Human
ggcacucccugagacccaaagacccaccucaacgacgaguggcguugagccacuucccuu

SEQ ID NO: 366003 - RNA, 60 nt, Human
gagcuccuuccccaucauuucuccuuggccaacgacgaggccagccagaauggcaauaag

SEQ ID NO: 366004 - RNA, 60 nt, Human
gcucugcgugcgcaccgcgccuacacgcccaacgacgagugcuucuucaucuuccuggac

SEQ ID NO: 366005 - RNA, 60 nt, Human
ugauuauuucaacaguauugguuaagucacaacgacgaagugcugagaagguuaugggua

SEQ ID NO: 366006 - RNA, 60 nt, Human
uaguauaauuccucucacuuacugaaauacaacgacgacgacugcaaaguguaugcacac

SEQ ID NO: 366007 - RNA, 60 nt, Human
gauuuucuugacuguagguuuaagacgcuaaacgacgaaaacuccagucaccuccucuac

SEQ ID NO: 366008 - RNA, 60 nt, Human
uauuuuucuuccuuuuuuuguaauauugaaaacgacgauauaauuauuauaaguagacua

SEQ ID NO: 366009 - RNA, 60 nt, Human
gaauacacguggcuauaacaucuauaacaaaacgacgauuccucuacaagaggcuguuuc

SEQ ID NO: 366010 - RNA, 60 nt, Human
agcauccugaagccccauucuccgacuuacaacgacgagggacuuugaugggcugggccc

SEQ ID NO: 366011 - RNA, 64 nt, Human
gugcgagaugagcucgaacacugcccgccuuacugccgccuaccccgcccgccacgccgccguc

SEQ ID NO: 366012 - RNA, 64 nt, Human
gauggucuguguggaagaaaagaaaaaucugucugccgccuauuucccauuggugucgauugaa

SEQ ID NO: 366013 - RNA, 64 nt, Human
uuuguaugaguuuggagcagugcugaaggccaaagccgccuacugguuuguaguuaaccuagag

SEQ ID NO: 366014 - RNA, 64 nt, Human
ccauccccugcugaaccaggcccuguuacacacagccgccuaaggcccgcggcucaugugcugc

SEQ ID NO: 366015 - RNA, 64 nt, Human
uggggccgccuuggggcgcggcagcgcaggcagagccgccuagagcugugcagccggcucgaac

SEQ ID NO: 366016 - RNA, 64 nt, Human
agacgcgacguccauuugucgaaagaacaggagagccgccuacccucucacuggcugaaaagca

SEQ ID NO: 366017 - RNA, 64 nt, Human
ggcugcgggggaaccggcgccgagaggggaaggggccgccuagcccgaguaggccccagggcgc

SEQ ID NO: 366018 - RNA, 64 nt, Human
ucucugcagaggaacaacccuaaaaccagaccacuccacgcaggacaggcaggagagauucuuc

SEQ ID NO: 366019 - RNA, 64 nt, Human
cgcccuccgucgggccccugccugccuucuccccuccacgcaaggcugugcucuuccucugguu

SEQ ID NO: 366020 - RNA, 64 nt, Human
cuugggccggcacgcgugacacggcacuucaggcuccacgcacagaaucucgcagauaguuggg

SEQ ID NO: 366021 - RNA, 62 nt, Human
uaauucuauccaacuuaaaaaggcucuuuuaagagccgccuacuuucacccgaaaauagcug

SEQ ID NO: 366022 - RNA, 64 nt, Human
cccacgcuugacuucuuaucacuuuggcuguggugccgccuaguggaaaaaggaagucccugca

SEQ ID NO: 366023 - RNA, 64 nt, Human
ggcccuuugacuuugugaaugagcacaaugaaaugccgccuacugaugcuucuuaugaucagaa

SEQ ID NO: 366024 - RNA, 64 nt, Human
cagacccaucucgcggcggggguuuuguucuguugccgccuaacuuucucauccucggucucug

SEQ ID NO: 366025 - RNA, 64 nt, Human
ggcuuccccagaagccugggcuuaggguggagaugccgccuacacacgauccuggcccuccacc

SEQ ID NO: 366026 - RNA, 64 nt, Human
acuuccacacauggcacaguucugccugugaccugccgccuaagcuuuacuggaauucagguuu

SEQ ID NO: 366027 - RNA, 64 nt, Human
cuucccucuccugcgcuuccuccuggaguccggagccgccuacaacugcucccugcacggugcg

SEQ ID NO: 366028 - RNA, 64 nt, Human
gagugcagaggagggucuggcaggggcugcucaggccgccuagcugccccuuugccagguuaau

SEQ ID NO: 366029 - RNA, 64 nt, Human
aacuggugaaaaccauggggguggugcugacucagccgccuauuccccaaggagcuucagggca

SEQ ID NO: 366030 - RNA, 64 nt, Human
ggagggguccugcaggggcaagcaggagcuagcagccgccuacuuggugcuaaccccucgaugu

SEQ ID NO: 366031 - RNA, 64 nt, Human
gcagcaguuacuggcaagagggagaaaggacgcugccgccuaagagugcaaggcugcucagguc

SEQ ID NO: 366032 - RNA, 64 nt, Human
cacaaaggaagugcccccuccccggcacccucuggccgccuaggcucagcggcgaccgcccucc

SEQ ID NO: 366033 - RNA, 64 nt, Human
acuguauagaacccagggcucugaaacagcucuagccgccuaaugcacuucacagguaacuccc

SEQ ID NO: 366034 - RNA, 64 nt, Human
gagcuggacacuccuggcuggacgccaggccagugccgccuacguggagacuguccacacagcu

SEQ ID NO: 366035 - RNA, 64 nt, Human
agaauaucauuggcccugaucacauagaugcugcgccgccuagcaaaugcuuggugguucgacu

SEQ ID NO: 366036 - RNA, 64 nt, Human
cgauccuugauccgggucccggaucguggauccggccgccuagggcucagacuugcggccccgg

SEQ ID NO: 366037 - RNA, 64 nt, Human
uuuuaaggcaaagcagagagcagagguucuucaguccacgcaacgguucuucucugaacagcaa

SEQ ID NO: 366038 - RNA, 64 nt, Human
ucuguuguaggaagagagcgaggcaucccugaauuccacgcaucugcuggaaacgagccguguc

SEQ ID NO: 366039 - RNA, 64 nt, Human
guccuugaacacuacugggguauauucaggcucauccacgcagcugcuggguucuugcccuaac

SEQ ID NO: 366040 - RNA, 64 nt, Human
ucuuuguugcguuuugugcuuugaugccaggaaugccgccuaguuuauguccccgguggggcac

SEQ ID NO: 366041 - RNA, 64 nt, Human
uggacagggucuguccacgcaccaccuggggucugccgccuauuaaaagugccguauucuuacc

SEQ ID NO: 366042 - RNA, 64 nt, Human
cacagacacugagccacgcagccccgccucuggggccgccuaccuuugcuggucccacuucaga

SEQ ID NO: 366043 - RNA, 64 nt, Human
accugcgagggccgcccgcucccuuccugccacugccgccuacuggacgcugcccugcaugcug

SEQ ID NO: 366044 - RNA, 64 nt, Human
gccagcuugagccagacagcgcugcccagggguggccgccuaguacacacccaccuggccgagc

SEQ ID NO: 366045 - RNA, 64 nt, Human
caggacagaaagguguccaaguaccuguaucacagccgccuacgcccaccuaguggccaguccc

SEQ ID NO: 366046 - RNA, 64 nt, Human
cccgucccugucugggugggccucaggccaucuggccgccuagcgaggguccugcuuucuuccu

SEQ ID NO: 366047 - RNA, 64 nt, Human
uugaaccggaaccugagugacagccuggcccgcggccgccuacacccggaccugcaguccaacc

SEQ ID NO: 366048 - RNA, 64 nt, Human
aggcgagggcgacaugaagaugcacugcugcguggccgccuauaucuccgacuaugccuucuug

SEQ ID NO: 366049 - RNA, 64 nt, Human
guugcuaaacgccacggagcucacgcaggacccggccgccuacucccagcugguggccgugcug

SEQ ID NO: 366050 - RNA, 64 nt, Human
cacucucuacugguaggaagagguaccacaggaagccgccuagugcagagagguugugaaaaca

SEQ ID NO: 366051 - RNA, 64 nt, Human
cucagguuggggauggggacauggagaggaaggggccgccuacuccugcaaaugcuugugacag

SEQ ID NO: 366052 - RNA, 64 nt, Human
uaugccagccuguuccugccacagggcagucacugccgccuacccugaaauaaacccucgagug

SEQ ID NO: 366053 - RNA, 64 nt, Human
aguguggcccggagcgucuuggcugccgcccugcuccacgcagucugcuucagugcagugaagg

SEQ ID NO: 366054 - RNA, 64 nt, Human
uggaggggugacaguggaggaaaauccauggauauccacgcagcagccccucuuuaaccucauc

SEQ ID NO: 366055 - RNA, 64 nt, Human
ugaucaaauugcacuuguucuccuacaagcaaccuccacgcagacaccucguacugcuacaggu

SEQ ID NO: 366056 - RNA, 64 nt, Human
ucaguuccuggaggggggaaagggugaaagagaaaccacguauuuuguuauuauuuuggauuau

SEQ ID NO: 366057 - RNA, 64 nt, Human
cauacugaauacgcugugguucauuaauauuaacaccacguacuauaguauucuuaauacagug

SEQ ID NO: 366058 - RNA, 64 nt, Human
uucaguuuucucuucugugaaacaggaagacugaaccacguaauuaauauccaaggucccuucc

SEQ ID NO: 366059 - RNA, 64 nt, Human
ugauuugguucccaggacagugaaacauaguaauaccacguaaaucaagccauucauuuugggg

SEQ ID NO: 366060 - RNA, 64 nt, Human
gggcaggagucaccaugcaagggugacaucgacaaccacguaccaagccaccgcagcugcugcc

SEQ ID NO: 366061 - RNA, 64 nt, Human
ccaggccggggcauugccagggaggacccucacaaccacguacaugacccuuucuccuucaugc

SEQ ID NO: 366062 - RNA, 64 nt, Human
ugccgggagugaucagucggacauuuuaauuugaaccacguaucucuggguagcuacaaaauuc

SEQ ID NO: 366063 - RNA, 64 nt, Human
guucagagcaggaaaaccuucaaggagcugacugaccacguagcaugggggcaagaggcguggg

SEQ ID NO: 366064 - RNA, 64 nt, Human
uuauugcaucuguuauucaccauguaauucagguaccacguauuccagggagccuuucuuggcc

SEQ ID NO: 366065 - RNA, 64 nt, Human
uggaauuuuccuucuuaacaaguauagucauggcaccacguaacauuuuggucaaugacauugu

SEQ ID NO: 366066 - RNA, 64 nt, Human
uuugagugccggcuuucugaguagaguuaggaaaaccacguaacguagcauaugauguauaaua

SEQ ID NO: 366067 - RNA, 64 nt, Human
aacaaauggugcuuacccuuugaacagcagagugaccacguagaaggaaggaaaagggcaaaau

SEQ ID NO: 366068 - RNA, 64 nt, Human
uguuaaaaauuggcagauaaaauuuuauguauuuaccacguacaacaugaaauuuugaaacaug

SEQ ID NO: 366069 - RNA, 64 nt, Human
uuuacuaaaccaguacuucguuaugaaaaugccuuccacgcaaauaagaaaccaagggauaaaa

SEQ ID NO: 366070 - RNA, 64 nt, Human
gguuaucagggcauguguucaacaacccccaaaguccacgcagguggcuuguagaaaccuuugg

SEQ ID NO: 366071 - RNA, 64 nt, Human
accaacugaugaaugggaaauaaaauguggucuguccacgcaauggaacauuauuagacucuaa

SEQ ID NO: 366072 - RNA, 64 nt, Human
cugcugucuugugauuaaaaucaucucuguagugaccacguauauuuucaaggacucacucuua

SEQ ID NO: 366073 - RNA, 64 nt, Human
ugagguuugaggaaaaauaaauguugaucagcagaccacguauuuaaaauucugaaucuucugg

SEQ ID NO: 366074 - RNA, 64 nt, Human
ccuacccccagcuucggaaaauacagagaccaccaccacguacccuguauuccccaaggugaug

SEQ ID NO: 366075 - RNA, 64 nt, Human
ugaccagguuggacuguuuaaugucuuucaacuuaccacguaauccucuuguagggaucacauc

SEQ ID NO: 366076 - RNA, 64 nt, Human
ggccacuggaggaugggugggggccucugugagcaccacguaugccugugugaagacaagcgac

SEQ ID NO: 366077 - RNA, 64 nt, Human
augugguacaaauuuauauugaagaucuaaauaaaccacguauuuuccagucuucguuguguga

SEQ ID NO: 366078 - RNA, 64 nt, Human
ucucucucugagaacacggugugucucgacacguaccacguacguggaaacacaagagcccacc

SEQ ID NO: 366079 - RNA, 64 nt, Human
cccaggagugagggaguggcaagcaccacagauuaccacguauguguggaagacauucguacuc

SEQ ID NO: 366080 - RNA, 64 nt, Human
ugcgcccccugugccuaccucuagcauuguaacgaccacguaguauugaaauggccaguuuacu

SEQ ID NO: 366081 - RNA, 53 nt, Human
ggcaucucuauccccuaugaggcaccacguaagaccuccugcccuuagcucuc

SEQ ID NO: 366082 - RNA, 64 nt, Human
uaaccugaagaucuauaccaaacgucgucugcuuaccacguaacacagcugcaucuugagcagu

SEQ ID NO: 366083 - RNA, 64 nt, Human
gacaacccacauucuuauccuggcucuagcaguaaccacguagccuuggauaagccauuuuccu

SEQ ID NO: 366084 - RNA, 64 nt, Human
uuaagacaccccugauggaaugaaagccaacugaaccacguaaagcucgaaccacguggcaagu

SEQ ID NO: 366085 - RNA, 64 nt, Human
cagaauuuagaauauuuagagcuaagcuucuggaaccacguaguuucuacacguggcaggccaa

SEQ ID NO: 366086 - RNA, 64 nt, Human
acucucccaaggaaaauauugccaccauuuguagaccacguaaccuucaaguaugugcuacuuu

SEQ ID NO: 366087 - RNA, 64 nt, Human
aaaacagugaaacugugagucaauaugaauuuaaaccacguaguuaucuuuucacuucaggugg

SEQ ID NO: 366088 - RNA, 64 nt, Human
aauuucucaaagccagucuaccugacuaggucuauccacgcacgguucccaaccccaaggggga

SEQ ID NO: 366089 - RNA, 64 nt, Human
agagagacaaacucuaggaacaaugccgauucauuccacgcagcaguauugggggugguucggg

SEQ ID NO: 366090 - RNA, 64 nt, Human
uuuccauugccgucagcaugacagaccuccagcauccacgcaucucuuggucccaauaacugcc

SEQ ID NO: 366091 - RNA, 64 nt, Human
gaaucaguagcagagcaaagccucuuugaaaaaaaccacguagcugauuggguuuuacaagagu

SEQ ID NO: 366092 - RNA, 64 nt, Human
aaaauguuguccugcaaaaggagguaaguuucucaccacguagcgcugaucaucccguguugcc

SEQ ID NO: 366093 - RNA, 64 nt, Human
uguguguguuuaugugcacgcauguauaugcaucaccacguagccaggaggggccuguuggggu

SEQ ID NO: 366094 - RNA, 64 nt, Human
auggacugccucucuugagcacuucccuggagcuaccacguaucuagcuaauauguauguguca

SEQ ID NO: 366095 - RNA, 64 nt, Human
aaaaauguuuucaaaguuccauucuguuaaaguaaccacguagaaugcugagucuauucugcau

SEQ ID NO: 366096 - RNA, 64 nt, Human
cacaucccaagauguaaaacggcaguaauuuaugaccacguauggaagaaauucuucaaauagc

SEQ ID NO: 366097 - RNA, 64 nt, Human
ccuguccucugaaggauuguauauauaccucucgaccacguaggaaccauguaggggucucuag

SEQ ID NO: 366098 - RNA, 64 nt, Human
cccucccugagugguccccaccuuucuggacggaaccacguacuuuuuacauacauugauucau

SEQ ID NO: 366099 - RNA, 64 nt, Human
aggucaggauccucugagagaaaaucaacauugcaccacguaggggugggcuaugggcuguauu

SEQ ID NO: 366100 - RNA, 64 nt, Human
uacaaaaaccaauuaucuuugacugcuguucucaaccacguagugcgccagucaucacugguag

SEQ ID NO: 366101 - RNA, 64 nt, Human
ggccagccaguacucagagaggaggaccuucucaaccacguacagaacacggguuuucauggcu

SEQ ID NO: 366102 - RNA, 64 nt, Human
aucacugagacacaguggauuuuuauugaaaggaaccacguacagcaaugcggagugggauagg

SEQ ID NO: 366103 - RNA, 64 nt, Human
ccacacacacacacacaccaggggaaccaagagaaccacguagaauccucaaccgugcggacca

SEQ ID NO: 366104 - RNA, 64 nt, Human
uccccuaucgcaucuuggacucggaaagccagacuccacgcaggaccagggaucucacgaggca

SEQ ID NO: 366105 - RNA, 64 nt, Human
gggcagcacgugagguagaacgagugugagcgucuccacgcaguggcuggccccguggccgggg

SEQ ID NO: 366106 - RNA, 64 nt, Human
cagauguuuugggggaacgccgggacugagagacuccacgcaggcgaauucccguuuggggcuu

SEQ ID NO: 366107 - RNA, 64 nt, Human
cccuucccugccuaguuuccuuuuguuccuugaguccacgcagaauuccauucucuggucagca

SEQ ID NO: 366108 - RNA, 64 nt, Human
agcacacagauacccacagcauacacugacgaucuccacgcaguagacagguuuugucuucacu

SEQ ID NO: 366109 - RNA, 64 nt, Human
ucucgcacacacagugauucccuccucccgucacuccacgcagcuggcagagagcacagugauc

SEQ ID NO: 366110 - RNA, 64 nt, Human
agccuauucagcgcuuugcuaggggauugggugguccacgcacucgcuaauacaguucuccagg

SEQ ID NO: 366111 - RNA, 64 nt, Human
uucgcaccuccccuccucgugccugcccugccucuccacgcacaguguuaaggagccaagagga

SEQ ID NO: 366112 - RNA, 64 nt, Human
ugucguggagcuggggugcgugaucuggugcucguccacgcaggugugugguguaaacauguau

SEQ ID NO: 366113 - RNA, 64 nt, Human
auacugguugggggcaggaucauucugccccuuguccacgcacccccaccagcccucucgcuuc

SEQ ID NO: 366114 - RNA, 64 nt, Human
cggaggccaggucugucccggcuggagaacagcguccacgcaguccugccuggggucaggcccu

SEQ ID NO: 366115 - RNA, 64 nt, Human
gaauuuggagggagggagcaguaccuucccggaguccacgcaugugaguugggucaagugcauu

SEQ ID NO: 366116 - RNA, 64 nt, Human
ggucacgcugcugugggcccgaguguguugcauguccacgcaccacccguucagggcccugaau

SEQ ID NO: 366117 - RNA, 64 nt, Human
uaauaggaaguugacucccagcauguaaaagugauccacgcagccggaguguaugccgggagcu

SEQ ID NO: 366118 - RNA, 64 nt, Human
aucuaccuuuccauccuuuacuccaaguccccacuccacgcauccuuccucaccaacucagagc

SEQ ID NO: 366119 - RNA, 64 nt, Human
ccgccccacagggcaaggacacagcgcgguuuuuuccacgcagcacccuucucggagacccauu

SEQ ID NO: 366120 - RNA, 64 nt, Human
aagccuccuucccugccugcccaccccuccaugcuccacgcaggcacucacgcuaggacagcau

SEQ ID NO: 366121 - RNA, 64 nt, Human
acaucaaccuggcaaaaaugcaacaaaugaauuuuccacgcaguucuuuccaugggcauaggua

SEQ ID NO: 366122 - RNA, 64 nt, Human
gagagcgaacccacucccaagauaacggccugaguccacgcaggagggcagagcccucguggcc

SEQ ID NO: 366123 - RNA, 64 nt, Human
ccgaaaccaguuaagaauggaagaaaacggugcauccacgcacacauggacacagacccacaca

SEQ ID NO: 366124 - RNA, 64 nt, Human
ccauaagccaccauucuguggaaccaaggcccccuccacgcaaacacccucccuccuggggacc

SEQ ID NO: 366125 - RNA, 64 nt, Human
uggagaaguaacugagccugcgcuugagaccuucuccacgcagcaggaagaucccaccgacccu

SEQ ID NO: 366126 - RNA, 64 nt, Human
auccuggcgcagaaccuaccugaugcgguuccucuccacgcaucucgaggcggcguuaccucca

SEQ ID NO: 366127 - RNA, 64 nt, Human
gcagcccugcacuccacgcuggccaagaaggccuuccacgcagaaugacaagacugcaaaaauc

SEQ ID NO: 366128 - RNA, 64 nt, Human
ccacagguugacuuugaauguggaccucugagcauccacgcaggauggcucucaggucccaguc

SEQ ID NO: 366129 - RNA, 64 nt, Human
aggacagaggcccccaagcugaucugguggugcauccacgcacccccacccugggacuuuggau

SEQ ID NO: 366130 - RNA, 64 nt, Human
ggacaucucaugaagccauguucaggguaggagcuccacgcacaucaccacccauugucaggug

SEQ ID NO: 366131 - RNA, 64 nt, Human
gaauaagaacugaucuggcugccugaugaguguuuccacgcagcccugcauauuuagugaccaa

SEQ ID NO: 366132 - RNA, 64 nt, Human
gaaggcugccuucugacaugcgcuggggcuucucuccacgcauuuagacaaaaaaagcacagga

SEQ ID NO: 366133 - RNA, 64 nt, Human
ggaauaagauccugugauuuuucucaccugcuuuuccacgcacuguggucaucacugugcaauc

SEQ ID NO: 366134 - RNA, 64 nt, Human
cuuccugucucugaaguuuggaucauuuuauagauccacgcaauagagagcuuccuuccuauga

SEQ ID NO: 366135 - RNA, 64 nt, Human
ccccgccucuggcugcgcacucccgaccgcgacguccacgcagcagagggacaugggccauucc

SEQ ID NO: 366136 - RNA, 64 nt, Human
ugcccaucauuuucaggucugcagaaccauagcuuccacgcaccugaacgagcacagaaugaac

SEQ ID NO: 366137 - RNA, 64 nt, Human
cuugccuaacucauacuuucccguugacacuugauccacgcagcguggcacugggacguaagug

SEQ ID NO: 366138 - RNA, 64 nt, Human
ugucugcccccucuuuaaaaucgaucuacacacauccacgcacaugcgaccccgaggaaacgaa

SEQ ID NO: 366139 - RNA, 64 nt, Human
aacuccuggguucuuaagggagcgaggcuuuggguccacgcacaggaucgcgcgcgggaucgca

SEQ ID NO: 366140 - RNA, 64 nt, Human
ugguagcaggacccuucauccugaacugccuuccuccacgcaggacaagucuuagcuuuuuugg

SEQ ID NO: 366141 - RNA, 64 nt, Human
acagacacagauuuccugcugggggagggaggaguccacgcauccugaugcugccuggaagcuu

SEQ ID NO: 366142 - RNA, 64 nt, Human
ggggcuggggggcggggcuggaggggaaggaguguccacgcaucaauaaagauuuaacgaacug

SEQ ID NO: 366143 - RNA, 64 nt, Human
uuugccggguaaggggcuaccgcgacgccacuuguccacgcagccaccaccggcccgggccagu

SEQ ID NO: 366144 - RNA, 64 nt, Human
gagaaaccgucugccuggcucccugucuucauucuccacgcagccuggugauggcaggccuggg

SEQ ID NO: 366145 - RNA, 64 nt, Human
cagcacgggagccaggcgcuguggacagggucuguccacgcaccaccuggggucugccgccuau

SEQ ID NO: 366146 - RNA, 64 nt, Human
cacucccgccccucccccaucgugcugcaugaccuccacgcacgcacguccagggacagacugg

SEQ ID NO: 366147 - RNA, 64 nt, Human
gcuccucgcagccgccucucccgcuccggaucccuccacgcagcggccggagccagacuagccc

SEQ ID NO: 366148 - RNA, 64 nt, Human
gacuucaccaaagucacccucgcgggcugggccuuccacgcaucccccccaccccccauggaac

SEQ ID NO: 366149 - RNA, 64 nt, Human
caaccuuugguugcugcauuccccuugguucgauuccacgcaaggagccacaagugagaacucc

SEQ ID NO: 366150 - RNA, 64 nt, Human
gucaaccaauggcacccagagagggcauggaggcuccacgcaaccccuuccacccccacaucuu

SEQ ID NO: 366151 - RNA, 64 nt, Human
ccuuggcccaggaaugcgugaccccugagauggguccacgcaucucucuacacuuccuucucuc

SEQ ID NO: 366152 - RNA, 64 nt, Human
caccugguucacauguggcacugaccgcgucacauccacgcacucccaaaggccagaaguaucu

SEQ ID NO: 366153 - RNA, 64 nt, Human
gagggguugauggcauuccuuucccauucuaaacuccacgcagccaaucgcuuuccuggaggag

SEQ ID NO: 366154 - RNA, 64 nt, Human
gagcucccagcacacucggagcuugugcuuugucuccacgcaaagcgauaaauaaaagcauugg

SEQ ID NO: 366155 - RNA, 64 nt, Human
gaaggcagcaagccgggccguccguguuccauccuccacgcacccccaccuaucguugguucgc

SEQ ID NO: 366156 - RNA, 64 nt, Human
agagccaagcccaguucucuggguugugcuuuacuccacgcaucaauaaauaauuuugaaggcc

SEQ ID NO: 366157 - RNA, 64 nt, Human
acacuccucucuuuuccuguagcguguggaccgguccacgcaauucuuuauccugugaacucau

SEQ ID NO: 366158 - RNA, 64 nt, Human
cccugucacuuuggacccuaugggagugggcaucuccacgcaccuguguaugugaaagucauuu

SEQ ID NO: 366159 - RNA, 64 nt, Human
cugaccuggggccccagcauccuggagcacacgcuccacgcacacacaccccagcccuguccca

SEQ ID NO: 366160 - RNA, 64 nt, Human
cuaucugugcacuuaccguagguagggacacguguccacgcaccacagacacacccacgacacc

SEQ ID NO: 366161 - RNA, 64 nt, Human
ggggcuggaugguaggaagggaugugcccgccucuccacgcacucagcuauaccucauucacag

SEQ ID NO: 366162 - RNA, 64 nt, Human
gcccaccuccuccaugccucggcgcucgaucuccuccacgcacuggcgcacgauguagggcacc

SEQ ID NO: 366163 - RNA, 64 nt, Human
gugccucagugugcccuguugaaacuuagguuuuuccacgcaaucgauggauuguguccuagga

SEQ ID NO: 366164 - RNA, 64 nt, Human
uuucccauagcuggugaaggacaccuccauccauuccacgcaguugcucaaagcagaaauuuuc

SEQ ID NO: 366165 - RNA, 64 nt, Human
ucuauugcaauaauguuagggacauuauaugauuuccacgcaggucacaccaucugggccugag

SEQ ID NO: 366166 - RNA, 64 nt, Human
ucauuuucuuuuaggauauuuagaccacccuuguuccacgcaaaccagagugugucaguguuug

SEQ ID NO: 366167 - RNA, 64 nt, Human
aggccaggccucugccuccucuucaucugcuucuuccacgcaccaccaccaccaccaccaccau

SEQ ID NO: 366168 - RNA, 64 nt, Human
gcaagaggccugaggagggaggcucccgggaccguccacgcacgacccagccagacccucgcgg

SEQ ID NO: 366169 - RNA, 64 nt, Human
aaacaaaaauggaacauuuauucgcaacucaaauacuacgcauauacgguaagagauuaaauau

SEQ ID NO: 366170 - RNA, 64 nt, Human
gaaggggggaauauuguaacacaaauuuaaacccacuacgcagggaugaggugcuauaauauga

SEQ ID NO: 366171 - RNA, 64 nt, Human
cugcugaguuugugaagacaguggaguucacaagacuacgcauucaagaggaaaggacuuuggc

SEQ ID NO: 366172 - RNA, 64 nt, Human
acuauaaacaggcccaauuaaaaacuguuccauuacuacgcaaacacauauuagaggccuuugc

SEQ ID NO: 366173 - RNA, 64 nt, Human
auuuaaaaagagcuagugugauaauccuaacucuacuacgcauuauauauuuaaauccauugcu

SEQ ID NO: 366174 - RNA, 64 nt, Human
cacugcaugcggcaaaccgcaugcucuuacccacacuacgcagaagagaaaguacaaccacuau

SEQ ID NO: 366175 - RNA, 64 nt, Human
ucucaagcagcauucuagagcuuggaauuuaagaacuacgcauugccuauaaagugaaacauag

SEQ ID NO: 366176 - RNA, 64 nt, Human
uugauauacaucauaaaauagucuuuugcaggguacuacgcaagccuuaaaauuuuucuuaaga

SEQ ID NO: 366177 - RNA, 64 nt, Human
aagaaaaaaaaaaagccuacaaacucagugaccuacuacgcagagggaauuuuucccugcugcu

SEQ ID NO: 366178 - RNA, 64 nt, Human
cgcguguugucucaaaccagucagggccgucaugacuacgcagcagcagcaguuuccaagacgg

SEQ ID NO: 366179 - RNA, 64 nt, Human
augcacccacaccaugugcccgugcacaccagugacuacgcaguccccccuuucugguuuagcu

SEQ ID NO: 366180 - RNA, 64 nt, Human
ucccucucuccacacggagcuccuggcagcgagaacuacgcacagcugccgcguugagcguacg

SEQ ID NO: 366181 - RNA, 64 nt, Human
cgagucauaccccaugaucaaaguuucaucgaaaacuacgcagggaucuuccacuuccagguga

SEQ ID NO: 366182 - RNA, 64 nt, Human
uuuuauuccuucuuuuuuccuccuuucauuucccacuacgcacaaagaguuuauaaacacuguu

SEQ ID NO: 366183 - RNA, 64 nt, Human
ugcuuuugaaugcuggugguucuauuccuuugacacuacgcacuuuuauaauacauguuaaugc

SEQ ID NO: 366184 - RNA, 64 nt, Human
ggggccugggcaugcgcaggaggagccaucggguacuacgcagcaacacucacaacuguccagg

SEQ ID NO: 366185 - RNA, 64 nt, Human
gccucccaaguagcugggaccacaggcaugcaccacuacgcaugacuaauuuuuuaaauauuug

SEQ ID NO: 366186 - RNA, 64 nt, Human
gccuacauucuuuucuaugagcagcaggggauagacuacgcacaauuucugccaaagauugaug

SEQ ID NO: 366187 - RNA, 64 nt, Human
guuuauuucauguggugaauaugcaaggcgguacacuacgcacuggacagcaucagaaauccuc

SEQ ID NO: 366188 - RNA, 64 nt, Human
aggugaugguuacaugaacagcccagacuucaccacuacgcaauauauccauguaacaaaaccg

SEQ ID NO: 366189 - RNA, 64 nt, Human
cagaggccugugacugcguuccagcggccaguucacuacgcaguaucucuggggccugggacca

SEQ ID NO: 366190 - RNA, 64 nt, Human
ccucacguucucuuggggacacccgagccaggacacuacgcaucccugcugagugugcagaggc

SEQ ID NO: 366191 - RNA, 64 nt, Human
acacauugaccaagcuccugaaagauguaaguuuacuacgcauagacuuuuaaacuucaaccaa

SEQ ID NO: 366192 - RNA, 64 nt, Human; identical to SEQ ID NO: 10635

SEQ ID NO: 366193 - RNA, 54 nt, Human; identical to SEQ ID NO: 10636

SEQ ID NO: 366194 - RNA, 64 nt, Human; identical to SEQ ID NO: 10637

SEQ ID NO: 366195 - RNA, 64 nt, Human; identical to SEQ ID NO: 10638

SEQ ID NO: 366196 - RNA, 63 nt, Human; identical to SEQ ID NO: 10639

SEQ ID NO: 366197 - RNA, 64 nt, Human; identical to SEQ ID NO: 10640

SEQ ID NO: 366198 - RNA, 64 nt, Human; identical to SEQ ID NO: 10641

SEQ ID NO: 366199 - RNA, 64 nt, Human; identical to SEQ ID NO: 10642

SEQ ID NO: 366200 - RNA, 64 nt, Human; identical to SEQ ID NO: 10643

SEQ ID NO: 366201 - RNA, 64 nt, Human; identical to SEQ ID NO: 10644

SEQ ID NO: 366202 - RNA, 62 nt, Human; identical to SEQ ID NO: 10645

SEQ ID NO: 366203 - RNA, 64 nt, Human; identical to SEQ ID NO: 10646

SEQ ID NO: 366204 - RNA, 64 nt, Human; identical to SEQ ID NO: 10647

SEQ ID NO: 366205 - RNA, 64 nt, Human; identical to SEQ ID NO: 10648

SEQ ID NO: 366206 - RNA, 64 nt, Human; identical to SEQ ID NO: 10649

SEQ ID NO: 366207 - RNA, 64 nt, Human; identical to SEQ ID NO: 10650

SEQ ID NO: 366208 - RNA, 64 nt, Human; identical to SEQ ID NO: 10651

SEQ ID NO: 366209 - RNA, 64 nt, Human; identical to SEQ ID NO: 10652

SEQ ID NO: 366210 - RNA, 64 nt, Human; identical to SEQ ID NO: 10653

SEQ ID NO: 366211 - RNA, 64 nt, Human; identical to SEQ ID NO: 10654

SEQ ID NO: 366212 - RNA, 64 nt, Human; identical to SEQ ID NO: 10655

SEQ ID NO: 366213 - RNA, 64 nt, Human; identical to SEQ ID NO: 10656

SEQ ID NO: 366214 - RNA, 64 nt, Human; identical to SEQ ID NO: 10657

SEQ ID NO: 366215 - RNA, 64 nt, Human; identical to SEQ ID NO: 10658

SEQ ID NO: 366216 - RNA, 64 nt, Human; identical to SEQ ID NO: 10659

SEQ ID NO: 366217 - RNA, 64 nt, Human; identical to SEQ ID NO: 10660

SEQ ID NO: 366218 - RNA, 64 nt, Human; identical to SEQ ID NO: 10661

SEQ ID NO: 366219 - RNA, 64 nt, Human; identical to SEQ ID NO: 10662

SEQ ID NO: 366220 - RNA, 64 nt, Human; identical to SEQ ID NO: 10663

SEQ ID NO: 366221 - RNA, 64 nt, Human; identical to SEQ ID NO: 10664

SEQ ID NO: 366222 - RNA, 64 nt, Human; identical to SEQ ID NO: 10665

SEQ ID NO: 366223 - RNA, 64 nt, Human; identical to SEQ ID NO: 10666

SEQ ID NO: 366224 - RNA, 64 nt, Human; identical to SEQ ID NO: 10667

SEQ ID NO: 366225 - RNA, 64 nt, Human; identical to SEQ ID NO: 10668

SEQ ID NO: 366226 - RNA, 64 nt, Human; identical to SEQ ID NO: 10669

SEQ ID NO: 366227 - RNA, 64 nt, Human; identical to SEQ ID NO: 10670

SEQ ID NO: 366228 - RNA, 63 nt, Human; identical to SEQ ID NO: 10671

SEQ ID NO: 366229 - RNA, 64 nt, Human; identical to SEQ ID NO: 10672

SEQ ID NO: 366230 - RNA, 64 nt, Human; identical to SEQ ID NO: 10673

SEQ ID NO: 366231 - RNA, 64 nt, Human; identical to SEQ ID NO: 10674

SEQ ID NO: 366232 - RNA, 64 nt, Human; identical to SEQ ID NO: 10675

SEQ ID NO: 366233 - RNA, 64 nt, Human; identical to SEQ ID NO: 10676

SEQ ID NO: 366234 - RNA, 64 nt, Human; identical to SEQ ID NO: 10677

SEQ ID NO: 366235 - RNA, 64 nt, Human; identical to SEQ ID NO: 10678

SEQ ID NO: 366236 - RNA, 64 nt, Human; identical to SEQ ID NO: 10679

SEQ ID NO: 366237 - RNA, 64 nt, Human; identical to SEQ ID NO: 10680

SEQ ID NO: 366238 - RNA, 64 nt, Human; identical to SEQ ID NO: 10681

SEQ ID NO: 366239 - RNA, 64 nt, Human; identical to SEQ ID NO: 10682

SEQ ID NO: 366240 - RNA, 64 nt, Human; identical to SEQ ID NO: 10683

SEQ ID NO: 366241 - RNA, 64 nt, Human; identical to SEQ ID NO: 10684

SEQ ID NO: 366242 - RNA, 64 nt, Human; identical to SEQ ID NO: 10685

SEQ ID NO: 366243 - RNA, 64 nt, Human; identical to SEQ ID NO: 10686

SEQ ID NO: 366244 - RNA, 64 nt, Human; identical to SEQ ID NO: 10687

SEQ ID NO: 366245 - RNA, 64 nt, Human; identical to SEQ ID NO: 10688

SEQ ID NO: 366246 - RNA, 64 nt, Human; identical to SEQ ID NO: 10689

SEQ ID NO: 366247 - RNA, 64 nt, Human; identical to SEQ ID NO: 10690

SEQ ID NO: 366248 - RNA, 64 nt, Human; identical to SEQ ID NO: 10691

SEQ ID NO: 366249 - RNA, 64 nt, Human; identical to SEQ ID NO: 10692

SEQ ID NO: 366250 - RNA, 64 nt, Human; identical to SEQ ID NO: 10693

SEQ ID NO: 366251 - RNA, 64 nt, Human; identical to SEQ ID NO: 10694

SEQ ID NO: 366252 - RNA, 64 nt, Human; identical to SEQ ID NO: 10695

SEQ ID NO: 366253 - RNA, 64 nt, Human; identical to SEQ ID NO: 10696

SEQ ID NO: 366254 - RNA, 64 nt, Human; identical to SEQ ID NO: 10697

SEQ ID NO: 366255 - RNA, 64 nt, Human; identical to SEQ ID NO: 10698

SEQ ID NO: 366256 - RNA, 64 nt, Human; identical to SEQ ID NO: 10699

SEQ ID NO: 366257 - RNA, 64 nt, Human; identical to SEQ ID NO: 10700

SEQ ID NO: 366258 - RNA, 64 nt, Human; identical to SEQ ID NO: 10701

SEQ ID NO: 366259 - RNA, 64 nt, Human; identical to SEQ ID NO: 10702

SEQ ID NO: 366260 - RNA, 64 nt, Human; identical to SEQ ID NO: 10703

SEQ ID NO: 366261 - RNA, 64 nt, Human; identical to SEQ ID NO: 10704

SEQ ID NO: 366262 - RNA, 64 nt, Human; identical to SEQ ID NO: 10705

SEQ ID NO: 366263 - RNA, 64 nt, Human; identical to SEQ ID NO: 10706

SEQ ID NO: 366264 - RNA, 64 nt, Human; identical to SEQ ID NO: 10707

SEQ ID NO: 366265 - RNA, 64 nt, Human; identical to SEQ ID NO: 10708

SEQ ID NO: 366266 - RNA, 64 nt, Human; identical to SEQ ID NO: 10709

SEQ ID NO: 366267 - RNA, 53 nt, Human; identical to SEQ ID NO: 10710

SEQ ID NO: 366268 - RNA, 64 nt, Human; identical to SEQ ID NO: 10711

SEQ ID NO: 366269 - RNA, 64 nt, Human; identical to SEQ ID NO: 10712

SEQ ID NO: 366270 - RNA, 64 nt, Human; identical to SEQ ID NO: 10713

SEQ ID NO: 366271 - RNA, 64 nt, Human; identical to SEQ ID NO: 10714

SEQ ID NO: 366272 - RNA, 64 nt, Human; identical to SEQ ID NO: 10715

SEQ ID NO: 366273 - RNA, 64 nt, Human; identical to SEQ ID NO: 10716

SEQ ID NO: 366274 - RNA, 64 nt, Human
ggcguggcagccucacagggaacacgggacagacgccggcgacgcgcagacacacggacacgcg

SEQ ID NO: 366275 - RNA, 64 nt, Human
gcuggacauuuguggcagugcugaagggggcauugccggcgaguaaaguauuauguuucuucuu

SEQ ID NO: 366276 - RNA, 64 nt, Human
uccgggcccagccucgcagcggccaggagcgcgggccggcgaugcggcugccggcgcccccccg

SEQ ID NO: 366277 - RNA, 64 nt, Human
agacaccauccaaggaugggcagccugcaguguggccggcgacugccauccagagaaaaggcac

SEQ ID NO: 366278 - RNA, 64 nt, Human
agggggucccccagcaggugcggccccugcaccugccggcgacacuccugccgguaguuuaggg

SEQ ID NO: 366279 - RNA, 64 nt, Human
gcucgcuggcccugcacuccgccuuaguccuggggccggcgacacagugggggcuccucacuug

SEQ ID NO: 366280 - RNA, 64 nt, Human
ugacuugccgacggucggcagguaauggcucucagccggcgaggcggucccacagcucuccucc

SEQ ID NO: 366281 - RNA, 64 nt, Human
cuccugagaacugugcugguggagagguccuagagccggcgagcguuugagaagagggcauggc

SEQ ID NO: 366282 - RNA, 64 nt, Human
gucccuugagggagcguggagcugcggugcccuggccggcgauggggaggagccggcuccggca

SEQ ID NO: 366283 - RNA, 64 nt, Human; identical to SEQ ID NO: 354048

SEQ ID NO: 366284 - RNA, 64 nt, Human; identical to SEQ ID NO: 354049

SEQ ID NO: 366285 - RNA, 64 nt, Human; identical to SEQ ID NO: 354050

SEQ ID NO: 366286 - RNA, 64 nt, Human
cagccuguggcugcccugcuguggggguccuggggccggcgaggccccuucagucuuguucugg

SEQ ID NO: 366287 - RNA, 64 nt, Human
aguauuucucugaagugccugaagguaggaaugggccggcgauugggaccagcugggccccacc

SEQ ID NO: 366288 - RNA, 64 nt, Human
gucaaaugugaccggaugcgcucccagaagcuccgccggcgaccagacuccugccacgccuucc

SEQ ID NO: 366289 - RNA, 64 nt, Human
ugaggacuacacuagugaaagcgccuggcgggcagccggcgaugcccaauaaauguguguuuug

SEQ ID NO: 366290 - RNA, 64 nt, Human
cacgacagggcagaaggaguuucuccggagaugagccggcgaggccaggugcggggcgcgcugc

SEQ ID NO: 366291 - RNA, 64 nt, Human
gugguccacaucccgggacgcagcaggaggccaggccggcgagcccuguggaugagcccucaga

SEQ ID NO: 366292 - RNA, 64 nt, Human
ugacucugggccccgaggguccgcugggcccgccgccggcgagauggacaccugagaugcugug

SEQ ID NO: 366293 - RNA, 64 nt, Human
ucugccuuucugggaugggagagaaggugagggagccggcgagcagguucuacccucucugcua

SEQ ID NO: 366294 - RNA, 64 nt, Human
ggaagggcgcaagucaaagagcacuggaggcaccgccggcgauggacguccaggucccggcucc

SEQ ID NO: 366295 - RNA, 64 nt, Human
gaagauggcuucacggaggucagaagagaaggaggccggcgagaucugaacccgucucccgggu

SEQ ID NO: 366296 - RNA, 64 nt, Human
aagcucacacugaugggcuggggcaggggccugggccggcgagggggccggggggaggggacag

SEQ ID NO: 366297 - RNA, 64 nt, Human
cucugcguaacagguuccuccuuugggcccagcggccggcgaggccgccagacauacacacguu

SEQ ID NO: 366298 - RNA, 64 nt, Human
cucacggccuacagcagcccacaagcugccacuggccggcgacacugacaccugagcagugucc

SEQ ID NO: 366299 - RNA, 64 nt, Human
gacccuccaccuggaggagguggugcaggaggccgccggcgaguggcaggcccucacccacguc

SEQ ID NO: 366300 - RNA, 64 nt, Human
uucauauuuuguagcgaaagucguuuuugucccagccggcgaucggagugggccuuuucuuucu

SEQ ID NO: 366301 - RNA, 64 nt, Human
gguuuagaagaugcuugggcuuggagggaggagggccggcgaggcuagcgaggggacaggagac

SEQ ID NO: 366302 - RNA, 64 nt, Human; identical to SEQ ID NO: 354051

SEQ ID NO: 366303 - RNA, 64 nt, Human; identical to SEQ ID NO: 354052

SEQ ID NO: 366304 - RNA, 64 nt, Human; identical to SEQ ID NO: 354053

SEQ ID NO: 366305 - RNA, 64 nt, Human
ucgggcccggccugcgccucgccuucucggcacggccggcgacuccccaacggcuacuacccgg

SEQ ID NO: 366306 - RNA, 64 nt, Human
ccuagcggccggggagggaggggccggguccgcggccggcgaacggggcucgaaggguccuugu

SEQ ID NO: 366307 - RNA, 64 nt, Human
gggaugcuagagggucaccugcaggaggccuggggccggcgagaaaucuccugugaugcccugu

SEQ ID NO: 366308 - RNA, 64 nt, Human
ggcaccaaggaacuguccggaacuaacagcaggggccggcgaugggagucaaacccaggcacgc

SEQ ID NO: 366309 - RNA, 64 nt, Human; identical to SEQ ID NO: 354054

SEQ ID NO: 366310 - RNA, 64 nt, Human; identical to SEQ ID NO: 354055

SEQ ID NO: 366311 - RNA, 64 nt, Human; identical to SEQ ID NO: 354056

SEQ ID NO: 366312 - RNA, 64 nt, Human; identical to SEQ ID NO: 354057

SEQ ID NO: 366313 - RNA, 64 nt, Human; identical to SEQ ID NO: 354058

SEQ ID NO: 366314 - RNA, 64 nt, Human; identical to SEQ ID NO: 354059

SEQ ID NO: 366315 - RNA, 64 nt, Human; identical to SEQ ID NO: 141728

SEQ ID NO: 366316 - RNA, 64 nt, Human; identical to SEQ ID NO: 141729

SEQ ID NO: 366317 - RNA, 64 nt, Human; identical to SEQ ID NO: 141730

SEQ ID NO: 366318 - RNA, 64 nt, Human; identical to SEQ ID NO: 116584

SEQ ID NO: 366319 - RNA, 64 nt, Human; identical to SEQ ID NO: 116590

SEQ ID NO: 366320 - RNA, 64 nt, Human; identical to SEQ ID NO: 116595

SEQ ID NO: 366321 - RNA, 64 nt, Human; identical to SEQ ID NO: 116598

SEQ ID NO: 366322 - RNA, 64 nt, Human; identical to SEQ ID NO: 141731

SEQ ID NO: 366323 - RNA, 55 nt, Human; identical to SEQ ID NO: 141732

SEQ ID NO: 366324 - RNA, 64 nt, Human; identical to SEQ ID NO: 141733

SEQ ID NO: 366325 - RNA, 64 nt, Human; identical to SEQ ID NO: 141734

SEQ ID NO: 366326 - RNA, 64 nt, Human; identical to SEQ ID NO: 141735

SEQ ID NO: 366327 - RNA, 64 nt, Human; identical to SEQ ID NO: 141736

SEQ ID NO: 366328 - RNA, 64 nt, Human; identical to SEQ ID NO: 141737

SEQ ID NO: 366329 - RNA, 64 nt, Human; identical to SEQ ID NO: 141738

SEQ ID NO: 366330 - RNA, 64 nt, Human; identical to SEQ ID NO: 141739

SEQ ID NO: 366331 - RNA, 64 nt, Human; identical to SEQ ID NO: 141740

SEQ ID NO: 366332 - RNA, 60 nt, Human; identical to SEQ ID NO: 141741

SEQ ID NO: 366333 - RNA, 64 nt, Human; identical to SEQ ID NO: 141742

SEQ ID NO: 366334 - RNA, 64 nt, Human; identical to SEQ ID NO: 141743

SEQ ID NO: 366335 - RNA, 64 nt, Human; identical to SEQ ID NO: 141744

SEQ ID NO: 366336 - RNA, 64 nt, Human; identical to SEQ ID NO: 141745

SEQ ID NO: 366337 - RNA, 62 nt, Human
uccuguguaugcugagguacagaagccccauguguaccuacagagcagccagguggagguua

SEQ ID NO: 366338 - RNA, 62 nt, Human
ugucagagcuaauucauguucagggugagcguuguaccuaccaacaaauuuccugguugggu

SEQ ID NO: 366339 - RNA, 62 nt, Human
aaacaguacucaaugagacuggaaauaccuuuuguaccuaaauguuuuuuaaauuaaucaaa

SEQ ID NO: 366340 - RNA, 64 nt, Human; identical to SEQ ID NO: 141746

SEQ ID NO: 366341 - RNA, 64 nt, Human; identical to SEQ ID NO: 141747

SEQ ID NO: 366342 - RNA, 64 nt, Human; identical to SEQ ID NO: 141748

SEQ ID NO: 366343 - RNA, 64 nt, Human; identical to SEQ ID NO: 141749

SEQ ID NO: 366344 - RNA, 64 nt, Human; identical to SEQ ID NO: 141750

SEQ ID NO: 366345 - RNA, 64 nt, Human; identical to SEQ ID NO: 141751

SEQ ID NO: 366346 - RNA, 64 nt, Human; identical to SEQ ID NO: 141752

SEQ ID NO: 366347 - RNA, 64 nt, Human; identical to SEQ ID NO: 141753

SEQ ID NO: 366348 - RNA, 64 nt, Human; identical to SEQ ID NO: 141754

SEQ ID NO: 366349 - RNA, 64 nt, Human; identical to SEQ ID NO: 141755

SEQ ID NO: 366350 - RNA, 64 nt, Human; identical to SEQ ID NO: 141756

SEQ ID NO: 366351 - RNA, 64 nt, Human; identical to SEQ ID NO: 141757

SEQ ID NO: 366352 - RNA, 64 nt, Human; identical to SEQ ID NO: 141758

SEQ ID NO: 366353 - RNA, 64 nt, Human; identical to SEQ ID NO: 141759

SEQ ID NO: 366354 - RNA, 64 nt, Human; identical to SEQ ID NO: 141760

SEQ ID NO: 366355 - RNA, 62 nt, Human
uaaaauaguuuugcuuuguugaauaauacguguguaccuaaaagagguaagagcaaaaagug

SEQ ID NO: 366356 - RNA, 62 nt, Human
ugaacugaaacaauucucaagaaugcaucagcuguaccuacaauagccccucccucuuccuu

SEQ ID NO: 366357 - RNA, 62 nt, Human
ccacaccauaguaugcauuguuauacauacuguguaccuaauuauguauagcaguguagucu

SEQ ID NO: 366358 - RNA, 64 nt, Human; identical to SEQ ID NO: 141761

SEQ ID NO: 366359 - RNA, 64 nt, Human; identical to SEQ ID NO: 141762

SEQ ID NO: 366360 - RNA, 64 nt, Human; identical to SEQ ID NO: 141763

SEQ ID NO: 366361 - RNA, 64 nt, Human; identical to SEQ ID NO: 141764

SEQ ID NO: 366362 - RNA, 64 nt, Human; identical to SEQ ID NO: 141765

SEQ ID NO: 366363 - RNA, 64 nt, Human; identical to SEQ ID NO: 141766

SEQ ID NO: 366364 - RNA, 64 nt, Human; identical to SEQ ID NO: 141767

SEQ ID NO: 366365 - RNA, 64 nt, Human; identical to SEQ ID NO: 141768

SEQ ID NO: 366366 - RNA, 64 nt, Human; identical to SEQ ID NO: 141769

SEQ ID NO: 366367 - RNA, 64 nt, Human; identical to SEQ ID NO: 141770

SEQ ID NO: 366368 - RNA, 64 nt, Human; identical to SEQ ID NO: 141771

SEQ ID NO: 366369 - RNA, 52 nt, Human; identical to SEQ ID NO: 141772

SEQ ID NO: 366370 - RNA, 64 nt, Human; identical to SEQ ID NO: 141773

SEQ ID NO: 366371 - RNA, 64 nt, Human; identical to SEQ ID NO: 141774

SEQ ID NO: 366372 - RNA, 64 nt, Human; identical to SEQ ID NO: 141775

SEQ ID NO: 366373 - RNA, 62 nt, Human
accgcucccgucuccaagccuucaugcacauauguaccuaaugaguuuuuauagcaaagaau

SEQ ID NO: 366374 - RNA, 62 nt, Human
aauaaaaagguauuaaauguguauuucugccauguaccuaaugauuauucagugcguauaua

SEQ ID NO: 366375 - RNA, 62 nt, Human
uuuaucuaaucuauuuuuguguuuaaaaaagcuguaccuaccaaauaaauaaauaguuuaua

SEQ ID NO: 366376 - RNA, 64 nt, Human; identical to SEQ ID NO: 141776

SEQ ID NO: 366377 - RNA, 64 nt, Human; identical to SEQ ID NO: 141777

SEQ ID NO: 366378 - RNA, 64 nt, Human; identical to SEQ ID NO: 141778

SEQ ID NO: 366379 - RNA, 64 nt, Human; identical to SEQ ID NO: 141779

SEQ ID NO: 366380 - RNA, 64 nt, Human; identical to SEQ ID NO: 141780

SEQ ID NO: 366381 - RNA, 64 nt, Human; identical to SEQ ID NO: 141781

SEQ ID NO: 366382 - RNA, 64 nt, Human; identical to SEQ ID NO: 141782

SEQ ID NO: 366383 - RNA, 64 nt, Human; identical to SEQ ID NO: 141783

SEQ ID NO: 366384 - RNA, 64 nt, Human; identical to SEQ ID NO: 141784

SEQ ID NO: 366385 - RNA, 64 nt, Human; identical to SEQ ID NO: 141785

SEQ ID NO: 366386 - RNA, 54 nt, Human; identical to SEQ ID NO: 141786

SEQ ID NO: 366387 - RNA, 64 nt, Human; identical to SEQ ID NO: 141787

SEQ ID NO: 366388 - RNA, 64 nt, Human; identical to SEQ ID NO: 141788

SEQ ID NO: 366389 - RNA, 64 nt, Human; identical to SEQ ID NO: 141789

SEQ ID NO: 366390 - RNA, 64 nt, Human; identical to SEQ ID NO: 141790

SEQ ID NO: 366391 - RNA, 62 nt, Human
ucccuagcauuuuggauaagggauacucagcuuguaccuauauauucauauauauucacugu

SEQ ID NO: 366392 - RNA, 62 nt, Human
gccuguuggaggcaaauagaucagauuuuuuuuguaccuacguaagaguacuugaaguuuua

SEQ ID NO: 366393 - RNA, 62 nt, Human
augaaauuacuuuaaauaugaauuguacuaacuguaccuaaauagcaaagcccuguguagau

SEQ ID NO: 366394 - RNA, 64 nt, Human; identical to SEQ ID NO: 141791

SEQ ID NO: 366395 - RNA, 62 nt, Human; identical to SEQ ID NO: 141792

SEQ ID NO: 366396 - RNA, 64 nt, Human; identical to SEQ ID NO: 141793

SEQ ID NO: 366397 - RNA, 64 nt, Human; identical to SEQ ID NO: 141794

SEQ ID NO: 366398 - RNA, 64 nt, Human; identical to SEQ ID NO: 141795

SEQ ID NO: 366399 - RNA, 64 nt, Human; identical to SEQ ID NO: 141796

SEQ ID NO: 366400 - RNA, 64 nt, Human; identical to SEQ ID NO: 141797

SEQ ID NO: 366401 - RNA, 64 nt, Human; identical to SEQ ID NO: 141798

SEQ ID NO: 366402 - RNA, 64 nt, Human; identical to SEQ ID NO: 141799

SEQ ID NO: 366403 - RNA, 64 nt, Human; identical to SEQ ID NO: 141800

SEQ ID NO: 366404 - RNA, 52 nt, Human; identical to SEQ ID NO: 141801

SEQ ID NO: 366405 - RNA, 64 nt, Human; identical to SEQ ID NO: 141802

SEQ ID NO: 366406 - RNA, 59 nt, Human; identical to SEQ ID NO: 141803

SEQ ID NO: 366407 - RNA, 64 nt, Human; identical to SEQ ID NO: 141804

SEQ ID NO: 366408 - RNA, 64 nt, Human; identical to SEQ ID NO: 141805

SEQ ID NO: 366409 - RNA, 62 nt, Human
aauuuggcuaggacuucaauuuuaaaaaucaguguaccuaggcagugcacagcacgaaauaa

SEQ ID NO: 366410 - RNA, 62 nt, Human
agcucugcugacccuuggccgaaacucuaaaauguaccuauuaaagauaaaugcuucuacca

SEQ ID NO: 366411 - RNA, 62 nt, Human
gcuuaguauacccucacccaaauaguauacauuguaccuaguaaauacuuucccaucucuca

SEQ ID NO: 366412 - RNA, 54 nt, Human; identical to SEQ ID NO: 141806

SEQ ID NO: 366413 - RNA, 64 nt, Human; identical to SEQ ID NO: 141807

SEQ ID NO: 366414 - RNA, 64 nt, Human; identical to SEQ ID NO: 141808

SEQ ID NO: 366415 - RNA, 55 nt, Human; identical to SEQ ID NO: 141809

SEQ ID NO: 366416 - RNA, 64 nt, Human; identical to SEQ ID NO: 141810

SEQ ID NO: 366417 - RNA, 64 nt, Human; identical to SEQ ID NO: 141811

SEQ ID NO: 366418 - RNA, 64 nt, Human; identical to SEQ ID NO: 141812

SEQ ID NO: 366419 - RNA, 64 nt, Human; identical to SEQ ID NO: 141813

SEQ ID NO: 366420 - RNA, 64 nt, Human; identical to SEQ ID NO: 141814

SEQ ID NO: 366421 - RNA, 61 nt, Human; identical to SEQ ID NO: 141815

SEQ ID NO: 366422 - RNA, 64 nt, Human; identical to SEQ ID NO: 141816

SEQ ID NO: 366423 - RNA, 64 nt, Human; identical to SEQ ID NO: 141817

SEQ ID NO: 366424 - RNA, 64 nt, Human; identical to SEQ ID NO: 141818

SEQ ID NO: 366425 - RNA, 64 nt, Human; identical to SEQ ID NO: 141819

SEQ ID NO: 366426 - RNA, 64 nt, Human; identical to SEQ ID NO: 141820

SEQ ID NO: 366427 - RNA, 62 nt, Human
gauugcgcagacugaaacuagcuaaaccugaauguaccuacuagggcaccauaauacugcag

SEQ ID NO: 366428 - RNA, 62 nt, Human
gcuggcucccucccccucagacccucacuuccuguaccuagaggccauucuggaugcugcca

SEQ ID NO: 366429 - RNA, 62 nt, Human
gcguuuguauauagauuuggugacauuucccauguaccuauuaugaucuuucucccuugagu

SEQ ID NO: 366430 - RNA, 64 nt, Human; identical to SEQ ID NO: 141821

SEQ ID NO: 366431 - RNA, 64 nt, Human; identical to SEQ ID NO: 141822

SEQ ID NO: 366432 - RNA, 64 nt, Human; identical to SEQ ID NO: 141823

SEQ ID NO: 366433 - RNA, 64 nt, Human; identical to SEQ ID NO: 141824

SEQ ID NO: 366434 - RNA, 64 nt, Human; identical to SEQ ID NO: 141825

SEQ ID NO: 366435 - RNA, 64 nt, Human; identical to SEQ ID NO: 141826

SEQ ID NO: 366436 - RNA, 64 nt, Human; identical to SEQ ID NO: 141827

SEQ ID NO: 366437 - RNA, 64 nt, Human; identical to SEQ ID NO: 141828

SEQ ID NO: 366438 - RNA, 64 nt, Human; identical to SEQ ID NO: 141829

SEQ ID NO: 366439 - RNA, 64 nt, Human; identical to SEQ ID NO: 141830

SEQ ID NO: 366440 - RNA, 64 nt, Human; identical to SEQ ID NO: 141831

SEQ ID NO: 366441 - RNA, 64 nt, Human; identical to SEQ ID NO: 141832

SEQ ID NO: 366442 - RNA, 56 nt, Human; identical to SEQ ID NO: 141833

SEQ ID NO: 366443 - RNA, 64 nt, Human; identical to SEQ ID NO: 141834

SEQ ID NO: 366444 - RNA, 64 nt, Human; identical to SEQ ID NO: 141835

SEQ ID NO: 366445 - RNA, 62 nt, Human
agucauuuuucuauuugugguauauguauauauguaccuauauguauuugcauuugaaauuu

SEQ ID NO: 366446 - RNA, 62 nt, Human
gggaacaaguuaccuaccacauuucacuuuaguguaccuauuuacagaaagauuaaacugcc

SEQ ID NO: 366447 - RNA, 62 nt, Human
uaguaaaugguaguguguccuguguaaauuaguguaccuauuaaaaguugcaaaguggaauu

SEQ ID NO: 366448 - RNA, 64 nt, Human; identical to SEQ ID NO: 141850

SEQ ID NO: 366449 - RNA, 64 nt, Human
ccgacccccgagaggccaccuccaagccgcgggugcccccuagggcgacaggagccagcgggac

SEQ ID NO: 366450 - RNA, 64 nt, Human
gguucugcagcuggaccgaccucauucaucgccugcccccuacccaauucugagcacacgguac

SEQ ID NO: 366451 - RNA, 64 nt, Human
uucccccugguggggcugguggggagcuguaguugcccccuaccucucccaccucuugcucuuc

SEQ ID NO: 366452 - RNA, 64 nt, Human
aggaggagaaucuggccugagaucuuagagcccagcccccuaaggacagggaaccaggucccug

SEQ ID NO: 366453 - RNA, 64 nt, Human
uacugacagcuccucuuucuggagagccccaagggcccccuagccagccccgcacgugaguagg

SEQ ID NO: 366454 - RNA, 64 nt, Human
ugaacucccucuguccccagggccucccuucugggcccccuacagcccacccuaccccuccucc

SEQ ID NO: 366455 - RNA, 64 nt, Human
cccacauccuaagguggaucccacgcuucccugugcccccuacuggauccuggaccucuacguc

SEQ ID NO: 366456 - RNA, 60 nt, Human
ucgacuacgcguuggugugaggggcgcggcgcccccuagccggcccugcgccggggucuc

SEQ ID NO: 366457 - RNA, 64 nt, Human
cucugccucccaggucaaagcaauccugccucaggcccccuaguagcuggcauuacaggcacau

SEQ ID NO: 366458 - RNA, 64 nt, Human
ccccgcaccccccaugcuucuuuugcugccuuaagcccccuaugcccuggaggugagggcagcu

SEQ ID NO: 366459 - RNA, 64 nt, Human
guucaagaccagccugggcaacauagugagaccugcccccuaucucuacaaaaaauaaaaaauu

SEQ ID NO: 366460 - RNA, 64 nt, Human
ucuccgcccagcuccaguccugugauccgggcccgcccccuagcggccggggagggaggggccg

SEQ ID NO: 366461 - RNA, 64 nt, Human
aggggugcugccggggauuuggggucagcaucuggcccccuaucuccugaccagcugagucaug

SEQ ID NO: 366462 - RNA, 64 nt, Human
uccugguccccauacccagcaucuaaucauccaugcccccuacuccuggccccuccauccuuuc

SEQ ID NO: 366463 - RNA, 64 nt, Human
cuuuggucaugggaucugcucuuugucauucuuagcccccuacuguggcccccauagccccaua

SEQ ID NO: 366464 - RNA, 64 nt, Human; identical to SEQ ID NO: 116604

SEQ ID NO: 366465 - RNA, 64 nt, Human; identical to SEQ ID NO: 116610

SEQ ID NO: 366466 - RNA, 64 nt, Human; identical to SEQ ID NO: 116616

SEQ ID NO: 366467 - RNA, 64 nt, Human; identical to SEQ ID NO: 141851

SEQ ID NO: 366468 - RNA, 64 nt, Human; identical to SEQ ID NO: 141852

SEQ ID NO: 366469 - RNA, 64 nt, Human; identical to SEQ ID NO: 141853

SEQ ID NO: 366470 - RNA, 64 nt, Human; identical to SEQ ID NO: 141854

SEQ ID NO: 366471 - RNA, 64 nt, Human; identical to SEQ ID NO: 141855

SEQ ID NO: 366472 - RNA, 64 nt, Human; identical to SEQ ID NO: 141856

SEQ ID NO: 366473 - RNA, 64 nt, Human; identical to SEQ ID NO: 141857

SEQ ID NO: 366474 - RNA, 64 nt, Human; identical to SEQ ID NO: 141858

SEQ ID NO: 366475 - RNA, 64 nt, Human; identical to SEQ ID NO: 141859

SEQ ID NO: 366476 - RNA, 64 nt, Human; identical to SEQ ID NO: 141860

SEQ ID NO: 366477 - RNA, 64 nt, Human; identical to SEQ ID NO: 141861

SEQ ID NO: 366478 - RNA, 61 nt, Human; identical to SEQ ID NO: 141862

SEQ ID NO: 366479 - RNA, 64 nt, Human; identical to SEQ ID NO: 141863

SEQ ID NO: 366480 - RNA, 64 nt, Human; identical to SEQ ID NO: 141864

SEQ ID NO: 366481 - RNA, 64 nt, Human; identical to SEQ ID NO: 141865

SEQ ID NO: 366482 - RNA, 62 nt, Human
uggucauuggauauuucugauccuuauugcauuguaccuaaaggagaguaacuaaugguaac

SEQ ID NO: 366483 - RNA, 62 nt, Human
agccauguacuauaaugugaugauucuaaauuuguaccuaugugacagacauuuucaauaau

SEQ ID NO: 366484 - RNA, 62 nt, Human
caacaucccuuauaccacuguguauguucuuguguaccuacagcuaagcuuccacuuauaag

SEQ ID NO: 366485 - RNA, 64 nt, Human; identical to SEQ ID NO: 141866

SEQ ID NO: 366486 - RNA, 56 nt, Human; identical to SEQ ID NO: 141867

SEQ ID NO: 366487 - RNA, 64 nt, Human; identical to SEQ ID NO: 141868

SEQ ID NO: 366488 - RNA, 64 nt, Human; identical to SEQ ID NO: 141869

SEQ ID NO: 366489 - RNA, 64 nt, Human; identical to SEQ ID NO: 141870

SEQ ID NO: 366490 - RNA, 64 nt, Human; identical to SEQ ID NO: 141871

SEQ ID NO: 366491 - RNA, 64 nt, Human; identical to SEQ ID NO: 141872

SEQ ID NO: 366492 - RNA, 64 nt, Human; identical to SEQ ID NO: 141873

SEQ ID NO: 366493 - RNA, 64 nt, Human; identical to SEQ ID NO: 141874

SEQ ID NO: 366494 - RNA, 64 nt, Human; identical to SEQ ID NO: 141875

SEQ ID NO: 366495 - RNA, 64 nt, Human; identical to SEQ ID NO: 141876

SEQ ID NO: 366496 - RNA, 64 nt, Human; identical to SEQ ID NO: 141877

SEQ ID NO: 366497 - RNA, 64 nt, Human; identical to SEQ ID NO: 141878

SEQ ID NO: 366498 - RNA, 64 nt, Human; identical to SEQ ID NO: 141879

SEQ ID NO: 366499 - RNA, 64 nt, Human; identical to SEQ ID NO: 141880

SEQ ID NO: 366500 - RNA, 62 nt, Human
cugaaucauuaaugaugucucacaaauuacuguguaccuaaguggugugauguaaauacugg

SEQ ID NO: 366501 - RNA, 62 nt, Human
uagaguccagccuaaucaaaugucauaauuguuguaccuauugaaaguuuuuaaauaauaga

SEQ ID NO: 366502 - RNA, 62 nt, Human
ugugaccuuagauuuuagaaggacaguggggcuguaccuagaauagugguucucgaagaaug

SEQ ID NO: 366503 - RNA, 64 nt, Human; identical to SEQ ID NO: 141881

SEQ ID NO: 366504 - RNA, 64 nt, Human; identical to SEQ ID NO: 141882

SEQ ID NO: 366505 - RNA, 64 nt, Human; identical to SEQ ID NO: 141883

SEQ ID NO: 366506 - RNA, 64 nt, Human; identical to SEQ ID NO: 141884

SEQ ID NO: 366507 - RNA, 64 nt, Human; identical to SEQ ID NO: 141885

SEQ ID NO: 366508 - RNA, 64 nt, Human; identical to SEQ ID NO: 141886

SEQ ID NO: 366509 - RNA, 64 nt, Human; identical to SEQ ID NO: 141887

SEQ ID NO: 366510 - RNA, 64 nt, Human; identical to SEQ ID NO: 141888

SEQ ID NO: 366511 - RNA, 64 nt, Human; identical to SEQ ID NO: 141889

SEQ ID NO: 366512 - RNA, 64 nt, Human; identical to SEQ ID NO: 141890

SEQ ID NO: 366513 - RNA, 64 nt, Human; identical to SEQ ID NO: 141891

SEQ ID NO: 366514 - RNA, 62 nt, Human
ugaaugaaugaauggcuaagcaaaaugugauauguaccuaacgaaguauccuucagccugaa

SEQ ID NO: 366515 - RNA, 62 nt, Human
cuucuguggcaaaugccaguuuuguuuaauaauguaccuauuccuucagaaagaugauaccc

SEQ ID NO: 366516 - RNA, 62 nt, Human
uguuucauuguuuaaggaaaaaaaaaaaugccuguaccuacaaugugauugcuuuguauugu

SEQ ID NO: 366517 - RNA, 64 nt, Human
cagagacccgagggcugcuuugggggaggggggaacucgagaauguauggauuuaccugaaaac

SEQ ID NO: 366518 - RNA, 64 nt, Human
cugagcgugguggugugcaccuguaaucccagcuacucgagaggccaaggcaugagaaucgcuu

SEQ ID NO: 366519 - RNA, 64 nt, Human
gggugccacagggaaagcuguagaaggcaagaagacucgagaaucccccagaguuauuuuucuc

SEQ ID NO: 366520 - RNA, 64 nt, Human
cugggcgugguggugggugccuguaaucccagcuacucgagaggccaaggcaggagaauugcua

SEQ ID NO: 366521 - RNA, 64 nt, Human
guauuuccccuuaauuaggaugcauguugauuaaacucgagauacagcuuuuugcaguauggug

SEQ ID NO: 366522 - RNA, 64 nt, Human
ucucagaugaggagggagagaaggaggccgccagacucgagaggugggaggaacuccuugcaca

SEQ ID NO: 366523 - RNA, 64 nt, Human
aacccuucucuguuggucugccuucugcugaaagacucgagaaccaaccagggaagcuguccug

SEQ ID NO: 366524 - RNA, 64 nt, Human
uuggcugguuucgcgccugaguugggcucuagugacucgagacucaaugacugggacuuagacu

SEQ ID NO: 366525 - RNA, 64 nt, Human
cugggcaugacggccagagcccauggucccagcuacucgagaggcugagguaagagcaucccuu

SEQ ID NO: 366526 - RNA, 64 nt, Human
guauuuauuaccaaugcugcagguacauuaaugaacucgagauggcucuguaagccugacuggc

SEQ ID NO: 366527 - RNA, 64 nt, Human
uauaaauuuuaauaguuauaaauauaauacuauaacucgagaaaaggcauuucuagagaacaga

SEQ ID NO: 366528 - RNA, 64 nt, Human
uuucaccccuuaccccaaagagaaagaguuugaaacucgagaccauaaagauauucuuuagugg

SEQ ID NO: 366529 - RNA, 62 nt, Human
cucgugucuuucuuuaggauacagagaguaacuguaccuauuauuuguuucuucagacaagc

SEQ ID NO: 366530 - RNA, 62 nt, Human
aauaugugaaauaguguaaauaugaaagaacuuguaccuaucacuucaaccccugccuugua

SEQ ID NO: 366531 - RNA, 62 nt, Human
ugcauacauguaaguauauaaacauuuagaaguguaccuaucuaacaaacuauuaugaaaua

SEQ ID NO: 366532 - RNA, 64 nt, Human
agagagccggcccgccugaaucauucucgauuuaacucgagaccuuuucaacuuggcuuccuuu

SEQ ID NO: 366533 - RNA, 64 nt, Human
accaagacagaacucaagaaagccacuggggaaaacucgagaagaaagggaguauacuaguagg

SEQ ID NO: 366534 - RNA, 64 nt, Human
cugggugugguggcgcgugccuguagucccagcuacucgagaggcuaaggcaggaaaaucgcuu

SEQ ID NO: 366535 - RNA, 64 nt, Human
cccgguauguuggcauaugccuguaaucccagcuacucgagaggcugagacacgaaaauugcuu

SEQ ID NO: 366536 - RNA, 64 nt, Human
cucucgcagcccggggagcacgucgccucuugaaacucgagauuucuuaaaucccaauauaaaa

SEQ ID NO: 366537 - RNA, 64 nt, Human
agcaccauuuuauuugguuugucccacuaaaaugacucgagaaguguuuagacaaacuccccuu

SEQ ID NO: 366538 - RNA, 64 nt, Human
uuucccccacgucucccucuauacccccucgaagacucgagagggggaggggguaaggagcgca

SEQ ID NO: 366539 - RNA, 64 nt, Human
ccaggugugguagcaggcaccuguagucuuagcuacucgagaggccaaagaaggaggauggcuu

SEQ ID NO: 366540 - RNA, 64 nt, Human
cuguuggagcaagaggaacaugcuuguuuugaaaacucgagaugaugagggugguacaugcagu

SEQ ID NO: 366541 - RNA, 52 nt, Human
gauccugugcuuuacucugaagacucgagagaaguuugcugaggaaugccuu

SEQ ID NO: 366542 - RNA, 64 nt, Human
gugaugugugguccccauauguggcucagcaaagacucgagagaucaucccuuugucugcauug

SEQ ID NO: 366543 - RNA, 64 nt, Human
agcgccucccgccgccucgggccgccuccuccagacucgagagggcugagccccuccucuccuc

SEQ ID NO: 366544 - RNA, 64 nt, Human
cccagaugccugagccuuuguccaaagugaggucacucgagaauucauggacacggcccccagu

SEQ ID NO: 366545 - RNA, 64 nt, Human
gugucuggugcgucagccugcugcuucgugucucacucgagaguugcuucugguuucacacuuu

SEQ ID NO: 366546 - RNA, 64 nt, Human
ccaggcgugguggugggugccuguaauuccagccacucgagaggcugaggcaggagaauugcuu

SEQ ID NO: 366547 - RNA, 64 nt, Human
uuagguucaaaaccuaauucccccagauuaguauacucgagaauucaaagggacauuuaaggug

SEQ ID NO: 366548 - RNA, 62 nt, Human
guauuuggggcuuuccuaccccuuuagccuucuguaccuaguaccauauuccaguuuuaaag

SEQ ID NO: 366549 - RNA, 62 nt, Human
aaaccagcaucacaccaacucugacacauggauguaccuaucuuggugaugggugggggcca

SEQ ID NO: 366550 - RNA, 64 nt, Human; identical to SEQ ID NO: 116622

SEQ ID NO: 366551 - RNA, 64 nt, Human
acagaggucuggugguuuucccuacuauccucccacucgagaguucacuucugguugggagaca

SEQ ID NO: 366552 - RNA, 64 nt, Human
agggccuucucgugagguacugacaacaccagcaacucgagagcugggaaacucaaggaggagg

SEQ ID NO: 366553 - RNA, 64 nt, Human
uaaaucauauuguaguauucaauaguuaauaaaaacucgagaaauguguuguuucugaugugaa

SEQ ID NO: 366554 - RNA, 64 nt, Human
ccggguguaguggugggcaccuguaguccuagcuacucgagaggcugaggcaggagaauggcgu

SEQ ID NO: 366555 - RNA, 64 nt, Human
cgaucaaggcucuggcauucagagaacccuugcaacucgagaagcuguuuuuauuucguuuuug

SEQ ID NO: 366556 - RNA, 64 nt, Human
ugacucagaccaggucccacacugagcugcccacacucgagagccagauauuuuuguaguuuuu

SEQ ID NO: 366557 - RNA, 53 nt, Human
gaggcggcgaggacgacuaggggacucgagagaggcgggccccagacccaugu

SEQ ID NO: 366558 - RNA, 64 nt, Human
aucaugcaagcgcucuaauuccuauaaauacgaaacucgagaagauucaaucacuguauagaau

SEQ ID NO: 366559 - RNA, 64 nt, Human
ugaaaaugcagaugguucugaggaggaaacggacacucgagacgcagacuucaauggaaccaag

SEQ ID NO: 366560 - RNA, 64 nt, Human
ccgggcaugguggaaugugccuguaaucccaccuacucgagaggcugaggcagcagaauugcuu

SEQ ID NO: 366561 - RNA, 64 nt, Human
uauugccuugcauucuaaugcaguuuguucuguaacucgagagccaguagcauuggauugaugg

SEQ ID NO: 366562 - RNA, 64 nt, Human
ccgagcaugguggcacaugccuguagucccaccuacucgagaagcugagauagggucaccugag

SEQ ID NO: 366563 - RNA, 64 nt, Human
aagucuguuucugcugcaggugaccaaccacauaacucgagacagggacagcgggaggcucaaa

SEQ ID NO: 366564 - RNA, 64 nt, Human
gugugcauagaucugagaggagucgggagucgagacucgagauuccaucauagcguaggugugu

SEQ ID NO: 366565 - RNA, 64 nt, Human
agucuguucuagggaaggccucccagcaucugggacucgagagugggcagccccucuaccuccu

SEQ ID NO: 366566 - RNA, 64 nt, Human
gugaccccacccagccaccucucccuuuuauggaacucgagaggguggcccuacugugcacccc

SEQ ID NO: 366567 - RNA, 62 nt, Human
uaaauuauuucauauagggaagaguucugaucuguaccuaugguucuuauugaaaacaacau

SEQ ID NO: 366568 - RNA, 62 nt, Human
cuuuucuguucaucaccagucuguaaaauacauguaccuauagaaauagaacacugccucug

SEQ ID NO: 366569 - RNA, 62 nt, Human
ggauuguaaccaugugaugaaguuaucuauguuguaccuaacauugcaaauuaaucaauaaa

SEQ ID NO: 366570 - RNA, 64 nt, Human
cagaaccuggugaaacuucagagagcugucuagaacucgagaaucauggcaccacagacgugaa

SEQ ID NO: 366571 - RNA, 64 nt, Human
cagagcuggccgcgccaaauaaugucucugugagacucgagaacuuucauuuuuuuccaggcug

SEQ ID NO: 366572 - RNA, 64 nt, Human
gaaguacugccaauacugccaaccagagcagcucacucgagaucuuuguguccagaguuuuuug

SEQ ID NO: 366573 - RNA, 64 nt, Human
gcuuucagcccugugcucuggccccagaacggccacucgagaccccgggcuucauccacaucca

SEQ ID NO: 366574 - RNA, 64 nt, Human
gcucacuugccuucuacaacaugaaagaauucacacucgagagaaaccuuaugaagguaaacaa

SEQ ID NO: 366575 - RNA, 64 nt, Human
caggcccguggcgccggcucaugugucugcugcgacucgagauggccugaaacgccacucauuc

SEQ ID NO: 366576 - RNA, 64 nt, Human
cccucuucagagccugcacucgcuaaggaaggggacucgagaaugggggggcagcuugcugacc

SEQ ID NO: 366577 - RNA, 64 nt, Human
ucgggcguaguggugcaugccuguaaucccaguuacucgagaggcugaggcaggaaaaucgcuu

SEQ ID NO: 366578 - RNA, 64 nt, Human
uaaauccuggggguuucuuagaaagcaacuuagaacucgagauucaccuuucguuucccuuucc

SEQ ID NO: 366579 - RNA, 64 nt, Human
uguugccgcuggccagaccaccagguggcccauuacucgagaugaucaucacaaccagaugaug

SEQ ID NO: 366580 - RNA, 64 nt, Human
aaguugacccaguuugucuuuuagguuaaguaagacucgagaguaaaggcaaggaggggggcca

SEQ ID NO: 366581 - RNA, 64 nt, Human
acccgagcccagcuacauuccucagcugccaagcacucgagaccauccuggccccuccagaccc

SEQ ID NO: 366582 - RNA, 62 nt, Human
auuuauuaaacaacuaaaugcuacuuaacugauguaccuaaauaauaaucuauucaauuuau

SEQ ID NO: 366583 - RNA, 62 nt, Human
ccucaucuugaaaugaggauaauaauaccugcuguaccuaccucacagggcuguugugagga

SEQ ID NO: 366584 - RNA, 62 nt, Human
uggcuggagcuggaauagcagggaggacuggguguaccuaggcaguauuuucucuacuucuc

SEQ ID NO: 366585 - RNA, 62 nt, Human
cgggcaguacacaggaagaggagccaggcccuuguaccuaugggauuggacaggacugcagu

SEQ ID NO: 366586 - RNA, 62 nt, Human
gcuguaccagugaaaacgaggcuuugcaagcuuguaccuacuauauaacaugugcuugguug

SEQ ID NO: 366587 - RNA, 62 nt, Human
cuuuuuuauuaaaagaaaaauuuuaaaaaucuuguaccuagcacaguauuguuauagaauau

SEQ ID NO: 366588 - RNA, 62 nt, Human
guaaaagagaccaguagauuuucaaugggaaauguaccuagcaagcugguucuugcuuauau

SEQ ID NO: 366589 - RNA, 62 nt, Human
aaugauuuauaagaugcuaaaugaauuguuuuuguaccuaaccauuguaauccaaaagauaa

SEQ ID NO: 366590 - RNA, 62 nt, Human
uuauguagagaguuuauaugcacauaauaaccuguaccuauaaaucgugcaauaaccauaug

SEQ ID NO: 366591 - RNA, 62 nt, Human
ucuugaugugucaucuaauuaagggaaucccuuguaccuauggcugccugcaucuauucuuu

SEQ ID NO: 366592 - RNA, 62 nt, Human
gacuuccugaguugauuagaaagcuguaugaguguaccuacccuagucucagaagcauagac

SEQ ID NO: 366593 - RNA, 62 nt, Human
uagccuguauucacaauucugcgguaccuuauuguaccuaagggauucuaaagguguuguca

SEQ ID NO: 366594 - RNA, 62 nt, Human
ugcuacuagugacagggcugccaucgcucaccuguaccuauuuacacccagaacuuuccagc

SEQ ID NO: 366595 - RNA, 62 nt, Human
uccccaagagaaaaugcuucuuuugagcacacuguaccuaccaucugcauugagcagaaaga

SEQ ID NO: 366596 - RNA, 62 nt, Human
ucaagaccagccuggucaacaugucaaaacccuguaccuacaaaaaaauacaaaaguuaacc

SEQ ID NO: 366597 - RNA, 62 nt, Human
cuuaaacauccuuccccagcaccagcuauugguguaccuauaauuuaagaaauagucuaugu
